United States Patent 7,250,496 (BIOINFORMATICALLY DETECTABLE GROUP OF NOVEL REGULATORY GENES AND USES THEREOF) - sequence listing, part 25

SEQ ID NO: 1061008 - RNA, 21 nt, Human
aagagaaggaagaccuggcua

SEQ ID NO: 1061009 - RNA, 23 nt, Human
aagggaggcgguggcggcggcgg

SEQ ID NO: 1061010 - RNA, 21 nt, Human
aaguguugggauuacaggcgu

SEQ ID NO: 1061011 - RNA, 26 nt, Human
aaguguugggauuacaggcgugagcc

SEQ ID NO: 1061012 - RNA, 19 nt, Human
aaugacccggaagaaacaa

SEQ ID NO: 1061013 - RNA, 21 nt, Human
agaaagcaggauuaaagagaa

SEQ ID NO: 1061014 - RNA, 21 nt, Human
agaauucccccauuggcccuu

SEQ ID NO: 1061015 - RNA, 25 nt, Human
agcaaagaaagcaggauuaaagaga

SEQ ID NO: 1061016 - RNA, 19 nt, Human
agccucuccuugagcucag

SEQ ID NO: 1061017 - RNA, 25 nt, Human
agcgccucccacccugccgggcggc

SEQ ID NO: 1061018 - RNA, 19 nt, Human
aggcaaaaggaugagggga

SEQ ID NO: 1061019 - RNA, 21 nt, Human
aggcccgagagcaaccgacgg

SEQ ID NO: 1061020 - RNA, 19 nt, Human
aggcgguggcggcggcggc

SEQ ID NO: 1061021 - RNA, 23 nt, Human
aggcgugagccacugugcccggc

SEQ ID NO: 1061022 - RNA, 19 nt, Human
aggggaaagaaaaccaacg

SEQ ID NO: 1061023 - RNA, 24 nt, Human
aggugauccacccuccuuggccuc

SEQ ID NO: 1061024 - RNA, 20 nt, Human
agucaguggccaacuccugg

SEQ ID NO: 1061025 - RNA, 20 nt, Human
aucgcucugcccucccugcu

SEQ ID NO: 1061026 - RNA, 22 nt, Human
caaacccggagaacaaguccca

SEQ ID NO: 1061027 - RNA, 24 nt, Human
caaaguguugggauuacaggcgug

SEQ ID NO: 1061028 - RNA, 21 nt, Human
caaugacccggaagaaacaaa

SEQ ID NO: 1061029 - RNA, 21 nt, Human
cagccucgaccccuccggcuc

SEQ ID NO: 1061030 - RNA, 23 nt, Human
cagccucgaccccuccggcuccg

SEQ ID NO: 1061031 - RNA, 22 nt, Human
cagccucuuucucaaacccgga

SEQ ID NO: 1061032 - RNA, 24 nt, Human
cauguuggccaggcuggucucgaa

SEQ ID NO: 1061033 - RNA, 20 nt, Human
ccaaaguguugggauuacag

SEQ ID NO: 1061034 - RNA, 22 nt, Human
ccaaaguguugggauuacaggc

SEQ ID NO: 1061035 - RNA, 22 nt, Human
ccaaaguguugggauuacaggc

SEQ ID NO: 1061036 - RNA, 24 nt, Human
ccaaaguguugggauuacaggcgu

SEQ ID NO: 1061037 - RNA, 18 nt, Human
ccaacgaacuacucccag

SEQ ID NO: 1061038 - RNA, 22 nt, Human
ccacgcggcgcagccucgaccc

SEQ ID NO: 1061039 - RNA, 19 nt, Human
ccauguuggccaggcuggu

SEQ ID NO: 1061040 - RNA, 22 nt, Human
ccauguuggccaggcuggucuc

SEQ ID NO: 1061041 - RNA, 23 nt, Human
ccauguuggccaggcuggucucg

SEQ ID NO: 1061042 - RNA, 22 nt, Human
ccccgcccgcuaguaggcugga

SEQ ID NO: 1061043 - RNA, 22 nt, Human
ccccuccggcuccgcgcagccu

SEQ ID NO: 1061044 - RNA, 23 nt, Human
ccccuccguuccccuccagucuu

SEQ ID NO: 1061045 - RNA, 18 nt, Human
cccgcuaccggaacgagc

SEQ ID NO: 1061046 - RNA, 23 nt, Human
cccucccugcuguuaagccaagc

SEQ ID NO: 1061047 - RNA, 20 nt, Human
cccuccguuccccuccaguc

SEQ ID NO: 1061048 - RNA, 21 nt, Human
cccuccguuccccuccagucu

SEQ ID NO: 1061049 - RNA, 19 nt, Human
ccuccugcugagcgagcuc

SEQ ID NO: 1061050 - RNA, 19 nt, Human
ccucgaccccuccggcucc

SEQ ID NO: 1061051 - RNA, 20 nt, Human
ccugaccucaggugauccac

SEQ ID NO: 1061052 - RNA, 23 nt, Human
ccugaccucaggugauccacccu

SEQ ID NO: 1061053 - RNA, 24 nt, Human
ccugaccucaggugauccacccuc

SEQ ID NO: 1061054 - RNA, 21 nt, Human
ccugcugagcgagcucagccu

SEQ ID NO: 1061055 - RNA, 25 nt, Human
cgaaaucaaagccaccccucgccgg

SEQ ID NO: 1061056 - RNA, 20 nt, Human
cgaaaugagaauucccccau

SEQ ID NO: 1061057 - RNA, 21 nt, Human
cgagagcaaccgacgggcagc

SEQ ID NO: 1061058 - RNA, 21 nt, Human
cgcagccucgaccccuccggc

SEQ ID NO: 1061059 - RNA, 24 nt, Human
cgccauguuggccaggcuggucuc

SEQ ID NO: 1061060 - RNA, 27 nt, Human
cgccauguuggccaggcuggucucgaa

SEQ ID NO: 1061061 - RNA, 22 nt, Human
cgccccggcucugggucagccc

SEQ ID NO: 1061062 - RNA, 22 nt, Human
cgcucugcccucccugcuguua

SEQ ID NO: 1061063 - RNA, 20 nt, Human
cggccgcgcgggacgugagg

SEQ ID NO: 1061064 - RNA, 21 nt, Human
cuaccggaacgagccucgcgc

SEQ ID NO: 1061065 - RNA, 25 nt, Human
cuggagccggggucagcuuuggcac

SEQ ID NO: 1061066 - RNA, 22 nt, Human
cugggucagcccacgugacucc

SEQ ID NO: 1061067 - RNA, 21 nt, Human
cuuuccgccccggcucugggu

SEQ ID NO: 1061068 - RNA, 24 nt, Human
gaagaaacaaacgcagccuuuccg

SEQ ID NO: 1061069 - RNA, 25 nt, Human
gacccggaagaaacaaacgcagccu

SEQ ID NO: 1061070 - RNA, 24 nt, Human
gaccucaggugauccacccuccuu

SEQ ID NO: 1061071 - RNA, 24 nt, Human
gaggcgguggcggcggcggcugcg

SEQ ID NO: 1061072 - RNA, 18 nt, Human
gauuacaggcgugagcca

SEQ ID NO: 1061073 - RNA, 21 nt, Human
gauuacaggcgugagccacug

SEQ ID NO: 1061074 - RNA, 24 nt, Human
gauuacaggcgugagccacugugc

SEQ ID NO: 1061075 - RNA, 22 nt, Human
gccucugauugguggaagugag

SEQ ID NO: 1061076 - RNA, 20 nt, Human
gcgcagccucgaccccuccg

SEQ ID NO: 1061077 - RNA, 18 nt, Human
gcucaguggggauugugc

SEQ ID NO: 1061078 - RNA, 19 nt, Human
gcucugcccucccugcugu

SEQ ID NO: 1061079 - RNA, 23 nt, Human
gcuggucucgaacuccugaccuc

SEQ ID NO: 1061080 - RNA, 18 nt, Human
gcuuuggcaccuuccucc

SEQ ID NO: 1061081 - RNA, 20 nt, Human
ggaagaaacaaacgcagccu

SEQ ID NO: 1061082 - RNA, 19 nt, Human
ggaggagcaaagaaagcag

SEQ ID NO: 1061083 - RNA, 20 nt, Human
ggaggucaaagagcaucgcu

SEQ ID NO: 1061084 - RNA, 22 nt, Human
ggcaaaaggaugaggggaaaga

SEQ ID NO: 1061085 - RNA, 18 nt, Human
ggcggccucugauuggug

SEQ ID NO: 1061086 - RNA, 18 nt, Human
ggcgguggcggcggcggc

SEQ ID NO: 1061087 - RNA, 21 nt, Human
ggcugggcuccgucucucccc

SEQ ID NO: 1061088 - RNA, 24 nt, Human
ggcuggucucgaacuccugaccuc

SEQ ID NO: 1061089 - RNA, 20 nt, Human
gggaggcgguggcggcggcg

SEQ ID NO: 1061090 - RNA, 21 nt, Human
ggguuccgccauguuggccag

SEQ ID NO: 1061091 - RNA, 22 nt, Human
ggguuccgccauguuggccagg

SEQ ID NO: 1061092 - RNA, 19 nt, Human
ggucucgaacuccugaccu

SEQ ID NO: 1061093 - RNA, 24 nt, Human
ggugauccacccuccuuggccucc

SEQ ID NO: 1061094 - RNA, 20 nt, Human
guccccuccguuccccucca

SEQ ID NO: 1061095 - RNA, 24 nt, Human
gugauccacccuccuuggccuccc

SEQ ID NO: 1061096 - RNA, 23 nt, Human
uacaggcgugagccacugugccc

SEQ ID NO: 1061097 - RNA, 23 nt, Human
uacaggcgugagccacugugccc

SEQ ID NO: 1061098 - RNA, 23 nt, Human
ucaaagccaccccucgccgggag

SEQ ID NO: 1061099 - RNA, 21 nt, Human
uccacccuccuuggccuccca

SEQ ID NO: 1061100 - RNA, 24 nt, Human
ucccaaaguguugggauuacaggc

SEQ ID NO: 1061101 - RNA, 23 nt, Human
ucccaggaauugacgcuucuguc

SEQ ID NO: 1061102 - RNA, 24 nt, Human
uccccuccagucuuccucccgcua

SEQ ID NO: 1061103 - RNA, 27 nt, Human
ucccugcuguuaagccaagccacucca

SEQ ID NO: 1061104 - RNA, 21 nt, Human
uccgcaauccccgccuccugc

SEQ ID NO: 1061105 - RNA, 21 nt, Human
uccuuggccucccaaaguguu

SEQ ID NO: 1061106 - RNA, 18 nt, Human
ucgcucugcccucccugc

SEQ ID NO: 1061107 - RNA, 23 nt, Human
ucucgaacuccugaccucaggug

SEQ ID NO: 1061108 - RNA, 24 nt, Human
ugacccggaagaaacaaacgcagc

SEQ ID NO: 1061109 - RNA, 20 nt, Human
ugaccucaggugauccaccc

SEQ ID NO: 1061110 - RNA, 21 nt, Human
ugaccucaggugauccacccu

SEQ ID NO: 1061111 - RNA, 22 nt, Human
ugaccucaggugauccacccuc

SEQ ID NO: 1061112 - RNA, 20 nt, Human
ugcagugccagaaagggagg

SEQ ID NO: 1061113 - RNA, 21 nt, Human
ugcagugccagaaagggaggc

SEQ ID NO: 1061114 - RNA, 24 nt, Human
uggccaggcuggucucgaacuccu

SEQ ID NO: 1061115 - RNA, 19 nt, Human
uggcggcggcggcugcgac

SEQ ID NO: 1061116 - RNA, 21 nt, Human
uggcuaggucuggguggcguc

SEQ ID NO: 1061117 - RNA, 18 nt, Human
ugggauuacaggcgugag

SEQ ID NO: 1061118 - RNA, 21 nt, Human
ugggauuacaggcgugagcca

SEQ ID NO: 1061119 - RNA, 22 nt, Human
ugggauuacaggcgugagccac

SEQ ID NO: 1061120 - RNA, 22 nt, Human
ugggauuacaggcgugagccac

SEQ ID NO: 1061121 - RNA, 22 nt, Human
ugggauuacaggcgugagccac

SEQ ID NO: 1061122 - RNA, 24 nt, Human
ugggauuacaggcgugagccacug

SEQ ID NO: 1061123 - RNA, 26 nt, Human
ugggauuacaggcgugagccacugug

SEQ ID NO: 1061124 - RNA, 21 nt, Human
ugguggaagugaggcaaggcu

SEQ ID NO: 1061125 - RNA, 21 nt, Human
uuccgccauguuggccaggcu

SEQ ID NO: 1061126 - RNA, 21 nt, Human
uugguucuucuuuuccgcaau

SEQ ID NO: 1061127 - RNA, 24 nt, Human
cugauguccaaauuggggauucau

SEQ ID NO: 1061128 - RNA, 20 nt, Human
gccgauauguugaauuacac

SEQ ID NO: 1061129 - RNA, 18 nt, Human
uagaaaaucaucaacugc

SEQ ID NO: 1061130 - RNA, 20 nt, Human
ucaucaacugcuacauccau

SEQ ID NO: 1061131 - RNA, 20 nt, Human
ucgguucccagucgccgaua

SEQ ID NO: 1061132 - RNA, 21 nt, Human
ugcuacauccauuuuucauua

SEQ ID NO: 1061133 - RNA, 25 nt, Human
ugggaaaagcuucucugucacggug

SEQ ID NO: 1061134 - RNA, 20 nt, Human
uucccagucgccgauauguu

SEQ ID NO: 1061135 - RNA, 20 nt, Human
uuguggaaacuggaauaauc

SEQ ID NO: 1061136 - RNA, 23 nt, Human
acagcgguggacgcugcuggggc

SEQ ID NO: 1061137 - RNA, 22 nt, Human
acccaggauggugcacggcagc

SEQ ID NO: 1061138 - RNA, 22 nt, Human
agccugcccagccacccuccug

SEQ ID NO: 1061139 - RNA, 22 nt, Human
agcucagagacguggguuucug

SEQ ID NO: 1061140 - RNA, 23 nt, Human
aggaggggcaggggugggcgggc

SEQ ID NO: 1061141 - RNA, 23 nt, Human
aggauggugcacggcagccuggc

SEQ ID NO: 1061142 - RNA, 22 nt, Human
cacccaggauggugcacggcag

SEQ ID NO: 1061143 - RNA, 20 nt, Human
cagcgguggacgcugcuggg

SEQ ID NO: 1061144 - RNA, 20 nt, Human
caggugcaggugaccuggug

SEQ ID NO: 1061145 - RNA, 20 nt, Human
caucaggacagcuuggcugc

SEQ ID NO: 1061146 - RNA, 25 nt, Human
caucaggacagcuuggcugcuggca

SEQ ID NO: 1061147 - RNA, 24 nt, Human
ccugcgcccggagcaccacgagga

SEQ ID NO: 1061148 - RNA, 24 nt, Human
ccuggugggcagggugcccaggag

SEQ ID NO: 1061149 - RNA, 23 nt, Human
cgccaucggcccuggugacaccc

SEQ ID NO: 1061150 - RNA, 21 nt, Human
cgcccggagcaccacgaggac

SEQ ID NO: 1061151 - RNA, 22 nt, Human
cggagccugagaggaagaggag

SEQ ID NO: 1061152 - RNA, 18 nt, Human
cgggcuccggguuccccu

SEQ ID NO: 1061153 - RNA, 20 nt, Human
cucagagacguggguuucug

SEQ ID NO: 1061154 - RNA, 18 nt, Human
cugccaccugcgcccgga

SEQ ID NO: 1061155 - RNA, 19 nt, Human
cuggccuagacagcagccu

SEQ ID NO: 1061156 - RNA, 18 nt, Human
cuggugacacccacgccc

SEQ ID NO: 1061157 - RNA, 22 nt, Human
gaggacacccaggauggugcac

SEQ ID NO: 1061158 - RNA, 21 nt, Human
gaggggcaggggugggcgggc

SEQ ID NO: 1061159 - RNA, 22 nt, Human
gcgggguccgggcuccggguuc

SEQ ID NO: 1061160 - RNA, 22 nt, Human
ggggcaggggugggcgggcgcu

SEQ ID NO: 1061161 - RNA, 20 nt, Human
ucacaguuuauucagagcag

SEQ ID NO: 1061162 - RNA, 21 nt, Human
ucaucaggacagcuuggcugc

SEQ ID NO: 1061163 - RNA, 26 nt, Human
ucaucaggacagcuuggcugcuggca

SEQ ID NO: 1061164 - RNA, 21 nt, Human
ugagaggaagaggagcuccac

SEQ ID NO: 1061165 - RNA, 21 nt, Human
ugccaccugcgcccggagcac

SEQ ID NO: 1061166 - RNA, 24 nt, Human
ugcugcacagccugggccgauucu

SEQ ID NO: 1061167 - RNA, 24 nt, Human
uggacgcugcuggggccgucucgg

SEQ ID NO: 1061168 - RNA, 22 nt, Human
uggcgggguccgggcuccgggu

SEQ ID NO: 1061169 - RNA, 23 nt, Human
ugucaucaggacagcuuggcugc

SEQ ID NO: 1061170 - RNA, 21 nt, Human
aagaugcagcggacccugagg

SEQ ID NO: 1061171 - RNA, 18 nt, Human
agagcaccaggugcgcca

SEQ ID NO: 1061172 - RNA, 23 nt, Human
caccuggccagcuccaggaaggg

SEQ ID NO: 1061173 - RNA, 24 nt, Human
ccagccaggccaggaagaugcagc

SEQ ID NO: 1061174 - RNA, 20 nt, Human
cccccuuggaggacucuccu

SEQ ID NO: 1061175 - RNA, 20 nt, Human
ccugcaggcgcuuggagaag

SEQ ID NO: 1061176 - RNA, 21 nt, Human
ccugcaggcgcuuggagaagg

SEQ ID NO: 1061177 - RNA, 24 nt, Human
cgccuuugcuccgagcuggggucu

SEQ ID NO: 1061178 - RNA, 24 nt, Human
cuccaggaaggguggccaggcccc

SEQ ID NO: 1061179 - RNA, 18 nt, Human
cugcaaagacgcccagcc

SEQ ID NO: 1061180 - RNA, 19 nt, Human
cuggggucucaugucugug

SEQ ID NO: 1061181 - RNA, 25 nt, Human
gagaaggggcagaagagcaccaggu

SEQ ID NO: 1061182 - RNA, 23 nt, Human
gaguagugcacguacaccagcca

SEQ ID NO: 1061183 - RNA, 22 nt, Human
gcagcggacccugaggccuggg

SEQ ID NO: 1061184 - RNA, 25 nt, Human
gccagcuccaggaaggggggaacgc

SEQ ID NO: 1061185 - RNA, 18 nt, Human
gcgcuuggagaaggggca

SEQ ID NO: 1061186 - RNA, 19 nt, Human
gcuggaauccagagcccug

SEQ ID NO: 1061187 - RNA, 23 nt, Human
ggacccuggcaccuggccagcuc

SEQ ID NO: 1061188 - RNA, 19 nt, Human
ggagccggcccugcaggcg

SEQ ID NO: 1061189 - RNA, 20 nt, Human
uccauguccgccuuugcucc

SEQ ID NO: 1061190 - RNA, 22 nt, Human
uccuggcagacggagcccgaga

SEQ ID NO: 1061191 - RNA, 18 nt, Human
ucuucagaguaacaaacc

SEQ ID NO: 1061192 - RNA, 22 nt, Human
uggcaccuggccagcuccagga

SEQ ID NO: 1061193 - RNA, 19 nt, Human
uggccaggccccucacugc

SEQ ID NO: 1061194 - RNA, 22 nt, Human
uguccgccuuugcuccgagcug

SEQ ID NO: 1061195 - RNA, 24 nt, Human
ugucuguggugcuggaauccagag

SEQ ID NO: 1061196 - RNA, 22 nt, Human
cagaagaggcuguaguuuggac

SEQ ID NO: 1061197 - RNA, 24 nt, Human
cccuuggacaaugcaagcuccaga

SEQ ID NO: 1061198 - RNA, 25 nt, Human
cuggggcugcuucuugucacccuug

SEQ ID NO: 1061199 - RNA, 25 nt, Human
gcaagcuccagaagagggggaacgc

SEQ ID NO: 1061200 - RNA, 19 nt, Human
agcucccagcauacuuuuc

SEQ ID NO: 1061201 - RNA, 19 nt, Human
cucauagcucccagcauac

SEQ ID NO: 1061202 - RNA, 18 nt, Human
uucucauagcucccagca

SEQ ID NO: 1061203 - RNA, 23 nt, Human
aaaaagccaggggagggagggua

SEQ ID NO: 1061204 - RNA, 26 nt, Human
aaacagagaacagaaggcagagacaa

SEQ ID NO: 1061205 - RNA, 18 nt, Human
aaaccgacucccaaacac

SEQ ID NO: 1061206 - RNA, 18 nt, Human
aaagccaggggagggagg

SEQ ID NO: 1061207 - RNA, 18 nt, Human
aaagggaaagggugaggg

SEQ ID NO: 1061208 - RNA, 24 nt, Human
aaagugcagggauuacaaguauga

SEQ ID NO: 1061209 - RNA, 22 nt, Human
aagcacacacacagacacacaa

SEQ ID NO: 1061210 - RNA, 18 nt, Human
aagccaggggagggaggg

SEQ ID NO: 1061211 - RNA, 21 nt, Human
aagccaggggagggaggguag

SEQ ID NO: 1061212 - RNA, 21 nt, Human
aagcgcagaugccagccaacc

SEQ ID NO: 1061213 - RNA, 23 nt, Human
aauuacagguacuaccaccaugc

SEQ ID NO: 1061214 - RNA, 20 nt, Human
acaaaugacaggaagaccag

SEQ ID NO: 1061215 - RNA, 20 nt, Human
acacaccccaccacagucac

SEQ ID NO: 1061216 - RNA, 21 nt, Human
acagagaacagaaggcagaga

SEQ ID NO: 1061217 - RNA, 18 nt, Human
acagaugugcugucaccc

SEQ ID NO: 1061218 - RNA, 19 nt, Human
acaggcuauauuggagacu

SEQ ID NO: 1061219 - RNA, 20 nt, Human
acagguacuaccaccaugcc

SEQ ID NO: 1061220 - RNA, 20 nt, Human
accacagucacuagcaaacc

SEQ ID NO: 1061221 - RNA, 20 nt, Human
acggagcccugagacauguu

SEQ ID NO: 1061222 - RNA, 18 nt, Human
agaaagagggagggaggg

SEQ ID NO: 1061223 - RNA, 25 nt, Human
agaaggacucucccaaccugcccga

SEQ ID NO: 1061224 - RNA, 22 nt, Human
agacacacacgggcgcacacgg

SEQ ID NO: 1061225 - RNA, 23 nt, Human
agacagacagcuugaaggagagc

SEQ ID NO: 1061226 - RNA, 18 nt, Human
agacaggaagaacacagg

SEQ ID NO: 1061227 - RNA, 19 nt, Human
agacaggaagaacacaggg

SEQ ID NO: 1061228 - RNA, 21 nt, Human
agacaggaagaacacagggcu

SEQ ID NO: 1061229 - RNA, 19 nt, Human
agacaggggccccuuuggc

SEQ ID NO: 1061230 - RNA, 20 nt, Human
agacccgagaccucgcgcaa

SEQ ID NO: 1061231 - RNA, 23 nt, Human
agagagcaagguggagagggaag

SEQ ID NO: 1061232 - RNA, 19 nt, Human
agagagcaaugagccgaga

SEQ ID NO: 1061233 - RNA, 23 nt, Human
agagauagaaacggaaggagaga

SEQ ID NO: 1061234 - RNA, 23 nt, Human
agagaugaggacaggaacagaga

SEQ ID NO: 1061235 - RNA, 24 nt, Human
agagaugggguuucaucauuuugg

SEQ ID NO: 1061236 - RNA, 23 nt, Human
agagcaaugagccgagacucagg

SEQ ID NO: 1061237 - RNA, 18 nt, Human
agagcccaguccagcuac

SEQ ID NO: 1061238 - RNA, 22 nt, Human
agagcucgaggcagauaguccc

SEQ ID NO: 1061239 - RNA, 21 nt, Human
agaggaaccagggagauugag

SEQ ID NO: 1061240 - RNA, 20 nt, Human
agagggaaguagggaaaggg

SEQ ID NO: 1061241 - RNA, 18 nt, Human
agagggagggagggagaa

SEQ ID NO: 1061242 - RNA, 19 nt, Human
agagggagggagggagaaa

SEQ ID NO: 1061243 - RNA, 23 nt, Human
agagggagggagggagaaaggga

SEQ ID NO: 1061244 - RNA, 18 nt, Human
agcaaaccgacucccaaa

SEQ ID NO: 1061245 - RNA, 23 nt, Human
agcaacagagccuuggagaggga

SEQ ID NO: 1061246 - RNA, 21 nt, Human
agcaagaaacagagaacagaa

SEQ ID NO: 1061247 - RNA, 18 nt, Human
agcacagaaagaauagau

SEQ ID NO: 1061248 - RNA, 18 nt, Human
agccaggggagggagggu

SEQ ID NO: 1061249 - RNA, 27 nt, Human
agcgauggagagagacacagagaggaa

SEQ ID NO: 1061250 - RNA, 22 nt, Human
agcucgugaccccggaggccuc

SEQ ID NO: 1061251 - RNA, 21 nt, Human
aggaacagagacagagugaga

SEQ ID NO: 1061252 - RNA, 27 nt, Human
aggaagaacacagggcucugcuggagg

SEQ ID NO: 1061253 - RNA, 21 nt, Human
aggaagaccagaacccacagc

SEQ ID NO: 1061254 - RNA, 20 nt, Human
aggcaagagggaaggcaggc

SEQ ID NO: 1061255 - RNA, 19 nt, Human
aggcagagaugaggacagg

SEQ ID NO: 1061256 - RNA, 20 nt, Human
aggcgugucuucccuuccag

SEQ ID NO: 1061257 - RNA, 22 nt, Human
aggcugggaucaggcaccccgg

SEQ ID NO: 1061258 - RNA, 19 nt, Human
agggaaguagggaaaggga

SEQ ID NO: 1061259 - RNA, 23 nt, Human
agggaaguagggaaagggaaagg

SEQ ID NO: 1061260 - RNA, 21 nt, Human
agggagaaagggaggaaaaag

SEQ ID NO: 1061261 - RNA, 21 nt, Human
agggagggagaaagggaggaa

SEQ ID NO: 1061262 - RNA, 18 nt, Human
agggagggagggagaaag

SEQ ID NO: 1061263 - RNA, 22 nt, Human
agggauuacaaguaugagccac

SEQ ID NO: 1061264 - RNA, 23 nt, Human
aggggagggaggguagaacagau

SEQ ID NO: 1061265 - RNA, 22 nt, Human
agggggcuuucgugagccagga

SEQ ID NO: 1061266 - RNA, 18 nt, Human
agggugccugggcugggc

SEQ ID NO: 1061267 - RNA, 20 nt, Human
aguacaguggugcggucucg

SEQ ID NO: 1061268 - RNA, 24 nt, Human
aguacaguggugcggucucggcuc

SEQ ID NO: 1061269 - RNA, 18 nt, Human
agucaccagcugcagugg

SEQ ID NO: 1061270 - RNA, 24 nt, Human
aucauuuuggccaggcuggucuug

SEQ ID NO: 1061271 - RNA, 23 nt, Human
auccagacacaccccaccacagu

SEQ ID NO: 1061272 - RNA, 18 nt, Human
augccuccagaaccaaca

SEQ ID NO: 1061273 - RNA, 23 nt, Human
auggacauccagacacaccccac

SEQ ID NO: 1061274 - RNA, 20 nt, Human
auggagcuaggcaaggaugg

SEQ ID NO: 1061275 - RNA, 20 nt, Human
augggguuucaucauuuugg

SEQ ID NO: 1061276 - RNA, 23 nt, Human
augggguuucaucauuuuggcca

SEQ ID NO: 1061277 - RNA, 24 nt, Human
augggguuucaucauuuuggccag

SEQ ID NO: 1061278 - RNA, 18 nt, Human
augugcugucacccagac

SEQ ID NO: 1061279 - RNA, 24 nt, Human
caaagugcagggauuacaaguaug

SEQ ID NO: 1061280 - RNA, 20 nt, Human
caagagcccaguccagcuac

SEQ ID NO: 1061281 - RNA, 22 nt, Human
caagccauucuucugccucagc

SEQ ID NO: 1061282 - RNA, 18 nt, Human
caagcgcagaugccagcc

SEQ ID NO: 1061283 - RNA, 18 nt, Human
cacacacacagacacaca

SEQ ID NO: 1061284 - RNA, 28 nt, Human
cacacagacacacacgggcgcacacgcg

SEQ ID NO: 1061285 - RNA, 22 nt, Human
cacccuccucccuccucuaucg

SEQ ID NO: 1061286 - RNA, 22 nt, Human
caccucccgagcucgugacccc

SEQ ID NO: 1061287 - RNA, 22 nt, Human
cacuccucagacaggaagaaca

SEQ ID NO: 1061288 - RNA, 24 nt, Human
cacucuuguugcccaggcuggagu

SEQ ID NO: 1061289 - RNA, 23 nt, Human
cacugcaaccucugccuccaggg

SEQ ID NO: 1061290 - RNA, 25 nt, Human
cagaaccaacaggacccagaacucc

SEQ ID NO: 1061291 - RNA, 19 nt, Human
cagaacuccgggaauaugu

SEQ ID NO: 1061292 - RNA, 19 nt, Human
cagagaacagaaggcagag

SEQ ID NO: 1061293 - RNA, 28 nt, Human
cagcaccauagagcgccuuacaacuaaa

SEQ ID NO: 1061294 - RNA, 18 nt, Human
cagcgcgacggccugcug

SEQ ID NO: 1061295 - RNA, 18 nt, Human
caggaaacaggaauccau

SEQ ID NO: 1061296 - RNA, 23 nt, Human
caggaagaccagaacccacagcg

SEQ ID NO: 1061297 - RNA, 24 nt, Human
caggcugcacaggcagaaggacuc

SEQ ID NO: 1061298 - RNA, 21 nt, Human
caggguucaagccauucuucu

SEQ ID NO: 1061299 - RNA, 24 nt, Human
caguaggucucaauagugggauua

SEQ ID NO: 1061300 - RNA, 24 nt, Human
cagugggacagcuuggggccccuc

SEQ ID NO: 1061301 - RNA, 24 nt, Human
caucauuuuggccaggcuggucuu

SEQ ID NO: 1061302 - RNA, 21 nt, Human
cauccagacacaccccaccac

SEQ ID NO: 1061303 - RNA, 18 nt, Human
cauuuuggccaggcuggu

SEQ ID NO: 1061304 - RNA, 20 nt, Human
cauuuuggccaggcuggucu

SEQ ID NO: 1061305 - RNA, 22 nt, Human
ccaaagugcagggauuacaagu

SEQ ID NO: 1061306 - RNA, 24 nt, Human
ccaaagugcagggauuacaaguau

SEQ ID NO: 1061307 - RNA, 21 nt, Human
ccaacccgugucccgccagcc

SEQ ID NO: 1061308 - RNA, 21 nt, Human
ccacccacgucccaccggagu

SEQ ID NO: 1061309 - RNA, 19 nt, Human
ccacgggccgcagcuuggg

SEQ ID NO: 1061310 - RNA, 20 nt, Human
ccacucgggaaaaccaacgg

SEQ ID NO: 1061311 - RNA, 23 nt, Human
ccagccaaccgggcaccucccaa

SEQ ID NO: 1061312 - RNA, 19 nt, Human
ccaggcaagagggaaggca

SEQ ID NO: 1061313 - RNA, 24 nt, Human
ccaggguaggguggagggugccug

SEQ ID NO: 1061314 - RNA, 19 nt, Human
ccaggguucaagccauucu

SEQ ID NO: 1061315 - RNA, 23 nt, Human
ccaggguucaagccauucuucug

SEQ ID NO: 1061316 - RNA, 20 nt, Human
ccaguccagcuacgccugcc

SEQ ID NO: 1061317 - RNA, 20 nt, Human
cccaagagcccaguccagcu

SEQ ID NO: 1061318 - RNA, 21 nt, Human
cccagaaacuuccaggaaugc

SEQ ID NO: 1061319 - RNA, 21 nt, Human
ccccaacaaaugacaggaaga

SEQ ID NO: 1061320 - RNA, 28 nt, Human
ccccaacaaaugacaggaagggaguuuc

SEQ ID NO: 1061321 - RNA, 21 nt, Human
ccccagaguuucagcaaaagg

SEQ ID NO: 1061322 - RNA, 24 nt, Human
cccccugcuccagcccagccaggc

SEQ ID NO: 1061323 - RNA, 21 nt, Human
ccccucacuguggcagaagcu

SEQ ID NO: 1061324 - RNA, 23 nt, Human
cccgagcucgugaccccggaggc

SEQ ID NO: 1061325 - RNA, 24 nt, Human
cccgaguagcugaaauuacaggua

SEQ ID NO: 1061326 - RNA, 19 nt, Human
cccucuggaucaccagccu

SEQ ID NO: 1061327 - RNA, 19 nt, Human
ccgaaacuggggcucuccc

SEQ ID NO: 1061328 - RNA, 19 nt, Human
ccgcuccaggagccggggc

SEQ ID NO: 1061329 - RNA, 18 nt, Human
ccggaagggagagaaaga

SEQ ID NO: 1061330 - RNA, 21 nt, Human
ccggcgccacugggggagcug

SEQ ID NO: 1061331 - RNA, 19 nt, Human
ccuacaccggggcgugggg

SEQ ID NO: 1061332 - RNA, 22 nt, Human
ccucagacucccugguggccuc

SEQ ID NO: 1061333 - RNA, 20 nt, Human
ccucaggugauccucagccu

SEQ ID NO: 1061334 - RNA, 23 nt, Human
ccuccagaaccaacaggacccag

SEQ ID NO: 1061335 - RNA, 19 nt, Human
ccucccaaagugcagggau

SEQ ID NO: 1061336 - RNA, 22 nt, Human
ccuccgaaccccaacaaaugac

SEQ ID NO: 1061337 - RNA, 18 nt, Human
ccucuggaucaccagccu

SEQ ID NO: 1061338 - RNA, 24 nt, Human
ccucuguaaaggugccuguugcuc

SEQ ID NO: 1061339 - RNA, 18 nt, Human
ccugaccucaggugaucc

SEQ ID NO: 1061340 - RNA, 18 nt, Human
ccugaccucaggugaucc

SEQ ID NO: 1061341 - RNA, 23 nt, Human
ccugaccucaggugauccucagc

SEQ ID NO: 1061342 - RNA, 19 nt, Human
ccugcaacagagcucgagg

SEQ ID NO: 1061343 - RNA, 19 nt, Human
cgccuggcuggcccaagag

SEQ ID NO: 1061344 - RNA, 19 nt, Human
cggaaggagagaaacagcg

SEQ ID NO: 1061345 - RNA, 22 nt, Human
cggaagggagagaaagagggag

SEQ ID NO: 1061346 - RNA, 24 nt, Human
cggaagggagagaaagagggaggg

SEQ ID NO: 1061347 - RNA, 21 nt, Human
cggagcccugagacauguuuu

SEQ ID NO: 1061348 - RNA, 22 nt, Human
cggaggccuccgcgucaagcgc

SEQ ID NO: 1061349 - RNA, 24 nt, Human
cucacugcaaccucugccuccagg

SEQ ID NO: 1061350 - RNA, 18 nt, Human
cucuuguugcccaggcug

SEQ ID NO: 1061351 - RNA, 24 nt, Human
cugaagccaaguguugacuucucu

SEQ ID NO: 1061352 - RNA, 24 nt, Human
cugcaaccucugccuccaggguuc

SEQ ID NO: 1061353 - RNA, 18 nt, Human
cugcccuuuccaggcaag

SEQ ID NO: 1061354 - RNA, 20 nt, Human
cugcccuuuccaggcaagag

SEQ ID NO: 1061355 - RNA, 23 nt, Human
cugccucagccucccgaguagcu

SEQ ID NO: 1061356 - RNA, 20 nt, Human
cugccuccaggguucaagcc

SEQ ID NO: 1061357 - RNA, 19 nt, Human
cugcuggaggagcagguug

SEQ ID NO: 1061358 - RNA, 22 nt, Human
gaacacagggcucugcuggagg

SEQ ID NO: 1061359 - RNA, 19 nt, Human
gaagaacacagggcucugc

SEQ ID NO: 1061360 - RNA, 25 nt, Human
gaaggagagaaacagcgauggagag

SEQ ID NO: 1061361 - RNA, 21 nt, Human
gaaucguuuuuuuuuuuuuuc

SEQ ID NO: 1061362 - RNA, 22 nt, Human
gacaaaaggagcaagaaacaga

SEQ ID NO: 1061363 - RNA, 20 nt, Human
gacacaccccaccacaguca

SEQ ID NO: 1061364 - RNA, 23 nt, Human
gaccucaggugauccucagccuc

SEQ ID NO: 1061365 - RNA, 18 nt, Human
gacuugcaagucuuccuu

SEQ ID NO: 1061366 - RNA, 18 nt, Human
gagagaaacagcgaugga

SEQ ID NO: 1061367 - RNA, 18 nt, Human
gagaugggguuucaucau

SEQ ID NO: 1061368 - RNA, 18 nt, Human
gagcaugcggggcuuugu

SEQ ID NO: 1061369 - RNA, 23 nt, Human
gagcucgugaccccggaggccuc

SEQ ID NO: 1061370 - RNA, 22 nt, Human
gaguagcugaaauuacagguac

SEQ ID NO: 1061371 - RNA, 22 nt, Human
gauggacggagagacaaaagga

SEQ ID NO: 1061372 - RNA, 18 nt, Human
gauuacaaguaugagcca

SEQ ID NO: 1061373 - RNA, 24 nt, Human
gauuacaaguaugagccacuaugc

SEQ ID NO: 1061374 - RNA, 22 nt, Human
gcaaccucugccuccaggguuc

SEQ ID NO: 1061375 - RNA, 24 nt, Human
gcacucaccuccagccuguuagau

SEQ ID NO: 1061376 - RNA, 18 nt, Human
gcaugggaacccgaagac

SEQ ID NO: 1061377 - RNA, 21 nt, Human
gccagccuccucgccagcacc

SEQ ID NO: 1061378 - RNA, 19 nt, Human
gcccaggcuggaguacagu

SEQ ID NO: 1061379 - RNA, 22 nt, Human
gccccaggucgccagggcggca

SEQ ID NO: 1061380 - RNA, 20 nt, Human
gcccucuggaucaccagccu

SEQ ID NO: 1061381 - RNA, 25 nt, Human
gccuggcuaauuuuuuuuguauuuu

SEQ ID NO: 1061382 - RNA, 20 nt, Human
gcgcaaaccagggugcugcc

SEQ ID NO: 1061383 - RNA, 22 nt, Human
gcgccacugggggagcugaagg

SEQ ID NO: 1061384 - RNA, 18 nt, Human
gcuggaacaggggggcag

SEQ ID NO: 1061385 - RNA, 23 nt, Human
gcuggucuugaacuccugaccuc

SEQ ID NO: 1061386 - RNA, 25 nt, Human
ggaacacaagcacacacacagacac

SEQ ID NO: 1061387 - RNA, 26 nt, Human
ggaaggagagaaacagcgauggagag

SEQ ID NO: 1061388 - RNA, 24 nt, Human
ggaagggagagaaagagggaggga

SEQ ID NO: 1061389 - RNA, 23 nt, Human
ggagaaagggaggaaaaagccag

SEQ ID NO: 1061390 - RNA, 18 nt, Human
ggagagaaagagggaggg

SEQ ID NO: 1061391 - RNA, 24 nt, Human
ggagagcaagggacagagggauga

SEQ ID NO: 1061392 - RNA, 21 nt, Human
ggagcagguuggggcggguuu

SEQ ID NO: 1061393 - RNA, 20 nt, Human
ggagggugccugggcugggc

SEQ ID NO: 1061394 - RNA, 21 nt, Human
ggauggagcuaggcaaggaug

SEQ ID NO: 1061395 - RNA, 18 nt, Human
ggcagggugggggcaggg

SEQ ID NO: 1061396 - RNA, 23 nt, Human
ggcgccacugggggagcugaagg

SEQ ID NO: 1061397 - RNA, 19 nt, Human
ggcuggaacaggggggcag

SEQ ID NO: 1061398 - RNA, 24 nt, Human
ggcuggucuugaacuccugaccuc

SEQ ID NO: 1061399 - RNA, 20 nt, Human
gggaacacaagcacacacac

SEQ ID NO: 1061400 - RNA, 25 nt, Human
gggaacacaagcacacacacagaca

SEQ ID NO: 1061401 - RNA, 24 nt, Human
gggagagcaacagagccuuggaga

SEQ ID NO: 1061402 - RNA, 21 nt, Human
gggauuacaaguaugagccac

SEQ ID NO: 1061403 - RNA, 23 nt, Human
gggauuacaaguaugagccacua

SEQ ID NO: 1061404 - RNA, 19 nt, Human
gggcagggugggggcaggg

SEQ ID NO: 1061405 - RNA, 20 nt, Human
gggcagggugggggcagggc

SEQ ID NO: 1061406 - RNA, 21 nt, Human
gggcuggagccccaggucgcc

SEQ ID NO: 1061407 - RNA, 20 nt, Human
ggggcagggugggggcaggg

SEQ ID NO: 1061408 - RNA, 22 nt, Human
gggguuucaucauuuuggccag

SEQ ID NO: 1061409 - RNA, 22 nt, Human
ggguuucaucauuuuggccagg

SEQ ID NO: 1061410 - RNA, 21 nt, Human
ggguuuggggcaggguggggg

SEQ ID NO: 1061411 - RNA, 19 nt, Human
ggucuugaacuccugaccu

SEQ ID NO: 1061412 - RNA, 21 nt, Human
ggugagggagcuugagaggga

SEQ ID NO: 1061413 - RNA, 18 nt, Human
gguggagggugccugggc

SEQ ID NO: 1061414 - RNA, 24 nt, Human
guucacuguccuggccccucccuc

SEQ ID NO: 1061415 - RNA, 19 nt, Human
uaaagacccgagaccucgc

SEQ ID NO: 1061416 - RNA, 23 nt, Human
uacaacuaaauaaagacccgaga

SEQ ID NO: 1061417 - RNA, 22 nt, Human
uacaaguaugagccacuaugcc

SEQ ID NO: 1061418 - RNA, 23 nt, Human
uacaaguaugagccacuaugccu

SEQ ID NO: 1061419 - RNA, 21 nt, Human
uacagguacuaccaccaugcc

SEQ ID NO: 1061420 - RNA, 22 nt, Human
uaccaccaugccuggcuaauuu

SEQ ID NO: 1061421 - RNA, 23 nt, Human
uagaacagauggaaggauggacg

SEQ ID NO: 1061422 - RNA, 20 nt, Human
uagagaugggguuucaucau

SEQ ID NO: 1061423 - RNA, 21 nt, Human
uagcaaaccgacucccaaaca

SEQ ID NO: 1061424 - RNA, 24 nt, Human
uagcaaaccgacucccaaacacac

SEQ ID NO: 1061425 - RNA, 18 nt, Human
uagcgucauuccuuuguu

SEQ ID NO: 1061426 - RNA, 19 nt, Human
uaggguggagggugccugg

SEQ ID NO: 1061427 - RNA, 20 nt, Human
uaucacggcaacugugacac

SEQ ID NO: 1061428 - RNA, 19 nt, Human
uauuagagaugggguuuca

SEQ ID NO: 1061429 - RNA, 22 nt, Human
uauuagagaugggguuucauca

SEQ ID NO: 1061430 - RNA, 25 nt, Human
ucaagccauucuucugccucagccu

SEQ ID NO: 1061431 - RNA, 22 nt, Human
ucaccucccgagcucgugaccc

SEQ ID NO: 1061432 - RNA, 23 nt, Human
ucacucuuguugcccaggcugga

SEQ ID NO: 1061433 - RNA, 23 nt, Human
ucacugcaaccucugccuccagg

SEQ ID NO: 1061434 - RNA, 24 nt, Human
ucacugcaaccucugccuccaggg

SEQ ID NO: 1061435 - RNA, 27 nt, Human
ucacugcaaccucugccuccaggguuc

SEQ ID NO: 1061436 - RNA, 18 nt, Human
ucagacaggaagaacaca

SEQ ID NO: 1061437 - RNA, 23 nt, Human
ucagcggcccucuggaucaccag

SEQ ID NO: 1061438 - RNA, 21 nt, Human
uccagaaccaacaggacccag

SEQ ID NO: 1061439 - RNA, 24 nt, Human
uccagaaccaacaggacccagaac

SEQ ID NO: 1061440 - RNA, 23 nt, Human
ucccaaagugcagggauuacaag

SEQ ID NO: 1061441 - RNA, 21 nt, Human
ucccauccucagacucccugg

SEQ ID NO: 1061442 - RNA, 21 nt, Human
uccccacguugagcccugcaa

SEQ ID NO: 1061443 - RNA, 23 nt, Human
ucccgaguagcugaaauuacagg

SEQ ID NO: 1061444 - RNA, 24 nt, Human
ucccgaguagcugaaauuacaggu

SEQ ID NO: 1061445 - RNA, 18 nt, Human
ucccuguccucuuggugc

SEQ ID NO: 1061446 - RNA, 22 nt, Human
uccucaaagagagucagcccau

SEQ ID NO: 1061447 - RNA, 22 nt, Human
uccucagccucccaaagugcag

SEQ ID NO: 1061448 - RNA, 23 nt, Human
uccucagccucccaaagugcagg

SEQ ID NO: 1061449 - RNA, 23 nt, Human
ucgaggcagauagucccauccac

SEQ ID NO: 1061450 - RNA, 20 nt, Human
ucgccagggcggcaugggaa

SEQ ID NO: 1061451 - RNA, 22 nt, Human
ucgcgcaaaccagggugcugcc

SEQ ID NO: 1061452 - RNA, 24 nt, Human
ucucucuagcuaugaaaauucuac

SEQ ID NO: 1061453 - RNA, 23 nt, Human
ucuugaacuccugaccucaggug

SEQ ID NO: 1061454 - RNA, 20 nt, Human
ucuuugcccucuguaaaggu

SEQ ID NO: 1061455 - RNA, 18 nt, Human
ucuuuuuuuuuuuuuuuu

SEQ ID NO: 1061456 - RNA, 23 nt, Human
ugaaauuacagguacuaccacca

SEQ ID NO: 1061457 - RNA, 20 nt, Human
ugaacacaccugcgugugug

SEQ ID NO: 1061458 - RNA, 18 nt, Human
ugaccucaggugauccuc

SEQ ID NO: 1061459 - RNA, 23 nt, Human
ugaccucaggugauccucagccu

SEQ ID NO: 1061460 - RNA, 21 nt, Human
ugagagagagagagagagagc

SEQ ID NO: 1061461 - RNA, 21 nt, Human
ugauucuggauuccacguuuc

SEQ ID NO: 1061462 - RNA, 23 nt, Human
ugcacaggcagaaggacucuccc

SEQ ID NO: 1061463 - RNA, 24 nt, Human
ugcagggauuacaaguaugagcca

SEQ ID NO: 1061464 - RNA, 20 nt, Human
ugcauaauucuuaagggccc

SEQ ID NO: 1061465 - RNA, 22 nt, Human
ugccaacccgugucccgccagc

SEQ ID NO: 1061466 - RNA, 21 nt, Human
ugcccaggcuggaguacagug

SEQ ID NO: 1061467 - RNA, 24 nt, Human
ugcccaggcuggaguacaguggug

SEQ ID NO: 1061468 - RNA, 18 nt, Human
ugcccaguacaggcugag

SEQ ID NO: 1061469 - RNA, 24 nt, Human
ugccucagccucccgaguagcuga

SEQ ID NO: 1061470 - RNA, 19 nt, Human
ugccugggcugggcuggaa

SEQ ID NO: 1061471 - RNA, 23 nt, Human
ugccugggcugggcuggaacagg

SEQ ID NO: 1061472 - RNA, 25 nt, Human
ugcuggaggagcagguuggggcggg

SEQ ID NO: 1061473 - RNA, 19 nt, Human
uggagcuaggcaaggaugg

SEQ ID NO: 1061474 - RNA, 18 nt, Human
uggagggugccugggcug

SEQ ID NO: 1061475 - RNA, 20 nt, Human
uggaguacaguggugcgguc

SEQ ID NO: 1061476 - RNA, 24 nt, Human
uggaguacaguggugcggucucgg

SEQ ID NO: 1061477 - RNA, 19 nt, Human
uggcagaagcaguggcgcu

SEQ ID NO: 1061478 - RNA, 24 nt, Human
uggccaggcuggucuugaacuccu

SEQ ID NO: 1061479 - RNA, 21 nt, Human
uggccggcggggcgcucagcg

SEQ ID NO: 1061480 - RNA, 22 nt, Human
ugggaucaggcaccccggagcc

SEQ ID NO: 1061481 - RNA, 24 nt, Human
ugggcugggcuggaacaggggggc

SEQ ID NO: 1061482 - RNA, 23 nt, Human
uggggccccagaaacuuccagga

SEQ ID NO: 1061483 - RNA, 18 nt, Human
uggggcucucccacaggg

SEQ ID NO: 1061484 - RNA, 23 nt, Human
ugggggcagggugggggcagggg

SEQ ID NO: 1061485 - RNA, 24 nt, Human
ugggguuucaucauuuuggccagg

SEQ ID NO: 1061486 - RNA, 29 nt, Human
uggguggaaggagggaccccggaagggag

SEQ ID NO: 1061487 - RNA, 24 nt, Human
ugguauggagaggcgugucuuccc

SEQ ID NO: 1061488 - RNA, 23 nt, Human
ugguggggcuggagccccagguc

SEQ ID NO: 1061489 - RNA, 19 nt, Human
uguacaggaaacaggaauc

SEQ ID NO: 1061490 - RNA, 22 nt, Human
ugugacacccaggcguuggcaa

SEQ ID NO: 1061491 - RNA, 20 nt, Human
uguggcagaagcaguggcgc

SEQ ID NO: 1061492 - RNA, 21 nt, Human
uuagagaugggguuucaucau

SEQ ID NO: 1061493 - RNA, 24 nt, Human
uuauuagagaugggguuucaucau

SEQ ID NO: 1061494 - RNA, 18 nt, Human
uucaagccauucuucugc

SEQ ID NO: 1061495 - RNA, 21 nt, Human
uucaagccauucuucugccuc

SEQ ID NO: 1061496 - RNA, 20 nt, Human
uucacagaugacauaucccc

SEQ ID NO: 1061497 - RNA, 22 nt, Human
uucacagaugacauauccccac

SEQ ID NO: 1061498 - RNA, 24 nt, Human
uucacucuuguugcccaggcugga

SEQ ID NO: 1061499 - RNA, 27 nt, Human
uucacuguccuggccccucccuccgaa

SEQ ID NO: 1061500 - RNA, 24 nt, Human
uuccaggaaugcguggaagaccag

SEQ ID NO: 1061501 - RNA, 20 nt, Human
uucuuugaggccacuguggu

SEQ ID NO: 1061502 - RNA, 24 nt, Human
uugcccaggcuggaguacaguggu

SEQ ID NO: 1061503 - RNA, 20 nt, Human
uuguuggcuccucccugucc

SEQ ID NO: 1061504 - RNA, 24 nt, Human
uuucacucuuguugcccaggcugg

SEQ ID NO: 1061505 - RNA, 24 nt, Human
uuucaucauuuuggccaggcuggu

SEQ ID NO: 1061506 - RNA, 18 nt, Human
uuugaaguucugaagcca

SEQ ID NO: 1061507 - RNA, 20 nt, Human
uuugcuggaaccacuccuca

SEQ ID NO: 1061508 - RNA, 19 nt, Human
uuuggccaggguagggugg

SEQ ID NO: 1061509 - RNA, 25 nt, Human
uuuucagaguggucaaugagcacug

SEQ ID NO: 1061510 - RNA, 24 nt, Human
uuuugcagugaaccucaggcuugg

SEQ ID NO: 1061511 - RNA, 22 nt, Human
uuuuggccaggcuggucuugaa

SEQ ID NO: 1061512 - RNA, 24 nt, Human
uuuuuauuagagaugggguuucau

SEQ ID NO: 1061513 - RNA, 24 nt, Human
uuuuuuguauuuuuauuagagaug

SEQ ID NO: 1061514 - RNA, 27 nt, Human
uuuuuuuuuucugagcaguaggucuca

SEQ ID NO: 1061515 - RNA, 24 nt, Human
uuuuuuuuuuuuuuuuugacguag

SEQ ID NO: 1061516 - RNA, 27 nt, Human
uuuuuuuuuuuuuuuuuuuuuuugggg

SEQ ID NO: 1061517 - RNA, 18 nt, Human
aaccccgcgcaaacaaac

SEQ ID NO: 1061518 - RNA, 26 nt, Human
aagcaugcagcccuagccauaccacu

SEQ ID NO: 1061519 - RNA, 20 nt, Human
aaggugcggguggcuggugg

SEQ ID NO: 1061520 - RNA, 23 nt, Human
acagcuuggguggcugcaguugc

SEQ ID NO: 1061521 - RNA, 21 nt, Human
accauuucuuuguguggaucc

SEQ ID NO: 1061522 - RNA, 18 nt, Human
acgggauccuugagguau

SEQ ID NO: 1061523 - RNA, 20 nt, Human
acuacuccaagcaugcacac

SEQ ID NO: 1061524 - RNA, 24 nt, Human
agcacacagcgagauugaaggcac

SEQ ID NO: 1061525 - RNA, 21 nt, Human
agcagccacagcuuggguggc

SEQ ID NO: 1061526 - RNA, 23 nt, Human
agccacuccugccaccaccacuu

SEQ ID NO: 1061527 - RNA, 23 nt, Human
aggcaaggugcggguggcuggug

SEQ ID NO: 1061528 - RNA, 18 nt, Human
aggugcggguggcuggug

SEQ ID NO: 1061529 - RNA, 21 nt, Human
auccauguuguuacuauuucu

SEQ ID NO: 1061530 - RNA, 18 nt, Human
augaagaggagcuuuacc

SEQ ID NO: 1061531 - RNA, 19 nt, Human
augauacuuuucauuucgu

SEQ ID NO: 1061532 - RNA, 18 nt, Human
augcagcccuagccauac

SEQ ID NO: 1061533 - RNA, 24 nt, Human
caaacaaacccaaugcuccugggg

SEQ ID NO: 1061534 - RNA, 18 nt, Human
caacuuucuggcuccaua

SEQ ID NO: 1061535 - RNA, 21 nt, Human
caagcaugcacacaugcagcu

SEQ ID NO: 1061536 - RNA, 23 nt, Human
caaggaguaccugcaggccagug

SEQ ID NO: 1061537 - RNA, 24 nt, Human
caaugcuccuggggccaccccaca

SEQ ID NO: 1061538 - RNA, 19 nt, Human
cacacaugcagcugggaug

SEQ ID NO: 1061539 - RNA, 20 nt, Human
caccaccacuugugccucca

SEQ ID NO: 1061540 - RNA, 21 nt, Human
cacccccuaggcuucagcccc

SEQ ID NO: 1061541 - RNA, 21 nt, Human
cacuuuguacugucuuuggua

SEQ ID NO: 1061542 - RNA, 23 nt, Human
cagacuccugagacgcagcacac

SEQ ID NO: 1061543 - RNA, 19 nt, Human
cagcacuacuccaagcaug

SEQ ID NO: 1061544 - RNA, 22 nt, Human
cagccaaccccgcgcaaacaaa

SEQ ID NO: 1061545 - RNA, 21 nt, Human
cagcucagaggagacccgcag

SEQ ID NO: 1061546 - RNA, 21 nt, Human
cagcugcacuugggagggcgg

SEQ ID NO: 1061547 - RNA, 18 nt, Human
caggucuccaguucuugu

SEQ ID NO: 1061548 - RNA, 20 nt, Human
caguagaucacaucauguaa

SEQ ID NO: 1061549 - RNA, 20 nt, Human
caguagaucacaucauguac

SEQ ID NO: 1061550 - RNA, 24 nt, Human
caguucuuguccugagaccaggaa

SEQ ID NO: 1061551 - RNA, 25 nt, Human
caugcacacaugcagcugggaugcg

SEQ ID NO: 1061552 - RNA, 22 nt, Human
ccaagcuguccucagccccacu

SEQ ID NO: 1061553 - RNA, 20 nt, Human
ccaauccauugaacuuuccc

SEQ ID NO: 1061554 - RNA, 22 nt, Human
ccacagcugcagcuuggguggc

SEQ ID NO: 1061555 - RNA, 19 nt, Human
ccacugcugcucccacagc

SEQ ID NO: 1061556 - RNA, 19 nt, Human
ccagguugugaacugugac

SEQ ID NO: 1061557 - RNA, 20 nt, Human
cccacaaguccuggcugcac

SEQ ID NO: 1061558 - RNA, 21 nt, Human
cccacaaguccuggcugcacu

SEQ ID NO: 1061559 - RNA, 21 nt, Human
cccacagccacuccugccacc

SEQ ID NO: 1061560 - RNA, 26 nt, Human
cccacagccacuccugccaccaccac

SEQ ID NO: 1061561 - RNA, 20 nt, Human
cccaugcuugucagccucca

SEQ ID NO: 1061562 - RNA, 24 nt, Human
ccccagcuugcagguggggcuuca

SEQ ID NO: 1061563 - RNA, 24 nt, Human
cccccaagaguacggagauuccug

SEQ ID NO: 1061564 - RNA, 19 nt, Human
cccccuaggcuucagcccc

SEQ ID NO: 1061565 - RNA, 18 nt, Human
ccccgcgcaaacaaaccc

SEQ ID NO: 1061566 - RNA, 21 nt, Human
ccuccuucccaugcuugucag

SEQ ID NO: 1061567 - RNA, 18 nt, Human
ccugcaggccagugccaa

SEQ ID NO: 1061568 - RNA, 21 nt, Human
ccugcaggccagugccaagcu

SEQ ID NO: 1061569 - RNA, 22 nt, Human
ccugcucccuuccacccaagag

SEQ ID NO: 1061570 - RNA, 19 nt, Human
ccuggguccacagcugcag

SEQ ID NO: 1061571 - RNA, 22 nt, Human
cgcaaacaaacccaaugcuccu

SEQ ID NO: 1061572 - RNA, 24 nt, Human
cggcugaccuucaggugacaguag

SEQ ID NO: 1061573 - RNA, 22 nt, Human
cucacagacuccugagacgcag

SEQ ID NO: 1061574 - RNA, 23 nt, Human
cuccugccaccaccacuugugcc

SEQ ID NO: 1061575 - RNA, 21 nt, Human
cucucugcaggcaggucaucc

SEQ ID NO: 1061576 - RNA, 20 nt, Human
cugcaguggguccugcccag

SEQ ID NO: 1061577 - RNA, 20 nt, Human
cugccucagggauguagggc

SEQ ID NO: 1061578 - RNA, 20 nt, Human
cuggguccacagcugcagcu

SEQ ID NO: 1061579 - RNA, 24 nt, Human
cuggguccacagcugcagcuuggg

SEQ ID NO: 1061580 - RNA, 21 nt, Human
cuuaacuuuucuuauagugca

SEQ ID NO: 1061581 - RNA, 21 nt, Human
cuuccugggcccccaagagua

SEQ ID NO: 1061582 - RNA, 20 nt, Human
cuuguccugagaccaggaag

SEQ ID NO: 1061583 - RNA, 25 nt, Human
cuuuaagcucuuauugucauccauu

SEQ ID NO: 1061584 - RNA, 22 nt, Human
cuuuaccgagagauaagacagc

SEQ ID NO: 1061585 - RNA, 23 nt, Human
cuuuguguggauccagauuucca

SEQ ID NO: 1061586 - RNA, 22 nt, Human
gaugcgaaagugcugagagaga

SEQ ID NO: 1061587 - RNA, 18 nt, Human
gcaaggugcggguggcug

SEQ ID NO: 1061588 - RNA, 23 nt, Human
gcagcuuggguggcugcagcugc

SEQ ID NO: 1061589 - RNA, 24 nt, Human
gcagcuuggguggcugcagcugca

SEQ ID NO: 1061590 - RNA, 26 nt, Human
gcaugcacacaugcagcugggaugcg

SEQ ID NO: 1061591 - RNA, 19 nt, Human
gccucagccaaccccgcgc

SEQ ID NO: 1061592 - RNA, 22 nt, Human
gcuccauaaagcaugcagcccu

SEQ ID NO: 1061593 - RNA, 18 nt, Human
gcuccugccuacucuugg

SEQ ID NO: 1061594 - RNA, 20 nt, Human
gcugcagcugcacuugggag

SEQ ID NO: 1061595 - RNA, 19 nt, Human
gcugcaguugcaccuggga

SEQ ID NO: 1061596 - RNA, 19 nt, Human
ggcagcaggcaaggugcgg

SEQ ID NO: 1061597 - RNA, 19 nt, Human
ggcagcuccucucugcagg

SEQ ID NO: 1061598 - RNA, 21 nt, Human
ggcugguggccucagccaacc

SEQ ID NO: 1061599 - RNA, 21 nt, Human
gggaagcucccacucuaccaa

SEQ ID NO: 1061600 - RNA, 18 nt, Human
ggggacccaccacuacca

SEQ ID NO: 1061601 - RNA, 22 nt, Human
ggguggcugcaguugcaccugg

SEQ ID NO: 1061602 - RNA, 19 nt, Human
ggugcagucagcugccuca

SEQ ID NO: 1061603 - RNA, 19 nt, Human
guagcagccacagcuuggg

SEQ ID NO: 1061604 - RNA, 22 nt, Human
gugcagucagcugccucaggga

SEQ ID NO: 1061605 - RNA, 21 nt, Human
guggauccagauuuccaucug

SEQ ID NO: 1061606 - RNA, 20 nt, Human
guggcugcaguugcaccugg

SEQ ID NO: 1061607 - RNA, 20 nt, Human
guucauggcacccacguuau

SEQ ID NO: 1061608 - RNA, 24 nt, Human
uaaaacgcacuuuguacugucuuu

SEQ ID NO: 1061609 - RNA, 23 nt, Human
uaaaccaauccauugaacuuucc

SEQ ID NO: 1061610 - RNA, 22 nt, Human
uaacaguaaggagaacacggac

SEQ ID NO: 1061611 - RNA, 21 nt, Human
uaauagcuguaaucuuuuggu

SEQ ID NO: 1061612 - RNA, 18 nt, Human
uagaccauuucuuugugu

SEQ ID NO: 1061613 - RNA, 20 nt, Human
uagccauaccacuggucugc

SEQ ID NO: 1061614 - RNA, 23 nt, Human
uagccauaccacuggucugcauu

SEQ ID NO: 1061615 - RNA, 20 nt, Human
uagggcacaggggacccacc

SEQ ID NO: 1061616 - RNA, 25 nt, Human
uaguaaacuuccccccuuuuagucu

SEQ ID NO: 1061617 - RNA, 21 nt, Human
ucacagacuccugagacgcag

SEQ ID NO: 1061618 - RNA, 28 nt, Human
ucagccaaccccgcgcaaacaaacccaa

SEQ ID NO: 1061619 - RNA, 18 nt, Human
ucagccccacuucagccu

SEQ ID NO: 1061620 - RNA, 18 nt, Human
ucagcugccucagggaug

SEQ ID NO: 1061621 - RNA, 27 nt, Human
uccacaguccaaagggggccggggucc

SEQ ID NO: 1061622 - RNA, 18 nt, Human
uccaguucuuguccugag

SEQ ID NO: 1061623 - RNA, 22 nt, Human
ucccacagccacuccugccacc

SEQ ID NO: 1061624 - RNA, 22 nt, Human
uccgccauucagcaggucucca

SEQ ID NO: 1061625 - RNA, 22 nt, Human
uccgggccugcaguggguccug

SEQ ID NO: 1061626 - RNA, 20 nt, Human
uccugggcccccaagaguac

SEQ ID NO: 1061627 - RNA, 18 nt, Human
ucuaccaacuuucuggcu

SEQ ID NO: 1061628 - RNA, 21 nt, Human
ucuccauagccaggguguccu

SEQ ID NO: 1061629 - RNA, 23 nt, Human
ucuuaaguuuuugcaggccugcu

SEQ ID NO: 1061630 - RNA, 18 nt, Human
ucuuugguaacuugacug

SEQ ID NO: 1061631 - RNA, 22 nt, Human
ucuuugguaacuugacugucuu

SEQ ID NO: 1061632 - RNA, 22 nt, Human
ugaccguuaguuaaaccaaucc

SEQ ID NO: 1061633 - RNA, 21 nt, Human
ugagaauaguaaacuuccccc

SEQ ID NO: 1061634 - RNA, 20 nt, Human
ugccaagcuguccucagccc

SEQ ID NO: 1061635 - RNA, 20 nt, Human
ugccaaggaguaccugcagg

SEQ ID NO: 1061636 - RNA, 18 nt, Human
ugcccugguagcagccac

SEQ ID NO: 1061637 - RNA, 18 nt, Human
ugccucagggauguaggg

SEQ ID NO: 1061638 - RNA, 22 nt, Human
ugccugaaggacaucccuuaac

SEQ ID NO: 1061639 - RNA, 18 nt, Human
uggaaaccugcucccuuc

SEQ ID NO: 1061640 - RNA, 22 nt, Human
uggcagcaggcaaggugcgggu

SEQ ID NO: 1061641 - RNA, 24 nt, Human
uggcugcagcugcacuugggaggg

SEQ ID NO: 1061642 - RNA, 18 nt, Human
uggcugcaguugcaccug

SEQ ID NO: 1061643 - RNA, 19 nt, Human
uggggccaccccacaaguc

SEQ ID NO: 1061644 - RNA, 23 nt, Human
uggggccaccccacaaguccugg

SEQ ID NO: 1061645 - RNA, 22 nt, Human
uguguggauccagauuuccauc

SEQ ID NO: 1061646 - RNA, 19 nt, Human
uuaauagcuguaaucuuuu

SEQ ID NO: 1061647 - RNA, 24 nt, Human
uucccaugcuugucagccuccaca

SEQ ID NO: 1061648 - RNA, 23 nt, Human
uuccccccuuuuagucuuuaagc

SEQ ID NO: 1061649 - RNA, 24 nt, Human
aaagugcugggauuauagguguga

SEQ ID NO: 1061650 - RNA, 22 nt, Human
aaguagcagggauuacaggcau

SEQ ID NO: 1061651 - RNA, 24 nt, Human
aaguagcagggauuacaggcaugc

SEQ ID NO: 1061652 - RNA, 27 nt, Human
aagugauucuccugccucagucuccca

SEQ ID NO: 1061653 - RNA, 18 nt, Human
aagugcugggauuauagg

SEQ ID NO: 1061654 - RNA, 26 nt, Human
aagugcugggauuauaggugugagcc

SEQ ID NO: 1061655 - RNA, 22 nt, Human
aaguuuagucuuccugaaguuc

SEQ ID NO: 1061656 - RNA, 18 nt, Human
acaggguuucaccauguu

SEQ ID NO: 1061657 - RNA, 21 nt, Human
acaggguuucaccauguuggc

SEQ ID NO: 1061658 - RNA, 24 nt, Human
acaggguuucaccauguuggccag

SEQ ID NO: 1061659 - RNA, 24 nt, Human
accauguuggccaggcuggucucg

SEQ ID NO: 1061660 - RNA, 18 nt, Human
acucugucacccagacug

SEQ ID NO: 1061661 - RNA, 25 nt, Human
acucugucacccagacuggagugca

SEQ ID NO: 1061662 - RNA, 22 nt, Human
acuuuuuguauuuuuaguagag

SEQ ID NO: 1061663 - RNA, 21 nt, Human
agcaaucccccagccucggcc

SEQ ID NO: 1061664 - RNA, 18 nt, Human
aggcagccauggccacua

SEQ ID NO: 1061665 - RNA, 20 nt, Human
aggcagccauggccacuagu

SEQ ID NO: 1061666 - RNA, 20 nt, Human
aggugugagccacugcaccc

SEQ ID NO: 1061667 - RNA, 21 nt, Human
agguucaagugauucuccugc

SEQ ID NO: 1061668 - RNA, 22 nt, Human
agguucaagugauucuccugcc

SEQ ID NO: 1061669 - RNA, 23 nt, Human
agguucaagugauucuccugccu

SEQ ID NO: 1061670 - RNA, 24 nt, Human
agugauucuccugccucagucucc

SEQ ID NO: 1061671 - RNA, 24 nt, Human
agugcagugccacaaucucagcuc

SEQ ID NO: 1061672 - RNA, 18 nt, Human
auucuccugccucagucu

SEQ ID NO: 1061673 - RNA, 24 nt, Human
caaagugcugggauuauaggugug

SEQ ID NO: 1061674 - RNA, 21 nt, Human
caagugauucuccugccucag

SEQ ID NO: 1061675 - RNA, 20 nt, Human
caaucucagcucacagcaac

SEQ ID NO: 1061676 - RNA, 21 nt, Human
caccauguuggccaggcuggu

SEQ ID NO: 1061677 - RNA, 24 nt, Human
caccauguuggccaggcuggucuc

SEQ ID NO: 1061678 - RNA, 27 nt, Human
caccauguuggccaggcuggucucgaa

SEQ ID NO: 1061679 - RNA, 21 nt, Human
caccccgcagcagccaauccu

SEQ ID NO: 1061680 - RNA, 23 nt, Human
cacucugucacccagacuggagu

SEQ ID NO: 1061681 - RNA, 24 nt, Human
cacucugucacccagacuggagug

SEQ ID NO: 1061682 - RNA, 24 nt, Human
cagcaaccuccgccucccagguuc

SEQ ID NO: 1061683 - RNA, 24 nt, Human
caggguuucaccauguuggccagg

SEQ ID NO: 1061684 - RNA, 24 nt, Human
cauguuggccaggcuggucucgaa

SEQ ID NO: 1061685 - RNA, 21 nt, Human
ccaaagugcugggauuauagg

SEQ ID NO: 1061686 - RNA, 24 nt, Human
ccaaagugcugggauuauaggugu

SEQ ID NO: 1061687 - RNA, 24 nt, Human
ccaaguagcagggauuacaggcau

SEQ ID NO: 1061688 - RNA, 21 nt, Human
ccacugcacccggccuccaag

SEQ ID NO: 1061689 - RNA, 21 nt, Human
ccacugcacccggccuccaag

SEQ ID NO: 1061690 - RNA, 22 nt, Human
ccacugcacccggccuccaagc

SEQ ID NO: 1061691 - RNA, 19 nt, Human
cccaaguagcagggauuac

SEQ ID NO: 1061692 - RNA, 24 nt, Human
cccaaguagcagggauuacaggca

SEQ ID NO: 1061693 - RNA, 23 nt, Human
cccagguucaagugauucuccuc

SEQ ID NO: 1061694 - RNA, 23 nt, Human
cccagguucaagugauucuccug

SEQ ID NO: 1061695 - RNA, 24 nt, Human
ccgccucccagguucaagugauuc

SEQ ID NO: 1061696 - RNA, 28 nt, Human
ccggccuccaagccagcaucuuuaaucu

SEQ ID NO: 1061697 - RNA, 24 nt, Human
ccucccagguucaagugauucucc

SEQ ID NO: 1061698 - RNA, 22 nt, Human
cgccucccagguucaagugauu

SEQ ID NO: 1061699 - RNA, 21 nt, Human
cgucacagugucccuucggga

SEQ ID NO: 1061700 - RNA, 24 nt, Human
cucacagcaaccuccgccucccag

SEQ ID NO: 1061701 - RNA, 19 nt, Human
cucccagguucaagugauu

SEQ ID NO: 1061702 - RNA, 21 nt, Human
cugggauuauaggugugagcc

SEQ ID NO: 1061703 - RNA, 25 nt, Human
cuucaguagcgcggcgucacagugu

SEQ ID NO: 1061704 - RNA, 24 nt, Human
cuuuuuguauuuuuaguagagaca

SEQ ID NO: 1061705 - RNA, 24 nt, Human
gaaccuacuccagaaauggacugg

SEQ ID NO: 1061706 - RNA, 23 nt, Human
gaacuccugacgucaagcaaucc

SEQ ID NO: 1061707 - RNA, 20 nt, Human
gaaguuccccuacgucccaa

SEQ ID NO: 1061708 - RNA, 22 nt, Human
gaaguuccccuacgucccaagu

SEQ ID NO: 1061709 - RNA, 24 nt, Human
gauuacaggcaugcaccaccaugc

SEQ ID NO: 1061710 - RNA, 18 nt, Human
gauuauaggugugagcca

SEQ ID NO: 1061711 - RNA, 22 nt, Human
gauuauaggugugagccacugc

SEQ ID NO: 1061712 - RNA, 23 nt, Human
gauuauaggugugagccacugca

SEQ ID NO: 1061713 - RNA, 22 nt, Human
gcaaccuccgccucccagguuc

SEQ ID NO: 1061714 - RNA, 23 nt, Human
gccucagucucccaaguagcagg

SEQ ID NO: 1061715 - RNA, 24 nt, Human
ggauuacaggcaugcaccaccaug

SEQ ID NO: 1061716 - RNA, 23 nt, Human
gggauuacaggcaugcaccacca

SEQ ID NO: 1061717 - RNA, 21 nt, Human
gggcggaagcggcgaggcggu

SEQ ID NO: 1061718 - RNA, 22 nt, Human
ggguuucaccauguuggccagg

SEQ ID NO: 1061719 - RNA, 20 nt, Human
gucacagugucccuucggga

SEQ ID NO: 1061720 - RNA, 19 nt, Human
guggccgccaugcuucuga

SEQ ID NO: 1061721 - RNA, 20 nt, Human
uaaaaaguagauaccaaggc

SEQ ID NO: 1061722 - RNA, 22 nt, Human
uacaggcaugcaccaccaugcc

SEQ ID NO: 1061723 - RNA, 22 nt, Human
uagagacaggguuucaccaugu

SEQ ID NO: 1061724 - RNA, 25 nt, Human
uaggacacagagagaagaaccuacu

SEQ ID NO: 1061725 - RNA, 19 nt, Human
uaggccucaaccucuccag

SEQ ID NO: 1061726 - RNA, 24 nt, Human
uaguagagacaggguuucaccaug

SEQ ID NO: 1061727 - RNA, 25 nt, Human
uaguagagacaggguuucaccaugu

SEQ ID NO: 1061728 - RNA, 19 nt, Human
uauaggugugagccacugc

SEQ ID NO: 1061729 - RNA, 19 nt, Human
ucaagugauucuccugccu

SEQ ID NO: 1061730 - RNA, 24 nt, Human
ucacagcaaccuccgccucccagg

SEQ ID NO: 1061731 - RNA, 25 nt, Human
ucacagcaaccuccgccucccaggu

SEQ ID NO: 1061732 - RNA, 24 nt, Human
ucacagucacccccacuuuaaucc

SEQ ID NO: 1061733 - RNA, 23 nt, Human
ucccaaagugcugggauuauagg

SEQ ID NO: 1061734 - RNA, 24 nt, Human
ucccaaguagcagggauuacaggc

SEQ ID NO: 1061735 - RNA, 21 nt, Human
ucccagguucaagugauucuc

SEQ ID NO: 1061736 - RNA, 24 nt, Human
ucccagguucaagugauucuccug

SEQ ID NO: 1061737 - RNA, 19 nt, Human
ucccccagccucggccucc

SEQ ID NO: 1061738 - RNA, 20 nt, Human
ucccccagccucggccuccc

SEQ ID NO: 1061739 - RNA, 24 nt, Human
uccgcaggcagccuggaacagucu

SEQ ID NO: 1061740 - RNA, 27 nt, Human
uccgcaggcagccuggaacagucuaga

SEQ ID NO: 1061741 - RNA, 19 nt, Human
uccgggaacccaggcgccu

SEQ ID NO: 1061742 - RNA, 18 nt, Human
ucggccucccaaagugcu

SEQ ID NO: 1061743 - RNA, 25 nt, Human
ucguguugccaacuguuuggcgucc

SEQ ID NO: 1061744 - RNA, 24 nt, Human
ucucacucugucacccagacugga

SEQ ID NO: 1061745 - RNA, 26 nt, Human
ucucacucugucacccagacuggagu

SEQ ID NO: 1061746 - RNA, 27 nt, Human
ucucacucugucacccagacuggagug

SEQ ID NO: 1061747 - RNA, 19 nt, Human
ucucccaaguagcagggau

SEQ ID NO: 1061748 - RNA, 20 nt, Human
ucucccaaguagcagggauu

SEQ ID NO: 1061749 - RNA, 21 nt, Human
ucucgaacuccugacgucaag

SEQ ID NO: 1061750 - RNA, 24 nt, Human
ucugucacccagacuggagugcag

SEQ ID NO: 1061751 - RNA, 20 nt, Human
ugacgucaagcaauccccca

SEQ ID NO: 1061752 - RNA, 21 nt, Human
ugccacaaucucagcucacag

SEQ ID NO: 1061753 - RNA, 20 nt, Human
ugccucagucucccaaguag

SEQ ID NO: 1061754 - RNA, 19 nt, Human
uggagugcagugccacaau

SEQ ID NO: 1061755 - RNA, 23 nt, Human
uggagugcagugccacaaucuca

SEQ ID NO: 1061756 - RNA, 28 nt, Human
uggcaaguccuuuccccgcuguaggccu

SEQ ID NO: 1061757 - RNA, 20 nt, Human
uggcaguggcuggguuggug

SEQ ID NO: 1061758 - RNA, 24 nt, Human
uggccaggcuggucucgaacuccu

SEQ ID NO: 1061759 - RNA, 18 nt, Human
ugggauuauaggugugag

SEQ ID NO: 1061760 - RNA, 19 nt, Human
ugggauuauaggugugagc

SEQ ID NO: 1061761 - RNA, 21 nt, Human
ugggauuauaggugugagcca

SEQ ID NO: 1061762 - RNA, 22 nt, Human
ugggauuauaggugugagccac

SEQ ID NO: 1061763 - RNA, 22 nt, Human
ugggauuauaggugugagccac

SEQ ID NO: 1061764 - RNA, 24 nt, Human
ugggauuauaggugugagccacug

SEQ ID NO: 1061765 - RNA, 18 nt, Human
uuaaucuuacagaugcgu

SEQ ID NO: 1061766 - RNA, 24 nt, Human
uuaguagagacaggguuucaccau

SEQ ID NO: 1061767 - RNA, 21 nt, Human
uucaagugauucuccugccuc

SEQ ID NO: 1061768 - RNA, 23 nt, Human
uucaagugauucuccugccucag

SEQ ID NO: 1061769 - RNA, 24 nt, Human
uucaagugauucuccugccucagu

SEQ ID NO: 1061770 - RNA, 24 nt, Human
uuucaccauguuggccaggcuggu

SEQ ID NO: 1061771 - RNA, 24 nt, Human
uuuuuaguagagacaggguuucac

SEQ ID NO: 1061772 - RNA, 21 nt, Human
uuuuuguauuuuuaguagaga

SEQ ID NO: 1061773 - RNA, 23 nt, Human
aagaauacaggcuccggaaucca

SEQ ID NO: 1061774 - RNA, 24 nt, Human
aaggagugaucaggggcaugcagg

SEQ ID NO: 1061775 - RNA, 19 nt, Human
agaaugccucccagagcuc

SEQ ID NO: 1061776 - RNA, 20 nt, Human
aggagcagggggccgggagg

SEQ ID NO: 1061777 - RNA, 22 nt, Human
agggcugcagccuucagccucc

SEQ ID NO: 1061778 - RNA, 20 nt, Human
aggggcaugcaggcuccugg

SEQ ID NO: 1061779 - RNA, 18 nt, Human
augaggaccaagcugcag

SEQ ID NO: 1061780 - RNA, 20 nt, Human
caccugagaucaguaguaga

SEQ ID NO: 1061781 - RNA, 21 nt, Human
cagaaugccucccagagcucc

SEQ ID NO: 1061782 - RNA, 18 nt, Human
cagaggagggcagagcuc

SEQ ID NO: 1061783 - RNA, 27 nt, Human
cagcccccaggaccccugcuucucccu

SEQ ID NO: 1061784 - RNA, 24 nt, Human
caggccccggagcaguucuggagg

SEQ ID NO: 1061785 - RNA, 21 nt, Human
caggcuggaguuuccuggagg

SEQ ID NO: 1061786 - RNA, 22 nt, Human
cauuuuacagauuagaccagcg

SEQ ID NO: 1061787 - RNA, 23 nt, Human
ccaaucccagcgccaggccacgc

SEQ ID NO: 1061788 - RNA, 22 nt, Human
ccagcgaggcacagagagguuu

SEQ ID NO: 1061789 - RNA, 24 nt, Human
ccagcgccaggccacgccuccuuc

SEQ ID NO: 1061790 - RNA, 24 nt, Human
ccaucuggaugacaagagggcugc

SEQ ID NO: 1061791 - RNA, 20 nt, Human
cccaccugcaucccuagagu

SEQ ID NO: 1061792 - RNA, 22 nt, Human
cccagcgccaggccacgccucc

SEQ ID NO: 1061793 - RNA, 23 nt, Human
cccaucguccagauccggagagu

SEQ ID NO: 1061794 - RNA, 24 nt, Human
ccccaggaccccugcuucucccac

SEQ ID NO: 1061795 - RNA, 25 nt, Human
ccccaggaccccugcuucucccacc

SEQ ID NO: 1061796 - RNA, 23 nt, Human
cccccaggaccccugcuucuccc

SEQ ID NO: 1061797 - RNA, 22 nt, Human
ccccugagccuccauuucaugg

SEQ ID NO: 1061798 - RNA, 25 nt, Human
ccccugcuucucccaccugcauccc

SEQ ID NO: 1061799 - RNA, 22 nt, Human
ccuucacccccugagccuccau

SEQ ID NO: 1061800 - RNA, 22 nt, Human
ccuucagccuccccccuugccc

SEQ ID NO: 1061801 - RNA, 19 nt, Human
cggaauccaaaagccaugg

SEQ ID NO: 1061802 - RNA, 25 nt, Human
cggaucccgacccgaucccaccccu

SEQ ID NO: 1061803 - RNA, 20 nt, Human
cggcaccuggacccuuccuu

SEQ ID NO: 1061804 - RNA, 25 nt, Human
cucaagauccgcggcaccuggaccc

SEQ ID NO: 1061805 - RNA, 23 nt, Human
cugggccucaguuuccccaucug

SEQ ID NO: 1061806 - RNA, 20 nt, Human
gaccccugcuucucccaccu

SEQ ID NO: 1061807 - RNA, 19 nt, Human
gagcucaccugagaucagu

SEQ ID NO: 1061808 - RNA, 20 nt, Human
gcccagaucaugaggaccaa

SEQ ID NO: 1061809 - RNA, 21 nt, Human
gcgaccaucaggaggaagcgc

SEQ ID NO: 1061810 - RNA, 23 nt, Human
ggcagcccccaggaccccugcuu

SEQ ID NO: 1061811 - RNA, 18 nt, Human
ggcccgggggaaccggcg

SEQ ID NO: 1061812 - RNA, 21 nt, Human
gggaaccggcguuccuggcgu

SEQ ID NO: 1061813 - RNA, 19 nt, Human
gggggccgggaggccuggg

SEQ ID NO: 1061814 - RNA, 18 nt, Human
uaaugaguuaaugagguc

SEQ ID NO: 1061815 - RNA, 23 nt, Human
uacagauuagaccagcgaggcac

SEQ ID NO: 1061816 - RNA, 22 nt, Human
uagcaccuugcuccagucacac

SEQ ID NO: 1061817 - RNA, 28 nt, Human
uaggggaugcugcccucuggcgaccauu

SEQ ID NO: 1061818 - RNA, 19 nt, Human
ucagaggccaggcuggagu

SEQ ID NO: 1061819 - RNA, 22 nt, Human
ucaggggcaugcaggcuccugg

SEQ ID NO: 1061820 - RNA, 18 nt, Human
ucccagagcuccaggcag

SEQ ID NO: 1061821 - RNA, 20 nt, Human
ucccagcgccaggccacgcc

SEQ ID NO: 1061822 - RNA, 20 nt, Human
ucccgacccgaucccacccc

SEQ ID NO: 1061823 - RNA, 18 nt, Human
uccggagaguggggccgg

SEQ ID NO: 1061824 - RNA, 19 nt, Human
ucguccagauccggagagu

SEQ ID NO: 1061825 - RNA, 21 nt, Human
ugaacuggggucagaggccag

SEQ ID NO: 1061826 - RNA, 20 nt, Human
ugagaaaagugacuuucaga

SEQ ID NO: 1061827 - RNA, 21 nt, Human
ugagaaaagugacuuucagag

SEQ ID NO: 1061828 - RNA, 22 nt, Human
ugagaaaagugacuuucagagg

SEQ ID NO: 1061829 - RNA, 24 nt, Human
ugaggaccaagcugcaggagcugg

SEQ ID NO: 1061830 - RNA, 21 nt, Human
ugcuucucccaccugcauccc

SEQ ID NO: 1061831 - RNA, 20 nt, Human
uggaugacaagagggcugca

SEQ ID NO: 1061832 - RNA, 24 nt, Human
ugguuaagaauacaggcuccggaa

SEQ ID NO: 1061833 - RNA, 20 nt, Human
uuucagaggagggcagagcu

SEQ ID NO: 1061834 - RNA, 20 nt, Human
uuuccuggaggaaggagaag

SEQ ID NO: 1061835 - RNA, 20 nt, Human
aaaagaaaacauugagaaga

SEQ ID NO: 1061836 - RNA, 23 nt, Human
aaaagaaaacauugagaagagac

SEQ ID NO: 1061837 - RNA, 22 nt, Human
aaaugcagauaaucccaguuca

SEQ ID NO: 1061838 - RNA, 21 nt, Human
accaaaugcagauaaucccag

SEQ ID NO: 1061839 - RNA, 21 nt, Human
accuggagguuggaugcagcu

SEQ ID NO: 1061840 - RNA, 19 nt, Human
caaaagaaaacauugagaa

SEQ ID NO: 1061841 - RNA, 18 nt, Human
cagcaagacugucagagg

SEQ ID NO: 1061842 - RNA, 18 nt, Human
cagcaucuucagcuccug

SEQ ID NO: 1061843 - RNA, 21 nt, Human
ccuucccaauuuugaguuccu

SEQ ID NO: 1061844 - RNA, 27 nt, Human
gaaaacauugagaagagaccgguaccc

SEQ ID NO: 1061845 - RNA, 21 nt, Human
gaaaucaaaagaaaacauuga

SEQ ID NO: 1061846 - RNA, 23 nt, Human
gaagagcagcaagacugucagag

SEQ ID NO: 1061847 - RNA, 18 nt, Human
gacaggauugcuugguuc

SEQ ID NO: 1061848 - RNA, 24 nt, Human
gacugucagaggaaaucaaaagaa

SEQ ID NO: 1061849 - RNA, 19 nt, Human
gcagcagugggcauucugu

SEQ ID NO: 1061850 - RNA, 24 nt, Human
gcuuguguuccuguacagcaucuu

SEQ ID NO: 1061851 - RNA, 22 nt, Human
guuccuguacagcaucuucagc

SEQ ID NO: 1061852 - RNA, 20 nt, Human
ucagaggaaaucaaaagaaa

SEQ ID NO: 1061853 - RNA, 24 nt, Human
ucccaguucaggguguucacuuuu

SEQ ID NO: 1061854 - RNA, 18 nt, Human
ugggaaggagcagcagug

SEQ ID NO: 1061855 - RNA, 21 nt, Human
ugggaaggagcagcagugggc

SEQ ID NO: 1061856 - RNA, 25 nt, Human
ugguucucugccaaauuugaccugg

SEQ ID NO: 1061857 - RNA, 20 nt, Human
uuuugaguuccugugccucu

SEQ ID NO: 1061858 - RNA, 18 nt, Human
aagagaaaggcaggggcg

SEQ ID NO: 1061859 - RNA, 22 nt, Human
acagggccugauggaggaagag

SEQ ID NO: 1061860 - RNA, 19 nt, Human
aggcaggggcgggcacagg

SEQ ID NO: 1061861 - RNA, 19 nt, Human
aggcaggggcgggcacagg

SEQ ID NO: 1061862 - RNA, 21 nt, Human
aggcaggggcgggcacagggu

SEQ ID NO: 1061863 - RNA, 18 nt, Human
aggggcgggcacagggug

SEQ ID NO: 1061864 - RNA, 22 nt, Human
agguugccagcauacagggccu

SEQ ID NO: 1061865 - RNA, 19 nt, Human
aucucucuggaaagcaggu

SEQ ID NO: 1061866 - RNA, 20 nt, Human
cagaagacgucucuggucug

SEQ ID NO: 1061867 - RNA, 21 nt, Human
cagaagacgucucuggucugu

SEQ ID NO: 1061868 - RNA, 21 nt, Human
caggguggaauugacaaccgu

SEQ ID NO: 1061869 - RNA, 18 nt, Human
cccacaugugagacuaca

SEQ ID NO: 1061870 - RNA, 23 nt, Human
cccacaugugagacuacauggac

SEQ ID NO: 1061871 - RNA, 21 nt, Human
cuguaggccgaccccacaugu

SEQ ID NO: 1061872 - RNA, 18 nt, Human
guggauggccgcccgggc

SEQ ID NO: 1061873 - RNA, 22 nt, Human
ucucuggaaagcagguggcugc

SEQ ID NO: 1061874 - RNA, 27 nt, Human
ucucuggaaagcagguggcugcagaag

SEQ ID NO: 1061875 - RNA, 18 nt, Human
uggaggaagagaaaggca

SEQ ID NO: 1061876 - RNA, 24 nt, Human
uggcugcagaagacgucucugguc

SEQ ID NO: 1061877 - RNA, 23 nt, Human
acaggaaggagcacugggcugga

SEQ ID NO: 1061878 - RNA, 19 nt, Human
aggaaggagcacugggcug

SEQ ID NO: 1061879 - RNA, 23 nt, Human
aucccgaggccaaaagccgaagc

SEQ ID NO: 1061880 - RNA, 24 nt, Human
cccaacaagccugauucuauuucu

SEQ ID NO: 1061881 - RNA, 18 nt, Human
cgaggccaaaagccgaag

SEQ ID NO: 1061882 - RNA, 19 nt, Human
ggaucuugcuuuccagaua

SEQ ID NO: 1061883 - RNA, 18 nt, Human
uccccaacaagccugauu

SEQ ID NO: 1061884 - RNA, 19 nt, Human
uggacaucccgaggccaaa

SEQ ID NO: 1061885 - RNA, 18 nt, Human
ugggcuggacaucccgag

SEQ ID NO: 1061886 - RNA, 20 nt, Human
uucuuuggcccagauucuag

SEQ ID NO: 1061887 - RNA, 19 nt, Human
acaggaaucgcccuggcag

SEQ ID NO: 1061888 - RNA, 25 nt, Human
agaaggcaggaccguugggcagggc

SEQ ID NO: 1061889 - RNA, 22 nt, Human
cagagggcagcgcugcugagga

SEQ ID NO: 1061890 - RNA, 19 nt, Human
cccuggcagccugucucug

SEQ ID NO: 1061891 - RNA, 22 nt, Human
ccuggccagagcucgaguccca

SEQ ID NO: 1061892 - RNA, 24 nt, Human
cgaggcggggccgcagcggccguc

SEQ ID NO: 1061893 - RNA, 19 nt, Human
cucauuuuucgacgcagcu

SEQ ID NO: 1061894 - RNA, 25 nt, Human
gaaggcaggaccguugggcagggcg

SEQ ID NO: 1061895 - RNA, 20 nt, Human
gagcucgagucccacgacaa

SEQ ID NO: 1061896 - RNA, 20 nt, Human
gccgcagcggccgucggggc

SEQ ID NO: 1061897 - RNA, 18 nt, Human
gccgucggggcuggggcu

SEQ ID NO: 1061898 - RNA, 20 nt, Human
gcuucauggaaggccaggcu

SEQ ID NO: 1061899 - RNA, 18 nt, Human
ggcagccugucucuggga

SEQ ID NO: 1061900 - RNA, 20 nt, Human
gggcgccagcagagggcagc

SEQ ID NO: 1061901 - RNA, 19 nt, Human
gggcuggggcuggucccgg

SEQ ID NO: 1061902 - RNA, 21 nt, Human
ucccuggccagagcucgaguc

SEQ ID NO: 1061903 - RNA, 23 nt, Human
ucggggcuggggcuggucccggc

SEQ ID NO: 1061904 - RNA, 19 nt, Human
ugucucugggaaaagaauu

SEQ ID NO: 1061905 - RNA, 23 nt, Human
aaaaaagaaaccuuuaaaaauau

SEQ ID NO: 1061906 - RNA, 22 nt, Human
aaaaagaaaaggaaaaacaaaa

SEQ ID NO: 1061907 - RNA, 24 nt, Human
aaaaagaaaaggaaaaacaaaaaa

SEQ ID NO: 1061908 - RNA, 24 nt, Human
aaaaauauuguagcaauagccuuc

SEQ ID NO: 1061909 - RNA, 21 nt, Human
aaaacucuaggaagaguucca

SEQ ID NO: 1061910 - RNA, 23 nt, Human
aaaagaaaaggaaaaacaaaaaa

SEQ ID NO: 1061911 - RNA, 23 nt, Human
aaaaggaaaaacaaaaaauuuca

SEQ ID NO: 1061912 - RNA, 23 nt, Human
aaacuaaaucucucugaaaaaua

SEQ ID NO: 1061913 - RNA, 20 nt, Human
aaagagacagacagacaggg

SEQ ID NO: 1061914 - RNA, 18 nt, Human
aaaggaagagaaagagac

SEQ ID NO: 1061915 - RNA, 21 nt, Human
aaauaauaugcuuugaaaccc

SEQ ID NO: 1061916 - RNA, 21 nt, Human
aacagcuuaagacacuuggug

SEQ ID NO: 1061917 - RNA, 23 nt, Human
aaguggcaccaaauuuauggcaa

SEQ ID NO: 1061918 - RNA, 20 nt, Human
acaaagagcaagucuacuuu

SEQ ID NO: 1061919 - RNA, 19 nt, Human
acuggacuaagacacugaa

SEQ ID NO: 1061920 - RNA, 22 nt, Human
agaaagagacagacagacagag

SEQ ID NO: 1061921 - RNA, 21 nt, Human
agacagacagacagagacaga

SEQ ID NO: 1061922 - RNA, 22 nt, Human
agacagacagacagagacagag

SEQ ID NO: 1061923 - RNA, 19 nt, Human
agacagagacagagacagg

SEQ ID NO: 1061924 - RNA, 23 nt, Human
agacagggagaggagagggaggu

SEQ ID NO: 1061925 - RNA, 28 nt, Human
agagacagagacagggagaggagaggga

SEQ ID NO: 1061926 - RNA, 25 nt, Human
agagagcagggcuggcacagagccc

SEQ ID NO: 1061927 - RNA, 18 nt, Human
agaggcaagcccugcuuc

SEQ ID NO: 1061928 - RNA, 23 nt, Human
aggaaaaacaaaaaauuucaaag

SEQ ID NO: 1061929 - RNA, 18 nt, Human
agggagugggaauaaggc

SEQ ID NO: 1061930 - RNA, 19 nt, Human
augguagaugagaaaguag

SEQ ID NO: 1061931 - RNA, 20 nt, Human
caagcaaaaaaucccaacca

SEQ ID NO: 1061932 - RNA, 23 nt, Human
caagguuguuuggaaaucugaca

SEQ ID NO: 1061933 - RNA, 20 nt, Human
caaucuucaacuuauucaca

SEQ ID NO: 1061934 - RNA, 19 nt, Human
cagaaacaguucacaagag

SEQ ID NO: 1061935 - RNA, 21 nt, Human
cagacagacagagacagagac

SEQ ID NO: 1061936 - RNA, 20 nt, Human
cagagacagagacagggaga

SEQ ID NO: 1061937 - RNA, 26 nt, Human
cagcacaaacuaacaacauucaaaau

SEQ ID NO: 1061938 - RNA, 18 nt, Human
cagggcuggcacagagcc

SEQ ID NO: 1061939 - RNA, 18 nt, Human
caugauucuugcgcugcc

SEQ ID NO: 1061940 - RNA, 21 nt, Human
ccacacuuccugccucugauc

SEQ ID NO: 1061941 - RNA, 22 nt, Human
ccacacuuccugccucugaucc

SEQ ID NO: 1061942 - RNA, 18 nt, Human
cccagccucuccacuucc

SEQ ID NO: 1061943 - RNA, 21 nt, Human
ccccacaaucuucaacuuauu

SEQ ID NO: 1061944 - RNA, 21 nt, Human
ccccaguuucucucuaugaaa

SEQ ID NO: 1061945 - RNA, 22 nt, Human
ccucccagccucuccacuucca

SEQ ID NO: 1061946 - RNA, 21 nt, Human
ccugcccugcacgaauauccc

SEQ ID NO: 1061947 - RNA, 21 nt, Human
cucauccccugcuucacaagc

SEQ ID NO: 1061948 - RNA, 26 nt, Human
cugagauaaggucgguuaaagcuuau

SEQ ID NO: 1061949 - RNA, 26 nt, Human
cugcacgaauaucccuguggaguccc

SEQ ID NO: 1061950 - RNA, 19 nt, Human
cuuagcaacuuuccacacu

SEQ ID NO: 1061951 - RNA, 24 nt, Human
cuuuccacacuuccugccucugau

SEQ ID NO: 1061952 - RNA, 22 nt, Human
cuuuucagccuucuggugaaca

SEQ ID NO: 1061953 - RNA, 19 nt, Human
gaauguaaacaccauauac

SEQ ID NO: 1061954 - RNA, 20 nt, Human
gacagagacagagacaggga

SEQ ID NO: 1061955 - RNA, 18 nt, Human
gagaaaaaguagccccac

SEQ ID NO: 1061956 - RNA, 19 nt, Human
gaggacagaggcaagcccu

SEQ ID NO: 1061957 - RNA, 20 nt, Human
gcccugcacgaauaucccug

SEQ ID NO: 1061958 - RNA, 18 nt, Human
gcuccugccuccuuuuga

SEQ ID NO: 1061959 - RNA, 19 nt, Human
ggaauggauacacaaugag

SEQ ID NO: 1061960 - RNA, 24 nt, Human
ggaccccucccagccucuccacuu

SEQ ID NO: 1061961 - RNA, 19 nt, Human
uaacaaauauaaaacagcu

SEQ ID NO: 1061962 - RNA, 24 nt, Human
uaagacacugaauucuguaagccc

SEQ ID NO: 1061963 - RNA, 20 nt, Human
uacaagcaaaaaaucccaac

SEQ ID NO: 1061964 - RNA, 23 nt, Human
uacaagcaaaaaaucccaaccac

SEQ ID NO: 1061965 - RNA, 19 nt, Human
uauagcacagggaaagggc

SEQ ID NO: 1061966 - RNA, 22 nt, Human
uaucccuguggaguccccggga

SEQ ID NO: 1061967 - RNA, 25 nt, Human
uaugaaacucauccccugcuucaca

SEQ ID NO: 1061968 - RNA, 24 nt, Human
uaugcuuugaaacccucuguuaca

SEQ ID NO: 1061969 - RNA, 27 nt, Human
uauuuuggaaagacaaguuaugauuau

SEQ ID NO: 1061970 - RNA, 19 nt, Human
ucacuccauuaaaguaaaa

SEQ ID NO: 1061971 - RNA, 18 nt, Human
ucagaaaccacagaaaca

SEQ ID NO: 1061972 - RNA, 21 nt, Human
ucagucaaauaaauaaaagaa

SEQ ID NO: 1061973 - RNA, 21 nt, Human
uccacacuuccugccucugau

SEQ ID NO: 1061974 - RNA, 21 nt, Human
ucccaaccacuucacagucac

SEQ ID NO: 1061975 - RNA, 24 nt, Human
ucccaaccacuucacagucacucc

SEQ ID NO: 1061976 - RNA, 18 nt, Human
uccccgggaggacagagg

SEQ ID NO: 1061977 - RNA, 21 nt, Human
ucgccacauauucuuucccaa

SEQ ID NO: 1061978 - RNA, 25 nt, Human
ucucuacuuuauucagaaaccacag

SEQ ID NO: 1061979 - RNA, 22 nt, Human
ucuuccuuuucagccuucuggu

SEQ ID NO: 1061980 - RNA, 24 nt, Human
ucuuccuuuucagccuucugguga

SEQ ID NO: 1061981 - RNA, 22 nt, Human
ugaaagacucaggcuccagagu

SEQ ID NO: 1061982 - RNA, 18 nt, Human
ugaacaaaacagaacuau

SEQ ID NO: 1061983 - RNA, 18 nt, Human
ugagaaaaaguagcccca

SEQ ID NO: 1061984 - RNA, 21 nt, Human
ugagaaaaaguagccccacaa

SEQ ID NO: 1061985 - RNA, 20 nt, Human
ugagaaaguagaaauaaggg

SEQ ID NO: 1061986 - RNA, 22 nt, Human
ugcaugauucuugcgcugccca

SEQ ID NO: 1061987 - RNA, 20 nt, Human
uggaguccccgggaggacag

SEQ ID NO: 1061988 - RNA, 21 nt, Human
uggaucuuuaggucugaaaua

SEQ ID NO: 1061989 - RNA, 22 nt, Human
uggaucuuuaggucugaaauau

SEQ ID NO: 1061990 - RNA, 18 nt, Human
uggcacagagccccugcc

SEQ ID NO: 1061991 - RNA, 23 nt, Human
uggcacagagccccugcccugca

SEQ ID NO: 1061992 - RNA, 22 nt, Human
uggcucagcagcaacccaaggg

SEQ ID NO: 1061993 - RNA, 23 nt, Human
uggugaacaaaacagaacuauuu

SEQ ID NO: 1061994 - RNA, 22 nt, Human
uguaaagaugcuauuuggcuca

SEQ ID NO: 1061995 - RNA, 22 nt, Human
uuagcaacuuuccacacuuccu

SEQ ID NO: 1061996 - RNA, 23 nt, Human
uucaaaauaaagugcuaugagaa

SEQ ID NO: 1061997 - RNA, 20 nt, Human
uucaaaguuaaaaaagaaac

SEQ ID NO: 1061998 - RNA, 21 nt, Human
uucaaaguuaaaaaagaaacc

SEQ ID NO: 1061999 - RNA, 30 nt, Human
uucaaaguuaaaaaagaaaccuuuaaaaaa

SEQ ID NO: 1062000 - RNA, 20 nt, Human
uuccacacuuccugccucug

SEQ ID NO: 1062001 - RNA, 20 nt, Human
uuccugccucugaucccacu

SEQ ID NO: 1062002 - RNA, 21 nt, Human
uuuaaaauaaauaauugguuc

SEQ ID NO: 1062003 - RNA, 24 nt, Human
uuucaaaguuaaaaaagaaaccuu

SEQ ID NO: 1062004 - RNA, 18 nt, Human
aaauccaagauccacccc

SEQ ID NO: 1062005 - RNA, 18 nt, Human
aacccgcgauccaccccc

SEQ ID NO: 1062006 - RNA, 21 nt, Human
aacccgcgauccacccccaaa

SEQ ID NO: 1062007 - RNA, 29 nt, Human
acaacccgcgauccacccccaaauccaaa

SEQ ID NO: 1062008 - RNA, 18 nt, Human
accacagccuucagcagc

SEQ ID NO: 1062009 - RNA, 21 nt, Human
accacagccuucagcagcgac

SEQ ID NO: 1062010 - RNA, 24 nt, Human
acccgcgauccacccccaaaucca

SEQ ID NO: 1062011 - RNA, 23 nt, Human
auccaagauccacccccaaaccc

SEQ ID NO: 1062012 - RNA, 19 nt, Human
caacccgcgauccaccccc

SEQ ID NO: 1062013 - RNA, 22 nt, Human
caacccgcgauccacccccaaa

SEQ ID NO: 1062014 - RNA, 22 nt, Human
caagaucugaauccugagugug

SEQ ID NO: 1062015 - RNA, 21 nt, Human
caccacagccuucagcagcga

SEQ ID NO: 1062016 - RNA, 19 nt, Human
caccacccgcuccugagcc

SEQ ID NO: 1062017 - RNA, 22 nt, Human
caccacccgcuccugagccgcc

SEQ ID NO: 1062018 - RNA, 20 nt, Human
cacccagccccaaauccgcc

SEQ ID NO: 1062019 - RNA, 25 nt, Human
cacccccaaacccgcgauguagcuc

SEQ ID NO: 1062020 - RNA, 21 nt, Human
cacccccaaauccaagaucca

SEQ ID NO: 1062021 - RNA, 20 nt, Human
cagacgcccaccacccgcuc

SEQ ID NO: 1062022 - RNA, 23 nt, Human
cagccccaaauccgccauccccc

SEQ ID NO: 1062023 - RNA, 21 nt, Human
cagccuccgaccucucagacc

SEQ ID NO: 1062024 - RNA, 22 nt, Human
cagcgacacucgcagccuccga

SEQ ID NO: 1062025 - RNA, 23 nt, Human
caucccccccacaacccgcgauc

SEQ ID NO: 1062026 - RNA, 28 nt, Human
ccacccccaaauccaagauccacccccu

SEQ ID NO: 1062027 - RNA, 20 nt, Human
cccaaauccaagauccaccc

SEQ ID NO: 1062028 - RNA, 26 nt, Human
cccacaacccgcgauccacccccaaa

SEQ ID NO: 1062029 - RNA, 22 nt, Human
ccccaaacccgcgauguagcuc

SEQ ID NO: 1062030 - RNA, 21 nt, Human
ccccaaauccaagauccaccc

SEQ ID NO: 1062031 - RNA, 23 nt, Human
ccccaaauccgccauccccccca

SEQ ID NO: 1062032 - RNA, 26 nt, Human
ccccacaacccgcgauccacccccaa

SEQ ID NO: 1062033 - RNA, 22 nt, Human
ccccacccagccccaaauccgc

SEQ ID NO: 1062034 - RNA, 21 nt, Human
cccccaaacccgcgauguagc

SEQ ID NO: 1062035 - RNA, 18 nt, Human
cccccaaauccaagaucc

SEQ ID NO: 1062036 - RNA, 25 nt, Human
cccccacaacccgcgauccaccccc

SEQ ID NO: 1062037 - RNA, 26 nt, Human
cccccacaacccgcgauccacccccc

SEQ ID NO: 1062038 - RNA, 18 nt, Human
cccccacccagccccaaa

SEQ ID NO: 1062039 - RNA, 23 nt, Human
ccccccacaacccgcgauccacc

SEQ ID NO: 1062040 - RNA, 22 nt, Human
cccccccacaacccgcgaucca

SEQ ID NO: 1062041 - RNA, 19 nt, Human
cccgcgauccacccccaau

SEQ ID NO: 1062042 - RNA, 21 nt, Human
ccgccgcggcuccucguggcc

SEQ ID NO: 1062043 - RNA, 21 nt, Human
ccgccgcggcuccucguggcc

SEQ ID NO: 1062044 - RNA, 22 nt, Human
ccgccgcggcuccucguggccu

SEQ ID NO: 1062045 - RNA, 23 nt, Human
ccucguggccuuuccacccccac

SEQ ID NO: 1062046 - RNA, 27 nt, Human
cggcuccucguggccuuuccacccccu

SEQ ID NO: 1062047 - RNA, 21 nt, Human
cgugcagagugucgauaucgc

SEQ ID NO: 1062048 - RNA, 21 nt, Human
cucguggccuuuccaccccca

SEQ ID NO: 1062049 - RNA, 22 nt, Human
cugagccgccgcggcuccucgu

SEQ ID NO: 1062050 - RNA, 25 nt, Human
gcuuucaacaagaucugaauccuga

SEQ ID NO: 1062051 - RNA, 20 nt, Human
gugugugugugugcgcccgu

SEQ ID NO: 1062052 - RNA, 18 nt, Human
uccaagauccacccccaa

SEQ ID NO: 1062053 - RNA, 20 nt, Human
uccgaccucucagaccgagu

SEQ ID NO: 1062054 - RNA, 19 nt, Human
uccugagccgccgcggcuc

SEQ ID NO: 1062055 - RNA, 20 nt, Human
ucucagaccgagugagcucc

SEQ ID NO: 1062056 - RNA, 24 nt, Human
ugagugugugugugugcgcccgug

SEQ ID NO: 1062057 - RNA, 20 nt, Human
ugcuggaggagaucaccaag

SEQ ID NO: 1062058 - RNA, 23 nt, Human
uggggacagacuugcuggaggag

SEQ ID NO: 1062059 - RNA, 24 nt, Human
ugugugugugcgcccgugaauccc

SEQ ID NO: 1062060 - RNA, 20 nt, Human
uugcuggaggagaucaccaa

SEQ ID NO: 1062061 - RNA, 21 nt, Human
uuuccacccccacccagcccc

SEQ ID NO: 1062062 - RNA, 20 nt, Human
uuugaggagcacgugcagag

SEQ ID NO: 1062063 - RNA, 24 nt, Human
uuuugcaccuucuugucuuuuuuu

SEQ ID NO: 1062064 - RNA, 24 nt, Human
cagccuccagucugggcugcuccu

SEQ ID NO: 1062065 - RNA, 24 nt, Human
ccccugagaggcaaugaacuccug

SEQ ID NO: 1062066 - RNA, 19 nt, Human
ccgccagaaguucuccagu

SEQ ID NO: 1062067 - RNA, 24 nt, Human
ccuccagcugggucagccugaccc

SEQ ID NO: 1062068 - RNA, 20 nt, Human
ccuugcucaccuccuucagc

SEQ ID NO: 1062069 - RNA, 21 nt, Human
cgcaccagccgccagaaguuc

SEQ ID NO: 1062070 - RNA, 19 nt, Human
gaccugcugcucccgcacc

SEQ ID NO: 1062071 - RNA, 22 nt, Human
ugagaggccccugagaggcaau

SEQ ID NO: 1062072 - RNA, 19 nt, Human
ugagcacucuuggccucau

SEQ ID NO: 1062073 - RNA, 20 nt, Human
ugagcacucuuggccucaua

SEQ ID NO: 1062074 - RNA, 20 nt, Human
ugggcggguguagccuggga

SEQ ID NO: 1062075 - RNA, 21 nt, Human
uggugguguuggcaggguacu

SEQ ID NO: 1062076 - RNA, 25 nt, Human
aggcuaaaaaagaauuugugacuga

SEQ ID NO: 1062077 - RNA, 22 nt, Human
gagugaauuuuuucuuggggac

SEQ ID NO: 1062078 - RNA, 22 nt, Human
uaaaaaaccauauauauugugg

SEQ ID NO: 1062079 - RNA, 21 nt, Human
uaaaugauccaacauuuucuu

SEQ ID NO: 1062080 - RNA, 23 nt, Human
ugagagaaaauauuuuuucucua

SEQ ID NO: 1062081 - RNA, 22 nt, Human
acaucagugaccuugagagcuc

SEQ ID NO: 1062082 - RNA, 21 nt, Human
cagcuuccaggcgcagucccc

SEQ ID NO: 1062083 - RNA, 20 nt, Human
ccccgaggaaagggccgccu

SEQ ID NO: 1062084 - RNA, 21 nt, Human
ccugguaccaggcgggacccc

SEQ ID NO: 1062085 - RNA, 20 nt, Human
gcgcagucccccagcugagg

SEQ ID NO: 1062086 - RNA, 22 nt, Human
ggccgccuucuuuccagccagc

SEQ ID NO: 1062087 - RNA, 18 nt, Human
ucccccagcugagggggu

SEQ ID NO: 1062088 - RNA, 23 nt, Human
ucccccagcugagggggucccug

SEQ ID NO: 1062089 - RNA, 21 nt, Human
aaaaggcacaagcaccccaga

SEQ ID NO: 1062090 - RNA, 19 nt, Human
aagcaccccagacauucag

SEQ ID NO: 1062091 - RNA, 23 nt, Human
acgauccggagccaagauggcgc

SEQ ID NO: 1062092 - RNA, 26 nt, Human
aggaagcccuuauuuagcaaugcaga

SEQ ID NO: 1062093 - RNA, 20 nt, Human
agggaaggggaagcaugaua

SEQ ID NO: 1062094 - RNA, 26 nt, Human
cacaagcaccccagacauucaggccc

SEQ ID NO: 1062095 - RNA, 21 nt, Human
cagaacuuggcagaggcccca

SEQ ID NO: 1062096 - RNA, 22 nt, Human
cucuuucagaaggcaguucaaa

SEQ ID NO: 1062097 - RNA, 20 nt, Human
cugucuugucugugacucuc

SEQ ID NO: 1062098 - RNA, 26 nt, Human
cuucucagaaaaggcacaagcacccc

SEQ ID NO: 1062099 - RNA, 20 nt, Human
cuugauggggauguugagca

SEQ ID NO: 1062100 - RNA, 20 nt, Human
guagguagaaggcagaggaa

SEQ ID NO: 1062101 - RNA, 20 nt, Human
uagaaacuuuauuuccuaau

SEQ ID NO: 1062102 - RNA, 21 nt, Human
ucacagcagucccuucccaca

SEQ ID NO: 1062103 - RNA, 19 nt, Human
ucugugacucucgcugccc

SEQ ID NO: 1062104 - RNA, 19 nt, Human
ugcuugcugucuugucugu

SEQ ID NO: 1062105 - RNA, 21 nt, Human
uggcagaggccccacaucugu

SEQ ID NO: 1062106 - RNA, 18 nt, Human
uuuuguggacucaaaccu

SEQ ID NO: 1062107 - RNA, 20 nt, Human
agaauuuccauuucuugucu

SEQ ID NO: 1062108 - RNA, 24 nt, Human
auuagaauuuccauuucuugucuc

SEQ ID NO: 1062109 - RNA, 20 nt, Human
auuucuugucuccacauccc

SEQ ID NO: 1062110 - RNA, 18 nt, Human
ccacauccccaccuuccc

SEQ ID NO: 1062111 - RNA, 24 nt, Human
gacuccuguggcugaagcugggaa

SEQ ID NO: 1062112 - RNA, 18 nt, Human
uccacauccccaccuucc

SEQ ID NO: 1062113 - RNA, 18 nt, Human
uggcuucaggucuuggca

SEQ ID NO: 1062114 - RNA, 21 nt, Human
uuucuccccucucugagaccc

SEQ ID NO: 1062115 - RNA, 21 nt, Human
aaaaaaggugcucagccucca

SEQ ID NO: 1062116 - RNA, 18 nt, Human
aaaaaggugcucagccuc

SEQ ID NO: 1062117 - RNA, 19 nt, Human
aaaaaggugcucagccucc

SEQ ID NO: 1062118 - RNA, 22 nt, Human
acccaccucucucccuuccaaa

SEQ ID NO: 1062119 - RNA, 20 nt, Human
acccucccacccucccaccc

SEQ ID NO: 1062120 - RNA, 18 nt, Human
aggaugaaaagggaaggg

SEQ ID NO: 1062121 - RNA, 21 nt, Human
cacccaccucucucccuucca

SEQ ID NO: 1062122 - RNA, 23 nt, Human
cacccaccucucucccuuccaaa

SEQ ID NO: 1062123 - RNA, 24 nt, Human
cacccaccucucucccuuccaaaa

SEQ ID NO: 1062124 - RNA, 19 nt, Human
cacccucccacccucccac

SEQ ID NO: 1062125 - RNA, 21 nt, Human
cacccucccacccucccaccc

SEQ ID NO: 1062126 - RNA, 26 nt, Human
cacccucccacccucccacccaccuc

SEQ ID NO: 1062127 - RNA, 18 nt, Human
cagccuccaaaccauuuu

SEQ ID NO: 1062128 - RNA, 19 nt, Human
ccacccucccacccuccca

SEQ ID NO: 1062129 - RNA, 22 nt, Human
ccacccucccacccucccaccc

SEQ ID NO: 1062130 - RNA, 25 nt, Human
cccacccaccucucucccuuccaaa

SEQ ID NO: 1062131 - RNA, 19 nt, Human
cccacccucccacccuccc

SEQ ID NO: 1062132 - RNA, 20 nt, Human
cccucccacccucccaccca

SEQ ID NO: 1062133 - RNA, 26 nt, Human
ccucccacccaccucucucccuucca

SEQ ID NO: 1062134 - RNA, 21 nt, Human
ccucccacccucccacccacc

SEQ ID NO: 1062135 - RNA, 18 nt, Human
gggauaggaugaaaaggg

SEQ ID NO: 1062136 - RNA, 19 nt, Human
guucccccacccucccacc

SEQ ID NO: 1062137 - RNA, 22 nt, Human
uaaaaaaggugcucagccucca

SEQ ID NO: 1062138 - RNA, 21 nt, Human
ucccccacccucccacccucc

SEQ ID NO: 1062139 - RNA, 22 nt, Human
ucuuuguguucccccacccucc

SEQ ID NO: 1062140 - RNA, 18 nt, Human
uguguucccccacccucc

SEQ ID NO: 1062141 - RNA, 26 nt, Human
uguucccccacccucccacccuccca

SEQ ID NO: 1062142 - RNA, 24 nt, Human
uucccccacccucccacccuccca

SEQ ID NO: 1062143 - RNA, 23 nt, Human
cucguuguggcucugccuccuug

SEQ ID NO: 1062144 - RNA, 19 nt, Human
ucugccuccuugguucuuc

SEQ ID NO: 1062145 - RNA, 18 nt, Human
aagcugccguggagaugg

SEQ ID NO: 1062146 - RNA, 21 nt, Human
agcugccguggagaugguugg

SEQ ID NO: 1062147 - RNA, 18 nt, Human
aggcggcgggcucuccgg

SEQ ID NO: 1062148 - RNA, 19 nt, Human
ccacgcuguggaaaagccc

SEQ ID NO: 1062149 - RNA, 19 nt, Human
cccugugucgugugugucc

SEQ ID NO: 1062150 - RNA, 20 nt, Human
ccgugcuggggcugcccugc

SEQ ID NO: 1062151 - RNA, 18 nt, Human
cggauuugacugaggucc

SEQ ID NO: 1062152 - RNA, 21 nt, Human
cgucccguucccugugucgug

SEQ ID NO: 1062153 - RNA, 23 nt, Human
cugggggcacccugcccgugcug

SEQ ID NO: 1062154 - RNA, 24 nt, Human
gaguguuucccaagcugccgugga

SEQ ID NO: 1062155 - RNA, 19 nt, Human
uaagcagagagggucuuca

SEQ ID NO: 1062156 - RNA, 18 nt, Human
ucccugugucgugugugu

SEQ ID NO: 1062157 - RNA, 20 nt, Human
ucccugugucgugugugucc

SEQ ID NO: 1062158 - RNA, 22 nt, Human
ucccugugucgugugugucccu

SEQ ID NO: 1062159 - RNA, 23 nt, Human
ucggccuuugcugccuccagacc

SEQ ID NO: 1062160 - RNA, 19 nt, Human
ugccaggagucggccuuug

SEQ ID NO: 1062161 - RNA, 21 nt, Human
ugcccgugcuggggcugcccu

SEQ ID NO: 1062162 - RNA, 22 nt, Human
ugcccgugcuggggcugcccug

SEQ ID NO: 1062163 - RNA, 21 nt, Human
ugggagcaccugggcuucugc

SEQ ID NO: 1062164 - RNA, 19 nt, Human
ugucacggauuugacugag

SEQ ID NO: 1062165 - RNA, 26 nt, Human
ugugguaagcagagagggucuucaca

SEQ ID NO: 1062166 - RNA, 18 nt, Human
uugcugccuccagaccug

SEQ ID NO: 1062167 - RNA, 21 nt, Human
aaggagaggcggcggcggcgg

SEQ ID NO: 1062168 - RNA, 24 nt, Human
aggaaaacccaacaugcaugcacu

SEQ ID NO: 1062169 - RNA, 19 nt, Human
aggcggcggcggcggcugc

SEQ ID NO: 1062170 - RNA, 22 nt, Human
aggcggcggcggcggcugcugc

SEQ ID NO: 1062171 - RNA, 23 nt, Human
aggcggcggcggcggcugcugcg

SEQ ID NO: 1062172 - RNA, 31 nt, Human
cccacggcuauggggaaauuagccugaggcc

SEQ ID NO: 1062173 - RNA, 21 nt, Human
cuuggugaccagggaagucac

SEQ ID NO: 1062174 - RNA, 23 nt, Human
gaaaacccaacaugcaugcacug

SEQ ID NO: 1062175 - RNA, 22 nt, Human
gcggcggcggcggcugcugcgc

SEQ ID NO: 1062176 - RNA, 18 nt, Human
ggcggcggcggcggcugc

SEQ ID NO: 1062177 - RNA, 19 nt, Human
ggugaccagggaagucacc

SEQ ID NO: 1062178 - RNA, 24 nt, Human
uacaacuuauagaaaagguaaagg

SEQ ID NO: 1062179 - RNA, 21 nt, Human
uuggugaccagggaagucacc

SEQ ID NO: 1062180 - RNA, 19 nt, Human
aagaggcccgaaggccuuc

SEQ ID NO: 1062181 - RNA, 25 nt, Human
agcgccgcuccaccgagggccgcgc

SEQ ID NO: 1062182 - RNA, 19 nt, Human
agcuaucgcagaggacuug

SEQ ID NO: 1062183 - RNA, 22 nt, Human
aggaugugcagggggugcagga

SEQ ID NO: 1062184 - RNA, 19 nt, Human
aggcgggcggggggcggcg

SEQ ID NO: 1062185 - RNA, 22 nt, Human
agggagggggcgucucugggcc

SEQ ID NO: 1062186 - RNA, 22 nt, Human
cacgguggagggagggggcguc

SEQ ID NO: 1062187 - RNA, 23 nt, Human
cagacaggaaugugugcugacug

SEQ ID NO: 1062188 - RNA, 21 nt, Human
ccaggccugccugggccgcgc

SEQ ID NO: 1062189 - RNA, 21 nt, Human
cccgaggcgggcggggggcgg

SEQ ID NO: 1062190 - RNA, 20 nt, Human
cccggaugacgaguacgaag

SEQ ID NO: 1062191 - RNA, 21 nt, Human
ccgcgagaggaugugcagggg

SEQ ID NO: 1062192 - RNA, 23 nt, Human
cgagggccgcgcgucggccgccg

SEQ ID NO: 1062193 - RNA, 23 nt, Human
cgccgcuccaccgagggccgcgc

SEQ ID NO: 1062194 - RNA, 20 nt, Human
cgggccagagcagggaacgg

SEQ ID NO: 1062195 - RNA, 24 nt, Human
cuccaccgagggccgcgcgucggc

SEQ ID NO: 1062196 - RNA, 20 nt, Human
cuggagcgagugugcgggcc

SEQ ID NO: 1062197 - RNA, 18 nt, Human
gacugugugcggggcugg

SEQ ID NO: 1062198 - RNA, 21 nt, Human
gagcagggaacgggucccgga

SEQ ID NO: 1062199 - RNA, 18 nt, Human
gagccugaucagacagga

SEQ ID NO: 1062200 - RNA, 22 nt, Human
gccaggccugccugggccgcgc

SEQ ID NO: 1062201 - RNA, 18 nt, Human
gcccgaaggccuucccga

SEQ ID NO: 1062202 - RNA, 20 nt, Human
gcgcuuccugccacgccagg

SEQ ID NO: 1062203 - RNA, 21 nt, Human
gcggggggcggcgaucccggg

SEQ ID NO: 1062204 - RNA, 24 nt, Human
gcuaaaguguagaggccugcucug

SEQ ID NO: 1062205 - RNA, 22 nt, Human
gggaggaugugcggggggcggu

SEQ ID NO: 1062206 - RNA, 20 nt, Human
gggagggggcgucucugggc

SEQ ID NO: 1062207 - RNA, 21 nt, Human
gggggcggcgaucccgggugg

SEQ ID NO: 1062208 - RNA, 27 nt, Human
gggggugcaggacugugugcggggcug

SEQ ID NO: 1062209 - RNA, 23 nt, Human
gugcggggcuggagcgagugugc

SEQ ID NO: 1062210 - RNA, 23 nt, Human
gugcugacuguugcagucucuga

SEQ ID NO: 1062211 - RNA, 19 nt, Human
ucggcugggcacgggcggc

SEQ ID NO: 1062212 - RNA, 18 nt, Human
ugacgcagcggcuccgga

SEQ ID NO: 1062213 - RNA, 21 nt, Human
ugcacgguggagggagggggc

SEQ ID NO: 1062214 - RNA, 22 nt, Human
uggcgcuuccugccacgccagg

SEQ ID NO: 1062215 - RNA, 18 nt, Human
ugugugcggggcuggagc

SEQ ID NO: 1062216 - RNA, 18 nt, Human
aagggagcuucuggauuc

SEQ ID NO: 1062217 - RNA, 22 nt, Human
acaaaacagauuugccucuuga

SEQ ID NO: 1062218 - RNA, 21 nt, Human
acaaagcacaaagagacgaag

SEQ ID NO: 1062219 - RNA, 21 nt, Human
acacggccaauguguuccaga

SEQ ID NO: 1062220 - RNA, 19 nt, Human
acaguuccaaggguuaucu

SEQ ID NO: 1062221 - RNA, 22 nt, Human
agcugguacagguguaccaguu

SEQ ID NO: 1062222 - RNA, 22 nt, Human
aggaaugaaaucagauugucau

SEQ ID NO: 1062223 - RNA, 23 nt, Human
cacggccaauguguuccagaacc

SEQ ID NO: 1062224 - RNA, 24 nt, Human
cacgucaaaaucacugccggugcc

SEQ ID NO: 1062225 - RNA, 25 nt, Human
cagaaccccgauauaagggagcuuc

SEQ ID NO: 1062226 - RNA, 18 nt, Human
ccccacaggacuccacag

SEQ ID NO: 1062227 - RNA, 20 nt, Human
cggccaauguguuccagaac

SEQ ID NO: 1062228 - RNA, 21 nt, Human
cggccaauguguuccagaacc

SEQ ID NO: 1062229 - RNA, 18 nt, Human
cuguucccucguauaucc

SEQ ID NO: 1062230 - RNA, 24 nt, Human
gacacggccaauguguuccagaac

SEQ ID NO: 1062231 - RNA, 18 nt, Human
gagacacccuuggaaaca

SEQ ID NO: 1062232 - RNA, 21 nt, Human
gagcuucuggauucuguuccc

SEQ ID NO: 1062233 - RNA, 23 nt, Human
gauucuguucccucguauaucca

SEQ ID NO: 1062234 - RNA, 18 nt, Human
gcagaagcaaggugccgg

SEQ ID NO: 1062235 - RNA, 20 nt, Human
ggcaagguguuagaggaggc

SEQ ID NO: 1062236 - RNA, 24 nt, Human
ggguacaaaacagauuugccucuu

SEQ ID NO: 1062237 - RNA, 21 nt, Human
gguuucuuuuaaaagccuucc

SEQ ID NO: 1062238 - RNA, 23 nt, Human
uaaauaaauguccucuguaugaa

SEQ ID NO: 1062239 - RNA, 20 nt, Human
uaagacacaaucugacugaa

SEQ ID NO: 1062240 - RNA, 23 nt, Human
uaagggagcuucuggauucuguu

SEQ ID NO: 1062241 - RNA, 22 nt, Human
uacaaaacagauuugccucuug

SEQ ID NO: 1062242 - RNA, 18 nt, Human
uacaaagcacaaagagac

SEQ ID NO: 1062243 - RNA, 21 nt, Human
uagaggaggcacccuuguuug

SEQ ID NO: 1062244 - RNA, 19 nt, Human
uagaguuugcaguaucccc

SEQ ID NO: 1062245 - RNA, 22 nt, Human
ucacagcuacaguuccaagggg

SEQ ID NO: 1062246 - RNA, 24 nt, Human
uccacaguauagguuuuauguagu

SEQ ID NO: 1062247 - RNA, 20 nt, Human
uccucuguaugaaguaagau

SEQ ID NO: 1062248 - RNA, 23 nt, Human
ucuuggcaguucacacuuagucc

SEQ ID NO: 1062249 - RNA, 22 nt, Human
ugaaggguguguuuugcagaag

SEQ ID NO: 1062250 - RNA, 18 nt, Human
ugagauugcgguuggaga

SEQ ID NO: 1062251 - RNA, 24 nt, Human
ugagauugcgguuggagagggcuu

SEQ ID NO: 1062252 - RNA, 25 nt, Human
uggaaggauuuguuguuuuuggugg

SEQ ID NO: 1062253 - RNA, 24 nt, Human
uggcauguucuccagccaagcuuu

SEQ ID NO: 1062254 - RNA, 27 nt, Human
uuaaaagccuuccauauaagucacugg

SEQ ID NO: 1062255 - RNA, 22 nt, Human
uugagguuaaauucaguauuau

SEQ ID NO: 1062256 - RNA, 19 nt, Human
uuucacagauagcuucucc

SEQ ID NO: 1062257 - RNA, 19 nt, Human
uuucacagauagcuucucc

SEQ ID NO: 1062258 - RNA, 23 nt, Human
uuucaucauuaaauaaauguccu

SEQ ID NO: 1062259 - RNA, 24 nt, Human
uuuuuuuuuuuuuuuuuuacuuuu

SEQ ID NO: 1062260 - RNA, 19 nt, Human
acccuagagcaacaguagc

SEQ ID NO: 1062261 - RNA, 20 nt, Human
cacccuagagcaacaguagc

SEQ ID NO: 1062262 - RNA, 18 nt, Human
ccaacauccaagaaucuu

SEQ ID NO: 1062263 - RNA, 19 nt, Human
cccugccacccuagagcaa

SEQ ID NO: 1062264 - RNA, 24 nt, Human
ccuacagccucuccugauuuuucc

SEQ ID NO: 1062265 - RNA, 22 nt, Human
ccucuccugauuuuucccuaac

SEQ ID NO: 1062266 - RNA, 23 nt, Human
cuagagcaacaguagccuacucc

SEQ ID NO: 1062267 - RNA, 23 nt, Human
ucccuaaccccugccacccuaga

SEQ ID NO: 1062268 - RNA, 23 nt, Human
ucucugcacaggagaccauuucu

SEQ ID NO: 1062269 - RNA, 23 nt, Human
ucugcacaggagaccauuucuag

SEQ ID NO: 1062270 - RNA, 19 nt, Human
ugaacaguagccuacagcc

SEQ ID NO: 1062271 - RNA, 25 nt, Human
ugaacaguagccuacagccucuccu

SEQ ID NO: 1062272 - RNA, 23 nt, Human
uuggugcaauauguaguuucucu

SEQ ID NO: 1062273 - RNA, 21 nt, Human
uuucccuaaccccugccaccc

SEQ ID NO: 1062274 - RNA, 19 nt, Human
ggagccugggggagaaggu

SEQ ID NO: 1062275 - RNA, 18 nt, Human
uauugggagggagccugg

SEQ ID NO: 1062276 - RNA, 20 nt, Human
augucacagaccccagcaac

SEQ ID NO: 1062277 - RNA, 22 nt, Human
uuacugcagugugguucuuucc

SEQ ID NO: 1062278 - RNA, 22 nt, Human
aaaacgccaccacuuccaaaug

SEQ ID NO: 1062279 - RNA, 25 nt, Human
agcaugggaacuguaguaagaggga

SEQ ID NO: 1062280 - RNA, 19 nt, Human
cauuccagcucaguuucag

SEQ ID NO: 1062281 - RNA, 23 nt, Human
ccugaaaaacgccaccacuucca

SEQ ID NO: 1062282 - RNA, 20 nt, Human
gaaaaacgccaccacuucca

SEQ ID NO: 1062283 - RNA, 24 nt, Human
ggaagccauuuucccugaaaaacg

SEQ ID NO: 1062284 - RNA, 27 nt, Human
ggcaagaaggccauggaagccauuuuc

SEQ ID NO: 1062285 - RNA, 22 nt, Human
guagagagcauacucggaguca

SEQ ID NO: 1062286 - RNA, 19 nt, Human
uacucggagucaugggcaa

SEQ ID NO: 1062287 - RNA, 26 nt, Human
uagugagguucuucccauuccagcuc

SEQ ID NO: 1062288 - RNA, 25 nt, Human
ucccugaaaaacgccaccacuucca

SEQ ID NO: 1062289 - RNA, 22 nt, Human
uggaagccauuuucccugaaaa

SEQ ID NO: 1062290 - RNA, 21 nt, Human
accuguagucacagcucgggu

SEQ ID NO: 1062291 - RNA, 19 nt, Human
auccaaaugagcacugagg

SEQ ID NO: 1062292 - RNA, 20 nt, Human
caccuguagucacagcucgg

SEQ ID NO: 1062293 - RNA, 21 nt, Human
caccuguagucacagcucggg

SEQ ID NO: 1062294 - RNA, 24 nt, Human
gcugcaauccaaaugagcacugag

SEQ ID NO: 1062295 - RNA, 24 nt, Human
guuccuguaauguggacacaaaag

SEQ ID NO: 1062296 - RNA, 19 nt, Human
ugagaggguuccuguaaug

SEQ ID NO: 1062297 - RNA, 19 nt, Human
ugccuggaguauagcaccu

SEQ ID NO: 1062298 - RNA, 19 nt, Human
aaaaaguagaaacagcaga

SEQ ID NO: 1062299 - RNA, 20 nt, Human
agaaacagcagaaaggaggc

SEQ ID NO: 1062300 - RNA, 24 nt, Human
agaaaggaaaugcagaaaugagaa

SEQ ID NO: 1062301 - RNA, 18 nt, Human
agaaaggaggccagacuc

SEQ ID NO: 1062302 - RNA, 24 nt, Human
agauaaaaaguagaaacagcagaa

SEQ ID NO: 1062303 - RNA, 21 nt, Human
aggaaaugcagaaaugagaaa

SEQ ID NO: 1062304 - RNA, 21 nt, Human
aggcagaaaggaaaugcagaa

SEQ ID NO: 1062305 - RNA, 25 nt, Human
aggcagaaaggaaaugcagaaauga

SEQ ID NO: 1062306 - RNA, 18 nt, Human
agacugugcagagcgugg

SEQ ID NO: 1062307 - RNA, 22 nt, Human
uacuuuuuaucuuuuucaugca

SEQ ID NO: 1062308 - RNA, 26 nt, Human
aaacaaaauaguacuuucccuucaaa

SEQ ID NO: 1062309 - RNA, 20 nt, Human
aacaagagcccaagagcaac

SEQ ID NO: 1062310 - RNA, 24 nt, Human
aacauuuauucucacaaaaauaua

SEQ ID NO: 1062311 - RNA, 21 nt, Human
aaccacagauccuagagaucu

SEQ ID NO: 1062312 - RNA, 20 nt, Human
aacugcuuguccagcagggc

SEQ ID NO: 1062313 - RNA, 20 nt, Human
aagauaccacugucaugugg

SEQ ID NO: 1062314 - RNA, 19 nt, Human
aagcaaguauaguuauaau

SEQ ID NO: 1062315 - RNA, 27 nt, Human
aagcagccaaaauuauuuucugcaugc

SEQ ID NO: 1062316 - RNA, 22 nt, Human
aauacaauaagucuagcugccu

SEQ ID NO: 1062317 - RNA, 20 nt, Human
acagguagaaaugcagacag

SEQ ID NO: 1062318 - RNA, 19 nt, Human
acccagcucggcacuucug

SEQ ID NO: 1062319 - RNA, 23 nt, Human
agaaaaggaaauaaagauguaau

SEQ ID NO: 1062320 - RNA, 23 nt, Human
agagaauuguucagagacuuuuu

SEQ ID NO: 1062321 - RNA, 18 nt, Human
agagagaauuguucagag

SEQ ID NO: 1062322 - RNA, 24 nt, Human
auaaaacaaaauaguacuuucccu

SEQ ID NO: 1062323 - RNA, 25 nt, Human
auaaaacaaaauaguacuuucccuu

SEQ ID NO: 1062324 - RNA, 21 nt, Human
caaaacaccaaacuuuugcaa

SEQ ID NO: 1062325 - RNA, 22 nt, Human
caaaacaccaaacuuuugcaaa

SEQ ID NO: 1062326 - RNA, 19 nt, Human
caacagcagaaauugaaca

SEQ ID NO: 1062327 - RNA, 20 nt, Human
caacagcagaaauugaacaa

SEQ ID NO: 1062328 - RNA, 20 nt, Human
cacaauauauuuaacaauac

SEQ ID NO: 1062329 - RNA, 24 nt, Human
cacauuauccaugcucccauuugc

SEQ ID NO: 1062330 - RNA, 20 nt, Human
caccucaauuuuccaaggau

SEQ ID NO: 1062331 - RNA, 22 nt, Human
cagcuauauuaagaagaucuac

SEQ ID NO: 1062332 - RNA, 21 nt, Human
caucacaugcagauugcccag

SEQ ID NO: 1062333 - RNA, 25 nt, Human
ccaaaauaaacuaacuuuucuaaca

SEQ ID NO: 1062334 - RNA, 21 nt, Human
ccagcagggccuuuacccagc

SEQ ID NO: 1062335 - RNA, 24 nt, Human
ccauacucagauaauugucauauu

SEQ ID NO: 1062336 - RNA, 18 nt, Human
cccuguagccuagacaug

SEQ ID NO: 1062337 - RNA, 22 nt, Human
ccuggugggucugguccugugg

SEQ ID NO: 1062338 - RNA, 23 nt, Human
ccuggugggucugguccuguggu

SEQ ID NO: 1062339 - RNA, 23 nt, Human
ccuucaagcaguuuggaaugacu

SEQ ID NO: 1062340 - RNA, 18 nt, Human
cuaacccaucaacagcag

SEQ ID NO: 1062341 - RNA, 20 nt, Human
cucaaaaaaaagugaacaca

SEQ ID NO: 1062342 - RNA, 22 nt, Human
cugguccugugguccggcuguc

SEQ ID NO: 1062343 - RNA, 19 nt, Human
gacuguauaacaagagccc

SEQ ID NO: 1062344 - RNA, 21 nt, Human
gaguggccaggcuguaaauac

SEQ ID NO: 1062345 - RNA, 19 nt, Human
gcuguaaauacaauaaguc

SEQ ID NO: 1062346 - RNA, 24 nt, Human
ggaaaacccaauauuuuauaaaaa

SEQ ID NO: 1062347 - RNA, 18 nt, Human
gugggucugguccugugg

SEQ ID NO: 1062348 - RNA, 18 nt, Human
uaaaagacucagaacaaa

SEQ ID NO: 1062349 - RNA, 21 nt, Human
uaaagauguaauuauaaccac

SEQ ID NO: 1062350 - RNA, 23 nt, Human
uaacaauacagcauagacucaaa

SEQ ID NO: 1062351 - RNA, 23 nt, Human
uaacaccagugcaauuuuaacau

SEQ ID NO: 1062352 - RNA, 19 nt, Human
uaacccaucaacagcagaa

SEQ ID NO: 1062353 - RNA, 19 nt, Human
uaagccuuuagaauuuccu

SEQ ID NO: 1062354 - RNA, 22 nt, Human
uaccaaagguugagguggcuau

SEQ ID NO: 1062355 - RNA, 22 nt, Human
uagcugccuuccacaugugguc

SEQ ID NO: 1062356 - RNA, 19 nt, Human
uauaacaagagcccaagag

SEQ ID NO: 1062357 - RNA, 18 nt, Human
uauuuaaccauacucaga

SEQ ID NO: 1062358 - RNA, 20 nt, Human
uauuuaaccauacucagaua

SEQ ID NO: 1062359 - RNA, 25 nt, Human
uauuuaaccauacucagauaauugu

SEQ ID NO: 1062360 - RNA, 18 nt, Human
ucagacauuuaauuguau

SEQ ID NO: 1062361 - RNA, 21 nt, Human
ucagagacuuuuuucaacuag

SEQ ID NO: 1062362 - RNA, 22 nt, Human
ucauaugucuagaguggccagg

SEQ ID NO: 1062363 - RNA, 21 nt, Human
ucauuggcuucagacauuuaa

SEQ ID NO: 1062364 - RNA, 24 nt, Human
ucccugucaugguuucaacuuuca

SEQ ID NO: 1062365 - RNA, 20 nt, Human
uccuagagaucucaaaaaaa

SEQ ID NO: 1062366 - RNA, 19 nt, Human
ucucagauucugguucauc

SEQ ID NO: 1062367 - RNA, 21 nt, Human
ugaagaagcgcaagaaaagga

SEQ ID NO: 1062368 - RNA, 22 nt, Human
ugaccuauuuccaaauucucag

SEQ ID NO: 1062369 - RNA, 19 nt, Human
ugcaaguucuacccaaaac

SEQ ID NO: 1062370 - RNA, 21 nt, Human
ugcacugucuuuccaaggcuu

SEQ ID NO: 1062371 - RNA, 23 nt, Human
uggaggcuuuuucugugaccuau

SEQ ID NO: 1062372 - RNA, 18 nt, Human
uggcaagaaaaauacuuc

SEQ ID NO: 1062373 - RNA, 19 nt, Human
uguauguauuuaaccauac

SEQ ID NO: 1062374 - RNA, 20 nt, Human
uguauguauuuaaccauacu

SEQ ID NO: 1062375 - RNA, 21 nt, Human
ugucauguggauccugguggg

SEQ ID NO: 1062376 - RNA, 18 nt, Human
ugucuagaguggccaggc

SEQ ID NO: 1062377 - RNA, 18 nt, Human
uucaagcaguuuggaaug

SEQ ID NO: 1062378 - RNA, 22 nt, Human
uucaaguuagaauaaacaacuc

SEQ ID NO: 1062379 - RNA, 18 nt, Human
uugaauuacaaguuguuu

SEQ ID NO: 1062380 - RNA, 23 nt, Human
uugcacugucuuuccaaggcuug

SEQ ID NO: 1062381 - RNA, 24 nt, Human
uugcuugguuugagacaacuaugu

SEQ ID NO: 1062382 - RNA, 20 nt, Human
uuuauauuugugugccaagg

SEQ ID NO: 1062383 - RNA, 20 nt, Human
aaagcaacagaaaagcagaa

SEQ ID NO: 1062384 - RNA, 20 nt, Human
aacaaaaauaaaucuaauag

SEQ ID NO: 1062385 - RNA, 21 nt, Human
aacagcaauccacaccuugcc

SEQ ID NO: 1062386 - RNA, 19 nt, Human
aacauuauuucaucaguag

SEQ ID NO: 1062387 - RNA, 21 nt, Human
aagaaccacuggcuuaaauua

SEQ ID NO: 1062388 - RNA, 25 nt, Human
aagaacuugagagagauauagacug

SEQ ID NO: 1062389 - RNA, 19 nt, Human
aagccuuuguaucaacuga

SEQ ID NO: 1062390 - RNA, 19 nt, Human
aagggaacuaaauuaugau

SEQ ID NO: 1062391 - RNA, 24 nt, Human
aaucaacauagcaucaagucuaaa

SEQ ID NO: 1062392 - RNA, 21 nt, Human
aaugaaugaaaacagacagaa

SEQ ID NO: 1062393 - RNA, 20 nt, Human
aaugcuauccacaauauaaa

SEQ ID NO: 1062394 - RNA, 21 nt, Human
acaauaagaacuugagagaga

SEQ ID NO: 1062395 - RNA, 23 nt, Human
accuugcccacccccacaccuca

SEQ ID NO: 1062396 - RNA, 24 nt, Human
acucuaggaaaacauuuaaagaaa

SEQ ID NO: 1062397 - RNA, 20 nt, Human
acuuuaguagucuuuaaaag

SEQ ID NO: 1062398 - RNA, 23 nt, Human
aggcgccucccuguugguuucug

SEQ ID NO: 1062399 - RNA, 23 nt, Human
agucaaaacguuuacccaaagua

SEQ ID NO: 1062400 - RNA, 21 nt, Human
caaaaugcuauccacaauaua

SEQ ID NO: 1062401 - RNA, 22 nt, Human
caaccauaucacagaccuuggc

SEQ ID NO: 1062402 - RNA, 19 nt, Human
caagaaccacuggcuuaaa

SEQ ID NO: 1062403 - RNA, 21 nt, Human
caagaugcauguaaacccaua

SEQ ID NO: 1062404 - RNA, 22 nt, Human
caagaugcauguaaacccauaa

SEQ ID NO: 1062405 - RNA, 18 nt, Human
cacaccuugcccaccccc

SEQ ID NO: 1062406 - RNA, 25 nt, Human
cacccccacaccucagaaaagauuu

SEQ ID NO: 1062407 - RNA, 24 nt, Human
caccgccauaaacuuuaaacaguc

SEQ ID NO: 1062408 - RNA, 25 nt, Human
caccucagaaaagauuuccaccagg

SEQ ID NO: 1062409 - RNA, 26 nt, Human
caccuucaaaaugcuauccacaaaac

SEQ ID NO: 1062410 - RNA, 21 nt, Human
caccuugcccacccccacacc

SEQ ID NO: 1062411 - RNA, 20 nt, Human
cacuaguaugcauuccuaac

SEQ ID NO: 1062412 - RNA, 26 nt, Human
cagaaaagauuuccaccaggaaucaa

SEQ ID NO: 1062413 - RNA, 21 nt, Human
cagacagaacuaaaacuaaug

SEQ ID NO: 1062414 - RNA, 22 nt, Human
cagcaguaccuugaaaucuucu

SEQ ID NO: 1062415 - RNA, 24 nt, Human
cauaaacuuuaaacagucaaaacg

SEQ ID NO: 1062416 - RNA, 24 nt, Human
caucagaauaacccagcacuuguu

SEQ ID NO: 1062417 - RNA, 20 nt, Human
cccacccccacaccucagaa

SEQ ID NO: 1062418 - RNA, 27 nt, Human
cccacuucaccgccauaaacuuuaaac

SEQ ID NO: 1062419 - RNA, 21 nt, Human
cccugcccccacucuaaccug

SEQ ID NO: 1062420 - RNA, 20 nt, Human
ccgccauaaacuuuaaacag

SEQ ID NO: 1062421 - RNA, 24 nt, Human
ccgccccugcccccacucuaaccu

SEQ ID NO: 1062422 - RNA, 23 nt, Human
cgccccugcccccacucuaaccu

SEQ ID NO: 1062423 - RNA, 18 nt, Human
cgcuccggggugugcccg

SEQ ID NO: 1062424 - RNA, 18 nt, Human
cgcugcugcuugccgggg

SEQ ID NO: 1062425 - RNA, 20 nt, Human
cuaggucacaugccagaagc

SEQ ID NO: 1062426 - RNA, 22 nt, Human
cuaguaugcauuccuaacaacu

SEQ ID NO: 1062427 - RNA, 19 nt, Human
cugcucccgcgcccgcccc

SEQ ID NO: 1062428 - RNA, 22 nt, Human
cugugcugaaaaaaaaaugacc

SEQ ID NO: 1062429 - RNA, 19 nt, Human
cuugcccacccccacaccu

SEQ ID NO: 1062430 - RNA, 23 nt, Human
gaaaacagacagaacuaaaacua

SEQ ID NO: 1062431 - RNA, 24 nt, Human
gauugucaguaguaucaguuucca

SEQ ID NO: 1062432 - RNA, 21 nt, Human
gcccgcugcugcuugccgggg

SEQ ID NO: 1062433 - RNA, 22 nt, Human
ggaguauuuuaaugcucacaaa

SEQ ID NO: 1062434 - RNA, 21 nt, Human
ggcaggcugggcgucgcggcc

SEQ ID NO: 1062435 - RNA, 24 nt, Human
ggcccgcugcugcuugccggggug

SEQ ID NO: 1062436 - RNA, 18 nt, Human
ggcucgggcucccucucu

SEQ ID NO: 1062437 - RNA, 22 nt, Human
ggcucgggcucccucucuggcc

SEQ ID NO: 1062438 - RNA, 24 nt, Human
uaaacuaagaaauuguaacauuaa

SEQ ID NO: 1062439 - RNA, 21 nt, Human
uaacaacuucucaagugaugc

SEQ ID NO: 1062440 - RNA, 21 nt, Human
uaacuaggucacaugccagaa

SEQ ID NO: 1062441 - RNA, 24 nt, Human
uaacuaggucacaugccagaagcu

SEQ ID NO: 1062442 - RNA, 21 nt, Human
uaagguguuuucuauaucuca

SEQ ID NO: 1062443 - RNA, 19 nt, Human
uaaugcuauuucuaauguu

SEQ ID NO: 1062444 - RNA, 24 nt, Human
uacaucagcacagcccuaaccaaa

SEQ ID NO: 1062445 - RNA, 22 nt, Human
uaggcgccucccuguugguuuc

SEQ ID NO: 1062446 - RNA, 24 nt, Human
uaucacagaccuuggcaaagcugc

SEQ ID NO: 1062447 - RNA, 23 nt, Human
uaugaucucuacacauguaugua

SEQ ID NO: 1062448 - RNA, 18 nt, Human
ucaagacaugugguagaa

SEQ ID NO: 1062449 - RNA, 23 nt, Human
ucagcaguaccuugaaaucuucu

SEQ ID NO: 1062450 - RNA, 20 nt, Human
ucccgcgcccgccccugccc

SEQ ID NO: 1062451 - RNA, 18 nt, Human
ucccucucuggcccuggg

SEQ ID NO: 1062452 - RNA, 24 nt, Human
ucccucucuggcccugggcugcuc

SEQ ID NO: 1062453 - RNA, 21 nt, Human
ucguaaacagcaauccacacc

SEQ ID NO: 1062454 - RNA, 26 nt, Human
ucucaagugaugcugaagcugcaggu

SEQ ID NO: 1062455 - RNA, 21 nt, Human
ugaaaaaaaaaugaccuacaa

SEQ ID NO: 1062456 - RNA, 22 nt, Human
ugaaagcaacagaaaagcagaa

SEQ ID NO: 1062457 - RNA, 25 nt, Human
ugaaagcaacagaaaagcuggagac

SEQ ID NO: 1062458 - RNA, 23 nt, Human
ugaagacgcccacuucaccgcca

SEQ ID NO: 1062459 - RNA, 24 nt, Human
ugacguaacaaaaaguaaaaaaaa

SEQ ID NO: 1062460 - RNA, 29 nt, Human
ugcccacccccacaccucagaaaagauuu

SEQ ID NO: 1062461 - RNA, 23 nt, Human
ugcccccacucuaaccuguccgc

SEQ ID NO: 1062462 - RNA, 18 nt, Human
ugcugaagcugcaggucu

SEQ ID NO: 1062463 - RNA, 20 nt, Human
ugcugaagcugcaggucuug

SEQ ID NO: 1062464 - RNA, 20 nt, Human
uggcaggcugggcgucgcgg

SEQ ID NO: 1062465 - RNA, 18 nt, Human
uggcccugggcugcuccc

SEQ ID NO: 1062466 - RNA, 23 nt, Human
ugguuucugauucacuaugucug

SEQ ID NO: 1062467 - RNA, 20 nt, Human
uuaaaaauuagagcugugcu

SEQ ID NO: 1062468 - RNA, 20 nt, Human
uuagagcucuauuaauaacc

SEQ ID NO: 1062469 - RNA, 22 nt, Human
uuaugaucucuacacauguaug

SEQ ID NO: 1062470 - RNA, 22 nt, Human
uucaaggaacgaaaaugaaauc

SEQ ID NO: 1062471 - RNA, 23 nt, Human
uucaaggaacgaaaaugaaaucc

SEQ ID NO: 1062472 - RNA, 19 nt, Human
uucaugauaacaaacacuc

SEQ ID NO: 1062473 - RNA, 23 nt, Human
uucaugauaacaaacacucuagg

SEQ ID NO: 1062474 - RNA, 18 nt, Human
uugcccacccccacaccu

SEQ ID NO: 1062475 - RNA, 19 nt, Human
agggacuucugacaggugg

SEQ ID NO: 1062476 - RNA, 23 nt, Human
cugaguucugagagacaaauguu

SEQ ID NO: 1062477 - RNA, 21 nt, Human
cuucugacagguggggguggg

SEQ ID NO: 1062478 - RNA, 22 nt, Human
gauguggguguugauggcagcc

SEQ ID NO: 1062479 - RNA, 22 nt, Human
gcuccaggcugauguggguguu

SEQ ID NO: 1062480 - RNA, 24 nt, Human
uaggaugcguggagcuccaggcug

SEQ ID NO: 1062481 - RNA, 18 nt, Human
ucgcaccggcgacagcgg

SEQ ID NO: 1062482 - RNA, 19 nt, Human
ucugagagacaaauguugu

SEQ ID NO: 1062483 - RNA, 21 nt, Human
ugauguggguguugauggcag

SEQ ID NO: 1062484 - RNA, 25 nt, Human
uggagcuccaggcugaugugggugu

SEQ ID NO: 1062485 - RNA, 22 nt, Human
ugggggagcacgcugaguucug

SEQ ID NO: 1062486 - RNA, 18 nt, Human
acagggaagggaccaggg

SEQ ID NO: 1062487 - RNA, 28 nt, Human
acccugcugcaccagacuggaauguguu

SEQ ID NO: 1062488 - RNA, 23 nt, Human
agccucuggcccugagaccgcuc

SEQ ID NO: 1062489 - RNA, 25 nt, Human
aucaucuucacugcugcuucugcua

SEQ ID NO: 1062490 - RNA, 18 nt, Human
caggcaacagggaaggga

SEQ ID NO: 1062491 - RNA, 21 nt, Human
ccaaaguaguucuguguucuu

SEQ ID NO: 1062492 - RNA, 20 nt, Human
ccacaucaucuucacugcug

SEQ ID NO: 1062493 - RNA, 22 nt, Human
ccaccagucccccaaaugccaa

SEQ ID NO: 1062494 - RNA, 23 nt, Human
ccaugccaccagucccccaaaug

SEQ ID NO: 1062495 - RNA, 22 nt, Human
cccccaaaugccaaaguaguuc

SEQ ID NO: 1062496 - RNA, 20 nt, Human
ccucuggcccugagaccgcu

SEQ ID NO: 1062497 - RNA, 22 nt, Human
cgcucuggggaagggcuguggg

SEQ ID NO: 1062498 - RNA, 24 nt, Human
cggaagacccagaauuacuaaaag

SEQ ID NO: 1062499 - RNA, 21 nt, Human
cugcuuguguucucaauggcu

SEQ ID NO: 1062500 - RNA, 21 nt, Human
gaaguuuuuccacaucaucuu

SEQ ID NO: 1062501 - RNA, 20 nt, Human
gacccagaauuacuaaaagu

SEQ ID NO: 1062502 - RNA, 23 nt, Human
gagcacaacugaaguuuuuccac

SEQ ID NO: 1062503 - RNA, 23 nt, Human
ggaagacccagaauuacuaaaag

SEQ ID NO: 1062504 - RNA, 23 nt, Human
ggcaacagggaagggaccaggga

SEQ ID NO: 1062505 - RNA, 20 nt, Human
gggaagggcugugggagagc

SEQ ID NO: 1062506 - RNA, 18 nt, Human
ggggaagggcugugggag

SEQ ID NO: 1062507 - RNA, 20 nt, Human
uaucacugcaguugcuggug

SEQ ID NO: 1062508 - RNA, 20 nt, Human
uaucacugggguccugcugc

SEQ ID NO: 1062509 - RNA, 21 nt, Human
uaugauuucacuagcaaugga

SEQ ID NO: 1062510 - RNA, 23 nt, Human
uaugcuggcauuguugauguugc

SEQ ID NO: 1062511 - RNA, 19 nt, Human
ucacugcaguugcuggugc

SEQ ID NO: 1062512 - RNA, 21 nt, Human
ucacugggguccugcugcucc

SEQ ID NO: 1062513 - RNA, 24 nt, Human
ucauuuuucacuuugauguucuua

SEQ ID NO: 1062514 - RNA, 22 nt, Human
ucuuagagcugcuugggccacu

SEQ ID NO: 1062515 - RNA, 22 nt, Human
ucuuauggcacuacugccacuu

SEQ ID NO: 1062516 - RNA, 19 nt, Human
ugccaaguuugucuccuga

SEQ ID NO: 1062517 - RNA, 24 nt, Human
ugcugcuuguguucucaauggcua

SEQ ID NO: 1062518 - RNA, 19 nt, Human
uggaauguguuggucccag

SEQ ID NO: 1062519 - RNA, 18 nt, Human
ugggcuggggagagccuc

SEQ ID NO: 1062520 - RNA, 21 nt, Human
ugggcuggggagagccucugg

SEQ ID NO: 1062521 - RNA, 21 nt, Human
uguguuggucccaguugggcu

SEQ ID NO: 1062522 - RNA, 18 nt, Human
uguucucucuuuaauucu

SEQ ID NO: 1062523 - RNA, 20 nt, Human
uucacuuugauguucuuaau

SEQ ID NO: 1062524 - RNA, 19 nt, Human
uucuguguucuuggcagaa

SEQ ID NO: 1062525 - RNA, 21 nt, Human
uuuuccacaucaucuucacug

SEQ ID NO: 1062526 - RNA, 23 nt, Human
uuuuucacuuugauguucuuaau

SEQ ID NO: 1062527 - RNA, 26 nt, Human
accaccuuuuguguauccuucucucc

SEQ ID NO: 1062528 - RNA, 26 nt, Human
caccuugaucuggauuccuuuggccc

SEQ ID NO: 1062529 - RNA, 22 nt, Human
cagcacaugcaggccuuccuca

SEQ ID NO: 1062530 - RNA, 24 nt, Human
cagcacaugcaggccuuccucaca

SEQ ID NO: 1062531 - RNA, 24 nt, Human
caugcaggccuuccucacagaucu

SEQ ID NO: 1062532 - RNA, 22 nt, Human
ccaggccuuccagcacaugcag

SEQ ID NO: 1062533 - RNA, 19 nt, Human
cccacacggucgcugugcg

SEQ ID NO: 1062534 - RNA, 23 nt, Human
cccacacggucgcugugcgaggc

SEQ ID NO: 1062535 - RNA, 22 nt, Human
cccuuucgguucaaccuuuucc

SEQ ID NO: 1062536 - RNA, 24 nt, Human
cucccuuucgguucaaccuuuucc

SEQ ID NO: 1062537 - RNA, 18 nt, Human
cuugcuuugacaagucca

SEQ ID NO: 1062538 - RNA, 22 nt, Human
cuuuuguguauccuucucuccu

SEQ ID NO: 1062539 - RNA, 22 nt, Human
ggccuuccagcacaugcaggcc

SEQ ID NO: 1062540 - RNA, 22 nt, Human
ggcuggucuccugaggccaggu

SEQ ID NO: 1062541 - RNA, 18 nt, Human
uauccuucucuccuggca

SEQ ID NO: 1062542 - RNA, 23 nt, Human
uccuccucuugcuuugacaaguc

SEQ ID NO: 1062543 - RNA, 21 nt, Human
ucgcugugcgaggcuggucuc

SEQ ID NO: 1062544 - RNA, 21 nt, Human
ucuccuggcaccuugaucugg

SEQ ID NO: 1062545 - RNA, 22 nt, Human
ugcgaggcuggucuccugaggc

SEQ ID NO: 1062546 - RNA, 22 nt, Human
uggcugggcucuagggcaaauc

SEQ ID NO: 1062547 - RNA, 18 nt, Human
uaaguuguuuuacuauuu

SEQ ID NO: 1062548 - RNA, 24 nt, Human
uguuuuacuauuucuucagcucca

SEQ ID NO: 1062549 - RNA, 18 nt, Human
aagcuaauacuucuaccu

SEQ ID NO: 1062550 - RNA, 19 nt, Human
acacugcauucacaguuug

SEQ ID NO: 1062551 - RNA, 19 nt, Human
aucaguuacccauuacaug

SEQ ID NO: 1062552 - RNA, 22 nt, Human
cacaguuuguguguuaaccacu

SEQ ID NO: 1062553 - RNA, 18 nt, Human
cacugcauucacaguuug

SEQ ID NO: 1062554 - RNA, 18 nt, Human
cuuguaguuuucugugua

SEQ ID NO: 1062555 - RNA, 20 nt, Human
uaaaggucaucaaaugcaag

SEQ ID NO: 1062556 - RNA, 20 nt, Human
uacccauuacaugauuuauu

SEQ ID NO: 1062557 - RNA, 22 nt, Human
ugcaacgccacacaucuuguag

SEQ ID NO: 1062558 - RNA, 21 nt, Human
uggaaauguaagggagaaacu

SEQ ID NO: 1062559 - RNA, 21 nt, Human
uuuacacugcauucacaguuu

SEQ ID NO: 1062560 - RNA, 20 nt, Human
agaacagauggcccaccagu

SEQ ID NO: 1062561 - RNA, 20 nt, Human
cagaagaacagauggcccac

SEQ ID NO: 1062562 - RNA, 23 nt, Human
cagauggcccaccaguagguggu

SEQ ID NO: 1062563 - RNA, 23 nt, Human
ccaacagccagaugucagccaga

SEQ ID NO: 1062564 - RNA, 18 nt, Human
gcagguggaccuccuggc

SEQ ID NO: 1062565 - RNA, 21 nt, Human
ggcuuugcagguggaccuccu

SEQ ID NO: 1062566 - RNA, 21 nt, Human
uaagaaccaaccaaacacugu

SEQ ID NO: 1062567 - RNA, 19 nt, Human
uaaugggcuuugcaggugg

SEQ ID NO: 1062568 - RNA, 22 nt, Human
ugcagguggaccuccuggccag

SEQ ID NO: 1062569 - RNA, 22 nt, Human
uggaccuccuggccaggacccu

SEQ ID NO: 1062570 - RNA, 19 nt, Human
uggguaagaaccaaccaaa

SEQ ID NO: 1062571 - RNA, 24 nt, Human
uggguaagaaccaaccaaacacug

SEQ ID NO: 1062572 - RNA, 19 nt, Human
aaacccaacauauuucuuu

SEQ ID NO: 1062573 - RNA, 24 nt, Human
aagcgaugaaagccacguuuugcu

SEQ ID NO: 1062574 - RNA, 19 nt, Human
aagucagccuuaauacuga

SEQ ID NO: 1062575 - RNA, 22 nt, Human
aagucagccuuaauacugaaac

SEQ ID NO: 1062576 - RNA, 26 nt, Human
aagucagccuuaauacugaaacuaua

SEQ ID NO: 1062577 - RNA, 20 nt, Human
acuuuaagggccgcucuagg

SEQ ID NO: 1062578 - RNA, 21 nt, Human
aguuuuuuaacuuauugcaaa

SEQ ID NO: 1062579 - RNA, 18 nt, Human
auaaaacacaaugaagaa

SEQ ID NO: 1062580 - RNA, 19 nt, Human
auacuacgguucacauacc

SEQ ID NO: 1062581 - RNA, 19 nt, Human
cauauuacaucagcagagu

SEQ ID NO: 1062582 - RNA, 20 nt, Human
ccccacccgcccuccucucc

SEQ ID NO: 1062583 - RNA, 21 nt, Human
ccccacccgcccuccucuccc

SEQ ID NO: 1062584 - RNA, 23 nt, Human
ccccacccgcccuccucucccug

SEQ ID NO: 1062585 - RNA, 24 nt, Human
ccuuauugcugccacuucucuucu

SEQ ID NO: 1062586 - RNA, 24 nt, Human
ccuuauugcugccacuucucuucu

SEQ ID NO: 1062587 - RNA, 24 nt, Human
cgcccuccucucccuggcacuuua

SEQ ID NO: 1062588 - RNA, 22 nt, Human
cguaguccugucuccgcccccu

SEQ ID NO: 1062589 - RNA, 18 nt, Human
cuccauaucuacauccaa

SEQ ID NO: 1062590 - RNA, 23 nt, Human
guccugucuccgcccccuucucu

SEQ ID NO: 1062591 - RNA, 21 nt, Human
uacagcagauacuaguuugcc

SEQ ID NO: 1062592 - RNA, 18 nt, Human
uagguuguuuuacagcag

SEQ ID NO: 1062593 - RNA, 22 nt, Human
uccccacccgcccuccucuccc

SEQ ID NO: 1062594 - RNA, 19 nt, Human
uccugucuccgcccccuuc

SEQ ID NO: 1062595 - RNA, 18 nt, Human
ucuaggccaggauggaag

SEQ ID NO: 1062596 - RNA, 19 nt, Human
ucuuuuuuccuccuucucc

SEQ ID NO: 1062597 - RNA, 24 nt, Human
ucuuuuuuccuccuucuccuacuc

SEQ ID NO: 1062598 - RNA, 18 nt, Human
ugcccuagagacucuggc

SEQ ID NO: 1062599 - RNA, 23 nt, Human
uggacacauaccauaaaacacaa

SEQ ID NO: 1062600 - RNA, 18 nt, Human
ugucuccgcccccuucuc

SEQ ID NO: 1062601 - RNA, 19 nt, Human
aaaaugccaccaauuauga

SEQ ID NO: 1062602 - RNA, 21 nt, Human
aggaaucugacaggggaucug

SEQ ID NO: 1062603 - RNA, 25 nt, Human
augagaccaaauacuguucagaaug

SEQ ID NO: 1062604 - RNA, 22 nt, Human
caaaauaugcaccaaaaaaugu

SEQ ID NO: 1062605 - RNA, 22 nt, Human
cagaaugaaaaagaguugaaua

SEQ ID NO: 1062606 - RNA, 19 nt, Human
ccaccaauuaugaugccaa

SEQ ID NO: 1062607 - RNA, 21 nt, Human
ccauccagagaauuuucaucu

SEQ ID NO: 1062608 - RNA, 18 nt, Human
gcagaguagcaaaggaga

SEQ ID NO: 1062609 - RNA, 19 nt, Human
uaaaauuauguaauuaggg

SEQ ID NO: 1062610 - RNA, 19 nt, Human
uagcagaguagcaaaggag

SEQ ID NO: 1062611 - RNA, 28 nt, Human
uauguaauuaggggcacacacauauaua

SEQ ID NO: 1062612 - RNA, 23 nt, Human
ugauguucauauagauauacaga

SEQ ID NO: 1062613 - RNA, 18 nt, Human
ugcuuggaauccuuuggg

SEQ ID NO: 1062614 - RNA, 25 nt, Human
uucagaaugaaaaagaguugaauaa

SEQ ID NO: 1062615 - RNA, 23 nt, Human
uucuauggaggaaucugacaggg

SEQ ID NO: 1062616 - RNA, 22 nt, Human
aacacagcgcagacaugcuccc

SEQ ID NO: 1062617 - RNA, 22 nt, Human
acagcgcagacaugcucccaga

SEQ ID NO: 1062618 - RNA, 22 nt, Human
caacacagcgcagacaugcucc

SEQ ID NO: 1062619 - RNA, 19 nt, Human
cacacccccacaagcacug

SEQ ID NO: 1062620 - RNA, 18 nt, Human
cacuggaugacccaggga

SEQ ID NO: 1062621 - RNA, 18 nt, Human
cagcgcagacaugcuccc

SEQ ID NO: 1062622 - RNA, 19 nt, Human
cagcgcagacaugcuccca

SEQ ID NO: 1062623 - RNA, 23 nt, Human
caggagauuuccucugauugcuu

SEQ ID NO: 1062624 - RNA, 24 nt, Human
ccagaaccacacccccacaagcac

SEQ ID NO: 1062625 - RNA, 18 nt, Human
gaaccacacccccacaag

SEQ ID NO: 1062626 - RNA, 22 nt, Human
gcagacaugcucccagaaccac

SEQ ID NO: 1062627 - RNA, 19 nt, Human
gcuucccugcaacacagcg

SEQ ID NO: 1062628 - RNA, 24 nt, Human
ucacuggaugacccagggacaugu

SEQ ID NO: 1062629 - RNA, 18 nt, Human
ucccagaaccacaccccc

SEQ ID NO: 1062630 - RNA, 22 nt, Human
ucccagaaccacacccccacaa

SEQ ID NO: 1062631 - RNA, 25 nt, Human
ucccagaaccacacccccacaagca

SEQ ID NO: 1062632 - RNA, 21 nt, Human
ucucacuggaugacccaggga

SEQ ID NO: 1062633 - RNA, 21 nt, Human
ugcucccagaaccacaccccc

SEQ ID NO: 1062634 - RNA, 23 nt, Human
aaccuuguaucucaagaaggcug

SEQ ID NO: 1062635 - RNA, 22 nt, Human
accuuguaucucaagaaggcug

SEQ ID NO: 1062636 - RNA, 19 nt, Human
aggcugugagguggaccag

SEQ ID NO: 1062637 - RNA, 22 nt, Human
agguggaccagcuuggaagggu

SEQ ID NO: 1062638 - RNA, 18 nt, Human
caagaaggcugugaggug

SEQ ID NO: 1062639 - RNA, 19 nt, Human
ccagcuuggaagggucauc

SEQ ID NO: 1062640 - RNA, 22 nt, Human
gaaacucuucaccuucccacaa

SEQ ID NO: 1062641 - RNA, 27 nt, Human
ggaaacucuucaccuucccacaaugcc

SEQ ID NO: 1062642 - RNA, 21 nt, Human
uccuuagggaaacucuucacc

SEQ ID NO: 1062643 - RNA, 22 nt, Human
ugugagguggaccagcuuggaa

SEQ ID NO: 1062644 - RNA, 24 nt, Human
acaaacaguaccccgacauucagc

SEQ ID NO: 1062645 - RNA, 23 nt, Human
caaacaguaccccgacauucagc

SEQ ID NO: 1062646 - RNA, 21 nt, Human
cucaggggaggaccaagagga

SEQ ID NO: 1062647 - RNA, 18 nt, Human
uagacaggccccuccuuc

SEQ ID NO: 1062648 - RNA, 25 nt, Human
uagacaggccccuccuucgcaguuc

SEQ ID NO: 1062649 - RNA, 19 nt, Human
agcaggugcuccacgcucu

SEQ ID NO: 1062650 - RNA, 25 nt, Human
agggaagaacuuugaauuuaauugu

SEQ ID NO: 1062651 - RNA, 19 nt, Human
ccugguagcggcugaagcu

SEQ ID NO: 1062652 - RNA, 24 nt, Human
gacccggccguagcgcccgggggu

SEQ ID NO: 1062653 - RNA, 20 nt, Human
gggaagaggcuguuaacgag

SEQ ID NO: 1062654 - RNA, 24 nt, Human
uaaggugaaaauaugccaagcaga

SEQ ID NO: 1062655 - RNA, 23 nt, Human
ucuuggccaggcugugcuggggc

SEQ ID NO: 1062656 - RNA, 18 nt, Human
ucuuuggucuugauaaga

SEQ ID NO: 1062657 - RNA, 18 nt, Human
uggaaggaggugacgaug

SEQ ID NO: 1062658 - RNA, 19 nt, Human
uggaaggaggugacgauga

SEQ ID NO: 1062659 - RNA, 18 nt, Human
uggccaggcugugcuggg

SEQ ID NO: 1062660 - RNA, 19 nt, Human
uggccaggcugugcugggg

SEQ ID NO: 1062661 - RNA, 22 nt, Human
uggcuuucuggaaggaggugac

SEQ ID NO: 1062662 - RNA, 20 nt, Human
ugugcuggggcgccagcagg

SEQ ID NO: 1062663 - RNA, 24 nt, Human
uuaacauaaucucuuuggucuuga

SEQ ID NO: 1062664 - RNA, 24 nt, Human
aaguuuaucacccagguucugguu

SEQ ID NO: 1062665 - RNA, 22 nt, Human
auauaccucuagaacaaaacua

SEQ ID NO: 1062666 - RNA, 23 nt, Human
caaacuaagacuuuccuucccaa

SEQ ID NO: 1062667 - RNA, 24 nt, Human
caaacuaagacuuuccuucccaaa

SEQ ID NO: 1062668 - RNA, 19 nt, Human
cagccuuguuggagaaaau

SEQ ID NO: 1062669 - RNA, 21 nt, Human
cccaaagaugguuuccucccc

SEQ ID NO: 1062670 - RNA, 19 nt, Human
cuucccaaagaugguuucc

SEQ ID NO: 1062671 - RNA, 26 nt, Human
uacuguuuuuuuuuaagauuaugaga

SEQ ID NO: 1062672 - RNA, 20 nt, Human
uagaacaaaacuacauuaac

SEQ ID NO: 1062673 - RNA, 23 nt, Human
uagaacaaaacuacauuaacauu

SEQ ID NO: 1062674 - RNA, 24 nt, Human
uaucucagccuuguuggagaaaau

SEQ ID NO: 1062675 - RNA, 22 nt, Human
ugaaaguacacucugaaagcua

SEQ ID NO: 1062676 - RNA, 25 nt, Human
ugauuuaucauuauaaguucacaug

SEQ ID NO: 1062677 - RNA, 22 nt, Human
ugcuaaaaaguuuaucacccag

SEQ ID NO: 1062678 - RNA, 19 nt, Human
uucauauaaacauaaacuu

SEQ ID NO: 1062679 - RNA, 19 nt, Human
uuccuucccaaagaugguu

SEQ ID NO: 1062680 - RNA, 27 nt, Human
uuuaacugaacuguuauuauuucuaau

SEQ ID NO: 1062681 - RNA, 24 nt, Human
uuuguugagccacauuuugagggu

SEQ ID NO: 1062682 - RNA, 19 nt, Human
aaagugcuaggauuacagg

SEQ ID NO: 1062683 - RNA, 24 nt, Human
aaagugcuaggauuacagguguga

SEQ ID NO: 1062684 - RNA, 26 nt, Human
aagugcuaggauuacaggugugagcc

SEQ ID NO: 1062685 - RNA, 24 nt, Human
aaugcagucgugugaucuuggcuc

SEQ ID NO: 1062686 - RNA, 20 nt, Human
acaccacugcacuccagucu

SEQ ID NO: 1062687 - RNA, 24 nt, Human
acaccacugcacuccagucugggc

SEQ ID NO: 1062688 - RNA, 22 nt, Human
accacugcacuccagucugggc

SEQ ID NO: 1062689 - RNA, 21 nt, Human
accgcacccgacccucuuugc

SEQ ID NO: 1062690 - RNA, 18 nt, Human
acgggguuucacuguguu

SEQ ID NO: 1062691 - RNA, 19 nt, Human
acgggguuucacuguguua

SEQ ID NO: 1062692 - RNA, 20 nt, Human
acgggguuucacuguguuag

SEQ ID NO: 1062693 - RNA, 18 nt, Human
acugcaagcuccgccucc

SEQ ID NO: 1062694 - RNA, 24 nt, Human
acugcacuccagucugggcaacag

SEQ ID NO: 1062695 - RNA, 24 nt, Human
acugcacuccagucugggcaacag

SEQ ID NO: 1062696 - RNA, 24 nt, Human
agauggucuugaucuccugaccuc

SEQ ID NO: 1062697 - RNA, 24 nt, Human
agcugcuugaaaggcugagguggg

SEQ ID NO: 1062698 - RNA, 24 nt, Human
aggauugcuugagcucaggaguuc

SEQ ID NO: 1062699 - RNA, 24 nt, Human
aggcugaggugggaggauugcuug

SEQ ID NO: 1062700 - RNA, 18 nt, Human
agguacaguggcucccaa

SEQ ID NO: 1062701 - RNA, 22 nt, Human
aggugggaggauugcuugagcu

SEQ ID NO: 1062702 - RNA, 24 nt, Human
aucacaccacugcacuccagucug

SEQ ID NO: 1062703 - RNA, 24 nt, Human
caaagugcuaggauuacaggugug

SEQ ID NO: 1062704 - RNA, 21 nt, Human
cacaccacugcacuccagucu

SEQ ID NO: 1062705 - RNA, 24 nt, Human
caccacugcacuccagucugggca

SEQ ID NO: 1062706 - RNA, 21 nt, Human
cacccugaccucccacagcuc

SEQ ID NO: 1062707 - RNA, 23 nt, Human
cacuccagucugggcaacagagc

SEQ ID NO: 1062708 - RNA, 24 nt, Human
cacuccagucugggcaacagagcg

SEQ ID NO: 1062709 - RNA, 19 nt, Human
cacugcacuccagucuggg

SEQ ID NO: 1062710 - RNA, 21 nt, Human
cacugcacuccagucugggca

SEQ ID NO: 1062711 - RNA, 22 nt, Human
cacugcacuccagucugggcaa

SEQ ID NO: 1062712 - RNA, 23 nt, Human
cacugcacuccagucugggcaac

SEQ ID NO: 1062713 - RNA, 24 nt, Human
cacugcacuccagucugggcaaca

SEQ ID NO: 1062714 - RNA, 24 nt, Human
cacuguguuagccaagauggucuu

SEQ ID NO: 1062715 - RNA, 18 nt, Human
caggaguucuaggcuaua

SEQ ID NO: 1062716 - RNA, 21 nt, Human
ccaaagugcuaggauuacagg

SEQ ID NO: 1062717 - RNA, 24 nt, Human
ccaaagugcuaggauuacaggugu

SEQ ID NO: 1062718 - RNA, 19 nt, Human
ccaacuguacuccuagcug

SEQ ID NO: 1062719 - RNA, 18 nt, Human
ccaagccaucacauagaa

SEQ ID NO: 1062720 - RNA, 20 nt, Human
ccacugcacuccagucuggg

SEQ ID NO: 1062721 - RNA, 21 nt, Human
ccacugcacuccagucugggc

SEQ ID NO: 1062722 - RNA, 23 nt, Human
ccacugcacuccagucugggcaa

SEQ ID NO: 1062723 - RNA, 24 nt, Human
ccacugcacuccagucugggcaac

SEQ ID NO: 1062724 - RNA, 21 nt, Human
cccacccugaccucccacagc

SEQ ID NO: 1062725 - RNA, 20 nt, Human
cccgacccucuuugcucuau

SEQ ID NO: 1062726 - RNA, 24 nt, Human
ccugccucagccuccugagcagcu

SEQ ID NO: 1062727 - RNA, 19 nt, Human
cgccucccggguuuacgcc

SEQ ID NO: 1062728 - RNA, 24 nt, Human
cgcucugucacccaggcuagaaug

SEQ ID NO: 1062729 - RNA, 19 nt, Human
cgggguuucacuguguuag

SEQ ID NO: 1062730 - RNA, 21 nt, Human
cuaggacuacaggaacccgcc

SEQ ID NO: 1062731 - RNA, 23 nt, Human
cucccaacuguacuccuagcugc

SEQ ID NO: 1062732 - RNA, 24 nt, Human
cuccugaccucaugauccgccugc

SEQ ID NO: 1062733 - RNA, 24 nt, Human
cuccugagcagcuaggacuacagg

SEQ ID NO: 1062734 - RNA, 23 nt, Human
cugccucggccucccaaagugcu

SEQ ID NO: 1062735 - RNA, 21 nt, Human
cugcuugaaaggcugaggugg

SEQ ID NO: 1062736 - RNA, 20 nt, Human
cuugagcucaggaguucuag

SEQ ID NO: 1062737 - RNA, 19 nt, Human
gaacccgccaccacgccug

SEQ ID NO: 1062738 - RNA, 19 nt, Human
gaagaaucucccucagacu

SEQ ID NO: 1062739 - RNA, 22 nt, Human
gaccucaugauccgccugccuc

SEQ ID NO: 1062740 - RNA, 22 nt, Human
gaccucaugauccgccugccuc

SEQ ID NO: 1062741 - RNA, 24 nt, Human
gaccucaugauccgccugccucgg

SEQ ID NO: 1062742 - RNA, 21 nt, Human
gagacagagucucgcucuguc

SEQ ID NO: 1062743 - RNA, 20 nt, Human
gagcagcuaggacuacagga

SEQ ID NO: 1062744 - RNA, 26 nt, Human
gagcagcuaggacuacaggaacccgc

SEQ ID NO: 1062745 - RNA, 24 nt, Human
gaggugggaggauugcuugagcuc

SEQ ID NO: 1062746 - RNA, 18 nt, Human
gauuacaggugugagcca

SEQ ID NO: 1062747 - RNA, 20 nt, Human
gauuacaggugugagccacc

SEQ ID NO: 1062748 - RNA, 23 nt, Human
gauuacaggugugagccaccgca

SEQ ID NO: 1062749 - RNA, 24 nt, Human
gcacuccagucugggcaacagagc

SEQ ID NO: 1062750 - RNA, 19 nt, Human
gccauucuccugccucagc

SEQ ID NO: 1062751 - RNA, 25 nt, Human
gccucccggguuuacgccauucucc

SEQ ID NO: 1062752 - RNA, 21 nt, Human
gccuccugagcagcuaggacu

SEQ ID NO: 1062753 - RNA, 23 nt, Human
gccuggcuaauuuuuuguauuuu

SEQ ID NO: 1062754 - RNA, 25 nt, Human
gcucugucacccaggcuagaaugca

SEQ ID NO: 1062755 - RNA, 22 nt, Human
ggacuacaggaacccgccacca

SEQ ID NO: 1062756 - RNA, 19 nt, Human
ggagaguuucccaauuaga

SEQ ID NO: 1062757 - RNA, 22 nt, Human
ggaggauugcuugagcucagga

SEQ ID NO: 1062758 - RNA, 22 nt, Human
ggauuacaggugugagccaccg

SEQ ID NO: 1062759 - RNA, 23 nt, Human
ggauugcuugagcucaggaguuc

SEQ ID NO: 1062760 - RNA, 18 nt, Human
gggguuucacuguguuag

SEQ ID NO: 1062761 - RNA, 23 nt, Human
guagagacgggguuucacugugu

SEQ ID NO: 1062762 - RNA, 18 nt, Human
gugaagcuacuuuaacca

SEQ ID NO: 1062763 - RNA, 23 nt, Human
guuaugaucacaccacugcacuu

SEQ ID NO: 1062764 - RNA, 21 nt, Human
uaaauggagaguuucccaauu

SEQ ID NO: 1062765 - RNA, 24 nt, Human
uaacacaaacauauuauucacugu

SEQ ID NO: 1062766 - RNA, 23 nt, Human
uaaccaucuauuaaaggaacaac

SEQ ID NO: 1062767 - RNA, 24 nt, Human
uaaccaucuauuaaaggaacaaca

SEQ ID NO: 1062768 - RNA, 24 nt, Human
uaauuuuuuguauuuuuaguagag

SEQ ID NO: 1062769 - RNA, 22 nt, Human
uacaggaacccgccaccacgcc

SEQ ID NO: 1062770 - RNA, 23 nt, Human
uacaggugugagccaccgcaccc

SEQ ID NO: 1062771 - RNA, 22 nt, Human
uacucuuaaucucacauacaga

SEQ ID NO: 1062772 - RNA, 23 nt, Human
uagaaugcagucgugugaucuug

SEQ ID NO: 1062773 - RNA, 24 nt, Human
uagaaugcagucgugugaucuugg

SEQ ID NO: 1062774 - RNA, 24 nt, Human
uagcugcuugaaaggcugaggugg

SEQ ID NO: 1062775 - RNA, 25 nt, Human
uaggaaaugccuaauuuacuaccau

SEQ ID NO: 1062776 - RNA, 24 nt, Human
uaggacuacaggaacccgccacca

SEQ ID NO: 1062777 - RNA, 18 nt, Human
uaggauuacaggugugag

SEQ ID NO: 1062778 - RNA, 19 nt, Human
uaggauuacaggugugagc

SEQ ID NO: 1062779 - RNA, 22 nt, Human
uaggauuacaggugugagccac

SEQ ID NO: 1062780 - RNA, 23 nt, Human
uaggauuacaggugugagccacc

SEQ ID NO: 1062781 - RNA, 24 nt, Human
uaggauuacaggugugagccaccg

SEQ ID NO: 1062782 - RNA, 20 nt, Human
uaguagagacgggguuucac

SEQ ID NO: 1062783 - RNA, 23 nt, Human
uaguagagacgggguuucacugu

SEQ ID NO: 1062784 - RNA, 24 nt, Human
uaguagagacgggguuucacugug

SEQ ID NO: 1062785 - RNA, 21 nt, Human
uauaaagcaauaaaucgcuua

SEQ ID NO: 1062786 - RNA, 23 nt, Human
ucacaccacugcacuccagucug

SEQ ID NO: 1062787 - RNA, 19 nt, Human
ucacccaggcuagaaugca

SEQ ID NO: 1062788 - RNA, 18 nt, Human
ucacugcaagcuccgccu

SEQ ID NO: 1062789 - RNA, 19 nt, Human
ucacugcaagcuccgccuc

SEQ ID NO: 1062790 - RNA, 24 nt, Human
ucacugcaagcuccgccucccggg

SEQ ID NO: 1062791 - RNA, 24 nt, Human
ucacuguguuagccaagauggucu

SEQ ID NO: 1062792 - RNA, 19 nt, Human
uccagucccacccugaccu

SEQ ID NO: 1062793 - RNA, 23 nt, Human
uccagucugggcaacagagcgag

SEQ ID NO: 1062794 - RNA, 24 nt, Human
uccagucugggcaacagagcgagg

SEQ ID NO: 1062795 - RNA, 23 nt, Human
ucccaaagugcuaggauuacagg

SEQ ID NO: 1062796 - RNA, 18 nt, Human
ucccaacuguacuccuag

SEQ ID NO: 1062797 - RNA, 21 nt, Human
ucccggguuuacgccauucuc

SEQ ID NO: 1062798 - RNA, 24 nt, Human
ucccggguuuacgccauucuccug

SEQ ID NO: 1062799 - RNA, 18 nt, Human
ucggccucccaaagugcu

SEQ ID NO: 1062800 - RNA, 19 nt, Human
ucucgcucugucacccagg

SEQ ID NO: 1062801 - RNA, 23 nt, Human
ucucgcucugucacccaggcuag

SEQ ID NO: 1062802 - RNA, 26 nt, Human
ucucgcucugucacccaggcuagaau

SEQ ID NO: 1062803 - RNA, 27 nt, Human
ucucgcucugucacccaggcuagaaug

SEQ ID NO: 1062804 - RNA, 24 nt, Human
ucugucacccaggcuagaaugcag

SEQ ID NO: 1062805 - RNA, 22 nt, Human
ugaaaggcugaggugggaggau

SEQ ID NO: 1062806 - RNA, 21 nt, Human
ugagccaccgcacccgacccu

SEQ ID NO: 1062807 - RNA, 20 nt, Human
ugaggugggaggauugcuug

SEQ ID NO: 1062808 - RNA, 22 nt, Human
ugaggugggaggauugcuugag

SEQ ID NO: 1062809 - RNA, 23 nt, Human
ugaggugggaggauugcuugagc

SEQ ID NO: 1062810 - RNA, 23 nt, Human
ugaggugggaggauugcuugagc

SEQ ID NO: 1062811 - RNA, 24 nt, Human
ugaggugggaggauugcuugagcu

SEQ ID NO: 1062812 - RNA, 25 nt, Human
ugcagcagccaaaaaggcaggugau

SEQ ID NO: 1062813 - RNA, 23 nt, Human
ugccucagccuccugagcagcua

SEQ ID NO: 1062814 - RNA, 24 nt, Human
ugccucagccuccugagcagcuag

SEQ ID NO: 1062815 - RNA, 21 nt, Human
ugccucggccucccaaagugc

SEQ ID NO: 1062816 - RNA, 23 nt, Human
ugccucggccucccaaagugcua

SEQ ID NO: 1062817 - RNA, 24 nt, Human
ugccucggccucccaaagugcuag

SEQ ID NO: 1062818 - RNA, 24 nt, Human
ugcuaggauuacaggugugagcca

SEQ ID NO: 1062819 - RNA, 18 nt, Human
uggcucacugcaagcucc

SEQ ID NO: 1062820 - RNA, 21 nt, Human
uguauuuuuaguagagacggg

SEQ ID NO: 1062821 - RNA, 18 nt, Human
uuaguagagacgggguuu

SEQ ID NO: 1062822 - RNA, 21 nt, Human
uuaguagagacgggguuucac

SEQ ID NO: 1062823 - RNA, 21 nt, Human
uuaguagagacgggguuucac

SEQ ID NO: 1062824 - RNA, 24 nt, Human
uuaguagagacgggguuucacugu

SEQ ID NO: 1062825 - RNA, 20 nt, Human
uugaaaggcugaggugggag

SEQ ID NO: 1062826 - RNA, 24 nt, Human
uugcuugagcucaggaguucuagg

SEQ ID NO: 1062827 - RNA, 19 nt, Human
uuucacuguguuagccaag

SEQ ID NO: 1062828 - RNA, 24 nt, Human
uuuuuaguagagacgggguuucac

SEQ ID NO: 1062829 - RNA, 21 nt, Human
uuuuuguauuuuuaguagaga

SEQ ID NO: 1062830 - RNA, 24 nt, Human
uuuuuuguauuuuuaguagagacg

SEQ ID NO: 1062831 - RNA, 19 nt, Human
aaaccagcuccaaacucaa

SEQ ID NO: 1062832 - RNA, 24 nt, Human
aaaccagcuccaaacucaaaccag

SEQ ID NO: 1062833 - RNA, 21 nt, Human
aaccagcuccaaacucaaacc

SEQ ID NO: 1062834 - RNA, 24 nt, Human
ucaaaaccagcuccaaacucaaac

SEQ ID NO: 1062835 - RNA, 25 nt, Human
uccaaacucaaaccaguuagggaug

SEQ ID NO: 1062836 - RNA, 22 nt, Human
acccuggaucccuuccaggagc

SEQ ID NO: 1062837 - RNA, 22 nt, Human
acccuggaucccuuccaggagc

SEQ ID NO: 1062838 - RNA, 20 nt, Human
ccucuggggacaucuugggg

SEQ ID NO: 1062839 - RNA, 18 nt, Human
ccuggaucccuuccagga

SEQ ID NO: 1062840 - RNA, 23 nt, Human
cguggugacccuggaucccuucc

SEQ ID NO: 1062841 - RNA, 19 nt, Human
gcagggcaaagacaacuuc

SEQ ID NO: 1062842 - RNA, 18 nt, Human
ggagauacaauauccccu

SEQ ID NO: 1062843 - RNA, 19 nt, Human
ggaguguuuccaaagauuc

SEQ ID NO: 1062844 - RNA, 21 nt, Human
uccaaagauucaaaguuugac

SEQ ID NO: 1062845 - RNA, 24 nt, Human
uccucuguccucucaucguuacuc

SEQ ID NO: 1062846 - RNA, 24 nt, Human
ucuucuuccucuguccucucaucg

SEQ ID NO: 1062847 - RNA, 18 nt, Human
ugacccuggaucccuucc

SEQ ID NO: 1062848 - RNA, 21 nt, Human
ugcaccuuuuacaucugggcu

SEQ ID NO: 1062849 - RNA, 19 nt, Human
ugggcucuggagcccuaug

SEQ ID NO: 1062850 - RNA, 24 nt, Human
uggugaacucuucuuccucugucc

SEQ ID NO: 1062851 - RNA, 20 nt, Human
aagcuuaaagugagaagucc

SEQ ID NO: 1062852 - RNA, 18 nt, Human
agccacaccggggugcca

SEQ ID NO: 1062853 - RNA, 20 nt, Human
cagagccacaccggggugcc

SEQ ID NO: 1062854 - RNA, 21 nt, Human
cagcagcagugccacguggag

SEQ ID NO: 1062855 - RNA, 18 nt, Human
cggggugccagcugggaa

SEQ ID NO: 1062856 - RNA, 18 nt, Human
cugggaagccuuccugcu

SEQ ID NO: 1062857 - RNA, 18 nt, Human
ggaaucacagauguaagc

SEQ ID NO: 1062858 - RNA, 26 nt, Human
ucagcagcagugccacguggagaguc

SEQ ID NO: 1062859 - RNA, 21 nt, Human
uuagcuguucugugaagaguu

SEQ ID NO: 1062860 - RNA, 22 nt, Human
aaccuccuucuccuugcaaaac

SEQ ID NO: 1062861 - RNA, 23 nt, Human
aagcagcagacagccugacagaa

SEQ ID NO: 1062862 - RNA, 23 nt, Human
aggaaacccaggccgaggucgcc

SEQ ID NO: 1062863 - RNA, 20 nt, Human
aggugcugggguuggggacc

SEQ ID NO: 1062864 - RNA, 20 nt, Human
ccuugaggugcugggguugg

SEQ ID NO: 1062865 - RNA, 21 nt, Human
cgcagcucccgcguacacgug

SEQ ID NO: 1062866 - RNA, 21 nt, Human
cguggccggaucugggcugga

SEQ ID NO: 1062867 - RNA, 18 nt, Human
cugggguuggggaccaag

SEQ ID NO: 1062868 - RNA, 19 nt, Human
cuugcaaaacccucacacc

SEQ ID NO: 1062869 - RNA, 20 nt, Human
cuugcaaaacccucacacca

SEQ ID NO: 1062870 - RNA, 21 nt, Human
cuuucuggagcucaucgaaca

SEQ ID NO: 1062871 - RNA, 23 nt, Human
gacuuucuuuuccugcuccugcu

SEQ ID NO: 1062872 - RNA, 19 nt, Human
gagcguggucgacgaagcc

SEQ ID NO: 1062873 - RNA, 20 nt, Human
gcgcugggguccucuggcuc

SEQ ID NO: 1062874 - RNA, 24 nt, Human
uaaaccuccuucuccuugcaaaac

SEQ ID NO: 1062875 - RNA, 21 nt, Human
uaugaauaaaccuccuucucc

SEQ ID NO: 1062876 - RNA, 19 nt, Human
ucgcaucgucuucuuucug

SEQ ID NO: 1062877 - RNA, 20 nt, Human
ucuccuccagcuucagucac

SEQ ID NO: 1062878 - RNA, 21 nt, Human
ucuccuugcaaaacccucaca

SEQ ID NO: 1062879 - RNA, 25 nt, Human
ugacacccacaauugugaagagaga

SEQ ID NO: 1062880 - RNA, 19 nt, Human
ugacagaaaguucaugcuc

SEQ ID NO: 1062881 - RNA, 25 nt, Human
ugacagaaaguucaugcucacccaa

SEQ ID NO: 1062882 - RNA, 18 nt, Human
ugcaaaacccucacacca

SEQ ID NO: 1062883 - RNA, 20 nt, Human
uggaauuucugagaaauccu

SEQ ID NO: 1062884 - RNA, 19 nt, Human
uggacuucgggucggacgc

SEQ ID NO: 1062885 - RNA, 23 nt, Human
uggcuccugguccgaguuccucc

SEQ ID NO: 1062886 - RNA, 19 nt, Human
ugugcuccuugaggugcug

SEQ ID NO: 1062887 - RNA, 22 nt, Human
uucaugcucacccaagaaaaug

SEQ ID NO: 1062888 - RNA, 22 nt, Human
uucuuugugcuuaaaaugaaua

SEQ ID NO: 1062889 - RNA, 18 nt, Human
uuggaaauucuuugugcu

SEQ ID NO: 1062890 - RNA, 18 nt, Human
uuucugagaaauccuugg

SEQ ID NO: 1062891 - RNA, 24 nt, Human
aaaaaaacaaaaaaaacacguugg

SEQ ID NO: 1062892 - RNA, 26 nt, Human
aaaaaaacaaaaaaacaaaaaaaaca

SEQ ID NO: 1062893 - RNA, 26 nt, Human
aaaaaaacaaaaaaacaaaaaaaaca

SEQ ID NO: 1062894 - RNA, 26 nt, Human
aaaaaacaaaaaaacaaaaaaaacac

SEQ ID NO: 1062895 - RNA, 28 nt, Human
aaaaaacaaaaaaacaaaaaaacaaaaa

SEQ ID NO: 1062896 - RNA, 20 nt, Human
aaaaagggaauucccucuag

SEQ ID NO: 1062897 - RNA, 23 nt, Human
aaaacaaaaaaaacaaaaaaaca

SEQ ID NO: 1062898 - RNA, 28 nt, Human
aaaacaaaaaaaacaaaaaaacaaaaaa

SEQ ID NO: 1062899 - RNA, 20 nt, Human
aaaacaaaaaaacaaaaaaa

SEQ ID NO: 1062900 - RNA, 20 nt, Human
aaaacaaaaaaacaaaaaaa

SEQ ID NO: 1062901 - RNA, 22 nt, Human
aaaacaaaaaaacaaaaaaaca

SEQ ID NO: 1062902 - RNA, 26 nt, Human
aaaacaaaaaaacaaaaaaacaaaaa

SEQ ID NO: 1062903 - RNA, 21 nt, Human
aaaagcaggcaaguuuagcua

SEQ ID NO: 1062904 - RNA, 22 nt, Human
aaacaaaaaaaacaaaaaaaca

SEQ ID NO: 1062905 - RNA, 25 nt, Human
aaacaaaaaaaacacguuggucugg

SEQ ID NO: 1062906 - RNA, 23 nt, Human
aaacauugggaauuaccacgacc

SEQ ID NO: 1062907 - RNA, 20 nt, Human
aaccacgauuuucccauuua

SEQ ID NO: 1062908 - RNA, 27 nt, Human
aagcuucuuuucaaaccacgauuuucc

SEQ ID NO: 1062909 - RNA, 20 nt, Human
aauuaccacgacccccaagu

SEQ ID NO: 1062910 - RNA, 25 nt, Human
acaaaaaaacaaaaaaaacaaaaaa

SEQ ID NO: 1062911 - RNA, 23 nt, Human
acaaaaaaacaaaaaaacaaaaa

SEQ ID NO: 1062912 - RNA, 19 nt, Human
accacgacccccaagugcu

SEQ ID NO: 1062913 - RNA, 22 nt, Human
agaaaccaggaccuuguuaaau

SEQ ID NO: 1062914 - RNA, 18 nt, Human
agagagaaaaugcccaag

SEQ ID NO: 1062915 - RNA, 21 nt, Human
agaugacgauaagagucuaaa

SEQ ID NO: 1062916 - RNA, 21 nt, Human
agcaucaggaacaggcaagga

SEQ ID NO: 1062917 - RNA, 19 nt, Human
agguuugggagguuuagaa

SEQ ID NO: 1062918 - RNA, 18 nt, Human
aucucacacuuuuccuuc

SEQ ID NO: 1062919 - RNA, 24 nt, Human
aucuccuuccaggucaucguuuca

SEQ ID NO: 1062920 - RNA, 28 nt, Human
caaaaaaaacaaaaaaacaaaaaaacaa

SEQ ID NO: 1062921 - RNA, 19 nt, Human
caagagaaaccaggaccuu

SEQ ID NO: 1062922 - RNA, 21 nt, Human
caagguuucaauacaaugugg

SEQ ID NO: 1062923 - RNA, 19 nt, Human
caccacaacuuuuccucua

SEQ ID NO: 1062924 - RNA, 22 nt, Human
caccacaacuuuuccucuaaaa

SEQ ID NO: 1062925 - RNA, 23 nt, Human
caccaguacccccauccucagcc

SEQ ID NO: 1062926 - RNA, 20 nt, Human
cagcagcaugcaaaauaguu

SEQ ID NO: 1062927 - RNA, 24 nt, Human
cagccuccuggagacuaaaacaac

SEQ ID NO: 1062928 - RNA, 24 nt, Human
cagcucuccauggcugagagagaa

SEQ ID NO: 1062929 - RNA, 18 nt, Human
ccacaacuuuuccucuaa

SEQ ID NO: 1062930 - RNA, 22 nt, Human
ccccauccucagccagaaaguc

SEQ ID NO: 1062931 - RNA, 19 nt, Human
ccccugggggguaaaaaaa

SEQ ID NO: 1062932 - RNA, 20 nt, Human
cccguggagcagugggaagg

SEQ ID NO: 1062933 - RNA, 23 nt, Human
cccuauuaccuggugcaaaauga

SEQ ID NO: 1062934 - RNA, 20 nt, Human
cccugucccuauuuauccac

SEQ ID NO: 1062935 - RNA, 18 nt, Human
ccguucccguuccugagu

SEQ ID NO: 1062936 - RNA, 24 nt, Human
ccuauagucucacucccaacuacc

SEQ ID NO: 1062937 - RNA, 20 nt, Human
ccuccccuacugcccaacca

SEQ ID NO: 1062938 - RNA, 18 nt, Human
ccuucucccucccucccc

SEQ ID NO: 1062939 - RNA, 28 nt, Human
cucaagggaagcuaaaaaaacaaaaaaa

SEQ ID NO: 1062940 - RNA, 18 nt, Human
cucaucacuucccaaaag

SEQ ID NO: 1062941 - RNA, 22 nt, Human
cuggcagccuccuggagacuaa

SEQ ID NO: 1062942 - RNA, 21 nt, Human
cuucccaaaagcuucuuuuca

SEQ ID NO: 1062943 - RNA, 21 nt, Human
cuuguuaaauaguucucucca

SEQ ID NO: 1062944 - RNA, 22 nt, Human
cuuuauggccuauagucucacu

SEQ ID NO: 1062945 - RNA, 24 nt, Human
gaaaacauugggaauuaccacgac

SEQ ID NO: 1062946 - RNA, 23 nt, Human
gaauucauauaugccacaauagg

SEQ ID NO: 1062947 - RNA, 24 nt, Human
gacucaucacuucccaaaagcuuc

SEQ ID NO: 1062948 - RNA, 20 nt, Human
gacugguuuggaaacauagg

SEQ ID NO: 1062949 - RNA, 18 nt, Human
gagaauucauauaugcca

SEQ ID NO: 1062950 - RNA, 18 nt, Human
gcuguagucccuuucucu

SEQ ID NO: 1062951 - RNA, 25 nt, Human
ggaauucccucuaggguggcccuuc

SEQ ID NO: 1062952 - RNA, 24 nt, Human
ggagaaaagcacaggauguagagg

SEQ ID NO: 1062953 - RNA, 20 nt, Human
gggaagcuaaaaaaacaaaa

SEQ ID NO: 1062954 - RNA, 21 nt, Human
ggggcugaucagguuugggag

SEQ ID NO: 1062955 - RNA, 24 nt, Human
guaaaaaaaaaaaaaaaagggaau

SEQ ID NO: 1062956 - RNA, 23 nt, Human
guggugacauaacgcaccacaac

SEQ ID NO: 1062957 - RNA, 28 nt, Human
uaaaaaaacaaaaaaacaaaaaaaacaa

SEQ ID NO: 1062958 - RNA, 19 nt, Human
uaaaaaguagaaaucucac

SEQ ID NO: 1062959 - RNA, 20 nt, Human
uaaaagcaggcaaguuuagc

SEQ ID NO: 1062960 - RNA, 26 nt, Human
uaccacgacccccaagugcuuccggc

SEQ ID NO: 1062961 - RNA, 26 nt, Human
uacccccauccucagccagaaagucu

SEQ ID NO: 1062962 - RNA, 19 nt, Human
uaccuggugcaaaaugacu

SEQ ID NO: 1062963 - RNA, 20 nt, Human
uacuguguugcaagagaaac

SEQ ID NO: 1062964 - RNA, 22 nt, Human
uagaaaggguaaaacuaggaca

SEQ ID NO: 1062965 - RNA, 19 nt, Human
uagaaaucucacacuuuuc

SEQ ID NO: 1062966 - RNA, 28 nt, Human
uaggguggcccccaaaacucagaauuaa

SEQ ID NO: 1062967 - RNA, 24 nt, Human
uauucggcauaaucuucucccuca

SEQ ID NO: 1062968 - RNA, 23 nt, Human
uauuuugguccaaugcaguccca

SEQ ID NO: 1062969 - RNA, 21 nt, Human
uccaagaguggaaaauuuauu

SEQ ID NO: 1062970 - RNA, 27 nt, Human
uccaccaguacccccauccucagccag

SEQ ID NO: 1062971 - RNA, 23 nt, Human
uccaccauccaagaccauccauu

SEQ ID NO: 1062972 - RNA, 20 nt, Human
uccagggguuauaucacucu

SEQ ID NO: 1062973 - RNA, 31 nt, Human
uccauggcugagagagaaaaugcccaagacc

SEQ ID NO: 1062974 - RNA, 18 nt, Human
ucccucuaggguggcccc

SEQ ID NO: 1062975 - RNA, 22 nt, Human
ucccucuaggguggcccccaaa

SEQ ID NO: 1062976 - RNA, 19 nt, Human
ucuagagcacucugaucua

SEQ ID NO: 1062977 - RNA, 19 nt, Human
ucuccauuaccguuuauuc

SEQ ID NO: 1062978 - RNA, 20 nt, Human
ucucccucccuccccuacug

SEQ ID NO: 1062979 - RNA, 20 nt, Human
ucucuccuucgugcauuucu

SEQ ID NO: 1062980 - RNA, 18 nt, Human
ucugaucuauaaaagggg

SEQ ID NO: 1062981 - RNA, 21 nt, Human
ucuggauagagguuuugauuu

SEQ ID NO: 1062982 - RNA, 20 nt, Human
ugaguuuuauuuugucuugu

SEQ ID NO: 1062983 - RNA, 19 nt, Human
ugccacaauaggauaaaaa

SEQ ID NO: 1062984 - RNA, 19 nt, Human
ugcucucgaauguuccagg

SEQ ID NO: 1062985 - RNA, 23 nt, Human
ugcuuccuccaccaguaccccca

SEQ ID NO: 1062986 - RNA, 23 nt, Human
uggagcagugggaaggauggaac

SEQ ID NO: 1062987 - RNA, 21 nt, Human
uggcagccuccuggagacuaa

SEQ ID NO: 1062988 - RNA, 21 nt, Human
ugggggguaaaaaaaaaaaaa

SEQ ID NO: 1062989 - RNA, 28 nt, Human
ugggggguaaaaaaaaaaaaaaaaggga

SEQ ID NO: 1062990 - RNA, 25 nt, Human
uggucuggccaccucaugaauccaa

SEQ ID NO: 1062991 - RNA, 19 nt, Human
ugucucucccgagcagccc

SEQ ID NO: 1062992 - RNA, 18 nt, Human
ugucuugucuggauagag

SEQ ID NO: 1062993 - RNA, 18 nt, Human
uuauaucacucucauuac

SEQ ID NO: 1062994 - RNA, 24 nt, Human
uuauccaccauccaagaccaucca

SEQ ID NO: 1062995 - RNA, 19 nt, Human
uuauucagauaauguuuga

SEQ ID NO: 1062996 - RNA, 21 nt, Human
uucaaaccacgauuuucccau

SEQ ID NO: 1062997 - RNA, 24 nt, Human
uucaggagauggugaguuuuauuu

SEQ ID NO: 1062998 - RNA, 18 nt, Human
uuccuccaccaguacccc

SEQ ID NO: 1062999 - RNA, 22 nt, Human
uuggagaguggcaaucuuccuc

SEQ ID NO: 1063000 - RNA, 21 nt, Human
uuuauccaccauccaagacca

SEQ ID NO: 1063001 - RNA, 22 nt, Human
uuuccccuauuaccuggugcaa

SEQ ID NO: 1063002 - RNA, 22 nt, Human
uuugcucucgaauguuccaggg

SEQ ID NO: 1063003 - RNA, 23 nt, Human
aaaaagcuuauaaaacaccugaa

SEQ ID NO: 1063004 - RNA, 24 nt, Human
acaccugaaggcuuuaaaaaaaga

SEQ ID NO: 1063005 - RNA, 25 nt, Human
acagaaaaaggccccagcauccaaa

SEQ ID NO: 1063006 - RNA, 18 nt, Human
agacagaaaaaggcccca

SEQ ID NO: 1063007 - RNA, 26 nt, Human
agacagaaaaaggccccagcauccaa

SEQ ID NO: 1063008 - RNA, 24 nt, Human
agacugaucaacuuagauugcaca

SEQ ID NO: 1063009 - RNA, 24 nt, Human
agcaaggaguccucccgaaaggga

SEQ ID NO: 1063010 - RNA, 19 nt, Human
aggccagggcucagggggc

SEQ ID NO: 1063011 - RNA, 19 nt, Human
agggggcuggagcaaggag

SEQ ID NO: 1063012 - RNA, 18 nt, Human
augaacucacacagaacc

SEQ ID NO: 1063013 - RNA, 21 nt, Human
augaacucacacagaacccca

SEQ ID NO: 1063014 - RNA, 23 nt, Human
caaaagaguaagggacagaggua

SEQ ID NO: 1063015 - RNA, 19 nt, Human
cacaagacgaauaaaaacu

SEQ ID NO: 1063016 - RNA, 18 nt, Human
cacacagaaccccacuga

SEQ ID NO: 1063017 - RNA, 20 nt, Human
caccugaaggcuuuaaaaaa

SEQ ID NO: 1063018 - RNA, 23 nt, Human
cacugagagacugaucaacuuag

SEQ ID NO: 1063019 - RNA, 24 nt, Human
cagaaaaaggccccagcauccaaa

SEQ ID NO: 1063020 - RNA, 20 nt, Human
cagcauccaaaagaguaagg

SEQ ID NO: 1063021 - RNA, 20 nt, Human
ccacucccucccggaccucc

SEQ ID NO: 1063022 - RNA, 23 nt, Human
ccaugagcccugccucauuggcc

SEQ ID NO: 1063023 - RNA, 24 nt, Human
cccaaucauccacucccucccgga

SEQ ID NO: 1063024 - RNA, 22 nt, Human
cgaaucaaaagcaaucccauga

SEQ ID NO: 1063025 - RNA, 23 nt, Human
cucuauugaggccuccuccucug

SEQ ID NO: 1063026 - RNA, 22 nt, Human
cucuuugaucgugcccgcugcu

SEQ ID NO: 1063027 - RNA, 22 nt, Human
gaacucacacagaaccccacug

SEQ ID NO: 1063028 - RNA, 22 nt, Human
gcccaaucauccacucccuccc

SEQ ID NO: 1063029 - RNA, 22 nt, Human
gcuggagcaaggaguccucccg

SEQ ID NO: 1063030 - RNA, 24 nt, Human
ggaccuccgaaucaaaagcaaucc

SEQ ID NO: 1063031 - RNA, 19 nt, Human
uaaaaagcuuauaaaacac

SEQ ID NO: 1063032 - RNA, 19 nt, Human
uccaaaagaguaagggaca

SEQ ID NO: 1063033 - RNA, 21 nt, Human
uccaaaagaguaagggacaga

SEQ ID NO: 1063034 - RNA, 18 nt, Human
uccacccucagccaagga

SEQ ID NO: 1063035 - RNA, 18 nt, Human
ucccucuucaaggcacuc

SEQ ID NO: 1063036 - RNA, 24 nt, Human
ucucuuugaucgugcccgcugcuc

SEQ ID NO: 1063037 - RNA, 19 nt, Human
uuccucaggaagcccaauc

SEQ ID NO: 1063038 - RNA, 24 nt, Human
uucucacuuccucaggaagcccaa

SEQ ID NO: 1063039 - RNA, 19 nt, Human
uugagccaggugucucuuu

SEQ ID NO: 1063040 - RNA, 23 nt, Human
ggugaccaaaagguaagguacuu

SEQ ID NO: 1063041 - RNA, 19 nt, Human
acccugcaacccugcacca

SEQ ID NO: 1063042 - RNA, 27 nt, Human
acccugcaacccugcaccacagcucuu

SEQ ID NO: 1063043 - RNA, 23 nt, Human
agacagacagacgcacgcacagg

SEQ ID NO: 1063044 - RNA, 19 nt, Human
aggacccugcaacccugcc

SEQ ID NO: 1063045 - RNA, 24 nt, Human
agggggcggccuaacgacugcccu

SEQ ID NO: 1063046 - RNA, 21 nt, Human
caccacagcucugccacccug

SEQ ID NO: 1063047 - RNA, 26 nt, Human
cacgcacaggcacacacgcagccaug

SEQ ID NO: 1063048 - RNA, 25 nt, Human
cacuggccuccugacggcccuagcc

SEQ ID NO: 1063049 - RNA, 22 nt, Human
cacugggcucccucuggcucca

SEQ ID NO: 1063050 - RNA, 20 nt, Human
cagagacagacagacgcacg

SEQ ID NO: 1063051 - RNA, 23 nt, Human
caggacccugcaacccugcacca

SEQ ID NO: 1063052 - RNA, 24 nt, Human
caugucacccuccugcagcucucu

SEQ ID NO: 1063053 - RNA, 18 nt, Human
ccacacuggccuccugac

SEQ ID NO: 1063054 - RNA, 23 nt, Human
ccaggacccugcaacccugcacc

SEQ ID NO: 1063055 - RNA, 19 nt, Human
cccugggcucccggcacuc

SEQ ID NO: 1063056 - RNA, 25 nt, Human
ccuaacgacugcccuggccccuccu

SEQ ID NO: 1063057 - RNA, 21 nt, Human
ccucacccucgcuuucuucuc

SEQ ID NO: 1063058 - RNA, 21 nt, Human
ccuccuccuccaccucuuccc

SEQ ID NO: 1063059 - RNA, 23 nt, Human
ccucuggcuccaccauuaauccc

SEQ ID NO: 1063060 - RNA, 19 nt, Human
ccuggccccuccuccuccc

SEQ ID NO: 1063061 - RNA, 22 nt, Human
cgcacgcacaggcacacacgca

SEQ ID NO: 1063062 - RNA, 24 nt, Human
cucacugggcucccucuggcucca

SEQ ID NO: 1063063 - RNA, 18 nt, Human
cucgcuuucuucucuacc

SEQ ID NO: 1063064 - RNA, 22 nt, Human
cucuaugucaauccaagucaaa

SEQ ID NO: 1063065 - RNA, 22 nt, Human
cuggccuccugacggcccuagc

SEQ ID NO: 1063066 - RNA, 21 nt, Human
ggcccuagccuuugcuccccu

SEQ ID NO: 1063067 - RNA, 18 nt, Human
gggccagagacagacaga

SEQ ID NO: 1063068 - RNA, 20 nt, Human
ucacugggcucccucuggcu

SEQ ID NO: 1063069 - RNA, 21 nt, Human
uccaccauuaaucccucaccc

SEQ ID NO: 1063070 - RNA, 19 nt, Human
uccccggccacacuggccu

SEQ ID NO: 1063071 - RNA, 24 nt, Human
ucccucuggcuccaccauuaaucc

SEQ ID NO: 1063072 - RNA, 22 nt, Human
ucuggggcugggggccagagac

SEQ ID NO: 1063073 - RNA, 22 nt, Human
ugcccuggccccuccuccucca

SEQ ID NO: 1063074 - RNA, 19 nt, Human
ugcuccccugccuggaaug

SEQ ID NO: 1063075 - RNA, 25 nt, Human
ugggcucccggcacucacugggcuc

SEQ ID NO: 1063076 - RNA, 25 nt, Human
uuccccggccacacuggccuccuga

SEQ ID NO: 1063077 - RNA, 18 nt, Human
uucgaucagauaucugcc

SEQ ID NO: 1063078 - RNA, 26 nt, Human
auaguuuuccuuuccaaguacuuuug

SEQ ID NO: 1063079 - RNA, 22 nt, Human
aucacagucaauccugaucaca

SEQ ID NO: 1063080 - RNA, 25 nt, Human
caauaguuuuccuuuccaaguacuu

SEQ ID NO: 1063081 - RNA, 24 nt, Human
gugcuuccagcaauaguuuuccuu

SEQ ID NO: 1063082 - RNA, 21 nt, Human
uccaaguacuuuuggauccau

SEQ ID NO: 1063083 - RNA, 20 nt, Human
ugcaucaucacagucaaucc

SEQ ID NO: 1063084 - RNA, 27 nt, Human
uggauccaugucucaauuggggacgac

SEQ ID NO: 1063085 - RNA, 18 nt, Human
ucucacggcugcccagcu

SEQ ID NO: 1063086 - RNA, 23 nt, Human
uguuucuauggcaucugguaccu

SEQ ID NO: 1063087 - RNA, 19 nt, Human
uuuuaagcgcaaaaugaga

SEQ ID NO: 1063088 - RNA, 21 nt, Human
aaaaaagacuaaggaaacaag

SEQ ID NO: 1063089 - RNA, 22 nt, Human
aaagacuaaggaaacaaguucc

SEQ ID NO: 1063090 - RNA, 20 nt, Human
aaagucacauauaugcuaga

SEQ ID NO: 1063091 - RNA, 18 nt, Human
aacuacugaaacaaaucu

SEQ ID NO: 1063092 - RNA, 28 nt, Human
aagagaaagggccgaggagaggggcggg

SEQ ID NO: 1063093 - RNA, 20 nt, Human
aagagcucaucugugcuuca

SEQ ID NO: 1063094 - RNA, 22 nt, Human
aaguaaaucugaacaacaucua

SEQ ID NO: 1063095 - RNA, 21 nt, Human
aaguuccuggcauucaagggc

SEQ ID NO: 1063096 - RNA, 24 nt, Human
aauaaacagggaagaaguguccaa

SEQ ID NO: 1063097 - RNA, 20 nt, Human
acagaagaaacuaggucaug

SEQ ID NO: 1063098 - RNA, 20 nt, Human
agaaagggccgaggagaggg

SEQ ID NO: 1063099 - RNA, 19 nt, Human
aggaugagcuguguccuug

SEQ ID NO: 1063100 - RNA, 20 nt, Human
aggcagccuccucucgccuc

SEQ ID NO: 1063101 - RNA, 25 nt, Human
aucugggaugacacagacauaggag

SEQ ID NO: 1063102 - RNA, 18 nt, Human
auuuuaagagacggaguc

SEQ ID NO: 1063103 - RNA, 27 nt, Human
caaaaaaggccacaggugccaaguuag

SEQ ID NO: 1063104 - RNA, 22 nt, Human
caaaguaaaucugaacaacauc

SEQ ID NO: 1063105 - RNA, 22 nt, Human
caagcuauucuucugccucagc

SEQ ID NO: 1063106 - RNA, 24 nt, Human
cacaaaaaaggccacaggugccaa

SEQ ID NO: 1063107 - RNA, 18 nt, Human
ccgcugccgggcagcagc

SEQ ID NO: 1063108 - RNA, 20 nt, Human
ccuccucucgccucucgcug

SEQ ID NO: 1063109 - RNA, 27 nt, Human
ccucucgcugcugugugggccgccgac

SEQ ID NO: 1063110 - RNA, 21 nt, Human
ccuuggagugugaaagagcuc

SEQ ID NO: 1063111 - RNA, 18 nt, Human
cucaagcuauucuucugc

SEQ ID NO: 1063112 - RNA, 21 nt, Human
cucaagcuauucuucugccuc

SEQ ID NO: 1063113 - RNA, 23 nt, Human
cucacagcugccuugaagcaguu

SEQ ID NO: 1063114 - RNA, 18 nt, Human
cucuuuaaaucuauaggu

SEQ ID NO: 1063115 - RNA, 18 nt, Human
cugccucagccuccugag

SEQ ID NO: 1063116 - RNA, 21 nt, Human
cugcugccgcugccgggcagc

SEQ ID NO: 1063117 - RNA, 21 nt, Human
gaggagaggggcggggagaga

SEQ ID NO: 1063118 - RNA, 19 nt, Human
gcacaaaaaaggccacagg

SEQ ID NO: 1063119 - RNA, 22 nt, Human
gcagcagccgaggugcugggaa

SEQ ID NO: 1063120 - RNA, 19 nt, Human
gcuagacuaaagcuccugg

SEQ ID NO: 1063121 - RNA, 26 nt, Human
ggaaauacagacacauaagagcacaa

SEQ ID NO: 1063122 - RNA, 24 nt, Human
gggccgccgacgcagcugcugccg

SEQ ID NO: 1063123 - RNA, 22 nt, Human
gggcggggagagagaggcgccu

SEQ ID NO: 1063124 - RNA, 22 nt, Human
uaaaaaagacuaaggaaacaag

SEQ ID NO: 1063125 - RNA, 20 nt, Human
uaagagcacaaaaaaggcca

SEQ ID NO: 1063126 - RNA, 22 nt, Human
uaagagcacaaaaaaggccagu

SEQ ID NO: 1063127 - RNA, 26 nt, Human
uaagagcacaaaaaaggcuggagacc

SEQ ID NO: 1063128 - RNA, 19 nt, Human
uacagauaguguaguauac

SEQ ID NO: 1063129 - RNA, 28 nt, Human
uauaaaaaagacuaaggaaacaaguucc

SEQ ID NO: 1063130 - RNA, 18 nt, Human
uauauugcucaggcuaga

SEQ ID NO: 1063131 - RNA, 23 nt, Human
uauauugcucaggcuagacuaaa

SEQ ID NO: 1063132 - RNA, 23 nt, Human
uaucucacagcugccuugaagca

SEQ ID NO: 1063133 - RNA, 23 nt, Human
ucaaaguaaaucugaacaacauc

SEQ ID NO: 1063134 - RNA, 20 nt, Human
uccauucacauacuugauuc

SEQ ID NO: 1063135 - RNA, 20 nt, Human
uccugggcucaagcuauucu

SEQ ID NO: 1063136 - RNA, 21 nt, Human
uccugggcucaagcuauucuu

SEQ ID NO: 1063137 - RNA, 24 nt, Human
uccugggcucaagcuauucuucug

SEQ ID NO: 1063138 - RNA, 18 nt, Human
ucgccucucgcugcugug

SEQ ID NO: 1063139 - RNA, 22 nt, Human
ucuauagguucauccuccaucu

SEQ ID NO: 1063140 - RNA, 19 nt, Human
ugaggcagacgcguaacac

SEQ ID NO: 1063141 - RNA, 18 nt, Human
ugccaaguuagaauuaug

SEQ ID NO: 1063142 - RNA, 19 nt, Human
ugccgggcagcagccgagg

SEQ ID NO: 1063143 - RNA, 21 nt, Human
ugccucagccuccugaggcag

SEQ ID NO: 1063144 - RNA, 19 nt, Human
uggagugugaaagagcuca

SEQ ID NO: 1063145 - RNA, 25 nt, Human
uguccuguaguuucuuauagucugg

SEQ ID NO: 1063146 - RNA, 24 nt, Human
uucacaauuccauucauccaucca

SEQ ID NO: 1063147 - RNA, 24 nt, Human
uucacauacuugauucuuucaaag

SEQ ID NO: 1063148 - RNA, 25 nt, Human
uuccauucauccauccauucacaua

SEQ ID NO: 1063149 - RNA, 26 nt, Human
uuuuacagauaguguaguauacugcc

SEQ ID NO: 1063150 - RNA, 22 nt, Human
caacauaaagacugcauguaug

SEQ ID NO: 1063151 - RNA, 21 nt, Human
cauaaagacugcauguauggu

SEQ ID NO: 1063152 - RNA, 20 nt, Human
ugcauguaugguuucagcuu

SEQ ID NO: 1063153 - RNA, 28 nt, Human
uuuuacuggugaaguuuccaacauaaag

SEQ ID NO: 1063154 - RNA, 26 nt, Human
cagugacaaagaaucaagauggcgga

SEQ ID NO: 1063155 - RNA, 19 nt, Human
ucagucuucauuugucuug

SEQ ID NO: 1063156 - RNA, 18 nt, Human
ugacaaagaaucaagaug

SEQ ID NO: 1063157 - RNA, 21 nt, Human
uucuugguuucagucuucauu

SEQ ID NO: 1063158 - RNA, 24 nt, Human
agaggauaggggugacgcucugag

SEQ ID NO: 1063159 - RNA, 27 nt, Human
augaagucagaggauaggggugacgcu

SEQ ID NO: 1063160 - RNA, 25 nt, Human
cauggcucuugugauucugugccaa

SEQ ID NO: 1063161 - RNA, 27 nt, Human
cccacuuggccacuuccuaauuagcca

SEQ ID NO: 1063162 - RNA, 18 nt, Human
cccugcugucugaccaca

SEQ ID NO: 1063163 - RNA, 22 nt, Human
cugguggggaugaagucagagg

SEQ ID NO: 1063164 - RNA, 21 nt, Human
gagcacagggucuggcaccca

SEQ ID NO: 1063165 - RNA, 19 nt, Human
gcccuggagcccugcuguc

SEQ ID NO: 1063166 - RNA, 18 nt, Human
guggcuguggagagucca

SEQ ID NO: 1063167 - RNA, 18 nt, Human
uacccaagaucccugccc

SEQ ID NO: 1063168 - RNA, 24 nt, Human
uacccaagaucccugcccuggagc

SEQ ID NO: 1063169 - RNA, 18 nt, Human
uauuggcaccguucagag

SEQ ID NO: 1063170 - RNA, 24 nt, Human
ucuggcacccaggcaaugcuccau

SEQ ID NO: 1063171 - RNA, 19 nt, Human
ugcccuggagcccugcugu

SEQ ID NO: 1063172 - RNA, 19 nt, Human
ugugguggcuguggagagu

SEQ ID NO: 1063173 - RNA, 19 nt, Human
agggacggcgcaguguacc

SEQ ID NO: 1063174 - RNA, 19 nt, Human
cagcgcggccagccuggcg

SEQ ID NO: 1063175 - RNA, 21 nt, Human
caguguaccccuccagcgcgg

SEQ ID NO: 1063176 - RNA, 20 nt, Human
ccgcugcagcugcucccgga

SEQ ID NO: 1063177 - RNA, 23 nt, Human
ccguucuccugccgcugcagcug

SEQ ID NO: 1063178 - RNA, 20 nt, Human
ggaagugcgccaccugcucc

SEQ ID NO: 1063179 - RNA, 18 nt, Human
uccugccgcugcagcugc

SEQ ID NO: 1063180 - RNA, 21 nt, Human
uccugccgcugcagcugcucc

SEQ ID NO: 1063181 - RNA, 20 nt, Human
ucuccugccgcugcagcugc

SEQ ID NO: 1063182 - RNA, 21 nt, Human
aggcgaccucugaaccugagg

SEQ ID NO: 1063183 - RNA, 21 nt, Human
agggagcccugauguugcucc

SEQ ID NO: 1063184 - RNA, 22 nt, Human
cugcagaggcuggcaccgcgaa

SEQ ID NO: 1063185 - RNA, 21 nt, Human
gaaccugagggagcccugaug

SEQ ID NO: 1063186 - RNA, 18 nt, Human
gccugggaagcuagaggc

SEQ ID NO: 1063187 - RNA, 19 nt, Human
gggcuccguggcugacugg

SEQ ID NO: 1063188 - RNA, 19 nt, Human
guugcucccucagaggacc

SEQ ID NO: 1063189 - RNA, 18 nt, Human
ucccucagaggaccugca

SEQ ID NO: 1063190 - RNA, 23 nt, Human
ucccucagaggaccugcagaggc

SEQ ID NO: 1063191 - RNA, 21 nt, Human
uccguggcugacuggccuggg

SEQ ID NO: 1063192 - RNA, 24 nt, Human
uccugcccacgggcuccguggcug

SEQ ID NO: 1063193 - RNA, 18 nt, Human
uggcaccgcgaagcuccu

SEQ ID NO: 1063194 - RNA, 18 nt, Human
uggauuccugagacaugc

SEQ ID NO: 1063195 - RNA, 21 nt, Human
uggauuccugagacaugcuua

SEQ ID NO: 1063196 - RNA, 20 nt, Human
agagagaagcccuguuggua

SEQ ID NO: 1063197 - RNA, 20 nt, Human
ccagagagaagcccuguugg

SEQ ID NO: 1063198 - RNA, 20 nt, Human
gcccuguugguacagcucca

SEQ ID NO: 1063199 - RNA, 18 nt, Human
gggcaggucacacaggga

SEQ ID NO: 1063200 - RNA, 21 nt, Human
gggcaggucacacagggaggu

SEQ ID NO: 1063201 - RNA, 18 nt, Human
ugccagagagaagcccug

SEQ ID NO: 1063202 - RNA, 22 nt, Human
ugggugggcaggucacacaggg

SEQ ID NO: 1063203 - RNA, 22 nt, Human
caacaaggaaacccuuguucuc

SEQ ID NO: 1063204 - RNA, 22 nt, Human
ggaaacccuuguucucccacuu

SEQ ID NO: 1063205 - RNA, 22 nt, Human
uacagccaccaacaaggaaacc

SEQ ID NO: 1063206 - RNA, 19 nt, Human
uuacagccaccaacaagga

SEQ ID NO: 1063207 - RNA, 18 nt, Human
uuugacauuuaaaaccau

SEQ ID NO: 1063208 - RNA, 21 nt, Human
agaagcacuuaaaggauuugc

SEQ ID NO: 1063209 - RNA, 21 nt, Human
cuccaguaugaacuauuuuau

SEQ ID NO: 1063210 - RNA, 21 nt, Human
cuccagugugaauucucuuau

SEQ ID NO: 1063211 - RNA, 18 nt, Human
uaaggguugaggagcggg

SEQ ID NO: 1063212 - RNA, 20 nt, Human
uaguaugaauuuucuuaugu

SEQ ID NO: 1063213 - RNA, 21 nt, Human
ucucuugugguuaauaagggu

SEQ ID NO: 1063214 - RNA, 21 nt, Human
ugagaaugagcucaauguuug

SEQ ID NO: 1063215 - RNA, 22 nt, Human
ugccacauucuucacaucugua

SEQ ID NO: 1063216 - RNA, 23 nt, Human
uguaggguuucucuccaguguga

SEQ ID NO: 1063217 - RNA, 19 nt, Human
ugucuaaugaggugugaga

SEQ ID NO: 1063218 - RNA, 23 nt, Human
ugugggguuucucuccaguauga

SEQ ID NO: 1063219 - RNA, 19 nt, Human
uucauggaugugggguuuc

SEQ ID NO: 1063220 - RNA, 19 nt, Human
uuguaggauuucucagcag

SEQ ID NO: 1063221 - RNA, 19 nt, Human
uuuguaggguuucucucca

SEQ ID NO: 1063222 - RNA, 19 nt, Human
agaaauucucaccaguauc

SEQ ID NO: 1063223 - RNA, 18 nt, Human
agggugaguggauucuug

SEQ ID NO: 1063224 - RNA, 19 nt, Human
cuguauguagucucucgcu

SEQ ID NO: 1063225 - RNA, 25 nt, Human
cuuccuuuccacuccgguucugucc

SEQ ID NO: 1063226 - RNA, 21 nt, Human
uagaaauucucaccaguauca

SEQ ID NO: 1063227 - RNA, 23 nt, Human
uggauucuugaaugacuguaucc

SEQ ID NO: 1063228 - RNA, 19 nt, Human
uucuaagcagggugagugg

SEQ ID NO: 1063229 - RNA, 24 nt, Human
cacaauuuccugaacugaggcaaa

SEQ ID NO: 1063230 - RNA, 21 nt, Human
cacaguaccagggaaacuagg

SEQ ID NO: 1063231 - RNA, 20 nt, Human
cugcugugucugcugcuggu

SEQ ID NO: 1063232 - RNA, 21 nt, Human
uaccagggaaacuaggguucc

SEQ ID NO: 1063233 - RNA, 24 nt, Human
uaccagggaaacuaggguuccccu

SEQ ID NO: 1063234 - RNA, 21 nt, Human
uacugcugugucugcugcugg

SEQ ID NO: 1063235 - RNA, 19 nt, Human
uuacugcugugucugcugc

SEQ ID NO: 1063236 - RNA, 23 nt, Human
uugugacucuuucacaguaccag

SEQ ID NO: 1063237 - RNA, 21 nt, Human
uuuccugaacugaggcaaaug

SEQ ID NO: 1063238 - RNA, 21 nt, Human
aaguacuuuaagggagauuca

SEQ ID NO: 1063239 - RNA, 25 nt, Human
accucccucaccuuguucuccuuca

SEQ ID NO: 1063240 - RNA, 23 nt, Human
accuuguucuccuucaaauucca

SEQ ID NO: 1063241 - RNA, 24 nt, Human
accuuguucuccuucaaauuccac

SEQ ID NO: 1063242 - RNA, 19 nt, Human
acuaagcuguagagaacag

SEQ ID NO: 1063243 - RNA, 18 nt, Human
aucuaacaaugagucuca

SEQ ID NO: 1063244 - RNA, 19 nt, Human
auuuggaaacaccucccuc

SEQ ID NO: 1063245 - RNA, 20 nt, Human
caaugagucucaaauaugga

SEQ ID NO: 1063246 - RNA, 19 nt, Human
ccuccacgaccagcugaaa

SEQ ID NO: 1063247 - RNA, 28 nt, Human
gaaaagccuugaacuguuuuucuacuga

SEQ ID NO: 1063248 - RNA, 22 nt, Human
ggcuuccacauauaagcaauuc

SEQ ID NO: 1063249 - RNA, 20 nt, Human
uaagcuguagagaacaguga

SEQ ID NO: 1063250 - RNA, 18 nt, Human
uaaguacuuuaagggaga

SEQ ID NO: 1063251 - RNA, 19 nt, Human
uaaguacuuuaagggagau

SEQ ID NO: 1063252 - RNA, 25 nt, Human
ucaccuuguucuccuucaaauucca

SEQ ID NO: 1063253 - RNA, 20 nt, Human
ucauuuguaauuggaauuuu

SEQ ID NO: 1063254 - RNA, 22 nt, Human
ugucauaaaagagaauuuguuc

SEQ ID NO: 1063255 - RNA, 19 nt, Human
ugugacagcauacgcuaaa

SEQ ID NO: 1063256 - RNA, 21 nt, Human
uucaacugcuguccuugaacu

SEQ ID NO: 1063257 - RNA, 18 nt, Human
uuccuguuuucauuugua

SEQ ID NO: 1063258 - RNA, 23 nt, Human
uugaagauuuccuccacgaccag

SEQ ID NO: 1063259 - RNA, 19 nt, Human
uuggacaccguaugaaaac

SEQ ID NO: 1063260 - RNA, 18 nt, Human
uuuaucaccauuuuccuu

SEQ ID NO: 1063261 - RNA, 20 nt, Human
uuucuagaaccuccuucagu

SEQ ID NO: 1063262 - RNA, 23 nt, Human
aaggggccaguguagagugacac

SEQ ID NO: 1063263 - RNA, 24 nt, Human
agcauuagagacaugucugaagaa

SEQ ID NO: 1063264 - RNA, 18 nt, Human
agguguccgaggccaccu

SEQ ID NO: 1063265 - RNA, 18 nt, Human
agucacuacugccaggau

SEQ ID NO: 1063266 - RNA, 26 nt, Human
caaauugaguacuuuuauuagaccua

SEQ ID NO: 1063267 - RNA, 19 nt, Human
caagcccuccugccucaua

SEQ ID NO: 1063268 - RNA, 24 nt, Human
cacaguuguccccaagcccuccug

SEQ ID NO: 1063269 - RNA, 22 nt, Human
caggaucagaucaucugggcca

SEQ ID NO: 1063270 - RNA, 23 nt, Human
ucaucugggccauguccccacag

SEQ ID NO: 1063271 - RNA, 18 nt, Human
uccccacaguugucccca

SEQ ID NO: 1063272 - RNA, 19 nt, Human
ugccaggaucagaucaucu

SEQ ID NO: 1063273 - RNA, 26 nt, Human
uuagagacaugucugaagaacuucaa

SEQ ID NO: 1063274 - RNA, 23 nt, Human
aaaaggccgggcagggcaguggg

SEQ ID NO: 1063275 - RNA, 21 nt, Human
aaggggcaaaggggaggaggg

SEQ ID NO: 1063276 - RNA, 24 nt, Human
agcugcguggccccgaagaggggc

SEQ ID NO: 1063277 - RNA, 28 nt, Human
aggggaggagggagagggggaggugggg

SEQ ID NO: 1063278 - RNA, 23 nt, Human
caaaggggaggagggagaggggg

SEQ ID NO: 1063279 - RNA, 21 nt, Human
gcaccgagcuucgagcugcgu

SEQ ID NO: 1063280 - RNA, 20 nt, Human
gccccaagagcccggcaccg

SEQ ID NO: 1063281 - RNA, 18 nt, Human
gccccaggacagcagccc

SEQ ID NO: 1063282 - RNA, 20 nt, Human
gcucagccccaagagcccgg

SEQ ID NO: 1063283 - RNA, 19 nt, Human
ggaggagggagagggggag

SEQ ID NO: 1063284 - RNA, 19 nt, Human
ggaggagggagagggggag

SEQ ID NO: 1063285 - RNA, 20 nt, Human
ggaggagggagagggggagg

SEQ ID NO: 1063286 - RNA, 26 nt, Human
ggaggagggagagggggagguggggu

SEQ ID NO: 1063287 - RNA, 22 nt, Human
ggggaggagggagagggggagg

SEQ ID NO: 1063288 - RNA, 23 nt, Human
ugagaacugcaggaaaaggccgg

SEQ ID NO: 1063289 - RNA, 23 nt, Human
ugccagugaaguuuacgggucuc

SEQ ID NO: 1063290 - RNA, 18 nt, Human
uucgagcugcguggcccc

SEQ ID NO: 1063291 - RNA, 18 nt, Human
aaagugcuggauuacagg

SEQ ID NO: 1063292 - RNA, 23 nt, Human
aaagugcuggauuacaggcauga

SEQ ID NO: 1063293 - RNA, 19 nt, Human
aagcaaauuaaauccuuca

SEQ ID NO: 1063294 - RNA, 24 nt, Human
aaugcaggggaacuacaggaagaa

SEQ ID NO: 1063295 - RNA, 21 nt, Human
aaugcaguggugcgaucucag

SEQ ID NO: 1063296 - RNA, 21 nt, Human
aauggagaagggcacaccaaa

SEQ ID NO: 1063297 - RNA, 24 nt, Human
acaguguuucaccauguuggccag

SEQ ID NO: 1063298 - RNA, 18 nt, Human
accaagagaugaaauuuc

SEQ ID NO: 1063299 - RNA, 20 nt, Human
accacucccucuaaacccca

SEQ ID NO: 1063300 - RNA, 25 nt, Human
accacucccucuaaaccccaucuua

SEQ ID NO: 1063301 - RNA, 19 nt, Human
accagcagcagcuaggggc

SEQ ID NO: 1063302 - RNA, 24 nt, Human
accauguuggccaggauggucucg

SEQ ID NO: 1063303 - RNA, 22 nt, Human
accuagacaagggccacaccac

SEQ ID NO: 1063304 - RNA, 24 nt, Human
accuugugaucugcccaccucggc

SEQ ID NO: 1063305 - RNA, 22 nt, Human
acguggcucucucucuuuuucu

SEQ ID NO: 1063306 - RNA, 27 nt, Human
acucagagcaauauuuuucuccuacgg

SEQ ID NO: 1063307 - RNA, 20 nt, Human
acucugucaccaggcugcaa

SEQ ID NO: 1063308 - RNA, 22 nt, Human
agagugagaggacgauagccca

SEQ ID NO: 1063309 - RNA, 22 nt, Human
agaguguguaucccucggaucc

SEQ ID NO: 1063310 - RNA, 24 nt, Human
agaguuuguuguaaggacuugggg

SEQ ID NO: 1063311 - RNA, 20 nt, Human
agcagccauuuggagaacug

SEQ ID NO: 1063312 - RNA, 21 nt, Human
agcuuagaaugagaguuuguu

SEQ ID NO: 1063313 - RNA, 23 nt, Human
aguagcugagauuacagguacgu

SEQ ID NO: 1063314 - RNA, 24 nt, Human
aguggugcgaucucagcucacugc

SEQ ID NO: 1063315 - RNA, 23 nt, Human
aguguuucaccauguuggccagg

SEQ ID NO: 1063316 - RNA, 23 nt, Human
auauaacaggaucuggcagccuc

SEQ ID NO: 1063317 - RNA, 19 nt, Human
auuacagguacgugccacc

SEQ ID NO: 1063318 - RNA, 23 nt, Human
caaagugcuggauuacaggcaug

SEQ ID NO: 1063319 - RNA, 24 nt, Human
caaagugcuggauuacaggcauga

SEQ ID NO: 1063320 - RNA, 20 nt, Human
caagcgauucuccugccuca

SEQ ID NO: 1063321 - RNA, 22 nt, Human
caagcgauucuccugccucagc

SEQ ID NO: 1063322 - RNA, 21 nt, Human
caauggccccaucaauugcac

SEQ ID NO: 1063323 - RNA, 18 nt, Human
cacagguucuaagucagg

SEQ ID NO: 1063324 - RNA, 18 nt, Human
caccauguuggccaggau

SEQ ID NO: 1063325 - RNA, 22 nt, Human
caccauguuggccaggaugguc

SEQ ID NO: 1063326 - RNA, 24 nt, Human
caccauguuggccaggauggucuc

SEQ ID NO: 1063327 - RNA, 24 nt, Human
caccucggccucccaaagugcugg

SEQ ID NO: 1063328 - RNA, 24 nt, Human
cacucagagcaauauuuuuucccc

SEQ ID NO: 1063329 - RNA, 24 nt, Human
cagcaacaaauaggagcaaaagca

SEQ ID NO: 1063330 - RNA, 19 nt, Human
cagcagcagcuaggggcac

SEQ ID NO: 1063331 - RNA, 20 nt, Human
cagccuccugaguagcugag

SEQ ID NO: 1063332 - RNA, 20 nt, Human
cagcuaggggcacugggcag

SEQ ID NO: 1063333 - RNA, 22 nt, Human
caggucugcauuccucuccugc

SEQ ID NO: 1063334 - RNA, 24 nt, Human
caguguuucaccauguuggccagg

SEQ ID NO: 1063335 - RNA, 24 nt, Human
cauaaccaauuguuaauagaugcc

SEQ ID NO: 1063336 - RNA, 19 nt, Human
caugcauggcucacagagu

SEQ ID NO: 1063337 - RNA, 18 nt, Human
ccaaagugcuggauuaca

SEQ ID NO: 1063338 - RNA, 23 nt, Human
ccaaagugcuggauuacaggcau

SEQ ID NO: 1063339 - RNA, 19 nt, Human
ccaccacgccagcuaauuu

SEQ ID NO: 1063340 - RNA, 18 nt, Human
ccauccaucuauccaucu

SEQ ID NO: 1063341 - RNA, 18 nt, Human
cccaggucugcauuccuc

SEQ ID NO: 1063342 - RNA, 24 nt, Human
cccucagauggggaaggaccucac

SEQ ID NO: 1063343 - RNA, 24 nt, Human
cccugaagauuccugaccccaucu

SEQ ID NO: 1063344 - RNA, 23 nt, Human
cccugguucaagcgauucuccug

SEQ ID NO: 1063345 - RNA, 23 nt, Human
ccuacaagucuaccagcagcagc

SEQ ID NO: 1063346 - RNA, 21 nt, Human
ccugaagcccuuucccucggg

SEQ ID NO: 1063347 - RNA, 19 nt, Human
ccugaguagcugagauuac

SEQ ID NO: 1063348 - RNA, 22 nt, Human
ccugaguagcugagauuacagg

SEQ ID NO: 1063349 - RNA, 24 nt, Human
ccugaguagcugagauuacaggua

SEQ ID NO: 1063350 - RNA, 23 nt, Human
ccugccucagccuccugaguagc

SEQ ID NO: 1063351 - RNA, 27 nt, Human
cgacaucagcaacaaauaggagcaaaa

SEQ ID NO: 1063352 - RNA, 21 nt, Human
cguggcucucucucuuuuucu

SEQ ID NO: 1063353 - RNA, 21 nt, Human
cuacaggaagaaacuggaacc

SEQ ID NO: 1063354 - RNA, 18 nt, Human
cuaccagcagcagcuagg

SEQ ID NO: 1063355 - RNA, 19 nt, Human
cuagaggaagacagcagcc

SEQ ID NO: 1063356 - RNA, 23 nt, Human
cucccugguucaagcgauucucc

SEQ ID NO: 1063357 - RNA, 22 nt, Human
cuccugaccuugugaucugccc

SEQ ID NO: 1063358 - RNA, 22 nt, Human
cuccugccucagccuccugagu

SEQ ID NO: 1063359 - RNA, 24 nt, Human
cucucaauccauccaucuauccau

SEQ ID NO: 1063360 - RNA, 18 nt, Human
cucuccucuuuccugucc

SEQ ID NO: 1063361 - RNA, 22 nt, Human
cucucuccaucuauccaucuaa

SEQ ID NO: 1063362 - RNA, 23 nt, Human
cucucuuucugucucucuccauc

SEQ ID NO: 1063363 - RNA, 25 nt, Human
cucuuuuucuuuuucucgugcccuu

SEQ ID NO: 1063364 - RNA, 18 nt, Human
cugaguagcugagauuac

SEQ ID NO: 1063365 - RNA, 21 nt, Human
cugaguagcugagauuacagg

SEQ ID NO: 1063366 - RNA, 18 nt, Human
cugcauuccucuccugca

SEQ ID NO: 1063367 - RNA, 23 nt, Human
cugccucagccuccugaguagcu

SEQ ID NO: 1063368 - RNA, 18 nt, Human
cuuucucuccucuuuccu

SEQ ID NO: 1063369 - RNA, 18 nt, Human
gaagauuccugaccccau

SEQ ID NO: 1063370 - RNA, 22 nt, Human
gaccuugugaucugcccaccuc

SEQ ID NO: 1063371 - RNA, 22 nt, Human
gaccuugugaucugcccaccuc

SEQ ID NO: 1063372 - RNA, 24 nt, Human
gaccuugugaucugcccaccucgg

SEQ ID NO: 1063373 - RNA, 21 nt, Human
gacugccuucucccgcuuccu

SEQ ID NO: 1063374 - RNA, 18 nt, Human
gagcgacaucagcaacaa

SEQ ID NO: 1063375 - RNA, 23 nt, Human
gaggaagacagcagccauuugga

SEQ ID NO: 1063376 - RNA, 22 nt, Human
gaguagcugagauuacagguac

SEQ ID NO: 1063377 - RNA, 20 nt, Human
gagucucacucugucaccag

SEQ ID NO: 1063378 - RNA, 21 nt, Human
gaguguguaucccucggaucc

SEQ ID NO: 1063379 - RNA, 22 nt, Human
gauggcagacuaaguacuagag

SEQ ID NO: 1063380 - RNA, 18 nt, Human
gauuacaggcaugagcca

SEQ ID NO: 1063381 - RNA, 21 nt, Human
gauuacaggcaugagccacua

SEQ ID NO: 1063382 - RNA, 23 nt, Human
gauuacaggcaugagccacuagc

SEQ ID NO: 1063383 - RNA, 18 nt, Human
gauuacagguacgugcca

SEQ ID NO: 1063384 - RNA, 21 nt, Human
gauucuccugccucagccucc

SEQ ID NO: 1063385 - RNA, 19 nt, Human
gcagaucagggugaccugc

SEQ ID NO: 1063386 - RNA, 23 nt, Human
gcauaaaagaccaagagaugaaa

SEQ ID NO: 1063387 - RNA, 18 nt, Human
gcccuuucuuucuuucuc

SEQ ID NO: 1063388 - RNA, 23 nt, Human
gcgauucuccugccucagccucc

SEQ ID NO: 1063389 - RNA, 21 nt, Human
gcuccccugaagauuccugac

SEQ ID NO: 1063390 - RNA, 19 nt, Human
ggagugcguauuccgcucc

SEQ ID NO: 1063391 - RNA, 24 nt, Human
ggauggucucgaucuccugaccuu

SEQ ID NO: 1063392 - RNA, 19 nt, Human
ggauuacaggcaugagcca

SEQ ID NO: 1063393 - RNA, 20 nt, Human
ggauuacaggcaugagccac

SEQ ID NO: 1063394 - RNA, 23 nt, Human
ggauuacaggcaugagccacuag

SEQ ID NO: 1063395 - RNA, 31 nt, Human
ggcugcaaugcaguggugcgaucucagcucc

SEQ ID NO: 1063396 - RNA, 27 nt, Human
gggaacuacaggaagaaaccgguaccc

SEQ ID NO: 1063397 - RNA, 20 nt, Human
ggucucgaucuccugaccuu

SEQ ID NO: 1063398 - RNA, 24 nt, Human
gugaucugcccaccucggccuccc

SEQ ID NO: 1063399 - RNA, 20 nt, Human
gugcaggcaacagaaacaaa

SEQ ID NO: 1063400 - RNA, 20 nt, Human
guucaagcgauucuccugcc

SEQ ID NO: 1063401 - RNA, 19 nt, Human
uaaaacaaggaaccauaac

SEQ ID NO: 1063402 - RNA, 19 nt, Human
uaaaacaaggaaccauaac

SEQ ID NO: 1063403 - RNA, 21 nt, Human
uaaagacugaauuccaaauca

SEQ ID NO: 1063404 - RNA, 22 nt, Human
uaagucaggagaauguuaauga

SEQ ID NO: 1063405 - RNA, 21 nt, Human
uaauuaaaacaaggaaccaua

SEQ ID NO: 1063406 - RNA, 18 nt, Human
uacuccauauaacaggau

SEQ ID NO: 1063407 - RNA, 24 nt, Human
uacuuccuacuugacugccuucuc

SEQ ID NO: 1063408 - RNA, 22 nt, Human
uagagacaguguuucaccaugu

SEQ ID NO: 1063409 - RNA, 19 nt, Human
uaggauccuacaagucuac

SEQ ID NO: 1063410 - RNA, 24 nt, Human
uaguagagacaguguuucaccaug

SEQ ID NO: 1063411 - RNA, 22 nt, Human
uaucacagguucuaagucagga

SEQ ID NO: 1063412 - RNA, 19 nt, Human
ucaagcgauucuccugccu

SEQ ID NO: 1063413 - RNA, 21 nt, Human
ucaaucuuaaaaguguuauca

SEQ ID NO: 1063414 - RNA, 24 nt, Human
ucaccauguuggccaggauggucu

SEQ ID NO: 1063415 - RNA, 19 nt, Human
ucacugcaaucuccgacuc

SEQ ID NO: 1063416 - RNA, 24 nt, Human
ucacugcaaucuccgacucccugg

SEQ ID NO: 1063417 - RNA, 21 nt, Human
ucauggaaccaaggaauagga

SEQ ID NO: 1063418 - RNA, 19 nt, Human
ucauuugcaugcauggcuc

SEQ ID NO: 1063419 - RNA, 23 nt, Human
ucccaaagugcuggauuacaggc

SEQ ID NO: 1063420 - RNA, 21 nt, Human
ucccaauuguuugucuauuac

SEQ ID NO: 1063421 - RNA, 19 nt, Human
ucccaggcuauugacuucc

SEQ ID NO: 1063422 - RNA, 21 nt, Human
ucccaugcacauuucucucug

SEQ ID NO: 1063423 - RNA, 18 nt, Human
ucccucuaaaccccaucu

SEQ ID NO: 1063424 - RNA, 21 nt, Human
ucccugguucaagcgauucuc

SEQ ID NO: 1063425 - RNA, 24 nt, Human
ucccugguucaagcgauucuccug

SEQ ID NO: 1063426 - RNA, 19 nt, Human
uccgugacccacacuccca

SEQ ID NO: 1063427 - RNA, 24 nt, Human
uccugaguagcugagauuacaggu

SEQ ID NO: 1063428 - RNA, 22 nt, Human
ucgugcccuuucuuucuuucuc

SEQ ID NO: 1063429 - RNA, 23 nt, Human
ucuaucaucucucaauccaucca

SEQ ID NO: 1063430 - RNA, 22 nt, Human
ucucaauccauccaucuaucca

SEQ ID NO: 1063431 - RNA, 21 nt, Human
ucucacucugucaccaggcug

SEQ ID NO: 1063432 - RNA, 22 nt, Human
ucucacucugucaccaggcugc

SEQ ID NO: 1063433 - RNA, 23 nt, Human
ucucacucugucaccaggcugca

SEQ ID NO: 1063434 - RNA, 21 nt, Human
ucucauggucaauucuugcag

SEQ ID NO: 1063435 - RNA, 19 nt, Human
ucucucuguacguggcucu

SEQ ID NO: 1063436 - RNA, 18 nt, Human
ucuggaguacagaaucua

SEQ ID NO: 1063437 - RNA, 21 nt, Human
ucuugcagugagagcaggagu

SEQ ID NO: 1063438 - RNA, 24 nt, Human
ucuuucucuccucuuuccuguccu

SEQ ID NO: 1063439 - RNA, 21 nt, Human
ucuuucuuucucuccucuuuc

SEQ ID NO: 1063440 - RNA, 23 nt, Human
ucuuuuucuuuuucucgugcccu

SEQ ID NO: 1063441 - RNA, 21 nt, Human
ugaagcaucauuuggguaaaa

SEQ ID NO: 1063442 - RNA, 22 nt, Human
ugagauggagucucacucuguc

SEQ ID NO: 1063443 - RNA, 21 nt, Human
ugagauuacagguacgugcca

SEQ ID NO: 1063444 - RNA, 22 nt, Human
ugagauuacagguacgugccac

SEQ ID NO: 1063445 - RNA, 24 nt, Human
ugagauuacagguacgugccacca

SEQ ID NO: 1063446 - RNA, 24 nt, Human
ugaucugcccaccucggccuccca

SEQ ID NO: 1063447 - RNA, 19 nt, Human
ugcaaugcaguggugcgau

SEQ ID NO: 1063448 - RNA, 24 nt, Human
ugcaugcauggcucacagagugaa

SEQ ID NO: 1063449 - RNA, 21 nt, Human
ugcauuccucuccugcacccc

SEQ ID NO: 1063450 - RNA, 24 nt, Human
ugccucagccuccugaguagcuga

SEQ ID NO: 1063451 - RNA, 20 nt, Human
uggagaacugagcgacauca

SEQ ID NO: 1063452 - RNA, 20 nt, Human
uggauuacaggcaugagcca

SEQ ID NO: 1063453 - RNA, 21 nt, Human
uggauuacaggcaugagccac

SEQ ID NO: 1063454 - RNA, 23 nt, Human
uggauuacaggcaugagccacua

SEQ ID NO: 1063455 - RNA, 24 nt, Human
uggccaggauggucucgaucuccu

SEQ ID NO: 1063456 - RNA, 20 nt, Human
ugggaugacugcuacggaga

SEQ ID NO: 1063457 - RNA, 22 nt, Human
ugggccccaggucugcauuccu

SEQ ID NO: 1063458 - RNA, 18 nt, Human
uggggggugcucucucag

SEQ ID NO: 1063459 - RNA, 21 nt, Human
ugggugucuuuaauuugcuuc

SEQ ID NO: 1063460 - RNA, 24 nt, Human
uggugcgaucucagcucacugcaa

SEQ ID NO: 1063461 - RNA, 23 nt, Human
ugguucaagcgauucuccugccu

SEQ ID NO: 1063462 - RNA, 24 nt, Human
uguuucaccauguuggccaggaug

SEQ ID NO: 1063463 - RNA, 24 nt, Human
uuaguagagacaguguuucaccau

SEQ ID NO: 1063464 - RNA, 21 nt, Human
uucaagcgauucuccugccuc

SEQ ID NO: 1063465 - RNA, 23 nt, Human
uucaagcgauucuccugccucag

SEQ ID NO: 1063466 - RNA, 24 nt, Human
uucaagcgauucuccugccucagc

SEQ ID NO: 1063467 - RNA, 22 nt, Human
uucccaugcacauuucucucug

SEQ ID NO: 1063468 - RNA, 19 nt, Human
uuucaccauguuggccagg

SEQ ID NO: 1063469 - RNA, 20 nt, Human
uuucaccauguuggccagga

SEQ ID NO: 1063470 - RNA, 24 nt, Human
uuuuuaguagagacaguguuucac

SEQ ID NO: 1063471 - RNA, 22 nt, Human
uuuuuguauuuuuaguagagaa

SEQ ID NO: 1063472 - RNA, 24 nt, Human
uuuuuuguauuuuuaguagagaca

SEQ ID NO: 1063473 - RNA, 22 nt, Human
uuuuuuguauuuuuaguagagg

SEQ ID NO: 1063474 - RNA, 26 nt, Human
uuuuuuuuuuuugagauggagucuca

SEQ ID NO: 1063475 - RNA, 30 nt, Human
uuuuuuuuuuuuuguauuuuuaguagagaa

SEQ ID NO: 1063476 - RNA, 22 nt, Human
uuuuuuuuuuuuuugagaugga

SEQ ID NO: 1063477 - RNA, 18 nt, Human
uuuuuuuuuuuuuuuuug

SEQ ID NO: 1063478 - RNA, 20 nt, Human
aacauggcaaaacuccgucu

SEQ ID NO: 1063479 - RNA, 21 nt, Human
aacauggcaaaacuccgucuc

SEQ ID NO: 1063480 - RNA, 20 nt, Human
aaccacccccuacucugccu

SEQ ID NO: 1063481 - RNA, 24 nt, Human
aacugcucuccaaccacccccuac

SEQ ID NO: 1063482 - RNA, 23 nt, Human
aaguuccuuucugacagcagccu

SEQ ID NO: 1063483 - RNA, 19 nt, Human
acaacauggcaaaacuccg

SEQ ID NO: 1063484 - RNA, 23 nt, Human
acaugcacaucugcauguacaua

SEQ ID NO: 1063485 - RNA, 23 nt, Human
agcagccucaccuguaaucccag

SEQ ID NO: 1063486 - RNA, 22 nt, Human
agccuggacaacauggcaaaac

SEQ ID NO: 1063487 - RNA, 24 nt, Human
agccuggacaacauggcaaaacuc

SEQ ID NO: 1063488 - RNA, 26 nt, Human
aggcaggcagaccacuugagcucagg

SEQ ID NO: 1063489 - RNA, 19 nt, Human
auaaaacucuacaacaugc

SEQ ID NO: 1063490 - RNA, 22 nt, Human
caaccacccccuacucugccuc

SEQ ID NO: 1063491 - RNA, 20 nt, Human
caccuguaaucccagcacuu

SEQ ID NO: 1063492 - RNA, 23 nt, Human
caccuguaaucccagcacuuugg

SEQ ID NO: 1063493 - RNA, 24 nt, Human
caccuguaaucccagcacuuuggg

SEQ ID NO: 1063494 - RNA, 23 nt, Human
cagaccacuugagcucaggauuu

SEQ ID NO: 1063495 - RNA, 25 nt, Human
cagcaaugcagcaggugcaggcuuc

SEQ ID NO: 1063496 - RNA, 18 nt, Human
cagcacuuugggaagccg

SEQ ID NO: 1063497 - RNA, 24 nt, Human
cagcacuuugggaagccgaggcag

SEQ ID NO: 1063498 - RNA, 18 nt, Human
cagcaggugcaggcuuca

SEQ ID NO: 1063499 - RNA, 22 nt, Human
cagcuggagcggucccaggcac

SEQ ID NO: 1063500 - RNA, 21 nt, Human
caggaaaacagcaaugcagca

SEQ ID NO: 1063501 - RNA, 19 nt, Human
caggcaacucuuggaauuc

SEQ ID NO: 1063502 - RNA, 20 nt, Human
cauggcaaaacuccgucuca

SEQ ID NO: 1063503 - RNA, 21 nt, Human
ccacccccuacucugccucca

SEQ ID NO: 1063504 - RNA, 22 nt, Human
cccacguuucuuccuagcugau

SEQ ID NO: 1063505 - RNA, 20 nt, Human
ccuccaguauuacucugcuu

SEQ ID NO: 1063506 - RNA, 23 nt, Human
ccuggacaacauggcaaaacucc

SEQ ID NO: 1063507 - RNA, 22 nt, Human
ccuggcugcagugcagcuggag

SEQ ID NO: 1063508 - RNA, 19 nt, Human
cgacaccagccuggacaac

SEQ ID NO: 1063509 - RNA, 22 nt, Human
cgacaccagccuggacaacaug

SEQ ID NO: 1063510 - RNA, 19 nt, Human
cgucucaggaaaacagcaa

SEQ ID NO: 1063511 - RNA, 24 nt, Human
cucaccuguaaucccagcacuuug

SEQ ID NO: 1063512 - RNA, 21 nt, Human
cuccaaccacccccuacucug

SEQ ID NO: 1063513 - RNA, 18 nt, Human
cuggcugcagugcagcug

SEQ ID NO: 1063514 - RNA, 24 nt, Human
gaccacuugagcucaggauuucga

SEQ ID NO: 1063515 - RNA, 19 nt, Human
gcacaucugcauguacaua

SEQ ID NO: 1063516 - RNA, 22 nt, Human
gcucaggauuucgacaccagcc

SEQ ID NO: 1063517 - RNA, 23 nt, Human
uaaaaugggcuuuaauguucccu

SEQ ID NO: 1063518 - RNA, 23 nt, Human
uaacaugcacaucugcauguaca

SEQ ID NO: 1063519 - RNA, 18 nt, Human
uacauagagcucuggaag

SEQ ID NO: 1063520 - RNA, 19 nt, Human
uacucugaggaaugaagcu

SEQ ID NO: 1063521 - RNA, 18 nt, Human
uaucugaaggcuauggaa

SEQ ID NO: 1063522 - RNA, 21 nt, Human
ucccuacuacgcccaccacag

SEQ ID NO: 1063523 - RNA, 19 nt, Human
uccuucuauacccagucag

SEQ ID NO: 1063524 - RNA, 23 nt, Human
ucgacaccagccuggacaacaug

SEQ ID NO: 1063525 - RNA, 23 nt, Human
ucuaaauacccacaucuccugua

SEQ ID NO: 1063526 - RNA, 22 nt, Human
ugaagcugguauccccccuggc

SEQ ID NO: 1063527 - RNA, 21 nt, Human
ugauucauggaauuaucccuu

SEQ ID NO: 1063528 - RNA, 18 nt, Human
ugcaguucuggaaccggc

SEQ ID NO: 1063529 - RNA, 21 nt, Human
uggcucccuacuacgcccacc

SEQ ID NO: 1063530 - RNA, 24 nt, Human
ugggaagccgaggcaggcagacca

SEQ ID NO: 1063531 - RNA, 19 nt, Human
uguacuaacugcucuccaa

SEQ ID NO: 1063532 - RNA, 26 nt, Human
uguacuaacugcucuccaaccacccc

SEQ ID NO: 1063533 - RNA, 19 nt, Human
uucaccaacuuugcaguuc

SEQ ID NO: 1063534 - RNA, 20 nt, Human
uucauggaauuaucccuuuc

SEQ ID NO: 1063535 - RNA, 20 nt, Human
uugcaguucuggaaccggca

SEQ ID NO: 1063536 - RNA, 18 nt, Human
uuugaauccucuguucug

SEQ ID NO: 1063537 - RNA, 20 nt, Human
uuugcaguucuggaaccggc

SEQ ID NO: 1063538 - RNA, 18 nt, Human
aaagaagcuucuugcccu

SEQ ID NO: 1063539 - RNA, 19 nt, Human
aaggcacaauucaaagaca

SEQ ID NO: 1063540 - RNA, 22 nt, Human
aggggcgguaugaaaauuaaag

SEQ ID NO: 1063541 - RNA, 21 nt, Human
auacuguaccuggccuugugc

SEQ ID NO: 1063542 - RNA, 22 nt, Human
caugcaaagggaaauuuucacc

SEQ ID NO: 1063543 - RNA, 20 nt, Human
cuucuugcccuacccggcug

SEQ ID NO: 1063544 - RNA, 21 nt, Human
cuugcccuacccggcugacca

SEQ ID NO: 1063545 - RNA, 20 nt, Human
gaaagaagcuucuugcccua

SEQ ID NO: 1063546 - RNA, 18 nt, Human
gaagcuucuugcccuacc

SEQ ID NO: 1063547 - RNA, 24 nt, Human
gggcgguaugaaaauuaaaggcac

SEQ ID NO: 1063548 - RNA, 26 nt, Human
uagcagccaacacuccuuacacauac

SEQ ID NO: 1063549 - RNA, 22 nt, Human
ucaccaaucacucuaauugugc

SEQ ID NO: 1063550 - RNA, 19 nt, Human
ucccugaaagaagcuucuu

SEQ ID NO: 1063551 - RNA, 21 nt, Human
ucccugaaagaagcuucuugc

SEQ ID NO: 1063552 - RNA, 20 nt, Human
ugccucauuuaagccucagg

SEQ ID NO: 1063553 - RNA, 23 nt, Human
ugguguaagaaccuuuagcugaa

SEQ ID NO: 1063554 - RNA, 22 nt, Human
uuuaagccucaggacaaaccuc

SEQ ID NO: 1063555 - RNA, 23 nt, Human
uuuagcugaagccaccuuuuucu

SEQ ID NO: 1063556 - RNA, 23 nt, Human
cagagucuucuucaaacucccac

SEQ ID NO: 1063557 - RNA, 25 nt, Human
ccagagucuucuucaaacucccaca

SEQ ID NO: 1063558 - RNA, 22 nt, Human
cuucuucaaacucccacagccc

SEQ ID NO: 1063559 - RNA, 25 nt, Human
uuggaagcaguccagagucuucuuc

SEQ ID NO: 1063560 - RNA, 24 nt, Human
aaacaaugaaagagagaggagaaa

SEQ ID NO: 1063561 - RNA, 19 nt, Human
aacccauccuucccaccuc

SEQ ID NO: 1063562 - RNA, 21 nt, Human
aagcaacaugugguucacuca

SEQ ID NO: 1063563 - RNA, 22 nt, Human
aagcaguucucagaggacucag

SEQ ID NO: 1063564 - RNA, 22 nt, Human
aaucucagagaaacugaacaug

SEQ ID NO: 1063565 - RNA, 26 nt, Human
acaacaauaucauaccaguaugaaac

SEQ ID NO: 1063566 - RNA, 19 nt, Human
accaaccgccuuuacucua

SEQ ID NO: 1063567 - RNA, 23 nt, Human
acccaacccauccuucccaccuc

SEQ ID NO: 1063568 - RNA, 26 nt, Human
accucaucucuuaccacccccuccca

SEQ ID NO: 1063569 - RNA, 20 nt, Human
acugcagauuuccacaaaug

SEQ ID NO: 1063570 - RNA, 22 nt, Human
agaaagacgaccgaacuacaaa

SEQ ID NO: 1063571 - RNA, 21 nt, Human
agaauucuuucaaacuaccau

SEQ ID NO: 1063572 - RNA, 22 nt, Human
agacagaaugaugcaaggucca

SEQ ID NO: 1063573 - RNA, 23 nt, Human
agaggcaaccagagaaauuacca

SEQ ID NO: 1063574 - RNA, 22 nt, Human
aggcaggcuuaggaguuaccag

SEQ ID NO: 1063575 - RNA, 21 nt, Human
aucaggcucugugguuaagga

SEQ ID NO: 1063576 - RNA, 21 nt, Human
aucucuuaccacccccuccca

SEQ ID NO: 1063577 - RNA, 20 nt, Human
auuuccacaaaugcagacug

SEQ ID NO: 1063578 - RNA, 21 nt, Human
caaaaacacugagaauaaaag

SEQ ID NO: 1063579 - RNA, 22 nt, Human
caaaauucucuaaaaagcuccc

SEQ ID NO: 1063580 - RNA, 24 nt, Human
caaaucucagagaaacugaacaug

SEQ ID NO: 1063581 - RNA, 21 nt, Human
caacacacaacagccaauguu

SEQ ID NO: 1063582 - RNA, 23 nt, Human
caaccagagaaauuaccaaccgc

SEQ ID NO: 1063583 - RNA, 24 nt, Human
cagcagcuccacuucuaagagaaa

SEQ ID NO: 1063584 - RNA, 19 nt, Human
cagcucccucgcucccuug

SEQ ID NO: 1063585 - RNA, 18 nt, Human
cauggagucaaaccucag

SEQ ID NO: 1063586 - RNA, 20 nt, Human
ccaacccauccuucccaccu

SEQ ID NO: 1063587 - RNA, 22 nt, Human
ccaugaaagcaaaaacacugag

SEQ ID NO: 1063588 - RNA, 22 nt, Human
cccacgaaggaaaggaugaaaa

SEQ ID NO: 1063589 - RNA, 18 nt, Human
cccauccuucccaccuca

SEQ ID NO: 1063590 - RNA, 21 nt, Human
cccuaaauaaguccccuccuu

SEQ ID NO: 1063591 - RNA, 19 nt, Human
ccuaauguaacucaaaaac

SEQ ID NO: 1063592 - RNA, 23 nt, Human
ccuagaagcaacaugugguucac

SEQ ID NO: 1063593 - RNA, 22 nt, Human
ccucaucucuuaccacccccuc

SEQ ID NO: 1063594 - RNA, 21 nt, Human
ccuccaaacuucaaauacugc

SEQ ID NO: 1063595 - RNA, 22 nt, Human
ccuucugucuccaucucagguu

SEQ ID NO: 1063596 - RNA, 18 nt, Human
cuaaguaauaucacaaaa

SEQ ID NO: 1063597 - RNA, 24 nt, Human
cucaucucuuaccacccccuccca

SEQ ID NO: 1063598 - RNA, 23 nt, Human
gaaacaggaagcaguucucagag

SEQ ID NO: 1063599 - RNA, 21 nt, Human
gaaacuuggacccaaaaaugu

SEQ ID NO: 1063600 - RNA, 18 nt, Human
gagucaguuuaaacauga

SEQ ID NO: 1063601 - RNA, 24 nt, Human
ggcccuaauguaacucaaaaacaa

SEQ ID NO: 1063602 - RNA, 19 nt, Human
gggagcacuuggggguggg

SEQ ID NO: 1063603 - RNA, 25 nt, Human
ggguggggaaagcuggccacaguuu

SEQ ID NO: 1063604 - RNA, 21 nt, Human
gguauguauuuuuuaaaacag

SEQ ID NO: 1063605 - RNA, 21 nt, Human
uaacucaaaaacaauuuguca

SEQ ID NO: 1063606 - RNA, 22 nt, Human
uaccagacgaaacaggaagcag

SEQ ID NO: 1063607 - RNA, 22 nt, Human
uaccuuccuacaugcucagaau

SEQ ID NO: 1063608 - RNA, 24 nt, Human
uagaccccucuaaauauuuaaaca

SEQ ID NO: 1063609 - RNA, 19 nt, Human
uagcauaacagaaagacga

SEQ ID NO: 1063610 - RNA, 22 nt, Human
ucaacacccuagugguucaacu

SEQ ID NO: 1063611 - RNA, 19 nt, Human
ucacccaacccauccuucc

SEQ ID NO: 1063612 - RNA, 21 nt, Human
ucacccaacccauccuuccca

SEQ ID NO: 1063613 - RNA, 21 nt, Human
ucagaacucuuuggucuccag

SEQ ID NO: 1063614 - RNA, 23 nt, Human
ucagagaaacugaacauggaguc

SEQ ID NO: 1063615 - RNA, 18 nt, Human
ucagagucaguuuaaaca

SEQ ID NO: 1063616 - RNA, 20 nt, Human
uccaaacuucaaauacugca

SEQ ID NO: 1063617 - RNA, 19 nt, Human
ucccauagauguguccagg

SEQ ID NO: 1063618 - RNA, 25 nt, Human
ucuaaauauuuaaacaacaauauca

SEQ ID NO: 1063619 - RNA, 22 nt, Human
ucuaagagaaaucaaagcaaau

SEQ ID NO: 1063620 - RNA, 18 nt, Human
ucuaaguccugauucugu

SEQ ID NO: 1063621 - RNA, 19 nt, Human
ucucagguuucuacccuaa

SEQ ID NO: 1063622 - RNA, 18 nt, Human
ucuccagaggugguugaa

SEQ ID NO: 1063623 - RNA, 18 nt, Human
ucuccagaggugguugaa

SEQ ID NO: 1063624 - RNA, 22 nt, Human
ucuccagaggugguugaaauau

SEQ ID NO: 1063625 - RNA, 19 nt, Human
ucucuuaccacccccuccc

SEQ ID NO: 1063626 - RNA, 22 nt, Human
ucugucuccaucucagguuucu

SEQ ID NO: 1063627 - RNA, 20 nt, Human
ucuuccacaaaguacaacua

SEQ ID NO: 1063628 - RNA, 19 nt, Human
ugaaagcaaaaacacugag

SEQ ID NO: 1063629 - RNA, 19 nt, Human
ugaaagcaaaaacacugag

SEQ ID NO: 1063630 - RNA, 18 nt, Human
ugaaauauucuuuauccc

SEQ ID NO: 1063631 - RNA, 18 nt, Human
ugaacauggagucaaacc

SEQ ID NO: 1063632 - RNA, 21 nt, Human
ugagaaacccuaaauaagucc

SEQ ID NO: 1063633 - RNA, 21 nt, Human
ugagaaacccuaaauaagucc

SEQ ID NO: 1063634 - RNA, 23 nt, Human
ugagaaacccuaaauaagucccc

SEQ ID NO: 1063635 - RNA, 29 nt, Human
ugaugaggaaugaaauauauuuucuggcu

SEQ ID NO: 1063636 - RNA, 22 nt, Human
ugcagacuguaggaaagaaagg

SEQ ID NO: 1063637 - RNA, 18 nt, Human
ugccucaucucuccuucu

SEQ ID NO: 1063638 - RNA, 20 nt, Human
uggggagcacuugggggugg

SEQ ID NO: 1063639 - RNA, 22 nt, Human
uguggggagcacuugggggugg

SEQ ID NO: 1063640 - RNA, 23 nt, Human
ugugguucacucaaguagacaga

SEQ ID NO: 1063641 - RNA, 18 nt, Human
uucaacuuuaaugcagcu

SEQ ID NO: 1063642 - RNA, 21 nt, Human
uuggacccaaaaauguuccaa

SEQ ID NO: 1063643 - RNA, 24 nt, Human
uuguggggagcacuuggggguggg

SEQ ID NO: 1063644 - RNA, 21 nt, Human
aaaaaaaaaacgaggcaugaa

SEQ ID NO: 1063645 - RNA, 20 nt, Human
aaaaaaaaacgaggcaugaa

SEQ ID NO: 1063646 - RNA, 20 nt, Human
aaaaaaacgaggcaugaaaa

SEQ ID NO: 1063647 - RNA, 21 nt, Human
aaacgaggcaugaaaaguccc

SEQ ID NO: 1063648 - RNA, 18 nt, Human
aaagucccagaggagcaa

SEQ ID NO: 1063649 - RNA, 24 nt, Human
aacucacgucucgcacccccucca

SEQ ID NO: 1063650 - RNA, 20 nt, Human
aacugcuuuccacaggggau

SEQ ID NO: 1063651 - RNA, 20 nt, Human
acaaguuuaacugcuuucca

SEQ ID NO: 1063652 - RNA, 18 nt, Human
acaggaagggaccgcggg

SEQ ID NO: 1063653 - RNA, 24 nt, Human
accaagccacaucugaaaaaaaaa

SEQ ID NO: 1063654 - RNA, 22 nt, Human
acccacguucugugggcccccu

SEQ ID NO: 1063655 - RNA, 22 nt, Human
accuugcguccagaccaagcca

SEQ ID NO: 1063656 - RNA, 19 nt, Human
agaacucacgucucgcacc

SEQ ID NO: 1063657 - RNA, 19 nt, Human
agaccaagccacaucugaa

SEQ ID NO: 1063658 - RNA, 21 nt, Human
aggacgagguacaggaaggga

SEQ ID NO: 1063659 - RNA, 21 nt, Human
aucugaaaaaaaaaacgaggc

SEQ ID NO: 1063660 - RNA, 24 nt, Human
aucuuggcagcccccucccccuca

SEQ ID NO: 1063661 - RNA, 21 nt, Human
augcugaggacgagguacagg

SEQ ID NO: 1063662 - RNA, 19 nt, Human
caacggagaaaaaccgacc

SEQ ID NO: 1063663 - RNA, 23 nt, Human
caagggccuggcucucuuucaau

SEQ ID NO: 1063664 - RNA, 20 nt, Human
cagaccaagccacaucugaa

SEQ ID NO: 1063665 - RNA, 19 nt, Human
cagcucaaguccacaccau

SEQ ID NO: 1063666 - RNA, 23 nt, Human
caucuuggcagcccccucccccu

SEQ ID NO: 1063667 - RNA, 19 nt, Human
ccagaccaagccacaucug

SEQ ID NO: 1063668 - RNA, 26 nt, Human
ccagcucaaguccacaccauucgccu

SEQ ID NO: 1063669 - RNA, 24 nt, Human
cccccuccagggcucccucagaca

SEQ ID NO: 1063670 - RNA, 24 nt, Human
ccccuccagggcucccucagacaa

SEQ ID NO: 1063671 - RNA, 24 nt, Human
ccuccccgcccccuccagggcucc

SEQ ID NO: 1063672 - RNA, 18 nt, Human
ccucccuagccaccgccu

SEQ ID NO: 1063673 - RNA, 18 nt, Human
cgaagacaacggcccgga

SEQ ID NO: 1063674 - RNA, 21 nt, Human
cgaagacaacggcccggagga

SEQ ID NO: 1063675 - RNA, 25 nt, Human
cgcacccccuccacaaguuuaacug

SEQ ID NO: 1063676 - RNA, 21 nt, Human
cggagaaaaaccgaccgaaga

SEQ ID NO: 1063677 - RNA, 23 nt, Human
cggagaaaaaccgaccgaagaca

SEQ ID NO: 1063678 - RNA, 22 nt, Human
cggcccggaggaggccgacgcc

SEQ ID NO: 1063679 - RNA, 21 nt, Human
cgggaucaacggagaaaaacc

SEQ ID NO: 1063680 - RNA, 24 nt, Human
cgggaucaacggagaaaaaccgac

SEQ ID NO: 1063681 - RNA, 24 nt, Human
cucacgucucgcacccccuccaca

SEQ ID NO: 1063682 - RNA, 23 nt, Human
cucgcacccccuccacaaguuua

SEQ ID NO: 1063683 - RNA, 20 nt, Human
cucuuccucuucucggaauc

SEQ ID NO: 1063684 - RNA, 25 nt, Human
cugcuggaccagcucaaguccacac

SEQ ID NO: 1063685 - RNA, 21 nt, Human
gaccgaagacaacggcccgga

SEQ ID NO: 1063686 - RNA, 21 nt, Human
gagaaaaaccgaccgaagaca

SEQ ID NO: 1063687 - RNA, 19 nt, Human
gagcaaacgcccccucucc

SEQ ID NO: 1063688 - RNA, 19 nt, Human
gagcaaacgcccccucucc

SEQ ID NO: 1063689 - RNA, 19 nt, Human
gauacuuuccccuuucaca

SEQ ID NO: 1063690 - RNA, 21 nt, Human
gccuggcaugggggagaacuc

SEQ ID NO: 1063691 - RNA, 19 nt, Human
gcugaggacgagguacagg

SEQ ID NO: 1063692 - RNA, 21 nt, Human
gcugcugggaccuugcgucca

SEQ ID NO: 1063693 - RNA, 22 nt, Human
ggaccgcgggaucaacggagaa

SEQ ID NO: 1063694 - RNA, 21 nt, Human
ggcagcccccucccccucaag

SEQ ID NO: 1063695 - RNA, 23 nt, Human
gggaucaacggagaaaaaccgac

SEQ ID NO: 1063696 - RNA, 18 nt, Human
gggcccccuccccgcccu

SEQ ID NO: 1063697 - RNA, 18 nt, Human
uacaggaagggaccgcgg

SEQ ID NO: 1063698 - RNA, 19 nt, Human
ucaagggccuggcucucuu

SEQ ID NO: 1063699 - RNA, 23 nt, Human
ucacagaagaguaagcuuaagcu

SEQ ID NO: 1063700 - RNA, 23 nt, Human
ucccaaugucucuuuauagaacc

SEQ ID NO: 1063701 - RNA, 22 nt, Human
uccccgcccccuccagggcucc

SEQ ID NO: 1063702 - RNA, 18 nt, Human
ucugugggcccccucccc

SEQ ID NO: 1063703 - RNA, 24 nt, Human
ugaaaaaaaaaacgaggcaugaaa

SEQ ID NO: 1063704 - RNA, 20 nt, Human
uggcagcccccucccccuca

SEQ ID NO: 1063705 - RNA, 21 nt, Human
uggcagcccccucccccucaa

SEQ ID NO: 1063706 - RNA, 21 nt, Human
ugggcccccuccccgcccccu

SEQ ID NO: 1063707 - RNA, 25 nt, Human
ugggcccccuccccgcccccuccag

SEQ ID NO: 1063708 - RNA, 21 nt, Human
uuccacaggggauacuuuccc

SEQ ID NO: 1063709 - RNA, 27 nt, Human
uucccaaugucucuuuauagaacccac

SEQ ID NO: 1063710 - RNA, 26 nt, Human
uagaucuuuaaacacacagcgccaug

SEQ ID NO: 1063711 - RNA, 19 nt, Human
ugaaaaauacacauccaaa

SEQ ID NO: 1063712 - RNA, 21 nt, Human
ugugaaaaauacacauccaaa

SEQ ID NO: 1063713 - RNA, 18 nt, Human
aagcaggaggaucacuug

SEQ ID NO: 1063714 - RNA, 22 nt, Human
aagcaggaggaucacuugagcc

SEQ ID NO: 1063715 - RNA, 24 nt, Human
aagcaggaggaucacuugagccua

SEQ ID NO: 1063716 - RNA, 18 nt, Human
acucuacuccagccuggg

SEQ ID NO: 1063717 - RNA, 24 nt, Human
acucuacuccagccugggugagag

SEQ ID NO: 1063718 - RNA, 21 nt, Human
agccgcugcagcugcugccaa

SEQ ID NO: 1063719 - RNA, 22 nt, Human
aggagguggaggcugcaguggu

SEQ ID NO: 1063720 - RNA, 18 nt, Human
agguggaggcugcagugg

SEQ ID NO: 1063721 - RNA, 23 nt, Human
agucuggcaggaagggggcagcc

SEQ ID NO: 1063722 - RNA, 22 nt, Human
auugucacucuacuccagccug

SEQ ID NO: 1063723 - RNA, 19 nt, Human
cacucuacuccagccuggg

SEQ ID NO: 1063724 - RNA, 19 nt, Human
cacucuacuccagccuggg

SEQ ID NO: 1063725 - RNA, 20 nt, Human
cacucuacuccagccugggu

SEQ ID NO: 1063726 - RNA, 22 nt, Human
cacucuacuccagccuggguga

SEQ ID NO: 1063727 - RNA, 24 nt, Human
cacucuacuccagccugggugaga

SEQ ID NO: 1063728 - RNA, 19 nt, Human
cagucuggcaggaaggggg

SEQ ID NO: 1063729 - RNA, 22 nt, Human
ccagucuggcaggaagggggca

SEQ ID NO: 1063730 - RNA, 21 nt, Human
ccugcaaucccugagggcagg

SEQ ID NO: 1063731 - RNA, 21 nt, Human
ccuugggaccucuugugucac

SEQ ID NO: 1063732 - RNA, 23 nt, Human
cgacucugucugaaggaagugau

SEQ ID NO: 1063733 - RNA, 20 nt, Human
gaccccuagcugcuucuuga

SEQ ID NO: 1063734 - RNA, 22 nt, Human
gagagcaagacccgacucuguc

SEQ ID NO: 1063735 - RNA, 23 nt, Human
gaggaucacuugagccuaggagg

SEQ ID NO: 1063736 - RNA, 24 nt, Human
gccuaggagguggaggcugcagug

SEQ ID NO: 1063737 - RNA, 20 nt, Human
ggcaggaagggggcagccug

SEQ ID NO: 1063738 - RNA, 23 nt, Human
gggggucuuguuauguugccugg

SEQ ID NO: 1063739 - RNA, 21 nt, Human
gucacgucgcucguuuguuuc

SEQ ID NO: 1063740 - RNA, 24 nt, Human
gucacucuacuccagccuggguga

SEQ ID NO: 1063741 - RNA, 18 nt, Human
uacuccagccugggugag

SEQ ID NO: 1063742 - RNA, 23 nt, Human
uacuccagccugggugagagagc

SEQ ID NO: 1063743 - RNA, 19 nt, Human
uagcugcuucuugaugacg

SEQ ID NO: 1063744 - RNA, 20 nt, Human
uaggagguggaggcugcagu

SEQ ID NO: 1063745 - RNA, 21 nt, Human
ucacucuacuccagccugggu

SEQ ID NO: 1063746 - RNA, 19 nt, Human
ucacuugagccuaggaggu

SEQ ID NO: 1063747 - RNA, 24 nt, Human
ucacuugagccuaggagguggagg

SEQ ID NO: 1063748 - RNA, 22 nt, Human
uccaagaagacgacagugcuga

SEQ ID NO: 1063749 - RNA, 22 nt, Human
uccagaagugaaaaggagaugg

SEQ ID NO: 1063750 - RNA, 18 nt, Human
uccagccugggugagaga

SEQ ID NO: 1063751 - RNA, 19 nt, Human
uccagccugggugagagag

SEQ ID NO: 1063752 - RNA, 20 nt, Human
uccaggaagggcgcuggagg

SEQ ID NO: 1063753 - RNA, 18 nt, Human
ucuuguuauguugccugg

SEQ ID NO: 1063754 - RNA, 20 nt, Human
ugaagcaggaggaucacuug

SEQ ID NO: 1063755 - RNA, 24 nt, Human
ugaagcaggaggaucacuugagcc

SEQ ID NO: 1063756 - RNA, 24 nt, Human
ugagccuaggagguggaggcugca

SEQ ID NO: 1063757 - RNA, 21 nt, Human
ugagggcaggucugggacuag

SEQ ID NO: 1063758 - RNA, 21 nt, Human
ugcucccuugggaccucuugu

SEQ ID NO: 1063759 - RNA, 24 nt, Human
uggcaggaagggggcagccugcaa

SEQ ID NO: 1063760 - RNA, 25 nt, Human
uguagagaugggggucuuguuaugu

SEQ ID NO: 1063761 - RNA, 19 nt, Human
uuaauuuuuuguagagaug

SEQ ID NO: 1063762 - RNA, 22 nt, Human
uugcucccuugggaccucuugu

SEQ ID NO: 1063763 - RNA, 24 nt, Human
uuguagagaugggggucuuguuau

SEQ ID NO: 1063764 - RNA, 21 nt, Human
uuguuauguugccuggugugg

SEQ ID NO: 1063765 - RNA, 20 nt, Human
uuucagguuugcucccuugg

SEQ ID NO: 1063766 - RNA, 21 nt, Human
uuuguagagaugggggucuug

SEQ ID NO: 1063767 - RNA, 18 nt, Human
uuuuuuguagagaugggg

SEQ ID NO: 1063768 - RNA, 25 nt, Human
aaaaaaaaaaaaaaaaagguugggg

SEQ ID NO: 1063769 - RNA, 22 nt, Human
aaaaaaaaaaaaaaaagcugag

SEQ ID NO: 1063770 - RNA, 23 nt, Human
aaaaaaaaaaaaaaaagcugagg

SEQ ID NO: 1063771 - RNA, 28 nt, Human
aaaaaaaaaaagguuggggggaugggag

SEQ ID NO: 1063772 - RNA, 18 nt, Human
aaacacucccccaguccc

SEQ ID NO: 1063773 - RNA, 18 nt, Human
aaagugcugggauuacaa

SEQ ID NO: 1063774 - RNA, 24 nt, Human
aaagugcugggauuacaagcauga

SEQ ID NO: 1063775 - RNA, 28 nt, Human
aacaacagaaccaggauaguggaaggaa

SEQ ID NO: 1063776 - RNA, 20 nt, Human
aaccgguugccuccccauuu

SEQ ID NO: 1063777 - RNA, 24 nt, Human
aacugcaccaaauucggagaccua

SEQ ID NO: 1063778 - RNA, 24 nt, Human
aagcaaaaaggaauuuuccucuaa

SEQ ID NO: 1063779 - RNA, 23 nt, Human
aagcaucagugaaggucaguggc

SEQ ID NO: 1063780 - RNA, 26 nt, Human
aaguaccagagguugacacaaaaacu

SEQ ID NO: 1063781 - RNA, 19 nt, Human
aagugcugggauuacaagc

SEQ ID NO: 1063782 - RNA, 21 nt, Human
aagugcugggauuacaagcau

SEQ ID NO: 1063783 - RNA, 26 nt, Human
aagugcugggauuacaagcaugagcc

SEQ ID NO: 1063784 - RNA, 19 nt, Human
aauucggagaccuaguugg

SEQ ID NO: 1063785 - RNA, 18 nt, Human
acaccagcuugggcaaca

SEQ ID NO: 1063786 - RNA, 18 nt, Human
acagaagcaucagugaag

SEQ ID NO: 1063787 - RNA, 19 nt, Human
accaaugcaauaguccuug

SEQ ID NO: 1063788 - RNA, 25 nt, Human
accacucaaacgaugacaggaggca

SEQ ID NO: 1063789 - RNA, 24 nt, Human
accagcuugggcaacauagugaga

SEQ ID NO: 1063790 - RNA, 24 nt, Human
acccaggcuagagugcaguggugu

SEQ ID NO: 1063791 - RNA, 23 nt, Human
acccaguucugcccucuggaacc

SEQ ID NO: 1063792 - RNA, 18 nt, Human
acgaugucauucaagaag

SEQ ID NO: 1063793 - RNA, 18 nt, Human
acgggguuucgccauguu

SEQ ID NO: 1063794 - RNA, 19 nt, Human
acgggguuucgccauguug

SEQ ID NO: 1063795 - RNA, 24 nt, Human
acgggguuucgccauguugcccag

SEQ ID NO: 1063796 - RNA, 20 nt, Human
agagagucccuggcucaaaa

SEQ ID NO: 1063797 - RNA, 22 nt, Human
agauaaauaccaaacagaacca

SEQ ID NO: 1063798 - RNA, 22 nt, Human
agcaagcagaagcaaaaaggaa

SEQ ID NO: 1063799 - RNA, 20 nt, Human
agccaccgcgcccagccaag

SEQ ID NO: 1063800 - RNA, 19 nt, Human
agccugggccugcuccuuu

SEQ ID NO: 1063801 - RNA, 23 nt, Human
agcgugguggcucacaccuguaa

SEQ ID NO: 1063802 - RNA, 22 nt, Human
agcuugggcaacauagugagac

SEQ ID NO: 1063803 - RNA, 23 nt, Human
agcuugggcaacauagugagacc

SEQ ID NO: 1063804 - RNA, 24 nt, Human
agcuugggcaacauagugagaccc

SEQ ID NO: 1063805 - RNA, 20 nt, Human
aggaaaacaaacauuaccaa

SEQ ID NO: 1063806 - RNA, 24 nt, Human
aggaagaggcugcggugagccgag

SEQ ID NO: 1063807 - RNA, 27 nt, Human
aggagugugcugaauaacucagcuuug

SEQ ID NO: 1063808 - RNA, 21 nt, Human
aggaucacuugaggccaggag

SEQ ID NO: 1063809 - RNA, 24 nt, Human
aggaucacuugaggccaggaguuu

SEQ ID NO: 1063810 - RNA, 21 nt, Human
aggccaagguggaaggaucac

SEQ ID NO: 1063811 - RNA, 24 nt, Human
aggggccagacacgguggcucaca

SEQ ID NO: 1063812 - RNA, 18 nt, Human
agguggaaggaucacuug

SEQ ID NO: 1063813 - RNA, 18 nt, Human
aguaccugggauuauagc

SEQ ID NO: 1063814 - RNA, 22 nt, Human
aguagagacgggguuucgccau

SEQ ID NO: 1063815 - RNA, 19 nt, Human
agugcaguggugugaucuc

SEQ ID NO: 1063816 - RNA, 21 nt, Human
agugcaguggugugaucucag

SEQ ID NO: 1063817 - RNA, 23 nt, Human
agugcaguggugugaucucagcu

SEQ ID NO: 1063818 - RNA, 24 nt, Human
agugcaguggugugaucucagcuc

SEQ ID NO: 1063819 - RNA, 24 nt, Human
aguggugugaucucagcucccugc

SEQ ID NO: 1063820 - RNA, 18 nt, Human
aguugcuuuuuucauaag

SEQ ID NO: 1063821 - RNA, 22 nt, Human
auaaagaagacauccaugagga

SEQ ID NO: 1063822 - RNA, 22 nt, Human
aucccagcacuuugggaggcca

SEQ ID NO: 1063823 - RNA, 23 nt, Human
augaggacgaauguccacaccug

SEQ ID NO: 1063824 - RNA, 21 nt, Human
augggugggaccaugucacag

SEQ ID NO: 1063825 - RNA, 21 nt, Human
augucucuuuaccacucaaac

SEQ ID NO: 1063826 - RNA, 24 nt, Human
auuuuuguauuuuuaguagagacg

SEQ ID NO: 1063827 - RNA, 22 nt, Human
caaaaacuuuaaaucaaaguaa

SEQ ID NO: 1063828 - RNA, 24 nt, Human
caaagugcugggauuacaagcaug

SEQ ID NO: 1063829 - RNA, 19 nt, Human
caacccaguucugcccucu

SEQ ID NO: 1063830 - RNA, 27 nt, Human
caacgccgacucccacagcaugccaca

SEQ ID NO: 1063831 - RNA, 28 nt, Human
caacuccuggguucaagcgagucucccu

SEQ ID NO: 1063832 - RNA, 26 nt, Human
caagguggaaggaucacuugaggcca

SEQ ID NO: 1063833 - RNA, 19 nt, Human
cacacccuucauacuuccc

SEQ ID NO: 1063834 - RNA, 23 nt, Human
cacaccuauaaucccaguacuuu

SEQ ID NO: 1063835 - RNA, 24 nt, Human
cacaccuguaaucccagcacuuug

SEQ ID NO: 1063836 - RNA, 18 nt, Human
cacagcucacauccggcc

SEQ ID NO: 1063837 - RNA, 24 nt, Human
caccaugcccgguuaauuuuugua

SEQ ID NO: 1063838 - RNA, 19 nt, Human
caccuguaaucccagcacu

SEQ ID NO: 1063839 - RNA, 24 nt, Human
caccuguaaucccagcacuuuggg

SEQ ID NO: 1063840 - RNA, 19 nt, Human
cacucccccagucccccug

SEQ ID NO: 1063841 - RNA, 20 nt, Human
cacuguacuacagucugggc

SEQ ID NO: 1063842 - RNA, 24 nt, Human
cacuguacuacagucugggcgaca

SEQ ID NO: 1063843 - RNA, 21 nt, Human
cacuguguaaacccaccugcc

SEQ ID NO: 1063844 - RNA, 25 nt, Human
cagaaccaggauaguggaaggaagu

SEQ ID NO: 1063845 - RNA, 18 nt, Human
cagagcucucuguccucc

SEQ ID NO: 1063846 - RNA, 19 nt, Human
cagagcucucuguccuccc

SEQ ID NO: 1063847 - RNA, 23 nt, Human
cagagcucucuguccucccaaag

SEQ ID NO: 1063848 - RNA, 19 nt, Human
cagaugauaaccaugaccc

SEQ ID NO: 1063849 - RNA, 25 nt, Human
cagcaccaaugcaauaguccuugaa

SEQ ID NO: 1063850 - RNA, 21 nt, Human
cagcacuuugggaggccaagg

SEQ ID NO: 1063851 - RNA, 24 nt, Human
cagcacuuugggaggccaaggugg

SEQ ID NO: 1063852 - RNA, 23 nt, Human
cagcagccucgggugccugaguu

SEQ ID NO: 1063853 - RNA, 21 nt, Human
cagcaugccacaacaugccuu

SEQ ID NO: 1063854 - RNA, 28 nt, Human
cagccaagggacauuacuucuuaaguac

SEQ ID NO: 1063855 - RNA, 22 nt, Human
cagcccacagagaacuguccag

SEQ ID NO: 1063856 - RNA, 20 nt, Human
cagccucccgaguaccuggg

SEQ ID NO: 1063857 - RNA, 19 nt, Human
cagcucccaaagugcuggg

SEQ ID NO: 1063858 - RNA, 19 nt, Human
caggauaguggaaggaagu

SEQ ID NO: 1063859 - RNA, 22 nt, Human
caguaucagagacacaaaagcc

SEQ ID NO: 1063860 - RNA, 24 nt, Human
cagucggcaggaguaacaacagaa

SEQ ID NO: 1063861 - RNA, 25 nt, Human
caugaccccaaaucaagaguuauaa

SEQ ID NO: 1063862 - RNA, 20 nt, Human
caugcaucacgugugucuuu

SEQ ID NO: 1063863 - RNA, 20 nt, Human
cauguugcccaggcuggucu

SEQ ID NO: 1063864 - RNA, 23 nt, Human
cauguugcccaggcuggucuuga

SEQ ID NO: 1063865 - RNA, 24 nt, Human
cauguugcccaggcuggucuugaa

SEQ ID NO: 1063866 - RNA, 19 nt, Human
ccaaagugcugggauuaca

SEQ ID NO: 1063867 - RNA, 24 nt, Human
ccaaagugcugggauuacaagcau

SEQ ID NO: 1063868 - RNA, 22 nt, Human
ccacaacaugccuuguggccag

SEQ ID NO: 1063869 - RNA, 22 nt, Human
ccacucacaugucucucauccc

SEQ ID NO: 1063870 - RNA, 21 nt, Human
ccacuguacuacagucugggc

SEQ ID NO: 1063871 - RNA, 23 nt, Human
ccacuguacuacagucugggcga

SEQ ID NO: 1063872 - RNA, 24 nt, Human
ccagagcucucuguccucccaaag

SEQ ID NO: 1063873 - RNA, 21 nt, Human
ccagcccacagagaacugucc

SEQ ID NO: 1063874 - RNA, 23 nt, Human
cccacagcaugccacaacaugcc

SEQ ID NO: 1063875 - RNA, 26 nt, Human
cccacuucucaccacuguguaaaccc

SEQ ID NO: 1063876 - RNA, 21 nt, Human
cccaggacgccagcccacaga

SEQ ID NO: 1063877 - RNA, 23 nt, Human
cccaggacgccagcccacagaga

SEQ ID NO: 1063878 - RNA, 21 nt, Human
cccccagucccccugaagggc

SEQ ID NO: 1063879 - RNA, 24 nt, Human
cccccagucccccugaagggcaaa

SEQ ID NO: 1063880 - RNA, 18 nt, Human
ccccccacuuaguccuca

SEQ ID NO: 1063881 - RNA, 24 nt, Human
cccgaguaccugggauuauagccu

SEQ ID NO: 1063882 - RNA, 24 nt, Human
cccucuggaaccgguugccucccc

SEQ ID NO: 1063883 - RNA, 25 nt, Human
cccucuggaaccgguugccucccca

SEQ ID NO: 1063884 - RNA, 19 nt, Human
cccuggcucaaaaaaaaaa

SEQ ID NO: 1063885 - RNA, 23 nt, Human
ccuccagcucccaaagugcuggg

SEQ ID NO: 1063886 - RNA, 23 nt, Human
ccucuggaaccgguugccucccc

SEQ ID NO: 1063887 - RNA, 24 nt, Human
ccugaccucaggugauucgcccac

SEQ ID NO: 1063888 - RNA, 20 nt, Human
ccuggagcuauuaaaggacc

SEQ ID NO: 1063889 - RNA, 21 nt, Human
ccuggagcuauuaaaggaccc

SEQ ID NO: 1063890 - RNA, 23 nt, Human
ccuggcucaaaaaaaaaaaaaaa

SEQ ID NO: 1063891 - RNA, 23 nt, Human
ccuggguucaagcgagucucccc

SEQ ID NO: 1063892 - RNA, 18 nt, Human
ccuucggugagcucuuca

SEQ ID NO: 1063893 - RNA, 30 nt, Human
ccuuucaugggcaggggugguaaaaggagc

SEQ ID NO: 1063894 - RNA, 24 nt, Human
cgccauguugcccaggcuggucuu

SEQ ID NO: 1063895 - RNA, 27 nt, Human
cgccauguugcccaggcuggucuugaa

SEQ ID NO: 1063896 - RNA, 24 nt, Human
cgccucagccucccgaguaccugg

SEQ ID NO: 1063897 - RNA, 24 nt, Human
cgggguuucgccauguugcccagg

SEQ ID NO: 1063898 - RNA, 24 nt, Human
cguucugucacccaggcuagagug

SEQ ID NO: 1063899 - RNA, 18 nt, Human
cuaauacccgccaugcaa

SEQ ID NO: 1063900 - RNA, 25 nt, Human
cuagaaaucaauagcccuacucaac

SEQ ID NO: 1063901 - RNA, 24 nt, Human
cuagagugcaguggugugaucuca

SEQ ID NO: 1063902 - RNA, 22 nt, Human
cucacaccuauaaucccaguac

SEQ ID NO: 1063903 - RNA, 24 nt, Human
cucacaccuauaaucccaguacuu

SEQ ID NO: 1063904 - RNA, 22 nt, Human
cucacaccuguaaucccagcac

SEQ ID NO: 1063905 - RNA, 24 nt, Human
cucacaccuguaaucccagcacuu

SEQ ID NO: 1063906 - RNA, 23 nt, Human
cucacaugucucucaucccccca

SEQ ID NO: 1063907 - RNA, 20 nt, Human
cucccaacccaguucugccc

SEQ ID NO: 1063908 - RNA, 19 nt, Human
cuccuucggugagcucuuc

SEQ ID NO: 1063909 - RNA, 21 nt, Human
cucuggaaccgguugccuccc

SEQ ID NO: 1063910 - RNA, 20 nt, Human
cugcggugagccgagaucau

SEQ ID NO: 1063911 - RNA, 22 nt, Human
cugggauuauagccugccacca

SEQ ID NO: 1063912 - RNA, 23 nt, Human
cugucuuccaaagagccugggcc

SEQ ID NO: 1063913 - RNA, 22 nt, Human
cuguuggcucaguuucauaugc

SEQ ID NO: 1063914 - RNA, 24 nt, Human
cuucuaauacccgccaugcaaacu

SEQ ID NO: 1063915 - RNA, 23 nt, Human
gaagaucacacccuucauacuuc

SEQ ID NO: 1063916 - RNA, 24 nt, Human
gaccucaggugauucgcccaccuc

SEQ ID NO: 1063917 - RNA, 22 nt, Human
gacgggguuucgccauguugcc

SEQ ID NO: 1063918 - RNA, 21 nt, Human
gagacagagucucguucuguc

SEQ ID NO: 1063919 - RNA, 23 nt, Human
gagacgggguuucgccauguugc

SEQ ID NO: 1063920 - RNA, 21 nt, Human
gaggagggccagcgugguggc

SEQ ID NO: 1063921 - RNA, 24 nt, Human
gaggagggccagcgugguggcuca

SEQ ID NO: 1063922 - RNA, 23 nt, Human
gaucacggccaaagcuauacuug

SEQ ID NO: 1063923 - RNA, 24 nt, Human
gaucacuugaggccaggaguuuga

SEQ ID NO: 1063924 - RNA, 21 nt, Human
gaugauaaccaugaccccaaa

SEQ ID NO: 1063925 - RNA, 18 nt, Human
gauuacaagcaugagcca

SEQ ID NO: 1063926 - RNA, 19 nt, Human
gauuauagccugccaccau

SEQ ID NO: 1063927 - RNA, 24 nt, Human
gcaggaguaacaacagaaccagga

SEQ ID NO: 1063928 - RNA, 21 nt, Human
gccaaagaucaagaugagaua

SEQ ID NO: 1063929 - RNA, 24 nt, Human
gccacuguacuacagucugggcga

SEQ ID NO: 1063930 - RNA, 24 nt, Human
gccauguugcccaggcuggucuug

SEQ ID NO: 1063931 - RNA, 20 nt, Human
gcccaacacccacucacaug

SEQ ID NO: 1063932 - RNA, 22 nt, Human
gcccgguuaauuuuuguauuuu

SEQ ID NO: 1063933 - RNA, 22 nt, Human
gccugaguuacuuuccugcacc

SEQ ID NO: 1063934 - RNA, 24 nt, Human
gcgagucucccgccucagccuccc

SEQ ID NO: 1063935 - RNA, 21 nt, Human
gcuaaacugaaaagggacaaa

SEQ ID NO: 1063936 - RNA, 21 nt, Human
gcucucgacaauaaauuuuag

SEQ ID NO: 1063937 - RNA, 21 nt, Human
gcugggauuacaagcaugagc

SEQ ID NO: 1063938 - RNA, 23 nt, Human
gcuggucuugaacuccugaccuc

SEQ ID NO: 1063939 - RNA, 21 nt, Human
ggaacagcacugcagucggca

SEQ ID NO: 1063940 - RNA, 20 nt, Human
ggaaccugggggccaagggg

SEQ ID NO: 1063941 - RNA, 23 nt, Human
ggagcaagcagaagcaaaaagga

SEQ ID NO: 1063942 - RNA, 23 nt, Human
ggagcgggaugaccugugcaguu

SEQ ID NO: 1063943 - RNA, 22 nt, Human
ggagggccagcgugguggcuca

SEQ ID NO: 1063944 - RNA, 22 nt, Human
ggaucacuugaggccaggaguu

SEQ ID NO: 1063945 - RNA, 22 nt, Human
ggauuacaagcaugagccaccg

SEQ ID NO: 1063946 - RNA, 22 nt, Human
ggccagcgugguggcucacacc

SEQ ID NO: 1063947 - RNA, 22 nt, Human
ggcuagagugcaguggugugau

SEQ ID NO: 1063948 - RNA, 21 nt, Human
ggcucacaccuguaaucccag

SEQ ID NO: 1063949 - RNA, 24 nt, Human
ggcuggucuugaacuccugaccuc

SEQ ID NO: 1063950 - RNA, 21 nt, Human
gggaaccugggggccaagggg

SEQ ID NO: 1063951 - RNA, 24 nt, Human
gggccagacacgguggcucacacc

SEQ ID NO: 1063952 - RNA, 23 nt, Human
gggguuucgccauguugcccagg

SEQ ID NO: 1063953 - RNA, 20 nt, Human
gguaaaaggagcaagcagaa

SEQ ID NO: 1063954 - RNA, 19 nt, Human
ggucuugaacuccugaccu

SEQ ID NO: 1063955 - RNA, 24 nt, Human
gguggcucacaccuauaaucccag

SEQ ID NO: 1063956 - RNA, 21 nt, Human
gguuauuuaaaaaaaaaaaaa

SEQ ID NO: 1063957 - RNA, 23 nt, Human
guagagacgggguuucgccaugu

SEQ ID NO: 1063958 - RNA, 24 nt, Human
guauuugccauccagcugaccaag

SEQ ID NO: 1063959 - RNA, 24 nt, Human
gugauucgcccaccuccagcuccc

SEQ ID NO: 1063960 - RNA, 23 nt, Human
guggcucacaccuguaaucccag

SEQ ID NO: 1063961 - RNA, 24 nt, Human
guuucgccauguugcccaggcugg

SEQ ID NO: 1063962 - RNA, 22 nt, Human
uaaaaaaaaaaaaaaaagcuga

SEQ ID NO: 1063963 - RNA, 21 nt, Human
uaaaaacagaauugcugaaag

SEQ ID NO: 1063964 - RNA, 21 nt, Human
uaaaaggagcaagcagaagca

SEQ ID NO: 1063965 - RNA, 23 nt, Human
uaaaaggagcaagcagaagcugg

SEQ ID NO: 1063966 - RNA, 26 nt, Human
uaacugaauauguaucauaaacugaa

SEQ ID NO: 1063967 - RNA, 21 nt, Human
uaaguacagaagcaucaguga

SEQ ID NO: 1063968 - RNA, 24 nt, Human
uaauuuuuguauuuuuaguagaga

SEQ ID NO: 1063969 - RNA, 24 nt, Human
uacaagcaugagccaccgcgccca

SEQ ID NO: 1063970 - RNA, 24 nt, Human
uacagaagcaucagugaaggucag

SEQ ID NO: 1063971 - RNA, 18 nt, Human
uaccaaacagaaccauuu

SEQ ID NO: 1063972 - RNA, 26 nt, Human
uaccaaacagaaccauuucacuuucu

SEQ ID NO: 1063973 - RNA, 22 nt, Human
uacuggcccaacacccacucac

SEQ ID NO: 1063974 - RNA, 23 nt, Human
uagaaaaaauauggaauaauaau

SEQ ID NO: 1063975 - RNA, 22 nt, Human
uagagacgggguuucgccaugu

SEQ ID NO: 1063976 - RNA, 18 nt, Human
uagagggauaggggccag

SEQ ID NO: 1063977 - RNA, 24 nt, Human
uagagugcaguggugugaucucag

SEQ ID NO: 1063978 - RNA, 22 nt, Human
uaggguaagaauaacaucucuc

SEQ ID NO: 1063979 - RNA, 24 nt, Human
uaguagagacgggguuucgccaug

SEQ ID NO: 1063980 - RNA, 19 nt, Human
ucaaaaaaaaaaaaaaaaa

SEQ ID NO: 1063981 - RNA, 22 nt, Human
ucaaaaaaaaaaaaaaaaaggu

SEQ ID NO: 1063982 - RNA, 19 nt, Human
ucaacgccuaacaauugag

SEQ ID NO: 1063983 - RNA, 24 nt, Human
ucaauagcccuacucaacgccuaa

SEQ ID NO: 1063984 - RNA, 25 nt, Human
ucaauagcccuacucaacgccuaac

SEQ ID NO: 1063985 - RNA, 20 nt, Human
ucaaugcaauggacaagcug

SEQ ID NO: 1063986 - RNA, 21 nt, Human
ucacacccuucauacuuccca

SEQ ID NO: 1063987 - RNA, 19 nt, Human
ucaccugaaaaugucucuc

SEQ ID NO: 1063988 - RNA, 18 nt, Human
ucacuauugcucauuacc

SEQ ID NO: 1063989 - RNA, 20 nt, Human
ucagcagccucgggugccug

SEQ ID NO: 1063990 - RNA, 24 nt, Human
uccaaagagccugggccugcuccu

SEQ ID NO: 1063991 - RNA, 23 nt, Human
uccaagccaaagaucaagaugag

SEQ ID NO: 1063992 - RNA, 18 nt, Human
uccagcucccaaagugcu

SEQ ID NO: 1063993 - RNA, 18 nt, Human
ucccaaagugcugggauu

SEQ ID NO: 1063994 - RNA, 24 nt, Human
ucccaaagugcugggauuacaagc

SEQ ID NO: 1063995 - RNA, 20 nt, Human
ucccaacccaguucugcccu

SEQ ID NO: 1063996 - RNA, 24 nt, Human
ucccccuuucaugggcagggguug

SEQ ID NO: 1063997 - RNA, 22 nt, Human
ucccugcaacuuccaacuccug

SEQ ID NO: 1063998 - RNA, 24 nt, Human
ucccugcaacuuccaacuccuggg

SEQ ID NO: 1063999 - RNA, 25 nt, Human
ucccuggcucaaaaaaaaaaaaaaa

SEQ ID NO: 1064000 - RNA, 21 nt, Human
uccucccaaagagaguuucau

SEQ ID NO: 1064001 - RNA, 24 nt, Human
uccugcaccguccauucccaccuc

SEQ ID NO: 1064002 - RNA, 21 nt, Human
uccuggguucaagcgagucuc

SEQ ID NO: 1064003 - RNA, 24 nt, Human
uccuugucucccaacccaguucug

SEQ ID NO: 1064004 - RNA, 22 nt, Human
ucgccauguugcccaggcuggu

SEQ ID NO: 1064005 - RNA, 22 nt, Human
ucggagauacuguacgauguca

SEQ ID NO: 1064006 - RNA, 22 nt, Human
ucuaauuucuuuaauaggguaa

SEQ ID NO: 1064007 - RNA, 24 nt, Human
ucucccgccucagccucccgagua

SEQ ID NO: 1064008 - RNA, 19 nt, Human
ucucguucugucacccagg

SEQ ID NO: 1064009 - RNA, 23 nt, Human
ucucguucugucacccaggcuag

SEQ ID NO: 1064010 - RNA, 24 nt, Human
ucucguucugucacccaggcuaga

SEQ ID NO: 1064011 - RNA, 25 nt, Human
ucucucauccccccacuuaguccuc

SEQ ID NO: 1064012 - RNA, 22 nt, Human
ucucugggaugcuucaacgccg

SEQ ID NO: 1064013 - RNA, 24 nt, Human
ucugucacccaggcuagagugcag

SEQ ID NO: 1064014 - RNA, 23 nt, Human
ucuugaacuccugaccucaggug

SEQ ID NO: 1064015 - RNA, 19 nt, Human
ugaaacagugaaaugcaaa

SEQ ID NO: 1064016 - RNA, 23 nt, Human
ugaaacagugaaaugcaaagaau

SEQ ID NO: 1064017 - RNA, 24 nt, Human
ugaaacagugaaaugcaaagaaug

SEQ ID NO: 1064018 - RNA, 20 nt, Human
ugaaaugcaaagaauguauc

SEQ ID NO: 1064019 - RNA, 21 nt, Human
ugaagaucacggccaaagcua

SEQ ID NO: 1064020 - RNA, 20 nt, Human
ugaccaacaaucagacccca

SEQ ID NO: 1064021 - RNA, 22 nt, Human
ugaccaacaaucagaccccaca

SEQ ID NO: 1064022 - RNA, 18 nt, Human
ugaccucaggugauucgc

SEQ ID NO: 1064023 - RNA, 24 nt, Human
ugaccucaggugauucgcccaccu

SEQ ID NO: 1064024 - RNA, 22 nt, Human
ugagccgagaucaugccacugu

SEQ ID NO: 1064025 - RNA, 20 nt, Human
ugaggagggccagcguggug

SEQ ID NO: 1064026 - RNA, 24 nt, Human
ugauucgcccaccuccagcuccca

SEQ ID NO: 1064027 - RNA, 25 nt, Human
ugauuuacaagaacugugcuuccuu

SEQ ID NO: 1064028 - RNA, 18 nt, Human
ugcaauggacaagcugaa

SEQ ID NO: 1064029 - RNA, 22 nt, Human
ugcagcucacagcauguacaug

SEQ ID NO: 1064030 - RNA, 22 nt, Human
ugcaguggugugaucucagcuc

SEQ ID NO: 1064031 - RNA, 19 nt, Human
ugccacuguacuacagucu

SEQ ID NO: 1064032 - RNA, 24 nt, Human
ugcccaggcuggucuugaacuccu

SEQ ID NO: 1064033 - RNA, 19 nt, Human
ugccccagagcucucuguc

SEQ ID NO: 1064034 - RNA, 22 nt, Human
ugccccuccccuggaagucugc

SEQ ID NO: 1064035 - RNA, 20 nt, Human
ugccucaaaacaagcugcga

SEQ ID NO: 1064036 - RNA, 18 nt, Human
ugccuuguggccaggcgg

SEQ ID NO: 1064037 - RNA, 20 nt, Human
ugccuuguggccaggcggcc

SEQ ID NO: 1064038 - RNA, 24 nt, Human
ugcugggauuacaagcaugagcca

SEQ ID NO: 1064039 - RNA, 20 nt, Human
uggaacaauacuccaaggac

SEQ ID NO: 1064040 - RNA, 21 nt, Human
uggaacaauacuccaaggaca

SEQ ID NO: 1064041 - RNA, 22 nt, Human
uggaauaauaaugguuauuuaa

SEQ ID NO: 1064042 - RNA, 27 nt, Human
uggcaaggggcguggaccgcugugggg

SEQ ID NO: 1064043 - RNA, 19 nt, Human
uggcccaacacccacucac

SEQ ID NO: 1064044 - RNA, 18 nt, Human
uggcucaaaaaaaaaaaa

SEQ ID NO: 1064045 - RNA, 22 nt, Human
uggcucacaccuauaaucccag

SEQ ID NO: 1064046 - RNA, 22 nt, Human
uggcucacaccuauaaucccag

SEQ ID NO: 1064047 - RNA, 21 nt, Human
uggcucacaccuguaauccca

SEQ ID NO: 1064048 - RNA, 22 nt, Human
uggcucacaccuguaaucccag

SEQ ID NO: 1064049 - RNA, 24 nt, Human
uggcucacaccuguaaucccagca

SEQ ID NO: 1064050 - RNA, 19 nt, Human
uggcucagggggagcacag

SEQ ID NO: 1064051 - RNA, 26 nt, Human
ugggaaccugggggccaaggggcccc

SEQ ID NO: 1064052 - RNA, 20 nt, Human
ugggaccaugucacaggagg

SEQ ID NO: 1064053 - RNA, 22 nt, Human
ugggaccaugucacaggagggu

SEQ ID NO: 1064054 - RNA, 23 nt, Human
ugggaccaugucacaggaggguu

SEQ ID NO: 1064055 - RNA, 19 nt, Human
ugggagcgggaugaccugu

SEQ ID NO: 1064056 - RNA, 24 nt, Human
ugggaggccaagguggaaggauca

SEQ ID NO: 1064057 - RNA, 21 nt, Human
ugggauuacaagcaugagcca

SEQ ID NO: 1064058 - RNA, 22 nt, Human
ugggauuacaagcaugagccac

SEQ ID NO: 1064059 - RNA, 23 nt, Human
ugggauuacaagcaugagccacc

SEQ ID NO: 1064060 - RNA, 24 nt, Human
ugggauuacaagcaugagccaccg

SEQ ID NO: 1064061 - RNA, 24 nt, Human
ugggauuacaagcaugagccaccg

SEQ ID NO: 1064062 - RNA, 26 nt, Human
ugggauuacaagcaugagccaccgcg

SEQ ID NO: 1064063 - RNA, 19 nt, Human
ugggauuauagccugccac

SEQ ID NO: 1064064 - RNA, 21 nt, Human
ugggauuauagccugccacca

SEQ ID NO: 1064065 - RNA, 22 nt, Human
ugggauuauagccugccaccau

SEQ ID NO: 1064066 - RNA, 24 nt, Human
uggggggaugggauuuggcugaaa

SEQ ID NO: 1064067 - RNA, 24 nt, Human
ugguggcucacaccuguaauccca

SEQ ID NO: 1064068 - RNA, 18 nt, Human
uggugugaucucagcucc

SEQ ID NO: 1064069 - RNA, 24 nt, Human
uggugugaucucagcucccugcaa

SEQ ID NO: 1064070 - RNA, 21 nt, Human
uguauuuuuaguagagacggg

SEQ ID NO: 1064071 - RNA, 21 nt, Human
ugucaagacaacuguaacugg

SEQ ID NO: 1064072 - RNA, 23 nt, Human
ugucucccaacccaguucugccc

SEQ ID NO: 1064073 - RNA, 22 nt, Human
uuaaaagacgugcucucgacaa

SEQ ID NO: 1064074 - RNA, 18 nt, Human
uuaguagagacgggguuu

SEQ ID NO: 1064075 - RNA, 22 nt, Human
uuaguagagacgggguuucgcc

SEQ ID NO: 1064076 - RNA, 24 nt, Human
uuaguagagacgggguuucgccau

SEQ ID NO: 1064077 - RNA, 18 nt, Human
uucaagcgagucucccgc

SEQ ID NO: 1064078 - RNA, 21 nt, Human
uucgcccaccuccagcuccca

SEQ ID NO: 1064079 - RNA, 22 nt, Human
uuuaaaaaaaaaaaaaaaagcu

SEQ ID NO: 1064080 - RNA, 22 nt, Human
uuucgccauguugcccaggcug

SEQ ID NO: 1064081 - RNA, 23 nt, Human
uuucgccauguugcccaggcugg

SEQ ID NO: 1064082 - RNA, 23 nt, Human
uuucgccauguugcccaggcugu

SEQ ID NO: 1064083 - RNA, 18 nt, Human
uuuucuuugaugcugcug

SEQ ID NO: 1064084 - RNA, 22 nt, Human
uuuuuaguagagacgggguuuc

SEQ ID NO: 1064085 - RNA, 23 nt, Human
uuuuuaguagagacgggguuucg

SEQ ID NO: 1064086 - RNA, 20 nt, Human
uuuuuguauuuuuaguagag

SEQ ID NO: 1064087 - RNA, 23 nt, Human
aaaaagaauacuggcccugugaa

SEQ ID NO: 1064088 - RNA, 23 nt, Human
aaacaauccucccacuugccaac

SEQ ID NO: 1064089 - RNA, 22 nt, Human
aagacucucaauggaguacggc

SEQ ID NO: 1064090 - RNA, 25 nt, Human
aagcaauccuccugccugagccucc

SEQ ID NO: 1064091 - RNA, 21 nt, Human
aaguagcuggaaccacaggua

SEQ ID NO: 1064092 - RNA, 18 nt, Human
acagcucacugcagccuc

SEQ ID NO: 1064093 - RNA, 23 nt, Human
agauuccugggcucaaacaaucc

SEQ ID NO: 1064094 - RNA, 19 nt, Human
aggaaaggccagcgaagug

SEQ ID NO: 1064095 - RNA, 24 nt, Human
aggaaaggccagcgaaguguccug

SEQ ID NO: 1064096 - RNA, 20 nt, Human
aggcauuugagcuugagaag

SEQ ID NO: 1064097 - RNA, 19 nt, Human
aggcuggagugcaguggca

SEQ ID NO: 1064098 - RNA, 23 nt, Human
aguagcuggaaccacagguaugc

SEQ ID NO: 1064099 - RNA, 21 nt, Human
agugcaguggcacaaucacag

SEQ ID NO: 1064100 - RNA, 18 nt, Human
auggggucucaucauguu

SEQ ID NO: 1064101 - RNA, 24 nt, Human
auggggucucaucauguugcucag

SEQ ID NO: 1064102 - RNA, 22 nt, Human
caaaaagaggaaaagcaccaac

SEQ ID NO: 1064103 - RNA, 22 nt, Human
caaacaauccucccacuugcca

SEQ ID NO: 1064104 - RNA, 24 nt, Human
caagaaucugcaucugaacgccau

SEQ ID NO: 1064105 - RNA, 27 nt, Human
caagcaauccuccugccugagccuccc

SEQ ID NO: 1064106 - RNA, 27 nt, Human
caagcaauccuccugccugagccuccc

SEQ ID NO: 1064107 - RNA, 24 nt, Human
cacagguaugcgccaccacaccca

SEQ ID NO: 1064108 - RNA, 24 nt, Human
caccgagugacaaguaugaggcca

SEQ ID NO: 1064109 - RNA, 23 nt, Human
cacuuaaucauucagcaccccgg

SEQ ID NO: 1064110 - RNA, 28 nt, Human
cagcccgccagcugcagaacuuugggcu

SEQ ID NO: 1064111 - RNA, 24 nt, Human
cagccucgaccuacugggcucaag

SEQ ID NO: 1064112 - RNA, 24 nt, Human
caucauguugcucaggcuggucuc

SEQ ID NO: 1064113 - RNA, 19 nt, Human
cauguugcucaggcugguc

SEQ ID NO: 1064114 - RNA, 21 nt, Human
cauguugcucaggcuggucuc

SEQ ID NO: 1064115 - RNA, 22 nt, Human
cauguugcucaggcuggucuca

SEQ ID NO: 1064116 - RNA, 23 nt, Human
cauguugcucaggcuggucucag

SEQ ID NO: 1064117 - RNA, 24 nt, Human
cauguugcucaggcuggucucaga

SEQ ID NO: 1064118 - RNA, 24 nt, Human
ccucccacuugccauuugcaagcc

SEQ ID NO: 1064119 - RNA, 26 nt, Human
ccuccugccugagccucccaaguagc

SEQ ID NO: 1064120 - RNA, 19 nt, Human
ccucgaccuacugggcuca

SEQ ID NO: 1064121 - RNA, 21 nt, Human
ccugugaaguugcaauuuuaa

SEQ ID NO: 1064122 - RNA, 21 nt, Human
cgaaguguccugucugcccuc

SEQ ID NO: 1064123 - RNA, 20 nt, Human
cgcagugucaccgagugaca

SEQ ID NO: 1064124 - RNA, 24 nt, Human
cggcggcaaaaagaggaaaagcac

SEQ ID NO: 1064125 - RNA, 24 nt, Human
cguucuguggcccaggcuggagug

SEQ ID NO: 1064126 - RNA, 22 nt, Human
cucaaacaauccucccacuugc

SEQ ID NO: 1064127 - RNA, 24 nt, Human
cucaagcaauccuccugccugagc

SEQ ID NO: 1064128 - RNA, 23 nt, Human
cugaacgccaucuccaaaggacu

SEQ ID NO: 1064129 - RNA, 18 nt, Human
gagauggggucucaucau

SEQ ID NO: 1064130 - RNA, 23 nt, Human
gagugacaaguaugaggccagga

SEQ ID NO: 1064131 - RNA, 24 nt, Human
gagugcaguggcacaaucacagcu

SEQ ID NO: 1064132 - RNA, 21 nt, Human
gcaaaaagaggaaaagcacca

SEQ ID NO: 1064133 - RNA, 19 nt, Human
gcccaggcuggagugcagu

SEQ ID NO: 1064134 - RNA, 23 nt, Human
gcccaggcuggagugcaguggca

SEQ ID NO: 1064135 - RNA, 19 nt, Human
gcuggagugcaguggcaca

SEQ ID NO: 1064136 - RNA, 22 nt, Human
gggcucaagcaauccuccugcc

SEQ ID NO: 1064137 - RNA, 22 nt, Human
gggucucaucauguugcucagg

SEQ ID NO: 1064138 - RNA, 21 nt, Human
guagagauggggucucaucau

SEQ ID NO: 1064139 - RNA, 23 nt, Human
guggcacaaucacagcucacugc

SEQ ID NO: 1064140 - RNA, 19 nt, Human
guggcccaggcuggagugc

SEQ ID NO: 1064141 - RNA, 22 nt, Human
guucuguggcccaggcuggagu

SEQ ID NO: 1064142 - RNA, 20 nt, Human
uaaaaagaauacuggcccug

SEQ ID NO: 1064143 - RNA, 18 nt, Human
uaaaugugcuuucugaac

SEQ ID NO: 1064144 - RNA, 23 nt, Human
uauccaaacuuuucugaucugau

SEQ ID NO: 1064145 - RNA, 20 nt, Human
uaugcgccaccacacccagc

SEQ ID NO: 1064146 - RNA, 24 nt, Human
uauggaacaagaaucugcaucuga

SEQ ID NO: 1064147 - RNA, 24 nt, Human
ucacugcagccucgaccuacuggg

SEQ ID NO: 1064148 - RNA, 24 nt, Human
ucauucagcaccccgguuuccuca

SEQ ID NO: 1064149 - RNA, 24 nt, Human
ucccaaguagcuggaaccacaggu

SEQ ID NO: 1064150 - RNA, 24 nt, Human
uccugggcucaaacaauccuccca

SEQ ID NO: 1064151 - RNA, 22 nt, Human
ucguucuguggcccaggcugga

SEQ ID NO: 1064152 - RNA, 19 nt, Human
ucucagauuccugggcuca

SEQ ID NO: 1064153 - RNA, 23 nt, Human
ucucaucauguugcucaggcugg

SEQ ID NO: 1064154 - RNA, 23 nt, Human
ucucguucuguggcccaggcugg

SEQ ID NO: 1064155 - RNA, 24 nt, Human
ucucguucuguggcccaggcugga

SEQ ID NO: 1064156 - RNA, 24 nt, Human
ucuguggcccaggcuggagugcag

SEQ ID NO: 1064157 - RNA, 21 nt, Human
ugacaaguaugaggccaggaa

SEQ ID NO: 1064158 - RNA, 19 nt, Human
ugaggccaggaaaggccag

SEQ ID NO: 1064159 - RNA, 24 nt, Human
ugccugagccucccaaguagcugg

SEQ ID NO: 1064160 - RNA, 22 nt, Human
ugcucaggcuggucucagauuc

SEQ ID NO: 1064161 - RNA, 24 nt, Human
ugcucaggcuggucucagauuccu

SEQ ID NO: 1064162 - RNA, 21 nt, Human
uggaaccacagguaugcgcca

SEQ ID NO: 1064163 - RNA, 24 nt, Human
uggaaccacagguaugcgccacca

SEQ ID NO: 1064164 - RNA, 18 nt, Human
uggagugcaguggcacaa

SEQ ID NO: 1064165 - RNA, 19 nt, Human
uggagugcaguggcacaau

SEQ ID NO: 1064166 - RNA, 21 nt, Human
uggagugcaguggcacaauca

SEQ ID NO: 1064167 - RNA, 20 nt, Human
uggcacaaucacagcucacu

SEQ ID NO: 1064168 - RNA, 23 nt, Human
uggcacaaucacagcucacugca

SEQ ID NO: 1064169 - RNA, 18 nt, Human
uggcccaggcuggagugc

SEQ ID NO: 1064170 - RNA, 24 nt, Human
ugggcucaagcaauccuccugccu

SEQ ID NO: 1064171 - RNA, 24 nt, Human
uggggucucaucauguugcucagg

SEQ ID NO: 1064172 - RNA, 24 nt, Human
uguagagauggggucucaucaugu

SEQ ID NO: 1064173 - RNA, 20 nt, Human
uguugcucaggcuggucuca

SEQ ID NO: 1064174 - RNA, 19 nt, Human
uuaauuuuuuguagagaug

SEQ ID NO: 1064175 - RNA, 23 nt, Human
uuccugggcucaaacaauccucc

SEQ ID NO: 1064176 - RNA, 24 nt, Human
uuguagagauggggucucaucaug

SEQ ID NO: 1064177 - RNA, 18 nt, Human
uuuguagagauggggucu

SEQ ID NO: 1064178 - RNA, 21 nt, Human
uuuguagagauggggucucau

SEQ ID NO: 1064179 - RNA, 24 nt, Human
uuuguagagauggggucucaucau

SEQ ID NO: 1064180 - RNA, 24 nt, Human
uuuuuuguagagauggggucucau

SEQ ID NO: 1064181 - RNA, 25 nt, Human
uuuuuuuuuucugagaugaagucuc

SEQ ID NO: 1064182 - RNA, 20 nt, Human
uuuuuuuuuuuuuuuucugg

SEQ ID NO: 1064183 - RNA, 22 nt, Human
aaaugguuaauaaauccgagca

SEQ ID NO: 1064184 - RNA, 20 nt, Human
aacccagaucuacccaauca

SEQ ID NO: 1064185 - RNA, 27 nt, Human
aacuuauuccuccuaccuaaucuccua

SEQ ID NO: 1064186 - RNA, 18 nt, Human
aaggaagaugugggugau

SEQ ID NO: 1064187 - RNA, 23 nt, Human
aagugagaacaugccguauuugg

SEQ ID NO: 1064188 - RNA, 18 nt, Human
acaauagcaggcccugga

SEQ ID NO: 1064189 - RNA, 22 nt, Human
acagaaaaaccucuccaggagc

SEQ ID NO: 1064190 - RNA, 19 nt, Human
accacauuuuccugaucca

SEQ ID NO: 1064191 - RNA, 20 nt, Human
accccucucuucuuagugcc

SEQ ID NO: 1064192 - RNA, 20 nt, Human
acuugagugcaugugucuuu

SEQ ID NO: 1064193 - RNA, 19 nt, Human
agaaagccugguauuuguc

SEQ ID NO: 1064194 - RNA, 18 nt, Human
agcacaauagcaggcccu

SEQ ID NO: 1064195 - RNA, 20 nt, Human
agcaggaacgaaagaaccua

SEQ ID NO: 1064196 - RNA, 24 nt, Human
agcaggcccuggagagcaaguuuu

SEQ ID NO: 1064197 - RNA, 22 nt, Human
aggagaagccagcugacccuug

SEQ ID NO: 1064198 - RNA, 24 nt, Human
aggccugcaaagaauguucgcugg

SEQ ID NO: 1064199 - RNA, 19 nt, Human
aggggcguaauaauuguuu

SEQ ID NO: 1064200 - RNA, 22 nt, Human
auagcacacuugagugcaugug

SEQ ID NO: 1064201 - RNA, 20 nt, Human
auggccaggcuccaccuugc

SEQ ID NO: 1064202 - RNA, 19 nt, Human
auuguuaucaauacaaucc

SEQ ID NO: 1064203 - RNA, 21 nt, Human
caacuucccagcuccuaaccc

SEQ ID NO: 1064204 - RNA, 26 nt, Human
caauagcaggaacgaaagaaccuauu

SEQ ID NO: 1064205 - RNA, 25 nt, Human
cacauuuuccugauccaaucuacca

SEQ ID NO: 1064206 - RNA, 19 nt, Human
cagcauccguccagcuuag

SEQ ID NO: 1064207 - RNA, 23 nt, Human
cagccuuggguuugcccuucuca

SEQ ID NO: 1064208 - RNA, 24 nt, Human
caggcaggcucucaucuguguauc

SEQ ID NO: 1064209 - RNA, 21 nt, Human
cauggccaggcuccaccuugc

SEQ ID NO: 1064210 - RNA, 21 nt, Human
ccagcuccuaacccagaucua

SEQ ID NO: 1064211 - RNA, 21 nt, Human
ccagguggugaguguaguacc

SEQ ID NO: 1064212 - RNA, 18 nt, Human
cccacuugucaguggagc

SEQ ID NO: 1064213 - RNA, 23 nt, Human
ccccaaccuucuaauaguccaca

SEQ ID NO: 1064214 - RNA, 21 nt, Human
ccccagagagcuguaauugcc

SEQ ID NO: 1064215 - RNA, 22 nt, Human
ccccugaggcucugcccugccu

SEQ ID NO: 1064216 - RNA, 19 nt, Human
ccuaacccagaucuaccca

SEQ ID NO: 1064217 - RNA, 22 nt, Human
ccuccagcuccauccauguugc

SEQ ID NO: 1064218 - RNA, 23 nt, Human
ccuccagcuccauccauguugcu

SEQ ID NO: 1064219 - RNA, 22 nt, Human
ccuuggguuugcccuucucaga

SEQ ID NO: 1064220 - RNA, 25 nt, Human
cgaagggagcaacauucacccaggu

SEQ ID NO: 1064221 - RNA, 28 nt, Human
cgagcaauuuacucuugaguuguaugaa

SEQ ID NO: 1064222 - RNA, 18 nt, Human
cuaacauaugcuaggggc

SEQ ID NO: 1064223 - RNA, 25 nt, Human
cuuaaaaauaaccaauuacagaaaa

SEQ ID NO: 1064224 - RNA, 21 nt, Human
gaaaccccugaggcucugccc

SEQ ID NO: 1064225 - RNA, 23 nt, Human
gaacuuauuccuccuaccuaauc

SEQ ID NO: 1064226 - RNA, 19 nt, Human
gaagccauuugauugaaaa

SEQ ID NO: 1064227 - RNA, 20 nt, Human
gacacuugagcagacugcag

SEQ ID NO: 1064228 - RNA, 22 nt, Human
gacagcacaaauaaauacagaa

SEQ ID NO: 1064229 - RNA, 20 nt, Human
gccuuggguuugcccuucuc

SEQ ID NO: 1064230 - RNA, 19 nt, Human
gcuuugggguuagacuugg

SEQ ID NO: 1064231 - RNA, 20 nt, Human
ggagcucgcccagccuuggg

SEQ ID NO: 1064232 - RNA, 18 nt, Human
ggaggccugcaaagaaug

SEQ ID NO: 1064233 - RNA, 21 nt, Human
ggcccuggagagcaaguuuua

SEQ ID NO: 1064234 - RNA, 23 nt, Human
gggaauauugugugguguuaagg

SEQ ID NO: 1064235 - RNA, 21 nt, Human
gugggugauuucccauggagg

SEQ ID NO: 1064236 - RNA, 22 nt, Human
uaacccagaucuacccaaucaa

SEQ ID NO: 1064237 - RNA, 22 nt, Human
uaagacaauagcaggaacgaaa

SEQ ID NO: 1064238 - RNA, 24 nt, Human
uaagauuucaucuugauucuuuuu

SEQ ID NO: 1064239 - RNA, 23 nt, Human
uaauaaucaaacuuacuucauac

SEQ ID NO: 1064240 - RNA, 22 nt, Human
uaaucuacguagaguauuuagc

SEQ ID NO: 1064241 - RNA, 21 nt, Human
uacaaagauugagaaauggug

SEQ ID NO: 1064242 - RNA, 19 nt, Human
uacagaaaauagaaaugag

SEQ ID NO: 1064243 - RNA, 21 nt, Human
uacagaaaauagaaaugagau

SEQ ID NO: 1064244 - RNA, 24 nt, Human
uacuuuuguauuuuacaagagaua

SEQ ID NO: 1064245 - RNA, 21 nt, Human
uagcacacuugagugcaugug

SEQ ID NO: 1064246 - RNA, 21 nt, Human
uagcaggaacgaaagaaccua

SEQ ID NO: 1064247 - RNA, 21 nt, Human
uagcuccuuccccaagucucc

SEQ ID NO: 1064248 - RNA, 23 nt, Human
uauauggaccacauuuuccugau

SEQ ID NO: 1064249 - RNA, 22 nt, Human
uauauuguuaucaauacaaucc

SEQ ID NO: 1064250 - RNA, 19 nt, Human
uauguuguauauggaccac

SEQ ID NO: 1064251 - RNA, 21 nt, Human
uauguuguauauggaccacau

SEQ ID NO: 1064252 - RNA, 24 nt, Human
uauuugguuuucuguuccuguguu

SEQ ID NO: 1064253 - RNA, 18 nt, Human
ucacagaccagcucugcc

SEQ ID NO: 1064254 - RNA, 24 nt, Human
uccagaucuuagcuccuuccccaa

SEQ ID NO: 1064255 - RNA, 21 nt, Human
ucccagcuccuaacccagauc

SEQ ID NO: 1064256 - RNA, 24 nt, Human
ucccauggaggucucagcgagggc

SEQ ID NO: 1064257 - RNA, 24 nt, Human
ucgggauacucugggagggccuau

SEQ ID NO: 1064258 - RNA, 18 nt, Human
ucuaccauugcugggcac

SEQ ID NO: 1064259 - RNA, 21 nt, Human
ucugcaaagacccuuauucca

SEQ ID NO: 1064260 - RNA, 23 nt, Human
ucugcaaagacccuuauuccaaa

SEQ ID NO: 1064261 - RNA, 24 nt, Human
ucuggggcuagaaaccccugaggc

SEQ ID NO: 1064262 - RNA, 19 nt, Human
ucuuugcuauugugaauag

SEQ ID NO: 1064263 - RNA, 20 nt, Human
ugaagccugagcuuuggggu

SEQ ID NO: 1064264 - RNA, 21 nt, Human
ugccaucagaccccucucuuc

SEQ ID NO: 1064265 - RNA, 26 nt, Human
uggaauggcuaaaucaagcuaauuga

SEQ ID NO: 1064266 - RNA, 23 nt, Human
uggagagcaaguuuuauccagug

SEQ ID NO: 1064267 - RNA, 30 nt, Human
uggccaggcuccaccuugcugagaaagccu

SEQ ID NO: 1064268 - RNA, 18 nt, Human
uggccuccagcuccaucc

SEQ ID NO: 1064269 - RNA, 22 nt, Human
ugggaagggcugaguuaagagu

SEQ ID NO: 1064270 - RNA, 23 nt, Human
ugggaagggcugaguuaagagug

SEQ ID NO: 1064271 - RNA, 20 nt, Human
ugggagggggcuagaauccu

SEQ ID NO: 1064272 - RNA, 18 nt, Human
ugugccagcauccgucca

SEQ ID NO: 1064273 - RNA, 19 nt, Human
uguggacugaagccugagc

SEQ ID NO: 1064274 - RNA, 21 nt, Human
ugugugguguuaagguuugca

SEQ ID NO: 1064275 - RNA, 24 nt, Human
uguuacaugggaauauuguguggu

SEQ ID NO: 1064276 - RNA, 19 nt, Human
uguuguuguuuuaauuaca

SEQ ID NO: 1064277 - RNA, 19 nt, Human
uguuuuaagacaauagcag

SEQ ID NO: 1064278 - RNA, 19 nt, Human
uuaaagcaaauauagucuc

SEQ ID NO: 1064279 - RNA, 19 nt, Human
uuaacccaccuccccaacc

SEQ ID NO: 1064280 - RNA, 21 nt, Human
uuaagcaacugugcaccuaac

SEQ ID NO: 1064281 - RNA, 21 nt, Human
uuccuaagccaacuuuuuucu

SEQ ID NO: 1064282 - RNA, 20 nt, Human
uucuauguuguauauggacc

SEQ ID NO: 1064283 - RNA, 21 nt, Human
uugccuuaggaggaagguggc

SEQ ID NO: 1064284 - RNA, 21 nt, Human
uuggaagugagaacaugccgu

SEQ ID NO: 1064285 - RNA, 22 nt, Human
uuguggaauggcuaaaucaagc

SEQ ID NO: 1064286 - RNA, 20 nt, Human
uuguggacugaagccugagc

SEQ ID NO: 1064287 - RNA, 22 nt, Human
uuucauuaagaagcauauguuu

SEQ ID NO: 1064288 - RNA, 20 nt, Human
uuuuauggcugcauaguauu

SEQ ID NO: 1064289 - RNA, 19 nt, Human
uuuuguuguaagauucaac

SEQ ID NO: 1064290 - RNA, 22 nt, Human
gagugugcugggugagaagaau

SEQ ID NO: 1064291 - RNA, 19 nt, Human
uauggcaaggaccauggug

SEQ ID NO: 1064292 - RNA, 18 nt, Human
ugagaagaauaugaagug

SEQ ID NO: 1064293 - RNA, 20 nt, Human
aaaagaacacagcuuccaca

SEQ ID NO: 1064294 - RNA, 22 nt, Human
aaaagaacacagcuuccacaaa

SEQ ID NO: 1064295 - RNA, 23 nt, Human
aaaauaaagccccgaggguucac

SEQ ID NO: 1064296 - RNA, 24 nt, Human
aaaaugcagggauuacaggcguga

SEQ ID NO: 1064297 - RNA, 18 nt, Human
aaaguucuccaagucccc

SEQ ID NO: 1064298 - RNA, 22 nt, Human
aaaguucuccaaguccccaccc

SEQ ID NO: 1064299 - RNA, 25 nt, Human
aagaagaaaugaaaauaaagccccg

SEQ ID NO: 1064300 - RNA, 24 nt, Human
acacagcuuccacaaacucgaaac

SEQ ID NO: 1064301 - RNA, 24 nt, Human
acacgauuucaccauguuggccag

SEQ ID NO: 1064302 - RNA, 22 nt, Human
accaaaagaacacagcuuccac

SEQ ID NO: 1064303 - RNA, 23 nt, Human
accacacccggccaguguuacag

SEQ ID NO: 1064304 - RNA, 18 nt, Human
accccuaagacucccaga

SEQ ID NO: 1064305 - RNA, 21 nt, Human
acccuuccuccugguuaccac

SEQ ID NO: 1064306 - RNA, 23 nt, Human
acugccucagccuccgaguagcu

SEQ ID NO: 1064307 - RNA, 23 nt, Human
agaaaggaaaagaauccagaagg

SEQ ID NO: 1064308 - RNA, 19 nt, Human
agaccccuaagacucccag

SEQ ID NO: 1064309 - RNA, 19 nt, Human
aggaaaagaaaggaaaaga

SEQ ID NO: 1064310 - RNA, 18 nt, Human
agggauuacaggcgugag

SEQ ID NO: 1064311 - RNA, 22 nt, Human
agggauuacaggcgugagccac

SEQ ID NO: 1064312 - RNA, 23 nt, Human
agggauuacaggcgugagccacc

SEQ ID NO: 1064313 - RNA, 24 nt, Human
agggauuacaggcgugagccacca

SEQ ID NO: 1064314 - RNA, 18 nt, Human
aguagcugggacuacagg

SEQ ID NO: 1064315 - RNA, 19 nt, Human
aguagcugggacuacaggc

SEQ ID NO: 1064316 - RNA, 18 nt, Human
aguccccacccgacccag

SEQ ID NO: 1064317 - RNA, 21 nt, Human
agugcagugaugcaaucccag

SEQ ID NO: 1064318 - RNA, 22 nt, Human
aguuacguccugccaagaagaa

SEQ ID NO: 1064319 - RNA, 23 nt, Human
auccagaaggcuccuccugggcu

SEQ ID NO: 1064320 - RNA, 21 nt, Human
auuucaccauguuggccagga

SEQ ID NO: 1064321 - RNA, 24 nt, Human
caaaaugcagggauuacaggcgug

SEQ ID NO: 1064322 - RNA, 25 nt, Human
caagacagaaaaguucuccaagucc

SEQ ID NO: 1064323 - RNA, 19 nt, Human
caccacacccggccagugu

SEQ ID NO: 1064324 - RNA, 18 nt, Human
caccauguuggccaggau

SEQ ID NO: 1064325 - RNA, 22 nt, Human
caccauguuggccaggaugguc

SEQ ID NO: 1064326 - RNA, 22 nt, Human
cacccaggcuggagugcaguga

SEQ ID NO: 1064327 - RNA, 18 nt, Human
cacccgacccagaagacc

SEQ ID NO: 1064328 - RNA, 22 nt, Human
caccucagcccccccaaaaugc

SEQ ID NO: 1064329 - RNA, 24 nt, Human
caccucagcccccccaaaaugcag

SEQ ID NO: 1064330 - RNA, 24 nt, Human
cacgauuucaccauguuggccagg

SEQ ID NO: 1064331 - RNA, 21 nt, Human
cagugacccuuccuccugguu

SEQ ID NO: 1064332 - RNA, 22 nt, Human
ccaaaaugcagggauuacaggc

SEQ ID NO: 1064333 - RNA, 24 nt, Human
ccaaaaugcagggauuacaggcgu

SEQ ID NO: 1064334 - RNA, 18 nt, Human
ccaaggccagacuucgcu

SEQ ID NO: 1064335 - RNA, 21 nt, Human
ccagagccuccuuccucggcu

SEQ ID NO: 1064336 - RNA, 18 nt, Human
ccaggcccugauauaccg

SEQ ID NO: 1064337 - RNA, 19 nt, Human
ccaugcugccaagaccccu

SEQ ID NO: 1064338 - RNA, 20 nt, Human
cccaaggccagacuucgcuc

SEQ ID NO: 1064339 - RNA, 22 nt, Human
cccagaagaccagcuggcuuca

SEQ ID NO: 1064340 - RNA, 24 nt, Human
cccagaagaccagcuggcuucacc

SEQ ID NO: 1064341 - RNA, 24 nt, Human
ccccaaaaugcagggauuacaggc

SEQ ID NO: 1064342 - RNA, 18 nt, Human
ccccaggacccaaggcca

SEQ ID NO: 1064343 - RNA, 19 nt, Human
ccccgaggguucacucggg

SEQ ID NO: 1064344 - RNA, 19 nt, Human
ccccuaagacucccagagc

SEQ ID NO: 1064345 - RNA, 22 nt, Human
ccgaguagcugggacuacaggc

SEQ ID NO: 1064346 - RNA, 26 nt, Human
ccgcccaccucagcccccccaaaaug

SEQ ID NO: 1064347 - RNA, 22 nt, Human
ccucccggguucaugccauucu

SEQ ID NO: 1064348 - RNA, 23 nt, Human
ccucgcucugucacccaggcugg

SEQ ID NO: 1064349 - RNA, 24 nt, Human
ccucgcucugucacccaggcugga

SEQ ID NO: 1064350 - RNA, 26 nt, Human
ccucgcucugucacccaggcuggagu

SEQ ID NO: 1064351 - RNA, 27 nt, Human
ccucgcucugucacccaggcuggagug

SEQ ID NO: 1064352 - RNA, 22 nt, Human
ccugccaagaagaaaugaaaau

SEQ ID NO: 1064353 - RNA, 21 nt, Human
ccugccaccacuccuggcuaa

SEQ ID NO: 1064354 - RNA, 22 nt, Human
cggcuccucacugccccuuccc

SEQ ID NO: 1064355 - RNA, 22 nt, Human
cgguaggaucguggucuugaug

SEQ ID NO: 1064356 - RNA, 24 nt, Human
cucacugcaagcuccaccucccgg

SEQ ID NO: 1064357 - RNA, 23 nt, Human
cucagccuccgaguagcugggac

SEQ ID NO: 1064358 - RNA, 21 nt, Human
cucccggguucaugccauucu

SEQ ID NO: 1064359 - RNA, 24 nt, Human
cuccgaguagcugggacuacaggc

SEQ ID NO: 1064360 - RNA, 20 nt, Human
cuccugaacuugugauccgc

SEQ ID NO: 1064361 - RNA, 20 nt, Human
cuccugggcuugcacaaauu

SEQ ID NO: 1064362 - RNA, 21 nt, Human
cuccugguuaccacauucccc

SEQ ID NO: 1064363 - RNA, 24 nt, Human
cucgcucugucacccaggcuggag

SEQ ID NO: 1064364 - RNA, 20 nt, Human
cucgggguucgcugggagcc

SEQ ID NO: 1064365 - RNA, 20 nt, Human
cucugucacccaggcuggag

SEQ ID NO: 1064366 - RNA, 18 nt, Human
cugagcucccugacgcuu

SEQ ID NO: 1064367 - RNA, 21 nt, Human
cugcaguugggccgguggcca

SEQ ID NO: 1064368 - RNA, 22 nt, Human
cuuugggcugaggccaggcccu

SEQ ID NO: 1064369 - RNA, 22 nt, Human
gaacuugugauccgcccaccuc

SEQ ID NO: 1064370 - RNA, 24 nt, Human
gaacuugugauccgcccaccucag

SEQ ID NO: 1064371 - RNA, 22 nt, Human
gacccuuccuccugguuaccac

SEQ ID NO: 1064372 - RNA, 19 nt, Human
gaggguucacucgggguuc

SEQ ID NO: 1064373 - RNA, 26 nt, Human
gaguagcugggacuacaggcgccugc

SEQ ID NO: 1064374 - RNA, 20 nt, Human
gaguuauucauuccucccgg

SEQ ID NO: 1064375 - RNA, 23 nt, Human
gaguuauucauuccucccgguag

SEQ ID NO: 1064376 - RNA, 18 nt, Human
gauuacaggcgugagcca

SEQ ID NO: 1064377 - RNA, 21 nt, Human
gauuacaggcgugagccacca

SEQ ID NO: 1064378 - RNA, 22 nt, Human
gauuacaggcgugagccaccac

SEQ ID NO: 1064379 - RNA, 21 nt, Human
gauuucaccauguuggccagg

SEQ ID NO: 1064380 - RNA, 24 nt, Human
gauuucaccauguuggccaggaug

SEQ ID NO: 1064381 - RNA, 22 nt, Human
gcaagcuccaccucccggguuc

SEQ ID NO: 1064382 - RNA, 21 nt, Human
gcaggcaaggcagccuggcag

SEQ ID NO: 1064383 - RNA, 24 nt, Human
gccuccuuccucggcuccucacug

SEQ ID NO: 1064384 - RNA, 25 nt, Human
gcucugucacccaggcuggagugca

SEQ ID NO: 1064385 - RNA, 25 nt, Human
ggaguuauucauuccucccgguagg

SEQ ID NO: 1064386 - RNA, 19 nt, Human
ggauuacaggcgugagcca

SEQ ID NO: 1064387 - RNA, 22 nt, Human
ggccaggauggucuggaucucc

SEQ ID NO: 1064388 - RNA, 18 nt, Human
gggauuacaggcgugagc

SEQ ID NO: 1064389 - RNA, 23 nt, Human
gggauuacaggcgugagccacca

SEQ ID NO: 1064390 - RNA, 20 nt, Human
gggggaugugcgggacaccc

SEQ ID NO: 1064391 - RNA, 21 nt, Human
guccauuuuacagagugcuga

SEQ ID NO: 1064392 - RNA, 23 nt, Human
guccauuuuuacagagugcugau

SEQ ID NO: 1064393 - RNA, 22 nt, Human
gugaagcccccuuacccaguga

SEQ ID NO: 1064394 - RNA, 21 nt, Human
gugauccgcccaccucagccc

SEQ ID NO: 1064395 - RNA, 24 nt, Human
uacaaaacuuaagcuagacacaga

SEQ ID NO: 1064396 - RNA, 23 nt, Human
uacaggcgugagccaccacaccc

SEQ ID NO: 1064397 - RNA, 26 nt, Human
uacugcaggaaaagaaaggaaaagaa

SEQ ID NO: 1064398 - RNA, 19 nt, Human
uagcaagacagaaaaguuc

SEQ ID NO: 1064399 - RNA, 23 nt, Human
uagcaagacagaaaaguucucca

SEQ ID NO: 1064400 - RNA, 24 nt, Human
uagcaagacagaaaaguucuccaa

SEQ ID NO: 1064401 - RNA, 21 nt, Human
uagcacaguucccaacacuaa

SEQ ID NO: 1064402 - RNA, 24 nt, Human
uagcagagacacgauuucaccaug

SEQ ID NO: 1064403 - RNA, 24 nt, Human
ucaccauguuggccaggauggucu

SEQ ID NO: 1064404 - RNA, 22 nt, Human
ucacccaggcuggagugcagug

SEQ ID NO: 1064405 - RNA, 24 nt, Human
ucacugcaagcuccaccucccggg

SEQ ID NO: 1064406 - RNA, 21 nt, Human
ucacugccccuucccgcccua

SEQ ID NO: 1064407 - RNA, 18 nt, Human
ucaugccauucuacugcc

SEQ ID NO: 1064408 - RNA, 25 nt, Human
uccaaguccccacccgacccagaag

SEQ ID NO: 1064409 - RNA, 21 nt, Human
uccacaaacucgaaacagacc

SEQ ID NO: 1064410 - RNA, 23 nt, Human
uccacaaacucgaaacagacccu

SEQ ID NO: 1064411 - RNA, 23 nt, Human
ucccagcucacugcaagcuccac

SEQ ID NO: 1064412 - RNA, 22 nt, Human
uccccaguggcgccuggucuau

SEQ ID NO: 1064413 - RNA, 24 nt, Human
ucccggguucaugccauucuacug

SEQ ID NO: 1064414 - RNA, 22 nt, Human
ucccugacgcuuugggcugagg

SEQ ID NO: 1064415 - RNA, 23 nt, Human
uccgaguagcugggacuacaggc

SEQ ID NO: 1064416 - RNA, 24 nt, Human
uccgaguagcugggacuacaggcg

SEQ ID NO: 1064417 - RNA, 18 nt, Human
uccgcccaccucagcccc

SEQ ID NO: 1064418 - RNA, 22 nt, Human
uccgcccaccucagccccccca

SEQ ID NO: 1064419 - RNA, 24 nt, Human
uccgcccaccucagcccccccaaa

SEQ ID NO: 1064420 - RNA, 25 nt, Human
uccgcccaccucagcccccccaaaa

SEQ ID NO: 1064421 - RNA, 24 nt, Human
ucgaaacagacccuacaggguugc

SEQ ID NO: 1064422 - RNA, 24 nt, Human
ucgcucugucacccaggcuggagu

SEQ ID NO: 1064423 - RNA, 21 nt, Human
ucuccaaguccccacccgacc

SEQ ID NO: 1064424 - RNA, 22 nt, Human
ucuccaaguccccacccgaccc

SEQ ID NO: 1064425 - RNA, 24 nt, Human
ucugucacccaggcuggagugcag

SEQ ID NO: 1064426 - RNA, 23 nt, Human
ugaaaauaaagccccgaggguuc

SEQ ID NO: 1064427 - RNA, 19 nt, Human
ugaaggcaggcaaggcagc

SEQ ID NO: 1064428 - RNA, 25 nt, Human
ugauccgcccaccucagccccccca

SEQ ID NO: 1064429 - RNA, 24 nt, Human
ugaugcaaucccagcucacugcaa

SEQ ID NO: 1064430 - RNA, 22 nt, Human
ugcacagguaacagugaagccc

SEQ ID NO: 1064431 - RNA, 24 nt, Human
ugccccuucccgcccuacuccaug

SEQ ID NO: 1064432 - RNA, 23 nt, Human
ugccucagccuccgaguagcugg

SEQ ID NO: 1064433 - RNA, 19 nt, Human
uggagugcagugaugcaau

SEQ ID NO: 1064434 - RNA, 24 nt, Human
uggccaggauggucuggaucuccu

SEQ ID NO: 1064435 - RNA, 21 nt, Human
uggcuucaccucucacuucca

SEQ ID NO: 1064436 - RNA, 21 nt, Human
ugggacuacaggcgccugcca

SEQ ID NO: 1064437 - RNA, 22 nt, Human
ugggacuacaggcgccugccac

SEQ ID NO: 1064438 - RNA, 24 nt, Human
ugggacuacaggcgccugccacca

SEQ ID NO: 1064439 - RNA, 24 nt, Human
uuagcagagacacgauuucaccau

SEQ ID NO: 1064440 - RNA, 27 nt, Human
uuauucauuccucccgguaggaucgug

SEQ ID NO: 1064441 - RNA, 21 nt, Human
uuauugugaagaccaaaagaa

SEQ ID NO: 1064442 - RNA, 19 nt, Human
uucaugccauucuacugcc

SEQ ID NO: 1064443 - RNA, 23 nt, Human
uuccacaaacucgaaacagaccc

SEQ ID NO: 1064444 - RNA, 19 nt, Human
uuccccaguggcgccuggu

SEQ ID NO: 1064445 - RNA, 20 nt, Human
uucccgcccuacuccaugcc

SEQ ID NO: 1064446 - RNA, 21 nt, Human
uucccgcccuacuccaugccu

SEQ ID NO: 1064447 - RNA, 21 nt, Human
uuccuccugguuaccacauuc

SEQ ID NO: 1064448 - RNA, 22 nt, Human
uuccucggcuccucacugcccc

SEQ ID NO: 1064449 - RNA, 25 nt, Human
uuccucggcuccucacugccccuuc

SEQ ID NO: 1064450 - RNA, 19 nt, Human
uugguccauuuuacagagu

SEQ ID NO: 1064451 - RNA, 19 nt, Human
uuucaccauguuggccagg

SEQ ID NO: 1064452 - RNA, 18 nt, Human
uuucuuagaagcaggaag

SEQ ID NO: 1064453 - RNA, 24 nt, Human
uuuuuagcagagacacgauuucac

SEQ ID NO: 1064454 - RNA, 19 nt, Human
aagggcagguccgacuuac

SEQ ID NO: 1064455 - RNA, 22 nt, Human
caauaaagaugaauacucgaca

SEQ ID NO: 1064456 - RNA, 23 nt, Human
cugggcacggugggaaaugacau

SEQ ID NO: 1064457 - RNA, 21 nt, Human
gggaacaugugaaggagcaac

SEQ ID NO: 1064458 - RNA, 20 nt, Human
uacaaaaucgagagccauaa

SEQ ID NO: 1064459 - RNA, 21 nt, Human
uggccgcacagagagugggaa

SEQ ID NO: 1064460 - RNA, 20 nt, Human
uuacaugguggccgcacaga

SEQ ID NO: 1064461 - RNA, 18 nt, Human
aagcagaagaucaggucc

SEQ ID NO: 1064462 - RNA, 25 nt, Human
aagucacuuucaaguagcccaaccg

SEQ ID NO: 1064463 - RNA, 23 nt, Human
cauguaagaagaaaagucacauc

SEQ ID NO: 1064464 - RNA, 25 nt, Human
uacuuuauuuucuggcaauucuugc

SEQ ID NO: 1064465 - RNA, 21 nt, Human
ucuugcuuauccuaacguuuc

SEQ ID NO: 1064466 - RNA, 21 nt, Human
uuggugaugacauaccuuucu

SEQ ID NO: 1064467 - RNA, 19 nt, Human
uuucuggcaauucuugcuu

SEQ ID NO: 1064468 - RNA, 24 nt, Human
aaaaauacaaaaugaaaccaugua

SEQ ID NO: 1064469 - RNA, 20 nt, Human
aaaacucugaguggcuuuuc

SEQ ID NO: 1064470 - RNA, 21 nt, Human
aaaccuacacuuucucccuaa

SEQ ID NO: 1064471 - RNA, 20 nt, Human
aaagaaaccuugaagugcag

SEQ ID NO: 1064472 - RNA, 25 nt, Human
aaaucaaguuucaaacuuuaucuag

SEQ ID NO: 1064473 - RNA, 18 nt, Human
aacaucauucacccugcc

SEQ ID NO: 1064474 - RNA, 20 nt, Human
aagcagcagcacagaagucc

SEQ ID NO: 1064475 - RNA, 19 nt, Human
aaggaaaccuuucuaaacu

SEQ ID NO: 1064476 - RNA, 21 nt, Human
aaggaaaccuuucuaaacuga

SEQ ID NO: 1064477 - RNA, 23 nt, Human
aaggaaaccuuucuaaacugaaa

SEQ ID NO: 1064478 - RNA, 20 nt, Human
aaguccacuuucaccuggcc

SEQ ID NO: 1064479 - RNA, 25 nt, Human
aagugccucugugggucuggcuucc

SEQ ID NO: 1064480 - RNA, 23 nt, Human
aaucauaaucauaaucauaaugc

SEQ ID NO: 1064481 - RNA, 18 nt, Human
aaugaacauguaggcuga

SEQ ID NO: 1064482 - RNA, 21 nt, Human
aaugaauauacucuagaccca

SEQ ID NO: 1064483 - RNA, 25 nt, Human
aaugaauauacucuagacccacagc

SEQ ID NO: 1064484 - RNA, 21 nt, Human
acaaugaauauacucuagacc

SEQ ID NO: 1064485 - RNA, 21 nt, Human
acccugagucccaugggaggg

SEQ ID NO: 1064486 - RNA, 20 nt, Human
accuacacuuucucccuaag

SEQ ID NO: 1064487 - RNA, 18 nt, Human
accuuguugaaccacuuc

SEQ ID NO: 1064488 - RNA, 19 nt, Human
agaaugcugauccucuacu

SEQ ID NO: 1064489 - RNA, 21 nt, Human
agcaaaggaaaccuuucuaaa

SEQ ID NO: 1064490 - RNA, 23 nt, Human
agcacagaaguccucaagggaua

SEQ ID NO: 1064491 - RNA, 22 nt, Human
agcccacuccuuuacuccccug

SEQ ID NO: 1064492 - RNA, 18 nt, Human
agcgcucuggggcagaug

SEQ ID NO: 1064493 - RNA, 20 nt, Human
aggaagaacugacaucucac

SEQ ID NO: 1064494 - RNA, 18 nt, Human
aggaaggugcugcacacg

SEQ ID NO: 1064495 - RNA, 21 nt, Human
aggagaagcagcagcacagaa

SEQ ID NO: 1064496 - RNA, 24 nt, Human
aguuauguacaaacccuuuuuaca

SEQ ID NO: 1064497 - RNA, 23 nt, Human
auauaugugugccuuguguuccc

SEQ ID NO: 1064498 - RNA, 21 nt, Human
auccagucccuacaaucccaa

SEQ ID NO: 1064499 - RNA, 21 nt, Human
augugugaggaaggugcugca

SEQ ID NO: 1064500 - RNA, 19 nt, Human
caaacacaucugccagcug

SEQ ID NO: 1064501 - RNA, 19 nt, Human
caaaggcgugucaggcugc

SEQ ID NO: 1064502 - RNA, 21 nt, Human
caacagaucuggguuuguguu

SEQ ID NO: 1064503 - RNA, 23 nt, Human
caaucccaaccaaucuucuacaa

SEQ ID NO: 1064504 - RNA, 19 nt, Human
cacugccuccgcuucuugc

SEQ ID NO: 1064505 - RNA, 18 nt, Human
cacuucaaaccacagcau

SEQ ID NO: 1064506 - RNA, 20 nt, Human
cagagaaagguuucuuuuca

SEQ ID NO: 1064507 - RNA, 23 nt, Human
caucuaagauucuaaacaguggg

SEQ ID NO: 1064508 - RNA, 19 nt, Human
caucucacuacuuucaacc

SEQ ID NO: 1064509 - RNA, 19 nt, Human
ccaacaccuuucaucucca

SEQ ID NO: 1064510 - RNA, 24 nt, Human
ccaacaccuuucaucuccaaccuc

SEQ ID NO: 1064511 - RNA, 18 nt, Human
ccaaggcaggcauggccg

SEQ ID NO: 1064512 - RNA, 22 nt, Human
ccaaucuucuacaacuauuacg

SEQ ID NO: 1064513 - RNA, 23 nt, Human
ccacaugccagauaauccugccu

SEQ ID NO: 1064514 - RNA, 24 nt, Human
ccagcugccuucccacgcugaccc

SEQ ID NO: 1064515 - RNA, 21 nt, Human
ccaggaagaacugacaucuca

SEQ ID NO: 1064516 - RNA, 19 nt, Human
ccaugggagggaagcacug

SEQ ID NO: 1064517 - RNA, 19 nt, Human
cccaaccaaucuucuacaa

SEQ ID NO: 1064518 - RNA, 22 nt, Human
cccacagccauugccccacauc

SEQ ID NO: 1064519 - RNA, 21 nt, Human
ccccccuuucucuagaaaucc

SEQ ID NO: 1064520 - RNA, 19 nt, Human
ccccuaaagaaaccuugaa

SEQ ID NO: 1064521 - RNA, 19 nt, Human
cccuaaagaaaccuugaag

SEQ ID NO: 1064522 - RNA, 25 nt, Human
ccuacaaucccaaccaaucuucuac

SEQ ID NO: 1064523 - RNA, 22 nt, Human
ccuagaaugcugauccucuacu

SEQ ID NO: 1064524 - RNA, 22 nt, Human
ccuagaucuccugucccaagaa

SEQ ID NO: 1064525 - RNA, 22 nt, Human
ccucacggacagcucucagcuu

SEQ ID NO: 1064526 - RNA, 26 nt, Human
ccuccgcuucuugccugcuucucuug

SEQ ID NO: 1064527 - RNA, 28 nt, Human
ccugugacagaaagcaaagccggggucc

SEQ ID NO: 1064528 - RNA, 20 nt, Human
ccuugaagugcagguuuugg

SEQ ID NO: 1064529 - RNA, 20 nt, Human
ccuuucaucuccaaccucau

SEQ ID NO: 1064530 - RNA, 23 nt, Human
cuaaaccuacacuuucucccuaa

SEQ ID NO: 1064531 - RNA, 26 nt, Human
cuaauggugcuuugagcauguuuucu

SEQ ID NO: 1064532 - RNA, 20 nt, Human
cuagacccacagccauugcc

SEQ ID NO: 1064533 - RNA, 22 nt, Human
cucaagggauaagcaaaggaaa

SEQ ID NO: 1064534 - RNA, 19 nt, Human
cucagcuuuucuugcucug

SEQ ID NO: 1064535 - RNA, 21 nt, Human
cuccaaccucauagaugaucu

SEQ ID NO: 1064536 - RNA, 21 nt, Human
cuccugucccugccagcugcc

SEQ ID NO: 1064537 - RNA, 20 nt, Human
cucuggggcagaugggacuc

SEQ ID NO: 1064538 - RNA, 18 nt, Human
cugccuccgcuucuugcc

SEQ ID NO: 1064539 - RNA, 22 nt, Human
cuggccagaacaucucuucuca

SEQ ID NO: 1064540 - RNA, 23 nt, Human
cugucccacuccucuugccugug

SEQ ID NO: 1064541 - RNA, 23 nt, Human
cuucccucucuuucuuaaaauuc

SEQ ID NO: 1064542 - RNA, 22 nt, Human
cuuggagugugcacccuuuagc

SEQ ID NO: 1064543 - RNA, 19 nt, Human
gaaaaacuuggcuguagcc

SEQ ID NO: 1064544 - RNA, 19 nt, Human
gaaggaaggggaggagagc

SEQ ID NO: 1064545 - RNA, 18 nt, Human
gagaagcagcagcacaga

SEQ ID NO: 1064546 - RNA, 19 nt, Human
gaggacacagcagcugcuc

SEQ ID NO: 1064547 - RNA, 23 nt, Human
gccugcuucucuuguuuuccuau

SEQ ID NO: 1064548 - RNA, 21 nt, Human
gcugauugauggcagaaccca

SEQ ID NO: 1064549 - RNA, 24 nt, Human
ggagugugcacccuuuagcacucc

SEQ ID NO: 1064550 - RNA, 19 nt, Human
ggaugaacccaauguaaca

SEQ ID NO: 1064551 - RNA, 20 nt, Human
ggcaggugggcugucuuccu

SEQ ID NO: 1064552 - RNA, 21 nt, Human
gggcggggcuccugucccugc

SEQ ID NO: 1064553 - RNA, 20 nt, Human
guggaagugaggcucagucc

SEQ ID NO: 1064554 - RNA, 19 nt, Human
guggcuuuucaugacuuuc

SEQ ID NO: 1064555 - RNA, 23 nt, Human
guuacugauuaacaucauucacc

SEQ ID NO: 1064556 - RNA, 20 nt, Human
uaaaaauaaaguccacuuuc

SEQ ID NO: 1064557 - RNA, 19 nt, Human
uaacuccuaaaccccccuu

SEQ ID NO: 1064558 - RNA, 22 nt, Human
uaacuccuaaaccccccuuucu

SEQ ID NO: 1064559 - RNA, 18 nt, Human
uacccuagaucuccuguc

SEQ ID NO: 1064560 - RNA, 22 nt, Human
uacuuugugaguuuguugcuga

SEQ ID NO: 1064561 - RNA, 23 nt, Human
uagaaaacaguaugauuggcagg

SEQ ID NO: 1064562 - RNA, 24 nt, Human
uagaucuccugucccaagaaguuc

SEQ ID NO: 1064563 - RNA, 23 nt, Human
uagcccacuccuuuacuccccug

SEQ ID NO: 1064564 - RNA, 24 nt, Human
uaugugugccuuguguucccaguu

SEQ ID NO: 1064565 - RNA, 22 nt, Human
uauugugcucauuucuccccca

SEQ ID NO: 1064566 - RNA, 20 nt, Human
ucaaaagauugaaagaugaa

SEQ ID NO: 1064567 - RNA, 22 nt, Human
ucaaugaacauguaggcugaac

SEQ ID NO: 1064568 - RNA, 25 nt, Human
ucaaugccuuguguacauuuccauc

SEQ ID NO: 1064569 - RNA, 21 nt, Human
ucagaguaauuaaucauaauc

SEQ ID NO: 1064570 - RNA, 19 nt, Human
ucauucacccugccacaug

SEQ ID NO: 1064571 - RNA, 22 nt, Human
uccaacaccuuucaucuccaac

SEQ ID NO: 1064572 - RNA, 19 nt, Human
uccaggaagaacugacauc

SEQ ID NO: 1064573 - RNA, 22 nt, Human
ucccaguuaggcaggugggcug

SEQ ID NO: 1064574 - RNA, 19 nt, Human
uccccugucccacuccucu

SEQ ID NO: 1064575 - RNA, 23 nt, Human
uccccugucccacuccucuugcc

SEQ ID NO: 1064576 - RNA, 23 nt, Human
ucccuacaaucccaaccaaucuu

SEQ ID NO: 1064577 - RNA, 20 nt, Human
ucccugccagcugccuuccc

SEQ ID NO: 1064578 - RNA, 21 nt, Human
ucucuucuucaauuccuguca

SEQ ID NO: 1064579 - RNA, 20 nt, Human
ucugaugguccugugacaga

SEQ ID NO: 1064580 - RNA, 22 nt, Human
ucugccagcugaucuaaaccua

SEQ ID NO: 1064581 - RNA, 24 nt, Human
ucuuagcugcuguacucacugccu

SEQ ID NO: 1064582 - RNA, 20 nt, Human
ucuucccucucuuucuuaaa

SEQ ID NO: 1064583 - RNA, 19 nt, Human
ugaaaaacuuggcuguagc

SEQ ID NO: 1064584 - RNA, 20 nt, Human
ugaaaaacuuggcuguagcc

SEQ ID NO: 1064585 - RNA, 23 nt, Human
ugaaccacuucaaaccacagcau

SEQ ID NO: 1064586 - RNA, 21 nt, Human
ugaacccaauguaacauuucu

SEQ ID NO: 1064587 - RNA, 23 nt, Human
ugaggacacagcagcugcucagu

SEQ ID NO: 1064588 - RNA, 22 nt, Human
ugccaacaaucaaaagauugaa

SEQ ID NO: 1064589 - RNA, 19 nt, Human
ugccuguguggccuucccu

SEQ ID NO: 1064590 - RNA, 18 nt, Human
uggcuguagcccacaaac

SEQ ID NO: 1064591 - RNA, 18 nt, Human
ugggagggaagcacuggg

SEQ ID NO: 1064592 - RNA, 20 nt, Human
uguauuauaagcugauugau

SEQ ID NO: 1064593 - RNA, 20 nt, Human
ugugugaggaaggugcugca

SEQ ID NO: 1064594 - RNA, 23 nt, Human
ugugugaggaaggugcugcacac

SEQ ID NO: 1064595 - RNA, 23 nt, Human
uuacagaugacagaguuggguag

SEQ ID NO: 1064596 - RNA, 21 nt, Human
uuacuccccugucccacuccu

SEQ ID NO: 1064597 - RNA, 23 nt, Human
uuagacuguacuuuguagccccu

SEQ ID NO: 1064598 - RNA, 21 nt, Human
uucacccugccacaugccaga

SEQ ID NO: 1064599 - RNA, 21 nt, Human
uucagaaaagccaccaaagca

SEQ ID NO: 1064600 - RNA, 21 nt, Human
uucaggagagucaggacguuc

SEQ ID NO: 1064601 - RNA, 25 nt, Human
uucccacgcugacccugagucccau

SEQ ID NO: 1064602 - RNA, 25 nt, Human
uugagcggaaggaaggggaggagag

SEQ ID NO: 1064603 - RNA, 23 nt, Human
uugcugcugagaaaauguucagu

SEQ ID NO: 1064604 - RNA, 21 nt, Human
uugcuuaaaacucugaguggc

SEQ ID NO: 1064605 - RNA, 20 nt, Human
uuucaaacuuuaucuaggcc

SEQ ID NO: 1064606 - RNA, 22 nt, Human
uuuccaauauaugugugccuug

SEQ ID NO: 1064607 - RNA, 19 nt, Human
uuuggcaguucuggacuau

SEQ ID NO: 1064608 - RNA, 19 nt, Human
uuugugugcauucucauga

SEQ ID NO: 1064609 - RNA, 20 nt, Human
aaaacucaggaucuccccuc

SEQ ID NO: 1064610 - RNA, 22 nt, Human
aagaaaacagcccagcugugua

SEQ ID NO: 1064611 - RNA, 22 nt, Human
acagaaaacucaggaucucccc

SEQ ID NO: 1064612 - RNA, 21 nt, Human
acagugcuaaagcccugucuc

SEQ ID NO: 1064613 - RNA, 25 nt, Human
agcccagcuguguagggccggggcc

SEQ ID NO: 1064614 - RNA, 21 nt, Human
aggccagcuccaagggccaca

SEQ ID NO: 1064615 - RNA, 19 nt, Human
aggcugcaguccugugguc

SEQ ID NO: 1064616 - RNA, 18 nt, Human
agggccggaagccccagg

SEQ ID NO: 1064617 - RNA, 22 nt, Human
agguuccaccugucagcaacuu

SEQ ID NO: 1064618 - RNA, 19 nt, Human
caaugccaggcuguccugc

SEQ ID NO: 1064619 - RNA, 22 nt, Human
cagaaaacucaggaucuccccu

SEQ ID NO: 1064620 - RNA, 19 nt, Human
ccaccgucccuggcccagg

SEQ ID NO: 1064621 - RNA, 21 nt, Human
ccaccgucccuggcccagguc

SEQ ID NO: 1064622 - RNA, 20 nt, Human
ccagcugccgguggguccag

SEQ ID NO: 1064623 - RNA, 24 nt, Human
cccccaccgucccuggcccagguu

SEQ ID NO: 1064624 - RNA, 18 nt, Human
cccguggccaaugccagg

SEQ ID NO: 1064625 - RNA, 22 nt, Human
ccucugcacagugcuaaagccc

SEQ ID NO: 1064626 - RNA, 20 nt, Human
ccugucucaaaguucagagc

SEQ ID NO: 1064627 - RNA, 19 nt, Human
cuccaagggccacagcucc

SEQ ID NO: 1064628 - RNA, 20 nt, Human
gccagcuccaagggccacag

SEQ ID NO: 1064629 - RNA, 21 nt, Human
ggaagccccaggcugcagucc

SEQ ID NO: 1064630 - RNA, 22 nt, Human
ggcccaggccagcuccaagggc

SEQ ID NO: 1064631 - RNA, 26 nt, Human
guggccgaugucccguggccaaugcc

SEQ ID NO: 1064632 - RNA, 19 nt, Human
ucagagcccggaaggugca

SEQ ID NO: 1064633 - RNA, 21 nt, Human
ucccuggcccaggucuaggac

SEQ ID NO: 1064634 - RNA, 22 nt, Human
uccugccccauuugaugccgaa

SEQ ID NO: 1064635 - RNA, 18 nt, Human
ugcccagcugccgguggg

SEQ ID NO: 1064636 - RNA, 23 nt, Human
ugccccauuugaugccgaaguug

SEQ ID NO: 1064637 - RNA, 21 nt, Human
ugccgguggguccagggggca

SEQ ID NO: 1064638 - RNA, 26 nt, Human
ugccucagguuccaccugucagcaac

SEQ ID NO: 1064639 - RNA, 22 nt, Human
uguccugcugccucagguucca

SEQ ID NO: 1064640 - RNA, 21 nt, Human
uguggcccuuggaaaucaagc

SEQ ID NO: 1064641 - RNA, 27 nt, Human
uguggccgaugucccguggccaaugcc

SEQ ID NO: 1064642 - RNA, 22 nt, Human
uuaauguucucucuccugcccc

SEQ ID NO: 1064643 - RNA, 25 nt, Human
aaaaacccauauucccuggccccuc

SEQ ID NO: 1064644 - RNA, 20 nt, Human
accacagcaaaggcacuuca

SEQ ID NO: 1064645 - RNA, 21 nt, Human
accccccucacacccaaccug

SEQ ID NO: 1064646 - RNA, 24 nt, Human
accucgggggcaccuuucccaggg

SEQ ID NO: 1064647 - RNA, 18 nt, Human
acuaagguuggcauugug

SEQ ID NO: 1064648 - RNA, 20 nt, Human
agacgcuuguuaaaaaccca

SEQ ID NO: 1064649 - RNA, 19 nt, Human
agaugggaauggggcuggg

SEQ ID NO: 1064650 - RNA, 21 nt, Human
agcccuucaugcugaggcauc

SEQ ID NO: 1064651 - RNA, 23 nt, Human
agcuccugcagggaggaaggaau

SEQ ID NO: 1064652 - RNA, 25 nt, Human
aggaaguugggaagaggaguccagg

SEQ ID NO: 1064653 - RNA, 24 nt, Human
agugaggaguccuggagacucugg

SEQ ID NO: 1064654 - RNA, 18 nt, Human
aguggugcugagggcaug

SEQ ID NO: 1064655 - RNA, 18 nt, Human
cacacccaaccugcgucc

SEQ ID NO: 1064656 - RNA, 21 nt, Human
cacaccugccugccguccccu

SEQ ID NO: 1064657 - RNA, 21 nt, Human
cagggcagcgccacaccugcc

SEQ ID NO: 1064658 - RNA, 22 nt, Human
caugauagagaaguguuuugua

SEQ ID NO: 1064659 - RNA, 18 nt, Human
ccacaaguccccaagccc

SEQ ID NO: 1064660 - RNA, 19 nt, Human
cccccgggcucugccuggc

SEQ ID NO: 1064661 - RNA, 21 nt, Human
cccccgggcucugccuggcuu

SEQ ID NO: 1064662 - RNA, 24 nt, Human
ccccucgcccccgggcucugccug

SEQ ID NO: 1064663 - RNA, 21 nt, Human
ccucacacccaaccugcgucc

SEQ ID NO: 1064664 - RNA, 19 nt, Human
ccugcagcugaggagugag

SEQ ID NO: 1064665 - RNA, 24 nt, Human
ccugccguccccucgcccccgggc

SEQ ID NO: 1064666 - RNA, 22 nt, Human
ccugccugccguccccucgccc

SEQ ID NO: 1064667 - RNA, 23 nt, Human
cgcccccgggcucugccuggcuu

SEQ ID NO: 1064668 - RNA, 20 nt, Human
cucccaggccccacccagac

SEQ ID NO: 1064669 - RNA, 19 nt, Human
cugaggcaucugucuggcu

SEQ ID NO: 1064670 - RNA, 23 nt, Human
cugcguccauggccgagguugaa

SEQ ID NO: 1064671 - RNA, 18 nt, Human
cuggcuccugcagcugag

SEQ ID NO: 1064672 - RNA, 19 nt, Human
cuggcuccugcagcugagg

SEQ ID NO: 1064673 - RNA, 23 nt, Human
cuggcuuugggcaucuccugugg

SEQ ID NO: 1064674 - RNA, 21 nt, Human
cugggaccccccucacaccca

SEQ ID NO: 1064675 - RNA, 20 nt, Human
cuuugcucuuguucuucugu

SEQ ID NO: 1064676 - RNA, 19 nt, Human
gaaaaccacagcaaaggca

SEQ ID NO: 1064677 - RNA, 19 nt, Human
gaauuuguaguuuauuuug

SEQ ID NO: 1064678 - RNA, 27 nt, Human
gacccuguuucaguagaugggaauggg

SEQ ID NO: 1064679 - RNA, 19 nt, Human
gcccagggcagcgccacac

SEQ ID NO: 1064680 - RNA, 22 nt, Human
gccguccccucgcccccgggcu

SEQ ID NO: 1064681 - RNA, 21 nt, Human
ggaaugauccacaagucccca

SEQ ID NO: 1064682 - RNA, 21 nt, Human
ggacaagaguggugcugaggg

SEQ ID NO: 1064683 - RNA, 19 nt, Human
ggaccccccucacacccaa

SEQ ID NO: 1064684 - RNA, 22 nt, Human
ggaccccccucacacccaaccu

SEQ ID NO: 1064685 - RNA, 22 nt, Human
ggaggaaggaaugauccacaag

SEQ ID NO: 1064686 - RNA, 18 nt, Human
ggcuucauggucuuugcu

SEQ ID NO: 1064687 - RNA, 19 nt, Human
guggugcugagggcauggu

SEQ ID NO: 1064688 - RNA, 22 nt, Human
uaagacgcuuguuaaaaaccca

SEQ ID NO: 1064689 - RNA, 18 nt, Human
uagaagaccgaaaggcug

SEQ ID NO: 1064690 - RNA, 19 nt, Human
uagaugggaauggggcugg

SEQ ID NO: 1064691 - RNA, 22 nt, Human
ucaggaauuuguaguuuauuuu

SEQ ID NO: 1064692 - RNA, 22 nt, Human
uccagguacccagucucaguug

SEQ ID NO: 1064693 - RNA, 18 nt, Human
ucccaggccccacccaga

SEQ ID NO: 1064694 - RNA, 19 nt, Human
ucgcccccgggcucugccu

SEQ ID NO: 1064695 - RNA, 22 nt, Human
ucuguauaaccugugcccagga

SEQ ID NO: 1064696 - RNA, 23 nt, Human
ucuguauaaccugugcccaggag

SEQ ID NO: 1064697 - RNA, 26 nt, Human
ucugucuggcuggagaaacacuaagg

SEQ ID NO: 1064698 - RNA, 21 nt, Human
ucugugcugcaugcagagggg

SEQ ID NO: 1064699 - RNA, 24 nt, Human
ugaccuggucagccaccaggggag

SEQ ID NO: 1064700 - RNA, 23 nt, Human
ugagggcauggucacacccuucu

SEQ ID NO: 1064701 - RNA, 18 nt, Human
ugagugaggaguccugga

SEQ ID NO: 1064702 - RNA, 20 nt, Human
uggaggaaguugggaagagg

SEQ ID NO: 1064703 - RNA, 25 nt, Human
uggaggaaguugggaagaggagucc

SEQ ID NO: 1064704 - RNA, 22 nt, Human
uggcauugugcucacacuggga

SEQ ID NO: 1064705 - RNA, 22 nt, Human
uggcucccaggccccacccaga

SEQ ID NO: 1064706 - RNA, 28 nt, Human
uggcuggagaaacacuaagguuggcauu

SEQ ID NO: 1064707 - RNA, 18 nt, Human
uggcuuugggcaucuccu

SEQ ID NO: 1064708 - RNA, 18 nt, Human
ugggaagaggaguccagg

SEQ ID NO: 1064709 - RNA, 19 nt, Human
ugggaauggggcugggguc

SEQ ID NO: 1064710 - RNA, 21 nt, Human
ugggaccccccucacacccaa

SEQ ID NO: 1064711 - RNA, 23 nt, Human
uggggacaagaguggugcugagg

SEQ ID NO: 1064712 - RNA, 24 nt, Human
uggggucuguauaaccugugccca

SEQ ID NO: 1064713 - RNA, 19 nt, Human
uggugcugagggcaugguc

SEQ ID NO: 1064714 - RNA, 19 nt, Human
uggugcugagggcaugguc

SEQ ID NO: 1064715 - RNA, 18 nt, Human
uguggcucccaggcccca

SEQ ID NO: 1064716 - RNA, 23 nt, Human
auagaacuuggcaucacccugaa

SEQ ID NO: 1064717 - RNA, 22 nt, Human
auucccugucauuucucuggcu

SEQ ID NO: 1064718 - RNA, 26 nt, Human
caaagccccuuuucuagccacugacu

SEQ ID NO: 1064719 - RNA, 18 nt, Human
caacagcaugggugcaaa

SEQ ID NO: 1064720 - RNA, 21 nt, Human
caauggcuucuccacccaagc

SEQ ID NO: 1064721 - RNA, 22 nt, Human
caccaaagguuucugaagacaa

SEQ ID NO: 1064722 - RNA, 22 nt, Human
cagcaugggugcaaaaaaaaaa

SEQ ID NO: 1064723 - RNA, 24 nt, Human
cucuccugcuaagcuuuguuuccu

SEQ ID NO: 1064724 - RNA, 18 nt, Human
cugcuaagcuuuguuucc

SEQ ID NO: 1064725 - RNA, 26 nt, Human
cuguagauucccugucauuucucugg

SEQ ID NO: 1064726 - RNA, 19 nt, Human
gacagggcuuuccuaacuu

SEQ ID NO: 1064727 - RNA, 20 nt, Human
gacagggcuuuccuaacuuc

SEQ ID NO: 1064728 - RNA, 24 nt, Human
gucauggucaucaaaaguuacaaa

SEQ ID NO: 1064729 - RNA, 24 nt, Human
guuuuuugcccauacacaugaguc

SEQ ID NO: 1064730 - RNA, 18 nt, Human
uaaaaucugccacugcca

SEQ ID NO: 1064731 - RNA, 18 nt, Human
uacugcugcugcuggaac

SEQ ID NO: 1064732 - RNA, 18 nt, Human
ucauuucucuggcucucc

SEQ ID NO: 1064733 - RNA, 20 nt, Human
ucucuggcucuccucuccug

SEQ ID NO: 1064734 - RNA, 25 nt, Human
ucugaagacaauggcuucuccaccc

SEQ ID NO: 1064735 - RNA, 21 nt, Human
ucugccacugccauagcuacu

SEQ ID NO: 1064736 - RNA, 19 nt, Human
ugaaugacaaucuuaucga

SEQ ID NO: 1064737 - RNA, 18 nt, Human
ugacucggucagucauga

SEQ ID NO: 1064738 - RNA, 18 nt, Human
uggaaccgccaauagcca

SEQ ID NO: 1064739 - RNA, 18 nt, Human
uucccacagaacagaaac

SEQ ID NO: 1064740 - RNA, 18 nt, Human
uuguggucauucacagua

SEQ ID NO: 1064741 - RNA, 25 nt, Human
uuguggucauucacaguaugguauu

SEQ ID NO: 1064742 - RNA, 26 nt, Human
aucuuccuguauggguuccccacugg

SEQ ID NO: 1064743 - RNA, 19 nt, Human
guucggagucgucaccauc

SEQ ID NO: 1064744 - RNA, 21 nt, Human
uccauauuuauuaugaucuuc

SEQ ID NO: 1064745 - RNA, 19 nt, Human
agcuaauggggaaaugaaa

SEQ ID NO: 1064746 - RNA, 21 nt, Human
cgugcuuacagacugcuccau

SEQ ID NO: 1064747 - RNA, 18 nt, Human
gccaguuuauuugaucgu

SEQ ID NO: 1064748 - RNA, 21 nt, Human
gcuaauggggaaaugaaagga

SEQ ID NO: 1064749 - RNA, 19 nt, Human
gugcuuacagacugcucca

SEQ ID NO: 1064750 - RNA, 19 nt, Human
uacaauuagccucaucuuu

SEQ ID NO: 1064751 - RNA, 23 nt, Human
uagccucaucuuuggccaguuua

SEQ ID NO: 1064752 - RNA, 30 nt, Human
uguuuuauucccauuuacaauuagccucaa

SEQ ID NO: 1064753 - RNA, 19 nt, Human
uugugguguguuuuauucc

SEQ ID NO: 1064754 - RNA, 21 nt, Human
uuuuaaaaucuguuuuuugug

SEQ ID NO: 1064755 - RNA, 24 nt, Human
aaaaagauacaaacaaaaccagca

SEQ ID NO: 1064756 - RNA, 21 nt, Human
aaaaccagcauucaacuugaa

SEQ ID NO: 1064757 - RNA, 21 nt, Human
aaaaugcacacacugugaacg

SEQ ID NO: 1064758 - RNA, 24 nt, Human
aaaccagcauucaacuugaaccaa

SEQ ID NO: 1064759 - RNA, 21 nt, Human
aagcuggcaugaugcaaggug

SEQ ID NO: 1064760 - RNA, 18 nt, Human
aaucuguauuauuuccuc

SEQ ID NO: 1064761 - RNA, 21 nt, Human
aauuucaguuacuccuuuaag

SEQ ID NO: 1064762 - RNA, 23 nt, Human
acagaccagugucacucccagau

SEQ ID NO: 1064763 - RNA, 21 nt, Human
acccuacuaccaaaacuguaa

SEQ ID NO: 1064764 - RNA, 20 nt, Human
agaaaaagacaauuauggaa

SEQ ID NO: 1064765 - RNA, 23 nt, Human
agcuaaauuuuguucaaagccua

SEQ ID NO: 1064766 - RNA, 18 nt, Human
agcuggcaugaugcaagg

SEQ ID NO: 1064767 - RNA, 21 nt, Human
aggcauaggaggcaacacugg

SEQ ID NO: 1064768 - RNA, 22 nt, Human
aggccgccgcaccauggagaau

SEQ ID NO: 1064769 - RNA, 22 nt, Human
agugauauagauuuaaaaaccc

SEQ ID NO: 1064770 - RNA, 21 nt, Human
auguaagaaagucuacacuuu

SEQ ID NO: 1064771 - RNA, 23 nt, Human
auuuccucaggccuuuuauccuc

SEQ ID NO: 1064772 - RNA, 25 nt, Human
cacaguaucauguacagagagcaaa

SEQ ID NO: 1064773 - RNA, 19 nt, Human
caccauggagaaugggcac

SEQ ID NO: 1064774 - RNA, 19 nt, Human
cacccagaaacagcagagc

SEQ ID NO: 1064775 - RNA, 21 nt, Human
cacucuauagaaaaagacaau

SEQ ID NO: 1064776 - RNA, 22 nt, Human
cagcauucaacuugaaccaaga

SEQ ID NO: 1064777 - RNA, 20 nt, Human
cagccaacagcucauacaga

SEQ ID NO: 1064778 - RNA, 21 nt, Human
cagccacaccugagaccagca

SEQ ID NO: 1064779 - RNA, 22 nt, Human
caggccuuuuauccuccacugg

SEQ ID NO: 1064780 - RNA, 18 nt, Human
caggucagcccaccgcuc

SEQ ID NO: 1064781 - RNA, 21 nt, Human
caugcacucuauagaaaaaga

SEQ ID NO: 1064782 - RNA, 21 nt, Human
ccaaaacuguaauugauuuca

SEQ ID NO: 1064783 - RNA, 22 nt, Human
ccaccgcucuccggacacccug

SEQ ID NO: 1064784 - RNA, 20 nt, Human
ccagaaacagcagagcucac

SEQ ID NO: 1064785 - RNA, 25 nt, Human
ccagugguucucuauuuuugaccag

SEQ ID NO: 1064786 - RNA, 20 nt, Human
ccauggagaaugggcaccgg

SEQ ID NO: 1064787 - RNA, 19 nt, Human
cccagaaacagcagagcuc

SEQ ID NO: 1064788 - RNA, 21 nt, Human
cccagaaacagcagagcucac

SEQ ID NO: 1064789 - RNA, 19 nt, Human
cccauacauacuaagccuc

SEQ ID NO: 1064790 - RNA, 19 nt, Human
cgacagcagcagccacacc

SEQ ID NO: 1064791 - RNA, 24 nt, Human
cgacagcagcagccacaccugaga

SEQ ID NO: 1064792 - RNA, 20 nt, Human
cggucuguucauccuucuua

SEQ ID NO: 1064793 - RNA, 19 nt, Human
cucaucgucaauaucuuca

SEQ ID NO: 1064794 - RNA, 23 nt, Human
cucccauacauacuaagccucua

SEQ ID NO: 1064795 - RNA, 20 nt, Human
cucucugaucucacuguuua

SEQ ID NO: 1064796 - RNA, 21 nt, Human
cugcagcugggcuggcagagc

SEQ ID NO: 1064797 - RNA, 23 nt, Human
cugccggguauaaucuuaaaugu

SEQ ID NO: 1064798 - RNA, 22 nt, Human
cugcugaauugauaccuucaac

SEQ ID NO: 1064799 - RNA, 23 nt, Human
gaacaggucagcccaccgcucuc

SEQ ID NO: 1064800 - RNA, 22 nt, Human
gacagcagcagccacaccugag

SEQ ID NO: 1064801 - RNA, 19 nt, Human
gaggaaggucaggucuucc

SEQ ID NO: 1064802 - RNA, 23 nt, Human
gccgcaccauggagaaugggcac

SEQ ID NO: 1064803 - RNA, 23 nt, Human
uaaaaacccuacuaccaaaacug

SEQ ID NO: 1064804 - RNA, 23 nt, Human
uaaaaagauacaaacaaaaccag

SEQ ID NO: 1064805 - RNA, 25 nt, Human
uaaaaagauacaaacaaaaccagca

SEQ ID NO: 1064806 - RNA, 19 nt, Human
uaaaaugcacacacuguga

SEQ ID NO: 1064807 - RNA, 24 nt, Human
uaagccucuagcuaagucucucug

SEQ ID NO: 1064808 - RNA, 21 nt, Human
uaauggcuuguucugaagcuc

SEQ ID NO: 1064809 - RNA, 19 nt, Human
uaauucuucugagccacag

SEQ ID NO: 1064810 - RNA, 23 nt, Human
uaccuucaacagcuaacauucaa

SEQ ID NO: 1064811 - RNA, 22 nt, Human
uagcuaagucucucugaaaauu

SEQ ID NO: 1064812 - RNA, 19 nt, Human
uaguguaguuuuucaugac

SEQ ID NO: 1064813 - RNA, 22 nt, Human
uauaauaacuguuaaaagucua

SEQ ID NO: 1064814 - RNA, 19 nt, Human
uauguaagaaagucuacac

SEQ ID NO: 1064815 - RNA, 19 nt, Human
ucaaagccuaggagaaccu

SEQ ID NO: 1064816 - RNA, 25 nt, Human
ucagcccaccgcucuccggacaccc

SEQ ID NO: 1064817 - RNA, 24 nt, Human
ucccauacauacuaagccucuagc

SEQ ID NO: 1064818 - RNA, 21 nt, Human
ucuccggacacccugccuucg

SEQ ID NO: 1064819 - RNA, 27 nt, Human
ucugagccacaguaucauguacagaga

SEQ ID NO: 1064820 - RNA, 22 nt, Human
ucugugaugauccacccagaaa

SEQ ID NO: 1064821 - RNA, 24 nt, Human
ucuuuugauggugucuccucuuug

SEQ ID NO: 1064822 - RNA, 19 nt, Human
ugaauaagaccacuucuau

SEQ ID NO: 1064823 - RNA, 19 nt, Human
ugacaaagcuggcaugaug

SEQ ID NO: 1064824 - RNA, 26 nt, Human
ugagaccagcagaagcgcugaacucc

SEQ ID NO: 1064825 - RNA, 22 nt, Human
ugccuuauccucauuaggauua

SEQ ID NO: 1064826 - RNA, 20 nt, Human
ugcgaauauguaagaaaguc

SEQ ID NO: 1064827 - RNA, 19 nt, Human
uggcagagcagccaacagc

SEQ ID NO: 1064828 - RNA, 23 nt, Human
uguaaaaagauacaaacaaaacc

SEQ ID NO: 1064829 - RNA, 18 nt, Human
uguaaaaggaagugcaca

SEQ ID NO: 1064830 - RNA, 19 nt, Human
ugucugucuggagcugcuc

SEQ ID NO: 1064831 - RNA, 21 nt, Human
uucaaacucgacagcagcagc

SEQ ID NO: 1064832 - RNA, 22 nt, Human
uucacucaagguaaaauuucag

SEQ ID NO: 1064833 - RNA, 19 nt, Human
uucauccuucuuaauggua

SEQ ID NO: 1064834 - RNA, 18 nt, Human
uuccaauucaacagccug

SEQ ID NO: 1064835 - RNA, 28 nt, Human
uucccuaaguucaucaccaacaugaaua

SEQ ID NO: 1064836 - RNA, 25 nt, Human
uuccuggcuauccacauguggcugc

SEQ ID NO: 1064837 - RNA, 18 nt, Human
uuuacugagucuuccuca

SEQ ID NO: 1064838 - RNA, 21 nt, Human
uuugauaaaccuugccuucuu

SEQ ID NO: 1064839 - RNA, 21 nt, Human
acaccgaggccugaggccucc

SEQ ID NO: 1064840 - RNA, 22 nt, Human
agauagccgacauguuugaagc

SEQ ID NO: 1064841 - RNA, 24 nt, Human
agccgacauguuugaagcagcccu

SEQ ID NO: 1064842 - RNA, 24 nt, Human
augucucuguuaagccuccagaca

SEQ ID NO: 1064843 - RNA, 18 nt, Human
caaucuguccauccacuc

SEQ ID NO: 1064844 - RNA, 22 nt, Human
cacacaucacuuaagagacaga

SEQ ID NO: 1064845 - RNA, 18 nt, Human
caccggaagaugcuggac

SEQ ID NO: 1064846 - RNA, 21 nt, Human
cacuuaagagacagaaagaaa

SEQ ID NO: 1064847 - RNA, 21 nt, Human
cagcacgggggcccaccucuu

SEQ ID NO: 1064848 - RNA, 20 nt, Human
ccaggaggcuacagcucagc

SEQ ID NO: 1064849 - RNA, 22 nt, Human
cccacuauccagcacgggggcc

SEQ ID NO: 1064850 - RNA, 19 nt, Human
ccuccagacaugcagcuca

SEQ ID NO: 1064851 - RNA, 23 nt, Human
ccuccaggucaccaucaaacucu

SEQ ID NO: 1064852 - RNA, 23 nt, Human
cuuaaagcugagggcaaucuguc

SEQ ID NO: 1064853 - RNA, 20 nt, Human
cuuaagagacagaaagaaac

SEQ ID NO: 1064854 - RNA, 24 nt, Human
cuucuccaguccaccaggaggcua

SEQ ID NO: 1064855 - RNA, 25 nt, Human
gucaccaucaaacucagcauucaga

SEQ ID NO: 1064856 - RNA, 20 nt, Human
uaagacagaucauccugaac

SEQ ID NO: 1064857 - RNA, 20 nt, Human
uaagccuccagacaugcagc

SEQ ID NO: 1064858 - RNA, 21 nt, Human
uacagcucagcucucaggacc

SEQ ID NO: 1064859 - RNA, 23 nt, Human
uagcaacagagccuagugcagag

SEQ ID NO: 1064860 - RNA, 25 nt, Human
uccacagagcaucgaucuuaagaca

SEQ ID NO: 1064861 - RNA, 19 nt, Human
ugaacugcccuuaaagcug

SEQ ID NO: 1064862 - RNA, 18 nt, Human
ugcccauuggauguagga

SEQ ID NO: 1064863 - RNA, 21 nt, Human
auugcugcccagcccacacca

SEQ ID NO: 1064864 - RNA, 23 nt, Human
caagugaauugcugcccagccca

SEQ ID NO: 1064865 - RNA, 21 nt, Human
cagccgccucuccacacccgg

SEQ ID NO: 1064866 - RNA, 23 nt, Human
ccuccaaggacagccgccucucc

SEQ ID NO: 1064867 - RNA, 22 nt, Human
cuccaaggacagccgccucucc

SEQ ID NO: 1064868 - RNA, 23 nt, Human
cuccacacccgggcuguuucucc

SEQ ID NO: 1064869 - RNA, 24 nt, Human
cuccuuagaaaggaucccuccaag

SEQ ID NO: 1064870 - RNA, 23 nt, Human
uccuuagaaaggaucccuccaag

SEQ ID NO: 1064871 - RNA, 18 nt, Human
ugaauugcugcccagccc

SEQ ID NO: 1064872 - RNA, 18 nt, Human
uguuagagaaucagauag

SEQ ID NO: 1064873 - RNA, 22 nt, Human
uucuccuucaagugaauugcug

SEQ ID NO: 1064874 - RNA, 24 nt, Human
aacugguuuggccacccagaagcu

SEQ ID NO: 1064875 - RNA, 21 nt, Human
aaguuccccgggguucuucuc

SEQ ID NO: 1064876 - RNA, 21 nt, Human
agaagucuuuggcugcaagag

SEQ ID NO: 1064877 - RNA, 21 nt, Human
cacccagaagcuugcagaagu

SEQ ID NO: 1064878 - RNA, 19 nt, Human
caggaacaaguuugucauc

SEQ ID NO: 1064879 - RNA, 22 nt, Human
caggauccaggggauuaauguc

SEQ ID NO: 1064880 - RNA, 19 nt, Human
cauucuccaggauccaggg

SEQ ID NO: 1064881 - RNA, 21 nt, Human
ccauuccauaagugcuuugcc

SEQ ID NO: 1064882 - RNA, 22 nt, Human
ccuugugcugggcaaguucccc

SEQ ID NO: 1064883 - RNA, 23 nt, Human
guaccucuuuggguugcagaaga

SEQ ID NO: 1064884 - RNA, 24 nt, Human
guaccucuuuggguugcagaagag

SEQ ID NO: 1064885 - RNA, 23 nt, Human
guucucauagucaaagguuccau

SEQ ID NO: 1064886 - RNA, 22 nt, Human
uaagucucccaaauaucgccca

SEQ ID NO: 1064887 - RNA, 19 nt, Human
uaauuccuucuucaaugau

SEQ ID NO: 1064888 - RNA, 23 nt, Human
ucccaugccauacguaaacuuca

SEQ ID NO: 1064889 - RNA, 19 nt, Human
ugcagaagagagcacuuug

SEQ ID NO: 1064890 - RNA, 22 nt, Human
uucacuaccaaaaucaaacacc

SEQ ID NO: 1064891 - RNA, 25 nt, Human
uucccaugccauacguaaacuucac

SEQ ID NO: 1064892 - RNA, 19 nt, Human
uuucaguucuguccaaucc

SEQ ID NO: 1064893 - RNA, 22 nt, Human
uuuuucguugugcuaacgugac

SEQ ID NO: 1064894 - RNA, 19 nt, Human
aacgucccucaaacaaucu

SEQ ID NO: 1064895 - RNA, 22 nt, Human
aagcagccggcgaaguuguagc

SEQ ID NO: 1064896 - RNA, 26 nt, Human
aagcggauuucuucuugcacaagucc

SEQ ID NO: 1064897 - RNA, 24 nt, Human
aaguccugcacugguuacaccacc

SEQ ID NO: 1064898 - RNA, 20 nt, Human
acaagcgagguggcgcugcc

SEQ ID NO: 1064899 - RNA, 18 nt, Human
acaccaccuccaacaaaa

SEQ ID NO: 1064900 - RNA, 24 nt, Human
caaggguuuuucacaucuuuccca

SEQ ID NO: 1064901 - RNA, 23 nt, Human
cacaaguccugcacugguuacac

SEQ ID NO: 1064902 - RNA, 19 nt, Human
caccaccuccaacaaaaug

SEQ ID NO: 1064903 - RNA, 24 nt, Human
caccaccuccaacaaaaugauuug

SEQ ID NO: 1064904 - RNA, 18 nt, Human
caccauucccucucugcc

SEQ ID NO: 1064905 - RNA, 18 nt, Human
cacugguuacaccaccuc

SEQ ID NO: 1064906 - RNA, 18 nt, Human
cagcgccugccugcacca

SEQ ID NO: 1064907 - RNA, 18 nt, Human
caugcugggaccagcagc

SEQ ID NO: 1064908 - RNA, 21 nt, Human
ccaccuccaacaaaaugauuu

SEQ ID NO: 1064909 - RNA, 24 nt, Human
ccaccuguagcaugccucggccau

SEQ ID NO: 1064910 - RNA, 25 nt, Human
ccaguagguuuuuucucugugacuc

SEQ ID NO: 1064911 - RNA, 19 nt, Human
ccccgggcggagagccuca

SEQ ID NO: 1064912 - RNA, 18 nt, Human
ccgccggccucccaaguc

SEQ ID NO: 1064913 - RNA, 21 nt, Human
ccggccccgggcggagagccu

SEQ ID NO: 1064914 - RNA, 23 nt, Human
ccugccugcaccauucccucucu

SEQ ID NO: 1064915 - RNA, 18 nt, Human
cgccugccugcaccauuc

SEQ ID NO: 1064916 - RNA, 27 nt, Human
cucucugccgcugccugcuucugcaau

SEQ ID NO: 1064917 - RNA, 26 nt, Human
cugccugcugggaaagcuccgggcgu

SEQ ID NO: 1064918 - RNA, 22 nt, Human
cuggcgaggacggugggacccu

SEQ ID NO: 1064919 - RNA, 19 nt, Human
cugucccgccugcccuggg

SEQ ID NO: 1064920 - RNA, 18 nt, Human
gcccugggacgcaggcug

SEQ ID NO: 1064921 - RNA, 20 nt, Human
gcguccgaagcagccggcga

SEQ ID NO: 1064922 - RNA, 19 nt, Human
guccgaagcagccggcgaa

SEQ ID NO: 1064923 - RNA, 28 nt, Human
uaaccugagagagauggacugcgcgucc

SEQ ID NO: 1064924 - RNA, 18 nt, Human
uacaccaccuccaacaaa

SEQ ID NO: 1064925 - RNA, 20 nt, Human
uacaccaccuccaacaaaau

SEQ ID NO: 1064926 - RNA, 23 nt, Human
uagacauucauugugauccagca

SEQ ID NO: 1064927 - RNA, 22 nt, Human
uagcaugccucggccauuuucu

SEQ ID NO: 1064928 - RNA, 19 nt, Human
ucaaggguuuuucacaucu

SEQ ID NO: 1064929 - RNA, 20 nt, Human
ucaaggguuuuucacaucuu

SEQ ID NO: 1064930 - RNA, 26 nt, Human
ucacaucuuucccauucuggaaaauc

SEQ ID NO: 1064931 - RNA, 26 nt, Human
ucccaagucaggccguaaacacucgc

SEQ ID NO: 1064932 - RNA, 23 nt, Human
ucccucucugccgcugccugcua

SEQ ID NO: 1064933 - RNA, 22 nt, Human
ucugccugcugggaaagcuccg

SEQ ID NO: 1064934 - RNA, 18 nt, Human
ucuugauuccuucagugu

SEQ ID NO: 1064935 - RNA, 19 nt, Human
ugaaaacaagcgagguggc

SEQ ID NO: 1064936 - RNA, 23 nt, Human
ugaaaacaagcgagguggcgcug

SEQ ID NO: 1064937 - RNA, 18 nt, Human
ugagagagauggacugcg

SEQ ID NO: 1064938 - RNA, 19 nt, Human
ugauuugcaaaauccaccu

SEQ ID NO: 1064939 - RNA, 20 nt, Human
uggcgcugccucugugcugu

SEQ ID NO: 1064940 - RNA, 23 nt, Human
ugggacgcaggcuggcgaggacg

SEQ ID NO: 1064941 - RNA, 23 nt, Human
ugucuugauuccuucagugucca

SEQ ID NO: 1064942 - RNA, 21 nt, Human
uuacaccaccuccaacaaaau

SEQ ID NO: 1064943 - RNA, 20 nt, Human
uucucugugacucuucuaaa

SEQ ID NO: 1064944 - RNA, 19 nt, Human
uuuacuauccaaacucugu

SEQ ID NO: 1064945 - RNA, 21 nt, Human
uuucccauucuggaaaaucuu

SEQ ID NO: 1064946 - RNA, 26 nt, Human
uuucccauucuggaaaaucuucaaga

SEQ ID NO: 1064947 - RNA, 23 nt, Human
aagcaggagcuggacccgcagag

SEQ ID NO: 1064948 - RNA, 19 nt, Human
aaguagcuaggcucuuuug

SEQ ID NO: 1064949 - RNA, 22 nt, Human
acacggaggucuacuuccccca

SEQ ID NO: 1064950 - RNA, 25 nt, Human
acagugacccuaacaucuacuuccu

SEQ ID NO: 1064951 - RNA, 24 nt, Human
agaacagccagccugguggccagg

SEQ ID NO: 1064952 - RNA, 19 nt, Human
agagguucagggaggaguu

SEQ ID NO: 1064953 - RNA, 18 nt, Human
agccugguggccaggcug

SEQ ID NO: 1064954 - RNA, 21 nt, Human
agcuuaagcuggagucacugc

SEQ ID NO: 1064955 - RNA, 24 nt, Human
aggaccacuugagcccgagaauuu

SEQ ID NO: 1064956 - RNA, 19 nt, Human
aggaggaggaggccuggcu

SEQ ID NO: 1064957 - RNA, 22 nt, Human
aggaggaggaggccuggcugca

SEQ ID NO: 1064958 - RNA, 19 nt, Human
aggcaaaugccagcaacag

SEQ ID NO: 1064959 - RNA, 20 nt, Human
aggcugagguuagggauuug

SEQ ID NO: 1064960 - RNA, 18 nt, Human
aggcugcagaucaucagc

SEQ ID NO: 1064961 - RNA, 24 nt, Human
agguacggugucucacgccauuaa

SEQ ID NO: 1064962 - RNA, 23 nt, Human
aguccuagcuacuccuaaguagc

SEQ ID NO: 1064963 - RNA, 20 nt, Human
agugagcucugaucaacugc

SEQ ID NO: 1064964 - RNA, 18 nt, Human
caaccaugccaccacccc

SEQ ID NO: 1064965 - RNA, 24 nt, Human
caacugcugcacuccagccugggu

SEQ ID NO: 1064966 - RNA, 24 nt, Human
caagaacagcucgcccugccaagg

SEQ ID NO: 1064967 - RNA, 19 nt, Human
caagaagccucuguauggc

SEQ ID NO: 1064968 - RNA, 24 nt, Human
caagcaacagaaugggaaaugaaa

SEQ ID NO: 1064969 - RNA, 21 nt, Human
caagccccccacgcaacaacu

SEQ ID NO: 1064970 - RNA, 24 nt, Human
caccaacagugacccuaacaucua

SEQ ID NO: 1064971 - RNA, 24 nt, Human
cacgccauuaaucccagcacuuug

SEQ ID NO: 1064972 - RNA, 20 nt, Human
cacuccagccugggugacag

SEQ ID NO: 1064973 - RNA, 22 nt, Human
cacuccagccugggugacagag

SEQ ID NO: 1064974 - RNA, 22 nt, Human
cacuccagccugggugacagag

SEQ ID NO: 1064975 - RNA, 22 nt, Human
cagcaaaguggaccugcucucc

SEQ ID NO: 1064976 - RNA, 22 nt, Human
cagcaauggccagccagacucc

SEQ ID NO: 1064977 - RNA, 22 nt, Human
cagcaccaucgccucagaccac

SEQ ID NO: 1064978 - RNA, 19 nt, Human
cagcacuuugggaggacca

SEQ ID NO: 1064979 - RNA, 23 nt, Human
cagcacuuugggaggaccacuug

SEQ ID NO: 1064980 - RNA, 23 nt, Human
cagccaccaacagugacccuaac

SEQ ID NO: 1064981 - RNA, 23 nt, Human
cagccagccugguggccaggcug

SEQ ID NO: 1064982 - RNA, 22 nt, Human
cagccgacccccaccaccccag

SEQ ID NO: 1064983 - RNA, 19 nt, Human
caggccgagugcuugcccc

SEQ ID NO: 1064984 - RNA, 20 nt, Human
cagugcgcucucccuaccuu

SEQ ID NO: 1064985 - RNA, 30 nt, Human
cauggagaagaagaacccucccucaauucc

SEQ ID NO: 1064986 - RNA, 22 nt, Human
caugguggccguggccuguagu

SEQ ID NO: 1064987 - RNA, 26 nt, Human
ccacuacagcaagcugggugagcagg

SEQ ID NO: 1064988 - RNA, 22 nt, Human
cccacaugcaggaggaggaggc

SEQ ID NO: 1064989 - RNA, 26 nt, Human
ccccaccaccccauagcagcucacgg

SEQ ID NO: 1064990 - RNA, 23 nt, Human
cccccaccaccccauagcagcuc

SEQ ID NO: 1064991 - RNA, 22 nt, Human
ccccgcaaccaugccaccaccc

SEQ ID NO: 1064992 - RNA, 24 nt, Human
ccccggccacuuccuggaccacaa

SEQ ID NO: 1064993 - RNA, 23 nt, Human
cccgcaaccaugccaccaccccu

SEQ ID NO: 1064994 - RNA, 26 nt, Human
cccgcaaccaugccaccaccccuuac

SEQ ID NO: 1064995 - RNA, 22 nt, Human
cccgcagaggcugcagaucauc

SEQ ID NO: 1064996 - RNA, 18 nt, Human
cccuaccugcuguccgac

SEQ ID NO: 1064997 - RNA, 22 nt, Human
ccgcaaccaugccaccaccccu

SEQ ID NO: 1064998 - RNA, 22 nt, Human
ccucaaggacucagcuggucag

SEQ ID NO: 1064999 - RNA, 23 nt, Human
ccucugccucuacaaaaaauuua

SEQ ID NO: 1065000 - RNA, 20 nt, Human
ccucuguauggcaucuugca

SEQ ID NO: 1065001 - RNA, 18 nt, Human
ccugcagcuuugaggcca

SEQ ID NO: 1065002 - RNA, 20 nt, Human
ccuguaguccuagcuacucc

SEQ ID NO: 1065003 - RNA, 20 nt, Human
cgaaggcaagccccccacgc

SEQ ID NO: 1065004 - RNA, 22 nt, Human
cgacaagcuccagggccugggg

SEQ ID NO: 1065005 - RNA, 23 nt, Human
cguccaacaggucccagcugcac

SEQ ID NO: 1065006 - RNA, 22 nt, Human
cucacgccauuaaucccagcac

SEQ ID NO: 1065007 - RNA, 24 nt, Human
cucacgccauuaaucccagcacuu

SEQ ID NO: 1065008 - RNA, 20 nt, Human
cuccaaaaaaaauugaugua

SEQ ID NO: 1065009 - RNA, 18 nt, Human
cugcacuccagccugggu

SEQ ID NO: 1065010 - RNA, 20 nt, Human
cugcacuccagccuggguga

SEQ ID NO: 1065011 - RNA, 21 nt, Human
cugcacuccagccugggugac

SEQ ID NO: 1065012 - RNA, 22 nt, Human
cugcacuccagccugggugaca

SEQ ID NO: 1065013 - RNA, 23 nt, Human
cugcacuccagccugggugacag

SEQ ID NO: 1065014 - RNA, 25 nt, Human
cugcacuccagccugggugacagag

SEQ ID NO: 1065015 - RNA, 25 nt, Human
cugccagcuugaggcugagcagugg

SEQ ID NO: 1065016 - RNA, 20 nt, Human
cugcugcacuccagccuggg

SEQ ID NO: 1065017 - RNA, 21 nt, Human
cugcugcacuccagccugggu

SEQ ID NO: 1065018 - RNA, 24 nt, Human
cugcugcacuccagccugggugac

SEQ ID NO: 1065019 - RNA, 23 nt, Human
cugcuggugcagcucuuccccaa

SEQ ID NO: 1065020 - RNA, 19 nt, Human
cuggcugcuggugcagcuc

SEQ ID NO: 1065021 - RNA, 18 nt, Human
cugugugacaggccgagu

SEQ ID NO: 1065022 - RNA, 21 nt, Human
cuucccccacaugcaggagga

SEQ ID NO: 1065023 - RNA, 24 nt, Human
gaaaaaaaaaaaaaauauggccag

SEQ ID NO: 1065024 - RNA, 20 nt, Human
gacaagcuccagggccuggg

SEQ ID NO: 1065025 - RNA, 24 nt, Human
gaccacuugagcccgagaauuuga

SEQ ID NO: 1065026 - RNA, 18 nt, Human
gacggcggcaagcaggag

SEQ ID NO: 1065027 - RNA, 24 nt, Human
gacuguggcagcacuggggcagcc

SEQ ID NO: 1065028 - RNA, 22 nt, Human
gagaagaagaacccucccucag

SEQ ID NO: 1065029 - RNA, 23 nt, Human
gagucagaaccaucuccaaaaaa

SEQ ID NO: 1065030 - RNA, 22 nt, Human
gagugaaaaggcaagcaacaga

SEQ ID NO: 1065031 - RNA, 24 nt, Human
gaucaacugcugcacuccagccug

SEQ ID NO: 1065032 - RNA, 20 nt, Human
gcaagccccccacgcaacaa

SEQ ID NO: 1065033 - RNA, 24 nt, Human
gcacuccagccugggugacagagu

SEQ ID NO: 1065034 - RNA, 19 nt, Human
gcagcacuggggcagccac

SEQ ID NO: 1065035 - RNA, 24 nt, Human
gcagcucauccacaacuacaugga

SEQ ID NO: 1065036 - RNA, 21 nt, Human
gcaggagcuggacccgcagag

SEQ ID NO: 1065037 - RNA, 21 nt, Human
gccaccaacagugacccuaac

SEQ ID NO: 1065038 - RNA, 18 nt, Human
gccuguaguccuagcuac

SEQ ID NO: 1065039 - RNA, 21 nt, Human
gcucaacacgcucacguccaa

SEQ ID NO: 1065040 - RNA, 21 nt, Human
gcuggcugcuggugcagcucu

SEQ ID NO: 1065041 - RNA, 20 nt, Human
ggacuucugagaagcacccu

SEQ ID NO: 1065042 - RNA, 18 nt, Human
ggaggaccacuugagccc

SEQ ID NO: 1065043 - RNA, 19 nt, Human
ggaggucaaggaugcagug

SEQ ID NO: 1065044 - RNA, 22 nt, Human
ggcaacuuugccgcggggcucc

SEQ ID NO: 1065045 - RNA, 19 nt, Human
ggccuguaguccuagcuac

SEQ ID NO: 1065046 - RNA, 20 nt, Human
gggcaacuuugccgcggggc

SEQ ID NO: 1065047 - RNA, 18 nt, Human
gggccuggggcuggacgc

SEQ ID NO: 1065048 - RNA, 19 nt, Human
ggguccuggccugcuggcu

SEQ ID NO: 1065049 - RNA, 24 nt, Human
ggugucucacgccauuaaucccag

SEQ ID NO: 1065050 - RNA, 24 nt, Human
gucagaaccaucuccaaaaaaaau

SEQ ID NO: 1065051 - RNA, 24 nt, Human
guggaccugcucucccugaaggug

SEQ ID NO: 1065052 - RNA, 20 nt, Human
guggagaggagguagcugau

SEQ ID NO: 1065053 - RNA, 20 nt, Human
uaaaauaacucacugaguga

SEQ ID NO: 1065054 - RNA, 27 nt, Human
uaaaauaacucacugagugaaaaggcc

SEQ ID NO: 1065055 - RNA, 22 nt, Human
uagauagauagauagauaggua

SEQ ID NO: 1065056 - RNA, 24 nt, Human
uagauagauagauagauagguuag

SEQ ID NO: 1065057 - RNA, 22 nt, Human
uagauagauagauagguaggua

SEQ ID NO: 1065058 - RNA, 22 nt, Human
uagauagauagguagguagaua

SEQ ID NO: 1065059 - RNA, 18 nt, Human
ucaacugcugcacuccag

SEQ ID NO: 1065060 - RNA, 24 nt, Human
ucaccuaguuccuggaugaagccu

SEQ ID NO: 1065061 - RNA, 23 nt, Human
ucagccacagucaacuucuccca

SEQ ID NO: 1065062 - RNA, 18 nt, Human
ucagggaggaguuugagg

SEQ ID NO: 1065063 - RNA, 22 nt, Human
ucaggugggguccuggccugcu

SEQ ID NO: 1065064 - RNA, 19 nt, Human
ucauggagaagaagaaccc

SEQ ID NO: 1065065 - RNA, 18 nt, Human
uccaaaaaaaauugaugu

SEQ ID NO: 1065066 - RNA, 23 nt, Human
uccacaacuacauggaggucuac

SEQ ID NO: 1065067 - RNA, 23 nt, Human
uccaccgccgagaacuuccggcu

SEQ ID NO: 1065068 - RNA, 21 nt, Human
uccacuacagcaagcugggug

SEQ ID NO: 1065069 - RNA, 18 nt, Human
uccacuggcucuucccug

SEQ ID NO: 1065070 - RNA, 24 nt, Human
uccagccugggugacagagucaga

SEQ ID NO: 1065071 - RNA, 22 nt, Human
uccgugaauuccaggacuucug

SEQ ID NO: 1065072 - RNA, 18 nt, Human
uccgugggcaacuuugcc

SEQ ID NO: 1065073 - RNA, 21 nt, Human
uccuagcaggcauguggaacc

SEQ ID NO: 1065074 - RNA, 21 nt, Human
uccuggaccacaaagaugagg

SEQ ID NO: 1065075 - RNA, 23 nt, Human
uccuggccugcuggcugcuggug

SEQ ID NO: 1065076 - RNA, 19 nt, Human
ucugcaagauccccuugga

SEQ ID NO: 1065077 - RNA, 19 nt, Human
ugacagagucagaaccauc

SEQ ID NO: 1065078 - RNA, 18 nt, Human
ugagaggagcagcaagga

SEQ ID NO: 1065079 - RNA, 18 nt, Human
ugaguuugccgucuuccu

SEQ ID NO: 1065080 - RNA, 20 nt, Human
ugcaaucaauccugagaggu

SEQ ID NO: 1065081 - RNA, 19 nt, Human
ugcaccugcagcucaucca

SEQ ID NO: 1065082 - RNA, 18 nt, Human
ugccccugagaggagcag

SEQ ID NO: 1065083 - RNA, 23 nt, Human
ugcugcacuccagccugggugac

SEQ ID NO: 1065084 - RNA, 24 nt, Human
ugcugcacuccagccugggugaca

SEQ ID NO: 1065085 - RNA, 21 nt, Human
ugcuggugcagcucuucccca

SEQ ID NO: 1065086 - RNA, 24 nt, Human
uggagacagaggccaaagaugcug

SEQ ID NO: 1065087 - RNA, 21 nt, Human
uggccaggcugccagcuugag

SEQ ID NO: 1065088 - RNA, 23 nt, Human
uggccaggcugccagcuugaggc

SEQ ID NO: 1065089 - RNA, 20 nt, Human
ugggguccuggccugcuggc

SEQ ID NO: 1065090 - RNA, 22 nt, Human
ugguggccguggccuguagucc

SEQ ID NO: 1065091 - RNA, 22 nt, Human
uguaaucauaaaauaacucacu

SEQ ID NO: 1065092 - RNA, 24 nt, Human
ugucucacgccauuaaucccagca

SEQ ID NO: 1065093 - RNA, 20 nt, Human
uuacugcccucaaggacuca

SEQ ID NO: 1065094 - RNA, 19 nt, Human
uuagccaggcaugguggcc

SEQ ID NO: 1065095 - RNA, 22 nt, Human
uucccugagcucuuccacuaca

SEQ ID NO: 1065096 - RNA, 19 nt, Human
uucuaagaagugagagugg

SEQ ID NO: 1065097 - RNA, 24 nt, Human
uugagggucccccgcugccccuga

SEQ ID NO: 1065098 - RNA, 20 nt, Human
uuugaaaaaaaaaaaaaaua

SEQ ID NO: 1065099 - RNA, 19 nt, Human
uuugcaaacauaaauacaa

SEQ ID NO: 1065100 - RNA, 23 nt, Human
uuuguaaucauaaaauaacucac

SEQ ID NO: 1065101 - RNA, 21 nt, Human
aaaaaaaaaaaauauggccag

SEQ ID NO: 1065102 - RNA, 18 nt, Human
aaaaauagcaaaacacac

SEQ ID NO: 1065103 - RNA, 22 nt, Human
aaaagagaagauacauaagaaa

SEQ ID NO: 1065104 - RNA, 20 nt, Human
aaaaggaaacaaucauaaaa

SEQ ID NO: 1065105 - RNA, 19 nt, Human
aaaaguaacuauugaaggc

SEQ ID NO: 1065106 - RNA, 22 nt, Human
aaacagaauagagagcucauaa

SEQ ID NO: 1065107 - RNA, 24 nt, Human
aaacauugaauuccuaauauaaaa

SEQ ID NO: 1065108 - RNA, 24 nt, Human
aaagacuuuaauauaccuuuuuca

SEQ ID NO: 1065109 - RNA, 23 nt, Human
aaagauauucaacagaaauaaag

SEQ ID NO: 1065110 - RNA, 22 nt, Human
aaaguuacuuugaaaagacuga

SEQ ID NO: 1065111 - RNA, 26 nt, Human
aaaugcaguguauagauaacuuugaa

SEQ ID NO: 1065112 - RNA, 18 nt, Human
aacuauugaaggcuagua

SEQ ID NO: 1065113 - RNA, 22 nt, Human
aagaaaaaauauaaugugaaga

SEQ ID NO: 1065114 - RNA, 20 nt, Human
aagcugcaaaucuauagcaa

SEQ ID NO: 1065115 - RNA, 19 nt, Human
aaguagcuaggcucuuuug

SEQ ID NO: 1065116 - RNA, 21 nt, Human
aaugaaaucagcaaaagccaa

SEQ ID NO: 1065117 - RNA, 20 nt, Human
aaugcaaaugaaaaugcagu

SEQ ID NO: 1065118 - RNA, 25 nt, Human
acagugacccuaacaucuacuuccu

SEQ ID NO: 1065119 - RNA, 25 nt, Human
acugagagaaauuaaagauauucaa

SEQ ID NO: 1065120 - RNA, 21 nt, Human
agaaaaggaaacaaucauaaa

SEQ ID NO: 1065121 - RNA, 22 nt, Human
agaauagagagcucauaaagag

SEQ ID NO: 1065122 - RNA, 24 nt, Human
agaauagagagcucauaaagagaa

SEQ ID NO: 1065123 - RNA, 18 nt, Human
agcauaauuugucugcau

SEQ ID NO: 1065124 - RNA, 18 nt, Human
agcucauaaagagaacca

SEQ ID NO: 1065125 - RNA, 24 nt, Human
aggaccacuugagcccgagaauuu

SEQ ID NO: 1065126 - RNA, 19 nt, Human
aggcaaaugccagcaacag

SEQ ID NO: 1065127 - RNA, 24 nt, Human
agguacggugucucacgccauuaa

SEQ ID NO: 1065128 - RNA, 20 nt, Human
aggugggguccuggccugcu

SEQ ID NO: 1065129 - RNA, 23 nt, Human
aguccuagcuacuccuaaguagc

SEQ ID NO: 1065130 - RNA, 20 nt, Human
agugagcucugaucaacugc

SEQ ID NO: 1065131 - RNA, 18 nt, Human
aguuuuuauaaauguaua

SEQ ID NO: 1065132 - RNA, 22 nt, Human
auaaaaaugaaaguaaaaauac

SEQ ID NO: 1065133 - RNA, 19 nt, Human
augaaacagaauagagagc

SEQ ID NO: 1065134 - RNA, 23 nt, Human
augaauauuaacauccaaccuca

SEQ ID NO: 1065135 - RNA, 19 nt, Human
caaaaauagcaaaacacac

SEQ ID NO: 1065136 - RNA, 18 nt, Human
caaccaugccaccacccc

SEQ ID NO: 1065137 - RNA, 19 nt, Human
caacugaaaaacugacuau

SEQ ID NO: 1065138 - RNA, 24 nt, Human
caacugcugcacuccagccugggu

SEQ ID NO: 1065139 - RNA, 24 nt, Human
caagaacagcucgcccugccaagg

SEQ ID NO: 1065140 - RNA, 19 nt, Human
caagaagccucuguauggc

SEQ ID NO: 1065141 - RNA, 24 nt, Human
caagcaacagaaugggaaaugaaa

SEQ ID NO: 1065142 - RNA, 19 nt, Human
caauaauaacaaggaaauc

SEQ ID NO: 1065143 - RNA, 24 nt, Human
cacaaaaauuauuucauauagaag

SEQ ID NO: 1065144 - RNA, 24 nt, Human
caccaacagugacccuaacaucua

SEQ ID NO: 1065145 - RNA, 23 nt, Human
cacccaaaaauagcaaaacacac

SEQ ID NO: 1065146 - RNA, 24 nt, Human
cacgccauuaaucccagcacuuug

SEQ ID NO: 1065147 - RNA, 22 nt, Human
cacuccagccugggugacagag

SEQ ID NO: 1065148 - RNA, 22 nt, Human
cagcaaaguggaccugcucucc

SEQ ID NO: 1065149 - RNA, 22 nt, Human
cagcaauggccagccagacucc

SEQ ID NO: 1065150 - RNA, 23 nt, Human
cagcacuuugggaggaccacuug

SEQ ID NO: 1065151 - RNA, 25 nt, Human
cagcacuuugggaggaccacuugag

SEQ ID NO: 1065152 - RNA, 23 nt, Human
cagccaccaacagugacccuaac

SEQ ID NO: 1065153 - RNA, 22 nt, Human
cagccgacccccaccaccccag

SEQ ID NO: 1065154 - RNA, 23 nt, Human
cauaaaauaaaugaaaucagcaa

SEQ ID NO: 1065155 - RNA, 18 nt, Human
cauaaagagaaccacaca

SEQ ID NO: 1065156 - RNA, 30 nt, Human; identical to SEQ ID NO: 1064985

SEQ ID NO: 1065157 - RNA, 22 nt, Human
caugguggccguggccuguagu

SEQ ID NO: 1065158 - RNA, 18 nt, Human
ccaaaaauagcaaaacac

SEQ ID NO: 1065159 - RNA, 22 nt, Human
ccaaaaauagcaaaacacacaa

SEQ ID NO: 1065160 - RNA, 22 nt, Human
ccaggaagaaacauugaauucc

SEQ ID NO: 1065161 - RNA, 23 nt, Human
cccaaaaauagcaaaacacacaa

SEQ ID NO: 1065162 - RNA, 26 nt, Human
ccccaccaccccauagcagcucacgg

SEQ ID NO: 1065163 - RNA, 23 nt, Human
cccccaccaccccauagcagcuc

SEQ ID NO: 1065164 - RNA, 23 nt, Human
cccgcaaccaugccaccaccccu

SEQ ID NO: 1065165 - RNA, 26 nt, Human
cccgcaaccaugccaccaccccuuac

SEQ ID NO: 1065166 - RNA, 22 nt, Human
ccgcaaccaugccaccaccccu

SEQ ID NO: 1065167 - RNA, 22 nt, Human
ccucaaggacucagcuggucag

SEQ ID NO: 1065168 - RNA, 23 nt, Human
ccucugccucuacaaaaaauuua

SEQ ID NO: 1065169 - RNA, 20 nt, Human
ccucuguauggcaucuugca

SEQ ID NO: 1065170 - RNA, 18 nt, Human
ccugcagcuuugaggcca

SEQ ID NO: 1065171 - RNA, 20 nt, Human
ccuguaguccuagcuacucc

SEQ ID NO: 1065172 - RNA, 22 nt, Human
cucacgccauuaaucccagcac

SEQ ID NO: 1065173 - RNA, 24 nt, Human
cucacgccauuaaucccagcacuu

SEQ ID NO: 1065174 - RNA, 18 nt, Human
cugaaaaacugacuauaa

SEQ ID NO: 1065175 - RNA, 19 nt, Human
cugauaaaaauauaccaug

SEQ ID NO: 1065176 - RNA, 18 nt, Human
cugcacuccagccugggu

SEQ ID NO: 1065177 - RNA, 20 nt, Human
cugcacuccagccuggguga

SEQ ID NO: 1065178 - RNA, 21 nt, Human
cugcacuccagccugggugac

SEQ ID NO: 1065179 - RNA, 23 nt, Human
cugcacuccagccugggugacag

SEQ ID NO: 1065180 - RNA, 25 nt, Human
cugcacuccagccugggugacagag

SEQ ID NO: 1065181 - RNA, 20 nt, Human
cugcugcacuccagccuggg

SEQ ID NO: 1065182 - RNA, 21 nt, Human
cugcugcacuccagccugggu

SEQ ID NO: 1065183 - RNA, 24 nt, Human
cugcugcacuccagccugggugac

SEQ ID NO: 1065184 - RNA, 23 nt, Human
cugcuggugcagcucuuccccaa

SEQ ID NO: 1065185 - RNA, 19 nt, Human
cuggcugcuggugcagcuc

SEQ ID NO: 1065186 - RNA, 20 nt, Human
cuugaaaauuaauaaucuaa

SEQ ID NO: 1065187 - RNA, 24 nt, Human
gaccacuugagcccgagaauuuga

SEQ ID NO: 1065188 - RNA, 24 nt, Human
gacuguggcagcacuggggcagcc

SEQ ID NO: 1065189 - RNA, 22 nt, Human
gagaagaagaacccucccucag

SEQ ID NO: 1065190 - RNA, 20 nt, Human
gagagaaauuaaagauauuc

SEQ ID NO: 1065191 - RNA, 19 nt, Human
gaggaaaagauucauuuuc

SEQ ID NO: 1065192 - RNA, 23 nt, Human
gagucagaaccaucuccaaaaaa

SEQ ID NO: 1065193 - RNA, 24 nt, Human
gaucaacugcugcacuccagccug

SEQ ID NO: 1065194 - RNA, 24 nt, Human
gcacuccagccugggugacagagu

SEQ ID NO: 1065195 - RNA, 19 nt, Human
gcagcacuggggcagccac

SEQ ID NO: 1065196 - RNA, 23 nt, Human
gcaguguauagauaacuuugaag

SEQ ID NO: 1065197 - RNA, 21 nt, Human
gcucaacacgcucacguccaa

SEQ ID NO: 1065198 - RNA, 24 nt, Human
gcugcacuccagccugggugacag

SEQ ID NO: 1065199 - RNA, 21 nt, Human
gcuggcugcuggugcagcucu

SEQ ID NO: 1065200 - RNA, 23 nt, Human
ggaaaagauucauuuucaauaaa

SEQ ID NO: 1065201 - RNA, 20 nt, Human
ggacuucugagaagcacccu

SEQ ID NO: 1065202 - RNA, 18 nt, Human
ggaggaccacuugagccc

SEQ ID NO: 1065203 - RNA, 19 nt, Human
ggaggucaaggaugcagug

SEQ ID NO: 1065204 - RNA, 19 nt, Human
ggccuguaguccuagcuac

SEQ ID NO: 1065205 - RNA, 19 nt, Human
ggguccuggccugcuggcu

SEQ ID NO: 1065206 - RNA, 24 nt, Human
gucagaaccaucuccaaaaaaaau

SEQ ID NO: 1065207 - RNA, 24 nt, Human
guggaccugcucucccugaaggug

SEQ ID NO: 1065208 - RNA, 24 nt, Human
uaaaaaaagacucaaaaaguaacu

SEQ ID NO: 1065209 - RNA, 27 nt, Human
uaaaauaaaugaaaucagcaaaagcca

SEQ ID NO: 1065210 - RNA, 20 nt, Human
uaaaauaacucacugaguga

SEQ ID NO: 1065211 - RNA, 27 nt, Human
uaaaauaacucacugagugaaaaggcc

SEQ ID NO: 1065212 - RNA, 23 nt, Human
uaacauagcauaugcaaucccuu

SEQ ID NO: 1065213 - RNA, 24 nt, Human
uaacugauagcaaaaaggauacaa

SEQ ID NO: 1065214 - RNA, 19 nt, Human
uaacuuuaagucaaaaauu

SEQ ID NO: 1065215 - RNA, 23 nt, Human
uacaaugaauauuaaaauauauu

SEQ ID NO: 1065216 - RNA, 25 nt, Human
uacaaugaauauuaaaauauauuuu

SEQ ID NO: 1065217 - RNA, 21 nt, Human
uacuuugaaaagacugauaaa

SEQ ID NO: 1065218 - RNA, 22 nt, Human
uagauagauagauagauaggua

SEQ ID NO: 1065219 - RNA, 24 nt, Human
uagauagauagauagauagguuag

SEQ ID NO: 1065220 - RNA, 22 nt, Human
uagauagauagauagguaggua

SEQ ID NO: 1065221 - RNA, 22 nt, Human
uagauagauagguagguagaua

SEQ ID NO: 1065222 - RNA, 21 nt, Human
uauaaaauauaacauagcaua

SEQ ID NO: 1065223 - RNA, 19 nt, Human
uauaaaaugcaaaugaaaa

SEQ ID NO: 1065224 - RNA, 23 nt, Human
uauaaaaugcaaaugaaaaugca

SEQ ID NO: 1065225 - RNA, 19 nt, Human
uauagaagccaauguguac

SEQ ID NO: 1065226 - RNA, 18 nt, Human
ucaacugcugcacuccag

SEQ ID NO: 1065227 - RNA, 19 nt, Human
ucauggagaagaagaaccc

SEQ ID NO: 1065228 - RNA, 18 nt, Human
uccaaaaaaaauugaugu

SEQ ID NO: 1065229 - RNA, 22 nt, Human
uccacaaauucuaaauaucauc

SEQ ID NO: 1065230 - RNA, 24 nt, Human
uccagccugggugacagagucaga

SEQ ID NO: 1065231 - RNA, 21 nt, Human
uccuagcaggcauguggaacc

SEQ ID NO: 1065232 - RNA, 23 nt, Human
uccuggccugcuggcugcuggug

SEQ ID NO: 1065233 - RNA, 21 nt, Human
ucuccaaaaaaaauugaugua

SEQ ID NO: 1065234 - RNA, 27 nt, Human
ugaaauagauacauuucuagaaaauca

SEQ ID NO: 1065235 - RNA, 19 nt, Human
ugacagagucagaaccauc

SEQ ID NO: 1065236 - RNA, 24 nt, Human
ugagaaaaggaaacaaucauaaaa

SEQ ID NO: 1065237 - RNA, 23 nt, Human
ugagugaaaaggcaagcaacaga

SEQ ID NO: 1065238 - RNA, 18 nt, Human
ugauagcaaaaaggauac

SEQ ID NO: 1065239 - RNA, 23 nt, Human
ugcugcacuccagccugggugac

SEQ ID NO: 1065240 - RNA, 24 nt, Human
ugcugcacuccagccugggugaca

SEQ ID NO: 1065241 - RNA, 25 nt, Human
ugcugcacuccagccugggugacag

SEQ ID NO: 1065242 - RNA, 21 nt, Human
ugcuggugcagcucuucccca

SEQ ID NO: 1065243 - RNA, 18 nt, Human
ugcuuguuaaaagauggg

SEQ ID NO: 1065244 - RNA, 20 nt, Human
ugcuuguuuaaaaaauuaaa

SEQ ID NO: 1065245 - RNA, 22 nt, Human
uggaaaaggugcaaguauagau

SEQ ID NO: 1065246 - RNA, 24 nt, Human
uggagacagaggccaaagaugcug

SEQ ID NO: 1065247 - RNA, 20 nt, Human
ugggguccuggccugcuggc

SEQ ID NO: 1065248 - RNA, 22 nt, Human
ugguggccguggccuguagucc

SEQ ID NO: 1065249 - RNA, 22 nt, Human
ugucucacgccauuaaucccag

SEQ ID NO: 1065250 - RNA, 24 nt, Human
ugucucacgccauuaaucccagca

SEQ ID NO: 1065251 - RNA, 24 nt, Human
uguuuagaaauuaagcaucacauu

SEQ ID NO: 1065252 - RNA, 18 nt, Human
uuaaagcuugaaaauuaa

SEQ ID NO: 1065253 - RNA, 26 nt, Human
uuaaauacuuugauauaaaaacugca

SEQ ID NO: 1065254 - RNA, 20 nt, Human
uuacugcccucaaggacuca

SEQ ID NO: 1065255 - RNA, 19 nt, Human
uuagccaggcaugguggcc

SEQ ID NO: 1065256 - RNA, 22 nt, Human
uuaggcaaaccucagcuuggag

SEQ ID NO: 1065257 - RNA, 19 nt, Human
uucuaagaagugagagugg

SEQ ID NO: 1065258 - RNA, 24 nt, Human
uugaauuccuaauauaaaauauaa

SEQ ID NO: 1065259 - RNA, 20 nt, Human
uuugaaaaaaaaaaaaaaua

SEQ ID NO: 1065260 - RNA, 19 nt, Human
uuugcaaacauaaauacaa

SEQ ID NO: 1065261 - RNA, 23 nt, Human
uuuguaaucauaaaauaacucac

SEQ ID NO: 1065262 - RNA, 24 nt, Human
uuuguaaucauaaaauaacucacu

SEQ ID NO: 1065263 - RNA, 23 nt, Human
agacuaacaaauccaccuuggca

SEQ ID NO: 1065264 - RNA, 21 nt, Human
agcaggcuguacagcagcagc

SEQ ID NO: 1065265 - RNA, 20 nt, Human
aggguccuccuggcuggugc

SEQ ID NO: 1065266 - RNA, 20 nt, Human
agguaugcucaaagaucuau

SEQ ID NO: 1065267 - RNA, 22 nt, Human
agucgauggaauggaggaggaa

SEQ ID NO: 1065268 - RNA, 22 nt, Human
aguugcuucuucuuauuucuac

SEQ ID NO: 1065269 - RNA, 26 nt, Human
caccaaggagacugcagucaaauaaa

SEQ ID NO: 1065270 - RNA, 18 nt, Human
caccaccugugccucugc

SEQ ID NO: 1065271 - RNA, 18 nt, Human
caccaccugugccucugc

SEQ ID NO: 1065272 - RNA, 18 nt, Human
cacgacaggucaguaugu

SEQ ID NO: 1065273 - RNA, 22 nt, Human
cacugaacugaggguccuccug

SEQ ID NO: 1065274 - RNA, 22 nt, Human
cgaaaaguacugaaaaugcuau

SEQ ID NO: 1065275 - RNA, 26 nt, Human
cgccucuacugucugccaccaccugu

SEQ ID NO: 1065276 - RNA, 19 nt, Human
cuacugucugccaccaccu

SEQ ID NO: 1065277 - RNA, 24 nt, Human
cucacagcuuuggccacgcacucc

SEQ ID NO: 1065278 - RNA, 19 nt, Human
cucccggucacgaacgugg

SEQ ID NO: 1065279 - RNA, 22 nt, Human
cuccugccauccuguccucagc

SEQ ID NO: 1065280 - RNA, 22 nt, Human
cuggugcugggagucgauggaa

SEQ ID NO: 1065281 - RNA, 20 nt, Human
gacuugggcaauguggccag

SEQ ID NO: 1065282 - RNA, 21 nt, Human
gggcaauguggccaggagggc

SEQ ID NO: 1065283 - RNA, 20 nt, Human
ggguggguguguuggcagug

SEQ ID NO: 1065284 - RNA, 20 nt, Human
ggucagaaaaaucaacauuu

SEQ ID NO: 1065285 - RNA, 19 nt, Human
guacagcagcagccauggg

SEQ ID NO: 1065286 - RNA, 22 nt, Human
gugcacacgacaggucaguaug

SEQ ID NO: 1065287 - RNA, 27 nt, Human
uaaauacauaauacagaagccugugug

SEQ ID NO: 1065288 - RNA, 18 nt, Human
uauuagcugaauuuguga

SEQ ID NO: 1065289 - RNA, 20 nt, Human
uauuucaaauauauuuucac

SEQ ID NO: 1065290 - RNA, 19 nt, Human
uauuuuucccauuuuguuu

SEQ ID NO: 1065291 - RNA, 18 nt, Human
uccauuucuguucuucgu

SEQ ID NO: 1065292 - RNA, 18 nt, Human
uccuaggccgaggcuaug

SEQ ID NO: 1065293 - RNA, 21 nt, Human
uccucagcuccugccuuccuc

SEQ ID NO: 1065294 - RNA, 22 nt, Human
uccuccuggcuggugcugggag

SEQ ID NO: 1065295 - RNA, 22 nt, Human
ugaguuauccuuauuuuuccca

SEQ ID NO: 1065296 - RNA, 24 nt, Human
ugaguuauccuuauuuuucccauu

SEQ ID NO: 1065297 - RNA, 21 nt, Human
ugcaaacgggggugggugugu

SEQ ID NO: 1065298 - RNA, 19 nt, Human
ugccaccaccugugccucu

SEQ ID NO: 1065299 - RNA, 23 nt, Human
ugcugggagucgauggaauggag

SEQ ID NO: 1065300 - RNA, 20 nt, Human
uggaauggaggaggaauagu

SEQ ID NO: 1065301 - RNA, 18 nt, Human
uguccuaggccgaggcua

SEQ ID NO: 1065302 - RNA, 23 nt, Human
ugugauaugaugagguaucucca

SEQ ID NO: 1065303 - RNA, 24 nt, Human
uuagcugaauuugugauuuccuuu

SEQ ID NO: 1065304 - RNA, 24 nt, Human
uuauggucagaaaaaucaacauuu

SEQ ID NO: 1065305 - RNA, 22 nt, Human
uuggcagaaggguuaaacucca

SEQ ID NO: 1065306 - RNA, 22 nt, Human
uuuaaacucccaccuccauuuc

SEQ ID NO: 1065307 - RNA, 18 nt, Human
aagcaggcaaccaucaaa

SEQ ID NO: 1065308 - RNA, 23 nt, Human
aagcaucuaggauuauugggaca

SEQ ID NO: 1065309 - RNA, 19 nt, Human
aggaagcugaggugccagg

SEQ ID NO: 1065310 - RNA, 20 nt, Human
aggagguucccuuccaggag

SEQ ID NO: 1065311 - RNA, 22 nt, Human
agggcuucaggaagggauuggg

SEQ ID NO: 1065312 - RNA, 24 nt, Human
agucagcaggaauccugccucucu

SEQ ID NO: 1065313 - RNA, 19 nt, Human
augcagccuggagaagugg

SEQ ID NO: 1065314 - RNA, 21 nt, Human
augcagccuggagaaguggga

SEQ ID NO: 1065315 - RNA, 18 nt, Human
auggcuauuucaacagaa

SEQ ID NO: 1065316 - RNA, 26 nt, Human
caagcugaagugacauuuacuccccg

SEQ ID NO: 1065317 - RNA, 20 nt, Human
cagcacugcagacaugcaga

SEQ ID NO: 1065318 - RNA, 26 nt, Human
caggagguucccuuccaggaggaccc

SEQ ID NO: 1065319 - RNA, 25 nt, Human
caggcaaccaucaaagcacuuugug

SEQ ID NO: 1065320 - RNA, 19 nt, Human
caggggcugccccaaguuc

SEQ ID NO: 1065321 - RNA, 21 nt, Human
ccccccaacucuggguuccug

SEQ ID NO: 1065322 - RNA, 20 nt, Human
cccccccaacucuggguucc

SEQ ID NO: 1065323 - RNA, 19 nt, Human
cccugcccggcaccccucc

SEQ ID NO: 1065324 - RNA, 19 nt, Human
ccugcccggcaccccucca

SEQ ID NO: 1065325 - RNA, 20 nt, Human
cuuccaggaggacccugccc

SEQ ID NO: 1065326 - RNA, 21 nt, Human
gaggugccaggugucccccug

SEQ ID NO: 1065327 - RNA, 21 nt, Human
gauggcuauuucaacagaaga

SEQ ID NO: 1065328 - RNA, 20 nt, Human
gcaaccaucaaagcacuuug

SEQ ID NO: 1065329 - RNA, 21 nt, Human
ggcaccccuccaugcagccuu

SEQ ID NO: 1065330 - RNA, 23 nt, Human
ggcugcaggagguucccuuccag

SEQ ID NO: 1065331 - RNA, 23 nt, Human
ggugcuugaggcugcaggagguu

SEQ ID NO: 1065332 - RNA, 22 nt, Human
ucccccuggagucagcaggaau

SEQ ID NO: 1065333 - RNA, 18 nt, Human
ucccuuccaggaggaccc

SEQ ID NO: 1065334 - RNA, 18 nt, Human
ucuggguuccugguaugg

SEQ ID NO: 1065335 - RNA, 18 nt, Human
ugacucaagcaggcaacc

SEQ ID NO: 1065336 - RNA, 19 nt, Human
ugccccaaguucgccacac

SEQ ID NO: 1065337 - RNA, 19 nt, Human
ugggagugacucaagcagg

SEQ ID NO: 1065338 - RNA, 25 nt, Human
uggguuccugguaugggguaaguuu

SEQ ID NO: 1065339 - RNA, 24 nt, Human
uggucaaagaacaagacuuccagg

SEQ ID NO: 1065340 - RNA, 23 nt, Human
uuacacagcacugcagacaugca

SEQ ID NO: 1065341 - RNA, 18 nt, Human
uucaggaagggauuggga

SEQ ID NO: 1065342 - RNA, 19 nt, Human
aaacagaaguuuuuuucag

SEQ ID NO: 1065343 - RNA, 19 nt, Human
aaacaggagaaagggaucc

SEQ ID NO: 1065344 - RNA, 21 nt, Human
aaacaggagaaagggauccaa

SEQ ID NO: 1065345 - RNA, 21 nt, Human
aauauccuuuuuucuucuucu

SEQ ID NO: 1065346 - RNA, 18 nt, Human
acaggacggccgccucuc

SEQ ID NO: 1065347 - RNA, 18 nt, Human
acgcggccgcggccgcau

SEQ ID NO: 1065348 - RNA, 24 nt, Human
agaaacaggagaaagggauccaac

SEQ ID NO: 1065349 - RNA, 19 nt, Human
aggagaaagggauccaaca

SEQ ID NO: 1065350 - RNA, 23 nt, Human
caacucgcccucccagauccuua

SEQ ID NO: 1065351 - RNA, 18 nt, Human
cauauuggucagcugaag

SEQ ID NO: 1065352 - RNA, 22 nt, Human
ccggcaccuacaugcugggucc

SEQ ID NO: 1065353 - RNA, 18 nt, Human
ccucugcuuaaacacacu

SEQ ID NO: 1065354 - RNA, 18 nt, Human
ccuuuacuguggauccuc

SEQ ID NO: 1065355 - RNA, 21 nt, Human
cgucacgcggccgcggccgca

SEQ ID NO: 1065356 - RNA, 22 nt, Human
cuucaacucgcccucccagauc

SEQ ID NO: 1065357 - RNA, 20 nt, Human
cuucccggcaaucuuucuga

SEQ ID NO: 1065358 - RNA, 21 nt, Human
gaaauucuucaacucgcccuu

SEQ ID NO: 1065359 - RNA, 21 nt, Human
gaagggugggggaugggcucu

SEQ ID NO: 1065360 - RNA, 19 nt, Human
gacacuugcagaaacagga

SEQ ID NO: 1065361 - RNA, 18 nt, Human
gacuuaaaugaacuucca

SEQ ID NO: 1065362 - RNA, 18 nt, Human
gccuauaaaguuggcuca

SEQ ID NO: 1065363 - RNA, 22 nt, Human
gcuuuuugagucuuccuguucu

SEQ ID NO: 1065364 - RNA, 20 nt, Human
ggaugaggugaagugguuuc

SEQ ID NO: 1065365 - RNA, 20 nt, Human
ggcugggaugaggugaagug

SEQ ID NO: 1065366 - RNA, 18 nt, Human
guccuugauagcuuuuuc

SEQ ID NO: 1065367 - RNA, 25 nt, Human
gugaagugguuucugcaguauuugc

SEQ ID NO: 1065368 - RNA, 23 nt, Human
guugacaggacggccgccucucu

SEQ ID NO: 1065369 - RNA, 18 nt, Human
uaagcccucucaagucau

SEQ ID NO: 1065370 - RNA, 18 nt, Human
uacuguggauccucacgg

SEQ ID NO: 1065371 - RNA, 21 nt, Human
uagaauaauuuauaaaaggca

SEQ ID NO: 1065372 - RNA, 18 nt, Human
ucaaagauggucuguuuu

SEQ ID NO: 1065373 - RNA, 18 nt, Human
ucacgcggccgcggccgc

SEQ ID NO: 1065374 - RNA, 20 nt, Human
ucauggcagucgcccggcac

SEQ ID NO: 1065375 - RNA, 20 nt, Human
ucauuuuugacuuggauucc

SEQ ID NO: 1065376 - RNA, 21 nt, Human
uccggggccggauccggcucc

SEQ ID NO: 1065377 - RNA, 19 nt, Human
uccuguucuuguuuuuugu

SEQ ID NO: 1065378 - RNA, 21 nt, Human
uccuuaauguccuuuugcagu

SEQ ID NO: 1065379 - RNA, 21 nt, Human
uccuuuuuauuugaaauaaga

SEQ ID NO: 1065380 - RNA, 23 nt, Human
ucucuacuuccgcuggcuacgga

SEQ ID NO: 1065381 - RNA, 19 nt, Human
ucuuguuaagcccucucaa

SEQ ID NO: 1065382 - RNA, 22 nt, Human
ugaaaaugcgucacgcggccgc

SEQ ID NO: 1065383 - RNA, 19 nt, Human
ugacagaagguaagucaag

SEQ ID NO: 1065384 - RNA, 20 nt, Human
ugcaagcaacauucacaaua

SEQ ID NO: 1065385 - RNA, 25 nt, Human
ugcaccacuaccaacucuuuugccc

SEQ ID NO: 1065386 - RNA, 23 nt, Human
uggcugggaugaggugaaguggu

SEQ ID NO: 1065387 - RNA, 18 nt, Human
ugggaugaggugaagugg

SEQ ID NO: 1065388 - RNA, 22 nt, Human
uggguccggagaaagggucgcg

SEQ ID NO: 1065389 - RNA, 20 nt, Human
uggugacuuaaaugaacuuc

SEQ ID NO: 1065390 - RNA, 22 nt, Human
uguaaaauaagaccagucacaa

SEQ ID NO: 1065391 - RNA, 19 nt, Human
uuucaguuuccugggucuc

SEQ ID NO: 1065392 - RNA, 19 nt, Human
uuuccugggucucuuuaua

SEQ ID NO: 1065393 - RNA, 21 nt, Human
uuugcagauucuggacuuggu

SEQ ID NO: 1065394 - RNA, 21 nt, Human
uuuggauucuuaguuuaaccu

SEQ ID NO: 1065395 - RNA, 19 nt, Human
uuuggauuuuucuggccug

SEQ ID NO: 1065396 - RNA, 20 nt, Human
uuuguucaauguaguaucua

SEQ ID NO: 1065397 - RNA, 22 nt, Human
uuuuucagauauggugacagaa

SEQ ID NO: 1065398 - RNA, 22 nt, Human
uuuuucuucuucucuuucaacu

SEQ ID NO: 1065399 - RNA, 23 nt, Human
agcaggggccggaaccaccuucu

SEQ ID NO: 1065400 - RNA, 19 nt, Human
cagcaggggccggaaccac

SEQ ID NO: 1065401 - RNA, 18 nt, Human
gggccggaaccaccuucu

SEQ ID NO: 1065402 - RNA, 18 nt, Human
uguacagaaaacucaaca

SEQ ID NO: 1065403 - RNA, 24 nt, Human
aaaaaaaaaagaaauacaaaaauu

SEQ ID NO: 1065404 - RNA, 23 nt, Human
aaaagaaaaagaaaaaaaaagaa

SEQ ID NO: 1065405 - RNA, 18 nt, Human
aaaauuagcugggcgugg

SEQ ID NO: 1065406 - RNA, 22 nt, Human
aaagaaaaaaaaagaaaaaaaa

SEQ ID NO: 1065407 - RNA, 22 nt, Human
aaaucacccagaaccacagcac

SEQ ID NO: 1065408 - RNA, 19 nt, Human
aacauggugaaacuccauc

SEQ ID NO: 1065409 - RNA, 20 nt, Human
aacauggugaaacuccaucu

SEQ ID NO: 1065410 - RNA, 21 nt, Human
aacauggugaaacuccaucuc

SEQ ID NO: 1065411 - RNA, 19 nt, Human
aagaaaaagaaaaaaaaag

SEQ ID NO: 1065412 - RNA, 27 nt, Human
aaucacccagaaccacagcacauuuga

SEQ ID NO: 1065413 - RNA, 23 nt, Human
aaucauaaagcucugggauggga

SEQ ID NO: 1065414 - RNA, 24 nt, Human
aaucgcuuggaccugggaggugga

SEQ ID NO: 1065415 - RNA, 28 nt, Human
acaaaaaaaaaaaaaagaaauacaaaaa

SEQ ID NO: 1065416 - RNA, 25 nt, Human
acaaaaugaauaauccacagcucau

SEQ ID NO: 1065417 - RNA, 18 nt, Human
acaccccgucuaaggcau

SEQ ID NO: 1065418 - RNA, 23 nt, Human
acagggcaagacucugucucaaa

SEQ ID NO: 1065419 - RNA, 24 nt, Human
acagggcaagacucugucucaaaa

SEQ ID NO: 1065420 - RNA, 24 nt, Human
acccagaaccacagcacauuugau

SEQ ID NO: 1065421 - RNA, 22 nt, Human
accccggaaggugcccccgaga

SEQ ID NO: 1065422 - RNA, 23 nt, Human
acuccacuccagccaggcgacag

SEQ ID NO: 1065423 - RNA, 24 nt, Human
agaaaaagaaaaaaaaagaaaaaa

SEQ ID NO: 1065424 - RNA, 19 nt, Human
agagcuggacuaagaccuu

SEQ ID NO: 1065425 - RNA, 19 nt, Human
agaggaaaggcggccagag

SEQ ID NO: 1065426 - RNA, 23 nt, Human
agcugggcgugguggugugugcc

SEQ ID NO: 1065427 - RNA, 22 nt, Human
aggcaagagaaucgcuuggacc

SEQ ID NO: 1065428 - RNA, 24 nt, Human
aggcaagagaaucgcuuggaccug

SEQ ID NO: 1065429 - RNA, 23 nt, Human
aggccaaagccuaggucagggaa

SEQ ID NO: 1065430 - RNA, 24 nt, Human
aggcugaggcaagagaaucgcuug

SEQ ID NO: 1065431 - RNA, 24 nt, Human
agguggagguugcagugagccaag

SEQ ID NO: 1065432 - RNA, 21 nt, Human
auccuggccaacauggugaaa

SEQ ID NO: 1065433 - RNA, 20 nt, Human
auuugaugucaguuuccccu

SEQ ID NO: 1065434 - RNA, 23 nt, Human
caaaaugaauaauccacagcuca

SEQ ID NO: 1065435 - RNA, 24 nt, Human
caacauggugaaacuccaucucua

SEQ ID NO: 1065436 - RNA, 18 nt, Human
cacccagaaccacagcac

SEQ ID NO: 1065437 - RNA, 21 nt, Human
cagaucacagagcuggacuaa

SEQ ID NO: 1065438 - RNA, 20 nt, Human
caucccagggaacagaagau

SEQ ID NO: 1065439 - RNA, 19 nt, Human
ccacuccacuccagccagg

SEQ ID NO: 1065440 - RNA, 20 nt, Human
ccacuccacuccagccaggc

SEQ ID NO: 1065441 - RNA, 23 nt, Human
ccacuccacuccagccaggcgac

SEQ ID NO: 1065442 - RNA, 27 nt, Human
ccaucucuacaaaaaaaaaaaaaagaa

SEQ ID NO: 1065443 - RNA, 21 nt, Human
cccagggaacagaagaugcgg

SEQ ID NO: 1065444 - RNA, 23 nt, Human
ccccggaaggugcccccgagagc

SEQ ID NO: 1065445 - RNA, 26 nt, Human
ccccggaaggugcccccgagagcaga

SEQ ID NO: 1065446 - RNA, 19 nt, Human
cccggaaggugcccccgag

SEQ ID NO: 1065447 - RNA, 20 nt, Human
ccucgaggggcagcgagggg

SEQ ID NO: 1065448 - RNA, 20 nt, Human
ccuggccaacauggugaaac

SEQ ID NO: 1065449 - RNA, 23 nt, Human
ccuggccaacauggugaaacucc

SEQ ID NO: 1065450 - RNA, 24 nt, Human
ccuggccaacauggugaaacucca

SEQ ID NO: 1065451 - RNA, 21 nt, Human
ccugggagguggagguugcag

SEQ ID NO: 1065452 - RNA, 21 nt, Human
ccuguagucccagcuacuugg

SEQ ID NO: 1065453 - RNA, 22 nt, Human
ccuguagucccagcuacuuggg

SEQ ID NO: 1065454 - RNA, 23 nt, Human
ccuuacaugcugucccugccgcc

SEQ ID NO: 1065455 - RNA, 19 nt, Human
ccuucagaucacagagcug

SEQ ID NO: 1065456 - RNA, 24 nt, Human
cgagaccauccuggccaacauggu

SEQ ID NO: 1065457 - RNA, 21 nt, Human
cgcuuggaccugggaggugga

SEQ ID NO: 1065458 - RNA, 19 nt, Human
cuaaaauacugcacacccc

SEQ ID NO: 1065459 - RNA, 21 nt, Human
cuauaaauacuuccaccagca

SEQ ID NO: 1065460 - RNA, 18 nt, Human
cucacgauguaccuaaaa

SEQ ID NO: 1065461 - RNA, 20 nt, Human
cucauuuaaauuccuccuuu

SEQ ID NO: 1065462 - RNA, 21 nt, Human
cucugggaugggaagggaccc

SEQ ID NO: 1065463 - RNA, 19 nt, Human
cucugucucaaaaaaaaaa

SEQ ID NO: 1065464 - RNA, 23 nt, Human
cuggccaacauggugaaacucca

SEQ ID NO: 1065465 - RNA, 21 nt, Human
cugucccugccgcccccuggg

SEQ ID NO: 1065466 - RNA, 23 nt, Human
gagaaucgcuuggaccugggagg

SEQ ID NO: 1065467 - RNA, 23 nt, Human
gaggggccccgcggcuuaggaac

SEQ ID NO: 1065468 - RNA, 18 nt, Human
gagguugcagugagccaa

SEQ ID NO: 1065469 - RNA, 23 nt, Human
gagguugcagugagccaagauug

SEQ ID NO: 1065470 - RNA, 22 nt, Human
gcacauggauggagugcucuug

SEQ ID NO: 1065471 - RNA, 24 nt, Human
gccaacauggugaaacuccaucuc

SEQ ID NO: 1065472 - RNA, 19 nt, Human
gcucuuguucuauuuuuga

SEQ ID NO: 1065473 - RNA, 22 nt, Human
ggagguugcagugagccaagau

SEQ ID NO: 1065474 - RNA, 24 nt, Human
ggagguugcagugagccaagauug

SEQ ID NO: 1065475 - RNA, 18 nt, Human
gggaaugcaggcuccuug

SEQ ID NO: 1065476 - RNA, 24 nt, Human
gggcacgguggcucacaagguuaa

SEQ ID NO: 1065477 - RNA, 19 nt, Human
gguugggcacgguggcuca

SEQ ID NO: 1065478 - RNA, 18 nt, Human
guggugugugccuguagu

SEQ ID NO: 1065479 - RNA, 25 nt, Human
uaaaucacccagaaccacagcacau

SEQ ID NO: 1065480 - RNA, 21 nt, Human
uaauggguuucucccuugauu

SEQ ID NO: 1065481 - RNA, 22 nt, Human
uacagaaucauaaagcucuggg

SEQ ID NO: 1065482 - RNA, 24 nt, Human
uaggguugggcacgguggcucaca

SEQ ID NO: 1065483 - RNA, 25 nt, Human
ucaaaaaaaaaaagaaaaagaaaaa

SEQ ID NO: 1065484 - RNA, 24 nt, Human
ucacaagguuaagagaucgagacc

SEQ ID NO: 1065485 - RNA, 22 nt, Human
ucacgauguaccuaaaauacug

SEQ ID NO: 1065486 - RNA, 23 nt, Human
ucagccuuauuauuuuguuagaa

SEQ ID NO: 1065487 - RNA, 21 nt, Human
ucagugagaaggcuucucauu

SEQ ID NO: 1065488 - RNA, 23 nt, Human
uccgcacauggauggagugcucu

SEQ ID NO: 1065489 - RNA, 24 nt, Human
ucgcuuggaccugggagguggagg

SEQ ID NO: 1065490 - RNA, 23 nt, Human
ucuacaaaaaaaaaaaaaagaaa

SEQ ID NO: 1065491 - RNA, 26 nt, Human
ucucaaaaaaaaaaagaaaaagaaaa

SEQ ID NO: 1065492 - RNA, 21 nt, Human
ucucuacaaaaaaaaaaaaaa

SEQ ID NO: 1065493 - RNA, 19 nt, Human
ucugucucaaaaaaaaaaa

SEQ ID NO: 1065494 - RNA, 24 nt, Human
ucugucucaaaaaaaaaaagaaaa

SEQ ID NO: 1065495 - RNA, 21 nt, Human
ucuuaugggacaaaaugaaua

SEQ ID NO: 1065496 - RNA, 23 nt, Human
ugaauaauccacagcucauuuaa

SEQ ID NO: 1065497 - RNA, 21 nt, Human
ugagaaggcuucucauugaag

SEQ ID NO: 1065498 - RNA, 19 nt, Human
ugagccaagauugugccac

SEQ ID NO: 1065499 - RNA, 20 nt, Human
ugaggcaagagaaucgcuug

SEQ ID NO: 1065500 - RNA, 24 nt, Human
ugaggcaagagaaucgcuuggacc

SEQ ID NO: 1065501 - RNA, 25 nt, Human
ugaggcaagagaaucgcuuggaccu

SEQ ID NO: 1065502 - RNA, 19 nt, Human
ugccaaguacucaugcacu

SEQ ID NO: 1065503 - RNA, 23 nt, Human
ugccuguagucccagcuacuugg

SEQ ID NO: 1065504 - RNA, 24 nt, Human
ugccuguagucccagcuacuuggg

SEQ ID NO: 1065505 - RNA, 24 nt, Human
uggaccugggagguggagguugca

SEQ ID NO: 1065506 - RNA, 18 nt, Human
uggacuaagaccuuacau

SEQ ID NO: 1065507 - RNA, 24 nt, Human
uggccaacauggugaaacuccauc

SEQ ID NO: 1065508 - RNA, 20 nt, Human
ugggaggcugaggcaagaga

SEQ ID NO: 1065509 - RNA, 23 nt, Human
ugggaggcugaggcaagagaauc

SEQ ID NO: 1065510 - RNA, 18 nt, Human
ugggagguggagguugca

SEQ ID NO: 1065511 - RNA, 29 nt, Human
ugggagguggagguugcagugacaacggu

SEQ ID NO: 1065512 - RNA, 24 nt, Human
ugggagguggagguugcagugagc

SEQ ID NO: 1065513 - RNA, 18 nt, Human
ugggaugggaagggacca

SEQ ID NO: 1065514 - RNA, 19 nt, Human
ugggaugggaagggaccag

SEQ ID NO: 1065515 - RNA, 24 nt, Human
ugguggugugugccuguaguccca

SEQ ID NO: 1065516 - RNA, 18 nt, Human
uggugugugccuguaguc

SEQ ID NO: 1065517 - RNA, 24 nt, Human
uggugugugccuguagucccagcu

SEQ ID NO: 1065518 - RNA, 19 nt, Human
uguaggucucagugaccuu

SEQ ID NO: 1065519 - RNA, 23 nt, Human
uuacaugcugucccugccgcccc

SEQ ID NO: 1065520 - RNA, 22 nt, Human
uuagcugggcgugguggugugu

SEQ ID NO: 1065521 - RNA, 24 nt, Human
uuagcugggcgugguggugugugc

SEQ ID NO: 1065522 - RNA, 23 nt, Human
uuccguccagggcagcucuuuca

SEQ ID NO: 1065523 - RNA, 22 nt, Human
uugcagugagccaagauugugc

SEQ ID NO: 1065524 - RNA, 24 nt, Human
uuggaccugggagguggagguugc

SEQ ID NO: 1065525 - RNA, 24 nt, Human
uugggaggcugaggcaagagaauc

SEQ ID NO: 1065526 - RNA, 18 nt, Human
uuguucuauuuuugaggu

SEQ ID NO: 1065527 - RNA, 19 nt, Human
uuucucccuugauuauuac

SEQ ID NO: 1065528 - RNA, 20 nt, Human
uuucucccuugauuauuaca

SEQ ID NO: 1065529 - RNA, 20 nt, Human
uuuuguucaguucauuuuug

SEQ ID NO: 1065530 - RNA, 23 nt, Human
aacagagcagccuacuucaucuc

SEQ ID NO: 1065531 - RNA, 26 nt, Human
aagcaacagaaacucauucuuaaaga

SEQ ID NO: 1065532 - RNA, 20 nt, Human
aaguaggcuucccauccugg

SEQ ID NO: 1065533 - RNA, 19 nt, Human
aagugccccucccugagcu

SEQ ID NO: 1065534 - RNA, 19 nt, Human
aauacagagucacagggga

SEQ ID NO: 1065535 - RNA, 19 nt, Human
aaucaguggcagucugaug

SEQ ID NO: 1065536 - RNA, 18 nt, Human
aaugcauguggcccaggc

SEQ ID NO: 1065537 - RNA, 20 nt, Human
aauuccugcgcucacauccc

SEQ ID NO: 1065538 - RNA, 18 nt, Human
acacacuagggcauaaga

SEQ ID NO: 1065539 - RNA, 18 nt, Human
agaaaaggaaugcaugug

SEQ ID NO: 1065540 - RNA, 21 nt, Human
agaagaagggaggccuggagc

SEQ ID NO: 1065541 - RNA, 23 nt, Human
agaagaagggaggccuggagcug

SEQ ID NO: 1065542 - RNA, 23 nt, Human
agaggcuauguuuacucaacagg

SEQ ID NO: 1065543 - RNA, 18 nt, Human
agcagggcaaggaagaaa

SEQ ID NO: 1065544 - RNA, 20 nt, Human
agccaauuaggaacccucuc

SEQ ID NO: 1065545 - RNA, 21 nt, Human
agccagacauggcuagcugcc

SEQ ID NO: 1065546 - RNA, 23 nt, Human
agcugccuccagcucuagguuca

SEQ ID NO: 1065547 - RNA, 20 nt, Human
aggaacccucucuggacugg

SEQ ID NO: 1065548 - RNA, 29 nt, Human
aggagguggggguagagugggugaggggg

SEQ ID NO: 1065549 - RNA, 22 nt, Human
aggcagcaggucccucaaagcc

SEQ ID NO: 1065550 - RNA, 20 nt, Human
aggcagggcugccugaaggu

SEQ ID NO: 1065551 - RNA, 19 nt, Human
aguaggcuucccauccugg

SEQ ID NO: 1065552 - RNA, 19 nt, Human
aguuugauggcugcaagca

SEQ ID NO: 1065553 - RNA, 26 nt, Human
augcugagcaggguggagaagaaggg

SEQ ID NO: 1065554 - RNA, 28 nt, Human
caagaaaaagcugagcaagcaggucuug

SEQ ID NO: 1065555 - RNA, 22 nt, Human
caccccacacacucucuuaagu

SEQ ID NO: 1065556 - RNA, 19 nt, Human
caccccuuacuucccaaag

SEQ ID NO: 1065557 - RNA, 19 nt, Human
caccuugccccucgccuca

SEQ ID NO: 1065558 - RNA, 21 nt, Human
cagagucacaggggaggcagc

SEQ ID NO: 1065559 - RNA, 22 nt, Human
cagcaggucccucaaagccaag

SEQ ID NO: 1065560 - RNA, 20 nt, Human
cagcagugcuggaaaucagu

SEQ ID NO: 1065561 - RNA, 23 nt, Human
cagccauggaacagcagugcugg

SEQ ID NO: 1065562 - RNA, 25 nt, Human
caggaagcaauaaacagcagugaua

SEQ ID NO: 1065563 - RNA, 18 nt, Human
caggcuuuggagucaggg

SEQ ID NO: 1065564 - RNA, 19 nt, Human
cauccugggucgagcuucc

SEQ ID NO: 1065565 - RNA, 23 nt, Human
ccccauucagaauuuaccccccu

SEQ ID NO: 1065566 - RNA, 19 nt, Human
ccccucccugagcuggaaa

SEQ ID NO: 1065567 - RNA, 22 nt, Human
ccccuguauggcuucucagcuc

SEQ ID NO: 1065568 - RNA, 19 nt, Human
cccucaaagccaaggcucu

SEQ ID NO: 1065569 - RNA, 24 nt, Human
ccuggccgggcgcgguggaaagua

SEQ ID NO: 1065570 - RNA, 19 nt, Human
ccuguggaacccacucagg

SEQ ID NO: 1065571 - RNA, 25 nt, Human
cgccucaugagguauguuguaaccc

SEQ ID NO: 1065572 - RNA, 19 nt, Human
cggccggggcccagcuggu

SEQ ID NO: 1065573 - RNA, 22 nt, Human
cuaguacuuauuauuguuagaa

SEQ ID NO: 1065574 - RNA, 20 nt, Human
cugaaugccugaaaauacaa

SEQ ID NO: 1065575 - RNA, 20 nt, Human
cugggcggccggggcccagc

SEQ ID NO: 1065576 - RNA, 19 nt, Human
cuucccaucccaggucgag

SEQ ID NO: 1065577 - RNA, 20 nt, Human
cuugcccacuaucagacccu

SEQ ID NO: 1065578 - RNA, 23 nt, Human
gaaaagcagagaggucuugaaga

SEQ ID NO: 1065579 - RNA, 19 nt, Human
gaaagucacacagccaugg

SEQ ID NO: 1065580 - RNA, 23 nt, Human
gagaagaagggaggccuggagcu

SEQ ID NO: 1065581 - RNA, 23 nt, Human
gagcuucuccagcuccuucccag

SEQ ID NO: 1065582 - RNA, 25 nt, Human
gaggggaaaugagacggucgaaagu

SEQ ID NO: 1065583 - RNA, 19 nt, Human
gcagaauccagggcucaaa

SEQ ID NO: 1065584 - RNA, 20 nt, Human
gcagaauccagggcucaaag

SEQ ID NO: 1065585 - RNA, 27 nt, Human
gcagugcuggaaaucaguucuguucac

SEQ ID NO: 1065586 - RNA, 18 nt, Human
gccucugucuugggagga

SEQ ID NO: 1065587 - RNA, 20 nt, Human
gcuucaguucagaagccccu

SEQ ID NO: 1065588 - RNA, 21 nt, Human
gcuucaguucagaagccccug

SEQ ID NO: 1065589 - RNA, 20 nt, Human
ggcuuuguggccagcaggcc

SEQ ID NO: 1065590 - RNA, 19 nt, Human
gggaagaagccagguuccu

SEQ ID NO: 1065591 - RNA, 18 nt, Human
gggguagagugggugagg

SEQ ID NO: 1065592 - RNA, 19 nt, Human
gucacaggggaggcagcag

SEQ ID NO: 1065593 - RNA, 18 nt, Human
guggacuuugcugggugu

SEQ ID NO: 1065594 - RNA, 18 nt, Human
uaaaacaaaaucaguggc

SEQ ID NO: 1065595 - RNA, 19 nt, Human
uaaaacagggcuacugaac

SEQ ID NO: 1065596 - RNA, 22 nt, Human
uaagagcacaggcuuuggaguc

SEQ ID NO: 1065597 - RNA, 18 nt, Human
uaaugaggaggugggggu

SEQ ID NO: 1065598 - RNA, 21 nt, Human
uacuagaaagaucuuucuggg

SEQ ID NO: 1065599 - RNA, 18 nt, Human
uagaaagaucuuucuggg

SEQ ID NO: 1065600 - RNA, 22 nt, Human
uagagugggugaggggaagcca

SEQ ID NO: 1065601 - RNA, 22 nt, Human
uaggagcucacagacaugguca

SEQ ID NO: 1065602 - RNA, 20 nt, Human
uaggaucaccccacacacuc

SEQ ID NO: 1065603 - RNA, 18 nt, Human
uauaguuucuguuugcaa

SEQ ID NO: 1065604 - RNA, 20 nt, Human
ucaaagaggcuacacaccuu

SEQ ID NO: 1065605 - RNA, 20 nt, Human
ucacaggggaggcagcaggu

SEQ ID NO: 1065606 - RNA, 22 nt, Human
ucacaggggaggcagcaggucc

SEQ ID NO: 1065607 - RNA, 24 nt, Human
uccaguauauaaaugcagaaucca

SEQ ID NO: 1065608 - RNA, 20 nt, Human
uccaucuccugcaaaaacca

SEQ ID NO: 1065609 - RNA, 19 nt, Human
ucccaaacagagcagccua

SEQ ID NO: 1065610 - RNA, 18 nt, Human
ucccugagcuggaaaggu

SEQ ID NO: 1065611 - RNA, 20 nt, Human
ucccuggagaccuggcucag

SEQ ID NO: 1065612 - RNA, 19 nt, Human
uccuggguggacuuugcug

SEQ ID NO: 1065613 - RNA, 20 nt, Human
uccuguggaacccacucagg

SEQ ID NO: 1065614 - RNA, 21 nt, Human
ucucaaguucaaaugcgucuc

SEQ ID NO: 1065615 - RNA, 19 nt, Human
ucucaggagaggcugaggu

SEQ ID NO: 1065616 - RNA, 23 nt, Human
ucuccagcuccuucccaggggcc

SEQ ID NO: 1065617 - RNA, 20 nt, Human
ucucugggcggccggggccc

SEQ ID NO: 1065618 - RNA, 23 nt, Human
ucucugggcggccggggcccagc

SEQ ID NO: 1065619 - RNA, 24 nt, Human
ucugaggaucuucugugcuuacca

SEQ ID NO: 1065620 - RNA, 20 nt, Human
ucugcugagaacuucucgga

SEQ ID NO: 1065621 - RNA, 18 nt, Human
ucugucuugggaggagcc

SEQ ID NO: 1065622 - RNA, 19 nt, Human
ugaaaagcagagaggucuu

SEQ ID NO: 1065623 - RNA, 23 nt, Human
ugaaauggauaaaacacugcuca

SEQ ID NO: 1065624 - RNA, 20 nt, Human
ugacaaaauaggaaguucaa

SEQ ID NO: 1065625 - RNA, 19 nt, Human
ugacucuaucccuuaauaa

SEQ ID NO: 1065626 - RNA, 18 nt, Human
ugagaaacagaggggaaa

SEQ ID NO: 1065627 - RNA, 21 nt, Human
ugagcaggguggagaagaagg

SEQ ID NO: 1065628 - RNA, 20 nt, Human
ugagcuggaaagguucccua

SEQ ID NO: 1065629 - RNA, 22 nt, Human
ugaggaucuucugugcuuacca

SEQ ID NO: 1065630 - RNA, 20 nt, Human
ugauggagagaggaguccac

SEQ ID NO: 1065631 - RNA, 21 nt, Human
ugauggcugcaagcaacagaa

SEQ ID NO: 1065632 - RNA, 21 nt, Human
ugcagaauccagggcucaaag

SEQ ID NO: 1065633 - RNA, 20 nt, Human
ugcaugaucucugggcggcc

SEQ ID NO: 1065634 - RNA, 24 nt, Human
ugcugcaagguggacuaaucugac

SEQ ID NO: 1065635 - RNA, 24 nt, Human
ugcuugaaaagcagagaggucuug

SEQ ID NO: 1065636 - RNA, 23 nt, Human
uggaaagguucccuacaguucuc

SEQ ID NO: 1065637 - RNA, 18 nt, Human
uggaacagcagugcugga

SEQ ID NO: 1065638 - RNA, 22 nt, Human
uggacuggcgggaagaagccag

SEQ ID NO: 1065639 - RNA, 21 nt, Human
uggagaccuggcucaguauca

SEQ ID NO: 1065640 - RNA, 21 nt, Human
uggagguaguaggagcucaca

SEQ ID NO: 1065641 - RNA, 24 nt, Human
uggcaaguuuuguuuuuauuuuua

SEQ ID NO: 1065642 - RNA, 18 nt, Human
uggcccaggcucugaagg

SEQ ID NO: 1065643 - RNA, 24 nt, Human
uggccgggcgcgguggaaaguaaa

SEQ ID NO: 1065644 - RNA, 25 nt, Human
uggcuucucagcucuuccaucuccu

SEQ ID NO: 1065645 - RNA, 24 nt, Human
uguggcccaggcucugaaggagca

SEQ ID NO: 1065646 - RNA, 21 nt, Human
uguggucuugaucaaguuucu

SEQ ID NO: 1065647 - RNA, 24 nt, Human
uguggucuugaucaaguuucuuaa

SEQ ID NO: 1065648 - RNA, 21 nt, Human
uguguuuccuguggaacccac

SEQ ID NO: 1065649 - RNA, 25 nt, Human
uguucuguaaugaggaggugggggu

SEQ ID NO: 1065650 - RNA, 24 nt, Human
uuaauggaaagccaauuaggaacc

SEQ ID NO: 1065651 - RNA, 22 nt, Human
uucagucucaggugcugcaagg

SEQ ID NO: 1065652 - RNA, 20 nt, Human
uuccacagggguucagcgug

SEQ ID NO: 1065653 - RNA, 25 nt, Human
uuccuggguggacuuugcugggugu

SEQ ID NO: 1065654 - RNA, 21 nt, Human
uugaaggucacuuguucagca

SEQ ID NO: 1065655 - RNA, 19 nt, Human
uugauggcugcaagcaaca

SEQ ID NO: 1065656 - RNA, 21 nt, Human
uuggacaaggagaacauggca

SEQ ID NO: 1065657 - RNA, 19 nt, Human
uuucugggcaggggaagaa

SEQ ID NO: 1065658 - RNA, 21 nt, Human
uuuucaauacuuucugguuuc

SEQ ID NO: 1065659 - RNA, 22 nt, Human
aaagauggagucucgcucuguu

SEQ ID NO: 1065660 - RNA, 24 nt, Human
aaaggcaaguacuuucuguaacuu

SEQ ID NO: 1065661 - RNA, 21 nt, Human
aaaucuaacaaacauauucuc

SEQ ID NO: 1065662 - RNA, 22 nt, Human
aagauucccccaacuugcguau

SEQ ID NO: 1065663 - RNA, 20 nt, Human
aagcugguuuuuuuuuuuuu

SEQ ID NO: 1065664 - RNA, 19 nt, Human
aaguagcugggauuacagg

SEQ ID NO: 1065665 - RNA, 27 nt, Human
aaguagcugggauuacaggcacgagcc

SEQ ID NO: 1065666 - RNA, 24 nt, Human
aagugcugauacacugggggugca

SEQ ID NO: 1065667 - RNA, 20 nt, Human
acagcauucaguggauggaa

SEQ ID NO: 1065668 - RNA, 25 nt, Human
acccgccucggccucccaaagugcu

SEQ ID NO: 1065669 - RNA, 18 nt, Human
acgggguuucaccauguu

SEQ ID NO: 1065670 - RNA, 23 nt, Human
acgggguuucaccauguuggcca

SEQ ID NO: 1065671 - RNA, 24 nt, Human
acgggguuucaccauguuggccag

SEQ ID NO: 1065672 - RNA, 21 nt, Human
acugcacugcagaggaaagua

SEQ ID NO: 1065673 - RNA, 18 nt, Human
agagguuaggaguguuuu

SEQ ID NO: 1065674 - RNA, 23 nt, Human
agccugggcaacauaacaagacc

SEQ ID NO: 1065675 - RNA, 24 nt, Human
agccugggcaacauaacaagaccu

SEQ ID NO: 1065676 - RNA, 22 nt, Human
agcugggauuacaggcacgagc

SEQ ID NO: 1065677 - RNA, 20 nt, Human
aggaguuugagaccagccug

SEQ ID NO: 1065678 - RNA, 20 nt, Human
agguggggucaacuggguuu

SEQ ID NO: 1065679 - RNA, 20 nt, Human
agugcaauggcgcgaucucg

SEQ ID NO: 1065680 - RNA, 24 nt, Human
agugcaauggcgcgaucucggcuc

SEQ ID NO: 1065681 - RNA, 24 nt, Human
agugcuugcacaccuucugaugau

SEQ ID NO: 1065682 - RNA, 19 nt, Human
auagaacaacaaaaacgug

SEQ ID NO: 1065683 - RNA, 21 nt, Human
auagagccuuucuugugaccu

SEQ ID NO: 1065684 - RNA, 18 nt, Human
augcucaugacuuuaaga

SEQ ID NO: 1065685 - RNA, 18 nt, Human
auucuccugccucagccu

SEQ ID NO: 1065686 - RNA, 21 nt, Human
auucuccugccucagccuccc

SEQ ID NO: 1065687 - RNA, 24 nt, Human
caacacauuccugaaauccuggca

SEQ ID NO: 1065688 - RNA, 21 nt, Human
caaccucugacucccugguuc

SEQ ID NO: 1065689 - RNA, 22 nt, Human
caagcuauucuccugccucagc

SEQ ID NO: 1065690 - RNA, 20 nt, Human
caauggcuuuguucucaacu

SEQ ID NO: 1065691 - RNA, 22 nt, Human
cacaccuucugaugauguucaa

SEQ ID NO: 1065692 - RNA, 24 nt, Human
caccaugcccagcuaauuuuugua

SEQ ID NO: 1065693 - RNA, 18 nt, Human
caccauguuggccaggau

SEQ ID NO: 1065694 - RNA, 22 nt, Human
caccauguuggccaggaugguc

SEQ ID NO: 1065695 - RNA, 24 nt, Human
caccauguuggccaggauggucuc

SEQ ID NO: 1065696 - RNA, 23 nt, Human
cacccgccucggccucccaaagu

SEQ ID NO: 1065697 - RNA, 18 nt, Human
cacuguaugacuggagac

SEQ ID NO: 1065698 - RNA, 28 nt, Human
cagcaauaugcucaugacuuuaagaaaa

SEQ ID NO: 1065699 - RNA, 24 nt, Human
cagucuaacucaaagauuccccca

SEQ ID NO: 1065700 - RNA, 24 nt, Human
caguguagacgggguuucaccaug

SEQ ID NO: 1065701 - RNA, 19 nt, Human
ccaaaggaaaaggagggga

SEQ ID NO: 1065702 - RNA, 23 nt, Human
ccaaguagcugggauuacaggca

SEQ ID NO: 1065703 - RNA, 23 nt, Human
cccaaguagcugggauuacaggc

SEQ ID NO: 1065704 - RNA, 24 nt, Human
cccaaguagcugggauuacaggca

SEQ ID NO: 1065705 - RNA, 23 nt, Human
ccugccucagccucccaaguagc

SEQ ID NO: 1065706 - RNA, 24 nt, Human
cgggguuucaccauguuggccagg

SEQ ID NO: 1065707 - RNA, 20 nt, Human
cuaaugucacaucuuccucc

SEQ ID NO: 1065708 - RNA, 22 nt, Human
cucaaagauucccccaacuugc

SEQ ID NO: 1065709 - RNA, 25 nt, Human
cucacugcaaccucugacucccugg

SEQ ID NO: 1065710 - RNA, 21 nt, Human
cucagauuaaccucaaaaggc

SEQ ID NO: 1065711 - RNA, 24 nt, Human
cucagccucccaaguagcugggau

SEQ ID NO: 1065712 - RNA, 23 nt, Human
cucgcucuguugccaagcuggag

SEQ ID NO: 1065713 - RNA, 24 nt, Human
cucuggaccucgugauccacccgc

SEQ ID NO: 1065714 - RNA, 24 nt, Human
cugcaaccucugacucccugguuc

SEQ ID NO: 1065715 - RNA, 23 nt, Human
cugccucagccucccaaguagcu

SEQ ID NO: 1065716 - RNA, 20 nt, Human
cuggaccucgugauccaccc

SEQ ID NO: 1065717 - RNA, 20 nt, Human
cuugcacaccuucugaugau

SEQ ID NO: 1065718 - RNA, 22 nt, Human
gaccucgugauccacccgccuc

SEQ ID NO: 1065719 - RNA, 22 nt, Human
gaccucgugauccacccgccuc

SEQ ID NO: 1065720 - RNA, 24 nt, Human
gaccucgugauccacccgccucgg

SEQ ID NO: 1065721 - RNA, 18 nt, Human
gauuacaggcacgagcca

SEQ ID NO: 1065722 - RNA, 24 nt, Human
gauuacaggcacgagccaccaugc

SEQ ID NO: 1065723 - RNA, 22 nt, Human
gcaaccucugacucccugguuc

SEQ ID NO: 1065724 - RNA, 24 nt, Human
gcaagcugguuuuuuuuuuuuuuu

SEQ ID NO: 1065725 - RNA, 22 nt, Human
gcccagcuaauuuuuguauuuu

SEQ ID NO: 1065726 - RNA, 22 nt, Human
gcccaggaguuugagaccagcc

SEQ ID NO: 1065727 - RNA, 19 nt, Human
gcuggagugcaauggcgcg

SEQ ID NO: 1065728 - RNA, 24 nt, Human
ggauuacaggcacgagccaccaug

SEQ ID NO: 1065729 - RNA, 23 nt, Human
gggguuucaccauguuggccagg

SEQ ID NO: 1065730 - RNA, 24 nt, Human
gguuucaccauguuggccaggaug

SEQ ID NO: 1065731 - RNA, 20 nt, Human
guaaauuuaaaaacacugca

SEQ ID NO: 1065732 - RNA, 19 nt, Human
guagacgggguuucaccau

SEQ ID NO: 1065733 - RNA, 24 nt, Human
gucucgcucuguugccaagcugga

SEQ ID NO: 1065734 - RNA, 24 nt, Human
gugauccacccgccucggccuccc

SEQ ID NO: 1065735 - RNA, 20 nt, Human
uaaaugaucuuuguacuugc

SEQ ID NO: 1065736 - RNA, 30 nt, Human
uaaauuuaaaaacacugcauuuacacucaa

SEQ ID NO: 1065737 - RNA, 20 nt, Human
uaaccucaaaaggcaaguac

SEQ ID NO: 1065738 - RNA, 21 nt, Human
uaagaagugcugauacacugg

SEQ ID NO: 1065739 - RNA, 24 nt, Human
uaauuuuuguauuuucaguguaga

SEQ ID NO: 1065740 - RNA, 24 nt, Human
uacacgcauuuuugcaaaugcucu

SEQ ID NO: 1065741 - RNA, 24 nt, Human
uacaggcacgagccaccaugccca

SEQ ID NO: 1065742 - RNA, 23 nt, Human
uacuuuacuagcccaaccagucu

SEQ ID NO: 1065743 - RNA, 21 nt, Human
uagaauguuuuacauauccuc

SEQ ID NO: 1065744 - RNA, 18 nt, Human
ucaaagauucccccaacu

SEQ ID NO: 1065745 - RNA, 23 nt, Human
ucaauggcuuuguucucaacuag

SEQ ID NO: 1065746 - RNA, 24 nt, Human
ucaccauguuggccaggauggucu

SEQ ID NO: 1065747 - RNA, 19 nt, Human
ucacugcaaccucugacuc

SEQ ID NO: 1065748 - RNA, 24 nt, Human
ucacugcaaccucugacucccugg

SEQ ID NO: 1065749 - RNA, 18 nt, Human
ucagccucccaaguagcu

SEQ ID NO: 1065750 - RNA, 20 nt, Human
ucagccucccaaguagcugg

SEQ ID NO: 1065751 - RNA, 19 nt, Human
ucaguguagacgggguuuc

SEQ ID NO: 1065752 - RNA, 24 nt, Human
ucaguguagacgggguuucaccau

SEQ ID NO: 1065753 - RNA, 20 nt, Human
ucccaaagugcuugcacacc

SEQ ID NO: 1065754 - RNA, 24 nt, Human
ucccaaguagcugggauuacaggc

SEQ ID NO: 1065755 - RNA, 21 nt, Human
ucccugguucaagcuauucuc

SEQ ID NO: 1065756 - RNA, 24 nt, Human
ucccugguucaagcuauucuccug

SEQ ID NO: 1065757 - RNA, 24 nt, Human
ucccuuaggucuaucugaagucua

SEQ ID NO: 1065758 - RNA, 21 nt, Human
ucuaaugucacaucuuccucc

SEQ ID NO: 1065759 - RNA, 26 nt, Human
ucuccugccucagccucccaaguagc

SEQ ID NO: 1065760 - RNA, 23 nt, Human
ucucgcucuguugccaagcugga

SEQ ID NO: 1065761 - RNA, 28 nt, Human
ucucucaacacauuccugaaauccuggg

SEQ ID NO: 1065762 - RNA, 23 nt, Human
ucuguugccaagcuggagugcaa

SEQ ID NO: 1065763 - RNA, 19 nt, Human
ugaacugaaucaaacucuu

SEQ ID NO: 1065764 - RNA, 24 nt, Human
ugacaguaauaauaaaucuaacaa

SEQ ID NO: 1065765 - RNA, 21 nt, Human
ugcagaggaaaguacagaggu

SEQ ID NO: 1065766 - RNA, 23 nt, Human
ugccaagcuggagugcaauggcg

SEQ ID NO: 1065767 - RNA, 24 nt, Human
ugccucagccucccaaguagcugg

SEQ ID NO: 1065768 - RNA, 23 nt, Human
ugcgcccaggaguuugagaccag

SEQ ID NO: 1065769 - RNA, 23 nt, Human
uggagugcaauggcgcgaucucg

SEQ ID NO: 1065770 - RNA, 24 nt, Human
uggagugcaauggcgcgaucucgg

SEQ ID NO: 1065771 - RNA, 22 nt, Human
uggcagccaaaggaaaaggagg

SEQ ID NO: 1065772 - RNA, 21 nt, Human
uggccaggauggucucaaucu

SEQ ID NO: 1065773 - RNA, 22 nt, Human
ugggauuacaggcacgagccac

SEQ ID NO: 1065774 - RNA, 23 nt, Human
ugggauuacaggcacgagccacc

SEQ ID NO: 1065775 - RNA, 24 nt, Human
ugggauuacaggcacgagccacca

SEQ ID NO: 1065776 - RNA, 20 nt, Human
ugggcaacauaacaagaccu

SEQ ID NO: 1065777 - RNA, 21 nt, Human
uguagacgggguuucaccaug

SEQ ID NO: 1065778 - RNA, 23 nt, Human
ugugauaacuacuuagcuugcaa

SEQ ID NO: 1065779 - RNA, 23 nt, Human
uguuuuacauauccuccuccugu

SEQ ID NO: 1065780 - RNA, 21 nt, Human
uucaagcuauucuccugccuc

SEQ ID NO: 1065781 - RNA, 23 nt, Human
uucaguggauggaaaacagguug

SEQ ID NO: 1065782 - RNA, 22 nt, Human
uuccugaaauccuggcacucca

SEQ ID NO: 1065783 - RNA, 25 nt, Human
uuuaagaagugcugauacacugggg

SEQ ID NO: 1065784 - RNA, 19 nt, Human
uuucaccauguuggccagg

SEQ ID NO: 1065785 - RNA, 20 nt, Human
uuucaccauguuggccagga

SEQ ID NO: 1065786 - RNA, 26 nt, Human
uuuuuuuuuuuuaaagauggagucuc

SEQ ID NO: 1065787 - RNA, 19 nt, Human
uuuuuuuuuuuuuuuuuaa

SEQ ID NO: 1065788 - RNA, 24 nt, Human
aaucacuugaacccgggaggcaga

SEQ ID NO: 1065789 - RNA, 25 nt, Human
acuccagccugggcaacaagaguga

SEQ ID NO: 1065790 - RNA, 22 nt, Human
agagguugcagugagcugagau

SEQ ID NO: 1065791 - RNA, 24 nt, Human
agagguugcagugagcugagauug

SEQ ID NO: 1065792 - RNA, 20 nt, Human
aggcagagguugcagugagc

SEQ ID NO: 1065793 - RNA, 24 nt, Human
aggcagagguugcagugagcugag

SEQ ID NO: 1065794 - RNA, 18 nt, Human
aggcaggagaaucacuug

SEQ ID NO: 1065795 - RNA, 24 nt, Human
aggcaggagaaucacuugaacccg

SEQ ID NO: 1065796 - RNA, 24 nt, Human
aggcugaggcaggagaaucacuug

SEQ ID NO: 1065797 - RNA, 24 nt, Human
auugcacuccagccugggcaacaa

SEQ ID NO: 1065798 - RNA, 25 nt, Human
auugcacuccagccugggcaacaag

SEQ ID NO: 1065799 - RNA, 24 nt, Human
auugugccauugcacuccagccug

SEQ ID NO: 1065800 - RNA, 19 nt, Human
cacacgcgccugcucgcca

SEQ ID NO: 1065801 - RNA, 23 nt, Human
cacuccagccugggcaacaagag

SEQ ID NO: 1065802 - RNA, 24 nt, Human
cacuccagccugggcaacaagagu

SEQ ID NO: 1065803 - RNA, 25 nt, Human
cacuccagccugggcaacaagagug

SEQ ID NO: 1065804 - RNA, 24 nt, Human
cagcuacuuggaaggcugaggcag

SEQ ID NO: 1065805 - RNA, 19 nt, Human
cauugcacuccagccuggg

SEQ ID NO: 1065806 - RNA, 21 nt, Human
cauugcacuccagccugggca

SEQ ID NO: 1065807 - RNA, 22 nt, Human
cauugcacuccagccugggcaa

SEQ ID NO: 1065808 - RNA, 24 nt, Human
cauugcacuccagccugggcaaca

SEQ ID NO: 1065809 - RNA, 20 nt, Human
ccauugcacuccagccuggg

SEQ ID NO: 1065810 - RNA, 21 nt, Human
ccauugcacuccagccugggc

SEQ ID NO: 1065811 - RNA, 22 nt, Human
ccauugcacuccagccugggca

SEQ ID NO: 1065812 - RNA, 23 nt, Human
ccauugcacuccagccugggcaa

SEQ ID NO: 1065813 - RNA, 24 nt, Human
ccauugcacuccagccugggcaac

SEQ ID NO: 1065814 - RNA, 18 nt, Human
ccuguaaucccagcuacu

SEQ ID NO: 1065815 - RNA, 21 nt, Human
ccuguaaucccagcuacuugg

SEQ ID NO: 1065816 - RNA, 24 nt, Human
cgggaggcagagguugcagugagc

SEQ ID NO: 1065817 - RNA, 23 nt, Human
gagaaucacuugaacccgggagg

SEQ ID NO: 1065818 - RNA, 23 nt, Human
gagauugugccauugcacuccag

SEQ ID NO: 1065819 - RNA, 23 nt, Human
gcaggagaaucacuugaacccgg

SEQ ID NO: 1065820 - RNA, 22 nt, Human
gccauugcacuccagccugggc

SEQ ID NO: 1065821 - RNA, 24 nt, Human
gccauugcacuccagccugggcaa

SEQ ID NO: 1065822 - RNA, 19 nt, Human
gcucgccacccaggagccc

SEQ ID NO: 1065823 - RNA, 26 nt, Human
ucccuacacacgcgccugcucgccac

SEQ ID NO: 1065824 - RNA, 18 nt, Human
ucuuuuuuuuuuuuuuuu

SEQ ID NO: 1065825 - RNA, 23 nt, Human
ugaaauuugaaacaaacaaaaac

SEQ ID NO: 1065826 - RNA, 24 nt, Human
ugaggcaggagaaucacuugaacc

SEQ ID NO: 1065827 - RNA, 25 nt, Human
ugaggcaggagaaucacuugaaccc

SEQ ID NO: 1065828 - RNA, 19 nt, Human
ugcacuccagccugggcaa

SEQ ID NO: 1065829 - RNA, 20 nt, Human
uggaaggcugaggcaggaga

SEQ ID NO: 1065830 - RNA, 24 nt, Human
uggaaggcugaggcaggagaauca

SEQ ID NO: 1065831 - RNA, 22 nt, Human
uugcagugagcugagauugugc

SEQ ID NO: 1065832 - RNA, 23 nt, Human
uugcagugagcugagauugugcc

SEQ ID NO: 1065833 - RNA, 25 nt, Human
uuggaaggcugaggcaggagaauca

SEQ ID NO: 1065834 - RNA, 23 nt, Human
uugugccauugcacuccagccug

SEQ ID NO: 1065835 - RNA, 30 nt, Human; identical to SEQ ID NO: 289986

SEQ ID NO: 1065836 - RNA, 31 nt, Human; identical to SEQ ID NO: 289987

SEQ ID NO: 1065837 - RNA, 32 nt, Human; identical to SEQ ID NO: 423254

SEQ ID NO: 1065838 - RNA, 23 nt, Human
uuuuuuuuuuuuuugaaauuuga

SEQ ID NO: 1065839 - RNA, 22 nt, Human
uuuuuuuuuuuuuuuucuuuuu

SEQ ID NO: 1065840 - RNA, 27 nt, Human
uuuuuuuuuuuuuuuuuuuuuuugggg

SEQ ID NO: 1065841 - RNA, 31 nt, Human
aaaaaaaaaaaaaaaaacuaaaccacaagcc

SEQ ID NO: 1065842 - RNA, 26 nt, Human
aaaaaaaaaaacuaaaccacaagcag

SEQ ID NO: 1065843 - RNA, 21 nt, Human
aaaaaaacuaaaccacaagca

SEQ ID NO: 1065844 - RNA, 20 nt, Human
aaccaaaauaaaacgucaaa

SEQ ID NO: 1065845 - RNA, 22 nt, Human
aaccacaagcagcacccacccc

SEQ ID NO: 1065846 - RNA, 21 nt, Human
aagaggcuucgauuccaacug

SEQ ID NO: 1065847 - RNA, 24 nt, Human
aauuaaaaaaaaaaaaaaaaaaaa

SEQ ID NO: 1065848 - RNA, 21 nt, Human
accacugccaccuugggagcc

SEQ ID NO: 1065849 - RNA, 21 nt, Human
agaggcuucgauuccaacugg

SEQ ID NO: 1065850 - RNA, 21 nt, Human
agcacccacccccuucucccc

SEQ ID NO: 1065851 - RNA, 18 nt, Human
aggaggaguccagccuag

SEQ ID NO: 1065852 - RNA, 20 nt, Human
aggcaggcgagggggcuggu

SEQ ID NO: 1065853 - RNA, 21 nt, Human
aggcaggcgagggggcugguc

SEQ ID NO: 1065854 - RNA, 21 nt, Human
agggcuaugggcaacagggga

SEQ ID NO: 1065855 - RNA, 19 nt, Human
aggggguggggaaaaccaa

SEQ ID NO: 1065856 - RNA, 23 nt, Human
agucuguuggguggugcucaggg

SEQ ID NO: 1065857 - RNA, 25 nt, Human
aucacugcugccaccacugccaccu

SEQ ID NO: 1065858 - RNA, 24 nt, Human
caagggagcuaggugaagggcagg

SEQ ID NO: 1065859 - RNA, 21 nt, Human
cacaagcagcacccacccccu

SEQ ID NO: 1065860 - RNA, 19 nt, Human
caccagggcuguaguguga

SEQ ID NO: 1065861 - RNA, 22 nt, Human
cacccccuucucccccaccagg

SEQ ID NO: 1065862 - RNA, 28 nt, Human
caggccagagccaggccaggcuggggga

SEQ ID NO: 1065863 - RNA, 22 nt, Human
cagguccccuccccucuccucc

SEQ ID NO: 1065864 - RNA, 18 nt, Human
ccaggccagagccaggcc

SEQ ID NO: 1065865 - RNA, 24 nt, Human
ccaugggggcagggccuucccaga

SEQ ID NO: 1065866 - RNA, 18 nt, Human
cccacccccuucuccccc

SEQ ID NO: 1065867 - RNA, 22 nt, Human
cccacccccuucucccccacca

SEQ ID NO: 1065868 - RNA, 18 nt, Human
ccccucuccuccucuucc

SEQ ID NO: 1065869 - RNA, 19 nt, Human
cccgccgccgccgccgccg

SEQ ID NO: 1065870 - RNA, 25 nt, Human
cccgccgccgccgccgccgccgccu

SEQ ID NO: 1065871 - RNA, 23 nt, Human
ccgccgccgccgccgccgccgcc

SEQ ID NO: 1065872 - RNA, 24 nt, Human
ccgccgccgccgccgccgccgccu

SEQ ID NO: 1065873 - RNA, 22 nt, Human
ccgccgccgccgccgccgccgg

SEQ ID NO: 1065874 - RNA, 20 nt, Human
ccuccgagcccgccgccgcc

SEQ ID NO: 1065875 - RNA, 21 nt, Human
ccucuccuccucuucccuccc

SEQ ID NO: 1065876 - RNA, 18 nt, Human
ccucuucccuccccaucu

SEQ ID NO: 1065877 - RNA, 20 nt, Human
ccucuucccuccccaucuaa

SEQ ID NO: 1065878 - RNA, 20 nt, Human
cuccccucuccuccucuucc

SEQ ID NO: 1065879 - RNA, 21 nt, Human
cucgccgcgagcccaaccgcu

SEQ ID NO: 1065880 - RNA, 28 nt, Human
cuggcgcaaacggcacugacucgacccc

SEQ ID NO: 1065881 - RNA, 19 nt, Human
cuucucccccaccagggcu

SEQ ID NO: 1065882 - RNA, 25 nt, Human
gagggcacaaggaccauuugccaga

SEQ ID NO: 1065883 - RNA, 23 nt, Human
gcacccacccccuucucccccac

SEQ ID NO: 1065884 - RNA, 21 nt, Human
ggcagggccuucccagaugcc

SEQ ID NO: 1065885 - RNA, 22 nt, Human
ggccaggcugggggagggggcc

SEQ ID NO: 1065886 - RNA, 19 nt, Human
gggaaaaccaaaauaaaac

SEQ ID NO: 1065887 - RNA, 25 nt, Human
guuuggggagagacacaggcaggcc

SEQ ID NO: 1065888 - RNA, 21 nt, Human
uagugugaggggagaagagga

SEQ ID NO: 1065889 - RNA, 23 nt, Human
uagugugaggggagaagaggagg

SEQ ID NO: 1065890 - RNA, 19 nt, Human
ucuccuccucuucccuccc

SEQ ID NO: 1065891 - RNA, 25 nt, Human
ucugcagguucggaggaucacugcu

SEQ ID NO: 1065892 - RNA, 20 nt, Human
ugaggagggggcaggucccc

SEQ ID NO: 1065893 - RNA, 20 nt, Human
ugaggggguggggaaaacca

SEQ ID NO: 1065894 - RNA, 24 nt, Human
ugggggcagggccuucccagaugc

SEQ ID NO: 1065895 - RNA, 18 nt, Human
uguaggaggaguccagcc

SEQ ID NO: 1065896 - RNA, 23 nt, Human
uguaguuuuauucagguuugauu

SEQ ID NO: 1065897 - RNA, 20 nt, Human
ugugaggggagaagaggagg

SEQ ID NO: 1065898 - RNA, 20 nt, Human
uuaaaaaaaaaaaaaaaaaa

SEQ ID NO: 1065899 - RNA, 20 nt, Human
aaccaaaauaaaacgucaaa

SEQ ID NO: 1065900 - RNA, 21 nt, Human
aagaggcuucgauuccaacug

SEQ ID NO: 1065901 - RNA, 22 nt, Human
accacugccaccuugggagcca

SEQ ID NO: 1065902 - RNA, 21 nt, Human
agaggcuucgauuccaacugg

SEQ ID NO: 1065903 - RNA, 25 nt, Human
aucacugcugccaccacugccaccu

SEQ ID NO: 1065904 - RNA, 24 nt, Human
caagggagcuaggugaagggcagg

SEQ ID NO: 1065905 - RNA, 22 nt, Human
gaggggguggggaaaaccaaaa

SEQ ID NO: 1065906 - RNA, 20 nt, Human
uaggaggaguccagccuagg

SEQ ID NO: 1065907 - RNA, 20 nt, Human
ugaggggguggggaaaacca

SEQ ID NO: 1065908 - RNA, 18 nt, Human
uguaggaggaguccagcc

SEQ ID NO: 1065909 - RNA, 23 nt, Human
cccugggcuagggguguggggug

SEQ ID NO: 1065910 - RNA, 22 nt, Human
gaucacccccuaucgaugaaga

SEQ ID NO: 1065911 - RNA, 22 nt, Human
aaucugugcuggcgucuccccu

SEQ ID NO: 1065912 - RNA, 18 nt, Human
aggguugguuucuucugg

SEQ ID NO: 1065913 - RNA, 24 nt, Human
cacacuucucaaggucagaagucu

SEQ ID NO: 1065914 - RNA, 22 nt, Human
ccacugcaguuguuuuauuggc

SEQ ID NO: 1065915 - RNA, 23 nt, Human
ccggugguggcuggccauucuuc

SEQ ID NO: 1065916 - RNA, 20 nt, Human
gaggguugguuucuucugga

SEQ ID NO: 1065917 - RNA, 24 nt, Human
gccgcaucacuucugucucugauc

SEQ ID NO: 1065918 - RNA, 18 nt, Human
uauuuuggaguucucaga

SEQ ID NO: 1065919 - RNA, 24 nt, Human
uauuuuggaguucucagauuagga

SEQ ID NO: 1065920 - RNA, 24 nt, Human
uccuuggcuugcagccgcaucacu

SEQ ID NO: 1065921 - RNA, 19 nt, Human
ucugugcuggcgucucccc

SEQ ID NO: 1065922 - RNA, 24 nt, Human
uggcuugcagccgcaucacuucug

SEQ ID NO: 1065923 - RNA, 19 nt, Human
uuggaggguugguuucuuc

SEQ ID NO: 1065924 - RNA, 23 nt, Human
aagcccguggaccuaccccccaa

SEQ ID NO: 1065925 - RNA, 18 nt, Human
aaucuggucccucuccca

SEQ ID NO: 1065926 - RNA, 19 nt, Human
aaucuuccucuucugccac

SEQ ID NO: 1065927 - RNA, 19 nt, Human
acaugaaggauuuggcugc

SEQ ID NO: 1065928 - RNA, 20 nt, Human
accaagcccguggaccuacc

SEQ ID NO: 1065929 - RNA, 21 nt, Human
agaaacaagcccaguagauua

SEQ ID NO: 1065930 - RNA, 24 nt, Human
agaaauaauucuaucaccaagccc

SEQ ID NO: 1065931 - RNA, 20 nt, Human
agcaguagccuagugggcac

SEQ ID NO: 1065932 - RNA, 18 nt, Human
agccuagugggcaccaca

SEQ ID NO: 1065933 - RNA, 18 nt, Human
aggaggaaggaggcagag

SEQ ID NO: 1065934 - RNA, 21 nt, Human
aggaggaaggaggcagagaua

SEQ ID NO: 1065935 - RNA, 20 nt, Human
agugguauggccagugucuu

SEQ ID NO: 1065936 - RNA, 23 nt, Human
caacauugcaaaaauggacuuca

SEQ ID NO: 1065937 - RNA, 19 nt, Human
caagaagucaaucgagaaa

SEQ ID NO: 1065938 - RNA, 22 nt, Human
caagcccguggaccuacccccc

SEQ ID NO: 1065939 - RNA, 22 nt, Human
caaguggccucugguuccuuuu

SEQ ID NO: 1065940 - RNA, 19 nt, Human
cagcaguagccuagugggc

SEQ ID NO: 1065941 - RNA, 20 nt, Human
cagugguauggccagugucu

SEQ ID NO: 1065942 - RNA, 27 nt, Human
caguucaaauugcacucaagaagucaa

SEQ ID NO: 1065943 - RNA, 23 nt, Human
ccaagcccguggaccuacccccc

SEQ ID NO: 1065944 - RNA, 19 nt, Human
cccaaucuggucccucucc

SEQ ID NO: 1065945 - RNA, 18 nt, Human
ccguggaccuacccccca

SEQ ID NO: 1065946 - RNA, 19 nt, Human
cucaagaagucaaucgaga

SEQ ID NO: 1065947 - RNA, 21 nt, Human
cucaagacccagcaauucagg

SEQ ID NO: 1065948 - RNA, 26 nt, Human
gacccagcaauucagguguuaacaua

SEQ ID NO: 1065949 - RNA, 23 nt, Human
gagaaauaauucuaucaccaagc

SEQ ID NO: 1065950 - RNA, 19 nt, Human
gaggaggaaggaggcagag

SEQ ID NO: 1065951 - RNA, 18 nt, Human
gaugauagacugggaagg

SEQ ID NO: 1065952 - RNA, 20 nt, Human
gaugcaaaaugacuccaagu

SEQ ID NO: 1065953 - RNA, 23 nt, Human
gguuccuuuuuguuuguuucccu

SEQ ID NO: 1065954 - RNA, 19 nt, Human
uaaaugcugaagagaccua

SEQ ID NO: 1065955 - RNA, 22 nt, Human
uaagcaaauguuacaguucaaa

SEQ ID NO: 1065956 - RNA, 24 nt, Human
uaccccccaaucuggucccucucc

SEQ ID NO: 1065957 - RNA, 26 nt, Human
uacuccacuaaaggugacuaagcaaa

SEQ ID NO: 1065958 - RNA, 23 nt, Human
ucagaaaucuuccucuucugcca

SEQ ID NO: 1065959 - RNA, 20 nt, Human
ucggcagggcucgguucagg

SEQ ID NO: 1065960 - RNA, 20 nt, Human
ugacuaagcaaauguuacag

SEQ ID NO: 1065961 - RNA, 23 nt, Human
ugccaccaauaaaugcugaagag

SEQ ID NO: 1065962 - RNA, 23 nt, Human
uggaacaacauugcaaaaaugga

SEQ ID NO: 1065963 - RNA, 19 nt, Human
uggaggaauuucagcuccc

SEQ ID NO: 1065964 - RNA, 27 nt, Human
uuacuccacuaaaggugacuaagcaaa

SEQ ID NO: 1065965 - RNA, 21 nt, Human
uucaaauugcacucaagaagu

SEQ ID NO: 1065966 - RNA, 22 nt, Human
aaauuaaaauaccccccaccuc

SEQ ID NO: 1065967 - RNA, 24 nt, Human
aagaagagagcuuuuaauuaugaa

SEQ ID NO: 1065968 - RNA, 21 nt, Human
aggcaaauugguggugguucu

SEQ ID NO: 1065969 - RNA, 18 nt, Human
caaucaaaucauuacaaa

SEQ ID NO: 1065970 - RNA, 25 nt, Human
ccaccuccaccaccaggacaccuag

SEQ ID NO: 1065971 - RNA, 21 nt, Human
cccaccuccaccaccaggaca

SEQ ID NO: 1065972 - RNA, 18 nt, Human
ccccccaccuccaccacc

SEQ ID NO: 1065973 - RNA, 19 nt, Human
ccccuccuuuuccuuuuuc

SEQ ID NO: 1065974 - RNA, 23 nt, Human
ccccuccuuuuccuuuuucucaa

SEQ ID NO: 1065975 - RNA, 19 nt, Human
ccucuguccaaaccccaaa

SEQ ID NO: 1065976 - RNA, 20 nt, Human
ccuuuuucucagucuacugg

SEQ ID NO: 1065977 - RNA, 18 nt, Human
cuccucuguccaaacccc

SEQ ID NO: 1065978 - RNA, 21 nt, Human
cucuguccaaaccccaaacuc

SEQ ID NO: 1065979 - RNA, 23 nt, Human
cuucuguuuucagcagcuucuuu

SEQ ID NO: 1065980 - RNA, 19 nt, Human
cuugaaagccgaagaagag

SEQ ID NO: 1065981 - RNA, 20 nt, Human
gcaaauugguggugguucuc

SEQ ID NO: 1065982 - RNA, 24 nt, Human
uaaaauaaucuaacuuuaugagaa

SEQ ID NO: 1065983 - RNA, 20 nt, Human
uaaaauaccccccaccuccu

SEQ ID NO: 1065984 - RNA, 20 nt, Human
uaccccccaccuccaccacc

SEQ ID NO: 1065985 - RNA, 26 nt, Human
uacgcuguuuuugucuaacaucaagg

SEQ ID NO: 1065986 - RNA, 23 nt, Human
uagggaaaacaagaugugcaggu

SEQ ID NO: 1065987 - RNA, 22 nt, Human
uccaccaccaggacaccuagac

SEQ ID NO: 1065988 - RNA, 23 nt, Human
uccaccaccaggacaccuagaca

SEQ ID NO: 1065989 - RNA, 19 nt, Human
uccucuguccaaaccccaa

SEQ ID NO: 1065990 - RNA, 23 nt, Human
uccuuuuccuuuuucucagucua

SEQ ID NO: 1065991 - RNA, 23 nt, Human
ugaaauuaaaauaccccccaccu

SEQ ID NO: 1065992 - RNA, 23 nt, Human
ugaacuucuguuuucagcagcuu

SEQ ID NO: 1065993 - RNA, 18 nt, Human
uggcuccucuguccaaac

SEQ ID NO: 1065994 - RNA, 21 nt, Human
uggcuccucuguccaaacccc

SEQ ID NO: 1065995 - RNA, 18 nt, Human
ugugcaggugaacuucug

SEQ ID NO: 1065996 - RNA, 21 nt, Human
uguuuucagcagcuucuuucu

SEQ ID NO: 1065997 - RNA, 21 nt, Human
uuaugagaauuccagcuacau

SEQ ID NO: 1065998 - RNA, 22 nt, Human
uucuucgggcuaacagcugaaa

SEQ ID NO: 1065999 - RNA, 19 nt, Human
uugucuaacaucaaggcaa

SEQ ID NO: 1066000 - RNA, 20 nt, Human
uuucagcagcuucuuucuuc

SEQ ID NO: 1066001 - RNA, 19 nt, Human
uuuccuuuccuuucuuguc

SEQ ID NO: 1066002 - RNA, 20 nt, Human
uuucuugucgcccccuccuu

SEQ ID NO: 1066003 - RNA, 18 nt, Human
uuuucucagucuacugga

SEQ ID NO: 1066004 - RNA, 19 nt, Human
aaacauugcaucccccucc

SEQ ID NO: 1066005 - RNA, 22 nt, Human
aaagagcauuccccaggaccga

SEQ ID NO: 1066006 - RNA, 23 nt, Human
aaagagcauuccccaggaccgag

SEQ ID NO: 1066007 - RNA, 23 nt, Human
aaccuggacuucuccccaaucuc

SEQ ID NO: 1066008 - RNA, 27 nt, Human
aagccuuauuaggguagagggaacgac

SEQ ID NO: 1066009 - RNA, 20 nt, Human
aaucucuaucacaguacccc

SEQ ID NO: 1066010 - RNA, 18 nt, Human
acauugcaucccccuccc

SEQ ID NO: 1066011 - RNA, 18 nt, Human
acccuugcccccaccccc

SEQ ID NO: 1066012 - RNA, 23 nt, Human
agcuuucccuuccccacgccucc

SEQ ID NO: 1066013 - RNA, 22 nt, Human
aggcaaagagcauuccccagga

SEQ ID NO: 1066014 - RNA, 18 nt, Human
aucucacccuuacccuug

SEQ ID NO: 1066015 - RNA, 20 nt, Human
caaagagcauuccccaggac

SEQ ID NO: 1066016 - RNA, 23 nt, Human
caaagagcauuccccaggaccga

SEQ ID NO: 1066017 - RNA, 19 nt, Human
caagcaucucacccuuacc

SEQ ID NO: 1066018 - RNA, 19 nt, Human
caauaaacauugcaucccc

SEQ ID NO: 1066019 - RNA, 20 nt, Human
cacccuuacccuugccccca

SEQ ID NO: 1066020 - RNA, 22 nt, Human
cacccuuacccuugcccccacc

SEQ ID NO: 1066021 - RNA, 18 nt, Human
cacucucaucccaagcau

SEQ ID NO: 1066022 - RNA, 19 nt, Human
cauugcaucccccucccca

SEQ ID NO: 1066023 - RNA, 23 nt, Human
ccagagauucuccauaccccuua

SEQ ID NO: 1066024 - RNA, 20 nt, Human
cccacccccauucgagaacc

SEQ ID NO: 1066025 - RNA, 19 nt, Human
ccccaucaacccucccuaa

SEQ ID NO: 1066026 - RNA, 22 nt, Human
cccccacccccauucgagaacc

SEQ ID NO: 1066027 - RNA, 23 nt, Human
cccccacccccauucgagaaccu

SEQ ID NO: 1066028 - RNA, 22 nt, Human
cccccaucaacccucccuaagc

SEQ ID NO: 1066029 - RNA, 20 nt, Human
cccccggucuaagacgcccu

SEQ ID NO: 1066030 - RNA, 24 nt, Human
ccccuuacacucucaucccaagca

SEQ ID NO: 1066031 - RNA, 22 nt, Human
cccggucuaagacgcccuuagc

SEQ ID NO: 1066032 - RNA, 20 nt, Human
cccuaagccggcaggcaguc

SEQ ID NO: 1066033 - RNA, 23 nt, Human
cccuuacacucucaucccaagca

SEQ ID NO: 1066034 - RNA, 19 nt, Human
ccucccccaucaacccucc

SEQ ID NO: 1066035 - RNA, 21 nt, Human
ccucccccaucaacccucccu

SEQ ID NO: 1066036 - RNA, 20 nt, Human
ccuuccccacgccuccccca

SEQ ID NO: 1066037 - RNA, 22 nt, Human
cucacccuuacccuugccccca

SEQ ID NO: 1066038 - RNA, 20 nt, Human
cuuacacucucaucccaagc

SEQ ID NO: 1066039 - RNA, 19 nt, Human
gauuucucuccccagucuc

SEQ ID NO: 1066040 - RNA, 19 nt, Human
gcaauugcucauggcugca

SEQ ID NO: 1066041 - RNA, 20 nt, Human
ggcaaagagcauuccccagg

SEQ ID NO: 1066042 - RNA, 18 nt, Human
uaacuucucugcuauccc

SEQ ID NO: 1066043 - RNA, 25 nt, Human
uaccccuuacacucucaucccaagc

SEQ ID NO: 1066044 - RNA, 20 nt, Human
uacgccuauuucuguuucca

SEQ ID NO: 1066045 - RNA, 25 nt, Human
uccccaaucucuaucacaguacccc

SEQ ID NO: 1066046 - RNA, 22 nt, Human
ucccccaucaacccucccuaag

SEQ ID NO: 1066047 - RNA, 18 nt, Human
ucucagaccacguuuguc

SEQ ID NO: 1066048 - RNA, 19 nt, Human
ucucagaccacguuugucg

SEQ ID NO: 1066049 - RNA, 20 nt, Human
ucuccccaaucucuaucaca

SEQ ID NO: 1066050 - RNA, 20 nt, Human
ucucuaucacaguacccccc

SEQ ID NO: 1066051 - RNA, 21 nt, Human
uuagucacucuaucucccccu

SEQ ID NO: 1066052 - RNA, 21 nt, Human
uuccccaggaccgaguucugg

SEQ ID NO: 1066053 - RNA, 26 nt, Human
uugcaucccccuccccacaugggacu

SEQ ID NO: 1066054 - RNA, 18 nt, Human
aaaaguacugaaguaacu

SEQ ID NO: 1066055 - RNA, 24 nt, Human
aaaccagagauggagauggcaaag

SEQ ID NO: 1066056 - RNA, 20 nt, Human
aaauuccucaggaugggaug

SEQ ID NO: 1066057 - RNA, 31 nt, Human
aaccccuccccgccccccccccccccccagg

SEQ ID NO: 1066058 - RNA, 21 nt, Human
aagcuugguucauaaagugaa

SEQ ID NO: 1066059 - RNA, 24 nt, Human
aaggaccagcagucuuccuacccu

SEQ ID NO: 1066060 - RNA, 23 nt, Human
aaucucauucuuaccucauucac

SEQ ID NO: 1066061 - RNA, 24 nt, Human
aauggaauccucucacagccaccc

SEQ ID NO: 1066062 - RNA, 23 nt, Human
acugagccuaccacacuggccua

SEQ ID NO: 1066063 - RNA, 19 nt, Human
agaaauuggugaugggugg

SEQ ID NO: 1066064 - RNA, 19 nt, Human
agcccaggaagaagcagag

SEQ ID NO: 1066065 - RNA, 20 nt, Human
agcccaggaagaagcagaga

SEQ ID NO: 1066066 - RNA, 18 nt, Human
agcuggauuugcagagag

SEQ ID NO: 1066067 - RNA, 22 nt, Human
aggaaaacuaaacaggcuucug

SEQ ID NO: 1066068 - RNA, 18 nt, Human
aguugauuuccaguuuuc

SEQ ID NO: 1066069 - RNA, 22 nt, Human
auacugagccuaccacacuggc

SEQ ID NO: 1066070 - RNA, 21 nt, Human
augaaugugugugugugugug

SEQ ID NO: 1066071 - RNA, 20 nt, Human
augcccuguucccucagccc

SEQ ID NO: 1066072 - RNA, 18 nt, Human
auggagauggcaaagcag

SEQ ID NO: 1066073 - RNA, 19 nt, Human
auuugcagagagacauacu

SEQ ID NO: 1066074 - RNA, 20 nt, Human
caccccaguccccuggcuuu

SEQ ID NO: 1066075 - RNA, 22 nt, Human
cacccugcgaagcagccagggu

SEQ ID NO: 1066076 - RNA, 24 nt, Human
caccucagcuguauauauagccaa

SEQ ID NO: 1066077 - RNA, 21 nt, Human
cacuguuaccaccaacccacu

SEQ ID NO: 1066078 - RNA, 22 nt, Human
cagaaaugcugccacauugaac

SEQ ID NO: 1066079 - RNA, 23 nt, Human
cagaggagcaaagcuugguucau

SEQ ID NO: 1066080 - RNA, 22 nt, Human
cagccauuucaucaaaucaaac

SEQ ID NO: 1066081 - RNA, 18 nt, Human
cagcccaggaagaagcag

SEQ ID NO: 1066082 - RNA, 20 nt, Human
caggcagcacagcuuuaugc

SEQ ID NO: 1066083 - RNA, 24 nt, Human
cauaaagccaccauuguacacagu

SEQ ID NO: 1066084 - RNA, 19 nt, Human
caugcuaaagcugagaaau

SEQ ID NO: 1066085 - RNA, 24 nt, Human
cauucauucuaacaauugagucuc

SEQ ID NO: 1066086 - RNA, 23 nt, Human
ccaaaaccaugccaguauuucug

SEQ ID NO: 1066087 - RNA, 21 nt, Human
ccacccugcgaagcagccagg

SEQ ID NO: 1066088 - RNA, 19 nt, Human
ccacuaggaaccccucccc

SEQ ID NO: 1066089 - RNA, 24 nt, Human
ccagcagucuuccuacccugccuc

SEQ ID NO: 1066090 - RNA, 25 nt, Human
ccagcagucuuccuacccugccucc

SEQ ID NO: 1066091 - RNA, 19 nt, Human
ccaggaagaagcagagaca

SEQ ID NO: 1066092 - RNA, 19 nt, Human
cccacccccuucaccuagg

SEQ ID NO: 1066093 - RNA, 21 nt, Human
cccacuaggaaccccuccccg

SEQ ID NO: 1066094 - RNA, 25 nt, Human
cccaggaagaagcagagacauugcc

SEQ ID NO: 1066095 - RNA, 23 nt, Human
ccccaacacaagccugugcauaa

SEQ ID NO: 1066096 - RNA, 20 nt, Human
ccccagccauuucaucaaau

SEQ ID NO: 1066097 - RNA, 20 nt, Human
ccccauccauaaaauggggc

SEQ ID NO: 1066098 - RNA, 21 nt, Human
cccccccccagccauuucauc

SEQ ID NO: 1066099 - RNA, 18 nt, Human
ccccccccccagccauuu

SEQ ID NO: 1066100 - RNA, 20 nt, Human
ccccccccccccccccagcc

SEQ ID NO: 1066101 - RNA, 22 nt, Human
ccccgcccccccccccccccca

SEQ ID NO: 1066102 - RNA, 21 nt, Human
cccgcccccccccccccccca

SEQ ID NO: 1066103 - RNA, 25 nt, Human
cccgccccccccccccccccagcca

SEQ ID NO: 1066104 - RNA, 18 nt, Human
cccugcuuccuccuucuc

SEQ ID NO: 1066105 - RNA, 19 nt, Human
ccuacucgccaccuccaga

SEQ ID NO: 1066106 - RNA, 23 nt, Human
ccucagacguccuuacucagucc

SEQ ID NO: 1066107 - RNA, 18 nt, Human
ccuccuucucagacuuuu

SEQ ID NO: 1066108 - RNA, 21 nt, Human
ccuccuucucagacuuuucca

SEQ ID NO: 1066109 - RNA, 22 nt, Human
ccuccuucucagacuuuuccag

SEQ ID NO: 1066110 - RNA, 23 nt, Human
ccuccuucucagacuuuuccagg

SEQ ID NO: 1066111 - RNA, 20 nt, Human
ccugcuuccuccuucucaga

SEQ ID NO: 1066112 - RNA, 21 nt, Human
cgggagcuggagcuucucugu

SEQ ID NO: 1066113 - RNA, 23 nt, Human
cuaggaaccccuccccgcccccc

SEQ ID NO: 1066114 - RNA, 22 nt, Human
cucacagccacccugcgaagca

SEQ ID NO: 1066115 - RNA, 25 nt, Human
cucacagccacccugcgaagcagcc

SEQ ID NO: 1066116 - RNA, 21 nt, Human
cucauucacuauguucauucc

SEQ ID NO: 1066117 - RNA, 24 nt, Human
cuccaagacgacuggcugggagga

SEQ ID NO: 1066118 - RNA, 23 nt, Human
cuccauaaacacaagaaugaacu

SEQ ID NO: 1066119 - RNA, 22 nt, Human
cucuccccgccacacacauccu

SEQ ID NO: 1066120 - RNA, 22 nt, Human
cuggaaaacauaaagccaccau

SEQ ID NO: 1066121 - RNA, 20 nt, Human
cuuagcccugccuugacugg

SEQ ID NO: 1066122 - RNA, 22 nt, Human
cuuccuuaguuccccaacacaa

SEQ ID NO: 1066123 - RNA, 24 nt, Human
cuugaccuugccccaaggccugac

SEQ ID NO: 1066124 - RNA, 23 nt, Human
gacagcccaggaagaagcagaga

SEQ ID NO: 1066125 - RNA, 24 nt, Human
gacuaagcgagcuaaugcaugaaa

SEQ ID NO: 1066126 - RNA, 18 nt, Human
gagccuaccacacuggcc

SEQ ID NO: 1066127 - RNA, 19 nt, Human
gaggaaaacuaaacaggcu

SEQ ID NO: 1066128 - RNA, 20 nt, Human
gaggaaaacuaaacaggcuu

SEQ ID NO: 1066129 - RNA, 21 nt, Human
gcaaaccauaucuccaaaaau

SEQ ID NO: 1066130 - RNA, 20 nt, Human
gccccaaggccugaccucag

SEQ ID NO: 1066131 - RNA, 24 nt, Human
gcccugccuugacuggucuuccca

SEQ ID NO: 1066132 - RNA, 18 nt, Human
ggaaaacauaaagccacc

SEQ ID NO: 1066133 - RNA, 23 nt, Human
ggaaccccuccccgccccccccc

SEQ ID NO: 1066134 - RNA, 20 nt, Human
ggaaccugcucaaguuucag

SEQ ID NO: 1066135 - RNA, 22 nt, Human
ggaauccucucacagccacccu

SEQ ID NO: 1066136 - RNA, 18 nt, Human
ggacuaagcgagcuaaug

SEQ ID NO: 1066137 - RNA, 18 nt, Human
ggagggaugaggggauga

SEQ ID NO: 1066138 - RNA, 22 nt, Human
ggggaugacagcccaggaagaa

SEQ ID NO: 1066139 - RNA, 23 nt, Human
gugcaaaguggagcuaaacucug

SEQ ID NO: 1066140 - RNA, 24 nt, Human
gugcccuauuucuuuggauaccgg

SEQ ID NO: 1066141 - RNA, 24 nt, Human
guggucugcuaucaaaaguacuga

SEQ ID NO: 1066142 - RNA, 20 nt, Human
gugucuaccucaggguuugu

SEQ ID NO: 1066143 - RNA, 22 nt, Human
uaaguaacuguucugugcaaag

SEQ ID NO: 1066144 - RNA, 20 nt, Human
uaaguggcugacaaucacug

SEQ ID NO: 1066145 - RNA, 19 nt, Human
uaauugcuguauacuuugc

SEQ ID NO: 1066146 - RNA, 21 nt, Human
uaccacacuggccuacucgcc

SEQ ID NO: 1066147 - RNA, 27 nt, Human
uacccugccuccacuguuaccaccaac

SEQ ID NO: 1066148 - RNA, 21 nt, Human
uacccugcuuccuccuucuca

SEQ ID NO: 1066149 - RNA, 20 nt, Human
uacuuaaugucuuagagccu

SEQ ID NO: 1066150 - RNA, 19 nt, Human
uacuuacuagagggcaggc

SEQ ID NO: 1066151 - RNA, 24 nt, Human
uagagggcaggcagcacagcuuua

SEQ ID NO: 1066152 - RNA, 20 nt, Human
uagccaaaauaaagaccaca

SEQ ID NO: 1066153 - RNA, 22 nt, Human
uauagccaaaauaaagaccaca

SEQ ID NO: 1066154 - RNA, 22 nt, Human
uaugaaugugugugugugugug

SEQ ID NO: 1066155 - RNA, 20 nt, Human
uaugggcagcuccauuaauu

SEQ ID NO: 1066156 - RNA, 22 nt, Human
ucacugcccucuuucaugcccc

SEQ ID NO: 1066157 - RNA, 24 nt, Human
ucagcccaccccaguccccuggcu

SEQ ID NO: 1066158 - RNA, 21 nt, Human
uccacuguuaccaccaaccca

SEQ ID NO: 1066159 - RNA, 22 nt, Human
uccacuguuaccaccaacccac

SEQ ID NO: 1066160 - RNA, 23 nt, Human
uccacuguuaccaccaacccacu

SEQ ID NO: 1066161 - RNA, 18 nt, Human
uccagcuaucucugcuga

SEQ ID NO: 1066162 - RNA, 21 nt, Human
uccagucuugauuguccucuc

SEQ ID NO: 1066163 - RNA, 20 nt, Human
uccccgcccccccccccccc

SEQ ID NO: 1066164 - RNA, 18 nt, Human
uccuuaguuccccaacac

SEQ ID NO: 1066165 - RNA, 18 nt, Human
ucuccccagcuaccuucc

SEQ ID NO: 1066166 - RNA, 18 nt, Human
ucugaguuugccaucagc

SEQ ID NO: 1066167 - RNA, 19 nt, Human
ucuuacagcaaaguugggg

SEQ ID NO: 1066168 - RNA, 21 nt, Human
ucuugcuuuggauuguccagu

SEQ ID NO: 1066169 - RNA, 22 nt, Human
ucuuucuuagcccugccuugac

SEQ ID NO: 1066170 - RNA, 24 nt, Human
ugacagccccuacagaagaagcac

SEQ ID NO: 1066171 - RNA, 18 nt, Human
ugaccucagaucccagau

SEQ ID NO: 1066172 - RNA, 18 nt, Human
ugacuggucuucccaccu

SEQ ID NO: 1066173 - RNA, 25 nt, Human
ugcccuguucccucagcccacccca

SEQ ID NO: 1066174 - RNA, 18 nt, Human
ugcuuuuacaucugauac

SEQ ID NO: 1066175 - RNA, 19 nt, Human
uggaaugcccuguucccuc

SEQ ID NO: 1066176 - RNA, 20 nt, Human
uggauaccgggagcuggagc

SEQ ID NO: 1066177 - RNA, 19 nt, Human
uggcaaagcaggaacagaa

SEQ ID NO: 1066178 - RNA, 20 nt, Human
uggcaaagcaggaacagaaa

SEQ ID NO: 1066179 - RNA, 23 nt, Human
uggcugacaaucacugcugaaga

SEQ ID NO: 1066180 - RNA, 20 nt, Human
ugggaguuggggaggcuaag

SEQ ID NO: 1066181 - RNA, 18 nt, Human
uggggcggagggaugagg

SEQ ID NO: 1066182 - RNA, 19 nt, Human
uguucugugcaaaguggag

SEQ ID NO: 1066183 - RNA, 18 nt, Human
uuaaagauuuuauacuac

SEQ ID NO: 1066184 - RNA, 24 nt, Human
uuaaugucuuagagccuguuuccc

SEQ ID NO: 1066185 - RNA, 21 nt, Human
uuaguuccccaacacaagccu

SEQ ID NO: 1066186 - RNA, 20 nt, Human
uuaguugauuuccaguuuuc

SEQ ID NO: 1066187 - RNA, 20 nt, Human
uuaguugauuuccaguuuuu

SEQ ID NO: 1066188 - RNA, 19 nt, Human
uuccccuucuggcuuaccc

SEQ ID NO: 1066189 - RNA, 22 nt, Human
uucuucuguggucuuuuucaaa

SEQ ID NO: 1066190 - RNA, 24 nt, Human
uuguacacaguucacuuuuauaua

SEQ ID NO: 1066191 - RNA, 24 nt, Human
uuuuccagcauuugugggaauguc

SEQ ID NO: 1066192 - RNA, 23 nt, Human
uuuuuuuuuuuuuaaagauuuua

SEQ ID NO: 1066193 - RNA, 19 nt, Human
aaagaagagaguggcgacc

SEQ ID NO: 1066194 - RNA, 23 nt, Human
aagggugcacucuaaguucugga

SEQ ID NO: 1066195 - RNA, 19 nt, Human
acacacagccauccaaacu

SEQ ID NO: 1066196 - RNA, 23 nt, Human
acaugaauacugucauggaugga

SEQ ID NO: 1066197 - RNA, 20 nt, Human
accaccccccccccgccccg

SEQ ID NO: 1066198 - RNA, 23 nt, Human
accuuguguucagagcuucccua

SEQ ID NO: 1066199 - RNA, 21 nt, Human
agccccuaccuuguguucaga

SEQ ID NO: 1066200 - RNA, 19 nt, Human
agcggaggagaggacgggc

SEQ ID NO: 1066201 - RNA, 19 nt, Human
aggaaggaccaggcugggu

SEQ ID NO: 1066202 - RNA, 22 nt, Human
aggaaggaccaggcugggucag

SEQ ID NO: 1066203 - RNA, 20 nt, Human
aggcagguggacaucuggga

SEQ ID NO: 1066204 - RNA, 24 nt, Human
aggccaccaccagggggcgauuuc

SEQ ID NO: 1066205 - RNA, 19 nt, Human
auguggagggugcacgggg

SEQ ID NO: 1066206 - RNA, 24 nt, Human
caagagucaaucacauauguuccu

SEQ ID NO: 1066207 - RNA, 21 nt, Human
caagccccuaccuuguguuca

SEQ ID NO: 1066208 - RNA, 25 nt, Human
caagcugaacagccccugaagcugg

SEQ ID NO: 1066209 - RNA, 26 nt, Human
caaggcgaggagugcgggcggcgccc

SEQ ID NO: 1066210 - RNA, 19 nt, Human
caccccccccccgccccgc

SEQ ID NO: 1066211 - RNA, 24 nt, Human
caccccccccccgccccgccucca

SEQ ID NO: 1066212 - RNA, 20 nt, Human
cacccccggcuccgccucca

SEQ ID NO: 1066213 - RNA, 22 nt, Human
cacccccggcuccgccuccacc

SEQ ID NO: 1066214 - RNA, 23 nt, Human
cacccuaggccgagagcagaagc

SEQ ID NO: 1066215 - RNA, 21 nt, Human
cagaagcggguggcaggagca

SEQ ID NO: 1066216 - RNA, 22 nt, Human
cagcggaggagaggacgggcua

SEQ ID NO: 1066217 - RNA, 24 nt, Human
caguaggcaagucagggggguccu

SEQ ID NO: 1066218 - RNA, 19 nt, Human
cauccuaguugaguuaaag

SEQ ID NO: 1066219 - RNA, 19 nt, Human
caucucccccacgcauagc

SEQ ID NO: 1066220 - RNA, 23 nt, Human
ccaccaccccccccccgccccgc

SEQ ID NO: 1066221 - RNA, 18 nt, Human
ccacccagucggccccgc

SEQ ID NO: 1066222 - RNA, 19 nt, Human
ccagaaagaaggaugaagc

SEQ ID NO: 1066223 - RNA, 21 nt, Human
cccaaccccgcaacgccagga

SEQ ID NO: 1066224 - RNA, 23 nt, Human
ccccaaccccgcaacgccaggac

SEQ ID NO: 1066225 - RNA, 18 nt, Human
ccccacccagucggcccc

SEQ ID NO: 1066226 - RNA, 22 nt, Human
ccccacguccauucuacccucc

SEQ ID NO: 1066227 - RNA, 25 nt, Human
ccccaucucccccacgcauagcuca

SEQ ID NO: 1066228 - RNA, 24 nt, Human
cccccaaccccgcaacgccaggac

SEQ ID NO: 1066229 - RNA, 20 nt, Human
cccccgccccgccuccagcc

SEQ ID NO: 1066230 - RNA, 22 nt, Human
cccccgccccgccuccagccgc

SEQ ID NO: 1066231 - RNA, 25 nt, Human
cccccggcuccgccuccaccacccc

SEQ ID NO: 1066232 - RNA, 19 nt, Human
cccuggcgugagccugggg

SEQ ID NO: 1066233 - RNA, 18 nt, Human
ccgcaacgccaggacagg

SEQ ID NO: 1066234 - RNA, 19 nt, Human
ccuagaagggugcacucua

SEQ ID NO: 1066235 - RNA, 22 nt, Human
cggccccgccuuucaggacccc

SEQ ID NO: 1066236 - RNA, 20 nt, Human
cggcuccgccuccaccaccc

SEQ ID NO: 1066237 - RNA, 18 nt, Human
cucccccacgcauagcuc

SEQ ID NO: 1066238 - RNA, 26 nt, Human
cucccccacguccauucuacccucca

SEQ ID NO: 1066239 - RNA, 23 nt, Human
cuccgagagggucccccaacccu

SEQ ID NO: 1066240 - RNA, 20 nt, Human
cuccgccuccaccacccccc

SEQ ID NO: 1066241 - RNA, 22 nt, Human
cucuccccgccacacacauccu

SEQ ID NO: 1066242 - RNA, 24 nt, Human
cugaagcugggaaucaagccccua

SEQ ID NO: 1066243 - RNA, 21 nt, Human
cugaccccaucucccccacgc

SEQ ID NO: 1066244 - RNA, 21 nt, Human
cuggcgugagccuggggcugc

SEQ ID NO: 1066245 - RNA, 23 nt, Human
cuggugcuguggggccgcggagc

SEQ ID NO: 1066246 - RNA, 20 nt, Human
cugugugugagccucgcccu

SEQ ID NO: 1066247 - RNA, 24 nt, Human
gaacagccccugaagcugggaauc

SEQ ID NO: 1066248 - RNA, 21 nt, Human
gaccaggcugggucagggccu

SEQ ID NO: 1066249 - RNA, 18 nt, Human
gaggugagccuagguuag

SEQ ID NO: 1066250 - RNA, 20 nt, Human
gcaaagaagagaguggcgac

SEQ ID NO: 1066251 - RNA, 23 nt, Human
gcaaagaagagaguggcgaccuu

SEQ ID NO: 1066252 - RNA, 21 nt, Human
gcaacgccaggacagguuugc

SEQ ID NO: 1066253 - RNA, 22 nt, Human
gcagagggaaauaccgccuaca

SEQ ID NO: 1066254 - RNA, 18 nt, Human
gcgggcggcgcccuggcg

SEQ ID NO: 1066255 - RNA, 19 nt, Human
ggacagguuugcacguccc

SEQ ID NO: 1066256 - RNA, 19 nt, Human
ggcaggagcacagggagug

SEQ ID NO: 1066257 - RNA, 18 nt, Human
gggagugagguccagguu

SEQ ID NO: 1066258 - RNA, 24 nt, Human
gggcggcgcccuggcgugagccug

SEQ ID NO: 1066259 - RNA, 21 nt, Human
ggugauugaaucugggaagga

SEQ ID NO: 1066260 - RNA, 19 nt, Human
gguggcaggagcacaggga

SEQ ID NO: 1066261 - RNA, 19 nt, Human
uacacuaggcagguggaca

SEQ ID NO: 1066262 - RNA, 21 nt, Human
uauugugcuagaguagggggc

SEQ ID NO: 1066263 - RNA, 21 nt, Human
uccaccaccccccccccgccc

SEQ ID NO: 1066264 - RNA, 22 nt, Human
uccaccaccccccccccgcccc

SEQ ID NO: 1066265 - RNA, 18 nt, Human
uccccagcaguaggcaag

SEQ ID NO: 1066266 - RNA, 26 nt, Human
uccccagcuaccuucccucuccccgc

SEQ ID NO: 1066267 - RNA, 20 nt, Human
uccccaguucccuccacccc

SEQ ID NO: 1066268 - RNA, 20 nt, Human
ucccccaaccccgcaacgcc

SEQ ID NO: 1066269 - RNA, 21 nt, Human
ucccugaggugagccuagguc

SEQ ID NO: 1066270 - RNA, 22 nt, Human
uccgagagggucccccaacccc

SEQ ID NO: 1066271 - RNA, 22 nt, Human
uccuuuaguuaaaugugccacu

SEQ ID NO: 1066272 - RNA, 22 nt, Human
ucgcugucucuauggccccgga

SEQ ID NO: 1066273 - RNA, 18 nt, Human
ucuccccagcuaccuucc

SEQ ID NO: 1066274 - RNA, 26 nt, Human
ucucuugagcccacaugaauacuguc

SEQ ID NO: 1066275 - RNA, 27 nt, Human
ucugcagucacacacagccauccaaac

SEQ ID NO: 1066276 - RNA, 23 nt, Human
ugagcuggaggggaaggcaagug

SEQ ID NO: 1066277 - RNA, 23 nt, Human
ugagcuuuggggaauccagaaag

SEQ ID NO: 1066278 - RNA, 22 nt, Human
ugagguccagguuagaggacag

SEQ ID NO: 1066279 - RNA, 23 nt, Human
ugagugaacaggugcaaacgcuu

SEQ ID NO: 1066280 - RNA, 18 nt, Human
ugcccaagaugagcugga

SEQ ID NO: 1066281 - RNA, 19 nt, Human
ugcgggcggcgcccuggcg

SEQ ID NO: 1066282 - RNA, 21 nt, Human
uggcaggagcacagggaguga

SEQ ID NO: 1066283 - RNA, 20 nt, Human
uggcgaggccaccaccaggg

SEQ ID NO: 1066284 - RNA, 19 nt, Human
ugggaugaaggucgagagc

SEQ ID NO: 1066285 - RNA, 23 nt, Human
ugggcccugcugucuagcagucu

SEQ ID NO: 1066286 - RNA, 22 nt, Human
uggggaauccagaaagaaggau

SEQ ID NO: 1066287 - RNA, 21 nt, Human
uggggcugcgggccggggguc

SEQ ID NO: 1066288 - RNA, 26 nt, Human
uggggcugcgggccgggggucgggca

SEQ ID NO: 1066289 - RNA, 20 nt, Human
uggggggucgcccgauggcc

SEQ ID NO: 1066290 - RNA, 24 nt, Human
ugguccaucucuugagcccacaug

SEQ ID NO: 1066291 - RNA, 18 nt, Human
uggugagugaacaggugc

SEQ ID NO: 1066292 - RNA, 21 nt, Human
uggugcuguggggccgcggag

SEQ ID NO: 1066293 - RNA, 23 nt, Human
uggugcuguggggccgcggagcc

SEQ ID NO: 1066294 - RNA, 20 nt, Human
ugugggcccugcugucuagc

SEQ ID NO: 1066295 - RNA, 21 nt, Human
uucaggaccccgccccacccc

SEQ ID NO: 1066296 - RNA, 19 nt, Human
uucaggccugaccccaucu

SEQ ID NO: 1066297 - RNA, 20 nt, Human
uugaaugacccagucccuga

SEQ ID NO: 1066298 - RNA, 18 nt, Human
uuuugguccaucucuuga

SEQ ID NO: 1066299 - RNA, 23 nt, Human
ucucggauggcagcauuuggcuu

SEQ ID NO: 1066300 - RNA, 18 nt, Human
ugaagacacuggcccucu

SEQ ID NO: 1066301 - RNA, 19 nt, Human
uggcugacaauuuacugau

SEQ ID NO: 1066302 - RNA, 19 nt, Human
uguaaggcugagcugaauc

SEQ ID NO: 1066303 - RNA, 21 nt, Human
ugucacagucucggauggcag

SEQ ID NO: 1066304 - RNA, 23 nt, Human
uugaugaagacacuggcccucuu

SEQ ID NO: 1066305 - RNA, 23 nt, Human
aaaaggcccaaaacuuuauuuag

SEQ ID NO: 1066306 - RNA, 22 nt, Human
aaacugaaccaccacagguguc

SEQ ID NO: 1066307 - RNA, 18 nt, Human
aacaaagacaaaacucca

SEQ ID NO: 1066308 - RNA, 23 nt, Human
aacgugccucucacuugccucua

SEQ ID NO: 1066309 - RNA, 22 nt, Human
aagcugugggucacugauccug

SEQ ID NO: 1066310 - RNA, 19 nt, Human
aaguuaacaguggggcugu

SEQ ID NO: 1066311 - RNA, 20 nt, Human
acacacuucccaggaagugu

SEQ ID NO: 1066312 - RNA, 22 nt, Human
acaugcucacgcuucagggauu

SEQ ID NO: 1066313 - RNA, 20 nt, Human
accagguggcaggcucagca

SEQ ID NO: 1066314 - RNA, 22 nt, Human
accagugugcccaccuuauggc

SEQ ID NO: 1066315 - RNA, 20 nt, Human
acccagucuaauucauacca

SEQ ID NO: 1066316 - RNA, 20 nt, Human
acugauccugucuucucacu

SEQ ID NO: 1066317 - RNA, 20 nt, Human
agauugguuuguggcuggug

SEQ ID NO: 1066318 - RNA, 24 nt, Human
agcaaguucucaccccaaccaccu

SEQ ID NO: 1066319 - RNA, 23 nt, Human
agccagaaacucaggaaggucua

SEQ ID NO: 1066320 - RNA, 19 nt, Human
aggccacugaguucuagga

SEQ ID NO: 1066321 - RNA, 25 nt, Human
aggcggggaccuucagugcagggga

SEQ ID NO: 1066322 - RNA, 24 nt, Human
auuggccaggauggaacugggagc

SEQ ID NO: 1066323 - RNA, 24 nt, Human
caaacugaaccaccacagguguca

SEQ ID NO: 1066324 - RNA, 18 nt, Human
caacaagacgacaaagga

SEQ ID NO: 1066325 - RNA, 21 nt, Human
caaccaccugacccacccucu

SEQ ID NO: 1066326 - RNA, 19 nt, Human
caaguucucaccccaacca

SEQ ID NO: 1066327 - RNA, 19 nt, Human
cacagagacaugagacugc

SEQ ID NO: 1066328 - RNA, 22 nt, Human
cacagcccuccacacacuuccc

SEQ ID NO: 1066329 - RNA, 19 nt, Human
cacccagucuaauucauac

SEQ ID NO: 1066330 - RNA, 20 nt, Human
cacccagucuaauucauacc

SEQ ID NO: 1066331 - RNA, 19 nt, Human
caccccaaccaccugaccc

SEQ ID NO: 1066332 - RNA, 21 nt, Human
caccccaaccaccugacccac

SEQ ID NO: 1066333 - RNA, 22 nt, Human
caccccaaccaccugacccacc

SEQ ID NO: 1066334 - RNA, 24 nt, Human
caccccaaccaccugacccacccu

SEQ ID NO: 1066335 - RNA, 20 nt, Human
cagcguguggcccaaugagu

SEQ ID NO: 1066336 - RNA, 20 nt, Human
caggaaggucuagcacagcc

SEQ ID NO: 1066337 - RNA, 23 nt, Human
caggcucagcaaacugaaccacc

SEQ ID NO: 1066338 - RNA, 18 nt, Human
cagggaaauauaagaugc

SEQ ID NO: 1066339 - RNA, 24 nt, Human
caguaggccccagcuaccccaaac

SEQ ID NO: 1066340 - RNA, 20 nt, Human
caugcagcuugggaaccaca

SEQ ID NO: 1066341 - RNA, 24 nt, Human
cauguaaacauaaaauacaaaaca

SEQ ID NO: 1066342 - RNA, 18 nt, Human
cauuauaaggggcuucuc

SEQ ID NO: 1066343 - RNA, 26 nt, Human
ccaccugacccacccucugaaacaag

SEQ ID NO: 1066344 - RNA, 21 nt, Human
cccuuucuaccugcucucuuc

SEQ ID NO: 1066345 - RNA, 18 nt, Human
ccucccucccucccuuuu

SEQ ID NO: 1066346 - RNA, 25 nt, Human
ccugacccacccucugguccccugg

SEQ ID NO: 1066347 - RNA, 27 nt, Human
ccugcaguugggacuaaaccggggucc

SEQ ID NO: 1066348 - RNA, 20 nt, Human
ccuuuuuucucuuucaccuc

SEQ ID NO: 1066349 - RNA, 22 nt, Human
cucaccccaaccaccugaccca

SEQ ID NO: 1066350 - RNA, 23 nt, Human
cucaccccaaccaccugacccac

SEQ ID NO: 1066351 - RNA, 24 nt, Human
cucaccccaaccaccugacccacc

SEQ ID NO: 1066352 - RNA, 18 nt, Human
cucaguguuucuauuccc

SEQ ID NO: 1066353 - RNA, 20 nt, Human
cucuucuuccugaaacacuc

SEQ ID NO: 1066354 - RNA, 19 nt, Human
cuggcccugcaguugggac

SEQ ID NO: 1066355 - RNA, 27 nt, Human
cugguaccaacaagacgacaaaggagg

SEQ ID NO: 1066356 - RNA, 20 nt, Human
cuguuuugcuguucuuucuc

SEQ ID NO: 1066357 - RNA, 21 nt, Human
cuucagggauuacugaagucu

SEQ ID NO: 1066358 - RNA, 20 nt, Human
cuucuggaagccuccuuccc

SEQ ID NO: 1066359 - RNA, 19 nt, Human
gaaguuaacaguggggcug

SEQ ID NO: 1066360 - RNA, 21 nt, Human
gaccccauucucuaaggccac

SEQ ID NO: 1066361 - RNA, 18 nt, Human
gacugcaccaaacagggc

SEQ ID NO: 1066362 - RNA, 19 nt, Human
gcccaccuuauggccuggg

SEQ ID NO: 1066363 - RNA, 24 nt, Human
ggacuaaacuuauaugcaccugca

SEQ ID NO: 1066364 - RNA, 18 nt, Human
ggaguaggagagggugcu

SEQ ID NO: 1066365 - RNA, 21 nt, Human
ggauuggggaagggggauugc

SEQ ID NO: 1066366 - RNA, 24 nt, Human
ggcaaaaccagcugagaacccggg

SEQ ID NO: 1066367 - RNA, 23 nt, Human
ggggacccagguuugcaggaggg

SEQ ID NO: 1066368 - RNA, 23 nt, Human
gguaccaacaagacgacaaagga

SEQ ID NO: 1066369 - RNA, 18 nt, Human
guaccaacaagacgacaa

SEQ ID NO: 1066370 - RNA, 18 nt, Human
gucuggcccugcaguugg

SEQ ID NO: 1066371 - RNA, 20 nt, Human
uaaaauacaaaacaaaaccc

SEQ ID NO: 1066372 - RNA, 21 nt, Human
uaaauaauucuuccucccucc

SEQ ID NO: 1066373 - RNA, 21 nt, Human
uaaucccaaccuuauaggcag

SEQ ID NO: 1066374 - RNA, 22 nt, Human
uaauuuguggaggugggucccu

SEQ ID NO: 1066375 - RNA, 23 nt, Human
uagcacagcccuccacacacuuc

SEQ ID NO: 1066376 - RNA, 22 nt, Human
uagccagaaacucaggaagguc

SEQ ID NO: 1066377 - RNA, 21 nt, Human
ucaacaaagacaaaacuccaa

SEQ ID NO: 1066378 - RNA, 21 nt, Human
ucagcaaacugaaccaccaca

SEQ ID NO: 1066379 - RNA, 24 nt, Human
uccugcagaccucugaguaccugg

SEQ ID NO: 1066380 - RNA, 21 nt, Human
ucucaccccaaccaccugacc

SEQ ID NO: 1066381 - RNA, 18 nt, Human
ucuggaagccuccuuccc

SEQ ID NO: 1066382 - RNA, 20 nt, Human
ucuggaaucagggccugcaa

SEQ ID NO: 1066383 - RNA, 19 nt, Human
ucuguaagcaccagugugc

SEQ ID NO: 1066384 - RNA, 19 nt, Human
ucuuccucccucccucccu

SEQ ID NO: 1066385 - RNA, 18 nt, Human
ugaagggacaguaggccc

SEQ ID NO: 1066386 - RNA, 20 nt, Human
ugacccacccucugaaacaa

SEQ ID NO: 1066387 - RNA, 23 nt, Human
ugacccauuguggucacugcucu

SEQ ID NO: 1066388 - RNA, 20 nt, Human
ugagaacccgggagcuggau

SEQ ID NO: 1066389 - RNA, 23 nt, Human
ugagaacccgggagcuggaugca

SEQ ID NO: 1066390 - RNA, 22 nt, Human
ugagaacugauggggacccagc

SEQ ID NO: 1066391 - RNA, 19 nt, Human
ugagagacuggcuuuggau

SEQ ID NO: 1066392 - RNA, 21 nt, Human
ugagagacuggcuuuggauug

SEQ ID NO: 1066393 - RNA, 18 nt, Human
ugaggcgcagccuauugg

SEQ ID NO: 1066394 - RNA, 21 nt, Human
ugcaggagggaaguuaacagu

SEQ ID NO: 1066395 - RNA, 20 nt, Human
ugccagugugaaauuuccaa

SEQ ID NO: 1066396 - RNA, 21 nt, Human
uggacagucaaagggaagugg

SEQ ID NO: 1066397 - RNA, 21 nt, Human
uggagccugggaugacugccu

SEQ ID NO: 1066398 - RNA, 21 nt, Human
uggcaggcucagcaaacugaa

SEQ ID NO: 1066399 - RNA, 25 nt, Human
uggcauggcugaggggugggaguca

SEQ ID NO: 1066400 - RNA, 27 nt, Human
ugggaaccacagagacaugagacugca

SEQ ID NO: 1066401 - RNA, 24 nt, Human
uggggacccagcguguggcccaau

SEQ ID NO: 1066402 - RNA, 24 nt, Human
uucccuuucuaccugcucucuucu

SEQ ID NO: 1066403 - RNA, 20 nt, Human
uuccucccucccucccuuuu

SEQ ID NO: 1066404 - RNA, 23 nt, Human
uuccugaaacacucagagcugac

SEQ ID NO: 1066405 - RNA, 23 nt, Human
uucucaccccaaccaccugaccc

SEQ ID NO: 1066406 - RNA, 23 nt, Human
uucucauacccauggcauggcug

SEQ ID NO: 1066407 - RNA, 30 nt, Human
uucucugcaguaaacucuuauggggagugg

SEQ ID NO: 1066408 - RNA, 20 nt, Human
uucucuuucaccucuugagg

SEQ ID NO: 1066409 - RNA, 21 nt, Human
uugcuguucuuucucugcagu

SEQ ID NO: 1066410 - RNA, 19 nt, Human
uugggaaccacagagacau

SEQ ID NO: 1066411 - RNA, 20 nt, Human
aaaaugaacauuugugaggg

SEQ ID NO: 1066412 - RNA, 18 nt, Human
aaacaaaggagccaucua

SEQ ID NO: 1066413 - RNA, 22 nt, Human
aaacaaaucacaaauuggccug

SEQ ID NO: 1066414 - RNA, 23 nt, Human
aaagacuguuuguguucuguacu

SEQ ID NO: 1066415 - RNA, 18 nt, Human
aaagaggucauggacaca

SEQ ID NO: 1066416 - RNA, 24 nt, Human
aaagugcugggauuacaggcguga

SEQ ID NO: 1066417 - RNA, 20 nt, Human
aaagugggugggagaagcca

SEQ ID NO: 1066418 - RNA, 20 nt, Human
aacaugcgcauaacauagga

SEQ ID NO: 1066419 - RNA, 19 nt, Human
aaccucucccccagcccua

SEQ ID NO: 1066420 - RNA, 20 nt, Human
aacuaggcccucagcaaguu

SEQ ID NO: 1066421 - RNA, 19 nt, Human
aagcaaggacaaaaaaggu

SEQ ID NO: 1066422 - RNA, 19 nt, Human
aagcaaggcagugcaagga

SEQ ID NO: 1066423 - RNA, 22 nt, Human
aagugcaaagcuccaugaagca

SEQ ID NO: 1066424 - RNA, 19 nt, Human
aagugcugggauuacaggc

SEQ ID NO: 1066425 - RNA, 19 nt, Human
aagugcugggauuacaggc

SEQ ID NO: 1066426 - RNA, 26 nt, Human
aagugcugggauuacaggcgugagcc

SEQ ID NO: 1066427 - RNA, 19 nt, Human
aauccaguuccuuccacag

SEQ ID NO: 1066428 - RNA, 24 nt, Human
aaugccacuuuuaaaaggaaggau

SEQ ID NO: 1066429 - RNA, 23 nt, Human
acacugcugugggaggccagccc

SEQ ID NO: 1066430 - RNA, 23 nt, Human
acaggcucccgccaccacgcccg

SEQ ID NO: 1066431 - RNA, 18 nt, Human
acaguggaaauauuuggc

SEQ ID NO: 1066432 - RNA, 23 nt, Human
accucggccucccaaagugcugg

SEQ ID NO: 1066433 - RNA, 18 nt, Human
acuaagcccagaacucca

SEQ ID NO: 1066434 - RNA, 20 nt, Human
agaaagcaauaaaggcgacu

SEQ ID NO: 1066435 - RNA, 22 nt, Human
agacuaugagcuuuugaaggag

SEQ ID NO: 1066436 - RNA, 19 nt, Human
agagaaugugguuuggagu

SEQ ID NO: 1066437 - RNA, 22 nt, Human
agagaggaaagucuacguaaua

SEQ ID NO: 1066438 - RNA, 20 nt, Human
agcaaggacaaaaaagguaa

SEQ ID NO: 1066439 - RNA, 20 nt, Human
agcaauaaaggcgacuaaaa

SEQ ID NO: 1066440 - RNA, 23 nt, Human
agcuacaugacucucugagccuc

SEQ ID NO: 1066441 - RNA, 21 nt, Human
aggacggagggaggcaggaaa

SEQ ID NO: 1066442 - RNA, 22 nt, Human
aggccuccagcagacuccccag

SEQ ID NO: 1066443 - RNA, 25 nt, Human
aggcuggggugcaguggcgcaaucu

SEQ ID NO: 1066444 - RNA, 22 nt, Human
aggguuucaccauguuagccag

SEQ ID NO: 1066445 - RNA, 19 nt, Human
aguagcugggacuacaggc

SEQ ID NO: 1066446 - RNA, 18 nt, Human
agugcugggauuacaggc

SEQ ID NO: 1066447 - RNA, 20 nt, Human
agugggaaguuccaugcugc

SEQ ID NO: 1066448 - RNA, 18 nt, Human
auaggguuucaccauguu

SEQ ID NO: 1066449 - RNA, 20 nt, Human
auaggguuucaccauguuag

SEQ ID NO: 1066450 - RNA, 21 nt, Human
aucaucaucccuauucuccaa

SEQ ID NO: 1066451 - RNA, 21 nt, Human
auuaugccucuuuuaaguuaa

SEQ ID NO: 1066452 - RNA, 24 nt, Human
caaagugcugggauuacaggcgug

SEQ ID NO: 1066453 - RNA, 24 nt, Human
cacacugcugugggaggccagccc

SEQ ID NO: 1066454 - RNA, 18 nt, Human
cacaguggaaauauuugg

SEQ ID NO: 1066455 - RNA, 18 nt, Human
caccauguuagccaggau

SEQ ID NO: 1066456 - RNA, 22 nt, Human
caccauguuagccaggaugguc

SEQ ID NO: 1066457 - RNA, 24 nt, Human
caccauguuagccaggauggucuc

SEQ ID NO: 1066458 - RNA, 25 nt, Human
cacccagcaaguauuuacugagcac

SEQ ID NO: 1066459 - RNA, 24 nt, Human
cacccaggcuggggugcaguggcg

SEQ ID NO: 1066460 - RNA, 22 nt, Human
cacccauccuucaaggccuuca

SEQ ID NO: 1066461 - RNA, 22 nt, Human
caccgugacuuccuuccagccc

SEQ ID NO: 1066462 - RNA, 23 nt, Human
cacuccucuuccuuucccucaac

SEQ ID NO: 1066463 - RNA, 22 nt, Human
cagaacuccaucccaggccucc

SEQ ID NO: 1066464 - RNA, 23 nt, Human
cagacaaucacauaacaugcgca

SEQ ID NO: 1066465 - RNA, 20 nt, Human
cagccuccugaguagcuggg

SEQ ID NO: 1066466 - RNA, 18 nt, Human
cagcuucagaucuacuga

SEQ ID NO: 1066467 - RNA, 20 nt, Human
caggggcacuggcacaucuu

SEQ ID NO: 1066468 - RNA, 22 nt, Human
caggucccaaaucagcugaagg

SEQ ID NO: 1066469 - RNA, 18 nt, Human
caucaucccuauucucca

SEQ ID NO: 1066470 - RNA, 21 nt, Human
cauccaugcuaucaucauccc

SEQ ID NO: 1066471 - RNA, 22 nt, Human
caucuuuugggagagaggaaag

SEQ ID NO: 1066472 - RNA, 21 nt, Human
caugaccucuagcuaauaaag

SEQ ID NO: 1066473 - RNA, 22 nt, Human
caugcaaagagaaugugguuug

SEQ ID NO: 1066474 - RNA, 18 nt, Human
caugcgguuugugguacc

SEQ ID NO: 1066475 - RNA, 22 nt, Human
ccaaagugcugggauuacaggc

SEQ ID NO: 1066476 - RNA, 22 nt, Human
ccaaagugcugggauuacaggc

SEQ ID NO: 1066477 - RNA, 24 nt, Human
ccaaagugcugggauuacaggcgu

SEQ ID NO: 1066478 - RNA, 20 nt, Human
ccaggccuccagcagacucc

SEQ ID NO: 1066479 - RNA, 22 nt, Human
ccaugaagcaaggcagugcaag

SEQ ID NO: 1066480 - RNA, 18 nt, Human
cccacucccuccuuucuc

SEQ ID NO: 1066481 - RNA, 20 nt, Human
cccacucccuccuuucuccc

SEQ ID NO: 1066482 - RNA, 21 nt, Human
cccacucccuccuuucucccu

SEQ ID NO: 1066483 - RNA, 22 nt, Human
cccagcuccaccacccaugagc

SEQ ID NO: 1066484 - RNA, 20 nt, Human
cccuccuuucucccuucucc

SEQ ID NO: 1066485 - RNA, 18 nt, Human
ccgcaagcuccaccuccc

SEQ ID NO: 1066486 - RNA, 24 nt, Human
ccgcaagcuccaccucccggguuc

SEQ ID NO: 1066487 - RNA, 19 nt, Human
ccggagcacauuuuagagc

SEQ ID NO: 1066488 - RNA, 22 nt, Human
ccggagcacauuuuagagccgg

SEQ ID NO: 1066489 - RNA, 18 nt, Human
ccuaacccacuucuggga

SEQ ID NO: 1066490 - RNA, 19 nt, Human
ccuaaccucucccccagcc

SEQ ID NO: 1066491 - RNA, 22 nt, Human
ccuauggccaagugucuaucuu

SEQ ID NO: 1066492 - RNA, 21 nt, Human
ccucaaaugagcuuccccaag

SEQ ID NO: 1066493 - RNA, 18 nt, Human
ccucagccuggaaugccc

SEQ ID NO: 1066494 - RNA, 24 nt, Human
ccucccggguucucgccauucucc

SEQ ID NO: 1066495 - RNA, 21 nt, Human
ccuccuggcugagaugcugcc

SEQ ID NO: 1066496 - RNA, 24 nt, Human
ccugaguagcugggacuacaggcu

SEQ ID NO: 1066497 - RNA, 23 nt, Human
ccugccucagccuccugaguagc

SEQ ID NO: 1066498 - RNA, 24 nt, Human
ccugccucagccuccugaguagcu

SEQ ID NO: 1066499 - RNA, 22 nt, Human
ccuuaagacccccuaccccaga

SEQ ID NO: 1066500 - RNA, 21 nt, Human
ccuuccagccccuuccuagac

SEQ ID NO: 1066501 - RNA, 24 nt, Human
cgcucugucacccaggcuggggug

SEQ ID NO: 1066502 - RNA, 18 nt, Human
cuaccuggugguggaaag

SEQ ID NO: 1066503 - RNA, 18 nt, Human
cuaggagacagaggaucc

SEQ ID NO: 1066504 - RNA, 21 nt, Human
cuaugagcuuuugaaggaggg

SEQ ID NO: 1066505 - RNA, 21 nt, Human
cucaaaugagcuuccccaagc

SEQ ID NO: 1066506 - RNA, 20 nt, Human
cucaauauuccacuuccaga

SEQ ID NO: 1066507 - RNA, 23 nt, Human
cucacccauccuucaaggggacc

SEQ ID NO: 1066508 - RNA, 24 nt, Human
cucaccgcaagcuccaccucccgg

SEQ ID NO: 1066509 - RNA, 24 nt, Human
cucagccuccugaguagcugggac

SEQ ID NO: 1066510 - RNA, 21 nt, Human
cuccacaccugggaguucuuc

SEQ ID NO: 1066511 - RNA, 23 nt, Human
cuccagacuaagcccagaacucc

SEQ ID NO: 1066512 - RNA, 19 nt, Human
cuccaucccaggccuccag

SEQ ID NO: 1066513 - RNA, 23 nt, Human
cucccuuaagacccccuacccca

SEQ ID NO: 1066514 - RNA, 20 nt, Human
cuccugaccucgugaucggc

SEQ ID NO: 1066515 - RNA, 24 nt, Human
cucgcucugucacccaggcugggg

SEQ ID NO: 1066516 - RNA, 24 nt, Human
cugcagacaggguggggugcaaac

SEQ ID NO: 1066517 - RNA, 21 nt, Human
cugcuccucaggcccacuccu

SEQ ID NO: 1066518 - RNA, 20 nt, Human
cugcugcuccucaggcccac

SEQ ID NO: 1066519 - RNA, 25 nt, Human
cugcugcuccucaggcccacuccuc

SEQ ID NO: 1066520 - RNA, 18 nt, Human
cugcuuggcccuacagac

SEQ ID NO: 1066521 - RNA, 20 nt, Human
cuggugguggaaagugggug

SEQ ID NO: 1066522 - RNA, 18 nt, Human
cuguaacaucccuucucu

SEQ ID NO: 1066523 - RNA, 25 nt, Human
cuuaagacccccuaccccagaaagc

SEQ ID NO: 1066524 - RNA, 20 nt, Human
cuuccacaggaggauguccc

SEQ ID NO: 1066525 - RNA, 25 nt, Human
cuuccagccccuuccuagacauccc

SEQ ID NO: 1066526 - RNA, 20 nt, Human
cuuccugugaaucugccuuu

SEQ ID NO: 1066527 - RNA, 18 nt, Human
gaauuccugcugcuccuc

SEQ ID NO: 1066528 - RNA, 22 nt, Human
gaccucgugaucggcccaccuc

SEQ ID NO: 1066529 - RNA, 21 nt, Human
gagacggagucucgcucuguc

SEQ ID NO: 1066530 - RNA, 21 nt, Human
gagagaaaguuaguaagcgag

SEQ ID NO: 1066531 - RNA, 18 nt, Human
gagcugugugguguuggg

SEQ ID NO: 1066532 - RNA, 21 nt, Human
gaggcaggaaagggcagaaag

SEQ ID NO: 1066533 - RNA, 20 nt, Human
gaguagcugggacuacaggc

SEQ ID NO: 1066534 - RNA, 25 nt, Human
gaguagcugggacuacaggcucccg

SEQ ID NO: 1066535 - RNA, 23 nt, Human
gagugccaggucccaaaucagcu

SEQ ID NO: 1066536 - RNA, 20 nt, Human
gauaccacacacugcugugg

SEQ ID NO: 1066537 - RNA, 18 nt, Human
gauuacaggcgugagcca

SEQ ID NO: 1066538 - RNA, 21 nt, Human
gauuacaggcgugagccaccg

SEQ ID NO: 1066539 - RNA, 24 nt, Human
gauuacaggcgugagccaccgugc

SEQ ID NO: 1066540 - RNA, 23 nt, Human
gauugcuugggugagccacgaua

SEQ ID NO: 1066541 - RNA, 24 nt, Human
gcaccgugacuuccuuccagcccc

SEQ ID NO: 1066542 - RNA, 19 nt, Human
gccauucuccugccucagc

SEQ ID NO: 1066543 - RNA, 23 nt, Human
gcccggcuaauuuuuuguauuuu

SEQ ID NO: 1066544 - RNA, 18 nt, Human
gcuaagugcaaagcucca

SEQ ID NO: 1066545 - RNA, 19 nt, Human
gcuacucuguaacaucccu

SEQ ID NO: 1066546 - RNA, 25 nt, Human
gcucugucacccaggcuggggugca

SEQ ID NO: 1066547 - RNA, 22 nt, Human
ggagaacaaagacuguuugugu

SEQ ID NO: 1066548 - RNA, 22 nt, Human
ggauacuugggcucagagaggu

SEQ ID NO: 1066549 - RNA, 21 nt, Human
ggcagggccucugcuagagcc

SEQ ID NO: 1066550 - RNA, 25 nt, Human
ggccaugcuuuucauaagguuggca

SEQ ID NO: 1066551 - RNA, 18 nt, Human
gggaggcacgcaggcauc

SEQ ID NO: 1066552 - RNA, 21 nt, Human
gggcagggccucugcuagagc

SEQ ID NO: 1066553 - RNA, 18 nt, Human
ggggcugguggaauuccu

SEQ ID NO: 1066554 - RNA, 19 nt, Human
ggguggcccugagauaacc

SEQ ID NO: 1066555 - RNA, 22 nt, Human
gggugggagaagccaaacuucu

SEQ ID NO: 1066556 - RNA, 21 nt, Human
ggguuucaccauguuagccag

SEQ ID NO: 1066557 - RNA, 22 nt, Human
ggguuucaccauguuagccagg

SEQ ID NO: 1066558 - RNA, 23 nt, Human
ggucacacagauauaaacccaga

SEQ ID NO: 1066559 - RNA, 20 nt, Human
ggucucaaucuccugaccuc

SEQ ID NO: 1066560 - RNA, 21 nt, Human
ggugcaguggcgcaaucucag

SEQ ID NO: 1066561 - RNA, 22 nt, Human
gguggaugaggggugggaggga

SEQ ID NO: 1066562 - RNA, 23 nt, Human
ggugguguugcgauuucugcagc

SEQ ID NO: 1066563 - RNA, 24 nt, Human
gguuucaccauguuagccaggaug

SEQ ID NO: 1066564 - RNA, 21 nt, Human
guccucucuccuccuaaccuc

SEQ ID NO: 1066565 - RNA, 24 nt, Human
gugaucggcccaccucggccuccc

SEQ ID NO: 1066566 - RNA, 22 nt, Human
gugaucuguaggauaccacaca

SEQ ID NO: 1066567 - RNA, 19 nt, Human
gugcaguggcgcaaucuca

SEQ ID NO: 1066568 - RNA, 22 nt, Human
gugguguugggcaagcuacaug

SEQ ID NO: 1066569 - RNA, 24 nt, Human
guuuccuuaaggaggcugcaccug

SEQ ID NO: 1066570 - RNA, 23 nt, Human
uaaaagcaaggacaaaaaaggua

SEQ ID NO: 1066571 - RNA, 20 nt, Human
uaaaaggaaggauuuuguuu

SEQ ID NO: 1066572 - RNA, 23 nt, Human
uaaaaugaacauuugugagggua

SEQ ID NO: 1066573 - RNA, 24 nt, Human
uaaacaaaucacaaauuggccugc

SEQ ID NO: 1066574 - RNA, 24 nt, Human
uaaaguaagcagcucagcagcuca

SEQ ID NO: 1066575 - RNA, 20 nt, Human
uaaauuaaacaaaucacaaa

SEQ ID NO: 1066576 - RNA, 20 nt, Human
uaacacuacggaaauggagu

SEQ ID NO: 1066577 - RNA, 18 nt, Human
uaaccucucccccagccc

SEQ ID NO: 1066578 - RNA, 24 nt, Human
uaagcgagugugagugccaggucc

SEQ ID NO: 1066579 - RNA, 19 nt, Human
uaagugcaaagcuccauga

SEQ ID NO: 1066580 - RNA, 24 nt, Human
uaauuuuuuguauuuuuaguagag

SEQ ID NO: 1066581 - RNA, 25 nt, Human
uaauuuuuuguauuuuuaguagaga

SEQ ID NO: 1066582 - RNA, 23 nt, Human
uacaggcucccgccaccacgccc

SEQ ID NO: 1066583 - RNA, 18 nt, Human
uacauagcacaccgccug

SEQ ID NO: 1066584 - RNA, 22 nt, Human
uacugagugggaaguuccaugc

SEQ ID NO: 1066585 - RNA, 22 nt, Human
uagagauaggguuucaccaugu

SEQ ID NO: 1066586 - RNA, 24 nt, Human
uagagccaucagcccuauggccaa

SEQ ID NO: 1066587 - RNA, 24 nt, Human
uaggaccuaaagcuaugcuuaagc

SEQ ID NO: 1066588 - RNA, 18 nt, Human
uaggauaccacacacugc

SEQ ID NO: 1066589 - RNA, 21 nt, Human
uaggcacuuaauaaaugcugg

SEQ ID NO: 1066590 - RNA, 24 nt, Human
uaggguuucaccauguuagccagg

SEQ ID NO: 1066591 - RNA, 24 nt, Human
uaguagagauaggguuucaccaug

SEQ ID NO: 1066592 - RNA, 26 nt, Human
uaguagagauaggguuucaccauguu

SEQ ID NO: 1066593 - RNA, 19 nt, Human
uauggccaagugucuaucu

SEQ ID NO: 1066594 - RNA, 21 nt, Human
uauuuuggguaauggggauga

SEQ ID NO: 1066595 - RNA, 21 nt, Human
ucacacagauauaaacccaga

SEQ ID NO: 1066596 - RNA, 24 nt, Human
ucacaguuggacgauugcuugggu

SEQ ID NO: 1066597 - RNA, 24 nt, Human
ucaccauguuagccaggauggucu

SEQ ID NO: 1066598 - RNA, 24 nt, Human
ucacccaggcuggggugcaguggc

SEQ ID NO: 1066599 - RNA, 24 nt, Human
ucaccgcaagcuccaccucccggg

SEQ ID NO: 1066600 - RNA, 23 nt, Human
ucagccuccugaguagcugggac

SEQ ID NO: 1066601 - RNA, 19 nt, Human
ucaggcccagcuccaccac

SEQ ID NO: 1066602 - RNA, 20 nt, Human
ucaggguggaugaggggugg

SEQ ID NO: 1066603 - RNA, 19 nt, Human
uccaaaacuguucuuucca

SEQ ID NO: 1066604 - RNA, 20 nt, Human
uccagaguuucaugaccucc

SEQ ID NO: 1066605 - RNA, 19 nt, Human
uccaggucccggagcacau

SEQ ID NO: 1066606 - RNA, 24 nt, Human
ucccaaagugcugggauuacaggc

SEQ ID NO: 1066607 - RNA, 19 nt, Human
ucccaggccuccagcagac

SEQ ID NO: 1066608 - RNA, 21 nt, Human
ucccaggccuccagcagacuc

SEQ ID NO: 1066609 - RNA, 24 nt, Human
uccccaggcgaaucugucauccug

SEQ ID NO: 1066610 - RNA, 21 nt, Human
ucccggguucucgccauucuc

SEQ ID NO: 1066611 - RNA, 24 nt, Human
ucccggguucucgccauucuccug

SEQ ID NO: 1066612 - RNA, 18 nt, Human
ucccuggggguggcccug

SEQ ID NO: 1066613 - RNA, 24 nt, Human
uccugaguagcugggacuacaggc

SEQ ID NO: 1066614 - RNA, 19 nt, Human
uccuuaaggaggcugcacc

SEQ ID NO: 1066615 - RNA, 19 nt, Human
uccuuccagccccuuccuc

SEQ ID NO: 1066616 - RNA, 22 nt, Human
uccuuccaggucccggagcaca

SEQ ID NO: 1066617 - RNA, 24 nt, Human
ucgcucugucacccaggcuggggu

SEQ ID NO: 1066618 - RNA, 18 nt, Human
ucggccucccaaagugcu

SEQ ID NO: 1066619 - RNA, 19 nt, Human
ucguccucucuccuccuaa

SEQ ID NO: 1066620 - RNA, 25 nt, Human
ucucacccauccuucaaggccuuca

SEQ ID NO: 1066621 - RNA, 24 nt, Human
ucuccugccucagccuccugagua

SEQ ID NO: 1066622 - RNA, 22 nt, Human
ucucgccauucuccugccucag

SEQ ID NO: 1066623 - RNA, 19 nt, Human
ucucgcucugucacccagg

SEQ ID NO: 1066624 - RNA, 23 nt, Human
ucucgcucugucacccaggcugg

SEQ ID NO: 1066625 - RNA, 23 nt, Human
ucucgcucugucacccaggcugg

SEQ ID NO: 1066626 - RNA, 24 nt, Human
ucucgcucugucacccaggcuggg

SEQ ID NO: 1066627 - RNA, 26 nt, Human
ucucgcucugucacccaggcuggggu

SEQ ID NO: 1066628 - RNA, 27 nt, Human
ucucgcucugucacccaggcuggggug

SEQ ID NO: 1066629 - RNA, 18 nt, Human
ucucuccuccuaaccucu

SEQ ID NO: 1066630 - RNA, 24 nt, Human
ucugucacccaggcuggggugcag

SEQ ID NO: 1066631 - RNA, 22 nt, Human
ucuuccuuucccucagccugga

SEQ ID NO: 1066632 - RNA, 21 nt, Human
ugaauccaguuccuuccacag

SEQ ID NO: 1066633 - RNA, 18 nt, Human
ugaauggcucaggccaaa

SEQ ID NO: 1066634 - RNA, 24 nt, Human
ugacagguccacaaccauugcaga

SEQ ID NO: 1066635 - RNA, 19 nt, Human
ugacuugccuaaggucaca

SEQ ID NO: 1066636 - RNA, 19 nt, Human
ugagauaacggacauggcc

SEQ ID NO: 1066637 - RNA, 26 nt, Human
ugagcaccugcuaagugcaaagcucc

SEQ ID NO: 1066638 - RNA, 19 nt, Human
ugagcuuccccaagcucau

SEQ ID NO: 1066639 - RNA, 19 nt, Human
ugaucaaacagcuucagau

SEQ ID NO: 1066640 - RNA, 21 nt, Human
ugauucaugaacaacauucuc

SEQ ID NO: 1066641 - RNA, 22 nt, Human
ugcaguggcgcaaucucagcuc

SEQ ID NO: 1066642 - RNA, 23 nt, Human
ugcaguggcgcaaucucagcuca

SEQ ID NO: 1066643 - RNA, 24 nt, Human
ugccucagccuccugaguagcugg

SEQ ID NO: 1066644 - RNA, 24 nt, Human
ugcugggauuacaggcgugagcca

SEQ ID NO: 1066645 - RNA, 23 nt, Human
ugcuuugcacauccagaguuuca

SEQ ID NO: 1066646 - RNA, 19 nt, Human
uggaaagugggugggagaa

SEQ ID NO: 1066647 - RNA, 22 nt, Human
uggaacaaggcaagguaaaagc

SEQ ID NO: 1066648 - RNA, 23 nt, Human
uggaacuggcuguccaugcuaga

SEQ ID NO: 1066649 - RNA, 21 nt, Human
uggaagcaucacccucccugg

SEQ ID NO: 1066650 - RNA, 19 nt, Human
uggaagugaucaagggaug

SEQ ID NO: 1066651 - RNA, 18 nt, Human
uggaaugcccacucccuc

SEQ ID NO: 1066652 - RNA, 23 nt, Human
uggaaugcccacucccuccuuuc

SEQ ID NO: 1066653 - RNA, 21 nt, Human
uggcaaaggguagcaugguca

SEQ ID NO: 1066654 - RNA, 24 nt, Human
uggcgcaaucucagcucaccgcaa

SEQ ID NO: 1066655 - RNA, 20 nt, Human
uggcucaggccaaaagucgg

SEQ ID NO: 1066656 - RNA, 19 nt, Human
uggcugggcauuucaggca

SEQ ID NO: 1066657 - RNA, 21 nt, Human
ugggacuacaggcucccgcca

SEQ ID NO: 1066658 - RNA, 22 nt, Human
ugggacuacaggcucccgccac

SEQ ID NO: 1066659 - RNA, 24 nt, Human
ugggacuacaggcucccgccacca

SEQ ID NO: 1066660 - RNA, 21 nt, Human
ugggagaagccaaacuucuua

SEQ ID NO: 1066661 - RNA, 18 nt, Human
ugggauuacaggcgugag

SEQ ID NO: 1066662 - RNA, 21 nt, Human
ugggauuacaggcgugagcca

SEQ ID NO: 1066663 - RNA, 22 nt, Human
ugggauuacaggcgugagccac

SEQ ID NO: 1066664 - RNA, 23 nt, Human
ugggauuacaggcgugagccacc

SEQ ID NO: 1066665 - RNA, 23 nt, Human
ugggauuacaggcgugagccacc

SEQ ID NO: 1066666 - RNA, 24 nt, Human
ugggauuacaggcgugagccaccg

SEQ ID NO: 1066667 - RNA, 18 nt, Human
uggggugcaguggcgcaa

SEQ ID NO: 1066668 - RNA, 24 nt, Human
uggggugcaguggcgcaaucucag

SEQ ID NO: 1066669 - RNA, 23 nt, Human
ugggugggagaagccaaacuucu

SEQ ID NO: 1066670 - RNA, 22 nt, Human
ugguacaauacauagacagcac

SEQ ID NO: 1066671 - RNA, 25 nt, Human
ugguacaauacauagacagcacuuu

SEQ ID NO: 1066672 - RNA, 21 nt, Human
uggugauaaaaacugggccac

SEQ ID NO: 1066673 - RNA, 22 nt, Human
ugguguugggcaagcuacauga

SEQ ID NO: 1066674 - RNA, 21 nt, Human
uguccaugcaaggagcucugc

SEQ ID NO: 1066675 - RNA, 20 nt, Human
uguugggcaagcuacaugac

SEQ ID NO: 1066676 - RNA, 21 nt, Human
uguuugcucaggucaccaugu

SEQ ID NO: 1066677 - RNA, 23 nt, Human
uuaaguuaaagaggcucucugag

SEQ ID NO: 1066678 - RNA, 20 nt, Human
uuacgcuagggagagaaagu

SEQ ID NO: 1066679 - RNA, 18 nt, Human
uuaguagagauaggguuu

SEQ ID NO: 1066680 - RNA, 22 nt, Human
uuaguagagauaggguuucacc

SEQ ID NO: 1066681 - RNA, 24 nt, Human
uuaguagagauaggguuucaccau

SEQ ID NO: 1066682 - RNA, 18 nt, Human
uuccaggucccggagcac

SEQ ID NO: 1066683 - RNA, 24 nt, Human
uuccaugcugcuggguucuuauuu

SEQ ID NO: 1066684 - RNA, 23 nt, Human
uucccaguugaaaggugguguug

SEQ ID NO: 1066685 - RNA, 19 nt, Human
uucucauaaaaugagaaau

SEQ ID NO: 1066686 - RNA, 21 nt, Human
uuuaccaccacuccucaaaug

SEQ ID NO: 1066687 - RNA, 19 nt, Human
uuucaccauguuagccagg

SEQ ID NO: 1066688 - RNA, 20 nt, Human
uuucaccauguuagccagga

SEQ ID NO: 1066689 - RNA, 21 nt, Human
uuuugggucuuuggagaacaa

SEQ ID NO: 1066690 - RNA, 20 nt, Human
uuuuguauuuuuaguagaga

SEQ ID NO: 1066691 - RNA, 18 nt, Human
uuuuguuuguuuuuuuaa

SEQ ID NO: 1066692 - RNA, 24 nt, Human
uuuuuaguagagauaggguuucac

SEQ ID NO: 1066693 - RNA, 21 nt, Human
uuuuuguauuuuuaguagaga

SEQ ID NO: 1066694 - RNA, 27 nt, Human
uaguaugucccuuucucuuagaagcuc

SEQ ID NO: 1066695 - RNA, 21 nt, Human
uauauuugcugccucacccua

SEQ ID NO: 1066696 - RNA, 21 nt, Human
acagccugaacuuccccagca

SEQ ID NO: 1066697 - RNA, 18 nt, Human
gauccuguguuggcagag

SEQ ID NO: 1066698 - RNA, 19 nt, Human
gccugaacuuccccagcac

SEQ ID NO: 1066699 - RNA, 21 nt, Human
uggcagaggcguuguaacugu

SEQ ID NO: 1066700 - RNA, 23 nt, Human
acacacacgaccaguaccuuaua

SEQ ID NO: 1066701 - RNA, 20 nt, Human
acccucauacugaacucugg

SEQ ID NO: 1066702 - RNA, 21 nt, Human
acccucauacugaacucuggc

SEQ ID NO: 1066703 - RNA, 22 nt, Human
aucaaggacaacuccuguggca

SEQ ID NO: 1066704 - RNA, 23 nt, Human
ccagaaagaaccacuaacggggc

SEQ ID NO: 1066705 - RNA, 25 nt, Human
cccucauacugaacucuggcuucau

SEQ ID NO: 1066706 - RNA, 22 nt, Human
ccucauacugaacucuggcuuc

SEQ ID NO: 1066707 - RNA, 23 nt, Human
ccugaccaggugucuuucucacc

SEQ ID NO: 1066708 - RNA, 21 nt, Human
uccacuaacacacacacgacc

SEQ ID NO: 1066709 - RNA, 21 nt, Human
uccagaaagaaccacuauuac

SEQ ID NO: 1066710 - RNA, 22 nt, Human
uccagaaagaaccacuauuacc

SEQ ID NO: 1066711 - RNA, 22 nt, Human
ucucacccacugguuucaacaa

SEQ ID NO: 1066712 - RNA, 22 nt, Human
ucuuuagucugacaccaugggc

SEQ ID NO: 1066713 - RNA, 18 nt, Human
ugacaccaugggcgagcc

SEQ ID NO: 1066714 - RNA, 22 nt, Human
ugucugugugacucccugucug

SEQ ID NO: 1066715 - RNA, 25 nt, Human
uucacaauuuuuauggauuuaucca

SEQ ID NO: 1066716 - RNA, 19 nt, Human
aaaaaaacacagauuuaaa

SEQ ID NO: 1066717 - RNA, 22 nt, Human
aaauguccuaccgaauacaucc

SEQ ID NO: 1066718 - RNA, 20 nt, Human
aagcaugcuuggcacaccag

SEQ ID NO: 1066719 - RNA, 19 nt, Human
aaggcuuuucauucaaccg

SEQ ID NO: 1066720 - RNA, 23 nt, Human
aaucagcucuuccugaauccaga

SEQ ID NO: 1066721 - RNA, 22 nt, Human
acaaaagaaaauuggggauugg

SEQ ID NO: 1066722 - RNA, 20 nt, Human
agaagaaaaucagagaaaac

SEQ ID NO: 1066723 - RNA, 21 nt, Human
agaagaaaaucagagaaaacc

SEQ ID NO: 1066724 - RNA, 19 nt, Human
agagaagaaaaucagagaa

SEQ ID NO: 1066725 - RNA, 23 nt, Human
agagaggcuucucugucuuaaaa

SEQ ID NO: 1066726 - RNA, 23 nt, Human
agaggaagagaagaaaaucagag

SEQ ID NO: 1066727 - RNA, 20 nt, Human
agcaaaaauuaacuccccau

SEQ ID NO: 1066728 - RNA, 21 nt, Human
aggaagagaagaaaaucagag

SEQ ID NO: 1066729 - RNA, 22 nt, Human
aggacggagggaguggaaaaaa

SEQ ID NO: 1066730 - RNA, 22 nt, Human
agggaguggaaaaaaacacaga

SEQ ID NO: 1066731 - RNA, 21 nt, Human
aggguaccuucaccugcacug

SEQ ID NO: 1066732 - RNA, 19 nt, Human
aggugguggagggaggccu

SEQ ID NO: 1066733 - RNA, 22 nt, Human
augcuuuuucagacccuuucuc

SEQ ID NO: 1066734 - RNA, 24 nt, Human
auugugugugugugugugugugug

SEQ ID NO: 1066735 - RNA, 20 nt, Human
cacccucaaaaaccucagga

SEQ ID NO: 1066736 - RNA, 18 nt, Human
cacugccacagucacccg

SEQ ID NO: 1066737 - RNA, 22 nt, Human
cagcaagagauguucaaacuaa

SEQ ID NO: 1066738 - RNA, 18 nt, Human
cagcaggaaaugccacgg

SEQ ID NO: 1066739 - RNA, 19 nt, Human
cagcucaaugccaggaaua

SEQ ID NO: 1066740 - RNA, 23 nt, Human
caggaaaugccacgggcagauua

SEQ ID NO: 1066741 - RNA, 20 nt, Human
caggugucaggggucaaugu

SEQ ID NO: 1066742 - RNA, 21 nt, Human
cagucacccggucucgcccca

SEQ ID NO: 1066743 - RNA, 24 nt, Human
caguuucugaguaccuacuauggg

SEQ ID NO: 1066744 - RNA, 22 nt, Human
caucagaaaugcccaaugacag

SEQ ID NO: 1066745 - RNA, 18 nt, Human
ccagaaaagcacaucaga

SEQ ID NO: 1066746 - RNA, 27 nt, Human
ccagaaaagcacaucagaaaugcccaa

SEQ ID NO: 1066747 - RNA, 22 nt, Human
ccaggacggagggaguggaaaa

SEQ ID NO: 1066748 - RNA, 21 nt, Human
ccaggucacccucaaaaaccu

SEQ ID NO: 1066749 - RNA, 21 nt, Human
cccaaugacagaccacagcca

SEQ ID NO: 1066750 - RNA, 24 nt, Human
cccaaugacagaccacaggguacc

SEQ ID NO: 1066751 - RNA, 18 nt, Human
cccacaaagucuaccccc

SEQ ID NO: 1066752 - RNA, 20 nt, Human
cccacaaagucuacccccgu

SEQ ID NO: 1066753 - RNA, 21 nt, Human
ccccagguaaucaaccuuuac

SEQ ID NO: 1066754 - RNA, 22 nt, Human
ccccugggagacugagcuucag

SEQ ID NO: 1066755 - RNA, 25 nt, Human
ccccugggagacugagcuucaguuu

SEQ ID NO: 1066756 - RNA, 24 nt, Human
cccuaagcugcugucagagggccc

SEQ ID NO: 1066757 - RNA, 25 nt, Human
cccuaagcugcugucagagggcccu

SEQ ID NO: 1066758 - RNA, 20 nt, Human
cccuguguucucaaguucag

SEQ ID NO: 1066759 - RNA, 18 nt, Human
ccgaagucgcagcugcgc

SEQ ID NO: 1066760 - RNA, 18 nt, Human
ccggugcugggcuuggca

SEQ ID NO: 1066761 - RNA, 19 nt, Human
ccucaaaaaccucaggagg

SEQ ID NO: 1066762 - RNA, 26 nt, Human
cggacuaacuggcgaauuucccacaa

SEQ ID NO: 1066763 - RNA, 20 nt, Human
cuacuucacucuagucuuag

SEQ ID NO: 1066764 - RNA, 20 nt, Human
cuccuauucccaccugcacc

SEQ ID NO: 1066765 - RNA, 19 nt, Human
cuugucagcauccugugcu

SEQ ID NO: 1066766 - RNA, 21 nt, Human
gaaaaccuucuauugaugccg

SEQ ID NO: 1066767 - RNA, 19 nt, Human
gaagagaagaaaaucagag

SEQ ID NO: 1066768 - RNA, 20 nt, Human
gaggaagagaagaaaaucag

SEQ ID NO: 1066769 - RNA, 23 nt, Human
gaggaagagaagaaaaucagaga

SEQ ID NO: 1066770 - RNA, 21 nt, Human
gaggcccagaggaguggcugc

SEQ ID NO: 1066771 - RNA, 23 nt, Human
gcaaaaauuaacuccccauggca

SEQ ID NO: 1066772 - RNA, 24 nt, Human
gcagacagccgaagucgcagcugc

SEQ ID NO: 1066773 - RNA, 22 nt, Human
gcucuggcaucuccuauuccca

SEQ ID NO: 1066774 - RNA, 28 nt, Human
ggcaauaaagaacaaggugguggaggga

SEQ ID NO: 1066775 - RNA, 20 nt, Human
ggggauugguaagaaagccc

SEQ ID NO: 1066776 - RNA, 21 nt, Human
guaaagagaauacagcgucuc

SEQ ID NO: 1066777 - RNA, 23 nt, Human
gucagagggcccuguguucucaa

SEQ ID NO: 1066778 - RNA, 21 nt, Human
gugugugugugugugugugug

SEQ ID NO: 1066779 - RNA, 21 nt, Human
gugugugugugugugugugug

SEQ ID NO: 1066780 - RNA, 21 nt, Human
gugugugugugugugugugug

SEQ ID NO: 1066781 - RNA, 19 nt, Human
uaaaugaaauguccuaccg

SEQ ID NO: 1066782 - RNA, 21 nt, Human
uaccugacagcugugacuucc

SEQ ID NO: 1066783 - RNA, 19 nt, Human
uaccuucaccugcacugcc

SEQ ID NO: 1066784 - RNA, 19 nt, Human
uacgaugaagaauugggga

SEQ ID NO: 1066785 - RNA, 24 nt, Human
uaggaucuguguuaugcuugcagg

SEQ ID NO: 1066786 - RNA, 21 nt, Human
uauccugauauaaaugaaaug

SEQ ID NO: 1066787 - RNA, 20 nt, Human
uaugcuugcaggugucaggg

SEQ ID NO: 1066788 - RNA, 18 nt, Human
uauucccaccugcaccau

SEQ ID NO: 1066789 - RNA, 19 nt, Human
ucaaggcuuuucauucaac

SEQ ID NO: 1066790 - RNA, 18 nt, Human
ucccuaagcugcugucag

SEQ ID NO: 1066791 - RNA, 23 nt, Human
uccucagcuaaagcagcucuggc

SEQ ID NO: 1066792 - RNA, 21 nt, Human
uccugaauccagaaaagcaca

SEQ ID NO: 1066793 - RNA, 25 nt, Human
uccugauauaaaugaaauguccuac

SEQ ID NO: 1066794 - RNA, 18 nt, Human
ucucaggauacugaugga

SEQ ID NO: 1066795 - RNA, 19 nt, Human
ucugaguaccuacuauggg

SEQ ID NO: 1066796 - RNA, 18 nt, Human
ucuggccagucuccuggc

SEQ ID NO: 1066797 - RNA, 23 nt, Human
ugaaagagagcugaaucagccaa

SEQ ID NO: 1066798 - RNA, 21 nt, Human
ugaaauggaaggauucugcca

SEQ ID NO: 1066799 - RNA, 23 nt, Human
ugaaucagccaauauccugauau

SEQ ID NO: 1066800 - RNA, 18 nt, Human
ugacuguuugcuuuccuc

SEQ ID NO: 1066801 - RNA, 20 nt, Human
ugagaagguccaggguaccu

SEQ ID NO: 1066802 - RNA, 23 nt, Human
ugagcacugcugacuguuugcuu

SEQ ID NO: 1066803 - RNA, 21 nt, Human
ugagccuguugggagagaugc

SEQ ID NO: 1066804 - RNA, 26 nt, Human
ugauuuguaaagagaauacagcgucu

SEQ ID NO: 1066805 - RNA, 18 nt, Human
ugccaaucuggaagggau

SEQ ID NO: 1066806 - RNA, 19 nt, Human
ugccacagucacccggucu

SEQ ID NO: 1066807 - RNA, 18 nt, Human
ugcccaaugacagaccac

SEQ ID NO: 1066808 - RNA, 23 nt, Human
uggaucauauagcccuccaauca

SEQ ID NO: 1066809 - RNA, 18 nt, Human
uggcaucuccuauuccca

SEQ ID NO: 1066810 - RNA, 19 nt, Human
uggcuccugagagaggcuu

SEQ ID NO: 1066811 - RNA, 21 nt, Human
ugggacaagaugcugauauug

SEQ ID NO: 1066812 - RNA, 21 nt, Human
ugguaagaaagcccagccuga

SEQ ID NO: 1066813 - RNA, 23 nt, Human
ugucagcauccugugcuugaggc

SEQ ID NO: 1066814 - RNA, 20 nt, Human
uguguguguguguguguaug

SEQ ID NO: 1066815 - RNA, 18 nt, Human
ugugugugugugugugug

SEQ ID NO: 1066816 - RNA, 18 nt, Human
ugugugugugugugugug

SEQ ID NO: 1066817 - RNA, 18 nt, Human
ugugugugugugugugug

SEQ ID NO: 1066818 - RNA, 18 nt, Human
ugugugugugugugugug

SEQ ID NO: 1066819 - RNA, 18 nt, Human
ugugugugugugugugug

SEQ ID NO: 1066820 - RNA, 18 nt, Human
ugugugugugugugugug

SEQ ID NO: 1066821 - RNA, 18 nt, Human
ugugugugugugugugug

SEQ ID NO: 1066822 - RNA, 18 nt, Human
ugugugugugugugugug

SEQ ID NO: 1066823 - RNA, 18 nt, Human
ugugugugugugugugug

SEQ ID NO: 1066824 - RNA, 18 nt, Human
ugugugugugugugugug

SEQ ID NO: 1066825 - RNA, 20 nt, Human
ugugugugugugugugugug

SEQ ID NO: 1066826 - RNA, 21 nt, Human
ugugugugugugugugugugu

SEQ ID NO: 1066827 - RNA, 21 nt, Human
ugugugugugugugugugugu

SEQ ID NO: 1066828 - RNA, 21 nt, Human
ugugugugugugugugugugu

SEQ ID NO: 1066829 - RNA, 21 nt, Human
ugugugugugugugugugugu

SEQ ID NO: 1066830 - RNA, 21 nt, Human
ugugugugugugugugugugu

SEQ ID NO: 1066831 - RNA, 21 nt, Human
ugugugugugugugugugugu

SEQ ID NO: 1066832 - RNA, 21 nt, Human
ugugugugugugugugugugu

SEQ ID NO: 1066833 - RNA, 21 nt, Human
ugugugugugugugugugugu

SEQ ID NO: 1066834 - RNA, 21 nt, Human
ugugugugugugugugugugu

SEQ ID NO: 1066835 - RNA, 21 nt, Human
ugugugugugugugugugugu

SEQ ID NO: 1066836 - RNA, 21 nt, Human
ugugugugugugugugugugu

SEQ ID NO: 1066837 - RNA, 21 nt, Human
ugugugugugugugugugugu

SEQ ID NO: 1066838 - RNA, 21 nt, Human
ugugugugugugugugugugu

SEQ ID NO: 1066839 - RNA, 21 nt, Human
ugugugugugugugugugugu

SEQ ID NO: 1066840 - RNA, 21 nt, Human
ugugugugugugugugugugu

SEQ ID NO: 1066841 - RNA, 21 nt, Human
ugugugugugugugugugugu

SEQ ID NO: 1066842 - RNA, 22 nt, Human
ugugugugugugugugugugua

SEQ ID NO: 1066843 - RNA, 22 nt, Human
ugugugugugugugugugugug

SEQ ID NO: 1066844 - RNA, 22 nt, Human
ugugugugugugugugugugug

SEQ ID NO: 1066845 - RNA, 22 nt, Human
ugugugugugugugugugugug

SEQ ID NO: 1066846 - RNA, 22 nt, Human
ugugugugugugugugugugug

SEQ ID NO: 1066847 - RNA, 21 nt, Human
uucccuaagcugcugucagag

SEQ ID NO: 1066848 - RNA, 18 nt, Human
uucucccaggucacccuc

SEQ ID NO: 1066849 - RNA, 19 nt, Human
uugcaggugucagggguca

SEQ ID NO: 1066850 - RNA, 20 nt, Human
uugcaggugucaggggucaa

SEQ ID NO: 1066851 - RNA, 24 nt, Human
uugcuuuccucagcuaaagcagcu

SEQ ID NO: 1066852 - RNA, 22 nt, Human
augguguucuuaaagugaacac

SEQ ID NO: 1066853 - RNA, 20 nt, Human
uggccugagcaguuucaugg

SEQ ID NO: 1066854 - RNA, 21 nt, Human
aaaaugccaaguccacaaaug

SEQ ID NO: 1066855 - RNA, 19 nt, Human
aaagcaaaagagauccuga

SEQ ID NO: 1066856 - RNA, 26 nt, Human
aacaaaacaagugcuuaaaaaaaaaa

SEQ ID NO: 1066857 - RNA, 18 nt, Human
aagagauccugacaugug

SEQ ID NO: 1066858 - RNA, 18 nt, Human
aagcaaaagagauccuga

SEQ ID NO: 1066859 - RNA, 20 nt, Human
aagcaaaagagauccugaca

SEQ ID NO: 1066860 - RNA, 24 nt, Human
aagcaaaagagauccugacaugug

SEQ ID NO: 1066861 - RNA, 18 nt, Human
acaugugaaaccaauaca

SEQ ID NO: 1066862 - RNA, 19 nt, Human
acguggugcgagggacugg

SEQ ID NO: 1066863 - RNA, 24 nt, Human
acucccacgcaacagggcagaggu

SEQ ID NO: 1066864 - RNA, 26 nt, Human
agaaagcggagccaaaaggggcggga

SEQ ID NO: 1066865 - RNA, 21 nt, Human
agcagcaacguuuuuuuuuuu

SEQ ID NO: 1066866 - RNA, 19 nt, Human
agcugggggcgcggccagg

SEQ ID NO: 1066867 - RNA, 20 nt, Human
caaaacaagugcuuaaaaaa

SEQ ID NO: 1066868 - RNA, 22 nt, Human
caaaagcagaguuagcauuuuc

SEQ ID NO: 1066869 - RNA, 22 nt, Human
caaaaugccaaguccacaaaug

SEQ ID NO: 1066870 - RNA, 19 nt, Human
cacccccaagucuagcagc

SEQ ID NO: 1066871 - RNA, 19 nt, Human
cacucccacgcaacagggc

SEQ ID NO: 1066872 - RNA, 23 nt, Human
cagcugggggcgcggccaggagg

SEQ ID NO: 1066873 - RNA, 23 nt, Human
cccacugugcucugaauacaguc

SEQ ID NO: 1066874 - RNA, 19 nt, Human
ccucacaggcaccugccgc

SEQ ID NO: 1066875 - RNA, 21 nt, Human
ccucacaggcaccugccgccu

SEQ ID NO: 1066876 - RNA, 21 nt, Human
cgccucggcuggcagggagcu

SEQ ID NO: 1066877 - RNA, 19 nt, Human
cggcaggaaugggcgcagc

SEQ ID NO: 1066878 - RNA, 26 nt, Human
cggcggcaggaaugggcgcagcggag

SEQ ID NO: 1066879 - RNA, 25 nt, Human
cggggccgacuagcuugaagacgcg

SEQ ID NO: 1066880 - RNA, 21 nt, Human
cucaaggcacagaguagaaga

SEQ ID NO: 1066881 - RNA, 25 nt, Human
cucacaggcaccugccgccugucuc

SEQ ID NO: 1066882 - RNA, 20 nt, Human
cugacggcggugggcgcucc

SEQ ID NO: 1066883 - RNA, 24 nt, Human
cuuugugacagagcuccugaguug

SEQ ID NO: 1066884 - RNA, 23 nt, Human
gagcuccugagugugugcagccc

SEQ ID NO: 1066885 - RNA, 18 nt, Human
gagggcacguggugcgag

SEQ ID NO: 1066886 - RNA, 20 nt, Human
gccaucuuggugggugaguu

SEQ ID NO: 1066887 - RNA, 20 nt, Human
gcggugggcgcuccggggcu

SEQ ID NO: 1066888 - RNA, 20 nt, Human
gcugcggugcgcagggucuc

SEQ ID NO: 1066889 - RNA, 22 nt, Human
ggagccaaaaggggcgggagcu

SEQ ID NO: 1066890 - RNA, 21 nt, Human
ggcagagguucgccccgccuc

SEQ ID NO: 1066891 - RNA, 19 nt, Human
gggcgcagcggagagggcu

SEQ ID NO: 1066892 - RNA, 19 nt, Human
uaaagcagcggcgcuccuc

SEQ ID NO: 1066893 - RNA, 18 nt, Human
uaacaggggaggcgcgac

SEQ ID NO: 1066894 - RNA, 19 nt, Human
uaagaaguccaacauccuc

SEQ ID NO: 1066895 - RNA, 21 nt, Human
uaaguggcacagggaauggaa

SEQ ID NO: 1066896 - RNA, 28 nt, Human
ugaauacagucucugcagcuccagugug

SEQ ID NO: 1066897 - RNA, 18 nt, Human
ugagugugugcagccccc

SEQ ID NO: 1066898 - RNA, 23 nt, Human
ugcacaaagcucaaggcacagag

SEQ ID NO: 1066899 - RNA, 26 nt, Human
ugccaaguccacaaaugaacaaaaca

SEQ ID NO: 1066900 - RNA, 18 nt, Human
ugcgagggacuggccgcg

SEQ ID NO: 1066901 - RNA, 19 nt, Human
ugcuacagggccacaccug

SEQ ID NO: 1066902 - RNA, 21 nt, Human
uggaaagggcagcugggggcg

SEQ ID NO: 1066903 - RNA, 23 nt, Human
uggcagggagcuaacaggggagg

SEQ ID NO: 1066904 - RNA, 19 nt, Human
uggcccccggcacccgccc

SEQ ID NO: 1066905 - RNA, 21 nt, Human
ugggagaggcagccguaaagc

SEQ ID NO: 1066906 - RNA, 19 nt, Human
ugugaaaccaauacaccaa

SEQ ID NO: 1066907 - RNA, 21 nt, Human
uuucuauuuucccacuuaauu

SEQ ID NO: 1066908 - RNA, 18 nt, Human
uuuuuuaguuuuuguuuu

SEQ ID NO: 1066909 - RNA, 25 nt, Human
aaauccuccacgaacccacuacucu

SEQ ID NO: 1066910 - RNA, 20 nt, Human
aaccaaaagccuaaagacaa

SEQ ID NO: 1066911 - RNA, 23 nt, Human
aggcagggguggugggagggugc

SEQ ID NO: 1066912 - RNA, 18 nt, Human
agggagccaucugcuugg

SEQ ID NO: 1066913 - RNA, 21 nt, Human
agucaugggggaugggagaga

SEQ ID NO: 1066914 - RNA, 21 nt, Human
cagcaagagugaaggcauggg

SEQ ID NO: 1066915 - RNA, 23 nt, Human
caggagaggcuguuguccugaug

SEQ ID NO: 1066916 - RNA, 20 nt, Human
ccuccacgaacccacuacuc

SEQ ID NO: 1066917 - RNA, 18 nt, Human
cuggcaggcagggguggu

SEQ ID NO: 1066918 - RNA, 23 nt, Human
cuuggcccuguguuucucagcga

SEQ ID NO: 1066919 - RNA, 19 nt, Human
gcagcuaggaggaggcugg

SEQ ID NO: 1066920 - RNA, 18 nt, Human
gcugguccugagugccag

SEQ ID NO: 1066921 - RNA, 19 nt, Human
ggugggagggugcucugag

SEQ ID NO: 1066922 - RNA, 23 nt, Human
guccugaugcaggggucugggag

SEQ ID NO: 1066923 - RNA, 22 nt, Human
uccacgaacccacuacucuaaa

SEQ ID NO: 1066924 - RNA, 18 nt, Human
uccuccacgaacccacua

SEQ ID NO: 1066925 - RNA, 20 nt, Human
uccugagugccaggagaggc

SEQ ID NO: 1066926 - RNA, 23 nt, Human
ugaaggcauggggucagagccga

SEQ ID NO: 1066927 - RNA, 19 nt, Human
ugaugcaggggucugggag

SEQ ID NO: 1066928 - RNA, 24 nt, Human
ugcaaaccaaaagccuaaagacaa

SEQ ID NO: 1066929 - RNA, 19 nt, Human
uggcuggcacuggcaggca

SEQ ID NO: 1066930 - RNA, 26 nt, Human
ugggggaugggagagagaagggagcc

SEQ ID NO: 1066931 - RNA, 26 nt, Human
aaaauucucugcacacaaauccuuuc

SEQ ID NO: 1066932 - RNA, 18 nt, Human
uauaaaaaaauucucugc

SEQ ID NO: 1066933 - RNA, 22 nt, Human
aacuucuuuccaauauauucua

SEQ ID NO: 1066934 - RNA, 23 nt, Human
aacuucuuuccaauauauucuac

SEQ ID NO: 1066935 - RNA, 20 nt, Human
agagcaaauccaacuuaaaa

SEQ ID NO: 1066936 - RNA, 19 nt, Human
cuuucugcuggacucgcuc

SEQ ID NO: 1066937 - RNA, 18 nt, Human
gacucgcucacaggcugc

SEQ ID NO: 1066938 - RNA, 21 nt, Human
gcaguugaaauccucugguuc

SEQ ID NO: 1066939 - RNA, 20 nt, Human
ucacugcagcuuucugcugg

SEQ ID NO: 1066940 - RNA, 23 nt, Human
ucacugcagcuuucugcuggacu

SEQ ID NO: 1066941 - RNA, 27 nt, Human
ucacugcagcuuucugcugggggcccu

SEQ ID NO: 1066942 - RNA, 24 nt, Human
uccaacuuaaaaaaaaaacuugcu

SEQ ID NO: 1066943 - RNA, 18 nt, Human
ucucggcugagacgagcc

SEQ ID NO: 1066944 - RNA, 21 nt, Human
ugggaagagcaaauccaacuu

SEQ ID NO: 1066945 - RNA, 24 nt, Human
uuccaaaguuuuaaaaaaugaggc

SEQ ID NO: 1066946 - RNA, 20 nt, Human
aaacaaaggccuauagccuu

SEQ ID NO: 1066947 - RNA, 22 nt, Human
aagcuucugagguggggaacag

SEQ ID NO: 1066948 - RNA, 23 nt, Human
aagcuucugagguggggaacagu

SEQ ID NO: 1066949 - RNA, 26 nt, Human
aaggaagcugaguaaugaaugagaug

SEQ ID NO: 1066950 - RNA, 21 nt, Human
acccaaucuggaaagaaggcc

SEQ ID NO: 1066951 - RNA, 19 nt, Human
acuauccugguggcgcuag

SEQ ID NO: 1066952 - RNA, 24 nt, Human
acucuggauucugcuguaaagaga

SEQ ID NO: 1066953 - RNA, 25 nt, Human
acugcuuccuacaaacaaaggccua

SEQ ID NO: 1066954 - RNA, 18 nt, Human
agacaauauuucugcuaa

SEQ ID NO: 1066955 - RNA, 18 nt, Human
agcccccaguccucccag

SEQ ID NO: 1066956 - RNA, 18 nt, Human
agccguuggaagauagca

SEQ ID NO: 1066957 - RNA, 21 nt, Human
agccucucagccucguugccu

SEQ ID NO: 1066958 - RNA, 18 nt, Human
agcuacugagugaguagu

SEQ ID NO: 1066959 - RNA, 21 nt, Human
agcuacugagugaguaguguu

SEQ ID NO: 1066960 - RNA, 23 nt, Human
aggcagaaccuuggauucucuuu

SEQ ID NO: 1066961 - RNA, 20 nt, Human
aggcagaguugcaaaugggc

SEQ ID NO: 1066962 - RNA, 24 nt, Human
aggcagaguugcaaaugggcugag

SEQ ID NO: 1066963 - RNA, 20 nt, Human
agggaacagccugcuugucu

SEQ ID NO: 1066964 - RNA, 22 nt, Human
aguaggcacagcugccucagga

SEQ ID NO: 1066965 - RNA, 19 nt, Human
agugaagcuugaauguaau

SEQ ID NO: 1066966 - RNA, 19 nt, Human
agugcugugguuacagcug

SEQ ID NO: 1066967 - RNA, 19 nt, Human
aguggucucugcccagccu

SEQ ID NO: 1066968 - RNA, 19 nt, Human
aguggucucugcccagccu

SEQ ID NO: 1066969 - RNA, 24 nt, Human
agugugcaaugggcuuccgaggau

SEQ ID NO: 1066970 - RNA, 22 nt, Human
auucagguucaccaaacccaau

SEQ ID NO: 1066971 - RNA, 23 nt, Human
auugugugaaaagaaaaauacua

SEQ ID NO: 1066972 - RNA, 19 nt, Human
caagagaacagaggcagag

SEQ ID NO: 1066973 - RNA, 25 nt, Human
caagcaguccucuuacccaugguca

SEQ ID NO: 1066974 - RNA, 20 nt, Human
cacaguuauuuucuggagac

SEQ ID NO: 1066975 - RNA, 19 nt, Human
cacgugcaugggaggaggc

SEQ ID NO: 1066976 - RNA, 24 nt, Human
cacuauaucuaucauuuguuuuug

SEQ ID NO: 1066977 - RNA, 23 nt, Human
cacuccaguggucucugcccagc

SEQ ID NO: 1066978 - RNA, 19 nt, Human
cacugcuuccuacaaacaa

SEQ ID NO: 1066979 - RNA, 23 nt, Human
cagaggaagccaaguuuuccuua

SEQ ID NO: 1066980 - RNA, 18 nt, Human
caggccagagaagcccaa

SEQ ID NO: 1066981 - RNA, 22 nt, Human
cagggaacagccugcuugucuu

SEQ ID NO: 1066982 - RNA, 22 nt, Human
caguggucucugcccagccucu

SEQ ID NO: 1066983 - RNA, 19 nt, Human
cauugugaccuacacgguc

SEQ ID NO: 1066984 - RNA, 22 nt, Human
ccaaacagaaugcaagagaaca

SEQ ID NO: 1066985 - RNA, 20 nt, Human
ccaccuucuauuucauacca

SEQ ID NO: 1066986 - RNA, 23 nt, Human
ccaggaagguaaacuacaaucca

SEQ ID NO: 1066987 - RNA, 23 nt, Human
ccauucagguucaccaaacccaa

SEQ ID NO: 1066988 - RNA, 19 nt, Human
cccaggauaugcugaggcc

SEQ ID NO: 1066989 - RNA, 24 nt, Human
cccauggucaucguuucuccaccu

SEQ ID NO: 1066990 - RNA, 19 nt, Human
ccccagacccagccggccc

SEQ ID NO: 1066991 - RNA, 19 nt, Human
ccgcccaguuaguuccaug

SEQ ID NO: 1066992 - RNA, 20 nt, Human
ccgccgccuccgggccgucc

SEQ ID NO: 1066993 - RNA, 21 nt, Human
ccggucggucaggcuuucucu

SEQ ID NO: 1066994 - RNA, 22 nt, Human
ccuauaaugggacagagaggac

SEQ ID NO: 1066995 - RNA, 23 nt, Human
ccuauagccuucuuagaucugcc

SEQ ID NO: 1066996 - RNA, 20 nt, Human
ccucaggaucuccaacccag

SEQ ID NO: 1066997 - RNA, 20 nt, Human
ccuuggcacaagcaguccuc

SEQ ID NO: 1066998 - RNA, 19 nt, Human
cguuggaagauagcacagg

SEQ ID NO: 1066999 - RNA, 19 nt, Human
cucauugugaccuacacgg

SEQ ID NO: 1067000 - RNA, 21 nt, Human
cugagcccgagccccagaccc

SEQ ID NO: 1067001 - RNA, 19 nt, Human
cugcugccuauuuagcacc

SEQ ID NO: 1067002 - RNA, 25 nt, Human
cuugggccaccugcagaagguggcu

SEQ ID NO: 1067003 - RNA, 22 nt, Human
cuuucucucucucccgcccccc

SEQ ID NO: 1067004 - RNA, 21 nt, Human
gaagacguauaacgauccuuc

SEQ ID NO: 1067005 - RNA, 20 nt, Human
gagggaugagcagaggggaa

SEQ ID NO: 1067006 - RNA, 18 nt, Human
gcaaaugggcugagggag

SEQ ID NO: 1067007 - RNA, 26 nt, Human
ggauaugcugaggccuuugguuucau

SEQ ID NO: 1067008 - RNA, 18 nt, Human
ggaugagcagaggggaac

SEQ ID NO: 1067009 - RNA, 24 nt, Human
gggcaggaagcuucugaggugggg

SEQ ID NO: 1067010 - RNA, 20 nt, Human
gucaucguuucuccaccagg

SEQ ID NO: 1067011 - RNA, 19 nt, Human
guccgaucuugguucuugg

SEQ ID NO: 1067012 - RNA, 20 nt, Human
guggucucugcccagccucu

SEQ ID NO: 1067013 - RNA, 24 nt, Human
uacagacaauauuucugcuaacua

SEQ ID NO: 1067014 - RNA, 25 nt, Human
uaccccagaaggcauucaggccaga

SEQ ID NO: 1067015 - RNA, 20 nt, Human
uagcuggccauugguuggca

SEQ ID NO: 1067016 - RNA, 22 nt, Human
uaggaaacuaaagggcaaccaa

SEQ ID NO: 1067017 - RNA, 19 nt, Human
uagguaacagcccccaguc

SEQ ID NO: 1067018 - RNA, 24 nt, Human
uagguaacagcccccaguccuccc

SEQ ID NO: 1067019 - RNA, 19 nt, Human
uaugacaacauuucacucc

SEQ ID NO: 1067020 - RNA, 19 nt, Human
uaugguggaggaugucuga

SEQ ID NO: 1067021 - RNA, 19 nt, Human
ucaaacagagauaaugagc

SEQ ID NO: 1067022 - RNA, 18 nt, Human
ucaaagguagucaugugu

SEQ ID NO: 1067023 - RNA, 23 nt, Human
ucaaagguagucaugugugaauu

SEQ ID NO: 1067024 - RNA, 21 nt, Human
ucagcgagacuuucacauagg

SEQ ID NO: 1067025 - RNA, 22 nt, Human
ucaggccagagaagcccaaaag

SEQ ID NO: 1067026 - RNA, 22 nt, Human
uccaacccaggcuuccauugcc

SEQ ID NO: 1067027 - RNA, 22 nt, Human
ucccaggauaugcugaggccuu

SEQ ID NO: 1067028 - RNA, 19 nt, Human
ucccagugguuggaagccu

SEQ ID NO: 1067029 - RNA, 19 nt, Human
uccgcgcucaccgccaggg

SEQ ID NO: 1067030 - RNA, 22 nt, Human
uccucaaaaucugguuuuagca

SEQ ID NO: 1067031 - RNA, 22 nt, Human
uccucaucaccaagggcuucau

SEQ ID NO: 1067032 - RNA, 25 nt, Human
ucuaacuaauuacuuuucauucuaa

SEQ ID NO: 1067033 - RNA, 22 nt, Human
ucucugggaccauucuucuggg

SEQ ID NO: 1067034 - RNA, 21 nt, Human
ucucugggcaggaagcuucug

SEQ ID NO: 1067035 - RNA, 18 nt, Human
ucugccaucaaaguagag

SEQ ID NO: 1067036 - RNA, 25 nt, Human
ucuucugggcucaucugccuagcuu

SEQ ID NO: 1067037 - RNA, 19 nt, Human
ugaggagggaugagcagag

SEQ ID NO: 1067038 - RNA, 18 nt, Human
ugcaagagaacagaggca

SEQ ID NO: 1067039 - RNA, 24 nt, Human
ugcuguaccaguuucugaggcugu

SEQ ID NO: 1067040 - RNA, 19 nt, Human
uggaagauagcacagggaa

SEQ ID NO: 1067041 - RNA, 18 nt, Human
uggaagccaaucagagaa

SEQ ID NO: 1067042 - RNA, 19 nt, Human
uggacaaguggauuugguc

SEQ ID NO: 1067043 - RNA, 21 nt, Human
uggaggcagaagcaaugagga

SEQ ID NO: 1067044 - RNA, 20 nt, Human
ugguaauggucagccugcca

SEQ ID NO: 1067045 - RNA, 18 nt, Human
uggucucugcccagccuc

SEQ ID NO: 1067046 - RNA, 20 nt, Human
uggugugaaagugauguaug

SEQ ID NO: 1067047 - RNA, 18 nt, Human
ugucugaaugaggaggga

SEQ ID NO: 1067048 - RNA, 26 nt, Human
ugugccuuucuauaggggauggcugu

SEQ ID NO: 1067049 - RNA, 21 nt, Human
uguugcauauggaaauacccc

SEQ ID NO: 1067050 - RNA, 22 nt, Human
uguugggggucucugauuccuc

SEQ ID NO: 1067051 - RNA, 22 nt, Human
uuacguggaggcagaagcaaug

SEQ ID NO: 1067052 - RNA, 21 nt, Human
uuaguuccaugcugaaauguu

SEQ ID NO: 1067053 - RNA, 18 nt, Human
uucagucgucugccauca

SEQ ID NO: 1067054 - RNA, 22 nt, Human
uucucugggaccauucuucugg

SEQ ID NO: 1067055 - RNA, 22 nt, Human
uuggaauaacgauuuccagggc

SEQ ID NO: 1067056 - RNA, 23 nt, Human
uuuaaauauucuguccuuccagg

SEQ ID NO: 1067057 - RNA, 22 nt, Human
uuuggucacugaaaucgucugg

SEQ ID NO: 1067058 - RNA, 18 nt, Human
aacuguguaaccuaaggc

SEQ ID NO: 1067059 - RNA, 18 nt, Human
aacuguguaaccuaaggc

SEQ ID NO: 1067060 - RNA, 18 nt, Human
aagcuuuuagcauggugc

SEQ ID NO: 1067061 - RNA, 21 nt, Human
aauccugagcccgggaggagg

SEQ ID NO: 1067062 - RNA, 30 nt, Human
acagcggcaggaaaagcacaacugaggccu

SEQ ID NO: 1067063 - RNA, 20 nt, Human
acccuccccaggcccagguc

SEQ ID NO: 1067064 - RNA, 19 nt, Human
acuccgucucaccgccccc

SEQ ID NO: 1067065 - RNA, 21 nt, Human
agcccagggcagagcuagaug

SEQ ID NO: 1067066 - RNA, 21 nt, Human
agcugcauguuggaggaagag

SEQ ID NO: 1067067 - RNA, 20 nt, Human
aggaaaagcacaacugaggc

SEQ ID NO: 1067068 - RNA, 24 nt, Human
aggaggggccugaggucaguggua

SEQ ID NO: 1067069 - RNA, 24 nt, Human
aggcagaggcucaggggagggugc

SEQ ID NO: 1067070 - RNA, 23 nt, Human
aggcccagguccaaaccccggcc

SEQ ID NO: 1067071 - RNA, 23 nt, Human
aggggacaaagagagguuccaga

SEQ ID NO: 1067072 - RNA, 18 nt, Human
aguacagugcccugugcc

SEQ ID NO: 1067073 - RNA, 20 nt, Human
aguacagugcccugugccag

SEQ ID NO: 1067074 - RNA, 20 nt, Human
auccugagcccgggaggagg

SEQ ID NO: 1067075 - RNA, 18 nt, Human
caaacagcgacccucccc

SEQ ID NO: 1067076 - RNA, 22 nt, Human
caacuccucccuguggagugau

SEQ ID NO: 1067077 - RNA, 21 nt, Human
caccgcccccugucuccagga

SEQ ID NO: 1067078 - RNA, 20 nt, Human
cacuaagugcucuauucaug

SEQ ID NO: 1067079 - RNA, 23 nt, Human
cagaaagcacacugggcuagaag

SEQ ID NO: 1067080 - RNA, 25 nt, Human
cagaugaccugcagcggcccuuccu

SEQ ID NO: 1067081 - RNA, 19 nt, Human
cagcgacccuccccaggcc

SEQ ID NO: 1067082 - RNA, 21 nt, Human
cagcgacccuccccaggccca

SEQ ID NO: 1067083 - RNA, 23 nt, Human
cagcggcccuuccugcucagucu

SEQ ID NO: 1067084 - RNA, 19 nt, Human
caggaaaagcacaacugag

SEQ ID NO: 1067085 - RNA, 24 nt, Human
cagggucuguggugaagccagagg

SEQ ID NO: 1067086 - RNA, 18 nt, Human
caguggcuccucagggaa

SEQ ID NO: 1067087 - RNA, 22 nt, Human
caguggcuccucagggaaccca

SEQ ID NO: 1067088 - RNA, 20 nt, Human
ccaggcaccaugcuaacagc

SEQ ID NO: 1067089 - RNA, 22 nt, Human
cccaggaggggccugaggucag

SEQ ID NO: 1067090 - RNA, 24 nt, Human
cccagggcagagcuagaugcggcc

SEQ ID NO: 1067091 - RNA, 20 nt, Human
cccagugggaauagcagguu

SEQ ID NO: 1067092 - RNA, 20 nt, Human
cccaugggacccgaggcagg

SEQ ID NO: 1067093 - RNA, 22 nt, Human
ccccaggcccagguccaaaccc

SEQ ID NO: 1067094 - RNA, 23 nt, Human
ccccaggcccagguccaaaccuu

SEQ ID NO: 1067095 - RNA, 20 nt, Human
ccccggccacugguguggcc

SEQ ID NO: 1067096 - RNA, 21 nt, Human
cccugugccaggcaccaugcc

SEQ ID NO: 1067097 - RNA, 22 nt, Human
cccugugccaggcaccaugcua

SEQ ID NO: 1067098 - RNA, 24 nt, Human
ccugcagcggcccuuccugcucag

SEQ ID NO: 1067099 - RNA, 22 nt, Human
ccuuacuccagaccugcucuuc

SEQ ID NO: 1067100 - RNA, 24 nt, Human
cgcuugagucccccagccuuacuc

SEQ ID NO: 1067101 - RNA, 21 nt, Human
cggcaggaaaagcacaacuga

SEQ ID NO: 1067102 - RNA, 21 nt, Human
cucacuccaacauuucaaaga

SEQ ID NO: 1067103 - RNA, 19 nt, Human
cuccuguuuucuggcaaug

SEQ ID NO: 1067104 - RNA, 24 nt, Human
cugaggcagaggcucaggggaggg

SEQ ID NO: 1067105 - RNA, 23 nt, Human
cugcagcggcccuuccugcucag

SEQ ID NO: 1067106 - RNA, 19 nt, Human
cugcucagucuucugggau

SEQ ID NO: 1067107 - RNA, 21 nt, Human
cuggaaaagcgcaucuggagc

SEQ ID NO: 1067108 - RNA, 18 nt, Human
cugguguggccugggcag

SEQ ID NO: 1067109 - RNA, 20 nt, Human
gaagaggggucuggacagug

SEQ ID NO: 1067110 - RNA, 21 nt, Human
gaccugcucuuccuccuguuu

SEQ ID NO: 1067111 - RNA, 21 nt, Human
gagacugggcugauuuucagc

SEQ ID NO: 1067112 - RNA, 22 nt, Human
gagcugcauguuggaggaagag

SEQ ID NO: 1067113 - RNA, 21 nt, Human
gaggcagaggcucaggggagg

SEQ ID NO: 1067114 - RNA, 27 nt, Human
gaggcaggacagcacagcggcaggaaa

SEQ ID NO: 1067115 - RNA, 24 nt, Human
gcaaagcagaaagcacacugggcu

SEQ ID NO: 1067116 - RNA, 27 nt, Human
gcagcggcccuuccugcucagucuucu

SEQ ID NO: 1067117 - RNA, 20 nt, Human
gcagggucuguggugaagcc

SEQ ID NO: 1067118 - RNA, 23 nt, Human
gcccaggaggggccugaggucag

SEQ ID NO: 1067119 - RNA, 20 nt, Human
gcccugugccaggcaccaug

SEQ ID NO: 1067120 - RNA, 24 nt, Human
ggaaaagcgcaucuggagcuuaga

SEQ ID NO: 1067121 - RNA, 20 nt, Human
ggaggaggcugaggcagagg

SEQ ID NO: 1067122 - RNA, 23 nt, Human
ggccacugguguggccugggcag

SEQ ID NO: 1067123 - RNA, 18 nt, Human
gggaauccugagcccggg

SEQ ID NO: 1067124 - RNA, 20 nt, Human
gggaggaggcugaggcagag

SEQ ID NO: 1067125 - RNA, 24 nt, Human
gugccugcacuaagugcucuauuc

SEQ ID NO: 1067126 - RNA, 19 nt, Human
guggccugggcagacuccg

SEQ ID NO: 1067127 - RNA, 21 nt, Human
gugguacagcugaggcaagcc

SEQ ID NO: 1067128 - RNA, 23 nt, Human
guguagagaaaaagcaaagaugg

SEQ ID NO: 1067129 - RNA, 25 nt, Human
guuaucuggaaggggacaaagagag

SEQ ID NO: 1067130 - RNA, 19 nt, Human
uaacagcauauaggguccc

SEQ ID NO: 1067131 - RNA, 19 nt, Human
uacagcugaggcaagccca

SEQ ID NO: 1067132 - RNA, 22 nt, Human
uagcccagggcagagcuagaug

SEQ ID NO: 1067133 - RNA, 26 nt, Human
uagcccagggcagagcuagaugcggg

SEQ ID NO: 1067134 - RNA, 19 nt, Human
uaggucuuucucauuucug

SEQ ID NO: 1067135 - RNA, 20 nt, Human
uaguaggugguuuguguaga

SEQ ID NO: 1067136 - RNA, 18 nt, Human
ucaccccauugcaaguga

SEQ ID NO: 1067137 - RNA, 20 nt, Human
ucagugguacagcugaggca

SEQ ID NO: 1067138 - RNA, 22 nt, Human
uccccaggcccagguccaaacc

SEQ ID NO: 1067139 - RNA, 18 nt, Human
uccugagcccgggaggag

SEQ ID NO: 1067140 - RNA, 20 nt, Human
uccugagcccgggaggaggc

SEQ ID NO: 1067141 - RNA, 21 nt, Human
ucucaaacagcgacccuccca

SEQ ID NO: 1067142 - RNA, 21 nt, Human
ucugggauucaacgaucauuc

SEQ ID NO: 1067143 - RNA, 18 nt, Human
ucuguggugaagccagag

SEQ ID NO: 1067144 - RNA, 18 nt, Human
ugaccugcagcggcccuu

SEQ ID NO: 1067145 - RNA, 22 nt, Human
ugagcaggcucuucaauagccc

SEQ ID NO: 1067146 - RNA, 21 nt, Human
ugaggcaagcccaugggaccc

SEQ ID NO: 1067147 - RNA, 19 nt, Human
ugaguguguggcuguggaa

SEQ ID NO: 1067148 - RNA, 21 nt, Human
ugcagacuaagggagaggagg

SEQ ID NO: 1067149 - RNA, 20 nt, Human
ugccaggcaccaugcuaaca

SEQ ID NO: 1067150 - RNA, 23 nt, Human
ugcccugugccaggcaccaugcu

SEQ ID NO: 1067151 - RNA, 18 nt, Human
ugccugcacuaagugcuc

SEQ ID NO: 1067152 - RNA, 18 nt, Human
ugcuaacagcauauaggg

SEQ ID NO: 1067153 - RNA, 19 nt, Human
ugcucuuccuccuguuuuc

SEQ ID NO: 1067154 - RNA, 20 nt, Human
uggccugggcagacuccguc

SEQ ID NO: 1067155 - RNA, 19 nt, Human
ugggcucuuuguccgggcu

SEQ ID NO: 1067156 - RNA, 28 nt, Human
uguaguaggugguuuguguuguaaugac

SEQ ID NO: 1067157 - RNA, 21 nt, Human
ugugaggagagggaaauucag

SEQ ID NO: 1067158 - RNA, 19 nt, Human
uguuggaggaagagggguc

SEQ ID NO: 1067159 - RNA, 25 nt, Human
uguuuugcucccugcuguaucccca

SEQ ID NO: 1067160 - RNA, 27 nt, Human
uuaacacagaugaccugcagcggcccu

SEQ ID NO: 1067161 - RNA, 19 nt, Human
uuacuauucagaugugcca

SEQ ID NO: 1067162 - RNA, 19 nt, Human
uucucauuucugggccuca

SEQ ID NO: 1067163 - RNA, 20 nt, Human
uucuuaucugcaaacaagug

SEQ ID NO: 1067164 - RNA, 18 nt, Human
uugcucccugcuguaucc

SEQ ID NO: 1067165 - RNA, 22 nt, Human
uuuauaaagcugcguccuccuc

SEQ ID NO: 1067166 - RNA, 24 nt, Human
uuucuuaucugcaaacaaguggaa

SEQ ID NO: 1067167 - RNA, 20 nt, Human
aaaacacagguaaaggugcc

SEQ ID NO: 1067168 - RNA, 24 nt, Human
aaaacacagguaaaggugccacca

SEQ ID NO: 1067169 - RNA, 20 nt, Human
aaccuggccugguuugugca

SEQ ID NO: 1067170 - RNA, 20 nt, Human
aaggugccaccagccagagg

SEQ ID NO: 1067171 - RNA, 25 nt, Human
accuugcucaccuucuacuugucca

SEQ ID NO: 1067172 - RNA, 21 nt, Human
acguugggaugaccugccugc

SEQ ID NO: 1067173 - RNA, 22 nt, Human
agaagagagaaggagagaagag

SEQ ID NO: 1067174 - RNA, 18 nt, Human
agccaggaauggguggga

SEQ ID NO: 1067175 - RNA, 24 nt, Human
agccaggaaugggugggagaccug

SEQ ID NO: 1067176 - RNA, 20 nt, Human
agccccgcccucccaggcaa

SEQ ID NO: 1067177 - RNA, 26 nt, Human
aggcaagaagaagagaagagggaccc

SEQ ID NO: 1067178 - RNA, 22 nt, Human
aggcagaaaagugacaccucag

SEQ ID NO: 1067179 - RNA, 22 nt, Human
agugcugagguacuaggaagga

SEQ ID NO: 1067180 - RNA, 22 nt, Human
aguggggaggaguggcuggggc

SEQ ID NO: 1067181 - RNA, 23 nt, Human
aguggggaggaguggcuggggcu

SEQ ID NO: 1067182 - RNA, 23 nt, Human
augauggcagcaguggcccacgu

SEQ ID NO: 1067183 - RNA, 21 nt, Human
caaaacacagguaaaggugcc

SEQ ID NO: 1067184 - RNA, 21 nt, Human
caaacccaggcaucucugcac

SEQ ID NO: 1067185 - RNA, 21 nt, Human
caagcacaggagggaggcuga

SEQ ID NO: 1067186 - RNA, 18 nt, Human
cacaggagggaggcugag

SEQ ID NO: 1067187 - RNA, 20 nt, Human
caccuugcucaccuucuacu

SEQ ID NO: 1067188 - RNA, 20 nt, Human
cagaaaggagcuacccacug

SEQ ID NO: 1067189 - RNA, 27 nt, Human
cagcaagccccccugucccgcaggcuc

SEQ ID NO: 1067190 - RNA, 18 nt, Human
cagccagagguuucaggc

SEQ ID NO: 1067191 - RNA, 24 nt, Human
cagccagagguuucaggcagaaaa

SEQ ID NO: 1067192 - RNA, 18 nt, Human
cagcccccugccaccucg

SEQ ID NO: 1067193 - RNA, 18 nt, Human
cagcccccugccaccucg

SEQ ID NO: 1067194 - RNA, 22 nt, Human
cagcccccugccaccucggccc

SEQ ID NO: 1067195 - RNA, 20 nt, Human
caggcaucucugcacucucu

SEQ ID NO: 1067196 - RNA, 21 nt, Human
caggcgggagccccgcccucc

SEQ ID NO: 1067197 - RNA, 21 nt, Human
caguggggaggaguggcuggg

SEQ ID NO: 1067198 - RNA, 21 nt, Human
ccaaaccugggcacagucaca

SEQ ID NO: 1067199 - RNA, 19 nt, Human
ccaggcaucucugcacucu

SEQ ID NO: 1067200 - RNA, 20 nt, Human
cccaggcacagcugcagcca

SEQ ID NO: 1067201 - RNA, 20 nt, Human
cccccugccaccucggcccc

SEQ ID NO: 1067202 - RNA, 21 nt, Human
ccccugccaccucggcccccu

SEQ ID NO: 1067203 - RNA, 22 nt, Human
cccgcccucccaggcacagcug

SEQ ID NO: 1067204 - RNA, 22 nt, Human
ccgugcgucuccucucagcugc

SEQ ID NO: 1067205 - RNA, 22 nt, Human
ccucagagcuggugggagccag

SEQ ID NO: 1067206 - RNA, 23 nt, Human
ccucagagcuggugggagccagg

SEQ ID NO: 1067207 - RNA, 19 nt, Human
ccucaggauucuguaacac

SEQ ID NO: 1067208 - RNA, 22 nt, Human
ccugcagaaaggagcuacccac

SEQ ID NO: 1067209 - RNA, 24 nt, Human
ccugccaccucggcccccuccaga

SEQ ID NO: 1067210 - RNA, 23 nt, Human
ccuucuacuuguccacauaccuc

SEQ ID NO: 1067211 - RNA, 22 nt, Human
ccuuugaucucucggagcagcu

SEQ ID NO: 1067212 - RNA, 20 nt, Human
cgcaggcucaguuguaccug

SEQ ID NO: 1067213 - RNA, 18 nt, Human
cgccugggcacuaugggc

SEQ ID NO: 1067214 - RNA, 21 nt, Human
cguugggaugaccugccugca

SEQ ID NO: 1067215 - RNA, 24 nt, Human
cucagaggcccagcaagccccccu

SEQ ID NO: 1067216 - RNA, 19 nt, Human
cucaggacaagaacucagg

SEQ ID NO: 1067217 - RNA, 23 nt, Human
cugcaguggggaggaguggcugg

SEQ ID NO: 1067218 - RNA, 21 nt, Human
cugccaccucggcccccucca

SEQ ID NO: 1067219 - RNA, 19 nt, Human
cugguuugugcaagcucag

SEQ ID NO: 1067220 - RNA, 21 nt, Human
gaaccugaaaggacccauuua

SEQ ID NO: 1067221 - RNA, 21 nt, Human
gacaugccagcccccugccac

SEQ ID NO: 1067222 - RNA, 25 nt, Human
gagcccacuccaaauucagauccaa

SEQ ID NO: 1067223 - RNA, 24 nt, Human
gcaaaacacagguaaaggugccac

SEQ ID NO: 1067224 - RNA, 21 nt, Human
gcaaacccaggcaucucugca

SEQ ID NO: 1067225 - RNA, 23 nt, Human
gcaagccccccugucccgcaggc

SEQ ID NO: 1067226 - RNA, 23 nt, Human
gcucaauaaagcaccucuucacc

SEQ ID NO: 1067227 - RNA, 20 nt, Human
ggacucaggacaagaacuca

SEQ ID NO: 1067228 - RNA, 24 nt, Human
ggcugcaguggggaggaguggcug

SEQ ID NO: 1067229 - RNA, 21 nt, Human
gggcacagcuacccaccgugc

SEQ ID NO: 1067230 - RNA, 18 nt, Human
guggagcaguugcuaugg

SEQ ID NO: 1067231 - RNA, 19 nt, Human
gugggagccaggaaugggg

SEQ ID NO: 1067232 - RNA, 18 nt, Human
uaacauaaacagggcuga

SEQ ID NO: 1067233 - RNA, 22 nt, Human
uaacccagugggcccgagcaag

SEQ ID NO: 1067234 - RNA, 22 nt, Human
uaccugguccugcccccuggca

SEQ ID NO: 1067235 - RNA, 24 nt, Human
uaucaggcgggagccccgcccucc

SEQ ID NO: 1067236 - RNA, 20 nt, Human
ucacugaaucugcugugauu

SEQ ID NO: 1067237 - RNA, 25 nt, Human
uccaaguugaggccaaaccgggguc

SEQ ID NO: 1067238 - RNA, 23 nt, Human
uccuggacucaggacaagaacuc

SEQ ID NO: 1067239 - RNA, 25 nt, Human
ucuauaaaucuuccaccaugugucu

SEQ ID NO: 1067240 - RNA, 21 nt, Human
ucucagaggcccagcaagccc

SEQ ID NO: 1067241 - RNA, 23 nt, Human
ucucugcuuccagagcccacucc

SEQ ID NO: 1067242 - RNA, 18 nt, Human
ucugcugugauucugggg

SEQ ID NO: 1067243 - RNA, 21 nt, Human
ugaaaggacccauuuaugaug

SEQ ID NO: 1067244 - RNA, 18 nt, Human
ugacaagcacaggaggga

SEQ ID NO: 1067245 - RNA, 25 nt, Human
ugagguacuaggaaggaaccugaaa

SEQ ID NO: 1067246 - RNA, 18 nt, Human
ugcacucucagaggccca

SEQ ID NO: 1067247 - RNA, 23 nt, Human
ugcaguggggaggaguggcuggg

SEQ ID NO: 1067248 - RNA, 25 nt, Human
ugcucaccuucuacuuguccacaua

SEQ ID NO: 1067249 - RNA, 20 nt, Human
uggacagaacuaacccagug

SEQ ID NO: 1067250 - RNA, 18 nt, Human
uggagacacuggcugcag

SEQ ID NO: 1067251 - RNA, 21 nt, Human
uggccggaaggcccuccucag

SEQ ID NO: 1067252 - RNA, 19 nt, Human
uggcugcaguggggaggag

SEQ ID NO: 1067253 - RNA, 25 nt, Human
uggcugcaguggggaggaguggcug

SEQ ID NO: 1067254 - RNA, 19 nt, Human
uggcuggggcugugcacuc

SEQ ID NO: 1067255 - RNA, 20 nt, Human
uggcuggggcugugcacucc

SEQ ID NO: 1067256 - RNA, 19 nt, Human
ugggaugaccugccugcag

SEQ ID NO: 1067257 - RNA, 21 nt, Human
ugggcacagucacaaccuggc

SEQ ID NO: 1067258 - RNA, 19 nt, Human
ugggcccgagcaaaacaca

SEQ ID NO: 1067259 - RNA, 19 nt, Human
ugugauucugggggcugcc

SEQ ID NO: 1067260 - RNA, 19 nt, Human
uucaggcagaaaagugaca

SEQ ID NO: 1067261 - RNA, 19 nt, Human
uucuacuuguccacauacc

SEQ ID NO: 1067262 - RNA, 19 nt, Human
uucuugccaaauugcaggc

SEQ ID NO: 1067263 - RNA, 23 nt, Human
uugcucaauuaagcuccuuuaaa

SEQ ID NO: 1067264 - RNA, 22 nt, Human
uuuaugauggcagcaguggccc

SEQ ID NO: 1067265 - RNA, 19 nt, Human
acuuccauccaauucacuc

SEQ ID NO: 1067266 - RNA, 22 nt, Human
ggaaaacagaggugcagaggcu

SEQ ID NO: 1067267 - RNA, 19 nt, Human
ugaaaucacagauggacca

SEQ ID NO: 1067268 - RNA, 21 nt, Human
uucuuuggccacuucggcuga

SEQ ID NO: 1067269 - RNA, 19 nt, Human
accagugccagcagggcca

SEQ ID NO: 1067270 - RNA, 23 nt, Human
caagaccagugccagcagggcca

SEQ ID NO: 1067271 - RNA, 26 nt, Human
caccaccagcacaaaaaugacggagc

SEQ ID NO: 1067272 - RNA, 22 nt, Human
caccagcacaaaaaugacggag

SEQ ID NO: 1067273 - RNA, 20 nt, Human
caccaggcgggacagcagca

SEQ ID NO: 1067274 - RNA, 21 nt, Human
cagggccaccaccagcacaaa

SEQ ID NO: 1067275 - RNA, 21 nt, Human
ccaccaggcgggacagcagca

SEQ ID NO: 1067276 - RNA, 24 nt, Human
gggugcugcagccggugcacgggc

SEQ ID NO: 1067277 - RNA, 22 nt, Human
ugaagucacaaacaccugccca

SEQ ID NO: 1067278 - RNA, 25 nt, Human
ugaagucacaaacaccugcccacug

SEQ ID NO: 1067279 - RNA, 21 nt, Human
uguugucuugacaguuauucu

SEQ ID NO: 1067280 - RNA, 18 nt, Human
uugcaguggugggggugg

SEQ ID NO: 1067281 - RNA, 21 nt, Human
aaaaaaaacaaauaugaugca

SEQ ID NO: 1067282 - RNA, 19 nt, Human
aaaagcacuggauuuaacu

SEQ ID NO: 1067283 - RNA, 21 nt, Human
aaaaugccaccaaacauuuga

SEQ ID NO: 1067284 - RNA, 27 nt, Human
aaacaaaaaaaacaaauaugaugcaca

SEQ ID NO: 1067285 - RNA, 21 nt, Human
aaacaaaaccaccuagauuua

SEQ ID NO: 1067286 - RNA, 21 nt, Human
aaacaaauaugaugcacacac

SEQ ID NO: 1067287 - RNA, 24 nt, Human
aaagugcugagauuacagguguga

SEQ ID NO: 1067288 - RNA, 20 nt, Human
aaauagaaguaaacaaaacc

SEQ ID NO: 1067289 - RNA, 21 nt, Human
aaauggucucauaauuuugag

SEQ ID NO: 1067290 - RNA, 24 nt, Human
aaccucaggugaucugccugcuuc

SEQ ID NO: 1067291 - RNA, 20 nt, Human
aacuuagcccagugaaaugg

SEQ ID NO: 1067292 - RNA, 21 nt, Human
aagcaagccccuucaugaaca

SEQ ID NO: 1067293 - RNA, 27 nt, Human
aagccccacuaaaaaaauacuggaauu

SEQ ID NO: 1067294 - RNA, 22 nt, Human
aaggauugcuuuugagguucac

SEQ ID NO: 1067295 - RNA, 24 nt, Human
aaguagcugugauuacaggcgugu

SEQ ID NO: 1067296 - RNA, 26 nt, Human
aagugcugagauuacaggugugagcc

SEQ ID NO: 1067297 - RNA, 23 nt, Human
aaguguauuauuugucaugaaag

SEQ ID NO: 1067298 - RNA, 18 nt, Human
aauagccaauaacaaaag

SEQ ID NO: 1067299 - RNA, 18 nt, Human
acaggguuucaccauguu

SEQ ID NO: 1067300 - RNA, 21 nt, Human
acaggguuucaccauguuggc

SEQ ID NO: 1067301 - RNA, 24 nt, Human
acaggguuucaccauguuggccag

SEQ ID NO: 1067302 - RNA, 21 nt, Human
acauacauaguuacauacacc

SEQ ID NO: 1067303 - RNA, 23 nt, Human
accaaacauuugaaacuggccua

SEQ ID NO: 1067304 - RNA, 18 nt, Human
accaccaaagccccacua

SEQ ID NO: 1067305 - RNA, 24 nt, Human
accauguuggccaggcuggucuug

SEQ ID NO: 1067306 - RNA, 20 nt, Human
acccuaaagaaagcuacaug

SEQ ID NO: 1067307 - RNA, 22 nt, Human
accuugaucauuaacaccuccu

SEQ ID NO: 1067308 - RNA, 23 nt, Human
acgcacaccaccaccaaagcccc

SEQ ID NO: 1067309 - RNA, 18 nt, Human
acuccgucacccaggcug

SEQ ID NO: 1067310 - RNA, 19 nt, Human
acuccgucacccaggcugg

SEQ ID NO: 1067311 - RNA, 22 nt, Human
acuccgucacccaggcuggagu

SEQ ID NO: 1067312 - RNA, 26 nt, Human
acuccgucacccaggcuggagugaag

SEQ ID NO: 1067313 - RNA, 22 nt, Human
agaaaaauagaaguaaacaaaa

SEQ ID NO: 1067314 - RNA, 24 nt, Human
agaaaaauagaaguaaacaaaacc

SEQ ID NO: 1067315 - RNA, 22 nt, Human
agaaagcuacaugaagaauagc

SEQ ID NO: 1067316 - RNA, 26 nt, Human
agaaagcuacaugaagaauagccaau

SEQ ID NO: 1067317 - RNA, 22 nt, Human
agauuacaggugugagccacua

SEQ ID NO: 1067318 - RNA, 19 nt, Human
agccaauaacaaaagcacu

SEQ ID NO: 1067319 - RNA, 19 nt, Human
agccuuuccaauacccccc

SEQ ID NO: 1067320 - RNA, 20 nt, Human
aggcaagaugcugcuguuac

SEQ ID NO: 1067321 - RNA, 19 nt, Human
aggcacauaugugcaugug

SEQ ID NO: 1067322 - RNA, 24 nt, Human
aggcgugugccaccacgccuagcu

SEQ ID NO: 1067323 - RNA, 24 nt, Human
aggugaucugccugcuucagccuc

SEQ ID NO: 1067324 - RNA, 20 nt, Human
aguaaugggggcaaauagga

SEQ ID NO: 1067325 - RNA, 20 nt, Human
agucuuuuuuuuuuuuuucu

SEQ ID NO: 1067326 - RNA, 20 nt, Human
agugaaguggugcaaucucg

SEQ ID NO: 1067327 - RNA, 21 nt, Human
auacagaaaaauagaaguaaa

SEQ ID NO: 1067328 - RNA, 21 nt, Human
auacuggaaucucugggagua

SEQ ID NO: 1067329 - RNA, 21 nt, Human
auaguuacauacacccaaggc

SEQ ID NO: 1067330 - RNA, 18 nt, Human
aucugugagcaucuccuu

SEQ ID NO: 1067331 - RNA, 21 nt, Human
augaaagcaaagugcuuuuaa

SEQ ID NO: 1067332 - RNA, 22 nt, Human
augccucagccucccaaguagc

SEQ ID NO: 1067333 - RNA, 23 nt, Human
augccucagccucccaaguagcu

SEQ ID NO: 1067334 - RNA, 24 nt, Human
caaaaugccaccaaacauuugaaa

SEQ ID NO: 1067335 - RNA, 24 nt, Human
caaagugcugagauuacaggugug

SEQ ID NO: 1067336 - RNA, 23 nt, Human
caaccuccaccuccuggguucaa

SEQ ID NO: 1067337 - RNA, 27 nt, Human
caagcaauucucaugccucagccuccc

SEQ ID NO: 1067338 - RNA, 22 nt, Human
caagcauacugugaaucaaaac

SEQ ID NO: 1067339 - RNA, 19 nt, Human
caaguaagcacagaacaca

SEQ ID NO: 1067340 - RNA, 21 nt, Human
cacaguccauccaagcauacu

SEQ ID NO: 1067341 - RNA, 21 nt, Human
caccauguuggccaggcuggu

SEQ ID NO: 1067342 - RNA, 23 nt, Human
caccauguuggccaggcuggucu

SEQ ID NO: 1067343 - RNA, 24 nt, Human
caccauguuggccaggcuggucuu

SEQ ID NO: 1067344 - RNA, 27 nt, Human
caccauguuggccaggcuggucuugaa

SEQ ID NO: 1067345 - RNA, 20 nt, Human
caccuguggugcuuaagauu

SEQ ID NO: 1067346 - RNA, 22 nt, Human
cacuccgucacccaggcuggag

SEQ ID NO: 1067347 - RNA, 23 nt, Human
cacuccgucacccaggcuggagu

SEQ ID NO: 1067348 - RNA, 21 nt, Human
cacugcaaccuccaccuccug

SEQ ID NO: 1067349 - RNA, 20 nt, Human
cacugccacauuuacaagaa

SEQ ID NO: 1067350 - RNA, 23 nt, Human
cacuuugaacaaacauugcuaga

SEQ ID NO: 1067351 - RNA, 26 nt, Human
cagaaagucuuuuuuuuuuuuuucuu

SEQ ID NO: 1067352 - RNA, 25 nt, Human
cagcaaugaaauaucucaaacauac

SEQ ID NO: 1067353 - RNA, 22 nt, Human
cagcuaugccccacuuugaaca

SEQ ID NO: 1067354 - RNA, 24 nt, Human
cagcuaugccccacuuugaacaaa

SEQ ID NO: 1067355 - RNA, 23 nt, Human
caggcaucgucuagaaaacuaac

SEQ ID NO: 1067356 - RNA, 24 nt, Human
caggguuucaccauguuggccagg

SEQ ID NO: 1067357 - RNA, 22 nt, Human
caguucacucucuaucuacaug

SEQ ID NO: 1067358 - RNA, 21 nt, Human
cauacacgcacaccaccacca

SEQ ID NO: 1067359 - RNA, 23 nt, Human
cauacagaaaaauagaaguaaac

SEQ ID NO: 1067360 - RNA, 20 nt, Human
caugaagaauagccaauaac

SEQ ID NO: 1067361 - RNA, 25 nt, Human
cauguguauacauaacauauacaca

SEQ ID NO: 1067362 - RNA, 24 nt, Human
cauguuggccaggcuggucuugaa

SEQ ID NO: 1067363 - RNA, 19 nt, Human
cauuaggaccaucuaacug

SEQ ID NO: 1067364 - RNA, 19 nt, Human
cauugcuagaaucuggaag

SEQ ID NO: 1067365 - RNA, 21 nt, Human
ccaaagugcugagauuacagg

SEQ ID NO: 1067366 - RNA, 21 nt, Human
ccaaagugcugagauuacagg

SEQ ID NO: 1067367 - RNA, 24 nt, Human
ccaaagugcugagauuacaggugu

SEQ ID NO: 1067368 - RNA, 24 nt, Human
ccaaggcacauaugugcauguguu

SEQ ID NO: 1067369 - RNA, 22 nt, Human
ccaaguagcugugauuacaggc

SEQ ID NO: 1067370 - RNA, 24 nt, Human
ccaaguagcugugauuacaggcgu

SEQ ID NO: 1067371 - RNA, 19 nt, Human
ccaauaccccccgcccccc

SEQ ID NO: 1067372 - RNA, 21 nt, Human
ccaccaccaaagccccacuaa

SEQ ID NO: 1067373 - RNA, 20 nt, Human
ccaccacgccuagcuaauuu

SEQ ID NO: 1067374 - RNA, 22 nt, Human
ccacccuaaagaaagcuacaug

SEQ ID NO: 1067375 - RNA, 26 nt, Human
ccaccuccuggguucaagcaauucuu

SEQ ID NO: 1067376 - RNA, 23 nt, Human
ccacuacaccuggccagcuaugc

SEQ ID NO: 1067377 - RNA, 24 nt, Human
ccacugcaaccuccaccuccuggg

SEQ ID NO: 1067378 - RNA, 26 nt, Human
ccacugcaaccuccaccuccuggguu

SEQ ID NO: 1067379 - RNA, 19 nt, Human
cccaaguagcugugauuac

SEQ ID NO: 1067380 - RNA, 24 nt, Human
cccaaguagcugugauuacaggcg

SEQ ID NO: 1067381 - RNA, 27 nt, Human
cccacugcaaccuccaccuccuggguu

SEQ ID NO: 1067382 - RNA, 21 nt, Human
cccuaaagaaagcuacaugaa

SEQ ID NO: 1067383 - RNA, 19 nt, Human
ccuccaccuccuggguuca

SEQ ID NO: 1067384 - RNA, 22 nt, Human
ccuccuggguucaagcaauucu

SEQ ID NO: 1067385 - RNA, 18 nt, Human
ccuggccagcuaugcccc

SEQ ID NO: 1067386 - RNA, 19 nt, Human
ccuggccagcuaugcccca

SEQ ID NO: 1067387 - RNA, 23 nt, Human
ccuggguucaagcaauucucaug

SEQ ID NO: 1067388 - RNA, 19 nt, Human
ccuuuugugaacaaaaugc

SEQ ID NO: 1067389 - RNA, 21 nt, Human
cgucacccaggcuggagugaa

SEQ ID NO: 1067390 - RNA, 20 nt, Human
cgugugccaccacgccuagc

SEQ ID NO: 1067391 - RNA, 20 nt, Human
cguugcccaaaaauaaucag

SEQ ID NO: 1067392 - RNA, 28 nt, Human
cucaaacauacagaaaaauagaaguaaa

SEQ ID NO: 1067393 - RNA, 25 nt, Human
cucaugccucagccucccaaguagc

SEQ ID NO: 1067394 - RNA, 21 nt, Human
cucccaaagugcugagauuac

SEQ ID NO: 1067395 - RNA, 21 nt, Human
cuccuggguucaagcaauucu

SEQ ID NO: 1067396 - RNA, 26 nt, Human
cucuuaaccucaggugaucugccugc

SEQ ID NO: 1067397 - RNA, 23 nt, Human
cugcaaccuccaccuccuggguu

SEQ ID NO: 1067398 - RNA, 24 nt, Human
cugcaaccuccaccuccuggguuc

SEQ ID NO: 1067399 - RNA, 19 nt, Human
cugcggggcuucaaacuua

SEQ ID NO: 1067400 - RNA, 23 nt, Human
cugcuucagccucccaaagugcu

SEQ ID NO: 1067401 - RNA, 24 nt, Human
cugcuucagccucccaaagugcug

SEQ ID NO: 1067402 - RNA, 25 nt, Human
cuuucuccaccuuaucucuuuguug

SEQ ID NO: 1067403 - RNA, 19 nt, Human
cuuuuggcuugucuucuga

SEQ ID NO: 1067404 - RNA, 18 nt, Human
cuuuuuuuuuuuuuucuu

SEQ ID NO: 1067405 - RNA, 18 nt, Human
gaaaaaacaaaaaaaaca

SEQ ID NO: 1067406 - RNA, 24 nt, Human
gaaucucugggaguaaugggggca

SEQ ID NO: 1067407 - RNA, 20 nt, Human
gagauggagucucacuccgu

SEQ ID NO: 1067408 - RNA, 21 nt, Human
gaucugccugcuucagccucc

SEQ ID NO: 1067409 - RNA, 18 nt, Human
gauuacaggcgugugcca

SEQ ID NO: 1067410 - RNA, 21 nt, Human
gauuacaggcgugugccacca

SEQ ID NO: 1067411 - RNA, 18 nt, Human
gauuacaggugugagcca

SEQ ID NO: 1067412 - RNA, 22 nt, Human
gauuacaggugugagccacuac

SEQ ID NO: 1067413 - RNA, 19 nt, Human
gcacaccaccaccaaagcc

SEQ ID NO: 1067414 - RNA, 19 nt, Human
gcacaccaccaccaaagcc

SEQ ID NO: 1067415 - RNA, 23 nt, Human
gcacaccaccaccaaagccccac

SEQ ID NO: 1067416 - RNA, 23 nt, Human
gccuagcuaauuuuuuguauuuu

SEQ ID NO: 1067417 - RNA, 20 nt, Human
ggaaacaauauacccacaac

SEQ ID NO: 1067418 - RNA, 22 nt, Human
ggcacauaugugcauguguaua

SEQ ID NO: 1067419 - RNA, 19 nt, Human
gggcaaauaggaggaguua

SEQ ID NO: 1067420 - RNA, 22 nt, Human
ggguuucaccauguuggccagg

SEQ ID NO: 1067421 - RNA, 20 nt, Human
gucuuuuuuuuuuuuuucuu

SEQ ID NO: 1067422 - RNA, 25 nt, Human
gugaaucaaaacacaugucauagcu

SEQ ID NO: 1067423 - RNA, 24 nt, Human
gugaucugccugcuucagccuccc

SEQ ID NO: 1067424 - RNA, 19 nt, Human
gugugccaccacgccuagc

SEQ ID NO: 1067425 - RNA, 23 nt, Human
uaaauaauuuugcaggcaagaug

SEQ ID NO: 1067426 - RNA, 21 nt, Human
uaacauauacacauacauaca

SEQ ID NO: 1067427 - RNA, 19 nt, Human
uaaccucaggugaucugcc

SEQ ID NO: 1067428 - RNA, 19 nt, Human
uaaccucaggugaucugcc

SEQ ID NO: 1067429 - RNA, 21 nt, Human
uaaccucaggugaucugccug

SEQ ID NO: 1067430 - RNA, 24 nt, Human
uaaccucaggugaucugccugcuu

SEQ ID NO: 1067431 - RNA, 20 nt, Human
uaacuggauuccacuggaau

SEQ ID NO: 1067432 - RNA, 19 nt, Human
uaauuagcaaacauuccuu

SEQ ID NO: 1067433 - RNA, 22 nt, Human
uaauuagcaaacauuccuuucu

SEQ ID NO: 1067434 - RNA, 24 nt, Human
uaauuuuuuguauuuuuacuagag

SEQ ID NO: 1067435 - RNA, 19 nt, Human
uacacgcacaccaccacca

SEQ ID NO: 1067436 - RNA, 22 nt, Human
uacaggcgugugccaccacgcc

SEQ ID NO: 1067437 - RNA, 22 nt, Human
uacaggugugagccacuacacc

SEQ ID NO: 1067438 - RNA, 23 nt, Human
uacaggugugagccacuacaccu

SEQ ID NO: 1067439 - RNA, 26 nt, Human
uacauacacccaaggcacauaugugc

SEQ ID NO: 1067440 - RNA, 21 nt, Human
uacauacauacacgcacacca

SEQ ID NO: 1067441 - RNA, 24 nt, Human
uacauacauacacgcacaccacca

SEQ ID NO: 1067442 - RNA, 22 nt, Human
uaccaccggggacaaauggucu

SEQ ID NO: 1067443 - RNA, 24 nt, Human
uacuagagacaggguuucaccaug

SEQ ID NO: 1067444 - RNA, 21 nt, Human
uagagacaggguuucaccaug

SEQ ID NO: 1067445 - RNA, 22 nt, Human
uagagacaggguuucaccaugu

SEQ ID NO: 1067446 - RNA, 18 nt, Human
uagccaauaacaaaagca

SEQ ID NO: 1067447 - RNA, 19 nt, Human
uagcccagugaaauggcag

SEQ ID NO: 1067448 - RNA, 22 nt, Human
uaggaggaguuaauguucaggu

SEQ ID NO: 1067449 - RNA, 23 nt, Human
uaggaggaguuaauguucaggua

SEQ ID NO: 1067450 - RNA, 25 nt, Human
uauacacauacauacauacacgcac

SEQ ID NO: 1067451 - RNA, 25 nt, Human
uauacacauacauacauacacgcag

SEQ ID NO: 1067452 - RNA, 19 nt, Human
uauacauaacauauacaca

SEQ ID NO: 1067453 - RNA, 18 nt, Human
uaugugcauguguauaca

SEQ ID NO: 1067454 - RNA, 20 nt, Human
uaugugcauguguauacaua

SEQ ID NO: 1067455 - RNA, 22 nt, Human
uaugugcauguguauacauaac

SEQ ID NO: 1067456 - RNA, 20 nt, Human
uauguguguauauacauaca

SEQ ID NO: 1067457 - RNA, 26 nt, Human
uauguuuaaaaauauguguguauaua

SEQ ID NO: 1067458 - RNA, 22 nt, Human
uauuauggacccauuguugaga

SEQ ID NO: 1067459 - RNA, 18 nt, Human
ucaaccacuaccuugauc

SEQ ID NO: 1067460 - RNA, 21 nt, Human
ucacccaggcuggagugaagu

SEQ ID NO: 1067461 - RNA, 21 nt, Human
ucagcaaugaaauaucucaaa

SEQ ID NO: 1067462 - RNA, 18 nt, Human
ucagccucccaaguagcu

SEQ ID NO: 1067463 - RNA, 20 nt, Human
ucagccucccaaguagcugg

SEQ ID NO: 1067464 - RNA, 18 nt, Human
ucaugaacaugggcauuu

SEQ ID NO: 1067465 - RNA, 20 nt, Human
uccaauaccccccgcccccc

SEQ ID NO: 1067466 - RNA, 21 nt, Human
uccacacaguccauccaagca

SEQ ID NO: 1067467 - RNA, 22 nt, Human
uccaugucccguugcccaaaaa

SEQ ID NO: 1067468 - RNA, 23 nt, Human
ucccaaagugcugagauuacagg

SEQ ID NO: 1067469 - RNA, 21 nt, Human
ucccaacaauggcuggacuuc

SEQ ID NO: 1067470 - RNA, 24 nt, Human
ucccaaguagcugugauuacaggc

SEQ ID NO: 1067471 - RNA, 22 nt, Human
ucccguugcccaaaaauaauca

SEQ ID NO: 1067472 - RNA, 21 nt, Human
uccuggguucaagcaauucuc

SEQ ID NO: 1067473 - RNA, 24 nt, Human
uccuggguucaagcaauucucaug

SEQ ID NO: 1067474 - RNA, 24 nt, Human
ucucacuccgucacccaggcugga

SEQ ID NO: 1067475 - RNA, 26 nt, Human
ucucacuccgucacccaggcuggagu

SEQ ID NO: 1067476 - RNA, 18 nt, Human
ucucugggaguaaugggg

SEQ ID NO: 1067477 - RNA, 19 nt, Human
ucuuccaugucccguugcc

SEQ ID NO: 1067478 - RNA, 25 nt, Human
ugaaaaaacaaaaaaaacaaauaug

SEQ ID NO: 1067479 - RNA, 22 nt, Human
ugaaguggugcaaucucggccc

SEQ ID NO: 1067480 - RNA, 23 nt, Human
ugaaguggugcaaucucggccca

SEQ ID NO: 1067481 - RNA, 22 nt, Human
ugagauggagucucacuccguc

SEQ ID NO: 1067482 - RNA, 18 nt, Human
ugagauuacaggugugag

SEQ ID NO: 1067483 - RNA, 19 nt, Human
ugagauuacaggugugagc

SEQ ID NO: 1067484 - RNA, 21 nt, Human
ugagauuacaggugugagcca

SEQ ID NO: 1067485 - RNA, 22 nt, Human
ugagauuacaggugugagccac

SEQ ID NO: 1067486 - RNA, 22 nt, Human
ugagauuacaggugugagccac

SEQ ID NO: 1067487 - RNA, 23 nt, Human
ugagauuacaggugugagccacu

SEQ ID NO: 1067488 - RNA, 24 nt, Human
ugagauuacaggugugagccacua

SEQ ID NO: 1067489 - RNA, 24 nt, Human
ugauuccaugguucccaacaaugg

SEQ ID NO: 1067490 - RNA, 19 nt, Human
ugcauguguauacauaaca

SEQ ID NO: 1067491 - RNA, 25 nt, Human
ugccaccaaacauuugaaacuggcc

SEQ ID NO: 1067492 - RNA, 25 nt, Human
ugccucagccucccaaguagcugug

SEQ ID NO: 1067493 - RNA, 27 nt, Human
ugccucugacuuuaaaaacauaaugaa

SEQ ID NO: 1067494 - RNA, 24 nt, Human
ugcugagauuacaggugugagcca

SEQ ID NO: 1067495 - RNA, 24 nt, Human
ugcuucagccucccaaagugcuga

SEQ ID NO: 1067496 - RNA, 18 nt, Human
uggaagagacaugcuggg

SEQ ID NO: 1067497 - RNA, 20 nt, Human
uggaaucucugggaguaauu

SEQ ID NO: 1067498 - RNA, 21 nt, Human
uggaggugacuuuuucccugc

SEQ ID NO: 1067499 - RNA, 24 nt, Human
uggagugaaguggugcaaucucgg

SEQ ID NO: 1067500 - RNA, 20 nt, Human
uggcagucuuuuuuaguuuu

SEQ ID NO: 1067501 - RNA, 22 nt, Human
uggccaggcuggucuugaacuc

SEQ ID NO: 1067502 - RNA, 24 nt, Human
ugggaguaaugggggcaaauagga

SEQ ID NO: 1067503 - RNA, 23 nt, Human
uguauacauaacauauacacaua

SEQ ID NO: 1067504 - RNA, 28 nt, Human
uguauacauaacauauacacauacauag

SEQ ID NO: 1067505 - RNA, 20 nt, Human
ugugagcaucuccuucucuu

SEQ ID NO: 1067506 - RNA, 24 nt, Human
ugugagcaucuccuucucuuccua

SEQ ID NO: 1067507 - RNA, 22 nt, Human
ugugauuacaggcgugugccac

SEQ ID NO: 1067508 - RNA, 24 nt, Human
ugugauuacaggcgugugccacca

SEQ ID NO: 1067509 - RNA, 18 nt, Human
uguguauauacauacaua

SEQ ID NO: 1067510 - RNA, 18 nt, Human
uguguauauacauacaua

SEQ ID NO: 1067511 - RNA, 25 nt, Human
uguguauauacauacauaguuacau

SEQ ID NO: 1067512 - RNA, 18 nt, Human
uguguguauauacauaca

SEQ ID NO: 1067513 - RNA, 21 nt, Human
uguguguauauacauacauag

SEQ ID NO: 1067514 - RNA, 21 nt, Human
uguguguauauacauacauag

SEQ ID NO: 1067515 - RNA, 21 nt, Human
uguguuugauuccaugguucc

SEQ ID NO: 1067516 - RNA, 24 nt, Human
uguuuaaaaauauguguguauaua

SEQ ID NO: 1067517 - RNA, 22 nt, Human
uguuuguuuugagauggagucu

SEQ ID NO: 1067518 - RNA, 20 nt, Human
uuacaaguuuucuguucuga

SEQ ID NO: 1067519 - RNA, 24 nt, Human
uuacuagagacaggguuucaccau

SEQ ID NO: 1067520 - RNA, 21 nt, Human
uucaugaacaugggcauuuuu

SEQ ID NO: 1067521 - RNA, 21 nt, Human
uuccaugguucccaacaaugg

SEQ ID NO: 1067522 - RNA, 22 nt, Human
uuccaugguucccaacaauggc

SEQ ID NO: 1067523 - RNA, 21 nt, Human
uucuguuagccaaggauugcu

SEQ ID NO: 1067524 - RNA, 23 nt, Human
uucuuccaugucccguugcccaa

SEQ ID NO: 1067525 - RNA, 26 nt, Human
uuguaaacaaccacccuaaagaaagc

SEQ ID NO: 1067526 - RNA, 22 nt, Human
uuuaccaggauccacucaacca

SEQ ID NO: 1067527 - RNA, 24 nt, Human
uuuaccaggauccacucaaccacu

SEQ ID NO: 1067528 - RNA, 24 nt, Human
uuucaccauguuggccaggcuggu

SEQ ID NO: 1067529 - RNA, 21 nt, Human
uuuguaaacaaccacccuaaa

SEQ ID NO: 1067530 - RNA, 24 nt, Human
uuuuuacuagagacaggguuucac

SEQ ID NO: 1067531 - RNA, 21 nt, Human
uuuuuguauuuuuacuagaga

SEQ ID NO: 1067532 - RNA, 24 nt, Human
uuuuuuguauuuuuacuagagaca

SEQ ID NO: 1067533 - RNA, 19 nt, Human
aucuuugugauuuuugcac

SEQ ID NO: 1067534 - RNA, 20 nt, Human
cagcaugggaggagccaaca

SEQ ID NO: 1067535 - RNA, 20 nt, Human
cugugguauagugcagugga

SEQ ID NO: 1067536 - RNA, 21 nt, Human
uagugcaguggaucacagaug

SEQ ID NO: 1067537 - RNA, 23 nt, Human
ucucaggaccacagccaagccaa

SEQ ID NO: 1067538 - RNA, 21 nt, Human
ugcaguggaucacagauggcc

SEQ ID NO: 1067539 - RNA, 22 nt, Human
ugggaggagccaacacgcagac

SEQ ID NO: 1067540 - RNA, 21 nt, Human
uucagcaugggaggagccaac

SEQ ID NO: 1067541 - RNA, 24 nt, Human
aauacagccucucugucuccgccu

SEQ ID NO: 1067542 - RNA, 22 nt, Human
auguuaacauuaaaaucugaau

SEQ ID NO: 1067543 - RNA, 24 nt, Human
cagguagaggcucaaccguaugga

SEQ ID NO: 1067544 - RNA, 23 nt, Human
cccccuuuguccagucuuccucc

SEQ ID NO: 1067545 - RNA, 22 nt, Human
cugaacugugaccagcaccagg

SEQ ID NO: 1067546 - RNA, 19 nt, Human
gaauggaaaagaaguuuga

SEQ ID NO: 1067547 - RNA, 20 nt, Human
gaccagcaccaggcagguag

SEQ ID NO: 1067548 - RNA, 18 nt, Human
ucugucuccgccuacucc

SEQ ID NO: 1067549 - RNA, 23 nt, Human
ugaagaagcugaacugugaccag

SEQ ID NO: 1067550 - RNA, 19 nt, Human
aaaaagaaauuccuagccc

SEQ ID NO: 1067551 - RNA, 20 nt, Human
aaaagaaauuccuagcccuu

SEQ ID NO: 1067552 - RNA, 23 nt, Human
aaacugggaaggacaacaggaga

SEQ ID NO: 1067553 - RNA, 21 nt, Human
aaagucuuucccuucucuagc

SEQ ID NO: 1067554 - RNA, 19 nt, Human
acaaacaucagcuaacaga

SEQ ID NO: 1067555 - RNA, 18 nt, Human
acuuguggaccuccccuc

SEQ ID NO: 1067556 - RNA, 22 nt, Human
agggaaaaagggagguugggga

SEQ ID NO: 1067557 - RNA, 19 nt, Human
agggagguuggggagaaac

SEQ ID NO: 1067558 - RNA, 19 nt, Human
agguauagacagggaaacc

SEQ ID NO: 1067559 - RNA, 22 nt, Human
aggugguggcgccgagggcguc

SEQ ID NO: 1067560 - RNA, 18 nt, Human
aguugcuagcuucggccu

SEQ ID NO: 1067561 - RNA, 25 nt, Human
aucacuagcaauacaccuacaauga

SEQ ID NO: 1067562 - RNA, 20 nt, Human
caacugccugcccauuuauu

SEQ ID NO: 1067563 - RNA, 23 nt, Human
cagaaguucuggugcuagcacau

SEQ ID NO: 1067564 - RNA, 18 nt, Human
cagcacaggagggguugg

SEQ ID NO: 1067565 - RNA, 22 nt, Human
caggagcuggaucaguaggcac

SEQ ID NO: 1067566 - RNA, 19 nt, Human
cagggccaggugguggcgc

SEQ ID NO: 1067567 - RNA, 22 nt, Human
cauaauagaucaaguaagccug

SEQ ID NO: 1067568 - RNA, 28 nt, Human
ccaccuggagaucuucaaagggggcugc

SEQ ID NO: 1067569 - RNA, 18 nt, Human
ccaccuuugucauguccc

SEQ ID NO: 1067570 - RNA, 21 nt, Human
cccgcuggaaaccauuuucca

SEQ ID NO: 1067571 - RNA, 18 nt, Human
cccuguccuauugauccc

SEQ ID NO: 1067572 - RNA, 18 nt, Human
ccugucuuacaaacuagg

SEQ ID NO: 1067573 - RNA, 20 nt, Human
cgagcucccugaaaaagaaa

SEQ ID NO: 1067574 - RNA, 26 nt, Human
cuacuaaguaauugucuguguugugc

SEQ ID NO: 1067575 - RNA, 19 nt, Human
cuagcacauucagcuccuc

SEQ ID NO: 1067576 - RNA, 23 nt, Human
cuauagcuaugccuuucuuuucu

SEQ ID NO: 1067577 - RNA, 23 nt, Human
cuccauaagcuuguaugccgggu

SEQ ID NO: 1067578 - RNA, 24 nt, Human
cucccgcuggaaaccauuuuccaa

SEQ ID NO: 1067579 - RNA, 20 nt, Human
cucggugccuacauaucuaa

SEQ ID NO: 1067580 - RNA, 19 nt, Human
cuuaagagccgagcucccu

SEQ ID NO: 1067581 - RNA, 22 nt, Human
cuugugcccauguggcaggccc

SEQ ID NO: 1067582 - RNA, 24 nt, Human
gaaaaaacaaggauaauacacagg

SEQ ID NO: 1067583 - RNA, 22 nt, Human
gaaguugcuagcuucggccuuc

SEQ ID NO: 1067584 - RNA, 20 nt, Human
gagauucuggaugagccgaa

SEQ ID NO: 1067585 - RNA, 22 nt, Human
gagccgagcucccugaaaaaga

SEQ ID NO: 1067586 - RNA, 20 nt, Human
gcaacaaaaccuuuuaucau

SEQ ID NO: 1067587 - RNA, 23 nt, Human
gccauucauuaucuuuccaguuu

SEQ ID NO: 1067588 - RNA, 18 nt, Human
gcguacauaacaagaagu

SEQ ID NO: 1067589 - RNA, 20 nt, Human
ggagguuggggagaaacugg

SEQ ID NO: 1067590 - RNA, 22 nt, Human
ggccaggugguggcgccgaggg

SEQ ID NO: 1067591 - RNA, 19 nt, Human
gucuaaggccaaucuauuc

SEQ ID NO: 1067592 - RNA, 22 nt, Human
uaaaaccgucaaagcucugcca

SEQ ID NO: 1067593 - RNA, 18 nt, Human
uaacacaacugccugccc

SEQ ID NO: 1067594 - RNA, 24 nt, Human
uaagccugaggaaugugacugggg

SEQ ID NO: 1067595 - RNA, 25 nt, Human
uaaggggucuacccgaaaaagucau

SEQ ID NO: 1067596 - RNA, 23 nt, Human
uaauugucuguguugugcuguua

SEQ ID NO: 1067597 - RNA, 22 nt, Human
uacuucuguuuuuuccaacuuu

SEQ ID NO: 1067598 - RNA, 25 nt, Human
uagcaauacaccuacaaugaggggu

SEQ ID NO: 1067599 - RNA, 21 nt, Human
ucaaguaagccugaggaaugu

SEQ ID NO: 1067600 - RNA, 24 nt, Human
ucacuagcaauacaccuacaauga

SEQ ID NO: 1067601 - RNA, 21 nt, Human
ucagcuacuagcaaguagucu

SEQ ID NO: 1067602 - RNA, 26 nt, Human
uccacaaacuccuccuucagcuacua

SEQ ID NO: 1067603 - RNA, 21 nt, Human
ucccugaaaaagaaauuccua

SEQ ID NO: 1067604 - RNA, 26 nt, Human
ucccugaaaaagaaauuccuagcccu

SEQ ID NO: 1067605 - RNA, 21 nt, Human
uccuucagcuacuagcaagua

SEQ ID NO: 1067606 - RNA, 20 nt, Human
uccuugaucauuuauuugua

SEQ ID NO: 1067607 - RNA, 19 nt, Human
ucggugccuacauaucuag

SEQ ID NO: 1067608 - RNA, 23 nt, Human
ucucauaccauauuuccccccuu

SEQ ID NO: 1067609 - RNA, 24 nt, Human
ucugaugaaucaaaguagcaacaa

SEQ ID NO: 1067610 - RNA, 19 nt, Human
ugaaucaaaguagcaacaa

SEQ ID NO: 1067611 - RNA, 23 nt, Human
ugaaucaaaguagcaacaaaacc

SEQ ID NO: 1067612 - RNA, 21 nt, Human
ugacuauguuuuuaaccaccu

SEQ ID NO: 1067613 - RNA, 24 nt, Human
ugagccgaagcaguuuuuaauuua

SEQ ID NO: 1067614 - RNA, 22 nt, Human
ugaggaaugugacugggggcua

SEQ ID NO: 1067615 - RNA, 23 nt, Human
ugccaagcuaaaaccgucaaagc

SEQ ID NO: 1067616 - RNA, 22 nt, Human
uggaaaccauuuuccaaauaaa

SEQ ID NO: 1067617 - RNA, 22 nt, Human
uggacccugccucgcauuaugc

SEQ ID NO: 1067618 - RNA, 18 nt, Human
uguggaccuccccucuaa

SEQ ID NO: 1067619 - RNA, 19 nt, Human
uguuauacaacuucugucc

SEQ ID NO: 1067620 - RNA, 24 nt, Human
uuaagggcuuacaauucuaagggg

SEQ ID NO: 1067621 - RNA, 25 nt, Human
uuacuaaauggauucuuuucagugu

SEQ ID NO: 1067622 - RNA, 23 nt, Human
uuacuucuguuuuuuccaacuuu

SEQ ID NO: 1067623 - RNA, 20 nt, Human
uucagcuccucacaaaaggu

SEQ ID NO: 1067624 - RNA, 21 nt, Human
uucagcuccucacaaaagguu

SEQ ID NO: 1067625 - RNA, 20 nt, Human
uuccacaaacuccuccuuca

SEQ ID NO: 1067626 - RNA, 21 nt, Human
uucucccuuuuuuccugucuu

SEQ ID NO: 1067627 - RNA, 21 nt, Human
uugcuagcuucggccuucuga

SEQ ID NO: 1067628 - RNA, 18 nt, Human
uugcuuucucccuuuuuu

SEQ ID NO: 1067629 - RNA, 21 nt, Human
uugcuuucucccuuuuuuccu

SEQ ID NO: 1067630 - RNA, 23 nt, Human
uugucuuuuucagaaguucuggu

SEQ ID NO: 1067631 - RNA, 19 nt, Human
uuuaaccaccuguccuuga

SEQ ID NO: 1067632 - RNA, 25 nt, Human
uuuagugggaguucucacucucauc

SEQ ID NO: 1067633 - RNA, 21 nt, Human
uuuuccacaaacuccuccuuc

SEQ ID NO: 1067634 - RNA, 23 nt, Human
uuuuccacaaacuccuccuucag

SEQ ID NO: 1067635 - RNA, 19 nt, Human
uuuuuagugggaguucuca

SEQ ID NO: 1067636 - RNA, 22 nt, Human
agcaaggaaaggagaaggcaau

SEQ ID NO: 1067637 - RNA, 19 nt, Human
aggaaaggagaaggcaaug

SEQ ID NO: 1067638 - RNA, 19 nt, Human
aggagaaggcaaugcugaa

SEQ ID NO: 1067639 - RNA, 18 nt, Human
aggcaaugcugaaccuaa

SEQ ID NO: 1067640 - RNA, 20 nt, Human
ccaaagcaaggaaaggagaa

SEQ ID NO: 1067641 - RNA, 19 nt, Human
uccucaagcauccuuggcu

SEQ ID NO: 1067642 - RNA, 23 nt, Human
ugagcagcucuacagccagguua

SEQ ID NO: 1067643 - RNA, 18 nt, Human
uggagagauuccaggcac

SEQ ID NO: 1067644 - RNA, 18 nt, Human
uggagugagcagcucuac

SEQ ID NO: 1067645 - RNA, 21 nt, Human
uggcuuggacugcagcaugaa

SEQ ID NO: 1067646 - RNA, 19 nt, Human
uucauccagugcucuuccc

SEQ ID NO: 1067647 - RNA, 21 nt, Human
uucaugggcaguacaguauaa

SEQ ID NO: 1067648 - RNA, 19 nt, Human
aagaacauagagauuggcc

SEQ ID NO: 1067649 - RNA, 20 nt, Human
aagcgcugaacaaugacagu

SEQ ID NO: 1067650 - RNA, 19 nt, Human
aaugacagugaaaauuccu

SEQ ID NO: 1067651 - RNA, 22 nt, Human
agggagggcagccugaagacug

SEQ ID NO: 1067652 - RNA, 20 nt, Human
caccaagggagggcagccug

SEQ ID NO: 1067653 - RNA, 22 nt, Human
cagcaggauguggacauacuug

SEQ ID NO: 1067654 - RNA, 22 nt, Human
ccaagcaccaagggagggcagc

SEQ ID NO: 1067655 - RNA, 18 nt, Human
cugaagacugcuugaacu

SEQ ID NO: 1067656 - RNA, 22 nt, Human
cuugggaaauuuucaggcaaag

SEQ ID NO: 1067657 - RNA, 19 nt, Human
ugagugcuuucauccaagc

SEQ ID NO: 1067658 - RNA, 19 nt, Human
acgcugugaggagaugcgg

SEQ ID NO: 1067659 - RNA, 25 nt, Human
acccacccgggccccagcccaggca

SEQ ID NO: 1067660 - RNA, 21 nt, Human
acccuccuuacccugcccccu

SEQ ID NO: 1067661 - RNA, 23 nt, Human
agaggagcgcggcgcugguagca

SEQ ID NO: 1067662 - RNA, 18 nt, Human
agagggaagggcccccug

SEQ ID NO: 1067663 - RNA, 22 nt, Human
cacacgggacggcacagcagcg

SEQ ID NO: 1067664 - RNA, 27 nt, Human
cacuuuaucacuuagaagauucacccu

SEQ ID NO: 1067665 - RNA, 22 nt, Human
ccaaauccacacgggacggcac

SEQ ID NO: 1067666 - RNA, 25 nt, Human
ccacacggcuucugcgcggcauccu

SEQ ID NO: 1067667 - RNA, 18 nt, Human
ccaggacucuucucccca

SEQ ID NO: 1067668 - RNA, 19 nt, Human
ccaggccuggccugcaguc

SEQ ID NO: 1067669 - RNA, 19 nt, Human
cccacaccugcgcagaccc

SEQ ID NO: 1067670 - RNA, 20 nt, Human
cccccggggcccagcugcuc

SEQ ID NO: 1067671 - RNA, 19 nt, Human
cccccgucuuccccgucuc

SEQ ID NO: 1067672 - RNA, 18 nt, Human
ccccggagccuccccugg

SEQ ID NO: 1067673 - RNA, 19 nt, Human
ccccgucuuccccgucucu

SEQ ID NO: 1067674 - RNA, 20 nt, Human
ccccuggugcgcugcagcca

SEQ ID NO: 1067675 - RNA, 22 nt, Human
ccccuggugcgcugcagccacg

SEQ ID NO: 1067676 - RNA, 21 nt, Human
cccgcucgggacgccucccca

SEQ ID NO: 1067677 - RNA, 19 nt, Human
cccgggccccagcccaggc

SEQ ID NO: 1067678 - RNA, 24 nt, Human
cccuccuuacccugcccccuuguc

SEQ ID NO: 1067679 - RNA, 26 nt, Human
cccuccuuacccugcccccuugucuu

SEQ ID NO: 1067680 - RNA, 24 nt, Human
ccgaggcccacacggcuucugcgc

SEQ ID NO: 1067681 - RNA, 25 nt, Human
ccgcagcaaauccuggcaacuccgc

SEQ ID NO: 1067682 - RNA, 20 nt, Human
ccgccuucagcaucuaccgg

SEQ ID NO: 1067683 - RNA, 19 nt, Human
ccuccccagcgcuccccgc

SEQ ID NO: 1067684 - RNA, 26 nt, Human
ccuuauccacuuucaugcuccucccg

SEQ ID NO: 1067685 - RNA, 22 nt, Human
cgaccuggagccaaauccacac

SEQ ID NO: 1067686 - RNA, 23 nt, Human
cgcaggccugcgucccgaggccc

SEQ ID NO: 1067687 - RNA, 27 nt, Human
cgcaggccugcgucccgaggcccacac

SEQ ID NO: 1067688 - RNA, 24 nt, Human
cgccucauuucuccaaaaguccgc

SEQ ID NO: 1067689 - RNA, 19 nt, Human
cgcugcagccacgcaggcc

SEQ ID NO: 1067690 - RNA, 21 nt, Human
cggaggccuaacccccucccu

SEQ ID NO: 1067691 - RNA, 21 nt, Human
cggcacagcagcguccugccg

SEQ ID NO: 1067692 - RNA, 20 nt, Human
cggcuucugcgcggcauccu

SEQ ID NO: 1067693 - RNA, 24 nt, Human
cgguagaagaaauagugaaagucu

SEQ ID NO: 1067694 - RNA, 19 nt, Human
cucccguacuccuggcucc

SEQ ID NO: 1067695 - RNA, 21 nt, Human
cucccguacuccuggcuccuc

SEQ ID NO: 1067696 - RNA, 24 nt, Human
cucuuuguggcauuacuaauacaa

SEQ ID NO: 1067697 - RNA, 21 nt, Human
cuggauauucuccaggccugg

SEQ ID NO: 1067698 - RNA, 26 nt, Human
cuuggucaagcgguaacgccagugcc

SEQ ID NO: 1067699 - RNA, 21 nt, Human
gaaaaugcugacauaugcugc

SEQ ID NO: 1067700 - RNA, 20 nt, Human
gaccuagaaggcaagaggug

SEQ ID NO: 1067701 - RNA, 19 nt, Human
gacgcggggcugggcugga

SEQ ID NO: 1067702 - RNA, 18 nt, Human
gauucacccuccuuaccc

SEQ ID NO: 1067703 - RNA, 18 nt, Human
gcacacggggaggacacc

SEQ ID NO: 1067704 - RNA, 19 nt, Human
gcagagaagaaaaugcuga

SEQ ID NO: 1067705 - RNA, 19 nt, Human
gccucauuucuccaaaagu

SEQ ID NO: 1067706 - RNA, 23 nt, Human
gccucccccgucuuccccgucuc

SEQ ID NO: 1067707 - RNA, 18 nt, Human
gcgcccgcucgggacgcc

SEQ ID NO: 1067708 - RNA, 18 nt, Human
gcugcagccacgcaggcc

SEQ ID NO: 1067709 - RNA, 19 nt, Human
gcugcagccacgcaggccu

SEQ ID NO: 1067710 - RNA, 18 nt, Human
gcugcgggacgggcggac

SEQ ID NO: 1067711 - RNA, 23 nt, Human
ggacucuucuccccaggugcucc

SEQ ID NO: 1067712 - RNA, 24 nt, Human
ggcaagaggugagcccucugucac

SEQ ID NO: 1067713 - RNA, 21 nt, Human
ggcgcugguagcaggcgacgc

SEQ ID NO: 1067714 - RNA, 21 nt, Human
gggaggcuggauauucuccag

SEQ ID NO: 1067715 - RNA, 21 nt, Human
gggccccagcccaggcagccc

SEQ ID NO: 1067716 - RNA, 21 nt, Human
gugcagagaagaaaaugcuga

SEQ ID NO: 1067717 - RNA, 24 nt, Human
uagcaggcgacgccaggacucuuc

SEQ ID NO: 1067718 - RNA, 18 nt, Human
uaguggucccccggggcc

SEQ ID NO: 1067719 - RNA, 19 nt, Human
ucacggagggcuccggcag

SEQ ID NO: 1067720 - RNA, 20 nt, Human
ucagcaucuaccgggagccg

SEQ ID NO: 1067721 - RNA, 21 nt, Human
uccccaggugcucccgccgcg

SEQ ID NO: 1067722 - RNA, 19 nt, Human
ucccccggggcccagcugc

SEQ ID NO: 1067723 - RNA, 22 nt, Human
ucccccgucuuccccgucuccc

SEQ ID NO: 1067724 - RNA, 18 nt, Human
uccccuggugcgcugcag

SEQ ID NO: 1067725 - RNA, 23 nt, Human
uccccuggugcgcugcagccacg

SEQ ID NO: 1067726 - RNA, 23 nt, Human
ucccgaggcccacacggcuucug

SEQ ID NO: 1067727 - RNA, 22 nt, Human
uccuaugaucacgugacuugcu

SEQ ID NO: 1067728 - RNA, 24 nt, Human
ucuccaaaaguccgcagcaaaucc

SEQ ID NO: 1067729 - RNA, 20 nt, Human
ucucuggucucugcacacgg

SEQ ID NO: 1067730 - RNA, 18 nt, Human
ucuuaaagucuuugaucg

SEQ ID NO: 1067731 - RNA, 23 nt, Human
ugagaagugaccuagaaggcaag

SEQ ID NO: 1067732 - RNA, 19 nt, Human
ugagggcuccuuggucaag

SEQ ID NO: 1067733 - RNA, 20 nt, Human
ugccuaagagggaagggccc

SEQ ID NO: 1067734 - RNA, 19 nt, Human
ugcgcagacccacccgggc

SEQ ID NO: 1067735 - RNA, 19 nt, Human
uggcauuacuaauacaacc

SEQ ID NO: 1067736 - RNA, 24 nt, Human
uggucaagcgguaacgccagugcc

SEQ ID NO: 1067737 - RNA, 23 nt, Human
ugugggaggcuggauauucucca

SEQ ID NO: 1067738 - RNA, 22 nt, Human
uucuccaaaaguccgcagcaaa

SEQ ID NO: 1067739 - RNA, 22 nt, Human
uuuaucacuuagaagauucacc

SEQ ID NO: 1067740 - RNA, 28 nt, Human
aaaacaaaaaccaaacaaacaaaaacaa

SEQ ID NO: 1067741 - RNA, 18 nt, Human
aaaacagcucacaucuga

SEQ ID NO: 1067742 - RNA, 24 nt, Human
aaacaaaaaccaaacaaacaaaaa

SEQ ID NO: 1067743 - RNA, 25 nt, Human
aaacaaaaaccaaacaaacaaaaac

SEQ ID NO: 1067744 - RNA, 22 nt, Human
aaaccaaacaaacaaaaacaaa

SEQ ID NO: 1067745 - RNA, 19 nt, Human
aagggguaggggggugggg

SEQ ID NO: 1067746 - RNA, 19 nt, Human
aauuccuagccccguccuc

SEQ ID NO: 1067747 - RNA, 24 nt, Human
acaaaaaccaaacaaacaaaaaca

SEQ ID NO: 1067748 - RNA, 25 nt, Human
acaaacaaaaacaaaaacuuugaag

SEQ ID NO: 1067749 - RNA, 21 nt, Human
acagggagauugggugccagg

SEQ ID NO: 1067750 - RNA, 22 nt, Human
accaaacaaacaaaaacaaaaa

SEQ ID NO: 1067751 - RNA, 18 nt, Human
acccugggcugaggaccc

SEQ ID NO: 1067752 - RNA, 21 nt, Human
acuagcugacucccaaaacag

SEQ ID NO: 1067753 - RNA, 20 nt, Human
agacuccuaaggcagcuccu

SEQ ID NO: 1067754 - RNA, 18 nt, Human
agaggagcugacucagag

SEQ ID NO: 1067755 - RNA, 23 nt, Human
agcccuggucaauuccuagcccc

SEQ ID NO: 1067756 - RNA, 22 nt, Human
agccugcugcuggucucugauc

SEQ ID NO: 1067757 - RNA, 19 nt, Human
aggaagcaaguggaggugg

SEQ ID NO: 1067758 - RNA, 19 nt, Human
aggacccacggacaccgga

SEQ ID NO: 1067759 - RNA, 22 nt, Human
aggccccccccccuccccgccc

SEQ ID NO: 1067760 - RNA, 24 nt, Human
aggccccccccccuccccgcccag

SEQ ID NO: 1067761 - RNA, 21 nt, Human
aggggacagugaaggacaggg

SEQ ID NO: 1067762 - RNA, 20 nt, Human
aggggggugggguccucagg

SEQ ID NO: 1067763 - RNA, 23 nt, Human
agguggcugggguggggcagugu

SEQ ID NO: 1067764 - RNA, 19 nt, Human
agguguuguguggcaaccc

SEQ ID NO: 1067765 - RNA, 22 nt, Human
agguguuguguggcaaccccca

SEQ ID NO: 1067766 - RNA, 24 nt, Human
agguguuguguggcaacccccaga

SEQ ID NO: 1067767 - RNA, 26 nt, Human
caaaaacaaaaacuuugaagcacaaa

SEQ ID NO: 1067768 - RNA, 23 nt, Human
caaaaaccaaacaaacaaaaaca

SEQ ID NO: 1067769 - RNA, 23 nt, Human
caaaacaaaaaccaaacaaacaa

SEQ ID NO: 1067770 - RNA, 26 nt, Human
caaaacaaaaaccaaacaaacaaaaa

SEQ ID NO: 1067771 - RNA, 27 nt, Human
caaaacaaaaaccaaacaaacaaaaac

SEQ ID NO: 1067772 - RNA, 24 nt, Human
caaaacuccaaauacaagucuacc

SEQ ID NO: 1067773 - RNA, 22 nt, Human
caaacaaaaacaaaaacuuuga

SEQ ID NO: 1067774 - RNA, 21 nt, Human
caacccccagaugggcccaga

SEQ ID NO: 1067775 - RNA, 20 nt, Human
cacaaaacuccaaauacaag

SEQ ID NO: 1067776 - RNA, 19 nt, Human
cacagcaccuugguuucug

SEQ ID NO: 1067777 - RNA, 19 nt, Human
caccugggccaccauccau

SEQ ID NO: 1067778 - RNA, 20 nt, Human
cacuuuagcaaggggccaga

SEQ ID NO: 1067779 - RNA, 24 nt, Human
cagaagacugcccagggcugccca

SEQ ID NO: 1067780 - RNA, 22 nt, Human
cagaagccacgggaucuggaga

SEQ ID NO: 1067781 - RNA, 22 nt, Human
cagagcagcuaaauucugggcc

SEQ ID NO: 1067782 - RNA, 22 nt, Human
cagagggacaggggcgagguuc

SEQ ID NO: 1067783 - RNA, 18 nt, Human
cagccgcuccagcucucu

SEQ ID NO: 1067784 - RNA, 18 nt, Human
cagccugcugcuggucuc

SEQ ID NO: 1067785 - RNA, 18 nt, Human
cagcuuccugccccucac

SEQ ID NO: 1067786 - RNA, 21 nt, Human
caggaaaagguaaguuaggug

SEQ ID NO: 1067787 - RNA, 22 nt, Human
caggccccccccccuccccccu

SEQ ID NO: 1067788 - RNA, 18 nt, Human
cagggcugcccacuccug

SEQ ID NO: 1067789 - RNA, 22 nt, Human
ccaaacaaacaaaaacaaaaac

SEQ ID NO: 1067790 - RNA, 23 nt, Human
ccaaacaaacaaaaacaaaaacu

SEQ ID NO: 1067791 - RNA, 19 nt, Human
ccaaaggcugcuggggaag

SEQ ID NO: 1067792 - RNA, 21 nt, Human
ccaccagggcgcagcgccuga

SEQ ID NO: 1067793 - RNA, 23 nt, Human
ccacccccucaaaacaaaaacca

SEQ ID NO: 1067794 - RNA, 20 nt, Human
ccacgggaucuggagaaccc

SEQ ID NO: 1067795 - RNA, 24 nt, Human
ccagaagacugcccagggcugccc

SEQ ID NO: 1067796 - RNA, 26 nt, Human
ccagcuggucucaaaaguggcuguca

SEQ ID NO: 1067797 - RNA, 26 nt, Human
ccauccaucucauuacccuaagagcc

SEQ ID NO: 1067798 - RNA, 24 nt, Human
ccccacccccucaaaacaaaaacc

SEQ ID NO: 1067799 - RNA, 27 nt, Human
ccccacccccucaaaacaaaaaccaaa

SEQ ID NO: 1067800 - RNA, 19 nt, Human
ccccagcuuccugccccuc

SEQ ID NO: 1067801 - RNA, 22 nt, Human
ccccccacccccucaaaacaaa

SEQ ID NO: 1067802 - RNA, 21 nt, Human
ccccccccacccccucaaaac

SEQ ID NO: 1067803 - RNA, 25 nt, Human
ccccccccacccccucaaaacaaaa

SEQ ID NO: 1067804 - RNA, 18 nt, Human
cccccucaaaacaaaaac

SEQ ID NO: 1067805 - RNA, 20 nt, Human
ccccucaaaacaaaaaccaa

SEQ ID NO: 1067806 - RNA, 24 nt, Human
ccccucaaaacaaaaaccaaacaa

SEQ ID NO: 1067807 - RNA, 19 nt, Human
ccccuccccgcccaggucu

SEQ ID NO: 1067808 - RNA, 20 nt, Human
cccggcagagggacaggggc

SEQ ID NO: 1067809 - RNA, 19 nt, Human
ccggcagagggacaggggc

SEQ ID NO: 1067810 - RNA, 20 nt, Human
ccuagccccguccuccgacc

SEQ ID NO: 1067811 - RNA, 24 nt, Human
ccucucugagcaaaggccucuagu

SEQ ID NO: 1067812 - RNA, 22 nt, Human
cgacccaagacuccuaaggcag

SEQ ID NO: 1067813 - RNA, 27 nt, Human
cggcaggcaaagcccuggucaauuccu

SEQ ID NO: 1067814 - RNA, 19 nt, Human
cggcuuucuggagggcagc

SEQ ID NO: 1067815 - RNA, 27 nt, Human
cgucccaucccgccugacugcagcuca

SEQ ID NO: 1067816 - RNA, 19 nt, Human
cuccauacuagcugacucc

SEQ ID NO: 1067817 - RNA, 21 nt, Human
cucuagacagggcagacagcc

SEQ ID NO: 1067818 - RNA, 24 nt, Human
cucuagacagggcagacagccugc

SEQ ID NO: 1067819 - RNA, 22 nt, Human
cucucugagcaaaggccucuag

SEQ ID NO: 1067820 - RNA, 24 nt, Human
cugaaugucaggaagaauccacaa

SEQ ID NO: 1067821 - RNA, 21 nt, Human
gagacggaagcgugcugcaga

SEQ ID NO: 1067822 - RNA, 21 nt, Human
gagcugacucagaggacaguc

SEQ ID NO: 1067823 - RNA, 22 nt, Human
gagcugacucagaggacagucu

SEQ ID NO: 1067824 - RNA, 21 nt, Human
gagcuggcaggggacucccag

SEQ ID NO: 1067825 - RNA, 21 nt, Human
gagguggcugggguggggcag

SEQ ID NO: 1067826 - RNA, 26 nt, Human
gcaaaguugccuccacucaacagaag

SEQ ID NO: 1067827 - RNA, 18 nt, Human
gccccccccccuccccgc

SEQ ID NO: 1067828 - RNA, 19 nt, Human
gcgccaaguggaacuggag

SEQ ID NO: 1067829 - RNA, 22 nt, Human
gcucuguauccccccccacccc

SEQ ID NO: 1067830 - RNA, 20 nt, Human
gcuggggaagggguaggggg

SEQ ID NO: 1067831 - RNA, 21 nt, Human
ggacaagagacaggguugggg

SEQ ID NO: 1067832 - RNA, 24 nt, Human
ggacagucuaagucagggugagga

SEQ ID NO: 1067833 - RNA, 22 nt, Human
ggagagaggugaggguccaaag

SEQ ID NO: 1067834 - RNA, 21 nt, Human
ggagauugggugccaggggcc

SEQ ID NO: 1067835 - RNA, 19 nt, Human
ggagggaaggaggaggaag

SEQ ID NO: 1067836 - RNA, 22 nt, Human
ggcccuggaaaaugcaccuggg

SEQ ID NO: 1067837 - RNA, 19 nt, Human
ggggaagagcucuagacag

SEQ ID NO: 1067838 - RNA, 21 nt, Human
ggggaagggguaggggggugg

SEQ ID NO: 1067839 - RNA, 22 nt, Human
ggggggugggguccucagggag

SEQ ID NO: 1067840 - RNA, 23 nt, Human
ggguuggggucuggcuggcucuu

SEQ ID NO: 1067841 - RNA, 20 nt, Human
guauccccccccacccccuc

SEQ ID NO: 1067842 - RNA, 20 nt, Human
gucagagcagcuaaauucug

SEQ ID NO: 1067843 - RNA, 26 nt, Human
uaaaauaaauaaauacaaauugauca

SEQ ID NO: 1067844 - RNA, 18 nt, Human
uaaagcaguguuuuggaa

SEQ ID NO: 1067845 - RNA, 19 nt, Human
uaagaaggaccacgcccua

SEQ ID NO: 1067846 - RNA, 21 nt, Human
uaagagaaugaagagaggaaa

SEQ ID NO: 1067847 - RNA, 21 nt, Human
uaccaagacugaaaucacaaa

SEQ ID NO: 1067848 - RNA, 25 nt, Human
uaccaagacugaaaucacaaagggc

SEQ ID NO: 1067849 - RNA, 21 nt, Human
uaccccggcuuucuggagggc

SEQ ID NO: 1067850 - RNA, 21 nt, Human
uagcugacucccaaaacagcu

SEQ ID NO: 1067851 - RNA, 22 nt, Human
uagguuugggggcuggguugca

SEQ ID NO: 1067852 - RNA, 22 nt, Human
uaucagagguggcuggagaggc

SEQ ID NO: 1067853 - RNA, 19 nt, Human
ucacaggccccccccccuc

SEQ ID NO: 1067854 - RNA, 26 nt, Human
ucacaggccccccccccuccccgccc

SEQ ID NO: 1067855 - RNA, 19 nt, Human
ucaggaaaagguaaguuag

SEQ ID NO: 1067856 - RNA, 23 nt, Human
ucauuacccuaagagccuuuugc

SEQ ID NO: 1067857 - RNA, 25 nt, Human
uccacucaacagaagccacgggauc

SEQ ID NO: 1067858 - RNA, 22 nt, Human
ucccagucagggcccagugggc

SEQ ID NO: 1067859 - RNA, 20 nt, Human
uccccgcccaggucugaggg

SEQ ID NO: 1067860 - RNA, 21 nt, Human
ucucagguggucacaggcccc

SEQ ID NO: 1067861 - RNA, 30 nt, Human
ucuccuaaauucagcccuuuagauaaauaa

SEQ ID NO: 1067862 - RNA, 24 nt, Human
ucucugauccucugccaacgauuc

SEQ ID NO: 1067863 - RNA, 24 nt, Human
ugaagagugugugugagcugggag

SEQ ID NO: 1067864 - RNA, 18 nt, Human
ugaagugacuacaaagcc

SEQ ID NO: 1067865 - RNA, 22 nt, Human
ugaccucuggccugcccguccc

SEQ ID NO: 1067866 - RNA, 22 nt, Human
ugacugcagcucacccugggcu

SEQ ID NO: 1067867 - RNA, 22 nt, Human
ugaggguccaaaggcugcuggg

SEQ ID NO: 1067868 - RNA, 20 nt, Human
ugaugaugguuucccaacuu

SEQ ID NO: 1067869 - RNA, 23 nt, Human
ugcuaggagcuggcugaccucug

SEQ ID NO: 1067870 - RNA, 18 nt, Human
ugcucuguaucccccccc

SEQ ID NO: 1067871 - RNA, 23 nt, Human
ugcugagggcggcaggcaaagcc

SEQ ID NO: 1067872 - RNA, 22 nt, Human
uggcaacccccagaugggccca

SEQ ID NO: 1067873 - RNA, 22 nt, Human
uggcaggggacucccagucagg

SEQ ID NO: 1067874 - RNA, 19 nt, Human
uggcugggguggggcagug

SEQ ID NO: 1067875 - RNA, 19 nt, Human
ugggagggggcgccaagug

SEQ ID NO: 1067876 - RNA, 19 nt, Human
ugggcagccgcuccagcuc

SEQ ID NO: 1067877 - RNA, 24 nt, Human
uggggucuggcuggcucuucucug

SEQ ID NO: 1067878 - RNA, 21 nt, Human
uuccuccaacuaguccaggca

SEQ ID NO: 1067879 - RNA, 20 nt, Human
uucuggagggcagccccagc

SEQ ID NO: 1067880 - RNA, 22 nt, Human
uugaagcacaaaacuccaaaua

SEQ ID NO: 1067881 - RNA, 23 nt, Human
uuggggucuggcuggcucuucuc

SEQ ID NO: 1067882 - RNA, 29 nt, Human
uuugccccuggguaaaaagucuccuaaau

SEQ ID NO: 1067883 - RNA, 18 nt, Human
uuuucagaguuccuaccc

SEQ ID NO: 1067884 - RNA, 23 nt, Human
uuuuucagaguuccuaccccggc

SEQ ID NO: 1067885 - RNA, 18 nt, Human
ccuggcuccugucguccc

SEQ ID NO: 1067886 - RNA, 20 nt, Human
guccuggcuccugucguccc

SEQ ID NO: 1067887 - RNA, 21 nt, Human
aaagagacagaguuagcauca

SEQ ID NO: 1067888 - RNA, 20 nt, Human
aacaccaucagcagcugcca

SEQ ID NO: 1067889 - RNA, 18 nt, Human
acaaagcaaaacaaugcu

SEQ ID NO: 1067890 - RNA, 24 nt, Human
acacaaaucuuuuaggauuggcac

SEQ ID NO: 1067891 - RNA, 27 nt, Human
acagagaaaaauauaucuuguccuuuu

SEQ ID NO: 1067892 - RNA, 18 nt, Human
agggucacuuugcugagc

SEQ ID NO: 1067893 - RNA, 21 nt, Human
agugcagaaaaaaguaaguac

SEQ ID NO: 1067894 - RNA, 23 nt, Human
aguuauagaaauacagagaaaaa

SEQ ID NO: 1067895 - RNA, 21 nt, Human
aucuuuuaggauuggcaccau

SEQ ID NO: 1067896 - RNA, 22 nt, Human
caacugagaaacaggcaaguau

SEQ ID NO: 1067897 - RNA, 23 nt, Human
caagcugccacaacagagaaaga

SEQ ID NO: 1067898 - RNA, 24 nt, Human
caauagacaguagagacucuccca

SEQ ID NO: 1067899 - RNA, 19 nt, Human
cacagaacugcagcagagc

SEQ ID NO: 1067900 - RNA, 21 nt, Human
cacugaucuguauuuuuucac

SEQ ID NO: 1067901 - RNA, 23 nt, Human
ccuagaaugaauauucaguucuc

SEQ ID NO: 1067902 - RNA, 21 nt, Human
ccucuucaaagugaauucuga

SEQ ID NO: 1067903 - RNA, 22 nt, Human
cgacugaauuaucacugggcac

SEQ ID NO: 1067904 - RNA, 19 nt, Human
ggcuuggaagucacagaac

SEQ ID NO: 1067905 - RNA, 23 nt, Human
uaaaaagagcauuuaauuccugg

SEQ ID NO: 1067906 - RNA, 22 nt, Human
uaaaaccaaaucaguuauaagu

SEQ ID NO: 1067907 - RNA, 19 nt, Human
uaccuuugaagucuccaaa

SEQ ID NO: 1067908 - RNA, 21 nt, Human
uagaguuauuacuuggaaccu

SEQ ID NO: 1067909 - RNA, 20 nt, Human
uauacaauucauuuacaguc

SEQ ID NO: 1067910 - RNA, 24 nt, Human
uauagcccuagaaugaauauucag

SEQ ID NO: 1067911 - RNA, 25 nt, Human
uauuauuuuaauaguacaagcugcc

SEQ ID NO: 1067912 - RNA, 23 nt, Human
uccaaaauaaaagaucucaagaa

SEQ ID NO: 1067913 - RNA, 22 nt, Human
ucccaggccucagacccucuuc

SEQ ID NO: 1067914 - RNA, 21 nt, Human
ucucccaggccucagacccuc

SEQ ID NO: 1067915 - RNA, 26 nt, Human
ugccacaacagagaaagaacagauac

SEQ ID NO: 1067916 - RNA, 20 nt, Human
ugcuuuuuaagagauauguu

SEQ ID NO: 1067917 - RNA, 19 nt, Human
ugugaaguucauauccuau

SEQ ID NO: 1067918 - RNA, 25 nt, Human
uguuacuaaaaaaauagaaaaugaa

SEQ ID NO: 1067919 - RNA, 24 nt, Human
uuaauuccuggcuuggaagucaca

SEQ ID NO: 1067920 - RNA, 19 nt, Human
uuauuauuacaguugauua

SEQ ID NO: 1067921 - RNA, 24 nt, Human
uucacaguauaaaauuguaaaugg

SEQ ID NO: 1067922 - RNA, 19 nt, Human
uuggaagucacagaacugc

SEQ ID NO: 1067923 - RNA, 19 nt, Human
uuuaaaaccaaaucaguua

SEQ ID NO: 1067924 - RNA, 26 nt, Human
uuucuaauuacaacaccaucagcagc

SEQ ID NO: 1067925 - RNA, 24 nt, Human
uuugaagucuccaaaacauguaca

SEQ ID NO: 1067926 - RNA, 18 nt, Human
aaaaugcucuacaacauu

SEQ ID NO: 1067927 - RNA, 20 nt, Human
caacucuuuaaaacaaaaua

SEQ ID NO: 1067928 - RNA, 23 nt, Human
caaugaaaauuuaccccaagcau

SEQ ID NO: 1067929 - RNA, 23 nt, Human
caugaaaacuaagccgucagaga

SEQ ID NO: 1067930 - RNA, 21 nt, Human
cauuaagaaaaccucagcaaa

SEQ ID NO: 1067931 - RNA, 23 nt, Human
ccacucuacaaaaugcucuacaa

SEQ ID NO: 1067932 - RNA, 23 nt, Human
cccaagcauacaacucuuuaaaa

SEQ ID NO: 1067933 - RNA, 24 nt, Human
cuagugaugccaguaguucaugcc

SEQ ID NO: 1067934 - RNA, 20 nt, Human
cucuacaacauuaagaaaac

SEQ ID NO: 1067935 - RNA, 20 nt, Human
gugggaauuagacucuguuu

SEQ ID NO: 1067936 - RNA, 21 nt, Human
uaaauuccacauaugacaaug

SEQ ID NO: 1067937 - RNA, 18 nt, Human
uacaaaaugcucuacaac

SEQ ID NO: 1067938 - RNA, 21 nt, Human
uaucugucaucaaaauaucac

SEQ ID NO: 1067939 - RNA, 21 nt, Human
uccacauaugacaaugaaaau

SEQ ID NO: 1067940 - RNA, 23 nt, Human
ugcuuuuuuuccuagacaugaaa

SEQ ID NO: 1067941 - RNA, 24 nt, Human
uuaaauuccacauaugacaaugaa

SEQ ID NO: 1067942 - RNA, 23 nt, Human
auaguuuuugaagaagauauugg

SEQ ID NO: 1067943 - RNA, 20 nt, Human
gagacgguggcugcccgggc

SEQ ID NO: 1067944 - RNA, 22 nt, Human
gagacgguggcugcccgggcuc

SEQ ID NO: 1067945 - RNA, 21 nt, Human
guaauagaugcuucauccaca

SEQ ID NO: 1067946 - RNA, 22 nt, Human
uguaucuuuugucucucugggg

SEQ ID NO: 1067947 - RNA, 25 nt, Human
aaaaacauuacagguacacauggaa

SEQ ID NO: 1067948 - RNA, 21 nt, Human
aacucgccuuccuccaucccc

SEQ ID NO: 1067949 - RNA, 21 nt, Human
acucgccuuccuccauccccu

SEQ ID NO: 1067950 - RNA, 22 nt, Human
acuuugagacaugauggaaaaa

SEQ ID NO: 1067951 - RNA, 22 nt, Human
augacuguacuuugagacauga

SEQ ID NO: 1067952 - RNA, 24 nt, Human
augauggaaaaacauuacagguac

SEQ ID NO: 1067953 - RNA, 19 nt, Human
cagaauccacaccaaccuc

SEQ ID NO: 1067954 - RNA, 21 nt, Human
cagaauccacaccaaccuccu

SEQ ID NO: 1067955 - RNA, 21 nt, Human
caggagcagacacuggguccc

SEQ ID NO: 1067956 - RNA, 19 nt, Human
cauuacagguacacaugga

SEQ ID NO: 1067957 - RNA, 24 nt, Human
ccaaccuccucauaauccuucuca

SEQ ID NO: 1067958 - RNA, 24 nt, Human
cccacguaccagugaacaaaggca

SEQ ID NO: 1067959 - RNA, 22 nt, Human
ccuccauccccucacccacgua

SEQ ID NO: 1067960 - RNA, 19 nt, Human
cgagcccaggccucagcaa

SEQ ID NO: 1067961 - RNA, 22 nt, Human
cucacccacguaccagugaaca

SEQ ID NO: 1067962 - RNA, 18 nt, Human
gacuguacuuugagacau

SEQ ID NO: 1067963 - RNA, 23 nt, Human
guccaggcgagcccaggccucag

SEQ ID NO: 1067964 - RNA, 25 nt, Human
uaaccagaaagcuuuaaugucuguc

SEQ ID NO: 1067965 - RNA, 18 nt, Human
uaccagugaacaaaggca

SEQ ID NO: 1067966 - RNA, 20 nt, Human
ucacgggccucugaaaacuc

SEQ ID NO: 1067967 - RNA, 20 nt, Human
ucagcuaagcugaagcugaa

SEQ ID NO: 1067968 - RNA, 22 nt, Human
uccacaccaaccuccucauaau

SEQ ID NO: 1067969 - RNA, 20 nt, Human
uccucucuuucuuccucacc

SEQ ID NO: 1067970 - RNA, 25 nt, Human
ucugaaaacucgccuuccuccaucc

SEQ ID NO: 1067971 - RNA, 18 nt, Human
ucuuucuuccucacccuc

SEQ ID NO: 1067972 - RNA, 20 nt, Human
ucuuucuuccucacccucuc

SEQ ID NO: 1067973 - RNA, 22 nt, Human
ugaaauucugggagcacgacau

SEQ ID NO: 1067974 - RNA, 21 nt, Human
ugagacaugauggaaaaacau

SEQ ID NO: 1067975 - RNA, 19 nt, Human
uggcauacaucaggucaaa

SEQ ID NO: 1067976 - RNA, 25 nt, Human
ugguccaggcgagcccaggccucag

SEQ ID NO: 1067977 - RNA, 22 nt, Human
aaaguacacauucaaggugguu

SEQ ID NO: 1067978 - RNA, 22 nt, Human
acaauaaaucaucgugaaaccc

SEQ ID NO: 1067979 - RNA, 19 nt, Human
acaggcucucgcacauagu

SEQ ID NO: 1067980 - RNA, 21 nt, Human
aggcucucgcacauagugucu

SEQ ID NO: 1067981 - RNA, 19 nt, Human
cacauucaaggugguuauc

SEQ ID NO: 1067982 - RNA, 22 nt, Human
cacauucaaggugguuauccca

SEQ ID NO: 1067983 - RNA, 18 nt, Human
cauuccaugaaguuacaa

SEQ ID NO: 1067984 - RNA, 22 nt, Human
cauuccaugaaguuacaaugag

SEQ ID NO: 1067985 - RNA, 23 nt, Human
aaaauguccucgcccuccuuucg

SEQ ID NO: 1067986 - RNA, 18 nt, Human
accauauuuaauagaaac

SEQ ID NO: 1067987 - RNA, 18 nt, Human
agacaaauuagcccacag

SEQ ID NO: 1067988 - RNA, 21 nt, Human
aggcucagacacuugcagcag

SEQ ID NO: 1067989 - RNA, 22 nt, Human
augagagacaaauuagcccaca

SEQ ID NO: 1067990 - RNA, 22 nt, Human
caacucugaauccacugagccu

SEQ ID NO: 1067991 - RNA, 23 nt, Human
caauaaaguaucacucacacucu

SEQ ID NO: 1067992 - RNA, 27 nt, Human
cagaguaaaaucaacucugaauccacu

SEQ ID NO: 1067993 - RNA, 25 nt, Human
ccaaaaugagagacaaauuagccca

SEQ ID NO: 1067994 - RNA, 21 nt, Human
ccagcaucugguucugguggu

SEQ ID NO: 1067995 - RNA, 23 nt, Human
ccuccugcaaaagagccaugaau

SEQ ID NO: 1067996 - RNA, 18 nt, Human
ccucgcccuccuuucgca

SEQ ID NO: 1067997 - RNA, 23 nt, Human
ccugcacugagcucuggauucac

SEQ ID NO: 1067998 - RNA, 21 nt, Human
ccuuccagcaucugguucugg

SEQ ID NO: 1067999 - RNA, 19 nt, Human
cucacauaauccuuccagc

SEQ ID NO: 1068000 - RNA, 20 nt, Human
cuccaaaagccugaguagcu

SEQ ID NO: 1068001 - RNA, 23 nt, Human
cucccugggauguuccauucugg

SEQ ID NO: 1068002 - RNA, 18 nt, Human
cuuggcuuucauugaguu

SEQ ID NO: 1068003 - RNA, 20 nt, Human
gaagcacaagugaggacaau

SEQ ID NO: 1068004 - RNA, 20 nt, Human
gacacuugcagcagcgggga

SEQ ID NO: 1068005 - RNA, 19 nt, Human
gaguuugcuuuguuucucc

SEQ ID NO: 1068006 - RNA, 23 nt, Human
gcacugagcucuggauucacagg

SEQ ID NO: 1068007 - RNA, 27 nt, Human
gcgaaaaagagggcuuucugggauaaa

SEQ ID NO: 1068008 - RNA, 25 nt, Human
gcuuuguuucuccucauguuuguca

SEQ ID NO: 1068009 - RNA, 30 nt, Human; identical to SEQ ID NO: 846133

SEQ ID NO: 1068010 - RNA, 18 nt, Human
uacgaaggacccaaaaug

SEQ ID NO: 1068011 - RNA, 30 nt, Human; identical to SEQ ID NO: 846135

SEQ ID NO: 1068012 - RNA, 22 nt, Human
ucaacucugaauccacugagcc

SEQ ID NO: 1068013 - RNA, 18 nt, Human
ucacucacacucugauau

SEQ ID NO: 1068014 - RNA, 19 nt, Human
ucacucacacucugauaua

SEQ ID NO: 1068015 - RNA, 19 nt, Human
uccacaucugcuuuauggu

SEQ ID NO: 1068016 - RNA, 22 nt, Human
ucuccaaaagccugaguagcuc

SEQ ID NO: 1068017 - RNA, 20 nt, Human
ugaaaaauguccucgcccuc

SEQ ID NO: 1068018 - RNA, 21 nt, Human
ugaaaaauguccucgcccucc

SEQ ID NO: 1068019 - RNA, 18 nt, Human
ugagagacaaauuagccc

SEQ ID NO: 1068020 - RNA, 22 nt, Human
ugagauuuucacaagcuuuuug

SEQ ID NO: 1068021 - RNA, 18 nt, Human
ugagccuguccagcaguc

SEQ ID NO: 1068022 - RNA, 23 nt, Human
ugaguagcuccacaucugcuuua

SEQ ID NO: 1068023 - RNA, 21 nt, Human
uggcuuggcuuucauugaguu

SEQ ID NO: 1068024 - RNA, 21 nt, Human
ugguucuggugguuucugugu

SEQ ID NO: 1068025 - RNA, 19 nt, Human
ugguucuuucaggcugcag

SEQ ID NO: 1068026 - RNA, 22 nt, Human
ugucuccaaaagccugaguagc

SEQ ID NO: 1068027 - RNA, 24 nt, Human
uucacaagcuuuuugccauaaaga

SEQ ID NO: 1068028 - RNA, 19 nt, Human
uugaugaggugcgaaaaag

SEQ ID NO: 1068029 - RNA, 19 nt, Human
aaaggcccaauuccaagag

SEQ ID NO: 1068030 - RNA, 20 nt, Human
aacacacccaagacuaaaga

SEQ ID NO: 1068031 - RNA, 18 nt, Human
agaggaggugagaaggag

SEQ ID NO: 1068032 - RNA, 19 nt, Human
agagucccccacauggacc

SEQ ID NO: 1068033 - RNA, 23 nt, Human
agagucccccacauggaccuccc

SEQ ID NO: 1068034 - RNA, 24 nt, Human
aguacuccucaaggucaggagcuc

SEQ ID NO: 1068035 - RNA, 23 nt, Human
auaaaacagaacguauuuguccu

SEQ ID NO: 1068036 - RNA, 18 nt, Human
caaaacacagcuuccucu

SEQ ID NO: 1068037 - RNA, 24 nt, Human
caagacuaaagagucccuccucuc

SEQ ID NO: 1068038 - RNA, 21 nt, Human
caccaaaggcccaauuccaag

SEQ ID NO: 1068039 - RNA, 18 nt, Human
caccccaugcaagaaaac

SEQ ID NO: 1068040 - RNA, 19 nt, Human
cucaaggucaggagcucau

SEQ ID NO: 1068041 - RNA, 23 nt, Human
cuuaacacacccaagacuaaaga

SEQ ID NO: 1068042 - RNA, 18 nt, Human
gaacacauaucugauuug

SEQ ID NO: 1068043 - RNA, 20 nt, Human
gaaggagcaauuagggaugg

SEQ ID NO: 1068044 - RNA, 22 nt, Human
gagaaauaauucuguuaaguac

SEQ ID NO: 1068045 - RNA, 19 nt, Human
gugguaaagaggcugcacu

SEQ ID NO: 1068046 - RNA, 22 nt, Human
guuaaguacuccucaaggucag

SEQ ID NO: 1068047 - RNA, 20 nt, Human
uaaagaggcugcacugaaug

SEQ ID NO: 1068048 - RNA, 23 nt, Human
uagcuucacaauccaggaauaau

SEQ ID NO: 1068049 - RNA, 21 nt, Human
ucagaggucaccaaaacacag

SEQ ID NO: 1068050 - RNA, 18 nt, Human
uccucaaggucaggagcu

SEQ ID NO: 1068051 - RNA, 18 nt, Human
ucgcuggguucuuugaag

SEQ ID NO: 1068052 - RNA, 19 nt, Human
ucgucccuuuccaauacuu

SEQ ID NO: 1068053 - RNA, 23 nt, Human
ugaacacagcaaaagauaggccu

SEQ ID NO: 1068054 - RNA, 25 nt, Human
ugagaaggagcaauuagggauggug

SEQ ID NO: 1068055 - RNA, 18 nt, Human
ugagaggaggugagaagg

SEQ ID NO: 1068056 - RNA, 21 nt, Human
ugagaggaggugagaaggagc

SEQ ID NO: 1068057 - RNA, 19 nt, Human
ugauaaggcacaaggaaga

SEQ ID NO: 1068058 - RNA, 20 nt, Human
uucgucccuuuccaauacuu

SEQ ID NO: 1068059 - RNA, 20 nt, Human
uaaaacacccgaggcagccu

SEQ ID NO: 1068060 - RNA, 23 nt, Human
uaaacaacaacuuuauuaaaaca

SEQ ID NO: 1068061 - RNA, 18 nt, Human
aaaacggggcugauuuga

SEQ ID NO: 1068062 - RNA, 19 nt, Human
aaaacuaaaaacaaaguca

SEQ ID NO: 1068063 - RNA, 24 nt, Human
aaaagaaguaagaaacaacuucca

SEQ ID NO: 1068064 - RNA, 20 nt, Human
aaacaaagucacucaagugu

SEQ ID NO: 1068065 - RNA, 21 nt, Human
aaacagacagacagaagcaaa

SEQ ID NO: 1068066 - RNA, 27 nt, Human
aaacagacagacagaagcaaaacccca

SEQ ID NO: 1068067 - RNA, 23 nt, Human
aacaaaaacaacucucagaccau

SEQ ID NO: 1068068 - RNA, 23 nt, Human
aacaaagucacucaaguguccaa

SEQ ID NO: 1068069 - RNA, 21 nt, Human
aagaaguaagaaacaacuucc

SEQ ID NO: 1068070 - RNA, 23 nt, Human
aaggcuagaggcugaaaggagcu

SEQ ID NO: 1068071 - RNA, 18 nt, Human
acaaaaacaacucucaga

SEQ ID NO: 1068072 - RNA, 21 nt, Human
acaaaaacaacucucagacca

SEQ ID NO: 1068073 - RNA, 22 nt, Human
acaaaacuaaaaacaaagucac

SEQ ID NO: 1068074 - RNA, 23 nt, Human
acaaaacuaaaaacaaagucacu

SEQ ID NO: 1068075 - RNA, 20 nt, Human
acaaagcauagacauacaau

SEQ ID NO: 1068076 - RNA, 20 nt, Human
acccaucuagaaaugacauu

SEQ ID NO: 1068077 - RNA, 18 nt, Human
agaauuagaaacccaucu

SEQ ID NO: 1068078 - RNA, 23 nt, Human
agacagacagaagcaaaacccca

SEQ ID NO: 1068079 - RNA, 22 nt, Human
agacauacaaugagaaagagca

SEQ ID NO: 1068080 - RNA, 24 nt, Human
agagagaaaagaaguaagaaacaa

SEQ ID NO: 1068081 - RNA, 19 nt, Human
agcaggcuucauguggcuc

SEQ ID NO: 1068082 - RNA, 22 nt, Human
agcaggcuucauguggcucugc

SEQ ID NO: 1068083 - RNA, 18 nt, Human
agcgucucccugagacag

SEQ ID NO: 1068084 - RNA, 25 nt, Human
agcuggcuugcugcucccuggcccc

SEQ ID NO: 1068085 - RNA, 18 nt, Human
auagaacaaaaacaacuc

SEQ ID NO: 1068086 - RNA, 27 nt, Human
caaaaacaaaacuaaaaacaaagucac

SEQ ID NO: 1068087 - RNA, 21 nt, Human
caaaaccccaaaugagaaaga

SEQ ID NO: 1068088 - RNA, 18 nt, Human
caaagcagcaccuugaac

SEQ ID NO: 1068089 - RNA, 18 nt, Human
caccagcgucuggguagc

SEQ ID NO: 1068090 - RNA, 19 nt, Human
cagacagaagcaaaacccc

SEQ ID NO: 1068091 - RNA, 19 nt, Human
cagcaggcuucauguggcu

SEQ ID NO: 1068092 - RNA, 24 nt, Human
caggaggagacuuuuuacccaggc

SEQ ID NO: 1068093 - RNA, 26 nt, Human
cauagacauacaaugagaaagagcaa

SEQ ID NO: 1068094 - RNA, 25 nt, Human
ccacccuccaaaacggggcugauuu

SEQ ID NO: 1068095 - RNA, 20 nt, Human
ccaucuagaaaugacauugc

SEQ ID NO: 1068096 - RNA, 20 nt, Human
cccacccuccaaaacggggc

SEQ ID NO: 1068097 - RNA, 21 nt, Human
cccacccuccaaaacggggcu

SEQ ID NO: 1068098 - RNA, 18 nt, Human
ccccaguccccagcaggc

SEQ ID NO: 1068099 - RNA, 20 nt, Human
cccugagacagcguccgccu

SEQ ID NO: 1068100 - RNA, 22 nt, Human
ccugcaaacacgauuugccuau

SEQ ID NO: 1068101 - RNA, 19 nt, Human
cugcucccuggcccccagu

SEQ ID NO: 1068102 - RNA, 23 nt, Human
gacagacagaagcaaaaccccaa

SEQ ID NO: 1068103 - RNA, 22 nt, Human
gacugugcaaccacuacaaagc

SEQ ID NO: 1068104 - RNA, 22 nt, Human
gcaaagcagcaccuugaaccuc

SEQ ID NO: 1068105 - RNA, 21 nt, Human
gccccaucuucugucccccac

SEQ ID NO: 1068106 - RNA, 23 nt, Human
gccgcagcgcaggaugcacccag

SEQ ID NO: 1068107 - RNA, 21 nt, Human
gcuggcuugcugcucccuggc

SEQ ID NO: 1068108 - RNA, 22 nt, Human
ggauauucaggauggccaggga

SEQ ID NO: 1068109 - RNA, 19 nt, Human
gggaaauguagccccaucu

SEQ ID NO: 1068110 - RNA, 18 nt, Human
gugcaaccacuacaaagc

SEQ ID NO: 1068111 - RNA, 21 nt, Human
uaaaaacaaagucacucaagu

SEQ ID NO: 1068112 - RNA, 22 nt, Human
uaaaaacaaagucacucaagug

SEQ ID NO: 1068113 - RNA, 25 nt, Human
uaaaaacaaagucacucaagugucc

SEQ ID NO: 1068114 - RNA, 24 nt, Human
uaaacagacagacagaagcaaaac

SEQ ID NO: 1068115 - RNA, 19 nt, Human
uacauagaacaaaaacaac

SEQ ID NO: 1068116 - RNA, 23 nt, Human
uacuguuacauagaacaaaaaca

SEQ ID NO: 1068117 - RNA, 22 nt, Human
uccaaaacggggcugauuugau

SEQ ID NO: 1068118 - RNA, 19 nt, Human
ucccagcuggcuugcugcu

SEQ ID NO: 1068119 - RNA, 27 nt, Human
ucccugagacagcguccgccucagucc

SEQ ID NO: 1068120 - RNA, 21 nt, Human
ugacaaagcauagacauacaa

SEQ ID NO: 1068121 - RNA, 20 nt, Human
ugagaaagaauacauuggua

SEQ ID NO: 1068122 - RNA, 23 nt, Human
ugcagaauuagaaacccaucuag

SEQ ID NO: 1068123 - RNA, 20 nt, Human
ugcugcucccuggcccccag

SEQ ID NO: 1068124 - RNA, 20 nt, Human
uggagcccaggagugaaggc

SEQ ID NO: 1068125 - RNA, 23 nt, Human
uggagcccaggagugaaggcuag

SEQ ID NO: 1068126 - RNA, 19 nt, Human
uggcaggcaugcaaagcag

SEQ ID NO: 1068127 - RNA, 19 nt, Human
uggcccccaguccccagca

SEQ ID NO: 1068128 - RNA, 24 nt, Human
uuacauagaacaaaaacaacucuc

SEQ ID NO: 1068129 - RNA, 21 nt, Human
uucauacaaucuaccuauuuc

SEQ ID NO: 1068130 - RNA, 18 nt, Human
uuccacauaaucugcagg

SEQ ID NO: 1068131 - RNA, 20 nt, Human
uugcugcucccuggccccca

SEQ ID NO: 1068132 - RNA, 18 nt, Human
uuucucuuuugaaagaug

SEQ ID NO: 1068133 - RNA, 20 nt, Human
aaaacuuacuaaguugccag

SEQ ID NO: 1068134 - RNA, 21 nt, Human
aaaauguuccuguuaauccuc

SEQ ID NO: 1068135 - RNA, 20 nt, Human
aaagcaaaugacaaagaccc

SEQ ID NO: 1068136 - RNA, 23 nt, Human
aacucaaaagucuaugacaaaua

SEQ ID NO: 1068137 - RNA, 18 nt, Human
aaguugccagcauucaug

SEQ ID NO: 1068138 - RNA, 23 nt, Human
acaacuagaaaacauccuuaauu

SEQ ID NO: 1068139 - RNA, 21 nt, Human
acacuaaagagucaagacuca

SEQ ID NO: 1068140 - RNA, 21 nt, Human
acccaguuuaccagcuuuacu

SEQ ID NO: 1068141 - RNA, 20 nt, Human
agacaaaaaaaaaauggucc

SEQ ID NO: 1068142 - RNA, 22 nt, Human
agacaaaaaaaaaaugguccua

SEQ ID NO: 1068143 - RNA, 24 nt, Human
agcaaaugacaaagacccaguuua

SEQ ID NO: 1068144 - RNA, 25 nt, Human
caacaauuuuaaagacaaaaaaaaa

SEQ ID NO: 1068145 - RNA, 19 nt, Human
cagacacaaugaaaagcag

SEQ ID NO: 1068146 - RNA, 18 nt, Human
cagcuccaggacugcugc

SEQ ID NO: 1068147 - RNA, 23 nt, Human
caugcacaacuagaaaacauccu

SEQ ID NO: 1068148 - RNA, 22 nt, Human
caugcugguguuaguguacaau

SEQ ID NO: 1068149 - RNA, 19 nt, Human
cgaggacagaagcggccgg

SEQ ID NO: 1068150 - RNA, 20 nt, Human
cguuugaaaucuucaaaaaa

SEQ ID NO: 1068151 - RNA, 21 nt, Human
cuagaaaacauccuuaauuua

SEQ ID NO: 1068152 - RNA, 25 nt, Human
cuagaaaacauccuuaauuuauauu

SEQ ID NO: 1068153 - RNA, 24 nt, Human
cuccaggacugcugcgcugguggu

SEQ ID NO: 1068154 - RNA, 23 nt, Human
cuuaauuuauauuaaaccagaaa

SEQ ID NO: 1068155 - RNA, 18 nt, Human
cuuuccuuucucuccuuu

SEQ ID NO: 1068156 - RNA, 20 nt, Human
cuuuccuuucucuccuuucu

SEQ ID NO: 1068157 - RNA, 25 nt, Human
gcaggccgacacuacguggcucaca

SEQ ID NO: 1068158 - RNA, 29 nt, Human
gcuggugguggcggcggcuccucgcgcuu

SEQ ID NO: 1068159 - RNA, 21 nt, Human
ggccgguggcgggacgcagga

SEQ ID NO: 1068160 - RNA, 20 nt, Human
gugguggcggcggcuccucg

SEQ ID NO: 1068161 - RNA, 20 nt, Human
uaaaaaagcaaagugcauac

SEQ ID NO: 1068162 - RNA, 22 nt, Human
uaaagcaaaugacaaagaccca

SEQ ID NO: 1068163 - RNA, 23 nt, Human
uaacuucacagcaggccgacacu

SEQ ID NO: 1068164 - RNA, 21 nt, Human
ucagacacaaugaaaagcagg

SEQ ID NO: 1068165 - RNA, 20 nt, Human
uccuacacuaaagagucaag

SEQ ID NO: 1068166 - RNA, 22 nt, Human
ugcaccaacacauucgcauuua

SEQ ID NO: 1068167 - RNA, 20 nt, Human
uggcggcggcuccucgcgcu

SEQ ID NO: 1068168 - RNA, 23 nt, Human
uuaaagcaaaugacaaagacccu

SEQ ID NO: 1068169 - RNA, 24 nt, Human
uuacuaaguugccagcauucaugc

SEQ ID NO: 1068170 - RNA, 19 nt, Human
uucaugcacaacuagaaaa

SEQ ID NO: 1068171 - RNA, 20 nt, Human
uugaaauuauuucuguagaa

SEQ ID NO: 1068172 - RNA, 22 nt, Human
uuuaaagcaaaugacaaagacc

SEQ ID NO: 1068173 - RNA, 20 nt, Human
uuuccuuucucuccuuucuc

SEQ ID NO: 1068174 - RNA, 22 nt, Human
uuuucuuuuuuuuuuuuuaaag

SEQ ID NO: 1068175 - RNA, 20 nt, Human
uuuuuuuuuuuaaagcaaau

SEQ ID NO: 1068176 - RNA, 25 nt, Human
aaaauaagaaaccaaccaaaaaaga

SEQ ID NO: 1068177 - RNA, 24 nt, Human
aaacaaauaaaguuauauuaaaac

SEQ ID NO: 1068178 - RNA, 18 nt, Human
acacugaaaauaagagag

SEQ ID NO: 1068179 - RNA, 21 nt, Human
acacugaaaauaagagagaaa

SEQ ID NO: 1068180 - RNA, 22 nt, Human
accaaaaaagaauggccaacag

SEQ ID NO: 1068181 - RNA, 18 nt, Human
accuuuguguuuauuuuc

SEQ ID NO: 1068182 - RNA, 21 nt, Human
agaaaaaaaaaacaauaaaug

SEQ ID NO: 1068183 - RNA, 23 nt, Human
agaaaaaaaaaacaauaaaugaa

SEQ ID NO: 1068184 - RNA, 19 nt, Human
agaaaaaguuugcugaagg

SEQ ID NO: 1068185 - RNA, 24 nt, Human
agccaaauucaacccaccacaaaa

SEQ ID NO: 1068186 - RNA, 21 nt, Human
aggugucagcaaacuauaacc

SEQ ID NO: 1068187 - RNA, 23 nt, Human
aguuacauauuauccaaaaacac

SEQ ID NO: 1068188 - RNA, 26 nt, Human
aguuguaugccuugauacuguaguuu

SEQ ID NO: 1068189 - RNA, 18 nt, Human
augaagauacugccaucc

SEQ ID NO: 1068190 - RNA, 22 nt, Human
caaaacaaucauauauaaaagc

SEQ ID NO: 1068191 - RNA, 22 nt, Human
caaaagcccaaauuaaauuauc

SEQ ID NO: 1068192 - RNA, 21 nt, Human
caaauuucugggauacaguau

SEQ ID NO: 1068193 - RNA, 24 nt, Human
caaccaaaaaagaauggccaacaa

SEQ ID NO: 1068194 - RNA, 23 nt, Human
caccacaaaaauauuugcuauca

SEQ ID NO: 1068195 - RNA, 23 nt, Human
ccaaauucaacccaccacaaaaa

SEQ ID NO: 1068196 - RNA, 18 nt, Human
ccaaauuucugggauaca

SEQ ID NO: 1068197 - RNA, 32 nt, Human
ccaaauuucugggauacaguauuuaacacuac

SEQ ID NO: 1068198 - RNA, 18 nt, Human
ccaggcaguaaaggacag

SEQ ID NO: 1068199 - RNA, 20 nt, Human
ccucagagaaugccaggcag

SEQ ID NO: 1068200 - RNA, 21 nt, Human
ccucuuguuuccacagcuuga

SEQ ID NO: 1068201 - RNA, 20 nt, Human
cuaaaauggugauaccucuu

SEQ ID NO: 1068202 - RNA, 22 nt, Human
cuugaaauguuuaggaccagca

SEQ ID NO: 1068203 - RNA, 18 nt, Human
gaagauacugccauccac

SEQ ID NO: 1068204 - RNA, 19 nt, Human
gcaaacuauaacccauaag

SEQ ID NO: 1068205 - RNA, 21 nt, Human
guaccuuuguguuuauuuucu

SEQ ID NO: 1068206 - RNA, 24 nt, Human
uaaaauaagaaaccaaccaaaaaa

SEQ ID NO: 1068207 - RNA, 19 nt, Human
uaaaauacuuugacacuuu

SEQ ID NO: 1068208 - RNA, 23 nt, Human
uaaaauggugauaccucuuguuu

SEQ ID NO: 1068209 - RNA, 24 nt, Human
uaagaaaaaaaaaacaauaaauga

SEQ ID NO: 1068210 - RNA, 24 nt, Human
uaagaaaccaaccaaaaaagaaug

SEQ ID NO: 1068211 - RNA, 24 nt, Human
ucaaauacacugaaaauaagagag

SEQ ID NO: 1068212 - RNA, 20 nt, Human
uccaaaaacacauuuuucac

SEQ ID NO: 1068213 - RNA, 18 nt, Human
uccuaaaauggugauacc

SEQ ID NO: 1068214 - RNA, 22 nt, Human
uccucagagaaugccaggcagu

SEQ ID NO: 1068215 - RNA, 19 nt, Human
ucuaagaaaaaaaaaacaa

SEQ ID NO: 1068216 - RNA, 23 nt, Human
ucuaagaaaaaaaaaacaauaaa

SEQ ID NO: 1068217 - RNA, 25 nt, Human
ucuaagaaaaaaaaaacaauaaaug

SEQ ID NO: 1068218 - RNA, 19 nt, Human
ucugugguucaaaauaauu

SEQ ID NO: 1068219 - RNA, 25 nt, Human
ugaacccugcuucauucaaauacac

SEQ ID NO: 1068220 - RNA, 22 nt, Human
ugacacuuuacaaucuuccaag

SEQ ID NO: 1068221 - RNA, 20 nt, Human
ugcugaagaucacaaaacaa

SEQ ID NO: 1068222 - RNA, 23 nt, Human
uggaaaacaaauaaaguuauauu

SEQ ID NO: 1068223 - RNA, 18 nt, Human
uggaguucacuccuccua

SEQ ID NO: 1068224 - RNA, 23 nt, Human
ugguagaaaauaugugcauauaa

SEQ ID NO: 1068225 - RNA, 24 nt, Human
uuaaaauacuuugacacuuuacaa

SEQ ID NO: 1068226 - RNA, 24 nt, Human
uuacauccuugaaauguuuaggac

SEQ ID NO: 1068227 - RNA, 20 nt, Human
uugaaugcauuuucucacaa

SEQ ID NO: 1068228 - RNA, 21 nt, Human
aaaagccuccacugaauuuuc

SEQ ID NO: 1068229 - RNA, 24 nt, Human
aaaaugccuuuaucuuuuaaacug

SEQ ID NO: 1068230 - RNA, 20 nt, Human
aaacaaaagccuccacugaa

SEQ ID NO: 1068231 - RNA, 19 nt, Human
aacaaugacaacaguaccc

SEQ ID NO: 1068232 - RNA, 22 nt, Human
aaccuagcaaugauacauaaaa

SEQ ID NO: 1068233 - RNA, 23 nt, Human
aacuaaucagcaauuuuuaaagc

SEQ ID NO: 1068234 - RNA, 24 nt, Human
aagaauauuuucucuccguaacuc

SEQ ID NO: 1068235 - RNA, 18 nt, Human
aagcaggggucuuaaaac

SEQ ID NO: 1068236 - RNA, 22 nt, Human
aagccacacacacacaaacaaa

SEQ ID NO: 1068237 - RNA, 18 nt, Human
aaugagagggggggagga

SEQ ID NO: 1068238 - RNA, 21 nt, Human
acaaaucuuuuauggacagag

SEQ ID NO: 1068239 - RNA, 26 nt, Human
acacacaaacaaaagccuccacugaa

SEQ ID NO: 1068240 - RNA, 22 nt, Human
acacacacacaaacaaaagccu

SEQ ID NO: 1068241 - RNA, 25 nt, Human
acacuuuuaaagaaugugcacauuu

SEQ ID NO: 1068242 - RNA, 22 nt, Human
acauaaacucaggccaggugua

SEQ ID NO: 1068243 - RNA, 24 nt, Human
agaaacauauacucuuggaaggcc

SEQ ID NO: 1068244 - RNA, 23 nt, Human
agaaagauuaacauuuacaacug

SEQ ID NO: 1068245 - RNA, 21 nt, Human
agaguacuuuaaaaaucaaag

SEQ ID NO: 1068246 - RNA, 19 nt, Human
agccacacacacacaaaca

SEQ ID NO: 1068247 - RNA, 20 nt, Human
aggagagagagagagagagc

SEQ ID NO: 1068248 - RNA, 18 nt, Human
auacaucaucacagaaaa

SEQ ID NO: 1068249 - RNA, 20 nt, Human
augguacauuaugcuuuuaa

SEQ ID NO: 1068250 - RNA, 21 nt, Human
caaacaaaagccuccacugaa

SEQ ID NO: 1068251 - RNA, 24 nt, Human
caaauacacaaaguucagagccaa

SEQ ID NO: 1068252 - RNA, 20 nt, Human
caacaguacccuuacauugu

SEQ ID NO: 1068253 - RNA, 22 nt, Human
caacauuucccuuugcaaccac

SEQ ID NO: 1068254 - RNA, 20 nt, Human
caauaccaaaagccaaguca

SEQ ID NO: 1068255 - RNA, 20 nt, Human
cacaaacaaaagccuccacu

SEQ ID NO: 1068256 - RNA, 19 nt, Human
cacacacacacaaacaaaa

SEQ ID NO: 1068257 - RNA, 20 nt, Human
cacagaaaauugauauggua

SEQ ID NO: 1068258 - RNA, 20 nt, Human
cacuuuuaaagaaugugcac

SEQ ID NO: 1068259 - RNA, 19 nt, Human
cagaaucaccuaccugaga

SEQ ID NO: 1068260 - RNA, 20 nt, Human
cagaguacuuuaaaaaucaa

SEQ ID NO: 1068261 - RNA, 19 nt, Human
cagucgaaccguucgacaa

SEQ ID NO: 1068262 - RNA, 22 nt, Human
cauuuacaacugaguguagaaa

SEQ ID NO: 1068263 - RNA, 21 nt, Human
cauuuuuacucucucuagagg

SEQ ID NO: 1068264 - RNA, 18 nt, Human
ccacacacacacaaacaa

SEQ ID NO: 1068265 - RNA, 20 nt, Human
ccagaauccaaaaauuucca

SEQ ID NO: 1068266 - RNA, 20 nt, Human
cucuccguaacucgaaagac

SEQ ID NO: 1068267 - RNA, 19 nt, Human
cugaacuaaaaaaggguaa

SEQ ID NO: 1068268 - RNA, 19 nt, Human
cugaaguaguaaaccaaca

SEQ ID NO: 1068269 - RNA, 22 nt, Human
cuuuauaguugguauacaucau

SEQ ID NO: 1068270 - RNA, 18 nt, Human
gaaaugccauaauaauga

SEQ ID NO: 1068271 - RNA, 19 nt, Human
gaacuacuaauuaaaucca

SEQ ID NO: 1068272 - RNA, 18 nt, Human
gagcuagaaauugaaacc

SEQ ID NO: 1068273 - RNA, 21 nt, Human
gaggagagagagagagagagc

SEQ ID NO: 1068274 - RNA, 22 nt, Human
ggaggagagagagagagagagc

SEQ ID NO: 1068275 - RNA, 21 nt, Human
uaaaaaaggguaaaaagggua

SEQ ID NO: 1068276 - RNA, 20 nt, Human
uaaaacccaaaaugccuuua

SEQ ID NO: 1068277 - RNA, 19 nt, Human
uaaacugauuaaagaaaca

SEQ ID NO: 1068278 - RNA, 22 nt, Human
uaacaauauucucaccucugau

SEQ ID NO: 1068279 - RNA, 26 nt, Human
uaagaaaugccauaauaaugauccac

SEQ ID NO: 1068280 - RNA, 18 nt, Human
uaagaauaauuuacugaa

SEQ ID NO: 1068281 - RNA, 22 nt, Human
uaccaagaagaaaucauuuuuc

SEQ ID NO: 1068282 - RNA, 25 nt, Human
uacuaaguauucuggauuccccaag

SEQ ID NO: 1068283 - RNA, 22 nt, Human
uauuuuguauuuuaaguuuuug

SEQ ID NO: 1068284 - RNA, 23 nt, Human
ucaaagccacacacacacaaaca

SEQ ID NO: 1068285 - RNA, 23 nt, Human
ucaaauacacaaaguucagagcc

SEQ ID NO: 1068286 - RNA, 21 nt, Human
ucuccguaacucgaaagacua

SEQ ID NO: 1068287 - RNA, 24 nt, Human
ucugaacuaaaaaaggguaaaaag

SEQ ID NO: 1068288 - RNA, 24 nt, Human
ucuuaaaacccaaaaugccuuuau

SEQ ID NO: 1068289 - RNA, 24 nt, Human
ugaaaaaaugagucauuaaaaaaa

SEQ ID NO: 1068290 - RNA, 25 nt, Human
ugaaaacaauauuuauuuuaaacau

SEQ ID NO: 1068291 - RNA, 18 nt, Human
ugaaguaguaaaccaaca

SEQ ID NO: 1068292 - RNA, 18 nt, Human
ugagagggggggaggaga

SEQ ID NO: 1068293 - RNA, 19 nt, Human
ugagagggggggaggagag

SEQ ID NO: 1068294 - RNA, 19 nt, Human
ugccauaauaaugauccac

SEQ ID NO: 1068295 - RNA, 18 nt, Human
uggaaggcagaaucaccu

SEQ ID NO: 1068296 - RNA, 24 nt, Human
uggcaucaugauaugacucggcaa

SEQ ID NO: 1068297 - RNA, 20 nt, Human
uggcauuauaacaugguaca

SEQ ID NO: 1068298 - RNA, 19 nt, Human
ugguaaaauauauuuugua

SEQ ID NO: 1068299 - RNA, 23 nt, Human
uguagcugaaauuuggauaaagc

SEQ ID NO: 1068300 - RNA, 19 nt, Human
uuaacauuuacaacugagu

SEQ ID NO: 1068301 - RNA, 22 nt, Human
uuauaaagcugggagaauuauu

SEQ ID NO: 1068302 - RNA, 18 nt, Human
uucgacaacauuucccuu

SEQ ID NO: 1068303 - RNA, 21 nt, Human
uuuuauggacagaguacuuua

SEQ ID NO: 1068304 - RNA, 22 nt, Human
aaaaaugcaaaagaagccagac

SEQ ID NO: 1068305 - RNA, 18 nt, Human
aaaugcaaaagaagccag

SEQ ID NO: 1068306 - RNA, 23 nt, Human
aagaaaacaacacaaucuccuga

SEQ ID NO: 1068307 - RNA, 23 nt, Human
aaguagguagagagcaggaaugu

SEQ ID NO: 1068308 - RNA, 23 nt, Human
acaacacaaucuccugauguaca

SEQ ID NO: 1068309 - RNA, 20 nt, Human
accacugagcaaacugcagu

SEQ ID NO: 1068310 - RNA, 21 nt, Human
acccacuucccucugaaccaa

SEQ ID NO: 1068311 - RNA, 22 nt, Human
agauaggagcaggugaagaaga

SEQ ID NO: 1068312 - RNA, 19 nt, Human
aggccaaaauccacagaga

SEQ ID NO: 1068313 - RNA, 19 nt, Human
aguagacuuaacaaccaug

SEQ ID NO: 1068314 - RNA, 18 nt, Human
auauccagcaucccaccu

SEQ ID NO: 1068315 - RNA, 21 nt, Human
caaaagaagccagacaguaga

SEQ ID NO: 1068316 - RNA, 22 nt, Human
caaaguagcugcucuauggugc

SEQ ID NO: 1068317 - RNA, 23 nt, Human
caacacaaucuccugauguacag

SEQ ID NO: 1068318 - RNA, 24 nt, Human
caagaaguagguagagagcaggaa

SEQ ID NO: 1068319 - RNA, 24 nt, Human
cagaaaaggccuucucuaaauuaa

SEQ ID NO: 1068320 - RNA, 18 nt, Human
cagaugucuucauccaac

SEQ ID NO: 1068321 - RNA, 22 nt, Human
caguagacuuaacaaccaugaa

SEQ ID NO: 1068322 - RNA, 24 nt, Human
cagucuaauccuuuaucuucaaac

SEQ ID NO: 1068323 - RNA, 24 nt, Human
caucuuuaccaaugauuuucugaa

SEQ ID NO: 1068324 - RNA, 21 nt, Human
ccacugagcaaacugcagugc

SEQ ID NO: 1068325 - RNA, 24 nt, Human
cccuucagaaaaggccuucucuaa

SEQ ID NO: 1068326 - RNA, 24 nt, Human
cggaugccuuuccuccaaagucuu

SEQ ID NO: 1068327 - RNA, 22 nt, Human
cugcagugcuuuuuuccucuga

SEQ ID NO: 1068328 - RNA, 23 nt, Human
cuuucucggaugccuuuccucca

SEQ ID NO: 1068329 - RNA, 25 nt, Human
gaccacucuucaucagauuccauua

SEQ ID NO: 1068330 - RNA, 20 nt, Human
gcaauggaaauaaaacugaa

SEQ ID NO: 1068331 - RNA, 21 nt, Human
gcaauggaaauaaaacugaac

SEQ ID NO: 1068332 - RNA, 18 nt, Human
ggaugccuuuccuccaaa

SEQ ID NO: 1068333 - RNA, 22 nt, Human
gguagagagcaggaaugugagc

SEQ ID NO: 1068334 - RNA, 23 nt, Human
guagacuuaacaaccaugaagca

SEQ ID NO: 1068335 - RNA, 19 nt, Human
guagagagcaggaauguga

SEQ ID NO: 1068336 - RNA, 21 nt, Human
uaaaaaugcaaaagaagccag

SEQ ID NO: 1068337 - RNA, 20 nt, Human
uaaaaugaaguccauagauu

SEQ ID NO: 1068338 - RNA, 22 nt, Human
uaaaauggaagguacaccucaa

SEQ ID NO: 1068339 - RNA, 23 nt, Human
uacaguugucacugacccagagc

SEQ ID NO: 1068340 - RNA, 22 nt, Human
uacuccauggugacuaaaauga

SEQ ID NO: 1068341 - RNA, 20 nt, Human
uauauguuuuuacuccaugg

SEQ ID NO: 1068342 - RNA, 24 nt, Human
ucagauuccauuauggcuuucuua

SEQ ID NO: 1068343 - RNA, 21 nt, Human
ucaguugcuucauuagaugca

SEQ ID NO: 1068344 - RNA, 18 nt, Human
uccacagagaaguaaggu

SEQ ID NO: 1068345 - RNA, 24 nt, Human
uccauagauaggagcaggugaaga

SEQ ID NO: 1068346 - RNA, 24 nt, Human
ucggaugccuuuccuccaaagucu

SEQ ID NO: 1068347 - RNA, 22 nt, Human
ucuucauccaacaaaguagcug

SEQ ID NO: 1068348 - RNA, 21 nt, Human
ugaagaagaaaacaacacaau

SEQ ID NO: 1068349 - RNA, 21 nt, Human
ugaaggccaaaauccacagag

SEQ ID NO: 1068350 - RNA, 19 nt, Human
ugcaaaagaagccagacag

SEQ ID NO: 1068351 - RNA, 23 nt, Human
ugcaaaagaagccagacaguaga

SEQ ID NO: 1068352 - RNA, 24 nt, Human
ugcugugacucucucugccuguga

SEQ ID NO: 1068353 - RNA, 22 nt, Human
ugcuuuuuuccucugauccuca

SEQ ID NO: 1068354 - RNA, 18 nt, Human
uggugaagucauaugguu

SEQ ID NO: 1068355 - RNA, 18 nt, Human
ugucacccacuuccuugg

SEQ ID NO: 1068356 - RNA, 25 nt, Human
uuccuuuuccuuuaacaaaaagaau

SEQ ID NO: 1068357 - RNA, 26 nt, Human
uucucuaaauuaacugaacaauucgg

SEQ ID NO: 1068358 - RNA, 21 nt, Human
uuuucuauaaaauccuaugaa

SEQ ID NO: 1068359 - RNA, 21 nt, Human
aaagagaaaggaaauuuccaa

SEQ ID NO: 1068360 - RNA, 21 nt, Human
aaagagcaaaauggaaaaaau

SEQ ID NO: 1068361 - RNA, 20 nt, Human
aaagccaaaagcagcuugua

SEQ ID NO: 1068362 - RNA, 24 nt, Human
aaagugcugggauuacaggcguga

SEQ ID NO: 1068363 - RNA, 18 nt, Human
aagcagcuuguaagagga

SEQ ID NO: 1068364 - RNA, 19 nt, Human
aagugcugggauuacaggc

SEQ ID NO: 1068365 - RNA, 19 nt, Human
aagugcugggauuacaggc

SEQ ID NO: 1068366 - RNA, 26 nt, Human
aagugcugggauuacaggcgugagcc

SEQ ID NO: 1068367 - RNA, 20 nt, Human
acaguaaaaaaaaaucuaaa

SEQ ID NO: 1068368 - RNA, 18 nt, Human
accauguuggccaggcug

SEQ ID NO: 1068369 - RNA, 23 nt, Human
acccaggcuggagugcaguggug

SEQ ID NO: 1068370 - RNA, 24 nt, Human
acccaggcuggagugcaguggugu

SEQ ID NO: 1068371 - RNA, 18 nt, Human
acgggguuucaccauguu

SEQ ID NO: 1068372 - RNA, 23 nt, Human
acgggguuucaccauguuggcca

SEQ ID NO: 1068373 - RNA, 24 nt, Human
acgggguuucaccauguuggccag

SEQ ID NO: 1068374 - RNA, 25 nt, Human
acucugucacccaggcuggagugca

SEQ ID NO: 1068375 - RNA, 18 nt, Human
acuguucugaaauuuggu

SEQ ID NO: 1068376 - RNA, 21 nt, Human
agccaccgggagaacuagucc

SEQ ID NO: 1068377 - RNA, 20 nt, Human
aggcgugagccacugcaacc

SEQ ID NO: 1068378 - RNA, 22 nt, Human
aggcugcugucucccuauagaa

SEQ ID NO: 1068379 - RNA, 25 nt, Human
aggcuggagugcagugguguaaucu

SEQ ID NO: 1068380 - RNA, 21 nt, Human
agguucaagugauucuccugc

SEQ ID NO: 1068381 - RNA, 22 nt, Human
agguucaagugauucuccugcc

SEQ ID NO: 1068382 - RNA, 20 nt, Human
aguagcugggauuacaggca

SEQ ID NO: 1068383 - RNA, 24 nt, Human
agugauucuccugccucagccucc

SEQ ID NO: 1068384 - RNA, 19 nt, Human
agugcagugguguaaucuc

SEQ ID NO: 1068385 - RNA, 21 nt, Human
agugcagugguguaaucucag

SEQ ID NO: 1068386 - RNA, 23 nt, Human
agugcagugguguaaucucagcu

SEQ ID NO: 1068387 - RNA, 18 nt, Human
agugcugggauuacaggc

SEQ ID NO: 1068388 - RNA, 24 nt, Human
agugguguaaucucagcucacugc

SEQ ID NO: 1068389 - RNA, 24 nt, Human
aguuuuuacgcaaaagauauuaau

SEQ ID NO: 1068390 - RNA, 18 nt, Human
auaaaauuaccuucaggg

SEQ ID NO: 1068391 - RNA, 26 nt, Human
auaaagcaaaaaguaagaauucccuu

SEQ ID NO: 1068392 - RNA, 22 nt, Human
augccaccuuuaauaacagagu

SEQ ID NO: 1068393 - RNA, 21 nt, Human
augccuuucaccugacuacag

SEQ ID NO: 1068394 - RNA, 21 nt, Human
auuuugcaauuugauccauac

SEQ ID NO: 1068395 - RNA, 24 nt, Human
auuuuuguauuuuuaguagagacg

SEQ ID NO: 1068396 - RNA, 22 nt, Human
caaaaaguaagaauucccuuca

SEQ ID NO: 1068397 - RNA, 24 nt, Human
caaagugcugggauuacaggcgug

SEQ ID NO: 1068398 - RNA, 20 nt, Human
caagugauucuccugccuca

SEQ ID NO: 1068399 - RNA, 22 nt, Human
caagugauucuccugccucagc

SEQ ID NO: 1068400 - RNA, 24 nt, Human
caccaugccuggcuaauuuuugua

SEQ ID NO: 1068401 - RNA, 21 nt, Human
caccauguuggccaggcuggu

SEQ ID NO: 1068402 - RNA, 24 nt, Human
caccauguuggccaggcuggucuc

SEQ ID NO: 1068403 - RNA, 27 nt, Human
caccauguuggccaggcuggucucaaa

SEQ ID NO: 1068404 - RNA, 21 nt, Human
cacccaggcuggagugcagug

SEQ ID NO: 1068405 - RNA, 23 nt, Human
cacucugucacccaggcuggagu

SEQ ID NO: 1068406 - RNA, 24 nt, Human
cacucugucacccaggcuggagug

SEQ ID NO: 1068407 - RNA, 19 nt, Human
cacugcaaccggccagagu

SEQ ID NO: 1068408 - RNA, 18 nt, Human
cacugcaaccucugccuc

SEQ ID NO: 1068409 - RNA, 21 nt, Human
cacugcaaccucugccuccca

SEQ ID NO: 1068410 - RNA, 18 nt, Human
cagucuucuauacugucc

SEQ ID NO: 1068411 - RNA, 20 nt, Human
caguuaucuuucaccuauuc

SEQ ID NO: 1068412 - RNA, 24 nt, Human
cauguuggccaggcuggucucaaa

SEQ ID NO: 1068413 - RNA, 22 nt, Human
ccaaagugcugggauuacaggc

SEQ ID NO: 1068414 - RNA, 22 nt, Human
ccaaagugcugggauuacaggc

SEQ ID NO: 1068415 - RNA, 22 nt, Human
ccaaagugcugggauuacaggc

SEQ ID NO: 1068416 - RNA, 24 nt, Human
ccaaagugcugggauuacaggcgu

SEQ ID NO: 1068417 - RNA, 20 nt, Human
ccaucuacauauauaaagcc

SEQ ID NO: 1068418 - RNA, 23 nt, Human
cccagguucaagugauucuccuc

SEQ ID NO: 1068419 - RNA, 23 nt, Human
cccagguucaagugauucuccug

SEQ ID NO: 1068420 - RNA, 23 nt, Human
cccgaguagcugggauuacaggc

SEQ ID NO: 1068421 - RNA, 24 nt, Human
cccgaguagcugggauuacaggca

SEQ ID NO: 1068422 - RNA, 19 nt, Human
cccuauagaauuuuuugag

SEQ ID NO: 1068423 - RNA, 23 nt, Human
ccgaguagcugggauuacaggca

SEQ ID NO: 1068424 - RNA, 19 nt, Human
ccuauagcauaccuucauc

SEQ ID NO: 1068425 - RNA, 18 nt, Human
ccucaaaagauccgccca

SEQ ID NO: 1068426 - RNA, 23 nt, Human
ccuccacagucuccaugccaccu

SEQ ID NO: 1068427 - RNA, 24 nt, Human
ccucccagguucaagugauucucc

SEQ ID NO: 1068428 - RNA, 23 nt, Human
ccugccucagccucccgaguagc

SEQ ID NO: 1068429 - RNA, 23 nt, Human
ccugguccuaagcauuucagaug

SEQ ID NO: 1068430 - RNA, 22 nt, Human
cuaagauagugacaccuuugcu

SEQ ID NO: 1068431 - RNA, 23 nt, Human
cuaagguuggcauuuuucuuuau

SEQ ID NO: 1068432 - RNA, 19 nt, Human
cuaugauccccaaguuuuc

SEQ ID NO: 1068433 - RNA, 24 nt, Human
cucacucugucacccaggcuggag

SEQ ID NO: 1068434 - RNA, 24 nt, Human
cucacugcaaccucugccucccag

SEQ ID NO: 1068435 - RNA, 24 nt, Human
cucacugcaaccucugccucccag

SEQ ID NO: 1068436 - RNA, 24 nt, Human
cucagccucccgaguagcugggau

SEQ ID NO: 1068437 - RNA, 19 nt, Human
cucccagguucaagugauu

SEQ ID NO: 1068438 - RNA, 20 nt, Human
cuccugguccuaagcauuuu

SEQ ID NO: 1068439 - RNA, 23 nt, Human
cugcaaccucugccucccagguu

SEQ ID NO: 1068440 - RNA, 24 nt, Human
cugcaaccucugccucccagguuc

SEQ ID NO: 1068441 - RNA, 23 nt, Human
cugccucagccucccgaguagcu

SEQ ID NO: 1068442 - RNA, 18 nt, Human
cugguccuaagcauuuca

SEQ ID NO: 1068443 - RNA, 20 nt, Human
gaaguggaagagaaaaagug

SEQ ID NO: 1068444 - RNA, 24 nt, Human
gaccucaaaagauccgcccaucuc

SEQ ID NO: 1068445 - RNA, 21 nt, Human
gacggggggcggggggacaac

SEQ ID NO: 1068446 - RNA, 26 nt, Human
gagaaaggaaauuuccaaagucuuca

SEQ ID NO: 1068447 - RNA, 24 nt, Human
gagacgggguuucaccauguuggc

SEQ ID NO: 1068448 - RNA, 26 nt, Human
gaguagcugggauuacaggcaaaugc

SEQ ID NO: 1068449 - RNA, 24 nt, Human
gauuacaggcaaaugccaccaugc

SEQ ID NO: 1068450 - RNA, 18 nt, Human
gauuacaggcgugagcca

SEQ ID NO: 1068451 - RNA, 22 nt, Human
gauuacaggcgugagccacugc

SEQ ID NO: 1068452 - RNA, 23 nt, Human
gauuacaggcgugagccacugca

SEQ ID NO: 1068453 - RNA, 23 nt, Human
gcaaauauucccaaaucuuaaaa

SEQ ID NO: 1068454 - RNA, 22 nt, Human
gcaaccucugccucccagguuc

SEQ ID NO: 1068455 - RNA, 23 nt, Human
gcuggucucaaacuccugaccuc

SEQ ID NO: 1068456 - RNA, 18 nt, Human
ggauacucaaccaguacu

SEQ ID NO: 1068457 - RNA, 24 nt, Human
ggcuggucucaaacuccugaccuc

SEQ ID NO: 1068458 - RNA, 23 nt, Human
gggguuucaccauguuggccagg

SEQ ID NO: 1068459 - RNA, 22 nt, Human
ggguuucaccauguuggccagg

SEQ ID NO: 1068460 - RNA, 23 nt, Human
guagagacgggguuucaccaugu

SEQ ID NO: 1068461 - RNA, 18 nt, Human
guagcugggauuacaggc

SEQ ID NO: 1068462 - RNA, 24 nt, Human
guagugcuuuaaaaaauauucccu

SEQ ID NO: 1068463 - RNA, 18 nt, Human
guccuaaauccugacccu

SEQ ID NO: 1068464 - RNA, 24 nt, Human
gugauucuccugccucagccuccc

SEQ ID NO: 1068465 - RNA, 21 nt, Human
uaaaaaaucugaagccugaaa

SEQ ID NO: 1068466 - RNA, 24 nt, Human
uaaacauagauuuaaaaagagcaa

SEQ ID NO: 1068467 - RNA, 26 nt, Human
uaagucccaagauauaaaguucuaaa

SEQ ID NO: 1068468 - RNA, 26 nt, Human
uaauaacagagucauucucuucuucc

SEQ ID NO: 1068469 - RNA, 24 nt, Human
uaauuuuuguauuuuuaguagaga

SEQ ID NO: 1068470 - RNA, 20 nt, Human
uacacaggagugugauucug

SEQ ID NO: 1068471 - RNA, 22 nt, Human
uacaggcaaaugccaccaugcc

SEQ ID NO: 1068472 - RNA, 22 nt, Human
uacaggcaaaugccaccaugcc

SEQ ID NO: 1068473 - RNA, 19 nt, Human
uacaggcgugagccacugc

SEQ ID NO: 1068474 - RNA, 23 nt, Human
uacaggcgugagccacugcaacc

SEQ ID NO: 1068475 - RNA, 22 nt, Human
uagagacgggguuucaccaugu

SEQ ID NO: 1068476 - RNA, 22 nt, Human
uagcaggcuuccugaagauugu

SEQ ID NO: 1068477 - RNA, 24 nt, Human
uaguagagacgggguuucaccaug

SEQ ID NO: 1068478 - RNA, 26 nt, Human
uaguagagacgggguuucaccauguu

SEQ ID NO: 1068479 - RNA, 20 nt, Human
uaugaguccuaaauccugac

SEQ ID NO: 1068480 - RNA, 23 nt, Human
uauguaaaccaauaaauauguaa

SEQ ID NO: 1068481 - RNA, 21 nt, Human
uaugugaacaagguauauaua

SEQ ID NO: 1068482 - RNA, 25 nt, Human
uauuuaaaagguauauauauacaua

SEQ ID NO: 1068483 - RNA, 19 nt, Human
ucaagugauucuccugccu

SEQ ID NO: 1068484 - RNA, 22 nt, Human
ucacccaggcuggagugcagug

SEQ ID NO: 1068485 - RNA, 24 nt, Human
ucacucugucacccaggcuggagu

SEQ ID NO: 1068486 - RNA, 19 nt, Human
ucacugcaaccucugccuc

SEQ ID NO: 1068487 - RNA, 24 nt, Human
ucacugcaaccucugccucccagg

SEQ ID NO: 1068488 - RNA, 25 nt, Human
ucacugcaaccucugccucccaggu

SEQ ID NO: 1068489 - RNA, 22 nt, Human
ucagaccuucuaaaaggaagcu

SEQ ID NO: 1068490 - RNA, 20 nt, Human
ucagccucccgaguagcugg

SEQ ID NO: 1068491 - RNA, 27 nt, Human
ucagcucacugcaaccucugccuccca

SEQ ID NO: 1068492 - RNA, 25 nt, Human
uccaugccaccuuuaauaacagagu

SEQ ID NO: 1068493 - RNA, 18 nt, Human
ucccaagauagcaggcuu

SEQ ID NO: 1068494 - RNA, 21 nt, Human
ucccagguucaagugauucuc

SEQ ID NO: 1068495 - RNA, 24 nt, Human
ucccagguucaagugauucuccug

SEQ ID NO: 1068496 - RNA, 24 nt, Human
ucccgaguagcugggauuacaggc

SEQ ID NO: 1068497 - RNA, 19 nt, Human
ucccuucacuccaucuucu

SEQ ID NO: 1068498 - RNA, 24 nt, Human
uccuaaauccugacccuguccuaa

SEQ ID NO: 1068499 - RNA, 23 nt, Human
uccuaagcauuucagaugaggga

SEQ ID NO: 1068500 - RNA, 23 nt, Human
ucucacucugucacccaggcugg

SEQ ID NO: 1068501 - RNA, 24 nt, Human
ucucacucugucacccaggcugga

SEQ ID NO: 1068502 - RNA, 26 nt, Human
ucucacucugucacccaggcuggagu

SEQ ID NO: 1068503 - RNA, 27 nt, Human
ucucacucugucacccaggcuggagug

SEQ ID NO: 1068504 - RNA, 24 nt, Human
ucuccugccucagccucccgagua

SEQ ID NO: 1068505 - RNA, 24 nt, Human
ucugucacccaggcuggagugcag

SEQ ID NO: 1068506 - RNA, 23 nt, Human
ugaaauagaaaagugguggagug

SEQ ID NO: 1068507 - RNA, 27 nt, Human
ugaaucuccucccaaacuuucaaccac

SEQ ID NO: 1068508 - RNA, 22 nt, Human
ugagauggagucucacucuguc

SEQ ID NO: 1068509 - RNA, 22 nt, Human
ugagcuuucaggcuaugagucc

SEQ ID NO: 1068510 - RNA, 21 nt, Human
ugaguccuaaauccugacccu

SEQ ID NO: 1068511 - RNA, 19 nt, Human
ugauauuugguaaugcuug

SEQ ID NO: 1068512 - RNA, 18 nt, Human
ugauuagacuguucugaa

SEQ ID NO: 1068513 - RNA, 20 nt, Human
ugauucuccugccucagccu

SEQ ID NO: 1068514 - RNA, 22 nt, Human
ugcagugguguaaucucagcuc

SEQ ID NO: 1068515 - RNA, 24 nt, Human
ugccucagccucccgaguagcugg

SEQ ID NO: 1068516 - RNA, 24 nt, Human
ugcugggauuacaggcgugagcca

SEQ ID NO: 1068517 - RNA, 20 nt, Human
uggaaguggaagagaaaaag

SEQ ID NO: 1068518 - RNA, 19 nt, Human
uggaauuacuaacuuaagg

SEQ ID NO: 1068519 - RNA, 21 nt, Human
uggagugaggaauggaugcuu

SEQ ID NO: 1068520 - RNA, 22 nt, Human
uggagugaggaauggaugcuug

SEQ ID NO: 1068521 - RNA, 26 nt, Human
uggagugcagugguguaaggcucuag

SEQ ID NO: 1068522 - RNA, 23 nt, Human
uggagugcagugguguaaucuca

SEQ ID NO: 1068523 - RNA, 24 nt, Human
uggagugcagugguguaaucucag

SEQ ID NO: 1068524 - RNA, 26 nt, Human
uggcaaaauuuaguuuaaaggauaug

SEQ ID NO: 1068525 - RNA, 24 nt, Human
uggccaggcuggucucaaacuccu

SEQ ID NO: 1068526 - RNA, 21 nt, Human
ugggauuacaggcaaaugcca

SEQ ID NO: 1068527 - RNA, 22 nt, Human
ugggauuacaggcaaaugccac

SEQ ID NO: 1068528 - RNA, 24 nt, Human
ugggauuacaggcaaaugccacca

SEQ ID NO: 1068529 - RNA, 25 nt, Human
ugggauuacaggcaaaugccaccau

SEQ ID NO: 1068530 - RNA, 18 nt, Human
ugggauuacaggcgugag

SEQ ID NO: 1068531 - RNA, 19 nt, Human
ugggauuacaggcgugagc

SEQ ID NO: 1068532 - RNA, 21 nt, Human
ugggauuacaggcgugagcca

SEQ ID NO: 1068533 - RNA, 22 nt, Human
ugggauuacaggcgugagccac

SEQ ID NO: 1068534 - RNA, 22 nt, Human
ugggauuacaggcgugagccac

SEQ ID NO: 1068535 - RNA, 24 nt, Human
ugggauuacaggcgugagccacug

SEQ ID NO: 1068536 - RNA, 24 nt, Human
ugggauuacaggcgugagccacug

SEQ ID NO: 1068537 - RNA, 21 nt, Human
uggugaaucuccucccaaacu

SEQ ID NO: 1068538 - RNA, 24 nt, Human
ugguguaaucucagcucacugcaa

SEQ ID NO: 1068539 - RNA, 21 nt, Human
uguauuuuuaguagagacggg

SEQ ID NO: 1068540 - RNA, 25 nt, Human
uuaaagcacauccuuccuguuccac

SEQ ID NO: 1068541 - RNA, 18 nt, Human
uuaguagagacgggguuu

SEQ ID NO: 1068542 - RNA, 22 nt, Human
uuaguagagacgggguuucacc

SEQ ID NO: 1068543 - RNA, 24 nt, Human
uuaguagagacgggguuucaccau

SEQ ID NO: 1068544 - RNA, 18 nt, Human
uuauguagauuaaggcug

SEQ ID NO: 1068545 - RNA, 21 nt, Human
uucaagugauucuccugccuc

SEQ ID NO: 1068546 - RNA, 23 nt, Human
uucaagugauucuccugccucag

SEQ ID NO: 1068547 - RNA, 24 nt, Human
uucaagugauucuccugccucagc

SEQ ID NO: 1068548 - RNA, 24 nt, Human
uucacuccaucuucuccucagaua

SEQ ID NO: 1068549 - RNA, 20 nt, Human
uucagcaagaauagauguaa

SEQ ID NO: 1068550 - RNA, 22 nt, Human
uuccugaagauuguuguagagg

SEQ ID NO: 1068551 - RNA, 21 nt, Human
uuccuuaaaguguagccggga

SEQ ID NO: 1068552 - RNA, 23 nt, Human
uuguauuuuuaguagagacgggg

SEQ ID NO: 1068553 - RNA, 23 nt, Human
uuuauuuuuauuuucaguuuuug

SEQ ID NO: 1068554 - RNA, 20 nt, Human
uuucaaaccagaaagccauu

SEQ ID NO: 1068555 - RNA, 24 nt, Human
uuucaccauguuggccaggcuggu

SEQ ID NO: 1068556 - RNA, 25 nt, Human
uuugagugcugacaccaccacuugg

SEQ ID NO: 1068557 - RNA, 22 nt, Human
uuuuaaagcacauccuuccugu

SEQ ID NO: 1068558 - RNA, 24 nt, Human
uuuuuaguagagacgggguuucac

SEQ ID NO: 1068559 - RNA, 20 nt, Human
uuuuuguauuuuuaguagag

SEQ ID NO: 1068560 - RNA, 21 nt, Human
gaauggaccagagaccgagcc

SEQ ID NO: 1068561 - RNA, 21 nt, Human
gccgcgcugcugccgccgccg

SEQ ID NO: 1068562 - RNA, 20 nt, Human
gugaauggaccagagaccga

SEQ ID NO: 1068563 - RNA, 18 nt, Human
ugaauggaccagagaccg

SEQ ID NO: 1068564 - RNA, 22 nt, Human
ugaauggaccagagaccgagcc

SEQ ID NO: 1068565 - RNA, 25 nt, Human
aagagaagguuguuuccaaagugaa

SEQ ID NO: 1068566 - RNA, 22 nt, Human
auccugaucuaagagaagguug

SEQ ID NO: 1068567 - RNA, 23 nt, Human
cacaaguacucacuaacugguaa

SEQ ID NO: 1068568 - RNA, 20 nt, Human
ugaucucaaugauccugauc

SEQ ID NO: 1068569 - RNA, 20 nt, Human
uuccugggacucuuuucggc

SEQ ID NO: 1068570 - RNA, 27 nt, Human
uucuuuauuuuaacacaaguacucacu

SEQ ID NO: 1068571 - RNA, 23 nt, Human
aaaacagaggugguuuuccaagc

SEQ ID NO: 1068572 - RNA, 23 nt, Human
aaacagauaugagaauugccgau

SEQ ID NO: 1068573 - RNA, 20 nt, Human
aacacucuguuuccugcucu

SEQ ID NO: 1068574 - RNA, 21 nt, Human
aacacucuguuuccugcucuu

SEQ ID NO: 1068575 - RNA, 22 nt, Human
aaccaagugacauuuauugaga

SEQ ID NO: 1068576 - RNA, 23 nt, Human
aaccagcucccugucccccuccg

SEQ ID NO: 1068577 - RNA, 27 nt, Human
acaaaaaaagguccccuguggccacau

SEQ ID NO: 1068578 - RNA, 18 nt, Human
acaugcucauccacagga

SEQ ID NO: 1068579 - RNA, 19 nt, Human
accuucuguguauuuuccu

SEQ ID NO: 1068580 - RNA, 22 nt, Human
agaggggaaccagcucccuguc

SEQ ID NO: 1068581 - RNA, 18 nt, Human
agccagagaggggcgagu

SEQ ID NO: 1068582 - RNA, 18 nt, Human
agcuggaugacuggcugg

SEQ ID NO: 1068583 - RNA, 22 nt, Human
aggcgggggggagggcgcggag

SEQ ID NO: 1068584 - RNA, 20 nt, Human
auagagcaaggaaaacagag

SEQ ID NO: 1068585 - RNA, 21 nt, Human
caaaaaaagguccccuguggc

SEQ ID NO: 1068586 - RNA, 18 nt, Human
cacagacuaacacucugu

SEQ ID NO: 1068587 - RNA, 22 nt, Human
cacaggccagccugugcuacca

SEQ ID NO: 1068588 - RNA, 23 nt, Human
cacucggccagccagagaggggc

SEQ ID NO: 1068589 - RNA, 18 nt, Human
cacucuguuuccugcucu

SEQ ID NO: 1068590 - RNA, 23 nt, Human
cagauaugagaauugccgaugca

SEQ ID NO: 1068591 - RNA, 23 nt, Human
cagcagcaucucuaggccaccga

SEQ ID NO: 1068592 - RNA, 24 nt, Human
cagcagcaucucuaggccaccgac

SEQ ID NO: 1068593 - RNA, 20 nt, Human
ccagcucccugucccccucc

SEQ ID NO: 1068594 - RNA, 19 nt, Human
ccccgcuggcuggcccgcc

SEQ ID NO: 1068595 - RNA, 22 nt, Human
cccugucccccuccgagcuucc

SEQ ID NO: 1068596 - RNA, 19 nt, Human
ccgacagccuccuccagcg

SEQ ID NO: 1068597 - RNA, 26 nt, Human
ccuccagcgagguuggcgccagacac

SEQ ID NO: 1068598 - RNA, 18 nt, Human
ccuccgagcuucccuggg

SEQ ID NO: 1068599 - RNA, 26 nt, Human
ccugucccccuccgagcuucccuggg

SEQ ID NO: 1068600 - RNA, 23 nt, Human
cggccagccagagaggggcgagu

SEQ ID NO: 1068601 - RNA, 20 nt, Human
cggcgguggagcgggcuggc

SEQ ID NO: 1068602 - RNA, 25 nt, Human
cuaacacucuguuuccugcucuuua

SEQ ID NO: 1068603 - RNA, 22 nt, Human
cuaugugccagaccugggcaag

SEQ ID NO: 1068604 - RNA, 24 nt, Human
cuccuccagcgagguuggcgccag

SEQ ID NO: 1068605 - RNA, 23 nt, Human
cuggaugucaggagaaacaaaaa

SEQ ID NO: 1068606 - RNA, 23 nt, Human
cuuuuccauuguugucaguuuca

SEQ ID NO: 1068607 - RNA, 22 nt, Human
gaugucaggagaaacaaaaaaa

SEQ ID NO: 1068608 - RNA, 21 nt, Human
ggcgggggggagggcgcggag

SEQ ID NO: 1068609 - RNA, 21 nt, Human
ggcuggcgggcagaggcgugc

SEQ ID NO: 1068610 - RNA, 19 nt, Human
ggcuuugaaaagauucugg

SEQ ID NO: 1068611 - RNA, 25 nt, Human
gggauaaaggauacagccaaaacgu

SEQ ID NO: 1068612 - RNA, 21 nt, Human
gugcgccccccgacacucggg

SEQ ID NO: 1068613 - RNA, 18 nt, Human
uaccauaugugggcuuug

SEQ ID NO: 1068614 - RNA, 20 nt, Human
uauagagcaaggaaaacaga

SEQ ID NO: 1068615 - RNA, 22 nt, Human
uaucacugccagguaaagcucu

SEQ ID NO: 1068616 - RNA, 21 nt, Human
ucccugggagaucccgcguuu

SEQ ID NO: 1068617 - RNA, 23 nt, Human
ucccugucccccuccgagcuucc

SEQ ID NO: 1068618 - RNA, 22 nt, Human
ucuaagcuuguucauagaccuu

SEQ ID NO: 1068619 - RNA, 23 nt, Human
ucuguaugauaauaugugcugcu

SEQ ID NO: 1068620 - RNA, 24 nt, Human
ucuuuauuugauuuuauuauucuu

SEQ ID NO: 1068621 - RNA, 21 nt, Human
ugaaaaaaacagauaugagaa

SEQ ID NO: 1068622 - RNA, 21 nt, Human
ugccgaugcacaggccagccu

SEQ ID NO: 1068623 - RNA, 18 nt, Human
ugcgaggagggcagcccc

SEQ ID NO: 1068624 - RNA, 19 nt, Human
ugcgccccccgacacucgg

SEQ ID NO: 1068625 - RNA, 19 nt, Human
ugcgcgacaacugcaaccg

SEQ ID NO: 1068626 - RNA, 21 nt, Human
ugcgcgacaacugcaaccgcg

SEQ ID NO: 1068627 - RNA, 22 nt, Human
ugcuguauagagcaaggaaaac

SEQ ID NO: 1068628 - RNA, 21 nt, Human
ugucaggagaaacaaaaaaag

SEQ ID NO: 1068629 - RNA, 21 nt, Human
ugucaggagaaacaaaaaaag

SEQ ID NO: 1068630 - RNA, 18 nt, Human
ugucccuuaaaaguuaga

SEQ ID NO: 1068631 - RNA, 19 nt, Human
ugugggcuuugaaaagauu

SEQ ID NO: 1068632 - RNA, 24 nt, Human
uucauagaccuucuguguauuuuc

SEQ ID NO: 1068633 - RNA, 18 nt, Human
uuccaagucuggauguca

SEQ ID NO: 1068634 - RNA, 24 nt, Human
uuuuccauuguugucaguuucagu

SEQ ID NO: 1068635 - RNA, 19 nt, Human
uuuugcuuaucauuucuuu

SEQ ID NO: 1068636 - RNA, 19 nt, Human
aaaaaccucacuccugccu

SEQ ID NO: 1068637 - RNA, 22 nt, Human
accccggcgcccaggccugcaa

SEQ ID NO: 1068638 - RNA, 25 nt, Human
cacuccugccucaagguauuuacag

SEQ ID NO: 1068639 - RNA, 19 nt, Human
cccugggaggcgugggcug

SEQ ID NO: 1068640 - RNA, 20 nt, Human
ccugggaggcgugggcugcc

SEQ ID NO: 1068641 - RNA, 23 nt, Human
ccuguccuuuaaaagauaaaaac

SEQ ID NO: 1068642 - RNA, 22 nt, Human
cggcgcccaggccugcaauccc

SEQ ID NO: 1068643 - RNA, 23 nt, Human
gcuuaaaaauaccauuuuauucu

SEQ ID NO: 1068644 - RNA, 21 nt, Human
ucacauccauuuuuagaaacu

SEQ ID NO: 1068645 - RNA, 22 nt, Human
ucacggguacagaauaaccagg

SEQ ID NO: 1068646 - RNA, 27 nt, Human
uccaaccccggcgcccaggccugcaau

SEQ ID NO: 1068647 - RNA, 20 nt, Human
ucccugggaggcgugggcug

SEQ ID NO: 1068648 - RNA, 23 nt, Human
ucccugggaggcgugggcugccg

SEQ ID NO: 1068649 - RNA, 22 nt, Human
ugaagaucucuaaccaacacac

SEQ ID NO: 1068650 - RNA, 19 nt, Human
ugguuccucaucuggugcc

SEQ ID NO: 1068651 - RNA, 21 nt, Human
uuugaagaucucuaaccaaca

SEQ ID NO: 1068652 - RNA, 19 nt, Human
aaaaaagaaaauuauaagc

SEQ ID NO: 1068653 - RNA, 21 nt, Human
aaagcauugcuuuuuuuuuuu

SEQ ID NO: 1068654 - RNA, 19 nt, Human
aacagaccaaaaugugggc

SEQ ID NO: 1068655 - RNA, 23 nt, Human
aaccagagaucugugcaggcccu

SEQ ID NO: 1068656 - RNA, 26 nt, Human
aagauaaaacaucuuggaauaaaaug

SEQ ID NO: 1068657 - RNA, 21 nt, Human
aagcauugcuuuuuuuuuuuu

SEQ ID NO: 1068658 - RNA, 20 nt, Human
acugaguccacugaacagcc

SEQ ID NO: 1068659 - RNA, 24 nt, Human
acugaguccacugaacagccuggu

SEQ ID NO: 1068660 - RNA, 19 nt, Human
agaagagccugccccucac

SEQ ID NO: 1068661 - RNA, 19 nt, Human
agcauugcuuuuuuuuuuu

SEQ ID NO: 1068662 - RNA, 24 nt, Human
agcauugcuuuuuuuuuuuuuuuu

SEQ ID NO: 1068663 - RNA, 23 nt, Human
agccuggugaccagaagagccug

SEQ ID NO: 1068664 - RNA, 22 nt, Human
agggggucagcugucccgggcc

SEQ ID NO: 1068665 - RNA, 20 nt, Human
augcaacauaaccccacauu

SEQ ID NO: 1068666 - RNA, 23 nt, Human
caaaaccaguuugaccuaaccac

SEQ ID NO: 1068667 - RNA, 21 nt, Human
caacauaaccccacauugagc

SEQ ID NO: 1068668 - RNA, 24 nt, Human
caacauaaccccacauugagcaau

SEQ ID NO: 1068669 - RNA, 20 nt, Human
cacaaguauuccgacagaau

SEQ ID NO: 1068670 - RNA, 18 nt, Human
cacauucuacugugugcu

SEQ ID NO: 1068671 - RNA, 26 nt, Human
cagaaccaaaaccaguuugaccuaac

SEQ ID NO: 1068672 - RNA, 21 nt, Human
cagaagugucagaacguuggg

SEQ ID NO: 1068673 - RNA, 22 nt, Human
caggagcugagaaaaugcaaca

SEQ ID NO: 1068674 - RNA, 19 nt, Human
caggcccuagaaucaaagg

SEQ ID NO: 1068675 - RNA, 20 nt, Human
cauaaccccacauugagcaa

SEQ ID NO: 1068676 - RNA, 20 nt, Human
caucaucaucaucaucaucu

SEQ ID NO: 1068677 - RNA, 20 nt, Human
caucuuggaauaaaaugacu

SEQ ID NO: 1068678 - RNA, 25 nt, Human
cauuuccauccccaggagcugagaa

SEQ ID NO: 1068679 - RNA, 20 nt, Human
cccucccggucucagacacc

SEQ ID NO: 1068680 - RNA, 23 nt, Human
ccuagaaucaaaggggccagggc

SEQ ID NO: 1068681 - RNA, 24 nt, Human
ccucccggucucagacacccaggc

SEQ ID NO: 1068682 - RNA, 22 nt, Human
ccucuauucugagggccugugc

SEQ ID NO: 1068683 - RNA, 19 nt, Human
cgacauuacaagaugaaga

SEQ ID NO: 1068684 - RNA, 25 nt, Human
cuaagaucucucuucauguuccucu

SEQ ID NO: 1068685 - RNA, 21 nt, Human
cucacugcugggcccucccgg

SEQ ID NO: 1068686 - RNA, 23 nt, Human
cuccauuuccauccccaggagcu

SEQ ID NO: 1068687 - RNA, 24 nt, Human
cucccggucucagacacccaggcu

SEQ ID NO: 1068688 - RNA, 18 nt, Human
cugcugggcccucccggu

SEQ ID NO: 1068689 - RNA, 20 nt, Human
cuuggccugguguggcaaag

SEQ ID NO: 1068690 - RNA, 23 nt, Human
cuuugaucucuuaacauaaaaga

SEQ ID NO: 1068691 - RNA, 20 nt, Human
gaauggacccagaggcagcc

SEQ ID NO: 1068692 - RNA, 18 nt, Human
gagaaaaugcaacauaac

SEQ ID NO: 1068693 - RNA, 23 nt, Human
gagaaaaugcaacauaaccccac

SEQ ID NO: 1068694 - RNA, 23 nt, Human
gaucucucuucauguuccucuau

SEQ ID NO: 1068695 - RNA, 24 nt, Human
gcauugcuuuuuuuuuuuuuuuuu

SEQ ID NO: 1068696 - RNA, 23 nt, Human
gccacugaucagacugcagaagu

SEQ ID NO: 1068697 - RNA, 20 nt, Human
gcccacagaauggacccaga

SEQ ID NO: 1068698 - RNA, 22 nt, Human
gccuggugaccagaagagccug

SEQ ID NO: 1068699 - RNA, 26 nt, Human
gggccaggugaucugagggcugaccu

SEQ ID NO: 1068700 - RNA, 18 nt, Human
gggggucagcugucccgg

SEQ ID NO: 1068701 - RNA, 20 nt, Human
uaaaaaagaaaauuauaagc

SEQ ID NO: 1068702 - RNA, 22 nt, Human
uaaccaucagaaccaaaaccag

SEQ ID NO: 1068703 - RNA, 22 nt, Human
ucagacugcagaagugucagaa

SEQ ID NO: 1068704 - RNA, 21 nt, Human
uccucuauucugagggccugu

SEQ ID NO: 1068705 - RNA, 26 nt, Human
ucucuuaacauaaaagauaaaacauc

SEQ ID NO: 1068706 - RNA, 21 nt, Human
ugaacagccuggugaccagaa

SEQ ID NO: 1068707 - RNA, 25 nt, Human
ugaccuaaccacaaccacuuugaca

SEQ ID NO: 1068708 - RNA, 19 nt, Human
ugaucagacugcagaagug

SEQ ID NO: 1068709 - RNA, 19 nt, Human
ugcaacauaaccccacauu

SEQ ID NO: 1068710 - RNA, 20 nt, Human
uggaauaaaaugacucccuc

SEQ ID NO: 1068711 - RNA, 19 nt, Human
uggcaugggcuuggccugg

SEQ ID NO: 1068712 - RNA, 22 nt, Human
uggcaugggcuuggccuggugu

SEQ ID NO: 1068713 - RNA, 22 nt, Human
ugggauccuccauuuccauccc

SEQ ID NO: 1068714 - RNA, 23 nt, Human
ugugcaggcccuagaaucaaagg

SEQ ID NO: 1068715 - RNA, 23 nt, Human
ugugggcagagucuuagguccua

SEQ ID NO: 1068716 - RNA, 22 nt, Human
uucaucaucaucaucaucaucu

SEQ ID NO: 1068717 - RNA, 19 nt, Human
uuugacagucuugacaagg

SEQ ID NO: 1068718 - RNA, 23 nt, Human
uuuuuuuuuuaaaggaaaaacuc

SEQ ID NO: 1068719 - RNA, 20 nt, Human
uuuuuuuuuuuuuaaaggaa

SEQ ID NO: 1068720 - RNA, 20 nt, Human
uuuuuuuuuuuuuuaaagga

SEQ ID NO: 1068721 - RNA, 22 nt, Human
uuuuuuuuuuuuuuuuuaaagg

SEQ ID NO: 1068722 - RNA, 22 nt, Human
aaagccugauccagccccaggg

SEQ ID NO: 1068723 - RNA, 26 nt, Human
aacaauaaaaauaacacuccaacaau

SEQ ID NO: 1068724 - RNA, 19 nt, Human
aagaacuaaugacauccug

SEQ ID NO: 1068725 - RNA, 22 nt, Human
aagaagcccaaacauaaaguug

SEQ ID NO: 1068726 - RNA, 21 nt, Human
aagccagggcugagccucaga

SEQ ID NO: 1068727 - RNA, 23 nt, Human
acaaagcagauacagucagcccu

SEQ ID NO: 1068728 - RNA, 20 nt, Human
acccuaaggcucccuccuac

SEQ ID NO: 1068729 - RNA, 18 nt, Human
acuggggagaucugaggc

SEQ ID NO: 1068730 - RNA, 22 nt, Human
acuggggagaucugaggcuggg

SEQ ID NO: 1068731 - RNA, 23 nt, Human
agaaaagaacuaaugacauccug

SEQ ID NO: 1068732 - RNA, 23 nt, Human
agaacuccuucaucauuuugccu

SEQ ID NO: 1068733 - RNA, 21 nt, Human
agccaagaaagccugauccag

SEQ ID NO: 1068734 - RNA, 21 nt, Human
agcugcugaagauaagaagcc

SEQ ID NO: 1068735 - RNA, 22 nt, Human
aggcagccacccucauuuaaag

SEQ ID NO: 1068736 - RNA, 24 nt, Human
agggaaagguaaacagagccaaau

SEQ ID NO: 1068737 - RNA, 18 nt, Human
agggccgggagcugcugg

SEQ ID NO: 1068738 - RNA, 23 nt, Human
aucagcacaucuggcaggcagcc

SEQ ID NO: 1068739 - RNA, 21 nt, Human
aucuaguguaaaucaccuugc

SEQ ID NO: 1068740 - RNA, 23 nt, Human
auuuacauagaauuuacauugug

SEQ ID NO: 1068741 - RNA, 19 nt, Human
caaacauaaaguuggggac

SEQ ID NO: 1068742 - RNA, 21 nt, Human
caacuggaugucccgcugggc

SEQ ID NO: 1068743 - RNA, 25 nt, Human
caauaaaaauaacacuccaacaaua

SEQ ID NO: 1068744 - RNA, 24 nt, Human
cacagggcagaaugucuccaggga

SEQ ID NO: 1068745 - RNA, 22 nt, Human
cagagcagccaagaaagccuga

SEQ ID NO: 1068746 - RNA, 21 nt, Human
cagggccgggagcugcuggag

SEQ ID NO: 1068747 - RNA, 19 nt, Human
caggucacagaagcccagu

SEQ ID NO: 1068748 - RNA, 21 nt, Human
cauuucuguucucaaaaagag

SEQ ID NO: 1068749 - RNA, 19 nt, Human
ccagugcuuggcuggcaug

SEQ ID NO: 1068750 - RNA, 20 nt, Human
ccccagggcaaaaucagacc

SEQ ID NO: 1068751 - RNA, 19 nt, Human
ccgggagcugcuggaggag

SEQ ID NO: 1068752 - RNA, 21 nt, Human
ccuaagccagggcugagccuc

SEQ ID NO: 1068753 - RNA, 28 nt, Human
ccucagagcagccaagaaagccugaucc

SEQ ID NO: 1068754 - RNA, 25 nt, Human
ccuccuaccuaagccagggcugagc

SEQ ID NO: 1068755 - RNA, 23 nt, Human
ccugagcaucccagggcuuuggu

SEQ ID NO: 1068756 - RNA, 18 nt, Human
cgggagcugcuggaggag

SEQ ID NO: 1068757 - RNA, 24 nt, Human
cuaggagccuuuucuucagccucu

SEQ ID NO: 1068758 - RNA, 21 nt, Human
cuaucuugcugugccuuugau

SEQ ID NO: 1068759 - RNA, 22 nt, Human
cuccaacaaagcagauacaguc

SEQ ID NO: 1068760 - RNA, 23 nt, Human
cuccuaccuaagccagggcugag

SEQ ID NO: 1068761 - RNA, 22 nt, Human
cugauccagccccagggcaaaa

SEQ ID NO: 1068762 - RNA, 20 nt, Human
gacuccaacaaagcagauac

SEQ ID NO: 1068763 - RNA, 23 nt, Human
gagaacuccuucaucauuuugcc

SEQ ID NO: 1068764 - RNA, 22 nt, Human
gagcauccagagcugcugaaga

SEQ ID NO: 1068765 - RNA, 20 nt, Human
gagguggugggcaacuggau

SEQ ID NO: 1068766 - RNA, 23 nt, Human
gcagcagcgagaugaauuccgug

SEQ ID NO: 1068767 - RNA, 21 nt, Human
gccccagggcaaaaucagacc

SEQ ID NO: 1068768 - RNA, 20 nt, Human
gcucauggucauuucuguca

SEQ ID NO: 1068769 - RNA, 18 nt, Human
gcuccagaacuggggaga

SEQ ID NO: 1068770 - RNA, 24 nt, Human
gcuuguugcccgaggggaguugag

SEQ ID NO: 1068771 - RNA, 24 nt, Human
ggaagauaagcagauccgugaggg

SEQ ID NO: 1068772 - RNA, 20 nt, Human
gggacagaugugacaaugga

SEQ ID NO: 1068773 - RNA, 18 nt, Human
gggcagauaaugggcuca

SEQ ID NO: 1068774 - RNA, 19 nt, Human
ggggaaaaaacaauaaaaa

SEQ ID NO: 1068775 - RNA, 25 nt, Human
gguggcuggcagagguaaucggcag

SEQ ID NO: 1068776 - RNA, 21 nt, Human
gugugugugggggugugugua

SEQ ID NO: 1068777 - RNA, 21 nt, Human
uaagaaauacaguauauccac

SEQ ID NO: 1068778 - RNA, 24 nt, Human
uauuauaagcaaucuagagaugau

SEQ ID NO: 1068779 - RNA, 19 nt, Human
uauuuggggaaaaaacaau

SEQ ID NO: 1068780 - RNA, 18 nt, Human
ucacaggagagagggaaa

SEQ ID NO: 1068781 - RNA, 18 nt, Human
ucacuaucuugcugugcc

SEQ ID NO: 1068782 - RNA, 23 nt, Human
ucagggaggguagggggaugcag

SEQ ID NO: 1068783 - RNA, 18 nt, Human
ucauggucauuucuguuc

SEQ ID NO: 1068784 - RNA, 24 nt, Human
uccagaacuggggagaucugaggc

SEQ ID NO: 1068785 - RNA, 21 nt, Human
ucccagggcuuugguaucugu

SEQ ID NO: 1068786 - RNA, 19 nt, Human
ucccugaauacuuuucagc

SEQ ID NO: 1068787 - RNA, 21 nt, Human
uccgugugugugggggugugu

SEQ ID NO: 1068788 - RNA, 19 nt, Human
uccuucaucauuuugccuu

SEQ ID NO: 1068789 - RNA, 18 nt, Human
ucuccagggagaacuccu

SEQ ID NO: 1068790 - RNA, 19 nt, Human
ugagcauccagagcugcug

SEQ ID NO: 1068791 - RNA, 19 nt, Human
ugaggcugggguggcuggc

SEQ ID NO: 1068792 - RNA, 25 nt, Human
ugaggcugggguggcuggcagaggu

SEQ ID NO: 1068793 - RNA, 25 nt, Human
ugaggcugggguggcuggcagaggu

SEQ ID NO: 1068794 - RNA, 19 nt, Human
ugccagcacccuaaggcuc

SEQ ID NO: 1068795 - RNA, 18 nt, Human
ugcccgaggggaguugag

SEQ ID NO: 1068796 - RNA, 27 nt, Human
uggccacccacagggccgggagcugcu

SEQ ID NO: 1068797 - RNA, 19 nt, Human
ugggagggggcagauaaug

SEQ ID NO: 1068798 - RNA, 20 nt, Human
ugggagggggcagauaaugg

SEQ ID NO: 1068799 - RNA, 21 nt, Human
ugggagggggcagauaaugga

SEQ ID NO: 1068800 - RNA, 22 nt, Human
ugggagggggcagauaaugggc

SEQ ID NO: 1068801 - RNA, 20 nt, Human
uggggagaucugaggcuggg

SEQ ID NO: 1068802 - RNA, 22 nt, Human
uggggguguguguaugugugug

SEQ ID NO: 1068803 - RNA, 22 nt, Human
uggugacaggagcccugcucca

SEQ ID NO: 1068804 - RNA, 21 nt, Human
ugguggauacaaagggaugac

SEQ ID NO: 1068805 - RNA, 23 nt, Human
ugugacaauggagugaugcucag

SEQ ID NO: 1068806 - RNA, 20 nt, Human
uguguguaugugugugcuug

SEQ ID NO: 1068807 - RNA, 23 nt, Human
ugugugugcuuguugcccgaggg

SEQ ID NO: 1068808 - RNA, 21 nt, Human
uguguguggggguguguguau

SEQ ID NO: 1068809 - RNA, 23 nt, Human
uguguguggggguguguguaugu

SEQ ID NO: 1068810 - RNA, 18 nt, Human
aaaaaaaaacaccccaga

SEQ ID NO: 1068811 - RNA, 21 nt, Human
aaaaaaaaacaccccagaaag

SEQ ID NO: 1068812 - RNA, 23 nt, Human
aaaaaaaaacaccccagaaagga

SEQ ID NO: 1068813 - RNA, 18 nt, Human
aaaaaaccaaacacugca

SEQ ID NO: 1068814 - RNA, 20 nt, Human
aaaaaaccaaacacugcaug

SEQ ID NO: 1068815 - RNA, 22 nt, Human
aaaccaucauucucagcaaacu

SEQ ID NO: 1068816 - RNA, 19 nt, Human
aaagccuggcucccaugcc

SEQ ID NO: 1068817 - RNA, 19 nt, Human
aacaaggugaaaccccauc

SEQ ID NO: 1068818 - RNA, 20 nt, Human
aacaaggugaaaccccaucu

SEQ ID NO: 1068819 - RNA, 21 nt, Human
aacaaggugaaaccccaucuc

SEQ ID NO: 1068820 - RNA, 21 nt, Human
aacaaguuuauuggaggucug

SEQ ID NO: 1068821 - RNA, 27 nt, Human
aacaauccaggcgguggaggauuaccc

SEQ ID NO: 1068822 - RNA, 21 nt, Human
aacacaacuugccuccccacu

SEQ ID NO: 1068823 - RNA, 19 nt, Human
aaccaaacacugcauguuc

SEQ ID NO: 1068824 - RNA, 21 nt, Human
aacccaaauguccaucaauga

SEQ ID NO: 1068825 - RNA, 21 nt, Human
aacuugccuccccacuaccac

SEQ ID NO: 1068826 - RNA, 23 nt, Human
aagacccucauucucuagccuuc

SEQ ID NO: 1068827 - RNA, 20 nt, Human
aagagacucuccagaccucc

SEQ ID NO: 1068828 - RNA, 21 nt, Human
aagcagagaauaggaccagga

SEQ ID NO: 1068829 - RNA, 26 nt, Human
aaggacaaaaaaccaaacacugcaug

SEQ ID NO: 1068830 - RNA, 27 nt, Human
aauaaaaaaaaacaccccagaaaggaa

SEQ ID NO: 1068831 - RNA, 25 nt, Human
aaucaacagggcagcuuaaaaggaa

SEQ ID NO: 1068832 - RNA, 18 nt, Human
acaaggacaaaaaaccaa

SEQ ID NO: 1068833 - RNA, 20 nt, Human
acaauagcaaagaccuggaa

SEQ ID NO: 1068834 - RNA, 21 nt, Human
acaauagcaaagaccuggaac

SEQ ID NO: 1068835 - RNA, 23 nt, Human
acacacacacacacgcacaugca

SEQ ID NO: 1068836 - RNA, 26 nt, Human
acacacacacacgcacaugcacacac

SEQ ID NO: 1068837 - RNA, 23 nt, Human
acacacacacauacacacacaca

SEQ ID NO: 1068838 - RNA, 23 nt, Human
acacacacauacacacacacaca

SEQ ID NO: 1068839 - RNA, 23 nt, Human
acacacacgcacaugcacacaca

SEQ ID NO: 1068840 - RNA, 25 nt, Human
acacacacgcacaugcacacacaca

SEQ ID NO: 1068841 - RNA, 23 nt, Human
acacacauacacacacacacaca

SEQ ID NO: 1068842 - RNA, 27 nt, Human
acacgcacaugcacacacacaagcaca

SEQ ID NO: 1068843 - RNA, 23 nt, Human
acacuuacacauagacauauagc

SEQ ID NO: 1068844 - RNA, 20 nt, Human
accagccuggccaacaaggu

SEQ ID NO: 1068845 - RNA, 24 nt, Human
accccaucucuacuaaaacuacaa

SEQ ID NO: 1068846 - RNA, 18 nt, Human
acccucauucucuagccu

SEQ ID NO: 1068847 - RNA, 24 nt, Human
accucaaacguccugcucuuaacc

SEQ ID NO: 1068848 - RNA, 21 nt, Human
acuugccuccccacuaccacc

SEQ ID NO: 1068849 - RNA, 26 nt, Human
agacaagauaaggguaaucaccccag

SEQ ID NO: 1068850 - RNA, 18 nt, Human
agaccuggaaccaaccca

SEQ ID NO: 1068851 - RNA, 19 nt, Human
agcaggcugggugcagugg

SEQ ID NO: 1068852 - RNA, 23 nt, Human
agcaggcugggugcagugguuca

SEQ ID NO: 1068853 - RNA, 24 nt, Human
agccuggccaacaaggugaaaccc

SEQ ID NO: 1068854 - RNA, 20 nt, Human
aggaaguagcccugcagaca

SEQ ID NO: 1068855 - RNA, 19 nt, Human
aggccgaggugguggauca

SEQ ID NO: 1068856 - RNA, 18 nt, Human
agggacauggaugaagcc

SEQ ID NO: 1068857 - RNA, 21 nt, Human
aggugguggaucaccugaggu

SEQ ID NO: 1068858 - RNA, 24 nt, Human
agugguucacgccuguaaucccag

SEQ ID NO: 1068859 - RNA, 24 nt, Human
aguuaaucacuuauaucuuuagau

SEQ ID NO: 1068860 - RNA, 25 nt, Human
auaaaaaaaaacaccccagaaagga

SEQ ID NO: 1068861 - RNA, 18 nt, Human
auaacacaacuugccucc

SEQ ID NO: 1068862 - RNA, 23 nt, Human
aucacgucucaccccugccacag

SEQ ID NO: 1068863 - RNA, 24 nt, Human
augaagccggaaaccaucauucuc

SEQ ID NO: 1068864 - RNA, 20 nt, Human
augcagccaggguugagaac

SEQ ID NO: 1068865 - RNA, 18 nt, Human
caaaaaaccaaacacugc

SEQ ID NO: 1068866 - RNA, 18 nt, Human
caaacaggcccaauccug

SEQ ID NO: 1068867 - RNA, 23 nt, Human
caaagaccuggaaccaacccaaa

SEQ ID NO: 1068868 - RNA, 22 nt, Human
caaauguccaucaaugauagac

SEQ ID NO: 1068869 - RNA, 20 nt, Human
caacuugccuccccacuacc

SEQ ID NO: 1068870 - RNA, 21 nt, Human
caaggacaaaaaaccaaacac

SEQ ID NO: 1068871 - RNA, 22 nt, Human
caauagcaaagaccuggaacca

SEQ ID NO: 1068872 - RNA, 19 nt, Human
cacaaggacaaaaaaccaa

SEQ ID NO: 1068873 - RNA, 24 nt, Human
cacacaaacauggcacauguauac

SEQ ID NO: 1068874 - RNA, 26 nt, Human
cacacacacacacacgcacaugcaca

SEQ ID NO: 1068875 - RNA, 25 nt, Human
cacacacacacacgcacaugcacac

SEQ ID NO: 1068876 - RNA, 22 nt, Human
cacacacacauacacacacaca

SEQ ID NO: 1068877 - RNA, 28 nt, Human
cacacacauacacacacacacacacacg

SEQ ID NO: 1068878 - RNA, 25 nt, Human
cacauacacacacacacacacacgc

SEQ ID NO: 1068879 - RNA, 27 nt, Human
cacaugcacacacacaagcacauccuu

SEQ ID NO: 1068880 - RNA, 18 nt, Human
cacauguauacauaugua

SEQ ID NO: 1068881 - RNA, 25 nt, Human
caccccagaaaggaucaguagcuca

SEQ ID NO: 1068882 - RNA, 24 nt, Human
cacgccuguaaucccagcaguuug

SEQ ID NO: 1068883 - RNA, 20 nt, Human
cagaaaggaucagcaggcug

SEQ ID NO: 1068884 - RNA, 21 nt, Human
cagcaaacuaucacaaggaca

SEQ ID NO: 1068885 - RNA, 26 nt, Human
cagcacacaaacauggcacauguaua

SEQ ID NO: 1068886 - RNA, 24 nt, Human
cagcaguuugggaggccgaggugg

SEQ ID NO: 1068887 - RNA, 20 nt, Human
caggauauaauaaauagaca

SEQ ID NO: 1068888 - RNA, 23 nt, Human
cauccuuuaucaaacaggcccaa

SEQ ID NO: 1068889 - RNA, 25 nt, Human
cauguacaccauagaauacuaugca

SEQ ID NO: 1068890 - RNA, 22 nt, Human
ccaauacacacacacauacaca

SEQ ID NO: 1068891 - RNA, 23 nt, Human
ccaccaaggugauucuaacaugc

SEQ ID NO: 1068892 - RNA, 22 nt, Human
ccccacuaccaccagugccaaa

SEQ ID NO: 1068893 - RNA, 18 nt, Human
ccccuaugauaaugagac

SEQ ID NO: 1068894 - RNA, 18 nt, Human
ccggggccuguugugggg

SEQ ID NO: 1068895 - RNA, 23 nt, Human
ccuccaaccucaauggcaggcug

SEQ ID NO: 1068896 - RNA, 26 nt, Human
ccuccacaaacaaguuuauuggaggu

SEQ ID NO: 1068897 - RNA, 28 nt, Human
ccuccccacuaccaccagugccaaagcc

SEQ ID NO: 1068898 - RNA, 24 nt, Human
ccugacccucaguuuggucuggga

SEQ ID NO: 1068899 - RNA, 22 nt, Human
ccugaggucagaaguuugagac

SEQ ID NO: 1068900 - RNA, 24 nt, Human
ccuggccaacaaggugaaacccca

SEQ ID NO: 1068901 - RNA, 18 nt, Human
ccuguugugggguggggg

SEQ ID NO: 1068902 - RNA, 22 nt, Human
ccuucaguagcuucgaguucac

SEQ ID NO: 1068903 - RNA, 23 nt, Human
cgaggugguggaucaccugaggu

SEQ ID NO: 1068904 - RNA, 25 nt, Human
cgaggugguggaucaccugagguca

SEQ ID NO: 1068905 - RNA, 24 nt, Human
cgccuguaaucccagcaguuuggg

SEQ ID NO: 1068906 - RNA, 24 nt, Human
cuaccaccagugccaaagccuggc

SEQ ID NO: 1068907 - RNA, 24 nt, Human
cucaccccugccacagagauguca

SEQ ID NO: 1068908 - RNA, 21 nt, Human
cuccaaccucaauggcaggcu

SEQ ID NO: 1068909 - RNA, 20 nt, Human
cuccuaaagaccuccaauac

SEQ ID NO: 1068910 - RNA, 25 nt, Human
cucuacugccccugucagcaucacg

SEQ ID NO: 1068911 - RNA, 26 nt, Human
cugcagacauuuggagaaagaacaau

SEQ ID NO: 1068912 - RNA, 23 nt, Human
cuggccaacaaggugaaacccca

SEQ ID NO: 1068913 - RNA, 19 nt, Human
cuguuguggggugggggca

SEQ ID NO: 1068914 - RNA, 23 nt, Human
cuguuguggggugggggcagugg

SEQ ID NO: 1068915 - RNA, 23 nt, Human
gaauaagcagccugacccucagu

SEQ ID NO: 1068916 - RNA, 30 nt, Human
gaccuccaauacacacacacauacacacag

SEQ ID NO: 1068917 - RNA, 23 nt, Human
gagaccagccuggccaacaaggu

SEQ ID NO: 1068918 - RNA, 24 nt, Human
gaucaccugaggucagaaguuuga

SEQ ID NO: 1068919 - RNA, 18 nt, Human
gcagugguucacgccugu

SEQ ID NO: 1068920 - RNA, 24 nt, Human
gccaacaaggugaaaccccaucuc

SEQ ID NO: 1068921 - RNA, 19 nt, Human
gccgggcaugguggugcau

SEQ ID NO: 1068922 - RNA, 22 nt, Human
gccuguuguggggugggggcag

SEQ ID NO: 1068923 - RNA, 20 nt, Human
gcuaugacauggcaaaagug

SEQ ID NO: 1068924 - RNA, 21 nt, Human
gcuuaagaaaggagggucccc

SEQ ID NO: 1068925 - RNA, 22 nt, Human
gcuuaagaaaggaggguccccu

SEQ ID NO: 1068926 - RNA, 27 nt, Human
gggcacaguaaaaguugaccgguaccc

SEQ ID NO: 1068927 - RNA, 24 nt, Human
ggggaacaucacacaccggggccu

SEQ ID NO: 1068928 - RNA, 23 nt, Human
ggggugggggcaguggggaggga

SEQ ID NO: 1068929 - RNA, 22 nt, Human
gggugggggcaguggggaggga

SEQ ID NO: 1068930 - RNA, 23 nt, Human
ggugacaaguacuaugggaaaaa

SEQ ID NO: 1068931 - RNA, 23 nt, Human
ggugcagugguucacgccuguaa

SEQ ID NO: 1068932 - RNA, 20 nt, Human
gugagucaaucauucaacaa

SEQ ID NO: 1068933 - RNA, 22 nt, Human
gugcaaccucaaacguccugcu

SEQ ID NO: 1068934 - RNA, 24 nt, Human
gugcuugcaugccccauaacacaa

SEQ ID NO: 1068935 - RNA, 24 nt, Human
gugguggaucaccugaggucagaa

SEQ ID NO: 1068936 - RNA, 22 nt, Human
uaaaaaaaaacaccccagaaag

SEQ ID NO: 1068937 - RNA, 20 nt, Human
uaaaacuacaaaaauuugcc

SEQ ID NO: 1068938 - RNA, 21 nt, Human
uaaauagacaaaaauuccugc

SEQ ID NO: 1068939 - RNA, 24 nt, Human
uaagagauauaccuaauguuaaac

SEQ ID NO: 1068940 - RNA, 26 nt, Human
uaauaauaauaaaaaaaaacacccca

SEQ ID NO: 1068941 - RNA, 18 nt, Human
uacacacacacacacaca

SEQ ID NO: 1068942 - RNA, 24 nt, Human
uacacacacacacacacacgcaca

SEQ ID NO: 1068943 - RNA, 26 nt, Human
uacacacacacacacacacgcacaug

SEQ ID NO: 1068944 - RNA, 26 nt, Human
uacacacacacauacacacacacaca

SEQ ID NO: 1068945 - RNA, 25 nt, Human
uacacacacacauacacacacacag

SEQ ID NO: 1068946 - RNA, 21 nt, Human
uaccaccagugccaaagccug

SEQ ID NO: 1068947 - RNA, 18 nt, Human
uacuaaaacuacaaaaaa

SEQ ID NO: 1068948 - RNA, 28 nt, Human
uagaauggcagagacuuaagucagagag

SEQ ID NO: 1068949 - RNA, 19 nt, Human
uagguuccagaggaauguc

SEQ ID NO: 1068950 - RNA, 19 nt, Human
uaucaaacaggcccaaucc

SEQ ID NO: 1068951 - RNA, 23 nt, Human
ucaaacguccugcucuuaacccc

SEQ ID NO: 1068952 - RNA, 24 nt, Human
ucaacagggcagcuuaaaaggaaa

SEQ ID NO: 1068953 - RNA, 20 nt, Human
ucacgccuguaaucccagca

SEQ ID NO: 1068954 - RNA, 22 nt, Human
ucagcaaacuaucacaaggaca

SEQ ID NO: 1068955 - RNA, 18 nt, Human
ucccaccuuccuucuguc

SEQ ID NO: 1068956 - RNA, 19 nt, Human
uccuuuaucaaacaggccc

SEQ ID NO: 1068957 - RNA, 20 nt, Human
ucucacucauaggugggaau

SEQ ID NO: 1068958 - RNA, 21 nt, Human
ucucuacuaaaacuacaaaaa

SEQ ID NO: 1068959 - RNA, 25 nt, Human
ucugaagagacucuccagaccucca

SEQ ID NO: 1068960 - RNA, 19 nt, Human
ugaaaccccaucucuacua

SEQ ID NO: 1068961 - RNA, 25 nt, Human
ugaaauuccaggucugugcaaccuc

SEQ ID NO: 1068962 - RNA, 24 nt, Human
ugaacaaugagaacacauggacac

SEQ ID NO: 1068963 - RNA, 19 nt, Human
ugacgcugaaauuccaggu

SEQ ID NO: 1068964 - RNA, 21 nt, Human
ugagaccagccuggccaacaa

SEQ ID NO: 1068965 - RNA, 23 nt, Human
ugagaccagccuggccaacaagg

SEQ ID NO: 1068966 - RNA, 21 nt, Human
ugcacacacacaagcacaucc

SEQ ID NO: 1068967 - RNA, 24 nt, Human
ugcagacauuuggagaaagaacaa

SEQ ID NO: 1068968 - RNA, 24 nt, Human
ugcccaggacuagggaggguuugc

SEQ ID NO: 1068969 - RNA, 20 nt, Human
ugccccugucagcaucacgu

SEQ ID NO: 1068970 - RNA, 20 nt, Human
ugccugcacacuuacacaua

SEQ ID NO: 1068971 - RNA, 23 nt, Human
uggacucuuggauaaggagguuc

SEQ ID NO: 1068972 - RNA, 20 nt, Human
uggauaaggagguucaugag

SEQ ID NO: 1068973 - RNA, 23 nt, Human
uggaucaccugaggucagaaguu

SEQ ID NO: 1068974 - RNA, 24 nt, Human
uggaucaccugaggucagaaguuu

SEQ ID NO: 1068975 - RNA, 27 nt, Human
uggaucaccugaggucagaaguuugag

SEQ ID NO: 1068976 - RNA, 20 nt, Human
uggauuaagaaaauguggcc

SEQ ID NO: 1068977 - RNA, 19 nt, Human
uggcacauguauacauaug

SEQ ID NO: 1068978 - RNA, 18 nt, Human
uggcagagacuuaaguca

SEQ ID NO: 1068979 - RNA, 21 nt, Human
ugggaaaaaauaaagcagaga

SEQ ID NO: 1068980 - RNA, 18 nt, Human
ugggaggccgagguggug

SEQ ID NO: 1068981 - RNA, 23 nt, Human
ugggaggccgaggugguggauca

SEQ ID NO: 1068982 - RNA, 21 nt, Human
uggggugggggcaguggggag

SEQ ID NO: 1068983 - RNA, 24 nt, Human
uggggugggggcaguggggaggga

SEQ ID NO: 1068984 - RNA, 25 nt, Human
uggggugggggcaguggggagggau

SEQ ID NO: 1068985 - RNA, 19 nt, Human
uggugacaaguacuauggg

SEQ ID NO: 1068986 - RNA, 22 nt, Human
ugguucacgccuguaaucccag

SEQ ID NO: 1068987 - RNA, 24 nt, Human
ugguucacgccuguaaucccagca

SEQ ID NO: 1068988 - RNA, 23 nt, Human
uguggggugggggcaguggggag

SEQ ID NO: 1068989 - RNA, 18 nt, Human
uguuguggggugggggca

SEQ ID NO: 1068990 - RNA, 18 nt, Human
uguuguggggugggggca

SEQ ID NO: 1068991 - RNA, 19 nt, Human
uguuguggggugggggcag

SEQ ID NO: 1068992 - RNA, 20 nt, Human
uuacacauagacauauagcu

SEQ ID NO: 1068993 - RNA, 18 nt, Human
uuacuuagguuccagagg

SEQ ID NO: 1068994 - RNA, 22 nt, Human
uucacaauagcaaagaccugga

SEQ ID NO: 1068995 - RNA, 19 nt, Human
uucucuagccuucaguagc

SEQ ID NO: 1068996 - RNA, 20 nt, Human
uugacgcugaaauuccaggu

SEQ ID NO: 1068997 - RNA, 19 nt, Human
uugauccucaacaguagaa

SEQ ID NO: 1068998 - RNA, 24 nt, Human
uugggaggccgaggugguggauca

SEQ ID NO: 1068999 - RNA, 23 nt, Human
uuguacauauguacccuaaaacu

SEQ ID NO: 1069000 - RNA, 23 nt, Human
aaaggccaaugcugccacaggua

SEQ ID NO: 1069001 - RNA, 20 nt, Human
acaagcacauugacgcuccu

SEQ ID NO: 1069002 - RNA, 24 nt, Human
acagagaacaccuggagaugggag

SEQ ID NO: 1069003 - RNA, 18 nt, Human
accccuggggaaagggga

SEQ ID NO: 1069004 - RNA, 18 nt, Human
acccugagggcgggaagg

SEQ ID NO: 1069005 - RNA, 25 nt, Human
acccugagggcgggaaggagagaag

SEQ ID NO: 1069006 - RNA, 23 nt, Human
acccugagggcgggaaggagagg

SEQ ID NO: 1069007 - RNA, 18 nt, Human
agagaaggcgcgcacgug

SEQ ID NO: 1069008 - RNA, 18 nt, Human
agagccuccugcuccacc

SEQ ID NO: 1069009 - RNA, 27 nt, Human
aucuccuucaggauauccacuucacug

SEQ ID NO: 1069010 - RNA, 26 nt, Human
caagcacauugacgcuccugacuacc

SEQ ID NO: 1069011 - RNA, 23 nt, Human
cagcucuaaacuaaaggaaugac

SEQ ID NO: 1069012 - RNA, 27 nt, Human
cagguacuggaucuccuuggccagggg

SEQ ID NO: 1069013 - RNA, 23 nt, Human
ccccugguagaggggcuaugcug

SEQ ID NO: 1069014 - RNA, 24 nt, Human
cccugagaagcgccauggcuuaag

SEQ ID NO: 1069015 - RNA, 20 nt, Human
cccuuuucuucccccuuguc

SEQ ID NO: 1069016 - RNA, 20 nt, Human
ccguggacccugagggcggg

SEQ ID NO: 1069017 - RNA, 20 nt, Human
ccuccugcuccacccucuuc

SEQ ID NO: 1069018 - RNA, 20 nt, Human
cgccaugguggccguggacc

SEQ ID NO: 1069019 - RNA, 21 nt, Human
cgcugcagagccuggugcugc

SEQ ID NO: 1069020 - RNA, 21 nt, Human
cgcuggggggugccgcugcag

SEQ ID NO: 1069021 - RNA, 23 nt, Human
cgggcagacccacagagaacacc

SEQ ID NO: 1069022 - RNA, 20 nt, Human
cucuuugcacucaccaguga

SEQ ID NO: 1069023 - RNA, 19 nt, Human
cugcagagccuggugcugc

SEQ ID NO: 1069024 - RNA, 18 nt, Human
cugcugccccugauacgc

SEQ ID NO: 1069025 - RNA, 18 nt, Human
cuggaaucgaggaaugug

SEQ ID NO: 1069026 - RNA, 18 nt, Human
gacccuuuucuucccccu

SEQ ID NO: 1069027 - RNA, 18 nt, Human
gacucugggcucauacag

SEQ ID NO: 1069028 - RNA, 22 nt, Human
gcaguggagucuggcuuccuau

SEQ ID NO: 1069029 - RNA, 18 nt, Human
gccacagguacugcugcc

SEQ ID NO: 1069030 - RNA, 20 nt, Human
gcccugagaagcgccauggc

SEQ ID NO: 1069031 - RNA, 20 nt, Human
gcuggggggugccgcugcag

SEQ ID NO: 1069032 - RNA, 24 nt, Human
ggacccuuuucuucccccuugucu

SEQ ID NO: 1069033 - RNA, 21 nt, Human
ggcagacccacagagaacacc

SEQ ID NO: 1069034 - RNA, 22 nt, Human
gguggccguggacccugagggc

SEQ ID NO: 1069035 - RNA, 22 nt, Human
gguggccguggacccugagggc

SEQ ID NO: 1069036 - RNA, 19 nt, Human
guacaagcacauugacgcu

SEQ ID NO: 1069037 - RNA, 22 nt, Human
guacaagcacauugacgcuccu

SEQ ID NO: 1069038 - RNA, 19 nt, Human
guacuggaucuccuuggcc

SEQ ID NO: 1069039 - RNA, 21 nt, Human
uacuuuugcugcuaccaucgu

SEQ ID NO: 1069040 - RNA, 18 nt, Human
uaggggacccuuuucuuc

SEQ ID NO: 1069041 - RNA, 23 nt, Human
ucaacuucuuauccaguuucuca

SEQ ID NO: 1069042 - RNA, 18 nt, Human
uccacuucacugcccagc

SEQ ID NO: 1069043 - RNA, 20 nt, Human
ucuaaacuaaaggaaugacc

SEQ ID NO: 1069044 - RNA, 19 nt, Human
ugcuaccaucgucucucca

SEQ ID NO: 1069045 - RNA, 20 nt, Human
ugcuccacccucuucuucug

SEQ ID NO: 1069046 - RNA, 24 nt, Human
uggagagccccugguagaggggcu

SEQ ID NO: 1069047 - RNA, 22 nt, Human
uggagucuggcuuccuaucucc

SEQ ID NO: 1069048 - RNA, 19 nt, Human
uggccguggacccugaggg

SEQ ID NO: 1069049 - RNA, 22 nt, Human
ugggcucauacagaugccacua

SEQ ID NO: 1069050 - RNA, 24 nt, Human
uugcggaccucuucuaucaaaucu

SEQ ID NO: 1069051 - RNA, 23 nt, Human
uuuuccagcucuuugcacucacc

SEQ ID NO: 1069052 - RNA, 23 nt, Human
uuuugcugcuaccaucgucucuc

SEQ ID NO: 1069053 - RNA, 20 nt, Human
cccccugcagcuccagggcc

SEQ ID NO: 1069054 - RNA, 21 nt, Human
ccccucgcccgcggacgcccg

SEQ ID NO: 1069055 - RNA, 21 nt, Human
ccccugcagcuccagggccuu

SEQ ID NO: 1069056 - RNA, 18 nt, Human
cccguccccucgcccgcg

SEQ ID NO: 1069057 - RNA, 18 nt, Human
ccugcagcuccagggccu

SEQ ID NO: 1069058 - RNA, 20 nt, Human
cugcagcuccagggccuugg

SEQ ID NO: 1069059 - RNA, 21 nt, Human
guucagggcccagucccgucc

SEQ ID NO: 1069060 - RNA, 20 nt, Human
uccagggccuuggacuguuc

SEQ ID NO: 1069061 - RNA, 23 nt, Human
aaaaauacccccuucugugagaa

SEQ ID NO: 1069062 - RNA, 23 nt, Human
aaagcagagacugguuagaggcc

SEQ ID NO: 1069063 - RNA, 24 nt, Human
aaagcagagacugguuagaggccu

SEQ ID NO: 1069064 - RNA, 23 nt, Human
aaaguagaaaagcaaggagaggg

SEQ ID NO: 1069065 - RNA, 24 nt, Human
aaagugcugggauuacaggcauga

SEQ ID NO: 1069066 - RNA, 23 nt, Human
aaagugggcaggguuaccacaga

SEQ ID NO: 1069067 - RNA, 21 nt, Human
aagacagccagaacuaaggcg

SEQ ID NO: 1069068 - RNA, 21 nt, Human
aaggacccagaaauaacaggc

SEQ ID NO: 1069069 - RNA, 19 nt, Human
aagugcugggauuacaggc

SEQ ID NO: 1069070 - RNA, 21 nt, Human
aagugcugggauuacaggcau

SEQ ID NO: 1069071 - RNA, 23 nt, Human
aagugguugucuucaaaagaacu

SEQ ID NO: 1069072 - RNA, 20 nt, Human
aauaacaaagugaaugagga

SEQ ID NO: 1069073 - RNA, 24 nt, Human
acccaggcuggagugcaguggcgu

SEQ ID NO: 1069074 - RNA, 24 nt, Human
accucgugauccgcccgccuuggc

SEQ ID NO: 1069075 - RNA, 20 nt, Human
acugcaagcuccaccuccca

SEQ ID NO: 1069076 - RNA, 20 nt, Human
agaaacuagaaagaguucaa

SEQ ID NO: 1069077 - RNA, 24 nt, Human
agacagagaugaagacagccagaa

SEQ ID NO: 1069078 - RNA, 20 nt, Human
agacagccagaacuaaggcg

SEQ ID NO: 1069079 - RNA, 20 nt, Human
agagagaaagcagagacugg

SEQ ID NO: 1069080 - RNA, 24 nt, Human
agagaugaagacagccagaacuaa

SEQ ID NO: 1069081 - RNA, 18 nt, Human
agaggcugcugaucuucc

SEQ ID NO: 1069082 - RNA, 18 nt, Human
agcaaggagagggucuca

SEQ ID NO: 1069083 - RNA, 22 nt, Human
aggagucaaggacuuguugacc

SEQ ID NO: 1069084 - RNA, 19 nt, Human
aggcaugagacacugcgcc

SEQ ID NO: 1069085 - RNA, 20 nt, Human
aggcggcagugacagacugg

SEQ ID NO: 1069086 - RNA, 22 nt, Human
aggcggcagugacagacuggaa

SEQ ID NO: 1069087 - RNA, 25 nt, Human
aggcuggagugcaguggcgugaucu

SEQ ID NO: 1069088 - RNA, 23 nt, Human
aggguccaagucaggaaggaccu

SEQ ID NO: 1069089 - RNA, 18 nt, Human
agugacagacuggaagga

SEQ ID NO: 1069090 - RNA, 19 nt, Human
agugcaguggcgugaucuc

SEQ ID NO: 1069091 - RNA, 20 nt, Human
agugcaguggcgugaucucg

SEQ ID NO: 1069092 - RNA, 23 nt, Human
agugcaguggcgugaucucggcu

SEQ ID NO: 1069093 - RNA, 24 nt, Human
agugcaguggcgugaucucggcuc

SEQ ID NO: 1069094 - RNA, 18 nt, Human
agugcugggauuacaggc

SEQ ID NO: 1069095 - RNA, 19 nt, Human
auccgcccgccuuggccuc

SEQ ID NO: 1069096 - RNA, 21 nt, Human
auucuccugccucagccuccc

SEQ ID NO: 1069097 - RNA, 19 nt, Human
auuuggcuuaacaaggacc

SEQ ID NO: 1069098 - RNA, 23 nt, Human
caaagugcugggauuacaggcau

SEQ ID NO: 1069099 - RNA, 24 nt, Human
caaagugcugggauuacaggcaug

SEQ ID NO: 1069100 - RNA, 19 nt, Human
caacccuuaagaucuuagc

SEQ ID NO: 1069101 - RNA, 24 nt, Human
caacgggucuggcacaaaaguggc

SEQ ID NO: 1069102 - RNA, 21 nt, Human
caagacagagaugaagacagc

SEQ ID NO: 1069103 - RNA, 27 nt, Human
caagaccagaggccucagggcugccgg

SEQ ID NO: 1069104 - RNA, 18 nt, Human
caaggacccagaaauaac

SEQ ID NO: 1069105 - RNA, 21 nt, Human
caaggacccagaaauaacagg

SEQ ID NO: 1069106 - RNA, 21 nt, Human
caauucuauucuaaaauuugg

SEQ ID NO: 1069107 - RNA, 18 nt, Human
cacagcccuauaccaagu

SEQ ID NO: 1069108 - RNA, 19 nt, Human
caccaacugauuaccaccc

SEQ ID NO: 1069109 - RNA, 21 nt, Human
caccacguccagcuaauuuuu

SEQ ID NO: 1069110 - RNA, 24 nt, Human
cacccaggcuggagugcaguggcg

SEQ ID NO: 1069111 - RNA, 19 nt, Human
cacccccagccucccaauc

SEQ ID NO: 1069112 - RNA, 24 nt, Human
caccguguuagcaaggauggucuc

SEQ ID NO: 1069113 - RNA, 22 nt, Human
cacgccauucuccugccucagc

SEQ ID NO: 1069114 - RNA, 21 nt, Human
cacugcaagcuccaccuccca

SEQ ID NO: 1069115 - RNA, 23 nt, Human
cagacaauucccacaaugaucac

SEQ ID NO: 1069116 - RNA, 23 nt, Human
caggaaggaccuugacuaucuca

SEQ ID NO: 1069117 - RNA, 23 nt, Human
caggccacgaagcggaggggaag

SEQ ID NO: 1069118 - RNA, 24 nt, Human
caggguccaagucaggaaggaccu

SEQ ID NO: 1069119 - RNA, 20 nt, Human
cauaucuggacacuagggac

SEQ ID NO: 1069120 - RNA, 24 nt, Human
caugccaccacguccagcuaauuu

SEQ ID NO: 1069121 - RNA, 24 nt, Human
ccauuuaaaaauacccccuucugu

SEQ ID NO: 1069122 - RNA, 20 nt, Human
cccaagaccagaggccucag

SEQ ID NO: 1069123 - RNA, 23 nt, Human
cccaagaccagaggccucagggc

SEQ ID NO: 1069124 - RNA, 19 nt, Human
cccaaguagcugggaguac

SEQ ID NO: 1069125 - RNA, 20 nt, Human
cccacagugacgauaccaag

SEQ ID NO: 1069126 - RNA, 20 nt, Human
cccagguucacgccauucuc

SEQ ID NO: 1069127 - RNA, 20 nt, Human
ccccacagcccuauaccaag

SEQ ID NO: 1069128 - RNA, 22 nt, Human
cccgccuuggccucucaaagug

SEQ ID NO: 1069129 - RNA, 27 nt, Human
ccuacaguucaagacagagaugaagac

SEQ ID NO: 1069130 - RNA, 24 nt, Human
ccucccaauccaaggggugggggu

SEQ ID NO: 1069131 - RNA, 24 nt, Human
ccucccagguucacgccauucucc

SEQ ID NO: 1069132 - RNA, 24 nt, Human
cgcucugucacccaggcuggagug

SEQ ID NO: 1069133 - RNA, 23 nt, Human
cggagguacuucugcccauaugg

SEQ ID NO: 1069134 - RNA, 22 nt, Human
cgggcacaguaagcaaaguggg

SEQ ID NO: 1069135 - RNA, 24 nt, Human
cucacugcaagcuccaccucccag

SEQ ID NO: 1069136 - RNA, 19 nt, Human
cucagggcugccgggguca

SEQ ID NO: 1069137 - RNA, 24 nt, Human
cuccugaccucgugauccgcccgc

SEQ ID NO: 1069138 - RNA, 24 nt, Human
cucgcucugucacccaggcuggag

SEQ ID NO: 1069139 - RNA, 26 nt, Human
cucugaauuaugcccuacugaggccc

SEQ ID NO: 1069140 - RNA, 23 nt, Human
cucugucacccaggcuggagugc

SEQ ID NO: 1069141 - RNA, 24 nt, Human
cugacaggaugaugauuuuagaaa

SEQ ID NO: 1069142 - RNA, 24 nt, Human
cugcaagcuccaccucccagguuc

SEQ ID NO: 1069143 - RNA, 23 nt, Human
cugccucagccucccaaguagcu

SEQ ID NO: 1069144 - RNA, 24 nt, Human
cuuggccucucaaagugcugggau

SEQ ID NO: 1069145 - RNA, 18 nt, Human
gaagcggaggggaaggcc

SEQ ID NO: 1069146 - RNA, 20 nt, Human
gaccucgugauccgcccgcc

SEQ ID NO: 1069147 - RNA, 21 nt, Human
gaccucgugauccgcccgccu

SEQ ID NO: 1069148 - RNA, 21 nt, Human
gagacagagucucgcucuguc

SEQ ID NO: 1069149 - RNA, 20 nt, Human
gagacugguuagaggccuac

SEQ ID NO: 1069150 - RNA, 26 nt, Human
gaugacaggguccaagucaggaagga

SEQ ID NO: 1069151 - RNA, 22 nt, Human
gauuacaggcaugagacacugc

SEQ ID NO: 1069152 - RNA, 22 nt, Human
gauuacaggcaugagacacugc

SEQ ID NO: 1069153 - RNA, 18 nt, Human
gcaagcuccaccucccag

SEQ ID NO: 1069154 - RNA, 20 nt, Human
gcaaugaaaacaacauugaa

SEQ ID NO: 1069155 - RNA, 22 nt, Human
gcagccuugcacccccagccuc

SEQ ID NO: 1069156 - RNA, 20 nt, Human
gccucagccucccaaguagc

SEQ ID NO: 1069157 - RNA, 22 nt, Human
gccuuggccucucaaagugcug

SEQ ID NO: 1069158 - RNA, 22 nt, Human
gcggaacguacaguauggauaa

SEQ ID NO: 1069159 - RNA, 18 nt, Human
gcggcagugacagacugg

SEQ ID NO: 1069160 - RNA, 18 nt, Human
gcgugaagaaugaggagc

SEQ ID NO: 1069161 - RNA, 18 nt, Human
gcugagagagaaagcaga

SEQ ID NO: 1069162 - RNA, 19 nt, Human
gcuggagugcaguggcgug

SEQ ID NO: 1069163 - RNA, 20 nt, Human
ggaguacaagcacaugccac

SEQ ID NO: 1069164 - RNA, 22 nt, Human
ggauuacaggcaugagacacug

SEQ ID NO: 1069165 - RNA, 24 nt, Human
ggcaaugaaaacaacauugaaaga

SEQ ID NO: 1069166 - RNA, 22 nt, Human
ggcuggagugcaguggcgugau

SEQ ID NO: 1069167 - RNA, 20 nt, Human
ggucucgaucuccugaccuc

SEQ ID NO: 1069168 - RNA, 22 nt, Human
guaaaguuuccuuucacaucaa

SEQ ID NO: 1069169 - RNA, 22 nt, Human
guagaggcagccuugcaccccc

SEQ ID NO: 1069170 - RNA, 23 nt, Human
guaggagucaaggacuuguugac

SEQ ID NO: 1069171 - RNA, 21 nt, Human
gugaucucggcucacugcaag

SEQ ID NO: 1069172 - RNA, 19 nt, Human
gugggugggagaagaggcu

SEQ ID NO: 1069173 - RNA, 19 nt, Human
uaagggaguuuguagucuu

SEQ ID NO: 1069174 - RNA, 19 nt, Human
uaauuuuuugcauuuuuag

SEQ ID NO: 1069175 - RNA, 24 nt, Human
uacaagcacaugccaccacgucca

SEQ ID NO: 1069176 - RNA, 22 nt, Human
uacaggcaugagacacugcgcc

SEQ ID NO: 1069177 - RNA, 19 nt, Human
uacccuaaaauguagauua

SEQ ID NO: 1069178 - RNA, 19 nt, Human
uacucaucugcaugguucu

SEQ ID NO: 1069179 - RNA, 18 nt, Human
uagaauguggucuuuuag

SEQ ID NO: 1069180 - RNA, 24 nt, Human
uagcaaagagcugagagccccaca

SEQ ID NO: 1069181 - RNA, 18 nt, Human
uagcugggaguacaagca

SEQ ID NO: 1069182 - RNA, 24 nt, Human
uaguaaagacagcuuuucaccgug

SEQ ID NO: 1069183 - RNA, 22 nt, Human
uauuagcaguggaagagaaagu

SEQ ID NO: 1069184 - RNA, 21 nt, Human
ucaaaagaacucaugccgcaa

SEQ ID NO: 1069185 - RNA, 23 nt, Human
ucaaagugcugggauuacaggca

SEQ ID NO: 1069186 - RNA, 24 nt, Human
ucaaagugcugggauuacaggcau

SEQ ID NO: 1069187 - RNA, 20 nt, Human
ucaagacagagaugaagaca

SEQ ID NO: 1069188 - RNA, 20 nt, Human
ucaauaucagaacagggagc

SEQ ID NO: 1069189 - RNA, 21 nt, Human
ucaccaacugauuaccaccca

SEQ ID NO: 1069190 - RNA, 22 nt, Human
ucacccaggcuggagugcagug

SEQ ID NO: 1069191 - RNA, 24 nt, Human
ucaccguguuagcaaggauggucu

SEQ ID NO: 1069192 - RNA, 19 nt, Human
ucacugcaagcuccaccuc

SEQ ID NO: 1069193 - RNA, 24 nt, Human
ucacugcaagcuccaccucccagg

SEQ ID NO: 1069194 - RNA, 20 nt, Human
ucagccucccaaguagcugg

SEQ ID NO: 1069195 - RNA, 20 nt, Human
uccaagggguggggguagcc

SEQ ID NO: 1069196 - RNA, 19 nt, Human
ucccagguucacgccauuc

SEQ ID NO: 1069197 - RNA, 20 nt, Human
ucccagguucacgccauucu

SEQ ID NO: 1069198 - RNA, 21 nt, Human
ucccagguucacgccauucuc

SEQ ID NO: 1069199 - RNA, 24 nt, Human
ucccagguucacgccauucuccug

SEQ ID NO: 1069200 - RNA, 24 nt, Human
ucgcucugucacccaggcuggagu

SEQ ID NO: 1069201 - RNA, 24 nt, Human
ucucaaagugcugggauuacaggc

SEQ ID NO: 1069202 - RNA, 26 nt, Human
ucuccugccucagccucccaaguagc

SEQ ID NO: 1069203 - RNA, 19 nt, Human
ucucgcucugucacccagg

SEQ ID NO: 1069204 - RNA, 23 nt, Human
ucucgcucugucacccaggcugg

SEQ ID NO: 1069205 - RNA, 24 nt, Human
ucucgcucugucacccaggcugga

SEQ ID NO: 1069206 - RNA, 26 nt, Human
ucucgcucugucacccaggcuggagu

SEQ ID NO: 1069207 - RNA, 27 nt, Human
ucucgcucugucacccaggcuggagug

SEQ ID NO: 1069208 - RNA, 21 nt, Human
ucuguaguaggagucaaggac

SEQ ID NO: 1069209 - RNA, 24 nt, Human
ucugucacccaggcuggagugcag

SEQ ID NO: 1069210 - RNA, 18 nt, Human
ugaagacagccagaacua

SEQ ID NO: 1069211 - RNA, 18 nt, Human
ugagagccccacagcccu

SEQ ID NO: 1069212 - RNA, 23 nt, Human
ugaggagcaguggcugagagaga

SEQ ID NO: 1069213 - RNA, 21 nt, Human
ugagggcacccauucaaagau

SEQ ID NO: 1069214 - RNA, 19 nt, Human
ugcacccccagccucccaa

SEQ ID NO: 1069215 - RNA, 24 nt, Human
ugccucagccucccaaguagcugg

SEQ ID NO: 1069216 - RNA, 24 nt, Human
ugcugggauuacaggcaugagaca

SEQ ID NO: 1069217 - RNA, 25 nt, Human
ugcuugggaaaguagaaaagcaagg

SEQ ID NO: 1069218 - RNA, 24 nt, Human
uggacacuagggacacugucucca

SEQ ID NO: 1069219 - RNA, 19 nt, Human
uggagugcaguggcgugau

SEQ ID NO: 1069220 - RNA, 23 nt, Human
uggagugcaguggcgugaucucg

SEQ ID NO: 1069221 - RNA, 24 nt, Human
uggagugcaguggcgugaucucgg

SEQ ID NO: 1069222 - RNA, 22 nt, Human
uggcaacccuuaagaucuuagc

SEQ ID NO: 1069223 - RNA, 25 nt, Human
uggcacaaaaguggcauuugugggu

SEQ ID NO: 1069224 - RNA, 20 nt, Human
uggcgugaucucggcucacu

SEQ ID NO: 1069225 - RNA, 24 nt, Human
ugggaguacaagcacaugccacca

SEQ ID NO: 1069226 - RNA, 18 nt, Human
ugggauuacaggcaugag

SEQ ID NO: 1069227 - RNA, 19 nt, Human
ugggauuacaggcaugaga

SEQ ID NO: 1069228 - RNA, 21 nt, Human
ugggauuacaggcaugagaca

SEQ ID NO: 1069229 - RNA, 22 nt, Human
ugggauuacaggcaugagacac

SEQ ID NO: 1069230 - RNA, 22 nt, Human
ugggauuacaggcaugagacac

SEQ ID NO: 1069231 - RNA, 22 nt, Human
ugggauuacaggcaugagacac

SEQ ID NO: 1069232 - RNA, 24 nt, Human
ugggauuacaggcaugagacacug

SEQ ID NO: 1069233 - RNA, 24 nt, Human
ugggauuacaggcaugagacacug

SEQ ID NO: 1069234 - RNA, 23 nt, Human
ugggcaggguuaccacagaugau

SEQ ID NO: 1069235 - RNA, 20 nt, Human
ugguaccaugauaguucuug

SEQ ID NO: 1069236 - RNA, 22 nt, Human
uuaguaaagacagcuuuucacc

SEQ ID NO: 1069237 - RNA, 24 nt, Human
uuaguaaagacagcuuuucaccgu

SEQ ID NO: 1069238 - RNA, 18 nt, Human
uuggccucucaaagugcu

SEQ ID NO: 1069239 - RNA, 22 nt, Human
uuuagauaaaaccacuggcaac

SEQ ID NO: 1069240 - RNA, 24 nt, Human
uuuagauaaaaccacuggcaaccc

SEQ ID NO: 1069241 - RNA, 24 nt, Human
uuuuuaguaaagacagcuuuucac

SEQ ID NO: 1069242 - RNA, 23 nt, Human
aggguuggguuuuuucucuaggg

SEQ ID NO: 1069243 - RNA, 18 nt, Human
cauccagagguugggcuc

SEQ ID NO: 1069244 - RNA, 19 nt, Human
ccucccucuuccuacgucc

SEQ ID NO: 1069245 - RNA, 23 nt, Human
ccugagaccuccagcuuuccagg

SEQ ID NO: 1069246 - RNA, 21 nt, Human
gagguugggcucauaaucugg

SEQ ID NO: 1069247 - RNA, 18 nt, Human
gggguggcugagaggagg

SEQ ID NO: 1069248 - RNA, 20 nt, Human
gggguggcugagaggagggg

SEQ ID NO: 1069249 - RNA, 19 nt, Human
ucagguccucccucuuccu

SEQ ID NO: 1069250 - RNA, 25 nt, Human
uccucccucuuccuacguccugaga

SEQ ID NO: 1069251 - RNA, 19 nt, Human
ucucuagggguaauuuugg

SEQ ID NO: 1069252 - RNA, 21 nt, Human
ugagaccuccagcuuuccagg

SEQ ID NO: 1069253 - RNA, 21 nt, Human
uuccagggggauacacaaugu

SEQ ID NO: 1069254 - RNA, 18 nt, Human
gccgggagggggagcgag

SEQ ID NO: 1069255 - RNA, 21 nt, Human
aaaaucuagaugauuucaucc

SEQ ID NO: 1069256 - RNA, 23 nt, Human
aaccagaaagugcugcuuccacc

SEQ ID NO: 1069257 - RNA, 19 nt, Human
agaaagugcugcuuccacc

SEQ ID NO: 1069258 - RNA, 22 nt, Human
augaauauacuccaaauuggcu

SEQ ID NO: 1069259 - RNA, 23 nt, Human
auuacaucacacucagauacacc

SEQ ID NO: 1069260 - RNA, 18 nt, Human
caggagacacugcagaaa

SEQ ID NO: 1069261 - RNA, 28 nt, Human
ccagcagguggccaaauauuguaaugac

SEQ ID NO: 1069262 - RNA, 19 nt, Human
cuccucccuagccccccua

SEQ ID NO: 1069263 - RNA, 22 nt, Human
gcugcuuccacccauagcugag

SEQ ID NO: 1069264 - RNA, 20 nt, Human
uaguccagucuugaguaagc

SEQ ID NO: 1069265 - RNA, 21 nt, Human
ugaacagacuauucaucaaga

SEQ ID NO: 1069266 - RNA, 25 nt, Human
ugaggaucuuucucuuucuccuccc

SEQ ID NO: 1069267 - RNA, 18 nt, Human
ugcagaaagucugcccuu

SEQ ID NO: 1069268 - RNA, 25 nt, Human
aaacaaaaaacaaaaaaaaacagga

SEQ ID NO: 1069269 - RNA, 18 nt, Human
aaacacacacauucuugc

SEQ ID NO: 1069270 - RNA, 19 nt, Human
aaggugaguugagccgcug

SEQ ID NO: 1069271 - RNA, 25 nt, Human
accccuuccuuucaucacuuucuca

SEQ ID NO: 1069272 - RNA, 23 nt, Human
accugguaaguauaaauaguuca

SEQ ID NO: 1069273 - RNA, 27 nt, Human
acuccuuccucccccuucccucccccu

SEQ ID NO: 1069274 - RNA, 18 nt, Human
aggaaagagagagugaug

SEQ ID NO: 1069275 - RNA, 28 nt, Human
aggcggagccggguggggccaggagccu

SEQ ID NO: 1069276 - RNA, 21 nt, Human
caaaaaacaaaaaaaaacagg

SEQ ID NO: 1069277 - RNA, 18 nt, Human
cagcccuguggcuccucc

SEQ ID NO: 1069278 - RNA, 24 nt, Human
cagcgacuccucugagcugaguuu

SEQ ID NO: 1069279 - RNA, 21 nt, Human
ccagcagugagucggagcucu

SEQ ID NO: 1069280 - RNA, 18 nt, Human
ccccuucccucccccuuu

SEQ ID NO: 1069281 - RNA, 21 nt, Human
ccccuucccucccccuuuuuu

SEQ ID NO: 1069282 - RNA, 19 nt, Human
ccccuuuccccucccuucc

SEQ ID NO: 1069283 - RNA, 22 nt, Human
cccgacuccuuccucccccuuc

SEQ ID NO: 1069284 - RNA, 21 nt, Human
cccucccuucccuauccccga

SEQ ID NO: 1069285 - RNA, 24 nt, Human
cccuguggcuccuccucgcugccc

SEQ ID NO: 1069286 - RNA, 23 nt, Human
cccuuuuuuuuguuuuccguucc

SEQ ID NO: 1069287 - RNA, 21 nt, Human
ccgccgccgaguggagcgcuc

SEQ ID NO: 1069288 - RNA, 22 nt, Human
ccgggcgcacgucucgccuccu

SEQ ID NO: 1069289 - RNA, 23 nt, Human
ccuccaaacacccgcggaagucu

SEQ ID NO: 1069290 - RNA, 24 nt, Human
ccucuuacugaacacuuuaaaagu

SEQ ID NO: 1069291 - RNA, 25 nt, Human
cgacuccuuccucccccuucccucc

SEQ ID NO: 1069292 - RNA, 19 nt, Human
cgaggaccuggagccgggu

SEQ ID NO: 1069293 - RNA, 20 nt, Human
cgucucgccuccuccccacu

SEQ ID NO: 1069294 - RNA, 24 nt, Human
cuccuccccacuacuuucuggguu

SEQ ID NO: 1069295 - RNA, 26 nt, Human
cuccuccccacuacuuucuggguucc

SEQ ID NO: 1069296 - RNA, 22 nt, Human
cucugguggguucggcugcccc

SEQ ID NO: 1069297 - RNA, 18 nt, Human
cugcagcagcgacuccuc

SEQ ID NO: 1069298 - RNA, 18 nt, Human
cuuucuggguucccuaag

SEQ ID NO: 1069299 - RNA, 22 nt, Human
gaaaaucaaccccuuccuuuca

SEQ ID NO: 1069300 - RNA, 19 nt, Human
gaccagggaaccgcaggcg

SEQ ID NO: 1069301 - RNA, 19 nt, Human
gaccggauccugaggaggc

SEQ ID NO: 1069302 - RNA, 20 nt, Human
gaccuggagucggcaggggc

SEQ ID NO: 1069303 - RNA, 19 nt, Human
gaggaaagagagagugaug

SEQ ID NO: 1069304 - RNA, 21 nt, Human
gaggaccuggagccggguagu

SEQ ID NO: 1069305 - RNA, 22 nt, Human
gaggaccuggagccggguagug

SEQ ID NO: 1069306 - RNA, 24 nt, Human
gcaaccgagcucagcccuguggcu

SEQ ID NO: 1069307 - RNA, 22 nt, Human
gcggcgaaggagccauucgggg

SEQ ID NO: 1069308 - RNA, 24 nt, Human
gcucagccucagagacuucgcgaa

SEQ ID NO: 1069309 - RNA, 18 nt, Human
gcugacggaguagaagga

SEQ ID NO: 1069310 - RNA, 25 nt, Human
gcugaguuugaggccguccccgacu

SEQ ID NO: 1069311 - RNA, 21 nt, Human
ggaccagggaaccgcaggcgu

SEQ ID NO: 1069312 - RNA, 24 nt, Human
ggagccuggccucccggcggggag

SEQ ID NO: 1069313 - RNA, 20 nt, Human
ggaggcagcugcgguggcag

SEQ ID NO: 1069314 - RNA, 18 nt, Human
ggccgcugauugggcggc

SEQ ID NO: 1069315 - RNA, 20 nt, Human
ggcgucccggagccuggccu

SEQ ID NO: 1069316 - RNA, 19 nt, Human
ggcugcagcagcgacuccu

SEQ ID NO: 1069317 - RNA, 21 nt, Human
gggaggcacgcgggccggcag

SEQ ID NO: 1069318 - RNA, 25 nt, Human
gggccgcugauugggcggcgaagga

SEQ ID NO: 1069319 - RNA, 20 nt, Human
gguggcagcugcugaguucu

SEQ ID NO: 1069320 - RNA, 23 nt, Human
guagaaggaaaacgucaguguug

SEQ ID NO: 1069321 - RNA, 18 nt, Human
gugcucggacggcgaggg

SEQ ID NO: 1069322 - RNA, 22 nt, Human
guggcagcggguaccgaguggc

SEQ ID NO: 1069323 - RNA, 22 nt, Human
guuccccuuuccccucccuucc

SEQ ID NO: 1069324 - RNA, 23 nt, Human
uaaaacacacacauucuugccuu

SEQ ID NO: 1069325 - RNA, 22 nt, Human
uaaaaugaaaauacacaacuga

SEQ ID NO: 1069326 - RNA, 27 nt, Human
uaaacaaacaaaaaacaaaaaaaaaca

SEQ ID NO: 1069327 - RNA, 23 nt, Human
uaacgugcacuuaaacaaacaaa

SEQ ID NO: 1069328 - RNA, 22 nt, Human
uagaaggaaaacgucaguguug

SEQ ID NO: 1069329 - RNA, 22 nt, Human
uauacacuguaaaaguacuaca

SEQ ID NO: 1069330 - RNA, 21 nt, Human
uauggagguggcagcggguac

SEQ ID NO: 1069331 - RNA, 18 nt, Human
ucacuuucucauucacuc

SEQ ID NO: 1069332 - RNA, 18 nt, Human
ucccccuucccucccccu

SEQ ID NO: 1069333 - RNA, 20 nt, Human
ucggugaaggugaguugagc

SEQ ID NO: 1069334 - RNA, 21 nt, Human
ugaaggugaguugagccgcug

SEQ ID NO: 1069335 - RNA, 22 nt, Human
ugacacacaggguguuuuccuc

SEQ ID NO: 1069336 - RNA, 19 nt, Human
ugaggaggcagcugcggug

SEQ ID NO: 1069337 - RNA, 22 nt, Human
ugauaaguucggcuucagacac

SEQ ID NO: 1069338 - RNA, 18 nt, Human
ugcaggagggggcccgcu

SEQ ID NO: 1069339 - RNA, 19 nt, Human
ugcgguggcagcugcuggc

SEQ ID NO: 1069340 - RNA, 19 nt, Human
ugcuuggagaacaaagagc

SEQ ID NO: 1069341 - RNA, 21 nt, Human
uggaaguaugacuccauuuua

SEQ ID NO: 1069342 - RNA, 21 nt, Human
uggcagcugcugaguucucgg

SEQ ID NO: 1069343 - RNA, 20 nt, Human
uggccaggccgccgugcgga

SEQ ID NO: 1069344 - RNA, 22 nt, Human
uggcgggaggcacgcgggccgg

SEQ ID NO: 1069345 - RNA, 19 nt, Human
ugggaaaagcagcuucuuc

SEQ ID NO: 1069346 - RNA, 26 nt, Human
ugggaaaagcagcuucuucucccggg

SEQ ID NO: 1069347 - RNA, 21 nt, Human
ugggaaaagcagcuucuucug

SEQ ID NO: 1069348 - RNA, 21 nt, Human
ugguggguucggcugccccaa

SEQ ID NO: 1069349 - RNA, 21 nt, Human
uuguuuaaguuuauggaagua

SEQ ID NO: 1069350 - RNA, 24 nt, Human
uuuuuuuuguuuuccguuccccuu

SEQ ID NO: 1069351 - RNA, 21 nt, Human
aagccccugcuccugggccag

SEQ ID NO: 1069352 - RNA, 20 nt, Human
aagcuggugccucuguuauc

SEQ ID NO: 1069353 - RNA, 19 nt, Human
aauucuguggcccucagag

SEQ ID NO: 1069354 - RNA, 23 nt, Human
acgcaguccaucccagagguagc

SEQ ID NO: 1069355 - RNA, 19 nt, Human
aggagacccaaaccccaga

SEQ ID NO: 1069356 - RNA, 19 nt, Human
agucaguccucuuacuacc

SEQ ID NO: 1069357 - RNA, 19 nt, Human
agucaguccucuuacuacc

SEQ ID NO: 1069358 - RNA, 20 nt, Human
caccagccccacuccaagcc

SEQ ID NO: 1069359 - RNA, 20 nt, Human
caggcacgcaguccauccca

SEQ ID NO: 1069360 - RNA, 18 nt, Human
caggcccuccucgcaagg

SEQ ID NO: 1069361 - RNA, 22 nt, Human
cccagcccugccugugcccggc

SEQ ID NO: 1069362 - RNA, 25 nt, Human
ccccacacaggcacgcaguccaucc

SEQ ID NO: 1069363 - RNA, 22 nt, Human
ccccacuccaagccccugcucc

SEQ ID NO: 1069364 - RNA, 19 nt, Human
cccgcaggucuuccuccuc

SEQ ID NO: 1069365 - RNA, 18 nt, Human
cccugauggaggggugag

SEQ ID NO: 1069366 - RNA, 18 nt, Human
ccgggcaccagccccacu

SEQ ID NO: 1069367 - RNA, 19 nt, Human
ccucagagacccugguucc

SEQ ID NO: 1069368 - RNA, 21 nt, Human
ccucagagacccugguuccag

SEQ ID NO: 1069369 - RNA, 22 nt, Human
ccucagagacccugguuccagg

SEQ ID NO: 1069370 - RNA, 20 nt, Human
ccuccuccucauccucaaag

SEQ ID NO: 1069371 - RNA, 25 nt, Human
ccugggccaggcccuccucgcaagg

SEQ ID NO: 1069372 - RNA, 18 nt, Human
ccugguuccaggaggaag

SEQ ID NO: 1069373 - RNA, 20 nt, Human
ccugugcccggcaacucgcc

SEQ ID NO: 1069374 - RNA, 25 nt, Human
ccugugcccggcaacucgccaaaag

SEQ ID NO: 1069375 - RNA, 18 nt, Human
cgacgcgcgggggcccgg

SEQ ID NO: 1069376 - RNA, 26 nt, Human
cgccaaaaguagccguuccauugacc

SEQ ID NO: 1069377 - RNA, 21 nt, Human
cucagggggccgaggagggag

SEQ ID NO: 1069378 - RNA, 23 nt, Human
cuccaagccccugcuccugggcc

SEQ ID NO: 1069379 - RNA, 24 nt, Human
cugccccacacaggcacgcagucc

SEQ ID NO: 1069380 - RNA, 23 nt, Human
cugcuccugggccaggcccuccu

SEQ ID NO: 1069381 - RNA, 19 nt, Human
cugggcgccggggcggagg

SEQ ID NO: 1069382 - RNA, 18 nt, Human
gaggaacacgguguccgc

SEQ ID NO: 1069383 - RNA, 18 nt, Human
gcuccaucggggacugga

SEQ ID NO: 1069384 - RNA, 24 nt, Human
gcuccuguccuagaaagggugggc

SEQ ID NO: 1069385 - RNA, 19 nt, Human
gggacccaccagucccgca

SEQ ID NO: 1069386 - RNA, 20 nt, Human
guccuagaaagggugggccu

SEQ ID NO: 1069387 - RNA, 19 nt, Human
uaaguagggacccaccagu

SEQ ID NO: 1069388 - RNA, 21 nt, Human
uagucaguccucuuacuaccu

SEQ ID NO: 1069389 - RNA, 19 nt, Human
uccaggaggaagcuggugc

SEQ ID NO: 1069390 - RNA, 19 nt, Human
ucccagagguagcggcucc

SEQ ID NO: 1069391 - RNA, 18 nt, Human
ucccgcaggucuuccucc

SEQ ID NO: 1069392 - RNA, 21 nt, Human
ucccgcaggucuuccuccucc

SEQ ID NO: 1069393 - RNA, 21 nt, Human
ucccgggcaccagccccacuc

SEQ ID NO: 1069394 - RNA, 24 nt, Human
uccuccucauccucaaaggcccgc

SEQ ID NO: 1069395 - RNA, 21 nt, Human
ucuuccuccuccucauccucc

SEQ ID NO: 1069396 - RNA, 20 nt, Human
ugaagaugagccccagcccu

SEQ ID NO: 1069397 - RNA, 19 nt, Human
ugauggaggggugagggca

SEQ ID NO: 1069398 - RNA, 18 nt, Human
uguccgcgacgcgcgggg

SEQ ID NO: 1069399 - RNA, 18 nt, Human
uuccaggaggaagcuggu

SEQ ID NO: 1069400 - RNA, 21 nt, Human
auuaagugacuuccuaaagag

SEQ ID NO: 1069401 - RNA, 22 nt, Human
ccuuucugcagucuuuuucuca

SEQ ID NO: 1069402 - RNA, 20 nt, Human
cuacucaggaauuguugcgg

SEQ ID NO: 1069403 - RNA, 20 nt, Human
cuacucaggaauuguugcgg

SEQ ID NO: 1069404 - RNA, 24 nt, Human
cucaagcaaggcccuacucaggaa

SEQ ID NO: 1069405 - RNA, 18 nt, Human
cucuccuuucugcagucu

SEQ ID NO: 1069406 - RNA, 21 nt, Human
cugcagucuuuuucucaagaa

SEQ ID NO: 1069407 - RNA, 18 nt, Human
gaagugaaggagcaagug

SEQ ID NO: 1069408 - RNA, 19 nt, Human
gggaauaaugaagcccaac

SEQ ID NO: 1069409 - RNA, 20 nt, Human
gguuugcuuguuucuacuga

SEQ ID NO: 1069410 - RNA, 19 nt, Human
uaagugacuuccuaaagag

SEQ ID NO: 1069411 - RNA, 22 nt, Human
ugaaagccccaccucuccuuuc

SEQ ID NO: 1069412 - RNA, 19 nt, Human
ugacuuccuaaagaggcga

SEQ ID NO: 1069413 - RNA, 19 nt, Human
uggagaguccccccacagg

SEQ ID NO: 1069414 - RNA, 20 nt, Human
uguggggguggaugagacuu

SEQ ID NO: 1069415 - RNA, 22 nt, Human
uucugcagucuuuuucucaaga

SEQ ID NO: 1069416 - RNA, 22 nt, Human
aacaccuccagcacagauucua

SEQ ID NO: 1069417 - RNA, 19 nt, Human
acccuuggggguccugggg

SEQ ID NO: 1069418 - RNA, 19 nt, Human
caaagcguggccccgugcc

SEQ ID NO: 1069419 - RNA, 20 nt, Human
cagaagaugcucaguuugac

SEQ ID NO: 1069420 - RNA, 18 nt, Human
ccauggagggcauggagc

SEQ ID NO: 1069421 - RNA, 22 nt, Human
cccggugcgcccggcgcucuuc

SEQ ID NO: 1069422 - RNA, 19 nt, Human
cccuuggggguccuggggg

SEQ ID NO: 1069423 - RNA, 21 nt, Human
ccuccagcacagauucuagcc

SEQ ID NO: 1069424 - RNA, 19 nt, Human
cgagauguccacacuccuc

SEQ ID NO: 1069425 - RNA, 19 nt, Human
cuccaggucuuucuucagc

SEQ ID NO: 1069426 - RNA, 23 nt, Human
cucuagcaugcuccugcuccggc

SEQ ID NO: 1069427 - RNA, 18 nt, Human
cugugugguuggccuggg

SEQ ID NO: 1069428 - RNA, 20 nt, Human
gacucgcucugcuggugugu

SEQ ID NO: 1069429 - RNA, 22 nt, Human
gagaaucccccagcgagauguc

SEQ ID NO: 1069430 - RNA, 19 nt, Human
gccacacggugccaucccg

SEQ ID NO: 1069431 - RNA, 19 nt, Human
ggagauggaggcacagaga

SEQ ID NO: 1069432 - RNA, 18 nt, Human
gggugggaagacccuugg

SEQ ID NO: 1069433 - RNA, 23 nt, Human
ggugggaagacccuugggggucc

SEQ ID NO: 1069434 - RNA, 23 nt, Human
guccgguggcuucacugugacuc

SEQ ID NO: 1069435 - RNA, 21 nt, Human
gugcaacaccuccagcacaga

SEQ ID NO: 1069436 - RNA, 24 nt, Human
guggccgccggggugggaagaccc

SEQ ID NO: 1069437 - RNA, 21 nt, Human
guguguggccgccgggguggg

SEQ ID NO: 1069438 - RNA, 23 nt, Human
uagcaugcuccugcuccggcccu

SEQ ID NO: 1069439 - RNA, 20 nt, Human
ucagcuggagguagguauca

SEQ ID NO: 1069440 - RNA, 19 nt, Human
ucauguaacccauggaggg

SEQ ID NO: 1069441 - RNA, 22 nt, Human
uccuggaggacccugucuuguu

SEQ ID NO: 1069442 - RNA, 26 nt, Human
uccugggggagggauguccgagggag

SEQ ID NO: 1069443 - RNA, 22 nt, Human
ucgcucugcugguguguguggc

SEQ ID NO: 1069444 - RNA, 23 nt, Human
ucucucguauguccgggucccac

SEQ ID NO: 1069445 - RNA, 19 nt, Human
ucugugugguuggccuggg

SEQ ID NO: 1069446 - RNA, 22 nt, Human
ugcuccggcccuggucggugaa

SEQ ID NO: 1069447 - RNA, 20 nt, Human
uggaggcacagagauggagc

SEQ ID NO: 1069448 - RNA, 23 nt, Human
ugggaagacccuuggggguccug

SEQ ID NO: 1069449 - RNA, 20 nt, Human
uggggagccaaggcagaugg

SEQ ID NO: 1069450 - RNA, 22 nt, Human
uggggagccaaggcagaugggc

SEQ ID NO: 1069451 - RNA, 18 nt, Human
ugggucauguaacccaug

SEQ ID NO: 1069452 - RNA, 22 nt, Human
uguaacccauggagggcaugga

SEQ ID NO: 1069453 - RNA, 21 nt, Human
uucacagaagaugcucaguuu

SEQ ID NO: 1069454 - RNA, 20 nt, Human
uuccaaguccuggaggaccc

SEQ ID NO: 1069455 - RNA, 19 nt, Human
uucugcaaagcguggcccc

SEQ ID NO: 1069456 - RNA, 20 nt, Human
uuggggguccugggggaggg

SEQ ID NO: 1069457 - RNA, 22 nt, Human
accggcuaaugauauucuugga

SEQ ID NO: 1069458 - RNA, 18 nt, Human
aggcuuuauagugggacc

SEQ ID NO: 1069459 - RNA, 20 nt, Human
auucaucuguccauugcugg

SEQ ID NO: 1069460 - RNA, 18 nt, Human
cacugacagaccgccccg

SEQ ID NO: 1069461 - RNA, 21 nt, Human
ccacugguucaaacugcuuuu

SEQ ID NO: 1069462 - RNA, 22 nt, Human
ccaguagggaagggaagccuuu

SEQ ID NO: 1069463 - RNA, 19 nt, Human
cccaagcugcucacugguc

SEQ ID NO: 1069464 - RNA, 19 nt, Human
cccaggucccaagcugcuc

SEQ ID NO: 1069465 - RNA, 22 nt, Human
ccucuucauauucucgcugccu

SEQ ID NO: 1069466 - RNA, 23 nt, Human
cugaguaaaucagugaaguucau

SEQ ID NO: 1069467 - RNA, 22 nt, Human
gccacugacagaccgccccggg

SEQ ID NO: 1069468 - RNA, 25 nt, Human
gcuggaauugagccacuuauggauc

SEQ ID NO: 1069469 - RNA, 26 nt, Human
gucguauucaucaucaucgucaucuu

SEQ ID NO: 1069470 - RNA, 19 nt, Human
gugaaguucauggguggug

SEQ ID NO: 1069471 - RNA, 18 nt, Human
uaccuugauuuccacugg

SEQ ID NO: 1069472 - RNA, 22 nt, Human
ucauauucucgcugccuuuugu

SEQ ID NO: 1069473 - RNA, 23 nt, Human
ucaugggugguggggcacuuuua

SEQ ID NO: 1069474 - RNA, 19 nt, Human
ucccagggccacugacaga

SEQ ID NO: 1069475 - RNA, 21 nt, Human
ucccagggccacugacagacc

SEQ ID NO: 1069476 - RNA, 20 nt, Human
uccucuucauauucucgcug

SEQ ID NO: 1069477 - RNA, 21 nt, Human
ucgcugccuuuuguaaccagu

SEQ ID NO: 1069478 - RNA, 22 nt, Human
ucggagacaacagugcacuuag

SEQ ID NO: 1069479 - RNA, 22 nt, Human
ucuguagccagauaggggaggc

SEQ ID NO: 1069480 - RNA, 22 nt, Human
uggauauuucuuccugaggcuc

SEQ ID NO: 1069481 - RNA, 18 nt, Human
uggaucucccagggccac

SEQ ID NO: 1069482 - RNA, 21 nt, Human
uuccauuucagagucguauuc

SEQ ID NO: 1069483 - RNA, 19 nt, Human
uucugcggucauaggucgc

SEQ ID NO: 1069484 - RNA, 25 nt, Human
uugaggaccuugggcagcucuguag

SEQ ID NO: 1069485 - RNA, 22 nt, Human
uugcuggaccggcuaaugauau

SEQ ID NO: 1069486 - RNA, 21 nt, Human
aacaaacaccagagagcaaac

SEQ ID NO: 1069487 - RNA, 23 nt, Human
aacaaacaccagagagcaaacug

SEQ ID NO: 1069488 - RNA, 19 nt, Human
cagccuccugaugccuggg

SEQ ID NO: 1069489 - RNA, 22 nt, Human
caggccaagaaacuccacauca

SEQ ID NO: 1069490 - RNA, 22 nt, Human
ccuacacugggccaugcagagg

SEQ ID NO: 1069491 - RNA, 23 nt, Human
ccugaugccugggcuuggcugga

SEQ ID NO: 1069492 - RNA, 23 nt, Human
gaaacuccacaucauaacagccu

SEQ ID NO: 1069493 - RNA, 19 nt, Human
gccuccugaugccugggcu

SEQ ID NO: 1069494 - RNA, 18 nt, Human
uaacagccuccugaugcc

SEQ ID NO: 1069495 - RNA, 24 nt, Human
uacauuaacaaacaccagagagca

SEQ ID NO: 1069496 - RNA, 21 nt, Human
uacauuaacaaacaccagagg

SEQ ID NO: 1069497 - RNA, 24 nt, Human
uacguuuauugccccaucccuuca

SEQ ID NO: 1069498 - RNA, 22 nt, Human
uuaacaaacaccagagagcaaa

SEQ ID NO: 1069499 - RNA, 24 nt, Human
uuccuacacugggccaugcagagg

SEQ ID NO: 1069500 - RNA, 18 nt, Human
aagaagcugagcaccauc

SEQ ID NO: 1069501 - RNA, 21 nt, Human
aagagggaaaagaaacggagg

SEQ ID NO: 1069502 - RNA, 20 nt, Human
acaaggauagaagagggaaa

SEQ ID NO: 1069503 - RNA, 19 nt, Human
agagggaaaagaaacggag

SEQ ID NO: 1069504 - RNA, 22 nt, Human
agagggaaaagaaacggaggcu

SEQ ID NO: 1069505 - RNA, 24 nt, Human
aggacagaaacauauagcagagaa

SEQ ID NO: 1069506 - RNA, 24 nt, Human
aggacagaaacauauagcagagaa

SEQ ID NO: 1069507 - RNA, 21 nt, Human
aggauagaagagggaaaagaa

SEQ ID NO: 1069508 - RNA, 25 nt, Human
aggggaaguggguggggggguguca

SEQ ID NO: 1069509 - RNA, 22 nt, Human
aguaacaaggauagaagaggga

SEQ ID NO: 1069510 - RNA, 24 nt, Human
aguaacaaggauagaagagggaaa

SEQ ID NO: 1069511 - RNA, 23 nt, Human
aguguaggagggacaaggaggaa

SEQ ID NO: 1069512 - RNA, 20 nt, Human
auagaagagggaaaagaaac

SEQ ID NO: 1069513 - RNA, 20 nt, Human
augggaccugagcuuugggc

SEQ ID NO: 1069514 - RNA, 19 nt, Human
augggcagcagaagaugga

SEQ ID NO: 1069515 - RNA, 23 nt, Human
auucuugagaccccaaacuccga

SEQ ID NO: 1069516 - RNA, 18 nt, Human
caccccucagcagcuccc

SEQ ID NO: 1069517 - RNA, 23 nt, Human
cagcagaagauggaguuguccca

SEQ ID NO: 1069518 - RNA, 20 nt, Human
caggacagaaacauauagca

SEQ ID NO: 1069519 - RNA, 19 nt, Human
cagucuucccaacuagggg

SEQ ID NO: 1069520 - RNA, 23 nt, Human
ccacaccucuucauguccccacc

SEQ ID NO: 1069521 - RNA, 24 nt, Human
ccacucucauccagucuucccaac

SEQ ID NO: 1069522 - RNA, 23 nt, Human
ccagccccaggaggagagagggg

SEQ ID NO: 1069523 - RNA, 18 nt, Human
cccacacgaacuugcaaa

SEQ ID NO: 1069524 - RNA, 21 nt, Human
cccaggcuggcacugcagcca

SEQ ID NO: 1069525 - RNA, 18 nt, Human
ccccagccccaggaggag

SEQ ID NO: 1069526 - RNA, 19 nt, Human
ccccucagcagcucccuga

SEQ ID NO: 1069527 - RNA, 24 nt, Human
ccccucagcagcucccugaggccc

SEQ ID NO: 1069528 - RNA, 19 nt, Human
ccugauaggguagaggugg

SEQ ID NO: 1069529 - RNA, 22 nt, Human
ccugcagguccccaggaucugg

SEQ ID NO: 1069530 - RNA, 26 nt, Human
ccuggacccacaccucuucauguccc

SEQ ID NO: 1069531 - RNA, 24 nt, Human
ccuuccagggggguuuugaaaguc

SEQ ID NO: 1069532 - RNA, 20 nt, Human
cggccaggacgcgcccacgg

SEQ ID NO: 1069533 - RNA, 20 nt, Human
cugaaccacgaguucugcua

SEQ ID NO: 1069534 - RNA, 20 nt, Human
cuuagagacugagauuguuc

SEQ ID NO: 1069535 - RNA, 23 nt, Human
cuugagaccccaaacuccgagac

SEQ ID NO: 1069536 - RNA, 19 nt, Human
gaagagggaaaagaaacgg

SEQ ID NO: 1069537 - RNA, 19 nt, Human
gacauaggcagacuaggag

SEQ ID NO: 1069538 - RNA, 24 nt, Human
gagaccccaaacuccgagaccaag

SEQ ID NO: 1069539 - RNA, 21 nt, Human
gagccaggcucagcaccccuc

SEQ ID NO: 1069540 - RNA, 18 nt, Human
gauucucccguuucccuc

SEQ ID NO: 1069541 - RNA, 20 nt, Human
gcaggacagaaacauauagc

SEQ ID NO: 1069542 - RNA, 23 nt, Human
gccccuuccuuuggcaugguuca

SEQ ID NO: 1069543 - RNA, 22 nt, Human
gcggcggcggcggcggcuggca

SEQ ID NO: 1069544 - RNA, 25 nt, Human
gcggcggcggcggcggcuggcaccc

SEQ ID NO: 1069545 - RNA, 19 nt, Human
gcucucagcauuguccuga

SEQ ID NO: 1069546 - RNA, 23 nt, Human
ggacagaaacauauagcagagaa

SEQ ID NO: 1069547 - RNA, 21 nt, Human
ggagauccuuuuccagccucc

SEQ ID NO: 1069548 - RNA, 19 nt, Human
ggagcccccuccucuugcu

SEQ ID NO: 1069549 - RNA, 18 nt, Human
ggaggagagaggggugac

SEQ ID NO: 1069550 - RNA, 22 nt, Human
ggccagguaagccggcgacgau

SEQ ID NO: 1069551 - RNA, 18 nt, Human
ggcggcggcggcggcggc

SEQ ID NO: 1069552 - RNA, 18 nt, Human
gggaaguggguggggggg

SEQ ID NO: 1069553 - RNA, 18 nt, Human
gggaccugagcuuugggc

SEQ ID NO: 1069554 - RNA, 19 nt, Human
ggggaaguggguggggggg

SEQ ID NO: 1069555 - RNA, 24 nt, Human
gggggguuuugaaaguccugauag

SEQ ID NO: 1069556 - RNA, 22 nt, Human
uacaaagcccggagggacggac

SEQ ID NO: 1069557 - RNA, 23 nt, Human
uacacacacacacagagaagcug

SEQ ID NO: 1069558 - RNA, 21 nt, Human
ucagcaccccucagcagcucc

SEQ ID NO: 1069559 - RNA, 23 nt, Human
ucagcagcucccugaggcccucu

SEQ ID NO: 1069560 - RNA, 20 nt, Human
ucauuggagcccccuccucu

SEQ ID NO: 1069561 - RNA, 23 nt, Human
uccacucucauccagucuuccca

SEQ ID NO: 1069562 - RNA, 19 nt, Human
ucccauccuugcuccccuu

SEQ ID NO: 1069563 - RNA, 20 nt, Human
uccccaggaucugggcccca

SEQ ID NO: 1069564 - RNA, 23 nt, Human
uccucaggcaguaccugcugccc

SEQ ID NO: 1069565 - RNA, 23 nt, Human
uccuuuggcaugguucacccuag

SEQ ID NO: 1069566 - RNA, 21 nt, Human
uccuuuuccagccuccccaca

SEQ ID NO: 1069567 - RNA, 21 nt, Human
ucugggccccagccccaggag

SEQ ID NO: 1069568 - RNA, 22 nt, Human
ugagaccccaaacuccgagacc

SEQ ID NO: 1069569 - RNA, 21 nt, Human
ugcagaugaaaaaggggagga

SEQ ID NO: 1069570 - RNA, 18 nt, Human
ugcccgagagagagaugg

SEQ ID NO: 1069571 - RNA, 24 nt, Human
ugggggggugucaagaagcugagc

SEQ ID NO: 1069572 - RNA, 21 nt, Human
ugggugaacccagcacugcca

SEQ ID NO: 1069573 - RNA, 19 nt, Human
ugguucacccuagcccugg

SEQ ID NO: 1069574 - RNA, 20 nt, Human
ugugaaaggggcuccugggu

SEQ ID NO: 1069575 - RNA, 22 nt, Human
ugugaaaggggcuccugggucu

SEQ ID NO: 1069576 - RNA, 22 nt, Human
uuuccagccuccccacacgaac

SEQ ID NO: 1069577 - RNA, 19 nt, Human
aaagcuggaugggucuggg

SEQ ID NO: 1069578 - RNA, 19 nt, Human
acagagcagagagcuugag

SEQ ID NO: 1069579 - RNA, 21 nt, Human
acaggcaccucaaaugcagga

SEQ ID NO: 1069580 - RNA, 22 nt, Human
agagagcuugagacccauuugu

SEQ ID NO: 1069581 - RNA, 21 nt, Human
agcugggcugcucuggaagcc

SEQ ID NO: 1069582 - RNA, 20 nt, Human
aggaggcaggcagcagcagg

SEQ ID NO: 1069583 - RNA, 25 nt, Human
aggcagcuccaggguuuggcugccu

SEQ ID NO: 1069584 - RNA, 20 nt, Human
aggcaggaugaauuuguggg

SEQ ID NO: 1069585 - RNA, 23 nt, Human
aggcaggcagcagcagggccaag

SEQ ID NO: 1069586 - RNA, 24 nt, Human
aggcaggcagcagcagggccaagg

SEQ ID NO: 1069587 - RNA, 23 nt, Human
aggcuugaggcaggaugaauuug

SEQ ID NO: 1069588 - RNA, 23 nt, Human
aggcuugaggcaggaugaauuug

SEQ ID NO: 1069589 - RNA, 25 nt, Human
caccggugcccagccuggagucccc

SEQ ID NO: 1069590 - RNA, 20 nt, Human
cacggugcccguagcaggau

SEQ ID NO: 1069591 - RNA, 18 nt, Human
cagaagcagccaccgggc

SEQ ID NO: 1069592 - RNA, 24 nt, Human
cagagcagagagcuugagacccau

SEQ ID NO: 1069593 - RNA, 22 nt, Human
caggauucaccucuugugcucc

SEQ ID NO: 1069594 - RNA, 22 nt, Human
cagggccaaggcuguggggagg

SEQ ID NO: 1069595 - RNA, 22 nt, Human
caggguggacagagcagagagc

SEQ ID NO: 1069596 - RNA, 21 nt, Human
cccacaccuggaaacggaggc

SEQ ID NO: 1069597 - RNA, 21 nt, Human
ccccuuuccuccugggccuuc

SEQ ID NO: 1069598 - RNA, 23 nt, Human
ccguagcaggauucaccucuugu

SEQ ID NO: 1069599 - RNA, 21 nt, Human
ccugcgagcuucugauaccac

SEQ ID NO: 1069600 - RNA, 21 nt, Human
ccugggccacggcacuccagg

SEQ ID NO: 1069601 - RNA, 21 nt, Human
cggcacuccaggcccacaccu

SEQ ID NO: 1069602 - RNA, 18 nt, Human
cggccaagcugggcugcu

SEQ ID NO: 1069603 - RNA, 20 nt, Human
cuccugggccuucuaaggca

SEQ ID NO: 1069604 - RNA, 23 nt, Human
cucuuugcugcggucgcguagac

SEQ ID NO: 1069605 - RNA, 20 nt, Human
cugauaccaccugggccacg

SEQ ID NO: 1069606 - RNA, 18 nt, Human
cuggaugggucugggcuc

SEQ ID NO: 1069607 - RNA, 21 nt, Human
cuggcagccugggaguccguu

SEQ ID NO: 1069608 - RNA, 18 nt, Human
cugggcugcucuggaagc

SEQ ID NO: 1069609 - RNA, 21 nt, Human
gaagccuguggaccaccggug

SEQ ID NO: 1069610 - RNA, 20 nt, Human
gcagcagcagggccaaggcu

SEQ ID NO: 1069611 - RNA, 18 nt, Human
gcaggaugaauuuguggg

SEQ ID NO: 1069612 - RNA, 18 nt, Human
ggagacugaggcuugagg

SEQ ID NO: 1069613 - RNA, 18 nt, Human
ggcagugguugagcagcu

SEQ ID NO: 1069614 - RNA, 25 nt, Human
ggcuugaggcaggaugaauuugugg

SEQ ID NO: 1069615 - RNA, 25 nt, Human
gggaaagcuggauggguuggacguc

SEQ ID NO: 1069616 - RNA, 26 nt, Human
gggcagugguugagcagcucuguccg

SEQ ID NO: 1069617 - RNA, 19 nt, Human
gggcccgaggcagcuccag

SEQ ID NO: 1069618 - RNA, 20 nt, Human
ggggacccugggcuccagug

SEQ ID NO: 1069619 - RNA, 22 nt, Human
ggucugggcuccccccaugagg

SEQ ID NO: 1069620 - RNA, 19 nt, Human
ucugggcuccccccaugag

SEQ ID NO: 1069621 - RNA, 23 nt, Human
ugacuuugacguaugaggccuuu

SEQ ID NO: 1069622 - RNA, 22 nt, Human
ugaggggaaagcuggauggguc

SEQ ID NO: 1069623 - RNA, 23 nt, Human
ugcguccucguuagcucccagug

SEQ ID NO: 1069624 - RNA, 18 nt, Human
uggaggaggcaggcagca

SEQ ID NO: 1069625 - RNA, 23 nt, Human
ugggcuccccccaugagggugcg

SEQ ID NO: 1069626 - RNA, 18 nt, Human
uggggagggugcgggggg

SEQ ID NO: 1069627 - RNA, 21 nt, Human
uugaggggaaagcuggauggg

SEQ ID NO: 1069628 - RNA, 19 nt, Human
acccagaagccucaggccu

SEQ ID NO: 1069629 - RNA, 21 nt, Human
caccaggacccagaagccuca

SEQ ID NO: 1069630 - RNA, 19 nt, Human
cccagaagccucaggccuc

SEQ ID NO: 1069631 - RNA, 20 nt, Human
cccagaagccucaggccucu

SEQ ID NO: 1069632 - RNA, 25 nt, Human
ccccccacugaagacauuggggacc

SEQ ID NO: 1069633 - RNA, 21 nt, Human
cccgucaccaggacccagaag

SEQ ID NO: 1069634 - RNA, 22 nt, Human
cccgucaccaggacccagaagc

SEQ ID NO: 1069635 - RNA, 18 nt, Human
gacccagaagccucaggc

SEQ ID NO: 1069636 - RNA, 18 nt, Human
ucaggccucuagacugcu

SEQ ID NO: 1069637 - RNA, 21 nt, Human
caaguagagauuugccagaag

SEQ ID NO: 1069638 - RNA, 24 nt, Human
aaaaaaagagaauauacuguaugc

SEQ ID NO: 1069639 - RNA, 21 nt, Human
aaugguucccacaacgauuuu

SEQ ID NO: 1069640 - RNA, 22 nt, Human
agaacccaauugugggggcugc

SEQ ID NO: 1069641 - RNA, 19 nt, Human
agagaauauacuguaugcc

SEQ ID NO: 1069642 - RNA, 20 nt, Human
aguuagauaaagaggaagaa

SEQ ID NO: 1069643 - RNA, 20 nt, Human
caccaaaaugcaguucuaag

SEQ ID NO: 1069644 - RNA, 26 nt, Human
cagucagaaauaaagaaaaaaagaga

SEQ ID NO: 1069645 - RNA, 21 nt, Human
caguccaucaggaaaagaaau

SEQ ID NO: 1069646 - RNA, 19 nt, Human
caguucuaagugcaguccu

SEQ ID NO: 1069647 - RNA, 20 nt, Human
cauucagacaugucugccau

SEQ ID NO: 1069648 - RNA, 18 nt, Human
cuucauucagacaugucu

SEQ ID NO: 1069649 - RNA, 25 nt, Human
gaaaagaaaucccccgcuggcugga

SEQ ID NO: 1069650 - RNA, 23 nt, Human
gugacagucagaaauaaagaaaa

SEQ ID NO: 1069651 - RNA, 21 nt, Human
uaaaauagagccuauuugucc

SEQ ID NO: 1069652 - RNA, 18 nt, Human
uacaguccaucaggaaaa

SEQ ID NO: 1069653 - RNA, 21 nt, Human
uaguuagauaaagaggaagaa

SEQ ID NO: 1069654 - RNA, 23 nt, Human
ucaagauauaaaauagagccuau

SEQ ID NO: 1069655 - RNA, 21 nt, Human
ucagaggucaccaaaaugcag

SEQ ID NO: 1069656 - RNA, 26 nt, Human
uccaaaaauaauuuuguuaaguucac

SEQ ID NO: 1069657 - RNA, 22 nt, Human
uccaaguuuuuugcaugaagca

SEQ ID NO: 1069658 - RNA, 21 nt, Human
ucuccuucagagaaaacugag

SEQ ID NO: 1069659 - RNA, 24 nt, Human
ucucuucuguguccuuuuauaaga

SEQ ID NO: 1069660 - RNA, 19 nt, Human
ugcuuaagcaaaugugaga

SEQ ID NO: 1069661 - RNA, 22 nt, Human
ugguuuaaagucaauagggggc

SEQ ID NO: 1069662 - RNA, 23 nt, Human
uguaauauaguuagauaaagagg

SEQ ID NO: 1069663 - RNA, 22 nt, Human
ugucucuucuguguccuuuuau

SEQ ID NO: 1069664 - RNA, 26 nt, Human
uucaccucaacgucagaagcucauuc

SEQ ID NO: 1069665 - RNA, 20 nt, Human
aaagagggcuuucugugaua

SEQ ID NO: 1069666 - RNA, 18 nt, Human
accauauuuaauagaaac

SEQ ID NO: 1069667 - RNA, 26 nt, Human
agaaggagcaauuaaggauucagagg

SEQ ID NO: 1069668 - RNA, 18 nt, Human
agacaaauuagcccacag

SEQ ID NO: 1069669 - RNA, 18 nt, Human
agaggaggugagaaggag

SEQ ID NO: 1069670 - RNA, 24 nt, Human
aucaacaaagcucaugguucuacc

SEQ ID NO: 1069671 - RNA, 22 nt, Human
augagagacaaauuagcccaca

SEQ ID NO: 1069672 - RNA, 18 nt, Human
auucugucuccucuuucc

SEQ ID NO: 1069673 - RNA, 22 nt, Human
cauucugucuccucuuuccaau

SEQ ID NO: 1069674 - RNA, 25 nt, Human
ccaaaaugagagacaaauuagccca

SEQ ID NO: 1069675 - RNA, 24 nt, Human
ccaagaagaaagagucccuccucu

SEQ ID NO: 1069676 - RNA, 23 nt, Human
cugcucagaagugacuacagcaa

SEQ ID NO: 1069677 - RNA, 20 nt, Human
gaaagagucccuccucucca

SEQ ID NO: 1069678 - RNA, 20 nt, Human
gaaggagcaauuaaggaugg

SEQ ID NO: 1069679 - RNA, 25 nt, Human
gcuguguuucuccucauguuugucg

SEQ ID NO: 1069680 - RNA, 21 nt, Human
gguaaagagauugcagugacu

SEQ ID NO: 1069681 - RNA, 18 nt, Human
uacgaagggcccaaaaug

SEQ ID NO: 1069682 - RNA, 19 nt, Human
uagcccacagaaaagagag

SEQ ID NO: 1069683 - RNA, 22 nt, Human
uagcccacagaaaagagaguuu

SEQ ID NO: 1069684 - RNA, 22 nt, Human
uccuccuuaacacauccaagaa

SEQ ID NO: 1069685 - RNA, 21 nt, Human
uccucuccaucuaucuuguca

SEQ ID NO: 1069686 - RNA, 25 nt, Human
ucugugauaaacagguucccagagc

SEQ ID NO: 1069687 - RNA, 19 nt, Human
ugaaaaagagggcuuucug

SEQ ID NO: 1069688 - RNA, 21 nt, Human
ugaagacaauaaaguaucauu

SEQ ID NO: 1069689 - RNA, 25 nt, Human
ugagaaggagcaauuaaggauggug

SEQ ID NO: 1069690 - RNA, 21 nt, Human
ugaucaacaucaacaaagcuc

SEQ ID NO: 1069691 - RNA, 19 nt, Human
uugcagugacuguccuccu

SEQ ID NO: 1069692 - RNA, 23 nt, Human
uuucugcucagaagugacuacag

SEQ ID NO: 1069693 - RNA, 22 nt, Human
aaaauagaacaacaaugacaaa

SEQ ID NO: 1069694 - RNA, 21 nt, Human
aaacaugguauaguagaugac

SEQ ID NO: 1069695 - RNA, 20 nt, Human
aaaccccagacuaccaggug

SEQ ID NO: 1069696 - RNA, 24 nt, Human
aacaacaaugacaaaugagcagcc

SEQ ID NO: 1069697 - RNA, 25 nt, Human
acaaaauagaacaacaaugacaaau

SEQ ID NO: 1069698 - RNA, 22 nt, Human
acccuagcaacucuucugggca

SEQ ID NO: 1069699 - RNA, 20 nt, Human
agcccaaucaacuucggaaa

SEQ ID NO: 1069700 - RNA, 18 nt, Human
caacaaugacaaaugagc

SEQ ID NO: 1069701 - RNA, 20 nt, Human
cacccuagcaacucuucugg

SEQ ID NO: 1069702 - RNA, 21 nt, Human
cagcccaaucaacuucggaaa

SEQ ID NO: 1069703 - RNA, 21 nt, Human
cucaaaccccagacuaccagg

SEQ ID NO: 1069704 - RNA, 20 nt, Human
gaacaacaaugacaaaugag

SEQ ID NO: 1069705 - RNA, 21 nt, Human
uaagacagacuaaagucaaga

SEQ ID NO: 1069706 - RNA, 18 nt, Human
uacuuagagaguaugggg

SEQ ID NO: 1069707 - RNA, 21 nt, Human
uagcaaaaacauuaacgcaaa

SEQ ID NO: 1069708 - RNA, 19 nt, Human
ucucaggcaccuacccaag

SEQ ID NO: 1069709 - RNA, 20 nt, Human
ucucaggcaccuacccaaga

SEQ ID NO: 1069710 - RNA, 22 nt, Human
ugagggagugacagauugcaga

SEQ ID NO: 1069711 - RNA, 23 nt, Human
ugcacuagauaaucucuaaaucu

SEQ ID NO: 1069712 - RNA, 21 nt, Human
uguaaaaaggguuuuaaucuc

SEQ ID NO: 1069713 - RNA, 23 nt, Human
aaaaggaaacgauucagacgguu

SEQ ID NO: 1069714 - RNA, 22 nt, Human
aacucggcugcacuguccucgg

SEQ ID NO: 1069715 - RNA, 21 nt, Human
acgaaccauccagagcccaga

SEQ ID NO: 1069716 - RNA, 21 nt, Human
agaaaaggaaacgauucagac

SEQ ID NO: 1069717 - RNA, 21 nt, Human
auccaaagaggguaaauugga

SEQ ID NO: 1069718 - RNA, 22 nt, Human
auccaaagaggguaaauuggag

SEQ ID NO: 1069719 - RNA, 23 nt, Human
augcacaguguuagcuaggucau

SEQ ID NO: 1069720 - RNA, 25 nt, Human
caaagaggguaaauuggagaaauca

SEQ ID NO: 1069721 - RNA, 24 nt, Human
caaagcagcuacguccaucuguaa

SEQ ID NO: 1069722 - RNA, 28 nt, Human
caacuuuccuacggaagaaaaggaaacg

SEQ ID NO: 1069723 - RNA, 22 nt, Human
caagacggacuaucaagaccug

SEQ ID NO: 1069724 - RNA, 21 nt, Human
cacaggacaucaaacaauggc

SEQ ID NO: 1069725 - RNA, 18 nt, Human
cacaguguuagcuagguc

SEQ ID NO: 1069726 - RNA, 19 nt, Human
caggcugcgcgaggcuggc

SEQ ID NO: 1069727 - RNA, 18 nt, Human
cauccagagcccagaaag

SEQ ID NO: 1069728 - RNA, 23 nt, Human
caucuucuaaaaucaacauccaa

SEQ ID NO: 1069729 - RNA, 19 nt, Human
ccgugccgaccgcggcgcg

SEQ ID NO: 1069730 - RNA, 25 nt, Human
cgcacgaaccauccagagcccagaa

SEQ ID NO: 1069731 - RNA, 25 nt, Human
cgcugcggggcugcugggcugcggg

SEQ ID NO: 1069732 - RNA, 19 nt, Human
cuggcaccauccaaagagg

SEQ ID NO: 1069733 - RNA, 21 nt, Human
gaagaaaaggaaacgauucag

SEQ ID NO: 1069734 - RNA, 19 nt, Human
gacacuguaaacagcaguu

SEQ ID NO: 1069735 - RNA, 21 nt, Human
gaccugagccgaccugacuua

SEQ ID NO: 1069736 - RNA, 18 nt, Human
gagacggcgcuggcagcu

SEQ ID NO: 1069737 - RNA, 18 nt, Human
gcacgaaccauccagagc

SEQ ID NO: 1069738 - RNA, 21 nt, Human
gcaggcugcgcgaggcuggca

SEQ ID NO: 1069739 - RNA, 20 nt, Human
ggcggccgcgggagacggcg

SEQ ID NO: 1069740 - RNA, 24 nt, Human
ggcugcggggcugaggagcugcgg

SEQ ID NO: 1069741 - RNA, 20 nt, Human
gggcggcggcggccgcggga

SEQ ID NO: 1069742 - RNA, 19 nt, Human
uaaagccugguuucucagu

SEQ ID NO: 1069743 - RNA, 24 nt, Human
uaaaugacaaacacuagugcuuua

SEQ ID NO: 1069744 - RNA, 19 nt, Human
uaaauuggagaaaucacac

SEQ ID NO: 1069745 - RNA, 22 nt, Human
uacggaagaaaaggaaacgauu

SEQ ID NO: 1069746 - RNA, 22 nt, Human
ucaagaccugagccgaccugac

SEQ ID NO: 1069747 - RNA, 23 nt, Human
ucaagaccugagccgaccugacu

SEQ ID NO: 1069748 - RNA, 23 nt, Human
ucagcgcaggcugcgcgaggcug

SEQ ID NO: 1069749 - RNA, 20 nt, Human
uccaaagaggguaaauugga

SEQ ID NO: 1069750 - RNA, 20 nt, Human
uccaaagaggguaaauugga

SEQ ID NO: 1069751 - RNA, 22 nt, Human
uccaccuggcaccauccaaaga

SEQ ID NO: 1069752 - RNA, 23 nt, Human
ucuaaaaucaacauccaaucccc

SEQ ID NO: 1069753 - RNA, 18 nt, Human
ugauacaauacaauguuu

SEQ ID NO: 1069754 - RNA, 24 nt, Human
ugcacaguguuagcuaggucaucg

SEQ ID NO: 1069755 - RNA, 18 nt, Human
ugcugggcugcggggcug

SEQ ID NO: 1069756 - RNA, 20 nt, Human
uggcaccauccaaagagggu

SEQ ID NO: 1069757 - RNA, 20 nt, Human
uggcagcugggcugcaggcg

SEQ ID NO: 1069758 - RNA, 24 nt, Human
uggcuaaguuuuaaacaaaugcuc

SEQ ID NO: 1069759 - RNA, 21 nt, Human
uggcuggaguucuccaucuuc

SEQ ID NO: 1069760 - RNA, 18 nt, Human
ugggcaaagaaagcacuu

SEQ ID NO: 1069761 - RNA, 21 nt, Human
uguccucggcgccgcugcggg

SEQ ID NO: 1069762 - RNA, 20 nt, Human
uuaaagccugguuucucagu

SEQ ID NO: 1069763 - RNA, 27 nt, Human
ucuguggcucagacaugaccggggucc

SEQ ID NO: 1069764 - RNA, 19 nt, Human
aguaaauuggacaggcaca

SEQ ID NO: 1069765 - RNA, 19 nt, Human
ccgugcugccucuucucac

SEQ ID NO: 1069766 - RNA, 23 nt, Human
ccuccgcgggagcuggagcacuc

SEQ ID NO: 1069767 - RNA, 19 nt, Human
ccuccuccgcgggagcugg

SEQ ID NO: 1069768 - RNA, 21 nt, Human
ccugccagggggcgagucccg

SEQ ID NO: 1069769 - RNA, 21 nt, Human
ccuggagcugcagggucccua

SEQ ID NO: 1069770 - RNA, 21 nt, Human
ggcgagucccgcgcucccugc

SEQ ID NO: 1069771 - RNA, 28 nt, Human
gggagcagcagagagcaaaccgguaccc

SEQ ID NO: 1069772 - RNA, 21 nt, Human
gguaguaaauuggacaggcac

SEQ ID NO: 1069773 - RNA, 21 nt, Human
gugcugccucuucucacgggc

SEQ ID NO: 1069774 - RNA, 21 nt, Human
uaaauuggacaggcacauuua

SEQ ID NO: 1069775 - RNA, 25 nt, Human
uaaauuggacaggcacauuuaaaua

SEQ ID NO: 1069776 - RNA, 21 nt, Human
uaauuugacaaguucaacucc

SEQ ID NO: 1069777 - RNA, 22 nt, Human
uaucccggggcgccgcccgcag

SEQ ID NO: 1069778 - RNA, 18 nt, Human
ugccagggggcgaguccc

SEQ ID NO: 1069779 - RNA, 19 nt, Human
uggacaggcacauuuaaau

SEQ ID NO: 1069780 - RNA, 22 nt, Human
uucauuaucucuuagguaguaa

SEQ ID NO: 1069781 - RNA, 22 nt, Human
aaauggaaauuuuaagccaagc

SEQ ID NO: 1069782 - RNA, 23 nt, Human
aauguaaagaaucgaaaauuuua

SEQ ID NO: 1069783 - RNA, 23 nt, Human
acucuucaucagaggacauuaau

SEQ ID NO: 1069784 - RNA, 21 nt, Human
acuuaaaaagacauugaagua

SEQ ID NO: 1069785 - RNA, 21 nt, Human
acuuggggaaaggaaauacua

SEQ ID NO: 1069786 - RNA, 23 nt, Human
agacacaaaauggaaauuuuaag

SEQ ID NO: 1069787 - RNA, 24 nt, Human
auaaaucuaucccuuggguuuuuu

SEQ ID NO: 1069788 - RNA, 19 nt, Human
aucacaauagguuuaccug

SEQ ID NO: 1069789 - RNA, 19 nt, Human
auuaagguguuuuaacuuu

SEQ ID NO: 1069790 - RNA, 22 nt, Human
auugacuuauuucauauaguca

SEQ ID NO: 1069791 - RNA, 21 nt, Human
caccauauuaaucuacagaau

SEQ ID NO: 1069792 - RNA, 20 nt, Human
cacccauuucaggaaggccc

SEQ ID NO: 1069793 - RNA, 19 nt, Human
ggaggccaccgggcucggg

SEQ ID NO: 1069794 - RNA, 19 nt, Human
gggcucgggccaccggcag

SEQ ID NO: 1069795 - RNA, 19 nt, Human
guaaaaaugcacccauuuc

SEQ ID NO: 1069796 - RNA, 24 nt, Human
uaaaugaaaauaaaucuaucccuu

SEQ ID NO: 1069797 - RNA, 26 nt, Human
uaaaugaugugucuugaacccugaag

SEQ ID NO: 1069798 - RNA, 22 nt, Human
uaagccaagccuacuuuucccc

SEQ ID NO: 1069799 - RNA, 18 nt, Human
uagaaaaugaacuacuug

SEQ ID NO: 1069800 - RNA, 18 nt, Human
ucaguggaggacgaaaag

SEQ ID NO: 1069801 - RNA, 19 nt, Human
ucaguggaggacgaaaagc

SEQ ID NO: 1069802 - RNA, 26 nt, Human
ucccucaauguucacuaaauauaguu

SEQ ID NO: 1069803 - RNA, 30 nt, Human
ugauaccccaccauauuaaucuacagaauu

SEQ ID NO: 1069804 - RNA, 21 nt, Human
ugaugugucuugaacgcugcu

SEQ ID NO: 1069805 - RNA, 27 nt, Human
ugcugagauugagaagaccuuagaaac

SEQ ID NO: 1069806 - RNA, 21 nt, Human
uuagcuucauuggggcguauc

SEQ ID NO: 1069807 - RNA, 21 nt, Human
uuauuucauauagucaaaaag

SEQ ID NO: 1069808 - RNA, 20 nt, Human
aaaacucaaguuaauuugcc

SEQ ID NO: 1069809 - RNA, 18 nt, Human
aacaccucccucuaaucu

SEQ ID NO: 1069810 - RNA, 19 nt, Human
aagauccaacaaacugcag

SEQ ID NO: 1069811 - RNA, 18 nt, Human
aagcagaagaggaugucc

SEQ ID NO: 1069812 - RNA, 18 nt, Human
aagcagaagaggaugucc

SEQ ID NO: 1069813 - RNA, 22 nt, Human
aagcagaagaggauguccagga

SEQ ID NO: 1069814 - RNA, 24 nt, Human
aagccauugaagauccaacaaacu

SEQ ID NO: 1069815 - RNA, 20 nt, Human
aaguuaauuugccgcguaga

SEQ ID NO: 1069816 - RNA, 23 nt, Human
aauaucagaacccaagggaggaa

SEQ ID NO: 1069817 - RNA, 23 nt, Human
acaccucccucuaaucucaauuu

SEQ ID NO: 1069818 - RNA, 21 nt, Human
acccuccaauaaugaacaaca

SEQ ID NO: 1069819 - RNA, 23 nt, Human
acugcagccuuggggugcucaug

SEQ ID NO: 1069820 - RNA, 23 nt, Human
aggcauacaacuuuucugagaaa

SEQ ID NO: 1069821 - RNA, 22 nt, Human
agguggcuuucccaugccggga

SEQ ID NO: 1069822 - RNA, 20 nt, Human
caaaucuuuuacucuauaac

SEQ ID NO: 1069823 - RNA, 19 nt, Human
caccuuaaccucuccagca

SEQ ID NO: 1069824 - RNA, 24 nt, Human
caccuuaaccucuccagcaucaaa

SEQ ID NO: 1069825 - RNA, 25 nt, Human
caggcaccacaucauuuacccucca

SEQ ID NO: 1069826 - RNA, 18 nt, Human
caguccuggguucauccu

SEQ ID NO: 1069827 - RNA, 22 nt, Human
ccaucugaaggacagaaauugu

SEQ ID NO: 1069828 - RNA, 21 nt, Human
cccaagggaggaaaagcuggc

SEQ ID NO: 1069829 - RNA, 21 nt, Human
ccugcggucagagcagggguc

SEQ ID NO: 1069830 - RNA, 18 nt, Human
cuccaauaaugaacaagg

SEQ ID NO: 1069831 - RNA, 19 nt, Human
cucuccagcaucaaaucuu

SEQ ID NO: 1069832 - RNA, 21 nt, Human
cugaaaugaagguagguucac

SEQ ID NO: 1069833 - RNA, 21 nt, Human
cuuccacacucauauguaucu

SEQ ID NO: 1069834 - RNA, 20 nt, Human
gaccucaggcaccacaucau

SEQ ID NO: 1069835 - RNA, 19 nt, Human
ggagggagguggaaggagg

SEQ ID NO: 1069836 - RNA, 18 nt, Human
uaaccucucuuuaaacac

SEQ ID NO: 1069837 - RNA, 21 nt, Human
uaaccucucuuuaaacaccuc

SEQ ID NO: 1069838 - RNA, 19 nt, Human
uacccuccaauaaugaaca

SEQ ID NO: 1069839 - RNA, 24 nt, Human
uagcuuuauuaaauaggcauacaa

SEQ ID NO: 1069840 - RNA, 22 nt, Human
uauaaccucucuuuaaacaccu

SEQ ID NO: 1069841 - RNA, 24 nt, Human
uauggaagugaggaaggugcucuu

SEQ ID NO: 1069842 - RNA, 21 nt, Human
ucaggcaccacaucauuuacc

SEQ ID NO: 1069843 - RNA, 20 nt, Human
ucccucuaaucucaauuucc

SEQ ID NO: 1069844 - RNA, 18 nt, Human
ucccugaauucuuauugc

SEQ ID NO: 1069845 - RNA, 26 nt, Human
ucccugaauucuuauugcaccuucua

SEQ ID NO: 1069846 - RNA, 21 nt, Human
ucuagugcggcaauaucagaa

SEQ ID NO: 1069847 - RNA, 22 nt, Human
ucucuccuaagcagaagaggau

SEQ ID NO: 1069848 - RNA, 20 nt, Human
ucugagguuggggcaacugc

SEQ ID NO: 1069849 - RNA, 18 nt, Human
ucuuuaaacaccucccuc

SEQ ID NO: 1069850 - RNA, 22 nt, Human
ugagggagagguggcuuuccca

SEQ ID NO: 1069851 - RNA, 24 nt, Human
ugagggagagguggcuuucccaug

SEQ ID NO: 1069852 - RNA, 20 nt, Human
ugcggucagagcaggggucc

SEQ ID NO: 1069853 - RNA, 18 nt, Human
uggcaaaguugucaugug

SEQ ID NO: 1069854 - RNA, 18 nt, Human
uguccugcggucagagca

SEQ ID NO: 1069855 - RNA, 23 nt, Human
uguccugcggucagagcaggggu

SEQ ID NO: 1069856 - RNA, 23 nt, Human
uuccacacucauauguaucugcu

SEQ ID NO: 1069857 - RNA, 19 nt, Human
uugacucccucuccaauuu

SEQ ID NO: 1069858 - RNA, 26 nt, Human
uugucaugugccaagcggccaauccc

SEQ ID NO: 1069859 - RNA, 19 nt, Human
uuucccaugccgggaggga

SEQ ID NO: 1069860 - RNA, 26 nt, Human
aaaaacuaaacaggcauuuuggacaa

SEQ ID NO: 1069861 - RNA, 28 nt, Human
aaacaggcauuuuggacaacacauucuu

SEQ ID NO: 1069862 - RNA, 21 nt, Human
acuauaaaaaggacagccaga

SEQ ID NO: 1069863 - RNA, 22 nt, Human
agauaguucuggggccucaggg

SEQ ID NO: 1069864 - RNA, 24 nt, Human
aggcauuuuggacaacacauucuu

SEQ ID NO: 1069865 - RNA, 24 nt, Human
auaguucuggggccucagggggcu

SEQ ID NO: 1069866 - RNA, 20 nt, Human
augguagggaaaguucucac

SEQ ID NO: 1069867 - RNA, 21 nt, Human
auucuuggcaauagaaccugg

SEQ ID NO: 1069868 - RNA, 22 nt, Human
ccagauaucaacuguuacagaa

SEQ ID NO: 1069869 - RNA, 20 nt, Human
cccauacauacuuaaaacca

SEQ ID NO: 1069870 - RNA, 19 nt, Human
ccccaccauuuccaugucu

SEQ ID NO: 1069871 - RNA, 23 nt, Human
ccucugcuucaacaaugugcagu

SEQ ID NO: 1069872 - RNA, 27 nt, Human
cucacucugcacuauaaaaaggacaac

SEQ ID NO: 1069873 - RNA, 18 nt, Human
cuuaaagauaacuggucu

SEQ ID NO: 1069874 - RNA, 21 nt, Human
gcacuauaaaaaggacagcca

SEQ ID NO: 1069875 - RNA, 20 nt, Human
gcauuuuggacaacacauuc

SEQ ID NO: 1069876 - RNA, 20 nt, Human
gggccucagggggcucaugu

SEQ ID NO: 1069877 - RNA, 21 nt, Human
uaacuggucucauuuucauca

SEQ ID NO: 1069878 - RNA, 21 nt, Human
uacuuuauuaaaauacugagu

SEQ ID NO: 1069879 - RNA, 19 nt, Human
uacuuuugucuccccacca

SEQ ID NO: 1069880 - RNA, 23 nt, Human
uagaaccuggacaacauuuauca

SEQ ID NO: 1069881 - RNA, 23 nt, Human
uagaaccuggacaacauuuauca

SEQ ID NO: 1069882 - RNA, 21 nt, Human
uagggaaaguucucacucugc

SEQ ID NO: 1069883 - RNA, 24 nt, Human
ucaacaaugugcaguucauccuuu

SEQ ID NO: 1069884 - RNA, 24 nt, Human
ucacguguauacuuuugucucccu

SEQ ID NO: 1069885 - RNA, 21 nt, Human
ucacucugcacuauaaaaagg

SEQ ID NO: 1069886 - RNA, 18 nt, Human
ugaaugcugcuccagaga

SEQ ID NO: 1069887 - RNA, 24 nt, Human
ugcugcuccagagaacagccgcgc

SEQ ID NO: 1069888 - RNA, 23 nt, Human
ugcuucaacaaugugcaguucau

SEQ ID NO: 1069889 - RNA, 25 nt, Human
ugucugaccacugcuacuacuaugu

SEQ ID NO: 1069890 - RNA, 19 nt, Human
ugugcaguucauccuuugc

SEQ ID NO: 1069891 - RNA, 20 nt, Human
uuugucuccccaccauuucc

SEQ ID NO: 1069892 - RNA, 22 nt, Human
aaaacaaaaaugagagauuuau

SEQ ID NO: 1069893 - RNA, 24 nt, Human
aaacaaaaaugagagauuuauaaa

SEQ ID NO: 1069894 - RNA, 21 nt, Human
aaauauauaugccuaaauuuu

SEQ ID NO: 1069895 - RNA, 22 nt, Human
aagaaaccauagcccacugcaa

SEQ ID NO: 1069896 - RNA, 24 nt, Human
aagaaaccauagcccacugcaaac

SEQ ID NO: 1069897 - RNA, 18 nt, Human
acaaaacaaaaaugagag

SEQ ID NO: 1069898 - RNA, 27 nt, Human
agaguaguucuuuacuauuuccaagga

SEQ ID NO: 1069899 - RNA, 22 nt, Human
aggaaagagaaaauccagaugc

SEQ ID NO: 1069900 - RNA, 23 nt, Human
auguacauacacacacauaugua

SEQ ID NO: 1069901 - RNA, 18 nt, Human
caagaaaccauagcccac

SEQ ID NO: 1069902 - RNA, 21 nt, Human
caagaaaccauagcccacugc

SEQ ID NO: 1069903 - RNA, 21 nt, Human
caggugccuguguuacuucug

SEQ ID NO: 1069904 - RNA, 19 nt, Human
cauacacacacauauguac

SEQ ID NO: 1069905 - RNA, 31 nt, Human
cauagacauguacauacacacacauauguag

SEQ ID NO: 1069906 - RNA, 24 nt, Human
ccugucaacuuacaaaacaaaaau

SEQ ID NO: 1069907 - RNA, 19 nt, Human
cuuccacaucuacugugua

SEQ ID NO: 1069908 - RNA, 22 nt, Human
cuuuucuuucuucaacuacugu

SEQ ID NO: 1069909 - RNA, 24 nt, Human
gcccacugcaaacuguucacgaug

SEQ ID NO: 1069910 - RNA, 24 nt, Human
ggauaaauguacaaccguguccuu

SEQ ID NO: 1069911 - RNA, 21 nt, Human
uaaaagguacauauauagcug

SEQ ID NO: 1069912 - RNA, 21 nt, Human
uacauacacacacauauguac

SEQ ID NO: 1069913 - RNA, 21 nt, Human
uacuagauguguuuucaaugg

SEQ ID NO: 1069914 - RNA, 19 nt, Human
uauaaauagauauuuagau

SEQ ID NO: 1069915 - RNA, 23 nt, Human
ucagaugguucaugauuuuuuuc

SEQ ID NO: 1069916 - RNA, 23 nt, Human
uccaaggaaagagaaaauccaga

SEQ ID NO: 1069917 - RNA, 18 nt, Human
ugaaguaccagacacuuu

SEQ ID NO: 1069918 - RNA, 18 nt, Human
ugacaagaaaccauagcc

SEQ ID NO: 1069919 - RNA, 19 nt, Human
uguacaaauauauaugccu

SEQ ID NO: 1069920 - RNA, 20 nt, Human
uguacauacacacacauaug

SEQ ID NO: 1069921 - RNA, 22 nt, Human
aaaaagugaaacagacauagaa

SEQ ID NO: 1069922 - RNA, 21 nt, Human
aaaagugaaacagacauagaa

SEQ ID NO: 1069923 - RNA, 20 nt, Human
aaaugggaagaacaauauua

SEQ ID NO: 1069924 - RNA, 18 nt, Human
aagcagcccuugucccca

SEQ ID NO: 1069925 - RNA, 19 nt, Human
aagcagcccuuguccccaa

SEQ ID NO: 1069926 - RNA, 22 nt, Human
aagcuuuggaaauagcaaaacc

SEQ ID NO: 1069927 - RNA, 23 nt, Human
aauucuuggcuucuucuagagga

SEQ ID NO: 1069928 - RNA, 21 nt, Human
acagagagcaugggggcggag

SEQ ID NO: 1069929 - RNA, 23 nt, Human
acagagagcaugggggcggaggg

SEQ ID NO: 1069930 - RNA, 22 nt, Human
acuccuucugcauccuuccccc

SEQ ID NO: 1069931 - RNA, 21 nt, Human
acugccaauuucccuccaccc

SEQ ID NO: 1069932 - RNA, 26 nt, Human
acuuagugccuggugcacagugggug

SEQ ID NO: 1069933 - RNA, 23 nt, Human
agaaagaggcuagagacuuagug

SEQ ID NO: 1069934 - RNA, 21 nt, Human
agaauggauagggcugggugg

SEQ ID NO: 1069935 - RNA, 23 nt, Human
agacagaagucuugaaggcaugg

SEQ ID NO: 1069936 - RNA, 27 nt, Human
agacagagaaggaacagagauuccugg

SEQ ID NO: 1069937 - RNA, 20 nt, Human
agacaggaaagagcauagau

SEQ ID NO: 1069938 - RNA, 21 nt, Human
agagacuuagugccuggugca

SEQ ID NO: 1069939 - RNA, 26 nt, Human
agagagcuuuggucaaggaagacagg

SEQ ID NO: 1069940 - RNA, 21 nt, Human
agagcaaggacacucaggugc

SEQ ID NO: 1069941 - RNA, 24 nt, Human
agagcuuuggucaaggaagacagg

SEQ ID NO: 1069942 - RNA, 18 nt, Human
agaggcugggccaggaug

SEQ ID NO: 1069943 - RNA, 29 nt, Human
agagggaaggagagaauggauagggccga

SEQ ID NO: 1069944 - RNA, 19 nt, Human
agccagaagcaggggauca

SEQ ID NO: 1069945 - RNA, 19 nt, Human
aggaaagagcauagaugag

SEQ ID NO: 1069946 - RNA, 20 nt, Human
aggaaagagcauagaugaga

SEQ ID NO: 1069947 - RNA, 19 nt, Human
aggaaggaggugggagaaa

SEQ ID NO: 1069948 - RNA, 27 nt, Human
aggaaggaggugggagaaaagauaggg

SEQ ID NO: 1069949 - RNA, 18 nt, Human
aggaggaaggagguggga

SEQ ID NO: 1069950 - RNA, 26 nt, Human
aggauggggccagccccaaacccauc

SEQ ID NO: 1069951 - RNA, 21 nt, Human
aggcacccagcacagcagcug

SEQ ID NO: 1069952 - RNA, 22 nt, Human
aggcauggaggccacagagagc

SEQ ID NO: 1069953 - RNA, 19 nt, Human
aggguaagaagagguuaag

SEQ ID NO: 1069954 - RNA, 21 nt, Human
aggugugugcugggcaagagg

SEQ ID NO: 1069955 - RNA, 19 nt, Human
agugccuggugcacagugg

SEQ ID NO: 1069956 - RNA, 22 nt, Human
aguuuguuggggugagaugggg

SEQ ID NO: 1069957 - RNA, 22 nt, Human
auagcucacugccuugcugccu

SEQ ID NO: 1069958 - RNA, 20 nt, Human
auggaggccacagagagcau

SEQ ID NO: 1069959 - RNA, 21 nt, Human
caaaacgacauugaagcacca

SEQ ID NO: 1069960 - RNA, 23 nt, Human
caaaacgacauugaagcaccauu

SEQ ID NO: 1069961 - RNA, 22 nt, Human
caacaucacagcuuaaagauac

SEQ ID NO: 1069962 - RNA, 21 nt, Human
caaggcacccagcacagcagc

SEQ ID NO: 1069963 - RNA, 21 nt, Human
caauagaggcuagaaauggua

SEQ ID NO: 1069964 - RNA, 22 nt, Human
cacagcagcugguacacaagaa

SEQ ID NO: 1069965 - RNA, 21 nt, Human
cacagcuuaaagauacaaaac

SEQ ID NO: 1069966 - RNA, 24 nt, Human
cagagauguuccuuauacacuguc

SEQ ID NO: 1069967 - RNA, 18 nt, Human
cagccccaaacccaucuc

SEQ ID NO: 1069968 - RNA, 20 nt, Human
cagccccaaacccaucuccu

SEQ ID NO: 1069969 - RNA, 19 nt, Human
cauauggcccagggcagcc

SEQ ID NO: 1069970 - RNA, 21 nt, Human
caugcaaggcacccagcacag

SEQ ID NO: 1069971 - RNA, 22 nt, Human
caugcaaggcacccagcacagc

SEQ ID NO: 1069972 - RNA, 24 nt, Human
ccaaacccaucuccuucugccugg

SEQ ID NO: 1069973 - RNA, 21 nt, Human
ccagccccaaacccaucuccu

SEQ ID NO: 1069974 - RNA, 19 nt, Human
ccaugcugggcucauagcu

SEQ ID NO: 1069975 - RNA, 22 nt, Human
ccccaaacccaucuccuucugc

SEQ ID NO: 1069976 - RNA, 23 nt, Human
ccccaaacccaucuccuucugcc

SEQ ID NO: 1069977 - RNA, 21 nt, Human
ccugagacacauccaugcugg

SEQ ID NO: 1069978 - RNA, 18 nt, Human
ccugaggacuggggagag

SEQ ID NO: 1069979 - RNA, 21 nt, Human
ccuuauacacugucuuucuug

SEQ ID NO: 1069980 - RNA, 19 nt, Human
ccuucugcauccuuccccc

SEQ ID NO: 1069981 - RNA, 21 nt, Human
ccuuuuuugaccucugacucc

SEQ ID NO: 1069982 - RNA, 25 nt, Human
cuggugcccaugguugcaugccuga

SEQ ID NO: 1069983 - RNA, 19 nt, Human
gaaagaggcuagagacuua

SEQ ID NO: 1069984 - RNA, 24 nt, Human
gaaagaggcuagagacuuagugcc

SEQ ID NO: 1069985 - RNA, 18 nt, Human
gaacuggaagcagcccuu

SEQ ID NO: 1069986 - RNA, 19 nt, Human
gagaauggauagggcuggg

SEQ ID NO: 1069987 - RNA, 21 nt, Human
gagaauggauagggcugggug

SEQ ID NO: 1069988 - RNA, 18 nt, Human
gagaugggugauggaugg

SEQ ID NO: 1069989 - RNA, 20 nt, Human
gagcaugggggcggaggggg

SEQ ID NO: 1069990 - RNA, 20 nt, Human
gagcaugggggcggaggggg

SEQ ID NO: 1069991 - RNA, 20 nt, Human
gauaaggggaagcuuuggaa

SEQ ID NO: 1069992 - RNA, 23 nt, Human
gauaaugguauuaagaauuacag

SEQ ID NO: 1069993 - RNA, 22 nt, Human
gcagcaggcugcucuauccaca

SEQ ID NO: 1069994 - RNA, 18 nt, Human
gcauccuucccccaggaa

SEQ ID NO: 1069995 - RNA, 18 nt, Human
gcuauuggggguuuggga

SEQ ID NO: 1069996 - RNA, 20 nt, Human
gcugcugccugaggacuggg

SEQ ID NO: 1069997 - RNA, 20 nt, Human
gcuguggagaggcagacaga

SEQ ID NO: 1069998 - RNA, 20 nt, Human
gcuuaaagauacaaaacgac

SEQ ID NO: 1069999 - RNA, 24 nt, Human
ggaaauagcaaaacccuucauggc

SEQ ID NO: 1070000 - RNA, 24 nt, Human
ggaacugccaauuucccuccaccc

SEQ ID NO: 1070001 - RNA, 19 nt, Human
ggaagcuuuggaaauagca

SEQ ID NO: 1070002 - RNA, 22 nt, Human
ggacuggggagagugagauggg

SEQ ID NO: 1070003 - RNA, 27 nt, Human
ggcuuacagucuagcugggaggcauug

SEQ ID NO: 1070004 - RNA, 19 nt, Human
gggaagcuuuggaaauagc

SEQ ID NO: 1070005 - RNA, 21 nt, Human
gggcggagggggguucaaggu

SEQ ID NO: 1070006 - RNA, 18 nt, Human
ggggaugaggugccugag

SEQ ID NO: 1070007 - RNA, 20 nt, Human
gggggcggagggggguucaa

SEQ ID NO: 1070008 - RNA, 22 nt, Human
guggaaaagcugcugccugagg

SEQ ID NO: 1070009 - RNA, 21 nt, Human
gugggugcuuggugcagugug

SEQ ID NO: 1070010 - RNA, 19 nt, Human
uacacagcaucuuuacaug

SEQ ID NO: 1070011 - RNA, 20 nt, Human
uacaguuuacacagcaucuu

SEQ ID NO: 1070012 - RNA, 20 nt, Human
uaccugugagacuuuagacc

SEQ ID NO: 1070013 - RNA, 21 nt, Human
uaccuuugucacgggguuggg

SEQ ID NO: 1070014 - RNA, 22 nt, Human
uaggagaacgccauccaagaac

SEQ ID NO: 1070015 - RNA, 19 nt, Human
uaggaggaaggagguggga

SEQ ID NO: 1070016 - RNA, 25 nt, Human
uaggugugugcugggcaagagggcu

SEQ ID NO: 1070017 - RNA, 22 nt, Human
ucaagguaugacccacauguua

SEQ ID NO: 1070018 - RNA, 18 nt, Human
ucacugccuugcugccuu

SEQ ID NO: 1070019 - RNA, 24 nt, Human
uccaaaaagugaaacagacauaga

SEQ ID NO: 1070020 - RNA, 20 nt, Human
uccaagaacuggaagcagcc

SEQ ID NO: 1070021 - RNA, 20 nt, Human
uccacccuucuucugguagu

SEQ ID NO: 1070022 - RNA, 24 nt, Human
uccauagcacauauggcccagggc

SEQ ID NO: 1070023 - RNA, 23 nt, Human
uccaucacuuggaauccuuuuuu

SEQ ID NO: 1070024 - RNA, 21 nt, Human
uccccaaagggcuuacagucu

SEQ ID NO: 1070025 - RNA, 20 nt, Human
ucccuuagccuugguuucug

SEQ ID NO: 1070026 - RNA, 21 nt, Human
ucccuuagccuugguuucuga

SEQ ID NO: 1070027 - RNA, 25 nt, Human
ucccuuagccuugguuucugaaucu

SEQ ID NO: 1070028 - RNA, 29 nt, Human
uccugggguggaaaagcugcuccaccagg

SEQ ID NO: 1070029 - RNA, 21 nt, Human
ucuccauagcacauauggccc

SEQ ID NO: 1070030 - RNA, 18 nt, Human
ucuuucuuggaugggagc

SEQ ID NO: 1070031 - RNA, 22 nt, Human
ucuuuugagagcaguaguacug

SEQ ID NO: 1070032 - RNA, 23 nt, Human
ugaaccucuagagcaaggacacu

SEQ ID NO: 1070033 - RNA, 19 nt, Human
ugaccucugacuccaaucu

SEQ ID NO: 1070034 - RNA, 18 nt, Human
ugagcgccuugcccagcc

SEQ ID NO: 1070035 - RNA, 18 nt, Human
ugaggugccugagacaca

SEQ ID NO: 1070036 - RNA, 19 nt, Human
ugcagagcaguugaaggaa

SEQ ID NO: 1070037 - RNA, 18 nt, Human
ugccaggaggacagcucu

SEQ ID NO: 1070038 - RNA, 19 nt, Human
ugccaggaggacagcucug

SEQ ID NO: 1070039 - RNA, 23 nt, Human
ugccuggaucuugugggcuccca

SEQ ID NO: 1070040 - RNA, 18 nt, Human
ugcuuuggccaucagcga

SEQ ID NO: 1070041 - RNA, 19 nt, Human
uggauagggcuggguggua

SEQ ID NO: 1070042 - RNA, 22 nt, Human
uggcccagggcagccuuuuuug

SEQ ID NO: 1070043 - RNA, 23 nt, Human
uggcugggggccuuuguccuucc

SEQ ID NO: 1070044 - RNA, 22 nt, Human
ugggagaguccucuccauagca

SEQ ID NO: 1070045 - RNA, 19 nt, Human
ugggagcagaagggagaaa

SEQ ID NO: 1070046 - RNA, 19 nt, Human
uggggagagugagaugggu

SEQ ID NO: 1070047 - RNA, 19 nt, Human
uggggccagccccaaaccc

SEQ ID NO: 1070048 - RNA, 21 nt, Human
ugggggcggagggggguucaa

SEQ ID NO: 1070049 - RNA, 18 nt, Human
ugguagugaggccaagug

SEQ ID NO: 1070050 - RNA, 18 nt, Human
ugguccugagagcagcag

SEQ ID NO: 1070051 - RNA, 20 nt, Human
uguauauauacaacaucaca

SEQ ID NO: 1070052 - RNA, 21 nt, Human
ugucacgggguugggagauaa

SEQ ID NO: 1070053 - RNA, 26 nt, Human
uuacaugcgucaucucacuuaauccc

SEQ ID NO: 1070054 - RNA, 22 nt, Human
uuagugccuggugcacaguggg

SEQ ID NO: 1070055 - RNA, 23 nt, Human
uugaaccucuagagcaaggacac

SEQ ID NO: 1070056 - RNA, 19 nt, Human
uuggccaucagcgaaagga

SEQ ID NO: 1070057 - RNA, 19 nt, Human
uugguuucugacuccaccc

SEQ ID NO: 1070058 - RNA, 21 nt, Human
uuuaguuuuuggggagaugca

SEQ ID NO: 1070059 - RNA, 21 nt, Human
uuuuuugaccucugacuccaa

SEQ ID NO: 1070060 - RNA, 26 nt, Human
aaaaacaaacaaacaaaaaaacagaa

SEQ ID NO: 1070061 - RNA, 23 nt, Human
aaaacccuuucaauaucuuucuu

SEQ ID NO: 1070062 - RNA, 21 nt, Human
aaacaaacaaaaaaacagaaa

SEQ ID NO: 1070063 - RNA, 21 nt, Human
aaacaaacaaacaaaaaaaca

SEQ ID NO: 1070064 - RNA, 23 nt, Human
aaagcagcccucuccauaaccca

SEQ ID NO: 1070065 - RNA, 23 nt, Human
aacaaacaaaaaaacagaaaaua

SEQ ID NO: 1070066 - RNA, 19 nt, Human
aagcagcccucuccauaac

SEQ ID NO: 1070067 - RNA, 21 nt, Human
aagcagcccucuccauaaccc

SEQ ID NO: 1070068 - RNA, 20 nt, Human
aaggagaaugaacauaauuc

SEQ ID NO: 1070069 - RNA, 23 nt, Human
aaguccagaagccugaagaaacc

SEQ ID NO: 1070070 - RNA, 25 nt, Human
aauccccaaaagcagcccucuccau

SEQ ID NO: 1070071 - RNA, 18 nt, Human
aaugcaaaaacaaacaaa

SEQ ID NO: 1070072 - RNA, 23 nt, Human
aaugcaaaaacaaacaaacaaag

SEQ ID NO: 1070073 - RNA, 21 nt, Human
aauuaugugccuuggacauuu

SEQ ID NO: 1070074 - RNA, 25 nt, Human
agaagaaugcaaaaacaaacaaaca

SEQ ID NO: 1070075 - RNA, 24 nt, Human
caaaagcagcccucuccauaaccc

SEQ ID NO: 1070076 - RNA, 21 nt, Human
caaacaauggggaacagauac

SEQ ID NO: 1070077 - RNA, 24 nt, Human
cagaaaauagauuccuaagcccca

SEQ ID NO: 1070078 - RNA, 23 nt, Human
ccaaaagcagcccucuccauaac

SEQ ID NO: 1070079 - RNA, 18 nt, Human
ccaaaagcuccugccagg

SEQ ID NO: 1070080 - RNA, 20 nt, Human
ccaaaagcuccugccagguu

SEQ ID NO: 1070081 - RNA, 21 nt, Human
ccaaaggcaggccuagcaagu

SEQ ID NO: 1070082 - RNA, 20 nt, Human
ccauaacccauaaccaggac

SEQ ID NO: 1070083 - RNA, 18 nt, Human
ccccaaaagcagcccucu

SEQ ID NO: 1070084 - RNA, 19 nt, Human
ccccaaaagcagcccucuc

SEQ ID NO: 1070085 - RNA, 20 nt, Human
ccccaaaagcagcccucucc

SEQ ID NO: 1070086 - RNA, 22 nt, Human
ccugauuguuaaggaauuaagg

SEQ ID NO: 1070087 - RNA, 18 nt, Human
gaagccugaagaaaccag

SEQ ID NO: 1070088 - RNA, 23 nt, Human
uacugauucuuucaauuaugugc

SEQ ID NO: 1070089 - RNA, 22 nt, Human
ucaauaucuuucuuggucuucu

SEQ ID NO: 1070090 - RNA, 20 nt, Human
uccacagauucauucuccuc

SEQ ID NO: 1070091 - RNA, 22 nt, Human
uccacguucugaaaaacuguac

SEQ ID NO: 1070092 - RNA, 22 nt, Human
uccagaccugaauuacuaaggu

SEQ ID NO: 1070093 - RNA, 18 nt, Human
uccauaacccauaaccag

SEQ ID NO: 1070094 - RNA, 23 nt, Human
uccauaacccauaaccaggacca

SEQ ID NO: 1070095 - RNA, 24 nt, Human
uccuaagccccauuccagaccuga

SEQ ID NO: 1070096 - RNA, 25 nt, Human
ugccagguuuugcggcugccugauu

SEQ ID NO: 1070097 - RNA, 22 nt, Human
uuacuaagguuuugcccaaagg

SEQ ID NO: 1070098 - RNA, 24 nt, Human
uucaauuaugugccuuggacauuu

SEQ ID NO: 1070099 - RNA, 18 nt, Human
uucuuggucuucuugccc

SEQ ID NO: 1070100 - RNA, 20 nt, Human
uuuaccaaaagcuccugcca

SEQ ID NO: 1070101 - RNA, 20 nt, Human
aagcuaccaucaacaugcgg

SEQ ID NO: 1070102 - RNA, 21 nt, Human
caugcgguuuccagggucacc

SEQ ID NO: 1070103 - RNA, 23 nt, Human
cugcuaagcuaccaucaacaugc

SEQ ID NO: 1070104 - RNA, 21 nt, Human
ucaacaugcgguuuccagggu

SEQ ID NO: 1070105 - RNA, 20 nt, Human
aaccacaauuacuuuugcac

SEQ ID NO: 1070106 - RNA, 23 nt, Human
aagaacccacuccuggaaaauuc

SEQ ID NO: 1070107 - RNA, 23 nt, Human
aauaaacuuauacauacaaaaca

SEQ ID NO: 1070108 - RNA, 24 nt, Human
aauggucuaauuauuaaguccauu

SEQ ID NO: 1070109 - RNA, 24 nt, Human
acaaaacauucccaagcuuuguga

SEQ ID NO: 1070110 - RNA, 24 nt, Human
acagccacugcccaagaacccacu

SEQ ID NO: 1070111 - RNA, 18 nt, Human
accacaauuacuuuugca

SEQ ID NO: 1070112 - RNA, 18 nt, Human
agcgcgggaggggcgugg

SEQ ID NO: 1070113 - RNA, 19 nt, Human
auuaaguccauuuuuacag

SEQ ID NO: 1070114 - RNA, 23 nt, Human
caaaacauucccaagcuuuguga

SEQ ID NO: 1070115 - RNA, 21 nt, Human
caaaacuuccggaaagggcgg

SEQ ID NO: 1070116 - RNA, 20 nt, Human
cauacaaaacauucccaagc

SEQ ID NO: 1070117 - RNA, 21 nt, Human
cauuucuauuuugacuuagaa

SEQ ID NO: 1070118 - RNA, 21 nt, Human
cccacagccacugcccaagaa

SEQ ID NO: 1070119 - RNA, 26 nt, Human
cccacagccacugcccaagaacccac

SEQ ID NO: 1070120 - RNA, 20 nt, Human
gagcgcgggaggggcguggc

SEQ ID NO: 1070121 - RNA, 27 nt, Human
uagguugguacaaaaguaauugugguc

SEQ ID NO: 1070122 - RNA, 18 nt, Human
uaguucuaguaauaugaa

SEQ ID NO: 1070123 - RNA, 21 nt, Human
uccaucacauuacucggggcg

SEQ ID NO: 1070124 - RNA, 20 nt, Human
ucccacagccacugcccaag

SEQ ID NO: 1070125 - RNA, 26 nt, Human
ucccacagccacugcccaagaaccca

SEQ ID NO: 1070126 - RNA, 23 nt, Human
ugaagcauacccaguuuuaauaa

SEQ ID NO: 1070127 - RNA, 22 nt, Human
ugagcccggaaacccgagcugg

SEQ ID NO: 1070128 - RNA, 22 nt, Human
ugccuagacagacauauaugag

SEQ ID NO: 1070129 - RNA, 20 nt, Human
ugcugggagagcgcggaucc

SEQ ID NO: 1070130 - RNA, 21 nt, Human
uguuaaggaacuuuucaguca

SEQ ID NO: 1070131 - RNA, 24 nt, Human
uguuaaggaacuuuucagucaaga

SEQ ID NO: 1070132 - RNA, 21 nt, Human
aaccauuuuuccaugcugcuu

SEQ ID NO: 1070133 - RNA, 20 nt, Human
uuccaugcugcuuaagagcc

SEQ ID NO: 1070134 - RNA, 21 nt, Human
aaaaaggaaugagacaaagcc

SEQ ID NO: 1070135 - RNA, 19 nt, Human
aaaauacaaaaauuagccc

SEQ ID NO: 1070136 - RNA, 24 nt, Human
aaagagcgagacuccgucucaaaa

SEQ ID NO: 1070137 - RNA, 23 nt, Human
aagccacuaaaaucuacuuaggu

SEQ ID NO: 1070138 - RNA, 24 nt, Human
aauggcuugaagccaggaggugga

SEQ ID NO: 1070139 - RNA, 20 nt, Human
acaccauugcacuccagccu

SEQ ID NO: 1070140 - RNA, 22 nt, Human
accauugcacuccagccugggc

SEQ ID NO: 1070141 - RNA, 24 nt, Human
accauugcacuccagccugggcga

SEQ ID NO: 1070142 - RNA, 23 nt, Human
acccauucccagauugccuuccu

SEQ ID NO: 1070143 - RNA, 25 nt, Human
acuuugugcuuguuccaaaaaggaa

SEQ ID NO: 1070144 - RNA, 19 nt, Human
agaauggcuugaagccagg

SEQ ID NO: 1070145 - RNA, 23 nt, Human
agcaugguggcaggcgccuguaa

SEQ ID NO: 1070146 - RNA, 24 nt, Human
agccaggagguggagguugcagug

SEQ ID NO: 1070147 - RNA, 26 nt, Human
agccaggagguggagguuggggaccc

SEQ ID NO: 1070148 - RNA, 24 nt, Human
agccugggcgaaagagcgagacuc

SEQ ID NO: 1070149 - RNA, 23 nt, Human
aggaaucauuugacacaaucccu

SEQ ID NO: 1070150 - RNA, 18 nt, Human
aggcaggagaauggcuug

SEQ ID NO: 1070151 - RNA, 24 nt, Human
aggcuaaggcaggagaauggcuug

SEQ ID NO: 1070152 - RNA, 20 nt, Human
agguggagguugcagugagc

SEQ ID NO: 1070153 - RNA, 24 nt, Human
agguggagguugcagugagcggag

SEQ ID NO: 1070154 - RNA, 24 nt, Human
aucacaccauugcacuccagccug

SEQ ID NO: 1070155 - RNA, 22 nt, Human
auugcacuccagccugggcgaa

SEQ ID NO: 1070156 - RNA, 25 nt, Human
caaaaaggaaugagacaaagcccug

SEQ ID NO: 1070157 - RNA, 25 nt, Human
caccauugcacuccagccugggcga

SEQ ID NO: 1070158 - RNA, 23 nt, Human
cacuccagccugggcgaaagagc

SEQ ID NO: 1070159 - RNA, 24 nt, Human
cacuccagccugggcgaaagagcg

SEQ ID NO: 1070160 - RNA, 21 nt, Human
cacugcaucauagcaugugga

SEQ ID NO: 1070161 - RNA, 29 nt, Human
caggagguggagguugcagugacaacggu

SEQ ID NO: 1070162 - RNA, 24 nt, Human
caggagguggagguugcagugagc

SEQ ID NO: 1070163 - RNA, 23 nt, Human
caguggcuuacacuggcuggugc

SEQ ID NO: 1070164 - RNA, 21 nt, Human
cauccaacccauucccagauu

SEQ ID NO: 1070165 - RNA, 19 nt, Human
cauugcacuccagccuggg

SEQ ID NO: 1070166 - RNA, 20 nt, Human
cauugcacuccagccugggc

SEQ ID NO: 1070167 - RNA, 21 nt, Human
cauugcacuccagccugggcg

SEQ ID NO: 1070168 - RNA, 24 nt, Human
cauugcacuccagccugggcgaaa

SEQ ID NO: 1070169 - RNA, 25 nt, Human
ccaccuuuucucccuccccauccaa

SEQ ID NO: 1070170 - RNA, 23 nt, Human
ccacuaaaaucuacuuagguaaa

SEQ ID NO: 1070171 - RNA, 20 nt, Human
ccaggagguggagguugcag

SEQ ID NO: 1070172 - RNA, 20 nt, Human
ccauugcacuccagccuggg

SEQ ID NO: 1070173 - RNA, 21 nt, Human
ccauugcacuccagccugggc

SEQ ID NO: 1070174 - RNA, 22 nt, Human
ccauugcacuccagccugggcg

SEQ ID NO: 1070175 - RNA, 23 nt, Human
ccauugcacuccagccugggcga

SEQ ID NO: 1070176 - RNA, 24 nt, Human
ccauugcacuccagccugggcgaa

SEQ ID NO: 1070177 - RNA, 21 nt, Human
cccaccuuuucucccucccca

SEQ ID NO: 1070178 - RNA, 20 nt, Human
ccccauccaacccauuccca

SEQ ID NO: 1070179 - RNA, 18 nt, Human
cccuccccauccaaccca

SEQ ID NO: 1070180 - RNA, 18 nt, Human
cccuccccauccaaccca

SEQ ID NO: 1070181 - RNA, 22 nt, Human
ccugggcgaaagagcgagacuc

SEQ ID NO: 1070182 - RNA, 19 nt, Human
ccuguaaucccagcuacuc

SEQ ID NO: 1070183 - RNA, 21 nt, Human
ccuguaaucccagcuacucgg

SEQ ID NO: 1070184 - RNA, 20 nt, Human
ccuuuucucccuccccaucc

SEQ ID NO: 1070185 - RNA, 24 nt, Human
cgccuguaaucccagcuacucggg

SEQ ID NO: 1070186 - RNA, 23 nt, Human
cucuccuauuacaccauccacag

SEQ ID NO: 1070187 - RNA, 18 nt, Human
cucuuccucugcuucccu

SEQ ID NO: 1070188 - RNA, 21 nt, Human
gaaagagcgagacuccgucuc

SEQ ID NO: 1070189 - RNA, 19 nt, Human
gagcgagacuccgucucaa

SEQ ID NO: 1070190 - RNA, 24 nt, Human
gauugccuuccuuugcucuccuau

SEQ ID NO: 1070191 - RNA, 22 nt, Human
gcuugaagccaggagguggagg

SEQ ID NO: 1070192 - RNA, 22 nt, Human
ggaaugagacaaagcccugccg

SEQ ID NO: 1070193 - RNA, 24 nt, Human
ggagaucacaccauugcacuccag

SEQ ID NO: 1070194 - RNA, 23 nt, Human
ggagguugcagugagcggagauc

SEQ ID NO: 1070195 - RNA, 24 nt, Human
ggagguugcagugagcggagauca

SEQ ID NO: 1070196 - RNA, 22 nt, Human
gggcaugguuggagaucaagaa

SEQ ID NO: 1070197 - RNA, 24 nt, Human
gguggcaggcgccuguaaucccag

SEQ ID NO: 1070198 - RNA, 22 nt, Human
gugaccaaagauaguccacacu

SEQ ID NO: 1070199 - RNA, 20 nt, Human
uaaaaauacaaaaauuagcc

SEQ ID NO: 1070200 - RNA, 21 nt, Human
uaaaaauacaaaaauuagccc

SEQ ID NO: 1070201 - RNA, 18 nt, Human
uaaaagagaacagaaggu

SEQ ID NO: 1070202 - RNA, 22 nt, Human
uaagagagaacugacaggccug

SEQ ID NO: 1070203 - RNA, 19 nt, Human
uacuuucuucauugccaug

SEQ ID NO: 1070204 - RNA, 24 nt, Human
ucaagaauagaaaagccacuaaaa

SEQ ID NO: 1070205 - RNA, 23 nt, Human
ucacaccauugcacuccagccug

SEQ ID NO: 1070206 - RNA, 20 nt, Human
uccacaguggcuuacacugg

SEQ ID NO: 1070207 - RNA, 23 nt, Human
uccagccugggcgaaagagcgag

SEQ ID NO: 1070208 - RNA, 24 nt, Human
uccagccugggcgaaagagcgaga

SEQ ID NO: 1070209 - RNA, 23 nt, Human
ucccccaccuuuucucccucccc

SEQ ID NO: 1070210 - RNA, 25 nt, Human
ucccccaccuuuucucccuccccau

SEQ ID NO: 1070211 - RNA, 24 nt, Human
ucucuuucccccaccuuuucuccc

SEQ ID NO: 1070212 - RNA, 18 nt, Human
ugacacaaucccuacacu

SEQ ID NO: 1070213 - RNA, 22 nt, Human
ugacacuucagauacaaacaua

SEQ ID NO: 1070214 - RNA, 18 nt, Human
ugacaggccugcuguggg

SEQ ID NO: 1070215 - RNA, 18 nt, Human
ugaccguccagguccagc

SEQ ID NO: 1070216 - RNA, 23 nt, Human
ugacuucuagucuacuccaacau

SEQ ID NO: 1070217 - RNA, 19 nt, Human
ugagacaaagcccugccgu

SEQ ID NO: 1070218 - RNA, 20 nt, Human
ugagacaaagcccugccguc

SEQ ID NO: 1070219 - RNA, 20 nt, Human
ugagagcaaauaagggugga

SEQ ID NO: 1070220 - RNA, 21 nt, Human
ugagagcaaauaaggguggau

SEQ ID NO: 1070221 - RNA, 24 nt, Human
ugcacuccagccugggcgaaagag

SEQ ID NO: 1070222 - RNA, 22 nt, Human
ugccauguuaucucuuccucug

SEQ ID NO: 1070223 - RNA, 22 nt, Human
uggaacagaaaaugaccaaaga

SEQ ID NO: 1070224 - RNA, 24 nt, Human
uggcuugaagccaggagguggagg

SEQ ID NO: 1070225 - RNA, 24 nt, Human
ugguggcaggcgccuguaauccca

SEQ ID NO: 1070226 - RNA, 19 nt, Human
uucuagucuacuccaacau

SEQ ID NO: 1070227 - RNA, 24 nt, Human
uugaagccaggagguggagguugc

SEQ ID NO: 1070228 - RNA, 19 nt, Human
uugcagugagcggagauca

SEQ ID NO: 1070229 - RNA, 20 nt, Human
uugcagugagcggagaucac

SEQ ID NO: 1070230 - RNA, 21 nt, Human
uuucucucuuucccccaccuc

SEQ ID NO: 1070231 - RNA, 21 nt, Human
ucucuggaucaggaauccugg

SEQ ID NO: 1070232 - RNA, 24 nt, Human
ucucuggaucaggaauccuggcuc

SEQ ID NO: 1070233 - RNA, 21 nt, Human
uggcucgcagacaugauccuu

SEQ ID NO: 1070234 - RNA, 22 nt, Human
uguccagcuuccacuccucucg

SEQ ID NO: 1070235 - RNA, 21 nt, Human
aaaaaccuuccagaaccuuca

SEQ ID NO: 1070236 - RNA, 18 nt, Human
aaaacccaggcgacuucc

SEQ ID NO: 1070237 - RNA, 20 nt, Human
aaagaaaaauauuuucccca

SEQ ID NO: 1070238 - RNA, 19 nt, Human
aagcagaaagcaaguccga

SEQ ID NO: 1070239 - RNA, 22 nt, Human
aaguaaacaaaauccugcauuu

SEQ ID NO: 1070240 - RNA, 19 nt, Human
aaucugaaaaaccuuccag

SEQ ID NO: 1070241 - RNA, 25 nt, Human
aauuggcuaaaaacucagaacuugg

SEQ ID NO: 1070242 - RNA, 18 nt, Human
acacugggccagcugcug

SEQ ID NO: 1070243 - RNA, 21 nt, Human
agaaggaaaguagaggaucaa

SEQ ID NO: 1070244 - RNA, 19 nt, Human
agacugaaggggcugcuuu

SEQ ID NO: 1070245 - RNA, 21 nt, Human
agcccauagggugcagugucu

SEQ ID NO: 1070246 - RNA, 23 nt, Human
aggaaaguagaggaucaauuggc

SEQ ID NO: 1070247 - RNA, 20 nt, Human
agguacuucugcauccucag

SEQ ID NO: 1070248 - RNA, 21 nt, Human
aguuuguuuuuauuaaccucu

SEQ ID NO: 1070249 - RNA, 18 nt, Human
augcucgaguaucuucua

SEQ ID NO: 1070250 - RNA, 21 nt, Human
caaucugaaaaaccuuccaga

SEQ ID NO: 1070251 - RNA, 21 nt, Human
caccagcgagcagucugacca

SEQ ID NO: 1070252 - RNA, 22 nt, Human
cagccccucacagccccuccca

SEQ ID NO: 1070253 - RNA, 23 nt, Human
caguguuuugagaggcgauauga

SEQ ID NO: 1070254 - RNA, 21 nt, Human
caugacaugaugaaaguaaac

SEQ ID NO: 1070255 - RNA, 21 nt, Human
caugcucgaguaucuucuacc

SEQ ID NO: 1070256 - RNA, 20 nt, Human
ccucauagaccacuguaccu

SEQ ID NO: 1070257 - RNA, 18 nt, Human
ccugcagguaggcagggu

SEQ ID NO: 1070258 - RNA, 22 nt, Human
ccugccuucugcugcuuuggga

SEQ ID NO: 1070259 - RNA, 24 nt, Human
cgagcagucugaccaccacaugac

SEQ ID NO: 1070260 - RNA, 20 nt, Human
cgcagcucuaucugcuccgu

SEQ ID NO: 1070261 - RNA, 23 nt, Human
cugaaaaaccuuccagaaccuuc

SEQ ID NO: 1070262 - RNA, 19 nt, Human
cuguucuuuguggccuucg

SEQ ID NO: 1070263 - RNA, 24 nt, Human
cuucugcugcuuugggauugcugc

SEQ ID NO: 1070264 - RNA, 23 nt, Human
cuuugugcaucugagcuguucuu

SEQ ID NO: 1070265 - RNA, 19 nt, Human
gagaucuucagguguuuca

SEQ ID NO: 1070266 - RNA, 19 nt, Human
gcagaaagcaaguccgaca

SEQ ID NO: 1070267 - RNA, 22 nt, Human
gcaguagaaaacacugccugaa

SEQ ID NO: 1070268 - RNA, 22 nt, Human
gccagccccucacagccccucc

SEQ ID NO: 1070269 - RNA, 23 nt, Human
ggaagggcgaaugcgccugcaaa

SEQ ID NO: 1070270 - RNA, 20 nt, Human
gggaacgcagacugaagggg

SEQ ID NO: 1070271 - RNA, 21 nt, Human
gggcggggcuugaugaaaacc

SEQ ID NO: 1070272 - RNA, 22 nt, Human
gugaaucuuugugcaucugagc

SEQ ID NO: 1070273 - RNA, 20 nt, Human
gugcaacugagaggacucgg

SEQ ID NO: 1070274 - RNA, 25 nt, Human
uaacuaacuauugguuuucgauucc

SEQ ID NO: 1070275 - RNA, 21 nt, Human
uagcccauagggugcaguguc

SEQ ID NO: 1070276 - RNA, 21 nt, Human
uaggaagggcgaaugcgccug

SEQ ID NO: 1070277 - RNA, 21 nt, Human
ucaagaguuguauauuuuguc

SEQ ID NO: 1070278 - RNA, 20 nt, Human
ucagugugauugauuccagg

SEQ ID NO: 1070279 - RNA, 24 nt, Human
ucagugugauugauuccaggaugu

SEQ ID NO: 1070280 - RNA, 20 nt, Human
uccacgaauggcagguacgu

SEQ ID NO: 1070281 - RNA, 18 nt, Human
uccccuggcagcaugcuc

SEQ ID NO: 1070282 - RNA, 19 nt, Human
uccccuguguaguuggaga

SEQ ID NO: 1070283 - RNA, 19 nt, Human
ucugcugcuuugggauugc

SEQ ID NO: 1070284 - RNA, 21 nt, Human
ucuuuaaauccaaguaaauuc

SEQ ID NO: 1070285 - RNA, 22 nt, Human
ugaaagggucuggauaaaggua

SEQ ID NO: 1070286 - RNA, 20 nt, Human
ugagagagaaagggcggggc

SEQ ID NO: 1070287 - RNA, 23 nt, Human
ugagaggcgauaugagaucuuca

SEQ ID NO: 1070288 - RNA, 26 nt, Human
ugagaggcgauaugagaucuucaggu

SEQ ID NO: 1070289 - RNA, 22 nt, Human
ugagagggacuaaagaaggaaa

SEQ ID NO: 1070290 - RNA, 23 nt, Human
ugagagggacuaaagaaggaaag

SEQ ID NO: 1070291 - RNA, 20 nt, Human
ugagcugaggugccagcccc

SEQ ID NO: 1070292 - RNA, 19 nt, Human
ugauacguacacgugugca

SEQ ID NO: 1070293 - RNA, 25 nt, Human
ugccugaaguuggcgugcuugaaga

SEQ ID NO: 1070294 - RNA, 20 nt, Human
uggaauugucuuauuuugcu

SEQ ID NO: 1070295 - RNA, 21 nt, Human
uggcuaaaaacucagaacuug

SEQ ID NO: 1070296 - RNA, 19 nt, Human
uggcugcguaucuuaagca

SEQ ID NO: 1070297 - RNA, 22 nt, Human
uggcugcguaucuuaagcaauc

SEQ ID NO: 1070298 - RNA, 19 nt, Human
ugggaggggcuacacuugg

SEQ ID NO: 1070299 - RNA, 20 nt, Human
ugggaggggcuacacuugga

SEQ ID NO: 1070300 - RNA, 21 nt, Human
ugggaggggcuacacuuggga

SEQ ID NO: 1070301 - RNA, 18 nt, Human
ugggccagcugcuggcug

SEQ ID NO: 1070302 - RNA, 18 nt, Human
ugggccagcugcuggcug

SEQ ID NO: 1070303 - RNA, 22 nt, Human
uuacacuccguuaucuuuaauu

SEQ ID NO: 1070304 - RNA, 25 nt, Human
uucccaugugguagguacuucugca

SEQ ID NO: 1070305 - RNA, 20 nt, Human
uucugcugcuuugggauugc

SEQ ID NO: 1070306 - RNA, 18 nt, Human
uuguugauuucucacuau

SEQ ID NO: 1070307 - RNA, 18 nt, Human
uuuaaauccaaguaaauu

SEQ ID NO: 1070308 - RNA, 23 nt, Human
uuuuguauucugugcuuuuacug

SEQ ID NO: 1070309 - RNA, 24 nt, Human
uuuuuuuuuuaaacugcuucuggc

SEQ ID NO: 1070310 - RNA, 24 nt, Human
uuuuuuuuuuuaaacugcuucugg

SEQ ID NO: 1070311 - RNA, 22 nt, Human
aaaaaauccauuaagccaauaa

SEQ ID NO: 1070312 - RNA, 31 nt, Human
aaaccaaggccacgucauuucagcagaggaa

SEQ ID NO: 1070313 - RNA, 23 nt, Human
aaagacucagugaagaugguuag

SEQ ID NO: 1070314 - RNA, 22 nt, Human
aaagaugccucauaaacuuaga

SEQ ID NO: 1070315 - RNA, 20 nt, Human
aaaggaaccaucugccuaca

SEQ ID NO: 1070316 - RNA, 20 nt, Human
acacacacacacacacaaaa

SEQ ID NO: 1070317 - RNA, 23 nt, Human
acacacacacacacacacacaca

SEQ ID NO: 1070318 - RNA, 23 nt, Human
acacacacacacacacacacaca

SEQ ID NO: 1070319 - RNA, 23 nt, Human
acacacacacacacacacacaca

SEQ ID NO: 1070320 - RNA, 23 nt, Human
acacacacacacacacacacaca

SEQ ID NO: 1070321 - RNA, 24 nt, Human
acaggacaacaggacuggcaggag

SEQ ID NO: 1070322 - RNA, 18 nt, Human
acccucccccacccuccc

SEQ ID NO: 1070323 - RNA, 24 nt, Human
acccucccugcucagcuguccagc

SEQ ID NO: 1070324 - RNA, 18 nt, Human
acucauccuccggcccca

SEQ ID NO: 1070325 - RNA, 18 nt, Human
acugccaacaucuguugc

SEQ ID NO: 1070326 - RNA, 18 nt, Human
agaacucugcggcuccuc

SEQ ID NO: 1070327 - RNA, 19 nt, Human
agagacaggcccgaggcca

SEQ ID NO: 1070328 - RNA, 23 nt, Human
agagagagacaggcccgaggcca

SEQ ID NO: 1070329 - RNA, 22 nt, Human
agccugaccucucuucagccca

SEQ ID NO: 1070330 - RNA, 20 nt, Human
agccuggaacacccuccccc

SEQ ID NO: 1070331 - RNA, 23 nt, Human
agcgauaaggagguucagagaga

SEQ ID NO: 1070332 - RNA, 21 nt, Human
agcuccuacucauccuccggc

SEQ ID NO: 1070333 - RNA, 19 nt, Human
agcugggcuguucuggccu

SEQ ID NO: 1070334 - RNA, 19 nt, Human
aggacccugcagcuggccc

SEQ ID NO: 1070335 - RNA, 24 nt, Human
aggaggaccuaaacccccaagcca

SEQ ID NO: 1070336 - RNA, 18 nt, Human
aggcagcuuucucuuccc

SEQ ID NO: 1070337 - RNA, 18 nt, Human
aggcagcuuucucuuccc

SEQ ID NO: 1070338 - RNA, 21 nt, Human
augaugacaggacaacaggac

SEQ ID NO: 1070339 - RNA, 22 nt, Human
auuuguuggggccuaauggaaa

SEQ ID NO: 1070340 - RNA, 20 nt, Human
caaaggcagaaaaaauccau

SEQ ID NO: 1070341 - RNA, 21 nt, Human
caaaggcagaaaaaauccauu

SEQ ID NO: 1070342 - RNA, 24 nt, Human
caaauucacucuuccacaaagccu

SEQ ID NO: 1070343 - RNA, 21 nt, Human
caacccgcagcugaccgcugg

SEQ ID NO: 1070344 - RNA, 23 nt, Human
caagagagagacaggcccgaggc

SEQ ID NO: 1070345 - RNA, 22 nt, Human
caagccacccuuggcaccaccc

SEQ ID NO: 1070346 - RNA, 18 nt, Human
caaggggcagccaccaca

SEQ ID NO: 1070347 - RNA, 19 nt, Human
caauauguaaaugaaucag

SEQ ID NO: 1070348 - RNA, 20 nt, Human
cacacacacacaaaaagaga

SEQ ID NO: 1070349 - RNA, 22 nt, Human
cacacacacacacacaaaaaga

SEQ ID NO: 1070350 - RNA, 18 nt, Human
cacacacacacacacaca

SEQ ID NO: 1070351 - RNA, 20 nt, Human
cacacacacacacacacaca

SEQ ID NO: 1070352 - RNA, 20 nt, Human
cacacacacacacacacaca

SEQ ID NO: 1070353 - RNA, 20 nt, Human
cacacacacacacacacaca

SEQ ID NO: 1070354 - RNA, 20 nt, Human
cacacacacacacacacaca

SEQ ID NO: 1070355 - RNA, 20 nt, Human
cacacacacacacacacaca

SEQ ID NO: 1070356 - RNA, 20 nt, Human
cacacacacacacacacaca

SEQ ID NO: 1070357 - RNA, 20 nt, Human
cacacacacacacacacaca

SEQ ID NO: 1070358 - RNA, 22 nt, Human
cacacacacacacacacacaaa

SEQ ID NO: 1070359 - RNA, 22 nt, Human
cacacacacacacacacacaca

SEQ ID NO: 1070360 - RNA, 22 nt, Human
cacacacacacacacacacaca

SEQ ID NO: 1070361 - RNA, 23 nt, Human
cacacacacacacacacacacaa

SEQ ID NO: 1070362 - RNA, 26 nt, Human
cacacacacacacacacacacacaca

SEQ ID NO: 1070363 - RNA, 26 nt, Human
cacacacacacacacacacacacaca

SEQ ID NO: 1070364 - RNA, 26 nt, Human
cacacacacacacacacacacacaca

SEQ ID NO: 1070365 - RNA, 18 nt, Human
cacccaugucugcucuua

SEQ ID NO: 1070366 - RNA, 22 nt, Human
cacccuuggcaccaccccuaca

SEQ ID NO: 1070367 - RNA, 18 nt, Human
cacguuuguguucccagg

SEQ ID NO: 1070368 - RNA, 22 nt, Human
cagaaaaaauccauuaagccaa

SEQ ID NO: 1070369 - RNA, 27 nt, Human
cagaggaccugcguguggaaggacccu

SEQ ID NO: 1070370 - RNA, 23 nt, Human
cagaggacuacuaaaagggacac

SEQ ID NO: 1070371 - RNA, 26 nt, Human
cagcacagucaucucugaccccuugg

SEQ ID NO: 1070372 - RNA, 27 nt, Human
cagccacaccccaugcugguccucagc

SEQ ID NO: 1070373 - RNA, 20 nt, Human
cagcccacaggaucucuccu

SEQ ID NO: 1070374 - RNA, 24 nt, Human
cagcccugacaucagcaucacacu

SEQ ID NO: 1070375 - RNA, 23 nt, Human
caggagcgguuccugacccauga

SEQ ID NO: 1070376 - RNA, 18 nt, Human
caggugucuggggucugu

SEQ ID NO: 1070377 - RNA, 21 nt, Human
caucuguugcugccaacaugg

SEQ ID NO: 1070378 - RNA, 19 nt, Human
caugaagaugcugguucuc

SEQ ID NO: 1070379 - RNA, 19 nt, Human
cauucaucucugggcuacc

SEQ ID NO: 1070380 - RNA, 19 nt, Human
ccaugugugauuucuuucc

SEQ ID NO: 1070381 - RNA, 25 nt, Human
cccaaaggaaccaucugccuacacc

SEQ ID NO: 1070382 - RNA, 18 nt, Human
cccacaggauagaagcgc

SEQ ID NO: 1070383 - RNA, 20 nt, Human
cccacaggauagaagcgcag

SEQ ID NO: 1070384 - RNA, 23 nt, Human
cccacccucccugcucagcuguc

SEQ ID NO: 1070385 - RNA, 25 nt, Human
cccagguauguuggcacagcuggcc

SEQ ID NO: 1070386 - RNA, 19 nt, Human
cccaguaaugauuauaaaa

SEQ ID NO: 1070387 - RNA, 27 nt, Human
cccaugauuugaaaucuacaaucuguc

SEQ ID NO: 1070388 - RNA, 21 nt, Human
cccaugcugguccucagccug

SEQ ID NO: 1070389 - RNA, 24 nt, Human
cccccaagccacccuuggcaccac

SEQ ID NO: 1070390 - RNA, 21 nt, Human
ccggccccagggcaaauucac

SEQ ID NO: 1070391 - RNA, 23 nt, Human
ccucaugggcccuuuguauugcc

SEQ ID NO: 1070392 - RNA, 20 nt, Human
ccugaccucucuucagccca

SEQ ID NO: 1070393 - RNA, 19 nt, Human
ccugcguguggaaggaccc

SEQ ID NO: 1070394 - RNA, 22 nt, Human
ccuggaacugauugguuucugg

SEQ ID NO: 1070395 - RNA, 25 nt, Human
cggcuccucuuucugaguacccccc

SEQ ID NO: 1070396 - RNA, 23 nt, Human
cuacaaucugucaaaauuaccau

SEQ ID NO: 1070397 - RNA, 19 nt, Human
cuccacuggcuuuaaagag

SEQ ID NO: 1070398 - RNA, 22 nt, Human
cuccugggagugcugcccuggc

SEQ ID NO: 1070399 - RNA, 20 nt, Human
cugccaacaucuguugcugc

SEQ ID NO: 1070400 - RNA, 19 nt, Human
cuggcuuuaaagagggucu

SEQ ID NO: 1070401 - RNA, 20 nt, Human
cugucaggaucaacaggccu

SEQ ID NO: 1070402 - RNA, 21 nt, Human
cuucccugcuagccuguugug

SEQ ID NO: 1070403 - RNA, 23 nt, Human
cuucuaguucugccagccacacc

SEQ ID NO: 1070404 - RNA, 22 nt, Human
gaaaaaauccauuaagccaaua

SEQ ID NO: 1070405 - RNA, 20 nt, Human
gacaacaggacuggcaggag

SEQ ID NO: 1070406 - RNA, 24 nt, Human
gacacagcacagucaucucugacu

SEQ ID NO: 1070407 - RNA, 23 nt, Human
gcacuggucagucuuccagcccc

SEQ ID NO: 1070408 - RNA, 21 nt, Human
ggacaacaggacuggcaggag

SEQ ID NO: 1070409 - RNA, 20 nt, Human
ggcacaaugagaacaaggag

SEQ ID NO: 1070410 - RNA, 18 nt, Human
ggcuaggcuggaaaacuc

SEQ ID NO: 1070411 - RNA, 22 nt, Human
gugaagcaccagaguuuaucca

SEQ ID NO: 1070412 - RNA, 25 nt, Human
guguauuuguuggggccuaauggaa

SEQ ID NO: 1070413 - RNA, 18 nt, Human
uaaagagggucuagaggc

SEQ ID NO: 1070414 - RNA, 23 nt, Human
uaaagagggucuagaggcacaau

SEQ ID NO: 1070415 - RNA, 25 nt, Human
uacacacacacacacacacacacac

SEQ ID NO: 1070416 - RNA, 22 nt, Human
uagauaauuaucaaccugugcc

SEQ ID NO: 1070417 - RNA, 25 nt, Human
uauacacacacacacacacacacac

SEQ ID NO: 1070418 - RNA, 22 nt, Human
uauccaaaggggggacgugggg

SEQ ID NO: 1070419 - RNA, 18 nt, Human
uauguguguauacacaca

SEQ ID NO: 1070420 - RNA, 23 nt, Human
uauucaugcaaagaugccucaua

SEQ ID NO: 1070421 - RNA, 21 nt, Human
ucaagagagagacaggcccga

SEQ ID NO: 1070422 - RNA, 21 nt, Human
ucaaugccugggcugagcaua

SEQ ID NO: 1070423 - RNA, 24 nt, Human
ucagcccacaggaucucuccugcc

SEQ ID NO: 1070424 - RNA, 20 nt, Human
uccaaaggggggacgugggg

SEQ ID NO: 1070425 - RNA, 20 nt, Human
uccacaaagccugaccucuc

SEQ ID NO: 1070426 - RNA, 19 nt, Human
ucccaaaggaaccaucugc

SEQ ID NO: 1070427 - RNA, 23 nt, Human
ucccaacuaggcccacucaucac

SEQ ID NO: 1070428 - RNA, 18 nt, Human
ucccaaggggacccuggc

SEQ ID NO: 1070429 - RNA, 19 nt, Human
ucccaugcugcacuucuag

SEQ ID NO: 1070430 - RNA, 22 nt, Human
uccuacucauccuccggcccca

SEQ ID NO: 1070431 - RNA, 23 nt, Human
ucuccugcaaaaccaaggccacg

SEQ ID NO: 1070432 - RNA, 20 nt, Human
ucucugggcuaccacaggug

SEQ ID NO: 1070433 - RNA, 25 nt, Human
ugaagcaccagaguuuauccaaagg

SEQ ID NO: 1070434 - RNA, 19 nt, Human
ugacaggacaacaggacug

SEQ ID NO: 1070435 - RNA, 19 nt, Human
ugaguaagggcgagaucaa

SEQ ID NO: 1070436 - RNA, 21 nt, Human
ugaguaagggcgagaucaaga

SEQ ID NO: 1070437 - RNA, 21 nt, Human
ugaugacaggacaacaggacu

SEQ ID NO: 1070438 - RNA, 19 nt, Human
ugccagccacaccccaugc

SEQ ID NO: 1070439 - RNA, 20 nt, Human
ugccauuuaacuuuuccucu

SEQ ID NO: 1070440 - RNA, 21 nt, Human
ugccauuuaacuuuuccucug

SEQ ID NO: 1070441 - RNA, 21 nt, Human
ugccucauaaacuuagauguc

SEQ ID NO: 1070442 - RNA, 23 nt, Human
uggaaaacucuuccuggaacuga

SEQ ID NO: 1070443 - RNA, 24 nt, Human
uggcaccaccccuacaaggggcag

SEQ ID NO: 1070444 - RNA, 20 nt, Human
uggcaggagcgguuccugac

SEQ ID NO: 1070445 - RNA, 24 nt, Human
uggcaggagcgguuccuggguccc

SEQ ID NO: 1070446 - RNA, 23 nt, Human
uggcaggguucaggcuaggcugg

SEQ ID NO: 1070447 - RNA, 18 nt, Human
uggguuuuuuuuuuuuuu

SEQ ID NO: 1070448 - RNA, 25 nt, Human
uguauacacacacacacacacacac

SEQ ID NO: 1070449 - RNA, 25 nt, Human
uguauacacacacacacacacacag

SEQ ID NO: 1070450 - RNA, 20 nt, Human
ugucaaaauuaccauaauua

SEQ ID NO: 1070451 - RNA, 23 nt, Human
ugucaggaucaacaggccuugag

SEQ ID NO: 1070452 - RNA, 21 nt, Human
uguggaaggacccugcagcug

SEQ ID NO: 1070453 - RNA, 26 nt, Human
uguggaaggacccugcagcuggccca

SEQ ID NO: 1070454 - RNA, 22 nt, Human
uuaguaugguguauaccacguu

SEQ ID NO: 1070455 - RNA, 20 nt, Human
uuccuggaacugauugguuu

SEQ ID NO: 1070456 - RNA, 22 nt, Human
uucuccugcaaaaccaaggcca

SEQ ID NO: 1070457 - RNA, 25 nt, Human
uucugaauccacagugucacagaga

SEQ ID NO: 1070458 - RNA, 23 nt, Human
uucugccagccacaccccaugcu

SEQ ID NO: 1070459 - RNA, 23 nt, Human
uugcugccaacaugguaucaguu

SEQ ID NO: 1070460 - RNA, 22 nt, Human
uugguugugcauauuuguccug

SEQ ID NO: 1070461 - RNA, 19 nt, Human
uuugagaaggggacccugc

SEQ ID NO: 1070462 - RNA, 21 nt, Human
uuuuacacugcccaguaauga

SEQ ID NO: 1070463 - RNA, 24 nt, Human
accaccaucaccaccaccaugcgc

SEQ ID NO: 1070464 - RNA, 23 nt, Human
accaugcgcuccacgaggcgccc

SEQ ID NO: 1070465 - RNA, 26 nt, Human
aggaccaucgagcagucuuugcuggc

SEQ ID NO: 1070466 - RNA, 24 nt, Human
aucgagcagucuuugcuggccacg

SEQ ID NO: 1070467 - RNA, 22 nt, Human
caccaucaccaccaccaugcgc

SEQ ID NO: 1070468 - RNA, 23 nt, Human
caccaucaccaccaccaugcgcu

SEQ ID NO: 1070469 - RNA, 20 nt, Human
caccaugcgcuccacgaggc

SEQ ID NO: 1070470 - RNA, 22 nt, Human
caccguggagacccuggagcac

SEQ ID NO: 1070471 - RNA, 18 nt, Human
ccacaagcagggggcacu

SEQ ID NO: 1070472 - RNA, 21 nt, Human
ccacaagcagggggcacugua

SEQ ID NO: 1070473 - RNA, 21 nt, Human
ccacggcaauggcaccccccu

SEQ ID NO: 1070474 - RNA, 27 nt, Human
ccgccgccaaccaccaccaucaccacc

SEQ ID NO: 1070475 - RNA, 27 nt, Human
ccggcagccgccgccaaccaccaccau

SEQ ID NO: 1070476 - RNA, 22 nt, Human
ccguggagacccuggagcacac

SEQ ID NO: 1070477 - RNA, 22 nt, Human
ccugcagccccucaaugccaag

SEQ ID NO: 1070478 - RNA, 18 nt, Human
cggagaucuggggucucc

SEQ ID NO: 1070479 - RNA, 22 nt, Human
cggcaauggcaccccccugcac

SEQ ID NO: 1070480 - RNA, 19 nt, Human
cggucaacaacgacucgga

SEQ ID NO: 1070481 - RNA, 20 nt, Human
cugcagcccuaccagcaccu

SEQ ID NO: 1070482 - RNA, 23 nt, Human
gaagccaaguuuaagcaggaccu

SEQ ID NO: 1070483 - RNA, 23 nt, Human
gcaauggcaccccccugcaccac

SEQ ID NO: 1070484 - RNA, 19 nt, Human
gcagcaucgccgaauugag

SEQ ID NO: 1070485 - RNA, 21 nt, Human
uacugggagcccgaggcccug

SEQ ID NO: 1070486 - RNA, 24 nt, Human
ucacagagacccacagcggucaaa

SEQ ID NO: 1070487 - RNA, 18 nt, Human
ucagccagucggagcuga

SEQ ID NO: 1070488 - RNA, 22 nt, Human
ugaacuguggacgaacagaccu

SEQ ID NO: 1070489 - RNA, 18 nt, Human
ugaccuggugucccgugc

SEQ ID NO: 1070490 - RNA, 19 nt, Human
uggacgaacagaccuggug

SEQ ID NO: 1070491 - RNA, 19 nt, Human
uguggacgaacagaccugg

SEQ ID NO: 1070492 - RNA, 22 nt, Human
aagggcagguggucucuugucu

SEQ ID NO: 1070493 - RNA, 24 nt, Human
acaacacagggcaggcaagaagac

SEQ ID NO: 1070494 - RNA, 22 nt, Human
aggaaaauuuguauuauuuuca

SEQ ID NO: 1070495 - RNA, 19 nt, Human
cacagggcaggcaagaaga

SEQ ID NO: 1070496 - RNA, 26 nt, Human
ccaagguggugaugguguuaacuccu

SEQ ID NO: 1070497 - RNA, 24 nt, Human
cuuucuuguucuccaccaaggugg

SEQ ID NO: 1070498 - RNA, 27 nt, Human
ggcaagaagacaaccagcucgauggaa

SEQ ID NO: 1070499 - RNA, 18 nt, Human
ggcaguucagggccuggg

SEQ ID NO: 1070500 - RNA, 24 nt, Human
gggcaggcaagaagacaaccagcu

SEQ ID NO: 1070501 - RNA, 21 nt, Human
uacaacacagggcaggcaaga

SEQ ID NO: 1070502 - RNA, 23 nt, Human
uacaacacagggcaggcaagaag

SEQ ID NO: 1070503 - RNA, 18 nt, Human
uguacagaaaacucaaca

SEQ ID NO: 1070504 - RNA, 23 nt, Human
uguucuccaccaagguggugaug

SEQ ID NO: 1070505 - RNA, 21 nt, Human
uuugugggccagcuuaagcag

SEQ ID NO: 1070506 - RNA, 25 nt, Human
aaaaugcucucugucccugugacug

SEQ ID NO: 1070507 - RNA, 20 nt, Human
aaacaaaagaggaugggugg

SEQ ID NO: 1070508 - RNA, 19 nt, Human
aaagugcugggauuacaga

SEQ ID NO: 1070509 - RNA, 24 nt, Human
aaagugcugggauuacagauguga

SEQ ID NO: 1070510 - RNA, 23 nt, Human
aacuggcccaggacacucuccca

SEQ ID NO: 1070511 - RNA, 18 nt, Human
aagacaagggccaugaac

SEQ ID NO: 1070512 - RNA, 18 nt, Human
aagugcugggauuacaga

SEQ ID NO: 1070513 - RNA, 19 nt, Human
aagugcugggauuacagau

SEQ ID NO: 1070514 - RNA, 24 nt, Human
aaugauucuccugccucagccucc

SEQ ID NO: 1070515 - RNA, 24 nt, Human
aauuuuguauuuuuaguagagaug

SEQ ID NO: 1070516 - RNA, 19 nt, Human
acauaccacuggauauccc

SEQ ID NO: 1070517 - RNA, 24 nt, Human
accaugguggccaggcuggucucg

SEQ ID NO: 1070518 - RNA, 24 nt, Human
acccaggcuggagugcaguggcau

SEQ ID NO: 1070519 - RNA, 18 nt, Human
acucugucacccaggcug

SEQ ID NO: 1070520 - RNA, 25 nt, Human
acucugucacccaggcuggagugca

SEQ ID NO: 1070521 - RNA, 22 nt, Human
acugcaaccuccaccucccggg

SEQ ID NO: 1070522 - RNA, 21 nt, Human
acuguaauuauacugccccca

SEQ ID NO: 1070523 - RNA, 22 nt, Human
agaaacuaagagauaggaagac

SEQ ID NO: 1070524 - RNA, 24 nt, Human
agaaacuaagagauaggaagacaa

SEQ ID NO: 1070525 - RNA, 18 nt, Human
agaaccucugagacucac

SEQ ID NO: 1070526 - RNA, 24 nt, Human
agagaugggguuucaccauggugg

SEQ ID NO: 1070527 - RNA, 19 nt, Human
agaugugagacaccgugcc

SEQ ID NO: 1070528 - RNA, 23 nt, Human
agaugugagacaccgugccuggu

SEQ ID NO: 1070529 - RNA, 23 nt, Human
agcaggaaugaaaaugcucucug

SEQ ID NO: 1070530 - RNA, 25 nt, Human
aggcuggagugcaguggcaugaucu

SEQ ID NO: 1070531 - RNA, 22 nt, Human
aguagagaugggguuucaccau

SEQ ID NO: 1070532 - RNA, 19 nt, Human
aguagcugggauuacaggc

SEQ ID NO: 1070533 - RNA, 23 nt, Human
aguagcugggauuacaggcgucc

SEQ ID NO: 1070534 - RNA, 19 nt, Human
agugcaguggcaugaucuc

SEQ ID NO: 1070535 - RNA, 21 nt, Human
agugcaguggcaugaucucag

SEQ ID NO: 1070536 - RNA, 23 nt, Human
agugcaguggcaugaucucagcu

SEQ ID NO: 1070537 - RNA, 24 nt, Human
aguggcaugaucucagcucacugc

SEQ ID NO: 1070538 - RNA, 24 nt, Human
augauucuccugccucagccuccc

SEQ ID NO: 1070539 - RNA, 19 nt, Human
augggguuucaccauggug

SEQ ID NO: 1070540 - RNA, 20 nt, Human
augggguuucaccauggugg

SEQ ID NO: 1070541 - RNA, 24 nt, Human
augggguuucaccaugguggccag

SEQ ID NO: 1070542 - RNA, 24 nt, Human
caaagugcugggauuacagaugug

SEQ ID NO: 1070543 - RNA, 22 nt, Human
caaaugauucuccugccucagc

SEQ ID NO: 1070544 - RNA, 19 nt, Human
caaccaucugcccaucagc

SEQ ID NO: 1070545 - RNA, 23 nt, Human
caaccuccaccucccggguucaa

SEQ ID NO: 1070546 - RNA, 24 nt, Human
caacugcaaccuccaccucccggg

SEQ ID NO: 1070547 - RNA, 19 nt, Human
caagugauccacccaccuc

SEQ ID NO: 1070548 - RNA, 23 nt, Human
caagugauccacccaccucgccc

SEQ ID NO: 1070549 - RNA, 22 nt, Human
caccagagggaaaagggucuca

SEQ ID NO: 1070550 - RNA, 21 nt, Human
caccaugguggccaggcuggu

SEQ ID NO: 1070551 - RNA, 22 nt, Human
caccaugguggccaggcugguc

SEQ ID NO: 1070552 - RNA, 24 nt, Human
caccaugguggccaggcuggucuc

SEQ ID NO: 1070553 - RNA, 22 nt, Human
cacccaccucgcccucccaaag

SEQ ID NO: 1070554 - RNA, 23 nt, Human
cacccaccucgcccucccaaagu

SEQ ID NO: 1070555 - RNA, 26 nt, Human
cacccaccucgcccucccaaagugcu

SEQ ID NO: 1070556 - RNA, 19 nt, Human
cacccagccuuuuccuauc

SEQ ID NO: 1070557 - RNA, 21 nt, Human
caccuaaagucauaucagacu

SEQ ID NO: 1070558 - RNA, 23 nt, Human
cacucugucacccaggcuggagu

SEQ ID NO: 1070559 - RNA, 24 nt, Human
cacucugucacccaggcuggagug

SEQ ID NO: 1070560 - RNA, 24 nt, Human
cacugcuggaguaggugcuacugg

SEQ ID NO: 1070561 - RNA, 21 nt, Human
cagccuucucuccccaguuuc

SEQ ID NO: 1070562 - RNA, 24 nt, Human
cagccuucucuccccaguuucuua

SEQ ID NO: 1070563 - RNA, 24 nt, Human
caguuguuucucuguccuuuagac

SEQ ID NO: 1070564 - RNA, 21 nt, Human
cauccucaaccaucugcccau

SEQ ID NO: 1070565 - RNA, 20 nt, Human
caucugcccaucagcagagc

SEQ ID NO: 1070566 - RNA, 21 nt, Human
ccaaagugcugggauuacaga

SEQ ID NO: 1070567 - RNA, 22 nt, Human
ccaaagugcugggauuacagau

SEQ ID NO: 1070568 - RNA, 24 nt, Human
ccaaagugcugggauuacagaugu

SEQ ID NO: 1070569 - RNA, 24 nt, Human
ccaccucccggguucaaaugauuc

SEQ ID NO: 1070570 - RNA, 20 nt, Human
cccaacucaugccccagauc

SEQ ID NO: 1070571 - RNA, 19 nt, Human
ccccuaaauuucgcuaggc

SEQ ID NO: 1070572 - RNA, 23 nt, Human
cccgaguagcugggauuacaggc

SEQ ID NO: 1070573 - RNA, 24 nt, Human
cccgaguagcugggauuacaggcg

SEQ ID NO: 1070574 - RNA, 21 nt, Human
cccggguucaaaugauucucc

SEQ ID NO: 1070575 - RNA, 23 nt, Human
cccggguucaaaugauucuccug

SEQ ID NO: 1070576 - RNA, 22 nt, Human
ccgaguagcugggauuacaggc

SEQ ID NO: 1070577 - RNA, 24 nt, Human
ccgaguagcugggauuacaggcgu

SEQ ID NO: 1070578 - RNA, 23 nt, Human
ccucaaccaucugcccaucagca

SEQ ID NO: 1070579 - RNA, 24 nt, Human
ccucccggguucaaaugauucucc

SEQ ID NO: 1070580 - RNA, 24 nt, Human
ccugaccucaagugauccacccac

SEQ ID NO: 1070581 - RNA, 23 nt, Human
ccugccucagccucccgaguagc

SEQ ID NO: 1070582 - RNA, 22 nt, Human
ccuguggugcaguguguuggaa

SEQ ID NO: 1070583 - RNA, 19 nt, Human
ccuuuccuuuuaacucuuu

SEQ ID NO: 1070584 - RNA, 18 nt, Human
cggaagugggagccuuau

SEQ ID NO: 1070585 - RNA, 24 nt, Human
cuaauuuuguauuuuuaguagaga

SEQ ID NO: 1070586 - RNA, 19 nt, Human
cuauucagucccacaccca

SEQ ID NO: 1070587 - RNA, 24 nt, Human
cucacucugucacccaggcuggag

SEQ ID NO: 1070588 - RNA, 24 nt, Human
cucagccucccgaguagcugggau

SEQ ID NO: 1070589 - RNA, 21 nt, Human
cucccuuuccuuuuaacucuu

SEQ ID NO: 1070590 - RNA, 19 nt, Human
cucugagacucaccgucua

SEQ ID NO: 1070591 - RNA, 18 nt, Human
cugcaaccuccaccuccc

SEQ ID NO: 1070592 - RNA, 21 nt, Human
cugcaaccuccaccucccggg

SEQ ID NO: 1070593 - RNA, 23 nt, Human
cugcaaccuccaccucccggguu

SEQ ID NO: 1070594 - RNA, 24 nt, Human
cugcaaccuccgccugccggguuc

SEQ ID NO: 1070595 - RNA, 23 nt, Human
cugccucagccucccgaguagcu

SEQ ID NO: 1070596 - RNA, 24 nt, Human
cuggagugcaguggcaugaucuca

SEQ ID NO: 1070597 - RNA, 24 nt, Human
cugucccugugacuguccagaacc

SEQ ID NO: 1070598 - RNA, 24 nt, Human
gaccucaagugauccacccaccuc

SEQ ID NO: 1070599 - RNA, 21 nt, Human
gagaugggguuucaccauggu

SEQ ID NO: 1070600 - RNA, 23 nt, Human
gaggaugggugggauuggccugg

SEQ ID NO: 1070601 - RNA, 23 nt, Human
gauauccccuucuggcaguucua

SEQ ID NO: 1070602 - RNA, 18 nt, Human
gauuacagaugugagaca

SEQ ID NO: 1070603 - RNA, 20 nt, Human
gauuacagaugugagacacc

SEQ ID NO: 1070604 - RNA, 19 nt, Human
gauuacaggcguccaccac

SEQ ID NO: 1070605 - RNA, 18 nt, Human
gcaaccuccaccucccgg

SEQ ID NO: 1070606 - RNA, 22 nt, Human
gcaaccuccaccucccggguuc

SEQ ID NO: 1070607 - RNA, 22 nt, Human
gcaaccuccgccugccggguuc

SEQ ID NO: 1070608 - RNA, 20 nt, Human
gccacuggcugguaacaucu

SEQ ID NO: 1070609 - RNA, 18 nt, Human
gcucccgggccacagccu

SEQ ID NO: 1070610 - RNA, 19 nt, Human
gcuggagugcaguggcaug

SEQ ID NO: 1070611 - RNA, 23 nt, Human
gcuggucucgaacuccugaccuc

SEQ ID NO: 1070612 - RNA, 19 nt, Human
ggaagacugucauguagug

SEQ ID NO: 1070613 - RNA, 25 nt, Human
ggacccuagcaucgucuagggaaca

SEQ ID NO: 1070614 - RNA, 18 nt, Human
ggagaaguggcauauucc

SEQ ID NO: 1070615 - RNA, 24 nt, Human
ggcuggucucgaacuccugaccuc

SEQ ID NO: 1070616 - RNA, 25 nt, Human
ggggugugcuaugaugagcaguugu

SEQ ID NO: 1070617 - RNA, 22 nt, Human
gggguuucaccaugguggccag

SEQ ID NO: 1070618 - RNA, 19 nt, Human
ggucucgaacuccugaccu

SEQ ID NO: 1070619 - RNA, 25 nt, Human
guagcccaacuggcccaggacacuc

SEQ ID NO: 1070620 - RNA, 18 nt, Human
guagcugggauuacaggc

SEQ ID NO: 1070621 - RNA, 18 nt, Human
guagcugggauuacaggc

SEQ ID NO: 1070622 - RNA, 21 nt, Human
gucuuuuuuuucccucccuca

SEQ ID NO: 1070623 - RNA, 24 nt, Human
gugauccacccaccucgcccuccc

SEQ ID NO: 1070624 - RNA, 21 nt, Human
uaagaagccugaccuuucauc

SEQ ID NO: 1070625 - RNA, 20 nt, Human
uagcaucgucuagggaacag

SEQ ID NO: 1070626 - RNA, 21 nt, Human
uaggcuccccuggggcccugu

SEQ ID NO: 1070627 - RNA, 24 nt, Human
uaguagagaugggguuucaccaug

SEQ ID NO: 1070628 - RNA, 25 nt, Human
uaguagagaugggguuucaccaugg

SEQ ID NO: 1070629 - RNA, 24 nt, Human
uauccccuucuggcaguucuaaac

SEQ ID NO: 1070630 - RNA, 19 nt, Human
ucaaaugauucuccugccu

SEQ ID NO: 1070631 - RNA, 20 nt, Human
ucaagugauccacccaccuc

SEQ ID NO: 1070632 - RNA, 24 nt, Human
ucacccaggcuggagugcaguggc

SEQ ID NO: 1070633 - RNA, 24 nt, Human
ucacucugucacccaggcuggagu

SEQ ID NO: 1070634 - RNA, 18 nt, Human
ucacugcaaccuccgccu

SEQ ID NO: 1070635 - RNA, 19 nt, Human
ucacugcaaccuccgccug

SEQ ID NO: 1070636 - RNA, 20 nt, Human
ucacugcaaccuccgccugc

SEQ ID NO: 1070637 - RNA, 24 nt, Human
ucacugcaaccuccgccugccggg

SEQ ID NO: 1070638 - RNA, 20 nt, Human
ucagccucccgaguagcugg

SEQ ID NO: 1070639 - RNA, 20 nt, Human
uccacccaccucgcccuccc

SEQ ID NO: 1070640 - RNA, 18 nt, Human
ucccaaagugcugggauu

SEQ ID NO: 1070641 - RNA, 23 nt, Human
ucccaaagugcugggauuacaga

SEQ ID NO: 1070642 - RNA, 19 nt, Human
uccccaguuucuuauucca

SEQ ID NO: 1070643 - RNA, 24 nt, Human
ucccgaguagcugggauuacaggc

SEQ ID NO: 1070644 - RNA, 21 nt, Human
ucccggguucaaaugauucuc

SEQ ID NO: 1070645 - RNA, 24 nt, Human
ucccggguucaaaugauucuccug

SEQ ID NO: 1070646 - RNA, 22 nt, Human
ucccucauccccauucccccac

SEQ ID NO: 1070647 - RNA, 25 nt, Human
uccuuuagacucuacuaaaucuuuc

SEQ ID NO: 1070648 - RNA, 18 nt, Human
ucgcccucccaaagugcu

SEQ ID NO: 1070649 - RNA, 23 nt, Human
ucuaaaccagccuugcccggaag

SEQ ID NO: 1070650 - RNA, 23 nt, Human
ucuaaaccagccuugcccggaag

SEQ ID NO: 1070651 - RNA, 19 nt, Human
ucuaagaauuucuaacuuc

SEQ ID NO: 1070652 - RNA, 23 nt, Human
ucucacucugucacccaggcugg

SEQ ID NO: 1070653 - RNA, 24 nt, Human
ucucacucugucacccaggcugga

SEQ ID NO: 1070654 - RNA, 26 nt, Human
ucucacucugucacccaggcuggagu

SEQ ID NO: 1070655 - RNA, 27 nt, Human
ucucacucugucacccaggcuggagug

SEQ ID NO: 1070656 - RNA, 23 nt, Human
ucucccacagcaggaaugaaaau

SEQ ID NO: 1070657 - RNA, 24 nt, Human
ucuccugccucagccucccgagua

SEQ ID NO: 1070658 - RNA, 21 nt, Human
ucucgaacuccugaccucaag

SEQ ID NO: 1070659 - RNA, 20 nt, Human
ucuggcaguucuaaaccagc

SEQ ID NO: 1070660 - RNA, 24 nt, Human
ucuguaccugacauauuuuguuuu

SEQ ID NO: 1070661 - RNA, 24 nt, Human
ucugucacccaggcuggagugcag

SEQ ID NO: 1070662 - RNA, 23 nt, Human
ucuuuuuuuucccucccucaucc

SEQ ID NO: 1070663 - RNA, 24 nt, Human
ugacuguccagaaccucugagacu

SEQ ID NO: 1070664 - RNA, 20 nt, Human
ugagacaccgugccuggugg

SEQ ID NO: 1070665 - RNA, 24 nt, Human
ugauccacccaccucgcccuccca

SEQ ID NO: 1070666 - RNA, 19 nt, Human
ugauccuaaacugcugcug

SEQ ID NO: 1070667 - RNA, 20 nt, Human
ugauucuccugccucagccu

SEQ ID NO: 1070668 - RNA, 22 nt, Human
ugcaguggcaugaucucagcuc

SEQ ID NO: 1070669 - RNA, 25 nt, Human
ugcccccaacucaugccccagaucu

SEQ ID NO: 1070670 - RNA, 24 nt, Human
ugccucagccucccgaguagcugg

SEQ ID NO: 1070671 - RNA, 19 nt, Human
ugcucccgggccacagccu

SEQ ID NO: 1070672 - RNA, 22 nt, Human
ugcucucugucccugugacugu

SEQ ID NO: 1070673 - RNA, 18 nt, Human
ugcugggauuacagaugu

SEQ ID NO: 1070674 - RNA, 24 nt, Human
ugcugggauuacagaugugagaca

SEQ ID NO: 1070675 - RNA, 19 nt, Human
uggagugcaguggcaugau

SEQ ID NO: 1070676 - RNA, 24 nt, Human
uggagugcaguggcaugaucucag

SEQ ID NO: 1070677 - RNA, 24 nt, Human
uggcaugaucucagcucacugcaa

SEQ ID NO: 1070678 - RNA, 24 nt, Human
uggccaggcuggucucgaacuccu

SEQ ID NO: 1070679 - RNA, 20 nt, Human
ugggacccuagcaucgucuu

SEQ ID NO: 1070680 - RNA, 18 nt, Human
ugggauuacagaugugag

SEQ ID NO: 1070681 - RNA, 19 nt, Human
ugggauuacagaugugaga

SEQ ID NO: 1070682 - RNA, 20 nt, Human
ugggauuacagaugugagac

SEQ ID NO: 1070683 - RNA, 21 nt, Human
ugggauuacagaugugagaca

SEQ ID NO: 1070684 - RNA, 23 nt, Human
ugggauuacagaugugagacacc

SEQ ID NO: 1070685 - RNA, 23 nt, Human
ugggauuacagaugugagacacc

SEQ ID NO: 1070686 - RNA, 24 nt, Human
ugggauuacagaugugagacaccg

SEQ ID NO: 1070687 - RNA, 18 nt, Human
ugggauuacaggcgucca

SEQ ID NO: 1070688 - RNA, 21 nt, Human
ugggauuacaggcguccacca

SEQ ID NO: 1070689 - RNA, 24 nt, Human
ugggauuacaggcguccaccacca

SEQ ID NO: 1070690 - RNA, 25 nt, Human
ugggauuacaggcguccaccaccau

SEQ ID NO: 1070691 - RNA, 22 nt, Human
ugggauuggccuggauuggggc

SEQ ID NO: 1070692 - RNA, 24 nt, Human
ugggguuucaccaugguggccagg

SEQ ID NO: 1070693 - RNA, 19 nt, Human
ugggugggauuggccugga

SEQ ID NO: 1070694 - RNA, 23 nt, Human
ugggugggauuggccuggauugg

SEQ ID NO: 1070695 - RNA, 24 nt, Human
ugggugggauuggccuggauuggg

SEQ ID NO: 1070696 - RNA, 19 nt, Human
ugguggccaggcuggucuc

SEQ ID NO: 1070697 - RNA, 21 nt, Human
uguauuuuuaguagagauggg

SEQ ID NO: 1070698 - RNA, 19 nt, Human
uguccagaaccucugagac

SEQ ID NO: 1070699 - RNA, 21 nt, Human
ugucuuuuuuuucccucccuc

SEQ ID NO: 1070700 - RNA, 23 nt, Human
ugugacugauucugccauccaaa

SEQ ID NO: 1070701 - RNA, 18 nt, Human
uuaguagagaugggguuu

SEQ ID NO: 1070702 - RNA, 22 nt, Human
uuaguagagaugggguuucacc

SEQ ID NO: 1070703 - RNA, 24 nt, Human
uuaguagagaugggguuucaccau

SEQ ID NO: 1070704 - RNA, 21 nt, Human
uuauacugcccccaacucaug

SEQ ID NO: 1070705 - RNA, 23 nt, Human
uucaaaugauucuccugccucag

SEQ ID NO: 1070706 - RNA, 24 nt, Human
uucaaaugauucuccugccucagc

SEQ ID NO: 1070707 - RNA, 19 nt, Human
uucgcuaggcuccccuggg

SEQ ID NO: 1070708 - RNA, 21 nt, Human
uugauuuucucaccucugggg

SEQ ID NO: 1070709 - RNA, 23 nt, Human
uuguauuuuuaguagagaugggg

SEQ ID NO: 1070710 - RNA, 21 nt, Human
uuucaccaugguggccaggcu

SEQ ID NO: 1070711 - RNA, 20 nt, Human
uuucuuggccccuaaauuuc

SEQ ID NO: 1070712 - RNA, 22 nt, Human
uuuuaagaggauuaaacaaaag

SEQ ID NO: 1070713 - RNA, 19 nt, Human
uuuuguauuuuuaguagag

SEQ ID NO: 1070714 - RNA, 20 nt, Human
uuuuguauuuuuaguagaga

SEQ ID NO: 1070715 - RNA, 24 nt, Human
uuuuuaguagagaugggguuucac

SEQ ID NO: 1070716 - RNA, 22 nt, Human
aaaaaaaaaaagcaaaauaaaa

SEQ ID NO: 1070717 - RNA, 27 nt, Human
aaaaaaaaaaagcaaaauaaaauugua

SEQ ID NO: 1070718 - RNA, 18 nt, Human
aaaaauagcuggccauag

SEQ ID NO: 1070719 - RNA, 19 nt, Human
aacacgguggcucacaccc

SEQ ID NO: 1070720 - RNA, 27 nt, Human
aagaagcuccagcauacuuuacaaccc

SEQ ID NO: 1070721 - RNA, 26 nt, Human
aagcaaaauaaaauuguaugagccua

SEQ ID NO: 1070722 - RNA, 19 nt, Human
aagcucaggaagcccccug

SEQ ID NO: 1070723 - RNA, 21 nt, Human
acacaacaaaaauacaccaag

SEQ ID NO: 1070724 - RNA, 22 nt, Human
accacugcacuccagccugggc

SEQ ID NO: 1070725 - RNA, 18 nt, Human
accccagccuccucccag

SEQ ID NO: 1070726 - RNA, 18 nt, Human
accuccuggcuccaucuc

SEQ ID NO: 1070727 - RNA, 21 nt, Human
acgugugugccccagggcccc

SEQ ID NO: 1070728 - RNA, 24 nt, Human
acugcacuccagccugggcaacag

SEQ ID NO: 1070729 - RNA, 24 nt, Human
acugcacuccagccugggcaacag

SEQ ID NO: 1070730 - RNA, 21 nt, Human
acuuaaaaaacaaacacacaa

SEQ ID NO: 1070731 - RNA, 23 nt, Human
agacaggaggaucgcuugggucc

SEQ ID NO: 1070732 - RNA, 24 nt, Human
agacaggaggaucgcuugggucca

SEQ ID NO: 1070733 - RNA, 19 nt, Human
agaccauagaugaagcauu

SEQ ID NO: 1070734 - RNA, 23 nt, Human
agcuacuuguaggcugagguggg

SEQ ID NO: 1070735 - RNA, 23 nt, Human
agcuaggcgugguggugcacgcc

SEQ ID NO: 1070736 - RNA, 19 nt, Human
aggaagacuugcaaaggug

SEQ ID NO: 1070737 - RNA, 18 nt, Human
aggaggaucgcuuggguc

SEQ ID NO: 1070738 - RNA, 24 nt, Human
aggaucgcuuggguccaggaguuu

SEQ ID NO: 1070739 - RNA, 24 nt, Human
aggccgagacaggaggaucgcuug

SEQ ID NO: 1070740 - RNA, 24 nt, Human
aggcgugguggugcacgccuguag

SEQ ID NO: 1070741 - RNA, 23 nt, Human
aggcugaggugggaggaucagug

SEQ ID NO: 1070742 - RNA, 19 nt, Human
agggccccggggcccgggg

SEQ ID NO: 1070743 - RNA, 22 nt, Human
aggguucuucucacuucccagg

SEQ ID NO: 1070744 - RNA, 24 nt, Human
agucagccugaaagccaggucauu

SEQ ID NO: 1070745 - RNA, 18 nt, Human
aucaugucaagugugagg

SEQ ID NO: 1070746 - RNA, 24 nt, Human
aucgcuuggguccaggaguuuaag

SEQ ID NO: 1070747 - RNA, 22 nt, Human
aucuccucucccugcaccccag

SEQ ID NO: 1070748 - RNA, 24 nt, Human
augguugguuaaaaaaaaaaaagc

SEQ ID NO: 1070749 - RNA, 24 nt, Human
auugcaccacugcacuccagccug

SEQ ID NO: 1070750 - RNA, 28 nt, Human
auugcaccacugcacuccagccugggca

SEQ ID NO: 1070751 - RNA, 20 nt, Human
caaaauagcugggcaaaggc

SEQ ID NO: 1070752 - RNA, 22 nt, Human
caaagcagaccauagaugaagc

SEQ ID NO: 1070753 - RNA, 19 nt, Human
caacaaaaauacaccaagc

SEQ ID NO: 1070754 - RNA, 18 nt, Human
caacacuuugggaggccg

SEQ ID NO: 1070755 - RNA, 24 nt, Human
caacacuuugggaggccgagacag

SEQ ID NO: 1070756 - RNA, 24 nt, Human
caacuuaaaaaacaaacacacaac

SEQ ID NO: 1070757 - RNA, 21 nt, Human
caagaggagacccguugggug

SEQ ID NO: 1070758 - RNA, 18 nt, Human
cacaacaaaaauacacca

SEQ ID NO: 1070759 - RNA, 21 nt, Human
caccaagcucaggaagccccc

SEQ ID NO: 1070760 - RNA, 22 nt, Human
caccccagccuccucccagcuu

SEQ ID NO: 1070761 - RNA, 23 nt, Human
cacgccuguagucccagcuacuu

SEQ ID NO: 1070762 - RNA, 24 nt, Human
cacuccagccugggcaacagagcg

SEQ ID NO: 1070763 - RNA, 19 nt, Human
cacugcacuccagccuggg

SEQ ID NO: 1070764 - RNA, 21 nt, Human
cacugcacuccagccugggca

SEQ ID NO: 1070765 - RNA, 22 nt, Human
cacugcacuccagccugggcaa

SEQ ID NO: 1070766 - RNA, 23 nt, Human
cacugcacuccagccugggcaac

SEQ ID NO: 1070767 - RNA, 24 nt, Human
cacugcacuccagccugggcaaca

SEQ ID NO: 1070768 - RNA, 25 nt, Human
cacugcacuccagccugggcaacaa

SEQ ID NO: 1070769 - RNA, 26 nt, Human
cagcacacaguaggcaugcacaguag

SEQ ID NO: 1070770 - RNA, 21 nt, Human
cagcauacuuuacaacccauc

SEQ ID NO: 1070771 - RNA, 25 nt, Human
cagggccagcagguaacacccauga

SEQ ID NO: 1070772 - RNA, 18 nt, Human
caucacccacaccccagc

SEQ ID NO: 1070773 - RNA, 19 nt, Human
cauuccagcaggaugacuu

SEQ ID NO: 1070774 - RNA, 25 nt, Human
ccaacacgguggcucacacccauaa

SEQ ID NO: 1070775 - RNA, 20 nt, Human
ccaacuaggaacuguccucc

SEQ ID NO: 1070776 - RNA, 20 nt, Human
ccacugcacuccagccuggg

SEQ ID NO: 1070777 - RNA, 21 nt, Human
ccacugcacuccagccugggc

SEQ ID NO: 1070778 - RNA, 23 nt, Human
ccacugcacuccagccugggcaa

SEQ ID NO: 1070779 - RNA, 24 nt, Human
ccacugcacuccagccugggcaac

SEQ ID NO: 1070780 - RNA, 20 nt, Human
ccacugcccaauuccaacug

SEQ ID NO: 1070781 - RNA, 18 nt, Human
ccagggccccggggcccg

SEQ ID NO: 1070782 - RNA, 21 nt, Human
cccaacacgguggcucacacc

SEQ ID NO: 1070783 - RNA, 22 nt, Human
cccaacuuaaaaaacaaacaca

SEQ ID NO: 1070784 - RNA, 23 nt, Human
cccacaccccagcacagugauua

SEQ ID NO: 1070785 - RNA, 18 nt, Human
cccacuuccucggccccc

SEQ ID NO: 1070786 - RNA, 22 nt, Human
cccagaucccggcucaggaaac

SEQ ID NO: 1070787 - RNA, 22 nt, Human
cccauaaucccaacacuuuggg

SEQ ID NO: 1070788 - RNA, 18 nt, Human
cccaucacccacacccca

SEQ ID NO: 1070789 - RNA, 23 nt, Human
cccaucacccacaccccagcacc

SEQ ID NO: 1070790 - RNA, 23 nt, Human
cccaugacugaagguggcggggc

SEQ ID NO: 1070791 - RNA, 21 nt, Human
ccccaaaaacucccaacuuaa

SEQ ID NO: 1070792 - RNA, 21 nt, Human
ccccacuuccucggcccccag

SEQ ID NO: 1070793 - RNA, 18 nt, Human
ccccagaucccggcucag

SEQ ID NO: 1070794 - RNA, 21 nt, Human
ccccagggccccggggcccgg

SEQ ID NO: 1070795 - RNA, 19 nt, Human
cccccaucacccacacccc

SEQ ID NO: 1070796 - RNA, 21 nt, Human
cccccuggcaucauacacaaa

SEQ ID NO: 1070797 - RNA, 28 nt, Human
ccccggggcccgggguaccgagggcucc

SEQ ID NO: 1070798 - RNA, 20 nt, Human
cccuagauaagaggaugacc

SEQ ID NO: 1070799 - RNA, 18 nt, Human
ccgguuacagguguaagg

SEQ ID NO: 1070800 - RNA, 18 nt, Human
ccucccccaucacccaca

SEQ ID NO: 1070801 - RNA, 19 nt, Human
ccuccucccagcuugucac

SEQ ID NO: 1070802 - RNA, 24 nt, Human
ccugcaccccagccuccucccagc

SEQ ID NO: 1070803 - RNA, 19 nt, Human
ccugggcucaagcgauugu

SEQ ID NO: 1070804 - RNA, 23 nt, Human
ccuguagucccagcuacuuguag

SEQ ID NO: 1070805 - RNA, 24 nt, Human
cgaaaaaaauagcuggccauagca

SEQ ID NO: 1070806 - RNA, 22 nt, Human
cgccuguagucccagcuacuug

SEQ ID NO: 1070807 - RNA, 26 nt, Human
cgccuguagucccagcuacuuguagg

SEQ ID NO: 1070808 - RNA, 19 nt, Human
cgggaacacaaaaaguagc

SEQ ID NO: 1070809 - RNA, 22 nt, Human
cucacacccauaaucccaacac

SEQ ID NO: 1070810 - RNA, 23 nt, Human
cucagccaaaugccugcagggcc

SEQ ID NO: 1070811 - RNA, 21 nt, Human
cuccagaaacgugcaagagga

SEQ ID NO: 1070812 - RNA, 23 nt, Human
cucccccaucacccacaccccag

SEQ ID NO: 1070813 - RNA, 18 nt, Human
cuccucucccugcacccc

SEQ ID NO: 1070814 - RNA, 19 nt, Human
cuccucucccugcacccca

SEQ ID NO: 1070815 - RNA, 18 nt, Human
cugcaccccagccuccuc

SEQ ID NO: 1070816 - RNA, 19 nt, Human
cuucccagguuccuggugu

SEQ ID NO: 1070817 - RNA, 22 nt, Human
cuugcugcuaagaagcuccagc

SEQ ID NO: 1070818 - RNA, 18 nt, Human
gaauaaccuaggauuuac

SEQ ID NO: 1070819 - RNA, 23 nt, Human
gacaaccaccuuucacguccaga

SEQ ID NO: 1070820 - RNA, 24 nt, Human
gagagguggaacaaauuugggcuc

SEQ ID NO: 1070821 - RNA, 24 nt, Human
gaucgcuuggguccaggaguuuaa

SEQ ID NO: 1070822 - RNA, 19 nt, Human
gcaaagguguguagggaag

SEQ ID NO: 1070823 - RNA, 24 nt, Human
gcacuccagccugggcaacagagc

SEQ ID NO: 1070824 - RNA, 24 nt, Human
gccaaguauuucaaaauaaaaagc

SEQ ID NO: 1070825 - RNA, 19 nt, Human
gcccaacacgguggcucac

SEQ ID NO: 1070826 - RNA, 20 nt, Human
gcccccaggaaggaugcuug

SEQ ID NO: 1070827 - RNA, 23 nt, Human
gcuccagcauacuuuacaaccca

SEQ ID NO: 1070828 - RNA, 19 nt, Human
gcugagccgaguguccagg

SEQ ID NO: 1070829 - RNA, 21 nt, Human
gcugggcuggacgugugugcc

SEQ ID NO: 1070830 - RNA, 19 nt, Human
gcuggucggcacaggaaga

SEQ ID NO: 1070831 - RNA, 22 nt, Human
ggaucgcuuggguccaggaguu

SEQ ID NO: 1070832 - RNA, 21 nt, Human
ggcauugaaugucaggagaaa

SEQ ID NO: 1070833 - RNA, 21 nt, Human
ggcccgggguaccgagggcuc

SEQ ID NO: 1070834 - RNA, 18 nt, Human
gggaacacaaaaaguagc

SEQ ID NO: 1070835 - RNA, 21 nt, Human
gggcggguggcagucagccug

SEQ ID NO: 1070836 - RNA, 20 nt, Human
ggguggcagucagccugaaa

SEQ ID NO: 1070837 - RNA, 24 nt, Human
gguggugcacgccuguagucccag

SEQ ID NO: 1070838 - RNA, 20 nt, Human
gguugguuaaaaaaaaaaaa

SEQ ID NO: 1070839 - RNA, 23 nt, Human
gucacacucccagcacacaguag

SEQ ID NO: 1070840 - RNA, 22 nt, Human
guuaaaaaaaaaaaagcaaaau

SEQ ID NO: 1070841 - RNA, 21 nt, Human
guugccagaccuucagauuuu

SEQ ID NO: 1070842 - RNA, 22 nt, Human
uaaaaaacaaacacacaacaaa

SEQ ID NO: 1070843 - RNA, 23 nt, Human
uaaaaaacaaacacacaacaaaa

SEQ ID NO: 1070844 - RNA, 21 nt, Human
uaaaaaacaaacacacaacca

SEQ ID NO: 1070845 - RNA, 22 nt, Human
uaaauucaaauauauauaaaua

SEQ ID NO: 1070846 - RNA, 22 nt, Human
uaggaacuguccucccccauca

SEQ ID NO: 1070847 - RNA, 23 nt, Human
uaugcccuagauaagaggaugac

SEQ ID NO: 1070848 - RNA, 23 nt, Human
uccagccugggcaacagagcgag

SEQ ID NO: 1070849 - RNA, 24 nt, Human
uccagccugggcaacagagcgaga

SEQ ID NO: 1070850 - RNA, 19 nt, Human
ucccaacuuaaaaaacaaa

SEQ ID NO: 1070851 - RNA, 23 nt, Human
ucccaggguucuucucacuuccc

SEQ ID NO: 1070852 - RNA, 22 nt, Human
uccucccagcuugucacacucc

SEQ ID NO: 1070853 - RNA, 24 nt, Human
uccucccccaucacccacacccca

SEQ ID NO: 1070854 - RNA, 19 nt, Human
ugagccgaguguccagggc

SEQ ID NO: 1070855 - RNA, 21 nt, Human
ugaggugggaggaucagugca

SEQ ID NO: 1070856 - RNA, 22 nt, Human
ugcaagaggagacccguugggu

SEQ ID NO: 1070857 - RNA, 21 nt, Human
ugcacaguaggcaugcuggug

SEQ ID NO: 1070858 - RNA, 21 nt, Human
ugcaccacugcacuccagccu

SEQ ID NO: 1070859 - RNA, 24 nt, Human
ugcaggaaacacugcaaacagcug

SEQ ID NO: 1070860 - RNA, 21 nt, Human
ugggaggaucagugcaguggu

SEQ ID NO: 1070861 - RNA, 23 nt, Human
ugggaggccgagacaggaggauc

SEQ ID NO: 1070862 - RNA, 19 nt, Human
ugggcuggacgugugugcc

SEQ ID NO: 1070863 - RNA, 19 nt, Human
uggguggagcagacccggg

SEQ ID NO: 1070864 - RNA, 21 nt, Human
uggucggcacaggaagacuug

SEQ ID NO: 1070865 - RNA, 18 nt, Human
uggugcacgccuguaguc

SEQ ID NO: 1070866 - RNA, 21 nt, Human
uggugcacgccuguaguccca

SEQ ID NO: 1070867 - RNA, 24 nt, Human
ugguggugcacgccuguaguccca

SEQ ID NO: 1070868 - RNA, 21 nt, Human
uguaagcaccccuccaauucu

SEQ ID NO: 1070869 - RNA, 24 nt, Human
uguagggaaguccaccgguuacag

SEQ ID NO: 1070870 - RNA, 22 nt, Human
ugucaggagaaaaauuuuuuuc

SEQ ID NO: 1070871 - RNA, 23 nt, Human
uuaagaccagccugggcucaagc

SEQ ID NO: 1070872 - RNA, 20 nt, Human
uuagcuaggcgugguggugc

SEQ ID NO: 1070873 - RNA, 24 nt, Human
uuagcuaggcgugguggugcacgc

SEQ ID NO: 1070874 - RNA, 24 nt, Human
uucaaaauaaaaagcuuuuccaaa

SEQ ID NO: 1070875 - RNA, 19 nt, Human
uuccaacugggaaagcagg

SEQ ID NO: 1070876 - RNA, 23 nt, Human
uuccaacugggaaagcaggcccc

SEQ ID NO: 1070877 - RNA, 21 nt, Human
uucuucucacuucccagguuc

SEQ ID NO: 1070878 - RNA, 23 nt, Human
uugcaccacugcacuccagccug

SEQ ID NO: 1070879 - RNA, 23 nt, Human
uugcugcuaagaagcuccagcug

SEQ ID NO: 1070880 - RNA, 24 nt, Human
uugggaggccgagacaggaggauc

SEQ ID NO: 1070881 - RNA, 22 nt, Human
uuggguccaggaguuuaagacc

SEQ ID NO: 1070882 - RNA, 19 nt, Human
uuggguggagcagacccgg

SEQ ID NO: 1070883 - RNA, 20 nt, Human
uuguaggcugaggugggagg

SEQ ID NO: 1070884 - RNA, 18 nt, Human
uuuguaagcaccccucca

SEQ ID NO: 1070885 - RNA, 18 nt, Human
aaaaaccuguccagccgc

SEQ ID NO: 1070886 - RNA, 20 nt, Human
aaaaggaacggaacauggug

SEQ ID NO: 1070887 - RNA, 21 nt, Human
aaaccgccauuuacacaacaa

SEQ ID NO: 1070888 - RNA, 22 nt, Human
aaagcagagaugucgagggccc

SEQ ID NO: 1070889 - RNA, 22 nt, Human
aaagcucuucaaccucccaccu

SEQ ID NO: 1070890 - RNA, 24 nt, Human
aaccaucucuucaaaggagcccug

SEQ ID NO: 1070891 - RNA, 21 nt, Human
aaccucccaccuugcuguccc

SEQ ID NO: 1070892 - RNA, 20 nt, Human
aacgucagcaacagacagag

SEQ ID NO: 1070893 - RNA, 22 nt, Human
aacuucuaggcucaagcaaucc

SEQ ID NO: 1070894 - RNA, 20 nt, Human
aagaaaagcccucaguggcg

SEQ ID NO: 1070895 - RNA, 21 nt, Human
aaguagcugggaccacaggca

SEQ ID NO: 1070896 - RNA, 25 nt, Human
aaguagcugggaccacaggcacuca

SEQ ID NO: 1070897 - RNA, 23 nt, Human
acacacacacacacacacgcaua

SEQ ID NO: 1070898 - RNA, 23 nt, Human
acacacacacacgcauacacaca

SEQ ID NO: 1070899 - RNA, 29 nt, Human
acacacacacgcauacacacaaagucaac

SEQ ID NO: 1070900 - RNA, 19 nt, Human
acacaccacauccccgugc

SEQ ID NO: 1070901 - RNA, 19 nt, Human
acacgcacacgcgcgcgug

SEQ ID NO: 1070902 - RNA, 21 nt, Human
acagugugacuggggcaugga

SEQ ID NO: 1070903 - RNA, 19 nt, Human
accauggaaggcagcagug

SEQ ID NO: 1070904 - RNA, 26 nt, Human
acccaggcuggagugcaguguggcau

SEQ ID NO: 1070905 - RNA, 19 nt, Human
acggagaugaggugggugu

SEQ ID NO: 1070906 - RNA, 21 nt, Human
agaugucgagggcccggagcc

SEQ ID NO: 1070907 - RNA, 19 nt, Human
agccacacaccacaucccc

SEQ ID NO: 1070908 - RNA, 20 nt, Human
agcucacugcaacuucuagg

SEQ ID NO: 1070909 - RNA, 22 nt, Human
agcuguggggcccgggcugagc

SEQ ID NO: 1070910 - RNA, 21 nt, Human
aggcagcagugcagugcaggg

SEQ ID NO: 1070911 - RNA, 24 nt, Human
agggcaauuuaucagaaacccgcc

SEQ ID NO: 1070912 - RNA, 23 nt, Human
aggguuuugcucugucacccagg

SEQ ID NO: 1070913 - RNA, 23 nt, Human
agguggguuccucuggggccggg

SEQ ID NO: 1070914 - RNA, 25 nt, Human
agugcaguguggcaugaucauagcu

SEQ ID NO: 1070915 - RNA, 18 nt, Human
auagcucacugcaacuuc

SEQ ID NO: 1070916 - RNA, 22 nt, Human
augcaaauauaguuuaaaaaau

SEQ ID NO: 1070917 - RNA, 20 nt, Human
augcugcugagccucaaagc

SEQ ID NO: 1070918 - RNA, 22 nt, Human
augcugcugagccucaaagcuc

SEQ ID NO: 1070919 - RNA, 24 nt, Human
caaaacaaaauuccaugaagucaa

SEQ ID NO: 1070920 - RNA, 28 nt, Human
caaaauuccaugaagucaacacgcacac

SEQ ID NO: 1070921 - RNA, 18 nt, Human
caaagcucuucaaccucc

SEQ ID NO: 1070922 - RNA, 21 nt, Human
caacacgcacacgcgcgcgug

SEQ ID NO: 1070923 - RNA, 24 nt, Human
caacuucuaggcucaagcaauccu

SEQ ID NO: 1070924 - RNA, 18 nt, Human
cacacacacacacacaca

SEQ ID NO: 1070925 - RNA, 25 nt, Human
cacacacacacacacacacgcauac

SEQ ID NO: 1070926 - RNA, 26 nt, Human
cacacacacacacacacgcauacaca

SEQ ID NO: 1070927 - RNA, 26 nt, Human
cacacacacacacacgcauacacaca

SEQ ID NO: 1070928 - RNA, 21 nt, Human
cacacaccacauccccgugca

SEQ ID NO: 1070929 - RNA, 19 nt, Human
cacgcacacgcgcgcgugc

SEQ ID NO: 1070930 - RNA, 31 nt, Human
cacgcgcgcgugcacacacacacacacacag

SEQ ID NO: 1070931 - RNA, 19 nt, Human
cagaaugaaaagcccacag

SEQ ID NO: 1070932 - RNA, 20 nt, Human
cagaccacgagguggaacca

SEQ ID NO: 1070933 - RNA, 21 nt, Human
cagcaagugaauccguuuucc

SEQ ID NO: 1070934 - RNA, 18 nt, Human
cagcccgcccagggugcc

SEQ ID NO: 1070935 - RNA, 21 nt, Human
cagcccuccuuucccuucccc

SEQ ID NO: 1070936 - RNA, 20 nt, Human
cagccucaggcccaaguagc

SEQ ID NO: 1070937 - RNA, 23 nt, Human
cagcugcucuguccucacccgcu

SEQ ID NO: 1070938 - RNA, 18 nt, Human
cagggugacguggaccgg

SEQ ID NO: 1070939 - RNA, 19 nt, Human
ccaaauaacuguuaggaaa

SEQ ID NO: 1070940 - RNA, 23 nt, Human
ccaacccuccacaaccucaacuc

SEQ ID NO: 1070941 - RNA, 23 nt, Human
ccaccaaauaacuguuaggaaac

SEQ ID NO: 1070942 - RNA, 22 nt, Human
ccagaaaaaaccgccauuuaca

SEQ ID NO: 1070943 - RNA, 22 nt, Human
ccagagcagagaaaccuuagga

SEQ ID NO: 1070944 - RNA, 22 nt, Human
cccaacccuccacaaccucaac

SEQ ID NO: 1070945 - RNA, 18 nt, Human
cccaaggccauggugucc

SEQ ID NO: 1070946 - RNA, 22 nt, Human
cccaaguagcugggaccacagg

SEQ ID NO: 1070947 - RNA, 28 nt, Human
cccacccaccauggaaggcagcagugca

SEQ ID NO: 1070948 - RNA, 22 nt, Human
ccccaaggaaacgcugggccaa

SEQ ID NO: 1070949 - RNA, 24 nt, Human
ccccaaggaaacgcugggccaagc

SEQ ID NO: 1070950 - RNA, 18 nt, Human
ccccgcucuggggucucc

SEQ ID NO: 1070951 - RNA, 18 nt, Human
ccccucuccccugacaag

SEQ ID NO: 1070952 - RNA, 22 nt, Human
cccgggcugagcccucccugcc

SEQ ID NO: 1070953 - RNA, 23 nt, Human
cccgggcugagcccucccugccu

SEQ ID NO: 1070954 - RNA, 24 nt, Human
ccggagccacacaccacauccccg

SEQ ID NO: 1070955 - RNA, 22 nt, Human
ccgggaccaugcgcagcacugg

SEQ ID NO: 1070956 - RNA, 22 nt, Human
ccucacaucacaaaaaccuguc

SEQ ID NO: 1070957 - RNA, 30 nt, Human
ccucacaucacaaaaaccuguccagccggu

SEQ ID NO: 1070958 - RNA, 24 nt, Human
ccucaggcccaaguagcugggacc

SEQ ID NO: 1070959 - RNA, 20 nt, Human
ccucuaagaauccaaauuua

SEQ ID NO: 1070960 - RNA, 28 nt, Human
ccugccaccaucaccaaagcucacacca

SEQ ID NO: 1070961 - RNA, 19 nt, Human
ccugccccgcucugggguc

SEQ ID NO: 1070962 - RNA, 18 nt, Human
ccugguacaggcaugggg

SEQ ID NO: 1070963 - RNA, 24 nt, Human
ccuucgucagcguuccuggagccc

SEQ ID NO: 1070964 - RNA, 18 nt, Human
cgagggcccggagccaca

SEQ ID NO: 1070965 - RNA, 21 nt, Human
cgcauacacacaaagucaaca

SEQ ID NO: 1070966 - RNA, 20 nt, Human
cgcccaaggccauggugucc

SEQ ID NO: 1070967 - RNA, 25 nt, Human
cgcgugcacacacacacacacacac

SEQ ID NO: 1070968 - RNA, 20 nt, Human
cgcugccugcccggaucagu

SEQ ID NO: 1070969 - RNA, 19 nt, Human
cgggagggcuggcugacgg

SEQ ID NO: 1070970 - RNA, 25 nt, Human
cgugcacacacacacacacacacgc

SEQ ID NO: 1070971 - RNA, 24 nt, Human
cuagagaaaagggggcacuguggg

SEQ ID NO: 1070972 - RNA, 19 nt, Human
cucaaagcucuucaaccuc

SEQ ID NO: 1070973 - RNA, 21 nt, Human
cuccagccucaggcccaagua

SEQ ID NO: 1070974 - RNA, 26 nt, Human
cucccaacccuccacaaccucaacuc

SEQ ID NO: 1070975 - RNA, 20 nt, Human
cuccccuggcugacagcucc

SEQ ID NO: 1070976 - RNA, 25 nt, Human
cucuccccugacaagugugcagaca

SEQ ID NO: 1070977 - RNA, 22 nt, Human
cucuggccaaaccagacucuuc

SEQ ID NO: 1070978 - RNA, 20 nt, Human
cucugucacccaggcuggag

SEQ ID NO: 1070979 - RNA, 27 nt, Human
cugaaccugaaaaaggaacggaacaug

SEQ ID NO: 1070980 - RNA, 23 nt, Human
cugacagcacagggcaauuuauc

SEQ ID NO: 1070981 - RNA, 23 nt, Human
cugcuggccgacuccaagaaaag

SEQ ID NO: 1070982 - RNA, 23 nt, Human
cuggggucucccacccaccaugg

SEQ ID NO: 1070983 - RNA, 18 nt, Human
cugucacccaggcuggag

SEQ ID NO: 1070984 - RNA, 23 nt, Human
cuucaaaggagcccugccaccau

SEQ ID NO: 1070985 - RNA, 24 nt, Human
cuucuaggcucaagcaauccucca

SEQ ID NO: 1070986 - RNA, 22 nt, Human
cuuuucuuucucgaagguuggu

SEQ ID NO: 1070987 - RNA, 23 nt, Human
cuuuuuuuuuuugagauaggguu

SEQ ID NO: 1070988 - RNA, 22 nt, Human
gagggcuggcugacggcugacc

SEQ ID NO: 1070989 - RNA, 25 nt, Human
gccacugugcuacuuuaucugggca

SEQ ID NO: 1070990 - RNA, 18 nt, Human
gcgccugccccgcucugg

SEQ ID NO: 1070991 - RNA, 20 nt, Human
gcucugucacccaggcugga

SEQ ID NO: 1070992 - RNA, 25 nt, Human
gcucugucacccaggcuggagugca

SEQ ID NO: 1070993 - RNA, 18 nt, Human
gcugggaccacaggcacu

SEQ ID NO: 1070994 - RNA, 20 nt, Human
ggagcccuugccaagcuuac

SEQ ID NO: 1070995 - RNA, 19 nt, Human
ggcgggaaacgggagggcu

SEQ ID NO: 1070996 - RNA, 18 nt, Human
gggauggccuggagcugu

SEQ ID NO: 1070997 - RNA, 30 nt, Human
gggcgaggcagcggccaggcgacaagggaa

SEQ ID NO: 1070998 - RNA, 22 nt, Human
ggggauggccuggagcuguggg

SEQ ID NO: 1070999 - RNA, 19 nt, Human
gggggucugcugcuuucca

SEQ ID NO: 1071000 - RNA, 21 nt, Human
ggggucucccacccaccaugg

SEQ ID NO: 1071001 - RNA, 20 nt, Human
gguggggguccuaaaacccu

SEQ ID NO: 1071002 - RNA, 18 nt, Human
gguguugagggaaaggcc

SEQ ID NO: 1071003 - RNA, 24 nt, Human
gucaacacgcacacgcgcgcgugg

SEQ ID NO: 1071004 - RNA, 24 nt, Human
guuuugcucugucacccaggcugg

SEQ ID NO: 1071005 - RNA, 23 nt, Human
uaagaaggcagcuagccagcccg

SEQ ID NO: 1071006 - RNA, 20 nt, Human
uaaggugucuuuauugucuu

SEQ ID NO: 1071007 - RNA, 24 nt, Human
uaccaugugccccaugcguguccc

SEQ ID NO: 1071008 - RNA, 20 nt, Human
uagaacuucaguuucuccca

SEQ ID NO: 1071009 - RNA, 20 nt, Human
uaggcucaagcaauccucca

SEQ ID NO: 1071010 - RNA, 24 nt, Human
uaggguuuugcucugucacccagg

SEQ ID NO: 1071011 - RNA, 20 nt, Human
ucaacacgcacacgcgcgcg

SEQ ID NO: 1071012 - RNA, 23 nt, Human
ucacccaggcuggagugcagugu

SEQ ID NO: 1071013 - RNA, 19 nt, Human
uccacaaccucaacucuug

SEQ ID NO: 1071014 - RNA, 25 nt, Human
uccagcccuccuuucccuuccccaa

SEQ ID NO: 1071015 - RNA, 30 nt, Human
uccaugaagucaacacgcacacgcgcggug

SEQ ID NO: 1071016 - RNA, 22 nt, Human
ucccacccaccauggaaggcag

SEQ ID NO: 1071017 - RNA, 20 nt, Human
ucccaccuugcuguccccuc

SEQ ID NO: 1071018 - RNA, 26 nt, Human
ucccccaaagcagagaugucgagggc

SEQ ID NO: 1071019 - RNA, 19 nt, Human
ucccucacaucacaaaaac

SEQ ID NO: 1071020 - RNA, 20 nt, Human
ucccuuuucuuucucgaagg

SEQ ID NO: 1071021 - RNA, 25 nt, Human
uccgccgugaacaaaaucagcaagu

SEQ ID NO: 1071022 - RNA, 23 nt, Human
uccuggagcccuugccaagcuua

SEQ ID NO: 1071023 - RNA, 18 nt, Human
ucucccaacccuccacaa

SEQ ID NO: 1071024 - RNA, 24 nt, Human
ucucccaacccuccacaaccucaa

SEQ ID NO: 1071025 - RNA, 24 nt, Human
ucugucacccaggcuggagugcag

SEQ ID NO: 1071026 - RNA, 23 nt, Human
ucuguccucacccgcucuggagg

SEQ ID NO: 1071027 - RNA, 21 nt, Human
ucuuagccagagcagagaaac

SEQ ID NO: 1071028 - RNA, 21 nt, Human
ucuuuggcacucuggcuggcc

SEQ ID NO: 1071029 - RNA, 28 nt, Human
ugaaaagcccacagcugcucuguccucc

SEQ ID NO: 1071030 - RNA, 22 nt, Human
ugacaagugugcagacaaggua

SEQ ID NO: 1071031 - RNA, 18 nt, Human
ugacagcagagcaaucag

SEQ ID NO: 1071032 - RNA, 19 nt, Human
ugacagcagagcaaucaga

SEQ ID NO: 1071033 - RNA, 23 nt, Human
ugagggaaaggccacuuucccac

SEQ ID NO: 1071034 - RNA, 24 nt, Human
ugcacggagaugaggugggugugu

SEQ ID NO: 1071035 - RNA, 18 nt, Human
ugccaccaucaccaaagc

SEQ ID NO: 1071036 - RNA, 21 nt, Human
ugccccgcucuggggucuccc

SEQ ID NO: 1071037 - RNA, 21 nt, Human
ugcgcagcacugggggggucu

SEQ ID NO: 1071038 - RNA, 19 nt, Human
ugcgugucccucacaucac

SEQ ID NO: 1071039 - RNA, 18 nt, Human
ugcuaggaggccucaggc

SEQ ID NO: 1071040 - RNA, 20 nt, Human
ugcugcguggccugcuggcc

SEQ ID NO: 1071041 - RNA, 21 nt, Human
ugcugcugagccucaaagcuc

SEQ ID NO: 1071042 - RNA, 25 nt, Human
uggagcccuugccaagcuuaccaug

SEQ ID NO: 1071043 - RNA, 22 nt, Human
uggagugcaguguggcaugauc

SEQ ID NO: 1071044 - RNA, 23 nt, Human
uggagugcaguguggcaugauca

SEQ ID NO: 1071045 - RNA, 18 nt, Human
uggcaugaucauagcuca

SEQ ID NO: 1071046 - RNA, 24 nt, Human
uggcaugaucauagcucacugcaa

SEQ ID NO: 1071047 - RNA, 21 nt, Human
uggccaaaccagacucuucuc

SEQ ID NO: 1071048 - RNA, 20 nt, Human
uggccgacuccaagaaaagc

SEQ ID NO: 1071049 - RNA, 22 nt, Human
uggccuggagcuguggggcccg

SEQ ID NO: 1071050 - RNA, 21 nt, Human
uggcgccugccccgcucuggg

SEQ ID NO: 1071051 - RNA, 19 nt, Human
ugggaccacaggcacucac

SEQ ID NO: 1071052 - RNA, 21 nt, Human
ugggaccacaggcacucacug

SEQ ID NO: 1071053 - RNA, 24 nt, Human
ugggcagggacugggggugccaug

SEQ ID NO: 1071054 - RNA, 20 nt, Human
ugggcgggaaacgggagggc

SEQ ID NO: 1071055 - RNA, 23 nt, Human
uggggguggggguccuaaaaccc

SEQ ID NO: 1071056 - RNA, 21 nt, Human
ugucacccaggcuggagugca

SEQ ID NO: 1071057 - RNA, 21 nt, Human
ugugcagacaagguaaaaauc

SEQ ID NO: 1071058 - RNA, 22 nt, Human
ugugcagacaagguaaaaaucc

SEQ ID NO: 1071059 - RNA, 20 nt, Human
uucaaaggagcccugccacc

SEQ ID NO: 1071060 - RNA, 24 nt, Human
uucaaaguagagauguccuaagaa

SEQ ID NO: 1071061 - RNA, 22 nt, Human
uucaaccucccaccuugcuguc

SEQ ID NO: 1071062 - RNA, 19 nt, Human
uucagagcgcagaaccaac

SEQ ID NO: 1071063 - RNA, 25 nt, Human
uucucccaacccuccacaaccucaa

SEQ ID NO: 1071064 - RNA, 23 nt, Human
uucuuuuuuuuuuugagauaggg

SEQ ID NO: 1071065 - RNA, 19 nt, Human
uugccaagcuuaccaugug

SEQ ID NO: 1071066 - RNA, 20 nt, Human
uugcucugucacccaggcug

SEQ ID NO: 1071067 - RNA, 22 nt, Human
uugcucugucacccaggcugga

SEQ ID NO: 1071068 - RNA, 24 nt, Human
uugcucugucacccaggcuggagu

SEQ ID NO: 1071069 - RNA, 24 nt, Human
uuuugcucugucacccaggcugga

SEQ ID NO: 1071070 - RNA, 18 nt, Human
uuuuuuuugagauagggu

SEQ ID NO: 1071071 - RNA, 24 nt, Human
aaaaguagugggugaagccaagag

SEQ ID NO: 1071072 - RNA, 18 nt, Human
aaaauuagcugggcgugg

SEQ ID NO: 1071073 - RNA, 23 nt, Human
aaacaaaugaaccucaauccaua

SEQ ID NO: 1071074 - RNA, 26 nt, Human
aaacaaaugaaccucaauccauaacu

SEQ ID NO: 1071075 - RNA, 22 nt, Human
aaaguagugggugaagccaaga

SEQ ID NO: 1071076 - RNA, 20 nt, Human
aacauggagaaaccccaguc

SEQ ID NO: 1071077 - RNA, 21 nt, Human
aacauggagaaaccccagucu

SEQ ID NO: 1071078 - RNA, 22 nt, Human
aacauggagaaaccccagucuc

SEQ ID NO: 1071079 - RNA, 23 nt, Human
aagaaacuagaauagccaaaaca

SEQ ID NO: 1071080 - RNA, 24 nt, Human
aagagugaaaacucugucucaaaa

SEQ ID NO: 1071081 - RNA, 23 nt, Human
aagcccacguccacacguuccga

SEQ ID NO: 1071082 - RNA, 24 nt, Human
accugaggucaggaguucgagacc

SEQ ID NO: 1071083 - RNA, 24 nt, Human
acuccagccugggcgacaggguga

SEQ ID NO: 1071084 - RNA, 22 nt, Human
acuucgaaacuuacuguaaaga

SEQ ID NO: 1071085 - RNA, 24 nt, Human
agaaaaguagugggugaagccaag

SEQ ID NO: 1071086 - RNA, 23 nt, Human
agaacgcugaaagcuggugggcu

SEQ ID NO: 1071087 - RNA, 18 nt, Human
agagcuggaagacucgca

SEQ ID NO: 1071088 - RNA, 22 nt, Human
agagguugcagugaguugagau

SEQ ID NO: 1071089 - RNA, 23 nt, Human
agagguugcagugaguugagauc

SEQ ID NO: 1071090 - RNA, 24 nt, Human
agagguugcagugaguugagaucg

SEQ ID NO: 1071091 - RNA, 20 nt, Human
agcaaagauaaagaguuuac

SEQ ID NO: 1071092 - RNA, 24 nt, Human
agcacuuugggaggccgaggcugg

SEQ ID NO: 1071093 - RNA, 22 nt, Human
agccugggcgacagggugagac

SEQ ID NO: 1071094 - RNA, 24 nt, Human
aggaagagguugcagugaguugag

SEQ ID NO: 1071095 - RNA, 22 nt, Human
aggcaccugucaucccagcuac

SEQ ID NO: 1071096 - RNA, 22 nt, Human
aggcaggagaaaugcuugaacc

SEQ ID NO: 1071097 - RNA, 23 nt, Human
aggcaggagaaaugcuugaaccu

SEQ ID NO: 1071098 - RNA, 24 nt, Human
aggcaggagaaaugcuugaaccug

SEQ ID NO: 1071099 - RNA, 25 nt, Human
aggcaggagaaaugcuugaaccugg

SEQ ID NO: 1071100 - RNA, 21 nt, Human
aggccgaggcugguggaucac

SEQ ID NO: 1071101 - RNA, 24 nt, Human
aggcgugguggcucacaccuguaa

SEQ ID NO: 1071102 - RNA, 24 nt, Human
aggcugaggcaggagaaaugcuug

SEQ ID NO: 1071103 - RNA, 22 nt, Human
aggcugguggaucaccugaggu

SEQ ID NO: 1071104 - RNA, 26 nt, Human
aggcugguggaucaccugaggucagg

SEQ ID NO: 1071105 - RNA, 21 nt, Human
aucaccugaggucaggaguuc

SEQ ID NO: 1071106 - RNA, 24 nt, Human
aucaccugaggucaggaguucgag

SEQ ID NO: 1071107 - RNA, 24 nt, Human
aucgcacuccagccugggcgacag

SEQ ID NO: 1071108 - RNA, 24 nt, Human
aucgcgccaucgcacuccagccug

SEQ ID NO: 1071109 - RNA, 19 nt, Human
aucuaaacauugugucaga

SEQ ID NO: 1071110 - RNA, 24 nt, Human
augcuugaaccugggaggaagagg

SEQ ID NO: 1071111 - RNA, 23 nt, Human
caaaacaaaugaaccucaaucca

SEQ ID NO: 1071112 - RNA, 19 nt, Human
caaagcccacguccacacg

SEQ ID NO: 1071113 - RNA, 19 nt, Human
caaugaaggaacuuccaaa

SEQ ID NO: 1071114 - RNA, 24 nt, Human
cacaccuguaaucccagcacuuug

SEQ ID NO: 1071115 - RNA, 23 nt, Human
caccugaggucaggaguucgaga

SEQ ID NO: 1071116 - RNA, 23 nt, Human
caccuguaaucccagcacuuugg

SEQ ID NO: 1071117 - RNA, 24 nt, Human
caccuguaaucccagcacuuuggg

SEQ ID NO: 1071118 - RNA, 18 nt, Human
caccugucaucccagcua

SEQ ID NO: 1071119 - RNA, 24 nt, Human
caccugucaucccagcuacucagg

SEQ ID NO: 1071120 - RNA, 20 nt, Human
cacuccagccugggcgacag

SEQ ID NO: 1071121 - RNA, 20 nt, Human
cacuccagccugggcgacag

SEQ ID NO: 1071122 - RNA, 24 nt, Human
cacuccagccugggcgacagggug

SEQ ID NO: 1071123 - RNA, 19 nt, Human
cacugcaccacagcaaaga

SEQ ID NO: 1071124 - RNA, 23 nt, Human
cacugcaccacagcaaagauaaa

SEQ ID NO: 1071125 - RNA, 19 nt, Human
cacuucgcggcggcucagu

SEQ ID NO: 1071126 - RNA, 25 nt, Human
cagcacuuugggaggccgaggcugg

SEQ ID NO: 1071127 - RNA, 24 nt, Human
cagcccgaccaacauggagaaacc

SEQ ID NO: 1071128 - RNA, 24 nt, Human
cagcuacucaggaggcugaggcag

SEQ ID NO: 1071129 - RNA, 19 nt, Human
caucgcacuccagccuggg

SEQ ID NO: 1071130 - RNA, 22 nt, Human
caucgcacuccagccugggcga

SEQ ID NO: 1071131 - RNA, 23 nt, Human
caucgcacuccagccugggcgac

SEQ ID NO: 1071132 - RNA, 24 nt, Human
caucgcacuccagccugggcgaca

SEQ ID NO: 1071133 - RNA, 18 nt, Human
ccaaagauugccaucaga

SEQ ID NO: 1071134 - RNA, 22 nt, Human
ccaaagcccacguccacacguu

SEQ ID NO: 1071135 - RNA, 28 nt, Human
ccaaagcccacguccacacguuccgagc

SEQ ID NO: 1071136 - RNA, 22 nt, Human
ccacugcgccuaacgaccgccc

SEQ ID NO: 1071137 - RNA, 20 nt, Human
ccaucgcacuccagccuggg

SEQ ID NO: 1071138 - RNA, 21 nt, Human
ccaucgcacuccagccugggc

SEQ ID NO: 1071139 - RNA, 23 nt, Human
ccaucgcacuccagccugggcga

SEQ ID NO: 1071140 - RNA, 24 nt, Human
ccaucgcacuccagccugggcgac

SEQ ID NO: 1071141 - RNA, 22 nt, Human
cccaucgcaaacauccgggggc

SEQ ID NO: 1071142 - RNA, 23 nt, Human
ccuaacgaccgcccaucucugac

SEQ ID NO: 1071143 - RNA, 23 nt, Human
ccucugagcuuccugacggccgu

SEQ ID NO: 1071144 - RNA, 22 nt, Human
ccugaggucaggaguucgagac

SEQ ID NO: 1071145 - RNA, 29 nt, Human
cgaggcggggguguggcgaggggaagucc

SEQ ID NO: 1071146 - RNA, 20 nt, Human
cgaggcugguggaucaccug

SEQ ID NO: 1071147 - RNA, 24 nt, Human
cgaggcugguggaucaccugaggu

SEQ ID NO: 1071148 - RNA, 26 nt, Human
cgaggcugguggaucaccugagguca

SEQ ID NO: 1071149 - RNA, 26 nt, Human
cgccaucgcacuccagccugggcgac

SEQ ID NO: 1071150 - RNA, 22 nt, Human
cgccgggcucacuucagugcgc

SEQ ID NO: 1071151 - RNA, 18 nt, Human
cgcugaaagcuggugggc

SEQ ID NO: 1071152 - RNA, 20 nt, Human
cgcugaaagcuggugggcuu

SEQ ID NO: 1071153 - RNA, 24 nt, Human
cggcccgaggcggggguguggcga

SEQ ID NO: 1071154 - RNA, 19 nt, Human
cggcucagucagcgcugcu

SEQ ID NO: 1071155 - RNA, 24 nt, Human
cguuccgagcccgccgucccaucg

SEQ ID NO: 1071156 - RNA, 18 nt, Human
cucaaaaaaaaaaaaaaa

SEQ ID NO: 1071157 - RNA, 22 nt, Human
cucacaccuguaaucccagcac

SEQ ID NO: 1071158 - RNA, 24 nt, Human
cucacaccuguaaucccagcacuu

SEQ ID NO: 1071159 - RNA, 19 nt, Human
cucugucucaaaaaaaaaa

SEQ ID NO: 1071160 - RNA, 21 nt, Human
cugucaucccagcuacucagg

SEQ ID NO: 1071161 - RNA, 20 nt, Human
gaaagucaauauacaaaaca

SEQ ID NO: 1071162 - RNA, 23 nt, Human
gaacagagcuggaagacucgcac

SEQ ID NO: 1071163 - RNA, 18 nt, Human
gaaccuaaacuaguauug

SEQ ID NO: 1071164 - RNA, 18 nt, Human
gaacgcugaaagcuggug

SEQ ID NO: 1071165 - RNA, 22 nt, Human
gaccaacauggagaaaccccag

SEQ ID NO: 1071166 - RNA, 22 nt, Human
gagaaaccccagucucuacuaa

SEQ ID NO: 1071167 - RNA, 22 nt, Human
gagaauacauaaauagaccuuc

SEQ ID NO: 1071168 - RNA, 23 nt, Human
gagaccagcccgaccaacaugga

SEQ ID NO: 1071169 - RNA, 23 nt, Human
gagaucgcgccaucgcacuccag

SEQ ID NO: 1071170 - RNA, 24 nt, Human
gagccaggcgugguggcucacacc

SEQ ID NO: 1071171 - RNA, 21 nt, Human
gaucaccugaggucaggaguu

SEQ ID NO: 1071172 - RNA, 24 nt, Human
gaucaccugaggucaggaguucga

SEQ ID NO: 1071173 - RNA, 21 nt, Human
gcacuccagccugggcgacag

SEQ ID NO: 1071174 - RNA, 22 nt, Human
gccaucgcacuccagccugggc

SEQ ID NO: 1071175 - RNA, 21 nt, Human
gcgcugcuggguuccaccccu

SEQ ID NO: 1071176 - RNA, 21 nt, Human
gcugcagccucugagcuuccu

SEQ ID NO: 1071177 - RNA, 23 nt, Human
gcugcuggguuccaccccuccua

SEQ ID NO: 1071178 - RNA, 18 nt, Human
gcuugggaagacaaacga

SEQ ID NO: 1071179 - RNA, 26 nt, Human
ggaaaagcagaagaaacuagaauagc

SEQ ID NO: 1071180 - RNA, 21 nt, Human
ggagccaggcgugguggcuca

SEQ ID NO: 1071181 - RNA, 22 nt, Human
ggcggggacggcccgaggcggg

SEQ ID NO: 1071182 - RNA, 23 nt, Human
ggcggggacggcccgaggcgggg

SEQ ID NO: 1071183 - RNA, 24 nt, Human
gguggcucacaccuguaaucccag

SEQ ID NO: 1071184 - RNA, 23 nt, Human
guggcucacaccuguaaucccag

SEQ ID NO: 1071185 - RNA, 21 nt, Human
uaaaaaaauggugcugcaaca

SEQ ID NO: 1071186 - RNA, 26 nt, Human
uauacaaaacaaaugaaccucaaucc

SEQ ID NO: 1071187 - RNA, 20 nt, Human
ucaaaaaaaaaaaaaaaaaa

SEQ ID NO: 1071188 - RNA, 21 nt, Human
ucaaaaaaaaaaaaaaaaaaa

SEQ ID NO: 1071189 - RNA, 18 nt, Human
ucaauauacaaaacaaau

SEQ ID NO: 1071190 - RNA, 19 nt, Human
ucaaugaaaauagugguuu

SEQ ID NO: 1071191 - RNA, 18 nt, Human
ucagagaaaaguaguggg

SEQ ID NO: 1071192 - RNA, 23 nt, Human
uccagccugggcgacagggugag

SEQ ID NO: 1071193 - RNA, 24 nt, Human
uccagccugggcgacagggugaga

SEQ ID NO: 1071194 - RNA, 24 nt, Human
ucuaaacauugugucagagaaagg

SEQ ID NO: 1071195 - RNA, 21 nt, Human
ucucuacuaaaaauacaaaaa

SEQ ID NO: 1071196 - RNA, 23 nt, Human
ucugucucaaaaaaaaaaaaaaa

SEQ ID NO: 1071197 - RNA, 19 nt, Human
ugaaagcuggugggcuugg

SEQ ID NO: 1071198 - RNA, 21 nt, Human
ugaaauuuggcucccagguaa

SEQ ID NO: 1071199 - RNA, 24 nt, Human
ugaaccugggaggaagagguugca

SEQ ID NO: 1071200 - RNA, 22 nt, Human
ugacaaaguugcaaggggacgc

SEQ ID NO: 1071201 - RNA, 24 nt, Human
ugaggcaggagaaaugcuugaacc

SEQ ID NO: 1071202 - RNA, 25 nt, Human
ugaggcaggagaaaugcuugaaccu

SEQ ID NO: 1071203 - RNA, 22 nt, Human
ugaguugagaucgcgccaucgc

SEQ ID NO: 1071204 - RNA, 22 nt, Human
ugcaacaauugaaagucaauau

SEQ ID NO: 1071205 - RNA, 24 nt, Human
ugcaagggcaaaucaaugaaaaua

SEQ ID NO: 1071206 - RNA, 21 nt, Human
ugcuugaaccugggaggaaga

SEQ ID NO: 1071207 - RNA, 19 nt, Human
uggagaacgcugaaagcug

SEQ ID NO: 1071208 - RNA, 24 nt, Human
uggagccaggcgugguggcucaca

SEQ ID NO: 1071209 - RNA, 24 nt, Human
uggaucaccugaggucaggaguuc

SEQ ID NO: 1071210 - RNA, 27 nt, Human
uggaucaccugaggucaggaguucgag

SEQ ID NO: 1071211 - RNA, 21 nt, Human
uggcucacaccuguaauccca

SEQ ID NO: 1071212 - RNA, 22 nt, Human
uggcucacaccuguaaucccag

SEQ ID NO: 1071213 - RNA, 24 nt, Human
uggcucacaccuguaaucccagca

SEQ ID NO: 1071214 - RNA, 22 nt, Human
uggcucccagguaauacguucc

SEQ ID NO: 1071215 - RNA, 24 nt, Human
ugggaggaagagguugcagugagu

SEQ ID NO: 1071216 - RNA, 21 nt, Human
ugggaggaagagguugcaguu

SEQ ID NO: 1071217 - RNA, 19 nt, Human
ugggaggccgaggcuggug

SEQ ID NO: 1071218 - RNA, 24 nt, Human
ugggaggccgaggcugguggauca

SEQ ID NO: 1071219 - RNA, 18 nt, Human
ugggugaagccaagaggu

SEQ ID NO: 1071220 - RNA, 23 nt, Human
ugguggaucaccugaggucagga

SEQ ID NO: 1071221 - RNA, 24 nt, Human
ugguggcucacaccuguaauccca

SEQ ID NO: 1071222 - RNA, 22 nt, Human
uguaaaaccuucacuuaacaaa

SEQ ID NO: 1071223 - RNA, 23 nt, Human
ugugucagagaaaggauaaacac

SEQ ID NO: 1071224 - RNA, 21 nt, Human
uuaacccaagaaaagaguaaa

SEQ ID NO: 1071225 - RNA, 20 nt, Human
uuagcugggcguggugucag

SEQ ID NO: 1071226 - RNA, 22 nt, Human
uuagcugggcguggugucaggc

SEQ ID NO: 1071227 - RNA, 24 nt, Human
uuagcugggcguggugucaggcac

SEQ ID NO: 1071228 - RNA, 24 nt, Human
uucacuuaacaaaaauucuagaca

SEQ ID NO: 1071229 - RNA, 24 nt, Human
uugaaccugggaggaagagguugc

SEQ ID NO: 1071230 - RNA, 19 nt, Human
uugcagugaguugagaucg

SEQ ID NO: 1071231 - RNA, 22 nt, Human
uugcagugaguugagaucgcgc

SEQ ID NO: 1071232 - RNA, 22 nt, Human
uuggaaaagcagaagaaacuag

SEQ ID NO: 1071233 - RNA, 25 nt, Human
uugggaggccgaggcugguggauca

SEQ ID NO: 1071234 - RNA, 19 nt, Human
uuugacaaaguugcaaggg

SEQ ID NO: 1071235 - RNA, 19 nt, Human
aaacaacuacuuauuucuc

SEQ ID NO: 1071236 - RNA, 19 nt, Human
aaaccaccccaaaugcagu

SEQ ID NO: 1071237 - RNA, 30 nt, Human
aaccaccccaaaugcaguggcuuaaacaag

SEQ ID NO: 1071238 - RNA, 20 nt, Human
aaccuucucuucagaagaaa

SEQ ID NO: 1071239 - RNA, 20 nt, Human
aacuggucagugaucaguag

SEQ ID NO: 1071240 - RNA, 22 nt, Human
aagaaaacaaaagcaaaauuaa

SEQ ID NO: 1071241 - RNA, 24 nt, Human
aagcaaaauuaaaaaccacccugg

SEQ ID NO: 1071242 - RNA, 25 nt, Human
accgugaaaagugagcgacagagga

SEQ ID NO: 1071243 - RNA, 20 nt, Human
agaagaaaacaaaagcaaaa

SEQ ID NO: 1071244 - RNA, 21 nt, Human
agaaggagacaaccgugaaaa

SEQ ID NO: 1071245 - RNA, 19 nt, Human
agcaaaauuaaaaaccacc

SEQ ID NO: 1071246 - RNA, 20 nt, Human
augcugcccuggggccaaac

SEQ ID NO: 1071247 - RNA, 22 nt, Human
cacuccucccagggcccauucc

SEQ ID NO: 1071248 - RNA, 18 nt, Human
ccaaaugcaguggcuuaa

SEQ ID NO: 1071249 - RNA, 21 nt, Human
ccagggcccauuccaaccagg

SEQ ID NO: 1071250 - RNA, 20 nt, Human
cucccagggcccauuccaac

SEQ ID NO: 1071251 - RNA, 22 nt, Human
cugguguuuaacaaccuucucu

SEQ ID NO: 1071252 - RNA, 22 nt, Human
gggaaagauuucaagcccaggg

SEQ ID NO: 1071253 - RNA, 21 nt, Human
uaaacaacuacuuauuucuca

SEQ ID NO: 1071254 - RNA, 20 nt, Human
uaauaaaccaccccaaaugc

SEQ ID NO: 1071255 - RNA, 27 nt, Human
ucccagggcccauuccaaccaggccaa

SEQ ID NO: 1071256 - RNA, 24 nt, Human
ucucaugauuauaugcuggcugcc

SEQ ID NO: 1071257 - RNA, 23 nt, Human
ucucuucagaagaaaacaaaagc

SEQ ID NO: 1071258 - RNA, 22 nt, Human
ugcaaacacuccucccagggcc

SEQ ID NO: 1071259 - RNA, 22 nt, Human
uugugccgcgggaaagauuuca

SEQ ID NO: 1071260 - RNA, 25 nt, Human
uuugaagcauuuaccaauuuccaca

SEQ ID NO: 1071261 - RNA, 23 nt, Human
uuugugccgcgggaaagauuuca

SEQ ID NO: 1071262 - RNA, 23 nt, Human
aaacuauuccaaaaaccacaaag

SEQ ID NO: 1071263 - RNA, 24 nt, Human
aaacuauuccaaaaaccacaaaga

SEQ ID NO: 1071264 - RNA, 20 nt, Human
aaagagcccaccuuacaugu

SEQ ID NO: 1071265 - RNA, 21 nt, Human
acauguuuagaaaaugaaaau

SEQ ID NO: 1071266 - RNA, 20 nt, Human
aguauggaauggcaauugga

SEQ ID NO: 1071267 - RNA, 18 nt, Human
aucacaugaaaauaccac

SEQ ID NO: 1071268 - RNA, 19 nt, Human
auucauugauggaagaggu

SEQ ID NO: 1071269 - RNA, 21 nt, Human
caccaauaaaaacuaugacag

SEQ ID NO: 1071270 - RNA, 22 nt, Human
cagauuccucuaccacaacuaa

SEQ ID NO: 1071271 - RNA, 20 nt, Human
caguaacaguaaaaacaaaa

SEQ ID NO: 1071272 - RNA, 22 nt, Human
ccacuaccaccaauaaaaacua

SEQ ID NO: 1071273 - RNA, 23 nt, Human
ccacuuaaacuauuccaaaaacc

SEQ ID NO: 1071274 - RNA, 23 nt, Human
ccaugaauauucauugauggaag

SEQ ID NO: 1071275 - RNA, 26 nt, Human
gucuuuuuuuguauuacacuuuuggu

SEQ ID NO: 1071276 - RNA, 19 nt, Human
uaaaaaacauuccaauggu

SEQ ID NO: 1071277 - RNA, 19 nt, Human
uaaaacacagagauggaaa

SEQ ID NO: 1071278 - RNA, 20 nt, Human
uacuauuuaaaacacagaga

SEQ ID NO: 1071279 - RNA, 18 nt, Human
uagaauaacauggugaaa

SEQ ID NO: 1071280 - RNA, 18 nt, Human
uagaauaacauggugaaa

SEQ ID NO: 1071281 - RNA, 21 nt, Human
uaguauuacuagugguaagca

SEQ ID NO: 1071282 - RNA, 23 nt, Human
uauaaauaauaaguuugcauccu

SEQ ID NO: 1071283 - RNA, 25 nt, Human
uaugacaguaacaguaaaaacaaaa

SEQ ID NO: 1071284 - RNA, 20 nt, Human
uauucauugauggaagaggu

SEQ ID NO: 1071285 - RNA, 23 nt, Human
uccaaaaaccacaaagacaaaua

SEQ ID NO: 1071286 - RNA, 19 nt, Human
ucuuagugucaaagagccc

SEQ ID NO: 1071287 - RNA, 18 nt, Human
ucuuuuuccuccucuuuc

SEQ ID NO: 1071288 - RNA, 20 nt, Human
ucuuuuuuuguauuacacuu

SEQ ID NO: 1071289 - RNA, 19 nt, Human
ugaaaauaccacuaccacc

SEQ ID NO: 1071290 - RNA, 19 nt, Human
ugaauaacaaguuaauagu

SEQ ID NO: 1071291 - RNA, 23 nt, Human
ugaauaaguauaggagagaaggg

SEQ ID NO: 1071292 - RNA, 26 nt, Human
ugacaguaacaguaaaaacaaaaaaa

SEQ ID NO: 1071293 - RNA, 23 nt, Human
uggaagcacccagauuccucuac

SEQ ID NO: 1071294 - RNA, 21 nt, Human
uggaaugaucuuaagcaccuu

SEQ ID NO: 1071295 - RNA, 25 nt, Human
uggcagaaaauuacagcaagucuuu

SEQ ID NO: 1071296 - RNA, 23 nt, Human
ugguuguuaugaacuuggaauga

SEQ ID NO: 1071297 - RNA, 23 nt, Human
uuacaaaguugauccaugaauau

SEQ ID NO: 1071298 - RNA, 24 nt, Human
uuagaauaacauggugaaaucuua

SEQ ID NO: 1071299 - RNA, 18 nt, Human
uuagauaccuuaauaucc

SEQ ID NO: 1071300 - RNA, 19 nt, Human
uuuagaaaaugaaaauucc

SEQ ID NO: 1071301 - RNA, 18 nt, Human
uuuuguuucuuuguuuua

SEQ ID NO: 1071302 - RNA, 21 nt, Human
uuuuuuuuuuuuucugucuuu

SEQ ID NO: 1071303 - RNA, 19 nt, Human
cagugacucuucugagcuc

SEQ ID NO: 1071304 - RNA, 22 nt, Human
ggcacggaagggaucagggcag

SEQ ID NO: 1071305 - RNA, 23 nt, Human
ucccugguuuugucuugcuuccu

SEQ ID NO: 1071306 - RNA, 20 nt, Human
aaaaauagaugcuuuuacug

SEQ ID NO: 1071307 - RNA, 21 nt, Human
aaaccgacagcugagcuccga

SEQ ID NO: 1071308 - RNA, 22 nt, Human
aaauacaucagucauuuugccc

SEQ ID NO: 1071309 - RNA, 20 nt, Human
aacuguggagugcauucagg

SEQ ID NO: 1071310 - RNA, 22 nt, Human
aaucuccccuccucaccuccac

SEQ ID NO: 1071311 - RNA, 30 nt, Human
acaccaaaacaaggagaccaccaccuagcu

SEQ ID NO: 1071312 - RNA, 22 nt, Human
accccgggccggccccagcccc

SEQ ID NO: 1071313 - RNA, 20 nt, Human
acggaaucuccccuccucac

SEQ ID NO: 1071314 - RNA, 20 nt, Human
acgggacacuggcaaggcca

SEQ ID NO: 1071315 - RNA, 21 nt, Human
acuugguuuugacaucaaggg

SEQ ID NO: 1071316 - RNA, 18 nt, Human
agaaaaugcacucucugu

SEQ ID NO: 1071317 - RNA, 21 nt, Human
agagguaccccucuucccuca

SEQ ID NO: 1071318 - RNA, 20 nt, Human
aggacacaugggguggcagg

SEQ ID NO: 1071319 - RNA, 22 nt, Human
aggcuccagaggcugagcaccu

SEQ ID NO: 1071320 - RNA, 18 nt, Human
agggagcucaagccccag

SEQ ID NO: 1071321 - RNA, 21 nt, Human
aggggggaggaaggcucagag

SEQ ID NO: 1071322 - RNA, 22 nt, Human
agugucucuuuaaaccgacagc

SEQ ID NO: 1071323 - RNA, 23 nt, Human
caaaucuuugacacuggagggca

SEQ ID NO: 1071324 - RNA, 21 nt, Human
caaccuccuggcucaacaucc

SEQ ID NO: 1071325 - RNA, 18 nt, Human
caagggcacuccauggac

SEQ ID NO: 1071326 - RNA, 22 nt, Human
cacagagggagcucaagcccca

SEQ ID NO: 1071327 - RNA, 22 nt, Human
cacagugcuggcuucuggggug

SEQ ID NO: 1071328 - RNA, 18 nt, Human
cacaugggguggcagggc

SEQ ID NO: 1071329 - RNA, 18 nt, Human
cacaugggguggcagggc

SEQ ID NO: 1071330 - RNA, 19 nt, Human
caccaaaacaaggagacca

SEQ ID NO: 1071331 - RNA, 20 nt, Human
caccaaaacaaggagaccac

SEQ ID NO: 1071332 - RNA, 21 nt, Human
caccaccuaacagugcaugcc

SEQ ID NO: 1071333 - RNA, 24 nt, Human
cacuugguuuugacaucaaggguu

SEQ ID NO: 1071334 - RNA, 20 nt, Human
cagcaccccgggccggcccc

SEQ ID NO: 1071335 - RNA, 19 nt, Human
cagcacccugccacagugc

SEQ ID NO: 1071336 - RNA, 21 nt, Human
cagcacccugccacagugcug

SEQ ID NO: 1071337 - RNA, 20 nt, Human
cagcagcagggaagagaggu

SEQ ID NO: 1071338 - RNA, 18 nt, Human
cagcggggagccgccucc

SEQ ID NO: 1071339 - RNA, 20 nt, Human
cagcggggagccgccuccuu

SEQ ID NO: 1071340 - RNA, 21 nt, Human
cagucauuuugccccuccugg

SEQ ID NO: 1071341 - RNA, 25 nt, Human
caucccacaggcaggggugagccug

SEQ ID NO: 1071342 - RNA, 18 nt, Human
caucguguccauccuccc

SEQ ID NO: 1071343 - RNA, 21 nt, Human
ccaccuaacagugcaugcccc

SEQ ID NO: 1071344 - RNA, 20 nt, Human
ccccaggcugggggcucccc

SEQ ID NO: 1071345 - RNA, 21 nt, Human
ccccagggaaccuuccccucc

SEQ ID NO: 1071346 - RNA, 21 nt, Human
ccccagggcucccggcuccuc

SEQ ID NO: 1071347 - RNA, 21 nt, Human
ccccgggccggccccagcccc

SEQ ID NO: 1071348 - RNA, 18 nt, Human
ccccucuucccucacaca

SEQ ID NO: 1071349 - RNA, 20 nt, Human
ccccugacccuggggguggc

SEQ ID NO: 1071350 - RNA, 20 nt, Human
cccgugcauccuggcuuguu

SEQ ID NO: 1071351 - RNA, 20 nt, Human
ccgacagcugagcuccgacu

SEQ ID NO: 1071352 - RNA, 20 nt, Human
ccucccuucccgccuccugc

SEQ ID NO: 1071353 - RNA, 21 nt, Human
ccuccugcccgagugccaggc

SEQ ID NO: 1071354 - RNA, 23 nt, Human
ccugcaggugaggcuccagaggc

SEQ ID NO: 1071355 - RNA, 18 nt, Human
ccuguaggucagggcagg

SEQ ID NO: 1071356 - RNA, 21 nt, Human
ccuuggccaccagccuaggac

SEQ ID NO: 1071357 - RNA, 22 nt, Human
cgaguucagacccggccucaca

SEQ ID NO: 1071358 - RNA, 22 nt, Human
cggugcaaccugcaugugugcg

SEQ ID NO: 1071359 - RNA, 24 nt, Human
cucacaacaucccacaggcagggg

SEQ ID NO: 1071360 - RNA, 22 nt, Human
cuccccuccucaccuccacaga

SEQ ID NO: 1071361 - RNA, 20 nt, Human
cuccuggcucaacauccgcc

SEQ ID NO: 1071362 - RNA, 21 nt, Human
cucugggggaguggcagccgu

SEQ ID NO: 1071363 - RNA, 19 nt, Human
cugaggcugggaugccucu

SEQ ID NO: 1071364 - RNA, 23 nt, Human
cugaggcugggaugccucugucc

SEQ ID NO: 1071365 - RNA, 19 nt, Human
cugcugggcugccccaggc

SEQ ID NO: 1071366 - RNA, 19 nt, Human
cuggcagccucccuucccg

SEQ ID NO: 1071367 - RNA, 25 nt, Human
cuggcagccucccuucccgccuccu

SEQ ID NO: 1071368 - RNA, 22 nt, Human
cuugacaccaaaacaaggagac

SEQ ID NO: 1071369 - RNA, 22 nt, Human
cuugccagcuuaagugcuaaaa

SEQ ID NO: 1071370 - RNA, 19 nt, Human
gaaauaccccaggccagca

SEQ ID NO: 1071371 - RNA, 21 nt, Human
gaacggaaucuccccuccuca

SEQ ID NO: 1071372 - RNA, 24 nt, Human
gaagagagguaccccucuucccuc

SEQ ID NO: 1071373 - RNA, 18 nt, Human
gacacuggagggcacggg

SEQ ID NO: 1071374 - RNA, 20 nt, Human
gcaggcagcggggagccgcc

SEQ ID NO: 1071375 - RNA, 23 nt, Human
gccacagugcuggcuucuggggu

SEQ ID NO: 1071376 - RNA, 19 nt, Human
gcugagggcggcagcccgg

SEQ ID NO: 1071377 - RNA, 18 nt, Human
ggcagcccccaacugugg

SEQ ID NO: 1071378 - RNA, 18 nt, Human
ggcuucuccccagggcuc

SEQ ID NO: 1071379 - RNA, 22 nt, Human
gggcucugggggaguggcagcc

SEQ ID NO: 1071380 - RNA, 20 nt, Human
ggggaggaaggcucagaggg

SEQ ID NO: 1071381 - RNA, 21 nt, Human
ggggggaggaaggcucagagg

SEQ ID NO: 1071382 - RNA, 21 nt, Human
ggguccuuggucuggcagccu

SEQ ID NO: 1071383 - RNA, 22 nt, Human
guccccucagugucucuuuaaa

SEQ ID NO: 1071384 - RNA, 23 nt, Human
gugccaggccgagcucaucgugu

SEQ ID NO: 1071385 - RNA, 19 nt, Human
guuuugacaucaaggguuc

SEQ ID NO: 1071386 - RNA, 23 nt, Human
uaaccagacagcaucucuggaga

SEQ ID NO: 1071387 - RNA, 18 nt, Human
uacaucagucauuuugcc

SEQ ID NO: 1071388 - RNA, 18 nt, Human
uaccccaggccagcagcu

SEQ ID NO: 1071389 - RNA, 21 nt, Human
uaggacacaugggguggcagg

SEQ ID NO: 1071390 - RNA, 19 nt, Human
uaggucagggcaggcagcg

SEQ ID NO: 1071391 - RNA, 20 nt, Human
uaggucagggcaggcagcgg

SEQ ID NO: 1071392 - RNA, 20 nt, Human
ucacacauggccuuggccac

SEQ ID NO: 1071393 - RNA, 23 nt, Human
ucaccgccuccacugggcacuug

SEQ ID NO: 1071394 - RNA, 24 nt, Human
uccauggacccauucuuuuccccu

SEQ ID NO: 1071395 - RNA, 19 nt, Human
uccccagggcucccggcuc

SEQ ID NO: 1071396 - RNA, 25 nt, Human
ucccccagcuccccgugcauccugg

SEQ ID NO: 1071397 - RNA, 18 nt, Human
uccccgugcauccuggcu

SEQ ID NO: 1071398 - RNA, 19 nt, Human
ucccucacacauggccuug

SEQ ID NO: 1071399 - RNA, 23 nt, Human
ucccucgaguucagacccggccu

SEQ ID NO: 1071400 - RNA, 22 nt, Human
uccggccuuugcccaaccuccu

SEQ ID NO: 1071401 - RNA, 21 nt, Human
ucuccccagcacccugccaca

SEQ ID NO: 1071402 - RNA, 18 nt, Human
ucucuggagagaaaaugc

SEQ ID NO: 1071403 - RNA, 20 nt, Human
ucucuggagagaaaaugcaa

SEQ ID NO: 1071404 - RNA, 21 nt, Human
ucugaggggggaggaaggcuc

SEQ ID NO: 1071405 - RNA, 20 nt, Human
ugaguccuugacaccaaaac

SEQ ID NO: 1071406 - RNA, 24 nt, Human
ugcucggggcuguucucugcuuca

SEQ ID NO: 1071407 - RNA, 18 nt, Human
uggcaggggcagccccca

SEQ ID NO: 1071408 - RNA, 22 nt, Human
uggcaggggcagcccccaacug

SEQ ID NO: 1071409 - RNA, 23 nt, Human
uggcaggggcagcccccaacugu

SEQ ID NO: 1071410 - RNA, 19 nt, Human
ugggcacuugguuuugaca

SEQ ID NO: 1071411 - RNA, 18 nt, Human
ugggcugccccaggcugg

SEQ ID NO: 1071412 - RNA, 18 nt, Human
uggggacgcccugcaggu

SEQ ID NO: 1071413 - RNA, 22 nt, Human
uggugcguggauggguguuagc

SEQ ID NO: 1071414 - RNA, 24 nt, Human
uguccauccucccggcuucucccc

SEQ ID NO: 1071415 - RNA, 21 nt, Human
ugucuggcucauguuccucuc

SEQ ID NO: 1071416 - RNA, 18 nt, Human
uucaagggcacuccaugg

SEQ ID NO: 1071417 - RNA, 18 nt, Human
uuccacacggguccuugg

SEQ ID NO: 1071418 - RNA, 21 nt, Human
uugguuuugacaucaaggguu

SEQ ID NO: 1071419 - RNA, 21 nt, Human
uuuacugaguccuugacacca

SEQ ID NO: 1071420 - RNA, 19 nt, Human
aaauauuucuugggucaau

SEQ ID NO: 1071421 - RNA, 18 nt, Human
aagaugugucucuuggau

SEQ ID NO: 1071422 - RNA, 22 nt, Human
agaagcucucuuaucuuccaaa

SEQ ID NO: 1071423 - RNA, 20 nt, Human
caaagaugugucucuuggau

SEQ ID NO: 1071424 - RNA, 22 nt, Human
caacaaaucaaucucacauaug

SEQ ID NO: 1071425 - RNA, 21 nt, Human
caagcaggcuccucggggucc

SEQ ID NO: 1071426 - RNA, 23 nt, Human
cacauaugccuccucagaaacaa

SEQ ID NO: 1071427 - RNA, 21 nt, Human
cacuuggcaugaaccaacaaa

SEQ ID NO: 1071428 - RNA, 22 nt, Human
cagagguccacauucaaaguca

SEQ ID NO: 1071429 - RNA, 24 nt, Human
cagcaagcaggcuccucggggucc

SEQ ID NO: 1071430 - RNA, 23 nt, Human
cagcagccuucugcgcugggugc

SEQ ID NO: 1071431 - RNA, 22 nt, Human
caugaaccaacaaaucaaucuc

SEQ ID NO: 1071432 - RNA, 19 nt, Human
ccaggccgcgggcgccgcg

SEQ ID NO: 1071433 - RNA, 21 nt, Human
ccccuggaaucuuccucuucc

SEQ ID NO: 1071434 - RNA, 20 nt, Human
ccccuguaucgaaggaugag

SEQ ID NO: 1071435 - RNA, 21 nt, Human
ccugccugucuuucuacggaa

SEQ ID NO: 1071436 - RNA, 24 nt, Human
cgggaugcucgccuccucugccgg

SEQ ID NO: 1071437 - RNA, 18 nt, Human
cucagagguccacauuca

SEQ ID NO: 1071438 - RNA, 18 nt, Human
gaacacacuuggcaugaa

SEQ ID NO: 1071439 - RNA, 21 nt, Human
gaacacacuuggcaugaacca

SEQ ID NO: 1071440 - RNA, 20 nt, Human
gaaccaacaaaucaaucuca

SEQ ID NO: 1071441 - RNA, 19 nt, Human
gagagccauccugcgugga

SEQ ID NO: 1071442 - RNA, 24 nt, Human
gcagcagccuucugcgcugggugc

SEQ ID NO: 1071443 - RNA, 21 nt, Human
gccggacgcagggcgccucca

SEQ ID NO: 1071444 - RNA, 20 nt, Human
gcgcugggugcgcgaggggu

SEQ ID NO: 1071445 - RNA, 20 nt, Human
gcggcagcagccuucugcgc

SEQ ID NO: 1071446 - RNA, 24 nt, Human
ggacaccucacaggugcgccuccg

SEQ ID NO: 1071447 - RNA, 22 nt, Human
gggaauucccuacauggguauc

SEQ ID NO: 1071448 - RNA, 20 nt, Human
uacaggguuuccuuccuagu

SEQ ID NO: 1071449 - RNA, 21 nt, Human
uagaaaaaggacuguacagua

SEQ ID NO: 1071450 - RNA, 26 nt, Human
uaucaugccgucuccuuuuuuggucu

SEQ ID NO: 1071451 - RNA, 23 nt, Human
ucaaucucacauaugccuccuca

SEQ ID NO: 1071452 - RNA, 21 nt, Human
ucacaggugcgccuccgagcc

SEQ ID NO: 1071453 - RNA, 20 nt, Human
uccuuuuuuggucuugaaga

SEQ ID NO: 1071454 - RNA, 22 nt, Human
ucugcgcugggugcgcgagggg

SEQ ID NO: 1071455 - RNA, 22 nt, Human
ucugugacugggaccugagagc

SEQ ID NO: 1071456 - RNA, 18 nt, Human
ugacugggaccugagagc

SEQ ID NO: 1071457 - RNA, 18 nt, Human
ugacuuccacgugaauuc

SEQ ID NO: 1071458 - RNA, 20 nt, Human
ugagccccuggaaucuuccu

SEQ ID NO: 1071459 - RNA, 18 nt, Human
ugcgcugggugcgcgagg

SEQ ID NO: 1071460 - RNA, 21 nt, Human
ugcucagagguccacauucaa

SEQ ID NO: 1071461 - RNA, 21 nt, Human
uuccaaagaugugucucuugg

SEQ ID NO: 1071462 - RNA, 20 nt, Human
uucccugccugucuuucuac

SEQ ID NO: 1071463 - RNA, 23 nt, Human
aaaagccucgaccgcuacgacuc

SEQ ID NO: 1071464 - RNA, 21 nt, Human
aaaauugagcauaaaguugcu

SEQ ID NO: 1071465 - RNA, 19 nt, Human
aaguaaugacuccauacau

SEQ ID NO: 1071466 - RNA, 19 nt, Human
agcauaaaguugcugauac

SEQ ID NO: 1071467 - RNA, 20 nt, Human
aggcccaaagguagcagcag

SEQ ID NO: 1071468 - RNA, 19 nt, Human
ccaaagguagcagcagcaa

SEQ ID NO: 1071469 - RNA, 22 nt, Human
ccagcaggcuauuucaagguca

SEQ ID NO: 1071470 - RNA, 19 nt, Human
cuacugcgaagcggggugg

SEQ ID NO: 1071471 - RNA, 22 nt, Human
gauuccuuucaaaaguuaagag

SEQ ID NO: 1071472 - RNA, 25 nt, Human
gccggagccgcaaaagccucgaccg

SEQ ID NO: 1071473 - RNA, 25 nt, Human
gggauuuuuuacacaacauguauau

SEQ ID NO: 1071474 - RNA, 23 nt, Human
ggugaaaaaauaagggauuccuu

SEQ ID NO: 1071475 - RNA, 19 nt, Human
guucaguagggcagcucag

SEQ ID NO: 1071476 - RNA, 20 nt, Human
guuuuguagugaaccuugag

SEQ ID NO: 1071477 - RNA, 23 nt, Human
uaaaaauaauuggcuaaguccua

SEQ ID NO: 1071478 - RNA, 25 nt, Human
uaaaauggagaaauaagcuaaaaau

SEQ ID NO: 1071479 - RNA, 21 nt, Human
uaagcuaaaaauaauuggcua

SEQ ID NO: 1071480 - RNA, 25 nt, Human
uaccaggaacuguuuguuuuguagu

SEQ ID NO: 1071481 - RNA, 27 nt, Human
uaucaaagaagguaauugauacacaac

SEQ ID NO: 1071482 - RNA, 28 nt, Human
uaucaaagaagguaauugauacacaaca

SEQ ID NO: 1071483 - RNA, 22 nt, Human
uauuuccuuuuaucaaagaagg

SEQ ID NO: 1071484 - RNA, 21 nt, Human
uccauacauauuauuuauuuc

SEQ ID NO: 1071485 - RNA, 19 nt, Human
uccggcacgccggagccgc

SEQ ID NO: 1071486 - RNA, 18 nt, Human
ucuacugcgaagcggggu

SEQ ID NO: 1071487 - RNA, 25 nt, Human
ucuccguaugaacagaaguugaaac

SEQ ID NO: 1071488 - RNA, 19 nt, Human
ugacuccauacauauuauu

SEQ ID NO: 1071489 - RNA, 24 nt, Human
uggcacugauagcuaaauuaaagu

SEQ ID NO: 1071490 - RNA, 20 nt, Human
uggcguugggggaggugggc

SEQ ID NO: 1071491 - RNA, 20 nt, Human
uggcuaaguccuauuaaguu

SEQ ID NO: 1071492 - RNA, 22 nt, Human
ugggggaggugggcaaccuguc

SEQ ID NO: 1071493 - RNA, 18 nt, Human
ugucaguaaaauggagaa

SEQ ID NO: 1071494 - RNA, 19 nt, Human
uucaaaauugggugcucau

SEQ ID NO: 1071495 - RNA, 25 nt, Human
uucaguagggcagcucagggauuuu

SEQ ID NO: 1071496 - RNA, 20 nt, Human
uuuaugcauaacauacgcag

SEQ ID NO: 1071497 - RNA, 23 nt, Human
uuuuacacaacauguauaucuuc

SEQ ID NO: 1071498 - RNA, 20 nt, Human
aacgccccaaggacagccag

SEQ ID NO: 1071499 - RNA, 20 nt, Human
aagccccugggcaggagccc

SEQ ID NO: 1071500 - RNA, 28 nt, Human
acugaaggagugacucaggaaggaggag

SEQ ID NO: 1071501 - RNA, 19 nt, Human
agacuuggaggaacuggca

SEQ ID NO: 1071502 - RNA, 24 nt, Human
agagggagaagacaggcgcaguca

SEQ ID NO: 1071503 - RNA, 19 nt, Human
agccuaauggcccuuggca

SEQ ID NO: 1071504 - RNA, 21 nt, Human
aggaacuggcacgaagccaag

SEQ ID NO: 1071505 - RNA, 18 nt, Human
aggaaggaggaggggaag

SEQ ID NO: 1071506 - RNA, 18 nt, Human
agugguugagagggaggg

SEQ ID NO: 1071507 - RNA, 23 nt, Human
augcaggauggaaagaaagauuc

SEQ ID NO: 1071508 - RNA, 22 nt, Human
caagccccugggcaggagcccu

SEQ ID NO: 1071509 - RNA, 21 nt, Human
caccuucuucgccggcagaau

SEQ ID NO: 1071510 - RNA, 21 nt, Human
cagaagaucccagcugaccac

SEQ ID NO: 1071511 - RNA, 19 nt, Human
cagcugccacagccuccug

SEQ ID NO: 1071512 - RNA, 23 nt, Human
cagggcuguggggcaggauagag

SEQ ID NO: 1071513 - RNA, 27 nt, Human
cagugacuuuccuccugcccccgguuu

SEQ ID NO: 1071514 - RNA, 21 nt, Human
caguuugcgauuucaccaguc

SEQ ID NO: 1071515 - RNA, 24 nt, Human
caugcaggauggaaagaaagauuc

SEQ ID NO: 1071516 - RNA, 20 nt, Human
ccaaggacagccaggaccca

SEQ ID NO: 1071517 - RNA, 21 nt, Human
ccccaaggacagccaggaccc

SEQ ID NO: 1071518 - RNA, 22 nt, Human
cccugaugguggcagaagaucc

SEQ ID NO: 1071519 - RNA, 22 nt, Human
ccuccugcccccgguuuguccc

SEQ ID NO: 1071520 - RNA, 19 nt, Human
ccucgucccgcugcuccuc

SEQ ID NO: 1071521 - RNA, 21 nt, Human
ccuuugcaaacagggguccgg

SEQ ID NO: 1071522 - RNA, 24 nt, Human
cggagaugccacaguggaugccac

SEQ ID NO: 1071523 - RNA, 22 nt, Human
cgucccgcugcuccucguccua

SEQ ID NO: 1071524 - RNA, 24 nt, Human
cguccuaaggaccucugcugccac

SEQ ID NO: 1071525 - RNA, 20 nt, Human
cuauuccaggaggggagcug

SEQ ID NO: 1071526 - RNA, 18 nt, Human
cucaggaaggaggagggg

SEQ ID NO: 1071527 - RNA, 21 nt, Human
cucaggaaggaggaggggaag

SEQ ID NO: 1071528 - RNA, 20 nt, Human
cuccaugaugauacgggguu

SEQ ID NO: 1071529 - RNA, 22 nt, Human
cucuauagucauguugagagcc

SEQ ID NO: 1071530 - RNA, 20 nt, Human
gaccacggccccuuucucug

SEQ ID NO: 1071531 - RNA, 24 nt, Human
gagaagacaggcgcagucagcagg

SEQ ID NO: 1071532 - RNA, 19 nt, Human
gagagggagggaggugcca

SEQ ID NO: 1071533 - RNA, 19 nt, Human
gagggauauuuucccacag

SEQ ID NO: 1071534 - RNA, 20 nt, Human
gccacaguggaugccacagc

SEQ ID NO: 1071535 - RNA, 19 nt, Human
gcccuguggccaugggauc

SEQ ID NO: 1071536 - RNA, 18 nt, Human
ggaacagacgcccaguuu

SEQ ID NO: 1071537 - RNA, 18 nt, Human
gggcagaggcagaugggc

SEQ ID NO: 1071538 - RNA, 20 nt, Human
ggucagagggagaagacagg

SEQ ID NO: 1071539 - RNA, 23 nt, Human
uacaaauccaggcagggcugugg

SEQ ID NO: 1071540 - RNA, 19 nt, Human
uagcugugcaggaugcaaa

SEQ ID NO: 1071541 - RNA, 20 nt, Human
ucaagugguugagagggagg

SEQ ID NO: 1071542 - RNA, 21 nt, Human
ucaccuucuucgccggcagaa

SEQ ID NO: 1071543 - RNA, 23 nt, Human
ucagugacuuuccuccugccccc

SEQ ID NO: 1071544 - RNA, 18 nt, Human
uccaggaggggagcugcc

SEQ ID NO: 1071545 - RNA, 23 nt, Human
uccaggaggggagcugcccugga

SEQ ID NO: 1071546 - RNA, 24 nt, Human
uccaugaugauacggggucucuau

SEQ ID NO: 1071547 - RNA, 23 nt, Human
uccuccugcccccgguuuguccc

SEQ ID NO: 1071548 - RNA, 25 nt, Human
uccugcccccgguuugucccugaug

SEQ ID NO: 1071549 - RNA, 20 nt, Human
ucugcccuuccucguccccc

SEQ ID NO: 1071550 - RNA, 19 nt, Human
ugagagggagggaggugcc

SEQ ID NO: 1071551 - RNA, 21 nt, Human
ugagagggagggaggugccau

SEQ ID NO: 1071552 - RNA, 21 nt, Human
ugcaaacagggguccggcgcc

SEQ ID NO: 1071553 - RNA, 20 nt, Human
ugccacagccuccuguggag

SEQ ID NO: 1071554 - RNA, 25 nt, Human
ugccacagccuccuguggagaccaa

SEQ ID NO: 1071555 - RNA, 21 nt, Human
ugccacagcugccacagccuc

SEQ ID NO: 1071556 - RNA, 24 nt, Human
ugccacaguggaugccacagcugc

SEQ ID NO: 1071557 - RNA, 22 nt, Human
ugcccuggaacgccccaaggac

SEQ ID NO: 1071558 - RNA, 19 nt, Human
ugcccuuccucgucccgcu

SEQ ID NO: 1071559 - RNA, 19 nt, Human
uggaugccacagcugccac

SEQ ID NO: 1071560 - RNA, 19 nt, Human
uggcagaagaucccagcug

SEQ ID NO: 1071561 - RNA, 22 nt, Human
ugggcaggacggagaugccaca

SEQ ID NO: 1071562 - RNA, 20 nt, Human
uggggucagagggagaagac

SEQ ID NO: 1071563 - RNA, 20 nt, Human
uucaggauucccgcauuuuc

SEQ ID NO: 1071564 - RNA, 25 nt, Human
uucccacaggaacaaaggucuccau

SEQ ID NO: 1071565 - RNA, 21 nt, Human
uuccucgucccgcugcuccuc

SEQ ID NO: 1071566 - RNA, 30 nt, Human
uuuccuccugcccccgguuugucccugauu

SEQ ID NO: 1071567 - RNA, 22 nt, Human
aauguuuacuggugagaaaguc

SEQ ID NO: 1071568 - RNA, 22 nt, Human
caggaacagccacaauguuuac

SEQ ID NO: 1071569 - RNA, 20 nt, Human
ccacaauguuuacuggugag

SEQ ID NO: 1071570 - RNA, 21 nt, Human
gcuuugcacucagcaguucca

SEQ ID NO: 1071571 - RNA, 22 nt, Human
uacaggaacagccacaauguuu

SEQ ID NO: 1071572 - RNA, 23 nt, Human
ucaguagggugacaguaacuucu

SEQ ID NO: 1071573 - RNA, 19 nt, Human
aaaaaaugacagaccccau

SEQ ID NO: 1071574 - RNA, 20 nt, Human
aaaacccaauucaagauaac

SEQ ID NO: 1071575 - RNA, 18 nt, Human
aacccaauucaagauaac

SEQ ID NO: 1071576 - RNA, 23 nt, Human
aacugggaccgacugaggaccug

SEQ ID NO: 1071577 - RNA, 18 nt, Human
aagauaacuuuagccaag

SEQ ID NO: 1071578 - RNA, 24 nt, Human
aaugauagcauccuucagaagaaa

SEQ ID NO: 1071579 - RNA, 24 nt, Human
acuacagccuucgacauuuacauc

SEQ ID NO: 1071580 - RNA, 22 nt, Human
acugcauuuuauugccuagggu

SEQ ID NO: 1071581 - RNA, 18 nt, Human
agggagcuucuuucucuu

SEQ ID NO: 1071582 - RNA, 22 nt, Human
cagacgcugccugcccucguuc

SEQ ID NO: 1071583 - RNA, 22 nt, Human
cagauucucauuuucaccccag

SEQ ID NO: 1071584 - RNA, 18 nt, Human
caucuuccagcuuccacc

SEQ ID NO: 1071585 - RNA, 23 nt, Human
caugacagaaaacccaauucaag

SEQ ID NO: 1071586 - RNA, 19 nt, Human
caugagccagagcuggcac

SEQ ID NO: 1071587 - RNA, 18 nt, Human
cauugggacccagcacag

SEQ ID NO: 1071588 - RNA, 23 nt, Human
cccaugcuggggcugggcaggac

SEQ ID NO: 1071589 - RNA, 26 nt, Human
ccccauccccagccccccugaaauga

SEQ ID NO: 1071590 - RNA, 19 nt, Human
ccccugaaaugacagugag

SEQ ID NO: 1071591 - RNA, 22 nt, Human
cccucaguuguuaggacccuau

SEQ ID NO: 1071592 - RNA, 22 nt, Human
cgcugccugcccucguuccgcu

SEQ ID NO: 1071593 - RNA, 18 nt, Human
cuccuggugccaaggugg

SEQ ID NO: 1071594 - RNA, 19 nt, Human
cugcccucagcagccucug

SEQ ID NO: 1071595 - RNA, 18 nt, Human
cugccugcccucguuccg

SEQ ID NO: 1071596 - RNA, 24 nt, Human
cuggaauggacagcagcucuuucu

SEQ ID NO: 1071597 - RNA, 21 nt, Human
cuggcaccauuugcugaccgg

SEQ ID NO: 1071598 - RNA, 19 nt, Human
gaacugggaccgacugagg

SEQ ID NO: 1071599 - RNA, 24 nt, Human
gaggugacaccuccucuaaucuca

SEQ ID NO: 1071600 - RNA, 24 nt, Human
gagugaccugggcagaggugacac

SEQ ID NO: 1071601 - RNA, 18 nt, Human
gauugcaugacagaaaac

SEQ ID NO: 1071602 - RNA, 18 nt, Human
gcccucagcagccucugu

SEQ ID NO: 1071603 - RNA, 19 nt, Human
ggaccaggagagaaaggcc

SEQ ID NO: 1071604 - RNA, 25 nt, Human
gggcuguaggugcccagagggggga

SEQ ID NO: 1071605 - RNA, 19 nt, Human
gggcuuuuuucugagugac

SEQ ID NO: 1071606 - RNA, 22 nt, Human
gucccccauccccagccccccu

SEQ ID NO: 1071607 - RNA, 18 nt, Human
uaacuuuagccaagaaag

SEQ ID NO: 1071608 - RNA, 24 nt, Human
uagcacugacagagggccggaguc

SEQ ID NO: 1071609 - RNA, 23 nt, Human
uagucccccauccccagcccccc

SEQ ID NO: 1071610 - RNA, 21 nt, Human
ucaacacgugggaacugggac

SEQ ID NO: 1071611 - RNA, 21 nt, Human
ucacccuggccaggugucccc

SEQ ID NO: 1071612 - RNA, 23 nt, Human
ucacuuugaaaccaagauaucac

SEQ ID NO: 1071613 - RNA, 25 nt, Human
ucauuuucaccccagucuccauggu

SEQ ID NO: 1071614 - RNA, 22 nt, Human
uccaggugugguggccuuuccu

SEQ ID NO: 1071615 - RNA, 18 nt, Human
uccaugagucauuuucug

SEQ ID NO: 1071616 - RNA, 23 nt, Human
uccaugcaccuuccaugagucau

SEQ ID NO: 1071617 - RNA, 22 nt, Human
uccccagccccccugaaaugac

SEQ ID NO: 1071618 - RNA, 25 nt, Human
ucccccauccccagccccccugaaa

SEQ ID NO: 1071619 - RNA, 23 nt, Human
ucccucaguuguuaggacccuau

SEQ ID NO: 1071620 - RNA, 20 nt, Human
uccuccuggugccaaggugg

SEQ ID NO: 1071621 - RNA, 23 nt, Human
ucucugucauagucccccauccc

SEQ ID NO: 1071622 - RNA, 24 nt, Human
ucucugucauagucccccaucccc

SEQ ID NO: 1071623 - RNA, 24 nt, Human
ugagucauuuucugugucugggag

SEQ ID NO: 1071624 - RNA, 20 nt, Human
ugauacaaaggcacagugcu

SEQ ID NO: 1071625 - RNA, 21 nt, Human
ugcccucguuccgcuucugac

SEQ ID NO: 1071626 - RNA, 18 nt, Human
ugcuaaaaaaugacagac

SEQ ID NO: 1071627 - RNA, 21 nt, Human
uggaaaagagggagcuucuuu

SEQ ID NO: 1071628 - RNA, 18 nt, Human
uggaauggacagcagcuc

SEQ ID NO: 1071629 - RNA, 18 nt, Human
uggcuuaggucucuguca

SEQ ID NO: 1071630 - RNA, 23 nt, Human
ugggcagaggugacaccuccucu

SEQ ID NO: 1071631 - RNA, 26 nt, Human
uggugccaagguggcugucaugcuuc

SEQ ID NO: 1071632 - RNA, 20 nt, Human
uguagaggaggaagaagguu

SEQ ID NO: 1071633 - RNA, 23 nt, Human
ugucugggagugcagaauaugcu

SEQ ID NO: 1071634 - RNA, 22 nt, Human
ugugguggccuuuccugauaca

SEQ ID NO: 1071635 - RNA, 22 nt, Human
uguugcauccucugcccucagc

SEQ ID NO: 1071636 - RNA, 19 nt, Human
uucucauuuucaccccagu

SEQ ID NO: 1071637 - RNA, 21 nt, Human
uucuguagaggaggaagaagg

SEQ ID NO: 1071638 - RNA, 22 nt, Human
uucugugucugggagugcagaa

SEQ ID NO: 1071639 - RNA, 18 nt, Human
uugguccaggugcucaca

SEQ ID NO: 1071640 - RNA, 22 nt, Human
uuuuguuagccuccuccuggug

SEQ ID NO: 1071641 - RNA, 22 nt, Human
uuuuucaucucuugcaauggaa

SEQ ID NO: 1071642 - RNA, 22 nt, Human
aaggauguugggcgucacuggc

SEQ ID NO: 1071643 - RNA, 23 nt, Human
cgcccacaaccacagcucgggcg

SEQ ID NO: 1071644 - RNA, 18 nt, Human
gaggaggcgccuuggacu

SEQ ID NO: 1071645 - RNA, 21 nt, Human
gcgcccacaaccacagcucgg

SEQ ID NO: 1071646 - RNA, 21 nt, Human
uauuucagaaagcccuaauug

SEQ ID NO: 1071647 - RNA, 21 nt, Human
ugcaccaguaaggauguuggg

SEQ ID NO: 1071648 - RNA, 18 nt, Human
ugggaggaggcgccuugg

SEQ ID NO: 1071649 - RNA, 25 nt, Human
uuguccggcgcccacaaccacagcu

SEQ ID NO: 1071650 - RNA, 22 nt, Human
aaggagcccgggagcccccugc

SEQ ID NO: 1071651 - RNA, 22 nt, Human
cagcaggaaguugaagacuucg

SEQ ID NO: 1071652 - RNA, 21 nt, Human
caggaauguggagacguagug

SEQ ID NO: 1071653 - RNA, 24 nt, Human
cgaauggucagggugcaguaauac

SEQ ID NO: 1071654 - RNA, 23 nt, Human
gagcccccugcagucugaagucc

SEQ ID NO: 1071655 - RNA, 19 nt, Human
guaggcgaacuuggccugg

SEQ ID NO: 1071656 - RNA, 19 nt, Human
uccggacaggaauguggag

SEQ ID NO: 1071657 - RNA, 18 nt, Human
ugccacggcacccaggag

SEQ ID NO: 1071658 - RNA, 18 nt, Human
ugcugggaaggagcccgg

SEQ ID NO: 1071659 - RNA, 18 nt, Human
ugggaaggagcccgggag

SEQ ID NO: 1071660 - RNA, 23 nt, Human
ugggaaggagcccgggagccccc

SEQ ID NO: 1071661 - RNA, 24 nt, Human
uucaaguagagccuggaaggaaac

SEQ ID NO: 1071662 - RNA, 19 nt, Human
aaaauaacggaaacacaga

SEQ ID NO: 1071663 - RNA, 23 nt, Human
aaacacagauauguuuaaaaucc

SEQ ID NO: 1071664 - RNA, 22 nt, Human
aaacucaaaagcauaacugaua

SEQ ID NO: 1071665 - RNA, 19 nt, Human
aacacucacaaaggggaag

SEQ ID NO: 1071666 - RNA, 18 nt, Human
aacacucaguuaaaagcu

SEQ ID NO: 1071667 - RNA, 19 nt, Human
aacauacuugacagcaaga

SEQ ID NO: 1071668 - RNA, 19 nt, Human
aaguagggugggaaaaaag

SEQ ID NO: 1071669 - RNA, 25 nt, Human
aagucacugaaagcuuacuggaacc

SEQ ID NO: 1071670 - RNA, 27 nt, Human
aauaacggaaacacagaagggagggcc

SEQ ID NO: 1071671 - RNA, 23 nt, Human
aauggagaacucucucacccaaa

SEQ ID NO: 1071672 - RNA, 23 nt, Human
acaaagagaacagacaaaaaucu

SEQ ID NO: 1071673 - RNA, 21 nt, Human
acaaagcaacucuuaggcccu

SEQ ID NO: 1071674 - RNA, 18 nt, Human
acagaaaggucucuaaac

SEQ ID NO: 1071675 - RNA, 21 nt, Human
accucccuuuuccaaugccaa

SEQ ID NO: 1071676 - RNA, 22 nt, Human
acuaaaucaaaacacuaaaauc

SEQ ID NO: 1071677 - RNA, 27 nt, Human
acuuuuuuuuuucuuuucgcucuuugg

SEQ ID NO: 1071678 - RNA, 25 nt, Human
agaccaaaagaauaaaauuuguauu

SEQ ID NO: 1071679 - RNA, 25 nt, Human
agagaacagacaaaaaucucaccac

SEQ ID NO: 1071680 - RNA, 26 nt, Human
agaguccuucucuuuuucuccucugg

SEQ ID NO: 1071681 - RNA, 23 nt, Human
agguaucaaagucacugaaagcu

SEQ ID NO: 1071682 - RNA, 24 nt, Human
aggugccccaaggaagacagaggc

SEQ ID NO: 1071683 - RNA, 21 nt, Human
auacaaagagaacagacaaaa

SEQ ID NO: 1071684 - RNA, 28 nt, Human
auacacuaaaucaaaacacuaaaaucau

SEQ ID NO: 1071685 - RNA, 22 nt, Human
caaacugauagccagacuauaa

SEQ ID NO: 1071686 - RNA, 22 nt, Human
caaagucacugaaagcuuacug

SEQ ID NO: 1071687 - RNA, 25 nt, Human
caacucaagaaacuuggggagguau

SEQ ID NO: 1071688 - RNA, 20 nt, Human
caagaccaaaagaauaaaau

SEQ ID NO: 1071689 - RNA, 19 nt, Human
caaugccaaguucauauga

SEQ ID NO: 1071690 - RNA, 23 nt, Human
cacagguaucugauuaaaagccu

SEQ ID NO: 1071691 - RNA, 20 nt, Human
cacuccuggcaaaguucuaa

SEQ ID NO: 1071692 - RNA, 22 nt, Human
cagacaaaaaucucaccacaaa

SEQ ID NO: 1071693 - RNA, 21 nt, Human
cagauugagaaacauacuuga

SEQ ID NO: 1071694 - RNA, 26 nt, Human
cagcaagauaucaaacugauagccag

SEQ ID NO: 1071695 - RNA, 21 nt, Human
caguucccaaaauaacggaaa

SEQ ID NO: 1071696 - RNA, 23 nt, Human
cauggcaacacaaaacccaagag

SEQ ID NO: 1071697 - RNA, 22 nt, Human
cauugcuguuugcaacuggaga

SEQ ID NO: 1071698 - RNA, 24 nt, Human
ccaauaauacugaacuauguagua

SEQ ID NO: 1071699 - RNA, 24 nt, Human
ccagggguagcauccagagcugag

SEQ ID NO: 1071700 - RNA, 18 nt, Human
cccaaaaaguaauucuca

SEQ ID NO: 1071701 - RNA, 22 nt, Human
ccucggagggcuauuucucacc

SEQ ID NO: 1071702 - RNA, 22 nt, Human
cggacuacacggcacaaagcaa

SEQ ID NO: 1071703 - RNA, 18 nt, Human
cuauguaguauacacuaa

SEQ ID NO: 1071704 - RNA, 20 nt, Human
cucccuuuuccaaugccaag

SEQ ID NO: 1071705 - RNA, 24 nt, Human
gaaacuuggggagguaucaaaguc

SEQ ID NO: 1071706 - RNA, 22 nt, Human
gaacagacaaaaaucucaccac

SEQ ID NO: 1071707 - RNA, 23 nt, Human
gaacagacaaaaaucucaccaca

SEQ ID NO: 1071708 - RNA, 21 nt, Human
gacaagaaaagaguuuuaggu

SEQ ID NO: 1071709 - RNA, 18 nt, Human
gagaacucucucacccaa

SEQ ID NO: 1071710 - RNA, 21 nt, Human
gagguaucaaagucacugaaa

SEQ ID NO: 1071711 - RNA, 24 nt, Human
gcauagacugcuuaaauucuccca

SEQ ID NO: 1071712 - RNA, 24 nt, Human
gcuucaacugaagaguuccugauu

SEQ ID NO: 1071713 - RNA, 21 nt, Human
ggagaacucucucacccaaaa

SEQ ID NO: 1071714 - RNA, 20 nt, Human
gguacuuaagccagcuggca

SEQ ID NO: 1071715 - RNA, 21 nt, Human
guccuuuuucuuuaccucccu

SEQ ID NO: 1071716 - RNA, 21 nt, Human
uaaaccaucaggagcaaacac

SEQ ID NO: 1071717 - RNA, 23 nt, Human
uaaaccaucaggagcaaacacuc

SEQ ID NO: 1071718 - RNA, 21 nt, Human
uaaacucaaaagcauaacuga

SEQ ID NO: 1071719 - RNA, 21 nt, Human
uaaauucucccaagaccaaaa

SEQ ID NO: 1071720 - RNA, 19 nt, Human
uaacaagcagcaacucaag

SEQ ID NO: 1071721 - RNA, 22 nt, Human
uaacaagcagcaacucaagaaa

SEQ ID NO: 1071722 - RNA, 21 nt, Human
uacacugauucaugaauggga

SEQ ID NO: 1071723 - RNA, 22 nt, Human
uaccgugcuuguuucaaacuca

SEQ ID NO: 1071724 - RNA, 19 nt, Human
uaccugagugacagauugg

SEQ ID NO: 1071725 - RNA, 19 nt, Human
uacuucagaagaccgauuu

SEQ ID NO: 1071726 - RNA, 26 nt, Human
uagccagacuauaaaauguauacauc

SEQ ID NO: 1071727 - RNA, 24 nt, Human
uaguaagcacuuuuuucuaguuca

SEQ ID NO: 1071728 - RNA, 21 nt, Human
uaguauacacuaaaucaaaac

SEQ ID NO: 1071729 - RNA, 24 nt, Human
uaguucacuccuggcaaaguucua

SEQ ID NO: 1071730 - RNA, 28 nt, Human
uaucaaaauaacucauaaacaaaaaaaa

SEQ ID NO: 1071731 - RNA, 24 nt, Human
uaucugauuaaaagccuuaaggac

SEQ ID NO: 1071732 - RNA, 23 nt, Human
ucaacugaagaguuccugauuac

SEQ ID NO: 1071733 - RNA, 21 nt, Human
ucaagcaucccucuccaugcu

SEQ ID NO: 1071734 - RNA, 21 nt, Human
ucacuuaccuccuaucauuca

SEQ ID NO: 1071735 - RNA, 23 nt, Human
ucccagggguagcauccagagcu

SEQ ID NO: 1071736 - RNA, 24 nt, Human
ucugacaagaaaagaguuuuaggu

SEQ ID NO: 1071737 - RNA, 19 nt, Human
ucuuuuuuucauuagccau

SEQ ID NO: 1071738 - RNA, 25 nt, Human
ugaaguagggugggaaaaaagguca

SEQ ID NO: 1071739 - RNA, 20 nt, Human
ugacagcaagauaucaaacu

SEQ ID NO: 1071740 - RNA, 20 nt, Human
ugauacaacaugaaaaucuc

SEQ ID NO: 1071741 - RNA, 20 nt, Human
ugaugaguugcauagacugc

SEQ ID NO: 1071742 - RNA, 23 nt, Human
ugcauagacugcuuaaauucucc

SEQ ID NO: 1071743 - RNA, 21 nt, Human
uggagaauuaaguagcagagg

SEQ ID NO: 1071744 - RNA, 22 nt, Human
uggcagaauaauaugcugagaa

SEQ ID NO: 1071745 - RNA, 20 nt, Human
uggggagguaucaaagucac

SEQ ID NO: 1071746 - RNA, 24 nt, Human
uuaaaauuuuucugucaacacugg

SEQ ID NO: 1071747 - RNA, 22 nt, Human
uuagcaugcugucaagcauccc

SEQ ID NO: 1071748 - RNA, 25 nt, Human
uucacauaacagcaguagauauccc

SEQ ID NO: 1071749 - RNA, 24 nt, Human
uuuuuuuucuuuucgcucuuuggu

SEQ ID NO: 1071750 - RNA, 22 nt, Human
aaaacguuuuuggaauaaaaua

SEQ ID NO: 1071751 - RNA, 20 nt, Human
guaagcuccucauccagucc

SEQ ID NO: 1071752 - RNA, 20 nt, Human
uccaagaaccagaaagcucc

SEQ ID NO: 1071753 - RNA, 22 nt, Human
aaaaagaagagaaauagagaaa

SEQ ID NO: 1071754 - RNA, 24 nt, Human
aaaaaggaugacagaauaaaagga

SEQ ID NO: 1071755 - RNA, 19 nt, Human
aaaaagucgaccagccuuc

SEQ ID NO: 1071756 - RNA, 23 nt, Human
aaaagaaagagaaaaaagaagag

SEQ ID NO: 1071757 - RNA, 21 nt, Human
aaaagaagagaaauagagaac

SEQ ID NO: 1071758 - RNA, 22 nt, Human
aaacagaugugagucaucuuau

SEQ ID NO: 1071759 - RNA, 19 nt, Human
aaacagcuguccugagagc

SEQ ID NO: 1071760 - RNA, 18 nt, Human
aaagaaaaaaagaaagag

SEQ ID NO: 1071761 - RNA, 19 nt, Human
aaagaaaaaaagaaagaga

SEQ ID NO: 1071762 - RNA, 20 nt, Human
aaagguaucaccagggucuu

SEQ ID NO: 1071763 - RNA, 22 nt, Human
aaaugucaauggcugcaagggc

SEQ ID NO: 1071764 - RNA, 18 nt, Human
aacuucugaugaaagcca

SEQ ID NO: 1071765 - RNA, 19 nt, Human
aagaaagagaaaaaagaag

SEQ ID NO: 1071766 - RNA, 18 nt, Human
aagaagagaaauagagaa

SEQ ID NO: 1071767 - RNA, 21 nt, Human
aagagacucgagagccagcca

SEQ ID NO: 1071768 - RNA, 20 nt, Human
aagagagaaaaguaaaaaag

SEQ ID NO: 1071769 - RNA, 22 nt, Human
aagaggaaauauuauaaccuga

SEQ ID NO: 1071770 - RNA, 24 nt, Human
aagaguucaaguuaaacagaugug

SEQ ID NO: 1071771 - RNA, 21 nt, Human
aauaguggaagcagaaagaaa

SEQ ID NO: 1071772 - RNA, 22 nt, Human
acaguugaauauauuuuccuca

SEQ ID NO: 1071773 - RNA, 19 nt, Human
accaucacuccuauaugcc

SEQ ID NO: 1071774 - RNA, 21 nt, Human
acucagagcucaagauggagg

SEQ ID NO: 1071775 - RNA, 24 nt, Human
agaaagccucaaacaaaaacguua

SEQ ID NO: 1071776 - RNA, 23 nt, Human
agaaagguaucaccagggucuuc

SEQ ID NO: 1071777 - RNA, 22 nt, Human
agacaggauggaucccaugggg

SEQ ID NO: 1071778 - RNA, 24 nt, Human
agacaggauggaucccauggggcc

SEQ ID NO: 1071779 - RNA, 26 nt, Human
agagaaaaaagaagagaaauagagaa

SEQ ID NO: 1071780 - RNA, 20 nt, Human
agagacucgagagccagccc

SEQ ID NO: 1071781 - RNA, 21 nt, Human
aggcacuugggagcccacgac

SEQ ID NO: 1071782 - RNA, 22 nt, Human
aggcuagaaccagguccuagaa

SEQ ID NO: 1071783 - RNA, 20 nt, Human
agggaaaaaaaggaugacag

SEQ ID NO: 1071784 - RNA, 25 nt, Human
agguauguccugggccuaauaugcu

SEQ ID NO: 1071785 - RNA, 21 nt, Human
aucuguuuccuugguguccag

SEQ ID NO: 1071786 - RNA, 21 nt, Human
auuuauaagucauguauguuu

SEQ ID NO: 1071787 - RNA, 19 nt, Human
cacagcagugcucaccgag

SEQ ID NO: 1071788 - RNA, 24 nt, Human
cacagcagugcucaccgagcgaaa

SEQ ID NO: 1071789 - RNA, 27 nt, Human
cagccuucagguauguccugggccuaa

SEQ ID NO: 1071790 - RNA, 25 nt, Human
cagcucuggaccccauuagccuccc

SEQ ID NO: 1071791 - RNA, 24 nt, Human
caggcauuaggugauccaucuccu

SEQ ID NO: 1071792 - RNA, 19 nt, Human
ccagcuccaguauccugcc

SEQ ID NO: 1071793 - RNA, 24 nt, Human
cccacgacaaacagcuguccugag

SEQ ID NO: 1071794 - RNA, 23 nt, Human
cccguguugcgacacgauuagga

SEQ ID NO: 1071795 - RNA, 22 nt, Human
cccugcugcugcucagucuugc

SEQ ID NO: 1071796 - RNA, 18 nt, Human
ccuagaacuugguggcac

SEQ ID NO: 1071797 - RNA, 20 nt, Human
ccucaguuuccuuguucagc

SEQ ID NO: 1071798 - RNA, 23 nt, Human
ccucaguuuccuuguucagcucu

SEQ ID NO: 1071799 - RNA, 19 nt, Human
ccucccagcuccaguaucc

SEQ ID NO: 1071800 - RNA, 20 nt, Human
ccugcgugucugggccuuug

SEQ ID NO: 1071801 - RNA, 20 nt, Human
ccuuucuuuauggcuaaaga

SEQ ID NO: 1071802 - RNA, 24 nt, Human
cgauuaggauuuuugcauaagagu

SEQ ID NO: 1071803 - RNA, 22 nt, Human
cggaaucauggugguagccccc

SEQ ID NO: 1071804 - RNA, 20 nt, Human
cuaaagaaaaaaagaaagag

SEQ ID NO: 1071805 - RNA, 21 nt, Human
cuccaguauccugcccauucc

SEQ ID NO: 1071806 - RNA, 18 nt, Human
cuguccugagagcucccu

SEQ ID NO: 1071807 - RNA, 21 nt, Human
cuguccugagagcucccuggg

SEQ ID NO: 1071808 - RNA, 23 nt, Human
cuucacaguugaauauauuuucc

SEQ ID NO: 1071809 - RNA, 19 nt, Human
gaaauauuauaaccugaaa

SEQ ID NO: 1071810 - RNA, 24 nt, Human
gagccagccacaauguugauccca

SEQ ID NO: 1071811 - RNA, 26 nt, Human
gagcccacgacaaacagcuguccuga

SEQ ID NO: 1071812 - RNA, 21 nt, Human
gagguagcggaaucauggugg

SEQ ID NO: 1071813 - RNA, 23 nt, Human
gaugacagaauaaaaggaaaaga

SEQ ID NO: 1071814 - RNA, 20 nt, Human
gcugaaccccuguaaacuca

SEQ ID NO: 1071815 - RNA, 23 nt, Human
gcugaaccccuguaaacucagga

SEQ ID NO: 1071816 - RNA, 20 nt, Human
gcugcugcucagucuugcuu

SEQ ID NO: 1071817 - RNA, 20 nt, Human
gggaaguguggcuggacccc

SEQ ID NO: 1071818 - RNA, 19 nt, Human
gggacuggggccuccagga

SEQ ID NO: 1071819 - RNA, 21 nt, Human
ggggaaguucucacacuggac

SEQ ID NO: 1071820 - RNA, 23 nt, Human
ggggacuggggccuccaggaggu

SEQ ID NO: 1071821 - RNA, 22 nt, Human
gggucuggacuuagguuuccca

SEQ ID NO: 1071822 - RNA, 18 nt, Human
guauccugcccauuccca

SEQ ID NO: 1071823 - RNA, 24 nt, Human
guauccugcccauucccaaaugac

SEQ ID NO: 1071824 - RNA, 25 nt, Human
uaauaugcugcuuuugguccuugga

SEQ ID NO: 1071825 - RNA, 21 nt, Human
uaccaguggcauuuugauggg

SEQ ID NO: 1071826 - RNA, 19 nt, Human
uacuagaaaagcagcacaa

SEQ ID NO: 1071827 - RNA, 23 nt, Human
uagccucccagcuccaguauccu

SEQ ID NO: 1071828 - RNA, 23 nt, Human
uauaaccugaaaaaugggacaga

SEQ ID NO: 1071829 - RNA, 24 nt, Human
ucaggcauuaggugauccaucucc

SEQ ID NO: 1071830 - RNA, 18 nt, Human
ucauggcaagacauaagc

SEQ ID NO: 1071831 - RNA, 23 nt, Human
ucauguauguuuuucagauuccu

SEQ ID NO: 1071832 - RNA, 19 nt, Human
ucccggaagacuccaccuu

SEQ ID NO: 1071833 - RNA, 19 nt, Human
uccuagaacuugguggcac

SEQ ID NO: 1071834 - RNA, 23 nt, Human
uccuuucuuuauggcuaaagaaa

SEQ ID NO: 1071835 - RNA, 26 nt, Human
ucuaggcuagaaccagguccuagaac

SEQ ID NO: 1071836 - RNA, 24 nt, Human
ucuggugcugaugaagcuuaagaa

SEQ ID NO: 1071837 - RNA, 19 nt, Human
ugaaccccuguaaacucag

SEQ ID NO: 1071838 - RNA, 18 nt, Human
ugacagaauaaaaggaaa

SEQ ID NO: 1071839 - RNA, 23 nt, Human
ugacagaauaaaaggaaaagaga

SEQ ID NO: 1071840 - RNA, 20 nt, Human
ugacccgauagacacaguaa

SEQ ID NO: 1071841 - RNA, 19 nt, Human
ugaugggggaaguucucac

SEQ ID NO: 1071842 - RNA, 20 nt, Human
ugcugcugcucagucuugcu

SEQ ID NO: 1071843 - RNA, 22 nt, Human
ugcuucaaccacgugguccauu

SEQ ID NO: 1071844 - RNA, 18 nt, Human
ugcuuggcugaaccccug

SEQ ID NO: 1071845 - RNA, 19 nt, Human
ugcuuggcugaaccccugu

SEQ ID NO: 1071846 - RNA, 24 nt, Human
uggcuaaagaaaaaaagaaagaga

SEQ ID NO: 1071847 - RNA, 19 nt, Human
uggggccuccaggaggugu

SEQ ID NO: 1071848 - RNA, 22 nt, Human
ugugaucaauaccucagguacc

SEQ ID NO: 1071849 - RNA, 22 nt, Human
uuacuagaaaagcagcacaacc

SEQ ID NO: 1071850 - RNA, 24 nt, Human
uucaggcauuaggugauccaucuc

SEQ ID NO: 1071851 - RNA, 20 nt, Human
uuccucaguuuccuuguucc

SEQ ID NO: 1071852 - RNA, 18 nt, Human
uucuccagugcccaacac

SEQ ID NO: 1071853 - RNA, 21 nt, Human
uuggcuucguuuuucuccagu

SEQ ID NO: 1071854 - RNA, 19 nt, Human
uuuccacaacuaauaaucu

SEQ ID NO: 1071855 - RNA, 24 nt, Human
uuuccacaacuaauaaucuaugaa

SEQ ID NO: 1071856 - RNA, 21 nt, Human
uuuuugguuaagacuuauuug

SEQ ID NO: 1071857 - RNA, 25 nt, Human
aaaccgggcccggcauugcaggaga

SEQ ID NO: 1071858 - RNA, 22 nt, Human
aagaaaccgggcccggcauugc

SEQ ID NO: 1071859 - RNA, 26 nt, Human
acaggaaaagggcccagagguggaga

SEQ ID NO: 1071860 - RNA, 19 nt, Human
accaugcaagggacacuga

SEQ ID NO: 1071861 - RNA, 22 nt, Human
accccgcggcguccgggcagcg

SEQ ID NO: 1071862 - RNA, 20 nt, Human
acgacacugugugaccuuga

SEQ ID NO: 1071863 - RNA, 23 nt, Human
acuuuggauuaaccacagcugug

SEQ ID NO: 1071864 - RNA, 18 nt, Human
aggccaggcaagcugaaa

SEQ ID NO: 1071865 - RNA, 23 nt, Human
auuuccccacucagaagaaacaa

SEQ ID NO: 1071866 - RNA, 24 nt, Human
caagggacacugaaagacggcagc

SEQ ID NO: 1071867 - RNA, 24 nt, Human
cacucagaagaaacaagagaguuu

SEQ ID NO: 1071868 - RNA, 18 nt, Human
cacugugugaccuugacu

SEQ ID NO: 1071869 - RNA, 22 nt, Human
cagaggcgcuucugagcugagg

SEQ ID NO: 1071870 - RNA, 23 nt, Human
caggagaauagagaacaggaaaa

SEQ ID NO: 1071871 - RNA, 21 nt, Human
ccagcgcucagaccggccgag

SEQ ID NO: 1071872 - RNA, 20 nt, Human
ccaggcaagcugaaauucac

SEQ ID NO: 1071873 - RNA, 23 nt, Human
cccacucagaagaaacaagagag

SEQ ID NO: 1071874 - RNA, 20 nt, Human
cccgcgccgagugcccuggg

SEQ ID NO: 1071875 - RNA, 21 nt, Human
cccugggcuggcggggacccc

SEQ ID NO: 1071876 - RNA, 18 nt, Human
ccggccgagcgcaacucc

SEQ ID NO: 1071877 - RNA, 20 nt, Human
cgagugcccugggcuggcgg

SEQ ID NO: 1071878 - RNA, 18 nt, Human
cucagaccggccgagcgc

SEQ ID NO: 1071879 - RNA, 23 nt, Human
cugacucugaagcugagggucug

SEQ ID NO: 1071880 - RNA, 25 nt, Human
cuggcucauccuccuccugagguuu

SEQ ID NO: 1071881 - RNA, 20 nt, Human
gaaagacggcagcugaccug

SEQ ID NO: 1071882 - RNA, 21 nt, Human
gagaacaggaaaagggcccag

SEQ ID NO: 1071883 - RNA, 23 nt, Human
gagggucugcagaagggagugug

SEQ ID NO: 1071884 - RNA, 19 nt, Human
gagggugcagaugacagcu

SEQ ID NO: 1071885 - RNA, 21 nt, Human
gagugcccugggcuggcgggg

SEQ ID NO: 1071886 - RNA, 24 nt, Human
gauccaaggccaggcaagcugaaa

SEQ ID NO: 1071887 - RNA, 21 nt, Human
gcaaggucuguggaaucugag

SEQ ID NO: 1071888 - RNA, 20 nt, Human
gcccugggcuggcggggacc

SEQ ID NO: 1071889 - RNA, 19 nt, Human
gccgacgagaagcugggcu

SEQ ID NO: 1071890 - RNA, 21 nt, Human
gcgaggcgcgcagauccccgc

SEQ ID NO: 1071891 - RNA, 18 nt, Human
ggaccuccacggacccaa

SEQ ID NO: 1071892 - RNA, 21 nt, Human
ggcaaggucuguggaaucuga

SEQ ID NO: 1071893 - RNA, 20 nt, Human
ggcugacucugaagcugagg

SEQ ID NO: 1071894 - RNA, 19 nt, Human
gggcccacaguaggggggg

SEQ ID NO: 1071895 - RNA, 20 nt, Human
guggagaugguaagaccaug

SEQ ID NO: 1071896 - RNA, 19 nt, Human
uaaccacagcuguggggcc

SEQ ID NO: 1071897 - RNA, 19 nt, Human
uacuuugccuuuuaguggc

SEQ ID NO: 1071898 - RNA, 24 nt, Human
uacuuugccuuuuaguggcuggcu

SEQ ID NO: 1071899 - RNA, 21 nt, Human
uagaagaaaccgggcccggca

SEQ ID NO: 1071900 - RNA, 18 nt, Human
uccccgcgccgagugccc

SEQ ID NO: 1071901 - RNA, 25 nt, Human
ucccuacuuugccuuuuaguggcug

SEQ ID NO: 1071902 - RNA, 23 nt, Human
uccuguguuugggagagcaccaa

SEQ ID NO: 1071903 - RNA, 23 nt, Human
ucugcagggaccuccacggaccc

SEQ ID NO: 1071904 - RNA, 24 nt, Human
ucugcagggaccuccacggaccca

SEQ ID NO: 1071905 - RNA, 25 nt, Human
ucugcagggaccuccacggacccaa

SEQ ID NO: 1071906 - RNA, 20 nt, Human
ugagggucugcagaagggag

SEQ ID NO: 1071907 - RNA, 23 nt, Human
ugcaagggacacugaaagacggc

SEQ ID NO: 1071908 - RNA, 21 nt, Human
ugcagaagggaguguggacga

SEQ ID NO: 1071909 - RNA, 21 nt, Human
uggacgacacugugugaccuu

SEQ ID NO: 1071910 - RNA, 23 nt, Human
ugggagagcaccaagaguagaag

SEQ ID NO: 1071911 - RNA, 20 nt, Human
uggggccgacgagaagcugg

SEQ ID NO: 1071912 - RNA, 18 nt, Human
uggggcuucugagcuucu

SEQ ID NO: 1071913 - RNA, 19 nt, Human
uuaguggcuggcucauccu

SEQ ID NO: 1071914 - RNA, 24 nt, Human
uugcuguugccuuuccugaaaucu

SEQ ID NO: 1071915 - RNA, 20 nt, Human
uugggcaugacaagcgacag

SEQ ID NO: 1071916 - RNA, 24 nt, Human
uuguuggacgacacugugugaccu

SEQ ID NO: 1071917 - RNA, 18 nt, Human
aaaccucaauuuaucauc

SEQ ID NO: 1071918 - RNA, 24 nt, Human
aaaguuuugggauuacaggcauga

SEQ ID NO: 1071919 - RNA, 20 nt, Human
acaccucuuccugauuccca

SEQ ID NO: 1071920 - RNA, 19 nt, Human
acaggcgcccgccaccaac

SEQ ID NO: 1071921 - RNA, 24 nt, Human
accaacaccuggcuaauuuuugua

SEQ ID NO: 1071922 - RNA, 21 nt, Human
acccaugugcuccuggccaca

SEQ ID NO: 1071923 - RNA, 25 nt, Human
acccgccucagccucccaaagugcu

SEQ ID NO: 1071924 - RNA, 18 nt, Human
acgggguuucuccauguu

SEQ ID NO: 1071925 - RNA, 20 nt, Human
acgggguuucuccauguugg

SEQ ID NO: 1071926 - RNA, 24 nt, Human
acgggguuucuccauguuggccag

SEQ ID NO: 1071927 - RNA, 24 nt, Human
acucuuguugcccaggcuggagug

SEQ ID NO: 1071928 - RNA, 21 nt, Human
acugcaaccucugccucccag

SEQ ID NO: 1071929 - RNA, 22 nt, Human
acugcaaccucugccucccagg

SEQ ID NO: 1071930 - RNA, 19 nt, Human
agaaagaggcugguuuagc

SEQ ID NO: 1071931 - RNA, 22 nt, Human
agaggcugguuuagcuggcuuc

SEQ ID NO: 1071932 - RNA, 18 nt, Human
agcugcugcaucccagaa

SEQ ID NO: 1071933 - RNA, 18 nt, Human
aggugaucaacccgccuc

SEQ ID NO: 1071934 - RNA, 21 nt, Human
agguucaagugauucuccugc

SEQ ID NO: 1071935 - RNA, 21 nt, Human
agguucaagugauucuccugc

SEQ ID NO: 1071936 - RNA, 22 nt, Human
agguucaagugauucuccugcc

SEQ ID NO: 1071937 - RNA, 22 nt, Human
agguucaagugauucuccugcc

SEQ ID NO: 1071938 - RNA, 23 nt, Human
agguucaagugauucuccugccu

SEQ ID NO: 1071939 - RNA, 23 nt, Human
agguucaagugauucuccugccu

SEQ ID NO: 1071940 - RNA, 22 nt, Human
aguagagacgggguuucuccau

SEQ ID NO: 1071941 - RNA, 22 nt, Human
aguagagaugggguuucuccau

SEQ ID NO: 1071942 - RNA, 18 nt, Human
aguagcugggauuacagg

SEQ ID NO: 1071943 - RNA, 21 nt, Human
aguagcugggauuacaggcau

SEQ ID NO: 1071944 - RNA, 24 nt, Human
agugauucuccugccucagccucc

SEQ ID NO: 1071945 - RNA, 24 nt, Human
agugcaauggcuugaucucggcuc

SEQ ID NO: 1071946 - RNA, 24 nt, Human
aguuuuguauuuuuaguagagaug

SEQ ID NO: 1071947 - RNA, 20 nt, Human
augggguuucuccauguugg

SEQ ID NO: 1071948 - RNA, 21 nt, Human
augggguuucuccauguuggu

SEQ ID NO: 1071949 - RNA, 24 nt, Human
augggguuucuccauguuggucag

SEQ ID NO: 1071950 - RNA, 18 nt, Human
auucuccugccucagccu

SEQ ID NO: 1071951 - RNA, 20 nt, Human
auugcacccggccaguuuac

SEQ ID NO: 1071952 - RNA, 24 nt, Human
auuuuuguauuuuuaguagagacg

SEQ ID NO: 1071953 - RNA, 22 nt, Human
caacccgccucagccucccaaa

SEQ ID NO: 1071954 - RNA, 20 nt, Human
caagugauucuccugccuca

SEQ ID NO: 1071955 - RNA, 22 nt, Human
caagugauucuccugccucaac

SEQ ID NO: 1071956 - RNA, 22 nt, Human
caagugauucuccugccucagc

SEQ ID NO: 1071957 - RNA, 18 nt, Human
caagugucuaccaaacac

SEQ ID NO: 1071958 - RNA, 21 nt, Human
caagugucuaccaaacaccag

SEQ ID NO: 1071959 - RNA, 21 nt, Human
cacaauauaugccagggcaag

SEQ ID NO: 1071960 - RNA, 21 nt, Human
caccacaacaucugccuccca

SEQ ID NO: 1071961 - RNA, 23 nt, Human
caccacaacaucugccucccagg

SEQ ID NO: 1071962 - RNA, 24 nt, Human
caccucuuccugauucccacaguc

SEQ ID NO: 1071963 - RNA, 18 nt, Human
cacguagcauagggcagc

SEQ ID NO: 1071964 - RNA, 24 nt, Human
cacucuuguugcccaggcuggagu

SEQ ID NO: 1071965 - RNA, 22 nt, Human
cagacagaacucaguuguaauc

SEQ ID NO: 1071966 - RNA, 20 nt, Human
cagccuccugaguagcuggg

SEQ ID NO: 1071967 - RNA, 18 nt, Human
caguaaagcaaucuacca

SEQ ID NO: 1071968 - RNA, 21 nt, Human
caguuguaauccuagcucuug

SEQ ID NO: 1071969 - RNA, 26 nt, Human
cauaaauaaggcacaauauaugccag

SEQ ID NO: 1071970 - RNA, 27 nt, Human
cauccugcugcuucuaguauuucucua

SEQ ID NO: 1071971 - RNA, 24 nt, Human
cauguuggccaggcuggucucaaa

SEQ ID NO: 1071972 - RNA, 24 nt, Human
cauguuggucaggcuggucuugaa

SEQ ID NO: 1071973 - RNA, 23 nt, Human
ccaaacaccagccacagauagcu

SEQ ID NO: 1071974 - RNA, 24 nt, Human
ccaaaguuuugggauuacaggcau

SEQ ID NO: 1071975 - RNA, 24 nt, Human
ccacaacacagugaagaccaccac

SEQ ID NO: 1071976 - RNA, 23 nt, Human
ccacaacaucugccucccagguu

SEQ ID NO: 1071977 - RNA, 24 nt, Human
ccacaacaucugccucccagguuc

SEQ ID NO: 1071978 - RNA, 27 nt, Human
ccaccacugccuuuccugcucuccuca

SEQ ID NO: 1071979 - RNA, 19 nt, Human
ccauguuggccaggcuggu

SEQ ID NO: 1071980 - RNA, 22 nt, Human
ccauguuggccaggcuggucuc

SEQ ID NO: 1071981 - RNA, 19 nt, Human
ccauguuggucaggcuggu

SEQ ID NO: 1071982 - RNA, 21 nt, Human
ccauguuggucaggcuggucu

SEQ ID NO: 1071983 - RNA, 18 nt, Human
ccauugcacccggccagu

SEQ ID NO: 1071984 - RNA, 24 nt, Human
cccaaaguuuugggauuacaggca

SEQ ID NO: 1071985 - RNA, 19 nt, Human
cccacagucucugagcauu

SEQ ID NO: 1071986 - RNA, 18 nt, Human
cccaggcuggagugcaau

SEQ ID NO: 1071987 - RNA, 19 nt, Human
cccaggcuggagugcaaug

SEQ ID NO: 1071988 - RNA, 23 nt, Human
cccagguucaagugauucuccuc

SEQ ID NO: 1071989 - RNA, 23 nt, Human
cccagguucaagugauucuccuc

SEQ ID NO: 1071990 - RNA, 23 nt, Human
cccagguucaagugauucuccug

SEQ ID NO: 1071991 - RNA, 23 nt, Human
cccagguucaagugauucuccug

SEQ ID NO: 1071992 - RNA, 18 nt, Human
cccgaccucaggugaucc

SEQ ID NO: 1071993 - RNA, 22 nt, Human
cccgaccucaggugauccgccc

SEQ ID NO: 1071994 - RNA, 23 nt, Human
cccgaguagcugggauuacaggc

SEQ ID NO: 1071995 - RNA, 24 nt, Human
cccgaguagcugggauuacaggca

SEQ ID NO: 1071996 - RNA, 21 nt, Human
cccgccugggacucccaaagu

SEQ ID NO: 1071997 - RNA, 23 nt, Human
ccgaguagcugggauuacaggca

SEQ ID NO: 1071998 - RNA, 24 nt, Human
ccgaguagcugggauuacaggcau

SEQ ID NO: 1071999 - RNA, 24 nt, Human
ccgccucagccucccaaagugcug

SEQ ID NO: 1072000 - RNA, 24 nt, Human
ccucccagguucaagugauucucc

SEQ ID NO: 1072001 - RNA, 24 nt, Human
ccucccagguucaagugauucucc

SEQ ID NO: 1072002 - RNA, 20 nt, Human
ccugaccucaggugaucaac

SEQ ID NO: 1072003 - RNA, 22 nt, Human
ccugaccucaggugaucaaccc

SEQ ID NO: 1072004 - RNA, 23 nt, Human
ccugaguagcugggauuacaggc

SEQ ID NO: 1072005 - RNA, 24 nt, Human
ccugaguagcugggauuacaggcg

SEQ ID NO: 1072006 - RNA, 23 nt, Human
ccugccucaaccucccgaguagc

SEQ ID NO: 1072007 - RNA, 24 nt, Human
ccugccucaaccucccgaguagcu

SEQ ID NO: 1072008 - RNA, 22 nt, Human
ccuuuccugcucuccucaggag

SEQ ID NO: 1072009 - RNA, 18 nt, Human
cgaccucaggugauccgc

SEQ ID NO: 1072010 - RNA, 24 nt, Human
cgccucagccucccaaagugcugg

SEQ ID NO: 1072011 - RNA, 24 nt, Human
cgggguuucuccauguuggccagg

SEQ ID NO: 1072012 - RNA, 19 nt, Human
cuaccaaacaccagccaca

SEQ ID NO: 1072013 - RNA, 24 nt, Human
cuaguuuuguauuuuuaguagaga

SEQ ID NO: 1072014 - RNA, 24 nt, Human
cucaccacaacaucugccucccag

SEQ ID NO: 1072015 - RNA, 23 nt, Human
cucagccuccugaguagcuggga

SEQ ID NO: 1072016 - RNA, 23 nt, Human
cucaggugaucaacccgccucag

SEQ ID NO: 1072017 - RNA, 23 nt, Human
cuccagagacaccugcuaucucu

SEQ ID NO: 1072018 - RNA, 24 nt, Human
cuccauguuggccaggcuggucuc

SEQ ID NO: 1072019 - RNA, 19 nt, Human
cucccagguucaagugauu

SEQ ID NO: 1072020 - RNA, 19 nt, Human
cucccagguucaagugauu

SEQ ID NO: 1072021 - RNA, 26 nt, Human
cucccgaccucaggugauccgcccgc

SEQ ID NO: 1072022 - RNA, 22 nt, Human
cuccugccucagccuccugagu

SEQ ID NO: 1072023 - RNA, 23 nt, Human
cuccuguuaucacuaggugaaca

SEQ ID NO: 1072024 - RNA, 22 nt, Human
cucuccuacugggaaacuccag

SEQ ID NO: 1072025 - RNA, 18 nt, Human
cucuuguugcccaggcug

SEQ ID NO: 1072026 - RNA, 20 nt, Human
cucuuguugcccaggcugga

SEQ ID NO: 1072027 - RNA, 22 nt, Human
cugagcauuaccuguuuuucuu

SEQ ID NO: 1072028 - RNA, 22 nt, Human
cugaguagcugggauuacaggc

SEQ ID NO: 1072029 - RNA, 23 nt, Human
cugcaaccucugccucccagguu

SEQ ID NO: 1072030 - RNA, 24 nt, Human
cugcaaccucugccucccagguuc

SEQ ID NO: 1072031 - RNA, 23 nt, Human
cugccucagccuccugaguagcu

SEQ ID NO: 1072032 - RNA, 19 nt, Human
cugggacucccaaaguuuu

SEQ ID NO: 1072033 - RNA, 23 nt, Human
cuuccuguguccaggauggaggu

SEQ ID NO: 1072034 - RNA, 24 nt, Human
cuuguugcccaggcuggagugcaa

SEQ ID NO: 1072035 - RNA, 21 nt, Human
cuuuccugcucuccucaggag

SEQ ID NO: 1072036 - RNA, 24 nt, Human
gaccucaggugaucaacccgccuc

SEQ ID NO: 1072037 - RNA, 22 nt, Human
gaccucaggugauccgcccgcc

SEQ ID NO: 1072038 - RNA, 23 nt, Human
gaccucaggugauccgcccgccu

SEQ ID NO: 1072039 - RNA, 24 nt, Human
gagacgggguuucuccauguuggc

SEQ ID NO: 1072040 - RNA, 24 nt, Human
gagaugggguuucuccauguuggu

SEQ ID NO: 1072041 - RNA, 23 nt, Human
gaggagcagcggugugagggugg

SEQ ID NO: 1072042 - RNA, 18 nt, Human
gaggcugguuuagcuggc

SEQ ID NO: 1072043 - RNA, 24 nt, Human
gaguagcugggauuacaggcaugc

SEQ ID NO: 1072044 - RNA, 25 nt, Human
gaguagcugggauuacaggcgcccg

SEQ ID NO: 1072045 - RNA, 18 nt, Human
gauuacaggcaugagcca

SEQ ID NO: 1072046 - RNA, 22 nt, Human
gauuacaggcaugagccauugc

SEQ ID NO: 1072047 - RNA, 23 nt, Human
gauuacaggcaugagccauugca

SEQ ID NO: 1072048 - RNA, 18 nt, Human
gauuacaggcgcccgcca

SEQ ID NO: 1072049 - RNA, 22 nt, Human
gcaaccucugccucccagguuc

SEQ ID NO: 1072050 - RNA, 26 nt, Human
gcagcuucagugguggggggaacgcc

SEQ ID NO: 1072051 - RNA, 19 nt, Human
gcccaggcuggagugcaac

SEQ ID NO: 1072052 - RNA, 20 nt, Human
gccucagccuccugaguagc

SEQ ID NO: 1072053 - RNA, 20 nt, Human
gcucuuguugcccaggcugg

SEQ ID NO: 1072054 - RNA, 21 nt, Human
gcucuuguugcccaggcugga

SEQ ID NO: 1072055 - RNA, 24 nt, Human
gcucuuguugcccaggcuggagug

SEQ ID NO: 1072056 - RNA, 20 nt, Human
gcugcauucagaaagaggcu

SEQ ID NO: 1072057 - RNA, 19 nt, Human
gcuggagugcaacggcacg

SEQ ID NO: 1072058 - RNA, 19 nt, Human
gcuggagugcaauggcuug

SEQ ID NO: 1072059 - RNA, 23 nt, Human
gcuggucucaaacuccugaccuc

SEQ ID NO: 1072060 - RNA, 23 nt, Human
gcuggucuugaacucccgaccuc

SEQ ID NO: 1072061 - RNA, 20 nt, Human
ggagcagcggugugagggug

SEQ ID NO: 1072062 - RNA, 22 nt, Human
ggauuacaggcaugagccauug

SEQ ID NO: 1072063 - RNA, 18 nt, Human
ggcugagcugcauucaga

SEQ ID NO: 1072064 - RNA, 24 nt, Human
ggcuggucucaaacuccugaccuc

SEQ ID NO: 1072065 - RNA, 24 nt, Human
ggcuggucuugaacucccgaccuc

SEQ ID NO: 1072066 - RNA, 22 nt, Human
gggaaccuccaaaaccucauaa

SEQ ID NO: 1072067 - RNA, 23 nt, Human
gggguuucuccauguuggccagg

SEQ ID NO: 1072068 - RNA, 22 nt, Human
gggguuucuccauguuggucag

SEQ ID NO: 1072069 - RNA, 23 nt, Human
guagagacgggguuucuccaugu

SEQ ID NO: 1072070 - RNA, 20 nt, Human
guagcugggauuacaggcau

SEQ ID NO: 1072071 - RNA, 24 nt, Human
gugaucaacccgccucagccuccc

SEQ ID NO: 1072072 - RNA, 24 nt, Human
gugauucuccugccucaaccuccc

SEQ ID NO: 1072073 - RNA, 24 nt, Human
gugauucuccugccucagccuccu

SEQ ID NO: 1072074 - RNA, 28 nt, Human
gugcagcuucagugguggggggaacgcc

SEQ ID NO: 1072075 - RNA, 21 nt, Human
gugcuccuggccacaacacag

SEQ ID NO: 1072076 - RNA, 21 nt, Human
guggugggaaccuccaaaacc

SEQ ID NO: 1072077 - RNA, 24 nt, Human
uaauuuuuguauuuuuaguagaga

SEQ ID NO: 1072078 - RNA, 23 nt, Human
uacaggcaugagccauugcaccc

SEQ ID NO: 1072079 - RNA, 22 nt, Human
uacaggcaugcaccaccgcgcc

SEQ ID NO: 1072080 - RNA, 23 nt, Human
uacaggcgcccgccaccaacacc

SEQ ID NO: 1072081 - RNA, 21 nt, Human
uacugcaaccucugccuccca

SEQ ID NO: 1072082 - RNA, 23 nt, Human
uacugcaaccucugccucccagg

SEQ ID NO: 1072083 - RNA, 24 nt, Human
uagcauagggcagccauuccaugu

SEQ ID NO: 1072084 - RNA, 23 nt, Human
uagcuuacugcaaccucugccuc

SEQ ID NO: 1072085 - RNA, 25 nt, Human
uagcuucuuaagucauuucucuccu

SEQ ID NO: 1072086 - RNA, 24 nt, Human
uaguagagacgggguuucuccaug

SEQ ID NO: 1072087 - RNA, 24 nt, Human
uaguagagaugggguuucuccaug

SEQ ID NO: 1072088 - RNA, 22 nt, Human
uauacagaugcaauaaauuauc

SEQ ID NO: 1072089 - RNA, 19 nt, Human
uaucaucaauaaaaugaag

SEQ ID NO: 1072090 - RNA, 19 nt, Human
ucaagugauucuccugccu

SEQ ID NO: 1072091 - RNA, 19 nt, Human
ucaagugauucuccugccu

SEQ ID NO: 1072092 - RNA, 24 nt, Human
ucaccacaacaucugccucccagg

SEQ ID NO: 1072093 - RNA, 23 nt, Human
ucacucuuguugcccaggcugga

SEQ ID NO: 1072094 - RNA, 20 nt, Human
ucagccuccugaguagcugg

SEQ ID NO: 1072095 - RNA, 20 nt, Human
ucagccuggcucauuguucu

SEQ ID NO: 1072096 - RNA, 24 nt, Human
uccauguuggucaggcuggucuug

SEQ ID NO: 1072097 - RNA, 24 nt, Human
ucccaaaguuuugggauuacaggc

SEQ ID NO: 1072098 - RNA, 23 nt, Human
ucccacagucucugagcauuacc

SEQ ID NO: 1072099 - RNA, 21 nt, Human
ucccagguucaagugauucuc

SEQ ID NO: 1072100 - RNA, 21 nt, Human
ucccagguucaagugauucuc

SEQ ID NO: 1072101 - RNA, 24 nt, Human
ucccagguucaagugauucuccug

SEQ ID NO: 1072102 - RNA, 24 nt, Human
ucccagguucaagugauucuccug

SEQ ID NO: 1072103 - RNA, 24 nt, Human
ucccgaguagcugggauuacaggc

SEQ ID NO: 1072104 - RNA, 19 nt, Human
ucccuacaccucuuccuga

SEQ ID NO: 1072105 - RNA, 18 nt, Human
uccuacugggaaacucca

SEQ ID NO: 1072106 - RNA, 24 nt, Human
uccugaguagcugggauuacaggc

SEQ ID NO: 1072107 - RNA, 19 nt, Human
uccugugugacagaggucc

SEQ ID NO: 1072108 - RNA, 24 nt, Human
ucuccugccucaaccucccgagua

SEQ ID NO: 1072109 - RNA, 21 nt, Human
ucucuggacacccaugugcuc

SEQ ID NO: 1072110 - RNA, 22 nt, Human
ucuuguugcccaggcuggagug

SEQ ID NO: 1072111 - RNA, 22 nt, Human
ucuuguugcccaggcuggagug

SEQ ID NO: 1072112 - RNA, 20 nt, Human
ugaccucaggugaucaaccc

SEQ ID NO: 1072113 - RNA, 24 nt, Human
ugaccucaggugaucaacccgccu

SEQ ID NO: 1072114 - RNA, 23 nt, Human
ugagcauuaccuguuuuucuugu

SEQ ID NO: 1072115 - RNA, 25 nt, Human
ugagcugcauucagaaagaggcugg

SEQ ID NO: 1072116 - RNA, 24 nt, Human
ugaggguggaugggacacugcaga

SEQ ID NO: 1072117 - RNA, 18 nt, Human
ugcccaggcuggagugca

SEQ ID NO: 1072118 - RNA, 18 nt, Human
ugcccaggcuggagugca

SEQ ID NO: 1072119 - RNA, 21 nt, Human
ugcccaggcuggagugcaacg

SEQ ID NO: 1072120 - RNA, 21 nt, Human
ugcccaggcuggagugcaaug

SEQ ID NO: 1072121 - RNA, 24 nt, Human
ugccucaaccucccgaguagcugg

SEQ ID NO: 1072122 - RNA, 24 nt, Human
ugccucagccuccugaguagcugg

SEQ ID NO: 1072123 - RNA, 21 nt, Human
ugcuccugugugacagagguu

SEQ ID NO: 1072124 - RNA, 24 nt, Human
ugcucuuguugcccaggcuggagu

SEQ ID NO: 1072125 - RNA, 26 nt, Human
uggaauggguugauuccucuaauuuu

SEQ ID NO: 1072126 - RNA, 20 nt, Human
uggagugcaacggcacgauc

SEQ ID NO: 1072127 - RNA, 19 nt, Human
uggagugcaauggcuugau

SEQ ID NO: 1072128 - RNA, 23 nt, Human
uggagugcaauggcuugaucucg

SEQ ID NO: 1072129 - RNA, 24 nt, Human
uggagugcaauggcuugaucucgg

SEQ ID NO: 1072130 - RNA, 24 nt, Human
uggccaggcuggucucaaacuccu

SEQ ID NO: 1072131 - RNA, 24 nt, Human
uggcuugaucucggcucaccacaa

SEQ ID NO: 1072132 - RNA, 18 nt, Human
ugggauuacaggcaugag

SEQ ID NO: 1072133 - RNA, 19 nt, Human
ugggauuacaggcaugagc

SEQ ID NO: 1072134 - RNA, 21 nt, Human
ugggauuacaggcaugagcca

SEQ ID NO: 1072135 - RNA, 21 nt, Human
ugggauuacaggcaugagcca

SEQ ID NO: 1072136 - RNA, 21 nt, Human
ugggauuacaggcaugagcca

SEQ ID NO: 1072137 - RNA, 22 nt, Human
ugggauuacaggcaugagccau

SEQ ID NO: 1072138 - RNA, 24 nt, Human
ugggauuacaggcaugagccauug

SEQ ID NO: 1072139 - RNA, 24 nt, Human
ugggauuacaggcaugagccauug

SEQ ID NO: 1072140 - RNA, 27 nt, Human
ugggauuacaggcaugagccauugcac

SEQ ID NO: 1072141 - RNA, 31 nt, Human
ugggauuacaggcaugagccauugcacccgg

SEQ ID NO: 1072142 - RNA, 21 nt, Human
ugggauuacaggcaugcacca

SEQ ID NO: 1072143 - RNA, 24 nt, Human
ugggauuacaggcaugcaccaccg

SEQ ID NO: 1072144 - RNA, 21 nt, Human
ugggauuacaggcgcccgcca

SEQ ID NO: 1072145 - RNA, 22 nt, Human
ugggauuacaggcgcccgccac

SEQ ID NO: 1072146 - RNA, 24 nt, Human
ugggauuacaggcgcccgccacca

SEQ ID NO: 1072147 - RNA, 24 nt, Human
ugggguuucuccauguuggucagg

SEQ ID NO: 1072148 - RNA, 23 nt, Human
uggucaggcuggucuugaacucc

SEQ ID NO: 1072149 - RNA, 23 nt, Human
uggugggaaccuccaaaaccuca

SEQ ID NO: 1072150 - RNA, 24 nt, Human
ugugucaagugucuaccaaacacc

SEQ ID NO: 1072151 - RNA, 20 nt, Human
uguugcccaggcuggagugc

SEQ ID NO: 1072152 - RNA, 20 nt, Human
uguugcccaggcuggagugc

SEQ ID NO: 1072153 - RNA, 22 nt, Human
uguugcccaggcuggagugcaa

SEQ ID NO: 1072154 - RNA, 19 nt, Human
uuacugcaaccucugccuc

SEQ ID NO: 1072155 - RNA, 24 nt, Human
uuacugcaaccucugccucccagg

SEQ ID NO: 1072156 - RNA, 25 nt, Human
uuacugcaaccucugccucccaggu

SEQ ID NO: 1072157 - RNA, 27 nt, Human
uuagcuuacugcaaccucugccuccca

SEQ ID NO: 1072158 - RNA, 18 nt, Human
uuaguagagacgggguuu

SEQ ID NO: 1072159 - RNA, 24 nt, Human
uuaguagagacgggguuucuccau

SEQ ID NO: 1072160 - RNA, 18 nt, Human
uuaguagagaugggguuu

SEQ ID NO: 1072161 - RNA, 24 nt, Human
uuaguagagaugggguuucuccau

SEQ ID NO: 1072162 - RNA, 21 nt, Human
uucaagugauucuccugccuc

SEQ ID NO: 1072163 - RNA, 21 nt, Human
uucaagugauucuccugccuc

SEQ ID NO: 1072164 - RNA, 24 nt, Human
uucaagugauucuccugccucaac

SEQ ID NO: 1072165 - RNA, 23 nt, Human
uucaagugauucuccugccucag

SEQ ID NO: 1072166 - RNA, 24 nt, Human
uucaagugauucuccugccucagc

SEQ ID NO: 1072167 - RNA, 24 nt, Human
uucacucuuguugcccaggcugga

SEQ ID NO: 1072168 - RNA, 18 nt, Human
uugcccaggcuggagugc

SEQ ID NO: 1072169 - RNA, 23 nt, Human
uugcucuuguugcccaggcugga

SEQ ID NO: 1072170 - RNA, 23 nt, Human
uuguauuuuuaguagagacgggg

SEQ ID NO: 1072171 - RNA, 23 nt, Human
uuguauuuuuaguagagaugggg

SEQ ID NO: 1072172 - RNA, 24 nt, Human
uuucacucuuguugcccaggcugg

SEQ ID NO: 1072173 - RNA, 21 nt, Human
uuucuccauguuggccaggcu

SEQ ID NO: 1072174 - RNA, 21 nt, Human
uuucuccauguuggucaggcu

SEQ ID NO: 1072175 - RNA, 24 nt, Human
uuugcucuuguugcccaggcugga

SEQ ID NO: 1072176 - RNA, 24 nt, Human
uuuugcucuuguugcccaggcugg

SEQ ID NO: 1072177 - RNA, 19 nt, Human
uuuuguauuuuuaguagag

SEQ ID NO: 1072178 - RNA, 20 nt, Human
uuuuguauuuuuaguagaga

SEQ ID NO: 1072179 - RNA, 22 nt, Human
uuuuuaguagagacgggguuuc

SEQ ID NO: 1072180 - RNA, 22 nt, Human
uuuuuaguagagaugggguuuc

SEQ ID NO: 1072181 - RNA, 20 nt, Human
uuuuuguauuuuuaguagag

SEQ ID NO: 1072182 - RNA, 26 nt, Human
aaacagauucacuggcugaugcuccu

SEQ ID NO: 1072183 - RNA, 21 nt, Human
aagaaggugccugcgucagua

SEQ ID NO: 1072184 - RNA, 18 nt, Human
aagcaaagaaaugaccuu

SEQ ID NO: 1072185 - RNA, 23 nt, Human
acacacacacacacacacacaca

SEQ ID NO: 1072186 - RNA, 23 nt, Human
acacacacacacacacacacaca

SEQ ID NO: 1072187 - RNA, 25 nt, Human
acacacacacacacacacacagagc

SEQ ID NO: 1072188 - RNA, 27 nt, Human
acagagaaaacaggaugauuucuccca

SEQ ID NO: 1072189 - RNA, 22 nt, Human
agaauauccuccauucauaauu

SEQ ID NO: 1072190 - RNA, 23 nt, Human
aguaaaaagauuuaugagaagaa

SEQ ID NO: 1072191 - RNA, 21 nt, Human
aguacaguagaauauccucca

SEQ ID NO: 1072192 - RNA, 18 nt, Human
agugccucauccaggcag

SEQ ID NO: 1072193 - RNA, 19 nt, Human
aguuagggaaggagugcaa

SEQ ID NO: 1072194 - RNA, 23 nt, Human
aucuccuuucagaauauaaacuc

SEQ ID NO: 1072195 - RNA, 20 nt, Human
cacacacacacacacacaca

SEQ ID NO: 1072196 - RNA, 20 nt, Human
cacacacacacacacacaca

SEQ ID NO: 1072197 - RNA, 20 nt, Human
cacacacacacacacacaca

SEQ ID NO: 1072198 - RNA, 20 nt, Human
cacacacacacacacacaca

SEQ ID NO: 1072199 - RNA, 20 nt, Human
cacacacacacacacacaca

SEQ ID NO: 1072200 - RNA, 22 nt, Human
cacacacacacacacacacaca

SEQ ID NO: 1072201 - RNA, 22 nt, Human
cacacacacacacacacacaca

SEQ ID NO: 1072202 - RNA, 26 nt, Human
cacacacacacacacacacacacaca

SEQ ID NO: 1072203 - RNA, 26 nt, Human
cacacacacacacacacacacacaca

SEQ ID NO: 1072204 - RNA, 20 nt, Human
cacacacacacacagagcua

SEQ ID NO: 1072205 - RNA, 25 nt, Human
cacacacacagagcuauuuuuccac

SEQ ID NO: 1072206 - RNA, 19 nt, Human
cacugugguaagacaagau

SEQ ID NO: 1072207 - RNA, 24 nt, Human
cagaaaaccuauccccaaccuaac

SEQ ID NO: 1072208 - RNA, 19 nt, Human
caggcaguaacaaaaacaa

SEQ ID NO: 1072209 - RNA, 24 nt, Human
ccaaaguaaaaagauuuaugagaa

SEQ ID NO: 1072210 - RNA, 18 nt, Human
ccacacauacaaaaacac

SEQ ID NO: 1072211 - RNA, 18 nt, Human
ccacaguuacuucaagca

SEQ ID NO: 1072212 - RNA, 18 nt, Human
ccacuagcacaugcuuug

SEQ ID NO: 1072213 - RNA, 18 nt, Human
ccaggcaguaacaaaaac

SEQ ID NO: 1072214 - RNA, 20 nt, Human
cccaagaacauacaaggaaa

SEQ ID NO: 1072215 - RNA, 33 nt, Human
cuaacagauuacacacacacacacacacacagu

SEQ ID NO: 1072216 - RNA, 19 nt, Human
cuagugaaagcccccuacc

SEQ ID NO: 1072217 - RNA, 19 nt, Human
cuugaugcucagagcagcu

SEQ ID NO: 1072218 - RNA, 23 nt, Human
gaaaggcauuuugaucugaauuu

SEQ ID NO: 1072219 - RNA, 21 nt, Human
gaauaaggacucugcuauaga

SEQ ID NO: 1072220 - RNA, 22 nt, Human
gaccuuaggaacauacccaggu

SEQ ID NO: 1072221 - RNA, 22 nt, Human
gauaccagaaggucgagagaga

SEQ ID NO: 1072222 - RNA, 21 nt, Human
gggcaugaacacacauucacc

SEQ ID NO: 1072223 - RNA, 21 nt, Human
gggcuucaaggauuuuuccau

SEQ ID NO: 1072224 - RNA, 19 nt, Human
uacaaggaaaaguuaaggg

SEQ ID NO: 1072225 - RNA, 22 nt, Human
uacaaggaaaaguuaagggaaa

SEQ ID NO: 1072226 - RNA, 20 nt, Human
uacacacacacacacacaca

SEQ ID NO: 1072227 - RNA, 25 nt, Human
uacacacacacacacacacacacac

SEQ ID NO: 1072228 - RNA, 25 nt, Human
uacacacacacacacacacacacag

SEQ ID NO: 1072229 - RNA, 21 nt, Human
uacacacacacacacacacag

SEQ ID NO: 1072230 - RNA, 22 nt, Human
uacgggcaugaacacacauuca

SEQ ID NO: 1072231 - RNA, 18 nt, Human
uagcacaugcuuuggagg

SEQ ID NO: 1072232 - RNA, 18 nt, Human
uaggaaccacccaagaac

SEQ ID NO: 1072233 - RNA, 24 nt, Human
uaggaaccacccaagaacauacaa

SEQ ID NO: 1072234 - RNA, 18 nt, Human
uagguaaugggccugaaa

SEQ ID NO: 1072235 - RNA, 19 nt, Human
uaugagaagaauaaggacu

SEQ ID NO: 1072236 - RNA, 19 nt, Human
uauugcaggucucuuuuaa

SEQ ID NO: 1072237 - RNA, 22 nt, Human
ucaggucacagagaaaacagga

SEQ ID NO: 1072238 - RNA, 24 nt, Human
ucaguaguauuuugaacacucccu

SEQ ID NO: 1072239 - RNA, 18 nt, Human
ucagugccaaaugcacua

SEQ ID NO: 1072240 - RNA, 21 nt, Human
ucagugccaaaugcacuaggu

SEQ ID NO: 1072241 - RNA, 18 nt, Human
uccacaguuacuucaagc

SEQ ID NO: 1072242 - RNA, 18 nt, Human
ucccaugaucaugugcuu

SEQ ID NO: 1072243 - RNA, 18 nt, Human
ucuccagcgccaagaagg

SEQ ID NO: 1072244 - RNA, 19 nt, Human
ucuccuauaaaacacugug

SEQ ID NO: 1072245 - RNA, 19 nt, Human
ugaaagcccccuaccuauu

SEQ ID NO: 1072246 - RNA, 18 nt, Human
ugaaaggcauuuugaucu

SEQ ID NO: 1072247 - RNA, 22 nt, Human
ugaacacacauucacccacaca

SEQ ID NO: 1072248 - RNA, 21 nt, Human
ugaacacucccuccacaguua

SEQ ID NO: 1072249 - RNA, 23 nt, Human
ugacagaagugccucauccaggc

SEQ ID NO: 1072250 - RNA, 20 nt, Human
ugagagaagaugagacggca

SEQ ID NO: 1072251 - RNA, 19 nt, Human
ugccaaaugcacuagguuc

SEQ ID NO: 1072252 - RNA, 18 nt, Human
ugccucauccaggcagua

SEQ ID NO: 1072253 - RNA, 21 nt, Human
uggggagguucaaaagaagug

SEQ ID NO: 1072254 - RNA, 22 nt, Human
uucaaggauuuuuccauucugc

SEQ ID NO: 1072255 - RNA, 24 nt, Human
uucagaauauaaacucagaagccc

SEQ ID NO: 1072256 - RNA, 25 nt, Human
uucccugccguuauaauuuuuggau

SEQ ID NO: 1072257 - RNA, 19 nt, Human
uuuaagauagauuucuagg

SEQ ID NO: 1072258 - RNA, 21 nt, Human
uuugaacacucccuccacagu

SEQ ID NO: 1072259 - RNA, 18 nt, Human
uuuuaagauagauuucua

SEQ ID NO: 1072260 - RNA, 25 nt, Human
uuuuuuauugcaggucucuuuuaau

SEQ ID NO: 1072261 - RNA, 22 nt, Human
aaaacacccucuuacuacauca

SEQ ID NO: 1072262 - RNA, 24 nt, Human
aaaacacccucuuacuacaucaca

SEQ ID NO: 1072263 - RNA, 22 nt, Human
aaaagcaaccauuuauuagaac

SEQ ID NO: 1072264 - RNA, 20 nt, Human
aaacacagagaaccagaaug

SEQ ID NO: 1072265 - RNA, 21 nt, Human
aaacucccccauaaaccuaaa

SEQ ID NO: 1072266 - RNA, 18 nt, Human
aaagggggaaaagaggag

SEQ ID NO: 1072267 - RNA, 19 nt, Human
aacacagcuaaaacucccc

SEQ ID NO: 1072268 - RNA, 21 nt, Human
aacacagcuaaaacuccccca

SEQ ID NO: 1072269 - RNA, 24 nt, Human
aacccagcucuugagucucuuaga

SEQ ID NO: 1072270 - RNA, 24 nt, Human
aacuagauuaauucaauaacugaa

SEQ ID NO: 1072271 - RNA, 28 nt, Human
aagcaagaucacauuccaacagaaacaa

SEQ ID NO: 1072272 - RNA, 23 nt, Human
aagcaaugacauaaaucaaaacc

SEQ ID NO: 1072273 - RNA, 23 nt, Human
aagcagacauguuuggcugaaau

SEQ ID NO: 1072274 - RNA, 23 nt, Human
aagugccuuccccaacaacaucc

SEQ ID NO: 1072275 - RNA, 19 nt, Human
aaucaguugaggagguggg

SEQ ID NO: 1072276 - RNA, 21 nt, Human
acaaaacacagagaaccagaa

SEQ ID NO: 1072277 - RNA, 20 nt, Human
acugaguaaccugaauuccu

SEQ ID NO: 1072278 - RNA, 20 nt, Human
acuugggagcagagggaagu

SEQ ID NO: 1072279 - RNA, 19 nt, Human
acuuuaauccccaaccugc

SEQ ID NO: 1072280 - RNA, 27 nt, Human
agaaacaaugaauaagaaccgguaccc

SEQ ID NO: 1072281 - RNA, 21 nt, Human
agaaagagcccuauugggaag

SEQ ID NO: 1072282 - RNA, 24 nt, Human
agagggggagagaaugaggucugc

SEQ ID NO: 1072283 - RNA, 23 nt, Human
agaguguacuugggagcagaggg

SEQ ID NO: 1072284 - RNA, 19 nt, Human
agauaccacaaagggguac

SEQ ID NO: 1072285 - RNA, 19 nt, Human
agcauccacucgauucuug

SEQ ID NO: 1072286 - RNA, 22 nt, Human
agccaggaccuugugcuuuuuc

SEQ ID NO: 1072287 - RNA, 23 nt, Human
aggaaguggugggaaagccagcg

SEQ ID NO: 1072288 - RNA, 21 nt, Human
agggggaaaagaggaggguag

SEQ ID NO: 1072289 - RNA, 21 nt, Human
aguacagagugcugaaagaaa

SEQ ID NO: 1072290 - RNA, 26 nt, Human
aucacaucccuccccacaauacccag

SEQ ID NO: 1072291 - RNA, 21 nt, Human
auccugagacagucugagucu

SEQ ID NO: 1072292 - RNA, 23 nt, Human
augcaagacacagaaaaucccaa

SEQ ID NO: 1072293 - RNA, 21 nt, Human
auguagcuuuugggggugggg

SEQ ID NO: 1072294 - RNA, 24 nt, Human
auuucucauuuccauucagaaauc

SEQ ID NO: 1072295 - RNA, 24 nt, Human
caaaacacagagaaccagaaugug

SEQ ID NO: 1072296 - RNA, 20 nt, Human
caaaccagagggaaaaaagg

SEQ ID NO: 1072297 - RNA, 22 nt, Human
caacagaaacaaugaauaagaa

SEQ ID NO: 1072298 - RNA, 25 nt, Human
caauguagcuuuugggggugggggg

SEQ ID NO: 1072299 - RNA, 23 nt, Human
cacaaacuagauuaauucaauaa

SEQ ID NO: 1072300 - RNA, 22 nt, Human
cagaaaaucccaagugccuucc

SEQ ID NO: 1072301 - RNA, 18 nt, Human
cagaaccaucugguacug

SEQ ID NO: 1072302 - RNA, 33 nt, Human
cagcuaaaacucccccauaaaccuaaaagucuu

SEQ ID NO: 1072303 - RNA, 20 nt, Human
caucacaucccuccccacaa

SEQ ID NO: 1072304 - RNA, 19 nt, Human
caucccuccccacaauacc

SEQ ID NO: 1072305 - RNA, 23 nt, Human
ccaauacaagaguaugaaaaggg

SEQ ID NO: 1072306 - RNA, 27 nt, Human
ccaguggugguucuuggagucuuccgg

SEQ ID NO: 1072307 - RNA, 19 nt, Human
cccacaauacccagagggc

SEQ ID NO: 1072308 - RNA, 23 nt, Human
cccagguacagauaccacaaagg

SEQ ID NO: 1072309 - RNA, 25 nt, Human
cccagguacagauaccacaaagggg

SEQ ID NO: 1072310 - RNA, 20 nt, Human
ccccaggacuccacagaacc

SEQ ID NO: 1072311 - RNA, 21 nt, Human
ccccauaaaccuaaaagucca

SEQ ID NO: 1072312 - RNA, 23 nt, Human
cccccauaaaccuaaaaguccau

SEQ ID NO: 1072313 - RNA, 18 nt, Human
ccccuaaacugagaugga

SEQ ID NO: 1072314 - RNA, 22 nt, Human
cccuccccacaauacccagagg

SEQ ID NO: 1072315 - RNA, 20 nt, Human
ccuaaaaguccauggagaau

SEQ ID NO: 1072316 - RNA, 19 nt, Human
ccugagacagucugagucu

SEQ ID NO: 1072317 - RNA, 21 nt, Human
cuagcaccacaaaacacccuc

SEQ ID NO: 1072318 - RNA, 26 nt, Human
cugaaggguauuaacugagggccuau

SEQ ID NO: 1072319 - RNA, 21 nt, Human
cugaauuccuaaaauccagaa

SEQ ID NO: 1072320 - RNA, 21 nt, Human
cugaguguuauacacauuucu

SEQ ID NO: 1072321 - RNA, 24 nt, Human
cuuacuacaucacaucccucccca

SEQ ID NO: 1072322 - RNA, 18 nt, Human
cuuccccaacaacauccu

SEQ ID NO: 1072323 - RNA, 18 nt, Human
gaagaggagcuggcugcg

SEQ ID NO: 1072324 - RNA, 22 nt, Human
gagcccuauugggaagaggagc

SEQ ID NO: 1072325 - RNA, 24 nt, Human
gaguaugaaaagggggaaaagagg

SEQ ID NO: 1072326 - RNA, 21 nt, Human
gagucugcuucaaacccaugg

SEQ ID NO: 1072327 - RNA, 22 nt, Human
gccaaggagagggaaagcagaa

SEQ ID NO: 1072328 - RNA, 21 nt, Human
gcuaaaacucccccauaaacc

SEQ ID NO: 1072329 - RNA, 26 nt, Human
gcuaaaacucccccauaaaccuaaaa

SEQ ID NO: 1072330 - RNA, 18 nt, Human
ggaaagcagaaagagccc

SEQ ID NO: 1072331 - RNA, 19 nt, Human
ggagugguaagcaaugaca

SEQ ID NO: 1072332 - RNA, 19 nt, Human
gggggaaaagaggagggua

SEQ ID NO: 1072333 - RNA, 22 nt, Human
gggggugggggguggaaauaag

SEQ ID NO: 1072334 - RNA, 20 nt, Human
ggugggggguggaaauaagg

SEQ ID NO: 1072335 - RNA, 24 nt, Human
guaagcaaugacauaaaucaaaac

SEQ ID NO: 1072336 - RNA, 19 nt, Human
guccugggauugguugggg

SEQ ID NO: 1072337 - RNA, 26 nt, Human
uaaaaaaaaaaucaaaagcagacaug

SEQ ID NO: 1072338 - RNA, 25 nt, Human
uaaaaccaagaaacacagcuaaaac

SEQ ID NO: 1072339 - RNA, 24 nt, Human
uaaaacucccccauaaaccuaaaa

SEQ ID NO: 1072340 - RNA, 18 nt, Human
uaagaaccuuuuccccag

SEQ ID NO: 1072341 - RNA, 22 nt, Human
uaccacaaagggguacagugac

SEQ ID NO: 1072342 - RNA, 20 nt, Human
uacuugggagcagagggaaa

SEQ ID NO: 1072343 - RNA, 23 nt, Human
uagcaccacaaaacacccucuua

SEQ ID NO: 1072344 - RNA, 20 nt, Human
uagggccaaggagagggaaa

SEQ ID NO: 1072345 - RNA, 20 nt, Human
uagguucagacugcagacac

SEQ ID NO: 1072346 - RNA, 19 nt, Human
uaucuaguauaaugugagg

SEQ ID NO: 1072347 - RNA, 23 nt, Human
ucaaaagcagacauguuuggcug

SEQ ID NO: 1072348 - RNA, 24 nt, Human
ucagaaaucuggcuacaaagugau

SEQ ID NO: 1072349 - RNA, 22 nt, Human
ucagaguuuuauacugaguaac

SEQ ID NO: 1072350 - RNA, 26 nt, Human
ucagaguuuuauacugaguaaccuga

SEQ ID NO: 1072351 - RNA, 21 nt, Human
uccaaaguuuucucaaaccag

SEQ ID NO: 1072352 - RNA, 18 nt, Human
uccaaugcucuugaaucu

SEQ ID NO: 1072353 - RNA, 20 nt, Human
uccacaaaacacagagaacc

SEQ ID NO: 1072354 - RNA, 23 nt, Human
uccauuucccagagcauuuuacc

SEQ ID NO: 1072355 - RNA, 21 nt, Human
ucccaagugccuuccccaaca

SEQ ID NO: 1072356 - RNA, 24 nt, Human
ucccagagcauuuuaccucucaga

SEQ ID NO: 1072357 - RNA, 20 nt, Human
ucccccauaaaccuaaaagu

SEQ ID NO: 1072358 - RNA, 24 nt, Human
ucccccauaaaccuaaaaguccau

SEQ ID NO: 1072359 - RNA, 18 nt, Human
ucccuccccacaauaccc

SEQ ID NO: 1072360 - RNA, 18 nt, Human
ucuagggccaaggagagg

SEQ ID NO: 1072361 - RNA, 19 nt, Human
ugaaaacacugucaacauu

SEQ ID NO: 1072362 - RNA, 18 nt, Human
ugaaaagggggaaaagag

SEQ ID NO: 1072363 - RNA, 20 nt, Human
ugaaaagggggaaaagagga

SEQ ID NO: 1072364 - RNA, 24 nt, Human
ugaaauaaaaccaagaaacacagc

SEQ ID NO: 1072365 - RNA, 20 nt, Human
ugaaggguauuaacugaggg

SEQ ID NO: 1072366 - RNA, 20 nt, Human
ugaauaagaaccuuuucccc

SEQ ID NO: 1072367 - RNA, 21 nt, Human
ugaauaagaaccuuuucccca

SEQ ID NO: 1072368 - RNA, 20 nt, Human
ugaaucugaaauggccuccc

SEQ ID NO: 1072369 - RNA, 20 nt, Human
ugacagauguugaauacggu

SEQ ID NO: 1072370 - RNA, 21 nt, Human
ugacagauguugaauacggug

SEQ ID NO: 1072371 - RNA, 19 nt, Human
ugaggaaggagaggcccag

SEQ ID NO: 1072372 - RNA, 20 nt, Human
ugcaaguugguggcguggga

SEQ ID NO: 1072373 - RNA, 22 nt, Human
ugccuuccccaacaacauccua

SEQ ID NO: 1072374 - RNA, 19 nt, Human
ugcuuugauccugagacag

SEQ ID NO: 1072375 - RNA, 20 nt, Human
uggaaaaaugaacugcuucu

SEQ ID NO: 1072376 - RNA, 23 nt, Human
ugggacaguacagagugcugaaa

SEQ ID NO: 1072377 - RNA, 20 nt, Human
ugggagcagagggaaguugg

SEQ ID NO: 1072378 - RNA, 24 nt, Human
ugggagcagagggaaguuggcagg

SEQ ID NO: 1072379 - RNA, 22 nt, Human
ugggaugaagcuuuaaggauca

SEQ ID NO: 1072380 - RNA, 19 nt, Human
uggggagugguaagcaaug

SEQ ID NO: 1072381 - RNA, 18 nt, Human
ugggggugggggguggaa

SEQ ID NO: 1072382 - RNA, 21 nt, Human
ugguacugcuagugcugggug

SEQ ID NO: 1072383 - RNA, 23 nt, Human
ugguacugcuagugcugggugaa

SEQ ID NO: 1072384 - RNA, 23 nt, Human
uguaggaaguggugggaaagcca

SEQ ID NO: 1072385 - RNA, 20 nt, Human
uguccaaaguuuucucaaac

SEQ ID NO: 1072386 - RNA, 25 nt, Human
uguuauagauguuuugaaaauaaaa

SEQ ID NO: 1072387 - RNA, 18 nt, Human
uugauccugagacagucu

SEQ ID NO: 1072388 - RNA, 22 nt, Human
uuggcugaaauaaaaccaagaa

SEQ ID NO: 1072389 - RNA, 19 nt, Human
uugggagcagagggaaguu

SEQ ID NO: 1072390 - RNA, 19 nt, Human
uuggggagugguaagcaau

SEQ ID NO: 1072391 - RNA, 21 nt, Human
uugguuggggagugguaagca

SEQ ID NO: 1072392 - RNA, 25 nt, Human
uuuaaaaaaaaaaucaaaagcagac

SEQ ID NO: 1072393 - RNA, 21 nt, Human
uuugggggugggggguggaaa

SEQ ID NO: 1072394 - RNA, 24 nt, Human
aaaguauugggauuacaggcauga

SEQ ID NO: 1072395 - RNA, 19 nt, Human
aaagugcuaggauuauagg

SEQ ID NO: 1072396 - RNA, 19 nt, Human
aagccauucuuagaucugg

SEQ ID NO: 1072397 - RNA, 21 nt, Human
aaguauugggauuacaggcau

SEQ ID NO: 1072398 - RNA, 26 nt, Human
aaguauugggauuacaggcaugagcu

SEQ ID NO: 1072399 - RNA, 20 nt, Human
aagugcuucacuugccucag

SEQ ID NO: 1072400 - RNA, 18 nt, Human
acugcagccucaaccucc

SEQ ID NO: 1072401 - RNA, 21 nt, Human
agagacgugcaccaccacacc

SEQ ID NO: 1072402 - RNA, 26 nt, Human
agcagcaucucaaaagggcugacugg

SEQ ID NO: 1072403 - RNA, 20 nt, Human
agccucaaccuccugggcuc

SEQ ID NO: 1072404 - RNA, 22 nt, Human
aggggagaagcugggcaaagag

SEQ ID NO: 1072405 - RNA, 20 nt, Human
agggugauugguaccugaaa

SEQ ID NO: 1072406 - RNA, 23 nt, Human
aggucuucagcaugacuugguuu

SEQ ID NO: 1072407 - RNA, 23 nt, Human
aguagcugggauuacaggcaugu

SEQ ID NO: 1072408 - RNA, 19 nt, Human
agucagcagcaucucaaaa

SEQ ID NO: 1072409 - RNA, 24 nt, Human
aguggcaugaucuuaguucacugc

SEQ ID NO: 1072410 - RNA, 20 nt, Human
aucucauucuguugcccaag

SEQ ID NO: 1072411 - RNA, 24 nt, Human
augggguuuugccauguuggccag

SEQ ID NO: 1072412 - RNA, 23 nt, Human
augggugcaguggcaugaucuua

SEQ ID NO: 1072413 - RNA, 24 nt, Human
caaaguauugggauuacaggcaug

SEQ ID NO: 1072414 - RNA, 24 nt, Human
caaagugcuaggauuauaggcaua

SEQ ID NO: 1072415 - RNA, 22 nt, Human
caagugauucuccugucucagc

SEQ ID NO: 1072416 - RNA, 19 nt, Human
caccugguuaauuuuuuua

SEQ ID NO: 1072417 - RNA, 24 nt, Human
cacuaaguugcccaggcuggucuu

SEQ ID NO: 1072418 - RNA, 23 nt, Human
cacucaggaauuucucccucuca

SEQ ID NO: 1072419 - RNA, 19 nt, Human
cacugcagccucaaccucc

SEQ ID NO: 1072420 - RNA, 21 nt, Human
cacuguaaccuccaccuccug

SEQ ID NO: 1072421 - RNA, 23 nt, Human
cacuguaaccuccaccuccuggg

SEQ ID NO: 1072422 - RNA, 23 nt, Human
cagcagcaucucaaaagggcuga

SEQ ID NO: 1072423 - RNA, 24 nt, Human
cagccucaaccuccugggcucaag

SEQ ID NO: 1072424 - RNA, 20 nt, Human
cagccuccugaguagcugag

SEQ ID NO: 1072425 - RNA, 25 nt, Human
caguggugugaucuuggcucacugu

SEQ ID NO: 1072426 - RNA, 22 nt, Human
caugccuguuuuuuucuggagg

SEQ ID NO: 1072427 - RNA, 24 nt, Human
cauguuggccaggcuggucucgaa

SEQ ID NO: 1072428 - RNA, 24 nt, Human
ccaaaguauugggauuacaggcau

SEQ ID NO: 1072429 - RNA, 24 nt, Human
ccaaagugcuaggauuauaggcau

SEQ ID NO: 1072430 - RNA, 22 nt, Human
ccacaccugguuaauuuuuuua

SEQ ID NO: 1072431 - RNA, 24 nt, Human
ccaccuccuggguucaagugauuc

SEQ ID NO: 1072432 - RNA, 19 nt, Human
ccauguuggccaggcuggu

SEQ ID NO: 1072433 - RNA, 22 nt, Human
ccauguuggccaggcuggucuc

SEQ ID NO: 1072434 - RNA, 23 nt, Human
ccauguuggccaggcuggucucg

SEQ ID NO: 1072435 - RNA, 24 nt, Human
cccaaaguauugggauuacaggca

SEQ ID NO: 1072436 - RNA, 20 nt, Human
ccccgggcaucucguuccca

SEQ ID NO: 1072437 - RNA, 23 nt, Human
cccgaguagcugggauuacaggc

SEQ ID NO: 1072438 - RNA, 24 nt, Human
cccgaguagcugggauuacaggca

SEQ ID NO: 1072439 - RNA, 23 nt, Human
ccgaguagcugggauuacaggca

SEQ ID NO: 1072440 - RNA, 24 nt, Human
ccgaguagcugggauuacaggcau

SEQ ID NO: 1072441 - RNA, 19 nt, Human
ccucaaccuccugggcuca

SEQ ID NO: 1072442 - RNA, 20 nt, Human
ccucaaccuccugggcucaa

SEQ ID NO: 1072443 - RNA, 19 nt, Human
ccucacuaaguugcccagg

SEQ ID NO: 1072444 - RNA, 22 nt, Human
ccuccaccuccuggguucaagu

SEQ ID NO: 1072445 - RNA, 26 nt, Human
ccuccuaccuuggccucccaaagugc

SEQ ID NO: 1072446 - RNA, 24 nt, Human
ccuccugggcucaagccaucuucc

SEQ ID NO: 1072447 - RNA, 24 nt, Human
ccuccuggguucaagugauucucc

SEQ ID NO: 1072448 - RNA, 20 nt, Human
ccuggccucaagccauccuc

SEQ ID NO: 1072449 - RNA, 20 nt, Human
ccugggcucaagccaucuuc

SEQ ID NO: 1072450 - RNA, 23 nt, Human
ccugggcucaagccaucuuccug

SEQ ID NO: 1072451 - RNA, 23 nt, Human
ccuggguucaagugauucuccuc

SEQ ID NO: 1072452 - RNA, 23 nt, Human
ccuggguucaagugauucuccug

SEQ ID NO: 1072453 - RNA, 21 nt, Human
ccuguauggucauuaucacuc

SEQ ID NO: 1072454 - RNA, 24 nt, Human
cucaagccauccuccuaccuuggc

SEQ ID NO: 1072455 - RNA, 21 nt, Human
cucaagccaucuuccugccac

SEQ ID NO: 1072456 - RNA, 24 nt, Human
cucacuguaaccuccaccuccugg

SEQ ID NO: 1072457 - RNA, 27 nt, Human
cucacuguaaccuccaccuccuggguu

SEQ ID NO: 1072458 - RNA, 23 nt, Human
cucagccucccgaguagcuggga

SEQ ID NO: 1072459 - RNA, 18 nt, Human
cuccaagugguggaaaag

SEQ ID NO: 1072460 - RNA, 19 nt, Human
cuccuggccucaagccauc

SEQ ID NO: 1072461 - RNA, 25 nt, Human
cuccugggcucaagccaucuuccug

SEQ ID NO: 1072462 - RNA, 20 nt, Human
cuccuggguucaagugauuc

SEQ ID NO: 1072463 - RNA, 21 nt, Human
cuccuggguucaagugauucu

SEQ ID NO: 1072464 - RNA, 20 nt, Human
cucucacccaaccucagcuc

SEQ ID NO: 1072465 - RNA, 19 nt, Human
cugcagccccagccugaag

SEQ ID NO: 1072466 - RNA, 20 nt, Human
cugcagccccagccugaagc

SEQ ID NO: 1072467 - RNA, 22 nt, Human
cugcagccucaaccuccugggc

SEQ ID NO: 1072468 - RNA, 23 nt, Human
cugccacagccuccugaguagcu

SEQ ID NO: 1072469 - RNA, 21 nt, Human
cuguaaccuccaccuccuggg

SEQ ID NO: 1072470 - RNA, 24 nt, Human
cuguaaccuccaccuccuggguuc

SEQ ID NO: 1072471 - RNA, 23 nt, Human
cugucucagccucccgaguagcu

SEQ ID NO: 1072472 - RNA, 19 nt, Human
cuuuauaggugcuuucuug

SEQ ID NO: 1072473 - RNA, 24 nt, Human
gaccucaagugcuucacuugccuc

SEQ ID NO: 1072474 - RNA, 18 nt, Human
gagaugggguuuugccau

SEQ ID NO: 1072475 - RNA, 25 nt, Human
gaguagcugggauuacaggcaugug

SEQ ID NO: 1072476 - RNA, 19 nt, Human
gauuacaggcaugagcuac

SEQ ID NO: 1072477 - RNA, 21 nt, Human
gauuacaggcaugagcuacua

SEQ ID NO: 1072478 - RNA, 18 nt, Human
gauuacaggcaugugcca

SEQ ID NO: 1072479 - RNA, 24 nt, Human
gauuacaggcaugugccaccaugc

SEQ ID NO: 1072480 - RNA, 18 nt, Human
gauuauaggcauaagcca

SEQ ID NO: 1072481 - RNA, 21 nt, Human
gauuauaggcauaagccaaug

SEQ ID NO: 1072482 - RNA, 21 nt, Human
gauucuccugucucagccucc

SEQ ID NO: 1072483 - RNA, 22 nt, Human
gcaaagaggugacugcagcccc

SEQ ID NO: 1072484 - RNA, 18 nt, Human
gcagcaucucaaaagggc

SEQ ID NO: 1072485 - RNA, 19 nt, Human
gcagccccagccugaagcc

SEQ ID NO: 1072486 - RNA, 21 nt, Human
gcagccugcugggauuuccag

SEQ ID NO: 1072487 - RNA, 20 nt, Human
gccauguuggccaggcuggu

SEQ ID NO: 1072488 - RNA, 23 nt, Human
gcuggucucgaacuccugaccuc

SEQ ID NO: 1072489 - RNA, 23 nt, Human
gcuggucuugaacuccuggccuc

SEQ ID NO: 1072490 - RNA, 24 nt, Human
ggauuacaggcaugagcuacuaug

SEQ ID NO: 1072491 - RNA, 24 nt, Human
ggauuacaggcaugugccaccaug

SEQ ID NO: 1072492 - RNA, 24 nt, Human
ggauuauaggcauaagccaaugug

SEQ ID NO: 1072493 - RNA, 18 nt, Human
ggcaggggagaagcuggg

SEQ ID NO: 1072494 - RNA, 24 nt, Human
ggcuggucucgaacuccugaccuc

SEQ ID NO: 1072495 - RNA, 24 nt, Human
ggcuggucuugaacuccuggccuc

SEQ ID NO: 1072496 - RNA, 21 nt, Human
gggagaagcugggcaaagagg

SEQ ID NO: 1072497 - RNA, 22 nt, Human
gggguuuugccauguuggccag

SEQ ID NO: 1072498 - RNA, 23 nt, Human
gggguuuugccauguuggccagg

SEQ ID NO: 1072499 - RNA, 18 nt, Human
ggguuuugccauguuggc

SEQ ID NO: 1072500 - RNA, 20 nt, Human
gguacaguggugugaucuug

SEQ ID NO: 1072501 - RNA, 19 nt, Human
ggucucgaacuccugaccu

SEQ ID NO: 1072502 - RNA, 21 nt, Human
ggugcaguggcaugaucuuag

SEQ ID NO: 1072503 - RNA, 23 nt, Human
ggugcaguggcaugaucuuaguu

SEQ ID NO: 1072504 - RNA, 23 nt, Human
guacaguggugugaucuuggcuc

SEQ ID NO: 1072505 - RNA, 23 nt, Human
guagagaugggguuuugccaugu

SEQ ID NO: 1072506 - RNA, 18 nt, Human
guagcugggauuacaggc

SEQ ID NO: 1072507 - RNA, 20 nt, Human
guagcugggauuacaggcau

SEQ ID NO: 1072508 - RNA, 24 nt, Human
gugauucuccugucucagccuccc

SEQ ID NO: 1072509 - RNA, 21 nt, Human
gugcuucacuugccucagccu

SEQ ID NO: 1072510 - RNA, 24 nt, Human
gugcuucacuugccucagccuccc

SEQ ID NO: 1072511 - RNA, 21 nt, Human
guugcccaggcuggucuugaa

SEQ ID NO: 1072512 - RNA, 19 nt, Human
uaacuuggcagauaagugg

SEQ ID NO: 1072513 - RNA, 24 nt, Human
uaaguugcccaggcuggucuugaa

SEQ ID NO: 1072514 - RNA, 24 nt, Human
uaauguuugcauuuuuaguagaga

SEQ ID NO: 1072515 - RNA, 23 nt, Human
uaauuuuuuuauuuuuuauagag

SEQ ID NO: 1072516 - RNA, 24 nt, Human
uaauuuuuuuauuuuuuauagaga

SEQ ID NO: 1072517 - RNA, 24 nt, Human
uacaggcaugagcuacuaugccca

SEQ ID NO: 1072518 - RNA, 24 nt, Human
uacaggcaugugccaccaugccca

SEQ ID NO: 1072519 - RNA, 19 nt, Human
uacaguggugugaucuugg

SEQ ID NO: 1072520 - RNA, 23 nt, Human
uacaguggugugaucuuggcucc

SEQ ID NO: 1072521 - RNA, 18 nt, Human
uagaagagcucuugggug

SEQ ID NO: 1072522 - RNA, 22 nt, Human
uagagaugggguuuugccaugu

SEQ ID NO: 1072523 - RNA, 21 nt, Human
uaggauuauaggcauaagcca

SEQ ID NO: 1072524 - RNA, 23 nt, Human
uaggauuauaggcauaagccaau

SEQ ID NO: 1072525 - RNA, 24 nt, Human
uaguagagaugggguuuugccaug

SEQ ID NO: 1072526 - RNA, 23 nt, Human
uaguucacugcagccucaaccuc

SEQ ID NO: 1072527 - RNA, 24 nt, Human
uaguucacugcagccucaaccucc

SEQ ID NO: 1072528 - RNA, 25 nt, Human
ucaagccauccuccuaccuuggccu

SEQ ID NO: 1072529 - RNA, 20 nt, Human
ucacugcagccucaaccucc

SEQ ID NO: 1072530 - RNA, 23 nt, Human
ucacugcagccucaaccuccugg

SEQ ID NO: 1072531 - RNA, 24 nt, Human
ucacugcagccucaaccuccuggg

SEQ ID NO: 1072532 - RNA, 23 nt, Human
ucacuguaaccuccaccuccugg

SEQ ID NO: 1072533 - RNA, 23 nt, Human
ucacuguaaccuccaccuccugg

SEQ ID NO: 1072534 - RNA, 24 nt, Human
ucacuguaaccuccaccuccuggg

SEQ ID NO: 1072535 - RNA, 27 nt, Human
ucacuguaaccuccaccuccuggguuc

SEQ ID NO: 1072536 - RNA, 20 nt, Human
ucagccucccgaguagcugg

SEQ ID NO: 1072537 - RNA, 19 nt, Human
uccaggucuucagcaugac

SEQ ID NO: 1072538 - RNA, 24 nt, Human
ucccaaaguauugggauuacaggc

SEQ ID NO: 1072539 - RNA, 24 nt, Human
ucccaaagugcuaggauuauaggc

SEQ ID NO: 1072540 - RNA, 24 nt, Human
ucccgaguagcugggauuacaggc

SEQ ID NO: 1072541 - RNA, 20 nt, Human
uccugggcucaagccaucuu

SEQ ID NO: 1072542 - RNA, 24 nt, Human
uccugggcucaagccaucuuccug

SEQ ID NO: 1072543 - RNA, 21 nt, Human
uccuggguucaagugauucuc

SEQ ID NO: 1072544 - RNA, 24 nt, Human
uccuggguucaagugauucuccug

SEQ ID NO: 1072545 - RNA, 18 nt, Human
ucucauucuguugcccaa

SEQ ID NO: 1072546 - RNA, 19 nt, Human
ucucauucuguugcccaag

SEQ ID NO: 1072547 - RNA, 20 nt, Human
ucucauucuguugcccaaga

SEQ ID NO: 1072548 - RNA, 23 nt, Human
ucucauucuguugcccaagaugg

SEQ ID NO: 1072549 - RNA, 23 nt, Human
ucucauucuguugcccaagaugg

SEQ ID NO: 1072550 - RNA, 24 nt, Human
ucucauucuguugcccaagauggg

SEQ ID NO: 1072551 - RNA, 24 nt, Human
ucuccugucucagccucccgagua

SEQ ID NO: 1072552 - RNA, 21 nt, Human
ucucgaacuccugaccucaag

SEQ ID NO: 1072553 - RNA, 23 nt, Human
ucucuucucuguugccuuuguuc

SEQ ID NO: 1072554 - RNA, 21 nt, Human
ucugcucucuucucuguugcc

SEQ ID NO: 1072555 - RNA, 24 nt, Human
ucugcucucuucucuguugccuuu

SEQ ID NO: 1072556 - RNA, 21 nt, Human
ucuugaacuccuggccucaag

SEQ ID NO: 1072557 - RNA, 22 nt, Human
ugaauccauggcuuaacacugg

SEQ ID NO: 1072558 - RNA, 19 nt, Human
ugaccucaagugcuucacu

SEQ ID NO: 1072559 - RNA, 20 nt, Human
ugaccucaagugcuucacuu

SEQ ID NO: 1072560 - RNA, 20 nt, Human
ugacugcagccccagccuga

SEQ ID NO: 1072561 - RNA, 19 nt, Human
ugacuugguuucucagugg

SEQ ID NO: 1072562 - RNA, 24 nt, Human
ugagacuagagacgugcaccacca

SEQ ID NO: 1072563 - RNA, 20 nt, Human
ugauucuccugucucagccu

SEQ ID NO: 1072564 - RNA, 23 nt, Human
ugcagccugcugggauuuccagg

SEQ ID NO: 1072565 - RNA, 22 nt, Human
ugcaguggcaugaucuuaguuc

SEQ ID NO: 1072566 - RNA, 24 nt, Human
ugccacagccuccugaguagcuga

SEQ ID NO: 1072567 - RNA, 27 nt, Human
ugccauguuggccaggcuggucucgaa

SEQ ID NO: 1072568 - RNA, 23 nt, Human
ugcccaagaugggugcaguggca

SEQ ID NO: 1072569 - RNA, 24 nt, Human
ugcccaggcuggucuugaacuccu

SEQ ID NO: 1072570 - RNA, 24 nt, Human
ugccucagccucccaaaguauugg

SEQ ID NO: 1072571 - RNA, 23 nt, Human
ugcugggauuuccaggucuucag

SEQ ID NO: 1072572 - RNA, 24 nt, Human
ugcuucacuugccucagccuccca

SEQ ID NO: 1072573 - RNA, 21 nt, Human
uggcagauaaguggguaguca

SEQ ID NO: 1072574 - RNA, 19 nt, Human
uggcaugaucuuaguucac

SEQ ID NO: 1072575 - RNA, 24 nt, Human
uggccaggcuggucucgaacuccu

SEQ ID NO: 1072576 - RNA, 20 nt, Human
uggccucaagccauccuccu

SEQ ID NO: 1072577 - RNA, 21 nt, Human
uggccucaagccauccuccua

SEQ ID NO: 1072578 - RNA, 18 nt, Human
ugggauuacaggcaugag

SEQ ID NO: 1072579 - RNA, 19 nt, Human
ugggauuacaggcaugagc

SEQ ID NO: 1072580 - RNA, 19 nt, Human
ugggauuacaggcaugagc

SEQ ID NO: 1072581 - RNA, 21 nt, Human
ugggauuacaggcaugagcua

SEQ ID NO: 1072582 - RNA, 22 nt, Human
ugggauuacaggcaugagcuac

SEQ ID NO: 1072583 - RNA, 22 nt, Human
ugggauuacaggcaugagcuac

SEQ ID NO: 1072584 - RNA, 23 nt, Human
ugggauuacaggcaugagcuacu

SEQ ID NO: 1072585 - RNA, 24 nt, Human
ugggauuacaggcaugagcuacua

SEQ ID NO: 1072586 - RNA, 26 nt, Human
ugggauuacaggcaugagcuacuaug

SEQ ID NO: 1072587 - RNA, 18 nt, Human
ugggauuacaggcaugug

SEQ ID NO: 1072588 - RNA, 21 nt, Human
ugggauuacaggcaugugcca

SEQ ID NO: 1072589 - RNA, 22 nt, Human
ugggauuacaggcaugugccac

SEQ ID NO: 1072590 - RNA, 24 nt, Human
ugggauuacaggcaugugccacca

SEQ ID NO: 1072591 - RNA, 20 nt, Human
uggggcuuguguacaggugc

SEQ ID NO: 1072592 - RNA, 24 nt, Human
ugggguuuugccauguuggccagg

SEQ ID NO: 1072593 - RNA, 23 nt, Human
ugggugcaguggcaugaucuuag

SEQ ID NO: 1072594 - RNA, 21 nt, Human
uggguggaaccuuuaaggaug

SEQ ID NO: 1072595 - RNA, 20 nt, Human
uggguucaagugauucuccu

SEQ ID NO: 1072596 - RNA, 24 nt, Human
uggguucaagugauucuccugucu

SEQ ID NO: 1072597 - RNA, 22 nt, Human
ugguacaguggugugaucuugg

SEQ ID NO: 1072598 - RNA, 23 nt, Human
uggugugaucuuggcucacugua

SEQ ID NO: 1072599 - RNA, 24 nt, Human
uggugugaucuuggcucacuguaa

SEQ ID NO: 1072600 - RNA, 24 nt, Human
ugucucagccucccgaguagcugg

SEQ ID NO: 1072601 - RNA, 24 nt, Human
ugugguacaguggugugaucuugg

SEQ ID NO: 1072602 - RNA, 22 nt, Human
uguuuuuauuuuuuuagagaca

SEQ ID NO: 1072603 - RNA, 18 nt, Human
uuaguagagaugggguuu

SEQ ID NO: 1072604 - RNA, 22 nt, Human
uuaguagagaugggguuuugcc

SEQ ID NO: 1072605 - RNA, 24 nt, Human
uuaguagagaugggguuuugccau

SEQ ID NO: 1072606 - RNA, 26 nt, Human
uuauagagacggggccucacuaaguu

SEQ ID NO: 1072607 - RNA, 23 nt, Human
uucaagugauucuccugucucag

SEQ ID NO: 1072608 - RNA, 24 nt, Human
uucacugcagccucaaccuccugg

SEQ ID NO: 1072609 - RNA, 23 nt, Human
uucucccucucacccaaccucag

SEQ ID NO: 1072610 - RNA, 19 nt, Human
uucuuucguugcucaggcu

SEQ ID NO: 1072611 - RNA, 24 nt, Human
uugccauguuggccaggcuggucu

SEQ ID NO: 1072612 - RNA, 23 nt, Human
uugcucaggcugugguacagugg

SEQ ID NO: 1072613 - RNA, 24 nt, Human
uugcucaggcugugguacaguggu

SEQ ID NO: 1072614 - RNA, 18 nt, Human
uuggccucccaaagugcu

SEQ ID NO: 1072615 - RNA, 21 nt, Human
uuguguacaggugcuuacugu

SEQ ID NO: 1072616 - RNA, 18 nt, Human
uuugacaggcucccucca

SEQ ID NO: 1072617 - RNA, 18 nt, Human
uuugcauuuuuaguagag

SEQ ID NO: 1072618 - RNA, 19 nt, Human
uuugcauuuuuaguagaga

SEQ ID NO: 1072619 - RNA, 23 nt, Human
uuuugccauguuggccaggcugg

SEQ ID NO: 1072620 - RNA, 21 nt, Human
uuuuuaguagagaugggguuu

SEQ ID NO: 1072621 - RNA, 24 nt, Human
uuuuuaguagagaugggguuuugc

SEQ ID NO: 1072622 - RNA, 18 nt, Human
aaccugugcucuagaacu

SEQ ID NO: 1072623 - RNA, 24 nt, Human
aagcaacuagaacaugauucagaa

SEQ ID NO: 1072624 - RNA, 20 nt, Human
acaaagcacucgcaaaaacc

SEQ ID NO: 1072625 - RNA, 18 nt, Human
acaagaaaccccagaagg

SEQ ID NO: 1072626 - RNA, 20 nt, Human
acuccgcucauggggacaga

SEQ ID NO: 1072627 - RNA, 24 nt, Human
agaaccugugcucuagaacugcua

SEQ ID NO: 1072628 - RNA, 18 nt, Human
agaugaacacuggaccca

SEQ ID NO: 1072629 - RNA, 19 nt, Human
aggcaggaagggauucuaa

SEQ ID NO: 1072630 - RNA, 22 nt, Human
aggcaguggccugacugcagaa

SEQ ID NO: 1072631 - RNA, 19 nt, Human
augaagggagugggugcag

SEQ ID NO: 1072632 - RNA, 22 nt, Human
caaccgccacaagaaaccccag

SEQ ID NO: 1072633 - RNA, 26 nt, Human
cacuccugccccucagaggucaagga

SEQ ID NO: 1072634 - RNA, 19 nt, Human
cacugccaugaaacaaggc

SEQ ID NO: 1072635 - RNA, 24 nt, Human
cacugccaugaaacaaggcaggaa

SEQ ID NO: 1072636 - RNA, 27 nt, Human
cacugccaugaaacaaggcaggaaggg

SEQ ID NO: 1072637 - RNA, 23 nt, Human
cagguuacauucgucuuccacug

SEQ ID NO: 1072638 - RNA, 19 nt, Human
caguaggcaguggccugac

SEQ ID NO: 1072639 - RNA, 20 nt, Human
cauuucacugccaugaaaca

SEQ ID NO: 1072640 - RNA, 24 nt, Human
ccacaagaaaccccagaaggguua

SEQ ID NO: 1072641 - RNA, 23 nt, Human
cgccacaagaaaccccagaaggg

SEQ ID NO: 1072642 - RNA, 20 nt, Human
cuaauacacacaccaggaag

SEQ ID NO: 1072643 - RNA, 24 nt, Human
cucaagaugucuacagaugugguc

SEQ ID NO: 1072644 - RNA, 21 nt, Human
cuccccaaaguccuuaguaaa

SEQ ID NO: 1072645 - RNA, 23 nt, Human
cucgcaaaaacccaagucacuac

SEQ ID NO: 1072646 - RNA, 20 nt, Human
cuuggacaggaccaagaggc

SEQ ID NO: 1072647 - RNA, 19 nt, Human
gagcagaggacagacuccg

SEQ ID NO: 1072648 - RNA, 21 nt, Human
gcagaggacagacuccgcuca

SEQ ID NO: 1072649 - RNA, 24 nt, Human
gcagguuacauucgucuuccacug

SEQ ID NO: 1072650 - RNA, 22 nt, Human
ggagcuuuuccauagcuuagac

SEQ ID NO: 1072651 - RNA, 19 nt, Human
gggacagacaggcucuguu

SEQ ID NO: 1072652 - RNA, 21 nt, Human
gucagugugacaugugcaggu

SEQ ID NO: 1072653 - RNA, 24 nt, Human
uaaacaaagcacucgcaaaaaccc

SEQ ID NO: 1072654 - RNA, 24 nt, Human
uaaauuaacacauaacgaaauuca

SEQ ID NO: 1072655 - RNA, 23 nt, Human
uacaguuaugcucagaugaacac

SEQ ID NO: 1072656 - RNA, 21 nt, Human
uacauucgucuuccacuggaa

SEQ ID NO: 1072657 - RNA, 24 nt, Human
uagaacaugauucagaaaucagug

SEQ ID NO: 1072658 - RNA, 24 nt, Human
uauuauacugauauggaaaaagga

SEQ ID NO: 1072659 - RNA, 18 nt, Human
ucauggggacagacaggc

SEQ ID NO: 1072660 - RNA, 19 nt, Human
uccauagcuuagacugaga

SEQ ID NO: 1072661 - RNA, 19 nt, Human
ucccaaccuagagccagau

SEQ ID NO: 1072662 - RNA, 21 nt, Human
uccccaaaguccuuaguaaac

SEQ ID NO: 1072663 - RNA, 23 nt, Human
uccccaaaguccuuaguaaacaa

SEQ ID NO: 1072664 - RNA, 24 nt, Human
uggaaugacuagagcccccaggca

SEQ ID NO: 1072665 - RNA, 24 nt, Human
uggcuuagcaugguuccuccccaa

SEQ ID NO: 1072666 - RNA, 19 nt, Human
ugggagccacuggucccca

SEQ ID NO: 1072667 - RNA, 21 nt, Human
uggggucagggaggaaacagu

SEQ ID NO: 1072668 - RNA, 18 nt, Human
uguggucagugugacaug

SEQ ID NO: 1072669 - RNA, 20 nt, Human
uuagacugagaaccugugcu

SEQ ID NO: 1072670 - RNA, 25 nt, Human
uuagcaugguuccuccccaaagucc

SEQ ID NO: 1072671 - RNA, 27 nt, Human
aaaaaacaccaaccagauaaaaagucc

SEQ ID NO: 1072672 - RNA, 19 nt, Human
aaaaguccaaaagacaaaa

SEQ ID NO: 1072673 - RNA, 19 nt, Human
aaacacgcacacauacaug

SEQ ID NO: 1072674 - RNA, 26 nt, Human
aaagcagugagaaucaaagcccaacc

SEQ ID NO: 1072675 - RNA, 20 nt, Human
aaagcccaaccaaggcacug

SEQ ID NO: 1072676 - RNA, 21 nt, Human
aaaugcucagcaaaugugagc

SEQ ID NO: 1072677 - RNA, 18 nt, Human
aacacgcacacauacaug

SEQ ID NO: 1072678 - RNA, 18 nt, Human
aaccaaggcacugaacaa

SEQ ID NO: 1072679 - RNA, 22 nt, Human
aagcagugagaaucaaagccca

SEQ ID NO: 1072680 - RNA, 22 nt, Human
acaaagcagugagaaucaaagc

SEQ ID NO: 1072681 - RNA, 19 nt, Human
acauauguacacacauaua

SEQ ID NO: 1072682 - RNA, 24 nt, Human
accauguuggccagggucgucucg

SEQ ID NO: 1072683 - RNA, 20 nt, Human
agacuccaaggcaagugccc

SEQ ID NO: 1072684 - RNA, 24 nt, Human
agcgugcugggauuacaggcguga

SEQ ID NO: 1072685 - RNA, 24 nt, Human
agggaaggagaggcgcgaaaagga

SEQ ID NO: 1072686 - RNA, 24 nt, Human
aggugauccaccugccuuggccuc

SEQ ID NO: 1072687 - RNA, 22 nt, Human
aguaauuguaucccacaccccu

SEQ ID NO: 1072688 - RNA, 21 nt, Human
augaaucccuuauuuuccuua

SEQ ID NO: 1072689 - RNA, 20 nt, Human
augggauuucaccauguugg

SEQ ID NO: 1072690 - RNA, 22 nt, Human
augggauuucaccauguuggcc

SEQ ID NO: 1072691 - RNA, 24 nt, Human
augggauuucaccauguuggccag

SEQ ID NO: 1072692 - RNA, 22 nt, Human
caaagcagugagaaucaaagcc

SEQ ID NO: 1072693 - RNA, 19 nt, Human
caacaacaacaaaaucacc

SEQ ID NO: 1072694 - RNA, 21 nt, Human
caacaacaacaaaaucaccuc

SEQ ID NO: 1072695 - RNA, 19 nt, Human
cacaccaaaaaugccugac

SEQ ID NO: 1072696 - RNA, 18 nt, Human
caccauguuggccagggu

SEQ ID NO: 1072697 - RNA, 24 nt, Human
caccauguuggccagggucgucuc

SEQ ID NO: 1072698 - RNA, 20 nt, Human
caccugccuuggccucccag

SEQ ID NO: 1072699 - RNA, 23 nt, Human
cagcaaaugugagcuacuguuau

SEQ ID NO: 1072700 - RNA, 19 nt, Human
cagcaaccggcgucggugg

SEQ ID NO: 1072701 - RNA, 20 nt, Human
cagcaaccggcgucgguggc

SEQ ID NO: 1072702 - RNA, 19 nt, Human
cagcgugcugggauuacag

SEQ ID NO: 1072703 - RNA, 19 nt, Human
cauauguacacacauauau

SEQ ID NO: 1072704 - RNA, 18 nt, Human
cauccagcaacauuccau

SEQ ID NO: 1072705 - RNA, 21 nt, Human
ccaaaaaugccugacaguaau

SEQ ID NO: 1072706 - RNA, 19 nt, Human
ccaaaagacaaaauguaaa

SEQ ID NO: 1072707 - RNA, 22 nt, Human
ccagcgugcugggauuacaggc

SEQ ID NO: 1072708 - RNA, 22 nt, Human
ccagcgugcugggauuacaggc

SEQ ID NO: 1072709 - RNA, 24 nt, Human
ccagcgugcugggauuacaggcgu

SEQ ID NO: 1072710 - RNA, 24 nt, Human
ccccuggggcucuggggaucucug

SEQ ID NO: 1072711 - RNA, 18 nt, Human
cccggccccgccgcugcc

SEQ ID NO: 1072712 - RNA, 19 nt, Human
ccgcugccgcugucacccg

SEQ ID NO: 1072713 - RNA, 20 nt, Human
ccgcugccgcugucacccgu

SEQ ID NO: 1072714 - RNA, 20 nt, Human
ccgcugucacccguggccgc

SEQ ID NO: 1072715 - RNA, 23 nt, Human
ccgcugucacccguggccgcucc

SEQ ID NO: 1072716 - RNA, 21 nt, Human
ccugaccucaggugauccacc

SEQ ID NO: 1072717 - RNA, 23 nt, Human
ccugaccucaggugauccaccug

SEQ ID NO: 1072718 - RNA, 23 nt, Human
ccugaccucaggugauccaccug

SEQ ID NO: 1072719 - RNA, 22 nt, Human
cggaaaugagacagcugugggg

SEQ ID NO: 1072720 - RNA, 24 nt, Human
cucaggugauccaccugccuuggc

SEQ ID NO: 1072721 - RNA, 22 nt, Human
cucugaguccaucccagggccc

SEQ ID NO: 1072722 - RNA, 23 nt, Human
cugccuuggccucccagcgugcu

SEQ ID NO: 1072723 - RNA, 19 nt, Human
cuuuuuguauuuuuaauag

SEQ ID NO: 1072724 - RNA, 23 nt, Human
gaccucaggugauccaccugccu

SEQ ID NO: 1072725 - RNA, 18 nt, Human
gagccaccgccauuuccc

SEQ ID NO: 1072726 - RNA, 18 nt, Human
gauuacaggcgugagcca

SEQ ID NO: 1072727 - RNA, 20 nt, Human
gauuacaggcgugagccacc

SEQ ID NO: 1072728 - RNA, 21 nt, Human
gauuacaggcgugagccaccg

SEQ ID NO: 1072729 - RNA, 18 nt, Human
gcuccaacgacgcgcauc

SEQ ID NO: 1072730 - RNA, 19 nt, Human
ggaaggagaggcgcgaaaa

SEQ ID NO: 1072731 - RNA, 22 nt, Human
ggaaggagaggcgcgaaaagga

SEQ ID NO: 1072732 - RNA, 22 nt, Human
ggagcgcagcccggccccgccg

SEQ ID NO: 1072733 - RNA, 22 nt, Human
ggccccgccgcugccgcuguca

SEQ ID NO: 1072734 - RNA, 22 nt, Human
gggauuucaccauguuggccag

SEQ ID NO: 1072735 - RNA, 18 nt, Human
ggggaagagggaaggaga

SEQ ID NO: 1072736 - RNA, 23 nt, Human
ggucgucucgaacuccugaccuc

SEQ ID NO: 1072737 - RNA, 21 nt, Human
gguguggggaagagggaagga

SEQ ID NO: 1072738 - RNA, 21 nt, Human
guauuccauugcauguaccaa

SEQ ID NO: 1072739 - RNA, 20 nt, Human
guccuuuuuuucccuccucu

SEQ ID NO: 1072740 - RNA, 24 nt, Human
gugauccaccugccuuggccuccc

SEQ ID NO: 1072741 - RNA, 21 nt, Human
gugcugggauuacaggcguga

SEQ ID NO: 1072742 - RNA, 20 nt, Human
guugucuggcuccagcguuu

SEQ ID NO: 1072743 - RNA, 21 nt, Human
uaaaaaagguggcaaauagua

SEQ ID NO: 1072744 - RNA, 20 nt, Human
uaaauuacaaaaaacaccaa

SEQ ID NO: 1072745 - RNA, 22 nt, Human
uaaauuacaaaaaacaccaacc

SEQ ID NO: 1072746 - RNA, 21 nt, Human
uaagcuguacuucacaaagca

SEQ ID NO: 1072747 - RNA, 23 nt, Human
uacaaaaaacaccaaccagauaa

SEQ ID NO: 1072748 - RNA, 24 nt, Human
uacaggcgugagccaccgccauuu

SEQ ID NO: 1072749 - RNA, 19 nt, Human
uaccacagagauuucugga

SEQ ID NO: 1072750 - RNA, 21 nt, Human
ucaggugauccaccugccuug

SEQ ID NO: 1072751 - RNA, 23 nt, Human
uccaaaagacaaaauguaaaaca

SEQ ID NO: 1072752 - RNA, 22 nt, Human
uccaccugccuuggccucccag

SEQ ID NO: 1072753 - RNA, 24 nt, Human
uccaccugccuuggccucccagcg

SEQ ID NO: 1072754 - RNA, 19 nt, Human
uccauuaccaacucgcugu

SEQ ID NO: 1072755 - RNA, 24 nt, Human
ucccagcgugcugggauuacaggc

SEQ ID NO: 1072756 - RNA, 24 nt, Human
ucccuccucuuaagagacacgguc

SEQ ID NO: 1072757 - RNA, 24 nt, Human
ucccucuaacggcuccggcagcaa

SEQ ID NO: 1072758 - RNA, 20 nt, Human
uccuuaugaaucccuuauuu

SEQ ID NO: 1072759 - RNA, 20 nt, Human
ucgcgcuccaacgacgcgca

SEQ ID NO: 1072760 - RNA, 21 nt, Human
ucggaaaugagacagcugugg

SEQ ID NO: 1072761 - RNA, 23 nt, Human
ucucgaacuccugaccucaggug

SEQ ID NO: 1072762 - RNA, 23 nt, Human
ucucugaguccaucccagggccc

SEQ ID NO: 1072763 - RNA, 22 nt, Human
ucuggaguugucuggcuccagc

SEQ ID NO: 1072764 - RNA, 24 nt, Human
ucuggaguugucuggcuccagcgu

SEQ ID NO: 1072765 - RNA, 22 nt, Human
ucuuggggguaaaaauaagcug

SEQ ID NO: 1072766 - RNA, 23 nt, Human
ugaaaggcugaccgccuacuuug

SEQ ID NO: 1072767 - RNA, 24 nt, Human
ugaccucaggugauccaccugccu

SEQ ID NO: 1072768 - RNA, 19 nt, Human
ugccacacaaaugcucagc

SEQ ID NO: 1072769 - RNA, 21 nt, Human
ugccuuggccucccagcgugc

SEQ ID NO: 1072770 - RNA, 24 nt, Human
ugcugggauuacaggcgugagcca

SEQ ID NO: 1072771 - RNA, 18 nt, Human
uggaagugggacaacuuu

SEQ ID NO: 1072772 - RNA, 19 nt, Human
uggaguugucuggcuccag

SEQ ID NO: 1072773 - RNA, 19 nt, Human
uggaguugucuggcuccag

SEQ ID NO: 1072774 - RNA, 21 nt, Human
uggcaaauaguauccuuauga

SEQ ID NO: 1072775 - RNA, 24 nt, Human
uggccagggucgucucgaacuccu

SEQ ID NO: 1072776 - RNA, 18 nt, Human
ugggaaggugucuguuuc

SEQ ID NO: 1072777 - RNA, 18 nt, Human
ugggauuacaggcgugag

SEQ ID NO: 1072778 - RNA, 22 nt, Human
ugggauuacaggcgugagccac

SEQ ID NO: 1072779 - RNA, 23 nt, Human
ugggauuacaggcgugagccacc

SEQ ID NO: 1072780 - RNA, 23 nt, Human
ugggauuacaggcgugagccacc

SEQ ID NO: 1072781 - RNA, 24 nt, Human
ugggauuacaggcgugagccaccg

SEQ ID NO: 1072782 - RNA, 26 nt, Human
ugggauuacaggcgugagccaccgcc

SEQ ID NO: 1072783 - RNA, 24 nt, Human
ugggauuucaccauguuggccagg

SEQ ID NO: 1072784 - RNA, 23 nt, Human
uggggaagagggaaggagaggcg

SEQ ID NO: 1072785 - RNA, 20 nt, Human
uggggaugggaaggugucug

SEQ ID NO: 1072786 - RNA, 20 nt, Human
uggggguaaaaauaagcugu

SEQ ID NO: 1072787 - RNA, 26 nt, Human
uguacacuuauauuaacauauguaca

SEQ ID NO: 1072788 - RNA, 18 nt, Human
uguccaauaauaacuaca

SEQ ID NO: 1072789 - RNA, 19 nt, Human
uguggggaagagggaagga

SEQ ID NO: 1072790 - RNA, 22 nt, Human
uuaacauauguacacacauaua

SEQ ID NO: 1072791 - RNA, 22 nt, Human
uuaauagaugggauuucaccau

SEQ ID NO: 1072792 - RNA, 21 nt, Human
uucaacaacaacaaaaucacc

SEQ ID NO: 1072793 - RNA, 18 nt, Human
uuccuuaggguauaugcc

SEQ ID NO: 1072794 - RNA, 20 nt, Human
uucugcuuuuuuuuuccuga

SEQ ID NO: 1072795 - RNA, 24 nt, Human
uuuaauagaugggauuucaccaug

SEQ ID NO: 1072796 - RNA, 24 nt, Human
uuucaccauguuggccagggucgu

SEQ ID NO: 1072797 - RNA, 21 nt, Human
uuuuuguauuuuuaauagaug

SEQ ID NO: 1072798 - RNA, 27 nt, Human
uuuuuuggacauacuuuaaugcaaaua

SEQ ID NO: 1072799 - RNA, 22 nt, Human
aaaacagacacacagcuuucuc

SEQ ID NO: 1072800 - RNA, 19 nt, Human
aaaagcaccaaucagcacc

SEQ ID NO: 1072801 - RNA, 21 nt, Human
aaacagacacacagcuuucuc

SEQ ID NO: 1072802 - RNA, 23 nt, Human
aaacagacacacagcuuucucca

SEQ ID NO: 1072803 - RNA, 24 nt, Human
aaacagacacacagcuuucuccau

SEQ ID NO: 1072804 - RNA, 19 nt, Human
aaccuagaggcuccaagcu

SEQ ID NO: 1072805 - RNA, 21 nt, Human
aagagcacgggaaagccaaga

SEQ ID NO: 1072806 - RNA, 18 nt, Human
aagaggaggugaggcaag

SEQ ID NO: 1072807 - RNA, 24 nt, Human
aagccucagcauugagagccaaga

SEQ ID NO: 1072808 - RNA, 25 nt, Human
aagcugcugggagcuggcugggggc

SEQ ID NO: 1072809 - RNA, 28 nt, Human
aaggaagcugugcagugggaggcuggug

SEQ ID NO: 1072810 - RNA, 22 nt, Human
aaggagggaaggaagcugugca

SEQ ID NO: 1072811 - RNA, 23 nt, Human
acacagcuuucuccauagacaaa

SEQ ID NO: 1072812 - RNA, 20 nt, Human
acaguaaaggcggaagguga

SEQ ID NO: 1072813 - RNA, 24 nt, Human
acccuuguaaggcugucauuuggg

SEQ ID NO: 1072814 - RNA, 23 nt, Human
acucacucaucaccaaggagaug

SEQ ID NO: 1072815 - RNA, 25 nt, Human
acugugccuucuuccuggccugcug

SEQ ID NO: 1072816 - RNA, 29 nt, Human
acugugccuucuuccuggccugcuggagg

SEQ ID NO: 1072817 - RNA, 24 nt, Human
agaaaggaggagcucuaaccccau

SEQ ID NO: 1072818 - RNA, 21 nt, Human
agaagaaaggaggagcucuaa

SEQ ID NO: 1072819 - RNA, 20 nt, Human
agacaaaacugaccccuaau

SEQ ID NO: 1072820 - RNA, 21 nt, Human
agagacaaggcaaggcuugag

SEQ ID NO: 1072821 - RNA, 18 nt, Human
agaggagagugaaggagg

SEQ ID NO: 1072822 - RNA, 23 nt, Human
agcaagaaggggacauggcccca

SEQ ID NO: 1072823 - RNA, 24 nt, Human
agccugaugcuggaggaggagccu

SEQ ID NO: 1072824 - RNA, 19 nt, Human
aggagaacagaggcccuga

SEQ ID NO: 1072825 - RNA, 22 nt, Human
aggaguaugccugccaacaccc

SEQ ID NO: 1072826 - RNA, 19 nt, Human
aggccuggagggccuugag

SEQ ID NO: 1072827 - RNA, 27 nt, Human
agggacccaugggaggaggaagggaug

SEQ ID NO: 1072828 - RNA, 19 nt, Human
aggggcagggaggggagag

SEQ ID NO: 1072829 - RNA, 20 nt, Human
aggggcagggaggggagagg

SEQ ID NO: 1072830 - RNA, 19 nt, Human
agugaaggagggaaggaag

SEQ ID NO: 1072831 - RNA, 21 nt, Human
aguggagugcccugggguucc

SEQ ID NO: 1072832 - RNA, 25 nt, Human
augaagagccugaggaaaagcacca

SEQ ID NO: 1072833 - RNA, 24 nt, Human
augcagaaacaggaagggaagcaa

SEQ ID NO: 1072834 - RNA, 20 nt, Human
auggagcggaguggcucuga

SEQ ID NO: 1072835 - RNA, 23 nt, Human
auggagggaggaaggggaaggag

SEQ ID NO: 1072836 - RNA, 21 nt, Human
auugagagccaagaggaggag

SEQ ID NO: 1072837 - RNA, 22 nt, Human
caaaacugaccccuaauuccga

SEQ ID NO: 1072838 - RNA, 23 nt, Human
caagccucagcauugagagccaa

SEQ ID NO: 1072839 - RNA, 22 nt, Human
cacagcuuucuccauagacaaa

SEQ ID NO: 1072840 - RNA, 19 nt, Human
cagagcucagauccaggcu

SEQ ID NO: 1072841 - RNA, 21 nt, Human
cagcaagaaggggacauggcc

SEQ ID NO: 1072842 - RNA, 23 nt, Human
cagcaagaaggggacauggcccc

SEQ ID NO: 1072843 - RNA, 18 nt, Human
cagcagccagccuuccca

SEQ ID NO: 1072844 - RNA, 20 nt, Human
cagccagccuucccaggaau

SEQ ID NO: 1072845 - RNA, 27 nt, Human
cagcuggaccucaagggcuuggaagcu

SEQ ID NO: 1072846 - RNA, 21 nt, Human
caggacagggcccacgccguc

SEQ ID NO: 1072847 - RNA, 19 nt, Human
caggccuggagggccuuga

SEQ ID NO: 1072848 - RNA, 21 nt, Human
cagggaggggagaggagagug

SEQ ID NO: 1072849 - RNA, 22 nt, Human
caguaacccuccagugcucccc

SEQ ID NO: 1072850 - RNA, 19 nt, Human
cagucccagucccaguucc

SEQ ID NO: 1072851 - RNA, 18 nt, Human
caguggagugcccugggg

SEQ ID NO: 1072852 - RNA, 23 nt, Human
caucaggaaaaccucuggccaga

SEQ ID NO: 1072853 - RNA, 25 nt, Human
cauggccccaagauagccaaucagg

SEQ ID NO: 1072854 - RNA, 21 nt, Human
ccaccaggcuccacuuccaac

SEQ ID NO: 1072855 - RNA, 22 nt, Human
cccacagcuggaccucaagggc

SEQ ID NO: 1072856 - RNA, 21 nt, Human
cccaccaggcuccacuuccaa

SEQ ID NO: 1072857 - RNA, 18 nt, Human
cccccggccggaagcagg

SEQ ID NO: 1072858 - RNA, 23 nt, Human
cccccggccggaagcaggagggc

SEQ ID NO: 1072859 - RNA, 23 nt, Human
ccccuccucccuucacucccuaa

SEQ ID NO: 1072860 - RNA, 18 nt, Human
cccucuuuugggacuuug

SEQ ID NO: 1072861 - RNA, 18 nt, Human
cccugggguuccuggggu

SEQ ID NO: 1072862 - RNA, 25 nt, Human
ccucucccacccuggcagcccacaa

SEQ ID NO: 1072863 - RNA, 23 nt, Human
ccugggaugggcccagaccucug

SEQ ID NO: 1072864 - RNA, 19 nt, Human
ccugggguuccuggggucc

SEQ ID NO: 1072865 - RNA, 21 nt, Human
cgacucacccaucaggaaaac

SEQ ID NO: 1072866 - RNA, 19 nt, Human
cuaauuccgacucacccau

SEQ ID NO: 1072867 - RNA, 23 nt, Human
cuccugcccaaucucaagcugcc

SEQ ID NO: 1072868 - RNA, 19 nt, Human
cugcuuucuugagucuagc

SEQ ID NO: 1072869 - RNA, 21 nt, Human
cuuggaagcucccagacuugc

SEQ ID NO: 1072870 - RNA, 18 nt, Human
cuuuuaaacaaccauauc

SEQ ID NO: 1072871 - RNA, 20 nt, Human
gaaagccaagagggucuuca

SEQ ID NO: 1072872 - RNA, 19 nt, Human
gaccaggggucuccaaggc

SEQ ID NO: 1072873 - RNA, 20 nt, Human
gacuuuuucucccuuaauug

SEQ ID NO: 1072874 - RNA, 23 nt, Human
gagaaagaggggagaggucucag

SEQ ID NO: 1072875 - RNA, 26 nt, Human
gagaggagagugaaggagggaaggaa

SEQ ID NO: 1072876 - RNA, 21 nt, Human
gagcauccaaaccauaucaga

SEQ ID NO: 1072877 - RNA, 19 nt, Human
gagccugaugcuggaggag

SEQ ID NO: 1072878 - RNA, 19 nt, Human
gaggaaaagcaccaaucag

SEQ ID NO: 1072879 - RNA, 19 nt, Human
gaggaggaagggaugcggg

SEQ ID NO: 1072880 - RNA, 19 nt, Human
gaggcuggugccgcuggga

SEQ ID NO: 1072881 - RNA, 21 nt, Human
gagggcccaggggggugagcg

SEQ ID NO: 1072882 - RNA, 19 nt, Human
gaggugaggcaaggggcag

SEQ ID NO: 1072883 - RNA, 22 nt, Human
gagugcccugggguuccugggg

SEQ ID NO: 1072884 - RNA, 21 nt, Human
gcaaggggcagggaggggaga

SEQ ID NO: 1072885 - RNA, 22 nt, Human
gcccugggguuccugggguccc

SEQ ID NO: 1072886 - RNA, 20 nt, Human
gcuggaguauguguuaucuu

SEQ ID NO: 1072887 - RNA, 21 nt, Human
gcuggugccgcugggaugccu

SEQ ID NO: 1072888 - RNA, 24 nt, Human
gcuuccacucccagggaguugauu

SEQ ID NO: 1072889 - RNA, 19 nt, Human
ggaagcaggagggcccagg

SEQ ID NO: 1072890 - RNA, 26 nt, Human
ggacagggcccacgccguccuccucg

SEQ ID NO: 1072891 - RNA, 18 nt, Human
ggagaacuuuguguguac

SEQ ID NO: 1072892 - RNA, 18 nt, Human
ggagaggucucagacucu

SEQ ID NO: 1072893 - RNA, 19 nt, Human
ggaggaagggaugcgggug

SEQ ID NO: 1072894 - RNA, 21 nt, Human
ggagggaggaaggggaaggag

SEQ ID NO: 1072895 - RNA, 20 nt, Human
ggcaagagcagcuuccggag

SEQ ID NO: 1072896 - RNA, 19 nt, Human
ggcccaggggggugagcga

SEQ ID NO: 1072897 - RNA, 21 nt, Human
ggcucacaauucugcaggcug

SEQ ID NO: 1072898 - RNA, 19 nt, Human
ggcugggggcacagagcuc

SEQ ID NO: 1072899 - RNA, 21 nt, Human
ggcugggggcacagagcucag

SEQ ID NO: 1072900 - RNA, 20 nt, Human
ggcuuccacucccagggagu

SEQ ID NO: 1072901 - RNA, 20 nt, Human
gggagggccaggcuauuugg

SEQ ID NO: 1072902 - RNA, 19 nt, Human
gggaugccucugcaagccu

SEQ ID NO: 1072903 - RNA, 24 nt, Human
ggucaaggauugggcaagagucag

SEQ ID NO: 1072904 - RNA, 24 nt, Human
gucaguaacccuccagugcucccc

SEQ ID NO: 1072905 - RNA, 22 nt, Human
guguguaccagcugcacugguc

SEQ ID NO: 1072906 - RNA, 18 nt, Human
guuuugaaccccucucuc

SEQ ID NO: 1072907 - RNA, 22 nt, Human
uaaacaaccauaucuaugugaa

SEQ ID NO: 1072908 - RNA, 20 nt, Human
uacaggacagggcccacgcc

SEQ ID NO: 1072909 - RNA, 20 nt, Human
uaggucccaaauagccaggg

SEQ ID NO: 1072910 - RNA, 26 nt, Human
uauggcaagagcagcuuccggagaag

SEQ ID NO: 1072911 - RNA, 24 nt, Human
uauuuuggcucacaauucugcagg

SEQ ID NO: 1072912 - RNA, 25 nt, Human
ucagcacccucuuuugggacuuugg

SEQ ID NO: 1072913 - RNA, 26 nt, Human
uccaaauacuucccaccaggcuccac

SEQ ID NO: 1072914 - RNA, 26 nt, Human
uccaaauacuucccaccaggcuccuu

SEQ ID NO: 1072915 - RNA, 23 nt, Human
ucccuaauacugucaggucucug

SEQ ID NO: 1072916 - RNA, 19 nt, Human
ucccuuggaaaccaaugaa

SEQ ID NO: 1072917 - RNA, 22 nt, Human
uccugggcucccccaugaaugc

SEQ ID NO: 1072918 - RNA, 22 nt, Human
ucuccaaggccuggugcaccaa

SEQ ID NO: 1072919 - RNA, 19 nt, Human
ucucuggggagcccaaaga

SEQ ID NO: 1072920 - RNA, 20 nt, Human
ucuggccaacauguccuggc

SEQ ID NO: 1072921 - RNA, 21 nt, Human
ugaaccccucucucaguucaa

SEQ ID NO: 1072922 - RNA, 23 nt, Human
ugaccccuaauuccgacucaccc

SEQ ID NO: 1072923 - RNA, 19 nt, Human
ugagacaggagaacuuugu

SEQ ID NO: 1072924 - RNA, 18 nt, Human
ugagagccaagaggagga

SEQ ID NO: 1072925 - RNA, 24 nt, Human
ugagagccaagaggaggagauagg

SEQ ID NO: 1072926 - RNA, 19 nt, Human
ugagaggggagauaaaaac

SEQ ID NO: 1072927 - RNA, 19 nt, Human
ugagauaggagucaagguc

SEQ ID NO: 1072928 - RNA, 21 nt, Human
ugagauaggagucaaggucaa

SEQ ID NO: 1072929 - RNA, 22 nt, Human
ugagaugaaugaaucuaaugca

SEQ ID NO: 1072930 - RNA, 23 nt, Human
ugaggauuugcucccuuggaaac

SEQ ID NO: 1072931 - RNA, 19 nt, Human
ugcagugggaggcuggugc

SEQ ID NO: 1072932 - RNA, 21 nt, Human
ugccaacaccccugucuucug

SEQ ID NO: 1072933 - RNA, 23 nt, Human
ugccaacaccccugucuucuggu

SEQ ID NO: 1072934 - RNA, 19 nt, Human
ugccugccaacaccccugu

SEQ ID NO: 1072935 - RNA, 18 nt, Human
ugccuggacugugccuuc

SEQ ID NO: 1072936 - RNA, 23 nt, Human
ugcugggagcuggcugggggcag

SEQ ID NO: 1072937 - RNA, 20 nt, Human
uggcaaaugagaugaaugaa

SEQ ID NO: 1072938 - RNA, 21 nt, Human
uggcaagagcagcuuccggag

SEQ ID NO: 1072939 - RNA, 25 nt, Human
uggcaagagcagcuuccgggguccc

SEQ ID NO: 1072940 - RNA, 19 nt, Human
uggcagcaagaaggggaca

SEQ ID NO: 1072941 - RNA, 23 nt, Human
uggccccaagauagccaaucagg

SEQ ID NO: 1072942 - RNA, 18 nt, Human
ugggaagugggccugggg

SEQ ID NO: 1072943 - RNA, 19 nt, Human
ugggaagugggccuggggc

SEQ ID NO: 1072944 - RNA, 19 nt, Human
ugggacuuuggggaugaga

SEQ ID NO: 1072945 - RNA, 20 nt, Human
ugggaggcuggugccgcugg

SEQ ID NO: 1072946 - RNA, 21 nt, Human
ugggaggcuggugccgcuggg

SEQ ID NO: 1072947 - RNA, 22 nt, Human
ugggaugggcccagaccucugg

SEQ ID NO: 1072948 - RNA, 19 nt, Human
ugggcauggagggaggaag

SEQ ID NO: 1072949 - RNA, 31 nt, Human
uggggagcccaaagagcacgggaaagccaag

SEQ ID NO: 1072950 - RNA, 21 nt, Human
uuauuuuggcucacaauucug

SEQ ID NO: 1072951 - RNA, 21 nt, Human
uugggaagugggccuggggcu

SEQ ID NO: 1072952 - RNA, 22 nt, Human
uuuauaugucuuguauccccac

SEQ ID NO: 1072953 - RNA, 22 nt, Human
cucuagcaauccucagacuagc

SEQ ID NO: 1072954 - RNA, 22 nt, Human
cugcucugccaaguccucuuuc

SEQ ID NO: 1072955 - RNA, 22 nt, Human
gagugcauuuccugaggguggc

SEQ ID NO: 1072956 - RNA, 21 nt, Human
gucccuggcacauggaucuga

SEQ ID NO: 1072957 - RNA, 21 nt, Human
ucugccaaguccucuuucuuc

SEQ ID NO: 1072958 - RNA, 18 nt, Human
ugaggguggcccguuggu

SEQ ID NO: 1072959 - RNA, 23 nt, Human
uggcacauggaucugagcuuggc

SEQ ID NO: 1072960 - RNA, 19 nt, Human
ugugcagaugccgagugca

SEQ ID NO: 1072961 - RNA, 19 nt, Human
aagaggaaauagagggacc

SEQ ID NO: 1072962 - RNA, 19 nt, Human
aagccagcuccacucacug

SEQ ID NO: 1072963 - RNA, 30 nt, Human
agaaaagccagcuccacucacugagggguu

SEQ ID NO: 1072964 - RNA, 22 nt, Human
agagucuuuaauucaaacaaaa

SEQ ID NO: 1072965 - RNA, 21 nt, Human
agaugcugccauucuuaggaa

SEQ ID NO: 1072966 - RNA, 19 nt, Human
agauguacacguggugucc

SEQ ID NO: 1072967 - RNA, 21 nt, Human
agcuauguaggacacagcccc

SEQ ID NO: 1072968 - RNA, 22 nt, Human
agcuccacucacugagcucagc

SEQ ID NO: 1072969 - RNA, 18 nt, Human
aucuggacuaggcaguag

SEQ ID NO: 1072970 - RNA, 19 nt, Human
cagagaauccccaauacac

SEQ ID NO: 1072971 - RNA, 19 nt, Human
cagauguacacgugguguc

SEQ ID NO: 1072972 - RNA, 20 nt, Human
cagccccagagagacugugg

SEQ ID NO: 1072973 - RNA, 24 nt, Human
cagcgacagaaaagccagcuccac

SEQ ID NO: 1072974 - RNA, 26 nt, Human
cagcucauggcaccaaaaauugagag

SEQ ID NO: 1072975 - RNA, 24 nt, Human
caguagcacucagcgacagaaaag

SEQ ID NO: 1072976 - RNA, 23 nt, Human
cccugagccacgacaucuggacu

SEQ ID NO: 1072977 - RNA, 25 nt, Human
cgacagaaaagccagcuccacucac

SEQ ID NO: 1072978 - RNA, 21 nt, Human
gccccagagagacuguggaag

SEQ ID NO: 1072979 - RNA, 25 nt, Human
ggaggugggugggugacacaggcug

SEQ ID NO: 1072980 - RNA, 21 nt, Human
gugcagcugguggucuacaga

SEQ ID NO: 1072981 - RNA, 20 nt, Human
gugggugggugacacaggcu

SEQ ID NO: 1072982 - RNA, 19 nt, Human
ucuggacuaggcaguagca

SEQ ID NO: 1072983 - RNA, 19 nt, Human
ugaaggaggugggugggug

SEQ ID NO: 1072984 - RNA, 22 nt, Human
uugacaaaugaugguagcuauu

SEQ ID NO: 1072985 - RNA, 23 nt, Human
aaacaucuccccuauucccagau

SEQ ID NO: 1072986 - RNA, 23 nt, Human
aaagcugacccaauaccuacagu

SEQ ID NO: 1072987 - RNA, 20 nt, Human
aaaggaaagagacugcugcc

SEQ ID NO: 1072988 - RNA, 22 nt, Human
aagcaggcauucucauucacuu

SEQ ID NO: 1072989 - RNA, 21 nt, Human
aagcugacccaauaccuacag

SEQ ID NO: 1072990 - RNA, 19 nt, Human
acccaauaccuacaguacc

SEQ ID NO: 1072991 - RNA, 25 nt, Human
acccugcaacccagcgauuagacug

SEQ ID NO: 1072992 - RNA, 18 nt, Human
accuaccagaaaccucaa

SEQ ID NO: 1072993 - RNA, 20 nt, Human
acggcaugaaagcugacccc

SEQ ID NO: 1072994 - RNA, 24 nt, Human
acucugugcuuacucauauucagg

SEQ ID NO: 1072995 - RNA, 19 nt, Human
acugcauaacuuccaacuc

SEQ ID NO: 1072996 - RNA, 20 nt, Human
acuucaaugaacauuugcac

SEQ ID NO: 1072997 - RNA, 20 nt, Human
acuuguauaacuccaaccuu

SEQ ID NO: 1072998 - RNA, 21 nt, Human
agaaaauggcagaacaguuac

SEQ ID NO: 1072999 - RNA, 23 nt, Human
agaaaauggcagaacaguuacaa

SEQ ID NO: 1073000 - RNA, 22 nt, Human
agacaaaaauaaauaguagauc

SEQ ID NO: 1073001 - RNA, 24 nt, Human
agacaaaaauaaauaguagaucua

SEQ ID NO: 1073002 - RNA, 25 nt, Human
agacaaaaauaaauaguagaucuaa

SEQ ID NO: 1073003 - RNA, 22 nt, Human
agagaauggaaucaagugacac

SEQ ID NO: 1073004 - RNA, 25 nt, Human
agcaaacgaccaggaaggaagcaac

SEQ ID NO: 1073005 - RNA, 18 nt, Human
agcaaagaaaguggcuca

SEQ ID NO: 1073006 - RNA, 18 nt, Human
aggaaaaaaaaggaaagg

SEQ ID NO: 1073007 - RNA, 25 nt, Human
aggaaaaauaauauauuuuaaaugc

SEQ ID NO: 1073008 - RNA, 21 nt, Human
augcugcagacagcaaagaaa

SEQ ID NO: 1073009 - RNA, 18 nt, Human
caacaguucugccuucag

SEQ ID NO: 1073010 - RNA, 24 nt, Human
caggaaugagguauggguguuaug

SEQ ID NO: 1073011 - RNA, 20 nt, Human
caggcauucucauucacuac

SEQ ID NO: 1073012 - RNA, 22 nt, Human
caggcauucucauucacuacuu

SEQ ID NO: 1073013 - RNA, 22 nt, Human
caggucacaggccacccugcaa

SEQ ID NO: 1073014 - RNA, 21 nt, Human
ccagagcaaacgaccaggaag

SEQ ID NO: 1073015 - RNA, 20 nt, Human
cccacuucaaugguccaaau

SEQ ID NO: 1073016 - RNA, 19 nt, Human
cccagauguuuauauuguu

SEQ ID NO: 1073017 - RNA, 23 nt, Human
cccugguucaugugaccaagggg

SEQ ID NO: 1073018 - RNA, 24 nt, Human
cccuucucaaaagauacaauuaaa

SEQ ID NO: 1073019 - RNA, 22 nt, Human
ccugcaacccagcgauuagacu

SEQ ID NO: 1073020 - RNA, 20 nt, Human
ccuuaaugccaugcagcuag

SEQ ID NO: 1073021 - RNA, 20 nt, Human
cgcauauccuaagaaaauaa

SEQ ID NO: 1073022 - RNA, 21 nt, Human
cggcaugaaagcugacccaau

SEQ ID NO: 1073023 - RNA, 23 nt, Human
cuccaacaguucugccuucagcc

SEQ ID NO: 1073024 - RNA, 23 nt, Human
cucuagguaaacucugugcuuac

SEQ ID NO: 1073025 - RNA, 21 nt, Human
cucuaugacuguagacuugcu

SEQ ID NO: 1073026 - RNA, 23 nt, Human
cugacccaauaccuacaguacca

SEQ ID NO: 1073027 - RNA, 21 nt, Human
cuuccaacucuaaaauaucug

SEQ ID NO: 1073028 - RNA, 19 nt, Human
cuucuuuuaaaagucagga

SEQ ID NO: 1073029 - RNA, 19 nt, Human
gaaagagacugcugccucu

SEQ ID NO: 1073030 - RNA, 20 nt, Human
gaccaaggggggucuggggu

SEQ ID NO: 1073031 - RNA, 23 nt, Human
gcaaagaaaguggcucagaaacg

SEQ ID NO: 1073032 - RNA, 21 nt, Human
gccugggauggaagggaugga

SEQ ID NO: 1073033 - RNA, 21 nt, Human
gcucagaaacgauguaaagag

SEQ ID NO: 1073034 - RNA, 19 nt, Human
ggagauggccagcagggaa

SEQ ID NO: 1073035 - RNA, 19 nt, Human
ggcaggucacaggccaccc

SEQ ID NO: 1073036 - RNA, 21 nt, Human
gggauggaagggauggagaga

SEQ ID NO: 1073037 - RNA, 18 nt, Human
gggggugaaggaagaagg

SEQ ID NO: 1073038 - RNA, 19 nt, Human
ggugaaggaagaaggaaga

SEQ ID NO: 1073039 - RNA, 23 nt, Human
guguacacacauacacaaacgua

SEQ ID NO: 1073040 - RNA, 22 nt, Human
uaaaacaacaacaacucuugaa

SEQ ID NO: 1073041 - RNA, 24 nt, Human
uaaaacacuucuguuggcacuucc

SEQ ID NO: 1073042 - RNA, 24 nt, Human
uaacuuccaacucuaaaauaucug

SEQ ID NO: 1073043 - RNA, 18 nt, Human
uaauaggcaccuaccaga

SEQ ID NO: 1073044 - RNA, 23 nt, Human
uaauucauccaaacaucuccccu

SEQ ID NO: 1073045 - RNA, 24 nt, Human
uaauucauccaaacaucuccccua

SEQ ID NO: 1073046 - RNA, 24 nt, Human
uacacacauacacaaacguacugg

SEQ ID NO: 1073047 - RNA, 19 nt, Human
uaccagaaaccucaacauc

SEQ ID NO: 1073048 - RNA, 18 nt, Human
uaccuacaguaccagucc

SEQ ID NO: 1073049 - RNA, 22 nt, Human
uagacuugcugacuuuacucug

SEQ ID NO: 1073050 - RNA, 23 nt, Human
uagcaagcaaagaauaaaaggga

SEQ ID NO: 1073051 - RNA, 26 nt, Human
uauaagagcauuuaccagaaagacag

SEQ ID NO: 1073052 - RNA, 21 nt, Human
uaugacuguagacuugcugac

SEQ ID NO: 1073053 - RNA, 20 nt, Human
ucaacuccacuucuauacgc

SEQ ID NO: 1073054 - RNA, 18 nt, Human
ucaaugaacauuugcaca

SEQ ID NO: 1073055 - RNA, 22 nt, Human
uccaaauacucaccggccuuca

SEQ ID NO: 1073056 - RNA, 21 nt, Human
ugaagccccuggggcacaggu

SEQ ID NO: 1073057 - RNA, 21 nt, Human
ugaccaaggggggucuggggu

SEQ ID NO: 1073058 - RNA, 19 nt, Human
ugaugauucuuuaugcucu

SEQ ID NO: 1073059 - RNA, 20 nt, Human
ugccugggauggaagggaug

SEQ ID NO: 1073060 - RNA, 18 nt, Human
uggauaacagauaacucc

SEQ ID NO: 1073061 - RNA, 20 nt, Human
uggcaauuuggagauauaug

SEQ ID NO: 1073062 - RNA, 21 nt, Human
uggcaauuuggagauauaugu

SEQ ID NO: 1073063 - RNA, 22 nt, Human
uggcaugaacacauuagggaau

SEQ ID NO: 1073064 - RNA, 22 nt, Human
ugggauggaagggauggagaga

SEQ ID NO: 1073065 - RNA, 19 nt, Human
uguacauacauguaacagg

SEQ ID NO: 1073066 - RNA, 24 nt, Human
ugugaccaaggggggucugggguu

SEQ ID NO: 1073067 - RNA, 18 nt, Human
uguggaagaaccacucca

SEQ ID NO: 1073068 - RNA, 21 nt, Human
uucuguuggcacuuccacacu

SEQ ID NO: 1073069 - RNA, 21 nt, Human
uugaguucaggauaccaaguc

SEQ ID NO: 1073070 - RNA, 22 nt, Human
uuuucccaauuuucuaaaaccu

SEQ ID NO: 1073071 - RNA, 26 nt, Human
auagcccagaggucuuuuuuuuuuuu

SEQ ID NO: 1073072 - RNA, 19 nt, Human
ggucuuuuuuuuuuuuuuu

SEQ ID NO: 1073073 - RNA, 21 nt, Human
gucuuuuuuuuuuuuuuuuuu

SEQ ID NO: 1073074 - RNA, 30 nt, Human
uagcccagaggucuuuuuuuuuuuuuuuuu

SEQ ID NO: 1073075 - RNA, 22 nt, Human
aaaacacucuugucuuaucuca

SEQ ID NO: 1073076 - RNA, 21 nt, Human
aaaaccaaccaaccaaaaaca

SEQ ID NO: 1073077 - RNA, 21 nt, Human
aaacaacaacaaaagaaauac

SEQ ID NO: 1073078 - RNA, 19 nt, Human
aaacaaguaaaucacauua

SEQ ID NO: 1073079 - RNA, 21 nt, Human
aaaccccgucucuacaagaaa

SEQ ID NO: 1073080 - RNA, 19 nt, Human
aaagagcuugauacaaaaa

SEQ ID NO: 1073081 - RNA, 18 nt, Human
aaaggaaaaagcgugggu

SEQ ID NO: 1073082 - RNA, 20 nt, Human
aacauggcaaaaccccgucu

SEQ ID NO: 1073083 - RNA, 21 nt, Human
aacauggcaaaaccccgucuc

SEQ ID NO: 1073084 - RNA, 22 nt, Human
aaccaaccaaaaacaacaacaa

SEQ ID NO: 1073085 - RNA, 22 nt, Human
aaguaaaucacauuacuguaga

SEQ ID NO: 1073086 - RNA, 18 nt, Human
aaucauggcagaaggcaa

SEQ ID NO: 1073087 - RNA, 25 nt, Human
acaacaacaaaagaaauaccugaga

SEQ ID NO: 1073088 - RNA, 18 nt, Human
acagaaagaacaccauau

SEQ ID NO: 1073089 - RNA, 21 nt, Human
acaugggaaggagcauccccc

SEQ ID NO: 1073090 - RNA, 22 nt, Human
accccagcacuuugggaagcca

SEQ ID NO: 1073091 - RNA, 24 nt, Human
accccgucucuacaagaaaaacaa

SEQ ID NO: 1073092 - RNA, 25 nt, Human
accugagacuggguaauuuuuguuu

SEQ ID NO: 1073093 - RNA, 22 nt, Human
acgauggcucaugacuguaacc

SEQ ID NO: 1073094 - RNA, 25 nt, Human
acucugucgcccaggcuggagugca

SEQ ID NO: 1073095 - RNA, 20 nt, Human
agaaggcaaagggggagcag

SEQ ID NO: 1073096 - RNA, 24 nt, Human
agagacacacagaaagaacaccau

SEQ ID NO: 1073097 - RNA, 18 nt, Human
agagugaggggaaggggc

SEQ ID NO: 1073098 - RNA, 23 nt, Human
agcaaaagcaggagcaagagaga

SEQ ID NO: 1073099 - RNA, 19 nt, Human
agcagguuaagcaugugug

SEQ ID NO: 1073100 - RNA, 18 nt, Human
agccacaggaauaaaguc

SEQ ID NO: 1073101 - RNA, 24 nt, Human
agccugggcaacauggcaaaaccc

SEQ ID NO: 1073102 - RNA, 22 nt, Human
aggagguggcaagagccacagg

SEQ ID NO: 1073103 - RNA, 18 nt, Human
aggaguucgagacuagcc

SEQ ID NO: 1073104 - RNA, 24 nt, Human
aggaucgcuucaggucaggaguuc

SEQ ID NO: 1073105 - RNA, 18 nt, Human
aggcaggaggaucaccug

SEQ ID NO: 1073106 - RNA, 18 nt, Human
aggcaggaggaucaccug

SEQ ID NO: 1073107 - RNA, 24 nt, Human
aggcugaggcaggaggaucaccug

SEQ ID NO: 1073108 - RNA, 25 nt, Human
aggcuggagugcaguggcgugaucu

SEQ ID NO: 1073109 - RNA, 23 nt, Human
aggcuuaggugggaggaucgcuu

SEQ ID NO: 1073110 - RNA, 22 nt, Human
aggggccacacccuuuuaaacc

SEQ ID NO: 1073111 - RNA, 25 nt, Human
agggugagggugggggugggggcaa

SEQ ID NO: 1073112 - RNA, 23 nt, Human
aggugggaggaucgcuucagguc

SEQ ID NO: 1073113 - RNA, 19 nt, Human
agugcaguggcgugaucuc

SEQ ID NO: 1073114 - RNA, 21 nt, Human
agugcaguggcgugaucucag

SEQ ID NO: 1073115 - RNA, 23 nt, Human
agugcaguggcgugaucucagcu

SEQ ID NO: 1073116 - RNA, 24 nt, Human
agugcaguggcgugaucucagcuc

SEQ ID NO: 1073117 - RNA, 18 nt, Human
aguggcgugaucucagcu

SEQ ID NO: 1073118 - RNA, 22 nt, Human
auauacgggcagcacauauaua

SEQ ID NO: 1073119 - RNA, 24 nt, Human
aucgcuucaggucaggaguucgag

SEQ ID NO: 1073120 - RNA, 23 nt, Human
auggcucaugacuguaaccccag

SEQ ID NO: 1073121 - RNA, 24 nt, Human
auggcucaugacuguaaccccagc

SEQ ID NO: 1073122 - RNA, 20 nt, Human
auugcaccacugcacuccag

SEQ ID NO: 1073123 - RNA, 24 nt, Human
caaaaacaacaacaaaagaaauac

SEQ ID NO: 1073124 - RNA, 27 nt, Human
caaaagaaauaccugagaccggggccc

SEQ ID NO: 1073125 - RNA, 23 nt, Human
caacaacaaaagaaauaccugag

SEQ ID NO: 1073126 - RNA, 21 nt, Human
caacagcaaaagcaggagcaa

SEQ ID NO: 1073127 - RNA, 24 nt, Human
caacauggcaaaaccccgucucua

SEQ ID NO: 1073128 - RNA, 23 nt, Human
caaccaaaaacaacaacaaaaga

SEQ ID NO: 1073129 - RNA, 23 nt, Human
caaccaaccaaaaacaacaacaa

SEQ ID NO: 1073130 - RNA, 21 nt, Human
caagacccagucucuacaaaa

SEQ ID NO: 1073131 - RNA, 26 nt, Human
caccacugcacuccagcccagguguc

SEQ ID NO: 1073132 - RNA, 22 nt, Human
caccuguagucucagcuacuua

SEQ ID NO: 1073133 - RNA, 24 nt, Human
caccuguagucucagcuacuuaag

SEQ ID NO: 1073134 - RNA, 24 nt, Human
cacucugucgcccaggcuggagug

SEQ ID NO: 1073135 - RNA, 22 nt, Human
cacucuugucuuaucucaagaa

SEQ ID NO: 1073136 - RNA, 18 nt, Human
cacugcacuccagcccag

SEQ ID NO: 1073137 - RNA, 19 nt, Human
cacugcacuccagcccagg

SEQ ID NO: 1073138 - RNA, 19 nt, Human
cacugcacuccagcccagg

SEQ ID NO: 1073139 - RNA, 24 nt, Human
cacugcacuccagcccagguguca

SEQ ID NO: 1073140 - RNA, 21 nt, Human
cagaaagaacaccauaugaca

SEQ ID NO: 1073141 - RNA, 22 nt, Human
cagaaagaacaccauaugacaa

SEQ ID NO: 1073142 - RNA, 21 nt, Human
cagaaggcaaagggggagcag

SEQ ID NO: 1073143 - RNA, 18 nt, Human
cagaccaugcuccaaaac

SEQ ID NO: 1073144 - RNA, 23 nt, Human
cagaucucucacuucucaccaaa

SEQ ID NO: 1073145 - RNA, 24 nt, Human
cagcacuuugggaagccaaggcag

SEQ ID NO: 1073146 - RNA, 25 nt, Human
cagcacuuugggaagccaaggcagg

SEQ ID NO: 1073147 - RNA, 24 nt, Human
cagcuacuuaagaggcugaggcag

SEQ ID NO: 1073148 - RNA, 22 nt, Human
caggaauaaagucuuccaucuc

SEQ ID NO: 1073149 - RNA, 24 nt, Human
caugacuguaaccccagcacuuug

SEQ ID NO: 1073150 - RNA, 20 nt, Human
cauuuuagaauaagccaggc

SEQ ID NO: 1073151 - RNA, 25 nt, Human
cauuuuguuuuuugagauggagucu

SEQ ID NO: 1073152 - RNA, 27 nt, Human
cauuuuguuuuuugagauggagucuca

SEQ ID NO: 1073153 - RNA, 18 nt, Human
ccaaaaccaaccaaccaa

SEQ ID NO: 1073154 - RNA, 28 nt, Human
ccaaaaccaaccaaccaaaaacaacaag

SEQ ID NO: 1073155 - RNA, 21 nt, Human
ccaagccauucaugagggauc

SEQ ID NO: 1073156 - RNA, 21 nt, Human
ccaccaggcccuaccuccagc

SEQ ID NO: 1073157 - RNA, 22 nt, Human
ccaccaggcccuaccuccagca

SEQ ID NO: 1073158 - RNA, 24 nt, Human
ccacggaaaugggaugagaacccc

SEQ ID NO: 1073159 - RNA, 19 nt, Human
ccacugcacuccagcccag

SEQ ID NO: 1073160 - RNA, 20 nt, Human
ccacugcacuccagcccagg

SEQ ID NO: 1073161 - RNA, 20 nt, Human
ccacugcacuccagcccagg

SEQ ID NO: 1073162 - RNA, 20 nt, Human
ccacugcacuccagcccagg

SEQ ID NO: 1073163 - RNA, 21 nt, Human
ccacugcacuccagcccaggu

SEQ ID NO: 1073164 - RNA, 21 nt, Human
ccacuggguuaggugcagagg

SEQ ID NO: 1073165 - RNA, 20 nt, Human
ccagcuccccacccuccucc

SEQ ID NO: 1073166 - RNA, 19 nt, Human
ccagucucuacaaaacauu

SEQ ID NO: 1073167 - RNA, 22 nt, Human
cccagagcuuuagaaggcuuag

SEQ ID NO: 1073168 - RNA, 22 nt, Human
cccaggcuggagugcaguggcg

SEQ ID NO: 1073169 - RNA, 21 nt, Human
cccaugaucccaauaccuccc

SEQ ID NO: 1073170 - RNA, 20 nt, Human
ccccagcacuuugggaagcc

SEQ ID NO: 1073171 - RNA, 20 nt, Human
ccccaugaucccaauaccuc

SEQ ID NO: 1073172 - RNA, 23 nt, Human
ccccugaguucccaggccacgga

SEQ ID NO: 1073173 - RNA, 19 nt, Human
ccgggccugguccacgccc

SEQ ID NO: 1073174 - RNA, 22 nt, Human
ccucccaccaggcccuaccucc

SEQ ID NO: 1073175 - RNA, 22 nt, Human
ccuccuccuccuucuuugaccc

SEQ ID NO: 1073176 - RNA, 19 nt, Human
ccuccuccuucuuugaccc

SEQ ID NO: 1073177 - RNA, 19 nt, Human
ccuccuccuucuuugaccc

SEQ ID NO: 1073178 - RNA, 20 nt, Human
ccugaaaggagguuuuauug

SEQ ID NO: 1073179 - RNA, 23 nt, Human
ccugggcaacauggcaaaacccc

SEQ ID NO: 1073180 - RNA, 24 nt, Human
ccugggcaacauggcaaaaccccg

SEQ ID NO: 1073181 - RNA, 22 nt, Human
ccuguagucucagcuacuuaag

SEQ ID NO: 1073182 - RNA, 19 nt, Human
cgacuuucugugcacaugu

SEQ ID NO: 1073183 - RNA, 22 nt, Human
cucaagaccagccugggcaaca

SEQ ID NO: 1073184 - RNA, 24 nt, Human
cucacgccugucaucccagagcuu

SEQ ID NO: 1073185 - RNA, 24 nt, Human
cucacucugucgcccaggcuggag

SEQ ID NO: 1073186 - RNA, 24 nt, Human
cucacuucucaccaaacggauggc

SEQ ID NO: 1073187 - RNA, 21 nt, Human
cucagcucgcugcauccugaa

SEQ ID NO: 1073188 - RNA, 24 nt, Human
cucaugacuguaaccccagcacuu

SEQ ID NO: 1073189 - RNA, 18 nt, Human
cuccaaaaccaaccaacc

SEQ ID NO: 1073190 - RNA, 23 nt, Human
cuccaaaaccaaccaaccaaaaa

SEQ ID NO: 1073191 - RNA, 24 nt, Human
cuccaugccgggccugguccacgc

SEQ ID NO: 1073192 - RNA, 21 nt, Human
cuccuccuccuucuuugaccc

SEQ ID NO: 1073193 - RNA, 20 nt, Human
cucucacuucucaccaaacg

SEQ ID NO: 1073194 - RNA, 22 nt, Human
cucucauaugucaaaaccuuag

SEQ ID NO: 1073195 - RNA, 21 nt, Human
cucuuucccccugaguuccca

SEQ ID NO: 1073196 - RNA, 20 nt, Human
cugcacuccagcccaggugu

SEQ ID NO: 1073197 - RNA, 21 nt, Human
cugcucucuggugcucaaggc

SEQ ID NO: 1073198 - RNA, 24 nt, Human
cuggagugcaguggcgugaucuca

SEQ ID NO: 1073199 - RNA, 23 nt, Human
cugugcacauguguguuccagug

SEQ ID NO: 1073200 - RNA, 23 nt, Human
cuucaggucaggaguucgagacu

SEQ ID NO: 1073201 - RNA, 22 nt, Human
cuugagcccaggaguucucaag

SEQ ID NO: 1073202 - RNA, 20 nt, Human
cuuggaguucugcucucugg

SEQ ID NO: 1073203 - RNA, 20 nt, Human
cuuucccccugaguucccag

SEQ ID NO: 1073204 - RNA, 18 nt, Human
cuuuuaaaccaucagauc

SEQ ID NO: 1073205 - RNA, 18 nt, Human
gaaaucuggccuuucugg

SEQ ID NO: 1073206 - RNA, 20 nt, Human
gaacccccggccuaagucag

SEQ ID NO: 1073207 - RNA, 18 nt, Human
gaaggagcaucccccccu

SEQ ID NO: 1073208 - RNA, 18 nt, Human
gaauaaacaggcaaacaa

SEQ ID NO: 1073209 - RNA, 25 nt, Human
gaccacuugagcccaggaguucuca

SEQ ID NO: 1073210 - RNA, 23 nt, Human
gaccucucauaugucaaaaccuu

SEQ ID NO: 1073211 - RNA, 23 nt, Human
gauacaaaaauaaaaaaaauaaa

SEQ ID NO: 1073212 - RNA, 18 nt, Human
gaucgcuucaggucagga

SEQ ID NO: 1073213 - RNA, 24 nt, Human
gaucgcuucaggucaggaguucga

SEQ ID NO: 1073214 - RNA, 27 nt, Human
gcagcaagacccagucucuacaaaaca

SEQ ID NO: 1073215 - RNA, 25 nt, Human
gcccaagccauucaugagggaucug

SEQ ID NO: 1073216 - RNA, 24 nt, Human
gcccaggaguucucaagaccagcc

SEQ ID NO: 1073217 - RNA, 20 nt, Human
gcccaggcuggagugcagug

SEQ ID NO: 1073218 - RNA, 24 nt, Human
gcccaggcuggagugcaguggcgu

SEQ ID NO: 1073219 - RNA, 20 nt, Human
gcccaggugucagaccaugc

SEQ ID NO: 1073220 - RNA, 21 nt, Human
gcccaggugucagaccaugcu

SEQ ID NO: 1073221 - RNA, 19 nt, Human
gcuggagugcaguggcgug

SEQ ID NO: 1073222 - RNA, 18 nt, Human
ggagcaagagagagagug

SEQ ID NO: 1073223 - RNA, 23 nt, Human
ggaucgcuucaggucaggaguuc

SEQ ID NO: 1073224 - RNA, 21 nt, Human
ggccagacacgauggcucaug

SEQ ID NO: 1073225 - RNA, 21 nt, Human
ggcucugugugggcuccaugc

SEQ ID NO: 1073226 - RNA, 22 nt, Human
ggcuggagugcaguggcgugau

SEQ ID NO: 1073227 - RNA, 23 nt, Human
gggaauaaacaggcaaacaagua

SEQ ID NO: 1073228 - RNA, 24 nt, Human
gggcaugguggugcgcaccuguag

SEQ ID NO: 1073229 - RNA, 23 nt, Human
ggggagcaggcaugucaacagca

SEQ ID NO: 1073230 - RNA, 24 nt, Human
gguggaccacuugagcccaggagu

SEQ ID NO: 1073231 - RNA, 24 nt, Human
gguggugcgcaccuguagucucag

SEQ ID NO: 1073232 - RNA, 22 nt, Human
uaaagagcuugauacaaaaaua

SEQ ID NO: 1073233 - RNA, 24 nt, Human
uaagaggcugaggcaggaggauca

SEQ ID NO: 1073234 - RNA, 23 nt, Human
uaagccaggcauggugggaggau

SEQ ID NO: 1073235 - RNA, 19 nt, Human
uaauugaaauagagucaua

SEQ ID NO: 1073236 - RNA, 26 nt, Human
uaccuccagcauuggggauuacaauu

SEQ ID NO: 1073237 - RNA, 21 nt, Human
uagaauaagccaggcauggug

SEQ ID NO: 1073238 - RNA, 23 nt, Human
uagcagcauuugcuucuggggag

SEQ ID NO: 1073239 - RNA, 20 nt, Human
uagcccgggcaaugcagcaa

SEQ ID NO: 1073240 - RNA, 19 nt, Human
uaugucaaaaccuuagagc

SEQ ID NO: 1073241 - RNA, 24 nt, Human
ucacucugucgcccaggcuggagu

SEQ ID NO: 1073242 - RNA, 23 nt, Human
ucagaccaugcuccaaaaccaac

SEQ ID NO: 1073243 - RNA, 18 nt, Human
ucauaugucaaaaccuua

SEQ ID NO: 1073244 - RNA, 22 nt, Human
ucaugacuguaaccccagcacu

SEQ ID NO: 1073245 - RNA, 23 nt, Human
ucauucauuuacccauucauuca

SEQ ID NO: 1073246 - RNA, 22 nt, Human
ucccagagcuuuagaaggcuua

SEQ ID NO: 1073247 - RNA, 18 nt, Human
ucccugcagacuaagagu

SEQ ID NO: 1073248 - RNA, 18 nt, Human
uccuuguaagaagauggc

SEQ ID NO: 1073249 - RNA, 22 nt, Human
ucgcccaggcuggagugcagug

SEQ ID NO: 1073250 - RNA, 24 nt, Human
ucgcuucaggucaggaguucgaga

SEQ ID NO: 1073251 - RNA, 19 nt, Human
ucucaagaccagccugggc

SEQ ID NO: 1073252 - RNA, 23 nt, Human
ucucacucugucgcccaggcugg

SEQ ID NO: 1073253 - RNA, 24 nt, Human
ucucacucugucgcccaggcugga

SEQ ID NO: 1073254 - RNA, 26 nt, Human
ucucacucugucgcccaggcuggagu

SEQ ID NO: 1073255 - RNA, 27 nt, Human
ucucacucugucgcccaggcuggagug

SEQ ID NO: 1073256 - RNA, 19 nt, Human
ucucucacuucucaccaaa

SEQ ID NO: 1073257 - RNA, 18 nt, Human
ucugcuccaucaaguguc

SEQ ID NO: 1073258 - RNA, 24 nt, Human
ucugucgcccaggcuggagugcag

SEQ ID NO: 1073259 - RNA, 20 nt, Human
ugaaaggaagggcugugugg

SEQ ID NO: 1073260 - RNA, 18 nt, Human
ugacacagagauugggcc

SEQ ID NO: 1073261 - RNA, 22 nt, Human
ugagauggagucucacucuguc

SEQ ID NO: 1073262 - RNA, 25 nt, Human
ugagcccaggaguucucaagaccag

SEQ ID NO: 1073263 - RNA, 20 nt, Human
ugaggcaggaggaucaccug

SEQ ID NO: 1073264 - RNA, 24 nt, Human
ugaggcaggaggaucaccugaaac

SEQ ID NO: 1073265 - RNA, 18 nt, Human
ugauucuggaacuucaag

SEQ ID NO: 1073266 - RNA, 21 nt, Human
ugcaccacugcacuccagccc

SEQ ID NO: 1073267 - RNA, 22 nt, Human
ugcagugaaccaugauugcacc

SEQ ID NO: 1073268 - RNA, 22 nt, Human
ugcaguggcgugaucucagcuc

SEQ ID NO: 1073269 - RNA, 21 nt, Human
ugccgggccugguccacgccc

SEQ ID NO: 1073270 - RNA, 21 nt, Human
ugcucuuucccccugaguucc

SEQ ID NO: 1073271 - RNA, 20 nt, Human
ugcuuguuuguuuguuuugu

SEQ ID NO: 1073272 - RNA, 24 nt, Human
uggaccacuugagcccaggaguuc

SEQ ID NO: 1073273 - RNA, 24 nt, Human
uggagucucacucugucgcccagg

SEQ ID NO: 1073274 - RNA, 19 nt, Human
uggagugcaguggcgugau

SEQ ID NO: 1073275 - RNA, 24 nt, Human
uggagugcaguggcgugaucucag

SEQ ID NO: 1073276 - RNA, 22 nt, Human
uggcaagagccacaggaauagu

SEQ ID NO: 1073277 - RNA, 23 nt, Human
uggcgugaucucagcucgcugca

SEQ ID NO: 1073278 - RNA, 21 nt, Human
uggcucacgccugucauccca

SEQ ID NO: 1073279 - RNA, 21 nt, Human
uggcucaugacuguaacccca

SEQ ID NO: 1073280 - RNA, 24 nt, Human
uggcucaugacuguaaccccagca

SEQ ID NO: 1073281 - RNA, 22 nt, Human
uggcuugagcccaggaguucag

SEQ ID NO: 1073282 - RNA, 21 nt, Human
ugggaaaacacucuugucuua

SEQ ID NO: 1073283 - RNA, 24 nt, Human
ugggaggauggcuugagcccagga

SEQ ID NO: 1073284 - RNA, 21 nt, Human
ugggggcagggaauaaacagg

SEQ ID NO: 1073285 - RNA, 20 nt, Human
ugggucuggccaccagcucc

SEQ ID NO: 1073286 - RNA, 22 nt, Human
uggugcgcaccuguagucucag

SEQ ID NO: 1073287 - RNA, 24 nt, Human
ugguggugcgcaccuguagucuca

SEQ ID NO: 1073288 - RNA, 23 nt, Human
ugugcacauguguguucucaugg

SEQ ID NO: 1073289 - RNA, 24 nt, Human
uguggcucacgccugucaucccag

SEQ ID NO: 1073290 - RNA, 21 nt, Human
uguguggaagcuacaugggaa

SEQ ID NO: 1073291 - RNA, 20 nt, Human
uguuacacgagccuucuguu

SEQ ID NO: 1073292 - RNA, 21 nt, Human
uguuuguuuuguuucauuuug

SEQ ID NO: 1073293 - RNA, 21 nt, Human
uuacaauucaacaugaguuug

SEQ ID NO: 1073294 - RNA, 20 nt, Human
uuagcugggcaugguggugc

SEQ ID NO: 1073295 - RNA, 20 nt, Human
uuagcugggcaugguggugc

SEQ ID NO: 1073296 - RNA, 20 nt, Human
uuaggugcagaggagguggc

SEQ ID NO: 1073297 - RNA, 18 nt, Human
uuaugcaauauuucuccu

SEQ ID NO: 1073298 - RNA, 23 nt, Human
uucaacaugaguuugggugggga

SEQ ID NO: 1073299 - RNA, 20 nt, Human
uucaggucaggaguucgaga

SEQ ID NO: 1073300 - RNA, 22 nt, Human
uucuccuauucacgcucucuac

SEQ ID NO: 1073301 - RNA, 26 nt, Human
uucugcuccaucaagugucuuugggg

SEQ ID NO: 1073302 - RNA, 18 nt, Human
uucugugcacaugugugu

SEQ ID NO: 1073303 - RNA, 22 nt, Human
uugcagugaaccaugauugcac

SEQ ID NO: 1073304 - RNA, 18 nt, Human
uuggggagcagagagcag

SEQ ID NO: 1073305 - RNA, 25 nt, Human
uuguuuguuuguuuuguuucauuuu

SEQ ID NO: 1073306 - RNA, 21 nt, Human
uuuaauugaaaaauucugggg

SEQ ID NO: 1073307 - RNA, 23 nt, Human
uuucuaaccucuggaaaaccagg

SEQ ID NO: 1073308 - RNA, 20 nt, Human
aaaaagaagauacagacaga

SEQ ID NO: 1073309 - RNA, 24 nt, Human
aaaaagaagauacagacagauaua

SEQ ID NO: 1073310 - RNA, 25 nt, Human
aaaaagaagauacagacagauauaa

SEQ ID NO: 1073311 - RNA, 21 nt, Human
aaaaugcugggauuacacaag

SEQ ID NO: 1073312 - RNA, 21 nt, Human
aaaaugcugggauuacacaug

SEQ ID NO: 1073313 - RNA, 22 nt, Human
aaaaugcugggauuacacaugu

SEQ ID NO: 1073314 - RNA, 24 nt, Human
aaaaugcugggauuacacauguga

SEQ ID NO: 1073315 - RNA, 21 nt, Human
aaagaagauaaaacgcuaaaa

SEQ ID NO: 1073316 - RNA, 20 nt, Human
aaauacuaugccccaacuaa

SEQ ID NO: 1073317 - RNA, 26 nt, Human
aaaugcugggauuacacaugugagcc

SEQ ID NO: 1073318 - RNA, 18 nt, Human
aacacggugaaacccggu

SEQ ID NO: 1073319 - RNA, 18 nt, Human
aacacuuaccauuguguu

SEQ ID NO: 1073320 - RNA, 23 nt, Human
aacugcaauaaauugaaacacag

SEQ ID NO: 1073321 - RNA, 23 nt, Human
aagcacaagcuaacaaagccaaa

SEQ ID NO: 1073322 - RNA, 18 nt, Human
aagcuaacaaagccaaac

SEQ ID NO: 1073323 - RNA, 20 nt, Human
aaguagcugggacuacaggc

SEQ ID NO: 1073324 - RNA, 22 nt, Human
aaguagcugggacuacaggcau

SEQ ID NO: 1073325 - RNA, 24 nt, Human
aaguagcugggacuacaggcauac

SEQ ID NO: 1073326 - RNA, 25 nt, Human
aauaacagacaacaacaaaaaaaga

SEQ ID NO: 1073327 - RNA, 24 nt, Human
aaucacuugaacucaggaggugga

SEQ ID NO: 1073328 - RNA, 21 nt, Human
acaaugaugacaucaccuaaa

SEQ ID NO: 1073329 - RNA, 21 nt, Human
acaguggcgugaucuuggcuc

SEQ ID NO: 1073330 - RNA, 19 nt, Human
acaugcuguagccuacaag

SEQ ID NO: 1073331 - RNA, 24 nt, Human
acccgguuucuacuaaaaauacaa

SEQ ID NO: 1073332 - RNA, 24 nt, Human
accguguuggccaggcuagucucg

SEQ ID NO: 1073333 - RNA, 18 nt, Human
acgguguuucaccguguu

SEQ ID NO: 1073334 - RNA, 24 nt, Human
acgguguuucaccguguuggccag

SEQ ID NO: 1073335 - RNA, 18 nt, Human
acuaugccccaacuaaag

SEQ ID NO: 1073336 - RNA, 24 nt, Human
acucaggagguggagguugcagug

SEQ ID NO: 1073337 - RNA, 18 nt, Human
acucugucacccaggcug

SEQ ID NO: 1073338 - RNA, 25 nt, Human
acucugucacccaggcuggaguaca

SEQ ID NO: 1073339 - RNA, 18 nt, Human
agacaggaggaucaccug

SEQ ID NO: 1073340 - RNA, 18 nt, Human
agacaggaggaucaccug

SEQ ID NO: 1073341 - RNA, 19 nt, Human
agauagaaaauuuaaacau

SEQ ID NO: 1073342 - RNA, 19 nt, Human
agcacuuugggaggccgag

SEQ ID NO: 1073343 - RNA, 22 nt, Human
agcagaaagaggauaaaacuaa

SEQ ID NO: 1073344 - RNA, 24 nt, Human
agcaguucuccugccucagccucc

SEQ ID NO: 1073345 - RNA, 23 nt, Human
agccagguaugguggugggcgcc

SEQ ID NO: 1073346 - RNA, 24 nt, Human
agccuggcuaacacggugaaaccc

SEQ ID NO: 1073347 - RNA, 19 nt, Human
agcuaacaaagccaaacug

SEQ ID NO: 1073348 - RNA, 20 nt, Human
aggaguuugagaccagccug

SEQ ID NO: 1073349 - RNA, 24 nt, Human
aggaucaccugaguucaggaguuu

SEQ ID NO: 1073350 - RNA, 24 nt, Human
agguaugguggugggcgccuguaa

SEQ ID NO: 1073351 - RNA, 24 nt, Human
agguggagguugcagugagcugag

SEQ ID NO: 1073352 - RNA, 20 nt, Human
aguacaguggcgugaucuug

SEQ ID NO: 1073353 - RNA, 24 nt, Human
aguacaguggcgugaucuuggcuc

SEQ ID NO: 1073354 - RNA, 19 nt, Human
agucucgaacuccugaccu

SEQ ID NO: 1073355 - RNA, 21 nt, Human
agugaagaaggauaaagaaaa

SEQ ID NO: 1073356 - RNA, 24 nt, Human
aguggcucacuccuguaaucccag

SEQ ID NO: 1073357 - RNA, 18 nt, Human
auugcacuccagcuuggg

SEQ ID NO: 1073358 - RNA, 25 nt, Human
auugcacuccagcuugggcaacaag

SEQ ID NO: 1073359 - RNA, 24 nt, Human
auuucuguauuuuuaguagagacg

SEQ ID NO: 1073360 - RNA, 18 nt, Human
caaaaagcaaggagggua

SEQ ID NO: 1073361 - RNA, 20 nt, Human
caaaaggauaacaacugcaa

SEQ ID NO: 1073362 - RNA, 24 nt, Human
caaaaugcugggauuacacaugug

SEQ ID NO: 1073363 - RNA, 22 nt, Human
caagcaguucuccugccucagc

SEQ ID NO: 1073364 - RNA, 20 nt, Human
caagcuacauaaagcccaga

SEQ ID NO: 1073365 - RNA, 22 nt, Human
caauaacagacaacaacaaaaa

SEQ ID NO: 1073366 - RNA, 21 nt, Human
cacaccugucauuucaauaac

SEQ ID NO: 1073367 - RNA, 21 nt, Human
cacagcagaaagaggauaaaa

SEQ ID NO: 1073368 - RNA, 21 nt, Human
caccguguuggccaggcuagu

SEQ ID NO: 1073369 - RNA, 24 nt, Human
caccguguuggccaggcuagucuc

SEQ ID NO: 1073370 - RNA, 18 nt, Human
caccuaaagaggcauuuc

SEQ ID NO: 1073371 - RNA, 24 nt, Human
caccuugaauagguuuccacugga

SEQ ID NO: 1073372 - RNA, 24 nt, Human
cacuccagcuugggcaacaagagc

SEQ ID NO: 1073373 - RNA, 24 nt, Human
cacuccuguaaucccagcacuuug

SEQ ID NO: 1073374 - RNA, 22 nt, Human
cacucugucacccaggcuggag

SEQ ID NO: 1073375 - RNA, 23 nt, Human
cacucugucacccaggcuggagu

SEQ ID NO: 1073376 - RNA, 18 nt, Human
cacugcgaccuccuccuc

SEQ ID NO: 1073377 - RNA, 27 nt, Human
cagacaacaacaaaaaaagaguuagca

SEQ ID NO: 1073378 - RNA, 18 nt, Human
cagcacuuugggaggccg

SEQ ID NO: 1073379 - RNA, 24 nt, Human
cagcacuuugggaggccgagacag

SEQ ID NO: 1073380 - RNA, 29 nt, Human
caggagguggagguugcagugacaacggu

SEQ ID NO: 1073381 - RNA, 20 nt, Human
caguucuccugccucagccu

SEQ ID NO: 1073382 - RNA, 21 nt, Human
cauaaaauguucaagauaaga

SEQ ID NO: 1073383 - RNA, 23 nt, Human
cauaaagcccagauguauauagu

SEQ ID NO: 1073384 - RNA, 24 nt, Human
caucuaaaaccuuaccuuaagcac

SEQ ID NO: 1073385 - RNA, 19 nt, Human
cauugcacuccagcuuggg

SEQ ID NO: 1073386 - RNA, 21 nt, Human
cauugcacuccagcuugggca

SEQ ID NO: 1073387 - RNA, 22 nt, Human
cauugcacuccagcuugggcaa

SEQ ID NO: 1073388 - RNA, 24 nt, Human
cauugcacuccagcuugggcaaca

SEQ ID NO: 1073389 - RNA, 19 nt, Human
ccaaaaugcugggauuaca

SEQ ID NO: 1073390 - RNA, 24 nt, Human
ccaaaaugcugggauuacacaugu

SEQ ID NO: 1073391 - RNA, 24 nt, Human
ccacucugucacccaggcuggagu

SEQ ID NO: 1073392 - RNA, 20 nt, Human
ccauugcacuccagcuuggg

SEQ ID NO: 1073393 - RNA, 21 nt, Human
ccauugcacuccagcuugggc

SEQ ID NO: 1073394 - RNA, 23 nt, Human
ccauugcacuccagcuugggcaa

SEQ ID NO: 1073395 - RNA, 24 nt, Human
ccauugcacuccagcuugggcaac

SEQ ID NO: 1073396 - RNA, 21 nt, Human
cccaggcuggaguacaguggc

SEQ ID NO: 1073397 - RNA, 23 nt, Human
ccuaaguagcugggacuacaggc

SEQ ID NO: 1073398 - RNA, 24 nt, Human
ccuaaguagcugggacuacaggca

SEQ ID NO: 1073399 - RNA, 23 nt, Human
ccuacaagcuacauaaagcccag

SEQ ID NO: 1073400 - RNA, 24 nt, Human
ccuccuccuccuggguucaagcag

SEQ ID NO: 1073401 - RNA, 21 nt, Human
ccuccuccuggguucaagcag

SEQ ID NO: 1073402 - RNA, 20 nt, Human
ccugaccucaggugauccac

SEQ ID NO: 1073403 - RNA, 22 nt, Human
ccuggcuaacacggugaaaccc

SEQ ID NO: 1073404 - RNA, 23 nt, Human
ccuggcuaacacggugaaacccg

SEQ ID NO: 1073405 - RNA, 23 nt, Human
ccuggguucaagcaguucuccug

SEQ ID NO: 1073406 - RNA, 22 nt, Human
ccuguaaucccagcacuuuggg

SEQ ID NO: 1073407 - RNA, 19 nt, Human
ccuguaaucccagcuacuc

SEQ ID NO: 1073408 - RNA, 22 nt, Human
ccuguaaucccagcuacucugg

SEQ ID NO: 1073409 - RNA, 23 nt, Human
ccuguaaucccagcuacucugga

SEQ ID NO: 1073410 - RNA, 19 nt, Human
ccuuuuuuuuucaaacacc

SEQ ID NO: 1073411 - RNA, 20 nt, Human
cgagacaggaggaucaccug

SEQ ID NO: 1073412 - RNA, 18 nt, Human
cgauaauauucaaaaaua

SEQ ID NO: 1073413 - RNA, 21 nt, Human
cggaaacacaaacacuuacca

SEQ ID NO: 1073414 - RNA, 18 nt, Human
cggggaaaaaaagguaac

SEQ ID NO: 1073415 - RNA, 24 nt, Human
cgguguuucaccguguuggccagg

SEQ ID NO: 1073416 - RNA, 24 nt, Human
cucacuccuguaaucccagcacuu

SEQ ID NO: 1073417 - RNA, 19 nt, Human
cucacugcgaccuccuccu

SEQ ID NO: 1073418 - RNA, 24 nt, Human
cucacugcgaccuccuccuccugg

SEQ ID NO: 1073419 - RNA, 24 nt, Human
cucagccuccuaaguagcugggac

SEQ ID NO: 1073420 - RNA, 21 nt, Human
cuccuggguucaagcaguucu

SEQ ID NO: 1073421 - RNA, 23 nt, Human
cuccuguaaucccagcacuuugg

SEQ ID NO: 1073422 - RNA, 22 nt, Human
cugaguucaggaguuugagacc

SEQ ID NO: 1073423 - RNA, 24 nt, Human
cugccucacccucccaaaaugcug

SEQ ID NO: 1073424 - RNA, 23 nt, Human
cugccucagccuccuaaguagcu

SEQ ID NO: 1073425 - RNA, 18 nt, Human
cuggcuaacacggugaaa

SEQ ID NO: 1073426 - RNA, 24 nt, Human
cuguuuacaaguuaaauaacaaaa

SEQ ID NO: 1073427 - RNA, 20 nt, Human
cuuaagcacaagcuaacaaa

SEQ ID NO: 1073428 - RNA, 25 nt, Human
cuuagcaaaaugggcuaauuccaaa

SEQ ID NO: 1073429 - RNA, 21 nt, Human
cuugaacucaggagguggagg

SEQ ID NO: 1073430 - RNA, 21 nt, Human
gaaaaagaagauacagacaga

SEQ ID NO: 1073431 - RNA, 20 nt, Human
gaacaucuaaaaccuuaccu

SEQ ID NO: 1073432 - RNA, 21 nt, Human
gaacucacaggucaucuuugg

SEQ ID NO: 1073433 - RNA, 18 nt, Human
gaagaaggauaaagaaaa

SEQ ID NO: 1073434 - RNA, 23 nt, Human
gagaaucacuugaacucaggagg

SEQ ID NO: 1073435 - RNA, 23 nt, Human
gagacaggaggaucaccugaguu

SEQ ID NO: 1073436 - RNA, 23 nt, Human
gagaucgugccauugcacuccag

SEQ ID NO: 1073437 - RNA, 21 nt, Human
gagauggagucccacucuguc

SEQ ID NO: 1073438 - RNA, 21 nt, Human
gagguggagguugcagugagc

SEQ ID NO: 1073439 - RNA, 23 nt, Human
gagguugcagugagcugagaucg

SEQ ID NO: 1073440 - RNA, 24 nt, Human
gaucaccugaguucaggaguuuga

SEQ ID NO: 1073441 - RNA, 24 nt, Human
gauggcaguguuguuauucuaaga

SEQ ID NO: 1073442 - RNA, 18 nt, Human
gauuacacaugugagcca

SEQ ID NO: 1073443 - RNA, 22 nt, Human
gcaacaguuaacuaucacccca

SEQ ID NO: 1073444 - RNA, 22 nt, Human
gccauugcacuccagcuugggc

SEQ ID NO: 1073445 - RNA, 24 nt, Human
gccauugcacuccagcuugggcaa

SEQ ID NO: 1073446 - RNA, 20 nt, Human
gccucagccuccuaaguagc

SEQ ID NO: 1073447 - RNA, 20 nt, Human
gccuuguuuuguagauuuga

SEQ ID NO: 1073448 - RNA, 18 nt, Human
gcgcaggagaaucacuug

SEQ ID NO: 1073449 - RNA, 24 nt, Human
gcuaacacggugaaacccgguuuc

SEQ ID NO: 1073450 - RNA, 23 nt, Human
gcuagucucgaacuccugaccuc

SEQ ID NO: 1073451 - RNA, 22 nt, Human
gcucacugcgaccuccuccucc

SEQ ID NO: 1073452 - RNA, 19 nt, Human
gcuggaguacaguggcgug

SEQ ID NO: 1073453 - RNA, 20 nt, Human
ggaaacacaaacacuuacca

SEQ ID NO: 1073454 - RNA, 19 nt, Human
ggaacauguugucauacca

SEQ ID NO: 1073455 - RNA, 24 nt, Human
ggacgcaguggcucacuccuguaa

SEQ ID NO: 1073456 - RNA, 22 nt, Human
ggagguugcagugagcugagau

SEQ ID NO: 1073457 - RNA, 24 nt, Human
ggagguugcagugagcugagaucg

SEQ ID NO: 1073458 - RNA, 22 nt, Human
ggaucaccugaguucaggaguu

SEQ ID NO: 1073459 - RNA, 19 nt, Human
ggcauacaccuccacaccc

SEQ ID NO: 1073460 - RNA, 19 nt, Human
ggccuaaaagguaugagua

SEQ ID NO: 1073461 - RNA, 25 nt, Human
ggcgccuguaaucccagcuacucug

SEQ ID NO: 1073462 - RNA, 22 nt, Human
ggcuggaguacaguggcgugau

SEQ ID NO: 1073463 - RNA, 19 nt, Human
gguggagguugcagugagc

SEQ ID NO: 1073464 - RNA, 24 nt, Human
gguggugggcgccuguaaucccag

SEQ ID NO: 1073465 - RNA, 23 nt, Human
gguguuucaccguguuggccagg

SEQ ID NO: 1073466 - RNA, 20 nt, Human
guggagguugcagugagcug

SEQ ID NO: 1073467 - RNA, 22 nt, Human
guucacacaaugaugacaucac

SEQ ID NO: 1073468 - RNA, 20 nt, Human
guucuccugccucagccucc

SEQ ID NO: 1073469 - RNA, 24 nt, Human
guugcagugagcugagaucgugcc

SEQ ID NO: 1073470 - RNA, 24 nt, Human
guuuuaaaaaaagaaaaaaaaaaa

SEQ ID NO: 1073471 - RNA, 20 nt, Human
uaaaaaccuuguaguccuga

SEQ ID NO: 1073472 - RNA, 23 nt, Human
uaaagaggcauuucucagaggca

SEQ ID NO: 1073473 - RNA, 21 nt, Human
uaaaggaacuauaauuccuua

SEQ ID NO: 1073474 - RNA, 20 nt, Human
uaaauacuaugccccaacua

SEQ ID NO: 1073475 - RNA, 28 nt, Human
uaaauugaaacacaguuuguuuuaaucc

SEQ ID NO: 1073476 - RNA, 19 nt, Human
uaacacggugaaacccggu

SEQ ID NO: 1073477 - RNA, 24 nt, Human
uaacacggugaaacccgguuucua

SEQ ID NO: 1073478 - RNA, 23 nt, Human
uaacagacaacaacaaaaaaaga

SEQ ID NO: 1073479 - RNA, 19 nt, Human
uaacguagauacaucuccc

SEQ ID NO: 1073480 - RNA, 22 nt, Human
uaagcacaagcuaacaaagcca

SEQ ID NO: 1073481 - RNA, 23 nt, Human
uaaguaaaaaccuuguaguccug

SEQ ID NO: 1073482 - RNA, 24 nt, Human
uaauuucuguauuuuuaguagaga

SEQ ID NO: 1073483 - RNA, 22 nt, Human
uacaggcauacaccuccacacc

SEQ ID NO: 1073484 - RNA, 19 nt, Human
uacaguggcgugaucuugg

SEQ ID NO: 1073485 - RNA, 22 nt, Human
uaccaaaaagcaaggaggguau

SEQ ID NO: 1073486 - RNA, 22 nt, Human
uaccuuaagcacaagcuaacaa

SEQ ID NO: 1073487 - RNA, 18 nt, Human
uagaaaauuuaaacaucg

SEQ ID NO: 1073488 - RNA, 19 nt, Human
uagaaaauuuaaacaucga

SEQ ID NO: 1073489 - RNA, 23 nt, Human
uagcaaaaugggcuaauuccaaa

SEQ ID NO: 1073490 - RNA, 21 nt, Human
uaguagagacgguguuucacc

SEQ ID NO: 1073491 - RNA, 24 nt, Human
uaguagagacgguguuucaccgug

SEQ ID NO: 1073492 - RNA, 26 nt, Human
uaguagagacgguguuucaccguguu

SEQ ID NO: 1073493 - RNA, 18 nt, Human
uauaguaggcuauacugu

SEQ ID NO: 1073494 - RNA, 21 nt, Human
ucaaaaauaggaacucacagg

SEQ ID NO: 1073495 - RNA, 24 nt, Human
ucaaaacaaaaggauaacaacugc

SEQ ID NO: 1073496 - RNA, 24 nt, Human
ucaccguguuggccaggcuagucu

SEQ ID NO: 1073497 - RNA, 23 nt, Human
ucaccugaguucaggaguuugag

SEQ ID NO: 1073498 - RNA, 22 nt, Human
ucacugcgaccuccuccuccug

SEQ ID NO: 1073499 - RNA, 24 nt, Human
ucacugcgaccuccuccuccuggg

SEQ ID NO: 1073500 - RNA, 20 nt, Human
ucaggagguggagguugcag

SEQ ID NO: 1073501 - RNA, 18 nt, Human
ucagugaagaaggauaaa

SEQ ID NO: 1073502 - RNA, 25 nt, Human
ucauaccaaaaagcaaggaggguau

SEQ ID NO: 1073503 - RNA, 19 nt, Human
uccagcuugggcaacaaga

SEQ ID NO: 1073504 - RNA, 21 nt, Human
ucccaaaaugcugggauuaca

SEQ ID NO: 1073505 - RNA, 24 nt, Human
ucccacucugucacccaggcugga

SEQ ID NO: 1073506 - RNA, 25 nt, Human
ucccacucugucacccaggcuggag

SEQ ID NO: 1073507 - RNA, 26 nt, Human
ucccacucugucacccaggcuggagu

SEQ ID NO: 1073508 - RNA, 24 nt, Human
uccuaaguagcugggacuacaggc

SEQ ID NO: 1073509 - RNA, 19 nt, Human
uccuggguucaagcaguuc

SEQ ID NO: 1073510 - RNA, 19 nt, Human
uccuggguucaagcaguuc

SEQ ID NO: 1073511 - RNA, 21 nt, Human
uccuggguucaagcaguucuc

SEQ ID NO: 1073512 - RNA, 24 nt, Human
uccuggguucaagcaguucuccug

SEQ ID NO: 1073513 - RNA, 18 nt, Human
ucgagaaggauaacaggc

SEQ ID NO: 1073514 - RNA, 22 nt, Human
ucuccugccucacccucccaaa

SEQ ID NO: 1073515 - RNA, 24 nt, Human
ucuccugccucagccuccuaagua

SEQ ID NO: 1073516 - RNA, 23 nt, Human
ucucgaacuccugaccucaggug

SEQ ID NO: 1073517 - RNA, 18 nt, Human
ucugucacccaggcugga

SEQ ID NO: 1073518 - RNA, 24 nt, Human
ucugucacccaggcuggaguacag

SEQ ID NO: 1073519 - RNA, 18 nt, Human
ugaaaaggccuaaaaggu

SEQ ID NO: 1073520 - RNA, 19 nt, Human
ugaaaaggccuaaaaggua

SEQ ID NO: 1073521 - RNA, 18 nt, Human
ugaaugaacaucuaucag

SEQ ID NO: 1073522 - RNA, 20 nt, Human
ugaccucaggugauccacuu

SEQ ID NO: 1073523 - RNA, 23 nt, Human
ugagaccagccuggcuaacacgg

SEQ ID NO: 1073524 - RNA, 19 nt, Human
ugcacuccagcuugggcaa

SEQ ID NO: 1073525 - RNA, 24 nt, Human
ugccucacccucccaaaaugcugg

SEQ ID NO: 1073526 - RNA, 24 nt, Human
ugccucagccuccuaaguagcugg

SEQ ID NO: 1073527 - RNA, 24 nt, Human
ugcugggauuacacaugugagcca

SEQ ID NO: 1073528 - RNA, 19 nt, Human
uggaguacaguggcgugau

SEQ ID NO: 1073529 - RNA, 23 nt, Human
uggaguacaguggcgugaucuug

SEQ ID NO: 1073530 - RNA, 24 nt, Human
uggaguacaguggcgugaucuugg

SEQ ID NO: 1073531 - RNA, 24 nt, Human
uggccaggcuagucucgaacuccu

SEQ ID NO: 1073532 - RNA, 21 nt, Human
uggcucacuccuguaauccca

SEQ ID NO: 1073533 - RNA, 22 nt, Human
uggcucacuccuguaaucccag

SEQ ID NO: 1073534 - RNA, 24 nt, Human
uggcucacuccuguaaucccagca

SEQ ID NO: 1073535 - RNA, 20 nt, Human
ugggaaaaagaagauacaga

SEQ ID NO: 1073536 - RNA, 18 nt, Human
ugggacuacaggcauaca

SEQ ID NO: 1073537 - RNA, 24 nt, Human
ugggacuacaggcauacaccucca

SEQ ID NO: 1073538 - RNA, 24 nt, Human
ugggaggccgagacaggaggauca

SEQ ID NO: 1073539 - RNA, 22 nt, Human
ugggauuacacaugugagccac

SEQ ID NO: 1073540 - RNA, 23 nt, Human
ugggauuacacaugugagccacc

SEQ ID NO: 1073541 - RNA, 24 nt, Human
ugggauuacacaugugagccaccg

SEQ ID NO: 1073542 - RNA, 20 nt, Human
ugggcucgaaagauucuccu

SEQ ID NO: 1073543 - RNA, 24 nt, Human
ugguggugggcgccuguaauccca

SEQ ID NO: 1073544 - RNA, 20 nt, Human
ugucauaccaaaaagcaagg

SEQ ID NO: 1073545 - RNA, 22 nt, Human
uuagccagguaugguggugggc

SEQ ID NO: 1073546 - RNA, 22 nt, Human
uuaguagagacgguguuucacc

SEQ ID NO: 1073547 - RNA, 24 nt, Human
uuaguagagacgguguuucaccgu

SEQ ID NO: 1073548 - RNA, 21 nt, Human
uucaagcaguucuccugccuc

SEQ ID NO: 1073549 - RNA, 19 nt, Human
uucaauaacagacaacaac

SEQ ID NO: 1073550 - RNA, 28 nt, Human
uuccuuagcaaaaugggcuaauuccaag

SEQ ID NO: 1073551 - RNA, 24 nt, Human
uugaacucaggagguggagguugc

SEQ ID NO: 1073552 - RNA, 18 nt, Human
uugcagugagcugagauc

SEQ ID NO: 1073553 - RNA, 22 nt, Human
uugcagugagcugagaucgugc

SEQ ID NO: 1073554 - RNA, 25 nt, Human
uugggaggccgagacaggaggauca

SEQ ID NO: 1073555 - RNA, 25 nt, Human
uuucaaacaccuguccuccucuuau

SEQ ID NO: 1073556 - RNA, 24 nt, Human
uuucaccguguuggccaggcuagu

SEQ ID NO: 1073557 - RNA, 22 nt, Human
uuucuacuaaaaauacaaaaaa

SEQ ID NO: 1073558 - RNA, 20 nt, Human
uuucuguauuuuuaguagag

SEQ ID NO: 1073559 - RNA, 24 nt, Human
uuuuuaguagagacgguguuucac

SEQ ID NO: 1073560 - RNA, 24 nt, Human
aaaccuacugcugggugguuuuga

SEQ ID NO: 1073561 - RNA, 21 nt, Human
uguuaacaaaaccuacugcug

SEQ ID NO: 1073562 - RNA, 19 nt, Human
aaauaagauguacagcaga

SEQ ID NO: 1073563 - RNA, 24 nt, Human
aaguaucaugaacagcaauuuuuu

SEQ ID NO: 1073564 - RNA, 20 nt, Human
aauggaaaauauccucugaa

SEQ ID NO: 1073565 - RNA, 18 nt, Human
aguuaaauccuucucugc

SEQ ID NO: 1073566 - RNA, 18 nt, Human
caaacaaguaucaugaac

SEQ ID NO: 1073567 - RNA, 20 nt, Human
cacaacaauuucuuuaucag

SEQ ID NO: 1073568 - RNA, 20 nt, Human
cacagcagcauccacagaaa

SEQ ID NO: 1073569 - RNA, 19 nt, Human
cagugcagacacagacaua

SEQ ID NO: 1073570 - RNA, 19 nt, Human
cauuucugccauaggaaca

SEQ ID NO: 1073571 - RNA, 18 nt, Human
ccucugaauauccacaag

SEQ ID NO: 1073572 - RNA, 21 nt, Human
ccucugaauauccacaagucu

SEQ ID NO: 1073573 - RNA, 24 nt, Human
cuuccugggcuuccuaaagauucc

SEQ ID NO: 1073574 - RNA, 21 nt, Human
gcagugcagacacagacauac

SEQ ID NO: 1073575 - RNA, 21 nt, Human
uaccacaaugucaaugucuuc

SEQ ID NO: 1073576 - RNA, 20 nt, Human
uaucagguugaacauccugg

SEQ ID NO: 1073577 - RNA, 20 nt, Human
uccaaaggaaagaucaaacc

SEQ ID NO: 1073578 - RNA, 26 nt, Human
uccacagaaauaacaucuuuucuucc

SEQ ID NO: 1073579 - RNA, 20 nt, Human
ugccaaauggaaaauauccu

SEQ ID NO: 1073580 - RNA, 24 nt, Human
ugccaaauggaaaauauccucuga

SEQ ID NO: 1073581 - RNA, 23 nt, Human
uuaucguguccacaacaauuucu

SEQ ID NO: 1073582 - RNA, 21 nt, Human
uucaaacaaguaucaugaaca

SEQ ID NO: 1073583 - RNA, 22 nt, Human
uucacagcagcauccacagaaa

SEQ ID NO: 1073584 - RNA, 23 nt, Human
uucacagcagcauccacagaaau

SEQ ID NO: 1073585 - RNA, 24 nt, Human
uucacagcagcauccacagaaaua

SEQ ID NO: 1073586 - RNA, 23 nt, Human
uuccugggcuuccuaaagauucc

SEQ ID NO: 1073587 - RNA, 21 nt, Human
uugaacauccuggggagcagu

SEQ ID NO: 1073588 - RNA, 21 nt, Human
uugacucuggaucauccugcc

SEQ ID NO: 1073589 - RNA, 19 nt, Human
uugacuguccuucuuuaua

SEQ ID NO: 1073590 - RNA, 23 nt, Human
uuuauagcagugaauuacuucau

SEQ ID NO: 1073591 - RNA, 22 nt, Human
uuuaucugccacagaagauaaa

SEQ ID NO: 1073592 - RNA, 24 nt, Human
caggcgccggagcggagaggccag

SEQ ID NO: 1073593 - RNA, 19 nt, Human
cccucgggccucccaggug

SEQ ID NO: 1073594 - RNA, 20 nt, Human
ccucgcgucgccccuucccc

SEQ ID NO: 1073595 - RNA, 22 nt, Human
ccugcgcccccucgcgucgccc

SEQ ID NO: 1073596 - RNA, 21 nt, Human
cggggcugcaggcgccggagc

SEQ ID NO: 1073597 - RNA, 18 nt, Human
gccggagcggagaggcca

SEQ ID NO: 1073598 - RNA, 19 nt, Human
gcgccggagcggagaggcc

SEQ ID NO: 1073599 - RNA, 21 nt, Human
ggccagaaguuggggccgcgg

SEQ ID NO: 1073600 - RNA, 23 nt, Human
ucccgggcgcccccucgggccuc

SEQ ID NO: 1073601 - RNA, 24 nt, Human
ucccugcgcccccucgcgucgccc

SEQ ID NO: 1073602 - RNA, 20 nt, Human
aaaaccugagauugugaaga

SEQ ID NO: 1073603 - RNA, 19 nt, Human
aaagugcugggauuacagg

SEQ ID NO: 1073604 - RNA, 24 nt, Human
aaagugcugggauuacaggugcga

SEQ ID NO: 1073605 - RNA, 27 nt, Human
aaccucuuuaagacucugucuuuguca

SEQ ID NO: 1073606 - RNA, 20 nt, Human
aagaaaaggcagacucauga

SEQ ID NO: 1073607 - RNA, 24 nt, Human
aagaaaaggcagacucaugacuga

SEQ ID NO: 1073608 - RNA, 21 nt, Human
aagaaugauccagccccaaau

SEQ ID NO: 1073609 - RNA, 24 nt, Human
aagcauccuacaaugccccgacaa

SEQ ID NO: 1073610 - RNA, 25 nt, Human
aagcgauccucccaccucagccucc

SEQ ID NO: 1073611 - RNA, 21 nt, Human
aaggucuugcuauuuuuccca

SEQ ID NO: 1073612 - RNA, 21 nt, Human
aaguagcugagaccacaggca

SEQ ID NO: 1073613 - RNA, 24 nt, Human
aaguagcugagaccacaggcaugu

SEQ ID NO: 1073614 - RNA, 27 nt, Human
aaguagcugagaccacaggcauguauc

SEQ ID NO: 1073615 - RNA, 18 nt, Human
aagugcugggauuacagg

SEQ ID NO: 1073616 - RNA, 19 nt, Human
aagugcugggauuacaggu

SEQ ID NO: 1073617 - RNA, 22 nt, Human
aauagugcugaaagugagagac

SEQ ID NO: 1073618 - RNA, 20 nt, Human
acaucuagucagcaucuguu

SEQ ID NO: 1073619 - RNA, 18 nt, Human
acccagccucaacuguuu

SEQ ID NO: 1073620 - RNA, 19 nt, Human
acccaggcuggagugcagu

SEQ ID NO: 1073621 - RNA, 20 nt, Human
acccaggcuggagugcagug

SEQ ID NO: 1073622 - RNA, 23 nt, Human
acccaggcuggagugcaguggug

SEQ ID NO: 1073623 - RNA, 24 nt, Human
acccugauuccaucuuagagauca

SEQ ID NO: 1073624 - RNA, 23 nt, Human
accucagccucccaaguagcuga

SEQ ID NO: 1073625 - RNA, 19 nt, Human
acggagcaguaaguacaga

SEQ ID NO: 1073626 - RNA, 19 nt, Human
acugcagccucuaccuccu

SEQ ID NO: 1073627 - RNA, 22 nt, Human
aguacagaguucuggagaggga

SEQ ID NO: 1073628 - RNA, 18 nt, Human
aguauccuuccaccaccc

SEQ ID NO: 1073629 - RNA, 20 nt, Human
agugcaguggugcgaucccg

SEQ ID NO: 1073630 - RNA, 23 nt, Human
agugcaguggugcgaucccggcu

SEQ ID NO: 1073631 - RNA, 24 nt, Human
agugcaguggugcgaucccggcuc

SEQ ID NO: 1073632 - RNA, 24 nt, Human
aucacuuugcaauaaaaccugagg

SEQ ID NO: 1073633 - RNA, 24 nt, Human
caaagugcugggauuacaggugcg

SEQ ID NO: 1073634 - RNA, 24 nt, Human
caaccgggagugauuuugcccccc

SEQ ID NO: 1073635 - RNA, 27 nt, Human
caagcgauccucccaccucagccuccc

SEQ ID NO: 1073636 - RNA, 27 nt, Human
caagcgauccucccaccucagccuccc

SEQ ID NO: 1073637 - RNA, 24 nt, Human
caaggucuugcuauuuuucccagg

SEQ ID NO: 1073638 - RNA, 20 nt, Human
cacauauuuaugaaaaugcc

SEQ ID NO: 1073639 - RNA, 19 nt, Human
caccacaccuggcuaauuu

SEQ ID NO: 1073640 - RNA, 23 nt, Human
cacugcagccucuaccuccuggg

SEQ ID NO: 1073641 - RNA, 21 nt, Human
cacuuugcaauaaaaccugag

SEQ ID NO: 1073642 - RNA, 24 nt, Human
cagcauccccuguguggcccuuag

SEQ ID NO: 1073643 - RNA, 25 nt, Human
cagcauccccuguguggcccuuagg

SEQ ID NO: 1073644 - RNA, 23 nt, Human
cagccucuaccuccuggguucaa

SEQ ID NO: 1073645 - RNA, 18 nt, Human
caguauccuuccaccacc

SEQ ID NO: 1073646 - RNA, 18 nt, Human
cagugcaccuguguuugg

SEQ ID NO: 1073647 - RNA, 20 nt, Human
cauccaagcacacuuggcca

SEQ ID NO: 1073648 - RNA, 23 nt, Human
caugaagaaaaggcagacucaug

SEQ ID NO: 1073649 - RNA, 25 nt, Human
caugaagaaaaggcagacucaugac

SEQ ID NO: 1073650 - RNA, 24 nt, Human
cauuuucaauugagucauuggggg

SEQ ID NO: 1073651 - RNA, 20 nt, Human
ccaaaggagagacaaucuug

SEQ ID NO: 1073652 - RNA, 21 nt, Human
ccaaagugcugggauuacagg

SEQ ID NO: 1073653 - RNA, 21 nt, Human
ccaaagugcugggauuacagg

SEQ ID NO: 1073654 - RNA, 22 nt, Human
ccaaagugcugggauuacaggu

SEQ ID NO: 1073655 - RNA, 21 nt, Human
ccaggcuggucuugaacuccu

SEQ ID NO: 1073656 - RNA, 22 nt, Human
ccauuccccacccugaucugga

SEQ ID NO: 1073657 - RNA, 20 nt, Human
cccaccucagccucccaagu

SEQ ID NO: 1073658 - RNA, 23 nt, Human
cccaccucagccucccaaguagc

SEQ ID NO: 1073659 - RNA, 21 nt, Human
cccccagagaacauguggcca

SEQ ID NO: 1073660 - RNA, 22 nt, Human
cccccagagaacauguggccau

SEQ ID NO: 1073661 - RNA, 23 nt, Human
cccgacaacucccacuaagacaa

SEQ ID NO: 1073662 - RNA, 18 nt, Human
cccuggagagcaggaugg

SEQ ID NO: 1073663 - RNA, 25 nt, Human
ccuacaaugccccgacaacucccac

SEQ ID NO: 1073664 - RNA, 24 nt, Human
ccuccuggguucaagcgauccucc

SEQ ID NO: 1073665 - RNA, 19 nt, Human
ccucuaccuccuggguuca

SEQ ID NO: 1073666 - RNA, 20 nt, Human
ccuggguucaagcgauccuc

SEQ ID NO: 1073667 - RNA, 23 nt, Human
ccuggguucaagcgauccuccca

SEQ ID NO: 1073668 - RNA, 21 nt, Human
ccuguagcugucaacucugug

SEQ ID NO: 1073669 - RNA, 19 nt, Human
cgaccucauuuuuauaacu

SEQ ID NO: 1073670 - RNA, 20 nt, Human
cgacuggccauuccccaccc

SEQ ID NO: 1073671 - RNA, 19 nt, Human
cggcuggaggagguggugc

SEQ ID NO: 1073672 - RNA, 23 nt, Human
cuaagcauccuacaaugccccuc

SEQ ID NO: 1073673 - RNA, 24 nt, Human
cucacugcagccucuaccuccugg

SEQ ID NO: 1073674 - RNA, 19 nt, Human
cucagcaucuuuuaacuca

SEQ ID NO: 1073675 - RNA, 21 nt, Human
cucccaaguagcugagaccac

SEQ ID NO: 1073676 - RNA, 22 nt, Human
cucucggcagcugggacuucau

SEQ ID NO: 1073677 - RNA, 23 nt, Human
cugcagccucuaccuccuggguu

SEQ ID NO: 1073678 - RNA, 24 nt, Human
cuucagggcuucucaaccgggagu

SEQ ID NO: 1073679 - RNA, 23 nt, Human
cuuuucucuuucuccaccucuuu

SEQ ID NO: 1073680 - RNA, 21 nt, Human
gaaaaugccaccccaggaauu

SEQ ID NO: 1073681 - RNA, 19 nt, Human
gaagaaaaggcagacucau

SEQ ID NO: 1073682 - RNA, 19 nt, Human
gaguaaucccaaagugcug

SEQ ID NO: 1073683 - RNA, 18 nt, Human
gauuacaggugcgaguca

SEQ ID NO: 1073684 - RNA, 24 nt, Human
gauuacaggugcgagucacucuac

SEQ ID NO: 1073685 - RNA, 20 nt, Human
gauuuugccccccagagaac

SEQ ID NO: 1073686 - RNA, 22 nt, Human
gcccugagcaugacuuugagua

SEQ ID NO: 1073687 - RNA, 22 nt, Human
gcggggggagggugaggguuca

SEQ ID NO: 1073688 - RNA, 21 nt, Human
gcucacugcagccucuaccuc

SEQ ID NO: 1073689 - RNA, 19 nt, Human
gcuuuuuuuuuuuuuuucc

SEQ ID NO: 1073690 - RNA, 22 nt, Human
ggaggaacuuuauuucuggcca

SEQ ID NO: 1073691 - RNA, 24 nt, Human
ggcuggaggagguggugcuacugg

SEQ ID NO: 1073692 - RNA, 20 nt, Human
ggcuggucuugaacuccuga

SEQ ID NO: 1073693 - RNA, 26 nt, Human
guacugcuuuuuuuuuuuuuuuccuu

SEQ ID NO: 1073694 - RNA, 19 nt, Human
gucucaaucucugguuucu

SEQ ID NO: 1073695 - RNA, 21 nt, Human
uacagaguucuggagagggaa

SEQ ID NO: 1073696 - RNA, 22 nt, Human
uaccauuugugcaaguugugca

SEQ ID NO: 1073697 - RNA, 24 nt, Human
uaccuccuggguucaagcgauccu

SEQ ID NO: 1073698 - RNA, 21 nt, Human
uacuuacaugugaucugcgua

SEQ ID NO: 1073699 - RNA, 18 nt, Human
uacuucagggcuucucaa

SEQ ID NO: 1073700 - RNA, 21 nt, Human
uagagaucauccaagcacacu

SEQ ID NO: 1073701 - RNA, 20 nt, Human
uagaggcaaggucuugcuau

SEQ ID NO: 1073702 - RNA, 26 nt, Human
uaguacugcuuuuuuuuuuuuuuucc

SEQ ID NO: 1073703 - RNA, 18 nt, Human
uaugucuuuacuucaggg

SEQ ID NO: 1073704 - RNA, 24 nt, Human
uauuuuucccaggcuggucuugaa

SEQ ID NO: 1073705 - RNA, 23 nt, Human
ucaagaaaggagaaauguugaaa

SEQ ID NO: 1073706 - RNA, 24 nt, Human
ucacugcagccucuaccuccuggg

SEQ ID NO: 1073707 - RNA, 25 nt, Human
ucacugcagccucuaccuccugggu

SEQ ID NO: 1073708 - RNA, 18 nt, Human
ucagcagcguugucccug

SEQ ID NO: 1073709 - RNA, 18 nt, Human
ucagccucccaaguagcu

SEQ ID NO: 1073710 - RNA, 21 nt, Human
ucagccucccaaguagcugag

SEQ ID NO: 1073711 - RNA, 23 nt, Human
ucagugcaccuguguuuggggcu

SEQ ID NO: 1073712 - RNA, 26 nt, Human
ucagugcaccuguguuuggggcuuug

SEQ ID NO: 1073713 - RNA, 23 nt, Human
ucccaaagugcugggauuacagg

SEQ ID NO: 1073714 - RNA, 24 nt, Human
ucccaaguagcugagaccacaggc

SEQ ID NO: 1073715 - RNA, 24 nt, Human
ucccaugaagaaaaggcagacuca

SEQ ID NO: 1073716 - RNA, 27 nt, Human
uccucccaccucagccucccaaguagc

SEQ ID NO: 1073717 - RNA, 20 nt, Human
uccugaguucaagcaaucuu

SEQ ID NO: 1073718 - RNA, 21 nt, Human
uccuggguucaagcgauccuc

SEQ ID NO: 1073719 - RNA, 25 nt, Human
ucuacauggcaauaagcaguugcuc

SEQ ID NO: 1073720 - RNA, 23 nt, Human
ucucugguuucuuuacucagugc

SEQ ID NO: 1073721 - RNA, 19 nt, Human
ucuguaacccaggcuggag

SEQ ID NO: 1073722 - RNA, 20 nt, Human
ucuguaacccaggcuggagu

SEQ ID NO: 1073723 - RNA, 24 nt, Human
ucuguaacccaggcuggagugcag

SEQ ID NO: 1073724 - RNA, 23 nt, Human
ucuugaacuccugaguucaagca

SEQ ID NO: 1073725 - RNA, 23 nt, Human
ucuugcuauuuuucccaggcugg

SEQ ID NO: 1073726 - RNA, 24 nt, Human
ucuugcuauuuuucccaggcuggu

SEQ ID NO: 1073727 - RNA, 21 nt, Human
ucuuuucucuuucuccaccuc

SEQ ID NO: 1073728 - RNA, 24 nt, Human
ugaaaaugccaccccaggaauugc

SEQ ID NO: 1073729 - RNA, 19 nt, Human
ugaacagagacgaccucau

SEQ ID NO: 1073730 - RNA, 24 nt, Human
ugaacuccugaguucaagcaaucu

SEQ ID NO: 1073731 - RNA, 19 nt, Human
ugacugauggcaacaucga

SEQ ID NO: 1073732 - RNA, 18 nt, Human
ugagaagcagauuagcca

SEQ ID NO: 1073733 - RNA, 24 nt, Human
ugagaccacaggcauguaucacca

SEQ ID NO: 1073734 - RNA, 21 nt, Human
ugaguucaagcaaucuuccca

SEQ ID NO: 1073735 - RNA, 19 nt, Human
ugccaccccaggaauugca

SEQ ID NO: 1073736 - RNA, 18 nt, Human
ugccccgacaacucccac

SEQ ID NO: 1073737 - RNA, 20 nt, Human
ugccccgacaacucccacua

SEQ ID NO: 1073738 - RNA, 26 nt, Human
ugccccgacaacucccacuaagacaa

SEQ ID NO: 1073739 - RNA, 24 nt, Human
ugcugggauuacaggugcgaguca

SEQ ID NO: 1073740 - RNA, 18 nt, Human
uggagacaauuuuggugg

SEQ ID NO: 1073741 - RNA, 24 nt, Human
uggagugcaguggugcgaucccgg

SEQ ID NO: 1073742 - RNA, 21 nt, Human
uggccaaauugguuuugcuac

SEQ ID NO: 1073743 - RNA, 23 nt, Human
uggcuaauuuuuucccuuuuucu

SEQ ID NO: 1073744 - RNA, 18 nt, Human
ugggauuacaggugcgag

SEQ ID NO: 1073745 - RNA, 18 nt, Human
ugggauuacaggugcgag

SEQ ID NO: 1073746 - RNA, 21 nt, Human
ugggauuacaggugcgaguca

SEQ ID NO: 1073747 - RNA, 22 nt, Human
ugggauuacaggugcgagucac

SEQ ID NO: 1073748 - RNA, 23 nt, Human
ugggauuacaggugcgagucacu

SEQ ID NO: 1073749 - RNA, 25 nt, Human
ugggauuacaggugcgagucacucu

SEQ ID NO: 1073750 - RNA, 24 nt, Human
uggugcgaucccggcucacugcag

SEQ ID NO: 1073751 - RNA, 19 nt, Human
ugguugcggcuggaggagg

SEQ ID NO: 1073752 - RNA, 26 nt, Human
ugucaguauccuuccaccacccuggc

SEQ ID NO: 1073753 - RNA, 20 nt, Human
ugucauggguacagcauccc

SEQ ID NO: 1073754 - RNA, 18 nt, Human
ugucccuggagagcagga

SEQ ID NO: 1073755 - RNA, 19 nt, Human
uguccugaggugcucugga

SEQ ID NO: 1073756 - RNA, 24 nt, Human
uucaagcaaucuucccaccucagc

SEQ ID NO: 1073757 - RNA, 24 nt, Human
uucaagcgauccucccaccucagc

SEQ ID NO: 1073758 - RNA, 18 nt, Human
uucauugucauuaccagu

SEQ ID NO: 1073759 - RNA, 20 nt, Human
uucccaccucagccugggag

SEQ ID NO: 1073760 - RNA, 22 nt, Human
uucccaccucagccugggagua

SEQ ID NO: 1073761 - RNA, 24 nt, Human
uucccaggcuggucuugaacuccu

SEQ ID NO: 1073762 - RNA, 23 nt, Human
uuggugguugcggcuggaggagg

SEQ ID NO: 1073763 - RNA, 19 nt, Human
uugucccuggagagcagga

SEQ ID NO: 1073764 - RNA, 21 nt, Human
uuucuuuucucuuucuccacc

SEQ ID NO: 1073765 - RNA, 23 nt, Human
uuuuucagcagcguugucccugg

SEQ ID NO: 1073766 - RNA, 19 nt, Human
aaaaagaaauuccuagccc

SEQ ID NO: 1073767 - RNA, 23 nt, Human
aaacugggaaggacaacaggaga

SEQ ID NO: 1073768 - RNA, 19 nt, Human
aaagaaauuccuagcccuu

SEQ ID NO: 1073769 - RNA, 21 nt, Human
aaagucuuucccuucucuagc

SEQ ID NO: 1073770 - RNA, 22 nt, Human
aacacauguccaauaggcacaa

SEQ ID NO: 1073771 - RNA, 19 nt, Human
aacaguccaguccugauga

SEQ ID NO: 1073772 - RNA, 19 nt, Human
aagguuugaaauacugguu

SEQ ID NO: 1073773 - RNA, 18 nt, Human
aaguuucuuuuauuguuu

SEQ ID NO: 1073774 - RNA, 18 nt, Human
acuuguggaccuccccuc

SEQ ID NO: 1073775 - RNA, 23 nt, Human
aggacaacaggagaagugguggc

SEQ ID NO: 1073776 - RNA, 23 nt, Human
aggagcuggaucaguagacacca

SEQ ID NO: 1073777 - RNA, 22 nt, Human
agggaaaaggggagguugggga

SEQ ID NO: 1073778 - RNA, 20 nt, Human
aguccaaaauuuaagaaaaa

SEQ ID NO: 1073779 - RNA, 24 nt, Human
aguggcauuauacaaacaaguuuc

SEQ ID NO: 1073780 - RNA, 25 nt, Human
aucacuagcaauacaccuacaauga

SEQ ID NO: 1073781 - RNA, 20 nt, Human
augaaccaaaguagcuacaa

SEQ ID NO: 1073782 - RNA, 19 nt, Human
auugucuuuguugugcugu

SEQ ID NO: 1073783 - RNA, 20 nt, Human
caacugccugcccauuuauu

SEQ ID NO: 1073784 - RNA, 21 nt, Human
cacucgaucaucucuacacuu

SEQ ID NO: 1073785 - RNA, 22 nt, Human
caggagcuggaucaguagacac

SEQ ID NO: 1073786 - RNA, 28 nt, Human
ccaccuggagaucuucaaagggggcugc

SEQ ID NO: 1073787 - RNA, 18 nt, Human
cccuguccuauugauccc

SEQ ID NO: 1073788 - RNA, 20 nt, Human
cgagcucccugaaaaagaaa

SEQ ID NO: 1073789 - RNA, 20 nt, Human
cgaugagcuuccucaugcuu

SEQ ID NO: 1073790 - RNA, 21 nt, Human
cgcguacauaacaagaaguag

SEQ ID NO: 1073791 - RNA, 23 nt, Human
cgggugugacuggagcagggcgu

SEQ ID NO: 1073792 - RNA, 21 nt, Human
cuagauucugccuucuaacug

SEQ ID NO: 1073793 - RNA, 23 nt, Human
cuccauaagcuuguaugccgggu

SEQ ID NO: 1073794 - RNA, 20 nt, Human
cucugugccuacauaucuaa

SEQ ID NO: 1073795 - RNA, 23 nt, Human
cugaaguuuuucugaugaaccaa

SEQ ID NO: 1073796 - RNA, 18 nt, Human
cugugccuacauaucuag

SEQ ID NO: 1073797 - RNA, 19 nt, Human
cuuaagagccgagcucccu

SEQ ID NO: 1073798 - RNA, 20 nt, Human
gagauucuggaugagccuaa

SEQ ID NO: 1073799 - RNA, 22 nt, Human
gagccgagcucccugaaaaaga

SEQ ID NO: 1073800 - RNA, 19 nt, Human
gaucaucucuacacuuuga

SEQ ID NO: 1073801 - RNA, 18 nt, Human
gcugcacaagcaucaaau

SEQ ID NO: 1073802 - RNA, 20 nt, Human
gcugugguggauccaagcug

SEQ ID NO: 1073803 - RNA, 21 nt, Human
gggaaaaggggagguugggga

SEQ ID NO: 1073804 - RNA, 18 nt, Human
gggagguuggggagaaac

SEQ ID NO: 1073805 - RNA, 21 nt, Human
gggagguuggggagaaacugg

SEQ ID NO: 1073806 - RNA, 20 nt, Human
ggguugucugggcuuggucu

SEQ ID NO: 1073807 - RNA, 20 nt, Human
guuugcuuggggauuuccuu

SEQ ID NO: 1073808 - RNA, 18 nt, Human
uaacacaacugccugccc

SEQ ID NO: 1073809 - RNA, 18 nt, Human
uaagaaaaaugaaucuca

SEQ ID NO: 1073810 - RNA, 19 nt, Human
uaagaaaaaugaaucucac

SEQ ID NO: 1073811 - RNA, 22 nt, Human
uaagcuuuccuaaagggaugau

SEQ ID NO: 1073812 - RNA, 23 nt, Human
uaauugucuuuguugugcuguua

SEQ ID NO: 1073813 - RNA, 27 nt, Human
uacacguucucccuuuuuccaaugggg

SEQ ID NO: 1073814 - RNA, 20 nt, Human
uaccuugcacugaguggcau

SEQ ID NO: 1073815 - RNA, 18 nt, Human
uacgugaaaaagucacaa

SEQ ID NO: 1073816 - RNA, 22 nt, Human
uacuucuguuuuuuccaacuuu

SEQ ID NO: 1073817 - RNA, 24 nt, Human
uagcaauacaccuacaaugagggu

SEQ ID NO: 1073818 - RNA, 23 nt, Human
uaguccagagggaacaguccagu

SEQ ID NO: 1073819 - RNA, 24 nt, Human
uauagaacagaaagauugcuuuaa

SEQ ID NO: 1073820 - RNA, 25 nt, Human
uauuucccuccuuugagcauuuuca

SEQ ID NO: 1073821 - RNA, 21 nt, Human
uauuucuagcuuuuuacuauu

SEQ ID NO: 1073822 - RNA, 24 nt, Human
ucacuagcaauacaccuacaauga

SEQ ID NO: 1073823 - RNA, 19 nt, Human
uccacaguggacacaaaga

SEQ ID NO: 1073824 - RNA, 21 nt, Human
uccacaguggacacaaagagg

SEQ ID NO: 1073825 - RNA, 21 nt, Human
ucccugaaaaagaaauuccua

SEQ ID NO: 1073826 - RNA, 26 nt, Human
ucccugaaaaagaaauuccuagcccu

SEQ ID NO: 1073827 - RNA, 26 nt, Human
ucuuuagcuccuuucucaggggccgc

SEQ ID NO: 1073828 - RNA, 20 nt, Human
ucuuuuucagaaguuauggu

SEQ ID NO: 1073829 - RNA, 25 nt, Human
ugaaaaagucacaauagaucaagua

SEQ ID NO: 1073830 - RNA, 23 nt, Human
ugaaccaaaguagcuacaaaacc

SEQ ID NO: 1073831 - RNA, 21 nt, Human
ugaguggcauuauacaaacaa

SEQ ID NO: 1073832 - RNA, 21 nt, Human
ugcuagauucugccuucuaac

SEQ ID NO: 1073833 - RNA, 19 nt, Human
ugcucaggacgacagucug

SEQ ID NO: 1073834 - RNA, 18 nt, Human
ugguggauccaagcuggg

SEQ ID NO: 1073835 - RNA, 22 nt, Human
uguggaccuccccucuaauuaa

SEQ ID NO: 1073836 - RNA, 23 nt, Human
ugugguggauccaagcugggauu

SEQ ID NO: 1073837 - RNA, 19 nt, Human
uguuauacaacuucugucc

SEQ ID NO: 1073838 - RNA, 25 nt, Human
uuacuaaauggauucuuuucagugu

SEQ ID NO: 1073839 - RNA, 23 nt, Human
uuacuucuguuuuuuccaacuuu

SEQ ID NO: 1073840 - RNA, 19 nt, Human
uucuacgugaaaaagucac

SEQ ID NO: 1073841 - RNA, 20 nt, Human
uugcuuucucccuuuuuugc

SEQ ID NO: 1073842 - RNA, 25 nt, Human
uuuagugggaguucucacucucauu

SEQ ID NO: 1073843 - RNA, 23 nt, Human
uuuccuuuucuucuguucuaguu

SEQ ID NO: 1073844 - RNA, 18 nt, Human
uuuuaagggcugacaacu

SEQ ID NO: 1073845 - RNA, 21 nt, Human
uuuucagaaguuauggugcug

SEQ ID NO: 1073846 - RNA, 20 nt, Human
aaccuccaccuccugggcuc

SEQ ID NO: 1073847 - RNA, 24 nt, Human
aaggauucuccucccucagccucc

SEQ ID NO: 1073848 - RNA, 24 nt, Human
aaggcgcugagaucacagguguga

SEQ ID NO: 1073849 - RNA, 19 nt, Human
aaguagcugggaaugcagg

SEQ ID NO: 1073850 - RNA, 22 nt, Human
aagugcugccugcacagguugg

SEQ ID NO: 1073851 - RNA, 21 nt, Human
acaggugcccaccacuacacc

SEQ ID NO: 1073852 - RNA, 22 nt, Human
accauagggaaaugucuucuca

SEQ ID NO: 1073853 - RNA, 18 nt, Human
accauguuggccaggcug

SEQ ID NO: 1073854 - RNA, 23 nt, Human
accuaucagguacuggaggugaa

SEQ ID NO: 1073855 - RNA, 24 nt, Human
acucuguugcccaagcuggagugc

SEQ ID NO: 1073856 - RNA, 23 nt, Human
agacaggaaggaaaugaggggac

SEQ ID NO: 1073857 - RNA, 19 nt, Human
agaucacaggugugagcca

SEQ ID NO: 1073858 - RNA, 18 nt, Human
agcaggaagaagacauga

SEQ ID NO: 1073859 - RNA, 21 nt, Human
aggaaggcagguuugggcugg

SEQ ID NO: 1073860 - RNA, 26 nt, Human
aggcgcugagaucacaggugugagcc

SEQ ID NO: 1073861 - RNA, 24 nt, Human
aggugauccgccugccucggccuc

SEQ ID NO: 1073862 - RNA, 22 nt, Human
aguagcgaugggguuucaccau

SEQ ID NO: 1073863 - RNA, 18 nt, Human
aguaggugggauuacagg

SEQ ID NO: 1073864 - RNA, 18 nt, Human
agugcaguggcaugaucu

SEQ ID NO: 1073865 - RNA, 19 nt, Human
agugcaguggcaugaucuc

SEQ ID NO: 1073866 - RNA, 21 nt, Human
agugcaguggcaugaucucug

SEQ ID NO: 1073867 - RNA, 22 nt, Human
augggguuucaccauguuggcc

SEQ ID NO: 1073868 - RNA, 24 nt, Human
augggguuucaccauguuggccag

SEQ ID NO: 1073869 - RNA, 23 nt, Human
auguuggcuuucuguacaagacu

SEQ ID NO: 1073870 - RNA, 19 nt, Human
auuuggguggcauguuggc

SEQ ID NO: 1073871 - RNA, 24 nt, Human
caaaggauucuccucccucagccu

SEQ ID NO: 1073872 - RNA, 20 nt, Human
caaccuccaccuccugggcu

SEQ ID NO: 1073873 - RNA, 23 nt, Human
caaccuccaccuccugggcucaa

SEQ ID NO: 1073874 - RNA, 24 nt, Human
caaccuccaccuccugggcucaag

SEQ ID NO: 1073875 - RNA, 22 nt, Human
caagccccuccagaaaagcaag

SEQ ID NO: 1073876 - RNA, 24 nt, Human
caaggcgcugagaucacaggugug

SEQ ID NO: 1073877 - RNA, 22 nt, Human
caagugauucucgugucucagc

SEQ ID NO: 1073878 - RNA, 19 nt, Human
cacagaacucaagagacag

SEQ ID NO: 1073879 - RNA, 19 nt, Human
cacaggugugagccaccac

SEQ ID NO: 1073880 - RNA, 21 nt, Human
caccauguuggccaggcuggu

SEQ ID NO: 1073881 - RNA, 24 nt, Human
caccauguuggccaggcuggucuc

SEQ ID NO: 1073882 - RNA, 27 nt, Human
caccauguuggccaggcuggucucaaa

SEQ ID NO: 1073883 - RNA, 21 nt, Human
cacccaccuagacugcagagu

SEQ ID NO: 1073884 - RNA, 21 nt, Human
cacugcaaccuccaccuccug

SEQ ID NO: 1073885 - RNA, 23 nt, Human
cacugcaaccuccaccuccuggg

SEQ ID NO: 1073886 - RNA, 20 nt, Human
cacuggacauuucaagcccc

SEQ ID NO: 1073887 - RNA, 24 nt, Human
caggugcccaccacuacaccuggc

SEQ ID NO: 1073888 - RNA, 24 nt, Human
cauguuggccaggcuggucucaaa

SEQ ID NO: 1073889 - RNA, 24 nt, Human
ccaaggcgcugagaucacaggugu

SEQ ID NO: 1073890 - RNA, 24 nt, Human
ccaccuccugggcucaagugauuc

SEQ ID NO: 1073891 - RNA, 21 nt, Human
ccagggagcaacgugugccag

SEQ ID NO: 1073892 - RNA, 23 nt, Human
cccaagcuggagugcaguggcau

SEQ ID NO: 1073893 - RNA, 23 nt, Human
cccaaguagcugggaaugcaggu

SEQ ID NO: 1073894 - RNA, 21 nt, Human
cccagguucaaaggauucucc

SEQ ID NO: 1073895 - RNA, 23 nt, Human
cccgaguaggugggauuacaggu

SEQ ID NO: 1073896 - RNA, 18 nt, Human
ccgggccgaaagugcugc

SEQ ID NO: 1073897 - RNA, 22 nt, Human
ccuccaccuccugggcucaagu

SEQ ID NO: 1073898 - RNA, 24 nt, Human
ccucccagguucaaaggauucucc

SEQ ID NO: 1073899 - RNA, 21 nt, Human
ccuccugggcucaagugauuc

SEQ ID NO: 1073900 - RNA, 21 nt, Human
ccugaccuaaggugauccgcc

SEQ ID NO: 1073901 - RNA, 23 nt, Human
ccugaccuaaggugauccgccug

SEQ ID NO: 1073902 - RNA, 26 nt, Human
ccugcacagguugguggaugguccuu

SEQ ID NO: 1073903 - RNA, 21 nt, Human
ccugccucggccucccaaggc

SEQ ID NO: 1073904 - RNA, 24 nt, Human
ccugccucggccucccaaggcgcu

SEQ ID NO: 1073905 - RNA, 20 nt, Human
ccugggcucaagugauucuc

SEQ ID NO: 1073906 - RNA, 20 nt, Human
ccugggcucaagugauucuc

SEQ ID NO: 1073907 - RNA, 21 nt, Human
cgacagagaggggcagggcac

SEQ ID NO: 1073908 - RNA, 30 nt, Human; identical to SEQ ID NO: 675786

SEQ ID NO: 1073909 - RNA, 24 nt, Human
cgcugagaucacaggugugagcca

SEQ ID NO: 1073910 - RNA, 23 nt, Human
cuaaggugauccgccugccucgg

SEQ ID NO: 1073911 - RNA, 24 nt, Human
cuaauuuuuguauuuuuaguagcg

SEQ ID NO: 1073912 - RNA, 23 nt, Human
cucaagugauucucgugucucag

SEQ ID NO: 1073913 - RNA, 24 nt, Human
cucacugcaaccuccaccuccugg

SEQ ID NO: 1073914 - RNA, 27 nt, Human
cucacugcaaccuccaccuccugggcu

SEQ ID NO: 1073915 - RNA, 21 nt, Human
cucccaaggcgcugagaucac

SEQ ID NO: 1073916 - RNA, 23 nt, Human
cucccucagccucccaaguagcu

SEQ ID NO: 1073917 - RNA, 26 nt, Human
cuccugaccuaaggugauccgccugc

SEQ ID NO: 1073918 - RNA, 21 nt, Human
cuccugggcucaagugauucu

SEQ ID NO: 1073919 - RNA, 24 nt, Human
cugcaaccuccaccuccugggcuc

SEQ ID NO: 1073920 - RNA, 24 nt, Human
cuggggaacccaccucccagguuc

SEQ ID NO: 1073921 - RNA, 26 nt, Human
cuuacugugcugggaguacuugugga

SEQ ID NO: 1073922 - RNA, 19 nt, Human
cuuguggagugcgggcugu

SEQ ID NO: 1073923 - RNA, 20 nt, Human
cuuguggagugcgggcugug

SEQ ID NO: 1073924 - RNA, 20 nt, Human
cuuuuguauuuuuaguggag

SEQ ID NO: 1073925 - RNA, 18 nt, Human
gaaagcacaaaauacuug

SEQ ID NO: 1073926 - RNA, 19 nt, Human
gacacagaacucaagagac

SEQ ID NO: 1073927 - RNA, 24 nt, Human
gacaggggucccugccagggaugc

SEQ ID NO: 1073928 - RNA, 19 nt, Human
gacagugucaggcaaggac

SEQ ID NO: 1073929 - RNA, 24 nt, Human
gaccuaaggugauccgccugccuc

SEQ ID NO: 1073930 - RNA, 18 nt, Human
gagcaggaagaagacaug

SEQ ID NO: 1073931 - RNA, 22 nt, Human
gagcaggaagaagacaugaagc

SEQ ID NO: 1073932 - RNA, 18 nt, Human
gaucacaggugugagcca

SEQ ID NO: 1073933 - RNA, 21 nt, Human
gauucucgugucucagccucc

SEQ ID NO: 1073934 - RNA, 21 nt, Human
gcauuguaacacagggaaagc

SEQ ID NO: 1073935 - RNA, 24 nt, Human
gcccaagcuggagugcaguggcau

SEQ ID NO: 1073936 - RNA, 20 nt, Human
gccuguuccccaccacaucc

SEQ ID NO: 1073937 - RNA, 21 nt, Human
gcgcugagaucacagguguga

SEQ ID NO: 1073938 - RNA, 25 nt, Human
gcuggagugcaguggcaugaucucu

SEQ ID NO: 1073939 - RNA, 22 nt, Human
ggacaagauggcgguuuugcuc

SEQ ID NO: 1073940 - RNA, 19 nt, Human
gggcuaggaaggcagguuu

SEQ ID NO: 1073941 - RNA, 22 nt, Human
gggguuucaccauguuggccag

SEQ ID NO: 1073942 - RNA, 18 nt, Human
ggguuucaccauguuggc

SEQ ID NO: 1073943 - RNA, 19 nt, Human
gugauccgccugccucggc

SEQ ID NO: 1073944 - RNA, 24 nt, Human
gugauucucgugucucagccuccc

SEQ ID NO: 1073945 - RNA, 20 nt, Human
gugcugccugcacagguugg

SEQ ID NO: 1073946 - RNA, 21 nt, Human
gugugagccaccacgcugggc

SEQ ID NO: 1073947 - RNA, 22 nt, Human
uaacuuuuguauuuuuagugga

SEQ ID NO: 1073948 - RNA, 24 nt, Human
uaauuuuuguauuuuuaguagcga

SEQ ID NO: 1073949 - RNA, 24 nt, Human
uacucuguugcccaagcuggagug

SEQ ID NO: 1073950 - RNA, 22 nt, Human
uagcuacgacagagaggggcag

SEQ ID NO: 1073951 - RNA, 19 nt, Human
uagcugggaaugcaggugc

SEQ ID NO: 1073952 - RNA, 25 nt, Human
uaggaaggcagguuugggcuggaga

SEQ ID NO: 1073953 - RNA, 24 nt, Human
uaguagcgaugggguuucaccaug

SEQ ID NO: 1073954 - RNA, 20 nt, Human
uauguuccaaaggacugacg

SEQ ID NO: 1073955 - RNA, 23 nt, Human
ucacugcaaccuccaccuccugg

SEQ ID NO: 1073956 - RNA, 24 nt, Human
ucacugcaaccuccaccuccuggg

SEQ ID NO: 1073957 - RNA, 25 nt, Human
ucacugcaaccuccaccuccugggc

SEQ ID NO: 1073958 - RNA, 27 nt, Human
ucacugcaaccuccaccuccugggcuc

SEQ ID NO: 1073959 - RNA, 18 nt, Human
ucagccucccaaguagcu

SEQ ID NO: 1073960 - RNA, 20 nt, Human
ucagccucccaaguagcugg

SEQ ID NO: 1073961 - RNA, 19 nt, Human
uccaaaggacugacggacc

SEQ ID NO: 1073962 - RNA, 23 nt, Human
ucccaaggcgcugagaucacagg

SEQ ID NO: 1073963 - RNA, 23 nt, Human
ucccaaguagcugggaaugcagg

SEQ ID NO: 1073964 - RNA, 21 nt, Human
ucccagguucaaaggauucuc

SEQ ID NO: 1073965 - RNA, 23 nt, Human
ucccgaguaggugggauuacagg

SEQ ID NO: 1073966 - RNA, 24 nt, Human
ucccgaguaggugggauuacaggu

SEQ ID NO: 1073967 - RNA, 24 nt, Human
ucccucagccucccaaguagcugg

SEQ ID NO: 1073968 - RNA, 21 nt, Human
uccugggcucaagugauucuc

SEQ ID NO: 1073969 - RNA, 24 nt, Human
uccugggcucaagugauucucgug

SEQ ID NO: 1073970 - RNA, 22 nt, Human
ucuagacuccauccuccauccc

SEQ ID NO: 1073971 - RNA, 20 nt, Human
ucuccucccucagccuccca

SEQ ID NO: 1073972 - RNA, 24 nt, Human
ucuguugcccaagcuggagugcag

SEQ ID NO: 1073973 - RNA, 23 nt, Human
ucuuacucuguugcccaagcugg

SEQ ID NO: 1073974 - RNA, 24 nt, Human
ucuuacucuguugcccaagcugga

SEQ ID NO: 1073975 - RNA, 18 nt, Human
ugaccuaaggugauccgc

SEQ ID NO: 1073976 - RNA, 24 nt, Human
ugaccuaaggugauccgccugccu

SEQ ID NO: 1073977 - RNA, 18 nt, Human
ugacguuggacucauugg

SEQ ID NO: 1073978 - RNA, 22 nt, Human
ugagaucacaggugugagccac

SEQ ID NO: 1073979 - RNA, 24 nt, Human
ugagaucacaggugugagccacca

SEQ ID NO: 1073980 - RNA, 20 nt, Human
ugaguugaaggcugggacag

SEQ ID NO: 1073981 - RNA, 23 nt, Human
ugaucucugcucacugcaaccuc

SEQ ID NO: 1073982 - RNA, 18 nt, Human
ugcagaguggauuugggu

SEQ ID NO: 1073983 - RNA, 24 nt, Human
ugcccaagcuggagugcaguggca

SEQ ID NO: 1073984 - RNA, 19 nt, Human
ugcccugggcuuuaauuau

SEQ ID NO: 1073985 - RNA, 21 nt, Human
ugccucggccucccaaggcgc

SEQ ID NO: 1073986 - RNA, 24 nt, Human
ugccucggccucccaaggcgcuga

SEQ ID NO: 1073987 - RNA, 22 nt, Human
ugccugggaugagaguggagac

SEQ ID NO: 1073988 - RNA, 22 nt, Human
ugccugguuuggggaguguuca

SEQ ID NO: 1073989 - RNA, 18 nt, Human
ugcgcgccaccaugcccg

SEQ ID NO: 1073990 - RNA, 19 nt, Human
uggagugcaguggcaugau

SEQ ID NO: 1073991 - RNA, 22 nt, Human
uggagugcaguggcaugaucuc

SEQ ID NO: 1073992 - RNA, 23 nt, Human
uggagugcaguggcaugaucucu

SEQ ID NO: 1073993 - RNA, 24 nt, Human
uggagugcaguggcaugaucucug

SEQ ID NO: 1073994 - RNA, 23 nt, Human
uggauuuggguggcauguuggcu

SEQ ID NO: 1073995 - RNA, 24 nt, Human
uggccaggcuggucucaaacuccu

SEQ ID NO: 1073996 - RNA, 24 nt, Human
ugggaaugcaggugcgcgccacca

SEQ ID NO: 1073997 - RNA, 20 nt, Human
ugggaugagaguggagacgg

SEQ ID NO: 1073998 - RNA, 21 nt, Human
ugggauuacaggugcccacca

SEQ ID NO: 1073999 - RNA, 24 nt, Human
ugggauuacaggugcccaccacua

SEQ ID NO: 1074000 - RNA, 18 nt, Human
ugggcucaagugauucuc

SEQ ID NO: 1074001 - RNA, 24 nt, Human
ugggcucaagugauucucgugucu

SEQ ID NO: 1074002 - RNA, 20 nt, Human
ugggcuggagacuugggcuu

SEQ ID NO: 1074003 - RNA, 18 nt, Human
uggggaguguucauggga

SEQ ID NO: 1074004 - RNA, 24 nt, Human
ugggguuucaccauguuggccagg

SEQ ID NO: 1074005 - RNA, 26 nt, Human
uguaacacagggaaagcacaaaauac

SEQ ID NO: 1074006 - RNA, 21 nt, Human
uguauuuuuaguagcgauggg

SEQ ID NO: 1074007 - RNA, 18 nt, Human
ugucucagccucccgagu

SEQ ID NO: 1074008 - RNA, 20 nt, Human
ugucucagccucccgaguag

SEQ ID NO: 1074009 - RNA, 22 nt, Human
ugugacacagaacucaagagac

SEQ ID NO: 1074010 - RNA, 18 nt, Human
uuaguagcgaugggguuu

SEQ ID NO: 1074011 - RNA, 22 nt, Human
uuaguagcgaugggguuucacc

SEQ ID NO: 1074012 - RNA, 24 nt, Human
uuaguagcgaugggguuucaccau

SEQ ID NO: 1074013 - RNA, 18 nt, Human
uucuucuuguggccucug

SEQ ID NO: 1074014 - RNA, 20 nt, Human
uugagcaggaagaagacaug

SEQ ID NO: 1074015 - RNA, 18 nt, Human
uugcccaagcuggagugc

SEQ ID NO: 1074016 - RNA, 21 nt, Human
uugggacgcaucccagguaga

SEQ ID NO: 1074017 - RNA, 23 nt, Human
uuguauuuuuaguagcgaugggg

SEQ ID NO: 1074018 - RNA, 22 nt, Human
uuuaaagauggagucuuacucu

SEQ ID NO: 1074019 - RNA, 24 nt, Human
uuucaccauguuggccaggcuggu

SEQ ID NO: 1074020 - RNA, 24 nt, Human
uuuuuaguagcgaugggguuucac

SEQ ID NO: 1074021 - RNA, 21 nt, Human
uuuuucuucuuguggccucug

SEQ ID NO: 1074022 - RNA, 18 nt, Human
uuuuuguauuuuuaguag

SEQ ID NO: 1074023 - RNA, 23 nt, Human
uuuuuguauuuuuaguagcgaug

SEQ ID NO: 1074024 - RNA, 23 nt, Human
agucggcugcaucuuugggauga

SEQ ID NO: 1074025 - RNA, 23 nt, Human
aucaaaaagcucauccaccacaa

SEQ ID NO: 1074026 - RNA, 19 nt, Human
gaacucaguuucucucugu

SEQ ID NO: 1074027 - RNA, 20 nt, Human
uagcaaacagaauccagcag

SEQ ID NO: 1074028 - RNA, 20 nt, Human
ugcugcaggacacucagcag

SEQ ID NO: 1074029 - RNA, 18 nt, Human
aaaaaaaugauacaguga

SEQ ID NO: 1074030 - RNA, 22 nt, Human
aaaagacuuugcaguucaagga

SEQ ID NO: 1074031 - RNA, 23 nt, Human
aaaugcuugaagaccacaaggcu

SEQ ID NO: 1074032 - RNA, 21 nt, Human
aagcaggaggauugagccaag

SEQ ID NO: 1074033 - RNA, 22 nt, Human
aagcaggaggauugagccaaga

SEQ ID NO: 1074034 - RNA, 21 nt, Human
aaggagcucccaggucugggc

SEQ ID NO: 1074035 - RNA, 22 nt, Human
aaggauagcuguaaagucaagg

SEQ ID NO: 1074036 - RNA, 20 nt, Human
acaaaauaagaaauaaaagc

SEQ ID NO: 1074037 - RNA, 20 nt, Human
acuaugcuacccagaacuaa

SEQ ID NO: 1074038 - RNA, 22 nt, Human
agacaaaauaagaaauaaaagc

SEQ ID NO: 1074039 - RNA, 20 nt, Human
agacuugaugaauaaacacu

SEQ ID NO: 1074040 - RNA, 20 nt, Human
agcagcuuccaacaguggca

SEQ ID NO: 1074041 - RNA, 18 nt, Human
agggccccaaagagggag

SEQ ID NO: 1074042 - RNA, 26 nt, Human
auagaauaccaagauuaaacuuaaag

SEQ ID NO: 1074043 - RNA, 21 nt, Human
caagugcugaaggacuucaga

SEQ ID NO: 1074044 - RNA, 24 nt, Human
cacaguaaggauguccuuuccaca

SEQ ID NO: 1074045 - RNA, 19 nt, Human
cacuaugcuacccagaacu

SEQ ID NO: 1074046 - RNA, 19 nt, Human
cacuggcgaaugcagugac

SEQ ID NO: 1074047 - RNA, 21 nt, Human
cagcagagaggagguucugga

SEQ ID NO: 1074048 - RNA, 24 nt, Human
cagcagagaggagguucuggaaug

SEQ ID NO: 1074049 - RNA, 23 nt, Human
cauaugauucccaauagaauacc

SEQ ID NO: 1074050 - RNA, 22 nt, Human
cccauugaguguucagcuuuca

SEQ ID NO: 1074051 - RNA, 20 nt, Human
cccgggcucaaggagcuccc

SEQ ID NO: 1074052 - RNA, 22 nt, Human
ccgggcucaaggagcucccagg

SEQ ID NO: 1074053 - RNA, 24 nt, Human
ccucucugcaaacaggucuuccca

SEQ ID NO: 1074054 - RNA, 23 nt, Human
ccuggaguggcuggcuccucucu

SEQ ID NO: 1074055 - RNA, 21 nt, Human
cgaaugcagugacgccaacca

SEQ ID NO: 1074056 - RNA, 21 nt, Human
cucucugcaaacaggucuucc

SEQ ID NO: 1074057 - RNA, 20 nt, Human
cuggcuccucucugcaaaca

SEQ ID NO: 1074058 - RNA, 22 nt, Human
cuggcuccucucugcaaacagg

SEQ ID NO: 1074059 - RNA, 20 nt, Human
cugugcagcuccucagcucc

SEQ ID NO: 1074060 - RNA, 21 nt, Human
cuuccaaucuagcugagucug

SEQ ID NO: 1074061 - RNA, 20 nt, Human
cuuugcuggaguccuguucu

SEQ ID NO: 1074062 - RNA, 21 nt, Human
gaaaugcuugaagaccacaag

SEQ ID NO: 1074063 - RNA, 20 nt, Human
gagcucccaggucugggcuu

SEQ ID NO: 1074064 - RNA, 25 nt, Human
ggaaagaauacucucugcucaugga

SEQ ID NO: 1074065 - RNA, 23 nt, Human
gggcauguugcagcccuguuugu

SEQ ID NO: 1074066 - RNA, 19 nt, Human
ggucugggcuucuccgagg

SEQ ID NO: 1074067 - RNA, 22 nt, Human
guuucccacuguacugauuagg

SEQ ID NO: 1074068 - RNA, 22 nt, Human
uaaaagacugacuucaccagaa

SEQ ID NO: 1074069 - RNA, 24 nt, Human
uaaacuaagaacuggaaaagacuu

SEQ ID NO: 1074070 - RNA, 21 nt, Human
uaaagcaggaggauugagcca

SEQ ID NO: 1074071 - RNA, 19 nt, Human
uaaggacuguggggaaaga

SEQ ID NO: 1074072 - RNA, 23 nt, Human
uagaaaaacacauuuauuggaga

SEQ ID NO: 1074073 - RNA, 23 nt, Human
uaugcuacccagaacuaagggaa

SEQ ID NO: 1074074 - RNA, 19 nt, Human
ucaaggagcucccaggucu

SEQ ID NO: 1074075 - RNA, 22 nt, Human
ucaaugucuuucccuguuuccu

SEQ ID NO: 1074076 - RNA, 24 nt, Human
ucagaauacaaaaaaaugauacag

SEQ ID NO: 1074077 - RNA, 18 nt, Human
uccacagcaagggugucc

SEQ ID NO: 1074078 - RNA, 23 nt, Human
uccacaguaaggauguccuuucc

SEQ ID NO: 1074079 - RNA, 19 nt, Human
ucccaggucugggcuucuc

SEQ ID NO: 1074080 - RNA, 18 nt, Human
ucccauccucucuuccaa

SEQ ID NO: 1074081 - RNA, 18 nt, Human
uccucagcuccugcaguu

SEQ ID NO: 1074082 - RNA, 18 nt, Human
uccuuuccacagcaaggg

SEQ ID NO: 1074083 - RNA, 19 nt, Human
ucucagagcuccacagaag

SEQ ID NO: 1074084 - RNA, 19 nt, Human
ucuccgagggccagagcuc

SEQ ID NO: 1074085 - RNA, 19 nt, Human
ucuuucuucuggaacuuug

SEQ ID NO: 1074086 - RNA, 24 nt, Human
ugaaguaggaaagguuaaagcagg

SEQ ID NO: 1074087 - RNA, 21 nt, Human
ugagcugaaaauaaugaaggg

SEQ ID NO: 1074088 - RNA, 20 nt, Human
uggagacccaaaucugucuu

SEQ ID NO: 1074089 - RNA, 21 nt, Human
uggcuccucucugcaaacagg

SEQ ID NO: 1074090 - RNA, 24 nt, Human
uggcuccucucugcaaacaggucu

SEQ ID NO: 1074091 - RNA, 21 nt, Human
ugggaauacccuaugaaaaac

SEQ ID NO: 1074092 - RNA, 21 nt, Human
ugggacuugaccugaauuggg

SEQ ID NO: 1074093 - RNA, 19 nt, Human
ugggcacuaugcuacccag

SEQ ID NO: 1074094 - RNA, 20 nt, Human
ugggguuucagauucaauaa

SEQ ID NO: 1074095 - RNA, 21 nt, Human
uguucagcuucuagcagaacg

SEQ ID NO: 1074096 - RNA, 25 nt, Human
uguuuccuguucauucaauaaauau

SEQ ID NO: 1074097 - RNA, 22 nt, Human
uuaaaggauagcuguaaaguca

SEQ ID NO: 1074098 - RNA, 23 nt, Human
uucagaauacaaaaaaaugauac

SEQ ID NO: 1074099 - RNA, 19 nt, Human
uugcuggaguccuguucuc

SEQ ID NO: 1074100 - RNA, 21 nt, Human
uuggaaaugcuugaagaccac

SEQ ID NO: 1074101 - RNA, 21 nt, Human
uuuccacaguaaggauguccu

SEQ ID NO: 1074102 - RNA, 24 nt, Human
uuucccacuguacugauuagguuu

SEQ ID NO: 1074103 - RNA, 21 nt, Human
aaacaaagcagaugccaaccc

SEQ ID NO: 1074104 - RNA, 21 nt, Human
caaagcagaugccaaccccug

SEQ ID NO: 1074105 - RNA, 19 nt, Human
cuagcauauuuuaacaaac

SEQ ID NO: 1074106 - RNA, 21 nt, Human
uuuuauagaugacuagcauau

SEQ ID NO: 1074107 - RNA, 22 nt, Human
aaaauacugaaacuacuuugcu

SEQ ID NO: 1074108 - RNA, 26 nt, Human
aaacagaaagcgaagcggagggaccc

SEQ ID NO: 1074109 - RNA, 20 nt, Human
aaacagaaagcgaagcggau

SEQ ID NO: 1074110 - RNA, 21 nt, Human
aaagaagucaaaacaaaugca

SEQ ID NO: 1074111 - RNA, 19 nt, Human
aaauaaccaaggaguagag

SEQ ID NO: 1074112 - RNA, 26 nt, Human
aacaacagaaaaacauaugggaaaaa

SEQ ID NO: 1074113 - RNA, 19 nt, Human
acaacagaaaaacauaugg

SEQ ID NO: 1074114 - RNA, 19 nt, Human
acaacagaaaaacauaugg

SEQ ID NO: 1074115 - RNA, 22 nt, Human
acagaaaacauauaguucuuaa

SEQ ID NO: 1074116 - RNA, 22 nt, Human
agaaggagggaaacagagaggc

SEQ ID NO: 1074117 - RNA, 22 nt, Human
agacagaaaacauauaguucuu

SEQ ID NO: 1074118 - RNA, 25 nt, Human
agacagaaaacauauaguucuuaau

SEQ ID NO: 1074119 - RNA, 21 nt, Human
agaggcuguuuggaauugcag

SEQ ID NO: 1074120 - RNA, 21 nt, Human
agaucagaaucauaaaucuac

SEQ ID NO: 1074121 - RNA, 22 nt, Human
agcagaaaagugauaaacagaa

SEQ ID NO: 1074122 - RNA, 22 nt, Human
agccuaaaaauaaccaaggagu

SEQ ID NO: 1074123 - RNA, 19 nt, Human
aguacugaggugauuacuc

SEQ ID NO: 1074124 - RNA, 22 nt, Human
aguugauuuuuagcaaguacag

SEQ ID NO: 1074125 - RNA, 22 nt, Human
auaaaucuacuaacuccauauu

SEQ ID NO: 1074126 - RNA, 24 nt, Human
aucauuagggcaauuaagaacagu

SEQ ID NO: 1074127 - RNA, 18 nt, Human
auuaccccaaaagaaccc

SEQ ID NO: 1074128 - RNA, 20 nt, Human
cagaccaccguagaucauua

SEQ ID NO: 1074129 - RNA, 21 nt, Human
cagcagaaaagugauaaacag

SEQ ID NO: 1074130 - RNA, 23 nt, Human
cauaugggaaaaaaaaaagccuu

SEQ ID NO: 1074131 - RNA, 21 nt, Human
caugauggcuuaugcugacuu

SEQ ID NO: 1074132 - RNA, 20 nt, Human
caugcuaccaaucugacuca

SEQ ID NO: 1074133 - RNA, 24 nt, Human
ccaaaagaacccauggcuauuaaa

SEQ ID NO: 1074134 - RNA, 20 nt, Human
ccaagaaggagggaaacaga

SEQ ID NO: 1074135 - RNA, 22 nt, Human
ccaccuacuucccaugaacacc

SEQ ID NO: 1074136 - RNA, 18 nt, Human
cccaugaccacuuccuag

SEQ ID NO: 1074137 - RNA, 21 nt, Human
cccauggcuauuaaagcugcc

SEQ ID NO: 1074138 - RNA, 22 nt, Human
ccugccgaaggaaagaaauaag

SEQ ID NO: 1074139 - RNA, 22 nt, Human
cgucaugcuaccaaucugacuc

SEQ ID NO: 1074140 - RNA, 22 nt, Human
cuacuaacuccauauucauuug

SEQ ID NO: 1074141 - RNA, 19 nt, Human
cugaaacuacuuugcugua

SEQ ID NO: 1074142 - RNA, 23 nt, Human
cuuauaaagugugcaacacaggg

SEQ ID NO: 1074143 - RNA, 19 nt, Human
cuuccuagauuacucuuug

SEQ ID NO: 1074144 - RNA, 24 nt, Human
gaaaccccuccacgcaaaucaccu

SEQ ID NO: 1074145 - RNA, 23 nt, Human
gaaaccccuccacgcaaaucacu

SEQ ID NO: 1074146 - RNA, 18 nt, Human
gcacaguugauuuuuagc

SEQ ID NO: 1074147 - RNA, 23 nt, Human
gccuucacugauccaccuacuuc

SEQ ID NO: 1074148 - RNA, 25 nt, Human
ggaaaauacugaaacuacuuugcug

SEQ ID NO: 1074149 - RNA, 25 nt, Human
uaaaaauaaccaaggaguagagcca

SEQ ID NO: 1074150 - RNA, 20 nt, Human
uaagccuaaaaauaaccaag

SEQ ID NO: 1074151 - RNA, 20 nt, Human
uaauaugcugaagaaugaag

SEQ ID NO: 1074152 - RNA, 21 nt, Human
uaccccaaaagaacccauggc

SEQ ID NO: 1074153 - RNA, 26 nt, Human
uagaacacaauguuuagaacaaccgc

SEQ ID NO: 1074154 - RNA, 19 nt, Human
uagaucagaaucauaaauc

SEQ ID NO: 1074155 - RNA, 19 nt, Human
uagcccaugaccacuuccu

SEQ ID NO: 1074156 - RNA, 24 nt, Human
uaucucaucccuauuacucuucca

SEQ ID NO: 1074157 - RNA, 20 nt, Human
ucagcagaaaagugauaaac

SEQ ID NO: 1074158 - RNA, 21 nt, Human
ucaugcuaccaaucugacuca

SEQ ID NO: 1074159 - RNA, 23 nt, Human
ucccaugaacaccugccgaagga

SEQ ID NO: 1074160 - RNA, 20 nt, Human
ucuaaacauaauuugugggg

SEQ ID NO: 1074161 - RNA, 22 nt, Human
ucuuaauucuaaaaaggccauu

SEQ ID NO: 1074162 - RNA, 21 nt, Human
ucuuuguggcuucuuuuuauu

SEQ ID NO: 1074163 - RNA, 21 nt, Human
ugaaagaggcaugaauggaug

SEQ ID NO: 1074164 - RNA, 21 nt, Human
ugaacuguuaaaaccuuacgu

SEQ ID NO: 1074165 - RNA, 20 nt, Human
ugaagaaagcccacaugaug

SEQ ID NO: 1074166 - RNA, 26 nt, Human
ugccaugaggaucuucugaacuguua

SEQ ID NO: 1074167 - RNA, 25 nt, Human
uggauguaaacucuauucacagacc

SEQ ID NO: 1074168 - RNA, 24 nt, Human
uggcaucaaaaauguuaauuugua

SEQ ID NO: 1074169 - RNA, 21 nt, Human
uggcugaaaaaccgacugcau

SEQ ID NO: 1074170 - RNA, 23 nt, Human
uguacauuaccccaaaagaaccc

SEQ ID NO: 1074171 - RNA, 23 nt, Human
uguggggggcaggcaugaaaccc

SEQ ID NO: 1074172 - RNA, 22 nt, Human
uguguacauuaccccaaaagaa

SEQ ID NO: 1074173 - RNA, 23 nt, Human
uguguacauuaccccaaaagaac

SEQ ID NO: 1074174 - RNA, 19 nt, Human
aaagugcuaggauuacagg

SEQ ID NO: 1074175 - RNA, 24 nt, Human
aaagugcuaggauuacagguguga

SEQ ID NO: 1074176 - RNA, 21 nt, Human
aaaugagccccuucugcuccu

SEQ ID NO: 1074177 - RNA, 20 nt, Human
aacauuugcugaaugaauau

SEQ ID NO: 1074178 - RNA, 24 nt, Human
aaccucaagugaucugcccaccuc

SEQ ID NO: 1074179 - RNA, 20 nt, Human
aagaccucaaucccuggggc

SEQ ID NO: 1074180 - RNA, 24 nt, Human
aagcaaucuggucugcugacccua

SEQ ID NO: 1074181 - RNA, 26 nt, Human
aagugcuaggauuacaggugugagcc

SEQ ID NO: 1074182 - RNA, 22 nt, Human
acaaccuccgccucccacguuc

SEQ ID NO: 1074183 - RNA, 21 nt, Human
acagagaccagcccuggccca

SEQ ID NO: 1074184 - RNA, 19 nt, Human
accaggaacaggaccgucc

SEQ ID NO: 1074185 - RNA, 18 nt, Human
accauguuggccaggcug

SEQ ID NO: 1074186 - RNA, 23 nt, Human
accucagccucccaaagugcuag

SEQ ID NO: 1074187 - RNA, 25 nt, Human
agaaagaccauaaacaccuuucccg

SEQ ID NO: 1074188 - RNA, 18 nt, Human
agagaccagcccuggccc

SEQ ID NO: 1074189 - RNA, 23 nt, Human
aggguaggggugggagagcaggg

SEQ ID NO: 1074190 - RNA, 19 nt, Human
agggucaggguaggggugg

SEQ ID NO: 1074191 - RNA, 23 nt, Human
aguaggugggacuauaggugugu

SEQ ID NO: 1074192 - RNA, 24 nt, Human
agugauuauccugccucagccucc

SEQ ID NO: 1074193 - RNA, 18 nt, Human
augggguuucaccauguu

SEQ ID NO: 1074194 - RNA, 22 nt, Human
augggguuucaccauguuggcc

SEQ ID NO: 1074195 - RNA, 24 nt, Human
augggguuucaccauguuggccag

SEQ ID NO: 1074196 - RNA, 19 nt, Human
auguccaagaaaugggagg

SEQ ID NO: 1074197 - RNA, 22 nt, Human
auuguuggcccgugggucugag

SEQ ID NO: 1074198 - RNA, 21 nt, Human
caaaaaugagccccuucugcu

SEQ ID NO: 1074199 - RNA, 24 nt, Human
caaagugcuaggauuacaggugug

SEQ ID NO: 1074200 - RNA, 24 nt, Human
caacaugcccggcuaauuuuugua

SEQ ID NO: 1074201 - RNA, 20 nt, Human
caaccagaccucucgucuua

SEQ ID NO: 1074202 - RNA, 22 nt, Human
caagugauuauccugccucagc

SEQ ID NO: 1074203 - RNA, 22 nt, Human
caccauguuggccaggcuggac

SEQ ID NO: 1074204 - RNA, 24 nt, Human
caccauguuggccaggcuggacuc

SEQ ID NO: 1074205 - RNA, 21 nt, Human
cacuacaaccuccgccuccca

SEQ ID NO: 1074206 - RNA, 19 nt, Human
cacugguggcuaacaaggu

SEQ ID NO: 1074207 - RNA, 18 nt, Human
caggaacaggaccguccu

SEQ ID NO: 1074208 - RNA, 21 nt, Human
caggaacaggaccguccugcu

SEQ ID NO: 1074209 - RNA, 20 nt, Human
cagguccaguguucucugcc

SEQ ID NO: 1074210 - RNA, 18 nt, Human
caguccuuuccugaggcc

SEQ ID NO: 1074211 - RNA, 21 nt, Human
cauacaccucugaauccuuac

SEQ ID NO: 1074212 - RNA, 25 nt, Human
cauguccacuccccucacuugggag

SEQ ID NO: 1074213 - RNA, 24 nt, Human
cauucugucacucgggcuggagug

SEQ ID NO: 1074214 - RNA, 19 nt, Human
cauuucuuggugaaagugc

SEQ ID NO: 1074215 - RNA, 21 nt, Human
ccaaagugcuaggauuacagg

SEQ ID NO: 1074216 - RNA, 24 nt, Human
ccaaagugcuaggauuacaggugu

SEQ ID NO: 1074217 - RNA, 23 nt, Human
ccacuagauugugaccuccacaa

SEQ ID NO: 1074218 - RNA, 20 nt, Human
ccacuguguucagcccacuu

SEQ ID NO: 1074219 - RNA, 23 nt, Human
ccagaccucucgucuuacauaac

SEQ ID NO: 1074220 - RNA, 26 nt, Human
cccagauaagcuugagccuguagagg

SEQ ID NO: 1074221 - RNA, 23 nt, Human
ccccgucuaccaguccuuuccug

SEQ ID NO: 1074222 - RNA, 20 nt, Human
ccgguaggaaugggccugcu

SEQ ID NO: 1074223 - RNA, 24 nt, Human
ccucauucugucacucgggcugga

SEQ ID NO: 1074224 - RNA, 18 nt, Human
ccucgccaugggucccca

SEQ ID NO: 1074225 - RNA, 24 nt, Human
ccugaguaggugggacuauaggug

SEQ ID NO: 1074226 - RNA, 18 nt, Human
ccuggcccagugaacccg

SEQ ID NO: 1074227 - RNA, 18 nt, Human
ccuuuccugaggccugga

SEQ ID NO: 1074228 - RNA, 19 nt, Human
cgccauggguccccacagc

SEQ ID NO: 1074229 - RNA, 27 nt, Human
cgccauggguccccacagccuuggugc

SEQ ID NO: 1074230 - RNA, 22 nt, Human
cggaagaaagaccauaaacacc

SEQ ID NO: 1074231 - RNA, 24 nt, Human
cuacaaccuccgccucccacguuc

SEQ ID NO: 1074232 - RNA, 24 nt, Human
cucaagugaucugcccaccucagc

SEQ ID NO: 1074233 - RNA, 24 nt, Human
cucauucugucacucgggcuggag

SEQ ID NO: 1074234 - RNA, 22 nt, Human
cuccgguaggaaugggccugcu

SEQ ID NO: 1074235 - RNA, 23 nt, Human
cucgucuuacauaacaagcaauc

SEQ ID NO: 1074236 - RNA, 20 nt, Human
cugauccucuccacguccau

SEQ ID NO: 1074237 - RNA, 21 nt, Human
cugccucagccuccugaguag

SEQ ID NO: 1074238 - RNA, 23 nt, Human
cugcucugcugucuguggagcag

SEQ ID NO: 1074239 - RNA, 24 nt, Human
cugcugucuguggagcaggucugg

SEQ ID NO: 1074240 - RNA, 19 nt, Human
cugugugugagccaggugg

SEQ ID NO: 1074241 - RNA, 20 nt, Human
gaagaaagaccauaaacacc

SEQ ID NO: 1074242 - RNA, 18 nt, Human
gaauccucuuccuucauu

SEQ ID NO: 1074243 - RNA, 19 nt, Human
gagaccagcccuggcccag

SEQ ID NO: 1074244 - RNA, 20 nt, Human
gagaugggguuucaccaugu

SEQ ID NO: 1074245 - RNA, 24 nt, Human
gagaugggguuucaccauguuggc

SEQ ID NO: 1074246 - RNA, 23 nt, Human
gaggcaccuccuugagaagucuu

SEQ ID NO: 1074247 - RNA, 18 nt, Human
gauuacaggugugagcca

SEQ ID NO: 1074248 - RNA, 21 nt, Human
gauuacaggugugagccacug

SEQ ID NO: 1074249 - RNA, 24 nt, Human
gauuacaggugugagccacugugu

SEQ ID NO: 1074250 - RNA, 18 nt, Human
gccacuguguucagccca

SEQ ID NO: 1074251 - RNA, 22 nt, Human
ggaacagagaccagcccuggcc

SEQ ID NO: 1074252 - RNA, 22 nt, Human
ggauuacaggugugagccacug

SEQ ID NO: 1074253 - RNA, 20 nt, Human
ggcacauucagaaauuuugu

SEQ ID NO: 1074254 - RNA, 18 nt, Human
gggcuggggaacagagac

SEQ ID NO: 1074255 - RNA, 22 nt, Human
gggguuucaccauguuggccag

SEQ ID NO: 1074256 - RNA, 19 nt, Human
gggucaggguagggguggg

SEQ ID NO: 1074257 - RNA, 18 nt, Human
ggguuucaccauguuggc

SEQ ID NO: 1074258 - RNA, 22 nt, Human
ggguuucaccauguuggccagg

SEQ ID NO: 1074259 - RNA, 19 nt, Human
guagagaugggguuucacc

SEQ ID NO: 1074260 - RNA, 21 nt, Human
guagagaugggguuucaccau

SEQ ID NO: 1074261 - RNA, 22 nt, Human
guagagaugggguuucaccaug

SEQ ID NO: 1074262 - RNA, 19 nt, Human
guaggagcguuugguauaa

SEQ ID NO: 1074263 - RNA, 23 nt, Human
guccauuguuggcccgugggucu

SEQ ID NO: 1074264 - RNA, 25 nt, Human
guccuuuccugaggccuggaguucu

SEQ ID NO: 1074265 - RNA, 20 nt, Human
gugaaugggucaaaaaugag

SEQ ID NO: 1074266 - RNA, 24 nt, Human
gugaucugcccaccucagccuccc

SEQ ID NO: 1074267 - RNA, 24 nt, Human
gugauuauccugccucagccuccu

SEQ ID NO: 1074268 - RNA, 21 nt, Human
uaacacagaccgaggcagcaa

SEQ ID NO: 1074269 - RNA, 18 nt, Human
uaaccucaagugaucugc

SEQ ID NO: 1074270 - RNA, 24 nt, Human
uaauuuuuguacuuuuuguagaga

SEQ ID NO: 1074271 - RNA, 18 nt, Human
uacaggugugagccacug

SEQ ID NO: 1074272 - RNA, 22 nt, Human
uacaggugugagccacuguguu

SEQ ID NO: 1074273 - RNA, 22 nt, Human
uagagaugggguuucaccaugu

SEQ ID NO: 1074274 - RNA, 18 nt, Human
uagccgccaugaguccuu

SEQ ID NO: 1074275 - RNA, 21 nt, Human
uaggauuacaggugugagcca

SEQ ID NO: 1074276 - RNA, 22 nt, Human
uaggauuacaggugugagccac

SEQ ID NO: 1074277 - RNA, 22 nt, Human
uaggauuacaggugugagccac

SEQ ID NO: 1074278 - RNA, 22 nt, Human
uaggauuacaggugugagccac

SEQ ID NO: 1074279 - RNA, 24 nt, Human
uaggauuacaggugugagccacug

SEQ ID NO: 1074280 - RNA, 23 nt, Human
uaggcucaaaaaacauuugcuga

SEQ ID NO: 1074281 - RNA, 23 nt, Human
uagggccucucacccaugugcuu

SEQ ID NO: 1074282 - RNA, 20 nt, Human
uauagaacuugaagacugau

SEQ ID NO: 1074283 - RNA, 19 nt, Human
uauagaacuugaagacugc

SEQ ID NO: 1074284 - RNA, 24 nt, Human
uauggucaaugucugguguguacc

SEQ ID NO: 1074285 - RNA, 18 nt, Human
ucacuacaaccuccgccu

SEQ ID NO: 1074286 - RNA, 19 nt, Human
ucacuacaaccuccgccuc

SEQ ID NO: 1074287 - RNA, 22 nt, Human
ucacuacaaccuccgccuccca

SEQ ID NO: 1074288 - RNA, 24 nt, Human
ucacuacaaccuccgccucccacg

SEQ ID NO: 1074289 - RNA, 26 nt, Human
ucacuacaaccuccgccucccacguu

SEQ ID NO: 1074290 - RNA, 22 nt, Human
ucacucgggcuggagugcaauu

SEQ ID NO: 1074291 - RNA, 18 nt, Human
ucagccucccaaagugcu

SEQ ID NO: 1074292 - RNA, 22 nt, Human
ucauucugucacucgggcugga

SEQ ID NO: 1074293 - RNA, 24 nt, Human
ucauucugucacucgggcuggagu

SEQ ID NO: 1074294 - RNA, 21 nt, Human
uccaagaccucaaucccuggg

SEQ ID NO: 1074295 - RNA, 22 nt, Human
uccaugccauaguuuucagaag

SEQ ID NO: 1074296 - RNA, 23 nt, Human
ucccaaagugcuaggauuacagg

SEQ ID NO: 1074297 - RNA, 23 nt, Human
ucccugacacauucuuuaguuau

SEQ ID NO: 1074298 - RNA, 21 nt, Human
ucccuggggcuagugaauggg

SEQ ID NO: 1074299 - RNA, 21 nt, Human
uccgguaggaaugggccugcu

SEQ ID NO: 1074300 - RNA, 24 nt, Human
uccugaguaggugggacuauaggu

SEQ ID NO: 1074301 - RNA, 23 nt, Human
ucuccuuggcagcacugggcaca

SEQ ID NO: 1074302 - RNA, 21 nt, Human
ucugcccaccucagccuccca

SEQ ID NO: 1074303 - RNA, 24 nt, Human
ucugucacucgggcuggagugcaa

SEQ ID NO: 1074304 - RNA, 18 nt, Human
ugagauggucagaccuca

SEQ ID NO: 1074305 - RNA, 20 nt, Human
ugaguaggugggacuauagg

SEQ ID NO: 1074306 - RNA, 24 nt, Human
ugaucugcccaccucagccuccca

SEQ ID NO: 1074307 - RNA, 23 nt, Human
ugcccggcuaauuuuuguacuuu

SEQ ID NO: 1074308 - RNA, 24 nt, Human
ugccucagccuccugaguaggugg

SEQ ID NO: 1074309 - RNA, 24 nt, Human
ugcuaggauuacaggugugagcca

SEQ ID NO: 1074310 - RNA, 18 nt, Human
ugcugaaugaauauagaa

SEQ ID NO: 1074311 - RNA, 18 nt, Human
ugcuugagauggucagac

SEQ ID NO: 1074312 - RNA, 24 nt, Human
uggaagggaucuggugcccuggua

SEQ ID NO: 1074313 - RNA, 21 nt, Human
uggauggagggcaccuggaug

SEQ ID NO: 1074314 - RNA, 24 nt, Human
uggccaggcuggacucuaacuucu

SEQ ID NO: 1074315 - RNA, 21 nt, Human
ugggacuauaggugugugcca

SEQ ID NO: 1074316 - RNA, 22 nt, Human
ugggcuggggaacagagaccag

SEQ ID NO: 1074317 - RNA, 24 nt, Human
ugggguuucaccauguuggccagg

SEQ ID NO: 1074318 - RNA, 21 nt, Human
uggucagaccucaugaacucu

SEQ ID NO: 1074319 - RNA, 24 nt, Human
uguagagaugggguuucaccaugu

SEQ ID NO: 1074320 - RNA, 21 nt, Human
ugucuguggagcaggucuggg

SEQ ID NO: 1074321 - RNA, 23 nt, Human
ugugccauccuggcucacuacaa

SEQ ID NO: 1074322 - RNA, 20 nt, Human
ugugugagccaggugggcug

SEQ ID NO: 1074323 - RNA, 22 nt, Human
ugugugugagccaggugggcug

SEQ ID NO: 1074324 - RNA, 21 nt, Human
uucaagugauuauccugccuc

SEQ ID NO: 1074325 - RNA, 23 nt, Human
uucaagugauuauccugccucag

SEQ ID NO: 1074326 - RNA, 23 nt, Human
uucauacaccucugaauccuuac

SEQ ID NO: 1074327 - RNA, 23 nt, Human
uucccugacacauucuuuaguua

SEQ ID NO: 1074328 - RNA, 24 nt, Human
uuguagagaugggguuucaccaug

SEQ ID NO: 1074329 - RNA, 21 nt, Human
uuucaccauguuggccaggcu

SEQ ID NO: 1074330 - RNA, 24 nt, Human
uuuguagagaugggguuucaccau

SEQ ID NO: 1074331 - RNA, 23 nt, Human
uuuuuguagagaugggguuucac

SEQ ID NO: 1074332 - RNA, 20 nt, Human
aaaacccucacuggauguac

SEQ ID NO: 1074333 - RNA, 21 nt, Human
aaacacaucacagguaagaaa

SEQ ID NO: 1074334 - RNA, 25 nt, Human
accagcuccaaaauguuuucgugcu

SEQ ID NO: 1074335 - RNA, 20 nt, Human
aggugaguguccggaggugc

SEQ ID NO: 1074336 - RNA, 20 nt, Human
aguauggugagcuauuuccu

SEQ ID NO: 1074337 - RNA, 20 nt, Human
aucaaguacugcuggucagg

SEQ ID NO: 1074338 - RNA, 23 nt, Human
caaauaccaaagguggcagugug

SEQ ID NO: 1074339 - RNA, 22 nt, Human
cacaaucuauggaagggaaacc

SEQ ID NO: 1074340 - RNA, 26 nt, Human
caccagcuccaaaauguuuucgugcu

SEQ ID NO: 1074341 - RNA, 24 nt, Human
cagguaagaaaugggaaaccuacc

SEQ ID NO: 1074342 - RNA, 23 nt, Human
cggcccacaaggcucugcucauc

SEQ ID NO: 1074343 - RNA, 20 nt, Human
cucaucagcaaaaucuucug

SEQ ID NO: 1074344 - RNA, 21 nt, Human
gaguauggugagcuauuuccu

SEQ ID NO: 1074345 - RNA, 19 nt, Human
gcgcagcagaugaaugaag

SEQ ID NO: 1074346 - RNA, 23 nt, Human
gguaagaaaugggaaaccuaccu

SEQ ID NO: 1074347 - RNA, 20 nt, Human
ggugcuggguaaaacacauc

SEQ ID NO: 1074348 - RNA, 21 nt, Human
guaaaacacaucacagguaaa

SEQ ID NO: 1074349 - RNA, 22 nt, Human
gugcuggguaaaacacaucaca

SEQ ID NO: 1074350 - RNA, 19 nt, Human
guguccggaggugcugggu

SEQ ID NO: 1074351 - RNA, 18 nt, Human
ucaaaaucaaguacugcu

SEQ ID NO: 1074352 - RNA, 22 nt, Human
uccgcugauuuccaccagcucc

SEQ ID NO: 1074353 - RNA, 22 nt, Human
ucuggaucagggucuucuacag

SEQ ID NO: 1074354 - RNA, 27 nt, Human
ugaaugaagcggcccacaaggcucugc

SEQ ID NO: 1074355 - RNA, 21 nt, Human
uggguaaaacacaucacaggu

SEQ ID NO: 1074356 - RNA, 23 nt, Human
ugguaagcugcaaauaccaaagg

SEQ ID NO: 1074357 - RNA, 19 nt, Human
uguccggaggugcugggua

SEQ ID NO: 1074358 - RNA, 21 nt, Human
uguucaaaaucaaguacugcu

SEQ ID NO: 1074359 - RNA, 20 nt, Human
uuccccagcagcuagugcuc

SEQ ID NO: 1074360 - RNA, 28 nt, Human
uucuggcauuucuuuucccauuugucau

SEQ ID NO: 1074361 - RNA, 21 nt, Human
uuucaaaaccaauuuccccag

SEQ ID NO: 1074362 - RNA, 22 nt, Human
aaaaaaaaaaaaaggaguucag

SEQ ID NO: 1074363 - RNA, 20 nt, Human
aaccaggucucuaguuuguu

SEQ ID NO: 1074364 - RNA, 21 nt, Human
aagcuaggaccaaggcuagaa

SEQ ID NO: 1074365 - RNA, 22 nt, Human
acaccugccaccaccaucaccu

SEQ ID NO: 1074366 - RNA, 20 nt, Human
accaccaucaccucauuacc

SEQ ID NO: 1074367 - RNA, 18 nt, Human
acccucaaugagggugac

SEQ ID NO: 1074368 - RNA, 24 nt, Human
acgcugcaggaacaaagggggacc

SEQ ID NO: 1074369 - RNA, 25 nt, Human
aggaacaaagggggacagcaucagc

SEQ ID NO: 1074370 - RNA, 18 nt, Human
aggccagggcugggaggg

SEQ ID NO: 1074371 - RNA, 24 nt, Human
agggaaguauuugcucuucagggc

SEQ ID NO: 1074372 - RNA, 19 nt, Human
aggggggccucuggacugc

SEQ ID NO: 1074373 - RNA, 20 nt, Human
agguggaggacggauguguc

SEQ ID NO: 1074374 - RNA, 26 nt, Human
agugaugaggccagggcugggaggga

SEQ ID NO: 1074375 - RNA, 22 nt, Human
caaggcuagaaucagcaccacc

SEQ ID NO: 1074376 - RNA, 24 nt, Human
cacaccugccaccaccaucaccuc

SEQ ID NO: 1074377 - RNA, 24 nt, Human
cacaccugccaccaccaucaccuu

SEQ ID NO: 1074378 - RNA, 19 nt, Human
caccacaccugccaccacc

SEQ ID NO: 1074379 - RNA, 22 nt, Human
caccaggugguccacaugcccc

SEQ ID NO: 1074380 - RNA, 18 nt, Human
caccccaaccuaaaccua

SEQ ID NO: 1074381 - RNA, 20 nt, Human
caccucauuacccacacccu

SEQ ID NO: 1074382 - RNA, 22 nt, Human
caccugccaccaccaucaccuc

SEQ ID NO: 1074383 - RNA, 24 nt, Human
ccaaggcuagaaucagcaccacca

SEQ ID NO: 1074384 - RNA, 18 nt, Human
ccacgcugcaggaacaaa

SEQ ID NO: 1074385 - RNA, 23 nt, Human
ccagcccugaaaaaaaaaaaaaa

SEQ ID NO: 1074386 - RNA, 23 nt, Human
ccaucaccucauuacccacaccc

SEQ ID NO: 1074387 - RNA, 19 nt, Human
cccugaaaaaaaaaaaaaa

SEQ ID NO: 1074388 - RNA, 20 nt, Human
ccugaaaaaaaaaaaaaagg

SEQ ID NO: 1074389 - RNA, 20 nt, Human
ccuuccuaauuccggcaccc

SEQ ID NO: 1074390 - RNA, 22 nt, Human
cugaaaaaaaaaaaaaaggagu

SEQ ID NO: 1074391 - RNA, 20 nt, Human
cugcaccugcuuguccucug

SEQ ID NO: 1074392 - RNA, 20 nt, Human
cugcaggaacaaagggggac

SEQ ID NO: 1074393 - RNA, 19 nt, Human
cugcugcugccugcaccug

SEQ ID NO: 1074394 - RNA, 20 nt, Human
gccuagccacagccagcucc

SEQ ID NO: 1074395 - RNA, 19 nt, Human
ggaguucaguuggcucggg

SEQ ID NO: 1074396 - RNA, 21 nt, Human
ggcugggagggaggcaggugc

SEQ ID NO: 1074397 - RNA, 19 nt, Human
gggacagcaucagcagagc

SEQ ID NO: 1074398 - RNA, 19 nt, Human
gugacaucagagagcucca

SEQ ID NO: 1074399 - RNA, 24 nt, Human
gugaugaggccagggcugggaggg

SEQ ID NO: 1074400 - RNA, 22 nt, Human
uagaaucagcaccaccacaccc

SEQ ID NO: 1074401 - RNA, 22 nt, Human
uagguucuaacugacccagccc

SEQ ID NO: 1074402 - RNA, 18 nt, Human
ucagcagagccugagggg

SEQ ID NO: 1074403 - RNA, 23 nt, Human
ucagcagagccugagggguugca

SEQ ID NO: 1074404 - RNA, 21 nt, Human
uccacgcugcaggaacaaagg

SEQ ID NO: 1074405 - RNA, 18 nt, Human
ugaaaaaaaaaaaaaagg

SEQ ID NO: 1074406 - RNA, 21 nt, Human
ugacacaauagcgcccaggag

SEQ ID NO: 1074407 - RNA, 18 nt, Human
ugaugaggccagggcugg

SEQ ID NO: 1074408 - RNA, 20 nt, Human
ugaugaggccagggcuggga

SEQ ID NO: 1074409 - RNA, 27 nt, Human
ugccaccaccaucaccucauuacccuc

SEQ ID NO: 1074410 - RNA, 21 nt, Human
ugccaccaggugguccacaug

SEQ ID NO: 1074411 - RNA, 18 nt, Human
ugcugcugccugcaccug

SEQ ID NO: 1074412 - RNA, 20 nt, Human
ugcugcugccugcaccugcu

SEQ ID NO: 1074413 - RNA, 20 nt, Human
acuuccaccccagccuucuu

SEQ ID NO: 1074414 - RNA, 23 nt, Human
aucccccguggcacgguagaggu

SEQ ID NO: 1074415 - RNA, 21 nt, Human
cacuguguaucccugaggaau

SEQ ID NO: 1074416 - RNA, 21 nt, Human
cagccuucuuggagagcagau

SEQ ID NO: 1074417 - RNA, 21 nt, Human
cccaaacugcuuccauacagu

SEQ ID NO: 1074418 - RNA, 20 nt, Human
cccugaggaauguuguagaa

SEQ ID NO: 1074419 - RNA, 22 nt, Human
ccucucgcuucuccacugugua

SEQ ID NO: 1074420 - RNA, 19 nt, Human
cuuuucaauggauuccaca

SEQ ID NO: 1074421 - RNA, 18 nt, Human
gccaggaagaacgacucc

SEQ ID NO: 1074422 - RNA, 19 nt, Human
gccauccagccucuacuuc

SEQ ID NO: 1074423 - RNA, 25 nt, Human
ggagccccccaaacugcuuccauac

SEQ ID NO: 1074424 - RNA, 23 nt, Human
guguaucccugaggaauguugua

SEQ ID NO: 1074425 - RNA, 20 nt, Human
uagaauuccgggagcccccc

SEQ ID NO: 1074426 - RNA, 18 nt, Human
uaggagggugggaucccc

SEQ ID NO: 1074427 - RNA, 25 nt, Human
ucuacuuccaccccagccuucuugg

SEQ ID NO: 1074428 - RNA, 19 nt, Human
ugcgguuguccagcuuuuc

SEQ ID NO: 1074429 - RNA, 19 nt, Human
uguaguaguugaggaaggu

SEQ ID NO: 1074430 - RNA, 19 nt, Human
uucacagucucggccagga

SEQ ID NO: 1074431 - RNA, 19 nt, Human
uucuaggagggugggaucc

SEQ ID NO: 1074432 - RNA, 20 nt, Human
aaacacacacacacaccccc

SEQ ID NO: 1074433 - RNA, 20 nt, Human
acacacccccaaaggggagc

SEQ ID NO: 1074434 - RNA, 24 nt, Human
acacacccccaaaggggagcaggg

SEQ ID NO: 1074435 - RNA, 22 nt, Human
acccccaaaggggagcagggac

SEQ ID NO: 1074436 - RNA, 18 nt, Human
acuguauccacagaaaug

SEQ ID NO: 1074437 - RNA, 23 nt, Human
agcaggaggcagcgggaggucgc

SEQ ID NO: 1074438 - RNA, 18 nt, Human
aggcuccccuccuuccca

SEQ ID NO: 1074439 - RNA, 19 nt, Human
agguccaggccccgggugg

SEQ ID NO: 1074440 - RNA, 19 nt, Human
cacacccccaaaggggagc

SEQ ID NO: 1074441 - RNA, 22 nt, Human
cacacccccaaaggggagcagg

SEQ ID NO: 1074442 - RNA, 23 nt, Human
cagaaacaagaggugggguggga

SEQ ID NO: 1074443 - RNA, 22 nt, Human
cagaggccggcgugggcggcgg

SEQ ID NO: 1074444 - RNA, 24 nt, Human
cagcagaggccggcgugggcggcg

SEQ ID NO: 1074445 - RNA, 25 nt, Human
caggccccggguggccccccaaagg

SEQ ID NO: 1074446 - RNA, 20 nt, Human
cagggacccagaaacaagag

SEQ ID NO: 1074447 - RNA, 18 nt, Human
ccaaguggaggagggcgg

SEQ ID NO: 1074448 - RNA, 22 nt, Human
ccccaaaggcuccccuccuucc

SEQ ID NO: 1074449 - RNA, 21 nt, Human
ccccaaaggggagcagggacc

SEQ ID NO: 1074450 - RNA, 20 nt, Human
cccccaaaggggagcaggga

SEQ ID NO: 1074451 - RNA, 18 nt, Human
ccccccaaaggcuccccu

SEQ ID NO: 1074452 - RNA, 19 nt, Human
ccccccaaaggcuccccuc

SEQ ID NO: 1074453 - RNA, 22 nt, Human
ccccggguggccccccaaaggc

SEQ ID NO: 1074454 - RNA, 18 nt, Human
ccccucccucuugccucc

SEQ ID NO: 1074455 - RNA, 24 nt, Human
ccucucugugcuaagggcugggga

SEQ ID NO: 1074456 - RNA, 20 nt, Human
cgugggcggcggcggcugcg

SEQ ID NO: 1074457 - RNA, 21 nt, Human
cucaguaccuccagagagcag

SEQ ID NO: 1074458 - RNA, 24 nt, Human
cucucucuauuuuuuuuuugucaa

SEQ ID NO: 1074459 - RNA, 22 nt, Human
gccggggcuuagugagggccgg

SEQ ID NO: 1074460 - RNA, 18 nt, Human
gccuccaggugagaccac

SEQ ID NO: 1074461 - RNA, 23 nt, Human
gccucuguccccucccucuugcc

SEQ ID NO: 1074462 - RNA, 21 nt, Human
gcggugggcacuguauccaca

SEQ ID NO: 1074463 - RNA, 23 nt, Human
ggaugggcagggaggauaccguu

SEQ ID NO: 1074464 - RNA, 18 nt, Human
ggcacuguauccacagaa

SEQ ID NO: 1074465 - RNA, 26 nt, Human
ggcagcagaggccggcgugggcggcg

SEQ ID NO: 1074466 - RNA, 18 nt, Human
ggccggcgugggcggcgg

SEQ ID NO: 1074467 - RNA, 22 nt, Human
ggccggcgugggcggcggcggc

SEQ ID NO: 1074468 - RNA, 18 nt, Human
gggaggggcauguguccc

SEQ ID NO: 1074469 - RNA, 25 nt, Human
gggcagcagaggccggcgugggcga

SEQ ID NO: 1074470 - RNA, 24 nt, Human
ggguggccccccaaaggcuccccu

SEQ ID NO: 1074471 - RNA, 21 nt, Human
gugcuaagggcuggggaaggg

SEQ ID NO: 1074472 - RNA, 18 nt, Human
gugggcggcggcggcugc

SEQ ID NO: 1074473 - RNA, 18 nt, Human
uaaaacacacacacacac

SEQ ID NO: 1074474 - RNA, 21 nt, Human
uaaaacacacacacacacccc

SEQ ID NO: 1074475 - RNA, 19 nt, Human
uccaggccccggguggccc

SEQ ID NO: 1074476 - RNA, 20 nt, Human
ugcauagguccaggccccgg

SEQ ID NO: 1074477 - RNA, 20 nt, Human
uggccccccaaaggcucccu

SEQ ID NO: 1074478 - RNA, 23 nt, Human
ugggcagggaggauaccguuucc

SEQ ID NO: 1074479 - RNA, 18 nt, Human
uggggugggacguggccc

SEQ ID NO: 1074480 - RNA, 21 nt, Human
uguccccucccucuugccucc

SEQ ID NO: 1074481 - RNA, 24 nt, Human
uuuauugcaguuaaauaccucucu

SEQ ID NO: 1074482 - RNA, 22 nt, Human
aaaaaaacauagcaacaaagag

SEQ ID NO: 1074483 - RNA, 24 nt, Human
aaaaaaacauagcaacaaagagac

SEQ ID NO: 1074484 - RNA, 25 nt, Human
aaacaaaaaaacauagcaacaaaga

SEQ ID NO: 1074485 - RNA, 26 nt, Human
aaacaaaaaaacauagcaacaaagag

SEQ ID NO: 1074486 - RNA, 21 nt, Human
aaacagaugggagaacaagac

SEQ ID NO: 1074487 - RNA, 18 nt, Human
aaagacacccccgccccc

SEQ ID NO: 1074488 - RNA, 24 nt, Human
aacaaaaaaacauagcaacaaaga

SEQ ID NO: 1074489 - RNA, 21 nt, Human
aagaauaaacagaugggagaa

SEQ ID NO: 1074490 - RNA, 23 nt, Human
aagacacccccgcccccagaaga

SEQ ID NO: 1074491 - RNA, 20 nt, Human
aagacccuccucuuccuugg

SEQ ID NO: 1074492 - RNA, 30 nt, Human; identical to SEQ ID NO: 759010

SEQ ID NO: 1074493 - RNA, 21 nt, Human
aagugaguucuaggaaaccag

SEQ ID NO: 1074494 - RNA, 22 nt, Human
acaaaaaaacauagcaacaaag

SEQ ID NO: 1074495 - RNA, 25 nt, Human
acccccgcccccagaagacgggguc

SEQ ID NO: 1074496 - RNA, 19 nt, Human
accgagaccgcagguuggu

SEQ ID NO: 1074497 - RNA, 19 nt, Human
agaaagccccaaaguaguc

SEQ ID NO: 1074498 - RNA, 18 nt, Human
agacacccuuuggcagau

SEQ ID NO: 1074499 - RNA, 22 nt, Human
agagauggguggggggcgaugg

SEQ ID NO: 1074500 - RNA, 18 nt, Human
agcccaaagaauaaacag

SEQ ID NO: 1074501 - RNA, 18 nt, Human
agccccaccccacaucag

SEQ ID NO: 1074502 - RNA, 22 nt, Human
aggccuggggcugggcagcugc

SEQ ID NO: 1074503 - RNA, 25 nt, Human
agggcggagcagcgccagcagggga

SEQ ID NO: 1074504 - RNA, 20 nt, Human
auuccugggaacuucaaaca

SEQ ID NO: 1074505 - RNA, 22 nt, Human
caacaaagagacccagcuucca

SEQ ID NO: 1074506 - RNA, 23 nt, Human
caacaaagagacccagcuuccag

SEQ ID NO: 1074507 - RNA, 22 nt, Human
caacauacaaaagucuggagaa

SEQ ID NO: 1074508 - RNA, 24 nt, Human
cacccccgcccccagaagacgggg

SEQ ID NO: 1074509 - RNA, 26 nt, Human
caccggaaccccucaaauauuccugg

SEQ ID NO: 1074510 - RNA, 24 nt, Human
cagacacccuuuggcagauauccu

SEQ ID NO: 1074511 - RNA, 18 nt, Human
cagagauggguggggggc

SEQ ID NO: 1074512 - RNA, 22 nt, Human
caucaccggaaccccucaaaua

SEQ ID NO: 1074513 - RNA, 20 nt, Human
caucugcucuguucagcuuc

SEQ ID NO: 1074514 - RNA, 23 nt, Human
ccaacacacgccgucaaaggaag

SEQ ID NO: 1074515 - RNA, 24 nt, Human
ccacagagaagaucccuaaacaca

SEQ ID NO: 1074516 - RNA, 22 nt, Human
ccacaucagacacccuuuggca

SEQ ID NO: 1074517 - RNA, 19 nt, Human
ccaccuagaaccuuccugg

SEQ ID NO: 1074518 - RNA, 25 nt, Human
ccagccccaccccacaucagacacc

SEQ ID NO: 1074519 - RNA, 19 nt, Human
cccaccccacaucagacac

SEQ ID NO: 1074520 - RNA, 22 nt, Human
cccaccccacaucagacacccu

SEQ ID NO: 1074521 - RNA, 21 nt, Human
cccccacagagaagaucccua

SEQ ID NO: 1074522 - RNA, 21 nt, Human
cccccagaagacgggguccca

SEQ ID NO: 1074523 - RNA, 21 nt, Human
cccgacuacccucagaaucca

SEQ ID NO: 1074524 - RNA, 18 nt, Human
cccgcccccagaagacgg

SEQ ID NO: 1074525 - RNA, 20 nt, Human
cccgcccccagaagacgggg

SEQ ID NO: 1074526 - RNA, 22 nt, Human
cccucagaauccaaauucugca

SEQ ID NO: 1074527 - RNA, 18 nt, Human
ccucccggaagaacuccu

SEQ ID NO: 1074528 - RNA, 18 nt, Human
ccucugagcaacuccucu

SEQ ID NO: 1074529 - RNA, 22 nt, Human
ccugugcccgacagggaccgag

SEQ ID NO: 1074530 - RNA, 18 nt, Human
cgaguggccucgccuggc

SEQ ID NO: 1074531 - RNA, 22 nt, Human
cggcuccaccgucguccucccg

SEQ ID NO: 1074532 - RNA, 18 nt, Human
cgugacguagguuaagug

SEQ ID NO: 1074533 - RNA, 18 nt, Human
cuccgugcgaggcccagc

SEQ ID NO: 1074534 - RNA, 18 nt, Human
cuccucuuccuuuucccc

SEQ ID NO: 1074535 - RNA, 18 nt, Human
cucugccucagugagcug

SEQ ID NO: 1074536 - RNA, 25 nt, Human
cugcagguuccuccgugcgaggccc

SEQ ID NO: 1074537 - RNA, 19 nt, Human
cuucaugcuggaccaggcc

SEQ ID NO: 1074538 - RNA, 19 nt, Human
cuucugccgaacuuccagg

SEQ ID NO: 1074539 - RNA, 21 nt, Human
gaaaagacacccccgccccca

SEQ ID NO: 1074540 - RNA, 25 nt, Human
gacccuccucuuccuuuucccccac

SEQ ID NO: 1074541 - RNA, 21 nt, Human
gagaacaagacccuccucuuc

SEQ ID NO: 1074542 - RNA, 19 nt, Human
gagccucugagcaacuccu

SEQ ID NO: 1074543 - RNA, 18 nt, Human
gaguggccucgccuggcu

SEQ ID NO: 1074544 - RNA, 21 nt, Human
gaugggcuucugccgaacuuc

SEQ ID NO: 1074545 - RNA, 22 nt, Human
gccccaccccacaucagacacc

SEQ ID NO: 1074546 - RNA, 23 nt, Human
gcugggcccggccggggcucugc

SEQ ID NO: 1074547 - RNA, 25 nt, Human
ggaccgagaccgcagguugguugca

SEQ ID NO: 1074548 - RNA, 23 nt, Human
ggagaacaagacccuccucuucc

SEQ ID NO: 1074549 - RNA, 20 nt, Human
gggaacuucaaacaaaaaaa

SEQ ID NO: 1074550 - RNA, 19 nt, Human
gggcacagggcggagcagc

SEQ ID NO: 1074551 - RNA, 19 nt, Human
gggcaggccuggggcuggg

SEQ ID NO: 1074552 - RNA, 22 nt, Human
gucggccccggccccgggaguc

SEQ ID NO: 1074553 - RNA, 19 nt, Human
gugcagagggcucuccaga

SEQ ID NO: 1074554 - RNA, 18 nt, Human
gugcagaucggcuccacc

SEQ ID NO: 1074555 - RNA, 22 nt, Human
guggcgguggacagguaggcac

SEQ ID NO: 1074556 - RNA, 23 nt, Human
uaaacagaugggagaacaagacc

SEQ ID NO: 1074557 - RNA, 24 nt, Human
uaccgugcauccuugcagauggaa

SEQ ID NO: 1074558 - RNA, 23 nt, Human
uagcaacaaagagacccagcuuc

SEQ ID NO: 1074559 - RNA, 20 nt, Human
uauccuguucugccuggcua

SEQ ID NO: 1074560 - RNA, 18 nt, Human
ucagugagcuggucugag

SEQ ID NO: 1074561 - RNA, 18 nt, Human
ucccaccuagaaccuucc

SEQ ID NO: 1074562 - RNA, 24 nt, Human
uccgagggcugggcccggccgggg

SEQ ID NO: 1074563 - RNA, 24 nt, Human
ucgaguggccucgccuggcugcgg

SEQ ID NO: 1074564 - RNA, 18 nt, Human
ucgcagaccccgguggcg

SEQ ID NO: 1074565 - RNA, 23 nt, Human
ucggcuccaccgucguccucccg

SEQ ID NO: 1074566 - RNA, 21 nt, Human
ucugcagguuccuccgugcga

SEQ ID NO: 1074567 - RNA, 23 nt, Human
ucugcagguuccuccgugcgagg

SEQ ID NO: 1074568 - RNA, 22 nt, Human
ucuuuggcuggaagcaaaaggc

SEQ ID NO: 1074569 - RNA, 20 nt, Human
ugagcaacuccucugccuca

SEQ ID NO: 1074570 - RNA, 22 nt, Human
ugcagagggcucuccagagaug

SEQ ID NO: 1074571 - RNA, 26 nt, Human
ugccagccccaccccacaucagacac

SEQ ID NO: 1074572 - RNA, 20 nt, Human
ugcucuguucagcuucagcc

SEQ ID NO: 1074573 - RNA, 20 nt, Human
uggccucgccuggcugcggc

SEQ ID NO: 1074574 - RNA, 24 nt, Human
uggcugcggcuccagcacuggcgu

SEQ ID NO: 1074575 - RNA, 19 nt, Human
uggcuggaagcaaaaggcc

SEQ ID NO: 1074576 - RNA, 21 nt, Human
uggcuggaagcaaaaggccgu

SEQ ID NO: 1074577 - RNA, 24 nt, Human
ugggaacuucaaacaaaaaaacau

SEQ ID NO: 1074578 - RNA, 20 nt, Human
ugggcugguguucguggagu

SEQ ID NO: 1074579 - RNA, 26 nt, Human
uggguggggggcgaugggcggggggc

SEQ ID NO: 1074580 - RNA, 19 nt, Human
ugugcagaucggcuccacc

SEQ ID NO: 1074581 - RNA, 23 nt, Human
uucaaacaaaaaaacauagcaac

SEQ ID NO: 1074582 - RNA, 24 nt, Human
uucccagagcccaaagaauaaaca

SEQ ID NO: 1074583 - RNA, 24 nt, Human
uuccugggaacuucaaacaaaaaa

SEQ ID NO: 1074584 - RNA, 23 nt, Human
uuggguaggggacaggccugcuc

SEQ ID NO: 1074585 - RNA, 20 nt, Human
aacccugucuuuggccuugc

SEQ ID NO: 1074586 - RNA, 23 nt, Human
aaggccccagggaaaccccacac

SEQ ID NO: 1074587 - RNA, 20 nt, Human
aaguaccccuucggccaggc

SEQ ID NO: 1074588 - RNA, 20 nt, Human
aggagcaggaaaaugucaug

SEQ ID NO: 1074589 - RNA, 19 nt, Human
agugacaagaagggguggu

SEQ ID NO: 1074590 - RNA, 19 nt, Human
agugcaggugaucccuccu

SEQ ID NO: 1074591 - RNA, 20 nt, Human
cacaaggccccagggaaacc

SEQ ID NO: 1074592 - RNA, 21 nt, Human
caccacgggcaaauugcucca

SEQ ID NO: 1074593 - RNA, 20 nt, Human
cagcaaagauggggugggug

SEQ ID NO: 1074594 - RNA, 21 nt, Human
cagcaggcccccgauggcacc

SEQ ID NO: 1074595 - RNA, 18 nt, Human
ccaggcaucaucugcacc

SEQ ID NO: 1074596 - RNA, 21 nt, Human
ccauacagcucuccccaucca

SEQ ID NO: 1074597 - RNA, 22 nt, Human
ccccuucggccaggcauggcuu

SEQ ID NO: 1074598 - RNA, 18 nt, Human
cccuccuccccagaaaca

SEQ ID NO: 1074599 - RNA, 23 nt, Human
ccuggaaguaccccuucggccag

SEQ ID NO: 1074600 - RNA, 24 nt, Human
cgaagagcacaguccuccuccgug

SEQ ID NO: 1074601 - RNA, 20 nt, Human
cucagcuuuggggcugccau

SEQ ID NO: 1074602 - RNA, 18 nt, Human
gagcaggaaaaugucaug

SEQ ID NO: 1074603 - RNA, 20 nt, Human
gaggcuggggguuggaaaac

SEQ ID NO: 1074604 - RNA, 22 nt, Human
ggcuggggguuggaaaacccug

SEQ ID NO: 1074605 - RNA, 18 nt, Human
gggacugaaauuuccccu

SEQ ID NO: 1074606 - RNA, 23 nt, Human
gggugggugggagacagugacaa

SEQ ID NO: 1074607 - RNA, 22 nt, Human
gucaaacugccucauucucagu

SEQ ID NO: 1074608 - RNA, 20 nt, Human
gucauagccucugaccuuau

SEQ ID NO: 1074609 - RNA, 20 nt, Human
ucaaaaagaugcgugucacc

SEQ ID NO: 1074610 - RNA, 21 nt, Human
uccacaucugcccaggcauca

SEQ ID NO: 1074611 - RNA, 20 nt, Human
uccuccccagaaacaagaac

SEQ ID NO: 1074612 - RNA, 21 nt, Human
ugagaaaaaauaguuguagcc

SEQ ID NO: 1074613 - RNA, 22 nt, Human
ugauuuuauuuugugaucugug

SEQ ID NO: 1074614 - RNA, 21 nt, Human
ugcuccagcaggcccccgaug

SEQ ID NO: 1074615 - RNA, 20 nt, Human
uggcuuccacaaggccccuc

SEQ ID NO: 1074616 - RNA, 19 nt, Human
uggggugggugggagacag

SEQ ID NO: 1074617 - RNA, 19 nt, Human
uggggugggugggagacag

SEQ ID NO: 1074618 - RNA, 21 nt, Human
uggggugggugggagacagug

SEQ ID NO: 1074619 - RNA, 22 nt, Human
ugucuuuggccuugcucagcuu

SEQ ID NO: 1074620 - RNA, 24 nt, Human
uuccccugaccuggaaguaccccc

SEQ ID NO: 1074621 - RNA, 18 nt, Human
uugcucagcuuuggggcu

SEQ ID NO: 1074622 - RNA, 19 nt, Human
aagaugccuccaacucgag

SEQ ID NO: 1074623 - RNA, 26 nt, Human
agaucuuagaaacuacuaugaaaaac

SEQ ID NO: 1074624 - RNA, 18 nt, Human
cagaaaugaacauuucug

SEQ ID NO: 1074625 - RNA, 20 nt, Human
ccuccaacucgagagacagg

SEQ ID NO: 1074626 - RNA, 25 nt, Human
ccuccaacucgagagacaggaccgu

SEQ ID NO: 1074627 - RNA, 24 nt, Human
cucuuagccgacaaccaaccaauu

SEQ ID NO: 1074628 - RNA, 20 nt, Human
uaacauagcacauguuuggc

SEQ ID NO: 1074629 - RNA, 23 nt, Human
uagaaacuacuaugaaaaaccau

SEQ ID NO: 1074630 - RNA, 22 nt, Human
ucaguuagcagcuaucuucuuc

SEQ ID NO: 1074631 - RNA, 24 nt, Human
uccaacaaauaaguuccaacacaa

SEQ ID NO: 1074632 - RNA, 25 nt, Human
ugccuccaacucgagagacaggacc

SEQ ID NO: 1074633 - RNA, 22 nt, Human
uucuccaacaaauaaguuccaa

SEQ ID NO: 1074634 - RNA, 19 nt, Human
uugccagaugacuuuugug

SEQ ID NO: 1074635 - RNA, 22 nt, Human
uuggcaccaaaagaucuuagaa

SEQ ID NO: 1074636 - RNA, 24 nt, Human
aacaggaucuacaggagaguggag

SEQ ID NO: 1074637 - RNA, 19 nt, Human
acguuucuccuaagacugc

SEQ ID NO: 1074638 - RNA, 18 nt, Human
agaguggagggccugucu

SEQ ID NO: 1074639 - RNA, 19 nt, Human
auggagagcaaccuucucu

SEQ ID NO: 1074640 - RNA, 19 nt, Human
caggaggacugaauguuug

SEQ ID NO: 1074641 - RNA, 22 nt, Human
cucaugaaacguuucuccuaag

SEQ ID NO: 1074642 - RNA, 21 nt, Human
cuccuaagacugcaucucucc

SEQ ID NO: 1074643 - RNA, 21 nt, Human
cucucuggcuucugcaucacu

SEQ ID NO: 1074644 - RNA, 23 nt, Human
cugcaucucuccuccuggcuuca

SEQ ID NO: 1074645 - RNA, 26 nt, Human
gcuacagcucaugaaacguuucuccu

SEQ ID NO: 1074646 - RNA, 21 nt, Human
uaagacugcaucucuccuccu

SEQ ID NO: 1074647 - RNA, 21 nt, Human
ucacugaguuaggauucagga

SEQ ID NO: 1074648 - RNA, 23 nt, Human
uccgauggagagcaaccuucucu

SEQ ID NO: 1074649 - RNA, 23 nt, Human
ucucucuggcuucugcaucacuu

SEQ ID NO: 1074650 - RNA, 20 nt, Human
ugagaaagacugauagggua

SEQ ID NO: 1074651 - RNA, 21 nt, Human
uuuuagggaggucuccgaaac

SEQ ID NO: 1074652 - RNA, 19 nt, Human
aaacaaaaacaaaaaaccc

SEQ ID NO: 1074653 - RNA, 20 nt, Human
aaacaaaaacaaaaaaccca

SEQ ID NO: 1074654 - RNA, 19 nt, Human
aacauagggagaccccauc

SEQ ID NO: 1074655 - RNA, 20 nt, Human
aacauagggagaccccaucu

SEQ ID NO: 1074656 - RNA, 21 nt, Human
aacauagggagaccccaucuc

SEQ ID NO: 1074657 - RNA, 19 nt, Human
aacauguggagagaccagg

SEQ ID NO: 1074658 - RNA, 22 nt, Human
aagacaggaccaaaggaaggga

SEQ ID NO: 1074659 - RNA, 26 nt, Human
aagcacaccccuccucagggccagcc

SEQ ID NO: 1074660 - RNA, 22 nt, Human
aaugaguucacauuggccaccc

SEQ ID NO: 1074661 - RNA, 24 nt, Human
aauuugaggccagccugggcaaca

SEQ ID NO: 1074662 - RNA, 24 nt, Human
acagagcaagacccugccucaaaa

SEQ ID NO: 1074663 - RNA, 23 nt, Human
acccugccucaaaaacaaaaaca

SEQ ID NO: 1074664 - RNA, 20 nt, Human
acgccacuacccuccagccu

SEQ ID NO: 1074665 - RNA, 24 nt, Human
acgggagcaagcacaccccuccuc

SEQ ID NO: 1074666 - RNA, 24 nt, Human
acuacccuccagccuggaugacag

SEQ ID NO: 1074667 - RNA, 18 nt, Human
agacagaugcaagacagg

SEQ ID NO: 1074668 - RNA, 21 nt, Human
agacagaugcaagacaggacc

SEQ ID NO: 1074669 - RNA, 23 nt, Human
agacaggacaaguucccugcagg

SEQ ID NO: 1074670 - RNA, 20 nt, Human
agcacaccccuccucagggc

SEQ ID NO: 1074671 - RNA, 21 nt, Human
agcacugguggggauccugcc

SEQ ID NO: 1074672 - RNA, 21 nt, Human
agcagagacaagacaggacaa

SEQ ID NO: 1074673 - RNA, 23 nt, Human
agccaggugugguggugccugcc

SEQ ID NO: 1074674 - RNA, 20 nt, Human
agccucggugcaagcagcag

SEQ ID NO: 1074675 - RNA, 24 nt, Human
agccugggcaacauagggagaccc

SEQ ID NO: 1074676 - RNA, 21 nt, Human
agcgagggcuucugagcacug

SEQ ID NO: 1074677 - RNA, 24 nt, Human
agcugggaggaucgcuugagccug

SEQ ID NO: 1074678 - RNA, 20 nt, Human
aggaauuugaggccagccug

SEQ ID NO: 1074679 - RNA, 22 nt, Human
aggcagccagcagggggcgagc

SEQ ID NO: 1074680 - RNA, 20 nt, Human
aggccggggcuuggagccag

SEQ ID NO: 1074681 - RNA, 24 nt, Human
aggcugagcugggaggaucgcuug

SEQ ID NO: 1074682 - RNA, 21 nt, Human
aggcugggagcuggaacaugu

SEQ ID NO: 1074683 - RNA, 24 nt, Human
aguggcucacaucuguaaccccag

SEQ ID NO: 1074684 - RNA, 23 nt, Human
aucucuacaaaaaguuuaaaaaa

SEQ ID NO: 1074685 - RNA, 23 nt, Human
auggcuccaggcagccagcaggg

SEQ ID NO: 1074686 - RNA, 22 nt, Human
caaaaacaaaaacaaaaaaccc

SEQ ID NO: 1074687 - RNA, 24 nt, Human
caaaaacaaaaacaaaaaacccac

SEQ ID NO: 1074688 - RNA, 22 nt, Human
caacauuaagagcugaagauag

SEQ ID NO: 1074689 - RNA, 23 nt, Human
caagacccugccucaaaaacaaa

SEQ ID NO: 1074690 - RNA, 21 nt, Human
caagcacaccccuccucaggg

SEQ ID NO: 1074691 - RNA, 21 nt, Human
cacaccccuccucagggccag

SEQ ID NO: 1074692 - RNA, 19 nt, Human
cacaucuguaaccccagua

SEQ ID NO: 1074693 - RNA, 22 nt, Human
caccaacauuaagagcugaaga

SEQ ID NO: 1074694 - RNA, 23 nt, Human
caccccuccucagggccagccca

SEQ ID NO: 1074695 - RNA, 21 nt, Human
cacgccacuacccuccagccu

SEQ ID NO: 1074696 - RNA, 24 nt, Human
cacuacccuccagccuggaugaca

SEQ ID NO: 1074697 - RNA, 25 nt, Human
cagagcaagacccugccucaaaaac

SEQ ID NO: 1074698 - RNA, 19 nt, Human
cagaugagacccaucccgc

SEQ ID NO: 1074699 - RNA, 21 nt, Human
cagcaagggcugugcucagca

SEQ ID NO: 1074700 - RNA, 20 nt, Human
cagcauaccccacaucccug

SEQ ID NO: 1074701 - RNA, 19 nt, Human
cagccucucgguagccccu

SEQ ID NO: 1074702 - RNA, 19 nt, Human
caggaccugggagguaugg

SEQ ID NO: 1074703 - RNA, 19 nt, Human
caggccccagaccaggaga

SEQ ID NO: 1074704 - RNA, 24 nt, Human
caguacuauaggaggccagggugg

SEQ ID NO: 1074705 - RNA, 23 nt, Human
ccagcauaccccacaucccugcc

SEQ ID NO: 1074706 - RNA, 23 nt, Human
ccagcccagccucucgguagccc

SEQ ID NO: 1074707 - RNA, 25 nt, Human
ccagcccagccucucgguagccccu

SEQ ID NO: 1074708 - RNA, 20 nt, Human
ccaggaaaagugagguucgg

SEQ ID NO: 1074709 - RNA, 19 nt, Human
ccaggccuuucuaggcaga

SEQ ID NO: 1074710 - RNA, 22 nt, Human
cccaccucuggggagaagugca

SEQ ID NO: 1074711 - RNA, 22 nt, Human
cccacuggcauuccugagaauc

SEQ ID NO: 1074712 - RNA, 21 nt, Human
cccagagggguuucucuuggg

SEQ ID NO: 1074713 - RNA, 23 nt, Human
cccagccucggccuucgcaucac

SEQ ID NO: 1074714 - RNA, 21 nt, Human
cccaggguuggggagaggggc

SEQ ID NO: 1074715 - RNA, 20 nt, Human
cccaggucagcaagggcugu

SEQ ID NO: 1074716 - RNA, 18 nt, Human
ccccaggaaaagugaggu

SEQ ID NO: 1074717 - RNA, 19 nt, Human
ccccaggccuuucuaggca

SEQ ID NO: 1074718 - RNA, 18 nt, Human
ccccgaggggcauauuac

SEQ ID NO: 1074719 - RNA, 23 nt, Human
cccgagaggcuggcuuucucucu

SEQ ID NO: 1074720 - RNA, 21 nt, Human
cccuccaacucugcagggccu

SEQ ID NO: 1074721 - RNA, 23 nt, Human
cccuccagccuggaugacagagc

SEQ ID NO: 1074722 - RNA, 18 nt, Human
cccuggggcccagcugca

SEQ ID NO: 1074723 - RNA, 24 nt, Human
ccuccccaccuccaggcccugcag

SEQ ID NO: 1074724 - RNA, 21 nt, Human
ccucuggccuccccaccucca

SEQ ID NO: 1074725 - RNA, 18 nt, Human
ccucuggggagaagugca

SEQ ID NO: 1074726 - RNA, 20 nt, Human
ccugccucaaaaacaaaaac

SEQ ID NO: 1074727 - RNA, 24 nt, Human
ccugggcaacauagggagacccca

SEQ ID NO: 1074728 - RNA, 22 nt, Human
ccuucaggucacuccuguguac

SEQ ID NO: 1074729 - RNA, 26 nt, Human
cgcuggagccucggugcaagcagcag

SEQ ID NO: 1074730 - RNA, 23 nt, Human
cucaaaaacaaaaacaaaaaacc

SEQ ID NO: 1074731 - RNA, 24 nt, Human
cucaaaaacaaaaacaaaaaaccc

SEQ ID NO: 1074732 - RNA, 23 nt, Human
cugccucaaaaacaaaaacaaaa

SEQ ID NO: 1074733 - RNA, 23 nt, Human
cugggagcuggaacauguggaga

SEQ ID NO: 1074734 - RNA, 28 nt, Human
gaagaaaccagcacggaauggcuccagg

SEQ ID NO: 1074735 - RNA, 20 nt, Human
gaccugggagguauggaggc

SEQ ID NO: 1074736 - RNA, 18 nt, Human
gacgggcggaaaaaggga

SEQ ID NO: 1074737 - RNA, 21 nt, Human
gagaagugcaggaccugggag

SEQ ID NO: 1074738 - RNA, 19 nt, Human
gagcugccccuucucagcc

SEQ ID NO: 1074739 - RNA, 20 nt, Human
gaggccagggugggaggaug

SEQ ID NO: 1074740 - RNA, 21 nt, Human
gagggcuucugagcacuggug

SEQ ID NO: 1074741 - RNA, 22 nt, Human
gagggcuucugagcacuggugg

SEQ ID NO: 1074742 - RNA, 23 nt, Human
gaucgcuugagccugggagguca

SEQ ID NO: 1074743 - RNA, 18 nt, Human
gcaggaaggagugaggcc

SEQ ID NO: 1074744 - RNA, 23 nt, Human
gccagcaggacacggcuuuccag

SEQ ID NO: 1074745 - RNA, 24 nt, Human
gccugggaggucaaggcugcagug

SEQ ID NO: 1074746 - RNA, 19 nt, Human
gcgaagaaaccagcacgga

SEQ ID NO: 1074747 - RNA, 18 nt, Human
ggacaaguucccugcagg

SEQ ID NO: 1074748 - RNA, 20 nt, Human
ggagaagugcaggaccuggg

SEQ ID NO: 1074749 - RNA, 22 nt, Human
ggagcaagcacaccccuccuca

SEQ ID NO: 1074750 - RNA, 19 nt, Human
ggaguaggcagguugaagg

SEQ ID NO: 1074751 - RNA, 24 nt, Human
ggaguaggcagguugaagggcuag

SEQ ID NO: 1074752 - RNA, 24 nt, Human
ggcuguguuugugaccacagugag

SEQ ID NO: 1074753 - RNA, 18 nt, Human
gggcccuggggcccagcu

SEQ ID NO: 1074754 - RNA, 23 nt, Human
gggccugugauuuaguccacgcu

SEQ ID NO: 1074755 - RNA, 24 nt, Human
gggcgaaguggcucacaucuguaa

SEQ ID NO: 1074756 - RNA, 20 nt, Human
ggguugggccgggcccuggg

SEQ ID NO: 1074757 - RNA, 21 nt, Human
gguuggggagaggggccccag

SEQ ID NO: 1074758 - RNA, 25 nt, Human
uaaugaguucacauuggccacccua

SEQ ID NO: 1074759 - RNA, 20 nt, Human
uagccaggugugguggugcc

SEQ ID NO: 1074760 - RNA, 22 nt, Human
uagccccuggagaauccucaca

SEQ ID NO: 1074761 - RNA, 20 nt, Human
uauaggaggccaggguggga

SEQ ID NO: 1074762 - RNA, 19 nt, Human
ucaagacagaugcaagaca

SEQ ID NO: 1074763 - RNA, 23 nt, Human
ucacgccacuacccuccagccug

SEQ ID NO: 1074764 - RNA, 18 nt, Human
ucagcaggcugagcuggg

SEQ ID NO: 1074765 - RNA, 20 nt, Human
ucagcaggcugggagcugga

SEQ ID NO: 1074766 - RNA, 24 nt, Human
uccagccuggaugacagagcaaga

SEQ ID NO: 1074767 - RNA, 24 nt, Human
ucccaccccaugcauuucccagaa

SEQ ID NO: 1074768 - RNA, 25 nt, Human
ucccaccccaugcauuucccagaag

SEQ ID NO: 1074769 - RNA, 21 nt, Human
uccccaccuccaggcccugca

SEQ ID NO: 1074770 - RNA, 20 nt, Human
ucccugaguaagcaucagca

SEQ ID NO: 1074771 - RNA, 19 nt, Human
uccucagggccagcccagg

SEQ ID NO: 1074772 - RNA, 18 nt, Human
ucgcuugagccugggagg

SEQ ID NO: 1074773 - RNA, 23 nt, Human
ucgcuugagccugggaggucaag

SEQ ID NO: 1074774 - RNA, 23 nt, Human
ucuaggggaagagccacuccguc

SEQ ID NO: 1074775 - RNA, 18 nt, Human
ucucagcccuccaacucu

SEQ ID NO: 1074776 - RNA, 22 nt, Human
ucuuccugaaaacucccugccu

SEQ ID NO: 1074777 - RNA, 20 nt, Human
ugacagagcaagacccugcc

SEQ ID NO: 1074778 - RNA, 20 nt, Human
ugaccacagugaggggccuu

SEQ ID NO: 1074779 - RNA, 20 nt, Human
ugacugcccugccucuggcc

SEQ ID NO: 1074780 - RNA, 23 nt, Human
ugagcccaggaauuugaggccag

SEQ ID NO: 1074781 - RNA, 24 nt, Human
ugagccugggaggucaaggcugca

SEQ ID NO: 1074782 - RNA, 18 nt, Human
ugagcugggaggaucgcu

SEQ ID NO: 1074783 - RNA, 20 nt, Human
ugagcugggaggaucgcuug

SEQ ID NO: 1074784 - RNA, 23 nt, Human
ugagcugggaggaucgcuugagc

SEQ ID NO: 1074785 - RNA, 24 nt, Human
ugagcugggaggaucgcuugagcc

SEQ ID NO: 1074786 - RNA, 21 nt, Human
ugcagugagcccuggucacgc

SEQ ID NO: 1074787 - RNA, 18 nt, Human
ugccucaaaaacaaaaac

SEQ ID NO: 1074788 - RNA, 23 nt, Human
ugccucagcugggcgaaguggcu

SEQ ID NO: 1074789 - RNA, 22 nt, Human
ugccucuggccuccccaccucc

SEQ ID NO: 1074790 - RNA, 24 nt, Human
uggagccagggucucccagagggg

SEQ ID NO: 1074791 - RNA, 23 nt, Human
uggagccucggugcaagcagcag

SEQ ID NO: 1074792 - RNA, 21 nt, Human
uggcucacaucuguaacccca

SEQ ID NO: 1074793 - RNA, 22 nt, Human
uggcucacaucuguaaccccag

SEQ ID NO: 1074794 - RNA, 23 nt, Human
uggcucacaucuguaaccccagu

SEQ ID NO: 1074795 - RNA, 24 nt, Human
uggcuugagcccaggaauuugagg

SEQ ID NO: 1074796 - RNA, 18 nt, Human
ugggaaagccacuaggca

SEQ ID NO: 1074797 - RNA, 20 nt, Human
ugggagcuggaacaugugga

SEQ ID NO: 1074798 - RNA, 24 nt, Human
ugggaggauggcuugagcccagga

SEQ ID NO: 1074799 - RNA, 22 nt, Human
ugggcaacauagggagacccca

SEQ ID NO: 1074800 - RNA, 19 nt, Human
uggggagaagugcaggacc

SEQ ID NO: 1074801 - RNA, 18 nt, Human
uggguguggcacucggcc

SEQ ID NO: 1074802 - RNA, 23 nt, Human
uggucagcaggcugagcugggag

SEQ ID NO: 1074803 - RNA, 24 nt, Human
ugguggugccugccuaucauccca

SEQ ID NO: 1074804 - RNA, 19 nt, Human
ugucccaccccaugcauuu

SEQ ID NO: 1074805 - RNA, 26 nt, Human
ugugaccucucccagccucggccuuc

SEQ ID NO: 1074806 - RNA, 18 nt, Human
ugugacugcccugccucu

SEQ ID NO: 1074807 - RNA, 21 nt, Human
uuagccaggugugguggugcc

SEQ ID NO: 1074808 - RNA, 21 nt, Human
uucaagacagaugcaagacag

SEQ ID NO: 1074809 - RNA, 18 nt, Human
uuccuuuuaaugaguuca

SEQ ID NO: 1074810 - RNA, 19 nt, Human
uuggccaccccaggccuuu

SEQ ID NO: 1074811 - RNA, 19 nt, Human
uuuuucggcagcugccugg

SEQ ID NO: 1074812 - RNA, 24 nt, Human
acagugcccaccccugguauuccc

SEQ ID NO: 1074813 - RNA, 22 nt, Human
caggaacccucucuugaggucu

SEQ ID NO: 1074814 - RNA, 23 nt, Human
cauagggacccucuggcacagcc

SEQ ID NO: 1074815 - RNA, 18 nt, Human
ccugcuccugcucugaaa

SEQ ID NO: 1074816 - RNA, 22 nt, Human
gacucacacucuccucuggccu

SEQ ID NO: 1074817 - RNA, 20 nt, Human
gcuccugcucugaaagugag

SEQ ID NO: 1074818 - RNA, 20 nt, Human
ggcauuugaagucaaagcug

SEQ ID NO: 1074819 - RNA, 23 nt, Human
guggcauuugaagucaaagcugg

SEQ ID NO: 1074820 - RNA, 23 nt, Human
uaucuuggcucuaaucaguuuca

SEQ ID NO: 1074821 - RNA, 19 nt, Human
ucacacucuccucuggccu

SEQ ID NO: 1074822 - RNA, 22 nt, Human
ucauuugguuggcuaucuuggc

SEQ ID NO: 1074823 - RNA, 22 nt, Human
ucucuugacagugcccaccccu

SEQ ID NO: 1074824 - RNA, 24 nt, Human
ucucuugacagugcccaccccugg

SEQ ID NO: 1074825 - RNA, 23 nt, Human
ucuuccugaagucauuugguugg

SEQ ID NO: 1074826 - RNA, 18 nt, Human
ugaagccugaggucuucc

SEQ ID NO: 1074827 - RNA, 23 nt, Human
ugagaugauaaugaagccugagg

SEQ ID NO: 1074828 - RNA, 19 nt, Human
ugaggucuuccugaaguca

SEQ ID NO: 1074829 - RNA, 22 nt, Human
ugaggucuuccugaagucauuu

SEQ ID NO: 1074830 - RNA, 23 nt, Human
uucagcuggucuugaaucccuuu

SEQ ID NO: 1074831 - RNA, 23 nt, Human
aaaaaaaacauggaagucaucau

SEQ ID NO: 1074832 - RNA, 19 nt, Human
acucccucagcccuggaga

SEQ ID NO: 1074833 - RNA, 22 nt, Human
agcuggaacugccuguccgcgu

SEQ ID NO: 1074834 - RNA, 23 nt, Human
cacggaaacuccgugucugcaga

SEQ ID NO: 1074835 - RNA, 22 nt, Human
caucaugaguuuguuucugggg

SEQ ID NO: 1074836 - RNA, 22 nt, Human
cccgggcuccaggaccgucccc

SEQ ID NO: 1074837 - RNA, 19 nt, Human
ccgcguggacccgcuccuc

SEQ ID NO: 1074838 - RNA, 19 nt, Human
ccucagcccuggagacuuc

SEQ ID NO: 1074839 - RNA, 20 nt, Human
cgccguccgacuccggagcc

SEQ ID NO: 1074840 - RNA, 22 nt, Human
cucccucagcccuggagacuuc

SEQ ID NO: 1074841 - RNA, 21 nt, Human
cuccucuggcacggaaacucc

SEQ ID NO: 1074842 - RNA, 19 nt, Human
cucgcacccuucccgggcu

SEQ ID NO: 1074843 - RNA, 19 nt, Human
cucuuguuccuguucuugu

SEQ ID NO: 1074844 - RNA, 23 nt, Human
cuggaacugccuguccgcgugga

SEQ ID NO: 1074845 - RNA, 21 nt, Human
gagccggggacggagaggaga

SEQ ID NO: 1074846 - RNA, 19 nt, Human
gcagacucccucagcccug

SEQ ID NO: 1074847 - RNA, 20 nt, Human
ggaggagagagagcgcgggc

SEQ ID NO: 1074848 - RNA, 22 nt, Human
gggaaaggaaaauucuccaugu

SEQ ID NO: 1074849 - RNA, 21 nt, Human
guccgcguggacccgcuccuc

SEQ ID NO: 1074850 - RNA, 18 nt, Human
uaaaaaagcuuacugaaa

SEQ ID NO: 1074851 - RNA, 23 nt, Human
uaaaaaagcuuacugaaaauuag

SEQ ID NO: 1074852 - RNA, 18 nt, Human
uaggagguggcaggucuc

SEQ ID NO: 1074853 - RNA, 22 nt, Human
ucccgggcuccaggaccguccc

SEQ ID NO: 1074854 - RNA, 23 nt, Human
ucccucagcccuggagacuucug

SEQ ID NO: 1074855 - RNA, 19 nt, Human
ucuccgggacugcugcugg

SEQ ID NO: 1074856 - RNA, 22 nt, Human
ucucuuguuccuguucuugucc

SEQ ID NO: 1074857 - RNA, 19 nt, Human
ucugcagacucccucagcc

SEQ ID NO: 1074858 - RNA, 20 nt, Human
ucugcagacucccucagccc

SEQ ID NO: 1074859 - RNA, 24 nt, Human
ucugcagacucccucagcccugga

SEQ ID NO: 1074860 - RNA, 23 nt, Human
ugguaagacugucucuuguuccu

SEQ ID NO: 1074861 - RNA, 22 nt, Human
ugucugcagacucccucagccc

SEQ ID NO: 1074862 - RNA, 23 nt, Human
uuauucagaaauaaaaaagcuua

SEQ ID NO: 1074863 - RNA, 19 nt, Human
uucuuguccauugcugcau

SEQ ID NO: 1074864 - RNA, 23 nt, Human
aaaaaaaacauggaagucaucau

SEQ ID NO: 1074865 - RNA, 22 nt, Human
caucaugaguuuguuucugggg

SEQ ID NO: 1074866 - RNA, 22 nt, Human
gggaaaggaaaauucuccaugu

SEQ ID NO: 1074867 - RNA, 18 nt, Human
uaggagguggcaggucuc

SEQ ID NO: 1074868 - RNA, 19 nt, Human
aaccagaggcacuaaaacu

SEQ ID NO: 1074869 - RNA, 19 nt, Human
agaggcacuaaaacugcca

SEQ ID NO: 1074870 - RNA, 18 nt, Human
agccaugcaugguggggc

SEQ ID NO: 1074871 - RNA, 22 nt, Human
agggaagaaaaccagaggcacu

SEQ ID NO: 1074872 - RNA, 19 nt, Human
aucuacaugagaugcucac

SEQ ID NO: 1074873 - RNA, 25 nt, Human
ccaauuuuaauccuggcuccagcau

SEQ ID NO: 1074874 - RNA, 18 nt, Human
cggcagccugugcagugc

SEQ ID NO: 1074875 - RNA, 20 nt, Human
cucacaguaggagagaggga

SEQ ID NO: 1074876 - RNA, 20 nt, Human
cuggagggagggagugcugg

SEQ ID NO: 1074877 - RNA, 20 nt, Human
cuuuauacuuucgucuuccu

SEQ ID NO: 1074878 - RNA, 19 nt, Human
gagugcugggaaccuuggg

SEQ ID NO: 1074879 - RNA, 20 nt, Human
gagugcugggaaccuugggc

SEQ ID NO: 1074880 - RNA, 23 nt, Human
gaucuuuauacuuucgucuuccu

SEQ ID NO: 1074881 - RNA, 23 nt, Human
ggagggagugcugggaaccuugg

SEQ ID NO: 1074882 - RNA, 20 nt, Human
gggcucuggccuggagccag

SEQ ID NO: 1074883 - RNA, 20 nt, Human
uacuuucgucuuccuaagug

SEQ ID NO: 1074884 - RNA, 20 nt, Human
ucuggaaggaacuauacagg

SEQ ID NO: 1074885 - RNA, 20 nt, Human
ugcuggagggagggagugcu

SEQ ID NO: 1074886 - RNA, 21 nt, Human
ugcuggagggagggagugcug

SEQ ID NO: 1074887 - RNA, 20 nt, Human
uggaaggaacuauacaggca

SEQ ID NO: 1074888 - RNA, 20 nt, Human
uggggcugcuuccugcccaa

SEQ ID NO: 1074889 - RNA, 23 nt, Human
ugucccagucuucuagaucuuua

SEQ ID NO: 1074890 - RNA, 23 nt, Human
uguggcuaagcagacaaccacau

SEQ ID NO: 1074891 - RNA, 23 nt, Human
uguuguaugacuuggugaaaauu

SEQ ID NO: 1074892 - RNA, 21 nt, Human
uuccuaagugucagggaagaa

SEQ ID NO: 1074893 - RNA, 20 nt, Human
uugcuggagggagggagugc

SEQ ID NO: 1074894 - RNA, 23 nt, Human
aaauaccaagaggccagagagcu

SEQ ID NO: 1074895 - RNA, 23 nt, Human
aaccacagcuacaacuaaauuca

SEQ ID NO: 1074896 - RNA, 22 nt, Human
aagaaaauaccaagaggccaga

SEQ ID NO: 1074897 - RNA, 18 nt, Human
aagaggccagagagcuca

SEQ ID NO: 1074898 - RNA, 25 nt, Human
aagccagaggcagguggcuccaggg

SEQ ID NO: 1074899 - RNA, 19 nt, Human
aagucauggguucuuggau

SEQ ID NO: 1074900 - RNA, 20 nt, Human
aagucugucuguagcagucu

SEQ ID NO: 1074901 - RNA, 18 nt, Human
aauaccaagaggccagag

SEQ ID NO: 1074902 - RNA, 22 nt, Human
acagacacaaaagaaaauacca

SEQ ID NO: 1074903 - RNA, 23 nt, Human
acagacacaaaagaaaauaccaa

SEQ ID NO: 1074904 - RNA, 21 nt, Human
accagcaucuccucagggccg

SEQ ID NO: 1074905 - RNA, 20 nt, Human
acccugccucgcccccaccu

SEQ ID NO: 1074906 - RNA, 19 nt, Human
accuguguagcccuuccuc

SEQ ID NO: 1074907 - RNA, 21 nt, Human
agaaaauaccaagaggccagu

SEQ ID NO: 1074908 - RNA, 21 nt, Human
agacacaaaagaaaauaccaa

SEQ ID NO: 1074909 - RNA, 22 nt, Human
agacugcccugcaggggugggg

SEQ ID NO: 1074910 - RNA, 22 nt, Human
agccagucccccggccuuccug

SEQ ID NO: 1074911 - RNA, 19 nt, Human
aggagcagugagggcagcc

SEQ ID NO: 1074912 - RNA, 18 nt, Human
aggcagguggcuccaggg

SEQ ID NO: 1074913 - RNA, 23 nt, Human
agguuccuucuguguuuccuccu

SEQ ID NO: 1074914 - RNA, 23 nt, Human
augaagccagaggcagguggcuc

SEQ ID NO: 1074915 - RNA, 21 nt, Human
auggagcacugacggaugaca

SEQ ID NO: 1074916 - RNA, 26 nt, Human
auggagcacugacggaugacacgugc

SEQ ID NO: 1074917 - RNA, 18 nt, Human
auggcgaugaggacgaca

SEQ ID NO: 1074918 - RNA, 19 nt, Human
caaagcccugaggugcagg

SEQ ID NO: 1074919 - RNA, 19 nt, Human
caacucaauuuccuccuca

SEQ ID NO: 1074920 - RNA, 21 nt, Human
cacagugacaccuguguagcc

SEQ ID NO: 1074921 - RNA, 27 nt, Human
cacagugacaccuguguagcccuuccu

SEQ ID NO: 1074922 - RNA, 20 nt, Human
caccaugcaugggugggggc

SEQ ID NO: 1074923 - RNA, 23 nt, Human
cagaguggagcacagacccugcc

SEQ ID NO: 1074924 - RNA, 21 nt, Human
cagcucacaugaagccagagg

SEQ ID NO: 1074925 - RNA, 21 nt, Human
cagggccccagucucccuggg

SEQ ID NO: 1074926 - RNA, 18 nt, Human
cagguccgggaugucacc

SEQ ID NO: 1074927 - RNA, 18 nt, Human
cauccccgcggagcuggu

SEQ ID NO: 1074928 - RNA, 21 nt, Human
cauccccgcggagcugguggc

SEQ ID NO: 1074929 - RNA, 22 nt, Human
ccagcagugcagcacaggggag

SEQ ID NO: 1074930 - RNA, 20 nt, Human
ccagucccccggccuuccug

SEQ ID NO: 1074931 - RNA, 22 nt, Human
cccaccucagggagcucagagc

SEQ ID NO: 1074932 - RNA, 18 nt, Human
cccaugcugauucccagg

SEQ ID NO: 1074933 - RNA, 19 nt, Human
cccaugcugauucccaggg

SEQ ID NO: 1074934 - RNA, 20 nt, Human
ccccgcggagcugguggcag

SEQ ID NO: 1074935 - RNA, 25 nt, Human
ccccuugucauuaucacccuccuca

SEQ ID NO: 1074936 - RNA, 18 nt, Human
cccugaggugcagggccc

SEQ ID NO: 1074937 - RNA, 23 nt, Human
ccucagaguggagcacagacccu

SEQ ID NO: 1074938 - RNA, 19 nt, Human
ccucccucagaagccuggg

SEQ ID NO: 1074939 - RNA, 23 nt, Human
ccuguggucaucguggcuccccu

SEQ ID NO: 1074940 - RNA, 24 nt, Human
ccuguggucaucguggcuccccuu

SEQ ID NO: 1074941 - RNA, 23 nt, Human
ccuuccugcguggauacgggaau

SEQ ID NO: 1074942 - RNA, 20 nt, Human
ccuugucugaccccagcagu

SEQ ID NO: 1074943 - RNA, 19 nt, Human
cgcagguuccuucuguguu

SEQ ID NO: 1074944 - RNA, 22 nt, Human
cgugcacauggcgaugaggacg

SEQ ID NO: 1074945 - RNA, 23 nt, Human
cucccaugcugauucccagggcu

SEQ ID NO: 1074946 - RNA, 25 nt, Human
gaagcagagaggcagcuacugguuc

SEQ ID NO: 1074947 - RNA, 20 nt, Human
gacagggcuuccacgcagac

SEQ ID NO: 1074948 - RNA, 24 nt, Human
gacugcccugcagggguggggugg

SEQ ID NO: 1074949 - RNA, 19 nt, Human
gagaagacagacacaaaag

SEQ ID NO: 1074950 - RNA, 20 nt, Human
gagcacagacccugccucgc

SEQ ID NO: 1074951 - RNA, 22 nt, Human
gagccgggggcacaucagagga

SEQ ID NO: 1074952 - RNA, 19 nt, Human
gccacaggauggcugccac

SEQ ID NO: 1074953 - RNA, 19 nt, Human
gcuuggauuucuuucuucu

SEQ ID NO: 1074954 - RNA, 19 nt, Human
ggagcacugcauggagcac

SEQ ID NO: 1074955 - RNA, 21 nt, Human
ggagccagucccccggccuuc

SEQ ID NO: 1074956 - RNA, 19 nt, Human
ggaggcgacauggugugug

SEQ ID NO: 1074957 - RNA, 23 nt, Human
ggcacagugacaccuguguagcc

SEQ ID NO: 1074958 - RNA, 23 nt, Human
ggggugggcacagugacaccugu

SEQ ID NO: 1074959 - RNA, 19 nt, Human
guggagcacagacccugcc

SEQ ID NO: 1074960 - RNA, 20 nt, Human
guggagcacugcauggagca

SEQ ID NO: 1074961 - RNA, 21 nt, Human
guguagaugaggaagcagaga

SEQ ID NO: 1074962 - RNA, 18 nt, Human
uagaaugcagggcaauga

SEQ ID NO: 1074963 - RNA, 21 nt, Human
uaguuaacuuguccgaggcuu

SEQ ID NO: 1074964 - RNA, 21 nt, Human
ucagcaaauggcgagaucucu

SEQ ID NO: 1074965 - RNA, 23 nt, Human
ucccagaccuggauccaaagccc

SEQ ID NO: 1074966 - RNA, 18 nt, Human
ucccucagaagccugggc

SEQ ID NO: 1074967 - RNA, 19 nt, Human
ucccucagaagccugggcu

SEQ ID NO: 1074968 - RNA, 22 nt, Human
ucccugggugcccccaaggucc

SEQ ID NO: 1074969 - RNA, 24 nt, Human
ucccugggugcccccaagguccug

SEQ ID NO: 1074970 - RNA, 22 nt, Human
ucugaccccagcagugcagcac

SEQ ID NO: 1074971 - RNA, 23 nt, Human
ucugccugggguaaacccuaugu

SEQ ID NO: 1074972 - RNA, 18 nt, Human
ucuguagcagucucccua

SEQ ID NO: 1074973 - RNA, 24 nt, Human
ucuugggcacuuccaacucaauuu

SEQ ID NO: 1074974 - RNA, 19 nt, Human
ucuuucuuuugaagucaug

SEQ ID NO: 1074975 - RNA, 22 nt, Human
ugacggaugacacgugcacaug

SEQ ID NO: 1074976 - RNA, 18 nt, Human
ugagaagacagacacaaa

SEQ ID NO: 1074977 - RNA, 23 nt, Human
ugagaagacagacacaaaagaaa

SEQ ID NO: 1074978 - RNA, 24 nt, Human
ugagaagacagacacaaaagaaaa

SEQ ID NO: 1074979 - RNA, 20 nt, Human
ugaggacaaagguuucuuuc

SEQ ID NO: 1074980 - RNA, 18 nt, Human
ugagggcagcacguccug

SEQ ID NO: 1074981 - RNA, 21 nt, Human
ugagggcagcacguccuggag

SEQ ID NO: 1074982 - RNA, 19 nt, Human
ugcccugcaggcaucgggg

SEQ ID NO: 1074983 - RNA, 24 nt, Human
ugcucagccuugagccgggggcac

SEQ ID NO: 1074984 - RNA, 19 nt, Human
uggauccaaagcccugagg

SEQ ID NO: 1074985 - RNA, 23 nt, Human
uggauuucuuucuucugccuccc

SEQ ID NO: 1074986 - RNA, 23 nt, Human
uggcgaugaggacgacaccuccu

SEQ ID NO: 1074987 - RNA, 21 nt, Human
ugggucucaugcccuuaugag

SEQ ID NO: 1074988 - RNA, 19 nt, Human
ugggugcccccaagguccu

SEQ ID NO: 1074989 - RNA, 21 nt, Human
ugggugcccccaagguccugg

SEQ ID NO: 1074990 - RNA, 19 nt, Human
ugggugggggccggguccc

SEQ ID NO: 1074991 - RNA, 18 nt, Human
uggguucuuggauggagc

SEQ ID NO: 1074992 - RNA, 21 nt, Human
uguagcccuuccucugccuga

SEQ ID NO: 1074993 - RNA, 22 nt, Human
ugucugaccccagcagugcagc

SEQ ID NO: 1074994 - RNA, 19 nt, Human
ugucuguagcagucucccu

SEQ ID NO: 1074995 - RNA, 23 nt, Human
uguguucgaacaccugcugcucc

SEQ ID NO: 1074996 - RNA, 18 nt, Human
uugccuguuaccaaauuu

SEQ ID NO: 1074997 - RNA, 23 nt, Human
uuucagguuguccuccagccagc

SEQ ID NO: 1074998 - RNA, 24 nt, Human
aaaagcugaacagacugaaaaagc

SEQ ID NO: 1074999 - RNA, 22 nt, Human
aaaccacuguccccagaacugg

SEQ ID NO: 1075000 - RNA, 18 nt, Human
aaccaugucguugucccc

SEQ ID NO: 1075001 - RNA, 23 nt, Human
aagucuggaaguuaaagauccac

SEQ ID NO: 1075002 - RNA, 23 nt, Human
agcaaaccacuguccccagaacu

SEQ ID NO: 1075003 - RNA, 22 nt, Human
agcagaagcccugggcagcagc

SEQ ID NO: 1075004 - RNA, 19 nt, Human
aggcgcgggccccgccgcu

SEQ ID NO: 1075005 - RNA, 18 nt, Human
agguaccggagcagaagc

SEQ ID NO: 1075006 - RNA, 19 nt, Human
auugcaauuccauccuagc

SEQ ID NO: 1075007 - RNA, 21 nt, Human
caaguaaaaagcugaacagac

SEQ ID NO: 1075008 - RNA, 21 nt, Human
cacuguccccagaacuggaga

SEQ ID NO: 1075009 - RNA, 21 nt, Human
cagagcgggcaagucuggaag

SEQ ID NO: 1075010 - RNA, 21 nt, Human
caggcgacgagagcgcuucuc

SEQ ID NO: 1075011 - RNA, 23 nt, Human
caggcgacgagagcgcuucuccc

SEQ ID NO: 1075012 - RNA, 24 nt, Human
cauuauauauaucaucaucuuaua

SEQ ID NO: 1075013 - RNA, 24 nt, Human
ccagaacuggagaaaccggcagga

SEQ ID NO: 1075014 - RNA, 19 nt, Human
ccagagugccggaggcgca

SEQ ID NO: 1075015 - RNA, 21 nt, Human
ccccagaacuggagaaaccuc

SEQ ID NO: 1075016 - RNA, 19 nt, Human
ccuguacauagauauaugu

SEQ ID NO: 1075017 - RNA, 19 nt, Human
cgcuggggggaggaggcgc

SEQ ID NO: 1075018 - RNA, 24 nt, Human
cgggaaccaugucguuguccccuc

SEQ ID NO: 1075019 - RNA, 23 nt, Human
cuagcaaguaaaaagcugaacag

SEQ ID NO: 1075020 - RNA, 20 nt, Human
cuccuuggauccauaaagga

SEQ ID NO: 1075021 - RNA, 19 nt, Human
cugggcagcagccucugcc

SEQ ID NO: 1075022 - RNA, 21 nt, Human
gaaaaagcaagucuccuugga

SEQ ID NO: 1075023 - RNA, 18 nt, Human
gaacuggagaaaccggca

SEQ ID NO: 1075024 - RNA, 23 nt, Human
gaacuggagaaaccggcaggaga

SEQ ID NO: 1075025 - RNA, 21 nt, Human
gacauuccucuaucucauggg

SEQ ID NO: 1075026 - RNA, 22 nt, Human
gagcaaaccacuguccccagaa

SEQ ID NO: 1075027 - RNA, 19 nt, Human
gcaaaccacuguccccaga

SEQ ID NO: 1075028 - RNA, 20 nt, Human
gccccgccgcuccggccucg

SEQ ID NO: 1075029 - RNA, 20 nt, Human
gcccugggcagcagccucug

SEQ ID NO: 1075030 - RNA, 28 nt, Human
ggauuucuuucacauaugggcacucuuc

SEQ ID NO: 1075031 - RNA, 20 nt, Human
ggcgcagagcgggcaagucu

SEQ ID NO: 1075032 - RNA, 19 nt, Human
gggaagacagauauauucu

SEQ ID NO: 1075033 - RNA, 18 nt, Human
gggggaggaggcgcgggc

SEQ ID NO: 1075034 - RNA, 22 nt, Human
uaaaaagcugaacagacugaaa

SEQ ID NO: 1075035 - RNA, 19 nt, Human
uaaaauuaaaguguggaac

SEQ ID NO: 1075036 - RNA, 19 nt, Human
uacauagauauauguacac

SEQ ID NO: 1075037 - RNA, 20 nt, Human
uacauuguucccauuaaaau

SEQ ID NO: 1075038 - RNA, 21 nt, Human
uaccggagcagaagcccuggg

SEQ ID NO: 1075039 - RNA, 20 nt, Human
uauauguacacauguauaua

SEQ ID NO: 1075040 - RNA, 18 nt, Human
uauauguauauauauaau

SEQ ID NO: 1075041 - RNA, 26 nt, Human
uaucaucaucuuauauguauauauau

SEQ ID NO: 1075042 - RNA, 24 nt, Human
ucacaagguaccggagcagaagcc

SEQ ID NO: 1075043 - RNA, 20 nt, Human
ucagggcaggaacagggaau

SEQ ID NO: 1075044 - RNA, 25 nt, Human
ucagugauugaaauuguuucagggc

SEQ ID NO: 1075045 - RNA, 21 nt, Human
ucaucuuauauguauauauau

SEQ ID NO: 1075046 - RNA, 19 nt, Human
uccauaaaggaagcgaggu

SEQ ID NO: 1075047 - RNA, 18 nt, Human
uccccagaacuggagaaa

SEQ ID NO: 1075048 - RNA, 24 nt, Human
ucucauggggaaacugcuaggcag

SEQ ID NO: 1075049 - RNA, 20 nt, Human
ugaaauacguagacauuccu

SEQ ID NO: 1075050 - RNA, 18 nt, Human
ugggcacucaguaaacau

SEQ ID NO: 1075051 - RNA, 18 nt, Human
ugggcagcagccucugcc

SEQ ID NO: 1075052 - RNA, 19 nt, Human
uggggaaacugcuaggcag

SEQ ID NO: 1075053 - RNA, 19 nt, Human
uggggggaggaggcgcggg

SEQ ID NO: 1075054 - RNA, 22 nt, Human
uguacacauguauauauuuaua

SEQ ID NO: 1075055 - RNA, 24 nt, Human
uguacacauguauauauuuauaug

SEQ ID NO: 1075056 - RNA, 28 nt, Human
uguacacauguauauauuuauauguaua

SEQ ID NO: 1075057 - RNA, 23 nt, Human
uguacauagauauauguacacau

SEQ ID NO: 1075058 - RNA, 22 nt, Human
uguauaaaauuaaaguguggaa

SEQ ID NO: 1075059 - RNA, 21 nt, Human
uguauauauauaauaccccuc

SEQ ID NO: 1075060 - RNA, 18 nt, Human
uuauauguauauauauaa

SEQ ID NO: 1075061 - RNA, 18 nt, Human
uuccugucgaagaagcuu

SEQ ID NO: 1075062 - RNA, 21 nt, Human
uuccuuguguguccagcuauc

SEQ ID NO: 1075063 - RNA, 20 nt, Human
ccagaaggcuacauguagua

SEQ ID NO: 1075064 - RNA, 19 nt, Human
cugcaaggaacuuguuccu

SEQ ID NO: 1075065 - RNA, 23 nt, Human
gaggaaggguauaguaaaaauac

SEQ ID NO: 1075066 - RNA, 19 nt, Human
uaaaaauacaagucauaaa

SEQ ID NO: 1075067 - RNA, 20 nt, Human
uaauggugggagagauuucu

SEQ ID NO: 1075068 - RNA, 18 nt, Human
uauaauggugggagagau

SEQ ID NO: 1075069 - RNA, 23 nt, Human
ucugggcacauauaucccagaag

SEQ ID NO: 1075070 - RNA, 19 nt, Human
ucugugguucugagacuca

SEQ ID NO: 1075071 - RNA, 18 nt, Human
ugcuucucccucugggca

SEQ ID NO: 1075072 - RNA, 19 nt, Human
ugcuucucccucugggcac

SEQ ID NO: 1075073 - RNA, 22 nt, Human
aaauacauccaucaaggggcac

SEQ ID NO: 1075074 - RNA, 21 nt, Human
aggaggagcccuggaguggca

SEQ ID NO: 1075075 - RNA, 30 nt, Human
cagcaugagaacagacaaauacauccaucu

SEQ ID NO: 1075076 - RNA, 21 nt, Human
caucaaggggcacucacaggc

SEQ ID NO: 1075077 - RNA, 24 nt, Human
cuccacagccucagcucucuuaaa

SEQ ID NO: 1075078 - RNA, 19 nt, Human
gaggaggagcccuggagug

SEQ ID NO: 1075079 - RNA, 22 nt, Human
gaugaggaggagcccuggagug

SEQ ID NO: 1075080 - RNA, 19 nt, Human
uagcagcaugagaacagac

SEQ ID NO: 1075081 - RNA, 25 nt, Human
ugagaacagacaaauacauccauca

SEQ ID NO: 1075082 - RNA, 27 nt, Human
uggcagggaaauaaggauggaggguga

SEQ ID NO: 1075083 - RNA, 21 nt, Human
cucuaaggagcaggugaaaga

SEQ ID NO: 1075084 - RNA, 18 nt, Human
uaaggagcaggugaaaga

SEQ ID NO: 1075085 - RNA, 19 nt, Human
uaaggagcaggugaaagag

SEQ ID NO: 1075086 - RNA, 18 nt, Human
uggcugggaugcuucuug

SEQ ID NO: 1075087 - RNA, 18 nt, Human
ugggaugcuucuuggaac

SEQ ID NO: 1075088 - RNA, 23 nt, Human
aaaaaacacaggagagaacagga

SEQ ID NO: 1075089 - RNA, 25 nt, Human
aaaaacacaggagagaaccgguacc

SEQ ID NO: 1075090 - RNA, 20 nt, Human
aaacauucuugucaaaaaua

SEQ ID NO: 1075091 - RNA, 20 nt, Human
aaacucaggcugucuuggca

SEQ ID NO: 1075092 - RNA, 25 nt, Human
aagaacagagacauuugucuuccac

SEQ ID NO: 1075093 - RNA, 24 nt, Human
aaugcugaaaaaacacaggagaga

SEQ ID NO: 1075094 - RNA, 20 nt, Human
acaggagagaacaggacaca

SEQ ID NO: 1075095 - RNA, 20 nt, Human
acucuuaaagggccaaagaa

SEQ ID NO: 1075096 - RNA, 20 nt, Human
acugccgcucaucacgcacu

SEQ ID NO: 1075097 - RNA, 22 nt, Human
agaacagagacauuugucuucc

SEQ ID NO: 1075098 - RNA, 22 nt, Human
agagcaagaccuuuuuuagaug

SEQ ID NO: 1075099 - RNA, 23 nt, Human
aucuaccauucuacucucuaccu

SEQ ID NO: 1075100 - RNA, 18 nt, Human
augcugaaaaaacacagg

SEQ ID NO: 1075101 - RNA, 18 nt, Human
cacaccauuaccagccuc

SEQ ID NO: 1075102 - RNA, 19 nt, Human
cacaggagagaacaggaca

SEQ ID NO: 1075103 - RNA, 21 nt, Human
cacaguucuaaagcaugcaaa

SEQ ID NO: 1075104 - RNA, 23 nt, Human
caccuuauuccacuccaaacuca

SEQ ID NO: 1075105 - RNA, 24 nt, Human
caggacacauccauaugcugaccg

SEQ ID NO: 1075106 - RNA, 21 nt, Human
caggcugucuuggcaguggag

SEQ ID NO: 1075107 - RNA, 24 nt, Human
cauuacuaagcuacaagagccaaa

SEQ ID NO: 1075108 - RNA, 23 nt, Human
cccacacaccauuaccagccucu

SEQ ID NO: 1075109 - RNA, 26 nt, Human
ccucuaguuccauccacguugcaugu

SEQ ID NO: 1075110 - RNA, 20 nt, Human
cuaaaguacaacugcuugcc

SEQ ID NO: 1075111 - RNA, 21 nt, Human
cuacucucuaccuccaugaga

SEQ ID NO: 1075112 - RNA, 20 nt, Human
cuauucacaguucuaaagca

SEQ ID NO: 1075113 - RNA, 19 nt, Human
cuuucccaaauacugacug

SEQ ID NO: 1075114 - RNA, 18 nt, Human
ggccaaagaacagagaca

SEQ ID NO: 1075115 - RNA, 22 nt, Human
uaccagccucugguaucuacca

SEQ ID NO: 1075116 - RNA, 20 nt, Human
uagagcuugaacugcuuucc

SEQ ID NO: 1075117 - RNA, 23 nt, Human
uagagcuugaacugcuuucccaa

SEQ ID NO: 1075118 - RNA, 21 nt, Human
uagugaccucuaguuccaucc

SEQ ID NO: 1075119 - RNA, 22 nt, Human
uaucagaucuggugaauauucu

SEQ ID NO: 1075120 - RNA, 21 nt, Human
uaugcugaccgagaagaauuc

SEQ ID NO: 1075121 - RNA, 21 nt, Human
ucaaaaauaacuugcaaaggc

SEQ ID NO: 1075122 - RNA, 18 nt, Human
ucuagccagaacucguca

SEQ ID NO: 1075123 - RNA, 18 nt, Human
ugaaaaaacacaggagag

SEQ ID NO: 1075124 - RNA, 19 nt, Human
ugaagguuucagaaagaug

SEQ ID NO: 1075125 - RNA, 19 nt, Human
ugaccgagaagaauucaca

SEQ ID NO: 1075126 - RNA, 21 nt, Human
uggcaguggaggauacuguuc

SEQ ID NO: 1075127 - RNA, 19 nt, Human
uggugaauauucugcacuu

SEQ ID NO: 1075128 - RNA, 22 nt, Human
uuacuaagcuacaagagccaaa

SEQ ID NO: 1075129 - RNA, 24 nt, Human
uuccaugccuggcuuauuucacuu

SEQ ID NO: 1075130 - RNA, 20 nt, Human
uucucuauauuucuuucaag

SEQ ID NO: 1075131 - RNA, 18 nt, Human
uugcaugucuguagaaga

SEQ ID NO: 1075132 - RNA, 18 nt, Human
aaaauaaauaaaauucca

SEQ ID NO: 1075133 - RNA, 21 nt, Human
aacuucuguaagcuuccuccu

SEQ ID NO: 1075134 - RNA, 20 nt, Human
acuucaguaguuacugguau

SEQ ID NO: 1075135 - RNA, 24 nt, Human
agaguaaugagaaagcaccugggu

SEQ ID NO: 1075136 - RNA, 22 nt, Human
aggaaguccggguagggcagaa

SEQ ID NO: 1075137 - RNA, 18 nt, Human
agucccaauuacacgaac

SEQ ID NO: 1075138 - RNA, 25 nt, Human
ccccaagucccaauuacacgaacuc

SEQ ID NO: 1075139 - RNA, 26 nt, Human
cccugauccccaagucccaauuacac

SEQ ID NO: 1075140 - RNA, 24 nt, Human
ccuccgagagcggccgagaacuaa

SEQ ID NO: 1075141 - RNA, 18 nt, Human
gagaggggucccauggag

SEQ ID NO: 1075142 - RNA, 22 nt, Human
gaguaaugagaaagcaccuggg

SEQ ID NO: 1075143 - RNA, 21 nt, Human
gcagaaucaggcaagccugga

SEQ ID NO: 1075144 - RNA, 21 nt, Human
gggcucccagaucgccauccu

SEQ ID NO: 1075145 - RNA, 21 nt, Human
uagggcagaaucaggcaagcc

SEQ ID NO: 1075146 - RNA, 21 nt, Human
uaucuuucucuucuauaagca

SEQ ID NO: 1075147 - RNA, 19 nt, Human
uaugagaaguuucggcaac

SEQ ID NO: 1075148 - RNA, 19 nt, Human
ucagguuuuagccugugcc

SEQ ID NO: 1075149 - RNA, 18 nt, Human
ucccauggaggggcuccc

SEQ ID NO: 1075150 - RNA, 21 nt, Human
ucccauggaggggcucccaga

SEQ ID NO: 1075151 - RNA, 24 nt, Human
uccccaagucccaauuacacgaac

SEQ ID NO: 1075152 - RNA, 23 nt, Human
ucucccacagacgggauaaggaa

SEQ ID NO: 1075153 - RNA, 22 nt, Human
ucuucuauaagcaaaauaaaau

SEQ ID NO: 1075154 - RNA, 18 nt, Human
aaaauuagcugggcaugg

SEQ ID NO: 1075155 - RNA, 18 nt, Human
aaagugcccccuccaaga

SEQ ID NO: 1075156 - RNA, 19 nt, Human
aacacaguucucaggugaa

SEQ ID NO: 1075157 - RNA, 20 nt, Human
aacauggugaaaaccugucu

SEQ ID NO: 1075158 - RNA, 22 nt, Human
aacuccaagagacaggccaaaa

SEQ ID NO: 1075159 - RNA, 22 nt, Human
aacuguaugcauauaacaggau

SEQ ID NO: 1075160 - RNA, 20 nt, Human
aagaauccacaauacaccuc

SEQ ID NO: 1075161 - RNA, 19 nt, Human
aagagacaggccaaaauca

SEQ ID NO: 1075162 - RNA, 18 nt, Human
aagcaagagagaaaagcc

SEQ ID NO: 1075163 - RNA, 23 nt, Human
aagcaagagagaaaagccgcugg

SEQ ID NO: 1075164 - RNA, 23 nt, Human
aagcaccauggacugaacagcaa

SEQ ID NO: 1075165 - RNA, 18 nt, Human
aagcagaugugcagaaac

SEQ ID NO: 1075166 - RNA, 25 nt, Human
aagccaaccacaaaccccuuccccc

SEQ ID NO: 1075167 - RNA, 24 nt, Human
aagccgcuggggggagccucugga

SEQ ID NO: 1075168 - RNA, 25 nt, Human
aagguggguggaucauuugaggcca

SEQ ID NO: 1075169 - RNA, 22 nt, Human
aagguuugaacggggaaugauc

SEQ ID NO: 1075170 - RNA, 19 nt, Human
acacccauaaccccagcac

SEQ ID NO: 1075171 - RNA, 20 nt, Human
acagagugagacccuguuug

SEQ ID NO: 1075172 - RNA, 19 nt, Human
accacaaaccccuucccca

SEQ ID NO: 1075173 - RNA, 24 nt, Human
accacaagaagggaacugaagaau

SEQ ID NO: 1075174 - RNA, 22 nt, Human
accccagcacuuugggaggcca

SEQ ID NO: 1075175 - RNA, 22 nt, Human
accucaaagaauccacaauaca

SEQ ID NO: 1075176 - RNA, 24 nt, Human
acuguacuccagccuaggcaacag

SEQ ID NO: 1075177 - RNA, 25 nt, Human
acuguacuccagccuaggcaacaga

SEQ ID NO: 1075178 - RNA, 23 nt, Human
agaaaagccgcuggggggagccu

SEQ ID NO: 1075179 - RNA, 18 nt, Human
agaaacuggaauggaggu

SEQ ID NO: 1075180 - RNA, 22 nt, Human
agagaaaaggugaggaccuagg

SEQ ID NO: 1075181 - RNA, 24 nt, Human
agcacuuugggaggccaagguggg

SEQ ID NO: 1075182 - RNA, 24 nt, Human
agccuggccaacauggugaaaacc

SEQ ID NO: 1075183 - RNA, 23 nt, Human
agcugggcaugguaacaugugcc

SEQ ID NO: 1075184 - RNA, 18 nt, Human
aggcaggagaauagcuug

SEQ ID NO: 1075185 - RNA, 24 nt, Human
aggcaggagaauagcuugaacccg

SEQ ID NO: 1075186 - RNA, 20 nt, Human
aggccaagguggguggauca

SEQ ID NO: 1075187 - RNA, 22 nt, Human
aggccaggcgcgguggcucaca

SEQ ID NO: 1075188 - RNA, 24 nt, Human
aggcgaagguugcagggagccgag

SEQ ID NO: 1075189 - RNA, 24 nt, Human
aggcgcgguggcucacacccauaa

SEQ ID NO: 1075190 - RNA, 26 nt, Human
aggcgcgguggcucacacccauaacc

SEQ ID NO: 1075191 - RNA, 27 nt, Human
aggcgcgguggcucacacccauaaccc

SEQ ID NO: 1075192 - RNA, 21 nt, Human
aggcuccaugggccaaaaaca

SEQ ID NO: 1075193 - RNA, 24 nt, Human
aggcugaggcaggagaauagcuug

SEQ ID NO: 1075194 - RNA, 18 nt, Human
agggaccucaaagaaucc

SEQ ID NO: 1075195 - RNA, 23 nt, Human
agguggguggaucauuugaggcc

SEQ ID NO: 1075196 - RNA, 21 nt, Human
aucauuugaggccaugaguuc

SEQ ID NO: 1075197 - RNA, 20 nt, Human
aucuugccacuguacuccag

SEQ ID NO: 1075198 - RNA, 20 nt, Human
auggcaaagaguguggauac

SEQ ID NO: 1075199 - RNA, 22 nt, Human
caaagcaccauggacugaacag

SEQ ID NO: 1075200 - RNA, 19 nt, Human
caacaaggcagcuaguuuc

SEQ ID NO: 1075201 - RNA, 24 nt, Human
caacauggugaaaaccugucucua

SEQ ID NO: 1075202 - RNA, 22 nt, Human
caaccacaaaccccuuccccaa

SEQ ID NO: 1075203 - RNA, 23 nt, Human
caagguggguggaucauuugagg

SEQ ID NO: 1075204 - RNA, 20 nt, Human
cacaaaccccuuccccaaca

SEQ ID NO: 1075205 - RNA, 25 nt, Human
cacaagaagggaacugaagaauccc

SEQ ID NO: 1075206 - RNA, 18 nt, Human
caccugaaaggaguagaa

SEQ ID NO: 1075207 - RNA, 21 nt, Human
cacuacuggucaagagagccc

SEQ ID NO: 1075208 - RNA, 19 nt, Human
cacuguacuccagccuagg

SEQ ID NO: 1075209 - RNA, 21 nt, Human
cacuguacuccagccuaggca

SEQ ID NO: 1075210 - RNA, 22 nt, Human
cacuguacuccagccuaggcaa

SEQ ID NO: 1075211 - RNA, 23 nt, Human
cacuguacuccagccuaggcaac

SEQ ID NO: 1075212 - RNA, 24 nt, Human
cacuguacuccagccuaggcaaca

SEQ ID NO: 1075213 - RNA, 23 nt, Human
cagaauaagcaagagagaaaagc

SEQ ID NO: 1075214 - RNA, 24 nt, Human
cagcacuuugggaggccaaggugg

SEQ ID NO: 1075215 - RNA, 21 nt, Human
cagcaggagaacuccaagaga

SEQ ID NO: 1075216 - RNA, 24 nt, Human
cagcuacucagaaggcugaggcag

SEQ ID NO: 1075217 - RNA, 22 nt, Human
cagucucagcugaagguuugaa

SEQ ID NO: 1075218 - RNA, 19 nt, Human
cauucagggucucuuguuc

SEQ ID NO: 1075219 - RNA, 27 nt, Human
ccaaccacaaaccccuuccccaacauc

SEQ ID NO: 1075220 - RNA, 19 nt, Human
ccacuguacuccagccuag

SEQ ID NO: 1075221 - RNA, 20 nt, Human
ccacuguacuccagccuagg

SEQ ID NO: 1075222 - RNA, 21 nt, Human
ccacuguacuccagccuaggc

SEQ ID NO: 1075223 - RNA, 22 nt, Human
ccacuguacuccagccuaggca

SEQ ID NO: 1075224 - RNA, 24 nt, Human
ccacuguacuccagccuaggcaac

SEQ ID NO: 1075225 - RNA, 20 nt, Human
ccccagcacuuugggaggcc

SEQ ID NO: 1075226 - RNA, 19 nt, Human
cccucugcucccuugggcc

SEQ ID NO: 1075227 - RNA, 18 nt, Human
ccgcuggggggagccucu

SEQ ID NO: 1075228 - RNA, 20 nt, Human
ccuccaagaacuguaccucc

SEQ ID NO: 1075229 - RNA, 23 nt, Human
ccuccaagaacuguaccuccauu

SEQ ID NO: 1075230 - RNA, 19 nt, Human
ccucuccucccucugcucc

SEQ ID NO: 1075231 - RNA, 21 nt, Human
ccucuccucccucugcucccu

SEQ ID NO: 1075232 - RNA, 22 nt, Human
ccucuggaaaguugcuuaacuu

SEQ ID NO: 1075233 - RNA, 22 nt, Human
ccuggccaacauggugaaaacc

SEQ ID NO: 1075234 - RNA, 24 nt, Human
ccuggccaacauggugaaaaccug

SEQ ID NO: 1075235 - RNA, 21 nt, Human
ccuguagucccagcuacucag

SEQ ID NO: 1075236 - RNA, 22 nt, Human
ccugucucuacuaaaaauacaa

SEQ ID NO: 1075237 - RNA, 23 nt, Human
ccuucugccacauucuguugguc

SEQ ID NO: 1075238 - RNA, 24 nt, Human
cgagaccagccuggccaacauggu

SEQ ID NO: 1075239 - RNA, 23 nt, Human
cggaguccacaggcucaggaucu

SEQ ID NO: 1075240 - RNA, 22 nt, Human
cucacacccauaaccccagcac

SEQ ID NO: 1075241 - RNA, 19 nt, Human
cuccaagaacuguaccucc

SEQ ID NO: 1075242 - RNA, 22 nt, Human
cugauucugcucuuauucacau

SEQ ID NO: 1075243 - RNA, 21 nt, Human
cuguuggccaguggucaugcu

SEQ ID NO: 1075244 - RNA, 20 nt, Human
cuucauccauaaaauucagg

SEQ ID NO: 1075245 - RNA, 21 nt, Human
gaacuguaccuccauuuaucu

SEQ ID NO: 1075246 - RNA, 18 nt, Human
gaagcaucccaccugaaa

SEQ ID NO: 1075247 - RNA, 22 nt, Human
gaagggaacugaagaauccccc

SEQ ID NO: 1075248 - RNA, 18 nt, Human
gaggcuagguggcucugc

SEQ ID NO: 1075249 - RNA, 20 nt, Human
gaggggcuaacaagccaugg

SEQ ID NO: 1075250 - RNA, 25 nt, Human
gagucaagcagaugugcagaaacug

SEQ ID NO: 1075251 - RNA, 18 nt, Human
gaucauuugaggccauga

SEQ ID NO: 1075252 - RNA, 24 nt, Human
gaucauuugaggccaugaguucga

SEQ ID NO: 1075253 - RNA, 18 nt, Human
gccaacauggugaaaacc

SEQ ID NO: 1075254 - RNA, 24 nt, Human
gccaacauggugaaaaccugucuc

SEQ ID NO: 1075255 - RNA, 24 nt, Human
gccacuguacuccagccuaggcaa

SEQ ID NO: 1075256 - RNA, 23 nt, Human
gcuagguggcucugcuaaucuug

SEQ ID NO: 1075257 - RNA, 19 nt, Human
gcuugaacccgggaggcga

SEQ ID NO: 1075258 - RNA, 18 nt, Human
ggaagccaaccacaaacc

SEQ ID NO: 1075259 - RNA, 19 nt, Human
ggcaugggaucugggaaag

SEQ ID NO: 1075260 - RNA, 23 nt, Human
ggcaugggaucugggaaagaggc

SEQ ID NO: 1075261 - RNA, 25 nt, Human
gggccuuuggcuagcaaucagagaa

SEQ ID NO: 1075262 - RNA, 20 nt, Human
ggguauugguuucaguugag

SEQ ID NO: 1075263 - RNA, 24 nt, Human
gggucaggaauccaggcacagcug

SEQ ID NO: 1075264 - RNA, 21 nt, Human
guacucacagcuaccaccugg

SEQ ID NO: 1075265 - RNA, 23 nt, Human
guacuccagccuaggcaacagag

SEQ ID NO: 1075266 - RNA, 18 nt, Human
gucauuggcuucuuucuc

SEQ ID NO: 1075267 - RNA, 24 nt, Human
guggaucauuugaggccaugaguu

SEQ ID NO: 1075268 - RNA, 21 nt, Human
guuuauucacaggacagcagg

SEQ ID NO: 1075269 - RNA, 19 nt, Human
uaaaauggaauauuugggu

SEQ ID NO: 1075270 - RNA, 19 nt, Human
uaacaaauuuccccaaaac

SEQ ID NO: 1075271 - RNA, 19 nt, Human
uaacagggaccucaaagaa

SEQ ID NO: 1075272 - RNA, 22 nt, Human
uacuccagccuaggcaacagag

SEQ ID NO: 1075273 - RNA, 23 nt, Human
uacuccagccuaggcaacagagu

SEQ ID NO: 1075274 - RNA, 24 nt, Human
uacuccagccuaggcaacagagug

SEQ ID NO: 1075275 - RNA, 22 nt, Human
uagcugggcaugguaacaugug

SEQ ID NO: 1075276 - RNA, 21 nt, Human
uaggcaacagagugagacccu

SEQ ID NO: 1075277 - RNA, 24 nt, Human
uagguggcucugcuaaucuuggug

SEQ ID NO: 1075278 - RNA, 22 nt, Human
uauaacaggaugcuaaaaugga

SEQ ID NO: 1075279 - RNA, 23 nt, Human
ucaaauaccugacauuuccaacc

SEQ ID NO: 1075280 - RNA, 20 nt, Human
ucacacccauaaccccagca

SEQ ID NO: 1075281 - RNA, 21 nt, Human
ucacauagucugucauuccgc

SEQ ID NO: 1075282 - RNA, 21 nt, Human
uccaagagacaggccaaaauc

SEQ ID NO: 1075283 - RNA, 19 nt, Human
uccacaauacaccucaaag

SEQ ID NO: 1075284 - RNA, 19 nt, Human
uccacagaguaacucacaa

SEQ ID NO: 1075285 - RNA, 22 nt, Human
uccacaggcucaggaucucuca

SEQ ID NO: 1075286 - RNA, 23 nt, Human
uccagccuaggcaacagagugag

SEQ ID NO: 1075287 - RNA, 22 nt, Human
uccauaaagaaacgggucucca

SEQ ID NO: 1075288 - RNA, 19 nt, Human
uccaucagugcaguaaauc

SEQ ID NO: 1075289 - RNA, 18 nt, Human
ucccacaacaacguaaaa

SEQ ID NO: 1075290 - RNA, 20 nt, Human
ucccucugcucccuugggcc

SEQ ID NO: 1075291 - RNA, 21 nt, Human
ucccucugcucccuugggccu

SEQ ID NO: 1075292 - RNA, 23 nt, Human
ucccucugcucccuugggccucc

SEQ ID NO: 1075293 - RNA, 22 nt, Human
ucucccacaacaacguaaaagu

SEQ ID NO: 1075294 - RNA, 21 nt, Human
ucucuacuaaaaauacaaaaa

SEQ ID NO: 1075295 - RNA, 19 nt, Human
ucuuccaagcucaugagug

SEQ ID NO: 1075296 - RNA, 19 nt, Human
ugaaaggaguagaaagagg

SEQ ID NO: 1075297 - RNA, 18 nt, Human
ugaaauguucaaauaccu

SEQ ID NO: 1075298 - RNA, 21 nt, Human
ugaagaauccccaccugaaca

SEQ ID NO: 1075299 - RNA, 24 nt, Human
ugagaggggcuaacaagccauggc

SEQ ID NO: 1075300 - RNA, 24 nt, Human
ugaggcaggagaauagcuugaacc

SEQ ID NO: 1075301 - RNA, 25 nt, Human
ugaggcaggagaauagcuugaaccc

SEQ ID NO: 1075302 - RNA, 25 nt, Human
ugcaguaaaucucccacaacaacgu

SEQ ID NO: 1075303 - RNA, 24 nt, Human
ugcagucucagcugaagguuugaa

SEQ ID NO: 1075304 - RNA, 24 nt, Human
ugcauaacaaauuuccccaaaacu

SEQ ID NO: 1075305 - RNA, 22 nt, Human
ugcauauaacaggaugcuaaaa

SEQ ID NO: 1075306 - RNA, 19 nt, Human
ugccucuaggucauuggcu

SEQ ID NO: 1075307 - RNA, 23 nt, Human
ugccuguagucccagcuacucag

SEQ ID NO: 1075308 - RNA, 24 nt, Human
ugccuguagucccagcuacucaga

SEQ ID NO: 1075309 - RNA, 24 nt, Human
uggaauauuuggguauugguuuca

SEQ ID NO: 1075310 - RNA, 21 nt, Human
uggaauggaggugucuuagaa

SEQ ID NO: 1075311 - RNA, 24 nt, Human
uggaucauuugaggccaugaguuc

SEQ ID NO: 1075312 - RNA, 21 nt, Human
uggcaugggaucugggaaaga

SEQ ID NO: 1075313 - RNA, 24 nt, Human
uggcaugggaucugggaaagaggc

SEQ ID NO: 1075314 - RNA, 24 nt, Human
uggccaacauggugaaaaccuguc

SEQ ID NO: 1075315 - RNA, 23 nt, Human
uggcucugcuaaucuuggugggg

SEQ ID NO: 1075316 - RNA, 24 nt, Human
ugggaaauagacuucaacccuuga

SEQ ID NO: 1075317 - RNA, 23 nt, Human
ugggaggccaagguggguggauc

SEQ ID NO: 1075318 - RNA, 24 nt, Human
ugggaggccaagguggguggauca

SEQ ID NO: 1075319 - RNA, 20 nt, Human
ugggcaguucugaucaccug

SEQ ID NO: 1075320 - RNA, 24 nt, Human
ugguaacaugugccuguaguccca

SEQ ID NO: 1075321 - RNA, 20 nt, Human
ugucauuccgcccacagguu

SEQ ID NO: 1075322 - RNA, 19 nt, Human
ugugccuguaacaagcaau

SEQ ID NO: 1075323 - RNA, 18 nt, Human
uuagaagcaucccaccug

SEQ ID NO: 1075324 - RNA, 19 nt, Human
uuagcugggcaugguaaca

SEQ ID NO: 1075325 - RNA, 24 nt, Human
uuagcugggcaugguaacaugugc

SEQ ID NO: 1075326 - RNA, 21 nt, Human
uucagaauaagcaagagagaa

SEQ ID NO: 1075327 - RNA, 24 nt, Human
uucauccauaaagaaacgggucuc

SEQ ID NO: 1075328 - RNA, 22 nt, Human
uugcagggagccgagaucuugc

SEQ ID NO: 1075329 - RNA, 21 nt, Human
uuggcuagcaaucagagaaaa

SEQ ID NO: 1075330 - RNA, 23 nt, Human
uuuaaauaccugccaggcagaga

SEQ ID NO: 1075331 - RNA, 20 nt, Human
uuugccucuaggucauuggc

SEQ ID NO: 1075332 - RNA, 18 nt, Human
accugucagcagcugccu

SEQ ID NO: 1075333 - RNA, 22 nt, Human
agccauaacccucgaggaccca

SEQ ID NO: 1075334 - RNA, 22 nt, Human
aggacugaccagggacaagcca

SEQ ID NO: 1075335 - RNA, 19 nt, Human
aggcaacacaguccggggc

SEQ ID NO: 1075336 - RNA, 20 nt, Human
aggcucccagaugacagccc

SEQ ID NO: 1075337 - RNA, 19 nt, Human
aggggcagagaggcgaggc

SEQ ID NO: 1075338 - RNA, 20 nt, Human
caccuaggcaacacaguccg

SEQ ID NO: 1075339 - RNA, 23 nt, Human
caggcucccagaugacagccccu

SEQ ID NO: 1075340 - RNA, 21 nt, Human
caggggcacaggcucccagau

SEQ ID NO: 1075341 - RNA, 19 nt, Human
ccagguggguaggaacugg

SEQ ID NO: 1075342 - RNA, 18 nt, Human
cugaaugagcaccuaggc

SEQ ID NO: 1075343 - RNA, 21 nt, Human
gaccagggacaagccauaacc

SEQ ID NO: 1075344 - RNA, 21 nt, Human
gguaggguuaaaaaugggcac

SEQ ID NO: 1075345 - RNA, 18 nt, Human
uaggaacugggcagggag

SEQ ID NO: 1075346 - RNA, 21 nt, Human
ucagcagcugccuccugggac

SEQ ID NO: 1075347 - RNA, 23 nt, Human
ugccuccugggacaaccaccccc

SEQ ID NO: 1075348 - RNA, 18 nt, Human
ugccugggugccacacag

SEQ ID NO: 1075349 - RNA, 20 nt, Human
ugggacaaccacccccuuaa

SEQ ID NO: 1075350 - RNA, 18 nt, Human
uguggaacauguuuugcc

SEQ ID NO: 1075351 - RNA, 19 nt, Human
uugccugggugccacacag

SEQ ID NO: 1075352 - RNA, 24 nt, Human
aaaaaaaaauacagugcagagaga

SEQ ID NO: 1075353 - RNA, 19 nt, Human
aaaaaaacacacacagaaa

SEQ ID NO: 1075354 - RNA, 20 nt, Human
aaaaaacacacacagaaacu

SEQ ID NO: 1075355 - RNA, 20 nt, Human
aaaaacagcaaccacagaua

SEQ ID NO: 1075356 - RNA, 19 nt, Human
aaaaagaagaggggaaaag

SEQ ID NO: 1075357 - RNA, 21 nt, Human
aaaaagaagaggggaaaagaa

SEQ ID NO: 1075358 - RNA, 18 nt, Human
aaaaagcuaccaagggaa

SEQ ID NO: 1075359 - RNA, 21 nt, Human
aaaacaacagccaucaaaaga

SEQ ID NO: 1075360 - RNA, 21 nt, Human
aaaagaaaacagcagaagaaa

SEQ ID NO: 1075361 - RNA, 23 nt, Human
aaaccagaaaccccgggaagguu

SEQ ID NO: 1075362 - RNA, 24 nt, Human
aacaacagccaucaaaagaacuaa

SEQ ID NO: 1075363 - RNA, 21 nt, Human
aacaaugguuaaauccagagc

SEQ ID NO: 1075364 - RNA, 22 nt, Human
aacagcagaagaaaagaugaaa

SEQ ID NO: 1075365 - RNA, 20 nt, Human
aagaagaggggaaaagaaaa

SEQ ID NO: 1075366 - RNA, 22 nt, Human
aagacugaggcuagagacccau

SEQ ID NO: 1075367 - RNA, 21 nt, Human
aaguuucucagcuggacucgg

SEQ ID NO: 1075368 - RNA, 24 nt, Human
acaaaauuuucuguucagcuaaag

SEQ ID NO: 1075369 - RNA, 18 nt, Human
acuaaaaaaacacacaca

SEQ ID NO: 1075370 - RNA, 25 nt, Human
acuaaauacagagggcuuuaaccca

SEQ ID NO: 1075371 - RNA, 21 nt, Human
acuccaaaaacagcaaccaca

SEQ ID NO: 1075372 - RNA, 22 nt, Human
acugaagccuccauuucugcca

SEQ ID NO: 1075373 - RNA, 25 nt, Human
agaaaaaaaaauacagugcagagag

SEQ ID NO: 1075374 - RNA, 27 nt, Human
agaaaaaaaaauacagugcagagagaa

SEQ ID NO: 1075375 - RNA, 22 nt, Human
agaaaacagcagaagaaaagau

SEQ ID NO: 1075376 - RNA, 18 nt, Human
agacagcagcaccuggag

SEQ ID NO: 1075377 - RNA, 21 nt, Human
agcaauucagggaaagaggug

SEQ ID NO: 1075378 - RNA, 18 nt, Human
agccaucaaaagaacuaa

SEQ ID NO: 1075379 - RNA, 21 nt, Human
auacacaggccaaagaaacac

SEQ ID NO: 1075380 - RNA, 19 nt, Human
auagaaguugguucaugug

SEQ ID NO: 1075381 - RNA, 24 nt, Human
auaggaauaccauugcagucuuuu

SEQ ID NO: 1075382 - RNA, 23 nt, Human
auucagacugauacacaggccaa

SEQ ID NO: 1075383 - RNA, 22 nt, Human
auuucauucagacugauacaca

SEQ ID NO: 1075384 - RNA, 23 nt, Human
caaaauuuucuguucagcuaaag

SEQ ID NO: 1075385 - RNA, 24 nt, Human
caaagaaacacauaggaauaccaa

SEQ ID NO: 1075386 - RNA, 21 nt, Human
caaaugaaguccaggcccuac

SEQ ID NO: 1075387 - RNA, 26 nt, Human
caacgacuaugaccucauucugcaaa

SEQ ID NO: 1075388 - RNA, 19 nt, Human
caagacugaggcuagagac

SEQ ID NO: 1075389 - RNA, 22 nt, Human
caagacugaggcuagagaccca

SEQ ID NO: 1075390 - RNA, 23 nt, Human
caagggaauguuggacauugagu

SEQ ID NO: 1075391 - RNA, 25 nt, Human
caagguaagcccaucuuggucuccu

SEQ ID NO: 1075392 - RNA, 28 nt, Human
cacaggccaaagaaacacauaggaauac

SEQ ID NO: 1075393 - RNA, 20 nt, Human
caccuggagcugggagaugg

SEQ ID NO: 1075394 - RNA, 22 nt, Human
cacuggugcagaagugagaaga

SEQ ID NO: 1075395 - RNA, 25 nt, Human
cagaagugagaagaacgagacuucc

SEQ ID NO: 1075396 - RNA, 20 nt, Human
cagacagcagcaccuggagc

SEQ ID NO: 1075397 - RNA, 21 nt, Human
cagcagaagacacaagagaca

SEQ ID NO: 1075398 - RNA, 21 nt, Human
cagccaucaaaagaacuaaaa

SEQ ID NO: 1075399 - RNA, 20 nt, Human
cagcuggacucggcuggcca

SEQ ID NO: 1075400 - RNA, 22 nt, Human
caggccaaagaaacacauagga

SEQ ID NO: 1075401 - RNA, 19 nt, Human
caggcugaaaaaccagaaa

SEQ ID NO: 1075402 - RNA, 25 nt, Human
cauuuuauucuuccauuaauuucca

SEQ ID NO: 1075403 - RNA, 21 nt, Human
ccaaaaacagcaaccacagau

SEQ ID NO: 1075404 - RNA, 22 nt, Human
ccaaaaacagcaaccacagaua

SEQ ID NO: 1075405 - RNA, 22 nt, Human
ccaaagaaacacauaggaauac

SEQ ID NO: 1075406 - RNA, 23 nt, Human
ccaggcccuacuuuuuuguuucc

SEQ ID NO: 1075407 - RNA, 25 nt, Human
ccccaucaugguauuuacaaugcaa

SEQ ID NO: 1075408 - RNA, 19 nt, Human
cccgugaugacuuuggacc

SEQ ID NO: 1075409 - RNA, 18 nt, Human
cggcuggccagugcggga

SEQ ID NO: 1075410 - RNA, 18 nt, Human
cggggcuuagagagaagu

SEQ ID NO: 1075411 - RNA, 19 nt, Human
cguacaggcugaaaaacca

SEQ ID NO: 1075412 - RNA, 23 nt, Human
cuaugucacuggguuauuugaau

SEQ ID NO: 1075413 - RNA, 20 nt, Human
cugauacacaggccaaagaa

SEQ ID NO: 1075414 - RNA, 20 nt, Human
cuguucagcuaaaggggaaa

SEQ ID NO: 1075415 - RNA, 21 nt, Human
cuuuucccaauauuacucaau

SEQ ID NO: 1075416 - RNA, 22 nt, Human
gaaaaagaagaggggaaaagaa

SEQ ID NO: 1075417 - RNA, 20 nt, Human
gaaaagaaaacagcagaaga

SEQ ID NO: 1075418 - RNA, 23 nt, Human
gaaaagaaaacagcagaagaaaa

SEQ ID NO: 1075419 - RNA, 22 nt, Human
gacugaggcuagagacccauuc

SEQ ID NO: 1075420 - RNA, 18 nt, Human
gagaaaaagcuaccaagg

SEQ ID NO: 1075421 - RNA, 21 nt, Human
gagccucaguuuucuccucug

SEQ ID NO: 1075422 - RNA, 24 nt, Human
gaggaauccuguuuuuugacuucg

SEQ ID NO: 1075423 - RNA, 25 nt, Human
gaggggaaaagaaaacagcagaaga

SEQ ID NO: 1075424 - RNA, 21 nt, Human
gcaaaacaacagccaucaaaa

SEQ ID NO: 1075425 - RNA, 18 nt, Human
ggugcagaagugagaaga

SEQ ID NO: 1075426 - RNA, 22 nt, Human
gucaacucccccuccugagccu

SEQ ID NO: 1075427 - RNA, 22 nt, Human
guccuucucuuuucccaauauu

SEQ ID NO: 1075428 - RNA, 21 nt, Human
gucuuuuuggcuuggcucguu

SEQ ID NO: 1075429 - RNA, 21 nt, Human
gugauucuagcacuccuuacc

SEQ ID NO: 1075430 - RNA, 21 nt, Human
uaaaaaaacacacacagaaac

SEQ ID NO: 1075431 - RNA, 24 nt, Human
uaaugcccuugcugcagacagcag

SEQ ID NO: 1075432 - RNA, 22 nt, Human
uaauuugugugacugaagccuc

SEQ ID NO: 1075433 - RNA, 18 nt, Human
uacaggcugaaaaaccag

SEQ ID NO: 1075434 - RNA, 24 nt, Human
uacaggcugaaaaaccagaaaccc

SEQ ID NO: 1075435 - RNA, 19 nt, Human
uagcacaggaccccggaga

SEQ ID NO: 1075436 - RNA, 21 nt, Human
uagcauaaguuucucagcugg

SEQ ID NO: 1075437 - RNA, 23 nt, Human
uaggaauaccauugcagucuuuu

SEQ ID NO: 1075438 - RNA, 20 nt, Human
uaggacaagccccauuuuac

SEQ ID NO: 1075439 - RNA, 21 nt, Human
ucaacucccccuccugagccu

SEQ ID NO: 1075440 - RNA, 22 nt, Human
ucagcuaaaggggaaagugggg

SEQ ID NO: 1075441 - RNA, 18 nt, Human
uccaaaaacagcaaccac

SEQ ID NO: 1075442 - RNA, 20 nt, Human
uccugagccucaguuuucuc

SEQ ID NO: 1075443 - RNA, 20 nt, Human
ugacagcaacuugaggucuc

SEQ ID NO: 1075444 - RNA, 20 nt, Human
ugaccucauucugcaaauga

SEQ ID NO: 1075445 - RNA, 23 nt, Human
ugaccucauucugcaaaugaagu

SEQ ID NO: 1075446 - RNA, 20 nt, Human
ugacugugggacucaacgac

SEQ ID NO: 1075447 - RNA, 19 nt, Human
ugagaagaacgagacuuca

SEQ ID NO: 1075448 - RNA, 22 nt, Human
ugagaagaacgagacuucaaua

SEQ ID NO: 1075449 - RNA, 19 nt, Human
ugagacaaaauuuucuguu

SEQ ID NO: 1075450 - RNA, 22 nt, Human
ugagaccauuuugaacauuugu

SEQ ID NO: 1075451 - RNA, 20 nt, Human
ugagccucaguuuucuccuc

SEQ ID NO: 1075452 - RNA, 25 nt, Human
ugcaaaacaacagccaucaaaagaa

SEQ ID NO: 1075453 - RNA, 18 nt, Human
ugcagaagugagaagaac

SEQ ID NO: 1075454 - RNA, 18 nt, Human
ugcagacagcagcaccug

SEQ ID NO: 1075455 - RNA, 23 nt, Human
ugcagagagaaguucuuauagca

SEQ ID NO: 1075456 - RNA, 19 nt, Human
ugcgggaggaggcauguuu

SEQ ID NO: 1075457 - RNA, 23 nt, Human
ugcugcagacagcagcaccugga

SEQ ID NO: 1075458 - RNA, 19 nt, Human
uggccagaaaaaaaaaaga

SEQ ID NO: 1075459 - RNA, 20 nt, Human
uggcucguuagaagaugagg

SEQ ID NO: 1075460 - RNA, 21 nt, Human
ugggagaaaaaaaaauacagu

SEQ ID NO: 1075461 - RNA, 22 nt, Human
ugggagaaaaaaaaauacagug

SEQ ID NO: 1075462 - RNA, 18 nt, Human
uuacuccaaaaacagcaa

SEQ ID NO: 1075463 - RNA, 19 nt, Human
uuggcuuggcucguuagaa

SEQ ID NO: 1075464 - RNA, 23 nt, Human
uuuacaaugcaaaacaacagcca

SEQ ID NO: 1075465 - RNA, 18 nt, Human
uuucaaggaguugugacu

SEQ ID NO: 1075466 - RNA, 24 nt, Human
uuucccaauauuacucaauaaaua

SEQ ID NO: 1075467 - RNA, 24 nt, Human
uuuccuggagauaaccaguguuuu

SEQ ID NO: 1075468 - RNA, 21 nt, Human
uuucucagcuggacucggcug

SEQ ID NO: 1075469 - RNA, 24 nt, Human
acuggcccuggguugucaggaucu

SEQ ID NO: 1075470 - RNA, 23 nt, Human
acuguaaaggacaucaauaagaa

SEQ ID NO: 1075471 - RNA, 23 nt, Human
agaguggaacuuagcgauugagg

SEQ ID NO: 1075472 - RNA, 24 nt, Human
aggcuuccgagacacucacuggcc

SEQ ID NO: 1075473 - RNA, 20 nt, Human
aucaauaagaacagacagga

SEQ ID NO: 1075474 - RNA, 20 nt, Human
auccccggcucggaucccgg

SEQ ID NO: 1075475 - RNA, 23 nt, Human
auucuggucagcugccgggagcg

SEQ ID NO: 1075476 - RNA, 21 nt, Human
auugaggcgcagccugcagaa

SEQ ID NO: 1075477 - RNA, 22 nt, Human
cacucuugccccaucagcucca

SEQ ID NO: 1075478 - RNA, 20 nt, Human
cacugcacgacuggcgcggc

SEQ ID NO: 1075479 - RNA, 27 nt, Human
cagcagccuccaagguucccaaagccc

SEQ ID NO: 1075480 - RNA, 24 nt, Human
cagccuccaagguucccaaagccc

SEQ ID NO: 1075481 - RNA, 22 nt, Human
caggagacccuccaagagauuc

SEQ ID NO: 1075482 - RNA, 19 nt, Human
ccaaagccaccaaggcgcc

SEQ ID NO: 1075483 - RNA, 23 nt, Human
ccaaagccaccaaggcgccgcgc

SEQ ID NO: 1075484 - RNA, 20 nt, Human
ccaaagcccacgauucaggc

SEQ ID NO: 1075485 - RNA, 21 nt, Human
ccaaggcgccgcgccaagucc

SEQ ID NO: 1075486 - RNA, 19 nt, Human
cccagcaacgaagcucccc

SEQ ID NO: 1075487 - RNA, 18 nt, Human
cccaggagacccuccaag

SEQ ID NO: 1075488 - RNA, 19 nt, Human
ccccgggccgggucuccgc

SEQ ID NO: 1075489 - RNA, 25 nt, Human
ccccucacaggcuuccgagacacuc

SEQ ID NO: 1075490 - RNA, 21 nt, Human
cccgggccgggucuccgcccc

SEQ ID NO: 1075491 - RNA, 21 nt, Human
ccgcgacccgccagggccgcc

SEQ ID NO: 1075492 - RNA, 21 nt, Human
ccgcgaguuccuggagcagca

SEQ ID NO: 1075493 - RNA, 19 nt, Human
ccggccgcgacccgccagg

SEQ ID NO: 1075494 - RNA, 18 nt, Human
ccggcucccggccgaccg

SEQ ID NO: 1075495 - RNA, 18 nt, Human
ccgggccguggacugugg

SEQ ID NO: 1075496 - RNA, 23 nt, Human
ccuagccacaaccuuauuccgac

SEQ ID NO: 1075497 - RNA, 22 nt, Human
cgcagccugcagaaagcugcac

SEQ ID NO: 1075498 - RNA, 24 nt, Human
cgccggaguccgcgaauaccgccc

SEQ ID NO: 1075499 - RNA, 22 nt, Human
cgggucuuccucgcagcagccu

SEQ ID NO: 1075500 - RNA, 22 nt, Human
cguggaagagcaaccaaagcca

SEQ ID NO: 1075501 - RNA, 23 nt, Human
cucacaggcuuccgagacacuca

SEQ ID NO: 1075502 - RNA, 22 nt, Human
cucagcuuuccguucucccucu

SEQ ID NO: 1075503 - RNA, 18 nt, Human
gagcagcagccuccaagg

SEQ ID NO: 1075504 - RNA, 21 nt, Human
gaguuccuggagcagcagccu

SEQ ID NO: 1075505 - RNA, 25 nt, Human
gcagcagccuccaagguucccaaag

SEQ ID NO: 1075506 - RNA, 23 nt, Human
gcgauugaggcgcagccugcaga

SEQ ID NO: 1075507 - RNA, 24 nt, Human
gcucccagcaacgaagcuccccgg

SEQ ID NO: 1075508 - RNA, 19 nt, Human
gcuuccgagacacucacug

SEQ ID NO: 1075509 - RNA, 18 nt, Human
ggcuucuggcgcuuccuu

SEQ ID NO: 1075510 - RNA, 18 nt, Human
gggccguggacuguggca

SEQ ID NO: 1075511 - RNA, 22 nt, Human
uaaaacuacagaagucucacug

SEQ ID NO: 1075512 - RNA, 19 nt, Human
uaagaggaccgauggggga

SEQ ID NO: 1075513 - RNA, 19 nt, Human
uacaauuacuccacaggcu

SEQ ID NO: 1075514 - RNA, 26 nt, Human
ucacugcacgacuggcgcggccgagg

SEQ ID NO: 1075515 - RNA, 21 nt, Human
uccaagagauucuggucagcu

SEQ ID NO: 1075516 - RNA, 23 nt, Human
ucccaaagcccacgauucaggcg

SEQ ID NO: 1075517 - RNA, 24 nt, Human
uccccggagcagucaccucagcuu

SEQ ID NO: 1075518 - RNA, 23 nt, Human
uccccggcucggaucccggccgc

SEQ ID NO: 1075519 - RNA, 23 nt, Human
ucccggccgaccgcgaguuccug

SEQ ID NO: 1075520 - RNA, 24 nt, Human
ucuuccuagccacaaccuuauucc

SEQ ID NO: 1075521 - RNA, 24 nt, Human
ugauccacaugccaggaguagcgc

SEQ ID NO: 1075522 - RNA, 25 nt, Human
ugggggaagggacagcugaccgggu

SEQ ID NO: 1075523 - RNA, 23 nt, Human
uguaaaggacaucaauaagaaca

SEQ ID NO: 1075524 - RNA, 23 nt, Human
uuccuggagcagcagccuccaag

SEQ ID NO: 1075525 - RNA, 20 nt, Human
agugcucuuguacauuuccc

SEQ ID NO: 1075526 - RNA, 26 nt, Human
caucacaaaauguauaguugucucuu

SEQ ID NO: 1075527 - RNA, 18 nt, Human
gcuggacuucuucaguag

SEQ ID NO: 1075528 - RNA, 19 nt, Human
ggcuggacuucuucaguag

SEQ ID NO: 1075529 - RNA, 25 nt, Human
ucaguagugcucuuguacauuuccc

SEQ ID NO: 1075530 - RNA, 22 nt, Human
aacucauggaccguucuuccuc

SEQ ID NO: 1075531 - RNA, 21 nt, Human
aaucgccacacugacuuccac

SEQ ID NO: 1075532 - RNA, 21 nt, Human
agagggaaggauggcaacuca

SEQ ID NO: 1075533 - RNA, 20 nt, Human
aggcaggaagagggaaggau

SEQ ID NO: 1075534 - RNA, 19 nt, Human
aucguuguuggacauuugg

SEQ ID NO: 1075535 - RNA, 20 nt, Human
auggcaacucauggaccguu

SEQ ID NO: 1075536 - RNA, 21 nt, Human
auggcugcauaguauuccaug

SEQ ID NO: 1075537 - RNA, 23 nt, Human
augguauuucuaguucuacaucu

SEQ ID NO: 1075538 - RNA, 23 nt, Human
auucugcuccuucuucagugggc

SEQ ID NO: 1075539 - RNA, 19 nt, Human
auuucuaguucuacaucuc

SEQ ID NO: 1075540 - RNA, 22 nt, Human
caacaguguaaaaguguuccua

SEQ ID NO: 1075541 - RNA, 19 nt, Human
caagccagagcagagugag

SEQ ID NO: 1075542 - RNA, 20 nt, Human
cagugggcucuaccucuucu

SEQ ID NO: 1075543 - RNA, 19 nt, Human
caugucccuacaaaggaca

SEQ ID NO: 1075544 - RNA, 24 nt, Human
ccacacugacuuccacaaugguug

SEQ ID NO: 1075545 - RNA, 18 nt, Human
ccacauuuucuuaaucca

SEQ ID NO: 1075546 - RNA, 21 nt, Human
cccaguaaugggauggcuggg

SEQ ID NO: 1075547 - RNA, 19 nt, Human
ccucaggaaaggaauugcu

SEQ ID NO: 1075548 - RNA, 21 nt, Human
ccucaggaaaggaauugcuuc

SEQ ID NO: 1075549 - RNA, 24 nt, Human
cuuccacaaugguugaacuaguuu

SEQ ID NO: 1075550 - RNA, 21 nt, Human
ggacaugaacucaucauuuuu

SEQ ID NO: 1075551 - RNA, 19 nt, Human
ggcugcauaguauuccaug

SEQ ID NO: 1075552 - RNA, 18 nt, Human
gggcagcguuucuuaucu

SEQ ID NO: 1075553 - RNA, 19 nt, Human
uagcagcaugauuuauaau

SEQ ID NO: 1075554 - RNA, 20 nt, Human
uauaugugccacauuuucuu

SEQ ID NO: 1075555 - RNA, 23 nt, Human
ucaccuagcuucauccauguccc

SEQ ID NO: 1075556 - RNA, 19 nt, Human
ucauuguccaacccuguca

SEQ ID NO: 1075557 - RNA, 22 nt, Human
uccaacccugucacuuauuagu

SEQ ID NO: 1075558 - RNA, 24 nt, Human
uccacaaugguugaacuaguuuac

SEQ ID NO: 1075559 - RNA, 19 nt, Human
uccagcacuuuuccggaag

SEQ ID NO: 1075560 - RNA, 22 nt, Human
ucccagucuucucauguuugag

SEQ ID NO: 1075561 - RNA, 20 nt, Human
ucccuacaaaggacaugaac

SEQ ID NO: 1075562 - RNA, 23 nt, Human
ucuuugcuguugugaauagugcc

SEQ ID NO: 1075563 - RNA, 26 nt, Human
ugccacaauaaacauacguguguaug

SEQ ID NO: 1075564 - RNA, 20 nt, Human
ugcuucaccuagcuucaucc

SEQ ID NO: 1075565 - RNA, 21 nt, Human
ugcuucaccuagcuucaucca

SEQ ID NO: 1075566 - RNA, 20 nt, Human
uggaccguucuuccucaacu

SEQ ID NO: 1075567 - RNA, 20 nt, Human
ugucccagucuucucauguu

SEQ ID NO: 1075568 - RNA, 24 nt, Human
uguugugaauagugccacaauaaa

SEQ ID NO: 1075569 - RNA, 20 nt, Human
uuauucugcuccuucuucaa

SEQ ID NO: 1075570 - RNA, 22 nt, Human
uuauucugcuccuucuucagug

SEQ ID NO: 1075571 - RNA, 20 nt, Human
uuccaugguguauaugugcc

SEQ ID NO: 1075572 - RNA, 26 nt, Human
uuccaugguguauaugugccacauuu

SEQ ID NO: 1075573 - RNA, 22 nt, Human
uucccaaacagcaaauggaggc

SEQ ID NO: 1075574 - RNA, 23 nt, Human
uuuacagucccaccaacagugua

SEQ ID NO: 1075575 - RNA, 18 nt, Human
uuucuaguucuacaucuc

SEQ ID NO: 1075576 - RNA, 22 nt, Human
uuuuauggcugcauaguauucc

SEQ ID NO: 1075577 - RNA, 18 nt, Human
aaccuauaagaaagauaa

SEQ ID NO: 1075578 - RNA, 21 nt, Human
aagaaggcaagaaagacagac

SEQ ID NO: 1075579 - RNA, 19 nt, Human
aagggaggaggguuagagc

SEQ ID NO: 1075580 - RNA, 19 nt, Human
aagucucuggcuuugcuca

SEQ ID NO: 1075581 - RNA, 24 nt, Human
aaucacuugaguccagguguucaa

SEQ ID NO: 1075582 - RNA, 22 nt, Human
accuucaucagaggccaccagu

SEQ ID NO: 1075583 - RNA, 21 nt, Human
acuccagccugagugauggag

SEQ ID NO: 1075584 - RNA, 24 nt, Human
acuccagccugagugauggaguga

SEQ ID NO: 1075585 - RNA, 18 nt, Human
acuguacuccagccugag

SEQ ID NO: 1075586 - RNA, 24 nt, Human
acuguacuccagccugagugaugg

SEQ ID NO: 1075587 - RNA, 27 nt, Human
agagagaaaaccugguucaagcuuagu

SEQ ID NO: 1075588 - RNA, 22 nt, Human
agaggccaccaaccuauaagaa

SEQ ID NO: 1075589 - RNA, 24 nt, Human
agccugggcaacagaaugaggcuc

SEQ ID NO: 1075590 - RNA, 18 nt, Human
aggcaggagaaucacuug

SEQ ID NO: 1075591 - RNA, 23 nt, Human
aggcaggagaaucacuugagucc

SEQ ID NO: 1075592 - RNA, 24 nt, Human
aggcaggagaaucacuugagucca

SEQ ID NO: 1075593 - RNA, 24 nt, Human
aggcugaggcaggagaaucacuug

SEQ ID NO: 1075594 - RNA, 20 nt, Human
agggaugagaauuccauugu

SEQ ID NO: 1075595 - RNA, 23 nt, Human
agguagacaaugagucucaacca

SEQ ID NO: 1075596 - RNA, 24 nt, Human
agguguucaaggcugcagugagcc

SEQ ID NO: 1075597 - RNA, 19 nt, Human
aucacaguuguuuucccua

SEQ ID NO: 1075598 - RNA, 24 nt, Human
aucucagcacuguacuccagccug

SEQ ID NO: 1075599 - RNA, 24 nt, Human
auugcacuccagccugggcaacag

SEQ ID NO: 1075600 - RNA, 19 nt, Human
caagaaagacagacagcaa

SEQ ID NO: 1075601 - RNA, 23 nt, Human
caagaagaaaauguggucacagu

SEQ ID NO: 1075602 - RNA, 19 nt, Human
cacaaucugcaugguuccu

SEQ ID NO: 1075603 - RNA, 20 nt, Human
cacuccagccugggcaacag

SEQ ID NO: 1075604 - RNA, 19 nt, Human
cacuguacuccagccugag

SEQ ID NO: 1075605 - RNA, 19 nt, Human
cacuguacuccagccugag

SEQ ID NO: 1075606 - RNA, 21 nt, Human
cacuguacuccagccugagug

SEQ ID NO: 1075607 - RNA, 22 nt, Human
cacuguacuccagccugaguga

SEQ ID NO: 1075608 - RNA, 22 nt, Human
cacuguacuccagccugaguga

SEQ ID NO: 1075609 - RNA, 25 nt, Human
cacuguacuccagccugagugaugg

SEQ ID NO: 1075610 - RNA, 24 nt, Human
caggaggcugaggcaggagaauca

SEQ ID NO: 1075611 - RNA, 18 nt, Human
cauugcacuccagccugg

SEQ ID NO: 1075612 - RNA, 19 nt, Human
cauugcacuccagccuggg

SEQ ID NO: 1075613 - RNA, 21 nt, Human
cauugcacuccagccugggca

SEQ ID NO: 1075614 - RNA, 23 nt, Human
cauugcacuccagccugggcaac

SEQ ID NO: 1075615 - RNA, 24 nt, Human
cauugcacuccagccugggcaaca

SEQ ID NO: 1075616 - RNA, 20 nt, Human
ccauugcacuccagccuggg

SEQ ID NO: 1075617 - RNA, 21 nt, Human
ccauugcacuccagccugggc

SEQ ID NO: 1075618 - RNA, 22 nt, Human
ccauugcacuccagccugggca

SEQ ID NO: 1075619 - RNA, 23 nt, Human
ccauugcacuccagccugggcaa

SEQ ID NO: 1075620 - RNA, 24 nt, Human
ccauugcacuccagccugggcaac

SEQ ID NO: 1075621 - RNA, 21 nt, Human
cccucagugguguuacugaau

SEQ ID NO: 1075622 - RNA, 22 nt, Human
cccuugaaagugcagcuuagug

SEQ ID NO: 1075623 - RNA, 21 nt, Human
ccucucaaguuuacuuggccc

SEQ ID NO: 1075624 - RNA, 23 nt, Human
ccucuggaaaccaugcaaagaga

SEQ ID NO: 1075625 - RNA, 18 nt, Human
cgugcuaugacuuaaaug

SEQ ID NO: 1075626 - RNA, 22 nt, Human
cuaaaaggaaaaugugcagaaa

SEQ ID NO: 1075627 - RNA, 18 nt, Human
cuaacuuuucuuacuccc

SEQ ID NO: 1075628 - RNA, 18 nt, Human
cuccaucaaugccguauc

SEQ ID NO: 1075629 - RNA, 21 nt, Human
cucccuaacuuuucuuacucc

SEQ ID NO: 1075630 - RNA, 22 nt, Human
cucucaaguuuacuuggcccga

SEQ ID NO: 1075631 - RNA, 20 nt, Human
cucuguagucucugcuacuc

SEQ ID NO: 1075632 - RNA, 23 nt, Human
cugcagugagccuugaucucagc

SEQ ID NO: 1075633 - RNA, 19 nt, Human
gaaaauguacuucucugac

SEQ ID NO: 1075634 - RNA, 18 nt, Human
gaaagaugugggauguug

SEQ ID NO: 1075635 - RNA, 20 nt, Human
gcacuguacuccagccugag

SEQ ID NO: 1075636 - RNA, 21 nt, Human
gcacuguacuccagccugagu

SEQ ID NO: 1075637 - RNA, 22 nt, Human
gcaggagaaucacuugagucca

SEQ ID NO: 1075638 - RNA, 18 nt, Human
gccauugcacuccagccu

SEQ ID NO: 1075639 - RNA, 22 nt, Human
gccauugcacuccagccugggc

SEQ ID NO: 1075640 - RNA, 24 nt, Human
gccauugcacuccagccugggcaa

SEQ ID NO: 1075641 - RNA, 22 nt, Human
gcuacucaggaggcugaggcag

SEQ ID NO: 1075642 - RNA, 22 nt, Human
ggaaaaugugcagaaagaaggc

SEQ ID NO: 1075643 - RNA, 24 nt, Human
guacuccagccugagugauggagu

SEQ ID NO: 1075644 - RNA, 24 nt, Human
guccagguguucaaggcugcagug

SEQ ID NO: 1075645 - RNA, 20 nt, Human
uaagucucuggcuuugcuca

SEQ ID NO: 1075646 - RNA, 18 nt, Human
uacaaccagagagaaaac

SEQ ID NO: 1075647 - RNA, 25 nt, Human
uaccuugcccccuugaaagugcagc

SEQ ID NO: 1075648 - RNA, 28 nt, Human
uaccuugcccccuugaaagugcagcuua

SEQ ID NO: 1075649 - RNA, 21 nt, Human
uacuacaaccagagagaaaac

SEQ ID NO: 1075650 - RNA, 24 nt, Human
uacuacaaccagagagaaaaccug

SEQ ID NO: 1075651 - RNA, 22 nt, Human
uacuccagccugagugauggag

SEQ ID NO: 1075652 - RNA, 24 nt, Human
uacuccagccugagugauggagug

SEQ ID NO: 1075653 - RNA, 23 nt, Human
uacuucucugacucuugggcaca

SEQ ID NO: 1075654 - RNA, 20 nt, Human
uagaguucauuggcuugaaa

SEQ ID NO: 1075655 - RNA, 21 nt, Human
uagcuucaguuugcugaguga

SEQ ID NO: 1075656 - RNA, 23 nt, Human
uaguagggaugagaauuccauug

SEQ ID NO: 1075657 - RNA, 25 nt, Human
uauuaguauucaaaccauuuaaaau

SEQ ID NO: 1075658 - RNA, 24 nt, Human
uauuuuguccauuuucuguaucca

SEQ ID NO: 1075659 - RNA, 23 nt, Human
uccagccugagugauggagugag

SEQ ID NO: 1075660 - RNA, 24 nt, Human
uccagccugagugauggagugaga

SEQ ID NO: 1075661 - RNA, 18 nt, Human
ucccaggaucacaguugu

SEQ ID NO: 1075662 - RNA, 21 nt, Human
uccugcugaugaauuuagagg

SEQ ID NO: 1075663 - RNA, 18 nt, Human
ucucuggcuuugcucauc

SEQ ID NO: 1075664 - RNA, 18 nt, Human
ucuugcagcacuuaauac

SEQ ID NO: 1075665 - RNA, 20 nt, Human
ugaggcaggagaaucacuug

SEQ ID NO: 1075666 - RNA, 24 nt, Human
ugaggcaggagaaucacuugaguc

SEQ ID NO: 1075667 - RNA, 25 nt, Human
ugaggcaggagaaucacuugagucc

SEQ ID NO: 1075668 - RNA, 19 nt, Human
ugcaaagagaccuagcuuc

SEQ ID NO: 1075669 - RNA, 22 nt, Human
ugcacuccagccugggcaacag

SEQ ID NO: 1075670 - RNA, 24 nt, Human
ugcagcacuuaauacaugcacgua

SEQ ID NO: 1075671 - RNA, 18 nt, Human
uggcuuugcucauccugu

SEQ ID NO: 1075672 - RNA, 21 nt, Human
uucaaggaagugaaauauguc

SEQ ID NO: 1075673 - RNA, 21 nt, Human
uucauugucuccauuucuuua

SEQ ID NO: 1075674 - RNA, 23 nt, Human
uuuauggguaacucaaccuuucu

SEQ ID NO: 1075675 - RNA, 21 nt, Human
uuuauuagcucccaggaucac

SEQ ID NO: 1075676 - RNA, 19 nt, Human
uuuggguggauacgaaaug

SEQ ID NO: 1075677 - RNA, 18 nt, Human
uuuguggcuuuuucacuu

SEQ ID NO: 1075678 - RNA, 21 nt, Human
uuuugcucccucagugguguu

SEQ ID NO: 1075679 - RNA, 20 nt, Human
guccuuuauuuauuuuuuuu

SEQ ID NO: 1075680 - RNA, 20 nt, Human
aaagcacccacuagauacca

SEQ ID NO: 1075681 - RNA, 21 nt, Human
aaagcacccacuagauaccag

SEQ ID NO: 1075682 - RNA, 18 nt, Human
aacaaauaugcacaaagc

SEQ ID NO: 1075683 - RNA, 24 nt, Human
aacaaauaugcacaaagcacccac

SEQ ID NO: 1075684 - RNA, 19 nt, Human
aagcugccauuccuauuca

SEQ ID NO: 1075685 - RNA, 22 nt, Human
acaaagcacccacuagauacca

SEQ ID NO: 1075686 - RNA, 22 nt, Human
caaauaugcacaaagcacccac

SEQ ID NO: 1075687 - RNA, 25 nt, Human
cauucaacaaauaugcacaaagcac

SEQ ID NO: 1075688 - RNA, 27 nt, Human
ccauuccuauucaguguaguuuucuua

SEQ ID NO: 1075689 - RNA, 21 nt, Human
cuugcuggcaaaauuuauaug

SEQ ID NO: 1075690 - RNA, 20 nt, Human
ggauacaugggcaaacuucc

SEQ ID NO: 1075691 - RNA, 23 nt, Human
uauuagaaauuauucacugucau

SEQ ID NO: 1075692 - RNA, 24 nt, Human
uauuagaaauuauucacugucauu

SEQ ID NO: 1075693 - RNA, 20 nt, Human
ucaacaaauaugcacaaagc

SEQ ID NO: 1075694 - RNA, 24 nt, Human
agguucccucgugccagcugcccc

SEQ ID NO: 1075695 - RNA, 20 nt, Human
ggagggagguaggccagggc

SEQ ID NO: 1075696 - RNA, 18 nt, Human
ucaccucgccgcggccgc

SEQ ID NO: 1075697 - RNA, 22 nt, Human
ucccaggaucccaggggaaacc

SEQ ID NO: 1075698 - RNA, 21 nt, Human
uuggugcgaacgcggcgggcc

SEQ ID NO: 1075699 - RNA, 20 nt, Human
aaaugucucucuaauccauc

SEQ ID NO: 1075700 - RNA, 20 nt, Human
aaccuguuuuuccagcccua

SEQ ID NO: 1075701 - RNA, 21 nt, Human
aaccuguuuuuccagcccuaa

SEQ ID NO: 1075702 - RNA, 19 nt, Human
aagaugaauuauccauugu

SEQ ID NO: 1075703 - RNA, 22 nt, Human
aauuucucucuugcagucaguu

SEQ ID NO: 1075704 - RNA, 28 nt, Human
acugaacugaacaaaucuauuccugauc

SEQ ID NO: 1075705 - RNA, 21 nt, Human
auccauuguaauccauuuggu

SEQ ID NO: 1075706 - RNA, 23 nt, Human
aucuacucucuucccuauuuuaa

SEQ ID NO: 1075707 - RNA, 21 nt, Human
augcacuuucaguuucaugcc

SEQ ID NO: 1075708 - RNA, 22 nt, Human
caaaaaccucuacaucuuucga

SEQ ID NO: 1075709 - RNA, 19 nt, Human
caaccuguuuuuccagccc

SEQ ID NO: 1075710 - RNA, 18 nt, Human
cacaauuuaaauccaucc

SEQ ID NO: 1075711 - RNA, 21 nt, Human
cacaauuuaaauccauccucu

SEQ ID NO: 1075712 - RNA, 19 nt, Human
cacacaauuuaaauccauc

SEQ ID NO: 1075713 - RNA, 18 nt, Human
cauugcauuugagacccu

SEQ ID NO: 1075714 - RNA, 22 nt, Human
ccaaucuugguaagcagccaag

SEQ ID NO: 1075715 - RNA, 19 nt, Human
cccaaaagaugaauuaucc

SEQ ID NO: 1075716 - RNA, 22 nt, Human
cuaauccaucuacucucuuccc

SEQ ID NO: 1075717 - RNA, 25 nt, Human
cuagucucuaugcuuuggucucaca

SEQ ID NO: 1075718 - RNA, 23 nt, Human
cuuucaguuucaugcccugguuc

SEQ ID NO: 1075719 - RNA, 22 nt, Human
gacccuuacuuaucuguuucca

SEQ ID NO: 1075720 - RNA, 24 nt, Human
gaucgccucuuaucuagucucuau

SEQ ID NO: 1075721 - RNA, 23 nt, Human
ggaaaaaaaaaaaaaacauccuu

SEQ ID NO: 1075722 - RNA, 23 nt, Human
uaaccucuauuccuuauguucuc

SEQ ID NO: 1075723 - RNA, 18 nt, Human
uaacucaugcccacaccc

SEQ ID NO: 1075724 - RNA, 18 nt, Human
uaagcagccaagcagaaa

SEQ ID NO: 1075725 - RNA, 24 nt, Human
uaaguaaaucaaacagcuaaauuu

SEQ ID NO: 1075726 - RNA, 22 nt, Human
uaauccaucuacucucuucccu

SEQ ID NO: 1075727 - RNA, 20 nt, Human
uagucucuaugcuuuggucu

SEQ ID NO: 1075728 - RNA, 24 nt, Human
uaucuaguaacaggaucuauugau

SEQ ID NO: 1075729 - RNA, 21 nt, Human
uaucuagucucuaugcuuugg

SEQ ID NO: 1075730 - RNA, 25 nt, Human
ucaaacagcuaaauuucucucuugc

SEQ ID NO: 1075731 - RNA, 20 nt, Human
ucaguuauuauuacaauuaa

SEQ ID NO: 1075732 - RNA, 22 nt, Human
ucuuaaaugucucucuaaucca

SEQ ID NO: 1075733 - RNA, 18 nt, Human
ucuuucgagcccauguga

SEQ ID NO: 1075734 - RNA, 20 nt, Human
ugacuuuuccacucuuccuc

SEQ ID NO: 1075735 - RNA, 22 nt, Human
ugauuuucucuguaauauuuuu

SEQ ID NO: 1075736 - RNA, 24 nt, Human
ugguaagcagccaagcagaaaucu

SEQ ID NO: 1075737 - RNA, 23 nt, Human
uguaauaaacagggagaacaaac

SEQ ID NO: 1075738 - RNA, 20 nt, Human
uguucauuuugauucacaua

SEQ ID NO: 1075739 - RNA, 20 nt, Human
uuggucucacacaauuuaaa

SEQ ID NO: 1075740 - RNA, 27 nt, Human
uuuccagcccuaacucaugcccacacc

SEQ ID NO: 1075741 - RNA, 23 nt, Human
uuuuuggcugccuacucauugcc

SEQ ID NO: 1075742 - RNA, 24 nt, Human
aaaaaggacucucccaguuauuuc

SEQ ID NO: 1075743 - RNA, 19 nt, Human
aaagugcugggauuacagg

SEQ ID NO: 1075744 - RNA, 24 nt, Human
aaagugcugggauuacaggaguga

SEQ ID NO: 1075745 - RNA, 24 nt, Human
aaagugcugggauuacaggcguga

SEQ ID NO: 1075746 - RNA, 25 nt, Human
aagaaaaccagucagaaaaaaggac

SEQ ID NO: 1075747 - RNA, 18 nt, Human
aagugcugggauuacagg

SEQ ID NO: 1075748 - RNA, 22 nt, Human
aagugcugggauuacaggaguc

SEQ ID NO: 1075749 - RNA, 26 nt, Human
aagugcugggauuacaggagugagcc

SEQ ID NO: 1075750 - RNA, 19 nt, Human
aagugcugggauuacaggc

SEQ ID NO: 1075751 - RNA, 19 nt, Human
aagugcugggauuacaggc

SEQ ID NO: 1075752 - RNA, 26 nt, Human
aagugcugggauuacaggcgugagcc

SEQ ID NO: 1075753 - RNA, 27 nt, Human
acaagagaaaagccaaguauccacagg

SEQ ID NO: 1075754 - RNA, 18 nt, Human
acaggguuucaccguguu

SEQ ID NO: 1075755 - RNA, 19 nt, Human
acaggguuucaccguguua

SEQ ID NO: 1075756 - RNA, 20 nt, Human
acaggguuucaccguguuag

SEQ ID NO: 1075757 - RNA, 24 nt, Human
acaggguuucaccguguuagccag

SEQ ID NO: 1075758 - RNA, 18 nt, Human
acaggguuucacuauguu

SEQ ID NO: 1075759 - RNA, 21 nt, Human
acaggguuucacuauguuggc

SEQ ID NO: 1075760 - RNA, 22 nt, Human
acaggguuucacuauguuggcc

SEQ ID NO: 1075761 - RNA, 24 nt, Human
acauuguccccugggcuggagugc

SEQ ID NO: 1075762 - RNA, 22 nt, Human
accacugcacuccagccugggc

SEQ ID NO: 1075763 - RNA, 18 nt, Human
acccaggaacaugcccca

SEQ ID NO: 1075764 - RNA, 22 nt, Human
acucucuccauuuucaucuucc

SEQ ID NO: 1075765 - RNA, 24 nt, Human
acugcacuccagccugggcgacag

SEQ ID NO: 1075766 - RNA, 26 nt, Human
acugcacuccagccugggcgacagag

SEQ ID NO: 1075767 - RNA, 18 nt, Human
agaaaaaaggacucuccc

SEQ ID NO: 1075768 - RNA, 24 nt, Human
agaaaaaaggacucucccaguuau

SEQ ID NO: 1075769 - RNA, 18 nt, Human
agacaggguuucaccgug

SEQ ID NO: 1075770 - RNA, 22 nt, Human
agagaaaagccaaguauccaca

SEQ ID NO: 1075771 - RNA, 19 nt, Human
agauuacaggugugcgcca

SEQ ID NO: 1075772 - RNA, 22 nt, Human
agccacagacuuaaggcugccc

SEQ ID NO: 1075773 - RNA, 23 nt, Human
agccugggcgacagagcaagacu

SEQ ID NO: 1075774 - RNA, 24 nt, Human
agccugggcgacagagcaagacuu

SEQ ID NO: 1075775 - RNA, 26 nt, Human
aggcaggagggagcagccauuuccag

SEQ ID NO: 1075776 - RNA, 23 nt, Human
aggcaggguguguuugugggggg

SEQ ID NO: 1075777 - RNA, 18 nt, Human
agggacugaagaaaacca

SEQ ID NO: 1075778 - RNA, 22 nt, Human
agggagcagccauuuccaggcu

SEQ ID NO: 1075779 - RNA, 24 nt, Human
agggauucuccugccucagccucc

SEQ ID NO: 1075780 - RNA, 24 nt, Human
aggugauccgcccaccucagccuc

SEQ ID NO: 1075781 - RNA, 18 nt, Human
aguagcugagauuacagg

SEQ ID NO: 1075782 - RNA, 23 nt, Human
aguagcugagauuacaggugugc

SEQ ID NO: 1075783 - RNA, 25 nt, Human
aguauccacaggauacuuggauagc

SEQ ID NO: 1075784 - RNA, 23 nt, Human
agucagaaaaaaggacucuccca

SEQ ID NO: 1075785 - RNA, 23 nt, Human
agugauccgcccgccucagccuc

SEQ ID NO: 1075786 - RNA, 18 nt, Human
agugcugggauuacaggc

SEQ ID NO: 1075787 - RNA, 18 nt, Human
aucuuccuccaaccuguu

SEQ ID NO: 1075788 - RNA, 21 nt, Human
auuacaggugugcgccaccau

SEQ ID NO: 1075789 - RNA, 24 nt, Human
auuguccccugggcuggagugcaa

SEQ ID NO: 1075790 - RNA, 21 nt, Human
auuucaucaugggugcccugg

SEQ ID NO: 1075791 - RNA, 24 nt, Human
caaagugcugggauuacaggagug

SEQ ID NO: 1075792 - RNA, 24 nt, Human
caaagugcugggauuacaggcgug

SEQ ID NO: 1075793 - RNA, 23 nt, Human
caagagaaaagccaaguauccac

SEQ ID NO: 1075794 - RNA, 22 nt, Human
caagagaaaagccaaguauccc

SEQ ID NO: 1075795 - RNA, 19 nt, Human
caagcuccugaccucaggu

SEQ ID NO: 1075796 - RNA, 22 nt, Human
caagggauucuccugccucagc

SEQ ID NO: 1075797 - RNA, 24 nt, Human
cacacccaggaacaugccccaaac

SEQ ID NO: 1075798 - RNA, 18 nt, Human
caccguguuagccaggau

SEQ ID NO: 1075799 - RNA, 24 nt, Human
caccguguuagccaggauggucuc

SEQ ID NO: 1075800 - RNA, 24 nt, Human
caccucagccucccaaagugcugg

SEQ ID NO: 1075801 - RNA, 24 nt, Human
cacuauguuggccgggaugaucuc

SEQ ID NO: 1075802 - RNA, 23 nt, Human
cacuccagccugggcgacagagc

SEQ ID NO: 1075803 - RNA, 26 nt, Human
cacucuacucucuccauuuucaucuu

SEQ ID NO: 1075804 - RNA, 19 nt, Human
cacugcacuccagccuggg

SEQ ID NO: 1075805 - RNA, 20 nt, Human
cacugcacuccagccugggc

SEQ ID NO: 1075806 - RNA, 22 nt, Human
cacugcacuccagccugggcga

SEQ ID NO: 1075807 - RNA, 23 nt, Human
cacugcacuccagccugggcgac

SEQ ID NO: 1075808 - RNA, 24 nt, Human
cacugcacuccagccugggcgaca

SEQ ID NO: 1075809 - RNA, 27 nt, Human
cacugcacuccagccugggcgacagag

SEQ ID NO: 1075810 - RNA, 19 nt, Human
cagaaaaaaggacucuccc

SEQ ID NO: 1075811 - RNA, 21 nt, Human
caggccaucugguuucuucag

SEQ ID NO: 1075812 - RNA, 24 nt, Human
caggguuucaccguguuagccagg

SEQ ID NO: 1075813 - RNA, 24 nt, Human
caggguuucacuauguuggccggg

SEQ ID NO: 1075814 - RNA, 21 nt, Human
cauugcaaccucugccuccug

SEQ ID NO: 1075815 - RNA, 21 nt, Human
ccaaaccagugagccaagguc

SEQ ID NO: 1075816 - RNA, 19 nt, Human
ccaaagugcugggauuaca

SEQ ID NO: 1075817 - RNA, 20 nt, Human
ccaaagugcugggauuacag

SEQ ID NO: 1075818 - RNA, 20 nt, Human
ccaaagugcugggauuacag

SEQ ID NO: 1075819 - RNA, 21 nt, Human
ccaaagugcugggauuacagg

SEQ ID NO: 1075820 - RNA, 24 nt, Human
ccaaagugcugggauuacaggagu

SEQ ID NO: 1075821 - RNA, 22 nt, Human
ccaaagugcugggauuacaggc

SEQ ID NO: 1075822 - RNA, 22 nt, Human
ccaaagugcugggauuacaggc

SEQ ID NO: 1075823 - RNA, 24 nt, Human
ccaaagugcugggauuacaggcgu

SEQ ID NO: 1075824 - RNA, 20 nt, Human
ccacugcacuccagccuggg

SEQ ID NO: 1075825 - RNA, 21 nt, Human
ccacugcacuccagccugggc

SEQ ID NO: 1075826 - RNA, 21 nt, Human
ccacugcacuccagccugggc

SEQ ID NO: 1075827 - RNA, 23 nt, Human
ccacugcacuccagccugggcga

SEQ ID NO: 1075828 - RNA, 23 nt, Human
ccacugcacuccagccugggcga

SEQ ID NO: 1075829 - RNA, 24 nt, Human
ccacugcacuccagccugggcgac

SEQ ID NO: 1075830 - RNA, 20 nt, Human
ccaggcucugagugucagaa

SEQ ID NO: 1075831 - RNA, 19 nt, Human
cccacaagagaaaagccaa

SEQ ID NO: 1075832 - RNA, 18 nt, Human
cccaggaacaugccccaa

SEQ ID NO: 1075833 - RNA, 23 nt, Human
cccaggaacaugccccaaaccag

SEQ ID NO: 1075834 - RNA, 19 nt, Human
cccagggccccacagaugc

SEQ ID NO: 1075835 - RNA, 19 nt, Human
cccgaguagcugagauuac

SEQ ID NO: 1075836 - RNA, 24 nt, Human
cccgaguagcugagauuacaggug

SEQ ID NO: 1075837 - RNA, 18 nt, Human
cccugggcuggagugcaa

SEQ ID NO: 1075838 - RNA, 19 nt, Human
cccugggcuggagugcaau

SEQ ID NO: 1075839 - RNA, 21 nt, Human
ccgaguagcugagauuacagg

SEQ ID NO: 1075840 - RNA, 24 nt, Human
ccgaguagcugagauuacaggugu

SEQ ID NO: 1075841 - RNA, 26 nt, Human
ccgcccaccucagccucccaaagugc

SEQ ID NO: 1075842 - RNA, 26 nt, Human
ccgcccgccucagccucccaaagugc

SEQ ID NO: 1075843 - RNA, 24 nt, Human
ccgccucagccucccaaagugcug

SEQ ID NO: 1075844 - RNA, 19 nt, Human
ccucacagacacacccagg

SEQ ID NO: 1075845 - RNA, 20 nt, Human
ccuccaaccuguuauauuuu

SEQ ID NO: 1075846 - RNA, 24 nt, Human
ccuccuggguucaagggauucucc

SEQ ID NO: 1075847 - RNA, 19 nt, Human
ccucugccuccuggguuca

SEQ ID NO: 1075848 - RNA, 20 nt, Human
ccugaccuagugauccgccc

SEQ ID NO: 1075849 - RNA, 24 nt, Human
ccugaccucaggugauccgcccac

SEQ ID NO: 1075850 - RNA, 23 nt, Human
ccugccucagccucccgaguagc

SEQ ID NO: 1075851 - RNA, 21 nt, Human
ccugggcgacagagcaagacu

SEQ ID NO: 1075852 - RNA, 18 nt, Human
ccuggguucaagggauuc

SEQ ID NO: 1075853 - RNA, 23 nt, Human
ccuggguucaagggauucuccug

SEQ ID NO: 1075854 - RNA, 24 nt, Human
ccugguaacaacacccggacaccu

SEQ ID NO: 1075855 - RNA, 21 nt, Human
cgcaccacugcacuccagccu

SEQ ID NO: 1075856 - RNA, 24 nt, Human
cgccucagccucccaaagugcugg

SEQ ID NO: 1075857 - RNA, 27 nt, Human
cuagugauccgcccgccucagccuccc

SEQ ID NO: 1075858 - RNA, 20 nt, Human
cucacagacacacccaggaa

SEQ ID NO: 1075859 - RNA, 24 nt, Human
cucauugcaaccucugccuccugg

SEQ ID NO: 1075860 - RNA, 24 nt, Human
cuccugaccuagugauccgcccgc

SEQ ID NO: 1075861 - RNA, 21 nt, Human
cuccuggguucaagggauucu

SEQ ID NO: 1075862 - RNA, 25 nt, Human
cucucuccauuuucaucuuccucca

SEQ ID NO: 1075863 - RNA, 23 nt, Human
cugccucagccucccgaguagcu

SEQ ID NO: 1075864 - RNA, 23 nt, Human
cugggggaggcaggguguguuug

SEQ ID NO: 1075865 - RNA, 19 nt, Human
cuugucgugugcucuggag

SEQ ID NO: 1075866 - RNA, 21 nt, Human
gaaaagccaaguauccacagg

SEQ ID NO: 1075867 - RNA, 21 nt, Human
gaacaugccccaaaccaguga

SEQ ID NO: 1075868 - RNA, 24 nt, Human
gaacaugccccaaaccagugagcc

SEQ ID NO: 1075869 - RNA, 24 nt, Human
gaccuagugauccgcccgccucag

SEQ ID NO: 1075870 - RNA, 24 nt, Human
gaccucaggugauccgcccaccuc

SEQ ID NO: 1075871 - RNA, 23 nt, Human
gagucucucccagggccccacag

SEQ ID NO: 1075872 - RNA, 18 nt, Human
gauuacaggcgugagcca

SEQ ID NO: 1075873 - RNA, 19 nt, Human
gauuacaggcgugagccac

SEQ ID NO: 1075874 - RNA, 22 nt, Human
gauuacaggcgugagccacugc

SEQ ID NO: 1075875 - RNA, 18 nt, Human
gauuacaggugugcgcca

SEQ ID NO: 1075876 - RNA, 24 nt, Human
gauuacaggugugcgccaccaugc

SEQ ID NO: 1075877 - RNA, 22 nt, Human
gcaaccucugccuccuggguuc

SEQ ID NO: 1075878 - RNA, 20 nt, Human
gcaccacugcacuccagccu

SEQ ID NO: 1075879 - RNA, 24 nt, Human
gcacuccagccugggcgacagagc

SEQ ID NO: 1075880 - RNA, 18 nt, Human
gcccggccaggcauaggg

SEQ ID NO: 1075881 - RNA, 18 nt, Human
gccuguacagggugggac

SEQ ID NO: 1075882 - RNA, 21 nt, Human
gcucauugcaaccucugccuc

SEQ ID NO: 1075883 - RNA, 18 nt, Human
ggaacaugccccaaacca

SEQ ID NO: 1075884 - RNA, 20 nt, Human
ggacaccuggacuacuacaa

SEQ ID NO: 1075885 - RNA, 18 nt, Human
ggacugggggaggcaggg

SEQ ID NO: 1075886 - RNA, 24 nt, Human
gggagcagccauuuccaggcucug

SEQ ID NO: 1075887 - RNA, 24 nt, Human
gggauucuccugccucagccuccc

SEQ ID NO: 1075888 - RNA, 22 nt, Human
ggguuucacuauguuggccggg

SEQ ID NO: 1075889 - RNA, 24 nt, Human
gucgcaccacugcacuccagccug

SEQ ID NO: 1075890 - RNA, 24 nt, Human
gugauccgcccaccucagccuccc

SEQ ID NO: 1075891 - RNA, 24 nt, Human
gugauccgcccgccucagccuccc

SEQ ID NO: 1075892 - RNA, 19 nt, Human
gugcuuuggcugauucgac

SEQ ID NO: 1075893 - RNA, 21 nt, Human
gugugcgccaccaugcccagc

SEQ ID NO: 1075894 - RNA, 22 nt, Human
uaaagacaggguuucaccgugu

SEQ ID NO: 1075895 - RNA, 24 nt, Human
uaauuuuucguauuuuuauuagag

SEQ ID NO: 1075896 - RNA, 25 nt, Human
uaauuuuucguauuuuuauuagaga

SEQ ID NO: 1075897 - RNA, 19 nt, Human
uacaggcgugagccacugc

SEQ ID NO: 1075898 - RNA, 23 nt, Human
uacaggcgugagccacugcgccc

SEQ ID NO: 1075899 - RNA, 21 nt, Human
uacagggugggacucuaggug

SEQ ID NO: 1075900 - RNA, 21 nt, Human
uagagacaggguuucacuaug

SEQ ID NO: 1075901 - RNA, 22 nt, Human
uagagacaggguuucacuaugu

SEQ ID NO: 1075902 - RNA, 27 nt, Human
uaggguuucuaaggacugggggaggca

SEQ ID NO: 1075903 - RNA, 21 nt, Human
uaguaaagacaggguuucacc

SEQ ID NO: 1075904 - RNA, 24 nt, Human
uaguaaagacaggguuucaccgug

SEQ ID NO: 1075905 - RNA, 26 nt, Human
uaguaaagacaggguuucaccguguu

SEQ ID NO: 1075906 - RNA, 24 nt, Human
uauuagagacaggguuucacuaug

SEQ ID NO: 1075907 - RNA, 19 nt, Human
ucaaacccugugauggguu

SEQ ID NO: 1075908 - RNA, 24 nt, Human
ucacauuguccccugggcuggagu

SEQ ID NO: 1075909 - RNA, 24 nt, Human
ucaccguguuagccaggauggucu

SEQ ID NO: 1075910 - RNA, 18 nt, Human
ucagccucccaaagugcu

SEQ ID NO: 1075911 - RNA, 19 nt, Human
ucagugauuugccaggguc

SEQ ID NO: 1075912 - RNA, 23 nt, Human
ucagugauuugccagggucucuc

SEQ ID NO: 1075913 - RNA, 24 nt, Human
ucauugcaaccucugccuccuggg

SEQ ID NO: 1075914 - RNA, 25 nt, Human
ucauugcaaccucugccuccugggu

SEQ ID NO: 1075915 - RNA, 19 nt, Human
uccaaugagauugugaggu

SEQ ID NO: 1075916 - RNA, 24 nt, Human
uccagccugggcgacagagcaaga

SEQ ID NO: 1075917 - RNA, 22 nt, Human
uccaguucgugcccacuugugg

SEQ ID NO: 1075918 - RNA, 18 nt, Human
ucccaaagugcugggauu

SEQ ID NO: 1075919 - RNA, 23 nt, Human
ucccaaagugcugggauuacagg

SEQ ID NO: 1075920 - RNA, 24 nt, Human
ucccaaagugcugggauuacaggc

SEQ ID NO: 1075921 - RNA, 22 nt, Human
uccccugggcuggagugcaauc

SEQ ID NO: 1075922 - RNA, 23 nt, Human
ucccgaguagcugagauuacagg

SEQ ID NO: 1075923 - RNA, 24 nt, Human
ucccgaguagcugagauuacaggu

SEQ ID NO: 1075924 - RNA, 21 nt, Human
uccgcccaccucagccuccca

SEQ ID NO: 1075925 - RNA, 21 nt, Human
uccgcccgccucagccuccca

SEQ ID NO: 1075926 - RNA, 19 nt, Human
uccucaauucccuucccca

SEQ ID NO: 1075927 - RNA, 22 nt, Human
uccucacagacacacccaggaa

SEQ ID NO: 1075928 - RNA, 21 nt, Human
uccuggguucaagggauucuc

SEQ ID NO: 1075929 - RNA, 24 nt, Human
uccuggguucaagggauucuccug

SEQ ID NO: 1075930 - RNA, 23 nt, Human
ucgcaccacugcacuccagccug

SEQ ID NO: 1075931 - RNA, 21 nt, Human
ucgccaguuccaguucgugcc

SEQ ID NO: 1075932 - RNA, 24 nt, Human
ucuccugccucagccucccgagua

SEQ ID NO: 1075933 - RNA, 19 nt, Human
ucucucccagggccccaca

SEQ ID NO: 1075934 - RNA, 27 nt, Human
ucuucagcuuuuggacuuauaucagug

SEQ ID NO: 1075935 - RNA, 25 nt, Human
ucuuccucuugucgugugcucugga

SEQ ID NO: 1075936 - RNA, 23 nt, Human
ugaagaaaaccagucagaaaaaa

SEQ ID NO: 1075937 - RNA, 23 nt, Human
ugaccuagugauccgcccgccuc

SEQ ID NO: 1075938 - RNA, 18 nt, Human
ugaccucaggugauccgc

SEQ ID NO: 1075939 - RNA, 21 nt, Human
ugaccucaggugauccgccca

SEQ ID NO: 1075940 - RNA, 24 nt, Human
ugaccucaggugauccgcccaccu

SEQ ID NO: 1075941 - RNA, 18 nt, Human
ugagauuacaggugugcg

SEQ ID NO: 1075942 - RNA, 21 nt, Human
ugagauuacaggugugcgcca

SEQ ID NO: 1075943 - RNA, 22 nt, Human
ugagauuacaggugugcgccac

SEQ ID NO: 1075944 - RNA, 24 nt, Human
ugagauuacaggugugcgccacca

SEQ ID NO: 1075945 - RNA, 25 nt, Human
ugagauuacaggugugcgccaccau

SEQ ID NO: 1075946 - RNA, 23 nt, Human
ugagauugugagguaaaguugcu

SEQ ID NO: 1075947 - RNA, 23 nt, Human
ugagccaaggucgcaccacugca

SEQ ID NO: 1075948 - RNA, 23 nt, Human
ugagucucucccagggccccaca

SEQ ID NO: 1075949 - RNA, 23 nt, Human
ugagugucagaauggucccagcu

SEQ ID NO: 1075950 - RNA, 24 nt, Human
ugauccgcccaccucagccuccca

SEQ ID NO: 1075951 - RNA, 20 nt, Human
ugcaaccucugccuccuggg

SEQ ID NO: 1075952 - RNA, 25 nt, Human
ugcccugucggcuucccuacuuuug

SEQ ID NO: 1075953 - RNA, 24 nt, Human
ugccucagccucccgaguagcuga

SEQ ID NO: 1075954 - RNA, 23 nt, Human
ugcuccucacagacacacccagg

SEQ ID NO: 1075955 - RNA, 24 nt, Human
ugcugggauuacaggcgugagcca

SEQ ID NO: 1075956 - RNA, 19 nt, Human
ugggauuacaggagugagc

SEQ ID NO: 1075957 - RNA, 20 nt, Human
ugggauuacaggagugagcc

SEQ ID NO: 1075958 - RNA, 21 nt, Human
ugggauuacaggagugagccg

SEQ ID NO: 1075959 - RNA, 21 nt, Human
ugggauuacaggagugagccg

SEQ ID NO: 1075960 - RNA, 22 nt, Human
ugggauuacaggagugagccgu

SEQ ID NO: 1075961 - RNA, 23 nt, Human
ugggauuacaggagugagccgua

SEQ ID NO: 1075962 - RNA, 18 nt, Human
ugggauuacaggcgugag

SEQ ID NO: 1075963 - RNA, 19 nt, Human
ugggauuacaggcgugagc

SEQ ID NO: 1075964 - RNA, 21 nt, Human
ugggauuacaggcgugagcca

SEQ ID NO: 1075965 - RNA, 22 nt, Human
ugggauuacaggcgugagccac

SEQ ID NO: 1075966 - RNA, 22 nt, Human
ugggauuacaggcgugagccac

SEQ ID NO: 1075967 - RNA, 24 nt, Human
ugggauuacaggcgugagccacug

SEQ ID NO: 1075968 - RNA, 26 nt, Human
ugggauuacaggcgugagccacugcg

SEQ ID NO: 1075969 - RNA, 20 nt, Human
ugggggggugcauguaggga

SEQ ID NO: 1075970 - RNA, 19 nt, Human
uuacacucuacucucucca

SEQ ID NO: 1075971 - RNA, 18 nt, Human
uuagagacaggguuucac

SEQ ID NO: 1075972 - RNA, 22 nt, Human
uuaguaaagacaggguuucacc

SEQ ID NO: 1075973 - RNA, 24 nt, Human
uuaguaaagacaggguuucaccgu

SEQ ID NO: 1075974 - RNA, 24 nt, Human
uuauuagagacaggguuucacuau

SEQ ID NO: 1075975 - RNA, 24 nt, Human
uucaaaaacuucuguuuucauugc

SEQ ID NO: 1075976 - RNA, 18 nt, Human
uucaagggauucuccugc

SEQ ID NO: 1075977 - RNA, 23 nt, Human
uucaagggauucuccugccucag

SEQ ID NO: 1075978 - RNA, 19 nt, Human
uucaucuuccuccaaccug

SEQ ID NO: 1075979 - RNA, 24 nt, Human
uuccaguucgugcccacuuguggg

SEQ ID NO: 1075980 - RNA, 25 nt, Human
uuccaguucgugcccacuugugggg

SEQ ID NO: 1075981 - RNA, 22 nt, Human
uugaugccuuuuucaaaaacuu

SEQ ID NO: 1075982 - RNA, 23 nt, Human
uugcaaccucugccuccuggguu

SEQ ID NO: 1075983 - RNA, 24 nt, Human
uugcaaccucugccuccuggguuc

SEQ ID NO: 1075984 - RNA, 20 nt, Human
uugccagggucucucaggcc

SEQ ID NO: 1075985 - RNA, 19 nt, Human
uuggauagcaggcaggagg

SEQ ID NO: 1075986 - RNA, 23 nt, Human
uugucgugugcucuggagacccu

SEQ ID NO: 1075987 - RNA, 19 nt, Human
uuucaccguguuagccagg

SEQ ID NO: 1075988 - RNA, 18 nt, Human
uuucacuauguuggccgg

SEQ ID NO: 1075989 - RNA, 22 nt, Human
uuucuaaggacugggggaggca

SEQ ID NO: 1075990 - RNA, 21 nt, Human
uuuucguauuuuuauuagaga

SEQ ID NO: 1075991 - RNA, 24 nt, Human
uuuuuaguaaagacaggguuucac

SEQ ID NO: 1075992 - RNA, 24 nt, Human
uuuuuauuagagacaggguuucac

SEQ ID NO: 1075993 - RNA, 20 nt, Human
uuuuuuuuuuugagacagag

SEQ ID NO: 1075994 - RNA, 26 nt, Human
uuuuuuuuuuuugagacagagucuca

SEQ ID NO: 1075995 - RNA, 24 nt, Human
accucccauggguguucacgagaa

SEQ ID NO: 1075996 - RNA, 21 nt, Human
agcaguccauucacccaucuc

SEQ ID NO: 1075997 - RNA, 18 nt, Human
cacaccuucagaccaguc

SEQ ID NO: 1075998 - RNA, 23 nt, Human
cacccaucucuucaggaucucug

SEQ ID NO: 1075999 - RNA, 19 nt, Human
cacugagcgagcucccuug

SEQ ID NO: 1076000 - RNA, 21 nt, Human
cagaacuucccgagccagcau

SEQ ID NO: 1076001 - RNA, 26 nt, Human
cagagggcaccugcacaccuucagac

SEQ ID NO: 1076002 - RNA, 24 nt, Human
ccagcauccaccacaucaaaccca

SEQ ID NO: 1076003 - RNA, 20 nt, Human
gaacucaggagcuggagcag

SEQ ID NO: 1076004 - RNA, 21 nt, Human
ggagcugcagaccagucuucc

SEQ ID NO: 1076005 - RNA, 24 nt, Human
gugaacucaggagcuggagcaguc

SEQ ID NO: 1076006 - RNA, 21 nt, Human
uagcgcagaggagaaucuguu

SEQ ID NO: 1076007 - RNA, 20 nt, Human
uccauucacccaucucuuca

SEQ ID NO: 1076008 - RNA, 20 nt, Human
ucccgagccagcauccacca

SEQ ID NO: 1076009 - RNA, 26 nt, Human
ucccuuguuguugcaugggauggcaa

SEQ ID NO: 1076010 - RNA, 24 nt, Human
ucucuucaggaucucuguagaagu

SEQ ID NO: 1076011 - RNA, 25 nt, Human
ucugcaaccucaggcugaguagcag

SEQ ID NO: 1076012 - RNA, 22 nt, Human
ugaauaggcacagagggcaccu

SEQ ID NO: 1076013 - RNA, 25 nt, Human
ugaauaggcacagagggcaccugca

SEQ ID NO: 1076014 - RNA, 18 nt, Human
ugagcgagcucccuuguu

SEQ ID NO: 1076015 - RNA, 20 nt, Human
uggcaggcugagcgcuccag

SEQ ID NO: 1076016 - RNA, 18 nt, Human
uggugccacgcaugcgca

SEQ ID NO: 1076017 - RNA, 21 nt, Human
uguccacauagcgcagaggag

SEQ ID NO: 1076018 - RNA, 19 nt, Human
aaagugcugggauuacagg

SEQ ID NO: 1076019 - RNA, 19 nt, Human
aaagugcugggauuacagg

SEQ ID NO: 1076020 - RNA, 24 nt, Human
aaagugcugggauuacaggaguga

SEQ ID NO: 1076021 - RNA, 19 nt, Human
aacaguggacacuccaccu

SEQ ID NO: 1076022 - RNA, 23 nt, Human
aagaagaggccagucugaccuga

SEQ ID NO: 1076023 - RNA, 22 nt, Human
aagcaccaagaguagaggaggg

SEQ ID NO: 1076024 - RNA, 24 nt, Human
aagugaucugcccgccuuggccuc

SEQ ID NO: 1076025 - RNA, 18 nt, Human
aagugcugggauuacagg

SEQ ID NO: 1076026 - RNA, 22 nt, Human
aagugcugggauuacaggaguc

SEQ ID NO: 1076027 - RNA, 26 nt, Human
aagugcugggauuacaggagugagcc

SEQ ID NO: 1076028 - RNA, 21 nt, Human
acaaguccaaauuuacacuca

SEQ ID NO: 1076029 - RNA, 19 nt, Human
acacugcagcuuccccugg

SEQ ID NO: 1076030 - RNA, 19 nt, Human
acacugcccagagcaaaac

SEQ ID NO: 1076031 - RNA, 20 nt, Human
accauguuggccaggcuggu

SEQ ID NO: 1076032 - RNA, 22 nt, Human
accauguuggccaggcuggucu

SEQ ID NO: 1076033 - RNA, 24 nt, Human
accauguuggccaggcuggucuug

SEQ ID NO: 1076034 - RNA, 18 nt, Human
acgggguuuuaccauguu

SEQ ID NO: 1076035 - RNA, 23 nt, Human
acgggguuuuaccauguuggcca

SEQ ID NO: 1076036 - RNA, 24 nt, Human
acgggguuuuaccauguuggccag

SEQ ID NO: 1076037 - RNA, 23 nt, Human
acugucagaucugaacucugcgg

SEQ ID NO: 1076038 - RNA, 23 nt, Human
acuucacccccaccuugccccac

SEQ ID NO: 1076039 - RNA, 22 nt, Human
agcaccaagaguagaggaggga

SEQ ID NO: 1076040 - RNA, 22 nt, Human
aggcacacagaacaguggacac

SEQ ID NO: 1076041 - RNA, 21 nt, Human
aguagcugagauuacaggcau

SEQ ID NO: 1076042 - RNA, 24 nt, Human
agugauuuuccugccucagccucc

SEQ ID NO: 1076043 - RNA, 23 nt, Human
agugccacccauucccuccccac

SEQ ID NO: 1076044 - RNA, 18 nt, Human
aguggacacuccaccucc

SEQ ID NO: 1076045 - RNA, 20 nt, Human
augcagcaggagugcacuuc

SEQ ID NO: 1076046 - RNA, 24 nt, Human
auuuuuguauuuuuaguagagacg

SEQ ID NO: 1076047 - RNA, 24 nt, Human
caaagugcugggauuacaggagug

SEQ ID NO: 1076048 - RNA, 18 nt, Human
caacugucagaucugaac

SEQ ID NO: 1076049 - RNA, 20 nt, Human
caagaguagaggagggaaga

SEQ ID NO: 1076050 - RNA, 22 nt, Human
caagugauuuuccugccucagc

SEQ ID NO: 1076051 - RNA, 24 nt, Human
cacaaugaaguuucagcauugaga

SEQ ID NO: 1076052 - RNA, 22 nt, Human
cacacagaacaguggacacucc

SEQ ID NO: 1076053 - RNA, 21 nt, Human
cacaugcuuuacaacuguacc

SEQ ID NO: 1076054 - RNA, 24 nt, Human
caccaugcauggcuaauuuuugua

SEQ ID NO: 1076055 - RNA, 23 nt, Human
cacccccaccuugccccaccucg

SEQ ID NO: 1076056 - RNA, 21 nt, Human
cacugcaaccuccgccucccg

SEQ ID NO: 1076057 - RNA, 23 nt, Human
cacugcaaccuccgccucccggg

SEQ ID NO: 1076058 - RNA, 18 nt, Human
cacugcagcuuccccugg

SEQ ID NO: 1076059 - RNA, 28 nt, Human
cacuucacccccaccuugccccaccaac

SEQ ID NO: 1076060 - RNA, 22 nt, Human
cagacacgcagcagugccaccc

SEQ ID NO: 1076061 - RNA, 24 nt, Human
cagagucuugcucugucgcccggg

SEQ ID NO: 1076062 - RNA, 19 nt, Human
cagcacccacgugugugug

SEQ ID NO: 1076063 - RNA, 24 nt, Human
caguggacacuccaccucccugag

SEQ ID NO: 1076064 - RNA, 24 nt, Human
cauguuggccaggcuggucuugaa

SEQ ID NO: 1076065 - RNA, 19 nt, Human
ccaaagugcugggauuaca

SEQ ID NO: 1076066 - RNA, 21 nt, Human
ccaaagugcugggauuacagg

SEQ ID NO: 1076067 - RNA, 24 nt, Human
ccaaagugcugggauuacaggagu

SEQ ID NO: 1076068 - RNA, 20 nt, Human
ccacacugcagcuuccccug

SEQ ID NO: 1076069 - RNA, 23 nt, Human
ccacagacacgcagcagugccac

SEQ ID NO: 1076070 - RNA, 18 nt, Human
ccacccauucccucccca

SEQ ID NO: 1076071 - RNA, 20 nt, Human
ccacucaugcagcaggaguu

SEQ ID NO: 1076072 - RNA, 23 nt, Human
ccagcacccacgugugugugugc

SEQ ID NO: 1076073 - RNA, 21 nt, Human
ccagccagcacccacgugugu

SEQ ID NO: 1076074 - RNA, 18 nt, Human
cccaccacaaccuggccc

SEQ ID NO: 1076075 - RNA, 19 nt, Human
cccagagcaaaacuaggca

SEQ ID NO: 1076076 - RNA, 22 nt, Human
cccagugggguggcccccacag

SEQ ID NO: 1076077 - RNA, 20 nt, Human
ccccacacugcagcuucccc

SEQ ID NO: 1076078 - RNA, 26 nt, Human
ccccacagacacgcagcagugccacc

SEQ ID NO: 1076079 - RNA, 19 nt, Human
cccgaguagcugagauuac

SEQ ID NO: 1076080 - RNA, 24 nt, Human
cccgaguagcugagauuacaggca

SEQ ID NO: 1076081 - RNA, 22 nt, Human
cccgccuuggccucccaaagug

SEQ ID NO: 1076082 - RNA, 23 nt, Human
cccggguucaagugauuuuccuc

SEQ ID NO: 1076083 - RNA, 23 nt, Human
cccggguucaagugauuuuccug

SEQ ID NO: 1076084 - RNA, 23 nt, Human
ccgaguagcugagauuacaggca

SEQ ID NO: 1076085 - RNA, 24 nt, Human
ccgaguagcugagauuacaggcau

SEQ ID NO: 1076086 - RNA, 24 nt, Human
ccgccucccggguucaagugauuu

SEQ ID NO: 1076087 - RNA, 24 nt, Human
ccggagggacugagaguacuggug

SEQ ID NO: 1076088 - RNA, 24 nt, Human
ccucacugcaaccuccgccucccg

SEQ ID NO: 1076089 - RNA, 19 nt, Human
ccugaccucaagugaucug

SEQ ID NO: 1076090 - RNA, 22 nt, Human
ccugaccucaagugaucugccc

SEQ ID NO: 1076091 - RNA, 18 nt, Human
ccugcaccugccagcgcc

SEQ ID NO: 1076092 - RNA, 22 nt, Human
ccugccacucaugcagcaggag

SEQ ID NO: 1076093 - RNA, 23 nt, Human
ccugccucagccucccgaguagc

SEQ ID NO: 1076094 - RNA, 24 nt, Human
cgcccgggcuggaguguaguggug

SEQ ID NO: 1076095 - RNA, 24 nt, Human
cggguucaagugauuuuccugccu

SEQ ID NO: 1076096 - RNA, 24 nt, Human
cucacugcaaccuccgccucccgg

SEQ ID NO: 1076097 - RNA, 21 nt, Human
cuccaccucccugagcgacca

SEQ ID NO: 1076098 - RNA, 26 nt, Human
cuccugaccucaagugaucugcccgc

SEQ ID NO: 1076099 - RNA, 19 nt, Human
cucgaguguccuagaagcc

SEQ ID NO: 1076100 - RNA, 23 nt, Human
cugcaaccuccgccucccggguu

SEQ ID NO: 1076101 - RNA, 24 nt, Human
cugcaaccuccgccucccggguuc

SEQ ID NO: 1076102 - RNA, 24 nt, Human
cugcccagagcaaaacuaggcaca

SEQ ID NO: 1076103 - RNA, 23 nt, Human
cugccucagccucccgaguagcu

SEQ ID NO: 1076104 - RNA, 19 nt, Human
cuugcucugucgcccgggc

SEQ ID NO: 1076105 - RNA, 24 nt, Human
cuugcucugucgcccgggcuggag

SEQ ID NO: 1076106 - RNA, 25 nt, Human
gaagcccccaucauagcuucuaccc

SEQ ID NO: 1076107 - RNA, 24 nt, Human
gaccucaagugaucugcccgccuu

SEQ ID NO: 1076108 - RNA, 19 nt, Human
gagacccccaguggggugg

SEQ ID NO: 1076109 - RNA, 24 nt, Human
gagacgggguuuuaccauguuggc

SEQ ID NO: 1076110 - RNA, 24 nt, Human
gaguagcugagauuacaggcaugc

SEQ ID NO: 1076111 - RNA, 18 nt, Human
gauuacaggagugagccg

SEQ ID NO: 1076112 - RNA, 24 nt, Human
gauuacaggcaugcaccaccaugc

SEQ ID NO: 1076113 - RNA, 21 nt, Human
gcaugcaccaccaugcauggu

SEQ ID NO: 1076114 - RNA, 18 nt, Human
gccccgcccccaccacaa

SEQ ID NO: 1076115 - RNA, 20 nt, Human
gcccgggcuggaguguagug

SEQ ID NO: 1076116 - RNA, 23 nt, Human
gcccgggcuggaguguaguggug

SEQ ID NO: 1076117 - RNA, 22 nt, Human
gccuuggccucccaaagugcug

SEQ ID NO: 1076118 - RNA, 23 nt, Human
gcuggucuugaacuccugaccuc

SEQ ID NO: 1076119 - RNA, 24 nt, Human
ggcuggucuugaacuccugaccuc

SEQ ID NO: 1076120 - RNA, 23 nt, Human
gggguuuuaccauguuggccagg

SEQ ID NO: 1076121 - RNA, 22 nt, Human
ggguucaagugauuuuccugcc

SEQ ID NO: 1076122 - RNA, 22 nt, Human
ggguuuuaccauguuggccagg

SEQ ID NO: 1076123 - RNA, 19 nt, Human
ggucuugaacuccugaccu

SEQ ID NO: 1076124 - RNA, 23 nt, Human
guagagacgggguuuuaccaugu

SEQ ID NO: 1076125 - RNA, 20 nt, Human
guagcugagauuacaggcau

SEQ ID NO: 1076126 - RNA, 24 nt, Human
gugauuuuccugccucagccuccc

SEQ ID NO: 1076127 - RNA, 24 nt, Human
uaauuuuuguauuuuuaguagaga

SEQ ID NO: 1076128 - RNA, 22 nt, Human
uacaggagugagccgccgcgcc

SEQ ID NO: 1076129 - RNA, 23 nt, Human
uacaggagugagccgccgcgccu

SEQ ID NO: 1076130 - RNA, 23 nt, Human
uacaggagugagccgccgcgccu

SEQ ID NO: 1076131 - RNA, 21 nt, Human
uaccauguuggccaggcuggu

SEQ ID NO: 1076132 - RNA, 24 nt, Human
uaccauguuggccaggcuggucuu

SEQ ID NO: 1076133 - RNA, 27 nt, Human
uaccauguuggccaggcuggucuugaa

SEQ ID NO: 1076134 - RNA, 19 nt, Human
uacccuggcagacggaacu

SEQ ID NO: 1076135 - RNA, 24 nt, Human
uaccucacugcaaccuccgccucc

SEQ ID NO: 1076136 - RNA, 21 nt, Human
uagaagagcugccccggaggg

SEQ ID NO: 1076137 - RNA, 18 nt, Human
uagaaucaacuugcuccc

SEQ ID NO: 1076138 - RNA, 22 nt, Human
uagagacgggguuuuaccaugu

SEQ ID NO: 1076139 - RNA, 18 nt, Human
uaggaagaaacugaugca

SEQ ID NO: 1076140 - RNA, 21 nt, Human
uaggaagaaacugaugcaaug

SEQ ID NO: 1076141 - RNA, 24 nt, Human
uaguagagacgggguuuuaccaug

SEQ ID NO: 1076142 - RNA, 19 nt, Human
ucaagugauuuuccugccu

SEQ ID NO: 1076143 - RNA, 23 nt, Human
ucacugcaaccuccgccucccgg

SEQ ID NO: 1076144 - RNA, 24 nt, Human
ucacugcaaccuccgccucccggg

SEQ ID NO: 1076145 - RNA, 25 nt, Human
ucacugcaaccuccgccucccgggu

SEQ ID NO: 1076146 - RNA, 27 nt, Human
ucacugcaaccuccgccucccggguuc

SEQ ID NO: 1076147 - RNA, 23 nt, Human
ucagcaacacugcccagagcaaa

SEQ ID NO: 1076148 - RNA, 21 nt, Human
ucagccccgcccccaccacaa

SEQ ID NO: 1076149 - RNA, 21 nt, Human
ucagccucgaguguccuagaa

SEQ ID NO: 1076150 - RNA, 18 nt, Human
ucccaaagugcugggauu

SEQ ID NO: 1076151 - RNA, 23 nt, Human
ucccaaagugcugggauuacagg

SEQ ID NO: 1076152 - RNA, 24 nt, Human
ucccgaguagcugagauuacaggc

SEQ ID NO: 1076153 - RNA, 18 nt, Human
ucccggguucaagugauu

SEQ ID NO: 1076154 - RNA, 24 nt, Human
ucccggguucaagugauuuuccug

SEQ ID NO: 1076155 - RNA, 19 nt, Human
ucccugagcgaccaagagc

SEQ ID NO: 1076156 - RNA, 20 nt, Human
ucccugagcgaccaagagcc

SEQ ID NO: 1076157 - RNA, 21 nt, Human
ucccugagcgaccaagagccc

SEQ ID NO: 1076158 - RNA, 25 nt, Human
ucccugagcgaccaagagcccucug

SEQ ID NO: 1076159 - RNA, 24 nt, Human
ucgcccgggcuggaguguaguggu

SEQ ID NO: 1076160 - RNA, 24 nt, Human
ucugucgcccgggcuggaguguag

SEQ ID NO: 1076161 - RNA, 21 nt, Human
ucuugaacuccugaccucaag

SEQ ID NO: 1076162 - RNA, 18 nt, Human
ucuugcucugucgcccgg

SEQ ID NO: 1076163 - RNA, 23 nt, Human
ucuugcucugucgcccgggcugg

SEQ ID NO: 1076164 - RNA, 24 nt, Human
ucuugcucugucgcccgggcugga

SEQ ID NO: 1076165 - RNA, 23 nt, Human
ucuuuucuuguaaucuuucugac

SEQ ID NO: 1076166 - RNA, 27 nt, Human
ugaaaagagacugacuuuauaaaagua

SEQ ID NO: 1076167 - RNA, 22 nt, Human
ugacacagagucuugcucuguc

SEQ ID NO: 1076168 - RNA, 18 nt, Human
ugaccucaagugaucugc

SEQ ID NO: 1076169 - RNA, 24 nt, Human
ugaccucaagugaucugcccgccu

SEQ ID NO: 1076170 - RNA, 21 nt, Human
ugagauuacaggcaugcacca

SEQ ID NO: 1076171 - RNA, 24 nt, Human
ugagauuacaggcaugcaccacca

SEQ ID NO: 1076172 - RNA, 23 nt, Human
ugcacaaagaccugcaccugcca

SEQ ID NO: 1076173 - RNA, 19 nt, Human
ugcccugccacucaugcag

SEQ ID NO: 1076174 - RNA, 24 nt, Human
ugccucagccucccgaguagcuga

SEQ ID NO: 1076175 - RNA, 24 nt, Human
ugcucugucgcccgggcuggagug

SEQ ID NO: 1076176 - RNA, 21 nt, Human
ugcuuuacaacuguacccaca

SEQ ID NO: 1076177 - RNA, 22 nt, Human
ugcuuuacaacuguacccacaa

SEQ ID NO: 1076178 - RNA, 21 nt, Human
uggagccuuagcagucagccc

SEQ ID NO: 1076179 - RNA, 24 nt, Human
uggccaggcuggucuugaacuccu

SEQ ID NO: 1076180 - RNA, 19 nt, Human
ugggauuacaggagugagc

SEQ ID NO: 1076181 - RNA, 21 nt, Human
ugggauuacaggagugagccg

SEQ ID NO: 1076182 - RNA, 22 nt, Human
ugggauuacaggagugagccgc

SEQ ID NO: 1076183 - RNA, 23 nt, Human
ugggauuacaggagugagccgcc

SEQ ID NO: 1076184 - RNA, 24 nt, Human
ugggauuacaggagugagccgccg

SEQ ID NO: 1076185 - RNA, 21 nt, Human
ugugugugugcacccugcccu

SEQ ID NO: 1076186 - RNA, 18 nt, Human
uuaguagagacgggguuu

SEQ ID NO: 1076187 - RNA, 22 nt, Human
uuaguagagacgggguuuuacc

SEQ ID NO: 1076188 - RNA, 24 nt, Human
uuaguagagacgggguuuuaccau

SEQ ID NO: 1076189 - RNA, 21 nt, Human
uucaagugauuuuccugccuc

SEQ ID NO: 1076190 - RNA, 23 nt, Human
uucaagugauuuuccugccucag

SEQ ID NO: 1076191 - RNA, 24 nt, Human
uucaagugauuuuccugccucagc

SEQ ID NO: 1076192 - RNA, 19 nt, Human
uucacccccaccuugcccc

SEQ ID NO: 1076193 - RNA, 21 nt, Human
uucccuccccacacugcagcu

SEQ ID NO: 1076194 - RNA, 24 nt, Human
uugcucugucgcccgggcuggagu

SEQ ID NO: 1076195 - RNA, 18 nt, Human
uuggccucccaaagugcu

SEQ ID NO: 1076196 - RNA, 23 nt, Human
uuguauuuuuaguagagacgggg

SEQ ID NO: 1076197 - RNA, 24 nt, Human
uuuuuaguagagacgggguuuuac

SEQ ID NO: 1076198 - RNA, 20 nt, Human
uuuuuguauuuuuaguagag

SEQ ID NO: 1076199 - RNA, 19 nt, Human
uuuuuuuuuugacacagag

SEQ ID NO: 1076200 - RNA, 24 nt, Human
uuuuuuuuuuuugacacagagucu

SEQ ID NO: 1076201 - RNA, 23 nt, Human
uuuuuuuuuuuuuuuugacacag

SEQ ID NO: 1076202 - RNA, 19 nt, Human
aaaagcaacccucgacaca

SEQ ID NO: 1076203 - RNA, 24 nt, Human
aaauaaaucccacuuccaagguuu

SEQ ID NO: 1076204 - RNA, 21 nt, Human
aagcaacccucgacacaagau

SEQ ID NO: 1076205 - RNA, 19 nt, Human
acuccaugcacacugucgu

SEQ ID NO: 1076206 - RNA, 19 nt, Human
agaggaaccaaguucccag

SEQ ID NO: 1076207 - RNA, 19 nt, Human
caccauggcccugggucac

SEQ ID NO: 1076208 - RNA, 21 nt, Human
caccauggcccugggucacgg

SEQ ID NO: 1076209 - RNA, 22 nt, Human
ccagaggcauccuggaggcugg

SEQ ID NO: 1076210 - RNA, 18 nt, Human
ccaucugucucucccagg

SEQ ID NO: 1076211 - RNA, 23 nt, Human
cuggaggcuggccuuggugcugc

SEQ ID NO: 1076212 - RNA, 19 nt, Human
gaagccacacacagcggcc

SEQ ID NO: 1076213 - RNA, 20 nt, Human
ggugcugcuggaaguuuugg

SEQ ID NO: 1076214 - RNA, 24 nt, Human
uacgucacaaaugagcaggagucu

SEQ ID NO: 1076215 - RNA, 21 nt, Human
uacuugauacuuguacugagc

SEQ ID NO: 1076216 - RNA, 22 nt, Human
uauuuguguaugucugaaauac

SEQ ID NO: 1076217 - RNA, 21 nt, Human
uccacuacuuuggguaaaagc

SEQ ID NO: 1076218 - RNA, 19 nt, Human
ucccacugaugaaggcuuc

SEQ ID NO: 1076219 - RNA, 18 nt, Human
ucccagaggcauccugga

SEQ ID NO: 1076220 - RNA, 24 nt, Human
uccuggaggcuggccuuggugcug

SEQ ID NO: 1076221 - RNA, 18 nt, Human
ucgaagccacacacagcg

SEQ ID NO: 1076222 - RNA, 20 nt, Human
ucucccaggugugaguacuu

SEQ ID NO: 1076223 - RNA, 21 nt, Human
ucuguggugacagaggcuguu

SEQ ID NO: 1076224 - RNA, 20 nt, Human
ucuuccuucucuuuaaucuc

SEQ ID NO: 1076225 - RNA, 21 nt, Human
ugaaauaaaucccacuuccaa

SEQ ID NO: 1076226 - RNA, 18 nt, Human
ugacagaggcuguuugug

SEQ ID NO: 1076227 - RNA, 21 nt, Human
ugagcaaaucacugaaauaaa

SEQ ID NO: 1076228 - RNA, 19 nt, Human
ugauguggacauccuccag

SEQ ID NO: 1076229 - RNA, 25 nt, Human
ugcacaccacgaucuuccacuacuu

SEQ ID NO: 1076230 - RNA, 20 nt, Human
uggcccugggucacggcucc

SEQ ID NO: 1076231 - RNA, 21 nt, Human
uggcccugggucacggcuccu

SEQ ID NO: 1076232 - RNA, 25 nt, Human
ugggcacaugacuuuuauuugugua

SEQ ID NO: 1076233 - RNA, 22 nt, Human
uggugcugcuggaaguuuuggc

SEQ ID NO: 1076234 - RNA, 20 nt, Human
uucuuugcacaccacgaucu

SEQ ID NO: 1076235 - RNA, 18 nt, Human
uugaaaaauuugaaaacu

SEQ ID NO: 1076236 - RNA, 19 nt, Human
uuguguaugucugaaauac

SEQ ID NO: 1076237 - RNA, 24 nt, Human
aaacagggacuccucaaggccaga

SEQ ID NO: 1076238 - RNA, 22 nt, Human
aaagacgggguccuuguccguc

SEQ ID NO: 1076239 - RNA, 21 nt, Human
aacauuuugucuuucuuccuc

SEQ ID NO: 1076240 - RNA, 22 nt, Human
aaccucuaaaggccaaccaagc

SEQ ID NO: 1076241 - RNA, 19 nt, Human
aagaacaaaauucagagga

SEQ ID NO: 1076242 - RNA, 20 nt, Human
aagugcuagggaucgcugcu

SEQ ID NO: 1076243 - RNA, 19 nt, Human
acccccucccaccuggcug

SEQ ID NO: 1076244 - RNA, 21 nt, Human
acuccucugcccaaaagcagg

SEQ ID NO: 1076245 - RNA, 19 nt, Human
acuucuguggcuccacccc

SEQ ID NO: 1076246 - RNA, 22 nt, Human
agaggcuggccuaacguggaua

SEQ ID NO: 1076247 - RNA, 18 nt, Human
aggaaaaaagggaaacag

SEQ ID NO: 1076248 - RNA, 19 nt, Human
aggaagaggaggggccagg

SEQ ID NO: 1076249 - RNA, 20 nt, Human
aggaagaggaggggccaggc

SEQ ID NO: 1076250 - RNA, 18 nt, Human
aggcauggagaggcuggc

SEQ ID NO: 1076251 - RNA, 24 nt, Human
agugcuccuccaugggcacugccu

SEQ ID NO: 1076252 - RNA, 18 nt, Human
aguuccugauuugugaau

SEQ ID NO: 1076253 - RNA, 23 nt, Human
aucugaucuguaauaaacauggc

SEQ ID NO: 1076254 - RNA, 20 nt, Human
augaacaugcucaucucuca

SEQ ID NO: 1076255 - RNA, 19 nt, Human
auuuugucuuucuuccucu

SEQ ID NO: 1076256 - RNA, 18 nt, Human
caagugaacacaacucuc

SEQ ID NO: 1076257 - RNA, 24 nt, Human
caccccagugcacacccuucccag

SEQ ID NO: 1076258 - RNA, 20 nt, Human
cacuuuuguuuuagaguaaa

SEQ ID NO: 1076259 - RNA, 21 nt, Human
cagaucaccgucagcauccuc

SEQ ID NO: 1076260 - RNA, 23 nt, Human
cauggaaacuaagccgucagaga

SEQ ID NO: 1076261 - RNA, 20 nt, Human
cauucaugaauacauuugcu

SEQ ID NO: 1076262 - RNA, 22 nt, Human
ccacgcagagucaccagcugca

SEQ ID NO: 1076263 - RNA, 23 nt, Human
ccacgcagagucaccagcugcac

SEQ ID NO: 1076264 - RNA, 21 nt, Human
ccacgcugucuuacacacugc

SEQ ID NO: 1076265 - RNA, 18 nt, Human
ccaggaagaggaggggcc

SEQ ID NO: 1076266 - RNA, 22 nt, Human
ccaggaagaggaggggccaggc

SEQ ID NO: 1076267 - RNA, 24 nt, Human
cccaggaagaggaggggccaggcu

SEQ ID NO: 1076268 - RNA, 26 nt, Human
cccaggaagaggaggggccaggcucc

SEQ ID NO: 1076269 - RNA, 21 nt, Human
ccccagugcacacccuuccca

SEQ ID NO: 1076270 - RNA, 24 nt, Human
cccucccaccuggcugccucacaa

SEQ ID NO: 1076271 - RNA, 19 nt, Human
ccgcaggacuuuuccuuag

SEQ ID NO: 1076272 - RNA, 20 nt, Human
ccucgagggcauggguugcu

SEQ ID NO: 1076273 - RNA, 21 nt, Human
ccugucaccugcuguggcugg

SEQ ID NO: 1076274 - RNA, 21 nt, Human
ccuuaguucagcuaaagacgg

SEQ ID NO: 1076275 - RNA, 18 nt, Human
cgcagcuugaauccccag

SEQ ID NO: 1076276 - RNA, 22 nt, Human
cgcaggacuuuuccuuaguuca

SEQ ID NO: 1076277 - RNA, 21 nt, Human
cggcagguggcccgagcccca

SEQ ID NO: 1076278 - RNA, 22 nt, Human
cggcagguggcccgagccccuc

SEQ ID NO: 1076279 - RNA, 23 nt, Human
cguguuaaaacaaaaacaaaaac

SEQ ID NO: 1076280 - RNA, 19 nt, Human
cuaguccacaaaaauccuu

SEQ ID NO: 1076281 - RNA, 19 nt, Human
cuccccacugcaaaggguu

SEQ ID NO: 1076282 - RNA, 20 nt, Human
cuccuccccacugcaaaggg

SEQ ID NO: 1076283 - RNA, 20 nt, Human
cugcacaugcugugcgugug

SEQ ID NO: 1076284 - RNA, 18 nt, Human
cugccacaguaacaggcc

SEQ ID NO: 1076285 - RNA, 21 nt, Human
cugcggcagguggcccgagcc

SEQ ID NO: 1076286 - RNA, 21 nt, Human
cuuuauaacucagugcuccuc

SEQ ID NO: 1076287 - RNA, 20 nt, Human
gaaauugaaaaaaagucuuu

SEQ ID NO: 1076288 - RNA, 25 nt, Human
gagcuaccauucaugaauacauuug

SEQ ID NO: 1076289 - RNA, 19 nt, Human
gcagaguuauucuucuuac

SEQ ID NO: 1076290 - RNA, 22 nt, Human
gccacaguaacaggccuggggu

SEQ ID NO: 1076291 - RNA, 22 nt, Human
ggaaacuaagccagggguccac

SEQ ID NO: 1076292 - RNA, 22 nt, Human
ggaauaaaagcaaccagagcua

SEQ ID NO: 1076293 - RNA, 19 nt, Human
ggcuuuucaaggcuuagca

SEQ ID NO: 1076294 - RNA, 19 nt, Human
ggugaaaaggaaaaaaggg

SEQ ID NO: 1076295 - RNA, 18 nt, Human
ggugaguaaagcaggguu

SEQ ID NO: 1076296 - RNA, 22 nt, Human
gucuacacaauaguaugacuuc

SEQ ID NO: 1076297 - RNA, 19 nt, Human
gugaacacaacucucauug

SEQ ID NO: 1076298 - RNA, 21 nt, Human
gugguuugaacuccucugccc

SEQ ID NO: 1076299 - RNA, 22 nt, Human
uaaaacaaaaacaaaaacauuu

SEQ ID NO: 1076300 - RNA, 21 nt, Human
uaacauguguuucuguguagc

SEQ ID NO: 1076301 - RNA, 19 nt, Human
uaacguggauaacaugugu

SEQ ID NO: 1076302 - RNA, 18 nt, Human
uaauccaaaacacagcag

SEQ ID NO: 1076303 - RNA, 19 nt, Human
uagcuuguguuaauaaccu

SEQ ID NO: 1076304 - RNA, 20 nt, Human
uaucuggaauaaaagcaacc

SEQ ID NO: 1076305 - RNA, 22 nt, Human
ucagcauccucgagggcauggg

SEQ ID NO: 1076306 - RNA, 18 nt, Human
uccaugggcacugccucc

SEQ ID NO: 1076307 - RNA, 21 nt, Human
uccaugggcacugccuccuug

SEQ ID NO: 1076308 - RNA, 19 nt, Human
ugaaaaaaagucuuucuac

SEQ ID NO: 1076309 - RNA, 21 nt, Human
ugaaaaaaagucuuucuacau

SEQ ID NO: 1076310 - RNA, 25 nt, Human
ugaaaaaaagucuuucuacauaggg

SEQ ID NO: 1076311 - RNA, 18 nt, Human
ugaaaaggaaaaaaggga

SEQ ID NO: 1076312 - RNA, 21 nt, Human
ugaaaguaaacauuaauaacc

SEQ ID NO: 1076313 - RNA, 18 nt, Human
ugaaaugcaaacaaacug

SEQ ID NO: 1076314 - RNA, 21 nt, Human
ugaaaugcaaacaaacugugg

SEQ ID NO: 1076315 - RNA, 18 nt, Human
ugccaugcuaagauagca

SEQ ID NO: 1076316 - RNA, 19 nt, Human
uggccuaacguggauaaca

SEQ ID NO: 1076317 - RNA, 22 nt, Human
ugggugaaaaggaaaaaaggga

SEQ ID NO: 1076318 - RNA, 20 nt, Human
uggugacaacucuuuuuuua

SEQ ID NO: 1076319 - RNA, 19 nt, Human
ugguuugaacuccucugcc

SEQ ID NO: 1076320 - RNA, 19 nt, Human
ugugaauguuugaagcuga

SEQ ID NO: 1076321 - RNA, 19 nt, Human
uguuaauaaccucacacaa

SEQ ID NO: 1076322 - RNA, 24 nt, Human
uucaugaauacauuugccuauagg

SEQ ID NO: 1076323 - RNA, 19 nt, Human
uucccagggcgcagucugg

SEQ ID NO: 1076324 - RNA, 19 nt, Human
uuccucuauuguuauaaau

SEQ ID NO: 1076325 - RNA, 21 nt, Human
uuucaggaagggcugagcuuc

SEQ ID NO: 1076326 - RNA, 22 nt, Human
uuucugcuucaguaucugaaga

SEQ ID NO: 1076327 - RNA, 18 nt, Human
aaaaaaaagguuaccugg

SEQ ID NO: 1076328 - RNA, 25 nt, Human
aaaaaaacccccaaauaaucccacc

SEQ ID NO: 1076329 - RNA, 20 nt, Human
aaaaagguuaccuggcaccu

SEQ ID NO: 1076330 - RNA, 23 nt, Human
aaaacacuacauugagauggauu

SEQ ID NO: 1076331 - RNA, 19 nt, Human
aaaaggaaagaagagcaga

SEQ ID NO: 1076332 - RNA, 20 nt, Human
aaaaggaaccagauugaaaa

SEQ ID NO: 1076333 - RNA, 22 nt, Human
aaaaggaaccagauugaaaaag

SEQ ID NO: 1076334 - RNA, 18 nt, Human
aaacaaacaaaaaaaacc

SEQ ID NO: 1076335 - RNA, 21 nt, Human
aaacaaacaaaaaaaaccccc

SEQ ID NO: 1076336 - RNA, 24 nt, Human
aaacaaacaaaaaaaacccccaaa

SEQ ID NO: 1076337 - RNA, 20 nt, Human
aaagaagagcagaauacaaa

SEQ ID NO: 1076338 - RNA, 21 nt, Human
aaaggaaccagauugaaaaag

SEQ ID NO: 1076339 - RNA, 24 nt, Human
aaaugucaaagacaacuucugacc

SEQ ID NO: 1076340 - RNA, 18 nt, Human
aacacagugaaaccccau

SEQ ID NO: 1076341 - RNA, 18 nt, Human
aacacagugaaaccccau

SEQ ID NO: 1076342 - RNA, 19 nt, Human
aacacagugaaaccccauu

SEQ ID NO: 1076343 - RNA, 21 nt, Human
aacacagugaaaccccauuuc

SEQ ID NO: 1076344 - RNA, 24 nt, Human
aacagagcaagauucugucucaaa

SEQ ID NO: 1076345 - RNA, 22 nt, Human
aacccccaaauaaucccaccuc

SEQ ID NO: 1076346 - RNA, 18 nt, Human
aacugcuugaacccggga

SEQ ID NO: 1076347 - RNA, 24 nt, Human
aaggcgggcagaucacaaggucag

SEQ ID NO: 1076348 - RNA, 18 nt, Human
aauuagccaggcauggug

SEQ ID NO: 1076349 - RNA, 25 nt, Human
acaaacaucuccaauguuuaccucc

SEQ ID NO: 1076350 - RNA, 18 nt, Human
acaaaguacagaccacug

SEQ ID NO: 1076351 - RNA, 24 nt, Human
acagagcaagauucugucucaaaa

SEQ ID NO: 1076352 - RNA, 22 nt, Human
accaaaaaggaaagaagagcag

SEQ ID NO: 1076353 - RNA, 19 nt, Human
accacugauaacuccaccc

SEQ ID NO: 1076354 - RNA, 24 nt, Human
accccauuucuacuaaaaauacaa

SEQ ID NO: 1076355 - RNA, 23 nt, Human
acuccacccaugaagcucaccaa

SEQ ID NO: 1076356 - RNA, 23 nt, Human
agaaagcacaaacuuucagaacu

SEQ ID NO: 1076357 - RNA, 21 nt, Human
agaauacaacagcuguggcua

SEQ ID NO: 1076358 - RNA, 18 nt, Human
agagcaagauucugucuc

SEQ ID NO: 1076359 - RNA, 19 nt, Human
agcaagaguaauauuuuca

SEQ ID NO: 1076360 - RNA, 23 nt, Human
agccaggcaugguggugcgugcc

SEQ ID NO: 1076361 - RNA, 24 nt, Human
agccugggcaacagagcaagauuc

SEQ ID NO: 1076362 - RNA, 18 nt, Human
agcuguaagguguucacu

SEQ ID NO: 1076363 - RNA, 18 nt, Human
aggcaggagaacugcuug

SEQ ID NO: 1076364 - RNA, 24 nt, Human
aggcaggagaacugcuugaacccg

SEQ ID NO: 1076365 - RNA, 24 nt, Human
aggcagggggaaugacuaucucuu

SEQ ID NO: 1076366 - RNA, 24 nt, Human
aggcgcaguggcucacgccuguaa

SEQ ID NO: 1076367 - RNA, 18 nt, Human
aggcgggcagaucacaag

SEQ ID NO: 1076368 - RNA, 24 nt, Human
aggcgggcagaucacaaggucagg

SEQ ID NO: 1076369 - RNA, 24 nt, Human
aggcugaggcaggagaacugcuug

SEQ ID NO: 1076370 - RNA, 23 nt, Human
aguggcucacgccuguaauccca

SEQ ID NO: 1076371 - RNA, 20 nt, Human
auauacaaaaggaaccagaa

SEQ ID NO: 1076372 - RNA, 23 nt, Human
auauuuguagacaugucugagac

SEQ ID NO: 1076373 - RNA, 20 nt, Human
aucacaaggucaggagaucc

SEQ ID NO: 1076374 - RNA, 28 nt, Human
auucugucucaaaaaaaaaaaaaaaaaa

SEQ ID NO: 1076375 - RNA, 21 nt, Human
caaaauauccacaaaguacag

SEQ ID NO: 1076376 - RNA, 20 nt, Human
caaagacaacuucugaccca

SEQ ID NO: 1076377 - RNA, 24 nt, Human
caacacuuuggaaggccaaggcgg

SEQ ID NO: 1076378 - RNA, 24 nt, Human
caagaccauccuggcuaacacagu

SEQ ID NO: 1076379 - RNA, 23 nt, Human
caccagaaaacugccgacagcca

SEQ ID NO: 1076380 - RNA, 24 nt, Human
cacgccuguaaucccaacacuuug

SEQ ID NO: 1076381 - RNA, 19 nt, Human
cagaaaacugccgacagcc

SEQ ID NO: 1076382 - RNA, 21 nt, Human
cagaaaacugccgacagccau

SEQ ID NO: 1076383 - RNA, 18 nt, Human
cagaauacaacagcugug

SEQ ID NO: 1076384 - RNA, 23 nt, Human
cagaccacugauaacuccaccca

SEQ ID NO: 1076385 - RNA, 23 nt, Human
cagauugaaaaagauauugcuga

SEQ ID NO: 1076386 - RNA, 23 nt, Human
cagcgaaacaacagauugcagag

SEQ ID NO: 1076387 - RNA, 19 nt, Human
cagggccgugucuguaacc

SEQ ID NO: 1076388 - RNA, 24 nt, Human
caguggcuaauuuuacucuuaaau

SEQ ID NO: 1076389 - RNA, 23 nt, Human
caucuccaauguuuaccuccucc

SEQ ID NO: 1076390 - RNA, 20 nt, Human
ccaaaaaggaaagaagagca

SEQ ID NO: 1076391 - RNA, 19 nt, Human
ccaacacuuuggaaggcca

SEQ ID NO: 1076392 - RNA, 23 nt, Human
ccauaaauauuuuuauuaaaugu

SEQ ID NO: 1076393 - RNA, 21 nt, Human
cccaaauaaucccaccucuua

SEQ ID NO: 1076394 - RNA, 22 nt, Human
cccaucaccagggccgugucug

SEQ ID NO: 1076395 - RNA, 19 nt, Human
ccccaaauaaucccaccuc

SEQ ID NO: 1076396 - RNA, 23 nt, Human
cccguuuuggaaccuuuucacaa

SEQ ID NO: 1076397 - RNA, 19 nt, Human
cccugcacuccagccuggg

SEQ ID NO: 1076398 - RNA, 19 nt, Human
cccugcacuccagccuggg

SEQ ID NO: 1076399 - RNA, 20 nt, Human
cccugcacuccagccugggc

SEQ ID NO: 1076400 - RNA, 23 nt, Human
cccugcacuccagccugggcaac

SEQ ID NO: 1076401 - RNA, 24 nt, Human
cccugcacuccagccugggcaaca

SEQ ID NO: 1076402 - RNA, 18 nt, Human
ccuacagugagacaggca

SEQ ID NO: 1076403 - RNA, 24 nt, Human
ccuacagugagacaggccgggguc

SEQ ID NO: 1076404 - RNA, 21 nt, Human
ccuauagucccagcuacuugg

SEQ ID NO: 1076405 - RNA, 23 nt, Human
ccucucugauuucacuuuuccug

SEQ ID NO: 1076406 - RNA, 24 nt, Human
ccugcacuccagccugggcaacag

SEQ ID NO: 1076407 - RNA, 24 nt, Human
ccuggcuaacacagugaaacccca

SEQ ID NO: 1076408 - RNA, 22 nt, Human
ccugggcaacagagcaagauuc

SEQ ID NO: 1076409 - RNA, 22 nt, Human
cgggcagaucacaaggucagga

SEQ ID NO: 1076410 - RNA, 18 nt, Human
cucaaaaaaaaaaaaaaa

SEQ ID NO: 1076411 - RNA, 22 nt, Human
cucacgccuguaaucccaacac

SEQ ID NO: 1076412 - RNA, 24 nt, Human
cucacgccuguaaucccaacacuu

SEQ ID NO: 1076413 - RNA, 20 nt, Human
cuccuaaauagaugcagaaa

SEQ ID NO: 1076414 - RNA, 18 nt, Human
cucuccguuuggguggac

SEQ ID NO: 1076415 - RNA, 18 nt, Human
cugacuaaagagaaaggc

SEQ ID NO: 1076416 - RNA, 23 nt, Human
cugcacuccagccugggcaacag

SEQ ID NO: 1076417 - RNA, 23 nt, Human
cugcacuccagccugggcaacag

SEQ ID NO: 1076418 - RNA, 18 nt, Human
cugcuugaacccgggagg

SEQ ID NO: 1076419 - RNA, 23 nt, Human
cuggcuaacacagugaaacccca

SEQ ID NO: 1076420 - RNA, 21 nt, Human
gaaacaacagauugcagagaa

SEQ ID NO: 1076421 - RNA, 19 nt, Human
gaaagcacaaacuuucaga

SEQ ID NO: 1076422 - RNA, 24 nt, Human
gcacuccagccugggcaacagagc

SEQ ID NO: 1076423 - RNA, 19 nt, Human
gcaggagugacugucucuc

SEQ ID NO: 1076424 - RNA, 24 nt, Human
gccacagacaagugcaacaaaacc

SEQ ID NO: 1076425 - RNA, 21 nt, Human
gcgaaacaacagauugcagag

SEQ ID NO: 1076426 - RNA, 20 nt, Human
gcgcaguggcucacgccugu

SEQ ID NO: 1076427 - RNA, 21 nt, Human
ggaggugucccugcacuccag

SEQ ID NO: 1076428 - RNA, 21 nt, Human
ggcacuggcauguggcaccag

SEQ ID NO: 1076429 - RNA, 21 nt, Human
ggcagaucacaaggucaggag

SEQ ID NO: 1076430 - RNA, 22 nt, Human
ggccaggcgcaguggcucacgg

SEQ ID NO: 1076431 - RNA, 22 nt, Human
gggcaaaauauccacaaaguac

SEQ ID NO: 1076432 - RNA, 22 nt, Human
ggugucccugcacuccagccug

SEQ ID NO: 1076433 - RNA, 22 nt, Human
gucaaagacaacuucugaccca

SEQ ID NO: 1076434 - RNA, 21 nt, Human
uaaaaauacaaaaauuagcca

SEQ ID NO: 1076435 - RNA, 18 nt, Human
uaaacaaacaaaaaaaac

SEQ ID NO: 1076436 - RNA, 19 nt, Human
uaaacugccacuaacaaaa

SEQ ID NO: 1076437 - RNA, 20 nt, Human
uaccugauggccaggcgcag

SEQ ID NO: 1076438 - RNA, 21 nt, Human
uagaaaaaggauauucguugu

SEQ ID NO: 1076439 - RNA, 20 nt, Human
uagaugcagaaagcacuuaa

SEQ ID NO: 1076440 - RNA, 22 nt, Human
uaugguuuuacaguggauaaug

SEQ ID NO: 1076441 - RNA, 25 nt, Human
uauugguaagaaauagacuccuaaa

SEQ ID NO: 1076442 - RNA, 22 nt, Human
ucaaaaaaaaaaaaaaaaaaaa

SEQ ID NO: 1076443 - RNA, 23 nt, Human
ucaaaaaaaaaaaaaaaaaaaaa

SEQ ID NO: 1076444 - RNA, 21 nt, Human
ucaaaacaaacuaaaaccuca

SEQ ID NO: 1076445 - RNA, 23 nt, Human
ucaaagacaacuucugacccauu

SEQ ID NO: 1076446 - RNA, 18 nt, Human
ucacaaggucaggagauc

SEQ ID NO: 1076447 - RNA, 24 nt, Human
ucacaaggucaggagaucaagacc

SEQ ID NO: 1076448 - RNA, 19 nt, Human
uccacccaugaagcucacc

SEQ ID NO: 1076449 - RNA, 19 nt, Human
uccccaagggaaaaugaaa

SEQ ID NO: 1076450 - RNA, 21 nt, Human
ucccugcacuccagccugggc

SEQ ID NO: 1076451 - RNA, 23 nt, Human
ucugucucaaaaaaaaaaaaaaa

SEQ ID NO: 1076452 - RNA, 24 nt, Human
ugaaaauacacgggcauaaaaaua

SEQ ID NO: 1076453 - RNA, 22 nt, Human
ugaaacauuaaagcaaaaugaa

SEQ ID NO: 1076454 - RNA, 23 nt, Human
ugaaauuacaggauaaacugcca

SEQ ID NO: 1076455 - RNA, 26 nt, Human
ugaaauuacaggauaaacugccacua

SEQ ID NO: 1076456 - RNA, 19 nt, Human
ugaaucagcgaaacaacag

SEQ ID NO: 1076457 - RNA, 21 nt, Human
ugaauuaaauuuugucucccg

SEQ ID NO: 1076458 - RNA, 18 nt, Human
ugacuaaagagaaaggca

SEQ ID NO: 1076459 - RNA, 24 nt, Human
ugaggcaggagaacugcuugaacc

SEQ ID NO: 1076460 - RNA, 25 nt, Human
ugaggcaggagaacugcuugaaccc

SEQ ID NO: 1076461 - RNA, 18 nt, Human
ugccacuaacaaaaaagg

SEQ ID NO: 1076462 - RNA, 20 nt, Human
ugccacuaacaaaaaaggaa

SEQ ID NO: 1076463 - RNA, 21 nt, Human
ugccgacagccaucaaggcug

SEQ ID NO: 1076464 - RNA, 23 nt, Human
ugccuauagucccagcuacuugg

SEQ ID NO: 1076465 - RNA, 24 nt, Human
uggaaggccaaggcgggcagauca

SEQ ID NO: 1076466 - RNA, 22 nt, Human
uggacaccagaaaacugccgac

SEQ ID NO: 1076467 - RNA, 18 nt, Human
uggauuaaguuacuuagu

SEQ ID NO: 1076468 - RNA, 23 nt, Human
uggcaaauuaacauuugccuucu

SEQ ID NO: 1076469 - RNA, 24 nt, Human
uggccaggcgcaguggcucacgcc

SEQ ID NO: 1076470 - RNA, 20 nt, Human
uggcuaggguacgccucucu

SEQ ID NO: 1076471 - RNA, 24 nt, Human
uggcucacgccuguaaucccaaca

SEQ ID NO: 1076472 - RNA, 18 nt, Human
uggugcgugccuauaguc

SEQ ID NO: 1076473 - RNA, 24 nt, Human
uggugcgugccuauagucccagcu

SEQ ID NO: 1076474 - RNA, 24 nt, Human
ugguggugcgugccuauaguccca

SEQ ID NO: 1076475 - RNA, 21 nt, Human
uguagaauuaguaguacguua

SEQ ID NO: 1076476 - RNA, 24 nt, Human
ugucccugcacuccagccugggca

SEQ ID NO: 1076477 - RNA, 22 nt, Human
uugccuucuuccuuccuuuaua

SEQ ID NO: 1076478 - RNA, 25 nt, Human
uuuccacugcagguaaguguuucag

SEQ ID NO: 1076479 - RNA, 23 nt, Human
uuucuacuaaaaauacaaaaauu

SEQ ID NO: 1076480 - RNA, 22 nt, Human
uuuuacaguggauaaugcuacc

SEQ ID NO: 1076481 - RNA, 18 nt, Human
aaggaucuagaccuggaa

SEQ ID NO: 1076482 - RNA, 18 nt, Human
agaacagccaaaagaaga

SEQ ID NO: 1076483 - RNA, 22 nt, Human
agaacugauucuuugaaaaaau

SEQ ID NO: 1076484 - RNA, 20 nt, Human
aggaagucuuggcaaauucu

SEQ ID NO: 1076485 - RNA, 23 nt, Human
caaaagaagacauacauagagca

SEQ ID NO: 1076486 - RNA, 22 nt, Human
caaaaggauacaaaucagaaca

SEQ ID NO: 1076487 - RNA, 21 nt, Human
cacaaaguuucugugcccuca

SEQ ID NO: 1076488 - RNA, 18 nt, Human
ccuagaaaaucccaagga

SEQ ID NO: 1076489 - RNA, 18 nt, Human
cuggaaccuggaguggag

SEQ ID NO: 1076490 - RNA, 22 nt, Human
gaacagccaaaagaagacauac

SEQ ID NO: 1076491 - RNA, 22 nt, Human
gaaggacuucuuuuccccaccu

SEQ ID NO: 1076492 - RNA, 18 nt, Human
ggacuucuuuuccccacc

SEQ ID NO: 1076493 - RNA, 22 nt, Human
ggaucuagaccuggaaccugga

SEQ ID NO: 1076494 - RNA, 21 nt, Human
uaacaagaagaaaacauuaga

SEQ ID NO: 1076495 - RNA, 19 nt, Human
uauuauagcaaaaggauac

SEQ ID NO: 1076496 - RNA, 20 nt, Human
ucccaaacacaaaguuucug

SEQ ID NO: 1076497 - RNA, 23 nt, Human
ugcaauuggugaaaaaaauggga

SEQ ID NO: 1076498 - RNA, 19 nt, Human
uucagggaagggaaaugag

SEQ ID NO: 1076499 - RNA, 23 nt, Human
uuuaacaagaagaaaacauuaga

SEQ ID NO: 1076500 - RNA, 22 nt, Human
uuuccccaccuuuuucaacuuu

SEQ ID NO: 1076501 - RNA, 20 nt, Human
uuugggaggagggaaggaag

SEQ ID NO: 1076502 - RNA, 24 nt, Human
uuuguacaaugugcauauauuacc

SEQ ID NO: 1076503 - RNA, 24 nt, Human
aaaaacaggaaauacagagaagga

SEQ ID NO: 1076504 - RNA, 23 nt, Human
aaaacaggaaauacagagaagga

SEQ ID NO: 1076505 - RNA, 20 nt, Human
aaaagguucuggagaccuuu

SEQ ID NO: 1076506 - RNA, 19 nt, Human
aaaauagcauagaacagga

SEQ ID NO: 1076507 - RNA, 18 nt, Human
aaaggcauccaagucaga

SEQ ID NO: 1076508 - RNA, 24 nt, Human
aaauuaccucaacaucauaaaggc

SEQ ID NO: 1076509 - RNA, 21 nt, Human
aacacauugcugaaagcaauu

SEQ ID NO: 1076510 - RNA, 18 nt, Human
aacagaaggaaauuaccu

SEQ ID NO: 1076511 - RNA, 22 nt, Human
aagaaaaagaaauuuaaaaggc

SEQ ID NO: 1076512 - RNA, 21 nt, Human
aagcauagggaaguguagggu

SEQ ID NO: 1076513 - RNA, 19 nt, Human
aagcuuuucuucugagauc

SEQ ID NO: 1076514 - RNA, 24 nt, Human
aaguucucagccuggcggcagucu

SEQ ID NO: 1076515 - RNA, 23 nt, Human
aauaagcaaucugaaaagacaaa

SEQ ID NO: 1076516 - RNA, 28 nt, Human
aaugcagaaagaggaaaacccaauccaa

SEQ ID NO: 1076517 - RNA, 22 nt, Human
acaauuuuuaaaacuccacaaa

SEQ ID NO: 1076518 - RNA, 22 nt, Human
accagccauccccucuacccag

SEQ ID NO: 1076519 - RNA, 20 nt, Human
agaaaaagaaauuuaaaagg

SEQ ID NO: 1076520 - RNA, 25 nt, Human
agaaagaggaaaacccaauccaaaa

SEQ ID NO: 1076521 - RNA, 30 nt, Human
agaaagaggaaaacccaauccaaaaauguu

SEQ ID NO: 1076522 - RNA, 21 nt, Human
agagccagagaggcuuuugga

SEQ ID NO: 1076523 - RNA, 18 nt, Human
agcccucaucuuaguuuc

SEQ ID NO: 1076524 - RNA, 18 nt, Human
agcgguuucugagggaga

SEQ ID NO: 1076525 - RNA, 24 nt, Human
aggaaaaaacacacaaucacuuca

SEQ ID NO: 1076526 - RNA, 20 nt, Human
aggaaauacagagaaggauu

SEQ ID NO: 1076527 - RNA, 27 nt, Human
aggaacaagaaaaggaugccgguaccc

SEQ ID NO: 1076528 - RNA, 25 nt, Human
aggaacagaaggaaauuaccucaac

SEQ ID NO: 1076529 - RNA, 20 nt, Human
aguccagcaggcccaggcuc

SEQ ID NO: 1076530 - RNA, 20 nt, Human
auccccucuacccagcccuc

SEQ ID NO: 1076531 - RNA, 21 nt, Human
auggagucucauugcaugccc

SEQ ID NO: 1076532 - RNA, 25 nt, Human
auuuuuaaaacuccacaaauuaaaa

SEQ ID NO: 1076533 - RNA, 20 nt, Human
caaauauacuuaacacuacu

SEQ ID NO: 1076534 - RNA, 22 nt, Human
caaauuaaaaaacaggaaauac

SEQ ID NO: 1076535 - RNA, 21 nt, Human
caacaaaggaacagaaggaaa

SEQ ID NO: 1076536 - RNA, 26 nt, Human
caacacaacuucaugauuuaaaaaca

SEQ ID NO: 1076537 - RNA, 20 nt, Human
cagccauccccucuacccag

SEQ ID NO: 1076538 - RNA, 24 nt, Human
caggcaagauguguacacugaaaa

SEQ ID NO: 1076539 - RNA, 18 nt, Human
caggcucaguuccugcug

SEQ ID NO: 1076540 - RNA, 22 nt, Human
cagugcaagugacagagccaga

SEQ ID NO: 1076541 - RNA, 27 nt, Human
ccaagcaggcaagauguguacacugaa

SEQ ID NO: 1076542 - RNA, 19 nt, Human
ccaccauacuugacagggu

SEQ ID NO: 1076543 - RNA, 21 nt, Human
ccagcccucacucuggugcca

SEQ ID NO: 1076544 - RNA, 24 nt, Human
cccucaaugacacuguggcuucau

SEQ ID NO: 1076545 - RNA, 23 nt, Human
cgucuuuccuuucucucgucuca

SEQ ID NO: 1076546 - RNA, 21 nt, Human
cugccuggcuccuucagcuau

SEQ ID NO: 1076547 - RNA, 19 nt, Human
cugcguuguucccugcaug

SEQ ID NO: 1076548 - RNA, 18 nt, Human
cugcugccucucaccagc

SEQ ID NO: 1076549 - RNA, 19 nt, Human
cuggagaccuuuuucacaa

SEQ ID NO: 1076550 - RNA, 23 nt, Human
cuguaaucaaaauagcauagaac

SEQ ID NO: 1076551 - RNA, 23 nt, Human
cuucagcuaucaccagccauccc

SEQ ID NO: 1076552 - RNA, 21 nt, Human
cuuggggucagugcaagugac

SEQ ID NO: 1076553 - RNA, 23 nt, Human
gaaauuaccucaacaucauaaag

SEQ ID NO: 1076554 - RNA, 19 nt, Human
gaacaaaaagcauagggaa

SEQ ID NO: 1076555 - RNA, 22 nt, Human
gaaggagcgguuucugagggag

SEQ ID NO: 1076556 - RNA, 21 nt, Human
gagcaaguucuuucucugccu

SEQ ID NO: 1076557 - RNA, 21 nt, Human
gcaaucaggcaagaaaaagaa

SEQ ID NO: 1076558 - RNA, 24 nt, Human
gcagaaagaggaaaacccaaucca

SEQ ID NO: 1076559 - RNA, 24 nt, Human
gcugccucgucuuuccuuucucuc

SEQ ID NO: 1076560 - RNA, 19 nt, Human
ggaaaacccaauccaaaaa

SEQ ID NO: 1076561 - RNA, 24 nt, Human
ggagaccuuuuucacaacucaaau

SEQ ID NO: 1076562 - RNA, 19 nt, Human
ggagcgguuucugagggag

SEQ ID NO: 1076563 - RNA, 20 nt, Human
ggaguccagcaggcccaggc

SEQ ID NO: 1076564 - RNA, 19 nt, Human
ggauggugccaccaccucu

SEQ ID NO: 1076565 - RNA, 20 nt, Human
guucagaugucaauauuucc

SEQ ID NO: 1076566 - RNA, 25 nt, Human
uaaaacaaguagggaacaaaaagca

SEQ ID NO: 1076567 - RNA, 20 nt, Human
uaaaaggcauccaagucaga

SEQ ID NO: 1076568 - RNA, 22 nt, Human
uaauacacuacauuaacagaau

SEQ ID NO: 1076569 - RNA, 20 nt, Human
uagaaaauguaaacauuuca

SEQ ID NO: 1076570 - RNA, 20 nt, Human
uagaacuaauaagcaaauuc

SEQ ID NO: 1076571 - RNA, 24 nt, Human
uagaacuaauaagcaaauucagug

SEQ ID NO: 1076572 - RNA, 24 nt, Human
uagcauagaacaggaauuccuccu

SEQ ID NO: 1076573 - RNA, 23 nt, Human
uagcaucaaaaagaauaaaauac

SEQ ID NO: 1076574 - RNA, 18 nt, Human
uaugaaaagcccacagcu

SEQ ID NO: 1076575 - RNA, 18 nt, Human
ucacaacucaaauauacu

SEQ ID NO: 1076576 - RNA, 22 nt, Human
ucaccagccauccccucuaccc

SEQ ID NO: 1076577 - RNA, 28 nt, Human
ucagcagcaggaagagcaaguucuuucu

SEQ ID NO: 1076578 - RNA, 19 nt, Human
ucaggaacaagaaaaggau

SEQ ID NO: 1076579 - RNA, 25 nt, Human
uccaagucagagguaagaaguaaaa

SEQ ID NO: 1076580 - RNA, 24 nt, Human
uccaccauacuugacagggucacc

SEQ ID NO: 1076581 - RNA, 24 nt, Human
ucccugcauggcugcguuguuccc

SEQ ID NO: 1076582 - RNA, 22 nt, Human
ucccuugggccuuggggucagu

SEQ ID NO: 1076583 - RNA, 21 nt, Human
uccuagcuggagcaaucaggc

SEQ ID NO: 1076584 - RNA, 22 nt, Human
ucgggccagagcccucaucuua

SEQ ID NO: 1076585 - RNA, 29 nt, Human
ucugugguuuugcuuuccgugacaguggu

SEQ ID NO: 1076586 - RNA, 25 nt, Human
ucuucugucuccccucaaugacacu

SEQ ID NO: 1076587 - RNA, 21 nt, Human
ugaaaagacaaacuauuccau

SEQ ID NO: 1076588 - RNA, 23 nt, Human
ugaaaaguacaacacauugcuga

SEQ ID NO: 1076589 - RNA, 21 nt, Human
ugaaagcaauuaaagaggaca

SEQ ID NO: 1076590 - RNA, 23 nt, Human
ugaaagcaauuaaagaggacaua

SEQ ID NO: 1076591 - RNA, 19 nt, Human
ugacaagugugucuucugu

SEQ ID NO: 1076592 - RNA, 23 nt, Human
ugacagggucaccucccuugggc

SEQ ID NO: 1076593 - RNA, 24 nt, Human
ugacuucaaaacuuaucauaaagu

SEQ ID NO: 1076594 - RNA, 23 nt, Human
ugagaucaggaacaagaaaagga

SEQ ID NO: 1076595 - RNA, 18 nt, Human
ugagggagagugccugug

SEQ ID NO: 1076596 - RNA, 20 nt, Human
ugagggagagugccugugcu

SEQ ID NO: 1076597 - RNA, 20 nt, Human
ugauuuaaaaacagucaaca

SEQ ID NO: 1076598 - RNA, 21 nt, Human
ugcaagaugaaaagguucugg

SEQ ID NO: 1076599 - RNA, 24 nt, Human
ugcaaguucucagccuggcggcag

SEQ ID NO: 1076600 - RNA, 19 nt, Human
ugcagaaagaggaaaaccc

SEQ ID NO: 1076601 - RNA, 19 nt, Human
ugccauugcagagccugag

SEQ ID NO: 1076602 - RNA, 22 nt, Human
ugccuggcuccuucagcuauca

SEQ ID NO: 1076603 - RNA, 18 nt, Human
uggcugcguuguucccug

SEQ ID NO: 1076604 - RNA, 21 nt, Human
ugugaucuuggaaaagaacaa

SEQ ID NO: 1076605 - RNA, 24 nt, Human
uuaaaaacagucaacaaaggaaca

SEQ ID NO: 1076606 - RNA, 22 nt, Human
uuaaugcaguccuuuaaugcag

SEQ ID NO: 1076607 - RNA, 19 nt, Human
uuacugaaggagcgguuuc

SEQ ID NO: 1076608 - RNA, 19 nt, Human
uuauguguauuuuaucaca

SEQ ID NO: 1076609 - RNA, 19 nt, Human
uucagcuaucaccagccau

SEQ ID NO: 1076610 - RNA, 23 nt, Human
uucaguuuugcaagaugaaaagg

SEQ ID NO: 1076611 - RNA, 20 nt, Human
uucccugcauggcugcauuu

SEQ ID NO: 1076612 - RNA, 23 nt, Human
uugcaggagacaaaauucacaca

SEQ ID NO: 1076613 - RNA, 22 nt, Human
uuggaggucucauacuuccuga

SEQ ID NO: 1076614 - RNA, 23 nt, Human
uuucucugccuccccgcugccug

SEQ ID NO: 1076615 - RNA, 24 nt, Human
uuugcaaaccaucucugccauugc

SEQ ID NO: 1076616 - RNA, 21 nt, Human
uuuuauacacuaacaauaagc

SEQ ID NO: 1076617 - RNA, 18 nt, Human
aaaggcaccaucuccaca

SEQ ID NO: 1076618 - RNA, 20 nt, Human
aauguuuauaaaccugcuac

SEQ ID NO: 1076619 - RNA, 19 nt, Human
acaaauuucaccaugaggc

SEQ ID NO: 1076620 - RNA, 21 nt, Human
acucgaucccugaauuaguag

SEQ ID NO: 1076621 - RNA, 18 nt, Human
acuuuccagguuucuuuc

SEQ ID NO: 1076622 - RNA, 18 nt, Human
agcagauggucacauucu

SEQ ID NO: 1076623 - RNA, 18 nt, Human
aggaagaaugaaaaccug

SEQ ID NO: 1076624 - RNA, 19 nt, Human
aggaagaaugaaaaccugu

SEQ ID NO: 1076625 - RNA, 21 nt, Human
aggcugaaaagccccagacug

SEQ ID NO: 1076626 - RNA, 20 nt, Human
aucuccacauaaucaucaca

SEQ ID NO: 1076627 - RNA, 22 nt, Human
augcauauauuaccacaccaug

SEQ ID NO: 1076628 - RNA, 24 nt, Human
augggcggguuccagugaggacuu

SEQ ID NO: 1076629 - RNA, 21 nt, Human
auuaguagccuccuuaggucu

SEQ ID NO: 1076630 - RNA, 23 nt, Human
caaaggcaccaucuccacauaau

SEQ ID NO: 1076631 - RNA, 18 nt, Human
cacaccaugaaguagugu

SEQ ID NO: 1076632 - RNA, 21 nt, Human
cacaucuaagcccaguuaccu

SEQ ID NO: 1076633 - RNA, 22 nt, Human
caccuuguggcaguucuaauuc

SEQ ID NO: 1076634 - RNA, 25 nt, Human
caucuaagcccaguuaccucccaaa

SEQ ID NO: 1076635 - RNA, 22 nt, Human
cccacaucuaagcccaguuacc

SEQ ID NO: 1076636 - RNA, 24 nt, Human
cccauagccucuuuguagaauuca

SEQ ID NO: 1076637 - RNA, 25 nt, Human
ccucauguggcagaggaagaaugaa

SEQ ID NO: 1076638 - RNA, 23 nt, Human
cuagguacuagagaagacaugcc

SEQ ID NO: 1076639 - RNA, 22 nt, Human
cuauaugcauauauuaccacaa

SEQ ID NO: 1076640 - RNA, 20 nt, Human
cucaagguuuugcuugcacc

SEQ ID NO: 1076641 - RNA, 22 nt, Human
cucacgcccacaucuaagccca

SEQ ID NO: 1076642 - RNA, 21 nt, Human
cuugagagaugauacuucaag

SEQ ID NO: 1076643 - RNA, 23 nt, Human
gaucccugaauuaguagccuccu

SEQ ID NO: 1076644 - RNA, 22 nt, Human
gcuucuauaugcauauauuacc

SEQ ID NO: 1076645 - RNA, 21 nt, Human
ggauguuuuacucgcaaaugu

SEQ ID NO: 1076646 - RNA, 21 nt, Human
ggugaaggauuagaagaggaa

SEQ ID NO: 1076647 - RNA, 18 nt, Human
uaaugggcauucuucuuu

SEQ ID NO: 1076648 - RNA, 18 nt, Human
uaauuccuuuugcaucuc

SEQ ID NO: 1076649 - RNA, 19 nt, Human
uacucaaauguacacagcc

SEQ ID NO: 1076650 - RNA, 23 nt, Human
uacuugagagaugauacuucaag

SEQ ID NO: 1076651 - RNA, 20 nt, Human
ucucaugguucuggaggcuc

SEQ ID NO: 1076652 - RNA, 19 nt, Human
ugaggacuuuccuccuggc

SEQ ID NO: 1076653 - RNA, 24 nt, Human
ugcuugcaccuuguggcaguucua

SEQ ID NO: 1076654 - RNA, 22 nt, Human
uguggcagaggaagaaugaaaa

SEQ ID NO: 1076655 - RNA, 23 nt, Human
uuauagugcucucuuuacucaaa

SEQ ID NO: 1076656 - RNA, 19 nt, Human
uuuacuagcuucuauaugc

SEQ ID NO: 1076657 - RNA, 19 nt, Human
uuuauaaaccugcuacugc

SEQ ID NO: 1076658 - RNA, 19 nt, Human
uuuccagguuucuuuccca

SEQ ID NO: 1076659 - RNA, 22 nt, Human
aagcuaucuuaaaaccuaaagc

SEQ ID NO: 1076660 - RNA, 19 nt, Human
acaaaguuugauuuuuacc

SEQ ID NO: 1076661 - RNA, 25 nt, Human
acuuccugcuaugcagguuccuaac

SEQ ID NO: 1076662 - RNA, 22 nt, Human
agacacgucccacaacuucucc

SEQ ID NO: 1076663 - RNA, 22 nt, Human
cacacagacacgucccacaacu

SEQ ID NO: 1076664 - RNA, 20 nt, Human
cucacuuccugcuaugcagg

SEQ ID NO: 1076665 - RNA, 23 nt, Human
cuucaagcuaucuuaaaaccuaa

SEQ ID NO: 1076666 - RNA, 18 nt, Human
gagagaauaaaguaggga

SEQ ID NO: 1076667 - RNA, 21 nt, Human
gcccacacucagugaaggacc

SEQ ID NO: 1076668 - RNA, 20 nt, Human
uaaaaccuaaagcaauguua

SEQ ID NO: 1076669 - RNA, 21 nt, Human
uaaagcaauguuaugcuuucc

SEQ ID NO: 1076670 - RNA, 19 nt, Human
uaccaguccgugaccuggc

SEQ ID NO: 1076671 - RNA, 20 nt, Human
uaugcuuuccugagacacaa

SEQ ID NO: 1076672 - RNA, 23 nt, Human
ucagugaaggaccggauaaaacu

SEQ ID NO: 1076673 - RNA, 19 nt, Human
ucaugcuugcuuccggccg

SEQ ID NO: 1076674 - RNA, 23 nt, Human
ucgaucuucaagcuaucuuaaaa

SEQ ID NO: 1076675 - RNA, 23 nt, Human
uuaaaaccuaaagcaauguuagu

SEQ ID NO: 1076676 - RNA, 23 nt, Human
acagcugacauuaaggacaacgc

SEQ ID NO: 1076677 - RNA, 23 nt, Human
agcgaacagcugacauuaaggac

SEQ ID NO: 1076678 - RNA, 24 nt, Human
agcggcagcugccagcccuggggu

SEQ ID NO: 1076679 - RNA, 20 nt, Human
aucggggagagcuggucucu

SEQ ID NO: 1076680 - RNA, 20 nt, Human
cacaucauccuggcccagga

SEQ ID NO: 1076681 - RNA, 25 nt, Human
cagcggcagcugccagcccuggggu

SEQ ID NO: 1076682 - RNA, 22 nt, Human
caggaaggagagagcugugaug

SEQ ID NO: 1076683 - RNA, 18 nt, Human
cauuaaggacaacgcccc

SEQ ID NO: 1076684 - RNA, 24 nt, Human
cccucauuguugcuggcuucugac

SEQ ID NO: 1076685 - RNA, 22 nt, Human
cccucgcaugcaacgguuccac

SEQ ID NO: 1076686 - RNA, 20 nt, Human
cccuggcucccggaggcagg

SEQ ID NO: 1076687 - RNA, 22 nt, Human
ccgggagcgcucuguuucuucu

SEQ ID NO: 1076688 - RNA, 21 nt, Human
ccugugcugugaugaaugggg

SEQ ID NO: 1076689 - RNA, 18 nt, Human
cgcucuguuucuucuucc

SEQ ID NO: 1076690 - RNA, 18 nt, Human
cggcagcugccagcccug

SEQ ID NO: 1076691 - RNA, 20 nt, Human
cggcagcugccagcccuggg

SEQ ID NO: 1076692 - RNA, 23 nt, Human
cucuucaaccugugcugugauga

SEQ ID NO: 1076693 - RNA, 19 nt, Human
gaacagcugacauuaagga

SEQ ID NO: 1076694 - RNA, 21 nt, Human
gagcuggucucuucaaccugu

SEQ ID NO: 1076695 - RNA, 24 nt, Human
gaugcugcagcgaacagcugacau

SEQ ID NO: 1076696 - RNA, 25 nt, Human
gccuucaacaaguccucccuucagc

SEQ ID NO: 1076697 - RNA, 22 nt, Human
gcgcucuguuucuucuuccuug

SEQ ID NO: 1076698 - RNA, 18 nt, Human
gcggcagcugccagcccu

SEQ ID NO: 1076699 - RNA, 22 nt, Human
gcugugaugaauggggcucugc

SEQ ID NO: 1076700 - RNA, 21 nt, Human
guuuacaacuagauguaggug

SEQ ID NO: 1076701 - RNA, 21 nt, Human
ucugcuuuuucaacauuuccc

SEQ ID NO: 1076702 - RNA, 18 nt, Human
ugugauggaaauucugcc

SEQ ID NO: 1076703 - RNA, 20 nt, Human
uucaacauuucccgggagcg

SEQ ID NO: 1076704 - RNA, 19 nt, Human
uucauauuuucucaugccu

SEQ ID NO: 1076705 - RNA, 23 nt, Human
uugcuggcuucugacugccucuc

SEQ ID NO: 1076706 - RNA, 22 nt, Human
uuuuucaacauuucccgggagc

SEQ ID NO: 1076707 - RNA, 20 nt, Human
cccugaagccuuucucuguu

SEQ ID NO: 1076708 - RNA, 21 nt, Human
cucuuuuauuccagaggcggg

SEQ ID NO: 1076709 - RNA, 21 nt, Human
cuuuuauuccagaggcgggaa

SEQ ID NO: 1076710 - RNA, 24 nt, Human
ucucuguucugcgacucuuuuauu

SEQ ID NO: 1076711 - RNA, 21 nt, Human
uuggucucgauuccucugugc

SEQ ID NO: 1076712 - RNA, 22 nt, Human
aaaaaaaaguuucugaagagga

SEQ ID NO: 1076713 - RNA, 20 nt, Human
acacagucacuccagcagca

SEQ ID NO: 1076714 - RNA, 19 nt, Human
agagacacgcggagccugg

SEQ ID NO: 1076715 - RNA, 23 nt, Human
agcuggucgucagucgugacaca

SEQ ID NO: 1076716 - RNA, 18 nt, Human
aguaacaccaaaaacugc

SEQ ID NO: 1076717 - RNA, 22 nt, Human
auugcaaaaaaaaguuucugaa

SEQ ID NO: 1076718 - RNA, 23 nt, Human
caaaaaaaaguuucugaagagga

SEQ ID NO: 1076719 - RNA, 22 nt, Human
caccaaaaacugcugcacgaua

SEQ ID NO: 1076720 - RNA, 24 nt, Human
ccaaaaacugcugcacgauacccu

SEQ ID NO: 1076721 - RNA, 23 nt, Human
ccagccugaagcuaagaaaccga

SEQ ID NO: 1076722 - RNA, 22 nt, Human
cgaagacucucgucagagcugg

SEQ ID NO: 1076723 - RNA, 25 nt, Human
cuccagcagcaaacacgagguaccc

SEQ ID NO: 1076724 - RNA, 23 nt, Human
cucccugggaggaccgcgagcuu

SEQ ID NO: 1076725 - RNA, 18 nt, Human
gaacacacagucacucca

SEQ ID NO: 1076726 - RNA, 27 nt, Human
gcugcgccgcccccugguacccagaga

SEQ ID NO: 1076727 - RNA, 18 nt, Human
gggcaagggaacacacag

SEQ ID NO: 1076728 - RNA, 21 nt, Human
uaagggcaagggaacacacag

SEQ ID NO: 1076729 - RNA, 25 nt, Human
uaauaauauugcaaaaaaaaguuuc

SEQ ID NO: 1076730 - RNA, 23 nt, Human
ucuaauaauauugcaaaaaaaag

SEQ ID NO: 1076731 - RNA, 20 nt, Human
ugaaagcauuucuucaucuu

SEQ ID NO: 1076732 - RNA, 26 nt, Human
uugcaaaaaaaaguuucugaagagga

SEQ ID NO: 1076733 - RNA, 26 nt, Human
aaaagauaaacaaauuagaagccaag

SEQ ID NO: 1076734 - RNA, 23 nt, Human
aaagauaaacaaauuagaagcca

SEQ ID NO: 1076735 - RNA, 23 nt, Human
aagcuuguuuuccugcaacugga

SEQ ID NO: 1076736 - RNA, 24 nt, Human
aagcuuguuuuccugcaacuggau

SEQ ID NO: 1076737 - RNA, 22 nt, Human
acuggauggucccaccuccugc

SEQ ID NO: 1076738 - RNA, 22 nt, Human
acuuagcucccaaggcaugugc

SEQ ID NO: 1076739 - RNA, 25 nt, Human
agaaacgacccuucuucccacaccu

SEQ ID NO: 1076740 - RNA, 26 nt, Human
auaauaaggaaaauaaaauaaaaaau

SEQ ID NO: 1076741 - RNA, 21 nt, Human
caaaaaguugccaugacuguc

SEQ ID NO: 1076742 - RNA, 20 nt, Human
caaauaauaaggaaaauaaa

SEQ ID NO: 1076743 - RNA, 21 nt, Human
caacaguaagugguagcuuga

SEQ ID NO: 1076744 - RNA, 22 nt, Human
caacuggauggucccaccuccu

SEQ ID NO: 1076745 - RNA, 18 nt, Human
caccagcaucccauuucc

SEQ ID NO: 1076746 - RNA, 21 nt, Human
cagcaaccacuuagcucccaa

SEQ ID NO: 1076747 - RNA, 24 nt, Human
cagugggcguguuaagcuuguuuu

SEQ ID NO: 1076748 - RNA, 24 nt, Human
cugcuguguggcuccuugcggcuc

SEQ ID NO: 1076749 - RNA, 20 nt, Human
gacccuucuucccacaccag

SEQ ID NO: 1076750 - RNA, 18 nt, Human
ggaaaggccguugugagg

SEQ ID NO: 1076751 - RNA, 21 nt, Human
ggaagggaaaaacggggccug

SEQ ID NO: 1076752 - RNA, 20 nt, Human
gugcagaaacucacuccaaa

SEQ ID NO: 1076753 - RNA, 21 nt, Human
uaaacaaauuagaagccaaga

SEQ ID NO: 1076754 - RNA, 21 nt, Human
uaagugguagcuugagucacu

SEQ ID NO: 1076755 - RNA, 18 nt, Human
uagaagccaagaggcugc

SEQ ID NO: 1076756 - RNA, 25 nt, Human
ucaacaguaagugguagcuugaguc

SEQ ID NO: 1076757 - RNA, 20 nt, Human
ucaccagcaucccauuuccc

SEQ ID NO: 1076758 - RNA, 21 nt, Human
uccauggcucagggguugggg

SEQ ID NO: 1076759 - RNA, 18 nt, Human
ucccacuggcaaagagcu

SEQ ID NO: 1076760 - RNA, 21 nt, Human
uccugcuguguggcuccuugc

SEQ ID NO: 1076761 - RNA, 23 nt, Human
ucgggcauggugcagaaacucac

SEQ ID NO: 1076762 - RNA, 25 nt, Human
ugcaucagaaacgacccuucuuccc

SEQ ID NO: 1076763 - RNA, 25 nt, Human
ugccggaagggaaaaacggggccug

SEQ ID NO: 1076764 - RNA, 20 nt, Human
uggaaaggccguugugagga

SEQ ID NO: 1076765 - RNA, 18 nt, Human
ugugaggaaugagcuggg

SEQ ID NO: 1076766 - RNA, 18 nt, Human
uucacaguggucaagugc

SEQ ID NO: 1076767 - RNA, 22 nt, Human
uucacaguggucaagugcagca

SEQ ID NO: 1076768 - RNA, 25 nt, Human
uucacaguggucaagugcagcaacc

SEQ ID NO: 1076769 - RNA, 22 nt, Human
uucauugugccaaaaaguugcc

SEQ ID NO: 1076770 - RNA, 27 nt, Human
uucccacaccagucuucacagugguca

SEQ ID NO: 1076771 - RNA, 20 nt, Human
uuggggaccccugcucaagu

SEQ ID NO: 1076772 - RNA, 18 nt, Human
uugugaggaaugagcugg

SEQ ID NO: 1076773 - RNA, 21 nt, Human
uuuuccugcaacuggaugguc

SEQ ID NO: 1076774 - RNA, 18 nt, Human
aacacuuuguuggaaugc

SEQ ID NO: 1076775 - RNA, 19 nt, Human
aacacuuuguuggaaugcu

SEQ ID NO: 1076776 - RNA, 21 nt, Human
aacacuuuguuggaaugcuuu

SEQ ID NO: 1076777 - RNA, 18 nt, Human
caacagcaugggugcaaa

SEQ ID NO: 1076778 - RNA, 21 nt, Human
caaggugaagagagacuuuaa

SEQ ID NO: 1076779 - RNA, 23 nt, Human
cagcaugggugcaaaaaaaaaaa

SEQ ID NO: 1076780 - RNA, 20 nt, Human
ccugcuaagcuuuguuuccu

SEQ ID NO: 1076781 - RNA, 18 nt, Human
cugcuaagcuuuguuucc

SEQ ID NO: 1076782 - RNA, 21 nt, Human
cuuuccacagaacagaaacua

SEQ ID NO: 1076783 - RNA, 20 nt, Human
gaagagagacuuuaacgaug

SEQ ID NO: 1076784 - RNA, 24 nt, Human
guuuuuugcccauacacaugaguc

SEQ ID NO: 1076785 - RNA, 18 nt, Human
ucagcggcguccacgggc

SEQ ID NO: 1076786 - RNA, 20 nt, Human
ucucuggcucuccucuccug

SEQ ID NO: 1076787 - RNA, 19 nt, Human
uguuguaaccuguagcuuc

SEQ ID NO: 1076788 - RNA, 18 nt, Human
aaaaccccuucaaaucuc

SEQ ID NO: 1076789 - RNA, 21 nt, Human
aaaagacaaagugguaucaca

SEQ ID NO: 1076790 - RNA, 25 nt, Human
aaaauaacaucauauaacagagaca

SEQ ID NO: 1076791 - RNA, 20 nt, Human
agaccuaaaagacaaagugg

SEQ ID NO: 1076792 - RNA, 22 nt, Human
agagcuuuggaaaggcuguuac

SEQ ID NO: 1076793 - RNA, 20 nt, Human
agcaaggugcucucuaaagg

SEQ ID NO: 1076794 - RNA, 24 nt, Human
agcuuuggaaaggcuguuacuagg

SEQ ID NO: 1076795 - RNA, 23 nt, Human
caacuuguaaauaaauaaucacu

SEQ ID NO: 1076796 - RNA, 26 nt, Human
caauuuuuagaaguuuggguuucuua

SEQ ID NO: 1076797 - RNA, 19 nt, Human
cacaucacauauuuuguau

SEQ ID NO: 1076798 - RNA, 24 nt, Human
cacaucacauauuuuguaugugug

SEQ ID NO: 1076799 - RNA, 18 nt, Human
caccuauuagagcaaggu

SEQ ID NO: 1076800 - RNA, 18 nt, Human
cacuguuugcucaugcau

SEQ ID NO: 1076801 - RNA, 24 nt, Human
cagauaauguguuaaacccugaag

SEQ ID NO: 1076802 - RNA, 20 nt, Human
caucauauaacagagacaac

SEQ ID NO: 1076803 - RNA, 23 nt, Human
cauuucagauacauaaauugucc

SEQ ID NO: 1076804 - RNA, 23 nt, Human
ccaaaaauuuuaaaugcugaaag

SEQ ID NO: 1076805 - RNA, 22 nt, Human
cccucacacauuggcacaacca

SEQ ID NO: 1076806 - RNA, 19 nt, Human
ccuaaagguaaaucccuca

SEQ ID NO: 1076807 - RNA, 19 nt, Human
cuccagugcucaaacagcc

SEQ ID NO: 1076808 - RNA, 20 nt, Human
cuggcaaaaauaacaucaua

SEQ ID NO: 1076809 - RNA, 22 nt, Human
gagaaggcacaaaauuauccac

SEQ ID NO: 1076810 - RNA, 22 nt, Human
gcacaaaacuguuugucaugaa

SEQ ID NO: 1076811 - RNA, 24 nt, Human
gcugaugggaguuguccacucuuc

SEQ ID NO: 1076812 - RNA, 18 nt, Human
uaaauacagauaaugugu

SEQ ID NO: 1076813 - RNA, 27 nt, Human
uaacagagacaacacauuucagauaca

SEQ ID NO: 1076814 - RNA, 24 nt, Human
uaaguggauaucugucuaguaaga

SEQ ID NO: 1076815 - RNA, 24 nt, Human
uacaaggucccuucuuuucuaauu

SEQ ID NO: 1076816 - RNA, 20 nt, Human
uauaaaagcuuagaguccug

SEQ ID NO: 1076817 - RNA, 20 nt, Human
uaugacauuuuugcuguuuc

SEQ ID NO: 1076818 - RNA, 19 nt, Human
ucaauguuuguuuuugcuu

SEQ ID NO: 1076819 - RNA, 21 nt, Human
uccucaauucaacuauaaaag

SEQ ID NO: 1076820 - RNA, 19 nt, Human
ucugcuccagugcucaaac

SEQ ID NO: 1076821 - RNA, 21 nt, Human
ugcucucuaaaggugugauuu

SEQ ID NO: 1076822 - RNA, 25 nt, Human
uggcacaaccaauuauuacaaccuu

SEQ ID NO: 1076823 - RNA, 19 nt, Human
uggccagaagagaaggcac

SEQ ID NO: 1076824 - RNA, 22 nt, Human
uggguuucuuacugaaauuucc

SEQ ID NO: 1076825 - RNA, 23 nt, Human
uguccaaaauauagagagucaau

SEQ ID NO: 1076826 - RNA, 18 nt, Human
uguccacucuucccucuc

SEQ ID NO: 1076827 - RNA, 23 nt, Human
ugucuaguaagagagaagcaaca

SEQ ID NO: 1076828 - RNA, 22 nt, Human
ugugauuuuggcaucucauagg

SEQ ID NO: 1076829 - RNA, 23 nt, Human
uguuacuaggaaccaaaauauag

SEQ ID NO: 1076830 - RNA, 23 nt, Human
uguuugucaugaagcuguaaaau

SEQ ID NO: 1076831 - RNA, 21 nt, Human
uuagaguccugacugcugaau

SEQ ID NO: 1076832 - RNA, 22 nt, Human
uuccuugaaagccaagcaccag

SEQ ID NO: 1076833 - RNA, 23 nt, Human
uuucuacacuggcuugguggcca

SEQ ID NO: 1076834 - RNA, 24 nt, Human
uuuuggcaucucauaggcuuccuu

SEQ ID NO: 1076835 - RNA, 22 nt, Human
uuuuugcuguuucuacacuggc

SEQ ID NO: 1076836 - RNA, 23 nt, Human
aaaaaaaaaaaaaaaaaaaagag

SEQ ID NO: 1076837 - RNA, 21 nt, Human
aaaaaaacaguacacuacaag

SEQ ID NO: 1076838 - RNA, 28 nt, Human
aaaaaaagagagagagaggaagcaggga

SEQ ID NO: 1076839 - RNA, 21 nt, Human
aaaagaaaaaaaguuuguuaa

SEQ ID NO: 1076840 - RNA, 18 nt, Human
aaacccgggaggcggagg

SEQ ID NO: 1076841 - RNA, 22 nt, Human
aaagaacuguaauauacguaaa

SEQ ID NO: 1076842 - RNA, 19 nt, Human
aaagagagagagaggaagc

SEQ ID NO: 1076843 - RNA, 24 nt, Human
aagcagggaacaacugagccaaaa

SEQ ID NO: 1076844 - RNA, 19 nt, Human
aauaaccugagguuuccaa

SEQ ID NO: 1076845 - RNA, 18 nt, Human
aauugcuuaaacccggga

SEQ ID NO: 1076846 - RNA, 24 nt, Human
acagagcgagacuccaucucaaaa

SEQ ID NO: 1076847 - RNA, 18 nt, Human
acauguauaaguaucaua

SEQ ID NO: 1076848 - RNA, 24 nt, Human
accagaguucacugaucucacauu

SEQ ID NO: 1076849 - RNA, 21 nt, Human
accagccuagccaaaagagug

SEQ ID NO: 1076850 - RNA, 24 nt, Human
acccugucucuacuaaaaauacaa

SEQ ID NO: 1076851 - RNA, 24 nt, Human
acugcacuccagccugggcgacag

SEQ ID NO: 1076852 - RNA, 26 nt, Human
acugcacuccagccugggcgacagag

SEQ ID NO: 1076853 - RNA, 18 nt, Human
agaaucugccaauuaccu

SEQ ID NO: 1076854 - RNA, 20 nt, Human
agagagagaggaagcaggga

SEQ ID NO: 1076855 - RNA, 19 nt, Human
agagagaggaagcagggaa

SEQ ID NO: 1076856 - RNA, 24 nt, Human
agcacuuugggaggccgaggcggg

SEQ ID NO: 1076857 - RNA, 22 nt, Human
agccaaaacaaaauuauccccu

SEQ ID NO: 1076858 - RNA, 23 nt, Human
agccaggcgugguggcaggugcc

SEQ ID NO: 1076859 - RNA, 24 nt, Human
agccugggcgacagagcgagacuc

SEQ ID NO: 1076860 - RNA, 21 nt, Human
aggaugcagugagcugagauc

SEQ ID NO: 1076861 - RNA, 19 nt, Human
aggcagccaaccugguaag

SEQ ID NO: 1076862 - RNA, 21 nt, Human
aggccgaggcggguggaucac

SEQ ID NO: 1076863 - RNA, 20 nt, Human
aggcggaggaugcagugagc

SEQ ID NO: 1076864 - RNA, 24 nt, Human
aggcggaggaugcagugagcugag

SEQ ID NO: 1076865 - RNA, 24 nt, Human
aggcggguggaucacgaggucagg

SEQ ID NO: 1076866 - RNA, 24 nt, Human
aggcgugguggcaggugccuguaa

SEQ ID NO: 1076867 - RNA, 21 nt, Human
agggaacaacugagccaaaac

SEQ ID NO: 1076868 - RNA, 21 nt, Human
aggugccuguaaucccaacua

SEQ ID NO: 1076869 - RNA, 18 nt, Human
agugaaacccugucucua

SEQ ID NO: 1076870 - RNA, 23 nt, Human
auagaaaauauccuugauuuccc

SEQ ID NO: 1076871 - RNA, 20 nt, Human
aucaaauauggucccggauc

SEQ ID NO: 1076872 - RNA, 22 nt, Human
aucacgaggucaggaguucaag

SEQ ID NO: 1076873 - RNA, 24 nt, Human
aucgcgccacugcacuccagccug

SEQ ID NO: 1076874 - RNA, 23 nt, Human
augagaucaaauucauauaaacg

SEQ ID NO: 1076875 - RNA, 19 nt, Human
augcagugagcugagaucg

SEQ ID NO: 1076876 - RNA, 22 nt, Human
augcagugagcugagaucgcgc

SEQ ID NO: 1076877 - RNA, 19 nt, Human
augccuguaaucccagcac

SEQ ID NO: 1076878 - RNA, 23 nt, Human
auguagacaauugcuuaaacccg

SEQ ID NO: 1076879 - RNA, 18 nt, Human
caaaacaaaauuaucccc

SEQ ID NO: 1076880 - RNA, 23 nt, Human
caaugagcucugucccugcaucu

SEQ ID NO: 1076881 - RNA, 19 nt, Human
cacauguauaaguaucaua

SEQ ID NO: 1076882 - RNA, 23 nt, Human
cacuccagccugggcgacagagc

SEQ ID NO: 1076883 - RNA, 24 nt, Human
cacuccagccugggcgacagagcg

SEQ ID NO: 1076884 - RNA, 19 nt, Human
cacugcacuccagccuggg

SEQ ID NO: 1076885 - RNA, 20 nt, Human
cacugcacuccagccugggc

SEQ ID NO: 1076886 - RNA, 22 nt, Human
cacugcacuccagccugggcga

SEQ ID NO: 1076887 - RNA, 23 nt, Human
cacugcacuccagccugggcgac

SEQ ID NO: 1076888 - RNA, 24 nt, Human
cacugcacuccagccugggcgaca

SEQ ID NO: 1076889 - RNA, 24 nt, Human
cagcacuuugggaggccgaggcgg

SEQ ID NO: 1076890 - RNA, 24 nt, Human
caggcauguggcucaugccuguaa

SEQ ID NO: 1076891 - RNA, 20 nt, Human
caugccuguaaucccagcac

SEQ ID NO: 1076892 - RNA, 24 nt, Human
caugccuguaaucccagcacuuug

SEQ ID NO: 1076893 - RNA, 24 nt, Human
ccaaaacaaaauuauccccuaagg

SEQ ID NO: 1076894 - RNA, 21 nt, Human
ccaaaagagugaaacccuguc

SEQ ID NO: 1076895 - RNA, 20 nt, Human
ccacugcacuccagccuggg

SEQ ID NO: 1076896 - RNA, 21 nt, Human
ccacugcacuccagccugggc

SEQ ID NO: 1076897 - RNA, 21 nt, Human
ccacugcacuccagccugggc

SEQ ID NO: 1076898 - RNA, 23 nt, Human
ccacugcacuccagccugggcga

SEQ ID NO: 1076899 - RNA, 24 nt, Human
ccacugcacuccagccugggcgac

SEQ ID NO: 1076900 - RNA, 20 nt, Human
ccagaguucacugaucucac

SEQ ID NO: 1076901 - RNA, 25 nt, Human
ccaucucaaaaaaaaaaaaaaaaaa

SEQ ID NO: 1076902 - RNA, 21 nt, Human
cccacacaauaauugcccaga

SEQ ID NO: 1076903 - RNA, 18 nt, Human
ccccuaaggacuugacuu

SEQ ID NO: 1076904 - RNA, 22 nt, Human
ccuagccaaaagagugaaaccc

SEQ ID NO: 1076905 - RNA, 24 nt, Human
ccuagccaaaagagugaaacccug

SEQ ID NO: 1076906 - RNA, 21 nt, Human
ccucacccacacaauaauugc

SEQ ID NO: 1076907 - RNA, 22 nt, Human
ccugggcgacagagcgagacuc

SEQ ID NO: 1076908 - RNA, 19 nt, Human
ccuguaaucccaacuacuc

SEQ ID NO: 1076909 - RNA, 22 nt, Human
ccuguaaucccagcacuuuggg

SEQ ID NO: 1076910 - RNA, 23 nt, Human
cgagacuccaucucaaaaaaaaa

SEQ ID NO: 1076911 - RNA, 26 nt, Human
cgccacugcacuccagccugggcgac

SEQ ID NO: 1076912 - RNA, 21 nt, Human
cgggaggcggaggaugcagug

SEQ ID NO: 1076913 - RNA, 21 nt, Human
cuagccaaaagagugaaaccc

SEQ ID NO: 1076914 - RNA, 18 nt, Human
cucaaaaaaaaaaaaaaa

SEQ ID NO: 1076915 - RNA, 19 nt, Human
cucaggaggcugauguaga

SEQ ID NO: 1076916 - RNA, 23 nt, Human
cucaugccuguaaucccagcacu

SEQ ID NO: 1076917 - RNA, 24 nt, Human
cucaugccuguaaucccagcacuu

SEQ ID NO: 1076918 - RNA, 19 nt, Human
cuccaucucaaaaaaaaaa

SEQ ID NO: 1076919 - RNA, 21 nt, Human
cuuccauccucacccacacaa

SEQ ID NO: 1076920 - RNA, 22 nt, Human
cuuuccaugcaaacaguggcua

SEQ ID NO: 1076921 - RNA, 24 nt, Human
cuuuucauugaguugacuucugau

SEQ ID NO: 1076922 - RNA, 23 nt, Human
gaggaugcagugagcugagaucg

SEQ ID NO: 1076923 - RNA, 23 nt, Human
gaggcggguggaucacgagguca

SEQ ID NO: 1076924 - RNA, 19 nt, Human
gaguaucaucauaccaaaa

SEQ ID NO: 1076925 - RNA, 22 nt, Human
gaucacgaggucaggaguucaa

SEQ ID NO: 1076926 - RNA, 24 nt, Human
gaucacgaggucaggaguucaaga

SEQ ID NO: 1076927 - RNA, 24 nt, Human
gcacuccagccugggcgacagagc

SEQ ID NO: 1076928 - RNA, 24 nt, Human
gccaaaagagugaaacccugucuc

SEQ ID NO: 1076929 - RNA, 25 nt, Human
gccaauuaccuagauccuccugaac

SEQ ID NO: 1076930 - RNA, 22 nt, Human
gccacugcacuccagccugggc

SEQ ID NO: 1076931 - RNA, 24 nt, Human
gccacugcacuccagccugggcga

SEQ ID NO: 1076932 - RNA, 20 nt, Human
gcugagaucgcgccacugca

SEQ ID NO: 1076933 - RNA, 22 nt, Human
gcugcauggcugaaaccuccau

SEQ ID NO: 1076934 - RNA, 18 nt, Human
ggaggaugcagugagcug

SEQ ID NO: 1076935 - RNA, 24 nt, Human
ggaggaugcagugagcugagaucg

SEQ ID NO: 1076936 - RNA, 21 nt, Human
ggcggaggaugcagugagcug

SEQ ID NO: 1076937 - RNA, 23 nt, Human
gguggaucacgaggucaggaguu

SEQ ID NO: 1076938 - RNA, 21 nt, Human
gugaaacccugucucuacuaa

SEQ ID NO: 1076939 - RNA, 20 nt, Human
gugcuaccuuuucauugagu

SEQ ID NO: 1076940 - RNA, 23 nt, Human
guggaucacgaggucaggaguuc

SEQ ID NO: 1076941 - RNA, 22 nt, Human
guggcucaugccuguaauccca

SEQ ID NO: 1076942 - RNA, 23 nt, Human
guggcucaugccuguaaucccag

SEQ ID NO: 1076943 - RNA, 25 nt, Human
uaaaaagaacuguaauauacguaaa

SEQ ID NO: 1076944 - RNA, 21 nt, Human
uaaaaauacaaaaauuagcca

SEQ ID NO: 1076945 - RNA, 22 nt, Human
uaaauaauaaccugagguuucc

SEQ ID NO: 1076946 - RNA, 26 nt, Human
uaacaaaauacuaaaucauaaacugg

SEQ ID NO: 1076947 - RNA, 18 nt, Human
uaagagccaggcugcaug

SEQ ID NO: 1076948 - RNA, 20 nt, Human
uaaguaguaacaaacauccc

SEQ ID NO: 1076949 - RNA, 19 nt, Human
uaagugauuccuaaacaga

SEQ ID NO: 1076950 - RNA, 24 nt, Human
uacacacucaaaaaaaacaguaca

SEQ ID NO: 1076951 - RNA, 22 nt, Human
uagaaaauguuucaaaugcuau

SEQ ID NO: 1076952 - RNA, 20 nt, Human
uagagaggaagcagggaggg

SEQ ID NO: 1076953 - RNA, 19 nt, Human
uagcagaguuucugccuuc

SEQ ID NO: 1076954 - RNA, 19 nt, Human
uauauuacucccaaggacc

SEQ ID NO: 1076955 - RNA, 24 nt, Human
uauauuacucccaaggaccuuguu

SEQ ID NO: 1076956 - RNA, 23 nt, Human
uaucauagcuauuagaaaauguu

SEQ ID NO: 1076957 - RNA, 19 nt, Human
uauuuggcaagagcuaaga

SEQ ID NO: 1076958 - RNA, 22 nt, Human
ucaaaaaaaaaaaaaaaaaaaa

SEQ ID NO: 1076959 - RNA, 23 nt, Human
ucaaaaaaaaaaaaaaaaaaaaa

SEQ ID NO: 1076960 - RNA, 23 nt, Human
ucaaaaaaaacaguacacuacaa

SEQ ID NO: 1076961 - RNA, 24 nt, Human
ucacgaggucaggaguucaagacc

SEQ ID NO: 1076962 - RNA, 21 nt, Human
ucacugaucucacauuuuaaa

SEQ ID NO: 1076963 - RNA, 19 nt, Human
ucagaaagagcuucaaaca

SEQ ID NO: 1076964 - RNA, 25 nt, Human
uccaagauuugaauacccugaacuu

SEQ ID NO: 1076965 - RNA, 23 nt, Human
uccagccugggcgacagagcgag

SEQ ID NO: 1076966 - RNA, 24 nt, Human
uccagccugggcgacagagcgaga

SEQ ID NO: 1076967 - RNA, 23 nt, Human
uccaucucaaaaaaaaaaaaaaa

SEQ ID NO: 1076968 - RNA, 23 nt, Human
ucgcgccacugcacuccagccug

SEQ ID NO: 1076969 - RNA, 23 nt, Human
ucucuacuaaaaauacaaaaauu

SEQ ID NO: 1076970 - RNA, 20 nt, Human
ugaaaacagacaauguggua

SEQ ID NO: 1076971 - RNA, 19 nt, Human
ugaacuuccugaaagcaca

SEQ ID NO: 1076972 - RNA, 24 nt, Human
ugagaucgcgccacugcacuccag

SEQ ID NO: 1076973 - RNA, 23 nt, Human
ugagcucugucccugcaucugaa

SEQ ID NO: 1076974 - RNA, 22 nt, Human
ugagcugagaucgcgccacugc

SEQ ID NO: 1076975 - RNA, 24 nt, Human
ugauguagacaauugcuuaaaccc

SEQ ID NO: 1076976 - RNA, 24 nt, Human
ugccuguaaucccaacuacucagg

SEQ ID NO: 1076977 - RNA, 23 nt, Human
ugccuguaaucccagcacuuugg

SEQ ID NO: 1076978 - RNA, 23 nt, Human
ugccuguaaucccagcacuuugg

SEQ ID NO: 1076979 - RNA, 18 nt, Human
ugcuacuucaucaucagu

SEQ ID NO: 1076980 - RNA, 22 nt, Human
uggaucacgaggucaggaguuc

SEQ ID NO: 1076981 - RNA, 18 nt, Human
uggcaagagcuaagagua

SEQ ID NO: 1076982 - RNA, 22 nt, Human
uggcucaugccuguaaucccag

SEQ ID NO: 1076983 - RNA, 24 nt, Human
uggcucaugccuguaaucccagca

SEQ ID NO: 1076984 - RNA, 21 nt, Human
uggcugaaaccuccauccaaa

SEQ ID NO: 1076985 - RNA, 23 nt, Human
uggcugaaaccuccauccaaauc

SEQ ID NO: 1076986 - RNA, 22 nt, Human
ugggaaaauauccaucaaugag

SEQ ID NO: 1076987 - RNA, 23 nt, Human
ugggaggccgaggcggguggauc

SEQ ID NO: 1076988 - RNA, 24 nt, Human
ugggaggccgaggcggguggauca

SEQ ID NO: 1076989 - RNA, 24 nt, Human
ugguggcaggugccuguaauccca

SEQ ID NO: 1076990 - RNA, 24 nt, Human
uguggcucaugccuguaaucccag

SEQ ID NO: 1076991 - RNA, 20 nt, Human
ugugguauuuuuucagccau

SEQ ID NO: 1076992 - RNA, 21 nt, Human
uuccuuuccaugcaaacagug

SEQ ID NO: 1076993 - RNA, 24 nt, Human
uugcuuaaacccgggaggcggagg

SEQ ID NO: 1076994 - RNA, 25 nt, Human
uugggaggccgaggcggguggauca

SEQ ID NO: 1076995 - RNA, 21 nt, Human
acagcacugaguacaucaugc

SEQ ID NO: 1076996 - RNA, 22 nt, Human
auagucuuaaguguguauaaaa

SEQ ID NO: 1076997 - RNA, 25 nt, Human
aagccagcacauaucuuuaacaggg

SEQ ID NO: 1076998 - RNA, 26 nt, Human
aagccagcacauaucuuuaacagggg

SEQ ID NO: 1076999 - RNA, 23 nt, Human
acacagcuuuuugcaaaaaggcc

SEQ ID NO: 1077000 - RNA, 18 nt, Human
agcuccgaaucccaaccu

SEQ ID NO: 1077001 - RNA, 24 nt, Human
aggggguuucgcuauguuucccag

SEQ ID NO: 1077002 - RNA, 21 nt, Human
caacucaggggcaaagagaaa

SEQ ID NO: 1077003 - RNA, 24 nt, Human
cagcaggggcugucuagccaugac

SEQ ID NO: 1077004 - RNA, 18 nt, Human
caggcccagcaggggcug

SEQ ID NO: 1077005 - RNA, 21 nt, Human
ccagcaggggcugucuagcca

SEQ ID NO: 1077006 - RNA, 23 nt, Human
ccucaaaucuccugacacaacuc

SEQ ID NO: 1077007 - RNA, 19 nt, Human
ccugaccucaagugauccg

SEQ ID NO: 1077008 - RNA, 24 nt, Human
ccugaccucaagugauccgcccac

SEQ ID NO: 1077009 - RNA, 24 nt, Human
cgcuauguuucccaggcuggucuc

SEQ ID NO: 1077010 - RNA, 26 nt, Human
cucaagugauccgcccaccuugggac

SEQ ID NO: 1077011 - RNA, 23 nt, Human
gaccucaagugauccgcccaccu

SEQ ID NO: 1077012 - RNA, 18 nt, Human
gcaaagagaaagggacag

SEQ ID NO: 1077013 - RNA, 24 nt, Human
ggcuggucucuaauuccugaccuc

SEQ ID NO: 1077014 - RNA, 23 nt, Human
uaagaagccagcacauaucuuua

SEQ ID NO: 1077015 - RNA, 19 nt, Human
uagagaggggguuucgcua

SEQ ID NO: 1077016 - RNA, 22 nt, Human
uagagaggggguuucgcuaugu

SEQ ID NO: 1077017 - RNA, 21 nt, Human
uagccaugacauaagaagcca

SEQ ID NO: 1077018 - RNA, 19 nt, Human
uauguuucccaggcugguc

SEQ ID NO: 1077019 - RNA, 24 nt, Human
uauguuucccaggcuggucucuaa

SEQ ID NO: 1077020 - RNA, 22 nt, Human
ucgcuauguuucccaggcuggu

SEQ ID NO: 1077021 - RNA, 25 nt, Human
ugacacaacucaggggcaaagagaa

SEQ ID NO: 1077022 - RNA, 18 nt, Human
ugaccucaagugauccgc

SEQ ID NO: 1077023 - RNA, 24 nt, Human
uguagagaggggguuucgcuaugu

SEQ ID NO: 1077024 - RNA, 22 nt, Human
uuccucaaaucuccugacacaa

SEQ ID NO: 1077025 - RNA, 24 nt, Human
uuguagagaggggguuucgcuaug

SEQ ID NO: 1077026 - RNA, 24 nt, Human
uuuguagagaggggguuucgcuau

SEQ ID NO: 1077027 - RNA, 24 nt, Human
uuuuuuguagagaggggguuucgc

SEQ ID NO: 1077028 - RNA, 24 nt, Human
uuuuuuuguagagaggggguuucg

SEQ ID NO: 1077029 - RNA, 30 nt, Human
uuuuuuuuuuuuguagagaggggguuucgc

SEQ ID NO: 1077030 - RNA, 24 nt, Human
uuuuuuuuuuuuuuguagagaggg

SEQ ID NO: 1077031 - RNA, 22 nt, Human
aacuuguguuccucacauccuu

SEQ ID NO: 1077032 - RNA, 25 nt, Human
cuccuagaacuugagcaacaaaaaa

SEQ ID NO: 1077033 - RNA, 23 nt, Human
cugccacccccacuagcuggccc

SEQ ID NO: 1077034 - RNA, 22 nt, Human
gagaccucugccacccccacua

SEQ ID NO: 1077035 - RNA, 24 nt, Human
gcaaagagaccucugccaccccca

SEQ ID NO: 1077036 - RNA, 23 nt, Human
gcaacaaaaaaaagaguucaacc

SEQ ID NO: 1077037 - RNA, 19 nt, Human
gcccaguccuggaaacgga

SEQ ID NO: 1077038 - RNA, 24 nt, Human
ggaaagggacuccuagaacuugag

SEQ ID NO: 1077039 - RNA, 22 nt, Human
uagcuggcccaguccuggaaac

SEQ ID NO: 1077040 - RNA, 27 nt, Human
ucuacagagcucgggcugaaugaagca

SEQ ID NO: 1077041 - RNA, 21 nt, Human
ugaaaaggaaacuaugacaaa

SEQ ID NO: 1077042 - RNA, 22 nt, Human
ugaagcaaagagaccucugcca

SEQ ID NO: 1077043 - RNA, 19 nt, Human
ugagcaacaaaaaaaagag

SEQ ID NO: 1077044 - RNA, 20 nt, Human
uggcccaguccuggaaacgg

SEQ ID NO: 1077045 - RNA, 20 nt, Human
aacuuguuucucaaaggcag

SEQ ID NO: 1077046 - RNA, 20 nt, Human
agauuggcauuuuuucacga

SEQ ID NO: 1077047 - RNA, 23 nt, Human
aggagaagcaggucuacaccaaa

SEQ ID NO: 1077048 - RNA, 25 nt, Human
caacaaaacuuguuucucaaaggca

SEQ ID NO: 1077049 - RNA, 20 nt, Human
cgcggcgcgcagucugggcg

SEQ ID NO: 1077050 - RNA, 23 nt, Human
cggcgcgcagucugggcgcacgg

SEQ ID NO: 1077051 - RNA, 27 nt, Human
cguguuugcagaauucaccacccaagg

SEQ ID NO: 1077052 - RNA, 23 nt, Human
gagaagcaggucuacaccaaaag

SEQ ID NO: 1077053 - RNA, 24 nt, Human
guggggcggugcuccggucuggac

SEQ ID NO: 1077054 - RNA, 26 nt, Human
guguuugcagaauucaccacccaagg

SEQ ID NO: 1077055 - RNA, 22 nt, Human
ucagaugugcauugagacugca

SEQ ID NO: 1077056 - RNA, 22 nt, Human
ucuccugcgcuagcgguggggc

SEQ ID NO: 1077057 - RNA, 21 nt, Human
ugaaggagugaucugguagau

SEQ ID NO: 1077058 - RNA, 21 nt, Human
ugaggcaaugccucacgggac

SEQ ID NO: 1077059 - RNA, 30 nt, Human
uuaaagucaaaacuucacacagggcuuacu

SEQ ID NO: 1077060 - RNA, 23 nt, Human
uuucacgaucguguuugcagaau

SEQ ID NO: 1077061 - RNA, 22 nt, Human
aaaaagacaaagcuacaacaga

SEQ ID NO: 1077062 - RNA, 23 nt, Human
aaaagaaaaagaaaaagacaaag

SEQ ID NO: 1077063 - RNA, 23 nt, Human
aacagcucucuuugguuccacua

SEQ ID NO: 1077064 - RNA, 23 nt, Human
aacuguggcuaugagaguccuga

SEQ ID NO: 1077065 - RNA, 19 nt, Human
acagaauccucucuagaaa

SEQ ID NO: 1077066 - RNA, 20 nt, Human
accaccaacaaaaauuuucu

SEQ ID NO: 1077067 - RNA, 18 nt, Human
acuaccacaauuuacagg

SEQ ID NO: 1077068 - RNA, 20 nt, Human
agaaaaagacaaagcuacaa

SEQ ID NO: 1077069 - RNA, 23 nt, Human
auaaaagaccucaggaaucuaca

SEQ ID NO: 1077070 - RNA, 18 nt, Human
aucuucuuuaauaccacc

SEQ ID NO: 1077071 - RNA, 21 nt, Human
augaaaagaaaaagaaaaaga

SEQ ID NO: 1077072 - RNA, 24 nt, Human
cugauguaaugaaaagaaaaagaa

SEQ ID NO: 1077073 - RNA, 18 nt, Human
gaaaagaaaaagaaaaag

SEQ ID NO: 1077074 - RNA, 19 nt, Human
gaaaagaaaaagaaaaaga

SEQ ID NO: 1077075 - RNA, 21 nt, Human
uaaugaaaagaaaaagaaaaa

SEQ ID NO: 1077076 - RNA, 18 nt, Human
uccucucuagaaacagcu

SEQ ID NO: 1077077 - RNA, 20 nt, Human
uccugacaacuccuugcucu

SEQ ID NO: 1077078 - RNA, 21 nt, Human
ucuaaugcauuugggacaacu

SEQ ID NO: 1077079 - RNA, 18 nt, Human
ugagaguccugaacaaga

SEQ ID NO: 1077080 - RNA, 21 nt, Human
uggcuaugagaguccugaaca

SEQ ID NO: 1077081 - RNA, 20 nt, Human
uuacagaauccucucuagaa

SEQ ID NO: 1077082 - RNA, 21 nt, Human
uucuaugguuucaaucuugcu

SEQ ID NO: 1077083 - RNA, 18 nt, Human
uugcaaacuguggcuaug

SEQ ID NO: 1077084 - RNA, 22 nt, Human
uuuacagaauccucucuagaaa

SEQ ID NO: 1077085 - RNA, 26 nt, Human
aaaccaucucccuucuggcuccccca

SEQ ID NO: 1077086 - RNA, 23 nt, Human
aaacuccuggguccaagcaaucc

SEQ ID NO: 1077087 - RNA, 21 nt, Human
aaaugaccaacaaaaggaagc

SEQ ID NO: 1077088 - RNA, 24 nt, Human
aacacaaucucaaaaucuaugccu

SEQ ID NO: 1077089 - RNA, 20 nt, Human
aacauggcaaaaccucgucu

SEQ ID NO: 1077090 - RNA, 18 nt, Human
aaccuccgccucuggauc

SEQ ID NO: 1077091 - RNA, 21 nt, Human
aagaagugauuauaggccaga

SEQ ID NO: 1077092 - RNA, 22 nt, Human
aagagacaggguuuugccaugu

SEQ ID NO: 1077093 - RNA, 25 nt, Human
aagcaauccuucugccucagccucc

SEQ ID NO: 1077094 - RNA, 24 nt, Human
aagcagguagaucccuugagccca

SEQ ID NO: 1077095 - RNA, 23 nt, Human
aagguggguggaucaccuuaggu

SEQ ID NO: 1077096 - RNA, 19 nt, Human
aagguuuugaaauuuguuu

SEQ ID NO: 1077097 - RNA, 25 nt, Human
aagugauccucccaccuuggcuucc

SEQ ID NO: 1077098 - RNA, 27 nt, Human
aagugauccucccaccuuggcuuccca

SEQ ID NO: 1077099 - RNA, 23 nt, Human
aauuucaucacauucucuuacug

SEQ ID NO: 1077100 - RNA, 18 nt, Human
aauuuuuuguauuuuuag

SEQ ID NO: 1077101 - RNA, 23 nt, Human
acacacacacacacacacacaca

SEQ ID NO: 1077102 - RNA, 23 nt, Human
acacacacacacacacacacaca

SEQ ID NO: 1077103 - RNA, 23 nt, Human
acacacacacacacacacacaca

SEQ ID NO: 1077104 - RNA, 23 nt, Human
acacacacacacacacacacaca

SEQ ID NO: 1077105 - RNA, 23 nt, Human
acacacacacacacacacacaca

SEQ ID NO: 1077106 - RNA, 23 nt, Human
acacacacacacacacacacaca

SEQ ID NO: 1077107 - RNA, 23 nt, Human
acacacacacacacacacacaca

SEQ ID NO: 1077108 - RNA, 23 nt, Human
acacacacacacacacacacaca

SEQ ID NO: 1077109 - RNA, 23 nt, Human
acacacacacacacacacacaua

SEQ ID NO: 1077110 - RNA, 23 nt, Human
acacacacacacacacacacaua

SEQ ID NO: 1077111 - RNA, 24 nt, Human
acagacggagacccugucucaaaa

SEQ ID NO: 1077112 - RNA, 18 nt, Human
acaggguuuugccauguu

SEQ ID NO: 1077113 - RNA, 21 nt, Human
acaggguuuugccauguuggu

SEQ ID NO: 1077114 - RNA, 23 nt, Human
acaggguuuugccauguugguca

SEQ ID NO: 1077115 - RNA, 24 nt, Human
acaggguuuugccauguuggucag

SEQ ID NO: 1077116 - RNA, 21 nt, Human
acaguggcaagaucuuggcuc

SEQ ID NO: 1077117 - RNA, 18 nt, Human
accacacccagcaaauuu

SEQ ID NO: 1077118 - RNA, 24 nt, Human
accaucucccuucuggcuccccca

SEQ ID NO: 1077119 - RNA, 28 nt, Human
acccugucucaaaaaaaaaaaaaaaaaa

SEQ ID NO: 1077120 - RNA, 23 nt, Human
accucgucucuaugaaaauacaa

SEQ ID NO: 1077121 - RNA, 24 nt, Human
acuacacuccagacagggaaacag

SEQ ID NO: 1077122 - RNA, 19 nt, Human
acuacaggugcgugucacc

SEQ ID NO: 1077123 - RNA, 19 nt, Human
acuuaaggagaauugguga

SEQ ID NO: 1077124 - RNA, 23 nt, Human
agaaacccaacucaaauauuagu

SEQ ID NO: 1077125 - RNA, 19 nt, Human
agaagaagauagaggcagg

SEQ ID NO: 1077126 - RNA, 21 nt, Human
agacaaaaaacaguacaugua

SEQ ID NO: 1077127 - RNA, 18 nt, Human
agacaggguuuugccaug

SEQ ID NO: 1077128 - RNA, 22 nt, Human
agagaggagcacaucaaugaaa

SEQ ID NO: 1077129 - RNA, 22 nt, Human
agauacaggagugcugggaagg

SEQ ID NO: 1077130 - RNA, 20 nt, Human
agcacuuugaggggcugaag

SEQ ID NO: 1077131 - RNA, 25 nt, Human
agcagaagaagauagaggcaggggg

SEQ ID NO: 1077132 - RNA, 20 nt, Human
agcaggcucaaguuauucca

SEQ ID NO: 1077133 - RNA, 23 nt, Human
agcuggucuugaacucagggcuc

SEQ ID NO: 1077134 - RNA, 26 nt, Human
aggaaaaagaauaaaaauaaacagaa

SEQ ID NO: 1077135 - RNA, 22 nt, Human
aggcaggaggaugauuugagcc

SEQ ID NO: 1077136 - RNA, 24 nt, Human
aggcaggaggaugauuugagccug

SEQ ID NO: 1077137 - RNA, 24 nt, Human
aggccagaugugguggcucaugcc

SEQ ID NO: 1077138 - RNA, 24 nt, Human
aggcugaggcaggaggaugauuug

SEQ ID NO: 1077139 - RNA, 21 nt, Human
aggugauccacccaccugagu

SEQ ID NO: 1077140 - RNA, 24 nt, Human
aggugugguggcucaugccuguaa

SEQ ID NO: 1077141 - RNA, 24 nt, Human
aguacaguggcaagaucuuggcuc

SEQ ID NO: 1077142 - RNA, 20 nt, Human
agugcaauggugcgaucaug

SEQ ID NO: 1077143 - RNA, 23 nt, Human
agugcaauggugcgaucauggcu

SEQ ID NO: 1077144 - RNA, 22 nt, Human
auaggccagaugugguggcuca

SEQ ID NO: 1077145 - RNA, 24 nt, Human
auaggccagaugugguggcucaug

SEQ ID NO: 1077146 - RNA, 21 nt, Human
aucagagguuagaauguucca

SEQ ID NO: 1077147 - RNA, 20 nt, Human
auccuucugccucagccucc

SEQ ID NO: 1077148 - RNA, 22 nt, Human
augaaaaacaacuauuguugca

SEQ ID NO: 1077149 - RNA, 24 nt, Human
augauucuccugccucagccuccc

SEQ ID NO: 1077150 - RNA, 19 nt, Human
augccuguaaucccagcac

SEQ ID NO: 1077151 - RNA, 27 nt, Human
auuuugaucuguaaucuuuuuuuuuuu

SEQ ID NO: 1077152 - RNA, 23 nt, Human
caaaagagacaggguuuugccau

SEQ ID NO: 1077153 - RNA, 24 nt, Human
caaaagagacaggguuuugccaug

SEQ ID NO: 1077154 - RNA, 22 nt, Human
caaaagauauguaauaagagaa

SEQ ID NO: 1077155 - RNA, 25 nt, Human
caaacuccuggguccaagcaauccu

SEQ ID NO: 1077156 - RNA, 18 nt, Human
caaacuuaugaaaaacaa

SEQ ID NO: 1077157 - RNA, 24 nt, Human
caaagaccgaaacgacuggacgug

SEQ ID NO: 1077158 - RNA, 20 nt, Human
caaaugauucuccugccuca

SEQ ID NO: 1077159 - RNA, 22 nt, Human
caaaugauucuccugccucagc

SEQ ID NO: 1077160 - RNA, 24 nt, Human
caacauggcaaaaccucgucucua

SEQ ID NO: 1077161 - RNA, 21 nt, Human
caagaccauccuggcccacca

SEQ ID NO: 1077162 - RNA, 22 nt, Human
caagcaauccuucugccucagc

SEQ ID NO: 1077163 - RNA, 27 nt, Human
caagcaauccuucugccucagccuccu

SEQ ID NO: 1077164 - RNA, 18 nt, Human
caaggcaaagaccgaaac

SEQ ID NO: 1077165 - RNA, 27 nt, Human
caagugauccucccaccuuggcuuccc

SEQ ID NO: 1077166 - RNA, 20 nt, Human
caauuucucaccaauuugcc

SEQ ID NO: 1077167 - RNA, 18 nt, Human
cacacacacacacacaca

SEQ ID NO: 1077168 - RNA, 20 nt, Human
cacacacacacacacacaca

SEQ ID NO: 1077169 - RNA, 20 nt, Human
cacacacacacacacacaca

SEQ ID NO: 1077170 - RNA, 20 nt, Human
cacacacacacacacacaca

SEQ ID NO: 1077171 - RNA, 20 nt, Human
cacacacacacacacacaca

SEQ ID NO: 1077172 - RNA, 20 nt, Human
cacacacacacacacacaca

SEQ ID NO: 1077173 - RNA, 20 nt, Human
cacacacacacacacacaca

SEQ ID NO: 1077174 - RNA, 20 nt, Human
cacacacacacacacacaca

SEQ ID NO: 1077175 - RNA, 20 nt, Human
cacacacacacacacacaca

SEQ ID NO: 1077176 - RNA, 20 nt, Human
cacacacacacacacacaca

SEQ ID NO: 1077177 - RNA, 20 nt, Human
cacacacacacacacacaca

SEQ ID NO: 1077178 - RNA, 20 nt, Human
cacacacacacacacacaca

SEQ ID NO: 1077179 - RNA, 22 nt, Human
cacacacacacacacacacaca

SEQ ID NO: 1077180 - RNA, 22 nt, Human
cacacacacacacacacacaca

SEQ ID NO: 1077181 - RNA, 22 nt, Human
cacacacacacacacacacaca

SEQ ID NO: 1077182 - RNA, 22 nt, Human
cacacacacacacacacacaca

SEQ ID NO: 1077183 - RNA, 26 nt, Human
cacacacacacacacacacacacaca

SEQ ID NO: 1077184 - RNA, 26 nt, Human
cacacacacacacacacacacacaca

SEQ ID NO: 1077185 - RNA, 26 nt, Human
cacacacacacacacacacacacaca

SEQ ID NO: 1077186 - RNA, 26 nt, Human
cacacacacacacacacacacacaua

SEQ ID NO: 1077187 - RNA, 25 nt, Human
cacacacacacacacacacauacaa

SEQ ID NO: 1077188 - RNA, 20 nt, Human
cacacacacacacacacaua

SEQ ID NO: 1077189 - RNA, 22 nt, Human
cacacacacacacacacauaca

SEQ ID NO: 1077190 - RNA, 19 nt, Human
cacacacacacacacauac

SEQ ID NO: 1077191 - RNA, 24 nt, Human
cacacacacacauacaagauacuc

SEQ ID NO: 1077192 - RNA, 19 nt, Human
caccacacccagcaaauuu

SEQ ID NO: 1077193 - RNA, 21 nt, Human
cacucugaaaugaccaacaaa

SEQ ID NO: 1077194 - RNA, 25 nt, Human
cagaagaagauagaggcagggggau

SEQ ID NO: 1077195 - RNA, 24 nt, Human
cagcacuuugaggggcugaagcag

SEQ ID NO: 1077196 - RNA, 27 nt, Human
cagcugaagagcacaccgacaggacac

SEQ ID NO: 1077197 - RNA, 21 nt, Human
caggggaaaaccaucucccuu

SEQ ID NO: 1077198 - RNA, 19 nt, Human
caggguuuugccauguugg

SEQ ID NO: 1077199 - RNA, 23 nt, Human
caggguuuugccauguuggucag

SEQ ID NO: 1077200 - RNA, 21 nt, Human
cagugagccacgauuuugcca

SEQ ID NO: 1077201 - RNA, 21 nt, Human
caguggcaaucucaucuggcu

SEQ ID NO: 1077202 - RNA, 24 nt, Human
caugccaguaauuccagcacucug

SEQ ID NO: 1077203 - RNA, 20 nt, Human
caugccuguaaucccagcac

SEQ ID NO: 1077204 - RNA, 24 nt, Human
caugccuguaaucccagcacuuug

SEQ ID NO: 1077205 - RNA, 19 nt, Human
ccaaaugauucuccugccu

SEQ ID NO: 1077206 - RNA, 19 nt, Human
ccaccacggccccauccug

SEQ ID NO: 1077207 - RNA, 19 nt, Human
ccacuacacuccagacagg

SEQ ID NO: 1077208 - RNA, 20 nt, Human
ccaguaucauuuccaaaucu

SEQ ID NO: 1077209 - RNA, 19 nt, Human
ccauguuggucagucuggu

SEQ ID NO: 1077210 - RNA, 22 nt, Human
ccauguuggucagucuggucuc

SEQ ID NO: 1077211 - RNA, 23 nt, Human
ccauguuggucagucuggucucg

SEQ ID NO: 1077212 - RNA, 22 nt, Human
cccaaauguuguauuucccaag

SEQ ID NO: 1077213 - RNA, 23 nt, Human
cccaacucaaauauuaacacaau

SEQ ID NO: 1077214 - RNA, 23 nt, Human
cccaccuuggcuucccaagcgug

SEQ ID NO: 1077215 - RNA, 19 nt, Human
cccugucucaaaaaaaaaa

SEQ ID NO: 1077216 - RNA, 21 nt, Human
ccuauagucccagcuauuggg

SEQ ID NO: 1077217 - RNA, 22 nt, Human
ccuauagucccagcuauugggg

SEQ ID NO: 1077218 - RNA, 22 nt, Human
ccuauguugucccagcuggucu

SEQ ID NO: 1077219 - RNA, 19 nt, Human
ccuccuuuucccucugugu

SEQ ID NO: 1077220 - RNA, 24 nt, Human
ccugaucucaggugauccacccac

SEQ ID NO: 1077221 - RNA, 18 nt, Human
ccugcagucuagagugca

SEQ ID NO: 1077222 - RNA, 25 nt, Human
ccuggcccaccacggccccauccug

SEQ ID NO: 1077223 - RNA, 22 nt, Human
ccuggccguggagugccccaac

SEQ ID NO: 1077224 - RNA, 21 nt, Human
ccugggcaacauggcaaaacc

SEQ ID NO: 1077225 - RNA, 24 nt, Human
ccugggcaacauggcaaaaccucg

SEQ ID NO: 1077226 - RNA, 21 nt, Human
ccuggguccaagcaauccuuc

SEQ ID NO: 1077227 - RNA, 23 nt, Human
ccugucucaaaaaaaaaaaaaaa

SEQ ID NO: 1077228 - RNA, 24 nt, Human
ccugugacuauaaaaaccugagac

SEQ ID NO: 1077229 - RNA, 24 nt, Human
ccuucugccucagccuccucagua

SEQ ID NO: 1077230 - RNA, 24 nt, Human
cgggagugcuggguagaggaaggg

SEQ ID NO: 1077231 - RNA, 18 nt, Human
cucaaaaaaaaaaaaaaa

SEQ ID NO: 1077232 - RNA, 24 nt, Human
cucaagugauccucccaccuuggc

SEQ ID NO: 1077233 - RNA, 24 nt, Human
cucacuauagccucaaacuccugg

SEQ ID NO: 1077234 - RNA, 23 nt, Human
cucacugcaaccuccgccucugg

SEQ ID NO: 1077235 - RNA, 19 nt, Human
cucaggugauccacccacc

SEQ ID NO: 1077236 - RNA, 23 nt, Human
cucaugccaguaauuccagcacu

SEQ ID NO: 1077237 - RNA, 24 nt, Human
cucaugccuguaaucccagcacuu

SEQ ID NO: 1077238 - RNA, 19 nt, Human
cucccuucuggcuccccca

SEQ ID NO: 1077239 - RNA, 21 nt, Human
cuccuggguccaagcaauccu

SEQ ID NO: 1077240 - RNA, 18 nt, Human
cugaagacaaguguaaag

SEQ ID NO: 1077241 - RNA, 22 nt, Human
cugcaaccuccgccucuggauc

SEQ ID NO: 1077242 - RNA, 23 nt, Human
cugccucagccucccuaguagcu

SEQ ID NO: 1077243 - RNA, 22 nt, Human
cugccucagccuccucaguagc

SEQ ID NO: 1077244 - RNA, 23 nt, Human
cugccucagccuccucaguagcu

SEQ ID NO: 1077245 - RNA, 18 nt, Human
cuggaacuggaacuauag

SEQ ID NO: 1077246 - RNA, 18 nt, Human
cuggcuagggcuccaccc

SEQ ID NO: 1077247 - RNA, 19 nt, Human
cuggguagaggaagggugu

SEQ ID NO: 1077248 - RNA, 19 nt, Human
cugguacuacaggugcgug

SEQ ID NO: 1077249 - RNA, 20 nt, Human
cuuucuguacagacgguuuu

SEQ ID NO: 1077250 - RNA, 18 nt, Human
gaagguggguggaucacc

SEQ ID NO: 1077251 - RNA, 19 nt, Human
gagaggauguugaggggag

SEQ ID NO: 1077252 - RNA, 23 nt, Human
gagcccaggaguuugacaaaaga

SEQ ID NO: 1077253 - RNA, 23 nt, Human
gagugcuggguagaggaagggug

SEQ ID NO: 1077254 - RNA, 21 nt, Human
gaguuuggugggggcaguggg

SEQ ID NO: 1077255 - RNA, 19 nt, Human
gaucauggcucacuauagc

SEQ ID NO: 1077256 - RNA, 24 nt, Human
gaucccuugagcccaggaguuuga

SEQ ID NO: 1077257 - RNA, 18 nt, Human
gaugaggcggaguuuggu

SEQ ID NO: 1077258 - RNA, 21 nt, Human
gauucuccugccucagccucc

SEQ ID NO: 1077259 - RNA, 20 nt, Human
gcaaccuccgccucuggauc

SEQ ID NO: 1077260 - RNA, 26 nt, Human
gcaauccuucugccucagccuccuca

SEQ ID NO: 1077261 - RNA, 20 nt, Human
gccauguuggucagucuggu

SEQ ID NO: 1077262 - RNA, 18 nt, Human
gccuuacacauuaagggc

SEQ ID NO: 1077263 - RNA, 24 nt, Human
gcggaucagcagaagaagauagag

SEQ ID NO: 1077264 - RNA, 23 nt, Human
gcgguaagugccuauagucccag

SEQ ID NO: 1077265 - RNA, 18 nt, Human
gcuugcucuucuuccugc

SEQ ID NO: 1077266 - RNA, 26 nt, Human
ggaaaagagguguagaaaacaaaacu

SEQ ID NO: 1077267 - RNA, 23 nt, Human
ggaacacacaggccguugaagcg

SEQ ID NO: 1077268 - RNA, 18 nt, Human
ggagaugaggcuacagug

SEQ ID NO: 1077269 - RNA, 18 nt, Human
ggagcggaucagcagaag

SEQ ID NO: 1077270 - RNA, 23 nt, Human
ggcagugggaggagagcccuggc

SEQ ID NO: 1077271 - RNA, 19 nt, Human
ggccagcaggcucaaguuc

SEQ ID NO: 1077272 - RNA, 21 nt, Human
gggcucaagugauccucccac

SEQ ID NO: 1077273 - RNA, 24 nt, Human
gguagaucccuugagcccaggagu

SEQ ID NO: 1077274 - RNA, 20 nt, Human
ggucucgaacuccugaucuc

SEQ ID NO: 1077275 - RNA, 19 nt, Human
gguggcaugagccuggccu

SEQ ID NO: 1077276 - RNA, 24 nt, Human
gguggcucaugccaguaauuccag

SEQ ID NO: 1077277 - RNA, 24 nt, Human
gguggcucaugccuguaaucccag

SEQ ID NO: 1077278 - RNA, 24 nt, Human
ggugggggcagugggaggagagcc

SEQ ID NO: 1077279 - RNA, 23 nt, Human
guggcucaugccaguaauuccag

SEQ ID NO: 1077280 - RNA, 24 nt, Human
guggucucccuauguugucccagc

SEQ ID NO: 1077281 - RNA, 18 nt, Human
guuagaugcuugaugugu

SEQ ID NO: 1077282 - RNA, 24 nt, Human
guuagaugcuugauguguuccaug

SEQ ID NO: 1077283 - RNA, 21 nt, Human
guuauuuuucagaagcaaacu

SEQ ID NO: 1077284 - RNA, 18 nt, Human
guuggccaccacucccag

SEQ ID NO: 1077285 - RNA, 21 nt, Human
uaaaagcaguggcaaucucau

SEQ ID NO: 1077286 - RNA, 24 nt, Human
uaaauucuauucauaccuuagaaa

SEQ ID NO: 1077287 - RNA, 22 nt, Human
uaagauagggucucucuccguc

SEQ ID NO: 1077288 - RNA, 19 nt, Human
uacaagauacucucuuuuu

SEQ ID NO: 1077289 - RNA, 25 nt, Human
uacacacacacacacacacacacac

SEQ ID NO: 1077290 - RNA, 24 nt, Human
uacaggugcgugucaccacaccca

SEQ ID NO: 1077291 - RNA, 22 nt, Human
uacagugagccacgauuuugcc

SEQ ID NO: 1077292 - RNA, 19 nt, Human
uacaguggcaagaucuugg

SEQ ID NO: 1077293 - RNA, 22 nt, Human
uagaggaaggguguggucccug

SEQ ID NO: 1077294 - RNA, 21 nt, Human
uagagugcaauggugcgauca

SEQ ID NO: 1077295 - RNA, 24 nt, Human
uagaucccuugagcccaggaguuu

SEQ ID NO: 1077296 - RNA, 20 nt, Human
uagcaaggcaaagaccgaaa

SEQ ID NO: 1077297 - RNA, 22 nt, Human
uagggcuccacccccaccgacc

SEQ ID NO: 1077298 - RNA, 24 nt, Human
uagucaggugugguggcucaugcc

SEQ ID NO: 1077299 - RNA, 25 nt, Human
uauacacacacacacacacacacac

SEQ ID NO: 1077300 - RNA, 22 nt, Human
uauagcacuuuucacaauacac

SEQ ID NO: 1077301 - RNA, 24 nt, Human
uauagucaggugugguggcucaug

SEQ ID NO: 1077302 - RNA, 25 nt, Human
uauauacacacacacacacacacac

SEQ ID NO: 1077303 - RNA, 25 nt, Human
uauauacacacacacacacacacag

SEQ ID NO: 1077304 - RNA, 24 nt, Human
uaucaaacuuaugaaaaacaacua

SEQ ID NO: 1077305 - RNA, 24 nt, Human
uauguugucccagcuggucuugaa

SEQ ID NO: 1077306 - RNA, 22 nt, Human
ucaaaaaaaaaaaaaaaaaaaa

SEQ ID NO: 1077307 - RNA, 23 nt, Human
ucaaaaaaaaaaaaaaaaaaaaa

SEQ ID NO: 1077308 - RNA, 24 nt, Human
ucaaaaaaaaaaaaaaaaaaaaau

SEQ ID NO: 1077309 - RNA, 18 nt, Human
ucaaugaaagaaggcaca

SEQ ID NO: 1077310 - RNA, 24 nt, Human
ucacuauagccucaaacuccuggg

SEQ ID NO: 1077311 - RNA, 18 nt, Human
ucacugcaaccuccgccu

SEQ ID NO: 1077312 - RNA, 19 nt, Human
ucacugcaaccuccgccuc

SEQ ID NO: 1077313 - RNA, 22 nt, Human
ucacugcaaccuccgccucugg

SEQ ID NO: 1077314 - RNA, 23 nt, Human
ucacugcaaccuccgccucugga

SEQ ID NO: 1077315 - RNA, 25 nt, Human
ucacugcaaccuccgccucuggauc

SEQ ID NO: 1077316 - RNA, 20 nt, Human
ucagggcucaagugauccuc

SEQ ID NO: 1077317 - RNA, 21 nt, Human
ucaucacauucucuuacugug

SEQ ID NO: 1077318 - RNA, 22 nt, Human
ucaugccaguaauuccagcacu

SEQ ID NO: 1077319 - RNA, 22 nt, Human
ucaugccuguaaucccagcacu

SEQ ID NO: 1077320 - RNA, 24 nt, Human
uccaaaugauucuccugccucagc

SEQ ID NO: 1077321 - RNA, 24 nt, Human
uccaagcaauccuucugccucagc

SEQ ID NO: 1077322 - RNA, 21 nt, Human
uccacccccaccgaccuagau

SEQ ID NO: 1077323 - RNA, 24 nt, Human
ucccagcuggucuugaacucaggg

SEQ ID NO: 1077324 - RNA, 19 nt, Human
ucccagcuuaccaaauauu

SEQ ID NO: 1077325 - RNA, 23 nt, Human
ucccagcuuaccaaauauuucac

SEQ ID NO: 1077326 - RNA, 24 nt, Human
uccucccaccuuggcuucccaagc

SEQ ID NO: 1077327 - RNA, 18 nt, Human
uccuggguccaagcaauc

SEQ ID NO: 1077328 - RNA, 24 nt, Human
uccuggguccaagcaauccuucug

SEQ ID NO: 1077329 - RNA, 19 nt, Human
ucuagcaaggcaaagaccg

SEQ ID NO: 1077330 - RNA, 18 nt, Human
ucuauucauaccuuagaa

SEQ ID NO: 1077331 - RNA, 24 nt, Human
ucucccuauguugucccagcuggu

SEQ ID NO: 1077332 - RNA, 25 nt, Human
ucuccugccucagccucccuaguag

SEQ ID NO: 1077333 - RNA, 19 nt, Human
ucucgaacuccugaucuca

SEQ ID NO: 1077334 - RNA, 21 nt, Human
ucugaaaugaccaacaaaagg

SEQ ID NO: 1077335 - RNA, 24 nt, Human
ucugucaccuaggcuagaguacag

SEQ ID NO: 1077336 - RNA, 18 nt, Human
ugaaaugccuuacacauu

SEQ ID NO: 1077337 - RNA, 18 nt, Human
ugaacugaagacaagugu

SEQ ID NO: 1077338 - RNA, 18 nt, Human
ugaagagcacaccgacag

SEQ ID NO: 1077339 - RNA, 22 nt, Human
ugaagagcacaccgacaggaca

SEQ ID NO: 1077340 - RNA, 20 nt, Human
ugacuauaaaaaccugagac

SEQ ID NO: 1077341 - RNA, 21 nt, Human
ugacuauaaaaaccugagacu

SEQ ID NO: 1077342 - RNA, 22 nt, Human
ugagacagagucucugucuguc

SEQ ID NO: 1077343 - RNA, 24 nt, Human
ugaggcaggaggaugauuugagcc

SEQ ID NO: 1077344 - RNA, 25 nt, Human
ugaggcaggaggaugauuugagccu

SEQ ID NO: 1077345 - RNA, 24 nt, Human
ugaucucaggugauccacccaccu

SEQ ID NO: 1077346 - RNA, 18 nt, Human
ugaucuguaaucuuuuuu

SEQ ID NO: 1077347 - RNA, 21 nt, Human
ugauggaaguuauauacuuaa

SEQ ID NO: 1077348 - RNA, 19 nt, Human
ugauguguuccaugacgug

SEQ ID NO: 1077349 - RNA, 20 nt, Human
ugauucuccugccucagccu

SEQ ID NO: 1077350 - RNA, 19 nt, Human
ugauuugagccugggagau

SEQ ID NO: 1077351 - RNA, 22 nt, Human
ugauuugagccugggagaugag

SEQ ID NO: 1077352 - RNA, 18 nt, Human
ugccuauagucccagcua

SEQ ID NO: 1077353 - RNA, 22 nt, Human
ugccuauagucccagcuauugg

SEQ ID NO: 1077354 - RNA, 24 nt, Human
ugccucagccucccuaguagcugg

SEQ ID NO: 1077355 - RNA, 24 nt, Human
ugccucagccuccucaguagcugg

SEQ ID NO: 1077356 - RNA, 18 nt, Human
ugccuguaaucccagcac

SEQ ID NO: 1077357 - RNA, 23 nt, Human
ugccuguaaucccagcacuuuga

SEQ ID NO: 1077358 - RNA, 25 nt, Human
ugcuggguagaggaagggugugguc

SEQ ID NO: 1077359 - RNA, 24 nt, Human
ugcuucaggcuuuucuaauauuuu

SEQ ID NO: 1077360 - RNA, 21 nt, Human
uggaacuauaggcaugugcca

SEQ ID NO: 1077361 - RNA, 24 nt, Human
uggaacuauaggcaugugccacug

SEQ ID NO: 1077362 - RNA, 23 nt, Human
uggaagguggguggaucaccuua

SEQ ID NO: 1077363 - RNA, 19 nt, Human
uggaucaccuuagguuagg

SEQ ID NO: 1077364 - RNA, 20 nt, Human
uggaucaccuuagguuaggu

SEQ ID NO: 1077365 - RNA, 20 nt, Human
uggauccaaaugauucuccu

SEQ ID NO: 1077366 - RNA, 24 nt, Human
uggauccaaaugauucuccugccu

SEQ ID NO: 1077367 - RNA, 25 nt, Human
uggcaaaaccucgucucuaugaaaa

SEQ ID NO: 1077368 - RNA, 18 nt, Human
uggcagcugaagagcaca

SEQ ID NO: 1077369 - RNA, 19 nt, Human
uggcuagggcuccaccccc

SEQ ID NO: 1077370 - RNA, 24 nt, Human
uggcucaugccuguaaucccagca

SEQ ID NO: 1077371 - RNA, 19 nt, Human
uggcuucccaagcgugggg

SEQ ID NO: 1077372 - RNA, 18 nt, Human
ugggaaggcaagaccaug

SEQ ID NO: 1077373 - RNA, 20 nt, Human
ugggagaugaggcuacagug

SEQ ID NO: 1077374 - RNA, 24 nt, Human
ugggggcagugggaggagagcccu

SEQ ID NO: 1077375 - RNA, 21 nt, Human
uggguagaggaaggguguggu

SEQ ID NO: 1077376 - RNA, 23 nt, Human
uggguccaagcaauccuucugcc

SEQ ID NO: 1077377 - RNA, 18 nt, Human
uggguggguggcaugagc

SEQ ID NO: 1077378 - RNA, 24 nt, Human
ugguacuacaggugcgugucacca

SEQ ID NO: 1077379 - RNA, 24 nt, Human
uggucagucuggucucgaacuccu

SEQ ID NO: 1077380 - RNA, 19 nt, Human
uggugcgaucauggcucac

SEQ ID NO: 1077381 - RNA, 24 nt, Human
ugguggcucaugccaguaauucca

SEQ ID NO: 1077382 - RNA, 24 nt, Human
ugguggcucaugccuguaauccca

SEQ ID NO: 1077383 - RNA, 23 nt, Human
ugguggguggguggcaugagccu

SEQ ID NO: 1077384 - RNA, 18 nt, Human
ugucagaagcuagauacc

SEQ ID NO: 1077385 - RNA, 20 nt, Human
ugugugaaaugccuuacaca

SEQ ID NO: 1077386 - RNA, 23 nt, Human
uuaaacauauuuucuguuuuuca

SEQ ID NO: 1077387 - RNA, 19 nt, Human
uuagaugcuugauguguuc

SEQ ID NO: 1077388 - RNA, 20 nt, Human
uuccaaaucuuucagguuuu

SEQ ID NO: 1077389 - RNA, 24 nt, Human
uucucaccaauuugcccuuuuaaa

SEQ ID NO: 1077390 - RNA, 20 nt, Human
uugaaauuuguuuuaagauu

SEQ ID NO: 1077391 - RNA, 24 nt, Human
uugccauguuggucagucuggucu

SEQ ID NO: 1077392 - RNA, 24 nt, Human
uuggugggggcagugggaggagag

SEQ ID NO: 1077393 - RNA, 26 nt, Human
uuggugggggcagugggaggagagcc

SEQ ID NO: 1077394 - RNA, 20 nt, Human
uuguugcauuuuuaaaauaa

SEQ ID NO: 1077395 - RNA, 21 nt, Human
uuuggcuugcucuucuuccug

SEQ ID NO: 1077396 - RNA, 22 nt, Human
uuuucagaagcaaacuaaaacu

SEQ ID NO: 1077397 - RNA, 23 nt, Human
uuuuuuuuuuaagauagggucuc

SEQ ID NO: 1077398 - RNA, 20 nt, Human
uuuuuuuuuuugagacagag

SEQ ID NO: 1077399 - RNA, 21 nt, Human
uuuuuuuuuuuuaagauaggg

SEQ ID NO: 1077400 - RNA, 20 nt, Human
aaaaaagcaacaaagacaac

SEQ ID NO: 1077401 - RNA, 22 nt, Human
aaaagagcagauuuuagacaca

SEQ ID NO: 1077402 - RNA, 20 nt, Human
aaaaggaaagaaguggagaa

SEQ ID NO: 1077403 - RNA, 21 nt, Human
aaaauugaggaagagugggga

SEQ ID NO: 1077404 - RNA, 27 nt, Human
aaagacaaccaauguugccccagaggu

SEQ ID NO: 1077405 - RNA, 24 nt, Human
aaagaccuaaaacacacacaggca

SEQ ID NO: 1077406 - RNA, 26 nt, Human
aaagauuaauaacauugaguagauaa

SEQ ID NO: 1077407 - RNA, 20 nt, Human
aaaucauguccuugugccaa

SEQ ID NO: 1077408 - RNA, 23 nt, Human
aacaaagacaaccaauguugccc

SEQ ID NO: 1077409 - RNA, 21 nt, Human
aacauucaaaaacuuguccuc

SEQ ID NO: 1077410 - RNA, 22 nt, Human
aacuuauacauagcugucuucc

SEQ ID NO: 1077411 - RNA, 19 nt, Human
aagauuaauaacauugagu

SEQ ID NO: 1077412 - RNA, 18 nt, Human
aagcaguucccuacccuc

SEQ ID NO: 1077413 - RNA, 20 nt, Human
aaucaugacauuucaucugg

SEQ ID NO: 1077414 - RNA, 18 nt, Human
aauucccucuccuucccc

SEQ ID NO: 1077415 - RNA, 24 nt, Human
acaaacacaguaauagaccaagau

SEQ ID NO: 1077416 - RNA, 23 nt, Human
acacacacacacacacacacaca

SEQ ID NO: 1077417 - RNA, 23 nt, Human
acacacacacacacacacacaca

SEQ ID NO: 1077418 - RNA, 23 nt, Human
acacacacacacacacacacaca

SEQ ID NO: 1077419 - RNA, 23 nt, Human
acacacacacacacacacacaca

SEQ ID NO: 1077420 - RNA, 23 nt, Human
acacacacacacacacacacaca

SEQ ID NO: 1077421 - RNA, 23 nt, Human
acacacacacacacacacacaca

SEQ ID NO: 1077422 - RNA, 23 nt, Human
acacacacacacacacacacaca

SEQ ID NO: 1077423 - RNA, 23 nt, Human
acacacacacacacacacacaca

SEQ ID NO: 1077424 - RNA, 23 nt, Human
acacacacacacacacacacaca

SEQ ID NO: 1077425 - RNA, 23 nt, Human
acacacacacacacacacacaca

SEQ ID NO: 1077426 - RNA, 28 nt, Human
acacacacacacacacacacacaaacac

SEQ ID NO: 1077427 - RNA, 19 nt, Human
accugcuaccuaccacaag

SEQ ID NO: 1077428 - RNA, 23 nt, Human
accugcuaccuaccacaagcauc

SEQ ID NO: 1077429 - RNA, 25 nt, Human
acucaguccacuagccuggacaccu

SEQ ID NO: 1077430 - RNA, 21 nt, Human
acuuauacauagcugucuucc

SEQ ID NO: 1077431 - RNA, 20 nt, Human
agaaaaaagcaacaaagaca

SEQ ID NO: 1077432 - RNA, 22 nt, Human
agaaaugaaaauaaaaaaggga

SEQ ID NO: 1077433 - RNA, 22 nt, Human
agaccuaaaacacacacaggca

SEQ ID NO: 1077434 - RNA, 21 nt, Human
agcuggugacaggaggccugg

SEQ ID NO: 1077435 - RNA, 22 nt, Human
aggaaagaaguggagaacaagg

SEQ ID NO: 1077436 - RNA, 19 nt, Human
aggaagauccaagcuggcu

SEQ ID NO: 1077437 - RNA, 22 nt, Human
aggcagagaguuuccaggaaca

SEQ ID NO: 1077438 - RNA, 18 nt, Human
aggcauuuggaaagaaaa

SEQ ID NO: 1077439 - RNA, 21 nt, Human
agggcuggaggcucccaaacu

SEQ ID NO: 1077440 - RNA, 19 nt, Human
aucugaagaugguaugaag

SEQ ID NO: 1077441 - RNA, 19 nt, Human
auuaauaaagaccuaaaac

SEQ ID NO: 1077442 - RNA, 21 nt, Human
caaaagagcagauuuuagaca

SEQ ID NO: 1077443 - RNA, 26 nt, Human
caaacacaguaauagaccaagaugaa

SEQ ID NO: 1077444 - RNA, 25 nt, Human
caacauuaauaaagaccuaaaacac

SEQ ID NO: 1077445 - RNA, 25 nt, Human
cacacacacacacacaaacacagua

SEQ ID NO: 1077446 - RNA, 20 nt, Human
cacacacacacacacacaca

SEQ ID NO: 1077447 - RNA, 20 nt, Human
cacacacacacacacacaca

SEQ ID NO: 1077448 - RNA, 20 nt, Human
cacacacacacacacacaca

SEQ ID NO: 1077449 - RNA, 20 nt, Human
cacacacacacacacacaca

SEQ ID NO: 1077450 - RNA, 20 nt, Human
cacacacacacacacacaca

SEQ ID NO: 1077451 - RNA, 20 nt, Human
cacacacacacacacacaca

SEQ ID NO: 1077452 - RNA, 20 nt, Human
cacacacacacacacacaca

SEQ ID NO: 1077453 - RNA, 20 nt, Human
cacacacacacacacacaca

SEQ ID NO: 1077454 - RNA, 20 nt, Human
cacacacacacacacacaca

SEQ ID NO: 1077455 - RNA, 20 nt, Human
cacacacacacacacacaca

SEQ ID NO: 1077456 - RNA, 20 nt, Human
cacacacacacacacacaca

SEQ ID NO: 1077457 - RNA, 20 nt, Human
cacacacacacacacacaca

SEQ ID NO: 1077458 - RNA, 22 nt, Human
cacacacacacacacacacaca

SEQ ID NO: 1077459 - RNA, 22 nt, Human
cacacacacacacacacacaca

SEQ ID NO: 1077460 - RNA, 22 nt, Human
cacacacacacacacacacaca

SEQ ID NO: 1077461 - RNA, 26 nt, Human
cacacacacacacacacacacacaaa

SEQ ID NO: 1077462 - RNA, 26 nt, Human
cacacacacacacacacacacacaca

SEQ ID NO: 1077463 - RNA, 26 nt, Human
cacacacacacacacacacacacaca

SEQ ID NO: 1077464 - RNA, 26 nt, Human
cacacacacacacacacacacacaca

SEQ ID NO: 1077465 - RNA, 26 nt, Human
cacacacacacacacacacacacaca

SEQ ID NO: 1077466 - RNA, 26 nt, Human
cacacacacacacacacacacacaca

SEQ ID NO: 1077467 - RNA, 20 nt, Human
cacacagcuggugacaggag

SEQ ID NO: 1077468 - RNA, 20 nt, Human
cacacaggcagaacacucac

SEQ ID NO: 1077469 - RNA, 26 nt, Human
cacacugaccaucaagcucuugcggu

SEQ ID NO: 1077470 - RNA, 21 nt, Human
cacaguaauagaccaagauga

SEQ ID NO: 1077471 - RNA, 22 nt, Human
cacaguaauagaccaagaugaa

SEQ ID NO: 1077472 - RNA, 21 nt, Human
cacagugaaugagaacccaua

SEQ ID NO: 1077473 - RNA, 20 nt, Human
cacucuguuuuuucucucug

SEQ ID NO: 1077474 - RNA, 19 nt, Human
cagccgcuuccagguccug

SEQ ID NO: 1077475 - RNA, 23 nt, Human
caguccacuagccuggacaccag

SEQ ID NO: 1077476 - RNA, 24 nt, Human
cauacacauccaacuccacguucc

SEQ ID NO: 1077477 - RNA, 22 nt, Human
cauauacauuauguuguauaug

SEQ ID NO: 1077478 - RNA, 22 nt, Human
cauccccaucauacacauccaa

SEQ ID NO: 1077479 - RNA, 21 nt, Human
caugacauaacagaaagagca

SEQ ID NO: 1077480 - RNA, 19 nt, Human
cauggaaaaauucagggaa

SEQ ID NO: 1077481 - RNA, 20 nt, Human
cccauguaccuccuccagcc

SEQ ID NO: 1077482 - RNA, 24 nt, Human
ccccagaaaggcagcaccagucuc

SEQ ID NO: 1077483 - RNA, 24 nt, Human
cccccaggugacaaaacuuaauuu

SEQ ID NO: 1077484 - RNA, 20 nt, Human
cccucuccuuccccagccca

SEQ ID NO: 1077485 - RNA, 18 nt, Human
ccuaaaacacacacaggc

SEQ ID NO: 1077486 - RNA, 24 nt, Human
ccugcuaccuaccacaagcaucug

SEQ ID NO: 1077487 - RNA, 26 nt, Human
cgggagagggggaugaacuuuggauc

SEQ ID NO: 1077488 - RNA, 20 nt, Human
cucgauugaguuacugaugu

SEQ ID NO: 1077489 - RNA, 23 nt, Human
cuguaauauuaaaugcuuggccu

SEQ ID NO: 1077490 - RNA, 20 nt, Human
gaaaacuucuagaaaaaagc

SEQ ID NO: 1077491 - RNA, 23 nt, Human
gaagaugguaugaaggaaagagg

SEQ ID NO: 1077492 - RNA, 25 nt, Human
gacacagaaaucacgauucauaaca

SEQ ID NO: 1077493 - RNA, 20 nt, Human
gauaaagagauauucccucg

SEQ ID NO: 1077494 - RNA, 25 nt, Human
gcccuggcucauuacagauucuucc

SEQ ID NO: 1077495 - RNA, 28 nt, Human
gcccuggcucauuacagauucuuccaac

SEQ ID NO: 1077496 - RNA, 20 nt, Human
gcuaccuaccacaagcaucu

SEQ ID NO: 1077497 - RNA, 21 nt, Human
gcugccaagcuuccauaucca

SEQ ID NO: 1077498 - RNA, 20 nt, Human
ggcaaaauguucacucuguu

SEQ ID NO: 1077499 - RNA, 18 nt, Human
gugaagcacggaaauuag

SEQ ID NO: 1077500 - RNA, 21 nt, Human
guuauuuaauacagagaagac

SEQ ID NO: 1077501 - RNA, 18 nt, Human
uaaaacacacacaggcag

SEQ ID NO: 1077502 - RNA, 23 nt, Human
uaaagaccuaaaacacacacagg

SEQ ID NO: 1077503 - RNA, 22 nt, Human
uaaagagauauucccucguuga

SEQ ID NO: 1077504 - RNA, 22 nt, Human
uaaagagauauucccucguuga

SEQ ID NO: 1077505 - RNA, 25 nt, Human
uaacaaaagagcagauuuuagacac

SEQ ID NO: 1077506 - RNA, 19 nt, Human
uaauggaucacaccaauac

SEQ ID NO: 1077507 - RNA, 20 nt, Human
uacacacacacacacacaca

SEQ ID NO: 1077508 - RNA, 25 nt, Human
uacacacacacacacacacacacac

SEQ ID NO: 1077509 - RNA, 25 nt, Human
uacacacacacacacacacacacag

SEQ ID NO: 1077510 - RNA, 24 nt, Human
uacacacacacacacacacacagu

SEQ ID NO: 1077511 - RNA, 18 nt, Human
uacacaccaccugcuacc

SEQ ID NO: 1077512 - RNA, 23 nt, Human
uacacuaaaaagauuaauaacau

SEQ ID NO: 1077513 - RNA, 18 nt, Human
uacagggacucucgggag

SEQ ID NO: 1077514 - RNA, 18 nt, Human
uacauuauugaguccugg

SEQ ID NO: 1077515 - RNA, 22 nt, Human
uaccacaucacagugaaugagg

SEQ ID NO: 1077516 - RNA, 19 nt, Human
uacuauguaccaguaggcc

SEQ ID NO: 1077517 - RNA, 20 nt, Human
uacuuaucaaaacaccacuc

SEQ ID NO: 1077518 - RNA, 21 nt, Human
uagcuuucuucacuucucugu

SEQ ID NO: 1077519 - RNA, 23 nt, Human
uaggaaaacuggcccuggcucau

SEQ ID NO: 1077520 - RNA, 18 nt, Human
uaggaagauccaagcugg

SEQ ID NO: 1077521 - RNA, 24 nt, Human
uaggagaagcaguucccuacccuc

SEQ ID NO: 1077522 - RNA, 20 nt, Human
uagucugcuucuggggaaac

SEQ ID NO: 1077523 - RNA, 22 nt, Human
uaucuacuuaucaaaacaccac

SEQ ID NO: 1077524 - RNA, 24 nt, Human
uaucuacuuaucaaaacaccacuc

SEQ ID NO: 1077525 - RNA, 19 nt, Human
uaucucagauuuucagccg

SEQ ID NO: 1077526 - RNA, 19 nt, Human
uaucuggggcacaggccag

SEQ ID NO: 1077527 - RNA, 24 nt, Human
uauuagcuuucuucacuucucugu

SEQ ID NO: 1077528 - RNA, 20 nt, Human
uauuuggagggagaagguug

SEQ ID NO: 1077529 - RNA, 23 nt, Human
uauuuggagggagaagguugggu

SEQ ID NO: 1077530 - RNA, 22 nt, Human
ucaaaaacuuguccuccugcca

SEQ ID NO: 1077531 - RNA, 21 nt, Human
ucaaaacaccacucaccagaa

SEQ ID NO: 1077532 - RNA, 24 nt, Human
ucaacuccaaaaaaacugcuugca

SEQ ID NO: 1077533 - RNA, 21 nt, Human
ucaagcucgcagucccccagg

SEQ ID NO: 1077534 - RNA, 19 nt, Human
ucaggccauggaguacagg

SEQ ID NO: 1077535 - RNA, 19 nt, Human
ucagugucguguuuguacc

SEQ ID NO: 1077536 - RNA, 19 nt, Human
uccaaaaaaacugcuugca

SEQ ID NO: 1077537 - RNA, 22 nt, Human
uccaacuccacguuccccugau

SEQ ID NO: 1077538 - RNA, 24 nt, Human
uccacgggagagggggaugaacuu

SEQ ID NO: 1077539 - RNA, 25 nt, Human
uccauacacaccaccugcuaccuac

SEQ ID NO: 1077540 - RNA, 27 nt, Human
uccauacacaccaccugcuaccuacca

SEQ ID NO: 1077541 - RNA, 28 nt, Human
uccauacacaccaccugcuaccuaccac

SEQ ID NO: 1077542 - RNA, 19 nt, Human
ucccccaggugacaaaacu

SEQ ID NO: 1077543 - RNA, 23 nt, Human
uccucgggcuuucucuggccaca

SEQ ID NO: 1077544 - RNA, 20 nt, Human
ucuauaacuaggaaaacugg

SEQ ID NO: 1077545 - RNA, 22 nt, Human
ucuauaacuaggaaaacuggcc

SEQ ID NO: 1077546 - RNA, 21 nt, Human
ucucgggaguuaacucagucc

SEQ ID NO: 1077547 - RNA, 22 nt, Human
ucucuggccacagaagcaugcc

SEQ ID NO: 1077548 - RNA, 25 nt, Human
ugaaaacuucuagaaaaaagcaaca

SEQ ID NO: 1077549 - RNA, 24 nt, Human
ugacuucagcaaagucacacagcu

SEQ ID NO: 1077550 - RNA, 18 nt, Human
ugagaacccauaaaguca

SEQ ID NO: 1077551 - RNA, 22 nt, Human
ugagacuuaggggaaagaaaug

SEQ ID NO: 1077552 - RNA, 23 nt, Human
ugaggaagaguggggagucuuug

SEQ ID NO: 1077553 - RNA, 18 nt, Human
ugauaucuacuuaucaaa

SEQ ID NO: 1077554 - RNA, 19 nt, Human
ugcagcaaaaucaugguau

SEQ ID NO: 1077555 - RNA, 24 nt, Human
ugcauaggaaaaugguuugcuucu

SEQ ID NO: 1077556 - RNA, 22 nt, Human
ugcguuguggaaacuaauuugg

SEQ ID NO: 1077557 - RNA, 20 nt, Human
uggcauaguuuauuuaugca

SEQ ID NO: 1077558 - RNA, 19 nt, Human
uggggaaacuaagucugag

SEQ ID NO: 1077559 - RNA, 25 nt, Human
uguacaauaauggaucacaccaaua

SEQ ID NO: 1077560 - RNA, 18 nt, Human
uguaccuccuccagccua

SEQ ID NO: 1077561 - RNA, 21 nt, Human
uguguagaaagugcaucauuu

SEQ ID NO: 1077562 - RNA, 18 nt, Human
uguugggauagucagggc

SEQ ID NO: 1077563 - RNA, 21 nt, Human
uucagggaacuugcuguuuuc

SEQ ID NO: 1077564 - RNA, 20 nt, Human
uuccagcgcucucuuucagg

SEQ ID NO: 1077565 - RNA, 18 nt, Human
uuccagguccugggacuc

SEQ ID NO: 1077566 - RNA, 23 nt, Human
uuccccagcccauguaccuccuc

SEQ ID NO: 1077567 - RNA, 18 nt, Human
uugaggaagaguggggag

SEQ ID NO: 1077568 - RNA, 24 nt, Human
uugcuguuuucccaagcccucccc

SEQ ID NO: 1077569 - RNA, 20 nt, Human
uuuagaaaugaaaauaaaaa

SEQ ID NO: 1077570 - RNA, 18 nt, Human
uuucccaagcccucccca

SEQ ID NO: 1077571 - RNA, 19 nt, Human
uuucccaagcccuccccag

SEQ ID NO: 1077572 - RNA, 24 nt, Human
uuuucccaagcccuccccagaaag

SEQ ID NO: 1077573 - RNA, 22 nt, Human
aaaaaaggaaaaaaaauaaacc

SEQ ID NO: 1077574 - RNA, 25 nt, Human
aaaaagaaagcgagaguucagggac

SEQ ID NO: 1077575 - RNA, 23 nt, Human
aaacaggccaaaaaaaauaaaca

SEQ ID NO: 1077576 - RNA, 28 nt, Human
aaauacaaacaaauuuccuuuuuaaagu

SEQ ID NO: 1077577 - RNA, 21 nt, Human
aacaggccaaaaaaaauaaac

SEQ ID NO: 1077578 - RNA, 24 nt, Human
aaggaggaacaaugcaaagauggc

SEQ ID NO: 1077579 - RNA, 23 nt, Human
aauaaaaaauacaaacaaauuuc

SEQ ID NO: 1077580 - RNA, 22 nt, Human
acaaauuuccuuuuuaaaguac

SEQ ID NO: 1077581 - RNA, 21 nt, Human
accaucucauacaaaccaacu

SEQ ID NO: 1077582 - RNA, 23 nt, Human
acccuaacaauauguauaaaaau

SEQ ID NO: 1077583 - RNA, 23 nt, Human
agaaaaaaagcauggccuuggaa

SEQ ID NO: 1077584 - RNA, 26 nt, Human
agacaaaaaaggaaaaaaagggaccc

SEQ ID NO: 1077585 - RNA, 19 nt, Human
aggaacaaugcaaagaugg

SEQ ID NO: 1077586 - RNA, 24 nt, Human
aggccaaaaaaaauaaacagcaac

SEQ ID NO: 1077587 - RNA, 22 nt, Human
auaaacagcaacuucauagaca

SEQ ID NO: 1077588 - RNA, 24 nt, Human
caaaaaaaauaaacagcaacuuca

SEQ ID NO: 1077589 - RNA, 19 nt, Human
caaacaggccaaaaaaaau

SEQ ID NO: 1077590 - RNA, 22 nt, Human
caagguuuuuuucuccuuugag

SEQ ID NO: 1077591 - RNA, 23 nt, Human
cacaccacaaguaaagucagaag

SEQ ID NO: 1077592 - RNA, 23 nt, Human
cauacaaaccaacuccuuauagu

SEQ ID NO: 1077593 - RNA, 18 nt, Human
cucaugguuuggguuggg

SEQ ID NO: 1077594 - RNA, 20 nt, Human
cuggaaugcucagaauaaga

SEQ ID NO: 1077595 - RNA, 23 nt, Human
gaaaaaaagcauggccuuggaag

SEQ ID NO: 1077596 - RNA, 18 nt, Human
gaacauggucacaccacc

SEQ ID NO: 1077597 - RNA, 25 nt, Human
gaacgcucccaaggcugguuugguc

SEQ ID NO: 1077598 - RNA, 21 nt, Human
gaugcaggggauuaaaaagaa

SEQ ID NO: 1077599 - RNA, 18 nt, Human
gcgcgcggcggaggcggc

SEQ ID NO: 1077600 - RNA, 20 nt, Human
gcggcggaggcggcugcggc

SEQ ID NO: 1077601 - RNA, 18 nt, Human
gcggcggcggaggaggcg

SEQ ID NO: 1077602 - RNA, 24 nt, Human
gcugguuuggucauccgagaucau

SEQ ID NO: 1077603 - RNA, 22 nt, Human
ggcgggccucucuacuugaagg

SEQ ID NO: 1077604 - RNA, 24 nt, Human
ggucauccgagaucauuaaaaaug

SEQ ID NO: 1077605 - RNA, 21 nt, Human
ggugggcaggcgggccucucu

SEQ ID NO: 1077606 - RNA, 21 nt, Human
uaaaaagaaagcgagaguuca

SEQ ID NO: 1077607 - RNA, 26 nt, Human
uacaaacaaauuuccuuuuuaaagua

SEQ ID NO: 1077608 - RNA, 19 nt, Human
uacaagguuuuuuucuccu

SEQ ID NO: 1077609 - RNA, 26 nt, Human
uacauacacaaaaaaguuacuggaau

SEQ ID NO: 1077610 - RNA, 18 nt, Human
ucacaccacaaguaaagu

SEQ ID NO: 1077611 - RNA, 23 nt, Human
ucauagacaaaaaaggaaaaaaa

SEQ ID NO: 1077612 - RNA, 20 nt, Human
ucucaugguuuggguugggu

SEQ ID NO: 1077613 - RNA, 18 nt, Human
ugaauaggucacggcggc

SEQ ID NO: 1077614 - RNA, 19 nt, Human
ugcccacggugggcaggcg

SEQ ID NO: 1077615 - RNA, 18 nt, Human
ugcggcgagcaaggagga

SEQ ID NO: 1077616 - RNA, 24 nt, Human
uggaaguuuugguucuuuuuuccu

SEQ ID NO: 1077617 - RNA, 20 nt, Human
uggaaugcucagaauaagau

SEQ ID NO: 1077618 - RNA, 24 nt, Human
uguaaauaaaaaauacaaacaaau

SEQ ID NO: 1077619 - RNA, 25 nt, Human
uuguuggacaacauuguuucacaca

SEQ ID NO: 1077620 - RNA, 22 nt, Human
uuuagauucugagacgggaagu

SEQ ID NO: 1077621 - RNA, 23 nt, Human
uuugguucuuuuuuccuccccug

SEQ ID NO: 1077622 - RNA, 20 nt, Human
aaaacacagguaaaggugcc

SEQ ID NO: 1077623 - RNA, 24 nt, Human
aaaacacagguaaaggugccacca

SEQ ID NO: 1077624 - RNA, 20 nt, Human
aaccuggccugguuugugca

SEQ ID NO: 1077625 - RNA, 20 nt, Human
aagcacaggagggaggcuga

SEQ ID NO: 1077626 - RNA, 20 nt, Human
aaggugccaccagccagagg

SEQ ID NO: 1077627 - RNA, 25 nt, Human
accuugcucaccuucuacuugucca

SEQ ID NO: 1077628 - RNA, 21 nt, Human
acguugggaugaccugccugc

SEQ ID NO: 1077629 - RNA, 22 nt, Human
agaagagagaaggagagaagag

SEQ ID NO: 1077630 - RNA, 18 nt, Human
agccaggaauggguggga

SEQ ID NO: 1077631 - RNA, 24 nt, Human
agccaggaaugggugggagaccug

SEQ ID NO: 1077632 - RNA, 20 nt, Human
agccccgcccucccaggcaa

SEQ ID NO: 1077633 - RNA, 26 nt, Human
aggcaagaagaagagaagagggaccc

SEQ ID NO: 1077634 - RNA, 22 nt, Human
aggcagaaaagugacaccucag

SEQ ID NO: 1077635 - RNA, 22 nt, Human
agugcugagguacaaggaagga

SEQ ID NO: 1077636 - RNA, 22 nt, Human
aguggggaggaguggcuggggc

SEQ ID NO: 1077637 - RNA, 23 nt, Human
aguggggaggaguggcuggggcu

SEQ ID NO: 1077638 - RNA, 23 nt, Human
augauggcagcaguggcccacgu

SEQ ID NO: 1077639 - RNA, 21 nt, Human
caaaacacagguaaaggugcc

SEQ ID NO: 1077640 - RNA, 21 nt, Human
caaacccaggcaucucugcac

SEQ ID NO: 1077641 - RNA, 18 nt, Human
cacaggagggaggcugag

SEQ ID NO: 1077642 - RNA, 19 nt, Human
caccucggcccccuccaga

SEQ ID NO: 1077643 - RNA, 20 nt, Human
caccuugcucaccuucuacu

SEQ ID NO: 1077644 - RNA, 27 nt, Human
cagcaagccccccugucccgcaggcuc

SEQ ID NO: 1077645 - RNA, 18 nt, Human
cagccagagguuucaggc

SEQ ID NO: 1077646 - RNA, 24 nt, Human
cagccagagguuucaggcagaaaa

SEQ ID NO: 1077647 - RNA, 18 nt, Human
cagcccccugccaccucg

SEQ ID NO: 1077648 - RNA, 18 nt, Human
cagcccccugccaccucg

SEQ ID NO: 1077649 - RNA, 22 nt, Human
cagcccccugccaccucggccc

SEQ ID NO: 1077650 - RNA, 20 nt, Human
caggcaucucugcacucucu

SEQ ID NO: 1077651 - RNA, 21 nt, Human
caguggggaggaguggcuggg

SEQ ID NO: 1077652 - RNA, 19 nt, Human
caugccagcccccugccac

SEQ ID NO: 1077653 - RNA, 21 nt, Human
ccaaaccugggcacagucaca

SEQ ID NO: 1077654 - RNA, 18 nt, Human
ccagagugcugagguaca

SEQ ID NO: 1077655 - RNA, 19 nt, Human
ccaggcaucucugcacucu

SEQ ID NO: 1077656 - RNA, 20 nt, Human
cccaggcacagcugcagcca

SEQ ID NO: 1077657 - RNA, 20 nt, Human
cccccugccaccucggcccc

SEQ ID NO: 1077658 - RNA, 21 nt, Human
ccccugccaccucggcccccu

SEQ ID NO: 1077659 - RNA, 22 nt, Human
cccgcccucccaggcacagcug

SEQ ID NO: 1077660 - RNA, 22 nt, Human
ccgugcgucuccucucagcugc

SEQ ID NO: 1077661 - RNA, 22 nt, Human
ccucagagcuggugggagccag

SEQ ID NO: 1077662 - RNA, 23 nt, Human
ccucagagcuggugggagccagg

SEQ ID NO: 1077663 - RNA, 19 nt, Human
ccucaggauucuguaacac

SEQ ID NO: 1077664 - RNA, 22 nt, Human
ccugcagaaaggagcuacccac

SEQ ID NO: 1077665 - RNA, 24 nt, Human
ccugccaccucggcccccuccaga

SEQ ID NO: 1077666 - RNA, 22 nt, Human
ccuuugaucucucggagcagcu

SEQ ID NO: 1077667 - RNA, 20 nt, Human
cgcaggcucaguuguaccug

SEQ ID NO: 1077668 - RNA, 18 nt, Human
cgccugggcacuaugggc

SEQ ID NO: 1077669 - RNA, 21 nt, Human
cguugggaugaccugccugca

SEQ ID NO: 1077670 - RNA, 24 nt, Human
cucagaggcccagcaagccccccu

SEQ ID NO: 1077671 - RNA, 19 nt, Human
cucaggacaagaacucagg

SEQ ID NO: 1077672 - RNA, 23 nt, Human
cugcaguggggaggaguggcugg

SEQ ID NO: 1077673 - RNA, 19 nt, Human
cugguuugugcaagcucag

SEQ ID NO: 1077674 - RNA, 22 nt, Human
cuucuacuuguccacauaccuc

SEQ ID NO: 1077675 - RNA, 21 nt, Human
gaaccugaaaggacccauuua

SEQ ID NO: 1077676 - RNA, 25 nt, Human
gagcccacuccaaauucagauccaa

SEQ ID NO: 1077677 - RNA, 24 nt, Human
gcaaaacacagguaaaggugccac

SEQ ID NO: 1077678 - RNA, 21 nt, Human
gcaaacccaggcaucucugca

SEQ ID NO: 1077679 - RNA, 23 nt, Human
gcaagccccccugucccgcaggc

SEQ ID NO: 1077680 - RNA, 23 nt, Human
gcucaauaaagcaccucuucacc

SEQ ID NO: 1077681 - RNA, 24 nt, Human
gcugagguacaaggaaggaaccug

SEQ ID NO: 1077682 - RNA, 20 nt, Human
ggacucaggacaagaacuca

SEQ ID NO: 1077683 - RNA, 24 nt, Human
ggcugcaguggggaggaguggcug

SEQ ID NO: 1077684 - RNA, 21 nt, Human
gggcacagcuacccaccgugc

SEQ ID NO: 1077685 - RNA, 18 nt, Human
guggagcaguugcuaugg

SEQ ID NO: 1077686 - RNA, 19 nt, Human
gugggagccaggaaugggg

SEQ ID NO: 1077687 - RNA, 18 nt, Human
uaacauaaacagggcuga

SEQ ID NO: 1077688 - RNA, 22 nt, Human
uaacccagugggcccgagcaag

SEQ ID NO: 1077689 - RNA, 22 nt, Human
uaccugguccugcccccuggca

SEQ ID NO: 1077690 - RNA, 24 nt, Human
uaucaggcaggagccccgcccucc

SEQ ID NO: 1077691 - RNA, 25 nt, Human
uccaaguugaggccaaaccgggguc

SEQ ID NO: 1077692 - RNA, 23 nt, Human
uccuggacucaggacaagaacuc

SEQ ID NO: 1077693 - RNA, 25 nt, Human
ucuauaaaucuuccaccaugugucu

SEQ ID NO: 1077694 - RNA, 21 nt, Human
ucucagaggcccagcaagccc

SEQ ID NO: 1077695 - RNA, 23 nt, Human
ucucugcuuccagagcccacucc

SEQ ID NO: 1077696 - RNA, 18 nt, Human
ucugcugugauucugggg

SEQ ID NO: 1077697 - RNA, 21 nt, Human
ugaaaggacccauuuaugaug

SEQ ID NO: 1077698 - RNA, 18 nt, Human
ugacaagcacaggaggga

SEQ ID NO: 1077699 - RNA, 19 nt, Human
ugagcaguguugcuaaggc

SEQ ID NO: 1077700 - RNA, 25 nt, Human
ugagguacaaggaaggaaccugaaa

SEQ ID NO: 1077701 - RNA, 18 nt, Human
ugcacucucagaggccca

SEQ ID NO: 1077702 - RNA, 23 nt, Human
ugcaguggggaggaguggcuggg

SEQ ID NO: 1077703 - RNA, 20 nt, Human
ugccaccucggcccccucca

SEQ ID NO: 1077704 - RNA, 24 nt, Human
ugcuaaggcuucuaaugaccccca

SEQ ID NO: 1077705 - RNA, 25 nt, Human
ugcucaccuucuacuuguccacaua

SEQ ID NO: 1077706 - RNA, 20 nt, Human
uggacagaacuaacccagug

SEQ ID NO: 1077707 - RNA, 18 nt, Human
uggagacacuggcugcag

SEQ ID NO: 1077708 - RNA, 21 nt, Human
uggccggaaggcccuccucag

SEQ ID NO: 1077709 - RNA, 19 nt, Human
uggcugcaguggggaggag

SEQ ID NO: 1077710 - RNA, 25 nt, Human
uggcugcaguggggaggaguggcug

SEQ ID NO: 1077711 - RNA, 19 nt, Human
uggcuggggcugugcacuc

SEQ ID NO: 1077712 - RNA, 20 nt, Human
uggcuggggcugugcacucc

SEQ ID NO: 1077713 - RNA, 19 nt, Human
ugggaugaccugccugcag

SEQ ID NO: 1077714 - RNA, 21 nt, Human
ugggcacagucacaaccuggc

SEQ ID NO: 1077715 - RNA, 19 nt, Human
ugggcccgagcaaaacaca

SEQ ID NO: 1077716 - RNA, 19 nt, Human
ugugauucugggggcugcc

SEQ ID NO: 1077717 - RNA, 23 nt, Human
uguggugagcaguguugcuaagg

SEQ ID NO: 1077718 - RNA, 19 nt, Human
uucaggcagaaaagugaca

SEQ ID NO: 1077719 - RNA, 19 nt, Human
uucuacuuguccacauacc

SEQ ID NO: 1077720 - RNA, 19 nt, Human
uucuugccaaauugcaggc

SEQ ID NO: 1077721 - RNA, 23 nt, Human
uugcucaauuaagcuccuuuaaa

SEQ ID NO: 1077722 - RNA, 22 nt, Human
uuuaugauggcagcaguggccc

SEQ ID NO: 1077723 - RNA, 19 nt, Human
aagccccaggccugcucag

SEQ ID NO: 1077724 - RNA, 19 nt, Human
agccccaggccugcucagc

SEQ ID NO: 1077725 - RNA, 24 nt, Human
aggauggcccaucuaugccuguag

SEQ ID NO: 1077726 - RNA, 19 nt, Human
aggcccccgacccaugacc

SEQ ID NO: 1077727 - RNA, 22 nt, Human
aggcccccgacccaugaccugc

SEQ ID NO: 1077728 - RNA, 27 nt, Human
aggcccccgacccaugaccugcccagg

SEQ ID NO: 1077729 - RNA, 18 nt, Human
agggaaacaaaaggaugg

SEQ ID NO: 1077730 - RNA, 19 nt, Human
agggacauagaaccaagcc

SEQ ID NO: 1077731 - RNA, 22 nt, Human
auuaacaagggaaacaaaagga

SEQ ID NO: 1077732 - RNA, 23 nt, Human
auuggagaaggucgcagcgagga

SEQ ID NO: 1077733 - RNA, 19 nt, Human
caagccccaggccugcuca

SEQ ID NO: 1077734 - RNA, 23 nt, Human
caagggaaacaaaaggauggccc

SEQ ID NO: 1077735 - RNA, 24 nt, Human
cagcagggaauggcccucccuggc

SEQ ID NO: 1077736 - RNA, 19 nt, Human
cccaugaccugcccagugu

SEQ ID NO: 1077737 - RNA, 20 nt, Human
cccccgacccaugaccugcc

SEQ ID NO: 1077738 - RNA, 22 nt, Human
ccgcaaagucuccuucccaucu

SEQ ID NO: 1077739 - RNA, 23 nt, Human
ccgcaaagucuccuucccaucuc

SEQ ID NO: 1077740 - RNA, 20 nt, Human
ccuggcacugggaggccccc

SEQ ID NO: 1077741 - RNA, 20 nt, Human
ccugggaagaugagguagca

SEQ ID NO: 1077742 - RNA, 21 nt, Human
cucccuggccucucuggcccc

SEQ ID NO: 1077743 - RNA, 24 nt, Human
cucccuggccucucuggggagagu

SEQ ID NO: 1077744 - RNA, 23 nt, Human
gcagcagggaauggcccucccug

SEQ ID NO: 1077745 - RNA, 21 nt, Human
gccgcaaagucuccuucccau

SEQ ID NO: 1077746 - RNA, 20 nt, Human
ggaaacaaaaggauggccca

SEQ ID NO: 1077747 - RNA, 18 nt, Human
ggcacaggucccuggcac

SEQ ID NO: 1077748 - RNA, 23 nt, Human
ggcagcagggaauggcccucccu

SEQ ID NO: 1077749 - RNA, 20 nt, Human
guguugcguguggccgcaaa

SEQ ID NO: 1077750 - RNA, 19 nt, Human
uaacaagggaaacaaaagg

SEQ ID NO: 1077751 - RNA, 23 nt, Human
uagaaccaagccccaggccugcu

SEQ ID NO: 1077752 - RNA, 23 nt, Human
ucccuggcacugggaggcccccg

SEQ ID NO: 1077753 - RNA, 25 nt, Human
uccugggaagaugagguagcagagg

SEQ ID NO: 1077754 - RNA, 23 nt, Human
ucuguguguuuaaggcgugcuug

SEQ ID NO: 1077755 - RNA, 23 nt, Human
ugaccugcccagugucaugucua

SEQ ID NO: 1077756 - RNA, 21 nt, Human
ugccuguagcccaggcguagg

SEQ ID NO: 1077757 - RNA, 18 nt, Human
ugggaagaugagguagca

SEQ ID NO: 1077758 - RNA, 20 nt, Human
aaacagagcaagacagacaa

SEQ ID NO: 1077759 - RNA, 27 nt, Human
aaaguugugucuuugauagguucguaa

SEQ ID NO: 1077760 - RNA, 20 nt, Human
aaaugccuuugcucaauuuc

SEQ ID NO: 1077761 - RNA, 28 nt, Human
aagaaaaaacaauuuaaaacgcugaaga

SEQ ID NO: 1077762 - RNA, 26 nt, Human
aagaaagaaaaaacaauuuaaaacgc

SEQ ID NO: 1077763 - RNA, 24 nt, Human
aagacagacaaccuacagcagcug

SEQ ID NO: 1077764 - RNA, 18 nt, Human
aagcugaaaguugagucu

SEQ ID NO: 1077765 - RNA, 22 nt, Human
aagucaugucuucuugaacuaa

SEQ ID NO: 1077766 - RNA, 23 nt, Human
aaucuugaacucacgacuuacua

SEQ ID NO: 1077767 - RNA, 27 nt, Human
acagaaaaaaguauguaaaagacacca

SEQ ID NO: 1077768 - RNA, 25 nt, Human
agaacagaaaaaaguauguaaaaga

SEQ ID NO: 1077769 - RNA, 21 nt, Human
agacagacaaccuacagcagc

SEQ ID NO: 1077770 - RNA, 18 nt, Human
aggagaaaacauaucagg

SEQ ID NO: 1077771 - RNA, 20 nt, Human
aggagaaaacauaucaggaa

SEQ ID NO: 1077772 - RNA, 20 nt, Human
aggagauguggggauucagu

SEQ ID NO: 1077773 - RNA, 18 nt, Human
aguauguaaaagacacca

SEQ ID NO: 1077774 - RNA, 20 nt, Human
caaccuuaaaaacccaaaca

SEQ ID NO: 1077775 - RNA, 20 nt, Human
caagacagacaaccuacagc

SEQ ID NO: 1077776 - RNA, 23 nt, Human
caagacagacaaccuacagcagc

SEQ ID NO: 1077777 - RNA, 25 nt, Human
cagaaaaagcugaaaguugagucug

SEQ ID NO: 1077778 - RNA, 18 nt, Human
caggcaaagaaugcaaag

SEQ ID NO: 1077779 - RNA, 23 nt, Human
cauuuuugcucaaaaauucuuua

SEQ ID NO: 1077780 - RNA, 22 nt, Human
cccacagccucaucucgacucc

SEQ ID NO: 1077781 - RNA, 26 nt, Human
cccucccucacguguaaaaucauccc

SEQ ID NO: 1077782 - RNA, 21 nt, Human
ccugcaggcaaagaaugcaaa

SEQ ID NO: 1077783 - RNA, 20 nt, Human
ccuggagacgcuccaaccuu

SEQ ID NO: 1077784 - RNA, 20 nt, Human
cgcuccaaccuuaaaaaccc

SEQ ID NO: 1077785 - RNA, 21 nt, Human
cuagaaccggcccgaggucac

SEQ ID NO: 1077786 - RNA, 25 nt, Human
cucccuuuacagaaaaagcugaaag

SEQ ID NO: 1077787 - RNA, 18 nt, Human
cuuacuaggaagaaagaa

SEQ ID NO: 1077788 - RNA, 20 nt, Human
cuugaacucacgacuuacua

SEQ ID NO: 1077789 - RNA, 21 nt, Human
gaaaguugagucugagcacag

SEQ ID NO: 1077790 - RNA, 22 nt, Human
gaagcaaacagaggagaaaaca

SEQ ID NO: 1077791 - RNA, 25 nt, Human
gacauuagaagcaaacagaggagaa

SEQ ID NO: 1077792 - RNA, 21 nt, Human
gcagacacaccugguaucuca

SEQ ID NO: 1077793 - RNA, 18 nt, Human
gcccacagccucaucucg

SEQ ID NO: 1077794 - RNA, 23 nt, Human
gggauucaguguggagucagcac

SEQ ID NO: 1077795 - RNA, 23 nt, Human
guaaaaucaucccgaaggcucac

SEQ ID NO: 1077796 - RNA, 24 nt, Human
uaaaaucaucccgaaggcucacaa

SEQ ID NO: 1077797 - RNA, 24 nt, Human
uacuaggaagaaagaaaaaacaau

SEQ ID NO: 1077798 - RNA, 22 nt, Human
uaucaggaagugcauaggcuuc

SEQ ID NO: 1077799 - RNA, 18 nt, Human
uaugugaauguauaugua

SEQ ID NO: 1077800 - RNA, 22 nt, Human
uaugugaauguauauguaaagu

SEQ ID NO: 1077801 - RNA, 21 nt, Human
uauuuccagaacagaaaaaag

SEQ ID NO: 1077802 - RNA, 19 nt, Human
ucacaagggggugaaaugu

SEQ ID NO: 1077803 - RNA, 23 nt, Human
ucagaguguguuucugauaaugc

SEQ ID NO: 1077804 - RNA, 21 nt, Human
ucauccggagacauuagaagc

SEQ ID NO: 1077805 - RNA, 18 nt, Human
uccaaccuuaaaaaccca

SEQ ID NO: 1077806 - RNA, 24 nt, Human
uccaaguuaauucucugauguuuu

SEQ ID NO: 1077807 - RNA, 28 nt, Human
uccagaacagaaaaaaguauguaaaaga

SEQ ID NO: 1077808 - RNA, 19 nt, Human
ugaaaaacauugaggaaac

SEQ ID NO: 1077809 - RNA, 18 nt, Human
ugaaaauguuguaguguu

SEQ ID NO: 1077810 - RNA, 23 nt, Human
ugagcacagucuuauuuaaacaa

SEQ ID NO: 1077811 - RNA, 19 nt, Human
ugaggaaacgaaccugagu

SEQ ID NO: 1077812 - RNA, 22 nt, Human
ugauucaugacauucggugccc

SEQ ID NO: 1077813 - RNA, 18 nt, Human
ugcaaagcaaggagauga

SEQ ID NO: 1077814 - RNA, 22 nt, Human
ugcauacaagcacgcucauaug

SEQ ID NO: 1077815 - RNA, 24 nt, Human
ugcauacaagcacgcucauaugua

SEQ ID NO: 1077816 - RNA, 18 nt, Human
ugccaccugcaggccagg

SEQ ID NO: 1077817 - RNA, 21 nt, Human
ugccaugcaggagaugugggg

SEQ ID NO: 1077818 - RNA, 23 nt, Human
ugcccacagccucaucucgacuc

SEQ ID NO: 1077819 - RNA, 20 nt, Human
ugcuggggauugaagucaug

SEQ ID NO: 1077820 - RNA, 21 nt, Human
ugcuggggauugaagucaugu

SEQ ID NO: 1077821 - RNA, 18 nt, Human
ugggcuucuagaaccggc

SEQ ID NO: 1077822 - RNA, 26 nt, Human
uguccugcaggcaaagaaugcaaagc

SEQ ID NO: 1077823 - RNA, 22 nt, Human
uguggagucagcacaugcccug

SEQ ID NO: 1077824 - RNA, 19 nt, Human
uuacuaggaagaaagaaaa

SEQ ID NO: 1077825 - RNA, 28 nt, Human
uucaccaaggucuucccauguuuuccaa

SEQ ID NO: 1077826 - RNA, 23 nt, Human
uuuccaaguuaauucucugaugu

SEQ ID NO: 1077827 - RNA, 24 nt, Human
uuuuuuuuuuuuuuuuugauacug

SEQ ID NO: 1077828 - RNA, 23 nt, Human
aaaacaaacagcgagaacccaga

SEQ ID NO: 1077829 - RNA, 18 nt, Human
aaaagcaacuucagaaca

SEQ ID NO: 1077830 - RNA, 19 nt, Human
aaacaaacagcgagaaccc

SEQ ID NO: 1077831 - RNA, 23 nt, Human
aaacaaacagcgagaacccagag

SEQ ID NO: 1077832 - RNA, 24 nt, Human
aaacaaacagcgagaacccagagc

SEQ ID NO: 1077833 - RNA, 21 nt, Human
aaaggaacuguugacuuugag

SEQ ID NO: 1077834 - RNA, 23 nt, Human
aacaaacagcgagaacccagagc

SEQ ID NO: 1077835 - RNA, 24 nt, Human
aagcaaaaagaaggugaaauuuca

SEQ ID NO: 1077836 - RNA, 21 nt, Human
acaaaagcaacuucagaacag

SEQ ID NO: 1077837 - RNA, 24 nt, Human
acacaaguccaagggcagccgagg

SEQ ID NO: 1077838 - RNA, 23 nt, Human
acauuuuuagaaagcaaaaagaa

SEQ ID NO: 1077839 - RNA, 25 nt, Human
accccggacaacacaaguccaaggg

SEQ ID NO: 1077840 - RNA, 23 nt, Human
acugaauuuauugaaaacaugcu

SEQ ID NO: 1077841 - RNA, 21 nt, Human
aggucucacacugcccagcag

SEQ ID NO: 1077842 - RNA, 22 nt, Human
aguggccaccaccccggacaac

SEQ ID NO: 1077843 - RNA, 30 nt, Human
auaaaauguccucauucuccauuuucugcu

SEQ ID NO: 1077844 - RNA, 20 nt, Human
aucaucaaaaggcaaaauau

SEQ ID NO: 1077845 - RNA, 23 nt, Human
aucccccccccccccacccccaa

SEQ ID NO: 1077846 - RNA, 20 nt, Human
augcugaaaacaaacagcga

SEQ ID NO: 1077847 - RNA, 22 nt, Human
caaaaagaaggugaaauuucaa

SEQ ID NO: 1077848 - RNA, 18 nt, Human
caaaagcaacuucagaac

SEQ ID NO: 1077849 - RNA, 23 nt, Human
caaacagcgagaacccagagcac

SEQ ID NO: 1077850 - RNA, 19 nt, Human
caagagccaccuugguguu

SEQ ID NO: 1077851 - RNA, 23 nt, Human
caagagccaccuugguguucagc

SEQ ID NO: 1077852 - RNA, 21 nt, Human
caagauaaaugcauaaaauua

SEQ ID NO: 1077853 - RNA, 28 nt, Human
caagguguaauaucccccccccccccaa

SEQ ID NO: 1077854 - RNA, 22 nt, Human
caaguccaagggcagccgagga

SEQ ID NO: 1077855 - RNA, 22 nt, Human
cacugcccagcaggaagauaac

SEQ ID NO: 1077856 - RNA, 18 nt, Human
cacuguggagaugcaagg

SEQ ID NO: 1077857 - RNA, 21 nt, Human
cacuugcuaucaucaaaaggc

SEQ ID NO: 1077858 - RNA, 19 nt, Human
cagaacagcucugagccgg

SEQ ID NO: 1077859 - RNA, 18 nt, Human
cagcacgccucaccacag

SEQ ID NO: 1077860 - RNA, 26 nt, Human
cagcaggaagauaacacacaaauagc

SEQ ID NO: 1077861 - RNA, 20 nt, Human
cagcucugagccggccuccc

SEQ ID NO: 1077862 - RNA, 19 nt, Human
ccaguggccaccaccccgg

SEQ ID NO: 1077863 - RNA, 21 nt, Human
cccaaccugccccauugaaag

SEQ ID NO: 1077864 - RNA, 24 nt, Human
ccccccacccccaaccugccccau

SEQ ID NO: 1077865 - RNA, 19 nt, Human
ccccccccacccccaaccu

SEQ ID NO: 1077866 - RNA, 22 nt, Human
ccccccccacccccaaccugcc

SEQ ID NO: 1077867 - RNA, 19 nt, Human
cccccccccacccccaacc

SEQ ID NO: 1077868 - RNA, 24 nt, Human
cccccccccacccccaaccugccc

SEQ ID NO: 1077869 - RNA, 23 nt, Human
ccccccccccccacccccaaccu

SEQ ID NO: 1077870 - RNA, 22 nt, Human
cccggacaacacaaguccaagg

SEQ ID NO: 1077871 - RNA, 31 nt, Human
ccucaccacagaggggcccugcucucccugg

SEQ ID NO: 1077872 - RNA, 20 nt, Human
ccucagcagccucaggcagg

SEQ ID NO: 1077873 - RNA, 24 nt, Human
ccucaggcaggagccugcuccgaa

SEQ ID NO: 1077874 - RNA, 20 nt, Human
ccucauucuccauuuucugc

SEQ ID NO: 1077875 - RNA, 18 nt, Human
ccugugagucuguugcau

SEQ ID NO: 1077876 - RNA, 22 nt, Human
cuccgaaggugcaggagaaaag

SEQ ID NO: 1077877 - RNA, 22 nt, Human
cuugcuaucaucaaaaggcaaa

SEQ ID NO: 1077878 - RNA, 24 nt, Human
cuuuuaugauaaaaacaaaauuuu

SEQ ID NO: 1077879 - RNA, 22 nt, Human
gaaaacaaacagcgagaaccca

SEQ ID NO: 1077880 - RNA, 22 nt, Human
gaaaaggagcuuugagaauagu

SEQ ID NO: 1077881 - RNA, 20 nt, Human
gaaagaaaaugaaucgagaa

SEQ ID NO: 1077882 - RNA, 21 nt, Human
gaacccagagcaccucagcag

SEQ ID NO: 1077883 - RNA, 25 nt, Human
gaaguccugccaccaagagccaccu

SEQ ID NO: 1077884 - RNA, 18 nt, Human
gagcaaucucuuuucacu

SEQ ID NO: 1077885 - RNA, 25 nt, Human
gcugaaaacaaacagcgagaaccca

SEQ ID NO: 1077886 - RNA, 21 nt, Human
ggaaagaaaaugaaucgagaa

SEQ ID NO: 1077887 - RNA, 27 nt, Human
ggcccugcucucccugcucaguagcca

SEQ ID NO: 1077888 - RNA, 21 nt, Human
guuguugaauuucuauaagga

SEQ ID NO: 1077889 - RNA, 25 nt, Human
uaaaaacaaaauuuuaauuguauuc

SEQ ID NO: 1077890 - RNA, 25 nt, Human
uacacugagcagcacgccucaccac

SEQ ID NO: 1077891 - RNA, 25 nt, Human
uacacugagcagcacgccuuccuug

SEQ ID NO: 1077892 - RNA, 18 nt, Human
uagaaagcaaaaagaagg

SEQ ID NO: 1077893 - RNA, 23 nt, Human
uagaaagcaaaaagaaggugaaa

SEQ ID NO: 1077894 - RNA, 19 nt, Human
uccaagggcagccgaggaa

SEQ ID NO: 1077895 - RNA, 19 nt, Human
ucccccccccccccacccc

SEQ ID NO: 1077896 - RNA, 22 nt, Human
ucccccccccccccacccccaa

SEQ ID NO: 1077897 - RNA, 30 nt, Human
ucccuaagcuaguaaccuuccagcuauguu

SEQ ID NO: 1077898 - RNA, 24 nt, Human
ucgagaaguaaaauacaaggugua

SEQ ID NO: 1077899 - RNA, 22 nt, Human
ugaaaacaugcuuggagcaauc

SEQ ID NO: 1077900 - RNA, 23 nt, Human
ugagaaaagccugaaccuggaug

SEQ ID NO: 1077901 - RNA, 22 nt, Human
ugagaauagauuguguuacaaa

SEQ ID NO: 1077902 - RNA, 21 nt, Human
ugcagaauuuuuguguugcag

SEQ ID NO: 1077903 - RNA, 21 nt, Human
ugcgugugugugugugugugu

SEQ ID NO: 1077904 - RNA, 25 nt, Human
ugcgugugugugugugugugugugg

SEQ ID NO: 1077905 - RNA, 22 nt, Human
uggccaccaccccggacaacac

SEQ ID NO: 1077906 - RNA, 19 nt, Human
ugugugugugcaagugugc

SEQ ID NO: 1077907 - RNA, 21 nt, Human
ugugugugugugugugcaagu

SEQ ID NO: 1077908 - RNA, 22 nt, Human
ugugugugugugugugcaagug

SEQ ID NO: 1077909 - RNA, 23 nt, Human
ugugugugugugugugcaagugu

SEQ ID NO: 1077910 - RNA, 18 nt, Human
ugugugugugugugugug

SEQ ID NO: 1077911 - RNA, 18 nt, Human
ugugugugugugugugug

SEQ ID NO: 1077912 - RNA, 21 nt, Human
ugugugugugugugugugugu

SEQ ID NO: 1077913 - RNA, 22 nt, Human
ugugugugugugugugugugug

SEQ ID NO: 1077914 - RNA, 27 nt, Human
uucuccaccauuuuugcuuuuccuuug

SEQ ID NO: 1077915 - RNA, 21 nt, Human
uugaaaacaugcuuggagcaa

SEQ ID NO: 1077916 - RNA, 23 nt, Human
uuuuacacugagcagcacgccuc

SEQ ID NO: 1077917 - RNA, 22 nt, Human
uuuucugcuauaguuguugaau

SEQ ID NO: 1077918 - RNA, 21 nt, Human
uuuugcuuuuccuuugacauu

SEQ ID NO: 1077919 - RNA, 22 nt, Human
acucaggugggucacaagccag

SEQ ID NO: 1077920 - RNA, 24 nt, Human
aggcuuugcggcacagaccggccu

SEQ ID NO: 1077921 - RNA, 22 nt, Human
aggugggucacaagccagggga

SEQ ID NO: 1077922 - RNA, 20 nt, Human
cccacgccacggccuccaca

SEQ ID NO: 1077923 - RNA, 22 nt, Human
cccucccaggccagcccuacaa

SEQ ID NO: 1077924 - RNA, 23 nt, Human
ccggugugucuugaacaagccug

SEQ ID NO: 1077925 - RNA, 18 nt, Human
ccucugcggaccagggau

SEQ ID NO: 1077926 - RNA, 19 nt, Human
cgccacggccuccacacag

SEQ ID NO: 1077927 - RNA, 18 nt, Human
cgcccaggcuuugcggca

SEQ ID NO: 1077928 - RNA, 22 nt, Human
cuguggccauggccgucgccuc

SEQ ID NO: 1077929 - RNA, 20 nt, Human
gcccacgccacggccuccac

SEQ ID NO: 1077930 - RNA, 18 nt, Human
ggagggacaggcgcagag

SEQ ID NO: 1077931 - RNA, 19 nt, Human
ggcucucgaggaacagccc

SEQ ID NO: 1077932 - RNA, 24 nt, Human
gggaugcccucccaggccagcccu

SEQ ID NO: 1077933 - RNA, 27 nt, Human
gucacaagccaggggacugagaucgcc

SEQ ID NO: 1077934 - RNA, 18 nt, Human
guuguggggaagaauaac

SEQ ID NO: 1077935 - RNA, 20 nt, Human
uaaaucuccaacagucaaac

SEQ ID NO: 1077936 - RNA, 18 nt, Human
uccaggucucuugcacag

SEQ ID NO: 1077937 - RNA, 23 nt, Human
ucccaggccagcccuacaagcac

SEQ ID NO: 1077938 - RNA, 23 nt, Human
ucuugcacaggauaaaucuccaa

SEQ ID NO: 1077939 - RNA, 21 nt, Human
ugcccucccaggccagcccua

SEQ ID NO: 1077940 - RNA, 22 nt, Human
uugcuuccaggucucuugcaca

SEQ ID NO: 1077941 - RNA, 20 nt, Human
uuuuggccucauugggccgu

SEQ ID NO: 1077942 - RNA, 20 nt, Human
uuuuuggccucauugggccg

SEQ ID NO: 1077943 - RNA, 19 nt, Human
agacuugccuggcucuccc

SEQ ID NO: 1077944 - RNA, 24 nt, Human
caaauuuugcuuucaauuuccuca

SEQ ID NO: 1077945 - RNA, 22 nt, Human
cagccacuaaaaguucacacug

SEQ ID NO: 1077946 - RNA, 25 nt, Human
caguaggaauggaauuuucaguaua

SEQ ID NO: 1077947 - RNA, 23 nt, Human
cccagcaaggguccugcaggcug

SEQ ID NO: 1077948 - RNA, 26 nt, Human
ccgcugccgccgccgcccugccgccg

SEQ ID NO: 1077949 - RNA, 21 nt, Human
ccucagccuuuaggcuuucag

SEQ ID NO: 1077950 - RNA, 20 nt, Human
cgccgcugccgccgccgccc

SEQ ID NO: 1077951 - RNA, 21 nt, Human
cgccgcugccgccgccgcccu

SEQ ID NO: 1077952 - RNA, 25 nt, Human
cgccgcugccgccgccgcccugccg

SEQ ID NO: 1077953 - RNA, 23 nt, Human
cuaccugggcgcggggaagggag

SEQ ID NO: 1077954 - RNA, 23 nt, Human
cugcgccgcugccgccgccgccc

SEQ ID NO: 1077955 - RNA, 19 nt, Human
cuuaacaauagguacccag

SEQ ID NO: 1077956 - RNA, 19 nt, Human
cuuucaguccuuuuucgcu

SEQ ID NO: 1077957 - RNA, 19 nt, Human
gcagccacuaaaaguucac

SEQ ID NO: 1077958 - RNA, 19 nt, Human
gcccuaccugggcgcgggg

SEQ ID NO: 1077959 - RNA, 22 nt, Human
gggcucccugcagcuugcagcc

SEQ ID NO: 1077960 - RNA, 21 nt, Human
gugcaaauuuugcuuucaauu

SEQ ID NO: 1077961 - RNA, 21 nt, Human
uaccugggcgcggggaaggga

SEQ ID NO: 1077962 - RNA, 19 nt, Human
uccacaguaggaauggaau

SEQ ID NO: 1077963 - RNA, 23 nt, Human
uccucaguccccagcaagggucc

SEQ ID NO: 1077964 - RNA, 23 nt, Human
ugagacuugccuggcucucccaa

SEQ ID NO: 1077965 - RNA, 23 nt, Human
ugccuggcucucccaagucugcu

SEQ ID NO: 1077966 - RNA, 24 nt, Human
uggaagaagcugugaggaaagguc

SEQ ID NO: 1077967 - RNA, 19 nt, Human
aaacagaaagcgggagcug

SEQ ID NO: 1077968 - RNA, 22 nt, Human
aacugaguaaauaucuaaauau

SEQ ID NO: 1077969 - RNA, 26 nt, Human
aagccaccccccacguuuucaacuga

SEQ ID NO: 1077970 - RNA, 24 nt, Human
aagcccauuucagaggcuuccuag

SEQ ID NO: 1077971 - RNA, 22 nt, Human
aaggacaguuccugaggcugga

SEQ ID NO: 1077972 - RNA, 20 nt, Human
agauuucuguaaaacaguuu

SEQ ID NO: 1077973 - RNA, 21 nt, Human
aggcugcaguccucgcccggu

SEQ ID NO: 1077974 - RNA, 23 nt, Human
auaaagcccagacaugcaacuug

SEQ ID NO: 1077975 - RNA, 26 nt, Human
auccuggguucgaagucuuugggauu

SEQ ID NO: 1077976 - RNA, 19 nt, Human
caacuguaagucaaaagcc

SEQ ID NO: 1077977 - RNA, 20 nt, Human
caacuguaagucaaaagccc

SEQ ID NO: 1077978 - RNA, 23 nt, Human
cacaauuaauacacugaaauaaa

SEQ ID NO: 1077979 - RNA, 18 nt, Human
caccggcccaaguacuac

SEQ ID NO: 1077980 - RNA, 20 nt, Human
caggggagccuuuugaaaug

SEQ ID NO: 1077981 - RNA, 21 nt, Human
caggggagccuuuugaaaugu

SEQ ID NO: 1077982 - RNA, 27 nt, Human
caugcaacuuguuacauccaucaccau

SEQ ID NO: 1077983 - RNA, 22 nt, Human
ccacauuguuugagguuccagg

SEQ ID NO: 1077984 - RNA, 18 nt, Human
ccuggguucgaagucuuu

SEQ ID NO: 1077985 - RNA, 19 nt, Human
cgacagggugcgucucagg

SEQ ID NO: 1077986 - RNA, 18 nt, Human
cuccccaggucuccggcg

SEQ ID NO: 1077987 - RNA, 20 nt, Human
cugaaauaaagcccagacau

SEQ ID NO: 1077988 - RNA, 21 nt, Human
gaccacgaagccaccccccac

SEQ ID NO: 1077989 - RNA, 23 nt, Human
gcccaaguacuacccccucccca

SEQ ID NO: 1077990 - RNA, 20 nt, Human
gcugcaguccucgcccgguu

SEQ ID NO: 1077991 - RNA, 19 nt, Human
ggcggcggcggcguucgug

SEQ ID NO: 1077992 - RNA, 20 nt, Human
gggagcuggcaguuccucuc

SEQ ID NO: 1077993 - RNA, 18 nt, Human
guuuucaacugaguaaau

SEQ ID NO: 1077994 - RNA, 30 nt, Human
uaauacacugaaauaaagcccagacaugcc

SEQ ID NO: 1077995 - RNA, 22 nt, Human
ucagaggcuuccuaguccuugg

SEQ ID NO: 1077996 - RNA, 19 nt, Human
uccccaggucuccggcggc

SEQ ID NO: 1077997 - RNA, 21 nt, Human
uccuggguucgaagucuuugg

SEQ ID NO: 1077998 - RNA, 23 nt, Human
ucgcgugcuuucggaaaggggcc

SEQ ID NO: 1077999 - RNA, 25 nt, Human
ugaaauaaagcccagacaugcaacu

SEQ ID NO: 1078000 - RNA, 23 nt, Human
ugaaauguggauugagaauugug

SEQ ID NO: 1078001 - RNA, 19 nt, Human
ugaggcuggacucaccggc

SEQ ID NO: 1078002 - RNA, 20 nt, Human
ugccagccuuaaguucgcgu

SEQ ID NO: 1078003 - RNA, 23 nt, Human
uuccugaggcuggacucaccggg

SEQ ID NO: 1078004 - RNA, 23 nt, Human
uucggaaaggggccgacagggug

SEQ ID NO: 1078005 - RNA, 18 nt, Human
uuuaaagcaccugccagc

SEQ ID NO: 1078006 - RNA, 24 nt, Human
uuucggaaaggggccgacagggug

SEQ ID NO: 1078007 - RNA, 18 nt, Human
aaagagcucuggaccaga

SEQ ID NO: 1078008 - RNA, 21 nt, Human
acccagacacuaucaucugac

SEQ ID NO: 1078009 - RNA, 21 nt, Human
agaaugcaguggaaaacacca

SEQ ID NO: 1078010 - RNA, 19 nt, Human
agagauccauccuggaucc

SEQ ID NO: 1078011 - RNA, 24 nt, Human
agaguugaggguaagaguaugggg

SEQ ID NO: 1078012 - RNA, 21 nt, Human
agauggcucagaguugagggu

SEQ ID NO: 1078013 - RNA, 21 nt, Human
agcagcugaggggacagaggc

SEQ ID NO: 1078014 - RNA, 19 nt, Human
agcuagccaggggaaauga

SEQ ID NO: 1078015 - RNA, 24 nt, Human
aggggacagaggcuccaagaggcu

SEQ ID NO: 1078016 - RNA, 19 nt, Human
auccacccuggggugggug

SEQ ID NO: 1078017 - RNA, 25 nt, Human
aucuggagucaccuucgcaccggca

SEQ ID NO: 1078018 - RNA, 19 nt, Human
cagcagcacaggcccuggc

SEQ ID NO: 1078019 - RNA, 18 nt, Human
cagcugaggggacagagg

SEQ ID NO: 1078020 - RNA, 20 nt, Human
caggagccagccguaaccag

SEQ ID NO: 1078021 - RNA, 21 nt, Human
caggagccagccguaaccagc

SEQ ID NO: 1078022 - RNA, 18 nt, Human
caggggacaggugucugc

SEQ ID NO: 1078023 - RNA, 22 nt, Human
cauaacugcccgcuccagcagc

SEQ ID NO: 1078024 - RNA, 21 nt, Human
ccagaagugagcaugguucag

SEQ ID NO: 1078025 - RNA, 19 nt, Human
ccaggccauugaggcugga

SEQ ID NO: 1078026 - RNA, 19 nt, Human
ccaugaugcauucuccauc

SEQ ID NO: 1078027 - RNA, 21 nt, Human
cccacuguccugggccugagc

SEQ ID NO: 1078028 - RNA, 20 nt, Human
ccguaaccagcugucucccu

SEQ ID NO: 1078029 - RNA, 22 nt, Human
ccuagggggcagcuagccaggg

SEQ ID NO: 1078030 - RNA, 22 nt, Human
ccucacaccagccucagccucc

SEQ ID NO: 1078031 - RNA, 21 nt, Human
ccuccuucagagaaugaggau

SEQ ID NO: 1078032 - RNA, 20 nt, Human
ccucuaugggcagggauggg

SEQ ID NO: 1078033 - RNA, 25 nt, Human
ccucuaugggcagggaugggguuuc

SEQ ID NO: 1078034 - RNA, 24 nt, Human
ccugaggaaagagcucuggaccag

SEQ ID NO: 1078035 - RNA, 23 nt, Human
ccuuucccucacaccagccucag

SEQ ID NO: 1078036 - RNA, 24 nt, Human
cgaggccaggagccagccguaacc

SEQ ID NO: 1078037 - RNA, 18 nt, Human
cuccaagaggcugagaag

SEQ ID NO: 1078038 - RNA, 22 nt, Human
cuccauccuagggggcagcuag

SEQ ID NO: 1078039 - RNA, 21 nt, Human
cugcaucccccuuucccucac

SEQ ID NO: 1078040 - RNA, 18 nt, Human
cuguguccccacuggcuc

SEQ ID NO: 1078041 - RNA, 19 nt, Human
cuguugaccacccacuguc

SEQ ID NO: 1078042 - RNA, 22 nt, Human
gagcaugguucaggcuacacac

SEQ ID NO: 1078043 - RNA, 19 nt, Human
gaggagcaggccaggcugu

SEQ ID NO: 1078044 - RNA, 24 nt, Human
gcaguggaaaacaccaggugaggg

SEQ ID NO: 1078045 - RNA, 19 nt, Human
gcuccagcagcacaggccc

SEQ ID NO: 1078046 - RNA, 19 nt, Human
gcucuggaccagaagugag

SEQ ID NO: 1078047 - RNA, 22 nt, Human
gcucugugucuugccuugggug

SEQ ID NO: 1078048 - RNA, 22 nt, Human
ggagauguguuccuucagcagc

SEQ ID NO: 1078049 - RNA, 21 nt, Human
ggagucaccuucgcaccggca

SEQ ID NO: 1078050 - RNA, 21 nt, Human
ggccaggagccagccguaacc

SEQ ID NO: 1078051 - RNA, 19 nt, Human
guauccccuugcugcaucc

SEQ ID NO: 1078052 - RNA, 18 nt, Human
gugucuugccuugggugg

SEQ ID NO: 1078053 - RNA, 23 nt, Human
uacugccacccacauuauugcug

SEQ ID NO: 1078054 - RNA, 18 nt, Human
uagcaaucagugcugacu

SEQ ID NO: 1078055 - RNA, 21 nt, Human
ucacagagcucaggcuaugcc

SEQ ID NO: 1078056 - RNA, 18 nt, Human
ucacuguucacagagcuc

SEQ ID NO: 1078057 - RNA, 26 nt, Human
ucaggauggugcucaggugguucagc

SEQ ID NO: 1078058 - RNA, 21 nt, Human
ucagugaccaugaugcauucu

SEQ ID NO: 1078059 - RNA, 24 nt, Human
ucagugaccaugaugcauucucca

SEQ ID NO: 1078060 - RNA, 25 nt, Human
ucccagggcccugaggaaagagcuc

SEQ ID NO: 1078061 - RNA, 21 nt, Human
ucccccuuucccucacaccag

SEQ ID NO: 1078062 - RNA, 23 nt, Human
uccccuugcugcaucccccuuuc

SEQ ID NO: 1078063 - RNA, 18 nt, Human
ucccugcacauaacugcc

SEQ ID NO: 1078064 - RNA, 20 nt, Human
ucucaggccacugagagacc

SEQ ID NO: 1078065 - RNA, 19 nt, Human
ucuugccuuggguggcugg

SEQ ID NO: 1078066 - RNA, 21 nt, Human
ucuuuuagcaaucagugcuga

SEQ ID NO: 1078067 - RNA, 26 nt, Human
ugaaugucccagggcccugaggaaag

SEQ ID NO: 1078068 - RNA, 22 nt, Human
ugagaagugcaggagauguguu

SEQ ID NO: 1078069 - RNA, 18 nt, Human
ugagcagcuacggagccc

SEQ ID NO: 1078070 - RNA, 18 nt, Human
ugaggauaauaguuagag

SEQ ID NO: 1078071 - RNA, 18 nt, Human
ugaggguaagaguauggg

SEQ ID NO: 1078072 - RNA, 23 nt, Human
ugaguacauaguagguguauaua

SEQ ID NO: 1078073 - RNA, 19 nt, Human
uggcuggccuaauguagga

SEQ ID NO: 1078074 - RNA, 22 nt, Human
ugucacugugaacugggaagca

SEQ ID NO: 1078075 - RNA, 21 nt, Human
uguguccccacuggcucugcc

SEQ ID NO: 1078076 - RNA, 19 nt, Human
ugugucuugccuugggugg

SEQ ID NO: 1078077 - RNA, 24 nt, Human
uguuaugcuuuccaauaagaauca

SEQ ID NO: 1078078 - RNA, 23 nt, Human
uuggguggcuggaagaggagcag

SEQ ID NO: 1078079 - RNA, 24 nt, Human
aaaacucccacagucuucaauagg

SEQ ID NO: 1078080 - RNA, 24 nt, Human
acucccacagucuucaauaggggu

SEQ ID NO: 1078081 - RNA, 22 nt, Human
acuuucgcuggcucauugggaa

SEQ ID NO: 1078082 - RNA, 19 nt, Human
cauuaagccgccaaaacuc

SEQ ID NO: 1078083 - RNA, 21 nt, Human
cauuaagccgccaaaacuccc

SEQ ID NO: 1078084 - RNA, 25 nt, Human
ccaaaacucccacagucuucaauag

SEQ ID NO: 1078085 - RNA, 18 nt, Human
gaaggaccgaacacaauc

SEQ ID NO: 1078086 - RNA, 20 nt, Human
gacagacuuucgcuggcuca

SEQ ID NO: 1078087 - RNA, 25 nt, Human
ucauugggaaccacgggguuucagu

SEQ ID NO: 1078088 - RNA, 23 nt, Human
ugccauggaaucuuuuaaaggag

SEQ ID NO: 1078089 - RNA, 22 nt, Human
ccaguacccauuagaaacacag

SEQ ID NO: 1078090 - RNA, 22 nt, Human
ccaguacccauuagaaacacag

SEQ ID NO: 1078091 - RNA, 24 nt, Human
cccuuugcagacugaguuuuuauu

SEQ ID NO: 1078092 - RNA, 22 nt, Human
uugaucccaguacccauuagaa

SEQ ID NO: 1078093 - RNA, 24 nt, Human
aaagugcugggauuacaggcguga

SEQ ID NO: 1078094 - RNA, 21 nt, Human
aaccaggaaggcucuggcuca

SEQ ID NO: 1078095 - RNA, 19 nt, Human
aagaagaaaagacggaaga

SEQ ID NO: 1078096 - RNA, 19 nt, Human
aagcagccaagaggcagag

SEQ ID NO: 1078097 - RNA, 22 nt, Human
aagcagccaagaggcagagagc

SEQ ID NO: 1078098 - RNA, 19 nt, Human
aagugcugggauuacaggc

SEQ ID NO: 1078099 - RNA, 19 nt, Human
aagugcugggauuacaggc

SEQ ID NO: 1078100 - RNA, 26 nt, Human
aagugcugggauuacaggcgugagcc

SEQ ID NO: 1078101 - RNA, 19 nt, Human
acaggugcccaccacgucc

SEQ ID NO: 1078102 - RNA, 21 nt, Human
acgggguuuugucauguuggu

SEQ ID NO: 1078103 - RNA, 23 nt, Human
acgggguuuugucauguugguca

SEQ ID NO: 1078104 - RNA, 24 nt, Human
acgggguuuugucauguuggucag

SEQ ID NO: 1078105 - RNA, 19 nt, Human
acuguuuugcucaaggcug

SEQ ID NO: 1078106 - RNA, 23 nt, Human
agaaugucagggaaaacccgaaa

SEQ ID NO: 1078107 - RNA, 19 nt, Human
agagcuccccuuucucuuc

SEQ ID NO: 1078108 - RNA, 26 nt, Human
agcuggggaaaagcaguggguuaggu

SEQ ID NO: 1078109 - RNA, 21 nt, Human
aggaggccuugaaggacagac

SEQ ID NO: 1078110 - RNA, 22 nt, Human
aggcagagagcuggggaaaagc

SEQ ID NO: 1078111 - RNA, 19 nt, Human
aggcaggagagggagcgau

SEQ ID NO: 1078112 - RNA, 23 nt, Human
aggcaggagagggagcgaugcgg

SEQ ID NO: 1078113 - RNA, 21 nt, Human
agggaccaagacuccuacccu

SEQ ID NO: 1078114 - RNA, 18 nt, Human
aggucaggaaugaaugaa

SEQ ID NO: 1078115 - RNA, 24 nt, Human
aggugauccgcccgccucagccuu

SEQ ID NO: 1078116 - RNA, 18 nt, Human
aguagcugggauuacagg

SEQ ID NO: 1078117 - RNA, 24 nt, Human
agugauucuccugccucagccucc

SEQ ID NO: 1078118 - RNA, 18 nt, Human
agugcugggauuacaggc

SEQ ID NO: 1078119 - RNA, 21 nt, Human
auggauccccucccucuuugg

SEQ ID NO: 1078120 - RNA, 19 nt, Human
auggugcuauggaagggcc

SEQ ID NO: 1078121 - RNA, 24 nt, Human
auuuuuguguuuuuaguagagacg

SEQ ID NO: 1078122 - RNA, 24 nt, Human
caaagugcugggauuacaggcgug

SEQ ID NO: 1078123 - RNA, 18 nt, Human
caacauccagagggaaag

SEQ ID NO: 1078124 - RNA, 18 nt, Human
caagaggcagagagcugg

SEQ ID NO: 1078125 - RNA, 20 nt, Human
caagugauucuccugccuca

SEQ ID NO: 1078126 - RNA, 22 nt, Human
caagugauucuccugccucagc

SEQ ID NO: 1078127 - RNA, 23 nt, Human
caccacguccggcuaauuuuugu

SEQ ID NO: 1078128 - RNA, 22 nt, Human
cacugcaaccuucgcuuccggg

SEQ ID NO: 1078129 - RNA, 20 nt, Human
cacugcccuccaggccagcc

SEQ ID NO: 1078130 - RNA, 20 nt, Human
cagccuccugaguagcuggg

SEQ ID NO: 1078131 - RNA, 26 nt, Human
cagccuuuucuuccucacaggggccc

SEQ ID NO: 1078132 - RNA, 22 nt, Human
cauacuacagaaacccccuaca

SEQ ID NO: 1078133 - RNA, 25 nt, Human
caucccccuuuguaaauccuggcac

SEQ ID NO: 1078134 - RNA, 18 nt, Human
cauguuggucaggcuggu

SEQ ID NO: 1078135 - RNA, 20 nt, Human
cauguuggucaggcuggucu

SEQ ID NO: 1078136 - RNA, 20 nt, Human
cauguuggucaggcuggucu

SEQ ID NO: 1078137 - RNA, 24 nt, Human
cauguuggucaggcuggucuugaa

SEQ ID NO: 1078138 - RNA, 20 nt, Human
ccaaagugcugggauuacag

SEQ ID NO: 1078139 - RNA, 22 nt, Human
ccaaagugcugggauuacaggc

SEQ ID NO: 1078140 - RNA, 22 nt, Human
ccaaagugcugggauuacaggc

SEQ ID NO: 1078141 - RNA, 24 nt, Human
ccaaagugcugggauuacaggcgu

SEQ ID NO: 1078142 - RNA, 22 nt, Human
ccagguguggcuguuacaugac

SEQ ID NO: 1078143 - RNA, 22 nt, Human
ccccagacagauuccagaagga

SEQ ID NO: 1078144 - RNA, 25 nt, Human
ccccccuuccuucuguaagcauccc

SEQ ID NO: 1078145 - RNA, 20 nt, Human
cccccuacaaagaagaaagg

SEQ ID NO: 1078146 - RNA, 19 nt, Human
ccccuagugguccccccuu

SEQ ID NO: 1078147 - RNA, 18 nt, Human
ccccucccucuuugggcc

SEQ ID NO: 1078148 - RNA, 18 nt, Human
ccccucccucuuugggcc

SEQ ID NO: 1078149 - RNA, 18 nt, Human
ccccuuucucuuccuucc

SEQ ID NO: 1078150 - RNA, 23 nt, Human
ccccuuucucuuccuuccagccc

SEQ ID NO: 1078151 - RNA, 21 nt, Human
ccgcacccggucgacagcagu

SEQ ID NO: 1078152 - RNA, 26 nt, Human
ccgcccgccucagccuuccaaagugc

SEQ ID NO: 1078153 - RNA, 19 nt, Human
ccggguucaagugauucuc

SEQ ID NO: 1078154 - RNA, 22 nt, Human
ccggguucaagugauucuccug

SEQ ID NO: 1078155 - RNA, 24 nt, Human
ccggucgacagcaccuuuugacag

SEQ ID NO: 1078156 - RNA, 22 nt, Human
ccugaguagcugggauuacagg

SEQ ID NO: 1078157 - RNA, 23 nt, Human
ccugaguagcugggauuacaggu

SEQ ID NO: 1078158 - RNA, 24 nt, Human
ccugaguagcugggauuacaggug

SEQ ID NO: 1078159 - RNA, 23 nt, Human
ccugccucagccuccugaguagc

SEQ ID NO: 1078160 - RNA, 20 nt, Human
cgacagcaccuuuugacagu

SEQ ID NO: 1078161 - RNA, 26 nt, Human
cgacagcaccuuuugacagugucccc

SEQ ID NO: 1078162 - RNA, 24 nt, Human
cgccucagccuuccaaagugcugg

SEQ ID NO: 1078163 - RNA, 18 nt, Human
cgccuuccuggaauuucc

SEQ ID NO: 1078164 - RNA, 21 nt, Human
cgggaauggauccccucccuc

SEQ ID NO: 1078165 - RNA, 22 nt, Human
cuagugguccccccuuccuucu

SEQ ID NO: 1078166 - RNA, 23 nt, Human
cucacugcaaccuucgcuuccgg

SEQ ID NO: 1078167 - RNA, 24 nt, Human
cucagccuccugaguagcugggau

SEQ ID NO: 1078168 - RNA, 20 nt, Human
cuccaggccagccuccucug

SEQ ID NO: 1078169 - RNA, 26 nt, Human
cucuugaccucaggugauccgcccgc

SEQ ID NO: 1078170 - RNA, 21 nt, Human
cugaguagcugggauuacagg

SEQ ID NO: 1078171 - RNA, 23 nt, Human
cugaguagcugggauuacaggug

SEQ ID NO: 1078172 - RNA, 24 nt, Human
cugcccuccccuaguggucccccc

SEQ ID NO: 1078173 - RNA, 23 nt, Human
cugccucagccuccugaguagcu

SEQ ID NO: 1078174 - RNA, 20 nt, Human
cuugcucugucgcuaggcug

SEQ ID NO: 1078175 - RNA, 21 nt, Human
cuugcugggagcagaguuggg

SEQ ID NO: 1078176 - RNA, 24 nt, Human
gaccucaggugauccgcccgccuc

SEQ ID NO: 1078177 - RNA, 19 nt, Human
gaccuuggcucacugcaac

SEQ ID NO: 1078178 - RNA, 19 nt, Human
gacgggguuuugucauguu

SEQ ID NO: 1078179 - RNA, 23 nt, Human
gagacgggguuuugucauguugg

SEQ ID NO: 1078180 - RNA, 24 nt, Human
gagacgggguuuugucauguuggu

SEQ ID NO: 1078181 - RNA, 21 nt, Human
gagauggagucuugcucuguc

SEQ ID NO: 1078182 - RNA, 19 nt, Human
gagcuccccuuucucuucc

SEQ ID NO: 1078183 - RNA, 19 nt, Human
gaggaagccaucuguuucc

SEQ ID NO: 1078184 - RNA, 19 nt, Human
gaggacagggaccucacug

SEQ ID NO: 1078185 - RNA, 18 nt, Human
gauuacaggcgugagcca

SEQ ID NO: 1078186 - RNA, 22 nt, Human
gauuacaggcgugagccaccgc

SEQ ID NO: 1078187 - RNA, 23 nt, Human
gauuacaggcgugagccaccgca

SEQ ID NO: 1078188 - RNA, 18 nt, Human
gccggaauacaaacucug

SEQ ID NO: 1078189 - RNA, 20 nt, Human
gccuggaccuggccgccgcu

SEQ ID NO: 1078190 - RNA, 21 nt, Human
gcuuccggguucaagugauuc

SEQ ID NO: 1078191 - RNA, 24 nt, Human
gcuuccggguucaagugauucucc

SEQ ID NO: 1078192 - RNA, 19 nt, Human
ggaaagagucccccuaaug

SEQ ID NO: 1078193 - RNA, 19 nt, Human
ggaaggcucuggcucagga

SEQ ID NO: 1078194 - RNA, 21 nt, Human
ggaagggccuucaguggggua

SEQ ID NO: 1078195 - RNA, 19 nt, Human
ggagagccacagcccggag

SEQ ID NO: 1078196 - RNA, 19 nt, Human
ggccuuggagagccacagc

SEQ ID NO: 1078197 - RNA, 19 nt, Human
ggccuuggagagccacagc

SEQ ID NO: 1078198 - RNA, 18 nt, Human
gggaaaacccgaaauaaa

SEQ ID NO: 1078199 - RNA, 20 nt, Human
gggaggucaaaggcaggaga

SEQ ID NO: 1078200 - RNA, 25 nt, Human
gggccuggaccuggccgccgcugag

SEQ ID NO: 1078201 - RNA, 21 nt, Human
gggccuuggagagccacagcc

SEQ ID NO: 1078202 - RNA, 23 nt, Human
gggguuuugucauguuggucagg

SEQ ID NO: 1078203 - RNA, 18 nt, Human
gggugcagcagcacgacc

SEQ ID NO: 1078204 - RNA, 22 nt, Human
ggguucaagugauucuccugcc

SEQ ID NO: 1078205 - RNA, 23 nt, Human
ggguucaagugauucuccugccu

SEQ ID NO: 1078206 - RNA, 19 nt, Human
ggguucuguuaaaaugcag

SEQ ID NO: 1078207 - RNA, 22 nt, Human
ggguuuugucauguuggucagg

SEQ ID NO: 1078208 - RNA, 19 nt, Human
ggucuugaacucuugaccu

SEQ ID NO: 1078209 - RNA, 23 nt, Human
guagagacgggguuuugucaugu

SEQ ID NO: 1078210 - RNA, 18 nt, Human
guagcugggauuacaggu

SEQ ID NO: 1078211 - RNA, 21 nt, Human
guccccccuuccuucuguaag

SEQ ID NO: 1078212 - RNA, 19 nt, Human
guccggcucucguccuccc

SEQ ID NO: 1078213 - RNA, 24 nt, Human
gucuugcucugucgcuaggcuggg

SEQ ID NO: 1078214 - RNA, 24 nt, Human
gugauccgcccgccucagccuucc

SEQ ID NO: 1078215 - RNA, 24 nt, Human
gugauucuccugccucagccuccu

SEQ ID NO: 1078216 - RNA, 23 nt, Human
uaaaucgccuuccuggaauuucc

SEQ ID NO: 1078217 - RNA, 24 nt, Human
uaauuuuuguguuuuuaguagaga

SEQ ID NO: 1078218 - RNA, 24 nt, Human
uacaaacucugugaggacagggac

SEQ ID NO: 1078219 - RNA, 19 nt, Human
uacaaagaagaaagguguu

SEQ ID NO: 1078220 - RNA, 23 nt, Human
uacaggcgugagccaccgcaccc

SEQ ID NO: 1078221 - RNA, 20 nt, Human
uagaagaaugucagggaaaa

SEQ ID NO: 1078222 - RNA, 24 nt, Human
uaguagagacgggguuuugucaug

SEQ ID NO: 1078223 - RNA, 19 nt, Human
ucaagugauucuccugccu

SEQ ID NO: 1078224 - RNA, 23 nt, Human
ucacugcaaccuucgcuuccggg

SEQ ID NO: 1078225 - RNA, 23 nt, Human
ucagcagauccaccuagaaugga

SEQ ID NO: 1078226 - RNA, 20 nt, Human
ucagccuccugaguagcugg

SEQ ID NO: 1078227 - RNA, 23 nt, Human
uccaaagugcugggauuacaggc

SEQ ID NO: 1078228 - RNA, 24 nt, Human
uccaaagugcugggauuacaggcg

SEQ ID NO: 1078229 - RNA, 18 nt, Human
uccagaaggaagggagaa

SEQ ID NO: 1078230 - RNA, 27 nt, Human
uccaggccagccuccucuggacuuucu

SEQ ID NO: 1078231 - RNA, 21 nt, Human
ucccagauugaugcuccaucc

SEQ ID NO: 1078232 - RNA, 24 nt, Human
ucccccuuuguaaaucgccuuccu

SEQ ID NO: 1078233 - RNA, 21 nt, Human
ucccucuuugggccugccucu

SEQ ID NO: 1078234 - RNA, 21 nt, Human
uccgcccgccucagccuucca

SEQ ID NO: 1078235 - RNA, 23 nt, Human
uccggguucaagugauucuccuc

SEQ ID NO: 1078236 - RNA, 24 nt, Human
uccugaguagcugggauuacaggu

SEQ ID NO: 1078237 - RNA, 24 nt, Human
ucuccugccucagccuccugagua

SEQ ID NO: 1078238 - RNA, 21 nt, Human
ucugucgcuaggcuggggugc

SEQ ID NO: 1078239 - RNA, 20 nt, Human
ucuuccuuccagcccugaug

SEQ ID NO: 1078240 - RNA, 19 nt, Human
ucuugcucugucgcuaggc

SEQ ID NO: 1078241 - RNA, 21 nt, Human
ucuugcucugucgcuaggcug

SEQ ID NO: 1078242 - RNA, 22 nt, Human
ucuugcucugucgcuaggcugg

SEQ ID NO: 1078243 - RNA, 22 nt, Human
ucuugcucugucgcuaggcugg

SEQ ID NO: 1078244 - RNA, 23 nt, Human
ucuugcucugucgcuaggcuggg

SEQ ID NO: 1078245 - RNA, 19 nt, Human
ugaaguguccuggcccagc

SEQ ID NO: 1078246 - RNA, 24 nt, Human
ugaaguguccuggcccagcagccu

SEQ ID NO: 1078247 - RNA, 18 nt, Human
ugaccucaggugauccgc

SEQ ID NO: 1078248 - RNA, 20 nt, Human
ugaccucaggugauccgccc

SEQ ID NO: 1078249 - RNA, 21 nt, Human
ugaccucaggugauccgcccg

SEQ ID NO: 1078250 - RNA, 24 nt, Human
ugaccucaggugauccgcccgccu

SEQ ID NO: 1078251 - RNA, 20 nt, Human
ugauucuccugccucagccu

SEQ ID NO: 1078252 - RNA, 22 nt, Human
ugcagccagauguggaggugcc

SEQ ID NO: 1078253 - RNA, 23 nt, Human
ugccagaaggggugaggggucuc

SEQ ID NO: 1078254 - RNA, 21 nt, Human
ugcccuccaggccagccuccu

SEQ ID NO: 1078255 - RNA, 24 nt, Human
ugccucagccuccugaguagcugg

SEQ ID NO: 1078256 - RNA, 22 nt, Human
ugcuggagagcuccccuuucuc

SEQ ID NO: 1078257 - RNA, 24 nt, Human
ugcugggauuacaggcgugagcca

SEQ ID NO: 1078258 - RNA, 18 nt, Human
uggagucuugcucugucg

SEQ ID NO: 1078259 - RNA, 24 nt, Human
uggauccccucccucuuugggccu

SEQ ID NO: 1078260 - RNA, 18 nt, Human
ugggauuacaggcgugag

SEQ ID NO: 1078261 - RNA, 19 nt, Human
ugggauuacaggcgugagc

SEQ ID NO: 1078262 - RNA, 21 nt, Human
ugggauuacaggcgugagcca

SEQ ID NO: 1078263 - RNA, 22 nt, Human
ugggauuacaggcgugagccac

SEQ ID NO: 1078264 - RNA, 23 nt, Human
ugggauuacaggcgugagccacc

SEQ ID NO: 1078265 - RNA, 24 nt, Human
ugggauuacaggcgugagccaccg

SEQ ID NO: 1078266 - RNA, 21 nt, Human
ugggauuacaggugcccacca

SEQ ID NO: 1078267 - RNA, 27 nt, Human
uggggaaaagcagugggggaggcgcuu

SEQ ID NO: 1078268 - RNA, 24 nt, Human
uggucaggcuggucuugaacucuu

SEQ ID NO: 1078269 - RNA, 20 nt, Human
uguaagcaucccccuuugua

SEQ ID NO: 1078270 - RNA, 24 nt, Human
ugucauguuggucaggcuggucuu

SEQ ID NO: 1078271 - RNA, 21 nt, Human
ugugaggacagggaccucacu

SEQ ID NO: 1078272 - RNA, 24 nt, Human
ugugcagggaccaagacuccuacc

SEQ ID NO: 1078273 - RNA, 18 nt, Human
uguggaggugcccugugg

SEQ ID NO: 1078274 - RNA, 21 nt, Human
uguguuuuuaguagagacggg

SEQ ID NO: 1078275 - RNA, 18 nt, Human
uuaguagagacgggguuu

SEQ ID NO: 1078276 - RNA, 18 nt, Human
uuaguagagacgggguuu

SEQ ID NO: 1078277 - RNA, 24 nt, Human
uuaguagagacgggguuuugucau

SEQ ID NO: 1078278 - RNA, 21 nt, Human
uucaagugauucuccugccuc

SEQ ID NO: 1078279 - RNA, 23 nt, Human
uucaagugauucuccugccucag

SEQ ID NO: 1078280 - RNA, 24 nt, Human
uucaagugauucuccugccucagc

SEQ ID NO: 1078281 - RNA, 24 nt, Human
uuuguguuuuuaguagagacgggg

SEQ ID NO: 1078282 - RNA, 21 nt, Human
uuuuuaguagagacgggguuu

SEQ ID NO: 1078283 - RNA, 24 nt, Human
uuuuuaguagagacgggguuuugu

SEQ ID NO: 1078284 - RNA, 20 nt, Human
uuuuuguguuuuuaguagag

SEQ ID NO: 1078285 - RNA, 18 nt, Human
aaccugcaccccaccaca

SEQ ID NO: 1078286 - RNA, 23 nt, Human
aagagacagagggaccaacggag

SEQ ID NO: 1078287 - RNA, 22 nt, Human
aagggucagccuugcugggagg

SEQ ID NO: 1078288 - RNA, 22 nt, Human
aaucuguaacucagagaugcug

SEQ ID NO: 1078289 - RNA, 19 nt, Human
aaugcuuggcagggcuggg

SEQ ID NO: 1078290 - RNA, 19 nt, Human
acacccugcacaguauggg

SEQ ID NO: 1078291 - RNA, 19 nt, Human
acacuccccaccagcaccc

SEQ ID NO: 1078292 - RNA, 24 nt, Human
acagucccacccaccucaaaggcc

SEQ ID NO: 1078293 - RNA, 20 nt, Human
accaaggugccaaugcccau

SEQ ID NO: 1078294 - RNA, 23 nt, Human
acccacucagcagcugccucccc

SEQ ID NO: 1078295 - RNA, 21 nt, Human
accugcaccccaccacacccu

SEQ ID NO: 1078296 - RNA, 21 nt, Human
agagaggaaauggugccaggg

SEQ ID NO: 1078297 - RNA, 23 nt, Human
agagcugcccaacugggagacag

SEQ ID NO: 1078298 - RNA, 24 nt, Human
agagcugcccaacugggagacagu

SEQ ID NO: 1078299 - RNA, 22 nt, Human
agaugucggaagcaguucaacc

SEQ ID NO: 1078300 - RNA, 23 nt, Human
agcaaacacuccccaccagcacc

SEQ ID NO: 1078301 - RNA, 19 nt, Human
agcaggcaaugggcgcaca

SEQ ID NO: 1078302 - RNA, 20 nt, Human
agcccagggcuucauaaaug

SEQ ID NO: 1078303 - RNA, 21 nt, Human
aggcacacaggcauaccccca

SEQ ID NO: 1078304 - RNA, 23 nt, Human
aggcagagucugcaagcuuuucu

SEQ ID NO: 1078305 - RNA, 18 nt, Human
agggaccaggacaaaagg

SEQ ID NO: 1078306 - RNA, 28 nt, Human
agggcugggauuauuccaaacuuugagu

SEQ ID NO: 1078307 - RNA, 23 nt, Human
aguucaaccaugcagggcaacac

SEQ ID NO: 1078308 - RNA, 23 nt, Human
auacccccaggaccuccugcacu

SEQ ID NO: 1078309 - RNA, 26 nt, Human
auugcccagagagaacggggaagcca

SEQ ID NO: 1078310 - RNA, 24 nt, Human
caaagcccuggaauuggggccgca

SEQ ID NO: 1078311 - RNA, 22 nt, Human
caagaccuggugggccaaucaa

SEQ ID NO: 1078312 - RNA, 22 nt, Human
caaggcaacuucuggagcagca

SEQ ID NO: 1078313 - RNA, 23 nt, Human
cacacaggcauacccccaggacc

SEQ ID NO: 1078314 - RNA, 23 nt, Human
caccagcacccuuaaugcuuggc

SEQ ID NO: 1078315 - RNA, 21 nt, Human
caccccaccacaaccugcacc

SEQ ID NO: 1078316 - RNA, 22 nt, Human
caccccaccacacccugcacag

SEQ ID NO: 1078317 - RNA, 23 nt, Human
caccccaccacacccugcacagu

SEQ ID NO: 1078318 - RNA, 23 nt, Human
caccuauagauggaaaacaaucu

SEQ ID NO: 1078319 - RNA, 20 nt, Human
cagagggaccaacggagaca

SEQ ID NO: 1078320 - RNA, 23 nt, Human
cagcaaacacuccccaccagcac

SEQ ID NO: 1078321 - RNA, 21 nt, Human
caggcaaugggcgcacaaacc

SEQ ID NO: 1078322 - RNA, 23 nt, Human
cagggaagaggacauucucucca

SEQ ID NO: 1078323 - RNA, 24 nt, Human
cauaaaaaggggaaggcuaauuuc

SEQ ID NO: 1078324 - RNA, 18 nt, Human
caucccagggugaugccu

SEQ ID NO: 1078325 - RNA, 23 nt, Human
ccacaaggcaacuucuggagcag

SEQ ID NO: 1078326 - RNA, 20 nt, Human
ccaccacaaccugcacccca

SEQ ID NO: 1078327 - RNA, 22 nt, Human
ccaccacaaccugcaccccacc

SEQ ID NO: 1078328 - RNA, 19 nt, Human
ccaccagcacccuuaaugc

SEQ ID NO: 1078329 - RNA, 18 nt, Human
ccaccuauagauggaaaa

SEQ ID NO: 1078330 - RNA, 19 nt, Human
ccagacaauauucuccucc

SEQ ID NO: 1078331 - RNA, 25 nt, Human
ccauggguuguugccuuccuuugcu

SEQ ID NO: 1078332 - RNA, 21 nt, Human
cccaccccaccacaaccugca

SEQ ID NO: 1078333 - RNA, 26 nt, Human
cccaccccaccacaaccugcacccca

SEQ ID NO: 1078334 - RNA, 20 nt, Human
cccccaggaccuccugcacu

SEQ ID NO: 1078335 - RNA, 23 nt, Human
ccugcaccccaccacacccugca

SEQ ID NO: 1078336 - RNA, 21 nt, Human
ccugcaucuccuccaggucug

SEQ ID NO: 1078337 - RNA, 25 nt, Human
ccuggccacuaagggauuggggccc

SEQ ID NO: 1078338 - RNA, 19 nt, Human
cucccugccauggcucccc

SEQ ID NO: 1078339 - RNA, 23 nt, Human
cugaaccuguagaucccgugguc

SEQ ID NO: 1078340 - RNA, 24 nt, Human
cugcacaguaugggcagggcagcc

SEQ ID NO: 1078341 - RNA, 20 nt, Human
cugcagaaaauccugccaaa

SEQ ID NO: 1078342 - RNA, 19 nt, Human
cugggccucuaaccugucu

SEQ ID NO: 1078343 - RNA, 20 nt, Human
gagaaaugggacaccuagau

SEQ ID NO: 1078344 - RNA, 18 nt, Human
gagcagcaagaccuggug

SEQ ID NO: 1078345 - RNA, 19 nt, Human
gagcuggggccugcaucuc

SEQ ID NO: 1078346 - RNA, 19 nt, Human
gcaacuucuggagcagcaa

SEQ ID NO: 1078347 - RNA, 20 nt, Human
gcccaacugggagacagucc

SEQ ID NO: 1078348 - RNA, 19 nt, Human
ggacaaaguggggcagggg

SEQ ID NO: 1078349 - RNA, 24 nt, Human
ggacaccuagauggagcagaaaca

SEQ ID NO: 1078350 - RNA, 21 nt, Human
ggacccagagaggaaauggug

SEQ ID NO: 1078351 - RNA, 19 nt, Human
ggaggaguuuggggagagg

SEQ ID NO: 1078352 - RNA, 21 nt, Human
ggccacuuucuaacggacccu

SEQ ID NO: 1078353 - RNA, 22 nt, Human
ggcccugauacccaaaaaagca

SEQ ID NO: 1078354 - RNA, 21 nt, Human
ggcuaacugcagaaaauccug

SEQ ID NO: 1078355 - RNA, 19 nt, Human
ggcuaggaaauacccuucg

SEQ ID NO: 1078356 - RNA, 19 nt, Human
ggcugggauuauuccaaac

SEQ ID NO: 1078357 - RNA, 22 nt, Human
gggcagggcagccagcagggaa

SEQ ID NO: 1078358 - RNA, 20 nt, Human
gggcugggccucuaaccugu

SEQ ID NO: 1078359 - RNA, 20 nt, Human
guauaggacccagagaggaa

SEQ ID NO: 1078360 - RNA, 20 nt, Human
gugcacaaaugugaaaagga

SEQ ID NO: 1078361 - RNA, 18 nt, Human
guuuggggagaggggcag

SEQ ID NO: 1078362 - RNA, 18 nt, Human
uaccaugggaugggccac

SEQ ID NO: 1078363 - RNA, 25 nt, Human
uacccuucguucugcucuggacggg

SEQ ID NO: 1078364 - RNA, 20 nt, Human
uagcagagcuggggccugca

SEQ ID NO: 1078365 - RNA, 22 nt, Human
uagcagagcuggggccugcauc

SEQ ID NO: 1078366 - RNA, 21 nt, Human
uauggaggcaucaacaagcug

SEQ ID NO: 1078367 - RNA, 19 nt, Human
uaugugcacaaaugugaaa

SEQ ID NO: 1078368 - RNA, 28 nt, Human
ucccuggccacuaagggauuggggcccu

SEQ ID NO: 1078369 - RNA, 24 nt, Human
ucuccacaggugauaccgucacuu

SEQ ID NO: 1078370 - RNA, 21 nt, Human
ucugcaagcuuuucuccagac

SEQ ID NO: 1078371 - RNA, 18 nt, Human
ucugggcuaucccuggug

SEQ ID NO: 1078372 - RNA, 20 nt, Human
ucuguaacucagagaugcug

SEQ ID NO: 1078373 - RNA, 21 nt, Human
ugaauaagcauaggccauugu

SEQ ID NO: 1078374 - RNA, 20 nt, Human
ugacucacuggcauugaaga

SEQ ID NO: 1078375 - RNA, 22 nt, Human
ugagaucugaaccuguagaucc

SEQ ID NO: 1078376 - RNA, 21 nt, Human
ugaggagugagagucagagcc

SEQ ID NO: 1078377 - RNA, 18 nt, Human
ugagucccuggccacuaa

SEQ ID NO: 1078378 - RNA, 23 nt, Human
ugccaggcacacaggcauacccc

SEQ ID NO: 1078379 - RNA, 20 nt, Human
ugccuuaugaggggcaacug

SEQ ID NO: 1078380 - RNA, 23 nt, Human
uggaaugcaagugugaagguggg

SEQ ID NO: 1078381 - RNA, 18 nt, Human
uggacggggcuaacugca

SEQ ID NO: 1078382 - RNA, 21 nt, Human
uggagagaggcccaggacacc

SEQ ID NO: 1078383 - RNA, 22 nt, Human
uggagcagcaagaccugguggg

SEQ ID NO: 1078384 - RNA, 22 nt, Human
uggagugaguauuucaccuguc

SEQ ID NO: 1078385 - RNA, 22 nt, Human
uggcugagaauuauggaggcau

SEQ ID NO: 1078386 - RNA, 21 nt, Human
ugggaacguauaggacccaga

SEQ ID NO: 1078387 - RNA, 22 nt, Human
ugggagacuaagacaacaugga

SEQ ID NO: 1078388 - RNA, 23 nt, Human
ugggccucuaaccugucugcauc

SEQ ID NO: 1078389 - RNA, 19 nt, Human
uggucaggccauggguugu

SEQ ID NO: 1078390 - RNA, 18 nt, Human
ugucacaggacaaagugg

SEQ ID NO: 1078391 - RNA, 19 nt, Human
uuaauacuguuuaaggagu

SEQ ID NO: 1078392 - RNA, 21 nt, Human
uuaaugcuuggcagggcuggg

SEQ ID NO: 1078393 - RNA, 21 nt, Human
uucauggggacucccuaggua

SEQ ID NO: 1078394 - RNA, 22 nt, Human
uugcucuggcugagaauuaugg

SEQ ID NO: 1078395 - RNA, 21 nt, Human
aaaaagaaagagaucaaccaa

SEQ ID NO: 1078396 - RNA, 20 nt, Human
aagaaagagaucaaccaaga

SEQ ID NO: 1078397 - RNA, 20 nt, Human
acaaaaagaaaccaucugca

SEQ ID NO: 1078398 - RNA, 23 nt, Human
agcugagccucuggugcugauga

SEQ ID NO: 1078399 - RNA, 21 nt, Human
auuuucucuaaaaauugaaag

SEQ ID NO: 1078400 - RNA, 24 nt, Human
caaccccagcucuggcucagguuc

SEQ ID NO: 1078401 - RNA, 18 nt, Human
cacccccaugcccagccu

SEQ ID NO: 1078402 - RNA, 24 nt, Human
cagcuucaaccccagcucuggcuc

SEQ ID NO: 1078403 - RNA, 21 nt, Human
ccagcuggccaagaggacaau

SEQ ID NO: 1078404 - RNA, 23 nt, Human
ccagggugguggcaaauauuuuu

SEQ ID NO: 1078405 - RNA, 21 nt, Human
cccccagaggguugcugacuu

SEQ ID NO: 1078406 - RNA, 25 nt, Human
cccccaugcccagccugggaucugc

SEQ ID NO: 1078407 - RNA, 24 nt, Human
ccuuuaggguuggccuucuccuug

SEQ ID NO: 1078408 - RNA, 22 nt, Human
cggaacucuuuacaaaaagaaa

SEQ ID NO: 1078409 - RNA, 19 nt, Human
cuccagcuucaaccccagc

SEQ ID NO: 1078410 - RNA, 21 nt, Human
cucuaaaaauugaaaggcaaa

SEQ ID NO: 1078411 - RNA, 24 nt, Human
cugagcagagcccagaauccuauu

SEQ ID NO: 1078412 - RNA, 22 nt, Human
cugcccaguccugcugccccca

SEQ ID NO: 1078413 - RNA, 20 nt, Human
cugcuucugcugcuucucug

SEQ ID NO: 1078414 - RNA, 19 nt, Human
cuggcuccagcucuuggcu

SEQ ID NO: 1078415 - RNA, 25 nt, Human
cuguagcugcuguugcuuuugcugc

SEQ ID NO: 1078416 - RNA, 22 nt, Human
cuguugcuuuugcugcugcucc

SEQ ID NO: 1078417 - RNA, 22 nt, Human
cuuagcuugagcuuguccagga

SEQ ID NO: 1078418 - RNA, 19 nt, Human
cuucugcugcuucucugcu

SEQ ID NO: 1078419 - RNA, 19 nt, Human
gaagaacacucuauaggug

SEQ ID NO: 1078420 - RNA, 20 nt, Human
gaggaaggaaucuaaauagg

SEQ ID NO: 1078421 - RNA, 21 nt, Human
gaggguugcugacuuuccagg

SEQ ID NO: 1078422 - RNA, 19 nt, Human
ggaagguccaggugagagg

SEQ ID NO: 1078423 - RNA, 21 nt, Human
ggcagugauggugcucuucuu

SEQ ID NO: 1078424 - RNA, 23 nt, Human
gggaagguccaggugagaggaag

SEQ ID NO: 1078425 - RNA, 18 nt, Human
gggaucugcccaguccug

SEQ ID NO: 1078426 - RNA, 25 nt, Human
gguuggccuucuccuuggucccugu

SEQ ID NO: 1078427 - RNA, 19 nt, Human
gugcucuucuugccucagc

SEQ ID NO: 1078428 - RNA, 24 nt, Human
guguuggucuagacuccagggugg

SEQ ID NO: 1078429 - RNA, 24 nt, Human
uaaauaggccaggguuagccagga

SEQ ID NO: 1078430 - RNA, 20 nt, Human
ucagguuccuggucuggcuc

SEQ ID NO: 1078431 - RNA, 24 nt, Human
ucaugccauaagccagucucacaa

SEQ ID NO: 1078432 - RNA, 20 nt, Human
ucccagaagggucaagagga

SEQ ID NO: 1078433 - RNA, 18 nt, Human
uccuuggucccuguucau

SEQ ID NO: 1078434 - RNA, 22 nt, Human
ucucugcuccucuccguccugg

SEQ ID NO: 1078435 - RNA, 23 nt, Human
ucugccacccccaugcccagccu

SEQ ID NO: 1078436 - RNA, 21 nt, Human
ucuggcucagguuccuggucu

SEQ ID NO: 1078437 - RNA, 19 nt, Human
ugccauaagccagucucac

SEQ ID NO: 1078438 - RNA, 25 nt, Human
ugccucagcugagccucuggugcug

SEQ ID NO: 1078439 - RNA, 23 nt, Human
ugcuccagcuucaaccccagcuc

SEQ ID NO: 1078440 - RNA, 21 nt, Human
ugcuguugcuuuugcugcugc

SEQ ID NO: 1078441 - RNA, 27 nt, Human
ugcuuuugcugcugcuccagcuucaac

SEQ ID NO: 1078442 - RNA, 27 nt, Human
uggcaaauauuuuuaaaaagaaagaga

SEQ ID NO: 1078443 - RNA, 18 nt, Human
uggcauggauugggccug

SEQ ID NO: 1078444 - RNA, 19 nt, Human
uggcauggauugggccuga

SEQ ID NO: 1078445 - RNA, 22 nt, Human
uggcucagguuccuggucuggc

SEQ ID NO: 1078446 - RNA, 19 nt, Human
ugggagauguaguccuuag

SEQ ID NO: 1078447 - RNA, 19 nt, Human
ugggugcugagcagcagcc

SEQ ID NO: 1078448 - RNA, 25 nt, Human
uggucuggcuccagcucuuggcugc

SEQ ID NO: 1078449 - RNA, 23 nt, Human
uguauagccccuagaaauaggca

SEQ ID NO: 1078450 - RNA, 21 nt, Human
ugucaggugugcaaacauucc

SEQ ID NO: 1078451 - RNA, 21 nt, Human
ugugcaaacauucccagaagg

SEQ ID NO: 1078452 - RNA, 18 nt, Human
uguguuggucuagacucc

SEQ ID NO: 1078453 - RNA, 24 nt, Human
uuccaacuucuguagcugcuguug

SEQ ID NO: 1078454 - RNA, 25 nt, Human
uuccaggucuuagagaagaacacuc

SEQ ID NO: 1078455 - RNA, 23 nt, Human
uucccagaagggucaagaggauc

SEQ ID NO: 1078456 - RNA, 20 nt, Human
uuccuggucuggcuccagcu

SEQ ID NO: 1078457 - RNA, 23 nt, Human
uuggcugcuucugcugcuucucu

SEQ ID NO: 1078458 - RNA, 21 nt, Human
aaaaaagucggagguagauaa

SEQ ID NO: 1078459 - RNA, 18 nt, Human
aaaaauaaaacgaguggg

SEQ ID NO: 1078460 - RNA, 22 nt, Human
aaaagacaggacucacauuccu

SEQ ID NO: 1078461 - RNA, 24 nt, Human
aaacuccugggcucaagugauccu

SEQ ID NO: 1078462 - RNA, 23 nt, Human
aaagugcugggauuacaggcaug

SEQ ID NO: 1078463 - RNA, 24 nt, Human
aaagugcugggauuacaggcaugg

SEQ ID NO: 1078464 - RNA, 25 nt, Human
aaagugcugggauuacaggcauggg

SEQ ID NO: 1078465 - RNA, 24 nt, Human
aaagugcugggauuauaggcauga

SEQ ID NO: 1078466 - RNA, 18 nt, Human
aaaugaaguggcuuaaaa

SEQ ID NO: 1078467 - RNA, 21 nt, Human
aacacagcagggucaaaaaca

SEQ ID NO: 1078468 - RNA, 23 nt, Human
aacuuuugauacuggagcuugau

SEQ ID NO: 1078469 - RNA, 24 nt, Human
aagaagauugaacacagcaggguc

SEQ ID NO: 1078470 - RNA, 23 nt, Human
aagcaaggagcaggcaaagagcu

SEQ ID NO: 1078471 - RNA, 23 nt, Human
aaggcaggaccucagccucccaa

SEQ ID NO: 1078472 - RNA, 24 nt, Human
aagggacaacuaugagcuggucca

SEQ ID NO: 1078473 - RNA, 22 nt, Human
aaguaauucgccugccucagcc

SEQ ID NO: 1078474 - RNA, 22 nt, Human
aaguagcugggauuacaggcau

SEQ ID NO: 1078475 - RNA, 24 nt, Human
aaguagcugggauuacaggcaugc

SEQ ID NO: 1078476 - RNA, 19 nt, Human
aagugcugggauuacaggc

SEQ ID NO: 1078477 - RNA, 21 nt, Human
aagugcugggauuacaggcau

SEQ ID NO: 1078478 - RNA, 19 nt, Human
aagugcugggauuauaggc

SEQ ID NO: 1078479 - RNA, 21 nt, Human
aagugcugggauuauaggcau

SEQ ID NO: 1078480 - RNA, 22 nt, Human
aaucauggguuccagggacucg

SEQ ID NO: 1078481 - RNA, 18 nt, Human
acacaccguugccugcug

SEQ ID NO: 1078482 - RNA, 20 nt, Human
acacacuuccagaaaacauc

SEQ ID NO: 1078483 - RNA, 25 nt, Human
acacugucacccaggcuggagugca

SEQ ID NO: 1078484 - RNA, 19 nt, Human
acagggucuuguuauguug

SEQ ID NO: 1078485 - RNA, 20 nt, Human
acaguucuuaugaggccacc

SEQ ID NO: 1078486 - RNA, 24 nt, Human
acauaguuucaccauguuggucag

SEQ ID NO: 1078487 - RNA, 24 nt, Human
accauguuggucaggcuagucucg

SEQ ID NO: 1078488 - RNA, 24 nt, Human
acccaaguagcugggauuacaggc

SEQ ID NO: 1078489 - RNA, 21 nt, Human
acccacccagauaauccagaa

SEQ ID NO: 1078490 - RNA, 19 nt, Human
acccaggcuggagugcagu

SEQ ID NO: 1078491 - RNA, 23 nt, Human
accccauguccaagggacaacua

SEQ ID NO: 1078492 - RNA, 18 nt, Human
acggaguuucaucauguu

SEQ ID NO: 1078493 - RNA, 19 nt, Human
acggaguuucaucauguug

SEQ ID NO: 1078494 - RNA, 24 nt, Human
acggaguuucaucauguugcucag

SEQ ID NO: 1078495 - RNA, 20 nt, Human
acugacaggcaucacuuuau

SEQ ID NO: 1078496 - RNA, 24 nt, Human
acugucacccaggcuggagugcag

SEQ ID NO: 1078497 - RNA, 23 nt, Human
agacaaaagacaggacucacauu

SEQ ID NO: 1078498 - RNA, 19 nt, Human
agacaggacucacauuccu

SEQ ID NO: 1078499 - RNA, 18 nt, Human
agacagggucuuguuaug

SEQ ID NO: 1078500 - RNA, 24 nt, Human
agagaaggcaggaccucagccucc

SEQ ID NO: 1078501 - RNA, 18 nt, Human
agagacugaaagaggguu

SEQ ID NO: 1078502 - RNA, 19 nt, Human
agauaaaaauauuaggcag

SEQ ID NO: 1078503 - RNA, 24 nt, Human
agauaauccagaaccaaucucccc

SEQ ID NO: 1078504 - RNA, 18 nt, Human
agcaacggccccagccuu

SEQ ID NO: 1078505 - RNA, 22 nt, Human
agcagcuaaggcagccucccaa

SEQ ID NO: 1078506 - RNA, 19 nt, Human
aggaaagagauguaaugga

SEQ ID NO: 1078507 - RNA, 19 nt, Human
aggcaaugacacuaaguca

SEQ ID NO: 1078508 - RNA, 20 nt, Human
aggcaggaaagagauguaau

SEQ ID NO: 1078509 - RNA, 20 nt, Human
aggcaugagccauugcaccc

SEQ ID NO: 1078510 - RNA, 25 nt, Human
aggcuggagugcaguagcgcgaucu

SEQ ID NO: 1078511 - RNA, 18 nt, Human
aguagcugagauuacagg

SEQ ID NO: 1078512 - RNA, 19 nt, Human
agucucgaacuccugaccu

SEQ ID NO: 1078513 - RNA, 22 nt, Human
agucuuuaagugccuguuuuuc

SEQ ID NO: 1078514 - RNA, 20 nt, Human
agugcaguagcgcgaucucg

SEQ ID NO: 1078515 - RNA, 24 nt, Human
agugcaguagcgcgaucucggcuc

SEQ ID NO: 1078516 - RNA, 18 nt, Human
agugcugggauuacaggc

SEQ ID NO: 1078517 - RNA, 21 nt, Human
aguuucaccauguuggucagg

SEQ ID NO: 1078518 - RNA, 24 nt, Human
augauucacccgccucagccuccc

SEQ ID NO: 1078519 - RNA, 25 nt, Human
augcaccaccacgcccugcuagagc

SEQ ID NO: 1078520 - RNA, 20 nt, Human
auggaggagguggguggcag

SEQ ID NO: 1078521 - RNA, 21 nt, Human
auucuccugccucagccuccc

SEQ ID NO: 1078522 - RNA, 22 nt, Human
caaaagacaggacucacauucc

SEQ ID NO: 1078523 - RNA, 24 nt, Human
caaagugcugggauuacaggcaug

SEQ ID NO: 1078524 - RNA, 24 nt, Human
caaagugcugggauuauaggcaug

SEQ ID NO: 1078525 - RNA, 24 nt, Human
caaccuccaucucccagguugaag

SEQ ID NO: 1078526 - RNA, 22 nt, Human
caagcaauucuccugccucagc

SEQ ID NO: 1078527 - RNA, 25 nt, Human
caagccagagagaggagagaugggc

SEQ ID NO: 1078528 - RNA, 19 nt, Human
caagugccuccuggacauu

SEQ ID NO: 1078529 - RNA, 24 nt, Human
cacacagagaggggccaagauaag

SEQ ID NO: 1078530 - RNA, 24 nt, Human
cacacugucacccaggcuggagug

SEQ ID NO: 1078531 - RNA, 25 nt, Human
cacagcagggucaaaaacauuagga

SEQ ID NO: 1078532 - RNA, 24 nt, Human
caccauguuggucaggcuagucuc

SEQ ID NO: 1078533 - RNA, 21 nt, Human
cacccaccaccacacccagcu

SEQ ID NO: 1078534 - RNA, 23 nt, Human
cacccgccucagccucccaaagu

SEQ ID NO: 1078535 - RNA, 21 nt, Human
caccgcaaccuccgccucccg

SEQ ID NO: 1078536 - RNA, 20 nt, Human
caccgugcccggcccagagu

SEQ ID NO: 1078537 - RNA, 24 nt, Human
caccucagccucccaagcagcugg

SEQ ID NO: 1078538 - RNA, 24 nt, Human
caccucagccugccaaagugcugg

SEQ ID NO: 1078539 - RNA, 19 nt, Human
cagaaccaaucuccccacc

SEQ ID NO: 1078540 - RNA, 24 nt, Human
cagacgagcucacaucugccuccc

SEQ ID NO: 1078541 - RNA, 18 nt, Human
cagcacagagacugaaag

SEQ ID NO: 1078542 - RNA, 22 nt, Human
cagcauaacaaagcacagcuga

SEQ ID NO: 1078543 - RNA, 23 nt, Human
cagccuacuacuacccucagcac

SEQ ID NO: 1078544 - RNA, 21 nt, Human
caggcacccaccaccacaccc

SEQ ID NO: 1078545 - RNA, 23 nt, Human
caggcacccaccaccacacccag

SEQ ID NO: 1078546 - RNA, 24 nt, Human
cagggucuuguuauguuguucagg

SEQ ID NO: 1078547 - RNA, 22 nt, Human
cauaacgcagacccuaaagucu

SEQ ID NO: 1078548 - RNA, 24 nt, Human
cauaggccaaagaacuggcaaagc

SEQ ID NO: 1078549 - RNA, 22 nt, Human
caucauguugcucaggcugguc

SEQ ID NO: 1078550 - RNA, 24 nt, Human
caucauguugcucaggcuggucuu

SEQ ID NO: 1078551 - RNA, 24 nt, Human
caugauucacccgccucagccucc

SEQ ID NO: 1078552 - RNA, 26 nt, Human
caugcaccaccacgcccugcuagagc

SEQ ID NO: 1078553 - RNA, 20 nt, Human
cauguugcucaggcuggucu

SEQ ID NO: 1078554 - RNA, 24 nt, Human
cauguugcucaggcuggucuugaa

SEQ ID NO: 1078555 - RNA, 23 nt, Human
ccaaagugcugggauuacaggca

SEQ ID NO: 1078556 - RNA, 24 nt, Human
ccaaagugcugggauuacaggcau

SEQ ID NO: 1078557 - RNA, 22 nt, Human
ccaaagugcugggauuauaggc

SEQ ID NO: 1078558 - RNA, 24 nt, Human
ccaaagugcugggauuauaggcau

SEQ ID NO: 1078559 - RNA, 23 nt, Human
ccaaguagcugggauuacaggca

SEQ ID NO: 1078560 - RNA, 24 nt, Human
ccaaguagcugggauuacaggcau

SEQ ID NO: 1078561 - RNA, 24 nt, Human
ccacccaaguagcugggauuacag

SEQ ID NO: 1078562 - RNA, 21 nt, Human
ccacccagauaauccagaacc

SEQ ID NO: 1078563 - RNA, 19 nt, Human
ccaggucagacugggccaa

SEQ ID NO: 1078564 - RNA, 18 nt, Human
ccauugcacccuggcuag

SEQ ID NO: 1078565 - RNA, 24 nt, Human
cccaaagugcugggauuacaggca

SEQ ID NO: 1078566 - RNA, 23 nt, Human
cccaaguagcugggauuacaggc

SEQ ID NO: 1078567 - RNA, 24 nt, Human
cccaaguagcugggauuacaggca

SEQ ID NO: 1078568 - RNA, 18 nt, Human
cccacacacacuuccaga

SEQ ID NO: 1078569 - RNA, 21 nt, Human
cccaccaccacacccagcuaa

SEQ ID NO: 1078570 - RNA, 20 nt, Human
cccagccuuauccacugacc

SEQ ID NO: 1078571 - RNA, 24 nt, Human
cccaugagcaacggccccagccuu

SEQ ID NO: 1078572 - RNA, 19 nt, Human
ccccagggcaugaacgaug

SEQ ID NO: 1078573 - RNA, 19 nt, Human
cccgaguagcugagauuac

SEQ ID NO: 1078574 - RNA, 24 nt, Human
cccgaguagcugagauuacaggca

SEQ ID NO: 1078575 - RNA, 23 nt, Human
cccggguucaagcaauucuccug

SEQ ID NO: 1078576 - RNA, 21 nt, Human
cccucccucccuuacucccuu

SEQ ID NO: 1078577 - RNA, 20 nt, Human
cccuggcuuuucuagcuucu

SEQ ID NO: 1078578 - RNA, 23 nt, Human
ccgaguagcugagauuacaggca

SEQ ID NO: 1078579 - RNA, 18 nt, Human
ccgcaaccuccgccuccc

SEQ ID NO: 1078580 - RNA, 23 nt, Human
ccgcaaccuccgccucccggguu

SEQ ID NO: 1078581 - RNA, 24 nt, Human
ccgcaaccuccgccucccggguuc

SEQ ID NO: 1078582 - RNA, 24 nt, Human
ccgccucagccucccaaagugcug

SEQ ID NO: 1078583 - RNA, 27 nt, Human
ccgccucccggguucaagcaauucuuu

SEQ ID NO: 1078584 - RNA, 21 nt, Human
ccuaaaggugauacccaaucu

SEQ ID NO: 1078585 - RNA, 21 nt, Human
ccucaccucagccucccaagc

SEQ ID NO: 1078586 - RNA, 24 nt, Human
ccucccggguucaagcaauucucc

SEQ ID NO: 1078587 - RNA, 19 nt, Human
ccucccuuacucccuuccu

SEQ ID NO: 1078588 - RNA, 24 nt, Human
ccugcaucugagacaacaggaagc

SEQ ID NO: 1078589 - RNA, 23 nt, Human
ccugccucagccucccgaguagc

SEQ ID NO: 1078590 - RNA, 24 nt, Human
ccugccucagccucccgaguagcu

SEQ ID NO: 1078591 - RNA, 21 nt, Human
ccuggacauuuggaauuggga

SEQ ID NO: 1078592 - RNA, 23 nt, Human
ccuggagcugggcugcccucugg

SEQ ID NO: 1078593 - RNA, 18 nt, Human
ccugggcucaagugaucc

SEQ ID NO: 1078594 - RNA, 18 nt, Human
ccuuugaagcuagggcag

SEQ ID NO: 1078595 - RNA, 24 nt, Human
cgccucagccucccaaagugcugg

SEQ ID NO: 1078596 - RNA, 20 nt, Human
cggaaauggauaucuugggg

SEQ ID NO: 1078597 - RNA, 24 nt, Human
cggaguuucaucauguugcucagg

SEQ ID NO: 1078598 - RNA, 18 nt, Human
cggcaccacauccggcua

SEQ ID NO: 1078599 - RNA, 23 nt, Human
cuaauuuuuuguauuuuuaguag

SEQ ID NO: 1078600 - RNA, 22 nt, Human
cuagcccaugagcaacggcccc

SEQ ID NO: 1078601 - RNA, 18 nt, Human
cuagggacaauacccauu

SEQ ID NO: 1078602 - RNA, 24 nt, Human
cucaccgcaaccuccgccucccgg

SEQ ID NO: 1078603 - RNA, 24 nt, Human
cucacugcaaccuccaucucccag

SEQ ID NO: 1078604 - RNA, 24 nt, Human
cucagccacccaaguagcugggau

SEQ ID NO: 1078605 - RNA, 23 nt, Human
cuccagcaggucaugccuauacc

SEQ ID NO: 1078606 - RNA, 24 nt, Human
cucccuuacucccuuccuuccuuc

SEQ ID NO: 1078607 - RNA, 24 nt, Human
cuccugaccucaugauucacccgc

SEQ ID NO: 1078608 - RNA, 21 nt, Human
cuccugcugggcccagcuauu

SEQ ID NO: 1078609 - RNA, 22 nt, Human
cuccugcugggcccagcuauuc

SEQ ID NO: 1078610 - RNA, 23 nt, Human
cuccuggacauuuggaauuggga

SEQ ID NO: 1078611 - RNA, 23 nt, Human
cuccugggcucaagugauccuca

SEQ ID NO: 1078612 - RNA, 22 nt, Human
cucuagggacaauacccauugc

SEQ ID NO: 1078613 - RNA, 18 nt, Human
cucuccucaccaccucag

SEQ ID NO: 1078614 - RNA, 22 nt, Human
cucuggguacccacuaugcaac

SEQ ID NO: 1078615 - RNA, 23 nt, Human
cugcaaccuccaucucccagguu

SEQ ID NO: 1078616 - RNA, 19 nt, Human
cuggaggcucucagggaga

SEQ ID NO: 1078617 - RNA, 18 nt, Human
cuggcuccugcaucugag

SEQ ID NO: 1078618 - RNA, 19 nt, Human
cuggcuccugcaucugaga

SEQ ID NO: 1078619 - RNA, 18 nt, Human
cugggcccagcuauucug

SEQ ID NO: 1078620 - RNA, 23 nt, Human
cugggcucgagcgauccgcccac

SEQ ID NO: 1078621 - RNA, 21 nt, Human
cugggcugcccucuggcuccu

SEQ ID NO: 1078622 - RNA, 20 nt, Human
cuguagaccugcauucuauc

SEQ ID NO: 1078623 - RNA, 21 nt, Human
cuucacacagcucaugccacc

SEQ ID NO: 1078624 - RNA, 23 nt, Human
cuucagucucuccucaccaccuc

SEQ ID NO: 1078625 - RNA, 19 nt, Human
cuuccuucuccccucucca

SEQ ID NO: 1078626 - RNA, 19 nt, Human
cuugaccccacacacacuu

SEQ ID NO: 1078627 - RNA, 21 nt, Human
cuuguuauguuguucaggcug

SEQ ID NO: 1078628 - RNA, 22 nt, Human
cuuguuauguuguucaggcugg

SEQ ID NO: 1078629 - RNA, 23 nt, Human
cuuuccaguucuguggcuggugc

SEQ ID NO: 1078630 - RNA, 25 nt, Human
gaaguccuuuacacauccaugacuu

SEQ ID NO: 1078631 - RNA, 22 nt, Human
gaccucaugauucacccgccuc

SEQ ID NO: 1078632 - RNA, 20 nt, Human
gagacccaaaaugggucugu

SEQ ID NO: 1078633 - RNA, 20 nt, Human
gagagaggagagaugggccu

SEQ ID NO: 1078634 - RNA, 20 nt, Human
gagagcuuuggagccuuaaa

SEQ ID NO: 1078635 - RNA, 23 nt, Human
gagcucacaucugccucccuuga

SEQ ID NO: 1078636 - RNA, 19 nt, Human
gaguagauacaggugcccc

SEQ ID NO: 1078637 - RNA, 25 nt, Human
gaguagcugagauuacaggcaccca

SEQ ID NO: 1078638 - RNA, 19 nt, Human
gauggaggagguggguggc

SEQ ID NO: 1078639 - RNA, 18 nt, Human
gauuacaggcaugggcca

SEQ ID NO: 1078640 - RNA, 21 nt, Human
gauuacaggcaugggccaccg

SEQ ID NO: 1078641 - RNA, 24 nt, Human
gauuacaggcaugggccaccgugc

SEQ ID NO: 1078642 - RNA, 22 nt, Human
gauuauaggcaugagccauugc

SEQ ID NO: 1078643 - RNA, 23 nt, Human
gauuauaggcaugagccauugca

SEQ ID NO: 1078644 - RNA, 18 nt, Human
gcagccucccaagggcca

SEQ ID NO: 1078645 - RNA, 25 nt, Human
gcagcuaaggcagccucccaagggc

SEQ ID NO: 1078646 - RNA, 21 nt, Human
gcccaugagcaacggccccag

SEQ ID NO: 1078647 - RNA, 23 nt, Human
gcuagucucgaacuccugaccuc

SEQ ID NO: 1078648 - RNA, 22 nt, Human
gcugggcugcccucuggcuccu

SEQ ID NO: 1078649 - RNA, 21 nt, Human
gcuuccuucuccccucuccau

SEQ ID NO: 1078650 - RNA, 20 nt, Human
ggaggagguggguggcagcu

SEQ ID NO: 1078651 - RNA, 23 nt, Human
ggaguuucaucauguugcucagg

SEQ ID NO: 1078652 - RNA, 24 nt, Human
ggauuacaggcaugggccaccgug

SEQ ID NO: 1078653 - RNA, 20 nt, Human
gggcaguuucuccagcaggu

SEQ ID NO: 1078654 - RNA, 24 nt, Human
gggcucgagcgauccgcccaccuc

SEQ ID NO: 1078655 - RNA, 20 nt, Human
gggcugcagggagaggaggg

SEQ ID NO: 1078656 - RNA, 21 nt, Human
ggugccuaccuggagcugggc

SEQ ID NO: 1078657 - RNA, 18 nt, Human
guaauucgccugccucag

SEQ ID NO: 1078658 - RNA, 20 nt, Human
guaauucgccugccucagcc

SEQ ID NO: 1078659 - RNA, 19 nt, Human
guaguccaaauggccggug

SEQ ID NO: 1078660 - RNA, 18 nt, Human
guauuuuucuguaaucag

SEQ ID NO: 1078661 - RNA, 19 nt, Human
gucaagggauggacaagcc

SEQ ID NO: 1078662 - RNA, 20 nt, Human
gucuguagaccugcauucua

SEQ ID NO: 1078663 - RNA, 19 nt, Human
gugauacccaaucuagccc

SEQ ID NO: 1078664 - RNA, 22 nt, Human
gugauccucaccucagccuccc

SEQ ID NO: 1078665 - RNA, 20 nt, Human
gugucaagaaaaugucaaca

SEQ ID NO: 1078666 - RNA, 24 nt, Human
guugaaguaauucgccugccucag

SEQ ID NO: 1078667 - RNA, 23 nt, Human
guuucacacugucacccaggcug

SEQ ID NO: 1078668 - RNA, 20 nt, Human
uaagaagauugaacacagca

SEQ ID NO: 1078669 - RNA, 21 nt, Human
uaagacaccauuaauccuaaa

SEQ ID NO: 1078670 - RNA, 20 nt, Human
uaaggcagccucccaagggc

SEQ ID NO: 1078671 - RNA, 21 nt, Human
uaagucaugacugcuaucugg

SEQ ID NO: 1078672 - RNA, 28 nt, Human
uaauccagaaccaaucuccccaccucaa

SEQ ID NO: 1078673 - RNA, 23 nt, Human
uaauuuuguauuuuuaguaaaga

SEQ ID NO: 1078674 - RNA, 25 nt, Human
uaauuuuguauuuuuaguaaagacg

SEQ ID NO: 1078675 - RNA, 24 nt, Human
uaauuuuuuguauuuuuaguagag

SEQ ID NO: 1078676 - RNA, 25 nt, Human
uaauuuuuuguauuuuuaguagaga

SEQ ID NO: 1078677 - RNA, 25 nt, Human
uacacuaugaucaucagcauuuucu

SEQ ID NO: 1078678 - RNA, 23 nt, Human
uacaggcaugcggcaccacaucc

SEQ ID NO: 1078679 - RNA, 23 nt, Human
uacaggcaugggccaccgugccc

SEQ ID NO: 1078680 - RNA, 22 nt, Human
uacaggugccccacaccauccu

SEQ ID NO: 1078681 - RNA, 30 nt, Human
uacaggugccccacaccauccuugaccccu

SEQ ID NO: 1078682 - RNA, 19 nt, Human
uaggagacugugaagaaau

SEQ ID NO: 1078683 - RNA, 20 nt, Human
uaggcaggaaagagauguaa

SEQ ID NO: 1078684 - RNA, 22 nt, Human
uaggcaggcaaugacacuaagu

SEQ ID NO: 1078685 - RNA, 24 nt, Human
uaguaaagacggaguuucaucaug

SEQ ID NO: 1078686 - RNA, 24 nt, Human
uaguagagacauaguuucaccaug

SEQ ID NO: 1078687 - RNA, 21 nt, Human
uauccuaaaggugauacccaa

SEQ ID NO: 1078688 - RNA, 19 nt, Human
uaucucaauaucagagaug

SEQ ID NO: 1078689 - RNA, 18 nt, Human
uauguuguucaggcugga

SEQ ID NO: 1078690 - RNA, 22 nt, Human
uauuaggcaggaaagagaugua

SEQ ID NO: 1078691 - RNA, 21 nt, Human
ucaacaaagucccuacaaaaa

SEQ ID NO: 1078692 - RNA, 18 nt, Human
ucaagggauggacaagcc

SEQ ID NO: 1078693 - RNA, 22 nt, Human
ucacacugucacccaggcugga

SEQ ID NO: 1078694 - RNA, 24 nt, Human
ucacacugucacccaggcuggagu

SEQ ID NO: 1078695 - RNA, 22 nt, Human
ucacagggcuguuuggugccgu

SEQ ID NO: 1078696 - RNA, 22 nt, Human
ucacccaggcuggagugcagua

SEQ ID NO: 1078697 - RNA, 24 nt, Human
ucaccgcaaccuccgccucccggg

SEQ ID NO: 1078698 - RNA, 25 nt, Human
ucaccgcaaccuccgccucccgggu

SEQ ID NO: 1078699 - RNA, 27 nt, Human
ucaccgcaaccuccgccucccggguuc

SEQ ID NO: 1078700 - RNA, 24 nt, Human
ucacugcaaccuccaucucccagg

SEQ ID NO: 1078701 - RNA, 25 nt, Human
ucacugcaaccuccaucucccaggu

SEQ ID NO: 1078702 - RNA, 20 nt, Human
ucagccucccaagcagcugg

SEQ ID NO: 1078703 - RNA, 23 nt, Human
ucagccucccaagggcuuuccag

SEQ ID NO: 1078704 - RNA, 24 nt, Human
ucaggcuggucuugaacuucuggg

SEQ ID NO: 1078705 - RNA, 23 nt, Human
uccagaaccaaucuccccaccuc

SEQ ID NO: 1078706 - RNA, 22 nt, Human
uccaugacuuucuguccaacuc

SEQ ID NO: 1078707 - RNA, 24 nt, Human
ucccaaagugcugggauuacaggc

SEQ ID NO: 1078708 - RNA, 22 nt, Human
ucccaagggcuuuccaguucug

SEQ ID NO: 1078709 - RNA, 19 nt, Human
ucccagguugaaguaauuc

SEQ ID NO: 1078710 - RNA, 24 nt, Human
ucccagguugaaguaauucgccug

SEQ ID NO: 1078711 - RNA, 21 nt, Human
ucccccauuuuacagacaggg

SEQ ID NO: 1078712 - RNA, 24 nt, Human
ucccgaguagcugagauuacaggc

SEQ ID NO: 1078713 - RNA, 21 nt, Human
ucccggguucaagcaauucuc

SEQ ID NO: 1078714 - RNA, 24 nt, Human
ucccggguucaagcaauucuccug

SEQ ID NO: 1078715 - RNA, 22 nt, Human
ucccuggcuuuucuagcuucua

SEQ ID NO: 1078716 - RNA, 21 nt, Human
uccgcccaccucagccugcca

SEQ ID NO: 1078717 - RNA, 24 nt, Human
uccgccucccggguucaagcaauu

SEQ ID NO: 1078718 - RNA, 24 nt, Human
uccugcugggcccagcuauucugg

SEQ ID NO: 1078719 - RNA, 21 nt, Human
uccugggcucaagugauccuc

SEQ ID NO: 1078720 - RNA, 19 nt, Human
uccuucagcaugaucucgg

SEQ ID NO: 1078721 - RNA, 24 nt, Human
ucuccugccucagccucccgagua

SEQ ID NO: 1078722 - RNA, 21 nt, Human
ucucgaacuccugaccucaug

SEQ ID NO: 1078723 - RNA, 24 nt, Human
ucucucgccucccucccucccuua

SEQ ID NO: 1078724 - RNA, 23 nt, Human
ucucuggguacccacuaugcaac

SEQ ID NO: 1078725 - RNA, 22 nt, Human
ucugggcucgagcgauccgccc

SEQ ID NO: 1078726 - RNA, 25 nt, Human
ucuguggcuggugccuaccuggagc

SEQ ID NO: 1078727 - RNA, 23 nt, Human
ucuuguuauguuguucaggcugg

SEQ ID NO: 1078728 - RNA, 24 nt, Human
ucuuguuauguuguucaggcugga

SEQ ID NO: 1078729 - RNA, 22 nt, Human
ucuuucucucucucucgccucc

SEQ ID NO: 1078730 - RNA, 23 nt, Human
ugaagaaacugaaguguaagaag

SEQ ID NO: 1078731 - RNA, 21 nt, Human
ugaagcuagggcaguuucucc

SEQ ID NO: 1078732 - RNA, 22 nt, Human
ugaagcuagggcaguuucucca

SEQ ID NO: 1078733 - RNA, 22 nt, Human
ugaauuaacaaucauggguucc

SEQ ID NO: 1078734 - RNA, 18 nt, Human
ugacaggcaucacuuuau

SEQ ID NO: 1078735 - RNA, 19 nt, Human
ugacucuuaagagacaacu

SEQ ID NO: 1078736 - RNA, 19 nt, Human
ugagauuacaggcacccac

SEQ ID NO: 1078737 - RNA, 21 nt, Human
ugagauuacaggcacccacca

SEQ ID NO: 1078738 - RNA, 24 nt, Human
ugagauuacaggcacccaccacca

SEQ ID NO: 1078739 - RNA, 18 nt, Human
ugagcaacggccccagcc

SEQ ID NO: 1078740 - RNA, 21 nt, Human
ugauggaggagguggguggca

SEQ ID NO: 1078741 - RNA, 20 nt, Human
ugcagggagaggagggaggc

SEQ ID NO: 1078742 - RNA, 22 nt, Human
ugcaguagcgcgaucucggcuc

SEQ ID NO: 1078743 - RNA, 20 nt, Human
ugccaucaauagaacugaaa

SEQ ID NO: 1078744 - RNA, 20 nt, Human
ugccguggaaaaaugaaggu

SEQ ID NO: 1078745 - RNA, 24 nt, Human
ugccucagccacccaaguagcugg

SEQ ID NO: 1078746 - RNA, 24 nt, Human
ugccucagccucccgaguagcuga

SEQ ID NO: 1078747 - RNA, 24 nt, Human
ugcucaggcuggucuugaacuucu

SEQ ID NO: 1078748 - RNA, 19 nt, Human
ugcuguaacaaauuaucac

SEQ ID NO: 1078749 - RNA, 23 nt, Human
ugcuucugucgucacauuuccuc

SEQ ID NO: 1078750 - RNA, 25 nt, Human
ugcuucugucgucacauuuccucug

SEQ ID NO: 1078751 - RNA, 18 nt, Human
uggaggagguggguggca

SEQ ID NO: 1078752 - RNA, 23 nt, Human
uggagugcaguagcgcgaucucg

SEQ ID NO: 1078753 - RNA, 24 nt, Human
uggagugcaguagcgcgaucucgg

SEQ ID NO: 1078754 - RNA, 25 nt, Human
uggauaucuugggggaccauuacuc

SEQ ID NO: 1078755 - RNA, 21 nt, Human
uggcacuacggacaugcacca

SEQ ID NO: 1078756 - RNA, 23 nt, Human
uggccucacaucacuccaacccc

SEQ ID NO: 1078757 - RNA, 18 nt, Human
ugggauuacaggcaugcg

SEQ ID NO: 1078758 - RNA, 24 nt, Human
ugggauuacaggcaugcggcacca

SEQ ID NO: 1078759 - RNA, 21 nt, Human
ugggauuacaggcaugggcca

SEQ ID NO: 1078760 - RNA, 22 nt, Human
ugggauuacaggcaugggccac

SEQ ID NO: 1078761 - RNA, 23 nt, Human
ugggauuacaggcaugggccacc

SEQ ID NO: 1078762 - RNA, 23 nt, Human
ugggauuacaggcaugggccacc

SEQ ID NO: 1078763 - RNA, 24 nt, Human
ugggauuacaggcaugggccaccg

SEQ ID NO: 1078764 - RNA, 19 nt, Human
ugggauuauaggcaugagc

SEQ ID NO: 1078765 - RNA, 21 nt, Human
ugggauuauaggcaugagcca

SEQ ID NO: 1078766 - RNA, 21 nt, Human
ugggauuauaggcaugagcca

SEQ ID NO: 1078767 - RNA, 21 nt, Human
ugggauuauaggcaugagcca

SEQ ID NO: 1078768 - RNA, 24 nt, Human
ugggauuauaggcaugagccauug

SEQ ID NO: 1078769 - RNA, 24 nt, Human
ugggauuauaggcaugagccauug

SEQ ID NO: 1078770 - RNA, 22 nt, Human
ugggcucaagugauccucaccu

SEQ ID NO: 1078771 - RNA, 23 nt, Human
ugggcugcagggagaggagggag

SEQ ID NO: 1078772 - RNA, 19 nt, Human
uggggcuuaucaucaagaa

SEQ ID NO: 1078773 - RNA, 18 nt, Human
ugggucuguagaccugca

SEQ ID NO: 1078774 - RNA, 24 nt, Human
uggucaggcuagucucgaacuccu

SEQ ID NO: 1078775 - RNA, 22 nt, Human
uggucuugaacuucugggcucg

SEQ ID NO: 1078776 - RNA, 20 nt, Human
ugucaagggauggacaagcc

SEQ ID NO: 1078777 - RNA, 24 nt, Human
uguuauguuguucaggcuggacuc

SEQ ID NO: 1078778 - RNA, 24 nt, Human
uuaguaaagacggaguuucaucau

SEQ ID NO: 1078779 - RNA, 24 nt, Human
uuaguagagacauaguuucaccau

SEQ ID NO: 1078780 - RNA, 21 nt, Human
uucaagcaauucuccugccuc

SEQ ID NO: 1078781 - RNA, 24 nt, Human
uucaagcaauucuccugccucagc

SEQ ID NO: 1078782 - RNA, 21 nt, Human
uucacccgccucagccuccca

SEQ ID NO: 1078783 - RNA, 22 nt, Human
uucaggcuggacucaaaacucc

SEQ ID NO: 1078784 - RNA, 18 nt, Human
uucguaagccaguacuac

SEQ ID NO: 1078785 - RNA, 18 nt, Human
uugggcacuaaccccaug

SEQ ID NO: 1078786 - RNA, 23 nt, Human
uuguauuuuuaguaaagacggag

SEQ ID NO: 1078787 - RNA, 20 nt, Human
uuuaguaaagacggaguuuc

SEQ ID NO: 1078788 - RNA, 24 nt, Human
uuucacacaccguugccugcugug

SEQ ID NO: 1078789 - RNA, 24 nt, Human
uuucacacugucacccaggcugga

SEQ ID NO: 1078790 - RNA, 24 nt, Human
uuucaccauguuggucaggcuagu

SEQ ID NO: 1078791 - RNA, 23 nt, Human
uuucaucauguugcucaggcugg

SEQ ID NO: 1078792 - RNA, 20 nt, Human
uuuuguauuuuuaguaaaga

SEQ ID NO: 1078793 - RNA, 24 nt, Human
uuuuuaguaaagacggaguuucau

SEQ ID NO: 1078794 - RNA, 24 nt, Human
uuuuuaguagagacauaguuucac

SEQ ID NO: 1078795 - RNA, 21 nt, Human
uuuuuguauuuuuaguagaga

SEQ ID NO: 1078796 - RNA, 24 nt, Human
uuuuuuguauuuuuaguagagaca

SEQ ID NO: 1078797 - RNA, 19 nt, Human
aaagcgccuuugucuuccg

SEQ ID NO: 1078798 - RNA, 20 nt, Human
aacagugcacauuuaaccca

SEQ ID NO: 1078799 - RNA, 24 nt, Human
aggaaaauuuguauuauuuuaauu

SEQ ID NO: 1078800 - RNA, 18 nt, Human
caaugcgagccacagacu

SEQ ID NO: 1078801 - RNA, 22 nt, Human
ccagcuuagccaaagcgccuuu

SEQ ID NO: 1078802 - RNA, 18 nt, Human
gcaaugcgagccacagac

SEQ ID NO: 1078803 - RNA, 21 nt, Human
uaggacccaggauguugccac

SEQ ID NO: 1078804 - RNA, 21 nt, Human
ugauagcuuccaccagcuuag

SEQ ID NO: 1078805 - RNA, 18 nt, Human
uguacagaaaacucaaca

SEQ ID NO: 1078806 - RNA, 19 nt, Human
uuagccaaagcgccuuugu

SEQ ID NO: 1078807 - RNA, 24 nt, Human
uuucuuugaaggaaaauuuguauu

SEQ ID NO: 1078808 - RNA, 19 nt, Human
uuuuuuuucuuugaaggaa

SEQ ID NO: 1078809 - RNA, 18 nt, Human
uuuuuuuuuuuuucuuug

SEQ ID NO: 1078810 - RNA, 22 nt, Human
uuuuuuuuuuuuucuuugaagg

SEQ ID NO: 1078811 - RNA, 25 nt, Human
aaaaaaaaacucuucucuuugcaga

SEQ ID NO: 1078812 - RNA, 19 nt, Human
aaaaauaccccaagccaga

SEQ ID NO: 1078813 - RNA, 21 nt, Human
aacaguaaagaggaaaaucac

SEQ ID NO: 1078814 - RNA, 23 nt, Human
aagaagcccaacaguaaagagga

SEQ ID NO: 1078815 - RNA, 19 nt, Human
aagaaggaaucacaaucaa

SEQ ID NO: 1078816 - RNA, 21 nt, Human
aagagugacccugauguacac

SEQ ID NO: 1078817 - RNA, 19 nt, Human
aagccagagcagcagaaga

SEQ ID NO: 1078818 - RNA, 22 nt, Human
aauacuccucaaaagcccccac

SEQ ID NO: 1078819 - RNA, 24 nt, Human
aauacuccucaaaagcccccacaa

SEQ ID NO: 1078820 - RNA, 19 nt, Human
agaagcccaacaguaaaga

SEQ ID NO: 1078821 - RNA, 19 nt, Human
agacaaaaauaccccaagc

SEQ ID NO: 1078822 - RNA, 21 nt, Human
agacaagaaggaaucacaauc

SEQ ID NO: 1078823 - RNA, 26 nt, Human
agacaagaaggaaucacaaucaaugg

SEQ ID NO: 1078824 - RNA, 18 nt, Human
agagccauccaggagccu

SEQ ID NO: 1078825 - RNA, 18 nt, Human
agagcugauccuccagga

SEQ ID NO: 1078826 - RNA, 23 nt, Human
agcagcagaagagugacccugau

SEQ ID NO: 1078827 - RNA, 20 nt, Human
agccugacaguagccagaaa

SEQ ID NO: 1078828 - RNA, 21 nt, Human
agggauguacuaacauuucug

SEQ ID NO: 1078829 - RNA, 22 nt, Human
aggugucuagaaaccaagagcu

SEQ ID NO: 1078830 - RNA, 21 nt, Human
aguagccagaaauagacaaaa

SEQ ID NO: 1078831 - RNA, 18 nt, Human
auguuaagaauaaccugc

SEQ ID NO: 1078832 - RNA, 21 nt, Human
caaagagacuaaaguguaaua

SEQ ID NO: 1078833 - RNA, 22 nt, Human
caaccagagacucaggggcacc

SEQ ID NO: 1078834 - RNA, 19 nt, Human
caagccagagcagcagaag

SEQ ID NO: 1078835 - RNA, 20 nt, Human
caauggcaaaaaaaaaaacu

SEQ ID NO: 1078836 - RNA, 18 nt, Human
cacaacaagcacugaaca

SEQ ID NO: 1078837 - RNA, 19 nt, Human
cacaacaagcacugaacac

SEQ ID NO: 1078838 - RNA, 24 nt, Human
cacaaccagagacucaggggcacc

SEQ ID NO: 1078839 - RNA, 26 nt, Human
cagaaauagacaaaaauaccccaagc

SEQ ID NO: 1078840 - RNA, 22 nt, Human
cagagacucaggggcacccucc

SEQ ID NO: 1078841 - RNA, 21 nt, Human
cagccugacaguagccagaaa

SEQ ID NO: 1078842 - RNA, 20 nt, Human
caggagccuuugcacuucug

SEQ ID NO: 1078843 - RNA, 20 nt, Human
caguaaagaggaaaaucaca

SEQ ID NO: 1078844 - RNA, 19 nt, Human
cauaagaagcccaacagua

SEQ ID NO: 1078845 - RNA, 24 nt, Human
cauguuaagaauaaccugcacuua

SEQ ID NO: 1078846 - RNA, 20 nt, Human
cauuucugcugcaaagagag

SEQ ID NO: 1078847 - RNA, 24 nt, Human
ccaacaguaaagaggaaaauccua

SEQ ID NO: 1078848 - RNA, 22 nt, Human
ccaagccagagcagcagaagag

SEQ ID NO: 1078849 - RNA, 21 nt, Human
ccacaacaagcacugaacaca

SEQ ID NO: 1078850 - RNA, 21 nt, Human
ccacaacaagcacugaacacu

SEQ ID NO: 1078851 - RNA, 23 nt, Human
ccagaaauagacaaaaauacccc

SEQ ID NO: 1078852 - RNA, 19 nt, Human
ccagaacauugucguagau

SEQ ID NO: 1078853 - RNA, 19 nt, Human
ccccacaacaagcacugaa

SEQ ID NO: 1078854 - RNA, 21 nt, Human
cccccacaacaagcacugaac

SEQ ID NO: 1078855 - RNA, 24 nt, Human
cccugauguacacuagggucccau

SEQ ID NO: 1078856 - RNA, 19 nt, Human
cguaaccaugauaguaaca

SEQ ID NO: 1078857 - RNA, 22 nt, Human
cuaaaguguaauaauucaugga

SEQ ID NO: 1078858 - RNA, 25 nt, Human
cugaacacaaccagagacucagggg

SEQ ID NO: 1078859 - RNA, 18 nt, Human
cugccccugcugaucacc

SEQ ID NO: 1078860 - RNA, 18 nt, Human
cugccccugcugaucacc

SEQ ID NO: 1078861 - RNA, 26 nt, Human
gaacacaaccagagacucaggggcac

SEQ ID NO: 1078862 - RNA, 20 nt, Human
gaauauuaaauuagagacau

SEQ ID NO: 1078863 - RNA, 22 nt, Human
gagggaaagauguagcuucagu

SEQ ID NO: 1078864 - RNA, 26 nt, Human
gccagagcagcagaagagugacccug

SEQ ID NO: 1078865 - RNA, 25 nt, Human
gcccccacaacaagcacugaacaca

SEQ ID NO: 1078866 - RNA, 21 nt, Human
ggaugaagagcugauccucca

SEQ ID NO: 1078867 - RNA, 23 nt, Human
gggcacccuccacguaaccauga

SEQ ID NO: 1078868 - RNA, 18 nt, Human
gggucccauccacugcca

SEQ ID NO: 1078869 - RNA, 24 nt, Human
uaagaagcccaacaguaaagagga

SEQ ID NO: 1078870 - RNA, 20 nt, Human
uacacuagggucccauccac

SEQ ID NO: 1078871 - RNA, 19 nt, Human
uaccccaagccagagcagc

SEQ ID NO: 1078872 - RNA, 29 nt, Human
uacuuuguaaaccagguguucaaaugugg

SEQ ID NO: 1078873 - RNA, 21 nt, Human
uagggucccauccacugccau

SEQ ID NO: 1078874 - RNA, 24 nt, Human
uaggugaacacugggaggugucua

SEQ ID NO: 1078875 - RNA, 23 nt, Human
ucaaaagcccccacaacaagcac

SEQ ID NO: 1078876 - RNA, 19 nt, Human
ucaauggcaaaaaaaaaaa

SEQ ID NO: 1078877 - RNA, 23 nt, Human
ucugugcuggcaguagggcgggg

SEQ ID NO: 1078878 - RNA, 23 nt, Human
ucuuaaccugaugaaugagccuu

SEQ ID NO: 1078879 - RNA, 21 nt, Human
ugaacacaaccagagacucag

SEQ ID NO: 1078880 - RNA, 19 nt, Human
ugaagagcugauccuccag

SEQ ID NO: 1078881 - RNA, 21 nt, Human
ugacaauguuugugguacuga

SEQ ID NO: 1078882 - RNA, 22 nt, Human
ugaugaaugagccuuaguuucu

SEQ ID NO: 1078883 - RNA, 23 nt, Human
uggaauauuaaauuagagacauu

SEQ ID NO: 1078884 - RNA, 20 nt, Human
ugggaccagaacauugucgu

SEQ ID NO: 1078885 - RNA, 23 nt, Human
ugggagggcccagccugacagua

SEQ ID NO: 1078886 - RNA, 24 nt, Human
uguaggugaacacugggagguguc

SEQ ID NO: 1078887 - RNA, 21 nt, Human
ugucuagaaaccaagagcuuc

SEQ ID NO: 1078888 - RNA, 25 nt, Human
uuaauacuccucaaaagcccccaca

SEQ ID NO: 1078889 - RNA, 20 nt, Human
uucagggauguacuaacauu

SEQ ID NO: 1078890 - RNA, 21 nt, Human
uuucagggauguacuaacauu

SEQ ID NO: 1078891 - RNA, 23 nt, Human
aaaaaggaaaacagcaucccgga

SEQ ID NO: 1078892 - RNA, 23 nt, Human
aaagauaaggguuggggcccagg

SEQ ID NO: 1078893 - RNA, 19 nt, Human
aacaucugccaucccugcu

SEQ ID NO: 1078894 - RNA, 19 nt, Human
aaccccgcaucuguaaaau

SEQ ID NO: 1078895 - RNA, 18 nt, Human
aaggguuggggcccagga

SEQ ID NO: 1078896 - RNA, 22 nt, Human
agaaacaaaaaaggaaaacagc

SEQ ID NO: 1078897 - RNA, 22 nt, Human
aggcuuccagccaucaagcagu

SEQ ID NO: 1078898 - RNA, 19 nt, Human
caccuaaacugugaugacu

SEQ ID NO: 1078899 - RNA, 23 nt, Human
ccgcaucuguaaaaucgcuagcc

SEQ ID NO: 1078900 - RNA, 22 nt, Human
cgcggcgggggcccaauccgcu

SEQ ID NO: 1078901 - RNA, 25 nt, Human
cgcuagccgcaccuaaacugugaug

SEQ ID NO: 1078902 - RNA, 25 nt, Human
cuaaccccgcaucuguaaaaucgcu

SEQ ID NO: 1078903 - RNA, 25 nt, Human
cugccaucccugcuaagaaacaaaa

SEQ ID NO: 1078904 - RNA, 21 nt, Human
cugcuaagaaacaaaaaagga

SEQ ID NO: 1078905 - RNA, 21 nt, Human
cuguaaaaucgcuagccgcac

SEQ ID NO: 1078906 - RNA, 24 nt, Human
gaaacaaaaaaggaaaacagcauc

SEQ ID NO: 1078907 - RNA, 23 nt, Human
gccgcaccuaaacugugaugacu

SEQ ID NO: 1078908 - RNA, 21 nt, Human
gcgcggcgggggcccaauccg

SEQ ID NO: 1078909 - RNA, 21 nt, Human
ggcguggcuggagcagggguu

SEQ ID NO: 1078910 - RNA, 23 nt, Human
ggguugggagagugggaggaugu

SEQ ID NO: 1078911 - RNA, 23 nt, Human
uaaacugugaugacuggaguuca

SEQ ID NO: 1078912 - RNA, 19 nt, Human
ucaaagcugggcuggaugc

SEQ ID NO: 1078913 - RNA, 23 nt, Human
ucuguucuacaaacaucugccau

SEQ ID NO: 1078914 - RNA, 22 nt, Human
ugacuggaguucacauaaaacc

SEQ ID NO: 1078915 - RNA, 21 nt, Human
ugauccagaggcggugaagcc

SEQ ID NO: 1078916 - RNA, 18 nt, Human
ugcacaggcacagaggca

SEQ ID NO: 1078917 - RNA, 23 nt, Human
ugcacaggcacagaggcagauac

SEQ ID NO: 1078918 - RNA, 26 nt, Human
ugcuaagaaacaaaaaaggaaaacag

SEQ ID NO: 1078919 - RNA, 19 nt, Human
uggagcagggguugggaga

SEQ ID NO: 1078920 - RNA, 23 nt, Human
uggcuggagcagggguugggaga

SEQ ID NO: 1078921 - RNA, 25 nt, Human
uguucuacaaacaucugccaucccu

SEQ ID NO: 1078922 - RNA, 22 nt, Human
uuggggcccaggacuguucaaa

SEQ ID NO: 1078923 - RNA, 22 nt, Human
cccugaccccagacgccgaccc

SEQ ID NO: 1078924 - RNA, 19 nt, Human
ccugaccccagacgccgac

SEQ ID NO: 1078925 - RNA, 20 nt, Human
ccugaccccagacgccgacc

SEQ ID NO: 1078926 - RNA, 24 nt, Human
cgcccugaccccagacgccgaccc

SEQ ID NO: 1078927 - RNA, 18 nt, Human
cggccucgggcugcuggg

SEQ ID NO: 1078928 - RNA, 19 nt, Human
cgggcaagugucccgcggc

SEQ ID NO: 1078929 - RNA, 19 nt, Human
cugugcgcgcccugacccc

SEQ ID NO: 1078930 - RNA, 21 nt, Human
gcccugaccccagacgccgac

SEQ ID NO: 1078931 - RNA, 22 nt, Human
guaauacgggcaagugucccgc

SEQ ID NO: 1078932 - RNA, 22 nt, Human
uacgggcaagugucccgcggcc

SEQ ID NO: 1078933 - RNA, 27 nt, Human
ucacuuuauuguacugucacccuuaau

SEQ ID NO: 1078934 - RNA, 21 nt, Human
ugaccccagacgccgacccuc

SEQ ID NO: 1078935 - RNA, 21 nt, Human
ugcgcgcccugaccccagacg

SEQ ID NO: 1078936 - RNA, 23 nt, Human
ugggcugugcgcgcccugacccc

SEQ ID NO: 1078937 - RNA, 18 nt, Human
uuccucuuucucgacccc

SEQ ID NO: 1078938 - RNA, 23 nt, Human
uuccucuuucucgacccccuccc

SEQ ID NO: 1078939 - RNA, 23 nt, Human
ucccuuuaaguuacgacgggaau

SEQ ID NO: 1078940 - RNA, 26 nt, Human
ugauguuuauuuuccgccaaucauuu

SEQ ID NO: 1078941 - RNA, 20 nt, Human
uuccguguugcuuaagagcc

SEQ ID NO: 1078942 - RNA, 22 nt, Human
acaguaauguuuuccaucugga

SEQ ID NO: 1078943 - RNA, 18 nt, Human
aggaaggaugaagauggc

SEQ ID NO: 1078944 - RNA, 18 nt, Human
caggaaggaugaagaugg

SEQ ID NO: 1078945 - RNA, 21 nt, Human
caggaaggaugaagauggcug

SEQ ID NO: 1078946 - RNA, 23 nt, Human
caggaaggaugaagauggcugug

SEQ ID NO: 1078947 - RNA, 23 nt, Human
cccucaucaggaaggaugaagau

SEQ ID NO: 1078948 - RNA, 23 nt, Human
cuccaagugcuucagcuugcccu

SEQ ID NO: 1078949 - RNA, 22 nt, Human
cugcgugacaguaauguuuucc

SEQ ID NO: 1078950 - RNA, 19 nt, Human
guacagacacgucuacgac

SEQ ID NO: 1078951 - RNA, 23 nt, Human
uggguacagacacgucuacgacc

SEQ ID NO: 1078952 - RNA, 23 nt, Human
aaaacaaacaaaacggaauaacc

SEQ ID NO: 1078953 - RNA, 23 nt, Human
aaaagcagacagugacuugcccc

SEQ ID NO: 1078954 - RNA, 22 nt, Human
aaaaucaaggugugagcagggc

SEQ ID NO: 1078955 - RNA, 19 nt, Human
aaauacaaaaauuagcugg

SEQ ID NO: 1078956 - RNA, 23 nt, Human
aaaucaaggugugagcagggcca

SEQ ID NO: 1078957 - RNA, 18 nt, Human
aacaaacaaaacggaaua

SEQ ID NO: 1078958 - RNA, 20 nt, Human
aacauggugaaacucugucu

SEQ ID NO: 1078959 - RNA, 21 nt, Human
aacauggugaaacucugucuc

SEQ ID NO: 1078960 - RNA, 18 nt, Human
aagagagaagucaguggc

SEQ ID NO: 1078961 - RNA, 23 nt, Human
aauagaccucaaauucugcugua

SEQ ID NO: 1078962 - RNA, 24 nt, Human
aaucgcuugaacccggcgggugga

SEQ ID NO: 1078963 - RNA, 25 nt, Human
acaaaacggaauaaccguucuuaac

SEQ ID NO: 1078964 - RNA, 19 nt, Human
acauggugaaacucugucu

SEQ ID NO: 1078965 - RNA, 21 nt, Human
accacguaugacaaauuuauu

SEQ ID NO: 1078966 - RNA, 24 nt, Human
acccgagguuaggaguucgagacc

SEQ ID NO: 1078967 - RNA, 18 nt, Human
acuucgcuccagccuggg

SEQ ID NO: 1078968 - RNA, 24 nt, Human
agcaccuguaaucccagcuacuug

SEQ ID NO: 1078969 - RNA, 24 nt, Human
agcacuuuggaaggcugagguggg

SEQ ID NO: 1078970 - RNA, 19 nt, Human
agcagcuggcagucccgca

SEQ ID NO: 1078971 - RNA, 22 nt, Human
agccuggccaacauggugaaac

SEQ ID NO: 1078972 - RNA, 24 nt, Human
agccuggccaacauggugaaacuc

SEQ ID NO: 1078973 - RNA, 20 nt, Human
agcuggacgugguggugagc

SEQ ID NO: 1078974 - RNA, 19 nt, Human
agcugugccaagccauagc

SEQ ID NO: 1078975 - RNA, 24 nt, Human
aggaagaagagaaguggcuuuugg

SEQ ID NO: 1078976 - RNA, 24 nt, Human
aggcaggagaaucgcuugaacccg

SEQ ID NO: 1078977 - RNA, 24 nt, Human
aggccacauuaggcugugaaugag

SEQ ID NO: 1078978 - RNA, 20 nt, Human
aggcugaggcaggagaaucg

SEQ ID NO: 1078979 - RNA, 24 nt, Human
aggcugaggcaggagaaucgcuug

SEQ ID NO: 1078980 - RNA, 19 nt, Human
aggcugagguggguggauc

SEQ ID NO: 1078981 - RNA, 22 nt, Human
agguggguggaucacccgaggu

SEQ ID NO: 1078982 - RNA, 24 nt, Human
aucucgucacuucgcuccagccug

SEQ ID NO: 1078983 - RNA, 18 nt, Human
augcaaccagccugugga

SEQ ID NO: 1078984 - RNA, 20 nt, Human
augcaaccagccuguggaag

SEQ ID NO: 1078985 - RNA, 20 nt, Human
auucuuuuucugaaugagug

SEQ ID NO: 1078986 - RNA, 25 nt, Human
auuggaaucaguuugcucucuaauu

SEQ ID NO: 1078987 - RNA, 21 nt, Human
auuggcccuguucaggucaca

SEQ ID NO: 1078988 - RNA, 24 nt, Human
caacauggugaaacucugucucua

SEQ ID NO: 1078989 - RNA, 22 nt, Human
caccaaagucugugaaugaugu

SEQ ID NO: 1078990 - RNA, 23 nt, Human
cacccgagguuaggaguucgaga

SEQ ID NO: 1078991 - RNA, 23 nt, Human
caccuguaaucccagcuacuugg

SEQ ID NO: 1078992 - RNA, 24 nt, Human
caccuguaaucccagcuacuuggg

SEQ ID NO: 1078993 - RNA, 23 nt, Human
cacgcugucaucccagcacuuug

SEQ ID NO: 1078994 - RNA, 18 nt, Human
cacugcauuuugcuguca

SEQ ID NO: 1078995 - RNA, 19 nt, Human
cacuucgcuccagccuggg

SEQ ID NO: 1078996 - RNA, 20 nt, Human
cacuucgcuccagccugggc

SEQ ID NO: 1078997 - RNA, 23 nt, Human
cacuucgcuccagccugggcaaa

SEQ ID NO: 1078998 - RNA, 18 nt, Human
cacuuuggaaggcugagg

SEQ ID NO: 1078999 - RNA, 23 nt, Human
cagagcagcugugccaagccaua

SEQ ID NO: 1079000 - RNA, 24 nt, Human
cagcacuuuggaaggcugaggugg

SEQ ID NO: 1079001 - RNA, 24 nt, Human
cagcuacuugggaggcugaggcag

SEQ ID NO: 1079002 - RNA, 23 nt, Human
cagcugcggccccuccgccuccu

SEQ ID NO: 1079003 - RNA, 24 nt, Human
cagcugcggccccuccgccuccua

SEQ ID NO: 1079004 - RNA, 20 nt, Human
cagguacagcuggcuccagg

SEQ ID NO: 1079005 - RNA, 21 nt, Human
cauccagacauagucuguguc

SEQ ID NO: 1079006 - RNA, 19 nt, Human
ccagcaauucucugccuuc

SEQ ID NO: 1079007 - RNA, 24 nt, Human
ccagcaauucucugccuuccuugg

SEQ ID NO: 1079008 - RNA, 20 nt, Human
ccauggcacaugcaaccagc

SEQ ID NO: 1079009 - RNA, 24 nt, Human
ccauuaaguuggccccagucacau

SEQ ID NO: 1079010 - RNA, 22 nt, Human
cccgagguuaggaguucgagac

SEQ ID NO: 1079011 - RNA, 21 nt, Human
cccggcggguggagguugcag

SEQ ID NO: 1079012 - RNA, 19 nt, Human
ccugcaggccucgguuugc

SEQ ID NO: 1079013 - RNA, 20 nt, Human
ccuggccaacauggugaaac

SEQ ID NO: 1079014 - RNA, 24 nt, Human
ccuggccaacauggugaaacucug

SEQ ID NO: 1079015 - RNA, 21 nt, Human
ccuguaaucccagcuacuugg

SEQ ID NO: 1079016 - RNA, 24 nt, Human
cgagaccagccuggccaacauggu

SEQ ID NO: 1079017 - RNA, 24 nt, Human
cgcuccagccugggcaaaagagug

SEQ ID NO: 1079018 - RNA, 23 nt, Human
cgcugucaucccagcacuuugga

SEQ ID NO: 1079019 - RNA, 23 nt, Human
cucacgcugucaucccagcacuu

SEQ ID NO: 1079020 - RNA, 18 nt, Human
cucaucuuaucucauuca

SEQ ID NO: 1079021 - RNA, 20 nt, Human
cuccagccugggcaaaagag

SEQ ID NO: 1079022 - RNA, 20 nt, Human
cuccagccugggcaaaagag

SEQ ID NO: 1079023 - RNA, 23 nt, Human
cuccagccugggcaaaagaguga

SEQ ID NO: 1079024 - RNA, 19 nt, Human
cucucccaguuuugaaagc

SEQ ID NO: 1079025 - RNA, 23 nt, Human
cugcagugacuccacucucugcc

SEQ ID NO: 1079026 - RNA, 24 nt, Human
cuggccaacauggugaaacucugu

SEQ ID NO: 1079027 - RNA, 21 nt, Human
cuguaaucccagcuacuuggg

SEQ ID NO: 1079028 - RNA, 18 nt, Human
cuuggccagguguggugg

SEQ ID NO: 1079029 - RNA, 22 nt, Human
cuuuuggggagcagcuggcagu

SEQ ID NO: 1079030 - RNA, 20 nt, Human
gaaaagcagacagugacuug

SEQ ID NO: 1079031 - RNA, 22 nt, Human
gaaacaauuucaaacugucuua

SEQ ID NO: 1079032 - RNA, 19 nt, Human
gaaacucugucucuacuaa

SEQ ID NO: 1079033 - RNA, 22 nt, Human
gacuccacucucugccugcauc

SEQ ID NO: 1079034 - RNA, 22 nt, Human
gagguugcagugagccaagauc

SEQ ID NO: 1079035 - RNA, 24 nt, Human
gaucacccgagguuaggaguucga

SEQ ID NO: 1079036 - RNA, 21 nt, Human
gcagugacuccacucucugcc

SEQ ID NO: 1079037 - RNA, 24 nt, Human
gccaacauggugaaacucugucuc

SEQ ID NO: 1079038 - RNA, 25 nt, Human
ggaagaagagaaguggcuuuugggg

SEQ ID NO: 1079039 - RNA, 24 nt, Human
ggacgugguggugagcaccuguaa

SEQ ID NO: 1079040 - RNA, 27 nt, Human
ggaggcucuagaggaaaauuuuuccuu

SEQ ID NO: 1079041 - RNA, 18 nt, Human
ggagguugcagugagcca

SEQ ID NO: 1079042 - RNA, 20 nt, Human
ggagguugcagugagccaag

SEQ ID NO: 1079043 - RNA, 21 nt, Human
ggccaggugugguggcucacg

SEQ ID NO: 1079044 - RNA, 18 nt, Human
ggccauggcacaugcaac

SEQ ID NO: 1079045 - RNA, 20 nt, Human
ggcucacgcugucaucccag

SEQ ID NO: 1079046 - RNA, 18 nt, Human
gggagcagcuggcagucc

SEQ ID NO: 1079047 - RNA, 19 nt, Human
gggcaaccaguuuugugcc

SEQ ID NO: 1079048 - RNA, 19 nt, Human
gguggagguugcagugagc

SEQ ID NO: 1079049 - RNA, 23 nt, Human
gguggagguugcagugagccaag

SEQ ID NO: 1079050 - RNA, 24 nt, Human
gguggugagcaccuguaaucccag

SEQ ID NO: 1079051 - RNA, 19 nt, Human
gucucuacuaaaaauacaa

SEQ ID NO: 1079052 - RNA, 19 nt, Human
gugacuccacucucugccu

SEQ ID NO: 1079053 - RNA, 22 nt, Human
guggcucacgcugucaucccag

SEQ ID NO: 1079054 - RNA, 23 nt, Human
guggcucacgcugucaucccagc

SEQ ID NO: 1079055 - RNA, 19 nt, Human
guggcuuuuggggagcagc

SEQ ID NO: 1079056 - RNA, 23 nt, Human
guggugagcaccuguaaucccag

SEQ ID NO: 1079057 - RNA, 22 nt, Human
guuugcucucuaauucuuccac

SEQ ID NO: 1079058 - RNA, 24 nt, Human
guuuugugccugccuaguuucagg

SEQ ID NO: 1079059 - RNA, 20 nt, Human
uaaaacaccaaagucuguga

SEQ ID NO: 1079060 - RNA, 21 nt, Human
uaaaacaccaaagucugugaa

SEQ ID NO: 1079061 - RNA, 21 nt, Human
uaacagcucagacuauaacac

SEQ ID NO: 1079062 - RNA, 22 nt, Human
uaacccaucaguggcugcauca

SEQ ID NO: 1079063 - RNA, 28 nt, Human
uagaccucaaauucugcuguaacagcuc

SEQ ID NO: 1079064 - RNA, 18 nt, Human
uagcuggacgugguggug

SEQ ID NO: 1079065 - RNA, 19 nt, Human
uaggaauauuuuuguuuga

SEQ ID NO: 1079066 - RNA, 24 nt, Human
uaggcaaggcuaaguugcuaugac

SEQ ID NO: 1079067 - RNA, 24 nt, Human
uauugcucucauaauaccaaacua

SEQ ID NO: 1079068 - RNA, 27 nt, Human
uauuucaaaaaacaaacaaaacggaau

SEQ ID NO: 1079069 - RNA, 20 nt, Human
ucacccgagguuaggaguuc

SEQ ID NO: 1079070 - RNA, 20 nt, Human
ucacuucgcuccagccuggg

SEQ ID NO: 1079071 - RNA, 21 nt, Human
ucacuucgcuccagccugggc

SEQ ID NO: 1079072 - RNA, 21 nt, Human
ucccagcugcggccccuccgc

SEQ ID NO: 1079073 - RNA, 24 nt, Human
ucgcuugaacccggcggguggagg

SEQ ID NO: 1079074 - RNA, 27 nt, Human
ucucacuuugucucuguaaggucggac

SEQ ID NO: 1079075 - RNA, 22 nt, Human
ucucccaguuuugaaagccaga

SEQ ID NO: 1079076 - RNA, 21 nt, Human
ucucuacuaaaaauacaaaaa

SEQ ID NO: 1079077 - RNA, 22 nt, Human
ugaaagccagaagaccaaaauc

SEQ ID NO: 1079078 - RNA, 23 nt, Human
ugaagcuauauuucaaaaaacaa

SEQ ID NO: 1079079 - RNA, 18 nt, Human
ugacaaauagaccucaaa

SEQ ID NO: 1079080 - RNA, 22 nt, Human
ugacaaauagaccucaaauucu

SEQ ID NO: 1079081 - RNA, 22 nt, Human
ugacaaauuuauucucucccag

SEQ ID NO: 1079082 - RNA, 23 nt, Human
ugacuugcccacuucuucccagc

SEQ ID NO: 1079083 - RNA, 19 nt, Human
ugagaagguagggucagcu

SEQ ID NO: 1079084 - RNA, 20 nt, Human
ugaggcaggagaaucgcuug

SEQ ID NO: 1079085 - RNA, 24 nt, Human
ugaggcaggagaaucgcuugaacc

SEQ ID NO: 1079086 - RNA, 25 nt, Human
ugaggcaggagaaucgcuugaaccc

SEQ ID NO: 1079087 - RNA, 20 nt, Human
ugagguggguggaucacccg

SEQ ID NO: 1079088 - RNA, 21 nt, Human
ugagguggguggaucacccga

SEQ ID NO: 1079089 - RNA, 24 nt, Human
ugagguggguggaucacccgaggu

SEQ ID NO: 1079090 - RNA, 22 nt, Human
ugccaagccauagccuucagca

SEQ ID NO: 1079091 - RNA, 23 nt, Human
ugccccaggccauggcacaugca

SEQ ID NO: 1079092 - RNA, 19 nt, Human
ugcggccccuccgccuccc

SEQ ID NO: 1079093 - RNA, 25 nt, Human
ugcggccccuccgccuccuacacga

SEQ ID NO: 1079094 - RNA, 20 nt, Human
uggaaggcugaggugggugg

SEQ ID NO: 1079095 - RNA, 23 nt, Human
uggaaggcugagguggguggauc

SEQ ID NO: 1079096 - RNA, 24 nt, Human
uggaaggcugagguggguggauca

SEQ ID NO: 1079097 - RNA, 21 nt, Human
uggaagggaaaagaaaagcag

SEQ ID NO: 1079098 - RNA, 23 nt, Human
uggaagggaaaagaaaagcagac

SEQ ID NO: 1079099 - RNA, 24 nt, Human
uggaucacccgagguuaggaguuc

SEQ ID NO: 1079100 - RNA, 24 nt, Human
uggccaacauggugaaacucuguc

SEQ ID NO: 1079101 - RNA, 24 nt, Human
uggccaggugugguggcucacgcu

SEQ ID NO: 1079102 - RNA, 21 nt, Human
uggcucacgcugucaucccag

SEQ ID NO: 1079103 - RNA, 23 nt, Human
uggcucacgcugucaucccagca

SEQ ID NO: 1079104 - RNA, 19 nt, Human
ugggaggcugaggcaggag

SEQ ID NO: 1079105 - RNA, 23 nt, Human
ugggaggcugaggcaggagaauc

SEQ ID NO: 1079106 - RNA, 23 nt, Human
ugggcaaaaacaggaccacaggc

SEQ ID NO: 1079107 - RNA, 24 nt, Human
uggguggaucacccgagguuagga

SEQ ID NO: 1079108 - RNA, 23 nt, Human
ugguggcucacgcugucauccca

SEQ ID NO: 1079109 - RNA, 24 nt, Human
ugguggugagcaccuguaauccca

SEQ ID NO: 1079110 - RNA, 18 nt, Human
uuagcuggacgugguggu

SEQ ID NO: 1079111 - RNA, 23 nt, Human
uugaaagccagaagaccaaaauc

SEQ ID NO: 1079112 - RNA, 24 nt, Human
uugaacccggcggguggagguugc

SEQ ID NO: 1079113 - RNA, 21 nt, Human
uugcagugagccaagaucucg

SEQ ID NO: 1079114 - RNA, 19 nt, Human
uuggaaggcugaggugggu

SEQ ID NO: 1079115 - RNA, 25 nt, Human
uuggaaggcugagguggguggauca

SEQ ID NO: 1079116 - RNA, 24 nt, Human
uugggaggcugaggcaggagaauc

SEQ ID NO: 1079117 - RNA, 22 nt, Human
uuguagcgggaugggcaaccag

SEQ ID NO: 1079118 - RNA, 20 nt, Human
uuuuuguuugaauguaacag

SEQ ID NO: 1079119 - RNA, 22 nt, Human
agaaaguugcaccuuggccucc

SEQ ID NO: 1079120 - RNA, 19 nt, Human
ccuccuccaagccgaaagc

SEQ ID NO: 1079121 - RNA, 22 nt, Human
gccuccuccaagccgaaagccg

SEQ ID NO: 1079122 - RNA, 22 nt, Human
ucaccaguugucaaaugauucu

SEQ ID NO: 1079123 - RNA, 24 nt, Human
aaagugcugggauuacaggcguga

SEQ ID NO: 1079124 - RNA, 19 nt, Human
aagugcugggauuacaggc

SEQ ID NO: 1079125 - RNA, 19 nt, Human
aagugcugggauuacaggc

SEQ ID NO: 1079126 - RNA, 26 nt, Human
aagugcugggauuacaggcgugagcc

SEQ ID NO: 1079127 - RNA, 25 nt, Human
acccgccucggccucccaaagugcu

SEQ ID NO: 1079128 - RNA, 18 nt, Human
acgggguuucaccuuguu

SEQ ID NO: 1079129 - RNA, 20 nt, Human
acgggguuucaccuuguuag

SEQ ID NO: 1079130 - RNA, 20 nt, Human
acugcaguggcgcaaucucg

SEQ ID NO: 1079131 - RNA, 24 nt, Human
acugcaguggcgcaaucucggcuc

SEQ ID NO: 1079132 - RNA, 20 nt, Human
aguagagacgggguuucacc

SEQ ID NO: 1079133 - RNA, 18 nt, Human
aguagcugggacuacagg

SEQ ID NO: 1079134 - RNA, 24 nt, Human
augauccacccgccucggccuccc

SEQ ID NO: 1079135 - RNA, 24 nt, Human
caaagugcugggauuacaggcgug

SEQ ID NO: 1079136 - RNA, 23 nt, Human
cacccgccucggccucccaaagu

SEQ ID NO: 1079137 - RNA, 24 nt, Human
caccuuguuagccaggauggucuc

SEQ ID NO: 1079138 - RNA, 22 nt, Human
cacgccauucuccugccucagc

SEQ ID NO: 1079139 - RNA, 21 nt, Human
caggcgcccgccaccgcgccc

SEQ ID NO: 1079140 - RNA, 22 nt, Human
ccaaagugcugggauuacaggc

SEQ ID NO: 1079141 - RNA, 22 nt, Human
ccaaagugcugggauuacaggc

SEQ ID NO: 1079142 - RNA, 24 nt, Human
ccaaagugcugggauuacaggcgu

SEQ ID NO: 1079143 - RNA, 23 nt, Human
cccgaguagcugggacuacaggc

SEQ ID NO: 1079144 - RNA, 24 nt, Human
cccgaguagcugggacuacaggcg

SEQ ID NO: 1079145 - RNA, 20 nt, Human
ccugaccucaugauccaccc

SEQ ID NO: 1079146 - RNA, 23 nt, Human
ccugccucagccucccgaguagc

SEQ ID NO: 1079147 - RNA, 21 nt, Human
cgcccaggccggacugcggac

SEQ ID NO: 1079148 - RNA, 24 nt, Human
cgccucggccucccaaagugcugg

SEQ ID NO: 1079149 - RNA, 19 nt, Human
cgcucugucgcccaggccg

SEQ ID NO: 1079150 - RNA, 24 nt, Human
cgggguuucaccuuguuagccagg

SEQ ID NO: 1079151 - RNA, 24 nt, Human
cucagccucccgaguagcugggac

SEQ ID NO: 1079152 - RNA, 24 nt, Human
cuccugaccucaugauccacccgc

SEQ ID NO: 1079153 - RNA, 22 nt, Human
cuccugccucagccucccgagu

SEQ ID NO: 1079154 - RNA, 23 nt, Human
cucugucgcccaggccggacugc

SEQ ID NO: 1079155 - RNA, 23 nt, Human
cugccucagccucccgaguagcu

SEQ ID NO: 1079156 - RNA, 22 nt, Human
gaccucaugauccacccgccuc

SEQ ID NO: 1079157 - RNA, 20 nt, Human
gagacgggguuucaccuugu

SEQ ID NO: 1079158 - RNA, 20 nt, Human
gaguagcugggacuacaggc

SEQ ID NO: 1079159 - RNA, 25 nt, Human
gaguagcugggacuacaggcgcccg

SEQ ID NO: 1079160 - RNA, 18 nt, Human
gauuacaggcgugagcca

SEQ ID NO: 1079161 - RNA, 22 nt, Human
gauuacaggcgugagccaccgc

SEQ ID NO: 1079162 - RNA, 22 nt, Human
gauuacaggcgugagccaccgc

SEQ ID NO: 1079163 - RNA, 23 nt, Human
gcccggcuaauuuuuuguauuuu

SEQ ID NO: 1079164 - RNA, 21 nt, Human
gccggacugcggacugcagug

SEQ ID NO: 1079165 - RNA, 25 nt, Human
gcuucccggguucacgccauucucc

SEQ ID NO: 1079166 - RNA, 20 nt, Human
ggucucgaucuccugaccuc

SEQ ID NO: 1079167 - RNA, 24 nt, Human
uaauuuuuuguauuuuuaguagag

SEQ ID NO: 1079168 - RNA, 25 nt, Human
uaauuuuuuguauuuuuaguagaga

SEQ ID NO: 1079169 - RNA, 23 nt, Human
uacaggcgugagccaccgcgccc

SEQ ID NO: 1079170 - RNA, 24 nt, Human
uaguagagacgggguuucaccuug

SEQ ID NO: 1079171 - RNA, 26 nt, Human
uaguagagacgggguuucaccuuguu

SEQ ID NO: 1079172 - RNA, 24 nt, Human
ucaccuuguuagccaggauggucu

SEQ ID NO: 1079173 - RNA, 23 nt, Human
ucacugcaagcuccgcuucccgg

SEQ ID NO: 1079174 - RNA, 24 nt, Human
ucacugcaagcuccgcuucccggg

SEQ ID NO: 1079175 - RNA, 23 nt, Human
ucagccucccgaguagcugggac

SEQ ID NO: 1079176 - RNA, 24 nt, Human
ucccaaagugcugggauuacaggc

SEQ ID NO: 1079177 - RNA, 24 nt, Human
ucccgaguagcugggacuacaggc

SEQ ID NO: 1079178 - RNA, 20 nt, Human
ucccggguucacgccauucu

SEQ ID NO: 1079179 - RNA, 21 nt, Human
ucccggguucacgccauucuc

SEQ ID NO: 1079180 - RNA, 24 nt, Human
ucccggguucacgccauucuccug

SEQ ID NO: 1079181 - RNA, 18 nt, Human
ucggccucccaaagugcu

SEQ ID NO: 1079182 - RNA, 18 nt, Human
ucucgcucugucgcccag

SEQ ID NO: 1079183 - RNA, 19 nt, Human
ucucgcucugucgcccagg

SEQ ID NO: 1079184 - RNA, 24 nt, Human
ucucgcucugucgcccaggccgga

SEQ ID NO: 1079185 - RNA, 23 nt, Human
ugaccucaugauccacccgccuc

SEQ ID NO: 1079186 - RNA, 22 nt, Human
ugagacggagucucgcucuguc

SEQ ID NO: 1079187 - RNA, 23 nt, Human
ugcaguggcgcaaucucggcuca

SEQ ID NO: 1079188 - RNA, 24 nt, Human
ugccucagccucccgaguagcugg

SEQ ID NO: 1079189 - RNA, 24 nt, Human
ugcugggauuacaggcgugagcca

SEQ ID NO: 1079190 - RNA, 21 nt, Human
ugggacuacaggcgcccgcca

SEQ ID NO: 1079191 - RNA, 22 nt, Human
ugggacuacaggcgcccgccac

SEQ ID NO: 1079192 - RNA, 23 nt, Human
ugggacuacaggcgcccgccacc

SEQ ID NO: 1079193 - RNA, 24 nt, Human
ugggacuacaggcgcccgccaccg

SEQ ID NO: 1079194 - RNA, 18 nt, Human
ugggauuacaggcgugag

SEQ ID NO: 1079195 - RNA, 19 nt, Human
ugggauuacaggcgugagc

SEQ ID NO: 1079196 - RNA, 21 nt, Human
ugggauuacaggcgugagcca

SEQ ID NO: 1079197 - RNA, 22 nt, Human
ugggauuacaggcgugagccac

SEQ ID NO: 1079198 - RNA, 23 nt, Human
ugggauuacaggcgugagccacc

SEQ ID NO: 1079199 - RNA, 24 nt, Human
ugggauuacaggcgugagccaccg

SEQ ID NO: 1079200 - RNA, 21 nt, Human
uguauuuuuaguagagacggg

SEQ ID NO: 1079201 - RNA, 22 nt, Human
uuaguagagacgggguuucacc

SEQ ID NO: 1079202 - RNA, 24 nt, Human
uuaguagagacgggguuucaccuu

SEQ ID NO: 1079203 - RNA, 25 nt, Human
uuaguagagacgggguuucaccuug

SEQ ID NO: 1079204 - RNA, 23 nt, Human
uuguauuuuuaguagagacgggg

SEQ ID NO: 1079205 - RNA, 24 nt, Human
uuuuuaguagagacgggguuucac

SEQ ID NO: 1079206 - RNA, 21 nt, Human
uuuuuguauuuuuaguagaga

SEQ ID NO: 1079207 - RNA, 24 nt, Human
uuuuuuguauuuuuaguagagacg

SEQ ID NO: 1079208 - RNA, 18 nt, Human
acacugcacuccagccug

SEQ ID NO: 1079209 - RNA, 19 nt, Human
acacugcacuccagccugc

SEQ ID NO: 1079210 - RNA, 21 nt, Human
auauuugcuucccuucuccaa

SEQ ID NO: 1079211 - RNA, 21 nt, Human
cacuccagccugcacaaccaa

SEQ ID NO: 1079212 - RNA, 18 nt, Human
cacugcacuccagccugc

SEQ ID NO: 1079213 - RNA, 22 nt, Human
cacugcacuccagccugcacaa

SEQ ID NO: 1079214 - RNA, 25 nt, Human
cacugcacuccagccugcacaacca

SEQ ID NO: 1079215 - RNA, 21 nt, Human
ccugcacaaccaagcaagucu

SEQ ID NO: 1079216 - RNA, 18 nt, Human
uauaaaauuaauagauga

SEQ ID NO: 1079217 - RNA, 20 nt, Human
uccaaauuuggaaauauuuu

SEQ ID NO: 1079218 - RNA, 22 nt, Human
ugaauaauuuaucucuucucuc

SEQ ID NO: 1079219 - RNA, 18 nt, Human
uggaaauauuuuuugcua

SEQ ID NO: 1079220 - RNA, 21 nt, Human
uucaucuguaaaaucauggug

SEQ ID NO: 1079221 - RNA, 20 nt, Human
uuuuuugcuauuauuuugaa

SEQ ID NO: 1079222 - RNA, 22 nt, Human
cugaucaccgaauggaaacacu

SEQ ID NO: 1079223 - RNA, 19 nt, Human
aaacuugaagaccaaggcc

SEQ ID NO: 1079224 - RNA, 19 nt, Human
aaagugagaggucucuggu

SEQ ID NO: 1079225 - RNA, 24 nt, Human
acagggacucuuauuccuuaaaca

SEQ ID NO: 1079226 - RNA, 18 nt, Human
acauggccucuucucugc

SEQ ID NO: 1079227 - RNA, 21 nt, Human
acccaagccugaaacagggac

SEQ ID NO: 1079228 - RNA, 24 nt, Human
agaccaaggccaggauagauaaga

SEQ ID NO: 1079229 - RNA, 18 nt, Human
aggcacccaagccugaaa

SEQ ID NO: 1079230 - RNA, 19 nt, Human
aggcacccaagccugaaac

SEQ ID NO: 1079231 - RNA, 21 nt, Human
aggguugguucuuggugaggc

SEQ ID NO: 1079232 - RNA, 22 nt, Human
auaaaaggcaacuuuugugaca

SEQ ID NO: 1079233 - RNA, 21 nt, Human
augugcccagccccagcgggc

SEQ ID NO: 1079234 - RNA, 18 nt, Human
caaagcccccagggcuuc

SEQ ID NO: 1079235 - RNA, 22 nt, Human
cagaaauuggccaacagggaca

SEQ ID NO: 1079236 - RNA, 18 nt, Human
cagaagauggucaguggu

SEQ ID NO: 1079237 - RNA, 20 nt, Human
cagcagaagauggucagugg

SEQ ID NO: 1079238 - RNA, 18 nt, Human
caguagguguacucaggc

SEQ ID NO: 1079239 - RNA, 18 nt, Human
caucaguuauguccuaau

SEQ ID NO: 1079240 - RNA, 24 nt, Human
ccaacugguacucauuguucauca

SEQ ID NO: 1079241 - RNA, 20 nt, Human
ccagcgggcugauucugcau

SEQ ID NO: 1079242 - RNA, 19 nt, Human
cccagaaauuggccaacag

SEQ ID NO: 1079243 - RNA, 24 nt, Human
ccccagggcuucuuuaaaagaccc

SEQ ID NO: 1079244 - RNA, 21 nt, Human
cuagugcauuacgucuccaca

SEQ ID NO: 1079245 - RNA, 27 nt, Human
gaagacauagaguaauguuccguuucg

SEQ ID NO: 1079246 - RNA, 18 nt, Human
gacagcgcuaacagaguu

SEQ ID NO: 1079247 - RNA, 22 nt, Human
gcagaagauggucaguggucag

SEQ ID NO: 1079248 - RNA, 20 nt, Human
ggaaaucugagagaugugcc

SEQ ID NO: 1079249 - RNA, 21 nt, Human
uaaaagaccuugcccagaaau

SEQ ID NO: 1079250 - RNA, 18 nt, Human
uaacagaguuauguggua

SEQ ID NO: 1079251 - RNA, 20 nt, Human
uagguguacucaggcaccca

SEQ ID NO: 1079252 - RNA, 20 nt, Human
uauuccuuaaacagaagaca

SEQ ID NO: 1079253 - RNA, 22 nt, Human
ucugucuggaucuucauaagaa

SEQ ID NO: 1079254 - RNA, 19 nt, Human
ucuugcacaggagguccag

SEQ ID NO: 1079255 - RNA, 18 nt, Human
ugaaacuugaagaccaag

SEQ ID NO: 1079256 - RNA, 18 nt, Human
ugacaaagcccccagggc

SEQ ID NO: 1079257 - RNA, 18 nt, Human
ugagaggucucugguguc

SEQ ID NO: 1079258 - RNA, 22 nt, Human
ugagaggucucuggugucucuu

SEQ ID NO: 1079259 - RNA, 20 nt, Human
uggcaggguugguucuuggu

SEQ ID NO: 1079260 - RNA, 18 nt, Human
ugggcuggauccaguagg

SEQ ID NO: 1079261 - RNA, 22 nt, Human
uggucagucuccauccaacugg

SEQ ID NO: 1079262 - RNA, 20 nt, Human
uggugaggcuucuuccuggc

SEQ ID NO: 1079263 - RNA, 19 nt, Human
uguaacagugugacugguc

SEQ ID NO: 1079264 - RNA, 22 nt, Human
ugugacuggucauuucucaggu

SEQ ID NO: 1079265 - RNA, 25 nt, Human
uuaggagacagcagaagauggucag

SEQ ID NO: 1079266 - RNA, 24 nt, Human
uuagucugucuggaucuucauaag

SEQ ID NO: 1079267 - RNA, 19 nt, Human
uuucucaggugauguguuc

SEQ ID NO: 1079268 - RNA, 20 nt, Human
uuugugacaaagcccccagg

SEQ ID NO: 1079269 - RNA, 19 nt, Human
aaaauguccgugagucccc

SEQ ID NO: 1079270 - RNA, 18 nt, Human
acacgucaugugcguccc

SEQ ID NO: 1079271 - RNA, 23 nt, Human
acagccucuggacgacucauccu

SEQ ID NO: 1079272 - RNA, 20 nt, Human
accaggaucuccgucuccca

SEQ ID NO: 1079273 - RNA, 21 nt, Human
accuggcuccccgggcugcag

SEQ ID NO: 1079274 - RNA, 19 nt, Human
acgcauccugucucuuccc

SEQ ID NO: 1079275 - RNA, 19 nt, Human
acucuggaacccccugccu

SEQ ID NO: 1079276 - RNA, 18 nt, Human
acugagcagcugaucccc

SEQ ID NO: 1079277 - RNA, 20 nt, Human
agacaggugaagaccccugc

SEQ ID NO: 1079278 - RNA, 22 nt, Human
agcuguugcuguggccucuccu

SEQ ID NO: 1079279 - RNA, 23 nt, Human
aggaccccagcacggcccacccc

SEQ ID NO: 1079280 - RNA, 20 nt, Human
aggccucugacgagcugugu

SEQ ID NO: 1079281 - RNA, 23 nt, Human
aggcuaucaccccagggccccaa

SEQ ID NO: 1079282 - RNA, 21 nt, Human
auccugucucuucccucgcug

SEQ ID NO: 1079283 - RNA, 21 nt, Human
aucuguccuucugugucuucc

SEQ ID NO: 1079284 - RNA, 25 nt, Human
caccaggaucuccgucucccagcag

SEQ ID NO: 1079285 - RNA, 25 nt, Human
cacucuggaacccccugccuggcug

SEQ ID NO: 1079286 - RNA, 19 nt, Human
cacuggcuccugccuccac

SEQ ID NO: 1079287 - RNA, 21 nt, Human
cacuguagccacuggcuccug

SEQ ID NO: 1079288 - RNA, 23 nt, Human
cacuguagccacuggcuccugcc

SEQ ID NO: 1079289 - RNA, 22 nt, Human
caggcccuucagucacagagug

SEQ ID NO: 1079290 - RNA, 20 nt, Human
cauugagucacugucuucuu

SEQ ID NO: 1079291 - RNA, 21 nt, Human
ccacucuggaacccccugccu

SEQ ID NO: 1079292 - RNA, 23 nt, Human
cccaacucuuccaggaccccagc

SEQ ID NO: 1079293 - RNA, 19 nt, Human
cccaccccacucuggaacc

SEQ ID NO: 1079294 - RNA, 23 nt, Human
ccccagggccccaacucuuccag

SEQ ID NO: 1079295 - RNA, 22 nt, Human
ccccugugcuucugcaugugug

SEQ ID NO: 1079296 - RNA, 20 nt, Human
cccggcccugccuucugcuc

SEQ ID NO: 1079297 - RNA, 25 nt, Human
cccggcccugccuucugcucuuggc

SEQ ID NO: 1079298 - RNA, 19 nt, Human
cccggcuccuuccaccucc

SEQ ID NO: 1079299 - RNA, 21 nt, Human
cccggcuccuuccaccuccuc

SEQ ID NO: 1079300 - RNA, 18 nt, Human
cccugggcuuccucuggg

SEQ ID NO: 1079301 - RNA, 19 nt, Human
cccugucccgagccugucc

SEQ ID NO: 1079302 - RNA, 19 nt, Human
cccuucccugcucuguguc

SEQ ID NO: 1079303 - RNA, 19 nt, Human
ccgugagcugggccucugu

SEQ ID NO: 1079304 - RNA, 24 nt, Human
ccuccagggucuuuccauggagcc

SEQ ID NO: 1079305 - RNA, 19 nt, Human
ccucuggacgacucauccu

SEQ ID NO: 1079306 - RNA, 20 nt, Human
ccucuggacgacucauccug

SEQ ID NO: 1079307 - RNA, 21 nt, Human
ccucuggacgacucauccuga

SEQ ID NO: 1079308 - RNA, 18 nt, Human
ccucuggcugcccggccc

SEQ ID NO: 1079309 - RNA, 19 nt, Human
ccugaaaaauguccgugag

SEQ ID NO: 1079310 - RNA, 22 nt, Human
ccugccccuccagggucuuucc

SEQ ID NO: 1079311 - RNA, 24 nt, Human
ccuucacccucccggcucauucca

SEQ ID NO: 1079312 - RNA, 21 nt, Human
ccuuccaccuccucacccuuc

SEQ ID NO: 1079313 - RNA, 22 nt, Human
ccuuccaccuccucacccuuca

SEQ ID NO: 1079314 - RNA, 23 nt, Human
cgaaugcccucauccgcaggccc

SEQ ID NO: 1079315 - RNA, 23 nt, Human
cgaaugcccucauccgcaggccc

SEQ ID NO: 1079316 - RNA, 23 nt, Human
cgauuuccaggcucugcaguccc

SEQ ID NO: 1079317 - RNA, 19 nt, Human
cgccuucacccucccggcu

SEQ ID NO: 1079318 - RNA, 21 nt, Human
cggcagccucagucguguauu

SEQ ID NO: 1079319 - RNA, 21 nt, Human
cguggucgaaugcccucaucc

SEQ ID NO: 1079320 - RNA, 22 nt, Human
cucauccugaaaaauguccgug

SEQ ID NO: 1079321 - RNA, 24 nt, Human
cucgcuuccaccaggaucuccguc

SEQ ID NO: 1079322 - RNA, 21 nt, Human
cugcaugugugguugguuccc

SEQ ID NO: 1079323 - RNA, 20 nt, Human
cugcccggcccugccuucug

SEQ ID NO: 1079324 - RNA, 18 nt, Human
cugcccucuccucucucc

SEQ ID NO: 1079325 - RNA, 24 nt, Human
cugccgggggcgucuuccuggagu

SEQ ID NO: 1079326 - RNA, 19 nt, Human
cugccuggcuguccugucg

SEQ ID NO: 1079327 - RNA, 21 nt, Human
cugggcccugggcuuccucug

SEQ ID NO: 1079328 - RNA, 20 nt, Human
cugggccucugugucugugc

SEQ ID NO: 1079329 - RNA, 18 nt, Human
cuggugggccaaucugug

SEQ ID NO: 1079330 - RNA, 21 nt, Human
cugucucuucccucgcugugg

SEQ ID NO: 1079331 - RNA, 20 nt, Human
cuguggcagccccagucucc

SEQ ID NO: 1079332 - RNA, 21 nt, Human
cuguugcuguggccucuccuu

SEQ ID NO: 1079333 - RNA, 24 nt, Human
cuucccuucccugcucugugucuu

SEQ ID NO: 1079334 - RNA, 19 nt, Human
cuucugcaugugugguugg

SEQ ID NO: 1079335 - RNA, 19 nt, Human
cuuuaaaucguguacucgc

SEQ ID NO: 1079336 - RNA, 22 nt, Human
gaccccagcacggcccaccccc

SEQ ID NO: 1079337 - RNA, 19 nt, Human
gagcugggccucugugucu

SEQ ID NO: 1079338 - RNA, 19 nt, Human
gagcugugugaccucuggg

SEQ ID NO: 1079339 - RNA, 21 nt, Human
gcccugggcuuccucugggcc

SEQ ID NO: 1079340 - RNA, 22 nt, Human
gcucugugucuucuguggcuuu

SEQ ID NO: 1079341 - RNA, 23 nt, Human
ggcugggcccugggcuuccucug

SEQ ID NO: 1079342 - RNA, 21 nt, Human
gggcgucuuccuggagucccc

SEQ ID NO: 1079343 - RNA, 23 nt, Human
ggucuuuccauggagccuggcug

SEQ ID NO: 1079344 - RNA, 20 nt, Human
guggaaaaugcaaauuuugg

SEQ ID NO: 1079345 - RNA, 19 nt, Human
guggcagccccagucuccu

SEQ ID NO: 1079346 - RNA, 20 nt, Human
guggucgaaugcccucaucc

SEQ ID NO: 1079347 - RNA, 24 nt, Human
uaaggaggguaucuugaacuuggg

SEQ ID NO: 1079348 - RNA, 23 nt, Human
ucauccgcaggcccuucagucac

SEQ ID NO: 1079349 - RNA, 23 nt, Human
uccaccaggaucuccgucuccca

SEQ ID NO: 1079350 - RNA, 21 nt, Human
uccaggaccccagcacggccc

SEQ ID NO: 1079351 - RNA, 21 nt, Human
uccauggagccuggcugcccu

SEQ ID NO: 1079352 - RNA, 19 nt, Human
ucccgagccuguccugaau

SEQ ID NO: 1079353 - RNA, 19 nt, Human
ucccggcccccgcuugcuc

SEQ ID NO: 1079354 - RNA, 22 nt, Human
ucccuagguucguaggccucug

SEQ ID NO: 1079355 - RNA, 19 nt, Human
ucccucgccuucacccucc

SEQ ID NO: 1079356 - RNA, 18 nt, Human
uccucugggccacugcug

SEQ ID NO: 1079357 - RNA, 18 nt, Human
uccuggaguccaaagucg

SEQ ID NO: 1079358 - RNA, 19 nt, Human
uccugugccugccccucca

SEQ ID NO: 1079359 - RNA, 20 nt, Human
ucguagacaggugaagaccc

SEQ ID NO: 1079360 - RNA, 25 nt, Human
ucuccaucuccuucaucccccugug

SEQ ID NO: 1079361 - RNA, 20 nt, Human
ucucccagcagaaccuugcc

SEQ ID NO: 1079362 - RNA, 21 nt, Human
ucucccagcagaaccuugccu

SEQ ID NO: 1079363 - RNA, 18 nt, Human
ucuggcucuuuuucugug

SEQ ID NO: 1079364 - RNA, 23 nt, Human
ucugggccacugcugucuccugu

SEQ ID NO: 1079365 - RNA, 20 nt, Human
ucuguaguccuuccucucca

SEQ ID NO: 1079366 - RNA, 26 nt, Human
ucuguaguccuuccucuccaucuccu

SEQ ID NO: 1079367 - RNA, 21 nt, Human
ucuguccuucugugucuuccc

SEQ ID NO: 1079368 - RNA, 21 nt, Human
ucugucuucagcgucaccucu

SEQ ID NO: 1079369 - RNA, 24 nt, Human
ucugucuucagcgucaccucuguu

SEQ ID NO: 1079370 - RNA, 19 nt, Human
ucugugcgucucuguucuc

SEQ ID NO: 1079371 - RNA, 20 nt, Human
ucuguggcuuuuucucugcc

SEQ ID NO: 1079372 - RNA, 20 nt, Human
ucugugucuucccugcccuu

SEQ ID NO: 1079373 - RNA, 18 nt, Human
ucuucccugcccuugucc

SEQ ID NO: 1079374 - RNA, 20 nt, Human
ucuucccugcccuuguccug

SEQ ID NO: 1079375 - RNA, 23 nt, Human
ugaccucuggggucccggccccc

SEQ ID NO: 1079376 - RNA, 20 nt, Human
ugcaugugugguugguuccc

SEQ ID NO: 1079377 - RNA, 23 nt, Human
ugcccggcccugccuucugcucu

SEQ ID NO: 1079378 - RNA, 18 nt, Human
ugcccugagucccccuuc

SEQ ID NO: 1079379 - RNA, 18 nt, Human
ugcccuuguccuguuccu

SEQ ID NO: 1079380 - RNA, 22 nt, Human
ugccgggggcgucuuccuggag

SEQ ID NO: 1079381 - RNA, 23 nt, Human
ugccugccccuccagggucuuuc

SEQ ID NO: 1079382 - RNA, 19 nt, Human
uggaaaaugcaaauuuugg

SEQ ID NO: 1079383 - RNA, 23 nt, Human
uggaguccaaagucggcagccuc

SEQ ID NO: 1079384 - RNA, 18 nt, Human
uggcagccccagucuccu

SEQ ID NO: 1079385 - RNA, 20 nt, Human
uggccucuccuucccuuccc

SEQ ID NO: 1079386 - RNA, 20 nt, Human
uggccucuccuucccuuccc

SEQ ID NO: 1079387 - RNA, 20 nt, Human
uggcuccccgggcugcagcu

SEQ ID NO: 1079388 - RNA, 19 nt, Human
uggcuccugccuccaccuc

SEQ ID NO: 1079389 - RNA, 20 nt, Human
uggcugcccugagucccccu

SEQ ID NO: 1079390 - RNA, 20 nt, Human
ugggcaauggcaugcucuga

SEQ ID NO: 1079391 - RNA, 23 nt, Human
uguccuguuccucagugauccuu

SEQ ID NO: 1079392 - RNA, 21 nt, Human
ugucucuucccucgcuguggg

SEQ ID NO: 1079393 - RNA, 21 nt, Human
ugugugccuccuucgguugug

SEQ ID NO: 1079394 - RNA, 20 nt, Human
uuccaggcucugcagucccu

SEQ ID NO: 1079395 - RNA, 22 nt, Human
uuccucagugauccuuguccuc

SEQ ID NO: 1079396 - RNA, 20 nt, Human
uuccugagggguucccucgc

SEQ ID NO: 1079397 - RNA, 20 nt, Human
uucguaggccucugacgagc

SEQ ID NO: 1079398 - RNA, 26 nt, Human
uucuguggcuuuuucucugccugucu

SEQ ID NO: 1079399 - RNA, 23 nt, Human
uucugugucuucccugcccuugu

SEQ ID NO: 1079400 - RNA, 21 nt, Human
uugaggaacuuccgccuccuc

SEQ ID NO: 1079401 - RNA, 27 nt, Human
uuggcggcugaggaguccuucagcacu

SEQ ID NO: 1079402 - RNA, 20 nt, Human
uuggugucuuuaaaucgugu

SEQ ID NO: 1079403 - RNA, 24 nt, Human
uugucauugagucacugucuucuu

SEQ ID NO: 1079404 - RNA, 31 nt, Human
uuucuggugggccaaucugugugccuccuuc

SEQ ID NO: 1079405 - RNA, 20 nt, Human
aacaugguccugguucccuc

SEQ ID NO: 1079406 - RNA, 21 nt, Human
aacgggccaggcccgcccagg

SEQ ID NO: 1079407 - RNA, 25 nt, Human
accccucccaggcccuugagaguug

SEQ ID NO: 1079408 - RNA, 23 nt, Human
acccucuuggccggcagcacccc

SEQ ID NO: 1079409 - RNA, 19 nt, Human
aggcccuugagaguugagc

SEQ ID NO: 1079410 - RNA, 22 nt, Human
cacaggugaacgggccaggccc

SEQ ID NO: 1079411 - RNA, 24 nt, Human
ccuccuucccgagggcucugaucu

SEQ ID NO: 1079412 - RNA, 24 nt, Human
cgcccaggccuccuucccgagggc

SEQ ID NO: 1079413 - RNA, 20 nt, Human
cggcagcaccccucccaggc

SEQ ID NO: 1079414 - RNA, 19 nt, Human
cuccccgagggacagaaac

SEQ ID NO: 1079415 - RNA, 25 nt, Human
cuggaacaugguccugguucccucc

SEQ ID NO: 1079416 - RNA, 23 nt, Human
gggcagaacugcagggcacacag

SEQ ID NO: 1079417 - RNA, 22 nt, Human
ucccuccuggcuccccgaggga

SEQ ID NO: 1079418 - RNA, 21 nt, Human
ugagguccuggacccucuugg

SEQ ID NO: 1079419 - RNA, 18 nt, Human
ugcccguccugcccgucc

SEQ ID NO: 1079420 - RNA, 24 nt, Human
uggggcacaguccagugagguccu

SEQ ID NO: 1079421 - RNA, 24 nt, Human
ugguccugguucccuccuggcucc

SEQ ID NO: 1079422 - RNA, 23 nt, Human
uucccuccuggcuccccgaggga

SEQ ID NO: 1079423 - RNA, 21 nt, Human
uuggccggcagcaccccuccc

SEQ ID NO: 1079424 - RNA, 21 nt, Human
aaaaaguaaaggcacaaaaca

SEQ ID NO: 1079425 - RNA, 24 nt, Human
aaagugcugggauuacaggcguga

SEQ ID NO: 1079426 - RNA, 19 nt, Human
aacauagcauuugcccaca

SEQ ID NO: 1079427 - RNA, 20 nt, Human
aaccacuaggcuccaaaccu

SEQ ID NO: 1079428 - RNA, 20 nt, Human
aaccuaggucacccaaccua

SEQ ID NO: 1079429 - RNA, 22 nt, Human
aaccucuuucccauccacccac

SEQ ID NO: 1079430 - RNA, 19 nt, Human
aacgauggauaggaggugg

SEQ ID NO: 1079431 - RNA, 19 nt, Human
aacucuucccuuccccucc

SEQ ID NO: 1079432 - RNA, 20 nt, Human
aacugccugggucuccaaga

SEQ ID NO: 1079433 - RNA, 23 nt, Human
aacuggagcuugguacuaagcug

SEQ ID NO: 1079434 - RNA, 24 nt, Human
aagauaucagacuuuggcuuugcc

SEQ ID NO: 1079435 - RNA, 24 nt, Human
aagcauuccucccaaggaacucuu

SEQ ID NO: 1079436 - RNA, 23 nt, Human
aagcucccugcucucagcaagcc

SEQ ID NO: 1079437 - RNA, 19 nt, Human
aaguagcugggacuacagg

SEQ ID NO: 1079438 - RNA, 20 nt, Human
aaguagcugggacuacaggc

SEQ ID NO: 1079439 - RNA, 25 nt, Human
aaguagcugggacuacaggcgcccg

SEQ ID NO: 1079440 - RNA, 19 nt, Human
aagugcugggauuacaggc

SEQ ID NO: 1079441 - RNA, 19 nt, Human
aagugcugggauuacaggc

SEQ ID NO: 1079442 - RNA, 26 nt, Human
aagugcugggauuacaggcgugagcc

SEQ ID NO: 1079443 - RNA, 22 nt, Human
aaguuaaaccucuuucccaucc

SEQ ID NO: 1079444 - RNA, 28 nt, Human
acaccagagccaucucacaaccggaggg

SEQ ID NO: 1079445 - RNA, 20 nt, Human
acaccagagccaucucacac

SEQ ID NO: 1079446 - RNA, 23 nt, Human
acaccuggagcaugggcgucauc

SEQ ID NO: 1079447 - RNA, 22 nt, Human
accaaccaccacagccuaccau

SEQ ID NO: 1079448 - RNA, 24 nt, Human
acccaaccuaggccucccaacccu

SEQ ID NO: 1079449 - RNA, 21 nt, Human
acccacucaccuucagucccc

SEQ ID NO: 1079450 - RNA, 21 nt, Human
accuggagcaugggcgucauc

SEQ ID NO: 1079451 - RNA, 20 nt, Human
acgggguuucaccguuuuag

SEQ ID NO: 1079452 - RNA, 21 nt, Human
acucuucccuuccccuccagg

SEQ ID NO: 1079453 - RNA, 20 nt, Human
acugcaagcucugccuccca

SEQ ID NO: 1079454 - RNA, 18 nt, Human
agaaaccccuaaaccaga

SEQ ID NO: 1079455 - RNA, 23 nt, Human
agaaaccccuaaaccagaacuga

SEQ ID NO: 1079456 - RNA, 20 nt, Human
agaaaguaacaacagccagu

SEQ ID NO: 1079457 - RNA, 18 nt, Human
agacucagaaggagguca

SEQ ID NO: 1079458 - RNA, 23 nt, Human
agagccaucucacacacuagcuc

SEQ ID NO: 1079459 - RNA, 27 nt, Human
agcaccaaccaccacagccuaccauuc

SEQ ID NO: 1079460 - RNA, 19 nt, Human
aggagaaaguaacaacagc

SEQ ID NO: 1079461 - RNA, 20 nt, Human
aggcagcaccaaccaccaac

SEQ ID NO: 1079462 - RNA, 23 nt, Human
aggcagcaccaaccaccacagcc

SEQ ID NO: 1079463 - RNA, 24 nt, Human
aggccagaagggaaauauggaaag

SEQ ID NO: 1079464 - RNA, 25 nt, Human
aggcuggagugcaguggcgcaaucu

SEQ ID NO: 1079465 - RNA, 21 nt, Human
aguagagacgggguuucaccg

SEQ ID NO: 1079466 - RNA, 21 nt, Human
aguccuaagucaguagcugag

SEQ ID NO: 1079467 - RNA, 20 nt, Human
agugcaguggcgcaaucucg

SEQ ID NO: 1079468 - RNA, 24 nt, Human
agugcaguggcgcaaucucggcuc

SEQ ID NO: 1079469 - RNA, 21 nt, Human
caaaaagcugcuaagagagac

SEQ ID NO: 1079470 - RNA, 24 nt, Human
caaagugcugggauuacaggcgug

SEQ ID NO: 1079471 - RNA, 24 nt, Human
cacaacuccauggcuuuccuuccu

SEQ ID NO: 1079472 - RNA, 19 nt, Human
cacagccuaccauucccuc

SEQ ID NO: 1079473 - RNA, 24 nt, Human
caccagagccaucucacacacuag

SEQ ID NO: 1079474 - RNA, 24 nt, Human
caccguuuuagccgggauggucuc

SEQ ID NO: 1079475 - RNA, 22 nt, Human
cacgccauucuccugccucagc

SEQ ID NO: 1079476 - RNA, 18 nt, Human
cagcaccaaccaccacag

SEQ ID NO: 1079477 - RNA, 20 nt, Human
cagcaccaaccaccacagcc

SEQ ID NO: 1079478 - RNA, 20 nt, Human
cagcaccaaccaccacagcc

SEQ ID NO: 1079479 - RNA, 18 nt, Human
cagcaucccagacucgug

SEQ ID NO: 1079480 - RNA, 21 nt, Human
caggcgcccgccacuacgccc

SEQ ID NO: 1079481 - RNA, 23 nt, Human
cauccucugucucucucccuacu

SEQ ID NO: 1079482 - RNA, 27 nt, Human
cauggggaagggagaugucuuagaggc

SEQ ID NO: 1079483 - RNA, 20 nt, Human
ccaaagugcugggauuacag

SEQ ID NO: 1079484 - RNA, 22 nt, Human
ccaaagugcugggauuacaggc

SEQ ID NO: 1079485 - RNA, 22 nt, Human
ccaaagugcugggauuacaggc

SEQ ID NO: 1079486 - RNA, 24 nt, Human
ccaaagugcugggauuacaggcgu

SEQ ID NO: 1079487 - RNA, 21 nt, Human
ccaacaccauggggaagggag

SEQ ID NO: 1079488 - RNA, 21 nt, Human
ccaaucucaaaaagcugcuaa

SEQ ID NO: 1079489 - RNA, 18 nt, Human
ccagaaaccccuaaacca

SEQ ID NO: 1079490 - RNA, 22 nt, Human
ccauuggccauggcuccuaugg

SEQ ID NO: 1079491 - RNA, 20 nt, Human
cccaaggaacucuucccuuc

SEQ ID NO: 1079492 - RNA, 23 nt, Human
cccaaguagcugggacuacaggc

SEQ ID NO: 1079493 - RNA, 23 nt, Human
cccaaguagcugggacuacaggc

SEQ ID NO: 1079494 - RNA, 24 nt, Human
cccacucaccuucaguccccaaaa

SEQ ID NO: 1079495 - RNA, 18 nt, Human
cccacuuccucuguccuc

SEQ ID NO: 1079496 - RNA, 22 nt, Human
cccaggcuggagugcaguggcg

SEQ ID NO: 1079497 - RNA, 20 nt, Human
cccagguucacgccauucuc

SEQ ID NO: 1079498 - RNA, 25 nt, Human
ccccuaaaccagaacugaaaugucu

SEQ ID NO: 1079499 - RNA, 21 nt, Human
ccccuggcccuucagcuccca

SEQ ID NO: 1079500 - RNA, 20 nt, Human
ccgcgcccggccgcacuuca

SEQ ID NO: 1079501 - RNA, 26 nt, Human
ccggugguccucagauaccauccucu

SEQ ID NO: 1079502 - RNA, 23 nt, Human
ccgugaaauacagguuggaaagg

SEQ ID NO: 1079503 - RNA, 22 nt, Human
ccuaugggucgguauaugaggc

SEQ ID NO: 1079504 - RNA, 18 nt, Human
ccucagauaccauccucu

SEQ ID NO: 1079505 - RNA, 19 nt, Human
ccuccaaguuccuagugga

SEQ ID NO: 1079506 - RNA, 20 nt, Human
ccucccaaggaacucuuccc

SEQ ID NO: 1079507 - RNA, 21 nt, Human
ccucccaaggaacucuucccu

SEQ ID NO: 1079508 - RNA, 23 nt, Human
ccugccucagccucccaaguagc

SEQ ID NO: 1079509 - RNA, 20 nt, Human
ccuugaggaguuccguaacc

SEQ ID NO: 1079510 - RNA, 24 nt, Human
cgcucugucgcccaggcuggagug

SEQ ID NO: 1079511 - RNA, 24 nt, Human
cgggguuucaccguuuuagccggg

SEQ ID NO: 1079512 - RNA, 22 nt, Human
cuaaaacuaagcccucucccca

SEQ ID NO: 1079513 - RNA, 21 nt, Human
cuaggucacccaaccuaggcc

SEQ ID NO: 1079514 - RNA, 20 nt, Human
cucaaaaagcugcuaagaga

SEQ ID NO: 1079515 - RNA, 22 nt, Human
cucaaaaagcugcuaagagaga

SEQ ID NO: 1079516 - RNA, 22 nt, Human
cucacacacuagcuccuguccu

SEQ ID NO: 1079517 - RNA, 18 nt, Human
cucagcaagcccaacacc

SEQ ID NO: 1079518 - RNA, 24 nt, Human
cucagccucccaaguagcugggac

SEQ ID NO: 1079519 - RNA, 26 nt, Human
cucccaacccuggggaaaggcucuuu

SEQ ID NO: 1079520 - RNA, 18 nt, Human
cuccccagccugaugccc

SEQ ID NO: 1079521 - RNA, 24 nt, Human
cuccugaccucgugauccgcccgc

SEQ ID NO: 1079522 - RNA, 25 nt, Human
cuccugccucagccucccaaguagc

SEQ ID NO: 1079523 - RNA, 21 nt, Human
cucgcucugucgcccaggcug

SEQ ID NO: 1079524 - RNA, 24 nt, Human
cucgcucugucgcccaggcuggag

SEQ ID NO: 1079525 - RNA, 19 nt, Human
cucucagcaagcccaacac

SEQ ID NO: 1079526 - RNA, 24 nt, Human
cugcaagcucugccucccagguuc

SEQ ID NO: 1079527 - RNA, 23 nt, Human
cugccucagccucccaaguagcu

SEQ ID NO: 1079528 - RNA, 29 nt, Human
cuuaccgccaagugaacugcuuuucccag

SEQ ID NO: 1079529 - RNA, 22 nt, Human
gaaaccccuaaaccagaacuga

SEQ ID NO: 1079530 - RNA, 20 nt, Human
gaacucuucccuuccccucc

SEQ ID NO: 1079531 - RNA, 25 nt, Human
gaccccuggcccuucagcucccagg

SEQ ID NO: 1079532 - RNA, 22 nt, Human
gaccucgugauccgcccgccuc

SEQ ID NO: 1079533 - RNA, 22 nt, Human
gaccucgugauccgcccgccuc

SEQ ID NO: 1079534 - RNA, 24 nt, Human
gaccucgugauccgcccgccucgg

SEQ ID NO: 1079535 - RNA, 21 nt, Human
gagacggagucucgcucuguc

SEQ ID NO: 1079536 - RNA, 18 nt, Human
gauuacaggcgugagcca

SEQ ID NO: 1079537 - RNA, 22 nt, Human
gauuacaggcgugagccaccgc

SEQ ID NO: 1079538 - RNA, 22 nt, Human
gauuacaggcgugagccaccgc

SEQ ID NO: 1079539 - RNA, 20 nt, Human
gcccacaggccaccaguucu

SEQ ID NO: 1079540 - RNA, 21 nt, Human
gcccagccuuucugcugcugg

SEQ ID NO: 1079541 - RNA, 19 nt, Human
gcccaggcuggagugcagu

SEQ ID NO: 1079542 - RNA, 20 nt, Human
gcccaggcuggagugcagug

SEQ ID NO: 1079543 - RNA, 23 nt, Human
gcccggcuaauuuuuuguauuuu

SEQ ID NO: 1079544 - RNA, 19 nt, Human
gcccucuccccagccugau

SEQ ID NO: 1079545 - RNA, 25 nt, Human
gccucccagguucacgccauucucc

SEQ ID NO: 1079546 - RNA, 23 nt, Human
gccucggccucccaaagugcugg

SEQ ID NO: 1079547 - RNA, 20 nt, Human
gccuucuaaccagccugugg

SEQ ID NO: 1079548 - RNA, 25 nt, Human
gcucugucgcccaggcuggagugca

SEQ ID NO: 1079549 - RNA, 19 nt, Human
gcuggagugcaguggcgca

SEQ ID NO: 1079550 - RNA, 21 nt, Human
ggaaagcauuccucccaagga

SEQ ID NO: 1079551 - RNA, 24 nt, Human
ggagaaugugaagauaucagacuu

SEQ ID NO: 1079552 - RNA, 20 nt, Human
ggucucgaucuccugaccuc

SEQ ID NO: 1079553 - RNA, 19 nt, Human
guagagacgggguuucacc

SEQ ID NO: 1079554 - RNA, 24 nt, Human
gugauccgcccgccucggccuccc

SEQ ID NO: 1079555 - RNA, 20 nt, Human
uaaaggcacaaaacauagca

SEQ ID NO: 1079556 - RNA, 21 nt, Human
uaaccaaaaggagaaaguaac

SEQ ID NO: 1079557 - RNA, 21 nt, Human
uaagagagacucagaaggagg

SEQ ID NO: 1079558 - RNA, 24 nt, Human
uaauuuuuuguauuuuuaguagag

SEQ ID NO: 1079559 - RNA, 23 nt, Human
uacaggcgugagccaccgcgccc

SEQ ID NO: 1079560 - RNA, 21 nt, Human
uacccuagccuucagcagcuc

SEQ ID NO: 1079561 - RNA, 24 nt, Human
uaccuaaggagggcugagccuuca

SEQ ID NO: 1079562 - RNA, 24 nt, Human
uaccuugugcccucauaaugguuu

SEQ ID NO: 1079563 - RNA, 26 nt, Human
uaggaggcuuccaaguaguaaagcuc

SEQ ID NO: 1079564 - RNA, 21 nt, Human
uaguagagacgggguuucacc

SEQ ID NO: 1079565 - RNA, 22 nt, Human
uaguagagacgggguuucaccg

SEQ ID NO: 1079566 - RNA, 25 nt, Human
uaguagagacgggguuucaccguuu

SEQ ID NO: 1079567 - RNA, 22 nt, Human
uauaggcaagcauuuggggacc

SEQ ID NO: 1079568 - RNA, 22 nt, Human
ucaaagaagaaggccucugaug

SEQ ID NO: 1079569 - RNA, 18 nt, Human
ucacugcaagcucugccu

SEQ ID NO: 1079570 - RNA, 18 nt, Human
ucacugcaagcucugccu

SEQ ID NO: 1079571 - RNA, 19 nt, Human
ucacugcaagcucugccuc

SEQ ID NO: 1079572 - RNA, 24 nt, Human
ucacugcaagcucugccucccagg

SEQ ID NO: 1079573 - RNA, 20 nt, Human
ucagccucccaaguagcugg

SEQ ID NO: 1079574 - RNA, 22 nt, Human
ucaguagcugaggguaggagac

SEQ ID NO: 1079575 - RNA, 24 nt, Human
ucccaaagugcugggauuacaggc

SEQ ID NO: 1079576 - RNA, 22 nt, Human
ucccaacccuggggaaaggcuc

SEQ ID NO: 1079577 - RNA, 25 nt, Human
ucccaaggaacucuucccuuccccu

SEQ ID NO: 1079578 - RNA, 24 nt, Human
ucccaaguagcugggacuacaggc

SEQ ID NO: 1079579 - RNA, 19 nt, Human
ucccagguucacgccauuc

SEQ ID NO: 1079580 - RNA, 21 nt, Human
ucccagguucacgccauucuc

SEQ ID NO: 1079581 - RNA, 24 nt, Human
ucccagguucacgccauucuccug

SEQ ID NO: 1079582 - RNA, 23 nt, Human
ucccauccacccacucaccuuca

SEQ ID NO: 1079583 - RNA, 22 nt, Human
uccccagccugaugcccagccu

SEQ ID NO: 1079584 - RNA, 24 nt, Human
ucgcccaggcuggagugcaguggc

SEQ ID NO: 1079585 - RNA, 24 nt, Human
ucgcucugucgcccaggcuggagu

SEQ ID NO: 1079586 - RNA, 18 nt, Human
ucggccucccaaagugcu

SEQ ID NO: 1079587 - RNA, 21 nt, Human
ucucagcaagcccaacaccau

SEQ ID NO: 1079588 - RNA, 19 nt, Human
ucucgcucugucgcccagg

SEQ ID NO: 1079589 - RNA, 23 nt, Human
ucucgcucugucgcccaggcugg

SEQ ID NO: 1079590 - RNA, 24 nt, Human
ucucgcucugucgcccaggcugga

SEQ ID NO: 1079591 - RNA, 26 nt, Human
ucucgcucugucgcccaggcuggagu

SEQ ID NO: 1079592 - RNA, 27 nt, Human
ucucgcucugucgcccaggcuggagug

SEQ ID NO: 1079593 - RNA, 24 nt, Human
ucugucgcccaggcuggagugcag

SEQ ID NO: 1079594 - RNA, 20 nt, Human
ucuuucccauccacccacuc

SEQ ID NO: 1079595 - RNA, 22 nt, Human
ugaccccuggcccuucagcucc

SEQ ID NO: 1079596 - RNA, 23 nt, Human
ugaccccuggcccuucagcuccc

SEQ ID NO: 1079597 - RNA, 23 nt, Human
ugaggggcugauccuauugcaaa

SEQ ID NO: 1079598 - RNA, 22 nt, Human
ugcaguggcgcaaucucggcuc

SEQ ID NO: 1079599 - RNA, 23 nt, Human
ugcaguggcgcaaucucggcuca

SEQ ID NO: 1079600 - RNA, 21 nt, Human
ugcccagagaucuuacgaggc

SEQ ID NO: 1079601 - RNA, 24 nt, Human
ugcccagagaucuuacgaggcuug

SEQ ID NO: 1079602 - RNA, 24 nt, Human
ugccucagccucccaaguagcugg

SEQ ID NO: 1079603 - RNA, 19 nt, Human
ugccucccagguucacgcc

SEQ ID NO: 1079604 - RNA, 25 nt, Human
ugcuaagagagacucagaaggaggu

SEQ ID NO: 1079605 - RNA, 24 nt, Human
ugcugggauuacaggcgugagcca

SEQ ID NO: 1079606 - RNA, 22 nt, Human
ugcuucucuuucuuucccccuc

SEQ ID NO: 1079607 - RNA, 23 nt, Human
uggaaggcauaaagggccaacca

SEQ ID NO: 1079608 - RNA, 23 nt, Human
uggagugcaguggcgcaaucucg

SEQ ID NO: 1079609 - RNA, 24 nt, Human
uggagugcaguggcgcaaucucgg

SEQ ID NO: 1079610 - RNA, 22 nt, Human
uggaugaauaugguuaugaggu

SEQ ID NO: 1079611 - RNA, 21 nt, Human
uggccaggagggguggggcca

SEQ ID NO: 1079612 - RNA, 21 nt, Human
uggcccuucagcucccagucu

SEQ ID NO: 1079613 - RNA, 21 nt, Human
ugggacuacaggcgcccgcca

SEQ ID NO: 1079614 - RNA, 22 nt, Human
ugggacuacaggcgcccgccac

SEQ ID NO: 1079615 - RNA, 22 nt, Human
ugggacuacaggcgcccgccac

SEQ ID NO: 1079616 - RNA, 24 nt, Human
ugggacuacaggcgcccgccacua

SEQ ID NO: 1079617 - RNA, 23 nt, Human
ugggagaaugugaagauaucaga

SEQ ID NO: 1079618 - RNA, 18 nt, Human
ugggauuacaggcgugag

SEQ ID NO: 1079619 - RNA, 19 nt, Human
ugggauuacaggcgugagc

SEQ ID NO: 1079620 - RNA, 21 nt, Human
ugggauuacaggcgugagcca

SEQ ID NO: 1079621 - RNA, 22 nt, Human
ugggauuacaggcgugagccac

SEQ ID NO: 1079622 - RNA, 23 nt, Human
ugggauuacaggcgugagccacc

SEQ ID NO: 1079623 - RNA, 24 nt, Human
ugggauuacaggcgugagccaccg

SEQ ID NO: 1079624 - RNA, 18 nt, Human
ugguaugaugggcuaucc

SEQ ID NO: 1079625 - RNA, 22 nt, Human
ugguaugaugggcuauccugcu

SEQ ID NO: 1079626 - RNA, 21 nt, Human
uguagcccuucuuaccgccaa

SEQ ID NO: 1079627 - RNA, 21 nt, Human
uguauuuuuaguagagacggg

SEQ ID NO: 1079628 - RNA, 21 nt, Human
uguugcuggacaagugggaga

SEQ ID NO: 1079629 - RNA, 22 nt, Human
uuaguagagacgggguuucacc

SEQ ID NO: 1079630 - RNA, 22 nt, Human
uuaguagagacgggguuucacc

SEQ ID NO: 1079631 - RNA, 24 nt, Human
uuaguagagacgggguuucaccgu

SEQ ID NO: 1079632 - RNA, 20 nt, Human
uuggagaaccuguugcuggg

SEQ ID NO: 1079633 - RNA, 24 nt, Human
uuuuuaguagagacgggguuucac

SEQ ID NO: 1079634 - RNA, 21 nt, Human
uuuuuguauuuuuaguagaga

SEQ ID NO: 1079635 - RNA, 24 nt, Human
uuuuuuguauuuuuaguagagacg

SEQ ID NO: 1079636 - RNA, 20 nt, Human
aaaaagcuucugaaacaaaa

SEQ ID NO: 1079637 - RNA, 19 nt, Human
aaacuacaaaagcugcuga

SEQ ID NO: 1079638 - RNA, 21 nt, Human
aacaggaaggaaagugucuga

SEQ ID NO: 1079639 - RNA, 22 nt, Human
aagagaccaagaccaagaggug

SEQ ID NO: 1079640 - RNA, 26 nt, Human
agaccaagaccaagaggugugaggaa

SEQ ID NO: 1079641 - RNA, 20 nt, Human
agagaacaggaaggaaagug

SEQ ID NO: 1079642 - RNA, 20 nt, Human
cuggaaagaacucaaccagc

SEQ ID NO: 1079643 - RNA, 23 nt, Human
gcaggcucuuuucugcaagaucu

SEQ ID NO: 1079644 - RNA, 19 nt, Human
uaaaacuacaaaagcugcu

SEQ ID NO: 1079645 - RNA, 21 nt, Human
uaaaacuacaaaagcugcuga

SEQ ID NO: 1079646 - RNA, 21 nt, Human
uacaaaagcugcugagaugaa

SEQ ID NO: 1079647 - RNA, 20 nt, Human
ugaacaagggaaacacugca

SEQ ID NO: 1079648 - RNA, 19 nt, Human
ugaagagaccaagaccaag

SEQ ID NO: 1079649 - RNA, 21 nt, Human
ugaagagaccaagaccaagag

SEQ ID NO: 1079650 - RNA, 18 nt, Human
uggaaagaacucaaccag

SEQ ID NO: 1079651 - RNA, 21 nt, Human
uggaaagaacucaaccagcug

SEQ ID NO: 1079652 - RNA, 23 nt, Human
ugggucggcuuagcccucuuugc

SEQ ID NO: 1079653 - RNA, 19 nt, Human
uuagcccucuuugccucau

SEQ ID NO: 1079654 - RNA, 21 nt, Human
aacagagcagacugaaggaga

SEQ ID NO: 1079655 - RNA, 19 nt, Human
aagagccaauaaagagagg

SEQ ID NO: 1079656 - RNA, 20 nt, Human
aagagcuuguccggguuuug

SEQ ID NO: 1079657 - RNA, 21 nt, Human
agagccaauaaagagaggcgg

SEQ ID NO: 1079658 - RNA, 22 nt, Human
auuccucagcaucuucuugucg

SEQ ID NO: 1079659 - RNA, 21 nt, Human
cacacacagcgcacacagggu

SEQ ID NO: 1079660 - RNA, 19 nt, Human
cacacaggguuuacagcag

SEQ ID NO: 1079661 - RNA, 18 nt, Human
cacagcgcacacaggguu

SEQ ID NO: 1079662 - RNA, 21 nt, Human
cacaggguuuacagcaggucc

SEQ ID NO: 1079663 - RNA, 22 nt, Human
cacgaaccccaaggcauccccu

SEQ ID NO: 1079664 - RNA, 18 nt, Human
cagacagcagaauuaaac

SEQ ID NO: 1079665 - RNA, 24 nt, Human
cagcagaauuaaacagagcagacu

SEQ ID NO: 1079666 - RNA, 20 nt, Human
cagcauuauuucagaaauau

SEQ ID NO: 1079667 - RNA, 18 nt, Human
ccccaaggcauccccuuu

SEQ ID NO: 1079668 - RNA, 18 nt, Human
ccuacaaagcggacacug

SEQ ID NO: 1079669 - RNA, 20 nt, Human
cgaaccccaaggcauccccu

SEQ ID NO: 1079670 - RNA, 23 nt, Human
cuagcccauuuuugcaaagggag

SEQ ID NO: 1079671 - RNA, 23 nt, Human
cucacacacagcgcacacagggu

SEQ ID NO: 1079672 - RNA, 19 nt, Human
cugaaggagagaucuucau

SEQ ID NO: 1079673 - RNA, 21 nt, Human
cugggcucacacacagcgcac

SEQ ID NO: 1079674 - RNA, 22 nt, Human
gaaugaagccuaaguauuccuc

SEQ ID NO: 1079675 - RNA, 21 nt, Human
gcaaugucuauguaagcaguu

SEQ ID NO: 1079676 - RNA, 23 nt, Human
gcagacagcagaauuaaacagag

SEQ ID NO: 1079677 - RNA, 18 nt, Human
gcgggaagugagugugag

SEQ ID NO: 1079678 - RNA, 18 nt, Human
ggaagugagugugaggug

SEQ ID NO: 1079679 - RNA, 19 nt, Human
gggaaagcaaccaaugccu

SEQ ID NO: 1079680 - RNA, 27 nt, Human
guaaacucauucauuagccaaacaaag

SEQ ID NO: 1079681 - RNA, 23 nt, Human
gugguguccuacaaagcggacac

SEQ ID NO: 1079682 - RNA, 23 nt, Human
guuucaaccaaaugauuuugauu

SEQ ID NO: 1079683 - RNA, 19 nt, Human
uaaacagagcagacugaag

SEQ ID NO: 1079684 - RNA, 20 nt, Human
uagccaaacaaagcugucua

SEQ ID NO: 1079685 - RNA, 18 nt, Human
uaucucaggaaucagcau

SEQ ID NO: 1079686 - RNA, 21 nt, Human
ucagcauuauuucagaaauau

SEQ ID NO: 1079687 - RNA, 31 nt, Human
ucauuuuuaucauuuaucaaaaacuaaaggg

SEQ ID NO: 1079688 - RNA, 19 nt, Human
ucccucagcacaauuacua

SEQ ID NO: 1079689 - RNA, 22 nt, Human
ucgcuuccuucaccuuguuuuu

SEQ ID NO: 1079690 - RNA, 20 nt, Human
ucugcaaugucuauguaagc

SEQ ID NO: 1079691 - RNA, 21 nt, Human
ucuucuuugauaacuggcuca

SEQ ID NO: 1079692 - RNA, 23 nt, Human
ucuugcucuucuucauugacugg

SEQ ID NO: 1079693 - RNA, 25 nt, Human
ucuugcucuucuucauugacugguu

SEQ ID NO: 1079694 - RNA, 24 nt, Human
ugaaggagagaucuucauuauuug

SEQ ID NO: 1079695 - RNA, 20 nt, Human
ugacugguuuuuggggccau

SEQ ID NO: 1079696 - RNA, 21 nt, Human
ugagacuggggaucaaaucca

SEQ ID NO: 1079697 - RNA, 23 nt, Human
ugagacuggggaucaaauccacu

SEQ ID NO: 1079698 - RNA, 20 nt, Human
ugaucaccuugacugucugg

SEQ ID NO: 1079699 - RNA, 23 nt, Human
ugcucuucuucauugacugguuu

SEQ ID NO: 1079700 - RNA, 23 nt, Human
uggaauacagaggaaugaacuuc

SEQ ID NO: 1079701 - RNA, 24 nt, Human
ugggcucaaaggcaacuccagggu

SEQ ID NO: 1079702 - RNA, 18 nt, Human
uguccauuuuucauuaug

SEQ ID NO: 1079703 - RNA, 23 nt, Human
ugucuauguaagcaguuucccuc

SEQ ID NO: 1079704 - RNA, 18 nt, Human
uguguacacagaagcaug

SEQ ID NO: 1079705 - RNA, 24 nt, Human
uucaccuuguuuuucuugcucuuc

SEQ ID NO: 1079706 - RNA, 25 nt, Human
uugugcacgaaccccaaggcauccc

SEQ ID NO: 1079707 - RNA, 24 nt, Human
uuucacaaauuuacaaguguugcu

SEQ ID NO: 1079708 - RNA, 23 nt, Human
aaacaggccagcagagccugguu

SEQ ID NO: 1079709 - RNA, 18 nt, Human
aagcaccugccucugagc

SEQ ID NO: 1079710 - RNA, 25 nt, Human
aagcagagaagagacacgaugcacg

SEQ ID NO: 1079711 - RNA, 19 nt, Human
aagcuauacccugucccua

SEQ ID NO: 1079712 - RNA, 18 nt, Human
acacaguacacgaaguuc

SEQ ID NO: 1079713 - RNA, 19 nt, Human
acccaguucuuuguuuugg

SEQ ID NO: 1079714 - RNA, 19 nt, Human
agaauggaggugacuuuuu

SEQ ID NO: 1079715 - RNA, 22 nt, Human
agaccacuccaggguggacggg

SEQ ID NO: 1079716 - RNA, 20 nt, Human
agagaagugggggaagagag

SEQ ID NO: 1079717 - RNA, 21 nt, Human
agagagaaaaagcagagaaga

SEQ ID NO: 1079718 - RNA, 21 nt, Human
agagguagggcagccccaggc

SEQ ID NO: 1079719 - RNA, 22 nt, Human
agccccaggcucgaggacuccc

SEQ ID NO: 1079720 - RNA, 19 nt, Human
agccugguuaacagucugg

SEQ ID NO: 1079721 - RNA, 20 nt, Human
agcgggcucagcccugcucc

SEQ ID NO: 1079722 - RNA, 21 nt, Human
aggaaggaaggaaagagcgag

SEQ ID NO: 1079723 - RNA, 18 nt, Human
aggcaggcgggcagccaa

SEQ ID NO: 1079724 - RNA, 20 nt, Human
aggcaggcgggcagccaagc

SEQ ID NO: 1079725 - RNA, 22 nt, Human
aggccuguggcuggggaaacag

SEQ ID NO: 1079726 - RNA, 19 nt, Human
agguagggcagccccaggc

SEQ ID NO: 1079727 - RNA, 25 nt, Human
auggcacccugccugaucuucaggg

SEQ ID NO: 1079728 - RNA, 23 nt, Human
caaacccucaagccuaucaggag

SEQ ID NO: 1079729 - RNA, 20 nt, Human
caagacagcaggugcagagg

SEQ ID NO: 1079730 - RNA, 21 nt, Human
caaggaagcaacuccagccuu

SEQ ID NO: 1079731 - RNA, 20 nt, Human
caagucccuggcugaagaca

SEQ ID NO: 1079732 - RNA, 18 nt, Human
caauucuccuucugcucc

SEQ ID NO: 1079733 - RNA, 23 nt, Human
cacagauuggagccacugcccaa

SEQ ID NO: 1079734 - RNA, 18 nt, Human
caccccucauuuuguuuc

SEQ ID NO: 1079735 - RNA, 23 nt, Human
cacccuguagccuuuggcccacc

SEQ ID NO: 1079736 - RNA, 25 nt, Human
caccuguagccacagugugguuggc

SEQ ID NO: 1079737 - RNA, 22 nt, Human
cacgagccuggguccauccccu

SEQ ID NO: 1079738 - RNA, 24 nt, Human
cacgcagugcagcuaauguguggc

SEQ ID NO: 1079739 - RNA, 21 nt, Human
cacugaccccagggcucuccu

SEQ ID NO: 1079740 - RNA, 25 nt, Human
cagaaccccuaggguacaguacaaa

SEQ ID NO: 1079741 - RNA, 21 nt, Human
cagcagggcaaagccccggcu

SEQ ID NO: 1079742 - RNA, 19 nt, Human
caggagguagagggcaaga

SEQ ID NO: 1079743 - RNA, 26 nt, Human
cagggcaaagccccggcuccccuguc

SEQ ID NO: 1079744 - RNA, 18 nt, Human
cagggccuuccuucucuc

SEQ ID NO: 1079745 - RNA, 19 nt, Human
caggguggacgggcugggg

SEQ ID NO: 1079746 - RNA, 22 nt, Human
cauuuuguuuccuucucugaag

SEQ ID NO: 1079747 - RNA, 23 nt, Human
ccagaaccccuaggguacaguac

SEQ ID NO: 1079748 - RNA, 21 nt, Human
ccagcagagccugguuaacag

SEQ ID NO: 1079749 - RNA, 18 nt, Human
ccagcucucccuugcucu

SEQ ID NO: 1079750 - RNA, 20 nt, Human
ccaggagaaccuugguugcu

SEQ ID NO: 1079751 - RNA, 18 nt, Human
ccagggccuuccuucucu

SEQ ID NO: 1079752 - RNA, 19 nt, Human
ccagggccuuccuucucuc

SEQ ID NO: 1079753 - RNA, 19 nt, Human
cccaaggagucccaucuuc

SEQ ID NO: 1079754 - RNA, 18 nt, Human
cccacgggccuccugagg

SEQ ID NO: 1079755 - RNA, 19 nt, Human
cccaggcucgaggacuccc

SEQ ID NO: 1079756 - RNA, 20 nt, Human
cccagugugauguggcauag

SEQ ID NO: 1079757 - RNA, 18 nt, Human
ccccagugugauguggca

SEQ ID NO: 1079758 - RNA, 19 nt, Human
ccccuggaguacccacagg

SEQ ID NO: 1079759 - RNA, 20 nt, Human
cccuaaguccugagccaccc

SEQ ID NO: 1079760 - RNA, 22 nt, Human
cccuggaguacccacaggccuu

SEQ ID NO: 1079761 - RNA, 23 nt, Human
cccuggcugaagacagacuugag

SEQ ID NO: 1079762 - RNA, 21 nt, Human
cccuggcuguugucugguggg

SEQ ID NO: 1079763 - RNA, 19 nt, Human
ccgcucucagggccaggca

SEQ ID NO: 1079764 - RNA, 22 nt, Human
ccgcugccaucgcggcccgcgc

SEQ ID NO: 1079765 - RNA, 19 nt, Human
ccucgcccaccuugggacg

SEQ ID NO: 1079766 - RNA, 18 nt, Human
ccugagggaagaggggug

SEQ ID NO: 1079767 - RNA, 20 nt, Human
ccuggacuccagcccuggcc

SEQ ID NO: 1079768 - RNA, 20 nt, Human
ccuggauccaaggguggaac

SEQ ID NO: 1079769 - RNA, 20 nt, Human
ccuggcuguugucugguggg

SEQ ID NO: 1079770 - RNA, 21 nt, Human
ccuguggcuggggaaacaggc

SEQ ID NO: 1079771 - RNA, 20 nt, Human
cuacccagggccuuccuucu

SEQ ID NO: 1079772 - RNA, 18 nt, Human
cuaggcucaguccuccgc

SEQ ID NO: 1079773 - RNA, 20 nt, Human
cuccugagggaagaggggug

SEQ ID NO: 1079774 - RNA, 21 nt, Human
cugccucugagcucaguuccc

SEQ ID NO: 1079775 - RNA, 24 nt, Human
cugcucacaauucauauauggacc

SEQ ID NO: 1079776 - RNA, 21 nt, Human
cugcugugcaaacugcugucc

SEQ ID NO: 1079777 - RNA, 18 nt, Human
cugucccuggccagcucu

SEQ ID NO: 1079778 - RNA, 22 nt, Human
cuuccugaacauagcacucugg

SEQ ID NO: 1079779 - RNA, 24 nt, Human
gaagcaccugccucugagcucagu

SEQ ID NO: 1079780 - RNA, 22 nt, Human
gagcagguggcgugccuggggc

SEQ ID NO: 1079781 - RNA, 22 nt, Human
gagccuggguccauccccuugg

SEQ ID NO: 1079782 - RNA, 23 nt, Human
gagcuaguccuucauuuccaaau

SEQ ID NO: 1079783 - RNA, 21 nt, Human
gaugguucuuuccccacuucu

SEQ ID NO: 1079784 - RNA, 19 nt, Human
gcccauggcacaugaggga

SEQ ID NO: 1079785 - RNA, 23 nt, Human
gccugggagucugaggaaaugcu

SEQ ID NO: 1079786 - RNA, 21 nt, Human
gcgggcgggcagcgggcucag

SEQ ID NO: 1079787 - RNA, 20 nt, Human
ggacaggggcugcuugagau

SEQ ID NO: 1079788 - RNA, 18 nt, Human
ggagaaccuugguugcug

SEQ ID NO: 1079789 - RNA, 20 nt, Human
ggagcagcugaaaguggccc

SEQ ID NO: 1079790 - RNA, 23 nt, Human
ggaggaaagguuugaugguucuu

SEQ ID NO: 1079791 - RNA, 21 nt, Human
ggaguccucuucccuccaccu

SEQ ID NO: 1079792 - RNA, 22 nt, Human
ggccaaagagaacagcaccaag

SEQ ID NO: 1079793 - RNA, 24 nt, Human
ggccuguggcuggggaaacaggcu

SEQ ID NO: 1079794 - RNA, 21 nt, Human
ggcgggcagcgggcucagccc

SEQ ID NO: 1079795 - RNA, 23 nt, Human
gggacggugggcaggaaccccag

SEQ ID NO: 1079796 - RNA, 22 nt, Human
gggagucugaggaaaugcucuu

SEQ ID NO: 1079797 - RNA, 22 nt, Human
gggcgggcagcgggcucagccc

SEQ ID NO: 1079798 - RNA, 18 nt, Human
gggcuggggacaggggcg

SEQ ID NO: 1079799 - RNA, 20 nt, Human
gggcuggggacaggggcugc

SEQ ID NO: 1079800 - RNA, 24 nt, Human
ggggccagcggggccgggaacugc

SEQ ID NO: 1079801 - RNA, 19 nt, Human
ggggccuaggaggcccugc

SEQ ID NO: 1079802 - RNA, 23 nt, Human
ggggcugcuugagaugacagcag

SEQ ID NO: 1079803 - RNA, 23 nt, Human
gggggaagagagaaaaagcagag

SEQ ID NO: 1079804 - RNA, 20 nt, Human
gggggugggggaagaggaag

SEQ ID NO: 1079805 - RNA, 24 nt, Human
ggguuaaagaaacuuccugaacau

SEQ ID NO: 1079806 - RNA, 20 nt, Human
ggugagacagugcuugcggc

SEQ ID NO: 1079807 - RNA, 20 nt, Human
gguugcugaaggcuaggcuc

SEQ ID NO: 1079808 - RNA, 23 nt, Human
guagaacugguaaauuacuuguu

SEQ ID NO: 1079809 - RNA, 26 nt, Human
gugggggaagagagaaaaagcagaga

SEQ ID NO: 1079810 - RNA, 20 nt, Human
uaaaauagaugaacccugcu

SEQ ID NO: 1079811 - RNA, 20 nt, Human
uaaagaaacuuccugaacau

SEQ ID NO: 1079812 - RNA, 21 nt, Human
uaacuucucaagucccuggcu

SEQ ID NO: 1079813 - RNA, 23 nt, Human
uaaguccugagccacccucuccu

SEQ ID NO: 1079814 - RNA, 21 nt, Human
uacaaauauaguccuucuuuc

SEQ ID NO: 1079815 - RNA, 24 nt, Human
uacccacaggccuugguccacauc

SEQ ID NO: 1079816 - RNA, 18 nt, Human
uacugguccacagauugg

SEQ ID NO: 1079817 - RNA, 20 nt, Human
uagccacagugugguuggca

SEQ ID NO: 1079818 - RNA, 23 nt, Human
uagcugcacccuaaaaucccaau

SEQ ID NO: 1079819 - RNA, 19 nt, Human
uagucacagcuucauccua

SEQ ID NO: 1079820 - RNA, 26 nt, Human
ucaacacccaguucuuuguuuuggcu

SEQ ID NO: 1079821 - RNA, 19 nt, Human
ucaagacagcaggugcaga

SEQ ID NO: 1079822 - RNA, 23 nt, Human
ucacugaccccagggcucuccuu

SEQ ID NO: 1079823 - RNA, 22 nt, Human
ucagagaaagagaaguggggga

SEQ ID NO: 1079824 - RNA, 19 nt, Human
ucagggccaggcaggggga

SEQ ID NO: 1079825 - RNA, 23 nt, Human
ucccauaaacuuugggucccagg

SEQ ID NO: 1079826 - RNA, 18 nt, Human
ucccauaccuuuucccag

SEQ ID NO: 1079827 - RNA, 23 nt, Human
ucccuagccccagugugaugugg

SEQ ID NO: 1079828 - RNA, 19 nt, Human
uccuaccucgaugcuccac

SEQ ID NO: 1079829 - RNA, 22 nt, Human
uccuagaguuagcugucuccuu

SEQ ID NO: 1079830 - RNA, 21 nt, Human
uccugaacauagcacucugga

SEQ ID NO: 1079831 - RNA, 20 nt, Human
ucugaagcaccugccucuga

SEQ ID NO: 1079832 - RNA, 18 nt, Human
ucugggccucaagacaug

SEQ ID NO: 1079833 - RNA, 25 nt, Human
ugaacccugcucacaauucauauau

SEQ ID NO: 1079834 - RNA, 19 nt, Human
ugaagacagacuugagggc

SEQ ID NO: 1079835 - RNA, 19 nt, Human
ugaccccagggcucuccuu

SEQ ID NO: 1079836 - RNA, 19 nt, Human
ugagggaagaggggugucg

SEQ ID NO: 1079837 - RNA, 21 nt, Human
ugagggcuggcaucaccuacu

SEQ ID NO: 1079838 - RNA, 19 nt, Human
ugauacucaauagggucau

SEQ ID NO: 1079839 - RNA, 25 nt, Human
ugauuuacaacuuccugcucuccuu

SEQ ID NO: 1079840 - RNA, 22 nt, Human
ugccaccccucauuuuguuucc

SEQ ID NO: 1079841 - RNA, 21 nt, Human
ugccuggggcuggauggaguc

SEQ ID NO: 1079842 - RNA, 20 nt, Human
uggaggaguaaggaagugag

SEQ ID NO: 1079843 - RNA, 23 nt, Human
uggaggaguaaggaagugagguu

SEQ ID NO: 1079844 - RNA, 21 nt, Human
uggauccaaggguggaaccuc

SEQ ID NO: 1079845 - RNA, 24 nt, Human
uggcugcagccacgcagugcagcu

SEQ ID NO: 1079846 - RNA, 23 nt, Human
ugggacggugggcaggaacccca

SEQ ID NO: 1079847 - RNA, 21 nt, Human
ugggccucaagacaugcccca

SEQ ID NO: 1079848 - RNA, 18 nt, Human
uggggccagcggggccgg

SEQ ID NO: 1079849 - RNA, 18 nt, Human
uggggcuggauggagucu

SEQ ID NO: 1079850 - RNA, 18 nt, Human
ugucuggugggugcggga

SEQ ID NO: 1079851 - RNA, 25 nt, Human
uguuuucccuuccagaaccccuagg

SEQ ID NO: 1079852 - RNA, 23 nt, Human
uuccuaggccucgcccaccuugg

SEQ ID NO: 1079853 - RNA, 22 nt, Human
uugaaauaaucuuuauuuugua

SEQ ID NO: 1079854 - RNA, 20 nt, Human
uugguucuuaguugaugaau

SEQ ID NO: 1079855 - RNA, 20 nt, Human
uugguugcugaaggcuaggc

SEQ ID NO: 1079856 - RNA, 24 nt, Human
uuuccuucucugaagcaccugccu

SEQ ID NO: 1079857 - RNA, 21 nt, Human
aaaagcaucuucuuuuacuuc

SEQ ID NO: 1079858 - RNA, 21 nt, Human
agagaagaaaaacugacuaag

SEQ ID NO: 1079859 - RNA, 22 nt, Human
aggcggcgcaggggucuggagc

SEQ ID NO: 1079860 - RNA, 24 nt, Human
cagaacauucagcaauauguugcc

SEQ ID NO: 1079861 - RNA, 19 nt, Human
cagaguaccuaugccuuuc

SEQ ID NO: 1079862 - RNA, 24 nt, Human
cagcaauauguugccuaaauuggu

SEQ ID NO: 1079863 - RNA, 19 nt, Human
ccacauuaaucuuccucac

SEQ ID NO: 1079864 - RNA, 18 nt, Human
ccgcugcacucgcugggu

SEQ ID NO: 1079865 - RNA, 18 nt, Human
ccucagaggacuuggugc

SEQ ID NO: 1079866 - RNA, 20 nt, Human
gaacauucagcaauauguug

SEQ ID NO: 1079867 - RNA, 18 nt, Human
gcacucgcugggucuugg

SEQ ID NO: 1079868 - RNA, 20 nt, Human
gcacucgcugggucuugggu

SEQ ID NO: 1079869 - RNA, 21 nt, Human
ggaacacagacgauaagaacg

SEQ ID NO: 1079870 - RNA, 22 nt, Human
ggccgcuuccggugcugcccug

SEQ ID NO: 1079871 - RNA, 19 nt, Human
ggcugguggucgccgggcu

SEQ ID NO: 1079872 - RNA, 18 nt, Human
uaaagguuuuacuggcca

SEQ ID NO: 1079873 - RNA, 20 nt, Human
ucaaagaagagaagaaaaac

SEQ ID NO: 1079874 - RNA, 19 nt, Human
ucagaacauucagcaauau

SEQ ID NO: 1079875 - RNA, 20 nt, Human
ucccuguucgcguacauggc

SEQ ID NO: 1079876 - RNA, 20 nt, Human
ucggccgcuuccggugcugc

SEQ ID NO: 1079877 - RNA, 21 nt, Human
uggaagaagcagcaacuuggc

SEQ ID NO: 1079878 - RNA, 22 nt, Human
uggaagaagcagcaacuuggca

SEQ ID NO: 1079879 - RNA, 22 nt, Human
uggaguaaaaagcaucuucuuu

SEQ ID NO: 1079880 - RNA, 24 nt, Human
uuacuggccacauuaaucuuccuc

SEQ ID NO: 1079881 - RNA, 22 nt, Human
uucuuagaaugucaaagaagag

SEQ ID NO: 1079882 - RNA, 22 nt, Human
aagaugccaacuaccggcaugg

SEQ ID NO: 1079883 - RNA, 19 nt, Human
acagaaaguauaaaaggac

SEQ ID NO: 1079884 - RNA, 24 nt, Human
acggcugcccggggcgcggagcgg

SEQ ID NO: 1079885 - RNA, 18 nt, Human
agacaucgaggcuccccc

SEQ ID NO: 1079886 - RNA, 19 nt, Human
aggacaguguuuucaugac

SEQ ID NO: 1079887 - RNA, 18 nt, Human
augggcacagaguccaga

SEQ ID NO: 1079888 - RNA, 22 nt, Human
caagaugccaacuaccggcaug

SEQ ID NO: 1079889 - RNA, 24 nt, Human
caucaaggaaggauaucucccaaa

SEQ ID NO: 1079890 - RNA, 21 nt, Human
ccccaagaugccaacuaccgg

SEQ ID NO: 1079891 - RNA, 20 nt, Human
cccgcaggcgccugcacacg

SEQ ID NO: 1079892 - RNA, 20 nt, Human
ccuccugcgaggaauguuga

SEQ ID NO: 1079893 - RNA, 18 nt, Human
cgcggagcggggcggggc

SEQ ID NO: 1079894 - RNA, 24 nt, Human
cguuuugccaucauucuccugaac

SEQ ID NO: 1079895 - RNA, 25 nt, Human
cuccugaacugaacaaaagucaugc

SEQ ID NO: 1079896 - RNA, 20 nt, Human
cugcccggggcgcggagcgg

SEQ ID NO: 1079897 - RNA, 20 nt, Human
cuggaucaagggggugaagc

SEQ ID NO: 1079898 - RNA, 20 nt, Human
cuggaucaagggggugaagc

SEQ ID NO: 1079899 - RNA, 21 nt, Human
gagaggacaguguuuucauga

SEQ ID NO: 1079900 - RNA, 25 nt, Human
gaggauaccgcccgcaggcgccugc

SEQ ID NO: 1079901 - RNA, 23 nt, Human
gcagcagaguagacaugacugga

SEQ ID NO: 1079902 - RNA, 18 nt, Human
gcgcggagcggggcgggg

SEQ ID NO: 1079903 - RNA, 20 nt, Human
gcggagcggggcggggcguc

SEQ ID NO: 1079904 - RNA, 18 nt, Human
gcugcccggggcgcggag

SEQ ID NO: 1079905 - RNA, 20 nt, Human
ggaagacaauccaagccaca

SEQ ID NO: 1079906 - RNA, 24 nt, Human
ggcagcagaguagacaugacugga

SEQ ID NO: 1079907 - RNA, 20 nt, Human
ggcgcggagcggggcggggc

SEQ ID NO: 1079908 - RNA, 21 nt, Human
gggcacagaguccagaguucc

SEQ ID NO: 1079909 - RNA, 21 nt, Human
uaccggcaugggcacagaguc

SEQ ID NO: 1079910 - RNA, 25 nt, Human
uacuugagauauggaauguaccagg

SEQ ID NO: 1079911 - RNA, 23 nt, Human
uccugaauccucauguuauuguu

SEQ ID NO: 1079912 - RNA, 26 nt, Human
ucucaaagacguuuugagcuuuuucu

SEQ ID NO: 1079913 - RNA, 23 nt, Human
ucuccugaacugaacaaaaguug

SEQ ID NO: 1079914 - RNA, 21 nt, Human
ucuggaucaagggggugaagc

SEQ ID NO: 1079915 - RNA, 23 nt, Human
ucuucuggaucaagggggugaag

SEQ ID NO: 1079916 - RNA, 21 nt, Human
ugcacacggcugcccggggcg

SEQ ID NO: 1079917 - RNA, 22 nt, Human
ugcccggggcgcggagcggggc

SEQ ID NO: 1079918 - RNA, 27 nt, Human
ugcccggggcgcggagcggggcggggc

SEQ ID NO: 1079919 - RNA, 19 nt, Human
ugggcacagaguccagagu

SEQ ID NO: 1079920 - RNA, 23 nt, Human
uguugauagcuuuuuuaauugcu

SEQ ID NO: 1079921 - RNA, 18 nt, Human
uguuuucuucuggaucaa

SEQ ID NO: 1079922 - RNA, 20 nt, Human
uuauuguuuuccaucaagga

SEQ ID NO: 1079923 - RNA, 19 nt, Human
acaggccccagugugugau

SEQ ID NO: 1079924 - RNA, 20 nt, Human
accuguuguuuccugacuuu

SEQ ID NO: 1079925 - RNA, 24 nt, Human
agaagccacugaggucagaaguuc

SEQ ID NO: 1079926 - RNA, 22 nt, Human
agaaguucaagaccagccuggu

SEQ ID NO: 1079927 - RNA, 23 nt, Human
agccuggucaauguagugaaacc

SEQ ID NO: 1079928 - RNA, 23 nt, Human
agccuggucaauguagugaaacc

SEQ ID NO: 1079929 - RNA, 24 nt, Human
agccuggucaauguagugaaaccu

SEQ ID NO: 1079930 - RNA, 22 nt, Human
aucccucuccccuccccccacc

SEQ ID NO: 1079931 - RNA, 21 nt, Human
auggcugcauaguauuccaug

SEQ ID NO: 1079932 - RNA, 24 nt, Human
augguauuucuaguucuggauccu

SEQ ID NO: 1079933 - RNA, 24 nt, Human
caagaccagccuggucaauguagu

SEQ ID NO: 1079934 - RNA, 19 nt, Human
caauguagugaaaccuugc

SEQ ID NO: 1079935 - RNA, 19 nt, Human
cacauguauacaugugcca

SEQ ID NO: 1079936 - RNA, 22 nt, Human
cacccaguaacucgucauuuac

SEQ ID NO: 1079937 - RNA, 23 nt, Human
caggagguucuccuuugucauuu

SEQ ID NO: 1079938 - RNA, 23 nt, Human
cagugugugauguuccccuuccu

SEQ ID NO: 1079939 - RNA, 23 nt, Human
cauguacacaacaugcagguuug

SEQ ID NO: 1079940 - RNA, 19 nt, Human
caugucccuacaaaggaca

SEQ ID NO: 1079941 - RNA, 24 nt, Human
ccacacugucuuccacaaugguug

SEQ ID NO: 1079942 - RNA, 21 nt, Human
ccaccccacaacaggccccag

SEQ ID NO: 1079943 - RNA, 21 nt, Human
ccagaucucaaguuauauaac

SEQ ID NO: 1079944 - RNA, 18 nt, Human
ccagggacuucucuuccc

SEQ ID NO: 1079945 - RNA, 22 nt, Human
ccagugaugaugagcauuuuuu

SEQ ID NO: 1079946 - RNA, 21 nt, Human
cccaguaaugggauggcuggg

SEQ ID NO: 1079947 - RNA, 21 nt, Human
cccccaccccacaacaggccc

SEQ ID NO: 1079948 - RNA, 20 nt, Human
ccccccaccccacaacaggc

SEQ ID NO: 1079949 - RNA, 26 nt, Human
cccuccccccaccccacaacaggccc

SEQ ID NO: 1079950 - RNA, 21 nt, Human
ccuccccccaccccacaacag

SEQ ID NO: 1079951 - RNA, 21 nt, Human
ccuggucaauguagugaaacc

SEQ ID NO: 1079952 - RNA, 24 nt, Human
ccuggucaauguagugaaaccuug

SEQ ID NO: 1079953 - RNA, 21 nt, Human
cuaugagugagaacaugcagu

SEQ ID NO: 1079954 - RNA, 19 nt, Human
cuccccuccccccaccccc

SEQ ID NO: 1079955 - RNA, 18 nt, Human
cucuccccuccccccacc

SEQ ID NO: 1079956 - RNA, 18 nt, Human
cuguagguugccuguuca

SEQ ID NO: 1079957 - RNA, 20 nt, Human
cuuccacaaugguugaacca

SEQ ID NO: 1079958 - RNA, 18 nt, Human
cuuuugagaagugucugu

SEQ ID NO: 1079959 - RNA, 18 nt, Human
gaacugaguccagcagca

SEQ ID NO: 1079960 - RNA, 24 nt, Human
gcccacuuuuugaugggguuguuu

SEQ ID NO: 1079961 - RNA, 21 nt, Human
ggacaugaacucauccuuuuu

SEQ ID NO: 1079962 - RNA, 19 nt, Human
ggcugcauaguauuccaug

SEQ ID NO: 1079963 - RNA, 18 nt, Human
gugugcaugugucuuuau

SEQ ID NO: 1079964 - RNA, 20 nt, Human
gugugcaugugucuuuauag

SEQ ID NO: 1079965 - RNA, 20 nt, Human
uaaaugucuucuuuugagaa

SEQ ID NO: 1079966 - RNA, 18 nt, Human
uacacauguauacaugug

SEQ ID NO: 1079967 - RNA, 19 nt, Human
uagcagcaugauuuauaau

SEQ ID NO: 1079968 - RNA, 21 nt, Human
uaggggcaguauuuuccagac

SEQ ID NO: 1079969 - RNA, 20 nt, Human
uauaugugccacauuuucuu

SEQ ID NO: 1079970 - RNA, 24 nt, Human
uauugugaauagugccacaauaaa

SEQ ID NO: 1079971 - RNA, 24 nt, Human
uccacaaugguugaaccaguuuac

SEQ ID NO: 1079972 - RNA, 23 nt, Human
ucccacuaauaguguaaaagugu

SEQ ID NO: 1079973 - RNA, 18 nt, Human
uccccccaccccacaaca

SEQ ID NO: 1079974 - RNA, 20 nt, Human
ucccuacaaaggacaugaac

SEQ ID NO: 1079975 - RNA, 21 nt, Human
ucccucuccccuccccccacc

SEQ ID NO: 1079976 - RNA, 22 nt, Human
uccuuugucauuuuuaucucca

SEQ ID NO: 1079977 - RNA, 23 nt, Human
uccuuugucauuuuuaucuccaa

SEQ ID NO: 1079978 - RNA, 18 nt, Human
ucuaaugauugcaaacuu

SEQ ID NO: 1079979 - RNA, 23 nt, Human
ucuccccuccccccaccccacaa

SEQ ID NO: 1079980 - RNA, 24 nt, Human
ucucugauggccagugaugaugag

SEQ ID NO: 1079981 - RNA, 23 nt, Human
ucuuugcuauugugaauagugcc

SEQ ID NO: 1079982 - RNA, 24 nt, Human
ugagaaugaugguuuccagcuuca

SEQ ID NO: 1079983 - RNA, 24 nt, Human
ugagaugguaucucauugugauuu

SEQ ID NO: 1079984 - RNA, 24 nt, Human
ugagugagaacaugcaguauuugg

SEQ ID NO: 1079985 - RNA, 24 nt, Human
ugaugagcauuuuuucaugugucu

SEQ ID NO: 1079986 - RNA, 20 nt, Human
ugauggacauuuggguuggu

SEQ ID NO: 1079987 - RNA, 26 nt, Human
ugccacaauaaacauacgugugcaug

SEQ ID NO: 1079988 - RNA, 19 nt, Human
ugccauguuggugugcugc

SEQ ID NO: 1079989 - RNA, 26 nt, Human
ugguaguuucuuuugcugucguagac

SEQ ID NO: 1079990 - RNA, 21 nt, Human
uguuacacauguauacaugug

SEQ ID NO: 1079991 - RNA, 18 nt, Human
uguugagaauucuuccca

SEQ ID NO: 1079992 - RNA, 18 nt, Human
uguugagaauucuuccca

SEQ ID NO: 1079993 - RNA, 20 nt, Human
uuccaugguguauaugugcc

SEQ ID NO: 1079994 - RNA, 26 nt, Human
uuccaugguguauaugugccacauuu

SEQ ID NO: 1079995 - RNA, 21 nt, Human
uucccagaucucaaguuauau

SEQ ID NO: 1079996 - RNA, 20 nt, Human
uucuagaagccacugagguu

SEQ ID NO: 1079997 - RNA, 23 nt, Human
uucucccauuugaaaguaggggc

SEQ ID NO: 1079998 - RNA, 24 nt, Human
uucuuuguagauucuggcuauuag

SEQ ID NO: 1079999 - RNA, 20 nt, Human
uugccuguucacucugaugg

SEQ ID NO: 1080000 - RNA, 19 nt, Human
uuguuuguuuuuucuugua

SEQ ID NO: 1080001 - RNA, 19 nt, Human
uuuacagucccacuaauag

SEQ ID NO: 1080002 - RNA, 19 nt, Human
uuuccagcuucauccaugu

SEQ ID NO: 1080003 - RNA, 18 nt, Human
uuugcuguauaucaacag

SEQ ID NO: 1080004 - RNA, 22 nt, Human
uuuuauggcugcauaguauucc

SEQ ID NO: 1080005 - RNA, 21 nt, Human
aaacacagccauuacgaauuc

SEQ ID NO: 1080006 - RNA, 23 nt, Human
aaacuccugcacucaagcaaucc

SEQ ID NO: 1080007 - RNA, 23 nt, Human
aaagugcugggauuacaggugua

SEQ ID NO: 1080008 - RNA, 19 nt, Human
aaaguucuucugagcuaau

SEQ ID NO: 1080009 - RNA, 23 nt, Human
aacaaccucuuuauuaaagcuga

SEQ ID NO: 1080010 - RNA, 24 nt, Human
aagcaauccuuuugccuuggccuc

SEQ ID NO: 1080011 - RNA, 25 nt, Human
aagcaauccuuuugccuuggccucc

SEQ ID NO: 1080012 - RNA, 25 nt, Human
aagugauccucccaccucagccucc

SEQ ID NO: 1080013 - RNA, 22 nt, Human
aagugcugggauaacaggcaug

SEQ ID NO: 1080014 - RNA, 18 nt, Human
aagugcugggauuacagg

SEQ ID NO: 1080015 - RNA, 19 nt, Human
aagugcugggauuacaggu

SEQ ID NO: 1080016 - RNA, 26 nt, Human
aagugcugggauuacagguguaagcc

SEQ ID NO: 1080017 - RNA, 22 nt, Human
aauaaaaucacuccuugccuuu

SEQ ID NO: 1080018 - RNA, 19 nt, Human
aaucauagcucacugcagc

SEQ ID NO: 1080019 - RNA, 21 nt, Human
acaggcaugggccaccgugcc

SEQ ID NO: 1080020 - RNA, 20 nt, Human
acaggguuucaccauauugg

SEQ ID NO: 1080021 - RNA, 24 nt, Human
acaggguuucaccauauuggccag

SEQ ID NO: 1080022 - RNA, 24 nt, Human
accauauuggccaggcuggucucg

SEQ ID NO: 1080023 - RNA, 19 nt, Human
acccaggcuggagugcagu

SEQ ID NO: 1080024 - RNA, 20 nt, Human
accucagccuccugaguagc

SEQ ID NO: 1080025 - RNA, 24 nt, Human
accuugugaucugcccgccucagc

SEQ ID NO: 1080026 - RNA, 18 nt, Human
acucugccacccaggcug

SEQ ID NO: 1080027 - RNA, 25 nt, Human
acucugccacccaggcuggagugca

SEQ ID NO: 1080028 - RNA, 20 nt, Human
acugcaccuggccuuggcag

SEQ ID NO: 1080029 - RNA, 18 nt, Human
acugcagccuccaccucc

SEQ ID NO: 1080030 - RNA, 18 nt, Human
agacaggauuuugccaug

SEQ ID NO: 1080031 - RNA, 23 nt, Human
agaccacaggcacaugccaccaa

SEQ ID NO: 1080032 - RNA, 24 nt, Human
agacuaccaccagcaaggccacag

SEQ ID NO: 1080033 - RNA, 18 nt, Human
agccuuccgaguagcuag

SEQ ID NO: 1080034 - RNA, 20 nt, Human
agcuaggacuacaugugccc

SEQ ID NO: 1080035 - RNA, 19 nt, Human
aggcuggagugcaguggca

SEQ ID NO: 1080036 - RNA, 18 nt, Human
aggugcuucacaaaccag

SEQ ID NO: 1080037 - RNA, 21 nt, Human
aguagcuaggacuacaugugc

SEQ ID NO: 1080038 - RNA, 23 nt, Human
agugcacuggugugaucuuggcu

SEQ ID NO: 1080039 - RNA, 21 nt, Human
agugcaguggcacaaucauag

SEQ ID NO: 1080040 - RNA, 23 nt, Human
agugcaguggcacaaucauagcu

SEQ ID NO: 1080041 - RNA, 21 nt, Human
auagagacaggauuuugccau

SEQ ID NO: 1080042 - RNA, 24 nt, Human
auagcucacugcagccuccaccuc

SEQ ID NO: 1080043 - RNA, 24 nt, Human
auuuugccauguugcccaggcugg

SEQ ID NO: 1080044 - RNA, 24 nt, Human
auuuuuguauuuuuaguagagaca

SEQ ID NO: 1080045 - RNA, 24 nt, Human
caaagugcugggauuacaggugua

SEQ ID NO: 1080046 - RNA, 21 nt, Human
caaccacgcccgacuaauuuu

SEQ ID NO: 1080047 - RNA, 22 nt, Human
caagcaauccuuuugccuuggc

SEQ ID NO: 1080048 - RNA, 27 nt, Human
caagcaauccuuuugccuuggccuccc

SEQ ID NO: 1080049 - RNA, 27 nt, Human
caagcaauccuuuugccuuggccuccc

SEQ ID NO: 1080050 - RNA, 22 nt, Human
caagcaauucuccugccucagc

SEQ ID NO: 1080051 - RNA, 20 nt, Human
caaggccacaggauuucaug

SEQ ID NO: 1080052 - RNA, 20 nt, Human
caagugauccucccaccuca

SEQ ID NO: 1080053 - RNA, 27 nt, Human
caagugauccucccaccucagccuccu

SEQ ID NO: 1080054 - RNA, 24 nt, Human
caagugcugggauaacaggcaugg

SEQ ID NO: 1080055 - RNA, 23 nt, Human
caaugcagccauccucacagaac

SEQ ID NO: 1080056 - RNA, 26 nt, Human
cacaaugcagccauccucacagaacu

SEQ ID NO: 1080057 - RNA, 18 nt, Human
cacagaacuuuuccuaca

SEQ ID NO: 1080058 - RNA, 20 nt, Human
caccagcaaggccacaggau

SEQ ID NO: 1080059 - RNA, 21 nt, Human
caccauauuggccaggcuggu

SEQ ID NO: 1080060 - RNA, 24 nt, Human
caccauauuggccaggcuggucuc

SEQ ID NO: 1080061 - RNA, 24 nt, Human
caccucagccuccugaguagcuga

SEQ ID NO: 1080062 - RNA, 23 nt, Human
cacucugccacccaggcuggagu

SEQ ID NO: 1080063 - RNA, 24 nt, Human
cacucugccacccaggcuggagug

SEQ ID NO: 1080064 - RNA, 21 nt, Human
cacugcaaccuccgccuccca

SEQ ID NO: 1080065 - RNA, 20 nt, Human
cagaaagaaaacuaaaaauu

SEQ ID NO: 1080066 - RNA, 21 nt, Human
cagagaaaaagucaggggccc

SEQ ID NO: 1080067 - RNA, 23 nt, Human
cagccuccaccuccuggacccaa

SEQ ID NO: 1080068 - RNA, 24 nt, Human
cagccuccaccuccuggacccaag

SEQ ID NO: 1080069 - RNA, 20 nt, Human
cagccuccugaguagcugag

SEQ ID NO: 1080070 - RNA, 24 nt, Human
caggauuuugccauguugcccagg

SEQ ID NO: 1080071 - RNA, 24 nt, Human
caggguuucaccauauuggccagg

SEQ ID NO: 1080072 - RNA, 23 nt, Human
cauauuggccaggcuggucucga

SEQ ID NO: 1080073 - RNA, 18 nt, Human
caugacuaacuaauuuug

SEQ ID NO: 1080074 - RNA, 23 nt, Human
cauguugcccaggcuggucucaa

SEQ ID NO: 1080075 - RNA, 24 nt, Human
cauguugcccaggcuggucucaaa

SEQ ID NO: 1080076 - RNA, 21 nt, Human
ccaaagugcugggauuacagg

SEQ ID NO: 1080077 - RNA, 21 nt, Human
ccaaagugcugggauuacagg

SEQ ID NO: 1080078 - RNA, 24 nt, Human
ccaaagugcugggauuacaggugu

SEQ ID NO: 1080079 - RNA, 23 nt, Human
ccaagugauccucccaccucagc

SEQ ID NO: 1080080 - RNA, 23 nt, Human
ccaagugcugggauaacaggcau

SEQ ID NO: 1080081 - RNA, 24 nt, Human
ccaagugcugggauaacaggcaug

SEQ ID NO: 1080082 - RNA, 23 nt, Human
ccaccucagccuccugaguagcu

SEQ ID NO: 1080083 - RNA, 24 nt, Human
ccaccuccuggacccaagugaucc

SEQ ID NO: 1080084 - RNA, 26 nt, Human
ccacuaggaaaccugaggggaaaucc

SEQ ID NO: 1080085 - RNA, 19 nt, Human
ccacugcaccuggccuugg

SEQ ID NO: 1080086 - RNA, 19 nt, Human
ccacugcaccuggccuugg

SEQ ID NO: 1080087 - RNA, 20 nt, Human
ccacugcaccuggccuuggc

SEQ ID NO: 1080088 - RNA, 21 nt, Human
ccacugcaccuggccuuggca

SEQ ID NO: 1080089 - RNA, 19 nt, Human
ccauguugcccaggcuggu

SEQ ID NO: 1080090 - RNA, 22 nt, Human
ccauguugcccaggcuggucuc

SEQ ID NO: 1080091 - RNA, 20 nt, Human
cccaggcuggagugcacugg

SEQ ID NO: 1080092 - RNA, 23 nt, Human
cccagguucaagcaauucuccug

SEQ ID NO: 1080093 - RNA, 26 nt, Human
ccgccucccagguucaagcaauucuu

SEQ ID NO: 1080094 - RNA, 19 nt, Human
ccguuccuugcaucccaga

SEQ ID NO: 1080095 - RNA, 24 nt, Human
ccucaagauuuuuaugcccagccu

SEQ ID NO: 1080096 - RNA, 24 nt, Human
ccucccaccucagccuccugagua

SEQ ID NO: 1080097 - RNA, 24 nt, Human
ccucccagguucaagcaauucucc

SEQ ID NO: 1080098 - RNA, 23 nt, Human
ccugccucagccuuccgaguagc

SEQ ID NO: 1080099 - RNA, 24 nt, Human
ccuggacccaagugauccucccac

SEQ ID NO: 1080100 - RNA, 23 nt, Human
ccuggccuuggcaguuuccuugg

SEQ ID NO: 1080101 - RNA, 24 nt, Human
ccuggccuuggcaguuuccuuggu

SEQ ID NO: 1080102 - RNA, 24 nt, Human
cgcaaccacgcccgacuaauuuuu

SEQ ID NO: 1080103 - RNA, 24 nt, Human
cgccucagccuccccaagugcugg

SEQ ID NO: 1080104 - RNA, 21 nt, Human
cuaccaccagcaaggccacag

SEQ ID NO: 1080105 - RNA, 24 nt, Human
cucacugcaaccuccgccucccag

SEQ ID NO: 1080106 - RNA, 21 nt, Human
cucacugcagccuccaccucc

SEQ ID NO: 1080107 - RNA, 24 nt, Human
cucacugcagccuccaccuccugg

SEQ ID NO: 1080108 - RNA, 24 nt, Human
cuccugaguagcugagaccacagg

SEQ ID NO: 1080109 - RNA, 24 nt, Human
cucucucugucgcccaggcuggag

SEQ ID NO: 1080110 - RNA, 24 nt, Human
cucucugucgcccaggcuggagug

SEQ ID NO: 1080111 - RNA, 23 nt, Human
cugcaaccuccgccucccagguu

SEQ ID NO: 1080112 - RNA, 24 nt, Human
cugcaaccuccgccucccagguuc

SEQ ID NO: 1080113 - RNA, 23 nt, Human
cugcagccuccaccuccuggacc

SEQ ID NO: 1080114 - RNA, 19 nt, Human
cugccacccaggcuggagu

SEQ ID NO: 1080115 - RNA, 24 nt, Human
cugcccgccucagccuccccaagu

SEQ ID NO: 1080116 - RNA, 23 nt, Human
cugccucagccuuccgaguagcu

SEQ ID NO: 1080117 - RNA, 21 nt, Human
gaaaaagucaggggccccuac

SEQ ID NO: 1080118 - RNA, 24 nt, Human
gaccuugugaucugcccgccucag

SEQ ID NO: 1080119 - RNA, 18 nt, Human
gacuaccaccagcaaggc

SEQ ID NO: 1080120 - RNA, 25 nt, Human
gaguagcugagaccacaggcacaug

SEQ ID NO: 1080121 - RNA, 19 nt, Human
gaguggcucccagagcucc

SEQ ID NO: 1080122 - RNA, 21 nt, Human
gauaacaggcaugggccaccg

SEQ ID NO: 1080123 - RNA, 24 nt, Human
gauaacaggcaugggccaccgugc

SEQ ID NO: 1080124 - RNA, 18 nt, Human
gauuacagguguaagcca

SEQ ID NO: 1080125 - RNA, 22 nt, Human
gauuacagguguaagccacugc

SEQ ID NO: 1080126 - RNA, 23 nt, Human
gauuacagguguaagccacugca

SEQ ID NO: 1080127 - RNA, 22 nt, Human
gcaaccuccgccucccagguuc

SEQ ID NO: 1080128 - RNA, 20 nt, Human
gccauguugcccaggcuggu

SEQ ID NO: 1080129 - RNA, 22 nt, Human
gcccgacuaauuuuuguauuuu

SEQ ID NO: 1080130 - RNA, 22 nt, Human
gccuuggccucccaaagugcug

SEQ ID NO: 1080131 - RNA, 19 nt, Human
gcuggagugcaguggcaca

SEQ ID NO: 1080132 - RNA, 24 nt, Human
ggauaacaggcaugggccaccgug

SEQ ID NO: 1080133 - RNA, 22 nt, Human
ggauuacagguguaagccacug

SEQ ID NO: 1080134 - RNA, 22 nt, Human
ggcuggagugcacuggugugau

SEQ ID NO: 1080135 - RNA, 20 nt, Human
ggucucgaucuacugaccuu

SEQ ID NO: 1080136 - RNA, 22 nt, Human
gugaaguauuuuuugcauguug

SEQ ID NO: 1080137 - RNA, 24 nt, Human
gugauccucccaccucagccuccu

SEQ ID NO: 1080138 - RNA, 24 nt, Human
gugaucugcccgccucagccuccc

SEQ ID NO: 1080139 - RNA, 22 nt, Human
uaaacacagccauuacgaauuc

SEQ ID NO: 1080140 - RNA, 25 nt, Human
uaagucaaagagaauugcuagauga

SEQ ID NO: 1080141 - RNA, 24 nt, Human
uaauuuugguauuuuuuauagaga

SEQ ID NO: 1080142 - RNA, 24 nt, Human
uaauuuuuguauuuuuaguagaga

SEQ ID NO: 1080143 - RNA, 22 nt, Human
uacagguguaagccacugcacc

SEQ ID NO: 1080144 - RNA, 22 nt, Human
uagagacaggauuuugccaugu

SEQ ID NO: 1080145 - RNA, 20 nt, Human
uagagacaggguuucaccau

SEQ ID NO: 1080146 - RNA, 23 nt, Human
uagaugaaauaagcugaaguagg

SEQ ID NO: 1080147 - RNA, 21 nt, Human
uagcucacugcagccuccacc

SEQ ID NO: 1080148 - RNA, 19 nt, Human
uaggugaguggcucccaga

SEQ ID NO: 1080149 - RNA, 22 nt, Human
uagguucauuuucuggaguaau

SEQ ID NO: 1080150 - RNA, 19 nt, Human
uaguagagacaggguuuca

SEQ ID NO: 1080151 - RNA, 26 nt, Human
uaguagagacaggguuucaccauauu

SEQ ID NO: 1080152 - RNA, 23 nt, Human
uauagagacaggauuuugccaug

SEQ ID NO: 1080153 - RNA, 24 nt, Human
uauagagacaggauuuugccaugu

SEQ ID NO: 1080154 - RNA, 26 nt, Human
ucacucagcuccauucuuccucgggg

SEQ ID NO: 1080155 - RNA, 19 nt, Human
ucacugcaaccuccgccuc

SEQ ID NO: 1080156 - RNA, 24 nt, Human
ucacugcaaccuccgccucccagg

SEQ ID NO: 1080157 - RNA, 25 nt, Human
ucacugcaaccuccgccucccaggu

SEQ ID NO: 1080158 - RNA, 27 nt, Human
ucacugcaaccuccgccucccagguuc

SEQ ID NO: 1080159 - RNA, 19 nt, Human
ucacugcagccuccaccuc

SEQ ID NO: 1080160 - RNA, 23 nt, Human
ucacugcagccuccaccuccugg

SEQ ID NO: 1080161 - RNA, 24 nt, Human
ucacugcagccuccaccuccugga

SEQ ID NO: 1080162 - RNA, 27 nt, Human
ucacugcagccuccaccuccuggaccc

SEQ ID NO: 1080163 - RNA, 19 nt, Human
ucagagccugcucugagug

SEQ ID NO: 1080164 - RNA, 23 nt, Human
ucccaaagugcugggauuacagg

SEQ ID NO: 1080165 - RNA, 21 nt, Human
ucccagguucaagcaauucuc

SEQ ID NO: 1080166 - RNA, 24 nt, Human
ucccagguucaagcaauucuccug

SEQ ID NO: 1080167 - RNA, 24 nt, Human
uccccaagugcugggauaacaggc

SEQ ID NO: 1080168 - RNA, 24 nt, Human
uccugaguagcugagaccacaggc

SEQ ID NO: 1080169 - RNA, 21 nt, Human
uccuggacccaagugauccuc

SEQ ID NO: 1080170 - RNA, 18 nt, Human
ucgcccaggcuggagugc

SEQ ID NO: 1080171 - RNA, 23 nt, Human
ucucacucugccacccaggcugg

SEQ ID NO: 1080172 - RNA, 24 nt, Human
ucucacucugccacccaggcugga

SEQ ID NO: 1080173 - RNA, 26 nt, Human
ucucacucugccacccaggcuggagu

SEQ ID NO: 1080174 - RNA, 27 nt, Human
ucucacucugccacccaggcuggagug

SEQ ID NO: 1080175 - RNA, 22 nt, Human
ucucaggcagaaaucuuuaaag

SEQ ID NO: 1080176 - RNA, 24 nt, Human
ucuccugccucagccuuccgagua

SEQ ID NO: 1080177 - RNA, 23 nt, Human
ucucucucugucgcccaggcugg

SEQ ID NO: 1080178 - RNA, 24 nt, Human
ucucucucugucgcccaggcugga

SEQ ID NO: 1080179 - RNA, 24 nt, Human
ucucucugucgcccaggcuggagu

SEQ ID NO: 1080180 - RNA, 19 nt, Human
ucucugucgcccaggcugg

SEQ ID NO: 1080181 - RNA, 27 nt, Human
ucucugucgcccaggcuggagugcacu

SEQ ID NO: 1080182 - RNA, 20 nt, Human
ucugagcuaauggcuuauuu

SEQ ID NO: 1080183 - RNA, 24 nt, Human
ucugccacccaggcuggagugcag

SEQ ID NO: 1080184 - RNA, 22 nt, Human
ucugcccgccucagccucccca

SEQ ID NO: 1080185 - RNA, 18 nt, Human
ucugucgcccaggcugga

SEQ ID NO: 1080186 - RNA, 21 nt, Human
ugaaauaagcugaaguaggug

SEQ ID NO: 1080187 - RNA, 21 nt, Human
ugacacaaugcagccauccuc

SEQ ID NO: 1080188 - RNA, 20 nt, Human
ugagacagggucucacucug

SEQ ID NO: 1080189 - RNA, 22 nt, Human
ugagacagggucucacucugcc

SEQ ID NO: 1080190 - RNA, 21 nt, Human
ugagaccacaggcacaugcca

SEQ ID NO: 1080191 - RNA, 24 nt, Human
ugagaccacaggcacaugccacca

SEQ ID NO: 1080192 - RNA, 22 nt, Human
ugagauggagucucucucuguc

SEQ ID NO: 1080193 - RNA, 26 nt, Human
ugcacucaagcaauccuuuugccuug

SEQ ID NO: 1080194 - RNA, 20 nt, Human
ugcauguuguucuauugugu

SEQ ID NO: 1080195 - RNA, 24 nt, Human
ugccauguugcccaggcuggucuc

SEQ ID NO: 1080196 - RNA, 27 nt, Human
ugccauguugcccaggcuggucucaaa

SEQ ID NO: 1080197 - RNA, 24 nt, Human
ugcccaggcuggucucaaacuccu

SEQ ID NO: 1080198 - RNA, 23 nt, Human
ugccucagccuuccgaguagcua

SEQ ID NO: 1080199 - RNA, 24 nt, Human
ugccucagccuuccgaguagcuag

SEQ ID NO: 1080200 - RNA, 22 nt, Human
ugccuuggccucccaaagugcu

SEQ ID NO: 1080201 - RNA, 24 nt, Human
ugcugggauuacagguguaagcca

SEQ ID NO: 1080202 - RNA, 24 nt, Human
uggaguaauacagaauaaaaucac

SEQ ID NO: 1080203 - RNA, 18 nt, Human
uggagugcacugguguga

SEQ ID NO: 1080204 - RNA, 24 nt, Human
uggagugcacuggugugaucuugg

SEQ ID NO: 1080205 - RNA, 18 nt, Human
uggagugcaguggcacaa

SEQ ID NO: 1080206 - RNA, 19 nt, Human
uggagugcaguggcacaau

SEQ ID NO: 1080207 - RNA, 21 nt, Human
uggagugcaguggcacaauca

SEQ ID NO: 1080208 - RNA, 20 nt, Human
uggcacaaucauagcucacu

SEQ ID NO: 1080209 - RNA, 23 nt, Human
uggcacaaucauagcucacugca

SEQ ID NO: 1080210 - RNA, 26 nt, Human
uggcaggugcuucacaaaccagcuuc

SEQ ID NO: 1080211 - RNA, 21 nt, Human
uggccaggcuggucucgaucu

SEQ ID NO: 1080212 - RNA, 22 nt, Human
ugggauaacaggcaugggccac

SEQ ID NO: 1080213 - RNA, 23 nt, Human
ugggauaacaggcaugggccacc

SEQ ID NO: 1080214 - RNA, 24 nt, Human
ugggauaacaggcaugggccaccg

SEQ ID NO: 1080215 - RNA, 19 nt, Human
ugggauuacagguguaagc

SEQ ID NO: 1080216 - RNA, 21 nt, Human
ugggauuacagguguaagcca

SEQ ID NO: 1080217 - RNA, 22 nt, Human
ugggauuacagguguaagccac

SEQ ID NO: 1080218 - RNA, 22 nt, Human
ugggauuacagguguaagccac

SEQ ID NO: 1080219 - RNA, 24 nt, Human
ugggauuacagguguaagccacug

SEQ ID NO: 1080220 - RNA, 19 nt, Human
uggucucaaacuccugcac

SEQ ID NO: 1080221 - RNA, 24 nt, Human
uuaguagagacaggguuucaccau

SEQ ID NO: 1080222 - RNA, 23 nt, Human
uuauagagacaggauuuugccau

SEQ ID NO: 1080223 - RNA, 24 nt, Human
uuauagagacaggauuuugccaug

SEQ ID NO: 1080224 - RNA, 21 nt, Human
uucaagcaauucuccugccuc

SEQ ID NO: 1080225 - RNA, 24 nt, Human
uucaagcaauucuccugccucagc

SEQ ID NO: 1080226 - RNA, 23 nt, Human
uuccgacuaagucaaagagaauu

SEQ ID NO: 1080227 - RNA, 23 nt, Human
uuccgaguagcuaggacuacaug

SEQ ID NO: 1080228 - RNA, 24 nt, Human
uuccuacagaaagaaaacuaaaaa

SEQ ID NO: 1080229 - RNA, 23 nt, Human
uuccugguaacaucuacagucuu

SEQ ID NO: 1080230 - RNA, 21 nt, Human
uugccauguugcccaggcugg

SEQ ID NO: 1080231 - RNA, 24 nt, Human
uugccuuggccucccaaagugcug

SEQ ID NO: 1080232 - RNA, 21 nt, Human
uuuaaacacagccauuacgaa

SEQ ID NO: 1080233 - RNA, 24 nt, Human
uuucaccauauuggccaggcuggu

SEQ ID NO: 1080234 - RNA, 22 nt, Human
uuucauggcaggugcuucacaa

SEQ ID NO: 1080235 - RNA, 20 nt, Human
uuuccuauucucucaggcaa

SEQ ID NO: 1080236 - RNA, 19 nt, Human
uuuuaaggaugcugaagau

SEQ ID NO: 1080237 - RNA, 23 nt, Human
uuuugccauguugcccaggcugg

SEQ ID NO: 1080238 - RNA, 24 nt, Human
uuuuuaguagagacaggguuucac

SEQ ID NO: 1080239 - RNA, 20 nt, Human
uuuuuguauuuuuaguagag

SEQ ID NO: 1080240 - RNA, 23 nt, Human
accagggaggguaaaaccuggca

SEQ ID NO: 1080241 - RNA, 19 nt, Human
caccauccaagcccucauc

SEQ ID NO: 1080242 - RNA, 22 nt, Human
cuaagccugguuccugggaugu

SEQ ID NO: 1080243 - RNA, 19 nt, Human
cuccucuaagccugguucc

SEQ ID NO: 1080244 - RNA, 23 nt, Human
uaaaaccuggcagcucaguguca

SEQ ID NO: 1080245 - RNA, 24 nt, Human
uaccagggaggguaaaaccuggca

SEQ ID NO: 1080246 - RNA, 21 nt, Human
ucaccauccaagcccucaucc

SEQ ID NO: 1080247 - RNA, 20 nt, Human
uccucuaagccugguuccug

SEQ ID NO: 1080248 - RNA, 23 nt, Human
ugugauaccagggaggguaaaac

SEQ ID NO: 1080249 - RNA, 23 nt, Human
ccuaccagcugcaaaaucuguuc

SEQ ID NO: 1080250 - RNA, 20 nt, Human
ugagacccuaccagcugcaa

SEQ ID NO: 1080251 - RNA, 18 nt, Human
aaaauguaaaagcuguga

SEQ ID NO: 1080252 - RNA, 24 nt, Human
aaagugcugggauuacaggcguga

SEQ ID NO: 1080253 - RNA, 25 nt, Human
aagagcagggcaguuuuuuuuuuuu

SEQ ID NO: 1080254 - RNA, 22 nt, Human
aagccaccuccgccggggaccg

SEQ ID NO: 1080255 - RNA, 19 nt, Human
aaguagcugggacuacagg

SEQ ID NO: 1080256 - RNA, 20 nt, Human
aaguagcugggacuacaggc

SEQ ID NO: 1080257 - RNA, 25 nt, Human
aaguagcugggacuacaggcgcccg

SEQ ID NO: 1080258 - RNA, 19 nt, Human
aagugcugggauuacaggc

SEQ ID NO: 1080259 - RNA, 19 nt, Human
aagugcugggauuacaggc

SEQ ID NO: 1080260 - RNA, 26 nt, Human
aagugcugggauuacaggcgugagcc

SEQ ID NO: 1080261 - RNA, 20 nt, Human
acaccaccgcguccaccuga

SEQ ID NO: 1080262 - RNA, 23 nt, Human
accucggccucccaaagugcugg

SEQ ID NO: 1080263 - RNA, 20 nt, Human
acgggguuucaccguuuuag

SEQ ID NO: 1080264 - RNA, 21 nt, Human
acucaggccaaacagccgccc

SEQ ID NO: 1080265 - RNA, 18 nt, Human
acucugucacccaggcua

SEQ ID NO: 1080266 - RNA, 26 nt, Human
acucugucacccaggcuagagucccg

SEQ ID NO: 1080267 - RNA, 20 nt, Human
acugcaagcuccgccucccg

SEQ ID NO: 1080268 - RNA, 19 nt, Human
agacacauaaaccccggca

SEQ ID NO: 1080269 - RNA, 19 nt, Human
agagagcuucagcuguaaa

SEQ ID NO: 1080270 - RNA, 19 nt, Human
agccggaggcggagaaggc

SEQ ID NO: 1080271 - RNA, 30 nt, Human
aggcagucauugaaacauauuucuuguucc

SEQ ID NO: 1080272 - RNA, 20 nt, Human
aggcgcccgccacuacgccc

SEQ ID NO: 1080273 - RNA, 25 nt, Human
aggcuggagugcaguggcgggaucu

SEQ ID NO: 1080274 - RNA, 24 nt, Human
aggcugucuugaacucccggccuc

SEQ ID NO: 1080275 - RNA, 22 nt, Human
agggaguccagccggaggcgga

SEQ ID NO: 1080276 - RNA, 23 nt, Human
agguccuguuuccuugucuccuc

SEQ ID NO: 1080277 - RNA, 18 nt, Human
aguaagacgacacucagg

SEQ ID NO: 1080278 - RNA, 25 nt, Human
aguacaguauccuuagaaacugccc

SEQ ID NO: 1080279 - RNA, 20 nt, Human
aguagagacgggguuucacc

SEQ ID NO: 1080280 - RNA, 21 nt, Human
aguagagacgggguuucaccg

SEQ ID NO: 1080281 - RNA, 21 nt, Human
aguagcuggggcuacaggcau

SEQ ID NO: 1080282 - RNA, 20 nt, Human
agugcaguggcgggaucucg

SEQ ID NO: 1080283 - RNA, 23 nt, Human
agugcaguggcgggaucucggcu

SEQ ID NO: 1080284 - RNA, 24 nt, Human
agugcaguggcgggaucucggcuc

SEQ ID NO: 1080285 - RNA, 20 nt, Human
aguuuuuuuuuuuuuuuuuu

SEQ ID NO: 1080286 - RNA, 18 nt, Human
aucgccgugguccacacc

SEQ ID NO: 1080287 - RNA, 24 nt, Human
caaagugcugggauuacaggcgug

SEQ ID NO: 1080288 - RNA, 21 nt, Human
caagaggcacacuuucaacca

SEQ ID NO: 1080289 - RNA, 24 nt, Human
caagaggcacacuuucaaccagua

SEQ ID NO: 1080290 - RNA, 24 nt, Human
caccguuuuagccgggauggucuc

SEQ ID NO: 1080291 - RNA, 24 nt, Human
caccucagccuccugaguagcugg

SEQ ID NO: 1080292 - RNA, 23 nt, Human
caccuccgucuccacagcagggg

SEQ ID NO: 1080293 - RNA, 22 nt, Human
caccugaggcucgccucgcuuc

SEQ ID NO: 1080294 - RNA, 22 nt, Human
cacgccauucuccugccucagc

SEQ ID NO: 1080295 - RNA, 19 nt, Human
cacuaaaaccacagcagac

SEQ ID NO: 1080296 - RNA, 22 nt, Human
cacucugucacccaggcuagag

SEQ ID NO: 1080297 - RNA, 26 nt, Human
cacucugucacccaggcuagaguccc

SEQ ID NO: 1080298 - RNA, 19 nt, Human
cacuguggccucaaccucc

SEQ ID NO: 1080299 - RNA, 23 nt, Human
cagccgcccccggccagcccgac

SEQ ID NO: 1080300 - RNA, 20 nt, Human
cagccuccugaguagcuggg

SEQ ID NO: 1080301 - RNA, 21 nt, Human
caggcgcccgccacuacgccc

SEQ ID NO: 1080302 - RNA, 18 nt, Human
cauaaaccccggcacucc

SEQ ID NO: 1080303 - RNA, 26 nt, Human
caucccauuuuaaaagccagacacau

SEQ ID NO: 1080304 - RNA, 22 nt, Human
caugggccaccaugcccggaaa

SEQ ID NO: 1080305 - RNA, 19 nt, Human
ccaaacagccgcccccggc

SEQ ID NO: 1080306 - RNA, 21 nt, Human
ccaaagugcuggaguaccgcu

SEQ ID NO: 1080307 - RNA, 22 nt, Human
ccaaagugcugggauuacaggc

SEQ ID NO: 1080308 - RNA, 22 nt, Human
ccaaagugcugggauuacaggc

SEQ ID NO: 1080309 - RNA, 24 nt, Human
ccaaagugcugggauuacaggcgu

SEQ ID NO: 1080310 - RNA, 23 nt, Human
ccaagccauccucccaccucagc

SEQ ID NO: 1080311 - RNA, 25 nt, Human
ccaagccauccucccaccucagccu

SEQ ID NO: 1080312 - RNA, 23 nt, Human
ccaccucagccuccugaguagcu

SEQ ID NO: 1080313 - RNA, 25 nt, Human
ccaugcaaacaagaggcacacuuuc

SEQ ID NO: 1080314 - RNA, 23 nt, Human
cccaaguagcugggacuacaggc

SEQ ID NO: 1080315 - RNA, 24 nt, Human
cccaaguagcugggacuacaggcg

SEQ ID NO: 1080316 - RNA, 23 nt, Human
cccaccucagccuccugaguagc

SEQ ID NO: 1080317 - RNA, 22 nt, Human
cccaggcuggagugcaguggcg

SEQ ID NO: 1080318 - RNA, 22 nt, Human
ccccaaguggccgcaccccucc

SEQ ID NO: 1080319 - RNA, 22 nt, Human
cccccaaguggccgcaccccuc

SEQ ID NO: 1080320 - RNA, 24 nt, Human
cccccggccagcccgacucggcuc

SEQ ID NO: 1080321 - RNA, 24 nt, Human
cccggccucaaacgauccugucac

SEQ ID NO: 1080322 - RNA, 22 nt, Human
ccgcccccggccagcccgacuc

SEQ ID NO: 1080323 - RNA, 21 nt, Human
ccucaaccuccuaggcccaag

SEQ ID NO: 1080324 - RNA, 24 nt, Human
ccucaucccauuuuaaaagccaga

SEQ ID NO: 1080325 - RNA, 24 nt, Human
ccucccaccucagccuccugagua

SEQ ID NO: 1080326 - RNA, 18 nt, Human
ccugaggaacuggagagg

SEQ ID NO: 1080327 - RNA, 24 nt, Human
ccugaguagcuggggcuacaggca

SEQ ID NO: 1080328 - RNA, 21 nt, Human
ccugcccccaaguggccgcac

SEQ ID NO: 1080329 - RNA, 19 nt, Human
cgccucccggguucacgcc

SEQ ID NO: 1080330 - RNA, 20 nt, Human
cgccucgcuuccuggguccc

SEQ ID NO: 1080331 - RNA, 23 nt, Human
cgccucgcuuccugggucccuag

SEQ ID NO: 1080332 - RNA, 24 nt, Human
cgcuuuaguaagacgacacucagg

SEQ ID NO: 1080333 - RNA, 22 nt, Human
cgggcagggggcugcaggauuc

SEQ ID NO: 1080334 - RNA, 23 nt, Human
cgggcgggcagggggcugcagga

SEQ ID NO: 1080335 - RNA, 24 nt, Human
cgggguuucaccguuuuagccggg

SEQ ID NO: 1080336 - RNA, 18 nt, Human
cucaaccuccuaggccca

SEQ ID NO: 1080337 - RNA, 24 nt, Human
cucagccucccaaguagcugggac

SEQ ID NO: 1080338 - RNA, 24 nt, Human
cucagccuccugaguagcuggggc

SEQ ID NO: 1080339 - RNA, 21 nt, Human
cucccggguucacgccauucu

SEQ ID NO: 1080340 - RNA, 21 nt, Human
cuccgcuuucuccugccccca

SEQ ID NO: 1080341 - RNA, 20 nt, Human
cuccuaggcccaagccaucu

SEQ ID NO: 1080342 - RNA, 24 nt, Human
cuccugaccucgugauccgcccgc

SEQ ID NO: 1080343 - RNA, 21 nt, Human
cucgcucugucgcccaggcug

SEQ ID NO: 1080344 - RNA, 24 nt, Human
cucgcucugucgcccaggcuggag

SEQ ID NO: 1080345 - RNA, 20 nt, Human
cucugucgcccaggcuggag

SEQ ID NO: 1080346 - RNA, 24 nt, Human
cugcccccaaguggccgcaccccu

SEQ ID NO: 1080347 - RNA, 23 nt, Human
cugccucagccucccaaguagcu

SEQ ID NO: 1080348 - RNA, 20 nt, Human
cugggucccuagaggggugg

SEQ ID NO: 1080349 - RNA, 22 nt, Human
cuguggccucaaccuccuaggc

SEQ ID NO: 1080350 - RNA, 21 nt, Human
cuugguuggguccagggcggg

SEQ ID NO: 1080351 - RNA, 24 nt, Human
gaaaggcccugaucgccguggucc

SEQ ID NO: 1080352 - RNA, 18 nt, Human
gacacauaaaccccggca

SEQ ID NO: 1080353 - RNA, 24 nt, Human
gacacucaggccaaacagccgccc

SEQ ID NO: 1080354 - RNA, 22 nt, Human
gaccucgugauccgcccgccuc

SEQ ID NO: 1080355 - RNA, 22 nt, Human
gaccucgugauccgcccgccuc

SEQ ID NO: 1080356 - RNA, 24 nt, Human
gaccucgugauccgcccgccucgg

SEQ ID NO: 1080357 - RNA, 30 nt, Human
gagcagggcaguuuuuuuuuuuuuuuuuuu

SEQ ID NO: 1080358 - RNA, 18 nt, Human
gauuacaggcgugagcca

SEQ ID NO: 1080359 - RNA, 20 nt, Human
gauuacaggcgugagccacc

SEQ ID NO: 1080360 - RNA, 22 nt, Human
gauuacaggcgugagccaccgc

SEQ ID NO: 1080361 - RNA, 20 nt, Human
gcccaggcuggagugcagug

SEQ ID NO: 1080362 - RNA, 23 nt, Human
gcccggcuaauuuuuuguauuuu

SEQ ID NO: 1080363 - RNA, 20 nt, Human
gccucagccucccaaguagc

SEQ ID NO: 1080364 - RNA, 25 nt, Human
gccucccggguucacgccauucucc

SEQ ID NO: 1080365 - RNA, 23 nt, Human
gccucggccucccaaagugcugg

SEQ ID NO: 1080366 - RNA, 25 nt, Human
gcucugucgcccaggcuggagugca

SEQ ID NO: 1080367 - RNA, 20 nt, Human
ggcacuaaaaccacagcaga

SEQ ID NO: 1080368 - RNA, 23 nt, Human
ggcaguuuuuuuuuuuuuuuuuu

SEQ ID NO: 1080369 - RNA, 20 nt, Human
ggccucaaccuccuaggccc

SEQ ID NO: 1080370 - RNA, 23 nt, Human
ggcuacaggcaugggccaccaug

SEQ ID NO: 1080371 - RNA, 24 nt, Human
ggcuacaggcaugggccaccaugc

SEQ ID NO: 1080372 - RNA, 20 nt, Human
gggcgggcgggcgcuccccg

SEQ ID NO: 1080373 - RNA, 24 nt, Human
gggcuacaggcaugggccaccaug

SEQ ID NO: 1080374 - RNA, 20 nt, Human
ggucucgaucuccugaccuc

SEQ ID NO: 1080375 - RNA, 19 nt, Human
guagagacgggguuucacc

SEQ ID NO: 1080376 - RNA, 24 nt, Human
gugauccgcccgccucggccuccc

SEQ ID NO: 1080377 - RNA, 24 nt, Human
guuggguccagggcggggcgggcg

SEQ ID NO: 1080378 - RNA, 27 nt, Human
guuuuuuuuuuuuuuuuuuuuuugggg

SEQ ID NO: 1080379 - RNA, 22 nt, Human
uaaaagcugugacugagacaau

SEQ ID NO: 1080380 - RNA, 21 nt, Human
uaaauaaacacaaaacugaau

SEQ ID NO: 1080381 - RNA, 24 nt, Human
uaauuuuuuguauuuuuaguagag

SEQ ID NO: 1080382 - RNA, 25 nt, Human
uaauuuuuuguauuuuuaguagaga

SEQ ID NO: 1080383 - RNA, 23 nt, Human
uacaggcaugggccaccaugccc

SEQ ID NO: 1080384 - RNA, 19 nt, Human
uaccugaggaacuggagag

SEQ ID NO: 1080385 - RNA, 22 nt, Human
uagaaacugcccaguuuuauca

SEQ ID NO: 1080386 - RNA, 24 nt, Human
uaguagaaacaaggucuggcuaug

SEQ ID NO: 1080387 - RNA, 21 nt, Human
uaguagagacgggguuucacc

SEQ ID NO: 1080388 - RNA, 22 nt, Human
uaguagagacgggguuucaccg

SEQ ID NO: 1080389 - RNA, 26 nt, Human
uaguagagacgggguuucaccguuuu

SEQ ID NO: 1080390 - RNA, 22 nt, Human
uaugaugcccaggcugucuuga

SEQ ID NO: 1080391 - RNA, 23 nt, Human
uaugaugcccaggcugucuugaa

SEQ ID NO: 1080392 - RNA, 24 nt, Human
uauuuuuuauuuuuaguagaaaca

SEQ ID NO: 1080393 - RNA, 18 nt, Human
ucacugcaagcuccgccu

SEQ ID NO: 1080394 - RNA, 19 nt, Human
ucacugcaagcuccgccuc

SEQ ID NO: 1080395 - RNA, 24 nt, Human
ucacugcaagcuccgccucccggg

SEQ ID NO: 1080396 - RNA, 19 nt, Human
ucacuguggccucaaccuc

SEQ ID NO: 1080397 - RNA, 18 nt, Human
ucagccucccaaguagcu

SEQ ID NO: 1080398 - RNA, 23 nt, Human
ucagccuccugaguagcuggggc

SEQ ID NO: 1080399 - RNA, 21 nt, Human
ucaguucuaauggcaugguuc

SEQ ID NO: 1080400 - RNA, 18 nt, Human
ucauauauucaucuuugg

SEQ ID NO: 1080401 - RNA, 19 nt, Human
uccauccagcgugaaaccc

SEQ ID NO: 1080402 - RNA, 22 nt, Human
ucccaaagugcuggaguaccuc

SEQ ID NO: 1080403 - RNA, 24 nt, Human
ucccaaagugcugggauuacaggc

SEQ ID NO: 1080404 - RNA, 24 nt, Human
ucccaaguagcugggacuacaggc

SEQ ID NO: 1080405 - RNA, 21 nt, Human
ucccggguucacgccauucuc

SEQ ID NO: 1080406 - RNA, 24 nt, Human
ucccggguucacgccauucuccug

SEQ ID NO: 1080407 - RNA, 20 nt, Human
uccuaggcccaagccauccu

SEQ ID NO: 1080408 - RNA, 24 nt, Human
uccugaguagcuggggcuacaggc

SEQ ID NO: 1080409 - RNA, 22 nt, Human
uccugggucccuagaggggugg

SEQ ID NO: 1080410 - RNA, 24 nt, Human
ucgcccaggcuggagugcaguggc

SEQ ID NO: 1080411 - RNA, 24 nt, Human
ucgcucugucgcccaggcuggagu

SEQ ID NO: 1080412 - RNA, 18 nt, Human
ucggccucccaaagugcu

SEQ ID NO: 1080413 - RNA, 18 nt, Human
ucggccucccaaagugcu

SEQ ID NO: 1080414 - RNA, 23 nt, Human
ucggccucccaaagugcuggagu

SEQ ID NO: 1080415 - RNA, 19 nt, Human
ucucacucugucacccagg

SEQ ID NO: 1080416 - RNA, 23 nt, Human
ucucacucugucacccaggcuag

SEQ ID NO: 1080417 - RNA, 24 nt, Human
ucucacucugucacccaggcuaga

SEQ ID NO: 1080418 - RNA, 24 nt, Human
ucuccucaucccauuuuaaaagcc

SEQ ID NO: 1080419 - RNA, 26 nt, Human
ucuccugccucagccucccaaguagc

SEQ ID NO: 1080420 - RNA, 19 nt, Human
ucucgcucugucgcccagg

SEQ ID NO: 1080421 - RNA, 23 nt, Human
ucucgcucugucgcccaggcugg

SEQ ID NO: 1080422 - RNA, 24 nt, Human
ucucgcucugucgcccaggcugga

SEQ ID NO: 1080423 - RNA, 26 nt, Human
ucucgcucugucgcccaggcuggagu

SEQ ID NO: 1080424 - RNA, 27 nt, Human
ucucgcucugucgcccaggcuggagug

SEQ ID NO: 1080425 - RNA, 23 nt, Human
ucugucacccaggcuagaguccc

SEQ ID NO: 1080426 - RNA, 21 nt, Human
ugaaaagagcagggcaguuuu

SEQ ID NO: 1080427 - RNA, 22 nt, Human
ugagacggagucucgcucuguc

SEQ ID NO: 1080428 - RNA, 24 nt, Human
ugcaaacaagaggcacacuuucaa

SEQ ID NO: 1080429 - RNA, 22 nt, Human
ugcaguggcgggaucucggcuc

SEQ ID NO: 1080430 - RNA, 18 nt, Human
ugcccccaaguggccgca

SEQ ID NO: 1080431 - RNA, 24 nt, Human
ugccucagccucccaaguagcugg

SEQ ID NO: 1080432 - RNA, 24 nt, Human
ugcugggauuacaggcgugagcca

SEQ ID NO: 1080433 - RNA, 23 nt, Human
uggagagguagaauuagaggggg

SEQ ID NO: 1080434 - RNA, 21 nt, Human
uggaguaccgcuaauuuaaaa

SEQ ID NO: 1080435 - RNA, 23 nt, Human
uggagugcaguggcgggaucucg

SEQ ID NO: 1080436 - RNA, 24 nt, Human
uggagugcaguggcgggaucucgg

SEQ ID NO: 1080437 - RNA, 19 nt, Human
uggauaguguccuuucuca

SEQ ID NO: 1080438 - RNA, 22 nt, Human
uggcaugguuccccaaaaugua

SEQ ID NO: 1080439 - RNA, 21 nt, Human
ugggacuacaggcgcccgcca

SEQ ID NO: 1080440 - RNA, 22 nt, Human
ugggacuacaggcgcccgccac

SEQ ID NO: 1080441 - RNA, 22 nt, Human
ugggacuacaggcgcccgccac

SEQ ID NO: 1080442 - RNA, 24 nt, Human
ugggacuacaggcgcccgccacua

SEQ ID NO: 1080443 - RNA, 18 nt, Human
ugggauuacaggcgugag

SEQ ID NO: 1080444 - RNA, 19 nt, Human
ugggauuacaggcgugagc

SEQ ID NO: 1080445 - RNA, 21 nt, Human
ugggauuacaggcgugagcca

SEQ ID NO: 1080446 - RNA, 22 nt, Human
ugggauuacaggcgugagccac

SEQ ID NO: 1080447 - RNA, 23 nt, Human
ugggauuacaggcgugagccacc

SEQ ID NO: 1080448 - RNA, 24 nt, Human
ugggauuacaggcgugagccaccg

SEQ ID NO: 1080449 - RNA, 22 nt, Human
uggggcuacaggcaugggccac

SEQ ID NO: 1080450 - RNA, 24 nt, Human
uggggcuacaggcaugggccacca

SEQ ID NO: 1080451 - RNA, 20 nt, Human
uggguccagggcggggcggg

SEQ ID NO: 1080452 - RNA, 23 nt, Human
uguaaaagcugugacugagacaa

SEQ ID NO: 1080453 - RNA, 21 nt, Human
ugucgcccaggcuggagugca

SEQ ID NO: 1080454 - RNA, 19 nt, Human
ugugaaaagacaaaagauc

SEQ ID NO: 1080455 - RNA, 22 nt, Human
uuaguagagacgggguuucacc

SEQ ID NO: 1080456 - RNA, 22 nt, Human
uuaguagagacgggguuucacc

SEQ ID NO: 1080457 - RNA, 24 nt, Human
uuaguagagacgggguuucaccgu

SEQ ID NO: 1080458 - RNA, 24 nt, Human
uucacuguggccucaaccuccuag

SEQ ID NO: 1080459 - RNA, 23 nt, Human
uuccuugucuccucaucccauuu

SEQ ID NO: 1080460 - RNA, 23 nt, Human
uuguauuuuuaguagagacgggg

SEQ ID NO: 1080461 - RNA, 19 nt, Human
uuguucucuuuugcaucau

SEQ ID NO: 1080462 - RNA, 24 nt, Human
uuuuuaguagagacgggguuucac

SEQ ID NO: 1080463 - RNA, 21 nt, Human
uuuuuguauuuuuaguagaga

SEQ ID NO: 1080464 - RNA, 24 nt, Human
uuuuuuguauuuuuaguagagacg

SEQ ID NO: 1080465 - RNA, 25 nt, Human
uuuuuuuuuuuugagacggagucuc

SEQ ID NO: 1080466 - RNA, 22 nt, Human
uuuuuuuuuuuuuugagacgga

SEQ ID NO: 1080467 - RNA, 18 nt, Human
aaacaaggcagaaacaca

SEQ ID NO: 1080468 - RNA, 18 nt, Human
aacaaggcagaaacacag

SEQ ID NO: 1080469 - RNA, 18 nt, Human
aagaaaaaaacagauaug

SEQ ID NO: 1080470 - RNA, 21 nt, Human
aagcacugcagcguaggcagc

SEQ ID NO: 1080471 - RNA, 23 nt, Human
aaguuuccaaccagaagaagcuu

SEQ ID NO: 1080472 - RNA, 24 nt, Human
agaaaaaaacagauaugaaggcua

SEQ ID NO: 1080473 - RNA, 22 nt, Human
agaaacccagaagcaggaaaca

SEQ ID NO: 1080474 - RNA, 25 nt, Human
agacaggagaggcucaaaggggacc

SEQ ID NO: 1080475 - RNA, 22 nt, Human
agagagaaagagacuugucuaa

SEQ ID NO: 1080476 - RNA, 21 nt, Human
agaggcucaaagagagaaaga

SEQ ID NO: 1080477 - RNA, 24 nt, Human
aggaauguggagaaacccagaagc

SEQ ID NO: 1080478 - RNA, 24 nt, Human
aggcuauaggaauguggagaaacc

SEQ ID NO: 1080479 - RNA, 21 nt, Human
agugcauucucaaauacagcu

SEQ ID NO: 1080480 - RNA, 22 nt, Human
augacagaaagaaaaggagaca

SEQ ID NO: 1080481 - RNA, 23 nt, Human
augacagaaagaaaaggagacac

SEQ ID NO: 1080482 - RNA, 18 nt, Human
caaauacagcugaaagca

SEQ ID NO: 1080483 - RNA, 21 nt, Human
caaccagaagaagcuucauaa

SEQ ID NO: 1080484 - RNA, 18 nt, Human
cagaaagaaaaggagaca

SEQ ID NO: 1080485 - RNA, 18 nt, Human
cagauccccuggccugug

SEQ ID NO: 1080486 - RNA, 23 nt, Human
cagccaucugcaaacguaaaaca

SEQ ID NO: 1080487 - RNA, 19 nt, Human
cagcguaggcagcugaauc

SEQ ID NO: 1080488 - RNA, 23 nt, Human
cagcugaaucccauuaagaaauc

SEQ ID NO: 1080489 - RNA, 22 nt, Human
ccacaggcucaggcuggacuug

SEQ ID NO: 1080490 - RNA, 23 nt, Human
ccaucugcaaacguaaaacaagg

SEQ ID NO: 1080491 - RNA, 21 nt, Human
cccagaagcaggaaacagggu

SEQ ID NO: 1080492 - RNA, 21 nt, Human
cccucccaggggaucuaagag

SEQ ID NO: 1080493 - RNA, 24 nt, Human
ccugggugucgggugccagggcug

SEQ ID NO: 1080494 - RNA, 20 nt, Human
ccuuagacuccucguggccg

SEQ ID NO: 1080495 - RNA, 23 nt, Human
cucauggcccaugagcucuugcc

SEQ ID NO: 1080496 - RNA, 24 nt, Human
cuccccucuguuauuucaucugau

SEQ ID NO: 1080497 - RNA, 21 nt, Human
cucuauguugucaugcccucc

SEQ ID NO: 1080498 - RNA, 23 nt, Human
cucuauguugucaugcccuccca

SEQ ID NO: 1080499 - RNA, 23 nt, Human
cugaaucccauuaagaaaucaug

SEQ ID NO: 1080500 - RNA, 20 nt, Human
cuuccuguagcccacucucc

SEQ ID NO: 1080501 - RNA, 25 nt, Human
gaaaaggagacacggagaguuccag

SEQ ID NO: 1080502 - RNA, 23 nt, Human
gaaagaaaaggagacacggagag

SEQ ID NO: 1080503 - RNA, 18 nt, Human
gaagcaggaaacagggug

SEQ ID NO: 1080504 - RNA, 20 nt, Human
gugccagggcugcucugguu

SEQ ID NO: 1080505 - RNA, 23 nt, Human
uaagaaaaaaacagauaugaagg

SEQ ID NO: 1080506 - RNA, 21 nt, Human
ucaggcuuuccuugcuuucag

SEQ ID NO: 1080507 - RNA, 23 nt, Human
ucaggcuuuccuugcuuucagug

SEQ ID NO: 1080508 - RNA, 21 nt, Human
ucccaggggaucuaagagacc

SEQ ID NO: 1080509 - RNA, 22 nt, Human
uccuguagcccacucuccuggg

SEQ ID NO: 1080510 - RNA, 22 nt, Human
ucuaguuucugcagacucugug

SEQ ID NO: 1080511 - RNA, 18 nt, Human
ucuccacugccgaccaca

SEQ ID NO: 1080512 - RNA, 18 nt, Human
ucugcagacucugugggc

SEQ ID NO: 1080513 - RNA, 18 nt, Human
ugaaagcacugcagcgua

SEQ ID NO: 1080514 - RNA, 24 nt, Human
ugaaagcacugcagcguaggcagc

SEQ ID NO: 1080515 - RNA, 20 nt, Human
ugaaggcuaagguccucuuu

SEQ ID NO: 1080516 - RNA, 18 nt, Human
ugacagaaagaaaaggag

SEQ ID NO: 1080517 - RNA, 18 nt, Human
ugccaguggccuggugcu

SEQ ID NO: 1080518 - RNA, 22 nt, Human
ugccucuaguuucugcagacuc

SEQ ID NO: 1080519 - RNA, 19 nt, Human
uggccuggugcugaugggg

SEQ ID NO: 1080520 - RNA, 18 nt, Human
uggcuccuggcuacaacc

SEQ ID NO: 1080521 - RNA, 21 nt, Human
ugggaggaggaccugucuucc

SEQ ID NO: 1080522 - RNA, 24 nt, Human
ugucaugcccucccaggggaucua

SEQ ID NO: 1080523 - RNA, 22 nt, Human
ugucgggugccagggcugcucu

SEQ ID NO: 1080524 - RNA, 18 nt, Human
ugugccucuaguuucugc

SEQ ID NO: 1080525 - RNA, 26 nt, Human
uguggagaaacccagaagcaggaaac

SEQ ID NO: 1080526 - RNA, 23 nt, Human
uguucccaccacacugggcuuac

SEQ ID NO: 1080527 - RNA, 28 nt, Human
uguugaaugcuuuuaaaggacucuucuu

SEQ ID NO: 1080528 - RNA, 18 nt, Human
uuccaaccagaagaagcu

SEQ ID NO: 1080529 - RNA, 18 nt, Human
uucccaccacacugggcu

SEQ ID NO: 1080530 - RNA, 23 nt, Human
uuccuguagcccacucuccuggg

SEQ ID NO: 1080531 - RNA, 24 nt, Human
uucucaaagaaugugggacuauac

SEQ ID NO: 1080532 - RNA, 18 nt, Human
aaagagcaggaggauggg

SEQ ID NO: 1080533 - RNA, 20 nt, Human
agaacauuccauacugccua

SEQ ID NO: 1080534 - RNA, 23 nt, Human
ccaccuccuauuaccaucacacu

SEQ ID NO: 1080535 - RNA, 24 nt, Human
cccagauauucggaccauagcaac

SEQ ID NO: 1080536 - RNA, 22 nt, Human
cccaguacaauuuuacauuaga

SEQ ID NO: 1080537 - RNA, 19 nt, Human
ccuccuauuaccaucacac

SEQ ID NO: 1080538 - RNA, 22 nt, Human
cuacuuugugguucauagauga

SEQ ID NO: 1080539 - RNA, 23 nt, Human
cucauccgaccagcccaguacaa

SEQ ID NO: 1080540 - RNA, 20 nt, Human
cuugggcuggucggucugag

SEQ ID NO: 1080541 - RNA, 23 nt, Human
gaccauagcaacuaccuuauuca

SEQ ID NO: 1080542 - RNA, 22 nt, Human
gcaggcccagauauucggacca

SEQ ID NO: 1080543 - RNA, 22 nt, Human
guaaaaauccuggaauguuccg

SEQ ID NO: 1080544 - RNA, 20 nt, Human
guguuugggccaagucuuca

SEQ ID NO: 1080545 - RNA, 18 nt, Human
uaaauaagaacauuccau

SEQ ID NO: 1080546 - RNA, 20 nt, Human
uauaagggcacuaaucucau

SEQ ID NO: 1080547 - RNA, 24 nt, Human
ucagagcucagucccaccuccuau

SEQ ID NO: 1080548 - RNA, 23 nt, Human
ugggggggcaggcccagauauuc

SEQ ID NO: 1080549 - RNA, 19 nt, Human
uuccauacugccuaacauu

SEQ ID NO: 1080550 - RNA, 18 nt, Human
uuggugagauguuucuug

SEQ ID NO: 1080551 - RNA, 22 nt, Human
uuuaccaaauucugguucucca

SEQ ID NO: 1080552 - RNA, 25 nt, Human
aaaaaaagaagaaagaaagaaagaa

SEQ ID NO: 1080553 - RNA, 19 nt, Human
aaaaaauaaaaaaauaggc

SEQ ID NO: 1080554 - RNA, 23 nt, Human
aaaagaaaauacaaaaaauaaaa

SEQ ID NO: 1080555 - RNA, 26 nt, Human
aaaagaaaauacaaaaaauaaaaaaa

SEQ ID NO: 1080556 - RNA, 21 nt, Human
aaacaggaauaauccccagaa

SEQ ID NO: 1080557 - RNA, 23 nt, Human
aaacaucuugagagacuucauuc

SEQ ID NO: 1080558 - RNA, 22 nt, Human
aaagaaaaaaaagaagaaagaa

SEQ ID NO: 1080559 - RNA, 22 nt, Human
aaagaaagagaaagaaagaaaa

SEQ ID NO: 1080560 - RNA, 25 nt, Human
aaagagaaagaaagaaaaagcaaga

SEQ ID NO: 1080561 - RNA, 24 nt, Human
aaagcagacagauccuugagguca

SEQ ID NO: 1080562 - RNA, 26 nt, Human
aaagcagacagauccuugaggucagg

SEQ ID NO: 1080563 - RNA, 24 nt, Human
aaauaggcugggcgugguggcuca

SEQ ID NO: 1080564 - RNA, 18 nt, Human
aacaggaauaauccccag

SEQ ID NO: 1080565 - RNA, 19 nt, Human
aacaugacaaaaccccauc

SEQ ID NO: 1080566 - RNA, 21 nt, Human
aacaugacaaaaccccaucuc

SEQ ID NO: 1080567 - RNA, 21 nt, Human
aacaugacaaaaccccaucuc

SEQ ID NO: 1080568 - RNA, 24 nt, Human
aaccucaggugauccaccugccuu

SEQ ID NO: 1080569 - RNA, 23 nt, Human
aagaaaaagcaagagaaagagau

SEQ ID NO: 1080570 - RNA, 25 nt, Human
aagaaaaagcaagagaaagagauua

SEQ ID NO: 1080571 - RNA, 21 nt, Human
aagaaagaaaaagcaagagaa

SEQ ID NO: 1080572 - RNA, 21 nt, Human
aagaaagaaagaaagaaagaa

SEQ ID NO: 1080573 - RNA, 23 nt, Human
aagaaagaaagaaagaaagagaa

SEQ ID NO: 1080574 - RNA, 21 nt, Human
aagaaagaaagaaggaaagaa

SEQ ID NO: 1080575 - RNA, 21 nt, Human
aagaaagaaagagaaagaaag

SEQ ID NO: 1080576 - RNA, 21 nt, Human
aagaaagagaaagaaagaaaa

SEQ ID NO: 1080577 - RNA, 21 nt, Human
aagaaggaaagaaagaaagaa

SEQ ID NO: 1080578 - RNA, 21 nt, Human
aagagaaagagauuaccaaaa

SEQ ID NO: 1080579 - RNA, 25 nt, Human
aagcaagagaaagagauuaccaaaa

SEQ ID NO: 1080580 - RNA, 19 nt, Human
aaguagcugggauuacagg

SEQ ID NO: 1080581 - RNA, 26 nt, Human
aaguagcugggauuacaggugacugc

SEQ ID NO: 1080582 - RNA, 23 nt, Human
aauacaaaaaauaaaaaaauagg

SEQ ID NO: 1080583 - RNA, 24 nt, Human
aauggugcgcaccuguaaucccag

SEQ ID NO: 1080584 - RNA, 24 nt, Human
aaugugcucagauuacagguguga

SEQ ID NO: 1080585 - RNA, 19 nt, Human
acacagugagacccugucu

SEQ ID NO: 1080586 - RNA, 20 nt, Human
acacagugagacccugucuc

SEQ ID NO: 1080587 - RNA, 19 nt, Human
accaaccaacacuccacca

SEQ ID NO: 1080588 - RNA, 21 nt, Human
accagcgagaacaaccaugug

SEQ ID NO: 1080589 - RNA, 26 nt, Human
accuuacuuuaugugucucuccauug

SEQ ID NO: 1080590 - RNA, 23 nt, Human
acgagguucacgguguuggccag

SEQ ID NO: 1080591 - RNA, 25 nt, Human
acucuguugcccaggcugaagugca

SEQ ID NO: 1080592 - RNA, 24 nt, Human
agaaaaaaaagaagaaagaaagaa

SEQ ID NO: 1080593 - RNA, 19 nt, Human
agaaaaagcaagagaaaga

SEQ ID NO: 1080594 - RNA, 20 nt, Human
agaaagaaaaagcaagagaa

SEQ ID NO: 1080595 - RNA, 24 nt, Human
agaaagaauacacuuugcaaagaa

SEQ ID NO: 1080596 - RNA, 23 nt, Human
agaaagagauuaccaaaagaaaa

SEQ ID NO: 1080597 - RNA, 25 nt, Human
agacagauccuugaggucaggaguu

SEQ ID NO: 1080598 - RNA, 23 nt, Human
agaccaaagcagacagauccuug

SEQ ID NO: 1080599 - RNA, 25 nt, Human
agagaaagagauuaccaaaagaaaa

SEQ ID NO: 1080600 - RNA, 21 nt, Human
agauccuugaggucaggaguu

SEQ ID NO: 1080601 - RNA, 22 nt, Human
agauccuugaggucaggaguuu

SEQ ID NO: 1080602 - RNA, 24 nt, Human
agauccuugaggucaggaguuuga

SEQ ID NO: 1080603 - RNA, 24 nt, Human
agauuacaggugugagccacggca

SEQ ID NO: 1080604 - RNA, 24 nt, Human
agauuacaggugugagccacggca

SEQ ID NO: 1080605 - RNA, 28 nt, Human
agcaagagaaagagauuaccaaaagaaa

SEQ ID NO: 1080606 - RNA, 24 nt, Human
agcgauucucgugccucagccucc

SEQ ID NO: 1080607 - RNA, 22 nt, Human
agcuucgcauccagcgcccucc

SEQ ID NO: 1080608 - RNA, 21 nt, Human
aggaaagaaagaaagaaagaa

SEQ ID NO: 1080609 - RNA, 20 nt, Human
aggaguuugagaccagacug

SEQ ID NO: 1080610 - RNA, 22 nt, Human
aggcugggcgugguggcucaug

SEQ ID NO: 1080611 - RNA, 24 nt, Human
aggugauccaccugccuuggccuc

SEQ ID NO: 1080612 - RNA, 24 nt, Human
auccuugaggucaggaguuugaga

SEQ ID NO: 1080613 - RNA, 31 nt, Human
augaaaccccaauaaaaacuuuagauaccgg

SEQ ID NO: 1080614 - RNA, 19 nt, Human
augccuguaaucccagcac

SEQ ID NO: 1080615 - RNA, 23 nt, Human
augccuguaaucccagcacguug

SEQ ID NO: 1080616 - RNA, 22 nt, Human
auuugggcuggaagaugagaug

SEQ ID NO: 1080617 - RNA, 27 nt, Human
caaaagaaaauacaaaaaauaaaaaaa

SEQ ID NO: 1080618 - RNA, 21 nt, Human
caaagaaugaugcccucagac

SEQ ID NO: 1080619 - RNA, 22 nt, Human
caaagugugacuggcaucaaaa

SEQ ID NO: 1080620 - RNA, 23 nt, Human
caagagaaagagauuaccaaaag

SEQ ID NO: 1080621 - RNA, 20 nt, Human
caagauggaggccaguuacc

SEQ ID NO: 1080622 - RNA, 27 nt, Human
caagcgauucucgugccucagccuccc

SEQ ID NO: 1080623 - RNA, 24 nt, Human
caccaugcccggcuaauuuuugua

SEQ ID NO: 1080624 - RNA, 22 nt, Human
cacccagccaaaccccuagauu

SEQ ID NO: 1080625 - RNA, 19 nt, Human
caccuguaaucccagcuac

SEQ ID NO: 1080626 - RNA, 23 nt, Human
caccuguaaucccagcuacucca

SEQ ID NO: 1080627 - RNA, 22 nt, Human
cacgguguuggccaggcugcuc

SEQ ID NO: 1080628 - RNA, 18 nt, Human
cacuccaccauuggcaag

SEQ ID NO: 1080629 - RNA, 18 nt, Human
cacuccaccauuggcaag

SEQ ID NO: 1080630 - RNA, 20 nt, Human
cacuccaccauuggcaaguu

SEQ ID NO: 1080631 - RNA, 24 nt, Human
cacucuguugcccaggcugaagug

SEQ ID NO: 1080632 - RNA, 18 nt, Human
cacugcaaccucugccuc

SEQ ID NO: 1080633 - RNA, 21 nt, Human
cacugcaaccucugccuccca

SEQ ID NO: 1080634 - RNA, 23 nt, Human
cagacagauccuugaggucagga

SEQ ID NO: 1080635 - RNA, 20 nt, Human
cagaccucuccuaccaacca

SEQ ID NO: 1080636 - RNA, 20 nt, Human
cagauuacaggugugagcca

SEQ ID NO: 1080637 - RNA, 18 nt, Human
cauccagcgcccuccuag

SEQ ID NO: 1080638 - RNA, 21 nt, Human
cauccagcgcccuccuagacc

SEQ ID NO: 1080639 - RNA, 22 nt, Human
cauggugaagcauccugguugg

SEQ ID NO: 1080640 - RNA, 23 nt, Human
ccaaagcagacagauccuugagg

SEQ ID NO: 1080641 - RNA, 24 nt, Human
ccaaagugugacuggcaucaaaag

SEQ ID NO: 1080642 - RNA, 21 nt, Human
ccaaguagcugggauuacagg

SEQ ID NO: 1080643 - RNA, 24 nt, Human
ccaaugugcucagauuacaggugu

SEQ ID NO: 1080644 - RNA, 18 nt, Human
ccagcgagaacaaccaug

SEQ ID NO: 1080645 - RNA, 19 nt, Human
ccaguuaccagcgagaaca

SEQ ID NO: 1080646 - RNA, 22 nt, Human
cccaaguagcugggauuacagg

SEQ ID NO: 1080647 - RNA, 23 nt, Human
cccaaguagcugggauuacaggu

SEQ ID NO: 1080648 - RNA, 24 nt, Human
cccaaguagcugggauuacaggug

SEQ ID NO: 1080649 - RNA, 20 nt, Human
cccagcacguugggagacca

SEQ ID NO: 1080650 - RNA, 20 nt, Human
cccagguucaagcgauucuc

SEQ ID NO: 1080651 - RNA, 22 nt, Human
cccucagaccucuccuaccaac

SEQ ID NO: 1080652 - RNA, 21 nt, Human
ccuaaccucaggugauccacc

SEQ ID NO: 1080653 - RNA, 23 nt, Human
ccuaaccucaggugauccaccug

SEQ ID NO: 1080654 - RNA, 23 nt, Human
ccuaaccucaggugauccaccug

SEQ ID NO: 1080655 - RNA, 21 nt, Human
ccuaccaaccaacacuccacc

SEQ ID NO: 1080656 - RNA, 22 nt, Human
ccuaggaggcagacucaaaaua

SEQ ID NO: 1080657 - RNA, 22 nt, Human
ccucccagguucaagcgauucu

SEQ ID NO: 1080658 - RNA, 21 nt, Human
ccugccuuggccucccaaugu

SEQ ID NO: 1080659 - RNA, 20 nt, Human
ccuguaaucccagcacguug

SEQ ID NO: 1080660 - RNA, 22 nt, Human
ccuguaaucccagcuacuccag

SEQ ID NO: 1080661 - RNA, 23 nt, Human
ccuguaaucccagcuacuccaga

SEQ ID NO: 1080662 - RNA, 24 nt, Human
ccugucuccaaagaaaaaaaagaa

SEQ ID NO: 1080663 - RNA, 24 nt, Human
ccuugaggucaggaguuugagacc

SEQ ID NO: 1080664 - RNA, 23 nt, Human
cgagguucacgguguuggccagg

SEQ ID NO: 1080665 - RNA, 19 nt, Human
cgcaccuguaaucccagcu

SEQ ID NO: 1080666 - RNA, 24 nt, Human
cucacugcaaccucugccucccag

SEQ ID NO: 1080667 - RNA, 24 nt, Human
cucacugcaaccucugccucccag

SEQ ID NO: 1080668 - RNA, 22 nt, Human
cucagaccucuccuaccaacca

SEQ ID NO: 1080669 - RNA, 23 nt, Human
cucagccucccaaguagcuggga

SEQ ID NO: 1080670 - RNA, 24 nt, Human
cucaggugauccaccugccuuggc

SEQ ID NO: 1080671 - RNA, 25 nt, Human
cucaugccuguaaucccagcacguu

SEQ ID NO: 1080672 - RNA, 24 nt, Human
cucccaaagugugacuggcaucaa

SEQ ID NO: 1080673 - RNA, 25 nt, Human
cucgugccucagccucccaaguagc

SEQ ID NO: 1080674 - RNA, 23 nt, Human
cugcaaccucugccucccagguu

SEQ ID NO: 1080675 - RNA, 24 nt, Human
cugcaaccucugccucccagguuc

SEQ ID NO: 1080676 - RNA, 23 nt, Human
cugccuuggccucccaaugugcu

SEQ ID NO: 1080677 - RNA, 23 nt, Human
cuggccaacaugacaaaacccca

SEQ ID NO: 1080678 - RNA, 23 nt, Human
cuuauauccuucauaauaaaaca

SEQ ID NO: 1080679 - RNA, 20 nt, Human
cuucgcauccagcgcccucc

SEQ ID NO: 1080680 - RNA, 20 nt, Human
gaaagaaagaaggaaagaaa

SEQ ID NO: 1080681 - RNA, 21 nt, Human
gacacagugagacccugucuc

SEQ ID NO: 1080682 - RNA, 19 nt, Human
gagaaagaaagaaaaagca

SEQ ID NO: 1080683 - RNA, 25 nt, Human
gagaaagagauuaccaaaagaaaau

SEQ ID NO: 1080684 - RNA, 21 nt, Human
gagguucacgguguuggccag

SEQ ID NO: 1080685 - RNA, 23 nt, Human
gauccuugaggucaggaguuuga

SEQ ID NO: 1080686 - RNA, 18 nt, Human
gauuacaggugacugcca

SEQ ID NO: 1080687 - RNA, 24 nt, Human
gauuacaggugacugccaccaugc

SEQ ID NO: 1080688 - RNA, 18 nt, Human
gauuacaggugugagcca

SEQ ID NO: 1080689 - RNA, 19 nt, Human
gcaaaacaggaauaauccc

SEQ ID NO: 1080690 - RNA, 25 nt, Human
gcauggugaagcauccugguuggug

SEQ ID NO: 1080691 - RNA, 21 nt, Human
gccaacaugacaaaaccccau

SEQ ID NO: 1080692 - RNA, 22 nt, Human
gcccggcuaauuuuuguauuuu

SEQ ID NO: 1080693 - RNA, 24 nt, Human
gcgauucucgugccucagccuccc

SEQ ID NO: 1080694 - RNA, 23 nt, Human
gcgcccuccuagaccuuacuucu

SEQ ID NO: 1080695 - RNA, 20 nt, Human
gcugaagugcaguggcacca

SEQ ID NO: 1080696 - RNA, 21 nt, Human
gcugggcgugguggcucaugc

SEQ ID NO: 1080697 - RNA, 23 nt, Human
ggcugggcgugguggcucaugcc

SEQ ID NO: 1080698 - RNA, 24 nt, Human
gggcgugguggcucaugccuguaa

SEQ ID NO: 1080699 - RNA, 19 nt, Human
ggucaggaguuugagacca

SEQ ID NO: 1080700 - RNA, 22 nt, Human
ggugaagcauccugguugguga

SEQ ID NO: 1080701 - RNA, 24 nt, Human
gguggcucaugccuguaaucccag

SEQ ID NO: 1080702 - RNA, 18 nt, Human
guagcugggauuacaggu

SEQ ID NO: 1080703 - RNA, 21 nt, Human
gugacacacccgauuccacaa

SEQ ID NO: 1080704 - RNA, 24 nt, Human
gugauccaccugccuuggccuccc

SEQ ID NO: 1080705 - RNA, 22 nt, Human
gugccucagccucccaaguagc

SEQ ID NO: 1080706 - RNA, 23 nt, Human
gugccucagccucccaaguagcu

SEQ ID NO: 1080707 - RNA, 21 nt, Human
gugcucagauuacagguguga

SEQ ID NO: 1080708 - RNA, 23 nt, Human
guggcucaugccuguaaucccag

SEQ ID NO: 1080709 - RNA, 24 nt, Human
uaaccucaggugauccaccugccu

SEQ ID NO: 1080710 - RNA, 19 nt, Human
uaagggguaggguggagau

SEQ ID NO: 1080711 - RNA, 22 nt, Human
uaauuuuuguauuuuuaguaga

SEQ ID NO: 1080712 - RNA, 24 nt, Human
uacaggugugagccacggcaccca

SEQ ID NO: 1080713 - RNA, 21 nt, Human
uacccuguagugucauagaau

SEQ ID NO: 1080714 - RNA, 20 nt, Human
uagaaaaucuauaaugaagg

SEQ ID NO: 1080715 - RNA, 22 nt, Human
uagaaaaucuauaaugaaggac

SEQ ID NO: 1080716 - RNA, 22 nt, Human
uagauaccgaagcauggugaag

SEQ ID NO: 1080717 - RNA, 18 nt, Human
uagcuggauguaauggug

SEQ ID NO: 1080718 - RNA, 20 nt, Human
uaguagauacgagguucacg

SEQ ID NO: 1080719 - RNA, 24 nt, Human
uauauccuucauaauaaaacaauu

SEQ ID NO: 1080720 - RNA, 24 nt, Human
uauuuagaaaaucuauaaugaagg

SEQ ID NO: 1080721 - RNA, 18 nt, Human
ucacaccugaauuugggc

SEQ ID NO: 1080722 - RNA, 19 nt, Human
ucacugcaaccucugccuc

SEQ ID NO: 1080723 - RNA, 23 nt, Human
ucacugcaaccucugccucccag

SEQ ID NO: 1080724 - RNA, 24 nt, Human
ucacugcaaccucugccucccagg

SEQ ID NO: 1080725 - RNA, 22 nt, Human
ucagauuacaggugugagccac

SEQ ID NO: 1080726 - RNA, 20 nt, Human
ucagccucccaaguagcugg

SEQ ID NO: 1080727 - RNA, 27 nt, Human
ucagcucacugcaaccucugccuccca

SEQ ID NO: 1080728 - RNA, 21 nt, Human
ucaggugauccaccugccuug

SEQ ID NO: 1080729 - RNA, 22 nt, Human
ucaugccuguaaucccagcacg

SEQ ID NO: 1080730 - RNA, 25 nt, Human
ucauugucaucaugcuuuccccggg

SEQ ID NO: 1080731 - RNA, 21 nt, Human
uccaaagaaaaaaaagaagaa

SEQ ID NO: 1080732 - RNA, 23 nt, Human
uccaaagaaaaaaaagaagaaag

SEQ ID NO: 1080733 - RNA, 23 nt, Human
uccaaagaaaaaaaagaagaaag

SEQ ID NO: 1080734 - RNA, 23 nt, Human
uccacaaugcaggacaugaaagc

SEQ ID NO: 1080735 - RNA, 23 nt, Human
ucccaaguagcugggauuacagg

SEQ ID NO: 1080736 - RNA, 23 nt, Human
ucccaaugugcucagauuacagg

SEQ ID NO: 1080737 - RNA, 21 nt, Human
ucccagguucaagcgauucuc

SEQ ID NO: 1080738 - RNA, 24 nt, Human
ucccagguucaagcgauucucgug

SEQ ID NO: 1080739 - RNA, 19 nt, Human
uccccagaaaaggugaaaa

SEQ ID NO: 1080740 - RNA, 19 nt, Human
ucccuaaguaacagggaua

SEQ ID NO: 1080741 - RNA, 21 nt, Human
uccuaggaggcagacucaaaa

SEQ ID NO: 1080742 - RNA, 21 nt, Human
uccuugaggucaggaguuuga

SEQ ID NO: 1080743 - RNA, 18 nt, Human
ucuaacccuaauuagugc

SEQ ID NO: 1080744 - RNA, 19 nt, Human
ucucacucuguugcccagg

SEQ ID NO: 1080745 - RNA, 21 nt, Human
ucucacucuguugcccaggcu

SEQ ID NO: 1080746 - RNA, 23 nt, Human
ucucacucuguugcccaggcuga

SEQ ID NO: 1080747 - RNA, 24 nt, Human
ucucacucuguugcccaggcugaa

SEQ ID NO: 1080748 - RNA, 26 nt, Human
ucucacucuguugcccaggcugaagu

SEQ ID NO: 1080749 - RNA, 23 nt, Human
ucuccaaagaaaaaaaagaagaa

SEQ ID NO: 1080750 - RNA, 18 nt, Human
ugaagcauccugguuggu

SEQ ID NO: 1080751 - RNA, 25 nt, Human
ugacaaaaccccaucuccacuaaaa

SEQ ID NO: 1080752 - RNA, 25 nt, Human
ugagaaguggucauugucaucaugc

SEQ ID NO: 1080753 - RNA, 23 nt, Human
ugagagacuucauucugugcaga

SEQ ID NO: 1080754 - RNA, 18 nt, Human
ugaggucaggaguuugag

SEQ ID NO: 1080755 - RNA, 22 nt, Human
ugcaguggcaccaucucagcuc

SEQ ID NO: 1080756 - RNA, 23 nt, Human
ugcccaggcugaagugcaguggc

SEQ ID NO: 1080757 - RNA, 24 nt, Human
ugcccaggcugaagugcaguggca

SEQ ID NO: 1080758 - RNA, 24 nt, Human
ugcccggcuaauuuuuguauuuuu

SEQ ID NO: 1080759 - RNA, 18 nt, Human
ugcccuaaagaaguuuuc

SEQ ID NO: 1080760 - RNA, 20 nt, Human
ugcccucagaccucuccuac

SEQ ID NO: 1080761 - RNA, 24 nt, Human
ugccucagccucccaaguagcugg

SEQ ID NO: 1080762 - RNA, 23 nt, Human
ugccuguaaucccagcacguugg

SEQ ID NO: 1080763 - RNA, 24 nt, Human
ugccuguaaucccagcacguuggg

SEQ ID NO: 1080764 - RNA, 21 nt, Human
ugcucucgaacuccuaaccuc

SEQ ID NO: 1080765 - RNA, 22 nt, Human
uggaagaugagaugacccaaga

SEQ ID NO: 1080766 - RNA, 19 nt, Human
uggcaccaucucagcucac

SEQ ID NO: 1080767 - RNA, 24 nt, Human
uggcaccaucucagcucacugcaa

SEQ ID NO: 1080768 - RNA, 24 nt, Human
uggccaggcugcucucgaacuccu

SEQ ID NO: 1080769 - RNA, 22 nt, Human
uggcucaugccuguaaucccag

SEQ ID NO: 1080770 - RNA, 24 nt, Human
uggcucaugccuguaaucccagca

SEQ ID NO: 1080771 - RNA, 18 nt, Human
ugggauuacaggugacug

SEQ ID NO: 1080772 - RNA, 21 nt, Human
ugggauuacaggugacugcca

SEQ ID NO: 1080773 - RNA, 22 nt, Human
ugggauuacaggugacugccac

SEQ ID NO: 1080774 - RNA, 24 nt, Human
ugggauuacaggugacugccacca

SEQ ID NO: 1080775 - RNA, 25 nt, Human
ugggauuacaggugacugccaccau

SEQ ID NO: 1080776 - RNA, 22 nt, Human
ugguacagaaagaauacacuuu

SEQ ID NO: 1080777 - RNA, 21 nt, Human
uggugcgcaccuguaauccca

SEQ ID NO: 1080778 - RNA, 24 nt, Human
ugguggcucaugccuguaauccca

SEQ ID NO: 1080779 - RNA, 19 nt, Human
ugucauagaauaaauaauu

SEQ ID NO: 1080780 - RNA, 20 nt, Human
ugugugacauagcgugcaca

SEQ ID NO: 1080781 - RNA, 21 nt, Human
uguugcccaggcugaagugca

SEQ ID NO: 1080782 - RNA, 20 nt, Human
uuagcuggauguaauggugc

SEQ ID NO: 1080783 - RNA, 23 nt, Human
uucaagcgauucucgugccucag

SEQ ID NO: 1080784 - RNA, 24 nt, Human
uucaauauaccgguugaggucaga

SEQ ID NO: 1080785 - RNA, 21 nt, Human
uucugugcagaugaaugagua

SEQ ID NO: 1080786 - RNA, 24 nt, Human
uugcccaggcugaagugcaguggc

SEQ ID NO: 1080787 - RNA, 20 nt, Human
uuuaacucagugguggaguu

SEQ ID NO: 1080788 - RNA, 22 nt, Human
uuugagucagccugacacccag

SEQ ID NO: 1080789 - RNA, 18 nt, Human
uuuuuguauuuuuaguag

SEQ ID NO: 1080790 - RNA, 21 nt, Human
uuuuuguauuuuuaguagaua

SEQ ID NO: 1080791 - RNA, 20 nt, Human
aaaagaauagagcuaacuca

SEQ ID NO: 1080792 - RNA, 24 nt, Human
aaacaaaaagaagcauuuccccca

SEQ ID NO: 1080793 - RNA, 20 nt, Human
aaacccucucgccgcucucc

SEQ ID NO: 1080794 - RNA, 19 nt, Human
aaggaaaugauaaaauagc

SEQ ID NO: 1080795 - RNA, 20 nt, Human
aguaacaggaaacuaaguac

SEQ ID NO: 1080796 - RNA, 22 nt, Human
auacauuuuuauaagagaaaaa

SEQ ID NO: 1080797 - RNA, 28 nt, Human
aucauaauauuccaaauguaugacaguu

SEQ ID NO: 1080798 - RNA, 18 nt, Human
aucuuaacaagugugaaa

SEQ ID NO: 1080799 - RNA, 23 nt, Human
augaugaacagcucuauuauaac

SEQ ID NO: 1080800 - RNA, 21 nt, Human
auggcauuugaaagcaaacac

SEQ ID NO: 1080801 - RNA, 21 nt, Human
caagcagcaccacuccagaac

SEQ ID NO: 1080802 - RNA, 20 nt, Human
cacaacaccagcagcuugca

SEQ ID NO: 1080803 - RNA, 21 nt, Human
cacaacaccagcagcuugcaa

SEQ ID NO: 1080804 - RNA, 24 nt, Human
cacugugcauuauaacaauaaggc

SEQ ID NO: 1080805 - RNA, 25 nt, Human
cagcucuauuauaacaaagaauaau

SEQ ID NO: 1080806 - RNA, 19 nt, Human
ccagccacaacaccagcag

SEQ ID NO: 1080807 - RNA, 23 nt, Human
ccggcccaagcagcaccacucca

SEQ ID NO: 1080808 - RNA, 23 nt, Human
cucgccgcucuccccagccacaa

SEQ ID NO: 1080809 - RNA, 21 nt, Human
gaacauaucacaguaucgaau

SEQ ID NO: 1080810 - RNA, 24 nt, Human
gacaaaaaaugccaaacccucucg

SEQ ID NO: 1080811 - RNA, 23 nt, Human
gcagcagaaauauccaugaugaa

SEQ ID NO: 1080812 - RNA, 20 nt, Human
gcagcuugcaauccuccacc

SEQ ID NO: 1080813 - RNA, 20 nt, Human
uaacaagugugaaaaguacu

SEQ ID NO: 1080814 - RNA, 22 nt, Human
uaagagaaaaauaugaaggaaa

SEQ ID NO: 1080815 - RNA, 23 nt, Human
uacccaaucuuuugccaaaauua

SEQ ID NO: 1080816 - RNA, 19 nt, Human
uaguuaaaaaaaaaaucca

SEQ ID NO: 1080817 - RNA, 21 nt, Human
uaucacaaacaaaaagaagca

SEQ ID NO: 1080818 - RNA, 18 nt, Human
ucacaaacaaaaagaagc

SEQ ID NO: 1080819 - RNA, 19 nt, Human
ucuccccagccacaacacc

SEQ ID NO: 1080820 - RNA, 18 nt, Human
ugaaaaguacuugcucuc

SEQ ID NO: 1080821 - RNA, 18 nt, Human
ugaaaggaaguggaguac

SEQ ID NO: 1080822 - RNA, 22 nt, Human
ugccaaacccucucgccgcucu

SEQ ID NO: 1080823 - RNA, 22 nt, Human
uggccaaauuuuaucaaaaauc

SEQ ID NO: 1080824 - RNA, 23 nt, Human
ugggaaacugcucuuuauuuaga

SEQ ID NO: 1080825 - RNA, 18 nt, Human
uugcaauccuccaccggc

SEQ ID NO: 1080826 - RNA, 21 nt, Human
uuugccaaaauuaauuuagau

SEQ ID NO: 1080827 - RNA, 24 nt, Human
aacuugauuuauaccgaggaggug

SEQ ID NO: 1080828 - RNA, 26 nt, Human
aaggccccaagggccagcgucagggg

SEQ ID NO: 1080829 - RNA, 19 nt, Human
accccugaggggggaggga

SEQ ID NO: 1080830 - RNA, 20 nt, Human
acccgggauggggaagcucc

SEQ ID NO: 1080831 - RNA, 22 nt, Human
acuggcuuugugguaguauguu

SEQ ID NO: 1080832 - RNA, 21 nt, Human
agccgauggugaguccagagc

SEQ ID NO: 1080833 - RNA, 21 nt, Human
aggagguuggccuugggcagg

SEQ ID NO: 1080834 - RNA, 22 nt, Human
agggaagggaggggggucaggu

SEQ ID NO: 1080835 - RNA, 19 nt, Human
aggggcaggagcuggagcu

SEQ ID NO: 1080836 - RNA, 23 nt, Human
agguggagguggaaucggaaggg

SEQ ID NO: 1080837 - RNA, 24 nt, Human
cacacugccccugguacucagaau

SEQ ID NO: 1080838 - RNA, 19 nt, Human
cagaaucccgaagcaccau

SEQ ID NO: 1080839 - RNA, 20 nt, Human
cagaauccugcgugccccuc

SEQ ID NO: 1080840 - RNA, 18 nt, Human
cagggggagguggaggug

SEQ ID NO: 1080841 - RNA, 19 nt, Human
caugcccacugggcacacu

SEQ ID NO: 1080842 - RNA, 28 nt, Human
ccccucuguggcagggggagguggaggu

SEQ ID NO: 1080843 - RNA, 23 nt, Human
ccccugaggggggagggaaggga

SEQ ID NO: 1080844 - RNA, 24 nt, Human
cccuccugggaccccaugcccacu

SEQ ID NO: 1080845 - RNA, 26 nt, Human
ccucagcugcugggguggcggggucc

SEQ ID NO: 1080846 - RNA, 21 nt, Human
ccuccugggaccccaugccca

SEQ ID NO: 1080847 - RNA, 22 nt, Human
ccucggggcgggccuaggcccu

SEQ ID NO: 1080848 - RNA, 18 nt, Human
ccucugccccuagugcuc

SEQ ID NO: 1080849 - RNA, 18 nt, Human
ccugcauccuugugcugg

SEQ ID NO: 1080850 - RNA, 23 nt, Human
ccugggaccccaugcccacuggg

SEQ ID NO: 1080851 - RNA, 21 nt, Human
ccuugugcuggccugaaaauc

SEQ ID NO: 1080852 - RNA, 21 nt, Human
ccuugugcuggccugaaaauc

SEQ ID NO: 1080853 - RNA, 20 nt, Human
cuccagcguggcacccacga

SEQ ID NO: 1080854 - RNA, 23 nt, Human
cuccugggaccccaugcccacuu

SEQ ID NO: 1080855 - RNA, 23 nt, Human
cugaggggggagggaagggaggg

SEQ ID NO: 1080856 - RNA, 21 nt, Human
cugcauccuugugcuggccug

SEQ ID NO: 1080857 - RNA, 20 nt, Human
cugcccccucggggcgggcc

SEQ ID NO: 1080858 - RNA, 19 nt, Human
cuggccgccucugccccua

SEQ ID NO: 1080859 - RNA, 21 nt, Human
cugguacucagaaucccgaag

SEQ ID NO: 1080860 - RNA, 27 nt, Human
cuuugaagaggagguuggccuugggca

SEQ ID NO: 1080861 - RNA, 18 nt, Human
gagcuggagcuucuucuc

SEQ ID NO: 1080862 - RNA, 19 nt, Human
gaggauggggacgccagga

SEQ ID NO: 1080863 - RNA, 25 nt, Human
gccccaagggccagcgucaggggca

SEQ ID NO: 1080864 - RNA, 20 nt, Human
gcucagaauccugcgugccc

SEQ ID NO: 1080865 - RNA, 22 nt, Human
gcuggagcuucuucuccagcgu

SEQ ID NO: 1080866 - RNA, 19 nt, Human
ggaaagugggcggggcagg

SEQ ID NO: 1080867 - RNA, 18 nt, Human
ggaagggaggggggucag

SEQ ID NO: 1080868 - RNA, 19 nt, Human
ggaaucccuccugggaccc

SEQ ID NO: 1080869 - RNA, 23 nt, Human
ggaggugggaaagugggcggggc

SEQ ID NO: 1080870 - RNA, 19 nt, Human
ggccuaggcccuuuggagg

SEQ ID NO: 1080871 - RNA, 19 nt, Human
ggcgguggcgccugcuccc

SEQ ID NO: 1080872 - RNA, 20 nt, Human
gggaaagugggcggggcagg

SEQ ID NO: 1080873 - RNA, 20 nt, Human
gggaaagugggcggggcagg

SEQ ID NO: 1080874 - RNA, 22 nt, Human
gggcaggagcuggagcuucuuc

SEQ ID NO: 1080875 - RNA, 21 nt, Human
ggggagggaagggaggggggu

SEQ ID NO: 1080876 - RNA, 18 nt, Human
gggggagggaagggaggg

SEQ ID NO: 1080877 - RNA, 20 nt, Human
guggaaggcgggggccagga

SEQ ID NO: 1080878 - RNA, 19 nt, Human
uacucagaaucccgaagca

SEQ ID NO: 1080879 - RNA, 24 nt, Human
uauccugcauccuugugcuggccu

SEQ ID NO: 1080880 - RNA, 18 nt, Human
ucagaaucccgaagcacc

SEQ ID NO: 1080881 - RNA, 24 nt, Human
uccacacccaccugcaacugguca

SEQ ID NO: 1080882 - RNA, 18 nt, Human
ucgcugcccccucggggc

SEQ ID NO: 1080883 - RNA, 19 nt, Human
ucgcuggcgguggcgccug

SEQ ID NO: 1080884 - RNA, 24 nt, Human
ucgcuggcgguggcgccugcuccc

SEQ ID NO: 1080885 - RNA, 22 nt, Human
ucuccagcguggcacccacgau

SEQ ID NO: 1080886 - RNA, 22 nt, Human
ucuggccgccucugccccuagu

SEQ ID NO: 1080887 - RNA, 19 nt, Human
ucuucuccagcguggcacc

SEQ ID NO: 1080888 - RNA, 19 nt, Human
ugaggggggagggaaggga

SEQ ID NO: 1080889 - RNA, 20 nt, Human
ugcccacugggcacacugcc

SEQ ID NO: 1080890 - RNA, 21 nt, Human
uggaaggcgggggccaggagg

SEQ ID NO: 1080891 - RNA, 24 nt, Human
uggagguggagguggaaucggaag

SEQ ID NO: 1080892 - RNA, 21 nt, Human
uggccugaaaauccacaccca

SEQ ID NO: 1080893 - RNA, 22 nt, Human
uggggaagcuccucucgcugcc

SEQ ID NO: 1080894 - RNA, 20 nt, Human
ugguacucagaaucccgaag

SEQ ID NO: 1080895 - RNA, 22 nt, Human
uuccgaugucccccccaacccc

SEQ ID NO: 1080896 - RNA, 22 nt, Human
uugcgugcaugcccgccuggcu

SEQ ID NO: 1080897 - RNA, 18 nt, Human
aaaaaucacuuccaggac

SEQ ID NO: 1080898 - RNA, 27 nt, Human
aaaauuccugacucaccuaaaucacaa

SEQ ID NO: 1080899 - RNA, 24 nt, Human
aaagauaaaccaacacagugaguu

SEQ ID NO: 1080900 - RNA, 20 nt, Human
aaagcauagcaucugcauca

SEQ ID NO: 1080901 - RNA, 20 nt, Human
aaauacaccucugaaaacac

SEQ ID NO: 1080902 - RNA, 21 nt, Human
aacacaucuauaaacauagaa

SEQ ID NO: 1080903 - RNA, 24 nt, Human
aacagagcgaugugcaucauaaga

SEQ ID NO: 1080904 - RNA, 19 nt, Human
aacagugguauaagguugg

SEQ ID NO: 1080905 - RNA, 18 nt, Human
aagaagccucaaagcacu

SEQ ID NO: 1080906 - RNA, 23 nt, Human
aagcacugggaacuuuuacagcu

SEQ ID NO: 1080907 - RNA, 22 nt, Human
acaucuauaaacauagaacuac

SEQ ID NO: 1080908 - RNA, 22 nt, Human
agaagugaaagcauagcaucug

SEQ ID NO: 1080909 - RNA, 21 nt, Human
agcagcaggcgucuuccacag

SEQ ID NO: 1080910 - RNA, 21 nt, Human
aggcaaugucuauuuuuaaac

SEQ ID NO: 1080911 - RNA, 22 nt, Human
agucaaacuggaaaauauccaa

SEQ ID NO: 1080912 - RNA, 20 nt, Human
aucagaucccuaggccccaa

SEQ ID NO: 1080913 - RNA, 20 nt, Human
augggguguauguguaugua

SEQ ID NO: 1080914 - RNA, 18 nt, Human
cacagaggcaagagcagc

SEQ ID NO: 1080915 - RNA, 23 nt, Human
cacaucuauaaacauagaacuac

SEQ ID NO: 1080916 - RNA, 20 nt, Human
cagugagucagagggcagag

SEQ ID NO: 1080917 - RNA, 19 nt, Human
cauacugccuuucagaguc

SEQ ID NO: 1080918 - RNA, 24 nt, Human
cauuugaaaaaucacuuccaggac

SEQ ID NO: 1080919 - RNA, 22 nt, Human
ccagggaagccaaaagauugga

SEQ ID NO: 1080920 - RNA, 21 nt, Human
cccaaguuacaagcacacuga

SEQ ID NO: 1080921 - RNA, 20 nt, Human
cccccaguucccuggaaaau

SEQ ID NO: 1080922 - RNA, 20 nt, Human
ccuaaaucacacugaagaau

SEQ ID NO: 1080923 - RNA, 19 nt, Human
ccuacacacugaggauggg

SEQ ID NO: 1080924 - RNA, 18 nt, Human
ccucugaaaacacaucua

SEQ ID NO: 1080925 - RNA, 25 nt, Human
ccugcagcugaggagccuggaauuu

SEQ ID NO: 1080926 - RNA, 18 nt, Human
cuaggccccaaauguacc

SEQ ID NO: 1080927 - RNA, 23 nt, Human
cuaggccccaaauguaccaaagg

SEQ ID NO: 1080928 - RNA, 22 nt, Human
cugaagaagcagacauauagca

SEQ ID NO: 1080929 - RNA, 19 nt, Human
cugaggagccuggaauuua

SEQ ID NO: 1080930 - RNA, 19 nt, Human
cuggaaaauccuaaaggua

SEQ ID NO: 1080931 - RNA, 24 nt, Human
gaaauucuaaaacaaauacaccuc

SEQ ID NO: 1080932 - RNA, 19 nt, Human
gagauaauuauggcaucaa

SEQ ID NO: 1080933 - RNA, 22 nt, Human
gagcagcagcugugaacaagga

SEQ ID NO: 1080934 - RNA, 22 nt, Human
gaggcaagagcagcagcuguga

SEQ ID NO: 1080935 - RNA, 19 nt, Human
gcagaugugcccauuugua

SEQ ID NO: 1080936 - RNA, 22 nt, Human
uaaaacaaauacaccucugaaa

SEQ ID NO: 1080937 - RNA, 24 nt, Human
uaaaacaaauacaccucugaaaac

SEQ ID NO: 1080938 - RNA, 20 nt, Human
uaaugaaagugaauauagca

SEQ ID NO: 1080939 - RNA, 21 nt, Human
uacauaaauuauauauauaua

SEQ ID NO: 1080940 - RNA, 22 nt, Human
uacucuuguucucuuuugcagc

SEQ ID NO: 1080941 - RNA, 26 nt, Human
uacucuuguucucuuuugcagcucua

SEQ ID NO: 1080942 - RNA, 19 nt, Human
uaggccccaaauguaccaa

SEQ ID NO: 1080943 - RNA, 21 nt, Human
uauguguauguaucugucugu

SEQ ID NO: 1080944 - RNA, 20 nt, Human
uccaggacagagugaaauuc

SEQ ID NO: 1080945 - RNA, 24 nt, Human
uccaggacagagugaaauucuaaa

SEQ ID NO: 1080946 - RNA, 21 nt, Human
ucccuaggccccaaauguacc

SEQ ID NO: 1080947 - RNA, 24 nt, Human
ucccuggaaaauccuaaagguaaa

SEQ ID NO: 1080948 - RNA, 23 nt, Human
ucgaccaugagaagugaaagcau

SEQ ID NO: 1080949 - RNA, 22 nt, Human
ucuaaaacaaauacaccucuga

SEQ ID NO: 1080950 - RNA, 25 nt, Human
ucuaaaacaaauacaccucugaaaa

SEQ ID NO: 1080951 - RNA, 24 nt, Human
ucuauaaacauagaacuacauaaa

SEQ ID NO: 1080952 - RNA, 22 nt, Human
ucucuaaccuuuccuagucaaa

SEQ ID NO: 1080953 - RNA, 20 nt, Human
ucuuccacagaggcaagagc

SEQ ID NO: 1080954 - RNA, 22 nt, Human
ugaaauucuaaaacaaauacac

SEQ ID NO: 1080955 - RNA, 18 nt, Human
ugagucagagggcagagc

SEQ ID NO: 1080956 - RNA, 21 nt, Human
ugaguguggacugaagaagca

SEQ ID NO: 1080957 - RNA, 26 nt, Human
uggacaucccugauuuaggcagucuc

SEQ ID NO: 1080958 - RNA, 21 nt, Human
uggcuggacuccuaagcaguu

SEQ ID NO: 1080959 - RNA, 25 nt, Human
uggggaggaaugucuggcuggacuc

SEQ ID NO: 1080960 - RNA, 21 nt, Human
uguaucugucugucuccccca

SEQ ID NO: 1080961 - RNA, 23 nt, Human
uguccuauccauuuuaauaucca

SEQ ID NO: 1080962 - RNA, 25 nt, Human
uucaaaaaguaucgaccaugagaag

SEQ ID NO: 1080963 - RNA, 25 nt, Human
uucacauaacugauaaaagcaggcc

SEQ ID NO: 1080964 - RNA, 23 nt, Human
uuggaaauuuucaucauucucaa

SEQ ID NO: 1080965 - RNA, 21 nt, Human
uuggcacuagcauacuguacu

SEQ ID NO: 1080966 - RNA, 21 nt, Human
uuuugaagaagccucaaagca

SEQ ID NO: 1080967 - RNA, 19 nt, Human
aaaaaaaaaaagagagagg

SEQ ID NO: 1080968 - RNA, 25 nt, Human
aaaaaaaaaaagagagagggcgaga

SEQ ID NO: 1080969 - RNA, 21 nt, Human
agagagggcgagaggcaacag

SEQ ID NO: 1080970 - RNA, 19 nt, Human
caacagucgcccauccccu

SEQ ID NO: 1080971 - RNA, 18 nt, Human
caccgcggcgagcaggaa

SEQ ID NO: 1080972 - RNA, 24 nt, Human
caugauguggccaacugagcccug

SEQ ID NO: 1080973 - RNA, 19 nt, Human
ccccuggggaaacguccug

SEQ ID NO: 1080974 - RNA, 21 nt, Human
ccccuggggaaacguccugcu

SEQ ID NO: 1080975 - RNA, 23 nt, Human
ccuugggcugggccuggagguuc

SEQ ID NO: 1080976 - RNA, 18 nt, Human
cgaagaggcaacgcuucc

SEQ ID NO: 1080977 - RNA, 19 nt, Human
cgaggcugggagcgcggag

SEQ ID NO: 1080978 - RNA, 20 nt, Human
cgaggcugggagcgcggagc

SEQ ID NO: 1080979 - RNA, 21 nt, Human
cggcgcgcgcggcaccgcggc

SEQ ID NO: 1080980 - RNA, 24 nt, Human
cuuguucugagccuugggcugggc

SEQ ID NO: 1080981 - RNA, 21 nt, Human
gagcgcggagcgcccagcggc

SEQ ID NO: 1080982 - RNA, 21 nt, Human
gcacaacucgaggcugggagc

SEQ ID NO: 1080983 - RNA, 18 nt, Human
ggcugcaggggagggggc

SEQ ID NO: 1080984 - RNA, 19 nt, Human
ggggcugcaggggaggggg

SEQ ID NO: 1080985 - RNA, 20 nt, Human
guccugcuggaagccgggcu

SEQ ID NO: 1080986 - RNA, 21 nt, Human
ucacagcuugaaaaaaaaaaa

SEQ ID NO: 1080987 - RNA, 18 nt, Human
ucuggcgugcuacaaagg

SEQ ID NO: 1080988 - RNA, 21 nt, Human
ugcuacaaaggauugcacaac

SEQ ID NO: 1080989 - RNA, 23 nt, Human
aaacauaugcuuuucucaauaua

SEQ ID NO: 1080990 - RNA, 20 nt, Human
aaacccccaauccugccccc

SEQ ID NO: 1080991 - RNA, 22 nt, Human
aaaccgcuggucuccuauccca

SEQ ID NO: 1080992 - RNA, 21 nt, Human
aaagugccucucaagcguucu

SEQ ID NO: 1080993 - RNA, 19 nt, Human
aaagugcuaggauuacagg

SEQ ID NO: 1080994 - RNA, 20 nt, Human
aaauaacaccuaugaucaca

SEQ ID NO: 1080995 - RNA, 24 nt, Human
aaauacuccgcuggggcccgaagc

SEQ ID NO: 1080996 - RNA, 23 nt, Human
aacauuuccaguucaacaaaucu

SEQ ID NO: 1080997 - RNA, 24 nt, Human
aagugaucugcccgccucugccuc

SEQ ID NO: 1080998 - RNA, 22 nt, Human
aagugccucucaagcguucuau

SEQ ID NO: 1080999 - RNA, 19 nt, Human
aagugcuaggauuacaggc

SEQ ID NO: 1081000 - RNA, 24 nt, Human
aaugauucuccagccucagccucc

SEQ ID NO: 1081001 - RNA, 19 nt, Human
acccuaugcaacuaaaaau

SEQ ID NO: 1081002 - RNA, 24 nt, Human
accguguuggccaggcuggucuug

SEQ ID NO: 1081003 - RNA, 24 nt, Human
acucuugucgcccaggcuggagug

SEQ ID NO: 1081004 - RNA, 23 nt, Human
acugucuuuguugucaaucuguu

SEQ ID NO: 1081005 - RNA, 19 nt, Human
agagaugggguuucaccgu

SEQ ID NO: 1081006 - RNA, 23 nt, Human
agccucagccuccugaguagcug

SEQ ID NO: 1081007 - RNA, 24 nt, Human
aggcgugugccaccacgcccagcu

SEQ ID NO: 1081008 - RNA, 21 nt, Human
aguagcugggauuacaggcgu

SEQ ID NO: 1081009 - RNA, 23 nt, Human
aguagcugggauuacaggcgugu

SEQ ID NO: 1081010 - RNA, 18 nt, Human
aucaaauacccuaugcaa

SEQ ID NO: 1081011 - RNA, 20 nt, Human
aucaagagcuauguauaguc

SEQ ID NO: 1081012 - RNA, 22 nt, Human
aucuguuugcccucucaaucuu

SEQ ID NO: 1081013 - RNA, 24 nt, Human
augauucuccagccucagccuccu

SEQ ID NO: 1081014 - RNA, 23 nt, Human
augggguuucaccguguuggcca

SEQ ID NO: 1081015 - RNA, 24 nt, Human
augggguuucaccguguuggccag

SEQ ID NO: 1081016 - RNA, 19 nt, Human
auuacaggcgugugccacc

SEQ ID NO: 1081017 - RNA, 27 nt, Human
caaagugcuaggauuacaggcuugaga

SEQ ID NO: 1081018 - RNA, 24 nt, Human
caccacgcccagcuaauuuuugua

SEQ ID NO: 1081019 - RNA, 21 nt, Human
caccguguuggccaggcuggu

SEQ ID NO: 1081020 - RNA, 23 nt, Human
caccguguuggccaggcuggucu

SEQ ID NO: 1081021 - RNA, 24 nt, Human
caccguguuggccaggcuggucuu

SEQ ID NO: 1081022 - RNA, 24 nt, Human
cacucuugucgcccaggcuggagu

SEQ ID NO: 1081023 - RNA, 18 nt, Human
cagccucagccuccugag

SEQ ID NO: 1081024 - RNA, 25 nt, Human
cagccucagccuccugaguagcugg

SEQ ID NO: 1081025 - RNA, 20 nt, Human
cagccuccugaguagcuggg

SEQ ID NO: 1081026 - RNA, 18 nt, Human
cagcuucgggagccacag

SEQ ID NO: 1081027 - RNA, 18 nt, Human
caucucaauucuauuuuu

SEQ ID NO: 1081028 - RNA, 18 nt, Human
cauguaaaacauuuccag

SEQ ID NO: 1081029 - RNA, 18 nt, Human
cauguaaaacguuuccag

SEQ ID NO: 1081030 - RNA, 24 nt, Human
cauuaagucucuuuucagucuaca

SEQ ID NO: 1081031 - RNA, 19 nt, Human
ccaaagugcuaggauuaca

SEQ ID NO: 1081032 - RNA, 25 nt, Human
ccaauccugcccccagucccuaugu

SEQ ID NO: 1081033 - RNA, 21 nt, Human
ccacagucgcgggagccgcuc

SEQ ID NO: 1081034 - RNA, 20 nt, Human
ccaccacgcccagcuaauuu

SEQ ID NO: 1081035 - RNA, 22 nt, Human
ccagccucagccuccugaguag

SEQ ID NO: 1081036 - RNA, 25 nt, Human
ccagccucagccuccugaguagcuu

SEQ ID NO: 1081037 - RNA, 24 nt, Human
cccaaagugcuaggauuacaggcu

SEQ ID NO: 1081038 - RNA, 18 nt, Human
cccaggcuggagugcaau

SEQ ID NO: 1081039 - RNA, 24 nt, Human
cccauacuaaucccaacccaaaac

SEQ ID NO: 1081040 - RNA, 24 nt, Human
ccgccucugccucccaaagugcua

SEQ ID NO: 1081041 - RNA, 24 nt, Human
ccucccagguucaaaugauucucc

SEQ ID NO: 1081042 - RNA, 22 nt, Human
ccugaccucaagugaucugccc

SEQ ID NO: 1081043 - RNA, 23 nt, Human
ccugaguagcugggauuacaggc

SEQ ID NO: 1081044 - RNA, 24 nt, Human
ccugaguagcugggauuacaggcg

SEQ ID NO: 1081045 - RNA, 18 nt, Human
cgaagcagcuucgggagc

SEQ ID NO: 1081046 - RNA, 24 nt, Human
cgccucugccucccaaagugcuag

SEQ ID NO: 1081047 - RNA, 21 nt, Human
cggaaagaggcuguacugcac

SEQ ID NO: 1081048 - RNA, 19 nt, Human
cggcaaccucccccuccca

SEQ ID NO: 1081049 - RNA, 21 nt, Human
cgugugccaccacgcccagcu

SEQ ID NO: 1081050 - RNA, 24 nt, Human
cguguuggccaggcuggucuugaa

SEQ ID NO: 1081051 - RNA, 22 nt, Human
cuaaucccaacccaaaaccgcu

SEQ ID NO: 1081052 - RNA, 24 nt, Human
cucaagugaucugcccgccucugc

SEQ ID NO: 1081053 - RNA, 24 nt, Human
cucacggcaaccucccccucccag

SEQ ID NO: 1081054 - RNA, 23 nt, Human
cucagccuccugaguagcuggga

SEQ ID NO: 1081055 - RNA, 24 nt, Human
cuccagccucagccuccugaguag

SEQ ID NO: 1081056 - RNA, 25 nt, Human
cuccagccucagccuccugaguagc

SEQ ID NO: 1081057 - RNA, 26 nt, Human
cuccugaccucaagugaucugcccgc

SEQ ID NO: 1081058 - RNA, 19 nt, Human
cucuugucgcccaggcugg

SEQ ID NO: 1081059 - RNA, 22 nt, Human
cugaguagcugggauuacaggc

SEQ ID NO: 1081060 - RNA, 24 nt, Human
cugaguagcugggauuacaggcgu

SEQ ID NO: 1081061 - RNA, 18 nt, Human
cuggaguaaaucuuguca

SEQ ID NO: 1081062 - RNA, 24 nt, Human
cuugucgcccaggcuggagugcaa

SEQ ID NO: 1081063 - RNA, 24 nt, Human
gaccucaagugaucugcccgccuc

SEQ ID NO: 1081064 - RNA, 24 nt, Human
gagaugggguuucaccguguuggc

SEQ ID NO: 1081065 - RNA, 20 nt, Human
gaguagcugggauuacaggc

SEQ ID NO: 1081066 - RNA, 25 nt, Human
gaguagcugggauuacaggcgugug

SEQ ID NO: 1081067 - RNA, 18 nt, Human
gauuacaggcgugugcca

SEQ ID NO: 1081068 - RNA, 18 nt, Human
gauuacaggcuugagaca

SEQ ID NO: 1081069 - RNA, 22 nt, Human
gcaaccucccccucccagguuc

SEQ ID NO: 1081070 - RNA, 22 nt, Human
gcccagcuaauuuuuguauuuu

SEQ ID NO: 1081071 - RNA, 20 nt, Human
gcccaggcuggagugcaaug

SEQ ID NO: 1081072 - RNA, 20 nt, Human
gccucagccuccugaguagc

SEQ ID NO: 1081073 - RNA, 23 nt, Human
gcuggucuugaacuccugaccuc

SEQ ID NO: 1081074 - RNA, 24 nt, Human
ggcuggucuugaacuccugaccuc

SEQ ID NO: 1081075 - RNA, 19 nt, Human
gggcccgaagcagcuucgg

SEQ ID NO: 1081076 - RNA, 22 nt, Human
gggguuucaccguguuggccag

SEQ ID NO: 1081077 - RNA, 22 nt, Human
ggguuucaccguguuggccagg

SEQ ID NO: 1081078 - RNA, 19 nt, Human
ggucuugaacuccugaccu

SEQ ID NO: 1081079 - RNA, 18 nt, Human
guagcugggauuacaggc

SEQ ID NO: 1081080 - RNA, 18 nt, Human
guagcugggauuacaggc

SEQ ID NO: 1081081 - RNA, 22 nt, Human
guaguuccugaacauucauguu

SEQ ID NO: 1081082 - RNA, 20 nt, Human
guaugauucauuaaugguug

SEQ ID NO: 1081083 - RNA, 18 nt, Human
gucauuuucugaaacugu

SEQ ID NO: 1081084 - RNA, 26 nt, Human
gucuacaaugugaaaaaaaggccauc

SEQ ID NO: 1081085 - RNA, 24 nt, Human
gugaucugcccgccucugccuccc

SEQ ID NO: 1081086 - RNA, 18 nt, Human
gugccugcuaaccuaaaa

SEQ ID NO: 1081087 - RNA, 18 nt, Human
gugugccaccacgcccag

SEQ ID NO: 1081088 - RNA, 21 nt, Human
uaaaauaaacauaugcuuuuc

SEQ ID NO: 1081089 - RNA, 21 nt, Human
uaaggauuuuuuaacauaucu

SEQ ID NO: 1081090 - RNA, 18 nt, Human
uaauaaaacaaacuuuug

SEQ ID NO: 1081091 - RNA, 23 nt, Human
uaauuuuuguauuuuuagagaga

SEQ ID NO: 1081092 - RNA, 24 nt, Human
uacaaagagaugauccucuggagu

SEQ ID NO: 1081093 - RNA, 19 nt, Human
uacaauuaauaaaacaaac

SEQ ID NO: 1081094 - RNA, 22 nt, Human
uacacaagcuccgaaaccccca

SEQ ID NO: 1081095 - RNA, 24 nt, Human
uacaggcgugugccaccacgccca

SEQ ID NO: 1081096 - RNA, 20 nt, Human
uagagagaugggguuucacc

SEQ ID NO: 1081097 - RNA, 23 nt, Human
uagagagaugggguuucaccgug

SEQ ID NO: 1081098 - RNA, 21 nt, Human
uaggauuacaggcuugagaca

SEQ ID NO: 1081099 - RNA, 24 nt, Human
ucaccguguuggccaggcuggucu

SEQ ID NO: 1081100 - RNA, 24 nt, Human
ucacggcaaccucccccucccagg

SEQ ID NO: 1081101 - RNA, 21 nt, Human
ucacucuugucgcccaggcug

SEQ ID NO: 1081102 - RNA, 23 nt, Human
ucacucuugucgcccaggcugga

SEQ ID NO: 1081103 - RNA, 20 nt, Human
ucagccuccugaguagcugg

SEQ ID NO: 1081104 - RNA, 22 nt, Human
ucccaaaaacuguuacacaagc

SEQ ID NO: 1081105 - RNA, 24 nt, Human
ucccaaagugcuaggauuacaggc

SEQ ID NO: 1081106 - RNA, 19 nt, Human
ucccagguucaaaugauuc

SEQ ID NO: 1081107 - RNA, 21 nt, Human
ucccagguucaaaugauucuc

SEQ ID NO: 1081108 - RNA, 20 nt, Human
uccgaaacccccaauccugc

SEQ ID NO: 1081109 - RNA, 22 nt, Human
uccgaaacccccaauccugccc

SEQ ID NO: 1081110 - RNA, 24 nt, Human
uccugaguagcugggauuacaggc

SEQ ID NO: 1081111 - RNA, 18 nt, Human
ucgcccaggcuggagugc

SEQ ID NO: 1081112 - RNA, 19 nt, Human
ucuucaguuuuacuguucu

SEQ ID NO: 1081113 - RNA, 21 nt, Human
ucuugaacuccugaccucaag

SEQ ID NO: 1081114 - RNA, 18 nt, Human
ugaccucaagugaucugc

SEQ ID NO: 1081115 - RNA, 24 nt, Human
ugaccucaagugaucugcccgccu

SEQ ID NO: 1081116 - RNA, 20 nt, Human
ugaguacaauuaauaaaaca

SEQ ID NO: 1081117 - RNA, 22 nt, Human
ugaguacaauuaauaaaacaaa

SEQ ID NO: 1081118 - RNA, 20 nt, Human
ugcccccagucccuauguac

SEQ ID NO: 1081119 - RNA, 24 nt, Human
ugcuaggauuacaggcuugagaca

SEQ ID NO: 1081120 - RNA, 18 nt, Human
uggagugcaauggugcaa

SEQ ID NO: 1081121 - RNA, 23 nt, Human
uggagugcaauggugcaagcuca

SEQ ID NO: 1081122 - RNA, 24 nt, Human
uggccaggcuggucuugaacuccu

SEQ ID NO: 1081123 - RNA, 18 nt, Human
ugggauuacaggcgugug

SEQ ID NO: 1081124 - RNA, 19 nt, Human
ugggauuacaggcgugugc

SEQ ID NO: 1081125 - RNA, 21 nt, Human
ugggauuacaggcgugugcca

SEQ ID NO: 1081126 - RNA, 22 nt, Human
ugggauuacaggcgugugccac

SEQ ID NO: 1081127 - RNA, 24 nt, Human
ugggauuacaggcgugugccacca

SEQ ID NO: 1081128 - RNA, 24 nt, Human
ugggguuucaccguguuggccagg

SEQ ID NO: 1081129 - RNA, 21 nt, Human
uggugcaagcucagcucacgg

SEQ ID NO: 1081130 - RNA, 20 nt, Human
ugucgcccaggcuggagugc

SEQ ID NO: 1081131 - RNA, 23 nt, Human
ugugccugcuaaccuaaaauaaa

SEQ ID NO: 1081132 - RNA, 24 nt, Human
ugugccugcuaaccuaaaauaaac

SEQ ID NO: 1081133 - RNA, 24 nt, Human
uguguaugauucauuaaugguugu

SEQ ID NO: 1081134 - RNA, 20 nt, Human
uguugucaaucuguuuuugu

SEQ ID NO: 1081135 - RNA, 21 nt, Human
uuagagagaugggguuucacc

SEQ ID NO: 1081136 - RNA, 23 nt, Human
uuagagagaugggguuucaccgu

SEQ ID NO: 1081137 - RNA, 24 nt, Human
uuagagagaugggguuucaccgug

SEQ ID NO: 1081138 - RNA, 18 nt, Human
uucaaaugauucuccagc

SEQ ID NO: 1081139 - RNA, 23 nt, Human
uucaaaugauucuccagccucag

SEQ ID NO: 1081140 - RNA, 24 nt, Human
uucacucuugucgcccaggcugga

SEQ ID NO: 1081141 - RNA, 21 nt, Human
uucauuaaugguuguaucaga

SEQ ID NO: 1081142 - RNA, 24 nt, Human
uuuagagagaugggguuucaccgu

SEQ ID NO: 1081143 - RNA, 24 nt, Human
uuucaccguguuggccaggcuggu

SEQ ID NO: 1081144 - RNA, 24 nt, Human
uuucacucuugucgcccaggcugg

SEQ ID NO: 1081145 - RNA, 23 nt, Human
uuuuuagagagaugggguuucac

SEQ ID NO: 1081146 - RNA, 21 nt, Human
uuuuuguauuuuuagagagau

SEQ ID NO: 1081147 - RNA, 24 nt, Human
aaacacacaggcacauucuaaaca

SEQ ID NO: 1081148 - RNA, 24 nt, Human
aaaguguugggauuacaggcguga

SEQ ID NO: 1081149 - RNA, 25 nt, Human
aacccuuaacuuuaggcuaccaucc

SEQ ID NO: 1081150 - RNA, 24 nt, Human
aaguagcuaggauuacaggcacgu

SEQ ID NO: 1081151 - RNA, 26 nt, Human
aaguagcuaggauuacaggcacgugu

SEQ ID NO: 1081152 - RNA, 21 nt, Human
aaguguugggauuacaggcgu

SEQ ID NO: 1081153 - RNA, 26 nt, Human
aaguguugggauuacaggcgugagcc

SEQ ID NO: 1081154 - RNA, 18 nt, Human
acaggcacauucuaaaca

SEQ ID NO: 1081155 - RNA, 24 nt, Human
acccucaacaaagaauuagguggc

SEQ ID NO: 1081156 - RNA, 22 nt, Human
accucugccucuuggguucaag

SEQ ID NO: 1081157 - RNA, 22 nt, Human
acucaaacccaaguuagcugcu

SEQ ID NO: 1081158 - RNA, 23 nt, Human
acuggucucaaacuccugaccuc

SEQ ID NO: 1081159 - RNA, 19 nt, Human
agacauuuuugguugucac

SEQ ID NO: 1081160 - RNA, 19 nt, Human
agaugaucugccugccuca

SEQ ID NO: 1081161 - RNA, 19 nt, Human
agcagguaguggccaggga

SEQ ID NO: 1081162 - RNA, 22 nt, Human
agccaggcacauuuuugccccc

SEQ ID NO: 1081163 - RNA, 20 nt, Human
agccaugacucaaaacccaa

SEQ ID NO: 1081164 - RNA, 24 nt, Human
aggaacccuuaacuuuaggcuacc

SEQ ID NO: 1081165 - RNA, 26 nt, Human
aggcauuugggccugugcucucuuuu

SEQ ID NO: 1081166 - RNA, 18 nt, Human
aguagccaugacucaaaa

SEQ ID NO: 1081167 - RNA, 24 nt, Human
agugauucuccugccucagcuucc

SEQ ID NO: 1081168 - RNA, 19 nt, Human
agugcuguggagugaucuc

SEQ ID NO: 1081169 - RNA, 24 nt, Human
auaucuggagacauuuuugguugu

SEQ ID NO: 1081170 - RNA, 24 nt, Human
augaucugccugccucagccuccc

SEQ ID NO: 1081171 - RNA, 24 nt, Human
auuuuuguauuuuuaguagaggug

SEQ ID NO: 1081172 - RNA, 24 nt, Human
caaaacccaaguuuucccugccuu

SEQ ID NO: 1081173 - RNA, 24 nt, Human
caaaguguugggauuacaggcgug

SEQ ID NO: 1081174 - RNA, 19 nt, Human
caaauuucuggcuugauga

SEQ ID NO: 1081175 - RNA, 22 nt, Human
caagugauucuccugccucagc

SEQ ID NO: 1081176 - RNA, 28 nt, Human
caagugauucuccugccucagcuuccca

SEQ ID NO: 1081177 - RNA, 21 nt, Human
cacgcccagcuaauuuuugua

SEQ ID NO: 1081178 - RNA, 24 nt, Human
cagaguuuugcucugcugcccagg

SEQ ID NO: 1081179 - RNA, 21 nt, Human
cagcagcgacagugacagcga

SEQ ID NO: 1081180 - RNA, 23 nt, Human
cagcagcgguggcagcgagagcu

SEQ ID NO: 1081181 - RNA, 24 nt, Human
cagccaggcacauuuuugcccccu

SEQ ID NO: 1081182 - RNA, 21 nt, Human
cagcgacagugacagcgauag

SEQ ID NO: 1081183 - RNA, 19 nt, Human
caggcacauuuuugccccc

SEQ ID NO: 1081184 - RNA, 19 nt, Human
caguagccaugacucaaaa

SEQ ID NO: 1081185 - RNA, 19 nt, Human
caguucccuuccccaaccc

SEQ ID NO: 1081186 - RNA, 19 nt, Human
caucacgcccagcuaauuu

SEQ ID NO: 1081187 - RNA, 25 nt, Human
cauuuuugguugucacagcugggga

SEQ ID NO: 1081188 - RNA, 24 nt, Human
ccaaaauauuaauagcacugagga

SEQ ID NO: 1081189 - RNA, 22 nt, Human
ccaaaguguugggauuacaggc

SEQ ID NO: 1081190 - RNA, 22 nt, Human
ccaaaguguugggauuacaggc

SEQ ID NO: 1081191 - RNA, 24 nt, Human
ccaaaguguugggauuacaggcgu

SEQ ID NO: 1081192 - RNA, 23 nt, Human
cccaaguagcuaggauuacaggc

SEQ ID NO: 1081193 - RNA, 24 nt, Human
cccaaguagcuaggauuacaggca

SEQ ID NO: 1081194 - RNA, 18 nt, Human
ccccuuauaggcauuugg

SEQ ID NO: 1081195 - RNA, 20 nt, Human
ccccuuauaggcauuugggc

SEQ ID NO: 1081196 - RNA, 19 nt, Human
ccguguuggcuggacuggu

SEQ ID NO: 1081197 - RNA, 18 nt, Human
ccuauauuccagcaggau

SEQ ID NO: 1081198 - RNA, 24 nt, Human
ccucuuggguucaagugauucucc

SEQ ID NO: 1081199 - RNA, 21 nt, Human
ccugaccucagaugaucugcc

SEQ ID NO: 1081200 - RNA, 23 nt, Human
ccugaccucagaugaucugccug

SEQ ID NO: 1081201 - RNA, 21 nt, Human
cggggccaggguccaccccuu

SEQ ID NO: 1081202 - RNA, 19 nt, Human
cuacaauguacaggacagu

SEQ ID NO: 1081203 - RNA, 23 nt, Human
cucacauaaacacacaggcacau

SEQ ID NO: 1081204 - RNA, 24 nt, Human
cucauuacaaccucugccucuugg

SEQ ID NO: 1081205 - RNA, 18 nt, Human
cuccaccugagccucccc

SEQ ID NO: 1081206 - RNA, 21 nt, Human
cuccaccugagccuccccacu

SEQ ID NO: 1081207 - RNA, 26 nt, Human
cuccugaccucagaugaucugccugc

SEQ ID NO: 1081208 - RNA, 19 nt, Human
cucugcugcccaggcugga

SEQ ID NO: 1081209 - RNA, 20 nt, Human
cucugcugcccaggcuggag

SEQ ID NO: 1081210 - RNA, 20 nt, Human
cucuuggguucaagugauuc

SEQ ID NO: 1081211 - RNA, 18 nt, Human
cugcccaggcuggagugc

SEQ ID NO: 1081212 - RNA, 18 nt, Human
cugccucagccucccaaa

SEQ ID NO: 1081213 - RNA, 23 nt, Human
cugccucagcuucccaaguagcu

SEQ ID NO: 1081214 - RNA, 23 nt, Human
cugccucuuggguucaagugauu

SEQ ID NO: 1081215 - RNA, 19 nt, Human
cugcugcccaggcuggagu

SEQ ID NO: 1081216 - RNA, 22 nt, Human
cugcugcucuuuuuuuuucuca

SEQ ID NO: 1081217 - RNA, 18 nt, Human
cuguuaucugcugcucuu

SEQ ID NO: 1081218 - RNA, 21 nt, Human
cuuaaaaugaaccucaugcuc

SEQ ID NO: 1081219 - RNA, 24 nt, Human
gaccucagaugaucugccugccuc

SEQ ID NO: 1081220 - RNA, 24 nt, Human
gaugaucugccugccucagccucc

SEQ ID NO: 1081221 - RNA, 18 nt, Human
gauuacaggcgugagcca

SEQ ID NO: 1081222 - RNA, 22 nt, Human
gauuacaggcgugagccacugc

SEQ ID NO: 1081223 - RNA, 22 nt, Human
gauuacaggcgugagccacugc

SEQ ID NO: 1081224 - RNA, 22 nt, Human
gccaggcacauuuuugcccccu

SEQ ID NO: 1081225 - RNA, 25 nt, Human
gccaguuuuugcuucaugcagccau

SEQ ID NO: 1081226 - RNA, 22 nt, Human
gcccagcuaauuuuuguauuuu

SEQ ID NO: 1081227 - RNA, 19 nt, Human
gccucagccucccaaagug

SEQ ID NO: 1081228 - RNA, 24 nt, Human
gccucagcuucccaaguagcuagg

SEQ ID NO: 1081229 - RNA, 22 nt, Human
gcggggccaggguccaccccuu

SEQ ID NO: 1081230 - RNA, 19 nt, Human
gcucugcugcccaggcugg

SEQ ID NO: 1081231 - RNA, 20 nt, Human
gcucugcugcccaggcugga

SEQ ID NO: 1081232 - RNA, 27 nt, Human
gcucugcugcccaggcuggagugcugu

SEQ ID NO: 1081233 - RNA, 20 nt, Human
ggaguuuugccguguuggcu

SEQ ID NO: 1081234 - RNA, 21 nt, Human
ggggauaugcaauaucuggag

SEQ ID NO: 1081235 - RNA, 20 nt, Human
ggguucaagugauucuccug

SEQ ID NO: 1081236 - RNA, 24 nt, Human
gugauucuccugccucagcuuccc

SEQ ID NO: 1081237 - RNA, 20 nt, Human
guggcagcagcgguggcagc

SEQ ID NO: 1081238 - RNA, 24 nt, Human
guuuugcucugcugcccaggcugg

SEQ ID NO: 1081239 - RNA, 25 nt, Human
uaaacacacaggcacauucuaaaca

SEQ ID NO: 1081240 - RNA, 23 nt, Human
uaaguuuacuuaaaaugaaccuc

SEQ ID NO: 1081241 - RNA, 23 nt, Human
uaauuuuuguauuuuuaguagag

SEQ ID NO: 1081242 - RNA, 24 nt, Human
uaauuuuuguauuuuuaguagagg

SEQ ID NO: 1081243 - RNA, 20 nt, Human
uacaaccucugccucuuggg

SEQ ID NO: 1081244 - RNA, 24 nt, Human
uacaggcacgugucaucacgccca

SEQ ID NO: 1081245 - RNA, 22 nt, Human
uacaggcgugagccacugcgcc

SEQ ID NO: 1081246 - RNA, 22 nt, Human
uacaggcgugagccacugcgcc

SEQ ID NO: 1081247 - RNA, 21 nt, Human
uacugucuacacccacuccau

SEQ ID NO: 1081248 - RNA, 23 nt, Human
uacuuuccagugucuacuaucuc

SEQ ID NO: 1081249 - RNA, 18 nt, Human
uaggauuacaggcacgug

SEQ ID NO: 1081250 - RNA, 21 nt, Human
uaggauuacaggcacguguca

SEQ ID NO: 1081251 - RNA, 24 nt, Human
uaggauuacaggcacgugucauca

SEQ ID NO: 1081252 - RNA, 19 nt, Human
uaguagagguggaguuuug

SEQ ID NO: 1081253 - RNA, 21 nt, Human
uaguagagguggaguuuugcc

SEQ ID NO: 1081254 - RNA, 24 nt, Human
uaguagagguggaguuuugccgug

SEQ ID NO: 1081255 - RNA, 22 nt, Human
uauaggcauuugggccugugcu

SEQ ID NO: 1081256 - RNA, 22 nt, Human
uauguuucugcacuagccccuu

SEQ ID NO: 1081257 - RNA, 22 nt, Human
ucaaaacccaaguuuucccugc

SEQ ID NO: 1081258 - RNA, 19 nt, Human
ucaagugauucuccugccu

SEQ ID NO: 1081259 - RNA, 23 nt, Human
ucauuacaaccucugccucuugg

SEQ ID NO: 1081260 - RNA, 24 nt, Human
ucauuacaaccucugccucuuggg

SEQ ID NO: 1081261 - RNA, 25 nt, Human
ucauuacaaccucugccucuugggu

SEQ ID NO: 1081262 - RNA, 19 nt, Human
uccauccucuaacaguagc

SEQ ID NO: 1081263 - RNA, 24 nt, Human
ucccaaaguguugggauuacaggc

SEQ ID NO: 1081264 - RNA, 24 nt, Human
ucccaaguagcuaggauuacaggc

SEQ ID NO: 1081265 - RNA, 21 nt, Human
ucccccaugggcuagaucuga

SEQ ID NO: 1081266 - RNA, 19 nt, Human
ucccuccaccugagccucc

SEQ ID NO: 1081267 - RNA, 23 nt, Human
ucccuuccccaacccucaacaaa

SEQ ID NO: 1081268 - RNA, 19 nt, Human
ucuaaacagauaacgggag

SEQ ID NO: 1081269 - RNA, 23 nt, Human
ucuaaguaauuuuuaaauuaguu

SEQ ID NO: 1081270 - RNA, 18 nt, Human
ucucuguuaucugcugcu

SEQ ID NO: 1081271 - RNA, 24 nt, Human
ucuuggguucaagugauucuccug

SEQ ID NO: 1081272 - RNA, 22 nt, Human
ugacaugcauaaucacauagua

SEQ ID NO: 1081273 - RNA, 18 nt, Human
ugaccucagaugaucugc

SEQ ID NO: 1081274 - RNA, 19 nt, Human
ugaccucagaugaucugcc

SEQ ID NO: 1081275 - RNA, 22 nt, Human
ugaggcacaaagcaggaacccu

SEQ ID NO: 1081276 - RNA, 20 nt, Human
ugauucuccugccucagcuu

SEQ ID NO: 1081277 - RNA, 26 nt, Human
ugccaguuuuugcuucaugcagccau

SEQ ID NO: 1081278 - RNA, 19 nt, Human
ugcccaggcuggagugcug

SEQ ID NO: 1081279 - RNA, 21 nt, Human
ugcccaggcuggagugcugug

SEQ ID NO: 1081280 - RNA, 24 nt, Human
ugccguguuggcuggacuggucuc

SEQ ID NO: 1081281 - RNA, 24 nt, Human
ugccucagccucccaaaguguugg

SEQ ID NO: 1081282 - RNA, 24 nt, Human
ugccucagcuucccaaguagcuag

SEQ ID NO: 1081283 - RNA, 22 nt, Human
ugccucuuggguucaagugauu

SEQ ID NO: 1081284 - RNA, 20 nt, Human
ugcgccuggccuguuaaucu

SEQ ID NO: 1081285 - RNA, 22 nt, Human
ugcuguggagugaucucagcuc

SEQ ID NO: 1081286 - RNA, 24 nt, Human
uggagugaucucagcucauuacaa

SEQ ID NO: 1081287 - RNA, 23 nt, Human
uggagugcuguggagugaucuca

SEQ ID NO: 1081288 - RNA, 24 nt, Human
uggcagcgagagcuaugcggggcc

SEQ ID NO: 1081289 - RNA, 24 nt, Human
uggcuggacuggucucaaacuccu

SEQ ID NO: 1081290 - RNA, 18 nt, Human
ugggauuacaggcgugag

SEQ ID NO: 1081291 - RNA, 19 nt, Human
ugggauuacaggcgugagc

SEQ ID NO: 1081292 - RNA, 21 nt, Human
ugggauuacaggcgugagcca

SEQ ID NO: 1081293 - RNA, 22 nt, Human
ugggauuacaggcgugagccac

SEQ ID NO: 1081294 - RNA, 22 nt, Human
ugggauuacaggcgugagccac

SEQ ID NO: 1081295 - RNA, 24 nt, Human
ugggauuacaggcgugagccacug

SEQ ID NO: 1081296 - RNA, 24 nt, Human
ugggauuacaggcgugagccacug

SEQ ID NO: 1081297 - RNA, 21 nt, Human
uggggagagggguacuacugg

SEQ ID NO: 1081298 - RNA, 23 nt, Human
uggguucaagugauucuccugcc

SEQ ID NO: 1081299 - RNA, 24 nt, Human
uggguucaagugauucuccugccu

SEQ ID NO: 1081300 - RNA, 24 nt, Human
ugguugucacagcuggggagaggg

SEQ ID NO: 1081301 - RNA, 22 nt, Human
uguauuuuuaguagagguggag

SEQ ID NO: 1081302 - RNA, 24 nt, Human
uuacaaccucugccucuuggguuc

SEQ ID NO: 1081303 - RNA, 18 nt, Human
uuaguagagguggaguuu

SEQ ID NO: 1081304 - RNA, 18 nt, Human
uuaguagagguggaguuu

SEQ ID NO: 1081305 - RNA, 22 nt, Human
uuaguagagguggaguuuugcc

SEQ ID NO: 1081306 - RNA, 24 nt, Human
uuaguagagguggaguuuugccgu

SEQ ID NO: 1081307 - RNA, 21 nt, Human
uucaagugauucuccugccuc

SEQ ID NO: 1081308 - RNA, 23 nt, Human
uucaagugauucuccugccucag

SEQ ID NO: 1081309 - RNA, 24 nt, Human
uucaagugauucuccugccucagc

SEQ ID NO: 1081310 - RNA, 24 nt, Human
uucccaaguagcuaggauuacagg

SEQ ID NO: 1081311 - RNA, 20 nt, Human
uucucuguuaucugcugcuc

SEQ ID NO: 1081312 - RNA, 24 nt, Human
uucucuguuaucugcugcucuuuu

SEQ ID NO: 1081313 - RNA, 24 nt, Human
uugccguguuggcuggacuggucu

SEQ ID NO: 1081314 - RNA, 22 nt, Human
uugcucugcugcccaggcugga

SEQ ID NO: 1081315 - RNA, 23 nt, Human
uuguauuuuuaguagagguggag

SEQ ID NO: 1081316 - RNA, 21 nt, Human
uugucacagcuggggagaggg

SEQ ID NO: 1081317 - RNA, 18 nt, Human
uuuacuuaaaaugaaccu

SEQ ID NO: 1081318 - RNA, 18 nt, Human
uuugguugucacagcugg

SEQ ID NO: 1081319 - RNA, 24 nt, Human
uuuugcucugcugcccaggcugga

SEQ ID NO: 1081320 - RNA, 24 nt, Human
uuuuuaguagagguggaguuuugc

SEQ ID NO: 1081321 - RNA, 20 nt, Human
uuuuuguauuuuuaguagag

SEQ ID NO: 1081322 - RNA, 27 nt, Human
aagacgcccuccuccaugaugcaauug

SEQ ID NO: 1081323 - RNA, 24 nt, Human
acuucuuucuagaccagacuuguu

SEQ ID NO: 1081324 - RNA, 18 nt, Human
aggccuccagguacagcu

SEQ ID NO: 1081325 - RNA, 21 nt, Human
aggccuccagguacagcuccu

SEQ ID NO: 1081326 - RNA, 19 nt, Human
caccaggcucaagacgccc

SEQ ID NO: 1081327 - RNA, 19 nt, Human
caccagggcuauagcaaua

SEQ ID NO: 1081328 - RNA, 19 nt, Human
caggcucaagacgcccucc

SEQ ID NO: 1081329 - RNA, 21 nt, Human
caucagcuugcaggccuccag

SEQ ID NO: 1081330 - RNA, 23 nt, Human
caucugggagagugggacugcuc

SEQ ID NO: 1081331 - RNA, 19 nt, Human
caucugggggcaucccagg

SEQ ID NO: 1081332 - RNA, 19 nt, Human
ccaccauccgacuugcgag

SEQ ID NO: 1081333 - RNA, 22 nt, Human
cccuguugaaaggauccccacc

SEQ ID NO: 1081334 - RNA, 21 nt, Human
ccgggcugguuucacuuuuuc

SEQ ID NO: 1081335 - RNA, 23 nt, Human
ccugcaguuauccuucccuccca

SEQ ID NO: 1081336 - RNA, 21 nt, Human
cgaaugaaguaggagacaggc

SEQ ID NO: 1081337 - RNA, 24 nt, Human
cgaggacuccucucgccgagacuu

SEQ ID NO: 1081338 - RNA, 20 nt, Human
cgccugugacuuugugacuc

SEQ ID NO: 1081339 - RNA, 23 nt, Human
cucccagcaagcccugggaagag

SEQ ID NO: 1081340 - RNA, 22 nt, Human
cuccucccugccaccauccgac

SEQ ID NO: 1081341 - RNA, 20 nt, Human
cucgccgagacuucuuucua

SEQ ID NO: 1081342 - RNA, 20 nt, Human
gagucuuccuugaagucauu

SEQ ID NO: 1081343 - RNA, 21 nt, Human
gcccugggaagaguaggcuuu

SEQ ID NO: 1081344 - RNA, 21 nt, Human
ggagucuuccuugaagucauu

SEQ ID NO: 1081345 - RNA, 20 nt, Human
guaccccuggggcccaggcc

SEQ ID NO: 1081346 - RNA, 18 nt, Human
uagccuugguaccccugg

SEQ ID NO: 1081347 - RNA, 18 nt, Human
ucaucugggagaguggga

SEQ ID NO: 1081348 - RNA, 20 nt, Human
ucccagcaagcccugggaag

SEQ ID NO: 1081349 - RNA, 23 nt, Human
ucccucccagcaagcccugggaa

SEQ ID NO: 1081350 - RNA, 24 nt, Human
uccuuuuguccaguggugaaaaau

SEQ ID NO: 1081351 - RNA, 19 nt, Human
ucgcugcucugucguacug

SEQ ID NO: 1081352 - RNA, 22 nt, Human
ucuccuggagguaguaguucuc

SEQ ID NO: 1081353 - RNA, 18 nt, Human
ugaaguaggagacaggca

SEQ ID NO: 1081354 - RNA, 22 nt, Human
ugcugcggagucuuccuugaag

SEQ ID NO: 1081355 - RNA, 24 nt, Human
uggcagagcagugcugcggagucu

SEQ ID NO: 1081356 - RNA, 21 nt, Human
uggcccaggugcuccccuccu

SEQ ID NO: 1081357 - RNA, 21 nt, Human
ugggaagaguaggcuuugaug

SEQ ID NO: 1081358 - RNA, 23 nt, Human
ugggaagaguaggcuuugauggg

SEQ ID NO: 1081359 - RNA, 19 nt, Human
uggggcccaggccguggug

SEQ ID NO: 1081360 - RNA, 19 nt, Human
ugggggcaucccaggggag

SEQ ID NO: 1081361 - RNA, 21 nt, Human
uugcaggccuccagguacagc

SEQ ID NO: 1081362 - RNA, 19 nt, Human
aaaguucucccgugcaaca

SEQ ID NO: 1081363 - RNA, 22 nt, Human
aacucccagcccugcacauccc

SEQ ID NO: 1081364 - RNA, 19 nt, Human
aagagcccagcucccaagg

SEQ ID NO: 1081365 - RNA, 26 nt, Human
aagggaccagaauugggcagugggca

SEQ ID NO: 1081366 - RNA, 21 nt, Human
accacagaagcugcccaaaug

SEQ ID NO: 1081367 - RNA, 19 nt, Human
agcccagagagcuucaggg

SEQ ID NO: 1081368 - RNA, 18 nt, Human
agcgauuaugugcaucuc

SEQ ID NO: 1081369 - RNA, 23 nt, Human
aggagaaaaaugaguggccaggg

SEQ ID NO: 1081370 - RNA, 22 nt, Human
aggcaaggaagugcagccaggg

SEQ ID NO: 1081371 - RNA, 24 nt, Human
aggcaaggaagugcagccagggga

SEQ ID NO: 1081372 - RNA, 22 nt, Human
aggcagggaagaggcaugaggu

SEQ ID NO: 1081373 - RNA, 27 nt, Human
aggcagggaagaggcaugaggugugcc

SEQ ID NO: 1081374 - RNA, 22 nt, Human
aggggguugucggugcaggcuc

SEQ ID NO: 1081375 - RNA, 22 nt, Human
aucagcagaacagagggggcug

SEQ ID NO: 1081376 - RNA, 23 nt, Human
augaggugugccgggagagcgau

SEQ ID NO: 1081377 - RNA, 18 nt, Human
auggaacgcaggcagaag

SEQ ID NO: 1081378 - RNA, 25 nt, Human
auggaacgcaggcagaagcgcgccg

SEQ ID NO: 1081379 - RNA, 18 nt, Human
caacagcagcagccgccu

SEQ ID NO: 1081380 - RNA, 21 nt, Human
caacagcagcagccgccugcc

SEQ ID NO: 1081381 - RNA, 18 nt, Human
caaccucacugggggagc

SEQ ID NO: 1081382 - RNA, 22 nt, Human
caaccuucucacuaaccccacu

SEQ ID NO: 1081383 - RNA, 23 nt, Human
caacucccagcccugcacauccc

SEQ ID NO: 1081384 - RNA, 18 nt, Human
cacagggcuguccauggc

SEQ ID NO: 1081385 - RNA, 26 nt, Human
cacauaugcacauuuccagggcuccc

SEQ ID NO: 1081386 - RNA, 19 nt, Human
caccggaagcugcggcccu

SEQ ID NO: 1081387 - RNA, 21 nt, Human
cagagccagggcagaagagcc

SEQ ID NO: 1081388 - RNA, 22 nt, Human
cagcagcagccgccugcccucu

SEQ ID NO: 1081389 - RNA, 20 nt, Human
cagcccaagacuaaaguugg

SEQ ID NO: 1081390 - RNA, 22 nt, Human
cagcugggcaggucccgcagca

SEQ ID NO: 1081391 - RNA, 22 nt, Human
cccaacucugaguucagugcau

SEQ ID NO: 1081392 - RNA, 23 nt, Human
cccagagauaaggagggguggcc

SEQ ID NO: 1081393 - RNA, 20 nt, Human
ccccuaacuuuugguggcuc

SEQ ID NO: 1081394 - RNA, 25 nt, Human
cccggcagacacaugcacauaugca

SEQ ID NO: 1081395 - RNA, 18 nt, Human
cccgugcaacagcagcag

SEQ ID NO: 1081396 - RNA, 21 nt, Human
cccgugcaacagcagcagccg

SEQ ID NO: 1081397 - RNA, 24 nt, Human
cccgugcaacagcagcagccgccu

SEQ ID NO: 1081398 - RNA, 21 nt, Human
cccugcagugucuguucagca

SEQ ID NO: 1081399 - RNA, 19 nt, Human
cccugggcccuacauaccc

SEQ ID NO: 1081400 - RNA, 19 nt, Human
ccugcccucucccugcagu

SEQ ID NO: 1081401 - RNA, 21 nt, Human
ccugucugggcaggggcgggu

SEQ ID NO: 1081402 - RNA, 19 nt, Human
cgccugcccucucccugca

SEQ ID NO: 1081403 - RNA, 23 nt, Human
cggccagugugcugcucucccca

SEQ ID NO: 1081404 - RNA, 20 nt, Human
cggggucgcuggcagagggc

SEQ ID NO: 1081405 - RNA, 19 nt, Human
cuaguacuccuuggccucc

SEQ ID NO: 1081406 - RNA, 20 nt, Human
cucccagcccugcacauccc

SEQ ID NO: 1081407 - RNA, 18 nt, Human
cugaguucagugcauuca

SEQ ID NO: 1081408 - RNA, 21 nt, Human
gaaaggcagcuuggggcuaca

SEQ ID NO: 1081409 - RNA, 23 nt, Human
gaauuuacaccacagaagcugcc

SEQ ID NO: 1081410 - RNA, 22 nt, Human
gagacaguugagacuucaauau

SEQ ID NO: 1081411 - RNA, 18 nt, Human
gcagcaucuggcucagau

SEQ ID NO: 1081412 - RNA, 20 nt, Human
gccacccaggcuggaugccc

SEQ ID NO: 1081413 - RNA, 19 nt, Human
gcccuggugcucguccugu

SEQ ID NO: 1081414 - RNA, 19 nt, Human
gcugcggcccuggugcucg

SEQ ID NO: 1081415 - RNA, 23 nt, Human
gcuuuuuuccccucccagagaac

SEQ ID NO: 1081416 - RNA, 21 nt, Human
ggagcacagcguggaggcggc

SEQ ID NO: 1081417 - RNA, 21 nt, Human
ggcagggaguggggaaagaag

SEQ ID NO: 1081418 - RNA, 22 nt, Human
ggcagggaguggggaaagaagg

SEQ ID NO: 1081419 - RNA, 20 nt, Human
ggcaggucccgcagcaucug

SEQ ID NO: 1081420 - RNA, 24 nt, Human
ggcccuacauacccuucaaccuuc

SEQ ID NO: 1081421 - RNA, 19 nt, Human
ggcccuggugcucguccug

SEQ ID NO: 1081422 - RNA, 23 nt, Human
gggaggccccggcagacacaugc

SEQ ID NO: 1081423 - RNA, 23 nt, Human
gggaguggggaaagaagggcaug

SEQ ID NO: 1081424 - RNA, 19 nt, Human
gggauuuuucuggagcugc

SEQ ID NO: 1081425 - RNA, 18 nt, Human
gggcagaagagcccagcu

SEQ ID NO: 1081426 - RNA, 19 nt, Human
gggucccagcaggcagcag

SEQ ID NO: 1081427 - RNA, 23 nt, Human
guggccacccaggcuggaugccc

SEQ ID NO: 1081428 - RNA, 19 nt, Human
uaaggagggguggccaccc

SEQ ID NO: 1081429 - RNA, 24 nt, Human
ucaaccccauagaaggcaaggaag

SEQ ID NO: 1081430 - RNA, 18 nt, Human
ucaccuccccacucgggg

SEQ ID NO: 1081431 - RNA, 25 nt, Human
ucagcaaccccgucacuaguacucc

SEQ ID NO: 1081432 - RNA, 19 nt, Human
ucagcagaacagagggggc

SEQ ID NO: 1081433 - RNA, 21 nt, Human
ucccagagaacugguuuacua

SEQ ID NO: 1081434 - RNA, 19 nt, Human
ucccagcccugcacauccc

SEQ ID NO: 1081435 - RNA, 21 nt, Human
ucccagggacacccacccugg

SEQ ID NO: 1081436 - RNA, 19 nt, Human
ucccuacaaucagcagaac

SEQ ID NO: 1081437 - RNA, 19 nt, Human
ucccugcagugucuguuca

SEQ ID NO: 1081438 - RNA, 18 nt, Human
ugacucguggcagauccc

SEQ ID NO: 1081439 - RNA, 25 nt, Human
ugaggagcccagagagcuucagggc

SEQ ID NO: 1081440 - RNA, 23 nt, Human
ugcaccacccagagauaaggagg

SEQ ID NO: 1081441 - RNA, 19 nt, Human
ugcuagguacuccuccucc

SEQ ID NO: 1081442 - RNA, 24 nt, Human
uggaacgcaggcagaagcgcgccg

SEQ ID NO: 1081443 - RNA, 18 nt, Human
uggaggcggcuccagucc

SEQ ID NO: 1081444 - RNA, 21 nt, Human
uggcagggaguggggaaagaa

SEQ ID NO: 1081445 - RNA, 21 nt, Human
uggccagggucccagcaggca

SEQ ID NO: 1081446 - RNA, 19 nt, Human
uggggaggcagggaagagg

SEQ ID NO: 1081447 - RNA, 20 nt, Human
uggggaggcagggaagaggc

SEQ ID NO: 1081448 - RNA, 19 nt, Human
uguugggagggagcacagc

SEQ ID NO: 1081449 - RNA, 18 nt, Human
uuaugugcaucucuuccc

SEQ ID NO: 1081450 - RNA, 21 nt, Human
uucaaccccauagaaggcaag

SEQ ID NO: 1081451 - RNA, 23 nt, Human
uuuccccucccagagaacugguu

SEQ ID NO: 1081452 - RNA, 19 nt, Human
uuuuccccucccagagaac

SEQ ID NO: 1081453 - RNA, 23 nt, Human
aaaaaaucaguuguauauaaaug

SEQ ID NO: 1081454 - RNA, 26 nt, Human
aaaaaggaaaauacaaagugaaaaaa

SEQ ID NO: 1081455 - RNA, 25 nt, Human
aaaauacaaagugaaaaaauaucau

SEQ ID NO: 1081456 - RNA, 20 nt, Human
aaaucuucuaguaggcucag

SEQ ID NO: 1081457 - RNA, 20 nt, Human
aagagccaaagcugcaggua

SEQ ID NO: 1081458 - RNA, 22 nt, Human
aaguugggaugguagaagcaga

SEQ ID NO: 1081459 - RNA, 19 nt, Human
aauacaaagugaaaaaaua

SEQ ID NO: 1081460 - RNA, 24 nt, Human
acugcaggaaucucugaagucuuu

SEQ ID NO: 1081461 - RNA, 20 nt, Human
agaaagguucugucaccuuu

SEQ ID NO: 1081462 - RNA, 19 nt, Human
agaagcagauaggaccaaa

SEQ ID NO: 1081463 - RNA, 22 nt, Human
agaauuucugcgaacccuguau

SEQ ID NO: 1081464 - RNA, 21 nt, Human
agacaggaagcgacugugauc

SEQ ID NO: 1081465 - RNA, 20 nt, Human
agaugaacugcaggaaucuc

SEQ ID NO: 1081466 - RNA, 24 nt, Human
agcagauaggaccaaauuauacaa

SEQ ID NO: 1081467 - RNA, 20 nt, Human
agcucccauauuccucuuuu

SEQ ID NO: 1081468 - RNA, 24 nt, Human
auuuguaacauacucauguaaaau

SEQ ID NO: 1081469 - RNA, 23 nt, Human
cagaugguccaaggccacuuggg

SEQ ID NO: 1081470 - RNA, 20 nt, Human
ccaaagagccaaagcugcag

SEQ ID NO: 1081471 - RNA, 22 nt, Human
cuaacccacgagugugggaacc

SEQ ID NO: 1081472 - RNA, 22 nt, Human
cugugcuaguauaaguugcaaa

SEQ ID NO: 1081473 - RNA, 26 nt, Human
cuuuugguucuguacuuggugucauc

SEQ ID NO: 1081474 - RNA, 22 nt, Human
gaagagaauuucugcgaacccu

SEQ ID NO: 1081475 - RNA, 21 nt, Human
gacugugauccugccaagagg

SEQ ID NO: 1081476 - RNA, 20 nt, Human
gaugguagaagcagauagga

SEQ ID NO: 1081477 - RNA, 25 nt, Human
gcaauaccaaagagccaaagcugca

SEQ ID NO: 1081478 - RNA, 21 nt, Human
gguccaggauaugacugaagu

SEQ ID NO: 1081479 - RNA, 21 nt, Human
guugggaugguagaagcagau

SEQ ID NO: 1081480 - RNA, 24 nt, Human
uaaaccaaagacgguccaggauau

SEQ ID NO: 1081481 - RNA, 23 nt, Human
uaauuuucagcuacgguaugcag

SEQ ID NO: 1081482 - RNA, 21 nt, Human
uaccaaagagccaaagcugca

SEQ ID NO: 1081483 - RNA, 22 nt, Human
uaccaaagagccaaagcugcag

SEQ ID NO: 1081484 - RNA, 19 nt, Human
uagacaggaagcgacugug

SEQ ID NO: 1081485 - RNA, 19 nt, Human
uagauauaaaaguccugag

SEQ ID NO: 1081486 - RNA, 19 nt, Human
uauaaaaguccugagcauu

SEQ ID NO: 1081487 - RNA, 19 nt, Human
uauaaaucucauggacaaa

SEQ ID NO: 1081488 - RNA, 18 nt, Human
uauaugcacaucuccaca

SEQ ID NO: 1081489 - RNA, 20 nt, Human
ucaccuuugaaacuuuuggu

SEQ ID NO: 1081490 - RNA, 19 nt, Human
ucaguuguauauaaaugcu

SEQ ID NO: 1081491 - RNA, 19 nt, Human
ucucaggcacagacuccag

SEQ ID NO: 1081492 - RNA, 21 nt, Human
ucugcgaacccuguauuugga

SEQ ID NO: 1081493 - RNA, 20 nt, Human
ucuuccuuguuugaagcuga

SEQ ID NO: 1081494 - RNA, 20 nt, Human
ugaaaaaaguugggauggua

SEQ ID NO: 1081495 - RNA, 23 nt, Human
ugaaaaaaguugggaugguagaa

SEQ ID NO: 1081496 - RNA, 19 nt, Human
ugaaucuggagcaacaguu

SEQ ID NO: 1081497 - RNA, 19 nt, Human
ugaccacacuugaaaaagg

SEQ ID NO: 1081498 - RNA, 19 nt, Human
uggccacaaaaagacaaau

SEQ ID NO: 1081499 - RNA, 18 nt, Human
ugguugggaaaaugugac

SEQ ID NO: 1081500 - RNA, 24 nt, Human
ugucaauguuuggcaauaccaaag

SEQ ID NO: 1081501 - RNA, 23 nt, Human
uuagcucccauauuccucuuuuu

SEQ ID NO: 1081502 - RNA, 24 nt, Human
uuagggagaaaauuuuucaaaaaa

SEQ ID NO: 1081503 - RNA, 19 nt, Human
uuauauaugcacaucucca

SEQ ID NO: 1081504 - RNA, 18 nt, Human
uuggccacaaaaagacaa

SEQ ID NO: 1081505 - RNA, 20 nt, Human
aacaacuuuucacaagccga

SEQ ID NO: 1081506 - RNA, 22 nt, Human
aacucccuucuucaauggacua

SEQ ID NO: 1081507 - RNA, 22 nt, Human
acuaccaaaaaucagaaagcca

SEQ ID NO: 1081508 - RNA, 24 nt, Human
agaaagccacuauaaaacccaaug

SEQ ID NO: 1081509 - RNA, 21 nt, Human
cagaugucucggcucaaggga

SEQ ID NO: 1081510 - RNA, 23 nt, Human
cagcugcgcgcgggcuuugguca

SEQ ID NO: 1081511 - RNA, 19 nt, Human
ccaaaaaucagaaagccac

SEQ ID NO: 1081512 - RNA, 20 nt, Human
ccacaaucuagaaauggaac

SEQ ID NO: 1081513 - RNA, 19 nt, Human
cgggcuuuggucaguccgg

SEQ ID NO: 1081514 - RNA, 22 nt, Human
cgguggcgggauguaggugcug

SEQ ID NO: 1081515 - RNA, 23 nt, Human
cgguggcgggauguaggugcugg

SEQ ID NO: 1081516 - RNA, 20 nt, Human
cugggggucaggucccaaca

SEQ ID NO: 1081517 - RNA, 21 nt, Human
ggcaucacuggaaaguccaga

SEQ ID NO: 1081518 - RNA, 21 nt, Human
gugcuggaugcgggaugcagc

SEQ ID NO: 1081519 - RNA, 22 nt, Human
uacaacaacuuucaaacucccu

SEQ ID NO: 1081520 - RNA, 24 nt, Human
uaccaaaaaucagaaagccacuau

SEQ ID NO: 1081521 - RNA, 25 nt, Human
uagaaauggaaccacugcucuuuug

SEQ ID NO: 1081522 - RNA, 22 nt, Human
ucaggcaggacaugggcagaca

SEQ ID NO: 1081523 - RNA, 25 nt, Human
ucccaacagaugucucggcucaagg

SEQ ID NO: 1081524 - RNA, 20 nt, Human
ugaaaauggcagaauuuauc

SEQ ID NO: 1081525 - RNA, 21 nt, Human
ugaaaauggcagaauuuaucu

SEQ ID NO: 1081526 - RNA, 22 nt, Human
ugcgggaugcagcugcgcgcgg

SEQ ID NO: 1081527 - RNA, 23 nt, Human
uggaaccacugcucuuuugacag

SEQ ID NO: 1081528 - RNA, 19 nt, Human
uggaugcgggaugcagcug

SEQ ID NO: 1081529 - RNA, 18 nt, Human
uggcaucacuggaaaguc

SEQ ID NO: 1081530 - RNA, 20 nt, Human
uuaucugaagauccacaauc

SEQ ID NO: 1081531 - RNA, 29 nt, Human
uuuagagugaggguugacauuucacauuu

SEQ ID NO: 1081532 - RNA, 26 nt, Human
uuucaaacucccuucuucaauggacu

SEQ ID NO: 1081533 - RNA, 20 nt, Human
aaauucuccaaguaccccaa

SEQ ID NO: 1081534 - RNA, 18 nt, Human
aaccuguugccagaaccc

SEQ ID NO: 1081535 - RNA, 23 nt, Human
aacuugcugugugacuuugggug

SEQ ID NO: 1081536 - RNA, 20 nt, Human
accagguaggcaagggugcu

SEQ ID NO: 1081537 - RNA, 19 nt, Human
acccauuucccccuugccc

SEQ ID NO: 1081538 - RNA, 23 nt, Human
acucugcaaugccaagcguucug

SEQ ID NO: 1081539 - RNA, 21 nt, Human
acuuggggagaagacacugag

SEQ ID NO: 1081540 - RNA, 20 nt, Human
agagcacugcugggacaggg

SEQ ID NO: 1081541 - RNA, 22 nt, Human
agaggcaguccaggaagaggcc

SEQ ID NO: 1081542 - RNA, 21 nt, Human
agcugugcaggccacaccugg

SEQ ID NO: 1081543 - RNA, 24 nt, Human
aggaaagagagcaccugccaaaaa

SEQ ID NO: 1081544 - RNA, 24 nt, Human
aggaagaggccuugggccccaagg

SEQ ID NO: 1081545 - RNA, 18 nt, Human
aggccagccagagugacg

SEQ ID NO: 1081546 - RNA, 18 nt, Human
agggagggagagugaggc

SEQ ID NO: 1081547 - RNA, 19 nt, Human
agggggcacccccgcugcu

SEQ ID NO: 1081548 - RNA, 18 nt, Human
agucaaaugagguaggcc

SEQ ID NO: 1081549 - RNA, 18 nt, Human
augaacuugcugugugac

SEQ ID NO: 1081550 - RNA, 20 nt, Human
augccaagcguucuggcaac

SEQ ID NO: 1081551 - RNA, 19 nt, Human
caaaaggcacaacugaggg

SEQ ID NO: 1081552 - RNA, 23 nt, Human
cacaccuggcuugagaaagcuga

SEQ ID NO: 1081553 - RNA, 25 nt, Human
cacaggacucggggggugauacaga

SEQ ID NO: 1081554 - RNA, 23 nt, Human
cacaguuucauggccaagauaga

SEQ ID NO: 1081555 - RNA, 18 nt, Human
caccuggaaggaacucac

SEQ ID NO: 1081556 - RNA, 20 nt, Human
cagcggccuccccacagccu

SEQ ID NO: 1081557 - RNA, 24 nt, Human
caggaucgguggguagcgaaccuc

SEQ ID NO: 1081558 - RNA, 22 nt, Human
caucaagauccuugauuccugu

SEQ ID NO: 1081559 - RNA, 22 nt, Human
ccaacccauuucccccuugccc

SEQ ID NO: 1081560 - RNA, 20 nt, Human
cccacacuuuccacuucuca

SEQ ID NO: 1081561 - RNA, 20 nt, Human
ccccaaaagaacagguugga

SEQ ID NO: 1081562 - RNA, 21 nt, Human
cccccuuaaaacagaggccgg

SEQ ID NO: 1081563 - RNA, 19 nt, Human
cccugagagcugugcaggc

SEQ ID NO: 1081564 - RNA, 21 nt, Human
ccuaguucaaggcaauucagc

SEQ ID NO: 1081565 - RNA, 25 nt, Human
ccugccaaaaaucccacacuuucca

SEQ ID NO: 1081566 - RNA, 20 nt, Human
ccuggucucagcucagccau

SEQ ID NO: 1081567 - RNA, 19 nt, Human
ccuguggggucaacaccau

SEQ ID NO: 1081568 - RNA, 19 nt, Human
cgcauacagcaccagggag

SEQ ID NO: 1081569 - RNA, 19 nt, Human
cuagcagcagaaacccacg

SEQ ID NO: 1081570 - RNA, 24 nt, Human
cucacacucacugcaagggugauc

SEQ ID NO: 1081571 - RNA, 18 nt, Human
cuggcaaccugggcuaga

SEQ ID NO: 1081572 - RNA, 20 nt, Human
cuuugggaugggguugggag

SEQ ID NO: 1081573 - RNA, 19 nt, Human
gaaccuguugccagaaccc

SEQ ID NO: 1081574 - RNA, 21 nt, Human
gacauaccauuacagagagga

SEQ ID NO: 1081575 - RNA, 18 nt, Human
gacguggcacuggccuuc

SEQ ID NO: 1081576 - RNA, 18 nt, Human
gagagcaccugccaaaaa

SEQ ID NO: 1081577 - RNA, 19 nt, Human
gaggaagagaaagaauggc

SEQ ID NO: 1081578 - RNA, 18 nt, Human
gaggauggccagcccugc

SEQ ID NO: 1081579 - RNA, 21 nt, Human
gaggccugggaggauggccag

SEQ ID NO: 1081580 - RNA, 19 nt, Human
gagucaaaugagguaggcc

SEQ ID NO: 1081581 - RNA, 19 nt, Human
gaguuggagagaauguggg

SEQ ID NO: 1081582 - RNA, 18 nt, Human
gcacaacugagggccccc

SEQ ID NO: 1081583 - RNA, 24 nt, Human
gcacacaccuggaaggaacucaca

SEQ ID NO: 1081584 - RNA, 18 nt, Human
gcagacgcccugcccccu

SEQ ID NO: 1081585 - RNA, 18 nt, Human
gcaggccacaccuggcuu

SEQ ID NO: 1081586 - RNA, 18 nt, Human
gccuuuggcaaauucucc

SEQ ID NO: 1081587 - RNA, 21 nt, Human
ggagaugaagaguuggagaga

SEQ ID NO: 1081588 - RNA, 23 nt, Human
ggagguagaaggagcagaggacu

SEQ ID NO: 1081589 - RNA, 23 nt, Human
ggaugggguugggagggguuggg

SEQ ID NO: 1081590 - RNA, 22 nt, Human
ggcgcggggggcggaggaaaga

SEQ ID NO: 1081591 - RNA, 20 nt, Human
ggcuggccauccucccacuc

SEQ ID NO: 1081592 - RNA, 19 nt, Human
gggaugggguugggagggg

SEQ ID NO: 1081593 - RNA, 19 nt, Human
ggggaaagaggauacuugg

SEQ ID NO: 1081594 - RNA, 19 nt, Human
ggggaugcuggucccuagu

SEQ ID NO: 1081595 - RNA, 24 nt, Human
ggguguagcauuuugaaggauucu

SEQ ID NO: 1081596 - RNA, 22 nt, Human
uaagggcaaaggguccccaaaa

SEQ ID NO: 1081597 - RNA, 25 nt, Human
uacagcaccagggagggagagugag

SEQ ID NO: 1081598 - RNA, 18 nt, Human
uaggccaacccauuuccc

SEQ ID NO: 1081599 - RNA, 21 nt, Human
uaguucaaggcaauucagcaa

SEQ ID NO: 1081600 - RNA, 23 nt, Human
uauugacaaaucaaaugaaaaaa

SEQ ID NO: 1081601 - RNA, 21 nt, Human
ucaggaauugucuccauuggc

SEQ ID NO: 1081602 - RNA, 20 nt, Human
ucagggagaugaagaguugg

SEQ ID NO: 1081603 - RNA, 18 nt, Human
uccacuucucagcuauca

SEQ ID NO: 1081604 - RNA, 23 nt, Human
uccaggaagaggccuugggcccc

SEQ ID NO: 1081605 - RNA, 20 nt, Human
ucccaguguaaaacugccag

SEQ ID NO: 1081606 - RNA, 24 nt, Human
ucccaugcugacaagcugguggcu

SEQ ID NO: 1081607 - RNA, 22 nt, Human
uccccacagccugcccaggcuu

SEQ ID NO: 1081608 - RNA, 18 nt, Human
ucccucugugauccucuu

SEQ ID NO: 1081609 - RNA, 21 nt, Human
ucugcaaugccaagcguucug

SEQ ID NO: 1081610 - RNA, 22 nt, Human
ugaaaaaaauucacuuaaaaga

SEQ ID NO: 1081611 - RNA, 21 nt, Human
ugacaaaucaaaugaaaaaaa

SEQ ID NO: 1081612 - RNA, 26 nt, Human
ugacagccuuuggcaaauucuccaag

SEQ ID NO: 1081613 - RNA, 19 nt, Human
ugagaaagcugaccgugag

SEQ ID NO: 1081614 - RNA, 21 nt, Human
ugagaaagcugaccgugaggc

SEQ ID NO: 1081615 - RNA, 24 nt, Human
ugaggcuaggaggcagcggccucc

SEQ ID NO: 1081616 - RNA, 24 nt, Human
ugaggcuggacauaccauuacaga

SEQ ID NO: 1081617 - RNA, 20 nt, Human
ugcuccagcagaggcagucc

SEQ ID NO: 1081618 - RNA, 21 nt, Human
ugcugugugacuuugggugaa

SEQ ID NO: 1081619 - RNA, 22 nt, Human
uggaagaucagggagaugaaga

SEQ ID NO: 1081620 - RNA, 18 nt, Human
uggacugagagcacugcu

SEQ ID NO: 1081621 - RNA, 22 nt, Human
uggagggaggagcccacauuug

SEQ ID NO: 1081622 - RNA, 18 nt, Human
uggcaaauucuccaagua

SEQ ID NO: 1081623 - RNA, 20 nt, Human
uggcaaccugggcuagacca

SEQ ID NO: 1081624 - RNA, 22 nt, Human
uggcagcggcagcaauucagag

SEQ ID NO: 1081625 - RNA, 19 nt, Human
uggcaucaagauccuugau

SEQ ID NO: 1081626 - RNA, 22 nt, Human
uggccagcccugcccugagagc

SEQ ID NO: 1081627 - RNA, 21 nt, Human
uggcuggccauccucccacuc

SEQ ID NO: 1081628 - RNA, 24 nt, Human
uggcugugagggagccuggguuuu

SEQ ID NO: 1081629 - RNA, 19 nt, Human
uggcuuguggcuggccauc

SEQ ID NO: 1081630 - RNA, 24 nt, Human
uggggauguuuccauggggaugcu

SEQ ID NO: 1081631 - RNA, 19 nt, Human
ugguggcuuguggcuggcc

SEQ ID NO: 1081632 - RNA, 21 nt, Human
ugugcacaccaccacacaccu

SEQ ID NO: 1081633 - RNA, 26 nt, Human
ugugcacaccaccacacaccuacaug

SEQ ID NO: 1081634 - RNA, 20 nt, Human
ugugugcacaccaccacaca

SEQ ID NO: 1081635 - RNA, 20 nt, Human
uuccucugcuguaaaacaau

SEQ ID NO: 1081636 - RNA, 22 nt, Human
uuggagggaggagcccacauuu

SEQ ID NO: 1081637 - RNA, 23 nt, Human
uuuaugaagcaaguucucuacaa

SEQ ID NO: 1081638 - RNA, 19 nt, Human
uuugggugaaucauuuucc

SEQ ID NO: 1081639 - RNA, 20 nt, Human
aaaugccuucuugauuuccc

SEQ ID NO: 1081640 - RNA, 18 nt, Human
aagagugcgcucagcccu

SEQ ID NO: 1081641 - RNA, 19 nt, Human
acccagaaaggccagagag

SEQ ID NO: 1081642 - RNA, 21 nt, Human
agagaguguaaucugcgagag

SEQ ID NO: 1081643 - RNA, 19 nt, Human
agagcuccaguagcugguu

SEQ ID NO: 1081644 - RNA, 19 nt, Human
agaggaaggagagggaagg

SEQ ID NO: 1081645 - RNA, 23 nt, Human
agagugcgcucagcccuggcugg

SEQ ID NO: 1081646 - RNA, 22 nt, Human
cacccaaaucaaagacugccag

SEQ ID NO: 1081647 - RNA, 19 nt, Human
caccgggcaccccaaggcu

SEQ ID NO: 1081648 - RNA, 23 nt, Human
ccaguagcugguuggccccuucu

SEQ ID NO: 1081649 - RNA, 21 nt, Human
cccaaaucaaagacugccagc

SEQ ID NO: 1081650 - RNA, 20 nt, Human
cccuucuaucucacuugucc

SEQ ID NO: 1081651 - RNA, 18 nt, Human
ccugaagaggucaaagag

SEQ ID NO: 1081652 - RNA, 19 nt, Human
cugucccuaccucaccugc

SEQ ID NO: 1081653 - RNA, 21 nt, Human
cuucugcugcaaccucucaaa

SEQ ID NO: 1081654 - RNA, 19 nt, Human
gagaaaggaauuccagucu

SEQ ID NO: 1081655 - RNA, 19 nt, Human
gagagggaagguucagccu

SEQ ID NO: 1081656 - RNA, 25 nt, Human
gccccgccuaucucguacaguucca

SEQ ID NO: 1081657 - RNA, 20 nt, Human
ggaaaaggagagcaccuuac

SEQ ID NO: 1081658 - RNA, 23 nt, Human
ggcaccucuggguacagucggac

SEQ ID NO: 1081659 - RNA, 19 nt, Human
ggggcgggagaugcaggga

SEQ ID NO: 1081660 - RNA, 22 nt, Human
gucccucacccaaaucaaagac

SEQ ID NO: 1081661 - RNA, 20 nt, Human
uaaauuacaaaugcaccuga

SEQ ID NO: 1081662 - RNA, 19 nt, Human
uacagucggacgucuuggc

SEQ ID NO: 1081663 - RNA, 23 nt, Human
uacagucggacgucuuggccccg

SEQ ID NO: 1081664 - RNA, 22 nt, Human
uaccugaagaggucaaagagcu

SEQ ID NO: 1081665 - RNA, 18 nt, Human
uagcugguuggccccuuc

SEQ ID NO: 1081666 - RNA, 18 nt, Human
ucagcccuggcugggucc

SEQ ID NO: 1081667 - RNA, 25 nt, Human
ucccucacccaaaucaaagacugcc

SEQ ID NO: 1081668 - RNA, 24 nt, Human
ucccugucccuaccucaccugcuc

SEQ ID NO: 1081669 - RNA, 20 nt, Human
ugaagaggucaaagagcuca

SEQ ID NO: 1081670 - RNA, 19 nt, Human
ugaagcagccgcaccgggc

SEQ ID NO: 1081671 - RNA, 23 nt, Human
ugcgcucagcccuggcugggucc

SEQ ID NO: 1081672 - RNA, 19 nt, Human
ugcuguuagggauguggaa

SEQ ID NO: 1081673 - RNA, 24 nt, Human
ugcuguuagggauguggaaaagga

SEQ ID NO: 1081674 - RNA, 21 nt, Human
ugucacacacagaugaacuuu

SEQ ID NO: 1081675 - RNA, 19 nt, Human
uucagccuggggcgggaga

SEQ ID NO: 1081676 - RNA, 20 nt, Human
uugaagcagccgcaccgggc

SEQ ID NO: 1081677 - RNA, 23 nt, Human
aaacaggaggguuggcgagucug

SEQ ID NO: 1081678 - RNA, 23 nt, Human
aaacaggcauaaagaggggacgc

SEQ ID NO: 1081679 - RNA, 21 nt, Human
aaagaaaaacugaggcccaga

SEQ ID NO: 1081680 - RNA, 18 nt, Human
aacgcgcgcucccccacc

SEQ ID NO: 1081681 - RNA, 24 nt, Human
aagccagccccaaaugcuugcuau

SEQ ID NO: 1081682 - RNA, 22 nt, Human
aaggguagcuggugggggcugc

SEQ ID NO: 1081683 - RNA, 25 nt, Human
aauuagagagccaauuauaacucaa

SEQ ID NO: 1081684 - RNA, 25 nt, Human
acaacacagaagacacaggugacac

SEQ ID NO: 1081685 - RNA, 23 nt, Human
acacaaaaauacuauccuuuuca

SEQ ID NO: 1081686 - RNA, 24 nt, Human
acugcaugcaagugugaaccagca

SEQ ID NO: 1081687 - RNA, 20 nt, Human
acuugcccaagggccccagc

SEQ ID NO: 1081688 - RNA, 22 nt, Human
acuugcuggugggugugugggc

SEQ ID NO: 1081689 - RNA, 18 nt, Human
agaaaaaugagaaggcuc

SEQ ID NO: 1081690 - RNA, 19 nt, Human
agacugaacuggcaagggu

SEQ ID NO: 1081691 - RNA, 20 nt, Human
agagacaacacagaagacac

SEQ ID NO: 1081692 - RNA, 22 nt, Human
agccaauuuccuuguaaacugg

SEQ ID NO: 1081693 - RNA, 22 nt, Human
agccacuucugcuccugacacu

SEQ ID NO: 1081694 - RNA, 24 nt, Human
aggaagaggcagauuuugcuucua

SEQ ID NO: 1081695 - RNA, 20 nt, Human
aggcagaagcagauuuguca

SEQ ID NO: 1081696 - RNA, 18 nt, Human
agggcuggcuacagcccu

SEQ ID NO: 1081697 - RNA, 23 nt, Human
aguguugaggauucagaaaggga

SEQ ID NO: 1081698 - RNA, 23 nt, Human
auacagaaagaaaaacugaggcc

SEQ ID NO: 1081699 - RNA, 23 nt, Human
auucccuucaggagcagucacug

SEQ ID NO: 1081700 - RNA, 24 nt, Human
caacacagaagacacaggugacag

SEQ ID NO: 1081701 - RNA, 24 nt, Human
caacuggaucuaaucaagacugaa

SEQ ID NO: 1081702 - RNA, 18 nt, Human
caagguccuacaaacugc

SEQ ID NO: 1081703 - RNA, 21 nt, Human
cacaaaacacacugaucccau

SEQ ID NO: 1081704 - RNA, 19 nt, Human
cacagaagacacaggugac

SEQ ID NO: 1081705 - RNA, 25 nt, Human
cacagcccggugggaugaacaccau

SEQ ID NO: 1081706 - RNA, 21 nt, Human
caccaucguccccacauacag

SEQ ID NO: 1081707 - RNA, 22 nt, Human
caccaucguccccacauacaga

SEQ ID NO: 1081708 - RNA, 24 nt, Human
cacugaucccaucauccaaagcac

SEQ ID NO: 1081709 - RNA, 20 nt, Human
cacugcaugcaagugugaac

SEQ ID NO: 1081710 - RNA, 24 nt, Human
cacugucgucuugaugguugaggg

SEQ ID NO: 1081711 - RNA, 20 nt, Human
cacuguuguuaugggcuugg

SEQ ID NO: 1081712 - RNA, 19 nt, Human
cagaaggucacuggccagc

SEQ ID NO: 1081713 - RNA, 22 nt, Human
cagccuucugagcuugauuucc

SEQ ID NO: 1081714 - RNA, 23 nt, Human
cagcugcacugcaugcaagugug

SEQ ID NO: 1081715 - RNA, 19 nt, Human
cagcuucugcuucacucag

SEQ ID NO: 1081716 - RNA, 23 nt, Human
caggcauacuguacaugugugca

SEQ ID NO: 1081717 - RNA, 24 nt, Human
cauacagaaagaaaaacugaggcc

SEQ ID NO: 1081718 - RNA, 20 nt, Human
ccacauacagaaagaaaaac

SEQ ID NO: 1081719 - RNA, 29 nt, Human
cccacauacagaaagaaaaacugaggcug

SEQ ID NO: 1081720 - RNA, 24 nt, Human
cccacaucuagaaaaaugagaagg

SEQ ID NO: 1081721 - RNA, 24 nt, Human
cccagagaaucgacaugacuugcc

SEQ ID NO: 1081722 - RNA, 23 nt, Human
cccaucauccaaagcacacuguc

SEQ ID NO: 1081723 - RNA, 24 nt, Human
ccuaagcugagagcagacuggggc

SEQ ID NO: 1081724 - RNA, 23 nt, Human
ccucaggagccucauuucccucc

SEQ ID NO: 1081725 - RNA, 24 nt, Human
ccucauuucccuccugcuccccaa

SEQ ID NO: 1081726 - RNA, 21 nt, Human
ccucccauucaggcuccaaac

SEQ ID NO: 1081727 - RNA, 18 nt, Human
ccugugcacgguggcuug

SEQ ID NO: 1081728 - RNA, 19 nt, Human
ccuugcuuugaaaggccug

SEQ ID NO: 1081729 - RNA, 24 nt, Human
cuacagcccuaagcugagagcaga

SEQ ID NO: 1081730 - RNA, 20 nt, Human
cucaaagcaucauugaaaca

SEQ ID NO: 1081731 - RNA, 20 nt, Human
cuccacaacgcgcgcucccc

SEQ ID NO: 1081732 - RNA, 18 nt, Human
cuccuuggguucuguccu

SEQ ID NO: 1081733 - RNA, 21 nt, Human
cugaaaaaacguaugaacauc

SEQ ID NO: 1081734 - RNA, 19 nt, Human
cugauccugcagugggcau

SEQ ID NO: 1081735 - RNA, 19 nt, Human
cugcagugggcaugcuccg

SEQ ID NO: 1081736 - RNA, 25 nt, Human
cuggccccaugcaucuggggucccc

SEQ ID NO: 1081737 - RNA, 22 nt, Human
cugggcuguguccaugucauac

SEQ ID NO: 1081738 - RNA, 19 nt, Human
cuguguccaugucauacuu

SEQ ID NO: 1081739 - RNA, 20 nt, Human
cuguguggugcggggugccc

SEQ ID NO: 1081740 - RNA, 25 nt, Human
cuuccugugcacgguggcuuggugg

SEQ ID NO: 1081741 - RNA, 21 nt, Human
cuucugcuccugacacuuauc

SEQ ID NO: 1081742 - RNA, 21 nt, Human
cuugauuucccuacagccaau

SEQ ID NO: 1081743 - RNA, 18 nt, Human
gaggagaggcucaaagca

SEQ ID NO: 1081744 - RNA, 19 nt, Human
gauguagagaaugagagag

SEQ ID NO: 1081745 - RNA, 27 nt, Human
gcaguaaggguagcuggugggggcugc

SEQ ID NO: 1081746 - RNA, 21 nt, Human
gcuuggggucacccacugucc

SEQ ID NO: 1081747 - RNA, 19 nt, Human
ggaaacaggaggguuggcc

SEQ ID NO: 1081748 - RNA, 24 nt, Human
ggaagaggcagauuuugcuucuag

SEQ ID NO: 1081749 - RNA, 22 nt, Human
ggacaccuggcaagagaaucag

SEQ ID NO: 1081750 - RNA, 18 nt, Human
ggcaaagccagccccaaa

SEQ ID NO: 1081751 - RNA, 18 nt, Human
ggcagcuucugcuucacu

SEQ ID NO: 1081752 - RNA, 19 nt, Human
ggccaagguccuacaaacu

SEQ ID NO: 1081753 - RNA, 19 nt, Human
gggcugcuggcggcaagga

SEQ ID NO: 1081754 - RNA, 23 nt, Human
guccucaggagccucauuucccu

SEQ ID NO: 1081755 - RNA, 20 nt, Human
guggugcggggugcccugau

SEQ ID NO: 1081756 - RNA, 20 nt, Human
uaaggguagcuggugggggc

SEQ ID NO: 1081757 - RNA, 21 nt, Human
uacaaacugccaguguauggc

SEQ ID NO: 1081758 - RNA, 23 nt, Human
uacagaaagaaaaacugaggccc

SEQ ID NO: 1081759 - RNA, 20 nt, Human
uacaugugugcacgugugug

SEQ ID NO: 1081760 - RNA, 19 nt, Human
uagaauucaaacaaggggc

SEQ ID NO: 1081761 - RNA, 21 nt, Human
uagcaagguggacugaaaaaa

SEQ ID NO: 1081762 - RNA, 19 nt, Human
uauuacagagguuaaauca

SEQ ID NO: 1081763 - RNA, 19 nt, Human
ucauacuugcuggugggug

SEQ ID NO: 1081764 - RNA, 22 nt, Human
uccaaacgguggcucagcaaca

SEQ ID NO: 1081765 - RNA, 23 nt, Human
uccacaacgcgcgcucccccacc

SEQ ID NO: 1081766 - RNA, 19 nt, Human
uccucccauucaggcucca

SEQ ID NO: 1081767 - RNA, 21 nt, Human
uccugugcacgguggcuuggu

SEQ ID NO: 1081768 - RNA, 19 nt, Human
ucgacaugacuugcccaag

SEQ ID NO: 1081769 - RNA, 21 nt, Human
ucuagaaaaaugagaaggcuc

SEQ ID NO: 1081770 - RNA, 21 nt, Human
ucuggcaaagccagccccaaa

SEQ ID NO: 1081771 - RNA, 26 nt, Human
ucuuugaucauugcaaaggcagaagc

SEQ ID NO: 1081772 - RNA, 23 nt, Human
ugaaacauccucagaacacuucc

SEQ ID NO: 1081773 - RNA, 21 nt, Human
ugacacuuauccaagagugau

SEQ ID NO: 1081774 - RNA, 24 nt, Human
ugagaaccaaggugcggcauuugu

SEQ ID NO: 1081775 - RNA, 18 nt, Human
ugagagagaaccugcagg

SEQ ID NO: 1081776 - RNA, 19 nt, Human
ugcuggugggugugugggc

SEQ ID NO: 1081777 - RNA, 22 nt, Human
uggaugucacaaaacacacuga

SEQ ID NO: 1081778 - RNA, 23 nt, Human
uggcaaggguggaccccaggcau

SEQ ID NO: 1081779 - RNA, 18 nt, Human
uggcagggaagagggcug

SEQ ID NO: 1081780 - RNA, 19 nt, Human
uggcagggaagagggcugg

SEQ ID NO: 1081781 - RNA, 19 nt, Human
ugggaugaacaccaucguc

SEQ ID NO: 1081782 - RNA, 21 nt, Human
ugggcaugcuccgcuccucug

SEQ ID NO: 1081783 - RNA, 24 nt, Human
uggggcuguggaaacaggaggguu

SEQ ID NO: 1081784 - RNA, 19 nt, Human
uggggucacccacuguccc

SEQ ID NO: 1081785 - RNA, 22 nt, Human
uggugggugugugggcgggagu

SEQ ID NO: 1081786 - RNA, 22 nt, Human
uguacaugugugcacgugugug

SEQ ID NO: 1081787 - RNA, 19 nt, Human
ugucacaaaacacacugau

SEQ ID NO: 1081788 - RNA, 21 nt, Human
ugucauacuugcuggugggug

SEQ ID NO: 1081789 - RNA, 19 nt, Human
ugugcacgugugugugcau

SEQ ID NO: 1081790 - RNA, 22 nt, Human
ugugugcacgugugugugcaug

SEQ ID NO: 1081791 - RNA, 24 nt, Human
ugugugugcauguccaagauuccc

SEQ ID NO: 1081792 - RNA, 21 nt, Human
uucccuccugcuccccaaacg

SEQ ID NO: 1081793 - RNA, 20 nt, Human
uugcuggugggugugugggc

SEQ ID NO: 1081794 - RNA, 22 nt, Human
uuugcugagacccuuccugugc

SEQ ID NO: 1081795 - RNA, 19 nt, Human
auucuuguaggaauucuga

SEQ ID NO: 1081796 - RNA, 21 nt, Human
caggaucaauacccaugcugg

SEQ ID NO: 1081797 - RNA, 23 nt, Human
ccaagaaaucaguguaacucaga

SEQ ID NO: 1081798 - RNA, 22 nt, Human
cccucgguccagggcggcgguc

SEQ ID NO: 1081799 - RNA, 21 nt, Human
gaaaucaguguaacucagaua

SEQ ID NO: 1081800 - RNA, 22 nt, Human
gcggaccucagucagcuggggc

SEQ ID NO: 1081801 - RNA, 18 nt, Human
gguauugggaaggccuca

SEQ ID NO: 1081802 - RNA, 22 nt, Human
uaggaauucugacuuaagguuc

SEQ ID NO: 1081803 - RNA, 20 nt, Human
ucccucgguccagggcggcg

SEQ ID NO: 1081804 - RNA, 18 nt, Human
uugucagguauugggaag

SEQ ID NO: 1081805 - RNA, 19 nt, Human
aagagcuucuggagccuga

SEQ ID NO: 1081806 - RNA, 22 nt, Human
aagcugauuucagaggacggug

SEQ ID NO: 1081807 - RNA, 22 nt, Human
acagaacuugaugccaauguag

SEQ ID NO: 1081808 - RNA, 22 nt, Human
agacaauuucuucuacgacacc

SEQ ID NO: 1081809 - RNA, 23 nt, Human
agacacacgcucacacucacaca

SEQ ID NO: 1081810 - RNA, 22 nt, Human
aggcagggcggccgcgcacgca

SEQ ID NO: 1081811 - RNA, 19 nt, Human
cacacagacacacgcucac

SEQ ID NO: 1081812 - RNA, 24 nt, Human
caccuuggcuccuguagacaauuu

SEQ ID NO: 1081813 - RNA, 18 nt, Human
cccgcaucguagggaauc

SEQ ID NO: 1081814 - RNA, 21 nt, Human
ccgccgcugcccgcaggucgc

SEQ ID NO: 1081815 - RNA, 23 nt, Human
ccgccgcugcccgcaggucgcuc

SEQ ID NO: 1081816 - RNA, 24 nt, Human
ccgccgcugcccgcaggucgcucu

SEQ ID NO: 1081817 - RNA, 21 nt, Human
ccugccacugccgccgcugcc

SEQ ID NO: 1081818 - RNA, 22 nt, Human
ccugccacugccgccgcugccc

SEQ ID NO: 1081819 - RNA, 28 nt, Human
cgcacgcacacacagacacacgcucaca

SEQ ID NO: 1081820 - RNA, 22 nt, Human
cggcaagguggcuccagguggc

SEQ ID NO: 1081821 - RNA, 24 nt, Human
cuccugccacugccgccgcugccc

SEQ ID NO: 1081822 - RNA, 22 nt, Human
cugcagaagacggacagaguga

SEQ ID NO: 1081823 - RNA, 21 nt, Human
cuucuggagccugaagaguuc

SEQ ID NO: 1081824 - RNA, 20 nt, Human
gaaaagacggucguaggaag

SEQ ID NO: 1081825 - RNA, 20 nt, Human
gaaccauggucuaauggagc

SEQ ID NO: 1081826 - RNA, 18 nt, Human
gagaggagaaguggugcu

SEQ ID NO: 1081827 - RNA, 23 nt, Human
gaugaaccauggucuaauggagc

SEQ ID NO: 1081828 - RNA, 20 nt, Human
gcuccugccacugccgccgc

SEQ ID NO: 1081829 - RNA, 18 nt, Human
gggcagaggcagggcggc

SEQ ID NO: 1081830 - RNA, 21 nt, Human
guggcuccagguggcuuucac

SEQ ID NO: 1081831 - RNA, 21 nt, Human
uaagagcuucuggagccugaa

SEQ ID NO: 1081832 - RNA, 18 nt, Human
uacgacaccaguucaaca

SEQ ID NO: 1081833 - RNA, 26 nt, Human
ucaacaccuggaugaaugguuacagg

SEQ ID NO: 1081834 - RNA, 21 nt, Human
uccgcgcccggggagcgggca

SEQ ID NO: 1081835 - RNA, 21 nt, Human
uccugccacugccgccgcugc

SEQ ID NO: 1081836 - RNA, 23 nt, Human
ucgcugcccuuugccauagcuca

SEQ ID NO: 1081837 - RNA, 19 nt, Human
ugaaagcaucuccaaagcu

SEQ ID NO: 1081838 - RNA, 21 nt, Human
ugaaagcaucuccaaagcuga

SEQ ID NO: 1081839 - RNA, 21 nt, Human
ugcaaucgccccaugaaaccu

SEQ ID NO: 1081840 - RNA, 19 nt, Human
ugccauagcucagcacccg

SEQ ID NO: 1081841 - RNA, 19 nt, Human
uguaggcuuuuuuucuuuu

SEQ ID NO: 1081842 - RNA, 18 nt, Human
uucaagauucuacagucu

SEQ ID NO: 1081843 - RNA, 22 nt, Human
uucuucuacgacaccaguucaa

SEQ ID NO: 1081844 - RNA, 24 nt, Human
uugaugccaauguaggcuuuuuuu

SEQ ID NO: 1081845 - RNA, 26 nt, Human
uuucacagucguacgcgggucucgcu

SEQ ID NO: 1081846 - RNA, 24 nt, Human
uuuucaggagagagaggagaagug

SEQ ID NO: 1081847 - RNA, 25 nt, Human
uuuuucuuuuuuaaaaaaaaaauac

SEQ ID NO: 1081848 - RNA, 22 nt, Human
aaccgcagcggggcaacgagga

SEQ ID NO: 1081849 - RNA, 19 nt, Human
agaggcuguucucaacugg

SEQ ID NO: 1081850 - RNA, 22 nt, Human
augucaugcagaggcuguucuc

SEQ ID NO: 1081851 - RNA, 19 nt, Human
caauccuacccaacucagg

SEQ ID NO: 1081852 - RNA, 20 nt, Human
cagaggcuguucucaacugg

SEQ ID NO: 1081853 - RNA, 24 nt, Human
caugcagaggcuguucucaacugg

SEQ ID NO: 1081854 - RNA, 21 nt, Human
ccaauaaccuuaaugaccaag

SEQ ID NO: 1081855 - RNA, 21 nt, Human
cugacaucaaaacaguuccgu

SEQ ID NO: 1081856 - RNA, 19 nt, Human
gaggaugacuaaugugugc

SEQ ID NO: 1081857 - RNA, 24 nt, Human
gucaugcagaggcuguucucaacu

SEQ ID NO: 1081858 - RNA, 23 nt, Human
uacccaacucaggaaaguaaugc

SEQ ID NO: 1081859 - RNA, 18 nt, Human
ucauuuuagggcaauccu

SEQ ID NO: 1081860 - RNA, 20 nt, Human
uccaaaaucucuuucucacc

SEQ ID NO: 1081861 - RNA, 20 nt, Human
ugugcuguggucucgccugc

SEQ ID NO: 1081862 - RNA, 22 nt, Human
uucaaugccaauuuaaucacuu

SEQ ID NO: 1081863 - RNA, 22 nt, Human
uuccaaaaucucuuucucaccu

SEQ ID NO: 1081864 - RNA, 21 nt, Human
uucuugugggcgccauuuuua

SEQ ID NO: 1081865 - RNA, 22 nt, Human
uuuucaaaugcuuaaguuguag

SEQ ID NO: 1081866 - RNA, 21 nt, Human
aacgagagagcauaacagaaa

SEQ ID NO: 1081867 - RNA, 19 nt, Human
aagcaggaaaggagaucag

SEQ ID NO: 1081868 - RNA, 21 nt, Human
aagcaggaaaggagaucagag

SEQ ID NO: 1081869 - RNA, 20 nt, Human
aagcaggagucccugaugca

SEQ ID NO: 1081870 - RNA, 23 nt, Human
aaggaaugccuccggggacaggc

SEQ ID NO: 1081871 - RNA, 25 nt, Human
aauguguauuuauuauucaaauagc

SEQ ID NO: 1081872 - RNA, 23 nt, Human
aauguguuuaucccaggcagagc

SEQ ID NO: 1081873 - RNA, 18 nt, Human
acaaggccaacaagcauc

SEQ ID NO: 1081874 - RNA, 21 nt, Human
acagaaaaccuauagacaccu

SEQ ID NO: 1081875 - RNA, 21 nt, Human
acagauaccaccacacccgga

SEQ ID NO: 1081876 - RNA, 21 nt, Human
acagugccccaucauuuccga

SEQ ID NO: 1081877 - RNA, 23 nt, Human
accaccacacccggaaagagaua

SEQ ID NO: 1081878 - RNA, 22 nt, Human
acccuaauaaugggccuggguc

SEQ ID NO: 1081879 - RNA, 24 nt, Human
acccugacagcccccucccaggac

SEQ ID NO: 1081880 - RNA, 21 nt, Human
accuuggaaaaaucccauccc

SEQ ID NO: 1081881 - RNA, 18 nt, Human
acgagagagcauaacaga

SEQ ID NO: 1081882 - RNA, 23 nt, Human
agaaaaacaaccucaacugugaa

SEQ ID NO: 1081883 - RNA, 18 nt, Human
agacaaggccaacaagca

SEQ ID NO: 1081884 - RNA, 19 nt, Human
agaccagggccuuuggccu

SEQ ID NO: 1081885 - RNA, 19 nt, Human
agcacagcccuccccaggc

SEQ ID NO: 1081886 - RNA, 25 nt, Human
agcaggcuggcgggcucccccaggc

SEQ ID NO: 1081887 - RNA, 23 nt, Human
agccucgccugggaagccuuggc

SEQ ID NO: 1081888 - RNA, 19 nt, Human
agcgcccccuccccaacug

SEQ ID NO: 1081889 - RNA, 25 nt, Human
aggaauuccgcgguuccugcccggc

SEQ ID NO: 1081890 - RNA, 25 nt, Human
aggcagagcagccgcugaaagggga

SEQ ID NO: 1081891 - RNA, 18 nt, Human
aggcaggacaagaaggga

SEQ ID NO: 1081892 - RNA, 24 nt, Human
auagaggcaaccaguggaucuucu

SEQ ID NO: 1081893 - RNA, 18 nt, Human
aucccaucccugcuccag

SEQ ID NO: 1081894 - RNA, 18 nt, Human
auccccagggcucuccuu

SEQ ID NO: 1081895 - RNA, 18 nt, Human
auguaccuuggaaaaauc

SEQ ID NO: 1081896 - RNA, 19 nt, Human
auguguuuaucccaggcag

SEQ ID NO: 1081897 - RNA, 19 nt, Human
caaccagcccccuccccac

SEQ ID NO: 1081898 - RNA, 19 nt, Human
caacugugaaaagcagucc

SEQ ID NO: 1081899 - RNA, 19 nt, Human
caccaauggagcgaggagc

SEQ ID NO: 1081900 - RNA, 24 nt, Human
cacccugacagcccccucccagga

SEQ ID NO: 1081901 - RNA, 24 nt, Human
caccuggcugcugggugucaggcc

SEQ ID NO: 1081902 - RNA, 21 nt, Human
cagacccccagcucacagcca

SEQ ID NO: 1081903 - RNA, 23 nt, Human
cagacccccagcucacagccaca

SEQ ID NO: 1081904 - RNA, 18 nt, Human
cagcaggcuggcgggcuc

SEQ ID NO: 1081905 - RNA, 23 nt, Human
cagcauucuggaugguuuccugc

SEQ ID NO: 1081906 - RNA, 21 nt, Human
cagcccaaccucgcagaauga

SEQ ID NO: 1081907 - RNA, 18 nt, Human
cagcccccuccccacccg

SEQ ID NO: 1081908 - RNA, 18 nt, Human
cagcgcccccuccccaac

SEQ ID NO: 1081909 - RNA, 22 nt, Human
caggacagaaaaccuauagaca

SEQ ID NO: 1081910 - RNA, 19 nt, Human
caggacccgccgggugccc

SEQ ID NO: 1081911 - RNA, 22 nt, Human
caggcagagcagccgcugaaag

SEQ ID NO: 1081912 - RNA, 22 nt, Human
caggccagacccccagcucaca

SEQ ID NO: 1081913 - RNA, 20 nt, Human
caggcugcggcaaagacugu

SEQ ID NO: 1081914 - RNA, 24 nt, Human
cagguccugccgcuccccugccaa

SEQ ID NO: 1081915 - RNA, 21 nt, Human
cauccagcugggagaagagca

SEQ ID NO: 1081916 - RNA, 27 nt, Human
caucccugcuccaggcccaaauagagg

SEQ ID NO: 1081917 - RNA, 21 nt, Human
cauucuggaugguuuccugca

SEQ ID NO: 1081918 - RNA, 23 nt, Human
ccaaaucugaauuuuuuccggcc

SEQ ID NO: 1081919 - RNA, 19 nt, Human
ccaagggugugagcagaga

SEQ ID NO: 1081920 - RNA, 21 nt, Human
ccacauccccagggcucuccu

SEQ ID NO: 1081921 - RNA, 23 nt, Human
ccagccacagauaccaccacacc

SEQ ID NO: 1081922 - RNA, 19 nt, Human
cccaaccagcccccucccc

SEQ ID NO: 1081923 - RNA, 22 nt, Human
cccaaccagcccccuccccacc

SEQ ID NO: 1081924 - RNA, 23 nt, Human
cccaaccagcccccuccccaccc

SEQ ID NO: 1081925 - RNA, 22 nt, Human
cccacagaggagagacaaggcc

SEQ ID NO: 1081926 - RNA, 21 nt, Human
cccagcacagcccuccccagg

SEQ ID NO: 1081927 - RNA, 24 nt, Human
cccagggcucuccuucuuccccag

SEQ ID NO: 1081928 - RNA, 19 nt, Human
ccccacccggucccccuuc

SEQ ID NO: 1081929 - RNA, 19 nt, Human
ccccagcacagcccucccc

SEQ ID NO: 1081930 - RNA, 19 nt, Human
ccccagcacagcccucccc

SEQ ID NO: 1081931 - RNA, 21 nt, Human
ccccaugcuguagcacugucc

SEQ ID NO: 1081932 - RNA, 23 nt, Human
cccccagcucacagccacaucuc

SEQ ID NO: 1081933 - RNA, 18 nt, Human
cccccuucuauuuuuccu

SEQ ID NO: 1081934 - RNA, 20 nt, Human
ccccuccccacccggucccc

SEQ ID NO: 1081935 - RNA, 20 nt, Human
ccccuucuccuuggagcaag

SEQ ID NO: 1081936 - RNA, 19 nt, Human
cccgccgggugcccugugc

SEQ ID NO: 1081937 - RNA, 20 nt, Human
cccggccucgccauccagcc

SEQ ID NO: 1081938 - RNA, 23 nt, Human
cccggucccccuucuauuuuucc

SEQ ID NO: 1081939 - RNA, 26 nt, Human
cccggucccccuucuauuuuuccugg

SEQ ID NO: 1081940 - RNA, 19 nt, Human
cccuagaccccauguaccu

SEQ ID NO: 1081941 - RNA, 22 nt, Human
cccucaggacccgccgggugcc

SEQ ID NO: 1081942 - RNA, 18 nt, Human
ccgggugcccugugcugc

SEQ ID NO: 1081943 - RNA, 20 nt, Human
ccuauagacaccuggcugcu

SEQ ID NO: 1081944 - RNA, 22 nt, Human
ccuauagacaccuggcugcugg

SEQ ID NO: 1081945 - RNA, 23 nt, Human
ccucaggacccgccgggugcccu

SEQ ID NO: 1081946 - RNA, 22 nt, Human
ccuccuguccaagggugugagc

SEQ ID NO: 1081947 - RNA, 18 nt, Human
ccugcaagcuagcugccu

SEQ ID NO: 1081948 - RNA, 18 nt, Human
ccuugcacagggggcugu

SEQ ID NO: 1081949 - RNA, 21 nt, Human
cgcccccuccccaacuguuug

SEQ ID NO: 1081950 - RNA, 20 nt, Human
cgggacccugcaagcuagcu

SEQ ID NO: 1081951 - RNA, 23 nt, Human
cuaaaaccagccacagauaccac

SEQ ID NO: 1081952 - RNA, 24 nt, Human
cuaaaaccagccacagauaccacc

SEQ ID NO: 1081953 - RNA, 23 nt, Human
cucccccaggccuuggcaggucc

SEQ ID NO: 1081954 - RNA, 21 nt, Human
cuucucagcagccucuugccc

SEQ ID NO: 1081955 - RNA, 19 nt, Human
cuugccccaggaaagacca

SEQ ID NO: 1081956 - RNA, 18 nt, Human
cuuggcagguccugccgc

SEQ ID NO: 1081957 - RNA, 22 nt, Human
cuuuguuuuucugcuucuuuau

SEQ ID NO: 1081958 - RNA, 20 nt, Human
gaaaggagaucagaggagga

SEQ ID NO: 1081959 - RNA, 18 nt, Human
gaacucagcaggcuggcg

SEQ ID NO: 1081960 - RNA, 22 nt, Human
gacaagaagggagcagcccuga

SEQ ID NO: 1081961 - RNA, 20 nt, Human
gacagcccccucccaggaca

SEQ ID NO: 1081962 - RNA, 18 nt, Human
gacaggccagacccccag

SEQ ID NO: 1081963 - RNA, 19 nt, Human
gagaggcaggacaagaagg

SEQ ID NO: 1081964 - RNA, 24 nt, Human
gauucagccuucucugagaaccga

SEQ ID NO: 1081965 - RNA, 20 nt, Human
gauuuaugcccaucuucccc

SEQ ID NO: 1081966 - RNA, 26 nt, Human
gcacagcccuccccaggcugcggcaa

SEQ ID NO: 1081967 - RNA, 23 nt, Human
gcacuggguguuuuccugggguc

SEQ ID NO: 1081968 - RNA, 26 nt, Human
gcccgcuggcacaggggucugcagcc

SEQ ID NO: 1081969 - RNA, 21 nt, Human
gccgggugcccugugcugccc

SEQ ID NO: 1081970 - RNA, 21 nt, Human
gcggagggggcucugggcagg

SEQ ID NO: 1081971 - RNA, 23 nt, Human
gcugccuugcacagggggcuguc

SEQ ID NO: 1081972 - RNA, 21 nt, Human
ggaaaggagaucagaggagga

SEQ ID NO: 1081973 - RNA, 20 nt, Human
ggaggagaugguggcaaagc

SEQ ID NO: 1081974 - RNA, 21 nt, Human
ggaggagaugguggcaaagcg

SEQ ID NO: 1081975 - RNA, 22 nt, Human
ggccgagccuggucgaggcucc

SEQ ID NO: 1081976 - RNA, 22 nt, Human
ggccuuuggccucucgggaccc

SEQ ID NO: 1081977 - RNA, 18 nt, Human
ggcugcugggugucaggc

SEQ ID NO: 1081978 - RNA, 20 nt, Human
ggcuguguggggugcggagg

SEQ ID NO: 1081979 - RNA, 19 nt, Human
gggaucaaccgcaggcucu

SEQ ID NO: 1081980 - RNA, 21 nt, Human
gggcaucacccugacagcccc

SEQ ID NO: 1081981 - RNA, 18 nt, Human
ggggugcggagggggcuc

SEQ ID NO: 1081982 - RNA, 22 nt, Human
guagcacuguccaguuggcucu

SEQ ID NO: 1081983 - RNA, 20 nt, Human
uaaaagaaaaacaaccucaa

SEQ ID NO: 1081984 - RNA, 21 nt, Human
uaaauaaaagaaaaacaaccc

SEQ ID NO: 1081985 - RNA, 25 nt, Human
uaacagagacagcgcccccucccca

SEQ ID NO: 1081986 - RNA, 25 nt, Human
uacaguagaacucagcaggcuggcg

SEQ ID NO: 1081987 - RNA, 18 nt, Human
uaccuuggaaaaauccca

SEQ ID NO: 1081988 - RNA, 20 nt, Human
uagacaccuggcugcugggu

SEQ ID NO: 1081989 - RNA, 21 nt, Human
uagagaaaacgaagaucucac

SEQ ID NO: 1081990 - RNA, 21 nt, Human
uagcacuguccaguuggcucu

SEQ ID NO: 1081991 - RNA, 21 nt, Human
ucacccugacagcccccuccc

SEQ ID NO: 1081992 - RNA, 23 nt, Human
ucacccugacagcccccucccag

SEQ ID NO: 1081993 - RNA, 19 nt, Human
ucacuuaguccacggccac

SEQ ID NO: 1081994 - RNA, 19 nt, Human
ucagcaggcuggcgggcuc

SEQ ID NO: 1081995 - RNA, 20 nt, Human
ucauuuccgaaucaccaggc

SEQ ID NO: 1081996 - RNA, 20 nt, Human
uccagcugggagaagagcau

SEQ ID NO: 1081997 - RNA, 21 nt, Human
uccaggcccaaauagaggcaa

SEQ ID NO: 1081998 - RNA, 19 nt, Human
ucccaaccagcccccuccc

SEQ ID NO: 1081999 - RNA, 20 nt, Human
ucccaaccagcccccuccca

SEQ ID NO: 1082000 - RNA, 22 nt, Human
ucccaaccagcccccuccccac

SEQ ID NO: 1082001 - RNA, 21 nt, Human
uccccacccggucccccuucu

SEQ ID NO: 1082002 - RNA, 21 nt, Human
uccccagcacagcccucccca

SEQ ID NO: 1082003 - RNA, 21 nt, Human
uccccaggcugcggcaaagac

SEQ ID NO: 1082004 - RNA, 19 nt, Human
uccuuccagccuuuccucu

SEQ ID NO: 1082005 - RNA, 22 nt, Human
uccuuggagcaaggcugugugg

SEQ ID NO: 1082006 - RNA, 21 nt, Human
ucucccaaccagcccccuccc

SEQ ID NO: 1082007 - RNA, 22 nt, Human
ucuccuggcagaaguggccuga

SEQ ID NO: 1082008 - RNA, 21 nt, Human
ucucugaauccuugaggaccc

SEQ ID NO: 1082009 - RNA, 22 nt, Human
ucucugagaaccgagaagauuc

SEQ ID NO: 1082010 - RNA, 22 nt, Human
ucucugcaggcgggcaucaccc

SEQ ID NO: 1082011 - RNA, 20 nt, Human
ucuugccccaggaaagacca

SEQ ID NO: 1082012 - RNA, 21 nt, Human
ugaaaagcaguccaaaucuga

SEQ ID NO: 1082013 - RNA, 22 nt, Human
ugaaaagcaguccaaaucugaa

SEQ ID NO: 1082014 - RNA, 24 nt, Human
ugaaaggggagauggagagagaau

SEQ ID NO: 1082015 - RNA, 23 nt, Human
ugacccauggcuccggggaccag

SEQ ID NO: 1082016 - RNA, 21 nt, Human
ugaggugggagaagccgcaga

SEQ ID NO: 1082017 - RNA, 19 nt, Human
uggcagcacuugguggaga

SEQ ID NO: 1082018 - RNA, 23 nt, Human
uggcagcacuugguggagauuua

SEQ ID NO: 1082019 - RNA, 18 nt, Human
uggccacccccgccccag

SEQ ID NO: 1082020 - RNA, 22 nt, Human
uggccucucgggacccugcaag

SEQ ID NO: 1082021 - RNA, 22 nt, Human
uggccugaucucugccuucuca

SEQ ID NO: 1082022 - RNA, 20 nt, Human
uggcgggcucccccaggccu

SEQ ID NO: 1082023 - RNA, 22 nt, Human
uggcuaaaaccagccacagaua

SEQ ID NO: 1082024 - RNA, 20 nt, Human
ugggagaagagcauggucau

SEQ ID NO: 1082025 - RNA, 22 nt, Human
ugggagaagccgcagauugggg

SEQ ID NO: 1082026 - RNA, 18 nt, Human
uguccaguuggcucugac

SEQ ID NO: 1082027 - RNA, 21 nt, Human
ugugggggauguggcggggug

SEQ ID NO: 1082028 - RNA, 20 nt, Human
uguggggugcggagggggcu

SEQ ID NO: 1082029 - RNA, 21 nt, Human
uguguggggugcggagggggc

SEQ ID NO: 1082030 - RNA, 21 nt, Human
uguguuuaucccaggcagagc

SEQ ID NO: 1082031 - RNA, 21 nt, Human
uucaaguuaacagagacagcg

SEQ ID NO: 1082032 - RNA, 22 nt, Human
uuccggccugaguuaauuacac

SEQ ID NO: 1082033 - RNA, 23 nt, Human
uuccuggggucucuccacagugc

SEQ ID NO: 1082034 - RNA, 21 nt, Human
uuggcauguuuacugaucggg

SEQ ID NO: 1082035 - RNA, 19 nt, Human
uuggggguucucugaaucc

SEQ ID NO: 1082036 - RNA, 18 nt, Human
uuuccuggggucucucca

SEQ ID NO: 1082037 - RNA, 27 nt, Human
aaaacacugcucaggcgggcuuccccc

SEQ ID NO: 1082038 - RNA, 22 nt, Human
aaaccaaggacaauuccagaaa

SEQ ID NO: 1082039 - RNA, 22 nt, Human
aacaacaugaauuucccaagcc

SEQ ID NO: 1082040 - RNA, 21 nt, Human
aacauaauuuuucucaccacc

SEQ ID NO: 1082041 - RNA, 24 nt, Human
aaccaaauaggaaaaaaaaaaucc

SEQ ID NO: 1082042 - RNA, 24 nt, Human
aacugcccccuccucaacacaucc

SEQ ID NO: 1082043 - RNA, 26 nt, Human
aacuucuuuuuagggggccagguuuu

SEQ ID NO: 1082044 - RNA, 22 nt, Human
aagauguacaugagacgaaaug

SEQ ID NO: 1082045 - RNA, 20 nt, Human
aagcacacaaacaccauaug

SEQ ID NO: 1082046 - RNA, 20 nt, Human
aagccucaguacagucccag

SEQ ID NO: 1082047 - RNA, 20 nt, Human
acaaauaguaugcucccccu

SEQ ID NO: 1082048 - RNA, 23 nt, Human
acaauuccagaaauggcaaagaa

SEQ ID NO: 1082049 - RNA, 22 nt, Human
accaaauaggaaaaaaaaaauc

SEQ ID NO: 1082050 - RNA, 19 nt, Human
acccaggcuggagugcagu

SEQ ID NO: 1082051 - RNA, 23 nt, Human
acccaggcuggagugcaguggug

SEQ ID NO: 1082052 - RNA, 25 nt, Human
accccaagaaagugcagcuuggagu

SEQ ID NO: 1082053 - RNA, 23 nt, Human
acuccacuaccaaaaagggggaa

SEQ ID NO: 1082054 - RNA, 27 nt, Human
acuccacuaccaaaaagggggaaauaa

SEQ ID NO: 1082055 - RNA, 25 nt, Human
acucuggucugagaccagucuggga

SEQ ID NO: 1082056 - RNA, 20 nt, Human
acugcaagcuccgccucccg

SEQ ID NO: 1082057 - RNA, 20 nt, Human
agaaccccaagaaagugcag

SEQ ID NO: 1082058 - RNA, 22 nt, Human
agacagaacagagcacagcaaa

SEQ ID NO: 1082059 - RNA, 24 nt, Human
agacagaacagagcacagcaaacu

SEQ ID NO: 1082060 - RNA, 23 nt, Human
agagagcagcagacagaacagag

SEQ ID NO: 1082061 - RNA, 24 nt, Human
agagcacagcaaacugcccccucc

SEQ ID NO: 1082062 - RNA, 24 nt, Human
agagcagcugggaggaagccucau

SEQ ID NO: 1082063 - RNA, 24 nt, Human
agcagcugggaggaagccucaugg

SEQ ID NO: 1082064 - RNA, 22 nt, Human
aggcaaccagggcaucugagca

SEQ ID NO: 1082065 - RNA, 25 nt, Human
aggcuggagugcaguggugcgaucu

SEQ ID NO: 1082066 - RNA, 18 nt, Human
agucggggguggggggag

SEQ ID NO: 1082067 - RNA, 23 nt, Human
agugcagcuuggaguuuuggcuu

SEQ ID NO: 1082068 - RNA, 20 nt, Human
agugcaguggugcgaucucg

SEQ ID NO: 1082069 - RNA, 23 nt, Human
agugcaguggugcgaucucggcu

SEQ ID NO: 1082070 - RNA, 24 nt, Human
agugcaguggugcgaucucggcuc

SEQ ID NO: 1082071 - RNA, 22 nt, Human
auagagccauauuacacaugcu

SEQ ID NO: 1082072 - RNA, 20 nt, Human
auauuucugcaucuaugacc

SEQ ID NO: 1082073 - RNA, 20 nt, Human
auccuuacucuugcuggggg

SEQ ID NO: 1082074 - RNA, 19 nt, Human
auggacaauguagaaaaaa

SEQ ID NO: 1082075 - RNA, 21 nt, Human
auugucagguuuccuuuuuuu

SEQ ID NO: 1082076 - RNA, 24 nt, Human
caacuccacuaccaaaaaggggga

SEQ ID NO: 1082077 - RNA, 20 nt, Human
caauguagaaaaaagagguu

SEQ ID NO: 1082078 - RNA, 27 nt, Human
cacacaaacaccauaugaaaccaacag

SEQ ID NO: 1082079 - RNA, 23 nt, Human
cacacugaucccuugggccuggg

SEQ ID NO: 1082080 - RNA, 18 nt, Human
caccacuguuuugaccuc

SEQ ID NO: 1082081 - RNA, 24 nt, Human
cacccaggcuggagugcaguggug

SEQ ID NO: 1082082 - RNA, 19 nt, Human
caccucccaccuuacggca

SEQ ID NO: 1082083 - RNA, 19 nt, Human
caccuuguggaaaaucaau

SEQ ID NO: 1082084 - RNA, 22 nt, Human
cacgccguucuccugccucagc

SEQ ID NO: 1082085 - RNA, 22 nt, Human
cacgucuccacaguaaguuuug

SEQ ID NO: 1082086 - RNA, 21 nt, Human
cacugaucccuugggccuggg

SEQ ID NO: 1082087 - RNA, 24 nt, Human
cagaacagagcacagcaaacugcc

SEQ ID NO: 1082088 - RNA, 21 nt, Human
cagaaccccaagaaagugcag

SEQ ID NO: 1082089 - RNA, 22 nt, Human
cagcaaacugcccccuccucaa

SEQ ID NO: 1082090 - RNA, 21 nt, Human
cagcagacagaacagagcaca

SEQ ID NO: 1082091 - RNA, 19 nt, Human
cagcagagcagcugggagg

SEQ ID NO: 1082092 - RNA, 21 nt, Human
cagcuuggcucucaccacugu

SEQ ID NO: 1082093 - RNA, 19 nt, Human
caggucacagaagucagag

SEQ ID NO: 1082094 - RNA, 20 nt, Human
caggugcccccuacagccga

SEQ ID NO: 1082095 - RNA, 19 nt, Human
ccaagccaggcugauuucc

SEQ ID NO: 1082096 - RNA, 22 nt, Human
ccagaaccccaagaaagugcag

SEQ ID NO: 1082097 - RNA, 19 nt, Human
cccagagagagcagcagac

SEQ ID NO: 1082098 - RNA, 22 nt, Human
ccccaagaaagugcagcuugga

SEQ ID NO: 1082099 - RNA, 23 nt, Human
cccucucaacuccacuaccaaaa

SEQ ID NO: 1082100 - RNA, 22 nt, Human
ccuacagccgaggguccaaggc

SEQ ID NO: 1082101 - RNA, 28 nt, Human
ccuaugagcuaaggaaaaaccggggucc

SEQ ID NO: 1082102 - RNA, 19 nt, Human
ccucuuggccacaaaucug

SEQ ID NO: 1082103 - RNA, 23 nt, Human
ccucuugugggucagaggccagc

SEQ ID NO: 1082104 - RNA, 19 nt, Human
ccuggggguggaugccagg

SEQ ID NO: 1082105 - RNA, 24 nt, Human
ccuuuuguccuguaaagucagaga

SEQ ID NO: 1082106 - RNA, 19 nt, Human
cgccucccggguucacgcc

SEQ ID NO: 1082107 - RNA, 18 nt, Human
cggggguggggggaggug

SEQ ID NO: 1082108 - RNA, 23 nt, Human
cucccgaaauuaucaggcuucca

SEQ ID NO: 1082109 - RNA, 21 nt, Human
cucccggguucacgccguucu

SEQ ID NO: 1082110 - RNA, 19 nt, Human
cucucuggcaccacacuga

SEQ ID NO: 1082111 - RNA, 22 nt, Human
cucuuggccacaaaucugccuu

SEQ ID NO: 1082112 - RNA, 21 nt, Human
cucuuugccuauagucggggg

SEQ ID NO: 1082113 - RNA, 19 nt, Human
cugaucccuugggccuggg

SEQ ID NO: 1082114 - RNA, 18 nt, Human
cugccucagccucccgaa

SEQ ID NO: 1082115 - RNA, 24 nt, Human
cuugcucugucacccaggcuggag

SEQ ID NO: 1082116 - RNA, 24 nt, Human
cuuggaguuuuggcuuccuucccc

SEQ ID NO: 1082117 - RNA, 22 nt, Human
cuuguggaaaaucaaucagugu

SEQ ID NO: 1082118 - RNA, 24 nt, Human
cuuuauacaaauaguaugcucccc

SEQ ID NO: 1082119 - RNA, 19 nt, Human
gaaaaagauguacaugaga

SEQ ID NO: 1082120 - RNA, 23 nt, Human
gaauaaaaacauaauuuuucuca

SEQ ID NO: 1082121 - RNA, 18 nt, Human
gaccuagccagccaucca

SEQ ID NO: 1082122 - RNA, 21 nt, Human
gagcagcugggaggaagccuc

SEQ ID NO: 1082123 - RNA, 21 nt, Human
gagcuaaggaaaaaccaagga

SEQ ID NO: 1082124 - RNA, 18 nt, Human
gaguuuuggcuuccuucc

SEQ ID NO: 1082125 - RNA, 21 nt, Human
gauaacgugucaaguacaugc

SEQ ID NO: 1082126 - RNA, 19 nt, Human
gcaacccugugacucagag

SEQ ID NO: 1082127 - RNA, 21 nt, Human
gcacagcaaacugcccccucc

SEQ ID NO: 1082128 - RNA, 19 nt, Human
gcauggccagaaccccaag

SEQ ID NO: 1082129 - RNA, 19 nt, Human
gccagaaccccaagaaagu

SEQ ID NO: 1082130 - RNA, 25 nt, Human
gccucccggguucacgccguucucc

SEQ ID NO: 1082131 - RNA, 19 nt, Human
gcucucaccacuguuuuga

SEQ ID NO: 1082132 - RNA, 25 nt, Human
gcucugucacccaggcuggagugca

SEQ ID NO: 1082133 - RNA, 18 nt, Human
gcuuggaaacacggacag

SEQ ID NO: 1082134 - RNA, 22 nt, Human
ggagacggagucuugcucuguc

SEQ ID NO: 1082135 - RNA, 20 nt, Human
ggcaucugagcauaaccuga

SEQ ID NO: 1082136 - RNA, 21 nt, Human
ggccugaacucugaagugcug

SEQ ID NO: 1082137 - RNA, 22 nt, Human
gguuuccuuuuuuuuuuuuuuu

SEQ ID NO: 1082138 - RNA, 21 nt, Human
gugggguaccuuuuguccugu

SEQ ID NO: 1082139 - RNA, 21 nt, Human
guucuccugccucagccuccc

SEQ ID NO: 1082140 - RNA, 24 nt, Human
uaaguccuugagccagggccuaca

SEQ ID NO: 1082141 - RNA, 24 nt, Human
uacagcaucugggugucucaugaa

SEQ ID NO: 1082142 - RNA, 24 nt, Human
uacagccgaggguccaaggcaacc

SEQ ID NO: 1082143 - RNA, 22 nt, Human
uaccaaaaagggggaaauaaua

SEQ ID NO: 1082144 - RNA, 22 nt, Human
uaggcaaagcacacaaacacca

SEQ ID NO: 1082145 - RNA, 22 nt, Human
ucaacaacaugaauuucccaag

SEQ ID NO: 1082146 - RNA, 23 nt, Human
ucaagggucaguaauuuggggug

SEQ ID NO: 1082147 - RNA, 22 nt, Human
ucaaguacaugcugcccauacu

SEQ ID NO: 1082148 - RNA, 21 nt, Human
ucaccacuguuuugaccucug

SEQ ID NO: 1082149 - RNA, 24 nt, Human
ucacccaggcuggagugcaguggu

SEQ ID NO: 1082150 - RNA, 18 nt, Human
ucacugcaagcuccgccu

SEQ ID NO: 1082151 - RNA, 19 nt, Human
ucacugcaagcuccgccuc

SEQ ID NO: 1082152 - RNA, 24 nt, Human
ucacugcaagcuccgccucccggg

SEQ ID NO: 1082153 - RNA, 18 nt, Human
ucagcaagccagcagagc

SEQ ID NO: 1082154 - RNA, 22 nt, Human
ucagguuuccuuuuuuuuuuuu

SEQ ID NO: 1082155 - RNA, 22 nt, Human
uccacaguaaguuuugcaaggc

SEQ ID NO: 1082156 - RNA, 21 nt, Human
uccagaaauggcaaagaacac

SEQ ID NO: 1082157 - RNA, 21 nt, Human
ucccggguucacgccguucuc

SEQ ID NO: 1082158 - RNA, 24 nt, Human
ucccggguucacgccguucuccug

SEQ ID NO: 1082159 - RNA, 24 nt, Human
uccguuugguacugaugccuuucu

SEQ ID NO: 1082160 - RNA, 19 nt, Human
uccucaggccuugaaucua

SEQ ID NO: 1082161 - RNA, 21 nt, Human
uccuccaauguacgcacucuc

SEQ ID NO: 1082162 - RNA, 21 nt, Human
uccugccucagccucccgaaa

SEQ ID NO: 1082163 - RNA, 18 nt, Human
uccuuuuuuuuuuuuuuu

SEQ ID NO: 1082164 - RNA, 19 nt, Human
ucuccugccucagccuccc

SEQ ID NO: 1082165 - RNA, 19 nt, Human
ucuggucugagaccagucu

SEQ ID NO: 1082166 - RNA, 24 nt, Human
ucugucacccaggcuggagugcag

SEQ ID NO: 1082167 - RNA, 18 nt, Human
ucugugagcagcuuggcu

SEQ ID NO: 1082168 - RNA, 23 nt, Human
ucuugcucugucacccaggcugg

SEQ ID NO: 1082169 - RNA, 24 nt, Human
ucuugcucugucacccaggcugga

SEQ ID NO: 1082170 - RNA, 20 nt, Human
ugaccucugggauccuuacu

SEQ ID NO: 1082171 - RNA, 22 nt, Human
ugacucagagcuggcuucagca

SEQ ID NO: 1082172 - RNA, 22 nt, Human
ugauaauagagccucacauguc

SEQ ID NO: 1082173 - RNA, 19 nt, Human
ugcaaacggacguggggca

SEQ ID NO: 1082174 - RNA, 22 nt, Human
ugcacuuaaaccaucuucaggc

SEQ ID NO: 1082175 - RNA, 22 nt, Human
ugcaguggugcgaucucggcuc

SEQ ID NO: 1082176 - RNA, 18 nt, Human
ugccacaaacucuggucu

SEQ ID NO: 1082177 - RNA, 22 nt, Human
ugcggacauugugcggccccca

SEQ ID NO: 1082178 - RNA, 24 nt, Human
ugcucugucacccaggcuggagug

SEQ ID NO: 1082179 - RNA, 19 nt, Human
ugcugaccugaugcuaacg

SEQ ID NO: 1082180 - RNA, 20 nt, Human
uggaagugaucaacucucuu

SEQ ID NO: 1082181 - RNA, 23 nt, Human
uggagugcaguggugcgaucucg

SEQ ID NO: 1082182 - RNA, 24 nt, Human
uggagugcaguggugcgaucucgg

SEQ ID NO: 1082183 - RNA, 25 nt, Human
uggcaaagaacacuuaagaaaaaga

SEQ ID NO: 1082184 - RNA, 27 nt, Human
uggcauggcuguggcaucaagugggug

SEQ ID NO: 1082185 - RNA, 21 nt, Human
uggccagaaccccaagaaagu

SEQ ID NO: 1082186 - RNA, 20 nt, Human
uggcuguggcaucaaguggg

SEQ ID NO: 1082187 - RNA, 22 nt, Human
uggcuguggcaucaagugggug

SEQ ID NO: 1082188 - RNA, 18 nt, Human
ugggaggaagccucaugg

SEQ ID NO: 1082189 - RNA, 20 nt, Human
ugggaggaagccucauggca

SEQ ID NO: 1082190 - RNA, 21 nt, Human
ugggccugaacucugaagugc

SEQ ID NO: 1082191 - RNA, 21 nt, Human
ugucugaagggccugcacuua

SEQ ID NO: 1082192 - RNA, 25 nt, Human
ugugaagacaugaacuugaacucug

SEQ ID NO: 1082193 - RNA, 23 nt, Human
ugugggagguuugcuuugccugc

SEQ ID NO: 1082194 - RNA, 19 nt, Human
uucccaucaagccucagua

SEQ ID NO: 1082195 - RNA, 21 nt, Human
uuccugugccacaaacucugg

SEQ ID NO: 1082196 - RNA, 21 nt, Human
uuccuuccccaccgcuugggu

SEQ ID NO: 1082197 - RNA, 24 nt, Human
uugccaggaccugcugggccugaa

SEQ ID NO: 1082198 - RNA, 24 nt, Human
uugcucugucacccaggcuggagu

SEQ ID NO: 1082199 - RNA, 22 nt, Human
uuuuagggggccagguuuuccu

SEQ ID NO: 1082200 - RNA, 18 nt, Human
uuuuccucaaauccucag

SEQ ID NO: 1082201 - RNA, 25 nt, Human
uuuuuuuuuuugggagacggagucu

SEQ ID NO: 1082202 - RNA, 24 nt, Human
uuuuuuuuuuuuuuuuuuuuuggg

SEQ ID NO: 1082203 - RNA, 19 nt, Human
aaauuccacagagccacag

SEQ ID NO: 1082204 - RNA, 24 nt, Human
aaccaaauaggaaaaaaaaaaucc

SEQ ID NO: 1082205 - RNA, 20 nt, Human
aagcacacaaacaccauaug

SEQ ID NO: 1082206 - RNA, 18 nt, Human
aaugagaacuaccucuac

SEQ ID NO: 1082207 - RNA, 25 nt, Human
acaaaaggcacuucaaaauuccaca

SEQ ID NO: 1082208 - RNA, 23 nt, Human
acacaaaacagaaagacacacag

SEQ ID NO: 1082209 - RNA, 23 nt, Human
acacaggagccuggcuccugcag

SEQ ID NO: 1082210 - RNA, 22 nt, Human
accaaauaggaaaaaaaaaauc

SEQ ID NO: 1082211 - RNA, 19 nt, Human
acccaggcuggagugcagu

SEQ ID NO: 1082212 - RNA, 23 nt, Human
acccaggcuggagugcaguggug

SEQ ID NO: 1082213 - RNA, 22 nt, Human
acgcuggggcuacucaacccga

SEQ ID NO: 1082214 - RNA, 22 nt, Human
acuccacuaccaaaaaggggga

SEQ ID NO: 1082215 - RNA, 27 nt, Human
acuccacuaccaaaaagggggaaauaa

SEQ ID NO: 1082216 - RNA, 20 nt, Human
acugcaagcuccgccucccg

SEQ ID NO: 1082217 - RNA, 19 nt, Human
agaaacaugcauuuauuuc

SEQ ID NO: 1082218 - RNA, 23 nt, Human
agaagcucuaagacaaugggcua

SEQ ID NO: 1082219 - RNA, 23 nt, Human
agacaggaaaggacagaagggac

SEQ ID NO: 1082220 - RNA, 24 nt, Human
agagacaggaaaggacagaagaga

SEQ ID NO: 1082221 - RNA, 18 nt, Human
agagggacuucauccaca

SEQ ID NO: 1082222 - RNA, 22 nt, Human
agagguacucauugagcagaau

SEQ ID NO: 1082223 - RNA, 19 nt, Human
agcacaauguugggcaaag

SEQ ID NO: 1082224 - RNA, 27 nt, Human
aggaaaggacagaagagaugaccaaag

SEQ ID NO: 1082225 - RNA, 21 nt, Human
aggagccuggcuccugcaggc

SEQ ID NO: 1082226 - RNA, 25 nt, Human
aggcuggagugcaguggugcgaucu

SEQ ID NO: 1082227 - RNA, 21 nt, Human
aggcuuccaauuccaaaacuu

SEQ ID NO: 1082228 - RNA, 20 nt, Human
agugcaguggugcgaucucg

SEQ ID NO: 1082229 - RNA, 23 nt, Human
agugcaguggugcgaucucggcu

SEQ ID NO: 1082230 - RNA, 24 nt, Human
agugcaguggugcgaucucggcuc

SEQ ID NO: 1082231 - RNA, 20 nt, Human
auaaaguauucucaagucug

SEQ ID NO: 1082232 - RNA, 21 nt, Human
auagaaaacaacaucuuguua

SEQ ID NO: 1082233 - RNA, 20 nt, Human
auccucaggccuugaaucua

SEQ ID NO: 1082234 - RNA, 25 nt, Human
caaaggcacccccaagggaucaagg

SEQ ID NO: 1082235 - RNA, 24 nt, Human
caacuccacuaccaaaaaggggga

SEQ ID NO: 1082236 - RNA, 27 nt, Human
cacacaaacaccauaugaaaccaacag

SEQ ID NO: 1082237 - RNA, 21 nt, Human
cacacaguauguuugcacuuu

SEQ ID NO: 1082238 - RNA, 24 nt, Human
cacccaggcuggagugcaguggug

SEQ ID NO: 1082239 - RNA, 22 nt, Human
cacgccguucuccugccucagc

SEQ ID NO: 1082240 - RNA, 18 nt, Human
cagggccaggcuccagug

SEQ ID NO: 1082241 - RNA, 22 nt, Human
caguggggagggaagguguggg

SEQ ID NO: 1082242 - RNA, 19 nt, Human
caguuccaucaaacuaccc

SEQ ID NO: 1082243 - RNA, 30 nt, Human
caguuccaucaaacuacccaagggguaacu

SEQ ID NO: 1082244 - RNA, 20 nt, Human
cauggcucucggggcugcca

SEQ ID NO: 1082245 - RNA, 24 nt, Human
cccucggcacugaagaccuccacc

SEQ ID NO: 1082246 - RNA, 23 nt, Human
cccucucaacuccacuaccaaaa

SEQ ID NO: 1082247 - RNA, 24 nt, Human
ccuggcuuacccagaaaacagcug

SEQ ID NO: 1082248 - RNA, 19 nt, Human
cgccucccggguucacgcc

SEQ ID NO: 1082249 - RNA, 23 nt, Human
cucacaaggcaggcauccauaga

SEQ ID NO: 1082250 - RNA, 23 nt, Human
cucccgaaauuaucaggcuucca

SEQ ID NO: 1082251 - RNA, 21 nt, Human
cucccggguucacgccguucu

SEQ ID NO: 1082252 - RNA, 18 nt, Human
cuccugcaggccauggca

SEQ ID NO: 1082253 - RNA, 21 nt, Human
cucucuccugacugccagaua

SEQ ID NO: 1082254 - RNA, 19 nt, Human
cucugcggugggcccuugg

SEQ ID NO: 1082255 - RNA, 18 nt, Human
cugccucagccucccgaa

SEQ ID NO: 1082256 - RNA, 18 nt, Human
cugucacccaggcuggag

SEQ ID NO: 1082257 - RNA, 24 nt, Human
cuuuauacaaauaguaugcucccc

SEQ ID NO: 1082258 - RNA, 25 nt, Human
gccucccggguucacgccguucucc

SEQ ID NO: 1082259 - RNA, 25 nt, Human
gcucugucacccaggcuggagugca

SEQ ID NO: 1082260 - RNA, 22 nt, Human
ggagacggagucuugcucuguc

SEQ ID NO: 1082261 - RNA, 23 nt, Human
ggcacagaggaagagggacuuca

SEQ ID NO: 1082262 - RNA, 18 nt, Human
gggguaacagauucugga

SEQ ID NO: 1082263 - RNA, 24 nt, Human
guguuucaccugauggggucccug

SEQ ID NO: 1082264 - RNA, 21 nt, Human
guucuccugccucagccuccc

SEQ ID NO: 1082265 - RNA, 19 nt, Human
uaaaguauucucaagucug

SEQ ID NO: 1082266 - RNA, 19 nt, Human
uaaauucuaaccacaagca

SEQ ID NO: 1082267 - RNA, 20 nt, Human
uaacacagccacgcuggggc

SEQ ID NO: 1082268 - RNA, 21 nt, Human
uaacacagccacgcuggggcu

SEQ ID NO: 1082269 - RNA, 22 nt, Human
uaacacagccacgcuggggcua

SEQ ID NO: 1082270 - RNA, 20 nt, Human
uacacaaaacagaaagacac

SEQ ID NO: 1082271 - RNA, 22 nt, Human
uaccaaaaagggggaaauaaua

SEQ ID NO: 1082272 - RNA, 22 nt, Human
uaggcaaagcacacaaacacca

SEQ ID NO: 1082273 - RNA, 23 nt, Human
uauacaaauaguaugcucccccu

SEQ ID NO: 1082274 - RNA, 24 nt, Human
uaucauggcaguuuauaaaguauu

SEQ ID NO: 1082275 - RNA, 21 nt, Human
ucaaggcacagaggaagaggg

SEQ ID NO: 1082276 - RNA, 24 nt, Human
ucacccaggcuggagugcaguggu

SEQ ID NO: 1082277 - RNA, 24 nt, Human
ucaccugauggggucccuggccau

SEQ ID NO: 1082278 - RNA, 18 nt, Human
ucacugcaagcuccgccu

SEQ ID NO: 1082279 - RNA, 19 nt, Human
ucacugcaagcuccgccuc

SEQ ID NO: 1082280 - RNA, 24 nt, Human
ucacugcaagcuccgccucccggg

SEQ ID NO: 1082281 - RNA, 22 nt, Human
ucauugagcagaauuuucuaau

SEQ ID NO: 1082282 - RNA, 22 nt, Human
uccacagagccacagggucacu

SEQ ID NO: 1082283 - RNA, 22 nt, Human
uccccauagcauaggugugcuc

SEQ ID NO: 1082284 - RNA, 21 nt, Human
ucccggguucacgccguucuc

SEQ ID NO: 1082285 - RNA, 24 nt, Human
ucccggguucacgccguucuccug

SEQ ID NO: 1082286 - RNA, 21 nt, Human
uccugccucagccucccgaaa

SEQ ID NO: 1082287 - RNA, 19 nt, Human
ucuccugccucagccuccc

SEQ ID NO: 1082288 - RNA, 22 nt, Human
ucucggggcugccagcagggcu

SEQ ID NO: 1082289 - RNA, 24 nt, Human
ucugucacccaggcuggagugcag

SEQ ID NO: 1082290 - RNA, 22 nt, Human
ucuugcucugucacccaggcug

SEQ ID NO: 1082291 - RNA, 23 nt, Human
ucuugcucugucacccaggcugg

SEQ ID NO: 1082292 - RNA, 24 nt, Human
ucuugcucugucacccaggcugga

SEQ ID NO: 1082293 - RNA, 19 nt, Human
ugauggggucccuggccau

SEQ ID NO: 1082294 - RNA, 22 nt, Human
ugcaguggugcgaucucggcuc

SEQ ID NO: 1082295 - RNA, 23 nt, Human
ugcccagguccaagucaaagaac

SEQ ID NO: 1082296 - RNA, 25 nt, Human
ugccucagccucccgaaauuaucag

SEQ ID NO: 1082297 - RNA, 24 nt, Human
ugcucugucacccaggcuggagug

SEQ ID NO: 1082298 - RNA, 21 nt, Human
uggagaagcucuaagacaaug

SEQ ID NO: 1082299 - RNA, 23 nt, Human
uggagugcaguggugcgaucucg

SEQ ID NO: 1082300 - RNA, 24 nt, Human
uggagugcaguggugcgaucucgg

SEQ ID NO: 1082301 - RNA, 22 nt, Human
uggccauuuguaaauaaaucuc

SEQ ID NO: 1082302 - RNA, 22 nt, Human
uuaauccucaagacaauggacu

SEQ ID NO: 1082303 - RNA, 25 nt, Human
uuaauccucaagacaauggacucac

SEQ ID NO: 1082304 - RNA, 22 nt, Human
uuacagaaguuaacucugcaga

SEQ ID NO: 1082305 - RNA, 25 nt, Human
uuccacagagccacagggucacugu

SEQ ID NO: 1082306 - RNA, 19 nt, Human
uuccaucaaacuacccaag

SEQ ID NO: 1082307 - RNA, 25 nt, Human
uugaccuaagauccaacauuauaau

SEQ ID NO: 1082308 - RNA, 24 nt, Human
uugcucugucacccaggcuggagu

SEQ ID NO: 1082309 - RNA, 18 nt, Human
uuuuccucaaauccucag

SEQ ID NO: 1082310 - RNA, 24 nt, Human
aaaaucccagcucagugcaggaga

SEQ ID NO: 1082311 - RNA, 24 nt, Human
aaagacaaaggcgagaacagggac

SEQ ID NO: 1082312 - RNA, 22 nt, Human
aaagacauaguacuccccaugc

SEQ ID NO: 1082313 - RNA, 19 nt, Human
aaagauugaguauuuucag

SEQ ID NO: 1082314 - RNA, 22 nt, Human
aaagcaagcccaacagaagucu

SEQ ID NO: 1082315 - RNA, 24 nt, Human
aaccuggccaacguggugaaaccc

SEQ ID NO: 1082316 - RNA, 20 nt, Human
aacguggugaaacccccucu

SEQ ID NO: 1082317 - RNA, 21 nt, Human
aacguggugaaacccccucuc

SEQ ID NO: 1082318 - RNA, 18 nt, Human
aagcagaaagaggaaaca

SEQ ID NO: 1082319 - RNA, 18 nt, Human
aagcagaaagaggaaaca

SEQ ID NO: 1082320 - RNA, 20 nt, Human
aagcagaaagaggaaacagu

SEQ ID NO: 1082321 - RNA, 21 nt, Human
aagcagaaagaggaaacagug

SEQ ID NO: 1082322 - RNA, 22 nt, Human
aagcagaaagaggaaacagugg

SEQ ID NO: 1082323 - RNA, 23 nt, Human
aagcagaaagaggaaacaguggg

SEQ ID NO: 1082324 - RNA, 20 nt, Human
aagcagaucauaugccaaaa

SEQ ID NO: 1082325 - RNA, 19 nt, Human
aagccaaagaguacucuuc

SEQ ID NO: 1082326 - RNA, 24 nt, Human
aagccaaagaguacucuuccucag

SEQ ID NO: 1082327 - RNA, 21 nt, Human
aaggaucaugaccuaccaaug

SEQ ID NO: 1082328 - RNA, 18 nt, Human
aaguucacaggagaccaa

SEQ ID NO: 1082329 - RNA, 23 nt, Human
aaucauugcuaauuagaagcaga

SEQ ID NO: 1082330 - RNA, 24 nt, Human
aaucguuugaacccgggaggcaga

SEQ ID NO: 1082331 - RNA, 22 nt, Human
acacagcucagugcaggagacc

SEQ ID NO: 1082332 - RNA, 22 nt, Human
acacagcucagugcaggagacc

SEQ ID NO: 1082333 - RNA, 22 nt, Human
acacagcucaguucaggagacc

SEQ ID NO: 1082334 - RNA, 23 nt, Human
acacagcucaguucaggagacca

SEQ ID NO: 1082335 - RNA, 22 nt, Human
acacagggaaacuagagugcag

SEQ ID NO: 1082336 - RNA, 19 nt, Human
acaccaagcccacacaggg

SEQ ID NO: 1082337 - RNA, 18 nt, Human
acacuacaggccaggcac

SEQ ID NO: 1082338 - RNA, 18 nt, Human
acaguggcccuguugggg

SEQ ID NO: 1082339 - RNA, 21 nt, Human
accagggugccagggaggguc

SEQ ID NO: 1082340 - RNA, 21 nt, Human
accagugugccaggaaggguc

SEQ ID NO: 1082341 - RNA, 24 nt, Human
acccccucucuacuaaaaauacaa

SEQ ID NO: 1082342 - RNA, 24 nt, Human
accgacaccaagcccacacaggga

SEQ ID NO: 1082343 - RNA, 23 nt, Human
acugaaagacaaaggcgagaaca

SEQ ID NO: 1082344 - RNA, 21 nt, Human
agaaaugcgugcuccuauguc

SEQ ID NO: 1082345 - RNA, 21 nt, Human
agaauucuacguuuccuucag

SEQ ID NO: 1082346 - RNA, 24 nt, Human
agcacuuugggaggcugaggcggg

SEQ ID NO: 1082347 - RNA, 19 nt, Human
agccaaagaguacucuucc

SEQ ID NO: 1082348 - RNA, 24 nt, Human
agcgccccuccacucucaccccua

SEQ ID NO: 1082349 - RNA, 22 nt, Human
aggaaaagcaagcccaacagaa

SEQ ID NO: 1082350 - RNA, 22 nt, Human
aggaaaagcgaggccgacagaa

SEQ ID NO: 1082351 - RNA, 19 nt, Human
aggaacccuuuccugccgg

SEQ ID NO: 1082352 - RNA, 20 nt, Human
aggaagggcuggagcuucag

SEQ ID NO: 1082353 - RNA, 24 nt, Human
aggcacaguggcucacgccuguaa

SEQ ID NO: 1082354 - RNA, 19 nt, Human
aggcagaaguugcagugag

SEQ ID NO: 1082355 - RNA, 21 nt, Human
aggcagaaguugcagugagcc

SEQ ID NO: 1082356 - RNA, 19 nt, Human
aggccuucucuuuucccug

SEQ ID NO: 1082357 - RNA, 24 nt, Human
aggcgggcgaaucacgacgucaag

SEQ ID NO: 1082358 - RNA, 21 nt, Human
aggcugaggcgggcgaaucac

SEQ ID NO: 1082359 - RNA, 24 nt, Human
aggcugagguaggagaaucguuug

SEQ ID NO: 1082360 - RNA, 18 nt, Human
agggguguugggugccag

SEQ ID NO: 1082361 - RNA, 24 nt, Human
agguaggagaaucguuugaacccg

SEQ ID NO: 1082362 - RNA, 22 nt, Human
agucaggaagggucagagcuuc

SEQ ID NO: 1082363 - RNA, 18 nt, Human
agugcaggagaucagggc

SEQ ID NO: 1082364 - RNA, 24 nt, Human
aguggcucacgccuguaaucccag

SEQ ID NO: 1082365 - RNA, 23 nt, Human
auaaguauuaaguagucugcacc

SEQ ID NO: 1082366 - RNA, 20 nt, Human
aucacugacccaacccaggg

SEQ ID NO: 1082367 - RNA, 25 nt, Human
auggugccacugcauuccaaccccu

SEQ ID NO: 1082368 - RNA, 21 nt, Human
auuguauuuuaagagagaaag

SEQ ID NO: 1082369 - RNA, 25 nt, Human
caacaagccaaagaguacucuuccu

SEQ ID NO: 1082370 - RNA, 24 nt, Human
caacguggugaaacccccucucua

SEQ ID NO: 1082371 - RNA, 22 nt, Human
caagcccacacagggaaacuag

SEQ ID NO: 1082372 - RNA, 19 nt, Human
cacaacaggccaaagagug

SEQ ID NO: 1082373 - RNA, 21 nt, Human
cacaacaggccaaagagugcu

SEQ ID NO: 1082374 - RNA, 22 nt, Human
caccaggaaaggcuggagcuuc

SEQ ID NO: 1082375 - RNA, 22 nt, Human
caccaggaagggcuggagcuuc

SEQ ID NO: 1082376 - RNA, 23 nt, Human
caccccccuucccgcacaugcau

SEQ ID NO: 1082377 - RNA, 24 nt, Human
caccugggugaugggcacuggcuc

SEQ ID NO: 1082378 - RNA, 19 nt, Human
caccugggugcugucaacc

SEQ ID NO: 1082379 - RNA, 24 nt, Human
cacgccuguaaucccagcacuuug

SEQ ID NO: 1082380 - RNA, 19 nt, Human
cacgcuugcucccccucca

SEQ ID NO: 1082381 - RNA, 26 nt, Human
cacuacaggccaggcacaguggcuca

SEQ ID NO: 1082382 - RNA, 19 nt, Human
cacuaugccagucaaugcc

SEQ ID NO: 1082383 - RNA, 27 nt, Human
cacuggcccaggaaaagcgaggccgac

SEQ ID NO: 1082384 - RNA, 23 nt, Human
cacugggggauuagcaccaggcu

SEQ ID NO: 1082385 - RNA, 24 nt, Human
cagcacuuugggaggcugaggcgg

SEQ ID NO: 1082386 - RNA, 24 nt, Human
cagcauccuuuuccaaaauucucc

SEQ ID NO: 1082387 - RNA, 21 nt, Human
cagcuacuugggaggcugagg

SEQ ID NO: 1082388 - RNA, 26 nt, Human
caggaaggagccaucaacauucccug

SEQ ID NO: 1082389 - RNA, 20 nt, Human
caggagccgagggcacuagg

SEQ ID NO: 1082390 - RNA, 23 nt, Human
caggccaggcacaguggcucacg

SEQ ID NO: 1082391 - RNA, 22 nt, Human
cagggcaccaggaagggcugga

SEQ ID NO: 1082392 - RNA, 21 nt, Human
cagugagaccaagaacccacc

SEQ ID NO: 1082393 - RNA, 20 nt, Human
cagugcaagagaccagggaa

SEQ ID NO: 1082394 - RNA, 21 nt, Human
cagugccaggcaguugagugg

SEQ ID NO: 1082395 - RNA, 23 nt, Human
caucgggggcugggaaccuggcu

SEQ ID NO: 1082396 - RNA, 23 nt, Human
caucggggguugggaaccuggcu

SEQ ID NO: 1082397 - RNA, 21 nt, Human
caucuaggggaacagguggag

SEQ ID NO: 1082398 - RNA, 24 nt, Human
caucuguagucccagcuacuuggg

SEQ ID NO: 1082399 - RNA, 20 nt, Human
caugaauuaguucacacacu

SEQ ID NO: 1082400 - RNA, 19 nt, Human
cauguggccugggcagucc

SEQ ID NO: 1082401 - RNA, 19 nt, Human
cauguggccugggcagucc

SEQ ID NO: 1082402 - RNA, 18 nt, Human
ccaaacagauaucugggu

SEQ ID NO: 1082403 - RNA, 21 nt, Human
ccaacacagacgcagagcauc

SEQ ID NO: 1082404 - RNA, 23 nt, Human
ccaagcccacacagggaaacuag

SEQ ID NO: 1082405 - RNA, 21 nt, Human
ccacugcauuccaaccccugu

SEQ ID NO: 1082406 - RNA, 22 nt, Human
ccacugcauuccaaccccuguc

SEQ ID NO: 1082407 - RNA, 23 nt, Human
ccagcauccuuuuccaaaauucu

SEQ ID NO: 1082408 - RNA, 22 nt, Human
ccagcccgcugaguuucagcug

SEQ ID NO: 1082409 - RNA, 20 nt, Human
ccaggaagggucugagcuuc

SEQ ID NO: 1082410 - RNA, 20 nt, Human
ccaggaggacccccuuggca

SEQ ID NO: 1082411 - RNA, 20 nt, Human
ccaggcucaccaucuaugcc

SEQ ID NO: 1082412 - RNA, 25 nt, Human
ccagugugccaggaagggucagagu

SEQ ID NO: 1082413 - RNA, 22 nt, Human
ccaugaagaacacugauccaac

SEQ ID NO: 1082414 - RNA, 22 nt, Human
ccauguggagaaagggguguug

SEQ ID NO: 1082415 - RNA, 21 nt, Human
cccacacagggaaacuagagu

SEQ ID NO: 1082416 - RNA, 18 nt, Human
ccccuacacacacccaga

SEQ ID NO: 1082417 - RNA, 22 nt, Human
ccccuucccgcacaugcaucca

SEQ ID NO: 1082418 - RNA, 22 nt, Human
cccuacacacacccagaggcaa

SEQ ID NO: 1082419 - RNA, 24 nt, Human
ccgacaccaagcccacacagggaa

SEQ ID NO: 1082420 - RNA, 20 nt, Human
ccggacacacugggaccagc

SEQ ID NO: 1082421 - RNA, 19 nt, Human
ccugccgggaccaccauca

SEQ ID NO: 1082422 - RNA, 22 nt, Human
ccuggaugauggacacuggccc

SEQ ID NO: 1082423 - RNA, 18 nt, Human
ccuggccaacguggugaa

SEQ ID NO: 1082424 - RNA, 23 nt, Human
ccuggccaacguggugaaacccc

SEQ ID NO: 1082425 - RNA, 22 nt, Human
ccugggugaugggcacuggcuc

SEQ ID NO: 1082426 - RNA, 18 nt, Human
ccugggugcugucaacug

SEQ ID NO: 1082427 - RNA, 19 nt, Human
ccuucaggcccaacugaag

SEQ ID NO: 1082428 - RNA, 23 nt, Human
ccuuccggacauuugguacaguc

SEQ ID NO: 1082429 - RNA, 18 nt, Human
cgacaccaagcccacaca

SEQ ID NO: 1082430 - RNA, 19 nt, Human
cgagaccaaccuggccaac

SEQ ID NO: 1082431 - RNA, 23 nt, Human
cgaggccugaccagccuuccaag

SEQ ID NO: 1082432 - RNA, 22 nt, Human
cgccaggaagggcuggagcuuc

SEQ ID NO: 1082433 - RNA, 22 nt, Human
cgccaggaagggcuggagcuuc

SEQ ID NO: 1082434 - RNA, 23 nt, Human
cgccuguaaucccagcacuuugg

SEQ ID NO: 1082435 - RNA, 24 nt, Human
cgccuguaaucccagcacuuuggg

SEQ ID NO: 1082436 - RNA, 24 nt, Human
cgggaggcagaaguugcagugagc

SEQ ID NO: 1082437 - RNA, 22 nt, Human
cgggcgaaucacgacgucaaga

SEQ ID NO: 1082438 - RNA, 20 nt, Human
cuaauacuaaaacuccaagu

SEQ ID NO: 1082439 - RNA, 23 nt, Human
cuaccagggcuuagcgccccucc

SEQ ID NO: 1082440 - RNA, 20 nt, Human
cuacuguuacuguucccugu

SEQ ID NO: 1082441 - RNA, 23 nt, Human
cuagugcaggagaccagggugug

SEQ ID NO: 1082442 - RNA, 22 nt, Human
cucacgccuguaaucccagcac

SEQ ID NO: 1082443 - RNA, 24 nt, Human
cucacgccuguaaucccagcacuu

SEQ ID NO: 1082444 - RNA, 22 nt, Human
cucacuggauauggucaucaca

SEQ ID NO: 1082445 - RNA, 22 nt, Human
cuccaggcucaccaucuaugcc

SEQ ID NO: 1082446 - RNA, 22 nt, Human
cuccagucucaucaucuauguc

SEQ ID NO: 1082447 - RNA, 21 nt, Human
cucccccaggcugggccucag

SEQ ID NO: 1082448 - RNA, 22 nt, Human
cucccgucucaccaucuaugcc

SEQ ID NO: 1082449 - RNA, 22 nt, Human
cuccgggcucaccaccuaugcc

SEQ ID NO: 1082450 - RNA, 22 nt, Human
cuccggggucaccaucuauacc

SEQ ID NO: 1082451 - RNA, 22 nt, Human
cuccuggguggaagagcucaca

SEQ ID NO: 1082452 - RNA, 21 nt, Human
cugauggacacuggcccagga

SEQ ID NO: 1082453 - RNA, 20 nt, Human
cugcgcuauguugggcugaa

SEQ ID NO: 1082454 - RNA, 19 nt, Human
cugggugugucagcugugc

SEQ ID NO: 1082455 - RNA, 21 nt, Human
cuguagucccagcuacuuggg

SEQ ID NO: 1082456 - RNA, 21 nt, Human
cugugggcccaacacaagucu

SEQ ID NO: 1082457 - RNA, 21 nt, Human
cugugggcccaacacgagucu

SEQ ID NO: 1082458 - RNA, 23 nt, Human
cuguggggguccaacacaagucu

SEQ ID NO: 1082459 - RNA, 21 nt, Human
cuucagggucaccaucuaugc

SEQ ID NO: 1082460 - RNA, 20 nt, Human
cuucccgcacaugcauccag

SEQ ID NO: 1082461 - RNA, 19 nt, Human
cuucucuuuucccugaagu

SEQ ID NO: 1082462 - RNA, 21 nt, Human
cuuuuggccacgugcuccauc

SEQ ID NO: 1082463 - RNA, 19 nt, Human
gaaaagcaagcccaacaga

SEQ ID NO: 1082464 - RNA, 21 nt, Human
gaacaccuguaucaauaaacc

SEQ ID NO: 1082465 - RNA, 21 nt, Human
gaacaugugaccacccuccau

SEQ ID NO: 1082466 - RNA, 25 nt, Human
gaacccaccaauuccggacacacug

SEQ ID NO: 1082467 - RNA, 19 nt, Human
gaaccgcuuggcagaagag

SEQ ID NO: 1082468 - RNA, 18 nt, Human
gaagggcuggagcuucag

SEQ ID NO: 1082469 - RNA, 18 nt, Human
gaagggcuggagcuucag

SEQ ID NO: 1082470 - RNA, 18 nt, Human
gaagggcuggagcuucag

SEQ ID NO: 1082471 - RNA, 21 nt, Human
gaccagggcgccaggaagggc

SEQ ID NO: 1082472 - RNA, 21 nt, Human
gacuggggcaccaggaaaggc

SEQ ID NO: 1082473 - RNA, 22 nt, Human
gagaacagggacucaggaagga

SEQ ID NO: 1082474 - RNA, 23 nt, Human
gagaaucguuugaacccgggagg

SEQ ID NO: 1082475 - RNA, 23 nt, Human
gagcugcgcuauguugggcugaa

SEQ ID NO: 1082476 - RNA, 22 nt, Human
gaggacccccuuggcagaagag

SEQ ID NO: 1082477 - RNA, 23 nt, Human
gaggguccaaacuccagagcacu

SEQ ID NO: 1082478 - RNA, 21 nt, Human
gcacugggggcugggugccua

SEQ ID NO: 1082479 - RNA, 22 nt, Human
gcagaucauaugccaaaaguuc

SEQ ID NO: 1082480 - RNA, 24 nt, Human
gccaacguggugaaacccccucuc

SEQ ID NO: 1082481 - RNA, 18 nt, Human
gccacgugcuccaucuua

SEQ ID NO: 1082482 - RNA, 22 nt, Human
gccacuggcccaggaacagcag

SEQ ID NO: 1082483 - RNA, 22 nt, Human
gccagguggaccuccuaggugg

SEQ ID NO: 1082484 - RNA, 31 nt, Human
gcccaacacaagucuuccucccgucucaccc

SEQ ID NO: 1082485 - RNA, 25 nt, Human
gccugagcuucagcgccucaggggc

SEQ ID NO: 1082486 - RNA, 22 nt, Human
gccugggcaguccucgaggccu

SEQ ID NO: 1082487 - RNA, 18 nt, Human
gcugacguacacuggccu

SEQ ID NO: 1082488 - RNA, 22 nt, Human
gcugauggacacuggcccagga

SEQ ID NO: 1082489 - RNA, 22 nt, Human
gcugauggacacuggcccagga

SEQ ID NO: 1082490 - RNA, 21 nt, Human
gcuucagcacaccaugggcug

SEQ ID NO: 1082491 - RNA, 23 nt, Human
ggccugaccagcccgcugaguuu

SEQ ID NO: 1082492 - RNA, 23 nt, Human
ggccugaccagccuuccaaguuu

SEQ ID NO: 1082493 - RNA, 23 nt, Human
ggccugggcaguccucgaggccu

SEQ ID NO: 1082494 - RNA, 18 nt, Human
ggccuggggccugugggc

SEQ ID NO: 1082495 - RNA, 18 nt, Human
ggccuggggccugugggc

SEQ ID NO: 1082496 - RNA, 18 nt, Human
ggccuggggccugugggg

SEQ ID NO: 1082497 - RNA, 19 nt, Human
ggccuggggccuguggggg

SEQ ID NO: 1082498 - RNA, 20 nt, Human
ggcgagaacagggacucagg

SEQ ID NO: 1082499 - RNA, 24 nt, Human
gggaccacuugggccgaagagcuc

SEQ ID NO: 1082500 - RNA, 24 nt, Human
gggcaccaggaaaggcuggagcuu

SEQ ID NO: 1082501 - RNA, 18 nt, Human
gggcugagcaccuggcug

SEQ ID NO: 1082502 - RNA, 21 nt, Human
ggguccaaacuccagagcacu

SEQ ID NO: 1082503 - RNA, 22 nt, Human
gguugcagggacagaggaucag

SEQ ID NO: 1082504 - RNA, 21 nt, Human
guccaaaauucagaauucgau

SEQ ID NO: 1082505 - RNA, 24 nt, Human
gucuggaccaccaucaccuuugca

SEQ ID NO: 1082506 - RNA, 25 nt, Human
gugaaucuccaaaacuaggccacaa

SEQ ID NO: 1082507 - RNA, 19 nt, Human
gugggcccaauggaagucu

SEQ ID NO: 1082508 - RNA, 23 nt, Human
guuuucuuccuccacagucuuuu

SEQ ID NO: 1082509 - RNA, 19 nt, Human
uaaaguggacuggaugcca

SEQ ID NO: 1082510 - RNA, 18 nt, Human
uaaaugguccuacgucca

SEQ ID NO: 1082511 - RNA, 24 nt, Human
uaauguggaagcugcauugacuuu

SEQ ID NO: 1082512 - RNA, 23 nt, Human
uaccagggcuuagcgccccucca

SEQ ID NO: 1082513 - RNA, 19 nt, Human
uacguuuccuucagauaua

SEQ ID NO: 1082514 - RNA, 22 nt, Human
uagagugcagagacagguugga

SEQ ID NO: 1082515 - RNA, 21 nt, Human
uagcaccaggcugauggacac

SEQ ID NO: 1082516 - RNA, 21 nt, Human
uauugugguaacggacaggaa

SEQ ID NO: 1082517 - RNA, 24 nt, Human
ucacgacgucaagagaucgagacc

SEQ ID NO: 1082518 - RNA, 19 nt, Human
ucacugcagcaugccugug

SEQ ID NO: 1082519 - RNA, 23 nt, Human
ucagagaauuuuagaggcauuug

SEQ ID NO: 1082520 - RNA, 21 nt, Human
ucaggacaauauaagguucuc

SEQ ID NO: 1082521 - RNA, 23 nt, Human
ucagggcaccaggaagggcugga

SEQ ID NO: 1082522 - RNA, 23 nt, Human
ucagugcaagagaccagggaacc

SEQ ID NO: 1082523 - RNA, 18 nt, Human
ucagugcaccagggacug

SEQ ID NO: 1082524 - RNA, 21 nt, Human
ucagugcaggagccgagggca

SEQ ID NO: 1082525 - RNA, 19 nt, Human
ucaguuucucccugaacaa

SEQ ID NO: 1082526 - RNA, 21 nt, Human
uccaaguuauuuucuucagug

SEQ ID NO: 1082527 - RNA, 19 nt, Human
uccagacucaccaucucau

SEQ ID NO: 1082528 - RNA, 21 nt, Human
uccaggcucaccaccuauguu

SEQ ID NO: 1082529 - RNA, 23 nt, Human
uccaggcucaccaucuaugccgc

SEQ ID NO: 1082530 - RNA, 21 nt, Human
uccaggcucaccaucuauguu

SEQ ID NO: 1082531 - RNA, 25 nt, Human
ucccagguccaaaauacaguggccc

SEQ ID NO: 1082532 - RNA, 23 nt, Human
ucccugaaguuuccuugaaguug

SEQ ID NO: 1082533 - RNA, 25 nt, Human
ucccugaaguuuccuugaaguuguu

SEQ ID NO: 1082534 - RNA, 19 nt, Human
uccggacacacugggacca

SEQ ID NO: 1082535 - RNA, 18 nt, Human
uccuaggugaaagagcuc

SEQ ID NO: 1082536 - RNA, 23 nt, Human
uccuagguggaaaaucccagcuc

SEQ ID NO: 1082537 - RNA, 18 nt, Human
uccuggguggcagagcuc

SEQ ID NO: 1082538 - RNA, 18 nt, Human
ucguuugaacccgggagg

SEQ ID NO: 1082539 - RNA, 23 nt, Human
ucuauacccaucaauuccagggg

SEQ ID NO: 1082540 - RNA, 25 nt, Human
ucucuacuaaaaauacaaaaaaauu

SEQ ID NO: 1082541 - RNA, 18 nt, Human
ucugcaccaaacuguuuu

SEQ ID NO: 1082542 - RNA, 20 nt, Human
ucuggaaccucaggaugaug

SEQ ID NO: 1082543 - RNA, 21 nt, Human
ucuguagucccagcuacuugg

SEQ ID NO: 1082544 - RNA, 19 nt, Human
ucuuucuucagggucacca

SEQ ID NO: 1082545 - RNA, 19 nt, Human
ugaaagaagcagaaagagg

SEQ ID NO: 1082546 - RNA, 22 nt, Human
ugaaagaagcagaaagaggaaa

SEQ ID NO: 1082547 - RNA, 22 nt, Human
ugaaagacaaaggcgagaacag

SEQ ID NO: 1082548 - RNA, 19 nt, Human
ugaaagagcucacugaaag

SEQ ID NO: 1082549 - RNA, 19 nt, Human
ugaaaguucacaggagacc

SEQ ID NO: 1082550 - RNA, 22 nt, Human
ugaaguggaggaucagauucca

SEQ ID NO: 1082551 - RNA, 22 nt, Human
ugacaacaccagagggugcucu

SEQ ID NO: 1082552 - RNA, 19 nt, Human
ugacauacaagucagagaa

SEQ ID NO: 1082553 - RNA, 20 nt, Human
ugaccuaccaaugacagucu

SEQ ID NO: 1082554 - RNA, 22 nt, Human
ugaccuaccaaugacagucuuc

SEQ ID NO: 1082555 - RNA, 18 nt, Human
ugagaccaagaacccacc

SEQ ID NO: 1082556 - RNA, 19 nt, Human
ugagaccaagaacccacca

SEQ ID NO: 1082557 - RNA, 24 nt, Human
ugaggcgggcgaaucacgacguca

SEQ ID NO: 1082558 - RNA, 24 nt, Human
ugagguaggagaaucguuugaacc

SEQ ID NO: 1082559 - RNA, 22 nt, Human
ugaugaaagaagcagaaagagg

SEQ ID NO: 1082560 - RNA, 22 nt, Human
ugauggacacuggcccggggcc

SEQ ID NO: 1082561 - RNA, 22 nt, Human
ugauggacacuggccuggggcc

SEQ ID NO: 1082562 - RNA, 22 nt, Human
ugcaccagagaguaccaguaac

SEQ ID NO: 1082563 - RNA, 21 nt, Human
ugcagagacagguugggccac

SEQ ID NO: 1082564 - RNA, 22 nt, Human
ugccaggaaaggcuugagcuuc

SEQ ID NO: 1082565 - RNA, 22 nt, Human
ugccaggaaaggcuugagcuuc

SEQ ID NO: 1082566 - RNA, 22 nt, Human
ugccaggaagggucagaguuuc

SEQ ID NO: 1082567 - RNA, 22 nt, Human
ugccaggaggacccccuuggca

SEQ ID NO: 1082568 - RNA, 22 nt, Human
ugccagggaggguccaaacucc

SEQ ID NO: 1082569 - RNA, 21 nt, Human
ugccagguggaccuccuaggu

SEQ ID NO: 1082570 - RNA, 18 nt, Human
ugcccuucagagccacca

SEQ ID NO: 1082571 - RNA, 19 nt, Human
ugcccuucagagccaccag

SEQ ID NO: 1082572 - RNA, 19 nt, Human
ugccgggaccaccaucacc

SEQ ID NO: 1082573 - RNA, 25 nt, Human
uggaaaagcucacuaugccagucaa

SEQ ID NO: 1082574 - RNA, 24 nt, Human
uggaagucuuccucaagucucacc

SEQ ID NO: 1082575 - RNA, 19 nt, Human
uggaauccaugaagaacac

SEQ ID NO: 1082576 - RNA, 20 nt, Human
uggacacuggcccggggccu

SEQ ID NO: 1082577 - RNA, 19 nt, Human
uggagcaccgacaccaagc

SEQ ID NO: 1082578 - RNA, 21 nt, Human
uggagcaccgacaccaagccc

SEQ ID NO: 1082579 - RNA, 19 nt, Human
uggcacaucucuuggcagc

SEQ ID NO: 1082580 - RNA, 24 nt, Human
uggccaacguggugaaacccccuc

SEQ ID NO: 1082581 - RNA, 22 nt, Human
uggcccaggaaaagcaagccca

SEQ ID NO: 1082582 - RNA, 24 nt, Human
uggcccaggaaaagcaagcccaac

SEQ ID NO: 1082583 - RNA, 27 nt, Human
uggcccaggaaaagcgaggccgacagg

SEQ ID NO: 1082584 - RNA, 23 nt, Human
uggcccaggaaaagugggcccaa

SEQ ID NO: 1082585 - RNA, 21 nt, Human
uggcccaggaacagcaggccc

SEQ ID NO: 1082586 - RNA, 23 nt, Human
uggccugggcaguccucgaggcc

SEQ ID NO: 1082587 - RNA, 23 nt, Human
uggccugggcaguccucgaggcc

SEQ ID NO: 1082588 - RNA, 18 nt, Human
uggccuggggccuguggg

SEQ ID NO: 1082589 - RNA, 18 nt, Human
uggccuggggccuguggg

SEQ ID NO: 1082590 - RNA, 18 nt, Human
uggccuggggccuguggg

SEQ ID NO: 1082591 - RNA, 24 nt, Human
uggcucacgccuguaaucccagca

SEQ ID NO: 1082592 - RNA, 23 nt, Human
uggcucaggaaaagcaggcccag

SEQ ID NO: 1082593 - RNA, 19 nt, Human
ugggaggcugaggcgggcg

SEQ ID NO: 1082594 - RNA, 24 nt, Human
ugggaggcugaggcgggcgaauca

SEQ ID NO: 1082595 - RNA, 19 nt, Human
ugggaggcugagguaggag

SEQ ID NO: 1082596 - RNA, 23 nt, Human
ugggaggcugagguaggagaauc

SEQ ID NO: 1082597 - RNA, 18 nt, Human
ugggcacuggcucaggaa

SEQ ID NO: 1082598 - RNA, 19 nt, Human
uggggacccugggauccca

SEQ ID NO: 1082599 - RNA, 20 nt, Human
uggggacccugggaucccag

SEQ ID NO: 1082600 - RNA, 19 nt, Human
uggggcaccaggaaaggcu

SEQ ID NO: 1082601 - RNA, 22 nt, Human
uggggcaccaggaaaggcugga

SEQ ID NO: 1082602 - RNA, 18 nt, Human
uggggccugugggcccaa

SEQ ID NO: 1082603 - RNA, 18 nt, Human
uggggccugugggcccaa

SEQ ID NO: 1082604 - RNA, 18 nt, Human
ugggugaugggcacuggc

SEQ ID NO: 1082605 - RNA, 21 nt, Human
ugggugccagcucacgcuugc

SEQ ID NO: 1082606 - RNA, 21 nt, Human
ugggugcugucaacuguccca

SEQ ID NO: 1082607 - RNA, 18 nt, Human
uggguggcagagcucacu

SEQ ID NO: 1082608 - RNA, 24 nt, Human
ugguggcgugcaucuguaguccca

SEQ ID NO: 1082609 - RNA, 18 nt, Human
uguauuaguuuuuauuug

SEQ ID NO: 1082610 - RNA, 22 nt, Human
ugugaggaagggccugagcuuc

SEQ ID NO: 1082611 - RNA, 19 nt, Human
ugugaggaagggccugagg

SEQ ID NO: 1082612 - RNA, 21 nt, Human
uguuaacacuaauuacaaagu

SEQ ID NO: 1082613 - RNA, 25 nt, Human
uguuacuguucccuguucguuacug

SEQ ID NO: 1082614 - RNA, 26 nt, Human
uguucauaucuaauuacaguguuuuu

SEQ ID NO: 1082615 - RNA, 20 nt, Human
uuaggaaaaauguauuaagu

SEQ ID NO: 1082616 - RNA, 18 nt, Human
uucacaggagaccaaaca

SEQ ID NO: 1082617 - RNA, 24 nt, Human
uuccucaagucucaccaucagagc

SEQ ID NO: 1082618 - RNA, 25 nt, Human
uugaagucagugagaccaagaaccc

SEQ ID NO: 1082619 - RNA, 22 nt, Human
uugcagugagccgaaauggugc

SEQ ID NO: 1082620 - RNA, 23 nt, Human
uugcagugagccgaaauggugcc

SEQ ID NO: 1082621 - RNA, 25 nt, Human
uugggaggcugaggcgggcgaauca

SEQ ID NO: 1082622 - RNA, 24 nt, Human
uugggaggcugagguaggagaauc

SEQ ID NO: 1082623 - RNA, 19 nt, Human
uugggcccaacgcaagucu

SEQ ID NO: 1082624 - RNA, 19 nt, Human
uugggcccaaugcaagucu

SEQ ID NO: 1082625 - RNA, 21 nt, Human
uuguuuuuucuucugugacau

SEQ ID NO: 1082626 - RNA, 21 nt, Human
uuuugaaugacuaccagggcu

SEQ ID NO: 1082627 - RNA, 25 nt, Human
uuuuuguuuuuguuuuugcauuguu

SEQ ID NO: 1082628 - RNA, 19 nt, Human
aaaacauaauucugccucu

SEQ ID NO: 1082629 - RNA, 23 nt, Human
aaacaccaagaggccaaacucuc

SEQ ID NO: 1082630 - RNA, 20 nt, Human
aaacauucuaaacaaaauac

SEQ ID NO: 1082631 - RNA, 22 nt, Human
aaagacaucccacagucaugga

SEQ ID NO: 1082632 - RNA, 19 nt, Human
aacaagaaaaagaugucug

SEQ ID NO: 1082633 - RNA, 22 nt, Human
aacacugacaagauaacagaaa

SEQ ID NO: 1082634 - RNA, 23 nt, Human
aacagcuucaacauuauauggca

SEQ ID NO: 1082635 - RNA, 19 nt, Human
aacaugcccggcauaauua

SEQ ID NO: 1082636 - RNA, 21 nt, Human
aaccaaauccagcagcauaga

SEQ ID NO: 1082637 - RNA, 19 nt, Human
aacuaaaucccuaucaaga

SEQ ID NO: 1082638 - RNA, 21 nt, Human
aacuaaaucccuaucaagauc

SEQ ID NO: 1082639 - RNA, 19 nt, Human
aagaagcauuuaacaaaac

SEQ ID NO: 1082640 - RNA, 20 nt, Human
aagaaucccagugacuccuc

SEQ ID NO: 1082641 - RNA, 18 nt, Human
aagacugagaauccagaa

SEQ ID NO: 1082642 - RNA, 22 nt, Human
aagagcacacauuucuucacga

SEQ ID NO: 1082643 - RNA, 24 nt, Human
aagaucccagcuguuuugcaggaa

SEQ ID NO: 1082644 - RNA, 23 nt, Human
aagcaaaugcaaagacaucccac

SEQ ID NO: 1082645 - RNA, 19 nt, Human
aagcagguaaagggaucaa

SEQ ID NO: 1082646 - RNA, 20 nt, Human
aagcagguaaagggaucaag

SEQ ID NO: 1082647 - RNA, 20 nt, Human
aagcuacagccaucaagaca

SEQ ID NO: 1082648 - RNA, 19 nt, Human
aaguaguugucucaggaaa

SEQ ID NO: 1082649 - RNA, 18 nt, Human
acaaaacaacaugaaaau

SEQ ID NO: 1082650 - RNA, 22 nt, Human
acaagauaacagaaagauggag

SEQ ID NO: 1082651 - RNA, 21 nt, Human
acacugaaaucucuaaaacau

SEQ ID NO: 1082652 - RNA, 28 nt, Human
accauaauaauaaaacuugagaacugaa

SEQ ID NO: 1082653 - RNA, 23 nt, Human
acccuaagacacucuguaagaau

SEQ ID NO: 1082654 - RNA, 22 nt, Human
acccugagagccuuuucagagu

SEQ ID NO: 1082655 - RNA, 20 nt, Human
accucuccucccucaacagc

SEQ ID NO: 1082656 - RNA, 19 nt, Human
acgacauuucuuccucuga

SEQ ID NO: 1082657 - RNA, 21 nt, Human
acucucauccccaaacuggac

SEQ ID NO: 1082658 - RNA, 26 nt, Human
agaaaaaaaauuacaguaagcaggua

SEQ ID NO: 1082659 - RNA, 27 nt, Human
agaaaaaaaauuacaguaagcagguaa

SEQ ID NO: 1082660 - RNA, 22 nt, Human
agaagaaaaaaagauguaagaa

SEQ ID NO: 1082661 - RNA, 20 nt, Human
agacuggaaaggaagaaguc

SEQ ID NO: 1082662 - RNA, 24 nt, Human
agagaugcaagaugaagaauuuug

SEQ ID NO: 1082663 - RNA, 24 nt, Human
agagggagaugagagucagggagu

SEQ ID NO: 1082664 - RNA, 20 nt, Human
agcuuccaaccucuccuccc

SEQ ID NO: 1082665 - RNA, 22 nt, Human
aggaaaguguguaacacaaggc

SEQ ID NO: 1082666 - RNA, 22 nt, Human
aggaaggaaugaugggagaggu

SEQ ID NO: 1082667 - RNA, 24 nt, Human
aggcaagaaaaugaaauaauagga

SEQ ID NO: 1082668 - RNA, 19 nt, Human
agugagggagcaaauggaa

SEQ ID NO: 1082669 - RNA, 20 nt, Human
aguugucucaggaaaccagg

SEQ ID NO: 1082670 - RNA, 19 nt, Human
auaacaugugaaaggcaaa

SEQ ID NO: 1082671 - RNA, 20 nt, Human
auauaauaugaaaacuacag

SEQ ID NO: 1082672 - RNA, 19 nt, Human
aucaagacuacacagggac

SEQ ID NO: 1082673 - RNA, 24 nt, Human
augcaaaaaauggaugaaauagga

SEQ ID NO: 1082674 - RNA, 23 nt, Human
augcagcgaggaaaguguguaac

SEQ ID NO: 1082675 - RNA, 19 nt, Human
augcaugaucucauaugca

SEQ ID NO: 1082676 - RNA, 24 nt, Human
augcugccccauuacaaccaucug

SEQ ID NO: 1082677 - RNA, 25 nt, Human
auggcucauagcccaucucuuucag

SEQ ID NO: 1082678 - RNA, 18 nt, Human
caaaacccacagccccuc

SEQ ID NO: 1082679 - RNA, 20 nt, Human
caaacccacagcuagcuaac

SEQ ID NO: 1082680 - RNA, 18 nt, Human
caacaaaucaucaguuuc

SEQ ID NO: 1082681 - RNA, 23 nt, Human
caacacugacaagauaacagaaa

SEQ ID NO: 1082682 - RNA, 26 nt, Human
caacagcuucaacauuauauggcacu

SEQ ID NO: 1082683 - RNA, 19 nt, Human
caacaugaaaaucuugaua

SEQ ID NO: 1082684 - RNA, 21 nt, Human
caacuaagaaauguaccccau

SEQ ID NO: 1082685 - RNA, 21 nt, Human
caacuugaagcaaacccacag

SEQ ID NO: 1082686 - RNA, 18 nt, Human
caagaucccagcuguuuu

SEQ ID NO: 1082687 - RNA, 20 nt, Human
caccuucuuucccauucaag

SEQ ID NO: 1082688 - RNA, 21 nt, Human
cagaagaagcauuuaacaaaa

SEQ ID NO: 1082689 - RNA, 23 nt, Human
cagaagaagcauuuaacaaaacc

SEQ ID NO: 1082690 - RNA, 22 nt, Human
cagcuauucugugcaaccgacg

SEQ ID NO: 1082691 - RNA, 22 nt, Human
cauagcccaucucuuucaguga

SEQ ID NO: 1082692 - RNA, 21 nt, Human
caucaguuucucuagguauua

SEQ ID NO: 1082693 - RNA, 23 nt, Human
cauuucuuccucugacaguuugu

SEQ ID NO: 1082694 - RNA, 20 nt, Human
ccacagccccuccuuuuuuu

SEQ ID NO: 1082695 - RNA, 20 nt, Human
ccacaggccaguucagacac

SEQ ID NO: 1082696 - RNA, 19 nt, Human
ccagaaaaguuuggcugca

SEQ ID NO: 1082697 - RNA, 19 nt, Human
ccaggaaugcaaaguuaau

SEQ ID NO: 1082698 - RNA, 21 nt, Human
ccagugaugaauacaaaaaua

SEQ ID NO: 1082699 - RNA, 23 nt, Human
ccagugaugaauacaagguaccc

SEQ ID NO: 1082700 - RNA, 22 nt, Human
cccuauacaagcaagcaucccc

SEQ ID NO: 1082701 - RNA, 20 nt, Human
cccuccuuuuuuuuuuuuuc

SEQ ID NO: 1082702 - RNA, 23 nt, Human
ccuaagacacucuguaagaaucc

SEQ ID NO: 1082703 - RNA, 22 nt, Human
ccucccuccaccuucuuuccca

SEQ ID NO: 1082704 - RNA, 23 nt, Human
cuagguauuaaaaagccuacacu

SEQ ID NO: 1082705 - RNA, 22 nt, Human
cuauacaagcaagcauccccaa

SEQ ID NO: 1082706 - RNA, 24 nt, Human
cucccuccaccuucuuucccauuc

SEQ ID NO: 1082707 - RNA, 21 nt, Human
cuccucccucaacagcuucaa

SEQ ID NO: 1082708 - RNA, 22 nt, Human
cucucauccccaaacuggacag

SEQ ID NO: 1082709 - RNA, 21 nt, Human
cucuguacuuguaaaacccuc

SEQ ID NO: 1082710 - RNA, 19 nt, Human
cugaggucuuuggguggga

SEQ ID NO: 1082711 - RNA, 18 nt, Human
cuggauucguuuuucugg

SEQ ID NO: 1082712 - RNA, 19 nt, Human
cuuagacacuggcggaaag

SEQ ID NO: 1082713 - RNA, 22 nt, Human
cuuguaaaacccucuacccucc

SEQ ID NO: 1082714 - RNA, 25 nt, Human
cuuguaaaacccucuacccucccca

SEQ ID NO: 1082715 - RNA, 18 nt, Human
cuuucuggaggggaggga

SEQ ID NO: 1082716 - RNA, 24 nt, Human
gaaaccacagcugagauucucuaa

SEQ ID NO: 1082717 - RNA, 22 nt, Human
gaagagggagaugagagucagg

SEQ ID NO: 1082718 - RNA, 23 nt, Human
gaagaguauuugagaaauaugac

SEQ ID NO: 1082719 - RNA, 23 nt, Human
gaagcaaacccacagcuagcuaa

SEQ ID NO: 1082720 - RNA, 21 nt, Human
gaaggaaggaaugaugggaga

SEQ ID NO: 1082721 - RNA, 21 nt, Human
gaauuuacuuacacuccaggc

SEQ ID NO: 1082722 - RNA, 18 nt, Human
gacccaaaacagacaaaa

SEQ ID NO: 1082723 - RNA, 22 nt, Human
gagauucucuaagcuggcagcu

SEQ ID NO: 1082724 - RNA, 23 nt, Human
gaggaaguauccacuguagucaa

SEQ ID NO: 1082725 - RNA, 21 nt, Human
gauccugccuuacccagucac

SEQ ID NO: 1082726 - RNA, 19 nt, Human
gaugggagagguuuagggg

SEQ ID NO: 1082727 - RNA, 22 nt, Human
gcucauuugcuggagcugccaa

SEQ ID NO: 1082728 - RNA, 23 nt, Human
gcucauuugcuggagcugccaag

SEQ ID NO: 1082729 - RNA, 19 nt, Human
gcuuccaaccucuccuccc

SEQ ID NO: 1082730 - RNA, 21 nt, Human
ggaaacauacaucuugacucc

SEQ ID NO: 1082731 - RNA, 21 nt, Human
ggacccaaaacagacaaaaug

SEQ ID NO: 1082732 - RNA, 18 nt, Human
ggaggggagaaaagacuu

SEQ ID NO: 1082733 - RNA, 19 nt, Human
ggauuggaagagggagaug

SEQ ID NO: 1082734 - RNA, 20 nt, Human
guaaaacccucuacccuccc

SEQ ID NO: 1082735 - RNA, 20 nt, Human
uaaaaaauaccucaguaggu

SEQ ID NO: 1082736 - RNA, 28 nt, Human
uaaaaaauaccucaguagguuuaagaac

SEQ ID NO: 1082737 - RNA, 18 nt, Human
uaaaaagaaacaaagaau

SEQ ID NO: 1082738 - RNA, 23 nt, Human
uaaaacccucuacccuccccagg

SEQ ID NO: 1082739 - RNA, 24 nt, Human
uaaaaggagacaagugagggagca

SEQ ID NO: 1082740 - RNA, 25 nt, Human
uaaaaguauuucuguucacagaugc

SEQ ID NO: 1082741 - RNA, 25 nt, Human
uaaaggacaaaacaacaugaaaaag

SEQ ID NO: 1082742 - RNA, 23 nt, Human
uaacugccacaggccaguucaga

SEQ ID NO: 1082743 - RNA, 22 nt, Human
uaagaacagggaaagcucccaa

SEQ ID NO: 1082744 - RNA, 20 nt, Human
uaagugacaaaaaaagaauu

SEQ ID NO: 1082745 - RNA, 24 nt, Human
uacaacauauuaauaaaggacaaa

SEQ ID NO: 1082746 - RNA, 24 nt, Human
uacaagcaagcauccccaaaagua

SEQ ID NO: 1082747 - RNA, 19 nt, Human
uacacauuaagaagcacag

SEQ ID NO: 1082748 - RNA, 27 nt, Human
uacacauuaagaagcacaguggaugag

SEQ ID NO: 1082749 - RNA, 19 nt, Human
uaccauaauaauaaaacuu

SEQ ID NO: 1082750 - RNA, 25 nt, Human
uaccauaauaauaaaacuugagaac

SEQ ID NO: 1082751 - RNA, 27 nt, Human
uagaaaaaaauuaaagacgucaagacu

SEQ ID NO: 1082752 - RNA, 20 nt, Human
uagaugcaaacauucuaaac

SEQ ID NO: 1082753 - RNA, 22 nt, Human
uagcuuuucuggucccuuuuug

SEQ ID NO: 1082754 - RNA, 21 nt, Human
uauaaagaaggaaggaaugau

SEQ ID NO: 1082755 - RNA, 23 nt, Human
uaucaugaauuuacuuacacucc

SEQ ID NO: 1082756 - RNA, 22 nt, Human
uaucuggucaugaagaguauuu

SEQ ID NO: 1082757 - RNA, 23 nt, Human
uauuaaaaagccuacacuuuuga

SEQ ID NO: 1082758 - RNA, 21 nt, Human
uauuacuuugagccagggugg

SEQ ID NO: 1082759 - RNA, 20 nt, Human
ucacuguuaauuauuacuuu

SEQ ID NO: 1082760 - RNA, 20 nt, Human
ucagaggaucaggaccugua

SEQ ID NO: 1082761 - RNA, 21 nt, Human
ucagggagugaaauuaggcag

SEQ ID NO: 1082762 - RNA, 25 nt, Human
ucaguaaacuagguuuaauaaaaga

SEQ ID NO: 1082763 - RNA, 22 nt, Human
uccaaguaguucacuuaaaaaa

SEQ ID NO: 1082764 - RNA, 23 nt, Human
uccaccuucuuucccauucaaga

SEQ ID NO: 1082765 - RNA, 23 nt, Human
uccaccuucuuucccauucaaga

SEQ ID NO: 1082766 - RNA, 29 nt, Human
uccaccuucuuucccauucaagagcugac

SEQ ID NO: 1082767 - RNA, 20 nt, Human
ucccagugacuccucacugu

SEQ ID NO: 1082768 - RNA, 18 nt, Human
ucccuccaccuucuuucc

SEQ ID NO: 1082769 - RNA, 24 nt, Human
uccuuuuuuucccuccagagcuuc

SEQ ID NO: 1082770 - RNA, 19 nt, Human
ucuagacuggaaaggaaga

SEQ ID NO: 1082771 - RNA, 19 nt, Human
ucuauaauaauaaaagguu

SEQ ID NO: 1082772 - RNA, 18 nt, Human
ucuaucuaucuaucaucu

SEQ ID NO: 1082773 - RNA, 22 nt, Human
ucucagaauggucauguuuuua

SEQ ID NO: 1082774 - RNA, 22 nt, Human
ucucuaaaauuuuaaggguagg

SEQ ID NO: 1082775 - RNA, 23 nt, Human
ucucuaagcuggcagcuuccaac

SEQ ID NO: 1082776 - RNA, 20 nt, Human
ucuggauucguuuuucuggg

SEQ ID NO: 1082777 - RNA, 25 nt, Human
ugaaaaggcagcaaaaguaagagga

SEQ ID NO: 1082778 - RNA, 19 nt, Human
ugaaaggcaaaaugguuug

SEQ ID NO: 1082779 - RNA, 23 nt, Human
ugaaaucucuaaaacaucacuga

SEQ ID NO: 1082780 - RNA, 22 nt, Human
ugacaagauaacagaaagaugg

SEQ ID NO: 1082781 - RNA, 19 nt, Human
ugaccagcucauuugcugg

SEQ ID NO: 1082782 - RNA, 23 nt, Human
ugaccagcucauuugcuggagcu

SEQ ID NO: 1082783 - RNA, 21 nt, Human
ugagaaaaauuccucgaaggg

SEQ ID NO: 1082784 - RNA, 19 nt, Human
ugagagauuuugaugauug

SEQ ID NO: 1082785 - RNA, 19 nt, Human
ugaggaaugagagauuuug

SEQ ID NO: 1082786 - RNA, 19 nt, Human
ugagggagcaaauggaagg

SEQ ID NO: 1082787 - RNA, 19 nt, Human
ugagggggcaaucugugga

SEQ ID NO: 1082788 - RNA, 19 nt, Human
ugcaaugcaagggacccaa

SEQ ID NO: 1082789 - RNA, 21 nt, Human
ugcaaugcaagggacccaaaa

SEQ ID NO: 1082790 - RNA, 24 nt, Human
uggaaaccacagcugagauucucu

SEQ ID NO: 1082791 - RNA, 22 nt, Human
uggaaagaguaucaagaggaga

SEQ ID NO: 1082792 - RNA, 22 nt, Human
uggaagagggagaugagaguca

SEQ ID NO: 1082793 - RNA, 21 nt, Human
uggaauacacccugcuggaag

SEQ ID NO: 1082794 - RNA, 22 nt, Human
uggaauucuugagaaaaauucc

SEQ ID NO: 1082795 - RNA, 18 nt, Human
uggaggcacugaaugcag

SEQ ID NO: 1082796 - RNA, 21 nt, Human
uggaugagguacuuuaaauau

SEQ ID NO: 1082797 - RNA, 25 nt, Human
uggcaacacugacaagauaacagaa

SEQ ID NO: 1082798 - RNA, 20 nt, Human
uggcuccaggccggcagucc

SEQ ID NO: 1082799 - RNA, 19 nt, Human
uggggaaaaaaaaaaaaaa

SEQ ID NO: 1082800 - RNA, 21 nt, Human
uggggaaauaauagucuuuuc

SEQ ID NO: 1082801 - RNA, 27 nt, Human
uggguaggaaugcagcgaggaaagugu

SEQ ID NO: 1082802 - RNA, 18 nt, Human
uguucagggacauuccau

SEQ ID NO: 1082803 - RNA, 19 nt, Human
uguucagggacauuccauu

SEQ ID NO: 1082804 - RNA, 23 nt, Human
uguuuugcucuuccuuauuguuc

SEQ ID NO: 1082805 - RNA, 24 nt, Human
uguuuugcucuuccuuauuguuca

SEQ ID NO: 1082806 - RNA, 21 nt, Human
uuaaaaagaaacaaagaaugg

SEQ ID NO: 1082807 - RNA, 24 nt, Human
uuaagaugacuacaguugcacgaa

SEQ ID NO: 1082808 - RNA, 19 nt, Human
uucaagauggcucauagcc

SEQ ID NO: 1082809 - RNA, 22 nt, Human
uuccuuaugaauauagaugcaa

SEQ ID NO: 1082810 - RNA, 21 nt, Human
uuugguaaucaacaaaucauc

SEQ ID NO: 1082811 - RNA, 20 nt, Human
uuuuucaaguuucuuuuuga

SEQ ID NO: 1082812 - RNA, 22 nt, Human
uuuuuuuuuugcaagucugcuc

SEQ ID NO: 1082813 - RNA, 22 nt, Human
aaaaagacaaucucaaagagcu

SEQ ID NO: 1082814 - RNA, 20 nt, Human
aaacaagaagaaaaagaaac

SEQ ID NO: 1082815 - RNA, 22 nt, Human
aaacaagaagaaaaagaaacaa

SEQ ID NO: 1082816 - RNA, 22 nt, Human
aaacagauggccccaacguuuu

SEQ ID NO: 1082817 - RNA, 19 nt, Human
aaaccaguuccaaaccuga

SEQ ID NO: 1082818 - RNA, 22 nt, Human
aaaccaguuccaaaccugacga

SEQ ID NO: 1082819 - RNA, 23 nt, Human
aaaugcuaaaaauugcauuuacu

SEQ ID NO: 1082820 - RNA, 18 nt, Human
aacugcuucuucaaguug

SEQ ID NO: 1082821 - RNA, 18 nt, Human
aagaaaaagaaacaauaa

SEQ ID NO: 1082822 - RNA, 22 nt, Human
aagaaaaagaaacaauaauuua

SEQ ID NO: 1082823 - RNA, 19 nt, Human
aagaaacaagaagaaaaag

SEQ ID NO: 1082824 - RNA, 25 nt, Human
aagaacaccacccucuccucgcugc

SEQ ID NO: 1082825 - RNA, 18 nt, Human
aagaagaaaaagaaacaa

SEQ ID NO: 1082826 - RNA, 22 nt, Human
aagcacauacaguauugcauaa

SEQ ID NO: 1082827 - RNA, 21 nt, Human
aaucauuugauaaaccauuca

SEQ ID NO: 1082828 - RNA, 21 nt, Human
acaagaacaccacccucuccu

SEQ ID NO: 1082829 - RNA, 21 nt, Human
acaagaagaaaaagaaacaau

SEQ ID NO: 1082830 - RNA, 33 nt, Human
acacacaaauacacauacauacacauauguggu

SEQ ID NO: 1082831 - RNA, 25 nt, Human
acacacacacacaaauacacauaca

SEQ ID NO: 1082832 - RNA, 19 nt, Human
acagaaguagacuguaacc

SEQ ID NO: 1082833 - RNA, 21 nt, Human
acauacauacacauauguggc

SEQ ID NO: 1082834 - RNA, 24 nt, Human
acauuccacauggaccaaggcagg

SEQ ID NO: 1082835 - RNA, 20 nt, Human
accaaggcaggcguuccacu

SEQ ID NO: 1082836 - RNA, 19 nt, Human
accagaaacaagaacacca

SEQ ID NO: 1082837 - RNA, 21 nt, Human
acgcaauuucuuucugaaguc

SEQ ID NO: 1082838 - RNA, 18 nt, Human
acucaguggaaagaaaca

SEQ ID NO: 1082839 - RNA, 19 nt, Human
agaacaccacccucuccuc

SEQ ID NO: 1082840 - RNA, 24 nt, Human
agaagaaaaagaaacaauaauuua

SEQ ID NO: 1082841 - RNA, 20 nt, Human
agaagauacccagcacugcc

SEQ ID NO: 1082842 - RNA, 21 nt, Human
agaagauacccagcacugcca

SEQ ID NO: 1082843 - RNA, 19 nt, Human
agaggaucagugcagagcc

SEQ ID NO: 1082844 - RNA, 21 nt, Human
agcccugaaugggaagggguu

SEQ ID NO: 1082845 - RNA, 22 nt, Human
aggagaugacccagagacagaa

SEQ ID NO: 1082846 - RNA, 21 nt, Human
aggcaggcguuccacugggga

SEQ ID NO: 1082847 - RNA, 22 nt, Human
aggcaguugguacuauuuuccc

SEQ ID NO: 1082848 - RNA, 20 nt, Human
auacaggaagcucugacauc

SEQ ID NO: 1082849 - RNA, 21 nt, Human
auagauccauuauaacuucaa

SEQ ID NO: 1082850 - RNA, 25 nt, Human
auauacacacacacacacaaauaca

SEQ ID NO: 1082851 - RNA, 24 nt, Human
augauaagaaaaaaaguuugugcc

SEQ ID NO: 1082852 - RNA, 23 nt, Human
caaaaugcuaaaaauugcauuua

SEQ ID NO: 1082853 - RNA, 21 nt, Human
caacagccugaaaauagcauc

SEQ ID NO: 1082854 - RNA, 27 nt, Human
caagaaacuucccacagcaaguaggga

SEQ ID NO: 1082855 - RNA, 22 nt, Human
caauucuacaacagccugaaaa

SEQ ID NO: 1082856 - RNA, 18 nt, Human
cacacaaauacacauaca

SEQ ID NO: 1082857 - RNA, 21 nt, Human
cacacacaaauacacauacau

SEQ ID NO: 1082858 - RNA, 24 nt, Human
cacauacauacacauauguggcug

SEQ ID NO: 1082859 - RNA, 21 nt, Human
cagaagauacccagcacugcc

SEQ ID NO: 1082860 - RNA, 23 nt, Human
cagaagauacccagcacugccau

SEQ ID NO: 1082861 - RNA, 24 nt, Human
cagcuaugaacuuucuccagauac

SEQ ID NO: 1082862 - RNA, 18 nt, Human
caguacagaugcaaccau

SEQ ID NO: 1082863 - RNA, 25 nt, Human
cauaacuacaagaaacuucccacag

SEQ ID NO: 1082864 - RNA, 19 nt, Human
cauacauacacauaugugg

SEQ ID NO: 1082865 - RNA, 20 nt, Human
cauaugauccacaugcaucc

SEQ ID NO: 1082866 - RNA, 19 nt, Human
ccacccaggacacuaguaa

SEQ ID NO: 1082867 - RNA, 23 nt, Human
ccacccaggacacuaguaacugc

SEQ ID NO: 1082868 - RNA, 21 nt, Human
ccagagacagaagauacccag

SEQ ID NO: 1082869 - RNA, 20 nt, Human
cccucaauuuacaccuuuaa

SEQ ID NO: 1082870 - RNA, 22 nt, Human
cuaauacugcauuuuuaugccu

SEQ ID NO: 1082871 - RNA, 21 nt, Human
gaaaauacaggaagcucugac

SEQ ID NO: 1082872 - RNA, 21 nt, Human
gaaacaagaagaaaaagaaac

SEQ ID NO: 1082873 - RNA, 20 nt, Human
gaaacagauggccccaacgu

SEQ ID NO: 1082874 - RNA, 19 nt, Human
gaaauccuaccauaugccc

SEQ ID NO: 1082875 - RNA, 21 nt, Human
gagacagaagauacccagcac

SEQ ID NO: 1082876 - RNA, 22 nt, Human
gagcuggcaauuauuuugagau

SEQ ID NO: 1082877 - RNA, 18 nt, Human
gagucucucuuucaugga

SEQ ID NO: 1082878 - RNA, 20 nt, Human
ggaaagaaacaagaagaaaa

SEQ ID NO: 1082879 - RNA, 23 nt, Human
ggagcuggcaauuauuuugagau

SEQ ID NO: 1082880 - RNA, 18 nt, Human
gugaaagauaacuuuucu

SEQ ID NO: 1082881 - RNA, 24 nt, Human
uaacuacaaugagagaaacagaug

SEQ ID NO: 1082882 - RNA, 22 nt, Human
uaauuuaauuuuacacacccaa

SEQ ID NO: 1082883 - RNA, 23 nt, Human
uacaacagccugaaaauagcauc

SEQ ID NO: 1082884 - RNA, 26 nt, Human
uacacacacacacacaaauacacaua

SEQ ID NO: 1082885 - RNA, 19 nt, Human
uacacauacauacacauau

SEQ ID NO: 1082886 - RNA, 26 nt, Human
uacauauacacacacacacacaaaua

SEQ ID NO: 1082887 - RNA, 21 nt, Human
uaccaaacuccauggauguuc

SEQ ID NO: 1082888 - RNA, 22 nt, Human
uaccagaaacaagaacaccacc

SEQ ID NO: 1082889 - RNA, 19 nt, Human
uaccauaugcccacauucc

SEQ ID NO: 1082890 - RNA, 19 nt, Human
uaccauaugcccacauucc

SEQ ID NO: 1082891 - RNA, 20 nt, Human
uaccaugaucagaaaauaca

SEQ ID NO: 1082892 - RNA, 26 nt, Human
uacccagcacugccauuuuuaauugc

SEQ ID NO: 1082893 - RNA, 18 nt, Human
uagaggacaggaagguag

SEQ ID NO: 1082894 - RNA, 23 nt, Human
uaguaacugcuucuucaaguuga

SEQ ID NO: 1082895 - RNA, 23 nt, Human
uaucacccaccacauaccaaacu

SEQ ID NO: 1082896 - RNA, 24 nt, Human
uaucacccaccacauaccaaacuc

SEQ ID NO: 1082897 - RNA, 23 nt, Human
ucacccaccacauaccaaacucc

SEQ ID NO: 1082898 - RNA, 19 nt, Human
ucaguacagaugcaaccau

SEQ ID NO: 1082899 - RNA, 22 nt, Human
ucaguacagaugcaaccauauu

SEQ ID NO: 1082900 - RNA, 23 nt, Human
ucaguggaaagaaacaagaagaa

SEQ ID NO: 1082901 - RNA, 20 nt, Human
uccaaaccugacgacgcaau

SEQ ID NO: 1082902 - RNA, 19 nt, Human
ucccuguggcccacccagg

SEQ ID NO: 1082903 - RNA, 23 nt, Human
ucccuguggucuuugccauggcu

SEQ ID NO: 1082904 - RNA, 25 nt, Human
uccuccuauauacuuuaaucucuag

SEQ ID NO: 1082905 - RNA, 21 nt, Human
ucgcugcuuucguggaacuca

SEQ ID NO: 1082906 - RNA, 25 nt, Human
ucuaugccagguauuguaccagaaa

SEQ ID NO: 1082907 - RNA, 19 nt, Human
ucucaaagagcucauaguu

SEQ ID NO: 1082908 - RNA, 22 nt, Human
ucuccagauacgagucucucuu

SEQ ID NO: 1082909 - RNA, 30 nt, Human
ucucuuuaccauuuuaacuugucccugauu

SEQ ID NO: 1082910 - RNA, 19 nt, Human
ucugacaucaggauaugaa

SEQ ID NO: 1082911 - RNA, 23 nt, Human
ugaauccacaaaugugaaaccca

SEQ ID NO: 1082912 - RNA, 23 nt, Human
ugaaugggaagggguugugucaa

SEQ ID NO: 1082913 - RNA, 22 nt, Human
ugacaucaggauaugaaaaaga

SEQ ID NO: 1082914 - RNA, 26 nt, Human
ugagauuauaccgaaguagugcauga

SEQ ID NO: 1082915 - RNA, 25 nt, Human
ugaggcuggcaaugccucuuugccc

SEQ ID NO: 1082916 - RNA, 21 nt, Human
ugaucagaaaauacaggaagc

SEQ ID NO: 1082917 - RNA, 21 nt, Human
uggaaagaaacaagaagaaaa

SEQ ID NO: 1082918 - RNA, 23 nt, Human
uggaugaauccacaaaugugaaa

SEQ ID NO: 1082919 - RNA, 25 nt, Human
ugguguugacagccagugugaggcu

SEQ ID NO: 1082920 - RNA, 23 nt, Human
uguaccagaaacaagaacaccac

SEQ ID NO: 1082921 - RNA, 21 nt, Human
uguggucuuugccauggcuag

SEQ ID NO: 1082922 - RNA, 20 nt, Human
uguuagugaugaaucugaca

SEQ ID NO: 1082923 - RNA, 24 nt, Human
uguuagugaugaaucugacauuuc

SEQ ID NO: 1082924 - RNA, 20 nt, Human
uucaaguugaguugcuaaua

SEQ ID NO: 1082925 - RNA, 21 nt, Human
uugauaaaccauucaaaaugc

SEQ ID NO: 1082926 - RNA, 24 nt, Human
uugcauaugauccacaugcauccu

SEQ ID NO: 1082927 - RNA, 19 nt, Human
uuuaucaaggaugaagaaa

SEQ ID NO: 1082928 - RNA, 24 nt, Human
uuucuccagauacgagucucucuu

SEQ ID NO: 1082929 - RNA, 22 nt, Human
aacaaaccccauccugcagaac

SEQ ID NO: 1082930 - RNA, 18 nt, Human
aaucaguuuuacccucuc

SEQ ID NO: 1082931 - RNA, 21 nt, Human
acaaaccccauccugcagaac

SEQ ID NO: 1082932 - RNA, 21 nt, Human
guguguuguauuuauuuuuaa

SEQ ID NO: 1082933 - RNA, 19 nt, Human
uaacaaaccccauccugca

SEQ ID NO: 1082934 - RNA, 23 nt, Human
uaacaaaccccauccugcagaac

SEQ ID NO: 1082935 - RNA, 24 nt, Human
uaucugaaaaaucaucauagaaaa

SEQ ID NO: 1082936 - RNA, 18 nt, Human
uccgaguaucguaaucag

SEQ ID NO: 1082937 - RNA, 19 nt, Human
aaaaacuggagaaaggaca

SEQ ID NO: 1082938 - RNA, 20 nt, Human
aaauuaccagguuugagggu

SEQ ID NO: 1082939 - RNA, 24 nt, Human
aacaaaaacuggagaaaggacaau

SEQ ID NO: 1082940 - RNA, 19 nt, Human
aaccagcgaucgaugcagu

SEQ ID NO: 1082941 - RNA, 27 nt, Human
acacaacacuuucucuguuaccagaag

SEQ ID NO: 1082942 - RNA, 23 nt, Human
caaauggauagaaagcuucuucc

SEQ ID NO: 1082943 - RNA, 21 nt, Human
caagugauuccuguuugccca

SEQ ID NO: 1082944 - RNA, 19 nt, Human
cagucuauuauagagucac

SEQ ID NO: 1082945 - RNA, 19 nt, Human
caucauccucauuuaagag

SEQ ID NO: 1082946 - RNA, 20 nt, Human
cccacggucugggcuccugc

SEQ ID NO: 1082947 - RNA, 24 nt, Human
ccucauuuaagaggaaaacugagc

SEQ ID NO: 1082948 - RNA, 18 nt, Human
ccucuuugcccacuucuu

SEQ ID NO: 1082949 - RNA, 20 nt, Human
ccugcuucuugcccuccccg

SEQ ID NO: 1082950 - RNA, 25 nt, Human
cuccgaagcugcuccgcaccucccu

SEQ ID NO: 1082951 - RNA, 25 nt, Human
cuggaacaaaaacuggagaaaggac

SEQ ID NO: 1082952 - RNA, 25 nt, Human
cuguagucuucucagcaacucuucc

SEQ ID NO: 1082953 - RNA, 27 nt, Human
cuuuuauucuggaacaaaaacuggaga

SEQ ID NO: 1082954 - RNA, 18 nt, Human
gaucgaugcagucagugg

SEQ ID NO: 1082955 - RNA, 19 nt, Human
gcagauggcucauuuucau

SEQ ID NO: 1082956 - RNA, 30 nt, Human
gcaguggugggccuucuuuaguuugcuguu

SEQ ID NO: 1082957 - RNA, 22 nt, Human
ggaacaaaaacuggagaaagga

SEQ ID NO: 1082958 - RNA, 22 nt, Human
uaaguaccacucaaaaagugga

SEQ ID NO: 1082959 - RNA, 25 nt, Human
uacacaacacuuucucuguuaccag

SEQ ID NO: 1082960 - RNA, 18 nt, Human
uaccucagaaagcaacga

SEQ ID NO: 1082961 - RNA, 18 nt, Human
uaccucagaaagcaacga

SEQ ID NO: 1082962 - RNA, 21 nt, Human
uagaaagcuucuucccgaucc

SEQ ID NO: 1082963 - RNA, 19 nt, Human
uagaauucucagauaacca

SEQ ID NO: 1082964 - RNA, 21 nt, Human
uauuaaugaacaaguggaaaa

SEQ ID NO: 1082965 - RNA, 21 nt, Human
uauuauagagucaccauuaga

SEQ ID NO: 1082966 - RNA, 24 nt, Human
uauuuccaguuugucugacagagu

SEQ ID NO: 1082967 - RNA, 23 nt, Human
ucaccugaguuuugcaguggugg

SEQ ID NO: 1082968 - RNA, 24 nt, Human
ucagcucuugcucuggcucuccca

SEQ ID NO: 1082969 - RNA, 18 nt, Human
ucaguggacaugguacuc

SEQ ID NO: 1082970 - RNA, 20 nt, Human
ucccacggucugggcuccug

SEQ ID NO: 1082971 - RNA, 23 nt, Human
uccucuuugcccacuucuuguug

SEQ ID NO: 1082972 - RNA, 27 nt, Human
ucugaagagucuccuccucuauuuuca

SEQ ID NO: 1082973 - RNA, 23 nt, Human
ucugcgacaaauaggaccggggc

SEQ ID NO: 1082974 - RNA, 25 nt, Human
ucuuuagugaguccucuagguuggu

SEQ ID NO: 1082975 - RNA, 21 nt, Human
ugcaaacacuacagguuuuua

SEQ ID NO: 1082976 - RNA, 24 nt, Human
ugcaccauuuucaccaaaacuucu

SEQ ID NO: 1082977 - RNA, 22 nt, Human
ugcucuggcucucccacggucu

SEQ ID NO: 1082978 - RNA, 19 nt, Human
uggccgcagcucucaagcc

SEQ ID NO: 1082979 - RNA, 20 nt, Human
uggcuuuuaaaauauuuccu

SEQ ID NO: 1082980 - RNA, 23 nt, Human
uucaccaaaacuucucauugcca

SEQ ID NO: 1082981 - RNA, 20 nt, Human
aaaagaacauuugaaagaca

SEQ ID NO: 1082982 - RNA, 20 nt, Human
aaaaucaaaauaagaugacc

SEQ ID NO: 1082983 - RNA, 21 nt, Human
aaacagaaaaauuauuuccca

SEQ ID NO: 1082984 - RNA, 18 nt, Human
aaaugccaagguauuuac

SEQ ID NO: 1082985 - RNA, 19 nt, Human
aaaugucaaaacacagaac

SEQ ID NO: 1082986 - RNA, 23 nt, Human
aacauuugaaagacagaaagaga

SEQ ID NO: 1082987 - RNA, 24 nt, Human
acauuugaaagacagaaagagaga

SEQ ID NO: 1082988 - RNA, 19 nt, Human
acuuugagaaacagaaaaa

SEQ ID NO: 1082989 - RNA, 23 nt, Human
agaaagagagagggaaaagagaa

SEQ ID NO: 1082990 - RNA, 28 nt, Human
agaaggggaggagagaaagagagaggga

SEQ ID NO: 1082991 - RNA, 23 nt, Human
agacagaaagagagaagggggac

SEQ ID NO: 1082992 - RNA, 22 nt, Human
agagagagggaaaagagaaagc

SEQ ID NO: 1082993 - RNA, 18 nt, Human
agaggaggaggaggagga

SEQ ID NO: 1082994 - RNA, 25 nt, Human
agaggaggaggaggaggauugagag

SEQ ID NO: 1082995 - RNA, 20 nt, Human
agcaagaaagaggaggagga

SEQ ID NO: 1082996 - RNA, 22 nt, Human
caaaagggagcauuuuaugaua

SEQ ID NO: 1082997 - RNA, 24 nt, Human
cagaaacaguaauucagaaugcaa

SEQ ID NO: 1082998 - RNA, 22 nt, Human
cauuucacuaucccccaguacc

SEQ ID NO: 1082999 - RNA, 19 nt, Human
cccaguaccaaaagggagc

SEQ ID NO: 1083000 - RNA, 20 nt, Human
gagaaagagagagggaaaag

SEQ ID NO: 1083001 - RNA, 22 nt, Human
gagaaggggaggagagaaagag

SEQ ID NO: 1083002 - RNA, 21 nt, Human
gagaauauuugaacauguugu

SEQ ID NO: 1083003 - RNA, 19 nt, Human
gagagaaagagagagggaa

SEQ ID NO: 1083004 - RNA, 18 nt, Human
gaggaggaggaggaggau

SEQ ID NO: 1083005 - RNA, 19 nt, Human
gaggaggaggaggaggauu

SEQ ID NO: 1083006 - RNA, 22 nt, Human
gaggaggaggaggaggauugag

SEQ ID NO: 1083007 - RNA, 20 nt, Human
ggagaguuugagauugagac

SEQ ID NO: 1083008 - RNA, 21 nt, Human
gggaggagagaaagagagagg

SEQ ID NO: 1083009 - RNA, 23 nt, Human
ggggaggagagaaagagagaggg

SEQ ID NO: 1083010 - RNA, 21 nt, Human
uaaaauguuuuucuccauguu

SEQ ID NO: 1083011 - RNA, 24 nt, Human
uauuagaaaccauccaacaugaaa

SEQ ID NO: 1083012 - RNA, 25 nt, Human
ucaaaccagaaacaguaauucagaa

SEQ ID NO: 1083013 - RNA, 22 nt, Human
ugaaagacagaaagagagaagg

SEQ ID NO: 1083014 - RNA, 19 nt, Human
uguuguuaaaagcuagggg

SEQ ID NO: 1083015 - RNA, 23 nt, Human
uuaauagaauguuaaagccaaaa

SEQ ID NO: 1083016 - RNA, 22 nt, Human
aaaaaaaaaaaagaacaaaaaa

SEQ ID NO: 1083017 - RNA, 31 nt, Human
aaaaaaaaaaaagaacaaaaaaacaaaaaga

SEQ ID NO: 1083018 - RNA, 30 nt, Human
aaaaaaaaagaacaaaaaaacaaaaacaaa

SEQ ID NO: 1083019 - RNA, 24 nt, Human
aaaaaaacaaaaacaaagcaagga

SEQ ID NO: 1083020 - RNA, 22 nt, Human
aaaaaaacuaugaacaaagaca

SEQ ID NO: 1083021 - RNA, 23 nt, Human
aaaaaacaaaaacaaagcaagga

SEQ ID NO: 1083022 - RNA, 26 nt, Human
aaaaaacuaugaacaaagacaaaaau

SEQ ID NO: 1083023 - RNA, 28 nt, Human
aaaaaagaacaaaaaaacaaaaacaaag

SEQ ID NO: 1083024 - RNA, 23 nt, Human
aaaaaagaacaaaaaaacaaaag

SEQ ID NO: 1083025 - RNA, 22 nt, Human
aaaaacaaaaacaaagcaagga

SEQ ID NO: 1083026 - RNA, 23 nt, Human
aaagauagcuauaauuaauuugc

SEQ ID NO: 1083027 - RNA, 21 nt, Human
aagaaaaaaaaagagaaagaa

SEQ ID NO: 1083028 - RNA, 22 nt, Human
aaugagaaaaaugaaaaagucc

SEQ ID NO: 1083029 - RNA, 18 nt, Human
aauuuaaucacauuccau

SEQ ID NO: 1083030 - RNA, 19 nt, Human
acagcagaggugaacaaac

SEQ ID NO: 1083031 - RNA, 24 nt, Human
acuacagucccuaaacaaaaaaac

SEQ ID NO: 1083032 - RNA, 24 nt, Human
acuggauuguauuuuauuuggcuu

SEQ ID NO: 1083033 - RNA, 22 nt, Human
agaaaaaaaaagagaaagaaaa

SEQ ID NO: 1083034 - RNA, 21 nt, Human
agaaaaauaaaaagagagccg

SEQ ID NO: 1083035 - RNA, 21 nt, Human
agaaaucacacagccugcaaa

SEQ ID NO: 1083036 - RNA, 23 nt, Human
agaacaaaaaaacaaaaacaaag

SEQ ID NO: 1083037 - RNA, 23 nt, Human
agcucuauuuuugggaaaacaau

SEQ ID NO: 1083038 - RNA, 18 nt, Human
auuggcucugaauucuaa

SEQ ID NO: 1083039 - RNA, 25 nt, Human
caaaaaaacuaugaacaaagacaaa

SEQ ID NO: 1083040 - RNA, 21 nt, Human
caaaaacaaagcaaggagcuc

SEQ ID NO: 1083041 - RNA, 25 nt, Human
caaauuaacuuacagcagaggugaa

SEQ ID NO: 1083042 - RNA, 23 nt, Human
caagaugauaaauauuaguguua

SEQ ID NO: 1083043 - RNA, 19 nt, Human
caauaaauaagcuacuuuc

SEQ ID NO: 1083044 - RNA, 24 nt, Human
caauacaaacauauuaugaaauga

SEQ ID NO: 1083045 - RNA, 23 nt, Human
cagaacagcccccaagaugauaa

SEQ ID NO: 1083046 - RNA, 19 nt, Human
cagccagaacacauuugau

SEQ ID NO: 1083047 - RNA, 21 nt, Human
cagucccuaaacaaaaaaacu

SEQ ID NO: 1083048 - RNA, 24 nt, Human
cauuaucaaauauucagcacagcc

SEQ ID NO: 1083049 - RNA, 23 nt, Human
ccauaauaaaaaaaaaaaagaaa

SEQ ID NO: 1083050 - RNA, 23 nt, Human
ccauaauaaaaaaaaaaaagaac

SEQ ID NO: 1083051 - RNA, 25 nt, Human
cuagaaaaauaaaaagagagcaaaa

SEQ ID NO: 1083052 - RNA, 24 nt, Human
cucacuggcagaauuuuagcuguu

SEQ ID NO: 1083053 - RNA, 25 nt, Human
cucacuggcagaauuuuagcuguua

SEQ ID NO: 1083054 - RNA, 21 nt, Human
cugaugagauaaugguggacu

SEQ ID NO: 1083055 - RNA, 21 nt, Human
gaaaaaaaaagagaaagaaaa

SEQ ID NO: 1083056 - RNA, 26 nt, Human
gagaaaaaugaaaaaguccaauuagc

SEQ ID NO: 1083057 - RNA, 22 nt, Human
gcaaaaaucauguaauagauca

SEQ ID NO: 1083058 - RNA, 18 nt, Human
gggaaaacaaugggugcu

SEQ ID NO: 1083059 - RNA, 18 nt, Human
uaaaaagagagcaaaaau

SEQ ID NO: 1083060 - RNA, 21 nt, Human
uaaaaagagagcaaaaaucau

SEQ ID NO: 1083061 - RNA, 24 nt, Human
uaaaaagagagcaaaaaucaugua

SEQ ID NO: 1083062 - RNA, 28 nt, Human
uaaacaaaaaaacuaugaacaaagacaa

SEQ ID NO: 1083063 - RNA, 19 nt, Human
uaacaaccaauuccaauuc

SEQ ID NO: 1083064 - RNA, 18 nt, Human
uaacagaaauuaacaacc

SEQ ID NO: 1083065 - RNA, 21 nt, Human
uaagaauaucaaacaggaaaa

SEQ ID NO: 1083066 - RNA, 19 nt, Human
uacagucccuaaacaaaaa

SEQ ID NO: 1083067 - RNA, 19 nt, Human
uacauauuaucuaugauug

SEQ ID NO: 1083068 - RNA, 20 nt, Human
uacccgaauuaccagccuga

SEQ ID NO: 1083069 - RNA, 19 nt, Human
uagaucacagaacagcccc

SEQ ID NO: 1083070 - RNA, 21 nt, Human
uagcaaagccaguaacagaaa

SEQ ID NO: 1083071 - RNA, 23 nt, Human
uagcaaagccaguaacagaaauu

SEQ ID NO: 1083072 - RNA, 23 nt, Human
uagcuaaaaaacuaauaagcaag

SEQ ID NO: 1083073 - RNA, 24 nt, Human
uaugaaaugagugaaaagggcaua

SEQ ID NO: 1083074 - RNA, 23 nt, Human
uccaaauucacucagccagaaca

SEQ ID NO: 1083075 - RNA, 21 nt, Human
uccaauaucaauguauaagca

SEQ ID NO: 1083076 - RNA, 19 nt, Human
uccacuacagucccuaaac

SEQ ID NO: 1083077 - RNA, 22 nt, Human
uccacuacagucccuaaacaaa

SEQ ID NO: 1083078 - RNA, 22 nt, Human
ucccaaauuaauguaagucuca

SEQ ID NO: 1083079 - RNA, 23 nt, Human
ucccuaaacaaaaaaacuaugaa

SEQ ID NO: 1083080 - RNA, 26 nt, Human
ucccuaaacaaaaaaacuaugaacaa

SEQ ID NO: 1083081 - RNA, 21 nt, Human
ucuagcaaagccaguaacaga

SEQ ID NO: 1083082 - RNA, 21 nt, Human
ugaacaaagacaaaaauaauc

SEQ ID NO: 1083083 - RNA, 24 nt, Human
ugaacaaagacaaaaauaaucugu

SEQ ID NO: 1083084 - RNA, 22 nt, Human
ugagaaaaaugaaaaaguccaa

SEQ ID NO: 1083085 - RNA, 23 nt, Human
ugauacuagaaaaauaaaaagag

SEQ ID NO: 1083086 - RNA, 18 nt, Human
ugcaacagaaaucacaca

SEQ ID NO: 1083087 - RNA, 24 nt, Human
ugcacauaugaauucuagcaaagc

SEQ ID NO: 1083088 - RNA, 19 nt, Human
uggccccucacagacacaa

SEQ ID NO: 1083089 - RNA, 22 nt, Human
uguaauagaucacagaacagcc

SEQ ID NO: 1083090 - RNA, 23 nt, Human
uuaacacauuuauagcuuaaaga

SEQ ID NO: 1083091 - RNA, 19 nt, Human
uuaacuuacagcagaggug

SEQ ID NO: 1083092 - RNA, 22 nt, Human
uuacagcagaggugaacaaacu

SEQ ID NO: 1083093 - RNA, 23 nt, Human
uuaccagccugauucaaauaugu

SEQ ID NO: 1083094 - RNA, 21 nt, Human
uucaaauauguugcuagcuaa

SEQ ID NO: 1083095 - RNA, 21 nt, Human
uuccuuuuuuuaaugagaaaa

SEQ ID NO: 1083096 - RNA, 24 nt, Human
uucuaaaugugccuauuuuauuuu

SEQ ID NO: 1083097 - RNA, 22 nt, Human
uuuaagaaaaaaaaagagaaag

SEQ ID NO: 1083098 - RNA, 22 nt, Human
aagcaaagccccugcucuccga

SEQ ID NO: 1083099 - RNA, 21 nt, Human
ccucagccggaaaagcaaagc

SEQ ID NO: 1083100 - RNA, 23 nt, Human
cuccaaaucuuccaagccauuuc

SEQ ID NO: 1083101 - RNA, 21 nt, Human
uauugacuuuagucacccugu

SEQ ID NO: 1083102 - RNA, 22 nt, Human
ugcccauaagguggcuggcugg

SEQ ID NO: 1083103 - RNA, 25 nt, Human
uguuguucuuuauccauucaucugu

SEQ ID NO: 1083104 - RNA, 18 nt, Human
uuuguuuaagagauguuu

SEQ ID NO: 1083105 - RNA, 21 nt, Human
aaaauagaaauaucagucacu

SEQ ID NO: 1083106 - RNA, 18 nt, Human
aaaauccuaauauuccag

SEQ ID NO: 1083107 - RNA, 23 nt, Human
aagaacacacaaaguucuagaag

SEQ ID NO: 1083108 - RNA, 26 nt, Human
aaguauugagauugcaggcgugagcc

SEQ ID NO: 1083109 - RNA, 22 nt, Human
aauucucauuccaaaaaaugag

SEQ ID NO: 1083110 - RNA, 31 nt, Human
acacagaugaaccaggcagacgaaaccagag

SEQ ID NO: 1083111 - RNA, 24 nt, Human
accaucuuggccaggcuggucucg

SEQ ID NO: 1083112 - RNA, 19 nt, Human
accgcgcccggccaaaaua

SEQ ID NO: 1083113 - RNA, 18 nt, Human
acgggguuucaccaucuu

SEQ ID NO: 1083114 - RNA, 20 nt, Human
acgggguuucaccaucuugg

SEQ ID NO: 1083115 - RNA, 24 nt, Human
acgggguuucaccaucuuggccag

SEQ ID NO: 1083116 - RNA, 25 nt, Human
acucugcugcccagucuggagugca

SEQ ID NO: 1083117 - RNA, 21 nt, Human
agacgaaaccagauuaggaaa

SEQ ID NO: 1083118 - RNA, 23 nt, Human
agauugcaggcgugagccaccgc

SEQ ID NO: 1083119 - RNA, 18 nt, Human
agccuccagaguagcugg

SEQ ID NO: 1083120 - RNA, 24 nt, Human
aggugauccacccaccucagccuc

SEQ ID NO: 1083121 - RNA, 23 nt, Human
aguagcuggaacuacaggcaugu

SEQ ID NO: 1083122 - RNA, 22 nt, Human
auccacucaaguccugaacuag

SEQ ID NO: 1083123 - RNA, 22 nt, Human
auuuuuuguauuuuuagcagag

SEQ ID NO: 1083124 - RNA, 23 nt, Human
caaaauuaaucuguaauggacac

SEQ ID NO: 1083125 - RNA, 23 nt, Human
caaagcuuaaaauaggacagcuc

SEQ ID NO: 1083126 - RNA, 24 nt, Human
caaaguauugagauugcaggcgug

SEQ ID NO: 1083127 - RNA, 23 nt, Human
caaccuccaccuccugguucaag

SEQ ID NO: 1083128 - RNA, 26 nt, Human
caacuccaaccucaccgaugcucaaa

SEQ ID NO: 1083129 - RNA, 22 nt, Human
caagugauucuggugccucagc

SEQ ID NO: 1083130 - RNA, 27 nt, Human
caagugauucuggugccucagccucca

SEQ ID NO: 1083131 - RNA, 21 nt, Human
caccaucuuggccaggcuggu

SEQ ID NO: 1083132 - RNA, 24 nt, Human
caccaucuuggccaggcuggucuc

SEQ ID NO: 1083133 - RNA, 22 nt, Human
cacccaccucagccucccaaag

SEQ ID NO: 1083134 - RNA, 23 nt, Human
cacccaccucagccucccaaagu

SEQ ID NO: 1083135 - RNA, 24 nt, Human
cacucugcugcccagucuggagug

SEQ ID NO: 1083136 - RNA, 21 nt, Human
cacugcaaccuccaccuccug

SEQ ID NO: 1083137 - RNA, 19 nt, Human
cacuggcuagaaaguugca

SEQ ID NO: 1083138 - RNA, 21 nt, Human
caggcgugagccaccgcgccc

SEQ ID NO: 1083139 - RNA, 22 nt, Human
ccaaaguauugagauugcaggc

SEQ ID NO: 1083140 - RNA, 24 nt, Human
ccaaaguauugagauugcaggcgu

SEQ ID NO: 1083141 - RNA, 22 nt, Human
ccaacuccaaccucaccgaugc

SEQ ID NO: 1083142 - RNA, 19 nt, Human
ccacccaccucagccuccc

SEQ ID NO: 1083143 - RNA, 23 nt, Human
ccaccuccugguucaagugauuc

SEQ ID NO: 1083144 - RNA, 25 nt, Human
ccagaguagcuggaacuacaggcau

SEQ ID NO: 1083145 - RNA, 21 nt, Human
cccaacuccaaccucaccgau

SEQ ID NO: 1083146 - RNA, 21 nt, Human
ccccaacuccaaccucaccga

SEQ ID NO: 1083147 - RNA, 24 nt, Human
ccccaccuucucccuuuuuauuuc

SEQ ID NO: 1083148 - RNA, 27 nt, Human
ccgcgcccggccaaaauaguggaccuc

SEQ ID NO: 1083149 - RNA, 18 nt, Human
ccucccugacaacucagg

SEQ ID NO: 1083150 - RNA, 22 nt, Human
ccucccugacaacucagggagc

SEQ ID NO: 1083151 - RNA, 24 nt, Human
ccugaccucaggugauccacccac

SEQ ID NO: 1083152 - RNA, 18 nt, Human
ccugguucaagugauucu

SEQ ID NO: 1083153 - RNA, 20 nt, Human
cggcagagaacguguucucu

SEQ ID NO: 1083154 - RNA, 24 nt, Human
cgggguuucaccaucuuggccagg

SEQ ID NO: 1083155 - RNA, 18 nt, Human
cucacagaucacauaucg

SEQ ID NO: 1083156 - RNA, 24 nt, Human
cucacagguccugacaauuugacu

SEQ ID NO: 1083157 - RNA, 24 nt, Human
cucacugcaaccuccaccuccugg

SEQ ID NO: 1083158 - RNA, 27 nt, Human
cucacugcaaccuccaccuccugguuc

SEQ ID NO: 1083159 - RNA, 20 nt, Human
cuccaaccucaccgaugcuc

SEQ ID NO: 1083160 - RNA, 21 nt, Human
cucccaaaguauugagauugc

SEQ ID NO: 1083161 - RNA, 23 nt, Human
cugaauauucaaccucccugaca

SEQ ID NO: 1083162 - RNA, 23 nt, Human
cugcaaccuccaccuccugguuc

SEQ ID NO: 1083163 - RNA, 21 nt, Human
cuuaaaauaggacagcucuga

SEQ ID NO: 1083164 - RNA, 24 nt, Human
cuucccaaaacaauuagacucugg

SEQ ID NO: 1083165 - RNA, 18 nt, Human
cuuggccaggcuggucuc

SEQ ID NO: 1083166 - RNA, 21 nt, Human
gaaccaggcagacgaaaccag

SEQ ID NO: 1083167 - RNA, 24 nt, Human
gaccucaggugauccacccaccuc

SEQ ID NO: 1083168 - RNA, 24 nt, Human
gagacgggguuucaccaucuuggc

SEQ ID NO: 1083169 - RNA, 25 nt, Human
gaguagcuggaacuacaggcaugug

SEQ ID NO: 1083170 - RNA, 21 nt, Human
gauucuggugccucagccucc

SEQ ID NO: 1083171 - RNA, 18 nt, Human
gauugcaggcgugagcca

SEQ ID NO: 1083172 - RNA, 20 nt, Human
gauugcaggcgugagccacc

SEQ ID NO: 1083173 - RNA, 21 nt, Human
gcaaccuccaccuccugguuc

SEQ ID NO: 1083174 - RNA, 23 nt, Human
gcuggucucgaacuccugaccuc

SEQ ID NO: 1083175 - RNA, 18 nt, Human
gcuuaaaauaggacagcu

SEQ ID NO: 1083176 - RNA, 23 nt, Human
gcuuccauuuaguucuuccccac

SEQ ID NO: 1083177 - RNA, 23 nt, Human
ggcaccaucucagcucacugcaa

SEQ ID NO: 1083178 - RNA, 24 nt, Human
ggcuggucucgaacuccugaccuc

SEQ ID NO: 1083179 - RNA, 23 nt, Human
gggguuucaccaucuuggccagg

SEQ ID NO: 1083180 - RNA, 24 nt, Human
gguccugacaauuugacucugggg

SEQ ID NO: 1083181 - RNA, 19 nt, Human
ggucucgaacuccugaccu

SEQ ID NO: 1083182 - RNA, 24 nt, Human
ggugccucagccuccagaguagcu

SEQ ID NO: 1083183 - RNA, 24 nt, Human
gugauccacccaccucagccuccc

SEQ ID NO: 1083184 - RNA, 24 nt, Human
uaaucuguaauggacaccucgcuu

SEQ ID NO: 1083185 - RNA, 19 nt, Human
uaauggacaccucgcuucc

SEQ ID NO: 1083186 - RNA, 23 nt, Human
uacaggcaugugccaccaugccc

SEQ ID NO: 1083187 - RNA, 25 nt, Human
uagauagcuaggucccugcccuuaa

SEQ ID NO: 1083188 - RNA, 23 nt, Human
uagcagagacgggguuucaccau

SEQ ID NO: 1083189 - RNA, 26 nt, Human
uagcagagacgggguuucaccaucuu

SEQ ID NO: 1083190 - RNA, 18 nt, Human
uaggaccaaagcuuaaaa

SEQ ID NO: 1083191 - RNA, 19 nt, Human
uaggucccugcccuuaagg

SEQ ID NO: 1083192 - RNA, 19 nt, Human
uagugcaaggaagaaaucc

SEQ ID NO: 1083193 - RNA, 22 nt, Human
uagugcaaggaagaaauccacu

SEQ ID NO: 1083194 - RNA, 20 nt, Human
uauccuucuuuaaauucuca

SEQ ID NO: 1083195 - RNA, 19 nt, Human
uauuucaacacacuuacuu

SEQ ID NO: 1083196 - RNA, 24 nt, Human
uauuuuuuguauuuuuagcagaga

SEQ ID NO: 1083197 - RNA, 22 nt, Human
ucacucugcugcccagucugga

SEQ ID NO: 1083198 - RNA, 19 nt, Human
ucacugcaaccuccaccuc

SEQ ID NO: 1083199 - RNA, 23 nt, Human
ucacugcaaccuccaccuccugg

SEQ ID NO: 1083200 - RNA, 24 nt, Human
ucacugcaaccuccaccuccuggu

SEQ ID NO: 1083201 - RNA, 27 nt, Human
ucacugcaaccuccaccuccugguuca

SEQ ID NO: 1083202 - RNA, 23 nt, Human
ucagucacuaaauuucaaacugu

SEQ ID NO: 1083203 - RNA, 21 nt, Human
uccacccaccucagccuccca

SEQ ID NO: 1083204 - RNA, 20 nt, Human
ucccaaaguauugagauugc

SEQ ID NO: 1083205 - RNA, 24 nt, Human
ucccaaaguauugagauugcaggc

SEQ ID NO: 1083206 - RNA, 26 nt, Human
uccccaccuucucccuuuuuauuuca

SEQ ID NO: 1083207 - RNA, 23 nt, Human
ucucgaacuccugaccucaggug

SEQ ID NO: 1083208 - RNA, 25 nt, Human
ucuuuagaauucaagucaauuuagg

SEQ ID NO: 1083209 - RNA, 21 nt, Human
ugaaccaggcagacgaaacca

SEQ ID NO: 1083210 - RNA, 21 nt, Human
ugaccucaggugauccaccca

SEQ ID NO: 1083211 - RNA, 24 nt, Human
ugaccucaggugauccacccaccu

SEQ ID NO: 1083212 - RNA, 18 nt, Human
ugagauugcaggcgugag

SEQ ID NO: 1083213 - RNA, 19 nt, Human
ugagauugcaggcgugagc

SEQ ID NO: 1083214 - RNA, 21 nt, Human
ugagauugcaggcgugagcca

SEQ ID NO: 1083215 - RNA, 23 nt, Human
ugagauugcaggcgugagccacc

SEQ ID NO: 1083216 - RNA, 24 nt, Human
ugagauugcaggcgugagccaccg

SEQ ID NO: 1083217 - RNA, 24 nt, Human
ugauccacccaccucagccuccca

SEQ ID NO: 1083218 - RNA, 19 nt, Human
ugcaaagagccccaacucc

SEQ ID NO: 1083219 - RNA, 24 nt, Human
ugcaaggaagaaauccacucaagu

SEQ ID NO: 1083220 - RNA, 21 nt, Human
ugcauugcaaagagccccaac

SEQ ID NO: 1083221 - RNA, 24 nt, Human
ugccucagccuccagaguagcugg

SEQ ID NO: 1083222 - RNA, 21 nt, Human
uggaacuacaggcaugugcca

SEQ ID NO: 1083223 - RNA, 24 nt, Human
uggaacuacaggcaugugccacca

SEQ ID NO: 1083224 - RNA, 24 nt, Human
uggccaggcuggucucgaacuccu

SEQ ID NO: 1083225 - RNA, 23 nt, Human
uggcuagaaaguugcacaaugaa

SEQ ID NO: 1083226 - RNA, 19 nt, Human
uuaacauuacugauuauag

SEQ ID NO: 1083227 - RNA, 24 nt, Human
uuagcagagacgggguuucaccau

SEQ ID NO: 1083228 - RNA, 22 nt, Human
uuagugaaccacuuuggaacua

SEQ ID NO: 1083229 - RNA, 23 nt, Human
uucaagugauucuggugccucag

SEQ ID NO: 1083230 - RNA, 20 nt, Human
uucuuccccaccuucucccu

SEQ ID NO: 1083231 - RNA, 23 nt, Human
uuguauuuuuagcagagacgggg

SEQ ID NO: 1083232 - RNA, 25 nt, Human
uuuagaauucaagucaauuuaggac

SEQ ID NO: 1083233 - RNA, 24 nt, Human
uuucaccaucuuggccaggcuggu

SEQ ID NO: 1083234 - RNA, 24 nt, Human
uuucacucugcugcccagucugga

SEQ ID NO: 1083235 - RNA, 24 nt, Human
uuuuuagcagagacgggguuucac

SEQ ID NO: 1083236 - RNA, 21 nt, Human
uuuuuguauuuuuagcagaga

SEQ ID NO: 1083237 - RNA, 24 nt, Human
uuuuuuguauuuuuagcagagacg

SEQ ID NO: 1083238 - RNA, 23 nt, Human
aaacaagcuugagauaccaaaau

SEQ ID NO: 1083239 - RNA, 23 nt, Human
aaacuccugaccucaggcaaucc

SEQ ID NO: 1083240 - RNA, 18 nt, Human
aaagugcugggauuacaa

SEQ ID NO: 1083241 - RNA, 24 nt, Human
aaagugcugggauuacaagcauga

SEQ ID NO: 1083242 - RNA, 22 nt, Human
aaccucgugauccgcccgccuc

SEQ ID NO: 1083243 - RNA, 19 nt, Human
aagugcugggauuacaagc

SEQ ID NO: 1083244 - RNA, 21 nt, Human
aagugcugggauuacaagcau

SEQ ID NO: 1083245 - RNA, 26 nt, Human
aagugcugggauuacaagcaugagcc

SEQ ID NO: 1083246 - RNA, 23 nt, Human
acaggcgcccgccaccacgcccg

SEQ ID NO: 1083247 - RNA, 18 nt, Human
acaggguuucaucauguu

SEQ ID NO: 1083248 - RNA, 19 nt, Human
acaggguuucaucauguug

SEQ ID NO: 1083249 - RNA, 24 nt, Human
acaggguuucaucauguugaccag

SEQ ID NO: 1083250 - RNA, 18 nt, Human
acgggguuucaccauguu

SEQ ID NO: 1083251 - RNA, 19 nt, Human
acgggguuucaccauguua

SEQ ID NO: 1083252 - RNA, 20 nt, Human
acgggguuucaccauguuag

SEQ ID NO: 1083253 - RNA, 24 nt, Human
acgggguuucaccauguuagccag

SEQ ID NO: 1083254 - RNA, 21 nt, Human
acugcacccggccucauacag

SEQ ID NO: 1083255 - RNA, 24 nt, Human
agcucugucgcccaggcuggagug

SEQ ID NO: 1083256 - RNA, 22 nt, Human
aggcaauccgccugccucggcc

SEQ ID NO: 1083257 - RNA, 23 nt, Human
aggcaauccgccugccucggccu

SEQ ID NO: 1083258 - RNA, 25 nt, Human
aggcuggagugcaguggcgccaucu

SEQ ID NO: 1083259 - RNA, 22 nt, Human
aguagagacgggguuucaccau

SEQ ID NO: 1083260 - RNA, 19 nt, Human
agucucaaacuccugaccu

SEQ ID NO: 1083261 - RNA, 20 nt, Human
agugcaguggcgccaucucg

SEQ ID NO: 1083262 - RNA, 24 nt, Human
agugcugggauuacaagcaugagc

SEQ ID NO: 1083263 - RNA, 21 nt, Human
auccacagcaauuaagacugc

SEQ ID NO: 1083264 - RNA, 23 nt, Human
aucucuugcccccccuccugcua

SEQ ID NO: 1083265 - RNA, 20 nt, Human
augagccaccgcgcccgacc

SEQ ID NO: 1083266 - RNA, 21 nt, Human
auucuccugccucagccuccc

SEQ ID NO: 1083267 - RNA, 24 nt, Human
caaagugcugggauuacaagcaug

SEQ ID NO: 1083268 - RNA, 18 nt, Human
caaaucucuugccccccc

SEQ ID NO: 1083269 - RNA, 23 nt, Human
caacgggccuucuugcgacgcuc

SEQ ID NO: 1083270 - RNA, 19 nt, Human
caauugcugggauuacagg

SEQ ID NO: 1083271 - RNA, 24 nt, Human
caauugcugggauuacaggcguga

SEQ ID NO: 1083272 - RNA, 27 nt, Human
caauugcugggauuacaggcgugagcc

SEQ ID NO: 1083273 - RNA, 18 nt, Human
caccauguuagccaggau

SEQ ID NO: 1083274 - RNA, 22 nt, Human
caccauguuagccaggaugguc

SEQ ID NO: 1083275 - RNA, 23 nt, Human
caccauguuagccaggauggucu

SEQ ID NO: 1083276 - RNA, 24 nt, Human
caccauguuagccaggauggucuu

SEQ ID NO: 1083277 - RNA, 22 nt, Human
cacgccauucuccugccucagc

SEQ ID NO: 1083278 - RNA, 26 nt, Human
cagcaaccccccaugugcuagggaca

SEQ ID NO: 1083279 - RNA, 21 nt, Human
cagcaauuaagacugcacugu

SEQ ID NO: 1083280 - RNA, 21 nt, Human
caggcgcccgccaccacgccc

SEQ ID NO: 1083281 - RNA, 24 nt, Human
caggguuucaucauguugaccagg

SEQ ID NO: 1083282 - RNA, 19 nt, Human
caucugcucgucuggugcu

SEQ ID NO: 1083283 - RNA, 21 nt, Human
cauguugaccaggauagucuc

SEQ ID NO: 1083284 - RNA, 25 nt, Human
cauuuuggccucucagcaacccccc

SEQ ID NO: 1083285 - RNA, 22 nt, Human
ccaaaauugaaaagacagcuca

SEQ ID NO: 1083286 - RNA, 19 nt, Human
ccaaagugcugggauuaca

SEQ ID NO: 1083287 - RNA, 24 nt, Human
ccaaagugcugggauuacaagcau

SEQ ID NO: 1083288 - RNA, 21 nt, Human
ccaauugcugggauuacaggc

SEQ ID NO: 1083289 - RNA, 23 nt, Human
ccaauugcugggauuacaggcgu

SEQ ID NO: 1083290 - RNA, 22 nt, Human
ccacugcacccggccucauaca

SEQ ID NO: 1083291 - RNA, 24 nt, Human
cccaauugcugggauuacaggcgu

SEQ ID NO: 1083292 - RNA, 22 nt, Human
cccaggcuggagugcaguggcg

SEQ ID NO: 1083293 - RNA, 20 nt, Human
ccccgcuggcuaaaaaaggg

SEQ ID NO: 1083294 - RNA, 24 nt, Human
cccgaguagcugagacuacaggcg

SEQ ID NO: 1083295 - RNA, 20 nt, Human
ccggccucauacagcucuaa

SEQ ID NO: 1083296 - RNA, 24 nt, Human
ccucacuacaagcuccgccucccg

SEQ ID NO: 1083297 - RNA, 18 nt, Human
ccugaccucaggcaaucc

SEQ ID NO: 1083298 - RNA, 21 nt, Human
ccugaccucaggcaauccgcc

SEQ ID NO: 1083299 - RNA, 24 nt, Human
ccugccucagccucccgaguagcu

SEQ ID NO: 1083300 - RNA, 19 nt, Human
cgccucccggguucacgcc

SEQ ID NO: 1083301 - RNA, 19 nt, Human
cggccucauacagcucuaa

SEQ ID NO: 1083302 - RNA, 23 nt, Human
cucaaaucucuugcccccccucc

SEQ ID NO: 1083303 - RNA, 21 nt, Human
cucccggguucacgccauucu

SEQ ID NO: 1083304 - RNA, 24 nt, Human
cuccuaaccucgugauccgcccgc

SEQ ID NO: 1083305 - RNA, 23 nt, Human
cuccugaccucaggcaauccgcc

SEQ ID NO: 1083306 - RNA, 26 nt, Human
cuccugaccucaggcaauccgccugc

SEQ ID NO: 1083307 - RNA, 23 nt, Human
cucuugcccccccuccugcuagg

SEQ ID NO: 1083308 - RNA, 18 nt, Human
cugcauguacaaucucuc

SEQ ID NO: 1083309 - RNA, 19 nt, Human
cugucgcccaggcuggagu

SEQ ID NO: 1083310 - RNA, 21 nt, Human
cuuuccauccaugaacucugg

SEQ ID NO: 1083311 - RNA, 20 nt, Human
gaaaagacagcucaucaaaa

SEQ ID NO: 1083312 - RNA, 24 nt, Human
gaccucaggcaauccgccugccuc

SEQ ID NO: 1083313 - RNA, 24 nt, Human
gagacgggguuucaccauguuagc

SEQ ID NO: 1083314 - RNA, 25 nt, Human
gaguagcugagacuacaggcgcccg

SEQ ID NO: 1083315 - RNA, 18 nt, Human
gauuacaagcaugagcca

SEQ ID NO: 1083316 - RNA, 18 nt, Human
gauuacaggcgugagcca

SEQ ID NO: 1083317 - RNA, 22 nt, Human
gauuacaggcgugagccacugc

SEQ ID NO: 1083318 - RNA, 23 nt, Human
gauuacaggcgugagccacugca

SEQ ID NO: 1083319 - RNA, 20 nt, Human
gcccaggcuggagugcagug

SEQ ID NO: 1083320 - RNA, 25 nt, Human
gcccggcuaauuuuuuuuuguauuu

SEQ ID NO: 1083321 - RNA, 20 nt, Human
gccucagccucccgaguagc

SEQ ID NO: 1083322 - RNA, 25 nt, Human
gccucccggguucacgccauucucc

SEQ ID NO: 1083323 - RNA, 23 nt, Human
gccucggccucccaaagugcugg

SEQ ID NO: 1083324 - RNA, 25 nt, Human
gcucugucgcccaggcuggagugca

SEQ ID NO: 1083325 - RNA, 20 nt, Human
gcuggagugcaguggcgcca

SEQ ID NO: 1083326 - RNA, 22 nt, Human
ggauuacaagcaugagccaccg

SEQ ID NO: 1083327 - RNA, 23 nt, Human
gggguuucaccauguuagccagg

SEQ ID NO: 1083328 - RNA, 22 nt, Human
ggguuucaccauguuagccagg

SEQ ID NO: 1083329 - RNA, 24 nt, Human
gguuucaccauguuagccaggaug

SEQ ID NO: 1083330 - RNA, 23 nt, Human
guagagacgggguuucaccaugu

SEQ ID NO: 1083331 - RNA, 24 nt, Human
gugauccgcccgccucggccuccc

SEQ ID NO: 1083332 - RNA, 18 nt, Human
uacaaaaaugaaauacuc

SEQ ID NO: 1083333 - RNA, 23 nt, Human
uacaagcaugagccaccgcgccc

SEQ ID NO: 1083334 - RNA, 23 nt, Human
uacaggcgcccgccaccacgccc

SEQ ID NO: 1083335 - RNA, 19 nt, Human
uacaggcgugagccacugc

SEQ ID NO: 1083336 - RNA, 23 nt, Human
uacaggcgugagccacugcaccc

SEQ ID NO: 1083337 - RNA, 22 nt, Human
uagagacgggguuucaccaugu

SEQ ID NO: 1083338 - RNA, 22 nt, Human
uaguagacaggguuucaucaug

SEQ ID NO: 1083339 - RNA, 24 nt, Human
uaguagagacgggguuucaccaug

SEQ ID NO: 1083340 - RNA, 26 nt, Human
uaguagagacgggguuucaccauguu

SEQ ID NO: 1083341 - RNA, 22 nt, Human
uaguuuuuguauuuuuaguaga

SEQ ID NO: 1083342 - RNA, 23 nt, Human
ucaaguucugcauguacaaucuc

SEQ ID NO: 1083343 - RNA, 24 nt, Human
ucaccauguuagccaggauggucu

SEQ ID NO: 1083344 - RNA, 18 nt, Human
ucacuacaagcuccgccu

SEQ ID NO: 1083345 - RNA, 24 nt, Human
ucacuacaagcuccgccucccggg

SEQ ID NO: 1083346 - RNA, 18 nt, Human
ucccaaagugcugggauu

SEQ ID NO: 1083347 - RNA, 24 nt, Human
ucccaaagugcugggauuacaagc

SEQ ID NO: 1083348 - RNA, 23 nt, Human
ucccaauugcugggauuacaggc

SEQ ID NO: 1083349 - RNA, 24 nt, Human
ucccaauugcugggauuacaggcg

SEQ ID NO: 1083350 - RNA, 24 nt, Human
ucccgaguagcugagacuacaggc

SEQ ID NO: 1083351 - RNA, 21 nt, Human
ucccggguucacgccauucuc

SEQ ID NO: 1083352 - RNA, 24 nt, Human
ucccggguucacgccauucuccug

SEQ ID NO: 1083353 - RNA, 22 nt, Human
ucccucucggaggcucuuucca

SEQ ID NO: 1083354 - RNA, 22 nt, Human
ucgcccaggcuggagugcagug

SEQ ID NO: 1083355 - RNA, 25 nt, Human
ucuaaugccacgcaucaaguucugg

SEQ ID NO: 1083356 - RNA, 19 nt, Human
ucuagcucugucgcccagg

SEQ ID NO: 1083357 - RNA, 23 nt, Human
ucuagcucugucgcccaggcugg

SEQ ID NO: 1083358 - RNA, 24 nt, Human
ucuagcucugucgcccaggcugga

SEQ ID NO: 1083359 - RNA, 24 nt, Human
ucuccugccucagccucccgagua

SEQ ID NO: 1083360 - RNA, 20 nt, Human
ucucuagcucuguacaaauc

SEQ ID NO: 1083361 - RNA, 22 nt, Human
ucucuugcccccccuccugcua

SEQ ID NO: 1083362 - RNA, 24 nt, Human
ucugucgcccaggcuggagugcag

SEQ ID NO: 1083363 - RNA, 18 nt, Human
ugaaaagacagcucauca

SEQ ID NO: 1083364 - RNA, 25 nt, Human
ugaaauacucaaaucucuugccccc

SEQ ID NO: 1083365 - RNA, 21 nt, Human
ugaccucaggcaauccgccug

SEQ ID NO: 1083366 - RNA, 21 nt, Human
ugagacuacaggcgcccgcca

SEQ ID NO: 1083367 - RNA, 24 nt, Human
ugagacuacaggcgcccgccacca

SEQ ID NO: 1083368 - RNA, 22 nt, Human
ugcacccggccucauacagcuc

SEQ ID NO: 1083369 - RNA, 24 nt, Human
ugccucagccucccgaguagcuga

SEQ ID NO: 1083370 - RNA, 21 nt, Human
ugccucggccuucccaauugc

SEQ ID NO: 1083371 - RNA, 24 nt, Human
ugcugggauuacaagcaugagcca

SEQ ID NO: 1083372 - RNA, 20 nt, Human
ugcugggauuacaggcguga

SEQ ID NO: 1083373 - RNA, 24 nt, Human
ugcugggauuacaggcgugagcca

SEQ ID NO: 1083374 - RNA, 18 nt, Human
uggagugcaguggcgcca

SEQ ID NO: 1083375 - RNA, 28 nt, Human
uggagugcaguggcgccauccuagcacg

SEQ ID NO: 1083376 - RNA, 23 nt, Human
uggagugcaguggcgccaucucg

SEQ ID NO: 1083377 - RNA, 28 nt, Human
uggagugcaguggcgccauggcucuagc

SEQ ID NO: 1083378 - RNA, 19 nt, Human
uggccucucagcaaccccc

SEQ ID NO: 1083379 - RNA, 19 nt, Human
uggccucucagcaaccccc

SEQ ID NO: 1083380 - RNA, 20 nt, Human
uggccucucagcaacccccc

SEQ ID NO: 1083381 - RNA, 24 nt, Human
uggcgccaucucgccucacuacaa

SEQ ID NO: 1083382 - RNA, 21 nt, Human
uggcuaaaaaagggcaagcau

SEQ ID NO: 1083383 - RNA, 21 nt, Human
ugggauuacaagcaugagcca

SEQ ID NO: 1083384 - RNA, 22 nt, Human
ugggauuacaagcaugagccac

SEQ ID NO: 1083385 - RNA, 23 nt, Human
ugggauuacaagcaugagccacc

SEQ ID NO: 1083386 - RNA, 24 nt, Human
ugggauuacaagcaugagccaccg

SEQ ID NO: 1083387 - RNA, 24 nt, Human
ugggauuacaagcaugagccaccg

SEQ ID NO: 1083388 - RNA, 18 nt, Human
ugggauuacaggcgugag

SEQ ID NO: 1083389 - RNA, 19 nt, Human
ugggauuacaggcgugagc

SEQ ID NO: 1083390 - RNA, 21 nt, Human
ugggauuacaggcgugagcca

SEQ ID NO: 1083391 - RNA, 22 nt, Human
ugggauuacaggcgugagccac

SEQ ID NO: 1083392 - RNA, 22 nt, Human
ugggauuacaggcgugagccac

SEQ ID NO: 1083393 - RNA, 24 nt, Human
ugggauuacaggcgugagccacug

SEQ ID NO: 1083394 - RNA, 26 nt, Human
ugggauuacaggcgugagccacugca

SEQ ID NO: 1083395 - RNA, 24 nt, Human
uguacaaauccacagcaauuaaga

SEQ ID NO: 1083396 - RNA, 21 nt, Human
uguauuuuuaguagagacggg

SEQ ID NO: 1083397 - RNA, 22 nt, Human
uuaguagacaggguuucaucau

SEQ ID NO: 1083398 - RNA, 23 nt, Human
uuaguagacaggguuucaucaug

SEQ ID NO: 1083399 - RNA, 18 nt, Human
uuaguagagacgggguuu

SEQ ID NO: 1083400 - RNA, 22 nt, Human
uuaguagagacgggguuucacc

SEQ ID NO: 1083401 - RNA, 24 nt, Human
uuaguagagacgggguuucaccau

SEQ ID NO: 1083402 - RNA, 24 nt, Human
uugaaaagacagcucaucaaaaau

SEQ ID NO: 1083403 - RNA, 20 nt, Human
uugcgcgagacuccaacggg

SEQ ID NO: 1083404 - RNA, 23 nt, Human
uuguauuuuuaguagagacgggg

SEQ ID NO: 1083405 - RNA, 23 nt, Human
uuuaguagacaggguuucaucau

SEQ ID NO: 1083406 - RNA, 19 nt, Human
uuucaccauguuagccagg

SEQ ID NO: 1083407 - RNA, 20 nt, Human
uuucaccauguuagccagga

SEQ ID NO: 1083408 - RNA, 19 nt, Human
uuucaucauguugaccagg

SEQ ID NO: 1083409 - RNA, 21 nt, Human
uuuuuaguagacaggguuuca

SEQ ID NO: 1083410 - RNA, 24 nt, Human
uuuuuaguagagacgggguuucac

SEQ ID NO: 1083411 - RNA, 18 nt, Human
uuuuuguauuuuuaguag

SEQ ID NO: 1083412 - RNA, 19 nt, Human
uuuuuguauuuuuaguaga

SEQ ID NO: 1083413 - RNA, 21 nt, Human
uuuuuguauuuuuaguagaca

SEQ ID NO: 1083414 - RNA, 21 nt, Human
uuuuuguauuuuuaguagaga

SEQ ID NO: 1083415 - RNA, 21 nt, Human
uuuuuuguauuuuuaguagag

SEQ ID NO: 1083416 - RNA, 24 nt, Human
uuuuuuguauuuuuaguagagacg

SEQ ID NO: 1083417 - RNA, 22 nt, Human
agcaagaccucauuugggccug

SEQ ID NO: 1083418 - RNA, 21 nt, Human
gcaagaccucauuugggccug

SEQ ID NO: 1083419 - RNA, 18 nt, Human
ggccugguucagggauag

SEQ ID NO: 1083420 - RNA, 19 nt, Human
ucagaaauacauaucugaa

SEQ ID NO: 1083421 - RNA, 24 nt, Human
ugaguuuuccagcauauuucacuu

SEQ ID NO: 1083422 - RNA, 19 nt, Human
aaacacuuugugcagaagg

SEQ ID NO: 1083423 - RNA, 20 nt, Human
aaacucaaccuuccuuaacc

SEQ ID NO: 1083424 - RNA, 20 nt, Human
aaauaucgaaaguuaagaau

SEQ ID NO: 1083425 - RNA, 21 nt, Human
aaauuacuggaacccugagcu

SEQ ID NO: 1083426 - RNA, 18 nt, Human
aacacuuugugcagaagg

SEQ ID NO: 1083427 - RNA, 21 nt, Human
aacccacuccucugcucucca

SEQ ID NO: 1083428 - RNA, 20 nt, Human
aaccccuuguagagaugcac

SEQ ID NO: 1083429 - RNA, 18 nt, Human
aacccugguugcccacug

SEQ ID NO: 1083430 - RNA, 22 nt, Human
aagaggacuuugauuccccuag

SEQ ID NO: 1083431 - RNA, 19 nt, Human
aaguaauagaggucuacaa

SEQ ID NO: 1083432 - RNA, 20 nt, Human
aaguagggaggagaauuggu

SEQ ID NO: 1083433 - RNA, 18 nt, Human
aaucagagugcagggcca

SEQ ID NO: 1083434 - RNA, 25 nt, Human
acaaacuuucaaaaaugaugacaag

SEQ ID NO: 1083435 - RNA, 21 nt, Human
acaagcaaugccucagauucu

SEQ ID NO: 1083436 - RNA, 19 nt, Human
acaauggcuuugaggagau

SEQ ID NO: 1083437 - RNA, 21 nt, Human
acacugaggaccaggaauggc

SEQ ID NO: 1083438 - RNA, 18 nt, Human
acauuaagaaaagcaggc

SEQ ID NO: 1083439 - RNA, 21 nt, Human
accacagccacauuacacauc

SEQ ID NO: 1083440 - RNA, 24 nt, Human
accacagccacauuacacaucuug

SEQ ID NO: 1083441 - RNA, 18 nt, Human
acccugguugcccacugg

SEQ ID NO: 1083442 - RNA, 22 nt, Human
acugcuucaucuguguuccacc

SEQ ID NO: 1083443 - RNA, 23 nt, Human
acuguggaccauggcuuacaccu

SEQ ID NO: 1083444 - RNA, 26 nt, Human
agaggaaaggaagccauaucagagag

SEQ ID NO: 1083445 - RNA, 21 nt, Human
agcaacaacagucacacugaa

SEQ ID NO: 1083446 - RNA, 23 nt, Human
agcagaauuaaucaacucaauaa

SEQ ID NO: 1083447 - RNA, 19 nt, Human
agcauccagucuggcugca

SEQ ID NO: 1083448 - RNA, 25 nt, Human
aggaagaucagaaacaaggcaacug

SEQ ID NO: 1083449 - RNA, 24 nt, Human
aggagaagagcugagcagacaaaa

SEQ ID NO: 1083450 - RNA, 24 nt, Human
agggaggagaauugguaggaccug

SEQ ID NO: 1083451 - RNA, 24 nt, Human
aggggacgugaagaugacucugag

SEQ ID NO: 1083452 - RNA, 24 nt, Human
aguagggaggagaauugguaggac

SEQ ID NO: 1083453 - RNA, 18 nt, Human
agugguucugccuuccgu

SEQ ID NO: 1083454 - RNA, 21 nt, Human
auaugcuagggguugaaugua

SEQ ID NO: 1083455 - RNA, 18 nt, Human
augauaauuugcugccac

SEQ ID NO: 1083456 - RNA, 23 nt, Human
auggcuuacaccuucagagcacu

SEQ ID NO: 1083457 - RNA, 22 nt, Human
auucagagagcaucuccacugu

SEQ ID NO: 1083458 - RNA, 19 nt, Human
caaaaguaauagaggucua

SEQ ID NO: 1083459 - RNA, 19 nt, Human
caaaaguaauagaggucua

SEQ ID NO: 1083460 - RNA, 21 nt, Human
caacacugaggaccaggaaug

SEQ ID NO: 1083461 - RNA, 26 nt, Human
caagagcagaauuaaucaacucaaua

SEQ ID NO: 1083462 - RNA, 23 nt, Human
cacugcacacucuccaagcccaa

SEQ ID NO: 1083463 - RNA, 21 nt, Human
cacugcucccugaaaaagugg

SEQ ID NO: 1083464 - RNA, 21 nt, Human
cagcauaaaucccaacccacu

SEQ ID NO: 1083465 - RNA, 19 nt, Human
caggaaaacugaauagauu

SEQ ID NO: 1083466 - RNA, 20 nt, Human
cccacuccucugcucuccac

SEQ ID NO: 1083467 - RNA, 22 nt, Human
cccauacugcaaaaucaucagg

SEQ ID NO: 1083468 - RNA, 22 nt, Human
cccaugacaagcaaugccucag

SEQ ID NO: 1083469 - RNA, 18 nt, Human
ccccagaaaccacaaacu

SEQ ID NO: 1083470 - RNA, 22 nt, Human
cccugaaaaagugguccucaaa

SEQ ID NO: 1083471 - RNA, 18 nt, Human
cccuuggccaacacugag

SEQ ID NO: 1083472 - RNA, 25 nt, Human
ccucaaagugcacuuucuggcuaca

SEQ ID NO: 1083473 - RNA, 23 nt, Human
ccuuacauccaaccccuuguaga

SEQ ID NO: 1083474 - RNA, 24 nt, Human
cuaaagcaacaacagucacacuga

SEQ ID NO: 1083475 - RNA, 23 nt, Human
cucaagcaagcauaaaaucaaug

SEQ ID NO: 1083476 - RNA, 25 nt, Human
cucacagcagccugacaccacagcc

SEQ ID NO: 1083477 - RNA, 27 nt, Human
cucccauacugcaaaaucaucaggcug

SEQ ID NO: 1083478 - RNA, 22 nt, Human
cucccugaaaaagugguccuca

SEQ ID NO: 1083479 - RNA, 23 nt, Human
cugacaccacagccacauuacac

SEQ ID NO: 1083480 - RNA, 20 nt, Human
cugagcucuuucuucuucuu

SEQ ID NO: 1083481 - RNA, 21 nt, Human
cuucagaaauuacuggaaccc

SEQ ID NO: 1083482 - RNA, 19 nt, Human
cuucagagcacucugacau

SEQ ID NO: 1083483 - RNA, 21 nt, Human
cuucucuacaggaaaacugaa

SEQ ID NO: 1083484 - RNA, 23 nt, Human
cuugaaggaucccuuggccaaca

SEQ ID NO: 1083485 - RNA, 23 nt, Human
gaaaugcuaauucaaagaaucug

SEQ ID NO: 1083486 - RNA, 21 nt, Human
gaagaucagaaacaaggcaac

SEQ ID NO: 1083487 - RNA, 18 nt, Human
gaaucaucugaggagcug

SEQ ID NO: 1083488 - RNA, 22 nt, Human
gacauuaagaaaagcaggcagc

SEQ ID NO: 1083489 - RNA, 20 nt, Human
gacccuggacaggacuuuga

SEQ ID NO: 1083490 - RNA, 24 nt, Human
gagaggccugagaacacucacuga

SEQ ID NO: 1083491 - RNA, 23 nt, Human
gagccagcuucagaaauuacugg

SEQ ID NO: 1083492 - RNA, 19 nt, Human
gaugacaaggggaagagau

SEQ ID NO: 1083493 - RNA, 22 nt, Human
gcagcauaaaucccaacccacu

SEQ ID NO: 1083494 - RNA, 18 nt, Human
gcaguggugggguucugg

SEQ ID NO: 1083495 - RNA, 24 nt, Human
gcuggagcaaugcagcauaaaucc

SEQ ID NO: 1083496 - RNA, 21 nt, Human
ggacuguggggcagggugagg

SEQ ID NO: 1083497 - RNA, 21 nt, Human
ggagaauugguaggaccugaa

SEQ ID NO: 1083498 - RNA, 19 nt, Human
ggaggucaagcucuguuac

SEQ ID NO: 1083499 - RNA, 25 nt, Human
ggauaguagcaguggagaccauaag

SEQ ID NO: 1083500 - RNA, 20 nt, Human
ggccaggaggucaagcucug

SEQ ID NO: 1083501 - RNA, 19 nt, Human
gggcagggugaggauaguu

SEQ ID NO: 1083502 - RNA, 23 nt, Human
gguggggugaggagaggccugag

SEQ ID NO: 1083503 - RNA, 18 nt, Human
gugguuguacaguuaucc

SEQ ID NO: 1083504 - RNA, 20 nt, Human
guuagucaggaggcacugca

SEQ ID NO: 1083505 - RNA, 23 nt, Human
uaagacugcuucaucuguguucc

SEQ ID NO: 1083506 - RNA, 20 nt, Human
uaagguaagaguaaagaagg

SEQ ID NO: 1083507 - RNA, 22 nt, Human
uaccuuacauccaaccccuugu

SEQ ID NO: 1083508 - RNA, 20 nt, Human
uacuguagacccuggacagg

SEQ ID NO: 1083509 - RNA, 23 nt, Human
uagacucaugaguccuuucucaa

SEQ ID NO: 1083510 - RNA, 18 nt, Human
uaggaccugaagccagag

SEQ ID NO: 1083511 - RNA, 20 nt, Human
uaggaccugaagccagagag

SEQ ID NO: 1083512 - RNA, 18 nt, Human
uaggagaugcaugcagga

SEQ ID NO: 1083513 - RNA, 18 nt, Human
uaggagggaaaggcagug

SEQ ID NO: 1083514 - RNA, 23 nt, Human
uagggaggagaauugguaggacc

SEQ ID NO: 1083515 - RNA, 23 nt, Human
uaggguagggccauccacauguc

SEQ ID NO: 1083516 - RNA, 24 nt, Human
ucaacuuuccuucucugauuuuag

SEQ ID NO: 1083517 - RNA, 22 nt, Human
ucaagcucuguuacuauguaac

SEQ ID NO: 1083518 - RNA, 19 nt, Human
ucacagcagccugacacca

SEQ ID NO: 1083519 - RNA, 22 nt, Human
uccacaaacucaaccuuccuua

SEQ ID NO: 1083520 - RNA, 18 nt, Human
uccagcuaggagaugcau

SEQ ID NO: 1083521 - RNA, 24 nt, Human
uccagucucauacaucugcauccc

SEQ ID NO: 1083522 - RNA, 23 nt, Human
uccagucuggcugcagagaaagu

SEQ ID NO: 1083523 - RNA, 24 nt, Human
ucccaacccacuccucugcucucc

SEQ ID NO: 1083524 - RNA, 20 nt, Human
ucccugaggagugguucugc

SEQ ID NO: 1083525 - RNA, 22 nt, Human
ucuaagugggugaucguguggc

SEQ ID NO: 1083526 - RNA, 23 nt, Human
ucuggcuacaauggccacagagg

SEQ ID NO: 1083527 - RNA, 24 nt, Human
ucuggguuaagaaauaucuaagac

SEQ ID NO: 1083528 - RNA, 22 nt, Human
ucuuucuucuucuugugguucc

SEQ ID NO: 1083529 - RNA, 21 nt, Human
ugaaagaugcuggagcaaugc

SEQ ID NO: 1083530 - RNA, 25 nt, Human
ugaaagaugcuggagcaaugcagca

SEQ ID NO: 1083531 - RNA, 21 nt, Human
ugacaaggggaagagaugaaa

SEQ ID NO: 1083532 - RNA, 21 nt, Human
ugacaaggggaagagaugaaa

SEQ ID NO: 1083533 - RNA, 24 nt, Human
ugagaacacucacugauagccucc

SEQ ID NO: 1083534 - RNA, 23 nt, Human
ugauuuuagaucuauucagagag

SEQ ID NO: 1083535 - RNA, 23 nt, Human
ugcacuuucuggcuacaauggcc

SEQ ID NO: 1083536 - RNA, 20 nt, Human
ugcagagaaaguagggagga

SEQ ID NO: 1083537 - RNA, 21 nt, Human
ugcagcauaaaucccaaccca

SEQ ID NO: 1083538 - RNA, 18 nt, Human
ugcaucccugaggagugg

SEQ ID NO: 1083539 - RNA, 19 nt, Human
uggaacccugagcucuuuc

SEQ ID NO: 1083540 - RNA, 22 nt, Human
uggagaccauaagcaguggugg

SEQ ID NO: 1083541 - RNA, 21 nt, Human
uggauggaggugcugaggaag

SEQ ID NO: 1083542 - RNA, 21 nt, Human
uggauggaggugcugaggaag

SEQ ID NO: 1083543 - RNA, 19 nt, Human
uggcuacaauggccacaga

SEQ ID NO: 1083544 - RNA, 18 nt, Human
ugggaaaagcagggaugg

SEQ ID NO: 1083545 - RNA, 18 nt, Human
ugguggggugaggagagg

SEQ ID NO: 1083546 - RNA, 21 nt, Human
uguuacuauguaacaaggaga

SEQ ID NO: 1083547 - RNA, 23 nt, Human
uuaagaauagagaccaggcuuac

SEQ ID NO: 1083548 - RNA, 23 nt, Human
uuaguuccucagggcccuuccua

SEQ ID NO: 1083549 - RNA, 19 nt, Human
uuccucagggcccuuccua

SEQ ID NO: 1083550 - RNA, 24 nt, Human
uucuucuucuugugguuccuuaug

SEQ ID NO: 1083551 - RNA, 18 nt, Human
uuguuguuguuguuuuua

SEQ ID NO: 1083552 - RNA, 22 nt, Human
aaacucgaaacuagggcuggua

SEQ ID NO: 1083553 - RNA, 21 nt, Human
aaccagaggaagggagaaggc

SEQ ID NO: 1083554 - RNA, 24 nt, Human
aaccuagcucuccaagggaggcug

SEQ ID NO: 1083555 - RNA, 26 nt, Human
aagaaucaggugaggcacugaugcaa

SEQ ID NO: 1083556 - RNA, 19 nt, Human
aagcagccuacuugaacau

SEQ ID NO: 1083557 - RNA, 18 nt, Human
aagggagaaggcaggcca

SEQ ID NO: 1083558 - RNA, 23 nt, Human
aagguuuuauugugauugacuuu

SEQ ID NO: 1083559 - RNA, 20 nt, Human
aauauucaaaauguugaaaa

SEQ ID NO: 1083560 - RNA, 22 nt, Human
agaaggcaggccaaaccaagca

SEQ ID NO: 1083561 - RNA, 22 nt, Human
agaggaagggagaaggcaggcc

SEQ ID NO: 1083562 - RNA, 18 nt, Human
aggcauaggaggagaggc

SEQ ID NO: 1083563 - RNA, 24 nt, Human
aggggaaaugucaugagcuuucuc

SEQ ID NO: 1083564 - RNA, 23 nt, Human
aucauuccacaacagaggagggu

SEQ ID NO: 1083565 - RNA, 23 nt, Human
augacauucaaccagaggaaggg

SEQ ID NO: 1083566 - RNA, 23 nt, Human
auuacaacaaaaaagagcuguag

SEQ ID NO: 1083567 - RNA, 25 nt, Human
caaaaaagagcuguaguaaaccuua

SEQ ID NO: 1083568 - RNA, 25 nt, Human
caacaaaaaagagcuguaguaaacc

SEQ ID NO: 1083569 - RNA, 19 nt, Human
cagagcagauaaacaauau

SEQ ID NO: 1083570 - RNA, 25 nt, Human
cagagcagauaaacaauaugcagua

SEQ ID NO: 1083571 - RNA, 19 nt, Human
cagaggaagggagaaggca

SEQ ID NO: 1083572 - RNA, 28 nt, Human
caggauggcuccuggagcuccagucauc

SEQ ID NO: 1083573 - RNA, 27 nt, Human
cauauaauccacugauaugaaaacauc

SEQ ID NO: 1083574 - RNA, 24 nt, Human
cauauucaugcaugcaucuguaug

SEQ ID NO: 1083575 - RNA, 25 nt, Human
cauauucaugcaugcaucuguaugu

SEQ ID NO: 1083576 - RNA, 20 nt, Human
cauuuugcacuuuuguugcu

SEQ ID NO: 1083577 - RNA, 24 nt, Human
cauuuugcacuuuuguugcuuuuu

SEQ ID NO: 1083578 - RNA, 22 nt, Human
ccacauaucuaguuauagagaa

SEQ ID NO: 1083579 - RNA, 21 nt, Human
ccacccaguggcuuggagccc

SEQ ID NO: 1083580 - RNA, 22 nt, Human
ccacccucaaggucagaaauuc

SEQ ID NO: 1083581 - RNA, 20 nt, Human
ccagucaucaagaugacauu

SEQ ID NO: 1083582 - RNA, 24 nt, Human
ccaguuaaucagaacugaggcaga

SEQ ID NO: 1083583 - RNA, 23 nt, Human
cucucacaccguaggaguggcug

SEQ ID NO: 1083584 - RNA, 27 nt, Human
cugacucaugggaaggcauaggaggag

SEQ ID NO: 1083585 - RNA, 21 nt, Human
cugggaggggucacccuggua

SEQ ID NO: 1083586 - RNA, 24 nt, Human
cuuccuggguuuuaccagccccua

SEQ ID NO: 1083587 - RNA, 24 nt, Human
gaaaaagauuuuuucuuuugugaa

SEQ ID NO: 1083588 - RNA, 19 nt, Human
gaagcaggcggggguaaua

SEQ ID NO: 1083589 - RNA, 18 nt, Human
gaaugugacuggcccagu

SEQ ID NO: 1083590 - RNA, 19 nt, Human
gccagcuucaaaguuaagg

SEQ ID NO: 1083591 - RNA, 24 nt, Human
gggaaggcauaggaggagaggccu

SEQ ID NO: 1083592 - RNA, 18 nt, Human
gucucuucagugcucugg

SEQ ID NO: 1083593 - RNA, 21 nt, Human
uaaacucgaaacuagggcugg

SEQ ID NO: 1083594 - RNA, 23 nt, Human
uaaagggaaaagaauaaagugga

SEQ ID NO: 1083595 - RNA, 21 nt, Human
uaacaauauccuuacucuggc

SEQ ID NO: 1083596 - RNA, 18 nt, Human
uaaccaagaaucagguga

SEQ ID NO: 1083597 - RNA, 23 nt, Human
uaaccaagaaucaggugaggcac

SEQ ID NO: 1083598 - RNA, 22 nt, Human
uaacccucuaaugacugacuca

SEQ ID NO: 1083599 - RNA, 20 nt, Human
uaaccugagcucauccuggc

SEQ ID NO: 1083600 - RNA, 22 nt, Human
uaaccugagcucauccuggcau

SEQ ID NO: 1083601 - RNA, 18 nt, Human
uacauugucaucucaaau

SEQ ID NO: 1083602 - RNA, 22 nt, Human
uagacguacugcauacuuccug

SEQ ID NO: 1083603 - RNA, 21 nt, Human
uauguaaacacgcuaagcuau

SEQ ID NO: 1083604 - RNA, 23 nt, Human
ucagaacugaggcagaugagcug

SEQ ID NO: 1083605 - RNA, 21 nt, Human
uccacaacagaggagggugaa

SEQ ID NO: 1083606 - RNA, 23 nt, Human
uccacaacagaggagggugaagc

SEQ ID NO: 1083607 - RNA, 18 nt, Human
uccccagagcacauugcu

SEQ ID NO: 1083608 - RNA, 20 nt, Human
uccuggguuuuaccagcccc

SEQ ID NO: 1083609 - RNA, 18 nt, Human
ucucucacaccguaggag

SEQ ID NO: 1083610 - RNA, 24 nt, Human
ucugguacucagccucuuccucau

SEQ ID NO: 1083611 - RNA, 20 nt, Human
ucuuccucauccuucuauca

SEQ ID NO: 1083612 - RNA, 26 nt, Human
ucuucuagcuguauacauugucaucu

SEQ ID NO: 1083613 - RNA, 19 nt, Human
ugacuguggaugguaaagu

SEQ ID NO: 1083614 - RNA, 18 nt, Human
ugagagagguaaugagua

SEQ ID NO: 1083615 - RNA, 23 nt, Human
ugagagagguaaugaguauuuac

SEQ ID NO: 1083616 - RNA, 19 nt, Human
ugagcagaaacaacucaua

SEQ ID NO: 1083617 - RNA, 21 nt, Human
ugaggcagguguccauuccug

SEQ ID NO: 1083618 - RNA, 20 nt, Human
ugaguaggcaacuacgccug

SEQ ID NO: 1083619 - RNA, 21 nt, Human
ugaguaggcaacuacgccugc

SEQ ID NO: 1083620 - RNA, 20 nt, Human
ugaucaugugcucuacuggg

SEQ ID NO: 1083621 - RNA, 19 nt, Human
ugcaaaaaugaauauaaca

SEQ ID NO: 1083622 - RNA, 24 nt, Human
uggaagcaggcggggguaauauuc

SEQ ID NO: 1083623 - RNA, 22 nt, Human
uggaauuucagauuuucaguag

SEQ ID NO: 1083624 - RNA, 21 nt, Human
uggaugguaaaguugaaucuc

SEQ ID NO: 1083625 - RNA, 19 nt, Human
uggcuccuggagcuccagu

SEQ ID NO: 1083626 - RNA, 23 nt, Human
ugggaaggcauaggaggagaggc

SEQ ID NO: 1083627 - RNA, 18 nt, Human
ugggaggggucacccugg

SEQ ID NO: 1083628 - RNA, 20 nt, Human
ugggaggggucacccuggua

SEQ ID NO: 1083629 - RNA, 19 nt, Human
uggggggaauuuuauuuac

SEQ ID NO: 1083630 - RNA, 20 nt, Human
uguagaaaguuucagggcua

SEQ ID NO: 1083631 - RNA, 28 nt, Human
uguauguaaacacgcuaagcuaugaccc

SEQ ID NO: 1083632 - RNA, 23 nt, Human
ugucaugagcuuucuccccagag

SEQ ID NO: 1083633 - RNA, 20 nt, Human
uuaaggugguuuaaacaaga

SEQ ID NO: 1083634 - RNA, 25 nt, Human
uuaauacuaaccccaccucuaagug

SEQ ID NO: 1083635 - RNA, 24 nt, Human
uucauuguaguugcuaaauauugg

SEQ ID NO: 1083636 - RNA, 25 nt, Human
uugacuuuucuuucacagaagcagu

SEQ ID NO: 1083637 - RNA, 22 nt, Human
uuggcuggaaccuagcucucca

SEQ ID NO: 1083638 - RNA, 21 nt, Human
uugugccaaacauuaacccuc

SEQ ID NO: 1083639 - RNA, 23 nt, Human
uuuaccagccccuaaauuuacuc

SEQ ID NO: 1083640 - RNA, 19 nt, Human
uuuauuuaccaaagaccua

SEQ ID NO: 1083641 - RNA, 24 nt, Human
aaaaaagaaacugagggucagaga

SEQ ID NO: 1083642 - RNA, 21 nt, Human
aaaaagccuaauaaagcaagg

SEQ ID NO: 1083643 - RNA, 19 nt, Human
aaaacacaacuccaaauau

SEQ ID NO: 1083644 - RNA, 21 nt, Human
aaagcacacaucccugugcua

SEQ ID NO: 1083645 - RNA, 20 nt, Human
aaccuguuccuucagcaccu

SEQ ID NO: 1083646 - RNA, 22 nt, Human
acacacacacgcacaugcauac

SEQ ID NO: 1083647 - RNA, 25 nt, Human
acacccuuacaagaugcacagccac

SEQ ID NO: 1083648 - RNA, 19 nt, Human
accaggcaucucugcucac

SEQ ID NO: 1083649 - RNA, 19 nt, Human
accagguagcugcaaccug

SEQ ID NO: 1083650 - RNA, 19 nt, Human
acccaucacuggcccagac

SEQ ID NO: 1083651 - RNA, 20 nt, Human
acccugaaaggaaaaaaaga

SEQ ID NO: 1083652 - RNA, 23 nt, Human
acccugagcacuccaagagacag

SEQ ID NO: 1083653 - RNA, 30 nt, Human
acugguacguaucccaguccuucccacacc

SEQ ID NO: 1083654 - RNA, 19 nt, Human
agaagagagacaacuugcu

SEQ ID NO: 1083655 - RNA, 19 nt, Human
agagagccuggggcugaag

SEQ ID NO: 1083656 - RNA, 19 nt, Human
agagcacuuccaaaugcau

SEQ ID NO: 1083657 - RNA, 22 nt, Human
agagcagaggagggugauuuug

SEQ ID NO: 1083658 - RNA, 19 nt, Human
agaguagacuagagcccag

SEQ ID NO: 1083659 - RNA, 26 nt, Human
agccaccaaaaagccuaauaaagcaa

SEQ ID NO: 1083660 - RNA, 22 nt, Human
agccuuggaaaggcaaagcagg

SEQ ID NO: 1083661 - RNA, 30 nt, Human
agcgcaugucgcacgcacacacacacgcag

SEQ ID NO: 1083662 - RNA, 21 nt, Human
agcugcucuuccccgucuccu

SEQ ID NO: 1083663 - RNA, 19 nt, Human
aggcaggaauccagguggg

SEQ ID NO: 1083664 - RNA, 21 nt, Human
agggcuggcaaagggcccgcc

SEQ ID NO: 1083665 - RNA, 18 nt, Human
agggguggaacucacuuc

SEQ ID NO: 1083666 - RNA, 21 nt, Human
aggucucuggacucccagucc

SEQ ID NO: 1083667 - RNA, 19 nt, Human
agguggggcaccaggcauc

SEQ ID NO: 1083668 - RNA, 21 nt, Human
agguggggcaccaggcaucuc

SEQ ID NO: 1083669 - RNA, 19 nt, Human
agguguggauguuccaacc

SEQ ID NO: 1083670 - RNA, 23 nt, Human
aucaaggaggcucuccaggcucc

SEQ ID NO: 1083671 - RNA, 22 nt, Human
aucaguccagugccagccuuug

SEQ ID NO: 1083672 - RNA, 19 nt, Human
aucccaguccuucccacac

SEQ ID NO: 1083673 - RNA, 22 nt, Human
aucuucccaacuggugucagcu

SEQ ID NO: 1083674 - RNA, 23 nt, Human
caaaagcacacaucccugugcua

SEQ ID NO: 1083675 - RNA, 24 nt, Human
caaagggcccgccacccugagcac

SEQ ID NO: 1083676 - RNA, 30 nt, Human
caagcgcaugucgcacgcacacacacagug

SEQ ID NO: 1083677 - RNA, 22 nt, Human
cacaugcauacacacccuuaca

SEQ ID NO: 1083678 - RNA, 20 nt, Human
caccaggcaucucugcucac

SEQ ID NO: 1083679 - RNA, 23 nt, Human
caccuuggcugcugguggugggg

SEQ ID NO: 1083680 - RNA, 26 nt, Human
cacgcacacacacacgcacaugcaua

SEQ ID NO: 1083681 - RNA, 23 nt, Human
cacugugugugcccucagcaaac

SEQ ID NO: 1083682 - RNA, 26 nt, Human
cagcucccuccuuccagauccugccu

SEQ ID NO: 1083683 - RNA, 25 nt, Human
ccccaaacccaucacuggcccagac

SEQ ID NO: 1083684 - RNA, 26 nt, Human
cccccaaacccaucacuggcccagac

SEQ ID NO: 1083685 - RNA, 27 nt, Human
cccuggggaaagggugaggggcgcugc

SEQ ID NO: 1083686 - RNA, 19 nt, Human
cccugugcuauuccccuuc

SEQ ID NO: 1083687 - RNA, 20 nt, Human
cccugugcuauuccccuuca

SEQ ID NO: 1083688 - RNA, 21 nt, Human
cccuuacaagaugcacagcca

SEQ ID NO: 1083689 - RNA, 23 nt, Human
ccgacuagccuuggaaaggcaaa

SEQ ID NO: 1083690 - RNA, 21 nt, Human
ccuauucuucccccaaaccca

SEQ ID NO: 1083691 - RNA, 25 nt, Human
ccucccagagaaugcuucacacccu

SEQ ID NO: 1083692 - RNA, 21 nt, Human
ccucuguguaggccccagucu

SEQ ID NO: 1083693 - RNA, 24 nt, Human
ccugcugucucacugggucauuug

SEQ ID NO: 1083694 - RNA, 20 nt, Human
ccugugaccugggacaggau

SEQ ID NO: 1083695 - RNA, 21 nt, Human
ccugugauuccagcuccuuuc

SEQ ID NO: 1083696 - RNA, 25 nt, Human
cgcacacacacacgcacaugcauac

SEQ ID NO: 1083697 - RNA, 25 nt, Human
cgcacgcacacacacacgcacaugc

SEQ ID NO: 1083698 - RNA, 25 nt, Human
cgcacgcacacacacacgcacaugg

SEQ ID NO: 1083699 - RNA, 20 nt, Human
cuagagcccaggucucugga

SEQ ID NO: 1083700 - RNA, 19 nt, Human
cuccaggcucccugccggc

SEQ ID NO: 1083701 - RNA, 21 nt, Human
cuccuggagcugcucuucccc

SEQ ID NO: 1083702 - RNA, 22 nt, Human
cuccuugcugccuugcugucau

SEQ ID NO: 1083703 - RNA, 21 nt, Human
cucuuccccgucuccuugcug

SEQ ID NO: 1083704 - RNA, 18 nt, Human
cuggcagggucggggugg

SEQ ID NO: 1083705 - RNA, 20 nt, Human
cuggcccagacaucaaaagc

SEQ ID NO: 1083706 - RNA, 18 nt, Human
cugggacugggcuccacu

SEQ ID NO: 1083707 - RNA, 18 nt, Human
cugggcagcucccuccuu

SEQ ID NO: 1083708 - RNA, 19 nt, Human
cugguacguaucccagucc

SEQ ID NO: 1083709 - RNA, 24 nt, Human
cugguacguaucccaguccuuccc

SEQ ID NO: 1083710 - RNA, 20 nt, Human
cuggugguggggugccugcc

SEQ ID NO: 1083711 - RNA, 21 nt, Human
cuucuuuguccucuguguccc

SEQ ID NO: 1083712 - RNA, 21 nt, Human
cuuugccucacucuuucuucc

SEQ ID NO: 1083713 - RNA, 18 nt, Human
cuuugccucccagagaau

SEQ ID NO: 1083714 - RNA, 24 nt, Human
gaauggggugugagagacuccccc

SEQ ID NO: 1083715 - RNA, 19 nt, Human
gaccacgguucaggauccg

SEQ ID NO: 1083716 - RNA, 26 nt, Human
gagcccaggucucuggacucccaguc

SEQ ID NO: 1083717 - RNA, 19 nt, Human
gccggccuucggcuccugg

SEQ ID NO: 1083718 - RNA, 21 nt, Human
gccugugcugugcaugcugca

SEQ ID NO: 1083719 - RNA, 23 nt, Human
gcgguggggcugcgaguacccag

SEQ ID NO: 1083720 - RNA, 20 nt, Human
gcugcuggugguggggugcc

SEQ ID NO: 1083721 - RNA, 19 nt, Human
gcugucaugucaccugcug

SEQ ID NO: 1083722 - RNA, 18 nt, Human
ggaaaauaaaacacaacu

SEQ ID NO: 1083723 - RNA, 19 nt, Human
ggcagcucccuccuuccag

SEQ ID NO: 1083724 - RNA, 21 nt, Human
ggcuccugggguggagguggg

SEQ ID NO: 1083725 - RNA, 21 nt, Human
gggaggagcaggagcucagag

SEQ ID NO: 1083726 - RNA, 19 nt, Human
ggggaaagggugagggcug

SEQ ID NO: 1083727 - RNA, 19 nt, Human
ggucggggugggggcacca

SEQ ID NO: 1083728 - RNA, 21 nt, Human
guccaggcccagcgccuucca

SEQ ID NO: 1083729 - RNA, 24 nt, Human
guccaggcccagcgccuuccaguc

SEQ ID NO: 1083730 - RNA, 19 nt, Human
guggaauauacaugccugc

SEQ ID NO: 1083731 - RNA, 25 nt, Human
guuccuucagcaccugggaggagac

SEQ ID NO: 1083732 - RNA, 20 nt, Human
uaaagcaaggugcccaagac

SEQ ID NO: 1083733 - RNA, 22 nt, Human
uaaagcaaggugcccaagacca

SEQ ID NO: 1083734 - RNA, 26 nt, Human
uaacccugaaaggaaaaaaagaugau

SEQ ID NO: 1083735 - RNA, 19 nt, Human
uaagaacuugggucugaga

SEQ ID NO: 1083736 - RNA, 23 nt, Human
uacguaucccaguccuucccaca

SEQ ID NO: 1083737 - RNA, 18 nt, Human
uagacuagagcccagguc

SEQ ID NO: 1083738 - RNA, 21 nt, Human
ucacuccacaaaaaagaaacu

SEQ ID NO: 1083739 - RNA, 26 nt, Human
ucacuggcccagacaucaaaagcaca

SEQ ID NO: 1083740 - RNA, 21 nt, Human
ucacugggucauuugggcgug

SEQ ID NO: 1083741 - RNA, 22 nt, Human
ucacugggucauuugggcgugu

SEQ ID NO: 1083742 - RNA, 20 nt, Human
ucagagaagagagacaacuu

SEQ ID NO: 1083743 - RNA, 19 nt, Human
ucagcucgaaacccucugu

SEQ ID NO: 1083744 - RNA, 20 nt, Human
ucccaccucugcacuuugcc

SEQ ID NO: 1083745 - RNA, 21 nt, Human
ucccagagaaugcuucacacc

SEQ ID NO: 1083746 - RNA, 21 nt, Human
ucccaguccugugcucucuca

SEQ ID NO: 1083747 - RNA, 21 nt, Human
ucccccaaacccaucacuggc

SEQ ID NO: 1083748 - RNA, 24 nt, Human
ucccugaagccaaauguuucuucu

SEQ ID NO: 1083749 - RNA, 19 nt, Human
ucccuggggaaagggugag

SEQ ID NO: 1083750 - RNA, 22 nt, Human
ucccuggggaaagggugagggc

SEQ ID NO: 1083751 - RNA, 28 nt, Human
ucccuggggaaagggugaggggcgcugc

SEQ ID NO: 1083752 - RNA, 19 nt, Human
ucccuguucuccaccccau

SEQ ID NO: 1083753 - RNA, 21 nt, Human
ucuccaggcucccugccggcc

SEQ ID NO: 1083754 - RNA, 23 nt, Human
ucucugcucaccuuggcugcugg

SEQ ID NO: 1083755 - RNA, 18 nt, Human
ucucuggacucccagucc

SEQ ID NO: 1083756 - RNA, 18 nt, Human
ucugaauucagcauagag

SEQ ID NO: 1083757 - RNA, 20 nt, Human
ucugcacuuugccucacucu

SEQ ID NO: 1083758 - RNA, 23 nt, Human
ucuguggucugcagugcucagcc

SEQ ID NO: 1083759 - RNA, 18 nt, Human
ugaagccaaauguuucuu

SEQ ID NO: 1083760 - RNA, 19 nt, Human
ugaagggugggaggaaaga

SEQ ID NO: 1083761 - RNA, 20 nt, Human
ugacccgagucacagaguag

SEQ ID NO: 1083762 - RNA, 23 nt, Human
ugacuccuggagcugcucuuccc

SEQ ID NO: 1083763 - RNA, 21 nt, Human
ugagggucagagaagagagac

SEQ ID NO: 1083764 - RNA, 21 nt, Human
ugagggucuuguccaaggcua

SEQ ID NO: 1083765 - RNA, 18 nt, Human
ugcacagccaccaaaaag

SEQ ID NO: 1083766 - RNA, 24 nt, Human
ugccucacucuuucuuccugccca

SEQ ID NO: 1083767 - RNA, 22 nt, Human
ugccugugcugugcaugcugca

SEQ ID NO: 1083768 - RNA, 23 nt, Human
ugcucaaggccauuugauuggag

SEQ ID NO: 1083769 - RNA, 20 nt, Human
ugcugcagcuuuggcagggu

SEQ ID NO: 1083770 - RNA, 25 nt, Human
ugcuucacacccuauucuuccccca

SEQ ID NO: 1083771 - RNA, 22 nt, Human
uggaaaauaaaacacaacucca

SEQ ID NO: 1083772 - RNA, 21 nt, Human
uggaauauacaugccugccuc

SEQ ID NO: 1083773 - RNA, 21 nt, Human
ugggaggaaagagccuggugg

SEQ ID NO: 1083774 - RNA, 23 nt, Human
ugggaggagacacagagucuggu

SEQ ID NO: 1083775 - RNA, 20 nt, Human
ugggguggaggugggcgugg

SEQ ID NO: 1083776 - RNA, 23 nt, Human
ugggguggaggugggcguggggu

SEQ ID NO: 1083777 - RNA, 22 nt, Human
uggggugugagagacuccccug

SEQ ID NO: 1083778 - RNA, 24 nt, Human
ugguggggugccugccugugcugu

SEQ ID NO: 1083779 - RNA, 19 nt, Human
uggugucagcucgaaaccc

SEQ ID NO: 1083780 - RNA, 19 nt, Human
ugucaaacucuggucugug

SEQ ID NO: 1083781 - RNA, 19 nt, Human
ugucaugucaccugcuguc

SEQ ID NO: 1083782 - RNA, 21 nt, Human
ugucaugucaccugcugucuc

SEQ ID NO: 1083783 - RNA, 19 nt, Human
ugugagagacuccccuggg

SEQ ID NO: 1083784 - RNA, 27 nt, Human
ugugcuauuccccuucaaagagcuuca

SEQ ID NO: 1083785 - RNA, 21 nt, Human
uguggucugcagugcucagcc

SEQ ID NO: 1083786 - RNA, 24 nt, Human
ugugugcccucagcaaacaaggca

SEQ ID NO: 1083787 - RNA, 19 nt, Human
uuccaggucugggcagcuc

SEQ ID NO: 1083788 - RNA, 21 nt, Human
uuccccuucaaagagcuucau

SEQ ID NO: 1083789 - RNA, 22 nt, Human
uucccugaagccaaauguuucu

SEQ ID NO: 1083790 - RNA, 19 nt, Human
uucccuuuaagaacuuggg

SEQ ID NO: 1083791 - RNA, 22 nt, Human
uucuucuuuguccucugugucc

SEQ ID NO: 1083792 - RNA, 23 nt, Human
uucuucuuuguccucuguguccc

SEQ ID NO: 1083793 - RNA, 19 nt, Human
uugccugacuccuggagcu

SEQ ID NO: 1083794 - RNA, 19 nt, Human
uugcucaaggccauuugau

SEQ ID NO: 1083795 - RNA, 21 nt, Human
uugcugucaugucaccugcug

SEQ ID NO: 1083796 - RNA, 25 nt, Human
uugggcgugugccccucgcacgccu

SEQ ID NO: 1083797 - RNA, 22 nt, Human
uuuuucuccuucccuguucucc

SEQ ID NO: 1083798 - RNA, 22 nt, Human
aaaacaggagucgagacccagg

SEQ ID NO: 1083799 - RNA, 22 nt, Human
acugcaaugggaaccgcagaac

SEQ ID NO: 1083800 - RNA, 22 nt, Human
agagagggcggacgggggccga

SEQ ID NO: 1083801 - RNA, 19 nt, Human
agagugcaguuggccaacu

SEQ ID NO: 1083802 - RNA, 18 nt, Human
aggccgccgagcagggag

SEQ ID NO: 1083803 - RNA, 19 nt, Human
aggccucggggcugggggc

SEQ ID NO: 1083804 - RNA, 22 nt, Human
aggccucggggcugggggcaac

SEQ ID NO: 1083805 - RNA, 23 nt, Human
aggucuccugcaugauaauaccu

SEQ ID NO: 1083806 - RNA, 20 nt, Human
aucucccuccagcccugaca

SEQ ID NO: 1083807 - RNA, 23 nt, Human
auuccagaaagcucuccaagggu

SEQ ID NO: 1083808 - RNA, 21 nt, Human
auuuaguuuucccaagccaag

SEQ ID NO: 1083809 - RNA, 18 nt, Human
cacccgguucccgggggc

SEQ ID NO: 1083810 - RNA, 21 nt, Human
cacuuccgcggagguccugcc

SEQ ID NO: 1083811 - RNA, 23 nt, Human
cagccucugcagagugugccccc

SEQ ID NO: 1083812 - RNA, 28 nt, Human
ccagaaagcucuccaagggucaaacacc

SEQ ID NO: 1083813 - RNA, 24 nt, Human
cccccaagagucuguggcagugga

SEQ ID NO: 1083814 - RNA, 22 nt, Human
ccccccgccgccccgccugggc

SEQ ID NO: 1083815 - RNA, 18 nt, Human
cccccgccgccccgccug

SEQ ID NO: 1083816 - RNA, 19 nt, Human
cccgccgccccgccugggc

SEQ ID NO: 1083817 - RNA, 19 nt, Human
cccggugcugcugcggccg

SEQ ID NO: 1083818 - RNA, 19 nt, Human
cccgguucccgggggcggg

SEQ ID NO: 1083819 - RNA, 22 nt, Human
ccgccccgccugggccuccaag

SEQ ID NO: 1083820 - RNA, 22 nt, Human
ccgcccggugcugcugcggccg

SEQ ID NO: 1083821 - RNA, 24 nt, Human
ccgcccggugcugcugcggccgcg

SEQ ID NO: 1083822 - RNA, 24 nt, Human
ccgccgccccgccugggccuccaa

SEQ ID NO: 1083823 - RNA, 23 nt, Human
ccuccagaugaaccugagcucac

SEQ ID NO: 1083824 - RNA, 22 nt, Human
ccuccagaugaaccugagcucu

SEQ ID NO: 1083825 - RNA, 21 nt, Human
ccuccccacuuuccuucccug

SEQ ID NO: 1083826 - RNA, 21 nt, Human
ccucggggcugggggcaggcg

SEQ ID NO: 1083827 - RNA, 20 nt, Human
ccugccgcgucgccccccgc

SEQ ID NO: 1083828 - RNA, 24 nt, Human
ccugggccuccaaggggccaggaa

SEQ ID NO: 1083829 - RNA, 18 nt, Human
cgccccccgccgccccgc

SEQ ID NO: 1083830 - RNA, 20 nt, Human
cgcccggugcugcugcggcc

SEQ ID NO: 1083831 - RNA, 22 nt, Human
cgccugggccuccaaggggcca

SEQ ID NO: 1083832 - RNA, 21 nt, Human
cgcgggagccugggcgcggag

SEQ ID NO: 1083833 - RNA, 19 nt, Human
cggccguacgcgggcagcg

SEQ ID NO: 1083834 - RNA, 20 nt, Human
cggugcugcugcggccgcga

SEQ ID NO: 1083835 - RNA, 22 nt, Human
cuaggagacaagcgccacuucc

SEQ ID NO: 1083836 - RNA, 21 nt, Human
cuccagaugaaccugagcucc

SEQ ID NO: 1083837 - RNA, 18 nt, Human
cugcaucuccucucugcc

SEQ ID NO: 1083838 - RNA, 22 nt, Human
cugcaucuccucucugccuguu

SEQ ID NO: 1083839 - RNA, 21 nt, Human
cugcaugauaauaccugggcu

SEQ ID NO: 1083840 - RNA, 21 nt, Human
cugccgccgccuccagagugc

SEQ ID NO: 1083841 - RNA, 18 nt, Human
gagacccaggugaagggg

SEQ ID NO: 1083842 - RNA, 22 nt, Human
gagacccaggugaagggggcca

SEQ ID NO: 1083843 - RNA, 21 nt, Human
gcagcgcggacagcaucccgc

SEQ ID NO: 1083844 - RNA, 19 nt, Human
gcaguccuccucggggucc

SEQ ID NO: 1083845 - RNA, 18 nt, Human
gccaggaagggucggccc

SEQ ID NO: 1083846 - RNA, 22 nt, Human
gccgcgaccccaaagugggaac

SEQ ID NO: 1083847 - RNA, 22 nt, Human
gccuguuggcaacaccaggaag

SEQ ID NO: 1083848 - RNA, 24 nt, Human
gcuccguuucuggagagcccuggc

SEQ ID NO: 1083849 - RNA, 19 nt, Human
gcugggggcaggcgucucc

SEQ ID NO: 1083850 - RNA, 18 nt, Human
ggccgaggccucggggcu

SEQ ID NO: 1083851 - RNA, 23 nt, Human
gggcaguccuccucggggucccg

SEQ ID NO: 1083852 - RNA, 18 nt, Human
uaccugggcuccaacuag

SEQ ID NO: 1083853 - RNA, 19 nt, Human
uauuuaguuuucccaagcc

SEQ ID NO: 1083854 - RNA, 19 nt, Human
uccacucaggccgcggccg

SEQ ID NO: 1083855 - RNA, 21 nt, Human
uccacucaggccgcggccgua

SEQ ID NO: 1083856 - RNA, 21 nt, Human
ucccgcaugcgcguuugggcg

SEQ ID NO: 1083857 - RNA, 19 nt, Human
ucccgcccggugcugcugc

SEQ ID NO: 1083858 - RNA, 21 nt, Human
ucccgggacagccuuucccuu

SEQ ID NO: 1083859 - RNA, 18 nt, Human
ucccugugugugguauaa

SEQ ID NO: 1083860 - RNA, 22 nt, Human
ucgccuaggagacaagcgccac

SEQ ID NO: 1083861 - RNA, 19 nt, Human
ucgcuggcugccgccgccu

SEQ ID NO: 1083862 - RNA, 21 nt, Human
ucgcuggcugccgccgccucc

SEQ ID NO: 1083863 - RNA, 24 nt, Human
ucggagguggucucguguguggag

SEQ ID NO: 1083864 - RNA, 22 nt, Human
ucucaagaucucccuccagccc

SEQ ID NO: 1083865 - RNA, 21 nt, Human
ucugccuguuggcaacaccag

SEQ ID NO: 1083866 - RNA, 19 nt, Human
ugaagggggccagccccuc

SEQ ID NO: 1083867 - RNA, 19 nt, Human
ugaucucaagaucucccuc

SEQ ID NO: 1083868 - RNA, 21 nt, Human
ugcugcggccgcgaccccaaa

SEQ ID NO: 1083869 - RNA, 23 nt, Human
uggcugcaucuccucucugccug

SEQ ID NO: 1083870 - RNA, 20 nt, Human
uggcugccgccgccuccaga

SEQ ID NO: 1083871 - RNA, 20 nt, Human
ugggcgcggagaccccugcc

SEQ ID NO: 1083872 - RNA, 25 nt, Human
ugggggcaggcgucuccacucaggc

SEQ ID NO: 1083873 - RNA, 18 nt, Human
uguguggagcagagcgag

SEQ ID NO: 1083874 - RNA, 23 nt, Human
uuagaugggcuccguuucuggag

SEQ ID NO: 1083875 - RNA, 18 nt, Human
uuccugagcuucuggggg

SEQ ID NO: 1083876 - RNA, 21 nt, Human
uugaggccgagcccauccgcu

SEQ ID NO: 1083877 - RNA, 20 nt, Human
uuggcccguuugaaaugcgc

SEQ ID NO: 1083878 - RNA, 23 nt, Human
uuuccugagcuucugggggguca

SEQ ID NO: 1083879 - RNA, 19 nt, Human
uuucuugaaauccagaagc

SEQ ID NO: 1083880 - RNA, 18 nt, Human
aacuccuagcccaguccc

SEQ ID NO: 1083881 - RNA, 19 nt, Human
aagcaagagguggcccugg

SEQ ID NO: 1083882 - RNA, 24 nt, Human
aagcggcggcaaccgaggcgagca

SEQ ID NO: 1083883 - RNA, 24 nt, Human
aaguccccucccagaucugugacc

SEQ ID NO: 1083884 - RNA, 20 nt, Human
acagucccagaagggcccag

SEQ ID NO: 1083885 - RNA, 22 nt, Human
acccucccuguccucuccuggu

SEQ ID NO: 1083886 - RNA, 21 nt, Human
acccugauguccccaauucca

SEQ ID NO: 1083887 - RNA, 21 nt, Human
accuaugcaaccugcagcccc

SEQ ID NO: 1083888 - RNA, 22 nt, Human
acugaguccuggagguggucgu

SEQ ID NO: 1083889 - RNA, 18 nt, Human
acuugcaugacacuuccc

SEQ ID NO: 1083890 - RNA, 20 nt, Human
acuugcaugacacuucccuc

SEQ ID NO: 1083891 - RNA, 19 nt, Human
agaaagacaauaggcugcc

SEQ ID NO: 1083892 - RNA, 20 nt, Human
agaacccucccuguccucuc

SEQ ID NO: 1083893 - RNA, 22 nt, Human
agaacccucccuguccucuccu

SEQ ID NO: 1083894 - RNA, 20 nt, Human
agaagagggaagccgggggg

SEQ ID NO: 1083895 - RNA, 19 nt, Human
agagagggagggggguggg

SEQ ID NO: 1083896 - RNA, 18 nt, Human
agagaggggccucuggcg

SEQ ID NO: 1083897 - RNA, 21 nt, Human
agaggccaguguguguggggu

SEQ ID NO: 1083898 - RNA, 20 nt, Human
agagggaagccggggggguu

SEQ ID NO: 1083899 - RNA, 26 nt, Human
agagggaggggggugggaaucugagc

SEQ ID NO: 1083900 - RNA, 21 nt, Human
agcagacucacggaccuuggc

SEQ ID NO: 1083901 - RNA, 22 nt, Human
agccuccccugcuccugccugc

SEQ ID NO: 1083902 - RNA, 23 nt, Human
agcuucucccuccaucuuccucc

SEQ ID NO: 1083903 - RNA, 19 nt, Human
aggagcagaggcgagucug

SEQ ID NO: 1083904 - RNA, 21 nt, Human
aggcagccagggcuggcagag

SEQ ID NO: 1083905 - RNA, 20 nt, Human
aggcgagcagugggcacggc

SEQ ID NO: 1083906 - RNA, 25 nt, Human
agggaagccgggggggucaggagcc

SEQ ID NO: 1083907 - RNA, 19 nt, Human
agggaggggggugggaauc

SEQ ID NO: 1083908 - RNA, 19 nt, Human
agggcuggcagagccugcc

SEQ ID NO: 1083909 - RNA, 18 nt, Human
agucugagccaugcugcc

SEQ ID NO: 1083910 - RNA, 24 nt, Human
aucuuccuccccuuucccuuccaa

SEQ ID NO: 1083911 - RNA, 22 nt, Human
caaccgaggcgagcagugggca

SEQ ID NO: 1083912 - RNA, 19 nt, Human
caacuccuagcccaguccc

SEQ ID NO: 1083913 - RNA, 25 nt, Human
caaggacacacagcccccuucccuc

SEQ ID NO: 1083914 - RNA, 22 nt, Human
cacagacucacccccacucucu

SEQ ID NO: 1083915 - RNA, 21 nt, Human
caccccaccugagggcucuac

SEQ ID NO: 1083916 - RNA, 21 nt, Human
caccccgcgcaccggcuacaa

SEQ ID NO: 1083917 - RNA, 19 nt, Human
caccgugcggcucccgggg

SEQ ID NO: 1083918 - RNA, 20 nt, Human
caccgugcggcucccggggc

SEQ ID NO: 1083919 - RNA, 25 nt, Human
caccugagggcucuacucaccccgc

SEQ ID NO: 1083920 - RNA, 23 nt, Human
caccugugcuauucagccaagga

SEQ ID NO: 1083921 - RNA, 21 nt, Human
cacgcaagagggcaguaacgu

SEQ ID NO: 1083922 - RNA, 20 nt, Human
cacucucuggggcuggggcc

SEQ ID NO: 1083923 - RNA, 20 nt, Human
cacugaguccuggagguggu

SEQ ID NO: 1083924 - RNA, 23 nt, Human
cagaagagggaagccgggggggu

SEQ ID NO: 1083925 - RNA, 22 nt, Human
cagcacacccaagcuccugggc

SEQ ID NO: 1083926 - RNA, 22 nt, Human
cagcagcggcugcggcuaaagc

SEQ ID NO: 1083927 - RNA, 19 nt, Human
cagcccccaggcacuaccu

SEQ ID NO: 1083928 - RNA, 23 nt, Human
cauccuccauuccguccaacucc

SEQ ID NO: 1083929 - RNA, 20 nt, Human
caucuagcuaccugcccucc

SEQ ID NO: 1083930 - RNA, 23 nt, Human
caugacacuucccucuauuuuca

SEQ ID NO: 1083931 - RNA, 21 nt, Human
caugcaaggacacacagcccc

SEQ ID NO: 1083932 - RNA, 19 nt, Human
ccaaaaagaauggcaugca

SEQ ID NO: 1083933 - RNA, 23 nt, Human
ccaaacacagacucacccccacu

SEQ ID NO: 1083934 - RNA, 19 nt, Human
ccaccgugcggcucccggg

SEQ ID NO: 1083935 - RNA, 23 nt, Human
ccagccccucuuuuccaggaacc

SEQ ID NO: 1083936 - RNA, 20 nt, Human
ccagcucccagccugggagu

SEQ ID NO: 1083937 - RNA, 21 nt, Human
ccaggaaccuugccacgccca

SEQ ID NO: 1083938 - RNA, 23 nt, Human
ccagggucccuucaguggacccu

SEQ ID NO: 1083939 - RNA, 21 nt, Human
ccagguaccaucacagcugcu

SEQ ID NO: 1083940 - RNA, 18 nt, Human
ccaguguguguggggugg

SEQ ID NO: 1083941 - RNA, 21 nt, Human
ccaucuuccuccccuuucccu

SEQ ID NO: 1083942 - RNA, 18 nt, Human
cccaagcaagagguggcc

SEQ ID NO: 1083943 - RNA, 23 nt, Human
cccaccugagggcucuacucacc

SEQ ID NO: 1083944 - RNA, 20 nt, Human
ccccagggaucacugagucc

SEQ ID NO: 1083945 - RNA, 22 nt, Human
cccgcgcaccggcuacaagccg

SEQ ID NO: 1083946 - RNA, 24 nt, Human
cccuccaucuuccuccccuuuccc

SEQ ID NO: 1083947 - RNA, 21 nt, Human
cccucuuuuccaggaaccuug

SEQ ID NO: 1083948 - RNA, 21 nt, Human
cccugccuuccccaggguccc

SEQ ID NO: 1083949 - RNA, 21 nt, Human
cccugcuccugccugcccacc

SEQ ID NO: 1083950 - RNA, 18 nt, Human
cccugggccaguggguug

SEQ ID NO: 1083951 - RNA, 22 nt, Human
cccuuccagccccucuuuucca

SEQ ID NO: 1083952 - RNA, 22 nt, Human
ccuccccuuucccuuccagccc

SEQ ID NO: 1083953 - RNA, 19 nt, Human
ccucccuguccucuccugg

SEQ ID NO: 1083954 - RNA, 24 nt, Human
ccuccuucccagguaccaucacag

SEQ ID NO: 1083955 - RNA, 19 nt, Human
ccucuggcuucuucuggga

SEQ ID NO: 1083956 - RNA, 22 nt, Human
ccugcccucccugccuucccca

SEQ ID NO: 1083957 - RNA, 21 nt, Human
ccugggcuacuggggcuccua

SEQ ID NO: 1083958 - RNA, 21 nt, Human
ccuuucuucucgcuguccucc

SEQ ID NO: 1083959 - RNA, 19 nt, Human
cgaggcgagcagugggcac

SEQ ID NO: 1083960 - RNA, 19 nt, Human
cgagggccuucaccgcugc

SEQ ID NO: 1083961 - RNA, 24 nt, Human
cgcccggggguggccggggcacgc

SEQ ID NO: 1083962 - RNA, 22 nt, Human
cgcggagaaagacaauaggcug

SEQ ID NO: 1083963 - RNA, 21 nt, Human
cgcugcagcuucuccauggcc

SEQ ID NO: 1083964 - RNA, 22 nt, Human
cgcugcagcuucuccauggccc

SEQ ID NO: 1083965 - RNA, 20 nt, Human
cggccacuggaccacaggag

SEQ ID NO: 1083966 - RNA, 19 nt, Human
cggcucccggggcuccccc

SEQ ID NO: 1083967 - RNA, 26 nt, Human
cggugggucuccccaaacacagacuc

SEQ ID NO: 1083968 - RNA, 22 nt, Human
cguagccccagccaccccgcgc

SEQ ID NO: 1083969 - RNA, 23 nt, Human
cguuuuugaggagggggcugugg

SEQ ID NO: 1083970 - RNA, 23 nt, Human
cuacugaagcacuacugccagcc

SEQ ID NO: 1083971 - RNA, 23 nt, Human
cuccccaaacacagacucacccc

SEQ ID NO: 1083972 - RNA, 20 nt, Human
cucccuccaucuuccucccc

SEQ ID NO: 1083973 - RNA, 21 nt, Human
cucccucuucugcuuuuccca

SEQ ID NO: 1083974 - RNA, 22 nt, Human
cuccuagcccagucccgggggc

SEQ ID NO: 1083975 - RNA, 23 nt, Human
cuccugccugcccaccccaccug

SEQ ID NO: 1083976 - RNA, 24 nt, Human
cucuuccuuucuucucgcuguccu

SEQ ID NO: 1083977 - RNA, 23 nt, Human
cugcacguagccccagccacccc

SEQ ID NO: 1083978 - RNA, 22 nt, Human
cugcagcuucuccauggccccc

SEQ ID NO: 1083979 - RNA, 27 nt, Human
cugcccacacuuugcauuucucuuccu

SEQ ID NO: 1083980 - RNA, 19 nt, Human
cugccgccuucuguccagc

SEQ ID NO: 1083981 - RNA, 23 nt, Human
cuggaccucgguguccccaucug

SEQ ID NO: 1083982 - RNA, 24 nt, Human
cuggaucugcugugcagugggguu

SEQ ID NO: 1083983 - RNA, 26 nt, Human
cuggcagcacacccuuuguuccuccu

SEQ ID NO: 1083984 - RNA, 24 nt, Human
cuggggcuggggccgcuaccucug

SEQ ID NO: 1083985 - RNA, 21 nt, Human
cuuaaguccccucccagaucu

SEQ ID NO: 1083986 - RNA, 21 nt, Human
cuuccuuucuucucgcugucc

SEQ ID NO: 1083987 - RNA, 20 nt, Human
cuuggcggcugcccacacuu

SEQ ID NO: 1083988 - RNA, 23 nt, Human
cuuucccuuccagccccucuuuu

SEQ ID NO: 1083989 - RNA, 18 nt, Human
gaagagggaagccggggg

SEQ ID NO: 1083990 - RNA, 21 nt, Human
gacaauaggcugccucucccc

SEQ ID NO: 1083991 - RNA, 20 nt, Human
gacgaggccacugggugagc

SEQ ID NO: 1083992 - RNA, 24 nt, Human
gcaaggcagccagggcuggcagag

SEQ ID NO: 1083993 - RNA, 19 nt, Human
gcagcacacccuuuguucc

SEQ ID NO: 1083994 - RNA, 20 nt, Human
gcagccagggcuggcagagc

SEQ ID NO: 1083995 - RNA, 20 nt, Human
gccugggugcuccuggggag

SEQ ID NO: 1083996 - RNA, 23 nt, Human
gccuucaccgcugcugcuccggc

SEQ ID NO: 1083997 - RNA, 23 nt, Human
gcgacagcucugcacguagcccc

SEQ ID NO: 1083998 - RNA, 19 nt, Human
gcggcagcagcggcugcgg

SEQ ID NO: 1083999 - RNA, 22 nt, Human
gcggcucccggggcucccccgc

SEQ ID NO: 1084000 - RNA, 20 nt, Human
gcuccgcgacagcucugcac

SEQ ID NO: 1084001 - RNA, 23 nt, Human
gcugcagcuucuccauggccccc

SEQ ID NO: 1084002 - RNA, 18 nt, Human
gcugcccacacuuugcau

SEQ ID NO: 1084003 - RNA, 20 nt, Human
gcuggcagagccugcccccc

SEQ ID NO: 1084004 - RNA, 21 nt, Human
gcugggucccuggccagcgcu

SEQ ID NO: 1084005 - RNA, 18 nt, Human
ggaaccuugccacgccca

SEQ ID NO: 1084006 - RNA, 21 nt, Human
ggaaccuugccacgcccacac

SEQ ID NO: 1084007 - RNA, 18 nt, Human
ggaggggggugggaaucu

SEQ ID NO: 1084008 - RNA, 18 nt, Human
ggcacuggcuccagcgga

SEQ ID NO: 1084009 - RNA, 21 nt, Human
ggcagccagggcuggcagagc

SEQ ID NO: 1084010 - RNA, 22 nt, Human
ggccacugggugagccaggggc

SEQ ID NO: 1084011 - RNA, 20 nt, Human
ggcccggugggucuccccaa

SEQ ID NO: 1084012 - RNA, 18 nt, Human
ggcggcggcagcagcggc

SEQ ID NO: 1084013 - RNA, 21 nt, Human
gggaagccggggggguugagc

SEQ ID NO: 1084014 - RNA, 19 nt, Human
gggaaucugagcacagugc

SEQ ID NO: 1084015 - RNA, 23 nt, Human
gggcuacuggggcuccuagaguc

SEQ ID NO: 1084016 - RNA, 19 nt, Human
gggcucgucccaccugccg

SEQ ID NO: 1084017 - RNA, 22 nt, Human
ggggagguggaucuuccagucg

SEQ ID NO: 1084018 - RNA, 21 nt, Human
ggggcuccuagagugggcuca

SEQ ID NO: 1084019 - RNA, 20 nt, Human
ggggcuggggccgcuaccuc

SEQ ID NO: 1084020 - RNA, 23 nt, Human
ggucugaacuguggguggacugc

SEQ ID NO: 1084021 - RNA, 23 nt, Human
gucuuuuccucuggaccucggug

SEQ ID NO: 1084022 - RNA, 19 nt, Human
guucaagcaguguuccuuc

SEQ ID NO: 1084023 - RNA, 26 nt, Human
guuggaagauggggugaccacagaag

SEQ ID NO: 1084024 - RNA, 24 nt, Human
uagcuucucccuccaucuuccucc

SEQ ID NO: 1084025 - RNA, 20 nt, Human
uaggauaaaagccugagagu

SEQ ID NO: 1084026 - RNA, 25 nt, Human
uaggcugccucucccccggcggcgg

SEQ ID NO: 1084027 - RNA, 22 nt, Human
uaggucuuaaguccccucccag

SEQ ID NO: 1084028 - RNA, 20 nt, Human
ucagagagagggaggggggu

SEQ ID NO: 1084029 - RNA, 21 nt, Human
ucaguggacccugggcuuucu

SEQ ID NO: 1084030 - RNA, 19 nt, Human
uccacgcuaucagugaggc

SEQ ID NO: 1084031 - RNA, 27 nt, Human
uccagcgcacagucccagaagggcccc

SEQ ID NO: 1084032 - RNA, 22 nt, Human
uccccaaacacagacucacccc

SEQ ID NO: 1084033 - RNA, 23 nt, Human
ucccccgcgggccgagccgagac

SEQ ID NO: 1084034 - RNA, 21 nt, Human
uccccuuucccuuccagcccc

SEQ ID NO: 1084035 - RNA, 20 nt, Human
ucccggggcucccccgcggg

SEQ ID NO: 1084036 - RNA, 22 nt, Human
ucccugccuuccccaggguccc

SEQ ID NO: 1084037 - RNA, 19 nt, Human
uccggccacuggaccacag

SEQ ID NO: 1084038 - RNA, 21 nt, Human
uccggccacuggaccacagga

SEQ ID NO: 1084039 - RNA, 21 nt, Human
ucgcugcagcuucuccauggc

SEQ ID NO: 1084040 - RNA, 18 nt, Human
ucuacucaccacccugcu

SEQ ID NO: 1084041 - RNA, 23 nt, Human
ucuccccaaacacagacucaccc

SEQ ID NO: 1084042 - RNA, 21 nt, Human
ucucccucuucugcuuuuccc

SEQ ID NO: 1084043 - RNA, 22 nt, Human
ucugcuuuucccagcaggaagg

SEQ ID NO: 1084044 - RNA, 20 nt, Human
ucugucaggcuugguggcug

SEQ ID NO: 1084045 - RNA, 21 nt, Human
ucugucaggcuugguggcugu

SEQ ID NO: 1084046 - RNA, 22 nt, Human
ugaccacagaagagggaagccg

SEQ ID NO: 1084047 - RNA, 20 nt, Human
ugacuccuuugagccauccc

SEQ ID NO: 1084048 - RNA, 20 nt, Human
ugagaaaaggcaguggggag

SEQ ID NO: 1084049 - RNA, 21 nt, Human
ugagaaaaggcaguggggagg

SEQ ID NO: 1084050 - RNA, 23 nt, Human
ugagaaaaggcaguggggaggug

SEQ ID NO: 1084051 - RNA, 18 nt, Human
ugagagaggccagugugu

SEQ ID NO: 1084052 - RNA, 23 nt, Human
ugauagucagggucccaccuccu

SEQ ID NO: 1084053 - RNA, 22 nt, Human
ugccagggcagguauccagcuc

SEQ ID NO: 1084054 - RNA, 20 nt, Human
ugcccagagaggggccucug

SEQ ID NO: 1084055 - RNA, 23 nt, Human
ugccugggugcuccuggggaguc

SEQ ID NO: 1084056 - RNA, 21 nt, Human
ugcgagccuccccugcuccug

SEQ ID NO: 1084057 - RNA, 22 nt, Human
ugcuccggcuccgcgacagcuc

SEQ ID NO: 1084058 - RNA, 20 nt, Human
ugcuccugccugcccacccc

SEQ ID NO: 1084059 - RNA, 18 nt, Human
ugcuggaucugcugugca

SEQ ID NO: 1084060 - RNA, 19 nt, Human
uggaagauggggugaccac

SEQ ID NO: 1084061 - RNA, 26 nt, Human
uggauuuccuucagcuacccugaugu

SEQ ID NO: 1084062 - RNA, 20 nt, Human
ugggcuuucugacugcccag

SEQ ID NO: 1084063 - RNA, 19 nt, Human
uggggagaacccucccugu

SEQ ID NO: 1084064 - RNA, 24 nt, Human
uggggagggcugccacagccccca

SEQ ID NO: 1084065 - RNA, 24 nt, Human
uggggcuggggccgcuaccucugg

SEQ ID NO: 1084066 - RNA, 21 nt, Human
ugggugagccaggggcuggca

SEQ ID NO: 1084067 - RNA, 18 nt, Human
ugugcuauucagccaagg

SEQ ID NO: 1084068 - RNA, 20 nt, Human
ugugggguggggagggcugc

SEQ ID NO: 1084069 - RNA, 20 nt, Human
uucagagagagggagggggg

SEQ ID NO: 1084070 - RNA, 23 nt, Human
uucagcuacccugauguccccaa

SEQ ID NO: 1084071 - RNA, 23 nt, Human
uucaguggacccugggcuuucug

SEQ ID NO: 1084072 - RNA, 20 nt, Human
uuccguccaacuccuagccc

SEQ ID NO: 1084073 - RNA, 24 nt, Human
uuccuccccuuucccuuccagccc

SEQ ID NO: 1084074 - RNA, 19 nt, Human
uugaggagggggcuguggg

SEQ ID NO: 1084075 - RNA, 20 nt, Human
uuggcggcugcccacacuuu

SEQ ID NO: 1084076 - RNA, 18 nt, Human
uugguggcuguugggugg

SEQ ID NO: 1084077 - RNA, 18 nt, Human
uugguucaagcaguguuc

SEQ ID NO: 1084078 - RNA, 19 nt, Human
uuuugaggagggggcugug

SEQ ID NO: 1084079 - RNA, 22 nt, Human
uuuuugaggagggggcuguggg

SEQ ID NO: 1084080 - RNA, 19 nt, Human
aaaagaggggcuggaaagg

SEQ ID NO: 1084081 - RNA, 21 nt, Human
aaaauaaauaaaagcaggccc

SEQ ID NO: 1084082 - RNA, 25 nt, Human
aaaggaaaggggagggagauggagg

SEQ ID NO: 1084083 - RNA, 31 nt, Human
aacccaggcaauccacccauccacccacagg

SEQ ID NO: 1084084 - RNA, 20 nt, Human
aacuguagaccaggccaggg

SEQ ID NO: 1084085 - RNA, 23 nt, Human
aagcaacaggccaaggugcguga

SEQ ID NO: 1084086 - RNA, 19 nt, Human
aagcaacuuuucccucagg

SEQ ID NO: 1084087 - RNA, 20 nt, Human
aagcagaagagggagacucc

SEQ ID NO: 1084088 - RNA, 23 nt, Human
aagcagaagagggagacuccgcg

SEQ ID NO: 1084089 - RNA, 24 nt, Human
aagcagaagagggagacuccgcgg

SEQ ID NO: 1084090 - RNA, 19 nt, Human
aagcaggccccugucagca

SEQ ID NO: 1084091 - RNA, 20 nt, Human
aagcucccagccccuacacc

SEQ ID NO: 1084092 - RNA, 21 nt, Human
acacaacccccuccaagcucc

SEQ ID NO: 1084093 - RNA, 24 nt, Human
acacaacccccuccaagcucccag

SEQ ID NO: 1084094 - RNA, 19 nt, Human
acaggccaaggugcgugag

SEQ ID NO: 1084095 - RNA, 26 nt, Human
accccuccccagucagcccuuuacca

SEQ ID NO: 1084096 - RNA, 19 nt, Human
accugggagggagggaagg

SEQ ID NO: 1084097 - RNA, 19 nt, Human
acucccaggcugggagcug

SEQ ID NO: 1084098 - RNA, 20 nt, Human
agaagggcgggagggauggc

SEQ ID NO: 1084099 - RNA, 19 nt, Human
agagagaaaacggguuaga

SEQ ID NO: 1084100 - RNA, 18 nt, Human
agagguugguggaguugg

SEQ ID NO: 1084101 - RNA, 18 nt, Human
agaugccauuggccauag

SEQ ID NO: 1084102 - RNA, 19 nt, Human
agauggagggagaagcugg

SEQ ID NO: 1084103 - RNA, 23 nt, Human
agccaccagaccugauagagaag

SEQ ID NO: 1084104 - RNA, 20 nt, Human
agcgaggaagcaggcgggga

SEQ ID NO: 1084105 - RNA, 19 nt, Human
aggaagcaggcggggaugg

SEQ ID NO: 1084106 - RNA, 19 nt, Human
aggcaggcuuggaaaggga

SEQ ID NO: 1084107 - RNA, 19 nt, Human
aggcaggcuuggaaaggga

SEQ ID NO: 1084108 - RNA, 22 nt, Human
aggcaggcuuggaaagggaggu

SEQ ID NO: 1084109 - RNA, 20 nt, Human
aggccagggcacaggcugcu

SEQ ID NO: 1084110 - RNA, 22 nt, Human
aggccccugucagcauaagccu

SEQ ID NO: 1084111 - RNA, 24 nt, Human
aggccucuggccgccugaguccag

SEQ ID NO: 1084112 - RNA, 19 nt, Human
aggggcgaugucaggagac

SEQ ID NO: 1084113 - RNA, 24 nt, Human
aggggcuggaaaggaaaggggagg

SEQ ID NO: 1084114 - RNA, 19 nt, Human
agugccuggggacugcggc

SEQ ID NO: 1084115 - RNA, 18 nt, Human
agugcuucagcaggggcc

SEQ ID NO: 1084116 - RNA, 18 nt, Human
auauauauguauauaugu

SEQ ID NO: 1084117 - RNA, 22 nt, Human
auauauauguauauaugugugu

SEQ ID NO: 1084118 - RNA, 28 nt, Human
auauauguauauaugugugugugugugu

SEQ ID NO: 1084119 - RNA, 18 nt, Human
auccaacagccaccagac

SEQ ID NO: 1084120 - RNA, 22 nt, Human
augcugccuggugacaccuggu

SEQ ID NO: 1084121 - RNA, 22 nt, Human
augugugugugugugugugugg

SEQ ID NO: 1084122 - RNA, 22 nt, Human
augugugugugugugugugugu

SEQ ID NO: 1084123 - RNA, 23 nt, Human
auguguguguguguguguguguu

SEQ ID NO: 1084124 - RNA, 26 nt, Human
caaccccuagaagcaacaggccaagg

SEQ ID NO: 1084125 - RNA, 19 nt, Human
caaccccuccccagucagc

SEQ ID NO: 1084126 - RNA, 22 nt, Human
caaguuuucagcaacggucaca

SEQ ID NO: 1084127 - RNA, 22 nt, Human
cacaacccccuccaagcuccca

SEQ ID NO: 1084128 - RNA, 23 nt, Human
cacaacccccuccaagcucccag

SEQ ID NO: 1084129 - RNA, 19 nt, Human
cacaguucagaccaaugcc

SEQ ID NO: 1084130 - RNA, 19 nt, Human
caccaaagcaacuuuuccc

SEQ ID NO: 1084131 - RNA, 21 nt, Human
caccaaagcaacuuuucccuc

SEQ ID NO: 1084132 - RNA, 30 nt, Human
caccacuacaacagacuaagucacagaagg

SEQ ID NO: 1084133 - RNA, 21 nt, Human
cacguauauauauguauauau

SEQ ID NO: 1084134 - RNA, 23 nt, Human
cagaagagggagacuccgcggca

SEQ ID NO: 1084135 - RNA, 22 nt, Human
cagacuaagucacagaagaagg

SEQ ID NO: 1084136 - RNA, 20 nt, Human
cagcaguagugcuucagcag

SEQ ID NO: 1084137 - RNA, 21 nt, Human
cagccauggagaccuugagca

SEQ ID NO: 1084138 - RNA, 21 nt, Human
cagcuguggagggccggggag

SEQ ID NO: 1084139 - RNA, 19 nt, Human
caggacacccgcccaggca

SEQ ID NO: 1084140 - RNA, 19 nt, Human
caguucagaccaaugccag

SEQ ID NO: 1084141 - RNA, 25 nt, Human
cauaagccuggagaagugggucugg

SEQ ID NO: 1084142 - RNA, 19 nt, Human
cauccaacagccaccagac

SEQ ID NO: 1084143 - RNA, 22 nt, Human
ccaagcucccagccccuacacc

SEQ ID NO: 1084144 - RNA, 25 nt, Human
ccaagcucccagccccuacaccaua

SEQ ID NO: 1084145 - RNA, 19 nt, Human
ccacacaacccccuccaag

SEQ ID NO: 1084146 - RNA, 20 nt, Human
ccacagagggggcacaaguu

SEQ ID NO: 1084147 - RNA, 18 nt, Human
ccagaccugauagagaag

SEQ ID NO: 1084148 - RNA, 23 nt, Human
ccagggccaccucuugcuuggag

SEQ ID NO: 1084149 - RNA, 27 nt, Human
cccacacaacccccuccaagcucccag

SEQ ID NO: 1084150 - RNA, 21 nt, Human
cccacacacgcuggccugucu

SEQ ID NO: 1084151 - RNA, 22 nt, Human
cccacugaaugaggagccccag

SEQ ID NO: 1084152 - RNA, 19 nt, Human
cccaggcucagccauggag

SEQ ID NO: 1084153 - RNA, 19 nt, Human
cccagucagcccuuuacca

SEQ ID NO: 1084154 - RNA, 22 nt, Human
cccauccaacagccaccagacc

SEQ ID NO: 1084155 - RNA, 23 nt, Human
cccccaccaugucccuacaaccc

SEQ ID NO: 1084156 - RNA, 19 nt, Human
ccccccacacaacccccuc

SEQ ID NO: 1084157 - RNA, 20 nt, Human
cccuccaagcucccagcccc

SEQ ID NO: 1084158 - RNA, 18 nt, Human
ccuggagaagugggucug

SEQ ID NO: 1084159 - RNA, 21 nt, Human
cgcacuggcccagggccaccu

SEQ ID NO: 1084160 - RNA, 23 nt, Human
cggguuagagaaaagccagagcu

SEQ ID NO: 1084161 - RNA, 22 nt, Human
cguggcaagguuccuggaaaag

SEQ ID NO: 1084162 - RNA, 24 nt, Human
cucccagccccuacaccauaaacc

SEQ ID NO: 1084163 - RNA, 21 nt, Human
cucugggccaucagaaagccc

SEQ ID NO: 1084164 - RNA, 21 nt, Human
cucuugcuuggagagccccau

SEQ ID NO: 1084165 - RNA, 23 nt, Human
cuggagucuucacccccaccaug

SEQ ID NO: 1084166 - RNA, 23 nt, Human
cuggcuguccacaggccgcgcau

SEQ ID NO: 1084167 - RNA, 22 nt, Human
cugguuggcggggggcugcagg

SEQ ID NO: 1084168 - RNA, 21 nt, Human
cuuccucuugcugggcuacaa

SEQ ID NO: 1084169 - RNA, 23 nt, Human
gaaaagccagagcuggugaggca

SEQ ID NO: 1084170 - RNA, 23 nt, Human
gaaaaguuauuuuaaaaaguuau

SEQ ID NO: 1084171 - RNA, 22 nt, Human
gaacacugauugaaccaaaaug

SEQ ID NO: 1084172 - RNA, 20 nt, Human
gaacagggcaggggcauacc

SEQ ID NO: 1084173 - RNA, 19 nt, Human
gagaagcuggagcuucaua

SEQ ID NO: 1084174 - RNA, 21 nt, Human
gagggagaagcuggagcuuca

SEQ ID NO: 1084175 - RNA, 20 nt, Human
gaggucucugagaagaggag

SEQ ID NO: 1084176 - RNA, 21 nt, Human
gauggagggagaagcuggagc

SEQ ID NO: 1084177 - RNA, 20 nt, Human
gcaaccccuagaagcaacag

SEQ ID NO: 1084178 - RNA, 19 nt, Human
gcaauccacccauccaccc

SEQ ID NO: 1084179 - RNA, 20 nt, Human
gccaaggugcgugagccugc

SEQ ID NO: 1084180 - RNA, 19 nt, Human
gccagaggccccucugggc

SEQ ID NO: 1084181 - RNA, 19 nt, Human
gcccuuuaccauuagggua

SEQ ID NO: 1084182 - RNA, 19 nt, Human
gcgaggaagcaggcgggga

SEQ ID NO: 1084183 - RNA, 20 nt, Human
gcgggggcuggcuguccaca

SEQ ID NO: 1084184 - RNA, 21 nt, Human
gcucccaucuucuuacucaga

SEQ ID NO: 1084185 - RNA, 21 nt, Human
gcuggggguggccccccuucc

SEQ ID NO: 1084186 - RNA, 19 nt, Human
gcuuuggggcugggggagc

SEQ ID NO: 1084187 - RNA, 18 nt, Human
ggaaaaaaaguaaaaaaa

SEQ ID NO: 1084188 - RNA, 19 nt, Human
ggaaaggaaaggggaggga

SEQ ID NO: 1084189 - RNA, 20 nt, Human
ggagggauggcgggggcugg

SEQ ID NO: 1084190 - RNA, 22 nt, Human
ggaggucucugagaagaggagg

SEQ ID NO: 1084191 - RNA, 23 nt, Human
ggcaagguuccuggaaaagaggg

SEQ ID NO: 1084192 - RNA, 19 nt, Human
ggcaggaaagggaagugag

SEQ ID NO: 1084193 - RNA, 22 nt, Human
ggcaggggcauaccacagaggg

SEQ ID NO: 1084194 - RNA, 23 nt, Human
ggccagcaguagugcuucagcag

SEQ ID NO: 1084195 - RNA, 20 nt, Human
ggcugggggagccacuguca

SEQ ID NO: 1084196 - RNA, 23 nt, Human
gggagggagauggagggagaagc

SEQ ID NO: 1084197 - RNA, 26 nt, Human
gggagggagauggagggagaagcugg

SEQ ID NO: 1084198 - RNA, 21 nt, Human
gggaggucucugagaagagga

SEQ ID NO: 1084199 - RNA, 21 nt, Human
gggccggggaggggagggcgu

SEQ ID NO: 1084200 - RNA, 18 nt, Human
ggggaggggagggcguag

SEQ ID NO: 1084201 - RNA, 21 nt, Human
ggggcuggaaaggaaagggga

SEQ ID NO: 1084202 - RNA, 22 nt, Human
gggggcuggcuuuggggcuggg

SEQ ID NO: 1084203 - RNA, 22 nt, Human
gguuacauaggugaggcugggc

SEQ ID NO: 1084204 - RNA, 23 nt, Human
guaccuagcggagguugcagcug

SEQ ID NO: 1084205 - RNA, 21 nt, Human
gucuaagaggggagccuuaac

SEQ ID NO: 1084206 - RNA, 23 nt, Human
gucuggagucuucacccccacca

SEQ ID NO: 1084207 - RNA, 24 nt, Human
gucuuccaacgcacuggcccaggg

SEQ ID NO: 1084208 - RNA, 27 nt, Human
gugcccaggaugauguucccuacggua

SEQ ID NO: 1084209 - RNA, 22 nt, Human
guguacauacuguagcugugua

SEQ ID NO: 1084210 - RNA, 21 nt, Human
gugugugugugugugugugug

SEQ ID NO: 1084211 - RNA, 21 nt, Human
gugugugugugugugugugug

SEQ ID NO: 1084212 - RNA, 18 nt, Human
guuuguuuggaggagguc

SEQ ID NO: 1084213 - RNA, 24 nt, Human
guuuucagcaacggucacaccugg

SEQ ID NO: 1084214 - RNA, 27 nt, Human
uaaaagaacacaaacuaaaaaaguuaa

SEQ ID NO: 1084215 - RNA, 27 nt, Human
uaacugguuggcggggggcugcagguu

SEQ ID NO: 1084216 - RNA, 20 nt, Human
uaagagccagagguuggugg

SEQ ID NO: 1084217 - RNA, 20 nt, Human
uaagagcccccaggcucagc

SEQ ID NO: 1084218 - RNA, 26 nt, Human
uaccacagagggggcacaaguuuuca

SEQ ID NO: 1084219 - RNA, 22 nt, Human
uagagaaaagccagagcuggug

SEQ ID NO: 1084220 - RNA, 23 nt, Human
uauauaugugugugugugugugu

SEQ ID NO: 1084221 - RNA, 19 nt, Human
uauauguauauaugugugu

SEQ ID NO: 1084222 - RNA, 21 nt, Human
uauauguauauaugugugugu

SEQ ID NO: 1084223 - RNA, 23 nt, Human
uauauguauauaugugugugugu

SEQ ID NO: 1084224 - RNA, 19 nt, Human
uauaugugugugugugugu

SEQ ID NO: 1084225 - RNA, 25 nt, Human
uauaugugugugugugugugugugu

SEQ ID NO: 1084226 - RNA, 23 nt, Human
uauccuagaucaccacuggauug

SEQ ID NO: 1084227 - RNA, 21 nt, Human
uaugcugccuggugacaccug

SEQ ID NO: 1084228 - RNA, 22 nt, Human
uauguauauaugugugugugug

SEQ ID NO: 1084229 - RNA, 18 nt, Human
uaugugugugugugugug

SEQ ID NO: 1084230 - RNA, 23 nt, Human
uaugugugugugugugugugugu

SEQ ID NO: 1084231 - RNA, 24 nt, Human
uaugugugugugugugugugugug

SEQ ID NO: 1084232 - RNA, 22 nt, Human
ucacaggacacccgcccaggca

SEQ ID NO: 1084233 - RNA, 19 nt, Human
ucagagaggcagcugaggc

SEQ ID NO: 1084234 - RNA, 21 nt, Human
ucagcauguccagcugggcug

SEQ ID NO: 1084235 - RNA, 21 nt, Human
uccacaacugccaccuugggc

SEQ ID NO: 1084236 - RNA, 22 nt, Human
uccacaagcacagcacgggacu

SEQ ID NO: 1084237 - RNA, 19 nt, Human
ucccuacaaccccucccca

SEQ ID NO: 1084238 - RNA, 18 nt, Human
uccucugaggaacccugg

SEQ ID NO: 1084239 - RNA, 21 nt, Human
ucuucacccccaccauguccc

SEQ ID NO: 1084240 - RNA, 22 nt, Human
ucuuccaacgcacuggcccagg

SEQ ID NO: 1084241 - RNA, 19 nt, Human
ugacccgaucagcuggcag

SEQ ID NO: 1084242 - RNA, 20 nt, Human
ugacucagacugcgugacag

SEQ ID NO: 1084243 - RNA, 19 nt, Human
ugagaagaggagggaugug

SEQ ID NO: 1084244 - RNA, 21 nt, Human
ugagaagaggagggauguguu

SEQ ID NO: 1084245 - RNA, 21 nt, Human
ugaggcugggcccuuccugcu

SEQ ID NO: 1084246 - RNA, 20 nt, Human
ugccagaggccccucugggc

SEQ ID NO: 1084247 - RNA, 23 nt, Human
ugccagaggccccucugggccau

SEQ ID NO: 1084248 - RNA, 18 nt, Human
ugccguggauuuggcucu

SEQ ID NO: 1084249 - RNA, 20 nt, Human
ugcuggccagcaguagugcu

SEQ ID NO: 1084250 - RNA, 23 nt, Human
ugcugggaaaagcagaagaggga

SEQ ID NO: 1084251 - RNA, 18 nt, Human
ugcuggggguggcccccc

SEQ ID NO: 1084252 - RNA, 20 nt, Human
ugcuggggguggccccccuu

SEQ ID NO: 1084253 - RNA, 24 nt, Human
ugcuggggguggccccccuucccc

SEQ ID NO: 1084254 - RNA, 18 nt, Human
ugcuuggagagccccauc

SEQ ID NO: 1084255 - RNA, 19 nt, Human
uggaaaaaaaguaaaaaaa

SEQ ID NO: 1084256 - RNA, 20 nt, Human
uggaaaggaaaggggaggga

SEQ ID NO: 1084257 - RNA, 24 nt, Human
uggaaaggaaaggggagggagaug

SEQ ID NO: 1084258 - RNA, 19 nt, Human
uggaacccaggcaauccac

SEQ ID NO: 1084259 - RNA, 21 nt, Human
uggaacccaggcaauccaccc

SEQ ID NO: 1084260 - RNA, 21 nt, Human
uggaauaaauggauuuagcca

SEQ ID NO: 1084261 - RNA, 19 nt, Human
uggagaagugggucuggag

SEQ ID NO: 1084262 - RNA, 22 nt, Human
uggagguggugcacuuuggagg

SEQ ID NO: 1084263 - RNA, 21 nt, Human
uggauugcugacagauagagg

SEQ ID NO: 1084264 - RNA, 22 nt, Human
uggccgccugaguccagccccc

SEQ ID NO: 1084265 - RNA, 23 nt, Human
uggccgccugaguccagcccccc

SEQ ID NO: 1084266 - RNA, 24 nt, Human
ugggacuccuguuuuuuguuuuuu

SEQ ID NO: 1084267 - RNA, 21 nt, Human
ugggagggagggaagggggcu

SEQ ID NO: 1084268 - RNA, 19 nt, Human
uggguccugcaguuugucc

SEQ ID NO: 1084269 - RNA, 22 nt, Human
uggugaggcaagugcagaguau

SEQ ID NO: 1084270 - RNA, 19 nt, Human
uguauauaugugugugugu

SEQ ID NO: 1084271 - RNA, 21 nt, Human
uguauauaugugugugugugu

SEQ ID NO: 1084272 - RNA, 24 nt, Human
ugucaggagacagcuuccucuugc

SEQ ID NO: 1084273 - RNA, 22 nt, Human
ugucccuacaaccccuccccag

SEQ ID NO: 1084274 - RNA, 23 nt, Human
ugugggaugaccgcguguauagg

SEQ ID NO: 1084275 - RNA, 18 nt, Human
ugugugugugugugugug

SEQ ID NO: 1084276 - RNA, 18 nt, Human
ugugugugugugugugug

SEQ ID NO: 1084277 - RNA, 18 nt, Human
ugugugugugugugugug

SEQ ID NO: 1084278 - RNA, 18 nt, Human
ugugugugugugugugug

SEQ ID NO: 1084279 - RNA, 18 nt, Human
ugugugugugugugugug

SEQ ID NO: 1084280 - RNA, 18 nt, Human
ugugugugugugugugug

SEQ ID NO: 1084281 - RNA, 18 nt, Human
ugugugugugugugugug

SEQ ID NO: 1084282 - RNA, 18 nt, Human
ugugugugugugugugug

SEQ ID NO: 1084283 - RNA, 21 nt, Human
ugugugugugugugugugugu

SEQ ID NO: 1084284 - RNA, 21 nt, Human
ugugugugugugugugugugu

SEQ ID NO: 1084285 - RNA, 21 nt, Human
ugugugugugugugugugugu

SEQ ID NO: 1084286 - RNA, 21 nt, Human
ugugugugugugugugugugu

SEQ ID NO: 1084287 - RNA, 21 nt, Human
ugugugugugugugugugugu

SEQ ID NO: 1084288 - RNA, 21 nt, Human
ugugugugugugugugugugu

SEQ ID NO: 1084289 - RNA, 21 nt, Human
ugugugugugugugugugugu

SEQ ID NO: 1084290 - RNA, 21 nt, Human
ugugugugugugugugugugu

SEQ ID NO: 1084291 - RNA, 21 nt, Human
ugugugugugugugugugugu

SEQ ID NO: 1084292 - RNA, 21 nt, Human
ugugugugugugugugugugu

SEQ ID NO: 1084293 - RNA, 21 nt, Human
ugugugugugugugugugugu

SEQ ID NO: 1084294 - RNA, 22 nt, Human
ugugugugugugugugugugug

SEQ ID NO: 1084295 - RNA, 22 nt, Human
ugugugugugugugugugugug

SEQ ID NO: 1084296 - RNA, 22 nt, Human
ugugugugugugugugugugug

SEQ ID NO: 1084297 - RNA, 22 nt, Human
ugugugugugugugugugugug

SEQ ID NO: 1084298 - RNA, 20 nt, Human
uguuggggaccuuccaggcc

SEQ ID NO: 1084299 - RNA, 23 nt, Human
uguuuuuuguuuuuugcuuuuga

SEQ ID NO: 1084300 - RNA, 22 nt, Human
uuaaaagaacacaaacuaaaaa

SEQ ID NO: 1084301 - RNA, 26 nt, Human
uucccaggccucuggccgccugaguc

SEQ ID NO: 1084302 - RNA, 21 nt, Human
uucccucacuggguccugcag

SEQ ID NO: 1084303 - RNA, 29 nt, Human
uuggccacguauauauauguauauaugug

SEQ ID NO: 1084304 - RNA, 21 nt, Human
uuuguuuggaggaggucugac

SEQ ID NO: 1084305 - RNA, 22 nt, Human
uuuuuguuuuuuguuuuuugcu

SEQ ID NO: 1084306 - RNA, 22 nt, Human
aaaagccagagcuggugaggca

SEQ ID NO: 1084307 - RNA, 22 nt, Human
aaaaguuauuuuaaaaaguuau

SEQ ID NO: 1084308 - RNA, 21 nt, Human
aaaauaaauaaaagcaggccc

SEQ ID NO: 1084309 - RNA, 31 nt, Human; identical to SEQ ID NO: 1084083

SEQ ID NO: 1084310 - RNA, 20 nt, Human
aacuguagaccaggccaggg

SEQ ID NO: 1084311 - RNA, 23 nt, Human
aagcaacaggccaaggugcguga

SEQ ID NO: 1084312 - RNA, 19 nt, Human
aagcaacuuuucccucagg

SEQ ID NO: 1084313 - RNA, 20 nt, Human
aagcagaagagggagacucc

SEQ ID NO: 1084314 - RNA, 21 nt, Human
aagcagaagagggagacuccg

SEQ ID NO: 1084315 - RNA, 23 nt, Human
aagcagaagagggagacuccgug

SEQ ID NO: 1084316 - RNA, 19 nt, Human
aagcaggccccugucagca

SEQ ID NO: 1084317 - RNA, 20 nt, Human
aagcucccagccccuacacc

SEQ ID NO: 1084318 - RNA, 21 nt, Human
acacaacccccuccaagcucc

SEQ ID NO: 1084319 - RNA, 24 nt, Human
acacaacccccuccaagcucccag

SEQ ID NO: 1084320 - RNA, 19 nt, Human
acaggccaaggugcgugag

SEQ ID NO: 1084321 - RNA, 19 nt, Human
acucccaggcugggagcug

SEQ ID NO: 1084322 - RNA, 20 nt, Human
agaagggcgggagggauggc

SEQ ID NO: 1084323 - RNA, 19 nt, Human
agagagaaaacggguuaga

SEQ ID NO: 1084324 - RNA, 18 nt, Human
agagguugguggaguugg

SEQ ID NO: 1084325 - RNA, 20 nt, Human
agcgaggaagcaggcgggga

SEQ ID NO: 1084326 - RNA, 19 nt, Human
aggaagcaggcggggaugg

SEQ ID NO: 1084327 - RNA, 19 nt, Human
aggcaggcuuggaaaggga

SEQ ID NO: 1084328 - RNA, 19 nt, Human
aggcaggcuuggaaaggga

SEQ ID NO: 1084329 - RNA, 22 nt, Human
aggcaggcuuggaaagggaggu

SEQ ID NO: 1084330 - RNA, 20 nt, Human
aggccagggcacaggcugcu

SEQ ID NO: 1084331 - RNA, 22 nt, Human
aggccccugucagcauaagccu

SEQ ID NO: 1084332 - RNA, 24 nt, Human
aggccucuggccgccugaguccag

SEQ ID NO: 1084333 - RNA, 23 nt, Human
aggcggcgcucagcugggccagc

SEQ ID NO: 1084334 - RNA, 18 nt, Human
agggauggcuggcuggag

SEQ ID NO: 1084335 - RNA, 19 nt, Human
aggggcgaugucaggagac

SEQ ID NO: 1084336 - RNA, 23 nt, Human
agugagcucucuaggcggcgcuc

SEQ ID NO: 1084337 - RNA, 19 nt, Human
agugccuggggacugcggc

SEQ ID NO: 1084338 - RNA, 18 nt, Human
agugcuucagcaggggcc

SEQ ID NO: 1084339 - RNA, 18 nt, Human
auauauauguauauaugu

SEQ ID NO: 1084340 - RNA, 22 nt, Human
auauauauguauauaugugugu

SEQ ID NO: 1084341 - RNA, 28 nt, Human
auauauguauauaugugugugugugugu

SEQ ID NO: 1084342 - RNA, 18 nt, Human
auccaacagccaccagac

SEQ ID NO: 1084343 - RNA, 22 nt, Human
augcugccuggugacaccuggu

SEQ ID NO: 1084344 - RNA, 20 nt, Human
augggacuccuguuuuuugu

SEQ ID NO: 1084345 - RNA, 30 nt, Human
auguauauaugugugugugugugugugugg

SEQ ID NO: 1084346 - RNA, 22 nt, Human
augugugugugugugugugugu

SEQ ID NO: 1084347 - RNA, 23 nt, Human
auguguguguguguguguguguu

SEQ ID NO: 1084348 - RNA, 26 nt, Human
caaccccuagaagcaacaggccaagg

SEQ ID NO: 1084349 - RNA, 20 nt, Human
caaccccuccccagucagcc

SEQ ID NO: 1084350 - RNA, 24 nt, Human
caagcucccagccccuacaccaua

SEQ ID NO: 1084351 - RNA, 22 nt, Human
caaguuuucagcaacggucaca

SEQ ID NO: 1084352 - RNA, 18 nt, Human
caauccacccauccaccc

SEQ ID NO: 1084353 - RNA, 22 nt, Human
cacaacccccuccaagcuccca

SEQ ID NO: 1084354 - RNA, 23 nt, Human
cacaacccccuccaagcucccag

SEQ ID NO: 1084355 - RNA, 19 nt, Human
cacaguucagaccaaugcc

SEQ ID NO: 1084356 - RNA, 19 nt, Human
caccaaagcaacuuuuccc

SEQ ID NO: 1084357 - RNA, 21 nt, Human
caccaaagcaacuuuucccuc

SEQ ID NO: 1084358 - RNA, 30 nt, Human; identical to SEQ ID NO: 1084132

SEQ ID NO: 1084359 - RNA, 21 nt, Human
cacguauauauauguauauau

SEQ ID NO: 1084360 - RNA, 23 nt, Human
cagaagagggagacuccguggca

SEQ ID NO: 1084361 - RNA, 22 nt, Human
cagacuaagucacagaagaagg

SEQ ID NO: 1084362 - RNA, 19 nt, Human
cagcacgggacugauuccc

SEQ ID NO: 1084363 - RNA, 20 nt, Human
cagcaguagugcuucagcag

SEQ ID NO: 1084364 - RNA, 24 nt, Human
cagccaccagaccugauagagaag

SEQ ID NO: 1084365 - RNA, 21 nt, Human
cagccauggagaccuugagca

SEQ ID NO: 1084366 - RNA, 21 nt, Human
cagcuguggagggccggggag

SEQ ID NO: 1084367 - RNA, 19 nt, Human
caggacacccgcccaggca

SEQ ID NO: 1084368 - RNA, 19 nt, Human
caguucagaccaaugccag

SEQ ID NO: 1084369 - RNA, 25 nt, Human
cauaagccuggagaagugggucugg

SEQ ID NO: 1084370 - RNA, 19 nt, Human
cauccaacagccaccagac

SEQ ID NO: 1084371 - RNA, 22 nt, Human
ccaagcucccagccccuacacc

SEQ ID NO: 1084372 - RNA, 19 nt, Human
ccacacaacccccuccaag

SEQ ID NO: 1084373 - RNA, 21 nt, Human
ccacagagggggcacaaguuu

SEQ ID NO: 1084374 - RNA, 18 nt, Human
ccagaccugauagagaag

SEQ ID NO: 1084375 - RNA, 23 nt, Human
ccagggccaccucuugcuuggag

SEQ ID NO: 1084376 - RNA, 18 nt, Human
ccagucagcccuuuacca

SEQ ID NO: 1084377 - RNA, 27 nt, Human
cccacacaacccccuccaagcucccag

SEQ ID NO: 1084378 - RNA, 21 nt, Human
cccacacacgcuggccugucu

SEQ ID NO: 1084379 - RNA, 22 nt, Human
cccacugaaugaggagccccag

SEQ ID NO: 1084380 - RNA, 24 nt, Human
cccaggccucuggccgccugaguc

SEQ ID NO: 1084381 - RNA, 22 nt, Human
cccauccaacagccaccagacc

SEQ ID NO: 1084382 - RNA, 21 nt, Human
ccccaggcucagccauggaga

SEQ ID NO: 1084383 - RNA, 23 nt, Human
cccccaccaugucccuacaaccc

SEQ ID NO: 1084384 - RNA, 19 nt, Human
ccccccacacaacccccuc

SEQ ID NO: 1084385 - RNA, 20 nt, Human
cccuccaagcucccagcccc

SEQ ID NO: 1084386 - RNA, 24 nt, Human
cccuccccagucagcccuuuacca

SEQ ID NO: 1084387 - RNA, 18 nt, Human
cccucccuaccccacaca

SEQ ID NO: 1084388 - RNA, 18 nt, Human
ccuggagaagugggucug

SEQ ID NO: 1084389 - RNA, 23 nt, Human
cggguuagagaaaagccagagcu

SEQ ID NO: 1084390 - RNA, 21 nt, Human
cguauauauauguauauaugu

SEQ ID NO: 1084391 - RNA, 23 nt, Human
cguguacauacuguagcugugua

SEQ ID NO: 1084392 - RNA, 24 nt, Human
cucccagccccuacaccauaaacc

SEQ ID NO: 1084393 - RNA, 21 nt, Human
cucugggccaucagaaagccc

SEQ ID NO: 1084394 - RNA, 21 nt, Human
cucuugcuuggagagccccau

SEQ ID NO: 1084395 - RNA, 23 nt, Human
cuggagucuucacccccaccaug

SEQ ID NO: 1084396 - RNA, 23 nt, Human
cuggcuguccacaggccgcgcau

SEQ ID NO: 1084397 - RNA, 22 nt, Human
cuggggguggccccccuucccc

SEQ ID NO: 1084398 - RNA, 22 nt, Human
cugguuggcggggggcugcagg

SEQ ID NO: 1084399 - RNA, 21 nt, Human
cuuccucuugcugggcuacaa

SEQ ID NO: 1084400 - RNA, 22 nt, Human
gaacacugauugaaccaaaaug

SEQ ID NO: 1084401 - RNA, 20 nt, Human
gaacagggcaggggcauacc

SEQ ID NO: 1084402 - RNA, 20 nt, Human
gagaaaagccagagcuggug

SEQ ID NO: 1084403 - RNA, 19 nt, Human
gagaagcuggagcuucaua

SEQ ID NO: 1084404 - RNA, 21 nt, Human
gagggagaagcuggagcuuca

SEQ ID NO: 1084405 - RNA, 24 nt, Human
gaggggcuggaagggaaaggggag

SEQ ID NO: 1084406 - RNA, 20 nt, Human
gaggucucugagaagaggag

SEQ ID NO: 1084407 - RNA, 21 nt, Human
gauggagggagaagcuggagc

SEQ ID NO: 1084408 - RNA, 20 nt, Human
gcaaccccuagaagcaacag

SEQ ID NO: 1084409 - RNA, 20 nt, Human
gcacuggcccagggccaccu

SEQ ID NO: 1084410 - RNA, 20 nt, Human
gccaaggugcgugagccugc

SEQ ID NO: 1084411 - RNA, 19 nt, Human
gccagaggccccucugggc

SEQ ID NO: 1084412 - RNA, 25 nt, Human
gcccaggaugauguucccuacggua

SEQ ID NO: 1084413 - RNA, 19 nt, Human
gcccuuuaccauuagggua

SEQ ID NO: 1084414 - RNA, 19 nt, Human
gcgaggaagcaggcgggga

SEQ ID NO: 1084415 - RNA, 20 nt, Human
gcgggggcuggcuguccaca

SEQ ID NO: 1084416 - RNA, 21 nt, Human
gcucccaucuucuuacucaga

SEQ ID NO: 1084417 - RNA, 21 nt, Human
gcuggggguggccccccuucc

SEQ ID NO: 1084418 - RNA, 19 nt, Human
gcuuuggggcugggggagc

SEQ ID NO: 1084419 - RNA, 18 nt, Human
ggaaaaaaaguaaaaaaa

SEQ ID NO: 1084420 - RNA, 22 nt, Human
ggagauggagggagaagcugga

SEQ ID NO: 1084421 - RNA, 24 nt, Human
ggagcuauaagggauggcuggcug

SEQ ID NO: 1084422 - RNA, 20 nt, Human
ggagggauggcgggggcugg

SEQ ID NO: 1084423 - RNA, 22 nt, Human
ggaggucucugagaagaggagg

SEQ ID NO: 1084424 - RNA, 23 nt, Human
ggcaagguuccuggaaaagaggg

SEQ ID NO: 1084425 - RNA, 19 nt, Human
ggcaggaaagggaagugag

SEQ ID NO: 1084426 - RNA, 22 nt, Human
ggcaggggcauaccacagaggg

SEQ ID NO: 1084427 - RNA, 22 nt, Human
ggcggcgcucagcugggccagc

SEQ ID NO: 1084428 - RNA, 20 nt, Human
ggcugggggagccacuguca

SEQ ID NO: 1084429 - RNA, 21 nt, Human
gggaaaggggagggagaugga

SEQ ID NO: 1084430 - RNA, 26 nt, Human
gggagggagauggagggagaagcugg

SEQ ID NO: 1084431 - RNA, 21 nt, Human
gggaggucucugagaagagga

SEQ ID NO: 1084432 - RNA, 21 nt, Human
gggccggggaggggagggcgu

SEQ ID NO: 1084433 - RNA, 18 nt, Human
ggggaggggagggcguag

SEQ ID NO: 1084434 - RNA, 22 nt, Human
gggggcuggcuuuggggcuggg

SEQ ID NO: 1084435 - RNA, 22 nt, Human
gguuacauaggugaggcugggc

SEQ ID NO: 1084436 - RNA, 23 nt, Human
guaccuagcggagguugcagcug

SEQ ID NO: 1084437 - RNA, 20 nt, Human
guauauaugugugugugugu

SEQ ID NO: 1084438 - RNA, 19 nt, Human
guccucugaggaacccugg

SEQ ID NO: 1084439 - RNA, 23 nt, Human
gucuggagucuucacccccacca

SEQ ID NO: 1084440 - RNA, 24 nt, Human
gucuuccaacgcacuggcccaggg

SEQ ID NO: 1084441 - RNA, 21 nt, Human
gugugugugugugugugugug

SEQ ID NO: 1084442 - RNA, 18 nt, Human
guuuguuuggaggagguc

SEQ ID NO: 1084443 - RNA, 24 nt, Human
guuuucagcaacggucacaccugg

SEQ ID NO: 1084444 - RNA, 18 nt, Human
uaaaaauaaauaaaagca

SEQ ID NO: 1084445 - RNA, 28 nt, Human
uaaaagaacacaaacuaaaaaaguuaac

SEQ ID NO: 1084446 - RNA, 27 nt, Human
uaacugguuggcggggggcugcagguu

SEQ ID NO: 1084447 - RNA, 20 nt, Human
uaagagccagagguuggugg

SEQ ID NO: 1084448 - RNA, 20 nt, Human
uaagagcccccaggcucagc

SEQ ID NO: 1084449 - RNA, 26 nt, Human
uaccacagagggggcacaaguuuuca

SEQ ID NO: 1084450 - RNA, 23 nt, Human
uaccugggagggagggaaggggg

SEQ ID NO: 1084451 - RNA, 23 nt, Human
uauauaugugugugugugugugu

SEQ ID NO: 1084452 - RNA, 19 nt, Human
uauauguauauaugugugu

SEQ ID NO: 1084453 - RNA, 23 nt, Human
uauauguauauaugugugugugu

SEQ ID NO: 1084454 - RNA, 19 nt, Human
uauaugugugugugugugu

SEQ ID NO: 1084455 - RNA, 25 nt, Human
uauaugugugugugugugugugugu

SEQ ID NO: 1084456 - RNA, 23 nt, Human
uauccuagaucaccacuggauug

SEQ ID NO: 1084457 - RNA, 21 nt, Human
uaugcugccuggugacaccug

SEQ ID NO: 1084458 - RNA, 22 nt, Human
uauguauauaugugugugugug

SEQ ID NO: 1084459 - RNA, 18 nt, Human
uaugugugugugugugug

SEQ ID NO: 1084460 - RNA, 23 nt, Human
uaugugugugugugugugugugu

SEQ ID NO: 1084461 - RNA, 24 nt, Human
uaugugugugugugugugugugug

SEQ ID NO: 1084462 - RNA, 22 nt, Human
ucacaggacacccgcccaggca

SEQ ID NO: 1084463 - RNA, 19 nt, Human
ucagagaggcagcugaggc

SEQ ID NO: 1084464 - RNA, 18 nt, Human
ucagcauguccagcuggg

SEQ ID NO: 1084465 - RNA, 21 nt, Human
ucagcauguccagcugggcug

SEQ ID NO: 1084466 - RNA, 21 nt, Human
uccacaacugccaccuugggc

SEQ ID NO: 1084467 - RNA, 22 nt, Human
uccacaagcacagcacgggacu

SEQ ID NO: 1084468 - RNA, 19 nt, Human
ucccuacaaccccucccca

SEQ ID NO: 1084469 - RNA, 21 nt, Human
ucuucacccccaccauguccc

SEQ ID NO: 1084470 - RNA, 22 nt, Human
ucuuccaacgcacuggcccagg

SEQ ID NO: 1084471 - RNA, 19 nt, Human
ugacccgaucagcuggcag

SEQ ID NO: 1084472 - RNA, 20 nt, Human
ugacucagacugcgugacag

SEQ ID NO: 1084473 - RNA, 19 nt, Human
ugagaagaggagggaugug

SEQ ID NO: 1084474 - RNA, 21 nt, Human
ugagaagaggagggauguguu

SEQ ID NO: 1084475 - RNA, 21 nt, Human
ugaggcugggcccuuccugcu

SEQ ID NO: 1084476 - RNA, 20 nt, Human
ugccagaggccccucugggc

SEQ ID NO: 1084477 - RNA, 23 nt, Human
ugccagaggccccucugggccau

SEQ ID NO: 1084478 - RNA, 18 nt, Human
ugccguggauuuggcucu

SEQ ID NO: 1084479 - RNA, 20 nt, Human
ugcuggccagcaguagugcu

SEQ ID NO: 1084480 - RNA, 23 nt, Human
ugcugggaaaagcagaagaggga

SEQ ID NO: 1084481 - RNA, 18 nt, Human
ugcuggggguggcccccc

SEQ ID NO: 1084482 - RNA, 20 nt, Human
ugcuggggguggccccccuu

SEQ ID NO: 1084483 - RNA, 18 nt, Human
ugcuuggagagccccauc

SEQ ID NO: 1084484 - RNA, 19 nt, Human
uggaaaaaaaguaaaaaaa

SEQ ID NO: 1084485 - RNA, 19 nt, Human
uggaacccaggcaauccac

SEQ ID NO: 1084486 - RNA, 21 nt, Human
uggaacccaggcaauccaccc

SEQ ID NO: 1084487 - RNA, 23 nt, Human
uggaagggaaaggggagggagau

SEQ ID NO: 1084488 - RNA, 21 nt, Human
uggaauaaauggauuuagcca

SEQ ID NO: 1084489 - RNA, 19 nt, Human
uggagaagugggucuggag

SEQ ID NO: 1084490 - RNA, 22 nt, Human
uggagguggugcacuuuggagg

SEQ ID NO: 1084491 - RNA, 21 nt, Human
uggauugcugacagauagagg

SEQ ID NO: 1084492 - RNA, 20 nt, Human
uggcaagguuccuggaaaag

SEQ ID NO: 1084493 - RNA, 19 nt, Human
uggcaggaaagggaaguga

SEQ ID NO: 1084494 - RNA, 22 nt, Human
uggccgccugaguccagccccc

SEQ ID NO: 1084495 - RNA, 23 nt, Human
uggccgccugaguccagcccccc

SEQ ID NO: 1084496 - RNA, 24 nt, Human
ugggacuccuguuuuuuguuuuuu

SEQ ID NO: 1084497 - RNA, 21 nt, Human
ugggagggagggaagggggcu

SEQ ID NO: 1084498 - RNA, 19 nt, Human
uggguccugcaguuugucc

SEQ ID NO: 1084499 - RNA, 22 nt, Human
uggugaggcaagugcagaguau

SEQ ID NO: 1084500 - RNA, 19 nt, Human
uguauauaugugugugugu

SEQ ID NO: 1084501 - RNA, 24 nt, Human
ugucaggagacagcuuccucuugc

SEQ ID NO: 1084502 - RNA, 22 nt, Human
ugucccuacaaccccuccccag

SEQ ID NO: 1084503 - RNA, 23 nt, Human
ugugggaugaccgcguguauagg

SEQ ID NO: 1084504 - RNA, 18 nt, Human
ugugugugugugugugug

SEQ ID NO: 1084505 - RNA, 18 nt, Human
ugugugugugugugugug

SEQ ID NO: 1084506 - RNA, 18 nt, Human
ugugugugugugugugug

SEQ ID NO: 1084507 - RNA, 18 nt, Human
ugugugugugugugugug

SEQ ID NO: 1084508 - RNA, 18 nt, Human
ugugugugugugugugug

SEQ ID NO: 1084509 - RNA, 18 nt, Human
ugugugugugugugugug

SEQ ID NO: 1084510 - RNA, 18 nt, Human
ugugugugugugugugug

SEQ ID NO: 1084511 - RNA, 18 nt, Human
ugugugugugugugugug

SEQ ID NO: 1084512 - RNA, 21 nt, Human
ugugugugugugugugugugu

SEQ ID NO: 1084513 - RNA, 21 nt, Human
ugugugugugugugugugugu

SEQ ID NO: 1084514 - RNA, 21 nt, Human
ugugugugugugugugugugu

SEQ ID NO: 1084515 - RNA, 21 nt, Human
ugugugugugugugugugugu

SEQ ID NO: 1084516 - RNA, 21 nt, Human
ugugugugugugugugugugu

SEQ ID NO: 1084517 - RNA, 21 nt, Human
ugugugugugugugugugugu

SEQ ID NO: 1084518 - RNA, 21 nt, Human
ugugugugugugugugugugu

SEQ ID NO: 1084519 - RNA, 21 nt, Human
ugugugugugugugugugugu

SEQ ID NO: 1084520 - RNA, 21 nt, Human
ugugugugugugugugugugu

SEQ ID NO: 1084521 - RNA, 21 nt, Human
ugugugugugugugugugugu

SEQ ID NO: 1084522 - RNA, 21 nt, Human
ugugugugugugugugugugu

SEQ ID NO: 1084523 - RNA, 22 nt, Human
ugugugugugugugugugugug

SEQ ID NO: 1084524 - RNA, 22 nt, Human
ugugugugugugugugugugug

SEQ ID NO: 1084525 - RNA, 22 nt, Human
ugugugugugugugugugugug

SEQ ID NO: 1084526 - RNA, 22 nt, Human
ugugugugugugugugugugug

SEQ ID NO: 1084527 - RNA, 22 nt, Human
ugugugugugugugugugugug

SEQ ID NO: 1084528 - RNA, 20 nt, Human
uguuggggaccuuccaggcc

SEQ ID NO: 1084529 - RNA, 23 nt, Human
uguuuuuuguuuuuugcuuuuga

SEQ ID NO: 1084530 - RNA, 22 nt, Human
uuaaaagaacacaaacuaaaaa

SEQ ID NO: 1084531 - RNA, 24 nt, Human
uuucccucacuggguccugcaguu

SEQ ID NO: 1084532 - RNA, 21 nt, Human
uuuguuuggaggaggucugac

SEQ ID NO: 1084533 - RNA, 22 nt, Human
uuuuuguuuuuuguuuuuugcu

SEQ ID NO: 1084534 - RNA, 20 nt, Human
cagguucuggguggucuccu

SEQ ID NO: 1084535 - RNA, 23 nt, Human
ccagguucuggguggucuccuuu

SEQ ID NO: 1084536 - RNA, 18 nt, Human
cuaccagguucugggugg

SEQ ID NO: 1084537 - RNA, 23 nt, Human
guauaggagucuaccagguucug

SEQ ID NO: 1084538 - RNA, 19 nt, Human
uaccagguucugggugguc

SEQ ID NO: 1084539 - RNA, 20 nt, Human
uaccagguucuggguggucu

SEQ ID NO: 1084540 - RNA, 24 nt, Human
ucuaccagguucuggguggucucc

SEQ ID NO: 1084541 - RNA, 24 nt, Human
uguauaggagucuaccagguucug

SEQ ID NO: 1084542 - RNA, 19 nt, Human
aaaaaaaacugaguagaca

SEQ ID NO: 1084543 - RNA, 23 nt, Human
aacacagguaccaaagacugccc

SEQ ID NO: 1084544 - RNA, 23 nt, Human
aaccuucuucccuguuugcccac

SEQ ID NO: 1084545 - RNA, 18 nt, Human
aacuccuagcccaguccc

SEQ ID NO: 1084546 - RNA, 22 nt, Human
aaggagcacuggcugccggggg

SEQ ID NO: 1084547 - RNA, 24 nt, Human
aaguccccucccagaucugugacc

SEQ ID NO: 1084548 - RNA, 24 nt, Human
acacaaaaauuuuaaaaauagcug

SEQ ID NO: 1084549 - RNA, 20 nt, Human
acacagguaccaaagacugc

SEQ ID NO: 1084550 - RNA, 27 nt, Human
acacagguaccaaagacugccccccac

SEQ ID NO: 1084551 - RNA, 23 nt, Human
acagagggagccugggggccaca

SEQ ID NO: 1084552 - RNA, 20 nt, Human
acagucccagaagggcccag

SEQ ID NO: 1084553 - RNA, 23 nt, Human
accaaagacugccccccacggcc

SEQ ID NO: 1084554 - RNA, 21 nt, Human
accuggagugacggggggagc

SEQ ID NO: 1084555 - RNA, 23 nt, Human
acuguacuccagccuggugacag

SEQ ID NO: 1084556 - RNA, 25 nt, Human
acuguacuccagccuggugacagag

SEQ ID NO: 1084557 - RNA, 19 nt, Human
acugugugaccagcaaggu

SEQ ID NO: 1084558 - RNA, 23 nt, Human
acuuugagcccaggagguggagg

SEQ ID NO: 1084559 - RNA, 24 nt, Human
agacccuaucaccgccccccgccc

SEQ ID NO: 1084560 - RNA, 22 nt, Human
agacugccccccacggccccaa

SEQ ID NO: 1084561 - RNA, 22 nt, Human
agagcgagacccuaucaccgcc

SEQ ID NO: 1084562 - RNA, 23 nt, Human
agaguggggcugugggaccagcg

SEQ ID NO: 1084563 - RNA, 22 nt, Human
agcaaggcagccagggcggcac

SEQ ID NO: 1084564 - RNA, 23 nt, Human
agccugggccacauagugagacc

SEQ ID NO: 1084565 - RNA, 24 nt, Human
agccugggccacauagugagaccu

SEQ ID NO: 1084566 - RNA, 23 nt, Human
agccuggugacagagcgagaccc

SEQ ID NO: 1084567 - RNA, 26 nt, Human
agcugggcuuggugguggcaugugcc

SEQ ID NO: 1084568 - RNA, 19 nt, Human
aggagcagaggcgagucug

SEQ ID NO: 1084569 - RNA, 24 nt, Human
aggaguucgagaccagccugggcc

SEQ ID NO: 1084570 - RNA, 24 nt, Human
aggaucacuugagcccaggaguuc

SEQ ID NO: 1084571 - RNA, 18 nt, Human
aggcaggaggaucacuug

SEQ ID NO: 1084572 - RNA, 23 nt, Human
aggcaggaggaucacuugagccc

SEQ ID NO: 1084573 - RNA, 24 nt, Human
aggcaggaggaucacuugagccca

SEQ ID NO: 1084574 - RNA, 24 nt, Human
aggccgaggcaggaggaucacuug

SEQ ID NO: 1084575 - RNA, 22 nt, Human
aggcuauuuggcacccaggucu

SEQ ID NO: 1084576 - RNA, 26 nt, Human
agguaccaaagacugccccccacggc

SEQ ID NO: 1084577 - RNA, 19 nt, Human
agguggaggcugcagugag

SEQ ID NO: 1084578 - RNA, 20 nt, Human
agguggaggcugcagugagc

SEQ ID NO: 1084579 - RNA, 19 nt, Human
aguccagcgucaggaugcc

SEQ ID NO: 1084580 - RNA, 25 nt, Human
agugacggggggagcuugacaagga

SEQ ID NO: 1084581 - RNA, 23 nt, Human
aucacuguacuccagccugguga

SEQ ID NO: 1084582 - RNA, 26 nt, Human
aucucuccccucccugugccucccag

SEQ ID NO: 1084583 - RNA, 20 nt, Human
augaagcagggauuggggcu

SEQ ID NO: 1084584 - RNA, 21 nt, Human
augugggaaccagaacacacu

SEQ ID NO: 1084585 - RNA, 22 nt, Human
augugggaaccagaacacacug

SEQ ID NO: 1084586 - RNA, 18 nt, Human
auuucuucuccacacccc

SEQ ID NO: 1084587 - RNA, 19 nt, Human
caacuccuagcccaguccc

SEQ ID NO: 1084588 - RNA, 22 nt, Human
cacacugauggaggaguuggca

SEQ ID NO: 1084589 - RNA, 23 nt, Human
cacagguaccaaagacugccccc

SEQ ID NO: 1084590 - RNA, 26 nt, Human
caccaaaaaaaaacugaguagacagu

SEQ ID NO: 1084591 - RNA, 19 nt, Human
caccaugcccaugcccccg

SEQ ID NO: 1084592 - RNA, 20 nt, Human
caccaugcccaugcccccgc

SEQ ID NO: 1084593 - RNA, 21 nt, Human
cacccagaccugagcuaggac

SEQ ID NO: 1084594 - RNA, 21 nt, Human
cacuccuggaggccgaggcag

SEQ ID NO: 1084595 - RNA, 19 nt, Human
cacugcgcuggggcggggu

SEQ ID NO: 1084596 - RNA, 20 nt, Human
cacuggcugccggggggggg

SEQ ID NO: 1084597 - RNA, 18 nt, Human
cacuguacuccagccugg

SEQ ID NO: 1084598 - RNA, 18 nt, Human
cacuguacuccagccugg

SEQ ID NO: 1084599 - RNA, 18 nt, Human
cacuguacuccagccugg

SEQ ID NO: 1084600 - RNA, 22 nt, Human
cacuguacuccagccuggugac

SEQ ID NO: 1084601 - RNA, 23 nt, Human
cacuguacuccagccuggugaca

SEQ ID NO: 1084602 - RNA, 24 nt, Human
cacuguacuccagccuggugacag

SEQ ID NO: 1084603 - RNA, 21 nt, Human
cagagcaucccugacgaacac

SEQ ID NO: 1084604 - RNA, 19 nt, Human
cagagccucagcaucccuu

SEQ ID NO: 1084605 - RNA, 19 nt, Human
cagccagggcggcacaggc

SEQ ID NO: 1084606 - RNA, 20 nt, Human
caggagguggaggcugcagu

SEQ ID NO: 1084607 - RNA, 23 nt, Human
caggaugcccaggcuccugggcu

SEQ ID NO: 1084608 - RNA, 18 nt, Human
caggcacagcagcaugac

SEQ ID NO: 1084609 - RNA, 19 nt, Human
caggcaucaacuccaacuc

SEQ ID NO: 1084610 - RNA, 25 nt, Human
caggcuccugggcuuccuccccgag

SEQ ID NO: 1084611 - RNA, 24 nt, Human
cagggcggcacaggcaccaggucc

SEQ ID NO: 1084612 - RNA, 24 nt, Human
cagucaucacuguacuccagccug

SEQ ID NO: 1084613 - RNA, 24 nt, Human
cagugagcagucaucacuguacuc

SEQ ID NO: 1084614 - RNA, 18 nt, Human
cauccuuuggcugggccu

SEQ ID NO: 1084615 - RNA, 24 nt, Human
caucucuccccucccugugccucc

SEQ ID NO: 1084616 - RNA, 24 nt, Human
caugcaccacgcgcugaaggaggc

SEQ ID NO: 1084617 - RNA, 20 nt, Human
ccaaagacugccccccacgg

SEQ ID NO: 1084618 - RNA, 20 nt, Human
ccaacuccuagcccaguccc

SEQ ID NO: 1084619 - RNA, 18 nt, Human
ccacaccccuccccgccc

SEQ ID NO: 1084620 - RNA, 20 nt, Human
ccacauagugagaccuuguc

SEQ ID NO: 1084621 - RNA, 24 nt, Human
ccacggccccaaaaucccccaccc

SEQ ID NO: 1084622 - RNA, 24 nt, Human
ccacuggaccacaggagcagaggc

SEQ ID NO: 1084623 - RNA, 19 nt, Human
ccacuuccaaguccugacu

SEQ ID NO: 1084624 - RNA, 22 nt, Human
ccacuuccaaguccugacuccu

SEQ ID NO: 1084625 - RNA, 25 nt, Human
ccaggaguucgagaccagccugggc

SEQ ID NO: 1084626 - RNA, 20 nt, Human
ccaggucgcccaaguccagc

SEQ ID NO: 1084627 - RNA, 19 nt, Human
ccaugcccccgcccgugga

SEQ ID NO: 1084628 - RNA, 24 nt, Human
cccaaaaucccccacccgggaugc

SEQ ID NO: 1084629 - RNA, 25 nt, Human
cccaaaaucccccacccgggaugcc

SEQ ID NO: 1084630 - RNA, 25 nt, Human
cccacagagcuccuguauccaggca

SEQ ID NO: 1084631 - RNA, 22 nt, Human
cccacccgggaugcccagagga

SEQ ID NO: 1084632 - RNA, 24 nt, Human
cccacggccccaaaaucccccacc

SEQ ID NO: 1084633 - RNA, 20 nt, Human
cccauauauaaaaaugaagc

SEQ ID NO: 1084634 - RNA, 21 nt, Human
cccauauauaaaaaugaagca

SEQ ID NO: 1084635 - RNA, 23 nt, Human
cccccacccgggaugcccagagg

SEQ ID NO: 1084636 - RNA, 21 nt, Human
ccccccacggccccaaaaucc

SEQ ID NO: 1084637 - RNA, 25 nt, Human
cccccgccccaccaaaaaaaaacug

SEQ ID NO: 1084638 - RNA, 22 nt, Human
ccccgccccaccaaaaaaaaac

SEQ ID NO: 1084639 - RNA, 18 nt, Human
ccccgcccgacccugucu

SEQ ID NO: 1084640 - RNA, 18 nt, Human
ccccucccugugccuccc

SEQ ID NO: 1084641 - RNA, 19 nt, Human
cccgccccaccaaaaaaaa

SEQ ID NO: 1084642 - RNA, 23 nt, Human
cccgccccaccaaaaaaaaacug

SEQ ID NO: 1084643 - RNA, 21 nt, Human
cccugacgaacacagguacca

SEQ ID NO: 1084644 - RNA, 22 nt, Human
cccuuucccucccagagccuca

SEQ ID NO: 1084645 - RNA, 20 nt, Human
ccgccccaccaaaaaaaaac

SEQ ID NO: 1084646 - RNA, 20 nt, Human
ccgccccccgccccaccaaa

SEQ ID NO: 1084647 - RNA, 19 nt, Human
ccggggggggggggggugu

SEQ ID NO: 1084648 - RNA, 23 nt, Human
ccuaucaccgccccccgccccac

SEQ ID NO: 1084649 - RNA, 22 nt, Human
ccugagcuaggacagagggagc

SEQ ID NO: 1084650 - RNA, 21 nt, Human
ccugggccacauagugagacc

SEQ ID NO: 1084651 - RNA, 18 nt, Human
ccugucuaaacuaauggg

SEQ ID NO: 1084652 - RNA, 24 nt, Human
cgagaccagccugggccacauagu

SEQ ID NO: 1084653 - RNA, 21 nt, Human
cgagacccuaucaccgccccc

SEQ ID NO: 1084654 - RNA, 22 nt, Human
cgagacccuaucaccgcccccc

SEQ ID NO: 1084655 - RNA, 19 nt, Human
cgagcacacgaguguaaag

SEQ ID NO: 1084656 - RNA, 20 nt, Human
cgaggcaggaggaucacuug

SEQ ID NO: 1084657 - RNA, 24 nt, Human
cgaggcaggaggaucacuugagcc

SEQ ID NO: 1084658 - RNA, 20 nt, Human
cgcucagcaucaucggugac

SEQ ID NO: 1084659 - RNA, 21 nt, Human
cggccccaaaaucccccaccc

SEQ ID NO: 1084660 - RNA, 21 nt, Human
cuacugcauccuuuggcuggg

SEQ ID NO: 1084661 - RNA, 19 nt, Human
cuccacaccccuccccgcc

SEQ ID NO: 1084662 - RNA, 23 nt, Human
cuccacaccccuccccgcccgac

SEQ ID NO: 1084663 - RNA, 24 nt, Human
cuccagccuggugacagagcgaga

SEQ ID NO: 1084664 - RNA, 22 nt, Human
cuccuagcccagucccgggggc

SEQ ID NO: 1084665 - RNA, 22 nt, Human
cuccugccggguccgcccuugg

SEQ ID NO: 1084666 - RNA, 26 nt, Human
cugacuccagucuugcuaacacacac

SEQ ID NO: 1084667 - RNA, 23 nt, Human
cuggaccucgguguccccaucug

SEQ ID NO: 1084668 - RNA, 20 nt, Human
cugggcuuccuccugccggg

SEQ ID NO: 1084669 - RNA, 21 nt, Human
cuuaaguccccucccagaucu

SEQ ID NO: 1084670 - RNA, 19 nt, Human
cuuugagcccaggaggugg

SEQ ID NO: 1084671 - RNA, 23 nt, Human
cuuuggcugggccuuguugaccc

SEQ ID NO: 1084672 - RNA, 20 nt, Human
gagaugcugcacaugcaccc

SEQ ID NO: 1084673 - RNA, 18 nt, Human
gagcgagcacacgagugu

SEQ ID NO: 1084674 - RNA, 18 nt, Human
gagugcccugggggcaag

SEQ ID NO: 1084675 - RNA, 24 nt, Human
gaucacuugagcccaggaguucga

SEQ ID NO: 1084676 - RNA, 22 nt, Human
gcaugugccuguaguccuagcu

SEQ ID NO: 1084677 - RNA, 23 nt, Human
gccacauagugagaccuugucuc

SEQ ID NO: 1084678 - RNA, 24 nt, Human
gcccaggagguggaggcugcagug

SEQ ID NO: 1084679 - RNA, 22 nt, Human
gcccaggaguucgagaccagcc

SEQ ID NO: 1084680 - RNA, 23 nt, Human
gccgcgagggcagggaugggagu

SEQ ID NO: 1084681 - RNA, 22 nt, Human
gcgagacccuaucaccgccccc

SEQ ID NO: 1084682 - RNA, 21 nt, Human
gcugccggggggggggggggu

SEQ ID NO: 1084683 - RNA, 19 nt, Human
ggaagcgugccccauaccc

SEQ ID NO: 1084684 - RNA, 22 nt, Human
ggaggccgaggcaggaggauca

SEQ ID NO: 1084685 - RNA, 18 nt, Human
ggaggcugcagugagcag

SEQ ID NO: 1084686 - RNA, 23 nt, Human
ggaucacuugagcccaggaguuc

SEQ ID NO: 1084687 - RNA, 22 nt, Human
ggcaagaucacuggacugggag

SEQ ID NO: 1084688 - RNA, 22 nt, Human
ggcaagcucauuucuucuccac

SEQ ID NO: 1084689 - RNA, 18 nt, Human
ggcaaguggcacaccccc

SEQ ID NO: 1084690 - RNA, 18 nt, Human
ggcacccaggucuauggu

SEQ ID NO: 1084691 - RNA, 18 nt, Human
ggccgaggcaggaggauc

SEQ ID NO: 1084692 - RNA, 19 nt, Human
ggcuccugggcuuccuccu

SEQ ID NO: 1084693 - RNA, 22 nt, Human
ggcugccggggggggggggggu

SEQ ID NO: 1084694 - RNA, 20 nt, Human
ggcuuggugguggcaugugc

SEQ ID NO: 1084695 - RNA, 19 nt, Human
gggcaaguggcacaccccc

SEQ ID NO: 1084696 - RNA, 22 nt, Human
gggcaaguggcacacccccuuc

SEQ ID NO: 1084697 - RNA, 22 nt, Human
ggggagguggaucuuccagucg

SEQ ID NO: 1084698 - RNA, 19 nt, Human
ggggcugugggaccagcgc

SEQ ID NO: 1084699 - RNA, 22 nt, Human
ggggcugugggaccagcgccca

SEQ ID NO: 1084700 - RNA, 21 nt, Human
ggggggguguguggagcuggg

SEQ ID NO: 1084701 - RNA, 20 nt, Human
gggguauaggcaagcagcaa

SEQ ID NO: 1084702 - RNA, 23 nt, Human
gguagccgcgagggcagggaugg

SEQ ID NO: 1084703 - RNA, 25 nt, Human
ggucccaaccuucuucccuguuugc

SEQ ID NO: 1084704 - RNA, 23 nt, Human
guacuccagccuggugacagagc

SEQ ID NO: 1084705 - RNA, 18 nt, Human
guccagcgucaggaugcc

SEQ ID NO: 1084706 - RNA, 23 nt, Human
gucuuuuccucuggaccucggug

SEQ ID NO: 1084707 - RNA, 22 nt, Human
uaacugccaacgugaguucaga

SEQ ID NO: 1084708 - RNA, 19 nt, Human
uacuccagccuggugacag

SEQ ID NO: 1084709 - RNA, 23 nt, Human
uacuccagccuggugacagagcg

SEQ ID NO: 1084710 - RNA, 19 nt, Human
uaggacagagggagccugg

SEQ ID NO: 1084711 - RNA, 24 nt, Human
uaggcaagucccuuucccucccag

SEQ ID NO: 1084712 - RNA, 30 nt, Human
uaggcaagucccuuucccucccagagccuu

SEQ ID NO: 1084713 - RNA, 24 nt, Human
uaguccuagcuacucgagaggcug

SEQ ID NO: 1084714 - RNA, 18 nt, Human
uauugggcaagaucacug

SEQ ID NO: 1084715 - RNA, 21 nt, Human
ucaacuccaacucccacuccu

SEQ ID NO: 1084716 - RNA, 20 nt, Human
ucacuguacuccagccuggu

SEQ ID NO: 1084717 - RNA, 23 nt, Human
ucacuguacuccagccuggugac

SEQ ID NO: 1084718 - RNA, 20 nt, Human
ucacuugagcccaggaguuc

SEQ ID NO: 1084719 - RNA, 24 nt, Human
uccacaccccuccccgcccgaccc

SEQ ID NO: 1084720 - RNA, 22 nt, Human
uccagccuggugacagagcgag

SEQ ID NO: 1084721 - RNA, 27 nt, Human
uccagcgcacagucccagaagggcccc

SEQ ID NO: 1084722 - RNA, 21 nt, Human
uccccagagcucaggacccug

SEQ ID NO: 1084723 - RNA, 19 nt, Human
uccggccacuggaccacag

SEQ ID NO: 1084724 - RNA, 21 nt, Human
uccggccacuggaccacagga

SEQ ID NO: 1084725 - RNA, 24 nt, Human
ucgcccaucucuccccucccugug

SEQ ID NO: 1084726 - RNA, 22 nt, Human
ucggagccgcuggccaauaugu

SEQ ID NO: 1084727 - RNA, 23 nt, Human
ucuccuaggauggcuguggggau

SEQ ID NO: 1084728 - RNA, 21 nt, Human
ucucgcugcugggggcggggc

SEQ ID NO: 1084729 - RNA, 20 nt, Human
ucuuucaagaacauucacuc

SEQ ID NO: 1084730 - RNA, 22 nt, Human
ugaagccuacuucacucccaaa

SEQ ID NO: 1084731 - RNA, 18 nt, Human
ugacggggggagcuugac

SEQ ID NO: 1084732 - RNA, 20 nt, Human
ugacuccuuugagccauccc

SEQ ID NO: 1084733 - RNA, 20 nt, Human
ugagaaaaggcaguggggag

SEQ ID NO: 1084734 - RNA, 21 nt, Human
ugagaaaaggcaguggggagg

SEQ ID NO: 1084735 - RNA, 23 nt, Human
ugagaaaaggcaguggggaggug

SEQ ID NO: 1084736 - RNA, 23 nt, Human
ugagcccaggaguucgagaccag

SEQ ID NO: 1084737 - RNA, 19 nt, Human
ugaggugugacauauggga

SEQ ID NO: 1084738 - RNA, 22 nt, Human
ugcccagaggagugcccugggg

SEQ ID NO: 1084739 - RNA, 24 nt, Human
ugcccagaggagugcccugggggc

SEQ ID NO: 1084740 - RNA, 21 nt, Human
ugcccugggggcaaguggcac

SEQ ID NO: 1084741 - RNA, 23 nt, Human
ugcccugggggcaaguggcacac

SEQ ID NO: 1084742 - RNA, 19 nt, Human
ugcccugugaugugcuguu

SEQ ID NO: 1084743 - RNA, 22 nt, Human
ugccuguaguccuagcuacucg

SEQ ID NO: 1084744 - RNA, 23 nt, Human
ugccuguaguccuagcuacucga

SEQ ID NO: 1084745 - RNA, 21 nt, Human
ugcugggggcggggcuuaagc

SEQ ID NO: 1084746 - RNA, 26 nt, Human
uggauuuccuucagcuacccugaugu

SEQ ID NO: 1084747 - RNA, 24 nt, Human
uggcagagcaggcacagcagcauu

SEQ ID NO: 1084748 - RNA, 23 nt, Human
ugggauguucucgcugcuggggg

SEQ ID NO: 1084749 - RNA, 24 nt, Human
ugguagccgcgagggcagggaugg

SEQ ID NO: 1084750 - RNA, 22 nt, Human
ugguggcaugugccuguagucc

SEQ ID NO: 1084751 - RNA, 20 nt, Human
uguaaagaauggcacccaga

SEQ ID NO: 1084752 - RNA, 24 nt, Human
uguccggccacuggaccacaggag

SEQ ID NO: 1084753 - RNA, 24 nt, Human
ugugaugugugcgugagcgagcac

SEQ ID NO: 1084754 - RNA, 21 nt, Human
ugugccuguaguccuagcuac

SEQ ID NO: 1084755 - RNA, 24 nt, Human
uguuuuuguuuccaaauggcugga

SEQ ID NO: 1084756 - RNA, 20 nt, Human
uucuccacaccccuccccgc

SEQ ID NO: 1084757 - RNA, 24 nt, Human
uucucgcugcugggggcggggcuu

SEQ ID NO: 1084758 - RNA, 18 nt, Human
uucucuaaggaagaacaa

SEQ ID NO: 1084759 - RNA, 22 nt, Human
uugagcccaggaguucgagacc

SEQ ID NO: 1084760 - RNA, 19 nt, Human
uuucuaaggaaaaugguuc

SEQ ID NO: 1084761 - RNA, 21 nt, Human
uuugcccacucucagaccccg

SEQ ID NO: 1084762 - RNA, 22 nt, Human
ccucuaagauuauaguuauuaa

SEQ ID NO: 1084763 - RNA, 19 nt, Human
aaaaaaaacugaguagaca

SEQ ID NO: 1084764 - RNA, 23 nt, Human
aacacagguaccaaagacugccc

SEQ ID NO: 1084765 - RNA, 23 nt, Human
aaccuucuucccuguuugcccac

SEQ ID NO: 1084766 - RNA, 18 nt, Human
aacuccuagcccaguccc

SEQ ID NO: 1084767 - RNA, 22 nt, Human
aaggagcacuggcugccggggg

SEQ ID NO: 1084768 - RNA, 24 nt, Human
aaguccccucccagaucugugacc

SEQ ID NO: 1084769 - RNA, 24 nt, Human
acacaaaaauuuuaaaaauagcug

SEQ ID NO: 1084770 - RNA, 23 nt, Human
acagagggagccugggggccaca

SEQ ID NO: 1084771 - RNA, 25 nt, Human
acagguaccaaagacugccccccac

SEQ ID NO: 1084772 - RNA, 20 nt, Human
acagucccagaagggcccag

SEQ ID NO: 1084773 - RNA, 23 nt, Human
accaaagacugccccccacggcc

SEQ ID NO: 1084774 - RNA, 19 nt, Human
acccugauguccccacuuc

SEQ ID NO: 1084775 - RNA, 23 nt, Human
acuguacuccagccuggugacag

SEQ ID NO: 1084776 - RNA, 25 nt, Human
acuguacuccagccuggugacagag

SEQ ID NO: 1084777 - RNA, 19 nt, Human
acugugugaccagcaaggu

SEQ ID NO: 1084778 - RNA, 20 nt, Human
acuuccaaguccugacuccu

SEQ ID NO: 1084779 - RNA, 23 nt, Human
acuuugagcccaggagguggagg

SEQ ID NO: 1084780 - RNA, 24 nt, Human
agacccuaucaccgccccccgccc

SEQ ID NO: 1084781 - RNA, 22 nt, Human
agacugccccccacggccccaa

SEQ ID NO: 1084782 - RNA, 23 nt, Human
agaguggggcugugggaccagcg

SEQ ID NO: 1084783 - RNA, 22 nt, Human
agcaaggcagccagggcggcac

SEQ ID NO: 1084784 - RNA, 23 nt, Human
agccugggccacauagugagacc

SEQ ID NO: 1084785 - RNA, 24 nt, Human
agccugggccacauagugagaccu

SEQ ID NO: 1084786 - RNA, 23 nt, Human
agccuggugacagagcgagaccc

SEQ ID NO: 1084787 - RNA, 26 nt, Human
agcugggcuuggugguggcaugugcc

SEQ ID NO: 1084788 - RNA, 19 nt, Human
aggagcagaggcgagucug

SEQ ID NO: 1084789 - RNA, 24 nt, Human
aggaguucgagaccagccugggcc

SEQ ID NO: 1084790 - RNA, 24 nt, Human
aggaucacuugagcccaggaguuc

SEQ ID NO: 1084791 - RNA, 18 nt, Human
aggcaggaggaucacuug

SEQ ID NO: 1084792 - RNA, 23 nt, Human
aggcaggaggaucacuugagccc

SEQ ID NO: 1084793 - RNA, 24 nt, Human
aggcaggaggaucacuugagccca

SEQ ID NO: 1084794 - RNA, 24 nt, Human
aggccgaggcaggaggaucacuug

SEQ ID NO: 1084795 - RNA, 22 nt, Human
aggcuauuuggcacccaggucu

SEQ ID NO: 1084796 - RNA, 26 nt, Human
agguaccaaagacugccccccacggc

SEQ ID NO: 1084797 - RNA, 19 nt, Human
agguggaggcugcagugag

SEQ ID NO: 1084798 - RNA, 22 nt, Human
agguggaggcugcagugagcag

SEQ ID NO: 1084799 - RNA, 19 nt, Human
aguccagcgucaggaugcc

SEQ ID NO: 1084800 - RNA, 25 nt, Human
agugacggggggagcuugacaagga

SEQ ID NO: 1084801 - RNA, 26 nt, Human
aucucuccccucccugugccucccag

SEQ ID NO: 1084802 - RNA, 20 nt, Human
augaagcagggauuggggcu

SEQ ID NO: 1084803 - RNA, 25 nt, Human
augcccagaggagugcccugggggc

SEQ ID NO: 1084804 - RNA, 21 nt, Human
augugggaaccagaacacacu

SEQ ID NO: 1084805 - RNA, 22 nt, Human
augugggaaccagaacacacug

SEQ ID NO: 1084806 - RNA, 18 nt, Human
auuucuucuccacacccc

SEQ ID NO: 1084807 - RNA, 19 nt, Human
caacuccuagcccaguccc

SEQ ID NO: 1084808 - RNA, 22 nt, Human
cacacugauggaggaguuggca

SEQ ID NO: 1084809 - RNA, 19 nt, Human
cacagguaccaaagacugc

SEQ ID NO: 1084810 - RNA, 23 nt, Human
cacagguaccaaagacugccccc

SEQ ID NO: 1084811 - RNA, 25 nt, Human
caccaaaaaaaaacugaguagacag

SEQ ID NO: 1084812 - RNA, 19 nt, Human
caccaugcccaugcccccg

SEQ ID NO: 1084813 - RNA, 20 nt, Human
caccaugcccaugcccccgc

SEQ ID NO: 1084814 - RNA, 21 nt, Human
cacccagaccugagcuaggac

SEQ ID NO: 1084815 - RNA, 22 nt, Human
caccuggagugacggggggagc

SEQ ID NO: 1084816 - RNA, 21 nt, Human
cacuccuggaggccgaggcag

SEQ ID NO: 1084817 - RNA, 19 nt, Human
cacugcgcuggggcggggu

SEQ ID NO: 1084818 - RNA, 20 nt, Human
cacuggcugccggggggggg

SEQ ID NO: 1084819 - RNA, 18 nt, Human
cacuguacuccagccugg

SEQ ID NO: 1084820 - RNA, 18 nt, Human
cacuguacuccagccugg

SEQ ID NO: 1084821 - RNA, 18 nt, Human
cacuguacuccagccugg

SEQ ID NO: 1084822 - RNA, 21 nt, Human
cacuguacuccagccugguga

SEQ ID NO: 1084823 - RNA, 22 nt, Human
cacuguacuccagccuggugac

SEQ ID NO: 1084824 - RNA, 23 nt, Human
cacuguacuccagccuggugaca

SEQ ID NO: 1084825 - RNA, 23 nt, Human
cacuguacuccagccuggugaca

SEQ ID NO: 1084826 - RNA, 21 nt, Human
cagagcaucccugacgaacac

SEQ ID NO: 1084827 - RNA, 19 nt, Human
cagagccucagcaucccuu

SEQ ID NO: 1084828 - RNA, 23 nt, Human
cagagcgagacccuaucaccgcc

SEQ ID NO: 1084829 - RNA, 19 nt, Human
cagccagggcggcacaggc

SEQ ID NO: 1084830 - RNA, 20 nt, Human
caggagguggaggcugcagu

SEQ ID NO: 1084831 - RNA, 18 nt, Human
caggcacagcagcaugac

SEQ ID NO: 1084832 - RNA, 25 nt, Human
caggcuccugggcuuccuccccgag

SEQ ID NO: 1084833 - RNA, 21 nt, Human
caggcuccugggcuuccuccu

SEQ ID NO: 1084834 - RNA, 24 nt, Human
cagggcggcacaggcaccaggucc

SEQ ID NO: 1084835 - RNA, 24 nt, Human
cagucaucacuguacuccagccug

SEQ ID NO: 1084836 - RNA, 24 nt, Human
cagugagcagucaucacuguacuc

SEQ ID NO: 1084837 - RNA, 18 nt, Human
cauccuuuggcugggccu

SEQ ID NO: 1084838 - RNA, 24 nt, Human
caucucuccccucccugugccucc

SEQ ID NO: 1084839 - RNA, 24 nt, Human
caugcaccacgcgcugaaggaggc

SEQ ID NO: 1084840 - RNA, 22 nt, Human
ccaaaaucccccacccgggaug

SEQ ID NO: 1084841 - RNA, 24 nt, Human
ccaaaaucccccacccgggaugcc

SEQ ID NO: 1084842 - RNA, 20 nt, Human
ccaaagacugccccccacgg

SEQ ID NO: 1084843 - RNA, 21 nt, Human
ccaacuccuagcccagucccg

SEQ ID NO: 1084844 - RNA, 18 nt, Human
ccacaccccuccccgccc

SEQ ID NO: 1084845 - RNA, 21 nt, Human
ccacaccccuccccgcccgac

SEQ ID NO: 1084846 - RNA, 20 nt, Human
ccacauagugagaccuuguc

SEQ ID NO: 1084847 - RNA, 19 nt, Human
ccacuuccaaguccugacu

SEQ ID NO: 1084848 - RNA, 25 nt, Human
ccaggaguucgagaccagccugggc

SEQ ID NO: 1084849 - RNA, 20 nt, Human
ccaggucgcccaaguccagc

SEQ ID NO: 1084850 - RNA, 19 nt, Human
ccaugcccccgcccgugga

SEQ ID NO: 1084851 - RNA, 25 nt, Human
cccacagagcuccuguauccaggca

SEQ ID NO: 1084852 - RNA, 22 nt, Human
cccacccgggaugcccagagga

SEQ ID NO: 1084853 - RNA, 20 nt, Human
cccauauauaaaaaugaagc

SEQ ID NO: 1084854 - RNA, 21 nt, Human
cccauauauaaaaaugaagca

SEQ ID NO: 1084855 - RNA, 23 nt, Human
cccccacccgggaugcccagagg

SEQ ID NO: 1084856 - RNA, 21 nt, Human
ccccccacggccccaaaaucc

SEQ ID NO: 1084857 - RNA, 22 nt, Human
ccccgccccaccaaaaaaaaac

SEQ ID NO: 1084858 - RNA, 18 nt, Human
ccccgcccgacccugucu

SEQ ID NO: 1084859 - RNA, 18 nt, Human
ccccucccugugccuccc

SEQ ID NO: 1084860 - RNA, 19 nt, Human
cccgccccaccaaaaaaaa

SEQ ID NO: 1084861 - RNA, 23 nt, Human
cccgccccaccaaaaaaaaacug

SEQ ID NO: 1084862 - RNA, 21 nt, Human
cccugacgaacacagguacca

SEQ ID NO: 1084863 - RNA, 22 nt, Human
cccuuucccucccagagccuca

SEQ ID NO: 1084864 - RNA, 20 nt, Human
ccgccccaccaaaaaaaaac

SEQ ID NO: 1084865 - RNA, 22 nt, Human
ccgccccaccaaaaaaaaacug

SEQ ID NO: 1084866 - RNA, 20 nt, Human
ccgccccccgccccaccaaa

SEQ ID NO: 1084867 - RNA, 19 nt, Human
ccggggggggggggggugu

SEQ ID NO: 1084868 - RNA, 23 nt, Human
ccuaucaccgccccccgccccac

SEQ ID NO: 1084869 - RNA, 22 nt, Human
ccugagcuaggacagagggagc

SEQ ID NO: 1084870 - RNA, 21 nt, Human
ccugggccacauagugagacc

SEQ ID NO: 1084871 - RNA, 19 nt, Human
ccuguaguccuagcuacuc

SEQ ID NO: 1084872 - RNA, 18 nt, Human
ccugucuaaacuaauggg

SEQ ID NO: 1084873 - RNA, 24 nt, Human
cgagaccagccugggccacauagu

SEQ ID NO: 1084874 - RNA, 21 nt, Human
cgagacccuaucaccgccccc

SEQ ID NO: 1084875 - RNA, 22 nt, Human
cgagacccuaucaccgcccccc

SEQ ID NO: 1084876 - RNA, 19 nt, Human
cgagcacacgaguguaaag

SEQ ID NO: 1084877 - RNA, 20 nt, Human
cgaggcaggaggaucacuug

SEQ ID NO: 1084878 - RNA, 24 nt, Human
cgaggcaggaggaucacuugagcc

SEQ ID NO: 1084879 - RNA, 20 nt, Human
cgcucagcaucaucggugac

SEQ ID NO: 1084880 - RNA, 20 nt, Human
cggccccaaaaucccccacc

SEQ ID NO: 1084881 - RNA, 21 nt, Human
cggccccaaaaucccccaccc

SEQ ID NO: 1084882 - RNA, 21 nt, Human
cuacugcauccuuuggcuggg

SEQ ID NO: 1084883 - RNA, 19 nt, Human
cuccacaccccuccccgcc

SEQ ID NO: 1084884 - RNA, 22 nt, Human
cuccuagcccagucccgggggc

SEQ ID NO: 1084885 - RNA, 23 nt, Human
cuccugccggguccgcccuuggg

SEQ ID NO: 1084886 - RNA, 26 nt, Human
cugacuccagucuugcuaacacacac

SEQ ID NO: 1084887 - RNA, 23 nt, Human
cuggaccucgguguccccaucug

SEQ ID NO: 1084888 - RNA, 24 nt, Human
cuggaggccgaggcaggaggauca

SEQ ID NO: 1084889 - RNA, 20 nt, Human
cugggcuuccuccugccggg

SEQ ID NO: 1084890 - RNA, 21 nt, Human
cuuaaguccccucccagaucu

SEQ ID NO: 1084891 - RNA, 19 nt, Human
cuuugagcccaggaggugg

SEQ ID NO: 1084892 - RNA, 24 nt, Human
cuuuggcugggccuuguugacccc

SEQ ID NO: 1084893 - RNA, 20 nt, Human
gagaugcugcacaugcaccc

SEQ ID NO: 1084894 - RNA, 18 nt, Human
gagcgagcacacgagugu

SEQ ID NO: 1084895 - RNA, 18 nt, Human
gagugcccugggggcaag

SEQ ID NO: 1084896 - RNA, 24 nt, Human
gaucacuugagcccaggaguucga

SEQ ID NO: 1084897 - RNA, 23 nt, Human
gccacauagugagaccuugucuc

SEQ ID NO: 1084898 - RNA, 24 nt, Human
gcccaggagguggaggcugcagug

SEQ ID NO: 1084899 - RNA, 22 nt, Human
gcccaggaguucgagaccagcc

SEQ ID NO: 1084900 - RNA, 19 nt, Human
gccccaaaaucccccaccc

SEQ ID NO: 1084901 - RNA, 23 nt, Human
gccgcgagggcagggaugggagu

SEQ ID NO: 1084902 - RNA, 22 nt, Human
gcgagacccuaucaccgccccc

SEQ ID NO: 1084903 - RNA, 21 nt, Human
gcugccggggggggggggggu

SEQ ID NO: 1084904 - RNA, 19 nt, Human
ggaagcgugccccauaccc

SEQ ID NO: 1084905 - RNA, 18 nt, Human
ggaggcugcagugagcag

SEQ ID NO: 1084906 - RNA, 23 nt, Human
ggaucacuugagcccaggaguuc

SEQ ID NO: 1084907 - RNA, 22 nt, Human
ggcaagaucacuggacugggag

SEQ ID NO: 1084908 - RNA, 22 nt, Human
ggcaagcucauuucuucuccac

SEQ ID NO: 1084909 - RNA, 18 nt, Human
ggcaaguggcacaccccc

SEQ ID NO: 1084910 - RNA, 18 nt, Human
ggcaaguggcacaccccc

SEQ ID NO: 1084911 - RNA, 18 nt, Human
ggcacccaggucuauggu

SEQ ID NO: 1084912 - RNA, 18 nt, Human
ggccgaggcaggaggauc

SEQ ID NO: 1084913 - RNA, 22 nt, Human
ggcugccggggggggggggggu

SEQ ID NO: 1084914 - RNA, 20 nt, Human
ggcuuggugguggcaugugc

SEQ ID NO: 1084915 - RNA, 19 nt, Human
gggcaaguggcacaccccc

SEQ ID NO: 1084916 - RNA, 22 nt, Human
ggggagguggaucuuccagucg

SEQ ID NO: 1084917 - RNA, 19 nt, Human
ggggcugugggaccagcgc

SEQ ID NO: 1084918 - RNA, 22 nt, Human
ggggcugugggaccagcgccca

SEQ ID NO: 1084919 - RNA, 21 nt, Human
ggggggguguguggagcuggg

SEQ ID NO: 1084920 - RNA, 19 nt, Human
ggguauaggcaagcagcaa

SEQ ID NO: 1084921 - RNA, 23 nt, Human
gguagccgcgagggcagggaugg

SEQ ID NO: 1084922 - RNA, 25 nt, Human
ggucccaaccuucuucccuguuugc

SEQ ID NO: 1084923 - RNA, 23 nt, Human
guacuccagccuggugacagagc

SEQ ID NO: 1084924 - RNA, 18 nt, Human
guccagcgucaggaugcc

SEQ ID NO: 1084925 - RNA, 23 nt, Human
gucuuuuccucuggaccucggug

SEQ ID NO: 1084926 - RNA, 22 nt, Human
uaacugccaacgugaguucaga

SEQ ID NO: 1084927 - RNA, 19 nt, Human
uacuccagccuggugacag

SEQ ID NO: 1084928 - RNA, 23 nt, Human
uacuccagccuggugacagagcg

SEQ ID NO: 1084929 - RNA, 19 nt, Human
uaggacagagggagccugg

SEQ ID NO: 1084930 - RNA, 24 nt, Human
uaggcaagucccuuucccucccag

SEQ ID NO: 1084931 - RNA, 30 nt, Human; identical to SEQ ID NO: 1084712

SEQ ID NO: 1084932 - RNA, 24 nt, Human
uaguccuagcuacucgagaggcug

SEQ ID NO: 1084933 - RNA, 18 nt, Human
uauugggcaagaucacug

SEQ ID NO: 1084934 - RNA, 21 nt, Human
ucaacuccaacucccacuccu

SEQ ID NO: 1084935 - RNA, 19 nt, Human
ucacuguacuccagccugg

SEQ ID NO: 1084936 - RNA, 20 nt, Human
ucacuguacuccagccuggu

SEQ ID NO: 1084937 - RNA, 23 nt, Human
ucacuguacuccagccuggugac

SEQ ID NO: 1084938 - RNA, 20 nt, Human
ucacuugagcccaggaguuc

SEQ ID NO: 1084939 - RNA, 24 nt, Human
ucaggaugcccaggcuccugggcu

SEQ ID NO: 1084940 - RNA, 24 nt, Human
uccacaccccuccccgcccgaccc

SEQ ID NO: 1084941 - RNA, 22 nt, Human
uccagccuggugacagagcgag

SEQ ID NO: 1084942 - RNA, 23 nt, Human
uccagccuggugacagagcgaga

SEQ ID NO: 1084943 - RNA, 27 nt, Human
uccagcgcacagucccagaagggcccc

SEQ ID NO: 1084944 - RNA, 21 nt, Human
uccccagagcucaggacccug

SEQ ID NO: 1084945 - RNA, 19 nt, Human
uccggccacuggaccacag

SEQ ID NO: 1084946 - RNA, 21 nt, Human
uccggccacuggaccacagga

SEQ ID NO: 1084947 - RNA, 24 nt, Human
ucgcccaucucuccccucccugug

SEQ ID NO: 1084948 - RNA, 22 nt, Human
ucggagccgcuggccaauaugu

SEQ ID NO: 1084949 - RNA, 23 nt, Human
ucuccuaggauggcuguggggau

SEQ ID NO: 1084950 - RNA, 21 nt, Human
ucucgcugcugggggcggggc

SEQ ID NO: 1084951 - RNA, 20 nt, Human
ucuuucaagaacauucacuc

SEQ ID NO: 1084952 - RNA, 22 nt, Human
ugaagccuacuucacucccaaa

SEQ ID NO: 1084953 - RNA, 18 nt, Human
ugacggggggagcuugac

SEQ ID NO: 1084954 - RNA, 20 nt, Human
ugacuccuuugagccauccc

SEQ ID NO: 1084955 - RNA, 20 nt, Human
ugagaaaaggcaguggggag

SEQ ID NO: 1084956 - RNA, 21 nt, Human
ugagaaaaggcaguggggagg

SEQ ID NO: 1084957 - RNA, 23 nt, Human
ugagaaaaggcaguggggaggug

SEQ ID NO: 1084958 - RNA, 23 nt, Human
ugagcccaggaguucgagaccag

SEQ ID NO: 1084959 - RNA, 19 nt, Human
ugaggugugacauauggga

SEQ ID NO: 1084960 - RNA, 22 nt, Human
ugcccagaggagugcccugggg

SEQ ID NO: 1084961 - RNA, 21 nt, Human
ugcccugggggcaaguggcac

SEQ ID NO: 1084962 - RNA, 23 nt, Human
ugcccugggggcaaguggcacac

SEQ ID NO: 1084963 - RNA, 19 nt, Human
ugcccugugaugugcuguu

SEQ ID NO: 1084964 - RNA, 21 nt, Human
ugccuguaguccuagcuacuc

SEQ ID NO: 1084965 - RNA, 22 nt, Human
ugccuguaguccuagcuacucg

SEQ ID NO: 1084966 - RNA, 21 nt, Human
ugcugggggcggggcuuaagc

SEQ ID NO: 1084967 - RNA, 20 nt, Human
uggaccacaggagcagaggc

SEQ ID NO: 1084968 - RNA, 26 nt, Human
uggauuuccuucagcuacccugaugu

SEQ ID NO: 1084969 - RNA, 24 nt, Human
uggcagagcaggcacagcagcauu

SEQ ID NO: 1084970 - RNA, 24 nt, Human
uggcaugugccuguaguccuagcu

SEQ ID NO: 1084971 - RNA, 23 nt, Human
ugggauguucucgcugcuggggg

SEQ ID NO: 1084972 - RNA, 24 nt, Human
ugguagccgcgagggcagggaugg

SEQ ID NO: 1084973 - RNA, 22 nt, Human
ugguggcaugugccuguagucc

SEQ ID NO: 1084974 - RNA, 20 nt, Human
uguaaagaauggcacccaga

SEQ ID NO: 1084975 - RNA, 24 nt, Human
uguccggccacuggaccacaggag

SEQ ID NO: 1084976 - RNA, 24 nt, Human
ugugaugugugcgugagcgagcac

SEQ ID NO: 1084977 - RNA, 21 nt, Human
ugugccuguaguccuagcuac

SEQ ID NO: 1084978 - RNA, 18 nt, Human
uguggauuuccuucagcu

SEQ ID NO: 1084979 - RNA, 24 nt, Human
uguuuuuguuuccaaauggcugga

SEQ ID NO: 1084980 - RNA, 20 nt, Human
uucuccacaccccuccccgc

SEQ ID NO: 1084981 - RNA, 24 nt, Human
uucucgcugcugggggcggggcuu

SEQ ID NO: 1084982 - RNA, 18 nt, Human
uucucuaaggaagaacaa

SEQ ID NO: 1084983 - RNA, 22 nt, Human
uugagcccaggaguucgagacc

SEQ ID NO: 1084984 - RNA, 20 nt, Human
uuggugguggcaugugccug

SEQ ID NO: 1084985 - RNA, 19 nt, Human
uuucuaaggaaaaugguuc

SEQ ID NO: 1084986 - RNA, 21 nt, Human
uuugcccacucucagaccccg

SEQ ID NO: 1084987 - RNA, 20 nt, Human
aaaaaaaggcagagcuucuu

SEQ ID NO: 1084988 - RNA, 26 nt, Human
aaaaaagcaucccuaaauucacuucg

SEQ ID NO: 1084989 - RNA, 23 nt, Human
aaacagacuaaugauuaacaaac

SEQ ID NO: 1084990 - RNA, 21 nt, Human
aaaccagggucacucagagga

SEQ ID NO: 1084991 - RNA, 18 nt, Human
aaacccccaaauugaaca

SEQ ID NO: 1084992 - RNA, 19 nt, Human
aacagccacuaccugccac

SEQ ID NO: 1084993 - RNA, 18 nt, Human
aaccaguuggaucuggag

SEQ ID NO: 1084994 - RNA, 19 nt, Human
aagaaaugugagacaugaa

SEQ ID NO: 1084995 - RNA, 20 nt, Human
aagaauaaaauauggaucua

SEQ ID NO: 1084996 - RNA, 25 nt, Human
aagcagagagaaggagaaauaacuu

SEQ ID NO: 1084997 - RNA, 24 nt, Human
aaggugaucaaagccugggaugau

SEQ ID NO: 1084998 - RNA, 23 nt, Human
acuggaccauguucuggucccaa

SEQ ID NO: 1084999 - RNA, 20 nt, Human
agacaugaaagacuggauuu

SEQ ID NO: 1085000 - RNA, 24 nt, Human
agacuaaugauuaacaaacagaga

SEQ ID NO: 1085001 - RNA, 22 nt, Human
agagaaggagaaauaacuugac

SEQ ID NO: 1085002 - RNA, 24 nt, Human
agagacuaaugcaaaauuagguaa

SEQ ID NO: 1085003 - RNA, 19 nt, Human
agagagaaggagaaauaac

SEQ ID NO: 1085004 - RNA, 20 nt, Human
agaguaucacuaacccaaaa

SEQ ID NO: 1085005 - RNA, 19 nt, Human
agaguuucuggagcucaga

SEQ ID NO: 1085006 - RNA, 19 nt, Human
aggcacauaggggcugaag

SEQ ID NO: 1085007 - RNA, 22 nt, Human
aggcagagcuucuucugauguc

SEQ ID NO: 1085008 - RNA, 23 nt, Human
aggcagggugaccaguuaggagg

SEQ ID NO: 1085009 - RNA, 22 nt, Human
aggccagagguccaggccagaa

SEQ ID NO: 1085010 - RNA, 22 nt, Human
aguaggacccuuuuauauaaug

SEQ ID NO: 1085011 - RNA, 24 nt, Human
aguugacaaggagccuaggaaaaa

SEQ ID NO: 1085012 - RNA, 23 nt, Human
auagaaauuagucagaccuaaaa

SEQ ID NO: 1085013 - RNA, 19 nt, Human
auucaggaguacagaugau

SEQ ID NO: 1085014 - RNA, 25 nt, Human
caaaaaaugaugaguuauaauacaa

SEQ ID NO: 1085015 - RNA, 22 nt, Human
caaaacaaaacccccaaauuga

SEQ ID NO: 1085016 - RNA, 20 nt, Human
caaaacccccaaauugaaca

SEQ ID NO: 1085017 - RNA, 21 nt, Human
caaaacccccaaauugaacaa

SEQ ID NO: 1085018 - RNA, 19 nt, Human
cacccccuaaucucccacc

SEQ ID NO: 1085019 - RNA, 18 nt, Human
caccgcaaaacaaaaaua

SEQ ID NO: 1085020 - RNA, 21 nt, Human
caccgcaaaacaaaaauaguc

SEQ ID NO: 1085021 - RNA, 25 nt, Human
caccgcaaaacaaaaauagucucuc

SEQ ID NO: 1085022 - RNA, 19 nt, Human
cacuccauucaggaguaca

SEQ ID NO: 1085023 - RNA, 21 nt, Human
cagaaauaccauaacaggcac

SEQ ID NO: 1085024 - RNA, 22 nt, Human
cagaacagaguaggggaaggcg

SEQ ID NO: 1085025 - RNA, 18 nt, Human
cagaccuaaaagauauua

SEQ ID NO: 1085026 - RNA, 25 nt, Human
cagacuaaugauuaacaaacagaga

SEQ ID NO: 1085027 - RNA, 23 nt, Human
cagcaaugcuuugguuggaauga

SEQ ID NO: 1085028 - RNA, 25 nt, Human
cagccacuaccugccaccgcaaaac

SEQ ID NO: 1085029 - RNA, 20 nt, Human
caguaaauacuguagcaaac

SEQ ID NO: 1085030 - RNA, 22 nt, Human
cauguuuuuuuggcuugaaaac

SEQ ID NO: 1085031 - RNA, 18 nt, Human
ccacgcaguaauaugaac

SEQ ID NO: 1085032 - RNA, 22 nt, Human
ccacuaccugccaccgcaaaac

SEQ ID NO: 1085033 - RNA, 22 nt, Human
ccagaaauaccauaacaggcac

SEQ ID NO: 1085034 - RNA, 23 nt, Human
ccagagguccaggccagaaauac

SEQ ID NO: 1085035 - RNA, 18 nt, Human
ccagaguaugaaaaaaga

SEQ ID NO: 1085036 - RNA, 18 nt, Human
ccaggccagaaauaccau

SEQ ID NO: 1085037 - RNA, 19 nt, Human
cuaacccaaaaaagcaucc

SEQ ID NO: 1085038 - RNA, 25 nt, Human
cuaaugauuaacaaacagagacuaa

SEQ ID NO: 1085039 - RNA, 23 nt, Human
cuaccugccaccgcaaaacaaaa

SEQ ID NO: 1085040 - RNA, 19 nt, Human
cuagaguggaggccacgca

SEQ ID NO: 1085041 - RNA, 21 nt, Human
cugccacccccuaaucuccca

SEQ ID NO: 1085042 - RNA, 23 nt, Human
cuuuaaaggugaucaaagccugg

SEQ ID NO: 1085043 - RNA, 23 nt, Human
cuuugugugcauuggcacugugg

SEQ ID NO: 1085044 - RNA, 19 nt, Human
gaaaaacuuaagaguauca

SEQ ID NO: 1085045 - RNA, 23 nt, Human
gaaauaccauaacaggcacauag

SEQ ID NO: 1085046 - RNA, 22 nt, Human
gaggaagccaucuuagguuuuu

SEQ ID NO: 1085047 - RNA, 20 nt, Human
gccagguacaaaauugccca

SEQ ID NO: 1085048 - RNA, 18 nt, Human
gcucagaaaccaggguca

SEQ ID NO: 1085049 - RNA, 23 nt, Human
guacuuuauaaaaguaucaaaaa

SEQ ID NO: 1085050 - RNA, 20 nt, Human
guccaggccagaaauaccau

SEQ ID NO: 1085051 - RNA, 22 nt, Human
uaaaauaaucccuuaagacaaa

SEQ ID NO: 1085052 - RNA, 22 nt, Human
uaaauauuuuuuucauuggcuu

SEQ ID NO: 1085053 - RNA, 23 nt, Human
uaacccaaaaaagcaucccuaaa

SEQ ID NO: 1085054 - RNA, 20 nt, Human
uaacuagaguggaggccacg

SEQ ID NO: 1085055 - RNA, 19 nt, Human
uaauuuauauuuauuuucu

SEQ ID NO: 1085056 - RNA, 24 nt, Human
uacagaguuucuggagcucagaaa

SEQ ID NO: 1085057 - RNA, 26 nt, Human
uacuuuaaaggugaucaaagccuggg

SEQ ID NO: 1085058 - RNA, 21 nt, Human
uagcccugaugucucauagaa

SEQ ID NO: 1085059 - RNA, 22 nt, Human
uaucaaaaagacugucauauuu

SEQ ID NO: 1085060 - RNA, 21 nt, Human
uauggccagaguaugaaaaaa

SEQ ID NO: 1085061 - RNA, 23 nt, Human
uauggccagaguaugaaaaaaga

SEQ ID NO: 1085062 - RNA, 23 nt, Human
uaugguguaggcuuuuucuuuuc

SEQ ID NO: 1085063 - RNA, 18 nt, Human
uauuuugcaaaacaaaac

SEQ ID NO: 1085064 - RNA, 18 nt, Human
ucaggggaaaaagaauaa

SEQ ID NO: 1085065 - RNA, 19 nt, Human
uccucaaugaacuuacaaa

SEQ ID NO: 1085066 - RNA, 30 nt, Human
ugaagcaaauaagcaauauuuauugagugg

SEQ ID NO: 1085067 - RNA, 23 nt, Human
ugagaagggggaagauagaauga

SEQ ID NO: 1085068 - RNA, 26 nt, Human
ugagauuuugggaauauauggccagu

SEQ ID NO: 1085069 - RNA, 21 nt, Human
ugagugcuuugugugcauugg

SEQ ID NO: 1085070 - RNA, 23 nt, Human
ugaguuauaauacaacgguuguu

SEQ ID NO: 1085071 - RNA, 23 nt, Human
ugauggaacuagagaaggcuuaa

SEQ ID NO: 1085072 - RNA, 21 nt, Human
ugcaaaaaaaggcagagcuuc

SEQ ID NO: 1085073 - RNA, 18 nt, Human
ugcaaaacaaaaccccca

SEQ ID NO: 1085074 - RNA, 22 nt, Human
ugcaaaacaaaacccccaaauu

SEQ ID NO: 1085075 - RNA, 18 nt, Human
ugcauuggcacuguggug

SEQ ID NO: 1085076 - RNA, 21 nt, Human
ugcugaaaggcauuuugagga

SEQ ID NO: 1085077 - RNA, 20 nt, Human
uggaucuggagcacaggagg

SEQ ID NO: 1085078 - RNA, 18 nt, Human
ugggaacuguggggaaua

SEQ ID NO: 1085079 - RNA, 22 nt, Human
ugggaacuguggggaauaggau

SEQ ID NO: 1085080 - RNA, 19 nt, Human
uguuaucaggggaaaaaga

SEQ ID NO: 1085081 - RNA, 24 nt, Human
uguugagaacagcugggaucuaau

SEQ ID NO: 1085082 - RNA, 20 nt, Human
uucuggagcucagaaaccag

SEQ ID NO: 1085083 - RNA, 18 nt, Human
uuggcuuuuccacacaaa

SEQ ID NO: 1085084 - RNA, 25 nt, Human
uuuccacacaaauccaucaguuaug

SEQ ID NO: 1085085 - RNA, 23 nt, Human
uuucuguggcauuuuccuuuauu

SEQ ID NO: 1085086 - RNA, 20 nt, Human
uuuugcaaaacaaaaccccc

SEQ ID NO: 1085087 - RNA, 23 nt, Human
uuuuuuuuuuugcaaaaaaaggc

SEQ ID NO: 1085088 - RNA, 19 nt, Human
uuuuuuuuuuuuuuugcaa

SEQ ID NO: 1085089 - RNA, 28 nt, Human
aagcgcgcgcggcgggguuccgaggucg

SEQ ID NO: 1085090 - RNA, 18 nt, Human
caggagaggcgcuuagcg

SEQ ID NO: 1085091 - RNA, 20 nt, Human
cugcaccuuucugccuggga

SEQ ID NO: 1085092 - RNA, 23 nt, Human
gagguaucuauggaaaauaucau

SEQ ID NO: 1085093 - RNA, 21 nt, Human
gcagagcgccccggggagggc

SEQ ID NO: 1085094 - RNA, 18 nt, Human
gcgcggcgggguucagca

SEQ ID NO: 1085095 - RNA, 19 nt, Human
guccggagucccccgggca

SEQ ID NO: 1085096 - RNA, 21 nt, Human
ucugcaccuuucugccuggga

SEQ ID NO: 1085097 - RNA, 22 nt, Human
ucugcaccuuucugccugggac

SEQ ID NO: 1085098 - RNA, 22 nt, Human
ugggacaccgaccaggagaggc

SEQ ID NO: 1085099 - RNA, 21 nt, Human
uguaccacgcggcugucagug

SEQ ID NO: 1085100 - RNA, 19 nt, Human
uguccggagucccccgggc

SEQ ID NO: 1085101 - RNA, 18 nt, Human
aaaaaagcuuaaauugca

SEQ ID NO: 1085102 - RNA, 22 nt, Human
aacugcuucucacaggaaauac

SEQ ID NO: 1085103 - RNA, 26 nt, Human
aacuucuauuucucuguagaaacuuu

SEQ ID NO: 1085104 - RNA, 20 nt, Human
aagaaauacauaguaaauaa

SEQ ID NO: 1085105 - RNA, 20 nt, Human
aagaccuuuuucaccugcag

SEQ ID NO: 1085106 - RNA, 21 nt, Human
aagcagcccgaggaccacucg

SEQ ID NO: 1085107 - RNA, 21 nt, Human
aagcugguugaguccuguggc

SEQ ID NO: 1085108 - RNA, 23 nt, Human
aaugcuaaagguuguuguaaacu

SEQ ID NO: 1085109 - RNA, 23 nt, Human
acaaggcgcuggcuuugccacca

SEQ ID NO: 1085110 - RNA, 22 nt, Human
acgccagggccuacacuccagu

SEQ ID NO: 1085111 - RNA, 20 nt, Human
acucacuccaguaaagacgg

SEQ ID NO: 1085112 - RNA, 22 nt, Human
acucacuccaguaaagacggac

SEQ ID NO: 1085113 - RNA, 20 nt, Human
acuuaauggucaucucccuu

SEQ ID NO: 1085114 - RNA, 18 nt, Human
aggaagaggaguguuucu

SEQ ID NO: 1085115 - RNA, 21 nt, Human
aggcagccccuuccccuaaag

SEQ ID NO: 1085116 - RNA, 18 nt, Human
auagcugggguguaaagc

SEQ ID NO: 1085117 - RNA, 19 nt, Human
aucucaauuuuucccugaa

SEQ ID NO: 1085118 - RNA, 19 nt, Human
caacagcuguccuuccuca

SEQ ID NO: 1085119 - RNA, 19 nt, Human
caagaaauacauaguaaau

SEQ ID NO: 1085120 - RNA, 19 nt, Human
cacacacaacagcugggcc

SEQ ID NO: 1085121 - RNA, 18 nt, Human
cagcgcccaggcuccgcc

SEQ ID NO: 1085122 - RNA, 21 nt, Human
cagcuagaaaaugaaaaaucu

SEQ ID NO: 1085123 - RNA, 23 nt, Human
cagguggucccaaucaaaacucc

SEQ ID NO: 1085124 - RNA, 19 nt, Human
cagucggagcccugugcca

SEQ ID NO: 1085125 - RNA, 22 nt, Human
cauccugggucucaucaucucc

SEQ ID NO: 1085126 - RNA, 24 nt, Human
ccaaagcaaacgcagcuucucacg

SEQ ID NO: 1085127 - RNA, 23 nt, Human
ccaaagccuguuagagggggugg

SEQ ID NO: 1085128 - RNA, 20 nt, Human
cccacacacaacagcugggc

SEQ ID NO: 1085129 - RNA, 22 nt, Human
cccagccccaaaugcacauagc

SEQ ID NO: 1085130 - RNA, 20 nt, Human
cccaggcuccgccgcgaccg

SEQ ID NO: 1085131 - RNA, 19 nt, Human
ccccacuggccucccccuu

SEQ ID NO: 1085132 - RNA, 20 nt, Human
ccccuaaagcccucuccuuu

SEQ ID NO: 1085133 - RNA, 18 nt, Human
cccgccacccgcagccgc

SEQ ID NO: 1085134 - RNA, 19 nt, Human
ccgcagaaaguugcugagc

SEQ ID NO: 1085135 - RNA, 18 nt, Human
ccgcagccgccaccgcgc

SEQ ID NO: 1085136 - RNA, 21 nt, Human
ccgcgacccgccacccgcagc

SEQ ID NO: 1085137 - RNA, 25 nt, Human
ccgcgacccgccacccgcagccgcc

SEQ ID NO: 1085138 - RNA, 18 nt, Human
ccgcgaccggcgaccggc

SEQ ID NO: 1085139 - RNA, 27 nt, Human
ccgggucaucccugcuggucgccugcg

SEQ ID NO: 1085140 - RNA, 26 nt, Human
ccuacacuccagucacuuucuuacag

SEQ ID NO: 1085141 - RNA, 20 nt, Human
ccuccaagucccuucucagc

SEQ ID NO: 1085142 - RNA, 22 nt, Human
ccucccccuugucggcucccgg

SEQ ID NO: 1085143 - RNA, 20 nt, Human
cgacccgcgacccgccaccc

SEQ ID NO: 1085144 - RNA, 20 nt, Human
cgagacucugucauguuugc

SEQ ID NO: 1085145 - RNA, 21 nt, Human
cgcgacccgcgacccgccacc

SEQ ID NO: 1085146 - RNA, 22 nt, Human
cggcagcagcucgcaggcccgc

SEQ ID NO: 1085147 - RNA, 20 nt, Human
cggcggcagcagcucgcagg

SEQ ID NO: 1085148 - RNA, 18 nt, Human
cucacgugauauccagga

SEQ ID NO: 1085149 - RNA, 22 nt, Human
cuccuagcuaagcagauuccug

SEQ ID NO: 1085150 - RNA, 19 nt, Human
cucuucccaggcagcccca

SEQ ID NO: 1085151 - RNA, 18 nt, Human
cugcuuggcuccccuggg

SEQ ID NO: 1085152 - RNA, 20 nt, Human
cuggccucccccuugucggc

SEQ ID NO: 1085153 - RNA, 21 nt, Human
cugggccuuggaaggucuugg

SEQ ID NO: 1085154 - RNA, 28 nt, Human
cuguguugcauccugggucccggguccg

SEQ ID NO: 1085155 - RNA, 18 nt, Human
gcagcccgaggaccacuc

SEQ ID NO: 1085156 - RNA, 24 nt, Human
gccagcuccuagcuaagcagauuc

SEQ ID NO: 1085157 - RNA, 18 nt, Human
gcucaggggcggcggcag

SEQ ID NO: 1085158 - RNA, 20 nt, Human
gggcugaggacgagcucuuc

SEQ ID NO: 1085159 - RNA, 24 nt, Human
uaaaaauacucuaaucacagcugc

SEQ ID NO: 1085160 - RNA, 20 nt, Human
uaaacugaaaacuaaauuuu

SEQ ID NO: 1085161 - RNA, 19 nt, Human
uaaagcuuuggugcuccuc

SEQ ID NO: 1085162 - RNA, 21 nt, Human
uaaagcuuuggugcuccucau

SEQ ID NO: 1085163 - RNA, 23 nt, Human
uaaagucaauucauuacauuuuc

SEQ ID NO: 1085164 - RNA, 20 nt, Human
uaacaauuccucgugccuca

SEQ ID NO: 1085165 - RNA, 23 nt, Human
uaacuaguaaugcaucaacauaa

SEQ ID NO: 1085166 - RNA, 18 nt, Human
uagcuaagcagauuccug

SEQ ID NO: 1085167 - RNA, 21 nt, Human
uauccaggaaucuucccucca

SEQ ID NO: 1085168 - RNA, 18 nt, Human
ucaaggucuucgcuucug

SEQ ID NO: 1085169 - RNA, 20 nt, Human
ucagucuugcuucccagagg

SEQ ID NO: 1085170 - RNA, 19 nt, Human
uccaagucccuucucagcg

SEQ ID NO: 1085171 - RNA, 24 nt, Human
ucccaccggggccuaaucuggcug

SEQ ID NO: 1085172 - RNA, 23 nt, Human
ucccagcuguugcaggcuuuggg

SEQ ID NO: 1085173 - RNA, 28 nt, Human
ucccugaauguguuguuuuucuucauua

SEQ ID NO: 1085174 - RNA, 20 nt, Human
uccgccgcgaccggcgaccg

SEQ ID NO: 1085175 - RNA, 20 nt, Human
ucggagcccugugccagcug

SEQ ID NO: 1085176 - RNA, 19 nt, Human
ucggcucccgggucauccc

SEQ ID NO: 1085177 - RNA, 22 nt, Human
ucuaaucacagcugcagcuacu

SEQ ID NO: 1085178 - RNA, 18 nt, Human
ucucuggguugagacagg

SEQ ID NO: 1085179 - RNA, 22 nt, Human
ugaaaaagauuuuacaaaugua

SEQ ID NO: 1085180 - RNA, 24 nt, Human
ugagacagggucaaggaaaccguc

SEQ ID NO: 1085181 - RNA, 24 nt, Human
ugagagguaagcccugaucccucu

SEQ ID NO: 1085182 - RNA, 21 nt, Human
ugaguccuguggcuaaaaaua

SEQ ID NO: 1085183 - RNA, 20 nt, Human
ugcaagaagacacugcuuug

SEQ ID NO: 1085184 - RNA, 21 nt, Human
ugcaggcuucuuucucugggu

SEQ ID NO: 1085185 - RNA, 20 nt, Human
ugcaugcacagugcugugga

SEQ ID NO: 1085186 - RNA, 20 nt, Human
ugccagcugauuggcugcag

SEQ ID NO: 1085187 - RNA, 21 nt, Human
ugcccaaaauacauacaugau

SEQ ID NO: 1085188 - RNA, 18 nt, Human
ugccuggggacacaaggc

SEQ ID NO: 1085189 - RNA, 20 nt, Human
ugccuucuaagccagcuccu

SEQ ID NO: 1085190 - RNA, 23 nt, Human
ugcuuggcuccccugggugccuu

SEQ ID NO: 1085191 - RNA, 25 nt, Human
uggaucuuaagcuagaugauuagaa

SEQ ID NO: 1085192 - RNA, 19 nt, Human
uggcggcacaagcuggacu

SEQ ID NO: 1085193 - RNA, 20 nt, Human
ugggcuuguguccucauccc

SEQ ID NO: 1085194 - RNA, 19 nt, Human
uggguauguuagcuaucau

SEQ ID NO: 1085195 - RNA, 18 nt, Human
ugguaaauguuuguaguc

SEQ ID NO: 1085196 - RNA, 19 nt, Human
ugguaaauguuuguaguca

SEQ ID NO: 1085197 - RNA, 26 nt, Human
uguaaagcuuuggugcuccucauuuc

SEQ ID NO: 1085198 - RNA, 24 nt, Human
uguacacagguggucccaaucaaa

SEQ ID NO: 1085199 - RNA, 18 nt, Human
uguguguacacagguggu

SEQ ID NO: 1085200 - RNA, 24 nt, Human
uguugcaugcacagugcuguggau

SEQ ID NO: 1085201 - RNA, 22 nt, Human
uuaaaguacaguuuccaacagc

SEQ ID NO: 1085202 - RNA, 20 nt, Human
uucuauuucucuguagaaac

SEQ ID NO: 1085203 - RNA, 22 nt, Human
uucucuguagaaacuuucuuca

SEQ ID NO: 1085204 - RNA, 20 nt, Human
uugaaagcugguugaguccu

SEQ ID NO: 1085205 - RNA, 21 nt, Human
uugaguuuucagaguguuagg

SEQ ID NO: 1085206 - RNA, 19 nt, Human
uuggcugcagccugcucgg

SEQ ID NO: 1085207 - RNA, 19 nt, Human
uuugcuauauuuaaaaugg

SEQ ID NO: 1085208 - RNA, 25 nt, Human
aaacgauagaaauucaacccaaacu

SEQ ID NO: 1085209 - RNA, 22 nt, Human
ccucuaagauuauagucauuaa

SEQ ID NO: 1085210 - RNA, 19 nt, Human
uaaaaacaacuggcuuaaa

SEQ ID NO: 1085211 - RNA, 24 nt, Human
uuaaacacaaacuuaaaaacaacc

SEQ ID NO: 1085212 - RNA, 24 nt, Human
uuugaaggacuuaaaauacccaga

SEQ ID NO: 1085213 - RNA, 21 nt, Human
aaaaagaaacacacggcaaaa

SEQ ID NO: 1085214 - RNA, 20 nt, Human
aaaaccacaaugggucccug

SEQ ID NO: 1085215 - RNA, 19 nt, Human
aaaaggcccccauucauuc

SEQ ID NO: 1085216 - RNA, 24 nt, Human
aaagugcugggauuacaggcauga

SEQ ID NO: 1085217 - RNA, 24 nt, Human
aacacggugaccacaagccccauu

SEQ ID NO: 1085218 - RNA, 24 nt, Human
aagugauccaccugccuuggccuc

SEQ ID NO: 1085219 - RNA, 19 nt, Human
aagugcugggauuacaggc

SEQ ID NO: 1085220 - RNA, 21 nt, Human
aagugcugggauuacaggcau

SEQ ID NO: 1085221 - RNA, 26 nt, Human
aagugcugggauuacaggcaugagcc

SEQ ID NO: 1085222 - RNA, 24 nt, Human
aaucacuugaaccugggaggcaga

SEQ ID NO: 1085223 - RNA, 20 nt, Human
acacauguccuccauuuccc

SEQ ID NO: 1085224 - RNA, 19 nt, Human
acagagcaagacucuguag

SEQ ID NO: 1085225 - RNA, 27 nt, Human
acaguugcuguuuagaaaagugcggcu

SEQ ID NO: 1085226 - RNA, 22 nt, Human
acaugccugucuccccacaggc

SEQ ID NO: 1085227 - RNA, 20 nt, Human
accagguuuccucgucuggg

SEQ ID NO: 1085228 - RNA, 24 nt, Human
accauguuggccaggcuggucucg

SEQ ID NO: 1085229 - RNA, 24 nt, Human
accgcacuccagccugggcgacag

SEQ ID NO: 1085230 - RNA, 26 nt, Human
accgcacuccagccugggcgacagag

SEQ ID NO: 1085231 - RNA, 24 nt, Human
accuaggcuggaguacuguggugu

SEQ ID NO: 1085232 - RNA, 18 nt, Human
acgggguuucaccauguu

SEQ ID NO: 1085233 - RNA, 23 nt, Human
acgggguuucaccauguuggcca

SEQ ID NO: 1085234 - RNA, 24 nt, Human
acgggguuucaccauguuggccag

SEQ ID NO: 1085235 - RNA, 22 nt, Human
acgguccaugcucgggaaggug

SEQ ID NO: 1085236 - RNA, 21 nt, Human
acuccagcaacuuucuaacac

SEQ ID NO: 1085237 - RNA, 24 nt, Human
acucuguagucccagcuacucggg

SEQ ID NO: 1085238 - RNA, 24 nt, Human
acugcacuccagccugggcgacag

SEQ ID NO: 1085239 - RNA, 26 nt, Human
acugcacuccagccugggcgacagag

SEQ ID NO: 1085240 - RNA, 19 nt, Human
acugcaucccagcuccccc

SEQ ID NO: 1085241 - RNA, 19 nt, Human
acuugaagagagagaggcu

SEQ ID NO: 1085242 - RNA, 20 nt, Human
acuugaagagagagaggcug

SEQ ID NO: 1085243 - RNA, 20 nt, Human
agagccaucggaaacuggug

SEQ ID NO: 1085244 - RNA, 20 nt, Human
agaggaagcacaaaaccaca

SEQ ID NO: 1085245 - RNA, 25 nt, Human
agaggaagcacaaaaccacaauggg

SEQ ID NO: 1085246 - RNA, 23 nt, Human
agagguuguagugagccgagauc

SEQ ID NO: 1085247 - RNA, 24 nt, Human
agagguuguagugagccgagaucg

SEQ ID NO: 1085248 - RNA, 23 nt, Human
agcaaagccuucaccacacaugg

SEQ ID NO: 1085249 - RNA, 28 nt, Human
agcagaacaggcacagaggaagcacaaa

SEQ ID NO: 1085250 - RNA, 22 nt, Human
agccccacagcccgcccacccc

SEQ ID NO: 1085251 - RNA, 23 nt, Human
agccccacagcccgcccaccccc

SEQ ID NO: 1085252 - RNA, 24 nt, Human
agccugggcgacagagcaagacuc

SEQ ID NO: 1085253 - RNA, 24 nt, Human
agccugggcgacagagcgagacuc

SEQ ID NO: 1085254 - RNA, 20 nt, Human
agcgauucuccugccucagc

SEQ ID NO: 1085255 - RNA, 24 nt, Human
agcgauucuccugccucagccucc

SEQ ID NO: 1085256 - RNA, 23 nt, Human
aggaagucauaggaacaaugcau

SEQ ID NO: 1085257 - RNA, 21 nt, Human
aggcagagguuguagugagcc

SEQ ID NO: 1085258 - RNA, 24 nt, Human
aggcagagguuguagugagccgag

SEQ ID NO: 1085259 - RNA, 22 nt, Human
aggcaggagaaucacuugaacc

SEQ ID NO: 1085260 - RNA, 24 nt, Human
aggcaggagaaucacuugaaccug

SEQ ID NO: 1085261 - RNA, 21 nt, Human
aggcaggagaauggcgugaac

SEQ ID NO: 1085262 - RNA, 24 nt, Human
aggcaggagaauggcgugaacccg

SEQ ID NO: 1085263 - RNA, 24 nt, Human
aggcggagcuugcagugagccgag

SEQ ID NO: 1085264 - RNA, 19 nt, Human
aggcugagccagagcuggg

SEQ ID NO: 1085265 - RNA, 24 nt, Human
aggcugaggcaggagaaucacuug

SEQ ID NO: 1085266 - RNA, 19 nt, Human
aggcugaggcaggagaaug

SEQ ID NO: 1085267 - RNA, 23 nt, Human
agguaggaugagggccuaggggu

SEQ ID NO: 1085268 - RNA, 18 nt, Human
aguagcugggacuacugg

SEQ ID NO: 1085269 - RNA, 18 nt, Human
agugcugggauuacaggc

SEQ ID NO: 1085270 - RNA, 20 nt, Human
auccgaaggcuugacugggg

SEQ ID NO: 1085271 - RNA, 24 nt, Human
aucgcgccaccgcacuccagccug

SEQ ID NO: 1085272 - RNA, 24 nt, Human
aucgcgccacugcacuccagccug

SEQ ID NO: 1085273 - RNA, 22 nt, Human
augacauagaagcugguuuguc

SEQ ID NO: 1085274 - RNA, 19 nt, Human
augcagccggggaagaugg

SEQ ID NO: 1085275 - RNA, 20 nt, Human
augcaucucagagcagaagc

SEQ ID NO: 1085276 - RNA, 24 nt, Human
auuuuuguauuuuuaguagagacg

SEQ ID NO: 1085277 - RNA, 22 nt, Human
caaaaggcccccauucauucac

SEQ ID NO: 1085278 - RNA, 24 nt, Human
caaagugcugggauuacaggcaug

SEQ ID NO: 1085279 - RNA, 22 nt, Human
caagugauccaccugccuuggc

SEQ ID NO: 1085280 - RNA, 21 nt, Human
caagugcuuuugccccuuuua

SEQ ID NO: 1085281 - RNA, 24 nt, Human
cacaaaaccacaaugggucccugg

SEQ ID NO: 1085282 - RNA, 22 nt, Human
cacacauguccuccauuucccu

SEQ ID NO: 1085283 - RNA, 21 nt, Human
cacagcccagccccacagccc

SEQ ID NO: 1085284 - RNA, 25 nt, Human
cacagcccagccccacagcccgccc

SEQ ID NO: 1085285 - RNA, 18 nt, Human
cacagcccgcccaccccc

SEQ ID NO: 1085286 - RNA, 22 nt, Human
caccaccaugccuggcuaauuu

SEQ ID NO: 1085287 - RNA, 24 nt, Human
caccaugccuggcuaauuuuugua

SEQ ID NO: 1085288 - RNA, 21 nt, Human
caccauguuggccaggcuggu

SEQ ID NO: 1085289 - RNA, 24 nt, Human
caccauguuggccaggcuggucuc

SEQ ID NO: 1085290 - RNA, 19 nt, Human
cacccccaagauccccacu

SEQ ID NO: 1085291 - RNA, 24 nt, Human
caccgcacuccagccugggcgaca

SEQ ID NO: 1085292 - RNA, 23 nt, Human
caccugccuuggccucccaaagu

SEQ ID NO: 1085293 - RNA, 24 nt, Human
caccugccuuggccucccaaagug

SEQ ID NO: 1085294 - RNA, 21 nt, Human
cacggcaaaauaccuaucaag

SEQ ID NO: 1085295 - RNA, 23 nt, Human
cacuccagcaacuuucuaacacu

SEQ ID NO: 1085296 - RNA, 23 nt, Human
cacuccagccugggcgacagagc

SEQ ID NO: 1085297 - RNA, 23 nt, Human
cacuccagccugggcgacagagc

SEQ ID NO: 1085298 - RNA, 24 nt, Human
cacuccagccugggcgacagagcg

SEQ ID NO: 1085299 - RNA, 21 nt, Human
cacugcaaccuuugccuccug

SEQ ID NO: 1085300 - RNA, 23 nt, Human
cacugcaaccuuugccuccuggg

SEQ ID NO: 1085301 - RNA, 24 nt, Human
cacugcaaccuuugccuccugggu

SEQ ID NO: 1085302 - RNA, 19 nt, Human
cacugcacuccagccuggg

SEQ ID NO: 1085303 - RNA, 20 nt, Human
cacugcacuccagccugggc

SEQ ID NO: 1085304 - RNA, 20 nt, Human
cacugcacuccagccugggc

SEQ ID NO: 1085305 - RNA, 22 nt, Human
cacugcacuccagccugggcga

SEQ ID NO: 1085306 - RNA, 24 nt, Human
cacugcacuccagccugggcgaca

SEQ ID NO: 1085307 - RNA, 27 nt, Human
cacugcacuccagccugggcgacagag

SEQ ID NO: 1085308 - RNA, 22 nt, Human
cacugcaucccagcucccccug

SEQ ID NO: 1085309 - RNA, 18 nt, Human
cacuucucacuuccucac

SEQ ID NO: 1085310 - RNA, 24 nt, Human
cagcaaagccuucaccacacaugu

SEQ ID NO: 1085311 - RNA, 20 nt, Human
cagcaaguguucuaugugug

SEQ ID NO: 1085312 - RNA, 18 nt, Human
cagcagggcccagcugug

SEQ ID NO: 1085313 - RNA, 20 nt, Human
cagccuccugaguagcuggg

SEQ ID NO: 1085314 - RNA, 24 nt, Human
cagcuacucaggaggcugaggcag

SEQ ID NO: 1085315 - RNA, 24 nt, Human
cagcuacucgggaggcugaggcag

SEQ ID NO: 1085316 - RNA, 24 nt, Human
caggaggcugaggcaggagaauca

SEQ ID NO: 1085317 - RNA, 26 nt, Human
caggcacagaggaagcacaaaaccac

SEQ ID NO: 1085318 - RNA, 23 nt, Human
cauguuggccaggcuggucucga

SEQ ID NO: 1085319 - RNA, 18 nt, Human
cauugccaucuccugccu

SEQ ID NO: 1085320 - RNA, 21 nt, Human
cauugccaucuccugccuccu

SEQ ID NO: 1085321 - RNA, 22 nt, Human
ccaaagcaacaacuuuauguga

SEQ ID NO: 1085322 - RNA, 23 nt, Human
ccaaagugcugggauuacaggca

SEQ ID NO: 1085323 - RNA, 24 nt, Human
ccaaagugcugggauuacaggcau

SEQ ID NO: 1085324 - RNA, 20 nt, Human
ccaccgcacuccagccuggg

SEQ ID NO: 1085325 - RNA, 20 nt, Human
ccaccgcacuccagccuggg

SEQ ID NO: 1085326 - RNA, 21 nt, Human
ccaccgcacuccagccugggc

SEQ ID NO: 1085327 - RNA, 21 nt, Human
ccaccgcacuccagccugggc

SEQ ID NO: 1085328 - RNA, 23 nt, Human
ccaccgcacuccagccugggcga

SEQ ID NO: 1085329 - RNA, 20 nt, Human
ccacugcacuccagccuggg

SEQ ID NO: 1085330 - RNA, 20 nt, Human
ccacugcacuccagccuggg

SEQ ID NO: 1085331 - RNA, 21 nt, Human
ccacugcacuccagccugggc

SEQ ID NO: 1085332 - RNA, 21 nt, Human
ccacugcacuccagccugggc

SEQ ID NO: 1085333 - RNA, 24 nt, Human
ccacugcacuccagccugggcgac

SEQ ID NO: 1085334 - RNA, 24 nt, Human
ccacugcaucccagcucccccugg

SEQ ID NO: 1085335 - RNA, 27 nt, Human
ccacugcaucccagcucccccuggcca

SEQ ID NO: 1085336 - RNA, 20 nt, Human
ccacugcucucagccucugu

SEQ ID NO: 1085337 - RNA, 23 nt, Human
ccagcaacuuucuaacacuuccu

SEQ ID NO: 1085338 - RNA, 27 nt, Human
ccagcgauucuccugccucagccuccu

SEQ ID NO: 1085339 - RNA, 21 nt, Human
ccaggccuugcccugcuggcc

SEQ ID NO: 1085340 - RNA, 26 nt, Human
ccaggccuugcccugcuggccugggg

SEQ ID NO: 1085341 - RNA, 22 nt, Human
ccagucucagccacuuccagaa

SEQ ID NO: 1085342 - RNA, 24 nt, Human
ccaugucuuggucacccaaaaauc

SEQ ID NO: 1085343 - RNA, 24 nt, Human
cccaaagugcugggauuacaggca

SEQ ID NO: 1085344 - RNA, 24 nt, Human
cccaagauccccacuucucacuuc

SEQ ID NO: 1085345 - RNA, 21 nt, Human
cccacagcccgcccaccccca

SEQ ID NO: 1085346 - RNA, 24 nt, Human
cccacagcccgcccacccccaaga

SEQ ID NO: 1085347 - RNA, 24 nt, Human
cccacugcaucccagcucccccug

SEQ ID NO: 1085348 - RNA, 19 nt, Human
cccagauggcugccucagu

SEQ ID NO: 1085349 - RNA, 22 nt, Human
cccagccccacagcccgcccac

SEQ ID NO: 1085350 - RNA, 19 nt, Human
cccagcucccccuggcugg

SEQ ID NO: 1085351 - RNA, 19 nt, Human
cccaggagucuuuguccua

SEQ ID NO: 1085352 - RNA, 23 nt, Human
cccaggccuugcccugcuggccu

SEQ ID NO: 1085353 - RNA, 18 nt, Human
cccaggcucagacaaacg

SEQ ID NO: 1085354 - RNA, 22 nt, Human
cccccaagauccccacuucuca

SEQ ID NO: 1085355 - RNA, 23 nt, Human
cccgcccacccccaagaucccca

SEQ ID NO: 1085356 - RNA, 24 nt, Human
ccuccuggguuccagcgauucucc

SEQ ID NO: 1085357 - RNA, 21 nt, Human
ccugaccucaagugauccacc

SEQ ID NO: 1085358 - RNA, 23 nt, Human
ccugaccucaagugauccaccug

SEQ ID NO: 1085359 - RNA, 23 nt, Human
ccugaccucaagugauccaccug

SEQ ID NO: 1085360 - RNA, 20 nt, Human
ccugaguagcugggacuacu

SEQ ID NO: 1085361 - RNA, 18 nt, Human
ccugccuccugcccagug

SEQ ID NO: 1085362 - RNA, 24 nt, Human
ccugccuuggccucccaaagugcu

SEQ ID NO: 1085363 - RNA, 21 nt, Human
ccuggcuccgggagaccaggu

SEQ ID NO: 1085364 - RNA, 21 nt, Human
ccugggaggcagagguuguag

SEQ ID NO: 1085365 - RNA, 22 nt, Human
ccugggcgacagagcaagacuc

SEQ ID NO: 1085366 - RNA, 22 nt, Human
ccugggcgacagagcgagacuc

SEQ ID NO: 1085367 - RNA, 20 nt, Human
ccuugcccugcuggccuggg

SEQ ID NO: 1085368 - RNA, 23 nt, Human
ccuuugccuccuggguuccagcg

SEQ ID NO: 1085369 - RNA, 24 nt, Human
cgacacauauacucccugcuuguc

SEQ ID NO: 1085370 - RNA, 22 nt, Human
cgagacggagucucgcucuguc

SEQ ID NO: 1085371 - RNA, 24 nt, Human
cgagaucgcgccaccgcacuccag

SEQ ID NO: 1085372 - RNA, 26 nt, Human
cgccaccgcacuccagccugggcgac

SEQ ID NO: 1085373 - RNA, 26 nt, Human
cgccacugcacuccagccugggcgac

SEQ ID NO: 1085374 - RNA, 21 nt, Human
cgcccacccccaagaucccca

SEQ ID NO: 1085375 - RNA, 22 nt, Human
cgcucugucaccuaggcuggag

SEQ ID NO: 1085376 - RNA, 21 nt, Human
cggcuagggacgguccaugcu

SEQ ID NO: 1085377 - RNA, 20 nt, Human
cggggaagauggggagcugu

SEQ ID NO: 1085378 - RNA, 24 nt, Human
cgggguuucaccauguuggccagg

SEQ ID NO: 1085379 - RNA, 23 nt, Human
cucaagugauccaccugccuugg

SEQ ID NO: 1085380 - RNA, 24 nt, Human
cucaagugauccaccugccuuggc

SEQ ID NO: 1085381 - RNA, 24 nt, Human
cucacugcaaccuuugccuccugg

SEQ ID NO: 1085382 - RNA, 18 nt, Human
cucagccaggcccugcgu

SEQ ID NO: 1085383 - RNA, 24 nt, Human
cucagccuccugaguagcugggac

SEQ ID NO: 1085384 - RNA, 18 nt, Human
cuccuccuuuguuugucc

SEQ ID NO: 1085385 - RNA, 21 nt, Human
cuccuggguuccagcgauucu

SEQ ID NO: 1085386 - RNA, 23 nt, Human
cuccuggguuccagcgauucucc

SEQ ID NO: 1085387 - RNA, 24 nt, Human
cucgcucugucaccuaggcuggag

SEQ ID NO: 1085388 - RNA, 23 nt, Human
cugcaaccuuugccuccuggguu

SEQ ID NO: 1085389 - RNA, 24 nt, Human
cugcaaccuuugccuccuggguuc

SEQ ID NO: 1085390 - RNA, 18 nt, Human
cugcaccaaaucuccucc

SEQ ID NO: 1085391 - RNA, 28 nt, Human
cugccaagcccacuucaagggacaccuc

SEQ ID NO: 1085392 - RNA, 23 nt, Human
cugccucagccuccugaguagcu

SEQ ID NO: 1085393 - RNA, 19 nt, Human
cuggcuccaagaugccacu

SEQ ID NO: 1085394 - RNA, 18 nt, Human
cuguagucccagcuacuc

SEQ ID NO: 1085395 - RNA, 21 nt, Human
cuguagucccagcuacucggg

SEQ ID NO: 1085396 - RNA, 21 nt, Human
cuuccagucucagccacuucc

SEQ ID NO: 1085397 - RNA, 19 nt, Human
cuugcagugagccgagauc

SEQ ID NO: 1085398 - RNA, 21 nt, Human
cuugcagugagccgagaucgc

SEQ ID NO: 1085399 - RNA, 24 nt, Human
cuugguucuucagaauauguagug

SEQ ID NO: 1085400 - RNA, 19 nt, Human
cuuuauuuguuuauuuucg

SEQ ID NO: 1085401 - RNA, 21 nt, Human
gaacaggcacagaggaagcac

SEQ ID NO: 1085402 - RNA, 24 nt, Human
gaccucaagugauccaccugccuu

SEQ ID NO: 1085403 - RNA, 23 nt, Human
gagaaucacuugaaccugggagg

SEQ ID NO: 1085404 - RNA, 24 nt, Human
gagacgggguuucaccauguuggc

SEQ ID NO: 1085405 - RNA, 23 nt, Human
gagaucgcgccacugcacuccag

SEQ ID NO: 1085406 - RNA, 19 nt, Human
gagccagagcugggaggag

SEQ ID NO: 1085407 - RNA, 23 nt, Human
gagcuugcagugagccgagaucg

SEQ ID NO: 1085408 - RNA, 19 nt, Human
gaggacuguggggcagaga

SEQ ID NO: 1085409 - RNA, 21 nt, Human
gaggagcagaacaggcacaga

SEQ ID NO: 1085410 - RNA, 19 nt, Human
gaggaggugccugggcugg

SEQ ID NO: 1085411 - RNA, 22 nt, Human
gaggggacugggaggggcuggg

SEQ ID NO: 1085412 - RNA, 21 nt, Human
gaggugccugggcuggcugca

SEQ ID NO: 1085413 - RNA, 19 nt, Human
gaucguggcucacugcaac

SEQ ID NO: 1085414 - RNA, 23 nt, Human
gaugccagggacuugaagagaga

SEQ ID NO: 1085415 - RNA, 21 nt, Human
gaugugggguuuugcaccugg

SEQ ID NO: 1085416 - RNA, 18 nt, Human
gauuacaggcaugagcca

SEQ ID NO: 1085417 - RNA, 19 nt, Human
gauuacaggcaugagccac

SEQ ID NO: 1085418 - RNA, 21 nt, Human
gauuacaggcaugagccacug

SEQ ID NO: 1085419 - RNA, 24 nt, Human
gcacuccagccugggcgacagagc

SEQ ID NO: 1085420 - RNA, 24 nt, Human
gcacuccagccugggcgacagagc

SEQ ID NO: 1085421 - RNA, 21 nt, Human
gcagcacagcccagccccaca

SEQ ID NO: 1085422 - RNA, 23 nt, Human
gcaggagaaucacuugaaccugg

SEQ ID NO: 1085423 - RNA, 22 nt, Human
gccaccgcacuccagccugggc

SEQ ID NO: 1085424 - RNA, 22 nt, Human
gccacugcacuccagccugggc

SEQ ID NO: 1085425 - RNA, 24 nt, Human
gccacugcacuccagccugggcga

SEQ ID NO: 1085426 - RNA, 20 nt, Human
gccccacagcccgcccaccc

SEQ ID NO: 1085427 - RNA, 22 nt, Human
gcccugcguguccccucuccca

SEQ ID NO: 1085428 - RNA, 20 nt, Human
gccgagaucgcgccaccgca

SEQ ID NO: 1085429 - RNA, 20 nt, Human
gccgagaucgcgccacugca

SEQ ID NO: 1085430 - RNA, 20 nt, Human
gccucagccuccugaguagc

SEQ ID NO: 1085431 - RNA, 24 nt, Human
gccuucaccacacauguccuccau

SEQ ID NO: 1085432 - RNA, 22 nt, Human
gccuuggccucccaaagugcug

SEQ ID NO: 1085433 - RNA, 23 nt, Human
gcgauucuccugccucagccucc

SEQ ID NO: 1085434 - RNA, 21 nt, Human
gcucacugcaaccuuugccuc

SEQ ID NO: 1085435 - RNA, 22 nt, Human
gcugaggcaggagaauggcgug

SEQ ID NO: 1085436 - RNA, 23 nt, Human
gcuggucucgagcuccugaccuc

SEQ ID NO: 1085437 - RNA, 22 nt, Human
gcuguaaucccagcuacucagg

SEQ ID NO: 1085438 - RNA, 24 nt, Human
ggagcuugcagugagccgagaucg

SEQ ID NO: 1085439 - RNA, 22 nt, Human
ggauuacaggcaugagccacug

SEQ ID NO: 1085440 - RNA, 21 nt, Human
ggcagagagggggcuaugggc

SEQ ID NO: 1085441 - RNA, 27 nt, Human
ggcccaggcugagaccuuggugguggc

SEQ ID NO: 1085442 - RNA, 22 nt, Human
ggcugagccagagcugggagga

SEQ ID NO: 1085443 - RNA, 21 nt, Human
ggcugcugucccaggagucuu

SEQ ID NO: 1085444 - RNA, 22 nt, Human
ggcuggaguacuguggugugau

SEQ ID NO: 1085445 - RNA, 24 nt, Human
ggcuggucucgagcuccugaccuc

SEQ ID NO: 1085446 - RNA, 18 nt, Human
gggaagcagagacccaga

SEQ ID NO: 1085447 - RNA, 18 nt, Human
gggcaaaauguuuauagu

SEQ ID NO: 1085448 - RNA, 22 nt, Human
gggcagagagggggcuaugggc

SEQ ID NO: 1085449 - RNA, 19 nt, Human
ggggacugggaggggcugg

SEQ ID NO: 1085450 - RNA, 23 nt, Human
ggggagcugucgcuuccauugcc

SEQ ID NO: 1085451 - RNA, 19 nt, Human
ggggcuggggugcauggag

SEQ ID NO: 1085452 - RNA, 23 nt, Human
gggguuucaccauguuggccagg

SEQ ID NO: 1085453 - RNA, 19 nt, Human
ggucucgagcuccugaccu

SEQ ID NO: 1085454 - RNA, 21 nt, Human
ggugggaggaggugccugggc

SEQ ID NO: 1085455 - RNA, 23 nt, Human
guagagacgggguuucaccaugu

SEQ ID NO: 1085456 - RNA, 20 nt, Human
gucccaggagucuuuguccu

SEQ ID NO: 1085457 - RNA, 24 nt, Human
gugauccaccugccuuggccuccc

SEQ ID NO: 1085458 - RNA, 18 nt, Human
guggagggagugcagcuu

SEQ ID NO: 1085459 - RNA, 19 nt, Human
guuguagugagccgagauc

SEQ ID NO: 1085460 - RNA, 21 nt, Human
guuguagugagccgagaucgc

SEQ ID NO: 1085461 - RNA, 20 nt, Human
uaacuccugcaccaaaucuc

SEQ ID NO: 1085462 - RNA, 22 nt, Human
uaacuccugcaccaaaucuccu

SEQ ID NO: 1085463 - RNA, 26 nt, Human
uaagagaugcuucagcaaagccuuca

SEQ ID NO: 1085464 - RNA, 21 nt, Human
uaagaggggagccaugucuug

SEQ ID NO: 1085465 - RNA, 24 nt, Human
uaauuuuuguauuuuuaguagaga

SEQ ID NO: 1085466 - RNA, 19 nt, Human
uacacagcugcacagcuug

SEQ ID NO: 1085467 - RNA, 22 nt, Human
uagagacgggguuucaccaugu

SEQ ID NO: 1085468 - RNA, 20 nt, Human
uaggaugagggccuaggggu

SEQ ID NO: 1085469 - RNA, 24 nt, Human
uaguagagacgggguuucaccaug

SEQ ID NO: 1085470 - RNA, 26 nt, Human
uaguagagacgggguuucaccauguu

SEQ ID NO: 1085471 - RNA, 24 nt, Human
uauauaguuaaaaagaaacacacc

SEQ ID NO: 1085472 - RNA, 18 nt, Human
uauggccccaagugaggg

SEQ ID NO: 1085473 - RNA, 21 nt, Human
uauggccccaagugagggcug

SEQ ID NO: 1085474 - RNA, 21 nt, Human
ucaagugauccaccugccuug

SEQ ID NO: 1085475 - RNA, 20 nt, Human
ucacaugccugucuccccac

SEQ ID NO: 1085476 - RNA, 23 nt, Human
ucacugcaaccuuugccuccugg

SEQ ID NO: 1085477 - RNA, 24 nt, Human
ucacugcaaccuuugccuccuggg

SEQ ID NO: 1085478 - RNA, 25 nt, Human
ucacuugaaccugggaggcagaggu

SEQ ID NO: 1085479 - RNA, 18 nt, Human
ucagaauauguagugggg

SEQ ID NO: 1085480 - RNA, 19 nt, Human
ucagcaaagccuucaccac

SEQ ID NO: 1085481 - RNA, 23 nt, Human
ucagccuccugaguagcugggac

SEQ ID NO: 1085482 - RNA, 19 nt, Human
ucauucacuauggccccaa

SEQ ID NO: 1085483 - RNA, 24 nt, Human
uccagccugggcgacagagcaaga

SEQ ID NO: 1085484 - RNA, 23 nt, Human
uccagccugggcgacagagcgag

SEQ ID NO: 1085485 - RNA, 24 nt, Human
uccagccugggcgacagagcgaga

SEQ ID NO: 1085486 - RNA, 24 nt, Human
ucccaaagugcugggauuacaggc

SEQ ID NO: 1085487 - RNA, 25 nt, Human
ucccagcucccccuggcuggauucc

SEQ ID NO: 1085488 - RNA, 19 nt, Human
ucccaucccccugccccga

SEQ ID NO: 1085489 - RNA, 18 nt, Human
ucccccuggcuggauucc

SEQ ID NO: 1085490 - RNA, 22 nt, Human
uccccgucgccucuugucacuc

SEQ ID NO: 1085491 - RNA, 20 nt, Human
uccucagcgcaucugcugug

SEQ ID NO: 1085492 - RNA, 21 nt, Human
uccuccccgucgccucuuguc

SEQ ID NO: 1085493 - RNA, 22 nt, Human
uccuccccgucgccucuuguca

SEQ ID NO: 1085494 - RNA, 24 nt, Human
uccugaguagcugggacuacuggu

SEQ ID NO: 1085495 - RNA, 21 nt, Human
uccugccuccugcccagugug

SEQ ID NO: 1085496 - RNA, 21 nt, Human
uccuggguuccagcgauucuc

SEQ ID NO: 1085497 - RNA, 24 nt, Human
uccuggguuccagcgauucuccug

SEQ ID NO: 1085498 - RNA, 23 nt, Human
ucgcgccacugcacuccagccug

SEQ ID NO: 1085499 - RNA, 24 nt, Human
ucgcucugucaccuaggcuggagu

SEQ ID NO: 1085500 - RNA, 21 nt, Human
ucuaacacuuccuaacgagaa

SEQ ID NO: 1085501 - RNA, 20 nt, Human
ucucagccacuuccagaagc

SEQ ID NO: 1085502 - RNA, 24 nt, Human
ucuccugccucagccuccugagua

SEQ ID NO: 1085503 - RNA, 19 nt, Human
ucucgcucugucaccuagg

SEQ ID NO: 1085504 - RNA, 22 nt, Human
ucucgcucugucaccuaggcug

SEQ ID NO: 1085505 - RNA, 23 nt, Human
ucucgcucugucaccuaggcugg

SEQ ID NO: 1085506 - RNA, 24 nt, Human
ucucgcucugucaccuaggcugga

SEQ ID NO: 1085507 - RNA, 22 nt, Human
ucuggacagagaggccuacaca

SEQ ID NO: 1085508 - RNA, 22 nt, Human
ucuggcucagaaucucucauga

SEQ ID NO: 1085509 - RNA, 21 nt, Human
ucuguagucccagcuacucgg

SEQ ID NO: 1085510 - RNA, 18 nt, Human
ucugucaccuaggcugga

SEQ ID NO: 1085511 - RNA, 22 nt, Human
ucuuuaaauggcccucagucaa

SEQ ID NO: 1085512 - RNA, 22 nt, Human
ugaaccugggaggcagagguug

SEQ ID NO: 1085513 - RNA, 24 nt, Human
ugaccucaagugauccaccugccu

SEQ ID NO: 1085514 - RNA, 22 nt, Human
ugagccgagaucgcgccaccgc

SEQ ID NO: 1085515 - RNA, 22 nt, Human
ugagccgagaucgcgccacugc

SEQ ID NO: 1085516 - RNA, 24 nt, Human
ugagcugccugagugugcucauga

SEQ ID NO: 1085517 - RNA, 20 nt, Human
ugaggcaggagaaucacuug

SEQ ID NO: 1085518 - RNA, 24 nt, Human
ugaggcaggagaaucacuugaacc

SEQ ID NO: 1085519 - RNA, 25 nt, Human
ugaggcaggagaaucacuugaaccu

SEQ ID NO: 1085520 - RNA, 24 nt, Human
ugaggcaggagaauggcgugaacc

SEQ ID NO: 1085521 - RNA, 25 nt, Human
ugaggcaggagaauggcgugaaccc

SEQ ID NO: 1085522 - RNA, 23 nt, Human
ugaggggacugggaggggcuggg

SEQ ID NO: 1085523 - RNA, 23 nt, Human
ugaguuauaacuccuuacauuua

SEQ ID NO: 1085524 - RNA, 21 nt, Human
ugaucucacccuugcuggugu

SEQ ID NO: 1085525 - RNA, 18 nt, Human
ugcccagugugcagcaca

SEQ ID NO: 1085526 - RNA, 18 nt, Human
ugcccugcuggccugggg

SEQ ID NO: 1085527 - RNA, 24 nt, Human
ugccucagccuccugaguagcugg

SEQ ID NO: 1085528 - RNA, 28 nt, Human
ugccuccuggguuccagcgauucuccuu

SEQ ID NO: 1085529 - RNA, 18 nt, Human
ugccugggcuggcugcag

SEQ ID NO: 1085530 - RNA, 20 nt, Human
uggagccugaggacuguggg

SEQ ID NO: 1085531 - RNA, 20 nt, Human
uggaggaggaagugguuagg

SEQ ID NO: 1085532 - RNA, 18 nt, Human
uggcagccucauaaucug

SEQ ID NO: 1085533 - RNA, 24 nt, Human
uggccaggcuggucucgagcuccu

SEQ ID NO: 1085534 - RNA, 22 nt, Human
uggccgacacggucccaaauau

SEQ ID NO: 1085535 - RNA, 24 nt, Human
ugggacuacuggugugcaccacca

SEQ ID NO: 1085536 - RNA, 19 nt, Human
ugggaggaggugccugggc

SEQ ID NO: 1085537 - RNA, 21 nt, Human
ugggaggaggugccugggcug

SEQ ID NO: 1085538 - RNA, 22 nt, Human
ugggaggaggugccugggcugg

SEQ ID NO: 1085539 - RNA, 24 nt, Human
ugggaggcagagguuguagugagc

SEQ ID NO: 1085540 - RNA, 18 nt, Human
ugggauuacaggcaugag

SEQ ID NO: 1085541 - RNA, 19 nt, Human
ugggauuacaggcaugagc

SEQ ID NO: 1085542 - RNA, 21 nt, Human
ugggauuacaggcaugagcca

SEQ ID NO: 1085543 - RNA, 22 nt, Human
ugggauuacaggcaugagccac

SEQ ID NO: 1085544 - RNA, 22 nt, Human
ugggauuacaggcaugagccac

SEQ ID NO: 1085545 - RNA, 24 nt, Human
ugggauuacaggcaugagccacug

SEQ ID NO: 1085546 - RNA, 26 nt, Human
ugggauuacaggcaugagccacugcu

SEQ ID NO: 1085547 - RNA, 19 nt, Human
ugggugauucuggcucaga

SEQ ID NO: 1085548 - RNA, 20 nt, Human
uggguguucacaugccuguc

SEQ ID NO: 1085549 - RNA, 22 nt, Human
uggguuagacuuggguguucac

SEQ ID NO: 1085550 - RNA, 19 nt, Human
uggguuccagcgauucucc

SEQ ID NO: 1085551 - RNA, 20 nt, Human
uggguuccagcgauucuccu

SEQ ID NO: 1085552 - RNA, 19 nt, Human
uggucacccaaaaauccug

SEQ ID NO: 1085553 - RNA, 26 nt, Human
ugguuugucccagagcuguaauccca

SEQ ID NO: 1085554 - RNA, 21 nt, Human
uguauuuuuaguagagacggg

SEQ ID NO: 1085555 - RNA, 20 nt, Human
ugucccaggagucuuugucc

SEQ ID NO: 1085556 - RNA, 18 nt, Human
uguccuccagaccauccu

SEQ ID NO: 1085557 - RNA, 18 nt, Human
uguggggcagagaggggg

SEQ ID NO: 1085558 - RNA, 20 nt, Human
uguggggcagagagggggcu

SEQ ID NO: 1085559 - RNA, 24 nt, Human
ugugguuaaaaugucagccagggc

SEQ ID NO: 1085560 - RNA, 24 nt, Human
uuaaaaugucagccagggcugcag

SEQ ID NO: 1085561 - RNA, 18 nt, Human
uuaguagagacgggguuu

SEQ ID NO: 1085562 - RNA, 22 nt, Human
uuaguagagacgggguuucacc

SEQ ID NO: 1085563 - RNA, 24 nt, Human
uuaguagagacgggguuucaccau

SEQ ID NO: 1085564 - RNA, 23 nt, Human
uuauaacuccuuacauuuaccca

SEQ ID NO: 1085565 - RNA, 22 nt, Human
uuccagaagcugcccaaguccu

SEQ ID NO: 1085566 - RNA, 18 nt, Human
uuccagcgauucuccugc

SEQ ID NO: 1085567 - RNA, 23 nt, Human
uucccccagcucaccuugguucu

SEQ ID NO: 1085568 - RNA, 24 nt, Human
uugaaccugggaggcagagguugu

SEQ ID NO: 1085569 - RNA, 22 nt, Human
uugacuggggcuggagggucug

SEQ ID NO: 1085570 - RNA, 24 nt, Human
uugaggggacugggaggggcuggg

SEQ ID NO: 1085571 - RNA, 26 nt, Human
uugaggggacugggaggggcuggggu

SEQ ID NO: 1085572 - RNA, 18 nt, Human
uugcagugagccgagauc

SEQ ID NO: 1085573 - RNA, 19 nt, Human
uugcagugagccgagaucg

SEQ ID NO: 1085574 - RNA, 22 nt, Human
uugcagugagccgagaucgcgc

SEQ ID NO: 1085575 - RNA, 19 nt, Human
uugccuccuggguuccagc

SEQ ID NO: 1085576 - RNA, 18 nt, Human
uuggccucccaaagugcu

SEQ ID NO: 1085577 - RNA, 18 nt, Human
uuguagugagccgagauc

SEQ ID NO: 1085578 - RNA, 19 nt, Human
uuguagugagccgagaucg

SEQ ID NO: 1085579 - RNA, 22 nt, Human
uuguagugagccgagaucgcgc

SEQ ID NO: 1085580 - RNA, 23 nt, Human
uuguauuuuuaguagagacgggg

SEQ ID NO: 1085581 - RNA, 21 nt, Human
uuuaccaugcagaucucucca

SEQ ID NO: 1085582 - RNA, 24 nt, Human
uuucaccauguuggccaggcuggu

SEQ ID NO: 1085583 - RNA, 19 nt, Human
uuucaggaucugacucucg

SEQ ID NO: 1085584 - RNA, 20 nt, Human
uuugccuccuggguuccaga

SEQ ID NO: 1085585 - RNA, 24 nt, Human
uuuuuaguagagacgggguuucac

SEQ ID NO: 1085586 - RNA, 20 nt, Human
uuuuuguauuuuuaguagag

SEQ ID NO: 1085587 - RNA, 22 nt, Human
aaauggccuuaucccaaucaca

SEQ ID NO: 1085588 - RNA, 22 nt, Human
acagcagcaauacagaacaaag

SEQ ID NO: 1085589 - RNA, 18 nt, Human
acaguguguuaaauauuu

SEQ ID NO: 1085590 - RNA, 24 nt, Human
accccucugccuccuccuaucccu

SEQ ID NO: 1085591 - RNA, 23 nt, Human
acucaauucauuucuagccacac

SEQ ID NO: 1085592 - RNA, 24 nt, Human
acuuacauuaaaaaggaagaacaa

SEQ ID NO: 1085593 - RNA, 23 nt, Human
augcuagagucccucaugcucca

SEQ ID NO: 1085594 - RNA, 21 nt, Human
auugacccaaagcaaaacuua

SEQ ID NO: 1085595 - RNA, 25 nt, Human
caaaauacauuaugauauaacacac

SEQ ID NO: 1085596 - RNA, 25 nt, Human
caaacgcugugcuugagaaaacagc

SEQ ID NO: 1085597 - RNA, 21 nt, Human
caagcagaucagagucuaaga

SEQ ID NO: 1085598 - RNA, 19 nt, Human
cacacucagaguggcugcc

SEQ ID NO: 1085599 - RNA, 21 nt, Human
cacugcuggcucugaaaaagg

SEQ ID NO: 1085600 - RNA, 21 nt, Human
cacuucugggugaaacaguuu

SEQ ID NO: 1085601 - RNA, 21 nt, Human
cagaaacuccaggcaccccuc

SEQ ID NO: 1085602 - RNA, 23 nt, Human
cauucugggcucaugagcacucc

SEQ ID NO: 1085603 - RNA, 18 nt, Human
ccaaagcaaaacuuacau

SEQ ID NO: 1085604 - RNA, 25 nt, Human
ccagcaaucucccgaauaauccucu

SEQ ID NO: 1085605 - RNA, 19 nt, Human
cccgucuucggaaaccugu

SEQ ID NO: 1085606 - RNA, 24 nt, Human
ccuccaaacuaacaggcauggauu

SEQ ID NO: 1085607 - RNA, 21 nt, Human
ccugggguuguagggagaagu

SEQ ID NO: 1085608 - RNA, 18 nt, Human
cgcugugcuugagaaaac

SEQ ID NO: 1085609 - RNA, 22 nt, Human
cuccaggcaccccucugccucc

SEQ ID NO: 1085610 - RNA, 22 nt, Human
cugaaaaaggugaagccagaga

SEQ ID NO: 1085611 - RNA, 19 nt, Human
cuucugggugaaacaguuu

SEQ ID NO: 1085612 - RNA, 22 nt, Human
cuuuuuaagcuuccagauaaau

SEQ ID NO: 1085613 - RNA, 24 nt, Human
gaaacuccaggcaccccucugccu

SEQ ID NO: 1085614 - RNA, 18 nt, Human
gaagucacacucaauuca

SEQ ID NO: 1085615 - RNA, 21 nt, Human
gacucucucuggagauaacuu

SEQ ID NO: 1085616 - RNA, 18 nt, Human
ggacagacuacccguucc

SEQ ID NO: 1085617 - RNA, 22 nt, Human
ggacagacuacccguuccuauc

SEQ ID NO: 1085618 - RNA, 18 nt, Human
uaacaugaacaucacuga

SEQ ID NO: 1085619 - RNA, 23 nt, Human
uaauucaaauugacccaaagcaa

SEQ ID NO: 1085620 - RNA, 18 nt, Human
uagagucccucaugcucc

SEQ ID NO: 1085621 - RNA, 22 nt, Human
ucagaguggcugccugcgaaag

SEQ ID NO: 1085622 - RNA, 21 nt, Human
ucaggcuccagcuaguuugga

SEQ ID NO: 1085623 - RNA, 20 nt, Human
ucccugggccugggguugua

SEQ ID NO: 1085624 - RNA, 18 nt, Human
uccuauccaucaggcucc

SEQ ID NO: 1085625 - RNA, 18 nt, Human
uccuccaaacuaacaggc

SEQ ID NO: 1085626 - RNA, 22 nt, Human
uccuccuaucccugggccuggg

SEQ ID NO: 1085627 - RNA, 19 nt, Human
ucugaagucacagcagcaa

SEQ ID NO: 1085628 - RNA, 20 nt, Human
ucugccuccuccuauccccc

SEQ ID NO: 1085629 - RNA, 21 nt, Human
ugaaaaaggugaagccagaga

SEQ ID NO: 1085630 - RNA, 18 nt, Human
ugaauaaauuaacacaca

SEQ ID NO: 1085631 - RNA, 28 nt, Human
ugaauaaauuaacacacacauacgugga

SEQ ID NO: 1085632 - RNA, 23 nt, Human
ugacaaugaauuaaaaaaugaga

SEQ ID NO: 1085633 - RNA, 19 nt, Human
ugagaaaacagcacugcug

SEQ ID NO: 1085634 - RNA, 23 nt, Human
ugagaauacagcuuggcaacugu

SEQ ID NO: 1085635 - RNA, 19 nt, Human
ugcaggaaaguuagaaucu

SEQ ID NO: 1085636 - RNA, 18 nt, Human
ugccaaagagucuauggg

SEQ ID NO: 1085637 - RNA, 23 nt, Human
ugcgaaagagucuaugccaaaga

SEQ ID NO: 1085638 - RNA, 21 nt, Human
ugcuuaggcacaagcagauca

SEQ ID NO: 1085639 - RNA, 24 nt, Human
uggaaaccucugaauggcugggga

SEQ ID NO: 1085640 - RNA, 19 nt, Human
uggccuuaucccaaucaca

SEQ ID NO: 1085641 - RNA, 22 nt, Human
uggcuggggagagaaaaucuuu

SEQ ID NO: 1085642 - RNA, 20 nt, Human
uuccuauccaucaggcucca

SEQ ID NO: 1085643 - RNA, 22 nt, Human
uuggaaaccucugaauggcugg

SEQ ID NO: 1085644 - RNA, 20 nt, Human
uuuggaaaccucugaauggc

SEQ ID NO: 1085645 - RNA, 19 nt, Human
aggacugagaucuuuuccg

SEQ ID NO: 1085646 - RNA, 19 nt, Human
cauuacucucuugcuaaga

SEQ ID NO: 1085647 - RNA, 21 nt, Human
gaucuuguuucaucuuaacac

SEQ ID NO: 1085648 - RNA, 19 nt, Human
guuucaucuuaacacacac

SEQ ID NO: 1085649 - RNA, 21 nt, Human
uacucucuugcuaagaucuug

SEQ ID NO: 1085650 - RNA, 25 nt, Human
uucguggacaggcaaggccgaauuc

SEQ ID NO: 1085651 - RNA, 20 nt, Human
uuucguggacaggcaaggcc

SEQ ID NO: 1085652 - RNA, 18 nt, Human
aaacgugacccucucaaa

SEQ ID NO: 1085653 - RNA, 23 nt, Human
aaagguacuacaaaaggaaaaug

SEQ ID NO: 1085654 - RNA, 23 nt, Human
aacaaaauucacauuucucagca

SEQ ID NO: 1085655 - RNA, 24 nt, Human
aagcuuccaugccuuccacuuucu

SEQ ID NO: 1085656 - RNA, 18 nt, Human
aaggaaaaaaaucaagcu

SEQ ID NO: 1085657 - RNA, 24 nt, Human
aaggaaaaaaaucaagcugaaagc

SEQ ID NO: 1085658 - RNA, 22 nt, Human
aagggagucagagaaugaaggu

SEQ ID NO: 1085659 - RNA, 19 nt, Human
acaaaaggaaaaugaacac

SEQ ID NO: 1085660 - RNA, 26 nt, Human
acaagacaaacaagagccuuauacag

SEQ ID NO: 1085661 - RNA, 22 nt, Human
acccaaauccaagauccuccuc

SEQ ID NO: 1085662 - RNA, 23 nt, Human
agaagccuaagaaaauguaaggg

SEQ ID NO: 1085663 - RNA, 24 nt, Human
agaagcuagcaagaagccuaagaa

SEQ ID NO: 1085664 - RNA, 24 nt, Human
agcuuccaugccuuccacuuucuc

SEQ ID NO: 1085665 - RNA, 20 nt, Human
aggaaaaaaaucaagcugaa

SEQ ID NO: 1085666 - RNA, 22 nt, Human
aggcagugucuuucugagucug

SEQ ID NO: 1085667 - RNA, 20 nt, Human
agugcuucacacacagcagu

SEQ ID NO: 1085668 - RNA, 22 nt, Human
agugucuuucugagucugaucc

SEQ ID NO: 1085669 - RNA, 22 nt, Human
cacagcauuuccuccacaauac

SEQ ID NO: 1085670 - RNA, 18 nt, Human
cacugaacuuacaaauga

SEQ ID NO: 1085671 - RNA, 19 nt, Human
cagccacugacucauccug

SEQ ID NO: 1085672 - RNA, 22 nt, Human
cagcuucaguaaagagcagaac

SEQ ID NO: 1085673 - RNA, 19 nt, Human
cauccuuguauucaccagu

SEQ ID NO: 1085674 - RNA, 23 nt, Human
caugaggaagagugccagacccc

SEQ ID NO: 1085675 - RNA, 19 nt, Human
cauuacucucuugcuaaga

SEQ ID NO: 1085676 - RNA, 19 nt, Human
ccaagauccuccucagucu

SEQ ID NO: 1085677 - RNA, 23 nt, Human
ccaauucacucugccaaaggaaa

SEQ ID NO: 1085678 - RNA, 20 nt, Human
ccacaccagcaacuuccagc

SEQ ID NO: 1085679 - RNA, 22 nt, Human
ccacugacucauccugugacga

SEQ ID NO: 1085680 - RNA, 22 nt, Human
ccagagccgccgugccagaagc

SEQ ID NO: 1085681 - RNA, 21 nt, Human
ccccugccucccuggcagcca

SEQ ID NO: 1085682 - RNA, 18 nt, Human
cccucucaaaucccccaa

SEQ ID NO: 1085683 - RNA, 23 nt, Human
cccuguuuucaggagccgacucc

SEQ ID NO: 1085684 - RNA, 23 nt, Human
ccuguuaacauggaauccuuacc

SEQ ID NO: 1085685 - RNA, 23 nt, Human
ccuucccacugugcccuuaagag

SEQ ID NO: 1085686 - RNA, 22 nt, Human
cgacccuguuuucaggagccga

SEQ ID NO: 1085687 - RNA, 22 nt, Human
cgcagcaccuguucaagaugga

SEQ ID NO: 1085688 - RNA, 21 nt, Human
cucugccaaaggaaaaaaauc

SEQ ID NO: 1085689 - RNA, 18 nt, Human
cugaacuuacaaaugauu

SEQ ID NO: 1085690 - RNA, 21 nt, Human
cugccuccugccaucuaaucu

SEQ ID NO: 1085691 - RNA, 20 nt, Human
cugcugccucuucucugagc

SEQ ID NO: 1085692 - RNA, 22 nt, Human
cuguauaccccuuuucacugug

SEQ ID NO: 1085693 - RNA, 18 nt, Human
cuuaagagcugcugcucc

SEQ ID NO: 1085694 - RNA, 18 nt, Human
cuuuuuggcagaagcuag

SEQ ID NO: 1085695 - RNA, 20 nt, Human
gaaaauguaagguggcaaca

SEQ ID NO: 1085696 - RNA, 21 nt, Human
gaaaccacccagcccgaaagc

SEQ ID NO: 1085697 - RNA, 26 nt, Human
gaagaccaaagaggacugcggguucu

SEQ ID NO: 1085698 - RNA, 18 nt, Human
gaauucccuuugcccuuc

SEQ ID NO: 1085699 - RNA, 19 nt, Human
gaucugcugccucuucucu

SEQ ID NO: 1085700 - RNA, 21 nt, Human
gaucuuguuucaucuuaacac

SEQ ID NO: 1085701 - RNA, 20 nt, Human
gcagaagcuagcaagaagcc

SEQ ID NO: 1085702 - RNA, 22 nt, Human
gccacaccagcaacuuccagca

SEQ ID NO: 1085703 - RNA, 20 nt, Human
gccgacuccuggcagguugg

SEQ ID NO: 1085704 - RNA, 18 nt, Human
gccuaagaaaauguaagg

SEQ ID NO: 1085705 - RNA, 18 nt, Human
ggaccccaauucacucug

SEQ ID NO: 1085706 - RNA, 20 nt, Human
ggcugugcccagagccgccg

SEQ ID NO: 1085707 - RNA, 18 nt, Human
gugacccucucaaauccc

SEQ ID NO: 1085708 - RNA, 19 nt, Human
guuucaucuuaacacacac

SEQ ID NO: 1085709 - RNA, 24 nt, Human
uaacauggaauccuuaccucugcc

SEQ ID NO: 1085710 - RNA, 28 nt, Human
uaacauggaauccuuaccucugccuccu

SEQ ID NO: 1085711 - RNA, 23 nt, Human
uaccucugccuccugccaucuaa

SEQ ID NO: 1085712 - RNA, 21 nt, Human
uacucucuugcuaagaucuug

SEQ ID NO: 1085713 - RNA, 20 nt, Human
uagcaagaagccuaagaaaa

SEQ ID NO: 1085714 - RNA, 18 nt, Human
uauccuagaucugcugcc

SEQ ID NO: 1085715 - RNA, 19 nt, Human
ucauuugaggagcuuccuu

SEQ ID NO: 1085716 - RNA, 22 nt, Human
uccaagaccccugcguagacuc

SEQ ID NO: 1085717 - RNA, 20 nt, Human
ucccuggcagccacugacuc

SEQ ID NO: 1085718 - RNA, 25 nt, Human
uccucagucuugaaaccuucccacu

SEQ ID NO: 1085719 - RNA, 22 nt, Human
uccuccacaauacugugaacug

SEQ ID NO: 1085720 - RNA, 19 nt, Human
ucuuuuuuccccuaaggau

SEQ ID NO: 1085721 - RNA, 19 nt, Human
ugaaaauguaagguggcaa

SEQ ID NO: 1085722 - RNA, 20 nt, Human
ugaaaccacccagcccgaaa

SEQ ID NO: 1085723 - RNA, 18 nt, Human
ugagauagacaaagcucc

SEQ ID NO: 1085724 - RNA, 21 nt, Human
ugaggaaagguacuacaaaag

SEQ ID NO: 1085725 - RNA, 19 nt, Human
ugaggaagagugccagacc

SEQ ID NO: 1085726 - RNA, 21 nt, Human
ugagggaaagucgucuucaga

SEQ ID NO: 1085727 - RNA, 18 nt, Human
ugagucugaauucccuuu

SEQ ID NO: 1085728 - RNA, 21 nt, Human
ugagucugaauucccuuugcc

SEQ ID NO: 1085729 - RNA, 25 nt, Human
ugcccagagccgccgugccagaagc

SEQ ID NO: 1085730 - RNA, 26 nt, Human
ugcccagagccgccgugccagaagcu

SEQ ID NO: 1085731 - RNA, 22 nt, Human
ugcccggguuccaagaccccug

SEQ ID NO: 1085732 - RNA, 20 nt, Human
ugccucuucucugagcguuc

SEQ ID NO: 1085733 - RNA, 24 nt, Human
ugcugcuccauauccuagaucugc

SEQ ID NO: 1085734 - RNA, 21 nt, Human
uggaaguggguauguggggcu

SEQ ID NO: 1085735 - RNA, 19 nt, Human
uggaauccuuaccucugcc

SEQ ID NO: 1085736 - RNA, 22 nt, Human
uggcagaagcuagcaagaagcc

SEQ ID NO: 1085737 - RNA, 23 nt, Human
uggcagaagcuagcaagaagccu

SEQ ID NO: 1085738 - RNA, 23 nt, Human
ugggccaaacgugacccucucaa

SEQ ID NO: 1085739 - RNA, 23 nt, Human
ugguucgaacaccucugacagcu

SEQ ID NO: 1085740 - RNA, 19 nt, Human
ugucacaguucuggccacu

SEQ ID NO: 1085741 - RNA, 21 nt, Human
uuaaaaacaagacaaacaaga

SEQ ID NO: 1085742 - RNA, 22 nt, Human
uucagcuucaguaaagagcaga

SEQ ID NO: 1085743 - RNA, 25 nt, Human
uucguggacaggcaaggccgaauuc

SEQ ID NO: 1085744 - RNA, 18 nt, Human
uucucagcaucuuuuuuc

SEQ ID NO: 1085745 - RNA, 20 nt, Human
uuucguggacaggcaaggcc

SEQ ID NO: 1085746 - RNA, 18 nt, Human
uuugcccuucauccuugu

SEQ ID NO: 1085747 - RNA, 24 nt, Human
aaaaaaaaauugucaagccauuga

SEQ ID NO: 1085748 - RNA, 19 nt, Human
aaaacacccaucaucuaca

SEQ ID NO: 1085749 - RNA, 27 nt, Human
aaaacauuuuuuucuuuuuaauuguua

SEQ ID NO: 1085750 - RNA, 20 nt, Human
aaaauccccaugacauuuuu

SEQ ID NO: 1085751 - RNA, 21 nt, Human
aaacacccaucaucuacaaag

SEQ ID NO: 1085752 - RNA, 23 nt, Human
aagacagaagauuuacaagaaga

SEQ ID NO: 1085753 - RNA, 18 nt, Human
aagguaaacauuuagacc

SEQ ID NO: 1085754 - RNA, 19 nt, Human
aaugaagaagauaaaagcc

SEQ ID NO: 1085755 - RNA, 22 nt, Human
aauuaaaaaaaaauccccauga

SEQ ID NO: 1085756 - RNA, 23 nt, Human
acaaaagacagaagauuuacaag

SEQ ID NO: 1085757 - RNA, 18 nt, Human
acagugcauugacaugau

SEQ ID NO: 1085758 - RNA, 20 nt, Human
acauacagagaugaacaaac

SEQ ID NO: 1085759 - RNA, 21 nt, Human
acaugauaaaaccaaggcaca

SEQ ID NO: 1085760 - RNA, 20 nt, Human
aggaccuugucccagcuccc

SEQ ID NO: 1085761 - RNA, 19 nt, Human
aggcacaaaaauacaguua

SEQ ID NO: 1085762 - RNA, 24 nt, Human
agguggucaacgcagauauugagc

SEQ ID NO: 1085763 - RNA, 24 nt, Human
auaaaauccaaauuggacucaaag

SEQ ID NO: 1085764 - RNA, 24 nt, Human
auaccuuuccuuggugacacgaga

SEQ ID NO: 1085765 - RNA, 22 nt, Human
auccccaugacauuuuucaaaa

SEQ ID NO: 1085766 - RNA, 22 nt, Human
cacaguucagaacguugugucu

SEQ ID NO: 1085767 - RNA, 20 nt, Human
cacgagaaggaaauacagug

SEQ ID NO: 1085768 - RNA, 24 nt, Human
cagaucauaaagucugaaaaauua

SEQ ID NO: 1085769 - RNA, 21 nt, Human
cagcaaaauauguacuuuagc

SEQ ID NO: 1085770 - RNA, 22 nt, Human
cauuucuuggcacaugcacgcc

SEQ ID NO: 1085771 - RNA, 18 nt, Human
cccaucaucuacaaaguu

SEQ ID NO: 1085772 - RNA, 20 nt, Human
ccccuuacaaaagacagaag

SEQ ID NO: 1085773 - RNA, 23 nt, Human
cccuuacaaaagacagaagauuu

SEQ ID NO: 1085774 - RNA, 21 nt, Human
ccgcuggcgcuggcugagcag

SEQ ID NO: 1085775 - RNA, 20 nt, Human
cggcuccuagccccacuggc

SEQ ID NO: 1085776 - RNA, 18 nt, Human
cggcugcccauguccucg

SEQ ID NO: 1085777 - RNA, 21 nt, Human
cuacagagguauccggcuccu

SEQ ID NO: 1085778 - RNA, 19 nt, Human
gcgcggcugggugcggcgg

SEQ ID NO: 1085779 - RNA, 21 nt, Human
ggaacaauccugaaugcagcg

SEQ ID NO: 1085780 - RNA, 23 nt, Human
gggcgcgccgcggcugcccaugu

SEQ ID NO: 1085781 - RNA, 18 nt, Human
gugcggcggccgcuggcg

SEQ ID NO: 1085782 - RNA, 22 nt, Human
uaaaaaaaaauccccaugacau

SEQ ID NO: 1085783 - RNA, 23 nt, Human
uaaaacacccaucaucuacaaag

SEQ ID NO: 1085784 - RNA, 22 nt, Human
uaaaaccaaggcacaaaaauac

SEQ ID NO: 1085785 - RNA, 22 nt, Human
uaaaaccaaggcacaaaaauac

SEQ ID NO: 1085786 - RNA, 19 nt, Human
uaaaaccuguaauaucuag

SEQ ID NO: 1085787 - RNA, 21 nt, Human
uaaaguauuccuguuuuucuu

SEQ ID NO: 1085788 - RNA, 18 nt, Human
uaaguggaaauuuguggc

SEQ ID NO: 1085789 - RNA, 23 nt, Human
uaauuaaaaaaaaauccccauga

SEQ ID NO: 1085790 - RNA, 21 nt, Human
uacgauaaguguauauaaacc

SEQ ID NO: 1085791 - RNA, 23 nt, Human
uagaaaaugcuuuuuauuuuccu

SEQ ID NO: 1085792 - RNA, 18 nt, Human
uagggugaggagcaacac

SEQ ID NO: 1085793 - RNA, 23 nt, Human
ucaagccauugacagcaaaauau

SEQ ID NO: 1085794 - RNA, 21 nt, Human
uccauuaguaauacugaauga

SEQ ID NO: 1085795 - RNA, 20 nt, Human
ucuacugggacauucucuua

SEQ ID NO: 1085796 - RNA, 18 nt, Human
ucugcaaaacuuuuacag

SEQ ID NO: 1085797 - RNA, 24 nt, Human
ugaaauaaacugguaaaaacugua

SEQ ID NO: 1085798 - RNA, 23 nt, Human
ugaagaagauaaaagccuuucaa

SEQ ID NO: 1085799 - RNA, 20 nt, Human
ugaagucuaaucuacuggga

SEQ ID NO: 1085800 - RNA, 22 nt, Human
ugaguccuuggcaaacaaaaaa

SEQ ID NO: 1085801 - RNA, 22 nt, Human
ugauaaaaccaaggcacaaaaa

SEQ ID NO: 1085802 - RNA, 23 nt, Human
ugcauagacaacgauaauaaaau

SEQ ID NO: 1085803 - RNA, 21 nt, Human
uggaaacagaucauaaagucu

SEQ ID NO: 1085804 - RNA, 19 nt, Human
uggcaaacaaaaaacauuu

SEQ ID NO: 1085805 - RNA, 21 nt, Human
uggcugagcagggcgcccggc

SEQ ID NO: 1085806 - RNA, 24 nt, Human
ugguaaaaacuguauuucauacuu

SEQ ID NO: 1085807 - RNA, 23 nt, Human
uguauauaaacccuagcacuuug

SEQ ID NO: 1085808 - RNA, 18 nt, Human
uguuuuucuuuuuccugg

SEQ ID NO: 1085809 - RNA, 19 nt, Human
uuaaaaccuguaauaucua

SEQ ID NO: 1085810 - RNA, 22 nt, Human
uuaaauauuaaaaccuguaaua

SEQ ID NO: 1085811 - RNA, 19 nt, Human
uuagacccauaaaaacaca

SEQ ID NO: 1085812 - RNA, 25 nt, Human
uuagugcaucaagcauugaagaaaa

SEQ ID NO: 1085813 - RNA, 20 nt, Human
uucacaucggcgcggggggu

SEQ ID NO: 1085814 - RNA, 22 nt, Human
uuggacucaaagguugaagucu

SEQ ID NO: 1085815 - RNA, 22 nt, Human
uuuccugaguccuuggcaaaca

SEQ ID NO: 1085816 - RNA, 22 nt, Human
uuuucaagacucaagguaaaca

SEQ ID NO: 1085817 - RNA, 22 nt, Human
auccuuggcaaacccuucccag

SEQ ID NO: 1085818 - RNA, 18 nt, Human
caggugcagugauggguu

SEQ ID NO: 1085819 - RNA, 18 nt, Human
ccuuggcaaacccuuccc

SEQ ID NO: 1085820 - RNA, 19 nt, Human
cugcagcacugcagguccu

SEQ ID NO: 1085821 - RNA, 18 nt, Human
cugcugcucugagcacug

SEQ ID NO: 1085822 - RNA, 23 nt, Human
gagucugcagcuccaauccuugg

SEQ ID NO: 1085823 - RNA, 19 nt, Human
aaaaaaaucacaaguugaa

SEQ ID NO: 1085824 - RNA, 24 nt, Human
aaaacaccaauugauacugagaac

SEQ ID NO: 1085825 - RNA, 19 nt, Human
aaagaaaaaaaaaucacaa

SEQ ID NO: 1085826 - RNA, 20 nt, Human
aaagugagaaagaaaaaaaa

SEQ ID NO: 1085827 - RNA, 20 nt, Human
aaguagagcaugcaugaaca

SEQ ID NO: 1085828 - RNA, 19 nt, Human
accaagaggaaagagcacc

SEQ ID NO: 1085829 - RNA, 19 nt, Human
aguggaucagagccucagc

SEQ ID NO: 1085830 - RNA, 18 nt, Human
aguguggcucccacgacc

SEQ ID NO: 1085831 - RNA, 23 nt, Human
auaaaauucucuuuaaguuaaag

SEQ ID NO: 1085832 - RNA, 24 nt, Human
aucaaacaauccuggcaugaauaa

SEQ ID NO: 1085833 - RNA, 19 nt, Human
auuaaaccaagggacuagc

SEQ ID NO: 1085834 - RNA, 21 nt, Human
caaaggauuugaagccacagg

SEQ ID NO: 1085835 - RNA, 22 nt, Human
cacaagucucucaguguggcuc

SEQ ID NO: 1085836 - RNA, 19 nt, Human
cacaggguuccagagcuuu

SEQ ID NO: 1085837 - RNA, 19 nt, Human
cacucugccuucacuuucc

SEQ ID NO: 1085838 - RNA, 19 nt, Human
cccucucuuaccugcucac

SEQ ID NO: 1085839 - RNA, 24 nt, Human
ccucagcgauucccauuccggccg

SEQ ID NO: 1085840 - RNA, 21 nt, Human
ccugcgcgggggcgacgcggg

SEQ ID NO: 1085841 - RNA, 20 nt, Human
ccuucacuuuccuuccuguc

SEQ ID NO: 1085842 - RNA, 19 nt, Human
cggcaggguaugccgagug

SEQ ID NO: 1085843 - RNA, 23 nt, Human
cugagaacacuaaauuauuaaau

SEQ ID NO: 1085844 - RNA, 22 nt, Human
gaaacaacagucacccuuccca

SEQ ID NO: 1085845 - RNA, 23 nt, Human
gagaaagaaaaaaaaaucacaag

SEQ ID NO: 1085846 - RNA, 18 nt, Human
gccacaggguuccagagc

SEQ ID NO: 1085847 - RNA, 19 nt, Human
gccuucacuuuccuuccug

SEQ ID NO: 1085848 - RNA, 18 nt, Human
uaaggcacaaauuaaacc

SEQ ID NO: 1085849 - RNA, 26 nt, Human
uagcgggcuggacgccggcguuccuc

SEQ ID NO: 1085850 - RNA, 25 nt, Human
uaucaaaguagagcaugcaugaaca

SEQ ID NO: 1085851 - RNA, 24 nt, Human
uaugccgagugggugucugaaaug

SEQ ID NO: 1085852 - RNA, 19 nt, Human
ucccacgacccugcacaga

SEQ ID NO: 1085853 - RNA, 23 nt, Human
ucccacgacccugcacagaugcu

SEQ ID NO: 1085854 - RNA, 25 nt, Human
ucucuguaucagagaaacgcugccu

SEQ ID NO: 1085855 - RNA, 19 nt, Human
ucucuuaccugcucacucu

SEQ ID NO: 1085856 - RNA, 23 nt, Human
ugagaaagaaaaaaaaaucacaa

SEQ ID NO: 1085857 - RNA, 21 nt, Human
ugcaugaacagaugauucauu

SEQ ID NO: 1085858 - RNA, 20 nt, Human
ugccgagugggugucugaaa

SEQ ID NO: 1085859 - RNA, 23 nt, Human
ugccucuaauacuuuuaugggua

SEQ ID NO: 1085860 - RNA, 21 nt, Human
ugccuucacuuuccuuccugu

SEQ ID NO: 1085861 - RNA, 20 nt, Human
ugcgcgggggcgacgcggga

SEQ ID NO: 1085862 - RNA, 21 nt, Human
ugcggggcccgcccugcgcgg

SEQ ID NO: 1085863 - RNA, 18 nt, Human
ugggugcccaugcuucuu

SEQ ID NO: 1085864 - RNA, 22 nt, Human
uguaaaaaguguaugccucuga

SEQ ID NO: 1085865 - RNA, 22 nt, Human
uuaaagugagaaagaaaaaaaa

SEQ ID NO: 1085866 - RNA, 22 nt, Human
uuagaaguggaucagagccuca

SEQ ID NO: 1085867 - RNA, 24 nt, Human
uuagaaguggaucagagccucagc

SEQ ID NO: 1085868 - RNA, 18 nt, Human
uugaagccacaggguucc

SEQ ID NO: 1085869 - RNA, 24 nt, Human
aaaacuuuucccaacaaagaccag

SEQ ID NO: 1085870 - RNA, 30 nt, Human
aauugcuccucucauuggcccaaauauguu

SEQ ID NO: 1085871 - RNA, 25 nt, Human
acaugccccuguaaguaggcagagc

SEQ ID NO: 1085872 - RNA, 22 nt, Human
acucacuuaccuaagaggcaaa

SEQ ID NO: 1085873 - RNA, 19 nt, Human
acuuuucccaacaaagacc

SEQ ID NO: 1085874 - RNA, 22 nt, Human
agcucggggaccugggcagcgg

SEQ ID NO: 1085875 - RNA, 18 nt, Human
aggaagaguggauacugg

SEQ ID NO: 1085876 - RNA, 21 nt, Human
aggaagaguggauacugggga

SEQ ID NO: 1085877 - RNA, 23 nt, Human
caagaaaaucucacuucagccca

SEQ ID NO: 1085878 - RNA, 26 nt, Human
cacaugccccuguaaguaggcagagc

SEQ ID NO: 1085879 - RNA, 22 nt, Human
caccccgcucccaggaggcccu

SEQ ID NO: 1085880 - RNA, 22 nt, Human
cacuucagcccagaaucgaaga

SEQ ID NO: 1085881 - RNA, 21 nt, Human
caggaggcccggacgaggcuu

SEQ ID NO: 1085882 - RNA, 19 nt, Human
ccaaauauguuacgcucau

SEQ ID NO: 1085883 - RNA, 20 nt, Human
ccaagauaaggaagagugga

SEQ ID NO: 1085884 - RNA, 21 nt, Human
ccaccugacagcuccgguugu

SEQ ID NO: 1085885 - RNA, 23 nt, Human
ccccuccccaccggccccaacuc

SEQ ID NO: 1085886 - RNA, 18 nt, Human
ccccuguaaguaggcaga

SEQ ID NO: 1085887 - RNA, 26 nt, Human
ccccuguaaguaggcagagcagggau

SEQ ID NO: 1085888 - RNA, 19 nt, Human
cccuguaaguaggcagagc

SEQ ID NO: 1085889 - RNA, 19 nt, Human
ccgacugcagcccuccugg

SEQ ID NO: 1085890 - RNA, 18 nt, Human
ccgggaagcucggggacc

SEQ ID NO: 1085891 - RNA, 19 nt, Human
ccgggaagcucggggaccu

SEQ ID NO: 1085892 - RNA, 18 nt, Human
ccgggauucaaucaacuc

SEQ ID NO: 1085893 - RNA, 21 nt, Human
ccuccuggacgggagccucug

SEQ ID NO: 1085894 - RNA, 19 nt, Human
ccucugggcccagcuuagg

SEQ ID NO: 1085895 - RNA, 21 nt, Human
ccuucaguguccugcggccuc

SEQ ID NO: 1085896 - RNA, 19 nt, Human
cgagaaccagcaagaccaa

SEQ ID NO: 1085897 - RNA, 19 nt, Human
cgggagccucugggcccag

SEQ ID NO: 1085898 - RNA, 20 nt, Human
cgggagccucugggcccagc

SEQ ID NO: 1085899 - RNA, 22 nt, Human
cgguaccugccaccccgcuccc

SEQ ID NO: 1085900 - RNA, 24 nt, Human
cucaugccccuccccaccggcccc

SEQ ID NO: 1085901 - RNA, 20 nt, Human
cuccgcuucgggggccgaga

SEQ ID NO: 1085902 - RNA, 21 nt, Human
cuccuucuugccauguugucc

SEQ ID NO: 1085903 - RNA, 18 nt, Human
cucucggaacggccgagg

SEQ ID NO: 1085904 - RNA, 20 nt, Human
cugugucuccgucgcuccgc

SEQ ID NO: 1085905 - RNA, 23 nt, Human
cuucuugccauguuguccucggg

SEQ ID NO: 1085906 - RNA, 24 nt, Human
cuuggaaauccaccugacagcucc

SEQ ID NO: 1085907 - RNA, 19 nt, Human
gagaaccagcaagaccaac

SEQ ID NO: 1085908 - RNA, 19 nt, Human
gauaaggaagaguggauac

SEQ ID NO: 1085909 - RNA, 20 nt, Human
gcaaagccuuggaaauccac

SEQ ID NO: 1085910 - RNA, 24 nt, Human
gcaaagccuuggaaauccaccuga

SEQ ID NO: 1085911 - RNA, 23 nt, Human
gccucggguuccgggaagcucgg

SEQ ID NO: 1085912 - RNA, 24 nt, Human
gccucugggcccagcuuagggugg

SEQ ID NO: 1085913 - RNA, 19 nt, Human
gcguuggcugcuuccuccc

SEQ ID NO: 1085914 - RNA, 21 nt, Human
gcugugucuccgucgcuccgc

SEQ ID NO: 1085915 - RNA, 18 nt, Human
ggccgaggaggauggguc

SEQ ID NO: 1085916 - RNA, 19 nt, Human
gggaagcucggggaccugg

SEQ ID NO: 1085917 - RNA, 18 nt, Human
guacagccaaugcaaagc

SEQ ID NO: 1085918 - RNA, 22 nt, Human
uaaggaagaguggauacugggg

SEQ ID NO: 1085919 - RNA, 22 nt, Human
uaaguaggcagagcagggaugu

SEQ ID NO: 1085920 - RNA, 20 nt, Human
uaaguuucagguacagccaa

SEQ ID NO: 1085921 - RNA, 26 nt, Human
uaggguggcguccagcgugaccuacu

SEQ ID NO: 1085922 - RNA, 20 nt, Human
ucagaaaaugaaagaaaaac

SEQ ID NO: 1085923 - RNA, 23 nt, Human
ucagcccagaaucgaagaacugg

SEQ ID NO: 1085924 - RNA, 20 nt, Human
uccaaaggcuccuucuugcc

SEQ ID NO: 1085925 - RNA, 21 nt, Human
uccaucccaguccggaaucca

SEQ ID NO: 1085926 - RNA, 21 nt, Human
uccccaccggccccaacuccc

SEQ ID NO: 1085927 - RNA, 19 nt, Human
uccgggauucaaucaacuc

SEQ ID NO: 1085928 - RNA, 22 nt, Human
ucugcgccgacugcagcccucc

SEQ ID NO: 1085929 - RNA, 24 nt, Human
ucuucuuuccucaguguuucuucu

SEQ ID NO: 1085930 - RNA, 20 nt, Human
ucuugccauguuguccucgg

SEQ ID NO: 1085931 - RNA, 27 nt, Human
ugcacucacuuaccuaagaggcaaaac

SEQ ID NO: 1085932 - RNA, 19 nt, Human
ugcagaaagaauggguuac

SEQ ID NO: 1085933 - RNA, 20 nt, Human
ugcagcccuccuggacggga

SEQ ID NO: 1085934 - RNA, 22 nt, Human
uggaagauggcuacccaccauc

SEQ ID NO: 1085935 - RNA, 19 nt, Human
ugggauucugcugauuuag

SEQ ID NO: 1085936 - RNA, 18 nt, Human
ugucugcgccgacugcag

SEQ ID NO: 1085937 - RNA, 24 nt, Human
uuaccggucuuuacugcacucacu

SEQ ID NO: 1085938 - RNA, 20 nt, Human
uucaguguccugcggccucg

SEQ ID NO: 1085939 - RNA, 24 nt, Human
uuccacagcugugucuccgucgcu

SEQ ID NO: 1085940 - RNA, 20 nt, Human
uuggcccaaauauguuacgc

SEQ ID NO: 1085941 - RNA, 21 nt, Human
uuguaccguccgcccuccgua

SEQ ID NO: 1085942 - RNA, 21 nt, Human
uuugaggacaugcagaaagaa

SEQ ID NO: 1085943 - RNA, 22 nt, Human
uuuguuacuuuggaagugucuu

SEQ ID NO: 1085944 - RNA, 20 nt, Human
aaaaagaaacagcccugcaa

SEQ ID NO: 1085945 - RNA, 20 nt, Human
aaaagaaacagcccugcaag

SEQ ID NO: 1085946 - RNA, 22 nt, Human
aaacaccaucaacggcuuaaaa

SEQ ID NO: 1085947 - RNA, 24 nt, Human
aaacagcccugcaagcgccuugau

SEQ ID NO: 1085948 - RNA, 19 nt, Human
aaagaaacagcccugcaag

SEQ ID NO: 1085949 - RNA, 20 nt, Human
aaagccaagacaaacugaug

SEQ ID NO: 1085950 - RNA, 27 nt, Human
aaauggucaggaagaaagucugcaaaa

SEQ ID NO: 1085951 - RNA, 19 nt, Human
aaccucugucauuguuccc

SEQ ID NO: 1085952 - RNA, 23 nt, Human
aagcaggaagagaacuauacagg

SEQ ID NO: 1085953 - RNA, 24 nt, Human
aagcaggaagagaacuauacaggc

SEQ ID NO: 1085954 - RNA, 21 nt, Human
aagcaucccuauuauuaaggg

SEQ ID NO: 1085955 - RNA, 22 nt, Human
acagacaaaaguauagcaugug

SEQ ID NO: 1085956 - RNA, 18 nt, Human
accucagauuuccaaucu

SEQ ID NO: 1085957 - RNA, 24 nt, Human
acuaacuaggguuuguaucuugcc

SEQ ID NO: 1085958 - RNA, 19 nt, Human
acuauuaaaccaacagaau

SEQ ID NO: 1085959 - RNA, 23 nt, Human
acucagugcucacaaacugcaaa

SEQ ID NO: 1085960 - RNA, 19 nt, Human
agaaaaauuuguguuauuu

SEQ ID NO: 1085961 - RNA, 20 nt, Human
agaaaugcugaaaauugggg

SEQ ID NO: 1085962 - RNA, 21 nt, Human
agaagauuaaagccugaaaca

SEQ ID NO: 1085963 - RNA, 21 nt, Human
agagaugaaccaugugcuugg

SEQ ID NO: 1085964 - RNA, 23 nt, Human
agauggaaggagggguucccagc

SEQ ID NO: 1085965 - RNA, 26 nt, Human
aggaaaaauaauacaguaucugguaa

SEQ ID NO: 1085966 - RNA, 27 nt, Human
aggaaaaauaauacaguaucugguaaa

SEQ ID NO: 1085967 - RNA, 18 nt, Human
aggaacuucaguugggga

SEQ ID NO: 1085968 - RNA, 18 nt, Human
agugcucacaaacugcaa

SEQ ID NO: 1085969 - RNA, 26 nt, Human
auagauuuuucccuaaagccucaaaa

SEQ ID NO: 1085970 - RNA, 22 nt, Human
aucuugccuaaaccacucacua

SEQ ID NO: 1085971 - RNA, 18 nt, Human
augaaccaugugcuuggc

SEQ ID NO: 1085972 - RNA, 23 nt, Human
caaacauuucaauuuaacaacuc

SEQ ID NO: 1085973 - RNA, 23 nt, Human
caaagcauagcccacuuaaagaa

SEQ ID NO: 1085974 - RNA, 20 nt, Human
caacaaauggcaucauauua

SEQ ID NO: 1085975 - RNA, 21 nt, Human
caacauaaccacugaagagaa

SEQ ID NO: 1085976 - RNA, 19 nt, Human
caacucuaaauuccaaucu

SEQ ID NO: 1085977 - RNA, 21 nt, Human
caacucuuccccagcaacaua

SEQ ID NO: 1085978 - RNA, 21 nt, Human
cacaugugcagucuuagugac

SEQ ID NO: 1085979 - RNA, 22 nt, Human
cacuauagcuacugcugaagug

SEQ ID NO: 1085980 - RNA, 24 nt, Human
cagaaguccuuaacaaagccaaga

SEQ ID NO: 1085981 - RNA, 23 nt, Human
cagcuuuaucgauuuaguugaag

SEQ ID NO: 1085982 - RNA, 22 nt, Human
caugcccaaaucccuggaaccc

SEQ ID NO: 1085983 - RNA, 19 nt, Human
caugugcagucuuagugac

SEQ ID NO: 1085984 - RNA, 19 nt, Human
ccagcaacauaaccacuga

SEQ ID NO: 1085985 - RNA, 23 nt, Human
ccauuaaaguuugaaaacugagc

SEQ ID NO: 1085986 - RNA, 21 nt, Human
cccaacucuuccccagcaaca

SEQ ID NO: 1085987 - RNA, 18 nt, Human
cccccaacucuuccccag

SEQ ID NO: 1085988 - RNA, 22 nt, Human
ccuacagaaguccaugcccaaa

SEQ ID NO: 1085989 - RNA, 24 nt, Human
cggauaauacuugcuuuacagaau

SEQ ID NO: 1085990 - RNA, 22 nt, Human
cuaaucaaaauauaaaacccca

SEQ ID NO: 1085991 - RNA, 20 nt, Human
cuccagaaccugcuacucag

SEQ ID NO: 1085992 - RNA, 20 nt, Human
cugcauaagaacuugaacaa

SEQ ID NO: 1085993 - RNA, 18 nt, Human
cuugccuaaaccacucac

SEQ ID NO: 1085994 - RNA, 23 nt, Human
gaagauggaaggagggguuccca

SEQ ID NO: 1085995 - RNA, 19 nt, Human
gacaaaaguauagcaugug

SEQ ID NO: 1085996 - RNA, 23 nt, Human
gagaagauuaaagccugaaacau

SEQ ID NO: 1085997 - RNA, 18 nt, Human
gagcacaucuaucaaagc

SEQ ID NO: 1085998 - RNA, 18 nt, Human
gagcacauuucuggcaga

SEQ ID NO: 1085999 - RNA, 25 nt, Human
gauaacggaaggagcuucagagaga

SEQ ID NO: 1086000 - RNA, 20 nt, Human
gcaacauaaccacugaagag

SEQ ID NO: 1086001 - RNA, 21 nt, Human
gcugaagugaaaccacaucug

SEQ ID NO: 1086002 - RNA, 18 nt, Human
gggagaaguuguaaaaug

SEQ ID NO: 1086003 - RNA, 23 nt, Human
guagaugcucaacaaauggcauc

SEQ ID NO: 1086004 - RNA, 28 nt, Human
gugaaacagaaauguauauaagugaacc

SEQ ID NO: 1086005 - RNA, 25 nt, Human
uaaacaccaucaacggcuuaaaaag

SEQ ID NO: 1086006 - RNA, 21 nt, Human
uaaaccacucacuagcuguga

SEQ ID NO: 1086007 - RNA, 22 nt, Human
uaaagagcacaucuaucaaagc

SEQ ID NO: 1086008 - RNA, 18 nt, Human
uaaagccucaaaaagaaa

SEQ ID NO: 1086009 - RNA, 19 nt, Human
uaacaaagccaagacaaac

SEQ ID NO: 1086010 - RNA, 23 nt, Human
uaacacagaacucuacgguuaca

SEQ ID NO: 1086011 - RNA, 21 nt, Human
uaagaaucuaauuucuuuggu

SEQ ID NO: 1086012 - RNA, 23 nt, Human
uaauacuugcuuuacagaaugua

SEQ ID NO: 1086013 - RNA, 24 nt, Human
uaauguguuacagcagcaauagga

SEQ ID NO: 1086014 - RNA, 21 nt, Human
uaccaaacauagcaaaaggaa

SEQ ID NO: 1086015 - RNA, 18 nt, Human
uaccauaauacucugcaa

SEQ ID NO: 1086016 - RNA, 22 nt, Human
uaugaagcacauauucagaaac

SEQ ID NO: 1086017 - RNA, 19 nt, Human
uaugguagucuccagaacc

SEQ ID NO: 1086018 - RNA, 18 nt, Human
uauguuaccaaacauagc

SEQ ID NO: 1086019 - RNA, 21 nt, Human
ucaaaaagaaacagcccugca

SEQ ID NO: 1086020 - RNA, 18 nt, Human
ucagagacccauguggca

SEQ ID NO: 1086021 - RNA, 19 nt, Human
ucagagguaccauaauacu

SEQ ID NO: 1086022 - RNA, 23 nt, Human
ucauuuggcaaaaacaucaugug

SEQ ID NO: 1086023 - RNA, 21 nt, Human
uccaaucucacaccuuuaaag

SEQ ID NO: 1086024 - RNA, 22 nt, Human
uccaugcccaaaucccuggaac

SEQ ID NO: 1086025 - RNA, 21 nt, Human
ucccaauguuggcauugcucg

SEQ ID NO: 1086026 - RNA, 22 nt, Human
uccccaaggggcacaugaccuu

SEQ ID NO: 1086027 - RNA, 23 nt, Human
ucccccaacucuuccccagcaac

SEQ ID NO: 1086028 - RNA, 18 nt, Human
ucccuaaaaugcggauaa

SEQ ID NO: 1086029 - RNA, 18 nt, Human
uccgaagagacauguuug

SEQ ID NO: 1086030 - RNA, 18 nt, Human
ucuccagaaccugcuacu

SEQ ID NO: 1086031 - RNA, 19 nt, Human
ucugcaaaacacaugugca

SEQ ID NO: 1086032 - RNA, 21 nt, Human
ucugcaacauaaaagcuugcu

SEQ ID NO: 1086033 - RNA, 21 nt, Human
ugaaacagaaauguauauaag

SEQ ID NO: 1086034 - RNA, 18 nt, Human
ugaaacauacacauugca

SEQ ID NO: 1086035 - RNA, 22 nt, Human
ugaagugaaaccacaucugggu

SEQ ID NO: 1086036 - RNA, 24 nt, Human
ugaauuguuuucaaaggugucugc

SEQ ID NO: 1086037 - RNA, 22 nt, Human
ugacaugauuuguuugccucuu

SEQ ID NO: 1086038 - RNA, 21 nt, Human
ugaccucagauuuccaaucuc

SEQ ID NO: 1086039 - RNA, 19 nt, Human
ugagaagauuaaagccuga

SEQ ID NO: 1086040 - RNA, 24 nt, Human
ugagcauaaaucaacuuaacacag

SEQ ID NO: 1086041 - RNA, 24 nt, Human
ugaggaacuucaguuggggagauu

SEQ ID NO: 1086042 - RNA, 24 nt, Human
ugaguuccuguguuuugaggucuu

SEQ ID NO: 1086043 - RNA, 19 nt, Human
ugauaacggaaggagcuuc

SEQ ID NO: 1086044 - RNA, 21 nt, Human
ugaucuuauguccugagcaua

SEQ ID NO: 1086045 - RNA, 23 nt, Human
ugcaagcgccuugauuuuguccc

SEQ ID NO: 1086046 - RNA, 18 nt, Human
ugcccaaaucccuggaac

SEQ ID NO: 1086047 - RNA, 24 nt, Human
uggaaaguaucacaucauuuggca

SEQ ID NO: 1086048 - RNA, 25 nt, Human
uggaaaguaucacaucauuuggcaa

SEQ ID NO: 1086049 - RNA, 18 nt, Human
uggaaggagggguuccca

SEQ ID NO: 1086050 - RNA, 21 nt, Human
uggaaggagggguucccagcc

SEQ ID NO: 1086051 - RNA, 23 nt, Human
uggcaagagaucaggaagcuguu

SEQ ID NO: 1086052 - RNA, 24 nt, Human
ugggguuggacaaagagaaaugau

SEQ ID NO: 1086053 - RNA, 23 nt, Human
ugugaucuuauguccugagcaua

SEQ ID NO: 1086054 - RNA, 23 nt, Human
uguuaccaaacauagcaaaagga

SEQ ID NO: 1086055 - RNA, 21 nt, Human
uguuauuuuaagccaccaccu

SEQ ID NO: 1086056 - RNA, 21 nt, Human
uuaacaaagccaagacaaacu

SEQ ID NO: 1086057 - RNA, 25 nt, Human
uuaaucuuaaacaccaucaacggcu

SEQ ID NO: 1086058 - RNA, 23 nt, Human
uuaggacacuugcugauaaacau

SEQ ID NO: 1086059 - RNA, 21 nt, Human
uuccacagaaagaauguaccu

SEQ ID NO: 1086060 - RNA, 23 nt, Human
uuccccagcaacauaaccacuga

SEQ ID NO: 1086061 - RNA, 18 nt, Human
uuugaaaacugagcuccu

SEQ ID NO: 1086062 - RNA, 23 nt, Human
uuuggaaaguaucacaucauuug

SEQ ID NO: 1086063 - RNA, 22 nt, Human
aaacagaagaugaauagcuggg

SEQ ID NO: 1086064 - RNA, 23 nt, Human
aaccgcacccaauuaaagcagca

SEQ ID NO: 1086065 - RNA, 29 nt, Human
aagcagcaaacagaagaugaagggacccc

SEQ ID NO: 1086066 - RNA, 18 nt, Human
aauugauucaaaacuuuu

SEQ ID NO: 1086067 - RNA, 19 nt, Human
cacccaauuaaagcagcaa

SEQ ID NO: 1086068 - RNA, 19 nt, Human
cagcaaacagaagaugaau

SEQ ID NO: 1086069 - RNA, 22 nt, Human
cagcagauggcaagaaagccgg

SEQ ID NO: 1086070 - RNA, 21 nt, Human
uagcuggguggaucaguaugu

SEQ ID NO: 1086071 - RNA, 20 nt, Human
uagguauucuacccuuagau

SEQ ID NO: 1086072 - RNA, 22 nt, Human
ugaauagcuggguggaucagua

SEQ ID NO: 1086073 - RNA, 21 nt, Human
aaaacaugacuuuuggcauca

SEQ ID NO: 1086074 - RNA, 20 nt, Human
aaagaaacaaaauaaacaug

SEQ ID NO: 1086075 - RNA, 19 nt, Human
acaaaguacuguuuuacag

SEQ ID NO: 1086076 - RNA, 23 nt, Human
agagaacaaaguuuugucaauau

SEQ ID NO: 1086077 - RNA, 18 nt, Human
agugauauuucagaaagg

SEQ ID NO: 1086078 - RNA, 24 nt, Human
aucauaacaggcucuuguuucugc

SEQ ID NO: 1086079 - RNA, 18 nt, Human
augaaauaugguaaagcc

SEQ ID NO: 1086080 - RNA, 19 nt, Human
cacaugcaugcaguaguca

SEQ ID NO: 1086081 - RNA, 21 nt, Human
cagaaauaagaacucagccaa

SEQ ID NO: 1086082 - RNA, 23 nt, Human
cagaaugguucugacagucauga

SEQ ID NO: 1086083 - RNA, 18 nt, Human
cagguuuuuuacauaccu

SEQ ID NO: 1086084 - RNA, 18 nt, Human
cauaacaauacagaaaau

SEQ ID NO: 1086085 - RNA, 20 nt, Human
caugaacagauaucugaccc

SEQ ID NO: 1086086 - RNA, 20 nt, Human
caugauacuaagcacuucuu

SEQ ID NO: 1086087 - RNA, 26 nt, Human
ccuccagagauuauuucagaaauaag

SEQ ID NO: 1086088 - RNA, 19 nt, Human
cugcauucaauacuaauca

SEQ ID NO: 1086089 - RNA, 24 nt, Human
gaaugaaauaugguaaagccaaga

SEQ ID NO: 1086090 - RNA, 21 nt, Human
gcuuuaacagcauuucuucac

SEQ ID NO: 1086091 - RNA, 23 nt, Human
gugaaauggguaaagaaacaaaa

SEQ ID NO: 1086092 - RNA, 23 nt, Human
uaaaauuacaaaugcuuucuaga

SEQ ID NO: 1086093 - RNA, 20 nt, Human
uacuaagcacuucuguacuu

SEQ ID NO: 1086094 - RNA, 23 nt, Human
uauaaaauuacaaaugcuuucua

SEQ ID NO: 1086095 - RNA, 20 nt, Human
uauuuuggcauagacucuaa

SEQ ID NO: 1086096 - RNA, 20 nt, Human
ucauaacugucagagggaag

SEQ ID NO: 1086097 - RNA, 19 nt, Human
uccacuaacaguuaugacc

SEQ ID NO: 1086098 - RNA, 20 nt, Human
uccacuaacaguuaugacca

SEQ ID NO: 1086099 - RNA, 18 nt, Human
ucuaaaccauuaaugacu

SEQ ID NO: 1086100 - RNA, 22 nt, Human
ucuaugggcaauauaaucucaa

SEQ ID NO: 1086101 - RNA, 24 nt, Human
ucuuccgacuuaauuuuacuauuu

SEQ ID NO: 1086102 - RNA, 18 nt, Human
ugaguacuggcaaacauu

SEQ ID NO: 1086103 - RNA, 22 nt, Human
ugaugugaucuuggcaguuuua

SEQ ID NO: 1086104 - RNA, 21 nt, Human
uggcauagacucuaaaaaguc

SEQ ID NO: 1086105 - RNA, 25 nt, Human
uguuuuacagccauauauuuuggca

SEQ ID NO: 1086106 - RNA, 20 nt, Human
uuaaagaaugaaauauggua

SEQ ID NO: 1086107 - RNA, 19 nt, Human
uuaaugaaugugaaauggg

SEQ ID NO: 1086108 - RNA, 21 nt, Human
uuacauuguucuccuacugca

SEQ ID NO: 1086109 - RNA, 21 nt, Human
uuagaggagucauuaacaaag

SEQ ID NO: 1086110 - RNA, 21 nt, Human
uucagaaauaagaacucagcc

SEQ ID NO: 1086111 - RNA, 21 nt, Human
uucauggaacacugauuuccc

SEQ ID NO: 1086112 - RNA, 23 nt, Human
uugauauuucacuuuacaucaua

SEQ ID NO: 1086113 - RNA, 21 nt, Human
uuuccaucccauuucuaaacc

SEQ ID NO: 1086114 - RNA, 18 nt, Human
acccagcuccccacacaa

SEQ ID NO: 1086115 - RNA, 19 nt, Human
agaaauuggaaaagaacau

SEQ ID NO: 1086116 - RNA, 19 nt, Human
agaacacacacccagcucc

SEQ ID NO: 1086117 - RNA, 22 nt, Human
agccauggaggcuggggggcuu

SEQ ID NO: 1086118 - RNA, 18 nt, Human
auggaggcuggggggcuu

SEQ ID NO: 1086119 - RNA, 21 nt, Human
cagaacacacacccagcuccc

SEQ ID NO: 1086120 - RNA, 22 nt, Human
cagaacacacacccagcucccc

SEQ ID NO: 1086121 - RNA, 21 nt, Human
caggaccccagacucucccga

SEQ ID NO: 1086122 - RNA, 19 nt, Human
cccacacaaucuagagggu

SEQ ID NO: 1086123 - RNA, 21 nt, Human
cccagaauuugccuccauuuc

SEQ ID NO: 1086124 - RNA, 26 nt, Human
cucaggaccccagacucucccgauuc

SEQ ID NO: 1086125 - RNA, 20 nt, Human
cugcaccugcagucaggagu

SEQ ID NO: 1086126 - RNA, 21 nt, Human
cuggccagaacacacacccag

SEQ ID NO: 1086127 - RNA, 21 nt, Human
gccucgucuuaguucugacuc

SEQ ID NO: 1086128 - RNA, 24 nt, Human
ggggggcuuuggggccgugggggc

SEQ ID NO: 1086129 - RNA, 19 nt, Human
uacccagaauuugccucca

SEQ ID NO: 1086130 - RNA, 21 nt, Human
uccaguaggaugcucugcacc

SEQ ID NO: 1086131 - RNA, 18 nt, Human
ugcucugcaccugcaguc

SEQ ID NO: 1086132 - RNA, 21 nt, Human
uggaaaagaacaucuccaggu

SEQ ID NO: 1086133 - RNA, 21 nt, Human
uggaggcuggggggcuuuggg

SEQ ID NO: 1086134 - RNA, 22 nt, Human
ugggggccagcccugguaccug

SEQ ID NO: 1086135 - RNA, 22 nt, Human
uggggggcuuuggggccguggg

SEQ ID NO: 1086136 - RNA, 20 nt, Human
uuucaggucucugccucuca

SEQ ID NO: 1086137 - RNA, 21 nt, Human
accauccaccucagcaucuga

SEQ ID NO: 1086138 - RNA, 23 nt, Human
agcaucugagucagguuccuccu

SEQ ID NO: 1086139 - RNA, 21 nt, Human
agcuaccaaauccaugagcag

SEQ ID NO: 1086140 - RNA, 23 nt, Human
agcuaccuuuuuuuuuuuuuuuu

SEQ ID NO: 1086141 - RNA, 22 nt, Human
aggcgagcggagcccccggagc

SEQ ID NO: 1086142 - RNA, 24 nt, Human
aucacagcuaucuacgcuacagca

SEQ ID NO: 1086143 - RNA, 27 nt, Human
aucagcuaccuuuuuuuuuuuuuuuuu

SEQ ID NO: 1086144 - RNA, 24 nt, Human
caagagggacuacauggaggaaga

SEQ ID NO: 1086145 - RNA, 18 nt, Human
cagaaaguaaaaaugcug

SEQ ID NO: 1086146 - RNA, 18 nt, Human
cagcuaccuuuuuuuuuu

SEQ ID NO: 1086147 - RNA, 23 nt, Human
ccgcagcgggggcggauggggga

SEQ ID NO: 1086148 - RNA, 21 nt, Human
ccuccugguccucuuggucau

SEQ ID NO: 1086149 - RNA, 21 nt, Human
ccuggccugcacagcgagggc

SEQ ID NO: 1086150 - RNA, 24 nt, Human
ccugggguuuguaucagcuaccuu

SEQ ID NO: 1086151 - RNA, 19 nt, Human
cggcgugggggcaggcgag

SEQ ID NO: 1086152 - RNA, 21 nt, Human
cuccuacucuucauccacacc

SEQ ID NO: 1086153 - RNA, 20 nt, Human
cuucgucuucuucuucgccc

SEQ ID NO: 1086154 - RNA, 21 nt, Human
cuucgucuucuucuucgcccu

SEQ ID NO: 1086155 - RNA, 23 nt, Human
cuuuuuuuuuuuuuuuuuaacag

SEQ ID NO: 1086156 - RNA, 18 nt, Human
gaugggggagaggcaucc

SEQ ID NO: 1086157 - RNA, 19 nt, Human
gcgggcggcgugggggcag

SEQ ID NO: 1086158 - RNA, 19 nt, Human
ggcaggagcuugaagacac

SEQ ID NO: 1086159 - RNA, 20 nt, Human
ggccggcggcgcgguccugg

SEQ ID NO: 1086160 - RNA, 22 nt, Human
ggcggaugggggagaggcaucc

SEQ ID NO: 1086161 - RNA, 18 nt, Human
ggcggcgugggggcaggc

SEQ ID NO: 1086162 - RNA, 21 nt, Human
gggggcaggcgagcggagccc

SEQ ID NO: 1086163 - RNA, 24 nt, Human
ggguggcgggcggcgugggggcag

SEQ ID NO: 1086164 - RNA, 18 nt, Human
ggguggguguccuggggu

SEQ ID NO: 1086165 - RNA, 20 nt, Human
guaaaaaugcuguuacaguu

SEQ ID NO: 1086166 - RNA, 25 nt, Human
guuacagucccaguguaacugguag

SEQ ID NO: 1086167 - RNA, 25 nt, Human
uaaaaaugcuguuacagucccagug

SEQ ID NO: 1086168 - RNA, 22 nt, Human
uacagaaaguaaaaaugcuguu

SEQ ID NO: 1086169 - RNA, 19 nt, Human
uagguaagcuggggcagga

SEQ ID NO: 1086170 - RNA, 25 nt, Human
ucacacaaaaaccuaacaacgucac

SEQ ID NO: 1086171 - RNA, 21 nt, Human
ucaucuggggucuuaaucauc

SEQ ID NO: 1086172 - RNA, 19 nt, Human
ucaucuggggucuuaaucu

SEQ ID NO: 1086173 - RNA, 18 nt, Human
uccaugagcaguccaacc

SEQ ID NO: 1086174 - RNA, 20 nt, Human
uccauguagguaagcugggg

SEQ ID NO: 1086175 - RNA, 24 nt, Human
uccucgucuucuucgucuucuucu

SEQ ID NO: 1086176 - RNA, 20 nt, Human
ucugcaggucaucugggguc

SEQ ID NO: 1086177 - RNA, 22 nt, Human
ucuucauccacaccauccaccu

SEQ ID NO: 1086178 - RNA, 20 nt, Human
ucuucgcccuccuacucuuc

SEQ ID NO: 1086179 - RNA, 21 nt, Human
ucuucgcccuccuacucuuca

SEQ ID NO: 1086180 - RNA, 19 nt, Human
ucuuuggcucuuugggugg

SEQ ID NO: 1086181 - RNA, 23 nt, Human
ucuuuggcucuuugggugggugg

SEQ ID NO: 1086182 - RNA, 24 nt, Human
ucuuuggguggguggguguccugg

SEQ ID NO: 1086183 - RNA, 22 nt, Human
uggcgggcggcgugggggcagg

SEQ ID NO: 1086184 - RNA, 24 nt, Human
uggggcaggagcuugaagacacuc

SEQ ID NO: 1086185 - RNA, 23 nt, Human
ugggggcaggcgagcggagcccc

SEQ ID NO: 1086186 - RNA, 23 nt, Human
uggguggguggguguccuggggu

SEQ ID NO: 1086187 - RNA, 24 nt, Human
uggguggguggguguccugggguu

SEQ ID NO: 1086188 - RNA, 19 nt, Human
uggguggguguccuggggu

SEQ ID NO: 1086189 - RNA, 19 nt, Human
ugguugacucaccaaucac

SEQ ID NO: 1086190 - RNA, 18 nt, Human
ugucacaggaacuauucu

SEQ ID NO: 1086191 - RNA, 21 nt, Human
uucauccacaccauccaccuc

SEQ ID NO: 1086192 - RNA, 24 nt, Human
uuccccucuuccccccucuucaaa

SEQ ID NO: 1086193 - RNA, 27 nt, Human
uuuguaucagcuaccuuuuuuuuuuuu

SEQ ID NO: 1086194 - RNA, 22 nt, Human
aaaaacauccacccaugucucc

SEQ ID NO: 1086195 - RNA, 20 nt, Human
aaaacauccacccaugucuc

SEQ ID NO: 1086196 - RNA, 22 nt, Human
aaagagaaaggaauuuguccag

SEQ ID NO: 1086197 - RNA, 20 nt, Human
aagagaaaggaauuugucca

SEQ ID NO: 1086198 - RNA, 21 nt, Human
aagcagccagaggaagucccc

SEQ ID NO: 1086199 - RNA, 28 nt, Human
aagugggaggcaggguggaaggucgacc

SEQ ID NO: 1086200 - RNA, 21 nt, Human
agacuaagggggagggggagg

SEQ ID NO: 1086201 - RNA, 19 nt, Human
agagagacuaagggggagg

SEQ ID NO: 1086202 - RNA, 20 nt, Human
aggcaggguggagaggacca

SEQ ID NO: 1086203 - RNA, 23 nt, Human
aggcaggguggagaggaccaggg

SEQ ID NO: 1086204 - RNA, 25 nt, Human
aggcaggguggagaggaccagggcu

SEQ ID NO: 1086205 - RNA, 27 nt, Human
aggggacaagggggaaucagggagcag

SEQ ID NO: 1086206 - RNA, 18 nt, Human
agggggagggggaggagg

SEQ ID NO: 1086207 - RNA, 21 nt, Human
caaaaacauccacccaugucu

SEQ ID NO: 1086208 - RNA, 18 nt, Human
caggaaagcagccagagg

SEQ ID NO: 1086209 - RNA, 24 nt, Human
ccagcuugugcugcugcggggugg

SEQ ID NO: 1086210 - RNA, 20 nt, Human
cccccucgcccacugguucu

SEQ ID NO: 1086211 - RNA, 19 nt, Human
ccuaagccacacugcagcu

SEQ ID NO: 1086212 - RNA, 20 nt, Human
ccucuuaagugggaggcagg

SEQ ID NO: 1086213 - RNA, 18 nt, Human
ccugaggggacaaggggg

SEQ ID NO: 1086214 - RNA, 25 nt, Human
cugaacuaaagagaaaggaauuugu

SEQ ID NO: 1086215 - RNA, 21 nt, Human
cugcgggguggggaggacucc

SEQ ID NO: 1086216 - RNA, 22 nt, Human
gaaucagggagcagagagacua

SEQ ID NO: 1086217 - RNA, 20 nt, Human
gaggggacaagggggaauca

SEQ ID NO: 1086218 - RNA, 22 nt, Human
gaguuucuuucaaaaacaucca

SEQ ID NO: 1086219 - RNA, 27 nt, Human
gccacacugcagcugcaggacaucggg

SEQ ID NO: 1086220 - RNA, 21 nt, Human
gccacacugcagcugcaggga

SEQ ID NO: 1086221 - RNA, 19 nt, Human
gcugcgggguggggaggac

SEQ ID NO: 1086222 - RNA, 21 nt, Human
gcugcgggguggggaggacuc

SEQ ID NO: 1086223 - RNA, 21 nt, Human
ggacuccugaggggacaaggg

SEQ ID NO: 1086224 - RNA, 22 nt, Human
gguggagaggaccagggcuuug

SEQ ID NO: 1086225 - RNA, 22 nt, Human
gguuggcucgccuagcagcagg

SEQ ID NO: 1086226 - RNA, 24 nt, Human
ucuuaagugggaggcaggguggag

SEQ ID NO: 1086227 - RNA, 20 nt, Human
ucuuucaaaaacauccaccc

SEQ ID NO: 1086228 - RNA, 24 nt, Human
ugggguguguugcccagcaaccag

SEQ ID NO: 1086229 - RNA, 18 nt, Human
uucucuguaagucgcccc

SEQ ID NO: 1086230 - RNA, 20 nt, Human
uugcccagcaaccaguagag

SEQ ID NO: 1086231 - RNA, 19 nt, Human
uuggcucgccuagcagcag

SEQ ID NO: 1086232 - RNA, 18 nt, Human
aaaaaccacacacuggcc

SEQ ID NO: 1086233 - RNA, 21 nt, Human
aaaaaccacacacuggccccc

SEQ ID NO: 1086234 - RNA, 27 nt, Human
aaacaaacaaaauuaaucaucccccag

SEQ ID NO: 1086235 - RNA, 21 nt, Human
aaagaaacaggcaaauauugg

SEQ ID NO: 1086236 - RNA, 21 nt, Human
aaagaauaaagucacagagag

SEQ ID NO: 1086237 - RNA, 22 nt, Human
aacaacaaaaacaaacaaacaa

SEQ ID NO: 1086238 - RNA, 24 nt, Human
aacaugccauugcacuccagccug

SEQ ID NO: 1086239 - RNA, 21 nt, Human
aaccacacacuggcccccaag

SEQ ID NO: 1086240 - RNA, 18 nt, Human
aagcaggaggaucgcuug

SEQ ID NO: 1086241 - RNA, 24 nt, Human
aagcaggaggaucgcuugagccca

SEQ ID NO: 1086242 - RNA, 22 nt, Human
aagugagagaaucgcuugaacc

SEQ ID NO: 1086243 - RNA, 24 nt, Human
aagugagagaaucgcuugaaccug

SEQ ID NO: 1086244 - RNA, 18 nt, Human
aaucgcuugaaccuggga

SEQ ID NO: 1086245 - RNA, 18 nt, Human
aauuagccaggcauggug

SEQ ID NO: 1086246 - RNA, 18 nt, Human
acaaggcuuuucuccagc

SEQ ID NO: 1086247 - RNA, 18 nt, Human
acagagcgagacccuguc

SEQ ID NO: 1086248 - RNA, 19 nt, Human
acagagcgagacccugucu

SEQ ID NO: 1086249 - RNA, 24 nt, Human
acagagcgagacccugucuuaaaa

SEQ ID NO: 1086250 - RNA, 21 nt, Human
agaaacaggcaaauauuggcu

SEQ ID NO: 1086251 - RNA, 21 nt, Human
agaagaaaaacucgauccaau

SEQ ID NO: 1086252 - RNA, 19 nt, Human
agacaaaagugagagaauc

SEQ ID NO: 1086253 - RNA, 18 nt, Human
agacaggagacagggcag

SEQ ID NO: 1086254 - RNA, 19 nt, Human
agacaggagacagggcaga

SEQ ID NO: 1086255 - RNA, 24 nt, Human
agacaggagacagggcagacagaa

SEQ ID NO: 1086256 - RNA, 23 nt, Human
agccaggcaugguggugcaugcc

SEQ ID NO: 1086257 - RNA, 18 nt, Human
agcucuaccagggaacaa

SEQ ID NO: 1086258 - RNA, 19 nt, Human
aggaagacaggagacaggg

SEQ ID NO: 1086259 - RNA, 24 nt, Human
aggaguucaagaccagcgugggcc

SEQ ID NO: 1086260 - RNA, 24 nt, Human
aggaucgcuugagcccaggaguuc

SEQ ID NO: 1086261 - RNA, 24 nt, Human
aggccaaagcaggaggaucgcuug

SEQ ID NO: 1086262 - RNA, 19 nt, Human
agggaacaacaaaaacaaa

SEQ ID NO: 1086263 - RNA, 26 nt, Human
agggaacaacaaaaacaaacaaacaa

SEQ ID NO: 1086264 - RNA, 24 nt, Human
aggugcaguggcucacgccuauaa

SEQ ID NO: 1086265 - RNA, 19 nt, Human
aguggcucacgccuauaau

SEQ ID NO: 1086266 - RNA, 23 nt, Human
aguggcucacgccuauaauccca

SEQ ID NO: 1086267 - RNA, 24 nt, Human
aucgcuugagcccaggaguucaag

SEQ ID NO: 1086268 - RNA, 23 nt, Human
auggacacacaauccaaagaaac

SEQ ID NO: 1086269 - RNA, 21 nt, Human
augugucugggugggguucug

SEQ ID NO: 1086270 - RNA, 21 nt, Human
auugcacuccagccuggguga

SEQ ID NO: 1086271 - RNA, 24 nt, Human
auugcacuccagccugggugacag

SEQ ID NO: 1086272 - RNA, 28 nt, Human
caaacaaacaaaauuaaucaucccccag

SEQ ID NO: 1086273 - RNA, 18 nt, Human
caaagaggguggacccca

SEQ ID NO: 1086274 - RNA, 22 nt, Human
caacaaaaacaaacaaacaaaa

SEQ ID NO: 1086275 - RNA, 21 nt, Human
cacacaauccaaagaaacagg

SEQ ID NO: 1086276 - RNA, 24 nt, Human
cacgccuauaaucccaacaauuug

SEQ ID NO: 1086277 - RNA, 22 nt, Human
cacuccagccugggugacagag

SEQ ID NO: 1086278 - RNA, 24 nt, Human
cacuccagccugggugacagagcg

SEQ ID NO: 1086279 - RNA, 21 nt, Human
cacuggcccccaaggucacac

SEQ ID NO: 1086280 - RNA, 20 nt, Human
cagaaccugcaccauccuuu

SEQ ID NO: 1086281 - RNA, 22 nt, Human
cagccagaugccagaauguucc

SEQ ID NO: 1086282 - RNA, 19 nt, Human
cauugcacuccagccuggg

SEQ ID NO: 1086283 - RNA, 21 nt, Human
cauugcacuccagccugggug

SEQ ID NO: 1086284 - RNA, 22 nt, Human
cauugcacuccagccuggguga

SEQ ID NO: 1086285 - RNA, 24 nt, Human
cauugcacuccagccugggugaca

SEQ ID NO: 1086286 - RNA, 25 nt, Human
cauugcacuccagccugggugacag

SEQ ID NO: 1086287 - RNA, 21 nt, Human
ccaugucugugacagcucaca

SEQ ID NO: 1086288 - RNA, 20 nt, Human
ccauugcacuccagccuggg

SEQ ID NO: 1086289 - RNA, 21 nt, Human
ccauugcacuccagccugggu

SEQ ID NO: 1086290 - RNA, 21 nt, Human
ccauugcacuccagccugggu

SEQ ID NO: 1086291 - RNA, 22 nt, Human
ccauugcacuccagccugggug

SEQ ID NO: 1086292 - RNA, 23 nt, Human
ccauugcacuccagccuggguga

SEQ ID NO: 1086293 - RNA, 24 nt, Human
ccauugcacuccagccugggugac

SEQ ID NO: 1086294 - RNA, 22 nt, Human
ccccacaauuucugcagaagaa

SEQ ID NO: 1086295 - RNA, 18 nt, Human
cccccagcuccacuuaac

SEQ ID NO: 1086296 - RNA, 18 nt, Human
cccuccagggacucacug

SEQ ID NO: 1086297 - RNA, 19 nt, Human
ccuauaaucccaacaauuu

SEQ ID NO: 1086298 - RNA, 21 nt, Human
ccucucauccuuuuccuggga

SEQ ID NO: 1086299 - RNA, 20 nt, Human
ccugggugacagagcgagac

SEQ ID NO: 1086300 - RNA, 21 nt, Human
ccuguaguuccagcuacuugg

SEQ ID NO: 1086301 - RNA, 24 nt, Human
ccuuaggucacgcagcugcaugcc

SEQ ID NO: 1086302 - RNA, 22 nt, Human
ccuuuagcuucugggggaccag

SEQ ID NO: 1086303 - RNA, 24 nt, Human
cgagacccugucuuaaaaaacuaa

SEQ ID NO: 1086304 - RNA, 24 nt, Human
cgccuauaaucccaacaauuuggg

SEQ ID NO: 1086305 - RNA, 20 nt, Human
cuaccagggguucaugaaag

SEQ ID NO: 1086306 - RNA, 21 nt, Human
cucacgccuauaaucccaaca

SEQ ID NO: 1086307 - RNA, 21 nt, Human
cucacgccuauaaucccaaca

SEQ ID NO: 1086308 - RNA, 22 nt, Human
cucguauucaugcguucauuuc

SEQ ID NO: 1086309 - RNA, 23 nt, Human
cucuccgaguccagcugugcaca

SEQ ID NO: 1086310 - RNA, 22 nt, Human
cugccuuuaacaccgaggccga

SEQ ID NO: 1086311 - RNA, 21 nt, Human
cuugugagccucugaagccac

SEQ ID NO: 1086312 - RNA, 21 nt, Human
gaacaugccauugcacuccag

SEQ ID NO: 1086313 - RNA, 19 nt, Human
gaaccugcaccauccuuua

SEQ ID NO: 1086314 - RNA, 25 nt, Human
gaauguucccuccagggacucacug

SEQ ID NO: 1086315 - RNA, 21 nt, Human
gaccaggugcaguggcucacg

SEQ ID NO: 1086316 - RNA, 23 nt, Human
gacucugguggugguauuaucca

SEQ ID NO: 1086317 - RNA, 24 nt, Human
gagggguggcagguuguugggguu

SEQ ID NO: 1086318 - RNA, 24 nt, Human
gaucgcuugagcccaggaguucaa

SEQ ID NO: 1086319 - RNA, 18 nt, Human
gcaauagaggaguuggua

SEQ ID NO: 1086320 - RNA, 24 nt, Human
gcacuccagccugggugacagagc

SEQ ID NO: 1086321 - RNA, 19 nt, Human
gccauugcacuccagccug

SEQ ID NO: 1086322 - RNA, 24 nt, Human
gccauugcacuccagccuggguga

SEQ ID NO: 1086323 - RNA, 20 nt, Human
ggacucacuggguaagggca

SEQ ID NO: 1086324 - RNA, 24 nt, Human
ggagaauguuggaggaggaaaaug

SEQ ID NO: 1086325 - RNA, 23 nt, Human
ggaucgcuugagcccaggaguuc

SEQ ID NO: 1086326 - RNA, 20 nt, Human
ggauugugagaaagaaaaag

SEQ ID NO: 1086327 - RNA, 18 nt, Human
gggagaauguuggaggag

SEQ ID NO: 1086328 - RNA, 22 nt, Human
ggggaccaggugcaguggcuca

SEQ ID NO: 1086329 - RNA, 22 nt, Human
ggugggguucugcuugugagcc

SEQ ID NO: 1086330 - RNA, 19 nt, Human
gugccaaagaggguggacc

SEQ ID NO: 1086331 - RNA, 23 nt, Human
guuaaauuggguuuuguuugacu

SEQ ID NO: 1086332 - RNA, 23 nt, Human
uaaaaaccacacacuggccccca

SEQ ID NO: 1086333 - RNA, 18 nt, Human
uaaagccgcuuugagaca

SEQ ID NO: 1086334 - RNA, 21 nt, Human
uaaagccgcuuugagacacag

SEQ ID NO: 1086335 - RNA, 24 nt, Human
uaacaaauugucuugcuuuuuucu

SEQ ID NO: 1086336 - RNA, 18 nt, Human
uaacaaggcuuuucucca

SEQ ID NO: 1086337 - RNA, 25 nt, Human
uaggucccuguuaaaagaggaugac

SEQ ID NO: 1086338 - RNA, 21 nt, Human
ucaagaccagcgugggccacc

SEQ ID NO: 1086339 - RNA, 18 nt, Human
ucagugcuguuucuagug

SEQ ID NO: 1086340 - RNA, 21 nt, Human
ucaugguagguggcccugccu

SEQ ID NO: 1086341 - RNA, 24 nt, Human
uccagcauggacacacaauccaaa

SEQ ID NO: 1086342 - RNA, 23 nt, Human
uccagccugggugacagagcgag

SEQ ID NO: 1086343 - RNA, 24 nt, Human
uccagccugggugacagagcgaga

SEQ ID NO: 1086344 - RNA, 18 nt, Human
ucccaaacuccuuguucc

SEQ ID NO: 1086345 - RNA, 24 nt, Human
ucgcuugaaccugggacgucaagg

SEQ ID NO: 1086346 - RNA, 25 nt, Human
ucgcuugaaccugggacgucaaggu

SEQ ID NO: 1086347 - RNA, 23 nt, Human
ucuaaagccgcuuugagacacag

SEQ ID NO: 1086348 - RNA, 24 nt, Human
ucuauauuuacuucuaaagccgcu

SEQ ID NO: 1086349 - RNA, 20 nt, Human
ucucugguuuuguccccucu

SEQ ID NO: 1086350 - RNA, 18 nt, Human
ucugaagccaccucccca

SEQ ID NO: 1086351 - RNA, 20 nt, Human
ugacaaaaucccugcaccuc

SEQ ID NO: 1086352 - RNA, 24 nt, Human
ugacaacacuuguaaucaaggcug

SEQ ID NO: 1086353 - RNA, 21 nt, Human
ugacagagcgagacccugucu

SEQ ID NO: 1086354 - RNA, 22 nt, Human
ugaccacacccugugaauggag

SEQ ID NO: 1086355 - RNA, 23 nt, Human
ugagaaaacaguagggggauguc

SEQ ID NO: 1086356 - RNA, 23 nt, Human
ugagcccaggaguucaagaccag

SEQ ID NO: 1086357 - RNA, 24 nt, Human
ugagggacagugccaaagagggug

SEQ ID NO: 1086358 - RNA, 19 nt, Human
ugcaauaccauguaccaaa

SEQ ID NO: 1086359 - RNA, 22 nt, Human
ugcacuccagccugggugacag

SEQ ID NO: 1086360 - RNA, 24 nt, Human
ugcacuccagccugggugacagag

SEQ ID NO: 1086361 - RNA, 22 nt, Human
ugcagugagccaugaacaugcc

SEQ ID NO: 1086362 - RNA, 21 nt, Human
ugcaugccaucgaaucaaaau

SEQ ID NO: 1086363 - RNA, 23 nt, Human
ugccuguaguuccagcuacuugg

SEQ ID NO: 1086364 - RNA, 24 nt, Human
ugccuguaguuccagcuacuuggg

SEQ ID NO: 1086365 - RNA, 18 nt, Human
ugccuuaggucacgcagc

SEQ ID NO: 1086366 - RNA, 20 nt, Human
ugccuuuaacaccgaggccg

SEQ ID NO: 1086367 - RNA, 24 nt, Human
ugccuuuaacaccgaggccgacuu

SEQ ID NO: 1086368 - RNA, 21 nt, Human
ugcuaaagaauaaagucacag

SEQ ID NO: 1086369 - RNA, 20 nt, Human
uggaaacuucagaacagaaa

SEQ ID NO: 1086370 - RNA, 21 nt, Human
uggacacacaauccaaagaaa

SEQ ID NO: 1086371 - RNA, 20 nt, Human
uggcccccaaggucacaccc

SEQ ID NO: 1086372 - RNA, 21 nt, Human
uggcucacgccuauaauccca

SEQ ID NO: 1086373 - RNA, 18 nt, Human
uggcuguacuaacuuugg

SEQ ID NO: 1086374 - RNA, 24 nt, Human
ugggacgucaagguugcagugagc

SEQ ID NO: 1086375 - RNA, 19 nt, Human
ugggagaauguuggaggag

SEQ ID NO: 1086376 - RNA, 20 nt, Human
ugggagaauguuggaggagg

SEQ ID NO: 1086377 - RNA, 25 nt, Human
ugguagguggcccugccuuuaacac

SEQ ID NO: 1086378 - RNA, 18 nt, Human
uggugcaugccuguaguu

SEQ ID NO: 1086379 - RNA, 23 nt, Human
ugguggugcaugccuguaguucc

SEQ ID NO: 1086380 - RNA, 24 nt, Human
ugguggugcaugccuguaguucca

SEQ ID NO: 1086381 - RNA, 18 nt, Human
uguaccaaagaauuucua

SEQ ID NO: 1086382 - RNA, 18 nt, Human
ugucauuguggugacaca

SEQ ID NO: 1086383 - RNA, 19 nt, Human
uguuagggagggguggcag

SEQ ID NO: 1086384 - RNA, 23 nt, Human
uguuggaggaggaaaaugaggga

SEQ ID NO: 1086385 - RNA, 24 nt, Human
uguuguguuuuuuuuucucuccca

SEQ ID NO: 1086386 - RNA, 25 nt, Human
uguuucuaguguuguguuuuuuuuu

SEQ ID NO: 1086387 - RNA, 20 nt, Human
uuaaaaacagaaccugcacc

SEQ ID NO: 1086388 - RNA, 24 nt, Human
uuaaucaucccccagcuccacuua

SEQ ID NO: 1086389 - RNA, 18 nt, Human
uucaagaccagcgugggc

SEQ ID NO: 1086390 - RNA, 19 nt, Human
uucagggauacgugauggc

SEQ ID NO: 1086391 - RNA, 23 nt, Human
uucugggggaccaggugcagugg

SEQ ID NO: 1086392 - RNA, 24 nt, Human
uugaaccugggacgucaagguugc

SEQ ID NO: 1086393 - RNA, 22 nt, Human
uugagcccaggaguucaagacc

SEQ ID NO: 1086394 - RNA, 20 nt, Human
uugagcuaauacauacuuaa

SEQ ID NO: 1086395 - RNA, 25 nt, Human
uuggaggaggaaaaugagggacagu

SEQ ID NO: 1086396 - RNA, 19 nt, Human
uuucuaguguuguguuuuu

SEQ ID NO: 1086397 - RNA, 25 nt, Human
uuuuuuuuucucucccaaacuccuu

SEQ ID NO: 1086398 - RNA, 20 nt, Human
cacccucuuugucuuacaag

SEQ ID NO: 1086399 - RNA, 19 nt, Human
ccccugugaaauguccacc

SEQ ID NO: 1086400 - RNA, 23 nt, Human
uaacugaagcuaguucauccccu

SEQ ID NO: 1086401 - RNA, 22 nt, Human
ucuccugacaauaaaauaaccc

SEQ ID NO: 1086402 - RNA, 24 nt, Human
ugugaaauguccaccuuucagagu

SEQ ID NO: 1086403 - RNA, 24 nt, Human
uguucuuucuccugacaauaaaau

SEQ ID NO: 1086404 - RNA, 19 nt, Human
uguugggcuaauucagagu

SEQ ID NO: 1086405 - RNA, 25 nt, Human
uguugggcuaauucagaguuuuccc

SEQ ID NO: 1086406 - RNA, 20 nt, Human
uucuccugacaauaaaauaa

SEQ ID NO: 1086407 - RNA, 27 nt, Human
aaaaaaaaaaaaaaauggaucacaaag

SEQ ID NO: 1086408 - RNA, 22 nt, Human
aaaaaauggaucacaaacacac

SEQ ID NO: 1086409 - RNA, 19 nt, Human
aaaacccaaauaguuucca

SEQ ID NO: 1086410 - RNA, 23 nt, Human
aaaaugaaacccucugaccuguc

SEQ ID NO: 1086411 - RNA, 18 nt, Human
aaacaauguugaccagaa

SEQ ID NO: 1086412 - RNA, 27 nt, Human
aaacauccaaaugaaaaguugaaaaca

SEQ ID NO: 1086413 - RNA, 19 nt, Human
aaaccccagguguuuccca

SEQ ID NO: 1086414 - RNA, 22 nt, Human
aaaugaccaguaaaaaaugauc

SEQ ID NO: 1086415 - RNA, 19 nt, Human
aaauuuuuuuuuaacaaga

SEQ ID NO: 1086416 - RNA, 23 nt, Human
aaccucucaccucaaccucacug

SEQ ID NO: 1086417 - RNA, 23 nt, Human
aagaauccagaguauaucgcaau

SEQ ID NO: 1086418 - RNA, 25 nt, Human
aagaugcggacacacacacguggga

SEQ ID NO: 1086419 - RNA, 23 nt, Human
aagcaccccaaugugcaccgagc

SEQ ID NO: 1086420 - RNA, 19 nt, Human
aagcauccuagccuucuca

SEQ ID NO: 1086421 - RNA, 25 nt, Human
aagcauccuagccuucucacccauc

SEQ ID NO: 1086422 - RNA, 18 nt, Human
aagcauggggggaaaaga

SEQ ID NO: 1086423 - RNA, 23 nt, Human
aaggagaccugggguggucuggg

SEQ ID NO: 1086424 - RNA, 19 nt, Human
aaucuacuggacuuaagag

SEQ ID NO: 1086425 - RNA, 26 nt, Human
acaaaaugacaucaguaacucggaca

SEQ ID NO: 1086426 - RNA, 24 nt, Human
acagagaaaaaucaagaggcagag

SEQ ID NO: 1086427 - RNA, 25 nt, Human
acagagaaaaaucaagaggcagaga

SEQ ID NO: 1086428 - RNA, 19 nt, Human
acagaggaacauuaacgaa

SEQ ID NO: 1086429 - RNA, 30 nt, Human
acagguguccuaaaaaaaaaaaaaaaaaaa

SEQ ID NO: 1086430 - RNA, 22 nt, Human
accagaggguucuggaagacca

SEQ ID NO: 1086431 - RNA, 25 nt, Human
acccaccacccggucauuccaccau

SEQ ID NO: 1086432 - RNA, 19 nt, Human
acccugcugcucguaacuc

SEQ ID NO: 1086433 - RNA, 18 nt, Human
accucaaccucacuggcu

SEQ ID NO: 1086434 - RNA, 20 nt, Human
acgaaaagaacaaaccccaa

SEQ ID NO: 1086435 - RNA, 20 nt, Human
acugcugagccucgaugugg

SEQ ID NO: 1086436 - RNA, 18 nt, Human
acugggacugcuggaaug

SEQ ID NO: 1086437 - RNA, 19 nt, Human
acuucaagcagugugagcu

SEQ ID NO: 1086438 - RNA, 22 nt, Human
agaaaaaagcagaguaagagaa

SEQ ID NO: 1086439 - RNA, 23 nt, Human
agaauauacaaaaacauuuugaa

SEQ ID NO: 1086440 - RNA, 22 nt, Human
agacaaagggauacccagaggu

SEQ ID NO: 1086441 - RNA, 24 nt, Human
agaggguucuggaagaccaagaua

SEQ ID NO: 1086442 - RNA, 26 nt, Human
agccacuggcaagccauucccaucag

SEQ ID NO: 1086443 - RNA, 19 nt, Human
aggaacauuaacgaaaaga

SEQ ID NO: 1086444 - RNA, 19 nt, Human
aggccaggagaggccaggu

SEQ ID NO: 1086445 - RNA, 18 nt, Human
aguugaaaacaaaaccca

SEQ ID NO: 1086446 - RNA, 24 nt, Human
aucaaguucaaaaccuugcccaca

SEQ ID NO: 1086447 - RNA, 21 nt, Human
auucuuuucuguauuggaaau

SEQ ID NO: 1086448 - RNA, 18 nt, Human
caaaaaugaaacccucug

SEQ ID NO: 1086449 - RNA, 27 nt, Human
caaaaccuugcccacauuccuuccaag

SEQ ID NO: 1086450 - RNA, 24 nt, Human
caaaauagacaguuucuuuuuucc

SEQ ID NO: 1086451 - RNA, 23 nt, Human
caaagggauacccagagguagac

SEQ ID NO: 1086452 - RNA, 21 nt, Human
caacacagaggaacauuaacg

SEQ ID NO: 1086453 - RNA, 23 nt, Human
caagaacaaucaaguucaaaacc

SEQ ID NO: 1086454 - RNA, 18 nt, Human
caagcagugugagcugcu

SEQ ID NO: 1086455 - RNA, 20 nt, Human
cacaaacacacauuugcaca

SEQ ID NO: 1086456 - RNA, 19 nt, Human
caccaucacacaagccaag

SEQ ID NO: 1086457 - RNA, 18 nt, Human
cacuagacaagcauccua

SEQ ID NO: 1086458 - RNA, 20 nt, Human
cacuggcaagccauucggcc

SEQ ID NO: 1086459 - RNA, 23 nt, Human
cagaaaaugcauuauuugcggug

SEQ ID NO: 1086460 - RNA, 24 nt, Human
cagcuaagaacacuagacaagcau

SEQ ID NO: 1086461 - RNA, 20 nt, Human
caucccgccuucugguuuga

SEQ ID NO: 1086462 - RNA, 18 nt, Human
caucuuaagaaacaggcc

SEQ ID NO: 1086463 - RNA, 21 nt, Human
cauggaaaaugccacaacuca

SEQ ID NO: 1086464 - RNA, 22 nt, Human
ccaaagggaaaugaccaguaaa

SEQ ID NO: 1086465 - RNA, 23 nt, Human
ccaagauacugaagauacagaac

SEQ ID NO: 1086466 - RNA, 25 nt, Human
ccaagauacugaagauacagaacua

SEQ ID NO: 1086467 - RNA, 22 nt, Human
ccaaugcugcuuagcccaggaa

SEQ ID NO: 1086468 - RNA, 23 nt, Human
ccagagguagacaaacucuggca

SEQ ID NO: 1086469 - RNA, 24 nt, Human
cccaaagcaccccaaugugcaccg

SEQ ID NO: 1086470 - RNA, 22 nt, Human
cccacauuccuuccaagcccug

SEQ ID NO: 1086471 - RNA, 21 nt, Human
cccucugaccuguccaagguc

SEQ ID NO: 1086472 - RNA, 18 nt, Human
ccuaaaaaaaaaaaaaaa

SEQ ID NO: 1086473 - RNA, 18 nt, Human
ccuaaaaaaaaaaaaaaa

SEQ ID NO: 1086474 - RNA, 19 nt, Human
ccuaaaaaaaaaaaaaaaa

SEQ ID NO: 1086475 - RNA, 23 nt, Human
ccucucaccucaaccucacuggc

SEQ ID NO: 1086476 - RNA, 25 nt, Human
ccugcagagguggacugcuguggga

SEQ ID NO: 1086477 - RNA, 20 nt, Human
ccuugcccacauuccuucca

SEQ ID NO: 1086478 - RNA, 22 nt, Human
ccuugcccacauuccuuccaag

SEQ ID NO: 1086479 - RNA, 26 nt, Human
cgagcaucucgccauuugguaguucc

SEQ ID NO: 1086480 - RNA, 22 nt, Human
cgcaaaaaccccagguguuucc

SEQ ID NO: 1086481 - RNA, 19 nt, Human
cgucaugacaucccacgaa

SEQ ID NO: 1086482 - RNA, 24 nt, Human
cuaagaugaaggccaaaaaugaaa

SEQ ID NO: 1086483 - RNA, 22 nt, Human
cuagcuaguaaacagguguccu

SEQ ID NO: 1086484 - RNA, 22 nt, Human
cucguaacucuucucugugcca

SEQ ID NO: 1086485 - RNA, 23 nt, Human
cuggaagaccaagauacugaaga

SEQ ID NO: 1086486 - RNA, 23 nt, Human
cuuaagagcccuauugaaaacgc

SEQ ID NO: 1086487 - RNA, 22 nt, Human
cuucccaaccagaggguucugg

SEQ ID NO: 1086488 - RNA, 20 nt, Human
gaacaaaccccaaacuugaa

SEQ ID NO: 1086489 - RNA, 18 nt, Human
gacaaagggauacccaga

SEQ ID NO: 1086490 - RNA, 24 nt, Human
gagaggccaggucggccacgaaca

SEQ ID NO: 1086491 - RNA, 19 nt, Human
gagggugaaccacggaugg

SEQ ID NO: 1086492 - RNA, 19 nt, Human
gaucucugguccacaucuc

SEQ ID NO: 1086493 - RNA, 20 nt, Human
gcaaaaagcauggggggaaa

SEQ ID NO: 1086494 - RNA, 21 nt, Human
gcaacagagguucagucuaaa

SEQ ID NO: 1086495 - RNA, 24 nt, Human
gcaauaacaggaauaaauucuuac

SEQ ID NO: 1086496 - RNA, 18 nt, Human
gcagagaaaucagcauga

SEQ ID NO: 1086497 - RNA, 25 nt, Human
gccaacgugacagcuaagaacacca

SEQ ID NO: 1086498 - RNA, 21 nt, Human
gccaaguuuucucuuuuauug

SEQ ID NO: 1086499 - RNA, 21 nt, Human
gccacaacucagcuuaagauu

SEQ ID NO: 1086500 - RNA, 19 nt, Human
gcccugcacccugcugcuc

SEQ ID NO: 1086501 - RNA, 23 nt, Human
ggaaauacguaucuucgggguuc

SEQ ID NO: 1086502 - RNA, 21 nt, Human
ggaugugugugugcaacgcca

SEQ ID NO: 1086503 - RNA, 18 nt, Human
ggcaaaaagcaugggggg

SEQ ID NO: 1086504 - RNA, 21 nt, Human
ggccaaggcauaccacggcgg

SEQ ID NO: 1086505 - RNA, 21 nt, Human
ggcuuagaaagcagacaggug

SEQ ID NO: 1086506 - RNA, 22 nt, Human
gggucacugucaccaggagggc

SEQ ID NO: 1086507 - RNA, 18 nt, Human
gugaagaaagaaaguguc

SEQ ID NO: 1086508 - RNA, 21 nt, Human
guggucugggucuugaucaag

SEQ ID NO: 1086509 - RNA, 23 nt, Human
guuaaaacaauguugaccagaaa

SEQ ID NO: 1086510 - RNA, 23 nt, Human
uaaaacaaaaacaaaaugacauc

SEQ ID NO: 1086511 - RNA, 23 nt, Human
uaaaacaaaaacaaaaugacauc

SEQ ID NO: 1086512 - RNA, 26 nt, Human
uaaacagguguccuaaaaaaaaaaaa

SEQ ID NO: 1086513 - RNA, 23 nt, Human
uaaaguagcuacacuccaaaggg

SEQ ID NO: 1086514 - RNA, 27 nt, Human
uaacaggaauaaauucuuacaacagaa

SEQ ID NO: 1086515 - RNA, 23 nt, Human
uaacgaaaagaacaaaccccaaa

SEQ ID NO: 1086516 - RNA, 24 nt, Human
uaacugggacugcuggaaugggcc

SEQ ID NO: 1086517 - RNA, 23 nt, Human
uaagagaaacuaacguugccuua

SEQ ID NO: 1086518 - RNA, 18 nt, Human
uaagaugaaggccaaaaa

SEQ ID NO: 1086519 - RNA, 25 nt, Human
uaagaugaaggccaaaaaugaaacc

SEQ ID NO: 1086520 - RNA, 27 nt, Human
uaagcaaauggccuguguuguaaugac

SEQ ID NO: 1086521 - RNA, 19 nt, Human
uaauuaguucuuguaaacc

SEQ ID NO: 1086522 - RNA, 27 nt, Human
uacauaaaacaaaaacaaaaugacauc

SEQ ID NO: 1086523 - RNA, 20 nt, Human
uaccuacauaaaacaaaaac

SEQ ID NO: 1086524 - RNA, 21 nt, Human
uaccuacauaaaacaaaaaca

SEQ ID NO: 1086525 - RNA, 19 nt, Human
uacuuuacuagaaaaaagc

SEQ ID NO: 1086526 - RNA, 20 nt, Human
uagaaagcagacagguguuu

SEQ ID NO: 1086527 - RNA, 21 nt, Human
uagcccaggaaaugaagacag

SEQ ID NO: 1086528 - RNA, 20 nt, Human
uagcgcaaaaaccccaggug

SEQ ID NO: 1086529 - RNA, 24 nt, Human
uaggauguuagguuucuuuguuga

SEQ ID NO: 1086530 - RNA, 21 nt, Human
uaguuuccagaucuuucuccu

SEQ ID NO: 1086531 - RNA, 25 nt, Human
uauacacagaaagucauuuuaugua

SEQ ID NO: 1086532 - RNA, 18 nt, Human
uaucccaaagcaccccaa

SEQ ID NO: 1086533 - RNA, 19 nt, Human
ucagggaagggcugugugg

SEQ ID NO: 1086534 - RNA, 19 nt, Human
ucccagacaaagggauacc

SEQ ID NO: 1086535 - RNA, 25 nt, Human
ucccugugacaaugguucuguaccc

SEQ ID NO: 1086536 - RNA, 20 nt, Human
uccuagccuucucacccauc

SEQ ID NO: 1086537 - RNA, 21 nt, Human
uccuauguagcgcaaaaaccc

SEQ ID NO: 1086538 - RNA, 21 nt, Human
ucucccaaugcugcuuagccc

SEQ ID NO: 1086539 - RNA, 23 nt, Human
ucuccuauguagcgcaaaaacug

SEQ ID NO: 1086540 - RNA, 23 nt, Human
ucuucgggguucugccuuaaaua

SEQ ID NO: 1086541 - RNA, 25 nt, Human
ugaaaacaaaacccaaauaguuucc

SEQ ID NO: 1086542 - RNA, 20 nt, Human
ugaaaaguugaaaacaaaac

SEQ ID NO: 1086543 - RNA, 21 nt, Human
ugaaaaguugaaaacaaaacc

SEQ ID NO: 1086544 - RNA, 20 nt, Human
ugaagacagcugacaacaca

SEQ ID NO: 1086545 - RNA, 24 nt, Human
ugaagacagcugacaacacagagg

SEQ ID NO: 1086546 - RNA, 19 nt, Human
ugaagcauuugcuaugaug

SEQ ID NO: 1086547 - RNA, 22 nt, Human
ugaaggccaaaaaugaaacccu

SEQ ID NO: 1086548 - RNA, 20 nt, Human
ugaccaguaaaaaaugaucc

SEQ ID NO: 1086549 - RNA, 19 nt, Human
ugagguguuucugaagcau

SEQ ID NO: 1086550 - RNA, 20 nt, Human
ugagguguuucugaagcauu

SEQ ID NO: 1086551 - RNA, 20 nt, Human
ugcacacacagagaaaaaaa

SEQ ID NO: 1086552 - RNA, 19 nt, Human
ugcauggaaaaugccacaa

SEQ ID NO: 1086553 - RNA, 20 nt, Human
ugcauggaaaaugccacaac

SEQ ID NO: 1086554 - RNA, 19 nt, Human
ugccagagaauaguuggcu

SEQ ID NO: 1086555 - RNA, 18 nt, Human
ugcggacacacacacgug

SEQ ID NO: 1086556 - RNA, 25 nt, Human
ugcggacacacacacgugggacaua

SEQ ID NO: 1086557 - RNA, 22 nt, Human
uggaacacacagagaaaaauca

SEQ ID NO: 1086558 - RNA, 23 nt, Human
uggaacacacagagaaaagggag

SEQ ID NO: 1086559 - RNA, 20 nt, Human
uggaaggagccaacgugaca

SEQ ID NO: 1086560 - RNA, 25 nt, Human
uggaucucugguccacaucucccaa

SEQ ID NO: 1086561 - RNA, 20 nt, Human
uggcaaaccucucaccucac

SEQ ID NO: 1086562 - RNA, 22 nt, Human
uggcagaaggagguugcaugga

SEQ ID NO: 1086563 - RNA, 19 nt, Human
uggccaacaauccacugga

SEQ ID NO: 1086564 - RNA, 18 nt, Human
uggggucagggagaaauc

SEQ ID NO: 1086565 - RNA, 25 nt, Human
uggggucagggagaaauccuuuuuu

SEQ ID NO: 1086566 - RNA, 19 nt, Human
uggguugguccaguaaagu

SEQ ID NO: 1086567 - RNA, 18 nt, Human
uguaaagaauccagagua

SEQ ID NO: 1086568 - RNA, 21 nt, Human
ugugcaccgagcaucucgccc

SEQ ID NO: 1086569 - RNA, 20 nt, Human
ugugugccccauagcuguca

SEQ ID NO: 1086570 - RNA, 20 nt, Human
uuccagaguaggauguuagg

SEQ ID NO: 1086571 - RNA, 27 nt, Human
uucuccuauguagcgcaaaaaccccag

SEQ ID NO: 1086572 - RNA, 21 nt, Human
uugcccacauuccuuccaagc

SEQ ID NO: 1086573 - RNA, 23 nt, Human
uugcggugcauccauuccauccc

SEQ ID NO: 1086574 - RNA, 22 nt, Human
uuuaacaagaaaacucagaaaa

SEQ ID NO: 1086575 - RNA, 18 nt, Human
uuucuuacuuaaaaaaau

SEQ ID NO: 1086576 - RNA, 19 nt, Human
aaaauccaaagccugaaaa

SEQ ID NO: 1086577 - RNA, 24 nt, Human
aaagugcugggauuacaggcguga

SEQ ID NO: 1086578 - RNA, 21 nt, Human
aaccauggcuacccaggaucg

SEQ ID NO: 1086579 - RNA, 21 nt, Human
aagacacuuaacagcaggcuc

SEQ ID NO: 1086580 - RNA, 18 nt, Human
aagccagugaaaaccagg

SEQ ID NO: 1086581 - RNA, 19 nt, Human
aagugcugggauuacaggc

SEQ ID NO: 1086582 - RNA, 19 nt, Human
aagugcugggauuacaggc

SEQ ID NO: 1086583 - RNA, 26 nt, Human
aagugcugggauuacaggcgugagcc

SEQ ID NO: 1086584 - RNA, 21 nt, Human
acagauuuaaccauggcuacc

SEQ ID NO: 1086585 - RNA, 23 nt, Human
acaggaaacugcauaguuaaaac

SEQ ID NO: 1086586 - RNA, 21 nt, Human
acaggcgugagccauccuccc

SEQ ID NO: 1086587 - RNA, 24 nt, Human
acauccaucgacacaaauuaucuc

SEQ ID NO: 1086588 - RNA, 19 nt, Human
acaugcaaaaacauggcua

SEQ ID NO: 1086589 - RNA, 18 nt, Human
acgggguuucaccauguu

SEQ ID NO: 1086590 - RNA, 19 nt, Human
acgggguuucaccauguua

SEQ ID NO: 1086591 - RNA, 20 nt, Human
acgggguuucaccauguuag

SEQ ID NO: 1086592 - RNA, 24 nt, Human
acgggguuucaccauguuagccag

SEQ ID NO: 1086593 - RNA, 20 nt, Human
acugcaagcuccgccucccg

SEQ ID NO: 1086594 - RNA, 23 nt, Human
acuuaguccagguaguuaguaag

SEQ ID NO: 1086595 - RNA, 23 nt, Human
agaaaagcaguuuuucaaauggc

SEQ ID NO: 1086596 - RNA, 24 nt, Human
agaaagcaaaucagugauugcuua

SEQ ID NO: 1086597 - RNA, 21 nt, Human
agacacuuaacagcaggcuca

SEQ ID NO: 1086598 - RNA, 22 nt, Human
agauauacaauagcacugaacu

SEQ ID NO: 1086599 - RNA, 22 nt, Human
aggcagggggugaggagugggg

SEQ ID NO: 1086600 - RNA, 25 nt, Human
aggcauaaaacucccuugugacuug

SEQ ID NO: 1086601 - RNA, 20 nt, Human
aggcgcccuccaccacgccu

SEQ ID NO: 1086602 - RNA, 25 nt, Human
aggcuggagugcaguggcaugaucu

SEQ ID NO: 1086603 - RNA, 20 nt, Human
agggggugaggaguggggag

SEQ ID NO: 1086604 - RNA, 18 nt, Human
aguagcugggacuacagg

SEQ ID NO: 1086605 - RNA, 19 nt, Human
aguagcugggacuacaggc

SEQ ID NO: 1086606 - RNA, 19 nt, Human
agucaaugucugagccccu

SEQ ID NO: 1086607 - RNA, 20 nt, Human
agugcaguggcaugaucucg

SEQ ID NO: 1086608 - RNA, 23 nt, Human
agugcaguggcaugaucucggcu

SEQ ID NO: 1086609 - RNA, 24 nt, Human
agugcaguggcaugaucucggcuc

SEQ ID NO: 1086610 - RNA, 18 nt, Human
agugcugggauuacaggc

SEQ ID NO: 1086611 - RNA, 24 nt, Human
aguggcaugaucucggcucacugc

SEQ ID NO: 1086612 - RNA, 24 nt, Human
auuuacuuaacggcugucugcacc

SEQ ID NO: 1086613 - RNA, 24 nt, Human
caaagugcugggauuacaggcgug

SEQ ID NO: 1086614 - RNA, 18 nt, Human
caagccagugaaaaccag

SEQ ID NO: 1086615 - RNA, 22 nt, Human
caagccagugaaaaccagggca

SEQ ID NO: 1086616 - RNA, 18 nt, Human
caccauguuagccaggau

SEQ ID NO: 1086617 - RNA, 22 nt, Human
caccauguuagccaggaugguc

SEQ ID NO: 1086618 - RNA, 24 nt, Human
caccauguuagccaggauggucuc

SEQ ID NO: 1086619 - RNA, 18 nt, Human
cagaagacacuuaacagc

SEQ ID NO: 1086620 - RNA, 24 nt, Human
cagauauagauagauagauggaua

SEQ ID NO: 1086621 - RNA, 23 nt, Human
cagauuuaaccauggcuacccag

SEQ ID NO: 1086622 - RNA, 22 nt, Human
caggauggucuccaucuccuga

SEQ ID NO: 1086623 - RNA, 25 nt, Human
caggcucccacuguuaauggggcau

SEQ ID NO: 1086624 - RNA, 24 nt, Human
caucgacacaaauuaucucuguuc

SEQ ID NO: 1086625 - RNA, 23 nt, Human
cauuuuggccaggcucccuuacu

SEQ ID NO: 1086626 - RNA, 23 nt, Human
ccaaaccuggaaacaacccaaau

SEQ ID NO: 1086627 - RNA, 22 nt, Human
ccaaagugcugggauuacaggc

SEQ ID NO: 1086628 - RNA, 22 nt, Human
ccaaagugcugggauuacaggc

SEQ ID NO: 1086629 - RNA, 24 nt, Human
ccaaagugcugggauuacaggcgu

SEQ ID NO: 1086630 - RNA, 20 nt, Human
ccagagcuuugucacucuca

SEQ ID NO: 1086631 - RNA, 20 nt, Human
ccaggaacaaagcacuuugc

SEQ ID NO: 1086632 - RNA, 19 nt, Human
ccagugaaaaccagggcaa

SEQ ID NO: 1086633 - RNA, 23 nt, Human
ccauaaaauggauuaguacugag

SEQ ID NO: 1086634 - RNA, 18 nt, Human
ccccauucuccugccuca

SEQ ID NO: 1086635 - RNA, 21 nt, Human
ccccauucuccugccucaguc

SEQ ID NO: 1086636 - RNA, 23 nt, Human
cccgaguagcugggacuacaggc

SEQ ID NO: 1086637 - RNA, 24 nt, Human
cccgaguagcugggacuacaggcg

SEQ ID NO: 1086638 - RNA, 18 nt, Human
ccucccggguucucccca

SEQ ID NO: 1086639 - RNA, 24 nt, Human
ccuuacugaaauguaaguuucuug

SEQ ID NO: 1086640 - RNA, 24 nt, Human
cgacacaauaggccuucacagaac

SEQ ID NO: 1086641 - RNA, 24 nt, Human
cgggguuucaccauguuagccagg

SEQ ID NO: 1086642 - RNA, 22 nt, Human
cgucaaaaagcccaggcuccca

SEQ ID NO: 1086643 - RNA, 21 nt, Human
cuaggccucccaaagugcugg

SEQ ID NO: 1086644 - RNA, 24 nt, Human
cucagucucccgaguagcugggac

SEQ ID NO: 1086645 - RNA, 19 nt, Human
cuccccauucuccugccuc

SEQ ID NO: 1086646 - RNA, 21 nt, Human
cucccggguucuccccauucu

SEQ ID NO: 1086647 - RNA, 24 nt, Human
cuccugaccucgugauccgcccgc

SEQ ID NO: 1086648 - RNA, 24 nt, Human
cucuaacaagauauacaauagcac

SEQ ID NO: 1086649 - RNA, 23 nt, Human
cugccucagucucccgaguagcu

SEQ ID NO: 1086650 - RNA, 24 nt, Human
cuggagugcaguggcaugaucucg

SEQ ID NO: 1086651 - RNA, 20 nt, Human
gaccucgugauccgcccgcc

SEQ ID NO: 1086652 - RNA, 21 nt, Human
gaccucgugauccgcccgccu

SEQ ID NO: 1086653 - RNA, 23 nt, Human
gaccucgugauccgcccgccuag

SEQ ID NO: 1086654 - RNA, 18 nt, Human
gagaagaaaucccuccuc

SEQ ID NO: 1086655 - RNA, 24 nt, Human
gagacgggguuucaccauguuagc

SEQ ID NO: 1086656 - RNA, 27 nt, Human
gaguagcugggacuacaggcgcccucc

SEQ ID NO: 1086657 - RNA, 18 nt, Human
gauuacaggcgugagcca

SEQ ID NO: 1086658 - RNA, 21 nt, Human
gccagagcuuugucacucuca

SEQ ID NO: 1086659 - RNA, 23 nt, Human
gcccaggcuggagugcaguggca

SEQ ID NO: 1086660 - RNA, 24 nt, Human
gcccaggcuggagugcaguggcau

SEQ ID NO: 1086661 - RNA, 24 nt, Human
gccucagucucccgaguagcuggg

SEQ ID NO: 1086662 - RNA, 25 nt, Human
gccucccggguucuccccauucucc

SEQ ID NO: 1086663 - RNA, 18 nt, Human
gccugguuaauuuuuuuu

SEQ ID NO: 1086664 - RNA, 21 nt, Human
gcgucaaaaagcccaggcucc

SEQ ID NO: 1086665 - RNA, 25 nt, Human
gcucugucgcccaggcuggagugca

SEQ ID NO: 1086666 - RNA, 19 nt, Human
gcuggagugcaguggcaug

SEQ ID NO: 1086667 - RNA, 23 nt, Human
ggagucuugcucugucgcccagg

SEQ ID NO: 1086668 - RNA, 24 nt, Human
gggacuacaggcgcccuccaccac

SEQ ID NO: 1086669 - RNA, 25 nt, Human
gggcaauaucuugucggacacugau

SEQ ID NO: 1086670 - RNA, 23 nt, Human
gggguuucaccauguuagccagg

SEQ ID NO: 1086671 - RNA, 20 nt, Human
ggucuccaucuccugaccuc

SEQ ID NO: 1086672 - RNA, 24 nt, Human
gguuucaccauguuagccaggaug

SEQ ID NO: 1086673 - RNA, 23 nt, Human
guagagacgggguuucaccaugu

SEQ ID NO: 1086674 - RNA, 23 nt, Human
guccagguaguuaguaaaauguu

SEQ ID NO: 1086675 - RNA, 19 nt, Human
uaaaacaaaugagaugucc

SEQ ID NO: 1086676 - RNA, 22 nt, Human
uaaaacaaaugagauguccuuc

SEQ ID NO: 1086677 - RNA, 22 nt, Human
uaaaauggauuaguacugagca

SEQ ID NO: 1086678 - RNA, 21 nt, Human
uaaauauuuuuaaagucagga

SEQ ID NO: 1086679 - RNA, 24 nt, Human
uaacaagauauacaauagcacuga

SEQ ID NO: 1086680 - RNA, 20 nt, Human
uacaggcgugagccauccuu

SEQ ID NO: 1086681 - RNA, 22 nt, Human
uagagacgggguuucaccaugu

SEQ ID NO: 1086682 - RNA, 21 nt, Human
uagaugaauagaugauagaua

SEQ ID NO: 1086683 - RNA, 21 nt, Human
uagaugaauagaugauagaug

SEQ ID NO: 1086684 - RNA, 23 nt, Human
uagauggauagauagauagggau

SEQ ID NO: 1086685 - RNA, 21 nt, Human
uagauggauaguugauaggua

SEQ ID NO: 1086686 - RNA, 20 nt, Human
uagcagcuuuauuuguaaca

SEQ ID NO: 1086687 - RNA, 24 nt, Human
uagccaggauggucuccaucuccu

SEQ ID NO: 1086688 - RNA, 18 nt, Human
uaggaaaagccagguaga

SEQ ID NO: 1086689 - RNA, 19 nt, Human
uaggaaaagccagguagag

SEQ ID NO: 1086690 - RNA, 23 nt, Human
uaggaaaagccagguagaggggg

SEQ ID NO: 1086691 - RNA, 27 nt, Human
uaggcauaaaacucccuugugacuugu

SEQ ID NO: 1086692 - RNA, 22 nt, Human
uagguaaugcguugaaacuacc

SEQ ID NO: 1086693 - RNA, 24 nt, Human
uaguagagacgggguuucaccaug

SEQ ID NO: 1086694 - RNA, 26 nt, Human
uaguagagacgggguuucaccauguu

SEQ ID NO: 1086695 - RNA, 23 nt, Human
uauuuuuaaagucaggaagaaaa

SEQ ID NO: 1086696 - RNA, 20 nt, Human
ucaaaaagcccaggcuccca

SEQ ID NO: 1086697 - RNA, 21 nt, Human
ucaaugccuaaugcuucuucu

SEQ ID NO: 1086698 - RNA, 24 nt, Human
ucaccauguuagccaggauggucu

SEQ ID NO: 1086699 - RNA, 18 nt, Human
ucacugcaagcuccgccu

SEQ ID NO: 1086700 - RNA, 19 nt, Human
ucacugcaagcuccgccuc

SEQ ID NO: 1086701 - RNA, 24 nt, Human
ucacugcaagcuccgccucccggg

SEQ ID NO: 1086702 - RNA, 23 nt, Human
ucagucucccgaguagcugggac

SEQ ID NO: 1086703 - RNA, 19 nt, Human
uccaaauuuucucucuauu

SEQ ID NO: 1086704 - RNA, 19 nt, Human
uccauaaaauggauuagua

SEQ ID NO: 1086705 - RNA, 24 nt, Human
ucccaaagugcugggauuacaggc

SEQ ID NO: 1086706 - RNA, 24 nt, Human
ucccgaguagcugggacuacaggc

SEQ ID NO: 1086707 - RNA, 21 nt, Human
ucccggguucuccccauucuc

SEQ ID NO: 1086708 - RNA, 24 nt, Human
ucccggguucuccccauucuccug

SEQ ID NO: 1086709 - RNA, 22 nt, Human
ucgcccaggcuggagugcagug

SEQ ID NO: 1086710 - RNA, 23 nt, Human
ucuaacaagauauacaauagcac

SEQ ID NO: 1086711 - RNA, 23 nt, Human
ucuccugucugugauacagcugg

SEQ ID NO: 1086712 - RNA, 21 nt, Human
ucuguauccauaaaauggauu

SEQ ID NO: 1086713 - RNA, 24 nt, Human
ucugucgcccaggcuggagugcag

SEQ ID NO: 1086714 - RNA, 23 nt, Human
ucuugcucugucgcccaggcugg

SEQ ID NO: 1086715 - RNA, 24 nt, Human
ucuugcucugucgcccaggcugga

SEQ ID NO: 1086716 - RNA, 18 nt, Human
ugacagaugauaaaugag

SEQ ID NO: 1086717 - RNA, 23 nt, Human
ugacuuguuuuugguuuugaauu

SEQ ID NO: 1086718 - RNA, 23 nt, Human
ugagaagaaaucccuccucuccc

SEQ ID NO: 1086719 - RNA, 22 nt, Human
ugagauggagucuugcucuguc

SEQ ID NO: 1086720 - RNA, 21 nt, Human
ugauacugcaaauaaaaucag

SEQ ID NO: 1086721 - RNA, 22 nt, Human
ugcaguggcaugaucucggcuc

SEQ ID NO: 1086722 - RNA, 23 nt, Human
ugcauaguuaaaacaaaugagau

SEQ ID NO: 1086723 - RNA, 22 nt, Human
ugccuaaugcuucuucugcacu

SEQ ID NO: 1086724 - RNA, 24 nt, Human
ugccuaaugcuucuucugcacucc

SEQ ID NO: 1086725 - RNA, 23 nt, Human
ugccucagucucccgaguagcug

SEQ ID NO: 1086726 - RNA, 24 nt, Human
ugccucagucucccgaguagcugg

SEQ ID NO: 1086727 - RNA, 24 nt, Human
ugcucugucgcccaggcuggagug

SEQ ID NO: 1086728 - RNA, 24 nt, Human
ugcugggauuacaggcgugagcca

SEQ ID NO: 1086729 - RNA, 25 nt, Human
uggaacaauuauuauauugaagaca

SEQ ID NO: 1086730 - RNA, 23 nt, Human
uggagucuugcucugucgcccag

SEQ ID NO: 1086731 - RNA, 24 nt, Human
uggagucuugcucugucgcccagg

SEQ ID NO: 1086732 - RNA, 19 nt, Human
uggagugcaguggcaugau

SEQ ID NO: 1086733 - RNA, 24 nt, Human
uggagugcaguggcaugaucucgg

SEQ ID NO: 1086734 - RNA, 19 nt, Human
uggauagauagauagggau

SEQ ID NO: 1086735 - RNA, 20 nt, Human
uggcuaaaucucaaauugua

SEQ ID NO: 1086736 - RNA, 24 nt, Human
ugggacuacaggcgcccuccacca

SEQ ID NO: 1086737 - RNA, 23 nt, Human
ugggauagauagauagauagaca

SEQ ID NO: 1086738 - RNA, 18 nt, Human
ugggauuacaggcgugag

SEQ ID NO: 1086739 - RNA, 19 nt, Human
ugggauuacaggcgugagc

SEQ ID NO: 1086740 - RNA, 21 nt, Human
ugggauuacaggcgugagcca

SEQ ID NO: 1086741 - RNA, 21 nt, Human
ugggauuacaggcgugagcca

SEQ ID NO: 1086742 - RNA, 22 nt, Human
ugggauuacaggcgugagccau

SEQ ID NO: 1086743 - RNA, 23 nt, Human
ugggauuacaggcgugagccauc

SEQ ID NO: 1086744 - RNA, 27 nt, Human
ugggauuacaggcgugagccauccucc

SEQ ID NO: 1086745 - RNA, 28 nt, Human
ugggauuacaggcgugagccauccuccc

SEQ ID NO: 1086746 - RNA, 25 nt, Human
ugguagguaaugcguugaaacuacc

SEQ ID NO: 1086747 - RNA, 18 nt, Human
uguuucuuuugagaugga

SEQ ID NO: 1086748 - RNA, 25 nt, Human
uuaacugauagugacagaaagcaaa

SEQ ID NO: 1086749 - RNA, 18 nt, Human
uuaguagagacgggguuu

SEQ ID NO: 1086750 - RNA, 22 nt, Human
uuaguagagacgggguuucacc

SEQ ID NO: 1086751 - RNA, 24 nt, Human
uuaguagagacgggguuucaccau

SEQ ID NO: 1086752 - RNA, 23 nt, Human
uuaguugucacaauaaacuccau

SEQ ID NO: 1086753 - RNA, 19 nt, Human
uucucauuuaaccccugua

SEQ ID NO: 1086754 - RNA, 23 nt, Human
uugauacugcaaauaaaaucagu

SEQ ID NO: 1086755 - RNA, 24 nt, Human
uugcucugucgcccaggcuggagu

SEQ ID NO: 1086756 - RNA, 23 nt, Human
uuguauuuuuaguagagacgggg

SEQ ID NO: 1086757 - RNA, 22 nt, Human
uuuauuuguaacagcccaaacc

SEQ ID NO: 1086758 - RNA, 19 nt, Human
uuucaccauguuagccagg

SEQ ID NO: 1086759 - RNA, 20 nt, Human
uuucaccauguuagccagga

SEQ ID NO: 1086760 - RNA, 23 nt, Human
uuuucucucugaagaguccaagc

SEQ ID NO: 1086761 - RNA, 24 nt, Human
uuuuuaguagagacgggguuucac

SEQ ID NO: 1086762 - RNA, 22 nt, Human
uuuuuguauuuuuaguagagaa

SEQ ID NO: 1086763 - RNA, 24 nt, Human
uuuuuuguauuuuuaguagagacg

SEQ ID NO: 1086764 - RNA, 22 nt, Human
uuuuuuguauuuuuaguagagg

SEQ ID NO: 1086765 - RNA, 30 nt, Human; identical to SEQ ID NO: 1063475

SEQ ID NO: 1086766 - RNA, 23 nt, Human
aaaaaagcaucacugaugccucu

SEQ ID NO: 1086767 - RNA, 24 nt, Human
aaagugcugggauuacaggcauga

SEQ ID NO: 1086768 - RNA, 21 nt, Human
aagaaagacgaaagagaagga

SEQ ID NO: 1086769 - RNA, 19 nt, Human
aagugcugggauuacaggc

SEQ ID NO: 1086770 - RNA, 21 nt, Human
aagugcugggauuacaggcau

SEQ ID NO: 1086771 - RNA, 26 nt, Human
aagugcugggauuacaggcaugagcc

SEQ ID NO: 1086772 - RNA, 19 nt, Human
acaagaaagacgaugacac

SEQ ID NO: 1086773 - RNA, 18 nt, Human
agaacagaagaaggaagg

SEQ ID NO: 1086774 - RNA, 18 nt, Human
agaagaaagacgaaagag

SEQ ID NO: 1086775 - RNA, 19 nt, Human
agaagaaagacgaaagaga

SEQ ID NO: 1086776 - RNA, 18 nt, Human
agaagaaggaagguagaa

SEQ ID NO: 1086777 - RNA, 22 nt, Human
agacgaugacaacaacaaucau

SEQ ID NO: 1086778 - RNA, 18 nt, Human
aggaguuauguaaauuuc

SEQ ID NO: 1086779 - RNA, 23 nt, Human
agugagaagaaagacgaaagaga

SEQ ID NO: 1086780 - RNA, 18 nt, Human
agugcugggauuacaggc

SEQ ID NO: 1086781 - RNA, 22 nt, Human
auaaagugaacugcagccgccc

SEQ ID NO: 1086782 - RNA, 23 nt, Human
caaaauguuugacaaagccaaag

SEQ ID NO: 1086783 - RNA, 20 nt, Human
caaagaaaauauuccuaaga

SEQ ID NO: 1086784 - RNA, 20 nt, Human
caaagccaaagaaaauauuc

SEQ ID NO: 1086785 - RNA, 24 nt, Human
caaagugcugggauuacaggcaug

SEQ ID NO: 1086786 - RNA, 20 nt, Human
caacaucacagaaguauaaa

SEQ ID NO: 1086787 - RNA, 22 nt, Human
caacaucacagaaguauaaacu

SEQ ID NO: 1086788 - RNA, 20 nt, Human
cacugcaaacaucucccuga

SEQ ID NO: 1086789 - RNA, 18 nt, Human
cagaaugcauuuucccau

SEQ ID NO: 1086790 - RNA, 20 nt, Human
cagcagggcagcuuccacuc

SEQ ID NO: 1086791 - RNA, 21 nt, Human
cagggcugggagugagaagaa

SEQ ID NO: 1086792 - RNA, 21 nt, Human
caugcagugauaccauuuauu

SEQ ID NO: 1086793 - RNA, 21 nt, Human
cauuauuuggcaaaguuugcu

SEQ ID NO: 1086794 - RNA, 19 nt, Human
cauuuucccauaaaaacca

SEQ ID NO: 1086795 - RNA, 23 nt, Human
ccaaagugcugggauuacaggca

SEQ ID NO: 1086796 - RNA, 24 nt, Human
ccaaagugcugggauuacaggcau

SEQ ID NO: 1086797 - RNA, 22 nt, Human
ccacacugcaaacaucucccug

SEQ ID NO: 1086798 - RNA, 24 nt, Human
cccaaagugcugggauuacaggca

SEQ ID NO: 1086799 - RNA, 21 nt, Human
ccccaucgcuucuugcucuuc

SEQ ID NO: 1086800 - RNA, 25 nt, Human
ccgcccagcuggcuuucucuugcuc

SEQ ID NO: 1086801 - RNA, 22 nt, Human
ccuaccacggcuuagccacuga

SEQ ID NO: 1086802 - RNA, 22 nt, Human
ccuccuccuuucuauggggcag

SEQ ID NO: 1086803 - RNA, 21 nt, Human
cgaaagagaaggagaacagga

SEQ ID NO: 1086804 - RNA, 20 nt, Human
cucagaaucaaagauccaau

SEQ ID NO: 1086805 - RNA, 18 nt, Human
cuccacacugcaaacauc

SEQ ID NO: 1086806 - RNA, 21 nt, Human
cuccacacugcaaacaucucc

SEQ ID NO: 1086807 - RNA, 25 nt, Human
cuggaacaaaagcuaggagucugau

SEQ ID NO: 1086808 - RNA, 21 nt, Human
cuggcuuucucuugcucuuuc

SEQ ID NO: 1086809 - RNA, 23 nt, Human
gacaacaacaaucauagugcccc

SEQ ID NO: 1086810 - RNA, 18 nt, Human
gagaagaaagacgaaaga

SEQ ID NO: 1086811 - RNA, 19 nt, Human
gagaagaaagacgaaagag

SEQ ID NO: 1086812 - RNA, 18 nt, Human
gaggacaugggguucugc

SEQ ID NO: 1086813 - RNA, 21 nt, Human
gaggaggaaaaaaaagcauca

SEQ ID NO: 1086814 - RNA, 23 nt, Human
gagugagaagaaagacgaaagag

SEQ ID NO: 1086815 - RNA, 18 nt, Human
gauuacaggcaugagcca

SEQ ID NO: 1086816 - RNA, 21 nt, Human
gauuacaggcaugagccacug

SEQ ID NO: 1086817 - RNA, 24 nt, Human
gauuacaggcaugagccacugugc

SEQ ID NO: 1086818 - RNA, 23 nt, Human
gcaaagcaccuucagacuuuuug

SEQ ID NO: 1086819 - RNA, 24 nt, Human
ggagugagaagaaagacgaaagag

SEQ ID NO: 1086820 - RNA, 24 nt, Human
ggauuacaggcaugagccacugug

SEQ ID NO: 1086821 - RNA, 24 nt, Human
guagucuuuaaguggaucuguugu

SEQ ID NO: 1086822 - RNA, 23 nt, Human
gugacuggaugccucagcuuccu

SEQ ID NO: 1086823 - RNA, 20 nt, Human
guggaggaggaaaaaaaagc

SEQ ID NO: 1086824 - RNA, 21 nt, Human
uaaagugaacugcagccgccc

SEQ ID NO: 1086825 - RNA, 18 nt, Human
uaacaacaucacagaagu

SEQ ID NO: 1086826 - RNA, 19 nt, Human
uaacucagccgaucagcag

SEQ ID NO: 1086827 - RNA, 18 nt, Human
uaagaaauggaacuccaa

SEQ ID NO: 1086828 - RNA, 18 nt, Human
uaagaauaacaacaucac

SEQ ID NO: 1086829 - RNA, 24 nt, Human
uacaggcaugagccacugugccca

SEQ ID NO: 1086830 - RNA, 19 nt, Human
uaccacggcuuagccacug

SEQ ID NO: 1086831 - RNA, 19 nt, Human
uagagacuggcuuucugua

SEQ ID NO: 1086832 - RNA, 19 nt, Human
uagccacugacucuagaca

SEQ ID NO: 1086833 - RNA, 21 nt, Human
uagucauaaacucauuugucc

SEQ ID NO: 1086834 - RNA, 28 nt, Human
uagucuuuaaguggaucuguuguuucuc

SEQ ID NO: 1086835 - RNA, 19 nt, Human
uaugcaaauugcauaugua

SEQ ID NO: 1086836 - RNA, 19 nt, Human
uauguugcccaggcugguc

SEQ ID NO: 1086837 - RNA, 20 nt, Human
uauguugcccaggcuggucu

SEQ ID NO: 1086838 - RNA, 23 nt, Human
uauguugcccaggcuggucuuaa

SEQ ID NO: 1086839 - RNA, 24 nt, Human
uauguugcccaggcuggucuuaaa

SEQ ID NO: 1086840 - RNA, 21 nt, Human
ucacaggaguuauguaaauuu

SEQ ID NO: 1086841 - RNA, 18 nt, Human
ucagcagcugggugacug

SEQ ID NO: 1086842 - RNA, 26 nt, Human
uccacacugcaaacaucucccugggg

SEQ ID NO: 1086843 - RNA, 24 nt, Human
ucccaaagugcugggauuacaggc

SEQ ID NO: 1086844 - RNA, 21 nt, Human
uccccacuucauagagaccua

SEQ ID NO: 1086845 - RNA, 19 nt, Human
ucccugggguuggucagaa

SEQ ID NO: 1086846 - RNA, 18 nt, Human
uccuagaguuaagccucc

SEQ ID NO: 1086847 - RNA, 20 nt, Human
ucucaggauuaucacucuuc

SEQ ID NO: 1086848 - RNA, 19 nt, Human
ucuuauaauguuugcugcu

SEQ ID NO: 1086849 - RNA, 23 nt, Human
ucuucaauaauccauuuccauug

SEQ ID NO: 1086850 - RNA, 19 nt, Human
ugaacugcagccgcccagc

SEQ ID NO: 1086851 - RNA, 21 nt, Human
ugagggucaaagugaagcucu

SEQ ID NO: 1086852 - RNA, 18 nt, Human
ugaugccuucagggcugg

SEQ ID NO: 1086853 - RNA, 20 nt, Human
ugcagaaaaguccaaaaugu

SEQ ID NO: 1086854 - RNA, 18 nt, Human
ugcagugcuaaaccacag

SEQ ID NO: 1086855 - RNA, 21 nt, Human
ugcauuuucccauaaaaacca

SEQ ID NO: 1086856 - RNA, 24 nt, Human
ugcccaggcuggucuuaaacuccu

SEQ ID NO: 1086857 - RNA, 21 nt, Human
ugcuccucucucuuggcauca

SEQ ID NO: 1086858 - RNA, 20 nt, Human
uggaaagaacagaagaagga

SEQ ID NO: 1086859 - RNA, 24 nt, Human
uggaaagaacagaagaaggaaggu

SEQ ID NO: 1086860 - RNA, 18 nt, Human
ugggauccucucacuuca

SEQ ID NO: 1086861 - RNA, 18 nt, Human
ugggauuacaggcaugag

SEQ ID NO: 1086862 - RNA, 21 nt, Human
ugggauuacaggcaugagcca

SEQ ID NO: 1086863 - RNA, 22 nt, Human
ugggauuacaggcaugagccac

SEQ ID NO: 1086864 - RNA, 22 nt, Human
ugggauuacaggcaugagccac

SEQ ID NO: 1086865 - RNA, 22 nt, Human
ugggauuacaggcaugagccac

SEQ ID NO: 1086866 - RNA, 24 nt, Human
ugggauuacaggcaugagccacug

SEQ ID NO: 1086867 - RNA, 26 nt, Human
ugggauuacaggcaugagccacugug

SEQ ID NO: 1086868 - RNA, 19 nt, Human
ugguugcagaaaaguccaa

SEQ ID NO: 1086869 - RNA, 23 nt, Human
uguauguugcccaggcuggucuu

SEQ ID NO: 1086870 - RNA, 26 nt, Human
uguauguugcccaggcuggucuuaaa

SEQ ID NO: 1086871 - RNA, 19 nt, Human
ugugaggaacuccccauua

SEQ ID NO: 1086872 - RNA, 21 nt, Human
ugugaugccuucagggcuggg

SEQ ID NO: 1086873 - RNA, 24 nt, Human
uuacuacgggucuuugugucuuca

SEQ ID NO: 1086874 - RNA, 27 nt, Human
uuccccaucgcuucuugcucuucuuua

SEQ ID NO: 1086875 - RNA, 23 nt, Human
uuccuggggcccaccauaaagug

SEQ ID NO: 1086876 - RNA, 21 nt, Human
uucuggaacaaaagcuaggag

SEQ ID NO: 1086877 - RNA, 19 nt, Human
uugcagaaaaguccaaaau

SEQ ID NO: 1086878 - RNA, 19 nt, Human
uuuauagucauaaacucau

SEQ ID NO: 1086879 - RNA, 19 nt, Human
uuucaggguguuuucccca

SEQ ID NO: 1086880 - RNA, 18 nt, Human
uuucccauaaaaaccauu

SEQ ID NO: 1086881 - RNA, 22 nt, Human
uuucucaggauuaucacucuuc

SEQ ID NO: 1086882 - RNA, 23 nt, Human
uuucuguauguugcccaggcugg

SEQ ID NO: 1086883 - RNA, 23 nt, Human
agacaaaaaagcagcagagcuga

SEQ ID NO: 1086884 - RNA, 22 nt, Human
aggauguugcuuuggcuuguug

SEQ ID NO: 1086885 - RNA, 23 nt, Human
caaaaaagcagcagagcugaaag

SEQ ID NO: 1086886 - RNA, 21 nt, Human
caagacaaaaaagcagcagag

SEQ ID NO: 1086887 - RNA, 20 nt, Human
caccaagacaaaaaagcagc

SEQ ID NO: 1086888 - RNA, 22 nt, Human
caccaagacaaaaaagcagcag

SEQ ID NO: 1086889 - RNA, 21 nt, Human
ccaagacaaaaaagcagcaga

SEQ ID NO: 1086890 - RNA, 27 nt, Human
gacaaaaaagcagcagagcugaaagga

SEQ ID NO: 1086891 - RNA, 25 nt, Human
uccuccaccaagacaaaaaaggggg

SEQ ID NO: 1086892 - RNA, 24 nt, Human
ugcuuuggcuuguugacacccacu

SEQ ID NO: 1086893 - RNA, 20 nt, Human
aaaaccccaggcucagccag

SEQ ID NO: 1086894 - RNA, 21 nt, Human
aaaaggcugucacacugaccc

SEQ ID NO: 1086895 - RNA, 18 nt, Human
aaaccccaggcucagcca

SEQ ID NO: 1086896 - RNA, 19 nt, Human
aacccaagcacuaaaaagu

SEQ ID NO: 1086897 - RNA, 18 nt, Human
aagaggucagggaaauac

SEQ ID NO: 1086898 - RNA, 19 nt, Human
aagaggucagggaaauacc

SEQ ID NO: 1086899 - RNA, 20 nt, Human
aagggccugcacaaaguuua

SEQ ID NO: 1086900 - RNA, 19 nt, Human
aaguaucucucaauucuau

SEQ ID NO: 1086901 - RNA, 22 nt, Human
aaucccccacauuuaccaucac

SEQ ID NO: 1086902 - RNA, 23 nt, Human
aaugaaaaaacccaagcacuaaa

SEQ ID NO: 1086903 - RNA, 25 nt, Human
accaacaaaaucccccacauuuacc

SEQ ID NO: 1086904 - RNA, 19 nt, Human
accaucuuuauccguaugu

SEQ ID NO: 1086905 - RNA, 23 nt, Human
acccacucaccuguucucccccc

SEQ ID NO: 1086906 - RNA, 21 nt, Human
acccaugcacuccaguuccca

SEQ ID NO: 1086907 - RNA, 23 nt, Human
accuccuaaguaucucucaauuc

SEQ ID NO: 1086908 - RNA, 25 nt, Human
acucugagaaguccugccggaaagu

SEQ ID NO: 1086909 - RNA, 24 nt, Human
agaaagacacuaauaaucuacaaa

SEQ ID NO: 1086910 - RNA, 22 nt, Human
agacaaauagguacagggcaag

SEQ ID NO: 1086911 - RNA, 18 nt, Human
agagaggaaaagaagcug

SEQ ID NO: 1086912 - RNA, 19 nt, Human
agcacagcucucuacaacc

SEQ ID NO: 1086913 - RNA, 18 nt, Human
agcuaguucuagcaccca

SEQ ID NO: 1086914 - RNA, 18 nt, Human
aggcacauguuaguaucu

SEQ ID NO: 1086915 - RNA, 19 nt, Human
aggugcaaaaggcugucac

SEQ ID NO: 1086916 - RNA, 20 nt, Human
agugaaaggucagaaucuua

SEQ ID NO: 1086917 - RNA, 22 nt, Human
auaaacaaauuaagcaagggau

SEQ ID NO: 1086918 - RNA, 18 nt, Human
auccuuggcguuuuccuu

SEQ ID NO: 1086919 - RNA, 18 nt, Human
augguuggacacuggaga

SEQ ID NO: 1086920 - RNA, 22 nt, Human
caaaagcacucucccuggcucc

SEQ ID NO: 1086921 - RNA, 20 nt, Human
caaaaucccccacauuuacc

SEQ ID NO: 1086922 - RNA, 21 nt, Human
caagauaaauuaaauguagua

SEQ ID NO: 1086923 - RNA, 23 nt, Human
cacagcaggaccaagagagugga

SEQ ID NO: 1086924 - RNA, 24 nt, Human
cagacaacaccaaucaacaccucg

SEQ ID NO: 1086925 - RNA, 20 nt, Human
cagcagagagaggaaaagaa

SEQ ID NO: 1086926 - RNA, 23 nt, Human
caggcucagccagcagagagagg

SEQ ID NO: 1086927 - RNA, 21 nt, Human
cagugcccaaaagcacucucc

SEQ ID NO: 1086928 - RNA, 21 nt, Human
ccaacaaaaucccccacauuu

SEQ ID NO: 1086929 - RNA, 19 nt, Human
ccacauuuaccaucaccaa

SEQ ID NO: 1086930 - RNA, 19 nt, Human
ccacuuucaccaacaaaau

SEQ ID NO: 1086931 - RNA, 20 nt, Human
ccaugcacuccaguucccac

SEQ ID NO: 1086932 - RNA, 18 nt, Human
ccauucuaccuccuaagu

SEQ ID NO: 1086933 - RNA, 18 nt, Human
cccaaaagcacucucccu

SEQ ID NO: 1086934 - RNA, 18 nt, Human
cccaugcacuccaguucc

SEQ ID NO: 1086935 - RNA, 18 nt, Human
cccaugcacuccaguucc

SEQ ID NO: 1086936 - RNA, 19 nt, Human
cccaugcacuccaguuccc

SEQ ID NO: 1086937 - RNA, 20 nt, Human
ccccuuuucagcuccccuuc

SEQ ID NO: 1086938 - RNA, 22 nt, Human
ccccuuuucagcuccccuucca

SEQ ID NO: 1086939 - RNA, 23 nt, Human
cccgugccagcaccaaaguggcc

SEQ ID NO: 1086940 - RNA, 19 nt, Human
cccuagaugcugcugaagg

SEQ ID NO: 1086941 - RNA, 23 nt, Human
cccuagcuaaaccucauaacucc

SEQ ID NO: 1086942 - RNA, 21 nt, Human
ccuagcuaaaccucauaacuc

SEQ ID NO: 1086943 - RNA, 25 nt, Human
ccugcacccacucaccuguucuccc

SEQ ID NO: 1086944 - RNA, 25 nt, Human
ccugugaccauaaaaaccccaggcu

SEQ ID NO: 1086945 - RNA, 22 nt, Human
ccuuggcguuuuccuucccagg

SEQ ID NO: 1086946 - RNA, 21 nt, Human
cguuuuccuucccaggugcuc

SEQ ID NO: 1086947 - RNA, 19 nt, Human
cuaaaggagcacuguggca

SEQ ID NO: 1086948 - RNA, 21 nt, Human
cugaagcuuuagagguagugg

SEQ ID NO: 1086949 - RNA, 25 nt, Human
cugcucuuuccccuuuucagcuccc

SEQ ID NO: 1086950 - RNA, 22 nt, Human
cuuccagccacuuucaccaaca

SEQ ID NO: 1086951 - RNA, 19 nt, Human
cuucuacccaacacuucuc

SEQ ID NO: 1086952 - RNA, 20 nt, Human
cuuuccccuuuucagcuccc

SEQ ID NO: 1086953 - RNA, 22 nt, Human
gaaaaaacccaagcacuaaaaa

SEQ ID NO: 1086954 - RNA, 21 nt, Human
gaaagacacuaauaaucuaca

SEQ ID NO: 1086955 - RNA, 20 nt, Human
gacacuggagagaagcagcu

SEQ ID NO: 1086956 - RNA, 19 nt, Human
gagaguggaguccacccgu

SEQ ID NO: 1086957 - RNA, 25 nt, Human
gagggacagcuugacaguguagccu

SEQ ID NO: 1086958 - RNA, 20 nt, Human
gcagagagaggaaaagaagc

SEQ ID NO: 1086959 - RNA, 21 nt, Human
ggaaagacaaauagguacagg

SEQ ID NO: 1086960 - RNA, 24 nt, Human
gggugaaacacagcaggaccaaga

SEQ ID NO: 1086961 - RNA, 26 nt, Human
guaauaccuucucuaggcuuaagaua

SEQ ID NO: 1086962 - RNA, 22 nt, Human
uaaaaaccccaggcucagccag

SEQ ID NO: 1086963 - RNA, 23 nt, Human
uaaagcagccuuuucuaugcuga

SEQ ID NO: 1086964 - RNA, 18 nt, Human
uaaaggagcacuguggca

SEQ ID NO: 1086965 - RNA, 21 nt, Human
uaacccuagcuaaaccucaua

SEQ ID NO: 1086966 - RNA, 24 nt, Human
uaacuccuuaaugagaaagacacu

SEQ ID NO: 1086967 - RNA, 23 nt, Human
uaaguaucucucaauucuaucuc

SEQ ID NO: 1086968 - RNA, 19 nt, Human
uaagugauccacagacagg

SEQ ID NO: 1086969 - RNA, 22 nt, Human
uacaaaugaaaaaacccaagca

SEQ ID NO: 1086970 - RNA, 23 nt, Human
uacaaaugaaaaaacccaagcac

SEQ ID NO: 1086971 - RNA, 24 nt, Human
uacaccauguuuauugcuauuuaa

SEQ ID NO: 1086972 - RNA, 22 nt, Human
uagccuuggaaggaguccagcu

SEQ ID NO: 1086973 - RNA, 19 nt, Human
uaguaccagcucuucucca

SEQ ID NO: 1086974 - RNA, 22 nt, Human
uaguuugagaaaacacuaugcu

SEQ ID NO: 1086975 - RNA, 22 nt, Human
ucagagggacagcuugacagug

SEQ ID NO: 1086976 - RNA, 24 nt, Human
ucagcuccccuuccagccacuuuc

SEQ ID NO: 1086977 - RNA, 22 nt, Human
ucccucacauuuucacugcccu

SEQ ID NO: 1086978 - RNA, 21 nt, Human
ucccuggcuccugcacccacu

SEQ ID NO: 1086979 - RNA, 25 nt, Human
ucccuggcuccugcacccacucacc

SEQ ID NO: 1086980 - RNA, 20 nt, Human
uccuaaguaucucucaauuc

SEQ ID NO: 1086981 - RNA, 18 nt, Human
ucuccauggagcacagcc

SEQ ID NO: 1086982 - RNA, 20 nt, Human
ucuccccccgcucccacaag

SEQ ID NO: 1086983 - RNA, 23 nt, Human
ugaaaaaacccaagcacuaaaaa

SEQ ID NO: 1086984 - RNA, 24 nt, Human
ugaaaaaacccaagcacuaaaaag

SEQ ID NO: 1086985 - RNA, 27 nt, Human
ugaaaagggaaagacaaauagguacag

SEQ ID NO: 1086986 - RNA, 22 nt, Human
ugaccagacuccaggggaaguu

SEQ ID NO: 1086987 - RNA, 22 nt, Human
ugaccauaaaaaccccaggcuc

SEQ ID NO: 1086988 - RNA, 22 nt, Human
ugagaaaacacuaugcuacaag

SEQ ID NO: 1086989 - RNA, 18 nt, Human
ugagaaagacacuaauaa

SEQ ID NO: 1086990 - RNA, 19 nt, Human
ugaggaaaaacuaugguug

SEQ ID NO: 1086991 - RNA, 24 nt, Human
ugaggaaaaacuaugguuggacac

SEQ ID NO: 1086992 - RNA, 22 nt, Human
ugcaaaaggcugucacacugac

SEQ ID NO: 1086993 - RNA, 18 nt, Human
ugcccuaauucugagccu

SEQ ID NO: 1086994 - RNA, 23 nt, Human
uggacacuggagagaagcagcuu

SEQ ID NO: 1086995 - RNA, 20 nt, Human
uggaugaggaaaaacuaugg

SEQ ID NO: 1086996 - RNA, 21 nt, Human
uggcuccugcacccacucacc

SEQ ID NO: 1086997 - RNA, 24 nt, Human
uguccaagcuucccagcuagaaac

SEQ ID NO: 1086998 - RNA, 23 nt, Human
uuaagcacagcucucuacaaccu

SEQ ID NO: 1086999 - RNA, 24 nt, Human
uuccagacaacaccaaucaacacc

SEQ ID NO: 1087000 - RNA, 25 nt, Human
uucucuaggcuuaagauaauaaaca

SEQ ID NO: 1087001 - RNA, 24 nt, Human
uuuagagguagugggcacuccccu

SEQ ID NO: 1087002 - RNA, 18 nt, Human
uuuauuuuucccuuuuuu

SEQ ID NO: 1087003 - RNA, 20 nt, Human
uuuccuucccaggugcucag

SEQ ID NO: 1087004 - RNA, 24 nt, Human
aaaaagagaggagauauccacaaa

SEQ ID NO: 1087005 - RNA, 19 nt, Human
aaaagccuagacuuuccac

SEQ ID NO: 1087006 - RNA, 21 nt, Human
aaacaggcaccauggagaaca

SEQ ID NO: 1087007 - RNA, 20 nt, Human
aaacuuggagaaaaguagag

SEQ ID NO: 1087008 - RNA, 21 nt, Human
aaagcaggaaaaauacaaaga

SEQ ID NO: 1087009 - RNA, 22 nt, Human
aacaccaaccacacguccaccu

SEQ ID NO: 1087010 - RNA, 18 nt, Human
aagaagacagaagaaaca

SEQ ID NO: 1087011 - RNA, 19 nt, Human
aagaagacagaagaaacag

SEQ ID NO: 1087012 - RNA, 21 nt, Human
aagaagacagaagaaacagaa

SEQ ID NO: 1087013 - RNA, 22 nt, Human
aagagaggagauauccacaaau

SEQ ID NO: 1087014 - RNA, 24 nt, Human
aagcaaaaagagaggagauaucca

SEQ ID NO: 1087015 - RNA, 21 nt, Human
aagcaaaagccuagacuuucc

SEQ ID NO: 1087016 - RNA, 22 nt, Human
aagcaaaggcuaggagaucaaa

SEQ ID NO: 1087017 - RNA, 18 nt, Human
aagcaggaaaaauacaaa

SEQ ID NO: 1087018 - RNA, 23 nt, Human
aagcaggaaaaauacaaagaaaa

SEQ ID NO: 1087019 - RNA, 18 nt, Human
aagugcccugccccagga

SEQ ID NO: 1087020 - RNA, 19 nt, Human
acaaagcaaaaagagagga

SEQ ID NO: 1087021 - RNA, 21 nt, Human
acaaagcaaaaagagaggaga

SEQ ID NO: 1087022 - RNA, 24 nt, Human
acaauacuagcaaacacauagcac

SEQ ID NO: 1087023 - RNA, 19 nt, Human
accaacuaccccaccuaug

SEQ ID NO: 1087024 - RNA, 20 nt, Human
accaacuaccccaccuaugc

SEQ ID NO: 1087025 - RNA, 24 nt, Human
accaacuaccccaccuaugcaugc

SEQ ID NO: 1087026 - RNA, 22 nt, Human
acccccaugcuccuccccaagc

SEQ ID NO: 1087027 - RNA, 18 nt, Human
agaaacugagaaggggcu

SEQ ID NO: 1087028 - RNA, 18 nt, Human
agagaggagauauccaca

SEQ ID NO: 1087029 - RNA, 18 nt, Human
agaggaaaaccaucuaca

SEQ ID NO: 1087030 - RNA, 24 nt, Human
agcaaaaagagaggagauauccac

SEQ ID NO: 1087031 - RNA, 24 nt, Human
agcagaagauaaaugagaacagaa

SEQ ID NO: 1087032 - RNA, 18 nt, Human
agccacugggagggacug

SEQ ID NO: 1087033 - RNA, 21 nt, Human
aggaaccaugaaagaugaggc

SEQ ID NO: 1087034 - RNA, 21 nt, Human
aggagaucaaacaucuaaaac

SEQ ID NO: 1087035 - RNA, 21 nt, Human
aggggagagguuuacucuuca

SEQ ID NO: 1087036 - RNA, 19 nt, Human
aucaaccaacuaccccacc

SEQ ID NO: 1087037 - RNA, 23 nt, Human
aucuuacaccuccucucccuucc

SEQ ID NO: 1087038 - RNA, 24 nt, Human
aucuuacaccuccucucccuucca

SEQ ID NO: 1087039 - RNA, 23 nt, Human
auguaaaacauccuguaacauau

SEQ ID NO: 1087040 - RNA, 19 nt, Human
augugcaccucccaggccu

SEQ ID NO: 1087041 - RNA, 18 nt, Human
caagggaaagaaaucugu

SEQ ID NO: 1087042 - RNA, 23 nt, Human
caagugcccugccccaggauuca

SEQ ID NO: 1087043 - RNA, 24 nt, Human
caauacuagcaaacacauagcaca

SEQ ID NO: 1087044 - RNA, 18 nt, Human
cacacccuucagggaccc

SEQ ID NO: 1087045 - RNA, 18 nt, Human
caccauggagaacagagc

SEQ ID NO: 1087046 - RNA, 18 nt, Human
caccauggagaacagagc

SEQ ID NO: 1087047 - RNA, 21 nt, Human
cacccagaacaccaaccacac

SEQ ID NO: 1087048 - RNA, 24 nt, Human
caccuccacaggcaggagauucaa

SEQ ID NO: 1087049 - RNA, 20 nt, Human
caccuccucucccuuccaaa

SEQ ID NO: 1087050 - RNA, 20 nt, Human
cacggcacagggcaucugca

SEQ ID NO: 1087051 - RNA, 18 nt, Human
cagaacaccaaccacacg

SEQ ID NO: 1087052 - RNA, 24 nt, Human
cagaacaccaaccacacguccacc

SEQ ID NO: 1087053 - RNA, 23 nt, Human
cagaagaaacagaagcucgccac

SEQ ID NO: 1087054 - RNA, 22 nt, Human
cagaaggagcuagaagggaaau

SEQ ID NO: 1087055 - RNA, 25 nt, Human
cagcacaggcguaggcuuggagaaa

SEQ ID NO: 1087056 - RNA, 22 nt, Human
ccaagcagcagcagaagauaaa

SEQ ID NO: 1087057 - RNA, 22 nt, Human
cccaagcaggggagagguuuac

SEQ ID NO: 1087058 - RNA, 19 nt, Human
cccaguagcccagcccucg

SEQ ID NO: 1087059 - RNA, 19 nt, Human
cccauguuaugcagccagg

SEQ ID NO: 1087060 - RNA, 26 nt, Human
ccuccacaggcaggagauucaagggu

SEQ ID NO: 1087061 - RNA, 26 nt, Human
ccucccaggccugaagcaaaagccua

SEQ ID NO: 1087062 - RNA, 19 nt, Human
cuacuaagcccauguuaug

SEQ ID NO: 1087063 - RNA, 22 nt, Human
cucccaggccugaagcaaaagc

SEQ ID NO: 1087064 - RNA, 26 nt, Human
cucccaggccugaagcaaaagccuag

SEQ ID NO: 1087065 - RNA, 21 nt, Human
cuccuccccaagcaggggaga

SEQ ID NO: 1087066 - RNA, 24 nt, Human
cugaagcaaaagccuagacuuucc

SEQ ID NO: 1087067 - RNA, 21 nt, Human
cugacaagaagacagaagaaa

SEQ ID NO: 1087068 - RNA, 22 nt, Human
cugacagacaccccaguagccc

SEQ ID NO: 1087069 - RNA, 23 nt, Human
cugagcugcacggcacagggcau

SEQ ID NO: 1087070 - RNA, 19 nt, Human
cuggacugacagacacccc

SEQ ID NO: 1087071 - RNA, 19 nt, Human
cugguucaugauggaaaac

SEQ ID NO: 1087072 - RNA, 22 nt, Human
cuuacaccuccucucccuucca

SEQ ID NO: 1087073 - RNA, 24 nt, Human
cuuacaccuccucucccuuccaaa

SEQ ID NO: 1087074 - RNA, 19 nt, Human
gagaaaaccaaccaccuga

SEQ ID NO: 1087075 - RNA, 27 nt, Human
gagaaaaguagaggaaagccgguaccc

SEQ ID NO: 1087076 - RNA, 24 nt, Human
gagaacagaaggagcuagaaggga

SEQ ID NO: 1087077 - RNA, 19 nt, Human
gaggacaaagcaaaaagag

SEQ ID NO: 1087078 - RNA, 20 nt, Human
gauaaaugagaacagaagga

SEQ ID NO: 1087079 - RNA, 21 nt, Human
gcagacccaggaaacaggcac

SEQ ID NO: 1087080 - RNA, 23 nt, Human
gcagacccaggaaacaggcacca

SEQ ID NO: 1087081 - RNA, 24 nt, Human
ggaaaaauacaaagaaaagcaaag

SEQ ID NO: 1087082 - RNA, 18 nt, Human
ggagaaaaguagaggaaa

SEQ ID NO: 1087083 - RNA, 18 nt, Human
ggagcuagaagggaaaug

SEQ ID NO: 1087084 - RNA, 19 nt, Human
ggcacaggaaccaugaaag

SEQ ID NO: 1087085 - RNA, 22 nt, Human
ggcaggagauucaaggguucuu

SEQ ID NO: 1087086 - RNA, 23 nt, Human
gggcacccagaacaccaaccaca

SEQ ID NO: 1087087 - RNA, 19 nt, Human
gggccaggcauuuacauua

SEQ ID NO: 1087088 - RNA, 23 nt, Human
ggucucacacccuucagggaccc

SEQ ID NO: 1087089 - RNA, 20 nt, Human
guagaagaucuuugccaagg

SEQ ID NO: 1087090 - RNA, 20 nt, Human
guggaggaaacuugagaaca

SEQ ID NO: 1087091 - RNA, 26 nt, Human
uaaaacauccuguaacauaucuuagu

SEQ ID NO: 1087092 - RNA, 23 nt, Human
uaaaacguuuuaaccuaugagga

SEQ ID NO: 1087093 - RNA, 23 nt, Human
uaaaugagaacagaaggagcuag

SEQ ID NO: 1087094 - RNA, 20 nt, Human
uaacccccaugcuccucccc

SEQ ID NO: 1087095 - RNA, 21 nt, Human
uaaccuaugaggacaaagcaa

SEQ ID NO: 1087096 - RNA, 24 nt, Human
uaaccuaugaggacaaagcaaaaa

SEQ ID NO: 1087097 - RNA, 19 nt, Human
uaacuccaagcagcagcag

SEQ ID NO: 1087098 - RNA, 22 nt, Human
uaagaccaagagaauguaaaac

SEQ ID NO: 1087099 - RNA, 18 nt, Human
uaagaggaauguuuggua

SEQ ID NO: 1087100 - RNA, 19 nt, Human
uacaaagaaaagcaaaggc

SEQ ID NO: 1087101 - RNA, 23 nt, Human
uacaccuccucucccuuccaaaa

SEQ ID NO: 1087102 - RNA, 25 nt, Human
uacguaacccccaugcuccucccca

SEQ ID NO: 1087103 - RNA, 22 nt, Human
uccaaaacccuacuaaauuucc

SEQ ID NO: 1087104 - RNA, 24 nt, Human
uccaacaaaaaaagauagcucaaa

SEQ ID NO: 1087105 - RNA, 23 nt, Human
uccaagcagcagcagaagauaaa

SEQ ID NO: 1087106 - RNA, 23 nt, Human
ucucuggagaaaaccaaccaccu

SEQ ID NO: 1087107 - RNA, 19 nt, Human
ucuuaguagaagaucuuug

SEQ ID NO: 1087108 - RNA, 18 nt, Human
ugaagcaaaagccuagac

SEQ ID NO: 1087109 - RNA, 20 nt, Human
ugacaagaagacagaagaaa

SEQ ID NO: 1087110 - RNA, 22 nt, Human
ugacagacaccccaguagccca

SEQ ID NO: 1087111 - RNA, 24 nt, Human
ugacagacaccccaguagcccagc

SEQ ID NO: 1087112 - RNA, 24 nt, Human
ugagaacaaagccaucuggacuga

SEQ ID NO: 1087113 - RNA, 22 nt, Human
ugagagccuuugguucagagag

SEQ ID NO: 1087114 - RNA, 21 nt, Human
ugagaggaaaaccaucuacau

SEQ ID NO: 1087115 - RNA, 20 nt, Human
ugaggacaaagcaaaaagag

SEQ ID NO: 1087116 - RNA, 22 nt, Human
ugcagccaggcuacuacguaac

SEQ ID NO: 1087117 - RNA, 25 nt, Human
uggauaaacucaggccauacgucuu

SEQ ID NO: 1087118 - RNA, 19 nt, Human
ugggagggacuguuucaug

SEQ ID NO: 1087119 - RNA, 18 nt, Human
uucaugugcaccucccag

SEQ ID NO: 1087120 - RNA, 19 nt, Human
uugcugaaaauguaacucc

SEQ ID NO: 1087121 - RNA, 18 nt, Human
aaacgaaagcaaaccaga

SEQ ID NO: 1087122 - RNA, 19 nt, Human
agagguagaaguuuuuucc

SEQ ID NO: 1087123 - RNA, 23 nt, Human
agcaggacagaaaaacccagagc

SEQ ID NO: 1087124 - RNA, 18 nt, Human
cagcaggacagaaaaacc

SEQ ID NO: 1087125 - RNA, 22 nt, Human
cagcaggacagaaaaacccaga

SEQ ID NO: 1087126 - RNA, 22 nt, Human
cagccuuuucagcagaggaagg

SEQ ID NO: 1087127 - RNA, 21 nt, Human
ccagagcccugauugugccca

SEQ ID NO: 1087128 - RNA, 18 nt, Human
ccauuguccaaugacugc

SEQ ID NO: 1087129 - RNA, 18 nt, Human
cccagagcccugauugug

SEQ ID NO: 1087130 - RNA, 23 nt, Human
ccugccucuuccuccuuucuucc

SEQ ID NO: 1087131 - RNA, 20 nt, Human
cuccacacccuuucuccucc

SEQ ID NO: 1087132 - RNA, 24 nt, Human
cugcuaauaggcaaggcccucccu

SEQ ID NO: 1087133 - RNA, 20 nt, Human
gagguagaaguuuuuuccau

SEQ ID NO: 1087134 - RNA, 18 nt, Human
gcaaaccagagguagaag

SEQ ID NO: 1087135 - RNA, 24 nt, Human
gcgggagggugaugacugcauuga

SEQ ID NO: 1087136 - RNA, 23 nt, Human
ggaaaagcagccuuuucagcaga

SEQ ID NO: 1087137 - RNA, 22 nt, Human
gugcagcaggacagaaaaaccc

SEQ ID NO: 1087138 - RNA, 19 nt, Human
guggaaaagcagccuuuuc

SEQ ID NO: 1087139 - RNA, 23 nt, Human
uaauaggcaaggcccucccuucc

SEQ ID NO: 1087140 - RNA, 23 nt, Human
ucaacuggaaucagagcuaaggc

SEQ ID NO: 1087141 - RNA, 18 nt, Human
ugcuaauaggcaaggccc

SEQ ID NO: 1087142 - RNA, 23 nt, Human
ugugcagcaggacagaaaaaccc

SEQ ID NO: 1087143 - RNA, 19 nt, Human
agacaagaaaaaaaaacug

SEQ ID NO: 1087144 - RNA, 22 nt, Human
caaaaaaugcauaugaugacau

SEQ ID NO: 1087145 - RNA, 19 nt, Human
cagcuucuuaggaucuccu

SEQ ID NO: 1087146 - RNA, 19 nt, Human
cauaugaugacauuuugcc

SEQ ID NO: 1087147 - RNA, 24 nt, Human
cguuugcacaaaaaaugcauaugg

SEQ ID NO: 1087148 - RNA, 23 nt, Human
cuucuucuuaugcuccucccgac

SEQ ID NO: 1087149 - RNA, 18 nt, Human
gcccguccggcucucacu

SEQ ID NO: 1087150 - RNA, 20 nt, Human
uauagacaagaaaaaaaaac

SEQ ID NO: 1087151 - RNA, 21 nt, Human
ucuccuuugcccauguuuagu

SEQ ID NO: 1087152 - RNA, 20 nt, Human
ugcccuggcgcugucucugu

SEQ ID NO: 1087153 - RNA, 21 nt, Human
uucauagcaagagccuuuuuc

SEQ ID NO: 1087154 - RNA, 20 nt, Human
aaccagcuugugaggcauuc

SEQ ID NO: 1087155 - RNA, 21 nt, Human
aagacuucagggagaggccgg

SEQ ID NO: 1087156 - RNA, 21 nt, Human
aauguggaguguggggaggga

SEQ ID NO: 1087157 - RNA, 21 nt, Human
agggcuucaacauaugaaugu

SEQ ID NO: 1087158 - RNA, 18 nt, Human
agugaccucauuuuaaug

SEQ ID NO: 1087159 - RNA, 20 nt, Human
aucuccaaauacagugacau

SEQ ID NO: 1087160 - RNA, 27 nt, Human
augacauucccagagcaauuuggucgg

SEQ ID NO: 1087161 - RNA, 22 nt, Human
auuucgccuccucagcucuuca

SEQ ID NO: 1087162 - RNA, 18 nt, Human
caauaauuagaaugacau

SEQ ID NO: 1087163 - RNA, 20 nt, Human
ccaauaauuagaaugacauu

SEQ ID NO: 1087164 - RNA, 18 nt, Human
ccucuccagcuccccaca

SEQ ID NO: 1087165 - RNA, 21 nt, Human
cuccaaauacagugacauucu

SEQ ID NO: 1087166 - RNA, 20 nt, Human
cuccccacagcacagcuacc

SEQ ID NO: 1087167 - RNA, 21 nt, Human
cuguucacauuguuauucaau

SEQ ID NO: 1087168 - RNA, 20 nt, Human
cuucagggagaggccgguga

SEQ ID NO: 1087169 - RNA, 19 nt, Human
gacuucagggagaggccgg

SEQ ID NO: 1087170 - RNA, 19 nt, Human
ggugagcccuuuuaacugc

SEQ ID NO: 1087171 - RNA, 23 nt, Human
uaccuggaggacacaggcucccg

SEQ ID NO: 1087172 - RNA, 21 nt, Human
uaccuggaggacacaggcuuc

SEQ ID NO: 1087173 - RNA, 20 nt, Human
ucaacauaugaauguggagu

SEQ ID NO: 1087174 - RNA, 18 nt, Human
ucagggagaggccgguga

SEQ ID NO: 1087175 - RNA, 20 nt, Human
ucaguccucuccagcucccc

SEQ ID NO: 1087176 - RNA, 24 nt, Human
ucccagagcaauuuggucggagcg

SEQ ID NO: 1087177 - RNA, 19 nt, Human
uccccacagcacagcuacc

SEQ ID NO: 1087178 - RNA, 19 nt, Human
uccucagcucuucaguccu

SEQ ID NO: 1087179 - RNA, 22 nt, Human
ucggugcucuguucacauuguu

SEQ ID NO: 1087180 - RNA, 24 nt, Human
ugaccucauuuuaauguaaugacc

SEQ ID NO: 1087181 - RNA, 24 nt, Human
ugcauuucgccuccucagcucuuc

SEQ ID NO: 1087182 - RNA, 23 nt, Human
ugcucuguucacauuguuauuca

SEQ ID NO: 1087183 - RNA, 21 nt, Human
uggaggacacaggcucccggg

SEQ ID NO: 1087184 - RNA, 20 nt, Human
ugggucaggauccaauaauu

SEQ ID NO: 1087185 - RNA, 18 nt, Human
uguaaugaccucuuuaaa

SEQ ID NO: 1087186 - RNA, 23 nt, Human
uguaucuccaaauacagugacau

SEQ ID NO: 1087187 - RNA, 21 nt, Human
uucaacauaugaauguggagu

SEQ ID NO: 1087188 - RNA, 21 nt, Human
uucaguccucuccagcucccc

SEQ ID NO: 1087189 - RNA, 22 nt, Human
uucugcauuucgccuccucagc

SEQ ID NO: 1087190 - RNA, 19 nt, Human
acagggcagauggaagaag

SEQ ID NO: 1087191 - RNA, 18 nt, Human
agacagggcagauggaag

SEQ ID NO: 1087192 - RNA, 25 nt, Human
agauguuguuucaguugcuuccucu

SEQ ID NO: 1087193 - RNA, 22 nt, Human
agugccuuuaagccacccccau

SEQ ID NO: 1087194 - RNA, 25 nt, Human
caaggacagauuuuuccuggagaag

SEQ ID NO: 1087195 - RNA, 21 nt, Human
cccacacgagcccaaugaggu

SEQ ID NO: 1087196 - RNA, 22 nt, Human
cuccacuucaaauuucccaaga

SEQ ID NO: 1087197 - RNA, 20 nt, Human
cucgugccgcgcucucagac

SEQ ID NO: 1087198 - RNA, 22 nt, Human
gggcaguguuuuccguagccuc

SEQ ID NO: 1087199 - RNA, 20 nt, Human
ggguucuuggagagacaggg

SEQ ID NO: 1087200 - RNA, 18 nt, Human
ucagcucuguucugagac

SEQ ID NO: 1087201 - RNA, 18 nt, Human
uggaagaaguggaaggca

SEQ ID NO: 1087202 - RNA, 19 nt, Human
uggaaggcaucugcacacu

SEQ ID NO: 1087203 - RNA, 19 nt, Human
uggagaaggauuuuaccac

SEQ ID NO: 1087204 - RNA, 18 nt, Human
uggaguguaggagggcag

SEQ ID NO: 1087205 - RNA, 19 nt, Human
ugguacagguacuccacuu

SEQ ID NO: 1087206 - RNA, 20 nt, Human
uucugcacucagcucuguuc

SEQ ID NO: 1087207 - RNA, 24 nt, Human
uucuuggagagacagggcagaugg

SEQ ID NO: 1087208 - RNA, 21 nt, Human
uugccugaguuguuuuccuuu

SEQ ID NO: 1087209 - RNA, 18 nt, Human
uugcuuccucuuugguuc

SEQ ID NO: 1087210 - RNA, 23 nt, Human
uuuaccacugccaccaucuugaa

SEQ ID NO: 1087211 - RNA, 18 nt, Human
uuucauguugguacaggu

SEQ ID NO: 1087212 - RNA, 23 nt, Human
uuuucugggucucuccaaggugg

SEQ ID NO: 1087213 - RNA, 27 nt, Human
aaaaagccuauuaaauaagaaacaaac

SEQ ID NO: 1087214 - RNA, 22 nt, Human
aaacaaaaugcacuaagcaaaa

SEQ ID NO: 1087215 - RNA, 24 nt, Human
aaacaaacacugcaaucauaaaca

SEQ ID NO: 1087216 - RNA, 23 nt, Human
aacuaguccagcaacuggcacuc

SEQ ID NO: 1087217 - RNA, 22 nt, Human
aaugcaaaauaaaaaaaaaaaa

SEQ ID NO: 1087218 - RNA, 22 nt, Human
accacaaucugucaaacccgcc

SEQ ID NO: 1087219 - RNA, 20 nt, Human
acgcugcagccaacggccuu

SEQ ID NO: 1087220 - RNA, 22 nt, Human
acuaggcccucccucugggccu

SEQ ID NO: 1087221 - RNA, 21 nt, Human
agagaacauccucaaagcuca

SEQ ID NO: 1087222 - RNA, 23 nt, Human
agagaacauccucaaagcucaag

SEQ ID NO: 1087223 - RNA, 24 nt, Human
agguaacaaaauuucuccaguuau

SEQ ID NO: 1087224 - RNA, 22 nt, Human
aguaaagcuaauauucucagac

SEQ ID NO: 1087225 - RNA, 23 nt, Human
auaaacaaaaugcacuaagcaaa

SEQ ID NO: 1087226 - RNA, 20 nt, Human
auaaaggucuaguucaugag

SEQ ID NO: 1087227 - RNA, 21 nt, Human
caaacuccagcggaagcacua

SEQ ID NO: 1087228 - RNA, 19 nt, Human
caacuauguauuuuucuua

SEQ ID NO: 1087229 - RNA, 19 nt, Human
cacucagcuccccgcacag

SEQ ID NO: 1087230 - RNA, 20 nt, Human
cacucccccagccccucagg

SEQ ID NO: 1087231 - RNA, 20 nt, Human
cacugucacucccccagccc

SEQ ID NO: 1087232 - RNA, 21 nt, Human
cagaauuuucccuuuauaaag

SEQ ID NO: 1087233 - RNA, 22 nt, Human
cagagaacauccucaaagcuca

SEQ ID NO: 1087234 - RNA, 22 nt, Human
cagagagaaaacaaugcacuuc

SEQ ID NO: 1087235 - RNA, 18 nt, Human
cagcauugauagaagccc

SEQ ID NO: 1087236 - RNA, 20 nt, Human
cagcugcucagagagaaaac

SEQ ID NO: 1087237 - RNA, 22 nt, Human
cagggcacaucacucagcuccc

SEQ ID NO: 1087238 - RNA, 18 nt, Human
caugccaccagcucccca

SEQ ID NO: 1087239 - RNA, 22 nt, Human
ccaaaacccagagacacugacu

SEQ ID NO: 1087240 - RNA, 21 nt, Human
ccacugucacucccccagccc

SEQ ID NO: 1087241 - RNA, 25 nt, Human
ccauccguccugccacugucacucc

SEQ ID NO: 1087242 - RNA, 24 nt, Human
cccccagccccucaggauugcugc

SEQ ID NO: 1087243 - RNA, 18 nt, Human
ccccucaggauugcugcu

SEQ ID NO: 1087244 - RNA, 23 nt, Human
ccccucaggauugcugcuccucu

SEQ ID NO: 1087245 - RNA, 21 nt, Human
cccucaggauugcugcuccuc

SEQ ID NO: 1087246 - RNA, 18 nt, Human
cccuccucuucuuuuauc

SEQ ID NO: 1087247 - RNA, 21 nt, Human
cccuuuauaaaggaaaucaaa

SEQ ID NO: 1087248 - RNA, 19 nt, Human
ccuauuaaauaagaaacaa

SEQ ID NO: 1087249 - RNA, 21 nt, Human
ccuccaagcagaaaauccuga

SEQ ID NO: 1087250 - RNA, 22 nt, Human
ccugaacuaagacaacagucuc

SEQ ID NO: 1087251 - RNA, 20 nt, Human
ccuguauaaagcuggaaaac

SEQ ID NO: 1087252 - RNA, 24 nt, Human
cgcuguaucugcuaccaaaaccca

SEQ ID NO: 1087253 - RNA, 23 nt, Human
cggaagcacuaguguuagugcug

SEQ ID NO: 1087254 - RNA, 20 nt, Human
cuccagcggaagcacuagug

SEQ ID NO: 1087255 - RNA, 20 nt, Human
cugaaaaaugcaggucugca

SEQ ID NO: 1087256 - RNA, 23 nt, Human
cugcuaccaaaacccagagacac

SEQ ID NO: 1087257 - RNA, 19 nt, Human
cugcucagagagaaaacaa

SEQ ID NO: 1087258 - RNA, 18 nt, Human
cuguauaaagcuggaaaa

SEQ ID NO: 1087259 - RNA, 19 nt, Human
cuguaucugcuaccaaaac

SEQ ID NO: 1087260 - RNA, 19 nt, Human
cugucuggaagcugaaaga

SEQ ID NO: 1087261 - RNA, 22 nt, Human
cuucuucccaccacaaucuguc

SEQ ID NO: 1087262 - RNA, 21 nt, Human
gaggagugccagacaaucuuu

SEQ ID NO: 1087263 - RNA, 20 nt, Human
gauuugccagaauuuucccu

SEQ ID NO: 1087264 - RNA, 23 nt, Human
gccacugucacucccccagcccc

SEQ ID NO: 1087265 - RNA, 22 nt, Human
ggaagcacuaguguuagugcug

SEQ ID NO: 1087266 - RNA, 22 nt, Human
ggccuuggggcagagcccaugg

SEQ ID NO: 1087267 - RNA, 22 nt, Human
uaaaaagccuauuaaauaagaa

SEQ ID NO: 1087268 - RNA, 24 nt, Human
uaaacauggggguucacugauauc

SEQ ID NO: 1087269 - RNA, 22 nt, Human
uaacaaaugcaaaauaaaaaaa

SEQ ID NO: 1087270 - RNA, 27 nt, Human
uaacaaaugcaaaauaaaaaaaaaaaa

SEQ ID NO: 1087271 - RNA, 20 nt, Human
uaauaguaaaggcacgauuu

SEQ ID NO: 1087272 - RNA, 22 nt, Human
uaccaaaacccagagacacuga

SEQ ID NO: 1087273 - RNA, 23 nt, Human
uagcuuauacuagagagcaacac

SEQ ID NO: 1087274 - RNA, 22 nt, Human
uaggcccucccucugggccucc

SEQ ID NO: 1087275 - RNA, 21 nt, Human
uauuauacagccagucaggca

SEQ ID NO: 1087276 - RNA, 24 nt, Human
ucagcuccccgcacagcugcucag

SEQ ID NO: 1087277 - RNA, 20 nt, Human
uccaccagcuccagugaagc

SEQ ID NO: 1087278 - RNA, 23 nt, Human
ucccagggcacaucacucagcuc

SEQ ID NO: 1087279 - RNA, 18 nt, Human
uccccaaaagacaucaac

SEQ ID NO: 1087280 - RNA, 20 nt, Human
uccccaaaagacaucaacug

SEQ ID NO: 1087281 - RNA, 20 nt, Human
uccugccacugucacucccc

SEQ ID NO: 1087282 - RNA, 19 nt, Human
ucuacagagcagcaaauau

SEQ ID NO: 1087283 - RNA, 19 nt, Human
ucucacauaauaucagggc

SEQ ID NO: 1087284 - RNA, 22 nt, Human
ucugcuaccaaaacccagagac

SEQ ID NO: 1087285 - RNA, 23 nt, Human
ugaaaaaugcaggucugcaaaga

SEQ ID NO: 1087286 - RNA, 21 nt, Human
ugaaaugugauugagaagaaa

SEQ ID NO: 1087287 - RNA, 25 nt, Human
ugacuagaucuaaagagcauaugga

SEQ ID NO: 1087288 - RNA, 22 nt, Human
ugagaagaaaauguuaacgcug

SEQ ID NO: 1087289 - RNA, 21 nt, Human
ugauguguggcuagcccaaaa

SEQ ID NO: 1087290 - RNA, 22 nt, Human
ugcaaaauaaaaaaaaaaaagc

SEQ ID NO: 1087291 - RNA, 23 nt, Human
ugccacugucacucccccagccc

SEQ ID NO: 1087292 - RNA, 23 nt, Human
ugcugcuccucucuucugaaugu

SEQ ID NO: 1087293 - RNA, 21 nt, Human
uggcuauguuagcuuuaaaca

SEQ ID NO: 1087294 - RNA, 22 nt, Human
uggcuauguuagcuuuaaacau

SEQ ID NO: 1087295 - RNA, 18 nt, Human
uggggcagagcccaugga

SEQ ID NO: 1087296 - RNA, 23 nt, Human
uggggcagagcccauggaaagcu

SEQ ID NO: 1087297 - RNA, 27 nt, Human
uguauaacaucaauaacuccuguuugu

SEQ ID NO: 1087298 - RNA, 23 nt, Human
ugucacucccccagccccucagg

SEQ ID NO: 1087299 - RNA, 28 nt, Human
uuacacagugacaguacccgccucuucu

SEQ ID NO: 1087300 - RNA, 19 nt, Human
uucacagguaacaaaggau

SEQ ID NO: 1087301 - RNA, 19 nt, Human
uucaugccaccagcucccc

SEQ ID NO: 1087302 - RNA, 27 nt, Human
uuccugaacuaagacaaccggggguuc

SEQ ID NO: 1087303 - RNA, 25 nt, Human
uuuccacacucuacagagcagcaaa

SEQ ID NO: 1087304 - RNA, 21 nt, Human
uuugccagaauuuucccuuua

SEQ ID NO: 1087305 - RNA, 19 nt, Human
aaaguagaacaagccuacu

SEQ ID NO: 1087306 - RNA, 24 nt, Human
aacaaaccaaaaauaacacaaaac

SEQ ID NO: 1087307 - RNA, 24 nt, Human
aagaaauacagcaagaucauaauc

SEQ ID NO: 1087308 - RNA, 21 nt, Human
aagcaaaguagaacaagccua

SEQ ID NO: 1087309 - RNA, 22 nt, Human
aagucacaagaaacaauggaaa

SEQ ID NO: 1087310 - RNA, 20 nt, Human
aauaacacaaaacaaaacuu

SEQ ID NO: 1087311 - RNA, 24 nt, Human
aauggaaaauguuaauaaagcugg

SEQ ID NO: 1087312 - RNA, 18 nt, Human
acguauugaagaaauaca

SEQ ID NO: 1087313 - RNA, 23 nt, Human
acuacagcauugagccuggccca

SEQ ID NO: 1087314 - RNA, 22 nt, Human
acuuuuaaacauugugaaacaa

SEQ ID NO: 1087315 - RNA, 18 nt, Human
agaaacaauggaaaaugu

SEQ ID NO: 1087316 - RNA, 21 nt, Human
agaaagaaaacaaaguacuua

SEQ ID NO: 1087317 - RNA, 22 nt, Human
agaagaaaaaaaguuuacaaaa

SEQ ID NO: 1087318 - RNA, 23 nt, Human
agaagaaaaaaaguuuacaaaaa

SEQ ID NO: 1087319 - RNA, 24 nt, Human
agaagaaaaaaaguuuacaaaaaa

SEQ ID NO: 1087320 - RNA, 24 nt, Human
agacugcuuuuuuguuuuuuuuuu

SEQ ID NO: 1087321 - RNA, 20 nt, Human
agcaagaauaaagaaaagga

SEQ ID NO: 1087322 - RNA, 18 nt, Human
agucacaagaaacaaugg

SEQ ID NO: 1087323 - RNA, 24 nt, Human
auccuguuuugcgugcuaugaggg

SEQ ID NO: 1087324 - RNA, 23 nt, Human
caaaaauaacacaaaacaaaacu

SEQ ID NO: 1087325 - RNA, 23 nt, Human
caaaccaaaaauaacacaaaaca

SEQ ID NO: 1087326 - RNA, 20 nt, Human
caagaaauggaugugcacaa

SEQ ID NO: 1087327 - RNA, 19 nt, Human
caaucaaaaauggcaaaaa

SEQ ID NO: 1087328 - RNA, 27 nt, Human
cacaaaugcaagaaaauaaaagacaaa

SEQ ID NO: 1087329 - RNA, 19 nt, Human
caggugagcaacgagacau

SEQ ID NO: 1087330 - RNA, 26 nt, Human
caugucaucuuuucacaucaccuugu

SEQ ID NO: 1087331 - RNA, 22 nt, Human
cauuaaaacuacagcauugagc

SEQ ID NO: 1087332 - RNA, 24 nt, Human
ccccaaggacugcuuccugcaucu

SEQ ID NO: 1087333 - RNA, 22 nt, Human
cccccaauaaacaaaccaaaaa

SEQ ID NO: 1087334 - RNA, 22 nt, Human
cccccccaauaaacaaaccaaa

SEQ ID NO: 1087335 - RNA, 22 nt, Human
cucuucauccaaaaccaggacu

SEQ ID NO: 1087336 - RNA, 23 nt, Human
gaaaaaaaguuuacaaaaaauaa

SEQ ID NO: 1087337 - RNA, 21 nt, Human
gaaaaggccucucuaguugga

SEQ ID NO: 1087338 - RNA, 19 nt, Human
gaacaagccuacuuguucu

SEQ ID NO: 1087339 - RNA, 22 nt, Human
gagggucauuuuuuaaaauguu

SEQ ID NO: 1087340 - RNA, 25 nt, Human
gcuuuuggcauuaacagaauucuga

SEQ ID NO: 1087341 - RNA, 20 nt, Human
uaaaaaaagcccccccaaua

SEQ ID NO: 1087342 - RNA, 24 nt, Human
uaaaaaaagcccccccaauaaaca

SEQ ID NO: 1087343 - RNA, 20 nt, Human
uaaaacuacagcauugagcc

SEQ ID NO: 1087344 - RNA, 19 nt, Human
uaaaagacaaaugagggaa

SEQ ID NO: 1087345 - RNA, 21 nt, Human
uaaacaaaccaaaaauaacac

SEQ ID NO: 1087346 - RNA, 18 nt, Human
uaacacaaaacaaaacuu

SEQ ID NO: 1087347 - RNA, 22 nt, Human
uaaugcaggaaugaugcacuuu

SEQ ID NO: 1087348 - RNA, 19 nt, Human
uacaaaaaauaaaagauuc

SEQ ID NO: 1087349 - RNA, 18 nt, Human
uagcauaaaaaguucccu

SEQ ID NO: 1087350 - RNA, 23 nt, Human
uagcauuaaaacuacagcauuga

SEQ ID NO: 1087351 - RNA, 24 nt, Human
uauucugcccaugucaucuuuuca

SEQ ID NO: 1087352 - RNA, 19 nt, Human
ucaaaaauggcaaaaaacc

SEQ ID NO: 1087353 - RNA, 22 nt, Human
ucacaaaugcaagaaaauaaaa

SEQ ID NO: 1087354 - RNA, 19 nt, Human
ucauccaaaaccaggacuc

SEQ ID NO: 1087355 - RNA, 23 nt, Human
uccaaaucaagccaguuuugcaa

SEQ ID NO: 1087356 - RNA, 18 nt, Human
uccacaauucugcauucu

SEQ ID NO: 1087357 - RNA, 23 nt, Human
ugaaauuccccauccuguuuugc

SEQ ID NO: 1087358 - RNA, 24 nt, Human
ugaaauuccccauccuguuuugcg

SEQ ID NO: 1087359 - RNA, 22 nt, Human
ugaacuaauucacaaaugcaag

SEQ ID NO: 1087360 - RNA, 21 nt, Human
ugaagaaauacagcaagauca

SEQ ID NO: 1087361 - RNA, 24 nt, Human
ugacaauuaaaaaaagccccccca

SEQ ID NO: 1087362 - RNA, 23 nt, Human
ugagcuagggauugaaaccauaa

SEQ ID NO: 1087363 - RNA, 18 nt, Human
uggaagaggccucaugga

SEQ ID NO: 1087364 - RNA, 22 nt, Human
uuaaguucugaccacuuucuga

SEQ ID NO: 1087365 - RNA, 30 nt, Human
uuccaaaucaagccaguuuugcaauuugcc

SEQ ID NO: 1087366 - RNA, 19 nt, Human
uuguaccuauuaugcucuc

SEQ ID NO: 1087367 - RNA, 21 nt, Human
uuuacaaaaaauaaaagauuc

SEQ ID NO: 1087368 - RNA, 21 nt, Human
aaaaggaaacacacucagcaa

SEQ ID NO: 1087369 - RNA, 23 nt, Human
aacacacucagcaauuuuuaggg

SEQ ID NO: 1087370 - RNA, 22 nt, Human
aacaggauugaaccaaaguggg

SEQ ID NO: 1087371 - RNA, 21 nt, Human
aaccaaacagcacauuuuccu

SEQ ID NO: 1087372 - RNA, 21 nt, Human
aagaaaaggaaagguaaauaa

SEQ ID NO: 1087373 - RNA, 18 nt, Human
aagaaaccaaacagcaca

SEQ ID NO: 1087374 - RNA, 21 nt, Human
aagcuacccuguguugaagau

SEQ ID NO: 1087375 - RNA, 20 nt, Human
aaguggcuggcagccaggaa

SEQ ID NO: 1087376 - RNA, 24 nt, Human
aaguggcuggcagccaggaagaga

SEQ ID NO: 1087377 - RNA, 21 nt, Human
acauguuaauguauauauggg

SEQ ID NO: 1087378 - RNA, 20 nt, Human
acuggugcuucuauuaauua

SEQ ID NO: 1087379 - RNA, 21 nt, Human
acuuuuaauaaauaaucauaa

SEQ ID NO: 1087380 - RNA, 22 nt, Human
agaaaaacaaagcgucguugag

SEQ ID NO: 1087381 - RNA, 19 nt, Human
agaugacauuccuuguccc

SEQ ID NO: 1087382 - RNA, 20 nt, Human
agcaaccauuuauucucugc

SEQ ID NO: 1087383 - RNA, 18 nt, Human
agcacauuuuccuugcca

SEQ ID NO: 1087384 - RNA, 20 nt, Human
aggaaagguaaauaauccaa

SEQ ID NO: 1087385 - RNA, 22 nt, Human
aggaauggagacagaugucauc

SEQ ID NO: 1087386 - RNA, 22 nt, Human
auagaaaaaaaugcuuaaagga

SEQ ID NO: 1087387 - RNA, 25 nt, Human
caaaagaaaaacaaagcgucguuga

SEQ ID NO: 1087388 - RNA, 21 nt, Human
caagaacaggauugaaccaaa

SEQ ID NO: 1087389 - RNA, 20 nt, Human
cacaaaagaaaaacaaagcg

SEQ ID NO: 1087390 - RNA, 22 nt, Human
cacaaaagaaaaacaaagcguc

SEQ ID NO: 1087391 - RNA, 23 nt, Human
caccuggaggcuaaguggcuggc

SEQ ID NO: 1087392 - RNA, 20 nt, Human
cagaacuuuccaaaguaaac

SEQ ID NO: 1087393 - RNA, 23 nt, Human
cagugguggaccaagacauuccu

SEQ ID NO: 1087394 - RNA, 23 nt, Human
ccaaacagcacauuuuccuugcc

SEQ ID NO: 1087395 - RNA, 24 nt, Human
ccagucucuccauccagucucacu

SEQ ID NO: 1087396 - RNA, 18 nt, Human
ccuggagcaagaagcugu

SEQ ID NO: 1087397 - RNA, 22 nt, Human
cucacagggcaccaaacauuaa

SEQ ID NO: 1087398 - RNA, 21 nt, Human
cuccuugccauuuaccaucac

SEQ ID NO: 1087399 - RNA, 23 nt, Human
cuguugcucguguuuucuucuca

SEQ ID NO: 1087400 - RNA, 24 nt, Human
cuucuguuuucccuucuuugcccc

SEQ ID NO: 1087401 - RNA, 20 nt, Human
cuuuaagcccuucucagugg

SEQ ID NO: 1087402 - RNA, 22 nt, Human
gaagaugacauuccuugucccc

SEQ ID NO: 1087403 - RNA, 19 nt, Human
gauggcaggaauggagaca

SEQ ID NO: 1087404 - RNA, 19 nt, Human
gcaagaagcuguggcuaca

SEQ ID NO: 1087405 - RNA, 19 nt, Human
gcagccaggaagagauggc

SEQ ID NO: 1087406 - RNA, 19 nt, Human
gcuacagcuuuacagccac

SEQ ID NO: 1087407 - RNA, 25 nt, Human
gcuuuacagccacaaaucagucacu

SEQ ID NO: 1087408 - RNA, 22 nt, Human
ggacccaggagccagaauucca

SEQ ID NO: 1087409 - RNA, 20 nt, Human
ggcaaugaagaaaccaaaca

SEQ ID NO: 1087410 - RNA, 20 nt, Human
uaaacucuggguuacaccuc

SEQ ID NO: 1087411 - RNA, 22 nt, Human
uaaacucuggguuacaccuccu

SEQ ID NO: 1087412 - RNA, 24 nt, Human
uaaagacggaguugaaaagacaac

SEQ ID NO: 1087413 - RNA, 22 nt, Human
uaagaugaguaaagucacggga

SEQ ID NO: 1087414 - RNA, 22 nt, Human
uaaguuucucacucugcaauau

SEQ ID NO: 1087415 - RNA, 19 nt, Human
uacacaggccucucagaua

SEQ ID NO: 1087416 - RNA, 21 nt, Human
uaccugagcugcuacagcuuu

SEQ ID NO: 1087417 - RNA, 24 nt, Human
uacucauugucuuagauuugggag

SEQ ID NO: 1087418 - RNA, 19 nt, Human
uagaaaaaaaugcuuaaag

SEQ ID NO: 1087419 - RNA, 19 nt, Human
uagaacaagaagucuaaug

SEQ ID NO: 1087420 - RNA, 20 nt, Human
uagcaaaagaugaggaaauc

SEQ ID NO: 1087421 - RNA, 24 nt, Human
uagcugcaaggauuauguuaaaug

SEQ ID NO: 1087422 - RNA, 20 nt, Human
uagggacccaggagccagaa

SEQ ID NO: 1087423 - RNA, 21 nt, Human
uagggacccaggagccagaau

SEQ ID NO: 1087424 - RNA, 19 nt, Human
uauagcauaaaauuuaaug

SEQ ID NO: 1087425 - RNA, 19 nt, Human
uaucuuaaacucuggguua

SEQ ID NO: 1087426 - RNA, 21 nt, Human
uaugaucaaggcugaagaggc

SEQ ID NO: 1087427 - RNA, 18 nt, Human
ucaccaaagguagacaca

SEQ ID NO: 1087428 - RNA, 21 nt, Human
ucacuauguugauauucaacc

SEQ ID NO: 1087429 - RNA, 22 nt, Human
ucauuaugaucaaggcugaaga

SEQ ID NO: 1087430 - RNA, 24 nt, Human
uccaaaguaaaccuaaaugaaaag

SEQ ID NO: 1087431 - RNA, 20 nt, Human
uccauuucuuccaauuuccu

SEQ ID NO: 1087432 - RNA, 27 nt, Human
uccccggggccuuaauuccuccgcggg

SEQ ID NO: 1087433 - RNA, 22 nt, Human
ucccuaaagacggaguugaaaa

SEQ ID NO: 1087434 - RNA, 22 nt, Human
uccuuuuuauucuacuuccaga

SEQ ID NO: 1087435 - RNA, 26 nt, Human
ucgguggccugcugaguucucuggug

SEQ ID NO: 1087436 - RNA, 19 nt, Human
ucuaaaacuggugcuucua

SEQ ID NO: 1087437 - RNA, 20 nt, Human
ucuaaggcacaaguauagaa

SEQ ID NO: 1087438 - RNA, 22 nt, Human
ucucacucuuacaugugcuacc

SEQ ID NO: 1087439 - RNA, 18 nt, Human
ucucugcuauaugcuaga

SEQ ID NO: 1087440 - RNA, 18 nt, Human
ucuuaaagauccugcuca

SEQ ID NO: 1087441 - RNA, 19 nt, Human
ugaccacgaguagauagac

SEQ ID NO: 1087442 - RNA, 18 nt, Human
ugaccauucugugaccuu

SEQ ID NO: 1087443 - RNA, 18 nt, Human
ugaguugacucuuaaacu

SEQ ID NO: 1087444 - RNA, 20 nt, Human
ugauauaacucacuuuuuug

SEQ ID NO: 1087445 - RNA, 21 nt, Human
ugcagugucuuuaaucucaug

SEQ ID NO: 1087446 - RNA, 18 nt, Human
uggaaagagaguuggccu

SEQ ID NO: 1087447 - RNA, 19 nt, Human
uggaauguggauuggcuca

SEQ ID NO: 1087448 - RNA, 18 nt, Human
uggagcaagaagcugugg

SEQ ID NO: 1087449 - RNA, 24 nt, Human
uggauuggcucauuucaucuuaaa

SEQ ID NO: 1087450 - RNA, 19 nt, Human
uggcaggaauggagacaga

SEQ ID NO: 1087451 - RNA, 18 nt, Human
ugucuuuaaucucauguu

SEQ ID NO: 1087452 - RNA, 23 nt, Human
uuaauauaccuauuuuacaaaaa

SEQ ID NO: 1087453 - RNA, 19 nt, Human
uuccugacgacauguuaau

SEQ ID NO: 1087454 - RNA, 18 nt, Human
uuggauuucuuuuuccuu

SEQ ID NO: 1087455 - RNA, 20 nt, Human
uuugaaacaguuuucuuugc

SEQ ID NO: 1087456 - RNA, 23 nt, Human
uuugaaacaguuuucuuugcuuc

SEQ ID NO: 1087457 - RNA, 25 nt, Human
uuugcauauuucaauauuagauucc

SEQ ID NO: 1087458 - RNA, 21 nt, Human
aaguaaacacagcucugagau

SEQ ID NO: 1087459 - RNA, 22 nt, Human
acagcucugagauuuuuaggac

SEQ ID NO: 1087460 - RNA, 24 nt, Human
agcuaaguaaacacagcucugaga

SEQ ID NO: 1087461 - RNA, 24 nt, Human
caagcuaaguaaacacagcucuga

SEQ ID NO: 1087462 - RNA, 21 nt, Human
cccauaaaauaaaugauugcc

SEQ ID NO: 1087463 - RNA, 19 nt, Human
ccuccacaccccauaaaau

SEQ ID NO: 1087464 - RNA, 24 nt, Human
cgcuuucuaucccuuuccccucca

SEQ ID NO: 1087465 - RNA, 22 nt, Human
cucugagauuuuuaggacaggg

SEQ ID NO: 1087466 - RNA, 19 nt, Human
cugagauuuuuaggacagg

SEQ ID NO: 1087467 - RNA, 22 nt, Human
gcucugagauuuuuaggacagg

SEQ ID NO: 1087468 - RNA, 24 nt, Human
gcuuucuaucccuuuccccuccac

SEQ ID NO: 1087469 - RNA, 24 nt, Human
uaaguaaacacagcucugagauuu

SEQ ID NO: 1087470 - RNA, 23 nt, Human
uuucuaucccuuuccccuccaca

SEQ ID NO: 1087471 - RNA, 21 nt, Human
acagcggccccguggccuccc

SEQ ID NO: 1087472 - RNA, 18 nt, Human
cccccgggcgagcgccgg

SEQ ID NO: 1087473 - RNA, 18 nt, Human
ccucccgcugggggugga

SEQ ID NO: 1087474 - RNA, 22 nt, Human
ccucccgcuggggguggagucc

SEQ ID NO: 1087475 - RNA, 19 nt, Human
cgccgggaaggccaaccgg

SEQ ID NO: 1087476 - RNA, 21 nt, Human
cgcgggugcccgagagccccc

SEQ ID NO: 1087477 - RNA, 22 nt, Human
cgggcgagcgccgggaaggcca

SEQ ID NO: 1087478 - RNA, 24 nt, Human
cggugugcggcggcgcgugcgcac

SEQ ID NO: 1087479 - RNA, 23 nt, Human
gugcggcggcgcgugcgcacagc

SEQ ID NO: 1087480 - RNA, 22 nt, Human
ugcccgagagcccccggugugc

SEQ ID NO: 1087481 - RNA, 19 nt, Human
uggggguggaguccggggg

SEQ ID NO: 1087482 - RNA, 22 nt, Human
aaacaacaugguaauagaagua

SEQ ID NO: 1087483 - RNA, 21 nt, Human
aaagagugguuuucuuuagga

SEQ ID NO: 1087484 - RNA, 22 nt, Human
aagcauuuacacuuaaaaaaug

SEQ ID NO: 1087485 - RNA, 18 nt, Human
acucuccagcuuaaaauu

SEQ ID NO: 1087486 - RNA, 20 nt, Human
agcuacuaaaaaacuugcau

SEQ ID NO: 1087487 - RNA, 22 nt, Human
aggaaaacaggacuaccacaac

SEQ ID NO: 1087488 - RNA, 24 nt, Human
aggacugacuccauauugccauuu

SEQ ID NO: 1087489 - RNA, 20 nt, Human
agugacucuccagcuuaaaa

SEQ ID NO: 1087490 - RNA, 19 nt, Human
auuccagugacucuccagc

SEQ ID NO: 1087491 - RNA, 24 nt, Human
caauaucccacacuacuuucuggu

SEQ ID NO: 1087492 - RNA, 19 nt, Human
ccgcugccgcuccucccgc

SEQ ID NO: 1087493 - RNA, 20 nt, Human
ccgcugccgcuccucccgcc

SEQ ID NO: 1087494 - RNA, 20 nt, Human
ccuugccgcugccgcuccuc

SEQ ID NO: 1087495 - RNA, 23 nt, Human
ccuugccgcugccgcuccucccg

SEQ ID NO: 1087496 - RNA, 25 nt, Human
cuaccacaaccaaagauguuacaga

SEQ ID NO: 1087497 - RNA, 18 nt, Human
cuggcggcggggaaggcg

SEQ ID NO: 1087498 - RNA, 21 nt, Human
gagacagggaccacugaugag

SEQ ID NO: 1087499 - RNA, 22 nt, Human
gcgcgugccgggugccugcggg

SEQ ID NO: 1087500 - RNA, 21 nt, Human
gggauauaaaaacuaaccccc

SEQ ID NO: 1087501 - RNA, 22 nt, Human
guaacgaaauucuaaaaagcca

SEQ ID NO: 1087502 - RNA, 20 nt, Human
guuaucaaguaccaguaucu

SEQ ID NO: 1087503 - RNA, 26 nt, Human
uaaaaaaaagcauuuacacuuaaaaa

SEQ ID NO: 1087504 - RNA, 23 nt, Human
uaagagguuaucaaguaccagua

SEQ ID NO: 1087505 - RNA, 19 nt, Human
uacacuuaaaaaaugggau

SEQ ID NO: 1087506 - RNA, 22 nt, Human
uaggaaacaauucuacuaaaaa

SEQ ID NO: 1087507 - RNA, 24 nt, Human
uaggaaacaauucuacuaaaaaac

SEQ ID NO: 1087508 - RNA, 19 nt, Human
uauaaaaacuaacccccca

SEQ ID NO: 1087509 - RNA, 19 nt, Human
uaucaaguaccaguaucuu

SEQ ID NO: 1087510 - RNA, 18 nt, Human
uaugcuuuguauuauggg

SEQ ID NO: 1087511 - RNA, 22 nt, Human
uauggaauguuaagcugacacc

SEQ ID NO: 1087512 - RNA, 18 nt, Human
ucaagacauuaaaugcag

SEQ ID NO: 1087513 - RNA, 21 nt, Human
ucccacacuacuuucugguug

SEQ ID NO: 1087514 - RNA, 21 nt, Human
ucuagagcuacuaaaaaacuu

SEQ ID NO: 1087515 - RNA, 25 nt, Human
ugacacccgagacagucagagccuc

SEQ ID NO: 1087516 - RNA, 24 nt, Human
ugacuccauauugccauuuaauau

SEQ ID NO: 1087517 - RNA, 21 nt, Human
ugaggugggauucccuccucc

SEQ ID NO: 1087518 - RNA, 24 nt, Human
ugaggugggauucccuccuccuua

SEQ ID NO: 1087519 - RNA, 19 nt, Human
uggcggcggggaaggcgcg

SEQ ID NO: 1087520 - RNA, 25 nt, Human
uguaccaaaaaauaaacaaccagga

SEQ ID NO: 1087521 - RNA, 27 nt, Human
uucaauaucccacacuacuuucugguu

SEQ ID NO: 1087522 - RNA, 22 nt, Human
uuguaccaaaaaauaaacaacc

SEQ ID NO: 1087523 - RNA, 20 nt, Human
uuuacacuuaaaaaauggga

SEQ ID NO: 1087524 - RNA, 20 nt, Human
uuuagaauguucaagacauu

SEQ ID NO: 1087525 - RNA, 21 nt, Human
aaaaaaacccaccagacaaaa

SEQ ID NO: 1087526 - RNA, 23 nt, Human
aaaaccgagcccagccuggaauc

SEQ ID NO: 1087527 - RNA, 20 nt, Human
aaaauccuuuaucaaugccc

SEQ ID NO: 1087528 - RNA, 20 nt, Human
aacccaccagacaaaaccga

SEQ ID NO: 1087529 - RNA, 18 nt, Human
aagcaaaagaaagaccuc

SEQ ID NO: 1087530 - RNA, 28 nt, Human
aaugcccaucuuucucagcaggggugac

SEQ ID NO: 1087531 - RNA, 21 nt, Human
acaacggcaguggcaaaaaaa

SEQ ID NO: 1087532 - RNA, 21 nt, Human
accuuuaacucagcuuugcug

SEQ ID NO: 1087533 - RNA, 22 nt, Human
agacaaaaccgagcccagccug

SEQ ID NO: 1087534 - RNA, 20 nt, Human
agcccagccuggaaucagga

SEQ ID NO: 1087535 - RNA, 20 nt, Human
agcuggggcuacaccucugu

SEQ ID NO: 1087536 - RNA, 19 nt, Human
caaaaccgagcccagccug

SEQ ID NO: 1087537 - RNA, 19 nt, Human
caagcauuuggcuuguuca

SEQ ID NO: 1087538 - RNA, 24 nt, Human
cacaacggcaguggcaaaaaaacc

SEQ ID NO: 1087539 - RNA, 24 nt, Human
caccaggggccugagaggggcugc

SEQ ID NO: 1087540 - RNA, 18 nt, Human
cacccauuccuagggccu

SEQ ID NO: 1087541 - RNA, 18 nt, Human
cagaagcaaaagaaagac

SEQ ID NO: 1087542 - RNA, 18 nt, Human
cagaagccagaagcaaaa

SEQ ID NO: 1087543 - RNA, 23 nt, Human
cagaagccagaagcaaaagaaag

SEQ ID NO: 1087544 - RNA, 25 nt, Human
cagaagccagaagcaaaagaaagac

SEQ ID NO: 1087545 - RNA, 19 nt, Human
cagcaucaugcaaagaaaa

SEQ ID NO: 1087546 - RNA, 24 nt, Human
cagcaucaugcaaagaaaagccuu

SEQ ID NO: 1087547 - RNA, 19 nt, Human
caggagaugcccgggccau

SEQ ID NO: 1087548 - RNA, 22 nt, Human
caggaugccccccucuuccuga

SEQ ID NO: 1087549 - RNA, 19 nt, Human
caguggcaaaaaaacccac

SEQ ID NO: 1087550 - RNA, 23 nt, Human
ccaccagacaaaaccgagcccag

SEQ ID NO: 1087551 - RNA, 26 nt, Human
ccaccagacaaaaccgagcccagccu

SEQ ID NO: 1087552 - RNA, 25 nt, Human
ccagaagcaaaagaaagaccucaca

SEQ ID NO: 1087553 - RNA, 19 nt, Human
cccaccagacaaaaccgag

SEQ ID NO: 1087554 - RNA, 22 nt, Human
cccaccagacaaaaccgagccc

SEQ ID NO: 1087555 - RNA, 20 nt, Human
ccgagcccagccuggaauca

SEQ ID NO: 1087556 - RNA, 20 nt, Human
ccuagggccucgucgauccu

SEQ ID NO: 1087557 - RNA, 20 nt, Human
cgagcccagccuggaaucag

SEQ ID NO: 1087558 - RNA, 23 nt, Human
cgagcccagccuggaaucaggaa

SEQ ID NO: 1087559 - RNA, 23 nt, Human
cggcaguggcaaaaaaacccacc

SEQ ID NO: 1087560 - RNA, 24 nt, Human
cggucacagaaauucaggaacuga

SEQ ID NO: 1087561 - RNA, 21 nt, Human
cuccaaaggaagguugccaug

SEQ ID NO: 1087562 - RNA, 22 nt, Human
cuccaaaggaagguugccaugg

SEQ ID NO: 1087563 - RNA, 20 nt, Human
cucccgaucugaagggcgag

SEQ ID NO: 1087564 - RNA, 25 nt, Human
cucuggugggagccccugcaggaug

SEQ ID NO: 1087565 - RNA, 20 nt, Human
cucugugccaagcacaguuc

SEQ ID NO: 1087566 - RNA, 20 nt, Human
cucugugugaccuggugagc

SEQ ID NO: 1087567 - RNA, 21 nt, Human
cuggaugccugguuaaaaugg

SEQ ID NO: 1087568 - RNA, 21 nt, Human
cuucuggcuucagcaucaugc

SEQ ID NO: 1087569 - RNA, 19 nt, Human
cuuugcugucacuaccuga

SEQ ID NO: 1087570 - RNA, 21 nt, Human
gaaagaccucacaccaggggc

SEQ ID NO: 1087571 - RNA, 23 nt, Human
gccagaccuagguuucaggaggu

SEQ ID NO: 1087572 - RNA, 21 nt, Human
ggagaccuggaugccacuaac

SEQ ID NO: 1087573 - RNA, 18 nt, Human
ggcucuggugggagcccc

SEQ ID NO: 1087574 - RNA, 21 nt, Human
ggggaggcagagaacauggua

SEQ ID NO: 1087575 - RNA, 21 nt, Human
uaacacaacggcaguggcaaa

SEQ ID NO: 1087576 - RNA, 25 nt, Human
uaacacaacggcaguggcaaaagag

SEQ ID NO: 1087577 - RNA, 24 nt, Human
uacucugugccaagcacaguucua

SEQ ID NO: 1087578 - RNA, 22 nt, Human
uagacaggccuuuccucccacu

SEQ ID NO: 1087579 - RNA, 22 nt, Human
uagcuuccaaauaccagcuccu

SEQ ID NO: 1087580 - RNA, 23 nt, Human
uagcuuccaaauaccagcuccuu

SEQ ID NO: 1087581 - RNA, 19 nt, Human
ucacagaaauucaggaacu

SEQ ID NO: 1087582 - RNA, 18 nt, Human
ucccugaaggccagaccu

SEQ ID NO: 1087583 - RNA, 24 nt, Human
ucucagaagccagaagcaaaagaa

SEQ ID NO: 1087584 - RNA, 18 nt, Human
ugaggaaaguugggcaau

SEQ ID NO: 1087585 - RNA, 20 nt, Human
ugaggaaaguugggcaauuu

SEQ ID NO: 1087586 - RNA, 22 nt, Human
ugaugcuccaauagaaaaaaga

SEQ ID NO: 1087587 - RNA, 22 nt, Human
ugcaaagaaaagccuucucaac

SEQ ID NO: 1087588 - RNA, 19 nt, Human
ugccauggaagcggucaca

SEQ ID NO: 1087589 - RNA, 24 nt, Human
ugccucggugaacaugccagacaa

SEQ ID NO: 1087590 - RNA, 22 nt, Human
ugccugguuaaaaugguuguuc

SEQ ID NO: 1087591 - RNA, 18 nt, Human
uggagugauaaagaaggu

SEQ ID NO: 1087592 - RNA, 19 nt, Human
uggagugauaaagaagguc

SEQ ID NO: 1087593 - RNA, 18 nt, Human
uggggcuacaccucugug

SEQ ID NO: 1087594 - RNA, 22 nt, Human
ugguagacaggccuuuccuccc

SEQ ID NO: 1087595 - RNA, 24 nt, Human
uggucaggaaugccucggugaaca

SEQ ID NO: 1087596 - RNA, 20 nt, Human
uggugggagccccugcagga

SEQ ID NO: 1087597 - RNA, 20 nt, Human
uuaagugccuacucugugcc

SEQ ID NO: 1087598 - RNA, 23 nt, Human
uuauguuguuuccuugaaggcuu

SEQ ID NO: 1087599 - RNA, 25 nt, Human
uuccugauguuguuugccacccauu

SEQ ID NO: 1087600 - RNA, 20 nt, Human
uuggguguagaguggcauaa

SEQ ID NO: 1087601 - RNA, 18 nt, Human
uuguuuccuugaaggcuu

SEQ ID NO: 1087602 - RNA, 21 nt, Human
aacaaaacagauucuuuggaa

SEQ ID NO: 1087603 - RNA, 23 nt, Human
aacuggcuuccagcccuagcccc

SEQ ID NO: 1087604 - RNA, 23 nt, Human
agaacuggcuuccagcccuagcc

SEQ ID NO: 1087605 - RNA, 19 nt, Human
agaggugggcaggagaggc

SEQ ID NO: 1087606 - RNA, 23 nt, Human
agcggugcaggcggcgguggcgg

SEQ ID NO: 1087607 - RNA, 24 nt, Human
aggugggcaggagaggcccaaagc

SEQ ID NO: 1087608 - RNA, 20 nt, Human
caaagcccagcuccggaggc

SEQ ID NO: 1087609 - RNA, 21 nt, Human
cagauucuuuggaaccgagag

SEQ ID NO: 1087610 - RNA, 21 nt, Human
cagguaguacacccgccccuu

SEQ ID NO: 1087611 - RNA, 26 nt, Human
ccaaagcccagcuccggaggcccccg

SEQ ID NO: 1087612 - RNA, 21 nt, Human
cccacaaaaaauaguaaaaaa

SEQ ID NO: 1087613 - RNA, 20 nt, Human
cccccaggcugaggggcagg

SEQ ID NO: 1087614 - RNA, 25 nt, Human
cccccaggcugaggggcagggagaa

SEQ ID NO: 1087615 - RNA, 21 nt, Human
ccuggcaggccucccuugccu

SEQ ID NO: 1087616 - RNA, 18 nt, Human
cucccggcggcauucuag

SEQ ID NO: 1087617 - RNA, 21 nt, Human
cuccggaggcccccgaggccc

SEQ ID NO: 1087618 - RNA, 21 nt, Human
cuccuuaagggagggagacca

SEQ ID NO: 1087619 - RNA, 19 nt, Human
gaacccuccagaagcccac

SEQ ID NO: 1087620 - RNA, 23 nt, Human
gccuagaacuggcuuccagcccu

SEQ ID NO: 1087621 - RNA, 25 nt, Human
gcgaagcagaauacaucauagcggu

SEQ ID NO: 1087622 - RNA, 21 nt, Human
gcggugcaggcggcgguggcg

SEQ ID NO: 1087623 - RNA, 22 nt, Human
gcuccggaggcccccgaggccc

SEQ ID NO: 1087624 - RNA, 21 nt, Human
ggcaguagcgaagcagaauac

SEQ ID NO: 1087625 - RNA, 24 nt, Human
ggcugaggggcagggagaacugug

SEQ ID NO: 1087626 - RNA, 20 nt, Human
gggcaggagaggcccaaagc

SEQ ID NO: 1087627 - RNA, 18 nt, Human
ggggaacggggaggggag

SEQ ID NO: 1087628 - RNA, 21 nt, Human
ggggaaggggaacggggaggg

SEQ ID NO: 1087629 - RNA, 22 nt, Human
uagaggugggcaggagaggccc

SEQ ID NO: 1087630 - RNA, 21 nt, Human
uccagaagcccacaaaaaaua

SEQ ID NO: 1087631 - RNA, 18 nt, Human
ucccccaggcugaggggc

SEQ ID NO: 1087632 - RNA, 19 nt, Human
ucuucuucccccaggcuga

SEQ ID NO: 1087633 - RNA, 20 nt, Human
ugagggcaguagcgaagcag

SEQ ID NO: 1087634 - RNA, 21 nt, Human
ugcccggacucccggcggcau

SEQ ID NO: 1087635 - RNA, 23 nt, Human
ugccucugucagcgucagcuucu

SEQ ID NO: 1087636 - RNA, 23 nt, Human
uggaagccuagaacuggcuucca

SEQ ID NO: 1087637 - RNA, 21 nt, Human
uggcuuccagcccuagccccu

SEQ ID NO: 1087638 - RNA, 19 nt, Human
aaggggcagcuugcaagcc

SEQ ID NO: 1087639 - RNA, 24 nt, Human
auaacauuuauauaucauauuaua

SEQ ID NO: 1087640 - RNA, 19 nt, Human
auauauauauauauauaua

SEQ ID NO: 1087641 - RNA, 19 nt, Human
auauauguauauauauaua

SEQ ID NO: 1087642 - RNA, 19 nt, Human
aucucauuuaccuuuccaa

SEQ ID NO: 1087643 - RNA, 22 nt, Human
auggagacacucaaaacauacu

SEQ ID NO: 1087644 - RNA, 18 nt, Human
auguauauauauauauau

SEQ ID NO: 1087645 - RNA, 19 nt, Human
auguauauauauauauaua

SEQ ID NO: 1087646 - RNA, 20 nt, Human
auguauauauauauauauaa

SEQ ID NO: 1087647 - RNA, 22 nt, Human
caaucaccuuuuaaggccccac

SEQ ID NO: 1087648 - RNA, 20 nt, Human
cagaagagaccgcaagggca

SEQ ID NO: 1087649 - RNA, 19 nt, Human
cagucaaaccucaagccag

SEQ ID NO: 1087650 - RNA, 21 nt, Human
ccgaccaugcccuaccuccau

SEQ ID NO: 1087651 - RNA, 25 nt, Human
ccuccauggcacugccaggggaccc

SEQ ID NO: 1087652 - RNA, 23 nt, Human
ccuccuccuggaauuccuuuccu

SEQ ID NO: 1087653 - RNA, 23 nt, Human
cugcucguccuucaaggggcagc

SEQ ID NO: 1087654 - RNA, 20 nt, Human
cuguguuucaggugucccca

SEQ ID NO: 1087655 - RNA, 19 nt, Human
cuuccuagaacuaacucaa

SEQ ID NO: 1087656 - RNA, 23 nt, Human
cuugcaagccucccuuuagacac

SEQ ID NO: 1087657 - RNA, 18 nt, Human
cuuuaugaugagcugcuc

SEQ ID NO: 1087658 - RNA, 22 nt, Human
gacaccucuacagguacagccg

SEQ ID NO: 1087659 - RNA, 21 nt, Human
gagaccgcaagggcaagcuaa

SEQ ID NO: 1087660 - RNA, 21 nt, Human
gcaacuaaauuucagcauaag

SEQ ID NO: 1087661 - RNA, 18 nt, Human
gcagaagagaccgcaagg

SEQ ID NO: 1087662 - RNA, 23 nt, Human
gcagcuugcaagccucccuuuag

SEQ ID NO: 1087663 - RNA, 20 nt, Human
gcauuaauccauucgugagg

SEQ ID NO: 1087664 - RNA, 21 nt, Human
gggcagcuugcaagccucccu

SEQ ID NO: 1087665 - RNA, 23 nt, Human
ggggcagcuugcaagccucccuu

SEQ ID NO: 1087666 - RNA, 19 nt, Human
guauauauauauauauaua

SEQ ID NO: 1087667 - RNA, 22 nt, Human
guauauauauauauauauauag

SEQ ID NO: 1087668 - RNA, 24 nt, Human
uaaauauagguuuuaauauuuucu

SEQ ID NO: 1087669 - RNA, 25 nt, Human
uaacauuuauauauaucauauuaua

SEQ ID NO: 1087670 - RNA, 25 nt, Human
uaacauuuauauauaucauauuaua

SEQ ID NO: 1087671 - RNA, 23 nt, Human
uaacauuuauauaucauauuaua

SEQ ID NO: 1087672 - RNA, 25 nt, Human
uaacauuuuuauauaucauauuaua

SEQ ID NO: 1087673 - RNA, 24 nt, Human
uaacccaaucccagucugaccaug

SEQ ID NO: 1087674 - RNA, 22 nt, Human
uaacucaauccuguguuaaugg

SEQ ID NO: 1087675 - RNA, 21 nt, Human
uaaugcacuuccuagaacuaa

SEQ ID NO: 1087676 - RNA, 21 nt, Human
uauauauaacauauaacauuu

SEQ ID NO: 1087677 - RNA, 19 nt, Human
uauauauauauauauauau

SEQ ID NO: 1087678 - RNA, 20 nt, Human
uauauauauguauauauaua

SEQ ID NO: 1087679 - RNA, 23 nt, Human
uauauauauguauauauauauau

SEQ ID NO: 1087680 - RNA, 22 nt, Human
uauauguauauauauauauaua

SEQ ID NO: 1087681 - RNA, 24 nt, Human
uaucauauauaacauauaacauuu

SEQ ID NO: 1087682 - RNA, 22 nt, Human
uauguaauauauaacauauaua

SEQ ID NO: 1087683 - RNA, 18 nt, Human
uauguauauauauauaua

SEQ ID NO: 1087684 - RNA, 22 nt, Human
uauguauauauauauauauaua

SEQ ID NO: 1087685 - RNA, 24 nt, Human
uauuauauauaacacauaacauuu

SEQ ID NO: 1087686 - RNA, 22 nt, Human
uauuauauauaacauaacauuu

SEQ ID NO: 1087687 - RNA, 22 nt, Human
uauuauauauaacauaacauuu

SEQ ID NO: 1087688 - RNA, 22 nt, Human
uauuauauauaacauaacauuu

SEQ ID NO: 1087689 - RNA, 24 nt, Human
uauuauauauaacauauaacauuu

SEQ ID NO: 1087690 - RNA, 24 nt, Human
uauuauauauaacauauaacauuu

SEQ ID NO: 1087691 - RNA, 24 nt, Human
uauuauauauaacauauaacauuu

SEQ ID NO: 1087692 - RNA, 24 nt, Human
uauuauauauaacauauaacauuu

SEQ ID NO: 1087693 - RNA, 24 nt, Human
uauuauauauaacauauaacauuu

SEQ ID NO: 1087694 - RNA, 24 nt, Human
uauuauauauaacauauaacauuu

SEQ ID NO: 1087695 - RNA, 22 nt, Human
ucagcauaaguuuuucggaacc

SEQ ID NO: 1087696 - RNA, 24 nt, Human
ucccaucucauuuaccuuuccaaa

SEQ ID NO: 1087697 - RNA, 21 nt, Human
ucuauggacaaccuccaugcc

SEQ ID NO: 1087698 - RNA, 23 nt, Human
ucuuuucccaucucauuuaccuu

SEQ ID NO: 1087699 - RNA, 19 nt, Human
ugcauaaauauauauaugu

SEQ ID NO: 1087700 - RNA, 22 nt, Human
uggcauuaauccauucgugagg

SEQ ID NO: 1087701 - RNA, 18 nt, Human
uguauauauauauauaua

SEQ ID NO: 1087702 - RNA, 22 nt, Human
uguauauauauauauauauaua

SEQ ID NO: 1087703 - RNA, 24 nt, Human
uucauuuugcauaaauauauauau

SEQ ID NO: 1087704 - RNA, 24 nt, Human
uugcaagccucccuuuagacaccu

SEQ ID NO: 1087705 - RNA, 20 nt, Human
uuuauggagacacucaaaac

SEQ ID NO: 1087706 - RNA, 29 nt, Human
uuucauuuugcauaaauauauauauguau

SEQ ID NO: 1087707 - RNA, 23 nt, Human
acaacuuccggcuugaaccggaa

SEQ ID NO: 1087708 - RNA, 23 nt, Human
cuaacauuugcauccauuucuaa

SEQ ID NO: 1087709 - RNA, 24 nt, Human
gaucugcagaaaugggaccaaggg

SEQ ID NO: 1087710 - RNA, 22 nt, Human
gggcggcguugcgucgccuugg

SEQ ID NO: 1087711 - RNA, 25 nt, Human
uggaagacucaauuuaaugucuccu

SEQ ID NO: 1087712 - RNA, 27 nt, Human
uggaagacucaauuuaaugucuccuuu

SEQ ID NO: 1087713 - RNA, 22 nt, Human
uugcggcugucugacuuuuuuc

SEQ ID NO: 1087714 - RNA, 23 nt, Human
aaaccuauagagacagagacuag

SEQ ID NO: 1087715 - RNA, 22 nt, Human
aaagauugcaagaaccccuccc

SEQ ID NO: 1087716 - RNA, 20 nt, Human
aagaaccccucccaccucuc

SEQ ID NO: 1087717 - RNA, 18 nt, Human
acagauauuuugguuuua

SEQ ID NO: 1087718 - RNA, 23 nt, Human
accagguucaaagaaaagaugag

SEQ ID NO: 1087719 - RNA, 22 nt, Human
acucuggaggccuaccugggcu

SEQ ID NO: 1087720 - RNA, 26 nt, Human
acuucgaaggugcugaggccaaaaag

SEQ ID NO: 1087721 - RNA, 23 nt, Human
agaaaaggcagaugggaaaaugc

SEQ ID NO: 1087722 - RNA, 18 nt, Human
agacuagaagagugagug

SEQ ID NO: 1087723 - RNA, 20 nt, Human
agagaaaaggcagaugggaa

SEQ ID NO: 1087724 - RNA, 23 nt, Human
agccucggugcucacagagacgg

SEQ ID NO: 1087725 - RNA, 20 nt, Human
agcgcugggacucuggaggc

SEQ ID NO: 1087726 - RNA, 22 nt, Human
aggccaaaggggucugggccug

SEQ ID NO: 1087727 - RNA, 22 nt, Human
aggccccaacauguauggagcu

SEQ ID NO: 1087728 - RNA, 18 nt, Human
aggggucugggccugugg

SEQ ID NO: 1087729 - RNA, 21 nt, Human
aggggucugggccuguggggg

SEQ ID NO: 1087730 - RNA, 20 nt, Human
agguauacgguuucuuuugg

SEQ ID NO: 1087731 - RNA, 21 nt, Human
aggugcugaggccaaaaagcc

SEQ ID NO: 1087732 - RNA, 24 nt, Human
auaaauaaauucacauuaggcaga

SEQ ID NO: 1087733 - RNA, 27 nt, Human
aucuggacuagaugcugagccaggggg

SEQ ID NO: 1087734 - RNA, 24 nt, Human
augccggcggagggugggggaguu

SEQ ID NO: 1087735 - RNA, 26 nt, Human
auuuugguuuuaaccaguuccccacc

SEQ ID NO: 1087736 - RNA, 21 nt, Human
caagguggggaaaccagagaa

SEQ ID NO: 1087737 - RNA, 27 nt, Human
cacaaauaaauaaauucacauuaggca

SEQ ID NO: 1087738 - RNA, 20 nt, Human
cacaccauuauuuaugucuc

SEQ ID NO: 1087739 - RNA, 22 nt, Human
caccucucccaugcucuucuuu

SEQ ID NO: 1087740 - RNA, 21 nt, Human
caggccccaacauguauggag

SEQ ID NO: 1087741 - RNA, 20 nt, Human
caggcugacccaucuggacu

SEQ ID NO: 1087742 - RNA, 26 nt, Human
cagggcuggggguaaggccaaagggg

SEQ ID NO: 1087743 - RNA, 23 nt, Human
ccaggaaaggcagucugccaagg

SEQ ID NO: 1087744 - RNA, 22 nt, Human
ccagguucaaagaaaagaugag

SEQ ID NO: 1087745 - RNA, 22 nt, Human
ccccgucgggaucgcccgugcc

SEQ ID NO: 1087746 - RNA, 19 nt, Human
cccgugcccucuuccagga

SEQ ID NO: 1087747 - RNA, 20 nt, Human
cuacuugccgcugccuucuc

SEQ ID NO: 1087748 - RNA, 21 nt, Human
cucacaggacgucccucccca

SEQ ID NO: 1087749 - RNA, 21 nt, Human
cucacaggacgucccucccca

SEQ ID NO: 1087750 - RNA, 18 nt, Human
cugccaaggaaccacuuc

SEQ ID NO: 1087751 - RNA, 21 nt, Human
cuggcaaaaucccacaagagc

SEQ ID NO: 1087752 - RNA, 20 nt, Human
cuuggagcuguuaucccuca

SEQ ID NO: 1087753 - RNA, 19 nt, Human
gaaaauaaccccuuggagc

SEQ ID NO: 1087754 - RNA, 18 nt, Human
gaaggugcugaggccaaa

SEQ ID NO: 1087755 - RNA, 25 nt, Human
gcagagccuccugcuugccucaaag

SEQ ID NO: 1087756 - RNA, 25 nt, Human
gccaaaaagccucggugcucacaga

SEQ ID NO: 1087757 - RNA, 21 nt, Human
gccacuccagaggcgagaggg

SEQ ID NO: 1087758 - RNA, 24 nt, Human
gcggagggugggggaguuccaagg

SEQ ID NO: 1087759 - RNA, 23 nt, Human
ggagggagagagggagcucugug

SEQ ID NO: 1087760 - RNA, 19 nt, Human
ggaggggcugagaagggcc

SEQ ID NO: 1087761 - RNA, 25 nt, Human
ggcggagggugggggaguuccaagg

SEQ ID NO: 1087762 - RNA, 20 nt, Human
ggcugagaagggccgccgcg

SEQ ID NO: 1087763 - RNA, 20 nt, Human
gggccugugggggucggggg

SEQ ID NO: 1087764 - RNA, 29 nt, Human
gugggggucggggggcuaaaggguagucc

SEQ ID NO: 1087765 - RNA, 24 nt, Human
guuaacagguauacgguuucuuuu

SEQ ID NO: 1087766 - RNA, 24 nt, Human
uaagccacaagguggggaaaccag

SEQ ID NO: 1087767 - RNA, 27 nt, Human
uaagccacaagguggggaaaccagaga

SEQ ID NO: 1087768 - RNA, 22 nt, Human
uagaagagugagugccagggac

SEQ ID NO: 1087769 - RNA, 18 nt, Human
uccaaggccaggaugcuc

SEQ ID NO: 1087770 - RNA, 21 nt, Human
ucccacaagagcugagcgcug

SEQ ID NO: 1087771 - RNA, 18 nt, Human
ucccuccauggagggagg

SEQ ID NO: 1087772 - RNA, 21 nt, Human
uccucaggcagccacuccaga

SEQ ID NO: 1087773 - RNA, 19 nt, Human
ucuagcccuaugggucccu

SEQ ID NO: 1087774 - RNA, 18 nt, Human
ucucacaggacgucccuc

SEQ ID NO: 1087775 - RNA, 24 nt, Human
ucucacaggacgucccuccccacc

SEQ ID NO: 1087776 - RNA, 20 nt, Human
ucucccaugcucuucuuugg

SEQ ID NO: 1087777 - RNA, 24 nt, Human
ugaaaaagcaaaccuauagagaca

SEQ ID NO: 1087778 - RNA, 20 nt, Human
ugagaagggccgccgcggug

SEQ ID NO: 1087779 - RNA, 25 nt, Human
ugagccagggcuggggguaaggcca

SEQ ID NO: 1087780 - RNA, 23 nt, Human
ugagcgcugauccucauccuucu

SEQ ID NO: 1087781 - RNA, 24 nt, Human
ugcaagaaaauaaccccuuggagc

SEQ ID NO: 1087782 - RNA, 18 nt, Human
ugcccucuuccaggaaag

SEQ ID NO: 1087783 - RNA, 18 nt, Human
ugcugagccagggcuggg

SEQ ID NO: 1087784 - RNA, 25 nt, Human
uggagaauaagaccacaggaugcaa

SEQ ID NO: 1087785 - RNA, 21 nt, Human
uggcaaaaucccacaagagcu

SEQ ID NO: 1087786 - RNA, 20 nt, Human
ugggacucuggaggccuacc

SEQ ID NO: 1087787 - RNA, 18 nt, Human
ugggaguagggaauagug

SEQ ID NO: 1087788 - RNA, 21 nt, Human
ugggccugugggggucggggg

SEQ ID NO: 1087789 - RNA, 24 nt, Human
uuaugucucuaagccacaaggugg

SEQ ID NO: 1087790 - RNA, 22 nt, Human
uucaaagaaaagaugagcagau

SEQ ID NO: 1087791 - RNA, 18 nt, Human
uuccaaggccaggaugcu

SEQ ID NO: 1087792 - RNA, 19 nt, Human
aaagagggaagccgaggcc

SEQ ID NO: 1087793 - RNA, 20 nt, Human
aacauggcgagaccuugucu

SEQ ID NO: 1087794 - RNA, 24 nt, Human
aaggagaacaugaaaagccacuaa

SEQ ID NO: 1087795 - RNA, 24 nt, Human
acagugcccccgcccugacuccag

SEQ ID NO: 1087796 - RNA, 20 nt, Human
acccaagcuacaggacugau

SEQ ID NO: 1087797 - RNA, 18 nt, Human
accccuucuuagagcagc

SEQ ID NO: 1087798 - RNA, 21 nt, Human
accccuucuuagagcagcuca

SEQ ID NO: 1087799 - RNA, 18 nt, Human
acuugaguucaggaguuc

SEQ ID NO: 1087800 - RNA, 19 nt, Human
agagcagcucagacugugc

SEQ ID NO: 1087801 - RNA, 20 nt, Human
agccagcuccagacccacca

SEQ ID NO: 1087802 - RNA, 20 nt, Human
agccuuggcuaaaggagaac

SEQ ID NO: 1087803 - RNA, 22 nt, Human
aucacuuggaaaaagggagccu

SEQ ID NO: 1087804 - RNA, 21 nt, Human
augaaaagccacuaauuaaca

SEQ ID NO: 1087805 - RNA, 22 nt, Human
auggaaagagggaagccgaggc

SEQ ID NO: 1087806 - RNA, 22 nt, Human
caacauggcgagaccuugucuc

SEQ ID NO: 1087807 - RNA, 24 nt, Human
caacauggcgagaccuugucuccu

SEQ ID NO: 1087808 - RNA, 20 nt, Human
caccaagaagcagagccugg

SEQ ID NO: 1087809 - RNA, 18 nt, Human
cacccauucucccaccug

SEQ ID NO: 1087810 - RNA, 18 nt, Human
caccugucccugcccagc

SEQ ID NO: 1087811 - RNA, 21 nt, Human
caggacugauuccuggaugga

SEQ ID NO: 1087812 - RNA, 22 nt, Human
caugaaaagccacuaauuaaca

SEQ ID NO: 1087813 - RNA, 23 nt, Human
ccaccugucccugcccagcugcc

SEQ ID NO: 1087814 - RNA, 19 nt, Human
ccauucucccaccuguccc

SEQ ID NO: 1087815 - RNA, 19 nt, Human
cccccgcccugacuccauc

SEQ ID NO: 1087816 - RNA, 23 nt, Human
cccgcccugacuccauccaggga

SEQ ID NO: 1087817 - RNA, 27 nt, Human
cccugaaagacaucacuuggaaaaagg

SEQ ID NO: 1087818 - RNA, 20 nt, Human
ccuagcacuuugggaggcca

SEQ ID NO: 1087819 - RNA, 21 nt, Human
ccuccuacacccauucuccca

SEQ ID NO: 1087820 - RNA, 20 nt, Human
ccuguaauccuagcacuuug

SEQ ID NO: 1087821 - RNA, 21 nt, Human
cuacacccauucucccaccug

SEQ ID NO: 1087822 - RNA, 18 nt, Human
cucccaccugucccugcc

SEQ ID NO: 1087823 - RNA, 24 nt, Human
cugauuccuggauggaaagaggga

SEQ ID NO: 1087824 - RNA, 23 nt, Human
cuggggccugccuccuacaccca

SEQ ID NO: 1087825 - RNA, 20 nt, Human
gaacaugaaaagccacuaau

SEQ ID NO: 1087826 - RNA, 24 nt, Human
gauuacuugaguucaggaguucga

SEQ ID NO: 1087827 - RNA, 18 nt, Human
gccuguaauccuagcacu

SEQ ID NO: 1087828 - RNA, 23 nt, Human
gccuguaauccuagcacuuuggg

SEQ ID NO: 1087829 - RNA, 22 nt, Human
gucuccugcauugucagccagc

SEQ ID NO: 1087830 - RNA, 18 nt, Human
guggaggacagugccccc

SEQ ID NO: 1087831 - RNA, 20 nt, Human
gugucuagcaguggaggaca

SEQ ID NO: 1087832 - RNA, 21 nt, Human
uaaggaggcacccaagcuaca

SEQ ID NO: 1087833 - RNA, 24 nt, Human
uagcacuuugggaggccaaggugg

SEQ ID NO: 1087834 - RNA, 18 nt, Human
ucacuuggaaaaagggag

SEQ ID NO: 1087835 - RNA, 21 nt, Human
ugaguucaggaguucgagaac

SEQ ID NO: 1087836 - RNA, 24 nt, Human
uggauuacuugaguucaggaguuc

SEQ ID NO: 1087837 - RNA, 20 nt, Human
ugggaggccaagguggauua

SEQ ID NO: 1087838 - RNA, 18 nt, Human
ugucaccaagaagcagag

SEQ ID NO: 1087839 - RNA, 24 nt, Human
ugucaccaagaagcagagccuggg

SEQ ID NO: 1087840 - RNA, 20 nt, Human
ugucagccagcuccagaccc

SEQ ID NO: 1087841 - RNA, 19 nt, Human
ugucuagcaguggaggaca

SEQ ID NO: 1087842 - RNA, 20 nt, Human
uguguguguuuuuucuuuuu

SEQ ID NO: 1087843 - RNA, 21 nt, Human
uuacuugaguucaggaguucg

SEQ ID NO: 1087844 - RNA, 23 nt, Human
uuaggguaaaggagaccccuucu

SEQ ID NO: 1087845 - RNA, 22 nt, Human
uucugggggugucuagcagugg

SEQ ID NO: 1087846 - RNA, 18 nt, Human
uuggaaaaagggagccuu

SEQ ID NO: 1087847 - RNA, 25 nt, Human
aaaagagcacagcaaacagcuguac

SEQ ID NO: 1087848 - RNA, 22 nt, Human
acccaguuuccaaaagagcaca

SEQ ID NO: 1087849 - RNA, 22 nt, Human
acugguaccuucaaggagaggu

SEQ ID NO: 1087850 - RNA, 19 nt, Human
agaaggauauacaagugcu

SEQ ID NO: 1087851 - RNA, 21 nt, Human
cccaguuuccaaaagagcaca

SEQ ID NO: 1087852 - RNA, 22 nt, Human
cuguacgugugugccugugacu

SEQ ID NO: 1087853 - RNA, 20 nt, Human
uccagguggaggagaaccga

SEQ ID NO: 1087854 - RNA, 26 nt, Human
ugagcaaagagaaauauauagaagga

SEQ ID NO: 1087855 - RNA, 19 nt, Human
ugguaccuucaaggagagg

SEQ ID NO: 1087856 - RNA, 21 nt, Human
ugugacuauauauaugugugu

SEQ ID NO: 1087857 - RNA, 24 nt, Human
ugugugccugugacuauauauaug

SEQ ID NO: 1087858 - RNA, 22 nt, Human
uucuaaguuaaaaaaaaagcac

SEQ ID NO: 1087859 - RNA, 24 nt, Human
aagcagguaaagcuggcaaucaaa

SEQ ID NO: 1087860 - RNA, 24 nt, Human
acccaucaaaacucgcuguucacc

SEQ ID NO: 1087861 - RNA, 20 nt, Human
acugugaaagguaacaaaaa

SEQ ID NO: 1087862 - RNA, 20 nt, Human
aggcugggcuggguaaggag

SEQ ID NO: 1087863 - RNA, 24 nt, Human
aucaaaacucgcuguucacccuga

SEQ ID NO: 1087864 - RNA, 22 nt, Human
augaaacccaucaaaacucgcu

SEQ ID NO: 1087865 - RNA, 18 nt, Human
caacccauagaacuguga

SEQ ID NO: 1087866 - RNA, 25 nt, Human
caacugaaacagucuuccccaccaa

SEQ ID NO: 1087867 - RNA, 19 nt, Human
caccaaacuguuggugccu

SEQ ID NO: 1087868 - RNA, 19 nt, Human
cagaugagaacagugaagc

SEQ ID NO: 1087869 - RNA, 22 nt, Human
cagcccagcagacaucaacauc

SEQ ID NO: 1087870 - RNA, 21 nt, Human
cagcuggacccagucaaccca

SEQ ID NO: 1087871 - RNA, 23 nt, Human
caugaagcagguaaagcuggcaa

SEQ ID NO: 1087872 - RNA, 22 nt, Human
ccccaccaaacuguuggugccu

SEQ ID NO: 1087873 - RNA, 20 nt, Human
cucugagagguuaagugacu

SEQ ID NO: 1087874 - RNA, 20 nt, Human
cugagauagaauagauuuau

SEQ ID NO: 1087875 - RNA, 21 nt, Human
gaacagccccagugcagccca

SEQ ID NO: 1087876 - RNA, 20 nt, Human
gaacugacagcuggacccag

SEQ ID NO: 1087877 - RNA, 24 nt, Human
uaaaaagcagguaugguguccuug

SEQ ID NO: 1087878 - RNA, 21 nt, Human
uaaagcuggcaaucaaaauca

SEQ ID NO: 1087879 - RNA, 23 nt, Human
uagauuuauuagcaagagguaau

SEQ ID NO: 1087880 - RNA, 24 nt, Human
uaggcaacugaaacagucuucccc

SEQ ID NO: 1087881 - RNA, 19 nt, Human
ucaacauccagccauguga

SEQ ID NO: 1087882 - RNA, 22 nt, Human
uccuugacacucuggaucuccg

SEQ ID NO: 1087883 - RNA, 22 nt, Human
uccuugacacucuggaucuccg

SEQ ID NO: 1087884 - RNA, 22 nt, Human
ugaaacccaucaaaacucgcug

SEQ ID NO: 1087885 - RNA, 18 nt, Human
ugaaacuucaugagagac

SEQ ID NO: 1087886 - RNA, 24 nt, Human
ugaaacuucaugagagacuccaaa

SEQ ID NO: 1087887 - RNA, 22 nt, Human
ugaaauauuuuaggacuugaaa

SEQ ID NO: 1087888 - RNA, 24 nt, Human
ugaagcagguaaagcuggcaauca

SEQ ID NO: 1087889 - RNA, 20 nt, Human
ugacuuggcugagcucauga

SEQ ID NO: 1087890 - RNA, 19 nt, Human
ugagaacagugaagcucug

SEQ ID NO: 1087891 - RNA, 18 nt, Human
ugagagguuaagugacuu

SEQ ID NO: 1087892 - RNA, 24 nt, Human
ugagccuucagaugacuccagucc

SEQ ID NO: 1087893 - RNA, 21 nt, Human
ugcaauaggcaacugaaacag

SEQ ID NO: 1087894 - RNA, 22 nt, Human
ugcaccaacuagagcaccaccc

SEQ ID NO: 1087895 - RNA, 28 nt, Human
ugccuaaaaagcagguaugguguccuug

SEQ ID NO: 1087896 - RNA, 21 nt, Human
uggcugagcucaugaagcagg

SEQ ID NO: 1087897 - RNA, 18 nt, Human
uggguaaggagcaagugc

SEQ ID NO: 1087898 - RNA, 21 nt, Human
ugugacagcgccaucuuggug

SEQ ID NO: 1087899 - RNA, 27 nt, Human
uuacaaaaauggaaauuuuuuuccaaa

SEQ ID NO: 1087900 - RNA, 23 nt, Human
aaacaacagcagaacauaggcac

SEQ ID NO: 1087901 - RNA, 23 nt, Human
aaccucuagcucccuuucggcuu

SEQ ID NO: 1087902 - RNA, 21 nt, Human
aagaggaagacagagaucuaa

SEQ ID NO: 1087903 - RNA, 23 nt, Human
aagaguacaacugcugaagcuca

SEQ ID NO: 1087904 - RNA, 25 nt, Human
aagccacagagacccacucucuuuu

SEQ ID NO: 1087905 - RNA, 19 nt, Human
aagcccuuuuuaggucauc

SEQ ID NO: 1087906 - RNA, 24 nt, Human
aaucucuggauuugaaccucuagc

SEQ ID NO: 1087907 - RNA, 26 nt, Human
acaaagaaaucauguuacuucuucca

SEQ ID NO: 1087908 - RNA, 21 nt, Human
acaacagcagaacauaggcac

SEQ ID NO: 1087909 - RNA, 19 nt, Human
agaaugccaccacugcccc

SEQ ID NO: 1087910 - RNA, 20 nt, Human
agcacugaucaacaccucca

SEQ ID NO: 1087911 - RNA, 23 nt, Human
aguucucggccuuuaaacaacuc

SEQ ID NO: 1087912 - RNA, 22 nt, Human
augagcccagagcacauacaaa

SEQ ID NO: 1087913 - RNA, 19 nt, Human
auucuuggcaacagaacaa

SEQ ID NO: 1087914 - RNA, 23 nt, Human
caaaaucccaccaagcacugauc

SEQ ID NO: 1087915 - RNA, 21 nt, Human
caacagaacaaaugaaacaca

SEQ ID NO: 1087916 - RNA, 24 nt, Human
caccaagcacugaucaacaccucc

SEQ ID NO: 1087917 - RNA, 24 nt, Human
cagagugaacaucagugaaagcca

SEQ ID NO: 1087918 - RNA, 19 nt, Human
caucaaaaaagaguacaac

SEQ ID NO: 1087919 - RNA, 21 nt, Human
caucaaaaaagaguacaacug

SEQ ID NO: 1087920 - RNA, 18 nt, Human
cauguccccagaaugcca

SEQ ID NO: 1087921 - RNA, 19 nt, Human
ccaaaccgagcagucaugg

SEQ ID NO: 1087922 - RNA, 21 nt, Human
ccagaaguggcugucucaugg

SEQ ID NO: 1087923 - RNA, 21 nt, Human
ccagaaugccaccacugcccc

SEQ ID NO: 1087924 - RNA, 21 nt, Human
ccagaaugccaccacugcccc

SEQ ID NO: 1087925 - RNA, 18 nt, Human
ccagagcacauacaaauc

SEQ ID NO: 1087926 - RNA, 22 nt, Human
ccagcugauguuccacuuguuc

SEQ ID NO: 1087927 - RNA, 23 nt, Human
cccagaaugccaccacugccccu

SEQ ID NO: 1087928 - RNA, 23 nt, Human
cccaggcugggagugggugagac

SEQ ID NO: 1087929 - RNA, 24 nt, Human
ccccagaaugccaccacugccccu

SEQ ID NO: 1087930 - RNA, 27 nt, Human
ccccagaaugccaccacugccccugcc

SEQ ID NO: 1087931 - RNA, 18 nt, Human
ccccaggcugggaguggg

SEQ ID NO: 1087932 - RNA, 18 nt, Human
cccguggauaccuguugc

SEQ ID NO: 1087933 - RNA, 22 nt, Human
cccguggauaccuguugcugaa

SEQ ID NO: 1087934 - RNA, 25 nt, Human
ccucuacaucugagugucccccaaa

SEQ ID NO: 1087935 - RNA, 23 nt, Human
ccucuagcucccuuucgggggcc

SEQ ID NO: 1087936 - RNA, 18 nt, Human
ccugccccgggacaggcc

SEQ ID NO: 1087937 - RNA, 22 nt, Human
cuaaaggaacuacaauaguaca

SEQ ID NO: 1087938 - RNA, 21 nt, Human
cucccaucaccaauacacaga

SEQ ID NO: 1087939 - RNA, 18 nt, Human
cucuacaucugagugucc

SEQ ID NO: 1087940 - RNA, 21 nt, Human
cugcaaugaauguugcagacg

SEQ ID NO: 1087941 - RNA, 22 nt, Human
cugccauuuguuuuccuguucc

SEQ ID NO: 1087942 - RNA, 22 nt, Human
cuuaaacuauaaauuagaaaca

SEQ ID NO: 1087943 - RNA, 22 nt, Human
cuucuuccccaggcugggagug

SEQ ID NO: 1087944 - RNA, 19 nt, Human
gagcacauacaaauccuaa

SEQ ID NO: 1087945 - RNA, 19 nt, Human
gagcccagagcacauacaa

SEQ ID NO: 1087946 - RNA, 21 nt, Human
gaguuucuucugccaucgcag

SEQ ID NO: 1087947 - RNA, 19 nt, Human
gcaacagaacaaaugaaac

SEQ ID NO: 1087948 - RNA, 24 nt, Human
gcacugaucaacaccuccagucac

SEQ ID NO: 1087949 - RNA, 21 nt, Human
gcucccuuucggcuuucuguu

SEQ ID NO: 1087950 - RNA, 20 nt, Human
gcugccauuuguuuuccugu

SEQ ID NO: 1087951 - RNA, 26 nt, Human
gcuggaacaccagggcuguuucucug

SEQ ID NO: 1087952 - RNA, 21 nt, Human
ggaugcugccauuuguuuucc

SEQ ID NO: 1087953 - RNA, 19 nt, Human
ggccagauccuuggacucu

SEQ ID NO: 1087954 - RNA, 19 nt, Human
ggggaugggguggacucug

SEQ ID NO: 1087955 - RNA, 22 nt, Human
gggggaugggguggacucugga

SEQ ID NO: 1087956 - RNA, 23 nt, Human
guggggagggaggcgggcuuggg

SEQ ID NO: 1087957 - RNA, 25 nt, Human
uaaaaacacauggcagccuauucca

SEQ ID NO: 1087958 - RNA, 21 nt, Human
uaaaggaacuacaauaguaca

SEQ ID NO: 1087959 - RNA, 22 nt, Human
uaaauuagaaacacaaauaauc

SEQ ID NO: 1087960 - RNA, 21 nt, Human
uaagaagaaugccaaccagug

SEQ ID NO: 1087961 - RNA, 19 nt, Human
uacaaaguauuaaauagug

SEQ ID NO: 1087962 - RNA, 23 nt, Human
uacaaauccuaaaggaacuacaa

SEQ ID NO: 1087963 - RNA, 19 nt, Human
uacauuaagaagaaugcca

SEQ ID NO: 1087964 - RNA, 24 nt, Human
uagaaacacaaauaaucauaagug

SEQ ID NO: 1087965 - RNA, 23 nt, Human
uagcagaugauguagggcucucc

SEQ ID NO: 1087966 - RNA, 24 nt, Human
uagcucccuuucggcuuucuguuu

SEQ ID NO: 1087967 - RNA, 18 nt, Human
uaggaagaggaagacaga

SEQ ID NO: 1087968 - RNA, 21 nt, Human
uaguuuugugcaaauaguggg

SEQ ID NO: 1087969 - RNA, 23 nt, Human
uccccagaaugccaccacugccc

SEQ ID NO: 1087970 - RNA, 18 nt, Human
uccccaggcugggagugg

SEQ ID NO: 1087971 - RNA, 23 nt, Human
ucccccaaaauguuauuacuccc

SEQ ID NO: 1087972 - RNA, 26 nt, Human
uccuguaggaagaggaagacagagau

SEQ ID NO: 1087973 - RNA, 24 nt, Human
ucgcgagcaaacaaagaaaucaug

SEQ ID NO: 1087974 - RNA, 22 nt, Human
ucggccuuuaaacaacucuaaa

SEQ ID NO: 1087975 - RNA, 23 nt, Human
ucuaaccaggcagaggcagagau

SEQ ID NO: 1087976 - RNA, 22 nt, Human
ucucugccaauauucuuuuaac

SEQ ID NO: 1087977 - RNA, 20 nt, Human
ucucuggauuugaaccucua

SEQ ID NO: 1087978 - RNA, 24 nt, Human
ucuggggggugagccuucuucccc

SEQ ID NO: 1087979 - RNA, 28 nt, Human
ugaacucccaccacguaagggcaaacuc

SEQ ID NO: 1087980 - RNA, 21 nt, Human
ugaagagcucacugugauuaa

SEQ ID NO: 1087981 - RNA, 24 nt, Human
ugaauauacaugcugcaauaacau

SEQ ID NO: 1087982 - RNA, 21 nt, Human
ugacagcagagagagcccgcu

SEQ ID NO: 1087983 - RNA, 22 nt, Human
ugagagaacguuucguguggua

SEQ ID NO: 1087984 - RNA, 21 nt, Human
ugagggaaaggcuguuuccag

SEQ ID NO: 1087985 - RNA, 21 nt, Human
ugaguggcaaccaccagaagu

SEQ ID NO: 1087986 - RNA, 20 nt, Human
ugaucaacaccuccagucac

SEQ ID NO: 1087987 - RNA, 18 nt, Human
ugauguagggcucucccc

SEQ ID NO: 1087988 - RNA, 21 nt, Human
ugccaccacugccccugcccc

SEQ ID NO: 1087989 - RNA, 23 nt, Human
ugccccugccccgggacaggccc

SEQ ID NO: 1087990 - RNA, 23 nt, Human
uggacucuggggggugagccuuc

SEQ ID NO: 1087991 - RNA, 18 nt, Human
uggcaacagaacaaauga

SEQ ID NO: 1087992 - RNA, 23 nt, Human
ugggagugggugagacgagacuc

SEQ ID NO: 1087993 - RNA, 22 nt, Human
uggggagggaggcgggcuuggg

SEQ ID NO: 1087994 - RNA, 23 nt, Human
uggggggugagccuucuucccca

SEQ ID NO: 1087995 - RNA, 18 nt, Human
uuuccaguucucggccuu

SEQ ID NO: 1087996 - RNA, 18 nt, Human
aagcucccccugguuucc

SEQ ID NO: 1087997 - RNA, 19 nt, Human
aagcucccccugguuuccc

SEQ ID NO: 1087998 - RNA, 20 nt, Human
acuggaagaacgugguugcc

SEQ ID NO: 1087999 - RNA, 23 nt, Human
auccugcucugccagcaucuuca

SEQ ID NO: 1088000 - RNA, 20 nt, Human
auucuuaucguccugcagcc

SEQ ID NO: 1088001 - RNA, 18 nt, Human
cagcugcuggcacugccu

SEQ ID NO: 1088002 - RNA, 21 nt, Human
cccuaaauggccgcaauaagu

SEQ ID NO: 1088003 - RNA, 20 nt, Human
cccugccgaagcucccccug

SEQ ID NO: 1088004 - RNA, 22 nt, Human
ccguuuaauagacuccagcugc

SEQ ID NO: 1088005 - RNA, 18 nt, Human
ccuagcccagcucccagc

SEQ ID NO: 1088006 - RNA, 20 nt, Human
ccugguaggcuucaucuucc

SEQ ID NO: 1088007 - RNA, 20 nt, Human
cguguuauucuuuccuacau

SEQ ID NO: 1088008 - RNA, 21 nt, Human
cucucugcaggcccugccgaa

SEQ ID NO: 1088009 - RNA, 23 nt, Human
cugcuggcacugccuucugaguu

SEQ ID NO: 1088010 - RNA, 22 nt, Human
cugguccauucuucagcuucuu

SEQ ID NO: 1088011 - RNA, 19 nt, Human
cuugaauagagacgacagc

SEQ ID NO: 1088012 - RNA, 25 nt, Human
gagaauaucuuaugcuuucuucagc

SEQ ID NO: 1088013 - RNA, 19 nt, Human
gcaggcccugccgaagcuc

SEQ ID NO: 1088014 - RNA, 20 nt, Human
ggcaaagguugggggccuag

SEQ ID NO: 1088015 - RNA, 19 nt, Human
ggcaaguacacuaggcucu

SEQ ID NO: 1088016 - RNA, 20 nt, Human
gggggccuagcccagcuccc

SEQ ID NO: 1088017 - RNA, 22 nt, Human
guugcaaucugagccaaugauu

SEQ ID NO: 1088018 - RNA, 22 nt, Human
uaauagacuccagcugcuggca

SEQ ID NO: 1088019 - RNA, 21 nt, Human
uagcccagcucccagcggcaa

SEQ ID NO: 1088020 - RNA, 21 nt, Human
uaggcuucaucuuccucuugg

SEQ ID NO: 1088021 - RNA, 24 nt, Human
ucacuuccgaauucuuaucguccu

SEQ ID NO: 1088022 - RNA, 23 nt, Human
ucgcuuguccucucugcaggccc

SEQ ID NO: 1088023 - RNA, 19 nt, Human
ucugaauacugugaugcug

SEQ ID NO: 1088024 - RNA, 24 nt, Human
ugaguucuuucacuuccgaauucu

SEQ ID NO: 1088025 - RNA, 23 nt, Human
ugccccguuuaauagacuccagc

SEQ ID NO: 1088026 - RNA, 21 nt, Human
ugccuucugaguucuuucacu

SEQ ID NO: 1088027 - RNA, 21 nt, Human
ugcuggcacugccuucugagu

SEQ ID NO: 1088028 - RNA, 23 nt, Human
uuacaacauccugcucugccagc

SEQ ID NO: 1088029 - RNA, 19 nt, Human
uucagcuucuuucuccagg

SEQ ID NO: 1088030 - RNA, 23 nt, Human
uugcacugauccuuucuacucug

SEQ ID NO: 1088031 - RNA, 24 nt, Human
uuuucaguuugcuugcaguauuuc

SEQ ID NO: 1088032 - RNA, 21 nt, Human
aaacaucccuguggguggacc

SEQ ID NO: 1088033 - RNA, 18 nt, Human
aaccugcguuguucaagg

SEQ ID NO: 1088034 - RNA, 22 nt, Human
aggaagacauggaggaaguggg

SEQ ID NO: 1088035 - RNA, 25 nt, Human
aggaggaggggcuggucuugcugcc

SEQ ID NO: 1088036 - RNA, 24 nt, Human
aggcaggagaggcagggacacuug

SEQ ID NO: 1088037 - RNA, 27 nt, Human
aggcaggagaggcagggacacuugguc

SEQ ID NO: 1088038 - RNA, 19 nt, Human
aguggcugaggaggagggg

SEQ ID NO: 1088039 - RNA, 20 nt, Human
aguggcugaggaggaggggc

SEQ ID NO: 1088040 - RNA, 21 nt, Human
aguggcugaggaggaggggcu

SEQ ID NO: 1088041 - RNA, 23 nt, Human
caagaaggcguaccugugugaca

SEQ ID NO: 1088042 - RNA, 21 nt, Human
cagggacacuugguauaacuc

SEQ ID NO: 1088043 - RNA, 24 nt, Human
cagggacacuugguauaacucuga

SEQ ID NO: 1088044 - RNA, 22 nt, Human
cauguaaacaaugguugaauga

SEQ ID NO: 1088045 - RNA, 24 nt, Human
ccugugugacagcaccuguaagcc

SEQ ID NO: 1088046 - RNA, 22 nt, Human
cggcaaggaccuuccuccaaga

SEQ ID NO: 1088047 - RNA, 22 nt, Human
cguugucuucauguugaguggc

SEQ ID NO: 1088048 - RNA, 22 nt, Human
cucaggguggcagagaggaaga

SEQ ID NO: 1088049 - RNA, 21 nt, Human
gaaggagcaagggagccuaag

SEQ ID NO: 1088050 - RNA, 23 nt, Human
gacauggaggaagugggaaggga

SEQ ID NO: 1088051 - RNA, 23 nt, Human
gaggaggggcuggucuugcugcc

SEQ ID NO: 1088052 - RNA, 23 nt, Human
ggaagggaggcaggagaggcagg

SEQ ID NO: 1088053 - RNA, 19 nt, Human
ggguaaaaguaacuugaaa

SEQ ID NO: 1088054 - RNA, 19 nt, Human
uaacuugaaaaguuggugg

SEQ ID NO: 1088055 - RNA, 19 nt, Human
ucccuguggguggaccugc

SEQ ID NO: 1088056 - RNA, 18 nt, Human
ucuucauguugaguggcu

SEQ ID NO: 1088057 - RNA, 23 nt, Human
ugaaaaguuggugggcagauggc

SEQ ID NO: 1088058 - RNA, 22 nt, Human
ugacagcaccuguaagccaggu

SEQ ID NO: 1088059 - RNA, 25 nt, Human
ugaguggcugaggaggaggggcugg

SEQ ID NO: 1088060 - RNA, 26 nt, Human
uggaaguggauuaucauagaagucuu

SEQ ID NO: 1088061 - RNA, 19 nt, Human
uggaggaagugggaaggga

SEQ ID NO: 1088062 - RNA, 21 nt, Human
uggaggaagugggaagggagg

SEQ ID NO: 1088063 - RNA, 20 nt, Human
uggcagagaggaagacaugg

SEQ ID NO: 1088064 - RNA, 21 nt, Human
uggcagagaggaagacaugga

SEQ ID NO: 1088065 - RNA, 30 nt, Human
ugucauuaagaauaucauaagagaaagcaa

SEQ ID NO: 1088066 - RNA, 22 nt, Human
uguucaaggguccacugugcuu

SEQ ID NO: 1088067 - RNA, 19 nt, Human
uugaagguggguaaaagua

SEQ ID NO: 1088068 - RNA, 22 nt, Human
uuuaucacaucaguaauucuug

SEQ ID NO: 1088069 - RNA, 20 nt, Human
aagaagcaggagagacagag

SEQ ID NO: 1088070 - RNA, 23 nt, Human
aagaagcaggagagacagagcca

SEQ ID NO: 1088071 - RNA, 22 nt, Human
aagcaggagagacagaggggac

SEQ ID NO: 1088072 - RNA, 27 nt, Human
agacagagccauaaaaacaaagagaga

SEQ ID NO: 1088073 - RNA, 21 nt, Human
agagaagaauguuguaaggag

SEQ ID NO: 1088074 - RNA, 20 nt, Human
agagacagagccauaaaaac

SEQ ID NO: 1088075 - RNA, 25 nt, Human
agccauaaaaacaaagagagaagaa

SEQ ID NO: 1088076 - RNA, 20 nt, Human
agguggcgcuggcuggagac

SEQ ID NO: 1088077 - RNA, 19 nt, Human
aguaaugaaaaaggacgag

SEQ ID NO: 1088078 - RNA, 19 nt, Human
caagacauuuauuugaguu

SEQ ID NO: 1088079 - RNA, 19 nt, Human
caggagagacagagccaua

SEQ ID NO: 1088080 - RNA, 21 nt, Human
cauccaaaauccauuuuuucu

SEQ ID NO: 1088081 - RNA, 19 nt, Human
cccauguauuaaacaaggu

SEQ ID NO: 1088082 - RNA, 18 nt, Human
cuggcuggagacaugcug

SEQ ID NO: 1088083 - RNA, 18 nt, Human
cuuccugacccgcucuuc

SEQ ID NO: 1088084 - RNA, 21 nt, Human
cuucuugcuguuguuuuuguc

SEQ ID NO: 1088085 - RNA, 20 nt, Human
gaaauaauaaauggaaaaau

SEQ ID NO: 1088086 - RNA, 18 nt, Human
gaaugugugaggcucuca

SEQ ID NO: 1088087 - RNA, 20 nt, Human
gaggauaguguauuuucagg

SEQ ID NO: 1088088 - RNA, 23 nt, Human
gaguucccauguauuaaacaagg

SEQ ID NO: 1088089 - RNA, 18 nt, Human
ggaaguguuucuucugcu

SEQ ID NO: 1088090 - RNA, 23 nt, Human
uacacagucuuguuuuaucugug

SEQ ID NO: 1088091 - RNA, 24 nt, Human
uacagaaugaauuucagugaguuc

SEQ ID NO: 1088092 - RNA, 18 nt, Human
uagagaucacaggcuucc

SEQ ID NO: 1088093 - RNA, 20 nt, Human
ucccauguauuaaacaaggu

SEQ ID NO: 1088094 - RNA, 22 nt, Human
ucugauagcuggaggauagugu

SEQ ID NO: 1088095 - RNA, 22 nt, Human
ugaaaacuccaagaugggaucu

SEQ ID NO: 1088096 - RNA, 21 nt, Human
ugaaagcuuuaaaacuuugug

SEQ ID NO: 1088097 - RNA, 23 nt, Human
ugaaggaaguggaagccagacca

SEQ ID NO: 1088098 - RNA, 23 nt, Human
ugaagugaaggaaguggaagcca

SEQ ID NO: 1088099 - RNA, 19 nt, Human
ugaguagaucucaauauaa

SEQ ID NO: 1088100 - RNA, 25 nt, Human
ugcaaacaaaauucucugugucaaa

SEQ ID NO: 1088101 - RNA, 20 nt, Human
ugcugugcucaucuuccuga

SEQ ID NO: 1088102 - RNA, 23 nt, Human
uggaagccagaccacaaugguug

SEQ ID NO: 1088103 - RNA, 20 nt, Human
uggcagagccauguugguga

SEQ ID NO: 1088104 - RNA, 19 nt, Human
uggccuagagaucacaggc

SEQ ID NO: 1088105 - RNA, 18 nt, Human
uggcgcuggcuggagaca

SEQ ID NO: 1088106 - RNA, 22 nt, Human
ugguauaaguuuaauuccugac

SEQ ID NO: 1088107 - RNA, 19 nt, Human
uguauuaaacaagguggcg

SEQ ID NO: 1088108 - RNA, 22 nt, Human
uuacauaugagaggcauccaaa

SEQ ID NO: 1088109 - RNA, 19 nt, Human
uugaagaaugaauguaaug

SEQ ID NO: 1088110 - RNA, 21 nt, Human
uugaaugugugaggcucucau

SEQ ID NO: 1088111 - RNA, 23 nt, Human
uuguaaggagggcuuaacgacca

SEQ ID NO: 1088112 - RNA, 25 nt, Human
uuucuucuugcuguuguuuuuguca

SEQ ID NO: 1088113 - RNA, 23 nt, Human
aaaauaaaaaguugaauugcaga

SEQ ID NO: 1088114 - RNA, 18 nt, Human
aaagugcugagauucuac

SEQ ID NO: 1088115 - RNA, 20 nt, Human
aaagugcugagauucuacua

SEQ ID NO: 1088116 - RNA, 24 nt, Human
aacacgacugacagccagaaggga

SEQ ID NO: 1088117 - RNA, 26 nt, Human
aaccguaagcaacacgacugacagcc

SEQ ID NO: 1088118 - RNA, 20 nt, Human
aagcaaaaagcaaauguuga

SEQ ID NO: 1088119 - RNA, 29 nt, Human
aagcaaaaagcaaauguugaagggacccc

SEQ ID NO: 1088120 - RNA, 21 nt, Human
agaaaccguaagcaacacgac

SEQ ID NO: 1088121 - RNA, 18 nt, Human
caaagugcugagauucua

SEQ ID NO: 1088122 - RNA, 19 nt, Human
cacaagcaaaaagcaaaug

SEQ ID NO: 1088123 - RNA, 19 nt, Human
cacuaccccagagucgggg

SEQ ID NO: 1088124 - RNA, 20 nt, Human
caucaagcuguuucucucua

SEQ ID NO: 1088125 - RNA, 24 nt, Human
ccagagucgggggucgggacacag

SEQ ID NO: 1088126 - RNA, 22 nt, Human
ccgaugguacggaugugccaag

SEQ ID NO: 1088127 - RNA, 22 nt, Human
cuaaaguaacaaagaaaccgua

SEQ ID NO: 1088128 - RNA, 20 nt, Human
cuacuaccuaaaguaacaaa

SEQ ID NO: 1088129 - RNA, 22 nt, Human
gguggugaggagccauggggag

SEQ ID NO: 1088130 - RNA, 25 nt, Human
uaaaguaacaaagaaaccguaagca

SEQ ID NO: 1088131 - RNA, 24 nt, Human
uaagagguuuuuaguuuuuguuuu

SEQ ID NO: 1088132 - RNA, 22 nt, Human
uaccuaaaguaacaaagaaacc

SEQ ID NO: 1088133 - RNA, 18 nt, Human
uccaggcagugggcuaau

SEQ ID NO: 1088134 - RNA, 19 nt, Human
ugacagccagaagggaaca

SEQ ID NO: 1088135 - RNA, 23 nt, Human
ugagaauaugaaacaaagugcug

SEQ ID NO: 1088136 - RNA, 23 nt, Human
ugggcaaaaugacuacucagugg

SEQ ID NO: 1088137 - RNA, 18 nt, Human
uugaauugcagaaaagcu

SEQ ID NO: 1088138 - RNA, 21 nt, Human
caaggcacauuuggcgggugc

SEQ ID NO: 1088139 - RNA, 22 nt, Human
ccauucagcuuuucuauuuguc

SEQ ID NO: 1088140 - RNA, 27 nt, Human
ccuccagagcagccucaggcuuagcuu

SEQ ID NO: 1088141 - RNA, 21 nt, Human
ccugcaacaagucuuccuggg

SEQ ID NO: 1088142 - RNA, 21 nt, Human
cuucccgaauaucagcuccag

SEQ ID NO: 1088143 - RNA, 23 nt, Human
gaauuaaagagucauugucucca

SEQ ID NO: 1088144 - RNA, 23 nt, Human
ggccaucaguccuguccgggucc

SEQ ID NO: 1088145 - RNA, 18 nt, Human
gucccgagcccuugacuc

SEQ ID NO: 1088146 - RNA, 24 nt, Human
uaccugcaacaagucuuccuggga

SEQ ID NO: 1088147 - RNA, 18 nt, Human
ucaguccuguccgggucc

SEQ ID NO: 1088148 - RNA, 19 nt, Human
ucucugaggccaucagucc

SEQ ID NO: 1088149 - RNA, 21 nt, Human
ucugcugggcuccggagucgc

SEQ ID NO: 1088150 - RNA, 19 nt, Human
ugaagggcuaauagucuag

SEQ ID NO: 1088151 - RNA, 24 nt, Human
uggcaaggcacauuuggcgggugc

SEQ ID NO: 1088152 - RNA, 23 nt, Human
uggccgcucgcuucuccggcccu

SEQ ID NO: 1088153 - RNA, 18 nt, Human
ugggaagcgaugagucag

SEQ ID NO: 1088154 - RNA, 19 nt, Human
ugucacugaaaauucaggc

SEQ ID NO: 1088155 - RNA, 22 nt, Human
uguccggguccguaguccuggc

SEQ ID NO: 1088156 - RNA, 27 nt, Human
aagcaaaucucuuuccuccacaaguuu

SEQ ID NO: 1088157 - RNA, 20 nt, Human
acaaguuucaugccucccuu

SEQ ID NO: 1088158 - RNA, 28 nt, Human
aggcaaacggugaggaaaaaacugaagc

SEQ ID NO: 1088159 - RNA, 18 nt, Human
aucaaguacuauucagcc

SEQ ID NO: 1088160 - RNA, 23 nt, Human
cacuucccuucuauugcucaagg

SEQ ID NO: 1088161 - RNA, 24 nt, Human
cuacaggcucggaucccacuuccc

SEQ ID NO: 1088162 - RNA, 23 nt, Human
ggaaagaugacguggugacagaa

SEQ ID NO: 1088163 - RNA, 21 nt, Human
gugaggaaaaaacugaagcaa

SEQ ID NO: 1088164 - RNA, 23 nt, Human
guuucaugccucccuucuacagg

SEQ ID NO: 1088165 - RNA, 24 nt, Human
uaauuuaucaauuaacuuuucuua

SEQ ID NO: 1088166 - RNA, 22 nt, Human
uccccaaauggucaaauuuguu

SEQ ID NO: 1088167 - RNA, 19 nt, Human
ucuauuacagagcuuuuua

SEQ ID NO: 1088168 - RNA, 18 nt, Human
ugaggaaaaaacugaagc

SEQ ID NO: 1088169 - RNA, 25 nt, Human
ugucuugucuuccugauccuucccu

SEQ ID NO: 1088170 - RNA, 22 nt, Human
uuaauccuggaaagaugacgug

SEQ ID NO: 1088171 - RNA, 22 nt, Human
aaaaacacgugcccuguugccc

SEQ ID NO: 1088172 - RNA, 22 nt, Human
aaaaauaggggagagagggugc

SEQ ID NO: 1088173 - RNA, 19 nt, Human
aaaacacgcacuccaacca

SEQ ID NO: 1088174 - RNA, 18 nt, Human
aaaacggaagccuugugc

SEQ ID NO: 1088175 - RNA, 19 nt, Human
aaaauguuuuauccugaua

SEQ ID NO: 1088176 - RNA, 20 nt, Human
aaacagggcuacaauuuuuc

SEQ ID NO: 1088177 - RNA, 23 nt, Human
aaagccuauugaaacacucauug

SEQ ID NO: 1088178 - RNA, 25 nt, Human
aacugcagagaacuccagaaguuuc

SEQ ID NO: 1088179 - RNA, 20 nt, Human
aagacucucccaagcugugg

SEQ ID NO: 1088180 - RNA, 25 nt, Human
aagcgauccuccugccucagccucc

SEQ ID NO: 1088181 - RNA, 23 nt, Human
aauaaaauuugaacaagcuucug

SEQ ID NO: 1088182 - RNA, 21 nt, Human
aauaaccggccaaugaaaaaa

SEQ ID NO: 1088183 - RNA, 21 nt, Human
aaugucuauuuaaugcacagc

SEQ ID NO: 1088184 - RNA, 22 nt, Human
acaauucacccuucucucuccu

SEQ ID NO: 1088185 - RNA, 18 nt, Human
acacgcacacaagugugu

SEQ ID NO: 1088186 - RNA, 21 nt, Human
acacgcacacaaguguguggu

SEQ ID NO: 1088187 - RNA, 24 nt, Human
acacugcccagacccguuucuaaa

SEQ ID NO: 1088188 - RNA, 19 nt, Human
acagcugggacuucaagua

SEQ ID NO: 1088189 - RNA, 27 nt, Human
acaggacauagaaaauguuccguuucg

SEQ ID NO: 1088190 - RNA, 27 nt, Human
acauucugaauaaaaauguuuacagaa

SEQ ID NO: 1088191 - RNA, 19 nt, Human
accagcaucucaagggagu

SEQ ID NO: 1088192 - RNA, 19 nt, Human
accagcaucucaagggagu

SEQ ID NO: 1088193 - RNA, 22 nt, Human
accgaaacccuggagacugcaa

SEQ ID NO: 1088194 - RNA, 22 nt, Human
accuaguaacaggcucucuuga

SEQ ID NO: 1088195 - RNA, 21 nt, Human
acuacucauaaacuagggaug

SEQ ID NO: 1088196 - RNA, 24 nt, Human
acugcaauuuaacaaaacagggcu

SEQ ID NO: 1088197 - RNA, 22 nt, Human
acugcagccuugaacucacaca

SEQ ID NO: 1088198 - RNA, 20 nt, Human
agaauccuucccaaagacac

SEQ ID NO: 1088199 - RNA, 18 nt, Human
agagggcugaaaggaggg

SEQ ID NO: 1088200 - RNA, 18 nt, Human
agcaguaaauauuaguuu

SEQ ID NO: 1088201 - RNA, 20 nt, Human
agccccgcccagagccugcu

SEQ ID NO: 1088202 - RNA, 21 nt, Human
aggcauaagagacacaaagcc

SEQ ID NO: 1088203 - RNA, 18 nt, Human
aggcccuuggcugugugc

SEQ ID NO: 1088204 - RNA, 23 nt, Human
aggugcuagaaugucauuaugcu

SEQ ID NO: 1088205 - RNA, 22 nt, Human
aggugugcuaggaagugguaga

SEQ ID NO: 1088206 - RNA, 24 nt, Human
aguaggaaccgaaacccuggagac

SEQ ID NO: 1088207 - RNA, 18 nt, Human
auaccucacugcagccuu

SEQ ID NO: 1088208 - RNA, 19 nt, Human
aucaguuucuaucugucag

SEQ ID NO: 1088209 - RNA, 18 nt, Human
augcugcugaacauuucu

SEQ ID NO: 1088210 - RNA, 18 nt, Human
augcuucuggccuguucu

SEQ ID NO: 1088211 - RNA, 21 nt, Human
auguugcuaccucuguugccu

SEQ ID NO: 1088212 - RNA, 22 nt, Human
auuaugcugccauacucucagg

SEQ ID NO: 1088213 - RNA, 23 nt, Human
auucugguuaauggacuuucuac

SEQ ID NO: 1088214 - RNA, 20 nt, Human
auuucuggcccauuuccccu

SEQ ID NO: 1088215 - RNA, 21 nt, Human
caaaaugaacgaauacucuuc

SEQ ID NO: 1088216 - RNA, 19 nt, Human
caaaugcuuaauauguucc

SEQ ID NO: 1088217 - RNA, 20 nt, Human
caaauuuucuaaaguaaaac

SEQ ID NO: 1088218 - RNA, 18 nt, Human
caacaugaaugcaaacau

SEQ ID NO: 1088219 - RNA, 22 nt, Human
caagcgauccuccugccucagc

SEQ ID NO: 1088220 - RNA, 27 nt, Human
caagcgauccuccugccucagccuccc

SEQ ID NO: 1088221 - RNA, 18 nt, Human
cacuuugccaguacuuac

SEQ ID NO: 1088222 - RNA, 22 nt, Human
cagacacagaaacuacacucga

SEQ ID NO: 1088223 - RNA, 24 nt, Human
cagccucccaaacagcugggacuu

SEQ ID NO: 1088224 - RNA, 22 nt, Human
cauucaaaaaccuaguaacagg

SEQ ID NO: 1088225 - RNA, 22 nt, Human
ccaaaagagcaggaucacaugc

SEQ ID NO: 1088226 - RNA, 23 nt, Human
ccagugugcuggaugcaaugcau

SEQ ID NO: 1088227 - RNA, 19 nt, Human
cccauaaagucuaaucuuu

SEQ ID NO: 1088228 - RNA, 19 nt, Human
cccccgccccccuccggcc

SEQ ID NO: 1088229 - RNA, 24 nt, Human
ccccgcacgacgggcccgccgccu

SEQ ID NO: 1088230 - RNA, 21 nt, Human
cccguuucuaaaaaucagagg

SEQ ID NO: 1088231 - RNA, 21 nt, Human
ccgcccagagccugcuccgcu

SEQ ID NO: 1088232 - RNA, 21 nt, Human
ccgccccccuccggccucagg

SEQ ID NO: 1088233 - RNA, 18 nt, Human
ccuacucuuauucccccg

SEQ ID NO: 1088234 - RNA, 20 nt, Human
ccuagacgaguucgacaggg

SEQ ID NO: 1088235 - RNA, 22 nt, Human
ccucacauacauacaaugacac

SEQ ID NO: 1088236 - RNA, 23 nt, Human
ccucacugcagccuugaacucac

SEQ ID NO: 1088237 - RNA, 18 nt, Human
ccuuuggugacccccgcc

SEQ ID NO: 1088238 - RNA, 21 nt, Human
cgcccagagccugcuccgcuc

SEQ ID NO: 1088239 - RNA, 21 nt, Human
cguggccacaauguugcuacc

SEQ ID NO: 1088240 - RNA, 26 nt, Human
cuaucaaaaaagaaaacacgcacucc

SEQ ID NO: 1088241 - RNA, 24 nt, Human
cucaagcgauccuccugccucagc

SEQ ID NO: 1088242 - RNA, 21 nt, Human
cucacagcaaguaaguaacag

SEQ ID NO: 1088243 - RNA, 19 nt, Human
cucgggagccccgcccaga

SEQ ID NO: 1088244 - RNA, 23 nt, Human
cugccucagccucccaaacagcu

SEQ ID NO: 1088245 - RNA, 21 nt, Human
cugcugaacauuucuggccca

SEQ ID NO: 1088246 - RNA, 20 nt, Human
cuggaaagcaaccagcaucu

SEQ ID NO: 1088247 - RNA, 25 nt, Human
cuggagacccccucuaacauguucc

SEQ ID NO: 1088248 - RNA, 19 nt, Human
cuggagauucuucacacug

SEQ ID NO: 1088249 - RNA, 20 nt, Human
cuggauauuuucuauggucc

SEQ ID NO: 1088250 - RNA, 24 nt, Human
cuucaugcauggaaaagacucucc

SEQ ID NO: 1088251 - RNA, 24 nt, Human
cuugcucuguugcucaggcuggag

SEQ ID NO: 1088252 - RNA, 20 nt, Human
cuuuauacaauucacccuuc

SEQ ID NO: 1088253 - RNA, 21 nt, Human
cuuuggugacccccgcccccc

SEQ ID NO: 1088254 - RNA, 28 nt, Human
gaaagcaaccagcaucucaacuaacgag

SEQ ID NO: 1088255 - RNA, 21 nt, Human
gaaugcuuauuucugaagucu

SEQ ID NO: 1088256 - RNA, 18 nt, Human
gacacagaaacuacacuc

SEQ ID NO: 1088257 - RNA, 18 nt, Human
gagccucaguuucuuuag

SEQ ID NO: 1088258 - RNA, 23 nt, Human
gaugauguguaucagacacuuga

SEQ ID NO: 1088259 - RNA, 23 nt, Human
gaugggaugaugauuuucuuugu

SEQ ID NO: 1088260 - RNA, 23 nt, Human
gccuacucuuauucccccagaua

SEQ ID NO: 1088261 - RNA, 24 nt, Human
gcgauccuccugccucagccuccc

SEQ ID NO: 1088262 - RNA, 18 nt, Human
gcugaacauuucuggccc

SEQ ID NO: 1088263 - RNA, 19 nt, Human
gcugcugaacauuucuggc

SEQ ID NO: 1088264 - RNA, 20 nt, Human
gcuucuggccuguucucuag

SEQ ID NO: 1088265 - RNA, 19 nt, Human
ggaaaagacucucccaagc

SEQ ID NO: 1088266 - RNA, 27 nt, Human
ggaaaagacucucccaagcugugguua

SEQ ID NO: 1088267 - RNA, 20 nt, Human
ggacguuaggacaaggcacu

SEQ ID NO: 1088268 - RNA, 23 nt, Human
ggagauucuucacacuggugaug

SEQ ID NO: 1088269 - RNA, 22 nt, Human
ggaguacaguaucaccaucaac

SEQ ID NO: 1088270 - RNA, 18 nt, Human
ggauuugaucaucuccaa

SEQ ID NO: 1088271 - RNA, 19 nt, Human
ggccugaggacagccugag

SEQ ID NO: 1088272 - RNA, 21 nt, Human
gggagagaggcucaaaaacac

SEQ ID NO: 1088273 - RNA, 20 nt, Human
gguccaggugcuagaauguc

SEQ ID NO: 1088274 - RNA, 20 nt, Human
ggucuuggaaaugacuaaca

SEQ ID NO: 1088275 - RNA, 19 nt, Human
guccaggugcuagaauguc

SEQ ID NO: 1088276 - RNA, 18 nt, Human
gugaugccaaagugccuu

SEQ ID NO: 1088277 - RNA, 18 nt, Human
guggccacaauguugcua

SEQ ID NO: 1088278 - RNA, 22 nt, Human
uaaaaagaaagucugauuaucu

SEQ ID NO: 1088279 - RNA, 25 nt, Human
uaaaacuaacaagaaauuauuauuu

SEQ ID NO: 1088280 - RNA, 18 nt, Human
uaaagggauuggauuuga

SEQ ID NO: 1088281 - RNA, 26 nt, Human
uaagcuuuuauaacuuuuagcaguuu

SEQ ID NO: 1088282 - RNA, 21 nt, Human
uacacacugucaggcuccacu

SEQ ID NO: 1088283 - RNA, 21 nt, Human
uacaguaucaccaucauaccu

SEQ ID NO: 1088284 - RNA, 20 nt, Human
uaccacaacaugaaugcaaa

SEQ ID NO: 1088285 - RNA, 22 nt, Human
uaccacaacaugaaugcaaaca

SEQ ID NO: 1088286 - RNA, 22 nt, Human
uaccucacugcagccuugaacu

SEQ ID NO: 1088287 - RNA, 23 nt, Human
uaccucacugcagccuugaacuc

SEQ ID NO: 1088288 - RNA, 22 nt, Human
uaccuggcaagccuagguagcc

SEQ ID NO: 1088289 - RNA, 19 nt, Human
uagagggcuggaaucucau

SEQ ID NO: 1088290 - RNA, 18 nt, Human
uaggaaacacugacuccc

SEQ ID NO: 1088291 - RNA, 20 nt, Human
uaggaaacacugacucccau

SEQ ID NO: 1088292 - RNA, 18 nt, Human
uauaaagcauuuacaaca

SEQ ID NO: 1088293 - RNA, 23 nt, Human
uauagacaucuauuguugaccua

SEQ ID NO: 1088294 - RNA, 18 nt, Human
uaucaaaaaagaaaacac

SEQ ID NO: 1088295 - RNA, 19 nt, Human
uaucaaaaaagaaaacacg

SEQ ID NO: 1088296 - RNA, 19 nt, Human
uaucagacccacauauuug

SEQ ID NO: 1088297 - RNA, 21 nt, Human
uauccuguaaaaagaaagucu

SEQ ID NO: 1088298 - RNA, 22 nt, Human
uaucugaacaauaugauguguu

SEQ ID NO: 1088299 - RNA, 23 nt, Human
uaucugaacaauaugauguguua

SEQ ID NO: 1088300 - RNA, 21 nt, Human
ucaaguaugugccacuauacc

SEQ ID NO: 1088301 - RNA, 20 nt, Human
ucacauacauacaaugacac

SEQ ID NO: 1088302 - RNA, 19 nt, Human
ucacugcagccuugaacuc

SEQ ID NO: 1088303 - RNA, 23 nt, Human
ucacugcagccuugaacucacac

SEQ ID NO: 1088304 - RNA, 23 nt, Human
ucagaagauugguuaaauauuca

SEQ ID NO: 1088305 - RNA, 20 nt, Human
ucagccucccaaacagcugg

SEQ ID NO: 1088306 - RNA, 27 nt, Human
ucaguauuuugcaaagccuauugaaac

SEQ ID NO: 1088307 - RNA, 22 nt, Human
ucauaguaggaaccgaaacccu

SEQ ID NO: 1088308 - RNA, 24 nt, Human
uccaagaauccuucccaaagacac

SEQ ID NO: 1088309 - RNA, 18 nt, Human
uccaccauucaaugaggc

SEQ ID NO: 1088310 - RNA, 23 nt, Human
uccaggcccuuggcugugugcug

SEQ ID NO: 1088311 - RNA, 24 nt, Human
ucccaaacagcugggacuucaagu

SEQ ID NO: 1088312 - RNA, 19 nt, Human
ucccaaagacaccuggaga

SEQ ID NO: 1088313 - RNA, 24 nt, Human
uccuccugccucagccucccaaac

SEQ ID NO: 1088314 - RNA, 20 nt, Human
ucggggacuuugguuuauac

SEQ ID NO: 1088315 - RNA, 18 nt, Human
ucgguccaggugcuagaa

SEQ ID NO: 1088316 - RNA, 19 nt, Human
ucuaucaaaaaagaaaaca

SEQ ID NO: 1088317 - RNA, 24 nt, Human
ucuaucugucaggucaauuauucc

SEQ ID NO: 1088318 - RNA, 18 nt, Human
ucucacuccacgaggugu

SEQ ID NO: 1088319 - RNA, 21 nt, Human
ucuccaguguaguauauaaau

SEQ ID NO: 1088320 - RNA, 18 nt, Human
ucuccugcugaugaaaga

SEQ ID NO: 1088321 - RNA, 28 nt, Human
ucucuugaaugcacuagagcaguaaaua

SEQ ID NO: 1088322 - RNA, 24 nt, Human
ucuggagacccccucuaacauguu

SEQ ID NO: 1088323 - RNA, 24 nt, Human
ucuggagacccccucuaacauguu

SEQ ID NO: 1088324 - RNA, 20 nt, Human
ucuucaauugcuucaugcau

SEQ ID NO: 1088325 - RNA, 19 nt, Human
ucuugcucuguugcucagg

SEQ ID NO: 1088326 - RNA, 20 nt, Human
ucuugcucuguugcucaggc

SEQ ID NO: 1088327 - RNA, 23 nt, Human
ucuugcucuguugcucaggcugg

SEQ ID NO: 1088328 - RNA, 24 nt, Human
ucuugcucuguugcucaggcugga

SEQ ID NO: 1088329 - RNA, 19 nt, Human
ucuuggaaugcuuauuucu

SEQ ID NO: 1088330 - RNA, 25 nt, Human
ugaaacacaaucauacauucaaaaa

SEQ ID NO: 1088331 - RNA, 19 nt, Human
ugaaaggagggagagagaa

SEQ ID NO: 1088332 - RNA, 24 nt, Human
ugaacagaacauuuaacacagaag

SEQ ID NO: 1088333 - RNA, 19 nt, Human
ugaagucauacaaagcugc

SEQ ID NO: 1088334 - RNA, 20 nt, Human
ugaaugcaaacauuauaagc

SEQ ID NO: 1088335 - RNA, 20 nt, Human
ugacaugauugcaaauuugu

SEQ ID NO: 1088336 - RNA, 24 nt, Human
ugacccccgccccccuccggccuc

SEQ ID NO: 1088337 - RNA, 24 nt, Human
ugagccuacucuuauucccccaga

SEQ ID NO: 1088338 - RNA, 20 nt, Human
ugaggacagccugagucggu

SEQ ID NO: 1088339 - RNA, 18 nt, Human
ugaggcagagaacugccc

SEQ ID NO: 1088340 - RNA, 20 nt, Human
ugaucaucuccaaggccuuu

SEQ ID NO: 1088341 - RNA, 20 nt, Human
ugcagagaacuccagaaguu

SEQ ID NO: 1088342 - RNA, 23 nt, Human
ugcccagacccguuucuaaaaau

SEQ ID NO: 1088343 - RNA, 24 nt, Human
ugcccagacccguuucuaaaaauc

SEQ ID NO: 1088344 - RNA, 24 nt, Human
ugccucagccucccaaacagcugg

SEQ ID NO: 1088345 - RNA, 18 nt, Human
ugcgaaaaucugggaauu

SEQ ID NO: 1088346 - RNA, 18 nt, Human
uggaaagcaaccagcauc

SEQ ID NO: 1088347 - RNA, 23 nt, Human
uggaugcaaugcauucuacacaa

SEQ ID NO: 1088348 - RNA, 20 nt, Human
uggcagagcugggaguuuuc

SEQ ID NO: 1088349 - RNA, 18 nt, Human
uggcaggagaaguccuca

SEQ ID NO: 1088350 - RNA, 18 nt, Human
uggccaaggacaggggcc

SEQ ID NO: 1088351 - RNA, 24 nt, Human
ugggacuucaaguaugugccacua

SEQ ID NO: 1088352 - RNA, 18 nt, Human
ugggaugaugauuuucuu

SEQ ID NO: 1088353 - RNA, 21 nt, Human
uggugcagggacacgcacaca

SEQ ID NO: 1088354 - RNA, 20 nt, Human
ugguuuguuuuguuuucucc

SEQ ID NO: 1088355 - RNA, 20 nt, Human
ugguuuguuuuguuuucucc

SEQ ID NO: 1088356 - RNA, 20 nt, Human
uguaucagacacuugacugg

SEQ ID NO: 1088357 - RNA, 25 nt, Human
ugucuauuuucaaaauggucucaca

SEQ ID NO: 1088358 - RNA, 22 nt, Human
ugucuugcucuguugcucaggc

SEQ ID NO: 1088359 - RNA, 25 nt, Human
ugucuugcucuguugcucaggcugg

SEQ ID NO: 1088360 - RNA, 18 nt, Human
uguguuacuuuuccuauu

SEQ ID NO: 1088361 - RNA, 22 nt, Human
uguuuuguuuucuccaguguag

SEQ ID NO: 1088362 - RNA, 19 nt, Human
uuagaaaacacgccuucaa

SEQ ID NO: 1088363 - RNA, 21 nt, Human
uuaggaagcaaggauaaaggu

SEQ ID NO: 1088364 - RNA, 22 nt, Human
uucaagaguuuauacucauaaa

SEQ ID NO: 1088365 - RNA, 23 nt, Human
uucccugaguucauuuaagaaca

SEQ ID NO: 1088366 - RNA, 21 nt, Human
uuccugcauuucugacauuau

SEQ ID NO: 1088367 - RNA, 21 nt, Human
uucuacacaaccguggccaca

SEQ ID NO: 1088368 - RNA, 18 nt, Human
uucuaugguccaggcccu

SEQ ID NO: 1088369 - RNA, 21 nt, Human
uucucaucuuuaauauccugu

SEQ ID NO: 1088370 - RNA, 20 nt, Human
uucugucaacugagccuacu

SEQ ID NO: 1088371 - RNA, 20 nt, Human
uugacccauacuuaaaacaa

SEQ ID NO: 1088372 - RNA, 20 nt, Human
uugcaaauuuguugacagau

SEQ ID NO: 1088373 - RNA, 19 nt, Human
uugcucaggcuggaguaca

SEQ ID NO: 1088374 - RNA, 21 nt, Human
uugcucaggcuggaguacagu

SEQ ID NO: 1088375 - RNA, 24 nt, Human
uugcucaggcuggaguacaguauc

SEQ ID NO: 1088376 - RNA, 24 nt, Human
uugcucuguugcucaggcuggagu

SEQ ID NO: 1088377 - RNA, 26 nt, Human
uuggagucccagcgaagcugcugacc

SEQ ID NO: 1088378 - RNA, 20 nt, Human
uuuacacuuggaaaaauaga

SEQ ID NO: 1088379 - RNA, 22 nt, Human
uuucuaugguccaggcccuugg

SEQ ID NO: 1088380 - RNA, 26 nt, Human
uuucuugcaauauauggaguaagggu

SEQ ID NO: 1088381 - RNA, 23 nt, Human
uuugaacaagcuucuggaaaaau

SEQ ID NO: 1088382 - RNA, 19 nt, Human
uuuguuuuugagauuccug

SEQ ID NO: 1088383 - RNA, 22 nt, Human
uuuguuuuugagauuccugucu

SEQ ID NO: 1088384 - RNA, 19 nt, Human
uuuuuguuuguuuguuuuu

SEQ ID NO: 1088385 - RNA, 20 nt, Human
uuuuuguuuguuuguuuuuu

SEQ ID NO: 1088386 - RNA, 19 nt, Human
aaacuucaaagaccaggug

SEQ ID NO: 1088387 - RNA, 18 nt, Human
aaugaagagaaucuagcc

SEQ ID NO: 1088388 - RNA, 24 nt, Human
agaaagacacacaaguggaucccu

SEQ ID NO: 1088389 - RNA, 22 nt, Human
agaaauggagacaaugaagaga

SEQ ID NO: 1088390 - RNA, 19 nt, Human
agcuucaggguagggacac

SEQ ID NO: 1088391 - RNA, 19 nt, Human
aggcugccacuaaagacaa

SEQ ID NO: 1088392 - RNA, 21 nt, Human
agggagcuguggcacugguag

SEQ ID NO: 1088393 - RNA, 20 nt, Human
agguaguucagaagugggag

SEQ ID NO: 1088394 - RNA, 22 nt, Human
cagaauacaccauuccaggacu

SEQ ID NO: 1088395 - RNA, 19 nt, Human
ccagaauacaccauuccag

SEQ ID NO: 1088396 - RNA, 25 nt, Human
cccagaaagacacacaaguggaucc

SEQ ID NO: 1088397 - RNA, 21 nt, Human
cccuuccuuccccgaggccca

SEQ ID NO: 1088398 - RNA, 21 nt, Human
ccucaugcccuuccuuccccg

SEQ ID NO: 1088399 - RNA, 19 nt, Human
ccugcacucaggaacuaca

SEQ ID NO: 1088400 - RNA, 22 nt, Human
cuccaugaugaccaauggaaga

SEQ ID NO: 1088401 - RNA, 21 nt, Human
cugcugaggauggucucucuu

SEQ ID NO: 1088402 - RNA, 18 nt, Human
gcagccuggucugaacaa

SEQ ID NO: 1088403 - RNA, 24 nt, Human
gcccuauaggagcucuggagaaag

SEQ ID NO: 1088404 - RNA, 20 nt, Human
gcucuggagaaagagaaaug

SEQ ID NO: 1088405 - RNA, 20 nt, Human
ggagaaagagaaauggagac

SEQ ID NO: 1088406 - RNA, 23 nt, Human
ggagacaaugaagagaaucuagc

SEQ ID NO: 1088407 - RNA, 22 nt, Human
ggcccaggcugccacuaaagac

SEQ ID NO: 1088408 - RNA, 21 nt, Human
gguaagggaaaagggaaaaga

SEQ ID NO: 1088409 - RNA, 19 nt, Human
guaggacagaaacuucaaa

SEQ ID NO: 1088410 - RNA, 19 nt, Human
uacaccauuccaggacuag

SEQ ID NO: 1088411 - RNA, 19 nt, Human
uagagccagcugauugccc

SEQ ID NO: 1088412 - RNA, 21 nt, Human
uauagagccagcugauugccc

SEQ ID NO: 1088413 - RNA, 25 nt, Human
ucaugcccuuccuuccccgaggccc

SEQ ID NO: 1088414 - RNA, 20 nt, Human
uccccgaggcccaggcugcc

SEQ ID NO: 1088415 - RNA, 18 nt, Human
uccgagcuaagcuccaag

SEQ ID NO: 1088416 - RNA, 19 nt, Human
ugccacuaaagacaauuau

SEQ ID NO: 1088417 - RNA, 22 nt, Human
ugcccuuuccaggugaguucca

SEQ ID NO: 1088418 - RNA, 20 nt, Human
ugggagagggagcuguggca

SEQ ID NO: 1088419 - RNA, 21 nt, Human
ugggagagggagcuguggcac

SEQ ID NO: 1088420 - RNA, 26 nt, Human
uuaucccagaaagacacacaagugga

SEQ ID NO: 1088421 - RNA, 25 nt, Human
uucaggguagggacacuauugaaaa

SEQ ID NO: 1088422 - RNA, 18 nt, Human
aaacaggggacuccaucu

SEQ ID NO: 1088423 - RNA, 26 nt, Human
aacaucccaucuucuguuuccugcca

SEQ ID NO: 1088424 - RNA, 23 nt, Human
acagggagaugagaugucauugu

SEQ ID NO: 1088425 - RNA, 21 nt, Human
acaucacauguguugacccca

SEQ ID NO: 1088426 - RNA, 20 nt, Human
acgggggaggggcaguuucu

SEQ ID NO: 1088427 - RNA, 25 nt, Human
acuuccuuucuaaagaaucaaaggc

SEQ ID NO: 1088428 - RNA, 25 nt, Human
agacagaugcaccguugcagcuccc

SEQ ID NO: 1088429 - RNA, 24 nt, Human
aggggcccaagcacucaggcucug

SEQ ID NO: 1088430 - RNA, 21 nt, Human
aucaucuguaugggcaugagc

SEQ ID NO: 1088431 - RNA, 26 nt, Human
auggggcucuacaagucgaacuuugg

SEQ ID NO: 1088432 - RNA, 20 nt, Human
cagcucccaagaucugcaug

SEQ ID NO: 1088433 - RNA, 24 nt, Human
cagcucccaagaucugcauggaga

SEQ ID NO: 1088434 - RNA, 21 nt, Human
caggggcccaagcacucaggc

SEQ ID NO: 1088435 - RNA, 21 nt, Human
caguggguucuaccuuugucc

SEQ ID NO: 1088436 - RNA, 22 nt, Human
ccaccaacaucccaucuucugu

SEQ ID NO: 1088437 - RNA, 19 nt, Human
ccagguucacaggggccca

SEQ ID NO: 1088438 - RNA, 22 nt, Human
cccaggaagggggccaguggcu

SEQ ID NO: 1088439 - RNA, 22 nt, Human
ccccaaggucuguguccccuuc

SEQ ID NO: 1088440 - RNA, 23 nt, Human
ccuuccccacucaacuuuuucuu

SEQ ID NO: 1088441 - RNA, 21 nt, Human
ccuuugucccaggaagggggc

SEQ ID NO: 1088442 - RNA, 20 nt, Human
cgaaccaugaucugcucaca

SEQ ID NO: 1088443 - RNA, 22 nt, Human
cuaaagaaucaaaggcaucauu

SEQ ID NO: 1088444 - RNA, 26 nt, Human
cucccaagaucugcauggagaauagg

SEQ ID NO: 1088445 - RNA, 19 nt, Human
cuccguacucacugucccc

SEQ ID NO: 1088446 - RNA, 23 nt, Human
cugcauggagaauagguuccucu

SEQ ID NO: 1088447 - RNA, 22 nt, Human
gaauagguuccucuccguacuc

SEQ ID NO: 1088448 - RNA, 19 nt, Human
gaauuugcuugaaggagaa

SEQ ID NO: 1088449 - RNA, 19 nt, Human
gaccacuggcaccaaaagg

SEQ ID NO: 1088450 - RNA, 20 nt, Human
gccaguggcugagcccaugg

SEQ ID NO: 1088451 - RNA, 19 nt, Human
ggccaguggcugagcccau

SEQ ID NO: 1088452 - RNA, 23 nt, Human
ggccaguggcugagcccauggaa

SEQ ID NO: 1088453 - RNA, 23 nt, Human
gggacagucaauuaggacggggg

SEQ ID NO: 1088454 - RNA, 19 nt, Human
gggguagcugagcgggcag

SEQ ID NO: 1088455 - RNA, 19 nt, Human
gucgaacuuuggggguagc

SEQ ID NO: 1088456 - RNA, 25 nt, Human
gugguacuuaaguccauugaugugc

SEQ ID NO: 1088457 - RNA, 23 nt, Human
uacucacuguccccauccgcuuc

SEQ ID NO: 1088458 - RNA, 18 nt, Human
uaggacgggggaggggca

SEQ ID NO: 1088459 - RNA, 20 nt, Human
ucaucagagccaucauugga

SEQ ID NO: 1088460 - RNA, 23 nt, Human
uccccacucaacuuuuucuuaca

SEQ ID NO: 1088461 - RNA, 19 nt, Human
uccguacucacugucccca

SEQ ID NO: 1088462 - RNA, 24 nt, Human
ucugcucacagggagaugagaugu

SEQ ID NO: 1088463 - RNA, 23 nt, Human
ugccacacgaugccuucaagguu

SEQ ID NO: 1088464 - RNA, 20 nt, Human
uggauaaggccccaaggucu

SEQ ID NO: 1088465 - RNA, 19 nt, Human
uggugguacuuaaguccau

SEQ ID NO: 1088466 - RNA, 26 nt, Human
ugucuuguuccuccacguuacauuua

SEQ ID NO: 1088467 - RNA, 23 nt, Human
uuacagaggccuuuugugcugaa

SEQ ID NO: 1088468 - RNA, 19 nt, Human
uuccucuccguacucacug

SEQ ID NO: 1088469 - RNA, 18 nt, Human
uucuuacagaggccuuuu

SEQ ID NO: 1088470 - RNA, 18 nt, Human
uugcucccuuuggagucc

SEQ ID NO: 1088471 - RNA, 18 nt, Human
uuggaguccucugagcua

SEQ ID NO: 1088472 - RNA, 25 nt, Human
uuuaccaccaacaucccaucuucug

SEQ ID NO: 1088473 - RNA, 18 nt, Human
uuugucccaggaaggggg

SEQ ID NO: 1088474 - RNA, 24 nt, Human
auuuuguuggacaugcaguguuuc

SEQ ID NO: 1088475 - RNA, 19 nt, Human
cuagugguguuucauuuuc

SEQ ID NO: 1088476 - RNA, 25 nt, Human
uauaacaugucaaaaaucugauuua

SEQ ID NO: 1088477 - RNA, 23 nt, Human
ugaaaaacaguacauucacacaa

SEQ ID NO: 1088478 - RNA, 21 nt, Human
ugccuuuguaaaauaaaaaca

SEQ ID NO: 1088479 - RNA, 22 nt, Human
ugccuuuguaaaauaaaaacaa

SEQ ID NO: 1088480 - RNA, 22 nt, Human
ugguguuucauuuucugccuuu

SEQ ID NO: 1088481 - RNA, 18 nt, Human
uuaauucuuuuaccuagu

SEQ ID NO: 1088482 - RNA, 19 nt, Human
uuuguuggacaugcagugu

SEQ ID NO: 1088483 - RNA, 18 nt, Human
uuuuuuuuuuuuuuuuug

SEQ ID NO: 1088484 - RNA, 21 nt, Human
uuuuuuuuuuuuuuuuugguu

SEQ ID NO: 1088485 - RNA, 18 nt, Human
uaacaucauuuggagaag

SEQ ID NO: 1088486 - RNA, 23 nt, Human
ucauuuggagaagaagccgucuu

SEQ ID NO: 1088487 - RNA, 19 nt, Human
ucuucauguuugggcucua

SEQ ID NO: 1088488 - RNA, 19 nt, Human
ugguauaaggauuaaauga

SEQ ID NO: 1088489 - RNA, 20 nt, Human
ugguauaaggauuaaaugag

SEQ ID NO: 1088490 - RNA, 21 nt, Human
uuacuauaaaaauaaagauag

SEQ ID NO: 1088491 - RNA, 19 nt, Human
aaaaaugaaaacuccaucu

SEQ ID NO: 1088492 - RNA, 18 nt, Human
aaaaggaaaaagauccac

SEQ ID NO: 1088493 - RNA, 28 nt, Human
aaaaggaaaaagauccacugcuucagaa

SEQ ID NO: 1088494 - RNA, 22 nt, Human
aaaauagauaggaaaaugaaug

SEQ ID NO: 1088495 - RNA, 23 nt, Human
aaaccuauuuccucccacuucca

SEQ ID NO: 1088496 - RNA, 24 nt, Human
aaagagagguuuaaaauuguaacc

SEQ ID NO: 1088497 - RNA, 19 nt, Human
aaccuauuuccucccacuu

SEQ ID NO: 1088498 - RNA, 22 nt, Human
aaucacugccugccauucaaac

SEQ ID NO: 1088499 - RNA, 22 nt, Human
accuauuuccucccacuuccaa

SEQ ID NO: 1088500 - RNA, 19 nt, Human
agaaaagaauauuugaaga

SEQ ID NO: 1088501 - RNA, 22 nt, Human
agaggcguaggaggggagcccc

SEQ ID NO: 1088502 - RNA, 18 nt, Human
agaugcagauagugaaaa

SEQ ID NO: 1088503 - RNA, 19 nt, Human
agucuuagaguguccauau

SEQ ID NO: 1088504 - RNA, 24 nt, Human
caggugagaccuuccugcugggga

SEQ ID NO: 1088505 - RNA, 20 nt, Human
ccacuuccaaaucacugccu

SEQ ID NO: 1088506 - RNA, 22 nt, Human
cugaagaugacagcuuuccagg

SEQ ID NO: 1088507 - RNA, 18 nt, Human
cuuagaguguccauaucu

SEQ ID NO: 1088508 - RNA, 19 nt, Human
gaagaaaaaaaugagaaaa

SEQ ID NO: 1088509 - RNA, 19 nt, Human
gaagaugacagcuuuccag

SEQ ID NO: 1088510 - RNA, 23 nt, Human
gaaguccaaggucgaagguucac

SEQ ID NO: 1088511 - RNA, 21 nt, Human
gagaaaaugaaauaagauggc

SEQ ID NO: 1088512 - RNA, 23 nt, Human
gaggggagccccucaugccuguu

SEQ ID NO: 1088513 - RNA, 24 nt, Human
gaugugccauuuaaaaaugaaaac

SEQ ID NO: 1088514 - RNA, 24 nt, Human
gcauagucuucucaccuguuaaag

SEQ ID NO: 1088515 - RNA, 27 nt, Human
ggaggacaguugcuuauguugugcacu

SEQ ID NO: 1088516 - RNA, 19 nt, Human
ggaggcugagaaguccaag

SEQ ID NO: 1088517 - RNA, 21 nt, Human
uaacacaacguuucaaaguuc

SEQ ID NO: 1088518 - RNA, 22 nt, Human
uagcaaaaaauguacaggcuuc

SEQ ID NO: 1088519 - RNA, 23 nt, Human
uaguauugcauuguaacucuggu

SEQ ID NO: 1088520 - RNA, 22 nt, Human
uagucagagauaaaaaucucuu

SEQ ID NO: 1088521 - RNA, 24 nt, Human
uauaauaacugguuuauuucacuu

SEQ ID NO: 1088522 - RNA, 23 nt, Human
uaucccuacuaacugaagaugac

SEQ ID NO: 1088523 - RNA, 22 nt, Human
uaugauguuugcagacuguagg

SEQ ID NO: 1088524 - RNA, 19 nt, Human
ucaggugagaccuuccugc

SEQ ID NO: 1088525 - RNA, 20 nt, Human
ucauucuggaggcugagaag

SEQ ID NO: 1088526 - RNA, 19 nt, Human
uccaaaccuauuuccuccc

SEQ ID NO: 1088527 - RNA, 22 nt, Human
uccaaaccuauuuccucccacu

SEQ ID NO: 1088528 - RNA, 21 nt, Human
uccuuagucagagauaaaaau

SEQ ID NO: 1088529 - RNA, 20 nt, Human
ucucagucuauuugaccaaa

SEQ ID NO: 1088530 - RNA, 19 nt, Human
ugaaauaagauggcaaggc

SEQ ID NO: 1088531 - RNA, 18 nt, Human
ugagaaguccaaggucga

SEQ ID NO: 1088532 - RNA, 21 nt, Human
ugagaaguccaaggucgaagg

SEQ ID NO: 1088533 - RNA, 25 nt, Human
ugauguuugcagacuguagggcuuu

SEQ ID NO: 1088534 - RNA, 19 nt, Human
ugccaaacaguagcuuuua

SEQ ID NO: 1088535 - RNA, 25 nt, Human
ugcuucagaaaugucaacaacuacc

SEQ ID NO: 1088536 - RNA, 18 nt, Human
uggaggcugagaagucca

SEQ ID NO: 1088537 - RNA, 20 nt, Human
uggcauagucuucucaccug

SEQ ID NO: 1088538 - RNA, 19 nt, Human
ugggcuuggaacccugugc

SEQ ID NO: 1088539 - RNA, 18 nt, Human
ugggguggaggugggagg

SEQ ID NO: 1088540 - RNA, 21 nt, Human
ugggguggaggugggaggugg

SEQ ID NO: 1088541 - RNA, 19 nt, Human
uguagggcuuugggccaau

SEQ ID NO: 1088542 - RNA, 27 nt, Human
uguucuguccauggcauagucuucuca

SEQ ID NO: 1088543 - RNA, 22 nt, Human
uguugcagggcaaucgcauggu

SEQ ID NO: 1088544 - RNA, 20 nt, Human
uuagcaaaaaauguacaggc

SEQ ID NO: 1088545 - RNA, 22 nt, Human
uucagaaaugucaacaacuacc

SEQ ID NO: 1088546 - RNA, 20 nt, Human
uucguguuguagcaugcauc

SEQ ID NO: 1088547 - RNA, 19 nt, Human
uugcauuguaacucuggua

SEQ ID NO: 1088548 - RNA, 21 nt, Human
aaaaaaaaaaagcaaaaaaag

SEQ ID NO: 1088549 - RNA, 23 nt, Human
aaaaaaaaaagcaaaaaaagcau

SEQ ID NO: 1088550 - RNA, 18 nt, Human
aaaaaaacaagcaagaag

SEQ ID NO: 1088551 - RNA, 24 nt, Human
aaaaaaagcaaaaaaagcauguaa

SEQ ID NO: 1088552 - RNA, 27 nt, Human
aaaaagcaaaaaaagcauguaaaacac

SEQ ID NO: 1088553 - RNA, 18 nt, Human
aaacaagcaagaauugac

SEQ ID NO: 1088554 - RNA, 18 nt, Human
aaagcaaaaaaagcaugu

SEQ ID NO: 1088555 - RNA, 25 nt, Human
aaagcuccugucaccugaacugccc

SEQ ID NO: 1088556 - RNA, 18 nt, Human
aaagggccacagugacca

SEQ ID NO: 1088557 - RNA, 19 nt, Human
aaagggccacagugaccac

SEQ ID NO: 1088558 - RNA, 20 nt, Human
aacgguguucuccggaggua

SEQ ID NO: 1088559 - RNA, 21 nt, Human
aaugaaaaaaacaagcaagaa

SEQ ID NO: 1088560 - RNA, 23 nt, Human
aauguaggaggcaccaaaaaaga

SEQ ID NO: 1088561 - RNA, 20 nt, Human
aauuacugaaaacuccaccu

SEQ ID NO: 1088562 - RNA, 22 nt, Human
accgcagccccgggugcgcgcu

SEQ ID NO: 1088563 - RNA, 26 nt, Human
accugaacugcccggcacugggagcc

SEQ ID NO: 1088564 - RNA, 21 nt, Human
acuccaccugcuguggaauaa

SEQ ID NO: 1088565 - RNA, 23 nt, Human
acugaaaacuccaccugcugugg

SEQ ID NO: 1088566 - RNA, 22 nt, Human
agaaaaaaaaaaaagcaaaaaa

SEQ ID NO: 1088567 - RNA, 23 nt, Human
agaaaaaaaaaaaagcaaaaaaa

SEQ ID NO: 1088568 - RNA, 24 nt, Human
agcaaauccaaauugugagauggg

SEQ ID NO: 1088569 - RNA, 22 nt, Human
agccaguuuuagaaauuucugg

SEQ ID NO: 1088570 - RNA, 23 nt, Human
agccaucgcuguaccucacggcg

SEQ ID NO: 1088571 - RNA, 23 nt, Human
agccggggcugggggaggagguu

SEQ ID NO: 1088572 - RNA, 23 nt, Human
agccuguccuaucugcuccucua

SEQ ID NO: 1088573 - RNA, 25 nt, Human
aggagaaaaaaaaaaaagcaaaaaa

SEQ ID NO: 1088574 - RNA, 19 nt, Human
aggagccuccaccgcagcc

SEQ ID NO: 1088575 - RNA, 20 nt, Human
aggguaggagaaaaaaaaaa

SEQ ID NO: 1088576 - RNA, 20 nt, Human
aggucaucgcuaggguagga

SEQ ID NO: 1088577 - RNA, 21 nt, Human
caaaacaggguagcuaaggac

SEQ ID NO: 1088578 - RNA, 21 nt, Human
caaauugugagaugggaaccc

SEQ ID NO: 1088579 - RNA, 22 nt, Human
caacacuuucugugaucccaca

SEQ ID NO: 1088580 - RNA, 23 nt, Human
cacacauugaaaauauuguucag

SEQ ID NO: 1088581 - RNA, 18 nt, Human
caccaaaaaagagaccgc

SEQ ID NO: 1088582 - RNA, 18 nt, Human
cagaaagcugccacagac

SEQ ID NO: 1088583 - RNA, 21 nt, Human
cagaaagcugccacagacccu

SEQ ID NO: 1088584 - RNA, 20 nt, Human
cagcuuuggaugccaaagca

SEQ ID NO: 1088585 - RNA, 24 nt, Human
cagugagucccuuuaccuggcuga

SEQ ID NO: 1088586 - RNA, 24 nt, Human
caucgcuaggguaggagaaaaaaa

SEQ ID NO: 1088587 - RNA, 18 nt, Human
cauuucuuggaaacaagc

SEQ ID NO: 1088588 - RNA, 24 nt, Human
ccacagacccucuccaugagauuu

SEQ ID NO: 1088589 - RNA, 22 nt, Human
cccccagccccuucccuuugga

SEQ ID NO: 1088590 - RNA, 23 nt, Human
cccuaggugucuuuggaaagcuc

SEQ ID NO: 1088591 - RNA, 23 nt, Human
cccucuccaugagauuuuuaaaa

SEQ ID NO: 1088592 - RNA, 22 nt, Human
ccgcccaggggcccgccagcga

SEQ ID NO: 1088593 - RNA, 25 nt, Human
ccucauugugucacgagacggaggc

SEQ ID NO: 1088594 - RNA, 20 nt, Human
ccucuaugagcaaauccaaa

SEQ ID NO: 1088595 - RNA, 18 nt, Human
ccugaacugcccggcacu

SEQ ID NO: 1088596 - RNA, 22 nt, Human
ccugaagcaacacuuucuguga

SEQ ID NO: 1088597 - RNA, 21 nt, Human
cgcucagggaucgggcugcuc

SEQ ID NO: 1088598 - RNA, 21 nt, Human
cggaggcagggucguccugcc

SEQ ID NO: 1088599 - RNA, 22 nt, Human
cuaggugucuuuggaaagcucc

SEQ ID NO: 1088600 - RNA, 22 nt, Human
cucaaaacaggguagcuaagga

SEQ ID NO: 1088601 - RNA, 22 nt, Human
cucaagaaauguaggaggcacc

SEQ ID NO: 1088602 - RNA, 22 nt, Human
cucacagaggagccuccaccgc

SEQ ID NO: 1088603 - RNA, 18 nt, Human
cuccucaguguccuuggc

SEQ ID NO: 1088604 - RNA, 18 nt, Human
cucuuacugaggaacaaa

SEQ ID NO: 1088605 - RNA, 22 nt, Human
cugaaaacuccaccugcugugg

SEQ ID NO: 1088606 - RNA, 18 nt, Human
cugcucccucauuguguc

SEQ ID NO: 1088607 - RNA, 22 nt, Human
cugguucccccagccccuuccc

SEQ ID NO: 1088608 - RNA, 20 nt, Human
cuguaccucacggcgcccgc

SEQ ID NO: 1088609 - RNA, 22 nt, Human
cuuaugaaauggagcugugugu

SEQ ID NO: 1088610 - RNA, 20 nt, Human
gaauuucuuuauuucucuua

SEQ ID NO: 1088611 - RNA, 22 nt, Human
gagcaaauccaaauugugagau

SEQ ID NO: 1088612 - RNA, 18 nt, Human
gagcagcagccuaguggg

SEQ ID NO: 1088613 - RNA, 19 nt, Human
gagcagcagccuagugggg

SEQ ID NO: 1088614 - RNA, 18 nt, Human
gagccggggcugggggag

SEQ ID NO: 1088615 - RNA, 19 nt, Human
gagccggggcugggggagg

SEQ ID NO: 1088616 - RNA, 18 nt, Human
gagccuccaccgcagccc

SEQ ID NO: 1088617 - RNA, 19 nt, Human
gaguaauaaaagaaacccc

SEQ ID NO: 1088618 - RNA, 20 nt, Human
gaguuugguuucugaaugga

SEQ ID NO: 1088619 - RNA, 23 nt, Human
gaugccaaagcagcugcucagcg

SEQ ID NO: 1088620 - RNA, 22 nt, Human
gcgaauuucuuuauuucucuua

SEQ ID NO: 1088621 - RNA, 20 nt, Human
gcugccacagacccucucca

SEQ ID NO: 1088622 - RNA, 21 nt, Human
gcugccacagacccucuccau

SEQ ID NO: 1088623 - RNA, 21 nt, Human
ggaaaaguaaaacuuucaaaa

SEQ ID NO: 1088624 - RNA, 21 nt, Human
ggaaccacuuaugcaaaacuu

SEQ ID NO: 1088625 - RNA, 21 nt, Human
ggaggggccacgaucacagug

SEQ ID NO: 1088626 - RNA, 24 nt, Human
ggcggccagguacccgccuucucc

SEQ ID NO: 1088627 - RNA, 20 nt, Human
ggggcugggggaggagguuu

SEQ ID NO: 1088628 - RNA, 21 nt, Human
guaggagaaaaaaaaaaaagc

SEQ ID NO: 1088629 - RNA, 18 nt, Human
uaaaacaaagggcugcga

SEQ ID NO: 1088630 - RNA, 23 nt, Human
uaaaacacucccuucuuaaaaca

SEQ ID NO: 1088631 - RNA, 22 nt, Human
uacacagugaccaaagggucaa

SEQ ID NO: 1088632 - RNA, 21 nt, Human
uaccuggaagaggucaucgcu

SEQ ID NO: 1088633 - RNA, 18 nt, Human
uagagcucacagaggagc

SEQ ID NO: 1088634 - RNA, 20 nt, Human
uaugaaauggagcugugugu

SEQ ID NO: 1088635 - RNA, 26 nt, Human
uaugaaauggagcuguguguuucuaa

SEQ ID NO: 1088636 - RNA, 20 nt, Human
ucaauuccucgcugucuccc

SEQ ID NO: 1088637 - RNA, 18 nt, Human
ucaguccagaaagcugcc

SEQ ID NO: 1088638 - RNA, 26 nt, Human
ucaguccagaaagcugccacagaccc

SEQ ID NO: 1088639 - RNA, 18 nt, Human
uccaccgcagccccgggu

SEQ ID NO: 1088640 - RNA, 18 nt, Human
ucccuuuggaaagagcag

SEQ ID NO: 1088641 - RNA, 18 nt, Human
ugaaaaaaacaagcaaga

SEQ ID NO: 1088642 - RNA, 22 nt, Human
ugaaaacuccaccugcugugga

SEQ ID NO: 1088643 - RNA, 21 nt, Human
ugaacccagacagaugcaggg

SEQ ID NO: 1088644 - RNA, 23 nt, Human
ugagaugggaacccugcuuuuug

SEQ ID NO: 1088645 - RNA, 24 nt, Human
ugagaugggaacccugcuuuuugg

SEQ ID NO: 1088646 - RNA, 23 nt, Human
ugcauauugcugcucaaaacagg

SEQ ID NO: 1088647 - RNA, 23 nt, Human
ugccacagacccucuccaugaga

SEQ ID NO: 1088648 - RNA, 21 nt, Human
uggaaagagcagcagccuagu

SEQ ID NO: 1088649 - RNA, 22 nt, Human
uggaaagagcagcagccuagug

SEQ ID NO: 1088650 - RNA, 18 nt, Human
uggaaagcuccugucacc

SEQ ID NO: 1088651 - RNA, 20 nt, Human
uggaagaggucaucgcuagg

SEQ ID NO: 1088652 - RNA, 22 nt, Human
uggauggcagugugaauggugc

SEQ ID NO: 1088653 - RNA, 23 nt, Human
uggauggcagugugaauggugcu

SEQ ID NO: 1088654 - RNA, 22 nt, Human
uggccaagaacgguguucuccg

SEQ ID NO: 1088655 - RNA, 20 nt, Human
ugggaggcagguagagcuca

SEQ ID NO: 1088656 - RNA, 22 nt, Human
uguaggaggcaccaaaaaagag

SEQ ID NO: 1088657 - RNA, 25 nt, Human
uguccuuggccaagaacgguguucu

SEQ ID NO: 1088658 - RNA, 20 nt, Human
ugucuuuggaaagcuccugu

SEQ ID NO: 1088659 - RNA, 20 nt, Human
uguggaauaauuaaaaacaa

SEQ ID NO: 1088660 - RNA, 18 nt, Human
ugugggggugggcuuccu

SEQ ID NO: 1088661 - RNA, 21 nt, Human
uuaaaaacaaaaaggcauuac

SEQ ID NO: 1088662 - RNA, 22 nt, Human
uuacauuaagaaaugaaaaaaa

SEQ ID NO: 1088663 - RNA, 18 nt, Human
uucugugaucccacagcu

SEQ ID NO: 1088664 - RNA, 23 nt, Human
uugcugcucaaaacaggguagcu

SEQ ID NO: 1088665 - RNA, 22 nt, Human
uuggaaagcuccugucaccuga

SEQ ID NO: 1088666 - RNA, 18 nt, Human
uuggaaggaagaggcugc

SEQ ID NO: 1088667 - RNA, 22 nt, Human
uuugcuuaugaaauggagcugu

SEQ ID NO: 1088668 - RNA, 18 nt, Human
aagcgccugcccaggcca

SEQ ID NO: 1088669 - RNA, 22 nt, Human
aagcgccugcccaggccaggcc

SEQ ID NO: 1088670 - RNA, 23 nt, Human
agggucugccuccuuagcuuucu

SEQ ID NO: 1088671 - RNA, 20 nt, Human
caacuucaagcucuucuccc

SEQ ID NO: 1088672 - RNA, 18 nt, Human
caagcucuucucccugcu

SEQ ID NO: 1088673 - RNA, 19 nt, Human
caagcucuucucccugcuu

SEQ ID NO: 1088674 - RNA, 20 nt, Human
cacaguccaaggcuaaggcu

SEQ ID NO: 1088675 - RNA, 23 nt, Human
caccucuggaccuauggcagcuu

SEQ ID NO: 1088676 - RNA, 24 nt, Human
cacgcccaccaucucacaguccaa

SEQ ID NO: 1088677 - RNA, 18 nt, Human
ccaggccaggccgaaaca

SEQ ID NO: 1088678 - RNA, 20 nt, Human
ccaggccaggccgaaacaca

SEQ ID NO: 1088679 - RNA, 19 nt, Human
ccccggccuccccgggccc

SEQ ID NO: 1088680 - RNA, 23 nt, Human
cccgagaccccggccuccccggg

SEQ ID NO: 1088681 - RNA, 24 nt, Human
ccugcuugagguucucaggcugaa

SEQ ID NO: 1088682 - RNA, 24 nt, Human
ccugggccggccgccacccgagac

SEQ ID NO: 1088683 - RNA, 19 nt, Human
cgccugggccggccgccac

SEQ ID NO: 1088684 - RNA, 22 nt, Human
cuacuugucauaaacgcacuuc

SEQ ID NO: 1088685 - RNA, 24 nt, Human
cucacgcccaccaucucacagucc

SEQ ID NO: 1088686 - RNA, 23 nt, Human
cuugagguucucaggcugaaucc

SEQ ID NO: 1088687 - RNA, 24 nt, Human
gacucaacuguuuccucgcuaucu

SEQ ID NO: 1088688 - RNA, 20 nt, Human
gccgccacccgagaccccgg

SEQ ID NO: 1088689 - RNA, 21 nt, Human
ggccgccacccgagaccccgg

SEQ ID NO: 1088690 - RNA, 22 nt, Human
gguggggcagggucugccuccu

SEQ ID NO: 1088691 - RNA, 21 nt, Human
uccacgagucugaggcugacg

SEQ ID NO: 1088692 - RNA, 19 nt, Human
uccacgucgucaaaccaca

SEQ ID NO: 1088693 - RNA, 21 nt, Human
uccagcgccugggccggccgc

SEQ ID NO: 1088694 - RNA, 22 nt, Human
ucucacaguccaaggcuaaggc

SEQ ID NO: 1088695 - RNA, 19 nt, Human
ucugaacaacuucaagcuc

SEQ ID NO: 1088696 - RNA, 20 nt, Human
ucuggaccuauggcagcuuc

SEQ ID NO: 1088697 - RNA, 19 nt, Human
ugcccaggccaggccgaaa

SEQ ID NO: 1088698 - RNA, 22 nt, Human
uggcagcacaagcgccugccca

SEQ ID NO: 1088699 - RNA, 23 nt, Human
aaaaaaaaaacacaaaaagauaa

SEQ ID NO: 1088700 - RNA, 28 nt, Human
aaaaaaaaaacacaaaaagauaaggcag

SEQ ID NO: 1088701 - RNA, 29 nt, Human
aaaaaaaaaacacaaaaagauaaggcaga

SEQ ID NO: 1088702 - RNA, 20 nt, Human
agaaaaaaaaaacacaaaaa

SEQ ID NO: 1088703 - RNA, 21 nt, Human
agaaaaaaaaaacacaaaaag

SEQ ID NO: 1088704 - RNA, 23 nt, Human
agaaaaaaaaaacacaaaaagau

SEQ ID NO: 1088705 - RNA, 21 nt, Human
aggcagaaacaaaaauuccag

SEQ ID NO: 1088706 - RNA, 20 nt, Human
aggcagaaacaaaaauuccg

SEQ ID NO: 1088707 - RNA, 21 nt, Human
caaaaagauaaggcagaaaca

SEQ ID NO: 1088708 - RNA, 24 nt, Human
caauggcuaugguuccugaaauuu

SEQ ID NO: 1088709 - RNA, 18 nt, Human
cagaaaaaaaaaacacaa

SEQ ID NO: 1088710 - RNA, 22 nt, Human
cagaaaaaaaaaacacaaaaag

SEQ ID NO: 1088711 - RNA, 20 nt, Human
uauucagaaaaaaaaaacac

SEQ ID NO: 1088712 - RNA, 24 nt, Human
ucaccaaaguuuguuacuguucac

SEQ ID NO: 1088713 - RNA, 22 nt, Human
aaaaaagaaaaaugcuaaagga

SEQ ID NO: 1088714 - RNA, 19 nt, Human
aaacaauaccaccucuauc

SEQ ID NO: 1088715 - RNA, 26 nt, Human
aaacagaggcccaaagagcucaagca

SEQ ID NO: 1088716 - RNA, 21 nt, Human
aaaccgcauauugagcuaugg

SEQ ID NO: 1088717 - RNA, 19 nt, Human
aaauaaacuuaaacuauaa

SEQ ID NO: 1088718 - RNA, 19 nt, Human
aacugccacaguacagugc

SEQ ID NO: 1088719 - RNA, 23 nt, Human
aagaagaaugccaaccagcgccc

SEQ ID NO: 1088720 - RNA, 23 nt, Human
aaguguggggauuacaggcguga

SEQ ID NO: 1088721 - RNA, 21 nt, Human
acaaaguaauaaacagugcac

SEQ ID NO: 1088722 - RNA, 22 nt, Human
acaaauccaaagggaacugcca

SEQ ID NO: 1088723 - RNA, 20 nt, Human
acaagucaaacaauaccacc

SEQ ID NO: 1088724 - RNA, 24 nt, Human
acagaaaauggaggaaaggggacc

SEQ ID NO: 1088725 - RNA, 24 nt, Human
acagcaaagaccauauccugggug

SEQ ID NO: 1088726 - RNA, 19 nt, Human
acccagagccuccuaccuc

SEQ ID NO: 1088727 - RNA, 18 nt, Human
accgcauauugagcuaug

SEQ ID NO: 1088728 - RNA, 22 nt, Human
accuggaagacagcugcguaac

SEQ ID NO: 1088729 - RNA, 24 nt, Human
accuugugauccaccugccucggu

SEQ ID NO: 1088730 - RNA, 20 nt, Human
acgccauucuccucccucag

SEQ ID NO: 1088731 - RNA, 20 nt, Human
acuauaagagaugagacugc

SEQ ID NO: 1088732 - RNA, 20 nt, Human
acugcaagcuccgccuccua

SEQ ID NO: 1088733 - RNA, 19 nt, Human
agaauccuucaccaguacc

SEQ ID NO: 1088734 - RNA, 18 nt, Human
agauaguaaaaucaaacu

SEQ ID NO: 1088735 - RNA, 19 nt, Human
agcagcugggacugcaggc

SEQ ID NO: 1088736 - RNA, 22 nt, Human
agccaaaucccagcgagcgcug

SEQ ID NO: 1088737 - RNA, 20 nt, Human
agcgcugaucaacacaucca

SEQ ID NO: 1088738 - RNA, 26 nt, Human
aggaggaggcggaggaggagggaccc

SEQ ID NO: 1088739 - RNA, 22 nt, Human
aggcccaaagagcucaagcaag

SEQ ID NO: 1088740 - RNA, 20 nt, Human
aggcggaggaggacuuggga

SEQ ID NO: 1088741 - RNA, 23 nt, Human
aggcgugagccacugugcccggc

SEQ ID NO: 1088742 - RNA, 25 nt, Human
aggcuggagugcaguggcgugaucu

SEQ ID NO: 1088743 - RNA, 23 nt, Human
agugcaguggcgugaucuuggcu

SEQ ID NO: 1088744 - RNA, 24 nt, Human
agugcaguggcgugaucuuggcuc

SEQ ID NO: 1088745 - RNA, 23 nt, Human
aguucucggccuuuaaacagcuc

SEQ ID NO: 1088746 - RNA, 20 nt, Human
auccagucaccuggaagaca

SEQ ID NO: 1088747 - RNA, 24 nt, Human
auccagucaccuggaagacagcug

SEQ ID NO: 1088748 - RNA, 23 nt, Human
aucccacccugggggccuugcag

SEQ ID NO: 1088749 - RNA, 24 nt, Human
augaaaaaagaaaaaugcuaaagg

SEQ ID NO: 1088750 - RNA, 20 nt, Human
augaaacacacuguauccug

SEQ ID NO: 1088751 - RNA, 22 nt, Human
augagcccagagcacauacaaa

SEQ ID NO: 1088752 - RNA, 23 nt, Human
augccagagugaacaucagugag

SEQ ID NO: 1088753 - RNA, 26 nt, Human
caaaauaugucccugacugaaacuga

SEQ ID NO: 1088754 - RNA, 23 nt, Human
caaacagcaaagaccauauccug

SEQ ID NO: 1088755 - RNA, 21 nt, Human
caaauccagaauccuucaccg

SEQ ID NO: 1088756 - RNA, 24 nt, Human
caaccaccagaagcggccgucuca

SEQ ID NO: 1088757 - RNA, 19 nt, Human
caacucugcgaucguauag

SEQ ID NO: 1088758 - RNA, 19 nt, Human
caacugcugcagcucacga

SEQ ID NO: 1088759 - RNA, 19 nt, Human
cacaaucuuaacgauugcc

SEQ ID NO: 1088760 - RNA, 24 nt, Human
cacagcuuuccuucacucuaauuc

SEQ ID NO: 1088761 - RNA, 23 nt, Human
cacauggagauguucuguccccc

SEQ ID NO: 1088762 - RNA, 24 nt, Human
caccguguuugccuggauggucuc

SEQ ID NO: 1088763 - RNA, 21 nt, Human
caggcgcccgccaccacgccc

SEQ ID NO: 1088764 - RNA, 21 nt, Human
caggcgcccgccaccacgccc

SEQ ID NO: 1088765 - RNA, 22 nt, Human
caggcgcccgccaccacgcccg

SEQ ID NO: 1088766 - RNA, 19 nt, Human
caguguguaaacauuuuca

SEQ ID NO: 1088767 - RNA, 24 nt, Human
caguguguaaacauuuucaguugc

SEQ ID NO: 1088768 - RNA, 26 nt, Human
cauacaaauccaaagggaacugccac

SEQ ID NO: 1088769 - RNA, 24 nt, Human
cauccacaaucuuaacgauugccc

SEQ ID NO: 1088770 - RNA, 19 nt, Human
cauucuuggcaccggaaca

SEQ ID NO: 1088771 - RNA, 18 nt, Human
ccacccagagccuccuac

SEQ ID NO: 1088772 - RNA, 20 nt, Human
ccacccagagccuccuaccu

SEQ ID NO: 1088773 - RNA, 18 nt, Human
ccagagcacauacaaauc

SEQ ID NO: 1088774 - RNA, 22 nt, Human
ccagcugauguuccacuuguuc

SEQ ID NO: 1088775 - RNA, 19 nt, Human
ccaggcaagacucacagcc

SEQ ID NO: 1088776 - RNA, 18 nt, Human
ccaggcuggagugcagug

SEQ ID NO: 1088777 - RNA, 21 nt, Human
ccaggcuggagugcaguggcg

SEQ ID NO: 1088778 - RNA, 23 nt, Human
ccaguccccgcugcgggaggagg

SEQ ID NO: 1088779 - RNA, 22 nt, Human
ccaugaacagagaggaaugcca

SEQ ID NO: 1088780 - RNA, 19 nt, Human
cccaaaagccuguccaggc

SEQ ID NO: 1088781 - RNA, 18 nt, Human
cccagagccuccuaccuc

SEQ ID NO: 1088782 - RNA, 25 nt, Human
ccccaucaacuggcaacauuuucuu

SEQ ID NO: 1088783 - RNA, 18 nt, Human
cccccuguccccaaaagc

SEQ ID NO: 1088784 - RNA, 21 nt, Human
cccccuguccccaaaagccug

SEQ ID NO: 1088785 - RNA, 22 nt, Human
cccccuguccccaaaagccugu

SEQ ID NO: 1088786 - RNA, 18 nt, Human
cccguggauaccuguugc

SEQ ID NO: 1088787 - RNA, 21 nt, Human
cccucuacugcuccuugggcc

SEQ ID NO: 1088788 - RNA, 22 nt, Human
cccucuagcucccuuucagcuu

SEQ ID NO: 1088789 - RNA, 24 nt, Human
ccgaaguguggggauuacaggcgu

SEQ ID NO: 1088790 - RNA, 19 nt, Human
ccggaacagaugaaacaca

SEQ ID NO: 1088791 - RNA, 24 nt, Human
ccggagcagcugggacugcaggcg

SEQ ID NO: 1088792 - RNA, 26 nt, Human
ccuacaauuaugaaaugaaaaaagaa

SEQ ID NO: 1088793 - RNA, 19 nt, Human
ccuaugucagaguaaccga

SEQ ID NO: 1088794 - RNA, 19 nt, Human
ccugaccuugugauccacc

SEQ ID NO: 1088795 - RNA, 21 nt, Human
ccugaccuugugauccaccug

SEQ ID NO: 1088796 - RNA, 22 nt, Human
ccuguuucagagacauuuaaac

SEQ ID NO: 1088797 - RNA, 22 nt, Human
ccuugcagugacuccugauggg

SEQ ID NO: 1088798 - RNA, 19 nt, Human
cgccuccuagguucacgcc

SEQ ID NO: 1088799 - RNA, 23 nt, Human
cggaacagaugaaacacacugua

SEQ ID NO: 1088800 - RNA, 21 nt, Human
cguauagacauguuuccugau

SEQ ID NO: 1088801 - RNA, 24 nt, Human
cuaauucauucuugacuagagccu

SEQ ID NO: 1088802 - RNA, 27 nt, Human
cuacaauuaugaaaugaaaaaagaaaa

SEQ ID NO: 1088803 - RNA, 22 nt, Human
cuacugcuccuugggcccccug

SEQ ID NO: 1088804 - RNA, 22 nt, Human
cucaagcaacuugcccuaaauc

SEQ ID NO: 1088805 - RNA, 21 nt, Human
cucccaucaccaauacacaga

SEQ ID NO: 1088806 - RNA, 20 nt, Human
cuccccaccaucccacccug

SEQ ID NO: 1088807 - RNA, 20 nt, Human
cucccuuucagcuuucuguu

SEQ ID NO: 1088808 - RNA, 21 nt, Human
cuccuagguucacgccauucu

SEQ ID NO: 1088809 - RNA, 24 nt, Human
cuccugaccuugugauccaccugc

SEQ ID NO: 1088810 - RNA, 22 nt, Human
cucucucugccuuccaggcugg

SEQ ID NO: 1088811 - RNA, 24 nt, Human
cucucucugccuuccaggcuggag

SEQ ID NO: 1088812 - RNA, 21 nt, Human
cugaauucuguaaugaacauc

SEQ ID NO: 1088813 - RNA, 24 nt, Human
cugcaagcuccgccuccuagguuc

SEQ ID NO: 1088814 - RNA, 18 nt, Human
cugcacauaccugccaga

SEQ ID NO: 1088815 - RNA, 18 nt, Human
cugccucggucucccgaa

SEQ ID NO: 1088816 - RNA, 23 nt, Human
cugccuuccaggcuggagugcag

SEQ ID NO: 1088817 - RNA, 19 nt, Human
cuggcagaggggcacccag

SEQ ID NO: 1088818 - RNA, 18 nt, Human
cuguccaguuucuucugc

SEQ ID NO: 1088819 - RNA, 22 nt, Human
cuuaaacuauaaauuagaaaca

SEQ ID NO: 1088820 - RNA, 23 nt, Human
cuugcagugacuccugaugggaa

SEQ ID NO: 1088821 - RNA, 24 nt, Human
cuuggcacgggcucugacgcgcau

SEQ ID NO: 1088822 - RNA, 25 nt, Human
cuuggcacgggcucugacgcgcaug

SEQ ID NO: 1088823 - RNA, 20 nt, Human
gaagagcucacugugauuaa

SEQ ID NO: 1088824 - RNA, 22 nt, Human
gaccuugugauccaccugccuc

SEQ ID NO: 1088825 - RNA, 22 nt, Human
gaccuugugauccaccugccuc

SEQ ID NO: 1088826 - RNA, 24 nt, Human
gaccuugugauccaccugccucgg

SEQ ID NO: 1088827 - RNA, 19 nt, Human
gacuagagccuguaugccu

SEQ ID NO: 1088828 - RNA, 19 nt, Human
gagcccagagcacauacaa

SEQ ID NO: 1088829 - RNA, 20 nt, Human
gagcccuccgacuuccuuuc

SEQ ID NO: 1088830 - RNA, 18 nt, Human
gagccuauuccaaaccag

SEQ ID NO: 1088831 - RNA, 19 nt, Human
gagccuccuaccuccagau

SEQ ID NO: 1088832 - RNA, 18 nt, Human
gaggacuugggggagagg

SEQ ID NO: 1088833 - RNA, 19 nt, Human
gagguuggagggcuggccu

SEQ ID NO: 1088834 - RNA, 20 nt, Human
gaguaaccgaggugguugaa

SEQ ID NO: 1088835 - RNA, 18 nt, Human
gauuacaggcgugagcca

SEQ ID NO: 1088836 - RNA, 21 nt, Human
gauuacaggcgugagccacug

SEQ ID NO: 1088837 - RNA, 24 nt, Human
gauuacaggcgugagccacugugc

SEQ ID NO: 1088838 - RNA, 25 nt, Human
gccuccuagguucacgccauucucc

SEQ ID NO: 1088839 - RNA, 26 nt, Human
gcuggaacaccagggcgguuucucug

SEQ ID NO: 1088840 - RNA, 19 nt, Human
gcuggagugcaguggcgug

SEQ ID NO: 1088841 - RNA, 23 nt, Human
ggaaaagaaguaaauuccuaugu

SEQ ID NO: 1088842 - RNA, 21 nt, Human
ggaggacuugggggagaggua

SEQ ID NO: 1088843 - RNA, 23 nt, Human
ggaggacuugggggagagguaga

SEQ ID NO: 1088844 - RNA, 18 nt, Human
ggaggaggcggaggagga

SEQ ID NO: 1088845 - RNA, 19 nt, Human
ggagggcuggccugcgggg

SEQ ID NO: 1088846 - RNA, 22 nt, Human
ggcuggagugcaguggcgugau

SEQ ID NO: 1088847 - RNA, 22 nt, Human
ggcuggccugcggggucacugc

SEQ ID NO: 1088848 - RNA, 22 nt, Human
gggagccuauuccaaaccagcg

SEQ ID NO: 1088849 - RNA, 21 nt, Human
gggaggagguuggagggcugg

SEQ ID NO: 1088850 - RNA, 19 nt, Human
gggagggaggcggggcugg

SEQ ID NO: 1088851 - RNA, 21 nt, Human
gggauuacaggcgugagccac

SEQ ID NO: 1088852 - RNA, 21 nt, Human
gggauuacaggcgugagccac

SEQ ID NO: 1088853 - RNA, 23 nt, Human
gggauuacaggcgugagccacug

SEQ ID NO: 1088854 - RNA, 24 nt, Human
gggcccccuguccccaaaagccug

SEQ ID NO: 1088855 - RNA, 22 nt, Human
ggggauuacaggcgugagccac

SEQ ID NO: 1088856 - RNA, 24 nt, Human
ggggauuacaggcgugagccacug

SEQ ID NO: 1088857 - RNA, 19 nt, Human
gggguggggagggaggcgg

SEQ ID NO: 1088858 - RNA, 22 nt, Human
gggguggggagggaggcggggc

SEQ ID NO: 1088859 - RNA, 21 nt, Human
ggguggggagggaggcggggc

SEQ ID NO: 1088860 - RNA, 23 nt, Human
ggguggggagggaggcggggcug

SEQ ID NO: 1088861 - RNA, 19 nt, Human
ggucucgaucuccugaccu

SEQ ID NO: 1088862 - RNA, 20 nt, Human
ggucucgaucuccugaccuu

SEQ ID NO: 1088863 - RNA, 26 nt, Human
guccaguuucuucugccauugugggg

SEQ ID NO: 1088864 - RNA, 21 nt, Human
gugaaaacagaggcccaaaga

SEQ ID NO: 1088865 - RNA, 24 nt, Human
gugauccaccugccucggucuccc

SEQ ID NO: 1088866 - RNA, 19 nt, Human
guggcuguucucauugucc

SEQ ID NO: 1088867 - RNA, 20 nt, Human
guucuuggcacgggcucuga

SEQ ID NO: 1088868 - RNA, 19 nt, Human
uaaaacagggaacacgaac

SEQ ID NO: 1088869 - RNA, 19 nt, Human
uaaaucauaucccuagcag

SEQ ID NO: 1088870 - RNA, 22 nt, Human
uaaauuagaaacacaaauaauc

SEQ ID NO: 1088871 - RNA, 21 nt, Human
uaacuguugauucuuucccaa

SEQ ID NO: 1088872 - RNA, 21 nt, Human
uaagaagaaugccaaccagcg

SEQ ID NO: 1088873 - RNA, 27 nt, Human
uaagcuaggaaagguuuuccacaucca

SEQ ID NO: 1088874 - RNA, 19 nt, Human
uacaaaguaauaaacagug

SEQ ID NO: 1088875 - RNA, 23 nt, Human
uacaggcgugagccacugugccc

SEQ ID NO: 1088876 - RNA, 23 nt, Human
uacaggcgugagccacugugccc

SEQ ID NO: 1088877 - RNA, 19 nt, Human
uacauuaagaagaaugcca

SEQ ID NO: 1088878 - RNA, 21 nt, Human
uacauuaagaagaaugccaac

SEQ ID NO: 1088879 - RNA, 20 nt, Human
uacugcuccuugggcccccu

SEQ ID NO: 1088880 - RNA, 21 nt, Human
uagaaacacaaauaaucauga

SEQ ID NO: 1088881 - RNA, 19 nt, Human
uagaaagcucccccaaaag

SEQ ID NO: 1088882 - RNA, 18 nt, Human
uagcagacggagaggcag

SEQ ID NO: 1088883 - RNA, 18 nt, Human
uagcagacggagaggcag

SEQ ID NO: 1088884 - RNA, 27 nt, Human
uagcagaugauguagggcccuccucuu

SEQ ID NO: 1088885 - RNA, 24 nt, Human
uagcucccuuucagcuuucuguuu

SEQ ID NO: 1088886 - RNA, 19 nt, Human
uaucauacagacgugaaaa

SEQ ID NO: 1088887 - RNA, 19 nt, Human
uauccuggguguccugggu

SEQ ID NO: 1088888 - RNA, 19 nt, Human
uauuucaccguguuugccu

SEQ ID NO: 1088889 - RNA, 22 nt, Human
ucaccaguacccaacaguccau

SEQ ID NO: 1088890 - RNA, 18 nt, Human
ucacugcaagcuccgccu

SEQ ID NO: 1088891 - RNA, 19 nt, Human
ucacugcaagcuccgccuc

SEQ ID NO: 1088892 - RNA, 19 nt, Human
ucacugcaagcuccgccuc

SEQ ID NO: 1088893 - RNA, 24 nt, Human
ucacugcaagcuccgccuccuagg

SEQ ID NO: 1088894 - RNA, 19 nt, Human
ucacugcaccuccacccag

SEQ ID NO: 1088895 - RNA, 20 nt, Human
ucacugcaccuccacccaga

SEQ ID NO: 1088896 - RNA, 22 nt, Human
ucacugcaccuccacccagagc

SEQ ID NO: 1088897 - RNA, 24 nt, Human
ucagucgacugauuuuuauggacc

SEQ ID NO: 1088898 - RNA, 19 nt, Human
uccacaaucuuaacgauug

SEQ ID NO: 1088899 - RNA, 21 nt, Human
uccacaaucuuaacgauugcc

SEQ ID NO: 1088900 - RNA, 19 nt, Human
uccauccacaaucuuaacg

SEQ ID NO: 1088901 - RNA, 24 nt, Human
ucccgaaguguggggauuacaggc

SEQ ID NO: 1088902 - RNA, 20 nt, Human
ucccuagcagacggagaggc

SEQ ID NO: 1088903 - RNA, 23 nt, Human
ucccucagacuccggagcagcug

SEQ ID NO: 1088904 - RNA, 22 nt, Human
uccgacuuccuuucuuccccau

SEQ ID NO: 1088905 - RNA, 24 nt, Human
uccggagcagcugggacugcaggc

SEQ ID NO: 1088906 - RNA, 18 nt, Human
uccuggguguccugggug

SEQ ID NO: 1088907 - RNA, 18 nt, Human
uccuugggcccccugucc

SEQ ID NO: 1088908 - RNA, 22 nt, Human
uccuuucuuccccaucaacugg

SEQ ID NO: 1088909 - RNA, 21 nt, Human
ucggccuuuaaacagcucuaa

SEQ ID NO: 1088910 - RNA, 18 nt, Human
ucuacugcuccuugggcc

SEQ ID NO: 1088911 - RNA, 23 nt, Human
ucucagggcuacugccauuugcu

SEQ ID NO: 1088912 - RNA, 18 nt, Human
ucucccgaagugugggga

SEQ ID NO: 1088913 - RNA, 24 nt, Human
ucucucucugccuuccaggcugga

SEQ ID NO: 1088914 - RNA, 22 nt, Human
ucucucugccuuccaggcugga

SEQ ID NO: 1088915 - RNA, 24 nt, Human
ucucucugccuuccaggcuggagu

SEQ ID NO: 1088916 - RNA, 19 nt, Human
ucugagcccuccgacuucc

SEQ ID NO: 1088917 - RNA, 23 nt, Human
ucuguguucaaucucuggauuug

SEQ ID NO: 1088918 - RNA, 20 nt, Human
ucuuaucuccccaccauccc

SEQ ID NO: 1088919 - RNA, 22 nt, Human
ugaaacggagucucucucugcc

SEQ ID NO: 1088920 - RNA, 28 nt, Human
ugaacucccaccacguaagggcaaacuc

SEQ ID NO: 1088921 - RNA, 23 nt, Human
ugaccuugugauccaccugccuc

SEQ ID NO: 1088922 - RNA, 19 nt, Human
ugacgcgcaugcagagagg

SEQ ID NO: 1088923 - RNA, 20 nt, Human
ugacuagagccuguaugccu

SEQ ID NO: 1088924 - RNA, 21 nt, Human
ugagacugcacauggagaugu

SEQ ID NO: 1088925 - RNA, 24 nt, Human
ugagacugcacauggagauguucu

SEQ ID NO: 1088926 - RNA, 18 nt, Human
ugauguagggcccucccc

SEQ ID NO: 1088927 - RNA, 22 nt, Human
ugcaguggcgugaucuuggcuc

SEQ ID NO: 1088928 - RNA, 19 nt, Human
ugcgggaggagguuggagg

SEQ ID NO: 1088929 - RNA, 19 nt, Human
uggagugcaguggcgugau

SEQ ID NO: 1088930 - RNA, 23 nt, Human
uggagugcaguggcgugaucuug

SEQ ID NO: 1088931 - RNA, 24 nt, Human
uggagugcaguggcgugaucuugg

SEQ ID NO: 1088932 - RNA, 18 nt, Human
uggcucacugcaagcucc

SEQ ID NO: 1088933 - RNA, 21 nt, Human
ugggacugcaggcgcccgcca

SEQ ID NO: 1088934 - RNA, 22 nt, Human
uggggagggaggcggggcuggg

SEQ ID NO: 1088935 - RNA, 18 nt, Human
ugggguggggagggaggc

SEQ ID NO: 1088936 - RNA, 26 nt, Human
ugggguggggagggaggcggggcugg

SEQ ID NO: 1088937 - RNA, 20 nt, Human
ugugggguggggagggaggc

SEQ ID NO: 1088938 - RNA, 18 nt, Human
uguuucuucuguuguuuc

SEQ ID NO: 1088939 - RNA, 19 nt, Human
uuagggcuggguugugugu

SEQ ID NO: 1088940 - RNA, 21 nt, Human
uucacaaacaguagauugcag

SEQ ID NO: 1088941 - RNA, 22 nt, Human
uucacaaauacaagucaaacaa

SEQ ID NO: 1088942 - RNA, 24 nt, Human
uuccaggcuggagugcaguggcgu

SEQ ID NO: 1088943 - RNA, 20 nt, Human
uuuaaaaauuucuugagcag

SEQ ID NO: 1088944 - RNA, 18 nt, Human
uuuccaguucucggccuu

SEQ ID NO: 1088945 - RNA, 20 nt, Human
uuuucuuuuuugaaacggag

SEQ ID NO: 1088946 - RNA, 24 nt, Human
aaaaaauaaaagaccaggacaccc

SEQ ID NO: 1088947 - RNA, 20 nt, Human
aaaagaccaggacacccaga

SEQ ID NO: 1088948 - RNA, 23 nt, Human
aaaagaccaggacacccagagug

SEQ ID NO: 1088949 - RNA, 22 nt, Human
aaccgucccuuagccgcuucca

SEQ ID NO: 1088950 - RNA, 19 nt, Human
accccuacccccccgccac

SEQ ID NO: 1088951 - RNA, 24 nt, Human
accugggcgcagcucugcuccagg

SEQ ID NO: 1088952 - RNA, 19 nt, Human
accuugguggccuugcccg

SEQ ID NO: 1088953 - RNA, 23 nt, Human
accuugguggccuugcccgccuu

SEQ ID NO: 1088954 - RNA, 20 nt, Human
acucccagagcgaggcgggg

SEQ ID NO: 1088955 - RNA, 24 nt, Human
agccaguggccggcucggggcgcg

SEQ ID NO: 1088956 - RNA, 19 nt, Human
agcgagucgacgccccagg

SEQ ID NO: 1088957 - RNA, 19 nt, Human
aggccgcggcgcggccccg

SEQ ID NO: 1088958 - RNA, 21 nt, Human
aggggaguagggaaccagggg

SEQ ID NO: 1088959 - RNA, 21 nt, Human
agggggcgacgccuggcuuca

SEQ ID NO: 1088960 - RNA, 21 nt, Human
auaaaagaccaggacacccag

SEQ ID NO: 1088961 - RNA, 23 nt, Human
aucugaaaucccucccagggcca

SEQ ID NO: 1088962 - RNA, 19 nt, Human
caaaaaaacaccgaggcuc

SEQ ID NO: 1088963 - RNA, 21 nt, Human
caaaaaauaaaagaccaggac

SEQ ID NO: 1088964 - RNA, 24 nt, Human
cacaucacucacuacuacagccag

SEQ ID NO: 1088965 - RNA, 19 nt, Human
caccacccaaaaaaacacc

SEQ ID NO: 1088966 - RNA, 23 nt, Human
caccacccaaaaaaacaccgagg

SEQ ID NO: 1088967 - RNA, 28 nt, Human
cacccagagugagaugcaugucggggac

SEQ ID NO: 1088968 - RNA, 19 nt, Human
caccuggaggagaaggggu

SEQ ID NO: 1088969 - RNA, 20 nt, Human
caccuggaggagaagggguu

SEQ ID NO: 1088970 - RNA, 26 nt, Human
cagacccuguggccgucacacccugc

SEQ ID NO: 1088971 - RNA, 18 nt, Human
cagagaaauaaggcucag

SEQ ID NO: 1088972 - RNA, 23 nt, Human
cagagaaauaaggcucagagccg

SEQ ID NO: 1088973 - RNA, 21 nt, Human
cagagccgucugaggucagaa

SEQ ID NO: 1088974 - RNA, 18 nt, Human
cagcaggggggcccuggc

SEQ ID NO: 1088975 - RNA, 19 nt, Human
cagcccccaaccgucccuu

SEQ ID NO: 1088976 - RNA, 18 nt, Human
cagcguguagccaguggc

SEQ ID NO: 1088977 - RNA, 21 nt, Human
caggaaccgggaagggcgggc

SEQ ID NO: 1088978 - RNA, 19 nt, Human
cagggccaggccgcagccg

SEQ ID NO: 1088979 - RNA, 22 nt, Human
cauggcgcaggaagcggugguc

SEQ ID NO: 1088980 - RNA, 22 nt, Human
ccaaaaaaacaccgaggcucag

SEQ ID NO: 1088981 - RNA, 23 nt, Human
ccaaccgucccuuagccgcuucc

SEQ ID NO: 1088982 - RNA, 22 nt, Human
ccaccacccaaaaaaacaccga

SEQ ID NO: 1088983 - RNA, 19 nt, Human
ccacccaaaaaaacaccga

SEQ ID NO: 1088984 - RNA, 22 nt, Human
ccaccugacggcuucccuuccc

SEQ ID NO: 1088985 - RNA, 21 nt, Human
ccagcuccuggggggcuggga

SEQ ID NO: 1088986 - RNA, 19 nt, Human
ccaggcccagggcuggggc

SEQ ID NO: 1088987 - RNA, 25 nt, Human
cccacaucacucacuacuacagcca

SEQ ID NO: 1088988 - RNA, 20 nt, Human
cccacccacaucacucacua

SEQ ID NO: 1088989 - RNA, 24 nt, Human
cccagcccccaaccgucccuuagc

SEQ ID NO: 1088990 - RNA, 21 nt, Human
cccaggaggcccaggaagcac

SEQ ID NO: 1088991 - RNA, 21 nt, Human
cccagggccaggccgcagccg

SEQ ID NO: 1088992 - RNA, 18 nt, Human
cccagggcuggggcugga

SEQ ID NO: 1088993 - RNA, 19 nt, Human
ccccacaccccuacccccc

SEQ ID NO: 1088994 - RNA, 19 nt, Human
ccccacaccccuacccccc

SEQ ID NO: 1088995 - RNA, 23 nt, Human
ccccacaccccuacccccccgcc

SEQ ID NO: 1088996 - RNA, 20 nt, Human
ccccacccacaucacucacu

SEQ ID NO: 1088997 - RNA, 19 nt, Human
ccccagggcuccccgaggg

SEQ ID NO: 1088998 - RNA, 20 nt, Human
cccccacaccccuacccccc

SEQ ID NO: 1088999 - RNA, 21 nt, Human
cccccacaccccuaccccccc

SEQ ID NO: 1089000 - RNA, 21 nt, Human
cccccacaccccuaccccccc

SEQ ID NO: 1089001 - RNA, 23 nt, Human
cccccacaccccuacccccccgc

SEQ ID NO: 1089002 - RNA, 22 nt, Human
ccccccgccaccaccacccugg

SEQ ID NO: 1089003 - RNA, 18 nt, Human
cccccgccaccaccaccc

SEQ ID NO: 1089004 - RNA, 24 nt, Human
cccccgccaccaccacccuggcag

SEQ ID NO: 1089005 - RNA, 24 nt, Human
ccccgccaccaccacccuggcaga

SEQ ID NO: 1089006 - RNA, 19 nt, Human
ccccgggagguggguggcg

SEQ ID NO: 1089007 - RNA, 26 nt, Human
ccccuacccccccgccaccaccaccc

SEQ ID NO: 1089008 - RNA, 20 nt, Human
ccccugcuccuuuguucggc

SEQ ID NO: 1089009 - RNA, 22 nt, Human
ccgcagccgcugacccgagggg

SEQ ID NO: 1089010 - RNA, 20 nt, Human
ccgcggcgcggccccgggag

SEQ ID NO: 1089011 - RNA, 20 nt, Human
ccuacccccccgccaccacc

SEQ ID NO: 1089012 - RNA, 23 nt, Human
ccucccagggccaggccgcagcc

SEQ ID NO: 1089013 - RNA, 21 nt, Human
ccucccgcccgggggagccca

SEQ ID NO: 1089014 - RNA, 22 nt, Human
ccucccgcccgggggagcccac

SEQ ID NO: 1089015 - RNA, 28 nt, Human
ccucgcagucgcggaaggccacauugcc

SEQ ID NO: 1089016 - RNA, 18 nt, Human
ccugcagcacgaccuggg

SEQ ID NO: 1089017 - RNA, 22 nt, Human
ccuggcuucauccacccaggag

SEQ ID NO: 1089018 - RNA, 23 nt, Human
ccuugagcgugccgcugggcccc

SEQ ID NO: 1089019 - RNA, 25 nt, Human
cgcagcccaggcccagggcuggggc

SEQ ID NO: 1089020 - RNA, 23 nt, Human
cgccaccaccacccuggcagaac

SEQ ID NO: 1089021 - RNA, 21 nt, Human
cgccacggugaggaagcggcg

SEQ ID NO: 1089022 - RNA, 30 nt, Human; identical to SEQ ID NO: 372438

SEQ ID NO: 1089023 - RNA, 20 nt, Human
cgccccagggcacgucgcgg

SEQ ID NO: 1089024 - RNA, 21 nt, Human
cgccgccagguagcggcccag

SEQ ID NO: 1089025 - RNA, 22 nt, Human
cgcguuaaccuugaacccgaac

SEQ ID NO: 1089026 - RNA, 20 nt, Human
cggcccagguggcugcgcag

SEQ ID NO: 1089027 - RNA, 22 nt, Human
cggcccccacaccccuaccccc

SEQ ID NO: 1089028 - RNA, 24 nt, Human
cggcccccacaccccuaccccccc

SEQ ID NO: 1089029 - RNA, 18 nt, Human
cggcgccagguaacggcc

SEQ ID NO: 1089030 - RNA, 21 nt, Human
cggcucggggcgcgccaccag

SEQ ID NO: 1089031 - RNA, 20 nt, Human
cggugguccgcggucugcac

SEQ ID NO: 1089032 - RNA, 23 nt, Human
cuacagccaggcuugccugggac

SEQ ID NO: 1089033 - RNA, 18 nt, Human
cucgcccaccugacggcu

SEQ ID NO: 1089034 - RNA, 18 nt, Human
cugcagcacgaccugggc

SEQ ID NO: 1089035 - RNA, 18 nt, Human
cugcgcaggcacacggcc

SEQ ID NO: 1089036 - RNA, 26 nt, Human
cuuccggucaggcuagggugaaagga

SEQ ID NO: 1089037 - RNA, 20 nt, Human
gacgggacgggggagacugg

SEQ ID NO: 1089038 - RNA, 23 nt, Human
gagacgccccacccacaucacuc

SEQ ID NO: 1089039 - RNA, 21 nt, Human
gaucugcugcuucuucaggcu

SEQ ID NO: 1089040 - RNA, 22 nt, Human
gcacccccuggggagggugcug

SEQ ID NO: 1089041 - RNA, 24 nt, Human
gcagcacgaccugggcgcagcucu

SEQ ID NO: 1089042 - RNA, 21 nt, Human
gccacauugccggagcggaac

SEQ ID NO: 1089043 - RNA, 21 nt, Human
gccaccaccacccuggcagaa

SEQ ID NO: 1089044 - RNA, 21 nt, Human
gccacggugaggaagcggcag

SEQ ID NO: 1089045 - RNA, 19 nt, Human
gccacgugggagaggggcu

SEQ ID NO: 1089046 - RNA, 21 nt, Human
gcccagggcuggggcuggacc

SEQ ID NO: 1089047 - RNA, 22 nt, Human
gcccagguggcugcgcaggcac

SEQ ID NO: 1089048 - RNA, 19 nt, Human
gcccccaaccgucccuuag

SEQ ID NO: 1089049 - RNA, 21 nt, Human
gccgccugcagcacgaccugg

SEQ ID NO: 1089050 - RNA, 25 nt, Human
gcgccugucauggcgcaggaagcgg

SEQ ID NO: 1089051 - RNA, 20 nt, Human
gcgcugcccgccuagucagg

SEQ ID NO: 1089052 - RNA, 21 nt, Human
gcugcgcaggcacacggccgc

SEQ ID NO: 1089053 - RNA, 18 nt, Human
ggacacgugcccagcucc

SEQ ID NO: 1089054 - RNA, 18 nt, Human
ggacgggggagacuggca

SEQ ID NO: 1089055 - RNA, 26 nt, Human
ggaggagaagggguuagcagggaggg

SEQ ID NO: 1089056 - RNA, 25 nt, Human
ggagggccacugacaggcuugggac

SEQ ID NO: 1089057 - RNA, 20 nt, Human
ggcagcaggggggcccuggc

SEQ ID NO: 1089058 - RNA, 19 nt, Human
ggcgcagcucugcuccagg

SEQ ID NO: 1089059 - RNA, 20 nt, Human
ggcgguggacgggaggccgc

SEQ ID NO: 1089060 - RNA, 18 nt, Human
ggcucggggcgcgccacc

SEQ ID NO: 1089061 - RNA, 20 nt, Human
ggcugggaggagguggcugg

SEQ ID NO: 1089062 - RNA, 21 nt, Human
ggcugggaggggcaagagauu

SEQ ID NO: 1089063 - RNA, 24 nt, Human
gggcaggaaccgggaagggcgggc

SEQ ID NO: 1089064 - RNA, 21 nt, Human
gggcggaggggagacugggaa

SEQ ID NO: 1089065 - RNA, 24 nt, Human
gggggcugggaggagguggcuggg

SEQ ID NO: 1089066 - RNA, 25 nt, Human
uacagccaggcuugccugggacgcc

SEQ ID NO: 1089067 - RNA, 21 nt, Human
uagcggcccagguggcugcgc

SEQ ID NO: 1089068 - RNA, 21 nt, Human
uaggggcgacaggugggggca

SEQ ID NO: 1089069 - RNA, 22 nt, Human
ucacucacuacuacagccaggc

SEQ ID NO: 1089070 - RNA, 21 nt, Human
uccagagaaauaaggcucaga

SEQ ID NO: 1089071 - RNA, 22 nt, Human
uccagcguccagaucugcugcu

SEQ ID NO: 1089072 - RNA, 19 nt, Human
uccccgagggggcgacgcc

SEQ ID NO: 1089073 - RNA, 25 nt, Human
uccccgagggggcgacgccuggcuu

SEQ ID NO: 1089074 - RNA, 20 nt, Human
uccccgcggcggcgccccug

SEQ ID NO: 1089075 - RNA, 23 nt, Human
uccccgcggcggcgccccugcuc

SEQ ID NO: 1089076 - RNA, 20 nt, Human
ucccuucccaagcagggguu

SEQ ID NO: 1089077 - RNA, 21 nt, Human
uccgcagcccaggcccagggc

SEQ ID NO: 1089078 - RNA, 22 nt, Human
uccgcagcccaggcccagggcu

SEQ ID NO: 1089079 - RNA, 23 nt, Human
uccgcggaggcccuuaggacccc

SEQ ID NO: 1089080 - RNA, 20 nt, Human
uccuggggggcugggaggag

SEQ ID NO: 1089081 - RNA, 21 nt, Human
uccuggggggcugggaggagg

SEQ ID NO: 1089082 - RNA, 23 nt, Human
uccuggggggcugggaggaggug

SEQ ID NO: 1089083 - RNA, 19 nt, Human
ucgcggaaggccacauugc

SEQ ID NO: 1089084 - RNA, 18 nt, Human
ugaaaggaaagaggagga

SEQ ID NO: 1089085 - RNA, 24 nt, Human
ugaaaggaaagaggaggaagacgg

SEQ ID NO: 1089086 - RNA, 25 nt, Human
ugaaaggaaagaggaggaagacggc

SEQ ID NO: 1089087 - RNA, 22 nt, Human
ugacaggcuugggacacgugcc

SEQ ID NO: 1089088 - RNA, 26 nt, Human
ugcccagcuccuggggggcuggggcc

SEQ ID NO: 1089089 - RNA, 23 nt, Human
ugccgcugggccccgacggcgcc

SEQ ID NO: 1089090 - RNA, 22 nt, Human
ugcugcuucuucaggcugcugg

SEQ ID NO: 1089091 - RNA, 19 nt, Human
uggcagcaggggggcccug

SEQ ID NO: 1089092 - RNA, 18 nt, Human
uggcugggaggggcaaga

SEQ ID NO: 1089093 - RNA, 21 nt, Human
ugggagaggggcuguuuccag

SEQ ID NO: 1089094 - RNA, 18 nt, Human
ugggaggagguggcuggg

SEQ ID NO: 1089095 - RNA, 21 nt, Human
ugggaggagguggcugggagg

SEQ ID NO: 1089096 - RNA, 24 nt, Human
ugggaggagguggcugggaggggc

SEQ ID NO: 1089097 - RNA, 21 nt, Human
uggggcuggaccggaaggacg

SEQ ID NO: 1089098 - RNA, 22 nt, Human
uggggggcugggaggagguggc

SEQ ID NO: 1089099 - RNA, 21 nt, Human
uuacaaaaaauaaaagaccag

SEQ ID NO: 1089100 - RNA, 21 nt, Human
uucugcuuccggucaggcuag

SEQ ID NO: 1089101 - RNA, 20 nt, Human
uucuucaggcugcuggccga

SEQ ID NO: 1089102 - RNA, 23 nt, Human
uuuucucugggguuuccaguuug

SEQ ID NO: 1089103 - RNA, 26 nt, Human
aaacacaacuucagaguguaagggua

SEQ ID NO: 1089104 - RNA, 26 nt, Human
aaauaacaaaaacaaaaaccaaaaaa

SEQ ID NO: 1089105 - RNA, 23 nt, Human
aacaaaaacaaaaaccaaaaaau

SEQ ID NO: 1089106 - RNA, 21 nt, Human
aauaacaaaaacaaaaaccaa

SEQ ID NO: 1089107 - RNA, 25 nt, Human
aauaacaaaaacaaaaaccaaaaaa

SEQ ID NO: 1089108 - RNA, 22 nt, Human
acacaacuucagaguguaaggg

SEQ ID NO: 1089109 - RNA, 28 nt, Human
accuagcauuaaaaaaaaaaaaaaaaaa

SEQ ID NO: 1089110 - RNA, 24 nt, Human
agacauucagcuucugcccaaaca

SEQ ID NO: 1089111 - RNA, 19 nt, Human
agcacaaauguaugaacag

SEQ ID NO: 1089112 - RNA, 27 nt, Human
aggaaagagaaauaccuuccugcucag

SEQ ID NO: 1089113 - RNA, 20 nt, Human
aggcgugcugagcgguggag

SEQ ID NO: 1089114 - RNA, 20 nt, Human
agggguuuugugcaggucau

SEQ ID NO: 1089115 - RNA, 20 nt, Human
aguuccccucucccuccccc

SEQ ID NO: 1089116 - RNA, 20 nt, Human
auaacaaaaacaaaaaccaa

SEQ ID NO: 1089117 - RNA, 21 nt, Human
aucagccaucuccaccauggc

SEQ ID NO: 1089118 - RNA, 23 nt, Human
caaauaacaaaaacaaaaaccaa

SEQ ID NO: 1089119 - RNA, 18 nt, Human
cacagcguagccaucagc

SEQ ID NO: 1089120 - RNA, 19 nt, Human
caccgcauagcugaugggu

SEQ ID NO: 1089121 - RNA, 22 nt, Human
caccgccgccgccgccgccucc

SEQ ID NO: 1089122 - RNA, 20 nt, Human
caggaauuucaccuucucca

SEQ ID NO: 1089123 - RNA, 18 nt, Human
caguuccccucucccucc

SEQ ID NO: 1089124 - RNA, 23 nt, Human
caucgcucccgaccgccucugcc

SEQ ID NO: 1089125 - RNA, 19 nt, Human
ccaccgccaccgccgccgc

SEQ ID NO: 1089126 - RNA, 20 nt, Human
ccaccgccaccgccgccgcc

SEQ ID NO: 1089127 - RNA, 25 nt, Human
ccaccgccaccgccgccgccgccgg

SEQ ID NO: 1089128 - RNA, 20 nt, Human
ccaccgccgccgccgccgcc

SEQ ID NO: 1089129 - RNA, 21 nt, Human
ccagcucaucauagaucucaa

SEQ ID NO: 1089130 - RNA, 23 nt, Human
ccauacaagcagaagacauugaa

SEQ ID NO: 1089131 - RNA, 21 nt, Human
cccauuccagcaguccagagg

SEQ ID NO: 1089132 - RNA, 22 nt, Human
cccauuccagcaguccagagga

SEQ ID NO: 1089133 - RNA, 24 nt, Human
cccccgccgccaucuucaucgcuc

SEQ ID NO: 1089134 - RNA, 19 nt, Human
ccccgccgccccgccuccu

SEQ ID NO: 1089135 - RNA, 18 nt, Human
ccccgccgccgcccccgc

SEQ ID NO: 1089136 - RNA, 18 nt, Human
ccccgccuccuccaccgc

SEQ ID NO: 1089137 - RNA, 23 nt, Human
ccccugcuguggacaacugggga

SEQ ID NO: 1089138 - RNA, 23 nt, Human
ccgccaccgccgccgccgccgcc

SEQ ID NO: 1089139 - RNA, 24 nt, Human
ccgccaccgccgccgccgccgccu

SEQ ID NO: 1089140 - RNA, 22 nt, Human
ccgcccccgccgccccgccucc

SEQ ID NO: 1089141 - RNA, 23 nt, Human
ccgccgccaucuucaucgcuccc

SEQ ID NO: 1089142 - RNA, 23 nt, Human
ccgccgcccucacugccgccgcc

SEQ ID NO: 1089143 - RNA, 23 nt, Human
ccgccgcccucacugccgccgcc

SEQ ID NO: 1089144 - RNA, 24 nt, Human
ccgccgcccucacugccgccgccu

SEQ ID NO: 1089145 - RNA, 23 nt, Human
ccgccgccgcccccgccgccccg

SEQ ID NO: 1089146 - RNA, 25 nt, Human
ccgccgccgcccccgccgccccgcc

SEQ ID NO: 1089147 - RNA, 26 nt, Human
ccgccgccgcccccgccgccccgccu

SEQ ID NO: 1089148 - RNA, 21 nt, Human
ccgccgccgccgccgccuccg

SEQ ID NO: 1089149 - RNA, 18 nt, Human
ccgccgccgccgccuccg

SEQ ID NO: 1089150 - RNA, 18 nt, Human
ccgccgccgccuccgugc

SEQ ID NO: 1089151 - RNA, 25 nt, Human
ccugcagacuuccagcguuuccguu

SEQ ID NO: 1089152 - RNA, 31 nt, Human
ccugcuguggacaacuggggaggcagggguu

SEQ ID NO: 1089153 - RNA, 24 nt, Human
cgcccucacugccgccgccuuagu

SEQ ID NO: 1089154 - RNA, 21 nt, Human
cgcuuaggggcaccgccgccc

SEQ ID NO: 1089155 - RNA, 23 nt, Human
cgcuucacucccagcucaucaua

SEQ ID NO: 1089156 - RNA, 22 nt, Human
cucccagcucaucauagaucuc

SEQ ID NO: 1089157 - RNA, 19 nt, Human
cucccccugcagacuucca

SEQ ID NO: 1089158 - RNA, 22 nt, Human
cugccgccccccgccgccaucu

SEQ ID NO: 1089159 - RNA, 19 nt, Human
cugccgccgccuuaguagc

SEQ ID NO: 1089160 - RNA, 19 nt, Human
cuucaucgcucccgaccgc

SEQ ID NO: 1089161 - RNA, 28 nt, Human
gaaccuagcauuaaaaaaaaaaaaaaag

SEQ ID NO: 1089162 - RNA, 21 nt, Human
gaauacuuucacagaagaugg

SEQ ID NO: 1089163 - RNA, 23 nt, Human
gauggcuggcugcuuggagacac

SEQ ID NO: 1089164 - RNA, 25 nt, Human
gauucccauuccagcaguccagagg

SEQ ID NO: 1089165 - RNA, 20 nt, Human
gcaguccagaggagcugcgc

SEQ ID NO: 1089166 - RNA, 20 nt, Human
gcaugauggcuggcugcuug

SEQ ID NO: 1089167 - RNA, 21 nt, Human
gccaucagccaucuccaccau

SEQ ID NO: 1089168 - RNA, 21 nt, Human
gccccccgccgccaucuucau

SEQ ID NO: 1089169 - RNA, 22 nt, Human
gccccccgccgccaucuucauc

SEQ ID NO: 1089170 - RNA, 22 nt, Human
gccgccaccgccgccucugccg

SEQ ID NO: 1089171 - RNA, 25 nt, Human
gccgccaucuucaucgcucccgacc

SEQ ID NO: 1089172 - RNA, 20 nt, Human
gggcaugauggcuggcugcu

SEQ ID NO: 1089173 - RNA, 24 nt, Human
ggguggagaaccgauuguuccggg

SEQ ID NO: 1089174 - RNA, 19 nt, Human
gguccaaacuccugcaagg

SEQ ID NO: 1089175 - RNA, 20 nt, Human
guccacagcguagccaucag

SEQ ID NO: 1089176 - RNA, 18 nt, Human
uaacaaaaacaaaaacca

SEQ ID NO: 1089177 - RNA, 24 nt, Human
uaugaacaggaaaaaaaaaucaca

SEQ ID NO: 1089178 - RNA, 21 nt, Human
ucauagaucucaaagaaguuc

SEQ ID NO: 1089179 - RNA, 22 nt, Human
uccaccacaucgucaaucaggc

SEQ ID NO: 1089180 - RNA, 18 nt, Human
uccccgccgccgcccccg

SEQ ID NO: 1089181 - RNA, 21 nt, Human
uccccgccgccgcccccgccg

SEQ ID NO: 1089182 - RNA, 24 nt, Human
uccccgccgccgcccccgccgccc

SEQ ID NO: 1089183 - RNA, 23 nt, Human
uccuccaccgccaccgccgccgc

SEQ ID NO: 1089184 - RNA, 26 nt, Human
ucgccugagaauacuuucacagaaga

SEQ ID NO: 1089185 - RNA, 20 nt, Human
ucgcucccgaccgccucugc

SEQ ID NO: 1089186 - RNA, 19 nt, Human
ucucaaagaaguucuccuc

SEQ ID NO: 1089187 - RNA, 24 nt, Human
ucuccacauugccauacaagcaga

SEQ ID NO: 1089188 - RNA, 19 nt, Human
ucugggguggagaaccgau

SEQ ID NO: 1089189 - RNA, 18 nt, Human
ucuugggagauaucaguu

SEQ ID NO: 1089190 - RNA, 28 nt, Human
ugagaauacuuucacagaagauggccgc

SEQ ID NO: 1089191 - RNA, 19 nt, Human
ugagguggguaaugacccg

SEQ ID NO: 1089192 - RNA, 23 nt, Human
ugagguggguaaugacccggucc

SEQ ID NO: 1089193 - RNA, 23 nt, Human
ugcaggucaugguaguucucccc

SEQ ID NO: 1089194 - RNA, 19 nt, Human
ugcuggaugcgguucuugg

SEQ ID NO: 1089195 - RNA, 22 nt, Human
uggauucccauuccagcagucc

SEQ ID NO: 1089196 - RNA, 19 nt, Human
uggcauaaaggaaagagaa

SEQ ID NO: 1089197 - RNA, 19 nt, Human
uggcugccugcucuggggu

SEQ ID NO: 1089198 - RNA, 18 nt, Human
uggggugcuggaugcggu

SEQ ID NO: 1089199 - RNA, 20 nt, Human
ugguaguucuccccgccgcc

SEQ ID NO: 1089200 - RNA, 23 nt, Human
uguaugaacaggaaaaaaaaauc

SEQ ID NO: 1089201 - RNA, 20 nt, Human
uuaaaaaaaaaaaaaaaaaa

SEQ ID NO: 1089202 - RNA, 22 nt, Human
uuccccucucccucccccugca

SEQ ID NO: 1089203 - RNA, 22 nt, Human
uucuccccgccgccgcccccgc

SEQ ID NO: 1089204 - RNA, 19 nt, Human
uugaagaagugcagcacgu

SEQ ID NO: 1089205 - RNA, 21 nt, Human
uugcuuuucaggaauuucacc

SEQ ID NO: 1089206 - RNA, 20 nt, Human
aaucucauuccucuccaguc

SEQ ID NO: 1089207 - RNA, 23 nt, Human
agaggauguggcuucuggcccuc

SEQ ID NO: 1089208 - RNA, 18 nt, Human
aggagcugcaggcaccuc

SEQ ID NO: 1089209 - RNA, 19 nt, Human
aggagcugcaggcaccugc

SEQ ID NO: 1089210 - RNA, 22 nt, Human
auagccaggagcugcaggcacc

SEQ ID NO: 1089211 - RNA, 22 nt, Human
augagucucaagauccaaaggg

SEQ ID NO: 1089212 - RNA, 23 nt, Human
auggggguggugaccccugccuu

SEQ ID NO: 1089213 - RNA, 21 nt, Human
cacacagccugccacacauuc

SEQ ID NO: 1089214 - RNA, 23 nt, Human
cauagccaggagcugcaggcacc

SEQ ID NO: 1089215 - RNA, 21 nt, Human
cuagcacacagccugccacac

SEQ ID NO: 1089216 - RNA, 24 nt, Human
cucauuccucuccagucccuccug

SEQ ID NO: 1089217 - RNA, 21 nt, Human
cuccuuuucgcugauggggcc

SEQ ID NO: 1089218 - RNA, 23 nt, Human
cugaagcagaggauguggcuucu

SEQ ID NO: 1089219 - RNA, 24 nt, Human
cugaagcagaggauguggcuucug

SEQ ID NO: 1089220 - RNA, 20 nt, Human
gccaaucucauuccucucca

SEQ ID NO: 1089221 - RNA, 21 nt, Human
gcgaagaggccugaagcagag

SEQ ID NO: 1089222 - RNA, 21 nt, Human
gcgaagaggccugaagcagag

SEQ ID NO: 1089223 - RNA, 20 nt, Human
ggaaagcaggacauagccag

SEQ ID NO: 1089224 - RNA, 20 nt, Human
ggaacugguuuuguucucgg

SEQ ID NO: 1089225 - RNA, 18 nt, Human
gggaaaugggggugguga

SEQ ID NO: 1089226 - RNA, 26 nt, Human
ggggccgcaaggaggggaacugguuu

SEQ ID NO: 1089227 - RNA, 19 nt, Human
gugcugccuucuuggucug

SEQ ID NO: 1089228 - RNA, 23 nt, Human
ucaguagugggaggcagguucag

SEQ ID NO: 1089229 - RNA, 24 nt, Human
ucaguagugggaggcagguucagu

SEQ ID NO: 1089230 - RNA, 20 nt, Human
ucauuccucuccagucccuc

SEQ ID NO: 1089231 - RNA, 21 nt, Human
ugaagcagaggauguggcuuc

SEQ ID NO: 1089232 - RNA, 19 nt, Human
uggcuucuggcccuccccu

SEQ ID NO: 1089233 - RNA, 21 nt, Human
aaaaaaaaaaaaaagagcuag

SEQ ID NO: 1089234 - RNA, 20 nt, Human
aaaaaaagagcuagacccac

SEQ ID NO: 1089235 - RNA, 19 nt, Human
aaaaagcccggcgcagugg

SEQ ID NO: 1089236 - RNA, 21 nt, Human
aaagaaaaccaaccuaaaucc

SEQ ID NO: 1089237 - RNA, 27 nt, Human
aaagaaaaccaaccuaaauccuguaaa

SEQ ID NO: 1089238 - RNA, 24 nt, Human
aaaucuuccuuucauucuuuagac

SEQ ID NO: 1089239 - RNA, 19 nt, Human
aacauggagaaaccccauc

SEQ ID NO: 1089240 - RNA, 20 nt, Human
aacauggagaaaccccaucu

SEQ ID NO: 1089241 - RNA, 21 nt, Human
aacauggagaaaccccaucuc

SEQ ID NO: 1089242 - RNA, 19 nt, Human
aacauggugaaaccccauc

SEQ ID NO: 1089243 - RNA, 20 nt, Human
aacauggugaaaccccaucu

SEQ ID NO: 1089244 - RNA, 20 nt, Human
aacauggugaaaccccaucu

SEQ ID NO: 1089245 - RNA, 21 nt, Human
aacauggugaaaccccaucuc

SEQ ID NO: 1089246 - RNA, 21 nt, Human
aaccuucccuccuuugaccac

SEQ ID NO: 1089247 - RNA, 20 nt, Human
aagcagagguugcagugagc

SEQ ID NO: 1089248 - RNA, 24 nt, Human
aagcagagguugcagugagcugag

SEQ ID NO: 1089249 - RNA, 24 nt, Human
aaucacuugaacccgggaagcaga

SEQ ID NO: 1089250 - RNA, 20 nt, Human
aauccaucuucccugccauu

SEQ ID NO: 1089251 - RNA, 18 nt, Human
aauuaaucucuaacacaa

SEQ ID NO: 1089252 - RNA, 20 nt, Human
aauuguuugaacccagaagg

SEQ ID NO: 1089253 - RNA, 24 nt, Human
aauuguuugaacccagaaggcaga

SEQ ID NO: 1089254 - RNA, 21 nt, Human
acacaguaguccauuuuccca

SEQ ID NO: 1089255 - RNA, 22 nt, Human
acagaaagaaaaccaaccuaaa

SEQ ID NO: 1089256 - RNA, 24 nt, Human
acagagugagacuccaucucgaaa

SEQ ID NO: 1089257 - RNA, 20 nt, Human
acauuuauugagccucuuuc

SEQ ID NO: 1089258 - RNA, 18 nt, Human
accccaucucuacuaaaa

SEQ ID NO: 1089259 - RNA, 18 nt, Human
accccaucucuacuaaaa

SEQ ID NO: 1089260 - RNA, 23 nt, Human
acucagaagaaacuaagaaaucc

SEQ ID NO: 1089261 - RNA, 24 nt, Human
acuccagccuggacgacagaguga

SEQ ID NO: 1089262 - RNA, 24 nt, Human
acugcacuccagccuggacgacag

SEQ ID NO: 1089263 - RNA, 26 nt, Human
acugcacuccagccuggacgacagag

SEQ ID NO: 1089264 - RNA, 22 nt, Human
agaaucacuugaacccgggaag

SEQ ID NO: 1089265 - RNA, 18 nt, Human
agagguugcagugagcug

SEQ ID NO: 1089266 - RNA, 22 nt, Human
agagguugcagugagcugagau

SEQ ID NO: 1089267 - RNA, 22 nt, Human
agagguugcagugagcugagau

SEQ ID NO: 1089268 - RNA, 23 nt, Human
agagguugcagugagcugagauc

SEQ ID NO: 1089269 - RNA, 23 nt, Human
agagguugcagugagcugagauc

SEQ ID NO: 1089270 - RNA, 24 nt, Human
agagguugcagugagcugagauca

SEQ ID NO: 1089271 - RNA, 24 nt, Human
agagguugcagugagcugagaucg

SEQ ID NO: 1089272 - RNA, 20 nt, Human
agagguugcagugagcuggc

SEQ ID NO: 1089273 - RNA, 22 nt, Human
agaucaccugaggucgggaguu

SEQ ID NO: 1089274 - RNA, 24 nt, Human
agcacuuugggaggccgaggcagg

SEQ ID NO: 1089275 - RNA, 25 nt, Human
agcagaauccuaauuaaucucuaac

SEQ ID NO: 1089276 - RNA, 24 nt, Human
agccuggacgacagagugagacuc

SEQ ID NO: 1089277 - RNA, 22 nt, Human
agccuggccaacauggugaaac

SEQ ID NO: 1089278 - RNA, 24 nt, Human
agccuggccaacauggugaaaccc

SEQ ID NO: 1089279 - RNA, 23 nt, Human
agcugggcaugguggcgcaugcu

SEQ ID NO: 1089280 - RNA, 19 nt, Human
aggcaaagagagggacuga

SEQ ID NO: 1089281 - RNA, 19 nt, Human
aggcagagguugcagugag

SEQ ID NO: 1089282 - RNA, 20 nt, Human
aggcagagguugcagugagc

SEQ ID NO: 1089283 - RNA, 24 nt, Human
aggcagagguugcagugagcugag

SEQ ID NO: 1089284 - RNA, 26 nt, Human
aggcagaucaccugaggucgggaguu

SEQ ID NO: 1089285 - RNA, 19 nt, Human
aggcagaucaugaggucaa

SEQ ID NO: 1089286 - RNA, 23 nt, Human
aggcaggaaaauuguuugaaccc

SEQ ID NO: 1089287 - RNA, 18 nt, Human
aggcaggagaaucacuug

SEQ ID NO: 1089288 - RNA, 24 nt, Human
aggcaggagaaucacuugaacccg

SEQ ID NO: 1089289 - RNA, 22 nt, Human
aggcaggcagaucaccugaggg

SEQ ID NO: 1089290 - RNA, 22 nt, Human
aggcaggcagaucaccugaggu

SEQ ID NO: 1089291 - RNA, 26 nt, Human
aggcaggcagaucaccugaggucggg

SEQ ID NO: 1089292 - RNA, 22 nt, Human
aggcaggcagaucaugagguca

SEQ ID NO: 1089293 - RNA, 23 nt, Human
aggcaggcagaucaugaggucaa

SEQ ID NO: 1089294 - RNA, 27 nt, Human
aggcaggcagaucaugaggucaauuca

SEQ ID NO: 1089295 - RNA, 21 nt, Human
aggcugaggcaggaaaauugu

SEQ ID NO: 1089296 - RNA, 24 nt, Human
aggcugaggcaggaaaauuguuug

SEQ ID NO: 1089297 - RNA, 24 nt, Human
aggcugaggcaggagaaucacuug

SEQ ID NO: 1089298 - RNA, 24 nt, Human
aguggcucacaccuguaaucccag

SEQ ID NO: 1089299 - RNA, 23 nt, Human
aguggcucaugccuguaauccca

SEQ ID NO: 1089300 - RNA, 24 nt, Human
aguggcucaugccuguaaucccag

SEQ ID NO: 1089301 - RNA, 24 nt, Human
aucaugccacugcacuccagccug

SEQ ID NO: 1089302 - RNA, 24 nt, Human
aucgugccauugcacuccagccug

SEQ ID NO: 1089303 - RNA, 25 nt, Human
augccacugcacuccagccuggacu

SEQ ID NO: 1089304 - RNA, 19 nt, Human
augccuguaaucccagcac

SEQ ID NO: 1089305 - RNA, 24 nt, Human
auugcacuccagccugggcaacaa

SEQ ID NO: 1089306 - RNA, 25 nt, Human
auugcacuccagccugggcaacaag

SEQ ID NO: 1089307 - RNA, 22 nt, Human
caaaacaccuugcucccccuuu

SEQ ID NO: 1089308 - RNA, 23 nt, Human
caaacaguggcauaaauccuaaa

SEQ ID NO: 1089309 - RNA, 19 nt, Human
caacauaacagaaguacca

SEQ ID NO: 1089310 - RNA, 24 nt, Human
caacauggugaaaccccaucucua

SEQ ID NO: 1089311 - RNA, 26 nt, Human
caagaugauucauagggcagaaccaa

SEQ ID NO: 1089312 - RNA, 24 nt, Human
cacaccuguaaucccagcacuuug

SEQ ID NO: 1089313 - RNA, 19 nt, Human
caccuaaugggcaaagucu

SEQ ID NO: 1089314 - RNA, 23 nt, Human
caccuguaaucccagcacuuugg

SEQ ID NO: 1089315 - RNA, 24 nt, Human
caccuguaaucccagcacuuuggg

SEQ ID NO: 1089316 - RNA, 19 nt, Human
caccuguucuugacaagau

SEQ ID NO: 1089317 - RNA, 22 nt, Human
cacuccagccuggacgacagag

SEQ ID NO: 1089318 - RNA, 24 nt, Human
cacuccagccuggacgacagagug

SEQ ID NO: 1089319 - RNA, 24 nt, Human
cacuccagccugggcaacaagagc

SEQ ID NO: 1089320 - RNA, 18 nt, Human
cacugcacuccagccugg

SEQ ID NO: 1089321 - RNA, 19 nt, Human
cacugcacuccagccugga

SEQ ID NO: 1089322 - RNA, 20 nt, Human
cacugcacuccagccuggac

SEQ ID NO: 1089323 - RNA, 22 nt, Human
cacugcacuccagccuggacga

SEQ ID NO: 1089324 - RNA, 24 nt, Human
cacugcacuccagccuggacgaca

SEQ ID NO: 1089325 - RNA, 21 nt, Human
cagaaagaaaaccaaccuaaa

SEQ ID NO: 1089326 - RNA, 20 nt, Human
cagaagaaacuaagaaaucc

SEQ ID NO: 1089327 - RNA, 21 nt, Human
cagaaugaguaaagaaggaug

SEQ ID NO: 1089328 - RNA, 24 nt, Human
cagaucaccugaggucgggaguuu

SEQ ID NO: 1089329 - RNA, 22 nt, Human
cagaucaugaggucaauucaaa

SEQ ID NO: 1089330 - RNA, 21 nt, Human
cagcacuuugggagaccuagg

SEQ ID NO: 1089331 - RNA, 24 nt, Human
cagcacuuugggagaccuaggcag

SEQ ID NO: 1089332 - RNA, 24 nt, Human
cagcacuuugggaggccgaggcag

SEQ ID NO: 1089333 - RNA, 25 nt, Human
cagcacuuugggaggccgaggcagg

SEQ ID NO: 1089334 - RNA, 24 nt, Human
cagccacuugggaggcugaggcag

SEQ ID NO: 1089335 - RNA, 24 nt, Human
cagccugcccaacauggagaaacc

SEQ ID NO: 1089336 - RNA, 24 nt, Human
cagcuacucaggaggcugaggcag

SEQ ID NO: 1089337 - RNA, 24 nt, Human
caggcagaucaccugaggucggga

SEQ ID NO: 1089338 - RNA, 24 nt, Human
caugccuguaaucccagcacuuug

SEQ ID NO: 1089339 - RNA, 18 nt, Human
cauugcacuccagccugg

SEQ ID NO: 1089340 - RNA, 19 nt, Human
cauugcacuccagccuggg

SEQ ID NO: 1089341 - RNA, 21 nt, Human
cauugcacuccagccugggca

SEQ ID NO: 1089342 - RNA, 24 nt, Human
cauugcacuccagccugggcaaca

SEQ ID NO: 1089343 - RNA, 20 nt, Human
ccaagauggacauuaaacuc

SEQ ID NO: 1089344 - RNA, 19 nt, Human
ccacugcacuccagccugg

SEQ ID NO: 1089345 - RNA, 19 nt, Human
ccacugcacuccagccugg

SEQ ID NO: 1089346 - RNA, 20 nt, Human
ccacugcacuccagccugga

SEQ ID NO: 1089347 - RNA, 21 nt, Human
ccacugcacuccagccuggac

SEQ ID NO: 1089348 - RNA, 24 nt, Human
ccacugcacuccagccuggacgac

SEQ ID NO: 1089349 - RNA, 18 nt, Human
ccagccuggccaacaugg

SEQ ID NO: 1089350 - RNA, 18 nt, Human
ccauugcacuccagccug

SEQ ID NO: 1089351 - RNA, 20 nt, Human
ccauugcacuccagccuggg

SEQ ID NO: 1089352 - RNA, 21 nt, Human
ccauugcacuccagccugggc

SEQ ID NO: 1089353 - RNA, 23 nt, Human
ccauugcacuccagccugggcaa

SEQ ID NO: 1089354 - RNA, 24 nt, Human
ccauugcacuccagccugggcaac

SEQ ID NO: 1089355 - RNA, 23 nt, Human
cccaguccuuggccaucuggccg

SEQ ID NO: 1089356 - RNA, 19 nt, Human
cccauuccucaacccaccc

SEQ ID NO: 1089357 - RNA, 24 nt, Human
ccccuuuuucccauuccucaaccc

SEQ ID NO: 1089358 - RNA, 22 nt, Human
ccuaaaucaucugagauccuga

SEQ ID NO: 1089359 - RNA, 22 nt, Human
ccugaggucgggaguuugagac

SEQ ID NO: 1089360 - RNA, 24 nt, Human
ccugcccaacauggagaaacccca

SEQ ID NO: 1089361 - RNA, 20 nt, Human
ccugcuucaugaagccuucc

SEQ ID NO: 1089362 - RNA, 22 nt, Human
ccuggacgacagagugagacuc

SEQ ID NO: 1089363 - RNA, 23 nt, Human
ccuggccaacauggugaaacccc

SEQ ID NO: 1089364 - RNA, 24 nt, Human
ccuggccaacauggugaaacccca

SEQ ID NO: 1089365 - RNA, 22 nt, Human
ccuguaaucccagcacuuuggg

SEQ ID NO: 1089366 - RNA, 22 nt, Human
ccuucccuccuuugaccacuuc

SEQ ID NO: 1089367 - RNA, 21 nt, Human
ccuugcucccccuuuuuccca

SEQ ID NO: 1089368 - RNA, 20 nt, Human
ccuugugcuauacagggcuc

SEQ ID NO: 1089369 - RNA, 21 nt, Human
cgaaaaaaaaaagcccggcgc

SEQ ID NO: 1089370 - RNA, 24 nt, Human
cggcuacuuaucccaguccuuggc

SEQ ID NO: 1089371 - RNA, 24 nt, Human
cgggaagcagagguugcagugagc

SEQ ID NO: 1089372 - RNA, 22 nt, Human
cucacaccuguaaucccagcac

SEQ ID NO: 1089373 - RNA, 24 nt, Human
cucacaccuguaaucccagcacuu

SEQ ID NO: 1089374 - RNA, 23 nt, Human
cucaugccuguaaucccagcacu

SEQ ID NO: 1089375 - RNA, 24 nt, Human
cucaugccuguaaucccagcacuu

SEQ ID NO: 1089376 - RNA, 20 nt, Human
cucucccugaucuuauucca

SEQ ID NO: 1089377 - RNA, 23 nt, Human
cugcucuaccugucaccacaugc

SEQ ID NO: 1089378 - RNA, 23 nt, Human
cuggccaacauggugaaacccca

SEQ ID NO: 1089379 - RNA, 25 nt, Human
cuucaugaagccuuccugaauaaag

SEQ ID NO: 1089380 - RNA, 18 nt, Human
gacagaaagaaaaccaac

SEQ ID NO: 1089381 - RNA, 24 nt, Human
gacagagugagacuccaucucgaa

SEQ ID NO: 1089382 - RNA, 23 nt, Human
gagaucaugccacugcacuccag

SEQ ID NO: 1089383 - RNA, 23 nt, Human
gagaucgugccauugcacuccag

SEQ ID NO: 1089384 - RNA, 21 nt, Human
gagcaaaacuccgucuccaaa

SEQ ID NO: 1089385 - RNA, 19 nt, Human
gaggcaggcagaucaccug

SEQ ID NO: 1089386 - RNA, 24 nt, Human
gaucaccugaggucgggaguuuga

SEQ ID NO: 1089387 - RNA, 19 nt, Human
gauuucugaccuuuaucuc

SEQ ID NO: 1089388 - RNA, 24 nt, Human
gcacuccagccuggacgacagagu

SEQ ID NO: 1089389 - RNA, 22 nt, Human
gcaggaaaauuguuugaaccca

SEQ ID NO: 1089390 - RNA, 22 nt, Human
gcaggagaaucacuugaacccg

SEQ ID NO: 1089391 - RNA, 19 nt, Human
gcagucagcuguuuccuua

SEQ ID NO: 1089392 - RNA, 24 nt, Human
gccaacauggugaaaccccaucuc

SEQ ID NO: 1089393 - RNA, 22 nt, Human
gccauugcacuccagccugggc

SEQ ID NO: 1089394 - RNA, 24 nt, Human
gccauugcacuccagccugggcaa

SEQ ID NO: 1089395 - RNA, 19 nt, Human
gcccggcgcaguggcucau

SEQ ID NO: 1089396 - RNA, 19 nt, Human
gcuaguccccuaaaacugc

SEQ ID NO: 1089397 - RNA, 20 nt, Human
gcugagaucaugccacugca

SEQ ID NO: 1089398 - RNA, 20 nt, Human
ggaagcagagguugcaguga

SEQ ID NO: 1089399 - RNA, 23 nt, Human
ggacagaaagaaaaccaaccuaa

SEQ ID NO: 1089400 - RNA, 22 nt, Human
ggaccacaacauuuaugcauag

SEQ ID NO: 1089401 - RNA, 19 nt, Human
ggaguuugagaccagccug

SEQ ID NO: 1089402 - RNA, 21 nt, Human
ggcagguggcuguaaucccag

SEQ ID NO: 1089403 - RNA, 19 nt, Human
ggccgggugcaguggcuca

SEQ ID NO: 1089404 - RNA, 21 nt, Human
ggccgggugcaguggcucaca

SEQ ID NO: 1089405 - RNA, 23 nt, Human
ggcgcaguggcucaugccuguaa

SEQ ID NO: 1089406 - RNA, 22 nt, Human
ggcgcaugcuuguaauuccagc

SEQ ID NO: 1089407 - RNA, 19 nt, Human
ggucgggaguuugagacca

SEQ ID NO: 1089408 - RNA, 23 nt, Human
ggugcaguggcucacaccuguaa

SEQ ID NO: 1089409 - RNA, 18 nt, Human
guaguaccugauuuacua

SEQ ID NO: 1089410 - RNA, 20 nt, Human
gugaaacggcuacuuauccc

SEQ ID NO: 1089411 - RNA, 18 nt, Human
gugcaguggcucacaccu

SEQ ID NO: 1089412 - RNA, 24 nt, Human
guucgcacacaguaguccauuuuc

SEQ ID NO: 1089413 - RNA, 19 nt, Human
guuugagaccagccugccc

SEQ ID NO: 1089414 - RNA, 21 nt, Human
uaaaaaugcaaaauuuagccu

SEQ ID NO: 1089415 - RNA, 22 nt, Human
uaaaaaugcaaaauuuagccug

SEQ ID NO: 1089416 - RNA, 19 nt, Human
uaaaauuagcugggcaugg

SEQ ID NO: 1089417 - RNA, 18 nt, Human
uaaaucaucugagauccu

SEQ ID NO: 1089418 - RNA, 22 nt, Human
uaagguaaaugaagagggugcc

SEQ ID NO: 1089419 - RNA, 21 nt, Human
uacuaaaaaugcaaaauuuag

SEQ ID NO: 1089420 - RNA, 25 nt, Human
uagaucaggaaaaacaaggaacaaa

SEQ ID NO: 1089421 - RNA, 23 nt, Human
uaggcaacauaacagaaguacca

SEQ ID NO: 1089422 - RNA, 23 nt, Human
uaggcaggcagaucaugagguca

SEQ ID NO: 1089423 - RNA, 18 nt, Human
uaucccaguccuuggcca

SEQ ID NO: 1089424 - RNA, 18 nt, Human
uauucaguugaaugugua

SEQ ID NO: 1089425 - RNA, 21 nt, Human
ucaaaaccagccuggccaaca

SEQ ID NO: 1089426 - RNA, 18 nt, Human
ucagacugguguuucuug

SEQ ID NO: 1089427 - RNA, 19 nt, Human
ucaggaaaaacaaggaaca

SEQ ID NO: 1089428 - RNA, 23 nt, Human
ucaugccacugcacuccagccug

SEQ ID NO: 1089429 - RNA, 18 nt, Human
ucauuuuagcauuuccau

SEQ ID NO: 1089430 - RNA, 23 nt, Human
uccagccuggacgacagagugag

SEQ ID NO: 1089431 - RNA, 24 nt, Human
uccagccuggacgacagagugaga

SEQ ID NO: 1089432 - RNA, 23 nt, Human
uccgucuccaaaaaaaaaaaaaa

SEQ ID NO: 1089433 - RNA, 22 nt, Human
ucuaacacaacaagcuaugaau

SEQ ID NO: 1089434 - RNA, 20 nt, Human
ucuccaaaaaaaaaaaaaaa

SEQ ID NO: 1089435 - RNA, 20 nt, Human
ucucuacuaaaaauauaaaa

SEQ ID NO: 1089436 - RNA, 20 nt, Human
ucucuacuaaaaaugcaaaa

SEQ ID NO: 1089437 - RNA, 19 nt, Human
ucugcuccuaacacccaug

SEQ ID NO: 1089438 - RNA, 20 nt, Human
ucuuccuacugcucucccug

SEQ ID NO: 1089439 - RNA, 19 nt, Human
ugaaaccccaucucuacua

SEQ ID NO: 1089440 - RNA, 24 nt, Human
ugagaccagccugcccaacaugga

SEQ ID NO: 1089441 - RNA, 25 nt, Human
ugagacuggacagaaagaaaaccaa

SEQ ID NO: 1089442 - RNA, 26 nt, Human
ugagacuggacagaaagaaaaccaac

SEQ ID NO: 1089443 - RNA, 22 nt, Human
ugagcugagaucaugccacugc

SEQ ID NO: 1089444 - RNA, 24 nt, Human
ugaggcaggaaaauuguuugaacc

SEQ ID NO: 1089445 - RNA, 25 nt, Human
ugaggcaggaaaauuguuugaaccc

SEQ ID NO: 1089446 - RNA, 20 nt, Human
ugaggcaggagaaucacuug

SEQ ID NO: 1089447 - RNA, 24 nt, Human
ugaggcaggagaaucacuugaacc

SEQ ID NO: 1089448 - RNA, 25 nt, Human
ugaggcaggagaaucacuugaaccc

SEQ ID NO: 1089449 - RNA, 18 nt, Human
ugaggucgggaguuugag

SEQ ID NO: 1089450 - RNA, 22 nt, Human
ugaguaauuauauuugcauuua

SEQ ID NO: 1089451 - RNA, 19 nt, Human
ugcacuccagccugggcaa

SEQ ID NO: 1089452 - RNA, 24 nt, Human
ugcagguaagugcccauggagggc

SEQ ID NO: 1089453 - RNA, 24 nt, Human
ugccauugcacuccagccugggca

SEQ ID NO: 1089454 - RNA, 26 nt, Human
ugccgcaacuaugcaugugcacuugu

SEQ ID NO: 1089455 - RNA, 23 nt, Human
ugccuguaaucccagcacuuugg

SEQ ID NO: 1089456 - RNA, 19 nt, Human
ugcuacuccaagcuuuauc

SEQ ID NO: 1089457 - RNA, 18 nt, Human
ugcuccuaacacccaugu

SEQ ID NO: 1089458 - RNA, 23 nt, Human
ugcuuguaauuccagccacuugg

SEQ ID NO: 1089459 - RNA, 24 nt, Human
ugcuuguaauuccagccacuuggg

SEQ ID NO: 1089460 - RNA, 18 nt, Human
ugcuuuuaauuguauuca

SEQ ID NO: 1089461 - RNA, 24 nt, Human
uggaacuucuggaccacaagagac

SEQ ID NO: 1089462 - RNA, 24 nt, Human
uggccaacauggugaaaccccauc

SEQ ID NO: 1089463 - RNA, 21 nt, Human
uggcucacaccuguaauccca

SEQ ID NO: 1089464 - RNA, 24 nt, Human
uggcucacaccuguaaucccagca

SEQ ID NO: 1089465 - RNA, 22 nt, Human
uggcucaugccuguaaucccag

SEQ ID NO: 1089466 - RNA, 24 nt, Human
uggcucaugccuguaaucccagca

SEQ ID NO: 1089467 - RNA, 24 nt, Human
uggcuguaaucccagcuacucagg

SEQ ID NO: 1089468 - RNA, 24 nt, Human
ugggagaccuaggcaggcagauca

SEQ ID NO: 1089469 - RNA, 20 nt, Human
ugggaggccgaggcaggcag

SEQ ID NO: 1089470 - RNA, 24 nt, Human
ugggaggccgaggcaggcagauca

SEQ ID NO: 1089471 - RNA, 19 nt, Human
ugggaggcugaggcaggag

SEQ ID NO: 1089472 - RNA, 24 nt, Human
ugggaggcugaggcaggagaauca

SEQ ID NO: 1089473 - RNA, 20 nt, Human
uguaauuccagccacuuggg

SEQ ID NO: 1089474 - RNA, 19 nt, Human
uguauaaagaagagcuggg

SEQ ID NO: 1089475 - RNA, 18 nt, Human
ugucuagauuggcagcuc

SEQ ID NO: 1089476 - RNA, 18 nt, Human
uuagcugggcaugguggc

SEQ ID NO: 1089477 - RNA, 20 nt, Human
uuagcugggcaugguggcgc

SEQ ID NO: 1089478 - RNA, 18 nt, Human
uucaugaagccuuccuga

SEQ ID NO: 1089479 - RNA, 19 nt, Human
uuccugaauaaagagaaaa

SEQ ID NO: 1089480 - RNA, 24 nt, Human
uucucaugcuacuccaagcuuuau

SEQ ID NO: 1089481 - RNA, 18 nt, Human
uugcagugagcugagauc

SEQ ID NO: 1089482 - RNA, 18 nt, Human
uugcagugagcugagauc

SEQ ID NO: 1089483 - RNA, 21 nt, Human
uugcagugagcugagaucaug

SEQ ID NO: 1089484 - RNA, 23 nt, Human
uugcagugagcugagaucaugcc

SEQ ID NO: 1089485 - RNA, 21 nt, Human
uugcagugagcugagaucgug

SEQ ID NO: 1089486 - RNA, 22 nt, Human
uugcagugagcugagaucgugc

SEQ ID NO: 1089487 - RNA, 23 nt, Human
uugcagugagcugagaucgugcc

SEQ ID NO: 1089488 - RNA, 25 nt, Human
uuggaccacaacauuuaugcauagu

SEQ ID NO: 1089489 - RNA, 25 nt, Human
uugggaggccgaggcaggcagauca

SEQ ID NO: 1089490 - RNA, 25 nt, Human
uugggaggcugaggcaggagaauca

SEQ ID NO: 1089491 - RNA, 21 nt, Human
uuguaaggacaaggagaggac

SEQ ID NO: 1089492 - RNA, 24 nt, Human
uuuagauuguaaggacaaggagag

SEQ ID NO: 1089493 - RNA, 22 nt, Human
uuuguacuaagauucaacagca

SEQ ID NO: 1089494 - RNA, 19 nt, Human
aagaugccagacgcugagg

SEQ ID NO: 1089495 - RNA, 21 nt, Human
acauuuguacacuuuccuccu

SEQ ID NO: 1089496 - RNA, 20 nt, Human
agaaagcaguauaaaaauca

SEQ ID NO: 1089497 - RNA, 25 nt, Human
agaaagcaguauaaaaaucaacuug

SEQ ID NO: 1089498 - RNA, 18 nt, Human
aggagguggugguggcgg

SEQ ID NO: 1089499 - RNA, 18 nt, Human
agguggugguggcggcaa

SEQ ID NO: 1089500 - RNA, 21 nt, Human
aguuagaaucugugucuauug

SEQ ID NO: 1089501 - RNA, 24 nt, Human
auauugaagucuuucagugauuca

SEQ ID NO: 1089502 - RNA, 24 nt, Human
augccagacgcugaggggucuggg

SEQ ID NO: 1089503 - RNA, 18 nt, Human
augcuucaucuuuguuuu

SEQ ID NO: 1089504 - RNA, 18 nt, Human
cacaguugagaagguuaa

SEQ ID NO: 1089505 - RNA, 20 nt, Human
cacuuugcugaaagcagggc

SEQ ID NO: 1089506 - RNA, 20 nt, Human
caucaugauaucacaguuga

SEQ ID NO: 1089507 - RNA, 23 nt, Human
ccaccaagaugccagacgcugag

SEQ ID NO: 1089508 - RNA, 18 nt, Human
ccagacgcugaggggucu

SEQ ID NO: 1089509 - RNA, 19 nt, Human
ccgcucaaauacgguccug

SEQ ID NO: 1089510 - RNA, 21 nt, Human
cuaguaaacccaaugccagaa

SEQ ID NO: 1089511 - RNA, 20 nt, Human
cuccagccuccucguccgcc

SEQ ID NO: 1089512 - RNA, 25 nt, Human
cugauacaccugguuucuuaaaugu

SEQ ID NO: 1089513 - RNA, 22 nt, Human
gacauuuguacacuuuccuccu

SEQ ID NO: 1089514 - RNA, 24 nt, Human
gcagaauucaggaggugguggugg

SEQ ID NO: 1089515 - RNA, 19 nt, Human
gguggugguggcggcaaug

SEQ ID NO: 1089516 - RNA, 24 nt, Human
guccuucuggccuucuaacugggg

SEQ ID NO: 1089517 - RNA, 25 nt, Human
uaaauuucuggcaccaauugugcca

SEQ ID NO: 1089518 - RNA, 21 nt, Human
uacaucaugauaucacaguug

SEQ ID NO: 1089519 - RNA, 21 nt, Human
uaccuccagccuccucguccg

SEQ ID NO: 1089520 - RNA, 21 nt, Human
uacgguccugagaauguacau

SEQ ID NO: 1089521 - RNA, 19 nt, Human
uacuucuucuucaggagcu

SEQ ID NO: 1089522 - RNA, 23 nt, Human
uaucauguccuucuggccuucua

SEQ ID NO: 1089523 - RNA, 19 nt, Human
ucaggagguggugguggcg

SEQ ID NO: 1089524 - RNA, 21 nt, Human
ucaggagguggugguggcggc

SEQ ID NO: 1089525 - RNA, 18 nt, Human
uccauccucucaguaccc

SEQ ID NO: 1089526 - RNA, 22 nt, Human
ucuaguaaacccaaugccagaa

SEQ ID NO: 1089527 - RNA, 23 nt, Human
ucuccuuuucuucugcauauguu

SEQ ID NO: 1089528 - RNA, 21 nt, Human
ugacauuuguacacuuuccuc

SEQ ID NO: 1089529 - RNA, 21 nt, Human
ugagaagguuaaucacuuugc

SEQ ID NO: 1089530 - RNA, 24 nt, Human
ugauuuccauccucucaguaccuc

SEQ ID NO: 1089531 - RNA, 26 nt, Human
uggcugaacuucccaaucuugaagcc

SEQ ID NO: 1089532 - RNA, 23 nt, Human
uuuccauccucucaguaccucca

SEQ ID NO: 1089533 - RNA, 20 nt, Human
uuugcugaaagcagggcaga

SEQ ID NO: 1089534 - RNA, 23 nt, Human
uuuguacacuuuccuccugcuuu

SEQ ID NO: 1089535 - RNA, 18 nt, Human
acccgagcgcggcuucca

SEQ ID NO: 1089536 - RNA, 19 nt, Human
accugcucccccuccugcc

SEQ ID NO: 1089537 - RNA, 22 nt, Human
accugcucccccuccugccgcc

SEQ ID NO: 1089538 - RNA, 19 nt, Human
cagagcccgcugacccgac

SEQ ID NO: 1089539 - RNA, 23 nt, Human
cagcucaggaccgggaccggcgg

SEQ ID NO: 1089540 - RNA, 21 nt, Human
ccacugccugcccauccccca

SEQ ID NO: 1089541 - RNA, 23 nt, Human
ccacugccugcccaucccccacc

SEQ ID NO: 1089542 - RNA, 22 nt, Human
cccccuccugccgccgccgccg

SEQ ID NO: 1089543 - RNA, 22 nt, Human
cccccuccugccgccgccgcua

SEQ ID NO: 1089544 - RNA, 21 nt, Human
cccuccugccgccgccgccgc

SEQ ID NO: 1089545 - RNA, 18 nt, Human
ccgccucguccccaccgc

SEQ ID NO: 1089546 - RNA, 20 nt, Human
ccgccucguccccaccgcuc

SEQ ID NO: 1089547 - RNA, 24 nt, Human
ccgcguuuacuggcggcggcggcg

SEQ ID NO: 1089548 - RNA, 23 nt, Human
ccuccugccgccgccgccgccuc

SEQ ID NO: 1089549 - RNA, 18 nt, Human
ccugccgccgccgccgcc

SEQ ID NO: 1089550 - RNA, 18 nt, Human
ccugccgccgccgccgcc

SEQ ID NO: 1089551 - RNA, 18 nt, Human
ccugcucccccuccugcc

SEQ ID NO: 1089552 - RNA, 20 nt, Human
cggccggcuggguagucccc

SEQ ID NO: 1089553 - RNA, 22 nt, Human
cucccaucgccgcugcggcgac

SEQ ID NO: 1089554 - RNA, 20 nt, Human
cuccugccgccgccgccgcc

SEQ ID NO: 1089555 - RNA, 24 nt, Human
cuccugccgccgccgccgccucgg

SEQ ID NO: 1089556 - RNA, 22 nt, Human
cuuccagggccggccggcuggg

SEQ ID NO: 1089557 - RNA, 19 nt, Human
gccucguccccaccgcucc

SEQ ID NO: 1089558 - RNA, 21 nt, Human
gccugcccaucccccaccgcc

SEQ ID NO: 1089559 - RNA, 20 nt, Human
gcgacuacugcagagcccgc

SEQ ID NO: 1089560 - RNA, 21 nt, Human
gcggcggcggcggcggcugcu

SEQ ID NO: 1089561 - RNA, 20 nt, Human
gcggcggcugcugcugcugu

SEQ ID NO: 1089562 - RNA, 20 nt, Human
ggacgcagggguuucuggag

SEQ ID NO: 1089563 - RNA, 24 nt, Human
ggcugcugcugcuguuacugcugc

SEQ ID NO: 1089564 - RNA, 18 nt, Human
uaaccugggccguggcgg

SEQ ID NO: 1089565 - RNA, 20 nt, Human
uacacugauaugguagaaca

SEQ ID NO: 1089566 - RNA, 19 nt, Human
uacugcagagcccgcugac

SEQ ID NO: 1089567 - RNA, 20 nt, Human
uccugccgccgccgccgccu

SEQ ID NO: 1089568 - RNA, 26 nt, Human
ucguccccaccgcucccaucgccgcu

SEQ ID NO: 1089569 - RNA, 23 nt, Human
ucuugugccagcaccugcucccc

SEQ ID NO: 1089570 - RNA, 24 nt, Human
ugcugcugcuguuacugcugcugc

SEQ ID NO: 1089571 - RNA, 19 nt, Human
uggcggcggcggcggcggc

SEQ ID NO: 1089572 - RNA, 24 nt, Human
uggcggcggcggcggcggcugcug

SEQ ID NO: 1089573 - RNA, 21 nt, Human
uaacaacaaugacaacaauaa

SEQ ID NO: 1089574 - RNA, 23 nt, Human
aaagucagguuucaguugguuga

SEQ ID NO: 1089575 - RNA, 24 nt, Human
aaagugcugggauuacaggcauga

SEQ ID NO: 1089576 - RNA, 21 nt, Human
aacaccaccucuucuacucca

SEQ ID NO: 1089577 - RNA, 23 nt, Human
aagaaaauguagacucccaagau

SEQ ID NO: 1089578 - RNA, 19 nt, Human
aagugcugggauuacaggc

SEQ ID NO: 1089579 - RNA, 21 nt, Human
aagugcugggauuacaggcau

SEQ ID NO: 1089580 - RNA, 26 nt, Human
aagugcugggauuacaggcaugagcc

SEQ ID NO: 1089581 - RNA, 20 nt, Human
acaccaccaugcccagcuaa

SEQ ID NO: 1089582 - RNA, 21 nt, Human
acaccaccucuucuacuccag

SEQ ID NO: 1089583 - RNA, 21 nt, Human
aggcaguccgccgaccucagg

SEQ ID NO: 1089584 - RNA, 21 nt, Human
aggcagugacacccuuagagc

SEQ ID NO: 1089585 - RNA, 21 nt, Human
aggcaugagccaccagacccg

SEQ ID NO: 1089586 - RNA, 18 nt, Human
aguagcugggauuacagg

SEQ ID NO: 1089587 - RNA, 20 nt, Human
agugcaguggugcgaccucg

SEQ ID NO: 1089588 - RNA, 23 nt, Human
agugcaguggugcgaccucggcu

SEQ ID NO: 1089589 - RNA, 24 nt, Human
agugcaguggugcgaccucggcuc

SEQ ID NO: 1089590 - RNA, 18 nt, Human
agugcugggauuacaggc

SEQ ID NO: 1089591 - RNA, 24 nt, Human
augggguuuugccauguuggccag

SEQ ID NO: 1089592 - RNA, 24 nt, Human
auuuuuuuauuuuuaguagagaug

SEQ ID NO: 1089593 - RNA, 23 nt, Human
caaagugcugggauuacaggcau

SEQ ID NO: 1089594 - RNA, 24 nt, Human
caaagugcugggauuacaggcaug

SEQ ID NO: 1089595 - RNA, 22 nt, Human
caagagauaaacaaacaccacc

SEQ ID NO: 1089596 - RNA, 19 nt, Human
caagcccacacaccucauu

SEQ ID NO: 1089597 - RNA, 19 nt, Human
cacacaccaccaugcccag

SEQ ID NO: 1089598 - RNA, 18 nt, Human
cacaccaccaugcccagc

SEQ ID NO: 1089599 - RNA, 23 nt, Human
caccccaaccagugagggucugc

SEQ ID NO: 1089600 - RNA, 23 nt, Human
caccuccagguucaagcaggucu

SEQ ID NO: 1089601 - RNA, 18 nt, Human
caugaauuccaagacuac

SEQ ID NO: 1089602 - RNA, 24 nt, Human
cauguuggccaggcuggucuugaa

SEQ ID NO: 1089603 - RNA, 23 nt, Human
ccaccucuucuacuccaggacug

SEQ ID NO: 1089604 - RNA, 19 nt, Human
ccagguucaagcaggucuc

SEQ ID NO: 1089605 - RNA, 22 nt, Human
ccagguucaagcaggucuccug

SEQ ID NO: 1089606 - RNA, 19 nt, Human
ccauguuggccaggcuggu

SEQ ID NO: 1089607 - RNA, 21 nt, Human
ccauguuggccaggcuggucu

SEQ ID NO: 1089608 - RNA, 21 nt, Human
ccccaaccagugagggucugc

SEQ ID NO: 1089609 - RNA, 24 nt, Human
ccgaccucaggccucucaaagugc

SEQ ID NO: 1089610 - RNA, 22 nt, Human
ccuccagguucaagcaggucuc

SEQ ID NO: 1089611 - RNA, 22 nt, Human
ccucuaggauucgcgugguggg

SEQ ID NO: 1089612 - RNA, 23 nt, Human
ccugaguagcugggauuacaggc

SEQ ID NO: 1089613 - RNA, 24 nt, Human
ccugaguagcugggauuacaggca

SEQ ID NO: 1089614 - RNA, 23 nt, Human
cgcucuguuacccagacuggagu

SEQ ID NO: 1089615 - RNA, 24 nt, Human
cgcucuguuacccagacuggagug

SEQ ID NO: 1089616 - RNA, 24 nt, Human
cuaaaugcccugugcuuggucccu

SEQ ID NO: 1089617 - RNA, 20 nt, Human
cuacaccccaaccagugagg

SEQ ID NO: 1089618 - RNA, 27 nt, Human
cucacugcaaccuccaccuccagguuc

SEQ ID NO: 1089619 - RNA, 21 nt, Human
cuccagguucaagcaggucuc

SEQ ID NO: 1089620 - RNA, 18 nt, Human
cuccuggugauaagaaaa

SEQ ID NO: 1089621 - RNA, 24 nt, Human
cucuaaaugcccugugcuuggucc

SEQ ID NO: 1089622 - RNA, 19 nt, Human
cugaagguacagggggaaa

SEQ ID NO: 1089623 - RNA, 23 nt, Human
cugaguagcugggauuacaggca

SEQ ID NO: 1089624 - RNA, 23 nt, Human
cugccucauccuccugaguagcu

SEQ ID NO: 1089625 - RNA, 25 nt, Human
cugccucauccuccugaguagcugg

SEQ ID NO: 1089626 - RNA, 23 nt, Human
gaaaauguagacucccaagauuc

SEQ ID NO: 1089627 - RNA, 19 nt, Human
gaccucggcucacugcaac

SEQ ID NO: 1089628 - RNA, 20 nt, Human
gagaugggguuuugccaugu

SEQ ID NO: 1089629 - RNA, 24 nt, Human
gaguagcugggauuacaggcacac

SEQ ID NO: 1089630 - RNA, 22 nt, Human
gauuacaggcacacaccaccau

SEQ ID NO: 1089631 - RNA, 18 nt, Human
gauuacaggcaugagcca

SEQ ID NO: 1089632 - RNA, 21 nt, Human
gauuacaggcaugagccacca

SEQ ID NO: 1089633 - RNA, 24 nt, Human
gauuacaggcaugagccaccagac

SEQ ID NO: 1089634 - RNA, 21 nt, Human
gcaaccuccaccuccagguuc

SEQ ID NO: 1089635 - RNA, 22 nt, Human
gcaaugcccaaggcagggccac

SEQ ID NO: 1089636 - RNA, 19 nt, Human
gcacacaccaccaugccca

SEQ ID NO: 1089637 - RNA, 19 nt, Human
gcaguggugcgaccucggc

SEQ ID NO: 1089638 - RNA, 18 nt, Human
gcaucucuggacuuuucu

SEQ ID NO: 1089639 - RNA, 20 nt, Human
gccauguuggccaggcuggu

SEQ ID NO: 1089640 - RNA, 22 nt, Human
gccauguuggccaggcuggucu

SEQ ID NO: 1089641 - RNA, 24 nt, Human
gccauguuggccaggcuggucuug

SEQ ID NO: 1089642 - RNA, 25 nt, Human
gcucuguuacccagacuggagugca

SEQ ID NO: 1089643 - RNA, 19 nt, Human
ggagaggucucaagagguu

SEQ ID NO: 1089644 - RNA, 19 nt, Human
ggauuacaggcaugagcca

SEQ ID NO: 1089645 - RNA, 24 nt, Human
ggcuggucuugaauuccugaccuc

SEQ ID NO: 1089646 - RNA, 22 nt, Human
gggguuuugccauguuggccag

SEQ ID NO: 1089647 - RNA, 18 nt, Human
ggguuuugccauguuggc

SEQ ID NO: 1089648 - RNA, 22 nt, Human
ggguuuugccauguuggccagg

SEQ ID NO: 1089649 - RNA, 19 nt, Human
ggucuugaauuccugaccu

SEQ ID NO: 1089650 - RNA, 23 nt, Human
guagagaugggguuuugccaugu

SEQ ID NO: 1089651 - RNA, 23 nt, Human
uaauuuuuuuauuuuuaguagag

SEQ ID NO: 1089652 - RNA, 24 nt, Human
uaauuuuuuuauuuuuaguagaga

SEQ ID NO: 1089653 - RNA, 23 nt, Human
uacaggcaugagccaccagaccc

SEQ ID NO: 1089654 - RNA, 24 nt, Human
uacccagacuggagugcaguggug

SEQ ID NO: 1089655 - RNA, 22 nt, Human
uagagaugggguuuugccaugu

SEQ ID NO: 1089656 - RNA, 24 nt, Human
uaguagagaugggguuuugccaug

SEQ ID NO: 1089657 - RNA, 23 nt, Human
ucaaagugcugggauuacaggca

SEQ ID NO: 1089658 - RNA, 24 nt, Human
ucaaagugcugggauuacaggcau

SEQ ID NO: 1089659 - RNA, 23 nt, Human
ucacugcaaccuccaccuccagg

SEQ ID NO: 1089660 - RNA, 24 nt, Human
ucacugcaaccuccaccuccaggu

SEQ ID NO: 1089661 - RNA, 26 nt, Human
ucacugcaaccuccaccuccagguuc

SEQ ID NO: 1089662 - RNA, 21 nt, Human
ucaggccucucaaagugcugg

SEQ ID NO: 1089663 - RNA, 20 nt, Human
uccaagagauaaacaaacac

SEQ ID NO: 1089664 - RNA, 22 nt, Human
uccaagagauaaacaaacacca

SEQ ID NO: 1089665 - RNA, 23 nt, Human
uccaagagauaaacaaacaccac

SEQ ID NO: 1089666 - RNA, 20 nt, Human
ucccaaaucaggccaacucu

SEQ ID NO: 1089667 - RNA, 25 nt, Human
uccucuaggauucgcguggugggaa

SEQ ID NO: 1089668 - RNA, 26 nt, Human
uccugaccucaggcaguccgccgacc

SEQ ID NO: 1089669 - RNA, 24 nt, Human
uccugaguagcugggauuacaggc

SEQ ID NO: 1089670 - RNA, 24 nt, Human
ucucaaagugcugggauuacaggc

SEQ ID NO: 1089671 - RNA, 24 nt, Human
ucucgcucuguuacccagacugga

SEQ ID NO: 1089672 - RNA, 26 nt, Human
ucucgcucuguuacccagacuggagu

SEQ ID NO: 1089673 - RNA, 27 nt, Human
ucucgcucuguuacccagacuggagug

SEQ ID NO: 1089674 - RNA, 24 nt, Human
ucuguuacccagacuggagugcag

SEQ ID NO: 1089675 - RNA, 22 nt, Human
ucuucauaaguuaagcaggagu

SEQ ID NO: 1089676 - RNA, 24 nt, Human
ugaauuccugaccucaggcagucc

SEQ ID NO: 1089677 - RNA, 20 nt, Human
ugaccucaggcaguccgccg

SEQ ID NO: 1089678 - RNA, 18 nt, Human
ugaggcggggguccaggg

SEQ ID NO: 1089679 - RNA, 20 nt, Human
ugaggcggggguccaggguu

SEQ ID NO: 1089680 - RNA, 22 nt, Human
ugcaguggugcgaccucggcuc

SEQ ID NO: 1089681 - RNA, 18 nt, Human
ugccaggcagugacaccc

SEQ ID NO: 1089682 - RNA, 25 nt, Human
ugccauaaucccaaaucaggccaac

SEQ ID NO: 1089683 - RNA, 22 nt, Human
ugccauguuggccaggcugguc

SEQ ID NO: 1089684 - RNA, 24 nt, Human
ugccauguuggccaggcuggucuu

SEQ ID NO: 1089685 - RNA, 23 nt, Human
ugccucauccuccugaguagcug

SEQ ID NO: 1089686 - RNA, 24 nt, Human
ugccucauccuccugaguagcugg

SEQ ID NO: 1089687 - RNA, 28 nt, Human
ugccucauccuccugaguagcugggauu

SEQ ID NO: 1089688 - RNA, 21 nt, Human
ugccucugucaugaauuccaa

SEQ ID NO: 1089689 - RNA, 22 nt, Human
uggagugcaguggugcgaccuc

SEQ ID NO: 1089690 - RNA, 23 nt, Human
uggagugcaguggugcgaccucg

SEQ ID NO: 1089691 - RNA, 24 nt, Human
uggagugcaguggugcgaccucgg

SEQ ID NO: 1089692 - RNA, 20 nt, Human
uggcaucucuggacuuuucu

SEQ ID NO: 1089693 - RNA, 24 nt, Human
uggccaggcuggucuugaauuccu

SEQ ID NO: 1089694 - RNA, 21 nt, Human
ugggauuacaggcacacacca

SEQ ID NO: 1089695 - RNA, 22 nt, Human
ugggauuacaggcacacaccac

SEQ ID NO: 1089696 - RNA, 22 nt, Human
ugggauuacaggcacacaccac

SEQ ID NO: 1089697 - RNA, 24 nt, Human
ugggauuacaggcacacaccacca

SEQ ID NO: 1089698 - RNA, 18 nt, Human
ugggauuacaggcaugag

SEQ ID NO: 1089699 - RNA, 19 nt, Human
ugggauuacaggcaugagc

SEQ ID NO: 1089700 - RNA, 22 nt, Human
ugggauuacaggcaugagccac

SEQ ID NO: 1089701 - RNA, 23 nt, Human
ugggauuacaggcaugagccacc

SEQ ID NO: 1089702 - RNA, 24 nt, Human
ugggauuacaggcaugagccacca

SEQ ID NO: 1089703 - RNA, 24 nt, Human
ugggguuuugccauguuggccagg

SEQ ID NO: 1089704 - RNA, 18 nt, Human
uuaguagagaugggguuu

SEQ ID NO: 1089705 - RNA, 22 nt, Human
uuaguagagaugggguuuugcc

SEQ ID NO: 1089706 - RNA, 24 nt, Human
uuaguagagaugggguuuugccau

SEQ ID NO: 1089707 - RNA, 22 nt, Human
uuccugaccucaggcaguccgc

SEQ ID NO: 1089708 - RNA, 20 nt, Human
uuggucccuggucagggaga

SEQ ID NO: 1089709 - RNA, 19 nt, Human
uuuaacuuucuucauaagu

SEQ ID NO: 1089710 - RNA, 22 nt, Human
uuuuauuuuuaguagagauggg

SEQ ID NO: 1089711 - RNA, 24 nt, Human
uuuuauuuuuaguagagauggggu

SEQ ID NO: 1089712 - RNA, 23 nt, Human
uuuugccauguuggccaggcugg

SEQ ID NO: 1089713 - RNA, 21 nt, Human
uuuuuaguagagaugggguuu

SEQ ID NO: 1089714 - RNA, 24 nt, Human
uuuuuaguagagaugggguuuugc

SEQ ID NO: 1089715 - RNA, 27 nt, Human
aaacagcccuagaacacauauuuaaau

SEQ ID NO: 1089716 - RNA, 20 nt, Human
aaagaacuguuaaccuaaaa

SEQ ID NO: 1089717 - RNA, 21 nt, Human
aaagaacuguuaaccuaaaag

SEQ ID NO: 1089718 - RNA, 18 nt, Human
aagauggcggcggcugcg

SEQ ID NO: 1089719 - RNA, 24 nt, Human
acagugaguggccaccucuaccag

SEQ ID NO: 1089720 - RNA, 25 nt, Human
accauaauagaauuaacaaacagcc

SEQ ID NO: 1089721 - RNA, 21 nt, Human
acccagcugaccagguuccaa

SEQ ID NO: 1089722 - RNA, 20 nt, Human
acgccgcacagcaaacaagc

SEQ ID NO: 1089723 - RNA, 23 nt, Human
agaacacauauuuaaauuugcag

SEQ ID NO: 1089724 - RNA, 19 nt, Human
agaauuaacaaacagcccu

SEQ ID NO: 1089725 - RNA, 23 nt, Human
agacagaaaagacucaggccagg

SEQ ID NO: 1089726 - RNA, 20 nt, Human
agacucaggccaggcuggca

SEQ ID NO: 1089727 - RNA, 18 nt, Human
aggccaggcuggcaugua

SEQ ID NO: 1089728 - RNA, 19 nt, Human
agggaugaagggcuggggc

SEQ ID NO: 1089729 - RNA, 21 nt, Human
aguagguccaaagucucacgg

SEQ ID NO: 1089730 - RNA, 20 nt, Human
aucacaauuacauuaaaaca

SEQ ID NO: 1089731 - RNA, 23 nt, Human
auggugguagaaauagcuuuguc

SEQ ID NO: 1089732 - RNA, 23 nt, Human
cacccagaacugggaaucacaau

SEQ ID NO: 1089733 - RNA, 27 nt, Human
cacuccacggcugugaagauggcggcg

SEQ ID NO: 1089734 - RNA, 21 nt, Human
cacuccgaccagcucccagcu

SEQ ID NO: 1089735 - RNA, 18 nt, Human
cagaaaagacucaggcca

SEQ ID NO: 1089736 - RNA, 26 nt, Human
cagcaaacaagcuccgcgacguuucc

SEQ ID NO: 1089737 - RNA, 19 nt, Human
caggacaagggcccugggc

SEQ ID NO: 1089738 - RNA, 23 nt, Human
ccaggcuggcauguagcgaucuc

SEQ ID NO: 1089739 - RNA, 21 nt, Human
cggaaguagagagccaaaucc

SEQ ID NO: 1089740 - RNA, 23 nt, Human
cguuuuucagugcgggaccggca

SEQ ID NO: 1089741 - RNA, 25 nt, Human
cuagaacacauauuuaaauuugcag

SEQ ID NO: 1089742 - RNA, 23 nt, Human
cugaggcaccaggacucuucacu

SEQ ID NO: 1089743 - RNA, 25 nt, Human
cuuuuuauucacccagaacugggaa

SEQ ID NO: 1089744 - RNA, 23 nt, Human
gaaccgaaacugggcggcgguga

SEQ ID NO: 1089745 - RNA, 19 nt, Human
gaccagguuccaacaggau

SEQ ID NO: 1089746 - RNA, 18 nt, Human
gagcucacccgucaccac

SEQ ID NO: 1089747 - RNA, 22 nt, Human
gaucuugcuuuuccugaggcac

SEQ ID NO: 1089748 - RNA, 27 nt, Human
gccgcacagcaaacaagcuccgcgacg

SEQ ID NO: 1089749 - RNA, 27 nt, Human
gcucccagcucucaggacaagggcugg

SEQ ID NO: 1089750 - RNA, 22 nt, Human
ggaaguagagagccaaauccug

SEQ ID NO: 1089751 - RNA, 23 nt, Human
ggaaucacaauuaguaaagacca

SEQ ID NO: 1089752 - RNA, 19 nt, Human
ggcggcugcguggcuucag

SEQ ID NO: 1089753 - RNA, 19 nt, Human
gggcggcggugagggcgug

SEQ ID NO: 1089754 - RNA, 21 nt, Human
gggcuuuuccagacuuucugg

SEQ ID NO: 1089755 - RNA, 21 nt, Human
gguggcugaugaggaacgugc

SEQ ID NO: 1089756 - RNA, 22 nt, Human
guaaagaccauaauagaauuaa

SEQ ID NO: 1089757 - RNA, 19 nt, Human
guagaaauagcuuugucua

SEQ ID NO: 1089758 - RNA, 21 nt, Human
guagaaauagcuuugucuaug

SEQ ID NO: 1089759 - RNA, 19 nt, Human
guagcgaucucucuaaccc

SEQ ID NO: 1089760 - RNA, 21 nt, Human
uaacccagcugaccagguucc

SEQ ID NO: 1089761 - RNA, 18 nt, Human
uaccagauauuuuguaaa

SEQ ID NO: 1089762 - RNA, 23 nt, Human
uaccagauauuuuguaaacauca

SEQ ID NO: 1089763 - RNA, 21 nt, Human
uagaauuaacaaacagcccua

SEQ ID NO: 1089764 - RNA, 19 nt, Human
ugacuccaucaacucuucc

SEQ ID NO: 1089765 - RNA, 21 nt, Human
ugacuccaucaacucuuccuu

SEQ ID NO: 1089766 - RNA, 22 nt, Human
uggcggcggcugcguggggugc

SEQ ID NO: 1089767 - RNA, 23 nt, Human
ugggaagggaguccccuccagau

SEQ ID NO: 1089768 - RNA, 25 nt, Human
ugggaaucacaauuaguaaagacca

SEQ ID NO: 1089769 - RNA, 21 nt, Human
uguaaagaacuguuaaccuaa

SEQ ID NO: 1089770 - RNA, 20 nt, Human
uuaaaaaagccgauugggug

SEQ ID NO: 1089771 - RNA, 20 nt, Human
uuaaauuugcaguggguguu

SEQ ID NO: 1089772 - RNA, 20 nt, Human
uuagagcagagccggaagaa

SEQ ID NO: 1089773 - RNA, 18 nt, Human
uuccuugguagguugauc

SEQ ID NO: 1089774 - RNA, 18 nt, Human
uugccugucauucuucug

SEQ ID NO: 1089775 - RNA, 19 nt, Human
uuuauucacccagaacugg

SEQ ID NO: 1089776 - RNA, 24 nt, Human
uuucuggccccaaagucugacauu

SEQ ID NO: 1089777 - RNA, 21 nt, Human
cccacaguggcagugccccuu

SEQ ID NO: 1089778 - RNA, 19 nt, Human
aacacagguguuacguccu

SEQ ID NO: 1089779 - RNA, 20 nt, Human
aaccacugaacaauuacacc

SEQ ID NO: 1089780 - RNA, 24 nt, Human
acaaagagcgacuccaaaugucaa

SEQ ID NO: 1089781 - RNA, 21 nt, Human
agugcauucauugaauucaaa

SEQ ID NO: 1089782 - RNA, 22 nt, Human
caagucucaaaaauaucaagga

SEQ ID NO: 1089783 - RNA, 18 nt, Human
cacugaacaauuacaccc

SEQ ID NO: 1089784 - RNA, 19 nt, Human
cacugaacaauuacacccc

SEQ ID NO: 1089785 - RNA, 19 nt, Human
cugaaaagcacacccagca

SEQ ID NO: 1089786 - RNA, 24 nt, Human
cuggaaagcugggggaacacaggu

SEQ ID NO: 1089787 - RNA, 19 nt, Human
uaaagaauagucucugcag

SEQ ID NO: 1089788 - RNA, 24 nt, Human
uauaaacaauggucccagaaauuu

SEQ ID NO: 1089789 - RNA, 20 nt, Human
ucugcagugcauucauugaa

SEQ ID NO: 1089790 - RNA, 18 nt, Human
ugaaaagcacacccagca

SEQ ID NO: 1089791 - RNA, 19 nt, Human
ugagcaaaaaccacugaac

SEQ ID NO: 1089792 - RNA, 20 nt, Human
ugauggaccuggaaagcugg

SEQ ID NO: 1089793 - RNA, 21 nt, Human
uggaaagcugggggaacacag

SEQ ID NO: 1089794 - RNA, 24 nt, Human
uggaaagcugggggaacacaggug

SEQ ID NO: 1089795 - RNA, 21 nt, Human
acagacaccagccccucauac

SEQ ID NO: 1089796 - RNA, 22 nt, Human
agcuacaaaucugacacagaca

SEQ ID NO: 1089797 - RNA, 21 nt, Human
cagacaccagccccucauacu

SEQ ID NO: 1089798 - RNA, 23 nt, Human
caugcuuuccuccaccgcgccuc

SEQ ID NO: 1089799 - RNA, 19 nt, Human
ccacucccacagcgcccgc

SEQ ID NO: 1089800 - RNA, 23 nt, Human
cccacagcgcccgccguagucaa

SEQ ID NO: 1089801 - RNA, 19 nt, Human
cccucauacucuuggcucc

SEQ ID NO: 1089802 - RNA, 19 nt, Human
cuccacucccacagcgccc

SEQ ID NO: 1089803 - RNA, 24 nt, Human
cucccacagcgcccgccguaguca

SEQ ID NO: 1089804 - RNA, 19 nt, Human
gcucccaugcuuuccucca

SEQ ID NO: 1089805 - RNA, 24 nt, Human
gcucccaugcuuuccuccaccgcg

SEQ ID NO: 1089806 - RNA, 18 nt, Human
ugacacagacaccagccc

SEQ ID NO: 1089807 - RNA, 21 nt, Human
uggcucccaugcuuuccucca

SEQ ID NO: 1089808 - RNA, 20 nt, Human
uugggagucucaggggccgc

SEQ ID NO: 1089809 - RNA, 20 nt, Human
aaauguccagagguaaacag

SEQ ID NO: 1089810 - RNA, 23 nt, Human
agcaacauagagguacuuguagu

SEQ ID NO: 1089811 - RNA, 19 nt, Human
aguuccccaaauaagccau

SEQ ID NO: 1089812 - RNA, 28 nt, Human
aucaggcaucagcaacauagagguacuu

SEQ ID NO: 1089813 - RNA, 19 nt, Human
auuguagcagcagaagcug

SEQ ID NO: 1089814 - RNA, 20 nt, Human
cacugcucaaccauugccuu

SEQ ID NO: 1089815 - RNA, 18 nt, Human
cagcacagcugcuaccuu

SEQ ID NO: 1089816 - RNA, 22 nt, Human
cagcacagcugcuaccuucucc

SEQ ID NO: 1089817 - RNA, 23 nt, Human
cagcacagcugcuaccuucuccg

SEQ ID NO: 1089818 - RNA, 23 nt, Human
cagcagaagcuguugcaggugau

SEQ ID NO: 1089819 - RNA, 22 nt, Human
cauccuagaacaaaugcugagu

SEQ ID NO: 1089820 - RNA, 24 nt, Human
cccacuccacugcucaaccauugc

SEQ ID NO: 1089821 - RNA, 18 nt, Human
ccccugaggaaggggagg

SEQ ID NO: 1089822 - RNA, 23 nt, Human
ccuuccauuauuuaaaaaaagcc

SEQ ID NO: 1089823 - RNA, 23 nt, Human
cgugcugugugcuuuucuguugc

SEQ ID NO: 1089824 - RNA, 20 nt, Human
cucauagugcuccaggcaua

SEQ ID NO: 1089825 - RNA, 25 nt, Human
cugaggguagaggcugagucucacu

SEQ ID NO: 1089826 - RNA, 23 nt, Human
cuggaaaucucccuaaaaucuga

SEQ ID NO: 1089827 - RNA, 19 nt, Human
gaacucugaggguagaggc

SEQ ID NO: 1089828 - RNA, 18 nt, Human
gaagcuguugcaggugau

SEQ ID NO: 1089829 - RNA, 22 nt, Human
gacuuuaagagacagcacagcu

SEQ ID NO: 1089830 - RNA, 19 nt, Human
gaugaaggaugagugcccc

SEQ ID NO: 1089831 - RNA, 22 nt, Human
gcaugaagaggccuuuucugga

SEQ ID NO: 1089832 - RNA, 23 nt, Human
gcuaaagggaugaaggaugagug

SEQ ID NO: 1089833 - RNA, 21 nt, Human
ggugauagcuguuuuucagcu

SEQ ID NO: 1089834 - RNA, 20 nt, Human
guacuuguaguuccccaaau

SEQ ID NO: 1089835 - RNA, 18 nt, Human
guuuucccauuagauugu

SEQ ID NO: 1089836 - RNA, 21 nt, Human
uaccugggcucccacuccacu

SEQ ID NO: 1089837 - RNA, 21 nt, Human
uagcagcagaagcuguugcag

SEQ ID NO: 1089838 - RNA, 23 nt, Human
ucaagcacugcauuuguaaugcu

SEQ ID NO: 1089839 - RNA, 18 nt, Human
ucccacuccacugcucaa

SEQ ID NO: 1089840 - RNA, 21 nt, Human
ucccacuccacugcucaacca

SEQ ID NO: 1089841 - RNA, 21 nt, Human
uccuagggcugggacuguccu

SEQ ID NO: 1089842 - RNA, 23 nt, Human
ucucacauaaugaaauguccaga

SEQ ID NO: 1089843 - RNA, 20 nt, Human
ucuccggauuguccucuuuu

SEQ ID NO: 1089844 - RNA, 24 nt, Human
ucugucuuagaauauuuuguuucu

SEQ ID NO: 1089845 - RNA, 23 nt, Human
ugaacucugaggguagaggcuga

SEQ ID NO: 1089846 - RNA, 19 nt, Human
ugagugccccugaggaagg

SEQ ID NO: 1089847 - RNA, 20 nt, Human
ugagugccccugaggaaggg

SEQ ID NO: 1089848 - RNA, 19 nt, Human
ugcaucuucuccugcugcc

SEQ ID NO: 1089849 - RNA, 19 nt, Human
ugcuguuuugugcccgucu

SEQ ID NO: 1089850 - RNA, 22 nt, Human
uggaauaaaaucuaagaggagu

SEQ ID NO: 1089851 - RNA, 22 nt, Human
uguaguuccccaaauaagccau

SEQ ID NO: 1089852 - RNA, 22 nt, Human
uguauugguuuccucaucugau

SEQ ID NO: 1089853 - RNA, 18 nt, Human
uuaaaaaaagccaucucc

SEQ ID NO: 1089854 - RNA, 24 nt, Human
uuccauuauuuaaaaaaagccauc

SEQ ID NO: 1089855 - RNA, 20 nt, Human
uuggcugauacuggaauaaa

SEQ ID NO: 1089856 - RNA, 21 nt, Human
uuucuacauaccccuauugca

SEQ ID NO: 1089857 - RNA, 23 nt, Human
uuuuucagcuauguggcuuugcu

SEQ ID NO: 1089858 - RNA, 27 nt, Human
aagggaccaaggcauagacagugggca

SEQ ID NO: 1089859 - RNA, 19 nt, Human
acaaagcaagcccuuuccu

SEQ ID NO: 1089860 - RNA, 19 nt, Human
accaccgccugcgccccuc

SEQ ID NO: 1089861 - RNA, 23 nt, Human
accaccgccugcgccccuccgga

SEQ ID NO: 1089862 - RNA, 21 nt, Human
acgugggaaccuugcuagcag

SEQ ID NO: 1089863 - RNA, 19 nt, Human
acuggucugcugcccgggc

SEQ ID NO: 1089864 - RNA, 20 nt, Human
acuguuuccuccucugucuc

SEQ ID NO: 1089865 - RNA, 22 nt, Human
agaaaacaaagcaagcccuuuc

SEQ ID NO: 1089866 - RNA, 22 nt, Human
agacaugagagcuaacaacaac

SEQ ID NO: 1089867 - RNA, 18 nt, Human
agagugcuuccgaacucu

SEQ ID NO: 1089868 - RNA, 23 nt, Human
agcaagcccuuuccuuggaguuu

SEQ ID NO: 1089869 - RNA, 24 nt, Human
agccugggcaacaaaguaagacuc

SEQ ID NO: 1089870 - RNA, 19 nt, Human
aggaaggacacacagaggg

SEQ ID NO: 1089871 - RNA, 18 nt, Human
aggagccacagggcugac

SEQ ID NO: 1089872 - RNA, 20 nt, Human
aggaguuugagaccagccug

SEQ ID NO: 1089873 - RNA, 24 nt, Human
aggauugcuugaagccaggaguuu

SEQ ID NO: 1089874 - RNA, 19 nt, Human
agggagcagacacugggcu

SEQ ID NO: 1089875 - RNA, 19 nt, Human
agggggugugcagagcucc

SEQ ID NO: 1089876 - RNA, 22 nt, Human
aucccagcacuuuggaaggcca

SEQ ID NO: 1089877 - RNA, 20 nt, Human
auccugaggugaauuugggg

SEQ ID NO: 1089878 - RNA, 21 nt, Human
augaaggggcaggagggggcg

SEQ ID NO: 1089879 - RNA, 22 nt, Human
augaaggggcaggagggggcgg

SEQ ID NO: 1089880 - RNA, 23 nt, Human
augaaggggcaggagggggcggu

SEQ ID NO: 1089881 - RNA, 25 nt, Human
augaggaaggacacacagagggcaa

SEQ ID NO: 1089882 - RNA, 19 nt, Human
augccuguaaucccagcac

SEQ ID NO: 1089883 - RNA, 24 nt, Human
auggucacgugccauugucaugcc

SEQ ID NO: 1089884 - RNA, 24 nt, Human
auugcuugaagccaggaguuugag

SEQ ID NO: 1089885 - RNA, 26 nt, Human
caaaguggaaggauugcuugaagcca

SEQ ID NO: 1089886 - RNA, 21 nt, Human
caacagaaaacaaagcaagcc

SEQ ID NO: 1089887 - RNA, 21 nt, Human
caaccaacuucaagcaggccc

SEQ ID NO: 1089888 - RNA, 25 nt, Human
caaguccugaggggaaagggaccaa

SEQ ID NO: 1089889 - RNA, 24 nt, Human
caccaggauacucuguugaguucc

SEQ ID NO: 1089890 - RNA, 22 nt, Human
cacgucucccacaaagggagca

SEQ ID NO: 1089891 - RNA, 23 nt, Human
cacucccccucuuccagcuccac

SEQ ID NO: 1089892 - RNA, 20 nt, Human
cacugcauucaacagaaaac

SEQ ID NO: 1089893 - RNA, 18 nt, Human
cagaaaacaaagcaagcc

SEQ ID NO: 1089894 - RNA, 24 nt, Human
cagcacuuuggaaggccaaagugg

SEQ ID NO: 1089895 - RNA, 21 nt, Human
cagcggagaaguuaaauccug

SEQ ID NO: 1089896 - RNA, 23 nt, Human
cagcggcgagggauggcugcaga

SEQ ID NO: 1089897 - RNA, 25 nt, Human
cagcggcgagggauggcugcagagg

SEQ ID NO: 1089898 - RNA, 19 nt, Human
cagcgguggcugcagagac

SEQ ID NO: 1089899 - RNA, 20 nt, Human
cagcuaagggacagcggcga

SEQ ID NO: 1089900 - RNA, 18 nt, Human
caggaccagugaucccau

SEQ ID NO: 1089901 - RNA, 23 nt, Human
caggcggccuccgcgcaugcaug

SEQ ID NO: 1089902 - RNA, 18 nt, Human
cagggcgggcucccugga

SEQ ID NO: 1089903 - RNA, 21 nt, Human
caucccggcgucugcugccau

SEQ ID NO: 1089904 - RNA, 21 nt, Human
caugaccgacucuccccucag

SEQ ID NO: 1089905 - RNA, 20 nt, Human
caugccuguaaucccagcac

SEQ ID NO: 1089906 - RNA, 24 nt, Human
caugccuguaaucccagcacuuug

SEQ ID NO: 1089907 - RNA, 25 nt, Human
cauggucacgugccauugucaugcc

SEQ ID NO: 1089908 - RNA, 24 nt, Human
ccagugaucccauggucacgugcc

SEQ ID NO: 1089909 - RNA, 23 nt, Human
cccauaccuuccccacagaacug

SEQ ID NO: 1089910 - RNA, 22 nt, Human
cccauggucacgugccauuguc

SEQ ID NO: 1089911 - RNA, 20 nt, Human
ccccauaccuuccccacaga

SEQ ID NO: 1089912 - RNA, 20 nt, Human
ccccugauacugggaauaga

SEQ ID NO: 1089913 - RNA, 21 nt, Human
ccggccccgggcgcccgcugg

SEQ ID NO: 1089914 - RNA, 18 nt, Human
ccuuccccacagaacugg

SEQ ID NO: 1089915 - RNA, 21 nt, Human
cgcccugcaucccggccccgg

SEQ ID NO: 1089916 - RNA, 20 nt, Human
cgggcccaggagugccuggg

SEQ ID NO: 1089917 - RNA, 20 nt, Human
cgucagcuaagggacagcgg

SEQ ID NO: 1089918 - RNA, 20 nt, Human
cuagaagacaugaucuguag

SEQ ID NO: 1089919 - RNA, 23 nt, Human
cucaggauucacucugauuugac

SEQ ID NO: 1089920 - RNA, 23 nt, Human
cucaugccuguaaucccagcacu

SEQ ID NO: 1089921 - RNA, 24 nt, Human
cucaugccuguaaucccagcacuu

SEQ ID NO: 1089922 - RNA, 21 nt, Human
cuccucacucccccucuucca

SEQ ID NO: 1089923 - RNA, 22 nt, Human
cucugcacaaugccugcccucc

SEQ ID NO: 1089924 - RNA, 22 nt, Human
cucugccagagcccagacuaga

SEQ ID NO: 1089925 - RNA, 23 nt, Human
cugaagucacuugucuaccccug

SEQ ID NO: 1089926 - RNA, 20 nt, Human
cugcccgggcccaggagugc

SEQ ID NO: 1089927 - RNA, 20 nt, Human
cugcugcccgggcccaggag

SEQ ID NO: 1089928 - RNA, 22 nt, Human
cugcugggccugagcugucugu

SEQ ID NO: 1089929 - RNA, 23 nt, Human
cugggcaugguggcucaugccug

SEQ ID NO: 1089930 - RNA, 22 nt, Human
cugggccuccucacucccccuc

SEQ ID NO: 1089931 - RNA, 22 nt, Human
cuguccgcgcgcccugcauccc

SEQ ID NO: 1089932 - RNA, 18 nt, Human
cuuccagcuccaccccug

SEQ ID NO: 1089933 - RNA, 21 nt, Human
gaagcugccccauaccuuccc

SEQ ID NO: 1089934 - RNA, 24 nt, Human
gagcuugcgugcugcugggccuga

SEQ ID NO: 1089935 - RNA, 23 nt, Human
gaggagccacagggcugacuggu

SEQ ID NO: 1089936 - RNA, 24 nt, Human
gauugcuugaagccaggaguuuga

SEQ ID NO: 1089937 - RNA, 19 nt, Human
gcgagggauggcugcagag

SEQ ID NO: 1089938 - RNA, 21 nt, Human
gcugcugcuaagauaauaaga

SEQ ID NO: 1089939 - RNA, 19 nt, Human
gcugggcaugguggcucau

SEQ ID NO: 1089940 - RNA, 22 nt, Human
gcugggcaugguggcucaugcc

SEQ ID NO: 1089941 - RNA, 22 nt, Human
ggaaggacacacagagggcaag

SEQ ID NO: 1089942 - RNA, 22 nt, Human
ggauugcuugaagccaggaguu

SEQ ID NO: 1089943 - RNA, 23 nt, Human
ggauugcuugaagccaggaguuu

SEQ ID NO: 1089944 - RNA, 22 nt, Human
ggcaucgucacuguuuccuccu

SEQ ID NO: 1089945 - RNA, 23 nt, Human
ggcaugguggcucaugccuguaa

SEQ ID NO: 1089946 - RNA, 21 nt, Human
ggccaaaguggaaggauugcu

SEQ ID NO: 1089947 - RNA, 23 nt, Human
ggcugggcaugguggcucaugcc

SEQ ID NO: 1089948 - RNA, 19 nt, Human
ggugcgcgcgcgccgcgcg

SEQ ID NO: 1089949 - RNA, 24 nt, Human
gguggcucaugccuguaaucccag

SEQ ID NO: 1089950 - RNA, 23 nt, Human
guggcucaugccuguaaucccag

SEQ ID NO: 1089951 - RNA, 23 nt, Human
uaaauccugaggugaauuugggg

SEQ ID NO: 1089952 - RNA, 20 nt, Human
uagcuugggaucugaaaccu

SEQ ID NO: 1089953 - RNA, 24 nt, Human
ucaacagaaaacaaagcaagcccu

SEQ ID NO: 1089954 - RNA, 22 nt, Human
ucagaacccuaauuggccaagc

SEQ ID NO: 1089955 - RNA, 23 nt, Human
ucccaacacugguuauccgcacc

SEQ ID NO: 1089956 - RNA, 18 nt, Human
ucccggccccgggcgccc

SEQ ID NO: 1089957 - RNA, 19 nt, Human
uccgcgcgcccugcauccc

SEQ ID NO: 1089958 - RNA, 20 nt, Human
uccgcgcgcccugcaucccg

SEQ ID NO: 1089959 - RNA, 19 nt, Human
uccucacucccccucuucc

SEQ ID NO: 1089960 - RNA, 22 nt, Human
uccucagcgguggcugcagaga

SEQ ID NO: 1089961 - RNA, 18 nt, Human
ucgccgaggagccacagg

SEQ ID NO: 1089962 - RNA, 23 nt, Human
ucucugccagagcccagacuaga

SEQ ID NO: 1089963 - RNA, 18 nt, Human
ucugcacaaugccugccc

SEQ ID NO: 1089964 - RNA, 22 nt, Human
ucuguagcuugggaucugaaac

SEQ ID NO: 1089965 - RNA, 18 nt, Human
ucugucucguuucugucc

SEQ ID NO: 1089966 - RNA, 24 nt, Human
ucuuccagcuccaccccugaucac

SEQ ID NO: 1089967 - RNA, 22 nt, Human
ugaacgggcccuugggucugau

SEQ ID NO: 1089968 - RNA, 18 nt, Human
ugaaggggcaggaggggg

SEQ ID NO: 1089969 - RNA, 21 nt, Human
ugacaggaccagugaucccau

SEQ ID NO: 1089970 - RNA, 22 nt, Human
ugacgagcacuucacggcgcca

SEQ ID NO: 1089971 - RNA, 23 nt, Human
ugagauggagauucccaugcagg

SEQ ID NO: 1089972 - RNA, 19 nt, Human
ugagcggcggcuccuggcc

SEQ ID NO: 1089973 - RNA, 18 nt, Human
ugagcugucugucucguu

SEQ ID NO: 1089974 - RNA, 21 nt, Human
ugauuugaccaagagucagaa

SEQ ID NO: 1089975 - RNA, 25 nt, Human
ugcagagggggugugcagagcucca

SEQ ID NO: 1089976 - RNA, 20 nt, Human
ugcaugaaggggcaggaggg

SEQ ID NO: 1089977 - RNA, 20 nt, Human
ugccccauaccuuccccaca

SEQ ID NO: 1089978 - RNA, 21 nt, Human
ugccugguguagcagucgcgg

SEQ ID NO: 1089979 - RNA, 18 nt, Human
ugccuguaaucccagcac

SEQ ID NO: 1089980 - RNA, 21 nt, Human
ugcgcgcgcgccgcgcgugug

SEQ ID NO: 1089981 - RNA, 21 nt, Human
ugcgugcugcugggccugagc

SEQ ID NO: 1089982 - RNA, 18 nt, Human
ugcugccaugaccgacuc

SEQ ID NO: 1089983 - RNA, 18 nt, Human
ugcugcccgggcccagga

SEQ ID NO: 1089984 - RNA, 20 nt, Human
ugcugcuaagauaauaagag

SEQ ID NO: 1089985 - RNA, 18 nt, Human
ugcuugaagccaggaguu

SEQ ID NO: 1089986 - RNA, 20 nt, Human
uggcaagagagcaguuucau

SEQ ID NO: 1089987 - RNA, 20 nt, Human
uggcaucgucacuguuuccu

SEQ ID NO: 1089988 - RNA, 23 nt, Human
uggcaucucagcuacgccuucaa

SEQ ID NO: 1089989 - RNA, 21 nt, Human
uggccaggcccuucucuagcc

SEQ ID NO: 1089990 - RNA, 21 nt, Human
uggccgcgggaccgugagacg

SEQ ID NO: 1089991 - RNA, 19 nt, Human
uggcggagaaaaaguaggg

SEQ ID NO: 1089992 - RNA, 22 nt, Human
uggcucaugccuguaaucccag

SEQ ID NO: 1089993 - RNA, 24 nt, Human
uggcucaugccuguaaucccagca

SEQ ID NO: 1089994 - RNA, 18 nt, Human
uggcugagcagcggagaa

SEQ ID NO: 1089995 - RNA, 19 nt, Human
ugggucugaugugauguua

SEQ ID NO: 1089996 - RNA, 21 nt, Human
uggguggugcagaaugugaca

SEQ ID NO: 1089997 - RNA, 24 nt, Human
ugguggcucaugccuguaauccca

SEQ ID NO: 1089998 - RNA, 19 nt, Human
uucccuccuuggugccccu

SEQ ID NO: 1089999 - RNA, 22 nt, Human
uugaagccaggaguuugagacc

SEQ ID NO: 1090000 - RNA, 23 nt, Human
uugaguuccaugacagaaucugu

SEQ ID NO: 1090001 - RNA, 23 nt, Human
uuucagggcgggcucccuggagg

SEQ ID NO: 1090002 - RNA, 23 nt, Human
uuucccuccuuggugccccugac

SEQ ID NO: 1090003 - RNA, 18 nt, Human
uuuccuccucugucucca

SEQ ID NO: 1090004 - RNA, 21 nt, Human
aaagcccaagucauuaacagu

SEQ ID NO: 1090005 - RNA, 24 nt, Human
aacauccugaucaggguuuaaugu

SEQ ID NO: 1090006 - RNA, 24 nt, Human
aagaacaagucuaaguugguuguu

SEQ ID NO: 1090007 - RNA, 22 nt, Human
acaacagcuacuuccaaagccc

SEQ ID NO: 1090008 - RNA, 21 nt, Human
acagaacuucuuaacaaugga

SEQ ID NO: 1090009 - RNA, 19 nt, Human
acagcaauucccuguauag

SEQ ID NO: 1090010 - RNA, 20 nt, Human
acauagugcuucuaccacca

SEQ ID NO: 1090011 - RNA, 19 nt, Human
acuaauaacaucagagaaa

SEQ ID NO: 1090012 - RNA, 20 nt, Human
acugacuaacauccugauca

SEQ ID NO: 1090013 - RNA, 20 nt, Human
acugcugcaugccugcagac

SEQ ID NO: 1090014 - RNA, 21 nt, Human
agaacuggcaaagacugugaa

SEQ ID NO: 1090015 - RNA, 20 nt, Human
agaagaagaacaagucuaaa

SEQ ID NO: 1090016 - RNA, 20 nt, Human
agaagauguuuuccaacaau

SEQ ID NO: 1090017 - RNA, 22 nt, Human
agacagaauaaaggugcauaug

SEQ ID NO: 1090018 - RNA, 21 nt, Human
agacagcaauucccuguauag

SEQ ID NO: 1090019 - RNA, 27 nt, Human
agacggaagacagaauaaaggggaccc

SEQ ID NO: 1090020 - RNA, 19 nt, Human
agauuuuccagauacugca

SEQ ID NO: 1090021 - RNA, 18 nt, Human
agcuuagaaagaacagug

SEQ ID NO: 1090022 - RNA, 22 nt, Human
aucgcuuaggaaaacaccuaaa

SEQ ID NO: 1090023 - RNA, 23 nt, Human
auggauuucugagguucccuugg

SEQ ID NO: 1090024 - RNA, 22 nt, Human
caaucaacaccugucauggcac

SEQ ID NO: 1090025 - RNA, 23 nt, Human
cacugcaggcuggccugccaaca

SEQ ID NO: 1090026 - RNA, 27 nt, Human
cagcaaucaacaccugucauggcacac

SEQ ID NO: 1090027 - RNA, 23 nt, Human
cagcaauucccuguauagcuuca

SEQ ID NO: 1090028 - RNA, 20 nt, Human
cagccuguugagccacugag

SEQ ID NO: 1090029 - RNA, 22 nt, Human
caggcuggcacucuuacaccca

SEQ ID NO: 1090030 - RNA, 18 nt, Human
caugaugagugccaaccu

SEQ ID NO: 1090031 - RNA, 23 nt, Human
ccaaacaaacagaacuucuuaac

SEQ ID NO: 1090032 - RNA, 21 nt, Human
ccaaagcccaagucauuaaca

SEQ ID NO: 1090033 - RNA, 22 nt, Human
ccaccaucauaaugcuuacuuc

SEQ ID NO: 1090034 - RNA, 19 nt, Human
ccacugacuaacauccuga

SEQ ID NO: 1090035 - RNA, 26 nt, Human
ccacugaguuaauccacagaagaugu

SEQ ID NO: 1090036 - RNA, 21 nt, Human
cccagcacuggcuaaggugag

SEQ ID NO: 1090037 - RNA, 24 nt, Human
ccugcacagcagcccaaucggcag

SEQ ID NO: 1090038 - RNA, 21 nt, Human
cgaauacaaguuccacggugc

SEQ ID NO: 1090039 - RNA, 26 nt, Human
cuacuuccaaagcccaagucauuaac

SEQ ID NO: 1090040 - RNA, 20 nt, Human
cucaaagcugcuuaaugauu

SEQ ID NO: 1090041 - RNA, 21 nt, Human
cuccacagaggccuuuucaaa

SEQ ID NO: 1090042 - RNA, 23 nt, Human
cuguauagcuucaggacaaugaa

SEQ ID NO: 1090043 - RNA, 19 nt, Human
cuuacacccagcacuggcu

SEQ ID NO: 1090044 - RNA, 22 nt, Human
cuuccaaagcccaagucauuaa

SEQ ID NO: 1090045 - RNA, 25 nt, Human
cuucuuaacaauggaacuucaaugg

SEQ ID NO: 1090046 - RNA, 18 nt, Human
gaaagacggaagacagaa

SEQ ID NO: 1090047 - RNA, 24 nt, Human
gcacuaguuggacacggcaaacau

SEQ ID NO: 1090048 - RNA, 18 nt, Human
gccugccaacaauccuac

SEQ ID NO: 1090049 - RNA, 18 nt, Human
gguuguuuucaucucugu

SEQ ID NO: 1090050 - RNA, 23 nt, Human
guucacauagugcuucuaccacc

SEQ ID NO: 1090051 - RNA, 22 nt, Human
uaaaacuaauaacaucagagaa

SEQ ID NO: 1090052 - RNA, 21 nt, Human
uaaaagaucaucuggcaagga

SEQ ID NO: 1090053 - RNA, 21 nt, Human
uaaaaggccuuugcaaaauuu

SEQ ID NO: 1090054 - RNA, 24 nt, Human
uaaaguagaaagucucagaggucc

SEQ ID NO: 1090055 - RNA, 24 nt, Human
uacaacagcuacuuccaaagccca

SEQ ID NO: 1090056 - RNA, 19 nt, Human
uacugguacucuuuuucaa

SEQ ID NO: 1090057 - RNA, 23 nt, Human
uacuuccaaagcccaagucauua

SEQ ID NO: 1090058 - RNA, 20 nt, Human
uagaacagucuuuccaacca

SEQ ID NO: 1090059 - RNA, 20 nt, Human
uagaacuggcaaagacugug

SEQ ID NO: 1090060 - RNA, 18 nt, Human
uauagacugccacuucug

SEQ ID NO: 1090061 - RNA, 26 nt, Human
uaucgcuuaggaaaacaccuaaagga

SEQ ID NO: 1090062 - RNA, 28 nt, Human
uauuuuguucuacucgguuuuauucuua

SEQ ID NO: 1090063 - RNA, 18 nt, Human
ucacauagugcuucuacc

SEQ ID NO: 1090064 - RNA, 19 nt, Human
ucacugcaggcuggccugc

SEQ ID NO: 1090065 - RNA, 19 nt, Human
ucagagaaaucuugggggu

SEQ ID NO: 1090066 - RNA, 20 nt, Human
ucagccuguugagccacuga

SEQ ID NO: 1090067 - RNA, 20 nt, Human
ucaggacaaugaaguucaca

SEQ ID NO: 1090068 - RNA, 23 nt, Human
uccaacaauagaugaugaccaga

SEQ ID NO: 1090069 - RNA, 19 nt, Human
uccacugacuaacauccug

SEQ ID NO: 1090070 - RNA, 20 nt, Human
uccacugacuaacauccuga

SEQ ID NO: 1090071 - RNA, 21 nt, Human
ucccauauggcccacugccaa

SEQ ID NO: 1090072 - RNA, 23 nt, Human
ucuauuuuuucuuuugauccucc

SEQ ID NO: 1090073 - RNA, 25 nt, Human
ucucacugucacugcaggcuggccu

SEQ ID NO: 1090074 - RNA, 21 nt, Human
ucuggcaaggaagaggauaga

SEQ ID NO: 1090075 - RNA, 21 nt, Human
ucugugugauuguuaucgcuu

SEQ ID NO: 1090076 - RNA, 23 nt, Human
ugaaacuguuaaaguagaaaguc

SEQ ID NO: 1090077 - RNA, 18 nt, Human
ugaccagacagcaauucc

SEQ ID NO: 1090078 - RNA, 26 nt, Human
ugaccagacagcaauucccuguauag

SEQ ID NO: 1090079 - RNA, 18 nt, Human
ugaccuugggaggugaag

SEQ ID NO: 1090080 - RNA, 21 nt, Human
ugacuggucacgcuuauccag

SEQ ID NO: 1090081 - RNA, 19 nt, Human
ugagcucugcccagugggg

SEQ ID NO: 1090082 - RNA, 21 nt, Human
ugagggaagugcuacugguac

SEQ ID NO: 1090083 - RNA, 24 nt, Human
ugaucaggguuuaaugugugaccu

SEQ ID NO: 1090084 - RNA, 22 nt, Human
uggaauaagacaguccucuguu

SEQ ID NO: 1090085 - RNA, 19 nt, Human
uggcacucuuacacccagc

SEQ ID NO: 1090086 - RNA, 22 nt, Human
ugugacuucuuaaugcuaaaga

SEQ ID NO: 1090087 - RNA, 22 nt, Human
uguuuuguuuuuugaauuuuuu

SEQ ID NO: 1090088 - RNA, 23 nt, Human
uguuuuguuuuuugaauuuuuua

SEQ ID NO: 1090089 - RNA, 23 nt, Human
uuaauccacagaagauguuuucc

SEQ ID NO: 1090090 - RNA, 21 nt, Human
uuauauuauuuauuuauucuu

SEQ ID NO: 1090091 - RNA, 20 nt, Human
uucacauagugcuucuacca

SEQ ID NO: 1090092 - RNA, 24 nt, Human
uuccccugagauaggcugguuguu

SEQ ID NO: 1090093 - RNA, 21 nt, Human
uucccuguauagcuucaggac

SEQ ID NO: 1090094 - RNA, 22 nt, Human
uucgaaugauaccuucaauugu

SEQ ID NO: 1090095 - RNA, 21 nt, Human
uucuccaacaacugauucugg

SEQ ID NO: 1090096 - RNA, 21 nt, Human
uucuccugguaacaauucuaa

SEQ ID NO: 1090097 - RNA, 20 nt, Human
uugauuucaacaguuuucca

SEQ ID NO: 1090098 - RNA, 24 nt, Human
uugcucaggcuugagugcacuggc

SEQ ID NO: 1090099 - RNA, 24 nt, Human
uuuucaugucuauuuuuucuuuug

SEQ ID NO: 1090100 - RNA, 22 nt, Human
uuuucuccaacaacugauucug

SEQ ID NO: 1090101 - RNA, 18 nt, Human
uuuucuuuugauccucca

SEQ ID NO: 1090102 - RNA, 22 nt, Human
aaaccaguagucucaacuccgg

SEQ ID NO: 1090103 - RNA, 23 nt, Human
aacagaaacccacaacccaaaac

SEQ ID NO: 1090104 - RNA, 21 nt, Human
aacccaaaacaagggcagccc

SEQ ID NO: 1090105 - RNA, 22 nt, Human
aacuugguuucauucacuuugg

SEQ ID NO: 1090106 - RNA, 19 nt, Human
aagcagaauccugccuugg

SEQ ID NO: 1090107 - RNA, 22 nt, Human
aaggagaaacugaggcacagua

SEQ ID NO: 1090108 - RNA, 20 nt, Human
aauguuuuuaaaguugggca

SEQ ID NO: 1090109 - RNA, 26 nt, Human
acaacuaagcccacuaccuuuggaag

SEQ ID NO: 1090110 - RNA, 21 nt, Human
acaggcacucucaugaucccu

SEQ ID NO: 1090111 - RNA, 26 nt, Human
accaagcugccucauggggcuguccu

SEQ ID NO: 1090112 - RNA, 20 nt, Human
agaaacccacaacccaaaac

SEQ ID NO: 1090113 - RNA, 21 nt, Human
agaaaggaagguagcuggagu

SEQ ID NO: 1090114 - RNA, 21 nt, Human
agacaaaacggcagaaaggaa

SEQ ID NO: 1090115 - RNA, 23 nt, Human
agacaaaacggcagaaaggaagg

SEQ ID NO: 1090116 - RNA, 19 nt, Human
agccaguucccucccugcc

SEQ ID NO: 1090117 - RNA, 21 nt, Human
agcucugcaccaguggcgaag

SEQ ID NO: 1090118 - RNA, 26 nt, Human
aggccacacccagaaagucggcauca

SEQ ID NO: 1090119 - RNA, 18 nt, Human
aggccugggauggaggga

SEQ ID NO: 1090120 - RNA, 20 nt, Human
agggacaagagggagggaca

SEQ ID NO: 1090121 - RNA, 23 nt, Human
agggaugcuggcaggccugggau

SEQ ID NO: 1090122 - RNA, 18 nt, Human
auccugacagguguggag

SEQ ID NO: 1090123 - RNA, 21 nt, Human
aucugcaccccuccccuccug

SEQ ID NO: 1090124 - RNA, 19 nt, Human
caaauuacccaauuugagu

SEQ ID NO: 1090125 - RNA, 18 nt, Human
caaccccuacauuacacu

SEQ ID NO: 1090126 - RNA, 19 nt, Human
caagucccaguuaccaaga

SEQ ID NO: 1090127 - RNA, 20 nt, Human
cacaacccaaaacaagggca

SEQ ID NO: 1090128 - RNA, 21 nt, Human
cacaacccaaaacaagggcag

SEQ ID NO: 1090129 - RNA, 24 nt, Human
cacaacccaaaacaagggcagccc

SEQ ID NO: 1090130 - RNA, 18 nt, Human
cacccccuugcggcaggu

SEQ ID NO: 1090131 - RNA, 22 nt, Human
caccccuccccuccugucuucc

SEQ ID NO: 1090132 - RNA, 23 nt, Human
cacucuccucucugaccugggaa

SEQ ID NO: 1090133 - RNA, 21 nt, Human
cacugaacagaaacccacaac

SEQ ID NO: 1090134 - RNA, 19 nt, Human
cagcagccaggguucccug

SEQ ID NO: 1090135 - RNA, 21 nt, Human
caggugccccucucacuccuu

SEQ ID NO: 1090136 - RNA, 27 nt, Human
cauccuccaccacaaccaacagcacac

SEQ ID NO: 1090137 - RNA, 23 nt, Human
cauuacuuccuguccgaucugca

SEQ ID NO: 1090138 - RNA, 21 nt, Human
ccaaaacaagggcagcccaug

SEQ ID NO: 1090139 - RNA, 21 nt, Human
ccacaacccaaaacaagggca

SEQ ID NO: 1090140 - RNA, 19 nt, Human
ccacacugcuagccccagg

SEQ ID NO: 1090141 - RNA, 18 nt, Human
ccagaucgaagcccagcc

SEQ ID NO: 1090142 - RNA, 22 nt, Human
ccaggguucccugacaaaagca

SEQ ID NO: 1090143 - RNA, 23 nt, Human
cccacaacccaaaacaagggcag

SEQ ID NO: 1090144 - RNA, 23 nt, Human
cccacaacccaaaacaagggcag

SEQ ID NO: 1090145 - RNA, 22 nt, Human
cccauggccgugauuaagcucu

SEQ ID NO: 1090146 - RNA, 20 nt, Human
ccccacccccuugcggcagg

SEQ ID NO: 1090147 - RNA, 19 nt, Human
ccgggcuggccuccagggu

SEQ ID NO: 1090148 - RNA, 20 nt, Human
ccgguacagaccccaccccc

SEQ ID NO: 1090149 - RNA, 21 nt, Human
ccuggacccugucaucucaaa

SEQ ID NO: 1090150 - RNA, 18 nt, Human
ccugggauggagggaagu

SEQ ID NO: 1090151 - RNA, 18 nt, Human
cgaucugcaccccucccc

SEQ ID NO: 1090152 - RNA, 21 nt, Human
cggcaucagggaugcuggcag

SEQ ID NO: 1090153 - RNA, 19 nt, Human
cgguacagaccccaccccc

SEQ ID NO: 1090154 - RNA, 21 nt, Human
cguauauaugugccacauccu

SEQ ID NO: 1090155 - RNA, 20 nt, Human
cguguagguacguauauaug

SEQ ID NO: 1090156 - RNA, 23 nt, Human
cuaacacuuucauagugcucaca

SEQ ID NO: 1090157 - RNA, 24 nt, Human
cucaacuccgggcuggccuccagg

SEQ ID NO: 1090158 - RNA, 25 nt, Human
cuccaccacaaccaacagcacacaa

SEQ ID NO: 1090159 - RNA, 21 nt, Human
cuccagcaauccucugucugc

SEQ ID NO: 1090160 - RNA, 22 nt, Human
cugaacagaaacccacaaccca

SEQ ID NO: 1090161 - RNA, 21 nt, Human
cugccuuccaacuugguuuca

SEQ ID NO: 1090162 - RNA, 21 nt, Human
cuggaggguccccaugacugg

SEQ ID NO: 1090163 - RNA, 20 nt, Human
cuggcaccaaagucugugcu

SEQ ID NO: 1090164 - RNA, 23 nt, Human
cuuggcccgguggcuuccagcgg

SEQ ID NO: 1090165 - RNA, 18 nt, Human
gaaccuagcaaacuggca

SEQ ID NO: 1090166 - RNA, 22 nt, Human
gaaccuagcaaacuggcaccaa

SEQ ID NO: 1090167 - RNA, 18 nt, Human
gagcuacaaagagggagu

SEQ ID NO: 1090168 - RNA, 20 nt, Human
gagcugccaccaagcugccu

SEQ ID NO: 1090169 - RNA, 20 nt, Human
gagugggagaccagaauucc

SEQ ID NO: 1090170 - RNA, 21 nt, Human
gauucacucuccacucuccuc

SEQ ID NO: 1090171 - RNA, 21 nt, Human
gcagaaaggaagguagcugga

SEQ ID NO: 1090172 - RNA, 20 nt, Human
gcagcccauggccgugauua

SEQ ID NO: 1090173 - RNA, 18 nt, Human
gccacauccuccaccaca

SEQ ID NO: 1090174 - RNA, 19 nt, Human
gcucuaaaaccaguagucu

SEQ ID NO: 1090175 - RNA, 26 nt, Human
gcugccaccaagcugccucauggggc

SEQ ID NO: 1090176 - RNA, 23 nt, Human
ggacaggcacucucaugaucccu

SEQ ID NO: 1090177 - RNA, 19 nt, Human
ggacccagaaggccagcag

SEQ ID NO: 1090178 - RNA, 25 nt, Human
ggagaaacugaggcacaguauuuca

SEQ ID NO: 1090179 - RNA, 21 nt, Human
ggcagaaaggaagguagcugg

SEQ ID NO: 1090180 - RNA, 19 nt, Human
ggcaggaaagcaggucagg

SEQ ID NO: 1090181 - RNA, 23 nt, Human
ggccuccaggguugcagcaauuc

SEQ ID NO: 1090182 - RNA, 21 nt, Human
ggcuggccuccaggguugcag

SEQ ID NO: 1090183 - RNA, 20 nt, Human
ggcuggggggcaggaaagca

SEQ ID NO: 1090184 - RNA, 23 nt, Human
ggcuggggggcaggaaagcaggu

SEQ ID NO: 1090185 - RNA, 24 nt, Human
gggcuggggggcaggaaagcaggu

SEQ ID NO: 1090186 - RNA, 21 nt, Human
ggggccugggaugccauuacu

SEQ ID NO: 1090187 - RNA, 21 nt, Human
uaaaaccaguagucucaacuc

SEQ ID NO: 1090188 - RNA, 22 nt, Human
uaaagaacagcuaacacuuuca

SEQ ID NO: 1090189 - RNA, 19 nt, Human
uaacuccuuccccacucag

SEQ ID NO: 1090190 - RNA, 21 nt, Human
uaacuccuuccccacucaggc

SEQ ID NO: 1090191 - RNA, 22 nt, Human
uaagcaaaggucacagcuccuu

SEQ ID NO: 1090192 - RNA, 21 nt, Human
uaauccaaucccaggcacauc

SEQ ID NO: 1090193 - RNA, 19 nt, Human
uacaaagagggagucagga

SEQ ID NO: 1090194 - RNA, 19 nt, Human
uacauuacacugaggggcc

SEQ ID NO: 1090195 - RNA, 21 nt, Human
uacugccuuuauuaagcucug

SEQ ID NO: 1090196 - RNA, 22 nt, Human
uacuguacaccuuguauauaua

SEQ ID NO: 1090197 - RNA, 24 nt, Human
uccaggguugcagcaauucggggc

SEQ ID NO: 1090198 - RNA, 23 nt, Human
ucccaguuaccaagaaguaacag

SEQ ID NO: 1090199 - RNA, 22 nt, Human
ucccuuggcccgguggcuucca

SEQ ID NO: 1090200 - RNA, 18 nt, Human
uccgcccucugugcggcc

SEQ ID NO: 1090201 - RNA, 24 nt, Human
uccucugucugcuaaagauaacuc

SEQ ID NO: 1090202 - RNA, 24 nt, Human
uccugagcugccaccaagcugccu

SEQ ID NO: 1090203 - RNA, 23 nt, Human
ucgaaccuagcaaacuggcacca

SEQ ID NO: 1090204 - RNA, 22 nt, Human
ucgagugggagaccagaauucc

SEQ ID NO: 1090205 - RNA, 20 nt, Human
ucuaaaaccaguagucucaa

SEQ ID NO: 1090206 - RNA, 23 nt, Human
ucucaaagccaguucccucccug

SEQ ID NO: 1090207 - RNA, 20 nt, Human
ugaacagaaacccacaaccc

SEQ ID NO: 1090208 - RNA, 24 nt, Human
ugaacagaaacccacaacccaaaa

SEQ ID NO: 1090209 - RNA, 22 nt, Human
ugaaucuuuuacaugugcacau

SEQ ID NO: 1090210 - RNA, 23 nt, Human
ugaccugggaacaugcccgugug

SEQ ID NO: 1090211 - RNA, 18 nt, Human
ugauugguccagcuaugg

SEQ ID NO: 1090212 - RNA, 18 nt, Human
ugcaccaguggcgaaggg

SEQ ID NO: 1090213 - RNA, 20 nt, Human
ugcaccccuccccuccuggu

SEQ ID NO: 1090214 - RNA, 21 nt, Human
ugcagcaauucggggccuggg

SEQ ID NO: 1090215 - RNA, 19 nt, Human
ugccacauccuccaccaca

SEQ ID NO: 1090216 - RNA, 21 nt, Human
ugccacauccuccaccacaac

SEQ ID NO: 1090217 - RNA, 18 nt, Human
ugccccucucacuccucc

SEQ ID NO: 1090218 - RNA, 22 nt, Human
ugcuagccccaggguucugcac

SEQ ID NO: 1090219 - RNA, 20 nt, Human
uggagcuuagggaggcagag

SEQ ID NO: 1090220 - RNA, 21 nt, Human
uggcaggccugggauggaggg

SEQ ID NO: 1090221 - RNA, 21 nt, Human
uggcccgguggcuuccagcgg

SEQ ID NO: 1090222 - RNA, 20 nt, Human
ugguaaagaacagcuaacac

SEQ ID NO: 1090223 - RNA, 21 nt, Human
uuaauguauuaauccaauccc

SEQ ID NO: 1090224 - RNA, 21 nt, Human
uuccuguccgaucugcacccc

SEQ ID NO: 1090225 - RNA, 24 nt, Human
uuccuguccgaucugcaccccucc

SEQ ID NO: 1090226 - RNA, 25 nt, Human
aagcagcacuccuuucugcugcugu

SEQ ID NO: 1090227 - RNA, 24 nt, Human
acaaggaccugcuagccuuggaca

SEQ ID NO: 1090228 - RNA, 19 nt, Human
accacacacacgggaccca

SEQ ID NO: 1090229 - RNA, 22 nt, Human
acggaucugggaccagcaggag

SEQ ID NO: 1090230 - RNA, 22 nt, Human
agaaauucuccuccggacagaa

SEQ ID NO: 1090231 - RNA, 21 nt, Human
agacauccagagagcaaaaga

SEQ ID NO: 1090232 - RNA, 21 nt, Human
agagcaaaagacugugucccc

SEQ ID NO: 1090233 - RNA, 19 nt, Human
agcaaaagacugugucccc

SEQ ID NO: 1090234 - RNA, 23 nt, Human
aggaggcuccuaacgaggccagg

SEQ ID NO: 1090235 - RNA, 20 nt, Human
aggcagggacagggcacggu

SEQ ID NO: 1090236 - RNA, 20 nt, Human
aggcggugagguggagggag

SEQ ID NO: 1090237 - RNA, 22 nt, Human
aggguuggugcgggcgggcggg

SEQ ID NO: 1090238 - RNA, 19 nt, Human
aucugcauaaugguuucac

SEQ ID NO: 1090239 - RNA, 19 nt, Human
cacuccuuucugcugcugu

SEQ ID NO: 1090240 - RNA, 19 nt, Human
cagcaaggcagugugaaga

SEQ ID NO: 1090241 - RNA, 22 nt, Human
cagcagccaggcgguucauuga

SEQ ID NO: 1090242 - RNA, 21 nt, Human
cagcaggaggggcagcgcucc

SEQ ID NO: 1090243 - RNA, 21 nt, Human
cagcgaacagcagccaggcgg

SEQ ID NO: 1090244 - RNA, 20 nt, Human
cagcugagcucagcucacca

SEQ ID NO: 1090245 - RNA, 25 nt, Human
cagggaggugaugcgauggcccacg

SEQ ID NO: 1090246 - RNA, 18 nt, Human
ccaggcaucuccugggga

SEQ ID NO: 1090247 - RNA, 21 nt, Human
ccauggcccuucagggacaag

SEQ ID NO: 1090248 - RNA, 19 nt, Human
cccacggucacagcaaggc

SEQ ID NO: 1090249 - RNA, 24 nt, Human
cgggcuucaucuucuucaucugca

SEQ ID NO: 1090250 - RNA, 23 nt, Human
cugcugcuguccugcucucuucc

SEQ ID NO: 1090251 - RNA, 24 nt, Human
gacagggcacggucagacauccag

SEQ ID NO: 1090252 - RNA, 23 nt, Human
gacuguguccccagcgaacagca

SEQ ID NO: 1090253 - RNA, 18 nt, Human
gauggcccugugaggcag

SEQ ID NO: 1090254 - RNA, 19 nt, Human
gccaggcaucuccugggga

SEQ ID NO: 1090255 - RNA, 21 nt, Human
gcccugugaggcagggacagg

SEQ ID NO: 1090256 - RNA, 19 nt, Human
gggaccagcaggaggggca

SEQ ID NO: 1090257 - RNA, 20 nt, Human
uaaaauggaaacagaaaccc

SEQ ID NO: 1090258 - RNA, 21 nt, Human
uaacgaggccaggcaucuccu

SEQ ID NO: 1090259 - RNA, 18 nt, Human
uagaggccaggaaaccaa

SEQ ID NO: 1090260 - RNA, 18 nt, Human
uagcuccauggcccuuca

SEQ ID NO: 1090261 - RNA, 20 nt, Human
ucacauuccuggccugggag

SEQ ID NO: 1090262 - RNA, 19 nt, Human
ucagacauccagagagcaa

SEQ ID NO: 1090263 - RNA, 24 nt, Human
ucagaggguuggugcgggcgggcg

SEQ ID NO: 1090264 - RNA, 18 nt, Human
uccagagagcaaaagacu

SEQ ID NO: 1090265 - RNA, 20 nt, Human
uccugcucucuuccuguugu

SEQ ID NO: 1090266 - RNA, 22 nt, Human
ucgggcuucaucuucuucaucu

SEQ ID NO: 1090267 - RNA, 18 nt, Human
ucuaaggacuuggcuugc

SEQ ID NO: 1090268 - RNA, 20 nt, Human
ucuccuccggacagaacgga

SEQ ID NO: 1090269 - RNA, 22 nt, Human
ucuccuggggauaagaaauucu

SEQ ID NO: 1090270 - RNA, 19 nt, Human
ucuuccuguuguucccagg

SEQ ID NO: 1090271 - RNA, 23 nt, Human
ugagaagagccacauaagcagca

SEQ ID NO: 1090272 - RNA, 23 nt, Human
ugccuucauccuuacaaacaacc

SEQ ID NO: 1090273 - RNA, 24 nt, Human
ugccuucauccuuacaaacaaccc

SEQ ID NO: 1090274 - RNA, 19 nt, Human
uguccccagcgaacagcag

SEQ ID NO: 1090275 - RNA, 19 nt, Human
uguccugcucucuuccugu

SEQ ID NO: 1090276 - RNA, 24 nt, Human
ugugaagauuccuaccacacacac

SEQ ID NO: 1090277 - RNA, 21 nt, Human
ugugaggcagggacagggcac

SEQ ID NO: 1090278 - RNA, 19 nt, Human
uucauccuuacaaacaacc

SEQ ID NO: 1090279 - RNA, 20 nt, Human
uucccaggcggugaggugga

SEQ ID NO: 1090280 - RNA, 24 nt, Human
uucccaggcggugagguggaggga

SEQ ID NO: 1090281 - RNA, 19 nt, Human
uuucugcugcuguccugcu

SEQ ID NO: 1090282 - RNA, 23 nt, Human
aaaaccccugcccugguccacuu

SEQ ID NO: 1090283 - RNA, 24 nt, Human
aaaaugcugggauuccagguguga

SEQ ID NO: 1090284 - RNA, 23 nt, Human
aaagagcaggcaccagcggugcc

SEQ ID NO: 1090285 - RNA, 18 nt, Human
aacauggucccuagaaaa

SEQ ID NO: 1090286 - RNA, 21 nt, Human
aaccuagcgaaaauuugacua

SEQ ID NO: 1090287 - RNA, 24 nt, Human
aacuaacuucugaaauauaaccua

SEQ ID NO: 1090288 - RNA, 21 nt, Human
aagaggcaaacccaccgaaca

SEQ ID NO: 1090289 - RNA, 22 nt, Human
aagaguggaggugacaguaaga

SEQ ID NO: 1090290 - RNA, 20 nt, Human
aagcaggaaauguaaaaggg

SEQ ID NO: 1090291 - RNA, 24 nt, Human
aaggucuggaccucugugccucag

SEQ ID NO: 1090292 - RNA, 25 nt, Human
aagugauccuccugccucagccucc

SEQ ID NO: 1090293 - RNA, 22 nt, Human
acuaagcugaaauauuuugugu

SEQ ID NO: 1090294 - RNA, 21 nt, Human
agaaaagggaaaauuucacau

SEQ ID NO: 1090295 - RNA, 18 nt, Human
agaagaugggagagcccu

SEQ ID NO: 1090296 - RNA, 25 nt, Human
agagcccuauuuagcacccccaccc

SEQ ID NO: 1090297 - RNA, 18 nt, Human
agcacagaaaacagggcu

SEQ ID NO: 1090298 - RNA, 24 nt, Human
agccagucaaggggcugguagggc

SEQ ID NO: 1090299 - RNA, 20 nt, Human
agcuggcuucaaacccgagc

SEQ ID NO: 1090300 - RNA, 23 nt, Human
aggcaaggucucacuauguugcc

SEQ ID NO: 1090301 - RNA, 22 nt, Human
agggaaaauuucacauggggcu

SEQ ID NO: 1090302 - RNA, 24 nt, Human
aggugacaguaagagcgugggagc

SEQ ID NO: 1090303 - RNA, 19 nt, Human
auaaaauggagguaaggcc

SEQ ID NO: 1090304 - RNA, 20 nt, Human
auaaaugccugagcuacacc

SEQ ID NO: 1090305 - RNA, 19 nt, Human
auggggcuugcuuugucua

SEQ ID NO: 1090306 - RNA, 24 nt, Human
caaaaugcugggauuccaggugug

SEQ ID NO: 1090307 - RNA, 25 nt, Human
caaacuccuggguucaagugauccu

SEQ ID NO: 1090308 - RNA, 26 nt, Human
caaaugaccacacucaggaauauggc

SEQ ID NO: 1090309 - RNA, 23 nt, Human
caagagcaagaggcaaacccacc

SEQ ID NO: 1090310 - RNA, 20 nt, Human
caagaggcaaacccaccgaa

SEQ ID NO: 1090311 - RNA, 18 nt, Human
caagcuguacuuuaaaau

SEQ ID NO: 1090312 - RNA, 24 nt, Human
caagggcgucgguccugccaaggu

SEQ ID NO: 1090313 - RNA, 22 nt, Human
caagugauccuccugccucagc

SEQ ID NO: 1090314 - RNA, 27 nt, Human
caagugauccuccugccucagccuccc

SEQ ID NO: 1090315 - RNA, 20 nt, Human
cacagcucggucacagucau

SEQ ID NO: 1090316 - RNA, 22 nt, Human
cacccaguccucgaucacagcu

SEQ ID NO: 1090317 - RNA, 18 nt, Human
cacccucucccuuucucc

SEQ ID NO: 1090318 - RNA, 25 nt, Human
caccuggagccgcucauccaagggc

SEQ ID NO: 1090319 - RNA, 24 nt, Human
cacuauguugcccaugcuggucuc

SEQ ID NO: 1090320 - RNA, 18 nt, Human
cagcauuaguggggcugu

SEQ ID NO: 1090321 - RNA, 21 nt, Human
cagcggugccgcugcucccga

SEQ ID NO: 1090322 - RNA, 21 nt, Human
cagcugggcguugauguacau

SEQ ID NO: 1090323 - RNA, 20 nt, Human
caggugugagccacugcacc

SEQ ID NO: 1090324 - RNA, 21 nt, Human
caugcuggucucaaacuccug

SEQ ID NO: 1090325 - RNA, 21 nt, Human
ccaaaaugcugggauuccagg

SEQ ID NO: 1090326 - RNA, 24 nt, Human
ccaaaaugcugggauuccaggugu

SEQ ID NO: 1090327 - RNA, 18 nt, Human
ccacugcaccuggccugu

SEQ ID NO: 1090328 - RNA, 22 nt, Human
ccagaagucucuugccaucuag

SEQ ID NO: 1090329 - RNA, 23 nt, Human
ccagcggugccgcugcucccgag

SEQ ID NO: 1090330 - RNA, 23 nt, Human
cccaugcuggucucaaacuccug

SEQ ID NO: 1090331 - RNA, 19 nt, Human
cccccacccucucccuuuc

SEQ ID NO: 1090332 - RNA, 22 nt, Human
ccuggguucaagugauccuccu

SEQ ID NO: 1090333 - RNA, 23 nt, Human
ccuggguucaagugauccuccug

SEQ ID NO: 1090334 - RNA, 18 nt, Human
ccuugagggaaggaaaag

SEQ ID NO: 1090335 - RNA, 20 nt, Human
ccuugagggaaggaaaagaa

SEQ ID NO: 1090336 - RNA, 21 nt, Human
cgugggagcacacaccuggga

SEQ ID NO: 1090337 - RNA, 21 nt, Human
cucaaaaccccugcccugguc

SEQ ID NO: 1090338 - RNA, 18 nt, Human
cucaggaauauggccaca

SEQ ID NO: 1090339 - RNA, 24 nt, Human
cucuugcugacacaaaggccccau

SEQ ID NO: 1090340 - RNA, 22 nt, Human
cugacacaaaggccccauuuac

SEQ ID NO: 1090341 - RNA, 23 nt, Human
cugccucagccucccaaaaugcu

SEQ ID NO: 1090342 - RNA, 24 nt, Human
cugccucagccucccaaaaugcug

SEQ ID NO: 1090343 - RNA, 18 nt, Human
cuggaccucugugccuca

SEQ ID NO: 1090344 - RNA, 24 nt, Human
cuggaccucugugccucaguuucc

SEQ ID NO: 1090345 - RNA, 21 nt, Human
cuugcugacacaaaggcccca

SEQ ID NO: 1090346 - RNA, 22 nt, Human
cuuggagcccuauuuuccaucc

SEQ ID NO: 1090347 - RNA, 18 nt, Human
gaagaugggagagcccua

SEQ ID NO: 1090348 - RNA, 24 nt, Human
gagccacugcaccuggccuguguu

SEQ ID NO: 1090349 - RNA, 18 nt, Human
gauuccaggugugagcca

SEQ ID NO: 1090350 - RNA, 22 nt, Human
gauuccaggugugagccacugc

SEQ ID NO: 1090351 - RNA, 23 nt, Human
gauuccaggugugagccacugca

SEQ ID NO: 1090352 - RNA, 21 nt, Human
gcucagggaccaggguaguca

SEQ ID NO: 1090353 - RNA, 23 nt, Human
ggaugcucucaaaaccccugccc

SEQ ID NO: 1090354 - RNA, 21 nt, Human
ggcaaggucucacuauguugc

SEQ ID NO: 1090355 - RNA, 24 nt, Human
gggagcacacaccugggacucgaa

SEQ ID NO: 1090356 - RNA, 23 nt, Human
ggggcuggaauaaaugccugagc

SEQ ID NO: 1090357 - RNA, 22 nt, Human
ggucacagucauaguccagcca

SEQ ID NO: 1090358 - RNA, 23 nt, Human
guaaaauucuuuccaaguuccaa

SEQ ID NO: 1090359 - RNA, 24 nt, Human
guaaaauucuuuccaaguuccaaa

SEQ ID NO: 1090360 - RNA, 19 nt, Human
gucagaucaagagacgagc

SEQ ID NO: 1090361 - RNA, 24 nt, Human
gugauccuccugccucagccuccc

SEQ ID NO: 1090362 - RNA, 18 nt, Human
uaaaauggagguaaggcc

SEQ ID NO: 1090363 - RNA, 22 nt, Human
uaaaauggagguaaggccagaa

SEQ ID NO: 1090364 - RNA, 18 nt, Human
uaacauggucccuagaaa

SEQ ID NO: 1090365 - RNA, 27 nt, Human
uaacucaggcccauuuuauuaagcagg

SEQ ID NO: 1090366 - RNA, 22 nt, Human
uaagacgaauuacugauacuua

SEQ ID NO: 1090367 - RNA, 22 nt, Human
uagaggcaaggucucacuaugu

SEQ ID NO: 1090368 - RNA, 30 nt, Human
uagcacccccacccucucccuuucuccagg

SEQ ID NO: 1090369 - RNA, 20 nt, Human
uaucuaaacccacacugauc

SEQ ID NO: 1090370 - RNA, 24 nt, Human
uauguugcccaugcuggucucaaa

SEQ ID NO: 1090371 - RNA, 19 nt, Human
ucaagugauccuccugccu

SEQ ID NO: 1090372 - RNA, 23 nt, Human
ucccaaaaugcugggauuccagg

SEQ ID NO: 1090373 - RNA, 18 nt, Human
ucccuagaaaagggaaaa

SEQ ID NO: 1090374 - RNA, 24 nt, Human
ucccucacccacuaagaguggagg

SEQ ID NO: 1090375 - RNA, 27 nt, Human
uccuccugccucagccucccaaaaugc

SEQ ID NO: 1090376 - RNA, 21 nt, Human
uccuggguucaagugauccuc

SEQ ID NO: 1090377 - RNA, 24 nt, Human
uccuggguucaagugauccuccug

SEQ ID NO: 1090378 - RNA, 21 nt, Human
uccuugagggaaggaaaagaa

SEQ ID NO: 1090379 - RNA, 19 nt, Human
ucgaggacagccacacagg

SEQ ID NO: 1090380 - RNA, 23 nt, Human
ucuagagaaacacuuggagaaga

SEQ ID NO: 1090381 - RNA, 21 nt, Human
ucucaaacuccuggguucaag

SEQ ID NO: 1090382 - RNA, 23 nt, Human
ucucacuauguugcccaugcugg

SEQ ID NO: 1090383 - RNA, 24 nt, Human
ucucacuauguugcccaugcuggu

SEQ ID NO: 1090384 - RNA, 18 nt, Human
ucuccagagcucuuugcc

SEQ ID NO: 1090385 - RNA, 24 nt, Human
ucuuaccuugaaacugaggcuuca

SEQ ID NO: 1090386 - RNA, 23 nt, Human
ugacagagaggacauccaggaaa

SEQ ID NO: 1090387 - RNA, 22 nt, Human
ugagugauguggccacagagcu

SEQ ID NO: 1090388 - RNA, 20 nt, Human
ugauguggccacagagcugg

SEQ ID NO: 1090389 - RNA, 21 nt, Human
ugauguggccacagagcuggg

SEQ ID NO: 1090390 - RNA, 19 nt, Human
ugcaaagugauuugccaca

SEQ ID NO: 1090391 - RNA, 27 nt, Human
ugcaaagugauuugccacaagguuuuu

SEQ ID NO: 1090392 - RNA, 19 nt, Human
ugccaaggucuggaccucu

SEQ ID NO: 1090393 - RNA, 19 nt, Human
ugccaaggucuggaccucu

SEQ ID NO: 1090394 - RNA, 22 nt, Human
ugccaaggucuggaccucugug

SEQ ID NO: 1090395 - RNA, 23 nt, Human
ugccaaggucuggaccucugugc

SEQ ID NO: 1090396 - RNA, 20 nt, Human
ugcccuggcaauggggcugg

SEQ ID NO: 1090397 - RNA, 24 nt, Human
ugccucagccucccaaaaugcugg

SEQ ID NO: 1090398 - RNA, 18 nt, Human
ugcucucaaaaccccugc

SEQ ID NO: 1090399 - RNA, 19 nt, Human
uggaaggggaauguuccca

SEQ ID NO: 1090400 - RNA, 18 nt, Human
uggaccucugugccucag

SEQ ID NO: 1090401 - RNA, 20 nt, Human
ugggagagcccuauuuagca

SEQ ID NO: 1090402 - RNA, 22 nt, Human
ugggagagcccuauuuagcacc

SEQ ID NO: 1090403 - RNA, 18 nt, Human
ugggauuccaggugugag

SEQ ID NO: 1090404 - RNA, 22 nt, Human
ugggauuccaggugugagccac

SEQ ID NO: 1090405 - RNA, 24 nt, Human
ugggauuccaggugugagccacug

SEQ ID NO: 1090406 - RNA, 23 nt, Human
uggggccccagaagucucuugcc

SEQ ID NO: 1090407 - RNA, 19 nt, Human
uggguucaagugauccucc

SEQ ID NO: 1090408 - RNA, 20 nt, Human
uggguucaagugauccuccu

SEQ ID NO: 1090409 - RNA, 23 nt, Human
uggguucaagugauccuccugcc

SEQ ID NO: 1090410 - RNA, 24 nt, Human
ugguaugaaaaaagaauguaaaau

SEQ ID NO: 1090411 - RNA, 18 nt, Human
uuaccuugaaacugaggc

SEQ ID NO: 1090412 - RNA, 18 nt, Human
uucaagugauccuccugc

SEQ ID NO: 1090413 - RNA, 21 nt, Human
uucaagugauccuccugccuc

SEQ ID NO: 1090414 - RNA, 23 nt, Human
uucaagugauccuccugccucag

SEQ ID NO: 1090415 - RNA, 24 nt, Human
uucaagugauccuccugccucagc

SEQ ID NO: 1090416 - RNA, 23 nt, Human
uucaucagaguauucuuccuuga

SEQ ID NO: 1090417 - RNA, 19 nt, Human
uuccugggacuccugcagu

SEQ ID NO: 1090418 - RNA, 23 nt, Human
uucuagauggaugaacaguuuac

SEQ ID NO: 1090419 - RNA, 23 nt, Human
uugagggaaggaaaagaauuuac

SEQ ID NO: 1090420 - RNA, 22 nt, Human
ccccggagggccccuuccugcc

SEQ ID NO: 1090421 - RNA, 25 nt, Human
gaggccacagccaacacaggguuuc

SEQ ID NO: 1090422 - RNA, 20 nt, Human
gcaucggucuccuggcugca

SEQ ID NO: 1090423 - RNA, 22 nt, Human
uaugaggaaaagaaauggcauc

SEQ ID NO: 1090424 - RNA, 20 nt, Human
ucagcccccggagggccccu

SEQ ID NO: 1090425 - RNA, 23 nt, Human
ucuccuggcugcauacagcagcc

SEQ ID NO: 1090426 - RNA, 18 nt, Human
ugcauacagcagccacgu

SEQ ID NO: 1090427 - RNA, 20 nt, Human
ugcauacagcagccacguag

SEQ ID NO: 1090428 - RNA, 21 nt, Human
aaaggaucuggaguccauggg

SEQ ID NO: 1090429 - RNA, 25 nt, Human
acagcagagaacccacaagcuugaa

SEQ ID NO: 1090430 - RNA, 18 nt, Human
acccagaagaguugacuu

SEQ ID NO: 1090431 - RNA, 20 nt, Human
acccagaguccucuagucuu

SEQ ID NO: 1090432 - RNA, 19 nt, Human
acgccucccgccccauggg

SEQ ID NO: 1090433 - RNA, 19 nt, Human
agacagcagagaacccaca

SEQ ID NO: 1090434 - RNA, 19 nt, Human
agagaacccacaagcuuga

SEQ ID NO: 1090435 - RNA, 19 nt, Human
aguccauuccuuuuagcag

SEQ ID NO: 1090436 - RNA, 25 nt, Human
caaaaggccacacaaggaagaauca

SEQ ID NO: 1090437 - RNA, 21 nt, Human
caagacagcagagaacccaca

SEQ ID NO: 1090438 - RNA, 20 nt, Human
caccccccgagccccggaca

SEQ ID NO: 1090439 - RNA, 22 nt, Human
cacuggccauauuuacuaaagu

SEQ ID NO: 1090440 - RNA, 19 nt, Human
cagaguccucuagucuugg

SEQ ID NO: 1090441 - RNA, 27 nt, Human
caggaccaagucuuugcaaaaccuauc

SEQ ID NO: 1090442 - RNA, 20 nt, Human
ccagaggucagaacauagua

SEQ ID NO: 1090443 - RNA, 20 nt, Human
ccccaccccccgagccccgg

SEQ ID NO: 1090444 - RNA, 20 nt, Human
ccccaugggccgccgccggg

SEQ ID NO: 1090445 - RNA, 20 nt, Human
ccccaugggccgccgccggg

SEQ ID NO: 1090446 - RNA, 24 nt, Human
ccccaugggccgccgccggggccc

SEQ ID NO: 1090447 - RNA, 22 nt, Human
ccccccaccccccgagccccgg

SEQ ID NO: 1090448 - RNA, 24 nt, Human
ccccccgagccccggacaggcagc

SEQ ID NO: 1090449 - RNA, 19 nt, Human
cccccgagccccggacagg

SEQ ID NO: 1090450 - RNA, 24 nt, Human
ccccgagccccggacaggcagcgg

SEQ ID NO: 1090451 - RNA, 18 nt, Human
ccccgccccgcucccccc

SEQ ID NO: 1090452 - RNA, 21 nt, Human
ccccgccccgcuccccccacc

SEQ ID NO: 1090453 - RNA, 25 nt, Human
ccccgccccgcuccccccacccccc

SEQ ID NO: 1090454 - RNA, 22 nt, Human
ccccgcuccccccaccccccga

SEQ ID NO: 1090455 - RNA, 26 nt, Human
ccgccccgcuccccccaccccccgag

SEQ ID NO: 1090456 - RNA, 22 nt, Human
ccgccgccggggcccggagucc

SEQ ID NO: 1090457 - RNA, 23 nt, Human
ccuaaaaauaguuuucagcagau

SEQ ID NO: 1090458 - RNA, 20 nt, Human
cgccccgcuccccccacccc

SEQ ID NO: 1090459 - RNA, 23 nt, Human
cgccccgcuccccccaccccccg

SEQ ID NO: 1090460 - RNA, 19 nt, Human
cggccagaaagagacaucc

SEQ ID NO: 1090461 - RNA, 30 nt, Human
cuaaaaugagaucaaauccucgaguccauu

SEQ ID NO: 1090462 - RNA, 20 nt, Human
cuaaagugcuguaaaauggc

SEQ ID NO: 1090463 - RNA, 23 nt, Human
cuccaugguuuguacacagaacu

SEQ ID NO: 1090464 - RNA, 21 nt, Human
cuccccccaccccccgagccc

SEQ ID NO: 1090465 - RNA, 21 nt, Human
cuccccgccccgcucccccca

SEQ ID NO: 1090466 - RNA, 20 nt, Human
ggaaauucuuuauuuuuguu

SEQ ID NO: 1090467 - RNA, 21 nt, Human
guccugguccucucuguacag

SEQ ID NO: 1090468 - RNA, 19 nt, Human
uaaagugcuguaaaauggc

SEQ ID NO: 1090469 - RNA, 21 nt, Human
uacugaaauguuugcuuuuaa

SEQ ID NO: 1090470 - RNA, 21 nt, Human
uaucaaauggauggauggcuu

SEQ ID NO: 1090471 - RNA, 18 nt, Human
uccaugguuuguacacag

SEQ ID NO: 1090472 - RNA, 21 nt, Human
uccauuccuuuuagcagaaau

SEQ ID NO: 1090473 - RNA, 21 nt, Human
uccccccaccccccgagcccc

SEQ ID NO: 1090474 - RNA, 25 nt, Human
uccccccaccccccgagccccggac

SEQ ID NO: 1090475 - RNA, 21 nt, Human
uccccgccccgcuccccccac

SEQ ID NO: 1090476 - RNA, 23 nt, Human
ugagaaagagugccagaggucag

SEQ ID NO: 1090477 - RNA, 24 nt, Human
ugagaucaaauccucgaguccauu

SEQ ID NO: 1090478 - RNA, 25 nt, Human
ugagaugauggucaguuuauccauc

SEQ ID NO: 1090479 - RNA, 22 nt, Human
uggguaacugugacccagaaga

SEQ ID NO: 1090480 - RNA, 18 nt, Human
uguuugcuuuuaauaaau

SEQ ID NO: 1090481 - RNA, 21 nt, Human
uucaagacagcagagaaccca

SEQ ID NO: 1090482 - RNA, 25 nt, Human
uucuuuauuuuuguugcuggguaac

SEQ ID NO: 1090483 - RNA, 20 nt, Human
uuggcgaugcuggcgauggc

SEQ ID NO: 1090484 - RNA, 23 nt, Human
uuuaagaaaauacuugaauugcc

SEQ ID NO: 1090485 - RNA, 21 nt, Human
aaagaaugagguaaacugaag

SEQ ID NO: 1090486 - RNA, 20 nt, Human
aaauguccauagaacauguc

SEQ ID NO: 1090487 - RNA, 18 nt, Human
aacugcaaucccaaaugu

SEQ ID NO: 1090488 - RNA, 18 nt, Human
aagaacuuaaagcugugg

SEQ ID NO: 1090489 - RNA, 21 nt, Human
aagacucucuccacuaugcag

SEQ ID NO: 1090490 - RNA, 25 nt, Human
aauagccagauauuuacuagcgaac

SEQ ID NO: 1090491 - RNA, 23 nt, Human
acacacacacacacacauauaua

SEQ ID NO: 1090492 - RNA, 23 nt, Human
acacacacauacacacacacaca

SEQ ID NO: 1090493 - RNA, 24 nt, Human
acacacauacacacacacacacag

SEQ ID NO: 1090494 - RNA, 22 nt, Human
accaccauaagugaaagaagua

SEQ ID NO: 1090495 - RNA, 18 nt, Human
accuagaaagguauggga

SEQ ID NO: 1090496 - RNA, 20 nt, Human
accuccaagacaacaaugaa

SEQ ID NO: 1090497 - RNA, 20 nt, Human
agcuccacugccaugaaaca

SEQ ID NO: 1090498 - RNA, 18 nt, Human
aggaccaaucaaaucaga

SEQ ID NO: 1090499 - RNA, 25 nt, Human
aguaaacaguggggaaauucuuagc

SEQ ID NO: 1090500 - RNA, 23 nt, Human
auagccagauauuuacuagcgaa

SEQ ID NO: 1090501 - RNA, 33 nt, Human
auauaaauuuacacacacauacacacacacagu

SEQ ID NO: 1090502 - RNA, 22 nt, Human
caaaaaccuguuaaaaucaagg

SEQ ID NO: 1090503 - RNA, 21 nt, Human
caaacaaaggcauauaacaua

SEQ ID NO: 1090504 - RNA, 21 nt, Human
caaugucuggucugcaagagg

SEQ ID NO: 1090505 - RNA, 20 nt, Human
cacacacacacacacacaca

SEQ ID NO: 1090506 - RNA, 22 nt, Human
cacacacacacacacacacaua

SEQ ID NO: 1090507 - RNA, 26 nt, Human
cacacacacacacacacacauauaua

SEQ ID NO: 1090508 - RNA, 20 nt, Human
cacacacacacacacacaua

SEQ ID NO: 1090509 - RNA, 22 nt, Human
cacacacacacacacacauaua

SEQ ID NO: 1090510 - RNA, 19 nt, Human
cacacacacacacacauau

SEQ ID NO: 1090511 - RNA, 23 nt, Human
cacacacacacacacauauauac

SEQ ID NO: 1090512 - RNA, 23 nt, Human
cacacacacacauauauacacac

SEQ ID NO: 1090513 - RNA, 28 nt, Human
cacacacauacacacacacacacacaca

SEQ ID NO: 1090514 - RNA, 22 nt, Human
cacacauacacacacacacaca

SEQ ID NO: 1090515 - RNA, 26 nt, Human
cacauacacacacacacacacacaca

SEQ ID NO: 1090516 - RNA, 24 nt, Human
cacauuucaaacaggagauuaucu

SEQ ID NO: 1090517 - RNA, 22 nt, Human
caccacaguguuuugcuagcaa

SEQ ID NO: 1090518 - RNA, 23 nt, Human
caccaggaaaaacaagcauugau

SEQ ID NO: 1090519 - RNA, 24 nt, Human
caccaggaaaaacaagcauugaug

SEQ ID NO: 1090520 - RNA, 25 nt, Human
caccaggaaaaacaagcauugaugc

SEQ ID NO: 1090521 - RNA, 19 nt, Human
caccuagaaagguauggga

SEQ ID NO: 1090522 - RNA, 24 nt, Human
cacuguauacugcaucagcaaaau

SEQ ID NO: 1090523 - RNA, 19 nt, Human
cagaauagcaacugcaauc

SEQ ID NO: 1090524 - RNA, 21 nt, Human
cagaauagcaacugcaauccc

SEQ ID NO: 1090525 - RNA, 21 nt, Human
cagccuucagauaaauggcuu

SEQ ID NO: 1090526 - RNA, 23 nt, Human
caguagaaaaagaaucucuguac

SEQ ID NO: 1090527 - RNA, 24 nt, Human
caguagaaaaagaaucucuguaca

SEQ ID NO: 1090528 - RNA, 26 nt, Human
cauacacacacacacacacacacaua

SEQ ID NO: 1090529 - RNA, 20 nt, Human
ccaaagcuuuccuucaaagg

SEQ ID NO: 1090530 - RNA, 27 nt, Human
ccaaucaaaucagaauagcaacugcaa

SEQ ID NO: 1090531 - RNA, 21 nt, Human
ccacugccaugaaacacccug

SEQ ID NO: 1090532 - RNA, 21 nt, Human
cgaaggcauggagauguggag

SEQ ID NO: 1090533 - RNA, 21 nt, Human
cugcuugugugaagcaugggc

SEQ ID NO: 1090534 - RNA, 19 nt, Human
cuguaccuauuacaaaaac

SEQ ID NO: 1090535 - RNA, 22 nt, Human
cuguaccuauuacaaaaaccug

SEQ ID NO: 1090536 - RNA, 19 nt, Human
cuuaaagcuguggguuuag

SEQ ID NO: 1090537 - RNA, 24 nt, Human
cuucaaagugauccauuugacuga

SEQ ID NO: 1090538 - RNA, 24 nt, Human
gaaaaagaaucucuguacaacaga

SEQ ID NO: 1090539 - RNA, 20 nt, Human
gaagaacuuaaagcuguggg

SEQ ID NO: 1090540 - RNA, 21 nt, Human
gaagaacuuaaagcugugggu

SEQ ID NO: 1090541 - RNA, 23 nt, Human
ggaaaaacaagcauugaugcgaa

SEQ ID NO: 1090542 - RNA, 23 nt, Human
ggcauggagauguggagaagaga

SEQ ID NO: 1090543 - RNA, 18 nt, Human
gucugcaagaguacgaag

SEQ ID NO: 1090544 - RNA, 21 nt, Human
uaaauagccaaaauagccaga

SEQ ID NO: 1090545 - RNA, 22 nt, Human
uaaaugcaauaccaccauaagu

SEQ ID NO: 1090546 - RNA, 19 nt, Human
uaauuuuuagcuuaacuua

SEQ ID NO: 1090547 - RNA, 20 nt, Human
uacacacacacacacacaca

SEQ ID NO: 1090548 - RNA, 26 nt, Human
uacacacacacacacacacacauaua

SEQ ID NO: 1090549 - RNA, 22 nt, Human
uacacacacauacacacacaca

SEQ ID NO: 1090550 - RNA, 19 nt, Human
uaccaccauaagugaaaga

SEQ ID NO: 1090551 - RNA, 24 nt, Human
uacuguauuuuaaaacugugaguu

SEQ ID NO: 1090552 - RNA, 19 nt, Human
uagauacaaauaaaaccuu

SEQ ID NO: 1090553 - RNA, 19 nt, Human
uagccaaaauagccagaua

SEQ ID NO: 1090554 - RNA, 22 nt, Human
uagcuuaacuuaaaaucgcacc

SEQ ID NO: 1090555 - RNA, 28 nt, Human
uauaacggugacaaccaaagcuuuccuu

SEQ ID NO: 1090556 - RNA, 20 nt, Human
uauaguguucaccaggaaaa

SEQ ID NO: 1090557 - RNA, 21 nt, Human
uauauaacggugacaaccaaa

SEQ ID NO: 1090558 - RNA, 21 nt, Human
uauuacaaaaaccuguuaaaa

SEQ ID NO: 1090559 - RNA, 18 nt, Human
ucagauuccccaaauuau

SEQ ID NO: 1090560 - RNA, 23 nt, Human
ucaugucauaaguuaauuugaac

SEQ ID NO: 1090561 - RNA, 25 nt, Human
uccaagacaacaaugaaauuaaaga

SEQ ID NO: 1090562 - RNA, 19 nt, Human
ucccaaauguccauagaac

SEQ ID NO: 1090563 - RNA, 20 nt, Human
ucccaaauguccauagaaca

SEQ ID NO: 1090564 - RNA, 24 nt, Human
ucucuguacaacagacaacaguug

SEQ ID NO: 1090565 - RNA, 21 nt, Human
ugaaacacccugucccacauu

SEQ ID NO: 1090566 - RNA, 18 nt, Human
ugaaagaaguaaacagug

SEQ ID NO: 1090567 - RNA, 22 nt, Human
ugacuucacauacuauccccca

SEQ ID NO: 1090568 - RNA, 21 nt, Human
ugcaauaccaccauaagugaa

SEQ ID NO: 1090569 - RNA, 18 nt, Human
ugcauguguguguauaua

SEQ ID NO: 1090570 - RNA, 22 nt, Human
ugcguucauuucugcuugugug

SEQ ID NO: 1090571 - RNA, 31 nt, Human
uguguguguauauaaauuuacacacacauaa

SEQ ID NO: 1090572 - RNA, 22 nt, Human
uguuugcauguguguguauaua

SEQ ID NO: 1090573 - RNA, 22 nt, Human
uuugaaccauacuuugcuaaca

SEQ ID NO: 1090574 - RNA, 19 nt, Human
uuugcauguguguguauau

SEQ ID NO: 1090575 - RNA, 20 nt, Human
agcaguucaaggaaauggug

SEQ ID NO: 1090576 - RNA, 20 nt, Human
aggaagccagcuuucucagg

SEQ ID NO: 1090577 - RNA, 18 nt, Human
aucucuuuucucccugag

SEQ ID NO: 1090578 - RNA, 21 nt, Human
cacugagcccacgucauuccc

SEQ ID NO: 1090579 - RNA, 21 nt, Human
cagcaaugcuugcaagaugga

SEQ ID NO: 1090580 - RNA, 22 nt, Human
cagcaggcugugaauuuuggag

SEQ ID NO: 1090581 - RNA, 23 nt, Human
caucucuuuucucccugaguuuu

SEQ ID NO: 1090582 - RNA, 20 nt, Human
cauggaaacugaaagcuuuc

SEQ ID NO: 1090583 - RNA, 20 nt, Human
ccagcuucaauuuuuugagc

SEQ ID NO: 1090584 - RNA, 23 nt, Human
ccuucucaagccccuuccuugag

SEQ ID NO: 1090585 - RNA, 18 nt, Human
cucaugacacgcugcauc

SEQ ID NO: 1090586 - RNA, 23 nt, Human
cugaaagcucucugcaaagcuga

SEQ ID NO: 1090587 - RNA, 20 nt, Human
cuggaaaucuccagcuucaa

SEQ ID NO: 1090588 - RNA, 22 nt, Human
gagcccauauuuugccacccac

SEQ ID NO: 1090589 - RNA, 22 nt, Human
gaggugcugcccugagcuugca

SEQ ID NO: 1090590 - RNA, 22 nt, Human
gcccugagcuugcagguggguc

SEQ ID NO: 1090591 - RNA, 22 nt, Human
ggacaaggcugcagcuuguguc

SEQ ID NO: 1090592 - RNA, 22 nt, Human
ggagaguguguccucacccaca

SEQ ID NO: 1090593 - RNA, 22 nt, Human
gguacuucuuguacacugagcc

SEQ ID NO: 1090594 - RNA, 29 nt, Human
gucagcaggcugugaauuuuggagagugg

SEQ ID NO: 1090595 - RNA, 21 nt, Human
guccuucucaagccccuuccu

SEQ ID NO: 1090596 - RNA, 19 nt, Human
uaagucaauagaagagcua

SEQ ID NO: 1090597 - RNA, 20 nt, Human
uacacugagcccacgucauu

SEQ ID NO: 1090598 - RNA, 24 nt, Human
uagaagagcuaguccuucucaagc

SEQ ID NO: 1090599 - RNA, 24 nt, Human
ucaauagaagagcuaguccuucuc

SEQ ID NO: 1090600 - RNA, 23 nt, Human
ucccugaguuuuuggacuucauu

SEQ ID NO: 1090601 - RNA, 19 nt, Human
ucucaggaacucaaccgcc

SEQ ID NO: 1090602 - RNA, 24 nt, Human
ucuccaccagcguguccugccaug

SEQ ID NO: 1090603 - RNA, 21 nt, Human
ugaaagcucucugcaaagcug

SEQ ID NO: 1090604 - RNA, 19 nt, Human
ugaugaagccuuuggucag

SEQ ID NO: 1090605 - RNA, 24 nt, Human
uggaggugcugcccugagcuugca

SEQ ID NO: 1090606 - RNA, 23 nt, Human
uggcuuuccgucggucaggaggu

SEQ ID NO: 1090607 - RNA, 20 nt, Human
uguccugccaugacugaaag

SEQ ID NO: 1090608 - RNA, 22 nt, Human
aacacuguaauuuucuuaauug

SEQ ID NO: 1090609 - RNA, 19 nt, Human
cauaaaaugagguagccaa

SEQ ID NO: 1090610 - RNA, 20 nt, Human
ccugacucuaggcccaaaac

SEQ ID NO: 1090611 - RNA, 25 nt, Human
gaccaccuuaaaguucucagcuuga

SEQ ID NO: 1090612 - RNA, 18 nt, Human
gcacugaacugcuuuaac

SEQ ID NO: 1090613 - RNA, 26 nt, Human
ggcccaaaacuuucuuuucuuagagc

SEQ ID NO: 1090614 - RNA, 21 nt, Human
uaaaaagagaggaaguucaac

SEQ ID NO: 1090615 - RNA, 22 nt, Human
uaaaaugagguagccaagacca

SEQ ID NO: 1090616 - RNA, 24 nt, Human
uaaaguucucagcuugacuugaaa

SEQ ID NO: 1090617 - RNA, 28 nt, Human
ucacuaaaucgauuuaguaauucuguau

SEQ ID NO: 1090618 - RNA, 25 nt, Human
ugagguagccaagaccaccuuaaag

SEQ ID NO: 1090619 - RNA, 20 nt, Human
aagcagacgagcaauacagc

SEQ ID NO: 1090620 - RNA, 21 nt, Human
aagucagucccacgaugauga

SEQ ID NO: 1090621 - RNA, 19 nt, Human
aaugacaacuuuauaacuu

SEQ ID NO: 1090622 - RNA, 21 nt, Human
acagaacuucuuaacaaugga

SEQ ID NO: 1090623 - RNA, 21 nt, Human
agaacuggcaaagacugugaa

SEQ ID NO: 1090624 - RNA, 20 nt, Human
aggaacuguggggucaggac

SEQ ID NO: 1090625 - RNA, 23 nt, Human
auggauuucugagguucccuugg

SEQ ID NO: 1090626 - RNA, 18 nt, Human
caugaugagugccaaccu

SEQ ID NO: 1090627 - RNA, 23 nt, Human
ccaaacaaacagaacuucuuaac

SEQ ID NO: 1090628 - RNA, 22 nt, Human
ccaaagguaaacuauccagagg

SEQ ID NO: 1090629 - RNA, 18 nt, Human
ccaccaaagucaguccca

SEQ ID NO: 1090630 - RNA, 22 nt, Human
cuggcccuggucaugggacagg

SEQ ID NO: 1090631 - RNA, 25 nt, Human
cuucuuaacaauggaacuucaaugg

SEQ ID NO: 1090632 - RNA, 22 nt, Human
gaugauggucagccagaguauu

SEQ ID NO: 1090633 - RNA, 24 nt, Human
uaaaguagaaagucucagaggucc

SEQ ID NO: 1090634 - RNA, 19 nt, Human
uaacuugucggaaaugcaa

SEQ ID NO: 1090635 - RNA, 20 nt, Human
uaaugacaacuuuauaacuu

SEQ ID NO: 1090636 - RNA, 20 nt, Human
uagaacuggcaaagacugug

SEQ ID NO: 1090637 - RNA, 18 nt, Human
uauagacugccacuucug

SEQ ID NO: 1090638 - RNA, 25 nt, Human
uccaccaaagucagucccacgauga

SEQ ID NO: 1090639 - RNA, 23 nt, Human
ucuucugugugaaacaggaacug

SEQ ID NO: 1090640 - RNA, 23 nt, Human
ugaaacuguuaaaguagaaaguc

SEQ ID NO: 1090641 - RNA, 18 nt, Human
ugauggucagccagagua

SEQ ID NO: 1090642 - RNA, 22 nt, Human
uggaauaagacaguccucuguu

SEQ ID NO: 1090643 - RNA, 22 nt, Human
ugggacaggaacugugggguca

SEQ ID NO: 1090644 - RNA, 19 nt, Human
uuacaaguauaccucuaca

SEQ ID NO: 1090645 - RNA, 21 nt, Human
uucuccaacaacugauucugg

SEQ ID NO: 1090646 - RNA, 28 nt, Human
uuuucaguuauagacugccacuucugau

SEQ ID NO: 1090647 - RNA, 22 nt, Human
uuuucuccaacaacugauucug

SEQ ID NO: 1090648 - RNA, 18 nt, Human
aaaugaccuuuuagaagg

SEQ ID NO: 1090649 - RNA, 24 nt, Human
aaggaaaaucaucuugauuccaaa

SEQ ID NO: 1090650 - RNA, 27 nt, Human
aaucaucuugauuccaaaaaaggaucc

SEQ ID NO: 1090651 - RNA, 21 nt, Human
accuaaaugugacagcaaaaa

SEQ ID NO: 1090652 - RNA, 21 nt, Human
agacaguugucucuggaaaca

SEQ ID NO: 1090653 - RNA, 18 nt, Human
aggaaggggauaugaaga

SEQ ID NO: 1090654 - RNA, 20 nt, Human
aggaaggggauaugaagaac

SEQ ID NO: 1090655 - RNA, 20 nt, Human
auagaucuuccugaaugucu

SEQ ID NO: 1090656 - RNA, 27 nt, Human
auaugcaugccggagaaagcauaugca

SEQ ID NO: 1090657 - RNA, 22 nt, Human
caaaauagcuguggguguaggc

SEQ ID NO: 1090658 - RNA, 23 nt, Human
caacccacacagucuggaaagga

SEQ ID NO: 1090659 - RNA, 24 nt, Human
caagaagcacagagguggccaggc

SEQ ID NO: 1090660 - RNA, 20 nt, Human
cacuucagcaaaggcuaagg

SEQ ID NO: 1090661 - RNA, 22 nt, Human
caguggaaacugugaacccaaa

SEQ ID NO: 1090662 - RNA, 21 nt, Human
ccacacagucuggaaaggaua

SEQ ID NO: 1090663 - RNA, 27 nt, Human
ccagcaccugaacucuauccuauagcu

SEQ ID NO: 1090664 - RNA, 24 nt, Human
cuggcuggggcacuucagcucucc

SEQ ID NO: 1090665 - RNA, 22 nt, Human
cuggggcacuucagcucuccuc

SEQ ID NO: 1090666 - RNA, 19 nt, Human
gaggcaaaaccaauugaga

SEQ ID NO: 1090667 - RNA, 19 nt, Human
gaucuuccugaaugucuca

SEQ ID NO: 1090668 - RNA, 18 nt, Human
gcauaugcaugcaagaaa

SEQ ID NO: 1090669 - RNA, 18 nt, Human
gcuaaguggggaacgugu

SEQ ID NO: 1090670 - RNA, 25 nt, Human
ggggaccuggcauuagacaguuguc

SEQ ID NO: 1090671 - RNA, 25 nt, Human
uacacagugucuuaaaaaggaccag

SEQ ID NO: 1090672 - RNA, 24 nt, Human
uagaaagcauaugcaugccggaga

SEQ ID NO: 1090673 - RNA, 22 nt, Human
uauaaugaauacacaaaacuca

SEQ ID NO: 1090674 - RNA, 26 nt, Human
uaugucuacccugcccauuacuguaa

SEQ ID NO: 1090675 - RNA, 20 nt, Human
ucagcucuccuccacguggu

SEQ ID NO: 1090676 - RNA, 25 nt, Human
ucagcucuccuccacguggucucuc

SEQ ID NO: 1090677 - RNA, 20 nt, Human
ucccuccaugacugacacuc

SEQ ID NO: 1090678 - RNA, 21 nt, Human
uccuauagcugacuguuugcu

SEQ ID NO: 1090679 - RNA, 19 nt, Human
ucucuggaaacacuucagc

SEQ ID NO: 1090680 - RNA, 21 nt, Human
ucuggaaacacuucagcaaag

SEQ ID NO: 1090681 - RNA, 21 nt, Human
ucuucagagagauugugaugu

SEQ ID NO: 1090682 - RNA, 19 nt, Human
ugaaauuuucugguugaau

SEQ ID NO: 1090683 - RNA, 21 nt, Human
ugaaauuuucugguugaaugu

SEQ ID NO: 1090684 - RNA, 24 nt, Human
ugaaugucucaucaccaaaacuuu

SEQ ID NO: 1090685 - RNA, 22 nt, Human
ugaugugcugaaauuuucuggu

SEQ ID NO: 1090686 - RNA, 20 nt, Human
uggaacacaagcaaaauagc

SEQ ID NO: 1090687 - RNA, 21 nt, Human
uggaacacaagcaaaauagcu

SEQ ID NO: 1090688 - RNA, 22 nt, Human
uggaacacaagcaaaauagcug

SEQ ID NO: 1090689 - RNA, 26 nt, Human
uggguguaggcuagcugcuggcuggg

SEQ ID NO: 1090690 - RNA, 18 nt, Human
uguaggcuagcugcuggc

SEQ ID NO: 1090691 - RNA, 23 nt, Human
uuaccuaaaugugacagcaaaaa

SEQ ID NO: 1090692 - RNA, 21 nt, Human
uuaucuuuguuccaagcaacu

SEQ ID NO: 1090693 - RNA, 18 nt, Human
uucaugacaaggaguuga

SEQ ID NO: 1090694 - RNA, 21 nt, Human
uuccaaaaaaggaucccgaua

SEQ ID NO: 1090695 - RNA, 19 nt, Human
uuccccagcaccugaacuc

SEQ ID NO: 1090696 - RNA, 22 nt, Human
aaaaaaaaaaaaaaagacaaag

SEQ ID NO: 1090697 - RNA, 27 nt, Human
aaaaaaaaaaaaaaagacaaaguuugg

SEQ ID NO: 1090698 - RNA, 26 nt, Human
aaaaaaaaaagacaaaguuuggaaaa

SEQ ID NO: 1090699 - RNA, 24 nt, Human
aaaaaaaagacaaaguuuggaaaa

SEQ ID NO: 1090700 - RNA, 23 nt, Human
aaaaaaagacaaaguuuggaaaa

SEQ ID NO: 1090701 - RNA, 26 nt, Human
aagacaaaguuuggaaaauuaaaccc

SEQ ID NO: 1090702 - RNA, 18 nt, Human
augaaacaaaauguuccu

SEQ ID NO: 1090703 - RNA, 27 nt, Human
uggaaaauuaaacccccagggaaaugg

SEQ ID NO: 1090704 - RNA, 20 nt, Human
aagcaagcugaauccccagg

SEQ ID NO: 1090705 - RNA, 24 nt, Human
acagaagccugaggaggggacaac

SEQ ID NO: 1090706 - RNA, 18 nt, Human
accccccuccccacccca

SEQ ID NO: 1090707 - RNA, 19 nt, Human
accccccuccccaccccag

SEQ ID NO: 1090708 - RNA, 21 nt, Human
accccccuccccaccccagac

SEQ ID NO: 1090709 - RNA, 19 nt, Human
agagggagggaggacugag

SEQ ID NO: 1090710 - RNA, 20 nt, Human
agagggggcaguuagagaug

SEQ ID NO: 1090711 - RNA, 19 nt, Human
aggaagcaagcaagcugaa

SEQ ID NO: 1090712 - RNA, 23 nt, Human
aggacugaggucagacuggugga

SEQ ID NO: 1090713 - RNA, 19 nt, Human
aggggccagagggggcagu

SEQ ID NO: 1090714 - RNA, 23 nt, Human
caagcaagcugaauccccagggg

SEQ ID NO: 1090715 - RNA, 23 nt, Human
caagcugaauccccaggggccag

SEQ ID NO: 1090716 - RNA, 23 nt, Human
cagacugguggaggaagcaagca

SEQ ID NO: 1090717 - RNA, 19 nt, Human
ccccaggggccagaggggg

SEQ ID NO: 1090718 - RNA, 19 nt, Human
ccccccuccccaccccaga

SEQ ID NO: 1090719 - RNA, 19 nt, Human
cccccuccccaccccagac

SEQ ID NO: 1090720 - RNA, 24 nt, Human
cuggcaaucgauggaguguucccu

SEQ ID NO: 1090721 - RNA, 25 nt, Human
gaggacugaggucagacugguggag

SEQ ID NO: 1090722 - RNA, 19 nt, Human
ugaggaggggacaacagag

SEQ ID NO: 1090723 - RNA, 24 nt, Human
accacgggggggugagucacuuug

SEQ ID NO: 1090724 - RNA, 18 nt, Human
agaagccaucgcugccca

SEQ ID NO: 1090725 - RNA, 23 nt, Human
aggcuguccaccucacuggccuc

SEQ ID NO: 1090726 - RNA, 24 nt, Human
augcauucugggcuaucuccaauu

SEQ ID NO: 1090727 - RNA, 19 nt, Human
ccuaggcuguccaccucac

SEQ ID NO: 1090728 - RNA, 21 nt, Human
ccucugcuugcuccaguccuu

SEQ ID NO: 1090729 - RNA, 21 nt, Human
cucacuggccucgggcagagg

SEQ ID NO: 1090730 - RNA, 20 nt, Human
cuccaguccuucagggugcc

SEQ ID NO: 1090731 - RNA, 23 nt, Human
gaggauaaccccuaggcugucca

SEQ ID NO: 1090732 - RNA, 18 nt, Human
ggcacaugcauucugggc

SEQ ID NO: 1090733 - RNA, 20 nt, Human
ggcagggcuuucucucuccu

SEQ ID NO: 1090734 - RNA, 23 nt, Human
ggcggguggggcaugaggggcug

SEQ ID NO: 1090735 - RNA, 21 nt, Human
uaaccccuaggcuguccaccu

SEQ ID NO: 1090736 - RNA, 18 nt, Human
uggcggguggggcaugag

SEQ ID NO: 1090737 - RNA, 23 nt, Human
uggcggguggggcaugaggggcu

SEQ ID NO: 1090738 - RNA, 20 nt, Human
ugggcacaugcauucugggc

SEQ ID NO: 1090739 - RNA, 23 nt, Human
uuggcggguggggcaugaggggc

SEQ ID NO: 1090740 - RNA, 23 nt, Human
ccagcuggccucgauguacguca

SEQ ID NO: 1090741 - RNA, 24 nt, Human
ccggcgcgcgcgcccggggauccc

SEQ ID NO: 1090742 - RNA, 23 nt, Human
cgcgcccggggauccccagcugc

SEQ ID NO: 1090743 - RNA, 22 nt, Human
cgcgcgcgcccggggaucccca

SEQ ID NO: 1090744 - RNA, 22 nt, Human
cguguacgcgccggcgcgcgcg

SEQ ID NO: 1090745 - RNA, 23 nt, Human
cugccagugauggucugguuccc

SEQ ID NO: 1090746 - RNA, 21 nt, Human
uacaaguggcugcgcuucagc

SEQ ID NO: 1090747 - RNA, 22 nt, Human
ucuguaccugaacguguacgcg

SEQ ID NO: 1090748 - RNA, 18 nt, Human
ugccagugauggucuggu

SEQ ID NO: 1090749 - RNA, 23 nt, Human
ugccagugauggucugguucccg

SEQ ID NO: 1090750 - RNA, 21 nt, Human
aaguggaccugggcagugacg

SEQ ID NO: 1090751 - RNA, 24 nt, Human
agaaaacuugacugagagacaggc

SEQ ID NO: 1090752 - RNA, 22 nt, Human
agagacaggcacgaggacggga

SEQ ID NO: 1090753 - RNA, 19 nt, Human
aggacgggagggaggagga

SEQ ID NO: 1090754 - RNA, 23 nt, Human
agguggcucagagucaaaggaag

SEQ ID NO: 1090755 - RNA, 18 nt, Human
caacugaaucacauggaa

SEQ ID NO: 1090756 - RNA, 21 nt, Human
caacugaaucacauggaaauc

SEQ ID NO: 1090757 - RNA, 21 nt, Human
cacagccccaaacgcugaggg

SEQ ID NO: 1090758 - RNA, 23 nt, Human
cacugggccacucgggaaacccu

SEQ ID NO: 1090759 - RNA, 23 nt, Human
ccacagccccaaacgcugaggaa

SEQ ID NO: 1090760 - RNA, 23 nt, Human
ccacucgggaaacccuuucccaa

SEQ ID NO: 1090761 - RNA, 19 nt, Human
cccaaaaugaacuuuuacc

SEQ ID NO: 1090762 - RNA, 24 nt, Human
cccaaaaugaacuuuuaccaaaga

SEQ ID NO: 1090763 - RNA, 24 nt, Human
cccgcccacugggccacucgggaa

SEQ ID NO: 1090764 - RNA, 19 nt, Human
cccgcccgccgccgccgcc

SEQ ID NO: 1090765 - RNA, 25 nt, Human
cccgcccgccgccgccgccucucgc

SEQ ID NO: 1090766 - RNA, 23 nt, Human
cccgccgcccggcugcggcugcg

SEQ ID NO: 1090767 - RNA, 18 nt, Human
ccgcccgccgccgccgcc

SEQ ID NO: 1090768 - RNA, 23 nt, Human
ccgccgcaucgccgccgccgccg

SEQ ID NO: 1090769 - RNA, 22 nt, Human
ccgccgccgccgccgcccgacu

SEQ ID NO: 1090770 - RNA, 18 nt, Human
ccgccgccgccgccgccg

SEQ ID NO: 1090771 - RNA, 18 nt, Human
ccgccgccgccgccgccg

SEQ ID NO: 1090772 - RNA, 18 nt, Human
ccgccgccgccgccgccg

SEQ ID NO: 1090773 - RNA, 23 nt, Human
ccgccgccgccgccgccgcccga

SEQ ID NO: 1090774 - RNA, 24 nt, Human
ccgccgccgccgccgccgccgccc

SEQ ID NO: 1090775 - RNA, 24 nt, Human
ccgccgccgccgccgccgccgccg

SEQ ID NO: 1090776 - RNA, 27 nt, Human
ccgccgccgccgccgccgccgccgccc

SEQ ID NO: 1090777 - RNA, 18 nt, Human
ccgccgccgccgccucuc

SEQ ID NO: 1090778 - RNA, 18 nt, Human
ccgccgccgccucucgcc

SEQ ID NO: 1090779 - RNA, 22 nt, Human
ccgccgccgccucucgcccgcc

SEQ ID NO: 1090780 - RNA, 21 nt, Human
ccgccgccgccucucgcccgg

SEQ ID NO: 1090781 - RNA, 23 nt, Human
ccgccgccucucgcccgccgccc

SEQ ID NO: 1090782 - RNA, 21 nt, Human
ccucccaacuccaccgcggac

SEQ ID NO: 1090783 - RNA, 21 nt, Human
cgccgcccggcugcggcugcg

SEQ ID NO: 1090784 - RNA, 19 nt, Human
cgccgccgccgccgccgcc

SEQ ID NO: 1090785 - RNA, 22 nt, Human
cggcccgggccgccucgcgcgg

SEQ ID NO: 1090786 - RNA, 19 nt, Human
cucagagucaaaggaagcc

SEQ ID NO: 1090787 - RNA, 18 nt, Human
cucgggaaacccuuuccc

SEQ ID NO: 1090788 - RNA, 22 nt, Human
cugacaggacaagggaaagaaa

SEQ ID NO: 1090789 - RNA, 22 nt, Human
gagacaggcacgaggacgggag

SEQ ID NO: 1090790 - RNA, 20 nt, Human
gcuggcucccggcgccagga

SEQ ID NO: 1090791 - RNA, 20 nt, Human
guggaccugggcagugacgc

SEQ ID NO: 1090792 - RNA, 21 nt, Human
uaccaaagaggacaaaauuca

SEQ ID NO: 1090793 - RNA, 23 nt, Human
uaccaaagaggacaaaauucaac

SEQ ID NO: 1090794 - RNA, 19 nt, Human
ucccaaaaugaacuuuuac

SEQ ID NO: 1090795 - RNA, 19 nt, Human
ucccaacuccaccgcggac

SEQ ID NO: 1090796 - RNA, 19 nt, Human
ucgcccgccgcccggcugc

SEQ ID NO: 1090797 - RNA, 25 nt, Human
ucgccgccgccgccgccgccgccgg

SEQ ID NO: 1090798 - RNA, 20 nt, Human
ugcuccacagccccaaacgc

SEQ ID NO: 1090799 - RNA, 22 nt, Human
aaaccacaggggaaggagccgg

SEQ ID NO: 1090800 - RNA, 18 nt, Human
aaagugccaccaggugaa

SEQ ID NO: 1090801 - RNA, 21 nt, Human
aacaagaugcaggagaagcag

SEQ ID NO: 1090802 - RNA, 19 nt, Human
aagcaggaacaagaugcag

SEQ ID NO: 1090803 - RNA, 21 nt, Human
aagcaggaacaagaugcagga

SEQ ID NO: 1090804 - RNA, 22 nt, Human
aagcccacaguugugucuuuaa

SEQ ID NO: 1090805 - RNA, 26 nt, Human
aaggagaagcaaaaggagccggugaa

SEQ ID NO: 1090806 - RNA, 22 nt, Human
aaggagaagcaaaaggagcugg

SEQ ID NO: 1090807 - RNA, 23 nt, Human
aaggggcccaggccagagaauac

SEQ ID NO: 1090808 - RNA, 22 nt, Human
aauuauuucacagaaauauacu

SEQ ID NO: 1090809 - RNA, 22 nt, Human
acaacgaaccaaucugagaucc

SEQ ID NO: 1090810 - RNA, 20 nt, Human
acucugcaguggcaggaagg

SEQ ID NO: 1090811 - RNA, 18 nt, Human
acuuucuuuguacuguuu

SEQ ID NO: 1090812 - RNA, 20 nt, Human
agaaagcccacaguuguguc

SEQ ID NO: 1090813 - RNA, 21 nt, Human
agacaggaggucagggcucug

SEQ ID NO: 1090814 - RNA, 18 nt, Human
agaggaaagaggaauagc

SEQ ID NO: 1090815 - RNA, 23 nt, Human
agcaagugguuaaaaaaugccaa

SEQ ID NO: 1090816 - RNA, 22 nt, Human
agcuccucacagcaaacagccu

SEQ ID NO: 1090817 - RNA, 24 nt, Human
agcuggcugaggucccccaggaag

SEQ ID NO: 1090818 - RNA, 24 nt, Human
aggaggucagggcucugaugcuac

SEQ ID NO: 1090819 - RNA, 24 nt, Human
aggucccccaggaagcuucccacu

SEQ ID NO: 1090820 - RNA, 20 nt, Human
aguacgugucugugucuugg

SEQ ID NO: 1090821 - RNA, 20 nt, Human
caauggcucagcuaguuuac

SEQ ID NO: 1090822 - RNA, 22 nt, Human
caccauuuuacacccaaagaca

SEQ ID NO: 1090823 - RNA, 20 nt, Human
caggaggucagggcucugau

SEQ ID NO: 1090824 - RNA, 22 nt, Human
cagggcucugaugcuacucuuc

SEQ ID NO: 1090825 - RNA, 18 nt, Human
cauaacucacguccugca

SEQ ID NO: 1090826 - RNA, 21 nt, Human
caugacaauuuaauacaauag

SEQ ID NO: 1090827 - RNA, 19 nt, Human
ccaaagacaggaggucagg

SEQ ID NO: 1090828 - RNA, 19 nt, Human
ccacaggggaaggagccgg

SEQ ID NO: 1090829 - RNA, 24 nt, Human
cccccaaaagugccaccaggugaa

SEQ ID NO: 1090830 - RNA, 20 nt, Human
ccccggagcuggcugagguc

SEQ ID NO: 1090831 - RNA, 23 nt, Human
ccucucaccauuuuacacccaaa

SEQ ID NO: 1090832 - RNA, 22 nt, Human
cggccucucaccauuuuacacc

SEQ ID NO: 1090833 - RNA, 19 nt, Human
gaaccaaucugagauccga

SEQ ID NO: 1090834 - RNA, 20 nt, Human
gaaggacaccaaaagcuaca

SEQ ID NO: 1090835 - RNA, 18 nt, Human
gagcauccacaacgaacc

SEQ ID NO: 1090836 - RNA, 20 nt, Human
gaugagagccccggagcugg

SEQ ID NO: 1090837 - RNA, 22 nt, Human
gcaagugguuaaaaaaugccaa

SEQ ID NO: 1090838 - RNA, 19 nt, Human
gcaguggcuccaaacugag

SEQ ID NO: 1090839 - RNA, 18 nt, Human
ggagaaaucauauuggaa

SEQ ID NO: 1090840 - RNA, 21 nt, Human
ggccugaagccuggaaaaggc

SEQ ID NO: 1090841 - RNA, 23 nt, Human
uaaaaaaugccaaaugcaauuau

SEQ ID NO: 1090842 - RNA, 23 nt, Human
uaacauugccccccaaaagugcc

SEQ ID NO: 1090843 - RNA, 22 nt, Human
uaccuucauuugcaauggcuca

SEQ ID NO: 1090844 - RNA, 21 nt, Human
uagccagagcauccacaacga

SEQ ID NO: 1090845 - RNA, 23 nt, Human
uauuucacagaaauauacucuua

SEQ ID NO: 1090846 - RNA, 19 nt, Human
ucaccauuuuacacccaaa

SEQ ID NO: 1090847 - RNA, 22 nt, Human
uccacaacgaaccaaucugaga

SEQ ID NO: 1090848 - RNA, 27 nt, Human
ucccccaggaagcuucccacucugcag

SEQ ID NO: 1090849 - RNA, 21 nt, Human
ucgccucagaaagcccacagu

SEQ ID NO: 1090850 - RNA, 23 nt, Human
ucucaccauuuuacacccaaaga

SEQ ID NO: 1090851 - RNA, 22 nt, Human
ucuguuuguaaaauauggaacc

SEQ ID NO: 1090852 - RNA, 20 nt, Human
ugaaagagacuugaugagua

SEQ ID NO: 1090853 - RNA, 19 nt, Human
ugacccuucagaaggacac

SEQ ID NO: 1090854 - RNA, 21 nt, Human
ugaggucccccaggaagcuuc

SEQ ID NO: 1090855 - RNA, 19 nt, Human
ugaugaguaaaaugugaua

SEQ ID NO: 1090856 - RNA, 24 nt, Human
ugcaggaaggagaagcaaaaggag

SEQ ID NO: 1090857 - RNA, 21 nt, Human
ugcaggagaagcagcagcaga

SEQ ID NO: 1090858 - RNA, 22 nt, Human
ugcaguggcaggaaggccaugc

SEQ ID NO: 1090859 - RNA, 18 nt, Human
ugccaccaggugaaguac

SEQ ID NO: 1090860 - RNA, 23 nt, Human
uggcugaggucccccaggaagcu

SEQ ID NO: 1090861 - RNA, 24 nt, Human
uuccuucaugacaauuuaauacaa

SEQ ID NO: 1090862 - RNA, 22 nt, Human
uuuacacccaaagacaggaggu

SEQ ID NO: 1090863 - RNA, 28 nt, Human
uuuguucaggccugaagccuggaaaagg

SEQ ID NO: 1090864 - RNA, 18 nt, Human
aagcucucucugcccacc

SEQ ID NO: 1090865 - RNA, 21 nt, Human
aaggagacugagcacccuuca

SEQ ID NO: 1090866 - RNA, 18 nt, Human
acacuccacguuaggaaa

SEQ ID NO: 1090867 - RNA, 20 nt, Human
acagagcaagaaaaaaauca

SEQ ID NO: 1090868 - RNA, 21 nt, Human
acaggugcugcuagacacagc

SEQ ID NO: 1090869 - RNA, 19 nt, Human
accagcaaugcuuccagag

SEQ ID NO: 1090870 - RNA, 27 nt, Human
acccauacacuccacguuaggaaacaa

SEQ ID NO: 1090871 - RNA, 23 nt, Human
acucacaggggccugggagcggc

SEQ ID NO: 1090872 - RNA, 18 nt, Human
agcaagaaaaaaaucaug

SEQ ID NO: 1090873 - RNA, 19 nt, Human
aggcaaaaaaaaaaaaaaa

SEQ ID NO: 1090874 - RNA, 21 nt, Human
aggggccugggagcggccuug

SEQ ID NO: 1090875 - RNA, 25 nt, Human
caaagacagaccccacaugucaaga

SEQ ID NO: 1090876 - RNA, 27 nt, Human
caaagguucugccuucgccaguuuucc

SEQ ID NO: 1090877 - RNA, 18 nt, Human
caaaucccaacuuuccag

SEQ ID NO: 1090878 - RNA, 24 nt, Human
caaaucccaacuuuccagacuauc

SEQ ID NO: 1090879 - RNA, 25 nt, Human
caaauucucaaagacagaccccaca

SEQ ID NO: 1090880 - RNA, 20 nt, Human
caagaaaaaaaucaugggua

SEQ ID NO: 1090881 - RNA, 21 nt, Human
cacaagaacugguccaaacag

SEQ ID NO: 1090882 - RNA, 24 nt, Human
caccagcucugccugccgcagagg

SEQ ID NO: 1090883 - RNA, 20 nt, Human
cagaagcuaaaaucacuggc

SEQ ID NO: 1090884 - RNA, 18 nt, Human
cagagggacagcagcccu

SEQ ID NO: 1090885 - RNA, 23 nt, Human
cagcucccgccuggcugcugccu

SEQ ID NO: 1090886 - RNA, 24 nt, Human
caggaagaaccaggaguugcaggc

SEQ ID NO: 1090887 - RNA, 24 nt, Human
caggggccugggagcggccuugcu

SEQ ID NO: 1090888 - RNA, 25 nt, Human
ccaccuccaaagcuucaggaccagc

SEQ ID NO: 1090889 - RNA, 23 nt, Human
ccagccuccucuccaagguggaa

SEQ ID NO: 1090890 - RNA, 25 nt, Human
ccauacacuccacguuaggaaacac

SEQ ID NO: 1090891 - RNA, 23 nt, Human
cccaacuuuccagacuaucccca

SEQ ID NO: 1090892 - RNA, 19 nt, Human
ccccaccagcucugccugc

SEQ ID NO: 1090893 - RNA, 21 nt, Human
ccugcccccaccagcucugcc

SEQ ID NO: 1090894 - RNA, 23 nt, Human
ccugcccccaccagcucugccug

SEQ ID NO: 1090895 - RNA, 20 nt, Human
cgagaggaaauauuggacug

SEQ ID NO: 1090896 - RNA, 22 nt, Human
cucuauuuacagccaacagcug

SEQ ID NO: 1090897 - RNA, 23 nt, Human
cucugcccaccuccaaagcuuca

SEQ ID NO: 1090898 - RNA, 20 nt, Human
cugcccccaccagcucugcc

SEQ ID NO: 1090899 - RNA, 21 nt, Human
cugcccccaccagcucugccu

SEQ ID NO: 1090900 - RNA, 21 nt, Human
cuggcccagcaggggcacuug

SEQ ID NO: 1090901 - RNA, 19 nt, Human
cugguccaaacaggaagaa

SEQ ID NO: 1090902 - RNA, 24 nt, Human
cuuaggcaaaaaaaaaaaaaaaaa

SEQ ID NO: 1090903 - RNA, 20 nt, Human
cuuucuuucucuuguuuucu

SEQ ID NO: 1090904 - RNA, 18 nt, Human
gaagaaccaggaguugca

SEQ ID NO: 1090905 - RNA, 19 nt, Human
gaagcucucucugcccacc

SEQ ID NO: 1090906 - RNA, 20 nt, Human
gaaggaguuauuggguauca

SEQ ID NO: 1090907 - RNA, 18 nt, Human
gagcacccuucaggagcc

SEQ ID NO: 1090908 - RNA, 21 nt, Human
gaguugcaggccuugacuucc

SEQ ID NO: 1090909 - RNA, 18 nt, Human
gcaagaaaaaaaucaugg

SEQ ID NO: 1090910 - RNA, 20 nt, Human
gcccugguccauggugucuc

SEQ ID NO: 1090911 - RNA, 20 nt, Human
ggacacagacaguacgggag

SEQ ID NO: 1090912 - RNA, 19 nt, Human
ggcagggaggacagcaggc

SEQ ID NO: 1090913 - RNA, 24 nt, Human
ggccacagacuuucaguaauucca

SEQ ID NO: 1090914 - RNA, 18 nt, Human
gggcacuuggcaccucug

SEQ ID NO: 1090915 - RNA, 18 nt, Human
ggucucuaggcugggaga

SEQ ID NO: 1090916 - RNA, 19 nt, Human
gugccuuaggcaaaaaaaa

SEQ ID NO: 1090917 - RNA, 18 nt, Human
guuuucugcuugauccaa

SEQ ID NO: 1090918 - RNA, 21 nt, Human
guuuucugcuugauccaaggg

SEQ ID NO: 1090919 - RNA, 21 nt, Human
uaagguauuuucugagccaaa

SEQ ID NO: 1090920 - RNA, 23 nt, Human
uacagccaacagcugcucugaga

SEQ ID NO: 1090921 - RNA, 22 nt, Human
uauacaaggacacagacaguac

SEQ ID NO: 1090922 - RNA, 19 nt, Human
ucaaaaagacuuaaggcca

SEQ ID NO: 1090923 - RNA, 27 nt, Human
ucaaagacagaccccacaugucaagau

SEQ ID NO: 1090924 - RNA, 19 nt, Human
ucaauguccacaugaagau

SEQ ID NO: 1090925 - RNA, 21 nt, Human
uccaaagcuucaggaccagca

SEQ ID NO: 1090926 - RNA, 23 nt, Human
uccaagguggaaggcagggagga

SEQ ID NO: 1090927 - RNA, 19 nt, Human
ucucuuguuuucugcuuga

SEQ ID NO: 1090928 - RNA, 27 nt, Human
ucugcccaccuccaaagcuucaggacc

SEQ ID NO: 1090929 - RNA, 21 nt, Human
ugaaauaacacuucaaaaaga

SEQ ID NO: 1090930 - RNA, 22 nt, Human
ugaccccugcccccaccagcuc

SEQ ID NO: 1090931 - RNA, 18 nt, Human
ugagauugugccuuaggc

SEQ ID NO: 1090932 - RNA, 18 nt, Human
ugcccaccuccaaagcuu

SEQ ID NO: 1090933 - RNA, 21 nt, Human
ugcccccaccagcucugccug

SEQ ID NO: 1090934 - RNA, 18 nt, Human
ugcccuggccacugcuga

SEQ ID NO: 1090935 - RNA, 19 nt, Human
ugcccugguccaugguguc

SEQ ID NO: 1090936 - RNA, 20 nt, Human
uggaagccagggcuggcugc

SEQ ID NO: 1090937 - RNA, 23 nt, Human
uggacuguucauuuacaaauucu

SEQ ID NO: 1090938 - RNA, 24 nt, Human
uggcacaagaacugguccaaacag

SEQ ID NO: 1090939 - RNA, 24 nt, Human
uggcacaagaacugguccaaacag

SEQ ID NO: 1090940 - RNA, 19 nt, Human
uggcucgaggcauuucccu

SEQ ID NO: 1090941 - RNA, 22 nt, Human
ugggacuggcccagcaggggca

SEQ ID NO: 1090942 - RNA, 18 nt, Human
ugugaccccugcccccac

SEQ ID NO: 1090943 - RNA, 24 nt, Human
ugugccuuaggcaaaaaaaaaaaa

SEQ ID NO: 1090944 - RNA, 18 nt, Human
aaaagcuauucagcucca

SEQ ID NO: 1090945 - RNA, 19 nt, Human
aaacaagucccucccccag

SEQ ID NO: 1090946 - RNA, 22 nt, Human
aacggaaccucacuggggccug

SEQ ID NO: 1090947 - RNA, 21 nt, Human
acacccacgugggcaaggcca

SEQ ID NO: 1090948 - RNA, 20 nt, Human
accagcaggacccggcuggc

SEQ ID NO: 1090949 - RNA, 23 nt, Human
accccagacccaggucccccacc

SEQ ID NO: 1090950 - RNA, 23 nt, Human
acgugugcaucucugugugugug

SEQ ID NO: 1090951 - RNA, 20 nt, Human
agaaaacaguacaccacuaa

SEQ ID NO: 1090952 - RNA, 20 nt, Human
agaaggacagcaccagcucc

SEQ ID NO: 1090953 - RNA, 23 nt, Human
agaggugggagggaggcagagug

SEQ ID NO: 1090954 - RNA, 24 nt, Human
agaugcuuggcugccacccucugu

SEQ ID NO: 1090955 - RNA, 22 nt, Human
agcagccaccuagaaggacagc

SEQ ID NO: 1090956 - RNA, 23 nt, Human
aggaacaagaaaagcuauucagc

SEQ ID NO: 1090957 - RNA, 20 nt, Human
aggcacagcgcacaacggaa

SEQ ID NO: 1090958 - RNA, 19 nt, Human
aggcagcacuguggugaag

SEQ ID NO: 1090959 - RNA, 19 nt, Human
agggacaagaggugggagg

SEQ ID NO: 1090960 - RNA, 21 nt, Human
agggacugaggguacuggggu

SEQ ID NO: 1090961 - RNA, 21 nt, Human
aguccugggcaguggcuggac

SEQ ID NO: 1090962 - RNA, 22 nt, Human
augagcagccaccuagaaggac

SEQ ID NO: 1090963 - RNA, 22 nt, Human
augauggugguggugguggcuu

SEQ ID NO: 1090964 - RNA, 25 nt, Human
auggagucuggggcuccccucucug

SEQ ID NO: 1090965 - RNA, 30 nt, Human
caaacacccacgugggcaaggccagaacag

SEQ ID NO: 1090966 - RNA, 26 nt, Human
caaauccccuucuguggcagcaaggc

SEQ ID NO: 1090967 - RNA, 21 nt, Human
caacggaaccucacuggggcc

SEQ ID NO: 1090968 - RNA, 19 nt, Human
caagaggugggagggaggc

SEQ ID NO: 1090969 - RNA, 18 nt, Human
cacagcgcacaacggaac

SEQ ID NO: 1090970 - RNA, 20 nt, Human
caccagcacgggggacacga

SEQ ID NO: 1090971 - RNA, 20 nt, Human
caccuaugacggcacucgcc

SEQ ID NO: 1090972 - RNA, 20 nt, Human
caccuuguaaguggcagggu

SEQ ID NO: 1090973 - RNA, 22 nt, Human
cagccaccuagaaggacagcac

SEQ ID NO: 1090974 - RNA, 20 nt, Human
caggagaggaugaugaccac

SEQ ID NO: 1090975 - RNA, 26 nt, Human
caguacaccacuaagguggucagaac

SEQ ID NO: 1090976 - RNA, 21 nt, Human
ccagaacacagccacucacca

SEQ ID NO: 1090977 - RNA, 22 nt, Human
ccagaacacagccacucaccau

SEQ ID NO: 1090978 - RNA, 23 nt, Human
ccagcacgggggacacgagcaga

SEQ ID NO: 1090979 - RNA, 22 nt, Human
ccaggcagcacuguggugaagc

SEQ ID NO: 1090980 - RNA, 23 nt, Human
ccaggcagcacuguggugaagcc

SEQ ID NO: 1090981 - RNA, 21 nt, Human
ccaggucccccaccuuguaag

SEQ ID NO: 1090982 - RNA, 23 nt, Human
cccccagcacucucuggaauugc

SEQ ID NO: 1090983 - RNA, 19 nt, Human
ccccuucauuuugucucug

SEQ ID NO: 1090984 - RNA, 23 nt, Human
cccuucauuggaggaacagaaau

SEQ ID NO: 1090985 - RNA, 21 nt, Human
ccgggccugccugucccugcg

SEQ ID NO: 1090986 - RNA, 18 nt, Human
ccuagaaaacaguacacc

SEQ ID NO: 1090987 - RNA, 21 nt, Human
ccuccaguuugcgccugagac

SEQ ID NO: 1090988 - RNA, 19 nt, Human
ccugagaccccagacccag

SEQ ID NO: 1090989 - RNA, 24 nt, Human
ccuugccacuccucugcuuaagaa

SEQ ID NO: 1090990 - RNA, 26 nt, Human
cgacgagggacaagaggugggaggga

SEQ ID NO: 1090991 - RNA, 25 nt, Human
cgccugagaccccagacccaggucc

SEQ ID NO: 1090992 - RNA, 20 nt, Human
cgugcaggccacaguggucg

SEQ ID NO: 1090993 - RNA, 20 nt, Human
cuacaaauccccuucugugg

SEQ ID NO: 1090994 - RNA, 22 nt, Human
cucucugagaaugugggguaga

SEQ ID NO: 1090995 - RNA, 23 nt, Human
cucugccucagagaggugcccag

SEQ ID NO: 1090996 - RNA, 24 nt, Human
cucugccucagagaggugcccagg

SEQ ID NO: 1090997 - RNA, 25 nt, Human
cugaagccgggccugccugucccug

SEQ ID NO: 1090998 - RNA, 18 nt, Human
cugagaaugugggguaga

SEQ ID NO: 1090999 - RNA, 23 nt, Human
cugcagcgucagagauagcucua

SEQ ID NO: 1091000 - RNA, 21 nt, Human
cuguaugugugcucguccgac

SEQ ID NO: 1091001 - RNA, 18 nt, Human
cuuucagcuccgcaccag

SEQ ID NO: 1091002 - RNA, 20 nt, Human
gaacuucuggguggauuccu

SEQ ID NO: 1091003 - RNA, 19 nt, Human
gacacgagcagauggcugu

SEQ ID NO: 1091004 - RNA, 20 nt, Human
gacccuacaaauccccuucu

SEQ ID NO: 1091005 - RNA, 21 nt, Human
gacgagggacaagagguggga

SEQ ID NO: 1091006 - RNA, 24 nt, Human
gacugaggguacugggguugggag

SEQ ID NO: 1091007 - RNA, 21 nt, Human
gagccagccuuucugcagcca

SEQ ID NO: 1091008 - RNA, 20 nt, Human
gcgguggugaugaugguggu

SEQ ID NO: 1091009 - RNA, 23 nt, Human
gcggugguggcgguggcggugcc

SEQ ID NO: 1091010 - RNA, 19 nt, Human
gcugacccuacaaaucccc

SEQ ID NO: 1091011 - RNA, 19 nt, Human
ggacaagaggugggaggga

SEQ ID NO: 1091012 - RNA, 20 nt, Human
ggacugcauuuuaaaggcua

SEQ ID NO: 1091013 - RNA, 20 nt, Human
ggcaguggcuggacugauga

SEQ ID NO: 1091014 - RNA, 21 nt, Human
gggaagcaggauagggugcug

SEQ ID NO: 1091015 - RNA, 23 nt, Human
gggccuagugggcugugagggcc

SEQ ID NO: 1091016 - RNA, 22 nt, Human
ggggaagcaggauagggugcug

SEQ ID NO: 1091017 - RNA, 23 nt, Human
ggguacugggguugggagggggc

SEQ ID NO: 1091018 - RNA, 24 nt, Human
ggguugggagggggccuagugggc

SEQ ID NO: 1091019 - RNA, 28 nt, Human
gguggugaugauggugguggugguggcg

SEQ ID NO: 1091020 - RNA, 18 nt, Human
ggugguggcggugguggc

SEQ ID NO: 1091021 - RNA, 19 nt, Human
gucaagaucugagccagcc

SEQ ID NO: 1091022 - RNA, 22 nt, Human
gugaugauggugguggugguuu

SEQ ID NO: 1091023 - RNA, 19 nt, Human
gugcacgccuuugugugcc

SEQ ID NO: 1091024 - RNA, 20 nt, Human
guggcggugguggcgguggc

SEQ ID NO: 1091025 - RNA, 23 nt, Human
guggcggugguggcgguggcggu

SEQ ID NO: 1091026 - RNA, 20 nt, Human
guggugaugauggugguggu

SEQ ID NO: 1091027 - RNA, 20 nt, Human
gugguggcggugguggcggu

SEQ ID NO: 1091028 - RNA, 20 nt, Human
guggugguggcggugguggc

SEQ ID NO: 1091029 - RNA, 20 nt, Human
gugguggugguggcgguggu

SEQ ID NO: 1091030 - RNA, 23 nt, Human
gugguggugguggcggugguggc

SEQ ID NO: 1091031 - RNA, 18 nt, Human
uacaguacaacagacaga

SEQ ID NO: 1091032 - RNA, 22 nt, Human
uagguaggaauuuuuaucccuu

SEQ ID NO: 1091033 - RNA, 18 nt, Human
uaugagcagccaccuaga

SEQ ID NO: 1091034 - RNA, 26 nt, Human
uaugugcgcauauucacacauaugug

SEQ ID NO: 1091035 - RNA, 20 nt, Human
uccccuucauuuugucucug

SEQ ID NO: 1091036 - RNA, 22 nt, Human
ucgacgccggcgguggugauuu

SEQ ID NO: 1091037 - RNA, 18 nt, Human
ugacugagggacugaggg

SEQ ID NO: 1091038 - RNA, 20 nt, Human
ugagggacugaggguacugg

SEQ ID NO: 1091039 - RNA, 18 nt, Human
ugaguagccuucuggucc

SEQ ID NO: 1091040 - RNA, 21 nt, Human
ugaguagccuucugguccucu

SEQ ID NO: 1091041 - RNA, 19 nt, Human
ugauggugguggugguggc

SEQ ID NO: 1091042 - RNA, 21 nt, Human
ugauggugguggugguggcgg

SEQ ID NO: 1091043 - RNA, 24 nt, Human
ugauguuguggcucaucugcccug

SEQ ID NO: 1091044 - RNA, 22 nt, Human
ugccauccuugccacuccucug

SEQ ID NO: 1091045 - RNA, 19 nt, Human
ugcccaggcagcacugugg

SEQ ID NO: 1091046 - RNA, 20 nt, Human
ugccucagagaggugcccag

SEQ ID NO: 1091047 - RNA, 25 nt, Human
ugccucagagaggugcccaggcagc

SEQ ID NO: 1091048 - RNA, 21 nt, Human
ugcuuguaaacaagucccucc

SEQ ID NO: 1091049 - RNA, 19 nt, Human
uggcugccacccucugugg

SEQ ID NO: 1091050 - RNA, 21 nt, Human
uggcuggacugaugagggaac

SEQ ID NO: 1091051 - RNA, 19 nt, Human
uggugguggcggugguggc

SEQ ID NO: 1091052 - RNA, 18 nt, Human
uggugguggugguggcgg

SEQ ID NO: 1091053 - RNA, 20 nt, Human
uggugguggugguggcgguc

SEQ ID NO: 1091054 - RNA, 20 nt, Human
uguaaacaagucccuccccc

SEQ ID NO: 1091055 - RNA, 23 nt, Human
uguauacaaguuuggucuaugug

SEQ ID NO: 1091056 - RNA, 19 nt, Human
ugugugcacgccuuugugu

SEQ ID NO: 1091057 - RNA, 20 nt, Human
ugugugcacgccuuugugug

SEQ ID NO: 1091058 - RNA, 20 nt, Human
uguguguauacaaguuuggu

SEQ ID NO: 1091059 - RNA, 22 nt, Human
ugugugugugugcacgccuuug

SEQ ID NO: 1091060 - RNA, 22 nt, Human
uguugcuuauucauugccuagu

SEQ ID NO: 1091061 - RNA, 22 nt, Human
uuaccugcguggucuuugaugg

SEQ ID NO: 1091062 - RNA, 24 nt, Human
uuagcccuucauuggaggaacaga

SEQ ID NO: 1091063 - RNA, 20 nt, Human
uucagccuguagggaccagc

SEQ ID NO: 1091064 - RNA, 23 nt, Human
uuccuggacugcauuuuaaaggc

SEQ ID NO: 1091065 - RNA, 20 nt, Human
uugaacacagaaaagauaca

SEQ ID NO: 1091066 - RNA, 19 nt, Human
uugaagacccuuaguccug

SEQ ID NO: 1091067 - RNA, 27 nt, Human
uugugguggcaaggugguauuuauggg

SEQ ID NO: 1091068 - RNA, 23 nt, Human
uuuuuaucccuuuuuuuccccca

SEQ ID NO: 1091069 - RNA, 21 nt, Human
aaagacaaugacuccagaaaa

SEQ ID NO: 1091070 - RNA, 26 nt, Human
aaagaugcuggguaggauuacgguga

SEQ ID NO: 1091071 - RNA, 18 nt, Human
aaaugaagucuagguacu

SEQ ID NO: 1091072 - RNA, 26 nt, Human
aaaugaagucuagguacuugugaauu

SEQ ID NO: 1091073 - RNA, 21 nt, Human
aacacagcgaagugcagccuc

SEQ ID NO: 1091074 - RNA, 19 nt, Human
aacacgguaaaaccccguc

SEQ ID NO: 1091075 - RNA, 20 nt, Human
aacacgguaaaaccccgucu

SEQ ID NO: 1091076 - RNA, 21 nt, Human
aacacgguaaaaccccgucuc

SEQ ID NO: 1091077 - RNA, 20 nt, Human
aacagagcgagacuccaucu

SEQ ID NO: 1091078 - RNA, 18 nt, Human
aacauggugaaaccccgu

SEQ ID NO: 1091079 - RNA, 19 nt, Human
aacauggugaaaccccguc

SEQ ID NO: 1091080 - RNA, 19 nt, Human
aacauggugaaaccccguc

SEQ ID NO: 1091081 - RNA, 21 nt, Human
aacauggugaaaccccgucac

SEQ ID NO: 1091082 - RNA, 20 nt, Human
aacauggugaaaccccgucu

SEQ ID NO: 1091083 - RNA, 21 nt, Human
aacauggugaaaccccgucuc

SEQ ID NO: 1091084 - RNA, 18 nt, Human
aaccugggagccggagcu

SEQ ID NO: 1091085 - RNA, 28 nt, Human
aacuacccuugaaaaauucugaaacagg

SEQ ID NO: 1091086 - RNA, 19 nt, Human
aacuguguaaccugaaguu

SEQ ID NO: 1091087 - RNA, 19 nt, Human
aacuuuaugaacggccagu

SEQ ID NO: 1091088 - RNA, 19 nt, Human
aagagauaaauuaauuuca

SEQ ID NO: 1091089 - RNA, 18 nt, Human
aagcauuagggcccggga

SEQ ID NO: 1091090 - RNA, 24 nt, Human
aaucgcuugaacccgggaggugga

SEQ ID NO: 1091091 - RNA, 20 nt, Human
aauugcuugaacccaggagg

SEQ ID NO: 1091092 - RNA, 19 nt, Human
acaagaaugaaacuccauc

SEQ ID NO: 1091093 - RNA, 20 nt, Human
acaagaaugaaacuccaucu

SEQ ID NO: 1091094 - RNA, 21 nt, Human
acaagaaugaaacuccaucuc

SEQ ID NO: 1091095 - RNA, 20 nt, Human
acaccugccaccaccaaacc

SEQ ID NO: 1091096 - RNA, 20 nt, Human
acagagcgagacuccgucuc

SEQ ID NO: 1091097 - RNA, 24 nt, Human
acagagcgagacuccgucucaaaa

SEQ ID NO: 1091098 - RNA, 24 nt, Human
acagagugagaguccaucucaaaa

SEQ ID NO: 1091099 - RNA, 23 nt, Human
accaaggaaggacuacaagacaa

SEQ ID NO: 1091100 - RNA, 22 nt, Human
accacuguacuccagccuaggc

SEQ ID NO: 1091101 - RNA, 22 nt, Human
accaucuuggcaaggcuggucu

SEQ ID NO: 1091102 - RNA, 22 nt, Human
accauuuauugagcauuuaugu

SEQ ID NO: 1091103 - RNA, 26 nt, Human
acccagcuggucacugcguuuuagag

SEQ ID NO: 1091104 - RNA, 22 nt, Human
accccgucacuacuaaaaauac

SEQ ID NO: 1091105 - RNA, 23 nt, Human
accccgucucuacuaaaaauaca

SEQ ID NO: 1091106 - RNA, 24 nt, Human
accccgucucuauuaaaaauacaa

SEQ ID NO: 1091107 - RNA, 21 nt, Human
acccugugucuacuaaaacua

SEQ ID NO: 1091108 - RNA, 24 nt, Human
acccugugucuacuaaaacuacaa

SEQ ID NO: 1091109 - RNA, 24 nt, Human
accugaggucaggaguuugagacc

SEQ ID NO: 1091110 - RNA, 18 nt, Human
accugccaccaccaaacc

SEQ ID NO: 1091111 - RNA, 21 nt, Human
acgaaaauuagcugggugugg

SEQ ID NO: 1091112 - RNA, 23 nt, Human
acuacaagccaagaagcuugaga

SEQ ID NO: 1091113 - RNA, 24 nt, Human
acucaggagguggagguugcagug

SEQ ID NO: 1091114 - RNA, 24 nt, Human
acucuagccugggcgacagaguga

SEQ ID NO: 1091115 - RNA, 24 nt, Human
acugcacuccagccugggcgacag

SEQ ID NO: 1091116 - RNA, 26 nt, Human
acugcacuccagccugggcgacagag

SEQ ID NO: 1091117 - RNA, 24 nt, Human
acugcacucuagccugggcgacag

SEQ ID NO: 1091118 - RNA, 26 nt, Human
acugcacucuagccugggcgacagag

SEQ ID NO: 1091119 - RNA, 18 nt, Human
acuggugggagggguccg

SEQ ID NO: 1091120 - RNA, 24 nt, Human
acuguacuccagccuaggcaacag

SEQ ID NO: 1091121 - RNA, 25 nt, Human
acuguacuccagccuaggcaacaga

SEQ ID NO: 1091122 - RNA, 24 nt, Human
acuugaggucaggaguuugagacc

SEQ ID NO: 1091123 - RNA, 18 nt, Human
agaaguaaaacaugacug

SEQ ID NO: 1091124 - RNA, 22 nt, Human
agaaucgcuugaacccgggagg

SEQ ID NO: 1091125 - RNA, 24 nt, Human
agacaggagaaucgcuugaacccg

SEQ ID NO: 1091126 - RNA, 24 nt, Human
agagugcugggauuacaggcguga

SEQ ID NO: 1091127 - RNA, 20 nt, Human
agauccuagaauggagaaaa

SEQ ID NO: 1091128 - RNA, 18 nt, Human
agaugaggccguggggcg

SEQ ID NO: 1091129 - RNA, 24 nt, Human
agcacuuugggaggccaagguggg

SEQ ID NO: 1091130 - RNA, 24 nt, Human
agcacuuuuggaggcugagguggg

SEQ ID NO: 1091131 - RNA, 22 nt, Human
agcagggcauggugacucacgc

SEQ ID NO: 1091132 - RNA, 22 nt, Human
agcagugagaauaauaaaugau

SEQ ID NO: 1091133 - RNA, 21 nt, Human
agccggagcuugcagugagcc

SEQ ID NO: 1091134 - RNA, 22 nt, Human
agccggagcuugcagugagccg

SEQ ID NO: 1091135 - RNA, 24 nt, Human
agccggagcuugcagugagccgag

SEQ ID NO: 1091136 - RNA, 24 nt, Human
agccuaggcaacagagcgagacuc

SEQ ID NO: 1091137 - RNA, 18 nt, Human
agccuccugaguagcuag

SEQ ID NO: 1091138 - RNA, 22 nt, Human
agccuggccaacauggugaaac

SEQ ID NO: 1091139 - RNA, 22 nt, Human
agccuggccaacauggugaaac

SEQ ID NO: 1091140 - RNA, 24 nt, Human
agccuggccaacauggugaaaccc

SEQ ID NO: 1091141 - RNA, 24 nt, Human
agccuggccaacauggugaaaccc

SEQ ID NO: 1091142 - RNA, 22 nt, Human
agccuggccaauauggugaaac

SEQ ID NO: 1091143 - RNA, 24 nt, Human
agccuggccaauauggugaaaccc

SEQ ID NO: 1091144 - RNA, 25 nt, Human
agccuggccaauauggugaaacccu

SEQ ID NO: 1091145 - RNA, 24 nt, Human
agccugggcgacagagcgagacuc

SEQ ID NO: 1091146 - RNA, 21 nt, Human
agccugggcgacagagugaga

SEQ ID NO: 1091147 - RNA, 23 nt, Human
agcgaagugcagccucaccuccc

SEQ ID NO: 1091148 - RNA, 21 nt, Human
agcgggcaccuguagucccag

SEQ ID NO: 1091149 - RNA, 23 nt, Human
agcuggguguggaggugggcgcc

SEQ ID NO: 1091150 - RNA, 20 nt, Human
aggaguuugagaccagccug

SEQ ID NO: 1091151 - RNA, 20 nt, Human
aggaguuugagaccagccug

SEQ ID NO: 1091152 - RNA, 20 nt, Human
aggaguuugagaccagccug

SEQ ID NO: 1091153 - RNA, 18 nt, Human
aggcaacaagaaugaaac

SEQ ID NO: 1091154 - RNA, 22 nt, Human
aggcaggacaauggcgugaacc

SEQ ID NO: 1091155 - RNA, 24 nt, Human
aggcaggacaauggcgugaaccug

SEQ ID NO: 1091156 - RNA, 21 nt, Human
aggcaggagaaucccuugaac

SEQ ID NO: 1091157 - RNA, 23 nt, Human
aggcaggagaaucccuugaacuc

SEQ ID NO: 1091158 - RNA, 21 nt, Human
aggccaaggcggguggaucac

SEQ ID NO: 1091159 - RNA, 20 nt, Human
aggccaagguggguggauca

SEQ ID NO: 1091160 - RNA, 21 nt, Human
aggccgaggcgggcggaucac

SEQ ID NO: 1091161 - RNA, 24 nt, Human
aggcgggcggaucacgagggcagg

SEQ ID NO: 1091162 - RNA, 22 nt, Human
aggcggguggaucacuugaggu

SEQ ID NO: 1091163 - RNA, 23 nt, Human
aggcggguggaucacuugagguc

SEQ ID NO: 1091164 - RNA, 26 nt, Human
aggcggguggaucacuugaggucagg

SEQ ID NO: 1091165 - RNA, 24 nt, Human
aggcugaccccauuugugugacac

SEQ ID NO: 1091166 - RNA, 24 nt, Human
aggcugagguggguggaucaccug

SEQ ID NO: 1091167 - RNA, 21 nt, Human
agggcaaaucaaaagccaaag

SEQ ID NO: 1091168 - RNA, 24 nt, Human
agggugaggcaggagaaucccuug

SEQ ID NO: 1091169 - RNA, 24 nt, Human
agguggagguugcagggagccgag

SEQ ID NO: 1091170 - RNA, 21 nt, Human
agguggagguugcagugagcc

SEQ ID NO: 1091171 - RNA, 22 nt, Human
agguggagguugcagugagccg

SEQ ID NO: 1091172 - RNA, 21 nt, Human
agguggccugggauuguauuc

SEQ ID NO: 1091173 - RNA, 24 nt, Human
aggugggcgccuguaaucccagug

SEQ ID NO: 1091174 - RNA, 22 nt, Human
agguggguggaucaccugaggu

SEQ ID NO: 1091175 - RNA, 24 nt, Human
agucaggguggcucacgccuguaa

SEQ ID NO: 1091176 - RNA, 22 nt, Human
agugcagccucaccucccgccu

SEQ ID NO: 1091177 - RNA, 18 nt, Human
agugcugggauuacaggc

SEQ ID NO: 1091178 - RNA, 18 nt, Human
agugcugggauuacaggc

SEQ ID NO: 1091179 - RNA, 22 nt, Human
agugcugggauuacaggcguga

SEQ ID NO: 1091180 - RNA, 23 nt, Human
aguggcgccaucuuggcucacug

SEQ ID NO: 1091181 - RNA, 24 nt, Human
aguggcucacaccuauaaucccag

SEQ ID NO: 1091182 - RNA, 20 nt, Human
aguguaguggcgccaucuug

SEQ ID NO: 1091183 - RNA, 24 nt, Human
aguguaguggcgccaucuuggcuc

SEQ ID NO: 1091184 - RNA, 22 nt, Human
aguuuuguaggaaaauggaaaa

SEQ ID NO: 1091185 - RNA, 20 nt, Human
auaauaauaaaaagaauguc

SEQ ID NO: 1091186 - RNA, 26 nt, Human
auaauaauaauaaaucauaugaacca

SEQ ID NO: 1091187 - RNA, 23 nt, Human
auaauaauggcaacaaacgugag

SEQ ID NO: 1091188 - RNA, 18 nt, Human
auagaauaugcacggacc

SEQ ID NO: 1091189 - RNA, 20 nt, Human
aucaccugaggucaggaguu

SEQ ID NO: 1091190 - RNA, 24 nt, Human
aucaccugaggucaggaguuugag

SEQ ID NO: 1091191 - RNA, 24 nt, Human
aucacuugaggucaggaguuugag

SEQ ID NO: 1091192 - RNA, 20 nt, Human
aucucgccauugcacuccag

SEQ ID NO: 1091193 - RNA, 20 nt, Human
augaaccacuuacugaucac

SEQ ID NO: 1091194 - RNA, 24 nt, Human
auggcgccacugcacuccagccug

SEQ ID NO: 1091195 - RNA, 18 nt, Human
auggucggaaaucaucgc

SEQ ID NO: 1091196 - RNA, 23 nt, Human
auggugggugccuguaaucccag

SEQ ID NO: 1091197 - RNA, 25 nt, Human
auugcacuccagccuaggcaacaag

SEQ ID NO: 1091198 - RNA, 24 nt, Human
auugugccacugcacucuagccug

SEQ ID NO: 1091199 - RNA, 24 nt, Human
auuugaagucaggaguuugagacc

SEQ ID NO: 1091200 - RNA, 22 nt, Human
caaaaaaaaaaaaaaaaaggga

SEQ ID NO: 1091201 - RNA, 24 nt, Human
caacauggugaaaccccgucacua

SEQ ID NO: 1091202 - RNA, 24 nt, Human
caacauggugaaaccccgucucua

SEQ ID NO: 1091203 - RNA, 24 nt, Human
caaggcggguggaucacuugaggu

SEQ ID NO: 1091204 - RNA, 24 nt, Human
caagguggguggaucauuugaagu

SEQ ID NO: 1091205 - RNA, 24 nt, Human
caauauggugaaacccugugucua

SEQ ID NO: 1091206 - RNA, 25 nt, Human
cacaccuauaaucccagcacuuuug

SEQ ID NO: 1091207 - RNA, 20 nt, Human
cacauuugaaccugaacuac

SEQ ID NO: 1091208 - RNA, 23 nt, Human
caccaaggaaggacuacaagacu

SEQ ID NO: 1091209 - RNA, 24 nt, Human
caccacuguacuccagccuaggca

SEQ ID NO: 1091210 - RNA, 24 nt, Human
caccaucuuggcaaggcuggucuu

SEQ ID NO: 1091211 - RNA, 19 nt, Human
cacccccucgcuucucuac

SEQ ID NO: 1091212 - RNA, 20 nt, Human
cacccgccucagccucccag

SEQ ID NO: 1091213 - RNA, 19 nt, Human
caccuauaaucccagcacu

SEQ ID NO: 1091214 - RNA, 23 nt, Human
caccugaggucaggaguuugaga

SEQ ID NO: 1091215 - RNA, 19 nt, Human
caccugccaccaccaaacc

SEQ ID NO: 1091216 - RNA, 24 nt, Human
caccuguagucccagcuacucugg

SEQ ID NO: 1091217 - RNA, 23 nt, Human
caccuguagucccagcuacuugg

SEQ ID NO: 1091218 - RNA, 24 nt, Human
caccuguagucccagcuacuuggg

SEQ ID NO: 1091219 - RNA, 24 nt, Human
cacgccuauaaucccagcacuuug

SEQ ID NO: 1091220 - RNA, 24 nt, Human
cacgccuguaaucccagcacuuug

SEQ ID NO: 1091221 - RNA, 24 nt, Human
cacgccuguaaucccagcauucug

SEQ ID NO: 1091222 - RNA, 24 nt, Human
cacuccagccugggcgacagagcg

SEQ ID NO: 1091223 - RNA, 22 nt, Human
cacucuagccugggcgacagag

SEQ ID NO: 1091224 - RNA, 22 nt, Human
cacucuagccugggcgacagag

SEQ ID NO: 1091225 - RNA, 24 nt, Human
cacucuagccugggcgacagagug

SEQ ID NO: 1091226 - RNA, 23 nt, Human
cacugcaaccuccgccuuccggg

SEQ ID NO: 1091227 - RNA, 19 nt, Human
cacugcacuccagccuggg

SEQ ID NO: 1091228 - RNA, 21 nt, Human
cacugcacuccagccugggcg

SEQ ID NO: 1091229 - RNA, 22 nt, Human
cacugcacuccagccugggcga

SEQ ID NO: 1091230 - RNA, 23 nt, Human
cacugcacuccagccugggcgac

SEQ ID NO: 1091231 - RNA, 24 nt, Human
cacugcacuccagccugggcgaca

SEQ ID NO: 1091232 - RNA, 19 nt, Human
cacugcacucuagccuggg

SEQ ID NO: 1091233 - RNA, 20 nt, Human
cacugcacucuagccugggc

SEQ ID NO: 1091234 - RNA, 21 nt, Human
cacugcacucuagccugggcg

SEQ ID NO: 1091235 - RNA, 22 nt, Human
cacugcacucuagccugggcga

SEQ ID NO: 1091236 - RNA, 24 nt, Human
cacugcacucuagccugggcgaca

SEQ ID NO: 1091237 - RNA, 19 nt, Human
cacuguacuccagccuagg

SEQ ID NO: 1091238 - RNA, 21 nt, Human
cacuguacuccagccuaggca

SEQ ID NO: 1091239 - RNA, 22 nt, Human
cacuguacuccagccuaggcaa

SEQ ID NO: 1091240 - RNA, 23 nt, Human
cacuguacuccagccuaggcaac

SEQ ID NO: 1091241 - RNA, 24 nt, Human
cacuguacuccagccuaggcaaca

SEQ ID NO: 1091242 - RNA, 23 nt, Human
cacuugaggucaggaguuugaga

SEQ ID NO: 1091243 - RNA, 21 nt, Human
cacuuuggccacucucucuuc

SEQ ID NO: 1091244 - RNA, 22 nt, Human
cagacacccacagggcucaccc

SEQ ID NO: 1091245 - RNA, 24 nt, Human
cagcaaauagaauaugcacggacc

SEQ ID NO: 1091246 - RNA, 19 nt, Human
cagcaagaauagcagugag

SEQ ID NO: 1091247 - RNA, 22 nt, Human
cagcacuuugggaggccaaggc

SEQ ID NO: 1091248 - RNA, 24 nt, Human
cagcacuuugggaggccaaggcgg

SEQ ID NO: 1091249 - RNA, 24 nt, Human
cagcacuuugggaggccaaggugg

SEQ ID NO: 1091250 - RNA, 21 nt, Human
cagcacuuuuggaggcugagg

SEQ ID NO: 1091251 - RNA, 24 nt, Human
cagcacuuuuggaggcugaggugg

SEQ ID NO: 1091252 - RNA, 24 nt, Human
cagcauucugggaggccgaggcgg

SEQ ID NO: 1091253 - RNA, 20 nt, Human
cagccucaccucccgccuug

SEQ ID NO: 1091254 - RNA, 18 nt, Human
cagccuccugaguagcua

SEQ ID NO: 1091255 - RNA, 22 nt, Human
cagcgaagugcagccucaccuc

SEQ ID NO: 1091256 - RNA, 29 nt, Human
caggagguggagguugcagugacaacggu

SEQ ID NO: 1091257 - RNA, 24 nt, Human
caggagguggagguugcagugagc

SEQ ID NO: 1091258 - RNA, 26 nt, Human
cagggcaaaucaaaagccaaagucuc

SEQ ID NO: 1091259 - RNA, 20 nt, Human
caucucaaaaaauaaauaaa

SEQ ID NO: 1091260 - RNA, 19 nt, Human
cauggucggaaaucaucgc

SEQ ID NO: 1091261 - RNA, 19 nt, Human
cauuccacucuaccacgcc

SEQ ID NO: 1091262 - RNA, 19 nt, Human
cauugcacuccagccuagg

SEQ ID NO: 1091263 - RNA, 21 nt, Human
cauugcacuccagccuaggca

SEQ ID NO: 1091264 - RNA, 22 nt, Human
cauugcacuccagccuaggcaa

SEQ ID NO: 1091265 - RNA, 24 nt, Human
cauugcacuccagccuaggcaaca

SEQ ID NO: 1091266 - RNA, 23 nt, Human
cauuugaagucaggaguuugaga

SEQ ID NO: 1091267 - RNA, 21 nt, Human
ccacgccggccuucuccagag

SEQ ID NO: 1091268 - RNA, 20 nt, Human
ccacugcacuccagccuggg

SEQ ID NO: 1091269 - RNA, 20 nt, Human
ccacugcacuccagccuggg

SEQ ID NO: 1091270 - RNA, 21 nt, Human
ccacugcacuccagccugggc

SEQ ID NO: 1091271 - RNA, 21 nt, Human
ccacugcacuccagccugggc

SEQ ID NO: 1091272 - RNA, 23 nt, Human
ccacugcacuccagccugggcga

SEQ ID NO: 1091273 - RNA, 24 nt, Human
ccacugcacuccagccugggcgac

SEQ ID NO: 1091274 - RNA, 20 nt, Human
ccacugcacucuagccuggg

SEQ ID NO: 1091275 - RNA, 21 nt, Human
ccacugcacucuagccugggc

SEQ ID NO: 1091276 - RNA, 21 nt, Human
ccacugcacucuagccugggc

SEQ ID NO: 1091277 - RNA, 23 nt, Human
ccacugcacucuagccugggcga

SEQ ID NO: 1091278 - RNA, 24 nt, Human
ccacugcacucuagccugggcgac

SEQ ID NO: 1091279 - RNA, 19 nt, Human
ccacuguacuccagccuag

SEQ ID NO: 1091280 - RNA, 20 nt, Human
ccacuguacuccagccuagg

SEQ ID NO: 1091281 - RNA, 20 nt, Human
ccacuguacuccagccuagg

SEQ ID NO: 1091282 - RNA, 21 nt, Human
ccacuguacuccagccuaggc

SEQ ID NO: 1091283 - RNA, 24 nt, Human
ccacuguacuccagccuaggcaac

SEQ ID NO: 1091284 - RNA, 21 nt, Human
ccagacaccugccaccaccaa

SEQ ID NO: 1091285 - RNA, 22 nt, Human
ccagagugcugggauuacaggc

SEQ ID NO: 1091286 - RNA, 22 nt, Human
ccagagugcugggauuacaggc

SEQ ID NO: 1091287 - RNA, 24 nt, Human
ccagagugcugggauuacaggcgu

SEQ ID NO: 1091288 - RNA, 23 nt, Human
ccaggcccaccuuuccccagaca

SEQ ID NO: 1091289 - RNA, 20 nt, Human
ccagguccucuucuacacac

SEQ ID NO: 1091290 - RNA, 19 nt, Human
ccauugcacuccagccuag

SEQ ID NO: 1091291 - RNA, 20 nt, Human
ccauugcacuccagccuagg

SEQ ID NO: 1091292 - RNA, 21 nt, Human
ccauugcacuccagccuaggc

SEQ ID NO: 1091293 - RNA, 22 nt, Human
ccauugcacuccagccuaggca

SEQ ID NO: 1091294 - RNA, 24 nt, Human
ccauugcacuccagccuaggcaac

SEQ ID NO: 1091295 - RNA, 18 nt, Human
cccaccuuuccccagaca

SEQ ID NO: 1091296 - RNA, 20 nt, Human
cccaucccacucuaccucau

SEQ ID NO: 1091297 - RNA, 21 nt, Human
ccccagacacccacagggcuc

SEQ ID NO: 1091298 - RNA, 18 nt, Human
ccccucgcuucucuaccu

SEQ ID NO: 1091299 - RNA, 23 nt, Human
cccgcuccacgguguagcacaga

SEQ ID NO: 1091300 - RNA, 21 nt, Human
cccgggagguggagguugcag

SEQ ID NO: 1091301 - RNA, 21 nt, Human
ccgcagccugcugcugggugc

SEQ ID NO: 1091302 - RNA, 24 nt, Human
ccgccucagccucccagagugcug

SEQ ID NO: 1091303 - RNA, 24 nt, Human
ccgcucagauaccacuuccuaggu

SEQ ID NO: 1091304 - RNA, 19 nt, Human
ccggguucaagcaauucuc

SEQ ID NO: 1091305 - RNA, 19 nt, Human
ccggguucaagcaauucuc

SEQ ID NO: 1091306 - RNA, 22 nt, Human
ccuauaaucccagcacuuuggg

SEQ ID NO: 1091307 - RNA, 20 nt, Human
ccugaccucgugauccaccc

SEQ ID NO: 1091308 - RNA, 23 nt, Human
ccugaggucauccagcuggugaa

SEQ ID NO: 1091309 - RNA, 18 nt, Human
ccugccaccaccaaacca

SEQ ID NO: 1091310 - RNA, 24 nt, Human
ccuggauaacacgguaaaaccccg

SEQ ID NO: 1091311 - RNA, 23 nt, Human
ccuggccaacauggugaaacccc

SEQ ID NO: 1091312 - RNA, 23 nt, Human
ccuggccaacauggugaaacccc

SEQ ID NO: 1091313 - RNA, 24 nt, Human
ccuggccaacauggugaaaccccg

SEQ ID NO: 1091314 - RNA, 24 nt, Human
ccuggccaacauggugaaaccccg

SEQ ID NO: 1091315 - RNA, 22 nt, Human
ccuggccaauauggugaaaccc

SEQ ID NO: 1091316 - RNA, 24 nt, Human
ccuggccaauauggugaaacccug

SEQ ID NO: 1091317 - RNA, 24 nt, Human
ccugggccuggagucagcucugcc

SEQ ID NO: 1091318 - RNA, 22 nt, Human
ccugggcgacagagcgagacuc

SEQ ID NO: 1091319 - RNA, 22 nt, Human
ccuguaaucccagcacuuuggg

SEQ ID NO: 1091320 - RNA, 22 nt, Human
ccuguaaucccagcauucuggg

SEQ ID NO: 1091321 - RNA, 21 nt, Human
ccuguaaucccagcuccucgg

SEQ ID NO: 1091322 - RNA, 22 nt, Human
ccuguagucccagcuacucugg

SEQ ID NO: 1091323 - RNA, 23 nt, Human
ccuguagucccagcuacucugga

SEQ ID NO: 1091324 - RNA, 25 nt, Human
ccuguagucccagcuacuugggugg

SEQ ID NO: 1091325 - RNA, 24 nt, Human
ccuuccggguucaagcaauucucu

SEQ ID NO: 1091326 - RNA, 24 nt, Human
cgagaccauccuggauaacacggu

SEQ ID NO: 1091327 - RNA, 24 nt, Human
cgagacugcaccacuguacuccag

SEQ ID NO: 1091328 - RNA, 24 nt, Human
cgagauggcgccacugcacuccag

SEQ ID NO: 1091329 - RNA, 19 nt, Human
cgcagccugcugcugggug

SEQ ID NO: 1091330 - RNA, 24 nt, Human
cgcccaggcuggaguguaguggcg

SEQ ID NO: 1091331 - RNA, 23 nt, Human
cgccuauaaucccagcacuuugg

SEQ ID NO: 1091332 - RNA, 24 nt, Human
cgccucagccucccagagugcugg

SEQ ID NO: 1091333 - RNA, 23 nt, Human
cgccucgagaucccagcacgccc

SEQ ID NO: 1091334 - RNA, 23 nt, Human
cgccuguaaucccagcacuuugg

SEQ ID NO: 1091335 - RNA, 24 nt, Human
cgccuguaaucccagugacucggg

SEQ ID NO: 1091336 - RNA, 24 nt, Human
cgcucugucgcccaggcuggagug

SEQ ID NO: 1091337 - RNA, 24 nt, Human
cgggagguggagguugcagggagc

SEQ ID NO: 1091338 - RNA, 21 nt, Human
cgggcaccuguagucccagcu

SEQ ID NO: 1091339 - RNA, 24 nt, Human
cgugauccacccgccucagccucc

SEQ ID NO: 1091340 - RNA, 23 nt, Human
cuaaaacuacaaaaauuagcccu

SEQ ID NO: 1091341 - RNA, 22 nt, Human
cuacaagacaaaaaacaggcac

SEQ ID NO: 1091342 - RNA, 19 nt, Human
cuaggcuauucaaaucauc

SEQ ID NO: 1091343 - RNA, 22 nt, Human
cucacaccuauaaucccagcac

SEQ ID NO: 1091344 - RNA, 24 nt, Human
cucacaccuauaaucccagcacuu

SEQ ID NO: 1091345 - RNA, 22 nt, Human
cucacgccuauaaucccagcac

SEQ ID NO: 1091346 - RNA, 24 nt, Human
cucacgccuauaaucccagcacuu

SEQ ID NO: 1091347 - RNA, 21 nt, Human
cucacgccuguaaucccagca

SEQ ID NO: 1091348 - RNA, 22 nt, Human
cucacgccuguaaucccagcac

SEQ ID NO: 1091349 - RNA, 24 nt, Human
cucacgccuguaaucccagcacuu

SEQ ID NO: 1091350 - RNA, 24 nt, Human
cucacgccuguaaucccagcauuc

SEQ ID NO: 1091351 - RNA, 24 nt, Human
cucacugcaaccuccgccuuccgg

SEQ ID NO: 1091352 - RNA, 19 nt, Human
cucagauaccacuuccuag

SEQ ID NO: 1091353 - RNA, 20 nt, Human
cucauuccacucuaccacgc

SEQ ID NO: 1091354 - RNA, 19 nt, Human
cuccaucucaaaaaaaaaa

SEQ ID NO: 1091355 - RNA, 20 nt, Human
cucccaucccacucuaccuc

SEQ ID NO: 1091356 - RNA, 21 nt, Human
cucccugggccucaucugugg

SEQ ID NO: 1091357 - RNA, 24 nt, Human
cuccugaccucgugauccacccgc

SEQ ID NO: 1091358 - RNA, 23 nt, Human
cuccugaguagcuaggauuccag

SEQ ID NO: 1091359 - RNA, 21 nt, Human
cucgcucugucgcccaggcug

SEQ ID NO: 1091360 - RNA, 24 nt, Human
cucgcucugucgcccaggcuggag

SEQ ID NO: 1091361 - RNA, 27 nt, Human
cucgcuucucuaccucgcuucuccgcu

SEQ ID NO: 1091362 - RNA, 25 nt, Human
cugaucacuuaauggacagaagccu

SEQ ID NO: 1091363 - RNA, 24 nt, Human
cugcaaccuccgccuuccggguuc

SEQ ID NO: 1091364 - RNA, 23 nt, Human
cugccacagccuccugaguagcu

SEQ ID NO: 1091365 - RNA, 24 nt, Human
cuggccaauauggugaaacccugu

SEQ ID NO: 1091366 - RNA, 18 nt, Human
cuggugggagggguccgg

SEQ ID NO: 1091367 - RNA, 20 nt, Human
cugugugccagguccucuuc

SEQ ID NO: 1091368 - RNA, 21 nt, Human
cuugaacucaggagguggagg

SEQ ID NO: 1091369 - RNA, 24 nt, Human
cuugcagugagccgagauggcgcc

SEQ ID NO: 1091370 - RNA, 19 nt, Human
gaauauccaggcugacccc

SEQ ID NO: 1091371 - RNA, 21 nt, Human
gaauaugcacggaccucucac

SEQ ID NO: 1091372 - RNA, 24 nt, Human
gacagagcgagacuccgucucaaa

SEQ ID NO: 1091373 - RNA, 22 nt, Human
gaccucgugauccacccgccuc

SEQ ID NO: 1091374 - RNA, 24 nt, Human
gaccucgugauccacccgccucag

SEQ ID NO: 1091375 - RNA, 21 nt, Human
gacucacgccuauaaucccag

SEQ ID NO: 1091376 - RNA, 23 nt, Human
gagaccagccuggccaacauggu

SEQ ID NO: 1091377 - RNA, 22 nt, Human
gagaucccagcacgccccgccc

SEQ ID NO: 1091378 - RNA, 20 nt, Human
gagauugugccacugcacuc

SEQ ID NO: 1091379 - RNA, 21 nt, Human
gagccgagauugugccacugc

SEQ ID NO: 1091380 - RNA, 18 nt, Human
gagcuugcagugagccga

SEQ ID NO: 1091381 - RNA, 21 nt, Human
gagcuugcagugagccgagau

SEQ ID NO: 1091382 - RNA, 23 nt, Human
gagguggguggaucaccugaggu

SEQ ID NO: 1091383 - RNA, 23 nt, Human
gagguugcagggagccgagauug

SEQ ID NO: 1091384 - RNA, 21 nt, Human
gaucaccugaggucaggaguu

SEQ ID NO: 1091385 - RNA, 24 nt, Human
gaucaccugaggucaggaguuuga

SEQ ID NO: 1091386 - RNA, 24 nt, Human
gaucacuugaggucaggaguuuga

SEQ ID NO: 1091387 - RNA, 24 nt, Human
gaucauuugaagucaggaguuuga

SEQ ID NO: 1091388 - RNA, 21 nt, Human
gaucucgccauugcacuccag

SEQ ID NO: 1091389 - RNA, 24 nt, Human
gauggugggugccuguaaucccag

SEQ ID NO: 1091390 - RNA, 18 nt, Human
gauuacaggcgugagcca

SEQ ID NO: 1091391 - RNA, 23 nt, Human
gauuacaggcgugagccacagca

SEQ ID NO: 1091392 - RNA, 22 nt, Human
gauuccagacaccugccaccac

SEQ ID NO: 1091393 - RNA, 24 nt, Human
gcacuccagccugggcgacagagc

SEQ ID NO: 1091394 - RNA, 24 nt, Human
gcacucuagccugggcgacagagu

SEQ ID NO: 1091395 - RNA, 20 nt, Human
gcacuuugggaggccaaggu

SEQ ID NO: 1091396 - RNA, 22 nt, Human
gccaacauggugaaaccccguc

SEQ ID NO: 1091397 - RNA, 24 nt, Human
gccaacauggugaaaccccgucuc

SEQ ID NO: 1091398 - RNA, 24 nt, Human
gccaauauggugaaacccuguguc

SEQ ID NO: 1091399 - RNA, 22 nt, Human
gccacugcacuccagccugggc

SEQ ID NO: 1091400 - RNA, 24 nt, Human
gccacugcacuccagccugggcga

SEQ ID NO: 1091401 - RNA, 24 nt, Human
gccacugcacucuagccugggcga

SEQ ID NO: 1091402 - RNA, 20 nt, Human
gcccaggcuggaguguagug

SEQ ID NO: 1091403 - RNA, 24 nt, Human
gccccgcuccacgguguagcacag

SEQ ID NO: 1091404 - RNA, 21 nt, Human
gcccggggcucgacugguggg

SEQ ID NO: 1091405 - RNA, 18 nt, Human
gccgcagccugcugcugg

SEQ ID NO: 1091406 - RNA, 19 nt, Human
gcgguugcucacgccugua

SEQ ID NO: 1091407 - RNA, 20 nt, Human
gcucacgccuguaaucccag

SEQ ID NO: 1091408 - RNA, 22 nt, Human
gcucacgccuguaaucccagca

SEQ ID NO: 1091409 - RNA, 19 nt, Human
gcuggguguggaggugggc

SEQ ID NO: 1091410 - RNA, 18 nt, Human
ggagcuugcagugagccg

SEQ ID NO: 1091411 - RNA, 24 nt, Human
ggagcuugcagugagccgagaugg

SEQ ID NO: 1091412 - RNA, 21 nt, Human
ggaggcugagguggguggauc

SEQ ID NO: 1091413 - RNA, 22 nt, Human
ggaggcugagguggguggauca

SEQ ID NO: 1091414 - RNA, 24 nt, Human
ggaggugggcgccuguaaucccag

SEQ ID NO: 1091415 - RNA, 22 nt, Human
ggagguugcagggagccgagau

SEQ ID NO: 1091416 - RNA, 24 nt, Human
ggagguugcagggagccgagauug

SEQ ID NO: 1091417 - RNA, 18 nt, Human
ggagguugcagugagccg

SEQ ID NO: 1091418 - RNA, 22 nt, Human
ggaucacuugaggucaggaguu

SEQ ID NO: 1091419 - RNA, 25 nt, Human
ggcaccuguagucccagcuacucug

SEQ ID NO: 1091420 - RNA, 24 nt, Human
ggcaccuguagucccagcuacuug

SEQ ID NO: 1091421 - RNA, 21 nt, Human
ggcaggagggugggcaagugg

SEQ ID NO: 1091422 - RNA, 18 nt, Human
ggccccuccucugacucc

SEQ ID NO: 1091423 - RNA, 24 nt, Human
ggcuggucuugaacuccugaccuc

SEQ ID NO: 1091424 - RNA, 20 nt, Human
gggcaccuguagucccagcu

SEQ ID NO: 1091425 - RNA, 24 nt, Human
gggcauggugacucacgccuauaa

SEQ ID NO: 1091426 - RNA, 22 nt, Human
gggugccuguaaucccagcucc

SEQ ID NO: 1091427 - RNA, 24 nt, Human
gggugcgguugcucacgccuguaa

SEQ ID NO: 1091428 - RNA, 24 nt, Human
gggugugguagcgggcaccuguag

SEQ ID NO: 1091429 - RNA, 24 nt, Human
gguagcgggcaccuguagucccag

SEQ ID NO: 1091430 - RNA, 19 nt, Human
ggucaggaguuugagacca

SEQ ID NO: 1091431 - RNA, 19 nt, Human
ggucaggaguuugagacca

SEQ ID NO: 1091432 - RNA, 19 nt, Human
ggucuugaacuccugaccu

SEQ ID NO: 1091433 - RNA, 21 nt, Human
gguggaucaccugaggucagg

SEQ ID NO: 1091434 - RNA, 21 nt, Human
gguggaucacuugaggucagg

SEQ ID NO: 1091435 - RNA, 23 nt, Human
gguggcucacgccuguaauccca

SEQ ID NO: 1091436 - RNA, 24 nt, Human
gguggcucacgccuguaaucccag

SEQ ID NO: 1091437 - RNA, 20 nt, Human
ggugggcgccuguaauccca

SEQ ID NO: 1091438 - RNA, 21 nt, Human
guaauauuauuauccuccggg

SEQ ID NO: 1091439 - RNA, 21 nt, Human
guacagauucacuaucucaau

SEQ ID NO: 1091440 - RNA, 24 nt, Human
guacuccagccuaggcaacagagc

SEQ ID NO: 1091441 - RNA, 21 nt, Human
gugaaaccccgucacuacuaa

SEQ ID NO: 1091442 - RNA, 21 nt, Human
gugaaacccugugucuacuaa

SEQ ID NO: 1091443 - RNA, 24 nt, Human
gugauccacccgccucagccuccc

SEQ ID NO: 1091444 - RNA, 18 nt, Human
gugccuguaaucccagcu

SEQ ID NO: 1091445 - RNA, 21 nt, Human
gugccuuuggauuuggguccc

SEQ ID NO: 1091446 - RNA, 23 nt, Human
guugcucacgccuguaaucccag

SEQ ID NO: 1091447 - RNA, 25 nt, Human
uaaaaauacagaaaaacauuagccg

SEQ ID NO: 1091448 - RNA, 20 nt, Human
uaaaacuacaaaaauuagcc

SEQ ID NO: 1091449 - RNA, 18 nt, Human
uaaagcucccugggccuc

SEQ ID NO: 1091450 - RNA, 24 nt, Human
uaacaagauccuagaauggagaaa

SEQ ID NO: 1091451 - RNA, 24 nt, Human
uaacacgguaaaaccccgucucua

SEQ ID NO: 1091452 - RNA, 23 nt, Human
uaauaauaaaaagaauguccuuc

SEQ ID NO: 1091453 - RNA, 22 nt, Human
uaauggcaacaaacgugagacc

SEQ ID NO: 1091454 - RNA, 18 nt, Human
uacagaaaaacauuagcc

SEQ ID NO: 1091455 - RNA, 24 nt, Human
uacaggcgugagccacagcaccca

SEQ ID NO: 1091456 - RNA, 20 nt, Human
uacuaaaacuacaaaaauua

SEQ ID NO: 1091457 - RNA, 23 nt, Human
uacuccagccuaggcaacagagc

SEQ ID NO: 1091458 - RNA, 24 nt, Human
uacuccagccuaggcaacagagcg

SEQ ID NO: 1091459 - RNA, 19 nt, Human
uacucuggaggcugaggca

SEQ ID NO: 1091460 - RNA, 20 nt, Human
uacugacugugugccagguc

SEQ ID NO: 1091461 - RNA, 21 nt, Human
uacugcagucacuuuggccac

SEQ ID NO: 1091462 - RNA, 23 nt, Human
uaggucacaaaaacagaguuuga

SEQ ID NO: 1091463 - RNA, 21 nt, Human
uagugugcucuauuagguagu

SEQ ID NO: 1091464 - RNA, 18 nt, Human
uauccaggcugaccccau

SEQ ID NO: 1091465 - RNA, 19 nt, Human
uauucaaaucaucuccauc

SEQ ID NO: 1091466 - RNA, 25 nt, Human
ucaaaaaaaaaaaaaaaaagggaau

SEQ ID NO: 1091467 - RNA, 21 nt, Human
ucaaacacagcgaagugcagc

SEQ ID NO: 1091468 - RNA, 24 nt, Human
ucacgagggcaggagaucgagacc

SEQ ID NO: 1091469 - RNA, 21 nt, Human
ucacgccuguaaucccagcau

SEQ ID NO: 1091470 - RNA, 23 nt, Human
ucacugcaaccuccgccuuccgg

SEQ ID NO: 1091471 - RNA, 24 nt, Human
ucacugcaaccuccgccuuccggg

SEQ ID NO: 1091472 - RNA, 25 nt, Human
ucacugcaaccuccgccuuccgggu

SEQ ID NO: 1091473 - RNA, 26 nt, Human
ucacugcaaccuccgccuuccggguu

SEQ ID NO: 1091474 - RNA, 25 nt, Human
ucacugcguuuuagagacauuaagc

SEQ ID NO: 1091475 - RNA, 23 nt, Human
ucacugcuuaacaagauccuaga

SEQ ID NO: 1091476 - RNA, 22 nt, Human
ucagaguggaagagaaauuuau

SEQ ID NO: 1091477 - RNA, 20 nt, Human
ucaggagguggagguugcag

SEQ ID NO: 1091478 - RNA, 19 nt, Human
ucauuugaagucaggaguu

SEQ ID NO: 1091479 - RNA, 21 nt, Human
uccacccgccucagccuccca

SEQ ID NO: 1091480 - RNA, 22 nt, Human
uccacccgccucagccucccag

SEQ ID NO: 1091481 - RNA, 23 nt, Human
uccagccuaggcaacagagcgag

SEQ ID NO: 1091482 - RNA, 23 nt, Human
uccagccugggcgacagagcgag

SEQ ID NO: 1091483 - RNA, 24 nt, Human
uccagccugggcgacagagcgaga

SEQ ID NO: 1091484 - RNA, 23 nt, Human
uccaucucaaaaaaaaaaaaaaa

SEQ ID NO: 1091485 - RNA, 19 nt, Human
ucccaaaugccggccucca

SEQ ID NO: 1091486 - RNA, 24 nt, Human
ucccagagugcugggauuacaggc

SEQ ID NO: 1091487 - RNA, 20 nt, Human
ucccuugaacucaggaggug

SEQ ID NO: 1091488 - RNA, 24 nt, Human
uccgccuuccggguucaagcaauu

SEQ ID NO: 1091489 - RNA, 22 nt, Human
uccgccuuccggguucaagccg

SEQ ID NO: 1091490 - RNA, 20 nt, Human
uccgccuuuuggcaacacug

SEQ ID NO: 1091491 - RNA, 22 nt, Human
ucgcccaggcuggaguguagug

SEQ ID NO: 1091492 - RNA, 24 nt, Human
ucgcucugucgcccaggcuggagu

SEQ ID NO: 1091493 - RNA, 24 nt, Human
ucgcuugaacccgggagguggagg

SEQ ID NO: 1091494 - RNA, 24 nt, Human
ucuagccugggcgacagagugaga

SEQ ID NO: 1091495 - RNA, 19 nt, Human
ucucaaaaauaaauaaaua

SEQ ID NO: 1091496 - RNA, 19 nt, Human
ucucgcucugucgcccagg

SEQ ID NO: 1091497 - RNA, 23 nt, Human
ucucgcucugucgcccaggcugg

SEQ ID NO: 1091498 - RNA, 24 nt, Human
ucucgcucugucgcccaggcugga

SEQ ID NO: 1091499 - RNA, 26 nt, Human
ucucgcucugucgcccaggcuggagu

SEQ ID NO: 1091500 - RNA, 22 nt, Human
ucucuacuaaaaauacagaaaa

SEQ ID NO: 1091501 - RNA, 23 nt, Human
ucucuauuaaaaauacaaaaauu

SEQ ID NO: 1091502 - RNA, 24 nt, Human
ucucucugaguucaggagcauuua

SEQ ID NO: 1091503 - RNA, 23 nt, Human
ucugccaggcccaccuuucccca

SEQ ID NO: 1091504 - RNA, 24 nt, Human
ucugucgcccaggcuggaguguag

SEQ ID NO: 1091505 - RNA, 19 nt, Human
ucuugaacuccugaccucg

SEQ ID NO: 1091506 - RNA, 18 nt, Human
ugaaaggagaaguagccc

SEQ ID NO: 1091507 - RNA, 22 nt, Human
ugacucacgccuauaaucccag

SEQ ID NO: 1091508 - RNA, 24 nt, Human
ugacucacgccuauaaucccagca

SEQ ID NO: 1091509 - RNA, 19 nt, Human
ugacugugauuuuuaaaca

SEQ ID NO: 1091510 - RNA, 26 nt, Human
ugagaauaauaaaugauagauaccau

SEQ ID NO: 1091511 - RNA, 20 nt, Human
ugagacaggagaaucgcuug

SEQ ID NO: 1091512 - RNA, 24 nt, Human
ugagacaggagaaucgcuugaacc

SEQ ID NO: 1091513 - RNA, 23 nt, Human
ugagaccagccuggccaacaugg

SEQ ID NO: 1091514 - RNA, 23 nt, Human
ugagaccagccuggccaacaugg

SEQ ID NO: 1091515 - RNA, 24 nt, Human
ugagaccagccuggccaacauggu

SEQ ID NO: 1091516 - RNA, 23 nt, Human
ugagaccagccuggccaauaugg

SEQ ID NO: 1091517 - RNA, 24 nt, Human
ugagaccagccuggccaauauggu

SEQ ID NO: 1091518 - RNA, 21 nt, Human
ugagagcuggcauucacugaa

SEQ ID NO: 1091519 - RNA, 22 nt, Human
ugagccgagauggcgccacugc

SEQ ID NO: 1091520 - RNA, 18 nt, Human
ugagccgugaucucgcca

SEQ ID NO: 1091521 - RNA, 23 nt, Human
ugaggcaggacaauggcgugaac

SEQ ID NO: 1091522 - RNA, 24 nt, Human
ugaggcaggacaauggcgugaacc

SEQ ID NO: 1091523 - RNA, 19 nt, Human
ugaggcaggagaaucccuu

SEQ ID NO: 1091524 - RNA, 23 nt, Human
ugaggcaggagaaucccuugaac

SEQ ID NO: 1091525 - RNA, 24 nt, Human
ugaggcaggagaaucccuugaacu

SEQ ID NO: 1091526 - RNA, 25 nt, Human
ugaggcaggagaaucccuugaacuc

SEQ ID NO: 1091527 - RNA, 24 nt, Human
ugaggcaugucuucugccaggccc

SEQ ID NO: 1091528 - RNA, 18 nt, Human
ugaggucaggaguuugag

SEQ ID NO: 1091529 - RNA, 18 nt, Human
ugaggucaggaguuugag

SEQ ID NO: 1091530 - RNA, 20 nt, Human
ugagguggguggaucaccug

SEQ ID NO: 1091531 - RNA, 24 nt, Human
ugagguggguggaucaccugaggu

SEQ ID NO: 1091532 - RNA, 18 nt, Human
ugagucaggagaacacag

SEQ ID NO: 1091533 - RNA, 18 nt, Human
ugagugaagacuucccag

SEQ ID NO: 1091534 - RNA, 18 nt, Human
ugaguucaggagcauuua

SEQ ID NO: 1091535 - RNA, 21 nt, Human
ugauaaugaaaggaagaagaa

SEQ ID NO: 1091536 - RNA, 26 nt, Human
ugaucacagaaguaaaacaugacugg

SEQ ID NO: 1091537 - RNA, 21 nt, Human
ugcaccacuguacuccagccu

SEQ ID NO: 1091538 - RNA, 19 nt, Human
ugcacuccagccuaggcaa

SEQ ID NO: 1091539 - RNA, 22 nt, Human
ugcacuccagccuaggcaacaa

SEQ ID NO: 1091540 - RNA, 22 nt, Human
ugcagugagccgugaucucgcc

SEQ ID NO: 1091541 - RNA, 24 nt, Human
ugccacagccuccugaguagcuag

SEQ ID NO: 1091542 - RNA, 21 nt, Human
ugccuguaaucccagcuccuc

SEQ ID NO: 1091543 - RNA, 23 nt, Human
ugccuguaaucccagcuccucgg

SEQ ID NO: 1091544 - RNA, 24 nt, Human
ugccuguaaucccagcuccucggg

SEQ ID NO: 1091545 - RNA, 22 nt, Human
ugcuacagaauugcuugaaccc

SEQ ID NO: 1091546 - RNA, 23 nt, Human
ugcugcugggugccuuuggauuu

SEQ ID NO: 1091547 - RNA, 25 nt, Human
ugcugggauuacaggcgugagccac

SEQ ID NO: 1091548 - RNA, 19 nt, Human
ugcuuagaacagugccugg

SEQ ID NO: 1091549 - RNA, 19 nt, Human
uggaggcugaggugggugg

SEQ ID NO: 1091550 - RNA, 19 nt, Human
uggagucagcucugcccgg

SEQ ID NO: 1091551 - RNA, 23 nt, Human
uggaucaccugaggucaggaguu

SEQ ID NO: 1091552 - RNA, 24 nt, Human
uggaucaccugaggucaggaguuu

SEQ ID NO: 1091553 - RNA, 27 nt, Human
uggaucaccugaggucaggaguuugag

SEQ ID NO: 1091554 - RNA, 23 nt, Human
uggaucacuugaggucaggaguu

SEQ ID NO: 1091555 - RNA, 24 nt, Human
uggaucacuugaggucaggaguuu

SEQ ID NO: 1091556 - RNA, 27 nt, Human
uggaucacuugaggucaggaguuugag

SEQ ID NO: 1091557 - RNA, 23 nt, Human
uggaucauuugaagucaggaguu

SEQ ID NO: 1091558 - RNA, 24 nt, Human
uggaucauuugaagucaggaguuu

SEQ ID NO: 1091559 - RNA, 24 nt, Human
uggcaaggcuggucuugaacuccu

SEQ ID NO: 1091560 - RNA, 24 nt, Human
uggccaacauggugaaaccccguc

SEQ ID NO: 1091561 - RNA, 24 nt, Human
uggccaacauggugaaaccccguc

SEQ ID NO: 1091562 - RNA, 25 nt, Human
uggccaauauggugaaacccugugu

SEQ ID NO: 1091563 - RNA, 22 nt, Human
uggcucacaccuauaaucccag

SEQ ID NO: 1091564 - RNA, 24 nt, Human
uggcucacaccuauaaucccagca

SEQ ID NO: 1091565 - RNA, 22 nt, Human
uggcucacgccuguaaucccag

SEQ ID NO: 1091566 - RNA, 24 nt, Human
uggcucacgccuguaaucccagca

SEQ ID NO: 1091567 - RNA, 24 nt, Human
ugggaggccaaggcggguggauca

SEQ ID NO: 1091568 - RNA, 23 nt, Human
ugggaggccaagguggguggauc

SEQ ID NO: 1091569 - RNA, 24 nt, Human
ugggaggccaagguggguggauca

SEQ ID NO: 1091570 - RNA, 19 nt, Human
ugggaggccgaggcgggcg

SEQ ID NO: 1091571 - RNA, 24 nt, Human
ugggaggccgaggcgggcggauca

SEQ ID NO: 1091572 - RNA, 23 nt, Human
ugggauauuuugggguguauguu

SEQ ID NO: 1091573 - RNA, 19 nt, Human
ugggauggugggugccugu

SEQ ID NO: 1091574 - RNA, 18 nt, Human
ugggauuacaggcgugag

SEQ ID NO: 1091575 - RNA, 19 nt, Human
ugggauuacaggcgugagc

SEQ ID NO: 1091576 - RNA, 21 nt, Human
ugggauuacaggcgugagcca

SEQ ID NO: 1091577 - RNA, 22 nt, Human
ugggauuacaggcgugagccac

SEQ ID NO: 1091578 - RNA, 22 nt, Human
ugggauuacaggcgugagccac

SEQ ID NO: 1091579 - RNA, 23 nt, Human
ugggauuacaggcgugagccaca

SEQ ID NO: 1091580 - RNA, 24 nt, Human
ugggauuacaggcgugagccacag

SEQ ID NO: 1091581 - RNA, 26 nt, Human
ugggauuacaggcgugagccacagca

SEQ ID NO: 1091582 - RNA, 27 nt, Human
ugggauuacaggcgugagccacagcac

SEQ ID NO: 1091583 - RNA, 24 nt, Human
ugggauucuaacaaacacagucug

SEQ ID NO: 1091584 - RNA, 24 nt, Human
ugguagcgggcaccuguaguccca

SEQ ID NO: 1091585 - RNA, 21 nt, Human
uggugggcaccuguaguccca

SEQ ID NO: 1091586 - RNA, 22 nt, Human
uggugggcaccuguagucccag

SEQ ID NO: 1091587 - RNA, 21 nt, Human
uggugggugccuguaauccca

SEQ ID NO: 1091588 - RNA, 22 nt, Human
uguaguggcgccaucuuggcuc

SEQ ID NO: 1091589 - RNA, 23 nt, Human
ugucuacuaaaacuacaaaaauu

SEQ ID NO: 1091590 - RNA, 19 nt, Human
uuaacauauggugggcagg

SEQ ID NO: 1091591 - RNA, 24 nt, Human
uuagcagggcauggugacucacgc

SEQ ID NO: 1091592 - RNA, 18 nt, Human
uuagcuggguguggaggu

SEQ ID NO: 1091593 - RNA, 24 nt, Human
uuagcuggguguggaggugggcgc

SEQ ID NO: 1091594 - RNA, 19 nt, Human
uuccagacaccugccacca

SEQ ID NO: 1091595 - RNA, 23 nt, Human
uuccggguucaagcaauucucug

SEQ ID NO: 1091596 - RNA, 18 nt, Human
uuccucaucuguagccug

SEQ ID NO: 1091597 - RNA, 24 nt, Human
uugaacccgggagguggagguugc

SEQ ID NO: 1091598 - RNA, 24 nt, Human
uugaacucaggagguggagguugc

SEQ ID NO: 1091599 - RNA, 22 nt, Human
uugcagggagccgagauugugc

SEQ ID NO: 1091600 - RNA, 18 nt, Human
uugcagugagccgagaug

SEQ ID NO: 1091601 - RNA, 22 nt, Human
uugcagugagccgagauggcgc

SEQ ID NO: 1091602 - RNA, 22 nt, Human
uugcagugagccgugaucucgc

SEQ ID NO: 1091603 - RNA, 22 nt, Human
uugcggugcgccgagacugcac

SEQ ID NO: 1091604 - RNA, 24 nt, Human
uugcucacgccuguaaucccagca

SEQ ID NO: 1091605 - RNA, 18 nt, Human
uugcuugaacccaggagg

SEQ ID NO: 1091606 - RNA, 22 nt, Human
uugcuugaacccaggaggcagg

SEQ ID NO: 1091607 - RNA, 24 nt, Human
uuggaggcugagguggguggauca

SEQ ID NO: 1091608 - RNA, 19 nt, Human
uuggcaaggcuggucuuga

SEQ ID NO: 1091609 - RNA, 21 nt, Human
uuggccacucucucuuccaug

SEQ ID NO: 1091610 - RNA, 25 nt, Human
uuggguggcugagacaggagaaucg

SEQ ID NO: 1091611 - RNA, 20 nt, Human
aaacagagaacggagaccca

SEQ ID NO: 1091612 - RNA, 20 nt, Human
acagccgucccccauccccu

SEQ ID NO: 1091613 - RNA, 18 nt, Human
accugcugcagccacagg

SEQ ID NO: 1091614 - RNA, 18 nt, Human
agagaaagagggcagaga

SEQ ID NO: 1091615 - RNA, 20 nt, Human
agagggcagagagcacggga

SEQ ID NO: 1091616 - RNA, 20 nt, Human
agagguuucuagagaaagag

SEQ ID NO: 1091617 - RNA, 23 nt, Human
agagguuucuagagaaagagggc

SEQ ID NO: 1091618 - RNA, 21 nt, Human
aggaaguggggaugagaccua

SEQ ID NO: 1091619 - RNA, 20 nt, Human
aggaaugugagagcugugcu

SEQ ID NO: 1091620 - RNA, 19 nt, Human
aggacagagaaccaaacag

SEQ ID NO: 1091621 - RNA, 23 nt, Human
aggacagagaaccaaacagagaa

SEQ ID NO: 1091622 - RNA, 21 nt, Human
aggagaaagggggcaggagaa

SEQ ID NO: 1091623 - RNA, 19 nt, Human
aggaggagguggggaaaag

SEQ ID NO: 1091624 - RNA, 21 nt, Human
aggcacugcagguccaccagc

SEQ ID NO: 1091625 - RNA, 19 nt, Human
aggcagcagggagagguuu

SEQ ID NO: 1091626 - RNA, 25 nt, Human
auacacacacacacgugugcucaca

SEQ ID NO: 1091627 - RNA, 20 nt, Human
augccagagcuguucaugau

SEQ ID NO: 1091628 - RNA, 24 nt, Human
auggcauuugguggaaggcugggg

SEQ ID NO: 1091629 - RNA, 25 nt, Human
auucggugcaagaaagcgcagggag

SEQ ID NO: 1091630 - RNA, 18 nt, Human
caaacagagaacggagac

SEQ ID NO: 1091631 - RNA, 20 nt, Human
cacagcuucaccauagcaac

SEQ ID NO: 1091632 - RNA, 21 nt, Human
caccaccucucucgcgcucuc

SEQ ID NO: 1091633 - RNA, 18 nt, Human
caccggggcugcaugcag

SEQ ID NO: 1091634 - RNA, 22 nt, Human
caccucucucgcgcucucgguc

SEQ ID NO: 1091635 - RNA, 23 nt, Human
cacuaucaugaggggucugaggu

SEQ ID NO: 1091636 - RNA, 22 nt, Human
cacuuggcuuucccaguugcac

SEQ ID NO: 1091637 - RNA, 27 nt, Human
cagaaccccagagaggcagcagggaga

SEQ ID NO: 1091638 - RNA, 19 nt, Human
cagaaggcacacacccaag

SEQ ID NO: 1091639 - RNA, 19 nt, Human
cagcagggagagguuucua

SEQ ID NO: 1091640 - RNA, 23 nt, Human
cagcucuacagccccggaggggu

SEQ ID NO: 1091641 - RNA, 19 nt, Human
cagcugcgcccccccgccc

SEQ ID NO: 1091642 - RNA, 22 nt, Human
cagcugcgcccccccgcccccg

SEQ ID NO: 1091643 - RNA, 18 nt, Human
caguugcacucagcucuc

SEQ ID NO: 1091644 - RNA, 27 nt, Human
cauacacacacacacgugugcucacau

SEQ ID NO: 1091645 - RNA, 28 nt, Human
cauccucucccuccuucccucucucucu

SEQ ID NO: 1091646 - RNA, 23 nt, Human
caugcacaaacaggcccauccac

SEQ ID NO: 1091647 - RNA, 23 nt, Human
ccacacucaaacugggcuuccag

SEQ ID NO: 1091648 - RNA, 22 nt, Human
ccagccccggaguuucccggcu

SEQ ID NO: 1091649 - RNA, 18 nt, Human
ccaggagauggccccacc

SEQ ID NO: 1091650 - RNA, 28 nt, Human
ccauacacacacacacgugugcucacau

SEQ ID NO: 1091651 - RNA, 22 nt, Human
ccaugccugacuaguaaaacag

SEQ ID NO: 1091652 - RNA, 23 nt, Human
cccacacucaaacugggcuucca

SEQ ID NO: 1091653 - RNA, 19 nt, Human
cccacagagguucgguggc

SEQ ID NO: 1091654 - RNA, 19 nt, Human
cccaggagauggccccacc

SEQ ID NO: 1091655 - RNA, 18 nt, Human
cccauacacacacacacg

SEQ ID NO: 1091656 - RNA, 19 nt, Human
cccauacacacacacacgu

SEQ ID NO: 1091657 - RNA, 28 nt, Human
cccauacacacacacacgugugcucaca

SEQ ID NO: 1091658 - RNA, 22 nt, Human
cccccccgcccccgcccccacc

SEQ ID NO: 1091659 - RNA, 20 nt, Human
ccccccgcccccgcccccac

SEQ ID NO: 1091660 - RNA, 21 nt, Human
cccccgcccccgcccccaccc

SEQ ID NO: 1091661 - RNA, 22 nt, Human
ccccugccagccugcaccaccu

SEQ ID NO: 1091662 - RNA, 23 nt, Human
ccccuggggugugggggccacgg

SEQ ID NO: 1091663 - RNA, 22 nt, Human
cccgcccccgcccccacccuac

SEQ ID NO: 1091664 - RNA, 23 nt, Human
cccgcucuccauccucucccucc

SEQ ID NO: 1091665 - RNA, 19 nt, Human
cccuccuucccucucucuc

SEQ ID NO: 1091666 - RNA, 27 nt, Human
cccugccagccugcaccaccucucucg

SEQ ID NO: 1091667 - RNA, 18 nt, Human
cccuggggccagccccgg

SEQ ID NO: 1091668 - RNA, 20 nt, Human
ccucacucuccccgcucucc

SEQ ID NO: 1091669 - RNA, 20 nt, Human
ccugcugcagccacaggccc

SEQ ID NO: 1091670 - RNA, 22 nt, Human
ccuugggcugguaacuugccuc

SEQ ID NO: 1091671 - RNA, 22 nt, Human
ccuuguugcugaauuacaccuc

SEQ ID NO: 1091672 - RNA, 19 nt, Human
cggaggacaggaggaggug

SEQ ID NO: 1091673 - RNA, 20 nt, Human
cucacucuccccgcucucca

SEQ ID NO: 1091674 - RNA, 22 nt, Human
cuccaagccaagcacuuggcuu

SEQ ID NO: 1091675 - RNA, 22 nt, Human
cucggguucuccucuccuaagg

SEQ ID NO: 1091676 - RNA, 25 nt, Human
cucucccuccuucccucucucucug

SEQ ID NO: 1091677 - RNA, 22 nt, Human
cugacuaguaaaacagccgucc

SEQ ID NO: 1091678 - RNA, 21 nt, Human
cugcacccuaguggccagcag

SEQ ID NO: 1091679 - RNA, 18 nt, Human
cuggcggcuucccagccc

SEQ ID NO: 1091680 - RNA, 20 nt, Human
cuuccaggaguaaagggcca

SEQ ID NO: 1091681 - RNA, 18 nt, Human
cuugcucucaugcucugu

SEQ ID NO: 1091682 - RNA, 23 nt, Human
cuugggcugguaacuugccucug

SEQ ID NO: 1091683 - RNA, 20 nt, Human
gaaagaccuuucauggcauu

SEQ ID NO: 1091684 - RNA, 25 nt, Human
gaaccaaacagagaacggagaccca

SEQ ID NO: 1091685 - RNA, 19 nt, Human
gaaggcuggggguugcugg

SEQ ID NO: 1091686 - RNA, 21 nt, Human
gagagguuucuagagaaagag

SEQ ID NO: 1091687 - RNA, 22 nt, Human
gagagucagugcugggggcagc

SEQ ID NO: 1091688 - RNA, 19 nt, Human
gagcuagcuuguugaccuu

SEQ ID NO: 1091689 - RNA, 18 nt, Human
gagcuggcggcuucccag

SEQ ID NO: 1091690 - RNA, 19 nt, Human
gagggggacaaagacucag

SEQ ID NO: 1091691 - RNA, 20 nt, Human
gagggggacaaagacucagg

SEQ ID NO: 1091692 - RNA, 18 nt, Human
gauugugggcgguugcuc

SEQ ID NO: 1091693 - RNA, 20 nt, Human
gcacccuaguggccagcagc

SEQ ID NO: 1091694 - RNA, 24 nt, Human
gcacgggagaggaguuagaaacac

SEQ ID NO: 1091695 - RNA, 25 nt, Human
gcagaaccccagagaggcagcaggg

SEQ ID NO: 1091696 - RNA, 20 nt, Human
gcagcagggagagguuucua

SEQ ID NO: 1091697 - RNA, 21 nt, Human
gcaggagaaagggaaaagggg

SEQ ID NO: 1091698 - RNA, 19 nt, Human
gcagggagagguuucuaga

SEQ ID NO: 1091699 - RNA, 21 nt, Human
gccacaggcccgcuucauuca

SEQ ID NO: 1091700 - RNA, 21 nt, Human
gcccauccacacagacacaca

SEQ ID NO: 1091701 - RNA, 24 nt, Human
gccccggaguuucccggcuaacac

SEQ ID NO: 1091702 - RNA, 26 nt, Human
gccugccccugccagccugcaccacc

SEQ ID NO: 1091703 - RNA, 18 nt, Human
gccuggggucccacaggc

SEQ ID NO: 1091704 - RNA, 18 nt, Human
gcgggccggcaaagaugg

SEQ ID NO: 1091705 - RNA, 23 nt, Human
gcuaaagccugggccguuacugc

SEQ ID NO: 1091706 - RNA, 20 nt, Human
ggaauuccucccauacacac

SEQ ID NO: 1091707 - RNA, 18 nt, Human
ggagacccaggagauggc

SEQ ID NO: 1091708 - RNA, 18 nt, Human
ggaggacagagaaccaaa

SEQ ID NO: 1091709 - RNA, 18 nt, Human
ggcagagucccaaagagg

SEQ ID NO: 1091710 - RNA, 22 nt, Human
ggccaggcacacauggcuucuu

SEQ ID NO: 1091711 - RNA, 21 nt, Human
gggaaggaaugugagagcugu

SEQ ID NO: 1091712 - RNA, 20 nt, Human
gggacaaagacucagggaag

SEQ ID NO: 1091713 - RNA, 22 nt, Human
gggacaaagacucagggaagga

SEQ ID NO: 1091714 - RNA, 23 nt, Human
gggcagaaggcacacacccaaga

SEQ ID NO: 1091715 - RNA, 22 nt, Human
gggcagcagaaccccagagagg

SEQ ID NO: 1091716 - RNA, 21 nt, Human
gggggcagcagaaccccagag

SEQ ID NO: 1091717 - RNA, 21 nt, Human
gggguggccugcgacgaugac

SEQ ID NO: 1091718 - RNA, 18 nt, Human
ggugcaagaaagcgcagg

SEQ ID NO: 1091719 - RNA, 21 nt, Human
ggugguggugauggugaccgu

SEQ ID NO: 1091720 - RNA, 22 nt, Human
gucaccaaaccaauagcugcau

SEQ ID NO: 1091721 - RNA, 18 nt, Human
gucuggcagguccacuca

SEQ ID NO: 1091722 - RNA, 21 nt, Human
gugacugucacuuacucauuu

SEQ ID NO: 1091723 - RNA, 22 nt, Human
uaaaacagccgucccccauccc

SEQ ID NO: 1091724 - RNA, 18 nt, Human
uaacaagagaggguggca

SEQ ID NO: 1091725 - RNA, 24 nt, Human
uaacacagugcugaucaugaaggu

SEQ ID NO: 1091726 - RNA, 20 nt, Human
uaccuggaggggaggauggu

SEQ ID NO: 1091727 - RNA, 26 nt, Human
uaccuggaggggaggauggugccugc

SEQ ID NO: 1091728 - RNA, 24 nt, Human
uagaaacacagagagaggaggaca

SEQ ID NO: 1091729 - RNA, 23 nt, Human
uagcaacgcucagcugcgccccc

SEQ ID NO: 1091730 - RNA, 23 nt, Human
uaggaacaugccugcccccugaa

SEQ ID NO: 1091731 - RNA, 18 nt, Human
uaucugaggcuccaagcc

SEQ ID NO: 1091732 - RNA, 22 nt, Human
ucacaugcacaaacaggcccau

SEQ ID NO: 1091733 - RNA, 27 nt, Human
ucaccauagcaacgcucagcugcgccc

SEQ ID NO: 1091734 - RNA, 19 nt, Human
ucagggaaggaagugggga

SEQ ID NO: 1091735 - RNA, 21 nt, Human
ucagggaaggaaguggggaug

SEQ ID NO: 1091736 - RNA, 21 nt, Human
ucaugaagguggugguggugg

SEQ ID NO: 1091737 - RNA, 20 nt, Human
uccauccucucccuccuucc

SEQ ID NO: 1091738 - RNA, 26 nt, Human
ucccacacucaaacugggcuuccagu

SEQ ID NO: 1091739 - RNA, 19 nt, Human
ucccauacacacacacacg

SEQ ID NO: 1091740 - RNA, 18 nt, Human
uccccuggggccagcccc

SEQ ID NO: 1091741 - RNA, 20 nt, Human
uccccuggggugugggggcc

SEQ ID NO: 1091742 - RNA, 24 nt, Human
ucccugggcuugccaugccugacu

SEQ ID NO: 1091743 - RNA, 20 nt, Human
ucucccuccuucccucucuc

SEQ ID NO: 1091744 - RNA, 22 nt, Human
ucucuaccugcugcagccacag

SEQ ID NO: 1091745 - RNA, 24 nt, Human
ucugucucucucccucacucuccc

SEQ ID NO: 1091746 - RNA, 18 nt, Human
ugacuuccaggggucccu

SEQ ID NO: 1091747 - RNA, 20 nt, Human
ugaggaacuucucucagcuu

SEQ ID NO: 1091748 - RNA, 21 nt, Human
ugagugcccaacgggaccagg

SEQ ID NO: 1091749 - RNA, 27 nt, Human
ugccagccugcaccaccucucucgcgc

SEQ ID NO: 1091750 - RNA, 21 nt, Human
ugccccugccagccugcacug

SEQ ID NO: 1091751 - RNA, 22 nt, Human
ugccugagccuuucccauucau

SEQ ID NO: 1091752 - RNA, 24 nt, Human
ugcucguguguggguugugaucag

SEQ ID NO: 1091753 - RNA, 18 nt, Human
ugcugcagccacaggccc

SEQ ID NO: 1091754 - RNA, 20 nt, Human
ugcuuuuggcacugaaauug

SEQ ID NO: 1091755 - RNA, 18 nt, Human
uggaaggcuggggguugc

SEQ ID NO: 1091756 - RNA, 24 nt, Human
uggaaggcuggggguugcuggagg

SEQ ID NO: 1091757 - RNA, 23 nt, Human
uggagggggacaaagacucaggg

SEQ ID NO: 1091758 - RNA, 24 nt, Human
uggcacugaaauugcccccagcca

SEQ ID NO: 1091759 - RNA, 18 nt, Human
ugggcaucucuaccugcu

SEQ ID NO: 1091760 - RNA, 20 nt, Human
uggggguugcuggaggaaac

SEQ ID NO: 1091761 - RNA, 18 nt, Human
ugguaacuugccucugcc

SEQ ID NO: 1091762 - RNA, 25 nt, Human
ugguggaaggcuggggguugcugga

SEQ ID NO: 1091763 - RNA, 27 nt, Human
uggugguggugauggugaccgugacug

SEQ ID NO: 1091764 - RNA, 20 nt, Human
uggugguggugguggugaug

SEQ ID NO: 1091765 - RNA, 20 nt, Human
uggugguggugguggugguc

SEQ ID NO: 1091766 - RNA, 20 nt, Human
ugguggugguggugguggug

SEQ ID NO: 1091767 - RNA, 20 nt, Human
ugugcucguguguggguugu

SEQ ID NO: 1091768 - RNA, 18 nt, Human
uguugaccuugggcuggu

SEQ ID NO: 1091769 - RNA, 29 nt, Human
uuccucccauacacacacacacguggugu

SEQ ID NO: 1091770 - RNA, 23 nt, Human
uuggcacugaaauugcccccagc

SEQ ID NO: 1091771 - RNA, 21 nt, Human
uuuccaagcccuuccuuggcc

SEQ ID NO: 1091772 - RNA, 21 nt, Human
uuucuucggaggacaggagga

SEQ ID NO: 1091773 - RNA, 21 nt, Human
uuuuggcacugaaauugcccc

SEQ ID NO: 1091774 - RNA, 22 nt, Human
aacacaaauaugguaauaccau

SEQ ID NO: 1091775 - RNA, 21 nt, Human
aacagcauccauugccucagu

SEQ ID NO: 1091776 - RNA, 26 nt, Human
aagugcaagucugaagggccuagagc

SEQ ID NO: 1091777 - RNA, 21 nt, Human
acagagcagggagagaaacag

SEQ ID NO: 1091778 - RNA, 22 nt, Human
acagagcagggagagaaacagc

SEQ ID NO: 1091779 - RNA, 24 nt, Human
agaacagcccuggguuccugccaa

SEQ ID NO: 1091780 - RNA, 18 nt, Human
agacaaguacauaucucu

SEQ ID NO: 1091781 - RNA, 20 nt, Human
agaguguucauuggauaaaa

SEQ ID NO: 1091782 - RNA, 21 nt, Human
agcaaggagguuuggaagaga

SEQ ID NO: 1091783 - RNA, 26 nt, Human
agcugaaccuugacagaacagcccug

SEQ ID NO: 1091784 - RNA, 20 nt, Human
agggcgcugucagaacuucc

SEQ ID NO: 1091785 - RNA, 22 nt, Human
aucucuguggcaaaaccaggaa

SEQ ID NO: 1091786 - RNA, 22 nt, Human
auggggcuaggcagaagguggc

SEQ ID NO: 1091787 - RNA, 26 nt, Human
caaccaguccccaugccaggcggcca

SEQ ID NO: 1091788 - RNA, 18 nt, Human
cacccuuaucucagagcu

SEQ ID NO: 1091789 - RNA, 18 nt, Human
cacucugugacccaaucc

SEQ ID NO: 1091790 - RNA, 18 nt, Human
cacucugugacccaaucu

SEQ ID NO: 1091791 - RNA, 19 nt, Human
cagcauccauugccucagu

SEQ ID NO: 1091792 - RNA, 18 nt, Human
cagcccuggguuccugcc

SEQ ID NO: 1091793 - RNA, 26 nt, Human
cauagacaaguagaaaacuaaaauca

SEQ ID NO: 1091794 - RNA, 19 nt, Human
caucaggauaggagugggg

SEQ ID NO: 1091795 - RNA, 21 nt, Human
ccaggcggccaggcugggguc

SEQ ID NO: 1091796 - RNA, 21 nt, Human
cccaguggaggcugaaguaga

SEQ ID NO: 1091797 - RNA, 24 nt, Human
cccggcaggccccaugaauggacc

SEQ ID NO: 1091798 - RNA, 19 nt, Human
ccugcagcugaaccuugac

SEQ ID NO: 1091799 - RNA, 19 nt, Human
cgacaacacaaauauggua

SEQ ID NO: 1091800 - RNA, 25 nt, Human
cgacaacacaaauaugguaauacca

SEQ ID NO: 1091801 - RNA, 22 nt, Human
cggucugcccacagcuccucca

SEQ ID NO: 1091802 - RNA, 19 nt, Human
cucagagcuccgaucugac

SEQ ID NO: 1091803 - RNA, 20 nt, Human
gaaccuugacagaacagccc

SEQ ID NO: 1091804 - RNA, 19 nt, Human
gagcuccgaucugacgcaa

SEQ ID NO: 1091805 - RNA, 20 nt, Human
gagguuuggaagagaggaga

SEQ ID NO: 1091806 - RNA, 19 nt, Human
ggaagagaggagaguggag

SEQ ID NO: 1091807 - RNA, 20 nt, Human
ggccaggcuggggucggucu

SEQ ID NO: 1091808 - RNA, 22 nt, Human
ggcuuaguuuucugcccagugg

SEQ ID NO: 1091809 - RNA, 19 nt, Human
ggugaaaaugggcuuuaaa

SEQ ID NO: 1091810 - RNA, 26 nt, Human
gguuuggaagagaggagaguggaguu

SEQ ID NO: 1091811 - RNA, 19 nt, Human
uaaaggcaaacuaaaguca

SEQ ID NO: 1091812 - RNA, 21 nt, Human
uacagaguguucauuggauaa

SEQ ID NO: 1091813 - RNA, 19 nt, Human
uacagauuaaaggauaggg

SEQ ID NO: 1091814 - RNA, 21 nt, Human
uagaaaacuaaaaucaauaaa

SEQ ID NO: 1091815 - RNA, 19 nt, Human
uaggaguggggguuaggug

SEQ ID NO: 1091816 - RNA, 24 nt, Human
uagggugcaccauuuuuguaacuu

SEQ ID NO: 1091817 - RNA, 19 nt, Human
uagugaguuuucuuucucc

SEQ ID NO: 1091818 - RNA, 20 nt, Human
ucagagcuccgaucugacgc

SEQ ID NO: 1091819 - RNA, 23 nt, Human
ucaguuggaaaauggaguuggac

SEQ ID NO: 1091820 - RNA, 24 nt, Human
uccaaagcaaggagguuuggaaga

SEQ ID NO: 1091821 - RNA, 20 nt, Human
ucccaggaacacccggcagg

SEQ ID NO: 1091822 - RNA, 23 nt, Human
ucugcccacagcuccuccagaga

SEQ ID NO: 1091823 - RNA, 18 nt, Human
ucuggggaugucugucug

SEQ ID NO: 1091824 - RNA, 21 nt, Human
ucuguggcaaaaccaggaaac

SEQ ID NO: 1091825 - RNA, 18 nt, Human
ugaauggaccuugggcca

SEQ ID NO: 1091826 - RNA, 21 nt, Human
ugaauggaccuugggccaaaa

SEQ ID NO: 1091827 - RNA, 22 nt, Human
ugaugaggaugaugguauuugg

SEQ ID NO: 1091828 - RNA, 21 nt, Human
ugccaaagauuucauuugaag

SEQ ID NO: 1091829 - RNA, 19 nt, Human
ugccuagcggcuuuucagc

SEQ ID NO: 1091830 - RNA, 24 nt, Human
uggaaggggcucugguccugcagc

SEQ ID NO: 1091831 - RNA, 21 nt, Human
uggaggcugaaguagagacag

SEQ ID NO: 1091832 - RNA, 18 nt, Human
uggcaaaaccaggaaaca

SEQ ID NO: 1091833 - RNA, 18 nt, Human
uggcacggucaugagaca

SEQ ID NO: 1091834 - RNA, 21 nt, Human
uggggguuagguggaaggggc

SEQ ID NO: 1091835 - RNA, 23 nt, Human
ugguaauaccauuuagguggcac

SEQ ID NO: 1091836 - RNA, 20 nt, Human
uggugagaaaccacagcaga

SEQ ID NO: 1091837 - RNA, 22 nt, Human
uggugaugaucaugcccuggcc

SEQ ID NO: 1091838 - RNA, 18 nt, Human
ugugacccaaucucugug

SEQ ID NO: 1091839 - RNA, 20 nt, Human
uguuucuuuugaagaaacca

SEQ ID NO: 1091840 - RNA, 20 nt, Human
uguuuuuuuuuaaagaaagg

SEQ ID NO: 1091841 - RNA, 19 nt, Human
uuaaaggauagggugcacc

SEQ ID NO: 1091842 - RNA, 21 nt, Human
uucaaaccaagaggcgacaac

SEQ ID NO: 1091843 - RNA, 21 nt, Human
uucugucaaauauuuguccaa

SEQ ID NO: 1091844 - RNA, 22 nt, Human
uugggauuuucugcccaucuuc

SEQ ID NO: 1091845 - RNA, 19 nt, Human
uuuggccucuucuggaagu

SEQ ID NO: 1091846 - RNA, 25 nt, Human
uuuuaaagaaaggaaaggaggaaua

SEQ ID NO: 1091847 - RNA, 23 nt, Human
ccaucaucaugacuaaaacccaa

SEQ ID NO: 1091848 - RNA, 21 nt, Human
uagcgugccacuggcccugca

SEQ ID NO: 1091849 - RNA, 18 nt, Human
agcagggugggacugggg

SEQ ID NO: 1091850 - RNA, 18 nt, Human
cagcagcagggugggacu

SEQ ID NO: 1091851 - RNA, 23 nt, Human
cagcagcagggugggacuggggc

SEQ ID NO: 1091852 - RNA, 18 nt, Human
cagggugggacuggggca

SEQ ID NO: 1091853 - RNA, 22 nt, Human
cugcagaaccuggaucuugcgc

SEQ ID NO: 1091854 - RNA, 19 nt, Human
gagcagcagcaggguggga

SEQ ID NO: 1091855 - RNA, 21 nt, Human
gaggagcagcagcaggguggg

SEQ ID NO: 1091856 - RNA, 21 nt, Human
gcagcagcagggugggacugg

SEQ ID NO: 1091857 - RNA, 28 nt, Human
ggagcagcagcagggugggacuggggca

SEQ ID NO: 1091858 - RNA, 22 nt, Human
gggaggagcagcagcagggugg

SEQ ID NO: 1091859 - RNA, 24 nt, Human
gggaggagcagcagcaggguggga

SEQ ID NO: 1091860 - RNA, 23 nt, Human
ugcucagccucuagcccagcugg

SEQ ID NO: 1091861 - RNA, 24 nt, Human
uuaaagacauuaugcauugugcuc

SEQ ID NO: 1091862 - RNA, 22 nt, Human
agccugcugcuuccuccagccu

SEQ ID NO: 1091863 - RNA, 23 nt, Human
uagccugcugcuuccuccagccu

SEQ ID NO: 1091864 - RNA, 24 nt, Human
uccuccagccugggaucaugggug

SEQ ID NO: 1091865 - RNA, 22 nt, Human
ugguccugaauuccgcuagccu

SEQ ID NO: 1091866 - RNA, 22 nt, Human
uuuguaaaguguguuuucuuua

SEQ ID NO: 1091867 - RNA, 22 nt, Human
aaaagccacccaggcccaaguc

SEQ ID NO: 1091868 - RNA, 24 nt, Human
aaacaaaaccaagaagcaggccug

SEQ ID NO: 1091869 - RNA, 24 nt, Human
aaacauccaagauaaguggaaaca

SEQ ID NO: 1091870 - RNA, 21 nt, Human
aaaggcuguuuaggaggacac

SEQ ID NO: 1091871 - RNA, 21 nt, Human
aacagacggaggugagccaga

SEQ ID NO: 1091872 - RNA, 22 nt, Human
aacuacugggcaagcaucugcc

SEQ ID NO: 1091873 - RNA, 20 nt, Human
aagaagagacaaaaagaaug

SEQ ID NO: 1091874 - RNA, 24 nt, Human
aagaagagacaaaaagaaugaggg

SEQ ID NO: 1091875 - RNA, 23 nt, Human
aagaagcaggccuggagggagca

SEQ ID NO: 1091876 - RNA, 22 nt, Human
aagaaugagggaggucugggag

SEQ ID NO: 1091877 - RNA, 18 nt, Human
aagugcugugcggucaca

SEQ ID NO: 1091878 - RNA, 23 nt, Human
aauaucagggguuucggaaggaa

SEQ ID NO: 1091879 - RNA, 18 nt, Human
acagacauccucccuguu

SEQ ID NO: 1091880 - RNA, 18 nt, Human
acauuugcaaacugggaa

SEQ ID NO: 1091881 - RNA, 19 nt, Human
accagcugcccucuccacc

SEQ ID NO: 1091882 - RNA, 20 nt, Human
accgggccguccccaagggc

SEQ ID NO: 1091883 - RNA, 24 nt, Human
acugcaguuucucaacaugugguc

SEQ ID NO: 1091884 - RNA, 21 nt, Human
agaaugagggaggucugggag

SEQ ID NO: 1091885 - RNA, 25 nt, Human
agacaaaaagaaugagggaggucug

SEQ ID NO: 1091886 - RNA, 19 nt, Human
agacaagauccggacaggc

SEQ ID NO: 1091887 - RNA, 18 nt, Human
agacagagccccagcgcg

SEQ ID NO: 1091888 - RNA, 18 nt, Human
agacggaggugagccaga

SEQ ID NO: 1091889 - RNA, 20 nt, Human
agccacugcagaucacuucg

SEQ ID NO: 1091890 - RNA, 18 nt, Human
agccagaguggcaagugc

SEQ ID NO: 1091891 - RNA, 22 nt, Human
agccgagccugccuagcaacgc

SEQ ID NO: 1091892 - RNA, 20 nt, Human
agcggccccacugcaggagg

SEQ ID NO: 1091893 - RNA, 18 nt, Human
aggaaagggguuggggga

SEQ ID NO: 1091894 - RNA, 22 nt, Human
aggagagggacgguguggcccu

SEQ ID NO: 1091895 - RNA, 20 nt, Human
aggagaugugaacuuugugg

SEQ ID NO: 1091896 - RNA, 24 nt, Human
aggaggcgggaggcgugggucaga

SEQ ID NO: 1091897 - RNA, 25 nt, Human
aggcaaaaagaagagacaaaaagaa

SEQ ID NO: 1091898 - RNA, 25 nt, Human
aggcaaaaagaagagacaaaaagaa

SEQ ID NO: 1091899 - RNA, 29 nt, Human
aggcaaaaagaagagacaaaagggacccc

SEQ ID NO: 1091900 - RNA, 23 nt, Human
aggcaaccaaugagcaauccuuc

SEQ ID NO: 1091901 - RNA, 22 nt, Human
aggcagcaagccgacugugagc

SEQ ID NO: 1091902 - RNA, 23 nt, Human
aggcagcaagccgacugugagca

SEQ ID NO: 1091903 - RNA, 18 nt, Human
aggcagguaggagcuggg

SEQ ID NO: 1091904 - RNA, 19 nt, Human
aggcagguaggagcugggg

SEQ ID NO: 1091905 - RNA, 19 nt, Human
agggaaguggugggaagca

SEQ ID NO: 1091906 - RNA, 25 nt, Human
aggggacagcgaggagagggacggu

SEQ ID NO: 1091907 - RNA, 22 nt, Human
aguggagagugggaggugaggg

SEQ ID NO: 1091908 - RNA, 23 nt, Human
auacaaagcccuuugaaggucca

SEQ ID NO: 1091909 - RNA, 20 nt, Human
augcaagcugcaggucuggg

SEQ ID NO: 1091910 - RNA, 22 nt, Human
augcagccuacagggguucaaa

SEQ ID NO: 1091911 - RNA, 18 nt, Human
augugcaccaagacagag

SEQ ID NO: 1091912 - RNA, 19 nt, Human
augugcaccaagacagagc

SEQ ID NO: 1091913 - RNA, 24 nt, Human
auuaaauauuaaauaucagggguu

SEQ ID NO: 1091914 - RNA, 18 nt, Human
caaaaccaagaagcaggc

SEQ ID NO: 1091915 - RNA, 19 nt, Human
caagacagagccccagcgc

SEQ ID NO: 1091916 - RNA, 21 nt, Human
caagacagagccccagcgcgg

SEQ ID NO: 1091917 - RNA, 21 nt, Human
cacaucccagccgugccacaa

SEQ ID NO: 1091918 - RNA, 21 nt, Human
caccaccacgagccccaaagg

SEQ ID NO: 1091919 - RNA, 21 nt, Human
caccauuuacaaaccagcacu

SEQ ID NO: 1091920 - RNA, 26 nt, Human
cacccaggcccaagucccggccagac

SEQ ID NO: 1091921 - RNA, 23 nt, Human
cacgagggcagagcaggggaccc

SEQ ID NO: 1091922 - RNA, 18 nt, Human
cagccgagccugccuagc

SEQ ID NO: 1091923 - RNA, 18 nt, Human
caggacaggcagcaagcc

SEQ ID NO: 1091924 - RNA, 19 nt, Human
caugugcaccaagacagag

SEQ ID NO: 1091925 - RNA, 20 nt, Human
caugugguccguggaucacc

SEQ ID NO: 1091926 - RNA, 18 nt, Human
ccacgagccccaaaggug

SEQ ID NO: 1091927 - RNA, 18 nt, Human
ccagcaaagcacgagggc

SEQ ID NO: 1091928 - RNA, 19 nt, Human
ccagcaaagcacgagggca

SEQ ID NO: 1091929 - RNA, 22 nt, Human
ccaggcccaagucccggccaga

SEQ ID NO: 1091930 - RNA, 23 nt, Human
cccacaggcagccacaccugagg

SEQ ID NO: 1091931 - RNA, 24 nt, Human
cccacgaggagcucacagucuaga

SEQ ID NO: 1091932 - RNA, 21 nt, Human
cccagcgcggccuugcagcca

SEQ ID NO: 1091933 - RNA, 27 nt, Human
cccauagccgagaaagggaaaggggac

SEQ ID NO: 1091934 - RNA, 18 nt, Human
ccccaugcaagcugcagg

SEQ ID NO: 1091935 - RNA, 20 nt, Human
cccccaaguccccucaccau

SEQ ID NO: 1091936 - RNA, 21 nt, Human
cccccaaguccccucaccauu

SEQ ID NO: 1091937 - RNA, 22 nt, Human
cccccaaguccccucaccauuu

SEQ ID NO: 1091938 - RNA, 21 nt, Human
cccucuccaccaccacgagcc

SEQ ID NO: 1091939 - RNA, 22 nt, Human
cccucuccaccaccacgagccc

SEQ ID NO: 1091940 - RNA, 18 nt, Human
ccuccagaacuacugggc

SEQ ID NO: 1091941 - RNA, 24 nt, Human
ccuucuucacuggucucaaaagcc

SEQ ID NO: 1091942 - RNA, 21 nt, Human
cgagccccaaagguggggaaa

SEQ ID NO: 1091943 - RNA, 20 nt, Human
cgcaggaggaggggugacua

SEQ ID NO: 1091944 - RNA, 21 nt, Human
cgcccaggauggcccagacac

SEQ ID NO: 1091945 - RNA, 25 nt, Human
cggaggugagccagagacaccuccu

SEQ ID NO: 1091946 - RNA, 19 nt, Human
cggcaugaggccggcucuc

SEQ ID NO: 1091947 - RNA, 18 nt, Human
cucaggacuaggagacaa

SEQ ID NO: 1091948 - RNA, 26 nt, Human
cucucccuucuucacuggucucaaaa

SEQ ID NO: 1091949 - RNA, 25 nt, Human
cuuaacaccagcugcccucuccacc

SEQ ID NO: 1091950 - RNA, 20 nt, Human
gaaguggagagugggaggug

SEQ ID NO: 1091951 - RNA, 19 nt, Human
gaaugaagaggauucuucc

SEQ ID NO: 1091952 - RNA, 23 nt, Human
gacacuagagacaaacacaggga

SEQ ID NO: 1091953 - RNA, 18 nt, Human
gagaggggacagcgagga

SEQ ID NO: 1091954 - RNA, 27 nt, Human
gagcaguagacagggaagaggcgagcg

SEQ ID NO: 1091955 - RNA, 23 nt, Human
gagccugagcaguagacagggaa

SEQ ID NO: 1091956 - RNA, 18 nt, Human
gaggcagguaggagcugg

SEQ ID NO: 1091957 - RNA, 21 nt, Human
gagggaggucugggagugagg

SEQ ID NO: 1091958 - RNA, 22 nt, Human
gaguagcgggcaggggccagca

SEQ ID NO: 1091959 - RNA, 22 nt, Human
gaguucucagccuccgcuccuc

SEQ ID NO: 1091960 - RNA, 19 nt, Human
gaucaccugcaugggaacu

SEQ ID NO: 1091961 - RNA, 18 nt, Human
gauucccgggccuuccuc

SEQ ID NO: 1091962 - RNA, 20 nt, Human
gcaucugagaggaaacauga

SEQ ID NO: 1091963 - RNA, 20 nt, Human
gccacacugcagcaucugga

SEQ ID NO: 1091964 - RNA, 21 nt, Human
gccagaguggcaagugcuccu

SEQ ID NO: 1091965 - RNA, 22 nt, Human
gcccaccaccccugggugucug

SEQ ID NO: 1091966 - RNA, 23 nt, Human
gccccagcgcggccuugcagcca

SEQ ID NO: 1091967 - RNA, 21 nt, Human
gccuggagggagcacucuggg

SEQ ID NO: 1091968 - RNA, 24 nt, Human
gcgugggaggcagguaggagcugg

SEQ ID NO: 1091969 - RNA, 21 nt, Human
gcucauuugcagauucccggg

SEQ ID NO: 1091970 - RNA, 25 nt, Human
gcucauuugcagauucccgggaaac

SEQ ID NO: 1091971 - RNA, 20 nt, Human
gcugggagguggacagccac

SEQ ID NO: 1091972 - RNA, 20 nt, Human
gcugugcggucacaacauca

SEQ ID NO: 1091973 - RNA, 18 nt, Human
ggaaaagucugcaagcca

SEQ ID NO: 1091974 - RNA, 25 nt, Human
ggagggcggggagaagagggguuuc

SEQ ID NO: 1091975 - RNA, 24 nt, Human
ggcaaaaagaagagacaaaaagaa

SEQ ID NO: 1091976 - RNA, 19 nt, Human
ggcagagggcagcgcuggg

SEQ ID NO: 1091977 - RNA, 20 nt, Human
ggcaggacaggcagcaagcc

SEQ ID NO: 1091978 - RNA, 23 nt, Human
ggccaggaggcgggaggcguggg

SEQ ID NO: 1091979 - RNA, 19 nt, Human
ggcggggagaagagggguu

SEQ ID NO: 1091980 - RNA, 27 nt, Human
gggaaguggagagugggaggugagggg

SEQ ID NO: 1091981 - RNA, 23 nt, Human
gggcagcgcugggaggggccagc

SEQ ID NO: 1091982 - RNA, 22 nt, Human
ggggagggcggggagaagaggg

SEQ ID NO: 1091983 - RNA, 23 nt, Human
gggggagggcggggagaagaggg

SEQ ID NO: 1091984 - RNA, 19 nt, Human
ggguguuaaggacuggcuu

SEQ ID NO: 1091985 - RNA, 28 nt, Human
gguaaaucuggccacacugcagcaucug

SEQ ID NO: 1091986 - RNA, 18 nt, Human
gguguggaagaagggagg

SEQ ID NO: 1091987 - RNA, 20 nt, Human
gugcucaaagcgagacacaa

SEQ ID NO: 1091988 - RNA, 24 nt, Human
gugggaggcagguaggagcugggg

SEQ ID NO: 1091989 - RNA, 19 nt, Human
uaacugaugaaggcaacca

SEQ ID NO: 1091990 - RNA, 19 nt, Human
uaagucagaacacgaagac

SEQ ID NO: 1091991 - RNA, 22 nt, Human
uacagagaggggacagcgagga

SEQ ID NO: 1091992 - RNA, 20 nt, Human
uacagauacuuaugcagcag

SEQ ID NO: 1091993 - RNA, 18 nt, Human
uacauggaugccacgaag

SEQ ID NO: 1091994 - RNA, 22 nt, Human
uagaacagacaauauuaagaua

SEQ ID NO: 1091995 - RNA, 23 nt, Human
uaggagcugggggagggcgggga

SEQ ID NO: 1091996 - RNA, 20 nt, Human
uagggcccaccaccccuggg

SEQ ID NO: 1091997 - RNA, 24 nt, Human
uagggcccaccaccccuggguguc

SEQ ID NO: 1091998 - RNA, 19 nt, Human
uaucagggguuucggaagg

SEQ ID NO: 1091999 - RNA, 20 nt, Human
ucaaacaaaaccaagaagca

SEQ ID NO: 1092000 - RNA, 20 nt, Human
ucaacaugugguccguggau

SEQ ID NO: 1092001 - RNA, 24 nt, Human
ucacugacacugaauuugggcaac

SEQ ID NO: 1092002 - RNA, 26 nt, Human
ucacugacacugaauuugggcaacac

SEQ ID NO: 1092003 - RNA, 23 nt, Human
ucagagacacugcaggaacuggg

SEQ ID NO: 1092004 - RNA, 21 nt, Human
ucaugcccgguaaccuacauu

SEQ ID NO: 1092005 - RNA, 18 nt, Human
uccaccaccacgagcccc

SEQ ID NO: 1092006 - RNA, 23 nt, Human
uccaccaccacgagccccaaagg

SEQ ID NO: 1092007 - RNA, 23 nt, Human
uccaggagggaagccauuccguc

SEQ ID NO: 1092008 - RNA, 23 nt, Human
uccccaagggcugcucucagucc

SEQ ID NO: 1092009 - RNA, 22 nt, Human
uccguggaucaccugcauggga

SEQ ID NO: 1092010 - RNA, 18 nt, Human
uccugaaggucagggcca

SEQ ID NO: 1092011 - RNA, 20 nt, Human
ucgcaggaggaggggugacc

SEQ ID NO: 1092012 - RNA, 22 nt, Human
ucuccaccaccacgagccccaa

SEQ ID NO: 1092013 - RNA, 22 nt, Human
ucuuaacaccagcugcccucuc

SEQ ID NO: 1092014 - RNA, 24 nt, Human
ucuuaacaccagcugcccucucca

SEQ ID NO: 1092015 - RNA, 20 nt, Human
ugaaugagagugacaucucu

SEQ ID NO: 1092016 - RNA, 21 nt, Human
ugagcaacagacauccucccu

SEQ ID NO: 1092017 - RNA, 19 nt, Human
ugagcaauccuuccuuccc

SEQ ID NO: 1092018 - RNA, 23 nt, Human
ugaggcgugggaggcagguagga

SEQ ID NO: 1092019 - RNA, 21 nt, Human
ugagggaaguggugggaagca

SEQ ID NO: 1092020 - RNA, 19 nt, Human
ugaguucucagccuccgcu

SEQ ID NO: 1092021 - RNA, 19 nt, Human
ugaugaaggcaaccaauga

SEQ ID NO: 1092022 - RNA, 24 nt, Human
ugaugaaggcaaccaaugagcaau

SEQ ID NO: 1092023 - RNA, 19 nt, Human
ugccacaagccgcaucggc

SEQ ID NO: 1092024 - RNA, 18 nt, Human
ugcccccaaguccccuca

SEQ ID NO: 1092025 - RNA, 21 nt, Human
uggaaacacuggggaggaagg

SEQ ID NO: 1092026 - RNA, 21 nt, Human
uggaagaagggaggggcccca

SEQ ID NO: 1092027 - RNA, 18 nt, Human
uggagggagcacucuggg

SEQ ID NO: 1092028 - RNA, 21 nt, Human
uggcccagacaccuucugucu

SEQ ID NO: 1092029 - RNA, 21 nt, Human
ugggaggcagguaggagcugg

SEQ ID NO: 1092030 - RNA, 19 nt, Human
ugggaggugaggggaagca

SEQ ID NO: 1092031 - RNA, 26 nt, Human
ugggaggugaggggaagcacuagcaa

SEQ ID NO: 1092032 - RNA, 20 nt, Human
ugggaugcccccaagucccc

SEQ ID NO: 1092033 - RNA, 26 nt, Human
ugggcaacaccuagaacagacaauau

SEQ ID NO: 1092034 - RNA, 23 nt, Human
uggggacagucaaguauggcugg

SEQ ID NO: 1092035 - RNA, 20 nt, Human
uggguguggaagaagggagg

SEQ ID NO: 1092036 - RNA, 18 nt, Human
uggucaaacagccacugc

SEQ ID NO: 1092037 - RNA, 23 nt, Human
ugucauagggcuuccugguagag

SEQ ID NO: 1092038 - RNA, 19 nt, Human
uguggcccuaagggugacu

SEQ ID NO: 1092039 - RNA, 20 nt, Human
uguguguagaucugaguccu

SEQ ID NO: 1092040 - RNA, 22 nt, Human
uguuucaaucuaaaacauccaa

SEQ ID NO: 1092041 - RNA, 21 nt, Human
uuccuccagaacuacugggca

SEQ ID NO: 1092042 - RNA, 23 nt, Human
uugaagaacgcagugaucaaaca

SEQ ID NO: 1092043 - RNA, 19 nt, Human
uugcagccaggcaccgggc

SEQ ID NO: 1092044 - RNA, 20 nt, Human
aaacaggauggaaacgaggg

SEQ ID NO: 1092045 - RNA, 21 nt, Human
aaagagagagaggcacagacc

SEQ ID NO: 1092046 - RNA, 24 nt, Human
aaagugcugggauuacagguguga

SEQ ID NO: 1092047 - RNA, 23 nt, Human
aagccuccgauggcaggaacucc

SEQ ID NO: 1092048 - RNA, 25 nt, Human
aagcgauccuuccaccucagccucc

SEQ ID NO: 1092049 - RNA, 23 nt, Human
aagucacagaaacaggauggaaa

SEQ ID NO: 1092050 - RNA, 18 nt, Human
aagugcugggauuacagg

SEQ ID NO: 1092051 - RNA, 19 nt, Human
aagugcugggauuacaggu

SEQ ID NO: 1092052 - RNA, 26 nt, Human
aagugcugggauuacaggugugagcc

SEQ ID NO: 1092053 - RNA, 20 nt, Human
acagcauggaggcaggacac

SEQ ID NO: 1092054 - RNA, 22 nt, Human
accagccccagccccugcuccu

SEQ ID NO: 1092055 - RNA, 18 nt, Human
accagcccccuccaaccc

SEQ ID NO: 1092056 - RNA, 18 nt, Human
accucccugugccccucc

SEQ ID NO: 1092057 - RNA, 22 nt, Human
accucccugugccccuccccaa

SEQ ID NO: 1092058 - RNA, 26 nt, Human
accucccugugccccuccccaacccu

SEQ ID NO: 1092059 - RNA, 21 nt, Human
acuccagcacagguaaugggg

SEQ ID NO: 1092060 - RNA, 25 nt, Human
agcgauccuuccaccucagccuccc

SEQ ID NO: 1092061 - RNA, 21 nt, Human
agucacagaaacaggauggaa

SEQ ID NO: 1092062 - RNA, 19 nt, Human
agugggucuugugcugaga

SEQ ID NO: 1092063 - RNA, 22 nt, Human
aucaggacaggagccacaaagg

SEQ ID NO: 1092064 - RNA, 23 nt, Human
auccucucccuuagguuguuccc

SEQ ID NO: 1092065 - RNA, 25 nt, Human
auccuggaaccuuccccgcagcccc

SEQ ID NO: 1092066 - RNA, 21 nt, Human
aucuccaccagcccccuccaa

SEQ ID NO: 1092067 - RNA, 25 nt, Human
caaacuccugggcucaagcgauccu

SEQ ID NO: 1092068 - RNA, 24 nt, Human
caaagugcugggauuacaggugug

SEQ ID NO: 1092069 - RNA, 20 nt, Human
caccaccucccugugccccu

SEQ ID NO: 1092070 - RNA, 20 nt, Human
cacccccucuugccugcccu

SEQ ID NO: 1092071 - RNA, 20 nt, Human
caccucaaaucuccaccagc

SEQ ID NO: 1092072 - RNA, 21 nt, Human
caccucaaaucuccaccagcc

SEQ ID NO: 1092073 - RNA, 24 nt, Human
caccucagccucccaaagugcugg

SEQ ID NO: 1092074 - RNA, 20 nt, Human
caccuugugguugcaugucc

SEQ ID NO: 1092075 - RNA, 24 nt, Human
cagagucucccuguguugcccagg

SEQ ID NO: 1092076 - RNA, 21 nt, Human
cagccuggcgccuccaccccc

SEQ ID NO: 1092077 - RNA, 22 nt, Human
cagccuggcgccuccacccccu

SEQ ID NO: 1092078 - RNA, 21 nt, Human
caggacaggagccacaaaggu

SEQ ID NO: 1092079 - RNA, 19 nt, Human
caggacccagggccucaga

SEQ ID NO: 1092080 - RNA, 18 nt, Human
cagguaauguggcucgga

SEQ ID NO: 1092081 - RNA, 22 nt, Human
cauuuucugacagaguugagag

SEQ ID NO: 1092082 - RNA, 21 nt, Human
ccaaagugcugggauuacagg

SEQ ID NO: 1092083 - RNA, 21 nt, Human
ccaaagugcugggauuacagg

SEQ ID NO: 1092084 - RNA, 24 nt, Human
ccaaagugcugggauuacaggugu

SEQ ID NO: 1092085 - RNA, 22 nt, Human
ccacaaagguaugccuuucacc

SEQ ID NO: 1092086 - RNA, 23 nt, Human
ccaccuuaucaggacaggagcug

SEQ ID NO: 1092087 - RNA, 18 nt, Human
ccacugcaccuggcuggc

SEQ ID NO: 1092088 - RNA, 19 nt, Human
ccagcccccuccaaccccc

SEQ ID NO: 1092089 - RNA, 27 nt, Human
ccauugccaggccagccucccuucagu

SEQ ID NO: 1092090 - RNA, 21 nt, Human
cccaacccugacuguggcaau

SEQ ID NO: 1092091 - RNA, 24 nt, Human
cccauugugucccagcuucagaag

SEQ ID NO: 1092092 - RNA, 18 nt, Human
cccccagggacagugagc

SEQ ID NO: 1092093 - RNA, 22 nt, Human
cccccuccaacccccuaguuaa

SEQ ID NO: 1092094 - RNA, 18 nt, Human
cccuagccugucaagccc

SEQ ID NO: 1092095 - RNA, 23 nt, Human
cccugagcaguggccaagccaag

SEQ ID NO: 1092096 - RNA, 20 nt, Human
ccucccugugccccucccca

SEQ ID NO: 1092097 - RNA, 21 nt, Human
ccucugugucuucacucucag

SEQ ID NO: 1092098 - RNA, 19 nt, Human
ccugaagcuuccggagagc

SEQ ID NO: 1092099 - RNA, 20 nt, Human
ccuggcgccuccacccccuc

SEQ ID NO: 1092100 - RNA, 18 nt, Human
ccugggcucaagcgaucc

SEQ ID NO: 1092101 - RNA, 20 nt, Human
ccugugccccuccccaaccc

SEQ ID NO: 1092102 - RNA, 24 nt, Human
ccugugccccuccccaacccugac

SEQ ID NO: 1092103 - RNA, 18 nt, Human
ccuguguugcccaggcug

SEQ ID NO: 1092104 - RNA, 23 nt, Human
ccuguguugcccaggcuggucuc

SEQ ID NO: 1092105 - RNA, 26 nt, Human
ccuuccaccucagccucccaaagugc

SEQ ID NO: 1092106 - RNA, 24 nt, Human
cguccuaaggguuuggcaguccca

SEQ ID NO: 1092107 - RNA, 22 nt, Human
cuagccugucaagcccucccca

SEQ ID NO: 1092108 - RNA, 28 nt, Human
cucaaaucuccaccagcccccuccaacc

SEQ ID NO: 1092109 - RNA, 24 nt, Human
cucaagcgauccuuccaccucagc

SEQ ID NO: 1092110 - RNA, 23 nt, Human
cuccugggcucaagcgauccuuc

SEQ ID NO: 1092111 - RNA, 24 nt, Human
cuccugggcucaagcgauccuucc

SEQ ID NO: 1092112 - RNA, 21 nt, Human
cugcacacggcccacugcaca

SEQ ID NO: 1092113 - RNA, 18 nt, Human
cugggauccucugagcua

SEQ ID NO: 1092114 - RNA, 25 nt, Human
cuucagaagucaccgucugcccccu

SEQ ID NO: 1092115 - RNA, 20 nt, Human
cuuccagcaccaggaccccc

SEQ ID NO: 1092116 - RNA, 18 nt, Human
cuugccugccuccucaca

SEQ ID NO: 1092117 - RNA, 19 nt, Human
gagaggcacagacacagcc

SEQ ID NO: 1092118 - RNA, 21 nt, Human
gagcaguggccaagccaaggg

SEQ ID NO: 1092119 - RNA, 18 nt, Human
gagugcccuucaaaggcc

SEQ ID NO: 1092120 - RNA, 21 nt, Human
gagugcccuucaaaggcccau

SEQ ID NO: 1092121 - RNA, 18 nt, Human
gauuacaggugugagcca

SEQ ID NO: 1092122 - RNA, 22 nt, Human
gauuacaggugugagccacugc

SEQ ID NO: 1092123 - RNA, 23 nt, Human
gauuacaggugugagccacugca

SEQ ID NO: 1092124 - RNA, 20 nt, Human
gcucuggggguuucugaggc

SEQ ID NO: 1092125 - RNA, 19 nt, Human
ggacauucuccaccuugaa

SEQ ID NO: 1092126 - RNA, 20 nt, Human
ggacccagggccucagacaa

SEQ ID NO: 1092127 - RNA, 21 nt, Human
ggcgugcaggucagccccagg

SEQ ID NO: 1092128 - RNA, 20 nt, Human
ggcugcaggagccauggaua

SEQ ID NO: 1092129 - RNA, 24 nt, Human
gggcagacacagguccggggacuc

SEQ ID NO: 1092130 - RNA, 23 nt, Human
gggcgugcaggucagccccaggu

SEQ ID NO: 1092131 - RNA, 21 nt, Human
gguguggggagucaggaggga

SEQ ID NO: 1092132 - RNA, 22 nt, Human
gguucuaggaaagagagagagg

SEQ ID NO: 1092133 - RNA, 20 nt, Human
guccggggacucuggugcug

SEQ ID NO: 1092134 - RNA, 22 nt, Human
uaaggcagacugccagcccccu

SEQ ID NO: 1092135 - RNA, 22 nt, Human
uacaggugugagccacugcacc

SEQ ID NO: 1092136 - RNA, 22 nt, Human
uacaggugugagccacugcacc

SEQ ID NO: 1092137 - RNA, 23 nt, Human
uacaggugugagccacugcaccu

SEQ ID NO: 1092138 - RNA, 22 nt, Human
uagagacagagucucccugugu

SEQ ID NO: 1092139 - RNA, 24 nt, Human
uagggcagacacagguccggggac

SEQ ID NO: 1092140 - RNA, 18 nt, Human
ucaccgucugcccccuuc

SEQ ID NO: 1092141 - RNA, 18 nt, Human
ucagccucccaaagugcu

SEQ ID NO: 1092142 - RNA, 21 nt, Human
ucaggaagccuccgauggcag

SEQ ID NO: 1092143 - RNA, 20 nt, Human
ucauaucaggaaccugcucc

SEQ ID NO: 1092144 - RNA, 20 nt, Human
uccaccuugaaucuugcggu

SEQ ID NO: 1092145 - RNA, 20 nt, Human
uccagcacagguaauggggu

SEQ ID NO: 1092146 - RNA, 23 nt, Human
ucccaaagugcugggauuacagg

SEQ ID NO: 1092147 - RNA, 20 nt, Human
ucccagcuucagaagucacc

SEQ ID NO: 1092148 - RNA, 23 nt, Human
ucccugagcaguggccaagccaa

SEQ ID NO: 1092149 - RNA, 21 nt, Human
ucccuguguugcccaggcugg

SEQ ID NO: 1092150 - RNA, 26 nt, Human
uccucugugucuucacucucaggcag

SEQ ID NO: 1092151 - RNA, 21 nt, Human
uccugggcucaagcgauccuu

SEQ ID NO: 1092152 - RNA, 24 nt, Human
uccugggcucaagcgauccuucca

SEQ ID NO: 1092153 - RNA, 23 nt, Human
ucgagugcccuucaaaggcccau

SEQ ID NO: 1092154 - RNA, 19 nt, Human
ucgccuuaaucugggcaga

SEQ ID NO: 1092155 - RNA, 23 nt, Human
ucucaaacuccugggcucaagcg

SEQ ID NO: 1092156 - RNA, 19 nt, Human
ucucccuguguugcccagg

SEQ ID NO: 1092157 - RNA, 23 nt, Human
ucucccuguguugcccaggcugg

SEQ ID NO: 1092158 - RNA, 24 nt, Human
ucucccuguguugcccaggcuggu

SEQ ID NO: 1092159 - RNA, 24 nt, Human
ucugagcuagcccacaccugaagc

SEQ ID NO: 1092160 - RNA, 23 nt, Human
ugaaaaugccagggugcggcugc

SEQ ID NO: 1092161 - RNA, 23 nt, Human
ugaccugacuagacaagcagugg

SEQ ID NO: 1092162 - RNA, 18 nt, Human
ugacguccuaaggguuug

SEQ ID NO: 1092163 - RNA, 23 nt, Human
ugagaagggacagcauggaggca

SEQ ID NO: 1092164 - RNA, 18 nt, Human
ugcacacggcccacugca

SEQ ID NO: 1092165 - RNA, 22 nt, Human
ugccagggugcggcugccuucc

SEQ ID NO: 1092166 - RNA, 24 nt, Human
ugcccaggcuggucucaaacuccu

SEQ ID NO: 1092167 - RNA, 28 nt, Human
ugcccaggcuggucucaaacuccugggc

SEQ ID NO: 1092168 - RNA, 25 nt, Human
ugccugccuccucacagacccauug

SEQ ID NO: 1092169 - RNA, 21 nt, Human
ugccugggcagcaguguaugg

SEQ ID NO: 1092170 - RNA, 24 nt, Human
ugcgcagguaauguggcucggagg

SEQ ID NO: 1092171 - RNA, 20 nt, Human
ugcgcuguccucugugucuu

SEQ ID NO: 1092172 - RNA, 24 nt, Human
ugcugggauuacaggugugagcca

SEQ ID NO: 1092173 - RNA, 19 nt, Human
uggaaggacuucccugagc

SEQ ID NO: 1092174 - RNA, 19 nt, Human
uggcucggagggcgugcag

SEQ ID NO: 1092175 - RNA, 18 nt, Human
ugggauuacaggugugag

SEQ ID NO: 1092176 - RNA, 19 nt, Human
ugggauuacaggugugagc

SEQ ID NO: 1092177 - RNA, 21 nt, Human
ugggauuacaggugugagcca

SEQ ID NO: 1092178 - RNA, 22 nt, Human
ugggauuacaggugugagccac

SEQ ID NO: 1092179 - RNA, 22 nt, Human
ugggauuacaggugugagccac

SEQ ID NO: 1092180 - RNA, 24 nt, Human
ugggauuacaggugugagccacug

SEQ ID NO: 1092181 - RNA, 23 nt, Human
uggggggcuagacacacaguggg

SEQ ID NO: 1092182 - RNA, 19 nt, Human
uggggugaaggugcagggc

SEQ ID NO: 1092183 - RNA, 23 nt, Human
ugggucuugugcugagaagggac

SEQ ID NO: 1092184 - RNA, 22 nt, Human
ugguggagguggugguuucagc

SEQ ID NO: 1092185 - RNA, 19 nt, Human
ugugccccuccccaacccu

SEQ ID NO: 1092186 - RNA, 25 nt, Human
ugugcugagaagggacagcauggag

SEQ ID NO: 1092187 - RNA, 23 nt, Human
uguguugcccaggcuggucucaa

SEQ ID NO: 1092188 - RNA, 24 nt, Human
uguguugcccaggcuggucucaaa

SEQ ID NO: 1092189 - RNA, 22 nt, Human
uguugcccaggcuggucucaaa

SEQ ID NO: 1092190 - RNA, 21 nt, Human
uuaaacccaccucaaaucucc

SEQ ID NO: 1092191 - RNA, 19 nt, Human
uucaaaaccagccccagcc

SEQ ID NO: 1092192 - RNA, 24 nt, Human
uucaaaaccagccccagccccugc

SEQ ID NO: 1092193 - RNA, 22 nt, Human
uuguagagacagagucucccug

SEQ ID NO: 1092194 - RNA, 18 nt, Human
uuguucccuacccgaucc

SEQ ID NO: 1092195 - RNA, 23 nt, Human
aaaaacagguggaaaaagguggc

SEQ ID NO: 1092196 - RNA, 27 nt, Human
aaacagcccacaaagcucuugcugaac

SEQ ID NO: 1092197 - RNA, 21 nt, Human
auuccugccagccugcaccuc

SEQ ID NO: 1092198 - RNA, 19 nt, Human
cacucggaaaaacaggugg

SEQ ID NO: 1092199 - RNA, 23 nt, Human
cagccugcaccucugccacaguu

SEQ ID NO: 1092200 - RNA, 24 nt, Human
cagcuccgcccgucgccgcugaag

SEQ ID NO: 1092201 - RNA, 25 nt, Human
cagcuccgcccgucgccgcugaagg

SEQ ID NO: 1092202 - RNA, 23 nt, Human
caggagcccaccuggcgcccagg

SEQ ID NO: 1092203 - RNA, 21 nt, Human
cauuccugccagccugcacug

SEQ ID NO: 1092204 - RNA, 19 nt, Human
cccaggagcccaccuggcg

SEQ ID NO: 1092205 - RNA, 24 nt, Human
cccggggcuccagcuccgcccguc

SEQ ID NO: 1092206 - RNA, 21 nt, Human
ccuggcucuugggaacuucag

SEQ ID NO: 1092207 - RNA, 23 nt, Human
ccuggcucuugggaacuucaguu

SEQ ID NO: 1092208 - RNA, 24 nt, Human
cggaaaaacagguggaaaaaggug

SEQ ID NO: 1092209 - RNA, 23 nt, Human
cucccaggagcccaccuggcgcc

SEQ ID NO: 1092210 - RNA, 18 nt, Human
ggcccggggcuccagcuc

SEQ ID NO: 1092211 - RNA, 22 nt, Human
ggcccggggcuccagcuccgcc

SEQ ID NO: 1092212 - RNA, 19 nt, Human
uaccuggcucuugggaacu

SEQ ID NO: 1092213 - RNA, 22 nt, Human
ugccagccugcaccucugccac

SEQ ID NO: 1092214 - RNA, 18 nt, Human
ugcuucaucacccuccca

SEQ ID NO: 1092215 - RNA, 22 nt, Human
ugcuucaucacccucccaggag

SEQ ID NO: 1092216 - RNA, 19 nt, Human
uugcugaaccagucgcagc

SEQ ID NO: 1092217 - RNA, 20 nt, Human
aaaaauagccaugagguagc

SEQ ID NO: 1092218 - RNA, 22 nt, Human
aaacccaaaaauacagccaaga

SEQ ID NO: 1092219 - RNA, 21 nt, Human
aaagagcucgaggaggagggg

SEQ ID NO: 1092220 - RNA, 24 nt, Human
aaagcagggggacugggaccuaga

SEQ ID NO: 1092221 - RNA, 22 nt, Human
aagaaacugaagcaaaacaaac

SEQ ID NO: 1092222 - RNA, 21 nt, Human
aagaggaaaguccugagccca

SEQ ID NO: 1092223 - RNA, 23 nt, Human
aagcaaaacaaacccaaaaauac

SEQ ID NO: 1092224 - RNA, 27 nt, Human
aagcaaaacaaacccaaagccuuucgg

SEQ ID NO: 1092225 - RNA, 20 nt, Human
aagucagaggagagagacac

SEQ ID NO: 1092226 - RNA, 22 nt, Human
aagucagaggagagagacacag

SEQ ID NO: 1092227 - RNA, 24 nt, Human
aaguggggucugaauuucuguuuu

SEQ ID NO: 1092228 - RNA, 22 nt, Human
aauuucuguuuuagcucaagag

SEQ ID NO: 1092229 - RNA, 21 nt, Human
acaaacccaaaaauacagcca

SEQ ID NO: 1092230 - RNA, 19 nt, Human
acccauuuccuuacacaca

SEQ ID NO: 1092231 - RNA, 20 nt, Human
acugaagcaaaacaaaccca

SEQ ID NO: 1092232 - RNA, 25 nt, Human
agaaacagcuaaaagagcaagaaac

SEQ ID NO: 1092233 - RNA, 23 nt, Human
agaaucuggcacgacuuggauaa

SEQ ID NO: 1092234 - RNA, 22 nt, Human
agagggugggaaaggaacgcag

SEQ ID NO: 1092235 - RNA, 22 nt, Human
agcaaaacaaacccaaaaauac

SEQ ID NO: 1092236 - RNA, 19 nt, Human
agcaaggaaguagaaguca

SEQ ID NO: 1092237 - RNA, 23 nt, Human
agcacaaagagggugggaaagga

SEQ ID NO: 1092238 - RNA, 18 nt, Human
aggagagagacacagaga

SEQ ID NO: 1092239 - RNA, 24 nt, Human
aggaggagggggaauuagauggag

SEQ ID NO: 1092240 - RNA, 21 nt, Human
aggcugggaagcugaggccuc

SEQ ID NO: 1092241 - RNA, 22 nt, Human
auagacucccucaacuucaaag

SEQ ID NO: 1092242 - RNA, 24 nt, Human
caaaacaaacccaaaaauacagcc

SEQ ID NO: 1092243 - RNA, 24 nt, Human
caaacccaaaaauacagccaagaa

SEQ ID NO: 1092244 - RNA, 26 nt, Human
caagaaacugaagcaaaacaaaccca

SEQ ID NO: 1092245 - RNA, 25 nt, Human
caagcucaggacagcagaaccaccu

SEQ ID NO: 1092246 - RNA, 19 nt, Human
cagucuucccccaccccuc

SEQ ID NO: 1092247 - RNA, 24 nt, Human
cauguuugucuagguuuggcugca

SEQ ID NO: 1092248 - RNA, 20 nt, Human
ccaacaacuuccagacccaa

SEQ ID NO: 1092249 - RNA, 23 nt, Human
cccaaaaauacagccaagaaaag

SEQ ID NO: 1092250 - RNA, 21 nt, Human
ccccaccccucuuggcuccag

SEQ ID NO: 1092251 - RNA, 25 nt, Human
cccccaccccucuuggcuccagcua

SEQ ID NO: 1092252 - RNA, 20 nt, Human
cccugucucugucucucuca

SEQ ID NO: 1092253 - RNA, 22 nt, Human
ccuccaacaacuuccagaccca

SEQ ID NO: 1092254 - RNA, 23 nt, Human
ccuccaacaacuuccagacccaa

SEQ ID NO: 1092255 - RNA, 19 nt, Human
ccucuaaacugacggaaca

SEQ ID NO: 1092256 - RNA, 21 nt, Human
ccucuaaacugacggaacaag

SEQ ID NO: 1092257 - RNA, 18 nt, Human
ccugagcccagcuagagc

SEQ ID NO: 1092258 - RNA, 23 nt, Human
cgaggaggagggggaauuagaug

SEQ ID NO: 1092259 - RNA, 23 nt, Human
cuaaaagagcaagaaacugaagc

SEQ ID NO: 1092260 - RNA, 19 nt, Human
cucaggacagcagaaccac

SEQ ID NO: 1092261 - RNA, 21 nt, Human
cucagucuucccccaccccuc

SEQ ID NO: 1092262 - RNA, 22 nt, Human
cucccucaacuucaaagagcuc

SEQ ID NO: 1092263 - RNA, 22 nt, Human
cucuguggagcagggacuggcu

SEQ ID NO: 1092264 - RNA, 23 nt, Human
cugaagcaaaacaaacccaaaaa

SEQ ID NO: 1092265 - RNA, 19 nt, Human
gaaauccagaaacagcuaa

SEQ ID NO: 1092266 - RNA, 22 nt, Human
gagagcaaggaaguagaaguca

SEQ ID NO: 1092267 - RNA, 18 nt, Human
gagcccagcuagagccau

SEQ ID NO: 1092268 - RNA, 21 nt, Human
gaggaaaguccugagcccagc

SEQ ID NO: 1092269 - RNA, 21 nt, Human
gcagcugcaauggccucuggg

SEQ ID NO: 1092270 - RNA, 22 nt, Human
ggaaggugaaaugaauuaagaa

SEQ ID NO: 1092271 - RNA, 20 nt, Human
ggagggggaauuagauggag

SEQ ID NO: 1092272 - RNA, 22 nt, Human
ggcagguuuuuaacuccugcau

SEQ ID NO: 1092273 - RNA, 19 nt, Human
gggggguuguggcuuccag

SEQ ID NO: 1092274 - RNA, 21 nt, Human
guccugagcccagcuagagcc

SEQ ID NO: 1092275 - RNA, 19 nt, Human
guucugccacuuacuagcu

SEQ ID NO: 1092276 - RNA, 23 nt, Human
uaaaagagcaagaaacugaagca

SEQ ID NO: 1092277 - RNA, 20 nt, Human
uaaaaucaaagcagggggac

SEQ ID NO: 1092278 - RNA, 19 nt, Human
uaauaacaaugccugcccc

SEQ ID NO: 1092279 - RNA, 18 nt, Human
uaggaggagucugcugua

SEQ ID NO: 1092280 - RNA, 22 nt, Human
ucaagagguagcauugcauauc

SEQ ID NO: 1092281 - RNA, 20 nt, Human
uccaacaacuuccagacccu

SEQ ID NO: 1092282 - RNA, 24 nt, Human
ucgaggaggagggggaauuagaug

SEQ ID NO: 1092283 - RNA, 23 nt, Human
ucuaaacugacggaacaagaaga

SEQ ID NO: 1092284 - RNA, 22 nt, Human
ucucccugucucugucucucuc

SEQ ID NO: 1092285 - RNA, 21 nt, Human
ucuccgagaccagauggcaga

SEQ ID NO: 1092286 - RNA, 18 nt, Human
ucucuguggagcagggac

SEQ ID NO: 1092287 - RNA, 20 nt, Human
ucugucucucucagucuucc

SEQ ID NO: 1092288 - RNA, 22 nt, Human
ucugucucucucagucuucccc

SEQ ID NO: 1092289 - RNA, 24 nt, Human
ucuguggagcagggacuggcuguu

SEQ ID NO: 1092290 - RNA, 18 nt, Human
ugaagcaaaacaaaccca

SEQ ID NO: 1092291 - RNA, 23 nt, Human
ugaagcaaaacaaacccaaaaau

SEQ ID NO: 1092292 - RNA, 25 nt, Human
ugaagcaaaacaaacccaaaaauac

SEQ ID NO: 1092293 - RNA, 19 nt, Human
ugaaggagaaagcauccau

SEQ ID NO: 1092294 - RNA, 24 nt, Human
ugauggaaagcacaaagagggugg

SEQ ID NO: 1092295 - RNA, 18 nt, Human
uggcagaagaaaugauuu

SEQ ID NO: 1092296 - RNA, 22 nt, Human
uggcagaagaaaugauuuaucc

SEQ ID NO: 1092297 - RNA, 18 nt, Human
ugggaaaggaacgcagca

SEQ ID NO: 1092298 - RNA, 20 nt, Human
ugggaagcugaggccucuuu

SEQ ID NO: 1092299 - RNA, 23 nt, Human
ugggauaaauaggcaguuaggca

SEQ ID NO: 1092300 - RNA, 19 nt, Human
uguggagcagggacuggcu

SEQ ID NO: 1092301 - RNA, 19 nt, Human
ugugggcagagacggugag

SEQ ID NO: 1092302 - RNA, 22 nt, Human
uucccccaccccucuuggcucc

SEQ ID NO: 1092303 - RNA, 19 nt, Human
uuggcuccagcuaggugaa

SEQ ID NO: 1092304 - RNA, 23 nt, Human
aagaagcccuccagccacaaccc

SEQ ID NO: 1092305 - RNA, 24 nt, Human
caacccccacagcggccagcacca

SEQ ID NO: 1092306 - RNA, 23 nt, Human
cagccacaacccccacagcggcc

SEQ ID NO: 1092307 - RNA, 20 nt, Human
cccacuggauuggggacggg

SEQ ID NO: 1092308 - RNA, 18 nt, Human
cccuccagccacaacccc

SEQ ID NO: 1092309 - RNA, 24 nt, Human
cccugccagcagcuguccucccug

SEQ ID NO: 1092310 - RNA, 23 nt, Human
ccuggccagcccacuggauuggg

SEQ ID NO: 1092311 - RNA, 19 nt, Human
ccuuggcuugggagggccc

SEQ ID NO: 1092312 - RNA, 21 nt, Human
cuccagccacaacccccacag

SEQ ID NO: 1092313 - RNA, 24 nt, Human
cuccagccacaacccccacagcgg

SEQ ID NO: 1092314 - RNA, 21 nt, Human
cugccagcagcuguccucccu

SEQ ID NO: 1092315 - RNA, 22 nt, Human
gcccugagcagagccaagaagc

SEQ ID NO: 1092316 - RNA, 21 nt, Human
gggccaggcugggccaggucg

SEQ ID NO: 1092317 - RNA, 23 nt, Human
ucccugccagcagcuguccuccc

SEQ ID NO: 1092318 - RNA, 21 nt, Human
ucugcagccuuggcuugggag

SEQ ID NO: 1092319 - RNA, 24 nt, Human
uggccuggccagcccacuggauuc

SEQ ID NO: 1092320 - RNA, 20 nt, Human
ugggagggcccugagcagag

SEQ ID NO: 1092321 - RNA, 20 nt, Human
agaggcaggcaggccggggg

SEQ ID NO: 1092322 - RNA, 19 nt, Human
aggcaggcaggccgggggu

SEQ ID NO: 1092323 - RNA, 19 nt, Human
aggcaggcaggccgggggu

SEQ ID NO: 1092324 - RNA, 21 nt, Human
aggcaggcaggccgggggucu

SEQ ID NO: 1092325 - RNA, 21 nt, Human
cccaugaucugcgucuagaca

SEQ ID NO: 1092326 - RNA, 23 nt, Human
cccauggcagacggagccggggc

SEQ ID NO: 1092327 - RNA, 19 nt, Human
ccuacagcacggacagguc

SEQ ID NO: 1092328 - RNA, 22 nt, Human
ccuugcuggccucuugagaacc

SEQ ID NO: 1092329 - RNA, 25 nt, Human
cuagccaccggaggaugcacuuuuu

SEQ ID NO: 1092330 - RNA, 19 nt, Human
cugcauggcaaccuugcug

SEQ ID NO: 1092331 - RNA, 24 nt, Human
ugagaucauacccgccacccauga

SEQ ID NO: 1092332 - RNA, 26 nt, Human
ugagaucauacccgccacccaugauc

SEQ ID NO: 1092333 - RNA, 18 nt, Human
uggccucuugagaacccc

SEQ ID NO: 1092334 - RNA, 19 nt, Human
uggcgaagagguugagauc

SEQ ID NO: 1092335 - RNA, 22 nt, Human
aaaagguuucagugacagacac

SEQ ID NO: 1092336 - RNA, 21 nt, Human
aagaaggugggggaggugaca

SEQ ID NO: 1092337 - RNA, 22 nt, Human
aagagaaagaagaggucaaaga

SEQ ID NO: 1092338 - RNA, 27 nt, Human
aagcucccagcugaccuguuucucugg

SEQ ID NO: 1092339 - RNA, 19 nt, Human
aauaaaggaccucuagcug

SEQ ID NO: 1092340 - RNA, 26 nt, Human
aaugugaucucggggugguggaggcu

SEQ ID NO: 1092341 - RNA, 24 nt, Human
acagcagcaauggcagaaccaaag

SEQ ID NO: 1092342 - RNA, 18 nt, Human
acagcugccuccccaaca

SEQ ID NO: 1092343 - RNA, 20 nt, Human
acucaucuuuccuccaaucu

SEQ ID NO: 1092344 - RNA, 20 nt, Human
agaaagaagaggucaaagaa

SEQ ID NO: 1092345 - RNA, 20 nt, Human
agaagcucccagcugaccug

SEQ ID NO: 1092346 - RNA, 20 nt, Human
agacaacaggggccagaaga

SEQ ID NO: 1092347 - RNA, 22 nt, Human
agagaaagaagaggucaaagaa

SEQ ID NO: 1092348 - RNA, 24 nt, Human
agagggaggagagaagggcaguca

SEQ ID NO: 1092349 - RNA, 21 nt, Human
agccccugucuguccacccag

SEQ ID NO: 1092350 - RNA, 20 nt, Human
aggaagaggccuacuucugg

SEQ ID NO: 1092351 - RNA, 20 nt, Human
aggaggcuuuauaggccacc

SEQ ID NO: 1092352 - RNA, 24 nt, Human
agguuagggagcaaggcugcagga

SEQ ID NO: 1092353 - RNA, 22 nt, Human
aguugcuggaagucagacaccu

SEQ ID NO: 1092354 - RNA, 24 nt, Human
auggaagacagauuggauuccaca

SEQ ID NO: 1092355 - RNA, 20 nt, Human
caaaaaagguuucagugaca

SEQ ID NO: 1092356 - RNA, 18 nt, Human
caaagaaaaggcugacgg

SEQ ID NO: 1092357 - RNA, 20 nt, Human
caacacucuggauuccacac

SEQ ID NO: 1092358 - RNA, 19 nt, Human
caacaggggccagaagaug

SEQ ID NO: 1092359 - RNA, 22 nt, Human
caacuccccuuuccucuucucc

SEQ ID NO: 1092360 - RNA, 21 nt, Human
cacacagcagcaauggcagaa

SEQ ID NO: 1092361 - RNA, 21 nt, Human
cacagcaucaagacccuguga

SEQ ID NO: 1092362 - RNA, 22 nt, Human
caccagagccuuucuugggggc

SEQ ID NO: 1092363 - RNA, 20 nt, Human
caccugcagaucaagaccac

SEQ ID NO: 1092364 - RNA, 24 nt, Human
caccugcagaucaagaccacagca

SEQ ID NO: 1092365 - RNA, 23 nt, Human
cagaccaggcccaugacaaacac

SEQ ID NO: 1092366 - RNA, 22 nt, Human
cagcaaauacacaugaagagaa

SEQ ID NO: 1092367 - RNA, 24 nt, Human
cagcaauggcagaaccaaagguuu

SEQ ID NO: 1092368 - RNA, 22 nt, Human
cagcagcaauggcagaaccaaa

SEQ ID NO: 1092369 - RNA, 18 nt, Human
cagcagggcuccagauga

SEQ ID NO: 1092370 - RNA, 20 nt, Human
cagcaggggcagcuguugca

SEQ ID NO: 1092371 - RNA, 25 nt, Human
cagccuguccaggacagggugccgg

SEQ ID NO: 1092372 - RNA, 19 nt, Human
caggacccaccauuucuuc

SEQ ID NO: 1092373 - RNA, 23 nt, Human
caggagugaacuuccacacagca

SEQ ID NO: 1092374 - RNA, 20 nt, Human
caggauggaagacagauugg

SEQ ID NO: 1092375 - RNA, 21 nt, Human
caggcccaugacaaacaccgu

SEQ ID NO: 1092376 - RNA, 23 nt, Human
cagguucuccaccagagccuuuc

SEQ ID NO: 1092377 - RNA, 21 nt, Human
cagugcucagcuugcacccug

SEQ ID NO: 1092378 - RNA, 25 nt, Human
caucaagacccugugaccucucaaa

SEQ ID NO: 1092379 - RNA, 23 nt, Human
cauccccuucuccuuccucagcc

SEQ ID NO: 1092380 - RNA, 21 nt, Human
ccacaggaaaacuccacucca

SEQ ID NO: 1092381 - RNA, 20 nt, Human
ccaggcccaugacaaacacc

SEQ ID NO: 1092382 - RNA, 18 nt, Human
cccaguagagcccuaggg

SEQ ID NO: 1092383 - RNA, 19 nt, Human
cccaucccacucuaggcau

SEQ ID NO: 1092384 - RNA, 23 nt, Human
cccaugcggacuguuugcugcuu

SEQ ID NO: 1092385 - RNA, 22 nt, Human
ccccaacagugcauccccuucu

SEQ ID NO: 1092386 - RNA, 22 nt, Human
cccuucuccagccccugucugu

SEQ ID NO: 1092387 - RNA, 22 nt, Human
cccuucuccuuccucagccuca

SEQ ID NO: 1092388 - RNA, 24 nt, Human
cccuuuccucuucuccccuucucc

SEQ ID NO: 1092389 - RNA, 26 nt, Human
ccuccugccccuguuggucccuaggc

SEQ ID NO: 1092390 - RNA, 23 nt, Human
ccucugcaacacuggggacacuc

SEQ ID NO: 1092391 - RNA, 20 nt, Human
ccuggguccuggcaacacuc

SEQ ID NO: 1092392 - RNA, 22 nt, Human
ccuucuccuuccucagccucag

SEQ ID NO: 1092393 - RNA, 23 nt, Human
cuaaaaauagucaugcugagagc

SEQ ID NO: 1092394 - RNA, 24 nt, Human
cuaagagacagcaaauacacauga

SEQ ID NO: 1092395 - RNA, 25 nt, Human
cucacggauggccaggacccaccau

SEQ ID NO: 1092396 - RNA, 18 nt, Human
cucagcuugcacccuggc

SEQ ID NO: 1092397 - RNA, 21 nt, Human
cuccagugcucagcuugcacc

SEQ ID NO: 1092398 - RNA, 18 nt, Human
cuccccuucuccagcccc

SEQ ID NO: 1092399 - RNA, 22 nt, Human
cucuggagaccugaugcugggg

SEQ ID NO: 1092400 - RNA, 23 nt, Human
gaaagaagaggucaaagaaaagg

SEQ ID NO: 1092401 - RNA, 18 nt, Human
gaagaugaacaauggccc

SEQ ID NO: 1092402 - RNA, 21 nt, Human
gaguuacagcugccuccccaa

SEQ ID NO: 1092403 - RNA, 24 nt, Human
gaucuuuuuaaauggagacuaggg

SEQ ID NO: 1092404 - RNA, 20 nt, Human
gcaacacuggggacacucac

SEQ ID NO: 1092405 - RNA, 20 nt, Human
gcagcgccaggcaguggugc

SEQ ID NO: 1092406 - RNA, 21 nt, Human
gcagcucuggagaccugaugc

SEQ ID NO: 1092407 - RNA, 21 nt, Human
gcaggacaaauggcagccucc

SEQ ID NO: 1092408 - RNA, 22 nt, Human
gcaugccuggcaucaccacaca

SEQ ID NO: 1092409 - RNA, 22 nt, Human
gcccaugacaaacaccgucucc

SEQ ID NO: 1092410 - RNA, 20 nt, Human
gccccuggccugggcucuga

SEQ ID NO: 1092411 - RNA, 22 nt, Human
gcccuguggccauggggauccc

SEQ ID NO: 1092412 - RNA, 22 nt, Human
gccuggguccuggcaacacucu

SEQ ID NO: 1092413 - RNA, 18 nt, Human
ggcaaggcuguggggcag

SEQ ID NO: 1092414 - RNA, 18 nt, Human
ggccugggcucugagcug

SEQ ID NO: 1092415 - RNA, 21 nt, Human
gggcccuguggccauggggau

SEQ ID NO: 1092416 - RNA, 20 nt, Human
ggggaagggcaugccuggca

SEQ ID NO: 1092417 - RNA, 25 nt, Human
gguugugguauuaaguuacaugcag

SEQ ID NO: 1092418 - RNA, 20 nt, Human
gugcucagcuugcacccugg

SEQ ID NO: 1092419 - RNA, 19 nt, Human
guuagggagcaaggcugca

SEQ ID NO: 1092420 - RNA, 23 nt, Human
uaagagacagcaaauacacauga

SEQ ID NO: 1092421 - RNA, 18 nt, Human
uaggcauggcuccucucc

SEQ ID NO: 1092422 - RNA, 20 nt, Human
uaggccaccgcaagcagcag

SEQ ID NO: 1092423 - RNA, 19 nt, Human
uauggacugguugacagcc

SEQ ID NO: 1092424 - RNA, 19 nt, Human
ucaaaggcccgguggaaag

SEQ ID NO: 1092425 - RNA, 19 nt, Human
ucagauucaggccaacagc

SEQ ID NO: 1092426 - RNA, 23 nt, Human
ucaggaagaaggugggggaggug

SEQ ID NO: 1092427 - RNA, 21 nt, Human
uccacaggaaaacuccacucc

SEQ ID NO: 1092428 - RNA, 18 nt, Human
uccccuucuccuuccuca

SEQ ID NO: 1092429 - RNA, 20 nt, Human
uccucuccacaggaaaacuc

SEQ ID NO: 1092430 - RNA, 22 nt, Human
uccucuucuccccuucuccagg

SEQ ID NO: 1092431 - RNA, 20 nt, Human
ucuaagaaggugggcaggac

SEQ ID NO: 1092432 - RNA, 19 nt, Human
ucucacggauggccaggac

SEQ ID NO: 1092433 - RNA, 19 nt, Human
ucucacucaucuuuccucc

SEQ ID NO: 1092434 - RNA, 28 nt, Human
ucuccagcgggcagagcaaaggaagggc

SEQ ID NO: 1092435 - RNA, 23 nt, Human
ucucccacaaaaaagguuucagu

SEQ ID NO: 1092436 - RNA, 23 nt, Human
ucuccuggguuucaccuuuguag

SEQ ID NO: 1092437 - RNA, 19 nt, Human
ucuggagaccugaugcugg

SEQ ID NO: 1092438 - RNA, 19 nt, Human
ucuugggggccccuggccc

SEQ ID NO: 1092439 - RNA, 20 nt, Human
ugaacuuccacacagcagca

SEQ ID NO: 1092440 - RNA, 23 nt, Human
ugacagacacggggucucuaaaa

SEQ ID NO: 1092441 - RNA, 24 nt, Human
ugacagacacggggucucuaaaaa

SEQ ID NO: 1092442 - RNA, 21 nt, Human
ugacaucacagggaagagcaa

SEQ ID NO: 1092443 - RNA, 20 nt, Human
ugacgccacucccacucacu

SEQ ID NO: 1092444 - RNA, 18 nt, Human
ugacggcaaguuaacaaa

SEQ ID NO: 1092445 - RNA, 19 nt, Human
ugagagggaggagagaagg

SEQ ID NO: 1092446 - RNA, 19 nt, Human
ugagcugggagugaagggg

SEQ ID NO: 1092447 - RNA, 20 nt, Human
ugaguuacagcugccucccc

SEQ ID NO: 1092448 - RNA, 24 nt, Human
ugcagaucaagaccacagcaucaa

SEQ ID NO: 1092449 - RNA, 20 nt, Human
ugccccuguuggucccuagg

SEQ ID NO: 1092450 - RNA, 24 nt, Human
ugcccugggaagaucucacggaug

SEQ ID NO: 1092451 - RNA, 23 nt, Human
ugccuccugccccuguugguccc

SEQ ID NO: 1092452 - RNA, 25 nt, Human
ugccuggguccuggcaacacucugg

SEQ ID NO: 1092453 - RNA, 21 nt, Human
uggcacaggccagcaguugcu

SEQ ID NO: 1092454 - RNA, 22 nt, Human
uggcccaucccacucuaggcau

SEQ ID NO: 1092455 - RNA, 18 nt, Human
ugggaacagaggcuaagg

SEQ ID NO: 1092456 - RNA, 19 nt, Human
ugggaagaucucacggaug

SEQ ID NO: 1092457 - RNA, 23 nt, Human
ugggaugagagggaggagagaag

SEQ ID NO: 1092458 - RNA, 18 nt, Human
ugggcaggacaaauggca

SEQ ID NO: 1092459 - RNA, 20 nt, Human
ugggggcagaagcucccagc

SEQ ID NO: 1092460 - RNA, 20 nt, Human
ugggggccccuggccugggc

SEQ ID NO: 1092461 - RNA, 21 nt, Human
ugggggccccuggccugggcu

SEQ ID NO: 1092462 - RNA, 20 nt, Human
uggguccuggcaacacucug

SEQ ID NO: 1092463 - RNA, 24 nt, Human
uguagcaggaucccugcagaccag

SEQ ID NO: 1092464 - RNA, 18 nt, Human
ugucaggaagaggccuac

SEQ ID NO: 1092465 - RNA, 20 nt, Human
uguugcagaugggaggaaua

SEQ ID NO: 1092466 - RNA, 24 nt, Human
uuaauaaaggaccucuagcugugc

SEQ ID NO: 1092467 - RNA, 24 nt, Human
uuagggagcaaggcugcaggagug

SEQ ID NO: 1092468 - RNA, 19 nt, Human
uuggagccagaccaggagg

SEQ ID NO: 1092469 - RNA, 19 nt, Human
acaagggcuccagaaacuu

SEQ ID NO: 1092470 - RNA, 21 nt, Human
agagggguugaggggggagcc

SEQ ID NO: 1092471 - RNA, 23 nt, Human
agagggguugaggggggagccuc

SEQ ID NO: 1092472 - RNA, 22 nt, Human
cauccagacaggaccucugacc

SEQ ID NO: 1092473 - RNA, 25 nt, Human
ccauccagacaggaccucugaccgc

SEQ ID NO: 1092474 - RNA, 20 nt, Human
cuccagaaacuucaguccau

SEQ ID NO: 1092475 - RNA, 25 nt, Human
cuccagccuccauccagacaggacc

SEQ ID NO: 1092476 - RNA, 21 nt, Human
cugcuaggggccccuucucag

SEQ ID NO: 1092477 - RNA, 24 nt, Human
gagcagagggguugaggggggagc

SEQ ID NO: 1092478 - RNA, 21 nt, Human
gagccuccagccuccauccag

SEQ ID NO: 1092479 - RNA, 21 nt, Human
gggagccuccagccuccaucc

SEQ ID NO: 1092480 - RNA, 19 nt, Human
gggguugaggggggagccu

SEQ ID NO: 1092481 - RNA, 21 nt, Human
gguugaggggggagccuccag

SEQ ID NO: 1092482 - RNA, 24 nt, Human
uaggggccccuucucaggagguuc

SEQ ID NO: 1092483 - RNA, 18 nt, Human
ucagacaagggcuccaga

SEQ ID NO: 1092484 - RNA, 25 nt, Human
ucagucucagacaagggcuccagaa

SEQ ID NO: 1092485 - RNA, 21 nt, Human
ugcuccccacaggcacugagc

SEQ ID NO: 1092486 - RNA, 21 nt, Human
aacaguuucuguuuuaauguc

SEQ ID NO: 1092487 - RNA, 23 nt, Human
aacuucccgccccuccccgcccc

SEQ ID NO: 1092488 - RNA, 19 nt, Human
accauggccaccugcuccc

SEQ ID NO: 1092489 - RNA, 19 nt, Human
acuucccgccccuccccgc

SEQ ID NO: 1092490 - RNA, 21 nt, Human
aggcaggugaggggcaggggc

SEQ ID NO: 1092491 - RNA, 25 nt, Human
aggcaggugaggggcaggggcugca

SEQ ID NO: 1092492 - RNA, 19 nt, Human
aggggcugcaggagagggg

SEQ ID NO: 1092493 - RNA, 24 nt, Human
aggugaggggcaggggcugcagga

SEQ ID NO: 1092494 - RNA, 23 nt, Human
cagggccgggcaccauggccacc

SEQ ID NO: 1092495 - RNA, 21 nt, Human
caggucccaggcaggugaggg

SEQ ID NO: 1092496 - RNA, 21 nt, Human
cccaggcaggugaggggcagg

SEQ ID NO: 1092497 - RNA, 23 nt, Human
ccccgccccgcgccggccgcgac

SEQ ID NO: 1092498 - RNA, 20 nt, Human
ccccgcgccggccgcgacuc

SEQ ID NO: 1092499 - RNA, 23 nt, Human
cccucgagcggcagcgacucccg

SEQ ID NO: 1092500 - RNA, 19 nt, Human
cccuguguggccccaggga

SEQ ID NO: 1092501 - RNA, 21 nt, Human
ccgcagccuccgccgccgccc

SEQ ID NO: 1092502 - RNA, 19 nt, Human
ccucgagcggcagcgacuc

SEQ ID NO: 1092503 - RNA, 19 nt, Human
ccugcucccggccgggagc

SEQ ID NO: 1092504 - RNA, 19 nt, Human
ccuguguggccccagggac

SEQ ID NO: 1092505 - RNA, 23 nt, Human
cgaggccgcguguagggcgcaaa

SEQ ID NO: 1092506 - RNA, 21 nt, Human
cgcuggggcucuggggguggg

SEQ ID NO: 1092507 - RNA, 18 nt, Human
cggucccucgagcggcag

SEQ ID NO: 1092508 - RNA, 24 nt, Human
cucccgcagccuccgccgccgccc

SEQ ID NO: 1092509 - RNA, 18 nt, Human
cugcaggagaggggccgg

SEQ ID NO: 1092510 - RNA, 23 nt, Human
cugggggugggaugcggcucccg

SEQ ID NO: 1092511 - RNA, 19 nt, Human
gcaugcugcaggcagagac

SEQ ID NO: 1092512 - RNA, 22 nt, Human
gcgccgggagccggaccucccg

SEQ ID NO: 1092513 - RNA, 22 nt, Human
gcgcuggggcucuggggguggg

SEQ ID NO: 1092514 - RNA, 21 nt, Human
gcggcagcgacucccgcagcc

SEQ ID NO: 1092515 - RNA, 21 nt, Human
ggcgccgggagccggaccucc

SEQ ID NO: 1092516 - RNA, 20 nt, Human
ggcugcaggagaggggccgg

SEQ ID NO: 1092517 - RNA, 18 nt, Human
gggcaggggcugcaggag

SEQ ID NO: 1092518 - RNA, 18 nt, Human
gggcaggucccaggcagg

SEQ ID NO: 1092519 - RNA, 22 nt, Human
uauccacaugcaugcggaggcg

SEQ ID NO: 1092520 - RNA, 24 nt, Human
uccacaugcaugcggaggcggggc

SEQ ID NO: 1092521 - RNA, 23 nt, Human
ucccgcagccuccgccgccgccc

SEQ ID NO: 1092522 - RNA, 21 nt, Human
ucccuguguggccccagggac

SEQ ID NO: 1092523 - RNA, 23 nt, Human
ucccuguguggccccagggacaa

SEQ ID NO: 1092524 - RNA, 21 nt, Human
ugaccuccagugucccugugu

SEQ ID NO: 1092525 - RNA, 18 nt, Human
ugaggcagggccgggcac

SEQ ID NO: 1092526 - RNA, 23 nt, Human
ugaggcccggcgccgggagccgg

SEQ ID NO: 1092527 - RNA, 23 nt, Human
ugcggaggcggggcaggucccag

SEQ ID NO: 1092528 - RNA, 19 nt, Human
ugggggaaacugaggcccg

SEQ ID NO: 1092529 - RNA, 22 nt, Human
ugggggaaacugaggcccggcg

SEQ ID NO: 1092530 - RNA, 18 nt, Human
ugugaacaguuucuguuu

SEQ ID NO: 1092531 - RNA, 20 nt, Human
ugugaccuccagugucccug

SEQ ID NO: 1092532 - RNA, 22 nt, Human
uuuuuuuuuuuuuuugugaaca

SEQ ID NO: 1092533 - RNA, 18 nt, Human
uuuuuuuuuuuuuuuuug

SEQ ID NO: 1092534 - RNA, 19 nt, Human
uuuuuuuuuuuuuuuuugu

SEQ ID NO: 1092535 - RNA, 23 nt, Human
cacggcucaggcccgaaucgaga

SEQ ID NO: 1092536 - RNA, 21 nt, Human
cggcuuccacggcucaggccc

SEQ ID NO: 1092537 - RNA, 18 nt, Human
cugcccuccccccaccag

SEQ ID NO: 1092538 - RNA, 24 nt, Human
gggaagcagggaggcgcagagaga

SEQ ID NO: 1092539 - RNA, 26 nt, Human
uccacggcucaggcccgaaucgagac

SEQ ID NO: 1092540 - RNA, 21 nt, Human
ucgggcuccucuuuccugugc

SEQ ID NO: 1092541 - RNA, 21 nt, Human
acagcacgcgccgccaggccu

SEQ ID NO: 1092542 - RNA, 19 nt, Human
agaaauaccagaagagccc

SEQ ID NO: 1092543 - RNA, 20 nt, Human
auggccggguucccgcgacc

SEQ ID NO: 1092544 - RNA, 21 nt, Human
cagcacacacuucucgcaggc

SEQ ID NO: 1092545 - RNA, 18 nt, Human
caggccgagaaauaccag

SEQ ID NO: 1092546 - RNA, 19 nt, Human
caggucggagacgccaacc

SEQ ID NO: 1092547 - RNA, 21 nt, Human
cauggccggguucccgcgacc

SEQ ID NO: 1092548 - RNA, 20 nt, Human
ccaaccaggcagaagcccuc

SEQ ID NO: 1092549 - RNA, 20 nt, Human
ccaggcagaagcccucgaag

SEQ ID NO: 1092550 - RNA, 20 nt, Human
cccgcgaccggggcgggggc

SEQ ID NO: 1092551 - RNA, 19 nt, Human
ccgcgaccggggcgggggc

SEQ ID NO: 1092552 - RNA, 21 nt, Human
cuccuuggcaugcagcaccgg

SEQ ID NO: 1092553 - RNA, 21 nt, Human
gaggccugcccagaacuuggg

SEQ ID NO: 1092554 - RNA, 23 nt, Human
ucucgcaggccgagaaauaccag

SEQ ID NO: 1092555 - RNA, 22 nt, Human
uucccgcgaccggggcgggggc

SEQ ID NO: 1092556 - RNA, 18 nt, Human
aaaguggagguuguccaa

SEQ ID NO: 1092557 - RNA, 24 nt, Human
aaaguguugggauuacaggcguga

SEQ ID NO: 1092558 - RNA, 24 nt, Human
aagcagcaaggaaccugaggaggg

SEQ ID NO: 1092559 - RNA, 21 nt, Human
aaguguugggauuacaggcgu

SEQ ID NO: 1092560 - RNA, 26 nt, Human
aaguguugggauuacaggcgugagcc

SEQ ID NO: 1092561 - RNA, 23 nt, Human
aaugcuccaagacccauuugggc

SEQ ID NO: 1092562 - RNA, 24 nt, Human
accaggcacucugcugcuuggccu

SEQ ID NO: 1092563 - RNA, 24 nt, Human
acccacacugucucccuaucuccc

SEQ ID NO: 1092564 - RNA, 22 nt, Human
accccccuccccagguguccac

SEQ ID NO: 1092565 - RNA, 23 nt, Human
accccccuccccagguguccaca

SEQ ID NO: 1092566 - RNA, 18 nt, Human
acccugccagccugcagc

SEQ ID NO: 1092567 - RNA, 22 nt, Human
acgguuucaccauguuggccag

SEQ ID NO: 1092568 - RNA, 20 nt, Human
agaaguguuugggcuggggg

SEQ ID NO: 1092569 - RNA, 23 nt, Human
agacagcugguugcaaagccagg

SEQ ID NO: 1092570 - RNA, 22 nt, Human
agacagguagguagaagccagg

SEQ ID NO: 1092571 - RNA, 24 nt, Human
agacgguuucaccauguuggccag

SEQ ID NO: 1092572 - RNA, 23 nt, Human
agagaagcagcaaggaaccugag

SEQ ID NO: 1092573 - RNA, 24 nt, Human
agccaugggggaagucggcacccu

SEQ ID NO: 1092574 - RNA, 19 nt, Human
agcuccugcccaccugcuc

SEQ ID NO: 1092575 - RNA, 21 nt, Human
aggacggggcuggugggugca

SEQ ID NO: 1092576 - RNA, 18 nt, Human
aggagagguuguaggaag

SEQ ID NO: 1092577 - RNA, 22 nt, Human
aggcaagugggagccagccagg

SEQ ID NO: 1092578 - RNA, 21 nt, Human
aggcacucugcugcuuggccu

SEQ ID NO: 1092579 - RNA, 20 nt, Human
aggcugccccagaggagcgg

SEQ ID NO: 1092580 - RNA, 19 nt, Human
agggcugaagaugaaaaag

SEQ ID NO: 1092581 - RNA, 21 nt, Human
agggcugaagaugaaaaagug

SEQ ID NO: 1092582 - RNA, 21 nt, Human
aggguucggccagggcccagc

SEQ ID NO: 1092583 - RNA, 18 nt, Human
agguagguagaagccagg

SEQ ID NO: 1092584 - RNA, 18 nt, Human
agguccccacgugccccc

SEQ ID NO: 1092585 - RNA, 22 nt, Human
agguccccacgugccccccacc

SEQ ID NO: 1092586 - RNA, 23 nt, Human
agguccccacgugccccccaccc

SEQ ID NO: 1092587 - RNA, 25 nt, Human
auccacaggccccaggcuccuguag

SEQ ID NO: 1092588 - RNA, 19 nt, Human
aucugcuugccugggccuc

SEQ ID NO: 1092589 - RNA, 22 nt, Human
augaagccccuggucuaaugcu

SEQ ID NO: 1092590 - RNA, 24 nt, Human
caaaguguugggauuacaggcgug

SEQ ID NO: 1092591 - RNA, 18 nt, Human
caccauguuggccaggau

SEQ ID NO: 1092592 - RNA, 22 nt, Human
caccauguuggccaggaugguc

SEQ ID NO: 1092593 - RNA, 24 nt, Human
caccauguuggccaggauggucuc

SEQ ID NO: 1092594 - RNA, 19 nt, Human
cacccauccucaucagccc

SEQ ID NO: 1092595 - RNA, 19 nt, Human
cacccugccagccugcagc

SEQ ID NO: 1092596 - RNA, 20 nt, Human
cacccugccagccugcagcc

SEQ ID NO: 1092597 - RNA, 26 nt, Human
caccuggcacgggaggcaagugggag

SEQ ID NO: 1092598 - RNA, 27 nt, Human
cacgugccccccacccagcagcggccc

SEQ ID NO: 1092599 - RNA, 21 nt, Human
cacucugcagccaccuguacc

SEQ ID NO: 1092600 - RNA, 18 nt, Human
cagaaggugggagaaccc

SEQ ID NO: 1092601 - RNA, 25 nt, Human
cagcaaggaaccugaggaggggcag

SEQ ID NO: 1092602 - RNA, 25 nt, Human
cagcccaggguguuugugaacaggg

SEQ ID NO: 1092603 - RNA, 22 nt, Human
caggauggucuccaucuccuga

SEQ ID NO: 1092604 - RNA, 25 nt, Human
caggccccaggcuccuguagcuccu

SEQ ID NO: 1092605 - RNA, 18 nt, Human
cagggcaggcaugaagcc

SEQ ID NO: 1092606 - RNA, 19 nt, Human
cagggcugaagaugaaaaa

SEQ ID NO: 1092607 - RNA, 23 nt, Human
caguggaagucccagggcggcgc

SEQ ID NO: 1092608 - RNA, 22 nt, Human
ccaaaguguugggauuacaggc

SEQ ID NO: 1092609 - RNA, 22 nt, Human
ccaaaguguugggauuacaggc

SEQ ID NO: 1092610 - RNA, 24 nt, Human
ccaaaguguugggauuacaggcgu

SEQ ID NO: 1092611 - RNA, 25 nt, Human
ccacacugucucccuaucucccaug

SEQ ID NO: 1092612 - RNA, 18 nt, Human
ccacgggaaagccucucc

SEQ ID NO: 1092613 - RNA, 23 nt, Human
ccacugcgcccaaccuccccacu

SEQ ID NO: 1092614 - RNA, 22 nt, Human
ccacuuuggccaccugucccca

SEQ ID NO: 1092615 - RNA, 20 nt, Human
ccagaagcaccuggcacggg

SEQ ID NO: 1092616 - RNA, 20 nt, Human
cccaccguacccgagggacc

SEQ ID NO: 1092617 - RNA, 24 nt, Human
cccaccguacccgagggacccuau

SEQ ID NO: 1092618 - RNA, 18 nt, Human
cccagggcaggcaugaag

SEQ ID NO: 1092619 - RNA, 19 nt, Human
ccccacagugcaugacacc

SEQ ID NO: 1092620 - RNA, 19 nt, Human
ccccaccguacccgagggg

SEQ ID NO: 1092621 - RNA, 24 nt, Human
ccccacuccucucccguccacacc

SEQ ID NO: 1092622 - RNA, 18 nt, Human
ccccucugccccuuuccu

SEQ ID NO: 1092623 - RNA, 23 nt, Human
cccgagggacccuaugccccucu

SEQ ID NO: 1092624 - RNA, 27 nt, Human
ccucacccauccucaucagcccugcgg

SEQ ID NO: 1092625 - RNA, 18 nt, Human
ccuccccacuccucuccc

SEQ ID NO: 1092626 - RNA, 18 nt, Human
ccucuccaagacaggagu

SEQ ID NO: 1092627 - RNA, 23 nt, Human
ccucuccugcugagccccagaag

SEQ ID NO: 1092628 - RNA, 18 nt, Human
ccugaccucaugaucugc

SEQ ID NO: 1092629 - RNA, 18 nt, Human
ccugcagccccuucccuc

SEQ ID NO: 1092630 - RNA, 23 nt, Human
ccugcccccaccguacccgaggg

SEQ ID NO: 1092631 - RNA, 25 nt, Human
ccuggcucagagccggagcgcugug

SEQ ID NO: 1092632 - RNA, 26 nt, Human
cgagggacccuaugccccucugcccc

SEQ ID NO: 1092633 - RNA, 21 nt, Human
cgggcaaggacggggcuggug

SEQ ID NO: 1092634 - RNA, 18 nt, Human
cggggcuggugggugcag

SEQ ID NO: 1092635 - RNA, 25 nt, Human
cggggcuggugggugcagcagagca

SEQ ID NO: 1092636 - RNA, 21 nt, Human
cucacccauccucaucagccc

SEQ ID NO: 1092637 - RNA, 24 nt, Human
cuccugaccucaugaucugcuugc

SEQ ID NO: 1092638 - RNA, 21 nt, Human
cuccugcugagccccagaagc

SEQ ID NO: 1092639 - RNA, 20 nt, Human
cucuccaagacaggagugga

SEQ ID NO: 1092640 - RNA, 22 nt, Human
cugccagccugcagccccuucc

SEQ ID NO: 1092641 - RNA, 20 nt, Human
cugcgcccaaccuccccacu

SEQ ID NO: 1092642 - RNA, 21 nt, Human
cugcggcaggcaggugaucug

SEQ ID NO: 1092643 - RNA, 18 nt, Human
cugcugcuuggccuuugg

SEQ ID NO: 1092644 - RNA, 22 nt, Human
cuggaggugaccccccucccca

SEQ ID NO: 1092645 - RNA, 20 nt, Human
cugugcgcccgccugccccu

SEQ ID NO: 1092646 - RNA, 18 nt, Human
cuuuggccaccugucccc

SEQ ID NO: 1092647 - RNA, 22 nt, Human
gaagcaccuggcacgggaggca

SEQ ID NO: 1092648 - RNA, 23 nt, Human
gaccccccuccccagguguccac

SEQ ID NO: 1092649 - RNA, 20 nt, Human
gagccggagcgcugugcgcc

SEQ ID NO: 1092650 - RNA, 18 nt, Human
gauuacaggcgugagcca

SEQ ID NO: 1092651 - RNA, 22 nt, Human
gauuacaggcgugagccacugc

SEQ ID NO: 1092652 - RNA, 22 nt, Human
gauuacaggcgugagccacugc

SEQ ID NO: 1092653 - RNA, 22 nt, Human
gcaaggacggggcuggugggug

SEQ ID NO: 1092654 - RNA, 23 nt, Human
gcaggugaucugugugaaagggu

SEQ ID NO: 1092655 - RNA, 21 nt, Human
gcucacccacacugucucccu

SEQ ID NO: 1092656 - RNA, 21 nt, Human
ggacccuaugccccucugccc

SEQ ID NO: 1092657 - RNA, 19 nt, Human
ggaggugaccccccucccc

SEQ ID NO: 1092658 - RNA, 21 nt, Human
ggaggugaccccccuccccag

SEQ ID NO: 1092659 - RNA, 24 nt, Human
ggauggucuccaucuccugaccuc

SEQ ID NO: 1092660 - RNA, 22 nt, Human
ggcuggugggugcagcagagca

SEQ ID NO: 1092661 - RNA, 18 nt, Human
gggcaggcaugaagcccc

SEQ ID NO: 1092662 - RNA, 24 nt, Human
gggcauggcacucaucaggcaucu

SEQ ID NO: 1092663 - RNA, 23 nt, Human
gggcgggacggggccaaggauga

SEQ ID NO: 1092664 - RNA, 19 nt, Human
ggguguggcugaaaaggag

SEQ ID NO: 1092665 - RNA, 25 nt, Human
gguccugugccugagcccucagcgu

SEQ ID NO: 1092666 - RNA, 21 nt, Human
gguuucaccauguuggccagg

SEQ ID NO: 1092667 - RNA, 24 nt, Human
gguuucaccauguuggccaggaug

SEQ ID NO: 1092668 - RNA, 21 nt, Human
gugaacagguggacuugggug

SEQ ID NO: 1092669 - RNA, 20 nt, Human
gugggagaacccccacagug

SEQ ID NO: 1092670 - RNA, 23 nt, Human
uaauuuuuuguguuuuauuagag

SEQ ID NO: 1092671 - RNA, 19 nt, Human
uacaggcgugagccacugc

SEQ ID NO: 1092672 - RNA, 24 nt, Human
uacaggcgugagccacugcgccca

SEQ ID NO: 1092673 - RNA, 19 nt, Human
uagagacgguuucaccaug

SEQ ID NO: 1092674 - RNA, 19 nt, Human
uagcuccugcccaccugcu

SEQ ID NO: 1092675 - RNA, 22 nt, Human
uaggaagcuggccagagaauca

SEQ ID NO: 1092676 - RNA, 18 nt, Human
uaguguuugcagaagugu

SEQ ID NO: 1092677 - RNA, 20 nt, Human
uauuggaggcugccccagag

SEQ ID NO: 1092678 - RNA, 24 nt, Human
ucaccauguuggccaggauggucu

SEQ ID NO: 1092679 - RNA, 22 nt, Human
ucaggcacuuccugagacaggu

SEQ ID NO: 1092680 - RNA, 18 nt, Human
ucaggcaucugcauccgc

SEQ ID NO: 1092681 - RNA, 21 nt, Human
ucagggcugaagaugaaaaag

SEQ ID NO: 1092682 - RNA, 20 nt, Human
uccacaccaggcacucugcu

SEQ ID NO: 1092683 - RNA, 19 nt, Human
uccacagagggcauggcac

SEQ ID NO: 1092684 - RNA, 21 nt, Human
uccacaggccccaggcuccug

SEQ ID NO: 1092685 - RNA, 21 nt, Human
uccacaggccccaggcuccug

SEQ ID NO: 1092686 - RNA, 24 nt, Human
ucccaaaguguugggauuacaggc

SEQ ID NO: 1092687 - RNA, 26 nt, Human
uccccagggcaggcaugaagccccug

SEQ ID NO: 1092688 - RNA, 21 nt, Human
ucuccaucuccugaccucaug

SEQ ID NO: 1092689 - RNA, 24 nt, Human
ucuccugcugagccccagaagcug

SEQ ID NO: 1092690 - RNA, 23 nt, Human
ucucuugcacgugcaguggaagu

SEQ ID NO: 1092691 - RNA, 21 nt, Human
ucugccccuuuccucuccucc

SEQ ID NO: 1092692 - RNA, 21 nt, Human
ucugcgggcucacagcagcca

SEQ ID NO: 1092693 - RNA, 24 nt, Human
ugaaaaaguggagguuguccaagg

SEQ ID NO: 1092694 - RNA, 18 nt, Human
ugaagaugaaaaagugga

SEQ ID NO: 1092695 - RNA, 22 nt, Human
ugaccccccuccccaggugucc

SEQ ID NO: 1092696 - RNA, 20 nt, Human
ugagccccagaagcaccugg

SEQ ID NO: 1092697 - RNA, 20 nt, Human
ugaggaggggcagaaggugg

SEQ ID NO: 1092698 - RNA, 22 nt, Human
ugagugcagguccccacgugcc

SEQ ID NO: 1092699 - RNA, 24 nt, Human
ugcauccgcuaaccuagagaaagg

SEQ ID NO: 1092700 - RNA, 25 nt, Human
ugcauccgcuaaccuagagaaagga

SEQ ID NO: 1092701 - RNA, 21 nt, Human
ugccugagcccucagcgugcc

SEQ ID NO: 1092702 - RNA, 20 nt, Human
ugcugagccccagaagcacc

SEQ ID NO: 1092703 - RNA, 23 nt, Human
uggccagagaaucagggcaagug

SEQ ID NO: 1092704 - RNA, 24 nt, Human
uggccaggauggucuccaucuccu

SEQ ID NO: 1092705 - RNA, 22 nt, Human
uggcggugucugugauccacag

SEQ ID NO: 1092706 - RNA, 19 nt, Human
uggcugcgcuccucaccca

SEQ ID NO: 1092707 - RNA, 23 nt, Human
ugggagaggagagaagcagcaag

SEQ ID NO: 1092708 - RNA, 18 nt, Human
ugggagggucuguaggug

SEQ ID NO: 1092709 - RNA, 18 nt, Human
ugggauuacaggcgugag

SEQ ID NO: 1092710 - RNA, 19 nt, Human
ugggauuacaggcgugagc

SEQ ID NO: 1092711 - RNA, 21 nt, Human
ugggauuacaggcgugagcca

SEQ ID NO: 1092712 - RNA, 22 nt, Human
ugggauuacaggcgugagccac

SEQ ID NO: 1092713 - RNA, 22 nt, Human
ugggauuacaggcgugagccac

SEQ ID NO: 1092714 - RNA, 24 nt, Human
ugggauuacaggcgugagccacug

SEQ ID NO: 1092715 - RNA, 26 nt, Human
ugggauuacaggcgugagccacugcg

SEQ ID NO: 1092716 - RNA, 21 nt, Human
ugggggcagauggauguaagg

SEQ ID NO: 1092717 - RNA, 24 nt, Human
uugccugggccucccaaaguguug

SEQ ID NO: 1092718 - RNA, 23 nt, Human
uugugggcccugcacagcugugu

SEQ ID NO: 1092719 - RNA, 19 nt, Human
uuucaccauguuggccagg

SEQ ID NO: 1092720 - RNA, 20 nt, Human
uuucaccauguuggccagga

SEQ ID NO: 1092721 - RNA, 19 nt, Human
uuuggccaccuguccccag

SEQ ID NO: 1092722 - RNA, 20 nt, Human
uuuuuguguuuuauuagaga

SEQ ID NO: 1092723 - RNA, 20 nt, Human
aagaucccuggcuggaccag

SEQ ID NO: 1092724 - RNA, 20 nt, Human
accaggguuucagggcuggc

SEQ ID NO: 1092725 - RNA, 20 nt, Human
aggccaaagcugcacggugc

SEQ ID NO: 1092726 - RNA, 21 nt, Human
aggguuucagggcuggccccg

SEQ ID NO: 1092727 - RNA, 20 nt, Human
caugagaugccccuuccaca

SEQ ID NO: 1092728 - RNA, 25 nt, Human
cccggagcugagaccaagucgaguc

SEQ ID NO: 1092729 - RNA, 22 nt, Human
cccugcugcugucaccgcuggg

SEQ ID NO: 1092730 - RNA, 18 nt, Human
cccuggcuggaccagcug

SEQ ID NO: 1092731 - RNA, 19 nt, Human
cuggccccggagcugagac

SEQ ID NO: 1092732 - RNA, 19 nt, Human
gcucugguugugggggcug

SEQ ID NO: 1092733 - RNA, 20 nt, Human
ggagcugagaccaagugcug

SEQ ID NO: 1092734 - RNA, 20 nt, Human
gggcucuacgaagaucccug

SEQ ID NO: 1092735 - RNA, 19 nt, Human
guccggggccggcccaggg

SEQ ID NO: 1092736 - RNA, 22 nt, Human
guugugggggcuggggguuguc

SEQ ID NO: 1092737 - RNA, 21 nt, Human
guuucagggcuggccccggag

SEQ ID NO: 1092738 - RNA, 24 nt, Human
uaaccaggguuucagggcuggccc

SEQ ID NO: 1092739 - RNA, 18 nt, Human
uccaggcccugcugcugu

SEQ ID NO: 1092740 - RNA, 18 nt, Human
uccggggccggcccaggg

SEQ ID NO: 1092741 - RNA, 21 nt, Human
ugagaccaagugcuggcccau

SEQ ID NO: 1092742 - RNA, 20 nt, Human
ugagaugccccuuccacaga

SEQ ID NO: 1092743 - RNA, 18 nt, Human
uggcucugguuguggggg

SEQ ID NO: 1092744 - RNA, 21 nt, Human
ugugggggcuggggguugucc

SEQ ID NO: 1092745 - RNA, 24 nt, Human
ugugggggcuggggguuguccggg

SEQ ID NO: 1092746 - RNA, 18 nt, Human
aagagagagagagggagg

SEQ ID NO: 1092747 - RNA, 22 nt, Human
aagcccacgauggcuacagagc

SEQ ID NO: 1092748 - RNA, 18 nt, Human
acaacaaaaugccccuaa

SEQ ID NO: 1092749 - RNA, 18 nt, Human
acaccacugcacuccagc

SEQ ID NO: 1092750 - RNA, 21 nt, Human
acaccacugcacuccagcgac

SEQ ID NO: 1092751 - RNA, 26 nt, Human
acagagcuccaaggaggagggaacgc

SEQ ID NO: 1092752 - RNA, 18 nt, Human
acaggugagaccccgucu

SEQ ID NO: 1092753 - RNA, 25 nt, Human
acccgccucggccucccacagugcu

SEQ ID NO: 1092754 - RNA, 22 nt, Human
acgcagcacacuccuuccggag

SEQ ID NO: 1092755 - RNA, 23 nt, Human
acuccuguccucaggugauccac

SEQ ID NO: 1092756 - RNA, 27 nt, Human
acugcacuccagcgacaggacaacggg

SEQ ID NO: 1092757 - RNA, 27 nt, Human
acugcacuccagcgacaggacaucggg

SEQ ID NO: 1092758 - RNA, 19 nt, Human
agagagagggagggaggag

SEQ ID NO: 1092759 - RNA, 21 nt, Human
agaugggguccccagcaagcc

SEQ ID NO: 1092760 - RNA, 22 nt, Human
agcagaaacaccugugcuuucc

SEQ ID NO: 1092761 - RNA, 24 nt, Human
agccauguugcccaggcuggucuu

SEQ ID NO: 1092762 - RNA, 27 nt, Human
agccauguugcccaggcuggucuugaa

SEQ ID NO: 1092763 - RNA, 19 nt, Human
agcccaagaguucaaggcc

SEQ ID NO: 1092764 - RNA, 21 nt, Human
agcccaggcauuagaggcucc

SEQ ID NO: 1092765 - RNA, 19 nt, Human
agccugcaccggcugaacu

SEQ ID NO: 1092766 - RNA, 24 nt, Human
agcuacucgggaggcugagguggg

SEQ ID NO: 1092767 - RNA, 22 nt, Human
agcugccaggcgugguggcuca

SEQ ID NO: 1092768 - RNA, 24 nt, Human
aggaucacuugagcccaagaguuc

SEQ ID NO: 1092769 - RNA, 24 nt, Human
aggcauuagaggcuccagugagcu

SEQ ID NO: 1092770 - RNA, 18 nt, Human
aggcgagaggaucacuug

SEQ ID NO: 1092771 - RNA, 21 nt, Human
aggcgugguggcucaagccug

SEQ ID NO: 1092772 - RNA, 24 nt, Human
aggcugaggugggaggaucgcuug

SEQ ID NO: 1092773 - RNA, 20 nt, Human
agggaagguugcauucugag

SEQ ID NO: 1092774 - RNA, 19 nt, Human
aggggagauggggucccca

SEQ ID NO: 1092775 - RNA, 24 nt, Human
aggugauccacccgccucggccuc

SEQ ID NO: 1092776 - RNA, 23 nt, Human
aggugggaggaucgcuugagccc

SEQ ID NO: 1092777 - RNA, 24 nt, Human
agucaacaacaaaaugccccuaaa

SEQ ID NO: 1092778 - RNA, 18 nt, Human
agucaacacagauggagc

SEQ ID NO: 1092779 - RNA, 24 nt, Human
agugcugggaugacaggcuugagc

SEQ ID NO: 1092780 - RNA, 20 nt, Human
aucacaccacugcacuccag

SEQ ID NO: 1092781 - RNA, 29 nt, Human
aucccaaagucuccaaggggagauggggg

SEQ ID NO: 1092782 - RNA, 22 nt, Human
auccuaacacuuugggaggcca

SEQ ID NO: 1092783 - RNA, 19 nt, Human
auggaggaacaccagugac

SEQ ID NO: 1092784 - RNA, 19 nt, Human
auuacaucugcaaagcccu

SEQ ID NO: 1092785 - RNA, 20 nt, Human
caacacagauggagcugcca

SEQ ID NO: 1092786 - RNA, 21 nt, Human
caaggcgagaggaucacuuga

SEQ ID NO: 1092787 - RNA, 22 nt, Human
cacaacaagagagagagaggga

SEQ ID NO: 1092788 - RNA, 20 nt, Human
cacagccugccucccgcccu

SEQ ID NO: 1092789 - RNA, 22 nt, Human
cacaucccaaagucuccaaggg

SEQ ID NO: 1092790 - RNA, 23 nt, Human
caccuguagucccagcuacucgg

SEQ ID NO: 1092791 - RNA, 24 nt, Human
caccuguagucccagcuacucggg

SEQ ID NO: 1092792 - RNA, 18 nt, Human
cacugcacuccagcgaca

SEQ ID NO: 1092793 - RNA, 18 nt, Human
cacugcacuccagcgaca

SEQ ID NO: 1092794 - RNA, 19 nt, Human
cacugcacuccagcgacag

SEQ ID NO: 1092795 - RNA, 23 nt, Human
cacugcacuccagcgacagguga

SEQ ID NO: 1092796 - RNA, 18 nt, Human
cagagcuccaaggaggag

SEQ ID NO: 1092797 - RNA, 26 nt, Human
cagcagcacugcagggcaggcucuga

SEQ ID NO: 1092798 - RNA, 20 nt, Human
cagcaugucuuccccuuggg

SEQ ID NO: 1092799 - RNA, 19 nt, Human
cagccucaauccaggguga

SEQ ID NO: 1092800 - RNA, 18 nt, Human
cagcguccuggggcugcu

SEQ ID NO: 1092801 - RNA, 18 nt, Human
cagcguccuggggcugcu

SEQ ID NO: 1092802 - RNA, 24 nt, Human
cagcuacucgggaggcugaggugg

SEQ ID NO: 1092803 - RNA, 19 nt, Human
caggcuuacaacaucagaa

SEQ ID NO: 1092804 - RNA, 23 nt, Human
cagggaaaauggcucccuuuuca

SEQ ID NO: 1092805 - RNA, 23 nt, Human
caucagagaaccagcaugucuuc

SEQ ID NO: 1092806 - RNA, 20 nt, Human
cauguugcccaggcuggucu

SEQ ID NO: 1092807 - RNA, 23 nt, Human
cauguugcccaggcuggucuuga

SEQ ID NO: 1092808 - RNA, 24 nt, Human
cauguugcccaggcuggucuugaa

SEQ ID NO: 1092809 - RNA, 21 nt, Human
ccacagggcagcugucgccau

SEQ ID NO: 1092810 - RNA, 24 nt, Human
ccacgguuggaagcuuccuggggc

SEQ ID NO: 1092811 - RNA, 18 nt, Human
ccacugcacuccagcgac

SEQ ID NO: 1092812 - RNA, 19 nt, Human
ccacugcacuccagcgaca

SEQ ID NO: 1092813 - RNA, 21 nt, Human
ccacugcacuccagcgacagg

SEQ ID NO: 1092814 - RNA, 22 nt, Human
ccacugcacuccagcgacaggu

SEQ ID NO: 1092815 - RNA, 18 nt, Human
ccagcucugggggcucca

SEQ ID NO: 1092816 - RNA, 23 nt, Human
ccagggugaccucguccccagau

SEQ ID NO: 1092817 - RNA, 18 nt, Human
ccauaucgacagcagccg

SEQ ID NO: 1092818 - RNA, 20 nt, Human
ccaugugagacaccugcucc

SEQ ID NO: 1092819 - RNA, 21 nt, Human
ccauguugcccaggcuggucu

SEQ ID NO: 1092820 - RNA, 24 nt, Human
ccccugcugcggccgacgcuccag

SEQ ID NO: 1092821 - RNA, 22 nt, Human
cccgccgcuccuuccucuccug

SEQ ID NO: 1092822 - RNA, 18 nt, Human
cccgcuucgccuuccacc

SEQ ID NO: 1092823 - RNA, 22 nt, Human
cccuggggaggaucccucccuc

SEQ ID NO: 1092824 - RNA, 21 nt, Human
cccuuugacucuugcaagccc

SEQ ID NO: 1092825 - RNA, 21 nt, Human
ccgccgcuccuuccucuccug

SEQ ID NO: 1092826 - RNA, 18 nt, Human
ccggaggcccuggggagg

SEQ ID NO: 1092827 - RNA, 20 nt, Human
ccgucuaaaaaauaucucac

SEQ ID NO: 1092828 - RNA, 21 nt, Human
ccucaggugauccacccgccu

SEQ ID NO: 1092829 - RNA, 21 nt, Human
ccucccgcccugggaagcugg

SEQ ID NO: 1092830 - RNA, 24 nt, Human
ccucccgcccugggaagcuggggg

SEQ ID NO: 1092831 - RNA, 21 nt, Human
ccugcccgccgcuccuuccuc

SEQ ID NO: 1092832 - RNA, 21 nt, Human
ccugcccgccgcuccuuccuc

SEQ ID NO: 1092833 - RNA, 19 nt, Human
ccugcucugugcaucuguc

SEQ ID NO: 1092834 - RNA, 21 nt, Human
ccuggggaggaucccucccuc

SEQ ID NO: 1092835 - RNA, 19 nt, Human
ccuggggccucuccagaag

SEQ ID NO: 1092836 - RNA, 21 nt, Human
ccuguagucccagcuacucgg

SEQ ID NO: 1092837 - RNA, 24 nt, Human
ccuguccucaggugauccacccgc

SEQ ID NO: 1092838 - RNA, 22 nt, Human
cgagggcagcagcacugcaggg

SEQ ID NO: 1092839 - RNA, 23 nt, Human
cgagggcagcagcacugcagggc

SEQ ID NO: 1092840 - RNA, 24 nt, Human
cgccucggccucccacagugcugg

SEQ ID NO: 1092841 - RNA, 23 nt, Human
cgggaggcugaggugggaggauc

SEQ ID NO: 1092842 - RNA, 20 nt, Human
cucagccucaauccagggug

SEQ ID NO: 1092843 - RNA, 22 nt, Human
cucagccucaauccagggugac

SEQ ID NO: 1092844 - RNA, 22 nt, Human
cucccggggccaccugcccgcc

SEQ ID NO: 1092845 - RNA, 24 nt, Human
cuccuuccggaggcccuggggagg

SEQ ID NO: 1092846 - RNA, 21 nt, Human
cucuauucugcucugcucuuc

SEQ ID NO: 1092847 - RNA, 22 nt, Human
cucuuccagcucugggggcucc

SEQ ID NO: 1092848 - RNA, 19 nt, Human
cugaggggcuucagggaga

SEQ ID NO: 1092849 - RNA, 21 nt, Human
cugugcaucugucucuauucu

SEQ ID NO: 1092850 - RNA, 18 nt, Human
cuuccuggggccucucca

SEQ ID NO: 1092851 - RNA, 22 nt, Human
cuugcaagcccacgauggcuac

SEQ ID NO: 1092852 - RNA, 19 nt, Human
gagaccucccccaucucua

SEQ ID NO: 1092853 - RNA, 22 nt, Human
gagaugggguccccagcaagcc

SEQ ID NO: 1092854 - RNA, 19 nt, Human
gagggagggaggagccugc

SEQ ID NO: 1092855 - RNA, 21 nt, Human
gaggugggaggaucgcuugag

SEQ ID NO: 1092856 - RNA, 19 nt, Human
gagguucugggcggacaug

SEQ ID NO: 1092857 - RNA, 24 nt, Human
gaucacuugagcccaagaguucaa

SEQ ID NO: 1092858 - RNA, 26 nt, Human
gaucacuugagcccaagaguucaagg

SEQ ID NO: 1092859 - RNA, 19 nt, Human
gaugacaggcuugagccac

SEQ ID NO: 1092860 - RNA, 19 nt, Human
gauggcaccuguaguccca

SEQ ID NO: 1092861 - RNA, 20 nt, Human
gcagcagcacugcagggcag

SEQ ID NO: 1092862 - RNA, 22 nt, Human
gcccuacuaccagggaagguug

SEQ ID NO: 1092863 - RNA, 23 nt, Human
gcuaugaucacaccacugcacuu

SEQ ID NO: 1092864 - RNA, 23 nt, Human
ggaggcuuccuggaggaggcggc

SEQ ID NO: 1092865 - RNA, 23 nt, Human
ggaucacuugagcccaagaguuc

SEQ ID NO: 1092866 - RNA, 19 nt, Human
ggaugccacgaguccaaaa

SEQ ID NO: 1092867 - RNA, 22 nt, Human
ggcaaacaaaucagggaaaaug

SEQ ID NO: 1092868 - RNA, 19 nt, Human
ggcaccuguagucccagcu

SEQ ID NO: 1092869 - RNA, 21 nt, Human
ggcagcagcacugcagggcag

SEQ ID NO: 1092870 - RNA, 21 nt, Human
ggcggccacagggcagcuguc

SEQ ID NO: 1092871 - RNA, 24 nt, Human
ggcuggucuugaacuccuguccuc

SEQ ID NO: 1092872 - RNA, 18 nt, Human
gggaggcugaggugggag

SEQ ID NO: 1092873 - RNA, 22 nt, Human
gggaggcugaggugggaggauc

SEQ ID NO: 1092874 - RNA, 22 nt, Human
gggcagcagcacugcagggcag

SEQ ID NO: 1092875 - RNA, 18 nt, Human
ggggcaggacacugucca

SEQ ID NO: 1092876 - RNA, 19 nt, Human
gggggcuccacgccccugc

SEQ ID NO: 1092877 - RNA, 24 nt, Human
guccucaggugauccacccgccuc

SEQ ID NO: 1092878 - RNA, 24 nt, Human
gucugauggcaccuguagucccag

SEQ ID NO: 1092879 - RNA, 24 nt, Human
gugauccacccgccucggccuccc

SEQ ID NO: 1092880 - RNA, 18 nt, Human
gugcugggaugacaggcu

SEQ ID NO: 1092881 - RNA, 21 nt, Human
guugcauucugagguucuggg

SEQ ID NO: 1092882 - RNA, 20 nt, Human
uaacacuuugggaggccaag

SEQ ID NO: 1092883 - RNA, 23 nt, Human
uaacacuuugggaggccaaggcg

SEQ ID NO: 1092884 - RNA, 23 nt, Human
ucacuugagcccaagaguucaag

SEQ ID NO: 1092885 - RNA, 18 nt, Human
ucaggagucaacacagau

SEQ ID NO: 1092886 - RNA, 21 nt, Human
ucagggagacgcaggugcugg

SEQ ID NO: 1092887 - RNA, 19 nt, Human
ucagugccgggcgccgcug

SEQ ID NO: 1092888 - RNA, 21 nt, Human
ucagugccgggcgccgcugug

SEQ ID NO: 1092889 - RNA, 23 nt, Human
uccaaggaggaggcuuccuggag

SEQ ID NO: 1092890 - RNA, 21 nt, Human
uccacgccccugcugcggccg

SEQ ID NO: 1092891 - RNA, 24 nt, Human
uccaggaugcugcggccaggccag

SEQ ID NO: 1092892 - RNA, 19 nt, Human
uccauauagccauguugcc

SEQ ID NO: 1092893 - RNA, 24 nt, Human
ucccacagugcugggaugacaggc

SEQ ID NO: 1092894 - RNA, 25 nt, Human
uccccagauccuuaauuacaucugc

SEQ ID NO: 1092895 - RNA, 21 nt, Human
ucccucccucuuccagcucug

SEQ ID NO: 1092896 - RNA, 22 nt, Human
ucccuuuucauuucccucugag

SEQ ID NO: 1092897 - RNA, 20 nt, Human
uccgucugggcucccggggc

SEQ ID NO: 1092898 - RNA, 19 nt, Human
uccuggggcugcuguagug

SEQ ID NO: 1092899 - RNA, 20 nt, Human
uccuggggcugcuguagugc

SEQ ID NO: 1092900 - RNA, 24 nt, Human
ucgcuugagcccaggcauuagagg

SEQ ID NO: 1092901 - RNA, 24 nt, Human
ucgggaggcugaggugggaggauc

SEQ ID NO: 1092902 - RNA, 20 nt, Human
ucugcaaagcccuacuaccg

SEQ ID NO: 1092903 - RNA, 24 nt, Human
ucugcacguuucccugcucugucc

SEQ ID NO: 1092904 - RNA, 19 nt, Human
ucugucucuauucugcucu

SEQ ID NO: 1092905 - RNA, 18 nt, Human
ucugucuuucucguuccc

SEQ ID NO: 1092906 - RNA, 23 nt, Human
ugaaaaguugaugaggcaaacaa

SEQ ID NO: 1092907 - RNA, 18 nt, Human
ugaccucguccccagauc

SEQ ID NO: 1092908 - RNA, 24 nt, Human
ugaccucguccccagauccuuaau

SEQ ID NO: 1092909 - RNA, 23 nt, Human
ugagcccaagaguucaaggccag

SEQ ID NO: 1092910 - RNA, 18 nt, Human
ugaggugggaggaucgcu

SEQ ID NO: 1092911 - RNA, 20 nt, Human
ugaggugggaggaucgcuug

SEQ ID NO: 1092912 - RNA, 23 nt, Human
ugaggugggaggaucgcuugagc

SEQ ID NO: 1092913 - RNA, 24 nt, Human
ugaggugggaggaucgcuugagcc

SEQ ID NO: 1092914 - RNA, 19 nt, Human
ugauggcaccuguaguccc

SEQ ID NO: 1092915 - RNA, 19 nt, Human
ugcagggcaggcucugagg

SEQ ID NO: 1092916 - RNA, 24 nt, Human
ugcccaggcuggucuugaacuccu

SEQ ID NO: 1092917 - RNA, 22 nt, Human
ugccucuguccucacagggccu

SEQ ID NO: 1092918 - RNA, 18 nt, Human
ugcggccaggccaggcgc

SEQ ID NO: 1092919 - RNA, 24 nt, Human
ugcucugcucuucauggaggaaca

SEQ ID NO: 1092920 - RNA, 22 nt, Human
ugcugggaugacaggcuugagc

SEQ ID NO: 1092921 - RNA, 20 nt, Human
uggaggaccccggccacuug

SEQ ID NO: 1092922 - RNA, 24 nt, Human
ugggaggccaaggcgagaggauca

SEQ ID NO: 1092923 - RNA, 22 nt, Human
ugggaugacaggcuugagccac

SEQ ID NO: 1092924 - RNA, 24 nt, Human
ugggaugacaggcuugagccacug

SEQ ID NO: 1092925 - RNA, 22 nt, Human
ugggcagcacgcagcacacucc

SEQ ID NO: 1092926 - RNA, 18 nt, Human
ugggggcaggacacuguc

SEQ ID NO: 1092927 - RNA, 22 nt, Human
ugggugcaggggcggccacagg

SEQ ID NO: 1092928 - RNA, 23 nt, Human
uggucuugaacuccuguccucag

SEQ ID NO: 1092929 - RNA, 22 nt, Human
ugguggcucaagccugccaucc

SEQ ID NO: 1092930 - RNA, 24 nt, Human
uguccucaggugauccacccgccu

SEQ ID NO: 1092931 - RNA, 18 nt, Human
uguggaggaccccggcca

SEQ ID NO: 1092932 - RNA, 19 nt, Human
uguggaggaccccggccac

SEQ ID NO: 1092933 - RNA, 20 nt, Human
uucucguucccgcucacgcc

SEQ ID NO: 1092934 - RNA, 24 nt, Human
uugaaugagucaacaacaaaaugc

SEQ ID NO: 1092935 - RNA, 18 nt, Human
uuuugggggcaggacacu

SEQ ID NO: 1092936 - RNA, 19 nt, Human
aaaacagugcacugccucc

SEQ ID NO: 1092937 - RNA, 21 nt, Human
aaacagugcacugccuccuca

SEQ ID NO: 1092938 - RNA, 24 nt, Human
aaggagguggugggcccuggacac

SEQ ID NO: 1092939 - RNA, 20 nt, Human
accccacgggcaccccggcc

SEQ ID NO: 1092940 - RNA, 25 nt, Human
acccucaucaccccugaggccccac

SEQ ID NO: 1092941 - RNA, 25 nt, Human
acccuggacccccuucccgaggccu

SEQ ID NO: 1092942 - RNA, 26 nt, Human
acccuggacccccuucccgaggccuc

SEQ ID NO: 1092943 - RNA, 23 nt, Human
agaaacuccucaaccaggaagga

SEQ ID NO: 1092944 - RNA, 24 nt, Human
agaaggcagguccaaggcacagca

SEQ ID NO: 1092945 - RNA, 19 nt, Human
aggaaggagguggugggcc

SEQ ID NO: 1092946 - RNA, 22 nt, Human
aggaaggagguggugggcccug

SEQ ID NO: 1092947 - RNA, 24 nt, Human
aggaaggagguggugggcccugga

SEQ ID NO: 1092948 - RNA, 20 nt, Human
aggccaagguggguggauca

SEQ ID NO: 1092949 - RNA, 21 nt, Human
aggccucuccaggccacuccc

SEQ ID NO: 1092950 - RNA, 18 nt, Human
aggcucagccacccugga

SEQ ID NO: 1092951 - RNA, 22 nt, Human
agguucuagaggcugcgggucu

SEQ ID NO: 1092952 - RNA, 18 nt, Human
agguuuuggagauaaagc

SEQ ID NO: 1092953 - RNA, 19 nt, Human
agguuuuggagauaaagcu

SEQ ID NO: 1092954 - RNA, 21 nt, Human
agguuuuggagauaaagcuga

SEQ ID NO: 1092955 - RNA, 21 nt, Human
auuuuguucucugggaagugg

SEQ ID NO: 1092956 - RNA, 22 nt, Human
caagguggguggaucaugaggu

SEQ ID NO: 1092957 - RNA, 24 nt, Human
caagguggguggaucaugagguca

SEQ ID NO: 1092958 - RNA, 21 nt, Human
cacaggccgguggaguggagc

SEQ ID NO: 1092959 - RNA, 20 nt, Human
cacgcaccucugcggcgucc

SEQ ID NO: 1092960 - RNA, 20 nt, Human
cagagcccccaaaacagugc

SEQ ID NO: 1092961 - RNA, 24 nt, Human
cagcacuuuguaaggccaaggugg

SEQ ID NO: 1092962 - RNA, 22 nt, Human
cagcgugggaccggccuccacu

SEQ ID NO: 1092963 - RNA, 19 nt, Human
caucaacacgcaccucugc

SEQ ID NO: 1092964 - RNA, 23 nt, Human
ccaugagggccgguguccccuag

SEQ ID NO: 1092965 - RNA, 23 nt, Human
ccccaaaacagugcacugccucc

SEQ ID NO: 1092966 - RNA, 20 nt, Human
ccccacgggcaccccggccc

SEQ ID NO: 1092967 - RNA, 22 nt, Human
cccccaaaacagugcacugccu

SEQ ID NO: 1092968 - RNA, 20 nt, Human
ccccugaggccccaccucca

SEQ ID NO: 1092969 - RNA, 25 nt, Human
ccccugaggccccaccuccacgucc

SEQ ID NO: 1092970 - RNA, 22 nt, Human
cccggccccgucagaaggcagg

SEQ ID NO: 1092971 - RNA, 25 nt, Human
cccuggacccccuucccgaggccuc

SEQ ID NO: 1092972 - RNA, 19 nt, Human
cccugggacugcgccugac

SEQ ID NO: 1092973 - RNA, 23 nt, Human
ccucaucaccccugaggccccac

SEQ ID NO: 1092974 - RNA, 19 nt, Human
ccucugcggcguccuccuc

SEQ ID NO: 1092975 - RNA, 20 nt, Human
ccuguaccccggggucucug

SEQ ID NO: 1092976 - RNA, 20 nt, Human
ccugucaucccagcacuuug

SEQ ID NO: 1092977 - RNA, 20 nt, Human
ccuucagcccaucgcugugu

SEQ ID NO: 1092978 - RNA, 22 nt, Human
cggggagacguaacaagaauca

SEQ ID NO: 1092979 - RNA, 19 nt, Human
cuaggaggcuccacccugg

SEQ ID NO: 1092980 - RNA, 19 nt, Human
cucacucccugcgggaugc

SEQ ID NO: 1092981 - RNA, 22 nt, Human
cucaucuaacccucaucacccc

SEQ ID NO: 1092982 - RNA, 24 nt, Human
cucaugccugucaucccagcacuu

SEQ ID NO: 1092983 - RNA, 18 nt, Human
cuccuguaccccgggguc

SEQ ID NO: 1092984 - RNA, 23 nt, Human
cugcgggucuaagaucaaggucc

SEQ ID NO: 1092985 - RNA, 23 nt, Human
cugggcagcuccagcauucucuc

SEQ ID NO: 1092986 - RNA, 23 nt, Human
cuucaagucgggcaggccgggcu

SEQ ID NO: 1092987 - RNA, 18 nt, Human
cuucccgaggccucucca

SEQ ID NO: 1092988 - RNA, 18 nt, Human
gagcaucugccacuaugg

SEQ ID NO: 1092989 - RNA, 21 nt, Human
gcaggaccggccgggcacggu

SEQ ID NO: 1092990 - RNA, 19 nt, Human
gccaagguggguggaucau

SEQ ID NO: 1092991 - RNA, 18 nt, Human
gccccaccuccacguccc

SEQ ID NO: 1092992 - RNA, 22 nt, Human
gccgggcacgguggcucaugcc

SEQ ID NO: 1092993 - RNA, 23 nt, Human
gcuagaguugcccacucaggugu

SEQ ID NO: 1092994 - RNA, 21 nt, Human
ggagcuguaugucucagccag

SEQ ID NO: 1092995 - RNA, 19 nt, Human
ggcagcuccagcauucucu

SEQ ID NO: 1092996 - RNA, 21 nt, Human
ggccgggcacgguggcucaug

SEQ ID NO: 1092997 - RNA, 23 nt, Human
ggccgggcacgguggcucaugcc

SEQ ID NO: 1092998 - RNA, 20 nt, Human
gggaccccacgggcaccccg

SEQ ID NO: 1092999 - RNA, 20 nt, Human
gggcaccccggccccgucag

SEQ ID NO: 1093000 - RNA, 24 nt, Human
gggcacgguggcucaugccuguca

SEQ ID NO: 1093001 - RNA, 20 nt, Human
ggggucuagaccucccuggg

SEQ ID NO: 1093002 - RNA, 23 nt, Human
gguggcucaugccugucauccca

SEQ ID NO: 1093003 - RNA, 24 nt, Human
gguggcucaugccugucaucccag

SEQ ID NO: 1093004 - RNA, 19 nt, Human
guggguggaucaugagguc

SEQ ID NO: 1093005 - RNA, 19 nt, Human
uaaaaagcuucccccucau

SEQ ID NO: 1093006 - RNA, 20 nt, Human
uaccccaccuccuggcacaa

SEQ ID NO: 1093007 - RNA, 21 nt, Human
uaccccggggucucugggcac

SEQ ID NO: 1093008 - RNA, 18 nt, Human
uaggaggcuccacccugg

SEQ ID NO: 1093009 - RNA, 21 nt, Human
ucacacccugggcagcuccag

SEQ ID NO: 1093010 - RNA, 24 nt, Human
ucacacccugggcagcuccagcau

SEQ ID NO: 1093011 - RNA, 24 nt, Human
ucagaaggcagguccaaggcacag

SEQ ID NO: 1093012 - RNA, 22 nt, Human
ucaugccugucaucccagcacu

SEQ ID NO: 1093013 - RNA, 18 nt, Human
uccagggucggagggcuc

SEQ ID NO: 1093014 - RNA, 21 nt, Human
ucccagaaacuccucaaccag

SEQ ID NO: 1093015 - RNA, 22 nt, Human
ucccccucauuugcagucauuu

SEQ ID NO: 1093016 - RNA, 24 nt, Human
ucccugcccuucuaggaggcucca

SEQ ID NO: 1093017 - RNA, 22 nt, Human
ucccugggacugcgccugaccc

SEQ ID NO: 1093018 - RNA, 19 nt, Human
uccuguaccccggggucuc

SEQ ID NO: 1093019 - RNA, 19 nt, Human
ucucugggcacaggccggu

SEQ ID NO: 1093020 - RNA, 18 nt, Human
ucugcggcguccuccucc

SEQ ID NO: 1093021 - RNA, 18 nt, Human
ugaguugauacauugggg

SEQ ID NO: 1093022 - RNA, 22 nt, Human
ugcagguucuagaggcugcggg

SEQ ID NO: 1093023 - RNA, 19 nt, Human
ugcccacucagguguggga

SEQ ID NO: 1093024 - RNA, 21 nt, Human
uggcucaugccugucauccca

SEQ ID NO: 1093025 - RNA, 24 nt, Human
uggcucaugccugucaucccagca

SEQ ID NO: 1093026 - RNA, 19 nt, Human
ugggaagugguagguuuug

SEQ ID NO: 1093027 - RNA, 23 nt, Human
ugggaagugguagguuuuggaga

SEQ ID NO: 1093028 - RNA, 21 nt, Human
ugggaccccacgggcaccccg

SEQ ID NO: 1093029 - RNA, 18 nt, Human
ugggacugcgccugaccc

SEQ ID NO: 1093030 - RNA, 24 nt, Human
uguaaggccaagguggguggauca

SEQ ID NO: 1093031 - RNA, 21 nt, Human
uguuuuccaaugauaauuuca

SEQ ID NO: 1093032 - RNA, 19 nt, Human
uucaaaggcuagaguugcc

SEQ ID NO: 1093033 - RNA, 22 nt, Human
uucagagcccccaaaacagugc

SEQ ID NO: 1093034 - RNA, 21 nt, Human
uucucccagaaacuccucaac

SEQ ID NO: 1093035 - RNA, 22 nt, Human
uuggggucuagaccucccuggg

SEQ ID NO: 1093036 - RNA, 20 nt, Human
uuguguuugcgucuccuccc

SEQ ID NO: 1093037 - RNA, 23 nt, Human
aaaaaaccaaaaaagccauuacg

SEQ ID NO: 1093038 - RNA, 23 nt, Human
aaacaaaaaaccaaaaaagccau

SEQ ID NO: 1093039 - RNA, 21 nt, Human
aaacaaaacaaaaaaccaaaa

SEQ ID NO: 1093040 - RNA, 19 nt, Human
aacacggugaaaccccguc

SEQ ID NO: 1093041 - RNA, 20 nt, Human
aacacggugaaaccccgucu

SEQ ID NO: 1093042 - RNA, 21 nt, Human
aacacggugaaaccccgucuc

SEQ ID NO: 1093043 - RNA, 20 nt, Human
aacaugaugaaauccugucu

SEQ ID NO: 1093044 - RNA, 21 nt, Human
aaccacuuaggugcugcccaa

SEQ ID NO: 1093045 - RNA, 24 nt, Human
aacggagugagacuccaucucaga

SEQ ID NO: 1093046 - RNA, 23 nt, Human
aacucuuuauuaaauucucccau

SEQ ID NO: 1093047 - RNA, 21 nt, Human
aagaccaaugggagggaaggc

SEQ ID NO: 1093048 - RNA, 20 nt, Human
aagguggguggaccacaugu

SEQ ID NO: 1093049 - RNA, 24 nt, Human
aagugggcacaucaugaggucagg

SEQ ID NO: 1093050 - RNA, 19 nt, Human
acaaaacaaaaaaccaaaa

SEQ ID NO: 1093051 - RNA, 22 nt, Human
acaaaacaaaaaaccaaaaaag

SEQ ID NO: 1093052 - RNA, 23 nt, Human
acagcacuccagccuggcaacgg

SEQ ID NO: 1093053 - RNA, 25 nt, Human
acagcacuccagccuggcaacggag

SEQ ID NO: 1093054 - RNA, 24 nt, Human
accccgucucuacuaaaaauacaa

SEQ ID NO: 1093055 - RNA, 23 nt, Human
acgagugaaacugugucucaaaa

SEQ ID NO: 1093056 - RNA, 24 nt, Human
acggagugagacuccaucucagaa

SEQ ID NO: 1093057 - RNA, 23 nt, Human
acuccagccuggcaacggaguga

SEQ ID NO: 1093058 - RNA, 23 nt, Human
acuccagccugggcaacgaguga

SEQ ID NO: 1093059 - RNA, 18 nt, Human
acugcacuccagccuggg

SEQ ID NO: 1093060 - RNA, 22 nt, Human
acugcacuccagccugggcaac

SEQ ID NO: 1093061 - RNA, 25 nt, Human
acugcacuccagccugggcaacgag

SEQ ID NO: 1093062 - RNA, 22 nt, Human
agaaaaaaaaaaaaaaggccag

SEQ ID NO: 1093063 - RNA, 24 nt, Human
agaaauaaaaggaagcauucuggc

SEQ ID NO: 1093064 - RNA, 22 nt, Human
agaaguugcagugagccgagau

SEQ ID NO: 1093065 - RNA, 24 nt, Human
agaaguugcagugagccgagauug

SEQ ID NO: 1093066 - RNA, 18 nt, Human
agaguguguucuaaggag

SEQ ID NO: 1093067 - RNA, 25 nt, Human
agcaaccaaagaccaaugggaggga

SEQ ID NO: 1093068 - RNA, 21 nt, Human
agccuggcaacggagugagac

SEQ ID NO: 1093069 - RNA, 23 nt, Human
agccuggcaacggagugagacuc

SEQ ID NO: 1093070 - RNA, 21 nt, Human
agccugggcaacgagugaaac

SEQ ID NO: 1093071 - RNA, 22 nt, Human
agcgggagaggaccacggguca

SEQ ID NO: 1093072 - RNA, 18 nt, Human
agcugggugugguggugc

SEQ ID NO: 1093073 - RNA, 23 nt, Human
agcugggugugguggugcaugcc

SEQ ID NO: 1093074 - RNA, 22 nt, Human
aggaggcaggggaggaaauggg

SEQ ID NO: 1093075 - RNA, 23 nt, Human
aggaguucgaaaccagcguggcc

SEQ ID NO: 1093076 - RNA, 21 nt, Human
aggcagaaguugcagugagcc

SEQ ID NO: 1093077 - RNA, 24 nt, Human
aggcagaaguugcagugagccgag

SEQ ID NO: 1093078 - RNA, 22 nt, Human
aggcaggacaaucgcuugaacc

SEQ ID NO: 1093079 - RNA, 24 nt, Human
aggcaggacaaucgcuugaaccag

SEQ ID NO: 1093080 - RNA, 18 nt, Human
aggcaggagaacugcuug

SEQ ID NO: 1093081 - RNA, 24 nt, Human
aggcaggagaacugcuugaaccua

SEQ ID NO: 1093082 - RNA, 18 nt, Human
aggcaggggaggaaaugg

SEQ ID NO: 1093083 - RNA, 24 nt, Human
aggcaugguggugcaugcccguaa

SEQ ID NO: 1093084 - RNA, 21 nt, Human
aggccaagguggguggaccac

SEQ ID NO: 1093085 - RNA, 21 nt, Human
aggccgaagugggcacaucau

SEQ ID NO: 1093086 - RNA, 23 nt, Human
aggcgaguggggaggaaggaagu

SEQ ID NO: 1093087 - RNA, 21 nt, Human
aggcgaguggggaggaagggg

SEQ ID NO: 1093088 - RNA, 20 nt, Human
aggcugaggcaggacaaucg

SEQ ID NO: 1093089 - RNA, 24 nt, Human
aggcugaggcaggacaaucgcuug

SEQ ID NO: 1093090 - RNA, 24 nt, Human
aggcugaggcaggagaacugcuug

SEQ ID NO: 1093091 - RNA, 18 nt, Human
agggaaggcaggcaagaa

SEQ ID NO: 1093092 - RNA, 21 nt, Human
aguggccucuccccagaugac

SEQ ID NO: 1093093 - RNA, 23 nt, Human
agugggcacaucaugaggucagg

SEQ ID NO: 1093094 - RNA, 24 nt, Human
auagcgccacagcacuccagccug

SEQ ID NO: 1093095 - RNA, 24 nt, Human
auugcgccacugcacuccagccug

SEQ ID NO: 1093096 - RNA, 23 nt, Human
caaaaaaccaaaaaagccauuac

SEQ ID NO: 1093097 - RNA, 24 nt, Human
caacacggugaaaccccgucucua

SEQ ID NO: 1093098 - RNA, 24 nt, Human
caacaugaugaaauccugucucua

SEQ ID NO: 1093099 - RNA, 24 nt, Human
caacuacuugggaggcugaggcag

SEQ ID NO: 1093100 - RNA, 24 nt, Human
caaggccugagagagacccacagc

SEQ ID NO: 1093101 - RNA, 26 nt, Human
caagguggguggaccacaugugguca

SEQ ID NO: 1093102 - RNA, 18 nt, Human
caaguaaaaaccugcaaa

SEQ ID NO: 1093103 - RNA, 24 nt, Human
caaguaaaaaccugcaaacucuuu

SEQ ID NO: 1093104 - RNA, 20 nt, Human
cacagcacuccagccuggca

SEQ ID NO: 1093105 - RNA, 23 nt, Human
cacauaauugaggccaagguggg

SEQ ID NO: 1093106 - RNA, 19 nt, Human
cacauguggucaggaguuc

SEQ ID NO: 1093107 - RNA, 24 nt, Human
caccagauggcuuuggggagcucu

SEQ ID NO: 1093108 - RNA, 21 nt, Human
cacuccagccuggcaacggag

SEQ ID NO: 1093109 - RNA, 21 nt, Human
cacuccagccuggcaacggag

SEQ ID NO: 1093110 - RNA, 23 nt, Human
cacuccagccuggcaacggagug

SEQ ID NO: 1093111 - RNA, 21 nt, Human
cacuccagccugggcaacgag

SEQ ID NO: 1093112 - RNA, 21 nt, Human
cacuccagccugggcaacgag

SEQ ID NO: 1093113 - RNA, 23 nt, Human
cacuccagccugggcaacgagug

SEQ ID NO: 1093114 - RNA, 18 nt, Human
cacugcacuccagccugg

SEQ ID NO: 1093115 - RNA, 19 nt, Human
cacugcacuccagccuggg

SEQ ID NO: 1093116 - RNA, 21 nt, Human
cacugcacuccagccugggca

SEQ ID NO: 1093117 - RNA, 23 nt, Human
cacugcacuccagccugggcaac

SEQ ID NO: 1093118 - RNA, 24 nt, Human
cacugcacuccagccugggcaacg

SEQ ID NO: 1093119 - RNA, 27 nt, Human
cacugcacuccagccugggcaacgagu

SEQ ID NO: 1093120 - RNA, 18 nt, Human
cacuuuggaaggccgaag

SEQ ID NO: 1093121 - RNA, 18 nt, Human
cacuuuggaaggccgaag

SEQ ID NO: 1093122 - RNA, 19 nt, Human
cagaaacaaaacaaaaaac

SEQ ID NO: 1093123 - RNA, 20 nt, Human
cagaaacaaaacaaaaaacc

SEQ ID NO: 1093124 - RNA, 20 nt, Human
cagcacuccagccuggcaac

SEQ ID NO: 1093125 - RNA, 23 nt, Human
caggauccugucaccaccagccu

SEQ ID NO: 1093126 - RNA, 21 nt, Human
caggccgggcgugguggcuca

SEQ ID NO: 1093127 - RNA, 24 nt, Human
caugcccguaaucccaacuacuug

SEQ ID NO: 1093128 - RNA, 22 nt, Human
cauucuggccuuucagguuuuu

SEQ ID NO: 1093129 - RNA, 24 nt, Human
ccaaaaaagccauuacggccaaaa

SEQ ID NO: 1093130 - RNA, 21 nt, Human
ccaaagaccaaugggagggaa

SEQ ID NO: 1093131 - RNA, 23 nt, Human
ccaagaaggggugcaguuagagg

SEQ ID NO: 1093132 - RNA, 19 nt, Human
ccacagcacuccagccugg

SEQ ID NO: 1093133 - RNA, 20 nt, Human
ccacagcacuccagccuggc

SEQ ID NO: 1093134 - RNA, 23 nt, Human
ccacagcacuccagccuggcaac

SEQ ID NO: 1093135 - RNA, 18 nt, Human
ccacauguggucaggagu

SEQ ID NO: 1093136 - RNA, 20 nt, Human
ccacugcacuccagccuggg

SEQ ID NO: 1093137 - RNA, 21 nt, Human
ccacugcacuccagccugggc

SEQ ID NO: 1093138 - RNA, 23 nt, Human
ccacugcacuccagccugggcaa

SEQ ID NO: 1093139 - RNA, 24 nt, Human
ccacugcacuccagccugggcaac

SEQ ID NO: 1093140 - RNA, 21 nt, Human
ccaggcaugguggugcaugcc

SEQ ID NO: 1093141 - RNA, 25 nt, Human
ccaggccgggcgugguggcucacgc

SEQ ID NO: 1093142 - RNA, 25 nt, Human
ccaggccgggcgugguggcucacgg

SEQ ID NO: 1093143 - RNA, 19 nt, Human
cccacaaugaccucaccag

SEQ ID NO: 1093144 - RNA, 20 nt, Human
cccacaaugaccucaccaga

SEQ ID NO: 1093145 - RNA, 19 nt, Human
cccggccccacgcccucua

SEQ ID NO: 1093146 - RNA, 19 nt, Human
cccggccccacgcccucuc

SEQ ID NO: 1093147 - RNA, 23 nt, Human
ccuggacaacacggugaaacccc

SEQ ID NO: 1093148 - RNA, 24 nt, Human
ccuggacaacacggugaaaccccg

SEQ ID NO: 1093149 - RNA, 22 nt, Human
ccuguaaucccagcuacuccgg

SEQ ID NO: 1093150 - RNA, 23 nt, Human
ccuguaaucccagcuacuccgga

SEQ ID NO: 1093151 - RNA, 21 nt, Human
ccugucaccaccagccugagc

SEQ ID NO: 1093152 - RNA, 22 nt, Human
ccugucaccaccagccugagca

SEQ ID NO: 1093153 - RNA, 24 nt, Human
cgaagugggcacaucaugagguca

SEQ ID NO: 1093154 - RNA, 24 nt, Human
cgccacugcacuccagccugggca

SEQ ID NO: 1093155 - RNA, 24 nt, Human
cguggccaacaugaugaaauccug

SEQ ID NO: 1093156 - RNA, 18 nt, Human
cuaguggagaggaggcga

SEQ ID NO: 1093157 - RNA, 18 nt, Human
cucaaaagaaaaaaaaaa

SEQ ID NO: 1093158 - RNA, 22 nt, Human
cucagaaacaaaacaaaaaacc

SEQ ID NO: 1093159 - RNA, 20 nt, Human
cucagacccggccccacgcc

SEQ ID NO: 1093160 - RNA, 24 nt, Human
cugugucucaaaagaaaaaaaaaa

SEQ ID NO: 1093161 - RNA, 23 nt, Human
cuuuggaaggccgaagugggcac

SEQ ID NO: 1093162 - RNA, 24 nt, Human
gaccacauguggucaggaguucga

SEQ ID NO: 1093163 - RNA, 23 nt, Human
gaccucaccagauggcuuugggg

SEQ ID NO: 1093164 - RNA, 23 nt, Human
gagauugcgccacugcacuccag

SEQ ID NO: 1093165 - RNA, 20 nt, Human
gaggaaggaccaagaagggg

SEQ ID NO: 1093166 - RNA, 21 nt, Human
gauggcuuuggggagcucuuc

SEQ ID NO: 1093167 - RNA, 23 nt, Human
gcacuccagccuggcaacggagu

SEQ ID NO: 1093168 - RNA, 24 nt, Human
gccaacaugaugaaauccugucuc

SEQ ID NO: 1093169 - RNA, 22 nt, Human
gccacugcacuccagccugggc

SEQ ID NO: 1093170 - RNA, 24 nt, Human
gccacugcacuccagccugggcaa

SEQ ID NO: 1093171 - RNA, 24 nt, Human
gcccguaaucccaacuacuuggga

SEQ ID NO: 1093172 - RNA, 23 nt, Human
gcgccacagcacuccagccuggc

SEQ ID NO: 1093173 - RNA, 22 nt, Human
ggagaacugcuugaaccuagga

SEQ ID NO: 1093174 - RNA, 18 nt, Human
ggcacaucaugaggucag

SEQ ID NO: 1093175 - RNA, 24 nt, Human
gggcgugguggcucacgccuguaa

SEQ ID NO: 1093176 - RNA, 24 nt, Human
gggugugguggugcaugccuguaa

SEQ ID NO: 1093177 - RNA, 19 nt, Human
ggugacaaauaaucagucc

SEQ ID NO: 1093178 - RNA, 21 nt, Human
ggugcaugccuguaaucccag

SEQ ID NO: 1093179 - RNA, 20 nt, Human
gguggcucacgccuguaaug

SEQ ID NO: 1093180 - RNA, 24 nt, Human
gguggugcaugccuguaaucccag

SEQ ID NO: 1093181 - RNA, 21 nt, Human
gucucaaaagaaaaaaaaaaa

SEQ ID NO: 1093182 - RNA, 19 nt, Human
guugcagugagccgagauu

SEQ ID NO: 1093183 - RNA, 22 nt, Human
uaaaaaccugcaaacucuuuau

SEQ ID NO: 1093184 - RNA, 19 nt, Human
uacuccggaggcugaggca

SEQ ID NO: 1093185 - RNA, 24 nt, Human
uaggaggcagaaguugcagugagc

SEQ ID NO: 1093186 - RNA, 20 nt, Human
uaucuauuaucugaagucug

SEQ ID NO: 1093187 - RNA, 23 nt, Human
ucacaccacaggccuggaggaug

SEQ ID NO: 1093188 - RNA, 23 nt, Human
ucaccagauggcuuuggggagcu

SEQ ID NO: 1093189 - RNA, 24 nt, Human
ucaugaggucaggagauggagacc

SEQ ID NO: 1093190 - RNA, 22 nt, Human
uccagccuggcaacggagugag

SEQ ID NO: 1093191 - RNA, 23 nt, Human
uccagccuggcaacggagugaga

SEQ ID NO: 1093192 - RNA, 22 nt, Human
ucccugguccccacaaugaccu

SEQ ID NO: 1093193 - RNA, 26 nt, Human
ucccugguccccacaaugaccucacc

SEQ ID NO: 1093194 - RNA, 25 nt, Human
uccuggacaacacggugaaaccccg

SEQ ID NO: 1093195 - RNA, 20 nt, Human
ucggaggauucgguaagcug

SEQ ID NO: 1093196 - RNA, 22 nt, Human
ucggggcagaagucacaccaca

SEQ ID NO: 1093197 - RNA, 20 nt, Human
ucuagggcuggcugacuucc

SEQ ID NO: 1093198 - RNA, 20 nt, Human
ucuccccagaugacucacua

SEQ ID NO: 1093199 - RNA, 22 nt, Human
ucucuacuaaaaauaagaaaaa

SEQ ID NO: 1093200 - RNA, 21 nt, Human
ucucuacuaaaaauacaaaaa

SEQ ID NO: 1093201 - RNA, 21 nt, Human
ugaaauacaaguaaauauacc

SEQ ID NO: 1093202 - RNA, 22 nt, Human
ugacuuccaagguuccuggucc

SEQ ID NO: 1093203 - RNA, 19 nt, Human
ugagagagacccacagcac

SEQ ID NO: 1093204 - RNA, 22 nt, Human
ugagccgagauugcgccacugc

SEQ ID NO: 1093205 - RNA, 24 nt, Human
ugaggcaggacaaucgcuugaacc

SEQ ID NO: 1093206 - RNA, 24 nt, Human
ugaggcaggagaacugcuugaacc

SEQ ID NO: 1093207 - RNA, 25 nt, Human
ugaggcaggagaacugcuugaaccu

SEQ ID NO: 1093208 - RNA, 24 nt, Human
ugcacauaauugaggccaaggugg

SEQ ID NO: 1093209 - RNA, 23 nt, Human
ugcccguaaucccaacuacuugg

SEQ ID NO: 1093210 - RNA, 24 nt, Human
ugcccguaaucccaacuacuuggg

SEQ ID NO: 1093211 - RNA, 19 nt, Human
ugccuguaaucccagcuac

SEQ ID NO: 1093212 - RNA, 24 nt, Human
ugccuguaaucccagcuacuccgg

SEQ ID NO: 1093213 - RNA, 24 nt, Human
uggaaggccgaagugggcacauca

SEQ ID NO: 1093214 - RNA, 24 nt, Human
uggaccacauguggucaggaguuc

SEQ ID NO: 1093215 - RNA, 23 nt, Human
uggagaggaggcgaguggggagg

SEQ ID NO: 1093216 - RNA, 20 nt, Human
uggccaacaugaugaaaucc

SEQ ID NO: 1093217 - RNA, 24 nt, Human
uggccaacaugaugaaauccuguc

SEQ ID NO: 1093218 - RNA, 19 nt, Human
ugggaagggaaggccucuu

SEQ ID NO: 1093219 - RNA, 20 nt, Human
ugggaagggaaggccucuuu

SEQ ID NO: 1093220 - RNA, 20 nt, Human
ugggaagggaaggccucuuu

SEQ ID NO: 1093221 - RNA, 24 nt, Human
ugggaagggaaggccucuuuucag

SEQ ID NO: 1093222 - RNA, 24 nt, Human
ugggaagggaaggccucuuuucag

SEQ ID NO: 1093223 - RNA, 18 nt, Human
ugggaggcugaggcagga

SEQ ID NO: 1093224 - RNA, 19 nt, Human
ugggaggcugaggcaggag

SEQ ID NO: 1093225 - RNA, 24 nt, Human
uggguggaccacauguggucagga

SEQ ID NO: 1093226 - RNA, 21 nt, Human
uggugcaugccuguaauccca

SEQ ID NO: 1093227 - RNA, 22 nt, Human
uggugcaugccuguaaucccag

SEQ ID NO: 1093228 - RNA, 18 nt, Human
ugguggcucacgccugua

SEQ ID NO: 1093229 - RNA, 24 nt, Human
ugguggugcaugcccguaauccca

SEQ ID NO: 1093230 - RNA, 24 nt, Human
ugguggugcaugccuguaauccca

SEQ ID NO: 1093231 - RNA, 21 nt, Human
uguggaggaaggaccaagaag

SEQ ID NO: 1093232 - RNA, 24 nt, Human
uguggaggaaggaccaagaagggg

SEQ ID NO: 1093233 - RNA, 21 nt, Human
uguggucaggaguucgaaacc

SEQ ID NO: 1093234 - RNA, 18 nt, Human
uuacaaaaccacuuaggu

SEQ ID NO: 1093235 - RNA, 22 nt, Human
uuagcugggugugguggugcau

SEQ ID NO: 1093236 - RNA, 24 nt, Human
uuagcugggugugguggugcaugc

SEQ ID NO: 1093237 - RNA, 18 nt, Human
uucaguggccucucccca

SEQ ID NO: 1093238 - RNA, 22 nt, Human
uucgaaaccagcguggccaaca

SEQ ID NO: 1093239 - RNA, 18 nt, Human
uugcagugagccgagauu

SEQ ID NO: 1093240 - RNA, 19 nt, Human
uugcagugagccgagauug

SEQ ID NO: 1093241 - RNA, 20 nt, Human
uugcagugagccgagauugc

SEQ ID NO: 1093242 - RNA, 22 nt, Human
uugcagugagccgagauugcgc

SEQ ID NO: 1093243 - RNA, 23 nt, Human
uugcgccacugcacuccagccug

SEQ ID NO: 1093244 - RNA, 19 nt, Human
uuuggaaggccgaaguggg

SEQ ID NO: 1093245 - RNA, 25 nt, Human
uuuuucaaacucacaagauguugaa

SEQ ID NO: 1093246 - RNA, 23 nt, Human
ucccuuuaaguuacgacgggaau

SEQ ID NO: 1093247 - RNA, 20 nt, Human
ugcuuaagagcccaugcagg

SEQ ID NO: 1093248 - RNA, 21 nt, Human
aacuugcuuaugagaauggga

SEQ ID NO: 1093249 - RNA, 22 nt, Human
aagcagcacucacacagucuca

SEQ ID NO: 1093250 - RNA, 22 nt, Human
caaucacuuaaccucucugggc

SEQ ID NO: 1093251 - RNA, 25 nt, Human
cacaaauccacugggugcugcucuc

SEQ ID NO: 1093252 - RNA, 21 nt, Human
ccacugggugcugcucucagc

SEQ ID NO: 1093253 - RNA, 23 nt, Human
cugggccucaguuuccucaucug

SEQ ID NO: 1093254 - RNA, 18 nt, Human
gagaaugggaaguaagga

SEQ ID NO: 1093255 - RNA, 23 nt, Human
gcagcacucacacagucucauac

SEQ ID NO: 1093256 - RNA, 18 nt, Human
ggaaacuugcuuaugaga

SEQ ID NO: 1093257 - RNA, 19 nt, Human
ggcaggaacuuauaucuuc

SEQ ID NO: 1093258 - RNA, 18 nt, Human
uacaauaugcugugagag

SEQ ID NO: 1093259 - RNA, 21 nt, Human
uccucaucugccacaaaucca

SEQ ID NO: 1093260 - RNA, 21 nt, Human
ugcagggaccauggguuuuua

SEQ ID NO: 1093261 - RNA, 24 nt, Human
aaccccuaauguucuuuuuuuccc

SEQ ID NO: 1093262 - RNA, 22 nt, Human
aucuggaggguacaggagccug

SEQ ID NO: 1093263 - RNA, 19 nt, Human
cagcuuccugagguacaga

SEQ ID NO: 1093264 - RNA, 21 nt, Human
cccuccuucaucucucugguc

SEQ ID NO: 1093265 - RNA, 23 nt, Human
cccuccuucaucucucuggucuc

SEQ ID NO: 1093266 - RNA, 21 nt, Human
cuccacauggcaacgaacacc

SEQ ID NO: 1093267 - RNA, 24 nt, Human
uacaauucaaccccuaauguucuu

SEQ ID NO: 1093268 - RNA, 18 nt, Human
uaucuggaggguacagga

SEQ ID NO: 1093269 - RNA, 19 nt, Human
ucuggucuccugcugguac

SEQ ID NO: 1093270 - RNA, 27 nt, Human
ugaaaagcagcuuccugagguacagag

SEQ ID NO: 1093271 - RNA, 24 nt, Human
ugggaaggaucucuccacauggca

SEQ ID NO: 1093272 - RNA, 23 nt, Human
ugggcaaagaggauuuccaggac

SEQ ID NO: 1093273 - RNA, 20 nt, Human
uguagcaucuuucuucuugg

SEQ ID NO: 1093274 - RNA, 22 nt, Human
uguucuuuuuuucccuccuuca

SEQ ID NO: 1093275 - RNA, 18 nt, Human
uuccaggacacuuuguag

SEQ ID NO: 1093276 - RNA, 23 nt, Human
uucccuccuucaucucucugguc

SEQ ID NO: 1093277 - RNA, 25 nt, Human
caaaaaaggguaggagccgcgagac

SEQ ID NO: 1093278 - RNA, 23 nt, Human
cacgcgguccgcggccaagggcc

SEQ ID NO: 1093279 - RNA, 22 nt, Human
cccaaagggugccggcgccgaa

SEQ ID NO: 1093280 - RNA, 19 nt, Human
cccacgcgguccgcggcca

SEQ ID NO: 1093281 - RNA, 21 nt, Human
cccgugaccagugagaaaggc

SEQ ID NO: 1093282 - RNA, 19 nt, Human
cgagacccuccaacugccc

SEQ ID NO: 1093283 - RNA, 18 nt, Human
gacccuccaacugcccag

SEQ ID NO: 1093284 - RNA, 18 nt, Human
gugaccagugagaaaggc

SEQ ID NO: 1093285 - RNA, 21 nt, Human
ugcccagagaaaacaagucuc

SEQ ID NO: 1093286 - RNA, 19 nt, Human
ugcgaaauaacagcagccu

SEQ ID NO: 1093287 - RNA, 24 nt, Human
uuccaaaaaaggguaggagccgcg

SEQ ID NO: 1093288 - RNA, 19 nt, Human
aacuuuugcucaucaacag

SEQ ID NO: 1093289 - RNA, 26 nt, Human
acagaccgcuaauaaaagacgaucug

SEQ ID NO: 1093290 - RNA, 21 nt, Human
acccccaagccuucccagugc

SEQ ID NO: 1093291 - RNA, 23 nt, Human
agcagggaacuuuugcucaucaa

SEQ ID NO: 1093292 - RNA, 23 nt, Human
agggaggagguggggggcuuggg

SEQ ID NO: 1093293 - RNA, 18 nt, Human
caacaggagaggaggugg

SEQ ID NO: 1093294 - RNA, 22 nt, Human
ccaccaaggcccuugccaccaa

SEQ ID NO: 1093295 - RNA, 26 nt, Human
cccccaagccuucccagugcugacaa

SEQ ID NO: 1093296 - RNA, 18 nt, Human
cgcgcccucgggcccugc

SEQ ID NO: 1093297 - RNA, 23 nt, Human
cuacccccaagccuucccagugc

SEQ ID NO: 1093298 - RNA, 23 nt, Human
cuacugaccucucaaggcuuccu

SEQ ID NO: 1093299 - RNA, 19 nt, Human
gaaggagguggcugcuacc

SEQ ID NO: 1093300 - RNA, 20 nt, Human
gaagggaggagguggggggc

SEQ ID NO: 1093301 - RNA, 18 nt, Human
gagguggggggcuugggc

SEQ ID NO: 1093302 - RNA, 22 nt, Human
gcccucgggcccugccaugucc

SEQ ID NO: 1093303 - RNA, 21 nt, Human
gcugacaaccccgggggcagg

SEQ ID NO: 1093304 - RNA, 21 nt, Human
ggaggagguggggggcuuggg

SEQ ID NO: 1093305 - RNA, 19 nt, Human
ggcugggaagggaggaggu

SEQ ID NO: 1093306 - RNA, 18 nt, Human
gggcugggaagggaggag

SEQ ID NO: 1093307 - RNA, 20 nt, Human
ggguugggggaaggaggugg

SEQ ID NO: 1093308 - RNA, 21 nt, Human
ggucgggggacccugggaggu

SEQ ID NO: 1093309 - RNA, 26 nt, Human
ggugggugugggugcucagguugagu

SEQ ID NO: 1093310 - RNA, 19 nt, Human
ucagggaggaggaaagcag

SEQ ID NO: 1093311 - RNA, 20 nt, Human
uccaaucuggggucggggga

SEQ ID NO: 1093312 - RNA, 22 nt, Human
ucccagugcugacaaccccggg

SEQ ID NO: 1093313 - RNA, 23 nt, Human
ucccagugcugacaaccccgggg

SEQ ID NO: 1093314 - RNA, 18 nt, Human
uccccagcugcucgcugg

SEQ ID NO: 1093315 - RNA, 19 nt, Human
ucgcgcccucgggcccugc

SEQ ID NO: 1093316 - RNA, 22 nt, Human
ucgcugggcagucagggaggag

SEQ ID NO: 1093317 - RNA, 22 nt, Human
ucgggcccugccaugucccugg

SEQ ID NO: 1093318 - RNA, 18 nt, Human
ucucaaggcuuccuccaa

SEQ ID NO: 1093319 - RNA, 18 nt, Human
ugcucaucaacaggagag

SEQ ID NO: 1093320 - RNA, 22 nt, Human
ugggaagggaggaggugggggg

SEQ ID NO: 1093321 - RNA, 19 nt, Human
ugggggaaggagguggcug

SEQ ID NO: 1093322 - RNA, 20 nt, Human
ugggggaaggagguggcugc

SEQ ID NO: 1093323 - RNA, 21 nt, Human
uggggggcuugggccauggga

SEQ ID NO: 1093324 - RNA, 19 nt, Human
uggguugggggaaggaggu

SEQ ID NO: 1093325 - RNA, 21 nt, Human
uggguugggggaaggaggugg

SEQ ID NO: 1093326 - RNA, 19 nt, Human
uguuggguugggggaagga

SEQ ID NO: 1093327 - RNA, 25 nt, Human
uuauuuauuuacccaaauuugaacu

SEQ ID NO: 1093328 - RNA, 23 nt, Human
aagggucccgcgggaaucggggc

SEQ ID NO: 1093329 - RNA, 22 nt, Human
acggcagcacaccaggcaccca

SEQ ID NO: 1093330 - RNA, 23 nt, Human
aggcacccaggggaaggaaccag

SEQ ID NO: 1093331 - RNA, 24 nt, Human
aggcacccaggggaaggaaccagg

SEQ ID NO: 1093332 - RNA, 19 nt, Human
aggugcuggugagguucuc

SEQ ID NO: 1093333 - RNA, 20 nt, Human
caagucauuguagagacccg

SEQ ID NO: 1093334 - RNA, 20 nt, Human
caccugggagcccccagcuc

SEQ ID NO: 1093335 - RNA, 26 nt, Human
cacugucaacccuguucguccagcag

SEQ ID NO: 1093336 - RNA, 26 nt, Human
cagcaugcugaacugagcugcuggag

SEQ ID NO: 1093337 - RNA, 20 nt, Human
ccagcagcacaaugguggcc

SEQ ID NO: 1093338 - RNA, 18 nt, Human
ccaggcacccaggggaag

SEQ ID NO: 1093339 - RNA, 18 nt, Human
ccaggggaaggaaccagg

SEQ ID NO: 1093340 - RNA, 23 nt, Human
ccugggagcccccagcucccgag

SEQ ID NO: 1093341 - RNA, 18 nt, Human
ccuguuaagagggggagg

SEQ ID NO: 1093342 - RNA, 24 nt, Human
cgggcagcgucacuuuuucuuggg

SEQ ID NO: 1093343 - RNA, 23 nt, Human
cuacaggggcugcugcgcucaac

SEQ ID NO: 1093344 - RNA, 21 nt, Human
cuucuugaugucggugcugac

SEQ ID NO: 1093345 - RNA, 19 nt, Human
gagcccgagggcacagcag

SEQ ID NO: 1093346 - RNA, 21 nt, Human
gcacaaugguggccgcaaaaa

SEQ ID NO: 1093347 - RNA, 24 nt, Human
gccacugugggaagaaagggaggc

SEQ ID NO: 1093348 - RNA, 19 nt, Human
gcuggcccugaccccccag

SEQ ID NO: 1093349 - RNA, 20 nt, Human
ggaggccugaggccccaggg

SEQ ID NO: 1093350 - RNA, 22 nt, Human
ggaggccugaggccccagggac

SEQ ID NO: 1093351 - RNA, 19 nt, Human
ggagggacaaagcggguuc

SEQ ID NO: 1093352 - RNA, 22 nt, Human
ggagggacaaagcggguucuga

SEQ ID NO: 1093353 - RNA, 20 nt, Human
ggcacagcaggacugugacc

SEQ ID NO: 1093354 - RNA, 23 nt, Human
ggcuuggcggaccauuggccgag

SEQ ID NO: 1093355 - RNA, 18 nt, Human
gugccucuucagcgucca

SEQ ID NO: 1093356 - RNA, 24 nt, Human
uccucugcuguccugccccaagau

SEQ ID NO: 1093357 - RNA, 18 nt, Human
ucugugcccggaggaagg

SEQ ID NO: 1093358 - RNA, 19 nt, Human
ugaccugaucugccaggug

SEQ ID NO: 1093359 - RNA, 21 nt, Human
ugagacggcagcacaccaggc

SEQ ID NO: 1093360 - RNA, 25 nt, Human
ugagacggcagcacaccaggcaccc

SEQ ID NO: 1093361 - RNA, 24 nt, Human
ugaggccccagggacaggggcugg

SEQ ID NO: 1093362 - RNA, 22 nt, Human
ugccagguguccuacaggggcu

SEQ ID NO: 1093363 - RNA, 21 nt, Human
ugcuggugagguucucuucuu

SEQ ID NO: 1093364 - RNA, 20 nt, Human
ugucggugcugacacagaag

SEQ ID NO: 1093365 - RNA, 23 nt, Human
uuagugaaaaguuccuaaaauuc

SEQ ID NO: 1093366 - RNA, 24 nt, Human
aaucuuguucuucuacuguuuucu

SEQ ID NO: 1093367 - RNA, 21 nt, Human
agauccugcugagacaaacaa

SEQ ID NO: 1093368 - RNA, 22 nt, Human
ccuccaaacuuacaggugaagu

SEQ ID NO: 1093369 - RNA, 19 nt, Human
cuuaaaaggugaguucuua

SEQ ID NO: 1093370 - RNA, 22 nt, Human
uacacugucuucauuaauuucu

SEQ ID NO: 1093371 - RNA, 23 nt, Human
uacacugucuucauuaauuucug

SEQ ID NO: 1093372 - RNA, 19 nt, Human
uacuguuuucuuaauagaa

SEQ ID NO: 1093373 - RNA, 23 nt, Human
uagaacuugugggcaguuggcca

SEQ ID NO: 1093374 - RNA, 24 nt, Human
uaggaauguaucaacaccuuuuuc

SEQ ID NO: 1093375 - RNA, 22 nt, Human
uaggucgugaguaguaaguuca

SEQ ID NO: 1093376 - RNA, 19 nt, Human
uagugucuugcuguauucc

SEQ ID NO: 1093377 - RNA, 23 nt, Human
uccuuuaacuccaccagaaggua

SEQ ID NO: 1093378 - RNA, 21 nt, Human
ucuaaauuagaacuugugggc

SEQ ID NO: 1093379 - RNA, 21 nt, Human
ucuggagaaucuggaaguuca

SEQ ID NO: 1093380 - RNA, 20 nt, Human
ucugguugggcaguuggugg

SEQ ID NO: 1093381 - RNA, 21 nt, Human
ucuuaauagaaugcuuaaucu

SEQ ID NO: 1093382 - RNA, 21 nt, Human
ugcuuaaucuuuucagcucuu

SEQ ID NO: 1093383 - RNA, 24 nt, Human
uguaaaggaacuguagucgcccug

SEQ ID NO: 1093384 - RNA, 21 nt, Human
uguagagacagucauuuuuuu

SEQ ID NO: 1093385 - RNA, 23 nt, Human
uguaucaacaccuuuuucugguu

SEQ ID NO: 1093386 - RNA, 20 nt, Human
ugucuugcuguauucccuuu

SEQ ID NO: 1093387 - RNA, 19 nt, Human
uuuaagacuuaaaagguga

SEQ ID NO: 1093388 - RNA, 21 nt, Human
aaaaaaaaaaaaagaagaaga

SEQ ID NO: 1093389 - RNA, 19 nt, Human
aaaaaaaaaaagaagaaga

SEQ ID NO: 1093390 - RNA, 23 nt, Human
aaaaaaaaaaagaagaagaagaa

SEQ ID NO: 1093391 - RNA, 21 nt, Human
aaaaaaaaaagaagaagaaga

SEQ ID NO: 1093392 - RNA, 27 nt, Human
aaaaaaaaaagaagaagaagaagaucg

SEQ ID NO: 1093393 - RNA, 19 nt, Human
aaaaaaaagaagaagaaga

SEQ ID NO: 1093394 - RNA, 19 nt, Human
aaaaaaaagaagaagaaga

SEQ ID NO: 1093395 - RNA, 18 nt, Human
aaaaaagaagaagaagaa

SEQ ID NO: 1093396 - RNA, 19 nt, Human
aaaaaagaagaagaagaag

SEQ ID NO: 1093397 - RNA, 18 nt, Human
aaaaagaagaagaagaag

SEQ ID NO: 1093398 - RNA, 29 nt, Human
aagaagaagaagaagaucgaaaagucaaa

SEQ ID NO: 1093399 - RNA, 20 nt, Human
aagaagaagaagaucgaaaa

SEQ ID NO: 1093400 - RNA, 18 nt, Human
aagaagaagaucgaaaag

SEQ ID NO: 1093401 - RNA, 28 nt, Human
aagaggcugcugagugcggacacagccc

SEQ ID NO: 1093402 - RNA, 23 nt, Human
aaggcaggcggaucaugagguca

SEQ ID NO: 1093403 - RNA, 18 nt, Human
acaccacugcacuccagc

SEQ ID NO: 1093404 - RNA, 20 nt, Human
acaccacugcacuccagccu

SEQ ID NO: 1093405 - RNA, 24 nt, Human
acagagcgagacuccaucucaaaa

SEQ ID NO: 1093406 - RNA, 23 nt, Human
acagcccgggaggccaggagccc

SEQ ID NO: 1093407 - RNA, 24 nt, Human
acccugucuuuacuaaaaauacaa

SEQ ID NO: 1093408 - RNA, 23 nt, Human
acugcacuccagccuggugacag

SEQ ID NO: 1093409 - RNA, 25 nt, Human
acugcacuccagccuggugacagag

SEQ ID NO: 1093410 - RNA, 23 nt, Human
agaagaagaagaagaucgaaaag

SEQ ID NO: 1093411 - RNA, 26 nt, Human
agagaguuggaggcugcagugagcug

SEQ ID NO: 1093412 - RNA, 23 nt, Human
agaguuggaggcugcagugagcu

SEQ ID NO: 1093413 - RNA, 21 nt, Human
agccuggugacagagcgagac

SEQ ID NO: 1093414 - RNA, 23 nt, Human
agccuggugacagagcgagacuc

SEQ ID NO: 1093415 - RNA, 19 nt, Human
aggcaggaaccuggguggg

SEQ ID NO: 1093416 - RNA, 22 nt, Human
aggcaggagaaucgcuugaacc

SEQ ID NO: 1093417 - RNA, 24 nt, Human
aggcaggagaaucgcuugaaccag

SEQ ID NO: 1093418 - RNA, 18 nt, Human
aggcaggcggaucaugag

SEQ ID NO: 1093419 - RNA, 24 nt, Human
aggcaggcggaucaugaggucagg

SEQ ID NO: 1093420 - RNA, 23 nt, Human
aggccaaggcaggcggaucauga

SEQ ID NO: 1093421 - RNA, 18 nt, Human
aggcggaucaugagguca

SEQ ID NO: 1093422 - RNA, 22 nt, Human
aggcggaucaugaggucaggag

SEQ ID NO: 1093423 - RNA, 20 nt, Human
aggcugaggcaggagaaucg

SEQ ID NO: 1093424 - RNA, 24 nt, Human
aggcugaggcaggagaaucgcuug

SEQ ID NO: 1093425 - RNA, 24 nt, Human
aguuggaggcugcagugagcugag

SEQ ID NO: 1093426 - RNA, 20 nt, Human
aguugugcgugguggugggu

SEQ ID NO: 1093427 - RNA, 24 nt, Human
aucacaccacugcacuccagccug

SEQ ID NO: 1093428 - RNA, 20 nt, Human
aucaugaggucaggagaucc

SEQ ID NO: 1093429 - RNA, 20 nt, Human
aucauggugaaacccugucu

SEQ ID NO: 1093430 - RNA, 21 nt, Human
aucucaaaaaaaaaaaaaaag

SEQ ID NO: 1093431 - RNA, 19 nt, Human
aucucugcccccaccccgc

SEQ ID NO: 1093432 - RNA, 22 nt, Human
caaggcaggcggaucaugaggu

SEQ ID NO: 1093433 - RNA, 21 nt, Human
cacaccacugcacuccagccu

SEQ ID NO: 1093434 - RNA, 21 nt, Human
cacaccuacuggguguggcug

SEQ ID NO: 1093435 - RNA, 25 nt, Human
caccacugcacuccagccuggugac

SEQ ID NO: 1093436 - RNA, 19 nt, Human
caccauccaggagcagggc

SEQ ID NO: 1093437 - RNA, 21 nt, Human
caccugcacugagacacgggc

SEQ ID NO: 1093438 - RNA, 22 nt, Human
cacuccagccuggugacagagc

SEQ ID NO: 1093439 - RNA, 23 nt, Human
cacuccagccuggugacagagcg

SEQ ID NO: 1093440 - RNA, 18 nt, Human
cacugcacuccagccugg

SEQ ID NO: 1093441 - RNA, 18 nt, Human
cacugcacuccagccugg

SEQ ID NO: 1093442 - RNA, 18 nt, Human
cacugcacuccagccugg

SEQ ID NO: 1093443 - RNA, 23 nt, Human
cacugcacuccagccuggugaca

SEQ ID NO: 1093444 - RNA, 23 nt, Human
cacugcacuccagccuggugaca

SEQ ID NO: 1093445 - RNA, 24 nt, Human
cagcacuuugggaggccaaggcag

SEQ ID NO: 1093446 - RNA, 24 nt, Human
cagcacuuugggaggccaaggcag

SEQ ID NO: 1093447 - RNA, 22 nt, Human
cagcccgggaggccaggagccc

SEQ ID NO: 1093448 - RNA, 24 nt, Human
cagcuacucaggaggcugaggcag

SEQ ID NO: 1093449 - RNA, 20 nt, Human
caggagccccaggacagaga

SEQ ID NO: 1093450 - RNA, 19 nt, Human
caggcaggaaccugggugg

SEQ ID NO: 1093451 - RNA, 21 nt, Human
caguuccugagccgucugccc

SEQ ID NO: 1093452 - RNA, 18 nt, Human
cauggugaaacccugucu

SEQ ID NO: 1093453 - RNA, 18 nt, Human
cauggugaaacccugucu

SEQ ID NO: 1093454 - RNA, 18 nt, Human
cauggugaaacccugucu

SEQ ID NO: 1093455 - RNA, 21 nt, Human
ccaccuggccccuccucccca

SEQ ID NO: 1093456 - RNA, 19 nt, Human
ccacugcacuccagccugg

SEQ ID NO: 1093457 - RNA, 19 nt, Human
ccacugcacuccagccugg

SEQ ID NO: 1093458 - RNA, 20 nt, Human
ccacugcacuccagccuggu

SEQ ID NO: 1093459 - RNA, 23 nt, Human
ccacugcacuccagccuggugac

SEQ ID NO: 1093460 - RNA, 24 nt, Human
ccacugcacuccagccuggugaca

SEQ ID NO: 1093461 - RNA, 23 nt, Human
ccagagccuucugugagcagugg

SEQ ID NO: 1093462 - RNA, 23 nt, Human
ccaggacagagaggaacagcaca

SEQ ID NO: 1093463 - RNA, 25 nt, Human
ccaucucaaaaaaaaaaaaaaagaa

SEQ ID NO: 1093464 - RNA, 21 nt, Human
cccaccauccaggagcagggc

SEQ ID NO: 1093465 - RNA, 25 nt, Human
cccagcgaggagcagcaggguaccc

SEQ ID NO: 1093466 - RNA, 21 nt, Human
ccccacggcuccaccugcacu

SEQ ID NO: 1093467 - RNA, 23 nt, Human
ccccuccuccccaugagaggccc

SEQ ID NO: 1093468 - RNA, 21 nt, Human
ccugagccgucugcccagagc

SEQ ID NO: 1093469 - RNA, 18 nt, Human
ccugcacugagacacggg

SEQ ID NO: 1093470 - RNA, 22 nt, Human
ccuggcuaucauggugaaaccc

SEQ ID NO: 1093471 - RNA, 22 nt, Human
ccuggcuaucauggugaaaccc

SEQ ID NO: 1093472 - RNA, 24 nt, Human
ccuggcuaucauggugaaacccug

SEQ ID NO: 1093473 - RNA, 20 nt, Human
ccuggcuucaggccugcgug

SEQ ID NO: 1093474 - RNA, 18 nt, Human
ccugggugggguaugggg

SEQ ID NO: 1093475 - RNA, 21 nt, Human
ccuggugacagagcgagacuc

SEQ ID NO: 1093476 - RNA, 22 nt, Human
ccuguaaucccagcacuuuggg

SEQ ID NO: 1093477 - RNA, 19 nt, Human
ccuguaaucccagcuacuc

SEQ ID NO: 1093478 - RNA, 21 nt, Human
ccuguaaucccagcuacucag

SEQ ID NO: 1093479 - RNA, 24 nt, Human
cgagaccauccuggcuaucauggu

SEQ ID NO: 1093480 - RNA, 23 nt, Human
cgagacuccaucucaaaaaaaaa

SEQ ID NO: 1093481 - RNA, 23 nt, Human
cggccgcgaagaggcugcugagu

SEQ ID NO: 1093482 - RNA, 20 nt, Human
cgggcaacccugaagcucac

SEQ ID NO: 1093483 - RNA, 24 nt, Human
cucaaaaaaaaaaaaaaagaagaa

SEQ ID NO: 1093484 - RNA, 22 nt, Human
cucaucucugcccccaccccgc

SEQ ID NO: 1093485 - RNA, 24 nt, Human
cuccacaccuacuggguguggcug

SEQ ID NO: 1093486 - RNA, 24 nt, Human
cuccagccuggugacagagcgaga

SEQ ID NO: 1093487 - RNA, 19 nt, Human
cuccaucucaaaaaaaaaa

SEQ ID NO: 1093488 - RNA, 18 nt, Human
cugagacacgggcuucug

SEQ ID NO: 1093489 - RNA, 19 nt, Human
cugcagugagcugagauca

SEQ ID NO: 1093490 - RNA, 20 nt, Human
cugcagugagcugagaucac

SEQ ID NO: 1093491 - RNA, 19 nt, Human
cuggaggccuccucaucuc

SEQ ID NO: 1093492 - RNA, 24 nt, Human
cuggcuaucauggugaaacccugu

SEQ ID NO: 1093493 - RNA, 19 nt, Human
gaaacccugucuuuacuaa

SEQ ID NO: 1093494 - RNA, 22 nt, Human
gaggcugcagugagcugagauc

SEQ ID NO: 1093495 - RNA, 23 nt, Human
gcacuccagccuggugacagagc

SEQ ID NO: 1093496 - RNA, 18 nt, Human
gcccuggacccugcugug

SEQ ID NO: 1093497 - RNA, 18 nt, Human
gccuguaaucccagcacu

SEQ ID NO: 1093498 - RNA, 21 nt, Human
gccuguaaucccagcacuuug

SEQ ID NO: 1093499 - RNA, 21 nt, Human
gccuguaaucccagcacuuug

SEQ ID NO: 1093500 - RNA, 24 nt, Human
gcuaucauggugaaacccugucuu

SEQ ID NO: 1093501 - RNA, 20 nt, Human
gcugagaucacaccacugca

SEQ ID NO: 1093502 - RNA, 21 nt, Human
ggaagaccucggccgcgaaga

SEQ ID NO: 1093503 - RNA, 24 nt, Human
ggagcagggcagugcuuuaccccg

SEQ ID NO: 1093504 - RNA, 22 nt, Human
ggaggccuccucaucucugccc

SEQ ID NO: 1093505 - RNA, 18 nt, Human
ggaggcugcagugagcug

SEQ ID NO: 1093506 - RNA, 20 nt, Human
ggaggcugcagugagcugag

SEQ ID NO: 1093507 - RNA, 23 nt, Human
ggaggcugcagugagcugagauc

SEQ ID NO: 1093508 - RNA, 24 nt, Human
ggaggcugcagugagcugagauca

SEQ ID NO: 1093509 - RNA, 18 nt, Human
ggcaggaaccuggguggg

SEQ ID NO: 1093510 - RNA, 21 nt, Human
ggccuugacuuuggucccauc

SEQ ID NO: 1093511 - RNA, 24 nt, Human
gguggugggugccuguaaucccag

SEQ ID NO: 1093512 - RNA, 18 nt, Human
gugccuguaaucccagcu

SEQ ID NO: 1093513 - RNA, 21 nt, Human
uaucauggugaaacccugucu

SEQ ID NO: 1093514 - RNA, 19 nt, Human
ucaaaaaaaaaaaaaaaga

SEQ ID NO: 1093515 - RNA, 23 nt, Human
ucacaccacugcacuccagccug

SEQ ID NO: 1093516 - RNA, 18 nt, Human
ucaugaggucaggagauc

SEQ ID NO: 1093517 - RNA, 24 nt, Human
ucaugaggucaggagaucgagacc

SEQ ID NO: 1093518 - RNA, 18 nt, Human
ucauggugaaacccuguc

SEQ ID NO: 1093519 - RNA, 19 nt, Human
ucauggugaaacccugucu

SEQ ID NO: 1093520 - RNA, 22 nt, Human
uccagccuggugacagagcgag

SEQ ID NO: 1093521 - RNA, 20 nt, Human
uccaggagcagggcagugcu

SEQ ID NO: 1093522 - RNA, 23 nt, Human
uccaucucaaaaaaaaaaaaaaa

SEQ ID NO: 1093523 - RNA, 22 nt, Human
ucccaguuccugagccgucugc

SEQ ID NO: 1093524 - RNA, 22 nt, Human
uccucaucucugcccccacccc

SEQ ID NO: 1093525 - RNA, 21 nt, Human
uccuccacaccuacugggugu

SEQ ID NO: 1093526 - RNA, 25 nt, Human
uccugagccgucugcccagagccuu

SEQ ID NO: 1093527 - RNA, 19 nt, Human
ucucugcccccaccccgca

SEQ ID NO: 1093528 - RNA, 19 nt, Human
ugaaccagagaguuggagg

SEQ ID NO: 1093529 - RNA, 18 nt, Human
ugagaggcccuggacccu

SEQ ID NO: 1093530 - RNA, 18 nt, Human
ugagaucacaccacugca

SEQ ID NO: 1093531 - RNA, 24 nt, Human
ugagaucacaccacugcacuccag

SEQ ID NO: 1093532 - RNA, 20 nt, Human
ugaggcaggagaaucgcuug

SEQ ID NO: 1093533 - RNA, 24 nt, Human
ugaggcaggagaaucgcuugaacc

SEQ ID NO: 1093534 - RNA, 20 nt, Human
ugcccagagccuucugugag

SEQ ID NO: 1093535 - RNA, 21 nt, Human
ugcccagagccuucugugagc

SEQ ID NO: 1093536 - RNA, 24 nt, Human
ugccccaggccuugacuuuggucc

SEQ ID NO: 1093537 - RNA, 25 nt, Human
ugcccccaccccgcacuccuggcuu

SEQ ID NO: 1093538 - RNA, 22 nt, Human
ugcccuggaccagacgucuggg

SEQ ID NO: 1093539 - RNA, 22 nt, Human
ugccuggggccuggcuggagac

SEQ ID NO: 1093540 - RNA, 24 nt, Human
ugccuguaaucccagcuacucagg

SEQ ID NO: 1093541 - RNA, 22 nt, Human
ugcuguguggccgggcaacccu

SEQ ID NO: 1093542 - RNA, 20 nt, Human
uggauggaggaaucacaggc

SEQ ID NO: 1093543 - RNA, 19 nt, Human
uggccuucccuccccuucc

SEQ ID NO: 1093544 - RNA, 21 nt, Human
uggcuggggggagacccaggg

SEQ ID NO: 1093545 - RNA, 24 nt, Human
uggcuggggggagacccagggccu

SEQ ID NO: 1093546 - RNA, 22 nt, Human
uggcuucaggccugcguggccu

SEQ ID NO: 1093547 - RNA, 24 nt, Human
ugggaggccaaggcaggcggauca

SEQ ID NO: 1093548 - RNA, 19 nt, Human
uggggacagggccuccugu

SEQ ID NO: 1093549 - RNA, 24 nt, Human
ugguggugggugccuguaauccca

SEQ ID NO: 1093550 - RNA, 22 nt, Human
uguggccgggcaacccugaagc

SEQ ID NO: 1093551 - RNA, 24 nt, Human
uguggcuggggggagacccagggc

SEQ ID NO: 1093552 - RNA, 24 nt, Human
uuaguugugcgugguggugggugc

SEQ ID NO: 1093553 - RNA, 23 nt, Human
aaacacccuucccaggggucccc

SEQ ID NO: 1093554 - RNA, 18 nt, Human
aagcugagcccugcugug

SEQ ID NO: 1093555 - RNA, 20 nt, Human
aaggaaaaacacccuuccca

SEQ ID NO: 1093556 - RNA, 23 nt, Human
accaccaccccuugaagucucag

SEQ ID NO: 1093557 - RNA, 24 nt, Human
acccacagcugugcccucacugcu

SEQ ID NO: 1093558 - RNA, 22 nt, Human
accccaagcaggugccuaaggg

SEQ ID NO: 1093559 - RNA, 24 nt, Human
acccuucccagggguccucuccca

SEQ ID NO: 1093560 - RNA, 20 nt, Human
agaaaaaagaaacuggaaga

SEQ ID NO: 1093561 - RNA, 18 nt, Human
agaagcaggucugagccg

SEQ ID NO: 1093562 - RNA, 23 nt, Human
agcguggaggacagccggggggc

SEQ ID NO: 1093563 - RNA, 21 nt, Human
agggaagggcuggcccuggag

SEQ ID NO: 1093564 - RNA, 23 nt, Human
agguccccagguccccuccgcuc

SEQ ID NO: 1093565 - RNA, 19 nt, Human
auccaccuucaggucccca

SEQ ID NO: 1093566 - RNA, 25 nt, Human
auuugcugguggccuuaaggggcuc

SEQ ID NO: 1093567 - RNA, 23 nt, Human
caagucccauggcagcccagaag

SEQ ID NO: 1093568 - RNA, 27 nt, Human
caccccuugaagucucagacccaguug

SEQ ID NO: 1093569 - RNA, 20 nt, Human
caccgcccucugcccccagc

SEQ ID NO: 1093570 - RNA, 20 nt, Human
cacugcugcgggccacagga

SEQ ID NO: 1093571 - RNA, 21 nt, Human
cacugcugcgggccacaggag

SEQ ID NO: 1093572 - RNA, 23 nt, Human
cagaggccuaagcacggccuucc

SEQ ID NO: 1093573 - RNA, 19 nt, Human
cagcguggaggacagccgg

SEQ ID NO: 1093574 - RNA, 18 nt, Human
cagucaccauccagggug

SEQ ID NO: 1093575 - RNA, 22 nt, Human
cagugugaaaucuggcucuguu

SEQ ID NO: 1093576 - RNA, 20 nt, Human
ccaagcaggugccuaagggc

SEQ ID NO: 1093577 - RNA, 22 nt, Human
ccacagaggccuaagcacggcc

SEQ ID NO: 1093578 - RNA, 22 nt, Human
cccagcaguguguccacagagg

SEQ ID NO: 1093579 - RNA, 22 nt, Human
cccauccaccuucaggucccca

SEQ ID NO: 1093580 - RNA, 21 nt, Human
ccccauccaccuucagguccc

SEQ ID NO: 1093581 - RNA, 23 nt, Human
cccccagcuccccagucugccag

SEQ ID NO: 1093582 - RNA, 19 nt, Human
cccccuuuaggcgggggga

SEQ ID NO: 1093583 - RNA, 19 nt, Human
ccccuauccgcagucacca

SEQ ID NO: 1093584 - RNA, 22 nt, Human
ccccucaaaggaaaaacacccu

SEQ ID NO: 1093585 - RNA, 18 nt, Human
ccccucggaaucuggggc

SEQ ID NO: 1093586 - RNA, 26 nt, Human
ccccugcaacccacagcugugcccuc

SEQ ID NO: 1093587 - RNA, 21 nt, Human
cccuggaggaguggcugggcu

SEQ ID NO: 1093588 - RNA, 21 nt, Human
ccgcaagucccauggcagccc

SEQ ID NO: 1093589 - RNA, 21 nt, Human
ccggcagcguggaggacagcc

SEQ ID NO: 1093590 - RNA, 19 nt, Human
ccgugcuggcugucucccc

SEQ ID NO: 1093591 - RNA, 23 nt, Human
ccgugcuggcugucuccccugca

SEQ ID NO: 1093592 - RNA, 18 nt, Human
ccucugcccccagcuccc

SEQ ID NO: 1093593 - RNA, 21 nt, Human
cgggcagugggugccagguug

SEQ ID NO: 1093594 - RNA, 21 nt, Human
cggggucuuccuuuccaagga

SEQ ID NO: 1093595 - RNA, 21 nt, Human
cuaagggccacgggcaguggg

SEQ ID NO: 1093596 - RNA, 21 nt, Human
cucccaccaccaccccuugaa

SEQ ID NO: 1093597 - RNA, 24 nt, Human
cucccaccaccaccccuugaaguc

SEQ ID NO: 1093598 - RNA, 18 nt, Human
cucugcccccagcucccc

SEQ ID NO: 1093599 - RNA, 23 nt, Human
cuggaagagcauccacuauggca

SEQ ID NO: 1093600 - RNA, 22 nt, Human
gacagugagggcagcaccagga

SEQ ID NO: 1093601 - RNA, 21 nt, Human
gagagucccuggcaggccccu

SEQ ID NO: 1093602 - RNA, 25 nt, Human
gcagcccagaagcaggucugagccg

SEQ ID NO: 1093603 - RNA, 23 nt, Human
gccagguuggagaggcugaggcu

SEQ ID NO: 1093604 - RNA, 21 nt, Human
ggcugcgggagugagcaggug

SEQ ID NO: 1093605 - RNA, 24 nt, Human
gggaagggcuggcccuggaggagu

SEQ ID NO: 1093606 - RNA, 20 nt, Human
gggcucccaccaccaccccu

SEQ ID NO: 1093607 - RNA, 19 nt, Human
gucugccaggcuggggggu

SEQ ID NO: 1093608 - RNA, 20 nt, Human
gugagcaggugccccaaggg

SEQ ID NO: 1093609 - RNA, 20 nt, Human
uaagggccacgggcaguggg

SEQ ID NO: 1093610 - RNA, 24 nt, Human
uccacagaggccuaagcacggccu

SEQ ID NO: 1093611 - RNA, 18 nt, Human
ucccccucaaaggaaaaa

SEQ ID NO: 1093612 - RNA, 20 nt, Human
uccgcagucaccauccaggg

SEQ ID NO: 1093613 - RNA, 18 nt, Human
ucucagacccaguugaac

SEQ ID NO: 1093614 - RNA, 19 nt, Human
ucucugauuucuccgacug

SEQ ID NO: 1093615 - RNA, 21 nt, Human
ugcccggcagcguggaggaca

SEQ ID NO: 1093616 - RNA, 20 nt, Human
ugcugguggccuuaaggggc

SEQ ID NO: 1093617 - RNA, 24 nt, Human
uggaaggcaggaagcugagcccug

SEQ ID NO: 1093618 - RNA, 20 nt, Human
uggcaagauguggcacuugg

SEQ ID NO: 1093619 - RNA, 19 nt, Human
uggcacagaaucccccuca

SEQ ID NO: 1093620 - RNA, 22 nt, Human
uggcacagaaucccccucaaag

SEQ ID NO: 1093621 - RNA, 24 nt, Human
ugggugccagguuggagaggcuga

SEQ ID NO: 1093622 - RNA, 22 nt, Human
uggucuggcugccccuauccgc

SEQ ID NO: 1093623 - RNA, 20 nt, Human
uuaggcggggggacagugag

SEQ ID NO: 1093624 - RNA, 23 nt, Human
uuccucgucccccugagagcuca

SEQ ID NO: 1093625 - RNA, 20 nt, Human
aagaacgccacggccacugc

SEQ ID NO: 1093626 - RNA, 23 nt, Human
aagacgccacagggacuucguga

SEQ ID NO: 1093627 - RNA, 19 nt, Human
aagcgacgcccgaccgaga

SEQ ID NO: 1093628 - RNA, 23 nt, Human
aaguuguguaucuucuucuggcu

SEQ ID NO: 1093629 - RNA, 20 nt, Human
aggagcugcgggaaaagccg

SEQ ID NO: 1093630 - RNA, 25 nt, Human
auuaaguauuacaugggaaugugug

SEQ ID NO: 1093631 - RNA, 24 nt, Human
cacugcaaaacucccacgcucuca

SEQ ID NO: 1093632 - RNA, 21 nt, Human
cgcgacgaagaacgccacggc

SEQ ID NO: 1093633 - RNA, 21 nt, Human
cuucccaccauacagauacug

SEQ ID NO: 1093634 - RNA, 21 nt, Human
gaaaauugaauuuaaacaaaa

SEQ ID NO: 1093635 - RNA, 19 nt, Human
gccacagggacuucgugac

SEQ ID NO: 1093636 - RNA, 24 nt, Human
gcccgaccgagacgcgacgaagaa

SEQ ID NO: 1093637 - RNA, 23 nt, Human
uaauaacaggccucgcgcucccu

SEQ ID NO: 1093638 - RNA, 21 nt, Human
uagcacauugccugggacaua

SEQ ID NO: 1093639 - RNA, 21 nt, Human
uauuacaugggaaugugugua

SEQ ID NO: 1093640 - RNA, 27 nt, Human
uccgcgguuaauaacaggccggggucc

SEQ ID NO: 1093641 - RNA, 23 nt, Human
ugacaggagcugcagaaagcgac

SEQ ID NO: 1093642 - RNA, 20 nt, Human
uguguaaagugcuuagcaca

SEQ ID NO: 1093643 - RNA, 20 nt, Human
aaacaucaccaaugagaggc

SEQ ID NO: 1093644 - RNA, 24 nt, Human
aaacaucaccaaugagaggcauaa

SEQ ID NO: 1093645 - RNA, 18 nt, Human
aacaagcucugggacucg

SEQ ID NO: 1093646 - RNA, 23 nt, Human
aacccguuucccccaugauucca

SEQ ID NO: 1093647 - RNA, 18 nt, Human
aagcucugggacucaggc

SEQ ID NO: 1093648 - RNA, 22 nt, Human
aaugacaaaagaaagaaaaucc

SEQ ID NO: 1093649 - RNA, 20 nt, Human
aauuccaacccguuuccccc

SEQ ID NO: 1093650 - RNA, 21 nt, Human
agagaucaauacaaagccaac

SEQ ID NO: 1093651 - RNA, 21 nt, Human
agcccucucauacacaggcuc

SEQ ID NO: 1093652 - RNA, 19 nt, Human
agcucauggacugcaaccu

SEQ ID NO: 1093653 - RNA, 19 nt, Human
cacugccuccuuucccagc

SEQ ID NO: 1093654 - RNA, 21 nt, Human
caggaaaagcuagaaucuguu

SEQ ID NO: 1093655 - RNA, 25 nt, Human
caggaaaagcuagaaucuguugagu

SEQ ID NO: 1093656 - RNA, 18 nt, Human
cagucuuugguguuuguu

SEQ ID NO: 1093657 - RNA, 22 nt, Human
cccuaguggugguuaacaagau

SEQ ID NO: 1093658 - RNA, 24 nt, Human
ccucggccagcuuggcuuccgugg

SEQ ID NO: 1093659 - RNA, 20 nt, Human
ccucucauacacaggcucag

SEQ ID NO: 1093660 - RNA, 21 nt, Human
ccucucauacacaggcucagu

SEQ ID NO: 1093661 - RNA, 19 nt, Human
cuggccuaccgcagcccug

SEQ ID NO: 1093662 - RNA, 21 nt, Human
cuuuuauugcagaaaauucuu

SEQ ID NO: 1093663 - RNA, 24 nt, Human
gaaaggccgccgaucugaggagcg

SEQ ID NO: 1093664 - RNA, 21 nt, Human
gacuauggaaauugguaagcc

SEQ ID NO: 1093665 - RNA, 19 nt, Human
gauaacaggauccaagaga

SEQ ID NO: 1093666 - RNA, 20 nt, Human
gccuaccgcagcccugucca

SEQ ID NO: 1093667 - RNA, 19 nt, Human
gccugcuacugugaagaga

SEQ ID NO: 1093668 - RNA, 22 nt, Human
gcucagucucuuuaugaguauu

SEQ ID NO: 1093669 - RNA, 23 nt, Human
ggagcgcaaccgccagcccaccg

SEQ ID NO: 1093670 - RNA, 21 nt, Human
ggcuucagcccgaaacuugag

SEQ ID NO: 1093671 - RNA, 20 nt, Human
gugaaauguauguuuauccc

SEQ ID NO: 1093672 - RNA, 22 nt, Human
guuacugcuuuuuguuuuggaa

SEQ ID NO: 1093673 - RNA, 19 nt, Human
uaagaaggaacucaaguga

SEQ ID NO: 1093674 - RNA, 21 nt, Human
uaagaaggaacucaagugaug

SEQ ID NO: 1093675 - RNA, 20 nt, Human
uacacaggcucagucucuuu

SEQ ID NO: 1093676 - RNA, 20 nt, Human
uagugccaagcuccauuugg

SEQ ID NO: 1093677 - RNA, 23 nt, Human
uaguuucuuuuauugcagaaaau

SEQ ID NO: 1093678 - RNA, 21 nt, Human
uaugcaauuaaacaugcaugg

SEQ ID NO: 1093679 - RNA, 22 nt, Human
ucagcccgaaacuugaggccuc

SEQ ID NO: 1093680 - RNA, 23 nt, Human
ucaucuggagauucccuaguggu

SEQ ID NO: 1093681 - RNA, 18 nt, Human
uccaaaauucuucaucuu

SEQ ID NO: 1093682 - RNA, 21 nt, Human
uccaacuuugcaaaccguguc

SEQ ID NO: 1093683 - RNA, 20 nt, Human
uccaaugacaaaagaaagaa

SEQ ID NO: 1093684 - RNA, 22 nt, Human
uccaaugacaaaagaaagaaaa

SEQ ID NO: 1093685 - RNA, 19 nt, Human
ucucccaagagcacugccu

SEQ ID NO: 1093686 - RNA, 25 nt, Human
ucucccaagagcacugccuccuuuc

SEQ ID NO: 1093687 - RNA, 22 nt, Human
ucuguuggcuucagcccgaaac

SEQ ID NO: 1093688 - RNA, 20 nt, Human
ugaccacagaagacuacuga

SEQ ID NO: 1093689 - RNA, 20 nt, Human
ugaguggcugcagagcaagu

SEQ ID NO: 1093690 - RNA, 22 nt, Human
ugauuccauuagagaugucuuc

SEQ ID NO: 1093691 - RNA, 21 nt, Human
ugcauguuacugcuuuuuguu

SEQ ID NO: 1093692 - RNA, 20 nt, Human
ugccaauguuucuauuggau

SEQ ID NO: 1093693 - RNA, 22 nt, Human
uggaggccgcuccucgcuuucu

SEQ ID NO: 1093694 - RNA, 20 nt, Human
uggcugcagagcaagucuug

SEQ ID NO: 1093695 - RNA, 23 nt, Human
ugguaagccugcuacugugaaga

SEQ ID NO: 1093696 - RNA, 20 nt, Human
ugguaugcaauuaaacaugc

SEQ ID NO: 1093697 - RNA, 23 nt, Human
ugguugggacucuguuggcuuca

SEQ ID NO: 1093698 - RNA, 23 nt, Human
uguuuguuugcucaggaaaagcu

SEQ ID NO: 1093699 - RNA, 20 nt, Human
uuacugcuuuuuguuuugga

SEQ ID NO: 1093700 - RNA, 18 nt, Human
uucagaaugaggacacug

SEQ ID NO: 1093701 - RNA, 19 nt, Human
acccugaagguggggaagg

SEQ ID NO: 1093702 - RNA, 23 nt, Human
acccugaagguggggaagguggg

SEQ ID NO: 1093703 - RNA, 19 nt, Human
caagagcaggugcaaccca

SEQ ID NO: 1093704 - RNA, 22 nt, Human
caagagcaggugcaacccaggc

SEQ ID NO: 1093705 - RNA, 19 nt, Human
caagcaggcacuguggcca

SEQ ID NO: 1093706 - RNA, 19 nt, Human
cacgccuguaaucccagca

SEQ ID NO: 1093707 - RNA, 21 nt, Human
cucacgccuguaaucccagca

SEQ ID NO: 1093708 - RNA, 21 nt, Human
cucacgccuguaaucccagca

SEQ ID NO: 1093709 - RNA, 19 nt, Human
gccaccuagaaaguggacc

SEQ ID NO: 1093710 - RNA, 23 nt, Human
ggcgcgguggcucacgccuguaa

SEQ ID NO: 1093711 - RNA, 23 nt, Human
gguggcucacgccuguaauccca

SEQ ID NO: 1093712 - RNA, 24 nt, Human
gguggcucacgccuguaaucccag

SEQ ID NO: 1093713 - RNA, 23 nt, Human
uaggcugggcgcgguggcucacg

SEQ ID NO: 1093714 - RNA, 21 nt, Human
ucacgccuguaaucccagcau

SEQ ID NO: 1093715 - RNA, 24 nt, Human
ucgguaaauguucuaauuuuuuuu

SEQ ID NO: 1093716 - RNA, 24 nt, Human
uggcucacgccuguaaucccagca

SEQ ID NO: 1093717 - RNA, 18 nt, Human
aagcaucuugccgagcuc

SEQ ID NO: 1093718 - RNA, 21 nt, Human
agcacaaaggggaagaagccc

SEQ ID NO: 1093719 - RNA, 20 nt, Human
cagcacaaaggggaagaagc

SEQ ID NO: 1093720 - RNA, 19 nt, Human
ccagaagcaucuugccgag

SEQ ID NO: 1093721 - RNA, 23 nt, Human
ccccugagagcggcccggacggg

SEQ ID NO: 1093722 - RNA, 21 nt, Human
ccgcugggagaggcgcccccu

SEQ ID NO: 1093723 - RNA, 19 nt, Human
ccucgggcuccucaggccc

SEQ ID NO: 1093724 - RNA, 22 nt, Human
ccuucugcugcagcugcaaggc

SEQ ID NO: 1093725 - RNA, 25 nt, Human
cucaggcccugggcccccucccagg

SEQ ID NO: 1093726 - RNA, 23 nt, Human
cugcugcagcugcaaggcuaggu

SEQ ID NO: 1093727 - RNA, 20 nt, Human
cuugccgagcuccgcggcca

SEQ ID NO: 1093728 - RNA, 23 nt, Human
gcacaaaggggaagaagcccucg

SEQ ID NO: 1093729 - RNA, 19 nt, Human
gcccccucccaggaaugag

SEQ ID NO: 1093730 - RNA, 23 nt, Human
gcccugggcccccucccaggaau

SEQ ID NO: 1093731 - RNA, 24 nt, Human
gcugggcgcucagcgucuccagcu

SEQ ID NO: 1093732 - RNA, 21 nt, Human
ggaagcugggcccaucuggag

SEQ ID NO: 1093733 - RNA, 19 nt, Human
ggccaacagcaggucuuuc

SEQ ID NO: 1093734 - RNA, 23 nt, Human
ucaccugcagcaucugcggggac

SEQ ID NO: 1093735 - RNA, 19 nt, Human
ucccaggaaugagucccgc

SEQ ID NO: 1093736 - RNA, 18 nt, Human
ucccgccgcuccagcaca

SEQ ID NO: 1093737 - RNA, 18 nt, Human
uccucaggcccugggccc

SEQ ID NO: 1093738 - RNA, 20 nt, Human
ucuccagcugccgccgcagc

SEQ ID NO: 1093739 - RNA, 19 nt, Human
ugagagcggcccggacggg

SEQ ID NO: 1093740 - RNA, 22 nt, Human
aaaauagacaaaagacacgaag

SEQ ID NO: 1093741 - RNA, 19 nt, Human
aaaguggagaccaaggugg

SEQ ID NO: 1093742 - RNA, 20 nt, Human
aacugaaaucuucaaaggcu

SEQ ID NO: 1093743 - RNA, 18 nt, Human
aaucucugccugggucuc

SEQ ID NO: 1093744 - RNA, 23 nt, Human
acacgaagagaaauuucuccaaa

SEQ ID NO: 1093745 - RNA, 18 nt, Human
acugcacuccagcccggg

SEQ ID NO: 1093746 - RNA, 18 nt, Human
acugcacuccagcccggg

SEQ ID NO: 1093747 - RNA, 29 nt, Human
agacaaaagacacgaagagaagggacccc

SEQ ID NO: 1093748 - RNA, 24 nt, Human
agacacgaagagaaauuucuccaa

SEQ ID NO: 1093749 - RNA, 24 nt, Human
agaucccuggcaugggcaccgcuc

SEQ ID NO: 1093750 - RNA, 20 nt, Human
agcacuuugggagguuaagg

SEQ ID NO: 1093751 - RNA, 24 nt, Human
aggaaggcuugcaccacagggucc

SEQ ID NO: 1093752 - RNA, 23 nt, Human
aggagugagacucugucccaaaa

SEQ ID NO: 1093753 - RNA, 23 nt, Human
aggaguucaagaccagccugggc

SEQ ID NO: 1093754 - RNA, 23 nt, Human
aggcuugcaccacaggguccucc

SEQ ID NO: 1093755 - RNA, 21 nt, Human
aggggggucuggaggaaggcu

SEQ ID NO: 1093756 - RNA, 24 nt, Human
aucgugccacugcacuccagcccg

SEQ ID NO: 1093757 - RNA, 21 nt, Human
augaugauuucaucuucagau

SEQ ID NO: 1093758 - RNA, 22 nt, Human
auggacugucacagagcggagg

SEQ ID NO: 1093759 - RNA, 23 nt, Human
auggcucacaccuguaaucccag

SEQ ID NO: 1093760 - RNA, 18 nt, Human
augugcugagccugcugc

SEQ ID NO: 1093761 - RNA, 19 nt, Human
auucugugggguccaagag

SEQ ID NO: 1093762 - RNA, 23 nt, Human
caacaagcacaucaaaagauucu

SEQ ID NO: 1093763 - RNA, 24 nt, Human
cacaccuguaaucccagcacuuug

SEQ ID NO: 1093764 - RNA, 21 nt, Human
cacagagcggagggaaaagag

SEQ ID NO: 1093765 - RNA, 22 nt, Human
caccacaggguccuccaccagg

SEQ ID NO: 1093766 - RNA, 19 nt, Human
caccuguaaucccagcacu

SEQ ID NO: 1093767 - RNA, 24 nt, Human
caccuguaaucccagcacuuuggg

SEQ ID NO: 1093768 - RNA, 22 nt, Human
cacuccagcccgggguuaggag

SEQ ID NO: 1093769 - RNA, 23 nt, Human
cacuccagcccgggguuaggagu

SEQ ID NO: 1093770 - RNA, 24 nt, Human
cacuccagcccgggguuaggagug

SEQ ID NO: 1093771 - RNA, 18 nt, Human
cacugcacuccagcccgg

SEQ ID NO: 1093772 - RNA, 19 nt, Human
cacugcacuccagcccggg

SEQ ID NO: 1093773 - RNA, 19 nt, Human
cacugcacuccagcccggg

SEQ ID NO: 1093774 - RNA, 23 nt, Human
cacugcacuccagcccgggguua

SEQ ID NO: 1093775 - RNA, 20 nt, Human
cagcacuuugggagguuaag

SEQ ID NO: 1093776 - RNA, 22 nt, Human
cagcacuuugggagguuaaggg

SEQ ID NO: 1093777 - RNA, 20 nt, Human
cagccauggcugucucuggg

SEQ ID NO: 1093778 - RNA, 23 nt, Human
caucugcaaaaucucuuauucca

SEQ ID NO: 1093779 - RNA, 22 nt, Human
caucuucagaucuuuaacucaa

SEQ ID NO: 1093780 - RNA, 20 nt, Human
cauucugugggguccaagag

SEQ ID NO: 1093781 - RNA, 24 nt, Human
ccaccucuacuaaaaauaaaaaaa

SEQ ID NO: 1093782 - RNA, 18 nt, Human
ccacgggaaggaccagcc

SEQ ID NO: 1093783 - RNA, 20 nt, Human
ccacugcacuccagcccggg

SEQ ID NO: 1093784 - RNA, 20 nt, Human
ccacugcacuccagcccggg

SEQ ID NO: 1093785 - RNA, 21 nt, Human
ccacugcacuccagcccgggg

SEQ ID NO: 1093786 - RNA, 22 nt, Human
ccacugcacuccagcccggggu

SEQ ID NO: 1093787 - RNA, 19 nt, Human
cccgggguuaggagugaga

SEQ ID NO: 1093788 - RNA, 24 nt, Human
ccucuugucuucuuguaaggaugu

SEQ ID NO: 1093789 - RNA, 21 nt, Human
ccuguaaucccagcuacuugg

SEQ ID NO: 1093790 - RNA, 22 nt, Human
ccugugugcuuuuuuucuuuuu

SEQ ID NO: 1093791 - RNA, 19 nt, Human
cgaggugacagccgcuagg

SEQ ID NO: 1093792 - RNA, 21 nt, Human
cgccuguaaucccagcuacuu

SEQ ID NO: 1093793 - RNA, 23 nt, Human
cgccuguaaucccagcuacuugg

SEQ ID NO: 1093794 - RNA, 24 nt, Human
cgccuguaaucccagcuacuuggg

SEQ ID NO: 1093795 - RNA, 21 nt, Human
cgggaaggaccagccuuggaa

SEQ ID NO: 1093796 - RNA, 20 nt, Human
cgucauggacugucacagag

SEQ ID NO: 1093797 - RNA, 22 nt, Human
cuacaaaaaacuccaccucuac

SEQ ID NO: 1093798 - RNA, 26 nt, Human
cuacuuacaaacugaaaucuucaaag

SEQ ID NO: 1093799 - RNA, 22 nt, Human
cucacaccuguaaucccagcac

SEQ ID NO: 1093800 - RNA, 24 nt, Human
cucacaccuguaaucccagcacuu

SEQ ID NO: 1093801 - RNA, 24 nt, Human
cuccaaagauguacaaacggccaa

SEQ ID NO: 1093802 - RNA, 27 nt, Human
cugcagggccucucccagcuucuggcu

SEQ ID NO: 1093803 - RNA, 23 nt, Human
gacaguuugagcccaggaguuca

SEQ ID NO: 1093804 - RNA, 20 nt, Human
gagaacaagcauaggcaagu

SEQ ID NO: 1093805 - RNA, 22 nt, Human
gagcugggugguggcgugcgcc

SEQ ID NO: 1093806 - RNA, 18 nt, Human
gaggugacagccgcuagg

SEQ ID NO: 1093807 - RNA, 24 nt, Human
gcaaagccaagaucauugcucuca

SEQ ID NO: 1093808 - RNA, 22 nt, Human
gccaggggggucuggaggaagg

SEQ ID NO: 1093809 - RNA, 22 nt, Human
gcccaggaguucaagaccagcc

SEQ ID NO: 1093810 - RNA, 23 nt, Human
gccuguaaucccagcuacuuggg

SEQ ID NO: 1093811 - RNA, 22 nt, Human
gcgugcgccuguaaucccagcu

SEQ ID NO: 1093812 - RNA, 22 nt, Human
gcguggagaucgugccacugca

SEQ ID NO: 1093813 - RNA, 23 nt, Human
ggaacuggaagcugaaggcccac

SEQ ID NO: 1093814 - RNA, 23 nt, Human
ggagacacaaucucuacaaaaaa

SEQ ID NO: 1093815 - RNA, 24 nt, Human
ggagaucgugccacugcacuccag

SEQ ID NO: 1093816 - RNA, 18 nt, Human
ggccaacaagcacaucaa

SEQ ID NO: 1093817 - RNA, 20 nt, Human
ggccaacaagcacaucaaaa

SEQ ID NO: 1093818 - RNA, 19 nt, Human
ggguuaggagugagacucu

SEQ ID NO: 1093819 - RNA, 20 nt, Human
ggugccuguguccucuuguc

SEQ ID NO: 1093820 - RNA, 24 nt, Human
gguggcgugcgccuguaaucccag

SEQ ID NO: 1093821 - RNA, 21 nt, Human
ggugguggcgugcgccuguaa

SEQ ID NO: 1093822 - RNA, 22 nt, Human
guuugagcccaggaguucaaga

SEQ ID NO: 1093823 - RNA, 18 nt, Human
uaaaauagacaaaagaca

SEQ ID NO: 1093824 - RNA, 25 nt, Human
uaaaauagacaaaagacacgaagag

SEQ ID NO: 1093825 - RNA, 23 nt, Human
uaggagugagacucugucccaaa

SEQ ID NO: 1093826 - RNA, 18 nt, Human
ucacagagcggagggaaa

SEQ ID NO: 1093827 - RNA, 28 nt, Human
uccaccucuacuaaaaauaaccccuagg

SEQ ID NO: 1093828 - RNA, 19 nt, Human
uccccuacagcucuggagg

SEQ ID NO: 1093829 - RNA, 21 nt, Human
ucucacuacuuacaaacugaa

SEQ ID NO: 1093830 - RNA, 18 nt, Human
ucuccaaagauguacaaa

SEQ ID NO: 1093831 - RNA, 19 nt, Human
ucucccagcuucuggcucc

SEQ ID NO: 1093832 - RNA, 23 nt, Human
ucucccagcuucuggcuccuccu

SEQ ID NO: 1093833 - RNA, 24 nt, Human
ucucccagcuucuggcuccuccug

SEQ ID NO: 1093834 - RNA, 20 nt, Human
ucucuggggguggugccccu

SEQ ID NO: 1093835 - RNA, 21 nt, Human
ucugcaaaaucucuuauucca

SEQ ID NO: 1093836 - RNA, 23 nt, Human
ucuucagaucuuuaacucaauua

SEQ ID NO: 1093837 - RNA, 23 nt, Human
ugagcccaggaguucaagaccag

SEQ ID NO: 1093838 - RNA, 19 nt, Human
ugccauggcucacaccugu

SEQ ID NO: 1093839 - RNA, 19 nt, Human
ugccugggucuccuacggc

SEQ ID NO: 1093840 - RNA, 27 nt, Human
ugccugggucuccuacggccucuuccc

SEQ ID NO: 1093841 - RNA, 24 nt, Human
ugcgccuguaaucccagcuacuug

SEQ ID NO: 1093842 - RNA, 22 nt, Human
ugcugagccugcugccccagga

SEQ ID NO: 1093843 - RNA, 23 nt, Human
uggagaccaagguguggacaggg

SEQ ID NO: 1093844 - RNA, 21 nt, Human
uggcgugcgccuguaauccca

SEQ ID NO: 1093845 - RNA, 22 nt, Human
uggcgugcgccuguaaucccag

SEQ ID NO: 1093846 - RNA, 21 nt, Human
uggcucacaccuguaauccca

SEQ ID NO: 1093847 - RNA, 24 nt, Human
uggcucacaccuguaaucccagca

SEQ ID NO: 1093848 - RNA, 25 nt, Human
ugggaggcugagguacaagaauugu

SEQ ID NO: 1093849 - RNA, 24 nt, Human
ugguggcgugcgccuguaauccca

SEQ ID NO: 1093850 - RNA, 24 nt, Human
ugucacagagcggagggaaaagag

SEQ ID NO: 1093851 - RNA, 18 nt, Human
ugugcugagccugcugcc

SEQ ID NO: 1093852 - RNA, 23 nt, Human
uugggaggcugagguacaagaau

SEQ ID NO: 1093853 - RNA, 23 nt, Human
uuugagcccaggaguucaagacc

SEQ ID NO: 1093854 - RNA, 18 nt, Human
uuuguucauacucaaaau

SEQ ID NO: 1093855 - RNA, 24 nt, Human
uuuuugcugauuuguauauuuccu

SEQ ID NO: 1093856 - RNA, 24 nt, Human
aaaaacacccaaccacacaaagaa

SEQ ID NO: 1093857 - RNA, 23 nt, Human
aaaacacccaaccacacaaagaa

SEQ ID NO: 1093858 - RNA, 23 nt, Human
aaaagaagaaaaaaaacacccaa

SEQ ID NO: 1093859 - RNA, 25 nt, Human
aaacacccaaccacacaaagaacaa

SEQ ID NO: 1093860 - RNA, 21 nt, Human
aaagaaaagaagaaaaaaaac

SEQ ID NO: 1093861 - RNA, 20 nt, Human
aaccacacaaagaacaaaac

SEQ ID NO: 1093862 - RNA, 20 nt, Human
aaccacacaaagaacaaaac

SEQ ID NO: 1093863 - RNA, 22 nt, Human
aaccacacaaagaacaaaacca

SEQ ID NO: 1093864 - RNA, 18 nt, Human
aaccaugcgcccgcccug

SEQ ID NO: 1093865 - RNA, 27 nt, Human
aacccagucccgcccagacuagugggg

SEQ ID NO: 1093866 - RNA, 23 nt, Human
aagccagccagagcagagagggc

SEQ ID NO: 1093867 - RNA, 21 nt, Human
acaaagaacaaaaccaguaac

SEQ ID NO: 1093868 - RNA, 24 nt, Human
accacacaaagaacaaaaccagua

SEQ ID NO: 1093869 - RNA, 19 nt, Human
acugugugcugguccugcu

SEQ ID NO: 1093870 - RNA, 23 nt, Human
agaaaaaaaacacccaaccacac

SEQ ID NO: 1093871 - RNA, 23 nt, Human
agagccccucagagcuucuacau

SEQ ID NO: 1093872 - RNA, 22 nt, Human
agcaggcugccgaguggagggu

SEQ ID NO: 1093873 - RNA, 24 nt, Human
agcaguguuggucucuggggcugg

SEQ ID NO: 1093874 - RNA, 20 nt, Human
agcccucacucccuuugggg

SEQ ID NO: 1093875 - RNA, 24 nt, Human
aggccagauccaaacugagaggga

SEQ ID NO: 1093876 - RNA, 19 nt, Human
aggccuccgugugcccucg

SEQ ID NO: 1093877 - RNA, 20 nt, Human
aggcugccgaguggagggug

SEQ ID NO: 1093878 - RNA, 20 nt, Human
agggaaggugucguuuuuac

SEQ ID NO: 1093879 - RNA, 18 nt, Human
agggagcccugcgggggc

SEQ ID NO: 1093880 - RNA, 22 nt, Human
agguugucccuggagggcagcc

SEQ ID NO: 1093881 - RNA, 19 nt, Human
aguaacaaacacaaaggaa

SEQ ID NO: 1093882 - RNA, 25 nt, Human
aguaacaaacacaaaggaauucagg

SEQ ID NO: 1093883 - RNA, 19 nt, Human
aguggacagaccugguguc

SEQ ID NO: 1093884 - RNA, 22 nt, Human
augcugccggcucaucugggcc

SEQ ID NO: 1093885 - RNA, 22 nt, Human
auguccacgccucuccaguugc

SEQ ID NO: 1093886 - RNA, 26 nt, Human
caaagaacaaaaccaguaacaaacac

SEQ ID NO: 1093887 - RNA, 18 nt, Human
caaccacacaaagaacaa

SEQ ID NO: 1093888 - RNA, 19 nt, Human
caccaccgucacacacgcc

SEQ ID NO: 1093889 - RNA, 19 nt, Human
caccagggagggagcccug

SEQ ID NO: 1093890 - RNA, 21 nt, Human
caccagggagggagcccugcg

SEQ ID NO: 1093891 - RNA, 24 nt, Human
cacccaaccacacaaagaacaaaa

SEQ ID NO: 1093892 - RNA, 22 nt, Human
cacccucccuggucccuaccuc

SEQ ID NO: 1093893 - RNA, 24 nt, Human
cacgccagggagugcagacaccac

SEQ ID NO: 1093894 - RNA, 19 nt, Human
cagagccccucagagcuuc

SEQ ID NO: 1093895 - RNA, 20 nt, Human
cagccuucucaugcugccgg

SEQ ID NO: 1093896 - RNA, 21 nt, Human
caggcagguuugcguggugag

SEQ ID NO: 1093897 - RNA, 22 nt, Human
cauuuuuauuuaaaagaaaaga

SEQ ID NO: 1093898 - RNA, 21 nt, Human
ccaguaacaaacacaaaggaa

SEQ ID NO: 1093899 - RNA, 23 nt, Human
cccaagucacaggugacucagca

SEQ ID NO: 1093900 - RNA, 21 nt, Human
cccagguugucccuggagggc

SEQ ID NO: 1093901 - RNA, 20 nt, Human
ccccaagucacaggugacuc

SEQ ID NO: 1093902 - RNA, 18 nt, Human
ccccgcucugcagcacag

SEQ ID NO: 1093903 - RNA, 28 nt, Human
ccccgcucugcagcacagacaggccaga

SEQ ID NO: 1093904 - RNA, 23 nt, Human
cccgagcccuagguggggccagg

SEQ ID NO: 1093905 - RNA, 22 nt, Human
cccgcucugcagcacagacagg

SEQ ID NO: 1093906 - RNA, 19 nt, Human
cccuggcaucagcagaccc

SEQ ID NO: 1093907 - RNA, 20 nt, Human
cccuuaggccuggcugggcc

SEQ ID NO: 1093908 - RNA, 18 nt, Human
cccuucucucccugccca

SEQ ID NO: 1093909 - RNA, 22 nt, Human
ccgcagcuuuguggagggagcc

SEQ ID NO: 1093910 - RNA, 18 nt, Human
ccguguggagcagagagg

SEQ ID NO: 1093911 - RNA, 20 nt, Human
ccugccccaacugugugcug

SEQ ID NO: 1093912 - RNA, 21 nt, Human
ccugugguggcucugguggca

SEQ ID NO: 1093913 - RNA, 23 nt, Human
ccugugugccaggccagauccaa

SEQ ID NO: 1093914 - RNA, 24 nt, Human
cgaaccaugcgcccgcccugcccc

SEQ ID NO: 1093915 - RNA, 19 nt, Human
cgggagcaggcugccgagu

SEQ ID NO: 1093916 - RNA, 20 nt, Human
cgggagggguuggaguggug

SEQ ID NO: 1093917 - RNA, 22 nt, Human
cuagcaucaguccgaaccaugc

SEQ ID NO: 1093918 - RNA, 21 nt, Human
cuccugguggccuggcagguc

SEQ ID NO: 1093919 - RNA, 21 nt, Human
cucuuuaugccccucccgcug

SEQ ID NO: 1093920 - RNA, 19 nt, Human
cugguggcagcuuucugug

SEQ ID NO: 1093921 - RNA, 20 nt, Human
gaaaagaagaaaaaaaacac

SEQ ID NO: 1093922 - RNA, 23 nt, Human
gaacagcacacuucaaccccagc

SEQ ID NO: 1093923 - RNA, 25 nt, Human
gaagaaaaaaaacacccaaccacac

SEQ ID NO: 1093924 - RNA, 19 nt, Human
gagagggcugcugacuucc

SEQ ID NO: 1093925 - RNA, 21 nt, Human
gagccgccgugcuucugucac

SEQ ID NO: 1093926 - RNA, 22 nt, Human
gagccgccgugcuucugucacc

SEQ ID NO: 1093927 - RNA, 21 nt, Human
gagggugccaucgagggcucc

SEQ ID NO: 1093928 - RNA, 22 nt, Human
gcccacagaccugccucugacu

SEQ ID NO: 1093929 - RNA, 20 nt, Human
gcccugcgggggccgcagcu

SEQ ID NO: 1093930 - RNA, 22 nt, Human
gcccuuaggccuggcugggccc

SEQ ID NO: 1093931 - RNA, 21 nt, Human
gcuguggccgaggggaccggg

SEQ ID NO: 1093932 - RNA, 18 nt, Human
gcuuucuguggccccugc

SEQ ID NO: 1093933 - RNA, 22 nt, Human
ggagaagccagccagagcagag

SEQ ID NO: 1093934 - RNA, 19 nt, Human
ggccagaugcauuuguccu

SEQ ID NO: 1093935 - RNA, 22 nt, Human
ggcuggaagccgagcgcaugcu

SEQ ID NO: 1093936 - RNA, 19 nt, Human
gggagggguuggaguggug

SEQ ID NO: 1093937 - RNA, 19 nt, Human
gggcccuucucucccugcc

SEQ ID NO: 1093938 - RNA, 20 nt, Human
gggcccuucucucccugccc

SEQ ID NO: 1093939 - RNA, 18 nt, Human
gggggccgcagcuuugug

SEQ ID NO: 1093940 - RNA, 23 nt, Human
gguacugucagaagugagcccag

SEQ ID NO: 1093941 - RNA, 18 nt, Human
gucaccugcucccuuucu

SEQ ID NO: 1093942 - RNA, 18 nt, Human
gugcuccugguggccugg

SEQ ID NO: 1093943 - RNA, 24 nt, Human
guuuggcucuuuaugccccucccg

SEQ ID NO: 1093944 - RNA, 19 nt, Human
uagcaguguuggucucugg

SEQ ID NO: 1093945 - RNA, 21 nt, Human
uagggucugagagaacccugg

SEQ ID NO: 1093946 - RNA, 24 nt, Human
ucaacuguguccacccucccuggu

SEQ ID NO: 1093947 - RNA, 21 nt, Human
ucagcagugacccugugugcc

SEQ ID NO: 1093948 - RNA, 19 nt, Human
uccaaacugagagggaagg

SEQ ID NO: 1093949 - RNA, 20 nt, Human
uccaguugcugaaguagggu

SEQ ID NO: 1093950 - RNA, 23 nt, Human
uccaugcacgucaacccaguccc

SEQ ID NO: 1093951 - RNA, 22 nt, Human
ucccugugguggcucugguggc

SEQ ID NO: 1093952 - RNA, 23 nt, Human
uccguggaggccuccgugugccc

SEQ ID NO: 1093953 - RNA, 22 nt, Human
ucucacagccuucucaugcugc

SEQ ID NO: 1093954 - RNA, 23 nt, Human
ucucacagccuucucaugcugcc

SEQ ID NO: 1093955 - RNA, 25 nt, Human
ucuccugcagaccacgccagggagu

SEQ ID NO: 1093956 - RNA, 18 nt, Human
ucugcagcacagacaggc

SEQ ID NO: 1093957 - RNA, 23 nt, Human
ucugugcuccguggaggccuccg

SEQ ID NO: 1093958 - RNA, 18 nt, Human
ugacucaacuguguccac

SEQ ID NO: 1093959 - RNA, 24 nt, Human
ugaugggcccuuaggccuggcugg

SEQ ID NO: 1093960 - RNA, 21 nt, Human
ugcacaggaggcgagaacagc

SEQ ID NO: 1093961 - RNA, 27 nt, Human
ugccccaacugugugcugguccugcug

SEQ ID NO: 1093962 - RNA, 19 nt, Human
ugccgaguggagggugcca

SEQ ID NO: 1093963 - RNA, 22 nt, Human
ugccucugacucaacugugucc

SEQ ID NO: 1093964 - RNA, 19 nt, Human
ugcgcccgcccugccccaa

SEQ ID NO: 1093965 - RNA, 23 nt, Human
ugcuggucggcuuuccucuagag

SEQ ID NO: 1093966 - RNA, 20 nt, Human
ugcuugcucucugugcuccg

SEQ ID NO: 1093967 - RNA, 18 nt, Human
uggaagccgagcgcaugc

SEQ ID NO: 1093968 - RNA, 22 nt, Human
uggagggcagcccucacucccu

SEQ ID NO: 1093969 - RNA, 20 nt, Human
uggcucuuuaugccccuccc

SEQ ID NO: 1093970 - RNA, 21 nt, Human
uggcugggcccauuacauauc

SEQ ID NO: 1093971 - RNA, 19 nt, Human
ugggcuuugccaguugcug

SEQ ID NO: 1093972 - RNA, 22 nt, Human
uggggccaggaggugccuugga

SEQ ID NO: 1093973 - RNA, 22 nt, Human
uggucucuggggcuggaagccg

SEQ ID NO: 1093974 - RNA, 30 nt, Human
uggugaggagcgggagggguuggagugguu

SEQ ID NO: 1093975 - RNA, 18 nt, Human
ugugcccucguugccgug

SEQ ID NO: 1093976 - RNA, 19 nt, Human
uguguccacccucccuggu

SEQ ID NO: 1093977 - RNA, 19 nt, Human
uuaaaagaaaagaagaaaa

SEQ ID NO: 1093978 - RNA, 20 nt, Human
uuaaaagaaaagaagaaaaa

SEQ ID NO: 1093979 - RNA, 21 nt, Human
uuauuuaaaagaaaagaagaa

SEQ ID NO: 1093980 - RNA, 23 nt, Human
uugcuugcucucugugcuccgug

SEQ ID NO: 1093981 - RNA, 21 nt, Human
aauggugaccgacaugccaca

SEQ ID NO: 1093982 - RNA, 22 nt, Human
acaggcaucuuucaaauauuaa

SEQ ID NO: 1093983 - RNA, 18 nt, Human
agcugcugacuggggaac

SEQ ID NO: 1093984 - RNA, 22 nt, Human
caccacaccaugggccgguugg

SEQ ID NO: 1093985 - RNA, 18 nt, Human
caccaugggccgguuggc

SEQ ID NO: 1093986 - RNA, 18 nt, Human
caugggccgguuggcccg

SEQ ID NO: 1093987 - RNA, 19 nt, Human
caugggccgguuggcccgc

SEQ ID NO: 1093988 - RNA, 18 nt, Human
ccaugggccgguuggccc

SEQ ID NO: 1093989 - RNA, 19 nt, Human
gccacagugacuaccaagu

SEQ ID NO: 1093990 - RNA, 23 nt, Human
ggaggcacacaauggagggcaca

SEQ ID NO: 1093991 - RNA, 24 nt, Human
ggggugccugccucagccugaagc

SEQ ID NO: 1093992 - RNA, 24 nt, Human
ggguaugaccauuaaugagguguu

SEQ ID NO: 1093993 - RNA, 21 nt, Human
uagucaccacaccaugggccg

SEQ ID NO: 1093994 - RNA, 23 nt, Human
ucaaauauuaauggugaccgaca

SEQ ID NO: 1093995 - RNA, 20 nt, Human
ugaagcagagcacaggcauc

SEQ ID NO: 1093996 - RNA, 20 nt, Human
ugacuaccaaguagcugcug

SEQ ID NO: 1093997 - RNA, 21 nt, Human
ugccucagccugaagcagagc

SEQ ID NO: 1093998 - RNA, 19 nt, Human
ugguuggaagugcaaacgu

SEQ ID NO: 1093999 - RNA, 23 nt, Human
uuggcccgccugccugugauggu

SEQ ID NO: 1094000 - RNA, 22 nt, Human
acagaacuucuuaacaauugaa

SEQ ID NO: 1094001 - RNA, 21 nt, Human
agaacuggcaaagacugugaa

SEQ ID NO: 1094002 - RNA, 21 nt, Human
agcuucaccgaagaguggaau

SEQ ID NO: 1094003 - RNA, 23 nt, Human
auggauuucugagguucccuugg

SEQ ID NO: 1094004 - RNA, 24 nt, Human
caccuuuaauuuucucuuacaaaa

SEQ ID NO: 1094005 - RNA, 23 nt, Human
ccaaacaaacagaacuucuuaac

SEQ ID NO: 1094006 - RNA, 18 nt, Human
ccagacucgaagcugcuu

SEQ ID NO: 1094007 - RNA, 24 nt, Human
cugcauccauggccucacaucaug

SEQ ID NO: 1094008 - RNA, 22 nt, Human
cuuacaaaaaaaaaaaggaaaa

SEQ ID NO: 1094009 - RNA, 24 nt, Human
uaaaguagaaagucucagaggucc

SEQ ID NO: 1094010 - RNA, 20 nt, Human
uaacauguuacgaagcaggu

SEQ ID NO: 1094011 - RNA, 22 nt, Human
uacaaaaaaaaaaaggaaaacc

SEQ ID NO: 1094012 - RNA, 24 nt, Human
uagaaacuguguucuccaaagcag

SEQ ID NO: 1094013 - RNA, 20 nt, Human
uagaacuggcaaagacugug

SEQ ID NO: 1094014 - RNA, 18 nt, Human
uauagacugccacuucug

SEQ ID NO: 1094015 - RNA, 24 nt, Human
uauuuucuccugguaacaauucua

SEQ ID NO: 1094016 - RNA, 18 nt, Human
ucgaagcugcuuaaugau

SEQ ID NO: 1094017 - RNA, 23 nt, Human
ucuauuuuuucuuuugauccucc

SEQ ID NO: 1094018 - RNA, 20 nt, Human
ucuccugguaacaauucuaa

SEQ ID NO: 1094019 - RNA, 19 nt, Human
ucucuuacaaaaaaaaaaa

SEQ ID NO: 1094020 - RNA, 25 nt, Human
ucucuuacaaaaaaaaaaaggaaaa

SEQ ID NO: 1094021 - RNA, 23 nt, Human
ugaaacuguuaaaguagaaaguc

SEQ ID NO: 1094022 - RNA, 21 nt, Human
ugagggaagugcuacugguac

SEQ ID NO: 1094023 - RNA, 22 nt, Human
uggaauaagacaguccucuguu

SEQ ID NO: 1094024 - RNA, 18 nt, Human
uuacaaaaaaaaaaagga

SEQ ID NO: 1094025 - RNA, 21 nt, Human
uucuccaacaacugauucugg

SEQ ID NO: 1094026 - RNA, 28 nt, Human
uuuucaguuauagacugccacuucugau

SEQ ID NO: 1094027 - RNA, 24 nt, Human
uuuucaugucuauuuuuucuuuug

SEQ ID NO: 1094028 - RNA, 18 nt, Human
uuuucuuuugauccucca

SEQ ID NO: 1094029 - RNA, 23 nt, Human
uuuuucuccaacaacugauucug

SEQ ID NO: 1094030 - RNA, 20 nt, Human
uuuuucuuuugauccuccag

SEQ ID NO: 1094031 - RNA, 21 nt, Human
acucaaccucugccucuuggg

SEQ ID NO: 1094032 - RNA, 21 nt, Human
agagcauguuucuugcaccag

SEQ ID NO: 1094033 - RNA, 25 nt, Human
aggagguggcuggcggcccauccug

SEQ ID NO: 1094034 - RNA, 22 nt, Human
aggcggccggugguggcccggc

SEQ ID NO: 1094035 - RNA, 22 nt, Human
aggcugggguccugccccaggg

SEQ ID NO: 1094036 - RNA, 23 nt, Human
aucacccuuccacugaguacugc

SEQ ID NO: 1094037 - RNA, 21 nt, Human
augaaaagcccauuguccaca

SEQ ID NO: 1094038 - RNA, 21 nt, Human
caaaauuaccgccaccaacac

SEQ ID NO: 1094039 - RNA, 22 nt, Human
caaaauuaccgccaccaacacg

SEQ ID NO: 1094040 - RNA, 27 nt, Human
caacagacaguaagagaggcaugaaaa

SEQ ID NO: 1094041 - RNA, 22 nt, Human
caccaacacggucugcaccuuc

SEQ ID NO: 1094042 - RNA, 23 nt, Human
cagcugugagguagggccaguag

SEQ ID NO: 1094043 - RNA, 20 nt, Human
caugaaaagcccauugucca

SEQ ID NO: 1094044 - RNA, 18 nt, Human
cauguuugagacacagga

SEQ ID NO: 1094045 - RNA, 20 nt, Human
ccaccaacacggucugcacc

SEQ ID NO: 1094046 - RNA, 18 nt, Human
ccagggaagacagaguca

SEQ ID NO: 1094047 - RNA, 22 nt, Human
ccgcugccgccauucugaccug

SEQ ID NO: 1094048 - RNA, 25 nt, Human
ccggcggucccgggcucuacuuccu

SEQ ID NO: 1094049 - RNA, 22 nt, Human
ccucugccucuuggguuucagu

SEQ ID NO: 1094050 - RNA, 19 nt, Human
ccugaguagcuaagggagg

SEQ ID NO: 1094051 - RNA, 20 nt, Human
ccuguagggccgaagaaggg

SEQ ID NO: 1094052 - RNA, 22 nt, Human
ccuucuguugcuggugauagau

SEQ ID NO: 1094053 - RNA, 28 nt, Human
cggccggugguggcccggcggucccggg

SEQ ID NO: 1094054 - RNA, 24 nt, Human
cggccuccugaguagcuaagggag

SEQ ID NO: 1094055 - RNA, 23 nt, Human
cggucccgggcucuacuuccucc

SEQ ID NO: 1094056 - RNA, 23 nt, Human
cugccucggccuccugaguagcu

SEQ ID NO: 1094057 - RNA, 18 nt, Human
cugucugcaaauguaggc

SEQ ID NO: 1094058 - RNA, 23 nt, Human
cuuacucaaccucugccucuugg

SEQ ID NO: 1094059 - RNA, 24 nt, Human
cuuacucaaccucugccucuuggg

SEQ ID NO: 1094060 - RNA, 22 nt, Human
gacagcuggggaguaaagaaaa

SEQ ID NO: 1094061 - RNA, 20 nt, Human
gagaggcaugaaaagcccau

SEQ ID NO: 1094062 - RNA, 18 nt, Human
gccuccugaguagcuaag

SEQ ID NO: 1094063 - RNA, 21 nt, Human
gccucggccuccugaguagcu

SEQ ID NO: 1094064 - RNA, 21 nt, Human
ggaggguggaagaggagaggg

SEQ ID NO: 1094065 - RNA, 20 nt, Human
ggcauguuugagacacagga

SEQ ID NO: 1094066 - RNA, 20 nt, Human
gguggcccggcggucccggg

SEQ ID NO: 1094067 - RNA, 18 nt, Human
uaagaagacauucgggag

SEQ ID NO: 1094068 - RNA, 22 nt, Human
uaagagaggcaugaaaagccca

SEQ ID NO: 1094069 - RNA, 22 nt, Human
uacucaaccucugccucuuggg

SEQ ID NO: 1094070 - RNA, 27 nt, Human
ucagugauuuuucugccucggccuccu

SEQ ID NO: 1094071 - RNA, 24 nt, Human
ucccgggcucuacuuccuccuccc

SEQ ID NO: 1094072 - RNA, 19 nt, Human
uccucauuccucccucaca

SEQ ID NO: 1094073 - RNA, 22 nt, Human
ucuacuuccuccucccgcgccc

SEQ ID NO: 1094074 - RNA, 21 nt, Human
ugaggcucagggaguuaucag

SEQ ID NO: 1094075 - RNA, 18 nt, Human
ugaguuggaggagguggc

SEQ ID NO: 1094076 - RNA, 23 nt, Human
ugccucggccuccugaguagcua

SEQ ID NO: 1094077 - RNA, 24 nt, Human
ugccucggccuccugaguagcuaa

SEQ ID NO: 1094078 - RNA, 23 nt, Human
ugcuccgcugccgccauucugac

SEQ ID NO: 1094079 - RNA, 18 nt, Human
uggaagaggagagggugg

SEQ ID NO: 1094080 - RNA, 21 nt, Human
ugggacacacuguugucucca

SEQ ID NO: 1094081 - RNA, 23 nt, Human
ugucuauccucauuccucccuca

SEQ ID NO: 1094082 - RNA, 23 nt, Human
uuacucaaccucugccucuuggg

SEQ ID NO: 1094083 - RNA, 21 nt, Human
uugagacacaggagugucuau

SEQ ID NO: 1094084 - RNA, 18 nt, Human
uugcccaggcuugagugc

SEQ ID NO: 1094085 - RNA, 18 nt, Human
uuucacacauauucauuu

SEQ ID NO: 1094086 - RNA, 24 nt, Human
uuuuuaaaguuucagcugugaggu

SEQ ID NO: 1094087 - RNA, 28 nt, Human
aaaaaaaaaaaaaaaaacaacaaacaaa

SEQ ID NO: 1094088 - RNA, 21 nt, Human
aaaaaaaaaaaaaacaacaaa

SEQ ID NO: 1094089 - RNA, 26 nt, Human
aaaaaaaaaaaacaacaaacaaacca

SEQ ID NO: 1094090 - RNA, 18 nt, Human
aaaaaaaacaacaaacaa

SEQ ID NO: 1094091 - RNA, 25 nt, Human
aaaaaaaacaacaaacaaaccaaaa

SEQ ID NO: 1094092 - RNA, 20 nt, Human
aaaaaaacagaaugaucaag

SEQ ID NO: 1094093 - RNA, 24 nt, Human
aaaaaaacagaaugaucaagauua

SEQ ID NO: 1094094 - RNA, 20 nt, Human
aaaaacaacaaacaaaccaa

SEQ ID NO: 1094095 - RNA, 22 nt, Human
aaaaacaacaaacaaaccaaaa

SEQ ID NO: 1094096 - RNA, 25 nt, Human
aaaaacaacaaacaaaccaaaaaaa

SEQ ID NO: 1094097 - RNA, 23 nt, Human
aaaacaacaaacaaaccaaaaaa

SEQ ID NO: 1094098 - RNA, 21 nt, Human
aaaugaaacaagauggacaaa

SEQ ID NO: 1094099 - RNA, 21 nt, Human
aacaaacaaaccaaaaaaaca

SEQ ID NO: 1094100 - RNA, 20 nt, Human
aagaaaagcugugaacagca

SEQ ID NO: 1094101 - RNA, 19 nt, Human
aauccuuaugaaugaagac

SEQ ID NO: 1094102 - RNA, 29 nt, Human
acaauacaccaauggaaaaaaaaggcagc

SEQ ID NO: 1094103 - RNA, 20 nt, Human
acagaguaagacuccaucuc

SEQ ID NO: 1094104 - RNA, 21 nt, Human
accaauggaaaaaaaaggcac

SEQ ID NO: 1094105 - RNA, 18 nt, Human
acuacacuccagccuggg

SEQ ID NO: 1094106 - RNA, 24 nt, Human
acuacacuccagccugggcgacag

SEQ ID NO: 1094107 - RNA, 23 nt, Human
agacacaaaagggucauuccugg

SEQ ID NO: 1094108 - RNA, 24 nt, Human
agacuucaggaaugcaccacacag

SEQ ID NO: 1094109 - RNA, 24 nt, Human
agagauugcagugagccgagaucg

SEQ ID NO: 1094110 - RNA, 22 nt, Human
agcaaagugccucccacuuccc

SEQ ID NO: 1094111 - RNA, 22 nt, Human
agcauuuugggaggcugaggca

SEQ ID NO: 1094112 - RNA, 25 nt, Human
agcauuuugggaggcugaggcaggg

SEQ ID NO: 1094113 - RNA, 24 nt, Human
agccugggcgacagaguaagacuc

SEQ ID NO: 1094114 - RNA, 22 nt, Human
aggaagauuucccacaaaaaga

SEQ ID NO: 1094115 - RNA, 21 nt, Human
aggcagagauugcagugagcc

SEQ ID NO: 1094116 - RNA, 24 nt, Human
aggcagagauugcagugagccgag

SEQ ID NO: 1094117 - RNA, 20 nt, Human
aggcugaggcaggggaucac

SEQ ID NO: 1094118 - RNA, 23 nt, Human
aggggaucacgaggucaggaguu

SEQ ID NO: 1094119 - RNA, 24 nt, Human
agugagguugggcacgguggcuca

SEQ ID NO: 1094120 - RNA, 24 nt, Human
aucgugccacuacacuccagccug

SEQ ID NO: 1094121 - RNA, 20 nt, Human
augcggcuaaggucauuggg

SEQ ID NO: 1094122 - RNA, 25 nt, Human
auuggcggugguggcggcugcagcu

SEQ ID NO: 1094123 - RNA, 22 nt, Human
caaaaaaaaaaaaaaaaaaaaa

SEQ ID NO: 1094124 - RNA, 18 nt, Human
caaagugccucccacuuc

SEQ ID NO: 1094125 - RNA, 19 nt, Human
caaauacaauacaccaaug

SEQ ID NO: 1094126 - RNA, 28 nt, Human
caacaaacaaaccaaaaaaacagaauga

SEQ ID NO: 1094127 - RNA, 20 nt, Human
caagaaaagcugugaacagc

SEQ ID NO: 1094128 - RNA, 19 nt, Human
caauacaccaauggaaaaa

SEQ ID NO: 1094129 - RNA, 24 nt, Human
cacagcaugacuaccuaagauagg

SEQ ID NO: 1094130 - RNA, 19 nt, Human
caccccucccuuguccucu

SEQ ID NO: 1094131 - RNA, 24 nt, Human
caccccuguaaucccagcauuuug

SEQ ID NO: 1094132 - RNA, 19 nt, Human
caccugggagugaauggag

SEQ ID NO: 1094133 - RNA, 19 nt, Human
cacggccucucccgucccg

SEQ ID NO: 1094134 - RNA, 27 nt, Human
cacuacacuccagccugggcgacagag

SEQ ID NO: 1094135 - RNA, 22 nt, Human
cacuccagccugggcgacagag

SEQ ID NO: 1094136 - RNA, 24 nt, Human
cagcaaagugccucccacuucccu

SEQ ID NO: 1094137 - RNA, 24 nt, Human
cagcauuuugggaggcugaggcag

SEQ ID NO: 1094138 - RNA, 25 nt, Human
cagcauuuugggaggcugaggcagg

SEQ ID NO: 1094139 - RNA, 26 nt, Human
cauuucuuccucagugaugucgggag

SEQ ID NO: 1094140 - RNA, 21 nt, Human
ccacuacacuccagccugggc

SEQ ID NO: 1094141 - RNA, 21 nt, Human
ccacuacacuccagccugggc

SEQ ID NO: 1094142 - RNA, 23 nt, Human
ccacuacacuccagccugggcga

SEQ ID NO: 1094143 - RNA, 24 nt, Human
ccacuacacuccagccugggcgac

SEQ ID NO: 1094144 - RNA, 23 nt, Human
ccaguucucagaaaaacuccaaa

SEQ ID NO: 1094145 - RNA, 23 nt, Human
cccaagaaaaagauggaggcaag

SEQ ID NO: 1094146 - RNA, 24 nt, Human
cccacuucccucuaaccuggacuu

SEQ ID NO: 1094147 - RNA, 19 nt, Human
ccccuguaaucccagcauu

SEQ ID NO: 1094148 - RNA, 24 nt, Human
ccccuguaaucccagcauuuuggg

SEQ ID NO: 1094149 - RNA, 24 nt, Human
ccguauguacguugccugugaccu

SEQ ID NO: 1094150 - RNA, 18 nt, Human
ccucacccaagaaaaaga

SEQ ID NO: 1094151 - RNA, 21 nt, Human
ccuccagcauacucccuagag

SEQ ID NO: 1094152 - RNA, 18 nt, Human
ccucuaccgacuggucuc

SEQ ID NO: 1094153 - RNA, 22 nt, Human
ccugggcgacagaguaagacuc

SEQ ID NO: 1094154 - RNA, 22 nt, Human
ccuguaaucccagcauuuuggg

SEQ ID NO: 1094155 - RNA, 18 nt, Human
ccuucuuuuaaggguuuu

SEQ ID NO: 1094156 - RNA, 23 nt, Human
cgcuacacggccucucccguccc

SEQ ID NO: 1094157 - RNA, 22 nt, Human
cuaagagaaaaugucuucuuua

SEQ ID NO: 1094158 - RNA, 21 nt, Human
cucaccccuguaaucccagca

SEQ ID NO: 1094159 - RNA, 21 nt, Human
cuccaguucucagaaaaacuc

SEQ ID NO: 1094160 - RNA, 28 nt, Human
cugguggugauguugaugaugcuuucuu

SEQ ID NO: 1094161 - RNA, 21 nt, Human
cuucccucuaaccuggacuuc

SEQ ID NO: 1094162 - RNA, 22 nt, Human
cuucucuccugguuuucuaaaa

SEQ ID NO: 1094163 - RNA, 22 nt, Human
cuuuuccaggguagaauucugg

SEQ ID NO: 1094164 - RNA, 21 nt, Human
gaaaaaaaaggcacagcauga

SEQ ID NO: 1094165 - RNA, 22 nt, Human
gacaaaucaaauacaauacacc

SEQ ID NO: 1094166 - RNA, 23 nt, Human
gagaucgugccacuacacuccag

SEQ ID NO: 1094167 - RNA, 22 nt, Human
gaucacgaggucaggaguucaa

SEQ ID NO: 1094168 - RNA, 24 nt, Human
gaucacgaggucaggaguucaaga

SEQ ID NO: 1094169 - RNA, 22 nt, Human
gccacuacacuccagccugggc

SEQ ID NO: 1094170 - RNA, 20 nt, Human
gccgagaucgugccacuaca

SEQ ID NO: 1094171 - RNA, 18 nt, Human
ggaggcugaggcagggga

SEQ ID NO: 1094172 - RNA, 21 nt, Human
ggaucacgaggucaggaguuc

SEQ ID NO: 1094173 - RNA, 23 nt, Human
ggcacgguggcucaccccuguaa

SEQ ID NO: 1094174 - RNA, 20 nt, Human
ggccaaauagucaaagccuu

SEQ ID NO: 1094175 - RNA, 23 nt, Human
gguggcucaccccuguaauccca

SEQ ID NO: 1094176 - RNA, 24 nt, Human
gguggcucaccccuguaaucccag

SEQ ID NO: 1094177 - RNA, 28 nt, Human
guaacggcgacgcuacacggccucuccc

SEQ ID NO: 1094178 - RNA, 23 nt, Human
guggcucaccccuguaaucccag

SEQ ID NO: 1094179 - RNA, 24 nt, Human
guggugauguugaugaugcuuucu

SEQ ID NO: 1094180 - RNA, 19 nt, Human
uaaaaugaaaaucucuaag

SEQ ID NO: 1094181 - RNA, 19 nt, Human
uaacuggaucuacuuugcc

SEQ ID NO: 1094182 - RNA, 24 nt, Human
uaagagaaaaugucuucuuuagga

SEQ ID NO: 1094183 - RNA, 24 nt, Human
uaagagcuacugucagaccuucag

SEQ ID NO: 1094184 - RNA, 21 nt, Human
uacaauacaccaauggaaaaa

SEQ ID NO: 1094185 - RNA, 22 nt, Human
uacguugccugugaccuuugug

SEQ ID NO: 1094186 - RNA, 21 nt, Human
uacucugcauuuuugcacccu

SEQ ID NO: 1094187 - RNA, 26 nt, Human
uaggccuaucaagaaaagcugugaac

SEQ ID NO: 1094188 - RNA, 18 nt, Human
uauaauagaaccguaugu

SEQ ID NO: 1094189 - RNA, 19 nt, Human
uaucaagaaaagcugugaa

SEQ ID NO: 1094190 - RNA, 20 nt, Human
uaucagagacaaaucaaaua

SEQ ID NO: 1094191 - RNA, 21 nt, Human
uaucagagacaaaucaaauac

SEQ ID NO: 1094192 - RNA, 22 nt, Human
uauuacucugcauuuuugcacc

SEQ ID NO: 1094193 - RNA, 22 nt, Human
ucacccaagaaaaagauggagg

SEQ ID NO: 1094194 - RNA, 21 nt, Human
ucacgaggucaggaguucaag

SEQ ID NO: 1094195 - RNA, 24 nt, Human
ucacgaggucaggaguucaagauc

SEQ ID NO: 1094196 - RNA, 25 nt, Human
ucagaaaaacuccaaauauaucaga

SEQ ID NO: 1094197 - RNA, 19 nt, Human
ucaggccaaauagucaaag

SEQ ID NO: 1094198 - RNA, 24 nt, Human
uccaaaaaggguccuucuuuuaag

SEQ ID NO: 1094199 - RNA, 24 nt, Human
uccagccugggcgacagaguaaga

SEQ ID NO: 1094200 - RNA, 22 nt, Human
uccccaggcccucaacaaucac

SEQ ID NO: 1094201 - RNA, 21 nt, Human
ucgggaggaagauuucccaca

SEQ ID NO: 1094202 - RNA, 23 nt, Human
ucuacuuugccaugguuucccca

SEQ ID NO: 1094203 - RNA, 19 nt, Human
ucuuccucagugaugucgg

SEQ ID NO: 1094204 - RNA, 19 nt, Human
ugaaugaagacuucgccug

SEQ ID NO: 1094205 - RNA, 19 nt, Human
ugagaaacuagacacugca

SEQ ID NO: 1094206 - RNA, 19 nt, Human
ugagccgagaucgugccac

SEQ ID NO: 1094207 - RNA, 18 nt, Human
ugaggcaggggaucacga

SEQ ID NO: 1094208 - RNA, 23 nt, Human
ugaggcaggggaucacgagguca

SEQ ID NO: 1094209 - RNA, 23 nt, Human
ugaugucgggaggaagauuuccc

SEQ ID NO: 1094210 - RNA, 23 nt, Human
uggaaaaaaaaggcacagcauga

SEQ ID NO: 1094211 - RNA, 20 nt, Human
uggacaaaaaaaaaaaaaaa

SEQ ID NO: 1094212 - RNA, 21 nt, Human
uggcucaccccuguaauccca

SEQ ID NO: 1094213 - RNA, 22 nt, Human
uggcucaccccuguaaucccag

SEQ ID NO: 1094214 - RNA, 24 nt, Human
uggcucaccccuguaaucccagca

SEQ ID NO: 1094215 - RNA, 18 nt, Human
ugggaggcugaggcaggg

SEQ ID NO: 1094216 - RNA, 23 nt, Human
ugggaggcugaggcaggggauca

SEQ ID NO: 1094217 - RNA, 20 nt, Human
ugggggauguuugguuuuug

SEQ ID NO: 1094218 - RNA, 24 nt, Human
ugguguauguggcaguuucucugg

SEQ ID NO: 1094219 - RNA, 21 nt, Human
uguggcaguuucucugggacu

SEQ ID NO: 1094220 - RNA, 25 nt, Human
ugugguguauguggcaguuucucug

SEQ ID NO: 1094221 - RNA, 24 nt, Human
uuaaggguuuugagaaacuagaca

SEQ ID NO: 1094222 - RNA, 21 nt, Human
uucaggaaugcaccacacaga

SEQ ID NO: 1094223 - RNA, 23 nt, Human
uucgauugaagacagcaaagugc

SEQ ID NO: 1094224 - RNA, 22 nt, Human
uugaagacagcaaagugccucc

SEQ ID NO: 1094225 - RNA, 18 nt, Human
uugcagugagccgagauc

SEQ ID NO: 1094226 - RNA, 21 nt, Human
uugcagugagccgagaucgug

SEQ ID NO: 1094227 - RNA, 22 nt, Human
uugcagugagccgagaucgugc

SEQ ID NO: 1094228 - RNA, 23 nt, Human
uugcagugagccgagaucgugcc

SEQ ID NO: 1094229 - RNA, 24 nt, Human
uugggaggcugaggcaggggauca

SEQ ID NO: 1094230 - RNA, 21 nt, Human
uuuuaaggguuuugagaaacu

SEQ ID NO: 1094231 - RNA, 23 nt, Human
acaacagaaauauauucucuccc

SEQ ID NO: 1094232 - RNA, 23 nt, Human
accacagcaaguacccugaucug

SEQ ID NO: 1094233 - RNA, 24 nt, Human
agaaauauauucucucccagcucc

SEQ ID NO: 1094234 - RNA, 19 nt, Human
agccagccuucuagcuccu

SEQ ID NO: 1094235 - RNA, 21 nt, Human
agccagccuucuagcuccugg

SEQ ID NO: 1094236 - RNA, 18 nt, Human
aggccagaagucugcaau

SEQ ID NO: 1094237 - RNA, 21 nt, Human
agugcaguggugcgaucucag

SEQ ID NO: 1094238 - RNA, 23 nt, Human
agugcaguggugcgaucucagcu

SEQ ID NO: 1094239 - RNA, 24 nt, Human
agugcaguggugcgaucucagcuc

SEQ ID NO: 1094240 - RNA, 24 nt, Human
aguggugcgaucucagcucacugc

SEQ ID NO: 1094241 - RNA, 20 nt, Human
caacagaaauauauucucuc

SEQ ID NO: 1094242 - RNA, 22 nt, Human
cagcuccggaggccagaagucu

SEQ ID NO: 1094243 - RNA, 18 nt, Human
ccacaucacuccagccuc

SEQ ID NO: 1094244 - RNA, 24 nt, Human
cccucugucgcccaggcuugagug

SEQ ID NO: 1094245 - RNA, 20 nt, Human
ccucugucgcccaggcuuga

SEQ ID NO: 1094246 - RNA, 18 nt, Human
cucacugcaaccuccacc

SEQ ID NO: 1094247 - RNA, 18 nt, Human
cuccagccucacgugggc

SEQ ID NO: 1094248 - RNA, 20 nt, Human
cuccagguguuccuugguuu

SEQ ID NO: 1094249 - RNA, 22 nt, Human
gagugcaguggugcgaucucag

SEQ ID NO: 1094250 - RNA, 19 nt, Human
ggcagggcuccacucccuc

SEQ ID NO: 1094251 - RNA, 25 nt, Human
ggcuccacucccuccagaggcucua

SEQ ID NO: 1094252 - RNA, 23 nt, Human
gggcagggcuccacucccuccag

SEQ ID NO: 1094253 - RNA, 27 nt, Human
guguugucucuuuuuuuuuuuuuuuuu

SEQ ID NO: 1094254 - RNA, 19 nt, Human
uacccugaucugggguugc

SEQ ID NO: 1094255 - RNA, 18 nt, Human
ucacuccagccucacgug

SEQ ID NO: 1094256 - RNA, 18 nt, Human
ucacugcaaccuccaccg

SEQ ID NO: 1094257 - RNA, 19 nt, Human
ucccagcuccggaggccag

SEQ ID NO: 1094258 - RNA, 18 nt, Human
ucccagcuccggaggccg

SEQ ID NO: 1094259 - RNA, 21 nt, Human
ucccucugucgcccaggcuug

SEQ ID NO: 1094260 - RNA, 22 nt, Human
uccugccucuuccagccagccu

SEQ ID NO: 1094261 - RNA, 18 nt, Human
ucgcccaggcuugagugc

SEQ ID NO: 1094262 - RNA, 19 nt, Human
ucucccucugucgcccagg

SEQ ID NO: 1094263 - RNA, 24 nt, Human
ucucccucugucgcccaggcuuga

SEQ ID NO: 1094264 - RNA, 25 nt, Human
ucucccucugucgcccaggcuugag

SEQ ID NO: 1094265 - RNA, 18 nt, Human
ucugcaaucaaggugugg

SEQ ID NO: 1094266 - RNA, 25 nt, Human
ucugcaaucaaggugugggcagggc

SEQ ID NO: 1094267 - RNA, 24 nt, Human
ucugucgcccaggcuugagugcag

SEQ ID NO: 1094268 - RNA, 20 nt, Human
ucugucucuguguugucucu

SEQ ID NO: 1094269 - RNA, 21 nt, Human
ucuuuuuuuuuuuuuuuuugg

SEQ ID NO: 1094270 - RNA, 22 nt, Human
ugcaguggugcgaucucagcuc

SEQ ID NO: 1094271 - RNA, 24 nt, Human
ugggcagggcuccacucccuccag

SEQ ID NO: 1094272 - RNA, 24 nt, Human
uggugcgaucucagcucacugcaa

SEQ ID NO: 1094273 - RNA, 22 nt, Human
ugucucuuuuuuuuuuuuuuuu

SEQ ID NO: 1094274 - RNA, 27 nt, Human
ugucucuuuuuuuuuuuuuuuuugcag

SEQ ID NO: 1094275 - RNA, 21 nt, Human
ugugggcagggcuccacuccc

SEQ ID NO: 1094276 - RNA, 29 nt, Human
uguugucucuuuuuuuuuuuuuuuuuuuc

SEQ ID NO: 1094277 - RNA, 24 nt, Human
uugagugcaguggugcgaucucag

SEQ ID NO: 1094278 - RNA, 23 nt, Human
uuuuuuuuuuuuuugcagacgga

SEQ ID NO: 1094279 - RNA, 21 nt, Human
uuuuuuuuuuuuuuuuugcag

SEQ ID NO: 1094280 - RNA, 19 nt, Human
aaagacaucaaaugucuaa

SEQ ID NO: 1094281 - RNA, 19 nt, Human
aauuuaaaauuugcaaagg

SEQ ID NO: 1094282 - RNA, 18 nt, Human
acaagaaaagcagccuag

SEQ ID NO: 1094283 - RNA, 19 nt, Human
accauuuugaguauauugu

SEQ ID NO: 1094284 - RNA, 18 nt, Human
accuugcugcucaaaccc

SEQ ID NO: 1094285 - RNA, 23 nt, Human
agaaaagcagccuagauccugag

SEQ ID NO: 1094286 - RNA, 22 nt, Human
agacaccaccucagucccauca

SEQ ID NO: 1094287 - RNA, 19 nt, Human
agagaaacauauaacuuuu

SEQ ID NO: 1094288 - RNA, 18 nt, Human
agagcuaucaaacuguag

SEQ ID NO: 1094289 - RNA, 22 nt, Human
agcuaucaaacuguagaaggcu

SEQ ID NO: 1094290 - RNA, 23 nt, Human
aggguucaccauuuugaguauau

SEQ ID NO: 1094291 - RNA, 22 nt, Human
auuugaaucuuccccuccaucc

SEQ ID NO: 1094292 - RNA, 20 nt, Human
cagacaccaccucaguccca

SEQ ID NO: 1094293 - RNA, 24 nt, Human
cagcaaguguccccucaaaagccu

SEQ ID NO: 1094294 - RNA, 23 nt, Human
cagcugccucaccccuuccuacu

SEQ ID NO: 1094295 - RNA, 18 nt, Human
caggacagcugccucacc

SEQ ID NO: 1094296 - RNA, 22 nt, Human
caggaugggacacgauauggug

SEQ ID NO: 1094297 - RNA, 24 nt, Human
caggcaauguggcugaaacaagcc

SEQ ID NO: 1094298 - RNA, 25 nt, Human
caggugaacauuugaaucuuccccu

SEQ ID NO: 1094299 - RNA, 19 nt, Human
ccgccagaaccgggcaagc

SEQ ID NO: 1094300 - RNA, 22 nt, Human
ccucuauaaaagucaacugcuu

SEQ ID NO: 1094301 - RNA, 18 nt, Human
ccugagcauucagcuccu

SEQ ID NO: 1094302 - RNA, 22 nt, Human
cucaaaaauuuuuucagucacc

SEQ ID NO: 1094303 - RNA, 23 nt, Human
cugguuagagcuaucaaacugua

SEQ ID NO: 1094304 - RNA, 18 nt, Human
cuucacacaacagacacc

SEQ ID NO: 1094305 - RNA, 18 nt, Human
cuucugaguccccaaaua

SEQ ID NO: 1094306 - RNA, 20 nt, Human
gaacauuugaaucuuccccu

SEQ ID NO: 1094307 - RNA, 22 nt, Human
gagcauucagcuccugucuuca

SEQ ID NO: 1094308 - RNA, 23 nt, Human
gcaaguguccccucaaaagccuu

SEQ ID NO: 1094309 - RNA, 21 nt, Human
ggacagcugccucaccccuuc

SEQ ID NO: 1094310 - RNA, 18 nt, Human
ggccaggcaauguggcug

SEQ ID NO: 1094311 - RNA, 24 nt, Human
ggcuuagugccugucccagcaagu

SEQ ID NO: 1094312 - RNA, 26 nt, Human
guccccaaauauucucugagugccag

SEQ ID NO: 1094313 - RNA, 18 nt, Human
uaaaagagaaacauauaa

SEQ ID NO: 1094314 - RNA, 26 nt, Human
uaaaauagaaggucugcaccugagca

SEQ ID NO: 1094315 - RNA, 19 nt, Human
uaaaauuugcaaaggcaua

SEQ ID NO: 1094316 - RNA, 22 nt, Human
uaacccaacugaccacaagaaa

SEQ ID NO: 1094317 - RNA, 19 nt, Human
uagauccugagcauucagc

SEQ ID NO: 1094318 - RNA, 23 nt, Human
uagauccugagcauucagcuccu

SEQ ID NO: 1094319 - RNA, 31 nt, Human
uagcagguucuugcucucauuccaagaccuu

SEQ ID NO: 1094320 - RNA, 18 nt, Human
uauagcagguucuugcuc

SEQ ID NO: 1094321 - RNA, 26 nt, Human
uccaccauugagacauauuccagagc

SEQ ID NO: 1094322 - RNA, 22 nt, Human
uccagggcuggauccccagggc

SEQ ID NO: 1094323 - RNA, 23 nt, Human
ucccagcaaguguccccucaaaa

SEQ ID NO: 1094324 - RNA, 18 nt, Human
uccccucaaaagccuucu

SEQ ID NO: 1094325 - RNA, 20 nt, Human
uccuauagcagguucuugcu

SEQ ID NO: 1094326 - RNA, 20 nt, Human
uccugagcauucagcuccug

SEQ ID NO: 1094327 - RNA, 23 nt, Human
ucugaauuaaaagagaaacauau

SEQ ID NO: 1094328 - RNA, 20 nt, Human
ucugcugaauggggucaggg

SEQ ID NO: 1094329 - RNA, 23 nt, Human
ugaaagacaucaaaugucuaaca

SEQ ID NO: 1094330 - RNA, 18 nt, Human
ugaccacaagaaaagcag

SEQ ID NO: 1094331 - RNA, 18 nt, Human
ugagaaaagcauacaaga

SEQ ID NO: 1094332 - RNA, 22 nt, Human
ugagaaaagcauacaagaaugg

SEQ ID NO: 1094333 - RNA, 21 nt, Human
ugagaagucuguaucugcugg

SEQ ID NO: 1094334 - RNA, 20 nt, Human
ugcccaggcaagggaugggc

SEQ ID NO: 1094335 - RNA, 20 nt, Human
ugccuuaacaggaugggaca

SEQ ID NO: 1094336 - RNA, 21 nt, Human
ugccuuaacaggaugggacac

SEQ ID NO: 1094337 - RNA, 23 nt, Human
uuaacauuuucccacagggagua

SEQ ID NO: 1094338 - RNA, 21 nt, Human
uuagaggcuacagccuuuucu

SEQ ID NO: 1094339 - RNA, 21 nt, Human
uucuuuccuucugagaaaagc

SEQ ID NO: 1094340 - RNA, 22 nt, Human
uuggucccaaacagguaaccca

SEQ ID NO: 1094341 - RNA, 24 nt, Human
uuggucccaaacagguaacccaac

SEQ ID NO: 1094342 - RNA, 21 nt, Human
uuuaacaccuucugaguccuu

SEQ ID NO: 1094343 - RNA, 21 nt, Human
acauagaaguccggaguucac

SEQ ID NO: 1094344 - RNA, 21 nt, Human
accucaugagauauucuugag

SEQ ID NO: 1094345 - RNA, 24 nt, Human
auaccaaauucauuauggaaucca

SEQ ID NO: 1094346 - RNA, 24 nt, Human
auauuagaagcauguuuuagagca

SEQ ID NO: 1094347 - RNA, 22 nt, Human
auugcuaguuguuucuucgucu

SEQ ID NO: 1094348 - RNA, 18 nt, Human
caaaauguccuuccugga

SEQ ID NO: 1094349 - RNA, 20 nt, Human
caagggaugcugcacaccac

SEQ ID NO: 1094350 - RNA, 21 nt, Human
caccaagcauauuagaagcau

SEQ ID NO: 1094351 - RNA, 18 nt, Human
cagcacagguucgaagaa

SEQ ID NO: 1094352 - RNA, 19 nt, Human
cagccuguauggcuucauc

SEQ ID NO: 1094353 - RNA, 18 nt, Human
cauccauaagcuuguuuu

SEQ ID NO: 1094354 - RNA, 23 nt, Human
cauuauggaauccaccuggucuu

SEQ ID NO: 1094355 - RNA, 20 nt, Human
ccaacugugaucaaaaggua

SEQ ID NO: 1094356 - RNA, 21 nt, Human
cccuacaguuuacaacuugcu

SEQ ID NO: 1094357 - RNA, 21 nt, Human
ccucaagggaugcugcacacc

SEQ ID NO: 1094358 - RNA, 19 nt, Human
ccugcucauccugagggga

SEQ ID NO: 1094359 - RNA, 22 nt, Human
ccuguauggcuucauccaagag

SEQ ID NO: 1094360 - RNA, 18 nt, Human
cgcucugcucaucagcaa

SEQ ID NO: 1094361 - RNA, 20 nt, Human
cucaagggaugcugcacacc

SEQ ID NO: 1094362 - RNA, 20 nt, Human
cucaucagcaaaaucuucug

SEQ ID NO: 1094363 - RNA, 22 nt, Human
cucaucagcaaaaucuucugga

SEQ ID NO: 1094364 - RNA, 18 nt, Human
cugaggggacugcugugu

SEQ ID NO: 1094365 - RNA, 18 nt, Human
cugaucuugaaucaacgu

SEQ ID NO: 1094366 - RNA, 23 nt, Human
cuucgucuguuggcucuccuuca

SEQ ID NO: 1094367 - RNA, 21 nt, Human
cuugcuccaauaugccagaca

SEQ ID NO: 1094368 - RNA, 18 nt, Human
gaaugaagggcccacaac

SEQ ID NO: 1094369 - RNA, 20 nt, Human
gagcauccauaagcuuguuu

SEQ ID NO: 1094370 - RNA, 19 nt, Human
gcauccauaagcuuguuuu

SEQ ID NO: 1094371 - RNA, 19 nt, Human
gguccaucuucacaguggc

SEQ ID NO: 1094372 - RNA, 19 nt, Human
guucuugucuuucucgcuc

SEQ ID NO: 1094373 - RNA, 19 nt, Human
uaacucagcacagguucga

SEQ ID NO: 1094374 - RNA, 23 nt, Human
uaccaaaucuuucaaaauguccu

SEQ ID NO: 1094375 - RNA, 20 nt, Human
uagaccuccaaguagugcag

SEQ ID NO: 1094376 - RNA, 19 nt, Human
uagagaucugccacuuucc

SEQ ID NO: 1094377 - RNA, 23 nt, Human
uauacaacuccaacugugaucaa

SEQ ID NO: 1094378 - RNA, 20 nt, Human
ucaucagggaaaaccugaau

SEQ ID NO: 1094379 - RNA, 20 nt, Human
ucaucugucagguagaccuc

SEQ ID NO: 1094380 - RNA, 19 nt, Human
uccaagagcuuuuccugcu

SEQ ID NO: 1094381 - RNA, 21 nt, Human
ucugcugggauuccaggucca

SEQ ID NO: 1094382 - RNA, 25 nt, Human
ucuggaggugaaauucaucagggaa

SEQ ID NO: 1094383 - RNA, 22 nt, Human
ucuggaucagggucuucuacag

SEQ ID NO: 1094384 - RNA, 23 nt, Human
ugaauaacacaccucaugagaua

SEQ ID NO: 1094385 - RNA, 20 nt, Human
ugagccaaaguaucccuaca

SEQ ID NO: 1094386 - RNA, 27 nt, Human
ugcaccaaauguguucccacuaaaauu

SEQ ID NO: 1094387 - RNA, 18 nt, Human
ugcugcacaccacggcac

SEQ ID NO: 1094388 - RNA, 18 nt, Human
uggaaucacugauauugc

SEQ ID NO: 1094389 - RNA, 19 nt, Human
ugggauuccagguccaucu

SEQ ID NO: 1094390 - RNA, 19 nt, Human
ugguguaacucagcacagg

SEQ ID NO: 1094391 - RNA, 26 nt, Human
uguucuacauuuacaccuuccaacug

SEQ ID NO: 1094392 - RNA, 20 nt, Human
uucacaguggcaaauaaagc

SEQ ID NO: 1094393 - RNA, 18 nt, Human
uuccagcauacuguacaa

SEQ ID NO: 1094394 - RNA, 18 nt, Human
uuccagguccaucuucac

SEQ ID NO: 1094395 - RNA, 22 nt, Human
uuucucgcucucuuuuuucucu

SEQ ID NO: 1094396 - RNA, 21 nt, Human
cccgcgcugcucuccugggac

SEQ ID NO: 1094397 - RNA, 23 nt, Human
cuccugggacuccgccugaaguu

SEQ ID NO: 1094398 - RNA, 23 nt, Human
gaggaguuagaaccaucuucuug

SEQ ID NO: 1094399 - RNA, 18 nt, Human
gggaggaguuagaaccau

SEQ ID NO: 1094400 - RNA, 18 nt, Human
gucugggcaggcugaggc

SEQ ID NO: 1094401 - RNA, 18 nt, Human
uagaaccaucuucuugga

SEQ ID NO: 1094402 - RNA, 21 nt, Human
ugggaucccgcgcugcucucc

SEQ ID NO: 1094403 - RNA, 21 nt, Human
aacagggauggggagaggggu

SEQ ID NO: 1094404 - RNA, 19 nt, Human
aacucgaugacaggggacc

SEQ ID NO: 1094405 - RNA, 22 nt, Human
aagaaaagaaaaucuggguccc

SEQ ID NO: 1094406 - RNA, 18 nt, Human
aagcccuccacaccuaca

SEQ ID NO: 1094407 - RNA, 23 nt, Human
aagcgguuguagcugcccagggc

SEQ ID NO: 1094408 - RNA, 19 nt, Human
acagaaguagaccagcacc

SEQ ID NO: 1094409 - RNA, 22 nt, Human
accacacacacacauccacaca

SEQ ID NO: 1094410 - RNA, 18 nt, Human
acccucacgcagccccag

SEQ ID NO: 1094411 - RNA, 21 nt, Human
accuccagucccccagacagc

SEQ ID NO: 1094412 - RNA, 19 nt, Human
acgaagccagcaaagaagc

SEQ ID NO: 1094413 - RNA, 22 nt, Human
acgaccaggaccacguagggga

SEQ ID NO: 1094414 - RNA, 22 nt, Human
acgcagccccagcccuccagcc

SEQ ID NO: 1094415 - RNA, 24 nt, Human
acugcugcuucuggggugaggggu

SEQ ID NO: 1094416 - RNA, 25 nt, Human
acuggaggugcaggaagugcauccg

SEQ ID NO: 1094417 - RNA, 21 nt, Human
agaacucgaugacaggggacc

SEQ ID NO: 1094418 - RNA, 21 nt, Human
agaagaacagggcagcccaga

SEQ ID NO: 1094419 - RNA, 22 nt, Human
agaccacgaagccagcaaagaa

SEQ ID NO: 1094420 - RNA, 22 nt, Human
agacucgcacaugcaacagcuc

SEQ ID NO: 1094421 - RNA, 18 nt, Human
agaguggggccacuggca

SEQ ID NO: 1094422 - RNA, 18 nt, Human
agcaaagaagcugguccc

SEQ ID NO: 1094423 - RNA, 18 nt, Human
agcaacagcaugaagaag

SEQ ID NO: 1094424 - RNA, 19 nt, Human
agcaacagcaugaagaaga

SEQ ID NO: 1094425 - RNA, 20 nt, Human
agcagagccuggagaggugg

SEQ ID NO: 1094426 - RNA, 21 nt, Human
agcagugaaguacacgaucuu

SEQ ID NO: 1094427 - RNA, 18 nt, Human
agccucuguccggguguc

SEQ ID NO: 1094428 - RNA, 19 nt, Human
agccuggagaggugggcag

SEQ ID NO: 1094429 - RNA, 19 nt, Human
agcgagaucuccaagaaga

SEQ ID NO: 1094430 - RNA, 18 nt, Human
agcgguuguagcugccca

SEQ ID NO: 1094431 - RNA, 24 nt, Human
agcguggugguaaaggacuugacc

SEQ ID NO: 1094432 - RNA, 21 nt, Human
agcuucuauaacagggauggg

SEQ ID NO: 1094433 - RNA, 19 nt, Human
aggcagcagcacuccaagc

SEQ ID NO: 1094434 - RNA, 21 nt, Human
aggcgaugaaggccaggccuc

SEQ ID NO: 1094435 - RNA, 20 nt, Human
agggggugggcguggcaggg

SEQ ID NO: 1094436 - RNA, 30 nt, Human; identical to SEQ ID NO: 368013

SEQ ID NO: 1094437 - RNA, 19 nt, Human
aguguggggacagccccga

SEQ ID NO: 1094438 - RNA, 20 nt, Human
aguguuccagguguggccac

SEQ ID NO: 1094439 - RNA, 22 nt, Human
auccacacaacagacucgcacc

SEQ ID NO: 1094440 - RNA, 20 nt, Human
aucucauucucucaaguuuu

SEQ ID NO: 1094441 - RNA, 23 nt, Human
auggaggcauagcccaggccuuu

SEQ ID NO: 1094442 - RNA, 19 nt, Human
auggggagagggguauagc

SEQ ID NO: 1094443 - RNA, 21 nt, Human
caaagggacaguguggggaca

SEQ ID NO: 1094444 - RNA, 25 nt, Human
caaagggacaguguggggacagccc

SEQ ID NO: 1094445 - RNA, 19 nt, Human
caagcagcaacagcaugaa

SEQ ID NO: 1094446 - RNA, 20 nt, Human
caagcagcacgaccaggacc

SEQ ID NO: 1094447 - RNA, 24 nt, Human
cacacacacacauccacacaacag

SEQ ID NO: 1094448 - RNA, 24 nt, Human
caccuccagucccccagacagccu

SEQ ID NO: 1094449 - RNA, 25 nt, Human
cacgcagccccagcccuccagccuc

SEQ ID NO: 1094450 - RNA, 18 nt, Human
cagagccuggagaggugg

SEQ ID NO: 1094451 - RNA, 21 nt, Human
cagaguggggccacuggcauc

SEQ ID NO: 1094452 - RNA, 27 nt, Human
cagcacuccaagcacaagcagcacgac

SEQ ID NO: 1094453 - RNA, 25 nt, Human
cagcagacaaagggucaccucccag

SEQ ID NO: 1094454 - RNA, 24 nt, Human
caggauggaauauugcagccucuu

SEQ ID NO: 1094455 - RNA, 18 nt, Human
caggcccaccacccucac

SEQ ID NO: 1094456 - RNA, 23 nt, Human
caggccuuugaacaagggacaga

SEQ ID NO: 1094457 - RNA, 25 nt, Human
cauaagaaaagaaaaucuggguccc

SEQ ID NO: 1094458 - RNA, 23 nt, Human
cauccacacaacagacucgcaca

SEQ ID NO: 1094459 - RNA, 19 nt, Human
cauugaugcugccggccuu

SEQ ID NO: 1094460 - RNA, 18 nt, Human
ccaagcugccacugcugc

SEQ ID NO: 1094461 - RNA, 21 nt, Human
ccacacacacacauccacaca

SEQ ID NO: 1094462 - RNA, 21 nt, Human
ccagcaccaugauguaguagg

SEQ ID NO: 1094463 - RNA, 25 nt, Human
ccagcacccagcaggccagcagaca

SEQ ID NO: 1094464 - RNA, 24 nt, Human
ccagcagacaaagggucaccuccc

SEQ ID NO: 1094465 - RNA, 22 nt, Human
ccaggauggagaagaccacgaa

SEQ ID NO: 1094466 - RNA, 21 nt, Human
ccaggcagcagcacuccaagc

SEQ ID NO: 1094467 - RNA, 24 nt, Human
ccauggauuugacccccuuucaga

SEQ ID NO: 1094468 - RNA, 24 nt, Human
cccacagaccugugggcaaaggga

SEQ ID NO: 1094469 - RNA, 21 nt, Human
cccaccacccucacgcagccc

SEQ ID NO: 1094470 - RNA, 24 nt, Human
cccaccacccucacgcagccccag

SEQ ID NO: 1094471 - RNA, 22 nt, Human
cccagacacccaggauggaaua

SEQ ID NO: 1094472 - RNA, 20 nt, Human
cccagaguggggccacuggc

SEQ ID NO: 1094473 - RNA, 21 nt, Human
cccagcuuugaccagucaggc

SEQ ID NO: 1094474 - RNA, 18 nt, Human
cccaggauggagaagacc

SEQ ID NO: 1094475 - RNA, 19 nt, Human
cccagggcugugagggccc

SEQ ID NO: 1094476 - RNA, 23 nt, Human
ccccacaucuauccauaccuggu

SEQ ID NO: 1094477 - RNA, 20 nt, Human
cccggcccugacucugccac

SEQ ID NO: 1094478 - RNA, 19 nt, Human
ccgucucgggacuggacgu

SEQ ID NO: 1094479 - RNA, 19 nt, Human
ccgucucucccuccuuccc

SEQ ID NO: 1094480 - RNA, 18 nt, Human
ccucccaguugagggccc

SEQ ID NO: 1094481 - RNA, 18 nt, Human
ccucccgucucucccucc

SEQ ID NO: 1094482 - RNA, 18 nt, Human
ccucccuucuccucucuc

SEQ ID NO: 1094483 - RNA, 19 nt, Human
ccucucucuccucccuccc

SEQ ID NO: 1094484 - RNA, 21 nt, Human
ccucuguccgggugucaggga

SEQ ID NO: 1094485 - RNA, 19 nt, Human
ccugacucugccaccuugg

SEQ ID NO: 1094486 - RNA, 22 nt, Human
cgcacaugcaacagcucgaagc

SEQ ID NO: 1094487 - RNA, 21 nt, Human
cgggaguguuccagguguggc

SEQ ID NO: 1094488 - RNA, 18 nt, Human
cgucucgggacuggacgu

SEQ ID NO: 1094489 - RNA, 26 nt, Human
cgugcacucgcacccaagcucacaca

SEQ ID NO: 1094490 - RNA, 25 nt, Human
cgugcucacgcacgcgugcacucgc

SEQ ID NO: 1094491 - RNA, 24 nt, Human
cuccaagaagaaaauggggauucc

SEQ ID NO: 1094492 - RNA, 23 nt, Human
cuccacaccuacaaaucuggcug

SEQ ID NO: 1094493 - RNA, 30 nt, Human
cuccacaccuacaaaucuggcugucgagaa

SEQ ID NO: 1094494 - RNA, 19 nt, Human
cuccagccucuguccgggu

SEQ ID NO: 1094495 - RNA, 20 nt, Human
cuccagucccccagacagcc

SEQ ID NO: 1094496 - RNA, 19 nt, Human
cucccuucuccucucucuc

SEQ ID NO: 1094497 - RNA, 20 nt, Human
cucccuugccucccuucucc

SEQ ID NO: 1094498 - RNA, 19 nt, Human
cuccuaggcuaggggcaga

SEQ ID NO: 1094499 - RNA, 19 nt, Human
cuucuauaacagggauggg

SEQ ID NO: 1094500 - RNA, 19 nt, Human
cuucuccucucucuccucc

SEQ ID NO: 1094501 - RNA, 19 nt, Human
gaggggucacccaagggug

SEQ ID NO: 1094502 - RNA, 20 nt, Human
gaggggucacccaagggugu

SEQ ID NO: 1094503 - RNA, 18 nt, Human
gcaggaagugcauccgcc

SEQ ID NO: 1094504 - RNA, 19 nt, Human
gccacauguggcccagggc

SEQ ID NO: 1094505 - RNA, 20 nt, Human
gccacugcugcuucuggggu

SEQ ID NO: 1094506 - RNA, 21 nt, Human
gccaugaagcccaggauggag

SEQ ID NO: 1094507 - RNA, 19 nt, Human
gcccaggauggagaagacc

SEQ ID NO: 1094508 - RNA, 23 nt, Human
gccccgaggcccccaccaugcac

SEQ ID NO: 1094509 - RNA, 21 nt, Human
gccccuggcaccuccaguccc

SEQ ID NO: 1094510 - RNA, 26 nt, Human
gccucuugccccacagaccugugggc

SEQ ID NO: 1094511 - RNA, 23 nt, Human
ggagaggugggcagggggugggc

SEQ ID NO: 1094512 - RNA, 21 nt, Human
ggagaugugcaugcccugcuc

SEQ ID NO: 1094513 - RNA, 23 nt, Human
ggagggcacaacagagggccaca

SEQ ID NO: 1094514 - RNA, 21 nt, Human
ggcaaagggacagugugggga

SEQ ID NO: 1094515 - RNA, 23 nt, Human
ggcagggggugggcguggcaggg

SEQ ID NO: 1094516 - RNA, 18 nt, Human
ggcggggccuaggaccag

SEQ ID NO: 1094517 - RNA, 24 nt, Human
ggcugggaggagguugaggaggcc

SEQ ID NO: 1094518 - RNA, 20 nt, Human
gggcagggggugggcguggc

SEQ ID NO: 1094519 - RNA, 19 nt, Human
gggccccuggcaccuccag

SEQ ID NO: 1094520 - RNA, 22 nt, Human
gggccccuggcaccuccagucc

SEQ ID NO: 1094521 - RNA, 20 nt, Human
ggggugggcguggcaggggc

SEQ ID NO: 1094522 - RNA, 22 nt, Human
guaaggagaggaugguuugggc

SEQ ID NO: 1094523 - RNA, 25 nt, Human
gugcacucgcacccaagcucacaca

SEQ ID NO: 1094524 - RNA, 19 nt, Human
guggugguaaaggacuuga

SEQ ID NO: 1094525 - RNA, 22 nt, Human
uagaagccccaggccagcacca

SEQ ID NO: 1094526 - RNA, 25 nt, Human
uagaagccccaggccagcaccauga

SEQ ID NO: 1094527 - RNA, 20 nt, Human
uagcccaggccuuugaacaa

SEQ ID NO: 1094528 - RNA, 20 nt, Human
uaggggcagagggguaaggu

SEQ ID NO: 1094529 - RNA, 21 nt, Human
uaggggcagagggguaaggua

SEQ ID NO: 1094530 - RNA, 20 nt, Human
uauaacagggauggggagag

SEQ ID NO: 1094531 - RNA, 24 nt, Human
ucaccuuugcuaagagauagagau

SEQ ID NO: 1094532 - RNA, 20 nt, Human
ucagcaagcuggucacaagu

SEQ ID NO: 1094533 - RNA, 22 nt, Human
ucagggaagccuuucuuggggu

SEQ ID NO: 1094534 - RNA, 21 nt, Human
uccacacaacagacucgcaca

SEQ ID NO: 1094535 - RNA, 18 nt, Human
uccauucugggucugggg

SEQ ID NO: 1094536 - RNA, 20 nt, Human
ucccaagcugccacugcugc

SEQ ID NO: 1094537 - RNA, 20 nt, Human
uccccacaucuauccauacc

SEQ ID NO: 1094538 - RNA, 25 nt, Human
ucccccagacagccucaagacuuug

SEQ ID NO: 1094539 - RNA, 20 nt, Human
uccccgcaggcccaccaccc

SEQ ID NO: 1094540 - RNA, 21 nt, Human
ucccgggggugugcccagccc

SEQ ID NO: 1094541 - RNA, 20 nt, Human
ucccgucucucccuccuucc

SEQ ID NO: 1094542 - RNA, 20 nt, Human
ucccucccgucucucccucc

SEQ ID NO: 1094543 - RNA, 20 nt, Human
ucccuuccucacauuuccca

SEQ ID NO: 1094544 - RNA, 23 nt, Human
ucccuucuccucucucuccuccc

SEQ ID NO: 1094545 - RNA, 18 nt, Human
ucccuugccucccuucuc

SEQ ID NO: 1094546 - RNA, 27 nt, Human
ucccuugccucccuucuccucucucuc

SEQ ID NO: 1094547 - RNA, 18 nt, Human
ucgagaccaagcagcaac

SEQ ID NO: 1094548 - RNA, 21 nt, Human
ucgggacuggacgugacagac

SEQ ID NO: 1094549 - RNA, 25 nt, Human
ucuacgugcucacgcacgcgugcag

SEQ ID NO: 1094550 - RNA, 22 nt, Human
ucuauccauaccugaggggacc

SEQ ID NO: 1094551 - RNA, 23 nt, Human
ucucccuuuggaaacagaaguug

SEQ ID NO: 1094552 - RNA, 18 nt, Human
ucucuaagcuucuauaac

SEQ ID NO: 1094553 - RNA, 18 nt, Human
ucuggggugaggggucac

SEQ ID NO: 1094554 - RNA, 24 nt, Human
ugaagcccaggauggagaagacca

SEQ ID NO: 1094555 - RNA, 24 nt, Human
ugaagcccuccacaccuacaaauc

SEQ ID NO: 1094556 - RNA, 19 nt, Human
ugacagccuguggguaggc

SEQ ID NO: 1094557 - RNA, 20 nt, Human
ugacucugccaccuuggaga

SEQ ID NO: 1094558 - RNA, 19 nt, Human
ugagguuggccaggcuggc

SEQ ID NO: 1094559 - RNA, 22 nt, Human
ugagguuggccaggcuggcacu

SEQ ID NO: 1094560 - RNA, 24 nt, Human
ugauguaguagguguugcaguaga

SEQ ID NO: 1094561 - RNA, 25 nt, Human
ugauuggcgcaggaaccagaagguu

SEQ ID NO: 1094562 - RNA, 20 nt, Human
ugccacugcugcuucugggg

SEQ ID NO: 1094563 - RNA, 21 nt, Human
ugccacugcugcuucuggggu

SEQ ID NO: 1094564 - RNA, 19 nt, Human
ugccaggcagcagcacucc

SEQ ID NO: 1094565 - RNA, 24 nt, Human
ugccaggcagcagcacuccaagca

SEQ ID NO: 1094566 - RNA, 20 nt, Human
ugcccagcccagggcacagg

SEQ ID NO: 1094567 - RNA, 19 nt, Human
ugcuacagagcagagccug

SEQ ID NO: 1094568 - RNA, 21 nt, Human
uggagggggagaggcaucuau

SEQ ID NO: 1094569 - RNA, 22 nt, Human
uggaggugcaggaagugcaucc

SEQ ID NO: 1094570 - RNA, 20 nt, Human
uggcaccuccagucccccag

SEQ ID NO: 1094571 - RNA, 20 nt, Human
uggcauaagaaaagaaaauc

SEQ ID NO: 1094572 - RNA, 23 nt, Human
uggcauaagaaaagaaaaucugg

SEQ ID NO: 1094573 - RNA, 18 nt, Human
uggcccagggcagcgugg

SEQ ID NO: 1094574 - RNA, 23 nt, Human
uggcugucgagaccaagcagcaa

SEQ ID NO: 1094575 - RNA, 21 nt, Human
ugggaagccugagcaggccag

SEQ ID NO: 1094576 - RNA, 19 nt, Human
ugggcaaagggacagugug

SEQ ID NO: 1094577 - RNA, 24 nt, Human
ugggcuaggacuggagggggagag

SEQ ID NO: 1094578 - RNA, 19 nt, Human
uggggcacuaggcggggcc

SEQ ID NO: 1094579 - RNA, 22 nt, Human
uggggucacucagccgucucgg

SEQ ID NO: 1094580 - RNA, 19 nt, Human
uggguaggcgaugaaggcc

SEQ ID NO: 1094581 - RNA, 19 nt, Human
uggguggggguggggcacu

SEQ ID NO: 1094582 - RNA, 23 nt, Human
ugguggguugugauauuuuuggc

SEQ ID NO: 1094583 - RNA, 24 nt, Human
ugguuugggcuccuuccucuuuuu

SEQ ID NO: 1094584 - RNA, 22 nt, Human
uguagcugcccagggcugugag

SEQ ID NO: 1094585 - RNA, 24 nt, Human
uguccagggugccaggcagcagca

SEQ ID NO: 1094586 - RNA, 18 nt, Human
ugucgagaccaagcagca

SEQ ID NO: 1094587 - RNA, 23 nt, Human
uguugcaguagaagacgaucacc

SEQ ID NO: 1094588 - RNA, 25 nt, Human
uuccagguguggccacauguggccc

SEQ ID NO: 1094589 - RNA, 18 nt, Human
uugggcuccuuccucuuu

SEQ ID NO: 1094590 - RNA, 25 nt, Human
uugguggguugugauauuuuuggcg

SEQ ID NO: 1094591 - RNA, 19 nt, Human
uugguggugauuggcgcag

SEQ ID NO: 1094592 - RNA, 21 nt, Human
uugguggugauuggcgcagga

SEQ ID NO: 1094593 - RNA, 24 nt, Human
uuguuguugaagcgguuguagcug

SEQ ID NO: 1094594 - RNA, 22 nt, Human
uuuagcacaguaagaauguccc

SEQ ID NO: 1094595 - RNA, 19 nt, Human
aaagcccucuucaugucuc

SEQ ID NO: 1094596 - RNA, 25 nt, Human
aacauccaccacugacuuaggcaac

SEQ ID NO: 1094597 - RNA, 20 nt, Human
aagauggaugacugaagcca

SEQ ID NO: 1094598 - RNA, 21 nt, Human
aaucucgacaggagacagcgg

SEQ ID NO: 1094599 - RNA, 23 nt, Human
accacuuguaucugugaaccccu

SEQ ID NO: 1094600 - RNA, 24 nt, Human
agcaagcgaccgaccucuuccacg

SEQ ID NO: 1094601 - RNA, 22 nt, Human
augaacuaaagauaaugccaca

SEQ ID NO: 1094602 - RNA, 18 nt, Human
augaggcaaaaugcaggc

SEQ ID NO: 1094603 - RNA, 19 nt, Human
caaacauccaccacugacu

SEQ ID NO: 1094604 - RNA, 23 nt, Human
caacauaacagcaagcgaccgac

SEQ ID NO: 1094605 - RNA, 18 nt, Human
caagcgaccgaccucuuc

SEQ ID NO: 1094606 - RNA, 24 nt, Human
caauucauuagagaggaaucucaa

SEQ ID NO: 1094607 - RNA, 20 nt, Human
cagcaagcgaccgaccucuu

SEQ ID NO: 1094608 - RNA, 18 nt, Human
cauccacuggcucuuccu

SEQ ID NO: 1094609 - RNA, 27 nt, Human
ccaaagcuaccacuggguuuuccccug

SEQ ID NO: 1094610 - RNA, 20 nt, Human
ccccagggcccaucuguggg

SEQ ID NO: 1094611 - RNA, 19 nt, Human
ccccugcaaacugagcaag

SEQ ID NO: 1094612 - RNA, 27 nt, Human
ccccuguaacaguacucaacaguggcu

SEQ ID NO: 1094613 - RNA, 21 nt, Human
ccucugcucucuccaacuguu

SEQ ID NO: 1094614 - RNA, 23 nt, Human
ccucugcucucuccaacuguuuu

SEQ ID NO: 1094615 - RNA, 24 nt, Human
ccucugcucucuccaacuguuuua

SEQ ID NO: 1094616 - RNA, 21 nt, Human
cgaaagcagcuuccaaagcua

SEQ ID NO: 1094617 - RNA, 24 nt, Human
cgcaagcucacacagcuuccuaga

SEQ ID NO: 1094618 - RNA, 22 nt, Human
cuaaagcccucuucaugucucu

SEQ ID NO: 1094619 - RNA, 23 nt, Human
cugcuucaaccacuuguaucugu

SEQ ID NO: 1094620 - RNA, 22 nt, Human
cuggaaguccuuuauaucauac

SEQ ID NO: 1094621 - RNA, 18 nt, Human
cuucugagcuauccuccu

SEQ ID NO: 1094622 - RNA, 18 nt, Human
gaaagcagcuuccaaagc

SEQ ID NO: 1094623 - RNA, 23 nt, Human
gaaguccuuuauaucauacacuu

SEQ ID NO: 1094624 - RNA, 19 nt, Human
gacuaugaggcaaaaugca

SEQ ID NO: 1094625 - RNA, 25 nt, Human
gagaagcaggcccagauuccucucu

SEQ ID NO: 1094626 - RNA, 19 nt, Human
gagcaagaauacuauuucc

SEQ ID NO: 1094627 - RNA, 21 nt, Human
gcaaugggucucuuguccaca

SEQ ID NO: 1094628 - RNA, 19 nt, Human
gcagugguccucaucuuuc

SEQ ID NO: 1094629 - RNA, 21 nt, Human
gcgaaccucugcucucuccaa

SEQ ID NO: 1094630 - RNA, 19 nt, Human
gcuguaguggaucuggcug

SEQ ID NO: 1094631 - RNA, 23 nt, Human
ggcccuguucuugaugagucuua

SEQ ID NO: 1094632 - RNA, 22 nt, Human
gucacuuccucauuauuucuac

SEQ ID NO: 1094633 - RNA, 21 nt, Human
gugcauggauucccgggugac

SEQ ID NO: 1094634 - RNA, 22 nt, Human
uaaaaaguaaacuucauaaauu

SEQ ID NO: 1094635 - RNA, 21 nt, Human
uaagaagcaacauaacagcaa

SEQ ID NO: 1094636 - RNA, 20 nt, Human
uagacaacucuacaaacauc

SEQ ID NO: 1094637 - RNA, 23 nt, Human
uaucccuuccaggcgaaccucug

SEQ ID NO: 1094638 - RNA, 23 nt, Human
uaucucauuuuuuccacauccac

SEQ ID NO: 1094639 - RNA, 22 nt, Human
uauuaugguucuccaaaucagc

SEQ ID NO: 1094640 - RNA, 21 nt, Human
ucaaucacaauccagaagccu

SEQ ID NO: 1094641 - RNA, 27 nt, Human
ucaccagauacaauuucaaaauuguau

SEQ ID NO: 1094642 - RNA, 19 nt, Human
uccaaauauuggccaacac

SEQ ID NO: 1094643 - RNA, 18 nt, Human
ucccccagggcccaucug

SEQ ID NO: 1094644 - RNA, 24 nt, Human
uccucaucuuucuccucguuguag

SEQ ID NO: 1094645 - RNA, 21 nt, Human
ucuacaaacauccaccacuga

SEQ ID NO: 1094646 - RNA, 18 nt, Human
ucuacaguucugaacugu

SEQ ID NO: 1094647 - RNA, 23 nt, Human
ucuacaguucugaacuguaaaaa

SEQ ID NO: 1094648 - RNA, 21 nt, Human
ucugaacuguaaaaaaugacu

SEQ ID NO: 1094649 - RNA, 20 nt, Human
ugaaaaacacaggaaccacu

SEQ ID NO: 1094650 - RNA, 20 nt, Human
ugaacuguaaaaaaugacuc

SEQ ID NO: 1094651 - RNA, 18 nt, Human
ugagaauggucccccagg

SEQ ID NO: 1094652 - RNA, 19 nt, Human
ugcagugguccucaucuuu

SEQ ID NO: 1094653 - RNA, 18 nt, Human
uggaugacugaagccauu

SEQ ID NO: 1094654 - RNA, 21 nt, Human
uggcaggugugcccacuggga

SEQ ID NO: 1094655 - RNA, 21 nt, Human
uggcugccauuuguccuuggg

SEQ ID NO: 1094656 - RNA, 21 nt, Human
uggcugccauuuguccuuggg

SEQ ID NO: 1094657 - RNA, 18 nt, Human
ugguauggugacaacuuc

SEQ ID NO: 1094658 - RNA, 23 nt, Human
ugguauggugacaacuucuuggu

SEQ ID NO: 1094659 - RNA, 19 nt, Human
uguggucaaauggcacugc

SEQ ID NO: 1094660 - RNA, 21 nt, Human
uguuauugucugcaauggcuu

SEQ ID NO: 1094661 - RNA, 22 nt, Human
uuaaugagcgaacauuuugcuu

SEQ ID NO: 1094662 - RNA, 19 nt, Human
uuaggcaacguucugugcu

SEQ ID NO: 1094663 - RNA, 24 nt, Human
uuccccugcaaacugagcaagaau

SEQ ID NO: 1094664 - RNA, 21 nt, Human
uucuagguugcuaaagcccuc

SEQ ID NO: 1094665 - RNA, 23 nt, Human
uuggucaggcuccaaauauuggc

SEQ ID NO: 1094666 - RNA, 19 nt, Human
uugugauccugaauguuau

SEQ ID NO: 1094667 - RNA, 19 nt, Human
uuuccccugcaaacugagc

SEQ ID NO: 1094668 - RNA, 19 nt, Human
aauuucuuccuuguuucuc

SEQ ID NO: 1094669 - RNA, 20 nt, Human
cagggccuucugcaaggcuu

SEQ ID NO: 1094670 - RNA, 23 nt, Human
ccugaccaggugucuuucucacc

SEQ ID NO: 1094671 - RNA, 22 nt, Human
ccuuuagucugacaccauaggc

SEQ ID NO: 1094672 - RNA, 19 nt, Human
gauuggcuuauacagagag

SEQ ID NO: 1094673 - RNA, 19 nt, Human
gcccccuuaucccacugac

SEQ ID NO: 1094674 - RNA, 18 nt, Human
gccuuuagucugacacca

SEQ ID NO: 1094675 - RNA, 19 nt, Human
uccaaaugcuuuuucuugg

SEQ ID NO: 1094676 - RNA, 22 nt, Human
uccaaaugcuuuuucuuggcac

SEQ ID NO: 1094677 - RNA, 20 nt, Human
uccaagucuucaaagucacc

SEQ ID NO: 1094678 - RNA, 19 nt, Human
ucgcaugaagacaauaucg

SEQ ID NO: 1094679 - RNA, 22 nt, Human
ucugaguaucggggcccgauuu

SEQ ID NO: 1094680 - RNA, 18 nt, Human
ugaauuaaaauguuucuu

SEQ ID NO: 1094681 - RNA, 21 nt, Human
ugaccaggugucuuucucacc

SEQ ID NO: 1094682 - RNA, 21 nt, Human
uuccaagucuucaaagucacc

SEQ ID NO: 1094683 - RNA, 23 nt, Human
uucucacccacugguuucaacaa

SEQ ID NO: 1094684 - RNA, 19 nt, Human
aaagcccucuucaugucuc

SEQ ID NO: 1094685 - RNA, 24 nt, Human
aagaaaaaaaaaacuuaaaaaaaa

SEQ ID NO: 1094686 - RNA, 23 nt, Human
agaaaaaaaaaacuuaaaaaaaa

SEQ ID NO: 1094687 - RNA, 24 nt, Human
cgcaagcucacacagcuuccuaga

SEQ ID NO: 1094688 - RNA, 22 nt, Human
cuaaagcccucuucaugucucu

SEQ ID NO: 1094689 - RNA, 22 nt, Human
uaaaaaguaaacuucauaaauu

SEQ ID NO: 1094690 - RNA, 24 nt, Human
uaauaaaagaaaaaaaaaacuuaa

SEQ ID NO: 1094691 - RNA, 20 nt, Human
ugaaaaacacaggaaccacu

SEQ ID NO: 1094692 - RNA, 21 nt, Human
uucuagguugcuaaagcccuc

SEQ ID NO: 1094693 - RNA, 23 nt, Human
aacagagacaggaaugccacugg

SEQ ID NO: 1094694 - RNA, 22 nt, Human
aacccacccagugacuuccaaa

SEQ ID NO: 1094695 - RNA, 18 nt, Human
aacugaggggccgugggg

SEQ ID NO: 1094696 - RNA, 23 nt, Human
aagaaaaaaaaagagggggauaa

SEQ ID NO: 1094697 - RNA, 18 nt, Human
aagcacuaaaaaccagca

SEQ ID NO: 1094698 - RNA, 18 nt, Human
aagcgacagaaccugugc

SEQ ID NO: 1094699 - RNA, 18 nt, Human
acauggaguauuucugga

SEQ ID NO: 1094700 - RNA, 21 nt, Human
acauggccaacuccuaagcac

SEQ ID NO: 1094701 - RNA, 24 nt, Human
acuaaaaaccagcagcaccaacac

SEQ ID NO: 1094702 - RNA, 19 nt, Human
agacaggaagaagacagcc

SEQ ID NO: 1094703 - RNA, 23 nt, Human
agacaggaagaagacagccagag

SEQ ID NO: 1094704 - RNA, 20 nt, Human
agaccaggacuuccaacaga

SEQ ID NO: 1094705 - RNA, 22 nt, Human
agcuccgccucaucguugcacu

SEQ ID NO: 1094706 - RNA, 22 nt, Human
agcuggcugcagccucagccuc

SEQ ID NO: 1094707 - RNA, 20 nt, Human
aggaagaagacagccagagu

SEQ ID NO: 1094708 - RNA, 21 nt, Human
aggaagcugaggucaggggga

SEQ ID NO: 1094709 - RNA, 18 nt, Human
aggauuagcugcccacag

SEQ ID NO: 1094710 - RNA, 20 nt, Human
aggcaggaagcugaggucaa

SEQ ID NO: 1094711 - RNA, 21 nt, Human
aggcaggaagcugaggucagg

SEQ ID NO: 1094712 - RNA, 22 nt, Human
aggcaggaagcugaggucaggg

SEQ ID NO: 1094713 - RNA, 18 nt, Human
agggagccauggaggggc

SEQ ID NO: 1094714 - RNA, 18 nt, Human
aggucagggggagggggc

SEQ ID NO: 1094715 - RNA, 21 nt, Human
aguauagaggucggggagaga

SEQ ID NO: 1094716 - RNA, 18 nt, Human
aucugggagccugauggc

SEQ ID NO: 1094717 - RNA, 23 nt, Human
augaaguaaacaauaauaaccuu

SEQ ID NO: 1094718 - RNA, 21 nt, Human
caacccacccagugacuucca

SEQ ID NO: 1094719 - RNA, 23 nt, Human
caaccgagaagagcuccgccuca

SEQ ID NO: 1094720 - RNA, 21 nt, Human
caaggugguggcugccagauc

SEQ ID NO: 1094721 - RNA, 21 nt, Human
cacaacccacccagugacuuc

SEQ ID NO: 1094722 - RNA, 21 nt, Human
cacaauuccaaagaaaaaaaa

SEQ ID NO: 1094723 - RNA, 19 nt, Human
cacagcccaccugggccuu

SEQ ID NO: 1094724 - RNA, 21 nt, Human
cacauggaguauuucuggaag

SEQ ID NO: 1094725 - RNA, 22 nt, Human
cagaacucagcuuugcucucac

SEQ ID NO: 1094726 - RNA, 20 nt, Human
cagcucaacccaccggcccu

SEQ ID NO: 1094727 - RNA, 18 nt, Human
cagcuccacccagggaua

SEQ ID NO: 1094728 - RNA, 22 nt, Human
cagcuccuuguggggcacaggc

SEQ ID NO: 1094729 - RNA, 18 nt, Human
caggaaugccacuggcuu

SEQ ID NO: 1094730 - RNA, 24 nt, Human
cagggacugugaccuucacaaccc

SEQ ID NO: 1094731 - RNA, 25 nt, Human
ccacccagugacuuccaaaugcucc

SEQ ID NO: 1094732 - RNA, 22 nt, Human
ccagagcuucucucuucaacga

SEQ ID NO: 1094733 - RNA, 20 nt, Human
ccagcagcaccaacacucag

SEQ ID NO: 1094734 - RNA, 19 nt, Human
cccagacaggaagaagaca

SEQ ID NO: 1094735 - RNA, 19 nt, Human
cccgugcccgcagcagagu

SEQ ID NO: 1094736 - RNA, 20 nt, Human
cccucaaccgagaagagcuc

SEQ ID NO: 1094737 - RNA, 19 nt, Human
ccucacagggcugcuccuc

SEQ ID NO: 1094738 - RNA, 19 nt, Human
ccugauggcaggugggugg

SEQ ID NO: 1094739 - RNA, 19 nt, Human
cgagaagagcuccgccuca

SEQ ID NO: 1094740 - RNA, 23 nt, Human
cgauccagccccagaacaaccca

SEQ ID NO: 1094741 - RNA, 24 nt, Human
cgauccagccccagaacaacccag

SEQ ID NO: 1094742 - RNA, 20 nt, Human
cuaaaaaccagcagcaccaa

SEQ ID NO: 1094743 - RNA, 22 nt, Human
cuaaaaaccagcagcaccaaca

SEQ ID NO: 1094744 - RNA, 24 nt, Human
cuaagcacuaaaaaccagcagcac

SEQ ID NO: 1094745 - RNA, 22 nt, Human
cucuucaacgauccagccccag

SEQ ID NO: 1094746 - RNA, 21 nt, Human
cugaggucagggggagggggc

SEQ ID NO: 1094747 - RNA, 23 nt, Human
cugugaacugaggggccgugggg

SEQ ID NO: 1094748 - RNA, 26 nt, Human
cuucugcuacaagccggaccagaacu

SEQ ID NO: 1094749 - RNA, 25 nt, Human
gaccuucacaacccacccagugacu

SEQ ID NO: 1094750 - RNA, 25 nt, Human
gagaagaaugaagaggaccgguacc

SEQ ID NO: 1094751 - RNA, 24 nt, Human
gagcacaggcaggaaaggauuagc

SEQ ID NO: 1094752 - RNA, 19 nt, Human
gagcacuccucuggcagcu

SEQ ID NO: 1094753 - RNA, 28 nt, Human
gcagauccaggcaacacgaugggggcca

SEQ ID NO: 1094754 - RNA, 22 nt, Human
gcagccucagccucacagggcu

SEQ ID NO: 1094755 - RNA, 24 nt, Human
gcccucaaccgagaagagcuccgc

SEQ ID NO: 1094756 - RNA, 25 nt, Human
gcucuucuucacuguccagagcuuc

SEQ ID NO: 1094757 - RNA, 23 nt, Human
gcuggcacugcagccgaccagua

SEQ ID NO: 1094758 - RNA, 21 nt, Human
ggagagagcacaggcaggaaa

SEQ ID NO: 1094759 - RNA, 19 nt, Human
ggccugcugggccaggcac

SEQ ID NO: 1094760 - RNA, 24 nt, Human
ggcugcuccucaacugugcuccac

SEQ ID NO: 1094761 - RNA, 26 nt, Human
ggcuugcaaccaacacaaagcuccag

SEQ ID NO: 1094762 - RNA, 23 nt, Human
gggagagagcacaggcaggaaag

SEQ ID NO: 1094763 - RNA, 18 nt, Human
ggggagggggcucagcag

SEQ ID NO: 1094764 - RNA, 18 nt, Human
ggggaugagcugugagug

SEQ ID NO: 1094765 - RNA, 23 nt, Human
gugcugcugggccauggccugcu

SEQ ID NO: 1094766 - RNA, 21 nt, Human
gugguucucaccaaaaaacag

SEQ ID NO: 1094767 - RNA, 26 nt, Human
uaagcacuaaaaaccagcagcaccuc

SEQ ID NO: 1094768 - RNA, 22 nt, Human
uaaguagggagccauggagggg

SEQ ID NO: 1094769 - RNA, 20 nt, Human
uacccaggccgggugggggc

SEQ ID NO: 1094770 - RNA, 19 nt, Human
uagggagccauggaggggc

SEQ ID NO: 1094771 - RNA, 18 nt, Human
ucacagacccaggcaaca

SEQ ID NO: 1094772 - RNA, 24 nt, Human
ucaccaaaaaacaggggagagagc

SEQ ID NO: 1094773 - RNA, 27 nt, Human
uccaaagaaaaaaaaagagggggauaa

SEQ ID NO: 1094774 - RNA, 18 nt, Human
uccacaaagacauccacc

SEQ ID NO: 1094775 - RNA, 24 nt, Human
uccgccucaucguugcacugguuc

SEQ ID NO: 1094776 - RNA, 19 nt, Human
ucggggagagaggguccac

SEQ ID NO: 1094777 - RNA, 21 nt, Human
ucguugcacugguugagcaug

SEQ ID NO: 1094778 - RNA, 23 nt, Human
ucucaccaaaaaacaggggagag

SEQ ID NO: 1094779 - RNA, 22 nt, Human
ucuccccagacaggaagaagac

SEQ ID NO: 1094780 - RNA, 21 nt, Human
ugaaguaaacaauaauaaccc

SEQ ID NO: 1094781 - RNA, 18 nt, Human
ugacuuccaaaugcuccu

SEQ ID NO: 1094782 - RNA, 19 nt, Human
ugagaagaaugaagaggac

SEQ ID NO: 1094783 - RNA, 19 nt, Human
ugaggcucauccuacccag

SEQ ID NO: 1094784 - RNA, 18 nt, Human
ugaggucagggggagggg

SEQ ID NO: 1094785 - RNA, 22 nt, Human
ugcaggggaagcuggcauggga

SEQ ID NO: 1094786 - RNA, 23 nt, Human
ugccacuggcuucuggaaaagag

SEQ ID NO: 1094787 - RNA, 22 nt, Human
ugcuccacaaagacauccacca

SEQ ID NO: 1094788 - RNA, 25 nt, Human
ugcuccacaaagacauccaccagcu

SEQ ID NO: 1094789 - RNA, 21 nt, Human
ugcugcugggccauggccugc

SEQ ID NO: 1094790 - RNA, 22 nt, Human
uggaaaagaguuacuuguggug

SEQ ID NO: 1094791 - RNA, 22 nt, Human
uggcaggugggugggggauggg

SEQ ID NO: 1094792 - RNA, 26 nt, Human
uggccaacuccuaagcacuaaaaacc

SEQ ID NO: 1094793 - RNA, 23 nt, Human
ugggagccugauggcaggugggu

SEQ ID NO: 1094794 - RNA, 18 nt, Human
ugggggaugggaaagggg

SEQ ID NO: 1094795 - RNA, 21 nt, Human
ugguugagcaugcaguggcac

SEQ ID NO: 1094796 - RNA, 23 nt, Human
uuacauaucuuaaaaaacuaaag

SEQ ID NO: 1094797 - RNA, 24 nt, Human
uucacagugugcugcugggccaug

SEQ ID NO: 1094798 - RNA, 18 nt, Human
uucacuguccagagcuuu

SEQ ID NO: 1094799 - RNA, 23 nt, Human
aaagacaggcccgcccacaagca

SEQ ID NO: 1094800 - RNA, 18 nt, Human
aaagagccaguugauuuu

SEQ ID NO: 1094801 - RNA, 18 nt, Human
aacagaauccugcacaca

SEQ ID NO: 1094802 - RNA, 23 nt, Human
aacuccugggcucaagugauccu

SEQ ID NO: 1094803 - RNA, 19 nt, Human
acugcagccucaaacuccu

SEQ ID NO: 1094804 - RNA, 27 nt, Human
acuggcaccaagucuacuugguggucc

SEQ ID NO: 1094805 - RNA, 20 nt, Human
acugugcuuccaugaaaggc

SEQ ID NO: 1094806 - RNA, 21 nt, Human
agagagggaauggacgugacg

SEQ ID NO: 1094807 - RNA, 19 nt, Human
agagaguugugaugggacc

SEQ ID NO: 1094808 - RNA, 19 nt, Human
aggaguugcaauuaagcac

SEQ ID NO: 1094809 - RNA, 18 nt, Human
agugcuugugauguacca

SEQ ID NO: 1094810 - RNA, 21 nt, Human
auaaaacacucugcagaucua

SEQ ID NO: 1094811 - RNA, 18 nt, Human
auaguucacugcagccuc

SEQ ID NO: 1094812 - RNA, 19 nt, Human
caagugauccucugccuca

SEQ ID NO: 1094813 - RNA, 21 nt, Human
caagugauccucugccucacc

SEQ ID NO: 1094814 - RNA, 21 nt, Human
caagugauccucugccucacc

SEQ ID NO: 1094815 - RNA, 24 nt, Human
caccaagucuacuugcauaaaaca

SEQ ID NO: 1094816 - RNA, 22 nt, Human
cacccccucaaggagcuggggg

SEQ ID NO: 1094817 - RNA, 22 nt, Human
cacgcucugcccuuucucugcu

SEQ ID NO: 1094818 - RNA, 21 nt, Human
cagaauccugcacacacuucc

SEQ ID NO: 1094819 - RNA, 24 nt, Human
cagccucaaacuccugggcucaag

SEQ ID NO: 1094820 - RNA, 19 nt, Human
caggaguugcaauuaagca

SEQ ID NO: 1094821 - RNA, 18 nt, Human
caugugcaggaugugcag

SEQ ID NO: 1094822 - RNA, 19 nt, Human
ccagccuggugaaagacag

SEQ ID NO: 1094823 - RNA, 20 nt, Human
cccacaagcagaacugaggc

SEQ ID NO: 1094824 - RNA, 23 nt, Human
ccgcccacaagcagaacugaggc

SEQ ID NO: 1094825 - RNA, 25 nt, Human
ccgcccacaagcagaacugagggga

SEQ ID NO: 1094826 - RNA, 22 nt, Human
ccucgagccgcuucucgacccu

SEQ ID NO: 1094827 - RNA, 19 nt, Human
ccugggcucaagugauccu

SEQ ID NO: 1094828 - RNA, 20 nt, Human
ccugggcucaagugauccuc

SEQ ID NO: 1094829 - RNA, 18 nt, Human
cguggcuacggggaugcc

SEQ ID NO: 1094830 - RNA, 23 nt, Human
cuccugggcucaagugauccucu

SEQ ID NO: 1094831 - RNA, 24 nt, Human
cuccugggcucaagugauccucug

SEQ ID NO: 1094832 - RNA, 23 nt, Human
cugcagccucaaacuccugggcu

SEQ ID NO: 1094833 - RNA, 23 nt, Human
cugccacguucguucuuucucag

SEQ ID NO: 1094834 - RNA, 21 nt, Human
cugcuccugucaacccaucac

SEQ ID NO: 1094835 - RNA, 21 nt, Human
cugggagacucaggccaagcu

SEQ ID NO: 1094836 - RNA, 19 nt, Human
cuggggccagagagggaau

SEQ ID NO: 1094837 - RNA, 20 nt, Human
gaaaggacauccaaccucug

SEQ ID NO: 1094838 - RNA, 18 nt, Human
gcagccuggucuccucga

SEQ ID NO: 1094839 - RNA, 19 nt, Human
gccacguucguucuuucuc

SEQ ID NO: 1094840 - RNA, 22 nt, Human
gccauggugguuugcugcuccu

SEQ ID NO: 1094841 - RNA, 18 nt, Human
gcucaagugauccucugc

SEQ ID NO: 1094842 - RNA, 22 nt, Human
ggacgugacggucugugcagcc

SEQ ID NO: 1094843 - RNA, 18 nt, Human
gggcauucaaacucuuuu

SEQ ID NO: 1094844 - RNA, 22 nt, Human
gggcucaagugauccucugccu

SEQ ID NO: 1094845 - RNA, 27 nt, Human
gucacauuugccucugaggguuugcug

SEQ ID NO: 1094846 - RNA, 22 nt, Human
gugaaagacaggcccgcccaca

SEQ ID NO: 1094847 - RNA, 24 nt, Human
gugaaagacaggcccgcccacaag

SEQ ID NO: 1094848 - RNA, 19 nt, Human
gugcaggaugugcagguuu

SEQ ID NO: 1094849 - RNA, 18 nt, Human
guggaguacaguggugcc

SEQ ID NO: 1094850 - RNA, 18 nt, Human
guugcaauuaagcacguu

SEQ ID NO: 1094851 - RNA, 24 nt, Human
guugcaauuaagcacguugucagg

SEQ ID NO: 1094852 - RNA, 26 nt, Human
uaaaccccacaugcauuagcuauuca

SEQ ID NO: 1094853 - RNA, 19 nt, Human
uaacagaauccugcacacu

SEQ ID NO: 1094854 - RNA, 19 nt, Human
uaauaagugaaugaacugc

SEQ ID NO: 1094855 - RNA, 19 nt, Human
uacaguggugccauuauag

SEQ ID NO: 1094856 - RNA, 22 nt, Human
uagcaaacaugaaagacauaga

SEQ ID NO: 1094857 - RNA, 21 nt, Human
uaggaagagagaguugugaug

SEQ ID NO: 1094858 - RNA, 21 nt, Human
uaggaggcgggucacauuugc

SEQ ID NO: 1094859 - RNA, 24 nt, Human
uaguucacugcagccucaaacucc

SEQ ID NO: 1094860 - RNA, 22 nt, Human
ucaacccaucaccuagguauua

SEQ ID NO: 1094861 - RNA, 27 nt, Human
ucaacccaucaccuagguauuaaaccc

SEQ ID NO: 1094862 - RNA, 20 nt, Human
ucacugcagccucaaacucc

SEQ ID NO: 1094863 - RNA, 23 nt, Human
ucacugcagccucaaacuccugg

SEQ ID NO: 1094864 - RNA, 24 nt, Human
ucacugcagccucaaacuccuggg

SEQ ID NO: 1094865 - RNA, 21 nt, Human
uccugggcucaagugauccuc

SEQ ID NO: 1094866 - RNA, 23 nt, Human
uccugggcucaagugauccucug

SEQ ID NO: 1094867 - RNA, 18 nt, Human
uccugucaacccaucacc

SEQ ID NO: 1094868 - RNA, 21 nt, Human
ucuacugugcuuccaugaaag

SEQ ID NO: 1094869 - RNA, 18 nt, Human
ucugaaagcaucuuccuu

SEQ ID NO: 1094870 - RNA, 18 nt, Human
ugaaagacauagacaagc

SEQ ID NO: 1094871 - RNA, 19 nt, Human
ugaaaggcggaaaggacau

SEQ ID NO: 1094872 - RNA, 21 nt, Human
ugaggcacuucuaacuugaaa

SEQ ID NO: 1094873 - RNA, 20 nt, Human
ugagugcuugugauguacca

SEQ ID NO: 1094874 - RNA, 20 nt, Human
ugauccucugccucaccccc

SEQ ID NO: 1094875 - RNA, 19 nt, Human
ugcacugcuuuugccagcc

SEQ ID NO: 1094876 - RNA, 21 nt, Human
ugccucacccccucaaggagc

SEQ ID NO: 1094877 - RNA, 20 nt, Human
ugcuccugucaacccaucac

SEQ ID NO: 1094878 - RNA, 19 nt, Human
ugcugggugggggugugga

SEQ ID NO: 1094879 - RNA, 28 nt, Human
uggaguacaguggugccauucuagcacg

SEQ ID NO: 1094880 - RNA, 18 nt, Human
uggcagauugucccuggc

SEQ ID NO: 1094881 - RNA, 18 nt, Human
uggcuggucccugacauc

SEQ ID NO: 1094882 - RNA, 19 nt, Human
ugggagacucaggccaagc

SEQ ID NO: 1094883 - RNA, 22 nt, Human
ugggagacucaggccaagcuuc

SEQ ID NO: 1094884 - RNA, 19 nt, Human
ugggcucaagugauccucu

SEQ ID NO: 1094885 - RNA, 24 nt, Human
ugucaacccaucaccuagguauua

SEQ ID NO: 1094886 - RNA, 19 nt, Human
ugucugagccucuguugcc

SEQ ID NO: 1094887 - RNA, 20 nt, Human
ugugaugggacccacaggag

SEQ ID NO: 1094888 - RNA, 19 nt, Human
ugugggaugucuucuuccu

SEQ ID NO: 1094889 - RNA, 20 nt, Human
uuacauagguaguaaaugug

SEQ ID NO: 1094890 - RNA, 18 nt, Human
aggcacgggcaucaaggc

SEQ ID NO: 1094891 - RNA, 23 nt, Human
cacguacucauacuccugcucac

SEQ ID NO: 1094892 - RNA, 22 nt, Human
cacugugcacacagccugggac

SEQ ID NO: 1094893 - RNA, 23 nt, Human
ccaugcacucuugugaucacucc

SEQ ID NO: 1094894 - RNA, 18 nt, Human
ccccuggggaaccuuccu

SEQ ID NO: 1094895 - RNA, 18 nt, Human
cccugagacgggagaaag

SEQ ID NO: 1094896 - RNA, 22 nt, Human
ccggaaucacauuucugucaau

SEQ ID NO: 1094897 - RNA, 21 nt, Human
ccugcucacucaucccuuccc

SEQ ID NO: 1094898 - RNA, 27 nt, Human
ccugucacugugcacacagccugggac

SEQ ID NO: 1094899 - RNA, 25 nt, Human
cgaauucuuugaggucuggacagag

SEQ ID NO: 1094900 - RNA, 24 nt, Human
cucauacuccugcucacucauccc

SEQ ID NO: 1094901 - RNA, 19 nt, Human
cuggcauaacagugcuucc

SEQ ID NO: 1094902 - RNA, 21 nt, Human
cugggaccucccauccugugg

SEQ ID NO: 1094903 - RNA, 28 nt, Human
cugugcacacagccugggaccucccucc

SEQ ID NO: 1094904 - RNA, 19 nt, Human
gccagcuucacaggcacgg

SEQ ID NO: 1094905 - RNA, 24 nt, Human
gccagggugaguccccaugcacuc

SEQ ID NO: 1094906 - RNA, 25 nt, Human
gcccugagacgggagaaaggguagg

SEQ ID NO: 1094907 - RNA, 21 nt, Human
uccugucacugugcacacagc

SEQ ID NO: 1094908 - RNA, 22 nt, Human
ucgaaacucacguacucauacc

SEQ ID NO: 1094909 - RNA, 23 nt, Human
ucucuggccagggugagucccca

SEQ ID NO: 1094910 - RNA, 18 nt, Human
ugaggucuucgcugaugc

SEQ ID NO: 1094911 - RNA, 21 nt, Human
ugcacacagccugggaccucc

SEQ ID NO: 1094912 - RNA, 20 nt, Human
ugggaccucccauccugugg

SEQ ID NO: 1094913 - RNA, 26 nt, Human
aaagccaaaaccaaccaaacaaaaau

SEQ ID NO: 1094914 - RNA, 18 nt, Human
aacacuguuuaagucaaa

SEQ ID NO: 1094915 - RNA, 24 nt, Human
aagccaaaaccaaccaaacaaaaa

SEQ ID NO: 1094916 - RNA, 25 nt, Human
aagcuugcagcuguacagccuccaa

SEQ ID NO: 1094917 - RNA, 23 nt, Human
acagcccaggucccacccggcca

SEQ ID NO: 1094918 - RNA, 23 nt, Human
acucccaacccaagcuccgccca

SEQ ID NO: 1094919 - RNA, 23 nt, Human
agaagacggaauccacucaguac

SEQ ID NO: 1094920 - RNA, 20 nt, Human
agaccucuccuggugcccag

SEQ ID NO: 1094921 - RNA, 18 nt, Human
agauuuuuguuacagagc

SEQ ID NO: 1094922 - RNA, 22 nt, Human
agccuccaagagcaaacagccc

SEQ ID NO: 1094923 - RNA, 21 nt, Human
agcuguacagccuccaagagc

SEQ ID NO: 1094924 - RNA, 19 nt, Human
aggugugccaaagccaaaa

SEQ ID NO: 1094925 - RNA, 21 nt, Human
auccuuggggggcucuuucuc

SEQ ID NO: 1094926 - RNA, 26 nt, Human
aucugcagacacuucugucauccucu

SEQ ID NO: 1094927 - RNA, 21 nt, Human
caagaaaaccuaacucaggug

SEQ ID NO: 1094928 - RNA, 23 nt, Human
cacacauuccauuccugaguaga

SEQ ID NO: 1094929 - RNA, 23 nt, Human
cacuucugucauccucccauccu

SEQ ID NO: 1094930 - RNA, 21 nt, Human
cagagaccucuccuggugccc

SEQ ID NO: 1094931 - RNA, 20 nt, Human
cagcuguacagccuccaaga

SEQ ID NO: 1094932 - RNA, 21 nt, Human
caggaaaaacagaaagcggug

SEQ ID NO: 1094933 - RNA, 18 nt, Human
cagugggcuucccaaucu

SEQ ID NO: 1094934 - RNA, 22 nt, Human
cauauaucauacacacaaaaca

SEQ ID NO: 1094935 - RNA, 22 nt, Human
ccaaagccaaaaccaaccaaac

SEQ ID NO: 1094936 - RNA, 20 nt, Human
ccaaccaaacaaaaauggaa

SEQ ID NO: 1094937 - RNA, 21 nt, Human
ccaaccaaacaaaaauggaau

SEQ ID NO: 1094938 - RNA, 22 nt, Human
ccacccggggauccucagagac

SEQ ID NO: 1094939 - RNA, 18 nt, Human
ccaggcagugccaucugc

SEQ ID NO: 1094940 - RNA, 23 nt, Human
ccaucugcagacacuucugucau

SEQ ID NO: 1094941 - RNA, 21 nt, Human
cccaacccaagcuccgcccaa

SEQ ID NO: 1094942 - RNA, 22 nt, Human
cccaacccaagcuccgcccaac

SEQ ID NO: 1094943 - RNA, 20 nt, Human
cccuccccguccccuucuuu

SEQ ID NO: 1094944 - RNA, 22 nt, Human
ccuccaagagcaaacagcccag

SEQ ID NO: 1094945 - RNA, 22 nt, Human
ccugaaaacuucaaacaacugc

SEQ ID NO: 1094946 - RNA, 19 nt, Human
ccuuugagcgcggacucaa

SEQ ID NO: 1094947 - RNA, 21 nt, Human
cgcccaacuguggguccuugc

SEQ ID NO: 1094948 - RNA, 21 nt, Human
cgggaggaguuuccacccggg

SEQ ID NO: 1094949 - RNA, 21 nt, Human
cucccaacccaagcuccgcca

SEQ ID NO: 1094950 - RNA, 22 nt, Human
cugaguagaagacggaauccac

SEQ ID NO: 1094951 - RNA, 19 nt, Human
gacaucugaaucauuaacu

SEQ ID NO: 1094952 - RNA, 21 nt, Human
gaguagaagacggaauccacu

SEQ ID NO: 1094953 - RNA, 18 nt, Human
gcucuccaauucucagau

SEQ ID NO: 1094954 - RNA, 21 nt, Human
ggacucaaaacaggccagaag

SEQ ID NO: 1094955 - RNA, 20 nt, Human
guggcuguucaaacauuauc

SEQ ID NO: 1094956 - RNA, 18 nt, Human
uacuaguggugucugaua

SEQ ID NO: 1094957 - RNA, 20 nt, Human
uacuaguggugucugauaua

SEQ ID NO: 1094958 - RNA, 24 nt, Human
uacuuuggccuugcacccaggcuc

SEQ ID NO: 1094959 - RNA, 22 nt, Human
uauaucauacacacaaaacauu

SEQ ID NO: 1094960 - RNA, 21 nt, Human
uaucuacuaguggugucugau

SEQ ID NO: 1094961 - RNA, 22 nt, Human
ucccaacccaagcuccgcccaa

SEQ ID NO: 1094962 - RNA, 22 nt, Human
ucuguaagagucuaguucuucu

SEQ ID NO: 1094963 - RNA, 19 nt, Human
ucuugcaauccugggacuu

SEQ ID NO: 1094964 - RNA, 20 nt, Human
ugaaagcuuuuaguuuccuu

SEQ ID NO: 1094965 - RNA, 22 nt, Human
ugacgcccuccccguccccuuc

SEQ ID NO: 1094966 - RNA, 22 nt, Human
ugcacccaggcucacacgcgua

SEQ ID NO: 1094967 - RNA, 21 nt, Human
ugcagacacuucugucauccu

SEQ ID NO: 1094968 - RNA, 23 nt, Human
ugccaaagccaaaaccaaccaaa

SEQ ID NO: 1094969 - RNA, 26 nt, Human
ugccaaagccaaaaccaaccaaacaa

SEQ ID NO: 1094970 - RNA, 22 nt, Human
ugccaucugcagacacuucugu

SEQ ID NO: 1094971 - RNA, 19 nt, Human
ugggcggggggagaguauu

SEQ ID NO: 1094972 - RNA, 20 nt, Human
ugugguuuuacucccgggag

SEQ ID NO: 1094973 - RNA, 23 nt, Human
uguuacagagcucaaguuguuag

SEQ ID NO: 1094974 - RNA, 24 nt, Human
uuucccauauaucauacacacaaa

SEQ ID NO: 1094975 - RNA, 18 nt, Human
uuuggucaucuacugaca

SEQ ID NO: 1094976 - RNA, 23 nt, Human
aaacaggauacaagauaccacaa

SEQ ID NO: 1094977 - RNA, 21 nt, Human
aaaccacaccaccauccugug

SEQ ID NO: 1094978 - RNA, 26 nt, Human
aaaccacaccaccauccugugcuucc

SEQ ID NO: 1094979 - RNA, 23 nt, Human
aaacccucuccgaacuccagaau

SEQ ID NO: 1094980 - RNA, 19 nt, Human
aaccugcuuguuucucccu

SEQ ID NO: 1094981 - RNA, 22 nt, Human
aacugacagcugcaaagaccca

SEQ ID NO: 1094982 - RNA, 19 nt, Human
aagacaccacuaguagaaa

SEQ ID NO: 1094983 - RNA, 24 nt, Human
aagauagucagacauuuggagcca

SEQ ID NO: 1094984 - RNA, 20 nt, Human
aagccaccuggaugacaaca

SEQ ID NO: 1094985 - RNA, 24 nt, Human
aaguuaauacaacagaagacacca

SEQ ID NO: 1094986 - RNA, 22 nt, Human
acaaaggaaagaaguuaauaca

SEQ ID NO: 1094987 - RNA, 24 nt, Human
acaacagaagacaccacuaguaga

SEQ ID NO: 1094988 - RNA, 19 nt, Human
acagcugcaaagacccaga

SEQ ID NO: 1094989 - RNA, 24 nt, Human
accaccauccugugcuucccccua

SEQ ID NO: 1094990 - RNA, 18 nt, Human
accauccugugcuucccc

SEQ ID NO: 1094991 - RNA, 21 nt, Human
accccaggaaagcuggagagu

SEQ ID NO: 1094992 - RNA, 22 nt, Human
accucuccuccuuccgccccag

SEQ ID NO: 1094993 - RNA, 22 nt, Human
acuacgugcaaacucccugccc

SEQ ID NO: 1094994 - RNA, 19 nt, Human
acucccugcccagggggug

SEQ ID NO: 1094995 - RNA, 20 nt, Human
agaacccaauuugaggccau

SEQ ID NO: 1094996 - RNA, 21 nt, Human
agauagucagacauuuggagc

SEQ ID NO: 1094997 - RNA, 18 nt, Human
agcugcaaagacccagau

SEQ ID NO: 1094998 - RNA, 19 nt, Human
aggcagcagggcaaaccgc

SEQ ID NO: 1094999 - RNA, 19 nt, Human
auccauccagaccucccca

SEQ ID NO: 1095000 - RNA, 18 nt, Human
auccguauauucuucccu

SEQ ID NO: 1095001 - RNA, 22 nt, Human
augaaccggacgccuacacuua

SEQ ID NO: 1095002 - RNA, 20 nt, Human
caagcugagagcagucugcu

SEQ ID NO: 1095003 - RNA, 20 nt, Human
cacacacacugcaggcaaga

SEQ ID NO: 1095004 - RNA, 22 nt, Human
cacagauccauccagaccuccc

SEQ ID NO: 1095005 - RNA, 27 nt, Human
caccaccauccugugcuucccccuaaa

SEQ ID NO: 1095006 - RNA, 20 nt, Human
caccugacuaguucuaaggc

SEQ ID NO: 1095007 - RNA, 23 nt, Human
cacuccuuaggacccuaaagcca

SEQ ID NO: 1095008 - RNA, 23 nt, Human
cagaagacaccacuaguagaaac

SEQ ID NO: 1095009 - RNA, 19 nt, Human
cagagggcucccaacagca

SEQ ID NO: 1095010 - RNA, 26 nt, Human
cagcaauaccagcaaugcacuaacca

SEQ ID NO: 1095011 - RNA, 22 nt, Human
cagcacugaagccuuaucccuu

SEQ ID NO: 1095012 - RNA, 24 nt, Human
cagcagggcaaaccgcaacaccuc

SEQ ID NO: 1095013 - RNA, 26 nt, Human
cagcccaccagcagcauuucauacca

SEQ ID NO: 1095014 - RNA, 18 nt, Human
cagcgugaucacucaacu

SEQ ID NO: 1095015 - RNA, 21 nt, Human
cagcugcaaagacccagaugc

SEQ ID NO: 1095016 - RNA, 20 nt, Human
caguggaauggcuuugggau

SEQ ID NO: 1095017 - RNA, 19 nt, Human
caguuacaaaaaagcacaa

SEQ ID NO: 1095018 - RNA, 22 nt, Human
ccaccagcagcauuucauacca

SEQ ID NO: 1095019 - RNA, 22 nt, Human
ccaccuggaugacaacauuccc

SEQ ID NO: 1095020 - RNA, 18 nt, Human
ccagaccuccccagugcc

SEQ ID NO: 1095021 - RNA, 21 nt, Human
ccagaccuccccagugccauc

SEQ ID NO: 1095022 - RNA, 20 nt, Human
ccccagugccauccuucucc

SEQ ID NO: 1095023 - RNA, 24 nt, Human
cccuaaaucgcccaugaugcccgc

SEQ ID NO: 1095024 - RNA, 23 nt, Human
cccuauucccaaauugguauaca

SEQ ID NO: 1095025 - RNA, 20 nt, Human
ccgcagguaaaaauaaaacu

SEQ ID NO: 1095026 - RNA, 19 nt, Human
ccuaaggugcugugcaagc

SEQ ID NO: 1095027 - RNA, 19 nt, Human
ccugcccagggggugggug

SEQ ID NO: 1095028 - RNA, 19 nt, Human
ccugugugacuaagaaggu

SEQ ID NO: 1095029 - RNA, 25 nt, Human
ccuuucuauuccuaagagcuggaaa

SEQ ID NO: 1095030 - RNA, 19 nt, Human
cgcaacaccucuccuccuu

SEQ ID NO: 1095031 - RNA, 25 nt, Human
cuacagggaacuccuacacagaucc

SEQ ID NO: 1095032 - RNA, 19 nt, Human
cuauccguauauucuuccc

SEQ ID NO: 1095033 - RNA, 18 nt, Human
cucuccuccuuccgcccc

SEQ ID NO: 1095034 - RNA, 24 nt, Human
cugcagguuuaaaccacaccacca

SEQ ID NO: 1095035 - RNA, 19 nt, Human
cugcuggggaggcagcagg

SEQ ID NO: 1095036 - RNA, 21 nt, Human
cuggaaauguccuacugcuga

SEQ ID NO: 1095037 - RNA, 24 nt, Human
cuuaggacccuaaagccaccugga

SEQ ID NO: 1095038 - RNA, 26 nt, Human
cuuucuccaccccauucccuauccgu

SEQ ID NO: 1095039 - RNA, 22 nt, Human
gaauccaccuaacuggagcugg

SEQ ID NO: 1095040 - RNA, 20 nt, Human
gacagucagcaguccuccuu

SEQ ID NO: 1095041 - RNA, 19 nt, Human
gaccuucccuaccccagga

SEQ ID NO: 1095042 - RNA, 21 nt, Human
gagcagucugcucucugcagc

SEQ ID NO: 1095043 - RNA, 21 nt, Human
gauagucagacauuuggagcc

SEQ ID NO: 1095044 - RNA, 21 nt, Human
gcaaaccgcaacaccucuccu

SEQ ID NO: 1095045 - RNA, 18 nt, Human
gcacugaagccuuauccc

SEQ ID NO: 1095046 - RNA, 20 nt, Human
gcacugugcauggucugcag

SEQ ID NO: 1095047 - RNA, 23 nt, Human
gccacacacacugcaggcaagaa

SEQ ID NO: 1095048 - RNA, 23 nt, Human
gccagugucauccuaggcacaga

SEQ ID NO: 1095049 - RNA, 21 nt, Human
gcucucugcagcuggaucaua

SEQ ID NO: 1095050 - RNA, 19 nt, Human
ggcaagaacccaauuugag

SEQ ID NO: 1095051 - RNA, 20 nt, Human
ggcagcagggcaaaccgcaa

SEQ ID NO: 1095052 - RNA, 18 nt, Human
ggcccuaaugugguuccc

SEQ ID NO: 1095053 - RNA, 21 nt, Human
gggagcaccugacuaguucua

SEQ ID NO: 1095054 - RNA, 24 nt, Human
gggcauuugcaguggaauggcuuu

SEQ ID NO: 1095055 - RNA, 19 nt, Human
ggggauaguagauggggga

SEQ ID NO: 1095056 - RNA, 20 nt, Human
ggguaagaaaugguauuggg

SEQ ID NO: 1095057 - RNA, 24 nt, Human
gucaacugcucauucuuaaaaagu

SEQ ID NO: 1095058 - RNA, 19 nt, Human
gucaagugagggaucaacc

SEQ ID NO: 1095059 - RNA, 21 nt, Human
guccaaagauggauccuagag

SEQ ID NO: 1095060 - RNA, 27 nt, Human
uaaaaaguuggcaacuucccacuaaaa

SEQ ID NO: 1095061 - RNA, 22 nt, Human
uaaaaauaaaacuaaaccccac

SEQ ID NO: 1095062 - RNA, 21 nt, Human
uaaaacaggauacaagauacc

SEQ ID NO: 1095063 - RNA, 24 nt, Human
uaaaacaggauacaagauaccaca

SEQ ID NO: 1095064 - RNA, 23 nt, Human
uaaccacucacagcucacaacua

SEQ ID NO: 1095065 - RNA, 20 nt, Human
uaaugugggagaccuucccu

SEQ ID NO: 1095066 - RNA, 18 nt, Human
uagaaaccugcuuguuuc

SEQ ID NO: 1095067 - RNA, 22 nt, Human
uaggacccuaaagccaccugga

SEQ ID NO: 1095068 - RNA, 22 nt, Human
ucaacccugccuucagcaauac

SEQ ID NO: 1095069 - RNA, 24 nt, Human
ucagcaguccuccuuucuauuccu

SEQ ID NO: 1095070 - RNA, 22 nt, Human
ucagucccucccccaacacaau

SEQ ID NO: 1095071 - RNA, 23 nt, Human
ucauaccaucccuaucgaacaug

SEQ ID NO: 1095072 - RNA, 19 nt, Human
ucccagcaaagggcaaaca

SEQ ID NO: 1095073 - RNA, 20 nt, Human
ucccauccuuucuccacccc

SEQ ID NO: 1095074 - RNA, 26 nt, Human
uccccagugccauccuucuccacucc

SEQ ID NO: 1095075 - RNA, 20 nt, Human
ucccuaaaacuuagucucug

SEQ ID NO: 1095076 - RNA, 24 nt, Human
uccuaggcacagaccaggcuucug

SEQ ID NO: 1095077 - RNA, 21 nt, Human
uccugcuggggaggcagcagg

SEQ ID NO: 1095078 - RNA, 20 nt, Human
ucuauuccuaagagcuggaa

SEQ ID NO: 1095079 - RNA, 23 nt, Human
ucuccagcgugaucacucaacuc

SEQ ID NO: 1095080 - RNA, 19 nt, Human
ucucugaagaaccucaguc

SEQ ID NO: 1095081 - RNA, 18 nt, Human
ucucugcagcuggaucau

SEQ ID NO: 1095082 - RNA, 19 nt, Human
ucuggggccagugucaucc

SEQ ID NO: 1095083 - RNA, 21 nt, Human
ugaaagagcaacugacagcca

SEQ ID NO: 1095084 - RNA, 23 nt, Human
ugaaagagcaacugacagcugca

SEQ ID NO: 1095085 - RNA, 18 nt, Human
ugaaccggacgccuacac

SEQ ID NO: 1095086 - RNA, 20 nt, Human
ugacaacauucccauccuuu

SEQ ID NO: 1095087 - RNA, 24 nt, Human
ugacaacauucccauccuuucucc

SEQ ID NO: 1095088 - RNA, 18 nt, Human
ugacagcugcaaagaccc

SEQ ID NO: 1095089 - RNA, 23 nt, Human
ugaguacagucagucccuccccc

SEQ ID NO: 1095090 - RNA, 18 nt, Human
ugcagcuggaucauauac

SEQ ID NO: 1095091 - RNA, 19 nt, Human
ugcuuuguuaaagaucagg

SEQ ID NO: 1095092 - RNA, 23 nt, Human
ugggaucacaaaacuuugaguuc

SEQ ID NO: 1095093 - RNA, 18 nt, Human
uggguggagggagcaccu

SEQ ID NO: 1095094 - RNA, 21 nt, Human
uggguuccccuauucccaaau

SEQ ID NO: 1095095 - RNA, 26 nt, Human
ugguauuggguggagggagcaccuga

SEQ ID NO: 1095096 - RNA, 20 nt, Human
uggucugcagcuaaggagag

SEQ ID NO: 1095097 - RNA, 20 nt, Human
uguacacuuuugcccaucug

SEQ ID NO: 1095098 - RNA, 18 nt, Human
ugugggagaccuucccua

SEQ ID NO: 1095099 - RNA, 19 nt, Human
uucccauccuuucuccacc

SEQ ID NO: 1095100 - RNA, 22 nt, Human
uugcugcagguuuaaaccacac

SEQ ID NO: 1095101 - RNA, 24 nt, Human
uuucucugaagaaccucagucccc

SEQ ID NO: 1095102 - RNA, 24 nt, Human
uuuuuauacagcgccagacaguca

SEQ ID NO: 1095103 - RNA, 23 nt, Human
aaagggacacgcgccaauccagc

SEQ ID NO: 1095104 - RNA, 21 nt, Human
aaauauucccucucuucuccc

SEQ ID NO: 1095105 - RNA, 18 nt, Human
aagaaagaaaaagaaaag

SEQ ID NO: 1095106 - RNA, 20 nt, Human
acaaaaacaaacacauacaa

SEQ ID NO: 1095107 - RNA, 25 nt, Human
acaaaaacaaacacauacaaaaagg

SEQ ID NO: 1095108 - RNA, 28 nt, Human
acacaugcauacauccuacauaugugug

SEQ ID NO: 1095109 - RNA, 25 nt, Human
acagcaacgcagacaacguaaguac

SEQ ID NO: 1095110 - RNA, 26 nt, Human
acauacccauaccuguagcacaaaaa

SEQ ID NO: 1095111 - RNA, 24 nt, Human
acccuuuugcagauuuuuuaaaaa

SEQ ID NO: 1095112 - RNA, 23 nt, Human
agaauaugcccaaaagaugccag

SEQ ID NO: 1095113 - RNA, 18 nt, Human
agaaucccggccucugcu

SEQ ID NO: 1095114 - RNA, 21 nt, Human
agccaacagcuuguccccccc

SEQ ID NO: 1095115 - RNA, 25 nt, Human
aggacaaaaacaaacacauacaaaa

SEQ ID NO: 1095116 - RNA, 21 nt, Human
agggagcuuuaaaagccccca

SEQ ID NO: 1095117 - RNA, 18 nt, Human
agugcaggaacauuucug

SEQ ID NO: 1095118 - RNA, 21 nt, Human
auacaccuauauacauaccca

SEQ ID NO: 1095119 - RNA, 20 nt, Human
auaguuggagcagccuaggc

SEQ ID NO: 1095120 - RNA, 19 nt, Human
augcaaaagggacacgcgc

SEQ ID NO: 1095121 - RNA, 20 nt, Human
auuuguuguuuguuuuccuu

SEQ ID NO: 1095122 - RNA, 22 nt, Human
caaaagaaacaaauauaaucca

SEQ ID NO: 1095123 - RNA, 22 nt, Human
caaaagaaacaaauauaaucca

SEQ ID NO: 1095124 - RNA, 19 nt, Human
caaaccccaaguagccgag

SEQ ID NO: 1095125 - RNA, 23 nt, Human
caacaucccucuucaaaaagaaa

SEQ ID NO: 1095126 - RNA, 23 nt, Human
caagccaacagcuuguccccccc

SEQ ID NO: 1095127 - RNA, 23 nt, Human
caccaaaagaaaaauuagcccca

SEQ ID NO: 1095128 - RNA, 23 nt, Human
caccaagucccccccuccccaag

SEQ ID NO: 1095129 - RNA, 21 nt, Human
caccaguaguggcuaaccagc

SEQ ID NO: 1095130 - RNA, 25 nt, Human
caccaguguuuccucaguagccccu

SEQ ID NO: 1095131 - RNA, 22 nt, Human
caccuuucaggauccacagcaa

SEQ ID NO: 1095132 - RNA, 24 nt, Human
cacuguauucuuucucuccccacc

SEQ ID NO: 1095133 - RNA, 21 nt, Human
cagcugcuguuuuaccaggaa

SEQ ID NO: 1095134 - RNA, 25 nt, Human
cauacacauacaugcacauacacau

SEQ ID NO: 1095135 - RNA, 23 nt, Human
cauuaccccccaaaagaaacaaa

SEQ ID NO: 1095136 - RNA, 20 nt, Human
cauucaucucccuggugaua

SEQ ID NO: 1095137 - RNA, 22 nt, Human
ccaaaagaaaaauuagccccac

SEQ ID NO: 1095138 - RNA, 19 nt, Human
ccaaaccccaaguagccga

SEQ ID NO: 1095139 - RNA, 23 nt, Human
ccaacagcuugucccccccacca

SEQ ID NO: 1095140 - RNA, 19 nt, Human
ccaaguacucacauauucc

SEQ ID NO: 1095141 - RNA, 23 nt, Human
ccaccaaaagaaaaauuagcccc

SEQ ID NO: 1095142 - RNA, 18 nt, Human
ccagccguucccugaaac

SEQ ID NO: 1095143 - RNA, 22 nt, Human
ccauugaaucacuuuauuuuuu

SEQ ID NO: 1095144 - RNA, 23 nt, Human
cccaaaagaaacaaauauaaucc

SEQ ID NO: 1095145 - RNA, 22 nt, Human
ccccaaaccccaaguagccgag

SEQ ID NO: 1095146 - RNA, 24 nt, Human
ccccaaaccccaaguagccgaguc

SEQ ID NO: 1095147 - RNA, 24 nt, Human
ccccaaagagcuacuaguuucagc

SEQ ID NO: 1095148 - RNA, 18 nt, Human
ccccacacaagcgccuuc

SEQ ID NO: 1095149 - RNA, 23 nt, Human
ccccaccaaaagaaaaauuagcc

SEQ ID NO: 1095150 - RNA, 19 nt, Human
ccccaccaagucccccccu

SEQ ID NO: 1095151 - RNA, 19 nt, Human
ccccaccaagucccccccu

SEQ ID NO: 1095152 - RNA, 24 nt, Human
ccccaccaagucccccccucccca

SEQ ID NO: 1095153 - RNA, 25 nt, Human
ccccaccaagucccccccuccccaa

SEQ ID NO: 1095154 - RNA, 27 nt, Human
cccccaaaagaaacaaauauaauccac

SEQ ID NO: 1095155 - RNA, 25 nt, Human
ccccccaaaagaaacaaauauaauc

SEQ ID NO: 1095156 - RNA, 22 nt, Human
ccccccuccccaaguacucaca

SEQ ID NO: 1095157 - RNA, 21 nt, Human
cccuccuccuccuucacuccc

SEQ ID NO: 1095158 - RNA, 18 nt, Human
ccucucucucccuccuuu

SEQ ID NO: 1095159 - RNA, 18 nt, Human
ccucugugguguggaaga

SEQ ID NO: 1095160 - RNA, 24 nt, Human
cggcagaaucaaguuuaaaggaaa

SEQ ID NO: 1095161 - RNA, 32 nt, Human
cucacacaugcauacauccuacauauguggug

SEQ ID NO: 1095162 - RNA, 21 nt, Human
cuccucucucucccuccuuuu

SEQ ID NO: 1095163 - RNA, 19 nt, Human
cucucucccuccuuuuucu

SEQ ID NO: 1095164 - RNA, 20 nt, Human
cuguguggcaucccuccucc

SEQ ID NO: 1095165 - RNA, 21 nt, Human
cuguguggcaucccuccuccu

SEQ ID NO: 1095166 - RNA, 19 nt, Human
cuugucuucguuuucuuug

SEQ ID NO: 1095167 - RNA, 25 nt, Human
gaaaggacaaaaacaaacacauaca

SEQ ID NO: 1095168 - RNA, 20 nt, Human
gacuaggcugaauggugggg

SEQ ID NO: 1095169 - RNA, 28 nt, Human
gauguaugcauacacauacaugcacaua

SEQ ID NO: 1095170 - RNA, 23 nt, Human
gcaccagagcgauuaacggaaaa

SEQ ID NO: 1095171 - RNA, 18 nt, Human
gcaggagagguccccccc

SEQ ID NO: 1095172 - RNA, 26 nt, Human
gccccacacaagcgccuucugcugca

SEQ ID NO: 1095173 - RNA, 19 nt, Human
gccucuuuccccuucuucu

SEQ ID NO: 1095174 - RNA, 21 nt, Human
gcgcccggugccaacagaaca

SEQ ID NO: 1095175 - RNA, 19 nt, Human
gcuucucccacugcaggag

SEQ ID NO: 1095176 - RNA, 20 nt, Human
gcuugucccccccaccaaaa

SEQ ID NO: 1095177 - RNA, 19 nt, Human
ggaaaagaucagagcuaca

SEQ ID NO: 1095178 - RNA, 22 nt, Human
ggugguuuucaguuuuuucugu

SEQ ID NO: 1095179 - RNA, 18 nt, Human
gucuguguggcaucccuc

SEQ ID NO: 1095180 - RNA, 24 nt, Human
guucauuaccccccaaaagaaaca

SEQ ID NO: 1095181 - RNA, 18 nt, Human
guuuguuguugacuaggc

SEQ ID NO: 1095182 - RNA, 23 nt, Human
uaaaaggaagaauaugcccaaaa

SEQ ID NO: 1095183 - RNA, 22 nt, Human
uaaccaccaccuuucuguccug

SEQ ID NO: 1095184 - RNA, 18 nt, Human
uaagaaagaaaaagaaaa

SEQ ID NO: 1095185 - RNA, 18 nt, Human
uacacauauuuccuucuc

SEQ ID NO: 1095186 - RNA, 23 nt, Human
uacauacccauaccuguagcaca

SEQ ID NO: 1095187 - RNA, 23 nt, Human
uaccagccguucccugaaacccu

SEQ ID NO: 1095188 - RNA, 19 nt, Human
uaccccccaaaagaaacaa

SEQ ID NO: 1095189 - RNA, 18 nt, Human
uagcaaaaguagaagaca

SEQ ID NO: 1095190 - RNA, 24 nt, Human
uagcagugaauguagauaaaucuc

SEQ ID NO: 1095191 - RNA, 26 nt, Human
uauacacauacaaccuuacacaugug

SEQ ID NO: 1095192 - RNA, 22 nt, Human
uauauacauacccauaccugua

SEQ ID NO: 1095193 - RNA, 23 nt, Human
uauccuccuuucucugccuucuu

SEQ ID NO: 1095194 - RNA, 18 nt, Human
uauguguguauaugcaua

SEQ ID NO: 1095195 - RNA, 22 nt, Human
uauuuguuguuuguuuuccuug

SEQ ID NO: 1095196 - RNA, 22 nt, Human
ucaaaaagaaaggacaaaaaca

SEQ ID NO: 1095197 - RNA, 24 nt, Human
ucacauauucccuaaccaccaccu

SEQ ID NO: 1095198 - RNA, 22 nt, Human
ucagagcuacaaaauaauugac

SEQ ID NO: 1095199 - RNA, 25 nt, Human
ucaguagccccuuccaaaucgcucu

SEQ ID NO: 1095200 - RNA, 22 nt, Human
ucauuagccaaacgauuauucc

SEQ ID NO: 1095201 - RNA, 21 nt, Human
uccacaagagcagcaauuaau

SEQ ID NO: 1095202 - RNA, 19 nt, Human
uccagcgccugccccuggc

SEQ ID NO: 1095203 - RNA, 23 nt, Human
ucccaggguccgaggaagggcuc

SEQ ID NO: 1095204 - RNA, 19 nt, Human
ucccauugaaucacuuuau

SEQ ID NO: 1095205 - RNA, 21 nt, Human
uccccaccaagucccccccuc

SEQ ID NO: 1095206 - RNA, 18 nt, Human
uccccuucuucuccccug

SEQ ID NO: 1095207 - RNA, 22 nt, Human
ucccuccuccuccuucacuccc

SEQ ID NO: 1095208 - RNA, 18 nt, Human
ucccugaaacccuuuugc

SEQ ID NO: 1095209 - RNA, 20 nt, Human
uccgcugugcuggcuccacu

SEQ ID NO: 1095210 - RNA, 25 nt, Human
uccuccuuucucugccuucuucgca

SEQ ID NO: 1095211 - RNA, 24 nt, Human
uccugagucccguaaccucgggag

SEQ ID NO: 1095212 - RNA, 22 nt, Human
ucgcaccagagcgauuaacgga

SEQ ID NO: 1095213 - RNA, 20 nt, Human
ucucccagcagaggcugugg

SEQ ID NO: 1095214 - RNA, 22 nt, Human
ucucccuccuuuuucucacaca

SEQ ID NO: 1095215 - RNA, 21 nt, Human
ucuccucucucucccuccuuu

SEQ ID NO: 1095216 - RNA, 21 nt, Human
ucucucucccuccuuuuucuc

SEQ ID NO: 1095217 - RNA, 23 nt, Human
ucucuggcugccugcuugcugcu

SEQ ID NO: 1095218 - RNA, 23 nt, Human
ucugcuacugcauuccccaaaga

SEQ ID NO: 1095219 - RNA, 22 nt, Human
ucugcugcaacagaugcccaga

SEQ ID NO: 1095220 - RNA, 21 nt, Human
ucuguccugucgggugcaggg

SEQ ID NO: 1095221 - RNA, 21 nt, Human
ucugugguguggaagaccccc

SEQ ID NO: 1095222 - RNA, 21 nt, Human
ucuguuuguugcuguauuugu

SEQ ID NO: 1095223 - RNA, 24 nt, Human
ucuucguuuucuuuguuucuaauu

SEQ ID NO: 1095224 - RNA, 21 nt, Human
ucuuuaguucauuacccccca

SEQ ID NO: 1095225 - RNA, 27 nt, Human
ugaaauagcaaacaagccaacagcuug

SEQ ID NO: 1095226 - RNA, 22 nt, Human
ugaaauagcccauugagggagc

SEQ ID NO: 1095227 - RNA, 22 nt, Human
ugaauggugggguuuuuuuuaa

SEQ ID NO: 1095228 - RNA, 28 nt, Human
ugauagcagugaauguagauaaaucucc

SEQ ID NO: 1095229 - RNA, 21 nt, Human
ugcaacagaugcccagaucac

SEQ ID NO: 1095230 - RNA, 22 nt, Human
ugcaacagaugcccagaucacc

SEQ ID NO: 1095231 - RNA, 19 nt, Human
ugcaggaacauuucugcug

SEQ ID NO: 1095232 - RNA, 18 nt, Human
ugcccaaaagaugccagc

SEQ ID NO: 1095233 - RNA, 20 nt, Human
ugccugcuugcugcuggagu

SEQ ID NO: 1095234 - RNA, 19 nt, Human
ugccuucaaguuugugcau

SEQ ID NO: 1095235 - RNA, 18 nt, Human
ugcugcuggaguaugauu

SEQ ID NO: 1095236 - RNA, 19 nt, Human
uggaagacccccaaacccc

SEQ ID NO: 1095237 - RNA, 23 nt, Human
uggcugccugcuugcugcuggag

SEQ ID NO: 1095238 - RNA, 24 nt, Human
uggcugccugcuugcugcuggagu

SEQ ID NO: 1095239 - RNA, 28 nt, Human
uguaugcauacacauacaugcacauaca

SEQ ID NO: 1095240 - RNA, 21 nt, Human
ugucugcuuuuucuuuguuug

SEQ ID NO: 1095241 - RNA, 23 nt, Human
ugucugcuuuuucuuuguuuguu

SEQ ID NO: 1095242 - RNA, 20 nt, Human
uguguauaugcauaaacaua

SEQ ID NO: 1095243 - RNA, 20 nt, Human
uguguauaugcauaaacaua

SEQ ID NO: 1095244 - RNA, 24 nt, Human
uguguauaugcauaaacauauaca

SEQ ID NO: 1095245 - RNA, 18 nt, Human
uguguguauaugcauaaa

SEQ ID NO: 1095246 - RNA, 19 nt, Human
uguguguauaugcauaaac

SEQ ID NO: 1095247 - RNA, 24 nt, Human
uguguguauaugcauaaacauaua

SEQ ID NO: 1095248 - RNA, 23 nt, Human
uguuuccucaguagccccuucca

SEQ ID NO: 1095249 - RNA, 23 nt, Human
uuaaaaacaaccaccuaaaacau

SEQ ID NO: 1095250 - RNA, 23 nt, Human
uuaauauguugugcauguauaag

SEQ ID NO: 1095251 - RNA, 18 nt, Human
uuaaugaagggauaaauu

SEQ ID NO: 1095252 - RNA, 24 nt, Human
uuaaugaagggauaaauuaccgau

SEQ ID NO: 1095253 - RNA, 21 nt, Human
uuagccaaacgauuauuccuc

SEQ ID NO: 1095254 - RNA, 25 nt, Human
uucaaaaguaacaacaucccucuuc

SEQ ID NO: 1095255 - RNA, 18 nt, Human
uuccagcgccugccccug

SEQ ID NO: 1095256 - RNA, 22 nt, Human
uuccgaugucugcuuuuucuuu

SEQ ID NO: 1095257 - RNA, 21 nt, Human
uuccucaguagccccuuccaa

SEQ ID NO: 1095258 - RNA, 21 nt, Human
uucuucauucucuuuaguuca

SEQ ID NO: 1095259 - RNA, 23 nt, Human
uugaaauagcaaacaagccaaca

SEQ ID NO: 1095260 - RNA, 21 nt, Human
uugaagagucaccaguagugg

SEQ ID NO: 1095261 - RNA, 19 nt, Human
uugcgccuucgguugcugc

SEQ ID NO: 1095262 - RNA, 24 nt, Human
uugcugcuugcuguucgcuccugg

SEQ ID NO: 1095263 - RNA, 21 nt, Human
uugucucucccuuuuguuucc

SEQ ID NO: 1095264 - RNA, 21 nt, Human
uuguuguuuguuuuccuuguu

SEQ ID NO: 1095265 - RNA, 22 nt, Human
uuuagcaaaaguagaagacaga

SEQ ID NO: 1095266 - RNA, 23 nt, Human
uuuccucaguagccccuuccaaa

SEQ ID NO: 1095267 - RNA, 24 nt, Human
uuucuugucuucguuuucuuuguu

SEQ ID NO: 1095268 - RNA, 19 nt, Human
uuuguaaaauccacaagag

SEQ ID NO: 1095269 - RNA, 22 nt, Human
accccuucuuggggguagcuca

SEQ ID NO: 1095270 - RNA, 24 nt, Human
agcucaucauccaaggagaaacaa

SEQ ID NO: 1095271 - RNA, 21 nt, Human
cauccaaggagaaacaaacag

SEQ ID NO: 1095272 - RNA, 21 nt, Human
cucaucauccaaggagaaaca

SEQ ID NO: 1095273 - RNA, 24 nt, Human
uccaaggagaaacaaacaguuaca

SEQ ID NO: 1095274 - RNA, 20 nt, Human
uugaauggaaguucugugcc

SEQ ID NO: 1095275 - RNA, 23 nt, Human
aaagagauauuugagucacugac

SEQ ID NO: 1095276 - RNA, 19 nt, Human
aaaggccacacagccagug

SEQ ID NO: 1095277 - RNA, 24 nt, Human
aaagugcugggauuacagguguga

SEQ ID NO: 1095278 - RNA, 20 nt, Human
aaccucugucucccaggcuc

SEQ ID NO: 1095279 - RNA, 20 nt, Human
aagauaacaccccguuccca

SEQ ID NO: 1095280 - RNA, 19 nt, Human
aagcuaggaauccaggucc

SEQ ID NO: 1095281 - RNA, 22 nt, Human
aagggacuccugcccuuaacca

SEQ ID NO: 1095282 - RNA, 25 nt, Human
aagugauuaaccagccucagccucc

SEQ ID NO: 1095283 - RNA, 18 nt, Human
aagugcugggauuacagg

SEQ ID NO: 1095284 - RNA, 19 nt, Human
aagugcugggauuacaggu

SEQ ID NO: 1095285 - RNA, 26 nt, Human
aagugcugggauuacaggugugagcc

SEQ ID NO: 1095286 - RNA, 24 nt, Human
acagugcugggaucacagguguga

SEQ ID NO: 1095287 - RNA, 21 nt, Human
acugcaaccucugucucccag

SEQ ID NO: 1095288 - RNA, 22 nt, Human
acugcaaccucugucucccagg

SEQ ID NO: 1095289 - RNA, 23 nt, Human
agagauauuugagucacugacca

SEQ ID NO: 1095290 - RNA, 21 nt, Human
agccuccugaguagcugggac

SEQ ID NO: 1095291 - RNA, 24 nt, Human
agcuggucucaaacuccugaccuc

SEQ ID NO: 1095292 - RNA, 22 nt, Human
aggcucaagugauccucuugcc

SEQ ID NO: 1095293 - RNA, 23 nt, Human
aggcucaagugauccucuugccu

SEQ ID NO: 1095294 - RNA, 18 nt, Human
aguagaaaugaggucuug

SEQ ID NO: 1095295 - RNA, 19 nt, Human
aguagcugggacuacaggc

SEQ ID NO: 1095296 - RNA, 23 nt, Human
aguagcugggacuacaggcaugu

SEQ ID NO: 1095297 - RNA, 21 nt, Human
aguccguaagggacuccugcc

SEQ ID NO: 1095298 - RNA, 25 nt, Human
agugauccucuugccuuagccuccu

SEQ ID NO: 1095299 - RNA, 22 nt, Human
agugcugggaucacagguguga

SEQ ID NO: 1095300 - RNA, 21 nt, Human
auccuccugccucagccuccc

SEQ ID NO: 1095301 - RNA, 19 nt, Human
aucuugccucuuccucucc

SEQ ID NO: 1095302 - RNA, 18 nt, Human
augggguuucacuauauu

SEQ ID NO: 1095303 - RNA, 22 nt, Human
augucugcaacuuacuuugaaa

SEQ ID NO: 1095304 - RNA, 24 nt, Human
caaagugcugggauuacaggugug

SEQ ID NO: 1095305 - RNA, 23 nt, Human
caaccucugucucccaggcucaa

SEQ ID NO: 1095306 - RNA, 20 nt, Human
caagugauccucuugccuua

SEQ ID NO: 1095307 - RNA, 22 nt, Human
caagugauccucuugccuuagc

SEQ ID NO: 1095308 - RNA, 23 nt, Human
cacaggugugagccaccgugccc

SEQ ID NO: 1095309 - RNA, 24 nt, Human
cacagugcugggaucacaggugug

SEQ ID NO: 1095310 - RNA, 24 nt, Human
caccacgccuggcuaauuuuuugg

SEQ ID NO: 1095311 - RNA, 21 nt, Human
caccccucgccuuuccucucu

SEQ ID NO: 1095312 - RNA, 23 nt, Human
cacuauauugcccagcuggucuc

SEQ ID NO: 1095313 - RNA, 26 nt, Human
cagaucuugccucuuccucuccaggg

SEQ ID NO: 1095314 - RNA, 25 nt, Human
cagccucagccucccacagugcugg

SEQ ID NO: 1095315 - RNA, 24 nt, Human
caggugugagccaccgugcccggc

SEQ ID NO: 1095316 - RNA, 24 nt, Human
cagugcugggaucacaggugugag

SEQ ID NO: 1095317 - RNA, 21 nt, Human
ccaaagugcugggauuacagg

SEQ ID NO: 1095318 - RNA, 21 nt, Human
ccaaagugcugggauuacagg

SEQ ID NO: 1095319 - RNA, 24 nt, Human
ccaaagugcugggauuacaggugu

SEQ ID NO: 1095320 - RNA, 24 nt, Human
ccacagugcugggaucacaggugu

SEQ ID NO: 1095321 - RNA, 20 nt, Human
ccaccacgccuggcuaauuu

SEQ ID NO: 1095322 - RNA, 22 nt, Human
cccaggcucaagugauccucuu

SEQ ID NO: 1095323 - RNA, 23 nt, Human
cccaggcuggagugcaauggagc

SEQ ID NO: 1095324 - RNA, 24 nt, Human
cccaguuuuuguaucuguuuuugu

SEQ ID NO: 1095325 - RNA, 24 nt, Human
ccccguucccaguuuuuguaucug

SEQ ID NO: 1095326 - RNA, 19 nt, Human
ccccucgccuuuccucucu

SEQ ID NO: 1095327 - RNA, 24 nt, Human
ccucuugccuuagccuccugagua

SEQ ID NO: 1095328 - RNA, 23 nt, Human
ccugaguagcugggacuacaggc

SEQ ID NO: 1095329 - RNA, 24 nt, Human
ccugaguagcugggacuacaggca

SEQ ID NO: 1095330 - RNA, 20 nt, Human
cucaagugauccucuugccu

SEQ ID NO: 1095331 - RNA, 23 nt, Human
cucaagugauuaaccagccucag

SEQ ID NO: 1095332 - RNA, 25 nt, Human
cucccaggcucaagugauccucuug

SEQ ID NO: 1095333 - RNA, 23 nt, Human
cugcaaccucugucucccaggcu

SEQ ID NO: 1095334 - RNA, 24 nt, Human
cugcaaccucugucucccaggcuc

SEQ ID NO: 1095335 - RNA, 23 nt, Human
cugccucagccucccaaagugcu

SEQ ID NO: 1095336 - RNA, 24 nt, Human
cugccucagccucccaaagugcug

SEQ ID NO: 1095337 - RNA, 21 nt, Human
cuuaaguuucuugcauaaaac

SEQ ID NO: 1095338 - RNA, 24 nt, Human
cuuagccuccugaguagcugggac

SEQ ID NO: 1095339 - RNA, 23 nt, Human
cuugccuuagccuccugaguagc

SEQ ID NO: 1095340 - RNA, 24 nt, Human
cuugccuuagccuccugaguagcu

SEQ ID NO: 1095341 - RNA, 21 nt, Human
cuuggaacccaaggauucaaa

SEQ ID NO: 1095342 - RNA, 18 nt, Human
gaagguggagaugcuggc

SEQ ID NO: 1095343 - RNA, 21 nt, Human
gaauggauagagggauggaua

SEQ ID NO: 1095344 - RNA, 23 nt, Human
gaauggauagagggauggauagg

SEQ ID NO: 1095345 - RNA, 22 nt, Human
gagaugggguuucacuauauug

SEQ ID NO: 1095346 - RNA, 25 nt, Human
gaguagcugggacuacaggcaugug

SEQ ID NO: 1095347 - RNA, 18 nt, Human
gaucacaggugugagcca

SEQ ID NO: 1095348 - RNA, 20 nt, Human
gaucacaggugugagccacc

SEQ ID NO: 1095349 - RNA, 21 nt, Human
gaugcuaaaggccacacagcc

SEQ ID NO: 1095350 - RNA, 18 nt, Human
gauuacaggugugagcca

SEQ ID NO: 1095351 - RNA, 21 nt, Human
gauuacaggugugagccacug

SEQ ID NO: 1095352 - RNA, 24 nt, Human
gauuacaggugugagccacuguac

SEQ ID NO: 1095353 - RNA, 19 nt, Human
gcaauccuccugccucagc

SEQ ID NO: 1095354 - RNA, 19 nt, Human
gcccaggcuggagugcaau

SEQ ID NO: 1095355 - RNA, 21 nt, Human
gcuggagugcaauggagccag

SEQ ID NO: 1095356 - RNA, 19 nt, Human
ggacuacaggcaugugcca

SEQ ID NO: 1095357 - RNA, 19 nt, Human
ggcuggagugcaauggagc

SEQ ID NO: 1095358 - RNA, 21 nt, Human
gggaagguggagaugcuggcg

SEQ ID NO: 1095359 - RNA, 22 nt, Human
gggguuucacuauauugcccag

SEQ ID NO: 1095360 - RNA, 21 nt, Human
ggugaaguaaagauaacaccc

SEQ ID NO: 1095361 - RNA, 18 nt, Human
guagagaugggguuucac

SEQ ID NO: 1095362 - RNA, 18 nt, Human
guagagaugggguuucac

SEQ ID NO: 1095363 - RNA, 23 nt, Human
gucccaccuaccucuuuuguuca

SEQ ID NO: 1095364 - RNA, 24 nt, Human
gugauuaaccagccucagccuccc

SEQ ID NO: 1095365 - RNA, 23 nt, Human
uaaaacaaauagagaaaaauguu

SEQ ID NO: 1095366 - RNA, 23 nt, Human
uaaaauggauaaaugaauggaua

SEQ ID NO: 1095367 - RNA, 22 nt, Human
uaaccaagauggaaccuuccug

SEQ ID NO: 1095368 - RNA, 19 nt, Human
uaaguuucuugcauaaaac

SEQ ID NO: 1095369 - RNA, 22 nt, Human
uacaggcaugugccaccacgcc

SEQ ID NO: 1095370 - RNA, 19 nt, Human
uacaggugugagccacugu

SEQ ID NO: 1095371 - RNA, 24 nt, Human
uacaggugugagccacuguaccca

SEQ ID NO: 1095372 - RNA, 23 nt, Human
uacugcaaccucugucucccagg

SEQ ID NO: 1095373 - RNA, 19 nt, Human
uagcagaucuugccucuuc

SEQ ID NO: 1095374 - RNA, 18 nt, Human
uagcccaggcuggagugc

SEQ ID NO: 1095375 - RNA, 20 nt, Human
uagccuccugaguagcuggg

SEQ ID NO: 1095376 - RNA, 22 nt, Human
uaggcagauugacauguguaaa

SEQ ID NO: 1095377 - RNA, 23 nt, Human
uauauugcccagcuggucucaaa

SEQ ID NO: 1095378 - RNA, 19 nt, Human
ucaaaaguuuccucuucaa

SEQ ID NO: 1095379 - RNA, 23 nt, Human
ucaaacucccaaucucaugcaau

SEQ ID NO: 1095380 - RNA, 26 nt, Human
ucagcuuacugcaaccucugucuccc

SEQ ID NO: 1095381 - RNA, 25 nt, Human
uccagggaaacgcugaccaguuugu

SEQ ID NO: 1095382 - RNA, 23 nt, Human
ucccaaagugcugggauuacagg

SEQ ID NO: 1095383 - RNA, 23 nt, Human
ucccacagugcugggaucacagg

SEQ ID NO: 1095384 - RNA, 21 nt, Human
ucccaggcucaagugauccuc

SEQ ID NO: 1095385 - RNA, 24 nt, Human
ucccaggcucaagugauccucuug

SEQ ID NO: 1095386 - RNA, 25 nt, Human
uccggggaagguggagaugcuggcc

SEQ ID NO: 1095387 - RNA, 27 nt, Human
uccuccugccucagccucccaaagugc

SEQ ID NO: 1095388 - RNA, 24 nt, Human
uccugaguagcugggacuacaggc

SEQ ID NO: 1095389 - RNA, 23 nt, Human
uccugcuuuguagcccaggcugg

SEQ ID NO: 1095390 - RNA, 24 nt, Human
uccugcuuuguagcccaggcugga

SEQ ID NO: 1095391 - RNA, 24 nt, Human
ucuaggugaugcuaaaggccacac

SEQ ID NO: 1095392 - RNA, 25 nt, Human
ucugcaacuuacuuugaaauacauu

SEQ ID NO: 1095393 - RNA, 19 nt, Human
ucuugccucuuccucucca

SEQ ID NO: 1095394 - RNA, 19 nt, Human
ucuuuuguucauuccuuca

SEQ ID NO: 1095395 - RNA, 21 nt, Human
ugaggucuugcuguuuuccag

SEQ ID NO: 1095396 - RNA, 23 nt, Human
ugaggucuugcuguuuuccaggc

SEQ ID NO: 1095397 - RNA, 24 nt, Human
ugccucagccucccaaagugcugg

SEQ ID NO: 1095398 - RNA, 20 nt, Human
ugccuuagccuccugaguaa

SEQ ID NO: 1095399 - RNA, 24 nt, Human
ugccuuagccuccugaguagcugg

SEQ ID NO: 1095400 - RNA, 24 nt, Human
ugcugggaucacaggugugagcca

SEQ ID NO: 1095401 - RNA, 24 nt, Human
ugcugggauuacaggugugagcca

SEQ ID NO: 1095402 - RNA, 23 nt, Human
ugcuuuguagcccaggcuggagu

SEQ ID NO: 1095403 - RNA, 24 nt, Human
ugcuuuguagcccaggcuggagug

SEQ ID NO: 1095404 - RNA, 20 nt, Human
uggagaugcuggcgcuuucc

SEQ ID NO: 1095405 - RNA, 24 nt, Human
uggagccaucucagcuuacugcaa

SEQ ID NO: 1095406 - RNA, 23 nt, Human
uggagugcaauggagccaucuca

SEQ ID NO: 1095407 - RNA, 19 nt, Human
uggcaaagggaggcuuccg

SEQ ID NO: 1095408 - RNA, 21 nt, Human
uggcaaagggaggcuuccggg

SEQ ID NO: 1095409 - RNA, 18 nt, Human
ugggacuacaggcaugug

SEQ ID NO: 1095410 - RNA, 21 nt, Human
ugggacuacaggcaugugcca

SEQ ID NO: 1095411 - RNA, 22 nt, Human
ugggacuacaggcaugugccac

SEQ ID NO: 1095412 - RNA, 24 nt, Human
ugggacuacaggcaugugccacca

SEQ ID NO: 1095413 - RNA, 21 nt, Human
ugggaucacaggugugagcca

SEQ ID NO: 1095414 - RNA, 22 nt, Human
ugggaucacaggugugagccac

SEQ ID NO: 1095415 - RNA, 23 nt, Human
ugggaucacaggugugagccacc

SEQ ID NO: 1095416 - RNA, 23 nt, Human
ugggaucacaggugugagccacc

SEQ ID NO: 1095417 - RNA, 24 nt, Human
ugggaucacaggugugagccaccg

SEQ ID NO: 1095418 - RNA, 18 nt, Human
ugggauuacaggugugag

SEQ ID NO: 1095419 - RNA, 21 nt, Human
ugggauuacaggugugagcca

SEQ ID NO: 1095420 - RNA, 22 nt, Human
ugggauuacaggugugagccac

SEQ ID NO: 1095421 - RNA, 22 nt, Human
ugggauuacaggugugagccac

SEQ ID NO: 1095422 - RNA, 22 nt, Human
ugggauuacaggugugagccac

SEQ ID NO: 1095423 - RNA, 24 nt, Human
ugggauuacaggugugagccacug

SEQ ID NO: 1095424 - RNA, 23 nt, Human
ugggguuucacuauauugcccag

SEQ ID NO: 1095425 - RNA, 23 nt, Human
ugguagagaugggguuucacuau

SEQ ID NO: 1095426 - RNA, 24 nt, Human
ugguagagaugggguuucacuaua

SEQ ID NO: 1095427 - RNA, 24 nt, Human
ugucucccaggcucaagugauccu

SEQ ID NO: 1095428 - RNA, 19 nt, Human
uguggugaaguaaagauaa

SEQ ID NO: 1095429 - RNA, 20 nt, Human
uuaauuaucuuggaacccaa

SEQ ID NO: 1095430 - RNA, 19 nt, Human
uuacugcaaccucugucuc

SEQ ID NO: 1095431 - RNA, 24 nt, Human
uuacugcaaccucugucucccagg

SEQ ID NO: 1095432 - RNA, 19 nt, Human
uuagaagugaaauguaaug

SEQ ID NO: 1095433 - RNA, 22 nt, Human
uucaaagagauauuugagucac

SEQ ID NO: 1095434 - RNA, 18 nt, Human
uuccaggcucgucucaaa

SEQ ID NO: 1095435 - RNA, 20 nt, Human
uucccaguuuuuguaucugu

SEQ ID NO: 1095436 - RNA, 25 nt, Human
uuccuucaaaaguuuccucuucaaa

SEQ ID NO: 1095437 - RNA, 24 nt, Human
uugguagagaugggguuucacuau

SEQ ID NO: 1095438 - RNA, 18 nt, Human
uuguagcccaggcuggag

SEQ ID NO: 1095439 - RNA, 21 nt, Human
uuugagucacugaccaccagu

SEQ ID NO: 1095440 - RNA, 24 nt, Human
uuuguagcccaggcuggagugcaa

SEQ ID NO: 1095441 - RNA, 24 nt, Human
uuuuugguagagaugggguuucac

SEQ ID NO: 1095442 - RNA, 23 nt, Human
uuuuuugguagagaugggguuuc

SEQ ID NO: 1095443 - RNA, 18 nt, Human
aggaaagcccagggcaug

SEQ ID NO: 1095444 - RNA, 25 nt, Human
cacuuuucuuuuuacaaguuggaaa

SEQ ID NO: 1095445 - RNA, 20 nt, Human
cuugagggauccuugaggaa

SEQ ID NO: 1095446 - RNA, 18 nt, Human
gaaacuugagggauccuu

SEQ ID NO: 1095447 - RNA, 21 nt, Human
gagccgccgccuccccgcccu

SEQ ID NO: 1095448 - RNA, 18 nt, Human
gcccaccucagggauccg

SEQ ID NO: 1095449 - RNA, 20 nt, Human
gcccagggcaugaauuucag

SEQ ID NO: 1095450 - RNA, 21 nt, Human
gucaggcucaacuccagccug

SEQ ID NO: 1095451 - RNA, 21 nt, Human
ucaggcucaacuccagccugc

SEQ ID NO: 1095452 - RNA, 23 nt, Human
ucaguggcccaccucagggaucc

SEQ ID NO: 1095453 - RNA, 21 nt, Human
uccuugaggaaagcccagggc

SEQ ID NO: 1095454 - RNA, 24 nt, Human
uccuugaggaaagcccaggggaaa

SEQ ID NO: 1095455 - RNA, 23 nt, Human
ugaggaaagcccagggcaugaau

SEQ ID NO: 1095456 - RNA, 24 nt, Human
ugagggauccuugaggaaagccca

SEQ ID NO: 1095457 - RNA, 21 nt, Human
uuccggaguccccgacucagu

SEQ ID NO: 1095458 - RNA, 24 nt, Human
uuccggaguccccgacucaguggc

SEQ ID NO: 1095459 - RNA, 20 nt, Human
uuuuuuuuuuuuuuuuuguu

SEQ ID NO: 1095460 - RNA, 20 nt, Human
uuuuuuuuuuuuuuuuuugg

SEQ ID NO: 1095461 - RNA, 22 nt, Human
agcagcuguguuggucagcaac

SEQ ID NO: 1095462 - RNA, 19 nt, Human
aggcaggugguggucagga

SEQ ID NO: 1095463 - RNA, 24 nt, Human
aggugacagggcugccggcagggg

SEQ ID NO: 1095464 - RNA, 23 nt, Human
cagagagggauccaagacucacc

SEQ ID NO: 1095465 - RNA, 21 nt, Human
cagcaguuagcaccgccuccu

SEQ ID NO: 1095466 - RNA, 20 nt, Human
cagccaggaacugugagcag

SEQ ID NO: 1095467 - RNA, 20 nt, Human
cagggcugccggcaggggca

SEQ ID NO: 1095468 - RNA, 20 nt, Human
caucagccuggccucccagg

SEQ ID NO: 1095469 - RNA, 20 nt, Human
cccagggccauggggagggu

SEQ ID NO: 1095470 - RNA, 19 nt, Human
ccccagcccuacgcuccau

SEQ ID NO: 1095471 - RNA, 22 nt, Human
ccgcaggcuggcucccaguguc

SEQ ID NO: 1095472 - RNA, 24 nt, Human
ccgcaggcuggcucccagugucac

SEQ ID NO: 1095473 - RNA, 22 nt, Human
ccugcagccaggaacugugagc

SEQ ID NO: 1095474 - RNA, 22 nt, Human
ccugcuguccucaaggauccac

SEQ ID NO: 1095475 - RNA, 21 nt, Human
ccuggcgccugugcagaggca

SEQ ID NO: 1095476 - RNA, 18 nt, Human
cuccauuccucuggggcc

SEQ ID NO: 1095477 - RNA, 21 nt, Human
cuccucugacaccagggcucc

SEQ ID NO: 1095478 - RNA, 20 nt, Human
cugcuucaggccccacuccu

SEQ ID NO: 1095479 - RNA, 21 nt, Human
gagcugcuucaggccccacuc

SEQ ID NO: 1095480 - RNA, 27 nt, Human
ggccccacuccuccggucuggucccca

SEQ ID NO: 1095481 - RNA, 18 nt, Human
ggucaggauagggcaggc

SEQ ID NO: 1095482 - RNA, 18 nt, Human
ggugcaucagccuggccu

SEQ ID NO: 1095483 - RNA, 23 nt, Human
ucccuggugcaucagccuggccu

SEQ ID NO: 1095484 - RNA, 24 nt, Human
ucccuggugcaucagccuggccuc

SEQ ID NO: 1095485 - RNA, 18 nt, Human
uccggggucucugggcuc

SEQ ID NO: 1095486 - RNA, 22 nt, Human
ugggccaggaaagcugcccccu

SEQ ID NO: 1095487 - RNA, 20 nt, Human
acagaccaggggccccccag

SEQ ID NO: 1095488 - RNA, 22 nt, Human
agaggacccaggagggggcgau

SEQ ID NO: 1095489 - RNA, 18 nt, Human
cacacagcaucccuggca

SEQ ID NO: 1095490 - RNA, 21 nt, Human
cacagaccaggggccccccag

SEQ ID NO: 1095491 - RNA, 22 nt, Human
caggggccccccagagucaccc

SEQ ID NO: 1095492 - RNA, 19 nt, Human
ccccagagucacccuggca

SEQ ID NO: 1095493 - RNA, 19 nt, Human
ccgccuuccucacagacca

SEQ ID NO: 1095494 - RNA, 26 nt, Human
ccucuggguagccagcacacagcauc

SEQ ID NO: 1095495 - RNA, 26 nt, Human
ccuggcaggugucccugcggcccucu

SEQ ID NO: 1095496 - RNA, 19 nt, Human
gagagugagguugaaggga

SEQ ID NO: 1095497 - RNA, 24 nt, Human
gaggacccaggagggggcgaugag

SEQ ID NO: 1095498 - RNA, 20 nt, Human
gccgccuuccucacagacca

SEQ ID NO: 1095499 - RNA, 21 nt, Human
ggagaggacccaggagggggc

SEQ ID NO: 1095500 - RNA, 18 nt, Human
ucccuggcaauaucugga

SEQ ID NO: 1095501 - RNA, 18 nt, Human
uccucacagaccaggggc

SEQ ID NO: 1095502 - RNA, 18 nt, Human
ugucccugcggcccucug

SEQ ID NO: 1095503 - RNA, 18 nt, Human
aagggaugaggacuaaag

SEQ ID NO: 1095504 - RNA, 20 nt, Human
accugggucccucccggccc

SEQ ID NO: 1095505 - RNA, 19 nt, Human
caccugggucccucccggc

SEQ ID NO: 1095506 - RNA, 21 nt, Human
caguugcaguugaacuuuauu

SEQ ID NO: 1095507 - RNA, 22 nt, Human
cccaccuacccuggccuugccu

SEQ ID NO: 1095508 - RNA, 20 nt, Human
cccaggaugugauccgugcc

SEQ ID NO: 1095509 - RNA, 22 nt, Human
cccggcccccaccuacccuggc

SEQ ID NO: 1095510 - RNA, 22 nt, Human
ccuccaggaucuaagggaugag

SEQ ID NO: 1095511 - RNA, 21 nt, Human
gggucccucccggcccccacc

SEQ ID NO: 1095512 - RNA, 22 nt, Human
gggucccucccggcccccaccu

SEQ ID NO: 1095513 - RNA, 21 nt, Human
gggucuguuccuccuccaggc

SEQ ID NO: 1095514 - RNA, 19 nt, Human
ucccggcccccaccuaccc

SEQ ID NO: 1095515 - RNA, 24 nt, Human
ucuaagggaugaggacuaaagggg

SEQ ID NO: 1095516 - RNA, 18 nt, Human
uggcauggaaccguccgu

SEQ ID NO: 1095517 - RNA, 24 nt, Human
uuuauucauccguucacaccuggg

SEQ ID NO: 1095518 - RNA, 18 nt, Human
aagagaccccugcccauc

SEQ ID NO: 1095519 - RNA, 22 nt, Human
aagagaccccugcccauccuca

SEQ ID NO: 1095520 - RNA, 24 nt, Human
acagcgcuauaaacagccuccagc

SEQ ID NO: 1095521 - RNA, 18 nt, Human
acugccuccgccuucccc

SEQ ID NO: 1095522 - RNA, 19 nt, Human
acugccuccgccuuccccc

SEQ ID NO: 1095523 - RNA, 21 nt, Human
acugccuccgccuucccccca

SEQ ID NO: 1095524 - RNA, 20 nt, Human
agccuccagcgcgucagucc

SEQ ID NO: 1095525 - RNA, 27 nt, Human
agcucauuggcuaccgcgggcaucaga

SEQ ID NO: 1095526 - RNA, 22 nt, Human
aggugggagagggccugggggc

SEQ ID NO: 1095527 - RNA, 26 nt, Human
auggaagaaaaugggguugaagaaaa

SEQ ID NO: 1095528 - RNA, 19 nt, Human
augggguugaagaaaaaaa

SEQ ID NO: 1095529 - RNA, 22 nt, Human
augggguugaagaaaaaaaaag

SEQ ID NO: 1095530 - RNA, 20 nt, Human
cacucucccucucagcggag

SEQ ID NO: 1095531 - RNA, 25 nt, Human
cacucucccucucagcggagcuuua

SEQ ID NO: 1095532 - RNA, 19 nt, Human
cagcguaugggggcagagc

SEQ ID NO: 1095533 - RNA, 27 nt, Human
caggccccggaguggagggggcagggg

SEQ ID NO: 1095534 - RNA, 21 nt, Human
caggccucugccuccacuccc

SEQ ID NO: 1095535 - RNA, 18 nt, Human
ccacggggcaaacagcag

SEQ ID NO: 1095536 - RNA, 19 nt, Human
ccccaccccgcccagcucc

SEQ ID NO: 1095537 - RNA, 21 nt, Human
ccccaccccgcccagcuccuc

SEQ ID NO: 1095538 - RNA, 25 nt, Human
ccccaccccgcccagcuccucuuuc

SEQ ID NO: 1095539 - RNA, 19 nt, Human
ccccgcccagcuccucuuu

SEQ ID NO: 1095540 - RNA, 19 nt, Human
ccccuggagggcggggacg

SEQ ID NO: 1095541 - RNA, 21 nt, Human
ccccuggagggcggggacgga

SEQ ID NO: 1095542 - RNA, 19 nt, Human
cccgcgcuguccugacagc

SEQ ID NO: 1095543 - RNA, 20 nt, Human
ccggcgcccuacugugcugc

SEQ ID NO: 1095544 - RNA, 22 nt, Human
ccuccugggacuuuauggaagc

SEQ ID NO: 1095545 - RNA, 22 nt, Human
ccugccucuccugcccccccca

SEQ ID NO: 1095546 - RNA, 24 nt, Human
ccuuugcgcguccugccucuccug

SEQ ID NO: 1095547 - RNA, 22 nt, Human
cucaggccucugccuccacucc

SEQ ID NO: 1095548 - RNA, 22 nt, Human
cuccgccuuccccccaccccgc

SEQ ID NO: 1095549 - RNA, 19 nt, Human
gacugccuccgccuucccc

SEQ ID NO: 1095550 - RNA, 23 nt, Human
gacugccuccgccuuccccccac

SEQ ID NO: 1095551 - RNA, 21 nt, Human
gagaccccugcccauccucag

SEQ ID NO: 1095552 - RNA, 21 nt, Human
gagggcagcguaugggggcag

SEQ ID NO: 1095553 - RNA, 24 nt, Human
gcagccuggccuugugcccuacag

SEQ ID NO: 1095554 - RNA, 19 nt, Human
gcccaggcuuccagaugcc

SEQ ID NO: 1095555 - RNA, 21 nt, Human
gccccggaguggagggggcag

SEQ ID NO: 1095556 - RNA, 21 nt, Human
gcccgggagcccccccccgcu

SEQ ID NO: 1095557 - RNA, 22 nt, Human
gccuccgccuuccccccacccc

SEQ ID NO: 1095558 - RNA, 20 nt, Human
gcuguccccuucuucagcac

SEQ ID NO: 1095559 - RNA, 24 nt, Human
ggaagaaaaugggguugaagaaaa

SEQ ID NO: 1095560 - RNA, 21 nt, Human
ggagcucucaggccucugccu

SEQ ID NO: 1095561 - RNA, 19 nt, Human
ggaguggggucgggugggg

SEQ ID NO: 1095562 - RNA, 21 nt, Human
ggcagcguaugggggcagagc

SEQ ID NO: 1095563 - RNA, 18 nt, Human
ggcaggggagggucucug

SEQ ID NO: 1095564 - RNA, 22 nt, Human
ggcauuaaaaaggugggagaaa

SEQ ID NO: 1095565 - RNA, 22 nt, Human
ggccccggaguggagggggcag

SEQ ID NO: 1095566 - RNA, 21 nt, Human
ggcccggcgcccuacugugcu

SEQ ID NO: 1095567 - RNA, 20 nt, Human
ggccugggggcugggaggca

SEQ ID NO: 1095568 - RNA, 22 nt, Human
gggagggucucuguagguggga

SEQ ID NO: 1095569 - RNA, 18 nt, Human
ggguugaagaaaaaaaaa

SEQ ID NO: 1095570 - RNA, 18 nt, Human
guccugccucuccugccc

SEQ ID NO: 1095571 - RNA, 24 nt, Human
guccugccucuccugcccccccca

SEQ ID NO: 1095572 - RNA, 20 nt, Human
gugcugccugagcccguggc

SEQ ID NO: 1095573 - RNA, 22 nt, Human
uacuagacugccuccgccuucc

SEQ ID NO: 1095574 - RNA, 19 nt, Human
uacuggcauuaaaaaggug

SEQ ID NO: 1095575 - RNA, 22 nt, Human
uauggaagccugucuugccuuu

SEQ ID NO: 1095576 - RNA, 19 nt, Human
ucaguggccuggcagccag

SEQ ID NO: 1095577 - RNA, 20 nt, Human
ucaucauugggagugggguc

SEQ ID NO: 1095578 - RNA, 20 nt, Human
uccugccucuccugcccccc

SEQ ID NO: 1095579 - RNA, 18 nt, Human
ucuccugccccccccauu

SEQ ID NO: 1095580 - RNA, 24 nt, Human
ucuccugccccccccauugguucc

SEQ ID NO: 1095581 - RNA, 19 nt, Human
ugaaccccaggggaagcug

SEQ ID NO: 1095582 - RNA, 19 nt, Human
ugaagaaaaaaaaagccuu

SEQ ID NO: 1095583 - RNA, 18 nt, Human
ugaccggaagguccgggu

SEQ ID NO: 1095584 - RNA, 21 nt, Human
ugacuugcaaugaaaaugccc

SEQ ID NO: 1095585 - RNA, 18 nt, Human
ugcaaugaaaaugccccu

SEQ ID NO: 1095586 - RNA, 25 nt, Human
ugccugguacaaggcuugaugagag

SEQ ID NO: 1095587 - RNA, 20 nt, Human
uggaagaaaaugggguugaa

SEQ ID NO: 1095588 - RNA, 19 nt, Human
ugggacacugucccaaagg

SEQ ID NO: 1095589 - RNA, 19 nt, Human
ugggagaaauggaagaaaa

SEQ ID NO: 1095590 - RNA, 21 nt, Human
ugggagagggccugggggcug

SEQ ID NO: 1095591 - RNA, 22 nt, Human
ugggagagggccugggggcugg

SEQ ID NO: 1095592 - RNA, 24 nt, Human
ugggagagggccugggggcugguc

SEQ ID NO: 1095593 - RNA, 21 nt, Human
ugggaguggggucgggugggg

SEQ ID NO: 1095594 - RNA, 27 nt, Human
ugggggcagagcccgguucuccccgag

SEQ ID NO: 1095595 - RNA, 22 nt, Human
ugggggcagagcccgguucugg

SEQ ID NO: 1095596 - RNA, 23 nt, Human
uuccccccaccccgcccagcucc

SEQ ID NO: 1095597 - RNA, 18 nt, Human
uuccccuggagggcgggg

SEQ ID NO: 1095598 - RNA, 22 nt, Human
uucuucagcacucucccucuca

SEQ ID NO: 1095599 - RNA, 22 nt, Human
uuggaacagaguuuauuuucca

SEQ ID NO: 1095600 - RNA, 21 nt, Human
uuuauggaagccugucuugcc

SEQ ID NO: 1095601 - RNA, 25 nt, Human
uuuuccaucacuguaaaacauucuc

SEQ ID NO: 1095602 - RNA, 23 nt, Human
uuuuuuuuuuuuuugaacuugga

SEQ ID NO: 1095603 - RNA, 18 nt, Human
uuuuuuuuuuuuuuuuug

SEQ ID NO: 1095604 - RNA, 23 nt, Human
uuuuuuuuuuuuuuuuugaacuu

SEQ ID NO: 1095605 - RNA, 18 nt, Human
aggcagaaacaaaaaucc

SEQ ID NO: 1095606 - RNA, 21 nt, Human
caaaaagauaaggcagaaaca

SEQ ID NO: 1095607 - RNA, 26 nt, Human
caacaaguucaucugaauuuauacca

SEQ ID NO: 1095608 - RNA, 24 nt, Human
caauggcuaugguuccugaaauuu

SEQ ID NO: 1095609 - RNA, 25 nt, Human
cugaaugcccaacaacaaguucauc

SEQ ID NO: 1095610 - RNA, 21 nt, Human
uaaggcagaaacaaaaauccc

SEQ ID NO: 1095611 - RNA, 20 nt, Human
uagguucccucauccauuuc

SEQ ID NO: 1095612 - RNA, 24 nt, Human
ucaucaaaguuuguuacuguucac

SEQ ID NO: 1095613 - RNA, 23 nt, Human
ugcccaacaacaaguucaucuga

SEQ ID NO: 1095614 - RNA, 28 nt, Human
ugcccaacaacaaguucaucugaauuua

SEQ ID NO: 1095615 - RNA, 24 nt, Human
uguggagcucccaggguaaaaaga

SEQ ID NO: 1095616 - RNA, 22 nt, Human
uuccauagccagauuucagggu

SEQ ID NO: 1095617 - RNA, 18 nt, Human
aagccagcuuuguacugg

SEQ ID NO: 1095618 - RNA, 20 nt, Human
aagccagcuuuguacuggga

SEQ ID NO: 1095619 - RNA, 23 nt, Human
agcacuuugggaggcugaggcag

SEQ ID NO: 1095620 - RNA, 24 nt, Human
agcacuuugggaggcugaggcagg

SEQ ID NO: 1095621 - RNA, 18 nt, Human
aggcaggaggaucacuug

SEQ ID NO: 1095622 - RNA, 24 nt, Human
aggcugaggcaggaggaucacuug

SEQ ID NO: 1095623 - RNA, 21 nt, Human
caacuccucaagcucaagccu

SEQ ID NO: 1095624 - RNA, 20 nt, Human
cagaagggacccgaggggcg

SEQ ID NO: 1095625 - RNA, 19 nt, Human
cagaaguggaagccagcuu

SEQ ID NO: 1095626 - RNA, 20 nt, Human
ccacaagggcagaagggacc

SEQ ID NO: 1095627 - RNA, 24 nt, Human
ccccuggugggcagcggugacccc

SEQ ID NO: 1095628 - RNA, 23 nt, Human
ccugacaccuggugggccccaac

SEQ ID NO: 1095629 - RNA, 21 nt, Human
ccuggcuguguggccuuagcc

SEQ ID NO: 1095630 - RNA, 24 nt, Human
cuccucucccuggcuguguggccu

SEQ ID NO: 1095631 - RNA, 24 nt, Human
gacaccuggugggccccaacuccu

SEQ ID NO: 1095632 - RNA, 20 nt, Human
gaggccaaacuucaaggcca

SEQ ID NO: 1095633 - RNA, 23 nt, Human
gaucacuugaggccaaacuucaa

SEQ ID NO: 1095634 - RNA, 19 nt, Human
gcuguguaauccuagcacu

SEQ ID NO: 1095635 - RNA, 19 nt, Human
ggaggauaggaggacuggc

SEQ ID NO: 1095636 - RNA, 18 nt, Human
ggaucacuugaggccaaa

SEQ ID NO: 1095637 - RNA, 24 nt, Human
gggcuguguaauccuagcacuuug

SEQ ID NO: 1095638 - RNA, 21 nt, Human
gugaccacccaguccucgcug

SEQ ID NO: 1095639 - RNA, 25 nt, Human
uagcacuuugggaggcugaggcagg

SEQ ID NO: 1095640 - RNA, 18 nt, Human
uccucaagcucaagccuc

SEQ ID NO: 1095641 - RNA, 19 nt, Human
uccucaagcucaagccuca

SEQ ID NO: 1095642 - RNA, 18 nt, Human
ugacaccuggugggcccc

SEQ ID NO: 1095643 - RNA, 20 nt, Human
ugaggcaggaggaucacuug

SEQ ID NO: 1095644 - RNA, 25 nt, Human
ugaggcaggaggaucacuugaggcc

SEQ ID NO: 1095645 - RNA, 26 nt, Human
ugaggcaggaggaucacuugaggcca

SEQ ID NO: 1095646 - RNA, 20 nt, Human
ugggaggcugaggcaggagg

SEQ ID NO: 1095647 - RNA, 24 nt, Human
ugggaggcugaggcaggaggauca

SEQ ID NO: 1095648 - RNA, 20 nt, Human
uggugggccccaacuccuca

SEQ ID NO: 1095649 - RNA, 25 nt, Human
uugggaggcugaggcaggaggauca

SEQ ID NO: 1095650 - RNA, 21 nt, Human
aaaaagcagaaaaaaaagugu

SEQ ID NO: 1095651 - RNA, 23 nt, Human
aaaacaaaacaaaaaacccuuga

SEQ ID NO: 1095652 - RNA, 25 nt, Human
aaaacaaaacaaacccaaacaaaca

SEQ ID NO: 1095653 - RNA, 24 nt, Human
aaaaccaaaccaaaacaaaacaaa

SEQ ID NO: 1095654 - RNA, 25 nt, Human
aaaaccaaaccaaaacaaaacaaac

SEQ ID NO: 1095655 - RNA, 28 nt, Human
aaacaaaacaaaaaacccuugaaggcaa

SEQ ID NO: 1095656 - RNA, 19 nt, Human
aaacaaaacaaaacaaaaa

SEQ ID NO: 1095657 - RNA, 22 nt, Human
aaacaaaacaaaacaaaacaaa

SEQ ID NO: 1095658 - RNA, 18 nt, Human
aaacaaaacaaacccaaa

SEQ ID NO: 1095659 - RNA, 27 nt, Human
aaacaaaacaaacccaaacaaacaaaa

SEQ ID NO: 1095660 - RNA, 26 nt, Human
aaacaaacccaaacaaacaaaaaaca

SEQ ID NO: 1095661 - RNA, 23 nt, Human
aaacagacugcggaaaggacucu

SEQ ID NO: 1095662 - RNA, 24 nt, Human
aaaccaaaacaaaacaaacccaaa

SEQ ID NO: 1095663 - RNA, 21 nt, Human
aaaccacccacaaaaagcaga

SEQ ID NO: 1095664 - RNA, 27 nt, Human
aacaaaacaaaaaacccuugaaggcaa

SEQ ID NO: 1095665 - RNA, 26 nt, Human
aacaaaacaaaacaaaaaacccuuga

SEQ ID NO: 1095666 - RNA, 19 nt, Human
aacacggugaaaccccguc

SEQ ID NO: 1095667 - RNA, 20 nt, Human
aacacggugaaaccccgucu

SEQ ID NO: 1095668 - RNA, 21 nt, Human
aacacggugaaaccccgucuc

SEQ ID NO: 1095669 - RNA, 27 nt, Human
aaccaaaccaaaacaaaacaaacccaa

SEQ ID NO: 1095670 - RNA, 23 nt, Human
aaccugcucuuucacauaacccu

SEQ ID NO: 1095671 - RNA, 19 nt, Human
aagcagaaaaaaaaguguc

SEQ ID NO: 1095672 - RNA, 22 nt, Human
aagcaguuguggaaccaaucag

SEQ ID NO: 1095673 - RNA, 22 nt, Human
aaggcaagguuucugcccugga

SEQ ID NO: 1095674 - RNA, 22 nt, Human
acaaaacaaaacaaaaaacccu

SEQ ID NO: 1095675 - RNA, 24 nt, Human
acaaaacaaaacaaaaaacccuug

SEQ ID NO: 1095676 - RNA, 22 nt, Human
acaaaacaaaacaaaacaaaaa

SEQ ID NO: 1095677 - RNA, 25 nt, Human
acaaaacaaaacaaaacaaaaaacc

SEQ ID NO: 1095678 - RNA, 28 nt, Human
acaaacccaaacaaacaaaaaacaaaac

SEQ ID NO: 1095679 - RNA, 18 nt, Human
acaaauaaagggaaaaag

SEQ ID NO: 1095680 - RNA, 20 nt, Human
acagacugcggaaaggacuc

SEQ ID NO: 1095681 - RNA, 24 nt, Human
acagagcgagacuccguuucaaaa

SEQ ID NO: 1095682 - RNA, 26 nt, Human
acagaguacacacauauaguuccccc

SEQ ID NO: 1095683 - RNA, 19 nt, Human
acagcaauacaaauaaagg

SEQ ID NO: 1095684 - RNA, 23 nt, Human
acauugagcucauggccaacagc

SEQ ID NO: 1095685 - RNA, 18 nt, Human
accaaaacaaaacaaacc

SEQ ID NO: 1095686 - RNA, 19 nt, Human
accacccacaaaaagcaga

SEQ ID NO: 1095687 - RNA, 26 nt, Human
acccaaacaaacaaaaaacaaaacaa

SEQ ID NO: 1095688 - RNA, 24 nt, Human
accccgucucuacugaaaauacaa

SEQ ID NO: 1095689 - RNA, 24 nt, Human
acugcacuccagccugggcgacag

SEQ ID NO: 1095690 - RNA, 26 nt, Human
acugcacuccagccugggcgacagag

SEQ ID NO: 1095691 - RNA, 20 nt, Human
agaaaccaggggagggguga

SEQ ID NO: 1095692 - RNA, 23 nt, Human
agcaauacaaauaaagggaaaaa

SEQ ID NO: 1095693 - RNA, 24 nt, Human
agccugggcgacagagcgagacuc

SEQ ID NO: 1095694 - RNA, 18 nt, Human
aggaacacugggcagagc

SEQ ID NO: 1095695 - RNA, 24 nt, Human
aggcaggagaaugacgugaacccg

SEQ ID NO: 1095696 - RNA, 20 nt, Human
aggcaggcggaucaugaggu

SEQ ID NO: 1095697 - RNA, 24 nt, Human
aggcaggcggaucaugaggucagg

SEQ ID NO: 1095698 - RNA, 20 nt, Human
aggccgaggcaggcggauca

SEQ ID NO: 1095699 - RNA, 23 nt, Human
aggccgaggcaggcggaucauga

SEQ ID NO: 1095700 - RNA, 24 nt, Human
aggcggagcuugcagugagccgag

SEQ ID NO: 1095701 - RNA, 24 nt, Human
aggcggaucaugaggucaggagau

SEQ ID NO: 1095702 - RNA, 24 nt, Human
aggcgugguaguggacgccuguag

SEQ ID NO: 1095703 - RNA, 18 nt, Human
aggcugaggcaggagaau

SEQ ID NO: 1095704 - RNA, 22 nt, Human
aguaaacagacugcggaaagga

SEQ ID NO: 1095705 - RNA, 18 nt, Human
agucgcucuuggcauugg

SEQ ID NO: 1095706 - RNA, 25 nt, Human
caaaaaacaaaacaaaacaaaacaa

SEQ ID NO: 1095707 - RNA, 26 nt, Human
caaaaaacaaaacaaaacaaaacaaa

SEQ ID NO: 1095708 - RNA, 20 nt, Human
caaaaaauuauccaggcgug

SEQ ID NO: 1095709 - RNA, 21 nt, Human
caaaacaaaaaacccuugaag

SEQ ID NO: 1095710 - RNA, 23 nt, Human
caaaacaaaacaaaaaacccuug

SEQ ID NO: 1095711 - RNA, 25 nt, Human
caaaacaaaacaaaacaaaaaaccc

SEQ ID NO: 1095712 - RNA, 19 nt, Human
caaaacaaaacaaacccaa

SEQ ID NO: 1095713 - RNA, 19 nt, Human
caaaaccaaaccaaaacaa

SEQ ID NO: 1095714 - RNA, 27 nt, Human
caaacaaacaaaaaacaaaacaaaaca

SEQ ID NO: 1095715 - RNA, 25 nt, Human
caaacccaaacaaacaaaaaacaaa

SEQ ID NO: 1095716 - RNA, 24 nt, Human
caacacuuugggaggccgaggcag

SEQ ID NO: 1095717 - RNA, 25 nt, Human
caacacuuugggaggccgaggcagg

SEQ ID NO: 1095718 - RNA, 24 nt, Human
caagaccauccuggcuaacacggu

SEQ ID NO: 1095719 - RNA, 23 nt, Human
cacaaaaagcagaaaaaaaagug

SEQ ID NO: 1095720 - RNA, 23 nt, Human
cacacacagaguacacacauaua

SEQ ID NO: 1095721 - RNA, 21 nt, Human
cacacauauaguucccauaua

SEQ ID NO: 1095722 - RNA, 23 nt, Human
cacccacaaaaagcagaaaaaaa

SEQ ID NO: 1095723 - RNA, 24 nt, Human
cacgccuguaaucccaacacuuug

SEQ ID NO: 1095724 - RNA, 23 nt, Human
cacuccagccugggcgacagagc

SEQ ID NO: 1095725 - RNA, 24 nt, Human
cacuccagccugggcgacagagcg

SEQ ID NO: 1095726 - RNA, 19 nt, Human
cacugcacuccagccuggg

SEQ ID NO: 1095727 - RNA, 20 nt, Human
cacugcacuccagccugggc

SEQ ID NO: 1095728 - RNA, 20 nt, Human
cacugcacuccagccugggc

SEQ ID NO: 1095729 - RNA, 22 nt, Human
cacugcacuccagccugggcga

SEQ ID NO: 1095730 - RNA, 24 nt, Human
cacugcacuccagccugggcgaca

SEQ ID NO: 1095731 - RNA, 20 nt, Human
cacuuuagucgcucuuggca

SEQ ID NO: 1095732 - RNA, 21 nt, Human
cagcaauacaaauaaagggaa

SEQ ID NO: 1095733 - RNA, 21 nt, Human
cagcacaggagcugcgacuag

SEQ ID NO: 1095734 - RNA, 24 nt, Human
cagcuacucgggaggcugaggcag

SEQ ID NO: 1095735 - RNA, 25 nt, Human
caugaauccacaaauuuagccgcuu

SEQ ID NO: 1095736 - RNA, 19 nt, Human
cauuuuagaaagcaaaacc

SEQ ID NO: 1095737 - RNA, 22 nt, Human
ccaaacaaacaaaaaacaaaac

SEQ ID NO: 1095738 - RNA, 27 nt, Human
ccaaaccaaaacaaaacaaacccaaac

SEQ ID NO: 1095739 - RNA, 21 nt, Human
ccacaguaaacacauacacua

SEQ ID NO: 1095740 - RNA, 22 nt, Human
ccacccacaaaaagcagaaaaa

SEQ ID NO: 1095741 - RNA, 23 nt, Human
ccacccacaaaaagcagaaaaaa

SEQ ID NO: 1095742 - RNA, 20 nt, Human
ccacugcacuccagccuggg

SEQ ID NO: 1095743 - RNA, 20 nt, Human
ccacugcacuccagccuggg

SEQ ID NO: 1095744 - RNA, 21 nt, Human
ccacugcacuccagccugggc

SEQ ID NO: 1095745 - RNA, 21 nt, Human
ccacugcacuccagccugggc

SEQ ID NO: 1095746 - RNA, 23 nt, Human
ccacugcacuccagccugggcga

SEQ ID NO: 1095747 - RNA, 24 nt, Human
ccacugcacuccagccugggcgac

SEQ ID NO: 1095748 - RNA, 23 nt, Human
ccuggcuaacacggugaaacccc

SEQ ID NO: 1095749 - RNA, 24 nt, Human
ccuggcuaacacggugaaaccccg

SEQ ID NO: 1095750 - RNA, 22 nt, Human
ccugggcgacagagcgagacuc

SEQ ID NO: 1095751 - RNA, 19 nt, Human
ccuguagucccagcuacuc

SEQ ID NO: 1095752 - RNA, 21 nt, Human
ccuguagucccagcuacucgg

SEQ ID NO: 1095753 - RNA, 24 nt, Human
cgaggcaggcggaucaugagguca

SEQ ID NO: 1095754 - RNA, 25 nt, Human
cgcacaauaacaagggugcaugauc

SEQ ID NO: 1095755 - RNA, 20 nt, Human
cgccacugcacuccagccug

SEQ ID NO: 1095756 - RNA, 26 nt, Human
cgccacugcacuccagccugggcgac

SEQ ID NO: 1095757 - RNA, 23 nt, Human
cgccuguaaucccaacacuuugg

SEQ ID NO: 1095758 - RNA, 24 nt, Human
cgccuguaaucccaacacuuuggg

SEQ ID NO: 1095759 - RNA, 24 nt, Human
cgccuguagucccagcuacucggg

SEQ ID NO: 1095760 - RNA, 21 nt, Human
cguaucgccuuuugaaacgcg

SEQ ID NO: 1095761 - RNA, 22 nt, Human
cucacgccuguaaucccaacac

SEQ ID NO: 1095762 - RNA, 24 nt, Human
cucacgccuguaaucccaacacuu

SEQ ID NO: 1095763 - RNA, 18 nt, Human
cuggcuaacacggugaaa

SEQ ID NO: 1095764 - RNA, 19 nt, Human
cuugcagugagccgagauu

SEQ ID NO: 1095765 - RNA, 21 nt, Human
cuugcagugagccgagauugc

SEQ ID NO: 1095766 - RNA, 23 nt, Human
cuugccccacagaaaccagggga

SEQ ID NO: 1095767 - RNA, 26 nt, Human
cuuucagccucaccacaaugcugucc

SEQ ID NO: 1095768 - RNA, 19 nt, Human
gaaaccccgucucuacuga

SEQ ID NO: 1095769 - RNA, 24 nt, Human
gacagagcgagacuccguuucaaa

SEQ ID NO: 1095770 - RNA, 30 nt, Human
gacuccguuucaaaaccaaaccaaaacaag

SEQ ID NO: 1095771 - RNA, 20 nt, Human
gacucguuaacauugagcuc

SEQ ID NO: 1095772 - RNA, 23 nt, Human
gagauugcgccacugcacuccag

SEQ ID NO: 1095773 - RNA, 18 nt, Human
gagcuugcagugagccga

SEQ ID NO: 1095774 - RNA, 23 nt, Human
gagcuugcagugagccgagauug

SEQ ID NO: 1095775 - RNA, 23 nt, Human
gaggcaggcggaucaugagguca

SEQ ID NO: 1095776 - RNA, 24 nt, Human
gcacuccagccugggcgacagagc

SEQ ID NO: 1095777 - RNA, 23 nt, Human
gcagagcucgccucaccugcaag

SEQ ID NO: 1095778 - RNA, 22 nt, Human
gccacugcacuccagccugggc

SEQ ID NO: 1095779 - RNA, 24 nt, Human
gccacugcacuccagccugggcga

SEQ ID NO: 1095780 - RNA, 20 nt, Human
gcccggcgcgguggcucacg

SEQ ID NO: 1095781 - RNA, 23 nt, Human
gccuguagucccagcuacucggg

SEQ ID NO: 1095782 - RNA, 24 nt, Human
gcuaacacggugaaaccccgucuc

SEQ ID NO: 1095783 - RNA, 24 nt, Human
ggagcuugcagugagccgagauug

SEQ ID NO: 1095784 - RNA, 23 nt, Human
ggcaggcggaucaugaggucagg

SEQ ID NO: 1095785 - RNA, 23 nt, Human
ggcgcgguggcucacgccuguaa

SEQ ID NO: 1095786 - RNA, 24 nt, Human
gguaguggacgccuguagucccag

SEQ ID NO: 1095787 - RNA, 23 nt, Human
gguggcucacgccuguaauccca

SEQ ID NO: 1095788 - RNA, 21 nt, Human
uaaaauucuuccgcagccucc

SEQ ID NO: 1095789 - RNA, 29 nt, Human
uaaacacauacacuacuuugcacacauag

SEQ ID NO: 1095790 - RNA, 18 nt, Human
uaaacagacugcggaaag

SEQ ID NO: 1095791 - RNA, 23 nt, Human
uaaacagacugcggaaaggacuc

SEQ ID NO: 1095792 - RNA, 18 nt, Human
uaaaccucucgaccuugg

SEQ ID NO: 1095793 - RNA, 22 nt, Human
uaacaaaaccuugaaggugccc

SEQ ID NO: 1095794 - RNA, 22 nt, Human
uaacacggugaaaccccgucuc

SEQ ID NO: 1095795 - RNA, 24 nt, Human
uaacacggugaaaccccgucucua

SEQ ID NO: 1095796 - RNA, 18 nt, Human
uaacgugaccacagauau

SEQ ID NO: 1095797 - RNA, 21 nt, Human
uaagcacuacgcuugggggcc

SEQ ID NO: 1095798 - RNA, 19 nt, Human
uaagugcuuguggauuuug

SEQ ID NO: 1095799 - RNA, 22 nt, Human
uacccuacaguacagcaauaca

SEQ ID NO: 1095800 - RNA, 21 nt, Human
uagaaagcaaaaccacccaca

SEQ ID NO: 1095801 - RNA, 20 nt, Human
uaggaacacugggcagagcu

SEQ ID NO: 1095802 - RNA, 19 nt, Human
uauccaaaauuaacaaaac

SEQ ID NO: 1095803 - RNA, 19 nt, Human
uauccaaaauuaacaaaac

SEQ ID NO: 1095804 - RNA, 22 nt, Human
uaucuuuggcuuucagccucac

SEQ ID NO: 1095805 - RNA, 24 nt, Human
ucaguaaacagacugcggaaagga

SEQ ID NO: 1095806 - RNA, 18 nt, Human
ucaugaggucaggagauc

SEQ ID NO: 1095807 - RNA, 24 nt, Human
ucaugaggucaggagaucaagacc

SEQ ID NO: 1095808 - RNA, 26 nt, Human
uccacaaauuuagccgcuuuuccauc

SEQ ID NO: 1095809 - RNA, 23 nt, Human
uccagccugggcgacagagcgag

SEQ ID NO: 1095810 - RNA, 24 nt, Human
uccagccugggcgacagagcgaga

SEQ ID NO: 1095811 - RNA, 25 nt, Human
ucccacaguaaacacauacacuacu

SEQ ID NO: 1095812 - RNA, 19 nt, Human
ucccguuaagugcuugugg

SEQ ID NO: 1095813 - RNA, 20 nt, Human
ucgaguucuuugcagcaaug

SEQ ID NO: 1095814 - RNA, 22 nt, Human
ucucuacugaaaauacaaaaaa

SEQ ID NO: 1095815 - RNA, 21 nt, Human
ucuuuggcuuucagccucacc

SEQ ID NO: 1095816 - RNA, 22 nt, Human
ugagccgagauugcgccacugc

SEQ ID NO: 1095817 - RNA, 23 nt, Human
ugaggcaggagaaugacgugaac

SEQ ID NO: 1095818 - RNA, 24 nt, Human
ugaggcaggagaaugacgugaacc

SEQ ID NO: 1095819 - RNA, 25 nt, Human
ugaggcaggagaaugacgugaaccc

SEQ ID NO: 1095820 - RNA, 20 nt, Human
ugaucugcagagcucgccuc

SEQ ID NO: 1095821 - RNA, 23 nt, Human
uggaaccaaucagacaucaucca

SEQ ID NO: 1095822 - RNA, 18 nt, Human
uggagacaguguucagcu

SEQ ID NO: 1095823 - RNA, 26 nt, Human
uggcacacacagaguacacacauaua

SEQ ID NO: 1095824 - RNA, 22 nt, Human
uggcaugauuuaaagccagggg

SEQ ID NO: 1095825 - RNA, 24 nt, Human
uggcucacgccuguaaucccaaca

SEQ ID NO: 1095826 - RNA, 20 nt, Human
ugggaggccgaggcaggcgg

SEQ ID NO: 1095827 - RNA, 24 nt, Human
ugggaggccgaggcaggcggauca

SEQ ID NO: 1095828 - RNA, 24 nt, Human
ugguaguggacgccuguaguccca

SEQ ID NO: 1095829 - RNA, 19 nt, Human
uguggaaccaaucagacaa

SEQ ID NO: 1095830 - RNA, 24 nt, Human
ugugguuaaaccucucgaccuugg

SEQ ID NO: 1095831 - RNA, 20 nt, Human
uucaaaaccaaaccaaaaca

SEQ ID NO: 1095832 - RNA, 18 nt, Human
uucaaagauggagcaucc

SEQ ID NO: 1095833 - RNA, 20 nt, Human
uucccguuaagugcuugugg

SEQ ID NO: 1095834 - RNA, 21 nt, Human
uuccuuuuccuuuuucuugau

SEQ ID NO: 1095835 - RNA, 21 nt, Human
uucucccaguucaaacuucag

SEQ ID NO: 1095836 - RNA, 18 nt, Human
uugcagugagccgagauu

SEQ ID NO: 1095837 - RNA, 19 nt, Human
uugcagugagccgagauug

SEQ ID NO: 1095838 - RNA, 22 nt, Human
uugcagugagccgagauugcgc

SEQ ID NO: 1095839 - RNA, 23 nt, Human
uugcgccacugcacuccagccug

SEQ ID NO: 1095840 - RNA, 25 nt, Human
uugggaggccgaggcaggcggauca

SEQ ID NO: 1095841 - RNA, 24 nt, Human
uuuaaaauucuuccgcagccuccu

SEQ ID NO: 1095842 - RNA, 18 nt, Human
uuuccuuuuccuuuuucu

SEQ ID NO: 1095843 - RNA, 25 nt, Human
uuugaaacgcgcgagccggccagca

SEQ ID NO: 1095844 - RNA, 24 nt, Human
uuuucgaguucuuugcagcaaugg

SEQ ID NO: 1095845 - RNA, 24 nt, Human
aaauuaccuuguguauccaagagu

SEQ ID NO: 1095846 - RNA, 22 nt, Human
accuuguguauccaagagucua

SEQ ID NO: 1095847 - RNA, 18 nt, Human
gauucccuucuacacccc

SEQ ID NO: 1095848 - RNA, 19 nt, Human
uaacuuuuuaaaagguuca

SEQ ID NO: 1095849 - RNA, 21 nt, Human
ucuacaccccgauaggaggag

SEQ ID NO: 1095850 - RNA, 25 nt, Human
ucuguagccuuucuaauauugcucu

SEQ ID NO: 1095851 - RNA, 24 nt, Human
ugaccucuguagccuuucuaauau

SEQ ID NO: 1095852 - RNA, 21 nt, Human
uggauuuucggaauuacaaaa

SEQ ID NO: 1095853 - RNA, 18 nt, Human
ugguauguuuuggaaaau

SEQ ID NO: 1095854 - RNA, 26 nt, Human
uguaugcguauguuugcgcaugcgug

SEQ ID NO: 1095855 - RNA, 22 nt, Human
uguguauccaagagucuacaug

SEQ ID NO: 1095856 - RNA, 18 nt, Human
uuaacacacuaagguaaa

SEQ ID NO: 1095857 - RNA, 19 nt, Human
uuaccuuguguauccaaga

SEQ ID NO: 1095858 - RNA, 23 nt, Human
uuguguauccaagagucuacaug

SEQ ID NO: 1095859 - RNA, 18 nt, Human
aaaaaacaaaacagagag

SEQ ID NO: 1095860 - RNA, 21 nt, Human
aacaaaacagagaggcuaagu

SEQ ID NO: 1095861 - RNA, 23 nt, Human
caagugacuucagagcucacaug

SEQ ID NO: 1095862 - RNA, 18 nt, Human
cacuugccuaagguuacg

SEQ ID NO: 1095863 - RNA, 24 nt, Human
cagcaaggacuaaaagagcuggaa

SEQ ID NO: 1095864 - RNA, 18 nt, Human
cgcagcaaggacuaaaag

SEQ ID NO: 1095865 - RNA, 25 nt, Human
gcggagcucacaguaugugcuacac

SEQ ID NO: 1095866 - RNA, 28 nt, Human
uacaaaugaaaaaacaaaacagagaggg

SEQ ID NO: 1095867 - RNA, 23 nt, Human
ugcuacacaagaguguuugcaca

SEQ ID NO: 1095868 - RNA, 22 nt, Human
ccugcucugaguagcccuuccu

SEQ ID NO: 1095869 - RNA, 24 nt, Human
cucccgcugcaggauguggugcag

SEQ ID NO: 1095870 - RNA, 22 nt, Human
gaguagcccuuccuucgcaugu

SEQ ID NO: 1095871 - RNA, 24 nt, Human
gugcaggugcaugauguccaggau

SEQ ID NO: 1095872 - RNA, 28 nt, Human
ugaguagcccuuccuucgcauguccucc

SEQ ID NO: 1095873 - RNA, 19 nt, Human
uggcuuccagguccugcuc

SEQ ID NO: 1095874 - RNA, 20 nt, Human
uguggugcaggugcaugaug

SEQ ID NO: 1095875 - RNA, 23 nt, Human
aacagcugguccuccaguccccc

SEQ ID NO: 1095876 - RNA, 28 nt, Human
acacgugcauacgaacaugcacacacac

SEQ ID NO: 1095877 - RNA, 20 nt, Human
acagcugagaaaacuggggc

SEQ ID NO: 1095878 - RNA, 18 nt, Human
accuccgccaggcacgcu

SEQ ID NO: 1095879 - RNA, 21 nt, Human
agcgggugggaccaggcucag

SEQ ID NO: 1095880 - RNA, 23 nt, Human
agucaaaacaagugccccccuca

SEQ ID NO: 1095881 - RNA, 23 nt, Human
augcacacacacacgugcucaca

SEQ ID NO: 1095882 - RNA, 21 nt, Human
caacgcacacuggcugcgucu

SEQ ID NO: 1095883 - RNA, 23 nt, Human
cagucaaaacaagugccccccuc

SEQ ID NO: 1095884 - RNA, 21 nt, Human
caguccccaagcugaagcugg

SEQ ID NO: 1095885 - RNA, 23 nt, Human
cccaagcugaagcugggcagcuc

SEQ ID NO: 1095886 - RNA, 26 nt, Human
cccccucacucacacgugcauacgaa

SEQ ID NO: 1095887 - RNA, 18 nt, Human
cgcugcuaaaccuccgcc

SEQ ID NO: 1095888 - RNA, 20 nt, Human
cggcaggacagucaaaacaa

SEQ ID NO: 1095889 - RNA, 18 nt, Human
cugaagcugggcagcucu

SEQ ID NO: 1095890 - RNA, 20 nt, Human
cugagcaccggccgucaccu

SEQ ID NO: 1095891 - RNA, 20 nt, Human
gaagaauuacgggucugugc

SEQ ID NO: 1095892 - RNA, 18 nt, Human
gaccaggcucagaugucc

SEQ ID NO: 1095893 - RNA, 18 nt, Human
gagcaccggccgucacca

SEQ ID NO: 1095894 - RNA, 31 nt, Human
gugcauacgaacaugcacacacacacguggu

SEQ ID NO: 1095895 - RNA, 18 nt, Human
uaacucaguguuaagugg

SEQ ID NO: 1095896 - RNA, 20 nt, Human
uacgggucugugccccagac

SEQ ID NO: 1095897 - RNA, 23 nt, Human
ucacagcugagaaaacuggggcu

SEQ ID NO: 1095898 - RNA, 20 nt, Human
uccccaagcugaagcugggc

SEQ ID NO: 1095899 - RNA, 18 nt, Human
uccuccaguccccaagcu

SEQ ID NO: 1095900 - RNA, 20 nt, Human
ugcuaaaccuccgccaggca

SEQ ID NO: 1095901 - RNA, 22 nt, Human
ugucccggcaggacagucaaaa

SEQ ID NO: 1095902 - RNA, 22 nt, Human
ugugcagcgggugggaccaggc

SEQ ID NO: 1095903 - RNA, 27 nt, Human
aaagugcuggggggaucacagguguga

SEQ ID NO: 1095904 - RNA, 27 nt, Human
aauuuuauuuuuguagaaauggggucu

SEQ ID NO: 1095905 - RNA, 25 nt, Human
acacacgcacuuccccacuggcucc

SEQ ID NO: 1095906 - RNA, 25 nt, Human
acacgcacuuccccacuggcuccuu

SEQ ID NO: 1095907 - RNA, 24 nt, Human
acuauguugcucagacuggucucg

SEQ ID NO: 1095908 - RNA, 18 nt, Human
auggggucucacuauguu

SEQ ID NO: 1095909 - RNA, 23 nt, Human
caaagugcuggggggaucacagg

SEQ ID NO: 1095910 - RNA, 23 nt, Human
cacaggugugagccacugcgccc

SEQ ID NO: 1095911 - RNA, 24 nt, Human
cacuauguugcucagacuggucuc

SEQ ID NO: 1095912 - RNA, 20 nt, Human
cccacaaagucuuggagcca

SEQ ID NO: 1095913 - RNA, 21 nt, Human
ccccacuggcuccuuggcccg

SEQ ID NO: 1095914 - RNA, 20 nt, Human
ccugggcucaagcgauccuc

SEQ ID NO: 1095915 - RNA, 25 nt, Human
cgaacuccugggcucaagcgauccu

SEQ ID NO: 1095916 - RNA, 24 nt, Human
cucaagcgauccuccuaccuuggc

SEQ ID NO: 1095917 - RNA, 23 nt, Human
cuccugggcucaagcgauccucc

SEQ ID NO: 1095918 - RNA, 18 nt, Human
gaucacaggugugagcca

SEQ ID NO: 1095919 - RNA, 22 nt, Human
gaucacaggugugagccacugc

SEQ ID NO: 1095920 - RNA, 22 nt, Human
gaucacaggugugagccacugc

SEQ ID NO: 1095921 - RNA, 21 nt, Human
gggaucacaggugugagccac

SEQ ID NO: 1095922 - RNA, 23 nt, Human
gggaucacaggugugagccacug

SEQ ID NO: 1095923 - RNA, 22 nt, Human
gggcucaagcgauccuccuacc

SEQ ID NO: 1095924 - RNA, 22 nt, Human
ggggaucacaggugugagccac

SEQ ID NO: 1095925 - RNA, 24 nt, Human
ggggaucacaggugugagccacug

SEQ ID NO: 1095926 - RNA, 22 nt, Human
ggggucucacuauguugcucag

SEQ ID NO: 1095927 - RNA, 21 nt, Human
gggucucacuauguugcucag

SEQ ID NO: 1095928 - RNA, 22 nt, Human
guagaaauggggucucacuaug

SEQ ID NO: 1095929 - RNA, 22 nt, Human
uagaaauggggucucacuaugu

SEQ ID NO: 1095930 - RNA, 21 nt, Human
uauguugcucagacuggucuc

SEQ ID NO: 1095931 - RNA, 24 nt, Human
uauguugcucagacuggucucgaa

SEQ ID NO: 1095932 - RNA, 27 nt, Human
ucaaagugcuggggggaucacaggugu

SEQ ID NO: 1095933 - RNA, 24 nt, Human
ucaagcgauccuccuaccuuggcc

SEQ ID NO: 1095934 - RNA, 21 nt, Human
uccugggcucaagcgauccuc

SEQ ID NO: 1095935 - RNA, 22 nt, Human
uccugggcucaagcgauccucc

SEQ ID NO: 1095936 - RNA, 27 nt, Human
ucucaaagugcuggggggaucacaggu

SEQ ID NO: 1095937 - RNA, 19 nt, Human
ucucacuauguugcucaga

SEQ ID NO: 1095938 - RNA, 19 nt, Human
ucucgaacuccugggcuca

SEQ ID NO: 1095939 - RNA, 23 nt, Human
ucucgaacuccugggcucaagcg

SEQ ID NO: 1095940 - RNA, 24 nt, Human
ugcucagacuggucucgaacuccu

SEQ ID NO: 1095941 - RNA, 18 nt, Human
uggggucucacuauguug

SEQ ID NO: 1095942 - RNA, 19 nt, Human
ugguccaacacacgcacuu

SEQ ID NO: 1095943 - RNA, 24 nt, Human
uguagaaauggggucucacuaugu

SEQ ID NO: 1095944 - RNA, 20 nt, Human
uguugcucagacuggucucg

SEQ ID NO: 1095945 - RNA, 20 nt, Human
acaagcacguugacacuccu

SEQ ID NO: 1095946 - RNA, 19 nt, Human
acccugagggcggggagga

SEQ ID NO: 1095947 - RNA, 18 nt, Human
agggaaggcgugcacgug

SEQ ID NO: 1095948 - RNA, 19 nt, Human
augcugccgcaggcacugc

SEQ ID NO: 1095949 - RNA, 26 nt, Human
caagcacguugacacuccugaccuac

SEQ ID NO: 1095950 - RNA, 22 nt, Human
cacacagcuacagcagacacuc

SEQ ID NO: 1095951 - RNA, 18 nt, Human
cccugagggcggggagga

SEQ ID NO: 1095952 - RNA, 20 nt, Human
ccguggacccugagggcggg

SEQ ID NO: 1095953 - RNA, 21 nt, Human
cgcugcagagccuggugcugc

SEQ ID NO: 1095954 - RNA, 21 nt, Human
cgcuggggggugccgcugcag

SEQ ID NO: 1095955 - RNA, 18 nt, Human
cggaaaaaacuacaucug

SEQ ID NO: 1095956 - RNA, 19 nt, Human
cugcagagccuggugcugc

SEQ ID NO: 1095957 - RNA, 20 nt, Human
cugcugccccuaauaugcca

SEQ ID NO: 1095958 - RNA, 22 nt, Human
gacccugagggcggggaggagg

SEQ ID NO: 1095959 - RNA, 20 nt, Human
gccgugggaagcgccauggc

SEQ ID NO: 1095960 - RNA, 26 nt, Human
gcuggaaucgaguaaugugcuuaauu

SEQ ID NO: 1095961 - RNA, 20 nt, Human
gcuggggggugccgcugcag

SEQ ID NO: 1095962 - RNA, 22 nt, Human
gguggccguggacccugagggc

SEQ ID NO: 1095963 - RNA, 26 nt, Human
gugccgcugcagagccuggugcugcu

SEQ ID NO: 1095964 - RNA, 19 nt, Human
ugagggcggggaggaggga

SEQ ID NO: 1095965 - RNA, 22 nt, Human
ugagggcggggaggagggaagg

SEQ ID NO: 1095966 - RNA, 19 nt, Human
uggccguggacccugaggg

SEQ ID NO: 1095967 - RNA, 20 nt, Human
uggccguggacccugagggc

SEQ ID NO: 1095968 - RNA, 24 nt, Human
aaagcccuuccuugucuuucacuc

SEQ ID NO: 1095969 - RNA, 24 nt, Human
aaagugcugggauuacaggcauga

SEQ ID NO: 1095970 - RNA, 19 nt, Human
aagaagacacuacccugac

SEQ ID NO: 1095971 - RNA, 18 nt, Human
aagugcauacacagcaca

SEQ ID NO: 1095972 - RNA, 19 nt, Human
aagugcugggauuacaggc

SEQ ID NO: 1095973 - RNA, 21 nt, Human
aagugcugggauuacaggcau

SEQ ID NO: 1095974 - RNA, 26 nt, Human
aagugcugggauuacaggcaugagcc

SEQ ID NO: 1095975 - RNA, 23 nt, Human
acacacacacacacacacacaca

SEQ ID NO: 1095976 - RNA, 23 nt, Human
acacaccccccugcaggaaagcc

SEQ ID NO: 1095977 - RNA, 23 nt, Human
acacacucagcacacaccacaca

SEQ ID NO: 1095978 - RNA, 27 nt, Human
acacgugcacacacaugggggcacaca

SEQ ID NO: 1095979 - RNA, 23 nt, Human
acacgugcacacaugugcaggca

SEQ ID NO: 1095980 - RNA, 18 nt, Human
acaggcacacacaccccc

SEQ ID NO: 1095981 - RNA, 19 nt, Human
accauagccacccagacca

SEQ ID NO: 1095982 - RNA, 20 nt, Human
accccccugcaggaaagccc

SEQ ID NO: 1095983 - RNA, 20 nt, Human
acccucacccccgcccccgu

SEQ ID NO: 1095984 - RNA, 24 nt, Human
accgccucggccucccaaagugcu

SEQ ID NO: 1095985 - RNA, 18 nt, Human
acgggguuucaccauguu

SEQ ID NO: 1095986 - RNA, 19 nt, Human
acgggguuucaccauguua

SEQ ID NO: 1095987 - RNA, 20 nt, Human
acgggguuucaccauguuag

SEQ ID NO: 1095988 - RNA, 24 nt, Human
acgggguuucaccauguuagccag

SEQ ID NO: 1095989 - RNA, 20 nt, Human
acuugaggagaagagaaggg

SEQ ID NO: 1095990 - RNA, 22 nt, Human
agaagagaagggggacaggggc

SEQ ID NO: 1095991 - RNA, 19 nt, Human
agagaagggggacaggggc

SEQ ID NO: 1095992 - RNA, 21 nt, Human
agagaggcagagcuucuucca

SEQ ID NO: 1095993 - RNA, 18 nt, Human
agcaagggccccuccccc

SEQ ID NO: 1095994 - RNA, 20 nt, Human
agcacaagaacagagagaag

SEQ ID NO: 1095995 - RNA, 18 nt, Human
agccacccagaccaggaa

SEQ ID NO: 1095996 - RNA, 21 nt, Human
aggcacacaccacacaggucc

SEQ ID NO: 1095997 - RNA, 23 nt, Human
aggcagagcuucuuccagaucua

SEQ ID NO: 1095998 - RNA, 19 nt, Human
aggccaggccccuggcccu

SEQ ID NO: 1095999 - RNA, 21 nt, Human
aggccccuggcccugaaacag

SEQ ID NO: 1096000 - RNA, 21 nt, Human
aggggcugaggccaggccccu

SEQ ID NO: 1096001 - RNA, 22 nt, Human
auauacacacucagcacacagu

SEQ ID NO: 1096002 - RNA, 24 nt, Human
caaagugcugggauuacaggcaug

SEQ ID NO: 1096003 - RNA, 18 nt, Human
caacaggcuucccuccca

SEQ ID NO: 1096004 - RNA, 20 nt, Human
caacccugccccucuaguga

SEQ ID NO: 1096005 - RNA, 21 nt, Human
caagugcauacacagcacaca

SEQ ID NO: 1096006 - RNA, 20 nt, Human
cacacacacacacacacaca

SEQ ID NO: 1096007 - RNA, 20 nt, Human
cacacacacacacacacaca

SEQ ID NO: 1096008 - RNA, 20 nt, Human
cacacacacacacacacaca

SEQ ID NO: 1096009 - RNA, 22 nt, Human
cacacacacacacacacacaca

SEQ ID NO: 1096010 - RNA, 29 nt, Human
cacacacacacacacacacacacacugca

SEQ ID NO: 1096011 - RNA, 26 nt, Human
cacacacacacacacacacugcacug

SEQ ID NO: 1096012 - RNA, 20 nt, Human
cacacacacugcacuggagg

SEQ ID NO: 1096013 - RNA, 21 nt, Human
cacacacaggcacacacaccc

SEQ ID NO: 1096014 - RNA, 23 nt, Human
cacacaccacacagguccacacg

SEQ ID NO: 1096015 - RNA, 23 nt, Human
cacacaccacacagguccacacg

SEQ ID NO: 1096016 - RNA, 22 nt, Human
cacaccccccugcaggaaagcc

SEQ ID NO: 1096017 - RNA, 23 nt, Human
cacagcacacaggcacacacagg

SEQ ID NO: 1096018 - RNA, 23 nt, Human
cacaggaaggagggcucaacagg

SEQ ID NO: 1096019 - RNA, 27 nt, Human
cacaggaaggagggcucaacaggcuuc

SEQ ID NO: 1096020 - RNA, 18 nt, Human
caccauguuagccaggau

SEQ ID NO: 1096021 - RNA, 22 nt, Human
caccauguuagccaggaugguc

SEQ ID NO: 1096022 - RNA, 24 nt, Human
caccauguuagccaggauggucuc

SEQ ID NO: 1096023 - RNA, 20 nt, Human
cacucucucuccucucucuc

SEQ ID NO: 1096024 - RNA, 19 nt, Human
cagcaagggccccuccccc

SEQ ID NO: 1096025 - RNA, 20 nt, Human
caggacaguaacacagggcc

SEQ ID NO: 1096026 - RNA, 19 nt, Human
caggcuucccucccaaccc

SEQ ID NO: 1096027 - RNA, 21 nt, Human
cagucaccacccuggucuagc

SEQ ID NO: 1096028 - RNA, 23 nt, Human
caugugcaggcacacaccacaca

SEQ ID NO: 1096029 - RNA, 23 nt, Human
ccaaagugcugggauuacaggca

SEQ ID NO: 1096030 - RNA, 24 nt, Human
ccaaagugcugggauuacaggcau

SEQ ID NO: 1096031 - RNA, 24 nt, Human
ccacaugcugccugcuccaauccc

SEQ ID NO: 1096032 - RNA, 19 nt, Human
ccaccagcccuucuaguug

SEQ ID NO: 1096033 - RNA, 19 nt, Human
ccaccagcccuucuaguug

SEQ ID NO: 1096034 - RNA, 21 nt, Human
ccacccugucugcaaaagaug

SEQ ID NO: 1096035 - RNA, 24 nt, Human
cccaaagugcugggauuacaggca

SEQ ID NO: 1096036 - RNA, 24 nt, Human
ccccagggcugugggcugcacagg

SEQ ID NO: 1096037 - RNA, 26 nt, Human
cccccacggcagcccuuauuuugucu

SEQ ID NO: 1096038 - RNA, 19 nt, Human
ccccugcacagggcccgcc

SEQ ID NO: 1096039 - RNA, 18 nt, Human
cccugcacagggcccgcc

SEQ ID NO: 1096040 - RNA, 19 nt, Human
cccuggcccugaaacagcc

SEQ ID NO: 1096041 - RNA, 20 nt, Human
ccucagcaggguggcccagc

SEQ ID NO: 1096042 - RNA, 19 nt, Human
ccucccaacccugccccuc

SEQ ID NO: 1096043 - RNA, 23 nt, Human
ccuccugcaugccacugguagcc

SEQ ID NO: 1096044 - RNA, 21 nt, Human
ccuccuguucccacccucacc

SEQ ID NO: 1096045 - RNA, 19 nt, Human
ccucucucucgucucucuc

SEQ ID NO: 1096046 - RNA, 22 nt, Human
ccucucucucgucucucucaca

SEQ ID NO: 1096047 - RNA, 18 nt, Human
ccucucugcuccuuuagc

SEQ ID NO: 1096048 - RNA, 19 nt, Human
ccuggcccugaaacagccc

SEQ ID NO: 1096049 - RNA, 20 nt, Human
ccugugcuuuauuucacaga

SEQ ID NO: 1096050 - RNA, 21 nt, Human
ccuuugcacuuggacgggaau

SEQ ID NO: 1096051 - RNA, 19 nt, Human
cggcagcccuuauuuuguc

SEQ ID NO: 1096052 - RNA, 24 nt, Human
cgugauccaaccgccucggccucc

SEQ ID NO: 1096053 - RNA, 21 nt, Human
cguggcaucuacccaccuccu

SEQ ID NO: 1096054 - RNA, 24 nt, Human
cguuuccuccucucugcuccuuua

SEQ ID NO: 1096055 - RNA, 20 nt, Human
cuacccaccuccuguuccca

SEQ ID NO: 1096056 - RNA, 23 nt, Human
cuacccaccuccuguucccaccc

SEQ ID NO: 1096057 - RNA, 20 nt, Human
cuagagcucuagcgagugac

SEQ ID NO: 1096058 - RNA, 24 nt, Human
cuccugaccucgugauccaaccgc

SEQ ID NO: 1096059 - RNA, 18 nt, Human
cuccuuucugcaccccuc

SEQ ID NO: 1096060 - RNA, 20 nt, Human
cucguggcaucuacccaccu

SEQ ID NO: 1096061 - RNA, 20 nt, Human
cucucugcuccuuuagccca

SEQ ID NO: 1096062 - RNA, 19 nt, Human
cugaaacagccauaacucc

SEQ ID NO: 1096063 - RNA, 22 nt, Human
cugccugcuccaaucccaaccu

SEQ ID NO: 1096064 - RNA, 20 nt, Human
cugcguuacuggaagaagac

SEQ ID NO: 1096065 - RNA, 21 nt, Human
cuggcccugaaacagccauaa

SEQ ID NO: 1096066 - RNA, 20 nt, Human
cugggcaacuugaggagaag

SEQ ID NO: 1096067 - RNA, 21 nt, Human
cugggcaacuugaggagaaga

SEQ ID NO: 1096068 - RNA, 19 nt, Human
cuuggcagcucaguucccu

SEQ ID NO: 1096069 - RNA, 21 nt, Human
cuuggcagcucaguucccuuc

SEQ ID NO: 1096070 - RNA, 18 nt, Human
cuuucugcaccccucugg

SEQ ID NO: 1096071 - RNA, 24 nt, Human
gaaaggccccagcaaacagugguc

SEQ ID NO: 1096072 - RNA, 18 nt, Human
gaagggccgcugggcugg

SEQ ID NO: 1096073 - RNA, 19 nt, Human
gaagggugaguuucugccu

SEQ ID NO: 1096074 - RNA, 22 nt, Human
gaccucgugauccaaccgccuc

SEQ ID NO: 1096075 - RNA, 22 nt, Human
gaccucgugauccaaccgccuc

SEQ ID NO: 1096076 - RNA, 24 nt, Human
gaccucgugauccaaccgccucgg

SEQ ID NO: 1096077 - RNA, 24 nt, Human
gagacgggguuucaccauguuagc

SEQ ID NO: 1096078 - RNA, 18 nt, Human
gauuacaggcaugagcca

SEQ ID NO: 1096079 - RNA, 22 nt, Human
gauuacaggcaugagccaccgc

SEQ ID NO: 1096080 - RNA, 23 nt, Human
gauuacaggcaugagccaccgca

SEQ ID NO: 1096081 - RNA, 27 nt, Human
gcacacacaggcacacacaccccccug

SEQ ID NO: 1096082 - RNA, 23 nt, Human
gcacacaggcacacacauauaca

SEQ ID NO: 1096083 - RNA, 25 nt, Human
gcacacaggcacacacauauacaca

SEQ ID NO: 1096084 - RNA, 21 nt, Human
gcagagcuucuuccagaucua

SEQ ID NO: 1096085 - RNA, 22 nt, Human
gcagagcuucuuccagaucuag

SEQ ID NO: 1096086 - RNA, 24 nt, Human
gccccuggcccugaaacagccaua

SEQ ID NO: 1096087 - RNA, 21 nt, Human
gcccuuccuugucuuucacuc

SEQ ID NO: 1096088 - RNA, 23 nt, Human
gccucggccucccaaagugcugg

SEQ ID NO: 1096089 - RNA, 23 nt, Human
gccucguggcaucuacccaccuc

SEQ ID NO: 1096090 - RNA, 18 nt, Human
gccuugggaaggguggag

SEQ ID NO: 1096091 - RNA, 18 nt, Human
gcucaguucccuucucug

SEQ ID NO: 1096092 - RNA, 23 nt, Human
gcuucuuccagaucuagagcucu

SEQ ID NO: 1096093 - RNA, 24 nt, Human
ggauggucucgaucuccugaccuc

SEQ ID NO: 1096094 - RNA, 22 nt, Human
ggauuacaggcaugagccaccg

SEQ ID NO: 1096095 - RNA, 21 nt, Human
ggcacacacaccccccugcag

SEQ ID NO: 1096096 - RNA, 23 nt, Human
ggcacacacaggcacacacaccc

SEQ ID NO: 1096097 - RNA, 18 nt, Human
ggcugugggcugcacagg

SEQ ID NO: 1096098 - RNA, 18 nt, Human
gggcugaggccaggcccc

SEQ ID NO: 1096099 - RNA, 23 nt, Human
gggguuucaccauguuagccagg

SEQ ID NO: 1096100 - RNA, 22 nt, Human
ggguuucaccauguuagccagg

SEQ ID NO: 1096101 - RNA, 19 nt, Human
ggugaguuucugccuuugg

SEQ ID NO: 1096102 - RNA, 24 nt, Human
gguuucaccauguuagccaggaug

SEQ ID NO: 1096103 - RNA, 23 nt, Human
guagagacgggguuucaccaugu

SEQ ID NO: 1096104 - RNA, 20 nt, Human
guccacacgugcacacaugu

SEQ ID NO: 1096105 - RNA, 24 nt, Human
gugauccaaccgccucggccuccc

SEQ ID NO: 1096106 - RNA, 22 nt, Human
guggaaggcaugccucguggca

SEQ ID NO: 1096107 - RNA, 23 nt, Human
guguacacaugugcaagugcaua

SEQ ID NO: 1096108 - RNA, 31 nt, Human
gugugguccuggggcuccucucuccuguucc

SEQ ID NO: 1096109 - RNA, 19 nt, Human
uacacacucagcacacacc

SEQ ID NO: 1096110 - RNA, 25 nt, Human
uacacagcacacaggcacacacaua

SEQ ID NO: 1096111 - RNA, 21 nt, Human
uacaggcaugagccaccgcac

SEQ ID NO: 1096112 - RNA, 22 nt, Human
uagagacgggguuucaccaugu

SEQ ID NO: 1096113 - RNA, 22 nt, Human
uagccacccagaccaggaauuc

SEQ ID NO: 1096114 - RNA, 24 nt, Human
uaguagagacgggguuucaccaug

SEQ ID NO: 1096115 - RNA, 26 nt, Human
uaguagagacgggguuucaccauguu

SEQ ID NO: 1096116 - RNA, 20 nt, Human
uauacacacucagcacacac

SEQ ID NO: 1096117 - RNA, 23 nt, Human
uauacacacucagcacacaccac

SEQ ID NO: 1096118 - RNA, 18 nt, Human
ucacacucucucuccucu

SEQ ID NO: 1096119 - RNA, 21 nt, Human
ucacagagaaggaaaggcccc

SEQ ID NO: 1096120 - RNA, 24 nt, Human
ucaccauguuagccaggauggucu

SEQ ID NO: 1096121 - RNA, 24 nt, Human
ucacccagaugcucaccccggcuc

SEQ ID NO: 1096122 - RNA, 24 nt, Human
ucccaaagugcugggauuacaggc

SEQ ID NO: 1096123 - RNA, 18 nt, Human
ucccaacccugccccucu

SEQ ID NO: 1096124 - RNA, 21 nt, Human
ucccaacccugccccucuagu

SEQ ID NO: 1096125 - RNA, 21 nt, Human
ucccacccucacccccgcccc

SEQ ID NO: 1096126 - RNA, 19 nt, Human
ucccuggaagcacaagaac

SEQ ID NO: 1096127 - RNA, 18 nt, Human
ucggccucccaaagugcu

SEQ ID NO: 1096128 - RNA, 21 nt, Human
ucuagcgagugacgggauuuc

SEQ ID NO: 1096129 - RNA, 22 nt, Human
ucucucacagagaaggaaaggc

SEQ ID NO: 1096130 - RNA, 23 nt, Human
ucucucgucucucucacagagaa

SEQ ID NO: 1096131 - RNA, 23 nt, Human
ucugucuggagcauucuggucau

SEQ ID NO: 1096132 - RNA, 18 nt, Human
ugaaacagccauaacucc

SEQ ID NO: 1096133 - RNA, 21 nt, Human
ugaaacagccauaacuccugg

SEQ ID NO: 1096134 - RNA, 21 nt, Human
ugaccaagcaccugccguguc

SEQ ID NO: 1096135 - RNA, 22 nt, Human
ugaccucgugauccaaccgccu

SEQ ID NO: 1096136 - RNA, 18 nt, Human
ugaugccggggcucuggg

SEQ ID NO: 1096137 - RNA, 21 nt, Human
ugcaggaaagcccuuccuugu

SEQ ID NO: 1096138 - RNA, 21 nt, Human
ugcaggcacacaccacacagg

SEQ ID NO: 1096139 - RNA, 24 nt, Human
ugcugaccaagcaccugccguguc

SEQ ID NO: 1096140 - RNA, 27 nt, Human
uggaagaagacacuacccugacucacu

SEQ ID NO: 1096141 - RNA, 22 nt, Human
uggagaccccacauucggccag

SEQ ID NO: 1096142 - RNA, 18 nt, Human
uggaggagagaagagagg

SEQ ID NO: 1096143 - RNA, 18 nt, Human
uggcagucaccacccugg

SEQ ID NO: 1096144 - RNA, 18 nt, Human
ugggauuacaggcaugag

SEQ ID NO: 1096145 - RNA, 19 nt, Human
ugggauuacaggcaugagc

SEQ ID NO: 1096146 - RNA, 21 nt, Human
ugggauuacaggcaugagcca

SEQ ID NO: 1096147 - RNA, 22 nt, Human
ugggauuacaggcaugagccac

SEQ ID NO: 1096148 - RNA, 23 nt, Human
ugggauuacaggcaugagccacc

SEQ ID NO: 1096149 - RNA, 24 nt, Human
ugggauuacaggcaugagccaccg

SEQ ID NO: 1096150 - RNA, 24 nt, Human
ugggauuacaggcaugagccaccg

SEQ ID NO: 1096151 - RNA, 19 nt, Human
ugggccuccugcaugccac

SEQ ID NO: 1096152 - RNA, 20 nt, Human
ugggccuccugcaugccacu

SEQ ID NO: 1096153 - RNA, 21 nt, Human
ugggcugggcgccaaccagag

SEQ ID NO: 1096154 - RNA, 31 nt, Human
uggggacacacacacacacacacacacacag

SEQ ID NO: 1096155 - RNA, 28 nt, Human
uguggggacacacacacacacacacaca

SEQ ID NO: 1096156 - RNA, 19 nt, Human
ugugugguccuggggcucc

SEQ ID NO: 1096157 - RNA, 18 nt, Human
uuaguagagacgggguuu

SEQ ID NO: 1096158 - RNA, 22 nt, Human
uuaguagagacgggguuucacc

SEQ ID NO: 1096159 - RNA, 24 nt, Human
uuaguagagacgggguuucaccau

SEQ ID NO: 1096160 - RNA, 22 nt, Human
uucccacccucacccccgcccc

SEQ ID NO: 1096161 - RNA, 18 nt, Human
uucccuucucugcaccuc

SEQ ID NO: 1096162 - RNA, 23 nt, Human
uucuuccagaucuagagcucuag

SEQ ID NO: 1096163 - RNA, 19 nt, Human
uuucaccauguuagccagg

SEQ ID NO: 1096164 - RNA, 20 nt, Human
uuucaccauguuagccagga

SEQ ID NO: 1096165 - RNA, 21 nt, Human
uuuucuggacuguacuaauga

SEQ ID NO: 1096166 - RNA, 23 nt, Human
uuuucuggacuguacuaaugagg

SEQ ID NO: 1096167 - RNA, 24 nt, Human
uuuuuaguagagacgggguuucac

SEQ ID NO: 1096168 - RNA, 23 nt, Human
aaagacagaccugggcccaagcc

SEQ ID NO: 1096169 - RNA, 20 nt, Human
aaauggauuuugaaccuguu

SEQ ID NO: 1096170 - RNA, 23 nt, Human
aagcaagcagaaagcacggcugg

SEQ ID NO: 1096171 - RNA, 22 nt, Human
acaaaccaaaagcaagcagaaa

SEQ ID NO: 1096172 - RNA, 23 nt, Human
acagugcuggauuacaggcguga

SEQ ID NO: 1096173 - RNA, 20 nt, Human
acauggagaaacacugagcc

SEQ ID NO: 1096174 - RNA, 21 nt, Human
accugcccuucacuccaacuu

SEQ ID NO: 1096175 - RNA, 24 nt, Human
accugggagcucguuacacaugca

SEQ ID NO: 1096176 - RNA, 23 nt, Human
agaaagacagaccugggcccaag

SEQ ID NO: 1096177 - RNA, 18 nt, Human
agaaggagacgaugucac

SEQ ID NO: 1096178 - RNA, 18 nt, Human
agaaggagacgaugucac

SEQ ID NO: 1096179 - RNA, 22 nt, Human
agacaaugucaccagcagcuga

SEQ ID NO: 1096180 - RNA, 22 nt, Human
agagcauagggcaggggugggg

SEQ ID NO: 1096181 - RNA, 21 nt, Human
agaggaaaucccaggccaccc

SEQ ID NO: 1096182 - RNA, 18 nt, Human
agagggaaaacauccucc

SEQ ID NO: 1096183 - RNA, 19 nt, Human
agagugagggacagcugau

SEQ ID NO: 1096184 - RNA, 19 nt, Human
agaugccuggcuccgggau

SEQ ID NO: 1096185 - RNA, 21 nt, Human
agcacaccucuacacagacaa

SEQ ID NO: 1096186 - RNA, 21 nt, Human
agcagagcugcugaaauggca

SEQ ID NO: 1096187 - RNA, 22 nt, Human
agcagcugauugggcgucuaug

SEQ ID NO: 1096188 - RNA, 22 nt, Human
agcagcugguuggguguccaug

SEQ ID NO: 1096189 - RNA, 18 nt, Human
aggauuggugaggaugaa

SEQ ID NO: 1096190 - RNA, 20 nt, Human
aggcaaggcugagggaccug

SEQ ID NO: 1096191 - RNA, 23 nt, Human
aggcgugaaccacugugcucggc

SEQ ID NO: 1096192 - RNA, 22 nt, Human
aggcgugaggcugggaacccau

SEQ ID NO: 1096193 - RNA, 21 nt, Human
aggcugaggucagguggcagg

SEQ ID NO: 1096194 - RNA, 19 nt, Human
aggcugcagggcugaaugc

SEQ ID NO: 1096195 - RNA, 22 nt, Human
aggcugcagggcugaaugcugu

SEQ ID NO: 1096196 - RNA, 18 nt, Human
agggcugaaugcuguggu

SEQ ID NO: 1096197 - RNA, 20 nt, Human
agggguggggaaggaaugag

SEQ ID NO: 1096198 - RNA, 23 nt, Human
agggucuuccaggagaaaugaca

SEQ ID NO: 1096199 - RNA, 22 nt, Human
aggugguuugguguccauaucc

SEQ ID NO: 1096200 - RNA, 22 nt, Human
aggugguuugguguccaugucc

SEQ ID NO: 1096201 - RNA, 22 nt, Human
aguagagaugggguuucgccau

SEQ ID NO: 1096202 - RNA, 23 nt, Human
aguagagaugggguuucgccaug

SEQ ID NO: 1096203 - RNA, 23 nt, Human
aguaggagagacccuccagcugg

SEQ ID NO: 1096204 - RNA, 21 nt, Human
agugcuggauuacaggcguga

SEQ ID NO: 1096205 - RNA, 21 nt, Human
augaaaauagagaugccuguc

SEQ ID NO: 1096206 - RNA, 18 nt, Human
augggguuucgccauguu

SEQ ID NO: 1096207 - RNA, 24 nt, Human
augggguuucgccauguuggccag

SEQ ID NO: 1096208 - RNA, 24 nt, Human
caaaagcaagcagaaagcacggcc

SEQ ID NO: 1096209 - RNA, 22 nt, Human
caaucacugcuaaaggugacac

SEQ ID NO: 1096210 - RNA, 19 nt, Human
cacuccagaggcguuggca

SEQ ID NO: 1096211 - RNA, 19 nt, Human
cagaaggagacaauaucau

SEQ ID NO: 1096212 - RNA, 22 nt, Human
cagaaggagacaauaucaucgg

SEQ ID NO: 1096213 - RNA, 19 nt, Human
cagaaggagacaaugucac

SEQ ID NO: 1096214 - RNA, 19 nt, Human
cagaaggagacgaugucac

SEQ ID NO: 1096215 - RNA, 19 nt, Human
cagaaggagacgaugucac

SEQ ID NO: 1096216 - RNA, 19 nt, Human
cagaaggagacgaugucac

SEQ ID NO: 1096217 - RNA, 24 nt, Human
cagaaggagacgaugucaccggca

SEQ ID NO: 1096218 - RNA, 24 nt, Human
cagaaggagacgaugucaccggca

SEQ ID NO: 1096219 - RNA, 24 nt, Human
cagaaggagacgaugucaccggca

SEQ ID NO: 1096220 - RNA, 24 nt, Human
cagaaggagacgaugucaccggca

SEQ ID NO: 1096221 - RNA, 24 nt, Human
cagaaggagacgaugucacuggca

SEQ ID NO: 1096222 - RNA, 19 nt, Human
cagaaggagaugaugucac

SEQ ID NO: 1096223 - RNA, 24 nt, Human
cagaaggggacgaugucaccggca

SEQ ID NO: 1096224 - RNA, 24 nt, Human
cagaaggggacgaugucaccggca

SEQ ID NO: 1096225 - RNA, 24 nt, Human
cagaaggggacgaugucaccggca

SEQ ID NO: 1096226 - RNA, 21 nt, Human
cagaccucagaaggagacgau

SEQ ID NO: 1096227 - RNA, 21 nt, Human
cagaucucagaaggagaugau

SEQ ID NO: 1096228 - RNA, 23 nt, Human
cagaugcuggaccuaaccucaca

SEQ ID NO: 1096229 - RNA, 20 nt, Human
cagcacuccagaggcguugg

SEQ ID NO: 1096230 - RNA, 22 nt, Human
cagcaggauggggcuccccaga

SEQ ID NO: 1096231 - RNA, 24 nt, Human
cagcuccgaucagagaggaaaucc

SEQ ID NO: 1096232 - RNA, 19 nt, Human
caggccacccccugccuuu

SEQ ID NO: 1096233 - RNA, 22 nt, Human
cagguggcuggguaucaauguc

SEQ ID NO: 1096234 - RNA, 24 nt, Human
cauguuggccaggcuggucucgaa

SEQ ID NO: 1096235 - RNA, 21 nt, Human
ccacagugcuggauuacaggc

SEQ ID NO: 1096236 - RNA, 23 nt, Human
ccacagugcuggauuacaggcgu

SEQ ID NO: 1096237 - RNA, 18 nt, Human
ccagcagcagguugggug

SEQ ID NO: 1096238 - RNA, 19 nt, Human
ccauguuggccaggcuggu

SEQ ID NO: 1096239 - RNA, 22 nt, Human
ccauguuggccaggcuggucuc

SEQ ID NO: 1096240 - RNA, 23 nt, Human
ccauguuggccaggcuggucucg

SEQ ID NO: 1096241 - RNA, 22 nt, Human
cccaggccacccccugccuuug

SEQ ID NO: 1096242 - RNA, 23 nt, Human
ccccugaggcugaggucaggugg

SEQ ID NO: 1096243 - RNA, 21 nt, Human
ccucuggcuaggaucuggagc

SEQ ID NO: 1096244 - RNA, 21 nt, Human
ccugaccucaggugauccacc

SEQ ID NO: 1096245 - RNA, 23 nt, Human
ccugaccucaggugauccaccug

SEQ ID NO: 1096246 - RNA, 23 nt, Human
ccugaccucaggugauccaccug

SEQ ID NO: 1096247 - RNA, 23 nt, Human
cgcaaaauccagcucuccaggcg

SEQ ID NO: 1096248 - RNA, 24 nt, Human
cgccauguuggccaggcuggucuc

SEQ ID NO: 1096249 - RNA, 27 nt, Human
cgccauguuggccaggcuggucucgaa

SEQ ID NO: 1096250 - RNA, 22 nt, Human
cuaauaccucucucuucaauaa

SEQ ID NO: 1096251 - RNA, 18 nt, Human
cuaaugcaucuacgaaac

SEQ ID NO: 1096252 - RNA, 23 nt, Human
cuacacagacaaugcuagccaag

SEQ ID NO: 1096253 - RNA, 24 nt, Human
cucagggugagcagagcugcugaa

SEQ ID NO: 1096254 - RNA, 21 nt, Human
cucgcaaaauccagcucucca

SEQ ID NO: 1096255 - RNA, 24 nt, Human
cugcucucucugcaugcucagggu

SEQ ID NO: 1096256 - RNA, 20 nt, Human
cugucccagccagcacucca

SEQ ID NO: 1096257 - RNA, 21 nt, Human
cuucacagguucuaauaccuc

SEQ ID NO: 1096258 - RNA, 19 nt, Human
cuuccaggagaaaugacac

SEQ ID NO: 1096259 - RNA, 24 nt, Human
gaaaucccaggccacccccugccu

SEQ ID NO: 1096260 - RNA, 21 nt, Human
gaacucccucaugcgcaaaaa

SEQ ID NO: 1096261 - RNA, 24 nt, Human
gaccucaggugauccaccugccuc

SEQ ID NO: 1096262 - RNA, 19 nt, Human
gaccugcccuucacuccuu

SEQ ID NO: 1096263 - RNA, 21 nt, Human
gacucggucauucaucagcag

SEQ ID NO: 1096264 - RNA, 18 nt, Human
gagaagggagggaucucc

SEQ ID NO: 1096265 - RNA, 20 nt, Human
gagaugccuggcuccgggau

SEQ ID NO: 1096266 - RNA, 18 nt, Human
gagaugggguuucgccau

SEQ ID NO: 1096267 - RNA, 24 nt, Human
gagaugggguuucgccauguuggc

SEQ ID NO: 1096268 - RNA, 23 nt, Human
gagccaguuguuagacuuacuag

SEQ ID NO: 1096269 - RNA, 21 nt, Human
gaggccccuggagaaagacag

SEQ ID NO: 1096270 - RNA, 21 nt, Human
gauuacaggcgugaaccacug

SEQ ID NO: 1096271 - RNA, 24 nt, Human
gauuacaggcgugaaccacugugc

SEQ ID NO: 1096272 - RNA, 18 nt, Human
gcaggugguuggguguuc

SEQ ID NO: 1096273 - RNA, 18 nt, Human
gcaggugguuggguguuc

SEQ ID NO: 1096274 - RNA, 23 nt, Human
gcuggucucgaacuccugaccuc

SEQ ID NO: 1096275 - RNA, 20 nt, Human
ggaaggagauggaugugagg

SEQ ID NO: 1096276 - RNA, 20 nt, Human
ggagacgaugucacuggcag

SEQ ID NO: 1096277 - RNA, 24 nt, Human
ggagcuucucaagcccuaaugcau

SEQ ID NO: 1096278 - RNA, 20 nt, Human
ggauuacaggcgugaaccac

SEQ ID NO: 1096279 - RNA, 22 nt, Human
ggcagggguggggaaggaauga

SEQ ID NO: 1096280 - RNA, 21 nt, Human
ggcgucuaugugagugucugu

SEQ ID NO: 1096281 - RNA, 24 nt, Human
ggcuggucucgaacuccugaccuc

SEQ ID NO: 1096282 - RNA, 18 nt, Human
gggaagggacauggugcu

SEQ ID NO: 1096283 - RNA, 22 nt, Human
gggaaguggcaaaugcuaccag

SEQ ID NO: 1096284 - RNA, 21 nt, Human
gggcagggguggggaaggaau

SEQ ID NO: 1096285 - RNA, 22 nt, Human
gggguuucgccauguuggccag

SEQ ID NO: 1096286 - RNA, 18 nt, Human
ggguuucgccauguuggc

SEQ ID NO: 1096287 - RNA, 19 nt, Human
ggucucgaacuccugaccu

SEQ ID NO: 1096288 - RNA, 21 nt, Human
guagagaugggguuucgccau

SEQ ID NO: 1096289 - RNA, 23 nt, Human
guagagaugggguuucgccaugu

SEQ ID NO: 1096290 - RNA, 26 nt, Human
gugauccaccugccucgaggccuccc

SEQ ID NO: 1096291 - RNA, 20 nt, Human
uaaaaccagacagugucugu

SEQ ID NO: 1096292 - RNA, 21 nt, Human
uacaggggugagcgagaugcc

SEQ ID NO: 1096293 - RNA, 22 nt, Human
uacaggggugagcgagaugccu

SEQ ID NO: 1096294 - RNA, 24 nt, Human
uagaaaggagcuucucaagcccua

SEQ ID NO: 1096295 - RNA, 22 nt, Human
uagagaugggguuucgccaugu

SEQ ID NO: 1096296 - RNA, 24 nt, Human
uaggcucagagaagggagggaucu

SEQ ID NO: 1096297 - RNA, 23 nt, Human
uauucuaaauuccuagaaagcag

SEQ ID NO: 1096298 - RNA, 23 nt, Human
uccaugugagugucuguccucag

SEQ ID NO: 1096299 - RNA, 23 nt, Human
ucccacagugcuggauuacaggc

SEQ ID NO: 1096300 - RNA, 23 nt, Human
ucccucaugcgcaaaaaggaaga

SEQ ID NO: 1096301 - RNA, 19 nt, Human
ucccuggcaggauugguga

SEQ ID NO: 1096302 - RNA, 23 nt, Human
ucccuggcaggauuggugaggau

SEQ ID NO: 1096303 - RNA, 22 nt, Human
ucgccauguuggccaggcuggu

SEQ ID NO: 1096304 - RNA, 24 nt, Human
ucgccauguuggccaggcuggucu

SEQ ID NO: 1096305 - RNA, 23 nt, Human
ucucaaaaccacauggagaaaca

SEQ ID NO: 1096306 - RNA, 20 nt, Human
ucucagagagccaguuguua

SEQ ID NO: 1096307 - RNA, 19 nt, Human
ucucgaacuccugaccuca

SEQ ID NO: 1096308 - RNA, 21 nt, Human
ucugcaugcucagggugagca

SEQ ID NO: 1096309 - RNA, 21 nt, Human
ucuguccucagaucucagaag

SEQ ID NO: 1096310 - RNA, 20 nt, Human
ugaaauggcagagugaggga

SEQ ID NO: 1096311 - RNA, 23 nt, Human
ugaaugcugugguggcuacaggg

SEQ ID NO: 1096312 - RNA, 18 nt, Human
ugacauuugcagaaggcc

SEQ ID NO: 1096313 - RNA, 24 nt, Human
ugaccucaggugauccaccugccu

SEQ ID NO: 1096314 - RNA, 20 nt, Human
ugaggccccuggagaaagac

SEQ ID NO: 1096315 - RNA, 24 nt, Human
ugaguaggagagacccuccagcug

SEQ ID NO: 1096316 - RNA, 20 nt, Human
ugccccaggccuagcaaggu

SEQ ID NO: 1096317 - RNA, 23 nt, Human
ugccucgaggccucccacagugc

SEQ ID NO: 1096318 - RNA, 20 nt, Human
ugcgagacucggucauucau

SEQ ID NO: 1096319 - RNA, 22 nt, Human
ugcugcuuuauuucucuggacc

SEQ ID NO: 1096320 - RNA, 20 nt, Human
uggauuacaggcgugaacca

SEQ ID NO: 1096321 - RNA, 23 nt, Human
uggauuacaggcgugaaccacug

SEQ ID NO: 1096322 - RNA, 20 nt, Human
uggcaggugguuuggugucc

SEQ ID NO: 1096323 - RNA, 24 nt, Human
uggccaggcuggucucgaacuccu

SEQ ID NO: 1096324 - RNA, 23 nt, Human
uggcuacaggggugagcgagaug

SEQ ID NO: 1096325 - RNA, 18 nt, Human
ugggaaggagauggaugu

SEQ ID NO: 1096326 - RNA, 24 nt, Human
ugggguuucgccauguuggccagg

SEQ ID NO: 1096327 - RNA, 19 nt, Human
ugggucacugagggucuuc

SEQ ID NO: 1096328 - RNA, 25 nt, Human
ugguguccauguccucaggacccag

SEQ ID NO: 1096329 - RNA, 25 nt, Human
ugguguccauguccucaggacccag

SEQ ID NO: 1096330 - RNA, 23 nt, Human
ugguuugguguccauguccucag

SEQ ID NO: 1096331 - RNA, 22 nt, Human
ugugaggccccuggagaaagac

SEQ ID NO: 1096332 - RNA, 24 nt, Human
ugugaggccccuggagaaagacag

SEQ ID NO: 1096333 - RNA, 21 nt, Human
ugugguggcuacaggggugag

SEQ ID NO: 1096334 - RNA, 21 nt, Human
uuacacaugcagaugcuggac

SEQ ID NO: 1096335 - RNA, 22 nt, Human
uuagaacucauuuaaaagcugc

SEQ ID NO: 1096336 - RNA, 25 nt, Human
uuggugaggaugaaaauagagaugc

SEQ ID NO: 1096337 - RNA, 23 nt, Human
uuucgccauguuggccaggcugu

SEQ ID NO: 1096338 - RNA, 19 nt, Human
aacagagaagcucccuaaa

SEQ ID NO: 1096339 - RNA, 22 nt, Human
caaaccccacucccaaaacaga

SEQ ID NO: 1096340 - RNA, 27 nt, Human
caaaccccacucccaaaacagagaagc

SEQ ID NO: 1096341 - RNA, 25 nt, Human
caauugccaggaucccauuacaaag

SEQ ID NO: 1096342 - RNA, 18 nt, Human
caccaucugcaccgagau

SEQ ID NO: 1096343 - RNA, 21 nt, Human
caccgagaucaucaaacccca

SEQ ID NO: 1096344 - RNA, 21 nt, Human
cagcaauugccaggaucccau

SEQ ID NO: 1096345 - RNA, 19 nt, Human
caucaaaccccacucccaa

SEQ ID NO: 1096346 - RNA, 23 nt, Human
ccccacucccaaaacagagaagc

SEQ ID NO: 1096347 - RNA, 23 nt, Human
ccgagaucaucaaaccccacucc

SEQ ID NO: 1096348 - RNA, 24 nt, Human
gaaggcacccacucaggaaagcac

SEQ ID NO: 1096349 - RNA, 21 nt, Human
gagagaaagaaaucaguggga

SEQ ID NO: 1096350 - RNA, 23 nt, Human
gcagcaauugccaggaucccauu

SEQ ID NO: 1096351 - RNA, 21 nt, Human
gcccccagcaggaugcuuggc

SEQ ID NO: 1096352 - RNA, 20 nt, Human
uacaaagugggagaaggcac

SEQ ID NO: 1096353 - RNA, 23 nt, Human
ugcaccgagaucaucaaacccca

SEQ ID NO: 1096354 - RNA, 27 nt, Human
ugcaccgagaucaucaaaccccacucc

SEQ ID NO: 1096355 - RNA, 20 nt, Human
ugcucaauggagagaaagaa

SEQ ID NO: 1096356 - RNA, 23 nt, Human
ugggagaaggcacccacucagga

SEQ ID NO: 1096357 - RNA, 22 nt, Human
uuugaagcccccagcaggaugc

SEQ ID NO: 1096358 - RNA, 18 nt, Human
ugaguuuuugcaugugca

SEQ ID NO: 1096359 - RNA, 18 nt, Human
aagugcugggauuacagg

SEQ ID NO: 1096360 - RNA, 18 nt, Human
aagugcugggauuacagg

SEQ ID NO: 1096361 - RNA, 18 nt, Human
aagugcugggauuacagg

SEQ ID NO: 1096362 - RNA, 19 nt, Human
aagugcugggauuacaggu

SEQ ID NO: 1096363 - RNA, 20 nt, Human
aagugcugggauuacaggug

SEQ ID NO: 1096364 - RNA, 21 nt, Human
aagugcugggauuacaggugu

SEQ ID NO: 1096365 - RNA, 23 nt, Human
aagugcugggauuacagguguga

SEQ ID NO: 1096366 - RNA, 26 nt, Human
aagugcugggauuacaggugugagcc

SEQ ID NO: 1096367 - RNA, 25 nt, Human
auacuggacacguggcagggaaagg

SEQ ID NO: 1096368 - RNA, 21 nt, Human
caccucuucccccugcucuga

SEQ ID NO: 1096369 - RNA, 23 nt, Human
ccagggucucuuugcuuauuccu

SEQ ID NO: 1096370 - RNA, 19 nt, Human
cgcccuuggguccaggguc

SEQ ID NO: 1096371 - RNA, 22 nt, Human
cuggacacguggcagggaaagg

SEQ ID NO: 1096372 - RNA, 18 nt, Human
cuuauuccugcgccaauc

SEQ ID NO: 1096373 - RNA, 18 nt, Human
gauuacaggugugagcca

SEQ ID NO: 1096374 - RNA, 21 nt, Human
gauuacaggugugagccaccg

SEQ ID NO: 1096375 - RNA, 24 nt, Human
gauuacaggugugagccaccgugc

SEQ ID NO: 1096376 - RNA, 19 nt, Human
gcuuauuccugcgccaauc

SEQ ID NO: 1096377 - RNA, 20 nt, Human
gucucuuugcuuauuccugg

SEQ ID NO: 1096378 - RNA, 24 nt, Human
uacaggugugagccaccgugccca

SEQ ID NO: 1096379 - RNA, 18 nt, Human
uccagggucucuuugcuu

SEQ ID NO: 1096380 - RNA, 19 nt, Human
ucugucaguguccaacuga

SEQ ID NO: 1096381 - RNA, 24 nt, Human
ugcugggauuacaggugugagcca

SEQ ID NO: 1096382 - RNA, 18 nt, Human
ugggauuacaggugugag

SEQ ID NO: 1096383 - RNA, 21 nt, Human
ugggauuacaggugugagcca

SEQ ID NO: 1096384 - RNA, 22 nt, Human
ugggauuacaggugugagccac

SEQ ID NO: 1096385 - RNA, 23 nt, Human
ugggauuacaggugugagccacc

SEQ ID NO: 1096386 - RNA, 23 nt, Human
ugggauuacaggugugagccacc

SEQ ID NO: 1096387 - RNA, 24 nt, Human
ugggauuacaggugugagccaccg

SEQ ID NO: 1096388 - RNA, 28 nt, Human
ugugagccaccgugcccagccugcucug

SEQ ID NO: 1096389 - RNA, 21 nt, Human
uguggggauggggucacuuuu

SEQ ID NO: 1096390 - RNA, 21 nt, Human
uguggggauggggucacuuuu

SEQ ID NO: 1096391 - RNA, 23 nt, Human
aaaaggcaaaccacaaaauggag

SEQ ID NO: 1096392 - RNA, 24 nt, Human
aaaaggcaaaccacaaaauggagg

SEQ ID NO: 1096393 - RNA, 26 nt, Human
aaacacaccugaguucagggaccagg

SEQ ID NO: 1096394 - RNA, 27 nt, Human
aaaccaccaugagaacacacuccccaa

SEQ ID NO: 1096395 - RNA, 21 nt, Human
aaaugccuuucagacgugccc

SEQ ID NO: 1096396 - RNA, 27 nt, Human
aacacacuccccaaacggcuggcgacc

SEQ ID NO: 1096397 - RNA, 22 nt, Human
aaugaugcugucacucaaagcc

SEQ ID NO: 1096398 - RNA, 24 nt, Human
acacacuccccaaacggcuggcga

SEQ ID NO: 1096399 - RNA, 20 nt, Human
accacugcugucacucaaau

SEQ ID NO: 1096400 - RNA, 22 nt, Human
agacucacaccugaaaccacca

SEQ ID NO: 1096401 - RNA, 20 nt, Human
agcaggaggaaucggagcuu

SEQ ID NO: 1096402 - RNA, 21 nt, Human
agcaggaggaaucggagcuug

SEQ ID NO: 1096403 - RNA, 23 nt, Human
agcaggaggaaucggagcuuggu

SEQ ID NO: 1096404 - RNA, 19 nt, Human
agccgagcagcugggcccu

SEQ ID NO: 1096405 - RNA, 21 nt, Human
augaaaaggcaaaccacaaaa

SEQ ID NO: 1096406 - RNA, 20 nt, Human
augaugcugucacucaaagc

SEQ ID NO: 1096407 - RNA, 22 nt, Human
caaaccacaaaauggaggaaga

SEQ ID NO: 1096408 - RNA, 26 nt, Human
cacaccugaaaccaccaugagaacac

SEQ ID NO: 1096409 - RNA, 23 nt, Human
cacagcagguguccagaaaugcc

SEQ ID NO: 1096410 - RNA, 24 nt, Human
caccacaucagaauccauuacacc

SEQ ID NO: 1096411 - RNA, 18 nt, Human
caccaccuaccacugcug

SEQ ID NO: 1096412 - RNA, 19 nt, Human
caccaugagaacacacucc

SEQ ID NO: 1096413 - RNA, 24 nt, Human
caccaugagaacacacuccccaaa

SEQ ID NO: 1096414 - RNA, 18 nt, Human
caccuccugaacaaguuc

SEQ ID NO: 1096415 - RNA, 22 nt, Human
caccugaaaccaccaugagaac

SEQ ID NO: 1096416 - RNA, 19 nt, Human
cacucaaaugaugcuguca

SEQ ID NO: 1096417 - RNA, 24 nt, Human
cacugcugucacucaaaugaugcu

SEQ ID NO: 1096418 - RNA, 18 nt, Human
cagcugggcccucuggcu

SEQ ID NO: 1096419 - RNA, 21 nt, Human
caggaggaaucggagcuuggc

SEQ ID NO: 1096420 - RNA, 22 nt, Human
caucauccagagaagcugagga

SEQ ID NO: 1096421 - RNA, 23 nt, Human
ccagcccagugugagggagccga

SEQ ID NO: 1096422 - RNA, 18 nt, Human
ccaggccagcccagugcg

SEQ ID NO: 1096423 - RNA, 19 nt, Human
cccaccccugcaauggagu

SEQ ID NO: 1096424 - RNA, 22 nt, Human
cccagugcguguugacaccguc

SEQ ID NO: 1096425 - RNA, 23 nt, Human
ccccaaacggcuggcgaccaagu

SEQ ID NO: 1096426 - RNA, 20 nt, Human
cccccaccacaucagaaucc

SEQ ID NO: 1096427 - RNA, 22 nt, Human
cccccaccacaucagaauccau

SEQ ID NO: 1096428 - RNA, 18 nt, Human
ccccgggucccuggaugc

SEQ ID NO: 1096429 - RNA, 25 nt, Human
ccccgggucccuggaugcuuaaucu

SEQ ID NO: 1096430 - RNA, 21 nt, Human
ccccugcaauggagugagggc

SEQ ID NO: 1096431 - RNA, 22 nt, Human
cccucuggcucugggcauguuc

SEQ ID NO: 1096432 - RNA, 26 nt, Human
ccgucuuaaacaagacucuguuaaaa

SEQ ID NO: 1096433 - RNA, 26 nt, Human
ccuaccacugcugucacucaaaugau

SEQ ID NO: 1096434 - RNA, 19 nt, Human
ccugaacaaguuccugaag

SEQ ID NO: 1096435 - RNA, 18 nt, Human
ccugcaauggagugaggg

SEQ ID NO: 1096436 - RNA, 24 nt, Human
ccuuggccaggucaccuacucucc

SEQ ID NO: 1096437 - RNA, 21 nt, Human
cgccagagaggaaggaacucc

SEQ ID NO: 1096438 - RNA, 19 nt, Human
cggagcuuggcugcgcccc

SEQ ID NO: 1096439 - RNA, 24 nt, Human
cgugcaguaggccgguggggaacc

SEQ ID NO: 1096440 - RNA, 20 nt, Human
cucacaccugaaaccaccau

SEQ ID NO: 1096441 - RNA, 23 nt, Human
cuccugaacaaguuccugaagac

SEQ ID NO: 1096442 - RNA, 18 nt, Human
cuccuguaugaggccaca

SEQ ID NO: 1096443 - RNA, 21 nt, Human
cugugugcuggccuuggccag

SEQ ID NO: 1096444 - RNA, 24 nt, Human
cuuguccugugugcuggccuuggc

SEQ ID NO: 1096445 - RNA, 21 nt, Human
gcacgggggguuguuggucag

SEQ ID NO: 1096446 - RNA, 18 nt, Human
gcagagugguggacacaa

SEQ ID NO: 1096447 - RNA, 22 nt, Human
gccgagcagcugggcccucugg

SEQ ID NO: 1096448 - RNA, 18 nt, Human
gcgaccaagugcccagcc

SEQ ID NO: 1096449 - RNA, 22 nt, Human
gcucugggcauguuccugggca

SEQ ID NO: 1096450 - RNA, 22 nt, Human
ggaugcagccacacccacgacc

SEQ ID NO: 1096451 - RNA, 20 nt, Human
ggcgaccaagugcccagccc

SEQ ID NO: 1096452 - RNA, 25 nt, Human
uaaacaagacucuguuaaaacuaga

SEQ ID NO: 1096453 - RNA, 27 nt, Human
ucacaguccuugguccuuggucccugg

SEQ ID NO: 1096454 - RNA, 20 nt, Human
ucauccagagaagcugagga

SEQ ID NO: 1096455 - RNA, 20 nt, Human
ucccuggaugcuuaaucuug

SEQ ID NO: 1096456 - RNA, 20 nt, Human
ucccuugucucucugcucua

SEQ ID NO: 1096457 - RNA, 21 nt, Human
ucuggcucugggcauguuccu

SEQ ID NO: 1096458 - RNA, 24 nt, Human
ucuguccuuccucccuugucucuc

SEQ ID NO: 1096459 - RNA, 25 nt, Human
ugaaaaggcaaaccacaaaauggag

SEQ ID NO: 1096460 - RNA, 18 nt, Human
ugaagacagcccggcaga

SEQ ID NO: 1096461 - RNA, 18 nt, Human
ugagaaacaccgccagag

SEQ ID NO: 1096462 - RNA, 18 nt, Human
ugagaacacacuccccaa

SEQ ID NO: 1096463 - RNA, 20 nt, Human
ugagaacacacuccccaaac

SEQ ID NO: 1096464 - RNA, 18 nt, Human
ugaugagaaacaccgcca

SEQ ID NO: 1096465 - RNA, 23 nt, Human
ugcaaaacauuaaaccaacaaag

SEQ ID NO: 1096466 - RNA, 19 nt, Human
uggcaggacagaggaggga

SEQ ID NO: 1096467 - RNA, 22 nt, Human
uggcgaccaagugcccagccca

SEQ ID NO: 1096468 - RNA, 19 nt, Human
uggcucugggcauguuccu

SEQ ID NO: 1096469 - RNA, 18 nt, Human
ugggcaucauccagagaa

SEQ ID NO: 1096470 - RNA, 22 nt, Human
uuaaacaagacucuguuaaaac

SEQ ID NO: 1096471 - RNA, 19 nt, Human
uugguccuugggcccagca

SEQ ID NO: 1096472 - RNA, 24 nt, Human
aaaauguugagauuacaagcauga

SEQ ID NO: 1096473 - RNA, 18 nt, Human
aaacccaggaccuagcga

SEQ ID NO: 1096474 - RNA, 24 nt, Human
aaagugcugggauuacaggcguga

SEQ ID NO: 1096475 - RNA, 26 nt, Human
aaauguugagauuacaagcaugagcc

SEQ ID NO: 1096476 - RNA, 22 nt, Human
aacaugcucauaucugucaaaa

SEQ ID NO: 1096477 - RNA, 18 nt, Human
aagagagaacacgacaca

SEQ ID NO: 1096478 - RNA, 18 nt, Human
aagcaugagccaccaagc

SEQ ID NO: 1096479 - RNA, 21 nt, Human
aagcaugagccaccaagcccg

SEQ ID NO: 1096480 - RNA, 25 nt, Human
aagugauucucgugccucagccucc

SEQ ID NO: 1096481 - RNA, 19 nt, Human
aagugcugggauuacaggc

SEQ ID NO: 1096482 - RNA, 19 nt, Human
aagugcugggauuacaggc

SEQ ID NO: 1096483 - RNA, 26 nt, Human
aagugcugggauuacaggcgugagcc

SEQ ID NO: 1096484 - RNA, 26 nt, Human
aauggcucccucuuguccucucuugg

SEQ ID NO: 1096485 - RNA, 20 nt, Human
acaagagagaacacgacaca

SEQ ID NO: 1096486 - RNA, 22 nt, Human
acaagagagaacacgacacaga

SEQ ID NO: 1096487 - RNA, 26 nt, Human
acacagaggugcuaaacggcgccaag

SEQ ID NO: 1096488 - RNA, 20 nt, Human
acagagcaauggaccaaugg

SEQ ID NO: 1096489 - RNA, 21 nt, Human
acaggcacccgccaccaugcc

SEQ ID NO: 1096490 - RNA, 20 nt, Human
acauuggccaggcuggucuu

SEQ ID NO: 1096491 - RNA, 19 nt, Human
accaggcuggagugcagug

SEQ ID NO: 1096492 - RNA, 18 nt, Human
acgccacaugcccucagc

SEQ ID NO: 1096493 - RNA, 24 nt, Human
acggaguuuugcucuguugcccag

SEQ ID NO: 1096494 - RNA, 20 nt, Human
acgggguuucacuacauugg

SEQ ID NO: 1096495 - RNA, 24 nt, Human
acgggguuucacuacauuggccag

SEQ ID NO: 1096496 - RNA, 23 nt, Human
agaugaucuccaacuuacgaagg

SEQ ID NO: 1096497 - RNA, 19 nt, Human
agauuacaagcaugagcca

SEQ ID NO: 1096498 - RNA, 27 nt, Human
agccagucccccagcgagggucaacac

SEQ ID NO: 1096499 - RNA, 21 nt, Human
agccuucccuccacagccccc

SEQ ID NO: 1096500 - RNA, 21 nt, Human
agcucaugcaaccuccgccuc

SEQ ID NO: 1096501 - RNA, 21 nt, Human
aggacggaagcacccggcuca

SEQ ID NO: 1096502 - RNA, 19 nt, Human
aggaggcggcugugacggc

SEQ ID NO: 1096503 - RNA, 25 nt, Human
aggcuggagugcaguggugugaucu

SEQ ID NO: 1096504 - RNA, 24 nt, Human
agggccagccagccugcagcccua

SEQ ID NO: 1096505 - RNA, 19 nt, Human
aggguuucgccauguuggc

SEQ ID NO: 1096506 - RNA, 24 nt, Human
aggugauacgcccgccuuggccuc

SEQ ID NO: 1096507 - RNA, 24 nt, Human
aggugaucugcccaccuuggccuc

SEQ ID NO: 1096508 - RNA, 22 nt, Human
aggugcuaaacggcgccaagcc

SEQ ID NO: 1096509 - RNA, 18 nt, Human
agguggguaauggggguu

SEQ ID NO: 1096510 - RNA, 20 nt, Human
aguccugccuuucccagcac

SEQ ID NO: 1096511 - RNA, 19 nt, Human
agugcaguggugugaucuc

SEQ ID NO: 1096512 - RNA, 21 nt, Human
agugcaguggugugaucucag

SEQ ID NO: 1096513 - RNA, 23 nt, Human
agugcaguggugugaucucagcu

SEQ ID NO: 1096514 - RNA, 24 nt, Human
agugcaguggugugaucucagcuc

SEQ ID NO: 1096515 - RNA, 18 nt, Human
agugcugggauuacaggc

SEQ ID NO: 1096516 - RNA, 18 nt, Human
aguggcuccgaggugacc

SEQ ID NO: 1096517 - RNA, 21 nt, Human
aguggcuccgaggugaccugc

SEQ ID NO: 1096518 - RNA, 19 nt, Human
aguggugcaaucucggcuc

SEQ ID NO: 1096519 - RNA, 23 nt, Human
aguggugugaucucagcucaugc

SEQ ID NO: 1096520 - RNA, 26 nt, Human
auaauaaucuccccaaaguaaacucu

SEQ ID NO: 1096521 - RNA, 18 nt, Human
auaggguuucgccauguu

SEQ ID NO: 1096522 - RNA, 24 nt, Human
auaggguuucgccauguuggccag

SEQ ID NO: 1096523 - RNA, 19 nt, Human
aucuccccaaaguaaacuc

SEQ ID NO: 1096524 - RNA, 24 nt, Human
auuuuuguauuuuuaguagagacg

SEQ ID NO: 1096525 - RNA, 25 nt, Human
auuuuuguauuuuuuaguagagaua

SEQ ID NO: 1096526 - RNA, 24 nt, Human
caaaauguugagauuacaagcaug

SEQ ID NO: 1096527 - RNA, 24 nt, Human
caaagugcugggauuacaggcgug

SEQ ID NO: 1096528 - RNA, 23 nt, Human
caagugacucaccugggggcucc

SEQ ID NO: 1096529 - RNA, 22 nt, Human
caagugauucuccugccucggc

SEQ ID NO: 1096530 - RNA, 22 nt, Human
caagugauucucgugccucagc

SEQ ID NO: 1096531 - RNA, 18 nt, Human
cacacaccacccaaaacc

SEQ ID NO: 1096532 - RNA, 21 nt, Human
cacaccacccaaaacccagga

SEQ ID NO: 1096533 - RNA, 19 nt, Human
cacagccuucagcccuccc

SEQ ID NO: 1096534 - RNA, 24 nt, Human
caccaugcccggcuaauuuuugua

SEQ ID NO: 1096535 - RNA, 24 nt, Human
caccaugcccggcuaauuuuugua

SEQ ID NO: 1096536 - RNA, 25 nt, Human
caccccuucauccaaggagaccucu

SEQ ID NO: 1096537 - RNA, 21 nt, Human
cacccuggaccagcaagcugg

SEQ ID NO: 1096538 - RNA, 18 nt, Human
caccgcgcccggcccggc

SEQ ID NO: 1096539 - RNA, 20 nt, Human
cacggaaaacugcaucuaac

SEQ ID NO: 1096540 - RNA, 21 nt, Human
cacuacauuggccaggcuggu

SEQ ID NO: 1096541 - RNA, 24 nt, Human
cacuacauuggccaggcuggucuu

SEQ ID NO: 1096542 - RNA, 22 nt, Human
cacucaccccauaccagggugc

SEQ ID NO: 1096543 - RNA, 21 nt, Human
cacugcaaccucugccucccg

SEQ ID NO: 1096544 - RNA, 23 nt, Human
cacugcaaccucugccucccggg

SEQ ID NO: 1096545 - RNA, 21 nt, Human
cagccagaauugccuaaaaac

SEQ ID NO: 1096546 - RNA, 27 nt, Human
cagccccuccggcucccaguccugccu

SEQ ID NO: 1096547 - RNA, 20 nt, Human
caggacacaaccccauugaa

SEQ ID NO: 1096548 - RNA, 18 nt, Human
caggaccuagcgaagaga

SEQ ID NO: 1096549 - RNA, 27 nt, Human
caggcaccccuucauccaaggagaccu

SEQ ID NO: 1096550 - RNA, 19 nt, Human
caggugauacgcccgcccc

SEQ ID NO: 1096551 - RNA, 25 nt, Human
caguagcugggacuacaggcacccg

SEQ ID NO: 1096552 - RNA, 24 nt, Human
cauguuggccaggcuggucuugaa

SEQ ID NO: 1096553 - RNA, 22 nt, Human
cauuggccaggcuggucuugaa

SEQ ID NO: 1096554 - RNA, 18 nt, Human
ccaaacucuuccucccuc

SEQ ID NO: 1096555 - RNA, 23 nt, Human
ccaaacucuuccucccuccagug

SEQ ID NO: 1096556 - RNA, 22 nt, Human
ccaaaguaaacucugcaaguga

SEQ ID NO: 1096557 - RNA, 20 nt, Human
ccaaagugcugggauuacag

SEQ ID NO: 1096558 - RNA, 22 nt, Human
ccaaagugcugggauuacaggc

SEQ ID NO: 1096559 - RNA, 22 nt, Human
ccaaagugcugggauuacaggc

SEQ ID NO: 1096560 - RNA, 24 nt, Human
ccaaagugcugggauuacaggcgu

SEQ ID NO: 1096561 - RNA, 22 nt, Human
ccaccgcgcccggcccggcaaa

SEQ ID NO: 1096562 - RNA, 22 nt, Human
ccagcaagcuggggcugccuga

SEQ ID NO: 1096563 - RNA, 21 nt, Human
ccaggccaucuggucagugcc

SEQ ID NO: 1096564 - RNA, 22 nt, Human
ccaguagcugggacuacaggca

SEQ ID NO: 1096565 - RNA, 18 nt, Human
ccagucccccagcgaggg

SEQ ID NO: 1096566 - RNA, 19 nt, Human
ccauguuggccaggcuggu

SEQ ID NO: 1096567 - RNA, 21 nt, Human
ccauguuggccaggcuggucu

SEQ ID NO: 1096568 - RNA, 23 nt, Human
cccaaaacccaggaccuagcgaa

SEQ ID NO: 1096569 - RNA, 21 nt, Human
cccaaaguaaacucugcaagu

SEQ ID NO: 1096570 - RNA, 22 nt, Human
cccacugugggaagccugaggc

SEQ ID NO: 1096571 - RNA, 23 nt, Human
cccauguagcugggauuauaggu

SEQ ID NO: 1096572 - RNA, 24 nt, Human
cccauguagcugggauuauaggug

SEQ ID NO: 1096573 - RNA, 23 nt, Human
ccccaaacucuuccucccuccag

SEQ ID NO: 1096574 - RNA, 18 nt, Human
ccccagaaacuccuggcu

SEQ ID NO: 1096575 - RNA, 22 nt, Human
ccccagaaacuccuggcuuuca

SEQ ID NO: 1096576 - RNA, 21 nt, Human
cccccaaacucuuccucccuc

SEQ ID NO: 1096577 - RNA, 22 nt, Human
cccgccuuggccucccaaagug

SEQ ID NO: 1096578 - RNA, 20 nt, Human
cccggguucaagugauucuc

SEQ ID NO: 1096579 - RNA, 20 nt, Human
cccggguucaagugauucuc

SEQ ID NO: 1096580 - RNA, 23 nt, Human
cccggguucaagugauucuccuc

SEQ ID NO: 1096581 - RNA, 23 nt, Human
cccggguucaagugauucuccug

SEQ ID NO: 1096582 - RNA, 26 nt, Human
ccgaagccccuuccccgaggagacca

SEQ ID NO: 1096583 - RNA, 24 nt, Human
ccgccucccggguucaagugauuc

SEQ ID NO: 1096584 - RNA, 24 nt, Human
ccggcggccuuccugucuacuccc

SEQ ID NO: 1096585 - RNA, 24 nt, Human
ccucccggguucaagugauucucc

SEQ ID NO: 1096586 - RNA, 21 nt, Human
ccuccggcucccaguccugcc

SEQ ID NO: 1096587 - RNA, 18 nt, Human
ccucuuguccucucuugg

SEQ ID NO: 1096588 - RNA, 19 nt, Human
ccugaccucaggugauacg

SEQ ID NO: 1096589 - RNA, 22 nt, Human
ccugaccucaggugauacgccc

SEQ ID NO: 1096590 - RNA, 24 nt, Human
ccugaccucaggugaucugcccac

SEQ ID NO: 1096591 - RNA, 23 nt, Human
ccuggaccagcaagcuggggcug

SEQ ID NO: 1096592 - RNA, 19 nt, Human
cgaagccccuuccccgagg

SEQ ID NO: 1096593 - RNA, 18 nt, Human
cgccaagccuucccucca

SEQ ID NO: 1096594 - RNA, 24 nt, Human
cgccauguuggccaggcuggucuu

SEQ ID NO: 1096595 - RNA, 27 nt, Human
cgccauguuggccaggcuggucuugaa

SEQ ID NO: 1096596 - RNA, 19 nt, Human
cgcccggcccggcaaauga

SEQ ID NO: 1096597 - RNA, 24 nt, Human
cgcuggccuugugcacacaccacc

SEQ ID NO: 1096598 - RNA, 24 nt, Human
cggaguuuugcucuguugcccagg

SEQ ID NO: 1096599 - RNA, 23 nt, Human
cguggugaacacuugcgggcgcc

SEQ ID NO: 1096600 - RNA, 24 nt, Human
cuaaaaacaaucguccuccauccu

SEQ ID NO: 1096601 - RNA, 24 nt, Human
cuaccaguagcugggacuacaggc

SEQ ID NO: 1096602 - RNA, 24 nt, Human
cucacugcaaccucugccucccgg

SEQ ID NO: 1096603 - RNA, 24 nt, Human
cucagccucccauguagcugggau

SEQ ID NO: 1096604 - RNA, 24 nt, Human
cucaggugaucugcccaccuuggc

SEQ ID NO: 1096605 - RNA, 24 nt, Human
cucaugcaaccuccgccucccggg

SEQ ID NO: 1096606 - RNA, 21 nt, Human
cucccaguccugccuuuccca

SEQ ID NO: 1096607 - RNA, 20 nt, Human
cucccggguucaagugauuc

SEQ ID NO: 1096608 - RNA, 20 nt, Human
cucccggguucaagugauuc

SEQ ID NO: 1096609 - RNA, 23 nt, Human
cucggccuaccaguagcugggac

SEQ ID NO: 1096610 - RNA, 25 nt, Human
cucgugccucagccucccauguagc

SEQ ID NO: 1096611 - RNA, 21 nt, Human
cucuacacggaauggcucccu

SEQ ID NO: 1096612 - RNA, 18 nt, Human
cucuguugcccaggcugg

SEQ ID NO: 1096613 - RNA, 19 nt, Human
cucuguugcccaggcugga

SEQ ID NO: 1096614 - RNA, 23 nt, Human
cugcaaccucugccucccggguu

SEQ ID NO: 1096615 - RNA, 24 nt, Human
cugcaaccucugccucccggguuc

SEQ ID NO: 1096616 - RNA, 23 nt, Human
cugccucccggguucaagugauu

SEQ ID NO: 1096617 - RNA, 19 nt, Human
cugccucugcccgcagccc

SEQ ID NO: 1096618 - RNA, 24 nt, Human
cuggagugcaguggugugaucuca

SEQ ID NO: 1096619 - RNA, 20 nt, Human
cugucucuuuguccucuucc

SEQ ID NO: 1096620 - RNA, 28 nt, Human
cuuguccucucuuggcaagggccagcca

SEQ ID NO: 1096621 - RNA, 24 nt, Human
gaccaggcuggagugcaguggugu

SEQ ID NO: 1096622 - RNA, 18 nt, Human
gaccuagcgaagagaggc

SEQ ID NO: 1096623 - RNA, 24 nt, Human
gaccucaggugauacgcccgccuu

SEQ ID NO: 1096624 - RNA, 24 nt, Human
gaccucaggugaucugcccaccuu

SEQ ID NO: 1096625 - RNA, 24 nt, Human
gacuacaggcacccgccaccaugc

SEQ ID NO: 1096626 - RNA, 20 nt, Human
gagccaccaagcccggucca

SEQ ID NO: 1096627 - RNA, 18 nt, Human
gauuacaagcaugagcca

SEQ ID NO: 1096628 - RNA, 18 nt, Human
gauuacaggcgugagcca

SEQ ID NO: 1096629 - RNA, 20 nt, Human
gauuacaggcgugagccacc

SEQ ID NO: 1096630 - RNA, 22 nt, Human
gauuacaggcgugagccaccgc

SEQ ID NO: 1096631 - RNA, 22 nt, Human
gauuauaggugccugucaccau

SEQ ID NO: 1096632 - RNA, 21 nt, Human
gauucucgugccucagccucc

SEQ ID NO: 1096633 - RNA, 22 nt, Human
gcaaccuccgccucccggguuc

SEQ ID NO: 1096634 - RNA, 22 nt, Human
gcaaccucugccucccggguuc

SEQ ID NO: 1096635 - RNA, 20 nt, Human
gcaagggccagccagccugc

SEQ ID NO: 1096636 - RNA, 22 nt, Human
gcacacaccacccaaaacccag

SEQ ID NO: 1096637 - RNA, 18 nt, Human
gccagccugcagcccuag

SEQ ID NO: 1096638 - RNA, 21 nt, Human
gccauggagaugaguuggacc

SEQ ID NO: 1096639 - RNA, 24 nt, Human
gccauguuggccaggcuggucuug

SEQ ID NO: 1096640 - RNA, 22 nt, Human
gcccggcuaauuuuuguauuuu

SEQ ID NO: 1096641 - RNA, 22 nt, Human
gcccggcuaauuuuuguauuuu

SEQ ID NO: 1096642 - RNA, 20 nt, Human
gcccucccugucuccugcuc

SEQ ID NO: 1096643 - RNA, 20 nt, Human
gcccugaguggcuccgaggu

SEQ ID NO: 1096644 - RNA, 19 nt, Human
gccucggccuaccaguagc

SEQ ID NO: 1096645 - RNA, 18 nt, Human
gccugaggccaugugaag

SEQ ID NO: 1096646 - RNA, 26 nt, Human
gccuucccuccacagcccccaaacuc

SEQ ID NO: 1096647 - RNA, 22 nt, Human
gccuuggccucccaaagugcug

SEQ ID NO: 1096648 - RNA, 19 nt, Human
gcuccaggccaucugguca

SEQ ID NO: 1096649 - RNA, 25 nt, Human
gcucugucucuuuguccucuuccug

SEQ ID NO: 1096650 - RNA, 20 nt, Human
gcucuguugcccaggcugga

SEQ ID NO: 1096651 - RNA, 24 nt, Human
gcucuguugcccaggcuggaguaa

SEQ ID NO: 1096652 - RNA, 20 nt, Human
gcugcacagccuucagcccu

SEQ ID NO: 1096653 - RNA, 23 nt, Human
gcuggucuugaacuccugaccuc

SEQ ID NO: 1096654 - RNA, 23 nt, Human
gcuggucuugaacuccugaccuc

SEQ ID NO: 1096655 - RNA, 18 nt, Human
ggacggaagcacccggcu

SEQ ID NO: 1096656 - RNA, 24 nt, Human
ggagagccggcagcagagcccgag

SEQ ID NO: 1096657 - RNA, 25 nt, Human
ggagcaccugggguggggcgaaguc

SEQ ID NO: 1096658 - RNA, 22 nt, Human
ggagccccuucugugggcgccc

SEQ ID NO: 1096659 - RNA, 23 nt, Human
ggagccccuucugugggcgcccu

SEQ ID NO: 1096660 - RNA, 20 nt, Human
ggcccggcaaaugaauucuu

SEQ ID NO: 1096661 - RNA, 22 nt, Human
ggcuggagugcaguggugugau

SEQ ID NO: 1096662 - RNA, 24 nt, Human
ggcuggucuugaacuccugaccuc

SEQ ID NO: 1096663 - RNA, 24 nt, Human
ggcuggucuugaacuccugaccuc

SEQ ID NO: 1096664 - RNA, 18 nt, Human
gggggcauuaagugcuuu

SEQ ID NO: 1096665 - RNA, 23 nt, Human
gggguuucacuacauuggccagg

SEQ ID NO: 1096666 - RNA, 22 nt, Human
ggguucaagugauucuccugcc

SEQ ID NO: 1096667 - RNA, 22 nt, Human
ggguuucacuacauuggccagg

SEQ ID NO: 1096668 - RNA, 21 nt, Human
ggguuucgccauguuggccag

SEQ ID NO: 1096669 - RNA, 22 nt, Human
ggguuucgccauguuggccagg

SEQ ID NO: 1096670 - RNA, 19 nt, Human
ggucuugaacuccugaccu

SEQ ID NO: 1096671 - RNA, 19 nt, Human
ggucuugaacuccugaccu

SEQ ID NO: 1096672 - RNA, 24 nt, Human
ggugauacgcccgccuuggccucc

SEQ ID NO: 1096673 - RNA, 18 nt, Human
guagcugggacuacaggc

SEQ ID NO: 1096674 - RNA, 24 nt, Human
guagcugggauuauaggugccugu

SEQ ID NO: 1096675 - RNA, 24 nt, Human
gugauucucgugccucagccuccc

SEQ ID NO: 1096676 - RNA, 21 nt, Human
gugcacacaccacccaaaacc

SEQ ID NO: 1096677 - RNA, 23 nt, Human
gugccucagccucccauguagcu

SEQ ID NO: 1096678 - RNA, 22 nt, Human
guggugaacacuugcgggcgcc

SEQ ID NO: 1096679 - RNA, 19 nt, Human
guugaccaggcuggagugc

SEQ ID NO: 1096680 - RNA, 24 nt, Human
guuuugcucuguugcccaggcugg

SEQ ID NO: 1096681 - RNA, 22 nt, Human
uaaguggugcaaucucggcuca

SEQ ID NO: 1096682 - RNA, 24 nt, Human
uaauuuuuguauuuuuaguagaga

SEQ ID NO: 1096683 - RNA, 25 nt, Human
uaauuuuuguauuuuuuaguagaga

SEQ ID NO: 1096684 - RNA, 20 nt, Human
uacaagcaugagccaccaag

SEQ ID NO: 1096685 - RNA, 23 nt, Human
uacaggcacccgccaccaugccc

SEQ ID NO: 1096686 - RNA, 23 nt, Human
uacaggcgugagccaccgcgccc

SEQ ID NO: 1096687 - RNA, 24 nt, Human
uacauuggccaggcuggucuugaa

SEQ ID NO: 1096688 - RNA, 22 nt, Human
uacccagagcacgccacaugcc

SEQ ID NO: 1096689 - RNA, 26 nt, Human
uaccccauuuauccauuucccuuuca

SEQ ID NO: 1096690 - RNA, 22 nt, Human
uagagauaggguuucgccaugu

SEQ ID NO: 1096691 - RNA, 20 nt, Human
uaggcacccucacucacccc

SEQ ID NO: 1096692 - RNA, 21 nt, Human
uaggcacccucacucacccca

SEQ ID NO: 1096693 - RNA, 24 nt, Human
uaggguuucgccauguuggccagg

SEQ ID NO: 1096694 - RNA, 19 nt, Human
uaggugccugucaccaugc

SEQ ID NO: 1096695 - RNA, 23 nt, Human
uaguagagacgggguuucacuac

SEQ ID NO: 1096696 - RNA, 24 nt, Human
uaguagagacgggguuucacuaca

SEQ ID NO: 1096697 - RNA, 24 nt, Human
uaguagagauaggguuucgccaug

SEQ ID NO: 1096698 - RNA, 19 nt, Human
ucaagugauucuccugccu

SEQ ID NO: 1096699 - RNA, 24 nt, Human
ucacugcaaccucugccucccggg

SEQ ID NO: 1096700 - RNA, 25 nt, Human
ucacugcaaccucugccucccgggu

SEQ ID NO: 1096701 - RNA, 23 nt, Human
ucagcccucccugucuccugcuc

SEQ ID NO: 1096702 - RNA, 28 nt, Human
ucaggagccccuucugugggcgcccucu

SEQ ID NO: 1096703 - RNA, 18 nt, Human
ucaggucuagcuccaggc

SEQ ID NO: 1096704 - RNA, 23 nt, Human
ucagugcccacuucugagccaag

SEQ ID NO: 1096705 - RNA, 23 nt, Human
ucaugcaaccuccgccucccggg

SEQ ID NO: 1096706 - RNA, 24 nt, Human
uccacagcccccaaacucuuccuc

SEQ ID NO: 1096707 - RNA, 22 nt, Human
uccaguggcugggaaaccccag

SEQ ID NO: 1096708 - RNA, 24 nt, Human
ucccaaagugcugggauuacaggc

SEQ ID NO: 1096709 - RNA, 23 nt, Human
ucccauguagcugggauuauagg

SEQ ID NO: 1096710 - RNA, 18 nt, Human
uccccgaggagaccaggc

SEQ ID NO: 1096711 - RNA, 21 nt, Human
ucccggguucaagugauucuc

SEQ ID NO: 1096712 - RNA, 21 nt, Human
ucccggguucaagugauucuc

SEQ ID NO: 1096713 - RNA, 24 nt, Human
ucccggguucaagugauucuccug

SEQ ID NO: 1096714 - RNA, 24 nt, Human
ucccggguucaagugauucucgug

SEQ ID NO: 1096715 - RNA, 20 nt, Human
ucccuccaguggcugggaaa

SEQ ID NO: 1096716 - RNA, 22 nt, Human
ucgccauguuggccaggcuggu

SEQ ID NO: 1096717 - RNA, 24 nt, Human
ucgccauguuggccaggcuggucu

SEQ ID NO: 1096718 - RNA, 22 nt, Human
ucuaacccugacacacacaggc

SEQ ID NO: 1096719 - RNA, 19 nt, Human
ucuacaagugacucaccug

SEQ ID NO: 1096720 - RNA, 22 nt, Human
ucuacacggaauggcucccucu

SEQ ID NO: 1096721 - RNA, 19 nt, Human
ucucaggccagccagaauu

SEQ ID NO: 1096722 - RNA, 23 nt, Human
ucuccaacuuacgaagguuugac

SEQ ID NO: 1096723 - RNA, 23 nt, Human
ucuccccaaaguaaacucugcaa

SEQ ID NO: 1096724 - RNA, 24 nt, Human
ucugcccaccuuggccucccaaaa

SEQ ID NO: 1096725 - RNA, 21 nt, Human
ucugucucuuuguccucuucc

SEQ ID NO: 1096726 - RNA, 19 nt, Human
ucuguugaccaggcuggag

SEQ ID NO: 1096727 - RNA, 18 nt, Human
ucuguugcccaggcugga

SEQ ID NO: 1096728 - RNA, 23 nt, Human
ucuugaacuccugaccucaggug

SEQ ID NO: 1096729 - RNA, 23 nt, Human
ucuugaacuccugaccucaggug

SEQ ID NO: 1096730 - RNA, 22 nt, Human
ucuugcucuguugaccaggcug

SEQ ID NO: 1096731 - RNA, 23 nt, Human
ucuugcucuguugaccaggcugg

SEQ ID NO: 1096732 - RNA, 24 nt, Human
ucuugcucuguugaccaggcugga

SEQ ID NO: 1096733 - RNA, 24 nt, Human
ugaccaggcuggagugcaguggug

SEQ ID NO: 1096734 - RNA, 18 nt, Human
ugaccucaggugauacgc

SEQ ID NO: 1096735 - RNA, 24 nt, Human
ugaccucaggugauacgcccgccu

SEQ ID NO: 1096736 - RNA, 18 nt, Human
ugaccucaggugaucugc

SEQ ID NO: 1096737 - RNA, 20 nt, Human
ugaccucaggugaucugccc

SEQ ID NO: 1096738 - RNA, 21 nt, Human
ugaccucaggugaucugccca

SEQ ID NO: 1096739 - RNA, 24 nt, Human
ugaccucaggugaucugcccaccu

SEQ ID NO: 1096740 - RNA, 22 nt, Human
ugagauggagucuugcucuguu

SEQ ID NO: 1096741 - RNA, 22 nt, Human
ugagauuacaagcaugagccac

SEQ ID NO: 1096742 - RNA, 24 nt, Human
ugagauuacaagcaugagccacca

SEQ ID NO: 1096743 - RNA, 24 nt, Human
ugaucugcccaccuuggccuccca

SEQ ID NO: 1096744 - RNA, 20 nt, Human
ugauucuccugccucggccu

SEQ ID NO: 1096745 - RNA, 18 nt, Human
ugcacacaccacccaaaa

SEQ ID NO: 1096746 - RNA, 19 nt, Human
ugcacacaccacccaaaac

SEQ ID NO: 1096747 - RNA, 19 nt, Human
ugcacacaccacccaaaac

SEQ ID NO: 1096748 - RNA, 22 nt, Human
ugcaguggugugaucucagcuc

SEQ ID NO: 1096749 - RNA, 20 nt, Human
ugcccaggcuggaguaagug

SEQ ID NO: 1096750 - RNA, 23 nt, Human
ugcccaggcuggaguaaguggug

SEQ ID NO: 1096751 - RNA, 24 nt, Human
ugcccggcuaauuuuuguauuuuu

SEQ ID NO: 1096752 - RNA, 25 nt, Human
ugcccggcuaauuuuuguauuuuuu

SEQ ID NO: 1096753 - RNA, 22 nt, Human
ugcccucagcucccugaggccu

SEQ ID NO: 1096754 - RNA, 24 nt, Human
ugccucagccucccauguagcugg

SEQ ID NO: 1096755 - RNA, 20 nt, Human
ugccucggccuaccaguagc

SEQ ID NO: 1096756 - RNA, 18 nt, Human
ugccucugcccgcagccc

SEQ ID NO: 1096757 - RNA, 22 nt, Human
ugcucuguugcccaggcuggag

SEQ ID NO: 1096758 - RNA, 24 nt, Human
ugcugggauuacaggcgugagcca

SEQ ID NO: 1096759 - RNA, 19 nt, Human
uggagugcaguggugugau

SEQ ID NO: 1096760 - RNA, 24 nt, Human
uggagugcaguggugugaucucag

SEQ ID NO: 1096761 - RNA, 24 nt, Human
uggcaagggccagccagccugcag

SEQ ID NO: 1096762 - RNA, 24 nt, Human
uggccaggcuggucuugaacuccu

SEQ ID NO: 1096763 - RNA, 24 nt, Human
uggccaggcuggucuugaacuccu

SEQ ID NO: 1096764 - RNA, 20 nt, Human
ugggaagccugaggccaugu

SEQ ID NO: 1096765 - RNA, 21 nt, Human
ugggacuacaggcacccgcca

SEQ ID NO: 1096766 - RNA, 22 nt, Human
ugggacuacaggcacccgccac

SEQ ID NO: 1096767 - RNA, 24 nt, Human
ugggacuacaggcacccgccacca

SEQ ID NO: 1096768 - RNA, 25 nt, Human
ugggacuacaggcacccgccaccau

SEQ ID NO: 1096769 - RNA, 18 nt, Human
ugggauuacaggcgugag

SEQ ID NO: 1096770 - RNA, 19 nt, Human
ugggauuacaggcgugagc

SEQ ID NO: 1096771 - RNA, 21 nt, Human
ugggauuacaggcgugagcca

SEQ ID NO: 1096772 - RNA, 22 nt, Human
ugggauuacaggcgugagccac

SEQ ID NO: 1096773 - RNA, 23 nt, Human
ugggauuacaggcgugagccacc

SEQ ID NO: 1096774 - RNA, 24 nt, Human
ugggauuacaggcgugagccaccg

SEQ ID NO: 1096775 - RNA, 22 nt, Human
ugggauuauaggugccugucac

SEQ ID NO: 1096776 - RNA, 24 nt, Human
ugggauuauaggugccugucacca

SEQ ID NO: 1096777 - RNA, 25 nt, Human
ugggauuauaggugccugucaccau

SEQ ID NO: 1096778 - RNA, 24 nt, Human
ugggcgcccucuaggcacccuuuu

SEQ ID NO: 1096779 - RNA, 20 nt, Human
ugggggagggaaaggaucag

SEQ ID NO: 1096780 - RNA, 19 nt, Human
uggggugggggaccuuggg

SEQ ID NO: 1096781 - RNA, 21 nt, Human
uggggugggggaccuuggggu

SEQ ID NO: 1096782 - RNA, 22 nt, Human
uggggugggggaccuugggguu

SEQ ID NO: 1096783 - RNA, 20 nt, Human
ugggguugggggagggaaag

SEQ ID NO: 1096784 - RNA, 26 nt, Human
uggguggccaugcgcggagcaccugg

SEQ ID NO: 1096785 - RNA, 18 nt, Human
uguagcugggauuauagg

SEQ ID NO: 1096786 - RNA, 21 nt, Human
uguauuuuuaguagagacggg

SEQ ID NO: 1096787 - RNA, 20 nt, Human
ugugaaggggacccccuggg

SEQ ID NO: 1096788 - RNA, 18 nt, Human
ugugcacacaccacccaa

SEQ ID NO: 1096789 - RNA, 21 nt, Human
uguugaccaggcuggagugca

SEQ ID NO: 1096790 - RNA, 24 nt, Human
uguugagauuacaagcaugagcca

SEQ ID NO: 1096791 - RNA, 19 nt, Human
uguugcccaggcuggagua

SEQ ID NO: 1096792 - RNA, 18 nt, Human
uuaguagagacgggguuu

SEQ ID NO: 1096793 - RNA, 21 nt, Human
uuaguagagacgggguuucac

SEQ ID NO: 1096794 - RNA, 22 nt, Human
uuaguagagacgggguuucacu

SEQ ID NO: 1096795 - RNA, 18 nt, Human
uuaguagagauaggguuu

SEQ ID NO: 1096796 - RNA, 22 nt, Human
uuaguagagauaggguuucgcc

SEQ ID NO: 1096797 - RNA, 24 nt, Human
uuaguagagauaggguuucgccau

SEQ ID NO: 1096798 - RNA, 21 nt, Human
uucaagugauucuccugccuc

SEQ ID NO: 1096799 - RNA, 21 nt, Human
uucaagugauucuccugccuc

SEQ ID NO: 1096800 - RNA, 25 nt, Human
uucaagugauucuccugccucggcc

SEQ ID NO: 1096801 - RNA, 23 nt, Human
uucaagugauucucgugccucag

SEQ ID NO: 1096802 - RNA, 20 nt, Human
uuccccgaggagaccaggcc

SEQ ID NO: 1096803 - RNA, 21 nt, Human
uugagauggagucuugcucug

SEQ ID NO: 1096804 - RNA, 18 nt, Human
uugcgggcgccugugagg

SEQ ID NO: 1096805 - RNA, 22 nt, Human
uugcucuguugcccaggcugga

SEQ ID NO: 1096806 - RNA, 24 nt, Human
uugcucuguugcccaggcuggagu

SEQ ID NO: 1096807 - RNA, 18 nt, Human
uuggccucccaaagugcu

SEQ ID NO: 1096808 - RNA, 24 nt, Human
uugugcacacaccacccaaaaccc

SEQ ID NO: 1096809 - RNA, 24 nt, Human
uuucgccauguuggccaggcuggu

SEQ ID NO: 1096810 - RNA, 19 nt, Human
uuugggcucauccaugggg

SEQ ID NO: 1096811 - RNA, 23 nt, Human
uuuguucacacuaaauauacauu

SEQ ID NO: 1096812 - RNA, 24 nt, Human
uuuugcucuguugcccaggcugga

SEQ ID NO: 1096813 - RNA, 24 nt, Human
uuuuuaguagagacgggguuucac

SEQ ID NO: 1096814 - RNA, 24 nt, Human
uuuuuaguagagauaggguuucgc

SEQ ID NO: 1096815 - RNA, 20 nt, Human
uuuuuguauuuuuaguagag

SEQ ID NO: 1096816 - RNA, 21 nt, Human
uuuuuguauuuuuuaguagag

SEQ ID NO: 1096817 - RNA, 24 nt, Human
uuuuuuaguagagauaggguuucg

SEQ ID NO: 1096818 - RNA, 24 nt, Human
uuuuuuuuuuuugagauggagucu

SEQ ID NO: 1096819 - RNA, 22 nt, Human
uuuuuuuuuuuuuugagaugga

SEQ ID NO: 1096820 - RNA, 18 nt, Human
uuuuuuuuuuuuuuuuug

SEQ ID NO: 1096821 - RNA, 24 nt, Human
aaaaaauuccccccuugaggauca

SEQ ID NO: 1096822 - RNA, 21 nt, Human
aaacaucaucacaagcaagcc

SEQ ID NO: 1096823 - RNA, 22 nt, Human
aaagaggcaguucuggcggccc

SEQ ID NO: 1096824 - RNA, 20 nt, Human
aaggaaaugaggccgagagg

SEQ ID NO: 1096825 - RNA, 21 nt, Human
aaggaaaugaggccgagaggu

SEQ ID NO: 1096826 - RNA, 23 nt, Human
aaggaaaugaggccgagagguuc

SEQ ID NO: 1096827 - RNA, 19 nt, Human
acagcucagccauugcucc

SEQ ID NO: 1096828 - RNA, 21 nt, Human
accacuaaaggcauccaagac

SEQ ID NO: 1096829 - RNA, 22 nt, Human
acccauccaccaugccuccccu

SEQ ID NO: 1096830 - RNA, 20 nt, Human
accucauuuggaaauaggau

SEQ ID NO: 1096831 - RNA, 19 nt, Human
accuccccuccuguuccac

SEQ ID NO: 1096832 - RNA, 20 nt, Human
accucucuucuuucccuuug

SEQ ID NO: 1096833 - RNA, 21 nt, Human
accugcccacacugccccucc

SEQ ID NO: 1096834 - RNA, 18 nt, Human
acuaaaggcauccaagac

SEQ ID NO: 1096835 - RNA, 20 nt, Human
agauuccuuuucuuuuucuu

SEQ ID NO: 1096836 - RNA, 19 nt, Human
agccaaacaccugugaccc

SEQ ID NO: 1096837 - RNA, 19 nt, Human
aggaggggaaagaggcagu

SEQ ID NO: 1096838 - RNA, 20 nt, Human
aggucacuguccaggacucc

SEQ ID NO: 1096839 - RNA, 23 nt, Human
auccccauuuugcagauaaggaa

SEQ ID NO: 1096840 - RNA, 22 nt, Human
caacuccucugccagggccccc

SEQ ID NO: 1096841 - RNA, 21 nt, Human
caagccaaacaccugugaccc

SEQ ID NO: 1096842 - RNA, 25 nt, Human
cacaagcaagccuuccagcaaggug

SEQ ID NO: 1096843 - RNA, 22 nt, Human
cacccugucuuuccuugccauu

SEQ ID NO: 1096844 - RNA, 21 nt, Human
caccucuuuucuccuggcggg

SEQ ID NO: 1096845 - RNA, 19 nt, Human
caccugcaaacucuccagc

SEQ ID NO: 1096846 - RNA, 20 nt, Human
caccugugacccauccacca

SEQ ID NO: 1096847 - RNA, 24 nt, Human
caccuucucuguucucccccuacc

SEQ ID NO: 1096848 - RNA, 23 nt, Human
cacucccuuccuccuucuugcca

SEQ ID NO: 1096849 - RNA, 22 nt, Human
cacugucagcucccugcacccc

SEQ ID NO: 1096850 - RNA, 18 nt, Human
cagcaaagugagccccgc

SEQ ID NO: 1096851 - RNA, 18 nt, Human
cagcaaggugagccccac

SEQ ID NO: 1096852 - RNA, 22 nt, Human
cagcgccugcaaagagagcgau

SEQ ID NO: 1096853 - RNA, 18 nt, Human
cagcucccugcacccccc

SEQ ID NO: 1096854 - RNA, 20 nt, Human
ccaaacaccugugacccauc

SEQ ID NO: 1096855 - RNA, 24 nt, Human
ccacacugccccucccugugccug

SEQ ID NO: 1096856 - RNA, 23 nt, Human
ccaccacugcccucauccaccug

SEQ ID NO: 1096857 - RNA, 24 nt, Human
ccaccugcaaacucuccagcaaag

SEQ ID NO: 1096858 - RNA, 20 nt, Human
ccacugcccucauccaccug

SEQ ID NO: 1096859 - RNA, 20 nt, Human
ccacugggccuagggggcaa

SEQ ID NO: 1096860 - RNA, 23 nt, Human
ccaggacuccucgcaggcagcag

SEQ ID NO: 1096861 - RNA, 20 nt, Human
ccagugucaacacccugucu

SEQ ID NO: 1096862 - RNA, 19 nt, Human
cccacagaggacauugguc

SEQ ID NO: 1096863 - RNA, 22 nt, Human
cccacuggcaugaccaugacaa

SEQ ID NO: 1096864 - RNA, 19 nt, Human
ccccccaccucuuuucucc

SEQ ID NO: 1096865 - RNA, 20 nt, Human
ccccccuugaggaucacuac

SEQ ID NO: 1096866 - RNA, 20 nt, Human
cccccucugcgaaucacucc

SEQ ID NO: 1096867 - RNA, 27 nt, Human
cccccuugucuucacacgccuccuugu

SEQ ID NO: 1096868 - RNA, 19 nt, Human
cccucugcgaaucacuccc

SEQ ID NO: 1096869 - RNA, 20 nt, Human
cccucugcgaaucacucccu

SEQ ID NO: 1096870 - RNA, 21 nt, Human
cccugaaacgucucccucuca

SEQ ID NO: 1096871 - RNA, 25 nt, Human
cccuucccacuccugccucugagag

SEQ ID NO: 1096872 - RNA, 26 nt, Human
cccuucccuaaaagccucuccuccug

SEQ ID NO: 1096873 - RNA, 21 nt, Human
cccuuccuccuucuugccacc

SEQ ID NO: 1096874 - RNA, 21 nt, Human
ccuaaaagccucuccuccugc

SEQ ID NO: 1096875 - RNA, 19 nt, Human
ccucuggauccuccucccc

SEQ ID NO: 1096876 - RNA, 21 nt, Human
ccugcccugcagcaucugggg

SEQ ID NO: 1096877 - RNA, 23 nt, Human
ccugugcugaucacuuccaaaga

SEQ ID NO: 1096878 - RNA, 21 nt, Human
ccuguuccacugucagcuccc

SEQ ID NO: 1096879 - RNA, 20 nt, Human
ccuugccauuagcauuuaaa

SEQ ID NO: 1096880 - RNA, 19 nt, Human
ccuuuucuuuuucuuucuc

SEQ ID NO: 1096881 - RNA, 27 nt, Human
cuaaaagccucuccuccugcacucccc

SEQ ID NO: 1096882 - RNA, 24 nt, Human
cucaaaaaugucaguuuccaugga

SEQ ID NO: 1096883 - RNA, 21 nt, Human
cucccccuaccugacuuucug

SEQ ID NO: 1096884 - RNA, 24 nt, Human
cuccccuguguugcucaagccaaa

SEQ ID NO: 1096885 - RNA, 18 nt, Human
cuccccuucuccuguacc

SEQ ID NO: 1096886 - RNA, 20 nt, Human
cucccucucacccccuuguc

SEQ ID NO: 1096887 - RNA, 18 nt, Human
cuccucugccagggcccc

SEQ ID NO: 1096888 - RNA, 20 nt, Human
cuccuggcggggccuggguc

SEQ ID NO: 1096889 - RNA, 22 nt, Human
cuccuuguccagcuuagcuguu

SEQ ID NO: 1096890 - RNA, 22 nt, Human
cucgcaggcagcaggugcucaa

SEQ ID NO: 1096891 - RNA, 24 nt, Human
cucucccccucugcgaaucacucc

SEQ ID NO: 1096892 - RNA, 24 nt, Human
cucuccugaguucagaaccaucuc

SEQ ID NO: 1096893 - RNA, 19 nt, Human
cugcacuccccagcucaag

SEQ ID NO: 1096894 - RNA, 18 nt, Human
cugcagguguacugaccu

SEQ ID NO: 1096895 - RNA, 22 nt, Human
cugcucccuuuuucccaacucc

SEQ ID NO: 1096896 - RNA, 23 nt, Human
cuggauccuccuccccgucuccc

SEQ ID NO: 1096897 - RNA, 20 nt, Human
cugucacuguccucucucca

SEQ ID NO: 1096898 - RNA, 24 nt, Human
cuucuccauucagcgagcaucugu

SEQ ID NO: 1096899 - RNA, 19 nt, Human
cuugucuucacacgccucc

SEQ ID NO: 1096900 - RNA, 18 nt, Human
gaaaauaugcaucuuuuc

SEQ ID NO: 1096901 - RNA, 19 nt, Human
gaccuccccuccuguucca

SEQ ID NO: 1096902 - RNA, 24 nt, Human
gaggcaguucuggcggcccuguuc

SEQ ID NO: 1096903 - RNA, 23 nt, Human
gaugacuuaauuuucagggccca

SEQ ID NO: 1096904 - RNA, 18 nt, Human
gcaccacuaaaggcaucc

SEQ ID NO: 1096905 - RNA, 19 nt, Human
gccaggacgcaccacuaaa

SEQ ID NO: 1096906 - RNA, 21 nt, Human
gcccaggacugaugacuuaau

SEQ ID NO: 1096907 - RNA, 20 nt, Human
gcccucagggccucugcugc

SEQ ID NO: 1096908 - RNA, 23 nt, Human
gcccucagggccucugcugcuuc

SEQ ID NO: 1096909 - RNA, 22 nt, Human
gcuagggcuggauucagauucc

SEQ ID NO: 1096910 - RNA, 23 nt, Human
ggaaaaaauuccccccuugagga

SEQ ID NO: 1096911 - RNA, 18 nt, Human
ggacagcucagccauugc

SEQ ID NO: 1096912 - RNA, 25 nt, Human
ggcaugaccaugacaauaccuugca

SEQ ID NO: 1096913 - RNA, 24 nt, Human
ggcccauugcaaaaugaaaauaug

SEQ ID NO: 1096914 - RNA, 20 nt, Human
ggucacuguccaggacuccu

SEQ ID NO: 1096915 - RNA, 22 nt, Human
guccacuggggucccucagaua

SEQ ID NO: 1096916 - RNA, 20 nt, Human
gucccauccacaccuucucu

SEQ ID NO: 1096917 - RNA, 22 nt, Human
gucccauccacaccuucucugu

SEQ ID NO: 1096918 - RNA, 18 nt, Human
guuguacugggguguccc

SEQ ID NO: 1096919 - RNA, 22 nt, Human
uaggcagaguaaggaggggaaa

SEQ ID NO: 1096920 - RNA, 23 nt, Human
ucagauuccuuuucuuuuucuuu

SEQ ID NO: 1096921 - RNA, 23 nt, Human
ucagggcccauugcaaaaugaaa

SEQ ID NO: 1096922 - RNA, 24 nt, Human
ucaguacccuucccuaaaagccuc

SEQ ID NO: 1096923 - RNA, 23 nt, Human
uccaaagcccaggacugaugacu

SEQ ID NO: 1096924 - RNA, 20 nt, Human
uccaagacuggucccccucc

SEQ ID NO: 1096925 - RNA, 20 nt, Human
uccacaaacacacagaggga

SEQ ID NO: 1096926 - RNA, 30 nt, Human
uccacaaacacacagagggacaacaggcuu

SEQ ID NO: 1096927 - RNA, 24 nt, Human
uccacaccuucucuguucuccccc

SEQ ID NO: 1096928 - RNA, 23 nt, Human
ucccucagauacccaaaccucua

SEQ ID NO: 1096929 - RNA, 24 nt, Human
ucccugaaacgucucccucucacc

SEQ ID NO: 1096930 - RNA, 19 nt, Human
ucccugugccugcccugca

SEQ ID NO: 1096931 - RNA, 30 nt, Human
ucccuuugccacugggcaggaacaagggcu

SEQ ID NO: 1096932 - RNA, 21 nt, Human
uccgccucuguggccacccuc

SEQ ID NO: 1096933 - RNA, 18 nt, Human
uccucgcaggcagcaggu

SEQ ID NO: 1096934 - RNA, 24 nt, Human
uccugguucuccuccguccuccuu

SEQ ID NO: 1096935 - RNA, 18 nt, Human
ucgcuggucuuccgccuc

SEQ ID NO: 1096936 - RNA, 21 nt, Human
ucgcuggucuuccgccucugu

SEQ ID NO: 1096937 - RNA, 19 nt, Human
ucuccugaguucagaacca

SEQ ID NO: 1096938 - RNA, 23 nt, Human
ucucugcagguguacugaccugu

SEQ ID NO: 1096939 - RNA, 26 nt, Human
ucugccggugaccuccccuccuguuc

SEQ ID NO: 1096940 - RNA, 18 nt, Human
ucugccuucuuggcuuga

SEQ ID NO: 1096941 - RNA, 19 nt, Human
ucugggguggggacgccac

SEQ ID NO: 1096942 - RNA, 18 nt, Human
ucuuuccucucccuuguc

SEQ ID NO: 1096943 - RNA, 24 nt, Human
ucuuuucuuuuuuguuuuuuucuu

SEQ ID NO: 1096944 - RNA, 23 nt, Human
ugaaacgucucccucucaccccc

SEQ ID NO: 1096945 - RNA, 21 nt, Human
ugacaauaccuugcacagagc

SEQ ID NO: 1096946 - RNA, 24 nt, Human
ugacccauccaccaugccuccccu

SEQ ID NO: 1096947 - RNA, 21 nt, Human
ugacuuucugccggugaccuc

SEQ ID NO: 1096948 - RNA, 20 nt, Human
ugaucucaguacccuucccu

SEQ ID NO: 1096949 - RNA, 28 nt, Human
ugcaaaaugaaaauaugcaucuuuucuu

SEQ ID NO: 1096950 - RNA, 20 nt, Human
ugcagauaaggaaaugaggc

SEQ ID NO: 1096951 - RNA, 18 nt, Human
ugccagggcccccgccau

SEQ ID NO: 1096952 - RNA, 21 nt, Human
ugcccucagggccucugcugc

SEQ ID NO: 1096953 - RNA, 26 nt, Human
ugcccugcagcaucugggguggggac

SEQ ID NO: 1096954 - RNA, 23 nt, Human
ugcccuuauccaccugcccacac

SEQ ID NO: 1096955 - RNA, 21 nt, Human
ugccggugaccuccccuccug

SEQ ID NO: 1096956 - RNA, 20 nt, Human
ugccuucuuggcuugaccuc

SEQ ID NO: 1096957 - RNA, 20 nt, Human
uggcccucuggauccuccuc

SEQ ID NO: 1096958 - RNA, 20 nt, Human
ugucaacacccugucuuucc

SEQ ID NO: 1096959 - RNA, 19 nt, Human
ugucagcucccugcacccc

SEQ ID NO: 1096960 - RNA, 19 nt, Human
ugucuuuccuugccauuag

SEQ ID NO: 1096961 - RNA, 18 nt, Human
uguggccacccuccuggu

SEQ ID NO: 1096962 - RNA, 20 nt, Human
uguggccacccuccugguuc

SEQ ID NO: 1096963 - RNA, 22 nt, Human
uguuccuccuccacugggccua

SEQ ID NO: 1096964 - RNA, 23 nt, Human
uguuuuuuucuucuccaaagccc

SEQ ID NO: 1096965 - RNA, 18 nt, Human
uugcagauaaggaaauga

SEQ ID NO: 1096966 - RNA, 22 nt, Human
uugccacugggcaggaacaagg

SEQ ID NO: 1096967 - RNA, 21 nt, Human
uugguccugggccuaauuagg

SEQ ID NO: 1096968 - RNA, 21 nt, Human
uuguacuggggugucccccca

SEQ ID NO: 1096969 - RNA, 18 nt, Human
uuuaauccacaaacacac

SEQ ID NO: 1096970 - RNA, 19 nt, Human
uuuuucuucuccaaagccc

SEQ ID NO: 1096971 - RNA, 19 nt, Human
aaaaaaugaaucgauucag

SEQ ID NO: 1096972 - RNA, 29 nt, Human
aaacaggagagaaaaaaugaagggacccc

SEQ ID NO: 1096973 - RNA, 19 nt, Human
aaagcagauuugggcaugg

SEQ ID NO: 1096974 - RNA, 18 nt, Human
aaagugcuggauuacagg

SEQ ID NO: 1096975 - RNA, 23 nt, Human
aaagugcuggauuacaggcauga

SEQ ID NO: 1096976 - RNA, 21 nt, Human
aacaaaacaaagaugugacca

SEQ ID NO: 1096977 - RNA, 25 nt, Human
aacaaaacaaagaugugaccacuga

SEQ ID NO: 1096978 - RNA, 21 nt, Human
aagaaaguggggagagaccgg

SEQ ID NO: 1096979 - RNA, 25 nt, Human
aagaaaguggggagagaccgguacc

SEQ ID NO: 1096980 - RNA, 23 nt, Human
aagaagucaguucgggcgucagc

SEQ ID NO: 1096981 - RNA, 19 nt, Human
aagcagacaacaaaacaaa

SEQ ID NO: 1096982 - RNA, 22 nt, Human
aaggggcagugggucagacagc

SEQ ID NO: 1096983 - RNA, 22 nt, Human
aaguagauuacaacagcagcca

SEQ ID NO: 1096984 - RNA, 20 nt, Human
aaucaauauuugauccaagg

SEQ ID NO: 1096985 - RNA, 23 nt, Human
acaagcaugaaauaaacaauaua

SEQ ID NO: 1096986 - RNA, 23 nt, Human
accauggugacccugauauccca

SEQ ID NO: 1096987 - RNA, 24 nt, Human
accgcauugucuuuauccacucau

SEQ ID NO: 1096988 - RNA, 20 nt, Human
agaagaagcagacaacaaaa

SEQ ID NO: 1096989 - RNA, 18 nt, Human
agagcuauuuuauauacu

SEQ ID NO: 1096990 - RNA, 26 nt, Human
aggagagaaaaaaugaaucgauucag

SEQ ID NO: 1096991 - RNA, 22 nt, Human
aggcgugugccaccaccuggcu

SEQ ID NO: 1096992 - RNA, 19 nt, Human
agggaggaugaaaucaggg

SEQ ID NO: 1096993 - RNA, 20 nt, Human
agggaggaugaaaucagggc

SEQ ID NO: 1096994 - RNA, 24 nt, Human
agguggucuguccgccuuggccuc

SEQ ID NO: 1096995 - RNA, 22 nt, Human
aguaaucaaagaaccaaaaaaa

SEQ ID NO: 1096996 - RNA, 22 nt, Human
aguagagaugggguuucuccau

SEQ ID NO: 1096997 - RNA, 21 nt, Human
aguagcugggauuacaggcgu

SEQ ID NO: 1096998 - RNA, 23 nt, Human
aguagcugggauuacaggcgugu

SEQ ID NO: 1096999 - RNA, 24 nt, Human
aucaguaaucaaagaaccaaaaaa

SEQ ID NO: 1097000 - RNA, 18 nt, Human
augggguuucuccauguu

SEQ ID NO: 1097001 - RNA, 20 nt, Human
augggguuucuccauguugg

SEQ ID NO: 1097002 - RNA, 24 nt, Human
augggguuucuccauguuggccag

SEQ ID NO: 1097003 - RNA, 19 nt, Human
auguagaacaaagcccaca

SEQ ID NO: 1097004 - RNA, 24 nt, Human
auuuuuguauuuuuaguagagaug

SEQ ID NO: 1097005 - RNA, 23 nt, Human
caaagugcuggauuacaggcaug

SEQ ID NO: 1097006 - RNA, 24 nt, Human
caaagugcuggauuacaggcauga

SEQ ID NO: 1097007 - RNA, 23 nt, Human
caaaugaagccccuauacccauc

SEQ ID NO: 1097008 - RNA, 21 nt, Human
caagaaucagcagacacuuga

SEQ ID NO: 1097009 - RNA, 24 nt, Human
caagcaugaaauaaacaauauaaa

SEQ ID NO: 1097010 - RNA, 19 nt, Human
caaggauaaggucuuuagc

SEQ ID NO: 1097011 - RNA, 23 nt, Human
cacagauauggaaaauauaaaac

SEQ ID NO: 1097012 - RNA, 22 nt, Human
caccaccuggcuaauuuuugua

SEQ ID NO: 1097013 - RNA, 23 nt, Human
caccauggugacccugauauccc

SEQ ID NO: 1097014 - RNA, 21 nt, Human
cacugcaaucuccaccuccca

SEQ ID NO: 1097015 - RNA, 20 nt, Human
cagacacuugaggaaggcuc

SEQ ID NO: 1097016 - RNA, 23 nt, Human
cagcccagggcaggaagaggcaa

SEQ ID NO: 1097017 - RNA, 24 nt, Human
cagcccagggcaggaagaggcaau

SEQ ID NO: 1097018 - RNA, 20 nt, Human
cagccuccugaguagcuggg

SEQ ID NO: 1097019 - RNA, 23 nt, Human
cagcuuuggcuucagagugauuu

SEQ ID NO: 1097020 - RNA, 22 nt, Human
caggcgauucuccugccucagc

SEQ ID NO: 1097021 - RNA, 20 nt, Human
caucaguaaucaaagaacca

SEQ ID NO: 1097022 - RNA, 19 nt, Human
cauggaguccaauuucugu

SEQ ID NO: 1097023 - RNA, 24 nt, Human
cauguuggccaggcugguuucgaa

SEQ ID NO: 1097024 - RNA, 18 nt, Human
ccaaagugcuggauuaca

SEQ ID NO: 1097025 - RNA, 23 nt, Human
ccaaagugcuggauuacaggcau

SEQ ID NO: 1097026 - RNA, 24 nt, Human
ccaccucccagguucaggcgauuc

SEQ ID NO: 1097027 - RNA, 21 nt, Human
ccaccuggcuaauuuuuguau

SEQ ID NO: 1097028 - RNA, 19 nt, Human
ccauguuggccaggcuggu

SEQ ID NO: 1097029 - RNA, 19 nt, Human
ccauguuggccaggcuggu

SEQ ID NO: 1097030 - RNA, 22 nt, Human
ccauguuggccaggcugguuuc

SEQ ID NO: 1097031 - RNA, 23 nt, Human
ccauguuggccaggcugguuucg

SEQ ID NO: 1097032 - RNA, 24 nt, Human
cccaaagugcuggauuacaggcau

SEQ ID NO: 1097033 - RNA, 19 nt, Human
cccaaauguagaacaaagc

SEQ ID NO: 1097034 - RNA, 23 nt, Human
cccagguucaggcgauucuccug

SEQ ID NO: 1097035 - RNA, 18 nt, Human
ccccacugagcccagcuu

SEQ ID NO: 1097036 - RNA, 22 nt, Human
ccccuauacccaucuuucccca

SEQ ID NO: 1097037 - RNA, 18 nt, Human
ccccugcauccuuucccc

SEQ ID NO: 1097038 - RNA, 18 nt, Human
cccuaaguccccaaaauc

SEQ ID NO: 1097039 - RNA, 21 nt, Human
ccgccuuggccucccaaagug

SEQ ID NO: 1097040 - RNA, 21 nt, Human
ccuacauacucugaggucuca

SEQ ID NO: 1097041 - RNA, 24 nt, Human
ccucccagguucaggcgauucucc

SEQ ID NO: 1097042 - RNA, 23 nt, Human
ccugaguagcugggauuacaggc

SEQ ID NO: 1097043 - RNA, 24 nt, Human
ccugaguagcugggauuacaggcg

SEQ ID NO: 1097044 - RNA, 23 nt, Human
ccugccucagccuccugaguagc

SEQ ID NO: 1097045 - RNA, 21 nt, Human
ccuuggguuguggagcucugc

SEQ ID NO: 1097046 - RNA, 22 nt, Human
ccuuggguuguggagcucugcc

SEQ ID NO: 1097047 - RNA, 24 nt, Human
cucacugcaaucuccaccucccag

SEQ ID NO: 1097048 - RNA, 24 nt, Human
cucagccuccugaguagcugggau

SEQ ID NO: 1097049 - RNA, 21 nt, Human
cucccacuuauaagugaggau

SEQ ID NO: 1097050 - RNA, 26 nt, Human
cuccugaccucagguggucuguccgc

SEQ ID NO: 1097051 - RNA, 22 nt, Human
cugaguagcugggauuacaggc

SEQ ID NO: 1097052 - RNA, 24 nt, Human
cugaguagcugggauuacaggcgu

SEQ ID NO: 1097053 - RNA, 24 nt, Human
cugcaaucuccaccucccagguuc

SEQ ID NO: 1097054 - RNA, 23 nt, Human
cugccucagccuccugaguagcu

SEQ ID NO: 1097055 - RNA, 18 nt, Human
cuggagcaguguacacug

SEQ ID NO: 1097056 - RNA, 20 nt, Human
cuguccgccuuggccuccca

SEQ ID NO: 1097057 - RNA, 24 nt, Human
cuuuccccuaaguccccaaaaucc

SEQ ID NO: 1097058 - RNA, 18 nt, Human
cuuuuuuggaacuaguuu

SEQ ID NO: 1097059 - RNA, 23 nt, Human
gaaagggagagaaagagggaagg

SEQ ID NO: 1097060 - RNA, 22 nt, Human
gaaaguacaagcaugaaauaaa

SEQ ID NO: 1097061 - RNA, 25 nt, Human
gaacaaaugaagccccuauacccau

SEQ ID NO: 1097062 - RNA, 23 nt, Human
gaaggggcagugggucagacagc

SEQ ID NO: 1097063 - RNA, 24 nt, Human
gaccucagguggucuguccgccuu

SEQ ID NO: 1097064 - RNA, 18 nt, Human
gagaugggguuucuccau

SEQ ID NO: 1097065 - RNA, 24 nt, Human
gagaugggguuucuccauguuggc

SEQ ID NO: 1097066 - RNA, 20 nt, Human
gaguagcugggauuacaggc

SEQ ID NO: 1097067 - RNA, 25 nt, Human
gaguagcugggauuacaggcgugug

SEQ ID NO: 1097068 - RNA, 18 nt, Human
gauuacaggcaugagcca

SEQ ID NO: 1097069 - RNA, 21 nt, Human
gauuacaggcaugagccacca

SEQ ID NO: 1097070 - RNA, 21 nt, Human
gauuacaggcaugagccacca

SEQ ID NO: 1097071 - RNA, 18 nt, Human
gauuacaggcgugugcca

SEQ ID NO: 1097072 - RNA, 22 nt, Human
gcaaucuccaccucccagguuc

SEQ ID NO: 1097073 - RNA, 22 nt, Human
gccuuggccucccaaagugcug

SEQ ID NO: 1097074 - RNA, 23 nt, Human
gcgauucuccugccucagccucc

SEQ ID NO: 1097075 - RNA, 23 nt, Human
gcugguuucgaacuccugaccuc

SEQ ID NO: 1097076 - RNA, 19 nt, Human
gcuucagagugauuucaga

SEQ ID NO: 1097077 - RNA, 26 nt, Human
ggaaagggagagaaagagggaaggga

SEQ ID NO: 1097078 - RNA, 18 nt, Human
ggaagaggcaaugagaug

SEQ ID NO: 1097079 - RNA, 19 nt, Human
ggauuacaggcaugagcca

SEQ ID NO: 1097080 - RNA, 22 nt, Human
ggauuacaggcaugagccacca

SEQ ID NO: 1097081 - RNA, 24 nt, Human
ggcgauucuccugccucagccucc

SEQ ID NO: 1097082 - RNA, 24 nt, Human
ggcugguuucgaacuccugaccuc

SEQ ID NO: 1097083 - RNA, 23 nt, Human
gggggaaggggcagugggucaga

SEQ ID NO: 1097084 - RNA, 22 nt, Human
gggguuucuccauguuggccag

SEQ ID NO: 1097085 - RNA, 19 nt, Human
gguuucgaacuccugaccu

SEQ ID NO: 1097086 - RNA, 18 nt, Human
guagcugggauuacaggc

SEQ ID NO: 1097087 - RNA, 18 nt, Human
guagcugggauuacaggc

SEQ ID NO: 1097088 - RNA, 21 nt, Human
gucuuuagcagugacuucuga

SEQ ID NO: 1097089 - RNA, 24 nt, Human
guggcugaauaguauuccauggug

SEQ ID NO: 1097090 - RNA, 22 nt, Human
uaaaaauacagucucuaaaauc

SEQ ID NO: 1097091 - RNA, 24 nt, Human
uaaacaauauaaaaagcuccccaa

SEQ ID NO: 1097092 - RNA, 21 nt, Human
uaaccaagaaucagcagacac

SEQ ID NO: 1097093 - RNA, 22 nt, Human
uaaccaagaaucagcagacacu

SEQ ID NO: 1097094 - RNA, 19 nt, Human
uaacgagaaaaggcaauuu

SEQ ID NO: 1097095 - RNA, 24 nt, Human
uaagugaggauguacaauauuugg

SEQ ID NO: 1097096 - RNA, 24 nt, Human
uaauauagaagaagcagacaacaa

SEQ ID NO: 1097097 - RNA, 25 nt, Human
uaaugaucuccaacuccauccaggu

SEQ ID NO: 1097098 - RNA, 24 nt, Human
uaauuuuuguauuuuuaguagaga

SEQ ID NO: 1097099 - RNA, 19 nt, Human
uacaacagcagccagggga

SEQ ID NO: 1097100 - RNA, 21 nt, Human
uacaaggauaaggucuuuagc

SEQ ID NO: 1097101 - RNA, 18 nt, Human
uacaggcaugagccacca

SEQ ID NO: 1097102 - RNA, 18 nt, Human
uacaguggggcugccugg

SEQ ID NO: 1097103 - RNA, 20 nt, Human
uacaguggggcugccuggaa

SEQ ID NO: 1097104 - RNA, 20 nt, Human
uagaacaaagcccacagaua

SEQ ID NO: 1097105 - RNA, 20 nt, Human
uagaacaaagcccacagauu

SEQ ID NO: 1097106 - RNA, 19 nt, Human
uagauuacaacagcagcca

SEQ ID NO: 1097107 - RNA, 22 nt, Human
uagcagugacuucugagauuuu

SEQ ID NO: 1097108 - RNA, 24 nt, Human
uaguagagaugggguuucuccaug

SEQ ID NO: 1097109 - RNA, 19 nt, Human
uaguuuuuggggagcagau

SEQ ID NO: 1097110 - RNA, 24 nt, Human
uauaaaacaggagagaaaaaauga

SEQ ID NO: 1097111 - RNA, 28 nt, Human
uaucauucuugugccuuuguaucuucau

SEQ ID NO: 1097112 - RNA, 20 nt, Human
uaucccaguaccucuuuagg

SEQ ID NO: 1097113 - RNA, 28 nt, Human
uauuuuauuucaauaguuuuuggggagc

SEQ ID NO: 1097114 - RNA, 24 nt, Human
ucacugcaaucuccaccucccagg

SEQ ID NO: 1097115 - RNA, 25 nt, Human
ucacugcaaucuccaccucccaggu

SEQ ID NO: 1097116 - RNA, 22 nt, Human
ucagagugacucaugaucccag

SEQ ID NO: 1097117 - RNA, 20 nt, Human
ucagccuccugaguagcugg

SEQ ID NO: 1097118 - RNA, 22 nt, Human
uccaaggauuggaagggaaagu

SEQ ID NO: 1097119 - RNA, 23 nt, Human
ucccaaagugcuggauuacaggc

SEQ ID NO: 1097120 - RNA, 19 nt, Human
ucccagguucaggcgauuc

SEQ ID NO: 1097121 - RNA, 21 nt, Human
ucccagguucaggcgauucuc

SEQ ID NO: 1097122 - RNA, 24 nt, Human
ucccagguucaggcgauucuccug

SEQ ID NO: 1097123 - RNA, 25 nt, Human
uccccaaauguagaacaaagcccac

SEQ ID NO: 1097124 - RNA, 20 nt, Human
ucccucauccccugcauccu

SEQ ID NO: 1097125 - RNA, 24 nt, Human
uccugaguagcugggauuacaggc

SEQ ID NO: 1097126 - RNA, 18 nt, Human
uccugggggaaggggcag

SEQ ID NO: 1097127 - RNA, 23 nt, Human
ucguguguaguuucuuaguuccc

SEQ ID NO: 1097128 - RNA, 21 nt, Human
ucuaaaaucaauauuugaucc

SEQ ID NO: 1097129 - RNA, 22 nt, Human
ucuccaacuccauccagguugc

SEQ ID NO: 1097130 - RNA, 24 nt, Human
ucuccugccucagccuccugagua

SEQ ID NO: 1097131 - RNA, 23 nt, Human
ugaaauaaacaauauaaaaagcu

SEQ ID NO: 1097132 - RNA, 25 nt, Human
ugaaauaaacaauauaaaaagcucc

SEQ ID NO: 1097133 - RNA, 18 nt, Human
ugaacaaaugaagccccu

SEQ ID NO: 1097134 - RNA, 26 nt, Human
ugaagccccuauacccaucuuucccc

SEQ ID NO: 1097135 - RNA, 27 nt, Human
ugaagccccuauacccaucuuucccca

SEQ ID NO: 1097136 - RNA, 20 nt, Human
ugacccugauaucccaguac

SEQ ID NO: 1097137 - RNA, 19 nt, Human
ugaccucagguggucuguc

SEQ ID NO: 1097138 - RNA, 24 nt, Human
ugaccucagguggucuguccgccu

SEQ ID NO: 1097139 - RNA, 24 nt, Human
ugccucagccuccugaguagcugg

SEQ ID NO: 1097140 - RNA, 22 nt, Human
uggaaaauauaaaacaggagag

SEQ ID NO: 1097141 - RNA, 21 nt, Human
uggauuacaggcaugagccac

SEQ ID NO: 1097142 - RNA, 23 nt, Human
uggauuacaggcaugagccacca

SEQ ID NO: 1097143 - RNA, 24 nt, Human
uggccaggcugguuucgaacuccu

SEQ ID NO: 1097144 - RNA, 18 nt, Human
ugggauuacaggcgugug

SEQ ID NO: 1097145 - RNA, 19 nt, Human
ugggauuacaggcgugugc

SEQ ID NO: 1097146 - RNA, 21 nt, Human
ugggauuacaggcgugugcca

SEQ ID NO: 1097147 - RNA, 22 nt, Human
ugggauuacaggcgugugccac

SEQ ID NO: 1097148 - RNA, 24 nt, Human
ugggauuacaggcgugugccacca

SEQ ID NO: 1097149 - RNA, 24 nt, Human
ugggcauggaguccaauuucuguu

SEQ ID NO: 1097150 - RNA, 19 nt, Human
ugggggaaggggcaguggg

SEQ ID NO: 1097151 - RNA, 22 nt, Human
ugggggaaggggcaguggguca

SEQ ID NO: 1097152 - RNA, 24 nt, Human
ugggguuucuccauguuggccagg

SEQ ID NO: 1097153 - RNA, 24 nt, Human
ugugcugcuauaaacaugcgugua

SEQ ID NO: 1097154 - RNA, 22 nt, Human
uguggcugaauaguauuccaug

SEQ ID NO: 1097155 - RNA, 18 nt, Human
uuaguagagaugggguuu

SEQ ID NO: 1097156 - RNA, 24 nt, Human
uuaguagagaugggguuucuccau

SEQ ID NO: 1097157 - RNA, 19 nt, Human
uucagagugaacaaaugaa

SEQ ID NO: 1097158 - RNA, 18 nt, Human
uucaggagggaaagggag

SEQ ID NO: 1097159 - RNA, 21 nt, Human
uucaggcgauucuccugccuc

SEQ ID NO: 1097160 - RNA, 23 nt, Human
uucaggcgauucuccugccucag

SEQ ID NO: 1097161 - RNA, 22 nt, Human
uuccaugguguauauguacacc

SEQ ID NO: 1097162 - RNA, 23 nt, Human
uuccugaguuauuucacuuagaa

SEQ ID NO: 1097163 - RNA, 19 nt, Human
uuccugggggaaggggcag

SEQ ID NO: 1097164 - RNA, 19 nt, Human
uuggaacuauuuucuuuuc

SEQ ID NO: 1097165 - RNA, 18 nt, Human
uuggccucccaaagugcu

SEQ ID NO: 1097166 - RNA, 19 nt, Human
uugguuacaaggauaaggu

SEQ ID NO: 1097167 - RNA, 23 nt, Human
uuguauuuuuaguagagaugggg

SEQ ID NO: 1097168 - RNA, 18 nt, Human
uuguggagcucugccugu

SEQ ID NO: 1097169 - RNA, 23 nt, Human
uuguggcugaauaguauuccaug

SEQ ID NO: 1097170 - RNA, 20 nt, Human
uuuccccuaaguccccaaaa

SEQ ID NO: 1097171 - RNA, 24 nt, Human
uuucgaacuccugaccucaggugg

SEQ ID NO: 1097172 - RNA, 21 nt, Human
uuucuccauguuggccaggcu

SEQ ID NO: 1097173 - RNA, 23 nt, Human
uuuggcuucagagugauuucaga

SEQ ID NO: 1097174 - RNA, 22 nt, Human
uuuuauuucaauaguuuuuggg

SEQ ID NO: 1097175 - RNA, 24 nt, Human
uuuucaaucgcaaauugugcugcu

SEQ ID NO: 1097176 - RNA, 22 nt, Human
uuuuuaguagagaugggguuuc

SEQ ID NO: 1097177 - RNA, 20 nt, Human
uuuuuguauuuuuaguagag

SEQ ID NO: 1097178 - RNA, 24 nt, Human
uuuuuugcccaggcuagagagcag

SEQ ID NO: 1097179 - RNA, 25 nt, Human
aaacucccuccaagccagaacacua

SEQ ID NO: 1097180 - RNA, 24 nt, Human
aagccagaacacggguccggggga

SEQ ID NO: 1097181 - RNA, 21 nt, Human
acggguccgggggacuccuca

SEQ ID NO: 1097182 - RNA, 20 nt, Human
cacggguccgggggacuccu

SEQ ID NO: 1097183 - RNA, 23 nt, Human
ccaaagucaaacucccuccaagc

SEQ ID NO: 1097184 - RNA, 18 nt, Human
ccacggcacaagcaccca

SEQ ID NO: 1097185 - RNA, 26 nt, Human
cccagguggugguucucgacgggcua

SEQ ID NO: 1097186 - RNA, 19 nt, Human
ccgugggccccgccugccc

SEQ ID NO: 1097187 - RNA, 21 nt, Human
ccugccccacggcacaagcac

SEQ ID NO: 1097188 - RNA, 24 nt, Human
cucccaagacugaauggggucuag

SEQ ID NO: 1097189 - RNA, 22 nt, Human
gaacacggguccgggggacucc

SEQ ID NO: 1097190 - RNA, 24 nt, Human
gaacuggcucucucaccucccaag

SEQ ID NO: 1097191 - RNA, 21 nt, Human
uaccuuuggccaaagucaaac

SEQ ID NO: 1097192 - RNA, 24 nt, Human
ucaccccuggcuguuccccccaac

SEQ ID NO: 1097193 - RNA, 27 nt, Human
uccucaccccuggcuguuccccccaag

SEQ ID NO: 1097194 - RNA, 18 nt, Human
aaaccagggcagggaggg

SEQ ID NO: 1097195 - RNA, 24 nt, Human
aaacuguugggauuauaggcguga

SEQ ID NO: 1097196 - RNA, 24 nt, Human
aaauagcugggauuauaggcaggu

SEQ ID NO: 1097197 - RNA, 25 nt, Human
aaaugauucucuugccucagccucc

SEQ ID NO: 1097198 - RNA, 23 nt, Human
aacuccaugaccggccacaccuc

SEQ ID NO: 1097199 - RNA, 27 nt, Human
aagcgauccuccugccucaaccuccca

SEQ ID NO: 1097200 - RNA, 22 nt, Human
aaguugaaaccagggcagggag

SEQ ID NO: 1097201 - RNA, 24 nt, Human
aauggugugaucucagcucacugc

SEQ ID NO: 1097202 - RNA, 18 nt, Human
acagcucacugcagccuc

SEQ ID NO: 1097203 - RNA, 20 nt, Human
accaauccuccagccucagc

SEQ ID NO: 1097204 - RNA, 22 nt, Human
accacccagcaagcagaaggug

SEQ ID NO: 1097205 - RNA, 18 nt, Human
accauguuggccaggcug

SEQ ID NO: 1097206 - RNA, 23 nt, Human
acccaucacaguccuccuaggcu

SEQ ID NO: 1097207 - RNA, 20 nt, Human
acccccaccccccaccccac

SEQ ID NO: 1097208 - RNA, 23 nt, Human
acccccaccccccaccccacucc

SEQ ID NO: 1097209 - RNA, 25 nt, Human
acccccaccccccaccccacuccac

SEQ ID NO: 1097210 - RNA, 22 nt, Human
acccuaucuccaaauagucaca

SEQ ID NO: 1097211 - RNA, 22 nt, Human
accuccuaagcucaaccaaucc

SEQ ID NO: 1097212 - RNA, 18 nt, Human
acgagguuucaccauguu

SEQ ID NO: 1097213 - RNA, 20 nt, Human
acgagguuucaccauguugg

SEQ ID NO: 1097214 - RNA, 24 nt, Human
acgagguuucaccauguuggccag

SEQ ID NO: 1097215 - RNA, 25 nt, Human
acucugcuucccaggcuggagugca

SEQ ID NO: 1097216 - RNA, 19 nt, Human
acugcagccucaaccuccu

SEQ ID NO: 1097217 - RNA, 24 nt, Human
agacuccugggcucaagcgauccu

SEQ ID NO: 1097218 - RNA, 26 nt, Human
agcagguacaugcaagucucccaugg

SEQ ID NO: 1097219 - RNA, 18 nt, Human
agccccaagcaccauguc

SEQ ID NO: 1097220 - RNA, 23 nt, Human
agccucagccuccugaguagcug

SEQ ID NO: 1097221 - RNA, 25 nt, Human
agccuguugcccaggcuggucucaa

SEQ ID NO: 1097222 - RNA, 21 nt, Human
aggaaguugaaaccagggcag

SEQ ID NO: 1097223 - RNA, 21 nt, Human
aggaaguugaaaccagggcag

SEQ ID NO: 1097224 - RNA, 24 nt, Human
aggcacagggggcggaaccacaga

SEQ ID NO: 1097225 - RNA, 20 nt, Human
aggcugcggugcccccagag

SEQ ID NO: 1097226 - RNA, 23 nt, Human
agggagggagcaggcucugcagc

SEQ ID NO: 1097227 - RNA, 22 nt, Human
agggcuucagcagauggauuug

SEQ ID NO: 1097228 - RNA, 23 nt, Human
aggggagccaucuugaauagggu

SEQ ID NO: 1097229 - RNA, 24 nt, Human
aggugauguaccugccucggccuc

SEQ ID NO: 1097230 - RNA, 26 nt, Human
agguggugcguuagguggucgagggc

SEQ ID NO: 1097231 - RNA, 21 nt, Human
aggugugugggcccagcugcu

SEQ ID NO: 1097232 - RNA, 23 nt, Human
agguucaaaugauucucuugccu

SEQ ID NO: 1097233 - RNA, 22 nt, Human
agguuucaccauguuggccagg

SEQ ID NO: 1097234 - RNA, 21 nt, Human
agugagugggagugggaggga

SEQ ID NO: 1097235 - RNA, 23 nt, Human
agugcaguggugggagcacagcu

SEQ ID NO: 1097236 - RNA, 24 nt, Human
agugcaguggugggagcacagcuc

SEQ ID NO: 1097237 - RNA, 24 nt, Human
auaaacuccaugaccggccacacc

SEQ ID NO: 1097238 - RNA, 19 nt, Human
auccagucaccacccagca

SEQ ID NO: 1097239 - RNA, 24 nt, Human
augauucucuugccucagccuccc

SEQ ID NO: 1097240 - RNA, 18 nt, Human
caaaaaauagccuguugc

SEQ ID NO: 1097241 - RNA, 22 nt, Human
caaaugauucucuugccucagc

SEQ ID NO: 1097242 - RNA, 20 nt, Human
caaccuccaccucccagguu

SEQ ID NO: 1097243 - RNA, 23 nt, Human
caaccuccaccucccagguucaa

SEQ ID NO: 1097244 - RNA, 25 nt, Human
caaccuccuaagcucaaccaauccu

SEQ ID NO: 1097245 - RNA, 23 nt, Human
caagcgauccuccugccucaacc

SEQ ID NO: 1097246 - RNA, 24 nt, Human
caaguccuccacugaucauucaca

SEQ ID NO: 1097247 - RNA, 18 nt, Human
cacaaagccccaagcacc

SEQ ID NO: 1097248 - RNA, 23 nt, Human
cacaguuugacccaucacagucc

SEQ ID NO: 1097249 - RNA, 20 nt, Human
caccaggucuuuggaauccc

SEQ ID NO: 1097250 - RNA, 24 nt, Human
caccaggucuuuggaaucccccug

SEQ ID NO: 1097251 - RNA, 21 nt, Human
caccauguuggccaggcuggu

SEQ ID NO: 1097252 - RNA, 24 nt, Human
caccauguuggccaggcuggucuc

SEQ ID NO: 1097253 - RNA, 27 nt, Human
caccauguuggccaggcuggucucaaa

SEQ ID NO: 1097254 - RNA, 25 nt, Human
caccccacaccccccgcugggucac

SEQ ID NO: 1097255 - RNA, 27 nt, Human
caccccacuccaccccacuccgacccg

SEQ ID NO: 1097256 - RNA, 18 nt, Human
caccccccaccccacucc

SEQ ID NO: 1097257 - RNA, 19 nt, Human
caccccccaccccacucca

SEQ ID NO: 1097258 - RNA, 19 nt, Human
caccccccaccccacucca

SEQ ID NO: 1097259 - RNA, 23 nt, Human
caccccccaccccacuccacccc

SEQ ID NO: 1097260 - RNA, 26 nt, Human
caccccccaccccacuccaccccacu

SEQ ID NO: 1097261 - RNA, 24 nt, Human
cacucugcuucccaggcuggagug

SEQ ID NO: 1097262 - RNA, 21 nt, Human
cacugcaaccuccaccuccca

SEQ ID NO: 1097263 - RNA, 24 nt, Human
cagaggcccugggaagcccaaggg

SEQ ID NO: 1097264 - RNA, 23 nt, Human
cagccccuggggcucuggcaccu

SEQ ID NO: 1097265 - RNA, 23 nt, Human
cagccucaaccuccuaagcucaa

SEQ ID NO: 1097266 - RNA, 25 nt, Human
cagccucaaccuccuaagcucaacc

SEQ ID NO: 1097267 - RNA, 18 nt, Human
cagccucagccuccugag

SEQ ID NO: 1097268 - RNA, 25 nt, Human
cagccucagccuccugaguagcugg

SEQ ID NO: 1097269 - RNA, 20 nt, Human
cagccuccugaguagcuggg

SEQ ID NO: 1097270 - RNA, 22 nt, Human
cagcugcuuccggcugccgcug

SEQ ID NO: 1097271 - RNA, 20 nt, Human
cagggagggagcaggcucug

SEQ ID NO: 1097272 - RNA, 18 nt, Human
cagggcuccagacaccgg

SEQ ID NO: 1097273 - RNA, 22 nt, Human
cagguacaugcaagucugugua

SEQ ID NO: 1097274 - RNA, 19 nt, Human
caggugauguaccugcccc

SEQ ID NO: 1097275 - RNA, 22 nt, Human
caggugauguaccugccucggc

SEQ ID NO: 1097276 - RNA, 20 nt, Human
caggugccaccaugccuggc

SEQ ID NO: 1097277 - RNA, 24 nt, Human
caguagagacgagguuucaccaug

SEQ ID NO: 1097278 - RNA, 26 nt, Human
caguagagacgagguuucaccauguu

SEQ ID NO: 1097279 - RNA, 23 nt, Human
caugcaccaccacaccuggcuaa

SEQ ID NO: 1097280 - RNA, 20 nt, Human
caugcuugacccccaccccc

SEQ ID NO: 1097281 - RNA, 22 nt, Human
cauggcuggauggccccaggug

SEQ ID NO: 1097282 - RNA, 24 nt, Human
cauguuggccaggcuggucucaaa

SEQ ID NO: 1097283 - RNA, 21 nt, Human
cauucacaaagccccaagcac

SEQ ID NO: 1097284 - RNA, 22 nt, Human
ccaaacuguugggauuauaggc

SEQ ID NO: 1097285 - RNA, 24 nt, Human
ccaaacuguugggauuauaggcgu

SEQ ID NO: 1097286 - RNA, 24 nt, Human
ccaccucccagguucaaaugauuc

SEQ ID NO: 1097287 - RNA, 18 nt, Human
ccaccugucagcauggcc

SEQ ID NO: 1097288 - RNA, 20 nt, Human
ccacugaucauucacaaagc

SEQ ID NO: 1097289 - RNA, 22 nt, Human
ccagccucagccuccugaguag

SEQ ID NO: 1097290 - RNA, 25 nt, Human
ccagccucagccuccugaguagcuu

SEQ ID NO: 1097291 - RNA, 19 nt, Human
cccaaauagcugggauuau

SEQ ID NO: 1097292 - RNA, 24 nt, Human
cccaaauagcugggauuauaggca

SEQ ID NO: 1097293 - RNA, 18 nt, Human
cccaccccacuccacccc

SEQ ID NO: 1097294 - RNA, 20 nt, Human
cccaccccacuccaccccac

SEQ ID NO: 1097295 - RNA, 22 nt, Human
cccaccccccaccccacuccac

SEQ ID NO: 1097296 - RNA, 18 nt, Human
cccacuccaccccacucc

SEQ ID NO: 1097297 - RNA, 19 nt, Human
cccaggcuggagugcagug

SEQ ID NO: 1097298 - RNA, 22 nt, Human
cccaggcuggagugcaguggug

SEQ ID NO: 1097299 - RNA, 22 nt, Human
ccccacuccaccccacuccgac

SEQ ID NO: 1097300 - RNA, 22 nt, Human
ccccagaggcccugggaagccc

SEQ ID NO: 1097301 - RNA, 27 nt, Human
cccccaccccccaccccacuccacccc

SEQ ID NO: 1097302 - RNA, 20 nt, Human
cccuaaguccuaggauuuac

SEQ ID NO: 1097303 - RNA, 21 nt, Human
cccugggaagcccaagggacu

SEQ ID NO: 1097304 - RNA, 25 nt, Human
ccgagcuggugaaggcacagggggc

SEQ ID NO: 1097305 - RNA, 18 nt, Human
ccgcuggguggggaagag

SEQ ID NO: 1097306 - RNA, 21 nt, Human
ccgguggugacaccaggggag

SEQ ID NO: 1097307 - RNA, 23 nt, Human
ccuccagccucagccuccugagu

SEQ ID NO: 1097308 - RNA, 24 nt, Human
ccucccagguucaaaugauucucu

SEQ ID NO: 1097309 - RNA, 22 nt, Human
ccuccugccucaaccucccaaa

SEQ ID NO: 1097310 - RNA, 18 nt, Human
ccugcaccccacaccccc

SEQ ID NO: 1097311 - RNA, 18 nt, Human
ccugggcucaagcgaucc

SEQ ID NO: 1097312 - RNA, 23 nt, Human
ccugggcucaagcgauccuccug

SEQ ID NO: 1097313 - RNA, 21 nt, Human
ccugucagcauggccaggaaa

SEQ ID NO: 1097314 - RNA, 21 nt, Human
ccuguugcccaggcuggucuc

SEQ ID NO: 1097315 - RNA, 19 nt, Human
ccuuacucaccucuuuaaa

SEQ ID NO: 1097316 - RNA, 20 nt, Human
ccuuacucaccucuuuaaag

SEQ ID NO: 1097317 - RNA, 19 nt, Human
ccuuuuagguccucucuuc

SEQ ID NO: 1097318 - RNA, 22 nt, Human
cgauccagucaccacccagcaa

SEQ ID NO: 1097319 - RNA, 19 nt, Human
cggccacaccuccuucugg

SEQ ID NO: 1097320 - RNA, 23 nt, Human
cuauuccggagcaccugggcagc

SEQ ID NO: 1097321 - RNA, 25 nt, Human
cucaaccaauccuccagccucagcc

SEQ ID NO: 1097322 - RNA, 22 nt, Human
cucaaccuccuaagcucaacca

SEQ ID NO: 1097323 - RNA, 24 nt, Human
cucaagcgauccuccugccucaac

SEQ ID NO: 1097324 - RNA, 24 nt, Human
cucacugcaaccuccaccucccag

SEQ ID NO: 1097325 - RNA, 24 nt, Human
cucagccuccugaguagcugggac

SEQ ID NO: 1097326 - RNA, 21 nt, Human
cucaggugauguaccugccuc

SEQ ID NO: 1097327 - RNA, 24 nt, Human
cuccagccucagccuccugaguag

SEQ ID NO: 1097328 - RNA, 25 nt, Human
cuccagccucagccuccugaguagc

SEQ ID NO: 1097329 - RNA, 24 nt, Human
cucccaaauagcugggauuauagg

SEQ ID NO: 1097330 - RNA, 24 nt, Human
cuccugaguagcugggaccacagg

SEQ ID NO: 1097331 - RNA, 23 nt, Human
cuccugccucaaccucccaaacu

SEQ ID NO: 1097332 - RNA, 23 nt, Human
cuccugggcucaagcgauccucc

SEQ ID NO: 1097333 - RNA, 19 nt, Human
cucuguuguccagucugga

SEQ ID NO: 1097334 - RNA, 24 nt, Human
cugcaaccuccaccucccagguuc

SEQ ID NO: 1097335 - RNA, 20 nt, Human
cugcaccccacaccccccgc

SEQ ID NO: 1097336 - RNA, 27 nt, Human
cugcagccucaaccuccuaagcucaac

SEQ ID NO: 1097337 - RNA, 23 nt, Human
cugcuucccaggcuggagugcag

SEQ ID NO: 1097338 - RNA, 24 nt, Human
cuggagggcaauggugugaucuca

SEQ ID NO: 1097339 - RNA, 19 nt, Human
cuggcaccugcaccccaca

SEQ ID NO: 1097340 - RNA, 19 nt, Human
cugugcgguugccgagcug

SEQ ID NO: 1097341 - RNA, 24 nt, Human
cuugacccccaccccccaccccac

SEQ ID NO: 1097342 - RNA, 23 nt, Human
cuugaccucaggugauguaccug

SEQ ID NO: 1097343 - RNA, 24 nt, Human
cuugccucagccucccaaauagcu

SEQ ID NO: 1097344 - RNA, 25 nt, Human
cuugccucagccucccaaauagcug

SEQ ID NO: 1097345 - RNA, 23 nt, Human
gaagaggcacaugcuugaccccc

SEQ ID NO: 1097346 - RNA, 20 nt, Human
gaaguugaaaccagggcagg

SEQ ID NO: 1097347 - RNA, 21 nt, Human
gacagggucagugagugggag

SEQ ID NO: 1097348 - RNA, 19 nt, Human
gacccaguuuucccagggc

SEQ ID NO: 1097349 - RNA, 22 nt, Human
gacccaguuuucccagggcucc

SEQ ID NO: 1097350 - RNA, 19 nt, Human
gacccccaccccccacccc

SEQ ID NO: 1097351 - RNA, 21 nt, Human
gacccccaccccccaccccac

SEQ ID NO: 1097352 - RNA, 24 nt, Human
gaccucaggugauguaccugccuc

SEQ ID NO: 1097353 - RNA, 21 nt, Human
gagaggugugugggcccagcu

SEQ ID NO: 1097354 - RNA, 23 nt, Human
gagguuucaccauguuggccagg

SEQ ID NO: 1097355 - RNA, 24 nt, Human
gaguagcugggaccacaggcaugc

SEQ ID NO: 1097356 - RNA, 22 nt, Human
gauccaguuuucccagggcucc

SEQ ID NO: 1097357 - RNA, 24 nt, Human
gauuauaggcaggugccaccaugc

SEQ ID NO: 1097358 - RNA, 18 nt, Human
gauuauaggcgugagcca

SEQ ID NO: 1097359 - RNA, 21 nt, Human
gauucucuugccucagccucc

SEQ ID NO: 1097360 - RNA, 22 nt, Human
gcaaccuccaccucccagguuc

SEQ ID NO: 1097361 - RNA, 18 nt, Human
gcaagucuguguagaggc

SEQ ID NO: 1097362 - RNA, 21 nt, Human
gcaauggugugaucucagcuc

SEQ ID NO: 1097363 - RNA, 21 nt, Human
gccucaaccucccaaacuguu

SEQ ID NO: 1097364 - RNA, 25 nt, Human
gccucaaccuccuaagcucaaccaa

SEQ ID NO: 1097365 - RNA, 20 nt, Human
gccucagccuccugaguagc

SEQ ID NO: 1097366 - RNA, 20 nt, Human
gcucuguuguccagucugga

SEQ ID NO: 1097367 - RNA, 19 nt, Human
gcuucagcagauggauuug

SEQ ID NO: 1097368 - RNA, 23 nt, Human
ggaagcccaagggacuccaaggu

SEQ ID NO: 1097369 - RNA, 18 nt, Human
gggaagcccaagggacuc

SEQ ID NO: 1097370 - RNA, 22 nt, Human
gggcaauggugugaucucagcu

SEQ ID NO: 1097371 - RNA, 22 nt, Human
gggcucaagcgauccuccugcc

SEQ ID NO: 1097372 - RNA, 22 nt, Human
ggggacacaguuugacccauca

SEQ ID NO: 1097373 - RNA, 19 nt, Human
ggucucggaagacaucgug

SEQ ID NO: 1097374 - RNA, 24 nt, Human
ggugauguaccugccucggccucc

SEQ ID NO: 1097375 - RNA, 21 nt, Human
gguguccccucgcaccugccu

SEQ ID NO: 1097376 - RNA, 21 nt, Human
uaaacuccaugaccggccaca

SEQ ID NO: 1097377 - RNA, 19 nt, Human
uaagcucaaccaauccucc

SEQ ID NO: 1097378 - RNA, 20 nt, Human
uaagcucaaccaauccucca

SEQ ID NO: 1097379 - RNA, 26 nt, Human
uaauuuucguauuuuuugguaagaga

SEQ ID NO: 1097380 - RNA, 24 nt, Human
uaauuuuuauauuuucaguagaga

SEQ ID NO: 1097381 - RNA, 24 nt, Human
uacagguaugagcuaccgccccca

SEQ ID NO: 1097382 - RNA, 21 nt, Human
uacucaccucuuuaaagaccc

SEQ ID NO: 1097383 - RNA, 22 nt, Human
uagagacgagguuucaccaugu

SEQ ID NO: 1097384 - RNA, 19 nt, Human
uagguggugcugagacuga

SEQ ID NO: 1097385 - RNA, 22 nt, Human
uauaggcaggugccaccaugcc

SEQ ID NO: 1097386 - RNA, 19 nt, Human
ucaaaugauucucuugccu

SEQ ID NO: 1097387 - RNA, 18 nt, Human
ucaccacccagcaagcag

SEQ ID NO: 1097388 - RNA, 22 nt, Human
ucaccucuuuuuuuuuuuuuuu

SEQ ID NO: 1097389 - RNA, 24 nt, Human
ucacugcaaccuccaccucccagg

SEQ ID NO: 1097390 - RNA, 25 nt, Human
ucacugcaaccuccaccucccaggu

SEQ ID NO: 1097391 - RNA, 27 nt, Human
ucacugcaaccuccaccucccagguuc

SEQ ID NO: 1097392 - RNA, 24 nt, Human
ucacugcagccucaaccuccuaag

SEQ ID NO: 1097393 - RNA, 18 nt, Human
ucagccucccaaauagcu

SEQ ID NO: 1097394 - RNA, 20 nt, Human
ucagccucccaaauagcugg

SEQ ID NO: 1097395 - RNA, 23 nt, Human
ucagccuccugaguagcugggac

SEQ ID NO: 1097396 - RNA, 25 nt, Human
ucagcucacugcaaccuccaccucc

SEQ ID NO: 1097397 - RNA, 24 nt, Human
ucaguagagacgagguuucaccau

SEQ ID NO: 1097398 - RNA, 19 nt, Human
uccacaggcugaagaauga

SEQ ID NO: 1097399 - RNA, 24 nt, Human
ucccaaacuguugggauuauaggc

SEQ ID NO: 1097400 - RNA, 24 nt, Human
ucccaaauagcugggauuauaggc

SEQ ID NO: 1097401 - RNA, 22 nt, Human
ucccaggcuggagugcaguggu

SEQ ID NO: 1097402 - RNA, 21 nt, Human
ucccagggcuccagacaccag

SEQ ID NO: 1097403 - RNA, 21 nt, Human
ucccagguucaaaugauucuc

SEQ ID NO: 1097404 - RNA, 21 nt, Human
ucccagguucaaaugauucuc

SEQ ID NO: 1097405 - RNA, 24 nt, Human
uccggagcaccugggcagccugga

SEQ ID NO: 1097406 - RNA, 20 nt, Human
uccggcugccgcuggguggg

SEQ ID NO: 1097407 - RNA, 19 nt, Human
uccuccagccucagccucc

SEQ ID NO: 1097408 - RNA, 24 nt, Human
uccuccugccucaaccucccaaac

SEQ ID NO: 1097409 - RNA, 24 nt, Human
uccugaguagcugggaccacaggc

SEQ ID NO: 1097410 - RNA, 20 nt, Human
uccugccucaaccucccaaa

SEQ ID NO: 1097411 - RNA, 21 nt, Human
uccugggcucaagcgauccuc

SEQ ID NO: 1097412 - RNA, 22 nt, Human
uccugggcucaagcgauccucc

SEQ ID NO: 1097413 - RNA, 24 nt, Human
uccugggcucaagcgauccuccug

SEQ ID NO: 1097414 - RNA, 23 nt, Human
ucucacucugcuucccaggcugg

SEQ ID NO: 1097415 - RNA, 24 nt, Human
ucucacucugcuucccaggcugga

SEQ ID NO: 1097416 - RNA, 19 nt, Human
ucugcuucccaggcuggag

SEQ ID NO: 1097417 - RNA, 24 nt, Human
ucugcuucccaggcuggagugcag

SEQ ID NO: 1097418 - RNA, 23 nt, Human
ucugugcgguugccgagcuggug

SEQ ID NO: 1097419 - RNA, 22 nt, Human
ucuuuuuuuuuuuuuuugacag

SEQ ID NO: 1097420 - RNA, 18 nt, Human
ugaaggcacagggggcgg

SEQ ID NO: 1097421 - RNA, 20 nt, Human
ugacccccaccccccacccc

SEQ ID NO: 1097422 - RNA, 19 nt, Human
ugaccucaggugauguacc

SEQ ID NO: 1097423 - RNA, 24 nt, Human
ugaccucaggugauguaccugccu

SEQ ID NO: 1097424 - RNA, 25 nt, Human
ugcccaggcuggucucaagacuccu

SEQ ID NO: 1097425 - RNA, 24 nt, Human
ugccucaaccucccaaacuguugg

SEQ ID NO: 1097426 - RNA, 26 nt, Human
ugccucagccucccaaauagcuggga

SEQ ID NO: 1097427 - RNA, 21 nt, Human
ugccucggccucccuaagucc

SEQ ID NO: 1097428 - RNA, 24 nt, Human
ugccuggcuaauuuuuauauuuuc

SEQ ID NO: 1097429 - RNA, 24 nt, Human
ugcuugacccccaccccccacccc

SEQ ID NO: 1097430 - RNA, 19 nt, Human
uggagggcaauggugugau

SEQ ID NO: 1097431 - RNA, 18 nt, Human
uggagugcagugguggga

SEQ ID NO: 1097432 - RNA, 20 nt, Human
uggagugcaguggugggagc

SEQ ID NO: 1097433 - RNA, 28 nt, Human
uggagugcaguggugggagggcucuagc

SEQ ID NO: 1097434 - RNA, 24 nt, Human
uggccaggcuggucucaaacucuu

SEQ ID NO: 1097435 - RNA, 18 nt, Human
uggcuggauggccccagg

SEQ ID NO: 1097436 - RNA, 19 nt, Human
uggcuggauggccccaggu

SEQ ID NO: 1097437 - RNA, 21 nt, Human
ugggaccacaggcaugcacca

SEQ ID NO: 1097438 - RNA, 24 nt, Human
ugggaccacaggcaugcaccacca

SEQ ID NO: 1097439 - RNA, 23 nt, Human
ugggagcacagcucacugcagcc

SEQ ID NO: 1097440 - RNA, 21 nt, Human
ugggauuauaggcaggugcca

SEQ ID NO: 1097441 - RNA, 22 nt, Human
ugggauuauaggcaggugccac

SEQ ID NO: 1097442 - RNA, 24 nt, Human
ugggauuauaggcaggugccacca

SEQ ID NO: 1097443 - RNA, 25 nt, Human
ugggauuauaggcaggugccaccau

SEQ ID NO: 1097444 - RNA, 18 nt, Human
ugggauuauaggcgugag

SEQ ID NO: 1097445 - RNA, 19 nt, Human
ugggauuauaggcgugagc

SEQ ID NO: 1097446 - RNA, 21 nt, Human
ugggauuauaggcgugagcca

SEQ ID NO: 1097447 - RNA, 22 nt, Human
ugggcccagcugcuuccggcug

SEQ ID NO: 1097448 - RNA, 24 nt, Human
ugggcucaagcgauccuccugccu

SEQ ID NO: 1097449 - RNA, 21 nt, Human
ugggggacacaguuugaccca

SEQ ID NO: 1097450 - RNA, 21 nt, Human
ugggugcaagagcuuggggau

SEQ ID NO: 1097451 - RNA, 23 nt, Human
ugggugcaagagcuuggggaugg

SEQ ID NO: 1097452 - RNA, 23 nt, Human
ugguaccaccaggacagggcagc

SEQ ID NO: 1097453 - RNA, 25 nt, Human
uggugacaccaggggagccaucuug

SEQ ID NO: 1097454 - RNA, 24 nt, Human
uggugugaucucagcucacugcaa

SEQ ID NO: 1097455 - RNA, 20 nt, Human
ugugaugaguggcaagauug

SEQ ID NO: 1097456 - RNA, 21 nt, Human
ugugugggcccagcugcuucc

SEQ ID NO: 1097457 - RNA, 21 nt, Human
uguugcccaggcuggucucaa

SEQ ID NO: 1097458 - RNA, 24 nt, Human
uguuugugaugaguggcaagauca

SEQ ID NO: 1097459 - RNA, 20 nt, Human
uuagggcuucagcagaugga

SEQ ID NO: 1097460 - RNA, 23 nt, Human
uucaaaugauucucuugccucag

SEQ ID NO: 1097461 - RNA, 20 nt, Human
uucacaaagccccaagcacc

SEQ ID NO: 1097462 - RNA, 23 nt, Human
uucccaggcuggagugcaguggu

SEQ ID NO: 1097463 - RNA, 24 nt, Human
uucccaggcuggagugcaguggug

SEQ ID NO: 1097464 - RNA, 21 nt, Human
uucccugcagaguggcuucac

SEQ ID NO: 1097465 - RNA, 18 nt, Human
uuccggagcaccugggca

SEQ ID NO: 1097466 - RNA, 24 nt, Human
uucucuguuaaaccaaagugagaa

SEQ ID NO: 1097467 - RNA, 23 nt, Human
uucugugcaugucuaaucucccu

SEQ ID NO: 1097468 - RNA, 22 nt, Human
uugcucuguuguccagucugga

SEQ ID NO: 1097469 - RNA, 24 nt, Human
uugcugccuauuccggagcaccug

SEQ ID NO: 1097470 - RNA, 23 nt, Human
uuggaaucccccuggggaccugg

SEQ ID NO: 1097471 - RNA, 21 nt, Human
uugggauuauaggcgugagcc

SEQ ID NO: 1097472 - RNA, 24 nt, Human
uuucaccauguuggccaggcuggu

SEQ ID NO: 1097473 - RNA, 23 nt, Human
uuuccuuuuagguccucucuucu

SEQ ID NO: 1097474 - RNA, 24 nt, Human
uuuucaguagagacgagguuucac

SEQ ID NO: 1097475 - RNA, 23 nt, Human
uuuugcucuguuguccagucugg

SEQ ID NO: 1097476 - RNA, 24 nt, Human
uuuugcucuguuguccagucugga

SEQ ID NO: 1097477 - RNA, 22 nt, Human
aaaaauaaccauacccuguugc

SEQ ID NO: 1097478 - RNA, 22 nt, Human
aaacacgucaguauaaaaugag

SEQ ID NO: 1097479 - RNA, 19 nt, Human
aacaaugagaacacuugga

SEQ ID NO: 1097480 - RNA, 23 nt, Human
aaccaguaggggcuuugcauggg

SEQ ID NO: 1097481 - RNA, 23 nt, Human
aagcgcagcccuggagagggugc

SEQ ID NO: 1097482 - RNA, 20 nt, Human
aagcucagagcaggcugcgg

SEQ ID NO: 1097483 - RNA, 18 nt, Human
acaaggacagaaaaccaa

SEQ ID NO: 1097484 - RNA, 23 nt, Human
acagacaccuccauuaucuguaa

SEQ ID NO: 1097485 - RNA, 21 nt, Human
acaucacacaccagggccagu

SEQ ID NO: 1097486 - RNA, 20 nt, Human
acaucagaaagcucagagca

SEQ ID NO: 1097487 - RNA, 18 nt, Human
accaaacaccgcauguuc

SEQ ID NO: 1097488 - RNA, 23 nt, Human
accaacccaaauguccaucaaua

SEQ ID NO: 1097489 - RNA, 21 nt, Human
acccuaugaccccacacccug

SEQ ID NO: 1097490 - RNA, 19 nt, Human
agaaaaacgcagagaucaa

SEQ ID NO: 1097491 - RNA, 20 nt, Human
agaaaaccaaacaccgcaug

SEQ ID NO: 1097492 - RNA, 21 nt, Human
agacaacacccuuaacagagc

SEQ ID NO: 1097493 - RNA, 21 nt, Human
agcugugugcagggauggugg

SEQ ID NO: 1097494 - RNA, 24 nt, Human
aggaaguagggcgcugagcugagg

SEQ ID NO: 1097495 - RNA, 21 nt, Human
aggaggaaggggaggucccag

SEQ ID NO: 1097496 - RNA, 23 nt, Human
aggaggaaggggaggucccagaa

SEQ ID NO: 1097497 - RNA, 22 nt, Human
aggagggaacaugugccugaga

SEQ ID NO: 1097498 - RNA, 23 nt, Human
aggagggagguacaaagaacugg

SEQ ID NO: 1097499 - RNA, 19 nt, Human
aggcgccuggccccgcccc

SEQ ID NO: 1097500 - RNA, 19 nt, Human
aggcgccuggcccugcccg

SEQ ID NO: 1097501 - RNA, 22 nt, Human
agggaagaaucuuggaagagcu

SEQ ID NO: 1097502 - RNA, 18 nt, Human
agggacauggauuaaacu

SEQ ID NO: 1097503 - RNA, 23 nt, Human
agggagaggagggagguacaaag

SEQ ID NO: 1097504 - RNA, 20 nt, Human
agggcgcugagcugaggugg

SEQ ID NO: 1097505 - RNA, 20 nt, Human
agggggaaccaguaggggcu

SEQ ID NO: 1097506 - RNA, 26 nt, Human
agggggaggagcugguaccugcucca

SEQ ID NO: 1097507 - RNA, 19 nt, Human
aggugggcaggcccagggc

SEQ ID NO: 1097508 - RNA, 20 nt, Human
aggugggggagugggggagg

SEQ ID NO: 1097509 - RNA, 22 nt, Human
auccaugguccagucguccugg

SEQ ID NO: 1097510 - RNA, 21 nt, Human
caaggacagaaaaccaaacac

SEQ ID NO: 1097511 - RNA, 22 nt, Human
caauagcaaagacuuggaacca

SEQ ID NO: 1097512 - RNA, 19 nt, Human
cacaaggacagaaaaccaa

SEQ ID NO: 1097513 - RNA, 23 nt, Human
caccccuagcucuccaugccugg

SEQ ID NO: 1097514 - RNA, 19 nt, Human
cacccuaugaccccacacc

SEQ ID NO: 1097515 - RNA, 21 nt, Human
cacccuaugaccccacacccu

SEQ ID NO: 1097516 - RNA, 18 nt, Human
cagaaaaccaaacaccgc

SEQ ID NO: 1097517 - RNA, 22 nt, Human
cagaauggagggaagaaucuug

SEQ ID NO: 1097518 - RNA, 20 nt, Human
cagagugaggagaggaaggg

SEQ ID NO: 1097519 - RNA, 21 nt, Human
cagcaaacuaucacaaggaca

SEQ ID NO: 1097520 - RNA, 18 nt, Human
cagcaagccaacauggca

SEQ ID NO: 1097521 - RNA, 22 nt, Human
cagcacgaugacuaaacacguc

SEQ ID NO: 1097522 - RNA, 19 nt, Human
cagcaggcaggggcaggca

SEQ ID NO: 1097523 - RNA, 18 nt, Human
cagcugggugagaugugu

SEQ ID NO: 1097524 - RNA, 24 nt, Human
caggcccagggcagugggggagcc

SEQ ID NO: 1097525 - RNA, 21 nt, Human
caggggaccacagcccccccu

SEQ ID NO: 1097526 - RNA, 22 nt, Human
caguaggggaggugggggaguc

SEQ ID NO: 1097527 - RNA, 18 nt, Human
caucuuucucagcaaacu

SEQ ID NO: 1097528 - RNA, 19 nt, Human
caugaagcaugcugugccc

SEQ ID NO: 1097529 - RNA, 21 nt, Human
caugacaacauacacagacac

SEQ ID NO: 1097530 - RNA, 23 nt, Human
caugacaacauacacagacaccu

SEQ ID NO: 1097531 - RNA, 22 nt, Human
caugagugagggagaggaggga

SEQ ID NO: 1097532 - RNA, 22 nt, Human
cauguccaaaucucuucuuccc

SEQ ID NO: 1097533 - RNA, 19 nt, Human
cauguccccagagaaucca

SEQ ID NO: 1097534 - RNA, 20 nt, Human
ccaaacgcucaggaaacacc

SEQ ID NO: 1097535 - RNA, 21 nt, Human
ccaaagacugaaaaauaacca

SEQ ID NO: 1097536 - RNA, 22 nt, Human
ccaaagacugaaaaauaaccau

SEQ ID NO: 1097537 - RNA, 20 nt, Human
ccacagcccccccugccugg

SEQ ID NO: 1097538 - RNA, 18 nt, Human
ccaggagagggcacuugc

SEQ ID NO: 1097539 - RNA, 20 nt, Human
ccauaaaaaagaugaauuca

SEQ ID NO: 1097540 - RNA, 21 nt, Human
ccauuuugacgacccuccauu

SEQ ID NO: 1097541 - RNA, 21 nt, Human
cccaaauguccaucaauaaca

SEQ ID NO: 1097542 - RNA, 19 nt, Human
cccaaccguucacacaucu

SEQ ID NO: 1097543 - RNA, 21 nt, Human
ccccacacccugcagcugcac

SEQ ID NO: 1097544 - RNA, 23 nt, Human
ccccagccguuugguguuuggug

SEQ ID NO: 1097545 - RNA, 23 nt, Human
ccccaucagcccggucaccuggu

SEQ ID NO: 1097546 - RNA, 22 nt, Human
cccccagggcagggaugggcca

SEQ ID NO: 1097547 - RNA, 20 nt, Human
ccccgccccuccccucaguc

SEQ ID NO: 1097548 - RNA, 18 nt, Human
cccgcaggcgccuggccc

SEQ ID NO: 1097549 - RNA, 18 nt, Human
cccgcaggcgccuggccc

SEQ ID NO: 1097550 - RNA, 26 nt, Human
cccgcccacaucagaaagcucagagc

SEQ ID NO: 1097551 - RNA, 19 nt, Human
cccgccccuccccgcaggc

SEQ ID NO: 1097552 - RNA, 19 nt, Human
ccgccccuccccgcaggcu

SEQ ID NO: 1097553 - RNA, 19 nt, Human
ccgggccccgccccucccc

SEQ ID NO: 1097554 - RNA, 20 nt, Human
ccgggccccgccccuccccg

SEQ ID NO: 1097555 - RNA, 21 nt, Human
ccggucccgcccacaucagaa

SEQ ID NO: 1097556 - RNA, 22 nt, Human
ccggucccgcccacaucagaaa

SEQ ID NO: 1097557 - RNA, 19 nt, Human
ccguucacacaucugaaca

SEQ ID NO: 1097558 - RNA, 21 nt, Human
ccucaucccuuuaccuaauaa

SEQ ID NO: 1097559 - RNA, 24 nt, Human
ccuccuaugcaggucaaacuacua

SEQ ID NO: 1097560 - RNA, 18 nt, Human
ccugcacugagcgacucc

SEQ ID NO: 1097561 - RNA, 20 nt, Human
ccuggaccaggucuccuccc

SEQ ID NO: 1097562 - RNA, 22 nt, Human
ccuguggugucgcccccagggc

SEQ ID NO: 1097563 - RNA, 22 nt, Human
cgcaggcgccuggccccgcccc

SEQ ID NO: 1097564 - RNA, 19 nt, Human
cgcugagcugagguggucc

SEQ ID NO: 1097565 - RNA, 20 nt, Human
cgucaguauaaaaugagauc

SEQ ID NO: 1097566 - RNA, 27 nt, Human
cguugugcaccuguacccuagaacuua

SEQ ID NO: 1097567 - RNA, 22 nt, Human
cuauuuuaaagaaacuauggau

SEQ ID NO: 1097568 - RNA, 23 nt, Human
cucagagcaggcugcgggcaguu

SEQ ID NO: 1097569 - RNA, 20 nt, Human
cuccgugcuccaaauccuga

SEQ ID NO: 1097570 - RNA, 21 nt, Human
cugcagagccuccucaccaug

SEQ ID NO: 1097571 - RNA, 18 nt, Human
cugccuggacugcccuag

SEQ ID NO: 1097572 - RNA, 19 nt, Human
cugcuucuugaagagguga

SEQ ID NO: 1097573 - RNA, 23 nt, Human
cuggacugcccuaggcucuggaa

SEQ ID NO: 1097574 - RNA, 24 nt, Human
cuggcuugcuccccauucgccugc

SEQ ID NO: 1097575 - RNA, 19 nt, Human
cuugccuccgugcuccaaa

SEQ ID NO: 1097576 - RNA, 18 nt, Human
cuuggaagagcugcagug

SEQ ID NO: 1097577 - RNA, 21 nt, Human
gaacucugggccgguccugca

SEQ ID NO: 1097578 - RNA, 20 nt, Human
gaauggagggugaagaugga

SEQ ID NO: 1097579 - RNA, 20 nt, Human
gagaacacuuggacacaggg

SEQ ID NO: 1097580 - RNA, 21 nt, Human
gagacaacacccuuaacagag

SEQ ID NO: 1097581 - RNA, 21 nt, Human
gaggacacaggcccuggagga

SEQ ID NO: 1097582 - RNA, 24 nt, Human
gagguggauucugggucaacaccc

SEQ ID NO: 1097583 - RNA, 18 nt, Human
gagugagggagaggaggg

SEQ ID NO: 1097584 - RNA, 19 nt, Human
gaucaagauuucuaacucg

SEQ ID NO: 1097585 - RNA, 24 nt, Human
gauccuggaccaggucuccucccg

SEQ ID NO: 1097586 - RNA, 25 nt, Human
gaugggaagugaguuuaucagggga

SEQ ID NO: 1097587 - RNA, 22 nt, Human
gcaaacuaucacaaggacagaa

SEQ ID NO: 1097588 - RNA, 23 nt, Human
gcagaugcucguggggcuguugu

SEQ ID NO: 1097589 - RNA, 23 nt, Human
gccacauauuaaagugacucaga

SEQ ID NO: 1097590 - RNA, 18 nt, Human
gcccuaggcucuggaucc

SEQ ID NO: 1097591 - RNA, 22 nt, Human
gcugcacugagcuucacugacc

SEQ ID NO: 1097592 - RNA, 19 nt, Human
gcugcuucuugaagaggug

SEQ ID NO: 1097593 - RNA, 18 nt, Human
gcuggggaaggugggcag

SEQ ID NO: 1097594 - RNA, 21 nt, Human
ggaaaaaacuucuguuuuucu

SEQ ID NO: 1097595 - RNA, 23 nt, Human
ggagggaacaugugccugagacu

SEQ ID NO: 1097596 - RNA, 24 nt, Human
ggaggugggggagugggggaggga

SEQ ID NO: 1097597 - RNA, 22 nt, Human
ggccacaggggcucaggaggaa

SEQ ID NO: 1097598 - RNA, 21 nt, Human
ggccauggagcuuaguugagg

SEQ ID NO: 1097599 - RNA, 19 nt, Human
ggccuggcggcuccagcug

SEQ ID NO: 1097600 - RNA, 19 nt, Human
ggcuggggaaggugggcag

SEQ ID NO: 1097601 - RNA, 18 nt, Human
gggaagggggaaccagua

SEQ ID NO: 1097602 - RNA, 22 nt, Human
gggaaggugggcaggcccaggg

SEQ ID NO: 1097603 - RNA, 18 nt, Human
gggagggaaagcauuagg

SEQ ID NO: 1097604 - RNA, 22 nt, Human
gggcagcaggcaggggcaggca

SEQ ID NO: 1097605 - RNA, 19 nt, Human
ggggaggugggggaguggg

SEQ ID NO: 1097606 - RNA, 18 nt, Human
ggggcgcgugaggcggcc

SEQ ID NO: 1097607 - RNA, 24 nt, Human
gguacaaagaacuggggaaaggga

SEQ ID NO: 1097608 - RNA, 28 nt, Human
gguacaaagaacuggggaaagggaguaa

SEQ ID NO: 1097609 - RNA, 21 nt, Human
guauuugcacaaacuuugaga

SEQ ID NO: 1097610 - RNA, 18 nt, Human
gugcugcuucuugaagag

SEQ ID NO: 1097611 - RNA, 20 nt, Human
gugggucugugugugugugu

SEQ ID NO: 1097612 - RNA, 18 nt, Human
guguggaguuggagagcc

SEQ ID NO: 1097613 - RNA, 20 nt, Human
guugcuggaucucucuugcc

SEQ ID NO: 1097614 - RNA, 18 nt, Human
uaacaaaugauguggcug

SEQ ID NO: 1097615 - RNA, 21 nt, Human
uaacagaguagauuaagaaaa

SEQ ID NO: 1097616 - RNA, 19 nt, Human
uaaccccuggcuugcuccc

SEQ ID NO: 1097617 - RNA, 19 nt, Human
uagaacagcccaugucuga

SEQ ID NO: 1097618 - RNA, 24 nt, Human
uagaacagcccaugucugaaaccc

SEQ ID NO: 1097619 - RNA, 23 nt, Human
uaggcucuggaucuguaaccccu

SEQ ID NO: 1097620 - RNA, 20 nt, Human
uauaaaaugagaucaugaag

SEQ ID NO: 1097621 - RNA, 25 nt, Human
uauauacaccacggaauacuaugca

SEQ ID NO: 1097622 - RNA, 23 nt, Human
uaucuguaaacccaaccguucac

SEQ ID NO: 1097623 - RNA, 18 nt, Human
ucaaaucuuauucaggua

SEQ ID NO: 1097624 - RNA, 25 nt, Human
ucaagccagggaugugaacucuggg

SEQ ID NO: 1097625 - RNA, 25 nt, Human
ucaagccagggauguugucucccga

SEQ ID NO: 1097626 - RNA, 22 nt, Human
ucagcaaacuaucacaaggaca

SEQ ID NO: 1097627 - RNA, 20 nt, Human
uccaaaucucuucuucccca

SEQ ID NO: 1097628 - RNA, 22 nt, Human
uccaaaucucuucuuccccagc

SEQ ID NO: 1097629 - RNA, 25 nt, Human
uccauuaucuguaaacccaaccguu

SEQ ID NO: 1097630 - RNA, 24 nt, Human
uccauuccauguuguaggugacac

SEQ ID NO: 1097631 - RNA, 19 nt, Human
uccccgcaggcgccuggcc

SEQ ID NO: 1097632 - RNA, 19 nt, Human
ucccgugucuuugacaucc

SEQ ID NO: 1097633 - RNA, 23 nt, Human
ucccuguggugucgcccccaggg

SEQ ID NO: 1097634 - RNA, 18 nt, Human
ucgcaucucuccagccac

SEQ ID NO: 1097635 - RNA, 24 nt, Human
ucgccugccugaccacagcuccga

SEQ ID NO: 1097636 - RNA, 22 nt, Human
ucuaagaagcucaccccuagcu

SEQ ID NO: 1097637 - RNA, 19 nt, Human
ucuguaaccccuggcuugc

SEQ ID NO: 1097638 - RNA, 21 nt, Human
ucuucacguuggaggugagga

SEQ ID NO: 1097639 - RNA, 19 nt, Human
ugaacucugggccgguccu

SEQ ID NO: 1097640 - RNA, 22 nt, Human
ugacuugccagcucuagagggu

SEQ ID NO: 1097641 - RNA, 23 nt, Human
ugagaugugucaucagucacagg

SEQ ID NO: 1097642 - RNA, 20 nt, Human
ugagcugugugcagggaugg

SEQ ID NO: 1097643 - RNA, 18 nt, Human
ugagggagaggagggagg

SEQ ID NO: 1097644 - RNA, 19 nt, Human
ugaguggaggugaaguggg

SEQ ID NO: 1097645 - RNA, 21 nt, Human
ugauccuggaccaggucuccu

SEQ ID NO: 1097646 - RNA, 20 nt, Human
ugccaaagacugaaaaauaa

SEQ ID NO: 1097647 - RNA, 21 nt, Human
ugccaaagacugaaaaauaac

SEQ ID NO: 1097648 - RNA, 23 nt, Human
ugccaaagacugaaaaauaacca

SEQ ID NO: 1097649 - RNA, 24 nt, Human
ugcccuaggcucuggaucuguaac

SEQ ID NO: 1097650 - RNA, 28 nt, Human
ugccuccgugcuccaaauccugaaaucu

SEQ ID NO: 1097651 - RNA, 20 nt, Human
ugccugagacugugcugcuu

SEQ ID NO: 1097652 - RNA, 19 nt, Human
ugccuggacugcccuaggc

SEQ ID NO: 1097653 - RNA, 22 nt, Human
ugccuggacugcccuaggcucu

SEQ ID NO: 1097654 - RNA, 18 nt, Human
ugccuggauggcagaugc

SEQ ID NO: 1097655 - RNA, 20 nt, Human
ugcgggcaguucccggguua

SEQ ID NO: 1097656 - RNA, 20 nt, Human
ugcgggggcuggggaaggug

SEQ ID NO: 1097657 - RNA, 21 nt, Human
uggaauggagggugaagaugg

SEQ ID NO: 1097658 - RNA, 22 nt, Human
uggaccaggucuccucccgcag

SEQ ID NO: 1097659 - RNA, 25 nt, Human
uggaggugaggacacaggcccugga

SEQ ID NO: 1097660 - RNA, 21 nt, Human
uggauucugggucaacacccu

SEQ ID NO: 1097661 - RNA, 22 nt, Human
uggauucugggucaacacccuu

SEQ ID NO: 1097662 - RNA, 18 nt, Human
uggcaaggucacagaagu

SEQ ID NO: 1097663 - RNA, 19 nt, Human
uggcaaggugagcggaagg

SEQ ID NO: 1097664 - RNA, 21 nt, Human
uggcacauguauaccuaugua

SEQ ID NO: 1097665 - RNA, 22 nt, Human
uggcauauauacaccacggaau

SEQ ID NO: 1097666 - RNA, 18 nt, Human
uggccuggcggcuccagc

SEQ ID NO: 1097667 - RNA, 18 nt, Human
ugggaggggacaugagug

SEQ ID NO: 1097668 - RNA, 20 nt, Human
ugggucugugugugugugug

SEQ ID NO: 1097669 - RNA, 20 nt, Human
uggugucgcccccagggcag

SEQ ID NO: 1097670 - RNA, 24 nt, Human
ugguguggaguuggagagccuuga

SEQ ID NO: 1097671 - RNA, 24 nt, Human
uguaaaugacgaguuuaugggugc

SEQ ID NO: 1097672 - RNA, 18 nt, Human
uguagaucaagccaggga

SEQ ID NO: 1097673 - RNA, 27 nt, Human
uguauaccuauguaacaaaccugcacg

SEQ ID NO: 1097674 - RNA, 22 nt, Human
uguauuugcacaaacuuugaga

SEQ ID NO: 1097675 - RNA, 23 nt, Human
uguccaaaucucuucuuccccag

SEQ ID NO: 1097676 - RNA, 19 nt, Human
ugucugaaacccuagucag

SEQ ID NO: 1097677 - RNA, 24 nt, Human
ugugaacucugggccgguccugca

SEQ ID NO: 1097678 - RNA, 21 nt, Human
ugugccugagacugugcugcu

SEQ ID NO: 1097679 - RNA, 19 nt, Human
uguggaguuggagagccuu

SEQ ID NO: 1097680 - RNA, 18 nt, Human
uguguguguggcggggag

SEQ ID NO: 1097681 - RNA, 22 nt, Human
uuaaaauuaaugucauguagaa

SEQ ID NO: 1097682 - RNA, 24 nt, Human
uuaucuguaaacccaaccguucac

SEQ ID NO: 1097683 - RNA, 20 nt, Human
uucacaguauuuuacaaagc

SEQ ID NO: 1097684 - RNA, 23 nt, Human
uucugggucaacacccuuuucag

SEQ ID NO: 1097685 - RNA, 19 nt, Human
uugauccuggaccaggucu

SEQ ID NO: 1097686 - RNA, 18 nt, Human
uuggaagagcugcagugg

SEQ ID NO: 1097687 - RNA, 23 nt, Human
uuggagagccuugacugcggggg

SEQ ID NO: 1097688 - RNA, 24 nt, Human
agagcuccagccauugugacaugg

SEQ ID NO: 1097689 - RNA, 22 nt, Human
agcuccagccauugugacaugg

SEQ ID NO: 1097690 - RNA, 23 nt, Human
augguuggagugggggugggguu

SEQ ID NO: 1097691 - RNA, 20 nt, Human
auugugacaugguuggagug

SEQ ID NO: 1097692 - RNA, 20 nt, Human
ccucagagcuccagccauug

SEQ ID NO: 1097693 - RNA, 19 nt, Human
ccuccuggcucagggagcc

SEQ ID NO: 1097694 - RNA, 24 nt, Human
ccuccuggcucagggagccugggc

SEQ ID NO: 1097695 - RNA, 18 nt, Human
gccugggccccucagagc

SEQ ID NO: 1097696 - RNA, 20 nt, Human
gccugggccccucagagcuc

SEQ ID NO: 1097697 - RNA, 23 nt, Human
gggagccugggccccucagagcu

SEQ ID NO: 1097698 - RNA, 22 nt, Human
ugacaugguuggagugggggug

SEQ ID NO: 1097699 - RNA, 20 nt, Human
ugggccccucagagcuccag

SEQ ID NO: 1097700 - RNA, 25 nt, Human
ugggguucuucccuggaacucuccu

SEQ ID NO: 1097701 - RNA, 23 nt, Human
aacggcgguggcggcggcggcgg

SEQ ID NO: 1097702 - RNA, 28 nt, Human
acccugguggccccacagccccacauug

SEQ ID NO: 1097703 - RNA, 20 nt, Human
acccugguggccccacagcu

SEQ ID NO: 1097704 - RNA, 20 nt, Human
agcugguuuucucauggagg

SEQ ID NO: 1097705 - RNA, 24 nt, Human
cacagccccacauuggagggcagg

SEQ ID NO: 1097706 - RNA, 18 nt, Human
caccugcacaggguccag

SEQ ID NO: 1097707 - RNA, 18 nt, Human
cagcagcaggaguaagag

SEQ ID NO: 1097708 - RNA, 21 nt, Human
cagcagcgacggcgacaacgg

SEQ ID NO: 1097709 - RNA, 18 nt, Human
cagcgacggcgacaacgg

SEQ ID NO: 1097710 - RNA, 27 nt, Human
caggagaaagaggaguacugcgugggu

SEQ ID NO: 1097711 - RNA, 24 nt, Human
caucauaguugccacguugaugcc

SEQ ID NO: 1097712 - RNA, 22 nt, Human
ccacauuggagggcaggcccgc

SEQ ID NO: 1097713 - RNA, 20 nt, Human
ccgcugcuggugguugcagc

SEQ ID NO: 1097714 - RNA, 23 nt, Human
ccuccuccuccagguaggaauug

SEQ ID NO: 1097715 - RNA, 19 nt, Human
ccugaucaaagaaaggcac

SEQ ID NO: 1097716 - RNA, 24 nt, Human
cggcgacgaacacagcgaagaaga

SEQ ID NO: 1097717 - RNA, 30 nt, Human
cggcggcggcggcgacgaacacagcgaagg

SEQ ID NO: 1097718 - RNA, 21 nt, Human
cuaaggcguucuggaguccau

SEQ ID NO: 1097719 - RNA, 23 nt, Human
gacaacggcgguggcggcggcgg

SEQ ID NO: 1097720 - RNA, 20 nt, Human
gacaagaacgaugaggccca

SEQ ID NO: 1097721 - RNA, 23 nt, Human
gcagcgacggcgacaacggcggu

SEQ ID NO: 1097722 - RNA, 21 nt, Human
gcaucgugggggcuuucuugg

SEQ ID NO: 1097723 - RNA, 22 nt, Human
gcgacgaacacagcgaagaaga

SEQ ID NO: 1097724 - RNA, 23 nt, Human
gcggcggcggcggcgacgaacac

SEQ ID NO: 1097725 - RNA, 20 nt, Human
gcgguggcggcggcggcggc

SEQ ID NO: 1097726 - RNA, 22 nt, Human
ggacaucuucaccugcacaggg

SEQ ID NO: 1097727 - RNA, 19 nt, Human
ggacugcagccucagcuca

SEQ ID NO: 1097728 - RNA, 19 nt, Human
ggcaggagaaagaggagua

SEQ ID NO: 1097729 - RNA, 30 nt, Human
ggcgacaacggcgguggcggcggcggcgac

SEQ ID NO: 1097730 - RNA, 21 nt, Human
ggcgacgaacacagcgaagaa

SEQ ID NO: 1097731 - RNA, 23 nt, Human
ggcgacgaacacagcgaagaaga

SEQ ID NO: 1097732 - RNA, 20 nt, Human
gucugggggaccacuugggg

SEQ ID NO: 1097733 - RNA, 21 nt, Human
uaaaacccgccccagccgcga

SEQ ID NO: 1097734 - RNA, 22 nt, Human
uaccacccugguggccccacag

SEQ ID NO: 1097735 - RNA, 21 nt, Human
uacgggaagggcagguugucc

SEQ ID NO: 1097736 - RNA, 20 nt, Human
uagagagagggugguggcag

SEQ ID NO: 1097737 - RNA, 24 nt, Human
uagcugguuuucucauggaggggg

SEQ ID NO: 1097738 - RNA, 24 nt, Human
uauugauugcaacaucucacggug

SEQ ID NO: 1097739 - RNA, 19 nt, Human
ucugaguagcccaaucaau

SEQ ID NO: 1097740 - RNA, 18 nt, Human
ucuguaguucugcggccg

SEQ ID NO: 1097741 - RNA, 19 nt, Human
ucuguaguucugcggccgc

SEQ ID NO: 1097742 - RNA, 20 nt, Human
ugacaagaacgaugaggccc

SEQ ID NO: 1097743 - RNA, 21 nt, Human
ugacaagaacgaugaggccca

SEQ ID NO: 1097744 - RNA, 24 nt, Human
ugacagguagagagaggguggugg

SEQ ID NO: 1097745 - RNA, 21 nt, Human
ugcaguggauguggacauccu

SEQ ID NO: 1097746 - RNA, 21 nt, Human
uggauguggacauccugagcc

SEQ ID NO: 1097747 - RNA, 19 nt, Human
uggcggcggcggcggcgac

SEQ ID NO: 1097748 - RNA, 20 nt, Human
ugggauacgggaagggcagg

SEQ ID NO: 1097749 - RNA, 19 nt, Human
uguccuccuccuccaggua

SEQ ID NO: 1097750 - RNA, 18 nt, Human
uuggagaaaugguggcag

SEQ ID NO: 1097751 - RNA, 22 nt, Human
uuugucuguaguucugcggccg

SEQ ID NO: 1097752 - RNA, 21 nt, Human
aacacaacuagguaucuccag

SEQ ID NO: 1097753 - RNA, 21 nt, Human
acacaaauucggccaagguca

SEQ ID NO: 1097754 - RNA, 23 nt, Human
acacaaauucggccaaggucaaa

SEQ ID NO: 1097755 - RNA, 19 nt, Human
cacaucacacaaauucggc

SEQ ID NO: 1097756 - RNA, 21 nt, Human
cucaagcggagaagaggagga

SEQ ID NO: 1097757 - RNA, 20 nt, Human
cuccuggagucccugacccu

SEQ ID NO: 1097758 - RNA, 24 nt, Human
cuccuggagucccugacccucucu

SEQ ID NO: 1097759 - RNA, 21 nt, Human
cugucuuagcuccuggagucc

SEQ ID NO: 1097760 - RNA, 23 nt, Human
gacccucucucucaagcggagaa

SEQ ID NO: 1097761 - RNA, 24 nt, Human
guaucuccagggccacaucacaca

SEQ ID NO: 1097762 - RNA, 20 nt, Human
gucccugacccucucucuca

SEQ ID NO: 1097763 - RNA, 23 nt, Human
uagcuccuggagucccugacccu

SEQ ID NO: 1097764 - RNA, 20 nt, Human
ucggccaaggucaaagucug

SEQ ID NO: 1097765 - RNA, 21 nt, Human
ucuuagcuccuggagucccug

SEQ ID NO: 1097766 - RNA, 22 nt, Human
aaacagaaaggauccaccaggg

SEQ ID NO: 1097767 - RNA, 24 nt, Human
aaagugcugggauuacaggcguga

SEQ ID NO: 1097768 - RNA, 24 nt, Human
aaagugcugggauuacaggcguga

SEQ ID NO: 1097769 - RNA, 22 nt, Human
aaccccugaccucaagugaucc

SEQ ID NO: 1097770 - RNA, 26 nt, Human
aagcacugggauuacagggaugagcc

SEQ ID NO: 1097771 - RNA, 19 nt, Human
aaguagcugggacuacagg

SEQ ID NO: 1097772 - RNA, 20 nt, Human
aaguagcugggacuacaggc

SEQ ID NO: 1097773 - RNA, 19 nt, Human
aagugcugggauuacaggc

SEQ ID NO: 1097774 - RNA, 19 nt, Human
aagugcugggauuacaggc

SEQ ID NO: 1097775 - RNA, 19 nt, Human
aagugcugggauuacaggc

SEQ ID NO: 1097776 - RNA, 19 nt, Human
aagugcugggauuacaggc

SEQ ID NO: 1097777 - RNA, 26 nt, Human
aagugcugggauuacaggcgugagcc

SEQ ID NO: 1097778 - RNA, 26 nt, Human
aagugcugggauuacaggcgugagcc

SEQ ID NO: 1097779 - RNA, 22 nt, Human
accaaaguucaagacucgccca

SEQ ID NO: 1097780 - RNA, 23 nt, Human
accauguuggucaggcuggucuc

SEQ ID NO: 1097781 - RNA, 21 nt, Human
accauuguuaagugccaggcg

SEQ ID NO: 1097782 - RNA, 19 nt, Human
accugcucacccugaccac

SEQ ID NO: 1097783 - RNA, 19 nt, Human
acgcggcugccacacaagu

SEQ ID NO: 1097784 - RNA, 20 nt, Human
acgggguuucaccguuuuag

SEQ ID NO: 1097785 - RNA, 19 nt, Human
acucgcccagggccaccaa

SEQ ID NO: 1097786 - RNA, 20 nt, Human
acugcaagcuccgccucccg

SEQ ID NO: 1097787 - RNA, 26 nt, Human
agacaguccucuagacuuuggucuuc

SEQ ID NO: 1097788 - RNA, 27 nt, Human
agacgggcuggcacccuugaguuaggc

SEQ ID NO: 1097789 - RNA, 19 nt, Human
agagacgggguuucaccgu

SEQ ID NO: 1097790 - RNA, 23 nt, Human
agcccaauacuggaugucccgcc

SEQ ID NO: 1097791 - RNA, 18 nt, Human
agcugcagacagaggccu

SEQ ID NO: 1097792 - RNA, 23 nt, Human
agcugcauaucggcucacauuca

SEQ ID NO: 1097793 - RNA, 18 nt, Human
aggaagagggcugagcug

SEQ ID NO: 1097794 - RNA, 25 nt, Human
aggcuggagugcaguggcgggaucu

SEQ ID NO: 1097795 - RNA, 21 nt, Human
agggauuggggugagucaggg

SEQ ID NO: 1097796 - RNA, 19 nt, Human
aggggagcugcugcugaag

SEQ ID NO: 1097797 - RNA, 20 nt, Human
aguagagacgggguuucacc

SEQ ID NO: 1097798 - RNA, 21 nt, Human
aguagagacgggguuucaccg

SEQ ID NO: 1097799 - RNA, 23 nt, Human
aguagcugggacuacaggcgccc

SEQ ID NO: 1097800 - RNA, 22 nt, Human
agugaggagagggacugggggc

SEQ ID NO: 1097801 - RNA, 20 nt, Human
agugcaguggcgggaucucg

SEQ ID NO: 1097802 - RNA, 23 nt, Human
agugcaguggcgggaucucggcu

SEQ ID NO: 1097803 - RNA, 24 nt, Human
agugcaguggcgggaucucggcuc

SEQ ID NO: 1097804 - RNA, 18 nt, Human
agugcugggauuacaggc

SEQ ID NO: 1097805 - RNA, 18 nt, Human
agugcugggauuacaggc

SEQ ID NO: 1097806 - RNA, 24 nt, Human
caaaaccccaagggcagggagccc

SEQ ID NO: 1097807 - RNA, 26 nt, Human
caaaccccugaccucaagugauccaa

SEQ ID NO: 1097808 - RNA, 24 nt, Human
caaagcacugggauuacagggaug

SEQ ID NO: 1097809 - RNA, 24 nt, Human
caaagugcugggauuacaggcgug

SEQ ID NO: 1097810 - RNA, 24 nt, Human
caaagugcugggauuacaggcgug

SEQ ID NO: 1097811 - RNA, 19 nt, Human
caagacaguccucuagacu

SEQ ID NO: 1097812 - RNA, 23 nt, Human
caagccccccuccucacugauca

SEQ ID NO: 1097813 - RNA, 28 nt, Human
caagugauccaccccgcccccugaaagg

SEQ ID NO: 1097814 - RNA, 18 nt, Human
cacaaagacacgccuaga

SEQ ID NO: 1097815 - RNA, 22 nt, Human
cacaccauucuccugccucagc

SEQ ID NO: 1097816 - RNA, 21 nt, Human
caccauguuggucaggcuggu

SEQ ID NO: 1097817 - RNA, 24 nt, Human
caccauguuggucaggcuggucuc

SEQ ID NO: 1097818 - RNA, 19 nt, Human
cacccagguggagugugcu

SEQ ID NO: 1097819 - RNA, 28 nt, Human
caccccgcccccgcuucggccucccaaa

SEQ ID NO: 1097820 - RNA, 24 nt, Human
cacccugaccaccccaccccaggg

SEQ ID NO: 1097821 - RNA, 24 nt, Human
caccguuuuagccgggauggucuu

SEQ ID NO: 1097822 - RNA, 22 nt, Human
cacugaucaaaaccccaagggc

SEQ ID NO: 1097823 - RNA, 19 nt, Human
cacugcguauccacguagc

SEQ ID NO: 1097824 - RNA, 23 nt, Human
cagacccagacucagacccaagc

SEQ ID NO: 1097825 - RNA, 21 nt, Human
cagacucagacccaagccccc

SEQ ID NO: 1097826 - RNA, 21 nt, Human
cagagcuccuggcaggagccc

SEQ ID NO: 1097827 - RNA, 22 nt, Human
cagagcuccuggcaggagcccc

SEQ ID NO: 1097828 - RNA, 18 nt, Human
cagcugcagacagaggcc

SEQ ID NO: 1097829 - RNA, 21 nt, Human
caggcgcccgccacuacgccc

SEQ ID NO: 1097830 - RNA, 24 nt, Human
caggcgucccaccaugcgggucuu

SEQ ID NO: 1097831 - RNA, 26 nt, Human
caggcucacagagcccaccugcucac

SEQ ID NO: 1097832 - RNA, 27 nt, Human
caggcuccuaacucucagaaucccaca

SEQ ID NO: 1097833 - RNA, 19 nt, Human
cagucucagagcugcccgg

SEQ ID NO: 1097834 - RNA, 22 nt, Human
ccaaagugcugggauuacaggc

SEQ ID NO: 1097835 - RNA, 22 nt, Human
ccaaagugcugggauuacaggc

SEQ ID NO: 1097836 - RNA, 22 nt, Human
ccaaagugcugggauuacaggc

SEQ ID NO: 1097837 - RNA, 22 nt, Human
ccaaagugcugggauuacaggc

SEQ ID NO: 1097838 - RNA, 24 nt, Human
ccaaagugcugggauuacaggcgu

SEQ ID NO: 1097839 - RNA, 24 nt, Human
ccaaagugcugggauuacaggcgu

SEQ ID NO: 1097840 - RNA, 23 nt, Human
ccacaaagacacgccuagacccc

SEQ ID NO: 1097841 - RNA, 25 nt, Human
ccacaaagacacgccuagaccccag

SEQ ID NO: 1097842 - RNA, 26 nt, Human
ccaccccaccccaggggaccccaggc

SEQ ID NO: 1097843 - RNA, 24 nt, Human
ccaccugcucacccugaccacccc

SEQ ID NO: 1097844 - RNA, 22 nt, Human
ccagagccuggaggaugagggg

SEQ ID NO: 1097845 - RNA, 23 nt, Human
cccaaguagcugggacuacaggc

SEQ ID NO: 1097846 - RNA, 23 nt, Human
cccaaguagcugggacuacaggc

SEQ ID NO: 1097847 - RNA, 24 nt, Human
cccagggccaccaagacaguccuc

SEQ ID NO: 1097848 - RNA, 18 nt, Human
ccccaagggcagggagcc

SEQ ID NO: 1097849 - RNA, 24 nt, Human
ccccaccccaggggaccccaggcu

SEQ ID NO: 1097850 - RNA, 23 nt, Human
ccccaggggaccccaggcuccua

SEQ ID NO: 1097851 - RNA, 20 nt, Human
cccggagggggugaggaugg

SEQ ID NO: 1097852 - RNA, 18 nt, Human
ccgaccacaaagacacgc

SEQ ID NO: 1097853 - RNA, 24 nt, Human
ccgaccacaaagacacgccuagac

SEQ ID NO: 1097854 - RNA, 22 nt, Human
ccucaccgcaggaggcccacaa

SEQ ID NO: 1097855 - RNA, 21 nt, Human
ccucccagcugcauaucggcu

SEQ ID NO: 1097856 - RNA, 22 nt, Human
ccugaccaccccaccccagggg

SEQ ID NO: 1097857 - RNA, 23 nt, Human
ccugaccucaagugauccacccc

SEQ ID NO: 1097858 - RNA, 22 nt, Human
ccugcucacccugaccacccca

SEQ ID NO: 1097859 - RNA, 19 nt, Human
ccuggaggaugaggggcag

SEQ ID NO: 1097860 - RNA, 26 nt, Human
ccugucccagcugccuucuuccuggg

SEQ ID NO: 1097861 - RNA, 20 nt, Human
ccuugccuccucggccuggg

SEQ ID NO: 1097862 - RNA, 24 nt, Human
cgcccaggcuggagugcaguggcg

SEQ ID NO: 1097863 - RNA, 24 nt, Human
cgcccagggccaccaagacagucc

SEQ ID NO: 1097864 - RNA, 19 nt, Human
cgccucccggguucacacc

SEQ ID NO: 1097865 - RNA, 24 nt, Human
cgcucugucgcccaggcuggagug

SEQ ID NO: 1097866 - RNA, 24 nt, Human
cgggguuucaccguuuuagccggg

SEQ ID NO: 1097867 - RNA, 24 nt, Human
cuagaccccagagucuagugagga

SEQ ID NO: 1097868 - RNA, 25 nt, Human
cucaagugauccaccccgcccccgc

SEQ ID NO: 1097869 - RNA, 23 nt, Human
cucacccugaccaccccacccca

SEQ ID NO: 1097870 - RNA, 20 nt, Human
cucacugaucaaaaccccaa

SEQ ID NO: 1097871 - RNA, 24 nt, Human
cucagccucccaaguagcugggac

SEQ ID NO: 1097872 - RNA, 21 nt, Human
cucccggguucacaccauucu

SEQ ID NO: 1097873 - RNA, 24 nt, Human
cuccugaccucgugauccgcccgc

SEQ ID NO: 1097874 - RNA, 21 nt, Human
cucgcucugucgcccaggcug

SEQ ID NO: 1097875 - RNA, 24 nt, Human
cucgcucugucgcccaggcuggag

SEQ ID NO: 1097876 - RNA, 20 nt, Human
cucuaggccucguuuuucag

SEQ ID NO: 1097877 - RNA, 23 nt, Human
cucugucgcccaggcuggagugc

SEQ ID NO: 1097878 - RNA, 19 nt, Human
cugagaagggucgaggucu

SEQ ID NO: 1097879 - RNA, 23 nt, Human
cugccucagccucccaaguagcu

SEQ ID NO: 1097880 - RNA, 18 nt, Human
cugcuccuucccgccaga

SEQ ID NO: 1097881 - RNA, 20 nt, Human
cuguagucccuuccccuuca

SEQ ID NO: 1097882 - RNA, 20 nt, Human
gacccaagccccccuccuca

SEQ ID NO: 1097883 - RNA, 18 nt, Human
gaccucaagugauccacc

SEQ ID NO: 1097884 - RNA, 22 nt, Human
gaccucgugauccgcccgccuc

SEQ ID NO: 1097885 - RNA, 22 nt, Human
gaccucgugauccgcccgccuc

SEQ ID NO: 1097886 - RNA, 25 nt, Human
gaccuuacuuucuugacuuggccac

SEQ ID NO: 1097887 - RNA, 19 nt, Human
gagcaaaacagaaaggauc

SEQ ID NO: 1097888 - RNA, 18 nt, Human
gagcugcugcugaaggag

SEQ ID NO: 1097889 - RNA, 22 nt, Human
gagguuucaccauguuggucag

SEQ ID NO: 1097890 - RNA, 20 nt, Human
gagugcaguggcgggaucuc

SEQ ID NO: 1097891 - RNA, 18 nt, Human
gauuacaggcgugagcca

SEQ ID NO: 1097892 - RNA, 18 nt, Human
gauuacaggcgugagcca

SEQ ID NO: 1097893 - RNA, 19 nt, Human
gauuacaggcgugagccac

SEQ ID NO: 1097894 - RNA, 22 nt, Human
gauuacaggcgugagccaccgc

SEQ ID NO: 1097895 - RNA, 22 nt, Human
gauuacaggcgugagccaccgc

SEQ ID NO: 1097896 - RNA, 22 nt, Human
gauuacaggcgugagccacugc

SEQ ID NO: 1097897 - RNA, 18 nt, Human
gauuacagggaugagcca

SEQ ID NO: 1097898 - RNA, 23 nt, Human
gauucuguggaggcuucucagag

SEQ ID NO: 1097899 - RNA, 18 nt, Human
gcacccuugaguuaggcc

SEQ ID NO: 1097900 - RNA, 22 nt, Human
gcacggcaggcaaggaagguuu

SEQ ID NO: 1097901 - RNA, 19 nt, Human
gcccaggcuggagugcagu

SEQ ID NO: 1097902 - RNA, 20 nt, Human
gcccaggcuggagugcagug

SEQ ID NO: 1097903 - RNA, 20 nt, Human
gcccggcccuaauuuuugua

SEQ ID NO: 1097904 - RNA, 23 nt, Human
gcccggcuaauuuuuuguauuuu

SEQ ID NO: 1097905 - RNA, 23 nt, Human
gccucagccucccaaagugcugg

SEQ ID NO: 1097906 - RNA, 20 nt, Human
gccucagccucccaaguagc

SEQ ID NO: 1097907 - RNA, 25 nt, Human
gccucccggguucacaccauucucc

SEQ ID NO: 1097908 - RNA, 23 nt, Human
gccucggccucccaaagugcugg

SEQ ID NO: 1097909 - RNA, 20 nt, Human
gccuucaggagcucuguccu

SEQ ID NO: 1097910 - RNA, 23 nt, Human
gcuggucucaaaccccugaccuc

SEQ ID NO: 1097911 - RNA, 22 nt, Human
gcuuggguguggugugguggcc

SEQ ID NO: 1097912 - RNA, 21 nt, Human
ggagagggacugggggcagug

SEQ ID NO: 1097913 - RNA, 18 nt, Human
ggagcccuuccugcuccu

SEQ ID NO: 1097914 - RNA, 19 nt, Human
ggaugaggggcagacggga

SEQ ID NO: 1097915 - RNA, 24 nt, Human
ggauggucuugaucuccugaccuc

SEQ ID NO: 1097916 - RNA, 23 nt, Human
ggcagcagcagcugcagacagag

SEQ ID NO: 1097917 - RNA, 24 nt, Human
ggcccuggcucagucucagagcug

SEQ ID NO: 1097918 - RNA, 25 nt, Human
ggccuagaggguuuggagaaggccg

SEQ ID NO: 1097919 - RNA, 24 nt, Human
gggagcugcugcugaaggagcccg

SEQ ID NO: 1097920 - RNA, 25 nt, Human
gggaggcccggccacuggugccugc

SEQ ID NO: 1097921 - RNA, 21 nt, Human
gggcagacgggaggcccggcc

SEQ ID NO: 1097922 - RNA, 22 nt, Human
gggccugcaaccacgucuuugg

SEQ ID NO: 1097923 - RNA, 18 nt, Human
ggggagcugcugcugaag

SEQ ID NO: 1097924 - RNA, 23 nt, Human
ggguguggugugguggcccuuuc

SEQ ID NO: 1097925 - RNA, 21 nt, Human
ggugcugcuaguggcccuggc

SEQ ID NO: 1097926 - RNA, 19 nt, Human
guagagacgggguuucacc

SEQ ID NO: 1097927 - RNA, 24 nt, Human
gugauccgcccgccucggccuccc

SEQ ID NO: 1097928 - RNA, 20 nt, Human
guggagugugcugcaccucc

SEQ ID NO: 1097929 - RNA, 22 nt, Human
uaauuuuuguauuuuuaguaga

SEQ ID NO: 1097930 - RNA, 24 nt, Human
uaauuuuuuguauuuuuaguagag

SEQ ID NO: 1097931 - RNA, 23 nt, Human
uacaggcgugagccaccgcgccc

SEQ ID NO: 1097932 - RNA, 19 nt, Human
uacaggcgugagccacugc

SEQ ID NO: 1097933 - RNA, 23 nt, Human
uacaggcgugagccacugcgccc

SEQ ID NO: 1097934 - RNA, 18 nt, Human
uacagggaugagccaccu

SEQ ID NO: 1097935 - RNA, 23 nt, Human
uaggcccccagucguuggcacag

SEQ ID NO: 1097936 - RNA, 21 nt, Human
uaguagagacgggguuucacc

SEQ ID NO: 1097937 - RNA, 22 nt, Human
uaguagagacgggguuucaccg

SEQ ID NO: 1097938 - RNA, 26 nt, Human
uaguagagacgggguuucaccguuuu

SEQ ID NO: 1097939 - RNA, 24 nt, Human
uaguagaguugagguuucaccaug

SEQ ID NO: 1097940 - RNA, 21 nt, Human
ucacaccauucuccugccuca

SEQ ID NO: 1097941 - RNA, 18 nt, Human
ucacugcaagcuccgccu

SEQ ID NO: 1097942 - RNA, 19 nt, Human
ucacugcaagcuccgccuc

SEQ ID NO: 1097943 - RNA, 24 nt, Human
ucacugcaagcuccgccucccggg

SEQ ID NO: 1097944 - RNA, 18 nt, Human
ucagacccaagccccccu

SEQ ID NO: 1097945 - RNA, 18 nt, Human
ucagccucccaaagugcu

SEQ ID NO: 1097946 - RNA, 18 nt, Human
ucagccucccaaguagcu

SEQ ID NO: 1097947 - RNA, 20 nt, Human
ucagccucccaaguagcugg

SEQ ID NO: 1097948 - RNA, 20 nt, Human
uccaccagggccugcaacca

SEQ ID NO: 1097949 - RNA, 22 nt, Human
uccaccagggccugcaaccacg

SEQ ID NO: 1097950 - RNA, 24 nt, Human
ucccaaagugcugggauuacaggc

SEQ ID NO: 1097951 - RNA, 24 nt, Human
ucccaaagugcugggauuacaggc

SEQ ID NO: 1097952 - RNA, 24 nt, Human
ucccaaguagcugggacuacaggc

SEQ ID NO: 1097953 - RNA, 21 nt, Human
ucccagcugccuucuuccugg

SEQ ID NO: 1097954 - RNA, 21 nt, Human
ucccggguucacaccauucuc

SEQ ID NO: 1097955 - RNA, 24 nt, Human
ucccggguucacaccauucuccug

SEQ ID NO: 1097956 - RNA, 18 nt, Human
ucccugucccagcugccu

SEQ ID NO: 1097957 - RNA, 22 nt, Human
ucccugucccagcugccuucuu

SEQ ID NO: 1097958 - RNA, 25 nt, Human
uccuugccuccucggccuggggugg

SEQ ID NO: 1097959 - RNA, 21 nt, Human
ucgaggucugggugcugcuag

SEQ ID NO: 1097960 - RNA, 24 nt, Human
ucgcccaggcuggagugcaguggc

SEQ ID NO: 1097961 - RNA, 22 nt, Human
ucgcccagggccaccaagacag

SEQ ID NO: 1097962 - RNA, 24 nt, Human
ucgcucugucgcccaggcuggagu

SEQ ID NO: 1097963 - RNA, 20 nt, Human
ucggccuggggugguggcgc

SEQ ID NO: 1097964 - RNA, 26 nt, Human
ucuccugccucagccucccaaguagc

SEQ ID NO: 1097965 - RNA, 19 nt, Human
ucucgcucugucgcccagg

SEQ ID NO: 1097966 - RNA, 23 nt, Human
ucucgcucugucgcccaggcugg

SEQ ID NO: 1097967 - RNA, 24 nt, Human
ucucgcucugucgcccaggcugga

SEQ ID NO: 1097968 - RNA, 26 nt, Human
ucucgcucugucgcccaggcuggagu

SEQ ID NO: 1097969 - RNA, 27 nt, Human
ucucgcucugucgcccaggcuggagug

SEQ ID NO: 1097970 - RNA, 18 nt, Human
ucugggacagucuuaugc

SEQ ID NO: 1097971 - RNA, 26 nt, Human
ucuguccugcucagagcugcugaaag

SEQ ID NO: 1097972 - RNA, 24 nt, Human
ucugucgcccaggcuggagugcag

SEQ ID NO: 1097973 - RNA, 21 nt, Human
ugaccucaagugauccacccc

SEQ ID NO: 1097974 - RNA, 23 nt, Human
ugagaagggucgaggucugggug

SEQ ID NO: 1097975 - RNA, 22 nt, Human
ugagacggagucucgcucuguc

SEQ ID NO: 1097976 - RNA, 19 nt, Human
ugagcugcggaaggccacc

SEQ ID NO: 1097977 - RNA, 24 nt, Human
ugagguuucaccauguuggucagg

SEQ ID NO: 1097978 - RNA, 22 nt, Human
ugcaguggcgggaucucggcuc

SEQ ID NO: 1097979 - RNA, 18 nt, Human
ugcccggagggggugagg

SEQ ID NO: 1097980 - RNA, 24 nt, Human
ugccucagccucccaaguagcugg

SEQ ID NO: 1097981 - RNA, 21 nt, Human
ugcugcaccuccuucaguggc

SEQ ID NO: 1097982 - RNA, 24 nt, Human
ugcugggauuacaggcgugagcca

SEQ ID NO: 1097983 - RNA, 24 nt, Human
ugcugggauuacaggcgugagcca

SEQ ID NO: 1097984 - RNA, 24 nt, Human
uggagugcaguggcgggaucucgg

SEQ ID NO: 1097985 - RNA, 21 nt, Human
uggagugugcugcaccuccuu

SEQ ID NO: 1097986 - RNA, 25 nt, Human
uggaugucccgccauuuucagcccu

SEQ ID NO: 1097987 - RNA, 19 nt, Human
uggcaaagugacgcccccc

SEQ ID NO: 1097988 - RNA, 22 nt, Human
uggcaaagugacgccccccucg

SEQ ID NO: 1097989 - RNA, 26 nt, Human
uggcaggaagagggcugaccggaacg

SEQ ID NO: 1097990 - RNA, 23 nt, Human
uggcaggaagagggcugagcugc

SEQ ID NO: 1097991 - RNA, 18 nt, Human
ugggacagucuuaugcac

SEQ ID NO: 1097992 - RNA, 24 nt, Human
ugggaccuuguguauagguccagg

SEQ ID NO: 1097993 - RNA, 21 nt, Human
ugggacuacaggcgcccgcca

SEQ ID NO: 1097994 - RNA, 22 nt, Human
ugggacuacaggcgcccgccac

SEQ ID NO: 1097995 - RNA, 22 nt, Human
ugggacuacaggcgcccgccac

SEQ ID NO: 1097996 - RNA, 24 nt, Human
ugggacuacaggcgcccgccacua

SEQ ID NO: 1097997 - RNA, 18 nt, Human
ugggauuacaggcgugag

SEQ ID NO: 1097998 - RNA, 18 nt, Human
ugggauuacaggcgugag

SEQ ID NO: 1097999 - RNA, 19 nt, Human
ugggauuacaggcgugagc

SEQ ID NO: 1098000 - RNA, 19 nt, Human
ugggauuacaggcgugagc

SEQ ID NO: 1098001 - RNA, 21 nt, Human
ugggauuacaggcgugagcca

SEQ ID NO: 1098002 - RNA, 21 nt, Human
ugggauuacaggcgugagcca

SEQ ID NO: 1098003 - RNA, 22 nt, Human
ugggauuacaggcgugagccac

SEQ ID NO: 1098004 - RNA, 22 nt, Human
ugggauuacaggcgugagccac

SEQ ID NO: 1098005 - RNA, 22 nt, Human
ugggauuacaggcgugagccac

SEQ ID NO: 1098006 - RNA, 23 nt, Human
ugggauuacaggcgugagccacc

SEQ ID NO: 1098007 - RNA, 24 nt, Human
ugggauuacaggcgugagccaccg

SEQ ID NO: 1098008 - RNA, 24 nt, Human
ugggauuacaggcgugagccacug

SEQ ID NO: 1098009 - RNA, 26 nt, Human
ugggauuacaggcgugagccacugcg

SEQ ID NO: 1098010 - RNA, 21 nt, Human
ugggauuacagggaugagcca

SEQ ID NO: 1098011 - RNA, 22 nt, Human
ugggauuacagggaugagccac

SEQ ID NO: 1098012 - RNA, 23 nt, Human
ugggauuacagggaugagccacc

SEQ ID NO: 1098013 - RNA, 24 nt, Human
ugggauuacagggaugagccaccu

SEQ ID NO: 1098014 - RNA, 24 nt, Human
uggucaggcuggucucaaaccccu

SEQ ID NO: 1098015 - RNA, 21 nt, Human
uggucuucccuccuugccucc

SEQ ID NO: 1098016 - RNA, 19 nt, Human
uggugugguggcccuuucc

SEQ ID NO: 1098017 - RNA, 20 nt, Human
uguauagguccaggcagcag

SEQ ID NO: 1098018 - RNA, 21 nt, Human
uguauuuuuaguagagacggg

SEQ ID NO: 1098019 - RNA, 21 nt, Human
ugucccagcugccuucuuccu

SEQ ID NO: 1098020 - RNA, 22 nt, Human
uuaguagagacgggguuucacc

SEQ ID NO: 1098021 - RNA, 22 nt, Human
uuaguagagacgggguuucacc

SEQ ID NO: 1098022 - RNA, 24 nt, Human
uuaguagagacgggguuucaccgu

SEQ ID NO: 1098023 - RNA, 24 nt, Human
uuaguagaguugagguuucaccau

SEQ ID NO: 1098024 - RNA, 19 nt, Human
uucagguguauaugaugau

SEQ ID NO: 1098025 - RNA, 22 nt, Human
uucaguuguaaagcagggauga

SEQ ID NO: 1098026 - RNA, 24 nt, Human
uugagguuucaccauguuggucag

SEQ ID NO: 1098027 - RNA, 23 nt, Human
uuguaugggcuuggguguggugu

SEQ ID NO: 1098028 - RNA, 23 nt, Human
uuguuuuuuuuuuuuuuuuuggg

SEQ ID NO: 1098029 - RNA, 24 nt, Human
uuucaccauguuggucaggcuggu

SEQ ID NO: 1098030 - RNA, 24 nt, Human
uuucccugucccagcugccuucuu

SEQ ID NO: 1098031 - RNA, 18 nt, Human
uuuggccccggugagggg

SEQ ID NO: 1098032 - RNA, 24 nt, Human
uuuuuaguagagacgggguuucac

SEQ ID NO: 1098033 - RNA, 24 nt, Human
uuuuuaguagaguugagguuucac

SEQ ID NO: 1098034 - RNA, 20 nt, Human
uuuuuguauuuuuaguagag

SEQ ID NO: 1098035 - RNA, 21 nt, Human
uuuuuguauuuuuaguagaga

SEQ ID NO: 1098036 - RNA, 24 nt, Human
uuuuuuguauuuuuaguagagacg

SEQ ID NO: 1098037 - RNA, 25 nt, Human
uuuuuuuuuuuugagacggagucuc

SEQ ID NO: 1098038 - RNA, 22 nt, Human
uuuuuuuuuuuuuugagacgga

SEQ ID NO: 1098039 - RNA, 19 nt, Human
aaaaaaaaagccaagucuc

SEQ ID NO: 1098040 - RNA, 22 nt, Human
aaaaaaaaagccaagucuccca

SEQ ID NO: 1098041 - RNA, 24 nt, Human
aaaaaaagccaagucucccacaaa

SEQ ID NO: 1098042 - RNA, 24 nt, Human
aaacacggcgcagcugccccgcgc

SEQ ID NO: 1098043 - RNA, 25 nt, Human
aaacccugaauuugaaaaaggcaac

SEQ ID NO: 1098044 - RNA, 24 nt, Human
aagcgcaggacagacccuuccccu

SEQ ID NO: 1098045 - RNA, 22 nt, Human
acaauacauuuugugaaaaaca

SEQ ID NO: 1098046 - RNA, 19 nt, Human
accaagaaaccggcagggc

SEQ ID NO: 1098047 - RNA, 25 nt, Human
accccgaggccgggcagcagcagcg

SEQ ID NO: 1098048 - RNA, 22 nt, Human
agaaaaagaugaaaagagggac

SEQ ID NO: 1098049 - RNA, 21 nt, Human
agaagaaaaaaaaaagccaag

SEQ ID NO: 1098050 - RNA, 23 nt, Human
agcagcagcagcagccgccgggc

SEQ ID NO: 1098051 - RNA, 23 nt, Human
agcugugccucgucuucucuggg

SEQ ID NO: 1098052 - RNA, 23 nt, Human
aggaauuccccucaagucauauc

SEQ ID NO: 1098053 - RNA, 21 nt, Human
aggcagcgccggcgcccgccc

SEQ ID NO: 1098054 - RNA, 26 nt, Human
aguacagacaguuauuuaccuaaaau

SEQ ID NO: 1098055 - RNA, 18 nt, Human
agucgcaguguucacagc

SEQ ID NO: 1098056 - RNA, 29 nt, Human
caaauuuuccuuuauuuaaaaaaaaaaac

SEQ ID NO: 1098057 - RNA, 25 nt, Human
caaccagaagaaaaaaaaaagccaa

SEQ ID NO: 1098058 - RNA, 21 nt, Human
caagaaaccggcagggcaagu

SEQ ID NO: 1098059 - RNA, 22 nt, Human
caccccgaggccgggcagcagc

SEQ ID NO: 1098060 - RNA, 19 nt, Human
caccugguacaugauaucc

SEQ ID NO: 1098061 - RNA, 22 nt, Human
cacgcuccccggucacucaccc

SEQ ID NO: 1098062 - RNA, 22 nt, Human
cagacccuuccccuggauccca

SEQ ID NO: 1098063 - RNA, 18 nt, Human
cagcagcagcagcagccg

SEQ ID NO: 1098064 - RNA, 22 nt, Human
cagcagcagcagccgccgggcc

SEQ ID NO: 1098065 - RNA, 18 nt, Human
cagcagcagcgucagcag

SEQ ID NO: 1098066 - RNA, 23 nt, Human
cagcagcuaccggaggcuuccag

SEQ ID NO: 1098067 - RNA, 21 nt, Human
cagccgcgcuggcuugggagg

SEQ ID NO: 1098068 - RNA, 22 nt, Human
caguaccaagaaaccggcaggg

SEQ ID NO: 1098069 - RNA, 25 nt, Human
caguaccaagaaaccggcagggcaa

SEQ ID NO: 1098070 - RNA, 23 nt, Human
ccacaaagugcccccaaauccac

SEQ ID NO: 1098071 - RNA, 21 nt, Human
ccagaaaaagaugaaaagaca

SEQ ID NO: 1098072 - RNA, 21 nt, Human
ccagaagaaaaaaaaaagcca

SEQ ID NO: 1098073 - RNA, 22 nt, Human
cccacaaagugcccccaaaucc

SEQ ID NO: 1098074 - RNA, 23 nt, Human
cccacaaagugcccccaaaucca

SEQ ID NO: 1098075 - RNA, 31 nt, Human
cccacaaagugcccccaaauccacagcugag

SEQ ID NO: 1098076 - RNA, 25 nt, Human
cccacgcuccccggucacucacccc

SEQ ID NO: 1098077 - RNA, 22 nt, Human
cccacggcugggcucacggggc

SEQ ID NO: 1098078 - RNA, 24 nt, Human
cccagcucggacuccagccccggc

SEQ ID NO: 1098079 - RNA, 21 nt, Human
cccaguaccaagaaaccggca

SEQ ID NO: 1098080 - RNA, 21 nt, Human
cccccaaauccacagcugagu

SEQ ID NO: 1098081 - RNA, 22 nt, Human
ccccgaggccgggcagcagcag

SEQ ID NO: 1098082 - RNA, 18 nt, Human
ccccgccaggcagcgccg

SEQ ID NO: 1098083 - RNA, 19 nt, Human
ccccucaagucauauccac

SEQ ID NO: 1098084 - RNA, 18 nt, Human
ccccuuucuuccuuuucc

SEQ ID NO: 1098085 - RNA, 26 nt, Human
cccggccccgacccggccgucgcgag

SEQ ID NO: 1098086 - RNA, 22 nt, Human
cccggcccgagccucccacggc

SEQ ID NO: 1098087 - RNA, 18 nt, Human
cccuaucauucgucuccu

SEQ ID NO: 1098088 - RNA, 18 nt, Human
cccuggaucccaacgccc

SEQ ID NO: 1098089 - RNA, 19 nt, Human
ccgcaggugggcggccucc

SEQ ID NO: 1098090 - RNA, 24 nt, Human
ccgcgacgcugccccggccccgac

SEQ ID NO: 1098091 - RNA, 18 nt, Human
ccggcgccgcgacgcugc

SEQ ID NO: 1098092 - RNA, 18 nt, Human
ccgucgcgagcuguccuc

SEQ ID NO: 1098093 - RNA, 23 nt, Human
ccgucgcgcucccagcucggacu

SEQ ID NO: 1098094 - RNA, 20 nt, Human
ccuaaaaugcaaaaccucca

SEQ ID NO: 1098095 - RNA, 19 nt, Human
ccuccaccccacgcucccc

SEQ ID NO: 1098096 - RNA, 20 nt, Human
ccuccagaaaaagaugaaaa

SEQ ID NO: 1098097 - RNA, 21 nt, Human
ccuccuacgcccggcccgagc

SEQ ID NO: 1098098 - RNA, 22 nt, Human
ccuccuuuucgucuuuccgccg

SEQ ID NO: 1098099 - RNA, 22 nt, Human
ccugcagccucccaguaccaag

SEQ ID NO: 1098100 - RNA, 18 nt, Human
ccuggcuccgggggcggu

SEQ ID NO: 1098101 - RNA, 22 nt, Human
ccuuauuuauuuacuucuccug

SEQ ID NO: 1098102 - RNA, 24 nt, Human
cgaacccaugcgggaucuuccaag

SEQ ID NO: 1098103 - RNA, 18 nt, Human
cgacagcgaggcggugac

SEQ ID NO: 1098104 - RNA, 22 nt, Human
cggaggcuuccagcaaacacgg

SEQ ID NO: 1098105 - RNA, 18 nt, Human
cggcgccgcgacgcugcc

SEQ ID NO: 1098106 - RNA, 25 nt, Human
cuagaagccuccuuuucgucuuucc

SEQ ID NO: 1098107 - RNA, 21 nt, Human
cuccagccccggcgccgcgac

SEQ ID NO: 1098108 - RNA, 22 nt, Human
cuccuccagaaaaagaugaaaa

SEQ ID NO: 1098109 - RNA, 20 nt, Human
cuccuccgcggcccccgcca

SEQ ID NO: 1098110 - RNA, 21 nt, Human
cucggcccuggcuccgggggc

SEQ ID NO: 1098111 - RNA, 22 nt, Human
cugauggccccaggugcucucc

SEQ ID NO: 1098112 - RNA, 23 nt, Human
cugcagccucccaguaccaagaa

SEQ ID NO: 1098113 - RNA, 24 nt, Human
cuggcuccgggggcgguacggaca

SEQ ID NO: 1098114 - RNA, 21 nt, Human
cuucugggacccccaagugcc

SEQ ID NO: 1098115 - RNA, 19 nt, Human
gaagcucucccggcccggu

SEQ ID NO: 1098116 - RNA, 24 nt, Human
gcaaaaccuccaaagaguucacac

SEQ ID NO: 1098117 - RNA, 19 nt, Human
gcaauucccacagcuccac

SEQ ID NO: 1098118 - RNA, 20 nt, Human
gcagaagccagcucucgggg

SEQ ID NO: 1098119 - RNA, 18 nt, Human
gcagcagcagcgucagca

SEQ ID NO: 1098120 - RNA, 19 nt, Human
gcagcagcagcgucagcag

SEQ ID NO: 1098121 - RNA, 23 nt, Human
gccccuuucuuccuuuuccuugc

SEQ ID NO: 1098122 - RNA, 21 nt, Human
gccgcgcuggcuugggaggcu

SEQ ID NO: 1098123 - RNA, 20 nt, Human
gcgcagcugccccgcgcggc

SEQ ID NO: 1098124 - RNA, 20 nt, Human
gcugcccgugacagccgcgc

SEQ ID NO: 1098125 - RNA, 21 nt, Human
ggaauuccccucaagucauau

SEQ ID NO: 1098126 - RNA, 23 nt, Human
ggaauuccccucaagucauaucc

SEQ ID NO: 1098127 - RNA, 21 nt, Human
gggcagcagcagcgucagcag

SEQ ID NO: 1098128 - RNA, 22 nt, Human
ggggaaaagggcgggacacggg

SEQ ID NO: 1098129 - RNA, 21 nt, Human
ggugcacagaaggaagccugc

SEQ ID NO: 1098130 - RNA, 19 nt, Human
gucgcaguguucacagccu

SEQ ID NO: 1098131 - RNA, 22 nt, Human
uaaaaugcaaaaccuccaaaga

SEQ ID NO: 1098132 - RNA, 23 nt, Human
uaaaaugcaaaaccuccaaagag

SEQ ID NO: 1098133 - RNA, 21 nt, Human
uaaaugaauguaaaccaggcc

SEQ ID NO: 1098134 - RNA, 24 nt, Human
uaccuaaaaugcaaaaccuccaaa

SEQ ID NO: 1098135 - RNA, 19 nt, Human
uacggacagaggacggggc

SEQ ID NO: 1098136 - RNA, 21 nt, Human
uagaagccuccuuuucgucuu

SEQ ID NO: 1098137 - RNA, 23 nt, Human
ucaaacaaggauucgaagcgcag

SEQ ID NO: 1098138 - RNA, 24 nt, Human
uccaaagaguucacacgguggcug

SEQ ID NO: 1098139 - RNA, 19 nt, Human
uccaaccagaagaaaaaaa

SEQ ID NO: 1098140 - RNA, 23 nt, Human
uccccggucacucaccccgaggc

SEQ ID NO: 1098141 - RNA, 23 nt, Human
uccuccagaaaaagaugaaaaga

SEQ ID NO: 1098142 - RNA, 23 nt, Human
ucgcgagcuguccuccaccccac

SEQ ID NO: 1098143 - RNA, 19 nt, Human
ucggacuccagccccggcg

SEQ ID NO: 1098144 - RNA, 19 nt, Human
ucucccggcccggugccgc

SEQ ID NO: 1098145 - RNA, 21 nt, Human
ucucccggcccggugccgccu

SEQ ID NO: 1098146 - RNA, 18 nt, Human
ucuuccuuuuccuugccc

SEQ ID NO: 1098147 - RNA, 24 nt, Human
ucuucucuggggccccuuucuucc

SEQ ID NO: 1098148 - RNA, 24 nt, Human
ugagaguccuuacucccuguugca

SEQ ID NO: 1098149 - RNA, 21 nt, Human
ugcacagaaggaagccugcag

SEQ ID NO: 1098150 - RNA, 19 nt, Human
uggccccaggugcucuccc

SEQ ID NO: 1098151 - RNA, 21 nt, Human
uggcgaggacucggcccuggc

SEQ ID NO: 1098152 - RNA, 21 nt, Human
uggggccccuuucuuccuuuu

SEQ ID NO: 1098153 - RNA, 21 nt, Human
uguccuccaccccacgcuccc

SEQ ID NO: 1098154 - RNA, 23 nt, Human
uuaaaugaauguaaaccaggccc

SEQ ID NO: 1098155 - RNA, 24 nt, Human
uuagguucuuccaaccagaagaaa

SEQ ID NO: 1098156 - RNA, 24 nt, Human
uuccuuuuccuugcccucaggaau

SEQ ID NO: 1098157 - RNA, 18 nt, Human
agacaaaagcaagaaaca

SEQ ID NO: 1098158 - RNA, 19 nt, Human
agaugucaaaauuuccagc

SEQ ID NO: 1098159 - RNA, 25 nt, Human
aagcaauccucccaccucagccucc

SEQ ID NO: 1098160 - RNA, 21 nt, Human
aagugcagggauuacaggcau

SEQ ID NO: 1098161 - RNA, 23 nt, Human
aagugcagggauuacaggcauga

SEQ ID NO: 1098162 - RNA, 21 nt, Human
acaggccugugccaccacacc

SEQ ID NO: 1098163 - RNA, 22 nt, Human
acccgccuuggccucccuaagu

SEQ ID NO: 1098164 - RNA, 23 nt, Human
accucagccuccugaguggcuag

SEQ ID NO: 1098165 - RNA, 24 nt, Human
accucagccuccugaguggcuagg

SEQ ID NO: 1098166 - RNA, 21 nt, Human
accucccaaagggguaggagu

SEQ ID NO: 1098167 - RNA, 24 nt, Human
accucgugauccacccgccuuggc

SEQ ID NO: 1098168 - RNA, 19 nt, Human
agaaacugaugaguaagac

SEQ ID NO: 1098169 - RNA, 18 nt, Human
agacagggucuugcuacg

SEQ ID NO: 1098170 - RNA, 23 nt, Human
agacagggucuugcuacguugcc

SEQ ID NO: 1098171 - RNA, 18 nt, Human
agagguuucucuguaagg

SEQ ID NO: 1098172 - RNA, 18 nt, Human
agccaccgcacccggccu

SEQ ID NO: 1098173 - RNA, 25 nt, Human
agcgauccucuugccuugaccuccc

SEQ ID NO: 1098174 - RNA, 18 nt, Human
agcuggucuugaacuccu

SEQ ID NO: 1098175 - RNA, 24 nt, Human
agcuggucuugaacuccugggcuc

SEQ ID NO: 1098176 - RNA, 24 nt, Human
aggcacaagcaauccucccaccuc

SEQ ID NO: 1098177 - RNA, 22 nt, Human
agggauuacaggcaugagccac

SEQ ID NO: 1098178 - RNA, 24 nt, Human
agggauuacaggcaugagccaccg

SEQ ID NO: 1098179 - RNA, 22 nt, Human
aguagaggcgggguuucaccau

SEQ ID NO: 1098180 - RNA, 23 nt, Human
aguagaggcgggguuucaccaug

SEQ ID NO: 1098181 - RNA, 24 nt, Human
aguuuuacuuuuuaaacugcuucu

SEQ ID NO: 1098182 - RNA, 19 nt, Human
auccacccgccuuggccuc

SEQ ID NO: 1098183 - RNA, 27 nt, Human
caagcaauccucccaccucagccuccu

SEQ ID NO: 1098184 - RNA, 28 nt, Human
caagcgauccucuugccuugaccuccca

SEQ ID NO: 1098185 - RNA, 24 nt, Human
cacaagcaauccucccaccucagc

SEQ ID NO: 1098186 - RNA, 20 nt, Human
caccacaacaacguuuauac

SEQ ID NO: 1098187 - RNA, 18 nt, Human
caccauguuagccaggau

SEQ ID NO: 1098188 - RNA, 22 nt, Human
caccauguuagccaggaugguc

SEQ ID NO: 1098189 - RNA, 24 nt, Human
caccauguuagccaggauggucuc

SEQ ID NO: 1098190 - RNA, 19 nt, Human
cagccuccugaguggcuag

SEQ ID NO: 1098191 - RNA, 24 nt, Human
cagccuugaccucccaggcacaag

SEQ ID NO: 1098192 - RNA, 23 nt, Human
caggcacaagcaauccucccacc

SEQ ID NO: 1098193 - RNA, 18 nt, Human
cagggucuugcuacguug

SEQ ID NO: 1098194 - RNA, 22 nt, Human
cagugcagccuugaccucccag

SEQ ID NO: 1098195 - RNA, 24 nt, Human
ccaagcuggucuugaacuccuggg

SEQ ID NO: 1098196 - RNA, 20 nt, Human
ccaccacaccuggcuaauuu

SEQ ID NO: 1098197 - RNA, 23 nt, Human
ccaccucagccuccugaguggcu

SEQ ID NO: 1098198 - RNA, 23 nt, Human
ccaguaagcagaaacugaugagu

SEQ ID NO: 1098199 - RNA, 18 nt, Human
cccaaagggguaggagua

SEQ ID NO: 1098200 - RNA, 23 nt, Human
cccaccucagccuccugaguggc

SEQ ID NO: 1098201 - RNA, 23 nt, Human
ccuaagugcagggauuacaggca

SEQ ID NO: 1098202 - RNA, 24 nt, Human
ccuaagugcagggauuacaggcau

SEQ ID NO: 1098203 - RNA, 24 nt, Human
ccucccaccucagccuccugagug

SEQ ID NO: 1098204 - RNA, 20 nt, Human
ccucccuaagugcagggauu

SEQ ID NO: 1098205 - RNA, 20 nt, Human
ccugaccucgugauccaccc

SEQ ID NO: 1098206 - RNA, 19 nt, Human
ccugggcucaagcgauccu

SEQ ID NO: 1098207 - RNA, 19 nt, Human
cgggguuucaccauguuag

SEQ ID NO: 1098208 - RNA, 23 nt, Human
cgggguuucaccauguuagccag

SEQ ID NO: 1098209 - RNA, 23 nt, Human
cuaagugcagggauuacaggcau

SEQ ID NO: 1098210 - RNA, 21 nt, Human
cuaggacuacaggccugugcc

SEQ ID NO: 1098211 - RNA, 21 nt, Human
cucaauaaaugaaaggucacc

SEQ ID NO: 1098212 - RNA, 24 nt, Human
cuccugaccucgugauccacccgc

SEQ ID NO: 1098213 - RNA, 24 nt, Human
cuccugaguggcuaggacuacagg

SEQ ID NO: 1098214 - RNA, 19 nt, Human
cuggucuugaacuccuggg

SEQ ID NO: 1098215 - RNA, 21 nt, Human
gaccucgugauccacccgccu

SEQ ID NO: 1098216 - RNA, 21 nt, Human
gaccucgugauccacccgccu

SEQ ID NO: 1098217 - RNA, 22 nt, Human
gaccucgugauccacccgccuu

SEQ ID NO: 1098218 - RNA, 24 nt, Human
gaccucgugauccacccgccuugg

SEQ ID NO: 1098219 - RNA, 24 nt, Human
gaggcgggguuucaccauguuagc

SEQ ID NO: 1098220 - RNA, 21 nt, Human
gaguacagguaugagccacca

SEQ ID NO: 1098221 - RNA, 18 nt, Human
gauuacaggcaugagcca

SEQ ID NO: 1098222 - RNA, 22 nt, Human
gauuacaggcaugagccaccgc

SEQ ID NO: 1098223 - RNA, 23 nt, Human
gauuacaggcaugagccaccgca

SEQ ID NO: 1098224 - RNA, 18 nt, Human
gcgggguuucaccauguu

SEQ ID NO: 1098225 - RNA, 19 nt, Human
gcgggguuucaccauguua

SEQ ID NO: 1098226 - RNA, 24 nt, Human
gcgggguuucaccauguuagccag

SEQ ID NO: 1098227 - RNA, 24 nt, Human
gcuacguugcccaagcuggucuug

SEQ ID NO: 1098228 - RNA, 22 nt, Human
ggacuacaggccugugccacca

SEQ ID NO: 1098229 - RNA, 22 nt, Human
ggaguacagguaugagccacca

SEQ ID NO: 1098230 - RNA, 24 nt, Human
ggaguacagguaugagccaccaug

SEQ ID NO: 1098231 - RNA, 24 nt, Human
ggauggucucgaucuccugaccuc

SEQ ID NO: 1098232 - RNA, 22 nt, Human
ggauuacaggcaugagccaccg

SEQ ID NO: 1098233 - RNA, 22 nt, Human
gggauuacaggcaugagccacc

SEQ ID NO: 1098234 - RNA, 23 nt, Human
gggauuacaggcaugagccaccg

SEQ ID NO: 1098235 - RNA, 18 nt, Human
gggcaaguuuagggcaga

SEQ ID NO: 1098236 - RNA, 18 nt, Human
gggcagaggaggaucuca

SEQ ID NO: 1098237 - RNA, 22 nt, Human
gggcucaagcgauccucuugcc

SEQ ID NO: 1098238 - RNA, 23 nt, Human
gggguuucaccauguuagccagg

SEQ ID NO: 1098239 - RNA, 22 nt, Human
ggguuucaccauguuagccagg

SEQ ID NO: 1098240 - RNA, 24 nt, Human
gguuucaccauguuagccaggaug

SEQ ID NO: 1098241 - RNA, 23 nt, Human
guagaggcgggguuucaccaugu

SEQ ID NO: 1098242 - RNA, 22 nt, Human
gucuugaacuccugggcucaag

SEQ ID NO: 1098243 - RNA, 24 nt, Human
gugauccacccgccuuggccuccc

SEQ ID NO: 1098244 - RNA, 18 nt, Human
uaagggaagggugauggg

SEQ ID NO: 1098245 - RNA, 23 nt, Human
uacaggcaugagccaccgcaccc

SEQ ID NO: 1098246 - RNA, 21 nt, Human
uacaggccugugccaccacac

SEQ ID NO: 1098247 - RNA, 22 nt, Human
uacaggccugugccaccacacc

SEQ ID NO: 1098248 - RNA, 18 nt, Human
uacagguaugagccacca

SEQ ID NO: 1098249 - RNA, 24 nt, Human
uacguugcccaagcuggucuugaa

SEQ ID NO: 1098250 - RNA, 22 nt, Human
uagagacagggucuugcuacgu

SEQ ID NO: 1098251 - RNA, 21 nt, Human
uagaggcgggguuucaccaug

SEQ ID NO: 1098252 - RNA, 24 nt, Human
uaggacuacaggccugugccacca

SEQ ID NO: 1098253 - RNA, 24 nt, Human
uaggaguacagguaugagccacca

SEQ ID NO: 1098254 - RNA, 19 nt, Human
uaggauaguagacuggaua

SEQ ID NO: 1098255 - RNA, 18 nt, Human
uauacacccauacauaug

SEQ ID NO: 1098256 - RNA, 24 nt, Human
ucaccauguuagccaggauggucu

SEQ ID NO: 1098257 - RNA, 23 nt, Human
ucacccaggguuucaaauuuuca

SEQ ID NO: 1098258 - RNA, 23 nt, Human
ucagugcagccuugaccucccag

SEQ ID NO: 1098259 - RNA, 24 nt, Human
ucagugcagccuugaccucccagg

SEQ ID NO: 1098260 - RNA, 22 nt, Human
uccacccgccuuggccucccua

SEQ ID NO: 1098261 - RNA, 24 nt, Human
ucccuaagugcagggauuacaggc

SEQ ID NO: 1098262 - RNA, 22 nt, Human
uccucaauaaaugaaaggucac

SEQ ID NO: 1098263 - RNA, 24 nt, Human
uccugaguggcuaggacuacaggc

SEQ ID NO: 1098264 - RNA, 21 nt, Human
uccugggcucaagcgauccuc

SEQ ID NO: 1098265 - RNA, 21 nt, Human
uccugggcucaagcgauccuc

SEQ ID NO: 1098266 - RNA, 21 nt, Human
uccugggcucaagcgauccuc

SEQ ID NO: 1098267 - RNA, 24 nt, Human
uccugggcucaagcgauccucuug

SEQ ID NO: 1098268 - RNA, 22 nt, Human
ucucacuguucauccuguagcu

SEQ ID NO: 1098269 - RNA, 19 nt, Human
ucuugaacuccugggcuca

SEQ ID NO: 1098270 - RNA, 23 nt, Human
ucuugaacuccugggcucaagcg

SEQ ID NO: 1098271 - RNA, 20 nt, Human
ucuugccuugaccucccaaa

SEQ ID NO: 1098272 - RNA, 23 nt, Human
ucuugcuacguugcccaagcugg

SEQ ID NO: 1098273 - RNA, 24 nt, Human
ucuugcuacguugcccaagcuggu

SEQ ID NO: 1098274 - RNA, 25 nt, Human
ugaacuccugggcucaagcgauccu

SEQ ID NO: 1098275 - RNA, 24 nt, Human
ugaccucccaggcacaagcaaucc

SEQ ID NO: 1098276 - RNA, 24 nt, Human
ugcccaagcuggucuugaacuccu

SEQ ID NO: 1098277 - RNA, 27 nt, Human
ugcuacguugcccaagcuggucuugaa

SEQ ID NO: 1098278 - RNA, 19 nt, Human
ugggcucaagcgauccucu

SEQ ID NO: 1098279 - RNA, 24 nt, Human
ugggcucaagcgauccucuugccu

SEQ ID NO: 1098280 - RNA, 19 nt, Human
uguagagacagggucuugc

SEQ ID NO: 1098281 - RNA, 26 nt, Human
uuauuucacucucuuauacacccaua

SEQ ID NO: 1098282 - RNA, 19 nt, Human
uucacucucuuauacaccc

SEQ ID NO: 1098283 - RNA, 24 nt, Human
uuguagagacagggucuugcuacg

SEQ ID NO: 1098284 - RNA, 19 nt, Human
uuucaccauguuagccagg

SEQ ID NO: 1098285 - RNA, 20 nt, Human
uuucaccauguuagccagga

SEQ ID NO: 1098286 - RNA, 18 nt, Human
uuuguagagacagggucu

SEQ ID NO: 1098287 - RNA, 22 nt, Human
aauuauccagccaugagcccug

SEQ ID NO: 1098288 - RNA, 23 nt, Human
aggggcugggcaugguuggcuuu

SEQ ID NO: 1098289 - RNA, 23 nt, Human
caaaaaauaaaacgaggaggcga

SEQ ID NO: 1098290 - RNA, 21 nt, Human
cgucagaauucagaacgaugg

SEQ ID NO: 1098291 - RNA, 19 nt, Human
ggaggcgaagcuugcuugg

SEQ ID NO: 1098292 - RNA, 20 nt, Human
ggggcuggggguguugggag

SEQ ID NO: 1098293 - RNA, 18 nt, Human
guguugggaggggcuggg

SEQ ID NO: 1098294 - RNA, 19 nt, Human
uaaaacgaggaggcgaagc

SEQ ID NO: 1098295 - RNA, 21 nt, Human
uaacaaaaaauaaaacgagga

SEQ ID NO: 1098296 - RNA, 24 nt, Human
uauccagccaugagcccuggccca

SEQ ID NO: 1098297 - RNA, 23 nt, Human
ucucucgagcugcacucuuucuu

SEQ ID NO: 1098298 - RNA, 23 nt, Human
uggcuuugugaucuggggucugg

SEQ ID NO: 1098299 - RNA, 18 nt, Human
ugggaggggcugggcaug

SEQ ID NO: 1098300 - RNA, 18 nt, Human
ugggaggggcugggcaug

SEQ ID NO: 1098301 - RNA, 20 nt, Human
ugggaggggcugggcauggu

SEQ ID NO: 1098302 - RNA, 18 nt, Human
uggggcuggggguguugg

SEQ ID NO: 1098303 - RNA, 19 nt, Human
uguugggaggggcugggca

SEQ ID NO: 1098304 - RNA, 23 nt, Human
accuccacugccaccucucugau

SEQ ID NO: 1098305 - RNA, 20 nt, Human
acugacuccugauuccuagu

SEQ ID NO: 1098306 - RNA, 26 nt, Human
agcuggcacuggcaacaccuggcaca

SEQ ID NO: 1098307 - RNA, 20 nt, Human
aggaguuugagaccagcgug

SEQ ID NO: 1098308 - RNA, 21 nt, Human
aguuuccaacucuuggguagc

SEQ ID NO: 1098309 - RNA, 21 nt, Human
caacaaccgcagcgaggcgag

SEQ ID NO: 1098310 - RNA, 21 nt, Human
caacaccuggcacaucgcucc

SEQ ID NO: 1098311 - RNA, 24 nt, Human
cacugcuuugggaggccaaggugg

SEQ ID NO: 1098312 - RNA, 22 nt, Human
cagccgcacuccuaucuccguc

SEQ ID NO: 1098313 - RNA, 24 nt, Human
ccaugaguccaggaguuugagacc

SEQ ID NO: 1098314 - RNA, 21 nt, Human
cccacagccacacagcaggcu

SEQ ID NO: 1098315 - RNA, 19 nt, Human
ccgcgcucccgcggcucca

SEQ ID NO: 1098316 - RNA, 24 nt, Human
ccuggcacaucgcuccagccgcac

SEQ ID NO: 1098317 - RNA, 18 nt, Human
cgaggcgagccgcgcucc

SEQ ID NO: 1098318 - RNA, 18 nt, Human
cggcuccagccuccagca

SEQ ID NO: 1098319 - RNA, 18 nt, Human
cugccaccucucugauga

SEQ ID NO: 1098320 - RNA, 28 nt, Human
cuucucugcuuuaagugccaucugaaga

SEQ ID NO: 1098321 - RNA, 20 nt, Human
cuuugggaggccaagguggg

SEQ ID NO: 1098322 - RNA, 23 nt, Human
gccaccucucugaugacucccac

SEQ ID NO: 1098323 - RNA, 23 nt, Human
gcuccagccgcacuccuaucucc

SEQ ID NO: 1098324 - RNA, 18 nt, Human
uaacaaaccuccacugcc

SEQ ID NO: 1098325 - RNA, 23 nt, Human
uaacaaaccuccacugccaccuc

SEQ ID NO: 1098326 - RNA, 22 nt, Human
uaucuccgucgcugccaacaac

SEQ ID NO: 1098327 - RNA, 18 nt, Human
ucccgcggcuccagccuc

SEQ ID NO: 1098328 - RNA, 18 nt, Human
ugacucccacagccacac

SEQ ID NO: 1098329 - RNA, 21 nt, Human
ugacuccugauuccuaguccu

SEQ ID NO: 1098330 - RNA, 25 nt, Human
ugcacaguguucacggugcugccaa

SEQ ID NO: 1098331 - RNA, 22 nt, Human
ugccaacaaccgcagcgaggcg

SEQ ID NO: 1098332 - RNA, 27 nt, Human
uggcaacaccuggcacaucgcuccagc

SEQ ID NO: 1098333 - RNA, 19 nt, Human
ugggaggccaaggugggag

SEQ ID NO: 1098334 - RNA, 25 nt, Human
aaacagguaacauucccuggaucug

SEQ ID NO: 1098335 - RNA, 19 nt, Human
aacauggugaaaccccauc

SEQ ID NO: 1098336 - RNA, 20 nt, Human
aacauggugaaaccccaucu

SEQ ID NO: 1098337 - RNA, 21 nt, Human
aacauggugaaaccccaucuc

SEQ ID NO: 1098338 - RNA, 21 nt, Human
aacauggugaaaccccaucuc

SEQ ID NO: 1098339 - RNA, 24 nt, Human
aagaauaucaacaaaagucuacaa

SEQ ID NO: 1098340 - RNA, 19 nt, Human
aaggcuguuggauggcuga

SEQ ID NO: 1098341 - RNA, 24 nt, Human
aaucgcuugaaccugggaggugga

SEQ ID NO: 1098342 - RNA, 22 nt, Human
aaugauauucuuccaggaagaa

SEQ ID NO: 1098343 - RNA, 19 nt, Human
acaagagugaaacuccauc

SEQ ID NO: 1098344 - RNA, 20 nt, Human
acaagagugaaacuccaucu

SEQ ID NO: 1098345 - RNA, 21 nt, Human
acaagagugaaacuccaucuc

SEQ ID NO: 1098346 - RNA, 19 nt, Human
accaccgcacuccagccug

SEQ ID NO: 1098347 - RNA, 24 nt, Human
accccaucucuacuaaaaacacaa

SEQ ID NO: 1098348 - RNA, 21 nt, Human
acccuaggagcaugggaaaau

SEQ ID NO: 1098349 - RNA, 18 nt, Human
accgcacuccagccuggg

SEQ ID NO: 1098350 - RNA, 24 nt, Human
accgcacuccagccugggcaacaa

SEQ ID NO: 1098351 - RNA, 18 nt, Human
accugaacuugcagucau

SEQ ID NO: 1098352 - RNA, 25 nt, Human
acuccagccugggcaacaagaguga

SEQ ID NO: 1098353 - RNA, 22 nt, Human
acugaaaaaaaaagcaaugcag

SEQ ID NO: 1098354 - RNA, 20 nt, Human
acuugggaggcugaggcagg

SEQ ID NO: 1098355 - RNA, 21 nt, Human
agaaaaccuuuagacucaaaa

SEQ ID NO: 1098356 - RNA, 22 nt, Human
agcacccuuguccuuccuggug

SEQ ID NO: 1098357 - RNA, 24 nt, Human
agcacuuugggaggccgaggcagg

SEQ ID NO: 1098358 - RNA, 20 nt, Human
aggaagaauaucaacaaaag

SEQ ID NO: 1098359 - RNA, 24 nt, Human
aggcagaucaugaggucagggguu

SEQ ID NO: 1098360 - RNA, 22 nt, Human
aggcaggagaaucgcuugaacc

SEQ ID NO: 1098361 - RNA, 24 nt, Human
aggcaggagaaucgcuugaaccug

SEQ ID NO: 1098362 - RNA, 24 nt, Human
aggcaggcagaucaugaggucagg

SEQ ID NO: 1098363 - RNA, 18 nt, Human
aggccgaggcaggcagau

SEQ ID NO: 1098364 - RNA, 23 nt, Human
aggccgaggcaggcagaucauga

SEQ ID NO: 1098365 - RNA, 20 nt, Human
aggcugaggcaggagaaucg

SEQ ID NO: 1098366 - RNA, 24 nt, Human
aggcugaggcaggagaaucgcuug

SEQ ID NO: 1098367 - RNA, 21 nt, Human
agguggagguugcagugagcc

SEQ ID NO: 1098368 - RNA, 24 nt, Human
agguggagguugcagugagccgag

SEQ ID NO: 1098369 - RNA, 20 nt, Human
auaaaaauuucgcaacacuc

SEQ ID NO: 1098370 - RNA, 22 nt, Human
auacaaacugaaaaaaaaagca

SEQ ID NO: 1098371 - RNA, 22 nt, Human
aucaugaggucagggguucaag

SEQ ID NO: 1098372 - RNA, 21 nt, Human
auccuggccaacauggugaaa

SEQ ID NO: 1098373 - RNA, 19 nt, Human
augccuguaaucccagcac

SEQ ID NO: 1098374 - RNA, 24 nt, Human
auuuuggcugggcgugguggcuca

SEQ ID NO: 1098375 - RNA, 22 nt, Human
caacaaaagucuacaaucacag

SEQ ID NO: 1098376 - RNA, 19 nt, Human
caacagagcacccuugucc

SEQ ID NO: 1098377 - RNA, 24 nt, Human
caacauggugaaaccccaucucua

SEQ ID NO: 1098378 - RNA, 23 nt, Human
caacccuucaagaaaagaaugau

SEQ ID NO: 1098379 - RNA, 23 nt, Human
caagaaaagaaugauauucuucc

SEQ ID NO: 1098380 - RNA, 24 nt, Human
caagaccauccuggccaacauggu

SEQ ID NO: 1098381 - RNA, 22 nt, Human
cacccuuugggccccuggcuca

SEQ ID NO: 1098382 - RNA, 24 nt, Human
caccgcacuccagccugggcaaca

SEQ ID NO: 1098383 - RNA, 19 nt, Human
caccugaucacauaaaugg

SEQ ID NO: 1098384 - RNA, 21 nt, Human
caccuguagucccagguacuu

SEQ ID NO: 1098385 - RNA, 23 nt, Human
caccuguagucccagguacuugg

SEQ ID NO: 1098386 - RNA, 24 nt, Human
caccuguagucccagguacuuggg

SEQ ID NO: 1098387 - RNA, 23 nt, Human
cacuccagccugggcaacaagag

SEQ ID NO: 1098388 - RNA, 24 nt, Human
cacuccagccugggcaacaagagu

SEQ ID NO: 1098389 - RNA, 25 nt, Human
cacuccagccugggcaacaagagug

SEQ ID NO: 1098390 - RNA, 18 nt, Human
cagaaaaugcaaagccac

SEQ ID NO: 1098391 - RNA, 20 nt, Human
cagagcacccuuguccuucc

SEQ ID NO: 1098392 - RNA, 24 nt, Human
cagcacuuugggaggccgaggcag

SEQ ID NO: 1098393 - RNA, 25 nt, Human
cagcacuuugggaggccgaggcagg

SEQ ID NO: 1098394 - RNA, 27 nt, Human
cagcagaaacagguaacauucccugga

SEQ ID NO: 1098395 - RNA, 24 nt, Human
cagguacuugggaggcugaggcag

SEQ ID NO: 1098396 - RNA, 23 nt, Human
caguacugagaaaacaaauucca

SEQ ID NO: 1098397 - RNA, 20 nt, Human
cauacuguugaccuucccga

SEQ ID NO: 1098398 - RNA, 20 nt, Human
caugccuguaaucccagcac

SEQ ID NO: 1098399 - RNA, 24 nt, Human
caugccuguaaucccagcacuuug

SEQ ID NO: 1098400 - RNA, 20 nt, Human
ccaccgcacuccagccuggg

SEQ ID NO: 1098401 - RNA, 20 nt, Human
ccaccgcacuccagccuggg

SEQ ID NO: 1098402 - RNA, 21 nt, Human
ccaccgcacuccagccugggc

SEQ ID NO: 1098403 - RNA, 24 nt, Human
ccaccgcacuccagccugggcaac

SEQ ID NO: 1098404 - RNA, 18 nt, Human
ccacguggacuccauacc

SEQ ID NO: 1098405 - RNA, 24 nt, Human
ccuccgucucuuccuccaaacaaa

SEQ ID NO: 1098406 - RNA, 22 nt, Human
ccuggccaacauggugaaaccc

SEQ ID NO: 1098407 - RNA, 23 nt, Human
ccuggccaacauggugaaacccc

SEQ ID NO: 1098408 - RNA, 24 nt, Human
ccuggccaacauggugaaacccca

SEQ ID NO: 1098409 - RNA, 21 nt, Human
ccugggagguggagguugcag

SEQ ID NO: 1098410 - RNA, 21 nt, Human
ccuguagucccagguacuugg

SEQ ID NO: 1098411 - RNA, 24 nt, Human
cgaggcaggcagaucaugagguca

SEQ ID NO: 1098412 - RNA, 24 nt, Human
cucaugccuguaaucccagcacuu

SEQ ID NO: 1098413 - RNA, 19 nt, Human
cuccaaacaaaguuggggc

SEQ ID NO: 1098414 - RNA, 23 nt, Human
cuccacgguuauuaacugucacc

SEQ ID NO: 1098415 - RNA, 22 nt, Human
cucuacauuuugucaguaggug

SEQ ID NO: 1098416 - RNA, 23 nt, Human
cucuacauuuugucaguaggugc

SEQ ID NO: 1098417 - RNA, 23 nt, Human
cugaaaaaaaaagcaaugcagua

SEQ ID NO: 1098418 - RNA, 21 nt, Human
cuggaucugcugcaucagccc

SEQ ID NO: 1098419 - RNA, 23 nt, Human
cuggccaacauggugaaacccca

SEQ ID NO: 1098420 - RNA, 19 nt, Human
cuugaaccugggaggugga

SEQ ID NO: 1098421 - RNA, 21 nt, Human
cuuuuaaaaauacaagauugu

SEQ ID NO: 1098422 - RNA, 23 nt, Human
gagaaucgcuugaaccugggagg

SEQ ID NO: 1098423 - RNA, 21 nt, Human
gagguugcagugagccgagau

SEQ ID NO: 1098424 - RNA, 23 nt, Human
gagguugcagugagccgagauug

SEQ ID NO: 1098425 - RNA, 24 nt, Human
gaucaugaggucagggguucaaga

SEQ ID NO: 1098426 - RNA, 21 nt, Human
gauugucacuuuuucucuuuu

SEQ ID NO: 1098427 - RNA, 24 nt, Human
gccaacauggugaaaccccaucuc

SEQ ID NO: 1098428 - RNA, 19 nt, Human
gcuaaguccuccuacaagc

SEQ ID NO: 1098429 - RNA, 24 nt, Human
gcucuacuggaauuaacaaauaau

SEQ ID NO: 1098430 - RNA, 21 nt, Human
gcugggcgugguggcucaugc

SEQ ID NO: 1098431 - RNA, 25 nt, Human
ggagaucaggucgggggugcuccag

SEQ ID NO: 1098432 - RNA, 22 nt, Human
ggagguugcagugagccgagau

SEQ ID NO: 1098433 - RNA, 24 nt, Human
ggagguugcagugagccgagauug

SEQ ID NO: 1098434 - RNA, 23 nt, Human
ggcgugguggcucaugccuguaa

SEQ ID NO: 1098435 - RNA, 18 nt, Human
gggccccuggcucagugu

SEQ ID NO: 1098436 - RNA, 24 nt, Human
gguggcucaugccuguaaucccag

SEQ ID NO: 1098437 - RNA, 22 nt, Human
ggugugguggcacgcaccugua

SEQ ID NO: 1098438 - RNA, 18 nt, Human
gucauucccacguggacu

SEQ ID NO: 1098439 - RNA, 22 nt, Human
gugguugaccccauuucuagau

SEQ ID NO: 1098440 - RNA, 19 nt, Human
guugcagugagccgagauu

SEQ ID NO: 1098441 - RNA, 24 nt, Human
uaaaagauauucugaaagacccua

SEQ ID NO: 1098442 - RNA, 20 nt, Human
uaaagaaacaggaaauggug

SEQ ID NO: 1098443 - RNA, 21 nt, Human
uaacacaauugugguugaccc

SEQ ID NO: 1098444 - RNA, 22 nt, Human
uaacacaauugugguugacccc

SEQ ID NO: 1098445 - RNA, 21 nt, Human
uaaggaaaaugacuuuaaaaa

SEQ ID NO: 1098446 - RNA, 20 nt, Human
uaagugguaacuaugaaaca

SEQ ID NO: 1098447 - RNA, 22 nt, Human
uaaucagaaaaugcaaagccac

SEQ ID NO: 1098448 - RNA, 26 nt, Human
uacaaacugaaaaaaaaagcaaugca

SEQ ID NO: 1098449 - RNA, 21 nt, Human
uacaaucacaggaauggauac

SEQ ID NO: 1098450 - RNA, 24 nt, Human
uaccaccgcacuccagccugggca

SEQ ID NO: 1098451 - RNA, 20 nt, Human
uacuggaauuaacaaauaaa

SEQ ID NO: 1098452 - RNA, 22 nt, Human
uagaaaaccuuuagacucaaaa

SEQ ID NO: 1098453 - RNA, 18 nt, Human
uagaugauggccuucauc

SEQ ID NO: 1098454 - RNA, 22 nt, Human
uagcagcagaaacagguaacau

SEQ ID NO: 1098455 - RNA, 20 nt, Human
uagcugggugugguggcacg

SEQ ID NO: 1098456 - RNA, 24 nt, Human
uauacagaaggaaaaaccucaacc

SEQ ID NO: 1098457 - RNA, 19 nt, Human
uauuauuaaaguucucuau

SEQ ID NO: 1098458 - RNA, 20 nt, Human
ucaagaccauccuggccaac

SEQ ID NO: 1098459 - RNA, 22 nt, Human
ucaagaccauccuggccaacau

SEQ ID NO: 1098460 - RNA, 18 nt, Human
ucagaaaaugcaaagcca

SEQ ID NO: 1098461 - RNA, 23 nt, Human
ucagaauccuucauacuguugac

SEQ ID NO: 1098462 - RNA, 21 nt, Human
ucagcccaaaugggaggagac

SEQ ID NO: 1098463 - RNA, 20 nt, Human
ucaggucgggggugcuccag

SEQ ID NO: 1098464 - RNA, 18 nt, Human
ucaguacugagaaaacaa

SEQ ID NO: 1098465 - RNA, 23 nt, Human
ucaguacugagaaaacaaauucc

SEQ ID NO: 1098466 - RNA, 24 nt, Human
ucaugaggucagggguucaagacc

SEQ ID NO: 1098467 - RNA, 19 nt, Human
ucaugccuacugcuguccc

SEQ ID NO: 1098468 - RNA, 22 nt, Human
ucaugccuguaaucccagcacu

SEQ ID NO: 1098469 - RNA, 22 nt, Human
uccaaacaaaguuggggcuuau

SEQ ID NO: 1098470 - RNA, 25 nt, Human
uccaggaagaauaucaacaaaaguc

SEQ ID NO: 1098471 - RNA, 24 nt, Human
ucgcuugaaccugggagguggagg

SEQ ID NO: 1098472 - RNA, 18 nt, Human
ucucaaaauaaauaaaua

SEQ ID NO: 1098473 - RNA, 22 nt, Human
ucucuacuaaaaacacaaaauu

SEQ ID NO: 1098474 - RNA, 18 nt, Human
ucugaaagacccuaacag

SEQ ID NO: 1098475 - RNA, 19 nt, Human
ucuuuggaauuugggggcu

SEQ ID NO: 1098476 - RNA, 19 nt, Human
ugaaaccccaucucuacua

SEQ ID NO: 1098477 - RNA, 24 nt, Human
ugaaccugggagguggagguugca

SEQ ID NO: 1098478 - RNA, 24 nt, Human
ugacccaggcuaaguccuccuaca

SEQ ID NO: 1098479 - RNA, 19 nt, Human
ugacuucaaaugcuucugu

SEQ ID NO: 1098480 - RNA, 24 nt, Human
ugacuuuaaaaaaauauuuuggcu

SEQ ID NO: 1098481 - RNA, 22 nt, Human
ugagccgagauuguaccaccgc

SEQ ID NO: 1098482 - RNA, 20 nt, Human
ugaggcaggagaaucgcuug

SEQ ID NO: 1098483 - RNA, 24 nt, Human
ugaggcaggagaaucgcuugaacc

SEQ ID NO: 1098484 - RNA, 24 nt, Human
ugaggcaggagaaucgcuugaacc

SEQ ID NO: 1098485 - RNA, 23 nt, Human
ugccuguaaucccagcacuuugg

SEQ ID NO: 1098486 - RNA, 23 nt, Human
ugccuguaaucccagcacuuugg

SEQ ID NO: 1098487 - RNA, 24 nt, Human
ugccuguaaucccagcacuuuggg

SEQ ID NO: 1098488 - RNA, 23 nt, Human
uggaauuaacaaauaauuucuuc

SEQ ID NO: 1098489 - RNA, 19 nt, Human
uggaauuugggggcuuuug

SEQ ID NO: 1098490 - RNA, 22 nt, Human
uggcacgcaccuguagucccag

SEQ ID NO: 1098491 - RNA, 21 nt, Human
uggcagugggagaucaggucg

SEQ ID NO: 1098492 - RNA, 23 nt, Human
uggcagugggagaucaggucggg

SEQ ID NO: 1098493 - RNA, 24 nt, Human
uggccaacauggugaaaccccauc

SEQ ID NO: 1098494 - RNA, 24 nt, Human
uggcucaugccuguaaucccagca

SEQ ID NO: 1098495 - RNA, 21 nt, Human
uggcugagugugaccuccacg

SEQ ID NO: 1098496 - RNA, 19 nt, Human
uggcugggcgugguggcuc

SEQ ID NO: 1098497 - RNA, 23 nt, Human
uggcugggcgugguggcucaugc

SEQ ID NO: 1098498 - RNA, 24 nt, Human
uggcugggcgugguggcucaugcc

SEQ ID NO: 1098499 - RNA, 18 nt, Human
ugggaaaaucuggcagug

SEQ ID NO: 1098500 - RNA, 19 nt, Human
ugggaggagacaggaaugg

SEQ ID NO: 1098501 - RNA, 23 nt, Human
ugggaggagacaggaauguugac

SEQ ID NO: 1098502 - RNA, 20 nt, Human
ugggaggccgaggcaggcag

SEQ ID NO: 1098503 - RNA, 24 nt, Human
ugggaggccgaggcaggcagauca

SEQ ID NO: 1098504 - RNA, 19 nt, Human
ugggaggcugaggcaggag

SEQ ID NO: 1098505 - RNA, 23 nt, Human
ugggaggcugaggcaggagaauc

SEQ ID NO: 1098506 - RNA, 18 nt, Human
ugggagguggagguugca

SEQ ID NO: 1098507 - RNA, 29 nt, Human
ugggagguggagguugcagugacaacggu

SEQ ID NO: 1098508 - RNA, 24 nt, Human
ugggagguggagguugcagugagc

SEQ ID NO: 1098509 - RNA, 19 nt, Human
ugggggcuuuuguguaggg

SEQ ID NO: 1098510 - RNA, 22 nt, Human
ugggugugguggcacgcaccug

SEQ ID NO: 1098511 - RNA, 22 nt, Human
ugguauguccuucacacacaca

SEQ ID NO: 1098512 - RNA, 24 nt, Human
ugguggcacgcaccuguaguccca

SEQ ID NO: 1098513 - RNA, 24 nt, Human
ugguggcucaugccuguaauccca

SEQ ID NO: 1098514 - RNA, 20 nt, Human
uguagggucacuguaaggcu

SEQ ID NO: 1098515 - RNA, 20 nt, Human
ugucaugccuacugcugucc

SEQ ID NO: 1098516 - RNA, 23 nt, Human
uguguggccacuaacaacagagc

SEQ ID NO: 1098517 - RNA, 18 nt, Human
uuagcugggugugguggc

SEQ ID NO: 1098518 - RNA, 19 nt, Human
uuagcugggugugguggca

SEQ ID NO: 1098519 - RNA, 22 nt, Human
uuagcugggugugguggcacgc

SEQ ID NO: 1098520 - RNA, 23 nt, Human
uuauaaagaaacaggaaauggug

SEQ ID NO: 1098521 - RNA, 24 nt, Human
uugaaccugggagguggagguugc

SEQ ID NO: 1098522 - RNA, 18 nt, Human
uugcagugagccgagauu

SEQ ID NO: 1098523 - RNA, 19 nt, Human
uugcagugagccgagauug

SEQ ID NO: 1098524 - RNA, 22 nt, Human
uugcagugagccgagauuguac

SEQ ID NO: 1098525 - RNA, 23 nt, Human
uuggcugggcgugguggcucaug

SEQ ID NO: 1098526 - RNA, 25 nt, Human
uugggaggccgaggcaggcagauca

SEQ ID NO: 1098527 - RNA, 24 nt, Human
uugggaggcugaggcaggagaauc

SEQ ID NO: 1098528 - RNA, 25 nt, Human
uuuaaucagaaaaugcaaagccacc

SEQ ID NO: 1098529 - RNA, 18 nt, Human
uuuagcuggguguggugg

SEQ ID NO: 1098530 - RNA, 21 nt, Human
uuucugaaaagccgaguucug

SEQ ID NO: 1098531 - RNA, 18 nt, Human
uuuggcugggcguggugg

SEQ ID NO: 1098532 - RNA, 22 nt, Human
uuuuggcugggcgugguggcuc

SEQ ID NO: 1098533 - RNA, 20 nt, Human
ugaccaagcggcccagcuug

SEQ ID NO: 1098534 - RNA, 18 nt, Human
cccucaaaugcccucccu

SEQ ID NO: 1098535 - RNA, 18 nt, Human
cccucggucauuucuucc

SEQ ID NO: 1098536 - RNA, 25 nt, Human
ccuauaaucacgugaggggaucguc

SEQ ID NO: 1098537 - RNA, 19 nt, Human
ccucccuucucccucgguc

SEQ ID NO: 1098538 - RNA, 21 nt, Human
ccucccuucucccucggucau

SEQ ID NO: 1098539 - RNA, 23 nt, Human
cucaaaugcccucccuucucccu

SEQ ID NO: 1098540 - RNA, 24 nt, Human
cucaaaugcccucccuucucccuc

SEQ ID NO: 1098541 - RNA, 24 nt, Human
cucuucuucuccccucaaaugccc

SEQ ID NO: 1098542 - RNA, 19 nt, Human
cuucuccccucaaaugccc

SEQ ID NO: 1098543 - RNA, 23 nt, Human
cuucucccucggucauuucuucc

SEQ ID NO: 1098544 - RNA, 24 nt, Human
gaccuuucuuuccaugucacgaga

SEQ ID NO: 1098545 - RNA, 24 nt, Human
gagcgaaugccucagaucacagga

SEQ ID NO: 1098546 - RNA, 21 nt, Human
ucagagcucagaccuuucuuu

SEQ ID NO: 1098547 - RNA, 23 nt, Human
ucauuucuuccuuuccagugagc

SEQ ID NO: 1098548 - RNA, 20 nt, Human
ucccucggucauuucuuccu

SEQ ID NO: 1098549 - RNA, 21 nt, Human
ucucugagcuauguguugugc

SEQ ID NO: 1098550 - RNA, 21 nt, Human
uggccugaugccccacauuga

SEQ ID NO: 1098551 - RNA, 20 nt, Human
uuccaugucacgagaugauc

SEQ ID NO: 1098552 - RNA, 20 nt, Human
acugcuuccccgucccaaga

SEQ ID NO: 1098553 - RNA, 24 nt, Human
acuucagugggcucucuaaugagc

SEQ ID NO: 1098554 - RNA, 23 nt, Human
agacuccccucuccccagcuccu

SEQ ID NO: 1098555 - RNA, 22 nt, Human
agagaaaaaaacuggcagagga

SEQ ID NO: 1098556 - RNA, 22 nt, Human
agcagcacaaaucggcucagcu

SEQ ID NO: 1098557 - RNA, 18 nt, Human
agccuggcacugagcccu

SEQ ID NO: 1098558 - RNA, 19 nt, Human
agcgaggagcagaaugcaa

SEQ ID NO: 1098559 - RNA, 26 nt, Human
aggaagagguggaaaccuugccagaa

SEQ ID NO: 1098560 - RNA, 21 nt, Human
agguagagaaaagacaauggu

SEQ ID NO: 1098561 - RNA, 20 nt, Human
auccuugagcgguuccucca

SEQ ID NO: 1098562 - RNA, 18 nt, Human
auuauccuugggaauaag

SEQ ID NO: 1098563 - RNA, 27 nt, Human
caaacauccuucuucauuuacggucuu

SEQ ID NO: 1098564 - RNA, 18 nt, Human
caagagaaaaaaacuggc

SEQ ID NO: 1098565 - RNA, 23 nt, Human
cacaguucccuuuggggugagga

SEQ ID NO: 1098566 - RNA, 18 nt, Human
caccccucccuaaagcca

SEQ ID NO: 1098567 - RNA, 25 nt, Human
caccccucccuaaagccauggcuug

SEQ ID NO: 1098568 - RNA, 19 nt, Human
cagaacacacacaguuccc

SEQ ID NO: 1098569 - RNA, 23 nt, Human
cagacuccccucuccccagcucc

SEQ ID NO: 1098570 - RNA, 24 nt, Human
cagaggagagccgugcccucucac

SEQ ID NO: 1098571 - RNA, 21 nt, Human
cagcacugcuuccccguccca

SEQ ID NO: 1098572 - RNA, 22 nt, Human
cagcaggguggccuuccaggcg

SEQ ID NO: 1098573 - RNA, 24 nt, Human
cagcuccaggagccugcccagcug

SEQ ID NO: 1098574 - RNA, 20 nt, Human
caggagccugcccagcuguc

SEQ ID NO: 1098575 - RNA, 22 nt, Human
cagugggcucucuaaugagccu

SEQ ID NO: 1098576 - RNA, 25 nt, Human
ccaagagaaaaaaacuggcagagga

SEQ ID NO: 1098577 - RNA, 19 nt, Human
ccccaaagaaaucauugug

SEQ ID NO: 1098578 - RNA, 20 nt, Human
cccgguggcugcugagagca

SEQ ID NO: 1098579 - RNA, 26 nt, Human
cccuagaugcugucauugucuugggg

SEQ ID NO: 1098580 - RNA, 20 nt, Human
ccuccaugggccugccacuu

SEQ ID NO: 1098581 - RNA, 22 nt, Human
ccucucaccccuccucucugca

SEQ ID NO: 1098582 - RNA, 23 nt, Human
ccuugagcgguuccuccaucccc

SEQ ID NO: 1098583 - RNA, 21 nt, Human
ccuugccagaacaggucucca

SEQ ID NO: 1098584 - RNA, 19 nt, Human
ccuugggaauaaggguggg

SEQ ID NO: 1098585 - RNA, 23 nt, Human
cgggagccuggcacugagcccua

SEQ ID NO: 1098586 - RNA, 24 nt, Human
cucacaccacuagguugggcaacu

SEQ ID NO: 1098587 - RNA, 22 nt, Human
cucccuccuucccaagccauca

SEQ ID NO: 1098588 - RNA, 23 nt, Human
cugcaccccucccuaaagccaug

SEQ ID NO: 1098589 - RNA, 19 nt, Human
cugugcgugugugagucag

SEQ ID NO: 1098590 - RNA, 22 nt, Human
cuuccccgucccaagagaaaaa

SEQ ID NO: 1098591 - RNA, 19 nt, Human
cuucugacucccuccuucc

SEQ ID NO: 1098592 - RNA, 24 nt, Human
gaaggcccuccaugggccugccac

SEQ ID NO: 1098593 - RNA, 20 nt, Human
gagccugcaccccucccuaa

SEQ ID NO: 1098594 - RNA, 18 nt, Human
gcccucucaccccucccu

SEQ ID NO: 1098595 - RNA, 21 nt, Human
gccgugcccucucaccccucc

SEQ ID NO: 1098596 - RNA, 21 nt, Human
gcucucuaaugagccugcacc

SEQ ID NO: 1098597 - RNA, 21 nt, Human
gcuuccccgucccaagagaaa

SEQ ID NO: 1098598 - RNA, 18 nt, Human
ggaugucauuaacaucaa

SEQ ID NO: 1098599 - RNA, 19 nt, Human
guccuuguggccuggacuc

SEQ ID NO: 1098600 - RNA, 21 nt, Human
guucucaggcugggcgagggg

SEQ ID NO: 1098601 - RNA, 20 nt, Human
guuuuuuuuucuccuccccc

SEQ ID NO: 1098602 - RNA, 23 nt, Human
uaguuuuuuuuucuccuccccaa

SEQ ID NO: 1098603 - RNA, 23 nt, Human
ucagugggcucucuaaugagccu

SEQ ID NO: 1098604 - RNA, 22 nt, Human
ucagugugcugugcagcagggu

SEQ ID NO: 1098605 - RNA, 18 nt, Human
ucaguugaccuugaguaa

SEQ ID NO: 1098606 - RNA, 21 nt, Human
uccaaaguuuccuguuuucag

SEQ ID NO: 1098607 - RNA, 19 nt, Human
uccaagcagcacugcuucc

SEQ ID NO: 1098608 - RNA, 22 nt, Human
uccccucuccccagcuccuuac

SEQ ID NO: 1098609 - RNA, 19 nt, Human
uccucauuuccccauugaa

SEQ ID NO: 1098610 - RNA, 24 nt, Human
uccuucccaagccaucagcuccag

SEQ ID NO: 1098611 - RNA, 18 nt, Human
uccuugggaauaagggug

SEQ ID NO: 1098612 - RNA, 20 nt, Human
uccuugggaauaaggguggg

SEQ ID NO: 1098613 - RNA, 20 nt, Human
uccuuguggccuggacuccu

SEQ ID NO: 1098614 - RNA, 19 nt, Human
ucggcucagcuggugcugu

SEQ ID NO: 1098615 - RNA, 23 nt, Human
ucucuuccaagggaggcggaggu

SEQ ID NO: 1098616 - RNA, 21 nt, Human
ucugcuccggccauccagagg

SEQ ID NO: 1098617 - RNA, 21 nt, Human
ucuggaaaguucucaggcugg

SEQ ID NO: 1098618 - RNA, 20 nt, Human
ugaaccaucagaacacacac

SEQ ID NO: 1098619 - RNA, 22 nt, Human
ugagccugcaccccucccuaaa

SEQ ID NO: 1098620 - RNA, 22 nt, Human
ugaggaagagguggaaaccuug

SEQ ID NO: 1098621 - RNA, 24 nt, Human
ugaggaaggcaagaccugcacagg

SEQ ID NO: 1098622 - RNA, 25 nt, Human
ugccagaacaggucuccaaaguuuc

SEQ ID NO: 1098623 - RNA, 22 nt, Human
uggaaaguucucaggcugggcg

SEQ ID NO: 1098624 - RNA, 23 nt, Human
uggcucacaccacuagguugggc

SEQ ID NO: 1098625 - RNA, 18 nt, Human
uggcugcugagagcagca

SEQ ID NO: 1098626 - RNA, 22 nt, Human
uggugcugugugcacgugugcg

SEQ ID NO: 1098627 - RNA, 24 nt, Human
uguaaugcggggagagcccgagac

SEQ ID NO: 1098628 - RNA, 24 nt, Human
ugucccgaaccaggcucgcacucu

SEQ ID NO: 1098629 - RNA, 19 nt, Human
ugugugagucagagcugcu

SEQ ID NO: 1098630 - RNA, 21 nt, Human
ugugugagucagagcugcugg

SEQ ID NO: 1098631 - RNA, 21 nt, Human
uucaggcaagcgaggagcaga

SEQ ID NO: 1098632 - RNA, 24 nt, Human
uuccaggcgcaugcucccaucugc

SEQ ID NO: 1098633 - RNA, 18 nt, Human
uugaccuugaguaaagga

SEQ ID NO: 1098634 - RNA, 25 nt, Human
uuggggacagacuccccucucccca

SEQ ID NO: 1098635 - RNA, 23 nt, Human
aaacacgugaaagacacuauaaa

SEQ ID NO: 1098636 - RNA, 22 nt, Human
aaacagcuggaacucugaauac

SEQ ID NO: 1098637 - RNA, 23 nt, Human
aagcaacaaaggcagcaguugcc

SEQ ID NO: 1098638 - RNA, 20 nt, Human
aaggccugcuucccaguucc

SEQ ID NO: 1098639 - RNA, 21 nt, Human
aauaagaacaagggggaaaaa

SEQ ID NO: 1098640 - RNA, 20 nt, Human
aaucccuggacucugacucg

SEQ ID NO: 1098641 - RNA, 20 nt, Human
aauccuagaaagaacauuuu

SEQ ID NO: 1098642 - RNA, 21 nt, Human
acacaggccagcaugcccagc

SEQ ID NO: 1098643 - RNA, 21 nt, Human
acauugaaaacagcuggaacu

SEQ ID NO: 1098644 - RNA, 20 nt, Human
accagcuguuucacugauag

SEQ ID NO: 1098645 - RNA, 21 nt, Human
acuccagcuugaccagaacag

SEQ ID NO: 1098646 - RNA, 25 nt, Human
acugagcaagagacaucagcagcug

SEQ ID NO: 1098647 - RNA, 19 nt, Human
acuggcuacccugcacgcc

SEQ ID NO: 1098648 - RNA, 22 nt, Human
agacacaggccagcaugcccag

SEQ ID NO: 1098649 - RNA, 22 nt, Human
agaggagacaggagucacagaa

SEQ ID NO: 1098650 - RNA, 29 nt, Human
agcaacaaaggcagcaguugccaggaaag

SEQ ID NO: 1098651 - RNA, 21 nt, Human
aggcccaggucugguugcagu

SEQ ID NO: 1098652 - RNA, 21 nt, Human
agggggaaaaaacugagcaag

SEQ ID NO: 1098653 - RNA, 24 nt, Human
auagacacagauggccucaaacac

SEQ ID NO: 1098654 - RNA, 18 nt, Human
aucaguguggcugacgcc

SEQ ID NO: 1098655 - RNA, 19 nt, Human
auggccucaaacacgugaa

SEQ ID NO: 1098656 - RNA, 18 nt, Human
caacacaaugacauuccu

SEQ ID NO: 1098657 - RNA, 19 nt, Human
caagcuucuuugcuagugc

SEQ ID NO: 1098658 - RNA, 18 nt, Human
cacuauaaaccggcaaga

SEQ ID NO: 1098659 - RNA, 20 nt, Human
cagaaggaugcccaguggua

SEQ ID NO: 1098660 - RNA, 18 nt, Human
cagccccacggcggauga

SEQ ID NO: 1098661 - RNA, 20 nt, Human
cagcggcaccaaaggccugc

SEQ ID NO: 1098662 - RNA, 21 nt, Human
caggaaauguguaaucuuuaa

SEQ ID NO: 1098663 - RNA, 19 nt, Human
caguauaagcaacaaaggc

SEQ ID NO: 1098664 - RNA, 23 nt, Human
cauagacacauugaaaacagcug

SEQ ID NO: 1098665 - RNA, 22 nt, Human
ccacaaaggucagaaggaugcc

SEQ ID NO: 1098666 - RNA, 18 nt, Human
ccacugaagauaggacug

SEQ ID NO: 1098667 - RNA, 21 nt, Human
cccacacauggaucugucagc

SEQ ID NO: 1098668 - RNA, 19 nt, Human
ccccucugagugucaccac

SEQ ID NO: 1098669 - RNA, 20 nt, Human
ccgcccccagagcagcccca

SEQ ID NO: 1098670 - RNA, 21 nt, Human
ccuguagccacugaagauagg

SEQ ID NO: 1098671 - RNA, 18 nt, Human
cgcccccagagcagcccc

SEQ ID NO: 1098672 - RNA, 20 nt, Human
cugaagaaguccacguggca

SEQ ID NO: 1098673 - RNA, 20 nt, Human
cugcagcaagcuuccagucc

SEQ ID NO: 1098674 - RNA, 18 nt, Human
cugcucucugcugcugcu

SEQ ID NO: 1098675 - RNA, 21 nt, Human
cugucagcagagaauggaagc

SEQ ID NO: 1098676 - RNA, 23 nt, Human
cuugaccagaacagaauugucaa

SEQ ID NO: 1098677 - RNA, 23 nt, Human
gacaaucccuggacucugacucg

SEQ ID NO: 1098678 - RNA, 19 nt, Human
gaccuggcucaccagggca

SEQ ID NO: 1098679 - RNA, 20 nt, Human
gagcaagagacaucagcagc

SEQ ID NO: 1098680 - RNA, 18 nt, Human
gcaagaccuggcucacca

SEQ ID NO: 1098681 - RNA, 21 nt, Human
gccauagacacauugaaaaca

SEQ ID NO: 1098682 - RNA, 20 nt, Human
gcuacccugcacgccugagc

SEQ ID NO: 1098683 - RNA, 24 nt, Human
ggaaauguguaaucuuuaauauaa

SEQ ID NO: 1098684 - RNA, 20 nt, Human
gguaggccgaugauguaaua

SEQ ID NO: 1098685 - RNA, 21 nt, Human
gguguugaacacagucucuga

SEQ ID NO: 1098686 - RNA, 18 nt, Human
gucagaaggaugcccagu

SEQ ID NO: 1098687 - RNA, 18 nt, Human
uaagaacaagggggaaaa

SEQ ID NO: 1098688 - RNA, 24 nt, Human
uaagaacaagggggaaaaaacuga

SEQ ID NO: 1098689 - RNA, 18 nt, Human
uaauaauagugacaaucc

SEQ ID NO: 1098690 - RNA, 18 nt, Human
uacccugcacgccugagc

SEQ ID NO: 1098691 - RNA, 25 nt, Human
uagaaagaacauuuuaaacuagaaa

SEQ ID NO: 1098692 - RNA, 19 nt, Human
ucacaugcagcauucucca

SEQ ID NO: 1098693 - RNA, 20 nt, Human
ucagaaggaugcccaguggu

SEQ ID NO: 1098694 - RNA, 18 nt, Human
ucagcagagaauggaagc

SEQ ID NO: 1098695 - RNA, 22 nt, Human
uccaagcuucuuugcuagugcc

SEQ ID NO: 1098696 - RNA, 19 nt, Human
uccaagucacagaagaaaa

SEQ ID NO: 1098697 - RNA, 22 nt, Human
uccaagucacagaagaaaacuc

SEQ ID NO: 1098698 - RNA, 20 nt, Human
uccucugcagcaagcuucca

SEQ ID NO: 1098699 - RNA, 19 nt, Human
uccuggccggggcacuggc

SEQ ID NO: 1098700 - RNA, 18 nt, Human
uccuugggucucacaugc

SEQ ID NO: 1098701 - RNA, 19 nt, Human
ucucaggcccaggucuggu

SEQ ID NO: 1098702 - RNA, 23 nt, Human
ucucugcucucugcugcugcugc

SEQ ID NO: 1098703 - RNA, 21 nt, Human
ucugcagcaagcuuccagucc

SEQ ID NO: 1098704 - RNA, 20 nt, Human
ugacaaucccuggacucuga

SEQ ID NO: 1098705 - RNA, 21 nt, Human
ugaccagaacagaauugucaa

SEQ ID NO: 1098706 - RNA, 18 nt, Human
ugaccgugagccccacca

SEQ ID NO: 1098707 - RNA, 20 nt, Human
ugacgccgcccccagagcag

SEQ ID NO: 1098708 - RNA, 21 nt, Human
ugccuguagccacugaagaua

SEQ ID NO: 1098709 - RNA, 23 nt, Human
ugcugguaggagcugaaagggcg

SEQ ID NO: 1098710 - RNA, 20 nt, Human
ugguaggagcugaaagggcg

SEQ ID NO: 1098711 - RNA, 19 nt, Human
uguccaccugcacuagacc

SEQ ID NO: 1098712 - RNA, 24 nt, Human
uuaaacuagaaagcuagacuuaaa

SEQ ID NO: 1098713 - RNA, 19 nt, Human
uucaaaguguccaccugca

SEQ ID NO: 1098714 - RNA, 23 nt, Human
uucccaguuccucucagaacucc

SEQ ID NO: 1098715 - RNA, 19 nt, Human
uuccuugggucucacaugc

SEQ ID NO: 1098716 - RNA, 19 nt, Human
uugaaaacagcuggaacuc

SEQ ID NO: 1098717 - RNA, 19 nt, Human
uugcagggcagaccguggu

SEQ ID NO: 1098718 - RNA, 18 nt, Human
uuggcugaacacuaagcu

SEQ ID NO: 1098719 - RNA, 21 nt, Human
uuguagaggagacaggaguca

SEQ ID NO: 1098720 - RNA, 18 nt, Human
agugugcagcugcagccc

SEQ ID NO: 1098721 - RNA, 24 nt, Human
caaggacagugugcagcugcagcc

SEQ ID NO: 1098722 - RNA, 18 nt, Human
cagugcucuuacuucugc

SEQ ID NO: 1098723 - RNA, 19 nt, Human
ccugcuagggccugcccca

SEQ ID NO: 1098724 - RNA, 18 nt, Human
cgcuggugcuggcagugc

SEQ ID NO: 1098725 - RNA, 26 nt, Human
cucaaaguggagaagcaacacgagaa

SEQ ID NO: 1098726 - RNA, 22 nt, Human
cuccgccgcuggugcuggcagu

SEQ ID NO: 1098727 - RNA, 19 nt, Human
cuccugaaucuccuggaca

SEQ ID NO: 1098728 - RNA, 20 nt, Human
cucucucuggaggggccucu

SEQ ID NO: 1098729 - RNA, 20 nt, Human
cuggugcuggcagugcucuu

SEQ ID NO: 1098730 - RNA, 20 nt, Human
cuuggcuggagcucccucca

SEQ ID NO: 1098731 - RNA, 22 nt, Human
gcaacacgagaacaucuugcuc

SEQ ID NO: 1098732 - RNA, 18 nt, Human
ucccaugcuggcucuggc

SEQ ID NO: 1098733 - RNA, 28 nt, Human
ucucuggaggggccucuucccaugcugg

SEQ ID NO: 1098734 - RNA, 21 nt, Human
ugaagcagcaaccucucaaag

SEQ ID NO: 1098735 - RNA, 25 nt, Human
ugguguggccuggccugcuagggcc

SEQ ID NO: 1098736 - RNA, 22 nt, Human
aaaagcaagaaaaagaaggaaa

SEQ ID NO: 1098737 - RNA, 18 nt, Human
aaaaugcucacauuagaa

SEQ ID NO: 1098738 - RNA, 18 nt, Human
aaacagaagaaacgcuuu

SEQ ID NO: 1098739 - RNA, 22 nt, Human
aaacagaagaaacgcuuuccaa

SEQ ID NO: 1098740 - RNA, 24 nt, Human
aaaccagacaaacuauauacaaaa

SEQ ID NO: 1098741 - RNA, 24 nt, Human
aaagaaaaaaagacauaauggcac

SEQ ID NO: 1098742 - RNA, 21 nt, Human
aaagcaagaaaaagaaggaaa

SEQ ID NO: 1098743 - RNA, 23 nt, Human
aaauaauaaagauaaaaguagaa

SEQ ID NO: 1098744 - RNA, 22 nt, Human
aaaucaaugaaacugaaaccaa

SEQ ID NO: 1098745 - RNA, 23 nt, Human
aacaccucucaauaauccaauua

SEQ ID NO: 1098746 - RNA, 19 nt, Human
aacauacagaaaauugacc

SEQ ID NO: 1098747 - RNA, 21 nt, Human
aacuaauagaacugaaaggaa

SEQ ID NO: 1098748 - RNA, 25 nt, Human
aagaaaaaaagacauaauggcacaa

SEQ ID NO: 1098749 - RNA, 25 nt, Human
aagaaaaagaaggaaauaauaaaga

SEQ ID NO: 1098750 - RNA, 21 nt, Human
aagaaggaaauaauaaagaua

SEQ ID NO: 1098751 - RNA, 22 nt, Human
aagaaggaaauaauaaagauaa

SEQ ID NO: 1098752 - RNA, 18 nt, Human
aagaggaaaggucucaaa

SEQ ID NO: 1098753 - RNA, 23 nt, Human
aagcaagaaaaagaaggagggac

SEQ ID NO: 1098754 - RNA, 23 nt, Human
aaguaguccuaggagggaacuaa

SEQ ID NO: 1098755 - RNA, 18 nt, Human
aauacaauucuacaaaua

SEQ ID NO: 1098756 - RNA, 22 nt, Human
aaugaccagagacugagaggaa

SEQ ID NO: 1098757 - RNA, 18 nt, Human
acaaaaaaaucuccgagc

SEQ ID NO: 1098758 - RNA, 26 nt, Human
acaaacuucugacaagaucaacaaag

SEQ ID NO: 1098759 - RNA, 20 nt, Human
acaaagaaaaaaagacauaa

SEQ ID NO: 1098760 - RNA, 21 nt, Human
acaaagaaaaugaccagagac

SEQ ID NO: 1098761 - RNA, 24 nt, Human
agaaaaaaagacauaauggcacaa

SEQ ID NO: 1098762 - RNA, 25 nt, Human
agaaaaaaagacauaauggcacaaa

SEQ ID NO: 1098763 - RNA, 23 nt, Human
agaaaaagaaggaaauaauaaag

SEQ ID NO: 1098764 - RNA, 19 nt, Human
agaaaucaaugaaacugaa

SEQ ID NO: 1098765 - RNA, 24 nt, Human
aggaaaacagaagaaaccgguacc

SEQ ID NO: 1098766 - RNA, 18 nt, Human
auaccaaaaccagacaaa

SEQ ID NO: 1098767 - RNA, 23 nt, Human
caaaagcaagaaaaagaaggaaa

SEQ ID NO: 1098768 - RNA, 21 nt, Human
caaaaggauaaugaagaauac

SEQ ID NO: 1098769 - RNA, 20 nt, Human
caaagaaaaugaccagagac

SEQ ID NO: 1098770 - RNA, 24 nt, Human
caacaaagaaaaaaagacauaaug

SEQ ID NO: 1098771 - RNA, 19 nt, Human
caagagaagccauaaagug

SEQ ID NO: 1098772 - RNA, 18 nt, Human
cacccuuucucccaucca

SEQ ID NO: 1098773 - RNA, 24 nt, Human
caccucuagaaccuagaaaaagaa

SEQ ID NO: 1098774 - RNA, 18 nt, Human
caccugccccuuagucac

SEQ ID NO: 1098775 - RNA, 18 nt, Human
cagcacaaagaaaaugac

SEQ ID NO: 1098776 - RNA, 22 nt, Human
cagccacagccugaccccuugg

SEQ ID NO: 1098777 - RNA, 20 nt, Human
cauaaagugcugccuuuaag

SEQ ID NO: 1098778 - RNA, 23 nt, Human
cauuagaaaagaggaaaggucuc

SEQ ID NO: 1098779 - RNA, 20 nt, Human
cccuuucucccauccacugu

SEQ ID NO: 1098780 - RNA, 22 nt, Human
ccuagaaaaagaagcacaaaau

SEQ ID NO: 1098781 - RNA, 23 nt, Human
ccugaaaauauuaaauggaaaau

SEQ ID NO: 1098782 - RNA, 20 nt, Human
ccuuuaagugaaaggguaaa

SEQ ID NO: 1098783 - RNA, 22 nt, Human
cgaguagugaugguagcaauuu

SEQ ID NO: 1098784 - RNA, 20 nt, Human
cucagguaugucuuuaucag

SEQ ID NO: 1098785 - RNA, 25 nt, Human
cugacaagaucaacaaagaaaaaaa

SEQ ID NO: 1098786 - RNA, 22 nt, Human
cugagaggaauauuacguaaug

SEQ ID NO: 1098787 - RNA, 22 nt, Human
cugcaaaauaaugugaagcuaa

SEQ ID NO: 1098788 - RNA, 22 nt, Human
cugguucuuggaacaaauugau

SEQ ID NO: 1098789 - RNA, 27 nt, Human
gaaauaaaacagggauaccauuacaga

SEQ ID NO: 1098790 - RNA, 25 nt, Human
gaagcacaaaauauaccaaaagcaa

SEQ ID NO: 1098791 - RNA, 20 nt, Human
gaggaaaggucucaaaucaa

SEQ ID NO: 1098792 - RNA, 23 nt, Human
gcaaaauaaugugaagcuaaaac

SEQ ID NO: 1098793 - RNA, 23 nt, Human
ggaaaaaagaaacuauggacuaa

SEQ ID NO: 1098794 - RNA, 22 nt, Human
ggaaaaauaaauaaauccacaa

SEQ ID NO: 1098795 - RNA, 23 nt, Human
ggaaaaauaaauaaauccacaaa

SEQ ID NO: 1098796 - RNA, 24 nt, Human
uaaaguauauuucagcacaaagaa

SEQ ID NO: 1098797 - RNA, 26 nt, Human
uaaauaaauccacaaauacaguugga

SEQ ID NO: 1098798 - RNA, 24 nt, Human
uaacacacacaaaaaaaucuccga

SEQ ID NO: 1098799 - RNA, 22 nt, Human
uaaggaaacugaauauguaauu

SEQ ID NO: 1098800 - RNA, 24 nt, Human
uacccugauaccaaaaccagacaa

SEQ ID NO: 1098801 - RNA, 19 nt, Human
uagaaaaaauucacugcaa

SEQ ID NO: 1098802 - RNA, 20 nt, Human
uagaaccuagaaaaagaagc

SEQ ID NO: 1098803 - RNA, 22 nt, Human
uaggagggaacuaaauguaacu

SEQ ID NO: 1098804 - RNA, 20 nt, Human
uaguagccaacaguuaucag

SEQ ID NO: 1098805 - RNA, 22 nt, Human
uagugaugguagcaauuuggau

SEQ ID NO: 1098806 - RNA, 22 nt, Human
uauaacacacacaaaaaaaucu

SEQ ID NO: 1098807 - RNA, 22 nt, Human
uauaccaaaagcaagaaaaaga

SEQ ID NO: 1098808 - RNA, 21 nt, Human
uaugcuuccaccucuagaacc

SEQ ID NO: 1098809 - RNA, 19 nt, Human
ucaacaaagaaaaaaagac

SEQ ID NO: 1098810 - RNA, 23 nt, Human
ucagcacaaagaaaaugaccaga

SEQ ID NO: 1098811 - RNA, 21 nt, Human
ucagucucagguaugucuuua

SEQ ID NO: 1098812 - RNA, 21 nt, Human
ucugcaguuucgcuuuccugg

SEQ ID NO: 1098813 - RNA, 20 nt, Human
ugaaaccaaaucaaugagcu

SEQ ID NO: 1098814 - RNA, 22 nt, Human
ugaaaggguaaaagcuuucaau

SEQ ID NO: 1098815 - RNA, 20 nt, Human
ugacaagaucaacaaagaaa

SEQ ID NO: 1098816 - RNA, 21 nt, Human
ugacaagaucaacaaagaaaa

SEQ ID NO: 1098817 - RNA, 24 nt, Human
ugacaagaucaacaaagaaaaaaa

SEQ ID NO: 1098818 - RNA, 26 nt, Human
ugacaagaucaacaaagaaaaaaaga

SEQ ID NO: 1098819 - RNA, 24 nt, Human
uggaacaaauugauaaaauugaca

SEQ ID NO: 1098820 - RNA, 20 nt, Human
uuccuggguuuguuacucac

SEQ ID NO: 1098821 - RNA, 20 nt, Human
uuccuggguuuguuacucac

SEQ ID NO: 1098822 - RNA, 22 nt, Human
uugcaucguccugcuccauccc

SEQ ID NO: 1098823 - RNA, 23 nt, Human
uugugaggccuccccagccaugu

SEQ ID NO: 1098824 - RNA, 20 nt, Human
uuuguuaaaagggaaaaaag

SEQ ID NO: 1098825 - RNA, 18 nt, Human
aaucgcuugaacccggga

SEQ ID NO: 1098826 - RNA, 22 nt, Human
agaggaugggcuuccuaauuuc

SEQ ID NO: 1098827 - RNA, 22 nt, Human
agccaguaucauucaugccaga

SEQ ID NO: 1098828 - RNA, 18 nt, Human
agcuuuugccucugagca

SEQ ID NO: 1098829 - RNA, 24 nt, Human
aggcaggagaaucgcuugaacccg

SEQ ID NO: 1098830 - RNA, 20 nt, Human
aggcugaggcaggagaaucg

SEQ ID NO: 1098831 - RNA, 24 nt, Human
aggcugaggcaggagaaucgcuug

SEQ ID NO: 1098832 - RNA, 18 nt, Human
aucuuccaugcucucguu

SEQ ID NO: 1098833 - RNA, 18 nt, Human
augaaguucuacaccugg

SEQ ID NO: 1098834 - RNA, 21 nt, Human
cccgggaugcggagguugcag

SEQ ID NO: 1098835 - RNA, 21 nt, Human
ccuguaaucccagcuacucug

SEQ ID NO: 1098836 - RNA, 22 nt, Human
ccuguaaucccagcuacucugg

SEQ ID NO: 1098837 - RNA, 23 nt, Human
ccuguaaucccagcuacucugga

SEQ ID NO: 1098838 - RNA, 24 nt, Human
cgggaugcggagguugcagugagc

SEQ ID NO: 1098839 - RNA, 19 nt, Human
gcggagguugcagugagcc

SEQ ID NO: 1098840 - RNA, 22 nt, Human
gcggagguugcagugagccgag

SEQ ID NO: 1098841 - RNA, 18 nt, Human
ggagguugcagugagccg

SEQ ID NO: 1098842 - RNA, 20 nt, Human
ggagguugcagugagccgag

SEQ ID NO: 1098843 - RNA, 19 nt, Human
guaggugccuguaauccca

SEQ ID NO: 1098844 - RNA, 20 nt, Human
guaggugccuguaaucccag

SEQ ID NO: 1098845 - RNA, 19 nt, Human
uacucuggaggcugaggca

SEQ ID NO: 1098846 - RNA, 23 nt, Human
uccaguccaccaacaucucaggg

SEQ ID NO: 1098847 - RNA, 24 nt, Human
ucgcuugaacccgggaugcggagg

SEQ ID NO: 1098848 - RNA, 25 nt, Human
ucugcaaucugggggccggaagagc

SEQ ID NO: 1098849 - RNA, 20 nt, Human
ugaggcaggagaaucgcuug

SEQ ID NO: 1098850 - RNA, 24 nt, Human
ugaggcaggagaaucgcuugaacc

SEQ ID NO: 1098851 - RNA, 25 nt, Human
ugaggcaggagaaucgcuugaaccc

SEQ ID NO: 1098852 - RNA, 19 nt, Human
ugccuguaaucccagcuac

SEQ ID NO: 1098853 - RNA, 24 nt, Human
ugccuguaaucccagcuacucugg

SEQ ID NO: 1098854 - RNA, 21 nt, Human
ugcggagguugcagugagccg

SEQ ID NO: 1098855 - RNA, 19 nt, Human
ugguugggugaucucuucc

SEQ ID NO: 1098856 - RNA, 20 nt, Human
uguacgaagucucugguugg

SEQ ID NO: 1098857 - RNA, 24 nt, Human
uguuguaggugccuguaaucccag

SEQ ID NO: 1098858 - RNA, 24 nt, Human
uuagcaauuauuccaacaucuucc

SEQ ID NO: 1098859 - RNA, 21 nt, Human
uucaugauggucaguuccucu

SEQ ID NO: 1098860 - RNA, 24 nt, Human
uucuagaucagagauccaguccac

SEQ ID NO: 1098861 - RNA, 24 nt, Human
uuugccucugagcaguuuuuucua

SEQ ID NO: 1098862 - RNA, 22 nt, Human
aaaagcaagaaaaagaaggaaa

SEQ ID NO: 1098863 - RNA, 18 nt, Human
aaaaugcucacauuagaa

SEQ ID NO: 1098864 - RNA, 18 nt, Human
aaacagaagaaacgcuuu

SEQ ID NO: 1098865 - RNA, 22 nt, Human
aaacagaagaaacgcuuuccaa

SEQ ID NO: 1098866 - RNA, 24 nt, Human
aaaccagacaaacuauauacaaaa

SEQ ID NO: 1098867 - RNA, 23 nt, Human
aaagaaaaaaagacauaacggca

SEQ ID NO: 1098868 - RNA, 21 nt, Human
aaagcaagaaaaagaaggaaa

SEQ ID NO: 1098869 - RNA, 23 nt, Human
aaauaauaaagauaaaaguagaa

SEQ ID NO: 1098870 - RNA, 22 nt, Human
aaaucaaugaaacugaaaccaa

SEQ ID NO: 1098871 - RNA, 23 nt, Human
aacaccucucaauaacccaauua

SEQ ID NO: 1098872 - RNA, 19 nt, Human
aacauacagaaaauggacc

SEQ ID NO: 1098873 - RNA, 21 nt, Human
aacuaauagaacugaaaggaa

SEQ ID NO: 1098874 - RNA, 25 nt, Human
aagaaaaagaaggaaauaauaaaga

SEQ ID NO: 1098875 - RNA, 20 nt, Human
aagaaggaaauaauaaagau

SEQ ID NO: 1098876 - RNA, 21 nt, Human
aagaaggaaauaauaaagaua

SEQ ID NO: 1098877 - RNA, 22 nt, Human
aagaaggaaauaauaaagauaa

SEQ ID NO: 1098878 - RNA, 18 nt, Human
aagagaagccauaaagug

SEQ ID NO: 1098879 - RNA, 18 nt, Human
aagaggaaaggucucaaa

SEQ ID NO: 1098880 - RNA, 20 nt, Human
aagcaagaaaaagaaggagg

SEQ ID NO: 1098881 - RNA, 23 nt, Human
aaguaguccuaggagggaacuaa

SEQ ID NO: 1098882 - RNA, 18 nt, Human
aauacaauucuacaaaua

SEQ ID NO: 1098883 - RNA, 22 nt, Human
aaugaccagagacugagaggaa

SEQ ID NO: 1098884 - RNA, 18 nt, Human
acaaaaaaaucuccgagc

SEQ ID NO: 1098885 - RNA, 26 nt, Human
acaaacuucugacaagaucaacaaag

SEQ ID NO: 1098886 - RNA, 20 nt, Human
acaaagaaaaaaagacauaa

SEQ ID NO: 1098887 - RNA, 21 nt, Human
acaaagaaaaugaccagagac

SEQ ID NO: 1098888 - RNA, 24 nt, Human
agaaaaaaagacauaacggcacaa

SEQ ID NO: 1098889 - RNA, 23 nt, Human
agaaaaagaaggaaauaauaaag

SEQ ID NO: 1098890 - RNA, 19 nt, Human
agaaaucaaugaaacugaa

SEQ ID NO: 1098891 - RNA, 18 nt, Human
auaccaaaaccagacaaa

SEQ ID NO: 1098892 - RNA, 23 nt, Human
caaaagcaagaaaaagaaggaaa

SEQ ID NO: 1098893 - RNA, 21 nt, Human
caaaaggauaauuaagaauac

SEQ ID NO: 1098894 - RNA, 23 nt, Human
caaagaaaaaaagacauaacggc

SEQ ID NO: 1098895 - RNA, 26 nt, Human
caaagaaaaaaagacauaacggcaca

SEQ ID NO: 1098896 - RNA, 20 nt, Human
caaagaaaaugaccagagac

SEQ ID NO: 1098897 - RNA, 24 nt, Human
caacaaagaaaaaaagacauaacg

SEQ ID NO: 1098898 - RNA, 24 nt, Human
caccucuagaaccuagaaaaagaa

SEQ ID NO: 1098899 - RNA, 18 nt, Human
cagcacaaagaaaaugac

SEQ ID NO: 1098900 - RNA, 22 nt, Human
cagccacagccugaccccuugg

SEQ ID NO: 1098901 - RNA, 20 nt, Human
cauaaagugcugccuuuaag

SEQ ID NO: 1098902 - RNA, 23 nt, Human
cauuagaaaagaggaaaggucuc

SEQ ID NO: 1098903 - RNA, 21 nt, Human
ccccuuuguccaucgcaucca

SEQ ID NO: 1098904 - RNA, 20 nt, Human
cccuuucucccauccacugu

SEQ ID NO: 1098905 - RNA, 20 nt, Human
ccuagaaaaagaagcacaaa

SEQ ID NO: 1098906 - RNA, 23 nt, Human
ccugaaaauauuaaauggaaaau

SEQ ID NO: 1098907 - RNA, 20 nt, Human
ccuuuaagugaaaggguaaa

SEQ ID NO: 1098908 - RNA, 23 nt, Human
cgaguagugaugguagcaguuuu

SEQ ID NO: 1098909 - RNA, 20 nt, Human
cucagguaugucuuuaucag

SEQ ID NO: 1098910 - RNA, 22 nt, Human
cugcaaaauaaugugaagcuaa

SEQ ID NO: 1098911 - RNA, 22 nt, Human
cugguucuuggaacaaauugau

SEQ ID NO: 1098912 - RNA, 27 nt, Human
gaaauaaaacagggauaccauuacaga

SEQ ID NO: 1098913 - RNA, 25 nt, Human
gaagcacaaaauauaccaaaagcaa

SEQ ID NO: 1098914 - RNA, 18 nt, Human
gagguagauccuccccuu

SEQ ID NO: 1098915 - RNA, 23 nt, Human
gcaaaauaaugugaagcuaaaac

SEQ ID NO: 1098916 - RNA, 24 nt, Human
gcugggagguagauccuccccuuu

SEQ ID NO: 1098917 - RNA, 23 nt, Human
ggaaaaaagaaacuauggacuaa

SEQ ID NO: 1098918 - RNA, 22 nt, Human
ggaaaaauaaauaaauccacaa

SEQ ID NO: 1098919 - RNA, 23 nt, Human
ggaaaaauaaauaaauccacaaa

SEQ ID NO: 1098920 - RNA, 23 nt, Human
ggaaaacagaagaaacgcuuucc

SEQ ID NO: 1098921 - RNA, 24 nt, Human
uaaaguauauuucagcacaaagaa

SEQ ID NO: 1098922 - RNA, 26 nt, Human
uaaauaaauccacaaauacaguugga

SEQ ID NO: 1098923 - RNA, 22 nt, Human
uaagaauacuaauacaauucua

SEQ ID NO: 1098924 - RNA, 23 nt, Human
uaagaauacuaauacaauucuac

SEQ ID NO: 1098925 - RNA, 22 nt, Human
uaaggaaacugaauauguaauu

SEQ ID NO: 1098926 - RNA, 20 nt, Human
uaccaaaagcaagaaaaaga

SEQ ID NO: 1098927 - RNA, 24 nt, Human
uacccugauaccaaaaccagacaa

SEQ ID NO: 1098928 - RNA, 20 nt, Human
uagaaccuagaaaaagaagc

SEQ ID NO: 1098929 - RNA, 23 nt, Human
uaggagggaacuaaauguaacua

SEQ ID NO: 1098930 - RNA, 20 nt, Human
uaguagccaacaguuaucag

SEQ ID NO: 1098931 - RNA, 22 nt, Human
uagugaugguagcaguuuggau

SEQ ID NO: 1098932 - RNA, 22 nt, Human
uauaacacacacaaaaaaaucu

SEQ ID NO: 1098933 - RNA, 21 nt, Human
uaugcuuccaccucuagaacc

SEQ ID NO: 1098934 - RNA, 19 nt, Human
ucaacaaagaaaaaaagac

SEQ ID NO: 1098935 - RNA, 19 nt, Human
ucacccuuucucccaucca

SEQ ID NO: 1098936 - RNA, 23 nt, Human
ucagcacaaagaaaaugaccaga

SEQ ID NO: 1098937 - RNA, 21 nt, Human
ucagucucagguaugucuuua

SEQ ID NO: 1098938 - RNA, 19 nt, Human
uccuggguuuguuacucac

SEQ ID NO: 1098939 - RNA, 19 nt, Human
ucugcaguuucgcuuuccu

SEQ ID NO: 1098940 - RNA, 21 nt, Human
ucugcaguuucgcuuuccugg

SEQ ID NO: 1098941 - RNA, 20 nt, Human
ugaaaccaaaucaaugagcu

SEQ ID NO: 1098942 - RNA, 22 nt, Human
ugaaaggguaaaagcuuucaau

SEQ ID NO: 1098943 - RNA, 20 nt, Human
ugacaagaucaacaaagaaa

SEQ ID NO: 1098944 - RNA, 21 nt, Human
ugacaagaucaacaaagaaaa

SEQ ID NO: 1098945 - RNA, 24 nt, Human
ugacaagaucaacaaagaaaaaaa

SEQ ID NO: 1098946 - RNA, 26 nt, Human
ugacaagaucaacaaagaaaaaaaga

SEQ ID NO: 1098947 - RNA, 21 nt, Human
ugagaggaauauuacauaaug

SEQ ID NO: 1098948 - RNA, 24 nt, Human
uggaacaaauugauaaaauugaca

SEQ ID NO: 1098949 - RNA, 19 nt, Human
uguggugguauugcagucc

SEQ ID NO: 1098950 - RNA, 20 nt, Human
uuccuggguuuguuacucac

SEQ ID NO: 1098951 - RNA, 22 nt, Human
uugcaucguccugcuccauccc

SEQ ID NO: 1098952 - RNA, 23 nt, Human
uugcgaggccuccccagccaugu

SEQ ID NO: 1098953 - RNA, 20 nt, Human
uuuguuaaaagggaaaaaag

SEQ ID NO: 1098954 - RNA, 18 nt, Human
acccuuuggagccaccuc

SEQ ID NO: 1098955 - RNA, 19 nt, Human
augguagggcagguggugg

SEQ ID NO: 1098956 - RNA, 20 nt, Human
ccuccugguccccucaccca

SEQ ID NO: 1098957 - RNA, 21 nt, Human
cuccugguccccucacccacu

SEQ ID NO: 1098958 - RNA, 20 nt, Human
ugcuuuacccuuuggagcca

SEQ ID NO: 1098959 - RNA, 20 nt, Human
aagcagccagcccuucagga

SEQ ID NO: 1098960 - RNA, 21 nt, Human
aaggagcuggaggagaagagg

SEQ ID NO: 1098961 - RNA, 24 nt, Human
aaugcuagaagcaucaugaaggaa

SEQ ID NO: 1098962 - RNA, 19 nt, Human
acauggcagcgcuuccugu

SEQ ID NO: 1098963 - RNA, 18 nt, Human
acucuuacaaggaauuuc

SEQ ID NO: 1098964 - RNA, 20 nt, Human
agagaaccaagggacuguca

SEQ ID NO: 1098965 - RNA, 21 nt, Human
agagaaccaagggacugucag

SEQ ID NO: 1098966 - RNA, 21 nt, Human
agauggcucagggaugaggag

SEQ ID NO: 1098967 - RNA, 19 nt, Human
agcaaucauaagagaacca

SEQ ID NO: 1098968 - RNA, 24 nt, Human
agcaucuacaugcucaaagaaacu

SEQ ID NO: 1098969 - RNA, 21 nt, Human
agccagcccuucaggagccag

SEQ ID NO: 1098970 - RNA, 21 nt, Human
aggcuaggaaacuugaaggca

SEQ ID NO: 1098971 - RNA, 20 nt, Human
aucacauuuuccuccaucaa

SEQ ID NO: 1098972 - RNA, 20 nt, Human
aucucuaucacauuuuccuc

SEQ ID NO: 1098973 - RNA, 20 nt, Human
augccaggguccuggcauga

SEQ ID NO: 1098974 - RNA, 19 nt, Human
caaauggaggaccacagau

SEQ ID NO: 1098975 - RNA, 24 nt, Human
caaugcauacagcaccugcacccu

SEQ ID NO: 1098976 - RNA, 24 nt, Human
cagcgcacaccccuacuccucaug

SEQ ID NO: 1098977 - RNA, 18 nt, Human
caggagccagccaggaga

SEQ ID NO: 1098978 - RNA, 22 nt, Human
caggagccagccaggagacagc

SEQ ID NO: 1098979 - RNA, 23 nt, Human
cagggaugaggagauggcaaagg

SEQ ID NO: 1098980 - RNA, 22 nt, Human
cauauaaaccaaugcauacagc

SEQ ID NO: 1098981 - RNA, 24 nt, Human
ccacagauggcuggugguacugag

SEQ ID NO: 1098982 - RNA, 21 nt, Human
ccacagggagauggcucaggg

SEQ ID NO: 1098983 - RNA, 21 nt, Human
cccaaggagcagugggagcuc

SEQ ID NO: 1098984 - RNA, 24 nt, Human
cccugucagcaucuacaugcucaa

SEQ ID NO: 1098985 - RNA, 19 nt, Human
ccuucaggagccagccagg

SEQ ID NO: 1098986 - RNA, 23 nt, Human
cuagaugcuuuccgcaaucgugg

SEQ ID NO: 1098987 - RNA, 23 nt, Human
cuaugaagagaagcaaaaaaaaa

SEQ ID NO: 1098988 - RNA, 19 nt, Human
cucagacuccccauccuuc

SEQ ID NO: 1098989 - RNA, 22 nt, Human
cugaggcucagaaauguuguac

SEQ ID NO: 1098990 - RNA, 21 nt, Human
cuggacuuccaggugggggaa

SEQ ID NO: 1098991 - RNA, 21 nt, Human
cuggaggauuuccaaugcuag

SEQ ID NO: 1098992 - RNA, 18 nt, Human
cuggaugcugaugguaac

SEQ ID NO: 1098993 - RNA, 19 nt, Human
cuuuccgcaaucguggaga

SEQ ID NO: 1098994 - RNA, 24 nt, Human
gaaagugcaccauucccaaggagc

SEQ ID NO: 1098995 - RNA, 22 nt, Human
gaagcagccagcccuucagggg

SEQ ID NO: 1098996 - RNA, 18 nt, Human
gaaggaagagaggggcug

SEQ ID NO: 1098997 - RNA, 21 nt, Human
gaggauuuccaaugcuagaag

SEQ ID NO: 1098998 - RNA, 18 nt, Human
gaugcagugcugguggcc

SEQ ID NO: 1098999 - RNA, 19 nt, Human
gauucccugucccuuucuc

SEQ ID NO: 1099000 - RNA, 23 nt, Human
gcaaaaaaaaaaaaaaaaaaaaa

SEQ ID NO: 1099001 - RNA, 19 nt, Human
gcccuucaggagccagcca

SEQ ID NO: 1099002 - RNA, 21 nt, Human
ggacugucaggcugugcggag

SEQ ID NO: 1099003 - RNA, 22 nt, Human
ggagaagaggacacccaggaac

SEQ ID NO: 1099004 - RNA, 23 nt, Human
ggagcagugggagcucgcucugg

SEQ ID NO: 1099005 - RNA, 20 nt, Human
ggaggagaagaggacaccca

SEQ ID NO: 1099006 - RNA, 18 nt, Human
ggcuggugguacugaggc

SEQ ID NO: 1099007 - RNA, 19 nt, Human
uacagcaccugcacccuuc

SEQ ID NO: 1099008 - RNA, 22 nt, Human
uacagcaccugcacccuucagc

SEQ ID NO: 1099009 - RNA, 21 nt, Human
uaugaagagaagcaaaaaaaa

SEQ ID NO: 1099010 - RNA, 21 nt, Human
ucccaaggagcagugggagcu

SEQ ID NO: 1099011 - RNA, 19 nt, Human
uccgcggagccuuccagcc

SEQ ID NO: 1099012 - RNA, 21 nt, Human
ucucuugcaggagagaaggcu

SEQ ID NO: 1099013 - RNA, 23 nt, Human
ucugccacagggagauggcucag

SEQ ID NO: 1099014 - RNA, 23 nt, Human
ugaagagaagcaaaaaaaaaaaa

SEQ ID NO: 1099015 - RNA, 31 nt, Human
ugaagagaagcaaaaaaaaaaaaaaaaaaaa

SEQ ID NO: 1099016 - RNA, 22 nt, Human
ugaagcgggaggagagcaauca

SEQ ID NO: 1099017 - RNA, 21 nt, Human
ugaaggaagagaggggcugga

SEQ ID NO: 1099018 - RNA, 22 nt, Human
ugaaggaagagaggggcuggag

SEQ ID NO: 1099019 - RNA, 20 nt, Human
ugagaaauguuaucucuugc

SEQ ID NO: 1099020 - RNA, 18 nt, Human
ugcuagaagcaucaugaa

SEQ ID NO: 1099021 - RNA, 18 nt, Human
uggaaucagcgcacaccc

SEQ ID NO: 1099022 - RNA, 18 nt, Human
uggaaucagcgcacaccc

SEQ ID NO: 1099023 - RNA, 19 nt, Human
uggaaucagcgcacacccc

SEQ ID NO: 1099024 - RNA, 21 nt, Human
uggagugccaacuggugugga

SEQ ID NO: 1099025 - RNA, 19 nt, Human
uggcaaaggcugagaagcg

SEQ ID NO: 1099026 - RNA, 22 nt, Human
ugguaagugggagcuguccuug

SEQ ID NO: 1099027 - RNA, 23 nt, Human
uggugguacugaggcucagaaau

SEQ ID NO: 1099028 - RNA, 27 nt, Human
ugguguggagguuugguuggggguacu

SEQ ID NO: 1099029 - RNA, 18 nt, Human
uguuguacagcuugagca

SEQ ID NO: 1099030 - RNA, 24 nt, Human
aaacaaaaaagguauauaaucacu

SEQ ID NO: 1099031 - RNA, 25 nt, Human
aaacaagaaaaagaaauaaaaagua

SEQ ID NO: 1099032 - RNA, 20 nt, Human
aaaccagcaauuuccauggg

SEQ ID NO: 1099033 - RNA, 24 nt, Human
aaagaaccauuuccacucuagaaa

SEQ ID NO: 1099034 - RNA, 19 nt, Human
aaagagccaauccaauuga

SEQ ID NO: 1099035 - RNA, 18 nt, Human
aacacauuccuaacaacu

SEQ ID NO: 1099036 - RNA, 19 nt, Human
aacacggugaaaccccguc

SEQ ID NO: 1099037 - RNA, 20 nt, Human
aacacggugaaaccccgucu

SEQ ID NO: 1099038 - RNA, 21 nt, Human
aacacggugaaaccccgucuc

SEQ ID NO: 1099039 - RNA, 22 nt, Human
aagaaaauacaaaacacaauca

SEQ ID NO: 1099040 - RNA, 20 nt, Human
aagaaaggcaggagucaaaa

SEQ ID NO: 1099041 - RNA, 22 nt, Human
aagcauaauucaaaacaaccac

SEQ ID NO: 1099042 - RNA, 24 nt, Human
aauaaaagaagguuuugcaacuag

SEQ ID NO: 1099043 - RNA, 20 nt, Human
acaaaaacuacaaauuucca

SEQ ID NO: 1099044 - RNA, 19 nt, Human
acaaaccaacagucaccau

SEQ ID NO: 1099045 - RNA, 23 nt, Human
acagagugagauuccaucucaaa

SEQ ID NO: 1099046 - RNA, 24 nt, Human
acagagugagauuccaucucaaaa

SEQ ID NO: 1099047 - RNA, 24 nt, Human
acccaggaggcggagguuguggug

SEQ ID NO: 1099048 - RNA, 24 nt, Human
accccgucucuacuaaaaacacaa

SEQ ID NO: 1099049 - RNA, 24 nt, Human
acuccagccugggcaacagaguga

SEQ ID NO: 1099050 - RNA, 24 nt, Human
acugcacuccagccugggcaacag

SEQ ID NO: 1099051 - RNA, 24 nt, Human
acugcacuccagccugggcaacag

SEQ ID NO: 1099052 - RNA, 19 nt, Human
agaaauaagagagagagcc

SEQ ID NO: 1099053 - RNA, 23 nt, Human
agaaucagaggcuguuugcagcu

SEQ ID NO: 1099054 - RNA, 22 nt, Human
agaccaaaauguaaacuaguca

SEQ ID NO: 1099055 - RNA, 20 nt, Human
agagaaagagagaagaaaau

SEQ ID NO: 1099056 - RNA, 18 nt, Human
agagagaagaaaauagug

SEQ ID NO: 1099057 - RNA, 20 nt, Human
agagccaauccaauugaaau

SEQ ID NO: 1099058 - RNA, 24 nt, Human
agccugggcaacagagugagauuc

SEQ ID NO: 1099059 - RNA, 23 nt, Human
aggcaaaaauaaaccacacaaag

SEQ ID NO: 1099060 - RNA, 24 nt, Human
aggcaggagaauggcaugaaccca

SEQ ID NO: 1099061 - RNA, 27 nt, Human
aggcaggagaauggcaugaacccagga

SEQ ID NO: 1099062 - RNA, 21 nt, Human
aggcaggagucaaaauucaac

SEQ ID NO: 1099063 - RNA, 26 nt, Human
aggcaggagucaaaauucaacaucca

SEQ ID NO: 1099064 - RNA, 24 nt, Human
aggcaggcauaucacgaggucagg

SEQ ID NO: 1099065 - RNA, 19 nt, Human
aggcauaucacgaggucag

SEQ ID NO: 1099066 - RNA, 21 nt, Human
aggccgaggcaggcauaucac

SEQ ID NO: 1099067 - RNA, 21 nt, Human
aggcggagguuguggugagcc

SEQ ID NO: 1099068 - RNA, 24 nt, Human
aggcggagguuguggugagccgag

SEQ ID NO: 1099069 - RNA, 19 nt, Human
aggcugaggcaggagaaug

SEQ ID NO: 1099070 - RNA, 18 nt, Human
aggcuggagugcaguggc

SEQ ID NO: 1099071 - RNA, 24 nt, Human
aggugugguggcgggcgccuguag

SEQ ID NO: 1099072 - RNA, 19 nt, Human
agucaccaucaggcaaaaa

SEQ ID NO: 1099073 - RNA, 24 nt, Human
agugguucacgccuguaaucccag

SEQ ID NO: 1099074 - RNA, 22 nt, Human
auaaagaccaaaauguaaacua

SEQ ID NO: 1099075 - RNA, 18 nt, Human
auagaggacaguuuaacu

SEQ ID NO: 1099076 - RNA, 23 nt, Human
aucaaugcuaauauaucauucua

SEQ ID NO: 1099077 - RNA, 21 nt, Human
aucucaaaaaaaaaaaaaaag

SEQ ID NO: 1099078 - RNA, 28 nt, Human
auuccaucucaaaaaaaaaaaaaaagaa

SEQ ID NO: 1099079 - RNA, 24 nt, Human
auugcgccacugcacuccagccug

SEQ ID NO: 1099080 - RNA, 23 nt, Human
caaaaaaaaaaaaaaagaaagaa

SEQ ID NO: 1099081 - RNA, 21 nt, Human
caaaaacuacaaauuuccaaa

SEQ ID NO: 1099082 - RNA, 24 nt, Human
caaauaaagaccaaaauguaaacu

SEQ ID NO: 1099083 - RNA, 24 nt, Human
caacacuaauuuguacacuaacug

SEQ ID NO: 1099084 - RNA, 23 nt, Human
caacagagugagauuccaucuca

SEQ ID NO: 1099085 - RNA, 24 nt, Human
cacaagcacucagugauacaaaac

SEQ ID NO: 1099086 - RNA, 23 nt, Human
cacgccuguaaucccagcacuuu

SEQ ID NO: 1099087 - RNA, 22 nt, Human
cacuccagccugggcaacagag

SEQ ID NO: 1099088 - RNA, 22 nt, Human
cacuccagccugggcaacagag

SEQ ID NO: 1099089 - RNA, 24 nt, Human
cacuccagccugggcaacagagug

SEQ ID NO: 1099090 - RNA, 18 nt, Human
cacugcacuccagccugg

SEQ ID NO: 1099091 - RNA, 19 nt, Human
cacugcacuccagccuggg

SEQ ID NO: 1099092 - RNA, 21 nt, Human
cacugcacuccagccugggca

SEQ ID NO: 1099093 - RNA, 23 nt, Human
cacugcacuccagccugggcaac

SEQ ID NO: 1099094 - RNA, 24 nt, Human
cacugcacuccagccugggcaaca

SEQ ID NO: 1099095 - RNA, 21 nt, Human
cagaggcauagcuugcuaugu

SEQ ID NO: 1099096 - RNA, 18 nt, Human
cagcacuuuaggaggccg

SEQ ID NO: 1099097 - RNA, 24 nt, Human
cagcacuuuaggaggccgaggcag

SEQ ID NO: 1099098 - RNA, 24 nt, Human
cagcuacuugggaggcugaggcag

SEQ ID NO: 1099099 - RNA, 24 nt, Human
cagugcaguuaaacaagaaaaaga

SEQ ID NO: 1099100 - RNA, 19 nt, Human
caguggaagaaauuaacac

SEQ ID NO: 1099101 - RNA, 24 nt, Human
caguuaagaucaauuacaaaccaa

SEQ ID NO: 1099102 - RNA, 23 nt, Human
cauaaugcaagaaaauacaaaac

SEQ ID NO: 1099103 - RNA, 20 nt, Human
cauacacacacaaaaacuac

SEQ ID NO: 1099104 - RNA, 23 nt, Human
cauacacacacaaaaacuacaaa

SEQ ID NO: 1099105 - RNA, 28 nt, Human
cauaugccaugcauacacacacaaaaac

SEQ ID NO: 1099106 - RNA, 25 nt, Human
cauccucguuaucagaugauaagaa

SEQ ID NO: 1099107 - RNA, 21 nt, Human
cauuuccacucuagaaagaag

SEQ ID NO: 1099108 - RNA, 21 nt, Human
ccacagauauuuagaacacac

SEQ ID NO: 1099109 - RNA, 20 nt, Human
ccacugcacuccagccuggg

SEQ ID NO: 1099110 - RNA, 21 nt, Human
ccacugcacuccagccugggc

SEQ ID NO: 1099111 - RNA, 23 nt, Human
ccacugcacuccagccugggcaa

SEQ ID NO: 1099112 - RNA, 24 nt, Human
ccacugcacuccagccugggcaac

SEQ ID NO: 1099113 - RNA, 24 nt, Human
ccagaccauccuggcuaacacggu

SEQ ID NO: 1099114 - RNA, 19 nt, Human
cccaggcuggagugcagug

SEQ ID NO: 1099115 - RNA, 23 nt, Human
ccuggcuaacacggugaaacccc

SEQ ID NO: 1099116 - RNA, 24 nt, Human
ccuggcuaacacggugaaaccccg

SEQ ID NO: 1099117 - RNA, 22 nt, Human
ccugggcaacagagugagauuc

SEQ ID NO: 1099118 - RNA, 21 nt, Human
ccuguagucccagcuacuugg

SEQ ID NO: 1099119 - RNA, 24 nt, Human
cgagauugcgccacugcacuccag

SEQ ID NO: 1099120 - RNA, 24 nt, Human
cgaggcaggcauaucacgagguca

SEQ ID NO: 1099121 - RNA, 24 nt, Human
cgccacugcacuccagccugggca

SEQ ID NO: 1099122 - RNA, 22 nt, Human
cgccuguaaucccagcacuuua

SEQ ID NO: 1099123 - RNA, 23 nt, Human
cgccuguagucccagcuacuugg

SEQ ID NO: 1099124 - RNA, 24 nt, Human
cgccuguagucccagcuacuuggg

SEQ ID NO: 1099125 - RNA, 24 nt, Human
cggcacagugguucacgccuguaa

SEQ ID NO: 1099126 - RNA, 18 nt, Human
cgggucagccagugcagu

SEQ ID NO: 1099127 - RNA, 22 nt, Human
cuaaaaacacaaaaacuuagcc

SEQ ID NO: 1099128 - RNA, 25 nt, Human
cucaaaaaaaaaaaaaaagaaagaa

SEQ ID NO: 1099129 - RNA, 18 nt, Human
cuggcuaacacggugaaa

SEQ ID NO: 1099130 - RNA, 18 nt, Human
cuugcuauguugcccagg

SEQ ID NO: 1099131 - RNA, 23 nt, Human
cuugcuauguugcccaggcugga

SEQ ID NO: 1099132 - RNA, 23 nt, Human
gaagagcuauuucagaaucagag

SEQ ID NO: 1099133 - RNA, 18 nt, Human
gagaaagagagaagaaaa

SEQ ID NO: 1099134 - RNA, 24 nt, Human
gagaaucaguggaagaaaauggaa

SEQ ID NO: 1099135 - RNA, 20 nt, Human
gaggaaaaagagagaaagag

SEQ ID NO: 1099136 - RNA, 21 nt, Human
gaggcggagguuguggugagc

SEQ ID NO: 1099137 - RNA, 20 nt, Human
gcacagugguucacgccugu

SEQ ID NO: 1099138 - RNA, 24 nt, Human
gcacuccagccugggcaacagagu

SEQ ID NO: 1099139 - RNA, 22 nt, Human
gcaggagaauggcaugaaccca

SEQ ID NO: 1099140 - RNA, 24 nt, Human
gcauagcuugcuauguugcccagg

SEQ ID NO: 1099141 - RNA, 22 nt, Human
gccacugcacuccagccugggc

SEQ ID NO: 1099142 - RNA, 24 nt, Human
gccacugcacuccagccugggcaa

SEQ ID NO: 1099143 - RNA, 19 nt, Human
gccaggugugguggcgggc

SEQ ID NO: 1099144 - RNA, 20 nt, Human
gcccaggcuggagugcagug

SEQ ID NO: 1099145 - RNA, 23 nt, Human
gccuguagucccagcuacuuggg

SEQ ID NO: 1099146 - RNA, 24 nt, Human
gcuaacacggugaaaccccgucuc

SEQ ID NO: 1099147 - RNA, 19 nt, Human
gcuauguugcccaggcugg

SEQ ID NO: 1099148 - RNA, 20 nt, Human
gcuauguugcccaggcugga

SEQ ID NO: 1099149 - RNA, 22 nt, Human
gcuggagugcaguggcuauuca

SEQ ID NO: 1099150 - RNA, 23 nt, Human
gcuugcuauguugcccaggcugg

SEQ ID NO: 1099151 - RNA, 24 nt, Human
gcuugcuauguugcccaggcugga

SEQ ID NO: 1099152 - RNA, 22 nt, Human
ggaaaccagcaauuuccauggc

SEQ ID NO: 1099153 - RNA, 23 nt, Human
ggacaguuuaacucaugaaaaua

SEQ ID NO: 1099154 - RNA, 21 nt, Human
ggaggaaaaagagagaaagag

SEQ ID NO: 1099155 - RNA, 22 nt, Human
ggagguuguggugagccgagau

SEQ ID NO: 1099156 - RNA, 24 nt, Human
ggagguuguggugagccgagauug

SEQ ID NO: 1099157 - RNA, 21 nt, Human
ggcaaaaauaaaccacacaaa

SEQ ID NO: 1099158 - RNA, 24 nt, Human
gguggcgggcgccuguagucccag

SEQ ID NO: 1099159 - RNA, 22 nt, Human
uaaaaacacaaaaacuuagcca

SEQ ID NO: 1099160 - RNA, 21 nt, Human
uaaaagaagguuuugcaacua

SEQ ID NO: 1099161 - RNA, 21 nt, Human
uaaauagauauccccuuaaga

SEQ ID NO: 1099162 - RNA, 25 nt, Human
uaacaaaauaugaacaaagagccaa

SEQ ID NO: 1099163 - RNA, 22 nt, Human
uaacacggugaaaccccgucuc

SEQ ID NO: 1099164 - RNA, 24 nt, Human
uaacacggugaaaccccgucucua

SEQ ID NO: 1099165 - RNA, 22 nt, Human
uaagaaaggcaggagucaaaau

SEQ ID NO: 1099166 - RNA, 19 nt, Human
uaagaucaauuacaaacca

SEQ ID NO: 1099167 - RNA, 23 nt, Human
uacaaaacaaaaaagguauauaa

SEQ ID NO: 1099168 - RNA, 27 nt, Human
uacaaaacaaaaaagguauauaaucac

SEQ ID NO: 1099169 - RNA, 18 nt, Human
uacuguguaaaguagaau

SEQ ID NO: 1099170 - RNA, 19 nt, Human
uagaaaacucaagagaauc

SEQ ID NO: 1099171 - RNA, 22 nt, Human
uagaacacaccaguaacaaaaa

SEQ ID NO: 1099172 - RNA, 22 nt, Human
uagagaagaacuuacagcugca

SEQ ID NO: 1099173 - RNA, 23 nt, Human
uagcauuauuucaaaaggguaac

SEQ ID NO: 1099174 - RNA, 24 nt, Human
uaggaggccgaggcaggcauauca

SEQ ID NO: 1099175 - RNA, 24 nt, Human
uaggucacaaaaucuaccuaaaau

SEQ ID NO: 1099176 - RNA, 18 nt, Human
uauguugcccaggcugga

SEQ ID NO: 1099177 - RNA, 22 nt, Human
uauguugcccaggcuggagugc

SEQ ID NO: 1099178 - RNA, 23 nt, Human
uauguugcccaggcuggagugca

SEQ ID NO: 1099179 - RNA, 19 nt, Human
ucaaaaaaaaaaaaaaaga

SEQ ID NO: 1099180 - RNA, 24 nt, Human
ucacaaaaucuaccuaaaaugcaa

SEQ ID NO: 1099181 - RNA, 18 nt, Human
ucacgaggucaggagauc

SEQ ID NO: 1099182 - RNA, 24 nt, Human
ucacgaggucaggagauccagacc

SEQ ID NO: 1099183 - RNA, 23 nt, Human
ucacgccuguaaucccagcacuu

SEQ ID NO: 1099184 - RNA, 19 nt, Human
ucagcaauaauuagugaga

SEQ ID NO: 1099185 - RNA, 20 nt, Human
ucaggcaaaaauaaaccaca

SEQ ID NO: 1099186 - RNA, 23 nt, Human
ucagugauacaaaacaaaaaagg

SEQ ID NO: 1099187 - RNA, 23 nt, Human
uccagccugggcaacagagugag

SEQ ID NO: 1099188 - RNA, 24 nt, Human
uccagccugggcaacagagugaga

SEQ ID NO: 1099189 - RNA, 23 nt, Human
uccaucucaaaaaaaaaaaaaaa

SEQ ID NO: 1099190 - RNA, 19 nt, Human
uccauggccaacagcaggg

SEQ ID NO: 1099191 - RNA, 22 nt, Human
uccccuuaagaaaggcaggagu

SEQ ID NO: 1099192 - RNA, 24 nt, Human
ucucaaaaaaaaaaaaaaagaaag

SEQ ID NO: 1099193 - RNA, 21 nt, Human
ucucuacuaaaaacacaaaaa

SEQ ID NO: 1099194 - RNA, 22 nt, Human
ugaacccaggaggcggagguug

SEQ ID NO: 1099195 - RNA, 22 nt, Human
ugagccgagauugcgccacugc

SEQ ID NO: 1099196 - RNA, 23 nt, Human
ugaggcaggagaauggcaugaac

SEQ ID NO: 1099197 - RNA, 24 nt, Human
ugaggcaggagaauggcaugaacc

SEQ ID NO: 1099198 - RNA, 25 nt, Human
ugaggcaggagaauggcaugaaccc

SEQ ID NO: 1099199 - RNA, 28 nt, Human
ugauauauuaauuauacauugugaagau

SEQ ID NO: 1099200 - RNA, 21 nt, Human
ugcaauagugaaaaagacuac

SEQ ID NO: 1099201 - RNA, 27 nt, Human
ugcagcaauaaaagaagguuuugcaac

SEQ ID NO: 1099202 - RNA, 22 nt, Human
ugcaguuaaacaagaaaaagaa

SEQ ID NO: 1099203 - RNA, 23 nt, Human
ugccaugcauacacacacaaaaa

SEQ ID NO: 1099204 - RNA, 18 nt, Human
ugcccaggcuggagugca

SEQ ID NO: 1099205 - RNA, 22 nt, Human
ugcccaggcuggagugcagugg

SEQ ID NO: 1099206 - RNA, 24 nt, Human
ugcuauguugcccaggcuggagug

SEQ ID NO: 1099207 - RNA, 25 nt, Human
ugcuauguugcccaggcuggagugc

SEQ ID NO: 1099208 - RNA, 21 nt, Human
uggaaacuaguaagaaucuuc

SEQ ID NO: 1099209 - RNA, 22 nt, Human
uggaagaaaauggaaacuagua

SEQ ID NO: 1099210 - RNA, 23 nt, Human
uggagugcaguggcuauucacag

SEQ ID NO: 1099211 - RNA, 18 nt, Human
ugggaggcugaggcagga

SEQ ID NO: 1099212 - RNA, 24 nt, Human
ugggaggcugaggcaggagaaugg

SEQ ID NO: 1099213 - RNA, 31 nt, Human
ugggcaaaagcauaauucaaaacaaccaccc

SEQ ID NO: 1099214 - RNA, 24 nt, Human
ugguggcgggcgccuguaguccca

SEQ ID NO: 1099215 - RNA, 24 nt, Human
ugguucacgccuguaaucccagca

SEQ ID NO: 1099216 - RNA, 18 nt, Human
uguauuuauuauuugaaa

SEQ ID NO: 1099217 - RNA, 23 nt, Human
ugugguggcgggcgccuguaguc

SEQ ID NO: 1099218 - RNA, 25 nt, Human
uguuguguauuuauuauuugaaaga

SEQ ID NO: 1099219 - RNA, 19 nt, Human
uuaauuguuuugaccuagg

SEQ ID NO: 1099220 - RNA, 21 nt, Human
uuacaaaccaacagucaccau

SEQ ID NO: 1099221 - RNA, 19 nt, Human
uucagucagaaauaagaga

SEQ ID NO: 1099222 - RNA, 23 nt, Human
uugcgccacugcacuccagccug

SEQ ID NO: 1099223 - RNA, 24 nt, Human
uugcuauguugcccaggcuggagu

SEQ ID NO: 1099224 - RNA, 28 nt, Human
uuguacauaugccaugcauacacacagu

SEQ ID NO: 1099225 - RNA, 18 nt, Human
uuguggugagccgagauu

SEQ ID NO: 1099226 - RNA, 22 nt, Human
uuguggugagccgagauugcgc

SEQ ID NO: 1099227 - RNA, 21 nt, Human
uuuaaucaagagaacaaaaau

SEQ ID NO: 1099228 - RNA, 23 nt, Human
uuuuaggugugaaaaaaauuuug

SEQ ID NO: 1099229 - RNA, 20 nt, Human
gaccgagacccccgccucgg

SEQ ID NO: 1099230 - RNA, 20 nt, Human
gagaacacggcgcggggcgg

SEQ ID NO: 1099231 - RNA, 18 nt, Human
gccucgguuucggugccu

SEQ ID NO: 1099232 - RNA, 23 nt, Human
gcgcggagggaccgagacccccg

SEQ ID NO: 1099233 - RNA, 19 nt, Human
ggagaacacggcgcggggc

SEQ ID NO: 1099234 - RNA, 22 nt, Human
ggcgcggggcggugaguccugc

SEQ ID NO: 1099235 - RNA, 29 nt, Human
uccgccuuccuccuugcgcggagggaccg

SEQ ID NO: 1099236 - RNA, 27 nt, Human
agaaaaagagaaaaauugacucaagaa

SEQ ID NO: 1099237 - RNA, 21 nt, Human
aguguuggaguuaucuaaacu

SEQ ID NO: 1099238 - RNA, 22 nt, Human
gaaaaagagaaaaauugacuca

SEQ ID NO: 1099239 - RNA, 21 nt, Human
gacugcgugcaacgccaaggc

SEQ ID NO: 1099240 - RNA, 21 nt, Human
ucuauaaagaaaaagagaaaa

SEQ ID NO: 1099241 - RNA, 20 nt, Human
ugacucaagaacaaaaacag

SEQ ID NO: 1099242 - RNA, 23 nt, Human
ugcacaaauuauucuugaacaua

SEQ ID NO: 1099243 - RNA, 21 nt, Human
uuuuuuuuuuuuuuuugccaa

SEQ ID NO: 1099244 - RNA, 25 nt, Human
aacaaugagagucgacguaaagaaa

SEQ ID NO: 1099245 - RNA, 18 nt, Human
aggagggagaugcauaug

SEQ ID NO: 1099246 - RNA, 19 nt, Human
cacguacauuacagugugc

SEQ ID NO: 1099247 - RNA, 24 nt, Human
cagcuucugggcuccccaaguccu

SEQ ID NO: 1099248 - RNA, 22 nt, Human
caggagggagaugcauauggua

SEQ ID NO: 1099249 - RNA, 19 nt, Human
ccccacgguccugagcgag

SEQ ID NO: 1099250 - RNA, 21 nt, Human
ccugagcgagguccccagucc

SEQ ID NO: 1099251 - RNA, 23 nt, Human
cuucugggcuccccaaguccuuc

SEQ ID NO: 1099252 - RNA, 22 nt, Human
cuuuccgccuucuguuucugac

SEQ ID NO: 1099253 - RNA, 20 nt, Human
gagaagcagaugucuugggg

SEQ ID NO: 1099254 - RNA, 19 nt, Human
gaggaggaugugguugucu

SEQ ID NO: 1099255 - RNA, 22 nt, Human
gcagcaagggaaugaugacaug

SEQ ID NO: 1099256 - RNA, 18 nt, Human
gcuucugggcuccccaag

SEQ ID NO: 1099257 - RNA, 19 nt, Human
gguucgguggcagcuucug

SEQ ID NO: 1099258 - RNA, 24 nt, Human
guccugagcgagguccccaguccc

SEQ ID NO: 1099259 - RNA, 27 nt, Human
uaaaacaaugagagucgaccgguaccc

SEQ ID NO: 1099260 - RNA, 21 nt, Human
uacauuacagugugcagcaag

SEQ ID NO: 1099261 - RNA, 19 nt, Human
uaggaggaggaggaugugg

SEQ ID NO: 1099262 - RNA, 22 nt, Human
uauucaaguaaaacaaugagag

SEQ ID NO: 1099263 - RNA, 18 nt, Human
ucgguggcagcuucuggg

SEQ ID NO: 1099264 - RNA, 18 nt, Human
ugacaagugaugcggguu

SEQ ID NO: 1099265 - RNA, 21 nt, Human
ugggcuccccaaguccuucag

SEQ ID NO: 1099266 - RNA, 18 nt, Human
ugguucgguggcagcuuc

SEQ ID NO: 1099267 - RNA, 22 nt, Human
uguaggaggaggaggauguggu

SEQ ID NO: 1099268 - RNA, 19 nt, Human
ugucuugggggagccucca

SEQ ID NO: 1099269 - RNA, 21 nt, Human
uucaaguaaaacaaugagagu

SEQ ID NO: 1099270 - RNA, 21 nt, Human
aggcagggagaaagcagagga

SEQ ID NO: 1099271 - RNA, 23 nt, Human
aucaaggcagggagaaagcagag

SEQ ID NO: 1099272 - RNA, 24 nt, Human
aucaaggcagggagaaagcagagg

SEQ ID NO: 1099273 - RNA, 21 nt, Human
caaggcagggagaaagcagag

SEQ ID NO: 1099274 - RNA, 24 nt, Human
caagggcugggggaggaugaggag

SEQ ID NO: 1099275 - RNA, 22 nt, Human
caaugaugaggaccaaccuauu

SEQ ID NO: 1099276 - RNA, 19 nt, Human
ccaaccuauucaagggcug

SEQ ID NO: 1099277 - RNA, 18 nt, Human
cuuggugccaggaguuca

SEQ ID NO: 1099278 - RNA, 19 nt, Human
ggaggaugaggagaugggg

SEQ ID NO: 1099279 - RNA, 20 nt, Human
gggcugggggaggaugagga

SEQ ID NO: 1099280 - RNA, 22 nt, Human
ggugccaggaguucagaaaaga

SEQ ID NO: 1099281 - RNA, 19 nt, Human
uauuccacaucacucaagc

SEQ ID NO: 1099282 - RNA, 22 nt, Human
ucagaugaauggacagaacuug

SEQ ID NO: 1099283 - RNA, 21 nt, Human
ugcaaaauccucccuuucuca

SEQ ID NO: 1099284 - RNA, 23 nt, Human
ugggggaggaugaggagaugggg

SEQ ID NO: 1099285 - RNA, 23 nt, Human
ugggggaggaugaggagaugggg

SEQ ID NO: 1099286 - RNA, 23 nt, Human
aagaggcagguuugucagaggga

SEQ ID NO: 1099287 - RNA, 22 nt, Human
agagggaugagggaacccugag

SEQ ID NO: 1099288 - RNA, 20 nt, Human
aggcagguuugucagaggga

SEQ ID NO: 1099289 - RNA, 22 nt, Human
gaggugaaggugaggcugugug

SEQ ID NO: 1099290 - RNA, 19 nt, Human
gcgugggggcggggagccc

SEQ ID NO: 1099291 - RNA, 20 nt, Human
gggccagagcggaucugaaa

SEQ ID NO: 1099292 - RNA, 25 nt, Human
uaggcgaugccucugcccccugaag

SEQ ID NO: 1099293 - RNA, 20 nt, Human
ucccaaggcugugcccugcu

SEQ ID NO: 1099294 - RNA, 18 nt, Human
ucucuaggcgaugccucu

SEQ ID NO: 1099295 - RNA, 19 nt, Human
ugaaauacccaagagguga

SEQ ID NO: 1099296 - RNA, 22 nt, Human
ugaaauacccaagaggugaagg

SEQ ID NO: 1099297 - RNA, 21 nt, Human
ugagcggacagagucaggugu

SEQ ID NO: 1099298 - RNA, 21 nt, Human
uggugcugcgugggggcgggg

SEQ ID NO: 1099299 - RNA, 26 nt, Human
uuuuuuggcacuuugaucagagguuu

SEQ ID NO: 1099300 - RNA, 26 nt, Human
aaaaaagaaaaaaaguuuuaacccag

SEQ ID NO: 1099301 - RNA, 24 nt, Human
aacccaacauuccccagucugaca

SEQ ID NO: 1099302 - RNA, 21 nt, Human
aaccuucuccccucacugauc

SEQ ID NO: 1099303 - RNA, 23 nt, Human
aaguuuuaacccagggggugauc

SEQ ID NO: 1099304 - RNA, 22 nt, Human
agaaggccuggccucacaaaga

SEQ ID NO: 1099305 - RNA, 23 nt, Human
aggaagagugaggggcaccuggc

SEQ ID NO: 1099306 - RNA, 20 nt, Human
caggaagagugaggggcacc

SEQ ID NO: 1099307 - RNA, 23 nt, Human
cagucagaaggccuggccucaca

SEQ ID NO: 1099308 - RNA, 18 nt, Human
cagucugacagaucagau

SEQ ID NO: 1099309 - RNA, 22 nt, Human
caucaugaaaaagaagcuaucc

SEQ ID NO: 1099310 - RNA, 22 nt, Human
ccacacucuguccaaaaaaaaa

SEQ ID NO: 1099311 - RNA, 33 nt, Human
ccacacucuguccaaaaaaaaaaaagaaaaaaa

SEQ ID NO: 1099312 - RNA, 20 nt, Human
cccagaacccaacauucccc

SEQ ID NO: 1099313 - RNA, 18 nt, Human
ccccagaacccaacauuc

SEQ ID NO: 1099314 - RNA, 20 nt, Human
cccuggaagccggagagcuc

SEQ ID NO: 1099315 - RNA, 20 nt, Human
cucccuuuccacacucuguc

SEQ ID NO: 1099316 - RNA, 18 nt, Human
cucuguccaaaaaaaaaa

SEQ ID NO: 1099317 - RNA, 20 nt, Human
cucuguccaaaaaaaaaaaa

SEQ ID NO: 1099318 - RNA, 18 nt, Human
cugcccacgaccagaccc

SEQ ID NO: 1099319 - RNA, 22 nt, Human
cuguccaaaaaaaaaaaagaaa

SEQ ID NO: 1099320 - RNA, 18 nt, Human
cuuuggggucaggaagag

SEQ ID NO: 1099321 - RNA, 22 nt, Human
gaccccagaacccaacauuccc

SEQ ID NO: 1099322 - RNA, 19 nt, Human
gcccugugccgguggugcu

SEQ ID NO: 1099323 - RNA, 22 nt, Human
gcguggcugcaggggccucagg

SEQ ID NO: 1099324 - RNA, 23 nt, Human
ggaucgggaggugcguggcugca

SEQ ID NO: 1099325 - RNA, 23 nt, Human
ggcggggaggucucccuggaagc

SEQ ID NO: 1099326 - RNA, 19 nt, Human
ggcuuuggggucaggaaga

SEQ ID NO: 1099327 - RNA, 20 nt, Human
gggaggucucccuggaagcc

SEQ ID NO: 1099328 - RNA, 21 nt, Human
uauccuuuggggggcucccuu

SEQ ID NO: 1099329 - RNA, 23 nt, Human
uccaaaaaaaaaaaagaaaaaaa

SEQ ID NO: 1099330 - RNA, 18 nt, Human
uccacacucuguccaaaa

SEQ ID NO: 1099331 - RNA, 21 nt, Human
ucccccggaccccuugaucgu

SEQ ID NO: 1099332 - RNA, 26 nt, Human
ucccuggaagccggagagcucaaccu

SEQ ID NO: 1099333 - RNA, 24 nt, Human
uccuugggccacccgcaucucugc

SEQ ID NO: 1099334 - RNA, 18 nt, Human
ucucugggggcugcuggg

SEQ ID NO: 1099335 - RNA, 24 nt, Human
ucuguccaaaaaaaaaaaagaaaa

SEQ ID NO: 1099336 - RNA, 23 nt, Human
ugaucgugguccuugggccaccc

SEQ ID NO: 1099337 - RNA, 21 nt, Human
ugcccacgaccagaccccaga

SEQ ID NO: 1099338 - RNA, 24 nt, Human
ugcccacgaccagaccccagaacc

SEQ ID NO: 1099339 - RNA, 20 nt, Human
ugcccugugccgguggugcu

SEQ ID NO: 1099340 - RNA, 21 nt, Human
ugcccugugccgguggugcug

SEQ ID NO: 1099341 - RNA, 23 nt, Human
ugcugggcggggaggucucccug

SEQ ID NO: 1099342 - RNA, 18 nt, Human
uggcagggacggaccauc

SEQ ID NO: 1099343 - RNA, 18 nt, Human
uggccucacaaagaagcu

SEQ ID NO: 1099344 - RNA, 21 nt, Human
uggcugcaggggccucaggcc

SEQ ID NO: 1099345 - RNA, 21 nt, Human
uggggggcucccuuuccacac

SEQ ID NO: 1099346 - RNA, 22 nt, Human
caggcccucuuuguuacccucc

SEQ ID NO: 1099347 - RNA, 23 nt, Human
aaacauacacccacgcauaccca

SEQ ID NO: 1099348 - RNA, 27 nt, Human
aaaccccacagugcauuuccaguaggc

SEQ ID NO: 1099349 - RNA, 19 nt, Human
aaacugaauuaugacagua

SEQ ID NO: 1099350 - RNA, 24 nt, Human
aaagacaugcauucuguggagaag

SEQ ID NO: 1099351 - RNA, 21 nt, Human
aaagagaucgcugaugccuuc

SEQ ID NO: 1099352 - RNA, 25 nt, Human
aaagcucccucucccucccccaccc

SEQ ID NO: 1099353 - RNA, 25 nt, Human
aaagugcuggugucaccugucuuga

SEQ ID NO: 1099354 - RNA, 21 nt, Human
aaaucagcuuugugcagcugg

SEQ ID NO: 1099355 - RNA, 19 nt, Human
aacacauuggggacagggg

SEQ ID NO: 1099356 - RNA, 20 nt, Human
aaccccacagugcauuucca

SEQ ID NO: 1099357 - RNA, 21 nt, Human
aagaaaguaggaagggacaac

SEQ ID NO: 1099358 - RNA, 23 nt, Human
aagaaauucauuucauacuuuug

SEQ ID NO: 1099359 - RNA, 24 nt, Human
aagcccaguaacuggaaaaaaucu

SEQ ID NO: 1099360 - RNA, 20 nt, Human
aaguaggcauuugcuacaaa

SEQ ID NO: 1099361 - RNA, 26 nt, Human
aauuucaacaaaacacacaacaaucu

SEQ ID NO: 1099362 - RNA, 18 nt, Human
acaaagcuggaagcagag

SEQ ID NO: 1099363 - RNA, 20 nt, Human
acaaagcuggaagcagaggc

SEQ ID NO: 1099364 - RNA, 20 nt, Human
acaaaucaacuagaaacuca

SEQ ID NO: 1099365 - RNA, 20 nt, Human
acauuuuguaccaaguccag

SEQ ID NO: 1099366 - RNA, 24 nt, Human
accacuuugcauauuguggaaauc

SEQ ID NO: 1099367 - RNA, 19 nt, Human
acccacgcauacccacaca

SEQ ID NO: 1099368 - RNA, 18 nt, Human
acuaacccacuuugugug

SEQ ID NO: 1099369 - RNA, 21 nt, Human
acuacacuugaagucuuccac

SEQ ID NO: 1099370 - RNA, 18 nt, Human
acugggacacacaguuca

SEQ ID NO: 1099371 - RNA, 21 nt, Human
agaaacucacaaacacauugg

SEQ ID NO: 1099372 - RNA, 21 nt, Human
agacuuuggagaaaaucagcu

SEQ ID NO: 1099373 - RNA, 20 nt, Human
agcgggagacacccuggaau

SEQ ID NO: 1099374 - RNA, 19 nt, Human
aggaaggaggaaggaaaag

SEQ ID NO: 1099375 - RNA, 21 nt, Human
aggaggagcagcaggggaggc

SEQ ID NO: 1099376 - RNA, 20 nt, Human
aggcucaggaggagcagcag

SEQ ID NO: 1099377 - RNA, 24 nt, Human
aggcucaggaggagcagcagggga

SEQ ID NO: 1099378 - RNA, 18 nt, Human
agggagccugcaacugug

SEQ ID NO: 1099379 - RNA, 20 nt, Human
aucuucuugaccuccuacug

SEQ ID NO: 1099380 - RNA, 21 nt, Human
auuccuaagaagagcugaaga

SEQ ID NO: 1099381 - RNA, 25 nt, Human
caaaaaucgcuucaaaguaaacaau

SEQ ID NO: 1099382 - RNA, 19 nt, Human
caaagcucccucucccucc

SEQ ID NO: 1099383 - RNA, 21 nt, Human
cacaaagcucccucucccucc

SEQ ID NO: 1099384 - RNA, 19 nt, Human
cacacagguuuagaugcuc

SEQ ID NO: 1099385 - RNA, 21 nt, Human
cacagcaagccaauccgggga

SEQ ID NO: 1099386 - RNA, 22 nt, Human
cagcaagccaauccggggagga

SEQ ID NO: 1099387 - RNA, 20 nt, Human
cagcaggggaggcaguaagu

SEQ ID NO: 1099388 - RNA, 19 nt, Human
caggaaaaaccccacagug

SEQ ID NO: 1099389 - RNA, 20 nt, Human
caggaaaaaccccacagugc

SEQ ID NO: 1099390 - RNA, 21 nt, Human
caggaaaauccacaacagcuu

SEQ ID NO: 1099391 - RNA, 22 nt, Human
caggaggagcagcaggggaggc

SEQ ID NO: 1099392 - RNA, 19 nt, Human
cagggauggagguugaaga

SEQ ID NO: 1099393 - RNA, 21 nt, Human
cagguucuucauccagaagcc

SEQ ID NO: 1099394 - RNA, 24 nt, Human
caguaggcacuuuacacaaagcuc

SEQ ID NO: 1099395 - RNA, 24 nt, Human
cauuucauacuuuugcaugacuuc

SEQ ID NO: 1099396 - RNA, 20 nt, Human
ccaaugcuuccucuaggacc

SEQ ID NO: 1099397 - RNA, 21 nt, Human
ccacaaagaacuaaguaggca

SEQ ID NO: 1099398 - RNA, 23 nt, Human
ccacacugacauuuuguaccaag

SEQ ID NO: 1099399 - RNA, 19 nt, Human
ccacugccaccugcccgag

SEQ ID NO: 1099400 - RNA, 22 nt, Human
cccaaugcuuccucuaggacca

SEQ ID NO: 1099401 - RNA, 21 nt, Human
cccacacaaagaauuuaaagu

SEQ ID NO: 1099402 - RNA, 18 nt, Human
cccagcaggccagguggc

SEQ ID NO: 1099403 - RNA, 19 nt, Human
ccccacagugcauuuccag

SEQ ID NO: 1099404 - RNA, 20 nt, Human
cccccucauucccacagucc

SEQ ID NO: 1099405 - RNA, 23 nt, Human
ccccuaagggauauuuucaauuc

SEQ ID NO: 1099406 - RNA, 23 nt, Human
ccgaggcucaggaggagcagcag

SEQ ID NO: 1099407 - RNA, 19 nt, Human
ccuccaacuugggacacca

SEQ ID NO: 1099408 - RNA, 24 nt, Human
ccuccuccccgaggcucaggagga

SEQ ID NO: 1099409 - RNA, 22 nt, Human
ccucuaggaccacacugacauu

SEQ ID NO: 1099410 - RNA, 21 nt, Human
ccugaagaguaaagcgggaga

SEQ ID NO: 1099411 - RNA, 23 nt, Human
cuaaaaaaauaaaaaguucaaaa

SEQ ID NO: 1099412 - RNA, 24 nt, Human
cuaagaagagcugaagaaauucau

SEQ ID NO: 1099413 - RNA, 19 nt, Human
cuaccuggaguaaacuggc

SEQ ID NO: 1099414 - RNA, 25 nt, Human
cucccucccccaccccaaugcuucc

SEQ ID NO: 1099415 - RNA, 20 nt, Human
cucucccucccccaccccaa

SEQ ID NO: 1099416 - RNA, 19 nt, Human
cucuugugguuuuuugcuu

SEQ ID NO: 1099417 - RNA, 20 nt, Human
cucuugugguuuuuugcuug

SEQ ID NO: 1099418 - RNA, 20 nt, Human
cugacacaaaaccuccaacu

SEQ ID NO: 1099419 - RNA, 20 nt, Human
cuguggagaucuucuugacc

SEQ ID NO: 1099420 - RNA, 22 nt, Human
cuuuacacaaagcucccucucc

SEQ ID NO: 1099421 - RNA, 20 nt, Human
gaggagcagcaggggaggca

SEQ ID NO: 1099422 - RNA, 19 nt, Human
gagugguucauggagacag

SEQ ID NO: 1099423 - RNA, 20 nt, Human
gagugguucauggagacagg

SEQ ID NO: 1099424 - RNA, 20 nt, Human
gccacaggaaugcuuaaaug

SEQ ID NO: 1099425 - RNA, 24 nt, Human
gccuuccuccuccccgaggcucag

SEQ ID NO: 1099426 - RNA, 23 nt, Human
gcugaggcucuugugguuuuuug

SEQ ID NO: 1099427 - RNA, 20 nt, Human
gcuggaagcagaggcagcua

SEQ ID NO: 1099428 - RNA, 22 nt, Human
ggaaaauccacaacagcuuaga

SEQ ID NO: 1099429 - RNA, 21 nt, Human
ggaaauaggggaaagcuuggc

SEQ ID NO: 1099430 - RNA, 21 nt, Human
ggaaugggagugguucaugga

SEQ ID NO: 1099431 - RNA, 18 nt, Human
ggacaggggaaugggagu

SEQ ID NO: 1099432 - RNA, 18 nt, Human
ggagaaggcauggcuuga

SEQ ID NO: 1099433 - RNA, 24 nt, Human
ggagcuuuuccaaaucauaggcau

SEQ ID NO: 1099434 - RNA, 20 nt, Human
ggaggaagaaaguaggaagg

SEQ ID NO: 1099435 - RNA, 18 nt, Human
gggauggagguugaagaa

SEQ ID NO: 1099436 - RNA, 21 nt, Human
gggauggagguugaagaagaa

SEQ ID NO: 1099437 - RNA, 22 nt, Human
gugagagacaacugauuguaca

SEQ ID NO: 1099438 - RNA, 19 nt, Human
gugcagcuggcaaagagaa

SEQ ID NO: 1099439 - RNA, 20 nt, Human
gugcuggugucaccugucuu

SEQ ID NO: 1099440 - RNA, 24 nt, Human
uaaagcgggagacacccuggaauu

SEQ ID NO: 1099441 - RNA, 23 nt, Human
uaacuggaaaaaaucuuaggcau

SEQ ID NO: 1099442 - RNA, 19 nt, Human
uaaggagaguucacaugaa

SEQ ID NO: 1099443 - RNA, 18 nt, Human
uacaaagcuggaagcaga

SEQ ID NO: 1099444 - RNA, 18 nt, Human
uacaaagcuggaagcaga

SEQ ID NO: 1099445 - RNA, 19 nt, Human
uacaaagcuggaagcagag

SEQ ID NO: 1099446 - RNA, 23 nt, Human
uacaaagcuggaagcagaggcag

SEQ ID NO: 1099447 - RNA, 22 nt, Human
uacacccacgcauacccacaca

SEQ ID NO: 1099448 - RNA, 21 nt, Human
uagcaaagcagggcuuuccca

SEQ ID NO: 1099449 - RNA, 22 nt, Human
uaggcacuuuacacaaagcucc

SEQ ID NO: 1099450 - RNA, 22 nt, Human
uccacaacagcuuagaguggca

SEQ ID NO: 1099451 - RNA, 18 nt, Human
uccagaagccuguggaga

SEQ ID NO: 1099452 - RNA, 19 nt, Human
uccccgaggcucaggagga

SEQ ID NO: 1099453 - RNA, 22 nt, Human
ucgcugaugccuuccuccuccc

SEQ ID NO: 1099454 - RNA, 19 nt, Human
ucuucccaaacauacaccc

SEQ ID NO: 1099455 - RNA, 22 nt, Human
ucuuuagacuuuggagaaaauc

SEQ ID NO: 1099456 - RNA, 25 nt, Human
ugaagcauaaucaacuacacuugaa

SEQ ID NO: 1099457 - RNA, 21 nt, Human
ugaagucuuccaccaguggga

SEQ ID NO: 1099458 - RNA, 26 nt, Human
ugaagucuuccaccagugggagcuuu

SEQ ID NO: 1099459 - RNA, 24 nt, Human
ugacacaaaaccuccaacuuggga

SEQ ID NO: 1099460 - RNA, 19 nt, Human
ugacauuuuguaccaaguc

SEQ ID NO: 1099461 - RNA, 21 nt, Human
ugaccuccuacugggacacac

SEQ ID NO: 1099462 - RNA, 19 nt, Human
ugagagacaacugauugua

SEQ ID NO: 1099463 - RNA, 24 nt, Human
ugagcucagucuuuagacuuugga

SEQ ID NO: 1099464 - RNA, 18 nt, Human
ugaggggaggaagccagg

SEQ ID NO: 1099465 - RNA, 20 nt, Human
ugaggggaggaagccaggga

SEQ ID NO: 1099466 - RNA, 23 nt, Human
ugaggggaggaagccagggaugg

SEQ ID NO: 1099467 - RNA, 19 nt, Human
ugagugccuacuaugugcc

SEQ ID NO: 1099468 - RNA, 23 nt, Human
ugcaacaaguauauuugaaaaca

SEQ ID NO: 1099469 - RNA, 18 nt, Human
ugcuugugugugugugug

SEQ ID NO: 1099470 - RNA, 21 nt, Human
uggagaaggcauggcuugaaa

SEQ ID NO: 1099471 - RNA, 23 nt, Human
uggccagaccccauucugcagcc

SEQ ID NO: 1099472 - RNA, 24 nt, Human
ugggacaaagcuccuugcagaagc

SEQ ID NO: 1099473 - RNA, 19 nt, Human
ugggacaccauuccugaag

SEQ ID NO: 1099474 - RNA, 23 nt, Human
ugguuuuuugcuugugugugugu

SEQ ID NO: 1099475 - RNA, 21 nt, Human
ugugugugaggggaggaagcc

SEQ ID NO: 1099476 - RNA, 23 nt, Human
uguguguguguguguuuuuuuuu

SEQ ID NO: 1099477 - RNA, 18 nt, Human
uucaugauacucuccugg

SEQ ID NO: 1099478 - RNA, 24 nt, Human
uucccagugggagaugaccacugc

SEQ ID NO: 1099479 - RNA, 18 nt, Human
uucugcagcccaucccuc

SEQ ID NO: 1099480 - RNA, 19 nt, Human
uucuuuaucugacccccuc

SEQ ID NO: 1099481 - RNA, 22 nt, Human
uuggagaaaaucagcuuugugc

SEQ ID NO: 1099482 - RNA, 19 nt, Human
uuggagccuguagcaaagc

SEQ ID NO: 1099483 - RNA, 25 nt, Human
uuggagccuguagcaaagcagggcu

SEQ ID NO: 1099484 - RNA, 20 nt, Human
uuugggaaauaggggaaagc

SEQ ID NO: 1099485 - RNA, 19 nt, Human
uuuguuuugagguuuguuc

SEQ ID NO: 1099486 - RNA, 22 nt, Human
uuuuugcuugugugugugugug

SEQ ID NO: 1099487 - RNA, 19 nt, Human
uuuuuuuuccccuaaggga

SEQ ID NO: 1099488 - RNA, 21 nt, Human
aucccugucccucccaacccc

SEQ ID NO: 1099489 - RNA, 20 nt, Human
auuuaucccugucccuccca

SEQ ID NO: 1099490 - RNA, 19 nt, Human
cccucccaacccccgggcu

SEQ ID NO: 1099491 - RNA, 20 nt, Human
ccucagagcuccagccauug

SEQ ID NO: 1099492 - RNA, 19 nt, Human
ccuccuggcucagggagcc

SEQ ID NO: 1099493 - RNA, 24 nt, Human
ccuccuggcucagggagccugggc

SEQ ID NO: 1099494 - RNA, 25 nt, Human
cucccaacccccgggcucccaaguu

SEQ ID NO: 1099495 - RNA, 18 nt, Human
gccugggccccucagagc

SEQ ID NO: 1099496 - RNA, 20 nt, Human
gccugggccccucagagcuc

SEQ ID NO: 1099497 - RNA, 22 nt, Human
gggagccugggccccucagagc

SEQ ID NO: 1099498 - RNA, 21 nt, Human
ucccaacccccgggcucccaa

SEQ ID NO: 1099499 - RNA, 19 nt, Human
ucccucccaacccccgggc

SEQ ID NO: 1099500 - RNA, 22 nt, Human
ucccucccaacccccgggcucc

SEQ ID NO: 1099501 - RNA, 27 nt, Human
ugccuuuauuuaucccugucccuccca

SEQ ID NO: 1099502 - RNA, 25 nt, Human
ugggauucuucccuggaacucuccu

SEQ ID NO: 1099503 - RNA, 20 nt, Human
ugggccccucagagcuccag

SEQ ID NO: 1099504 - RNA, 19 nt, Human
uuaucccugucccucccaa

SEQ ID NO: 1099505 - RNA, 23 nt, Human
aaacaauaagacaaaauaccaaa

SEQ ID NO: 1099506 - RNA, 26 nt, Human
aaacauaguacacaacaaauuuaugc

SEQ ID NO: 1099507 - RNA, 24 nt, Human
aaauggcauccaggauaaccagaa

SEQ ID NO: 1099508 - RNA, 24 nt, Human
aaccguuccauuugaacucuccug

SEQ ID NO: 1099509 - RNA, 23 nt, Human
aacugguuuaacugcacacucca

SEQ ID NO: 1099510 - RNA, 22 nt, Human
aagaaaggaugaagggauguug

SEQ ID NO: 1099511 - RNA, 21 nt, Human
acagcuuccuuuugugucuca

SEQ ID NO: 1099512 - RNA, 21 nt, Human
accaaacauaguacacaacaa

SEQ ID NO: 1099513 - RNA, 20 nt, Human
accagugacgauauucccua

SEQ ID NO: 1099514 - RNA, 21 nt, Human
acccacugcgagcccuuccaa

SEQ ID NO: 1099515 - RNA, 26 nt, Human
agaaacaauaagacaaaauaccaaac

SEQ ID NO: 1099516 - RNA, 23 nt, Human
agaaaccuagucagaggacaagc

SEQ ID NO: 1099517 - RNA, 24 nt, Human
agagcgcccggcagaacuuccucc

SEQ ID NO: 1099518 - RNA, 21 nt, Human
agucaagaaaaggguggacuu

SEQ ID NO: 1099519 - RNA, 26 nt, Human
auacagcuuccuuuugugucucaaaa

SEQ ID NO: 1099520 - RNA, 23 nt, Human
aucaggaaaugagcuuacauuuc

SEQ ID NO: 1099521 - RNA, 22 nt, Human
auccuucuuagcuuuccucagc

SEQ ID NO: 1099522 - RNA, 22 nt, Human
caaccggauuguagaccugcca

SEQ ID NO: 1099523 - RNA, 18 nt, Human
cacaacuugcuguaucug

SEQ ID NO: 1099524 - RNA, 24 nt, Human
cacccugaaucacccacugcgagc

SEQ ID NO: 1099525 - RNA, 22 nt, Human
caccggagcgcagugucucggg

SEQ ID NO: 1099526 - RNA, 19 nt, Human
caccuaguuucucagcagc

SEQ ID NO: 1099527 - RNA, 18 nt, Human
caccucccccaacagggc

SEQ ID NO: 1099528 - RNA, 23 nt, Human
caccucccccaacagggccuuuc

SEQ ID NO: 1099529 - RNA, 19 nt, Human
cagcagccugaaagauauu

SEQ ID NO: 1099530 - RNA, 21 nt, Human
cagcuacaugaucuaaaaguu

SEQ ID NO: 1099531 - RNA, 20 nt, Human
cagcuccgggcccaccuccc

SEQ ID NO: 1099532 - RNA, 22 nt, Human
cagcuccgggcccaccuccccc

SEQ ID NO: 1099533 - RNA, 19 nt, Human
cagcucuacagagaaauac

SEQ ID NO: 1099534 - RNA, 22 nt, Human
cauaguacacaacaaauuuaug

SEQ ID NO: 1099535 - RNA, 19 nt, Human
caucugaacugccuugauc

SEQ ID NO: 1099536 - RNA, 21 nt, Human
ccagcuccgggcccaccuccc

SEQ ID NO: 1099537 - RNA, 21 nt, Human
ccaggccugcguggauguccu

SEQ ID NO: 1099538 - RNA, 18 nt, Human
ccaugauucacaacuugc

SEQ ID NO: 1099539 - RNA, 19 nt, Human
ccccauccugaacuuggaa

SEQ ID NO: 1099540 - RNA, 20 nt, Human
cccggcagaacuuccucccg

SEQ ID NO: 1099541 - RNA, 24 nt, Human
cccugaaucacccacugcgagccc

SEQ ID NO: 1099542 - RNA, 21 nt, Human
ccggcagaacuuccucccgga

SEQ ID NO: 1099543 - RNA, 22 nt, Human
ccucuccagcaauggguggcuc

SEQ ID NO: 1099544 - RNA, 20 nt, Human
ccugaaucacccacugcgag

SEQ ID NO: 1099545 - RNA, 21 nt, Human
ccugcguggauguccucucca

SEQ ID NO: 1099546 - RNA, 20 nt, Human
ccuggcggcuggcugugaug

SEQ ID NO: 1099547 - RNA, 21 nt, Human
ccuugauccaguuugcccuau

SEQ ID NO: 1099548 - RNA, 24 nt, Human
cgccaaaccucggggcguccgcuc

SEQ ID NO: 1099549 - RNA, 19 nt, Human
cgcgauacuucccuucuug

SEQ ID NO: 1099550 - RNA, 21 nt, Human
cggcccauacagcuuccuuuu

SEQ ID NO: 1099551 - RNA, 22 nt, Human
cuaaagauucucgccauauugg

SEQ ID NO: 1099552 - RNA, 22 nt, Human
cuauaaccagugaggcaccggc

SEQ ID NO: 1099553 - RNA, 22 nt, Human
cuccucgaccgcgcggcuccgg

SEQ ID NO: 1099554 - RNA, 24 nt, Human
cuccucuucagcaucuggucaucc

SEQ ID NO: 1099555 - RNA, 20 nt, Human
cucugugcuggugcuuauuc

SEQ ID NO: 1099556 - RNA, 19 nt, Human
cucuuaucauggucuucuc

SEQ ID NO: 1099557 - RNA, 24 nt, Human
cuggagucagacagaacuuaugug

SEQ ID NO: 1099558 - RNA, 22 nt, Human
cuuaucauggucuucucugugc

SEQ ID NO: 1099559 - RNA, 21 nt, Human
gaacaagguacacaaucuguu

SEQ ID NO: 1099560 - RNA, 25 nt, Human
gaccugccagcuccgggcccaccuc

SEQ ID NO: 1099561 - RNA, 20 nt, Human
gagaaagcugguauguccuu

SEQ ID NO: 1099562 - RNA, 21 nt, Human
gaugaagaaaggaugaaggga

SEQ ID NO: 1099563 - RNA, 19 nt, Human
gcugagugcugaguugcag

SEQ ID NO: 1099564 - RNA, 19 nt, Human
ggacuggggcugggcugcg

SEQ ID NO: 1099565 - RNA, 21 nt, Human
ggaugaagggauguuguuuuc

SEQ ID NO: 1099566 - RNA, 20 nt, Human
ggcguccgcucgccggccuc

SEQ ID NO: 1099567 - RNA, 24 nt, Human
gggaugaagaaaggaugaagggaa

SEQ ID NO: 1099568 - RNA, 22 nt, Human
gguuaugagacaaagggagaaa

SEQ ID NO: 1099569 - RNA, 24 nt, Human
guacacaacaaauuuaugccucag

SEQ ID NO: 1099570 - RNA, 21 nt, Human
gucaagaaaaggguggacuug

SEQ ID NO: 1099571 - RNA, 22 nt, Human
guccucuccagcaauggguggc

SEQ ID NO: 1099572 - RNA, 21 nt, Human
gugaggcaccggcggagagcg

SEQ ID NO: 1099573 - RNA, 19 nt, Human
guuaaaggucccaggagcc

SEQ ID NO: 1099574 - RNA, 21 nt, Human
guuucaccuaguuucucagca

SEQ ID NO: 1099575 - RNA, 26 nt, Human
uaaaaagugcuacaauaacaaaccac

SEQ ID NO: 1099576 - RNA, 25 nt, Human
uaagacaaaauaccaaacauaguag

SEQ ID NO: 1099577 - RNA, 25 nt, Human
uacaauaacaaaccacauuuaagaa

SEQ ID NO: 1099578 - RNA, 23 nt, Human
uacaguuggaacuguucaaguau

SEQ ID NO: 1099579 - RNA, 19 nt, Human
uagaaaccuagucagagga

SEQ ID NO: 1099580 - RNA, 24 nt, Human
uagaucugugaagaugggcagcuu

SEQ ID NO: 1099581 - RNA, 22 nt, Human
uauacagacucauuuucauggu

SEQ ID NO: 1099582 - RNA, 23 nt, Human
uauacuaaguuucucaguuucac

SEQ ID NO: 1099583 - RNA, 24 nt, Human
ucagauacggaggaaauccuuagu

SEQ ID NO: 1099584 - RNA, 24 nt, Human
ucagcucugcucuggcagcucuac

SEQ ID NO: 1099585 - RNA, 23 nt, Human
ucauccuucuuagcuuuccucag

SEQ ID NO: 1099586 - RNA, 19 nt, Human
uccacauagaaauuagaaa

SEQ ID NO: 1099587 - RNA, 21 nt, Human
uccacggcccauacagcuucc

SEQ ID NO: 1099588 - RNA, 20 nt, Human
ucccgcaugcagcugagugc

SEQ ID NO: 1099589 - RNA, 22 nt, Human
uccucagcuccacauugaccuc

SEQ ID NO: 1099590 - RNA, 19 nt, Human
uccucccggacuggggcug

SEQ ID NO: 1099591 - RNA, 18 nt, Human
ucucugaguuugcuacac

SEQ ID NO: 1099592 - RNA, 22 nt, Human
ucuggucauccuucuuagcuuu

SEQ ID NO: 1099593 - RNA, 18 nt, Human
ucuguucaucuguaccag

SEQ ID NO: 1099594 - RNA, 21 nt, Human
ugaaucacccacugcgagccc

SEQ ID NO: 1099595 - RNA, 19 nt, Human
ugagacaaagggagaaagc

SEQ ID NO: 1099596 - RNA, 18 nt, Human
ugaggcaccggcggagag

SEQ ID NO: 1099597 - RNA, 23 nt, Human
ugagucuguucaucuguaccagu

SEQ ID NO: 1099598 - RNA, 18 nt, Human
ugaucuaaaaguuaaagg

SEQ ID NO: 1099599 - RNA, 21 nt, Human
ugcuacaauaacaaaccacau

SEQ ID NO: 1099600 - RNA, 21 nt, Human
ugcucuggcagcucuacagag

SEQ ID NO: 1099601 - RNA, 22 nt, Human
uggacaugguuaugagacaaag

SEQ ID NO: 1099602 - RNA, 19 nt, Human
ugguccuggcggcuggcug

SEQ ID NO: 1099603 - RNA, 20 nt, Human
uguucaaguauaguuucagu

SEQ ID NO: 1099604 - RNA, 19 nt, Human
uguugcaguuuuccugcag

SEQ ID NO: 1099605 - RNA, 22 nt, Human
uuaugagacaaagggagaaagc

SEQ ID NO: 1099606 - RNA, 20 nt, Human
uuaugccacagugaacaagg

SEQ ID NO: 1099607 - RNA, 18 nt, Human
uucccuuguucuuagauc

SEQ ID NO: 1099608 - RNA, 18 nt, Human
uucucaguuucaccuagu

SEQ ID NO: 1099609 - RNA, 23 nt, Human
uuggaacuguucaaguauaguuu

SEQ ID NO: 1099610 - RNA, 20 nt, Human
uuuaugccucagcuacauga

SEQ ID NO: 1099611 - RNA, 19 nt, Human
uuucaugguuuuguagagc

SEQ ID NO: 1099612 - RNA, 19 nt, Human
uuugcccuaugugaugccc

SEQ ID NO: 1099613 - RNA, 21 nt, Human
agccccugugccugcgucucc

SEQ ID NO: 1099614 - RNA, 21 nt, Human
caacuacuccacucaccaccc

SEQ ID NO: 1099615 - RNA, 18 nt, Human
cacucaccacccuucugg

SEQ ID NO: 1099616 - RNA, 23 nt, Human
cagccccugugccugcgucuccu

SEQ ID NO: 1099617 - RNA, 28 nt, Human
caguccuuuaucucccccucugaaaucc

SEQ ID NO: 1099618 - RNA, 23 nt, Human
ccccugugccugcgucuccugcg

SEQ ID NO: 1099619 - RNA, 18 nt, Human
cccuucugggcaguccuu

SEQ ID NO: 1099620 - RNA, 27 nt, Human
ccuccuccucgccugacuacuucugac

SEQ ID NO: 1099621 - RNA, 22 nt, Human
ccucugaaauccgaucgcugag

SEQ ID NO: 1099622 - RNA, 23 nt, Human
ccuucaaauuccccuuuucauca

SEQ ID NO: 1099623 - RNA, 23 nt, Human
cugugccugcgucuccugcggcu

SEQ ID NO: 1099624 - RNA, 19 nt, Human
guccuuuaucucccccucu

SEQ ID NO: 1099625 - RNA, 21 nt, Human
uagggaaagcugcuucucugc

SEQ ID NO: 1099626 - RNA, 23 nt, Human
uccacucaccacccuucugggca

SEQ ID NO: 1099627 - RNA, 19 nt, Human
uccccagccccugugccug

SEQ ID NO: 1099628 - RNA, 22 nt, Human
uggaauggcuccuucaaauucc

SEQ ID NO: 1099629 - RNA, 18 nt, Human
uguccugugcuguguagg

SEQ ID NO: 1099630 - RNA, 20 nt, Human
ugucuucuggaauggcuccu

SEQ ID NO: 1099631 - RNA, 21 nt, Human
ugucuucuggaauggcuccuu

SEQ ID NO: 1099632 - RNA, 20 nt, Human
uucaaauuccccuuuucauc

SEQ ID NO: 1099633 - RNA, 19 nt, Human
aacauggugaaaccccauc

SEQ ID NO: 1099634 - RNA, 20 nt, Human
aacauggugaaaccccaucu

SEQ ID NO: 1099635 - RNA, 20 nt, Human
aacauggugaaaccccaucu

SEQ ID NO: 1099636 - RNA, 21 nt, Human
aacauggugaaaccccaucuc

SEQ ID NO: 1099637 - RNA, 21 nt, Human
aaccuaucagggaugucccag

SEQ ID NO: 1099638 - RNA, 19 nt, Human
aagaagaaaagaguggaag

SEQ ID NO: 1099639 - RNA, 23 nt, Human
aagaagaaaagaguggaaggaag

SEQ ID NO: 1099640 - RNA, 23 nt, Human
aagaaucacuugaacccaggagg

SEQ ID NO: 1099641 - RNA, 18 nt, Human
aagcuggaggggucugag

SEQ ID NO: 1099642 - RNA, 24 nt, Human
aaucacuugaacccaggaggcgga

SEQ ID NO: 1099643 - RNA, 24 nt, Human
accccaucucuacuaaaaguacaa

SEQ ID NO: 1099644 - RNA, 19 nt, Human
acccccgaccccuucucca

SEQ ID NO: 1099645 - RNA, 24 nt, Human
acugagccuugucuggcccugcug

SEQ ID NO: 1099646 - RNA, 20 nt, Human
acugcacuccagccugggca

SEQ ID NO: 1099647 - RNA, 24 nt, Human
acugcacuccagccugggcagcag

SEQ ID NO: 1099648 - RNA, 19 nt, Human
acugcuggccuggccagga

SEQ ID NO: 1099649 - RNA, 24 nt, Human
acuuaggcaggccucaggggaguc

SEQ ID NO: 1099650 - RNA, 22 nt, Human
agaacccauaggcaaguaaccc

SEQ ID NO: 1099651 - RNA, 18 nt, Human
agacaaggaaggagccaa

SEQ ID NO: 1099652 - RNA, 22 nt, Human
agacaagguggggucuggagug

SEQ ID NO: 1099653 - RNA, 24 nt, Human
agacacaguggcucaugccuguaa

SEQ ID NO: 1099654 - RNA, 20 nt, Human
agacgcugggaaccguccgc

SEQ ID NO: 1099655 - RNA, 24 nt, Human
agaggagaaccuggggaggguggg

SEQ ID NO: 1099656 - RNA, 23 nt, Human
agccaggugugguggugcgugcc

SEQ ID NO: 1099657 - RNA, 21 nt, Human
agcccuggaguccgggcagcu

SEQ ID NO: 1099658 - RNA, 22 nt, Human
agccuggccaacauggugaaac

SEQ ID NO: 1099659 - RNA, 24 nt, Human
agccuggccaacauggugaaaccc

SEQ ID NO: 1099660 - RNA, 24 nt, Human
agccugggcagcagcacgagauuc

SEQ ID NO: 1099661 - RNA, 23 nt, Human
aggaaggcaggguccgacacugg

SEQ ID NO: 1099662 - RNA, 24 nt, Human
aggaaguacaacaaaacgaaauaa

SEQ ID NO: 1099663 - RNA, 21 nt, Human
aggcaaguaacccuuuccaga

SEQ ID NO: 1099664 - RNA, 18 nt, Human
aggcagaagaaucacuug

SEQ ID NO: 1099665 - RNA, 23 nt, Human
aggcagaagaaucacuugaaccc

SEQ ID NO: 1099666 - RNA, 24 nt, Human
aggcagaagaaucacuugaaccca

SEQ ID NO: 1099667 - RNA, 21 nt, Human
aggcaggguccgacacugggc

SEQ ID NO: 1099668 - RNA, 22 nt, Human
aggcaggguccgacacugggca

SEQ ID NO: 1099669 - RNA, 23 nt, Human
aggcucauuugaggucaggaguu

SEQ ID NO: 1099670 - RNA, 24 nt, Human
aggcucauuugaggucaggaguuc

SEQ ID NO: 1099671 - RNA, 24 nt, Human
aggcugaggcagaagaaucacuug

SEQ ID NO: 1099672 - RNA, 21 nt, Human
agggagggaagacaagguggg

SEQ ID NO: 1099673 - RNA, 19 nt, Human
aggucaggaguucaagacc

SEQ ID NO: 1099674 - RNA, 19 nt, Human
agguggggucuggaguggg

SEQ ID NO: 1099675 - RNA, 22 nt, Human
aggugguucaaagagaagccag

SEQ ID NO: 1099676 - RNA, 24 nt, Human
aggugugguggugcgugccuguaa

SEQ ID NO: 1099677 - RNA, 22 nt, Human
aguggcucaugccuguaauccc

SEQ ID NO: 1099678 - RNA, 24 nt, Human
aguggcucaugccuguaaucccgg

SEQ ID NO: 1099679 - RNA, 25 nt, Human
auacugaacaacucuuaauuucacu

SEQ ID NO: 1099680 - RNA, 24 nt, Human
aucgugccacugcacuccagccug

SEQ ID NO: 1099681 - RNA, 24 nt, Human
auuugaggucaggaguucaagacc

SEQ ID NO: 1099682 - RNA, 24 nt, Human
caacauggugaaaccccaucucua

SEQ ID NO: 1099683 - RNA, 24 nt, Human
caagaccagccuggccaacauggu

SEQ ID NO: 1099684 - RNA, 19 nt, Human
caagaggagaaccugggga

SEQ ID NO: 1099685 - RNA, 22 nt, Human
caagccccagagaugguuuugg

SEQ ID NO: 1099686 - RNA, 20 nt, Human
caaguaacccuuuccagaca

SEQ ID NO: 1099687 - RNA, 21 nt, Human
caaguuuugcauacugaacaa

SEQ ID NO: 1099688 - RNA, 20 nt, Human
cacagcccaaaugcagacuc

SEQ ID NO: 1099689 - RNA, 24 nt, Human
cacccccgaccccuucuccagggg

SEQ ID NO: 1099690 - RNA, 18 nt, Human
cacuccagccugggcagc

SEQ ID NO: 1099691 - RNA, 18 nt, Human
cacugcacuccagccugg

SEQ ID NO: 1099692 - RNA, 19 nt, Human
cacugcacuccagccuggg

SEQ ID NO: 1099693 - RNA, 23 nt, Human
cacugcacuccagccugggcagc

SEQ ID NO: 1099694 - RNA, 24 nt, Human
cacugcacuccagccugggcagca

SEQ ID NO: 1099695 - RNA, 26 nt, Human
cacugcacuccagccugggcagcagc

SEQ ID NO: 1099696 - RNA, 19 nt, Human
cagaacccauaggcaagua

SEQ ID NO: 1099697 - RNA, 18 nt, Human
cagacucuaagcuggagg

SEQ ID NO: 1099698 - RNA, 21 nt, Human
cagaguccugcaccaagcccc

SEQ ID NO: 1099699 - RNA, 19 nt, Human
cagcagcacgagauucugu

SEQ ID NO: 1099700 - RNA, 24 nt, Human
cagcuacucgggaggcugaggcag

SEQ ID NO: 1099701 - RNA, 18 nt, Human
caugccuguaaucccggc

SEQ ID NO: 1099702 - RNA, 24 nt, Human
caugccuguaaucccggcaauuug

SEQ ID NO: 1099703 - RNA, 23 nt, Human
cauuugaggucaggaguucaaga

SEQ ID NO: 1099704 - RNA, 19 nt, Human
ccaaaugcagacucuaagc

SEQ ID NO: 1099705 - RNA, 19 nt, Human
ccacucucugccgguccug

SEQ ID NO: 1099706 - RNA, 20 nt, Human
ccacugcacuccagccuggg

SEQ ID NO: 1099707 - RNA, 21 nt, Human
ccacugcacuccagccugggc

SEQ ID NO: 1099708 - RNA, 22 nt, Human
ccacugcacuccagccugggca

SEQ ID NO: 1099709 - RNA, 22 nt, Human
ccacugcacuccagccugggca

SEQ ID NO: 1099710 - RNA, 23 nt, Human
ccacugcacuccagccugggcag

SEQ ID NO: 1099711 - RNA, 23 nt, Human
ccacugcacuccagccugggcag

SEQ ID NO: 1099712 - RNA, 24 nt, Human
ccacugcacuccagccugggcagc

SEQ ID NO: 1099713 - RNA, 19 nt, Human
ccccagcaugcuccucuuc

SEQ ID NO: 1099714 - RNA, 22 nt, Human
cccgaccccuucuccagggggc

SEQ ID NO: 1099715 - RNA, 24 nt, Human
ccgguccugggcuuaucccugcaa

SEQ ID NO: 1099716 - RNA, 23 nt, Human
ccuggccaacauggugaaacccc

SEQ ID NO: 1099717 - RNA, 24 nt, Human
ccuggccaacauggugaaacccca

SEQ ID NO: 1099718 - RNA, 21 nt, Human
ccuguaaucccagcuacucgg

SEQ ID NO: 1099719 - RNA, 22 nt, Human
ccuguaaucccagcuacucggg

SEQ ID NO: 1099720 - RNA, 24 nt, Human
cgggaggcugaggcagaagaauca

SEQ ID NO: 1099721 - RNA, 18 nt, Human
cgguccugggcuuauccc

SEQ ID NO: 1099722 - RNA, 25 nt, Human
cucaugccuguaaucccggcaauuu

SEQ ID NO: 1099723 - RNA, 24 nt, Human
cucauuugaggucaggaguucaag

SEQ ID NO: 1099724 - RNA, 24 nt, Human
cucugaggcugagguggaaagcuu

SEQ ID NO: 1099725 - RNA, 23 nt, Human
cuggccaacauggugaaacccca

SEQ ID NO: 1099726 - RNA, 24 nt, Human
gaagagcaaggccaccgcucuggg

SEQ ID NO: 1099727 - RNA, 21 nt, Human
gacaagguggggucuggagug

SEQ ID NO: 1099728 - RNA, 22 nt, Human
gcagaagaaucacuugaaccca

SEQ ID NO: 1099729 - RNA, 24 nt, Human
gcagaucgugccacugcacuccag

SEQ ID NO: 1099730 - RNA, 24 nt, Human
gccaacauggugaaaccccaucuc

SEQ ID NO: 1099731 - RNA, 22 nt, Human
gccacugcacuccagccugggc

SEQ ID NO: 1099732 - RNA, 24 nt, Human
gccacugcacuccagccugggcag

SEQ ID NO: 1099733 - RNA, 20 nt, Human
gcgugccuguaaucccagcu

SEQ ID NO: 1099734 - RNA, 18 nt, Human
gcucauuugaggucagga

SEQ ID NO: 1099735 - RNA, 23 nt, Human
gcucauuugaggucaggaguuca

SEQ ID NO: 1099736 - RNA, 24 nt, Human
gcucauuugaggucaggaguucaa

SEQ ID NO: 1099737 - RNA, 20 nt, Human
gcuccucuucaucaccagcu

SEQ ID NO: 1099738 - RNA, 18 nt, Human
ggagaaccuggggagggu

SEQ ID NO: 1099739 - RNA, 22 nt, Human
ggcaagaaggcauggccaggga

SEQ ID NO: 1099740 - RNA, 24 nt, Human
ggcagcuggacucugaggcugagg

SEQ ID NO: 1099741 - RNA, 21 nt, Human
ggccagacacaguggcucaug

SEQ ID NO: 1099742 - RNA, 23 nt, Human
ggcucauuugaggucaggaguuc

SEQ ID NO: 1099743 - RNA, 19 nt, Human
gggcagcuggacucugagg

SEQ ID NO: 1099744 - RNA, 24 nt, Human
gggccagacacaguggcucaugcc

SEQ ID NO: 1099745 - RNA, 23 nt, Human
ggggaggguggggagagcccugg

SEQ ID NO: 1099746 - RNA, 25 nt, Human
ggggaggguggggagagcccuggag

SEQ ID NO: 1099747 - RNA, 21 nt, Human
ggggucuggagugggaggaag

SEQ ID NO: 1099748 - RNA, 19 nt, Human
gguggggcccaggaaucac

SEQ ID NO: 1099749 - RNA, 24 nt, Human
gguggugcgugccuguaaucccag

SEQ ID NO: 1099750 - RNA, 20 nt, Human
guaguugugcuacuuuacca

SEQ ID NO: 1099751 - RNA, 18 nt, Human
guccugcaccaagcccca

SEQ ID NO: 1099752 - RNA, 24 nt, Human
gugaagaagaaaagaguggaaggg

SEQ ID NO: 1099753 - RNA, 19 nt, Human
guggggagagcccuggagu

SEQ ID NO: 1099754 - RNA, 18 nt, Human
gugggucuugguggggcc

SEQ ID NO: 1099755 - RNA, 24 nt, Human
guggugcgugccuguaaucccagc

SEQ ID NO: 1099756 - RNA, 23 nt, Human
ucacaggcuuccugaagggcugg

SEQ ID NO: 1099757 - RNA, 22 nt, Human
ucaugccuguaaucccggcaau

SEQ ID NO: 1099758 - RNA, 21 nt, Human
ucauuugaggucaggaguuca

SEQ ID NO: 1099759 - RNA, 21 nt, Human
uccagggcugacaaacgcuuc

SEQ ID NO: 1099760 - RNA, 21 nt, Human
uccccagcuggaucuuggugu

SEQ ID NO: 1099761 - RNA, 23 nt, Human
ucccugcaaugugcaccugaccu

SEQ ID NO: 1099762 - RNA, 22 nt, Human
uccgggcagcuggacucugagg

SEQ ID NO: 1099763 - RNA, 23 nt, Human
uccucuucaucaccagcugaugc

SEQ ID NO: 1099764 - RNA, 23 nt, Human
uccugaagggcugggaugcaggu

SEQ ID NO: 1099765 - RNA, 25 nt, Human
ucgggaggcugaggcagaagaauca

SEQ ID NO: 1099766 - RNA, 23 nt, Human
ucgugccacugcacuccagccug

SEQ ID NO: 1099767 - RNA, 23 nt, Human
ucuagccaccagaacccauaggc

SEQ ID NO: 1099768 - RNA, 22 nt, Human
ucuccagccggaagagcaaggc

SEQ ID NO: 1099769 - RNA, 23 nt, Human
ucucuacuaaaaguacaaaaauu

SEQ ID NO: 1099770 - RNA, 19 nt, Human
ucucuggugagacuauggg

SEQ ID NO: 1099771 - RNA, 22 nt, Human
ucugaggacgccagggagggaa

SEQ ID NO: 1099772 - RNA, 18 nt, Human
ucugaggcugagguggaa

SEQ ID NO: 1099773 - RNA, 19 nt, Human
ugaaaccccaucucuacua

SEQ ID NO: 1099774 - RNA, 18 nt, Human
ugaagaagaaaagagugg

SEQ ID NO: 1099775 - RNA, 23 nt, Human
ugacauuuuuuucuuccuuuucu

SEQ ID NO: 1099776 - RNA, 22 nt, Human
ugagacuaugggugacauuuuu

SEQ ID NO: 1099777 - RNA, 20 nt, Human
ugaggcagaagaaucacuug

SEQ ID NO: 1099778 - RNA, 24 nt, Human
ugaggcagaagaaucacuugaacc

SEQ ID NO: 1099779 - RNA, 25 nt, Human
ugaggcagaagaaucacuugaaccc

SEQ ID NO: 1099780 - RNA, 24 nt, Human
ugcaccaagccccagagaugguuu

SEQ ID NO: 1099781 - RNA, 23 nt, Human
ugcaggagaccgugggacuaagu

SEQ ID NO: 1099782 - RNA, 24 nt, Human
ugccacugcacuccagccugggca

SEQ ID NO: 1099783 - RNA, 23 nt, Human
ugccuguaaucccagcuacucgg

SEQ ID NO: 1099784 - RNA, 24 nt, Human
ugccuguaaucccagcuacucggg

SEQ ID NO: 1099785 - RNA, 24 nt, Human
ugccuguaaucccggcaauuuggg

SEQ ID NO: 1099786 - RNA, 21 nt, Human
uggacucugaggcugaggugg

SEQ ID NO: 1099787 - RNA, 18 nt, Human
uggagugggaggaaggca

SEQ ID NO: 1099788 - RNA, 20 nt, Human
uggagugggaggaaggcagg

SEQ ID NO: 1099789 - RNA, 24 nt, Human
uggccaacauggugaaaccccauc

SEQ ID NO: 1099790 - RNA, 24 nt, Human
uggccagggagggcaaauggaaaa

SEQ ID NO: 1099791 - RNA, 24 nt, Human
uggcucaugccuguaaucccggca

SEQ ID NO: 1099792 - RNA, 18 nt, Human
ugggcaugaggcccagga

SEQ ID NO: 1099793 - RNA, 21 nt, Human
uggugcgugccuguaauccca

SEQ ID NO: 1099794 - RNA, 22 nt, Human
uggugcgugccuguaaucccag

SEQ ID NO: 1099795 - RNA, 24 nt, Human
ugguggugcgugccuguaauccca

SEQ ID NO: 1099796 - RNA, 20 nt, Human
uuagccaggugugguggugc

SEQ ID NO: 1099797 - RNA, 21 nt, Human
uucaucauuuuuccaaaggca

SEQ ID NO: 1099798 - RNA, 19 nt, Human
uuccagacaaggaaggagc

SEQ ID NO: 1099799 - RNA, 23 nt, Human
uuccugaagggcugggaugcagg

SEQ ID NO: 1099800 - RNA, 22 nt, Human
uuccuuuucuuuuucuccucca

SEQ ID NO: 1099801 - RNA, 19 nt, Human
uucuuccuuuucuuuuucu

SEQ ID NO: 1099802 - RNA, 25 nt, Human
uuggugggucuugguggggcccagg

SEQ ID NO: 1099803 - RNA, 19 nt, Human
uugucuggcccugcugagg

SEQ ID NO: 1099804 - RNA, 19 nt, Human
uuucuuuuucuccuccauc

SEQ ID NO: 1099805 - RNA, 26 nt, Human
uuuucacaggcuuccugaagggcugg

SEQ ID NO: 1099806 - RNA, 20 nt, Human
uuuucuccuccaucuuucca

SEQ ID NO: 1099807 - RNA, 21 nt, Human
uuuuuuuuuuuuuugcagcug

SEQ ID NO: 1099808 - RNA, 20 nt, Human
uuuuuuuuuuuuuuuugcag

SEQ ID NO: 1099809 - RNA, 20 nt, Human
aaaaaaaaaaaaaaaagcaa

SEQ ID NO: 1099810 - RNA, 21 nt, Human
aaaaaagccauccuggccagg

SEQ ID NO: 1099811 - RNA, 23 nt, Human
aacccuugcuucuucaucaccuc

SEQ ID NO: 1099812 - RNA, 21 nt, Human
aaccuuagacagccucagcua

SEQ ID NO: 1099813 - RNA, 24 nt, Human
aacggcucacagcuauaaucccag

SEQ ID NO: 1099814 - RNA, 19 nt, Human
aagagguaccacuaucauc

SEQ ID NO: 1099815 - RNA, 19 nt, Human
aagaguaauuccugccucc

SEQ ID NO: 1099816 - RNA, 21 nt, Human
aagccaggcuggaaccacgug

SEQ ID NO: 1099817 - RNA, 23 nt, Human
aaguagcaaagaggcauuuguaa

SEQ ID NO: 1099818 - RNA, 22 nt, Human
aaguagcugggauuacaggcac

SEQ ID NO: 1099819 - RNA, 25 nt, Human
aaguagcugggauuacaggcaccua

SEQ ID NO: 1099820 - RNA, 21 nt, Human
aauaaaaaaaaaaaauagcag

SEQ ID NO: 1099821 - RNA, 21 nt, Human
acacuuuuggucccagcuccu

SEQ ID NO: 1099822 - RNA, 21 nt, Human
acaggcaccuaccaccaugcc

SEQ ID NO: 1099823 - RNA, 24 nt, Human
acuccagccugggugacagaguga

SEQ ID NO: 1099824 - RNA, 24 nt, Human
acucugugaccucagguguuccug

SEQ ID NO: 1099825 - RNA, 24 nt, Human
acugcacuccagccugggugacag

SEQ ID NO: 1099826 - RNA, 26 nt, Human
acugcacuccagccugggugacagag

SEQ ID NO: 1099827 - RNA, 20 nt, Human
agacauuggccuaagagcug

SEQ ID NO: 1099828 - RNA, 28 nt, Human
agaugaucugugaguaagguucugaagc

SEQ ID NO: 1099829 - RNA, 20 nt, Human
agcacuuuaggaggcugagg

SEQ ID NO: 1099830 - RNA, 21 nt, Human
agccugggugacagagugaga

SEQ ID NO: 1099831 - RNA, 23 nt, Human
agcuuugaccucuuuguagaacc

SEQ ID NO: 1099832 - RNA, 21 nt, Human
aggcauuuguaagaugaucug

SEQ ID NO: 1099833 - RNA, 23 nt, Human
aggcugagguguguagaugcuug

SEQ ID NO: 1099834 - RNA, 22 nt, Human
agggcgugguguugggcagggg

SEQ ID NO: 1099835 - RNA, 24 nt, Human
agugcaauggugccaucucggcuc

SEQ ID NO: 1099836 - RNA, 24 nt, Human
aucaugccacugcacuccagccug

SEQ ID NO: 1099837 - RNA, 22 nt, Human
augccacugcacuccagccugg

SEQ ID NO: 1099838 - RNA, 19 nt, Human
augggguuucaucacguug

SEQ ID NO: 1099839 - RNA, 21 nt, Human
caagcaauucuccugccucag

SEQ ID NO: 1099840 - RNA, 28 nt, Human
caagcaauucuccugccucagucuccca

SEQ ID NO: 1099841 - RNA, 25 nt, Human
caccuugugccagagggcguggugu

SEQ ID NO: 1099842 - RNA, 24 nt, Human
cacguuggccaggcuguucucaaa

SEQ ID NO: 1099843 - RNA, 22 nt, Human
cacuccagccugggugacagag

SEQ ID NO: 1099844 - RNA, 24 nt, Human
cacuccagccugggugacagagug

SEQ ID NO: 1099845 - RNA, 21 nt, Human
cacugcaacaucugccuccca

SEQ ID NO: 1099846 - RNA, 19 nt, Human
cacugcacuccagccuggg

SEQ ID NO: 1099847 - RNA, 19 nt, Human
cacugcacuccagccuggg

SEQ ID NO: 1099848 - RNA, 19 nt, Human
cacugcacuccagccuggg

SEQ ID NO: 1099849 - RNA, 22 nt, Human
cacugcacuccagccuggguga

SEQ ID NO: 1099850 - RNA, 24 nt, Human
cacugcacuccagccugggugaca

SEQ ID NO: 1099851 - RNA, 25 nt, Human
cacugcacuccagccugggugacag

SEQ ID NO: 1099852 - RNA, 24 nt, Human
cacuuuuggucccagcuccuuggg

SEQ ID NO: 1099853 - RNA, 26 nt, Human
cacuuuuggucccagcuccuugggaa

SEQ ID NO: 1099854 - RNA, 22 nt, Human
cagaacagaugugcaaugaaug

SEQ ID NO: 1099855 - RNA, 18 nt, Human
cagcacuuuaggaggcug

SEQ ID NO: 1099856 - RNA, 20 nt, Human
cagcacuuuaggaggcugag

SEQ ID NO: 1099857 - RNA, 22 nt, Human
cagcuccuugggaagcugagau

SEQ ID NO: 1099858 - RNA, 18 nt, Human
caguacagaugggguuuc

SEQ ID NO: 1099859 - RNA, 24 nt, Human
caguacagaugggguuucaucacg

SEQ ID NO: 1099860 - RNA, 22 nt, Human
caucacguuggccaggcuguuc

SEQ ID NO: 1099861 - RNA, 24 nt, Human
caucacguuggccaggcuguucuc

SEQ ID NO: 1099862 - RNA, 26 nt, Human
caucucuccaagaaauaaaaaaaaaa

SEQ ID NO: 1099863 - RNA, 21 nt, Human
ccaagaaauaaaaaaaaaaaa

SEQ ID NO: 1099864 - RNA, 23 nt, Human
ccaaguagcugggauuacaggca

SEQ ID NO: 1099865 - RNA, 20 nt, Human
ccacugcacuccagccuggg

SEQ ID NO: 1099866 - RNA, 20 nt, Human
ccacugcacuccagccuggg

SEQ ID NO: 1099867 - RNA, 20 nt, Human
ccacugcacuccagccuggg

SEQ ID NO: 1099868 - RNA, 20 nt, Human
ccacugcacuccagccuggg

SEQ ID NO: 1099869 - RNA, 21 nt, Human
ccacugcacuccagccugggu

SEQ ID NO: 1099870 - RNA, 21 nt, Human
ccacugcacuccagccugggu

SEQ ID NO: 1099871 - RNA, 23 nt, Human
ccacugcacuccagccuggguga

SEQ ID NO: 1099872 - RNA, 24 nt, Human
ccacugcacuccagccugggugac

SEQ ID NO: 1099873 - RNA, 19 nt, Human
ccaggaacuggugcuuucu

SEQ ID NO: 1099874 - RNA, 21 nt, Human
ccaggaugcggggguggggcg

SEQ ID NO: 1099875 - RNA, 23 nt, Human
cccaaguagcugggauuacaggc

SEQ ID NO: 1099876 - RNA, 24 nt, Human
cccaaguagcugggauuacaggca

SEQ ID NO: 1099877 - RNA, 18 nt, Human
cccaggcuggagugcaau

SEQ ID NO: 1099878 - RNA, 23 nt, Human
cccagguucaagcaauucuccug

SEQ ID NO: 1099879 - RNA, 18 nt, Human
cccccauucccuuugcuc

SEQ ID NO: 1099880 - RNA, 25 nt, Human
cccuuugcuccuuuaccugccuuca

SEQ ID NO: 1099881 - RNA, 18 nt, Human
ccgcugcccccaugaggc

SEQ ID NO: 1099882 - RNA, 23 nt, Human
ccucagcuaccucacugggccuu

SEQ ID NO: 1099883 - RNA, 24 nt, Human
ccucccagguucaagcaauucucc

SEQ ID NO: 1099884 - RNA, 23 nt, Human
ccucccgcugcccccaugaggcc

SEQ ID NO: 1099885 - RNA, 24 nt, Human
ccuggccaggugcaacggcucaca

SEQ ID NO: 1099886 - RNA, 19 nt, Human
ccugggugacagagugaga

SEQ ID NO: 1099887 - RNA, 21 nt, Human
cgcagggcuaggugagggacg

SEQ ID NO: 1099888 - RNA, 24 nt, Human
cggcucacagcuauaaucccagca

SEQ ID NO: 1099889 - RNA, 20 nt, Human
cgucuaaaaaaaaaaaaaaa

SEQ ID NO: 1099890 - RNA, 22 nt, Human
cguuggccaggcuguucucaaa

SEQ ID NO: 1099891 - RNA, 23 nt, Human
cguuggccaggcuguucucaaac

SEQ ID NO: 1099892 - RNA, 24 nt, Human
cucacagcuauaaucccagcacuu

SEQ ID NO: 1099893 - RNA, 20 nt, Human
cucacguagcuuugaccucu

SEQ ID NO: 1099894 - RNA, 24 nt, Human
cucacugcaacaucugccucccag

SEQ ID NO: 1099895 - RNA, 24 nt, Human
cucagucucccaaguagcugggau

SEQ ID NO: 1099896 - RNA, 21 nt, Human
cucauagcacuuacuccaucc

SEQ ID NO: 1099897 - RNA, 24 nt, Human
cucauagcacuuacuccaucccca

SEQ ID NO: 1099898 - RNA, 24 nt, Human
cucccgcugcccccaugaggccca

SEQ ID NO: 1099899 - RNA, 25 nt, Human
cuccuagucucauagcacuuacucc

SEQ ID NO: 1099900 - RNA, 23 nt, Human
cugcaacaucugccucccagguu

SEQ ID NO: 1099901 - RNA, 24 nt, Human
cugcaacaucugccucccagguuc

SEQ ID NO: 1099902 - RNA, 18 nt, Human
cugcaggaccacagccag

SEQ ID NO: 1099903 - RNA, 23 nt, Human
cugccucagucucccaaguagcu

SEQ ID NO: 1099904 - RNA, 23 nt, Human
cuggaaccacguggaccuggguu

SEQ ID NO: 1099905 - RNA, 23 nt, Human
cugggccuugguuuucucaucug

SEQ ID NO: 1099906 - RNA, 24 nt, Human
cuugcucuugucacccaggcugga

SEQ ID NO: 1099907 - RNA, 24 nt, Human
cuugucacccaggcuggagugcaa

SEQ ID NO: 1099908 - RNA, 25 nt, Human
cuuuuggucccagcuccuugggaag

SEQ ID NO: 1099909 - RNA, 18 nt, Human
gacccuuccugacuccca

SEQ ID NO: 1099910 - RNA, 21 nt, Human
gaucaugccacugcacuccag

SEQ ID NO: 1099911 - RNA, 22 nt, Human
gauuacaggcaccuaccaccau

SEQ ID NO: 1099912 - RNA, 19 nt, Human
gcaaugaucaugccacugc

SEQ ID NO: 1099913 - RNA, 23 nt, Human
gcacuccagccugggugacagag

SEQ ID NO: 1099914 - RNA, 24 nt, Human
gcacuccagccugggugacagagu

SEQ ID NO: 1099915 - RNA, 21 nt, Human
gccaagcugcugcccuggggu

SEQ ID NO: 1099916 - RNA, 19 nt, Human
gccacugcacuccagccug

SEQ ID NO: 1099917 - RNA, 24 nt, Human
gccacugcacuccagccuggguga

SEQ ID NO: 1099918 - RNA, 18 nt, Human
gccaggaugcgggggugg

SEQ ID NO: 1099919 - RNA, 23 nt, Human
gcccggcuaauuuuuuguauuuu

SEQ ID NO: 1099920 - RNA, 26 nt, Human
gcccgucuaaaaaaaaaaaaaaaaaa

SEQ ID NO: 1099921 - RNA, 21 nt, Human
gccuaagagcugggccaggcu

SEQ ID NO: 1099922 - RNA, 24 nt, Human
gccucagucucccaaguagcuggg

SEQ ID NO: 1099923 - RNA, 21 nt, Human
gcucuugucacccaggcugga

SEQ ID NO: 1099924 - RNA, 24 nt, Human
gcucuugucacccaggcuggagug

SEQ ID NO: 1099925 - RNA, 21 nt, Human
gcuggagugcaauggugccag

SEQ ID NO: 1099926 - RNA, 20 nt, Human
ggcggguugggauugggggg

SEQ ID NO: 1099927 - RNA, 19 nt, Human
ggcucuggccaguggcggg

SEQ ID NO: 1099928 - RNA, 20 nt, Human
gggaagcugagauggcagga

SEQ ID NO: 1099929 - RNA, 22 nt, Human
gggccaggcucuggccaguggc

SEQ ID NO: 1099930 - RNA, 19 nt, Human
gggcgugguguugggcagg

SEQ ID NO: 1099931 - RNA, 18 nt, Human
gggguuucaucacguugg

SEQ ID NO: 1099932 - RNA, 22 nt, Human
gggguuucaucacguuggccag

SEQ ID NO: 1099933 - RNA, 22 nt, Human
ggguuucaucacguuggccagg

SEQ ID NO: 1099934 - RNA, 19 nt, Human
guagaugcuugagcccauc

SEQ ID NO: 1099935 - RNA, 21 nt, Human
uaagaugaucugugaguaagg

SEQ ID NO: 1099936 - RNA, 19 nt, Human
uaauuuuuuguauuuucag

SEQ ID NO: 1099937 - RNA, 22 nt, Human
uaccaccaugcccggcuaauuu

SEQ ID NO: 1099938 - RNA, 23 nt, Human
uaccaccaugcccggcuaauuuu

SEQ ID NO: 1099939 - RNA, 21 nt, Human
uaccucacugggccuugguuu

SEQ ID NO: 1099940 - RNA, 22 nt, Human
uagcaaagaggcauuuguaaga

SEQ ID NO: 1099941 - RNA, 21 nt, Human
uagcacuuacuccauccccau

SEQ ID NO: 1099942 - RNA, 20 nt, Human
uagugagcaaugaucaugcc

SEQ ID NO: 1099943 - RNA, 21 nt, Human
ucaaaaaaagccauccuggcc

SEQ ID NO: 1099944 - RNA, 20 nt, Human
ucacagcuauaaucccagca

SEQ ID NO: 1099945 - RNA, 18 nt, Human
ucacccaggcuggagugc

SEQ ID NO: 1099946 - RNA, 24 nt, Human
ucacugcaacaucugccucccagg

SEQ ID NO: 1099947 - RNA, 25 nt, Human
ucacugcaacaucugccucccaggu

SEQ ID NO: 1099948 - RNA, 22 nt, Human
ucacugggccuugguuuucuca

SEQ ID NO: 1099949 - RNA, 20 nt, Human
ucaguacagaugggguuuca

SEQ ID NO: 1099950 - RNA, 21 nt, Human
ucaguacagaugggguuuccu

SEQ ID NO: 1099951 - RNA, 23 nt, Human
ucaugccacugcacuccagccug

SEQ ID NO: 1099952 - RNA, 23 nt, Human
uccaagaaauaaaaaaaaaaaau

SEQ ID NO: 1099953 - RNA, 23 nt, Human
uccagccugggugacagagugag

SEQ ID NO: 1099954 - RNA, 24 nt, Human
uccagccugggugacagagugaga

SEQ ID NO: 1099955 - RNA, 24 nt, Human
ucccaaguagcugggauuacaggc

SEQ ID NO: 1099956 - RNA, 21 nt, Human
ucccagguucaagcaauucuc

SEQ ID NO: 1099957 - RNA, 24 nt, Human
ucccagguucaagcaauucuccug

SEQ ID NO: 1099958 - RNA, 21 nt, Human
uccucacguagcuuugaccuc

SEQ ID NO: 1099959 - RNA, 21 nt, Human
ucuaaaaaaaaaaaaaaaaaa

SEQ ID NO: 1099960 - RNA, 24 nt, Human
ucuugcucuugucacccaggcugg

SEQ ID NO: 1099961 - RNA, 25 nt, Human
ucuugcucuugucacccaggcugga

SEQ ID NO: 1099962 - RNA, 18 nt, Human
ucuuuguagaacccuugc

SEQ ID NO: 1099963 - RNA, 18 nt, Human
ugaccucagguguuccuu

SEQ ID NO: 1099964 - RNA, 25 nt, Human
ugcccggcuaauuuuuuguauuuuc

SEQ ID NO: 1099965 - RNA, 23 nt, Human
ugccucagucucccaaguagcug

SEQ ID NO: 1099966 - RNA, 24 nt, Human
ugccucagucucccaaguagcugg

SEQ ID NO: 1099967 - RNA, 18 nt, Human
ugcggggguggggcgggg

SEQ ID NO: 1099968 - RNA, 24 nt, Human
ugcucuugucacccaggcuggagu

SEQ ID NO: 1099969 - RNA, 21 nt, Human
ugcugcaggaccacagccagu

SEQ ID NO: 1099970 - RNA, 21 nt, Human
uggaaccacguggaccugggu

SEQ ID NO: 1099971 - RNA, 28 nt, Human
uggagugcaauggugccauccuagcacg

SEQ ID NO: 1099972 - RNA, 23 nt, Human
uggagugcaauggugccaucucg

SEQ ID NO: 1099973 - RNA, 24 nt, Human
uggagugcaauggugccaucucgg

SEQ ID NO: 1099974 - RNA, 21 nt, Human
uggccaggcuguucucaaacu

SEQ ID NO: 1099975 - RNA, 20 nt, Human
uggccaguggcggguuggga

SEQ ID NO: 1099976 - RNA, 19 nt, Human
ugggaagcugagauggcag

SEQ ID NO: 1099977 - RNA, 21 nt, Human
ugggauuacaggcaccuacca

SEQ ID NO: 1099978 - RNA, 24 nt, Human
ugggauuacaggcaccuaccacca

SEQ ID NO: 1099979 - RNA, 25 nt, Human
ugggauuacaggcaccuaccaccau

SEQ ID NO: 1099980 - RNA, 22 nt, Human
ugggccaggcucuggccagugg

SEQ ID NO: 1099981 - RNA, 24 nt, Human
ugggguuucaucacguuggccagg

SEQ ID NO: 1099982 - RNA, 23 nt, Human
ugguggcacacacuuuugguccc

SEQ ID NO: 1099983 - RNA, 24 nt, Human
uguagaugcuugagcccaucucuc

SEQ ID NO: 1099984 - RNA, 20 nt, Human
ugucacccaggcuggagugc

SEQ ID NO: 1099985 - RNA, 20 nt, Human
ugugaccucagguguuccug

SEQ ID NO: 1099986 - RNA, 18 nt, Human
uguuccucuccuagucuc

SEQ ID NO: 1099987 - RNA, 21 nt, Human
uucaagcaauucuccugccuc

SEQ ID NO: 1099988 - RNA, 24 nt, Human
uucaagcaauucuccugccucagu

SEQ ID NO: 1099989 - RNA, 24 nt, Human
uugagcccaugaaacaucgcugua

SEQ ID NO: 1099990 - RNA, 20 nt, Human
uugcuccuuuaccugccuuc

SEQ ID NO: 1099991 - RNA, 23 nt, Human
uugggaagcugagauggcaggau

SEQ ID NO: 1099992 - RNA, 21 nt, Human
uuucaucacguuggccaggcu

SEQ ID NO: 1099993 - RNA, 23 nt, Human
uuuggaauaagacauuggccuaa

SEQ ID NO: 1099994 - RNA, 23 nt, Human
uuuucaguacagaugggguuuca

SEQ ID NO: 1099995 - RNA, 24 nt, Human
uuuuuuuuuuuugacacggagucu

SEQ ID NO: 1099996 - RNA, 21 nt, Human
aaaaaaaaaagaaaacaaaua

SEQ ID NO: 1099997 - RNA, 27 nt, Human
aaaaacucaacaccaacaacaaaaacc

SEQ ID NO: 1099998 - RNA, 24 nt, Human
aaaaaugaacaaaggacuugaaua

SEQ ID NO: 1099999 - RNA, 20 nt, Human
aaaacaaauagccaguaaac

SEQ ID NO: 1100000 - RNA, 19 nt, Human
aaaagcuucccaacacugg

SEQ ID NO: 1100001 - RNA, 22 nt, Human
aaaagcuucccaacacuggagg

SEQ ID NO: 1100002 - RNA, 23 nt, Human
aaaauggaucaaauaccuaaaug

SEQ ID NO: 1100003 - RNA, 24 nt, Human
aaagaugggggcaacaauaacaac

SEQ ID NO: 1100004 - RNA, 24 nt, Human
aaagugcggggauuacagguguga

SEQ ID NO: 1100005 - RNA, 22 nt, Human
aacaauaacaacaaaauagaca

SEQ ID NO: 1100006 - RNA, 21 nt, Human
aacaccaacaacaaaaaccaa

SEQ ID NO: 1100007 - RNA, 19 nt, Human
aacauggugaaaccccguc

SEQ ID NO: 1100008 - RNA, 20 nt, Human
aacauggugaaaccccgucu

SEQ ID NO: 1100009 - RNA, 21 nt, Human
aacauggugaaaccccgucuc

SEQ ID NO: 1100010 - RNA, 22 nt, Human
aagaaaacauauggcaaaagcu

SEQ ID NO: 1100011 - RNA, 21 nt, Human
aagcaacccaaaaaugaacaa

SEQ ID NO: 1100012 - RNA, 24 nt, Human
aagcaacccaaaaaugaacaaagg

SEQ ID NO: 1100013 - RNA, 20 nt, Human
aagcuucccaacacuggauu

SEQ ID NO: 1100014 - RNA, 24 nt, Human
aagugauccaccugccucggccuu

SEQ ID NO: 1100015 - RNA, 25 nt, Human
aagugauucucccaccucggccuuc

SEQ ID NO: 1100016 - RNA, 22 nt, Human
aauagugcuggaaaaaacggau

SEQ ID NO: 1100017 - RNA, 21 nt, Human
acaaaaaccaagcaacccaaa

SEQ ID NO: 1100018 - RNA, 25 nt, Human
acaaaaauuaacucaaaauggauca

SEQ ID NO: 1100019 - RNA, 21 nt, Human
acaccaaagaugggggcaaca

SEQ ID NO: 1100020 - RNA, 25 nt, Human
acaccacggagcacaggucagaaac

SEQ ID NO: 1100021 - RNA, 21 nt, Human
accaacaacaaaaaccaagca

SEQ ID NO: 1100022 - RNA, 23 nt, Human
accaagcaacccaaaaaugaaca

SEQ ID NO: 1100023 - RNA, 24 nt, Human
accauguuggccaggcuggucucg

SEQ ID NO: 1100024 - RNA, 18 nt, Human
accccgucucuguuaaaa

SEQ ID NO: 1100025 - RNA, 20 nt, Human
accucggccuucugaguagc

SEQ ID NO: 1100026 - RNA, 24 nt, Human
accugaggucaggaguucgagacc

SEQ ID NO: 1100027 - RNA, 18 nt, Human
acgggguuucaccauguu

SEQ ID NO: 1100028 - RNA, 23 nt, Human
acgggguuucaccauguuggcca

SEQ ID NO: 1100029 - RNA, 24 nt, Human
acgggguuucaccauguuggccag

SEQ ID NO: 1100030 - RNA, 19 nt, Human
acuggagugcaguggcgcg

SEQ ID NO: 1100031 - RNA, 21 nt, Human
acuuugugcaucaaaaaacca

SEQ ID NO: 1100032 - RNA, 21 nt, Human
agaagaaaacauauggcaaaa

SEQ ID NO: 1100033 - RNA, 23 nt, Human
agacucgaggcgaggcgaggcga

SEQ ID NO: 1100034 - RNA, 24 nt, Human
agcacauugggaggcugaggcggg

SEQ ID NO: 1100035 - RNA, 22 nt, Human
agccuggccaacauggugaaac

SEQ ID NO: 1100036 - RNA, 24 nt, Human
agccuggccaacauggugaaaccc

SEQ ID NO: 1100037 - RNA, 26 nt, Human
aggaggagcgaggagucucgggccca

SEQ ID NO: 1100038 - RNA, 21 nt, Human
aggcagcuccuaaaaaacuca

SEQ ID NO: 1100039 - RNA, 22 nt, Human
aggcggguggaucaccugaggu

SEQ ID NO: 1100040 - RNA, 26 nt, Human
aggcggguggaucaccugaggucagg

SEQ ID NO: 1100041 - RNA, 24 nt, Human
aggcugaaguacaguggcgugauc

SEQ ID NO: 1100042 - RNA, 21 nt, Human
aggcugaggcggguggaucac

SEQ ID NO: 1100043 - RNA, 24 nt, Human
aggcugaggcggguggaucaccug

SEQ ID NO: 1100044 - RNA, 22 nt, Human
agggaucauuucccuuuuucug

SEQ ID NO: 1100045 - RNA, 24 nt, Human
aggugcgguggcucaugccuguaa

SEQ ID NO: 1100046 - RNA, 21 nt, Human
agguggagguugcaaugagcc

SEQ ID NO: 1100047 - RNA, 24 nt, Human
agguggagguugcaaugagccgag

SEQ ID NO: 1100048 - RNA, 19 nt, Human
aguacaguggcgugaucau

SEQ ID NO: 1100049 - RNA, 20 nt, Human
aguacaguggcgugaucaug

SEQ ID NO: 1100050 - RNA, 19 nt, Human
aguagcugggauuauaggc

SEQ ID NO: 1100051 - RNA, 21 nt, Human
aguagcugggauuauaggcau

SEQ ID NO: 1100052 - RNA, 20 nt, Human
agugcaguggcgcgaucucg

SEQ ID NO: 1100053 - RNA, 23 nt, Human
agugcaguggcgcgaucucggcu

SEQ ID NO: 1100054 - RNA, 24 nt, Human
agugcaguggcgcgaucucggcuc

SEQ ID NO: 1100055 - RNA, 18 nt, Human
agugcuggaaaaaacgga

SEQ ID NO: 1100056 - RNA, 21 nt, Human
aucaccugaggucaggaguuc

SEQ ID NO: 1100057 - RNA, 24 nt, Human
aucaugccacugcacuccagccug

SEQ ID NO: 1100058 - RNA, 18 nt, Human
aucugaaucaauguagag

SEQ ID NO: 1100059 - RNA, 21 nt, Human
augccacugcacuccagccug

SEQ ID NO: 1100060 - RNA, 19 nt, Human
augccuguaaucccagcac

SEQ ID NO: 1100061 - RNA, 23 nt, Human
augccuguaaucccagcacauug

SEQ ID NO: 1100062 - RNA, 24 nt, Human
augggggcaacaauaacaacaaaa

SEQ ID NO: 1100063 - RNA, 25 nt, Human
auucuguugcccaaacuggagugca

SEQ ID NO: 1100064 - RNA, 22 nt, Human
auuuuuguauuuuuaguagaga

SEQ ID NO: 1100065 - RNA, 24 nt, Human
auuuuuguauuuuuaguagagacg

SEQ ID NO: 1100066 - RNA, 24 nt, Human
caaagugcggggauuacaggugug

SEQ ID NO: 1100067 - RNA, 22 nt, Human
caaauaaaaacuacaacaaaag

SEQ ID NO: 1100068 - RNA, 23 nt, Human
caacaaaaaccaagcaacccaaa

SEQ ID NO: 1100069 - RNA, 26 nt, Human
caacaaaaaccaagcaacccaaaaau

SEQ ID NO: 1100070 - RNA, 25 nt, Human
caacaacaaaaaccaagcaacccaa

SEQ ID NO: 1100071 - RNA, 23 nt, Human
caacaccaacaacaaaaaccaag

SEQ ID NO: 1100072 - RNA, 23 nt, Human
caacauggugaaaccccgucucu

SEQ ID NO: 1100073 - RNA, 24 nt, Human
caacauggugaaaccccgucucug

SEQ ID NO: 1100074 - RNA, 22 nt, Human
caagugauccaccugccucggc

SEQ ID NO: 1100075 - RNA, 27 nt, Human
caagugaucuucccaucucagccuucc

SEQ ID NO: 1100076 - RNA, 22 nt, Human
caagugauucucccaccucggc

SEQ ID NO: 1100077 - RNA, 24 nt, Human
cacaccacuacgccuggcuaauuu

SEQ ID NO: 1100078 - RNA, 24 nt, Human
cacaccuguaaucucagcuacuug

SEQ ID NO: 1100079 - RNA, 21 nt, Human
cacaggucagaaacaagggag

SEQ ID NO: 1100080 - RNA, 22 nt, Human
cacauugggaggcugaggcggg

SEQ ID NO: 1100081 - RNA, 19 nt, Human
caccaaagaugggggcaac

SEQ ID NO: 1100082 - RNA, 20 nt, Human
caccaaagaugggggcaaca

SEQ ID NO: 1100083 - RNA, 19 nt, Human
caccaacaacaaaaaccaa

SEQ ID NO: 1100084 - RNA, 20 nt, Human
caccaacaacaaaaaccaag

SEQ ID NO: 1100085 - RNA, 19 nt, Human
caccaugccuugcucauuu

SEQ ID NO: 1100086 - RNA, 21 nt, Human
caccauguuggccaggcuggu

SEQ ID NO: 1100087 - RNA, 24 nt, Human
caccauguuggccaggcuggucuc

SEQ ID NO: 1100088 - RNA, 27 nt, Human
caccauguuggccaggcuggucucgaa

SEQ ID NO: 1100089 - RNA, 23 nt, Human
caccugaggucaggaguucgaga

SEQ ID NO: 1100090 - RNA, 23 nt, Human
caccugccucggccuuccaaagu

SEQ ID NO: 1100091 - RNA, 23 nt, Human
caccuguaaucucagcuacuugg

SEQ ID NO: 1100092 - RNA, 24 nt, Human
caccuguaaucucagcuacuuggg

SEQ ID NO: 1100093 - RNA, 24 nt, Human
cacuacgccuggcuaauuuuugua

SEQ ID NO: 1100094 - RNA, 23 nt, Human
cacugcaaccucugucuccuggg

SEQ ID NO: 1100095 - RNA, 18 nt, Human
cacugcacuccagccuga

SEQ ID NO: 1100096 - RNA, 27 nt, Human
cacugcacuccagccugauuuuugaca

SEQ ID NO: 1100097 - RNA, 21 nt, Human
cacuggcagagcaucagguga

SEQ ID NO: 1100098 - RNA, 22 nt, Human
cagcacauugggaggcugaggc

SEQ ID NO: 1100099 - RNA, 24 nt, Human
cagcacauugggaggcugaggcgg

SEQ ID NO: 1100100 - RNA, 23 nt, Human
cagcuccuaaaaaacucaacacc

SEQ ID NO: 1100101 - RNA, 27 nt, Human
caucucagccuuccaaguagcugggga

SEQ ID NO: 1100102 - RNA, 24 nt, Human
cauguuggccaggcuggucucgaa

SEQ ID NO: 1100103 - RNA, 24 nt, Human
cauucuguugcccaaacuggagug

SEQ ID NO: 1100104 - RNA, 21 nt, Human
ccaaagugcggggauuacagg

SEQ ID NO: 1100105 - RNA, 21 nt, Human
ccaaagugcggggauuacagg

SEQ ID NO: 1100106 - RNA, 24 nt, Human
ccaaagugcggggauuacaggugu

SEQ ID NO: 1100107 - RNA, 20 nt, Human
ccaauaucaacaaauucaaa

SEQ ID NO: 1100108 - RNA, 23 nt, Human
ccaccucggccuucugaguagcu

SEQ ID NO: 1100109 - RNA, 18 nt, Human
ccacugcacuccagccug

SEQ ID NO: 1100110 - RNA, 19 nt, Human
ccacugcacuccagccuga

SEQ ID NO: 1100111 - RNA, 20 nt, Human
ccacugcacuccagccugau

SEQ ID NO: 1100112 - RNA, 18 nt, Human
ccaggauauagaggcagc

SEQ ID NO: 1100113 - RNA, 20 nt, Human
ccggggcucaagugaucuuc

SEQ ID NO: 1100114 - RNA, 23 nt, Human
ccucauucuguugcccaaacugg

SEQ ID NO: 1100115 - RNA, 24 nt, Human
ccucauucuguugcccaaacugga

SEQ ID NO: 1100116 - RNA, 22 nt, Human
ccugaggucaggaguucgagac

SEQ ID NO: 1100117 - RNA, 21 nt, Human
ccugaucucaagugauccacc

SEQ ID NO: 1100118 - RNA, 23 nt, Human
ccugaucucaagugauccaccug

SEQ ID NO: 1100119 - RNA, 23 nt, Human
ccuggccaacauggugaaacccc

SEQ ID NO: 1100120 - RNA, 24 nt, Human
ccuggccaacauggugaaaccccg

SEQ ID NO: 1100121 - RNA, 21 nt, Human
ccugggauucaagugauucuc

SEQ ID NO: 1100122 - RNA, 20 nt, Human
ccuguaaucccagcacauug

SEQ ID NO: 1100123 - RNA, 22 nt, Human
ccuguaaucccagcacauuggg

SEQ ID NO: 1100124 - RNA, 21 nt, Human
ccuguaaucucagcuacuugg

SEQ ID NO: 1100125 - RNA, 24 nt, Human
cgagaccagccuggccaacauggu

SEQ ID NO: 1100126 - RNA, 20 nt, Human
cgaggaggagcgaggagucu

SEQ ID NO: 1100127 - RNA, 22 nt, Human
cgaggaggagcgaggagucucg

SEQ ID NO: 1100128 - RNA, 19 nt, Human
cggagcacaggucagaaac

SEQ ID NO: 1100129 - RNA, 24 nt, Human
cggguggaucaccugaggucagga

SEQ ID NO: 1100130 - RNA, 23 nt, Human
cuaaacuuuuaaaacucuuagaa

SEQ ID NO: 1100131 - RNA, 19 nt, Human
cucaacaccaacaacaaaa

SEQ ID NO: 1100132 - RNA, 21 nt, Human
cucaagugauccaccugccuc

SEQ ID NO: 1100133 - RNA, 21 nt, Human
cucaagugauccaccugccuc

SEQ ID NO: 1100134 - RNA, 24 nt, Human
cucaagugaucuucccaucucagc

SEQ ID NO: 1100135 - RNA, 24 nt, Human
cucacugcaaccucugucuccugg

SEQ ID NO: 1100136 - RNA, 25 nt, Human
cucaugccuguaaucccagcacauu

SEQ ID NO: 1100137 - RNA, 21 nt, Human
cuccugggauucaagugauuc

SEQ ID NO: 1100138 - RNA, 22 nt, Human
cuccugggauucaagugauucu

SEQ ID NO: 1100139 - RNA, 24 nt, Human
cuccugggauucaagugauucucc

SEQ ID NO: 1100140 - RNA, 24 nt, Human
cucggccuucugaguagcugggau

SEQ ID NO: 1100141 - RNA, 29 nt, Human
cugaggcaagagaaucuggaagguggagg

SEQ ID NO: 1100142 - RNA, 29 nt, Human
cugaggcaagagaaucuggaagguggagg

SEQ ID NO: 1100143 - RNA, 24 nt, Human
cugaguagcugggauuauaggcau

SEQ ID NO: 1100144 - RNA, 25 nt, Human
cugcaaccucugucuccugggauuc

SEQ ID NO: 1100145 - RNA, 21 nt, Human
cuguaaucucagcuacuuggg

SEQ ID NO: 1100146 - RNA, 26 nt, Human
cuucccaucucagccuuccaaguagc

SEQ ID NO: 1100147 - RNA, 24 nt, Human
gagacgggguuucaccauguuggc

SEQ ID NO: 1100148 - RNA, 20 nt, Human
gagaucagagacaccacgga

SEQ ID NO: 1100149 - RNA, 23 nt, Human
gagaucaugccacugcacuccag

SEQ ID NO: 1100150 - RNA, 23 nt, Human
gagauggggucucucccaugggc

SEQ ID NO: 1100151 - RNA, 23 nt, Human
gaggcggguggaucaccugaggu

SEQ ID NO: 1100152 - RNA, 22 nt, Human
gagguugcaaugagccgagauc

SEQ ID NO: 1100153 - RNA, 22 nt, Human
gaguagcugggauuauaggcau

SEQ ID NO: 1100154 - RNA, 18 nt, Human
gagugaguccugggaggg

SEQ ID NO: 1100155 - RNA, 24 nt, Human
gauauagaggcagcuccuaaaaaa

SEQ ID NO: 1100156 - RNA, 24 nt, Human
gaucaccugaggucaggaguucga

SEQ ID NO: 1100157 - RNA, 21 nt, Human
gauuacaggugugaaccaccg

SEQ ID NO: 1100158 - RNA, 22 nt, Human
gauuauaggcauccaccaccau

SEQ ID NO: 1100159 - RNA, 23 nt, Human
gcaagagaaucuggaagguggag

SEQ ID NO: 1100160 - RNA, 24 nt, Human
gccaacauggugaaaccccgucuc

SEQ ID NO: 1100161 - RNA, 20 nt, Human
gccgagaucaugccacugca

SEQ ID NO: 1100162 - RNA, 18 nt, Human
gcgaggcgaggaggagcg

SEQ ID NO: 1100163 - RNA, 20 nt, Human
gcucaagugaucuucccauc

SEQ ID NO: 1100164 - RNA, 22 nt, Human
gcuccaaaaaaaaaaaaaaaaa

SEQ ID NO: 1100165 - RNA, 19 nt, Human
gcugaaguacaguggcgug

SEQ ID NO: 1100166 - RNA, 20 nt, Human
ggaaaaaacggauauccaca

SEQ ID NO: 1100167 - RNA, 23 nt, Human
ggaaaaaacggauauccacaugu

SEQ ID NO: 1100168 - RNA, 18 nt, Human
ggagcacaggucagaaac

SEQ ID NO: 1100169 - RNA, 18 nt, Human
ggagguugcaaugagccg

SEQ ID NO: 1100170 - RNA, 24 nt, Human
ggagguugcaaugagccgagauca

SEQ ID NO: 1100171 - RNA, 22 nt, Human
ggaucaccugaggucaggaguu

SEQ ID NO: 1100172 - RNA, 22 nt, Human
ggcagggggagaucagagacac

SEQ ID NO: 1100173 - RNA, 23 nt, Human
ggcgugguggugcacaccuguaa

SEQ ID NO: 1100174 - RNA, 24 nt, Human
ggcuggucucgaacuccugaucuc

SEQ ID NO: 1100175 - RNA, 22 nt, Human
gggauuacaggugugaaccacc

SEQ ID NO: 1100176 - RNA, 22 nt, Human
gggauuacaggugugaaccacc

SEQ ID NO: 1100177 - RNA, 23 nt, Human
gggauuacaggugugaaccaccg

SEQ ID NO: 1100178 - RNA, 19 nt, Human
ggggauuacaggugugaac

SEQ ID NO: 1100179 - RNA, 24 nt, Human
ggggauuacaggugugaaccaccg

SEQ ID NO: 1100180 - RNA, 24 nt, Human
ggggcucaagugaucuucccaucu

SEQ ID NO: 1100181 - RNA, 23 nt, Human
gggguuucaccauguuggccagg

SEQ ID NO: 1100182 - RNA, 22 nt, Human
ggguuucaccauguuggccagg

SEQ ID NO: 1100183 - RNA, 21 nt, Human
gguggaucaccugaggucagg

SEQ ID NO: 1100184 - RNA, 23 nt, Human
gguggcucaugccuguaauccca

SEQ ID NO: 1100185 - RNA, 24 nt, Human
gguggcucaugccuguaaucccag

SEQ ID NO: 1100186 - RNA, 24 nt, Human
gguggugcacaccuguaaucucag

SEQ ID NO: 1100187 - RNA, 23 nt, Human
guagagacgggguuucaccaugu

SEQ ID NO: 1100188 - RNA, 23 nt, Human
guagagauggggucucucccaug

SEQ ID NO: 1100189 - RNA, 20 nt, Human
guagcugggauuauaggcau

SEQ ID NO: 1100190 - RNA, 19 nt, Human
guauuuuuuguagagaugg

SEQ ID NO: 1100191 - RNA, 24 nt, Human
gugauccaccugccucggccuucc

SEQ ID NO: 1100192 - RNA, 24 nt, Human
gugaucuucccaucucagccuucc

SEQ ID NO: 1100193 - RNA, 24 nt, Human
gugauucucccaccucggccuucu

SEQ ID NO: 1100194 - RNA, 18 nt, Human
guugcaaugagccgagau

SEQ ID NO: 1100195 - RNA, 25 nt, Human
uaaaaaacucaacaccaacaacaaa

SEQ ID NO: 1100196 - RNA, 24 nt, Human
uaauuuuuguauuuuuuguagaga

SEQ ID NO: 1100197 - RNA, 19 nt, Human
uagaagaaaacauauggca

SEQ ID NO: 1100198 - RNA, 22 nt, Human
uagaagaaaacauauggcaaaa

SEQ ID NO: 1100199 - RNA, 20 nt, Human
uagagacaucagcaauccag

SEQ ID NO: 1100200 - RNA, 22 nt, Human
uagagacgggguuucaccaugu

SEQ ID NO: 1100201 - RNA, 20 nt, Human
uaggcauccaccaccaugcc

SEQ ID NO: 1100202 - RNA, 22 nt, Human
uaggcauccaccaccaugccuu

SEQ ID NO: 1100203 - RNA, 24 nt, Human
uaguagagacgggguuucaccaug

SEQ ID NO: 1100204 - RNA, 26 nt, Human
uaguagagacgggguuucaccauguu

SEQ ID NO: 1100205 - RNA, 18 nt, Human
ucaaauaccuaaauguaa

SEQ ID NO: 1100206 - RNA, 24 nt, Human
ucaacaccaacaacaaaaaccaag

SEQ ID NO: 1100207 - RNA, 21 nt, Human
ucaagugauccaccugccucg

SEQ ID NO: 1100208 - RNA, 26 nt, Human
ucaauguagagacaucagcaauccac

SEQ ID NO: 1100209 - RNA, 20 nt, Human
ucaccugaggucaggaguuc

SEQ ID NO: 1100210 - RNA, 24 nt, Human
ucacugcaaccucugucuccuggg

SEQ ID NO: 1100211 - RNA, 25 nt, Human
ucagaccaggugcgguggcucaugc

SEQ ID NO: 1100212 - RNA, 22 nt, Human
ucagagacaccacggagcacag

SEQ ID NO: 1100213 - RNA, 23 nt, Human
ucaugccacugcacuccagccug

SEQ ID NO: 1100214 - RNA, 22 nt, Human
ucaugccuguaaucccagcaca

SEQ ID NO: 1100215 - RNA, 24 nt, Human
ucauuuuuguauuuuuaguagaga

SEQ ID NO: 1100216 - RNA, 25 nt, Human
uccaaaaaaaaaaaaaaaaaaagaa

SEQ ID NO: 1100217 - RNA, 23 nt, Human
uccaaguagcuggggaauccagg

SEQ ID NO: 1100218 - RNA, 23 nt, Human
uccaaguagcuggggaauccagg

SEQ ID NO: 1100219 - RNA, 22 nt, Human
uccacauguaagagaauaaagu

SEQ ID NO: 1100220 - RNA, 22 nt, Human
ucgcuccaaaaaaaaaaaaaaa

SEQ ID NO: 1100221 - RNA, 23 nt, Human
ucgcuccaaaaaaaaaaaaaaaa

SEQ ID NO: 1100222 - RNA, 23 nt, Human
ucgcuuugucacugaaggucggc

SEQ ID NO: 1100223 - RNA, 23 nt, Human
ucggccuucugaguagcugggau

SEQ ID NO: 1100224 - RNA, 21 nt, Human
ucuaggcugcagugcuguggu

SEQ ID NO: 1100225 - RNA, 21 nt, Human
ucucgaacuccugaucucaag

SEQ ID NO: 1100226 - RNA, 23 nt, Human
ucugaguagcugggauuauaggc

SEQ ID NO: 1100227 - RNA, 24 nt, Human
ucugaguagcugggauuauaggca

SEQ ID NO: 1100228 - RNA, 18 nt, Human
ucuggaagguggagguug

SEQ ID NO: 1100229 - RNA, 24 nt, Human
ucuguugcccaaacuggagugcag

SEQ ID NO: 1100230 - RNA, 19 nt, Human
ucuuaaacuugaucagacc

SEQ ID NO: 1100231 - RNA, 23 nt, Human
ucuuagaagaaaacauauggcaa

SEQ ID NO: 1100232 - RNA, 18 nt, Human
ucuugcucuguugucuag

SEQ ID NO: 1100233 - RNA, 20 nt, Human
ucuugcucuguugucuaggc

SEQ ID NO: 1100234 - RNA, 22 nt, Human
ucuugcucuguugucuaggcug

SEQ ID NO: 1100235 - RNA, 22 nt, Human
ugaaaaggugcucaacaucacu

SEQ ID NO: 1100236 - RNA, 21 nt, Human
ugaacaaaggacuugaauagg

SEQ ID NO: 1100237 - RNA, 19 nt, Human
ugaaguacaguggcgugau

SEQ ID NO: 1100238 - RNA, 22 nt, Human
ugagauggagccucauucuguu

SEQ ID NO: 1100239 - RNA, 22 nt, Human
ugagccgagaucaugccacugc

SEQ ID NO: 1100240 - RNA, 22 nt, Human
ugaggcaagagaaucuggaagg

SEQ ID NO: 1100241 - RNA, 20 nt, Human
ugaggcggguggaucaccug

SEQ ID NO: 1100242 - RNA, 22 nt, Human
ugaggcggguggaucaccugag

SEQ ID NO: 1100243 - RNA, 24 nt, Human
ugaggcggguggaucaccugaggu

SEQ ID NO: 1100244 - RNA, 26 nt, Human
ugaggcggguggaucaccugagguca

SEQ ID NO: 1100245 - RNA, 24 nt, Human
ugaguccugggagggauguuccuu

SEQ ID NO: 1100246 - RNA, 24 nt, Human
ugaucucaagugauccaccugccu

SEQ ID NO: 1100247 - RNA, 22 nt, Human
ugcaaugagccgagaucaugcc

SEQ ID NO: 1100248 - RNA, 25 nt, Human
ugcaucaaaaaaccaauaucaacaa

SEQ ID NO: 1100249 - RNA, 19 nt, Human
ugccaagaccauuuaaugg

SEQ ID NO: 1100250 - RNA, 20 nt, Human
ugccaagaccauuuaauggg

SEQ ID NO: 1100251 - RNA, 21 nt, Human
ugcccaaacuggagugcagug

SEQ ID NO: 1100252 - RNA, 24 nt, Human
ugcccaaacuggagugcaguggcg

SEQ ID NO: 1100253 - RNA, 23 nt, Human
ugccuguaaucccagcacauugg

SEQ ID NO: 1100254 - RNA, 23 nt, Human
ugccuguaaucccagcacauugg

SEQ ID NO: 1100255 - RNA, 25 nt, Human
ugccuugcucauuuuuguauuuuua

SEQ ID NO: 1100256 - RNA, 24 nt, Human
ugcucaacaucacuaaucguuagc

SEQ ID NO: 1100257 - RNA, 21 nt, Human
uggaaaaaacggauauccaca

SEQ ID NO: 1100258 - RNA, 29 nt, Human
uggaagguggagguugcaaugacaacggu

SEQ ID NO: 1100259 - RNA, 24 nt, Human
uggaagguggagguugcaaugagc

SEQ ID NO: 1100260 - RNA, 23 nt, Human
uggagugcaguggcgcgaucucg

SEQ ID NO: 1100261 - RNA, 24 nt, Human
uggagugcaguggcgcgaucucgg

SEQ ID NO: 1100262 - RNA, 24 nt, Human
uggaucaccugaggucaggaguuc

SEQ ID NO: 1100263 - RNA, 27 nt, Human
uggaucaccugaggucaggaguucgag

SEQ ID NO: 1100264 - RNA, 18 nt, Human
uggcagaaugggagaaaa

SEQ ID NO: 1100265 - RNA, 24 nt, Human
uggccaacauggugaaaccccguc

SEQ ID NO: 1100266 - RNA, 24 nt, Human
uggccaggcuggucucgaacuccu

SEQ ID NO: 1100267 - RNA, 22 nt, Human
uggcucaugccuguaaucccag

SEQ ID NO: 1100268 - RNA, 24 nt, Human
uggcucaugccuguaaucccagca

SEQ ID NO: 1100269 - RNA, 20 nt, Human
ugggaggcugaggcaagaga

SEQ ID NO: 1100270 - RNA, 26 nt, Human
ugggaggcugaggcaagagaaucugg

SEQ ID NO: 1100271 - RNA, 23 nt, Human
ugggaggcugaggcggguggauc

SEQ ID NO: 1100272 - RNA, 24 nt, Human
ugggaggcugaggcggguggauca

SEQ ID NO: 1100273 - RNA, 21 nt, Human
ugggauuauaggcauccacca

SEQ ID NO: 1100274 - RNA, 24 nt, Human
ugggauuauaggcauccaccacca

SEQ ID NO: 1100275 - RNA, 23 nt, Human
ugggggcaacaauaacaacaaaa

SEQ ID NO: 1100276 - RNA, 24 nt, Human
ugguggugcacaccuguaaucuca

SEQ ID NO: 1100277 - RNA, 21 nt, Human
uguauuuuuaguagagacggg

SEQ ID NO: 1100278 - RNA, 22 nt, Human
ugucuaggcugcagugcugugg

SEQ ID NO: 1100279 - RNA, 23 nt, Human
ugucuaggcugcagugcuguggu

SEQ ID NO: 1100280 - RNA, 24 nt, Human
ugucuaggcugcagugcuguggug

SEQ ID NO: 1100281 - RNA, 18 nt, Human
uuaauggggaaaggacag

SEQ ID NO: 1100282 - RNA, 20 nt, Human
uuagccgggcgugguggugc

SEQ ID NO: 1100283 - RNA, 22 nt, Human
uuagccgggcgugguggugcac

SEQ ID NO: 1100284 - RNA, 18 nt, Human
uuaguagagacgggguuu

SEQ ID NO: 1100285 - RNA, 22 nt, Human
uuaguagagacgggguuucacc

SEQ ID NO: 1100286 - RNA, 24 nt, Human
uuaguagagacgggguuucaccau

SEQ ID NO: 1100287 - RNA, 23 nt, Human
uucaagugauucucccaccucgg

SEQ ID NO: 1100288 - RNA, 24 nt, Human
uucaagugauucucccaccucggc

SEQ ID NO: 1100289 - RNA, 20 nt, Human
uucgcuuugucacugaggcu

SEQ ID NO: 1100290 - RNA, 24 nt, Human
uucugaguagcugggauuauaggc

SEQ ID NO: 1100291 - RNA, 20 nt, Human
uugcaaugagccgagaucau

SEQ ID NO: 1100292 - RNA, 25 nt, Human
uugggaggcugaggcggguggauca

SEQ ID NO: 1100293 - RNA, 25 nt, Human
uuguagagauggggucucucccaug

SEQ ID NO: 1100294 - RNA, 23 nt, Human
uuguauuuuuaguagagacgggg

SEQ ID NO: 1100295 - RNA, 18 nt, Human
uugucacugaggcugaag

SEQ ID NO: 1100296 - RNA, 24 nt, Human
uuucaccauguuggccaggcuggu

SEQ ID NO: 1100297 - RNA, 24 nt, Human
uuucgcuuugucacugaggcugaa

SEQ ID NO: 1100298 - RNA, 18 nt, Human
uuuguagagauggggucu

SEQ ID NO: 1100299 - RNA, 25 nt, Human
uuuguagagauggggucucucccau

SEQ ID NO: 1100300 - RNA, 18 nt, Human
uuuuguuuguuugauuuu

SEQ ID NO: 1100301 - RNA, 24 nt, Human
uuuuuaguagagacgggguuucac

SEQ ID NO: 1100302 - RNA, 23 nt, Human
uuuuuggaucugacaccaaagau

SEQ ID NO: 1100303 - RNA, 20 nt, Human
uuuuuguauuuuuaguagag

SEQ ID NO: 1100304 - RNA, 20 nt, Human
uuuuuguauuuuuuguagag

SEQ ID NO: 1100305 - RNA, 23 nt, Human
uuuuuguauuuuuuguagagaug

SEQ ID NO: 1100306 - RNA, 19 nt, Human
uuuuuuguagagauggggu

SEQ ID NO: 1100307 - RNA, 20 nt, Human
uuuuuuuuuuugaaacaggg

SEQ ID NO: 1100308 - RNA, 21 nt, Human
uuuuuuuuuuuugaaacaggc

SEQ ID NO: 1100309 - RNA, 22 nt, Human
uuuuuuuuuuuugaaacaggcu

SEQ ID NO: 1100310 - RNA, 21 nt, Human
aaaaaaacaaaaaacaaaaac

SEQ ID NO: 1100311 - RNA, 24 nt, Human
aaaaaaacaaaaaacaaaaaccac

SEQ ID NO: 1100312 - RNA, 27 nt, Human
aaaaaaacaaaaaacaaaaaccaccaa

SEQ ID NO: 1100313 - RNA, 23 nt, Human
aaaaaacaaaaaccaccaaaaaa

SEQ ID NO: 1100314 - RNA, 30 nt, Human
aaaaaacaaaaaccaccaaaaaacaaaaaa

SEQ ID NO: 1100315 - RNA, 22 nt, Human
aaaaaacaaaaaccaccaaaag

SEQ ID NO: 1100316 - RNA, 20 nt, Human
aaaaaacagcagcacauuaa

SEQ ID NO: 1100317 - RNA, 26 nt, Human
aaaaacaaaaaacaaaaaccaccaaa

SEQ ID NO: 1100318 - RNA, 28 nt, Human
aaaacaaaaaaaacaaaaaacaaaaacc

SEQ ID NO: 1100319 - RNA, 23 nt, Human
aaaacaaaaaccaccaaaaaaca

SEQ ID NO: 1100320 - RNA, 28 nt, Human
aaaacaaaaaccaccaaaaaacaaaaaa

SEQ ID NO: 1100321 - RNA, 25 nt, Human
aaacaaaaaacaaaaaccaccaaaa

SEQ ID NO: 1100322 - RNA, 31 nt, Human
aaacaaaaaacaaaaaccaccaaaaaacaaa

SEQ ID NO: 1100323 - RNA, 24 nt, Human
aaacaaaaaacagcagcacauuaa

SEQ ID NO: 1100324 - RNA, 22 nt, Human
aaaccaggaagagccaagccgc

SEQ ID NO: 1100325 - RNA, 24 nt, Human
aaacccccucucuauuaaaaagac

SEQ ID NO: 1100326 - RNA, 19 nt, Human
aacaaaaaccaccaaaaaa

SEQ ID NO: 1100327 - RNA, 19 nt, Human
aacacggugaaaccccauc

SEQ ID NO: 1100328 - RNA, 20 nt, Human
aacacggugaaaccccaucu

SEQ ID NO: 1100329 - RNA, 21 nt, Human
aacacggugaaaccccaucuc

SEQ ID NO: 1100330 - RNA, 21 nt, Human
aacacggugaaaccccaucuc

SEQ ID NO: 1100331 - RNA, 23 nt, Human
aaccaccaaaaaacaaaaaacag

SEQ ID NO: 1100332 - RNA, 23 nt, Human
aacccauccucauuccuccucua

SEQ ID NO: 1100333 - RNA, 23 nt, Human
aagccgcgacuccccgcucccca

SEQ ID NO: 1100334 - RNA, 18 nt, Human
aagggcucuaggcccugc

SEQ ID NO: 1100335 - RNA, 19 nt, Human
aagggcucuaggcccugca

SEQ ID NO: 1100336 - RNA, 23 nt, Human
acaaaaaacaaaaaccaccaaaa

SEQ ID NO: 1100337 - RNA, 27 nt, Human
acaaaaaacaaaaaccaccaaaaaaca

SEQ ID NO: 1100338 - RNA, 20 nt, Human
acaaaaaccaccaaaaaaca

SEQ ID NO: 1100339 - RNA, 24 nt, Human
acagagcgagacuccaucucaaaa

SEQ ID NO: 1100340 - RNA, 24 nt, Human
acagaguaagacuccaucucaaaa

SEQ ID NO: 1100341 - RNA, 19 nt, Human
accaaaaaacaaaaaacag

SEQ ID NO: 1100342 - RNA, 22 nt, Human
accacugcacuccagccugggc

SEQ ID NO: 1100343 - RNA, 22 nt, Human
accacugcacuccagccugggc

SEQ ID NO: 1100344 - RNA, 24 nt, Human
accauuaucauccacaucuucacc

SEQ ID NO: 1100345 - RNA, 24 nt, Human
acccaggaggcggagguugcagug

SEQ ID NO: 1100346 - RNA, 24 nt, Human
accccaucucuacuaaaaauacaa

SEQ ID NO: 1100347 - RNA, 20 nt, Human
acccuaggcccuccuuucuu

SEQ ID NO: 1100348 - RNA, 24 nt, Human
accugaggucaggaguucaagacc

SEQ ID NO: 1100349 - RNA, 18 nt, Human
acucaagggcagcucugc

SEQ ID NO: 1100350 - RNA, 24 nt, Human
acugcacuccagccugggcgacag

SEQ ID NO: 1100351 - RNA, 24 nt, Human
acugcacuccagccugggcgacag

SEQ ID NO: 1100352 - RNA, 26 nt, Human
acugcacuccagccugggcgacagag

SEQ ID NO: 1100353 - RNA, 26 nt, Human
acugcacuccagccugggcgacagag

SEQ ID NO: 1100354 - RNA, 20 nt, Human
acuugaacccaggaggcgga

SEQ ID NO: 1100355 - RNA, 22 nt, Human
agaauuacuugaacccaggagg

SEQ ID NO: 1100356 - RNA, 22 nt, Human
agaggggaggccgggcgcagug

SEQ ID NO: 1100357 - RNA, 20 nt, Human
agcacuuugggaagcugagg

SEQ ID NO: 1100358 - RNA, 24 nt, Human
agcacuuugggaggccgaggcggg

SEQ ID NO: 1100359 - RNA, 20 nt, Human
agcaggauggaugucugggg

SEQ ID NO: 1100360 - RNA, 23 nt, Human
agccaggcgugguggugggcgcc

SEQ ID NO: 1100361 - RNA, 24 nt, Human
agccuggccaacauggaaaaaccc

SEQ ID NO: 1100362 - RNA, 24 nt, Human
agccuggcuaacacggugaaaccc

SEQ ID NO: 1100363 - RNA, 24 nt, Human
agccugggcgacagagcgagacuc

SEQ ID NO: 1100364 - RNA, 24 nt, Human
agccugggcgacagaguaagacuc

SEQ ID NO: 1100365 - RNA, 21 nt, Human
agcucaugccuguaaucucag

SEQ ID NO: 1100366 - RNA, 23 nt, Human
agcuggguguggugaugggugcc

SEQ ID NO: 1100367 - RNA, 18 nt, Human
aggcaggagaauggugug

SEQ ID NO: 1100368 - RNA, 22 nt, Human
aggcaggagaauggugugaacc

SEQ ID NO: 1100369 - RNA, 24 nt, Human
aggcaggagaauggugugaaccug

SEQ ID NO: 1100370 - RNA, 18 nt, Human
aggcaggagaauuacuug

SEQ ID NO: 1100371 - RNA, 23 nt, Human
aggcaggagaauuacuugaaccc

SEQ ID NO: 1100372 - RNA, 24 nt, Human
aggcaggagaauuacuugaaccca

SEQ ID NO: 1100373 - RNA, 18 nt, Human
aggcaggcggaucaccug

SEQ ID NO: 1100374 - RNA, 22 nt, Human
aggcaggcggaucaccugaggu

SEQ ID NO: 1100375 - RNA, 26 nt, Human
aggcaggcggaucaccugaggucagg

SEQ ID NO: 1100376 - RNA, 20 nt, Human
aggccgaggcggguggauca

SEQ ID NO: 1100377 - RNA, 22 nt, Human
aggccgggcgcaguggcucacg

SEQ ID NO: 1100378 - RNA, 24 nt, Human
aggcggagcuugcagugagccaag

SEQ ID NO: 1100379 - RNA, 24 nt, Human
aggcggagguugcagugagccaag

SEQ ID NO: 1100380 - RNA, 23 nt, Human
aggcggguggaucaugaggucag

SEQ ID NO: 1100381 - RNA, 24 nt, Human
aggcggguggaucaugaggucaga

SEQ ID NO: 1100382 - RNA, 24 nt, Human
aggcgugguagcucaugccuguaa

SEQ ID NO: 1100383 - RNA, 24 nt, Human
aggcgugguggugggcgccuguag

SEQ ID NO: 1100384 - RNA, 19 nt, Human
aggcugaggcaggagaaug

SEQ ID NO: 1100385 - RNA, 24 nt, Human
aguggcucacgccuguaaucccag

SEQ ID NO: 1100386 - RNA, 21 nt, Human
auauaucuauauauauaugca

SEQ ID NO: 1100387 - RNA, 24 nt, Human
aucaccugaggucaggaguucaag

SEQ ID NO: 1100388 - RNA, 24 nt, Human
aucguaccacugcacuccagccug

SEQ ID NO: 1100389 - RNA, 19 nt, Human
augccuguaaucucagcac

SEQ ID NO: 1100390 - RNA, 20 nt, Human
augggugccuguaaucccag

SEQ ID NO: 1100391 - RNA, 27 nt, Human
caaaacaaaaaaaacaaaaaacaaaaa

SEQ ID NO: 1100392 - RNA, 22 nt, Human
caacauggaaaaacccccucuc

SEQ ID NO: 1100393 - RNA, 25 nt, Human
caacauggaaaaacccccucucuau

SEQ ID NO: 1100394 - RNA, 18 nt, Human
caagagggguauccagca

SEQ ID NO: 1100395 - RNA, 23 nt, Human
caccaaaaaacaaaaaacagcag

SEQ ID NO: 1100396 - RNA, 22 nt, Human
caccaggacugugguuggggac

SEQ ID NO: 1100397 - RNA, 23 nt, Human
caccugaggucaggaguucaaga

SEQ ID NO: 1100398 - RNA, 24 nt, Human
cacgccuguaaucccagcacuuug

SEQ ID NO: 1100399 - RNA, 24 nt, Human
cacuccagccugggcgacagagcg

SEQ ID NO: 1100400 - RNA, 19 nt, Human
cacugcacuccagccuggg

SEQ ID NO: 1100401 - RNA, 19 nt, Human
cacugcacuccagccuggg

SEQ ID NO: 1100402 - RNA, 20 nt, Human
cacugcacuccagccugggc

SEQ ID NO: 1100403 - RNA, 20 nt, Human
cacugcacuccagccugggc

SEQ ID NO: 1100404 - RNA, 20 nt, Human
cacugcacuccagccugggc

SEQ ID NO: 1100405 - RNA, 22 nt, Human
cacugcacuccagccugggcga

SEQ ID NO: 1100406 - RNA, 22 nt, Human
cacugcacuccagccugggcga

SEQ ID NO: 1100407 - RNA, 23 nt, Human
cacugcacuccagccugggcgac

SEQ ID NO: 1100408 - RNA, 24 nt, Human
cacugcacuccagccugggcgaca

SEQ ID NO: 1100409 - RNA, 24 nt, Human
cacugcacuccagccugggcgaca

SEQ ID NO: 1100410 - RNA, 27 nt, Human
cacugcacuccagccugggcgacagag

SEQ ID NO: 1100411 - RNA, 25 nt, Human
cagcaacacgggccaggcgugguag

SEQ ID NO: 1100412 - RNA, 18 nt, Human
cagcacauuaacacucac

SEQ ID NO: 1100413 - RNA, 24 nt, Human
cagcacuuugggaagcugaggcag

SEQ ID NO: 1100414 - RNA, 26 nt, Human
cagcacuuugggaagcugaggcaggc

SEQ ID NO: 1100415 - RNA, 24 nt, Human
cagcacuuugggaggccgaggcgg

SEQ ID NO: 1100416 - RNA, 25 nt, Human
cagcagcaucccugagaugcuuggc

SEQ ID NO: 1100417 - RNA, 19 nt, Human
cagcccaccucccaccugu

SEQ ID NO: 1100418 - RNA, 24 nt, Human
cagcuacuugggaggcugaggcag

SEQ ID NO: 1100419 - RNA, 21 nt, Human
cagcuccccguccccuccucc

SEQ ID NO: 1100420 - RNA, 19 nt, Human
cagcuccuggugcaggugg

SEQ ID NO: 1100421 - RNA, 24 nt, Human
caggcggaucaccugaggucagga

SEQ ID NO: 1100422 - RNA, 20 nt, Human
caggcgugguagcucaugcc

SEQ ID NO: 1100423 - RNA, 27 nt, Human
caucucaaaacaaaaaaaacaaaaaac

SEQ ID NO: 1100424 - RNA, 24 nt, Human
caugccuguaaucucagcacuuug

SEQ ID NO: 1100425 - RNA, 20 nt, Human
ccacugcacuccagccuggg

SEQ ID NO: 1100426 - RNA, 20 nt, Human
ccacugcacuccagccuggg

SEQ ID NO: 1100427 - RNA, 20 nt, Human
ccacugcacuccagccuggg

SEQ ID NO: 1100428 - RNA, 21 nt, Human
ccacugcacuccagccugggc

SEQ ID NO: 1100429 - RNA, 21 nt, Human
ccacugcacuccagccugggc

SEQ ID NO: 1100430 - RNA, 21 nt, Human
ccacugcacuccagccugggc

SEQ ID NO: 1100431 - RNA, 21 nt, Human
ccacugcacuccagccugggc

SEQ ID NO: 1100432 - RNA, 21 nt, Human
ccacugcacuccagccugggc

SEQ ID NO: 1100433 - RNA, 23 nt, Human
ccacugcacuccagccugggcga

SEQ ID NO: 1100434 - RNA, 23 nt, Human
ccacugcacuccagccugggcga

SEQ ID NO: 1100435 - RNA, 23 nt, Human
ccacugcacuccagccugggcga

SEQ ID NO: 1100436 - RNA, 24 nt, Human
ccacugcacuccagccugggcgac

SEQ ID NO: 1100437 - RNA, 24 nt, Human
ccacugcacuccagccugggcgac

SEQ ID NO: 1100438 - RNA, 22 nt, Human
ccaguuggauggguggcgggga

SEQ ID NO: 1100439 - RNA, 23 nt, Human
ccaucaccguggggccuguguua

SEQ ID NO: 1100440 - RNA, 23 nt, Human
ccaucucaaaacaaaaaaaacaa

SEQ ID NO: 1100441 - RNA, 25 nt, Human
ccaucucaaaacaaaaaaaacaaaa

SEQ ID NO: 1100442 - RNA, 22 nt, Human
ccccgcuccccaacccauccuc

SEQ ID NO: 1100443 - RNA, 18 nt, Human
ccccuccuccuucuuguc

SEQ ID NO: 1100444 - RNA, 18 nt, Human
cccuccuccuucuugucu

SEQ ID NO: 1100445 - RNA, 23 nt, Human
cccugcugagagugcucucccca

SEQ ID NO: 1100446 - RNA, 19 nt, Human
ccgguugcuagggcacagg

SEQ ID NO: 1100447 - RNA, 20 nt, Human
ccuccuccuucuugucuuca

SEQ ID NO: 1100448 - RNA, 22 nt, Human
ccugcugagagugcucucccca

SEQ ID NO: 1100449 - RNA, 24 nt, Human
ccuggcuaacacggugaaacccca

SEQ ID NO: 1100450 - RNA, 22 nt, Human
ccugggcgacagagcgagacuc

SEQ ID NO: 1100451 - RNA, 22 nt, Human
ccugggcgacagaguaagacuc

SEQ ID NO: 1100452 - RNA, 21 nt, Human
ccuguaaucccagcuacuugg

SEQ ID NO: 1100453 - RNA, 21 nt, Human
ccuguagucccagcuacuugg

SEQ ID NO: 1100454 - RNA, 25 nt, Human
ccuguggccaucaccguggggccug

SEQ ID NO: 1100455 - RNA, 25 nt, Human
cgacuccccgcuccccaacccaucc

SEQ ID NO: 1100456 - RNA, 24 nt, Human
cgagaccagccuggcuaacacggu

SEQ ID NO: 1100457 - RNA, 23 nt, Human
cgagacuccaucucaaaaaaaaa

SEQ ID NO: 1100458 - RNA, 22 nt, Human
cgaggcggguggaucaugaggu

SEQ ID NO: 1100459 - RNA, 24 nt, Human
cgaggcggguggaucaugagguca

SEQ ID NO: 1100460 - RNA, 23 nt, Human
cgccuguaaucccagcacuuugg

SEQ ID NO: 1100461 - RNA, 24 nt, Human
cgccuguaaucccagcacuuuggg

SEQ ID NO: 1100462 - RNA, 23 nt, Human
cgccuguagucccagcuacuugg

SEQ ID NO: 1100463 - RNA, 24 nt, Human
cgccuguagucccagcuacuuggg

SEQ ID NO: 1100464 - RNA, 24 nt, Human
cggaucaccugaggucaggaguuc

SEQ ID NO: 1100465 - RNA, 20 nt, Human
cuaggcccuccuuucuucug

SEQ ID NO: 1100466 - RNA, 20 nt, Human
cuaggcccugcagggagcuc

SEQ ID NO: 1100467 - RNA, 26 nt, Human
cucaaaacaaaaaaaacaaaaaacaa

SEQ ID NO: 1100468 - RNA, 26 nt, Human
cucaaaacaaaaaaaacaaaaaacaa

SEQ ID NO: 1100469 - RNA, 22 nt, Human
cucacgccuguaaucccagcac

SEQ ID NO: 1100470 - RNA, 24 nt, Human
cucacgccuguaaucccagcacuu

SEQ ID NO: 1100471 - RNA, 20 nt, Human
cucaucagcagcaucccuga

SEQ ID NO: 1100472 - RNA, 22 nt, Human
cucaucagcagcaucccugaga

SEQ ID NO: 1100473 - RNA, 24 nt, Human
cucaugccuguaaucucagcacuu

SEQ ID NO: 1100474 - RNA, 19 nt, Human
cuccaucucaaaaaaaaaa

SEQ ID NO: 1100475 - RNA, 22 nt, Human
cuccuggugcagguggcuacag

SEQ ID NO: 1100476 - RNA, 22 nt, Human
cugaauuccccuuuacacuuua

SEQ ID NO: 1100477 - RNA, 23 nt, Human
cuggcuaacacggugaaacccca

SEQ ID NO: 1100478 - RNA, 20 nt, Human
cugggucucagcuccccguc

SEQ ID NO: 1100479 - RNA, 20 nt, Human
cuucugggucucagcucccc

SEQ ID NO: 1100480 - RNA, 18 nt, Human
gagcuugcagugagccaa

SEQ ID NO: 1100481 - RNA, 23 nt, Human
gagcuugcagugagccaagaucg

SEQ ID NO: 1100482 - RNA, 21 nt, Human
gaggcggagguugcagugagc

SEQ ID NO: 1100483 - RNA, 23 nt, Human
gagguugcagugagccaagaucg

SEQ ID NO: 1100484 - RNA, 21 nt, Human
gaucaccugaggucaggaguu

SEQ ID NO: 1100485 - RNA, 23 nt, Human
gaucaccugaggucaggaguuca

SEQ ID NO: 1100486 - RNA, 24 nt, Human
gaucaccugaggucaggaguucaa

SEQ ID NO: 1100487 - RNA, 26 nt, Human
gaucgccaccacugcacuccagccug

SEQ ID NO: 1100488 - RNA, 21 nt, Human
gcaccauuaucauccacaucu

SEQ ID NO: 1100489 - RNA, 24 nt, Human
gcacuccagccugggcgacagagc

SEQ ID NO: 1100490 - RNA, 24 nt, Human
gcacuccagccugggcgacagagu

SEQ ID NO: 1100491 - RNA, 22 nt, Human
gcaggagaauuacuugaaccca

SEQ ID NO: 1100492 - RNA, 20 nt, Human
gccaagaucguaccacugca

SEQ ID NO: 1100493 - RNA, 18 nt, Human
gcccuccuuucuucuggg

SEQ ID NO: 1100494 - RNA, 23 nt, Human
gccuguagucccagcuacuuggg

SEQ ID NO: 1100495 - RNA, 20 nt, Human
gcgcaguggcucacgccugu

SEQ ID NO: 1100496 - RNA, 23 nt, Human
gcggguggaucaugaggucagau

SEQ ID NO: 1100497 - RNA, 24 nt, Human
gcuaacacggugaaaccccaucuc

SEQ ID NO: 1100498 - RNA, 18 nt, Human
gcucuguccccguccucc

SEQ ID NO: 1100499 - RNA, 18 nt, Human
ggagcucuggggugcagg

SEQ ID NO: 1100500 - RNA, 24 nt, Human
ggagcuugcagugagccaagaucg

SEQ ID NO: 1100501 - RNA, 20 nt, Human
ggagguugcagugagccaag

SEQ ID NO: 1100502 - RNA, 24 nt, Human
ggagguugcagugagccaagaucg

SEQ ID NO: 1100503 - RNA, 23 nt, Human
ggaucaccugaggucaggaguuc

SEQ ID NO: 1100504 - RNA, 25 nt, Human
ggaucaccugaggucaggaguucaa

SEQ ID NO: 1100505 - RNA, 18 nt, Human
ggauggguggcggggagu

SEQ ID NO: 1100506 - RNA, 22 nt, Human
ggcaccauuaucauccacaucu

SEQ ID NO: 1100507 - RNA, 22 nt, Human
ggcagguccagcuccuggugca

SEQ ID NO: 1100508 - RNA, 21 nt, Human
ggccaggcgugguagcucaug

SEQ ID NO: 1100509 - RNA, 23 nt, Human
ggccaggcgugguagcucaugcc

SEQ ID NO: 1100510 - RNA, 24 nt, Human
ggccuccauggcccaggcuauccc

SEQ ID NO: 1100511 - RNA, 23 nt, Human
ggcgcaguggcucacgccuguaa

SEQ ID NO: 1100512 - RNA, 19 nt, Human
gggaaaagagcccaagagc

SEQ ID NO: 1100513 - RNA, 22 nt, Human
ggggagggauguuaauacagca

SEQ ID NO: 1100514 - RNA, 18 nt, Human
gggugccuguaaucccag

SEQ ID NO: 1100515 - RNA, 24 nt, Human
gguagcucaugccuguaaucucag

SEQ ID NO: 1100516 - RNA, 24 nt, Human
ggugaugggugccuguaaucccag

SEQ ID NO: 1100517 - RNA, 24 nt, Human
ggugccuguaaucccagcuacuug

SEQ ID NO: 1100518 - RNA, 24 nt, Human
gguggugggcgccuguagucccag

SEQ ID NO: 1100519 - RNA, 18 nt, Human
uaaaacagcaacacgggc

SEQ ID NO: 1100520 - RNA, 22 nt, Human
uaacacggugaaaccccaucuc

SEQ ID NO: 1100521 - RNA, 24 nt, Human
uaacacggugaaaccccaucucua

SEQ ID NO: 1100522 - RNA, 22 nt, Human
uacaauagaguuaagcaauaaa

SEQ ID NO: 1100523 - RNA, 22 nt, Human
uaccacugcacuccagccuggg

SEQ ID NO: 1100524 - RNA, 22 nt, Human
uagcucaugccuguaaucucag

SEQ ID NO: 1100525 - RNA, 24 nt, Human
uagcucaugccuguaaucucagca

SEQ ID NO: 1100526 - RNA, 22 nt, Human
uauauaucuauauauauaugca

SEQ ID NO: 1100527 - RNA, 22 nt, Human
uauauguauauaucuauauaua

SEQ ID NO: 1100528 - RNA, 18 nt, Human
uauguauauaucuauaua

SEQ ID NO: 1100529 - RNA, 20 nt, Human
uauguauauaucuauauaua

SEQ ID NO: 1100530 - RNA, 18 nt, Human
ucaaaaaaaaaaaagaug

SEQ ID NO: 1100531 - RNA, 18 nt, Human
ucagcuccccguccccuc

SEQ ID NO: 1100532 - RNA, 21 nt, Human
ucaugaggucagaucgagacc

SEQ ID NO: 1100533 - RNA, 23 nt, Human
uccagccugggcgacagagcgag

SEQ ID NO: 1100534 - RNA, 24 nt, Human
uccagccugggcgacagagcgaga

SEQ ID NO: 1100535 - RNA, 24 nt, Human
uccagccugggcgacagaguaaga

SEQ ID NO: 1100536 - RNA, 23 nt, Human
uccaucucaaaacaaaaaaaaca

SEQ ID NO: 1100537 - RNA, 20 nt, Human
ucccucucagaaaccaggaa

SEQ ID NO: 1100538 - RNA, 26 nt, Human
ucccugcugagagugcucuccccacc

SEQ ID NO: 1100539 - RNA, 19 nt, Human
ucgccaccacugcacucca

SEQ ID NO: 1100540 - RNA, 23 nt, Human
ucguaccacugcacuccagccug

SEQ ID NO: 1100541 - RNA, 24 nt, Human
ucucuacuaaaaauacaaaaaauu

SEQ ID NO: 1100542 - RNA, 21 nt, Human
ucucuauuaaaaagacgaaaa

SEQ ID NO: 1100543 - RNA, 19 nt, Human
ugaaaccccaucucuacua

SEQ ID NO: 1100544 - RNA, 20 nt, Human
ugaagggcucuaggcccugc

SEQ ID NO: 1100545 - RNA, 21 nt, Human
ugaagggcucuaggcccugca

SEQ ID NO: 1100546 - RNA, 22 nt, Human
ugagaggggaggccgggcgcag

SEQ ID NO: 1100547 - RNA, 23 nt, Human
ugaggcaggagaauggugugaac

SEQ ID NO: 1100548 - RNA, 24 nt, Human
ugaggcaggagaauggugugaacc

SEQ ID NO: 1100549 - RNA, 25 nt, Human
ugaggcaggagaauggugugaaccu

SEQ ID NO: 1100550 - RNA, 24 nt, Human
ugaggcaggagaauuacuugaacc

SEQ ID NO: 1100551 - RNA, 25 nt, Human
ugaggcaggagaauuacuugaaccc

SEQ ID NO: 1100552 - RNA, 20 nt, Human
ugaggcaggcggaucaccug

SEQ ID NO: 1100553 - RNA, 26 nt, Human
ugaggcaggcggaucaccugagguca

SEQ ID NO: 1100554 - RNA, 20 nt, Human
ugccuguaaucccagcuacu

SEQ ID NO: 1100555 - RNA, 23 nt, Human
ugccuguaaucccagcuacuugg

SEQ ID NO: 1100556 - RNA, 23 nt, Human
ugccuguaaucucagcacuuugg

SEQ ID NO: 1100557 - RNA, 24 nt, Human
ugccuguaaucucagcacuuuggg

SEQ ID NO: 1100558 - RNA, 22 nt, Human
uggaaaaacccccucucuauua

SEQ ID NO: 1100559 - RNA, 24 nt, Human
uggaaaaacccccucucuauuaaa

SEQ ID NO: 1100560 - RNA, 20 nt, Human
uggaaagcugaggcaggaga

SEQ ID NO: 1100561 - RNA, 20 nt, Human
uggcaauacccuaggcccuc

SEQ ID NO: 1100562 - RNA, 18 nt, Human
uggcagcaccuuuaaaac

SEQ ID NO: 1100563 - RNA, 22 nt, Human
uggcucacgccuguaaucccag

SEQ ID NO: 1100564 - RNA, 24 nt, Human
uggcucacgccuguaaucccagca

SEQ ID NO: 1100565 - RNA, 24 nt, Human
ugggaagcugaggcaggcggauca

SEQ ID NO: 1100566 - RNA, 23 nt, Human
ugggaggccgaggcggguggauc

SEQ ID NO: 1100567 - RNA, 24 nt, Human
ugggaggccgaggcggguggauca

SEQ ID NO: 1100568 - RNA, 29 nt, Human
ugggaggcggagcuugcagugacaacggu

SEQ ID NO: 1100569 - RNA, 24 nt, Human
ugggaggcggagcuugcagugagc

SEQ ID NO: 1100570 - RNA, 18 nt, Human
ugggaggcugaggcagga

SEQ ID NO: 1100571 - RNA, 24 nt, Human
ugggaggcugaggcaggagaaugg

SEQ ID NO: 1100572 - RNA, 22 nt, Human
uggggaaaagagcccaagagcc

SEQ ID NO: 1100573 - RNA, 24 nt, Human
ugguagcucaugccuguaaucuca

SEQ ID NO: 1100574 - RNA, 20 nt, Human
uggucaggacauucuggcgg

SEQ ID NO: 1100575 - RNA, 24 nt, Human
uggugaugggugccuguaauccca

SEQ ID NO: 1100576 - RNA, 19 nt, Human
uggugcagguggcuacagg

SEQ ID NO: 1100577 - RNA, 24 nt, Human
ugguggugggcgccuguaguccca

SEQ ID NO: 1100578 - RNA, 24 nt, Human
uuacuugaacccaggaggcggagg

SEQ ID NO: 1100579 - RNA, 24 nt, Human
uuagccaggcgugguggugggcgc

SEQ ID NO: 1100580 - RNA, 24 nt, Human
uuagcuggguguggugaugggugc

SEQ ID NO: 1100581 - RNA, 24 nt, Human
uugaacccaggaggcggagguugc

SEQ ID NO: 1100582 - RNA, 20 nt, Human
uugcagugagccaagaucgc

SEQ ID NO: 1100583 - RNA, 22 nt, Human
uugcagugagccaagaucguac

SEQ ID NO: 1100584 - RNA, 23 nt, Human
uuggaaagcugaggcaggagaau

SEQ ID NO: 1100585 - RNA, 19 nt, Human
uuggauggguggcggggag

SEQ ID NO: 1100586 - RNA, 25 nt, Human
uugggaagcugaggcaggcggauca

SEQ ID NO: 1100587 - RNA, 25 nt, Human
uugggaggccgaggcggguggauca

SEQ ID NO: 1100588 - RNA, 21 nt, Human
uuuggaaaucaaggcaccauu

SEQ ID NO: 1100589 - RNA, 23 nt, Human
aaaaugccuuuaaccccaccucu

SEQ ID NO: 1100590 - RNA, 24 nt, Human
aaaaugccuuuaaccccaccucug

SEQ ID NO: 1100591 - RNA, 24 nt, Human
aaagugcugggauuacagguguga

SEQ ID NO: 1100592 - RNA, 18 nt, Human
aagugcugggauuacagg

SEQ ID NO: 1100593 - RNA, 19 nt, Human
aagugcugggauuacaggu

SEQ ID NO: 1100594 - RNA, 26 nt, Human
aagugcugggauuacaggugugagcc

SEQ ID NO: 1100595 - RNA, 24 nt, Human
accuugugauccgcccgccucggc

SEQ ID NO: 1100596 - RNA, 21 nt, Human
acuacaggugccugccaccau

SEQ ID NO: 1100597 - RNA, 25 nt, Human
acucugucgcccaggcuggagugca

SEQ ID NO: 1100598 - RNA, 20 nt, Human
acugcaagcuccgccuccug

SEQ ID NO: 1100599 - RNA, 19 nt, Human
acuuugcacucauuuggcc

SEQ ID NO: 1100600 - RNA, 19 nt, Human
agagaugggguuucaccgu

SEQ ID NO: 1100601 - RNA, 18 nt, Human
agcuccgccuccuggguu

SEQ ID NO: 1100602 - RNA, 18 nt, Human
aggauggucucgaacucc

SEQ ID NO: 1100603 - RNA, 25 nt, Human
aggcuggagugcaguggcgcgaucu

SEQ ID NO: 1100604 - RNA, 18 nt, Human
aguagcugggacuacagg

SEQ ID NO: 1100605 - RNA, 23 nt, Human
agugcaguggcgcgaucuuggcu

SEQ ID NO: 1100606 - RNA, 24 nt, Human
agugcaguggcgcgaucuuggcuc

SEQ ID NO: 1100607 - RNA, 23 nt, Human
augccuuuaaccccaccucugau

SEQ ID NO: 1100608 - RNA, 18 nt, Human
augggguuucaccguguu

SEQ ID NO: 1100609 - RNA, 19 nt, Human
augggguuucaccguguua

SEQ ID NO: 1100610 - RNA, 21 nt, Human
auucuccugccucagccuccc

SEQ ID NO: 1100611 - RNA, 24 nt, Human
caaagugcugggauuacaggugug

SEQ ID NO: 1100612 - RNA, 24 nt, Human
caccguguuagacaggauggucuc

SEQ ID NO: 1100613 - RNA, 22 nt, Human
cacgccauucuccugccucagc

SEQ ID NO: 1100614 - RNA, 22 nt, Human
cacucugucgcccaggcuggag

SEQ ID NO: 1100615 - RNA, 21 nt, Human
caggugccugccaccaugucc

SEQ ID NO: 1100616 - RNA, 19 nt, Human
caguggcgcgaucuuggcu

SEQ ID NO: 1100617 - RNA, 21 nt, Human
ccaaagugcugggauuacagg

SEQ ID NO: 1100618 - RNA, 21 nt, Human
ccaaagugcugggauuacagg

SEQ ID NO: 1100619 - RNA, 24 nt, Human
ccaaagugcugggauuacaggugu

SEQ ID NO: 1100620 - RNA, 23 nt, Human
cccgaguagcugggacuacaggu

SEQ ID NO: 1100621 - RNA, 24 nt, Human
cccgaguagcugggacuacaggug

SEQ ID NO: 1100622 - RNA, 22 nt, Human
ccgcgcccggccuggcagaacc

SEQ ID NO: 1100623 - RNA, 24 nt, Human
ccuccagcacaucuuuccgagagc

SEQ ID NO: 1100624 - RNA, 23 nt, Human
ccugccucagccucccgaguagc

SEQ ID NO: 1100625 - RNA, 24 nt, Human
ccugccucagccucccgaguagcu

SEQ ID NO: 1100626 - RNA, 24 nt, Human
cgcccaggcuggagugcaguggcg

SEQ ID NO: 1100627 - RNA, 19 nt, Human
cgccuccuggguucacgcc

SEQ ID NO: 1100628 - RNA, 24 nt, Human
cucacucugucgcccaggcuggag

SEQ ID NO: 1100629 - RNA, 24 nt, Human
cucagccucccgaguagcugggac

SEQ ID NO: 1100630 - RNA, 24 nt, Human
cuccugaccuugugauccgcccgc

SEQ ID NO: 1100631 - RNA, 21 nt, Human
cuccuggguucacgccauucu

SEQ ID NO: 1100632 - RNA, 19 nt, Human
cugucgcccaggcuggagu

SEQ ID NO: 1100633 - RNA, 22 nt, Human
gaccuugugauccgcccgccuc

SEQ ID NO: 1100634 - RNA, 24 nt, Human
gaccuugugauccgcccgccucgg

SEQ ID NO: 1100635 - RNA, 24 nt, Human
gacuacaggugccugccaccaugu

SEQ ID NO: 1100636 - RNA, 18 nt, Human
gauuacaggugugagcca

SEQ ID NO: 1100637 - RNA, 20 nt, Human
gauuacaggugugagccacc

SEQ ID NO: 1100638 - RNA, 22 nt, Human
gauuacaggugugagccaccgc

SEQ ID NO: 1100639 - RNA, 19 nt, Human
gcagaaccuucuuaacaag

SEQ ID NO: 1100640 - RNA, 21 nt, Human
gcagaaccuucuuaacaagga

SEQ ID NO: 1100641 - RNA, 20 nt, Human
gcccaggcuggagugcagug

SEQ ID NO: 1100642 - RNA, 25 nt, Human
gccuccuggguucacgccauucucc

SEQ ID NO: 1100643 - RNA, 23 nt, Human
gccucggccucccaaagugcugg

SEQ ID NO: 1100644 - RNA, 19 nt, Human
gcuggagugcaguggcgcg

SEQ ID NO: 1100645 - RNA, 18 nt, Human
gggguuucaccguguuag

SEQ ID NO: 1100646 - RNA, 19 nt, Human
ggucucgaacuccugaccu

SEQ ID NO: 1100647 - RNA, 20 nt, Human
ggucucgaacuccugaccuu

SEQ ID NO: 1100648 - RNA, 24 nt, Human
guccgacuaauuuuuuuguauuuu

SEQ ID NO: 1100649 - RNA, 24 nt, Human
gugauccgcccgccucggccuccc

SEQ ID NO: 1100650 - RNA, 26 nt, Human
uaauuuuuuuguauuuuuaguagaga

SEQ ID NO: 1100651 - RNA, 23 nt, Human
uacaggugugagccaccgcgccc

SEQ ID NO: 1100652 - RNA, 21 nt, Human
uaguagagaugggguuucacc

SEQ ID NO: 1100653 - RNA, 24 nt, Human
uaguagagaugggguuucaccgug

SEQ ID NO: 1100654 - RNA, 26 nt, Human
uaguagagaugggguuucaccguguu

SEQ ID NO: 1100655 - RNA, 24 nt, Human
uaugcuagaagacuagcacaucua

SEQ ID NO: 1100656 - RNA, 19 nt, Human
ucaccguguuagacaggau

SEQ ID NO: 1100657 - RNA, 24 nt, Human
ucaccguguuagacaggauggucu

SEQ ID NO: 1100658 - RNA, 18 nt, Human
ucacugcaagcuccgccu

SEQ ID NO: 1100659 - RNA, 23 nt, Human
ucacugcaagcuccgccuccugg

SEQ ID NO: 1100660 - RNA, 24 nt, Human
ucacugcaagcuccgccuccuggg

SEQ ID NO: 1100661 - RNA, 23 nt, Human
ucagccucccgaguagcugggac

SEQ ID NO: 1100662 - RNA, 23 nt, Human
ucccaaagugcugggauuacagg

SEQ ID NO: 1100663 - RNA, 23 nt, Human
ucccgaguagcugggacuacagg

SEQ ID NO: 1100664 - RNA, 24 nt, Human
ucccgaguagcugggacuacaggu

SEQ ID NO: 1100665 - RNA, 24 nt, Human
uccuggguucacgccauucuccug

SEQ ID NO: 1100666 - RNA, 22 nt, Human
ucgcccaggcuggagugcagug

SEQ ID NO: 1100667 - RNA, 18 nt, Human
ucggccucccaaagugcu

SEQ ID NO: 1100668 - RNA, 22 nt, Human
ucucacucugucgcccaggcug

SEQ ID NO: 1100669 - RNA, 23 nt, Human
ucucacucugucgcccaggcugg

SEQ ID NO: 1100670 - RNA, 24 nt, Human
ucucacucugucgcccaggcugga

SEQ ID NO: 1100671 - RNA, 26 nt, Human
ucucacucugucgcccaggcuggagu

SEQ ID NO: 1100672 - RNA, 24 nt, Human
ucuccugccucagccucccgagua

SEQ ID NO: 1100673 - RNA, 24 nt, Human
ucugucgcccaggcuggagugcag

SEQ ID NO: 1100674 - RNA, 22 nt, Human
ugcaguggcgcgaucuuggcuc

SEQ ID NO: 1100675 - RNA, 24 nt, Human
ugccucagccucccgaguagcugg

SEQ ID NO: 1100676 - RNA, 24 nt, Human
ugccuuuaaccccaccucugauuc

SEQ ID NO: 1100677 - RNA, 24 nt, Human
ugcugggauuacaggugugagcca

SEQ ID NO: 1100678 - RNA, 23 nt, Human
uggagugcaguggcgcgaucuug

SEQ ID NO: 1100679 - RNA, 24 nt, Human
uggagugcaguggcgcgaucuugg

SEQ ID NO: 1100680 - RNA, 18 nt, Human
uggcucacugcaagcucc

SEQ ID NO: 1100681 - RNA, 23 nt, Human
ugggaaaaaugccuuuaacccca

SEQ ID NO: 1100682 - RNA, 21 nt, Human
ugggacuacaggugccugcca

SEQ ID NO: 1100683 - RNA, 22 nt, Human
ugggacuacaggugccugccac

SEQ ID NO: 1100684 - RNA, 24 nt, Human
ugggacuacaggugccugccacca

SEQ ID NO: 1100685 - RNA, 25 nt, Human
ugggacuacaggugccugccaccau

SEQ ID NO: 1100686 - RNA, 18 nt, Human
ugggauuacaggugugag

SEQ ID NO: 1100687 - RNA, 19 nt, Human
ugggauuacaggugugagc

SEQ ID NO: 1100688 - RNA, 21 nt, Human
ugggauuacaggugugagcca

SEQ ID NO: 1100689 - RNA, 22 nt, Human
ugggauuacaggugugagccac

SEQ ID NO: 1100690 - RNA, 23 nt, Human
ugggauuacaggugugagccacc

SEQ ID NO: 1100691 - RNA, 24 nt, Human
ugggauuacaggugugagccaccg

SEQ ID NO: 1100692 - RNA, 24 nt, Human
ugggguuucaccguguuagacagg

SEQ ID NO: 1100693 - RNA, 20 nt, Human
uggguucacgccauucuccu

SEQ ID NO: 1100694 - RNA, 18 nt, Human
ugguggggaaaacagacu

SEQ ID NO: 1100695 - RNA, 18 nt, Human
uuaguagagaugggguuu

SEQ ID NO: 1100696 - RNA, 22 nt, Human
uuaguagagaugggguuucacc

SEQ ID NO: 1100697 - RNA, 24 nt, Human
uuaguagagaugggguuucaccgu

SEQ ID NO: 1100698 - RNA, 23 nt, Human
uuguauuuuuaguagagaugggg

SEQ ID NO: 1100699 - RNA, 20 nt, Human
uuuuguauuuuuaguagaga

SEQ ID NO: 1100700 - RNA, 24 nt, Human
uuuuuaguagagaugggguuucac

SEQ ID NO: 1100701 - RNA, 21 nt, Human
uuuuuguauuuuuaguagaga

SEQ ID NO: 1100702 - RNA, 21 nt, Human
uuuuuuguauuuuuaguagag

SEQ ID NO: 1100703 - RNA, 19 nt, Human
agccgucacuguuggggau

SEQ ID NO: 1100704 - RNA, 18 nt, Human
aucaguucucguucaucu

SEQ ID NO: 1100705 - RNA, 20 nt, Human
cucauggaagcccagcuccc

SEQ ID NO: 1100706 - RNA, 19 nt, Human
gaguuggggagcggggagg

SEQ ID NO: 1100707 - RNA, 20 nt, Human
gucuaggggcggcaugcucc

SEQ ID NO: 1100708 - RNA, 18 nt, Human
guggugcaggggaagccc

SEQ ID NO: 1100709 - RNA, 20 nt, Human
uacagcccuugcagcucggc

SEQ ID NO: 1100710 - RNA, 21 nt, Human
ucccuaucuuucuccggcucc

SEQ ID NO: 1100711 - RNA, 21 nt, Human
uggaagcccagcucccuaucu

SEQ ID NO: 1100712 - RNA, 21 nt, Human
uggggaagggagccgucacug

SEQ ID NO: 1100713 - RNA, 21 nt, Human
ugucguaagaucggaaagagg

SEQ ID NO: 1100714 - RNA, 20 nt, Human
aaacaucccgaaagaaucuc

SEQ ID NO: 1100715 - RNA, 18 nt, Human
auacugagcauaugcggc

SEQ ID NO: 1100716 - RNA, 20 nt, Human
aucucuucuuuuccuuucag

SEQ ID NO: 1100717 - RNA, 21 nt, Human
cagcccccggauuuccccccu

SEQ ID NO: 1100718 - RNA, 25 nt, Human
caucagggccucaugggguccaacg

SEQ ID NO: 1100719 - RNA, 19 nt, Human
ccccgagcccgcggcgccc

SEQ ID NO: 1100720 - RNA, 19 nt, Human
ccccggcugggcccagacc

SEQ ID NO: 1100721 - RNA, 21 nt, Human
cccgcggcgcccccuccccgg

SEQ ID NO: 1100722 - RNA, 21 nt, Human
cccuuuaacucggguggcccc

SEQ ID NO: 1100723 - RNA, 19 nt, Human
ccuuuaacucggguggccc

SEQ ID NO: 1100724 - RNA, 18 nt, Human
cggcgcccccuccccggg

SEQ ID NO: 1100725 - RNA, 22 nt, Human
cggcgcccccuccccgggcugg

SEQ ID NO: 1100726 - RNA, 21 nt, Human
cugggggcaggugccucuccc

SEQ ID NO: 1100727 - RNA, 24 nt, Human
gauccuuuguguuuuccaucaggg

SEQ ID NO: 1100728 - RNA, 21 nt, Human
gcagcagcccccggauuuccc

SEQ ID NO: 1100729 - RNA, 19 nt, Human
ggcaggugccucuccccgg

SEQ ID NO: 1100730 - RNA, 23 nt, Human
gggcaggugccucuccccgggac

SEQ ID NO: 1100731 - RNA, 20 nt, Human
gggcccccggcugggcccag

SEQ ID NO: 1100732 - RNA, 24 nt, Human
ucagauccuuuguguuuuccauca

SEQ ID NO: 1100733 - RNA, 19 nt, Human
ucagggccucauggguagg

SEQ ID NO: 1100734 - RNA, 20 nt, Human
ugcagaggggacggcugcuu

SEQ ID NO: 1100735 - RNA, 20 nt, Human
ugggggcaggugccucuccc

SEQ ID NO: 1100736 - RNA, 23 nt, Human
ugggggcaggugccucuccccgg

SEQ ID NO: 1100737 - RNA, 19 nt, Human
uuccccccuuuaacucggg

SEQ ID NO: 1100738 - RNA, 21 nt, Human
aacagagccagacuccgucuc

SEQ ID NO: 1100739 - RNA, 25 nt, Human
aacugaaauuacaaacauaaggaca

SEQ ID NO: 1100740 - RNA, 24 nt, Human
aagcacuucgggaggccaaggcgg

SEQ ID NO: 1100741 - RNA, 19 nt, Human
aaggacaagccuuuaaagc

SEQ ID NO: 1100742 - RNA, 22 nt, Human
aaugaacaauacaguaacugaa

SEQ ID NO: 1100743 - RNA, 23 nt, Human
acagagccagacuccgucucaaa

SEQ ID NO: 1100744 - RNA, 24 nt, Human
acagagccagacuccgucucaaaa

SEQ ID NO: 1100745 - RNA, 19 nt, Human
acauuccuuugcugcuugu

SEQ ID NO: 1100746 - RNA, 22 nt, Human
accacugcauuccagccugggc

SEQ ID NO: 1100747 - RNA, 24 nt, Human
acccugucucuacuaaaaauacaa

SEQ ID NO: 1100748 - RNA, 21 nt, Human
acgcaagccucuucucucccu

SEQ ID NO: 1100749 - RNA, 24 nt, Human
acugcauuccagccugggcaacag

SEQ ID NO: 1100750 - RNA, 24 nt, Human
acugcauuccagccugggcaacag

SEQ ID NO: 1100751 - RNA, 20 nt, Human
agaacuacuugaaccugaga

SEQ ID NO: 1100752 - RNA, 21 nt, Human
agaagcuuacauuuuggcauu

SEQ ID NO: 1100753 - RNA, 22 nt, Human
agaucaucugaggucaggaguu

SEQ ID NO: 1100754 - RNA, 22 nt, Human
agccuggccaauguggugaaac

SEQ ID NO: 1100755 - RNA, 24 nt, Human
agccuggccaauguggugaaaccc

SEQ ID NO: 1100756 - RNA, 25 nt, Human
agccuggccaauguggugaaacccu

SEQ ID NO: 1100757 - RNA, 24 nt, Human
agccugggcaacagagccagacuc

SEQ ID NO: 1100758 - RNA, 23 nt, Human
agcugcaauuaagagauucauuc

SEQ ID NO: 1100759 - RNA, 20 nt, Human
aggaguuugagaccagccug

SEQ ID NO: 1100760 - RNA, 22 nt, Human
aggcaggagaacuacuugaacc

SEQ ID NO: 1100761 - RNA, 24 nt, Human
aggcaggagaacuacuugaaccug

SEQ ID NO: 1100762 - RNA, 19 nt, Human
aggcauuuuuguccucucu

SEQ ID NO: 1100763 - RNA, 20 nt, Human
aggccaaggcggguagauca

SEQ ID NO: 1100764 - RNA, 26 nt, Human
aggcggguagaucaucugaggucagg

SEQ ID NO: 1100765 - RNA, 24 nt, Human
aggcugaggcaggagaacuacuug

SEQ ID NO: 1100766 - RNA, 19 nt, Human
aggucaggaguuugagacc

SEQ ID NO: 1100767 - RNA, 24 nt, Human
agguggagguugcagugagcugag

SEQ ID NO: 1100768 - RNA, 20 nt, Human
aguaguccuucugaugauug

SEQ ID NO: 1100769 - RNA, 20 nt, Human
aucaucugaggucaggaguu

SEQ ID NO: 1100770 - RNA, 24 nt, Human
aucgcaccacugcauuccagccug

SEQ ID NO: 1100771 - RNA, 24 nt, Human
aucugaggucaggaguuugagacc

SEQ ID NO: 1100772 - RNA, 22 nt, Human
caaaaaaagcaauuacaaccau

SEQ ID NO: 1100773 - RNA, 19 nt, Human
caacccaaaguacgcaagc

SEQ ID NO: 1100774 - RNA, 20 nt, Human
caagaagcuugagagggaaa

SEQ ID NO: 1100775 - RNA, 21 nt, Human
caagcuauggaaaaguagccu

SEQ ID NO: 1100776 - RNA, 26 nt, Human
caaggcggguagaucaucugagguca

SEQ ID NO: 1100777 - RNA, 21 nt, Human
caauggauccaaaugccuccu

SEQ ID NO: 1100778 - RNA, 24 nt, Human
caauguggugaaacccugucucua

SEQ ID NO: 1100779 - RNA, 23 nt, Human
cacaccuguaaucccagcuacuu

SEQ ID NO: 1100780 - RNA, 19 nt, Human
cacauguggcccaauggau

SEQ ID NO: 1100781 - RNA, 24 nt, Human
caccacugcauuccagccugggca

SEQ ID NO: 1100782 - RNA, 23 nt, Human
caccuguaaucccagcuacuugg

SEQ ID NO: 1100783 - RNA, 24 nt, Human
caccuguaaucccagcuacuuggg

SEQ ID NO: 1100784 - RNA, 19 nt, Human
cacgccuguaauucaagca

SEQ ID NO: 1100785 - RNA, 19 nt, Human
cacugcauuccagccuggg

SEQ ID NO: 1100786 - RNA, 22 nt, Human
cacugcauuccagccugggcaa

SEQ ID NO: 1100787 - RNA, 23 nt, Human
cacugcauuccagccugggcaac

SEQ ID NO: 1100788 - RNA, 24 nt, Human
cacugcauuccagccugggcaaca

SEQ ID NO: 1100789 - RNA, 24 nt, Human
cagcuacuugggaggcugaggcag

SEQ ID NO: 1100790 - RNA, 19 nt, Human
caguuaauuaacagggcca

SEQ ID NO: 1100791 - RNA, 18 nt, Human
cauaaaaugguuaagaua

SEQ ID NO: 1100792 - RNA, 24 nt, Human
cauagcaaacaagcuauggaaaag

SEQ ID NO: 1100793 - RNA, 23 nt, Human
caucugaggucaggaguuugaga

SEQ ID NO: 1100794 - RNA, 19 nt, Human
cauuuuggcauuuucuucc

SEQ ID NO: 1100795 - RNA, 21 nt, Human
ccaauagggguacacuuuuuu

SEQ ID NO: 1100796 - RNA, 22 nt, Human
ccaauggauccaaaugccuccu

SEQ ID NO: 1100797 - RNA, 20 nt, Human
ccacugcauuccagccuggg

SEQ ID NO: 1100798 - RNA, 20 nt, Human
ccacugcauuccagccuggg

SEQ ID NO: 1100799 - RNA, 21 nt, Human
ccacugcauuccagccugggc

SEQ ID NO: 1100800 - RNA, 23 nt, Human
ccacugcauuccagccugggcaa

SEQ ID NO: 1100801 - RNA, 24 nt, Human
ccacugcauuccagccugggcaac

SEQ ID NO: 1100802 - RNA, 20 nt, Human
ccuagagaauauuaucccuu

SEQ ID NO: 1100803 - RNA, 19 nt, Human
ccucucucuggucccugca

SEQ ID NO: 1100804 - RNA, 21 nt, Human
ccugagagguggagguugcag

SEQ ID NO: 1100805 - RNA, 21 nt, Human
ccugcaguuaauuaacagggc

SEQ ID NO: 1100806 - RNA, 23 nt, Human
ccugcaguuaauuaacagggcca

SEQ ID NO: 1100807 - RNA, 22 nt, Human
ccuggccaauguggugaaaccc

SEQ ID NO: 1100808 - RNA, 24 nt, Human
ccuggccaauguggugaaacccug

SEQ ID NO: 1100809 - RNA, 21 nt, Human
ccuguaaucccagcuacuugg

SEQ ID NO: 1100810 - RNA, 24 nt, Human
ccuguaauucaagcacuucgggag

SEQ ID NO: 1100811 - RNA, 20 nt, Human
ccuucugaugauugggggcc

SEQ ID NO: 1100812 - RNA, 23 nt, Human
cgccuguaauucaagcacuucgg

SEQ ID NO: 1100813 - RNA, 24 nt, Human
cggguagaucaucugaggucagga

SEQ ID NO: 1100814 - RNA, 24 nt, Human
cuacuugaaccugagagguggagg

SEQ ID NO: 1100815 - RNA, 18 nt, Human
cucaaaaaaaaaaaaaaa

SEQ ID NO: 1100816 - RNA, 24 nt, Human
cucaaguguaaaaaaaggagaaac

SEQ ID NO: 1100817 - RNA, 24 nt, Human
cucacgccuguaauucaagcacuu

SEQ ID NO: 1100818 - RNA, 19 nt, Human
cuccgucucaaaaaaaaaa

SEQ ID NO: 1100819 - RNA, 21 nt, Human
cucucaaaagugaguuccuag

SEQ ID NO: 1100820 - RNA, 24 nt, Human
cucuccacaagcugcaauuaagag

SEQ ID NO: 1100821 - RNA, 23 nt, Human
cugaaauuacaaacauaaggaca

SEQ ID NO: 1100822 - RNA, 24 nt, Human
cuggccaauguggugaaacccugu

SEQ ID NO: 1100823 - RNA, 21 nt, Human
cuguaaucccagcuacuuggg

SEQ ID NO: 1100824 - RNA, 23 nt, Human
gagguugcagugagcugagaucg

SEQ ID NO: 1100825 - RNA, 24 nt, Human
gaucaucugaggucaggaguuuga

SEQ ID NO: 1100826 - RNA, 20 nt, Human
gcaccacugcauuccagccu

SEQ ID NO: 1100827 - RNA, 28 nt, Human
gcaccacugcauuccagccugggcaaca

SEQ ID NO: 1100828 - RNA, 24 nt, Human
gcauuccagccugggcaacagagc

SEQ ID NO: 1100829 - RNA, 24 nt, Human
gccaauguggugaaacccugucuc

SEQ ID NO: 1100830 - RNA, 20 nt, Human
gccucuucucucccuugaug

SEQ ID NO: 1100831 - RNA, 20 nt, Human
gcugagaucgcaccacugca

SEQ ID NO: 1100832 - RNA, 22 nt, Human
ggagguugcagugagcugagau

SEQ ID NO: 1100833 - RNA, 23 nt, Human
ggagguugcagugagcugagauc

SEQ ID NO: 1100834 - RNA, 24 nt, Human
ggagguugcagugagcugagaucg

SEQ ID NO: 1100835 - RNA, 23 nt, Human
ggcaggguggcacacaccuguaa

SEQ ID NO: 1100836 - RNA, 23 nt, Human
ggcgcgggggcucacgccuguaa

SEQ ID NO: 1100837 - RNA, 23 nt, Human
gggaggccaaggcggguagauca

SEQ ID NO: 1100838 - RNA, 24 nt, Human
gggcaggguggcacacaccuguaa

SEQ ID NO: 1100839 - RNA, 20 nt, Human
gggcucacgccuguaauuca

SEQ ID NO: 1100840 - RNA, 21 nt, Human
gguagaucaucugaggucagg

SEQ ID NO: 1100841 - RNA, 19 nt, Human
ggucaggaguuugagacca

SEQ ID NO: 1100842 - RNA, 19 nt, Human
gguggagguugcagugagc

SEQ ID NO: 1100843 - RNA, 23 nt, Human
gguggcacacaccuguaauccca

SEQ ID NO: 1100844 - RNA, 24 nt, Human
gguggcacacaccuguaaucccag

SEQ ID NO: 1100845 - RNA, 21 nt, Human
gugaaacccugucucuacuaa

SEQ ID NO: 1100846 - RNA, 20 nt, Human
guggagguugcagugagcug

SEQ ID NO: 1100847 - RNA, 19 nt, Human
guugcagugagcugagauc

SEQ ID NO: 1100848 - RNA, 21 nt, Human
guugcagugagcugagaucgc

SEQ ID NO: 1100849 - RNA, 23 nt, Human
uaaaauucccaaacacuuuggug

SEQ ID NO: 1100850 - RNA, 20 nt, Human
uaaaucacacauuuucaaga

SEQ ID NO: 1100851 - RNA, 23 nt, Human
uaagauauauucaaauagagaaa

SEQ ID NO: 1100852 - RNA, 22 nt, Human
uacaagaaaugaacaauacagu

SEQ ID NO: 1100853 - RNA, 21 nt, Human
uaccacguugaccaaaguaaa

SEQ ID NO: 1100854 - RNA, 19 nt, Human
uagaaugucuuggacaaaa

SEQ ID NO: 1100855 - RNA, 23 nt, Human
uagaucaucugaggucaggaguu

SEQ ID NO: 1100856 - RNA, 24 nt, Human
uagaucaucugaggucaggaguuu

SEQ ID NO: 1100857 - RNA, 24 nt, Human
uagcaaacaagcuauggaaaagua

SEQ ID NO: 1100858 - RNA, 24 nt, Human
uaguccagaaaaaaaaaaucagug

SEQ ID NO: 1100859 - RNA, 18 nt, Human
uauucuuuuaauacagcu

SEQ ID NO: 1100860 - RNA, 21 nt, Human
uauugccaaaaauggcucaga

SEQ ID NO: 1100861 - RNA, 22 nt, Human
uauuguguacacaaugugcuua

SEQ ID NO: 1100862 - RNA, 23 nt, Human
ucaacccaaaguacgcaagccuc

SEQ ID NO: 1100863 - RNA, 20 nt, Human
ucaguaguccuucugaugau

SEQ ID NO: 1100864 - RNA, 19 nt, Human
ucaucugaggucaggaguu

SEQ ID NO: 1100865 - RNA, 20 nt, Human
uccaaaugccuccucuggcu

SEQ ID NO: 1100866 - RNA, 24 nt, Human
uccagaaaaaaaaaaucaguggua

SEQ ID NO: 1100867 - RNA, 20 nt, Human
ucccaaacacuuuggugucu

SEQ ID NO: 1100868 - RNA, 23 nt, Human
uccgucucaaaaaaaaaaaaaaa

SEQ ID NO: 1100869 - RNA, 25 nt, Human
uccgucucaaaaaaaaaaaaaaaaa

SEQ ID NO: 1100870 - RNA, 24 nt, Human
uccgucucaaaaaaaaaaaaaaag

SEQ ID NO: 1100871 - RNA, 23 nt, Human
ucgcaccacugcauuccagccug

SEQ ID NO: 1100872 - RNA, 21 nt, Human
ucucuacuaaaaauacaaaaa

SEQ ID NO: 1100873 - RNA, 22 nt, Human
ucugaggucaggaguuugagac

SEQ ID NO: 1100874 - RNA, 19 nt, Human
ucugauagaaugucuugga

SEQ ID NO: 1100875 - RNA, 18 nt, Human
ugaaauuacaaacauaag

SEQ ID NO: 1100876 - RNA, 22 nt, Human
ugaaauuacaaacauaaggaca

SEQ ID NO: 1100877 - RNA, 21 nt, Human
ugaacaacagcaaaugggauc

SEQ ID NO: 1100878 - RNA, 23 nt, Human
ugagaccagccuggccaaugugg

SEQ ID NO: 1100879 - RNA, 24 nt, Human
ugagaccagccuggccaauguggu

SEQ ID NO: 1100880 - RNA, 24 nt, Human
ugagagguggagguugcagugagc

SEQ ID NO: 1100881 - RNA, 22 nt, Human
ugagaucaacccaaaguacgca

SEQ ID NO: 1100882 - RNA, 24 nt, Human
ugagaucgcaccacugcauuccag

SEQ ID NO: 1100883 - RNA, 22 nt, Human
ugagcugagaucgcaccacugc

SEQ ID NO: 1100884 - RNA, 20 nt, Human
ugaggcaggagaacuacuug

SEQ ID NO: 1100885 - RNA, 24 nt, Human
ugaggcaggagaacuacuugaacc

SEQ ID NO: 1100886 - RNA, 25 nt, Human
ugaggcaggagaacuacuugaaccu

SEQ ID NO: 1100887 - RNA, 18 nt, Human
ugaggucaggaguuugag

SEQ ID NO: 1100888 - RNA, 19 nt, Human
ugcccugcaaaaaagugac

SEQ ID NO: 1100889 - RNA, 25 nt, Human
uggaaaaguagccuacauuuuggug

SEQ ID NO: 1100890 - RNA, 22 nt, Human
uggcacacaccuguaaucccag

SEQ ID NO: 1100891 - RNA, 24 nt, Human
uggccaauguggugaaacccuguc

SEQ ID NO: 1100892 - RNA, 23 nt, Human
uggcugaacaacagcaaauggga

SEQ ID NO: 1100893 - RNA, 18 nt, Human
ugggaggcugaggcagga

SEQ ID NO: 1100894 - RNA, 19 nt, Human
ugggaggcugaggcaggag

SEQ ID NO: 1100895 - RNA, 19 nt, Human
uggugaaacccugucucua

SEQ ID NO: 1100896 - RNA, 20 nt, Human
ugguucaaccuugcacauga

SEQ ID NO: 1100897 - RNA, 24 nt, Human
uguaaaaaaaggagaaaccuucaa

SEQ ID NO: 1100898 - RNA, 18 nt, Human
uguacacaaugugcuuau

SEQ ID NO: 1100899 - RNA, 22 nt, Human
uuacaaacauaaggacaagccu

SEQ ID NO: 1100900 - RNA, 18 nt, Human
uuagcugggcaggguggc

SEQ ID NO: 1100901 - RNA, 19 nt, Human
uuauagucacauguggccc

SEQ ID NO: 1100902 - RNA, 26 nt, Human
uucccaaacacuuuggugucucuuuc

SEQ ID NO: 1100903 - RNA, 24 nt, Human
uugaaccugagagguggagguugc

SEQ ID NO: 1100904 - RNA, 18 nt, Human
uugcagugagcugagauc

SEQ ID NO: 1100905 - RNA, 19 nt, Human
uugcagugagcugagaucg

SEQ ID NO: 1100906 - RNA, 22 nt, Human
uugcagugagcugagaucgcac

SEQ ID NO: 1100907 - RNA, 18 nt, Human
uuuuauuuuguuacuaag

SEQ ID NO: 1100908 - RNA, 25 nt, Human
uuuucaucucuaacuccugauuucc

SEQ ID NO: 1100909 - RNA, 27 nt, Human
aaaaaaaaaaaaaaucacauuaaucag

SEQ ID NO: 1100910 - RNA, 24 nt, Human
aaaaaacccaaacacucaaaaaaa

SEQ ID NO: 1100911 - RNA, 23 nt, Human
aaaaagaaaacugaacaaaucau

SEQ ID NO: 1100912 - RNA, 20 nt, Human
aaacaugaaaucagucaccu

SEQ ID NO: 1100913 - RNA, 23 nt, Human
aaacccaaacacucaaaaaaaaa

SEQ ID NO: 1100914 - RNA, 24 nt, Human
aacccaucuucccaccccuucucc

SEQ ID NO: 1100915 - RNA, 19 nt, Human
aaccgggcgucagccgccc

SEQ ID NO: 1100916 - RNA, 21 nt, Human
aacuaaaaaacccaaacacuc

SEQ ID NO: 1100917 - RNA, 24 nt, Human
aaggagucacuuaguaaaacuaug

SEQ ID NO: 1100918 - RNA, 23 nt, Human
acacucaaaaaaaaaaaaaaauc

SEQ ID NO: 1100919 - RNA, 22 nt, Human
acccaucuucccaccccuucuc

SEQ ID NO: 1100920 - RNA, 24 nt, Human
acccaucuucccaccccuucuccu

SEQ ID NO: 1100921 - RNA, 21 nt, Human
accccaccccuuucucucuca

SEQ ID NO: 1100922 - RNA, 23 nt, Human
acuccuguuugcaacuaaaaaac

SEQ ID NO: 1100923 - RNA, 18 nt, Human
agacuuuccccuuuuccc

SEQ ID NO: 1100924 - RNA, 21 nt, Human
agauggacuugucauuacaga

SEQ ID NO: 1100925 - RNA, 19 nt, Human
agccgcccuaccccacccc

SEQ ID NO: 1100926 - RNA, 18 nt, Human
agggcacuuucuggguac

SEQ ID NO: 1100927 - RNA, 21 nt, Human
auuacagaaaaccaaaaacaa

SEQ ID NO: 1100928 - RNA, 27 nt, Human
caaaaacaaacaaauaaaaaaagaaaa

SEQ ID NO: 1100929 - RNA, 21 nt, Human
caaacccaucuucccaccccu

SEQ ID NO: 1100930 - RNA, 20 nt, Human
caacuaaaaaacccaaacac

SEQ ID NO: 1100931 - RNA, 24 nt, Human
caauaaacaugaaaucagucaccu

SEQ ID NO: 1100932 - RNA, 24 nt, Human
cacccccagcccggcuccacgucu

SEQ ID NO: 1100933 - RNA, 20 nt, Human
cacucaaaaaaaaaaaaaaa

SEQ ID NO: 1100934 - RNA, 18 nt, Human
cagaaaaccaaaaacaaa

SEQ ID NO: 1100935 - RNA, 19 nt, Human
cagaaaaccaaaaacaaac

SEQ ID NO: 1100936 - RNA, 20 nt, Human
cagaaaaccaaaaacaaaca

SEQ ID NO: 1100937 - RNA, 21 nt, Human
cagcccauuccacaaacccau

SEQ ID NO: 1100938 - RNA, 24 nt, Human
cagcccauuccacaaacccaucuu

SEQ ID NO: 1100939 - RNA, 19 nt, Human
cagccgcccuaccccaccc

SEQ ID NO: 1100940 - RNA, 21 nt, Human
cagccgcccuaccccaccccu

SEQ ID NO: 1100941 - RNA, 22 nt, Human
cagccggggucgcaccgggagg

SEQ ID NO: 1100942 - RNA, 19 nt, Human
caugaaaucagucaccuga

SEQ ID NO: 1100943 - RNA, 24 nt, Human
cauuccacaaacccaucuucccac

SEQ ID NO: 1100944 - RNA, 25 nt, Human
cauuccacaaacccaucuucccacc

SEQ ID NO: 1100945 - RNA, 24 nt, Human
cauuucaauuccacuccuguuugc

SEQ ID NO: 1100946 - RNA, 26 nt, Human
ccaaacacucaaaaaaaaaaaaaaau

SEQ ID NO: 1100947 - RNA, 25 nt, Human
ccacaaacccaucuucccaccccuu

SEQ ID NO: 1100948 - RNA, 21 nt, Human
ccacuccccacccucagccca

SEQ ID NO: 1100949 - RNA, 26 nt, Human
cccaaacacucaaaaaaaaaaaaaaa

SEQ ID NO: 1100950 - RNA, 26 nt, Human
cccacccucagcccauuccacaaacc

SEQ ID NO: 1100951 - RNA, 23 nt, Human
ccccgccccuggggugggcugga

SEQ ID NO: 1100952 - RNA, 18 nt, Human
ccccuuuucccaguccga

SEQ ID NO: 1100953 - RNA, 20 nt, Human
cccguccccuccuucgcucc

SEQ ID NO: 1100954 - RNA, 20 nt, Human
cccucugcccggcgcucucc

SEQ ID NO: 1100955 - RNA, 24 nt, Human
ccuccagccccgguucuccugagc

SEQ ID NO: 1100956 - RNA, 25 nt, Human
ccuccagccccgguucuccugagcc

SEQ ID NO: 1100957 - RNA, 21 nt, Human
ccuccuucgcuccccccagac

SEQ ID NO: 1100958 - RNA, 27 nt, Human
cgcccuaccccaccccuuucucucuca

SEQ ID NO: 1100959 - RNA, 20 nt, Human
cgccuaaaccgggcgucagc

SEQ ID NO: 1100960 - RNA, 21 nt, Human
cggccucccuuccccaccccc

SEQ ID NO: 1100961 - RNA, 23 nt, Human
cuaaaaaacccaaacacucaaaa

SEQ ID NO: 1100962 - RNA, 21 nt, Human
cucacuuuuauuacagaugga

SEQ ID NO: 1100963 - RNA, 18 nt, Human
cucuggguggcgguuggc

SEQ ID NO: 1100964 - RNA, 18 nt, Human
cuuccccacccccagccc

SEQ ID NO: 1100965 - RNA, 21 nt, Human
gcauugagccuucagaaauac

SEQ ID NO: 1100966 - RNA, 23 nt, Human
gccgcagacccccgcggagaggg

SEQ ID NO: 1100967 - RNA, 22 nt, Human
gccgcccuaccccaccccuuuc

SEQ ID NO: 1100968 - RNA, 18 nt, Human
gccuaaaccgggcgucag

SEQ ID NO: 1100969 - RNA, 19 nt, Human
gccucccuuccccaccccc

SEQ ID NO: 1100970 - RNA, 21 nt, Human
ggcacuuucuggguacucuug

SEQ ID NO: 1100971 - RNA, 23 nt, Human
ggccugaggcugcggaagcaguu

SEQ ID NO: 1100972 - RNA, 20 nt, Human
ggggcgggagcuguggcggc

SEQ ID NO: 1100973 - RNA, 19 nt, Human
uaaaaaaagaaaacugaac

SEQ ID NO: 1100974 - RNA, 19 nt, Human
uaaaaaacccaaacacuca

SEQ ID NO: 1100975 - RNA, 22 nt, Human
uaaaacuauguuuuaggaaucu

SEQ ID NO: 1100976 - RNA, 19 nt, Human
uaaaccgggcgucagccgc

SEQ ID NO: 1100977 - RNA, 21 nt, Human
uacagaaaaccaaaaacaaac

SEQ ID NO: 1100978 - RNA, 24 nt, Human
uacgcauugagccuucagaaauac

SEQ ID NO: 1100979 - RNA, 23 nt, Human
uacucuugccgcuccuccagccc

SEQ ID NO: 1100980 - RNA, 19 nt, Human
ucagcccauuccacaaacc

SEQ ID NO: 1100981 - RNA, 18 nt, Human
ucauuggcacgucugccc

SEQ ID NO: 1100982 - RNA, 21 nt, Human
uccacaaacccaucuucccac

SEQ ID NO: 1100983 - RNA, 21 nt, Human
uccccacccccagcccggcuc

SEQ ID NO: 1100984 - RNA, 21 nt, Human
uccccacccucagcccauucc

SEQ ID NO: 1100985 - RNA, 19 nt, Human
ucccccucccccucugccc

SEQ ID NO: 1100986 - RNA, 19 nt, Human
uccuggauaccaggcagcc

SEQ ID NO: 1100987 - RNA, 23 nt, Human
ucuccgccuaaaccgggcgucag

SEQ ID NO: 1100988 - RNA, 21 nt, Human
ucucuggguggcgguuggccu

SEQ ID NO: 1100989 - RNA, 21 nt, Human
ucugcccggcgcucuccgccu

SEQ ID NO: 1100990 - RNA, 24 nt, Human
ucuuucuccccguccccuccuucg

SEQ ID NO: 1100991 - RNA, 20 nt, Human
ugaaaucagucaccugacca

SEQ ID NO: 1100992 - RNA, 21 nt, Human
ugcgaagggaccagcgcagcc

SEQ ID NO: 1100993 - RNA, 19 nt, Human
uggggugggcuggaggccg

SEQ ID NO: 1100994 - RNA, 22 nt, Human
uggguucugcagcugccacucu

SEQ ID NO: 1100995 - RNA, 20 nt, Human
uuacagaaaaccaaaaacaa

SEQ ID NO: 1100996 - RNA, 19 nt, Human
uucaauuccacuccuguuu

SEQ ID NO: 1100997 - RNA, 22 nt, Human
uucuccuacgcauugagccuuc

SEQ ID NO: 1100998 - RNA, 21 nt, Human
uugcaacuaaaaaacccaaac

SEQ ID NO: 1100999 - RNA, 18 nt, Human
uugcccuuucucuacccc

SEQ ID NO: 1101000 - RNA, 21 nt, Human
uugcuucuuucuccccguccc

SEQ ID NO: 1101001 - RNA, 20 nt, Human
uuucacaguuuugccauacu

SEQ ID NO: 1101002 - RNA, 18 nt, Human
uuucuccccguccccucc

SEQ ID NO: 1101003 - RNA, 21 nt, Human
aauaauaagacccaagaaaga

SEQ ID NO: 1101004 - RNA, 18 nt, Human
acaaugagaugaagacaa

SEQ ID NO: 1101005 - RNA, 20 nt, Human
auccucaucccugagggcua

SEQ ID NO: 1101006 - RNA, 19 nt, Human
cagcuucacucacgacuuc

SEQ ID NO: 1101007 - RNA, 18 nt, Human
caguauuucagucucugc

SEQ ID NO: 1101008 - RNA, 18 nt, Human
cagucucugccccagccg

SEQ ID NO: 1101009 - RNA, 22 nt, Human
ccagucaagccaacccgcagcu

SEQ ID NO: 1101010 - RNA, 22 nt, Human
ccagucucuucauuacagucag

SEQ ID NO: 1101011 - RNA, 19 nt, Human
cccaagaaagacugggccu

SEQ ID NO: 1101012 - RNA, 23 nt, Human
cccgccacucuuucaacugccac

SEQ ID NO: 1101013 - RNA, 19 nt, Human
ccucaucccugagggcuag

SEQ ID NO: 1101014 - RNA, 23 nt, Human
ccuucacaaauaauaagacccaa

SEQ ID NO: 1101015 - RNA, 22 nt, Human
cuaggcuuguguuccaggaggu

SEQ ID NO: 1101016 - RNA, 20 nt, Human
gagaugaagacaauauagaa

SEQ ID NO: 1101017 - RNA, 24 nt, Human
gagcccagucaagccaacccgcag

SEQ ID NO: 1101018 - RNA, 18 nt, Human
ggcucugagguuggggaa

SEQ ID NO: 1101019 - RNA, 23 nt, Human
gggggugguuugucuguggcagu

SEQ ID NO: 1101020 - RNA, 19 nt, Human
gucucugccccagccgaca

SEQ ID NO: 1101021 - RNA, 23 nt, Human
uaggagugggggugguuugucug

SEQ ID NO: 1101022 - RNA, 24 nt, Human
ucccugcaacuucucccgccacuc

SEQ ID NO: 1101023 - RNA, 22 nt, Human
uccuuuguguuuugagggcugg

SEQ ID NO: 1101024 - RNA, 20 nt, Human
ucuacaguuauuaaauaagu

SEQ ID NO: 1101025 - RNA, 19 nt, Human
ugccaggagaggaacauua

SEQ ID NO: 1101026 - RNA, 20 nt, Human
uggcuggguaggaguggggg

SEQ ID NO: 1101027 - RNA, 23 nt, Human
uggguaggagugggggugguuug

SEQ ID NO: 1101028 - RNA, 27 nt, Human
uuacagucaggcucugagguuggggaa

SEQ ID NO: 1101029 - RNA, 21 nt, Human
uucacaaauaauaagacccaa

SEQ ID NO: 1101030 - RNA, 21 nt, Human
uuuuugccaggagaggaacau

SEQ ID NO: 1101031 - RNA, 18 nt, Human
aagcaguccucccgcucc

SEQ ID NO: 1101032 - RNA, 19 nt, Human
aagcaguccucccgcucca

SEQ ID NO: 1101033 - RNA, 24 nt, Human
aagccaagaccagaagacagccaa

SEQ ID NO: 1101034 - RNA, 23 nt, Human
acacaucacccccugggcugcag

SEQ ID NO: 1101035 - RNA, 21 nt, Human
acaugcacucgccgcaucccu

SEQ ID NO: 1101036 - RNA, 23 nt, Human
accagccuccaggacuccuccug

SEQ ID NO: 1101037 - RNA, 20 nt, Human
accauggacaacagccuccu

SEQ ID NO: 1101038 - RNA, 21 nt, Human
accauuaaaaaaaaaaaaaaa

SEQ ID NO: 1101039 - RNA, 22 nt, Human
accuacugccauuccguguccc

SEQ ID NO: 1101040 - RNA, 19 nt, Human
agaagacagccaauuaaca

SEQ ID NO: 1101041 - RNA, 24 nt, Human
agacagccaauuaacauccagagc

SEQ ID NO: 1101042 - RNA, 20 nt, Human
agaggcaggagaggcugagc

SEQ ID NO: 1101043 - RNA, 18 nt, Human
agccacuacuccuggccu

SEQ ID NO: 1101044 - RNA, 18 nt, Human
agccacuacuccuggccu

SEQ ID NO: 1101045 - RNA, 18 nt, Human
agccugggcagagaggcu

SEQ ID NO: 1101046 - RNA, 23 nt, Human
aggcaggcugggcccccagagcu

SEQ ID NO: 1101047 - RNA, 20 nt, Human
aggcagggaagggacagggc

SEQ ID NO: 1101048 - RNA, 19 nt, Human
aggcugagcuccuggaaag

SEQ ID NO: 1101049 - RNA, 21 nt, Human
aggggagcaguguggaaaggg

SEQ ID NO: 1101050 - RNA, 24 nt, Human
aggggucucuccauguugcccagg

SEQ ID NO: 1101051 - RNA, 23 nt, Human
agggguguggcaccucggggagg

SEQ ID NO: 1101052 - RNA, 27 nt, Human
agggucagcccuguggcccugcuggcu

SEQ ID NO: 1101053 - RNA, 21 nt, Human
aguguucucuaucccccaccu

SEQ ID NO: 1101054 - RNA, 18 nt, Human
aucugggacugagaagug

SEQ ID NO: 1101055 - RNA, 22 nt, Human
auggacaacagccuccuggcca

SEQ ID NO: 1101056 - RNA, 22 nt, Human
caaaggcaggcugggcccccag

SEQ ID NO: 1101057 - RNA, 19 nt, Human
caagaccagaagacagcca

SEQ ID NO: 1101058 - RNA, 23 nt, Human
caagcaguccucccgcuccaacc

SEQ ID NO: 1101059 - RNA, 21 nt, Human
cacccccgacccaaauccuga

SEQ ID NO: 1101060 - RNA, 21 nt, Human
caccugugcucuggccaagga

SEQ ID NO: 1101061 - RNA, 19 nt, Human
cacuggggucaaaaucagg

SEQ ID NO: 1101062 - RNA, 23 nt, Human
cagaacuagggaagcguaacccc

SEQ ID NO: 1101063 - RNA, 18 nt, Human
cagcagaagcagggccug

SEQ ID NO: 1101064 - RNA, 18 nt, Human
cagcauccagccuggguu

SEQ ID NO: 1101065 - RNA, 19 nt, Human
cagcccuguggcccugcug

SEQ ID NO: 1101066 - RNA, 20 nt, Human
cagccuccaggacuccuccu

SEQ ID NO: 1101067 - RNA, 21 nt, Human
caggacccaggaccagccucc

SEQ ID NO: 1101068 - RNA, 21 nt, Human
caguccucccgcuccaaccuc

SEQ ID NO: 1101069 - RNA, 23 nt, Human
cauguugcccaggcuggucucaa

SEQ ID NO: 1101070 - RNA, 24 nt, Human
cauguugcccaggcuggucucaaa

SEQ ID NO: 1101071 - RNA, 24 nt, Human
ccaaagcguugggaugacaggcau

SEQ ID NO: 1101072 - RNA, 20 nt, Human
ccacugcuucuccgugugca

SEQ ID NO: 1101073 - RNA, 18 nt, Human
ccagggguggggcagagg

SEQ ID NO: 1101074 - RNA, 24 nt, Human
ccauuaaaaaaaaaaaaaaaucuu

SEQ ID NO: 1101075 - RNA, 24 nt, Human
cccacccccgacccaaauccugac

SEQ ID NO: 1101076 - RNA, 24 nt, Human
ccccagagcugcacaauaacugcu

SEQ ID NO: 1101077 - RNA, 20 nt, Human
cccccacccccgacccaaau

SEQ ID NO: 1101078 - RNA, 21 nt, Human
cccccacccccgacccaaauc

SEQ ID NO: 1101079 - RNA, 24 nt, Human
cccucacuguaggcaaagcccaga

SEQ ID NO: 1101080 - RNA, 20 nt, Human
cccugcugcucuggcaggcc

SEQ ID NO: 1101081 - RNA, 21 nt, Human
ccucaagcaacagcccuccca

SEQ ID NO: 1101082 - RNA, 25 nt, Human
ccuccaggacuccuccugacagguu

SEQ ID NO: 1101083 - RNA, 22 nt, Human
ccucccgcuccaaccucccaaa

SEQ ID NO: 1101084 - RNA, 24 nt, Human
ccucccgcuccaaccucccaaagc

SEQ ID NO: 1101085 - RNA, 18 nt, Human
ccugacagaggauucuga

SEQ ID NO: 1101086 - RNA, 33 nt, Human
cucaaaguaccauuaaaaaaaaaaaaaaauccu

SEQ ID NO: 1101087 - RNA, 21 nt, Human
cucaagcaacagcccucccca

SEQ ID NO: 1101088 - RNA, 24 nt, Human
cuccauguugcccaggcuggucuc

SEQ ID NO: 1101089 - RNA, 27 nt, Human
cuccauguugcccaggcuggucucaaa

SEQ ID NO: 1101090 - RNA, 23 nt, Human
cucccauucucuccccuguccag

SEQ ID NO: 1101091 - RNA, 19 nt, Human
cuccuggaaagcugcuuac

SEQ ID NO: 1101092 - RNA, 22 nt, Human
cuccuggccucaaaguaccauu

SEQ ID NO: 1101093 - RNA, 23 nt, Human
cucugcucccccucacaaaucuc

SEQ ID NO: 1101094 - RNA, 19 nt, Human
cugcagcauccagccuggg

SEQ ID NO: 1101095 - RNA, 21 nt, Human
cugcccucaagacugaugccc

SEQ ID NO: 1101096 - RNA, 21 nt, Human
cugcccucaagacugaugccc

SEQ ID NO: 1101097 - RNA, 20 nt, Human
cuggccucaaaguaccauua

SEQ ID NO: 1101098 - RNA, 21 nt, Human
cuggccucaaaguaccauuaa

SEQ ID NO: 1101099 - RNA, 18 nt, Human
cuggccucaagcaguccu

SEQ ID NO: 1101100 - RNA, 25 nt, Human
cugggccaggguucccagggagggg

SEQ ID NO: 1101101 - RNA, 19 nt, Human
cuuacagaugccccugcuc

SEQ ID NO: 1101102 - RNA, 22 nt, Human
gaagguuguagugggacacuca

SEQ ID NO: 1101103 - RNA, 20 nt, Human
gacaguguucucuauccccc

SEQ ID NO: 1101104 - RNA, 18 nt, Human
gagccaaugggaagugga

SEQ ID NO: 1101105 - RNA, 23 nt, Human
gaggagagccugggcagagaggc

SEQ ID NO: 1101106 - RNA, 20 nt, Human
gaggauucugauuuaacggu

SEQ ID NO: 1101107 - RNA, 18 nt, Human
gagggaggaggagagccu

SEQ ID NO: 1101108 - RNA, 19 nt, Human
gcaacagcccuccccagcc

SEQ ID NO: 1101109 - RNA, 22 nt, Human
gcaacagcccuccccagccaag

SEQ ID NO: 1101110 - RNA, 23 nt, Human
gcaccaggagcuguugagcuggg

SEQ ID NO: 1101111 - RNA, 21 nt, Human
gcauccccugccacugcuucu

SEQ ID NO: 1101112 - RNA, 20 nt, Human
gccacuggggucaaaaucag

SEQ ID NO: 1101113 - RNA, 20 nt, Human
gccugcagaggcaggagagg

SEQ ID NO: 1101114 - RNA, 18 nt, Human
gccuuuggaaucuuucuc

SEQ ID NO: 1101115 - RNA, 19 nt, Human
gcggccaaaggcaggcugg

SEQ ID NO: 1101116 - RNA, 23 nt, Human
gcuccaaccucccaaagcguugg

SEQ ID NO: 1101117 - RNA, 21 nt, Human
gcucuggcaggccugucuugg

SEQ ID NO: 1101118 - RNA, 23 nt, Human
gcuggucucaaacuccuggccuc

SEQ ID NO: 1101119 - RNA, 22 nt, Human
ggaggugggcaauggggcuggg

SEQ ID NO: 1101120 - RNA, 20 nt, Human
ggcaauggggcugggaggga

SEQ ID NO: 1101121 - RNA, 21 nt, Human
ggccacuggggucaaaaucag

SEQ ID NO: 1101122 - RNA, 24 nt, Human
ggcuggucucaaacuccuggccuc

SEQ ID NO: 1101123 - RNA, 20 nt, Human
gggaagcguaaccccacccc

SEQ ID NO: 1101124 - RNA, 18 nt, Human
gggcaauggggcugggag

SEQ ID NO: 1101125 - RNA, 21 nt, Human
gggcaccaggagcuguugagc

SEQ ID NO: 1101126 - RNA, 22 nt, Human
gggcagagaggcuuuuguauuu

SEQ ID NO: 1101127 - RNA, 20 nt, Human
gggccaggguucccagggag

SEQ ID NO: 1101128 - RNA, 21 nt, Human
gggccaggguucccagggagg

SEQ ID NO: 1101129 - RNA, 18 nt, Human
gggcugggcaccaggagc

SEQ ID NO: 1101130 - RNA, 22 nt, Human
gggggcggggagcggccaaagg

SEQ ID NO: 1101131 - RNA, 18 nt, Human
ggggucucuccauguugc

SEQ ID NO: 1101132 - RNA, 23 nt, Human
ggguucccagggagggguguggc

SEQ ID NO: 1101133 - RNA, 19 nt, Human
guaaaaucucccuuacaca

SEQ ID NO: 1101134 - RNA, 25 nt, Human
guaccauuaaaaaaaaaaaaaaauc

SEQ ID NO: 1101135 - RNA, 21 nt, Human
guucccagggagggguguggc

SEQ ID NO: 1101136 - RNA, 20 nt, Human
uaaagcuccucaggccuuuc

SEQ ID NO: 1101137 - RNA, 21 nt, Human
uagcaaaaagggaucugccug

SEQ ID NO: 1101138 - RNA, 24 nt, Human
uagcucagccuggaggcuuggguu

SEQ ID NO: 1101139 - RNA, 25 nt, Human
uagcucagccuggaggcuuggguuu

SEQ ID NO: 1101140 - RNA, 22 nt, Human
uaggcaaagcccagauucuuca

SEQ ID NO: 1101141 - RNA, 18 nt, Human
ucaguauggaaaagaaag

SEQ ID NO: 1101142 - RNA, 19 nt, Human
ucaguauggaaaagaaagg

SEQ ID NO: 1101143 - RNA, 24 nt, Human
ucccaaagcguugggaugacaggc

SEQ ID NO: 1101144 - RNA, 24 nt, Human
uccccauuauugucaccugcugua

SEQ ID NO: 1101145 - RNA, 19 nt, Human
ucccccucacaaaucucug

SEQ ID NO: 1101146 - RNA, 19 nt, Human
uccccugccacugcuucuc

SEQ ID NO: 1101147 - RNA, 24 nt, Human
ucccugugccagguccuaugaugc

SEQ ID NO: 1101148 - RNA, 25 nt, Human
ucccuuugugucucuguaaaaucuc

SEQ ID NO: 1101149 - RNA, 21 nt, Human
uccuccugacagguucagagg

SEQ ID NO: 1101150 - RNA, 21 nt, Human
uccucugggccaggguuccca

SEQ ID NO: 1101151 - RNA, 20 nt, Human
uccugacaaaagggcaccug

SEQ ID NO: 1101152 - RNA, 25 nt, Human
uccuggaaagcugcuuacagaugcc

SEQ ID NO: 1101153 - RNA, 24 nt, Human
ucucaaacuccuggccucaagcag

SEQ ID NO: 1101154 - RNA, 21 nt, Human
ucucaggguaucugcuccauc

SEQ ID NO: 1101155 - RNA, 20 nt, Human
ucuccauguugcccaggcug

SEQ ID NO: 1101156 - RNA, 23 nt, Human
ucucuccauguugcccaggcugg

SEQ ID NO: 1101157 - RNA, 20 nt, Human
ucugcagcauccagccuggg

SEQ ID NO: 1101158 - RNA, 21 nt, Human
ucuuggcauccccugccacug

SEQ ID NO: 1101159 - RNA, 21 nt, Human
ucuuggguccuuuccugccuc

SEQ ID NO: 1101160 - RNA, 22 nt, Human
ucuuugguaacaagaggggcug

SEQ ID NO: 1101161 - RNA, 18 nt, Human
ugagucaggggagcagug

SEQ ID NO: 1101162 - RNA, 23 nt, Human
ugaguuggaagcacugcaggacc

SEQ ID NO: 1101163 - RNA, 19 nt, Human
ugcagagaucugggcgagu

SEQ ID NO: 1101164 - RNA, 24 nt, Human
ugcccaggcuggucucaaacuccu

SEQ ID NO: 1101165 - RNA, 18 nt, Human
ugcuccauccccucccuu

SEQ ID NO: 1101166 - RNA, 21 nt, Human
ugcuguaaacauuuggaguuu

SEQ ID NO: 1101167 - RNA, 23 nt, Human
ugcuguaaacauuuggaguuuac

SEQ ID NO: 1101168 - RNA, 19 nt, Human
ugcuuacagaugccccugc

SEQ ID NO: 1101169 - RNA, 22 nt, Human
uggaagccaagaccagaagaca

SEQ ID NO: 1101170 - RNA, 23 nt, Human
uggaggugggcaauggggcuggg

SEQ ID NO: 1101171 - RNA, 21 nt, Human
uggcaccucggggagggucag

SEQ ID NO: 1101172 - RNA, 20 nt, Human
uggccucaagcaguccuccc

SEQ ID NO: 1101173 - RNA, 21 nt, Human
uggccucaagcaguccucccg

SEQ ID NO: 1101174 - RNA, 21 nt, Human
ugggaaguggaggugggcaau

SEQ ID NO: 1101175 - RNA, 19 nt, Human
ugggaaguggaggugggcc

SEQ ID NO: 1101176 - RNA, 19 nt, Human
ugggacacucauagcugcc

SEQ ID NO: 1101177 - RNA, 21 nt, Human
ugggaugacaggcaucagcca

SEQ ID NO: 1101178 - RNA, 22 nt, Human
ugggaugacaggcaucagccac

SEQ ID NO: 1101179 - RNA, 22 nt, Human
ugggcugcaggcagggaaggga

SEQ ID NO: 1101180 - RNA, 21 nt, Human
uggggcugggagggaucuggg

SEQ ID NO: 1101181 - RNA, 23 nt, Human
uggggcugggagggaucugggac

SEQ ID NO: 1101182 - RNA, 24 nt, Human
uguagugggacacucauagcugcc

SEQ ID NO: 1101183 - RNA, 18 nt, Human
ugugcagacaucaccaug

SEQ ID NO: 1101184 - RNA, 23 nt, Human
uucagcagaagcagggccuguuc

SEQ ID NO: 1101185 - RNA, 25 nt, Human
uucccagggagggguguggcaccuc

SEQ ID NO: 1101186 - RNA, 18 nt, Human
uucccugugccagguccu

SEQ ID NO: 1101187 - RNA, 19 nt, Human
uucccugugccagguccua

SEQ ID NO: 1101188 - RNA, 20 nt, Human
uuccucugggccaggguucc

SEQ ID NO: 1101189 - RNA, 23 nt, Human
uugucaccugcuguaaacauuug

SEQ ID NO: 1101190 - RNA, 24 nt, Human
uuucucugcagcauccagccuggg

SEQ ID NO: 1101191 - RNA, 19 nt, Human
uuugguaacaagaggggcu

SEQ ID NO: 1101192 - RNA, 21 nt, Human
aaagcacauuggaggaaccga

SEQ ID NO: 1101193 - RNA, 19 nt, Human
aaagugcugguauuacagg

SEQ ID NO: 1101194 - RNA, 19 nt, Human
aaagugcugguauuacagg

SEQ ID NO: 1101195 - RNA, 24 nt, Human
aaagugcugguauuacaggaguga

SEQ ID NO: 1101196 - RNA, 18 nt, Human
aaggagcaggagggcugg

SEQ ID NO: 1101197 - RNA, 18 nt, Human
acagcucacugcagcuuc

SEQ ID NO: 1101198 - RNA, 23 nt, Human
accacagacucacaccaccauga

SEQ ID NO: 1101199 - RNA, 22 nt, Human
accaugagugaagccaaaaaau

SEQ ID NO: 1101200 - RNA, 19 nt, Human
acccaggcuggagugcagu

SEQ ID NO: 1101201 - RNA, 24 nt, Human
acggagucucgcugugucacccag

SEQ ID NO: 1101202 - RNA, 18 nt, Human
acugcagcuucaaccucu

SEQ ID NO: 1101203 - RNA, 20 nt, Human
acugcugguucagagggcug

SEQ ID NO: 1101204 - RNA, 24 nt, Human
acugcugguucagagggcugggug

SEQ ID NO: 1101205 - RNA, 23 nt, Human
agaccuugggaaggacuggauuu

SEQ ID NO: 1101206 - RNA, 26 nt, Human
agauggagacaagccuggaggcagaa

SEQ ID NO: 1101207 - RNA, 25 nt, Human
aggcuggagugcaguggcacgaucu

SEQ ID NO: 1101208 - RNA, 23 nt, Human
agggggcacgcguggauacuggg

SEQ ID NO: 1101209 - RNA, 23 nt, Human
aggggugcugguucuugagccau

SEQ ID NO: 1101210 - RNA, 19 nt, Human
agguagaguggaggaaagc

SEQ ID NO: 1101211 - RNA, 24 nt, Human
aggugugcuggugugggugcaucc

SEQ ID NO: 1101212 - RNA, 21 nt, Human
aguacaguggugcgaucacag

SEQ ID NO: 1101213 - RNA, 23 nt, Human
aguacaguggugcgaucacagcu

SEQ ID NO: 1101214 - RNA, 21 nt, Human
agugcaguggcacgaucucag

SEQ ID NO: 1101215 - RNA, 23 nt, Human
agugcaguggcacgaucucagcu

SEQ ID NO: 1101216 - RNA, 20 nt, Human
aucuccuguaacggugggga

SEQ ID NO: 1101217 - RNA, 23 nt, Human
augauaggagaccuugggaagga

SEQ ID NO: 1101218 - RNA, 26 nt, Human
caaacauacuuuuuguauuuuuuugu

SEQ ID NO: 1101219 - RNA, 24 nt, Human
caaagugcugguauuacaggagug

SEQ ID NO: 1101220 - RNA, 28 nt, Human
caaucgaucuucccucccaccuuggccu

SEQ ID NO: 1101221 - RNA, 18 nt, Human
cacugcaaccucugccuc

SEQ ID NO: 1101222 - RNA, 19 nt, Human
cagaaaucagguaguucau

SEQ ID NO: 1101223 - RNA, 21 nt, Human
cagcugaaauugagguugggg

SEQ ID NO: 1101224 - RNA, 18 nt, Human
caggagugagacauggcg

SEQ ID NO: 1101225 - RNA, 19 nt, Human
cagggccaggcccuaagga

SEQ ID NO: 1101226 - RNA, 19 nt, Human
ccaaagugcugguauuaca

SEQ ID NO: 1101227 - RNA, 20 nt, Human
ccacagacucacaccaccau

SEQ ID NO: 1101228 - RNA, 20 nt, Human
ccacugugcucuggcggggg

SEQ ID NO: 1101229 - RNA, 19 nt, Human
cccccugccccaccuccgc

SEQ ID NO: 1101230 - RNA, 24 nt, Human
cccccugccccaccuccgcacuac

SEQ ID NO: 1101231 - RNA, 26 nt, Human
ccccugccccaccuccgcacuacccc

SEQ ID NO: 1101232 - RNA, 21 nt, Human
ccgggaaggggagaaaggcuc

SEQ ID NO: 1101233 - RNA, 26 nt, Human
ccucccaccuuggccucccaaagugc

SEQ ID NO: 1101234 - RNA, 26 nt, Human
cgcacuaccccgcccugccaucggau

SEQ ID NO: 1101235 - RNA, 22 nt, Human
cgcucugucacccaggcuggag

SEQ ID NO: 1101236 - RNA, 23 nt, Human
cgcuuuagaaagaucucccuaag

SEQ ID NO: 1101237 - RNA, 18 nt, Human
cgggggaagggggcacgc

SEQ ID NO: 1101238 - RNA, 18 nt, Human
cuagucacacaggggugc

SEQ ID NO: 1101239 - RNA, 20 nt, Human
cucaaucgaucuucccuccc

SEQ ID NO: 1101240 - RNA, 25 nt, Human
cucacugcaaccucugccucauugg

SEQ ID NO: 1101241 - RNA, 19 nt, Human
cucccccugccccaccucc

SEQ ID NO: 1101242 - RNA, 24 nt, Human
cucccccugccccaccuccgcacu

SEQ ID NO: 1101243 - RNA, 23 nt, Human
cuccugggcucaaucgaucuucc

SEQ ID NO: 1101244 - RNA, 21 nt, Human
cucgcucugucacccaggcug

SEQ ID NO: 1101245 - RNA, 24 nt, Human
cucgcucugucacccaggcuggag

SEQ ID NO: 1101246 - RNA, 24 nt, Human
cucuauguugcccaggcuggucuc

SEQ ID NO: 1101247 - RNA, 23 nt, Human
cucugucacccaggcuggaguac

SEQ ID NO: 1101248 - RNA, 20 nt, Human
cugaaauugagguugggggu

SEQ ID NO: 1101249 - RNA, 18 nt, Human
cuggaaguacaggaggug

SEQ ID NO: 1101250 - RNA, 21 nt, Human
cugggggccuccagggagagu

SEQ ID NO: 1101251 - RNA, 20 nt, Human
cugugucacccaggcuggag

SEQ ID NO: 1101252 - RNA, 18 nt, Human
gaaaguggggagggggga

SEQ ID NO: 1101253 - RNA, 19 nt, Human
gaaaugagucuagucacac

SEQ ID NO: 1101254 - RNA, 20 nt, Human
gaagggcugggggccuccag

SEQ ID NO: 1101255 - RNA, 20 nt, Human
gagcacgaugcagcuuccac

SEQ ID NO: 1101256 - RNA, 19 nt, Human
gagcugacaagauaaggua

SEQ ID NO: 1101257 - RNA, 25 nt, Human
gaggaaagccuguugguguuaagga

SEQ ID NO: 1101258 - RNA, 23 nt, Human
gaggcagaaaucagguaguucau

SEQ ID NO: 1101259 - RNA, 19 nt, Human
gagggaaaaagaaaucaca

SEQ ID NO: 1101260 - RNA, 22 nt, Human
gcauggaggugaggugugcugg

SEQ ID NO: 1101261 - RNA, 18 nt, Human
gccugcuuuuggcuggga

SEQ ID NO: 1101262 - RNA, 19 nt, Human
gcuggagugcaguggcacg

SEQ ID NO: 1101263 - RNA, 22 nt, Human
ggaugauggagugagggaaaaa

SEQ ID NO: 1101264 - RNA, 20 nt, Human
ggcauggaggugaggugugc

SEQ ID NO: 1101265 - RNA, 20 nt, Human
ggcauggaggugaggugugc

SEQ ID NO: 1101266 - RNA, 19 nt, Human
ggcccagugcaggcuggag

SEQ ID NO: 1101267 - RNA, 18 nt, Human
gggaaggggagaaaggcu

SEQ ID NO: 1101268 - RNA, 22 nt, Human
gggcauggaggugaggugugcu

SEQ ID NO: 1101269 - RNA, 18 nt, Human
gggcuagggaugaaggug

SEQ ID NO: 1101270 - RNA, 18 nt, Human
gguagaguggaggaaagc

SEQ ID NO: 1101271 - RNA, 23 nt, Human
gucgagggcuguaaccgugaaau

SEQ ID NO: 1101272 - RNA, 22 nt, Human
gugaagccaaaaaauacaaaca

SEQ ID NO: 1101273 - RNA, 22 nt, Human
guggaacagcagaugccagaag

SEQ ID NO: 1101274 - RNA, 23 nt, Human
guggugcgaucacagcucacugc

SEQ ID NO: 1101275 - RNA, 23 nt, Human
guuucuaaaggaggaaggguggg

SEQ ID NO: 1101276 - RNA, 22 nt, Human
uacaaacauacuuuuuguauuu

SEQ ID NO: 1101277 - RNA, 19 nt, Human
uagaaagaucucccuaagu

SEQ ID NO: 1101278 - RNA, 23 nt, Human
uagagacagaggucucucuaugu

SEQ ID NO: 1101279 - RNA, 24 nt, Human
uagggucucgcucugucacccagg

SEQ ID NO: 1101280 - RNA, 23 nt, Human
uauguugcccaggcuggucucga

SEQ ID NO: 1101281 - RNA, 24 nt, Human
uauguugcccaggcuggucucgaa

SEQ ID NO: 1101282 - RNA, 19 nt, Human
uauuacaggagugagacau

SEQ ID NO: 1101283 - RNA, 22 nt, Human
ucacccaggcuggagugcagug

SEQ ID NO: 1101284 - RNA, 19 nt, Human
ucacugcaaccucugccuc

SEQ ID NO: 1101285 - RNA, 24 nt, Human
ucacugcaaccucugccucauugg

SEQ ID NO: 1101286 - RNA, 25 nt, Human
ucacugcaaccucugccucauugga

SEQ ID NO: 1101287 - RNA, 19 nt, Human
ucacugcagcuucaaccuc

SEQ ID NO: 1101288 - RNA, 22 nt, Human
ucacugcagcuucaaccucuug

SEQ ID NO: 1101289 - RNA, 24 nt, Human
uccagggagaguuucuaaaggagg

SEQ ID NO: 1101290 - RNA, 18 nt, Human
ucccccugccccaccucc

SEQ ID NO: 1101291 - RNA, 24 nt, Human
ucccucccaccuuggccucccaaa

SEQ ID NO: 1101292 - RNA, 20 nt, Human
uccgcacuaccccgcccugc

SEQ ID NO: 1101293 - RNA, 24 nt, Human
ucgcucugucacccaggcuggagu

SEQ ID NO: 1101294 - RNA, 24 nt, Human
ucgcugugucacccaggcuggagu

SEQ ID NO: 1101295 - RNA, 23 nt, Human
ucgucccaccucagucucccccu

SEQ ID NO: 1101296 - RNA, 18 nt, Human
ucuauguugcccaggcug

SEQ ID NO: 1101297 - RNA, 18 nt, Human
ucuauguugcccaggcug

SEQ ID NO: 1101298 - RNA, 24 nt, Human
ucuauguugcccaggcuggucucg

SEQ ID NO: 1101299 - RNA, 19 nt, Human
ucucgaacuccugggcuca

SEQ ID NO: 1101300 - RNA, 21 nt, Human
ucucgaacuccugggcucaau

SEQ ID NO: 1101301 - RNA, 19 nt, Human
ucucgcucugucacccagg

SEQ ID NO: 1101302 - RNA, 23 nt, Human
ucucgcucugucacccaggcugg

SEQ ID NO: 1101303 - RNA, 24 nt, Human
ucucgcucugucacccaggcugga

SEQ ID NO: 1101304 - RNA, 25 nt, Human
ucucgcucugucacccaggcuggag

SEQ ID NO: 1101305 - RNA, 23 nt, Human
ucucgcugugucacccaggcugg

SEQ ID NO: 1101306 - RNA, 24 nt, Human
ucucgcugugucacccaggcugga

SEQ ID NO: 1101307 - RNA, 20 nt, Human
ucucuauguugcccaggcug

SEQ ID NO: 1101308 - RNA, 23 nt, Human
ucucucuauguugcccaggcugg

SEQ ID NO: 1101309 - RNA, 24 nt, Human
ucucucuauguugcccaggcuggu

SEQ ID NO: 1101310 - RNA, 24 nt, Human
ucucugaauauucuuacuuggccc

SEQ ID NO: 1101311 - RNA, 18 nt, Human
ucuggcgggggaaggggg

SEQ ID NO: 1101312 - RNA, 18 nt, Human
ucugucacccaggcugga

SEQ ID NO: 1101313 - RNA, 24 nt, Human
ucugucacccaggcuggaguacag

SEQ ID NO: 1101314 - RNA, 23 nt, Human
ugaaagcacauuggaggaaccga

SEQ ID NO: 1101315 - RNA, 19 nt, Human
ugaaaguggggagggggga

SEQ ID NO: 1101316 - RNA, 19 nt, Human
ugaaauugagguugggggu

SEQ ID NO: 1101317 - RNA, 21 nt, Human
ugagacauggcgcccagccca

SEQ ID NO: 1101318 - RNA, 22 nt, Human
ugcaguggcacgaucucagcuc

SEQ ID NO: 1101319 - RNA, 22 nt, Human
ugccagaagggcugggggccuc

SEQ ID NO: 1101320 - RNA, 24 nt, Human
ugcccaggcuggucucgaacuccu

SEQ ID NO: 1101321 - RNA, 28 nt, Human
ugcccaggcuggucucgaacuccugggc

SEQ ID NO: 1101322 - RNA, 25 nt, Human
ugcugguucagagggcugggugggc

SEQ ID NO: 1101323 - RNA, 22 nt, Human
uggaacagcagaugccagaagg

SEQ ID NO: 1101324 - RNA, 22 nt, Human
uggaggagcacgaugcagcuuc

SEQ ID NO: 1101325 - RNA, 19 nt, Human
uggagggaaauucgagccu

SEQ ID NO: 1101326 - RNA, 19 nt, Human
uggaguacaguggugcgau

SEQ ID NO: 1101327 - RNA, 23 nt, Human
uggagugcaguggcacgaucuca

SEQ ID NO: 1101328 - RNA, 24 nt, Human
uggagugcaguggcacgaucucag

SEQ ID NO: 1101329 - RNA, 24 nt, Human
uggcacgaucucagcucacugcaa

SEQ ID NO: 1101330 - RNA, 18 nt, Human
uggcauggugugguggug

SEQ ID NO: 1101331 - RNA, 21 nt, Human
uggcauggugugguggugaca

SEQ ID NO: 1101332 - RNA, 19 nt, Human
uggcuuggucgagggcugu

SEQ ID NO: 1101333 - RNA, 20 nt, Human
uggcuuggucgagggcugua

SEQ ID NO: 1101334 - RNA, 18 nt, Human
ugggaaggacuggauuug

SEQ ID NO: 1101335 - RNA, 22 nt, Human
ugggaaggacuggauuugaggg

SEQ ID NO: 1101336 - RNA, 24 nt, Human
ugggaccacagacucacaccacca

SEQ ID NO: 1101337 - RNA, 19 nt, Human
ugggaggcuugaggugauc

SEQ ID NO: 1101338 - RNA, 18 nt, Human
uggggaggggggaggugg

SEQ ID NO: 1101339 - RNA, 22 nt, Human
uggggaggggggagguggaaca

SEQ ID NO: 1101340 - RNA, 20 nt, Human
uggggcccagugcaggcugg

SEQ ID NO: 1101341 - RNA, 18 nt, Human
ugggggccuccagggaga

SEQ ID NO: 1101342 - RNA, 24 nt, Human
uggugcgaucacagcucacugcag

SEQ ID NO: 1101343 - RNA, 18 nt, Human
uggugugggugcauccuu

SEQ ID NO: 1101344 - RNA, 22 nt, Human
uguaacgguggggacaaacggc

SEQ ID NO: 1101345 - RNA, 21 nt, Human
ugugguggugacauaggaccu

SEQ ID NO: 1101346 - RNA, 24 nt, Human
ugugucacccaggcuggagugcag

SEQ ID NO: 1101347 - RNA, 21 nt, Human
uucgagccugcuuuuggcugg

SEQ ID NO: 1101348 - RNA, 18 nt, Human
uuggauccaacuggaguu

SEQ ID NO: 1101349 - RNA, 18 nt, Human
uuucuaaaggaggaaggg

SEQ ID NO: 1101350 - RNA, 21 nt, Human
uuugaaaugagucauuucaag

SEQ ID NO: 1101351 - RNA, 19 nt, Human
uuugagggggugguggagg

SEQ ID NO: 1101352 - RNA, 22 nt, Human
uuuuuguauuuuuuuguagaga

SEQ ID NO: 1101353 - RNA, 24 nt, Human
uuuuuguauuuuuuuguagagaca

SEQ ID NO: 1101354 - RNA, 19 nt, Human
uuuuuuuguagagacagag

SEQ ID NO: 1101355 - RNA, 24 nt, Human
aaaucagccaaaaaucaggagccu

SEQ ID NO: 1101356 - RNA, 23 nt, Human
agacaaaggugagucugacagag

SEQ ID NO: 1101357 - RNA, 24 nt, Human
agggucucggggagcgggucuggg

SEQ ID NO: 1101358 - RNA, 22 nt, Human
cccugcaggagauagugagggu

SEQ ID NO: 1101359 - RNA, 24 nt, Human
ccuccagggcggcuggaagucucc

SEQ ID NO: 1101360 - RNA, 24 nt, Human
ccuucucacagagaagacaaaggu

SEQ ID NO: 1101361 - RNA, 21 nt, Human
cggcaggcucugugacacccu

SEQ ID NO: 1101362 - RNA, 18 nt, Human
cuccagggcggcuggaag

SEQ ID NO: 1101363 - RNA, 22 nt, Human
cuccagggcggcuggaagucuc

SEQ ID NO: 1101364 - RNA, 20 nt, Human
cugacagagcggcaggcucu

SEQ ID NO: 1101365 - RNA, 24 nt, Human
gcuggaagucuccacugggcugcc

SEQ ID NO: 1101366 - RNA, 18 nt, Human
ucugacagagcggcaggc

SEQ ID NO: 1101367 - RNA, 23 nt, Human
ucugugacacccugcaggagaua

SEQ ID NO: 1101368 - RNA, 21 nt, Human
ugaaaaaucagccaaaaauca

SEQ ID NO: 1101369 - RNA, 24 nt, Human
ugaaaaaucagccaaaaaucagga

SEQ ID NO: 1101370 - RNA, 21 nt, Human
ugggugcaaggaccuccaggg

SEQ ID NO: 1101371 - RNA, 23 nt, Human
aaaaaaagccccaguuccacacc

SEQ ID NO: 1101372 - RNA, 21 nt, Human
aaagccccaguuccacaccaa

SEQ ID NO: 1101373 - RNA, 24 nt, Human
aaagugcugggauuauagguguga

SEQ ID NO: 1101374 - RNA, 19 nt, Human
aagauaguaacagcaacaa

SEQ ID NO: 1101375 - RNA, 18 nt, Human
aagugcugggauuauagg

SEQ ID NO: 1101376 - RNA, 26 nt, Human
aagugcugggauuauaggugugagcc

SEQ ID NO: 1101377 - RNA, 24 nt, Human
acaacagccacccuaacuuauguu

SEQ ID NO: 1101378 - RNA, 20 nt, Human
acagcaacaacagccacccu

SEQ ID NO: 1101379 - RNA, 21 nt, Human
acuuccagaaagaccauauug

SEQ ID NO: 1101380 - RNA, 21 nt, Human
aggugugagccaccgugccca

SEQ ID NO: 1101381 - RNA, 23 nt, Human
aguaacagcaacaacagccaccc

SEQ ID NO: 1101382 - RNA, 22 nt, Human
auaccuuaaaaaaaagccccag

SEQ ID NO: 1101383 - RNA, 24 nt, Human
caaagugcugggauuauaggugug

SEQ ID NO: 1101384 - RNA, 20 nt, Human
cacaacaaucaccuggauac

SEQ ID NO: 1101385 - RNA, 23 nt, Human
caccugccucggccucccaaagu

SEQ ID NO: 1101386 - RNA, 22 nt, Human
caccuggauaccuuaaaaaaaa

SEQ ID NO: 1101387 - RNA, 18 nt, Human
cagccuagaggauccuuc

SEQ ID NO: 1101388 - RNA, 24 nt, Human
cauauuggccaggcuggccucgaa

SEQ ID NO: 1101389 - RNA, 21 nt, Human
ccaaagugcugggauuauagg

SEQ ID NO: 1101390 - RNA, 24 nt, Human
ccaaagugcugggauuauaggugu

SEQ ID NO: 1101391 - RNA, 19 nt, Human
ccugaccucgugauccacc

SEQ ID NO: 1101392 - RNA, 21 nt, Human
ccugaccucgugauccaccug

SEQ ID NO: 1101393 - RNA, 24 nt, Human
cuccugaccucgugauccaccugc

SEQ ID NO: 1101394 - RNA, 23 nt, Human
cugccucggccucccaaagugcu

SEQ ID NO: 1101395 - RNA, 21 nt, Human
cugggauuauaggugugagcc

SEQ ID NO: 1101396 - RNA, 19 nt, Human
cuuccagaaagaccauauu

SEQ ID NO: 1101397 - RNA, 22 nt, Human
gaccucgugauccaccugccuc

SEQ ID NO: 1101398 - RNA, 22 nt, Human
gaccucgugauccaccugccuc

SEQ ID NO: 1101399 - RNA, 24 nt, Human
gaccucgugauccaccugccucgg

SEQ ID NO: 1101400 - RNA, 18 nt, Human
gauuauaggugugagcca

SEQ ID NO: 1101401 - RNA, 21 nt, Human
gauuauaggugugagccaccg

SEQ ID NO: 1101402 - RNA, 24 nt, Human
gauuauaggugugagccaccgugc

SEQ ID NO: 1101403 - RNA, 23 nt, Human
gcuggccucgaacuccugaccuc

SEQ ID NO: 1101404 - RNA, 24 nt, Human
ggcuggccucgaacuccugaccuc

SEQ ID NO: 1101405 - RNA, 24 nt, Human
gugauccaccugccucggccuccc

SEQ ID NO: 1101406 - RNA, 24 nt, Human
uaaaaaaaagccccaguuccacac

SEQ ID NO: 1101407 - RNA, 22 nt, Human
uaacagcaacaacagccacccu

SEQ ID NO: 1101408 - RNA, 20 nt, Human
uacugucugaguagauaucc

SEQ ID NO: 1101409 - RNA, 25 nt, Human
uagaggauccuucuucggagaaucu

SEQ ID NO: 1101410 - RNA, 26 nt, Human
uaguaacagcaacaacagccacccua

SEQ ID NO: 1101411 - RNA, 21 nt, Human
uccagaaagaccauauuggcc

SEQ ID NO: 1101412 - RNA, 23 nt, Human
ucccaaagugcugggauuauagg

SEQ ID NO: 1101413 - RNA, 18 nt, Human
ucggccucccaaagugcu

SEQ ID NO: 1101414 - RNA, 23 nt, Human
ugaguagauauccacuuccagaa

SEQ ID NO: 1101415 - RNA, 21 nt, Human
ugccucggccucccaaagugc

SEQ ID NO: 1101416 - RNA, 24 nt, Human
ugccucggccucccaaagugcugg

SEQ ID NO: 1101417 - RNA, 23 nt, Human
uggauaccuuaaaaaaaagcccc

SEQ ID NO: 1101418 - RNA, 24 nt, Human
uggccaggcuggccucgaacuccu

SEQ ID NO: 1101419 - RNA, 20 nt, Human
uggccucgaacuccugaccu

SEQ ID NO: 1101420 - RNA, 18 nt, Human
ugggauuauaggugugag

SEQ ID NO: 1101421 - RNA, 21 nt, Human
ugggauuauaggugugagcca

SEQ ID NO: 1101422 - RNA, 22 nt, Human
ugggauuauaggugugagccac

SEQ ID NO: 1101423 - RNA, 23 nt, Human
ugggauuauaggugugagccacc

SEQ ID NO: 1101424 - RNA, 23 nt, Human
ugggauuauaggugugagccacc

SEQ ID NO: 1101425 - RNA, 24 nt, Human
ugggauuauaggugugagccaccg

SEQ ID NO: 1101426 - RNA, 18 nt, Human
aagcucuuuuugaaucuc

SEQ ID NO: 1101427 - RNA, 24 nt, Human
auggaaccuccggaagcucuuuuu

SEQ ID NO: 1101428 - RNA, 19 nt, Human
uuagugguguggacccccc

SEQ ID NO: 1101429 - RNA, 19 nt, Human
uuuuucggauuuacuugua

SEQ ID NO: 1101430 - RNA, 24 nt, Human
aaaaaaaaaaaaaaaacgaaagag

SEQ ID NO: 1101431 - RNA, 20 nt, Human
aaaaaaaaaaaacgaaagag

SEQ ID NO: 1101432 - RNA, 26 nt, Human
aaaaaaaaaaaacgaaagagcgagga

SEQ ID NO: 1101433 - RNA, 30 nt, Human
aaaaaaaacgaaagagcgaggagaccggua

SEQ ID NO: 1101434 - RNA, 21 nt, Human
aagcagugcgcccuuuauggc

SEQ ID NO: 1101435 - RNA, 26 nt, Human
acaacagaggggaggaaaaaaaagaa

SEQ ID NO: 1101436 - RNA, 25 nt, Human
acagaggggaggaaaaaaaagaagc

SEQ ID NO: 1101437 - RNA, 19 nt, Human
accagggcuuugaauuuuc

SEQ ID NO: 1101438 - RNA, 23 nt, Human
agaaaaaaaacacaacagagggg

SEQ ID NO: 1101439 - RNA, 23 nt, Human
agaaaaaaaacacaacagagggg

SEQ ID NO: 1101440 - RNA, 18 nt, Human
agaccuccagcugcucaa

SEQ ID NO: 1101441 - RNA, 18 nt, Human
agagaggggcuagaagcg

SEQ ID NO: 1101442 - RNA, 22 nt, Human
agagauaaaggaaaagaggagg

SEQ ID NO: 1101443 - RNA, 18 nt, Human
agcagccgcagagguggc

SEQ ID NO: 1101444 - RNA, 20 nt, Human
aggaaaaaaaagaagcccua

SEQ ID NO: 1101445 - RNA, 26 nt, Human
aggaauggagagaaccagggcuuuga

SEQ ID NO: 1101446 - RNA, 23 nt, Human
caaagcagugcgcccuuuauggc

SEQ ID NO: 1101447 - RNA, 25 nt, Human
cacugagcccuccucuuggggaaaa

SEQ ID NO: 1101448 - RNA, 18 nt, Human
cagauuuauuagagaaac

SEQ ID NO: 1101449 - RNA, 24 nt, Human
cagccaccggcuccaccaguuuuc

SEQ ID NO: 1101450 - RNA, 19 nt, Human
cagccgcagagguggccag

SEQ ID NO: 1101451 - RNA, 22 nt, Human
cagggccaaggcgcacugaagc

SEQ ID NO: 1101452 - RNA, 23 nt, Human
ccagggccaaggcgcacugaagc

SEQ ID NO: 1101453 - RNA, 18 nt, Human
ccagggcuuugaauuuuc

SEQ ID NO: 1101454 - RNA, 24 nt, Human
ccccagguuugccugcggccaggg

SEQ ID NO: 1101455 - RNA, 20 nt, Human
ccccauacaccccaacauuu

SEQ ID NO: 1101456 - RNA, 21 nt, Human
cccggaguccagaccuccagc

SEQ ID NO: 1101457 - RNA, 18 nt, Human
ccgaacacagcaacuggg

SEQ ID NO: 1101458 - RNA, 22 nt, Human
ccucccaccccugccccuaauu

SEQ ID NO: 1101459 - RNA, 31 nt, Human
ccugcggccagggccaaggcgcacugaagcc

SEQ ID NO: 1101460 - RNA, 22 nt, Human
ccugcugacccgcauccaggga

SEQ ID NO: 1101461 - RNA, 26 nt, Human
cgcagccaccggcuccaccaguuuuc

SEQ ID NO: 1101462 - RNA, 21 nt, Human
cgcgcccagacgucuggcccc

SEQ ID NO: 1101463 - RNA, 31 nt, Human
cggaccugagugugugugugugugugugugg

SEQ ID NO: 1101464 - RNA, 23 nt, Human
cuugcacuaaguccugguggggg

SEQ ID NO: 1101465 - RNA, 21 nt, Human
gaaaggaccggcgcccccagg

SEQ ID NO: 1101466 - RNA, 18 nt, Human
gagacuguaaaagaauca

SEQ ID NO: 1101467 - RNA, 19 nt, Human
gaggagaaacaguugggcu

SEQ ID NO: 1101468 - RNA, 20 nt, Human
gaggagaaacaguugggcuu

SEQ ID NO: 1101469 - RNA, 23 nt, Human
gaggagaaacuccgcuuaccucc

SEQ ID NO: 1101470 - RNA, 22 nt, Human
gaggaggaauggagagaaccag

SEQ ID NO: 1101471 - RNA, 21 nt, Human
gaggggaccgugaggcaacgg

SEQ ID NO: 1101472 - RNA, 21 nt, Human
gauaaaggaaaagaggaggaa

SEQ ID NO: 1101473 - RNA, 25 nt, Human
gauaagcuaaaaaauagaaaaaaaa

SEQ ID NO: 1101474 - RNA, 18 nt, Human
gccgcagccaccggcucc

SEQ ID NO: 1101475 - RNA, 21 nt, Human
gccgcagccaccggcuccacc

SEQ ID NO: 1101476 - RNA, 18 nt, Human
gccgggaggacacaggag

SEQ ID NO: 1101477 - RNA, 20 nt, Human
gcgcccagacgucuggcccc

SEQ ID NO: 1101478 - RNA, 20 nt, Human
ggcagggauccggcggggcc

SEQ ID NO: 1101479 - RNA, 20 nt, Human
gggaaaauucagaaaauuga

SEQ ID NO: 1101480 - RNA, 21 nt, Human
gggggagaggagaggcugcag

SEQ ID NO: 1101481 - RNA, 20 nt, Human
guaaaagaaucaagaggcug

SEQ ID NO: 1101482 - RNA, 21 nt, Human
gugaggcaacggagggccgag

SEQ ID NO: 1101483 - RNA, 21 nt, Human
gugcgggucucagaacgaaag

SEQ ID NO: 1101484 - RNA, 20 nt, Human
gugugugugugugugugugu

SEQ ID NO: 1101485 - RNA, 23 nt, Human
uaaaaaauagaaaaaaaacacaa

SEQ ID NO: 1101486 - RNA, 24 nt, Human
uaaaaaugaaacuaucacuuuucc

SEQ ID NO: 1101487 - RNA, 18 nt, Human
uaaaauggggguaaggcc

SEQ ID NO: 1101488 - RNA, 22 nt, Human
uaacgagcccuauuuuuuuuau

SEQ ID NO: 1101489 - RNA, 23 nt, Human
uaagcuaaaaaauagaaaaaaaa

SEQ ID NO: 1101490 - RNA, 25 nt, Human
uagaaaaaaaacacaacagagggga

SEQ ID NO: 1101491 - RNA, 20 nt, Human
uagaguuggagugucccugg

SEQ ID NO: 1101492 - RNA, 20 nt, Human
uaggaaaaaaaaaaaaaaaa

SEQ ID NO: 1101493 - RNA, 18 nt, Human
uauggcguguaaaaaggg

SEQ ID NO: 1101494 - RNA, 18 nt, Human
uauuugaaaacucaccgg

SEQ ID NO: 1101495 - RNA, 21 nt, Human
ucagggccgaccaaggcgcgg

SEQ ID NO: 1101496 - RNA, 18 nt, Human
ucccaccccugccccuaa

SEQ ID NO: 1101497 - RNA, 22 nt, Human
uccgcagcugccgcuccaggga

SEQ ID NO: 1101498 - RNA, 22 nt, Human
ucgccuccuuucacggaaaauc

SEQ ID NO: 1101499 - RNA, 22 nt, Human
ucuuuugccggcuagccccucu

SEQ ID NO: 1101500 - RNA, 21 nt, Human
ugaaacuaucacuuuuccaaa

SEQ ID NO: 1101501 - RNA, 28 nt, Human
ugaaccuagagaaugagagaggggcuag

SEQ ID NO: 1101502 - RNA, 19 nt, Human
ugaauuuucagcgcguggc

SEQ ID NO: 1101503 - RNA, 21 nt, Human
ugaggaaaggaccggcgcccc

SEQ ID NO: 1101504 - RNA, 19 nt, Human
ugaggagaaacaguugggc

SEQ ID NO: 1101505 - RNA, 21 nt, Human
ugaggcaacggagggccgagu

SEQ ID NO: 1101506 - RNA, 28 nt, Human
ugcaaggggcugugaacaaccagggugc

SEQ ID NO: 1101507 - RNA, 19 nt, Human
ugccccaccgaacacagca

SEQ ID NO: 1101508 - RNA, 23 nt, Human
ugccccaccgaacacagcaacug

SEQ ID NO: 1101509 - RNA, 26 nt, Human
ugcccggaguccagaccuccagcugc

SEQ ID NO: 1101510 - RNA, 21 nt, Human
ugcugacccgcauccagggac

SEQ ID NO: 1101511 - RNA, 19 nt, Human
uggcguguaaaaaggggga

SEQ ID NO: 1101512 - RNA, 22 nt, Human
uggggaccccauacaccccaac

SEQ ID NO: 1101513 - RNA, 22 nt, Human
uguguguguguguggaugucug

SEQ ID NO: 1101514 - RNA, 19 nt, Human
uguguguguguguguggau

SEQ ID NO: 1101515 - RNA, 21 nt, Human
uguguguguguguguggaugu

SEQ ID NO: 1101516 - RNA, 18 nt, Human
ugugugugugugugugug

SEQ ID NO: 1101517 - RNA, 18 nt, Human
ugugugugugugugugug

SEQ ID NO: 1101518 - RNA, 18 nt, Human
ugugugugugugugugug

SEQ ID NO: 1101519 - RNA, 20 nt, Human
ugugugugugugugugugug

SEQ ID NO: 1101520 - RNA, 21 nt, Human
ugugugugugugugugugugu

SEQ ID NO: 1101521 - RNA, 21 nt, Human
ugugugugugugugugugugu

SEQ ID NO: 1101522 - RNA, 21 nt, Human
ugugugugugugugugugugu

SEQ ID NO: 1101523 - RNA, 21 nt, Human
ugugugugugugugugugugu

SEQ ID NO: 1101524 - RNA, 22 nt, Human
ugugugugugugugugugugug

SEQ ID NO: 1101525 - RNA, 22 nt, Human
ugugugugugugugugugugug

SEQ ID NO: 1101526 - RNA, 22 nt, Human
uguuauaggaaaaaaaaaaaaa

SEQ ID NO: 1101527 - RNA, 26 nt, Human
uguucuaaaucaucucuacaccgugc

SEQ ID NO: 1101528 - RNA, 18 nt, Human
uguuucaaauucugagga

SEQ ID NO: 1101529 - RNA, 22 nt, Human
uucuacguacaccucccacccc

SEQ ID NO: 1101530 - RNA, 25 nt, Human
uucuacguacaccucccaccccugc

SEQ ID NO: 1101531 - RNA, 21 nt, Human
uugaggagaaacuccgcuuac

SEQ ID NO: 1101532 - RNA, 22 nt, Human
uugccccaccgaacacagcaac

SEQ ID NO: 1101533 - RNA, 18 nt, Human
uuuauaaacacccagcgg

SEQ ID NO: 1101534 - RNA, 20 nt, Human
aaaaccccaaucggcuccuc

SEQ ID NO: 1101535 - RNA, 20 nt, Human
aaagagagagaaacagcugu

SEQ ID NO: 1101536 - RNA, 18 nt, Human
aacaacacaaaaacaacc

SEQ ID NO: 1101537 - RNA, 24 nt, Human
aacaacacaaaaacaacccucuaa

SEQ ID NO: 1101538 - RNA, 25 nt, Human
acaaaaugcgcugcuaggauccccc

SEQ ID NO: 1101539 - RNA, 27 nt, Human
acaacacaaaaacaacccucuaacugc

SEQ ID NO: 1101540 - RNA, 19 nt, Human
acaacuagguccagagacc

SEQ ID NO: 1101541 - RNA, 18 nt, Human
acaggaacaacacaaaaa

SEQ ID NO: 1101542 - RNA, 21 nt, Human
acaggaacaacacaaaaacaa

SEQ ID NO: 1101543 - RNA, 18 nt, Human
accccccucaccccucca

SEQ ID NO: 1101544 - RNA, 26 nt, Human
accucgccccucccagccacccuccg

SEQ ID NO: 1101545 - RNA, 22 nt, Human
agaccaagcagauggggcccca

SEQ ID NO: 1101546 - RNA, 24 nt, Human
agagagaaacagcuguaaagaaaa

SEQ ID NO: 1101547 - RNA, 18 nt, Human
agagaggaacaggcggca

SEQ ID NO: 1101548 - RNA, 19 nt, Human
agcgaaaccgaaggcccga

SEQ ID NO: 1101549 - RNA, 24 nt, Human
aggaagucaaaauaauaucaauuu

SEQ ID NO: 1101550 - RNA, 18 nt, Human
aggauccccaccagcucc

SEQ ID NO: 1101551 - RNA, 24 nt, Human
aggcggcugggugugaagguggug

SEQ ID NO: 1101552 - RNA, 19 nt, Human
auaauaguaaaauaagagc

SEQ ID NO: 1101553 - RNA, 22 nt, Human
aucggcuccuccgugccccucc

SEQ ID NO: 1101554 - RNA, 25 nt, Human
auuucauuaacaaauacaggaacaa

SEQ ID NO: 1101555 - RNA, 23 nt, Human
caaaaacaacccucuaacugcaa

SEQ ID NO: 1101556 - RNA, 23 nt, Human
caacucgccagcucucggaaacc

SEQ ID NO: 1101557 - RNA, 21 nt, Human
caagccuuuaguuugugauca

SEQ ID NO: 1101558 - RNA, 23 nt, Human
cacaaaaacaacccucuaacugc

SEQ ID NO: 1101559 - RNA, 27 nt, Human
cacaaaaacaacccucuaacugcaaca

SEQ ID NO: 1101560 - RNA, 21 nt, Human
cacaacuagguccagagaccc

SEQ ID NO: 1101561 - RNA, 23 nt, Human
caccaaggcgccgcaccccccuc

SEQ ID NO: 1101562 - RNA, 18 nt, Human
caccaccugccaauccca

SEQ ID NO: 1101563 - RNA, 22 nt, Human
caccccaagagagaggaacagg

SEQ ID NO: 1101564 - RNA, 20 nt, Human
caccccccucaccccuccag

SEQ ID NO: 1101565 - RNA, 18 nt, Human
caccggagcgggaggcug

SEQ ID NO: 1101566 - RNA, 19 nt, Human
caccggagcgggaggcugc

SEQ ID NO: 1101567 - RNA, 23 nt, Human
caccuccccugcgcucccggguc

SEQ ID NO: 1101568 - RNA, 24 nt, Human
cagcaccccaagagagaggaacag

SEQ ID NO: 1101569 - RNA, 21 nt, Human
caggaacaacacaaaaacaac

SEQ ID NO: 1101570 - RNA, 20 nt, Human
cagguggguaggaggagagu

SEQ ID NO: 1101571 - RNA, 25 nt, Human
cauaggccacuuagggucuccagga

SEQ ID NO: 1101572 - RNA, 22 nt, Human
ccaaggcgccgcaccccccuca

SEQ ID NO: 1101573 - RNA, 23 nt, Human
ccaccaaggcgccgcaccccccu

SEQ ID NO: 1101574 - RNA, 24 nt, Human
ccaccgcggguuuggguauccuuc

SEQ ID NO: 1101575 - RNA, 19 nt, Human
ccagacaggcugaacucac

SEQ ID NO: 1101576 - RNA, 24 nt, Human
ccagagaucucugccuaugcccag

SEQ ID NO: 1101577 - RNA, 19 nt, Human
ccaguccugggaccuugca

SEQ ID NO: 1101578 - RNA, 21 nt, Human
cccacaacuagguccagagac

SEQ ID NO: 1101579 - RNA, 23 nt, Human
cccagccacccuccgccguccag

SEQ ID NO: 1101580 - RNA, 19 nt, Human
cccaggugccccagcaccc

SEQ ID NO: 1101581 - RNA, 24 nt, Human
ccccaccccauaccuccuguccuu

SEQ ID NO: 1101582 - RNA, 18 nt, Human
ccccccucaccccuccag

SEQ ID NO: 1101583 - RNA, 21 nt, Human
ccccucaccccuccagccgcc

SEQ ID NO: 1101584 - RNA, 23 nt, Human
ccccucaccccuccagccgcccg

SEQ ID NO: 1101585 - RNA, 18 nt, Human
ccccuccagccgcccgag

SEQ ID NO: 1101586 - RNA, 23 nt, Human
ccccucccagccacccuccgccg

SEQ ID NO: 1101587 - RNA, 19 nt, Human
cccucccccaccccauacc

SEQ ID NO: 1101588 - RNA, 20 nt, Human
cccucuaacugcaacacucc

SEQ ID NO: 1101589 - RNA, 21 nt, Human
ccgcccgagauggagaacagg

SEQ ID NO: 1101590 - RNA, 19 nt, Human
ccuaugcccaguccuggga

SEQ ID NO: 1101591 - RNA, 23 nt, Human
ccuccgccguccaggcgugccca

SEQ ID NO: 1101592 - RNA, 24 nt, Human
ccucgccccucccagccacccucc

SEQ ID NO: 1101593 - RNA, 18 nt, Human
ccucugggccugauuucu

SEQ ID NO: 1101594 - RNA, 24 nt, Human
ccugcccacaacuagguccagaga

SEQ ID NO: 1101595 - RNA, 23 nt, Human
ccugcgcaccggcggcggcggcg

SEQ ID NO: 1101596 - RNA, 21 nt, Human
cgaaaccgaaggcccgagcgg

SEQ ID NO: 1101597 - RNA, 22 nt, Human
cgagauggagaacaggguuuau

SEQ ID NO: 1101598 - RNA, 21 nt, Human
cgagcugagccaccuccccug

SEQ ID NO: 1101599 - RNA, 23 nt, Human
cgcauaauaguaaaauaagagca

SEQ ID NO: 1101600 - RNA, 18 nt, Human
cgccccucccagccaccc

SEQ ID NO: 1101601 - RNA, 21 nt, Human
cgcgagcugagccaccucccc

SEQ ID NO: 1101602 - RNA, 22 nt, Human
cgcuaggaaucaucaccuuuug

SEQ ID NO: 1101603 - RNA, 22 nt, Human
cggcggcggcggcgcggaggag

SEQ ID NO: 1101604 - RNA, 21 nt, Human
cggcuccuccgugccccucca

SEQ ID NO: 1101605 - RNA, 23 nt, Human
cuccagagaucucugccuaugcc

SEQ ID NO: 1101606 - RNA, 18 nt, Human
cucccccaccccauaccu

SEQ ID NO: 1101607 - RNA, 20 nt, Human
cucccccaccccauaccucc

SEQ ID NO: 1101608 - RNA, 21 nt, Human
cuccccuucaccgcccagaag

SEQ ID NO: 1101609 - RNA, 20 nt, Human
cuccuccgugccccuccaaa

SEQ ID NO: 1101610 - RNA, 25 nt, Human
cugcccacaacuagguccagagacc

SEQ ID NO: 1101611 - RNA, 21 nt, Human
cugccucuccccuucaccgcc

SEQ ID NO: 1101612 - RNA, 23 nt, Human
cuuagggucuccaggacccacuc

SEQ ID NO: 1101613 - RNA, 24 nt, Human
cuuagggucuccaggacccacucc

SEQ ID NO: 1101614 - RNA, 20 nt, Human
cuucccagccgccuucuccu

SEQ ID NO: 1101615 - RNA, 25 nt, Human
gaccucgccccucccagccacccuc

SEQ ID NO: 1101616 - RNA, 20 nt, Human
gaggaagaggcggcugggug

SEQ ID NO: 1101617 - RNA, 21 nt, Human
gccccucccccaccccauacc

SEQ ID NO: 1101618 - RNA, 22 nt, Human
gccgcaccccccucaccccucc

SEQ ID NO: 1101619 - RNA, 21 nt, Human
gcgagcugagccaccuccccu

SEQ ID NO: 1101620 - RNA, 19 nt, Human
gcggcagagccaccgcggg

SEQ ID NO: 1101621 - RNA, 21 nt, Human
ggccggcggccgggccucucu

SEQ ID NO: 1101622 - RNA, 18 nt, Human
ggcggcggcggcgcggag

SEQ ID NO: 1101623 - RNA, 18 nt, Human
uaaaauaagagcaggggc

SEQ ID NO: 1101624 - RNA, 23 nt, Human
uacaggaacaacacaaaaacaac

SEQ ID NO: 1101625 - RNA, 23 nt, Human
uaccuccuguccuucucaacucg

SEQ ID NO: 1101626 - RNA, 18 nt, Human
uagcgugaccucgccccu

SEQ ID NO: 1101627 - RNA, 22 nt, Human
uagcgugaccucgccccuccca

SEQ ID NO: 1101628 - RNA, 23 nt, Human
uagcgugaccucgccccucccag

SEQ ID NO: 1101629 - RNA, 19 nt, Human
uaggauccccaccagcucc

SEQ ID NO: 1101630 - RNA, 25 nt, Human
ucaccaccugccaaucccaccaagg

SEQ ID NO: 1101631 - RNA, 24 nt, Human
ucagcgagggagcgaaaccgaagg

SEQ ID NO: 1101632 - RNA, 20 nt, Human
ucagggagacuagagucugg

SEQ ID NO: 1101633 - RNA, 19 nt, Human
ucagugguaaaaagagaga

SEQ ID NO: 1101634 - RNA, 20 nt, Human
uccaaagcgccucucagcga

SEQ ID NO: 1101635 - RNA, 21 nt, Human
uccaggccccucccccacccc

SEQ ID NO: 1101636 - RNA, 25 nt, Human
ucccaccaaggcgccgcaccccccu

SEQ ID NO: 1101637 - RNA, 20 nt, Human
ucccgggucuuuccguggcu

SEQ ID NO: 1101638 - RNA, 22 nt, Human
ucgccagcucucggaaacccgu

SEQ ID NO: 1101639 - RNA, 22 nt, Human
ucuaacugcaacacuccagaga

SEQ ID NO: 1101640 - RNA, 23 nt, Human
ucucccagacaggcugaacucac

SEQ ID NO: 1101641 - RNA, 19 nt, Human
ucucugccuaugcccaguc

SEQ ID NO: 1101642 - RNA, 23 nt, Human
ugcggcccaggugccccagcacc

SEQ ID NO: 1101643 - RNA, 21 nt, Human
uggcagccacagguugcuagc

SEQ ID NO: 1101644 - RNA, 21 nt, Human
uggcccagggcccacagacaa

SEQ ID NO: 1101645 - RNA, 23 nt, Human
uggcuucccagccgccuucuccu

SEQ ID NO: 1101646 - RNA, 19 nt, Human
ugggaccuugcaggugggu

SEQ ID NO: 1101647 - RNA, 22 nt, Human
ugggagggccgcugggccggcg

SEQ ID NO: 1101648 - RNA, 24 nt, Human
uggguauccuugauccuggcgccc

SEQ ID NO: 1101649 - RNA, 19 nt, Human
uucccagccgccuucuccu

SEQ ID NO: 1101650 - RNA, 27 nt, Human
aagaccccuacccuggggugggggggg

SEQ ID NO: 1101651 - RNA, 21 nt, Human
aaggagccaggguugggaaug

SEQ ID NO: 1101652 - RNA, 24 nt, Human
aauagaggucacaaguggccucca

SEQ ID NO: 1101653 - RNA, 19 nt, Human
aaugcaagaaucagaagga

SEQ ID NO: 1101654 - RNA, 24 nt, Human
acacaucaccacacggaccaaucc

SEQ ID NO: 1101655 - RNA, 20 nt, Human
acaggacagcguccagagga

SEQ ID NO: 1101656 - RNA, 22 nt, Human
acaucaccacacggaccaaucc

SEQ ID NO: 1101657 - RNA, 20 nt, Human
accucguucgccccaguggu

SEQ ID NO: 1101658 - RNA, 20 nt, Human
agaaguugaagcuguucauu

SEQ ID NO: 1101659 - RNA, 20 nt, Human
agagcacagucuucaucuuc

SEQ ID NO: 1101660 - RNA, 19 nt, Human
aggaaagugucaugagagu

SEQ ID NO: 1101661 - RNA, 21 nt, Human
aggaggagcugggagugaggu

SEQ ID NO: 1101662 - RNA, 22 nt, Human
aggguucucaucggcaagaagu

SEQ ID NO: 1101663 - RNA, 23 nt, Human
agguagagcacagucuucaucuu

SEQ ID NO: 1101664 - RNA, 23 nt, Human
aguggugggcuggggauggggag

SEQ ID NO: 1101665 - RNA, 19 nt, Human
auacugcuccugccucgug

SEQ ID NO: 1101666 - RNA, 21 nt, Human
auauauaugcacagcaauccc

SEQ ID NO: 1101667 - RNA, 21 nt, Human
aucugaaggcaugaugugagg

SEQ ID NO: 1101668 - RNA, 19 nt, Human
augaugcuggggagugauc

SEQ ID NO: 1101669 - RNA, 23 nt, Human
auggggagcaggaggagguagag

SEQ ID NO: 1101670 - RNA, 24 nt, Human
caaguggccuccagccaaaauccu

SEQ ID NO: 1101671 - RNA, 18 nt, Human
caccuggccauguugagc

SEQ ID NO: 1101672 - RNA, 24 nt, Human
cacugagccaauaggagugagugg

SEQ ID NO: 1101673 - RNA, 21 nt, Human
cagcaguccugagugcuacac

SEQ ID NO: 1101674 - RNA, 22 nt, Human
cagcguccagaggaggaagaga

SEQ ID NO: 1101675 - RNA, 25 nt, Human
caggacccacaaagaccccuacccu

SEQ ID NO: 1101676 - RNA, 24 nt, Human
cauuauguuaaccuucuugggagc

SEQ ID NO: 1101677 - RNA, 25 nt, Human
cauuauguuaaccuucuugggagcu

SEQ ID NO: 1101678 - RNA, 26 nt, Human
ccagcuacacguauauacuuacugca

SEQ ID NO: 1101679 - RNA, 20 nt, Human
ccaggcacacaguagaugcu

SEQ ID NO: 1101680 - RNA, 18 nt, Human
cccugggguggggggggu

SEQ ID NO: 1101681 - RNA, 19 nt, Human
ccuccagccaaaauccugc

SEQ ID NO: 1101682 - RNA, 23 nt, Human
ccugugccagcuacacguauaua

SEQ ID NO: 1101683 - RNA, 18 nt, Human
ccuucaagcuguuaccua

SEQ ID NO: 1101684 - RNA, 21 nt, Human
cuacacugaugcagcaaugac

SEQ ID NO: 1101685 - RNA, 19 nt, Human
cucccucucagcuugauuc

SEQ ID NO: 1101686 - RNA, 23 nt, Human
cugaaccucguucgccccagugg

SEQ ID NO: 1101687 - RNA, 19 nt, Human
cugccucgugagcagagag

SEQ ID NO: 1101688 - RNA, 20 nt, Human
cugcuccucccugaaccucg

SEQ ID NO: 1101689 - RNA, 24 nt, Human
cuucuuucuaggcuucaguuucau

SEQ ID NO: 1101690 - RNA, 19 nt, Human
gaggccuucugggcacuga

SEQ ID NO: 1101691 - RNA, 27 nt, Human
gcacugagccaauaggagugagugguu

SEQ ID NO: 1101692 - RNA, 23 nt, Human
gcagucacuucuuucuaggcuuc

SEQ ID NO: 1101693 - RNA, 21 nt, Human
ggcuccagucugcgcuccacc

SEQ ID NO: 1101694 - RNA, 18 nt, Human
gguggcccuccaggacag

SEQ ID NO: 1101695 - RNA, 23 nt, Human
gugggcucucucugaggccuucu

SEQ ID NO: 1101696 - RNA, 18 nt, Human
gugggcuggggaugggga

SEQ ID NO: 1101697 - RNA, 22 nt, Human
guggugggcuggggauggggag

SEQ ID NO: 1101698 - RNA, 19 nt, Human
guucaggaaagugucauga

SEQ ID NO: 1101699 - RNA, 19 nt, Human
uaagaugagacacaucacc

SEQ ID NO: 1101700 - RNA, 22 nt, Human
uacacacaggacagcguccaga

SEQ ID NO: 1101701 - RNA, 24 nt, Human
uaccucuaaggacuguucuucagc

SEQ ID NO: 1101702 - RNA, 19 nt, Human
uacgaugaguagcaaaacc

SEQ ID NO: 1101703 - RNA, 19 nt, Human
uagaugucuucagcagucc

SEQ ID NO: 1101704 - RNA, 19 nt, Human
uagcaagguccugugccag

SEQ ID NO: 1101705 - RNA, 19 nt, Human
uaggagugagugguuccau

SEQ ID NO: 1101706 - RNA, 27 nt, Human
uaggcuccagucugcgcuccacccagg

SEQ ID NO: 1101707 - RNA, 21 nt, Human
uauucaguguaaacuaagcac

SEQ ID NO: 1101708 - RNA, 20 nt, Human
ucacaaguggccuccagcca

SEQ ID NO: 1101709 - RNA, 21 nt, Human
ucaccacacggaccaaucccc

SEQ ID NO: 1101710 - RNA, 21 nt, Human
ucaucggcaagaaguugaagc

SEQ ID NO: 1101711 - RNA, 19 nt, Human
ucaugagagugacaggggc

SEQ ID NO: 1101712 - RNA, 23 nt, Human
uccugggcucaggugagucccug

SEQ ID NO: 1101713 - RNA, 19 nt, Human
uccugugcuagcaaggucc

SEQ ID NO: 1101714 - RNA, 22 nt, Human
ucgugagcagagagaggguucu

SEQ ID NO: 1101715 - RNA, 21 nt, Human
ucuccuggugguggcccucca

SEQ ID NO: 1101716 - RNA, 24 nt, Human
ucucucugaggccuucugggcacu

SEQ ID NO: 1101717 - RNA, 23 nt, Human
ucucuugguaaggaagaugagga

SEQ ID NO: 1101718 - RNA, 25 nt, Human
ucugagugcuggugaaaugguucag

SEQ ID NO: 1101719 - RNA, 18 nt, Human
ucugcgcuccacccagga

SEQ ID NO: 1101720 - RNA, 22 nt, Human
ucuugggagcugagcucugggg

SEQ ID NO: 1101721 - RNA, 21 nt, Human
ugaagcuguucauuuucuaag

SEQ ID NO: 1101722 - RNA, 21 nt, Human
ugagcugcaggaggagcuggg

SEQ ID NO: 1101723 - RNA, 20 nt, Human
ugagucugaggugggaggcc

SEQ ID NO: 1101724 - RNA, 21 nt, Human
ugagugggcagaguuagaugu

SEQ ID NO: 1101725 - RNA, 24 nt, Human
ugcuccaguggugggccguccccg

SEQ ID NO: 1101726 - RNA, 20 nt, Human
uggccauguugagcugcagg

SEQ ID NO: 1101727 - RNA, 20 nt, Human
uggccuccagccaaaauccu

SEQ ID NO: 1101728 - RNA, 18 nt, Human
uggcuggggcaaagucga

SEQ ID NO: 1101729 - RNA, 24 nt, Human
ugggcagaguuagauguuuguugg

SEQ ID NO: 1101730 - RNA, 19 nt, Human
ugggcucucucugaggccu

SEQ ID NO: 1101731 - RNA, 24 nt, Human
uggggagcaggaggagguagagcu

SEQ ID NO: 1101732 - RNA, 19 nt, Human
uggggauggggagcaggag

SEQ ID NO: 1101733 - RNA, 21 nt, Human
ugggguggggggggugcguuu

SEQ ID NO: 1101734 - RNA, 21 nt, Human
ugugcuuugcaacaauggccu

SEQ ID NO: 1101735 - RNA, 22 nt, Human
uuagauguuuguuggcuccccu

SEQ ID NO: 1101736 - RNA, 19 nt, Human
uuaggcuccagucugcgcu

SEQ ID NO: 1101737 - RNA, 18 nt, Human
uucaacucuuccagugaa

SEQ ID NO: 1101738 - RNA, 18 nt, Human
uucccgguuuauccugug

SEQ ID NO: 1101739 - RNA, 21 nt, Human
uucuaagacuucucccucuca

SEQ ID NO: 1101740 - RNA, 25 nt, Human
uucuaagacuucucccucucagcuu

SEQ ID NO: 1101741 - RNA, 24 nt, Human
uucuaggcuucaguuucauccacu

SEQ ID NO: 1101742 - RNA, 22 nt, Human
uucugagugcuggugaaauggu

SEQ ID NO: 1101743 - RNA, 24 nt, Human
uugaauuugaagaaugaugcuggg

SEQ ID NO: 1101744 - RNA, 21 nt, Human
aaauaucuguucaauaccuaa

SEQ ID NO: 1101745 - RNA, 20 nt, Human
agagccccccaaccacccuc

SEQ ID NO: 1101746 - RNA, 21 nt, Human
cacugcuaaagguaucaggag

SEQ ID NO: 1101747 - RNA, 23 nt, Human
ccccaaccacccucuaaguuggg

SEQ ID NO: 1101748 - RNA, 23 nt, Human
cccccaaccacccucuaaguugg

SEQ ID NO: 1101749 - RNA, 22 nt, Human
ccugggguuauuaccuaaccuc

SEQ ID NO: 1101750 - RNA, 22 nt, Human
cuggaaagcucuaaugcucccc

SEQ ID NO: 1101751 - RNA, 22 nt, Human
gagccccccaaccacccucuaa

SEQ ID NO: 1101752 - RNA, 18 nt, Human
ggaggggaagaaaagaga

SEQ ID NO: 1101753 - RNA, 20 nt, Human
gggaagaaaagagaaugugg

SEQ ID NO: 1101754 - RNA, 21 nt, Human
uaaagguaucaggagacccac

SEQ ID NO: 1101755 - RNA, 24 nt, Human
uaccuaaccucccgugacugcugg

SEQ ID NO: 1101756 - RNA, 24 nt, Human
ucuccugggguuauuaccuaaccu

SEQ ID NO: 1101757 - RNA, 19 nt, Human
uggagagccccccaaccac

SEQ ID NO: 1101758 - RNA, 23 nt, Human
uuaaugaggauggagagcccccc

SEQ ID NO: 1101759 - RNA, 19 nt, Human
uuccagggguaaagcacug

SEQ ID NO: 1101760 - RNA, 23 nt, Human
aaaugacuugcaacguuauaggc

SEQ ID NO: 1101761 - RNA, 24 nt, Human
acuuuaugaucaugaaccuguaau

SEQ ID NO: 1101762 - RNA, 20 nt, Human
augaaccuguaauuuccaaa

SEQ ID NO: 1101763 - RNA, 18 nt, Human
cagccgcugcugcggcug

SEQ ID NO: 1101764 - RNA, 24 nt, Human
caggcucugcuucuucaaagcucu

SEQ ID NO: 1101765 - RNA, 19 nt, Human
ccgcugcugcggcugccgc

SEQ ID NO: 1101766 - RNA, 18 nt, Human
ccuguaauuuccaaaagu

SEQ ID NO: 1101767 - RNA, 21 nt, Human
ccuguaauuuccaaaaguaag

SEQ ID NO: 1101768 - RNA, 22 nt, Human
cguuauaggcuauggaguuuca

SEQ ID NO: 1101769 - RNA, 23 nt, Human
cugcagccgcugcugcggcugcc

SEQ ID NO: 1101770 - RNA, 24 nt, Human
gcaaagccggauagagcggagcca

SEQ ID NO: 1101771 - RNA, 23 nt, Human
gcuauggaguuucaaccaccaag

SEQ ID NO: 1101772 - RNA, 22 nt, Human
ucaaccaccaagaagugggugc

SEQ ID NO: 1101773 - RNA, 18 nt, Human
ugcagccgcugcugcggc

SEQ ID NO: 1101774 - RNA, 26 nt, Human
ugccgcagcuccccuagcaaagccgg

SEQ ID NO: 1101775 - RNA, 18 nt, Human
ugcugcggcugccgcagc

SEQ ID NO: 1101776 - RNA, 21 nt, Human
ugcugugguuuuuugaacaua

SEQ ID NO: 1101777 - RNA, 22 nt, Human
uuguaguuaaaauuaacaauac

SEQ ID NO: 1101778 - RNA, 20 nt, Human
uuuccuuuuuauggugcagg

SEQ ID NO: 1101779 - RNA, 21 nt, Human
uuuuauggugcaggcucugcu

SEQ ID NO: 1101780 - RNA, 19 nt, Human
acccugagccucagcccgg

SEQ ID NO: 1101781 - RNA, 19 nt, Human
agccccuaaccccgccuca

SEQ ID NO: 1101782 - RNA, 24 nt, Human
ccaacccugagccucagcccggcc

SEQ ID NO: 1101783 - RNA, 22 nt, Human
ccccgccggccuccccagcccg

SEQ ID NO: 1101784 - RNA, 24 nt, Human
cccgccuagccccuaaccccgccu

SEQ ID NO: 1101785 - RNA, 22 nt, Human
ccuaaccccgccucaugcuggc

SEQ ID NO: 1101786 - RNA, 19 nt, Human
ccuagccccuaaccccgcc

SEQ ID NO: 1101787 - RNA, 21 nt, Human
ccucaugcuggcgcagccccc

SEQ ID NO: 1101788 - RNA, 23 nt, Human
cucagcccggccgagcccucggc

SEQ ID NO: 1101789 - RNA, 18 nt, Human
cuccccagcccggcuccc

SEQ ID NO: 1101790 - RNA, 21 nt, Human
gagcccucggcccagccguga

SEQ ID NO: 1101791 - RNA, 23 nt, Human
gcccccgccuagccccuaacccc

SEQ ID NO: 1101792 - RNA, 20 nt, Human
uagccccuaaccccgccuca

SEQ ID NO: 1101793 - RNA, 21 nt, Human
ucuugcgugaaguccaacccu

SEQ ID NO: 1101794 - RNA, 21 nt, Human
aaaggccaggacccacagaua

SEQ ID NO: 1101795 - RNA, 23 nt, Human
aaccccaaacaggccuggacaug

SEQ ID NO: 1101796 - RNA, 23 nt, Human
aaccccaacaggccccuccuggc

SEQ ID NO: 1101797 - RNA, 21 nt, Human
aacuacuaauugucaaccacc

SEQ ID NO: 1101798 - RNA, 19 nt, Human
aaggaggggggcgaagagg

SEQ ID NO: 1101799 - RNA, 20 nt, Human
aaggaggggggcgaagaggg

SEQ ID NO: 1101800 - RNA, 23 nt, Human
acacacacacacacacacacaca

SEQ ID NO: 1101801 - RNA, 31 nt, Human
acacacacacacacacacacacacccugugg

SEQ ID NO: 1101802 - RNA, 25 nt, Human
acacacacacacacacacacacccu

SEQ ID NO: 1101803 - RNA, 20 nt, Human
acaccgaaagaaaagaaaag

SEQ ID NO: 1101804 - RNA, 23 nt, Human
acccagcuucaggaguagaagcc

SEQ ID NO: 1101805 - RNA, 22 nt, Human
accccauucucucuccucccca

SEQ ID NO: 1101806 - RNA, 28 nt, Human
accccauucucucuccuccccacaguca

SEQ ID NO: 1101807 - RNA, 19 nt, Human
acccugugauuaaacuacu

SEQ ID NO: 1101808 - RNA, 24 nt, Human
acucaaaccccaacaggccccucc

SEQ ID NO: 1101809 - RNA, 21 nt, Human
agaaaggccaggacccacaga

SEQ ID NO: 1101810 - RNA, 18 nt, Human
agaaauaaugugugcccc

SEQ ID NO: 1101811 - RNA, 23 nt, Human
agaaaucccaucccuucccaucu

SEQ ID NO: 1101812 - RNA, 18 nt, Human
agaaccuucccuaccccu

SEQ ID NO: 1101813 - RNA, 24 nt, Human
agagaagagaugaaaagagcagag

SEQ ID NO: 1101814 - RNA, 24 nt, Human
agagaggggaagggagcuugaggu

SEQ ID NO: 1101815 - RNA, 21 nt, Human
agagaugaaaagagcagaggg

SEQ ID NO: 1101816 - RNA, 21 nt, Human
agaggggaagggagcuugagg

SEQ ID NO: 1101817 - RNA, 19 nt, Human
agauaugaaccaggaugcc

SEQ ID NO: 1101818 - RNA, 18 nt, Human
agcaacacagauaugaac

SEQ ID NO: 1101819 - RNA, 19 nt, Human
agccgcugagguccucucc

SEQ ID NO: 1101820 - RNA, 21 nt, Human
aggccaggccacccagcuuca

SEQ ID NO: 1101821 - RNA, 18 nt, Human
aggcccagcuaagcccag

SEQ ID NO: 1101822 - RNA, 21 nt, Human
aggcccagcuaagcccaguga

SEQ ID NO: 1101823 - RNA, 24 nt, Human
aggccucagaggcccagcuaagcc

SEQ ID NO: 1101824 - RNA, 22 nt, Human
aggccuggccuggcugccggcc

SEQ ID NO: 1101825 - RNA, 23 nt, Human
aguacaggagacaccgaaagaaa

SEQ ID NO: 1101826 - RNA, 19 nt, Human
auaaugugugccccacccc

SEQ ID NO: 1101827 - RNA, 19 nt, Human
auaccacagacacacccug

SEQ ID NO: 1101828 - RNA, 25 nt, Human
auauacaugcgugcacauaaacaca

SEQ ID NO: 1101829 - RNA, 21 nt, Human
aucccaucccuucccaucucc

SEQ ID NO: 1101830 - RNA, 23 nt, Human
aucccuucccaucuccuccccca

SEQ ID NO: 1101831 - RNA, 23 nt, Human
augaagaaaggccaggacccaca

SEQ ID NO: 1101832 - RNA, 31 nt, Human
augcgugcacauaaacacacacacacacaca

SEQ ID NO: 1101833 - RNA, 18 nt, Human
caacacagauaugaacca

SEQ ID NO: 1101834 - RNA, 22 nt, Human
caaccccaaacaggccuggaca

SEQ ID NO: 1101835 - RNA, 20 nt, Human
cacacacacacacacacaca

SEQ ID NO: 1101836 - RNA, 20 nt, Human
cacacacacacacacacaca

SEQ ID NO: 1101837 - RNA, 20 nt, Human
cacacacacacacacacaca

SEQ ID NO: 1101838 - RNA, 20 nt, Human
cacacacacacacacacaca

SEQ ID NO: 1101839 - RNA, 22 nt, Human
cacacacacacacacacacaca

SEQ ID NO: 1101840 - RNA, 22 nt, Human
cacacacacacacacacacaca

SEQ ID NO: 1101841 - RNA, 26 nt, Human
cacacacacacacacacacacacaca

SEQ ID NO: 1101842 - RNA, 30 nt, Human; identical to SEQ ID NO: 326474

SEQ ID NO: 1101843 - RNA, 22 nt, Human
cacacacacacccugugauuaa

SEQ ID NO: 1101844 - RNA, 20 nt, Human
cacagacacuguagucagca

SEQ ID NO: 1101845 - RNA, 20 nt, Human
cagacacacccugugccaga

SEQ ID NO: 1101846 - RNA, 20 nt, Human
cagacacuguagucagcaac

SEQ ID NO: 1101847 - RNA, 30 nt, Human
cagcaacacagauaugaaccaggaugccaa

SEQ ID NO: 1101848 - RNA, 18 nt, Human
cagccagggcucuggggc

SEQ ID NO: 1101849 - RNA, 22 nt, Human
cagcgacaccccucuguggucu

SEQ ID NO: 1101850 - RNA, 28 nt, Human
cagcgacaccccucuguggucuucagac

SEQ ID NO: 1101851 - RNA, 24 nt, Human
caggaagaucccagugacucaaac

SEQ ID NO: 1101852 - RNA, 24 nt, Human
caggacccacagauacuacccucu

SEQ ID NO: 1101853 - RNA, 23 nt, Human
caggaguagaagccaugguccaa

SEQ ID NO: 1101854 - RNA, 19 nt, Human
caggaguuucgggacccgg

SEQ ID NO: 1101855 - RNA, 20 nt, Human
caggccaggccaggccaccc

SEQ ID NO: 1101856 - RNA, 18 nt, Human
caguggguuuccggaauc

SEQ ID NO: 1101857 - RNA, 31 nt, Human
cauaaacacacacacacacacacacacacag

SEQ ID NO: 1101858 - RNA, 21 nt, Human
caucacagacacuguagucag

SEQ ID NO: 1101859 - RNA, 27 nt, Human
caugaccagugagaaauaaugugugcc

SEQ ID NO: 1101860 - RNA, 23 nt, Human
caugcggacaucacagacacugu

SEQ ID NO: 1101861 - RNA, 20 nt, Human
ccaaaggaggggggcgaaga

SEQ ID NO: 1101862 - RNA, 22 nt, Human
ccaaagugguggaauauagugu

SEQ ID NO: 1101863 - RNA, 21 nt, Human
ccacccagcuucaggaguaga

SEQ ID NO: 1101864 - RNA, 24 nt, Human
ccacccagcuucaggaguagaagc

SEQ ID NO: 1101865 - RNA, 24 nt, Human
ccaggaagaucccagugacucaaa

SEQ ID NO: 1101866 - RNA, 26 nt, Human
cccaaaagguugagagaagagaugaa

SEQ ID NO: 1101867 - RNA, 21 nt, Human
cccagugacucaaaccccaac

SEQ ID NO: 1101868 - RNA, 21 nt, Human
cccauugccauggggacuguc

SEQ ID NO: 1101869 - RNA, 22 nt, Human
ccccaaaagguugagagaagag

SEQ ID NO: 1101870 - RNA, 19 nt, Human
ccccaccccccaccaguga

SEQ ID NO: 1101871 - RNA, 18 nt, Human
cccgcucugggacccaga

SEQ ID NO: 1101872 - RNA, 22 nt, Human
cccggccgcgccgccuucccug

SEQ ID NO: 1101873 - RNA, 27 nt, Human
cccuggccagcccugccaucaguaugg

SEQ ID NO: 1101874 - RNA, 20 nt, Human
cccugggcggccuugggccu

SEQ ID NO: 1101875 - RNA, 21 nt, Human
cccugggcggccuugggccuu

SEQ ID NO: 1101876 - RNA, 22 nt, Human
cccuuaaacacugagcuccaaa

SEQ ID NO: 1101877 - RNA, 19 nt, Human
ccucccccacugucccaaa

SEQ ID NO: 1101878 - RNA, 19 nt, Human
ccuccgagaccccgggcag

SEQ ID NO: 1101879 - RNA, 18 nt, Human
ccugccaucaguauggga

SEQ ID NO: 1101880 - RNA, 23 nt, Human
ccuuggugggcucagguuuggga

SEQ ID NO: 1101881 - RNA, 19 nt, Human
cgcacacaugaagaaaggc

SEQ ID NO: 1101882 - RNA, 20 nt, Human
cgcugagguccucuccgccc

SEQ ID NO: 1101883 - RNA, 20 nt, Human
cguggugaugcauauacaug

SEQ ID NO: 1101884 - RNA, 21 nt, Human
cuccugaagcagagcuggaaa

SEQ ID NO: 1101885 - RNA, 19 nt, Human
cuucagacaguggguuucc

SEQ ID NO: 1101886 - RNA, 21 nt, Human
cuucaggggugcuaguacccc

SEQ ID NO: 1101887 - RNA, 27 nt, Human
gaaaagagcagagggcagccgguaccc

SEQ ID NO: 1101888 - RNA, 21 nt, Human
gaaagaaaagaaaaggcagaa

SEQ ID NO: 1101889 - RNA, 20 nt, Human
gaagaagcugugcgugagua

SEQ ID NO: 1101890 - RNA, 21 nt, Human
gaaguacaggagacaccgaaa

SEQ ID NO: 1101891 - RNA, 24 nt, Human
gacacacccugugccagaagaguc

SEQ ID NO: 1101892 - RNA, 19 nt, Human
gaggagaaauuuugggaag

SEQ ID NO: 1101893 - RNA, 20 nt, Human
gaggagaaauuuugggaagu

SEQ ID NO: 1101894 - RNA, 19 nt, Human
gauucuuccagaugaggga

SEQ ID NO: 1101895 - RNA, 25 nt, Human
gcaaccccaaacaggccuggacaug

SEQ ID NO: 1101896 - RNA, 33 nt, Human
gcacauaaacacacacacacacacacacacagu

SEQ ID NO: 1101897 - RNA, 23 nt, Human
gccaggccacccagcuucaggag

SEQ ID NO: 1101898 - RNA, 20 nt, Human
gcccccaaaggaggggggcc

SEQ ID NO: 1101899 - RNA, 22 nt, Human
gcccccaaaggaggggggcgaa

SEQ ID NO: 1101900 - RNA, 20 nt, Human
gcccugggcggccuugggcc

SEQ ID NO: 1101901 - RNA, 19 nt, Human
gcccuuaaacacugagcuc

SEQ ID NO: 1101902 - RNA, 20 nt, Human
gccgcgccgccuucccuggg

SEQ ID NO: 1101903 - RNA, 29 nt, Human
gcgugcacauaaacacacacacacacaca

SEQ ID NO: 1101904 - RNA, 24 nt, Human
gcgugcucagcccgggcugggagu

SEQ ID NO: 1101905 - RNA, 19 nt, Human
gcuggguuggaggcacagg

SEQ ID NO: 1101906 - RNA, 21 nt, Human
ggagguggugucaggacacag

SEQ ID NO: 1101907 - RNA, 25 nt, Human
ggcaaccccaaacaggccuggacau

SEQ ID NO: 1101908 - RNA, 19 nt, Human
ggccucagaggcccagcua

SEQ ID NO: 1101909 - RNA, 22 nt, Human
gggccacucagaggccuggccu

SEQ ID NO: 1101910 - RNA, 19 nt, Human
gguggauggggagguggug

SEQ ID NO: 1101911 - RNA, 21 nt, Human
gguuggaggcacagguggagc

SEQ ID NO: 1101912 - RNA, 21 nt, Human
guagauggcuuggaacauagc

SEQ ID NO: 1101913 - RNA, 21 nt, Human
gucacggggcccccaaaggag

SEQ ID NO: 1101914 - RNA, 21 nt, Human
guccagccagggcucuggggc

SEQ ID NO: 1101915 - RNA, 27 nt, Human
gugaugcauauacaugcgugcacauag

SEQ ID NO: 1101916 - RNA, 27 nt, Human
gugcacauaaacacacacacacacaca

SEQ ID NO: 1101917 - RNA, 19 nt, Human
guggaauauagugugcccc

SEQ ID NO: 1101918 - RNA, 20 nt, Human
guggaauauagugugccccc

SEQ ID NO: 1101919 - RNA, 21 nt, Human
gugguggauggggagguggug

SEQ ID NO: 1101920 - RNA, 25 nt, Human
uacaggagacaccgaaagaaaagaa

SEQ ID NO: 1101921 - RNA, 21 nt, Human
uaccccauucucucuccuccc

SEQ ID NO: 1101922 - RNA, 21 nt, Human
uagauggcuuggaacauagca

SEQ ID NO: 1101923 - RNA, 23 nt, Human
uagucagcaacacagauaugaac

SEQ ID NO: 1101924 - RNA, 22 nt, Human
uagugugccccccacauucagg

SEQ ID NO: 1101925 - RNA, 20 nt, Human
ucaaccaccucacagguaua

SEQ ID NO: 1101926 - RNA, 23 nt, Human
ucacagguauaccacagacacac

SEQ ID NO: 1101927 - RNA, 20 nt, Human
ucagcaacacagauaugaac

SEQ ID NO: 1101928 - RNA, 21 nt, Human
ucaggggugcuaguaccccau

SEQ ID NO: 1101929 - RNA, 21 nt, Human
uccaaagugguggaauauagu

SEQ ID NO: 1101930 - RNA, 23 nt, Human
uccagaguguucuggccucucau

SEQ ID NO: 1101931 - RNA, 22 nt, Human
uccagccagggcucuggggcca

SEQ ID NO: 1101932 - RNA, 22 nt, Human
uccagccccauugccaugggga

SEQ ID NO: 1101933 - RNA, 26 nt, Human
ucccaucuccucccccacugucccaa

SEQ ID NO: 1101934 - RNA, 24 nt, Human
uccccagaccucaauauccuucca

SEQ ID NO: 1101935 - RNA, 22 nt, Human
ucccugggugucgccgcagccg

SEQ ID NO: 1101936 - RNA, 19 nt, Human
ucccuucccaucuccuccc

SEQ ID NO: 1101937 - RNA, 23 nt, Human
uccugcccacaucugagcuccag

SEQ ID NO: 1101938 - RNA, 18 nt, Human
ucucauagcuccugaagc

SEQ ID NO: 1101939 - RNA, 21 nt, Human
ucuccucccccacugucccaa

SEQ ID NO: 1101940 - RNA, 24 nt, Human
ucuccucucucugcccugggcggc

SEQ ID NO: 1101941 - RNA, 23 nt, Human
ucucucuccuccccacagucaaa

SEQ ID NO: 1101942 - RNA, 21 nt, Human
ucucuuaccucucaccaggaa

SEQ ID NO: 1101943 - RNA, 24 nt, Human
ucugggaagcgggucagggucucc

SEQ ID NO: 1101944 - RNA, 19 nt, Human
ucuggggccacucagaggc

SEQ ID NO: 1101945 - RNA, 24 nt, Human
ucuguggucuucagacaguggguu

SEQ ID NO: 1101946 - RNA, 19 nt, Human
ugaaaagagcagagggcag

SEQ ID NO: 1101947 - RNA, 22 nt, Human
ugaaaagagcagagggcagcca

SEQ ID NO: 1101948 - RNA, 21 nt, Human
ugacgguggcgagcacagggc

SEQ ID NO: 1101949 - RNA, 18 nt, Human
ugacucaaaccccaacag

SEQ ID NO: 1101950 - RNA, 21 nt, Human
ugacuucucuuaccucucacc

SEQ ID NO: 1101951 - RNA, 19 nt, Human
ugagagaaccuucccuacc

SEQ ID NO: 1101952 - RNA, 23 nt, Human
ugcaaaguccucccuuuucccca

SEQ ID NO: 1101953 - RNA, 19 nt, Human
ugcacauaaacacacacac

SEQ ID NO: 1101954 - RNA, 21 nt, Human
ugcacauaaacacacacacac

SEQ ID NO: 1101955 - RNA, 28 nt, Human
ugcgugcacauaaacacacacacacagg

SEQ ID NO: 1101956 - RNA, 22 nt, Human
ugcucagcccgggcugggagug

SEQ ID NO: 1101957 - RNA, 21 nt, Human
uggaauauagugugcccccca

SEQ ID NO: 1101958 - RNA, 18 nt, Human
ugggacccagaaauccca

SEQ ID NO: 1101959 - RNA, 20 nt, Human
ugggaguguccgagggcucu

SEQ ID NO: 1101960 - RNA, 18 nt, Human
ugguggauggggaggugg

SEQ ID NO: 1101961 - RNA, 23 nt, Human
ugugugccccaccccccaccagu

SEQ ID NO: 1101962 - RNA, 25 nt, Human
uguuccccccuuuuccaagcccuua

SEQ ID NO: 1101963 - RNA, 21 nt, Human
uucucucuccuccccacaguc

SEQ ID NO: 1101964 - RNA, 19 nt, Human
uuggugggcucagguuugg

SEQ ID NO: 1101965 - RNA, 21 nt, Human
uuuccaagcccuuaaacacug

SEQ ID NO: 1101966 - RNA, 19 nt, Human
aaaacacacagaagacucc

SEQ ID NO: 1101967 - RNA, 18 nt, Human
aaacacacagaagacucc

SEQ ID NO: 1101968 - RNA, 19 nt, Human
aagaaggaaauaaaaugga

SEQ ID NO: 1101969 - RNA, 22 nt, Human
aaggaaccagacacauacucgg

SEQ ID NO: 1101970 - RNA, 22 nt, Human
acaagaaggaaauaaaauggac

SEQ ID NO: 1101971 - RNA, 18 nt, Human
acuuucuccugcccugga

SEQ ID NO: 1101972 - RNA, 19 nt, Human
agagcgccaucacugccca

SEQ ID NO: 1101973 - RNA, 21 nt, Human
agcuguguccacucugggccu

SEQ ID NO: 1101974 - RNA, 22 nt, Human
aggugcccauaggugaacacga

SEQ ID NO: 1101975 - RNA, 22 nt, Human
aguaacuucaaguagauuggcc

SEQ ID NO: 1101976 - RNA, 24 nt, Human
agucaacaaagggaagauuuuacc

SEQ ID NO: 1101977 - RNA, 21 nt, Human
auagcccacuguggcccccag

SEQ ID NO: 1101978 - RNA, 19 nt, Human
augggguuuccugaggcuc

SEQ ID NO: 1101979 - RNA, 23 nt, Human
caaaaacacacagaagacuccaa

SEQ ID NO: 1101980 - RNA, 19 nt, Human
caagagcuggacagugugg

SEQ ID NO: 1101981 - RNA, 19 nt, Human
cacaagaaggaaauaaaau

SEQ ID NO: 1101982 - RNA, 22 nt, Human
cacgggcagggguuguuugcug

SEQ ID NO: 1101983 - RNA, 23 nt, Human
cacucgcacuccagcagugggag

SEQ ID NO: 1101984 - RNA, 18 nt, Human
cagaggcuucaggaggcu

SEQ ID NO: 1101985 - RNA, 20 nt, Human
cagccaaggcgucucggcaa

SEQ ID NO: 1101986 - RNA, 21 nt, Human
caguguggucaggaaucgucc

SEQ ID NO: 1101987 - RNA, 22 nt, Human
caugaaagacucugaaguggca

SEQ ID NO: 1101988 - RNA, 21 nt, Human
caugucugucucuuacagggg

SEQ ID NO: 1101989 - RNA, 23 nt, Human
ccaaggaguugaaggaggcucac

SEQ ID NO: 1101990 - RNA, 18 nt, Human
ccagagcagcacaagaag

SEQ ID NO: 1101991 - RNA, 23 nt, Human
ccagucgauuaaaacagaaccaa

SEQ ID NO: 1101992 - RNA, 19 nt, Human
cccagaaaagaugaccugc

SEQ ID NO: 1101993 - RNA, 22 nt, Human
cccagacaacaggggaccaagg

SEQ ID NO: 1101994 - RNA, 22 nt, Human
ccccagagcgccaucacugccc

SEQ ID NO: 1101995 - RNA, 18 nt, Human
ccuagcuauuuggggaug

SEQ ID NO: 1101996 - RNA, 18 nt, Human
ccugaggaggguaagggc

SEQ ID NO: 1101997 - RNA, 26 nt, Human
cgaguaacuucaaguagauuggccca

SEQ ID NO: 1101998 - RNA, 18 nt, Human
cucagauuccucauccuu

SEQ ID NO: 1101999 - RNA, 21 nt, Human
cucuuugcuacugccucucuu

SEQ ID NO: 1102000 - RNA, 22 nt, Human
cuuugcuacugccucucuucca

SEQ ID NO: 1102001 - RNA, 24 nt, Human
gaaucgucccacccaaggaaccag

SEQ ID NO: 1102002 - RNA, 19 nt, Human
gacaacaggggaccaagga

SEQ ID NO: 1102003 - RNA, 19 nt, Human
gagcucaucucuuugcuac

SEQ ID NO: 1102004 - RNA, 18 nt, Human
gagggugccagccaaggc

SEQ ID NO: 1102005 - RNA, 22 nt, Human
gauccucuguugucaccagcca

SEQ ID NO: 1102006 - RNA, 25 nt, Human
ggagacagagcauuuaaugagagca

SEQ ID NO: 1102007 - RNA, 19 nt, Human
ggagaggugggacaggggg

SEQ ID NO: 1102008 - RNA, 20 nt, Human
gggaccaaggaguugaagga

SEQ ID NO: 1102009 - RNA, 23 nt, Human
ggggauggcaggggaagcaucuc

SEQ ID NO: 1102010 - RNA, 22 nt, Human
gguaagggcugugugugugguc

SEQ ID NO: 1102011 - RNA, 18 nt, Human
gucaccagccauggcugu

SEQ ID NO: 1102012 - RNA, 24 nt, Human
gugaaccccaaaacucuguacaag

SEQ ID NO: 1102013 - RNA, 25 nt, Human
gugcacuguggguggcaagccaggu

SEQ ID NO: 1102014 - RNA, 19 nt, Human
uagauuggcccacgggcag

SEQ ID NO: 1102015 - RNA, 24 nt, Human
ucaacgauccucuguugucaccag

SEQ ID NO: 1102016 - RNA, 21 nt, Human
ucaccaagcgcugcucaaucu

SEQ ID NO: 1102017 - RNA, 21 nt, Human
ucacugcccauacuuggagug

SEQ ID NO: 1102018 - RNA, 20 nt, Human
ucacuggagaggugggacag

SEQ ID NO: 1102019 - RNA, 18 nt, Human
ucauacuuucuccugccc

SEQ ID NO: 1102020 - RNA, 20 nt, Human
ucaugucugucucuuacagg

SEQ ID NO: 1102021 - RNA, 22 nt, Human
ucccagaggcuucaggaggcuc

SEQ ID NO: 1102022 - RNA, 19 nt, Human
uccucuguugucaccagcc

SEQ ID NO: 1102023 - RNA, 20 nt, Human
ucugaagauucccacagccu

SEQ ID NO: 1102024 - RNA, 22 nt, Human
ugaaggaggcucacuggagagg

SEQ ID NO: 1102025 - RNA, 18 nt, Human
ugacccagacaacagggg

SEQ ID NO: 1102026 - RNA, 23 nt, Human
ugacccagacaacaggggaccaa

SEQ ID NO: 1102027 - RNA, 25 nt, Human
ugagagcaagagcuggacaguguug

SEQ ID NO: 1102028 - RNA, 20 nt, Human
ugaugaagggcguagguugg

SEQ ID NO: 1102029 - RNA, 18 nt, Human
ugauucccacucgcacuc

SEQ ID NO: 1102030 - RNA, 18 nt, Human
ugccagaagguucgguag

SEQ ID NO: 1102031 - RNA, 24 nt, Human
ugccccacuuuggggucuuugucc

SEQ ID NO: 1102032 - RNA, 20 nt, Human
uggaaaaugccauccaggag

SEQ ID NO: 1102033 - RNA, 23 nt, Human
uggaaaaugccauccaggagcuc

SEQ ID NO: 1102034 - RNA, 18 nt, Human
uggagugugauccuagcu

SEQ ID NO: 1102035 - RNA, 21 nt, Human
uggcaggggaagcaucuccca

SEQ ID NO: 1102036 - RNA, 22 nt, Human
ugggacagggggccagucgauu

SEQ ID NO: 1102037 - RNA, 21 nt, Human
ugggagaaaagggggacccca

SEQ ID NO: 1102038 - RNA, 18 nt, Human
uggggugugaaccccaaa

SEQ ID NO: 1102039 - RNA, 24 nt, Human
ugugauccuagcuauuuggggaug

SEQ ID NO: 1102040 - RNA, 22 nt, Human
uguggucaggaaucgucccacc

SEQ ID NO: 1102041 - RNA, 23 nt, Human
uucaaguagauuggcccacgggc

SEQ ID NO: 1102042 - RNA, 20 nt, Human
uuccuaagucucaauaugug

SEQ ID NO: 1102043 - RNA, 18 nt, Human
uuccucauccuuuggugg

SEQ ID NO: 1102044 - RNA, 22 nt, Human
uugacccagacaacaggggacc

SEQ ID NO: 1102045 - RNA, 21 nt, Human
uuggcccacgggcagggguug

SEQ ID NO: 1102046 - RNA, 18 nt, Human
agcuccucccaaauugcu

SEQ ID NO: 1102047 - RNA, 20 nt, Human
cagcuccccuucugaugccu

SEQ ID NO: 1102048 - RNA, 22 nt, Human
cccggcugucauugcuuccugu

SEQ ID NO: 1102049 - RNA, 22 nt, Human
cccucuguacacuggcagaauc

SEQ ID NO: 1102050 - RNA, 21 nt, Human
ccuuucugccuguucucacug

SEQ ID NO: 1102051 - RNA, 19 nt, Human
cucuguacacuggcagaau

SEQ ID NO: 1102052 - RNA, 22 nt, Human
cucuuggaucugcccauuucug

SEQ ID NO: 1102053 - RNA, 21 nt, Human
cuggcagaauccccacuuccu

SEQ ID NO: 1102054 - RNA, 22 nt, Human
cuuccugucuggacuugcugca

SEQ ID NO: 1102055 - RNA, 24 nt, Human
cuuguagccguggcagcuccuccc

SEQ ID NO: 1102056 - RNA, 18 nt, Human
guguggacagcuccccuu

SEQ ID NO: 1102057 - RNA, 22 nt, Human
ucacaaccuucuuguagccgug

SEQ ID NO: 1102058 - RNA, 21 nt, Human
ucugcucuguaagcaaaacua

SEQ ID NO: 1102059 - RNA, 23 nt, Human
ucugcucuguaagcaaaacuaaa

SEQ ID NO: 1102060 - RNA, 22 nt, Human
ugagagugaauuuucacaaccu

SEQ ID NO: 1102061 - RNA, 21 nt, Human
ugcccauuucuguccaccuug

SEQ ID NO: 1102062 - RNA, 21 nt, Human
uguacacuggcagaaucccca

SEQ ID NO: 1102063 - RNA, 19 nt, Human
ugucauugcuuccugucug

SEQ ID NO: 1102064 - RNA, 19 nt, Human
ugucccggcugucauugcu

SEQ ID NO: 1102065 - RNA, 24 nt, Human
uuguagccguggcagcuccuccca

SEQ ID NO: 1102066 - RNA, 23 nt, Human
uuucugccuguucucacuggagg

SEQ ID NO: 1102067 - RNA, 18 nt, Human
aaagcaugcauucccggc

SEQ ID NO: 1102068 - RNA, 18 nt, Human
aacauggagaaaccccau

SEQ ID NO: 1102069 - RNA, 19 nt, Human
aacauggagaaaccccauc

SEQ ID NO: 1102070 - RNA, 20 nt, Human
aacauggagaaaccccaucc

SEQ ID NO: 1102071 - RNA, 18 nt, Human
aagaaggagaacuaagaa

SEQ ID NO: 1102072 - RNA, 24 nt, Human
aagcauggucuacggagaaggcac

SEQ ID NO: 1102073 - RNA, 25 nt, Human
aauauauaaugaaauaauuacacaa

SEQ ID NO: 1102074 - RNA, 20 nt, Human
aauugcuugaacccaggagg

SEQ ID NO: 1102075 - RNA, 24 nt, Human
aauugcuugaacccaggaggcgga

SEQ ID NO: 1102076 - RNA, 18 nt, Human
acacuuugggggcuguag

SEQ ID NO: 1102077 - RNA, 22 nt, Human
acccaagggucccgcagcacac

SEQ ID NO: 1102078 - RNA, 20 nt, Human
acgugugugugugugugugu

SEQ ID NO: 1102079 - RNA, 25 nt, Human
acgugugugugugugugugugcgug

SEQ ID NO: 1102080 - RNA, 19 nt, Human
acuaagaaagagacugaag

SEQ ID NO: 1102081 - RNA, 22 nt, Human
acuggcuggcugcucaccuccu

SEQ ID NO: 1102082 - RNA, 18 nt, Human
acuuugggggcuguagau

SEQ ID NO: 1102083 - RNA, 22 nt, Human
agaagaggagacuuggacaaaa

SEQ ID NO: 1102084 - RNA, 22 nt, Human
agaauugcuugaacccaggagg

SEQ ID NO: 1102085 - RNA, 21 nt, Human
agcagcuggguacaugcuggg

SEQ ID NO: 1102086 - RNA, 18 nt, Human
agcauggucuacggagaa

SEQ ID NO: 1102087 - RNA, 22 nt, Human
agcuggguacaugcuggggcuc

SEQ ID NO: 1102088 - RNA, 23 nt, Human
aggcaggagaauugcuugaaccc

SEQ ID NO: 1102089 - RNA, 24 nt, Human
aggcaggagaauugcuugaaccca

SEQ ID NO: 1102090 - RNA, 20 nt, Human
aggcggaaguugcagagagc

SEQ ID NO: 1102091 - RNA, 21 nt, Human
aggcggaaguugcagagagcc

SEQ ID NO: 1102092 - RNA, 24 nt, Human
aggcggaaguugcagagagccgag

SEQ ID NO: 1102093 - RNA, 22 nt, Human
aggcgggcggaucaccugagag

SEQ ID NO: 1102094 - RNA, 22 nt, Human
aggcgggcggaucaccugagau

SEQ ID NO: 1102095 - RNA, 21 nt, Human
aggcugaggcaggagaauugc

SEQ ID NO: 1102096 - RNA, 24 nt, Human
aggcugaggcaggagaauugcuug

SEQ ID NO: 1102097 - RNA, 21 nt, Human
aggcugaggcgggcggaucac

SEQ ID NO: 1102098 - RNA, 24 nt, Human
aggcugaggcgggcggaucaccug

SEQ ID NO: 1102099 - RNA, 20 nt, Human
augcuggggcucugcuucuc

SEQ ID NO: 1102100 - RNA, 28 nt, Human
augugugcauguuugugugugugugugu

SEQ ID NO: 1102101 - RNA, 20 nt, Human
auugcgccauugcacuccag

SEQ ID NO: 1102102 - RNA, 24 nt, Human
caacagcuggggcugggcccucug

SEQ ID NO: 1102103 - RNA, 21 nt, Human
cacccugucccagugggugcu

SEQ ID NO: 1102104 - RNA, 23 nt, Human
cacgccuguaaucccagcacuuu

SEQ ID NO: 1102105 - RNA, 22 nt, Human
cacgugugugugugugugugug

SEQ ID NO: 1102106 - RNA, 23 nt, Human
cacucacccugcguguuugcugc

SEQ ID NO: 1102107 - RNA, 18 nt, Human
cacuuuagaaggcugagg

SEQ ID NO: 1102108 - RNA, 22 nt, Human
cagcacuuuagaaggcugaggc

SEQ ID NO: 1102109 - RNA, 24 nt, Human
cagcacuuuagaaggcugaggcgg

SEQ ID NO: 1102110 - RNA, 20 nt, Human
cagcccgcacacucacccug

SEQ ID NO: 1102111 - RNA, 24 nt, Human
cagccugaccaacauggagaaacc

SEQ ID NO: 1102112 - RNA, 24 nt, Human
cagcuacucgggaggcugaggcag

SEQ ID NO: 1102113 - RNA, 22 nt, Human
cagggagugcgcacacgggguc

SEQ ID NO: 1102114 - RNA, 18 nt, Human
caguacuggaggucauga

SEQ ID NO: 1102115 - RNA, 25 nt, Human
cagugccuuccacucacuaggcucc

SEQ ID NO: 1102116 - RNA, 23 nt, Human
caugagugucaguccaagaucaa

SEQ ID NO: 1102117 - RNA, 21 nt, Human
ccaggcaugguggcacaugcc

SEQ ID NO: 1102118 - RNA, 19 nt, Human
ccagggugggucccuucug

SEQ ID NO: 1102119 - RNA, 18 nt, Human
cccaggcccuguccuggu

SEQ ID NO: 1102120 - RNA, 18 nt, Human
cccaggccggcgugcccc

SEQ ID NO: 1102121 - RNA, 23 nt, Human
cccauuuuuauuagcauuuaaac

SEQ ID NO: 1102122 - RNA, 20 nt, Human
ccccacgcagcucucuccgc

SEQ ID NO: 1102123 - RNA, 20 nt, Human
ccccgcuuguccccagggag

SEQ ID NO: 1102124 - RNA, 24 nt, Human
cccgcagcacacuuugggggcugu

SEQ ID NO: 1102125 - RNA, 24 nt, Human
cccggcugggcgcggugacucacg

SEQ ID NO: 1102126 - RNA, 20 nt, Human
cccugggugcccuugaucac

SEQ ID NO: 1102127 - RNA, 19 nt, Human
cccuguccugcuggcuccc

SEQ ID NO: 1102128 - RNA, 23 nt, Human
ccgcucugcacugccugggcagc

SEQ ID NO: 1102129 - RNA, 20 nt, Human
ccguguccugguaggguccc

SEQ ID NO: 1102130 - RNA, 22 nt, Human
ccuacacccacccaaggguccc

SEQ ID NO: 1102131 - RNA, 24 nt, Human
ccugaccaacauggagaaacccca

SEQ ID NO: 1102132 - RNA, 22 nt, Human
ccugagaucgggaguucgagac

SEQ ID NO: 1102133 - RNA, 18 nt, Human
ccugguucucagccaccc

SEQ ID NO: 1102134 - RNA, 21 nt, Human
ccuguagucccagcuacucgg

SEQ ID NO: 1102135 - RNA, 22 nt, Human
ccuguagucccagcuacucggg

SEQ ID NO: 1102136 - RNA, 22 nt, Human
ccuguccacacaugccuaggag

SEQ ID NO: 1102137 - RNA, 22 nt, Human
ccugugacucuucauuaagggu

SEQ ID NO: 1102138 - RNA, 24 nt, Human
ccuugaaccacccaaaauuaccuu

SEQ ID NO: 1102139 - RNA, 22 nt, Human
cgaacgaagcccagcaugugcu

SEQ ID NO: 1102140 - RNA, 24 nt, Human
cgagauugcgccauugcacuccag

SEQ ID NO: 1102141 - RNA, 18 nt, Human
cgcacacucacccugcgu

SEQ ID NO: 1102142 - RNA, 18 nt, Human
cgccuguaaucccagcac

SEQ ID NO: 1102143 - RNA, 22 nt, Human
cgccuguaaucccagcacuuua

SEQ ID NO: 1102144 - RNA, 24 nt, Human
cggaucaccugagaucgggaguuc

SEQ ID NO: 1102145 - RNA, 24 nt, Human
cgggcggaucaccugagaucggga

SEQ ID NO: 1102146 - RNA, 19 nt, Human
cguggagcauuccaucccu

SEQ ID NO: 1102147 - RNA, 22 nt, Human
cgugucugcacacgugugcgug

SEQ ID NO: 1102148 - RNA, 24 nt, Human
cuaaaaauacagaauuacccaggc

SEQ ID NO: 1102149 - RNA, 28 nt, Human
cuaagaaagagacugaagcauggucuac

SEQ ID NO: 1102150 - RNA, 22 nt, Human
cucacgccuguaaucccagcac

SEQ ID NO: 1102151 - RNA, 24 nt, Human
cucacgccuguaaucccagcacuu

SEQ ID NO: 1102152 - RNA, 20 nt, Human
cucauugcaucacucacuuc

SEQ ID NO: 1102153 - RNA, 21 nt, Human
cucuguuccaggccugucucc

SEQ ID NO: 1102154 - RNA, 24 nt, Human
cugacaggaggcagagcucaugcg

SEQ ID NO: 1102155 - RNA, 22 nt, Human
cugaggcugugcaggaaggcuc

SEQ ID NO: 1102156 - RNA, 23 nt, Human
cugaggcugugcaggaaggcucc

SEQ ID NO: 1102157 - RNA, 21 nt, Human
cugcaguguccucguauaguu

SEQ ID NO: 1102158 - RNA, 22 nt, Human
cugcgggucccuguccugcugg

SEQ ID NO: 1102159 - RNA, 20 nt, Human
cugguuccuaacaguuggga

SEQ ID NO: 1102160 - RNA, 21 nt, Human
cugugggcuaacaggcugcgu

SEQ ID NO: 1102161 - RNA, 20 nt, Human
cuucccaggcccuguccugg

SEQ ID NO: 1102162 - RNA, 22 nt, Human
cuugcacaccugcguguguccc

SEQ ID NO: 1102163 - RNA, 19 nt, Human
gaacuuguuuuccugcaac

SEQ ID NO: 1102164 - RNA, 21 nt, Human
gaagcccagcaugugcuggca

SEQ ID NO: 1102165 - RNA, 23 nt, Human
gaaguugcagagagccgagauug

SEQ ID NO: 1102166 - RNA, 21 nt, Human
gagaaaccccaucccuacuaa

SEQ ID NO: 1102167 - RNA, 23 nt, Human
gagaccagccugaccaacaugga

SEQ ID NO: 1102168 - RNA, 21 nt, Human
gagccgagauugcgccauugc

SEQ ID NO: 1102169 - RNA, 22 nt, Human
gaguaugugugcacagacugug

SEQ ID NO: 1102170 - RNA, 24 nt, Human
gaucaccugagaucgggaguucga

SEQ ID NO: 1102171 - RNA, 21 nt, Human
gcacuugcgcaaacaccagga

SEQ ID NO: 1102172 - RNA, 22 nt, Human
gcagcuggguacaugcuggggc

SEQ ID NO: 1102173 - RNA, 22 nt, Human
gcaggagaauugcuugaaccca

SEQ ID NO: 1102174 - RNA, 20 nt, Human
gcauaccuacacccacccaa

SEQ ID NO: 1102175 - RNA, 18 nt, Human
gccacccugucccagugg

SEQ ID NO: 1102176 - RNA, 19 nt, Human
gccgggugacgcgggcugg

SEQ ID NO: 1102177 - RNA, 20 nt, Human
gccugucuccugaugugugg

SEQ ID NO: 1102178 - RNA, 22 nt, Human
ggaaguugcagagagccgagau

SEQ ID NO: 1102179 - RNA, 24 nt, Human
ggaauccauccaugcccagggcuu

SEQ ID NO: 1102180 - RNA, 23 nt, Human
ggaucaccugagaucgggaguuc

SEQ ID NO: 1102181 - RNA, 24 nt, Human
gggcgcggugacucacgccuguaa

SEQ ID NO: 1102182 - RNA, 19 nt, Human
ggggaagggaugauaugga

SEQ ID NO: 1102183 - RNA, 18 nt, Human
ggguaucccucauuuacc

SEQ ID NO: 1102184 - RNA, 24 nt, Human
gggucccgcagcacacuuuggggg

SEQ ID NO: 1102185 - RNA, 22 nt, Human
gggugguugggugggggguggu

SEQ ID NO: 1102186 - RNA, 19 nt, Human
gguauggaagauucugccc

SEQ ID NO: 1102187 - RNA, 19 nt, Human
ggucccuguccugcuggcu

SEQ ID NO: 1102188 - RNA, 24 nt, Human
ggugacucacgccuguaaucccag

SEQ ID NO: 1102189 - RNA, 22 nt, Human
guccugguucucagccacccug

SEQ ID NO: 1102190 - RNA, 19 nt, Human
gugcgagugaguguggccc

SEQ ID NO: 1102191 - RNA, 21 nt, Human
gugugugugcgcacgugcgug

SEQ ID NO: 1102192 - RNA, 21 nt, Human
guugcagagagccgagauugc

SEQ ID NO: 1102193 - RNA, 21 nt, Human
uaaaaaaccgacgccucuuuu

SEQ ID NO: 1102194 - RNA, 18 nt, Human
uaaaaauacagaauuacc

SEQ ID NO: 1102195 - RNA, 20 nt, Human
uaacagcauccucaaccaac

SEQ ID NO: 1102196 - RNA, 24 nt, Human
uacaguaccacagacugggcaccu

SEQ ID NO: 1102197 - RNA, 26 nt, Human
uacccgagaccaguuuucuugaagac

SEQ ID NO: 1102198 - RNA, 22 nt, Human
uaccuacacccacccaaggguc

SEQ ID NO: 1102199 - RNA, 24 nt, Human
uagaaggcugaggcgggcggauca

SEQ ID NO: 1102200 - RNA, 21 nt, Human
uaugugugcauguuugugugu

SEQ ID NO: 1102201 - RNA, 25 nt, Human
uaugugugcauguuugugugugugu

SEQ ID NO: 1102202 - RNA, 31 nt, Human
uaugugugcauguuugugugugugugugugu

SEQ ID NO: 1102203 - RNA, 21 nt, Human
ucaccagggugggucccuucu

SEQ ID NO: 1102204 - RNA, 21 nt, Human
ucacuaggcuccccaggaaac

SEQ ID NO: 1102205 - RNA, 21 nt, Human
ucaugagugucaguccaagau

SEQ ID NO: 1102206 - RNA, 19 nt, Human
uccacacaugccuaggagu

SEQ ID NO: 1102207 - RNA, 22 nt, Human
uccacggacccgggagaagggg

SEQ ID NO: 1102208 - RNA, 24 nt, Human
uccaugcccagggcuuucugggga

SEQ ID NO: 1102209 - RNA, 22 nt, Human
ucccaaccgaguucuguuuccc

SEQ ID NO: 1102210 - RNA, 19 nt, Human
ucccaggccggcgugcccc

SEQ ID NO: 1102211 - RNA, 27 nt, Human
uccccaggaaacuugcgcacuuggcuu

SEQ ID NO: 1102212 - RNA, 21 nt, Human
uccccgcuuguccccagggag

SEQ ID NO: 1102213 - RNA, 21 nt, Human
uccccugauuacuucuauggg

SEQ ID NO: 1102214 - RNA, 24 nt, Human
ucccuggcaugcgcaguucacagu

SEQ ID NO: 1102215 - RNA, 23 nt, Human
ucgggaggcugaggcaggagaau

SEQ ID NO: 1102216 - RNA, 21 nt, Human
ucucagccacccugucccagu

SEQ ID NO: 1102217 - RNA, 23 nt, Human
ucucuuucaguaagaaggagaac

SEQ ID NO: 1102218 - RNA, 18 nt, Human
ucugacaggaggcagagc

SEQ ID NO: 1102219 - RNA, 18 nt, Human
ugaacuuguuuuccugca

SEQ ID NO: 1102220 - RNA, 21 nt, Human
ugacucacgccuguaauccca

SEQ ID NO: 1102221 - RNA, 24 nt, Human
ugacucacgccuguaaucccagca

SEQ ID NO: 1102222 - RNA, 24 nt, Human
ugaggcaggagaauugcuugaacc

SEQ ID NO: 1102223 - RNA, 25 nt, Human
ugaggcaggagaauugcuugaaccc

SEQ ID NO: 1102224 - RNA, 19 nt, Human
ugaggcgggcggaucaccu

SEQ ID NO: 1102225 - RNA, 20 nt, Human
ugaggcgggcggaucaccug

SEQ ID NO: 1102226 - RNA, 19 nt, Human
ugagggcucagaagaggag

SEQ ID NO: 1102227 - RNA, 19 nt, Human
ugaucacgugugugugugu

SEQ ID NO: 1102228 - RNA, 21 nt, Human
ugcauaccuacacccacccaa

SEQ ID NO: 1102229 - RNA, 20 nt, Human
ugcauaccuacacccacccu

SEQ ID NO: 1102230 - RNA, 21 nt, Human
ugcccagggcuuucuggggac

SEQ ID NO: 1102231 - RNA, 23 nt, Human
ugccugggcagcccgcacacuca

SEQ ID NO: 1102232 - RNA, 23 nt, Human
ugccuguagucccagcuacucgg

SEQ ID NO: 1102233 - RNA, 24 nt, Human
ugccuguagucccagcuacucggg

SEQ ID NO: 1102234 - RNA, 22 nt, Human
ugcgcaaacaccaggagaauga

SEQ ID NO: 1102235 - RNA, 24 nt, Human
ugcgcacgugcgugcuugcgcgcg

SEQ ID NO: 1102236 - RNA, 20 nt, Human
ugcgugugucccgugagagc

SEQ ID NO: 1102237 - RNA, 21 nt, Human
ugcgugugugugugugcgcac

SEQ ID NO: 1102238 - RNA, 24 nt, Human
ugcgugugugugugugcgcacgug

SEQ ID NO: 1102239 - RNA, 20 nt, Human
ugcugccgggugacgcgggc

SEQ ID NO: 1102240 - RNA, 21 nt, Human
ugcuucucucuuucaguaaga

SEQ ID NO: 1102241 - RNA, 18 nt, Human
uggagaaaccccaucccu

SEQ ID NO: 1102242 - RNA, 22 nt, Human
uggaugcuuccacuacgugucu

SEQ ID NO: 1102243 - RNA, 19 nt, Human
uggcuggcugcucaccucc

SEQ ID NO: 1102244 - RNA, 20 nt, Human
uggcuugggcccuaagcagc

SEQ ID NO: 1102245 - RNA, 20 nt, Human
uggguaucccucauuuaccc

SEQ ID NO: 1102246 - RNA, 20 nt, Human
ugggugguuggguggggggu

SEQ ID NO: 1102247 - RNA, 24 nt, Human
ugguggcacaugccuguaguccca

SEQ ID NO: 1102248 - RNA, 21 nt, Human
ugucaguccaagaucaaggug

SEQ ID NO: 1102249 - RNA, 21 nt, Human
ugugcacagacugugccugca

SEQ ID NO: 1102250 - RNA, 19 nt, Human
ugugccugcaguguccucg

SEQ ID NO: 1102251 - RNA, 20 nt, Human
ugugcgcacgugcgugcuug

SEQ ID NO: 1102252 - RNA, 24 nt, Human
ugugcgcacgugcgugcuugcgcg

SEQ ID NO: 1102253 - RNA, 23 nt, Human
uguggccccacgcagcucucucc

SEQ ID NO: 1102254 - RNA, 21 nt, Human
ugugggaagccuggacugggu

SEQ ID NO: 1102255 - RNA, 19 nt, Human
ugugugcauguuugugugu

SEQ ID NO: 1102256 - RNA, 19 nt, Human
ugugugcauguuugugugu

SEQ ID NO: 1102257 - RNA, 19 nt, Human
ugugugcauguuugugugu

SEQ ID NO: 1102258 - RNA, 22 nt, Human
ugugugcauguuugugugugug

SEQ ID NO: 1102259 - RNA, 31 nt, Human
ugugugcauguuuguguguguguguguggug

SEQ ID NO: 1102260 - RNA, 19 nt, Human
ugugugcgugugugugugu

SEQ ID NO: 1102261 - RNA, 21 nt, Human
ugugugugcgugugugugugu

SEQ ID NO: 1102262 - RNA, 21 nt, Human
ugugugugcgugugugugugu

SEQ ID NO: 1102263 - RNA, 21 nt, Human
ugugugugugcgugugugugu

SEQ ID NO: 1102264 - RNA, 22 nt, Human
ugugugugugugcgcacgugcg

SEQ ID NO: 1102265 - RNA, 20 nt, Human
ugugugugugugcgugugug

SEQ ID NO: 1102266 - RNA, 22 nt, Human
ugugugugugugcgugugugug

SEQ ID NO: 1102267 - RNA, 25 nt, Human
ugugugugugugcgugugugugugu

SEQ ID NO: 1102268 - RNA, 21 nt, Human
ugugugugugugugcgugugu

SEQ ID NO: 1102269 - RNA, 21 nt, Human
ugugugugugugugcgugugu

SEQ ID NO: 1102270 - RNA, 22 nt, Human
uguguguguguguguguccuac

SEQ ID NO: 1102271 - RNA, 19 nt, Human
uguuucuggaaagccaggc

SEQ ID NO: 1102272 - RNA, 22 nt, Human
uuacuguaauauauaaugaaau

SEQ ID NO: 1102273 - RNA, 25 nt, Human
uuagaaggcugaggcgggcggauca

SEQ ID NO: 1102274 - RNA, 21 nt, Human
uuauucaccuugaaccaccca

SEQ ID NO: 1102275 - RNA, 24 nt, Human
uuauucaccuugaaccacccaaaa

SEQ ID NO: 1102276 - RNA, 24 nt, Human
uucaguaagaaggagaacuaagaa

SEQ ID NO: 1102277 - RNA, 22 nt, Human
uugcagagagccgagauugcgc

SEQ ID NO: 1102278 - RNA, 21 nt, Human
uugcauaccuacacccaccca

SEQ ID NO: 1102279 - RNA, 18 nt, Human
uugcuugaacccaggagg

SEQ ID NO: 1102280 - RNA, 24 nt, Human
uugcuugaacccaggaggcggaag

SEQ ID NO: 1102281 - RNA, 21 nt, Human
aaaaaaaaaagagagcgagag

SEQ ID NO: 1102282 - RNA, 23 nt, Human
aaaaaaacaaaaaacaaacaaaa

SEQ ID NO: 1102283 - RNA, 25 nt, Human
aaaaaaacaaaaaacaaacaaaaaa

SEQ ID NO: 1102284 - RNA, 20 nt, Human
aaaaacaaaaaacaaacaaa

SEQ ID NO: 1102285 - RNA, 19 nt, Human
aaaacaaaaaaacaaaaaa

SEQ ID NO: 1102286 - RNA, 22 nt, Human
aaaacaaaaaaacaaaaaacaa

SEQ ID NO: 1102287 - RNA, 21 nt, Human
aaaacaaaaaacaaacaaaaa

SEQ ID NO: 1102288 - RNA, 24 nt, Human
aaaacaaacaaaaaaaaaaagaga

SEQ ID NO: 1102289 - RNA, 23 nt, Human
aaacaaaaaaaaaaagagagcga

SEQ ID NO: 1102290 - RNA, 22 nt, Human
aaacaaaaagcgagaaaaucug

SEQ ID NO: 1102291 - RNA, 23 nt, Human
aaacaaaaagcgagaaaaucugg

SEQ ID NO: 1102292 - RNA, 24 nt, Human
aaagugcugggauuacaggcauga

SEQ ID NO: 1102293 - RNA, 18 nt, Human
aacaaaaaacaaacaaaa

SEQ ID NO: 1102294 - RNA, 22 nt, Human
aacaggaauaacucuaagaagu

SEQ ID NO: 1102295 - RNA, 20 nt, Human
aagaaguuuggggacaggag

SEQ ID NO: 1102296 - RNA, 21 nt, Human
aagagagcgagagagaagugg

SEQ ID NO: 1102297 - RNA, 22 nt, Human
aagcugagcgcacagcagaaga

SEQ ID NO: 1102298 - RNA, 18 nt, Human
aagggaaaugcacugauc

SEQ ID NO: 1102299 - RNA, 19 nt, Human
aagugcugggauuacaggc

SEQ ID NO: 1102300 - RNA, 21 nt, Human
aagugcugggauuacaggcau

SEQ ID NO: 1102301 - RNA, 26 nt, Human
aagugcugggauuacaggcaugagcc

SEQ ID NO: 1102302 - RNA, 25 nt, Human
acaaaaaaaaaaagagagcgagaga

SEQ ID NO: 1102303 - RNA, 24 nt, Human
acagcagaagagccgccagcuaaa

SEQ ID NO: 1102304 - RNA, 25 nt, Human
acaguggagggaacucaagcccaga

SEQ ID NO: 1102305 - RNA, 18 nt, Human
accggguuucaccguguu

SEQ ID NO: 1102306 - RNA, 24 nt, Human
accggguuucaccguguuggccag

SEQ ID NO: 1102307 - RNA, 24 nt, Human
accuugugauccgccugccucggc

SEQ ID NO: 1102308 - RNA, 20 nt, Human
acucugucgcccaguggcgg

SEQ ID NO: 1102309 - RNA, 24 nt, Human
acuggcuaggcgcuggugaggggg

SEQ ID NO: 1102310 - RNA, 18 nt, Human
agaaguuuggggacagga

SEQ ID NO: 1102311 - RNA, 22 nt, Human
agagcgagagagaagugggugu

SEQ ID NO: 1102312 - RNA, 22 nt, Human
agcagcaggcaugggaguggcg

SEQ ID NO: 1102313 - RNA, 20 nt, Human
agcggaccgcccgggguggg

SEQ ID NO: 1102314 - RNA, 22 nt, Human
aggcgcuggugagggggcggcg

SEQ ID NO: 1102315 - RNA, 18 nt, Human
aggggagcuguucugggc

SEQ ID NO: 1102316 - RNA, 20 nt, Human
aguagagaccggguuucacc

SEQ ID NO: 1102317 - RNA, 18 nt, Human
aguagcugggacuacagg

SEQ ID NO: 1102318 - RNA, 19 nt, Human
aguagcugggacuacaggc

SEQ ID NO: 1102319 - RNA, 18 nt, Human
agugcugggauuacaggc

SEQ ID NO: 1102320 - RNA, 22 nt, Human
aguggccucccgccccccagcc

SEQ ID NO: 1102321 - RNA, 25 nt, Human
aucaugcuguuucuuccauugcuuu

SEQ ID NO: 1102322 - RNA, 24 nt, Human
aucgcaguggcgcgaucucggcuc

SEQ ID NO: 1102323 - RNA, 23 nt, Human
auuuagggcccacaccacugcuc

SEQ ID NO: 1102324 - RNA, 28 nt, Human
caaaaaaacaaaaaacaaacaaaaaaaa

SEQ ID NO: 1102325 - RNA, 19 nt, Human
caaacaaaaaaaaaaagag

SEQ ID NO: 1102326 - RNA, 24 nt, Human
caaagugcugggauuacaggcaug

SEQ ID NO: 1102327 - RNA, 22 nt, Human
caagcgauucuccugccucagc

SEQ ID NO: 1102328 - RNA, 21 nt, Human
caccacgggcuucuguccccu

SEQ ID NO: 1102329 - RNA, 19 nt, Human
cacccaggguagcugcccu

SEQ ID NO: 1102330 - RNA, 18 nt, Human
caccgcgcccgguccaac

SEQ ID NO: 1102331 - RNA, 23 nt, Human
caccgcuccgcuucuccucuacc

SEQ ID NO: 1102332 - RNA, 18 nt, Human
caccguguuggccaggau

SEQ ID NO: 1102333 - RNA, 21 nt, Human
caccguguuggccaggauggu

SEQ ID NO: 1102334 - RNA, 24 nt, Human
caccguguuggccaggauggucuc

SEQ ID NO: 1102335 - RNA, 19 nt, Human
cacucugucgcccaguggc

SEQ ID NO: 1102336 - RNA, 21 nt, Human
cagaaucugcucccaccucuu

SEQ ID NO: 1102337 - RNA, 22 nt, Human
cagcccggggucaguccugcag

SEQ ID NO: 1102338 - RNA, 18 nt, Human
cagccgguccccgccucc

SEQ ID NO: 1102339 - RNA, 18 nt, Human
cagcuuuuccauuuagug

SEQ ID NO: 1102340 - RNA, 22 nt, Human
caggauggucucuaucucuuga

SEQ ID NO: 1102341 - RNA, 19 nt, Human
caggcccucacgacucaag

SEQ ID NO: 1102342 - RNA, 24 nt, Human
caggcgcgcgccaagacgccgccc

SEQ ID NO: 1102343 - RNA, 21 nt, Human
cagggggacguggagccaggc

SEQ ID NO: 1102344 - RNA, 20 nt, Human
caguggagggaacucaagcc

SEQ ID NO: 1102345 - RNA, 23 nt, Human
ccaaagugcugggauuacaggca

SEQ ID NO: 1102346 - RNA, 24 nt, Human
ccaaagugcugggauuacaggcau

SEQ ID NO: 1102347 - RNA, 22 nt, Human
ccaccagauggacuccuaauuu

SEQ ID NO: 1102348 - RNA, 24 nt, Human
ccaccagauggacuccuaauuugc

SEQ ID NO: 1102349 - RNA, 20 nt, Human
ccaccgcgcccgguccaaca

SEQ ID NO: 1102350 - RNA, 24 nt, Human
ccaccuccuggguucaagcgauuc

SEQ ID NO: 1102351 - RNA, 18 nt, Human
ccagagccugcuggccga

SEQ ID NO: 1102352 - RNA, 18 nt, Human
ccagcccugcggcacugg

SEQ ID NO: 1102353 - RNA, 23 nt, Human
ccagguccggcaggagucgggaa

SEQ ID NO: 1102354 - RNA, 24 nt, Human
cccaaagugcugggauuacaggca

SEQ ID NO: 1102355 - RNA, 19 nt, Human
cccacaccacugcucagua

SEQ ID NO: 1102356 - RNA, 23 nt, Human
cccacaccacugcucaguagggg

SEQ ID NO: 1102357 - RNA, 23 nt, Human
ccccagccgguccccgccuccuu

SEQ ID NO: 1102358 - RNA, 25 nt, Human
cccccaaauucccuucacccaguuc

SEQ ID NO: 1102359 - RNA, 18 nt, Human
cccccagccgguccccgc

SEQ ID NO: 1102360 - RNA, 21 nt, Human
ccccccagccgguccccgccu

SEQ ID NO: 1102361 - RNA, 18 nt, Human
cccgaaggggaugugggg

SEQ ID NO: 1102362 - RNA, 23 nt, Human
cccgaguagcugggacuacaggc

SEQ ID NO: 1102363 - RNA, 24 nt, Human
cccgaguagcugggacuacaggcg

SEQ ID NO: 1102364 - RNA, 19 nt, Human
cccgccucgccuuccucgc

SEQ ID NO: 1102365 - RNA, 18 nt, Human
cccgcgccgcggccgccu

SEQ ID NO: 1102366 - RNA, 22 nt, Human
cccggagaggaaacagccuccg

SEQ ID NO: 1102367 - RNA, 20 nt, Human
cccucgggggaugcugggcc

SEQ ID NO: 1102368 - RNA, 20 nt, Human
cccuggaggccccggagagg

SEQ ID NO: 1102369 - RNA, 22 nt, Human
ccgcacccagagccugcuggcc

SEQ ID NO: 1102370 - RNA, 24 nt, Human
ccggguuucaccguguuggccagg

SEQ ID NO: 1102371 - RNA, 19 nt, Human
ccuccaccuccuggguuca

SEQ ID NO: 1102372 - RNA, 24 nt, Human
ccuccuggguucaagcgauucucc

SEQ ID NO: 1102373 - RNA, 19 nt, Human
ccucgccuuccucgccuuc

SEQ ID NO: 1102374 - RNA, 22 nt, Human
ccucuugcuacagcuggcccua

SEQ ID NO: 1102375 - RNA, 23 nt, Human
ccugccucagccucccgaguagc

SEQ ID NO: 1102376 - RNA, 24 nt, Human
ccugccucagccucccgaguagcu

SEQ ID NO: 1102377 - RNA, 24 nt, Human
ccugccucggccucccaaagugcu

SEQ ID NO: 1102378 - RNA, 21 nt, Human
ccugcuccagcuggccuaaga

SEQ ID NO: 1102379 - RNA, 23 nt, Human
ccuggguucaagcgauucuccug

SEQ ID NO: 1102380 - RNA, 21 nt, Human
ccuucccgggucgccgccgcc

SEQ ID NO: 1102381 - RNA, 22 nt, Human
ccuucccgggucgccgccgccu

SEQ ID NO: 1102382 - RNA, 18 nt, Human
cgagagagaagugggugu

SEQ ID NO: 1102383 - RNA, 19 nt, Human
cgcacagcagaagagccgc

SEQ ID NO: 1102384 - RNA, 23 nt, Human
cgcacccaggguagcugcccuuu

SEQ ID NO: 1102385 - RNA, 18 nt, Human
cgccucagggcaccacgg

SEQ ID NO: 1102386 - RNA, 20 nt, Human
cgcgccaagacgccgccccg

SEQ ID NO: 1102387 - RNA, 22 nt, Human
cgcugguccgggccgccggcac

SEQ ID NO: 1102388 - RNA, 22 nt, Human
cggcaaagggcggguccucccc

SEQ ID NO: 1102389 - RNA, 20 nt, Human
cggcugcggggaccggcggg

SEQ ID NO: 1102390 - RNA, 19 nt, Human
cgggauggagggcacucgu

SEQ ID NO: 1102391 - RNA, 24 nt, Human
cgggcuucuguccccuccuggagg

SEQ ID NO: 1102392 - RNA, 24 nt, Human
cggggucaguccugcagcccgcgc

SEQ ID NO: 1102393 - RNA, 22 nt, Human
cggguuucaccguguuggccag

SEQ ID NO: 1102394 - RNA, 23 nt, Human
cggguuucaccguguuggccagg

SEQ ID NO: 1102395 - RNA, 21 nt, Human
cucaagccucuuucucgagcc

SEQ ID NO: 1102396 - RNA, 24 nt, Human
cucagccucccgaguagcugggac

SEQ ID NO: 1102397 - RNA, 21 nt, Human
cucccaccucuucccaucgug

SEQ ID NO: 1102398 - RNA, 18 nt, Human
cuccccaccagguccggc

SEQ ID NO: 1102399 - RNA, 22 nt, Human
cuccugccucagccucccgagu

SEQ ID NO: 1102400 - RNA, 21 nt, Human
cuccuggguucaagcgauucu

SEQ ID NO: 1102401 - RNA, 24 nt, Human
cucuugaccuugugauccgccugc

SEQ ID NO: 1102402 - RNA, 24 nt, Human
cugcuaccuccaccuccuggguuc

SEQ ID NO: 1102403 - RNA, 18 nt, Human
cugcugcuuuaucucagu

SEQ ID NO: 1102404 - RNA, 22 nt, Human
cugggcccucgggggaugcugg

SEQ ID NO: 1102405 - RNA, 23 nt, Human
gaaggggauguggggcugucgcc

SEQ ID NO: 1102406 - RNA, 20 nt, Human
gaaucccccaaauucccuuc

SEQ ID NO: 1102407 - RNA, 21 nt, Human
gaaucugcucccaccucuucc

SEQ ID NO: 1102408 - RNA, 22 nt, Human
gaccuugugauccgccugccuc

SEQ ID NO: 1102409 - RNA, 24 nt, Human
gaccuugugauccgccugccucgg

SEQ ID NO: 1102410 - RNA, 24 nt, Human
gagcugccccuucccucacuugcu

SEQ ID NO: 1102411 - RNA, 24 nt, Human
gaguagcugggacuacaggcgcgc

SEQ ID NO: 1102412 - RNA, 20 nt, Human
gaguggccucccgcccccca

SEQ ID NO: 1102413 - RNA, 18 nt, Human
gauuacaggcaugagcca

SEQ ID NO: 1102414 - RNA, 22 nt, Human
gauuacaggcaugagccaccgc

SEQ ID NO: 1102415 - RNA, 22 nt, Human
gauuacaggcaugagccaccgc

SEQ ID NO: 1102416 - RNA, 21 nt, Human
gauucuccugccucagccucc

SEQ ID NO: 1102417 - RNA, 23 nt, Human
gccaggauggucucuaucucuug

SEQ ID NO: 1102418 - RNA, 18 nt, Human
gccagucugaaacccgaa

SEQ ID NO: 1102419 - RNA, 18 nt, Human
gccccgcuaauuuuugua

SEQ ID NO: 1102420 - RNA, 22 nt, Human
gccccgcuaauuuuuguauuuu

SEQ ID NO: 1102421 - RNA, 22 nt, Human
gcccgccucgccuuccucgccu

SEQ ID NO: 1102422 - RNA, 24 nt, Human
gcgauucuccugccucagccuccc

SEQ ID NO: 1102423 - RNA, 23 nt, Human
gcgcagcccggggucaguccugc

SEQ ID NO: 1102424 - RNA, 21 nt, Human
gcggcccccagcccugcggca

SEQ ID NO: 1102425 - RNA, 21 nt, Human
gcuccgcuucuccucuaccca

SEQ ID NO: 1102426 - RNA, 19 nt, Human
gcuggugagggggcggcgg

SEQ ID NO: 1102427 - RNA, 22 nt, Human
ggagcuguucugggcccugccu

SEQ ID NO: 1102428 - RNA, 22 nt, Human
ggauuacaggcaugagccaccg

SEQ ID NO: 1102429 - RNA, 24 nt, Human
ggcaucgcaguggcgcgaucucgg

SEQ ID NO: 1102430 - RNA, 26 nt, Human
ggcccccagcccugcggcacugguuc

SEQ ID NO: 1102431 - RNA, 21 nt, Human
ggccccggagaggaaacagcc

SEQ ID NO: 1102432 - RNA, 22 nt, Human
ggcgcgggcgcuccaggaggga

SEQ ID NO: 1102433 - RNA, 18 nt, Human
gggauggagggcacucgu

SEQ ID NO: 1102434 - RNA, 19 nt, Human
gggcggcggucccagcagc

SEQ ID NO: 1102435 - RNA, 19 nt, Human
ggguccggcaaagggcggg

SEQ ID NO: 1102436 - RNA, 21 nt, Human
ggguccucccccggucuaccc

SEQ ID NO: 1102437 - RNA, 24 nt, Human
gucacugcugucgaaucccccaaa

SEQ ID NO: 1102438 - RNA, 24 nt, Human
uaauuuuuguauuuuuaguagaga

SEQ ID NO: 1102439 - RNA, 23 nt, Human
uacaggcaugagccaccgcgccc

SEQ ID NO: 1102440 - RNA, 20 nt, Human
uaggggagcuguucugggcc

SEQ ID NO: 1102441 - RNA, 21 nt, Human
uaguagagaccggguuucacc

SEQ ID NO: 1102442 - RNA, 24 nt, Human
uaguagagaccggguuucaccgug

SEQ ID NO: 1102443 - RNA, 26 nt, Human
uaguagagaccggguuucaccguguu

SEQ ID NO: 1102444 - RNA, 22 nt, Human
uauccucaauuuacaguggagg

SEQ ID NO: 1102445 - RNA, 19 nt, Human
ucaagcgauucuccugccu

SEQ ID NO: 1102446 - RNA, 24 nt, Human
ucaccguguuggccaggauggucu

SEQ ID NO: 1102447 - RNA, 23 nt, Human
ucacugcuaccuccaccuccugg

SEQ ID NO: 1102448 - RNA, 24 nt, Human
ucacugcuaccuccaccuccuggg

SEQ ID NO: 1102449 - RNA, 27 nt, Human
ucacugcuaccuccaccuccuggguuc

SEQ ID NO: 1102450 - RNA, 23 nt, Human
ucagccucccgaguagcugggac

SEQ ID NO: 1102451 - RNA, 23 nt, Human
uccagguacgcuaggcgcaggau

SEQ ID NO: 1102452 - RNA, 24 nt, Human
ucccaaagugcugggauuacaggc

SEQ ID NO: 1102453 - RNA, 19 nt, Human
ucccaauacucagagugcc

SEQ ID NO: 1102454 - RNA, 19 nt, Human
ucccagagccggacaaugc

SEQ ID NO: 1102455 - RNA, 20 nt, Human
ucccaucgugucuccccacc

SEQ ID NO: 1102456 - RNA, 21 nt, Human
ucccccaaauucccuucaccc

SEQ ID NO: 1102457 - RNA, 18 nt, Human
ucccccggucuacccucu

SEQ ID NO: 1102458 - RNA, 24 nt, Human
ucccgaguagcugggacuacaggc

SEQ ID NO: 1102459 - RNA, 21 nt, Human
ucccucacuugcuccgggagg

SEQ ID NO: 1102460 - RNA, 23 nt, Human
uccugcagcccgcgccgcggccg

SEQ ID NO: 1102461 - RNA, 21 nt, Human
uccuggguucaagcgauucuc

SEQ ID NO: 1102462 - RNA, 24 nt, Human
uccuggguucaagcgauucuccug

SEQ ID NO: 1102463 - RNA, 20 nt, Human
ucgaaucccccaaauucccu

SEQ ID NO: 1102464 - RNA, 22 nt, Human
ucgccuucccgggucgccgccg

SEQ ID NO: 1102465 - RNA, 18 nt, Human
ucggccucccaaagugcu

SEQ ID NO: 1102466 - RNA, 25 nt, Human
ucucaaaaaacaaaaaaacaaaaaa

SEQ ID NO: 1102467 - RNA, 18 nt, Human
ucucacucugucgcccag

SEQ ID NO: 1102468 - RNA, 19 nt, Human
ucucacucugucgcccagu

SEQ ID NO: 1102469 - RNA, 21 nt, Human
ucucacucugucgcccagugg

SEQ ID NO: 1102470 - RNA, 25 nt, Human
ucucacucugucgcccaguggcggc

SEQ ID NO: 1102471 - RNA, 23 nt, Human
ugaccaccagauggacuccuaau

SEQ ID NO: 1102472 - RNA, 21 nt, Human
ugagacgaagucucaaaaaac

SEQ ID NO: 1102473 - RNA, 19 nt, Human
ugaguggccucccgccccc

SEQ ID NO: 1102474 - RNA, 21 nt, Human
ugaguggccucccgcccccca

SEQ ID NO: 1102475 - RNA, 22 nt, Human
ugaguggccucccgccccccag

SEQ ID NO: 1102476 - RNA, 24 nt, Human
ugccucagccucccgaguagcugg

SEQ ID NO: 1102477 - RNA, 21 nt, Human
ugccucggccucccaaagugc

SEQ ID NO: 1102478 - RNA, 24 nt, Human
ugccucggccucccaaagugcugg

SEQ ID NO: 1102479 - RNA, 23 nt, Human
ugcggggaccggcgggaacggag

SEQ ID NO: 1102480 - RNA, 18 nt, Human
uggaggaugucuacaacc

SEQ ID NO: 1102481 - RNA, 24 nt, Human
uggccaggauggucucuaucucuu

SEQ ID NO: 1102482 - RNA, 19 nt, Human
uggcuaaguauguuuuuug

SEQ ID NO: 1102483 - RNA, 21 nt, Human
ugggacuacaggcgcgcgcca

SEQ ID NO: 1102484 - RNA, 22 nt, Human
ugggaguggcggcgcggccccc

SEQ ID NO: 1102485 - RNA, 18 nt, Human
ugggauuacaggcaugag

SEQ ID NO: 1102486 - RNA, 19 nt, Human
ugggauuacaggcaugagc

SEQ ID NO: 1102487 - RNA, 21 nt, Human
ugggauuacaggcaugagcca

SEQ ID NO: 1102488 - RNA, 22 nt, Human
ugggauuacaggcaugagccac

SEQ ID NO: 1102489 - RNA, 23 nt, Human
ugggauuacaggcaugagccacc

SEQ ID NO: 1102490 - RNA, 24 nt, Human
ugggauuacaggcaugagccaccg

SEQ ID NO: 1102491 - RNA, 24 nt, Human
ugggauuacaggcaugagccaccg

SEQ ID NO: 1102492 - RNA, 23 nt, Human
uggguucaagcgauucuccugcc

SEQ ID NO: 1102493 - RNA, 24 nt, Human
uggguucaagcgauucuccugccu

SEQ ID NO: 1102494 - RNA, 18 nt, Human
ugucccggagccaccgag

SEQ ID NO: 1102495 - RNA, 22 nt, Human
ugucccggagccaccgaggcgg

SEQ ID NO: 1102496 - RNA, 22 nt, Human
uuaguagagaccggguuucacc

SEQ ID NO: 1102497 - RNA, 24 nt, Human
uuaguagagaccggguuucaccgu

SEQ ID NO: 1102498 - RNA, 21 nt, Human
uucaagcgauucuccugccuc

SEQ ID NO: 1102499 - RNA, 23 nt, Human
uucaagcgauucuccugccucag

SEQ ID NO: 1102500 - RNA, 24 nt, Human
uucaagcgauucuccugccucagc

SEQ ID NO: 1102501 - RNA, 19 nt, Human
uuggggcgaagggcacagg

SEQ ID NO: 1102502 - RNA, 19 nt, Human
uuucaccguguuggccagg

SEQ ID NO: 1102503 - RNA, 24 nt, Human
uuuuuaguagagaccggguuucac

SEQ ID NO: 1102504 - RNA, 20 nt, Human
uuuuuguauuuuuaguagag

SEQ ID NO: 1102505 - RNA, 21 nt, Human
aaacuuucuguagagacagag

SEQ ID NO: 1102506 - RNA, 25 nt, Human
acucuguugcccaggcuggucucaa

SEQ ID NO: 1102507 - RNA, 24 nt, Human
acugaauuugauuuucuuuuuuuu

SEQ ID NO: 1102508 - RNA, 18 nt, Human
agccauccucccgccuug

SEQ ID NO: 1102509 - RNA, 21 nt, Human
agccauccucccgccuuggcc

SEQ ID NO: 1102510 - RNA, 22 nt, Human
agccauccucccgccuuggccu

SEQ ID NO: 1102511 - RNA, 18 nt, Human
agcgaguggagcgggagg

SEQ ID NO: 1102512 - RNA, 23 nt, Human
agcuucucagcacgucucuguuc

SEQ ID NO: 1102513 - RNA, 19 nt, Human
aggcaggucaggucuuagg

SEQ ID NO: 1102514 - RNA, 21 nt, Human
aggcaggucaggucuuaggga

SEQ ID NO: 1102515 - RNA, 19 nt, Human
agggauuuuucuuucuuuc

SEQ ID NO: 1102516 - RNA, 19 nt, Human
aggggaaugagacugugau

SEQ ID NO: 1102517 - RNA, 20 nt, Human
caaacaacggcagguucccc

SEQ ID NO: 1102518 - RNA, 18 nt, Human
cacucuguugcccaggcu

SEQ ID NO: 1102519 - RNA, 24 nt, Human
cacucuguugcccaggcuggucuc

SEQ ID NO: 1102520 - RNA, 22 nt, Human
cacugaugccuugaccucccag

SEQ ID NO: 1102521 - RNA, 24 nt, Human
cagagucucacucuguugcccagg

SEQ ID NO: 1102522 - RNA, 20 nt, Human
cccaggcucaagccauccuc

SEQ ID NO: 1102523 - RNA, 19 nt, Human
ccucccgccuuggccuucc

SEQ ID NO: 1102524 - RNA, 25 nt, Human
cuaucuccaggcaguggcacaacca

SEQ ID NO: 1102525 - RNA, 18 nt, Human
cucaagccauccucccgc

SEQ ID NO: 1102526 - RNA, 25 nt, Human
cucacucuaucuccaggcaguggca

SEQ ID NO: 1102527 - RNA, 25 nt, Human
cucccaggcucaagccauccucccg

SEQ ID NO: 1102528 - RNA, 24 nt, Human
gcacaaccaucgcucacugaugcc

SEQ ID NO: 1102529 - RNA, 22 nt, Human
guagagacagagucucacucug

SEQ ID NO: 1102530 - RNA, 22 nt, Human
uacaagcaugugucacuacacc

SEQ ID NO: 1102531 - RNA, 24 nt, Human
uacaagcaugugucacuacaccug

SEQ ID NO: 1102532 - RNA, 22 nt, Human
uagagacagagucucacucugu

SEQ ID NO: 1102533 - RNA, 23 nt, Human
ucacugaugccuugaccucccag

SEQ ID NO: 1102534 - RNA, 20 nt, Human
uccaggcaguggcacaacca

SEQ ID NO: 1102535 - RNA, 18 nt, Human
ucccaggcucaagccauc

SEQ ID NO: 1102536 - RNA, 19 nt, Human
ucucacucuguugcccagg

SEQ ID NO: 1102537 - RNA, 23 nt, Human
ucucacucuguugcccaggcugg

SEQ ID NO: 1102538 - RNA, 26 nt, Human
ucucacucuguugcccaggcuggucu

SEQ ID NO: 1102539 - RNA, 27 nt, Human
ucucacucuguugcccaggcuggucuc

SEQ ID NO: 1102540 - RNA, 23 nt, Human
ucuguugcccaggcuggucucaa

SEQ ID NO: 1102541 - RNA, 24 nt, Human
ucuguugcccaggcuggucucaaa

SEQ ID NO: 1102542 - RNA, 22 nt, Human
ucuuucuuucuuucuuucuuuu

SEQ ID NO: 1102543 - RNA, 19 nt, Human
ucuuucuuucuuucuuuuu

SEQ ID NO: 1102544 - RNA, 22 nt, Human
ugagacagggucucacucuauc

SEQ ID NO: 1102545 - RNA, 19 nt, Human
ugaugccuugaccucccag

SEQ ID NO: 1102546 - RNA, 21 nt, Human
ugcccaggcuggucucaaacu

SEQ ID NO: 1102547 - RNA, 19 nt, Human
ugccuugaccucccaggcu

SEQ ID NO: 1102548 - RNA, 21 nt, Human
ugccuugaccucccaggcuca

SEQ ID NO: 1102549 - RNA, 26 nt, Human
uggcacaaccaucgcucacugaugcc

SEQ ID NO: 1102550 - RNA, 22 nt, Human
uguugcccaggcuggucucaaa

SEQ ID NO: 1102551 - RNA, 25 nt, Human
uuccucgcuggccucguuuuuugac

SEQ ID NO: 1102552 - RNA, 25 nt, Human
uucuuucuuucuuucuuuuuugaga

SEQ ID NO: 1102553 - RNA, 24 nt, Human
uugacaaacaacggcagguucccc

SEQ ID NO: 1102554 - RNA, 22 nt, Human
uugagacagggucucacucuau

SEQ ID NO: 1102555 - RNA, 22 nt, Human
uuggugcuuucuagggaguagg

SEQ ID NO: 1102556 - RNA, 18 nt, Human
uuucuuuuuugagacagg

SEQ ID NO: 1102557 - RNA, 23 nt, Human
uuuucuuuuuuuuuuucagucuc

SEQ ID NO: 1102558 - RNA, 23 nt, Human
aaagcaggagaaucgcuugaacc

SEQ ID NO: 1102559 - RNA, 24 nt, Human
aaagugcugggauuacaggcguga

SEQ ID NO: 1102560 - RNA, 22 nt, Human
aacagccaacucuccuacauau

SEQ ID NO: 1102561 - RNA, 20 nt, Human
aacauggugaaacuccgucu

SEQ ID NO: 1102562 - RNA, 21 nt, Human
aacauggugaaacuccgucuc

SEQ ID NO: 1102563 - RNA, 22 nt, Human
aacuagaacccagcugacuucc

SEQ ID NO: 1102564 - RNA, 18 nt, Human
aagaaggugcuucaucuu

SEQ ID NO: 1102565 - RNA, 19 nt, Human
aagagaaugaggagaaggg

SEQ ID NO: 1102566 - RNA, 19 nt, Human
aagcaaaggugaaagcaga

SEQ ID NO: 1102567 - RNA, 21 nt, Human
aagcaaaggugaaagcagaaa

SEQ ID NO: 1102568 - RNA, 22 nt, Human
aagcaggagaaucgcuugaacc

SEQ ID NO: 1102569 - RNA, 24 nt, Human
aagcaggagaaucgcuugaaccug

SEQ ID NO: 1102570 - RNA, 25 nt, Human
aagcaggagaaucgcuugaaccugg

SEQ ID NO: 1102571 - RNA, 21 nt, Human
aaggcccaggaaggccuccag

SEQ ID NO: 1102572 - RNA, 19 nt, Human
aagugcugggauuacaggc

SEQ ID NO: 1102573 - RNA, 19 nt, Human
aagugcugggauuacaggc

SEQ ID NO: 1102574 - RNA, 26 nt, Human
aagugcugggauuacaggcgugagcc

SEQ ID NO: 1102575 - RNA, 21 nt, Human
aauacuaaaggcaacugucac

SEQ ID NO: 1102576 - RNA, 18 nt, Human
aaucgcuugaaccuggga

SEQ ID NO: 1102577 - RNA, 24 nt, Human
aaucgcuugaaccugggaggcaga

SEQ ID NO: 1102578 - RNA, 23 nt, Human
acaagcaaaggugaaagcagaaa

SEQ ID NO: 1102579 - RNA, 20 nt, Human
acaccccucuccuccccuua

SEQ ID NO: 1102580 - RNA, 21 nt, Human
acagcacuucuagggucaccu

SEQ ID NO: 1102581 - RNA, 19 nt, Human
acauggugaaacuccgucu

SEQ ID NO: 1102582 - RNA, 21 nt, Human
acauugcacuucagccugggc

SEQ ID NO: 1102583 - RNA, 23 nt, Human
acauugcacuucagccugggcaa

SEQ ID NO: 1102584 - RNA, 24 nt, Human
acauugcacuucagccugggcaac

SEQ ID NO: 1102585 - RNA, 24 nt, Human
accaacauggugaaacuccgucuc

SEQ ID NO: 1102586 - RNA, 23 nt, Human
accagaguaaaaggaaaagacug

SEQ ID NO: 1102587 - RNA, 19 nt, Human
accccucuccuccccuuag

SEQ ID NO: 1102588 - RNA, 24 nt, Human
acuagaacccagcugacuuccccc

SEQ ID NO: 1102589 - RNA, 18 nt, Human
acuccagcgccugcugug

SEQ ID NO: 1102590 - RNA, 18 nt, Human
acuccagcgccugcugug

SEQ ID NO: 1102591 - RNA, 24 nt, Human
acuccgucucuacuaaaaauacaa

SEQ ID NO: 1102592 - RNA, 20 nt, Human
acugcaagcucugccuccca

SEQ ID NO: 1102593 - RNA, 22 nt, Human
acuuugggaggccgaggugggg

SEQ ID NO: 1102594 - RNA, 23 nt, Human
agaaacaaucccuauuuaagagc

SEQ ID NO: 1102595 - RNA, 18 nt, Human
agaaacuccaucucaaaa

SEQ ID NO: 1102596 - RNA, 21 nt, Human
agaacccagcugacuuccccc

SEQ ID NO: 1102597 - RNA, 24 nt, Human
agaacuuugggaggccgagguggg

SEQ ID NO: 1102598 - RNA, 19 nt, Human
agacaguagcauacuuggc

SEQ ID NO: 1102599 - RNA, 18 nt, Human
agagguugcagugagccg

SEQ ID NO: 1102600 - RNA, 23 nt, Human
agagguugcagugagccgagauc

SEQ ID NO: 1102601 - RNA, 24 nt, Human
agagguugcagugagccgagauca

SEQ ID NO: 1102602 - RNA, 19 nt, Human
agcacgccuucccauccug

SEQ ID NO: 1102603 - RNA, 21 nt, Human
agccaacucuccuacauaugc

SEQ ID NO: 1102604 - RNA, 18 nt, Human
agccaggugugauggugc

SEQ ID NO: 1102605 - RNA, 22 nt, Human
agccuaaccaacauggugaaac

SEQ ID NO: 1102606 - RNA, 18 nt, Human
aggaaauugagucacagg

SEQ ID NO: 1102607 - RNA, 20 nt, Human
aggaaggauuugggccucag

SEQ ID NO: 1102608 - RNA, 25 nt, Human
aggaaggccuccaggaaaaggcugc

SEQ ID NO: 1102609 - RNA, 18 nt, Human
aggagaagggagaguuga

SEQ ID NO: 1102610 - RNA, 21 nt, Human
aggcagagguugcagugagcc

SEQ ID NO: 1102611 - RNA, 24 nt, Human
aggcagagguugcagugagccgag

SEQ ID NO: 1102612 - RNA, 18 nt, Human
aggcaggacacagaggac

SEQ ID NO: 1102613 - RNA, 21 nt, Human
aggccgagguggggggaucac

SEQ ID NO: 1102614 - RNA, 23 nt, Human
aggccgagguggggggaucacug

SEQ ID NO: 1102615 - RNA, 25 nt, Human
aggcuggagugcaguggugcaaucu

SEQ ID NO: 1102616 - RNA, 24 nt, Human
aggggggccgggugugguggcuca

SEQ ID NO: 1102617 - RNA, 21 nt, Human
agguggggggaucacugaggu

SEQ ID NO: 1102618 - RNA, 21 nt, Human
aggugguguagccaccauacc

SEQ ID NO: 1102619 - RNA, 20 nt, Human
aguaaaaggaaaagacugga

SEQ ID NO: 1102620 - RNA, 22 nt, Human
aguagagaugggguuucaccau

SEQ ID NO: 1102621 - RNA, 19 nt, Human
aguagcugggacuccaggc

SEQ ID NO: 1102622 - RNA, 20 nt, Human
agugcaguggugcaaucucg

SEQ ID NO: 1102623 - RNA, 24 nt, Human
agugcaguggugcaaucucggcuc

SEQ ID NO: 1102624 - RNA, 18 nt, Human
agugcugggauuacaggc

SEQ ID NO: 1102625 - RNA, 18 nt, Human
auaaaacacuguagcccc

SEQ ID NO: 1102626 - RNA, 18 nt, Human
auaaaacacuguagcccc

SEQ ID NO: 1102627 - RNA, 24 nt, Human
aucacaacauugcacuucagccug

SEQ ID NO: 1102628 - RNA, 24 nt, Human
augauccgcccgccucggccuccc

SEQ ID NO: 1102629 - RNA, 18 nt, Human
augggguuucaccauguu

SEQ ID NO: 1102630 - RNA, 20 nt, Human
augggguuucaccauguuag

SEQ ID NO: 1102631 - RNA, 24 nt, Human
augggguuucaccauguuagccag

SEQ ID NO: 1102632 - RNA, 23 nt, Human
auggugcauaccugcaaucccag

SEQ ID NO: 1102633 - RNA, 24 nt, Human
auugcacuucagccugggcaacaa

SEQ ID NO: 1102634 - RNA, 25 nt, Human
auugcacuucagccugggcaacaag

SEQ ID NO: 1102635 - RNA, 24 nt, Human
caaagugcugggauuacaggcgug

SEQ ID NO: 1102636 - RNA, 24 nt, Human
caacauggugaaacuccgucucua

SEQ ID NO: 1102637 - RNA, 24 nt, Human
caagcacgccuucccauccugccc

SEQ ID NO: 1102638 - RNA, 18 nt, Human
cacacauggagaagaggc

SEQ ID NO: 1102639 - RNA, 19 nt, Human
caccacacccagccucuuc

SEQ ID NO: 1102640 - RNA, 18 nt, Human
caccauguuagccaggau

SEQ ID NO: 1102641 - RNA, 22 nt, Human
caccauguuagccaggaugguc

SEQ ID NO: 1102642 - RNA, 24 nt, Human
caccauguuagccaggauggucuu

SEQ ID NO: 1102643 - RNA, 18 nt, Human
cacccaccaccaugccug

SEQ ID NO: 1102644 - RNA, 18 nt, Human
caccccucuccuccccuu

SEQ ID NO: 1102645 - RNA, 24 nt, Human
cagaacuuugggaggccgaggugg

SEQ ID NO: 1102646 - RNA, 18 nt, Human
cagagaucuacccugugu

SEQ ID NO: 1102647 - RNA, 22 nt, Human
cagaguaaaaggaaaagacugg

SEQ ID NO: 1102648 - RNA, 18 nt, Human
cagccugggcaacaagag

SEQ ID NO: 1102649 - RNA, 20 nt, Human
caggacuccagcgccugcug

SEQ ID NO: 1102650 - RNA, 19 nt, Human
caggauauucagaagugcu

SEQ ID NO: 1102651 - RNA, 21 nt, Human
caguagcauacuuggcccugg

SEQ ID NO: 1102652 - RNA, 22 nt, Human
caugccauucuccugccucagc

SEQ ID NO: 1102653 - RNA, 18 nt, Human
cauguuaaaucauuuccu

SEQ ID NO: 1102654 - RNA, 19 nt, Human
cauugcacuucagccuggg

SEQ ID NO: 1102655 - RNA, 19 nt, Human
cauugcacuucagccuggg

SEQ ID NO: 1102656 - RNA, 20 nt, Human
cauugcacuucagccugggc

SEQ ID NO: 1102657 - RNA, 21 nt, Human
cauugcacuucagccugggca

SEQ ID NO: 1102658 - RNA, 22 nt, Human
cauugcacuucagccugggcaa

SEQ ID NO: 1102659 - RNA, 24 nt, Human
cauugcacuucagccugggcaaca

SEQ ID NO: 1102660 - RNA, 22 nt, Human
ccaaagugcugggauuacaggc

SEQ ID NO: 1102661 - RNA, 22 nt, Human
ccaaagugcugggauuacaggc

SEQ ID NO: 1102662 - RNA, 24 nt, Human
ccaaagugcugggauuacaggcgu

SEQ ID NO: 1102663 - RNA, 18 nt, Human
ccaacucuccuacauaug

SEQ ID NO: 1102664 - RNA, 22 nt, Human
ccagcgccugcugugguggggu

SEQ ID NO: 1102665 - RNA, 21 nt, Human
ccaggcacccaccaccaugcc

SEQ ID NO: 1102666 - RNA, 19 nt, Human
cccaggcuggagugcagug

SEQ ID NO: 1102667 - RNA, 20 nt, Human
cccagguucaugccauucuc

SEQ ID NO: 1102668 - RNA, 21 nt, Human
cccauccugcccugccggaac

SEQ ID NO: 1102669 - RNA, 21 nt, Human
ccccacagccguucuuaccua

SEQ ID NO: 1102670 - RNA, 21 nt, Human
cccccacagccguucuuaccu

SEQ ID NO: 1102671 - RNA, 23 nt, Human
ccuaaccaacauggugaaacucc

SEQ ID NO: 1102672 - RNA, 23 nt, Human
ccucagacccugguggucccagg

SEQ ID NO: 1102673 - RNA, 18 nt, Human
ccucaggauauucagaag

SEQ ID NO: 1102674 - RNA, 21 nt, Human
ccugcaaucccagcuacucag

SEQ ID NO: 1102675 - RNA, 22 nt, Human
ccugccggaacaccccucuccu

SEQ ID NO: 1102676 - RNA, 23 nt, Human
ccugccucagccucccgaguagc

SEQ ID NO: 1102677 - RNA, 24 nt, Human
ccugccucagccucccgaguagcu

SEQ ID NO: 1102678 - RNA, 25 nt, Human
ccugggaggcagagguugcagugag

SEQ ID NO: 1102679 - RNA, 24 nt, Human
cgagaccagccuaaccaacauggu

SEQ ID NO: 1102680 - RNA, 23 nt, Human
cgagguggggggaucacugaggu

SEQ ID NO: 1102681 - RNA, 25 nt, Human
cgagguggggggaucacugagguca

SEQ ID NO: 1102682 - RNA, 21 nt, Human
cgcccugucuuuaugacaccu

SEQ ID NO: 1102683 - RNA, 25 nt, Human
cuagaacccagcugacuucccccac

SEQ ID NO: 1102684 - RNA, 20 nt, Human
cuaggcuacaaaccuguacu

SEQ ID NO: 1102685 - RNA, 22 nt, Human
cucacacccauaaucccagaac

SEQ ID NO: 1102686 - RNA, 22 nt, Human
cucaccuaaauuucacaacaau

SEQ ID NO: 1102687 - RNA, 24 nt, Human
cucagccucccgaguagcugggac

SEQ ID NO: 1102688 - RNA, 18 nt, Human
cucaugauccgcccgccu

SEQ ID NO: 1102689 - RNA, 24 nt, Human
cuccugaccucaugauccgcccgc

SEQ ID NO: 1102690 - RNA, 23 nt, Human
cucuccuccccuuagugaggaag

SEQ ID NO: 1102691 - RNA, 24 nt, Human
cugcaagcucugccucccagguuc

SEQ ID NO: 1102692 - RNA, 22 nt, Human
cuguauuuuuaguagagauggg

SEQ ID NO: 1102693 - RNA, 23 nt, Human
cuguauuuuuaguagagaugggg

SEQ ID NO: 1102694 - RNA, 22 nt, Human
cuuaggacuccuaggcuacaaa

SEQ ID NO: 1102695 - RNA, 18 nt, Human
cuucaucuuauuuuagug

SEQ ID NO: 1102696 - RNA, 20 nt, Human
cuugaagucuccuugguggg

SEQ ID NO: 1102697 - RNA, 24 nt, Human
gaaaaauuucaaaacacuuugcaa

SEQ ID NO: 1102698 - RNA, 20 nt, Human
gaaauccgagaacacucuuc

SEQ ID NO: 1102699 - RNA, 21 nt, Human
gaaggggggccggguguggug

SEQ ID NO: 1102700 - RNA, 22 nt, Human
gaccucaugauccgcccgccuc

SEQ ID NO: 1102701 - RNA, 22 nt, Human
gacuccaggcacccaccaccau

SEQ ID NO: 1102702 - RNA, 20 nt, Human
gacuccuaggcuacaaaccu

SEQ ID NO: 1102703 - RNA, 23 nt, Human
gagaaucgcuugaaccugggagg

SEQ ID NO: 1102704 - RNA, 23 nt, Human
gagaucacaacauugcacuucag

SEQ ID NO: 1102705 - RNA, 21 nt, Human
gagauggagucuugcucuguc

SEQ ID NO: 1102706 - RNA, 20 nt, Human
gagaugggguuucaccaugu

SEQ ID NO: 1102707 - RNA, 24 nt, Human
gagaugggguuucaccauguuagc

SEQ ID NO: 1102708 - RNA, 21 nt, Human
gagguggggggaucacugagg

SEQ ID NO: 1102709 - RNA, 18 nt, Human
gagugcugacuuccucuc

SEQ ID NO: 1102710 - RNA, 23 nt, Human
gaucacugaggucagaaguucga

SEQ ID NO: 1102711 - RNA, 18 nt, Human
gauuacaggcgugagcca

SEQ ID NO: 1102712 - RNA, 21 nt, Human
gauuacaggcgugagccacca

SEQ ID NO: 1102713 - RNA, 22 nt, Human
gauuacaggcgugagccaccac

SEQ ID NO: 1102714 - RNA, 19 nt, Human
gcccaggcuggagugcagu

SEQ ID NO: 1102715 - RNA, 20 nt, Human
gcccaggcuggagugcagug

SEQ ID NO: 1102716 - RNA, 23 nt, Human
gcccaggcuggagugcaguggug

SEQ ID NO: 1102717 - RNA, 22 nt, Human
gcccuggguuugacauaaaacu

SEQ ID NO: 1102718 - RNA, 25 nt, Human
gccucccagguucaugccauucucc

SEQ ID NO: 1102719 - RNA, 23 nt, Human
gccucggccucccaaagugcugg

SEQ ID NO: 1102720 - RNA, 25 nt, Human
gcucugucgcccaggcuggagugca

SEQ ID NO: 1102721 - RNA, 21 nt, Human
gcuuggggagauaaagaaggc

SEQ ID NO: 1102722 - RNA, 27 nt, Human
ggacuccagcgccugcugugguggggu

SEQ ID NO: 1102723 - RNA, 24 nt, Human
ggauggucuugaucuccugaccuc

SEQ ID NO: 1102724 - RNA, 19 nt, Human
ggauuacaggcgugagcca

SEQ ID NO: 1102725 - RNA, 21 nt, Human
ggccgggugugguggcucaca

SEQ ID NO: 1102726 - RNA, 22 nt, Human
gggggccgggugugguggcuca

SEQ ID NO: 1102727 - RNA, 22 nt, Human
gggguuucaccauguuagccag

SEQ ID NO: 1102728 - RNA, 19 nt, Human
ggugggggcgcggcagagc

SEQ ID NO: 1102729 - RNA, 23 nt, Human
ggugugguggcucacacccauaa

SEQ ID NO: 1102730 - RNA, 24 nt, Human
gguuucaccauguuagccaggaug

SEQ ID NO: 1102731 - RNA, 23 nt, Human
guagagaugggguuucaccaugu

SEQ ID NO: 1102732 - RNA, 20 nt, Human
gucaguuguccauauggcuc

SEQ ID NO: 1102733 - RNA, 21 nt, Human
gugaaacuccgucucuacuaa

SEQ ID NO: 1102734 - RNA, 24 nt, Human
gugagccaccacacccagccucuu

SEQ ID NO: 1102735 - RNA, 18 nt, Human
guggugggguaggguggg

SEQ ID NO: 1102736 - RNA, 19 nt, Human
guugcagugagccgagauc

SEQ ID NO: 1102737 - RNA, 20 nt, Human
uaaaaauacaaaauuagcca

SEQ ID NO: 1102738 - RNA, 22 nt, Human
uaaaaauacaaaauuagccagg

SEQ ID NO: 1102739 - RNA, 23 nt, Human
uaaaaauacaaaauuagccaggu

SEQ ID NO: 1102740 - RNA, 21 nt, Human
uaaagaaggcccaggaaggcc

SEQ ID NO: 1102741 - RNA, 22 nt, Human
uaaagagggugaagcgaaaaug

SEQ ID NO: 1102742 - RNA, 22 nt, Human
uaaggugaaauccgagaacacu

SEQ ID NO: 1102743 - RNA, 24 nt, Human
uaauuuagaaacaaucccuauuua

SEQ ID NO: 1102744 - RNA, 23 nt, Human
uacacaaaccuaggugguguagc

SEQ ID NO: 1102745 - RNA, 24 nt, Human
uacaggcgugagccaccacaccca

SEQ ID NO: 1102746 - RNA, 24 nt, Human
uaccugcaaucccagcuacucagg

SEQ ID NO: 1102747 - RNA, 22 nt, Human
uagagaugggguuucaccaugu

SEQ ID NO: 1102748 - RNA, 20 nt, Human
uagcaugauccccaguuuaa

SEQ ID NO: 1102749 - RNA, 22 nt, Human
uagccccaaguuaaguucccuc

SEQ ID NO: 1102750 - RNA, 24 nt, Human
uaguagagaugggguuucaccaug

SEQ ID NO: 1102751 - RNA, 26 nt, Human
uaguagagaugggguuucaccauguu

SEQ ID NO: 1102752 - RNA, 23 nt, Human
uauucacucaccuaaauuucaca

SEQ ID NO: 1102753 - RNA, 23 nt, Human
ucaacacagccauuccccuagaa

SEQ ID NO: 1102754 - RNA, 24 nt, Human
ucaccauguuagccaggauggucu

SEQ ID NO: 1102755 - RNA, 21 nt, Human
ucaccuguguucagagaucua

SEQ ID NO: 1102756 - RNA, 25 nt, Human
ucacuaggugauuucaccauugugc

SEQ ID NO: 1102757 - RNA, 18 nt, Human
ucacugcaagcucugccu

SEQ ID NO: 1102758 - RNA, 18 nt, Human
ucacugcaagcucugccu

SEQ ID NO: 1102759 - RNA, 19 nt, Human
ucacugcaagcucugccuc

SEQ ID NO: 1102760 - RNA, 24 nt, Human
ucacugcaagcucugccucccagg

SEQ ID NO: 1102761 - RNA, 23 nt, Human
ucagccucccgaguagcugggac

SEQ ID NO: 1102762 - RNA, 21 nt, Human
ucaggcaggacacagaggaca

SEQ ID NO: 1102763 - RNA, 23 nt, Human
ucauauauucacucaccuaaaag

SEQ ID NO: 1102764 - RNA, 18 nt, Human
ucaugccauucuccugcc

SEQ ID NO: 1102765 - RNA, 24 nt, Human
ucccaaagugcugggauuacaggc

SEQ ID NO: 1102766 - RNA, 21 nt, Human
ucccaaggaagucaccggacc

SEQ ID NO: 1102767 - RNA, 22 nt, Human
ucccaaggaagucaccggaccu

SEQ ID NO: 1102768 - RNA, 18 nt, Human
ucccaggacuccagcgcc

SEQ ID NO: 1102769 - RNA, 20 nt, Human
ucccagguucaugccauucu

SEQ ID NO: 1102770 - RNA, 21 nt, Human
ucccagguucaugccauucuc

SEQ ID NO: 1102771 - RNA, 24 nt, Human
ucccagguucaugccauucuccug

SEQ ID NO: 1102772 - RNA, 19 nt, Human
ucccauccugcccugccgg

SEQ ID NO: 1102773 - RNA, 23 nt, Human
uccccaguuuaaaggugaggaaa

SEQ ID NO: 1102774 - RNA, 19 nt, Human
uccccuagaaguuacagca

SEQ ID NO: 1102775 - RNA, 24 nt, Human
ucccgaguagcugggacuccaggc

SEQ ID NO: 1102776 - RNA, 24 nt, Human
ucgcccaggcuggagugcaguggu

SEQ ID NO: 1102777 - RNA, 18 nt, Human
ucgcuugaaccugggagg

SEQ ID NO: 1102778 - RNA, 18 nt, Human
ucggccucccaaagugcu

SEQ ID NO: 1102779 - RNA, 23 nt, Human
ucuacauauagaaagcuagggac

SEQ ID NO: 1102780 - RNA, 24 nt, Human
ucuccugccucagccucccgagua

SEQ ID NO: 1102781 - RNA, 20 nt, Human
ucucuacuaaaaauacaaaa

SEQ ID NO: 1102782 - RNA, 23 nt, Human
ucuugcucugucgcccaggcugg

SEQ ID NO: 1102783 - RNA, 24 nt, Human
ucuugcucugucgcccaggcugga

SEQ ID NO: 1102784 - RNA, 20 nt, Human
ugaaaugcuaacuagcauga

SEQ ID NO: 1102785 - RNA, 24 nt, Human
ugaaccugggaggcagagguugca

SEQ ID NO: 1102786 - RNA, 20 nt, Human
ugaggagaagggagaguuga

SEQ ID NO: 1102787 - RNA, 19 nt, Human
ugcacuucagccugggcaa

SEQ ID NO: 1102788 - RNA, 24 nt, Human
ugccucagccucccgaguagcugg

SEQ ID NO: 1102789 - RNA, 20 nt, Human
ugccuggcauagacauaggg

SEQ ID NO: 1102790 - RNA, 24 nt, Human
ugcucugucgcccaggcuggagug

SEQ ID NO: 1102791 - RNA, 24 nt, Human
ugcugggauuacaggcgugagcca

SEQ ID NO: 1102792 - RNA, 23 nt, Human
uggagucuugcucugucgcccag

SEQ ID NO: 1102793 - RNA, 24 nt, Human
uggagucuugcucugucgcccagg

SEQ ID NO: 1102794 - RNA, 23 nt, Human
uggagugcaguggugcaaucucg

SEQ ID NO: 1102795 - RNA, 24 nt, Human
uggagugcaguggugcaaucucgg

SEQ ID NO: 1102796 - RNA, 22 nt, Human
uggcucacacccauaaucccag

SEQ ID NO: 1102797 - RNA, 18 nt, Human
ugggaggaggcugaacug

SEQ ID NO: 1102798 - RNA, 24 nt, Human
ugggaggcagagguugcagugagc

SEQ ID NO: 1102799 - RNA, 24 nt, Human
ugggaggccgagguggggggauca

SEQ ID NO: 1102800 - RNA, 18 nt, Human
ugggauuacaggcgugag

SEQ ID NO: 1102801 - RNA, 19 nt, Human
ugggauuacaggcgugagc

SEQ ID NO: 1102802 - RNA, 22 nt, Human
ugggauuacaggcgugagccac

SEQ ID NO: 1102803 - RNA, 23 nt, Human
ugggauuacaggcgugagccacc

SEQ ID NO: 1102804 - RNA, 24 nt, Human
ugggauuacaggcgugagccacca

SEQ ID NO: 1102805 - RNA, 27 nt, Human
ugggccucagacccugguggucccagg

SEQ ID NO: 1102806 - RNA, 23 nt, Human
uggggugggggcgcggcagagcu

SEQ ID NO: 1102807 - RNA, 24 nt, Human
ugggguuucaccauguuagccagg

SEQ ID NO: 1102808 - RNA, 21 nt, Human
uguaacuagaacccagcugac

SEQ ID NO: 1102809 - RNA, 21 nt, Human
ugucgcccaggcuggagugca

SEQ ID NO: 1102810 - RNA, 18 nt, Human
uuaguagagaugggguuu

SEQ ID NO: 1102811 - RNA, 22 nt, Human
uuaguagagaugggguuucacc

SEQ ID NO: 1102812 - RNA, 24 nt, Human
uuaguagagaugggguuucaccau

SEQ ID NO: 1102813 - RNA, 23 nt, Human
uucaucuuauuuuagugccuggc

SEQ ID NO: 1102814 - RNA, 19 nt, Human
uucaugccauucuccugcc

SEQ ID NO: 1102815 - RNA, 24 nt, Human
uugaaccugggaggcagagguugc

SEQ ID NO: 1102816 - RNA, 21 nt, Human
uugacucaacacagccauucc

SEQ ID NO: 1102817 - RNA, 22 nt, Human
uugagucacaggcagaauaacu

SEQ ID NO: 1102818 - RNA, 18 nt, Human
uugcagugagccgagauc

SEQ ID NO: 1102819 - RNA, 19 nt, Human
uugcagugagccgagauca

SEQ ID NO: 1102820 - RNA, 20 nt, Human
uugcagugagccgagaucac

SEQ ID NO: 1102821 - RNA, 24 nt, Human
uugcucugucgcccaggcuggagu

SEQ ID NO: 1102822 - RNA, 25 nt, Human
uugggaggccgagguggggggauca

SEQ ID NO: 1102823 - RNA, 25 nt, Human
uugggguaaaaguuaaauaaaacac

SEQ ID NO: 1102824 - RNA, 19 nt, Human
uuucaccauguuagccagg

SEQ ID NO: 1102825 - RNA, 20 nt, Human
uuucaccauguuagccagga

SEQ ID NO: 1102826 - RNA, 24 nt, Human
uuucauaugcagucaugcauugcu

SEQ ID NO: 1102827 - RNA, 21 nt, Human
uuucuguauuuuuaguagaga

SEQ ID NO: 1102828 - RNA, 21 nt, Human
uuuucuguauuuuuaguagag

SEQ ID NO: 1102829 - RNA, 24 nt, Human
uuuucuguauuuuuaguagagaug

SEQ ID NO: 1102830 - RNA, 24 nt, Human
uuuuuaguagagaugggguuucac

SEQ ID NO: 1102831 - RNA, 21 nt, Human
aacuggaauaagucuuccaga

SEQ ID NO: 1102832 - RNA, 25 nt, Human
aagcaacuggaauaagucuuccaga

SEQ ID NO: 1102833 - RNA, 20 nt, Human
aaggauggcugccaagaugg

SEQ ID NO: 1102834 - RNA, 21 nt, Human
acagagccuuaacugaguuau

SEQ ID NO: 1102835 - RNA, 22 nt, Human
accucguucuccccgcucgcac

SEQ ID NO: 1102836 - RNA, 22 nt, Human
agaguccaucuucaguuucuuc

SEQ ID NO: 1102837 - RNA, 24 nt, Human
agugcuaacaaacuaaaugaaaau

SEQ ID NO: 1102838 - RNA, 18 nt, Human
agugguuuggauugacug

SEQ ID NO: 1102839 - RNA, 23 nt, Human
aucaagauacuuccaucaugggu

SEQ ID NO: 1102840 - RNA, 19 nt, Human
aucauuauucugcugaagu

SEQ ID NO: 1102841 - RNA, 22 nt, Human
augcaguuuguuucauuauguu

SEQ ID NO: 1102842 - RNA, 19 nt, Human
caaaacagagccuuaacug

SEQ ID NO: 1102843 - RNA, 19 nt, Human
caaggggccacuccgagcc

SEQ ID NO: 1102844 - RNA, 22 nt, Human
cacagccuggcugccgccgucc

SEQ ID NO: 1102845 - RNA, 22 nt, Human
cagagagaaauaaguaucuguc

SEQ ID NO: 1102846 - RNA, 18 nt, Human
cagccccccugcacagcc

SEQ ID NO: 1102847 - RNA, 18 nt, Human
cagccccccugcacagcc

SEQ ID NO: 1102848 - RNA, 23 nt, Human
caugcaguuuguuucauuauguu

SEQ ID NO: 1102849 - RNA, 19 nt, Human
cauuuuccucacgcuggga

SEQ ID NO: 1102850 - RNA, 21 nt, Human
ccaucauggguacacugaaga

SEQ ID NO: 1102851 - RNA, 18 nt, Human
cccccagauuucccacaa

SEQ ID NO: 1102852 - RNA, 22 nt, Human
cccgcagccccccugcacagcc

SEQ ID NO: 1102853 - RNA, 20 nt, Human
ccgcgggugccuucuccucu

SEQ ID NO: 1102854 - RNA, 22 nt, Human
cgcucgggaguccccgcagccc

SEQ ID NO: 1102855 - RNA, 18 nt, Human
cuaugauccacagcuucg

SEQ ID NO: 1102856 - RNA, 24 nt, Human
gaauaucucccaaugagaagcccu

SEQ ID NO: 1102857 - RNA, 18 nt, Human
gcugaagugaguucuccu

SEQ ID NO: 1102858 - RNA, 23 nt, Human
guccacgcuggcgccggcuccuc

SEQ ID NO: 1102859 - RNA, 21 nt, Human
uaaaugaaaauaaggcuauuu

SEQ ID NO: 1102860 - RNA, 22 nt, Human
uaccucguucuccccgcucgca

SEQ ID NO: 1102861 - RNA, 20 nt, Human
uagauucaguggucuuuucu

SEQ ID NO: 1102862 - RNA, 24 nt, Human
uauguuaauagcuuugauacauug

SEQ ID NO: 1102863 - RNA, 18 nt, Human
uauuuuucccucuucguc

SEQ ID NO: 1102864 - RNA, 25 nt, Human
ucagaugucucucauuucuagauuc

SEQ ID NO: 1102865 - RNA, 23 nt, Human
ucccaaugagaagcccuccguga

SEQ ID NO: 1102866 - RNA, 21 nt, Human
ucccccagauuucccacaagu

SEQ ID NO: 1102867 - RNA, 23 nt, Human
ucccccagauuucccacaagugu

SEQ ID NO: 1102868 - RNA, 19 nt, Human
uccgugaauuuucaggcug

SEQ ID NO: 1102869 - RNA, 24 nt, Human
uccucugcuauuuuguuuucauca

SEQ ID NO: 1102870 - RNA, 20 nt, Human
ucucucauuucuagauucag

SEQ ID NO: 1102871 - RNA, 18 nt, Human
ucugccucccaaucaggu

SEQ ID NO: 1102872 - RNA, 22 nt, Human
ucuucaguuucuucucacuuuc

SEQ ID NO: 1102873 - RNA, 26 nt, Human
ugaaaauaaggcuauuuugcauuuaa

SEQ ID NO: 1102874 - RNA, 23 nt, Human
ugaaauaccucuuaaaacaauuu

SEQ ID NO: 1102875 - RNA, 20 nt, Human
ugaagagcauagugguuugg

SEQ ID NO: 1102876 - RNA, 24 nt, Human
ugaaguccuaaacauuuguccaug

SEQ ID NO: 1102877 - RNA, 22 nt, Human
ugauacauugugcucgcucucu

SEQ ID NO: 1102878 - RNA, 19 nt, Human
ugauccccaguguuugcuc

SEQ ID NO: 1102879 - RNA, 22 nt, Human
ugccgccguccacgcuggcgcc

SEQ ID NO: 1102880 - RNA, 21 nt, Human
ugccuggaagaggaauaucuc

SEQ ID NO: 1102881 - RNA, 20 nt, Human
uggaagaggaauaucuccca

SEQ ID NO: 1102882 - RNA, 24 nt, Human
ugggaacuaugauccacagcuucg

SEQ ID NO: 1102883 - RNA, 21 nt, Human
ugggcugacacccuuucuuca

SEQ ID NO: 1102884 - RNA, 20 nt, Human
uggguuuccuuuuucuggcc

SEQ ID NO: 1102885 - RNA, 19 nt, Human
ugugauccaaauaaucagu

SEQ ID NO: 1102886 - RNA, 20 nt, Human
ugugaugaaagcaacuggaa

SEQ ID NO: 1102887 - RNA, 22 nt, Human
uuaaaacaauuugauccccagu

SEQ ID NO: 1102888 - RNA, 25 nt, Human
uuaaaauaguauuugaaaagcucac

SEQ ID NO: 1102889 - RNA, 24 nt, Human
uucaucaucauuauucugcugaag

SEQ ID NO: 1102890 - RNA, 18 nt, Human
uuccucacgcugggaacu

SEQ ID NO: 1102891 - RNA, 23 nt, Human
uugaagcaguuucaaugguuugu

SEQ ID NO: 1102892 - RNA, 24 nt, Human
aaaagcacaggcugugugucugga

SEQ ID NO: 1102893 - RNA, 22 nt, Human
aaaugcagccgaaacuguuggc

SEQ ID NO: 1102894 - RNA, 19 nt, Human
aaccagauguccauauucc

SEQ ID NO: 1102895 - RNA, 19 nt, Human
aaccgaaucagaucaugag

SEQ ID NO: 1102896 - RNA, 25 nt, Human
aacuauugauaaagugagucagcag

SEQ ID NO: 1102897 - RNA, 23 nt, Human
aaggggacaucaucgcuucaguc

SEQ ID NO: 1102898 - RNA, 23 nt, Human
acacauuccuccccccucccccc

SEQ ID NO: 1102899 - RNA, 22 nt, Human
acauucacagacagaaagcuaa

SEQ ID NO: 1102900 - RNA, 22 nt, Human
acccucagaauuaccgaagaaa

SEQ ID NO: 1102901 - RNA, 22 nt, Human
acggccuccuuagcugcuagaa

SEQ ID NO: 1102902 - RNA, 23 nt, Human
acuaucuuacacauuccuccccc

SEQ ID NO: 1102903 - RNA, 24 nt, Human
agaaaucagaaguuuuaugaagcc

SEQ ID NO: 1102904 - RNA, 29 nt, Human
agacagaaagcuaagcuaagagggacccc

SEQ ID NO: 1102905 - RNA, 19 nt, Human
agagggcagcaggccaaag

SEQ ID NO: 1102906 - RNA, 23 nt, Human
agaugaggagggugaagcgagug

SEQ ID NO: 1102907 - RNA, 23 nt, Human
agccagaccagccacaagaccua

SEQ ID NO: 1102908 - RNA, 18 nt, Human
agcuugaaggagccggca

SEQ ID NO: 1102909 - RNA, 19 nt, Human
aggagacagggaaccgaau

SEQ ID NO: 1102910 - RNA, 21 nt, Human
aggcuggggucccacucuugu

SEQ ID NO: 1102911 - RNA, 19 nt, Human
aggguaacccuuuucaaag

SEQ ID NO: 1102912 - RNA, 22 nt, Human
aguaauaacuuuauuuccaaau

SEQ ID NO: 1102913 - RNA, 19 nt, Human
agucugugcccugacacag

SEQ ID NO: 1102914 - RNA, 24 nt, Human
aucaucgcuucaguccuaauccug

SEQ ID NO: 1102915 - RNA, 18 nt, Human
aucccaaucccugcugug

SEQ ID NO: 1102916 - RNA, 23 nt, Human
augaagccgcaggucuguagaug

SEQ ID NO: 1102917 - RNA, 22 nt, Human
auuucaugucccuccccccacc

SEQ ID NO: 1102918 - RNA, 26 nt, Human
caacaagcaauagcaaacaggauaca

SEQ ID NO: 1102919 - RNA, 21 nt, Human
cacaacaagcaauagcaaaca

SEQ ID NO: 1102920 - RNA, 25 nt, Human
cacacaauacacuauauagacauuc

SEQ ID NO: 1102921 - RNA, 27 nt, Human
cacacaauacacuauauagacauucac

SEQ ID NO: 1102922 - RNA, 19 nt, Human
cacaggcugugugucugga

SEQ ID NO: 1102923 - RNA, 23 nt, Human
caccacacaggccacacgagucc

SEQ ID NO: 1102924 - RNA, 21 nt, Human
caccacugacaaccaagacac

SEQ ID NO: 1102925 - RNA, 27 nt, Human
caccacugacaaccaagacacccagcc

SEQ ID NO: 1102926 - RNA, 23 nt, Human
cagaaguggcagaauugggccug

SEQ ID NO: 1102927 - RNA, 22 nt, Human
cagacagaaagcuaagcuaaga

SEQ ID NO: 1102928 - RNA, 19 nt, Human
cagcagauggaguuugugc

SEQ ID NO: 1102929 - RNA, 18 nt, Human
cagcagcuugaaggagcc

SEQ ID NO: 1102930 - RNA, 22 nt, Human
cagcaggguggcaccacacagg

SEQ ID NO: 1102931 - RNA, 24 nt, Human
cagccacaagaccuagucugugcc

SEQ ID NO: 1102932 - RNA, 18 nt, Human
caggaagaggaaccgagg

SEQ ID NO: 1102933 - RNA, 23 nt, Human
caggaaggggccaggccuucuca

SEQ ID NO: 1102934 - RNA, 18 nt, Human
caggccaaagcaaccaga

SEQ ID NO: 1102935 - RNA, 28 nt, Human
caggugaucaccucugcccccugaaagg

SEQ ID NO: 1102936 - RNA, 22 nt, Human
caguauggaguagguaccuccu

SEQ ID NO: 1102937 - RNA, 18 nt, Human
caguggaaaagagaaacc

SEQ ID NO: 1102938 - RNA, 21 nt, Human
cagugugagagguggcacaga

SEQ ID NO: 1102939 - RNA, 18 nt, Human
caguuggaugaguggaac

SEQ ID NO: 1102940 - RNA, 25 nt, Human
caugucccuccccccacccucagaa

SEQ ID NO: 1102941 - RNA, 23 nt, Human
ccaaaccagaaguggcagaauug

SEQ ID NO: 1102942 - RNA, 20 nt, Human
ccacaagggggagaucccag

SEQ ID NO: 1102943 - RNA, 24 nt, Human
ccacauuuccuucuccuucucaga

SEQ ID NO: 1102944 - RNA, 21 nt, Human
cccaagagccugcccccacaa

SEQ ID NO: 1102945 - RNA, 18 nt, Human
ccccaagagccugccccc

SEQ ID NO: 1102946 - RNA, 19 nt, Human
ccccaagagccugccccca

SEQ ID NO: 1102947 - RNA, 19 nt, Human
ccccaagaucucccuuugc

SEQ ID NO: 1102948 - RNA, 20 nt, Human
ccccaagggccucuaacucc

SEQ ID NO: 1102949 - RNA, 22 nt, Human
ccccauagcacaacaagcaaua

SEQ ID NO: 1102950 - RNA, 21 nt, Human
ccccccagcuggcaguggcuu

SEQ ID NO: 1102951 - RNA, 21 nt, Human
ccuaucuagcccacccaagga

SEQ ID NO: 1102952 - RNA, 19 nt, Human
ccuccccccacccucagaa

SEQ ID NO: 1102953 - RNA, 21 nt, Human
ccuccugcaaccaaccagggu

SEQ ID NO: 1102954 - RNA, 18 nt, Human
ccucgcgccgcaagccag

SEQ ID NO: 1102955 - RNA, 22 nt, Human
ccugcaaccaaccagggucauu

SEQ ID NO: 1102956 - RNA, 18 nt, Human
ccuggcucacaucuguga

SEQ ID NO: 1102957 - RNA, 20 nt, Human
ccugucaguggaaaagagaa

SEQ ID NO: 1102958 - RNA, 20 nt, Human
ccuucuccuucucagauccc

SEQ ID NO: 1102959 - RNA, 18 nt, Human
cucgcgccgcaagccaga

SEQ ID NO: 1102960 - RNA, 20 nt, Human
cucgcgccgcaagccagacc

SEQ ID NO: 1102961 - RNA, 28 nt, Human
cugccagccccaggggaggcccuggauu

SEQ ID NO: 1102962 - RNA, 20 nt, Human
cugcgcugccccuccagagg

SEQ ID NO: 1102963 - RNA, 18 nt, Human
cugcucccucccucuagc

SEQ ID NO: 1102964 - RNA, 20 nt, Human
cuugugaugcaggaguugua

SEQ ID NO: 1102965 - RNA, 21 nt, Human
gaaacaccuagggucacagcu

SEQ ID NO: 1102966 - RNA, 18 nt, Human
gaacccagucugaggggu

SEQ ID NO: 1102967 - RNA, 22 nt, Human
gagagguggcacagaggugcca

SEQ ID NO: 1102968 - RNA, 20 nt, Human
gagccagugugagagguggc

SEQ ID NO: 1102969 - RNA, 18 nt, Human
gaggcugggaauucggga

SEQ ID NO: 1102970 - RNA, 18 nt, Human
gaguagguaccuccugca

SEQ ID NO: 1102971 - RNA, 23 nt, Human
gcagggcacaagaacuucaggaa

SEQ ID NO: 1102972 - RNA, 25 nt, Human
gccagccccaggggagggggaacgc

SEQ ID NO: 1102973 - RNA, 19 nt, Human
gccaugagacuucgggcua

SEQ ID NO: 1102974 - RNA, 22 nt, Human
gcccugacacagggagccccaa

SEQ ID NO: 1102975 - RNA, 19 nt, Human
gccuggacuuugccuuccc

SEQ ID NO: 1102976 - RNA, 21 nt, Human
gcgugaagaaaugcagccgaa

SEQ ID NO: 1102977 - RNA, 20 nt, Human
gcuaugaccagagagaacca

SEQ ID NO: 1102978 - RNA, 27 nt, Human
gcuggcaguggcuuccuuuuucuugau

SEQ ID NO: 1102979 - RNA, 22 nt, Human
ggaaagccuuucaaaacuuggg

SEQ ID NO: 1102980 - RNA, 22 nt, Human
ggagaacaaagaugaggagggu

SEQ ID NO: 1102981 - RNA, 21 nt, Human
ggagcuucugggagcugcaga

SEQ ID NO: 1102982 - RNA, 22 nt, Human
ggagggaaugaacuagccagcu

SEQ ID NO: 1102983 - RNA, 23 nt, Human
ggcacaagaacuucaggaagagg

SEQ ID NO: 1102984 - RNA, 18 nt, Human
ggcccuuggugggaggcu

SEQ ID NO: 1102985 - RNA, 23 nt, Human
gggacuugcaagugccagaaaua

SEQ ID NO: 1102986 - RNA, 24 nt, Human
gggaggccccagcaggguggcacc

SEQ ID NO: 1102987 - RNA, 21 nt, Human
gggccaggccuucucagggga

SEQ ID NO: 1102988 - RNA, 20 nt, Human
gucauuacugagaaggggug

SEQ ID NO: 1102989 - RNA, 24 nt, Human
guugggucccaggugcugaggaaa

SEQ ID NO: 1102990 - RNA, 24 nt, Human
guuguaagccuccuuugggacugc

SEQ ID NO: 1102991 - RNA, 25 nt, Human
uaaccaccaccaaaucuaccccagu

SEQ ID NO: 1102992 - RNA, 19 nt, Human
uaacuccguggcugcuccc

SEQ ID NO: 1102993 - RNA, 22 nt, Human
uaagaucacaagccagcgugcc

SEQ ID NO: 1102994 - RNA, 20 nt, Human
uaagcuaagaugauuucaug

SEQ ID NO: 1102995 - RNA, 19 nt, Human
uaggaccccugaaagaggg

SEQ ID NO: 1102996 - RNA, 19 nt, Human
uaggagaauugcugggacu

SEQ ID NO: 1102997 - RNA, 23 nt, Human
uauaagaaggcccauggugcuga

SEQ ID NO: 1102998 - RNA, 19 nt, Human
ucaaagcugaagagaaauc

SEQ ID NO: 1102999 - RNA, 21 nt, Human
ucagaauuaccgaagaaauca

SEQ ID NO: 1103000 - RNA, 23 nt, Human
ucagcuccaaaagcacaggcugu

SEQ ID NO: 1103001 - RNA, 23 nt, Human
ucaguccuaauccugugcuucag

SEQ ID NO: 1103002 - RNA, 24 nt, Human
ucaugagauucguggugagggucc

SEQ ID NO: 1103003 - RNA, 23 nt, Human
uccaggacaggcaauucauccca

SEQ ID NO: 1103004 - RNA, 21 nt, Human
ucccaguuggaugaguggaac

SEQ ID NO: 1103005 - RNA, 27 nt, Human
uccccccagcuggcaguggcuuccuuu

SEQ ID NO: 1103006 - RNA, 18 nt, Human
ucccugcuguggucgcag

SEQ ID NO: 1103007 - RNA, 24 nt, Human
ucgcgccgcaagccagaccagcca

SEQ ID NO: 1103008 - RNA, 24 nt, Human
ucuccaugucaacaaggcagaaac

SEQ ID NO: 1103009 - RNA, 24 nt, Human
ucugccagcacugaucacccuaaa

SEQ ID NO: 1103010 - RNA, 20 nt, Human
ucugcccucgccccgaccuc

SEQ ID NO: 1103011 - RNA, 20 nt, Human
ucugggcccagagacuuccu

SEQ ID NO: 1103012 - RNA, 21 nt, Human
ucugugacgggaggaggagac

SEQ ID NO: 1103013 - RNA, 20 nt, Human
ugaagagaaaucagaaguuu

SEQ ID NO: 1103014 - RNA, 21 nt, Human
ugacuugucaagucauccuuc

SEQ ID NO: 1103015 - RNA, 18 nt, Human
ugagagugagaggcuggg

SEQ ID NO: 1103016 - RNA, 20 nt, Human
ugagagugagaggcuggggu

SEQ ID NO: 1103017 - RNA, 23 nt, Human
ugagcagugcccuggcucacauc

SEQ ID NO: 1103018 - RNA, 21 nt, Human
ugaggagggugaagcgaguga

SEQ ID NO: 1103019 - RNA, 18 nt, Human
ugaguggaacugagagug

SEQ ID NO: 1103020 - RNA, 22 nt, Human
ugaucaccucugcccucgcccc

SEQ ID NO: 1103021 - RNA, 22 nt, Human
ugccagcacugaucacccuaaa

SEQ ID NO: 1103022 - RNA, 19 nt, Human
ugcccugacacagggagcc

SEQ ID NO: 1103023 - RNA, 18 nt, Human
ugcuagaagcuggucucu

SEQ ID NO: 1103024 - RNA, 23 nt, Human
ugcuguggucgcagggcccuugg

SEQ ID NO: 1103025 - RNA, 21 nt, Human
uggacuuugccuucccuuaau

SEQ ID NO: 1103026 - RNA, 22 nt, Human
uggagaacaaagaugaggaggg

SEQ ID NO: 1103027 - RNA, 18 nt, Human
uggcaccacacaggccac

SEQ ID NO: 1103028 - RNA, 20 nt, Human
uggcagaauugggccugagg

SEQ ID NO: 1103029 - RNA, 18 nt, Human
uggcaguggcuuccuuuu

SEQ ID NO: 1103030 - RNA, 20 nt, Human
uggcaguggcuuccuuuuuc

SEQ ID NO: 1103031 - RNA, 21 nt, Human
ugggaacagugucuccugacu

SEQ ID NO: 1103032 - RNA, 24 nt, Human
ugggagaagugaggggaggggagg

SEQ ID NO: 1103033 - RNA, 23 nt, Human
ugggaggccccagcaggguggca

SEQ ID NO: 1103034 - RNA, 23 nt, Human
uggugaggcugggaauucgggac

SEQ ID NO: 1103035 - RNA, 18 nt, Human
ugucuggagccaguguga

SEQ ID NO: 1103036 - RNA, 20 nt, Human
ugucuggagccagugugaga

SEQ ID NO: 1103037 - RNA, 18 nt, Human
ugugcaaggucagcgggc

SEQ ID NO: 1103038 - RNA, 21 nt, Human
ugugugucuggagccagugug

SEQ ID NO: 1103039 - RNA, 24 nt, Human
uguuuugcaaaggcggcuucccuu

SEQ ID NO: 1103040 - RNA, 23 nt, Human
uucaauuuaucugccagcacuga

SEQ ID NO: 1103041 - RNA, 19 nt, Human
uuccucaggcaggcagcuu

SEQ ID NO: 1103042 - RNA, 23 nt, Human
uucugggcccagagacuuccuuu

SEQ ID NO: 1103043 - RNA, 20 nt, Human
uuggagaacaaagaugagga

SEQ ID NO: 1103044 - RNA, 23 nt, Human
uuuccuucuccuucucagauccc

SEQ ID NO: 1103045 - RNA, 21 nt, Human
aacaaguaucuccagugacag

SEQ ID NO: 1103046 - RNA, 19 nt, Human
aacauggugaaaccuuguc

SEQ ID NO: 1103047 - RNA, 20 nt, Human
aacauggugaaaccuugucu

SEQ ID NO: 1103048 - RNA, 21 nt, Human
aacauggugaaaccuugucuc

SEQ ID NO: 1103049 - RNA, 23 nt, Human
aagaauccccaacuucagccacc

SEQ ID NO: 1103050 - RNA, 19 nt, Human
aagugcugggauuacaggc

SEQ ID NO: 1103051 - RNA, 19 nt, Human
aagugcugggauuacaggc

SEQ ID NO: 1103052 - RNA, 23 nt, Human
aagugcugggauuacaggccuga

SEQ ID NO: 1103053 - RNA, 26 nt, Human
aagugcugggauuacaggccugagcc

SEQ ID NO: 1103054 - RNA, 24 nt, Human
aaugauucacagaauucagggaca

SEQ ID NO: 1103055 - RNA, 21 nt, Human
acacucugcuaggcugacuuc

SEQ ID NO: 1103056 - RNA, 20 nt, Human
acagagccagacuccgucuc

SEQ ID NO: 1103057 - RNA, 22 nt, Human
acauagaucugggaggacacca

SEQ ID NO: 1103058 - RNA, 22 nt, Human
accuuggcuuccugaagugcug

SEQ ID NO: 1103059 - RNA, 24 nt, Human
accuugucucuacugaaaauacaa

SEQ ID NO: 1103060 - RNA, 22 nt, Human
acucugcuaggcugacuucugu

SEQ ID NO: 1103061 - RNA, 25 nt, Human
acucugucaccuaagcuggagugca

SEQ ID NO: 1103062 - RNA, 20 nt, Human
acugcacuccagccuggcgg

SEQ ID NO: 1103063 - RNA, 24 nt, Human
acugcacuccagccuggcggacag

SEQ ID NO: 1103064 - RNA, 21 nt, Human
acuucuaggcuugguugaacc

SEQ ID NO: 1103065 - RNA, 24 nt, Human
agcacuuugggaggccgaggcggg

SEQ ID NO: 1103066 - RNA, 24 nt, Human
aggcaggagaauggugcaaacccg

SEQ ID NO: 1103067 - RNA, 21 nt, Human
aggccgaggcgggcggaucac

SEQ ID NO: 1103068 - RNA, 23 nt, Human
aggccgaggcgggcggaucacaa

SEQ ID NO: 1103069 - RNA, 24 nt, Human
aggcggagcuugcagugagccaag

SEQ ID NO: 1103070 - RNA, 24 nt, Human
aggcgggcggaucacaaggucagg

SEQ ID NO: 1103071 - RNA, 19 nt, Human
aggcugaggcaggagaaug

SEQ ID NO: 1103072 - RNA, 24 nt, Human
agugcugggauuacaggccugagc

SEQ ID NO: 1103073 - RNA, 24 nt, Human
auagcagcuguucuucauauggcc

SEQ ID NO: 1103074 - RNA, 25 nt, Human
aucauagacuuucagcuacuugaag

SEQ ID NO: 1103075 - RNA, 24 nt, Human
aucgcgccacugcacuccagccug

SEQ ID NO: 1103076 - RNA, 24 nt, Human
augauaacaaagauacugcugauc

SEQ ID NO: 1103077 - RNA, 24 nt, Human
auuuuuguauuuuuaguagagaug

SEQ ID NO: 1103078 - RNA, 24 nt, Human
caagaucgcgccacugcacuccag

SEQ ID NO: 1103079 - RNA, 21 nt, Human
cacaaacaaguaucuccagug

SEQ ID NO: 1103080 - RNA, 22 nt, Human
cacagguacgcgucaccacgcc

SEQ ID NO: 1103081 - RNA, 19 nt, Human
caccacgccuggcuaauuu

SEQ ID NO: 1103082 - RNA, 24 nt, Human
caccacgccuggcuaauuuuugua

SEQ ID NO: 1103083 - RNA, 24 nt, Human
cacccucauuuccccagaggugau

SEQ ID NO: 1103084 - RNA, 19 nt, Human
caccuuguuagcaucaacu

SEQ ID NO: 1103085 - RNA, 24 nt, Human
cacgccuguaaucccagcacuuug

SEQ ID NO: 1103086 - RNA, 23 nt, Human
cacuccagccuggcggacagagc

SEQ ID NO: 1103087 - RNA, 20 nt, Human
cacucugcuaggcugacuuc

SEQ ID NO: 1103088 - RNA, 23 nt, Human
cacucugucaccuaagcuggagu

SEQ ID NO: 1103089 - RNA, 24 nt, Human
cacucugucaccuaagcuggagug

SEQ ID NO: 1103090 - RNA, 21 nt, Human
cacugcaacugcugccucccg

SEQ ID NO: 1103091 - RNA, 23 nt, Human
cacugcaacugcugccucccggg

SEQ ID NO: 1103092 - RNA, 18 nt, Human
cacugcacuccagccugg

SEQ ID NO: 1103093 - RNA, 18 nt, Human
cacugcacuccagccugg

SEQ ID NO: 1103094 - RNA, 24 nt, Human
cacugcacuccagccuggcggaca

SEQ ID NO: 1103095 - RNA, 25 nt, Human
cacugcacuccagccuggcggacag

SEQ ID NO: 1103096 - RNA, 24 nt, Human
cagcacuuugggaggccgaggcgg

SEQ ID NO: 1103097 - RNA, 24 nt, Human
cagcugcucgggaggcugaggcag

SEQ ID NO: 1103098 - RNA, 24 nt, Human
caguagcugggaucacagguacgc

SEQ ID NO: 1103099 - RNA, 23 nt, Human
caugugacucaaacuuuagcacc

SEQ ID NO: 1103100 - RNA, 18 nt, Human
ccacugcacuccagccug

SEQ ID NO: 1103101 - RNA, 19 nt, Human
ccacugcacuccagccugg

SEQ ID NO: 1103102 - RNA, 19 nt, Human
ccacugcacuccagccugg

SEQ ID NO: 1103103 - RNA, 20 nt, Human
ccacugcacuccagccuggc

SEQ ID NO: 1103104 - RNA, 24 nt, Human
ccacugcacuccagccuggcggac

SEQ ID NO: 1103105 - RNA, 18 nt, Human
ccauauaacguucccagg

SEQ ID NO: 1103106 - RNA, 18 nt, Human
cccauauaacguucccag

SEQ ID NO: 1103107 - RNA, 21 nt, Human
cccauauaacguucccaggau

SEQ ID NO: 1103108 - RNA, 25 nt, Human
ccccccaguagcugggaucacaggu

SEQ ID NO: 1103109 - RNA, 21 nt, Human
cccguggagucaggggcuguu

SEQ ID NO: 1103110 - RNA, 23 nt, Human
ccuaagcuggagugcaguggcac

SEQ ID NO: 1103111 - RNA, 24 nt, Human
ccucccggguucaagcaauucuuu

SEQ ID NO: 1103112 - RNA, 23 nt, Human
ccugaagugcugggauuacaggc

SEQ ID NO: 1103113 - RNA, 21 nt, Human
ccuggcuaacauggugaaacc

SEQ ID NO: 1103114 - RNA, 21 nt, Human
ccuggcuaacauggugaaacc

SEQ ID NO: 1103115 - RNA, 24 nt, Human
ccuggcuaacauggugaaaccuug

SEQ ID NO: 1103116 - RNA, 22 nt, Human
ccuguaaucccagcacuuuggg

SEQ ID NO: 1103117 - RNA, 21 nt, Human
ccuguagucccagcugcucgg

SEQ ID NO: 1103118 - RNA, 22 nt, Human
ccuguagucccagcugcucggg

SEQ ID NO: 1103119 - RNA, 18 nt, Human
ccuuugcucuccugauca

SEQ ID NO: 1103120 - RNA, 24 nt, Human
cgaaaccauccuggcuaacauggu

SEQ ID NO: 1103121 - RNA, 26 nt, Human
cgaggcgggcggaucacaaggucagg

SEQ ID NO: 1103122 - RNA, 20 nt, Human
cgcaaagcuuucauuguucu

SEQ ID NO: 1103123 - RNA, 26 nt, Human
cgccacugcacuccagccuggcggac

SEQ ID NO: 1103124 - RNA, 23 nt, Human
cgccuguagucccagcugcucgg

SEQ ID NO: 1103125 - RNA, 24 nt, Human
cgccuguagucccagcugcucggg

SEQ ID NO: 1103126 - RNA, 24 nt, Human
cucaagucaucugcccaccuuggc

SEQ ID NO: 1103127 - RNA, 19 nt, Human
cucacagagcucuauaaaa

SEQ ID NO: 1103128 - RNA, 22 nt, Human
cucacgccuguaaucccagcac

SEQ ID NO: 1103129 - RNA, 24 nt, Human
cucacgccuguaaucccagcacuu

SEQ ID NO: 1103130 - RNA, 24 nt, Human
cucacucugucaccuaagcuggag

SEQ ID NO: 1103131 - RNA, 23 nt, Human
cucacugcaacugcugccucccg

SEQ ID NO: 1103132 - RNA, 24 nt, Human
cucacugcaacugcugccucccgg

SEQ ID NO: 1103133 - RNA, 24 nt, Human
cucagcccccccaguagcugggau

SEQ ID NO: 1103134 - RNA, 21 nt, Human
cuccccguggagucaggggcu

SEQ ID NO: 1103135 - RNA, 24 nt, Human
cugaagugcugggauuacaggccu

SEQ ID NO: 1103136 - RNA, 18 nt, Human
cugagcuucaguauuugu

SEQ ID NO: 1103137 - RNA, 22 nt, Human
cugaggcagccauugcaucuuc

SEQ ID NO: 1103138 - RNA, 23 nt, Human
cugcaacugcugccucccggguu

SEQ ID NO: 1103139 - RNA, 23 nt, Human
cugccucccggguucaagcaauu

SEQ ID NO: 1103140 - RNA, 20 nt, Human
cugcuaggcugacuucuguu

SEQ ID NO: 1103141 - RNA, 24 nt, Human
cuggcuaacauggugaaaccuugu

SEQ ID NO: 1103142 - RNA, 19 nt, Human
gaaaccuugucucuacuga

SEQ ID NO: 1103143 - RNA, 25 nt, Human
gacacauagaucugggaggacacca

SEQ ID NO: 1103144 - RNA, 21 nt, Human
gaccucaagucaucugcccac

SEQ ID NO: 1103145 - RNA, 24 nt, Human
gaccucaagucaucugcccaccuu

SEQ ID NO: 1103146 - RNA, 18 nt, Human
gagcuugcagugagccaa

SEQ ID NO: 1103147 - RNA, 23 nt, Human
gagcuugcagugagccaagaucg

SEQ ID NO: 1103148 - RNA, 18 nt, Human
gauuacaggccugagcca

SEQ ID NO: 1103149 - RNA, 21 nt, Human
gauuacaggccugagccacca

SEQ ID NO: 1103150 - RNA, 26 nt, Human
gcaauucuuuuaccucagccccccca

SEQ ID NO: 1103151 - RNA, 24 nt, Human
gcacuccagccuggcggacagagc

SEQ ID NO: 1103152 - RNA, 20 nt, Human
gccaagaucgcgccacugca

SEQ ID NO: 1103153 - RNA, 19 nt, Human
gccuaggaucaaacuguuc

SEQ ID NO: 1103154 - RNA, 24 nt, Human
gcuaacauggugaaaccuugucuc

SEQ ID NO: 1103155 - RNA, 24 nt, Human
gcugaucgggcgcgguggcucacg

SEQ ID NO: 1103156 - RNA, 20 nt, Human
gcuggagugcaguggcacca

SEQ ID NO: 1103157 - RNA, 23 nt, Human
gcugguuucgaaccccugaccuc

SEQ ID NO: 1103158 - RNA, 23 nt, Human
gcuuaaauccucuuuacaucaua

SEQ ID NO: 1103159 - RNA, 24 nt, Human
ggagcuugcagugagccaagaucg

SEQ ID NO: 1103160 - RNA, 19 nt, Human
ggauuacaggccugagcca

SEQ ID NO: 1103161 - RNA, 21 nt, Human
ggcggaucacaaggucaggag

SEQ ID NO: 1103162 - RNA, 24 nt, Human
gggcgcgguggcucacgccuguaa

SEQ ID NO: 1103163 - RNA, 22 nt, Human
gguacgguagcgggcgccugua

SEQ ID NO: 1103164 - RNA, 24 nt, Human
gguagcgggcgccuguagucccag

SEQ ID NO: 1103165 - RNA, 23 nt, Human
gguggcucacgccuguaauccca

SEQ ID NO: 1103166 - RNA, 24 nt, Human
gguggcucacgccuguaaucccag

SEQ ID NO: 1103167 - RNA, 19 nt, Human
gguuucgaaccccugaccu

SEQ ID NO: 1103168 - RNA, 24 nt, Human
uaaaacgcuuaaauccucuuuaca

SEQ ID NO: 1103169 - RNA, 24 nt, Human
uaaagcaaaaggauauaaaugaac

SEQ ID NO: 1103170 - RNA, 25 nt, Human
uaaagcaaaaggauauaaaugaacc

SEQ ID NO: 1103171 - RNA, 22 nt, Human
uaacauggugaaaccuugucuc

SEQ ID NO: 1103172 - RNA, 24 nt, Human
uaacauggugaaaccuugucucua

SEQ ID NO: 1103173 - RNA, 22 nt, Human
uaagggucucuucugcaggguc

SEQ ID NO: 1103174 - RNA, 24 nt, Human
uaauuuuuguauuuuuaguagaga

SEQ ID NO: 1103175 - RNA, 22 nt, Human
uacaggccugagccaccacacc

SEQ ID NO: 1103176 - RNA, 21 nt, Human
uaccucagcccccccaguagc

SEQ ID NO: 1103177 - RNA, 24 nt, Human
uaccucagcccccccaguagcugg

SEQ ID NO: 1103178 - RNA, 26 nt, Human
uaccucagcccccccaguagcuggga

SEQ ID NO: 1103179 - RNA, 22 nt, Human
uagccaucagccgcuacgugac

SEQ ID NO: 1103180 - RNA, 19 nt, Human
uaguagagaugggguuuug

SEQ ID NO: 1103181 - RNA, 24 nt, Human
uaguagagaugggguuuugccaag

SEQ ID NO: 1103182 - RNA, 21 nt, Human
uauggccuagugucuaaugcc

SEQ ID NO: 1103183 - RNA, 18 nt, Human
ucacaaggucaggagauc

SEQ ID NO: 1103184 - RNA, 24 nt, Human
ucacaaggucaggagaucgaaacc

SEQ ID NO: 1103185 - RNA, 24 nt, Human
ucacugcaacugcugccucccggg

SEQ ID NO: 1103186 - RNA, 22 nt, Human
uccacaagaauccccaacuuca

SEQ ID NO: 1103187 - RNA, 18 nt, Human
uccacuaucuaggggccc

SEQ ID NO: 1103188 - RNA, 24 nt, Human
uccccaacuucagccaccagcugg

SEQ ID NO: 1103189 - RNA, 27 nt, Human
uccccguggagucaggggcuguuaccu

SEQ ID NO: 1103190 - RNA, 20 nt, Human
ucccggguucaagcaauucu

SEQ ID NO: 1103191 - RNA, 23 nt, Human
ucccggguucaagcaauucuuuu

SEQ ID NO: 1103192 - RNA, 21 nt, Human
uccucagcccacccucacuuc

SEQ ID NO: 1103193 - RNA, 24 nt, Human
uccugaagugcugggauuacaggc

SEQ ID NO: 1103194 - RNA, 22 nt, Human
ucucacucugucaccuaagcug

SEQ ID NO: 1103195 - RNA, 24 nt, Human
ucucacucugucaccuaagcugga

SEQ ID NO: 1103196 - RNA, 21 nt, Human
ucuccaauuauagcagcuguu

SEQ ID NO: 1103197 - RNA, 24 nt, Human
ucuccagguaaaaucuccaauuau

SEQ ID NO: 1103198 - RNA, 25 nt, Human
ucuccagguaaaaucuccaauuaua

SEQ ID NO: 1103199 - RNA, 22 nt, Human
ucucuacugaaaauacaaaaaa

SEQ ID NO: 1103200 - RNA, 24 nt, Human
ucugucaccuaagcuggagugcag

SEQ ID NO: 1103201 - RNA, 19 nt, Human
ugaaguugugcacaaacaa

SEQ ID NO: 1103202 - RNA, 18 nt, Human
ugaccucaagucaucugc

SEQ ID NO: 1103203 - RNA, 20 nt, Human
ugaccucaagucaucugccc

SEQ ID NO: 1103204 - RNA, 20 nt, Human
ugacuucuguaguuuucacc

SEQ ID NO: 1103205 - RNA, 22 nt, Human
ugagccaagaucgcgccacugc

SEQ ID NO: 1103206 - RNA, 24 nt, Human
ugaggcaggagaauggugcaaacc

SEQ ID NO: 1103207 - RNA, 22 nt, Human
ugcaacugcugccucccggguu

SEQ ID NO: 1103208 - RNA, 22 nt, Human
ugcaguggcaccaucucagcuc

SEQ ID NO: 1103209 - RNA, 23 nt, Human
ugccccggucucagaguguggga

SEQ ID NO: 1103210 - RNA, 19 nt, Human
ugcgugacaauguauagag

SEQ ID NO: 1103211 - RNA, 21 nt, Human
ugcgugacaauguauagagua

SEQ ID NO: 1103212 - RNA, 22 nt, Human
ugcgugacaauguauagaguau

SEQ ID NO: 1103213 - RNA, 19 nt, Human
uggagugcaguggcaccau

SEQ ID NO: 1103214 - RNA, 23 nt, Human
uggagugcaguggcaccaucuca

SEQ ID NO: 1103215 - RNA, 21 nt, Human
uggaugccucuuaagggucuc

SEQ ID NO: 1103216 - RNA, 19 nt, Human
uggcaccaucucagcucac

SEQ ID NO: 1103217 - RNA, 24 nt, Human
uggcaccaucucagcucacugcaa

SEQ ID NO: 1103218 - RNA, 21 nt, Human
uggccuggcugguuucgaacc

SEQ ID NO: 1103219 - RNA, 24 nt, Human
uggccuggcugguuucgaaccccu

SEQ ID NO: 1103220 - RNA, 24 nt, Human
uggcucacgccuguaaucccagca

SEQ ID NO: 1103221 - RNA, 22 nt, Human
uggcugaaguugugcacaaaca

SEQ ID NO: 1103222 - RNA, 26 nt, Human
ugggaggacaccaaacgcaaagcuuu

SEQ ID NO: 1103223 - RNA, 19 nt, Human
ugggaggccgaggcgggcg

SEQ ID NO: 1103224 - RNA, 24 nt, Human
ugggaggccgaggcgggcggauca

SEQ ID NO: 1103225 - RNA, 22 nt, Human
ugggaucacagguacgcgucac

SEQ ID NO: 1103226 - RNA, 24 nt, Human
ugggaucacagguacgcgucacca

SEQ ID NO: 1103227 - RNA, 18 nt, Human
ugggauuacaggccugag

SEQ ID NO: 1103228 - RNA, 19 nt, Human
ugggauuacaggccugagc

SEQ ID NO: 1103229 - RNA, 21 nt, Human
ugggauuacaggccugagcca

SEQ ID NO: 1103230 - RNA, 22 nt, Human
ugggauuacaggccugagccac

SEQ ID NO: 1103231 - RNA, 24 nt, Human
ugggauuacaggccugagccacca

SEQ ID NO: 1103232 - RNA, 23 nt, Human
ugggguuuugccaaguuggccug

SEQ ID NO: 1103233 - RNA, 21 nt, Human
ugucagaaugauucacagaau

SEQ ID NO: 1103234 - RNA, 19 nt, Human
uguuuuguuuuguuuuuug

SEQ ID NO: 1103235 - RNA, 22 nt, Human
uguuuuguuuuuuguuuuuucc

SEQ ID NO: 1103236 - RNA, 23 nt, Human
uuacucuuagccaaacacaaauu

SEQ ID NO: 1103237 - RNA, 18 nt, Human
uuaguagagaugggguuu

SEQ ID NO: 1103238 - RNA, 22 nt, Human
uuaguagagaugggguuuugcc

SEQ ID NO: 1103239 - RNA, 23 nt, Human
uuaguagagaugggguuuugcca

SEQ ID NO: 1103240 - RNA, 24 nt, Human
uucaagcaauucuuuuaccucagc

SEQ ID NO: 1103241 - RNA, 20 nt, Human
uucaguuugccccggucuca

SEQ ID NO: 1103242 - RNA, 24 nt, Human
uuccugaagugcugggauuacagg

SEQ ID NO: 1103243 - RNA, 18 nt, Human
uucuaagacuucuugcuc

SEQ ID NO: 1103244 - RNA, 22 nt, Human
uugcagugagccaagaucgcgc

SEQ ID NO: 1103245 - RNA, 25 nt, Human
uugggaggccgaggcgggcggauca

SEQ ID NO: 1103246 - RNA, 23 nt, Human
uuguauuuuuaguagagaugggg

SEQ ID NO: 1103247 - RNA, 19 nt, Human
uuguggcugaaguugugca

SEQ ID NO: 1103248 - RNA, 20 nt, Human
uuugccaaguuggccuggcu

SEQ ID NO: 1103249 - RNA, 26 nt, Human
uuuggcagccacuucacauuuuugug

SEQ ID NO: 1103250 - RNA, 21 nt, Human
uuuguuuuguuuuguuuuuug

SEQ ID NO: 1103251 - RNA, 24 nt, Human
uuuguuuuguuuuguuuuuuguuu

SEQ ID NO: 1103252 - RNA, 25 nt, Human
uuuguuuuguuuuuuguuuuuuccg

SEQ ID NO: 1103253 - RNA, 20 nt, Human
uuuuccuaccugcuuauacu

SEQ ID NO: 1103254 - RNA, 21 nt, Human
uuuuuaguagagaugggguuu

SEQ ID NO: 1103255 - RNA, 21 nt, Human
uuuuuaguagagaugggguuu

SEQ ID NO: 1103256 - RNA, 20 nt, Human
uuuuuguauuuuuaguagag

SEQ ID NO: 1103257 - RNA, 20 nt, Human
aaacaggagugggcugcuuu

SEQ ID NO: 1103258 - RNA, 23 nt, Human
aaccaugacuacaguccaguugc

SEQ ID NO: 1103259 - RNA, 22 nt, Human
acuccagcgguucguccagcac

SEQ ID NO: 1103260 - RNA, 23 nt, Human
auagauuuuuuccccaaagaaca

SEQ ID NO: 1103261 - RNA, 20 nt, Human
augcacuagaacaaaagagg

SEQ ID NO: 1103262 - RNA, 22 nt, Human
cagcagcaugcuaauuacuggc

SEQ ID NO: 1103263 - RNA, 19 nt, Human
caggguaguaaaaaaaagu

SEQ ID NO: 1103264 - RNA, 18 nt, Human
caguccaguugcagaaac

SEQ ID NO: 1103265 - RNA, 21 nt, Human
ccuacagaacagcugagaccu

SEQ ID NO: 1103266 - RNA, 22 nt, Human
cuacuacaucaggacaccuugg

SEQ ID NO: 1103267 - RNA, 20 nt, Human
cuacucuuccucuucucaaa

SEQ ID NO: 1103268 - RNA, 20 nt, Human
cucaaagugccuacagaaca

SEQ ID NO: 1103269 - RNA, 23 nt, Human
cucaaagugccuacagaacagcu

SEQ ID NO: 1103270 - RNA, 20 nt, Human
cucuacacuugggaaacccc

SEQ ID NO: 1103271 - RNA, 22 nt, Human
cucuacacuugggaaaccccaa

SEQ ID NO: 1103272 - RNA, 22 nt, Human
cugcaaccaugacuacagucca

SEQ ID NO: 1103273 - RNA, 18 nt, Human
gaaaguauucaagcagaa

SEQ ID NO: 1103274 - RNA, 23 nt, Human
gaugcauguggguuacuugggaa

SEQ ID NO: 1103275 - RNA, 22 nt, Human
gccaaaugcaggagcuugucua

SEQ ID NO: 1103276 - RNA, 22 nt, Human
uaaaaaaaaguuuaaaaagcau

SEQ ID NO: 1103277 - RNA, 24 nt, Human
uagaacaaaagaggauguggagaa

SEQ ID NO: 1103278 - RNA, 25 nt, Human
uaggagaaaacuucucaguguaaug

SEQ ID NO: 1103279 - RNA, 22 nt, Human
uauacaguucugcaaccaugac

SEQ ID NO: 1103280 - RNA, 18 nt, Human
ucaguguaaugcuccuca

SEQ ID NO: 1103281 - RNA, 24 nt, Human
ucuacacuugggaaaccccaaggc

SEQ ID NO: 1103282 - RNA, 21 nt, Human
ucucaaagugccuacagaaca

SEQ ID NO: 1103283 - RNA, 20 nt, Human
ugauuauagauuuuuucccc

SEQ ID NO: 1103284 - RNA, 24 nt, Human
ugcagcagcaugcuaauuacuggc

SEQ ID NO: 1103285 - RNA, 18 nt, Human
uggccacagcauccuccu

SEQ ID NO: 1103286 - RNA, 18 nt, Human
ugggaaaccccaaggcug

SEQ ID NO: 1103287 - RNA, 18 nt, Human
uguggagaaugaaagaca

SEQ ID NO: 1103288 - RNA, 20 nt, Human
uguguggccacagcauccuc

SEQ ID NO: 1103289 - RNA, 23 nt, Human
uucaagcagaagcuggacgccau

SEQ ID NO: 1103290 - RNA, 24 nt, Human
uucacagcaguacuagaauaauaa

SEQ ID NO: 1103291 - RNA, 24 nt, Human
uuccucuacacuugggaaaccccc

SEQ ID NO: 1103292 - RNA, 22 nt, Human
acccugggacagcggagagagg

SEQ ID NO: 1103293 - RNA, 22 nt, Human
ccccuuuagccagcugucgcuc

SEQ ID NO: 1103294 - RNA, 18 nt, Human
ccuuuagccagcugucgc

SEQ ID NO: 1103295 - RNA, 25 nt, Human
gggacagcggagagaggccgguacc

SEQ ID NO: 1103296 - RNA, 20 nt, Human
ugggacagcggagagaggcc

SEQ ID NO: 1103297 - RNA, 24 nt, Human
uguggggggccccuuuagccagcu

SEQ ID NO: 1103298 - RNA, 18 nt, Human
uuuucccuacuacaucuu

SEQ ID NO: 1103299 - RNA, 19 nt, Human
aagaagacauuuccagagc

SEQ ID NO: 1103300 - RNA, 23 nt, Human
aagcacuuuaagcaaacaaaagc

SEQ ID NO: 1103301 - RNA, 21 nt, Human
aagcuuggggaaugcagaucu

SEQ ID NO: 1103302 - RNA, 18 nt, Human
acaagaauucccucagac

SEQ ID NO: 1103303 - RNA, 24 nt, Human
acccaucuucuugccuuguccucc

SEQ ID NO: 1103304 - RNA, 19 nt, Human
acucacuucagagccaagg

SEQ ID NO: 1103305 - RNA, 25 nt, Human
agaaauaaggaagaugaccgguacc

SEQ ID NO: 1103306 - RNA, 21 nt, Human
agaauucccucagacaauccc

SEQ ID NO: 1103307 - RNA, 23 nt, Human
agagggugggcuugcgggucaga

SEQ ID NO: 1103308 - RNA, 19 nt, Human
agauggggagugcuucaga

SEQ ID NO: 1103309 - RNA, 20 nt, Human
agcugcuugcuuuccaagaa

SEQ ID NO: 1103310 - RNA, 21 nt, Human
agcugcuugcuuuccaagaag

SEQ ID NO: 1103311 - RNA, 25 nt, Human
aggaacagagaaaggaaccgguacc

SEQ ID NO: 1103312 - RNA, 24 nt, Human
aggccaaggccaaaagcuuugaga

SEQ ID NO: 1103313 - RNA, 19 nt, Human
aggggcucagcuggguagg

SEQ ID NO: 1103314 - RNA, 24 nt, Human
aggugcagugacccacgccuguag

SEQ ID NO: 1103315 - RNA, 26 nt, Human
aggugggugggggggugugacgggcu

SEQ ID NO: 1103316 - RNA, 22 nt, Human
aguaagaggaacagagaaagga

SEQ ID NO: 1103317 - RNA, 24 nt, Human
agugacccacgccuguagucccag

SEQ ID NO: 1103318 - RNA, 20 nt, Human
auagaggcuguuguccauag

SEQ ID NO: 1103319 - RNA, 20 nt, Human
aucucagucuaguaagagga

SEQ ID NO: 1103320 - RNA, 22 nt, Human
augaggugaagagggugggcuu

SEQ ID NO: 1103321 - RNA, 18 nt, Human
cacaagaauucccucaga

SEQ ID NO: 1103322 - RNA, 23 nt, Human
caccuugggaggccaaggccaaa

SEQ ID NO: 1103323 - RNA, 24 nt, Human
cacgccuguagucccagcaccuug

SEQ ID NO: 1103324 - RNA, 23 nt, Human
cacugucaucugagaauugaggg

SEQ ID NO: 1103325 - RNA, 21 nt, Human
cacuucagagccaaggcagcc

SEQ ID NO: 1103326 - RNA, 21 nt, Human
cagaacaaaagcuguuggcag

SEQ ID NO: 1103327 - RNA, 20 nt, Human
cagcaccuugggaggccaag

SEQ ID NO: 1103328 - RNA, 22 nt, Human
cagcaccuugggaggccaaggc

SEQ ID NO: 1103329 - RNA, 21 nt, Human
cagcauggagcggggucaggg

SEQ ID NO: 1103330 - RNA, 25 nt, Human
cagccaggcccugucacuuaaaagc

SEQ ID NO: 1103331 - RNA, 26 nt, Human
cagccaggcccugucacuuaaaagcu

SEQ ID NO: 1103332 - RNA, 24 nt, Human
cagcugccauacagaggaggugac

SEQ ID NO: 1103333 - RNA, 20 nt, Human
caggggcaggagccucugag

SEQ ID NO: 1103334 - RNA, 20 nt, Human
cauagagcacacuccuugga

SEQ ID NO: 1103335 - RNA, 21 nt, Human
caucuucuugccuuguccucc

SEQ ID NO: 1103336 - RNA, 19 nt, Human
caugccccugcccuggagg

SEQ ID NO: 1103337 - RNA, 18 nt, Human
cauggagcggggucaggg

SEQ ID NO: 1103338 - RNA, 22 nt, Human
ccacgccuguagucccagcacc

SEQ ID NO: 1103339 - RNA, 21 nt, Human
ccagagcuuuccugcucgugg

SEQ ID NO: 1103340 - RNA, 19 nt, Human
ccagcaccuugggaggcca

SEQ ID NO: 1103341 - RNA, 21 nt, Human
ccaggugcagugacccacgcc

SEQ ID NO: 1103342 - RNA, 24 nt, Human
cccacgccuguagucccagcaccu

SEQ ID NO: 1103343 - RNA, 20 nt, Human
cccaucuucuugccuugucc

SEQ ID NO: 1103344 - RNA, 23 nt, Human
ccucagggagaagaaagcuuggg

SEQ ID NO: 1103345 - RNA, 23 nt, Human
ccuccacugcagggcucuccuca

SEQ ID NO: 1103346 - RNA, 23 nt, Human
ccuggagguuacucaguggggcu

SEQ ID NO: 1103347 - RNA, 21 nt, Human
ccuguuugggccugagauggg

SEQ ID NO: 1103348 - RNA, 22 nt, Human
cgccccauuccuuuaucaguca

SEQ ID NO: 1103349 - RNA, 23 nt, Human
cgccuguagucccagcaccuugg

SEQ ID NO: 1103350 - RNA, 22 nt, Human
cggggucaggggugcagaagga

SEQ ID NO: 1103351 - RNA, 21 nt, Human
cucagggagaagaaagcuugg

SEQ ID NO: 1103352 - RNA, 22 nt, Human
cugagccucaguuucccaucug

SEQ ID NO: 1103353 - RNA, 21 nt, Human
gagccucaguuucccaucugg

SEQ ID NO: 1103354 - RNA, 25 nt, Human
gagccucugaggugggucggguguc

SEQ ID NO: 1103355 - RNA, 20 nt, Human
gaggagggacccaacucaga

SEQ ID NO: 1103356 - RNA, 18 nt, Human
gaggugggugggggggug

SEQ ID NO: 1103357 - RNA, 20 nt, Human
gcaagaccuuccucaaauug

SEQ ID NO: 1103358 - RNA, 19 nt, Human
gcacuuuaagcaaacaaaa

SEQ ID NO: 1103359 - RNA, 19 nt, Human
gcagaagugacuuguuuac

SEQ ID NO: 1103360 - RNA, 18 nt, Human
gcaugaggugaagagggu

SEQ ID NO: 1103361 - RNA, 19 nt, Human
gccaacagguucuccuccu

SEQ ID NO: 1103362 - RNA, 18 nt, Human
gccucaguuucccaucug

SEQ ID NO: 1103363 - RNA, 18 nt, Human
ggccugagauggggagug

SEQ ID NO: 1103364 - RNA, 20 nt, Human
gggcaggagccucugaggug

SEQ ID NO: 1103365 - RNA, 20 nt, Human
gggcuggugggagcucguaa

SEQ ID NO: 1103366 - RNA, 25 nt, Human
ggggguagugagaaauaaggaagau

SEQ ID NO: 1103367 - RNA, 25 nt, Human
ggggugcagaaggaggcgcuaggag

SEQ ID NO: 1103368 - RNA, 20 nt, Human
gggugggggggugugacggg

SEQ ID NO: 1103369 - RNA, 22 nt, Human
ggucaaaguuggaucuucccag

SEQ ID NO: 1103370 - RNA, 22 nt, Human
guuguugcaucauuucuugaac

SEQ ID NO: 1103371 - RNA, 19 nt, Human
uaagaggaacagagaaagg

SEQ ID NO: 1103372 - RNA, 25 nt, Human
uaagaggaacagagaaaggaacuga

SEQ ID NO: 1103373 - RNA, 25 nt, Human
uaagcaaacaaaagcuuuggccagg

SEQ ID NO: 1103374 - RNA, 23 nt, Human
uaccagaagcucagccaguggag

SEQ ID NO: 1103375 - RNA, 19 nt, Human
ucacgcucgcgcaagcacu

SEQ ID NO: 1103376 - RNA, 23 nt, Human
ucacucaggucaggggcaggagc

SEQ ID NO: 1103377 - RNA, 26 nt, Human
ucagggagaagaaagcuuggggaaug

SEQ ID NO: 1103378 - RNA, 22 nt, Human
ucccaggacagacgaggcccag

SEQ ID NO: 1103379 - RNA, 24 nt, Human
ucgcgcaagcacuggccucugccu

SEQ ID NO: 1103380 - RNA, 19 nt, Human
ucucucuuuaagauugaug

SEQ ID NO: 1103381 - RNA, 19 nt, Human
ucuugccuuguccuccucc

SEQ ID NO: 1103382 - RNA, 20 nt, Human
ugaaccacugucaucugaga

SEQ ID NO: 1103383 - RNA, 21 nt, Human
ugaaccugucuaagacucagg

SEQ ID NO: 1103384 - RNA, 24 nt, Human
ugacccacgccuguagucccagca

SEQ ID NO: 1103385 - RNA, 20 nt, Human
ugacugaaccacugucaucu

SEQ ID NO: 1103386 - RNA, 21 nt, Human
ugagaauugagggucaaaguu

SEQ ID NO: 1103387 - RNA, 19 nt, Human
ugagauggggagugcuuca

SEQ ID NO: 1103388 - RNA, 27 nt, Human
ugaggugaagagggugggccggaaccc

SEQ ID NO: 1103389 - RNA, 25 nt, Human
ugauuucuggguucuguagccuccu

SEQ ID NO: 1103390 - RNA, 23 nt, Human
ugccccugcccuggagguuacuc

SEQ ID NO: 1103391 - RNA, 19 nt, Human
ugcccuggagguuacucag

SEQ ID NO: 1103392 - RNA, 26 nt, Human
ugcccuggagguuacucaguggggcu

SEQ ID NO: 1103393 - RNA, 21 nt, Human
ugccugggaccuaccagaagc

SEQ ID NO: 1103394 - RNA, 23 nt, Human
uggccaggugcagugacccacgg

SEQ ID NO: 1103395 - RNA, 18 nt, Human
ugggaagcuggggguagu

SEQ ID NO: 1103396 - RNA, 19 nt, Human
ugggaagcuggggguagug

SEQ ID NO: 1103397 - RNA, 19 nt, Human
ugggaggccaaggccaaaa

SEQ ID NO: 1103398 - RNA, 21 nt, Human
ugggaggccaaggccaaaagc

SEQ ID NO: 1103399 - RNA, 18 nt, Human
ugggccugagauggggag

SEQ ID NO: 1103400 - RNA, 20 nt, Human
uggguagguuguugcaaaga

SEQ ID NO: 1103401 - RNA, 22 nt, Human
ugggugggggggugugacgggc

SEQ ID NO: 1103402 - RNA, 23 nt, Human
ugggugggggggugugacgggcu

SEQ ID NO: 1103403 - RNA, 21 nt, Human
uguccauagagcacacuccuu

SEQ ID NO: 1103404 - RNA, 24 nt, Human
ugucuaacgugccugggaccuacc

SEQ ID NO: 1103405 - RNA, 20 nt, Human
ugugacgggcuggugggagc

SEQ ID NO: 1103406 - RNA, 24 nt, Human
uuacucaguggggcugggaguuuc

SEQ ID NO: 1103407 - RNA, 22 nt, Human
uucaguaucauaaaucgguaga

SEQ ID NO: 1103408 - RNA, 23 nt, Human
uucucaguccagcgcugcuuccg

SEQ ID NO: 1103409 - RNA, 19 nt, Human
uugccuuguccuccuccac

SEQ ID NO: 1103410 - RNA, 24 nt, Human
uugggaggccaaggccaaaagcuu

SEQ ID NO: 1103411 - RNA, 20 nt, Human
uuuaagauugaugacuuuca

SEQ ID NO: 1103412 - RNA, 20 nt, Human
uuuccagagcuuuccugcuc

SEQ ID NO: 1103413 - RNA, 24 nt, Human
uuuggccaggugcagugacccacg

SEQ ID NO: 1103414 - RNA, 22 nt, Human
aagcaguaccagacggcuucca

SEQ ID NO: 1103415 - RNA, 20 nt, Human
aaggacccccaggccacaga

SEQ ID NO: 1103416 - RNA, 22 nt, Human
aaggacccccaggccacagaug

SEQ ID NO: 1103417 - RNA, 23 nt, Human
acggcuuccaggaagaggagcca

SEQ ID NO: 1103418 - RNA, 21 nt, Human
acuggugcagcgggugucugg

SEQ ID NO: 1103419 - RNA, 23 nt, Human
aggaaggacccccaggccacaga

SEQ ID NO: 1103420 - RNA, 23 nt, Human
agggaaagccggggcaggagggc

SEQ ID NO: 1103421 - RNA, 18 nt, Human
ccccuggacuccuucagg

SEQ ID NO: 1103422 - RNA, 24 nt, Human
ccccuggacuccuucagguaguag

SEQ ID NO: 1103423 - RNA, 22 nt, Human
cgcgguugaagcaguaccagac

SEQ ID NO: 1103424 - RNA, 18 nt, Human
cgggagggccugcuggug

SEQ ID NO: 1103425 - RNA, 18 nt, Human
cugggccccucagugccg

SEQ ID NO: 1103426 - RNA, 22 nt, Human
gccaccgccggcugccccugga

SEQ ID NO: 1103427 - RNA, 21 nt, Human
gccggggcaggagggcaguga

SEQ ID NO: 1103428 - RNA, 24 nt, Human
gggcugccgucguugcaggucacc

SEQ ID NO: 1103429 - RNA, 19 nt, Human
uaaaauaauauaaaagggc

SEQ ID NO: 1103430 - RNA, 23 nt, Human
uaguagcugcggggcugccgucg

SEQ ID NO: 1103431 - RNA, 18 nt, Human
uaucuggagucgcaguuc

SEQ ID NO: 1103432 - RNA, 20 nt, Human
ucacuuuauaaaauaauaua

SEQ ID NO: 1103433 - RNA, 25 nt, Human
ucauucaucauauauucuuauuuuc

SEQ ID NO: 1103434 - RNA, 24 nt, Human
ucauuuuuaaaaaguuacaaaaca

SEQ ID NO: 1103435 - RNA, 21 nt, Human
uccaggaagaggagccaccgc

SEQ ID NO: 1103436 - RNA, 21 nt, Human
ucccgaagagacgggagggcc

SEQ ID NO: 1103437 - RNA, 26 nt, Human
ucuggcuacccccucguugucaggaa

SEQ ID NO: 1103438 - RNA, 22 nt, Human
ucuucuggcuacccccucguug

SEQ ID NO: 1103439 - RNA, 23 nt, Human
ugagguggcacuggugcagcggg

SEQ ID NO: 1103440 - RNA, 23 nt, Human
ugauggguggggccggugggugc

SEQ ID NO: 1103441 - RNA, 19 nt, Human
ugggcugugggagaggggc

SEQ ID NO: 1103442 - RNA, 21 nt, Human
uggggaugacagcaggucccu

SEQ ID NO: 1103443 - RNA, 22 nt, Human
uggggccggugggugcugucug

SEQ ID NO: 1103444 - RNA, 19 nt, Human
uggguggggccggugggug

SEQ ID NO: 1103445 - RNA, 21 nt, Human
uguggggugagguggcacugg

SEQ ID NO: 1103446 - RNA, 24 nt, Human
uuauuuuccuuuuuuuaaccuucg

SEQ ID NO: 1103447 - RNA, 24 nt, Human
accguccuggcaggccugaggcug

SEQ ID NO: 1103448 - RNA, 18 nt, Human
aggccugaggcugggaug

SEQ ID NO: 1103449 - RNA, 19 nt, Human
auccacccacaaaugaggu

SEQ ID NO: 1103450 - RNA, 23 nt, Human
caacccagcagaaacagguuugg

SEQ ID NO: 1103451 - RNA, 22 nt, Human
caccagaccuaaccaacccagc

SEQ ID NO: 1103452 - RNA, 20 nt, Human
ccguggggcauuuguccugg

SEQ ID NO: 1103453 - RNA, 18 nt, Human
cggccccuugcgacuccu

SEQ ID NO: 1103454 - RNA, 18 nt, Human
cguggagaggucaggccg

SEQ ID NO: 1103455 - RNA, 18 nt, Human
cucauccugcucggcccc

SEQ ID NO: 1103456 - RNA, 21 nt, Human
cucuugaucccgaacaccguc

SEQ ID NO: 1103457 - RNA, 23 nt, Human
gccugaggcugggaugccacgcu

SEQ ID NO: 1103458 - RNA, 19 nt, Human
guccugggcuggagugugg

SEQ ID NO: 1103459 - RNA, 27 nt, Human
guggaccccguggagaggucgguaccc

SEQ ID NO: 1103460 - RNA, 21 nt, Human
gugggucugcuccucuccugc

SEQ ID NO: 1103461 - RNA, 19 nt, Human
uauggaagacaagagcucc

SEQ ID NO: 1103462 - RNA, 20 nt, Human
uccacccacaaaugagguga

SEQ ID NO: 1103463 - RNA, 19 nt, Human
uccugggcuggaguguggu

SEQ ID NO: 1103464 - RNA, 19 nt, Human
ugaucccgaacaccguccu

SEQ ID NO: 1103465 - RNA, 24 nt, Human
ugccacgcugcuuccccuggacuc

SEQ ID NO: 1103466 - RNA, 21 nt, Human
uggcaggccugaggcugggau

SEQ ID NO: 1103467 - RNA, 22 nt, Human
ugggaugccacgcugcuucccc

SEQ ID NO: 1103468 - RNA, 21 nt, Human
ugugcuaccguggggcauuug

SEQ ID NO: 1103469 - RNA, 18 nt, Human
aagcuggcaaccaggccu

SEQ ID NO: 1103470 - RNA, 22 nt, Human
acagagcugcucacagauacca

SEQ ID NO: 1103471 - RNA, 24 nt, Human
agcacugugugccaccugcccucu

SEQ ID NO: 1103472 - RNA, 18 nt, Human
auuuccauccacuugcuc

SEQ ID NO: 1103473 - RNA, 23 nt, Human
caagguugaagggcccaugaugg

SEQ ID NO: 1103474 - RNA, 24 nt, Human
cacagagcugcucacagauaccac

SEQ ID NO: 1103475 - RNA, 18 nt, Human
cacagauaccacugucug

SEQ ID NO: 1103476 - RNA, 21 nt, Human
cacugugugccaccugcccuc

SEQ ID NO: 1103477 - RNA, 22 nt, Human
cagccaugggugccuguccccu

SEQ ID NO: 1103478 - RNA, 21 nt, Human
ccacagccaugggugccuguc

SEQ ID NO: 1103479 - RNA, 22 nt, Human
ccacagccaugggugccugucc

SEQ ID NO: 1103480 - RNA, 19 nt, Human
ccucucagggagaaaaccu

SEQ ID NO: 1103481 - RNA, 21 nt, Human
cuaccauguccauccugcccc

SEQ ID NO: 1103482 - RNA, 22 nt, Human
gaaaaccuuugaguccacagag

SEQ ID NO: 1103483 - RNA, 26 nt, Human
gacuggggucagggaccagaggucuc

SEQ ID NO: 1103484 - RNA, 23 nt, Human
gcaaccaggccugcgguccucug

SEQ ID NO: 1103485 - RNA, 22 nt, Human
gccacagccaugggugccuguc

SEQ ID NO: 1103486 - RNA, 20 nt, Human
ggagaaaaccuuugagucca

SEQ ID NO: 1103487 - RNA, 24 nt, Human
ggagaaaaccuuugaguccacaga

SEQ ID NO: 1103488 - RNA, 20 nt, Human
gggcaguaaagcuggcaacc

SEQ ID NO: 1103489 - RNA, 22 nt, Human
uaccauguccauccugccccag

SEQ ID NO: 1103490 - RNA, 19 nt, Human
uccauccugccccagcaug

SEQ ID NO: 1103491 - RNA, 24 nt, Human
ucucccauucucccagcauuucca

SEQ ID NO: 1103492 - RNA, 26 nt, Human
ugaaucagcuggccugggucggaucc

SEQ ID NO: 1103493 - RNA, 20 nt, Human
ugcaugaacgggcaguaaag

SEQ ID NO: 1103494 - RNA, 19 nt, Human
ugccaagguugaagggccc

SEQ ID NO: 1103495 - RNA, 23 nt, Human
ugccccagcauguugaauggugu

SEQ ID NO: 1103496 - RNA, 18 nt, Human
uguccaccugccaagguu

SEQ ID NO: 1103497 - RNA, 19 nt, Human
aaggacacugggaaaggag

SEQ ID NO: 1103498 - RNA, 20 nt, Human
acaaucccagucagcugccu

SEQ ID NO: 1103499 - RNA, 18 nt, Human
agcagacagcugguggcu

SEQ ID NO: 1103500 - RNA, 21 nt, Human
agcccccggccccagggccag

SEQ ID NO: 1103501 - RNA, 20 nt, Human
aggaagacaaucccagucaa

SEQ ID NO: 1103502 - RNA, 21 nt, Human
aggaccccgacugccccaccg

SEQ ID NO: 1103503 - RNA, 21 nt, Human
aggcacgguuggaaaggcugg

SEQ ID NO: 1103504 - RNA, 24 nt, Human
aguugguggaggccagugggaagc

SEQ ID NO: 1103505 - RNA, 21 nt, Human
cacaccccagcccccggcccc

SEQ ID NO: 1103506 - RNA, 23 nt, Human
cagaucccaggcacgguuggaaa

SEQ ID NO: 1103507 - RNA, 22 nt, Human
cagcagcuggcgccccaggugc

SEQ ID NO: 1103508 - RNA, 20 nt, Human
cagcccccggccccagggcc

SEQ ID NO: 1103509 - RNA, 20 nt, Human
cagcugccuucucaauucca

SEQ ID NO: 1103510 - RNA, 21 nt, Human
cagcugguggcuugagacugg

SEQ ID NO: 1103511 - RNA, 18 nt, Human
caggaccagauaaggaca

SEQ ID NO: 1103512 - RNA, 22 nt, Human
caggaggggugaaggguuggug

SEQ ID NO: 1103513 - RNA, 21 nt, Human
caucagaccugcuuuccagga

SEQ ID NO: 1103514 - RNA, 25 nt, Human
cauuuucauuucuuuauuuuaagga

SEQ ID NO: 1103515 - RNA, 22 nt, Human
ccaccgcugccuuucacaccug

SEQ ID NO: 1103516 - RNA, 21 nt, Human
cccagcccccggccccagggc

SEQ ID NO: 1103517 - RNA, 21 nt, Human
ccccacaccccagcccccggc

SEQ ID NO: 1103518 - RNA, 23 nt, Human
ccccacaccccagcccccggccc

SEQ ID NO: 1103519 - RNA, 18 nt, Human
ccccagggccagggagcc

SEQ ID NO: 1103520 - RNA, 20 nt, Human
ccccaggugcugcugcggcu

SEQ ID NO: 1103521 - RNA, 26 nt, Human
ccccaggugcugcugcgggggaccgc

SEQ ID NO: 1103522 - RNA, 21 nt, Human
ccucuguggccaccgcugccu

SEQ ID NO: 1103523 - RNA, 19 nt, Human
cucccuggcugugcccgcc

SEQ ID NO: 1103524 - RNA, 19 nt, Human
cugcauuaaagcccagauc

SEQ ID NO: 1103525 - RNA, 19 nt, Human
cuggcgccccaggugcugc

SEQ ID NO: 1103526 - RNA, 20 nt, Human
gaagcaggaccagauaagga

SEQ ID NO: 1103527 - RNA, 23 nt, Human
gaggaggggcugaggaggccauc

SEQ ID NO: 1103528 - RNA, 18 nt, Human
ggaagccaucagaccugc

SEQ ID NO: 1103529 - RNA, 20 nt, Human
ggaggggacugagcaugggg

SEQ ID NO: 1103530 - RNA, 18 nt, Human
ggcugugcccgccuucug

SEQ ID NO: 1103531 - RNA, 22 nt, Human
gggaaguggggaugaugagagg

SEQ ID NO: 1103532 - RNA, 22 nt, Human
ggugagagugagguuaaagguc

SEQ ID NO: 1103533 - RNA, 24 nt, Human
uaaaggucagagaggaggggcuga

SEQ ID NO: 1103534 - RNA, 23 nt, Human
uaaggacacugggaaaggagcca

SEQ ID NO: 1103535 - RNA, 20 nt, Human
ucagcugccuucucaauucc

SEQ ID NO: 1103536 - RNA, 22 nt, Human
ucagcugccuucucaauuccag

SEQ ID NO: 1103537 - RNA, 20 nt, Human
ucccagucagcugccuucuc

SEQ ID NO: 1103538 - RNA, 23 nt, Human
ucccagucagcugccuucucaau

SEQ ID NO: 1103539 - RNA, 26 nt, Human
ucccuggcugugcccgccuucuggga

SEQ ID NO: 1103540 - RNA, 20 nt, Human
ugagacugggguggagcugc

SEQ ID NO: 1103541 - RNA, 18 nt, Human
ugcaaggugagagugagg

SEQ ID NO: 1103542 - RNA, 21 nt, Human
uggaaaggcugggccugggaa

SEQ ID NO: 1103543 - RNA, 21 nt, Human
uggagcugcgugggggauggg

SEQ ID NO: 1103544 - RNA, 20 nt, Human
uggccucugcauuaaagccc

SEQ ID NO: 1103545 - RNA, 19 nt, Human
ugggaggggacugagcaug

SEQ ID NO: 1103546 - RNA, 21 nt, Human
ugggccugggaaguggggaug

SEQ ID NO: 1103547 - RNA, 18 nt, Human
uggugcagggugcaaggu

SEQ ID NO: 1103548 - RNA, 25 nt, Human
ugguggcuugagacugggguggagc

SEQ ID NO: 1103549 - RNA, 20 nt, Human
uucacugcccgcuccucccc

SEQ ID NO: 1103550 - RNA, 19 nt, Human
aagaggggagagcaaagag

SEQ ID NO: 1103551 - RNA, 18 nt, Human
aagcacccaccccacccu

SEQ ID NO: 1103552 - RNA, 25 nt, Human
aagccugcccaucaaggaggccacc

SEQ ID NO: 1103553 - RNA, 21 nt, Human
aagucccuuccaagccugccc

SEQ ID NO: 1103554 - RNA, 21 nt, Human
acaacgcagccaugaagaagc

SEQ ID NO: 1103555 - RNA, 23 nt, Human
acaacgcagccaugaagaagccc

SEQ ID NO: 1103556 - RNA, 18 nt, Human
acccacuccuccuccccc

SEQ ID NO: 1103557 - RNA, 22 nt, Human
acccacuccuccucccccgacc

SEQ ID NO: 1103558 - RNA, 19 nt, Human
accccaucucccaaaagcu

SEQ ID NO: 1103559 - RNA, 20 nt, Human
accccugcccaccccaucuc

SEQ ID NO: 1103560 - RNA, 20 nt, Human
acuggacuccccuggaccug

SEQ ID NO: 1103561 - RNA, 25 nt, Human
agaagguagguccugggagugaagg

SEQ ID NO: 1103562 - RNA, 20 nt, Human
agacagggaccaaagcugug

SEQ ID NO: 1103563 - RNA, 21 nt, Human
agacgugaccaccuagaggca

SEQ ID NO: 1103564 - RNA, 23 nt, Human
agagcaaagaggccugcagaggu

SEQ ID NO: 1103565 - RNA, 26 nt, Human
agagcaaagaggccugcagagguagg

SEQ ID NO: 1103566 - RNA, 22 nt, Human
agaggaacagaaagcacccacc

SEQ ID NO: 1103567 - RNA, 21 nt, Human
agaggggagagcaaagaggcc

SEQ ID NO: 1103568 - RNA, 25 nt, Human
agccaagcgacaccauaggcaggga

SEQ ID NO: 1103569 - RNA, 19 nt, Human
aggcaaggugggccagaag

SEQ ID NO: 1103570 - RNA, 20 nt, Human
aggcaggagggaggguggcu

SEQ ID NO: 1103571 - RNA, 21 nt, Human
aggcccccugcccuauguccu

SEQ ID NO: 1103572 - RNA, 19 nt, Human
agggggcuugggcugggag

SEQ ID NO: 1103573 - RNA, 20 nt, Human
agggggcuugggcugggagu

SEQ ID NO: 1103574 - RNA, 18 nt, Human
agguccugggagugaagg

SEQ ID NO: 1103575 - RNA, 19 nt, Human
auacaagcuagcucccaga

SEQ ID NO: 1103576 - RNA, 22 nt, Human
caacaaggcagugaggcccccu

SEQ ID NO: 1103577 - RNA, 20 nt, Human
caacgcagccaugaagaagc

SEQ ID NO: 1103578 - RNA, 18 nt, Human
caagacagggaccaaagc

SEQ ID NO: 1103579 - RNA, 21 nt, Human
caagcuagcucccagacguga

SEQ ID NO: 1103580 - RNA, 22 nt, Human
caccucagccccugcaagacag

SEQ ID NO: 1103581 - RNA, 21 nt, Human
caccucugggcugcccugccu

SEQ ID NO: 1103582 - RNA, 22 nt, Human
caccuggagccacaggugccac

SEQ ID NO: 1103583 - RNA, 19 nt, Human
cacggccaacacuugcagc

SEQ ID NO: 1103584 - RNA, 21 nt, Human
cacugaacucugggcuuuuua

SEQ ID NO: 1103585 - RNA, 23 nt, Human
cacugcuguccuccaggucuccg

SEQ ID NO: 1103586 - RNA, 24 nt, Human
cacuucaucacugccggcucaggc

SEQ ID NO: 1103587 - RNA, 21 nt, Human
cacuugcagcacaggcagagc

SEQ ID NO: 1103588 - RNA, 20 nt, Human
cagaaagcacccaccccacc

SEQ ID NO: 1103589 - RNA, 24 nt, Human
cagaaagcacccaccccacccucu

SEQ ID NO: 1103590 - RNA, 18 nt, Human
cagacgugaccaccuaga

SEQ ID NO: 1103591 - RNA, 22 nt, Human
cagaggaacagaaagcacccac

SEQ ID NO: 1103592 - RNA, 29 nt, Human
cagcacugcuguccuccaggucuccgggg

SEQ ID NO: 1103593 - RNA, 23 nt, Human
cagccaggaccaccccugcccac

SEQ ID NO: 1103594 - RNA, 24 nt, Human
cagccccugcaagacagggaccaa

SEQ ID NO: 1103595 - RNA, 21 nt, Human
cagcugccugccacugucuuu

SEQ ID NO: 1103596 - RNA, 23 nt, Human
cagggcugaaggcaaggugggcc

SEQ ID NO: 1103597 - RNA, 26 nt, Human
cagggcugaaggcaaggugggccaga

SEQ ID NO: 1103598 - RNA, 21 nt, Human
ccaagcagggaaccccuaaag

SEQ ID NO: 1103599 - RNA, 22 nt, Human
ccaagcagggaaccccuaaagg

SEQ ID NO: 1103600 - RNA, 22 nt, Human
ccacaggccuccuuggcguggg

SEQ ID NO: 1103601 - RNA, 28 nt, Human
ccaccccugcccaccccaucucccaaaa

SEQ ID NO: 1103602 - RNA, 20 nt, Human
ccacuccagggcugaaggca

SEQ ID NO: 1103603 - RNA, 21 nt, Human
ccacuggacuccccuggaccu

SEQ ID NO: 1103604 - RNA, 19 nt, Human
ccagcacugcuguccucca

SEQ ID NO: 1103605 - RNA, 21 nt, Human
ccaugaagaagcccgcucugu

SEQ ID NO: 1103606 - RNA, 18 nt, Human
cccacacaggacguaggg

SEQ ID NO: 1103607 - RNA, 20 nt, Human
cccacacaggacguagggag

SEQ ID NO: 1103608 - RNA, 19 nt, Human
ccccuaaaggugaugggga

SEQ ID NO: 1103609 - RNA, 20 nt, Human
ccccugcccaccccaucucc

SEQ ID NO: 1103610 - RNA, 21 nt, Human
cccucuaccaggcgggccccc

SEQ ID NO: 1103611 - RNA, 22 nt, Human
cccucuaccaggcgggcccccu

SEQ ID NO: 1103612 - RNA, 21 nt, Human
cccugcccaccccaucuccca

SEQ ID NO: 1103613 - RNA, 22 nt, Human
cccugccuugcugcccacgcug

SEQ ID NO: 1103614 - RNA, 20 nt, Human
ccuauguccugggacagagu

SEQ ID NO: 1103615 - RNA, 18 nt, Human
ccucugggcugcccugcc

SEQ ID NO: 1103616 - RNA, 19 nt, Human
ccugaggcaagaggggaga

SEQ ID NO: 1103617 - RNA, 19 nt, Human
ccugccaaggguccugccc

SEQ ID NO: 1103618 - RNA, 23 nt, Human
ccugcccaccccaucucccaaaa

SEQ ID NO: 1103619 - RNA, 24 nt, Human
ccugcccaccccaucucccaaaag

SEQ ID NO: 1103620 - RNA, 24 nt, Human
ccugccgcugccaccucugggcug

SEQ ID NO: 1103621 - RNA, 26 nt, Human
ccuuuugcucugggggcaggggcugg

SEQ ID NO: 1103622 - RNA, 24 nt, Human
cggcagacgggcccauggacaccc

SEQ ID NO: 1103623 - RNA, 19 nt, Human
cuccccacaauacucucug

SEQ ID NO: 1103624 - RNA, 22 nt, Human
cuccccuggaccugagcaccuc

SEQ ID NO: 1103625 - RNA, 21 nt, Human
cucugggcuuuuuagaaaugg

SEQ ID NO: 1103626 - RNA, 21 nt, Human
cugccaccucugggcugcccu

SEQ ID NO: 1103627 - RNA, 21 nt, Human
cugcggcacugggugggucuc

SEQ ID NO: 1103628 - RNA, 23 nt, Human
cuggacuuggauuuggagggagc

SEQ ID NO: 1103629 - RNA, 21 nt, Human
cuggccaugccuccccacaau

SEQ ID NO: 1103630 - RNA, 19 nt, Human
cuucagagcugccaggccu

SEQ ID NO: 1103631 - RNA, 20 nt, Human
cuucccgggacccucuacca

SEQ ID NO: 1103632 - RNA, 28 nt, Human
gaaaaugauacuccucaaggaaugccuc

SEQ ID NO: 1103633 - RNA, 21 nt, Human
gaaguccccuccugacaccuu

SEQ ID NO: 1103634 - RNA, 22 nt, Human
gaagucccuuccaagccugccc

SEQ ID NO: 1103635 - RNA, 24 nt, Human
gaagucccuuccaagccugcccau

SEQ ID NO: 1103636 - RNA, 20 nt, Human
gacagaguggggugcgggag

SEQ ID NO: 1103637 - RNA, 23 nt, Human
gaggagcaguucaaacucagcaa

SEQ ID NO: 1103638 - RNA, 18 nt, Human
gagugaagggaggggcuu

SEQ ID NO: 1103639 - RNA, 19 nt, Human
gauccagcuucccgggacc

SEQ ID NO: 1103640 - RNA, 24 nt, Human
gaugacguggaggaagaggaggaa

SEQ ID NO: 1103641 - RNA, 21 nt, Human
gcagcuugcuggccggggccc

SEQ ID NO: 1103642 - RNA, 19 nt, Human
gccaggaccaccccugccc

SEQ ID NO: 1103643 - RNA, 18 nt, Human
gccaugaagaagcccgcu

SEQ ID NO: 1103644 - RNA, 19 nt, Human
gccccagccagcccccacc

SEQ ID NO: 1103645 - RNA, 20 nt, Human
gccugcagagguaggaacaa

SEQ ID NO: 1103646 - RNA, 20 nt, Human
gcgcagcugguggcgccggg

SEQ ID NO: 1103647 - RNA, 20 nt, Human
gcgcugaguggagggggcag

SEQ ID NO: 1103648 - RNA, 26 nt, Human
gcuguggccagauggagggaacacua

SEQ ID NO: 1103649 - RNA, 21 nt, Human
ggacuccccuggaccugagca

SEQ ID NO: 1103650 - RNA, 18 nt, Human
ggagggggcagcuugcug

SEQ ID NO: 1103651 - RNA, 20 nt, Human
ggagggggcagcuugcuggc

SEQ ID NO: 1103652 - RNA, 18 nt, Human
ggauccuucagcucgggu

SEQ ID NO: 1103653 - RNA, 22 nt, Human
ggcaagaggggagagcaaagag

SEQ ID NO: 1103654 - RNA, 23 nt, Human
ggccccagccagcccccaccugu

SEQ ID NO: 1103655 - RNA, 21 nt, Human
ggcuauggaugcugcccugaa

SEQ ID NO: 1103656 - RNA, 18 nt, Human
gggaggggcuugccugcc

SEQ ID NO: 1103657 - RNA, 20 nt, Human
gggagugaagggaggggcuu

SEQ ID NO: 1103658 - RNA, 23 nt, Human
gggcaggaggugggucuggguuu

SEQ ID NO: 1103659 - RNA, 21 nt, Human
gggcugaaggcaaggugggcc

SEQ ID NO: 1103660 - RNA, 24 nt, Human
gggggcgcugaguggagggggcag

SEQ ID NO: 1103661 - RNA, 21 nt, Human
gggugggucucgcggccccgg

SEQ ID NO: 1103662 - RNA, 18 nt, Human
gguccugcccacuggacu

SEQ ID NO: 1103663 - RNA, 19 nt, Human
gguccugggagugaaggga

SEQ ID NO: 1103664 - RNA, 21 nt, Human
gguccugggagugaagggagg

SEQ ID NO: 1103665 - RNA, 19 nt, Human
gugauucagucacgcaggc

SEQ ID NO: 1103666 - RNA, 22 nt, Human
uacaagcuagcucccagacgug

SEQ ID NO: 1103667 - RNA, 22 nt, Human
uaccaggcgggcccccuagacu

SEQ ID NO: 1103668 - RNA, 21 nt, Human
ucacugggacacaggcaggag

SEQ ID NO: 1103669 - RNA, 22 nt, Human
ucagugggccuggggcaggagg

SEQ ID NO: 1103670 - RNA, 19 nt, Human
uccagcuuccccaauggca

SEQ ID NO: 1103671 - RNA, 21 nt, Human
uccccacaauacucucugccc

SEQ ID NO: 1103672 - RNA, 19 nt, Human
ucccgggacccucuaccag

SEQ ID NO: 1103673 - RNA, 20 nt, Human
ucccgggacccucuaccagg

SEQ ID NO: 1103674 - RNA, 21 nt, Human
uccuccucccccgacccagac

SEQ ID NO: 1103675 - RNA, 20 nt, Human
uccuucagcucggguuuggc

SEQ ID NO: 1103676 - RNA, 23 nt, Human
ucuccggggcagucugugggcca

SEQ ID NO: 1103677 - RNA, 20 nt, Human
ugagcaccuccacuuugggu

SEQ ID NO: 1103678 - RNA, 23 nt, Human
ugagcaccuccacuuuggguuuu

SEQ ID NO: 1103679 - RNA, 23 nt, Human
ugaggaagaggaggaugacgugg

SEQ ID NO: 1103680 - RNA, 18 nt, Human
ugagggggcuugggcugg

SEQ ID NO: 1103681 - RNA, 25 nt, Human
ugaguggagggggcagcuugcuggg

SEQ ID NO: 1103682 - RNA, 21 nt, Human
ugauucagucacgcaggccag

SEQ ID NO: 1103683 - RNA, 23 nt, Human
ugcaagacagggaccaaagcugu

SEQ ID NO: 1103684 - RNA, 22 nt, Human
ugccaggccugcaacgggggcg

SEQ ID NO: 1103685 - RNA, 19 nt, Human
ugcccaccccaucucccaa

SEQ ID NO: 1103686 - RNA, 19 nt, Human
ugccucauccacuugggca

SEQ ID NO: 1103687 - RNA, 23 nt, Human
uggacacccaagugccagcacug

SEQ ID NO: 1103688 - RNA, 19 nt, Human
uggagggggcagcuugcug

SEQ ID NO: 1103689 - RNA, 20 nt, Human
ugggauccuucagcucgggu

SEQ ID NO: 1103690 - RNA, 22 nt, Human
ugggauccuucagcucggguuu

SEQ ID NO: 1103691 - RNA, 23 nt, Human
ugggcuauggaugcugcccugaa

SEQ ID NO: 1103692 - RNA, 23 nt, Human
ugggcuuuuuagaaauggaacau

SEQ ID NO: 1103693 - RNA, 20 nt, Human
uggucagaagccauacaagc

SEQ ID NO: 1103694 - RNA, 23 nt, Human
uguccuccaggucuccggggcag

SEQ ID NO: 1103695 - RNA, 22 nt, Human
uguucaagacagucaccuggag

SEQ ID NO: 1103696 - RNA, 19 nt, Human
uuaaggccccagccagccc

SEQ ID NO: 1103697 - RNA, 21 nt, Human
uucaaacucagcaacaacgca

SEQ ID NO: 1103698 - RNA, 22 nt, Human
uucaagacagucaccuggagcc

SEQ ID NO: 1103699 - RNA, 18 nt, Human
uucagcuggaaaggagcc

SEQ ID NO: 1103700 - RNA, 25 nt, Human
uuccuugggacacacugaacucugg

SEQ ID NO: 1103701 - RNA, 24 nt, Human
uuggaaggggacucaggucaguuc

SEQ ID NO: 1103702 - RNA, 25 nt, Human
uuggccaccaggaucugggccuucu

SEQ ID NO: 1103703 - RNA, 23 nt, Human
uugugggcuauggaugcugcccu

SEQ ID NO: 1103704 - RNA, 18 nt, Human
uuuggaaggggacucagg

SEQ ID NO: 1103705 - RNA, 18 nt, Human
uuuuagggcugcugggcu

SEQ ID NO: 1103706 - RNA, 18 nt, Human
agagcagcuaaaacacac

SEQ ID NO: 1103707 - RNA, 23 nt, Human
cagcuaaaacacacucauuuugc

SEQ ID NO: 1103708 - RNA, 18 nt, Human
caguccucugccgugcuu

SEQ ID NO: 1103709 - RNA, 24 nt, Human
ccauucccuauccugaacccccca

SEQ ID NO: 1103710 - RNA, 21 nt, Human
ccccccaaacuccucuucacu

SEQ ID NO: 1103711 - RNA, 28 nt, Human
cccuauccugaaccccccaaacuccucc

SEQ ID NO: 1103712 - RNA, 18 nt, Human
cccugccaguccuccauc

SEQ ID NO: 1103713 - RNA, 18 nt, Human
ccugcaguccucugccgu

SEQ ID NO: 1103714 - RNA, 18 nt, Human
ccuguagagcggcaaggc

SEQ ID NO: 1103715 - RNA, 20 nt, Human
gaaccccccaaacuccucuu

SEQ ID NO: 1103716 - RNA, 18 nt, Human
gccucgguggguguaggg

SEQ ID NO: 1103717 - RNA, 27 nt, Human
gcuccuguagagcggcaaggcaaggau

SEQ ID NO: 1103718 - RNA, 22 nt, Human
gguggguguagggccucugcuc

SEQ ID NO: 1103719 - RNA, 27 nt, Human
uaaaacacacucauuuugcaugaacuc

SEQ ID NO: 1103720 - RNA, 19 nt, Human
uccugaaccccccaaacuc

SEQ ID NO: 1103721 - RNA, 24 nt, Human
uccugaaccccccaaacuccucuu

SEQ ID NO: 1103722 - RNA, 18 nt, Human
ucuccaggggacccugcc

SEQ ID NO: 1103723 - RNA, 23 nt, Human
ucuccaggggacccugccagucc

SEQ ID NO: 1103724 - RNA, 25 nt, Human
ugcuuugcguccucugaccucccca

SEQ ID NO: 1103725 - RNA, 21 nt, Human
uggacgguucauucuacaugg

SEQ ID NO: 1103726 - RNA, 22 nt, Human
uggcaagagcagcuaaaacaca

SEQ ID NO: 1103727 - RNA, 19 nt, Human
uggccugcaguccucugcc

SEQ ID NO: 1103728 - RNA, 21 nt, Human
aaccgguccaccagcagccuc

SEQ ID NO: 1103729 - RNA, 18 nt, Human
accaggaaggcgaaggcc

SEQ ID NO: 1103730 - RNA, 19 nt, Human
acucacagcugcucuuguc

SEQ ID NO: 1103731 - RNA, 21 nt, Human
aggcagggugaccaggaaggc

SEQ ID NO: 1103732 - RNA, 22 nt, Human
aggcccagaaccggccugagaa

SEQ ID NO: 1103733 - RNA, 20 nt, Human
caaugcacaguauggucuga

SEQ ID NO: 1103734 - RNA, 23 nt, Human
cacaguauggucugacccaggga

SEQ ID NO: 1103735 - RNA, 24 nt, Human
caccagcagccuccgaggcagggu

SEQ ID NO: 1103736 - RNA, 20 nt, Human
cagcagccuccgaggcaggg

SEQ ID NO: 1103737 - RNA, 21 nt, Human
cagcagccuccgaggcaggga

SEQ ID NO: 1103738 - RNA, 22 nt, Human
cagcagccuccgaggcagggug

SEQ ID NO: 1103739 - RNA, 25 nt, Human
ccagccaggcccagaaccggccuga

SEQ ID NO: 1103740 - RNA, 25 nt, Human
ccaggcccagaaccggccugagaac

SEQ ID NO: 1103741 - RNA, 20 nt, Human
cccacggaguucucccagca

SEQ ID NO: 1103742 - RNA, 19 nt, Human
ccccagggaggcuucgggg

SEQ ID NO: 1103743 - RNA, 22 nt, Human
cccccacggaguucucccagca

SEQ ID NO: 1103744 - RNA, 24 nt, Human
cggugaggaggaaguugaagauac

SEQ ID NO: 1103745 - RNA, 19 nt, Human
cugccaaugcacaguaugg

SEQ ID NO: 1103746 - RNA, 19 nt, Human
cugccccgccacgaugucc

SEQ ID NO: 1103747 - RNA, 23 nt, Human
gcccagaaccggccugagaaccc

SEQ ID NO: 1103748 - RNA, 22 nt, Human
ggaacuccucccguuccagcca

SEQ ID NO: 1103749 - RNA, 18 nt, Human
uccaccagcagccuccga

SEQ ID NO: 1103750 - RNA, 21 nt, Human
ugccccgccacgauguccagc

SEQ ID NO: 1103751 - RNA, 20 nt, Human
uuguacagcuccucccccac

SEQ ID NO: 1103752 - RNA, 28 nt, Human
acccccucccucccacuucucucuccag

SEQ ID NO: 1103753 - RNA, 24 nt, Human
agcauuaaggccaguggcuacagu

SEQ ID NO: 1103754 - RNA, 21 nt, Human
caacacgagaacaucuugcuc

SEQ ID NO: 1103755 - RNA, 18 nt, Human
cacccccucccucccacu

SEQ ID NO: 1103756 - RNA, 20 nt, Human
cauuaaggccaguggcuaca

SEQ ID NO: 1103757 - RNA, 18 nt, Human
cccccucccucccacuuc

SEQ ID NO: 1103758 - RNA, 25 nt, Human
cccccucccucccacuucucucucc

SEQ ID NO: 1103759 - RNA, 24 nt, Human
ccccucccucccacuucucucucc

SEQ ID NO: 1103760 - RNA, 21 nt, Human
ccucccucccacuucucucuc

SEQ ID NO: 1103761 - RNA, 18 nt, Human
ccuggucuccgccuccau

SEQ ID NO: 1103762 - RNA, 26 nt, Human
cucgaaguggggaagcaacacgagaa

SEQ ID NO: 1103763 - RNA, 21 nt, Human
cuugucacccccucccuccca

SEQ ID NO: 1103764 - RNA, 24 nt, Human
cuugucacccccucccucccacuu

SEQ ID NO: 1103765 - RNA, 25 nt, Human
cuugucacccccucccucccacuuc

SEQ ID NO: 1103766 - RNA, 21 nt, Human
ugaagcagcaaccucucgaag

SEQ ID NO: 1103767 - RNA, 19 nt, Human
ugcccaggacuaggggcag

SEQ ID NO: 1103768 - RNA, 18 nt, Human
uggcuggggcugugcuug

SEQ ID NO: 1103769 - RNA, 25 nt, Human
ugugcuugucacccccucccuccca

SEQ ID NO: 1103770 - RNA, 22 nt, Human
acaaagcaggacacuuggucuu

SEQ ID NO: 1103771 - RNA, 26 nt, Human
acaaagcaggacacuuggucuugggg

SEQ ID NO: 1103772 - RNA, 24 nt, Human
auaucuccaucagggaaucauaca

SEQ ID NO: 1103773 - RNA, 24 nt, Human
cacucuuccgcacaaagcaggaca

SEQ ID NO: 1103774 - RNA, 23 nt, Human
cagagaagacccaaggggccauu

SEQ ID NO: 1103775 - RNA, 18 nt, Human
cagcggguuccaucuuuc

SEQ ID NO: 1103776 - RNA, 22 nt, Human
caggacacuuggucuuggggcu

SEQ ID NO: 1103777 - RNA, 19 nt, Human
ggccucccugcacucuucc

SEQ ID NO: 1103778 - RNA, 21 nt, Human
gggaccagggaggccccagcu

SEQ ID NO: 1103779 - RNA, 21 nt, Human
gguguucguuuuuuaaacaga

SEQ ID NO: 1103780 - RNA, 19 nt, Human
uacagagaagacccaaggg

SEQ ID NO: 1103781 - RNA, 23 nt, Human
uacagagaagacccaaggggcca

SEQ ID NO: 1103782 - RNA, 23 nt, Human
ucuccaagggaccagggaggccc

SEQ ID NO: 1103783 - RNA, 23 nt, Human
uggcauugaagauuucgucucca

SEQ ID NO: 1103784 - RNA, 21 nt, Human
uggucacuugaaguggugcac

SEQ ID NO: 1103785 - RNA, 21 nt, Human
ugguggucacuugaaguggug

SEQ ID NO: 1103786 - RNA, 20 nt, Human
uuccugguggucacuugaag

SEQ ID NO: 1103787 - RNA, 20 nt, Human
uuggucuuggggcuucaguu

SEQ ID NO: 1103788 - RNA, 21 nt, Human
aagaaggagcaaaggcaccug

SEQ ID NO: 1103789 - RNA, 23 nt, Human
aagacccaggcccagcccugacc

SEQ ID NO: 1103790 - RNA, 20 nt, Human
aagacuuccuguaggaggag

SEQ ID NO: 1103791 - RNA, 18 nt, Human
aagcacccgcaggcugag

SEQ ID NO: 1103792 - RNA, 22 nt, Human
aagcagcacgagcugcugagcc

SEQ ID NO: 1103793 - RNA, 18 nt, Human
aagcuggucugcgcaggc

SEQ ID NO: 1103794 - RNA, 22 nt, Human
aaguggggauuucuggccaggu

SEQ ID NO: 1103795 - RNA, 19 nt, Human
aauggcucacccuggguga

SEQ ID NO: 1103796 - RNA, 21 nt, Human
acaauagaggaacagugggga

SEQ ID NO: 1103797 - RNA, 20 nt, Human
acagaaaaagcccuggggug

SEQ ID NO: 1103798 - RNA, 19 nt, Human
acagaguucuuccagacug

SEQ ID NO: 1103799 - RNA, 24 nt, Human
accagcaggagacgggcagcagcc

SEQ ID NO: 1103800 - RNA, 19 nt, Human
accaggaggcccugaagau

SEQ ID NO: 1103801 - RNA, 22 nt, Human
agaaggagugaguggggcugcg

SEQ ID NO: 1103802 - RNA, 19 nt, Human
agacagagcuggcaagucg

SEQ ID NO: 1103803 - RNA, 23 nt, Human
agaggaacaguggggaagggccc

SEQ ID NO: 1103804 - RNA, 20 nt, Human
agagugagaagggacguggu

SEQ ID NO: 1103805 - RNA, 20 nt, Human
agaguucuuccagacugcug

SEQ ID NO: 1103806 - RNA, 24 nt, Human
agcaaaggcaccugccaggaggaa

SEQ ID NO: 1103807 - RNA, 22 nt, Human
agcaaguuagggcacaaucugg

SEQ ID NO: 1103808 - RNA, 20 nt, Human
agcacuuugggaggcugagg

SEQ ID NO: 1103809 - RNA, 19 nt, Human
agcagcagcgccgcauccu

SEQ ID NO: 1103810 - RNA, 20 nt, Human
agcaggagacgggcagcagc

SEQ ID NO: 1103811 - RNA, 25 nt, Human
agcaggagggagggucgggcagggu

SEQ ID NO: 1103812 - RNA, 20 nt, Human
agcagggcguucugagggcc

SEQ ID NO: 1103813 - RNA, 21 nt, Human
agcuggggucccaaagguggg

SEQ ID NO: 1103814 - RNA, 19 nt, Human
aggagagcagcugcggagc

SEQ ID NO: 1103815 - RNA, 19 nt, Human
aggagggagggucgggcag

SEQ ID NO: 1103816 - RNA, 23 nt, Human
aggcaggaagcacugaggcuggg

SEQ ID NO: 1103817 - RNA, 24 nt, Human
aggcaggaagcacugaggcugggu

SEQ ID NO: 1103818 - RNA, 18 nt, Human
aggcauagauauuuuuau

SEQ ID NO: 1103819 - RNA, 19 nt, Human
aggcccggcggcucaagca

SEQ ID NO: 1103820 - RNA, 20 nt, Human
aggcucguccacgcucugcc

SEQ ID NO: 1103821 - RNA, 19 nt, Human
agggggccgucucccugug

SEQ ID NO: 1103822 - RNA, 19 nt, Human
aggggugggugggguaugg

SEQ ID NO: 1103823 - RNA, 22 nt, Human
aguagugaggagaggacaauuc

SEQ ID NO: 1103824 - RNA, 24 nt, Human
agucgcgguggcucacaccuguaa

SEQ ID NO: 1103825 - RNA, 18 nt, Human
auggagcuggagacuucu

SEQ ID NO: 1103826 - RNA, 21 nt, Human
auggcgccuuuugccccccac

SEQ ID NO: 1103827 - RNA, 23 nt, Human
augguggagcugcggcaccccgc

SEQ ID NO: 1103828 - RNA, 19 nt, Human
caacaucgugcagaaggag

SEQ ID NO: 1103829 - RNA, 19 nt, Human
caaggcccggcggcucaag

SEQ ID NO: 1103830 - RNA, 23 nt, Human
caaggcccggcggcucaagcacc

SEQ ID NO: 1103831 - RNA, 24 nt, Human
cacaccuguaaucccagcacuuug

SEQ ID NO: 1103832 - RNA, 22 nt, Human
cacagcauuaaugauggagaaa

SEQ ID NO: 1103833 - RNA, 18 nt, Human
cacccugcagagcagaau

SEQ ID NO: 1103834 - RNA, 23 nt, Human
caccuguaaucccagcacuuugg

SEQ ID NO: 1103835 - RNA, 24 nt, Human
caccuguaaucccagcacuuuggg

SEQ ID NO: 1103836 - RNA, 22 nt, Human
cacugcagggcugcacguggca

SEQ ID NO: 1103837 - RNA, 23 nt, Human
cagaaaaagcccugggguggaag

SEQ ID NO: 1103838 - RNA, 21 nt, Human
cagaauggcucacccugggug

SEQ ID NO: 1103839 - RNA, 18 nt, Human
cagcacuuugggaggcug

SEQ ID NO: 1103840 - RNA, 20 nt, Human
cagcacuuugggaggcugag

SEQ ID NO: 1103841 - RNA, 18 nt, Human
cagcagccugaaggaggc

SEQ ID NO: 1103842 - RNA, 19 nt, Human
cagcaggggugugggggcu

SEQ ID NO: 1103843 - RNA, 22 nt, Human
cagcaggugcucuauggaggcu

SEQ ID NO: 1103844 - RNA, 20 nt, Human
caggaccggcugaacaguga

SEQ ID NO: 1103845 - RNA, 20 nt, Human
caggcccagcccugaccugc

SEQ ID NO: 1103846 - RNA, 19 nt, Human
cagggcugcacguggcagc

SEQ ID NO: 1103847 - RNA, 20 nt, Human
cauccccugcccacaggacc

SEQ ID NO: 1103848 - RNA, 24 nt, Human
caugcacacagcaggugcucuaug

SEQ ID NO: 1103849 - RNA, 25 nt, Human
ccaauggcgccuuuugccccccacu

SEQ ID NO: 1103850 - RNA, 22 nt, Human
ccagaaagaaggagcaaaggca

SEQ ID NO: 1103851 - RNA, 18 nt, Human
ccagcuccagcacgugga

SEQ ID NO: 1103852 - RNA, 25 nt, Human
ccaggcccagcccugaccugcuggc

SEQ ID NO: 1103853 - RNA, 19 nt, Human
cccaaaugaccaaguccac

SEQ ID NO: 1103854 - RNA, 21 nt, Human
cccacaggaccggcugaacag

SEQ ID NO: 1103855 - RNA, 20 nt, Human
cccacaggagaggcacugca

SEQ ID NO: 1103856 - RNA, 20 nt, Human
ccccacccgacucgcccccc

SEQ ID NO: 1103857 - RNA, 22 nt, Human
ccccacuuucucucuccccacc

SEQ ID NO: 1103858 - RNA, 18 nt, Human
cccccauaaggcacugug

SEQ ID NO: 1103859 - RNA, 24 nt, Human
cccugaccugcuggccaccuucuu

SEQ ID NO: 1103860 - RNA, 18 nt, Human
cccugcagcaccagcagg

SEQ ID NO: 1103861 - RNA, 21 nt, Human
cccugcccacaggaccggcug

SEQ ID NO: 1103862 - RNA, 25 nt, Human
cccugugccuggcgugggccuccuu

SEQ ID NO: 1103863 - RNA, 21 nt, Human
cccuuggucaaggcaggaugc

SEQ ID NO: 1103864 - RNA, 25 nt, Human
ccgcccaauggcgccuuuugccccc

SEQ ID NO: 1103865 - RNA, 20 nt, Human
ccuaacacacggugggagag

SEQ ID NO: 1103866 - RNA, 19 nt, Human
ccucugcaguggccacccu

SEQ ID NO: 1103867 - RNA, 21 nt, Human
ccugcccggggccaguguucc

SEQ ID NO: 1103868 - RNA, 23 nt, Human
ccugugucuuugucaccugccuc

SEQ ID NO: 1103869 - RNA, 22 nt, Human
cgcaggccaguaugggccgggc

SEQ ID NO: 1103870 - RNA, 20 nt, Human
cgcccccagcacuucaagca

SEQ ID NO: 1103871 - RNA, 21 nt, Human
cggagccugguggggccggug

SEQ ID NO: 1103872 - RNA, 19 nt, Human
cggcagggcggcagggcgg

SEQ ID NO: 1103873 - RNA, 21 nt, Human
cggcgggaauacgaggucggc

SEQ ID NO: 1103874 - RNA, 19 nt, Human
cgggcaggguggcugcagg

SEQ ID NO: 1103875 - RNA, 18 nt, Human
cguggaggacuacagccg

SEQ ID NO: 1103876 - RNA, 22 nt, Human
cucacaccuguaaucccagcac

SEQ ID NO: 1103877 - RNA, 24 nt, Human
cucacaccuguaaucccagcacuu

SEQ ID NO: 1103878 - RNA, 27 nt, Human
cucaggggccacugcagaauggccucu

SEQ ID NO: 1103879 - RNA, 24 nt, Human
cugagcccagcgucugggaaccag

SEQ ID NO: 1103880 - RNA, 20 nt, Human
cugaggcugagcccagcguc

SEQ ID NO: 1103881 - RNA, 21 nt, Human
cugcaggugggccuggguggc

SEQ ID NO: 1103882 - RNA, 18 nt, Human
cugccaggaggaagccua

SEQ ID NO: 1103883 - RNA, 22 nt, Human
cugcccauccccugcccacagg

SEQ ID NO: 1103884 - RNA, 23 nt, Human
cugcggagccugguggggccggu

SEQ ID NO: 1103885 - RNA, 19 nt, Human
cugggccugacccugugcc

SEQ ID NO: 1103886 - RNA, 20 nt, Human
cugggccugacccugugccu

SEQ ID NO: 1103887 - RNA, 23 nt, Human
cugggccugacccugugccuggc

SEQ ID NO: 1103888 - RNA, 19 nt, Human
cugggggcagggcgagagu

SEQ ID NO: 1103889 - RNA, 21 nt, Human
cuuggccuugugaccuccaca

SEQ ID NO: 1103890 - RNA, 18 nt, Human
gaaggaggccgaggugcu

SEQ ID NO: 1103891 - RNA, 21 nt, Human
gaagggcccgggugcagcagg

SEQ ID NO: 1103892 - RNA, 22 nt, Human
gacaauagaggaacagugggga

SEQ ID NO: 1103893 - RNA, 22 nt, Human
gagcguaaaccagcuggaggag

SEQ ID NO: 1103894 - RNA, 19 nt, Human
gaggacaauuccagaaaga

SEQ ID NO: 1103895 - RNA, 22 nt, Human
gaggaggacggcaagcgcaugg

SEQ ID NO: 1103896 - RNA, 19 nt, Human
gaggcugcagggcgaaugc

SEQ ID NO: 1103897 - RNA, 18 nt, Human
gauagggguggguggggu

SEQ ID NO: 1103898 - RNA, 24 nt, Human
gaugggcagcaggggugugggggc

SEQ ID NO: 1103899 - RNA, 19 nt, Human
gcaagucgcgguggcucac

SEQ ID NO: 1103900 - RNA, 22 nt, Human
gcagagcagaauggcucacccu

SEQ ID NO: 1103901 - RNA, 18 nt, Human
gcagcagggguguggggg

SEQ ID NO: 1103902 - RNA, 19 nt, Human
gcccggacccugcccgggg

SEQ ID NO: 1103903 - RNA, 25 nt, Human
gcccucgggcagcggcagggcggca

SEQ ID NO: 1103904 - RNA, 18 nt, Human
gcccugggguggaagcaa

SEQ ID NO: 1103905 - RNA, 21 nt, Human
gccuuuugccccccacuuucu

SEQ ID NO: 1103906 - RNA, 21 nt, Human
gcgaaugcacagaaaaagccc

SEQ ID NO: 1103907 - RNA, 25 nt, Human
gcgcaggccaguaugggccgggcau

SEQ ID NO: 1103908 - RNA, 24 nt, Human
gcugcacgagcgggugacccagga

SEQ ID NO: 1103909 - RNA, 19 nt, Human
ggaagacccaggcccagcc

SEQ ID NO: 1103910 - RNA, 19 nt, Human
ggaaguggggauuucuggc

SEQ ID NO: 1103911 - RNA, 21 nt, Human
ggacgcccugggccugacccu

SEQ ID NO: 1103912 - RNA, 25 nt, Human
ggacguggacaaggcccggcggcuc

SEQ ID NO: 1103913 - RNA, 20 nt, Human
ggcccggcggcucaagcacc

SEQ ID NO: 1103914 - RNA, 21 nt, Human
ggcgccuuuugccccccacuu

SEQ ID NO: 1103915 - RNA, 18 nt, Human
ggcggggaaggggggggu

SEQ ID NO: 1103916 - RNA, 18 nt, Human
ggcucacccugggugagc

SEQ ID NO: 1103917 - RNA, 18 nt, Human
ggcugcggcagggcuggg

SEQ ID NO: 1103918 - RNA, 20 nt, Human
ggcugcggcagggcuggggg

SEQ ID NO: 1103919 - RNA, 24 nt, Human
gggaagacuuccuguaggaggagg

SEQ ID NO: 1103920 - RNA, 23 nt, Human
gggaaguggggauuucuggccag

SEQ ID NO: 1103921 - RNA, 20 nt, Human
gggcagagccugggcagccu

SEQ ID NO: 1103922 - RNA, 19 nt, Human
gggcagcagccugaaggag

SEQ ID NO: 1103923 - RNA, 21 nt, Human
gggcagcaggggugugggggc

SEQ ID NO: 1103924 - RNA, 24 nt, Human
gggcagcaggggugugggggcucu

SEQ ID NO: 1103925 - RNA, 21 nt, Human
gggcagcggcagggcggcagg

SEQ ID NO: 1103926 - RNA, 18 nt, Human
gggcggggaagggggggg

SEQ ID NO: 1103927 - RNA, 19 nt, Human
gggcggggaaggggggggu

SEQ ID NO: 1103928 - RNA, 19 nt, Human
ggggcugcggcagggcugg

SEQ ID NO: 1103929 - RNA, 23 nt, Human
gggggcucuggacccuggcaagu

SEQ ID NO: 1103930 - RNA, 21 nt, Human
ggguucucuggcucuccaccc

SEQ ID NO: 1103931 - RNA, 23 nt, Human
gguggcucacaccuguaauccca

SEQ ID NO: 1103932 - RNA, 24 nt, Human
gguggcucacaccuguaaucccag

SEQ ID NO: 1103933 - RNA, 22 nt, Human
guaggcuugaacagucagugua

SEQ ID NO: 1103934 - RNA, 19 nt, Human
gugagagggcucgguuggg

SEQ ID NO: 1103935 - RNA, 24 nt, Human
gugaguggggcugcggcagggcug

SEQ ID NO: 1103936 - RNA, 21 nt, Human
guggggaagggcccgggugca

SEQ ID NO: 1103937 - RNA, 25 nt, Human
uaacucagagcaaguuagggcacaa

SEQ ID NO: 1103938 - RNA, 25 nt, Human
uacacgcacugcagggcugcacgug

SEQ ID NO: 1103939 - RNA, 21 nt, Human
uacccaggcccaccaggaggc

SEQ ID NO: 1103940 - RNA, 21 nt, Human
ucagagcaaguuagggcacaa

SEQ ID NO: 1103941 - RNA, 23 nt, Human
uccccacccgacucgcccccagc

SEQ ID NO: 1103942 - RNA, 22 nt, Human
ucccuggggaagacccaggccc

SEQ ID NO: 1103943 - RNA, 25 nt, Human
ucccugguugaggaguugggguucc

SEQ ID NO: 1103944 - RNA, 20 nt, Human
uccgggugggagacgugugg

SEQ ID NO: 1103945 - RNA, 24 nt, Human
uccugcagaagcuggucugcgcag

SEQ ID NO: 1103946 - RNA, 24 nt, Human
ucucaggcucguccacgcucugcc

SEQ ID NO: 1103947 - RNA, 22 nt, Human
ucucaggggucugggcagggag

SEQ ID NO: 1103948 - RNA, 19 nt, Human
ucucuggcucuccacccug

SEQ ID NO: 1103949 - RNA, 21 nt, Human
ucucuggcucuccacccuggu

SEQ ID NO: 1103950 - RNA, 26 nt, Human
ucugcccauccccugcccacaggacc

SEQ ID NO: 1103951 - RNA, 20 nt, Human
ugaccacguaacucagagca

SEQ ID NO: 1103952 - RNA, 18 nt, Human
ugacuguaggcuugaaca

SEQ ID NO: 1103953 - RNA, 23 nt, Human
ugagcccagcgucugggaaccag

SEQ ID NO: 1103954 - RNA, 21 nt, Human
ugaggcugggucacagacaag

SEQ ID NO: 1103955 - RNA, 18 nt, Human
ugcagaaggagaucaacg

SEQ ID NO: 1103956 - RNA, 20 nt, Human
ugcagaaggagaucaacgac

SEQ ID NO: 1103957 - RNA, 22 nt, Human
ugcagcaccagcaggagacggg

SEQ ID NO: 1103958 - RNA, 23 nt, Human
ugcagggcgugcacccgggcugc

SEQ ID NO: 1103959 - RNA, 18 nt, Human
ugcaggugggccugggug

SEQ ID NO: 1103960 - RNA, 19 nt, Human
ugcaugcacacagcaggug

SEQ ID NO: 1103961 - RNA, 27 nt, Human
ugcccggggccaguguuccugagcgcc

SEQ ID NO: 1103962 - RNA, 23 nt, Human
ugccgccaccauccggagccaau

SEQ ID NO: 1103963 - RNA, 23 nt, Human
ugccucauggacgcccugggccu

SEQ ID NO: 1103964 - RNA, 19 nt, Human
ugcggagccugguggggcc

SEQ ID NO: 1103965 - RNA, 18 nt, Human
ugcggcgggaauacgagg

SEQ ID NO: 1103966 - RNA, 20 nt, Human
uggcaagucugcccaucccc

SEQ ID NO: 1103967 - RNA, 22 nt, Human
uggccucugcaguggccacccu

SEQ ID NO: 1103968 - RNA, 21 nt, Human
uggcucacaccuguaauccca

SEQ ID NO: 1103969 - RNA, 22 nt, Human
uggcucacaccuguaaucccag

SEQ ID NO: 1103970 - RNA, 24 nt, Human
uggcucacaccuguaaucccagca

SEQ ID NO: 1103971 - RNA, 23 nt, Human
ugggcagagccaggacauggggc

SEQ ID NO: 1103972 - RNA, 20 nt, Human
ugggccucgagguuggccag

SEQ ID NO: 1103973 - RNA, 19 nt, Human
ugggcggggaagggggggg

SEQ ID NO: 1103974 - RNA, 22 nt, Human
uggggaagacccaggcccagcc

SEQ ID NO: 1103975 - RNA, 25 nt, Human
uggggcugcggcagggcuggggguc

SEQ ID NO: 1103976 - RNA, 18 nt, Human
ugggguggaagcaagguu

SEQ ID NO: 1103977 - RNA, 20 nt, Human
ugggugcgggggcggggcgu

SEQ ID NO: 1103978 - RNA, 24 nt, Human
uggugagcaggagggagggucggg

SEQ ID NO: 1103979 - RNA, 24 nt, Human
ugguggggccggugggugagccgg

SEQ ID NO: 1103980 - RNA, 24 nt, Human
ugucaccugccucauggacgcccu

SEQ ID NO: 1103981 - RNA, 19 nt, Human
ugucucaggggucugggca

SEQ ID NO: 1103982 - RNA, 19 nt, Human
ugucuuggccacagaguuc

SEQ ID NO: 1103983 - RNA, 23 nt, Human
uuccuggacguggacaaggcccg

SEQ ID NO: 1103984 - RNA, 23 nt, Human
uuccuucuuugcugggcuccccu

SEQ ID NO: 1103985 - RNA, 21 nt, Human
uucucuggcucuccacccugg

SEQ ID NO: 1103986 - RNA, 19 nt, Human
uuggaccaaucugcccucu

SEQ ID NO: 1103987 - RNA, 26 nt, Human
aaaaacagagacagaguaagaaagga

SEQ ID NO: 1103988 - RNA, 27 nt, Human
aaccugucuccuacaaggaccauccug

SEQ ID NO: 1103989 - RNA, 19 nt, Human
aagaagaggcucccccagg

SEQ ID NO: 1103990 - RNA, 19 nt, Human
aagcaggaagagccaccug

SEQ ID NO: 1103991 - RNA, 19 nt, Human
aagcgcccgcgcuggggaa

SEQ ID NO: 1103992 - RNA, 22 nt, Human
acaaacccaacacccgcagggc

SEQ ID NO: 1103993 - RNA, 21 nt, Human
accauccugugugggacccug

SEQ ID NO: 1103994 - RNA, 23 nt, Human
agaaaacagcccagagagaaagc

SEQ ID NO: 1103995 - RNA, 20 nt, Human
agagaaagcagcccgaggga

SEQ ID NO: 1103996 - RNA, 22 nt, Human
agcauaaaaaugauaccaaaau

SEQ ID NO: 1103997 - RNA, 24 nt, Human
agccccucagccccucagccuccu

SEQ ID NO: 1103998 - RNA, 22 nt, Human
agccccucagccgccucagccc

SEQ ID NO: 1103999 - RNA, 20 nt, Human
aggagaaaacgcguaauaaa

SEQ ID NO: 1104000 - RNA, 26 nt, Human
aggagaaaacgcguaauaaaacaaaa

SEQ ID NO: 1104001 - RNA, 27 nt, Human
agggcagcuugugcccgagagugggau

SEQ ID NO: 1104002 - RNA, 24 nt, Human
aguaagaaaacagcccagagagaa

SEQ ID NO: 1104003 - RNA, 19 nt, Human
auaaaacaaaaugcugcaa

SEQ ID NO: 1104004 - RNA, 21 nt, Human
auccugugugggacccugcca

SEQ ID NO: 1104005 - RNA, 21 nt, Human
caaaaucuaggagaaaacgcg

SEQ ID NO: 1104006 - RNA, 19 nt, Human
caaaaugcugcaaaacaca

SEQ ID NO: 1104007 - RNA, 24 nt, Human
caaacccaacacccgcagggcuga

SEQ ID NO: 1104008 - RNA, 21 nt, Human
caagagaucauggcccagagc

SEQ ID NO: 1104009 - RNA, 18 nt, Human
caccucagcaacuuguca

SEQ ID NO: 1104010 - RNA, 21 nt, Human
caccugagcccgaaauugucc

SEQ ID NO: 1104011 - RNA, 23 nt, Human
caccugggugaccccccucccua

SEQ ID NO: 1104012 - RNA, 20 nt, Human
cacgugacgugcgguggacc

SEQ ID NO: 1104013 - RNA, 20 nt, Human
cagcaaagggcagcuugugc

SEQ ID NO: 1104014 - RNA, 25 nt, Human
cagcaacuugucaaaccugucuccu

SEQ ID NO: 1104015 - RNA, 19 nt, Human
cagcccagagagaaagcag

SEQ ID NO: 1104016 - RNA, 21 nt, Human
cagccccucagccccucagcc

SEQ ID NO: 1104017 - RNA, 21 nt, Human
cagccccucagccccucagcc

SEQ ID NO: 1104018 - RNA, 19 nt, Human
cagccccucagccgccuca

SEQ ID NO: 1104019 - RNA, 19 nt, Human
cagccccucagccgccuca

SEQ ID NO: 1104020 - RNA, 20 nt, Human
cagccgccucagccgccuca

SEQ ID NO: 1104021 - RNA, 22 nt, Human
caggagcccacggccucagaaa

SEQ ID NO: 1104022 - RNA, 19 nt, Human
caggcaaaggggaaauugg

SEQ ID NO: 1104023 - RNA, 25 nt, Human
cagugccaagagaucauggcccaga

SEQ ID NO: 1104024 - RNA, 20 nt, Human
caucacccaccaggaguccc

SEQ ID NO: 1104025 - RNA, 19 nt, Human
caucaggcaccucagcaac

SEQ ID NO: 1104026 - RNA, 19 nt, Human
cauggcccagagcuggcag

SEQ ID NO: 1104027 - RNA, 19 nt, Human
ccaagagaucauggcccag

SEQ ID NO: 1104028 - RNA, 22 nt, Human
ccaagagaucauggcccagagc

SEQ ID NO: 1104029 - RNA, 22 nt, Human
ccaccugggugaccccccuccc

SEQ ID NO: 1104030 - RNA, 21 nt, Human
ccacgcugucgcgggcuucug

SEQ ID NO: 1104031 - RNA, 22 nt, Human
ccagccaaggccucccggagcc

SEQ ID NO: 1104032 - RNA, 19 nt, Human
cccagagagaaagcagccc

SEQ ID NO: 1104033 - RNA, 19 nt, Human
cccccaggaugcaaacuca

SEQ ID NO: 1104034 - RNA, 22 nt, Human
cccgcgcuggggaagcgccccc

SEQ ID NO: 1104035 - RNA, 23 nt, Human
ccucagcaacuugucaaaccugu

SEQ ID NO: 1104036 - RNA, 18 nt, Human
ccuccugccaggagccca

SEQ ID NO: 1104037 - RNA, 18 nt, Human
cgcccccugcaccugagc

SEQ ID NO: 1104038 - RNA, 24 nt, Human
cgccugccacugacuccuggccgc

SEQ ID NO: 1104039 - RNA, 19 nt, Human
cggcagggaccggccaggc

SEQ ID NO: 1104040 - RNA, 24 nt, Human
cggugucuuccaaacccaagccuc

SEQ ID NO: 1104041 - RNA, 24 nt, Human
cguaauaaaacaaaaugcugcaaa

SEQ ID NO: 1104042 - RNA, 20 nt, Human
cuccagguccuccugccagg

SEQ ID NO: 1104043 - RNA, 21 nt, Human
cucccggagccaucacccacc

SEQ ID NO: 1104044 - RNA, 21 nt, Human
gaaauugucccuaacaaaccc

SEQ ID NO: 1104045 - RNA, 18 nt, Human
gagccgcagccgggcucg

SEQ ID NO: 1104046 - RNA, 21 nt, Human
gaggccccacucugucccagc

SEQ ID NO: 1104047 - RNA, 22 nt, Human
gcaaagggcagcuugugcccga

SEQ ID NO: 1104048 - RNA, 21 nt, Human
gcaggaagagccaccugggug

SEQ ID NO: 1104049 - RNA, 24 nt, Human
gcagucagcucagcagcucucccu

SEQ ID NO: 1104050 - RNA, 24 nt, Human
gccgcgccugccacugacuccugg

SEQ ID NO: 1104051 - RNA, 25 nt, Human
gccucagccgccucagccccucagc

SEQ ID NO: 1104052 - RNA, 20 nt, Human
ggaauggucuggaaaguggg

SEQ ID NO: 1104053 - RNA, 20 nt, Human
ggaggccccacucuguccca

SEQ ID NO: 1104054 - RNA, 21 nt, Human
gggcagggccaguccggggga

SEQ ID NO: 1104055 - RNA, 23 nt, Human
gggcagggccaguccgggggagc

SEQ ID NO: 1104056 - RNA, 19 nt, Human
gucccuaacaaacccaaca

SEQ ID NO: 1104057 - RNA, 21 nt, Human
uaaaacaaaaugcugcaaaac

SEQ ID NO: 1104058 - RNA, 18 nt, Human
uaagaaaggacaccgagc

SEQ ID NO: 1104059 - RNA, 23 nt, Human
ucagauggggcccaggaagcgcc

SEQ ID NO: 1104060 - RNA, 18 nt, Human
ucagccccucagccccuc

SEQ ID NO: 1104061 - RNA, 18 nt, Human
ucagccccucagccccuc

SEQ ID NO: 1104062 - RNA, 18 nt, Human
ucagccccucagccccuc

SEQ ID NO: 1104063 - RNA, 21 nt, Human
ucagccccucagccgccucag

SEQ ID NO: 1104064 - RNA, 21 nt, Human
ucagccccucagccgccucag

SEQ ID NO: 1104065 - RNA, 21 nt, Human
ucagccccucagccuccucag

SEQ ID NO: 1104066 - RNA, 21 nt, Human
ucagccgccucagccccucag

SEQ ID NO: 1104067 - RNA, 21 nt, Human
ucagccgccucagccccucag

SEQ ID NO: 1104068 - RNA, 22 nt, Human
ucagccgccucagccgccucag

SEQ ID NO: 1104069 - RNA, 19 nt, Human
ucagccuccucagccccuc

SEQ ID NO: 1104070 - RNA, 21 nt, Human
ucagccuccucagccccucag

SEQ ID NO: 1104071 - RNA, 18 nt, Human
ucagcucagcagcucucc

SEQ ID NO: 1104072 - RNA, 21 nt, Human
ucaggcaaaggggaaauugga

SEQ ID NO: 1104073 - RNA, 23 nt, Human
ucccagccaaggccucccggagc

SEQ ID NO: 1104074 - RNA, 23 nt, Human
uccgugcccaacgccagcaaagg

SEQ ID NO: 1104075 - RNA, 24 nt, Human
ugaaaacuccagguccuccugcca

SEQ ID NO: 1104076 - RNA, 24 nt, Human
ugaaaugggcaccgcgugcuuucc

SEQ ID NO: 1104077 - RNA, 19 nt, Human
ugccuggaauggucuggaa

SEQ ID NO: 1104078 - RNA, 23 nt, Human
ugcggugucgaugaaaugggcac

SEQ ID NO: 1104079 - RNA, 24 nt, Human
uggaauggucuggaaagugggggc

SEQ ID NO: 1104080 - RNA, 20 nt, Human
uggccgcccgcuacuacucg

SEQ ID NO: 1104081 - RNA, 21 nt, Human
ugggacccugccaagcuccua

SEQ ID NO: 1104082 - RNA, 18 nt, Human
ugggugaccccccucccu

SEQ ID NO: 1104083 - RNA, 20 nt, Human
ugucccagccaaggccuccc

SEQ ID NO: 1104084 - RNA, 21 nt, Human
ugucccuaacaaacccaacac

SEQ ID NO: 1104085 - RNA, 21 nt, Human
uucccggggaucugaaaacuc

SEQ ID NO: 1104086 - RNA, 24 nt, Human
uuggauccuugccagguuuccagu

SEQ ID NO: 1104087 - RNA, 24 nt, Human
uugucccuaacaaacccaacaccc

SEQ ID NO: 1104088 - RNA, 27 nt, Human
aaaaaaaaaaaaagaauuacugcaaac

SEQ ID NO: 1104089 - RNA, 23 nt, Human
aaaaaaaaaagaauuacugcaaa

SEQ ID NO: 1104090 - RNA, 18 nt, Human
aaagaauuacugcaaaca

SEQ ID NO: 1104091 - RNA, 21 nt, Human
aacagcaccauauggagcaaa

SEQ ID NO: 1104092 - RNA, 21 nt, Human
aacagugcgagacuccgucuc

SEQ ID NO: 1104093 - RNA, 24 nt, Human
aacagugcgagacuccgucucaaa

SEQ ID NO: 1104094 - RNA, 19 nt, Human
aacauggugaaaccccauc

SEQ ID NO: 1104095 - RNA, 20 nt, Human
aacauggugaaaccccaucu

SEQ ID NO: 1104096 - RNA, 21 nt, Human
aacauggugaaaccccaucuc

SEQ ID NO: 1104097 - RNA, 21 nt, Human
aacauggugaaaccccaucuc

SEQ ID NO: 1104098 - RNA, 24 nt, Human
aauugcuugaacucgggaggcgga

SEQ ID NO: 1104099 - RNA, 24 nt, Human
acagugcgagacuccgucucaaaa

SEQ ID NO: 1104100 - RNA, 23 nt, Human
accccauaggauuucaaaagcca

SEQ ID NO: 1104101 - RNA, 24 nt, Human
accccaucucuacuaaaaauacaa

SEQ ID NO: 1104102 - RNA, 23 nt, Human
acgccacugcacuccagccuggg

SEQ ID NO: 1104103 - RNA, 24 nt, Human
acgccacugcacuccagccugggc

SEQ ID NO: 1104104 - RNA, 24 nt, Human
acugcacuccagccugggcaacag

SEQ ID NO: 1104105 - RNA, 21 nt, Human
agaacagcaccauauggagca

SEQ ID NO: 1104106 - RNA, 29 nt, Human
agagaccccauaggauuucaaaagccagg

SEQ ID NO: 1104107 - RNA, 26 nt, Human
agagagcagcuggagaauguuuucau

SEQ ID NO: 1104108 - RNA, 19 nt, Human
agauggcauuuucauucaa

SEQ ID NO: 1104109 - RNA, 22 nt, Human
agcacuuugggaggccgaggug

SEQ ID NO: 1104110 - RNA, 23 nt, Human
agcaguuauuuuugcccccaaau

SEQ ID NO: 1104111 - RNA, 22 nt, Human
agccuggagccuggagauggca

SEQ ID NO: 1104112 - RNA, 24 nt, Human
agccugggcaacagugcgagacuc

SEQ ID NO: 1104113 - RNA, 24 nt, Human
aggcaggagaauugcuugaacucg

SEQ ID NO: 1104114 - RNA, 21 nt, Human
aggccgaggugagugcaucac

SEQ ID NO: 1104115 - RNA, 24 nt, Human
aggcggagcuugcagugagccaag

SEQ ID NO: 1104116 - RNA, 21 nt, Human
aggcugaggcaggagaauugc

SEQ ID NO: 1104117 - RNA, 24 nt, Human
aggcugaggcaggagaauugcuug

SEQ ID NO: 1104118 - RNA, 18 nt, Human
agugcaucacgaggucag

SEQ ID NO: 1104119 - RNA, 24 nt, Human
aguggcucacgccuguaaucccag

SEQ ID NO: 1104120 - RNA, 24 nt, Human
aucacgccacugcacuccagccug

SEQ ID NO: 1104121 - RNA, 23 nt, Human
auucugggcacagugugacauuu

SEQ ID NO: 1104122 - RNA, 24 nt, Human
caacauggugaaaccccaucucua

SEQ ID NO: 1104123 - RNA, 24 nt, Human
caagaucacgccacugcacuccag

SEQ ID NO: 1104124 - RNA, 25 nt, Human
cacccuaaaaugcaaaucccaucac

SEQ ID NO: 1104125 - RNA, 23 nt, Human
caccuguaaucccagcuacucgg

SEQ ID NO: 1104126 - RNA, 24 nt, Human
caccuguaaucccagcuacucggg

SEQ ID NO: 1104127 - RNA, 24 nt, Human
cacgccuguaaucccagcacuuug

SEQ ID NO: 1104128 - RNA, 20 nt, Human
cacuccagccugggcaacag

SEQ ID NO: 1104129 - RNA, 21 nt, Human
cacuccagccugggcaacagu

SEQ ID NO: 1104130 - RNA, 19 nt, Human
cacugcacuccagccuggg

SEQ ID NO: 1104131 - RNA, 21 nt, Human
cacugcacuccagccugggca

SEQ ID NO: 1104132 - RNA, 22 nt, Human
cacugcacuccagccugggcaa

SEQ ID NO: 1104133 - RNA, 23 nt, Human
cacugcacuccagccugggcaac

SEQ ID NO: 1104134 - RNA, 24 nt, Human
cacugcacuccagccugggcaaca

SEQ ID NO: 1104135 - RNA, 22 nt, Human
cacuguagcuggcaaaggucug

SEQ ID NO: 1104136 - RNA, 21 nt, Human
cagcacuuugggaggccgagg

SEQ ID NO: 1104137 - RNA, 23 nt, Human
cagcacuuugggaggccgaggug

SEQ ID NO: 1104138 - RNA, 24 nt, Human
cagcuacucgggaggcugaggcag

SEQ ID NO: 1104139 - RNA, 23 nt, Human
caggcagggcgcaguggcucacg

SEQ ID NO: 1104140 - RNA, 24 nt, Human
cauucagagaccccauaggauuuc

SEQ ID NO: 1104141 - RNA, 21 nt, Human
ccaaaucacccuaaaaugcaa

SEQ ID NO: 1104142 - RNA, 20 nt, Human
ccacugcacuccagccuggg

SEQ ID NO: 1104143 - RNA, 20 nt, Human
ccacugcacuccagccuggg

SEQ ID NO: 1104144 - RNA, 21 nt, Human
ccacugcacuccagccugggc

SEQ ID NO: 1104145 - RNA, 23 nt, Human
ccacugcacuccagccugggcaa

SEQ ID NO: 1104146 - RNA, 24 nt, Human
ccacugcacuccagccugggcaac

SEQ ID NO: 1104147 - RNA, 20 nt, Human
cccaaaucacccuaaaaugc

SEQ ID NO: 1104148 - RNA, 18 nt, Human
ccgacaccagaacagacu

SEQ ID NO: 1104149 - RNA, 26 nt, Human
ccucugacaccgacaccagaacagac

SEQ ID NO: 1104150 - RNA, 23 nt, Human
ccuggccaacauggugaaacccc

SEQ ID NO: 1104151 - RNA, 24 nt, Human
ccuggccaacauggugaaacccca

SEQ ID NO: 1104152 - RNA, 21 nt, Human
ccuguaaucccagcuacucgg

SEQ ID NO: 1104153 - RNA, 24 nt, Human
cgccacugcacuccagccugggca

SEQ ID NO: 1104154 - RNA, 23 nt, Human
cgccuguaaucccagcacuuugg

SEQ ID NO: 1104155 - RNA, 24 nt, Human
cgccuguaaucccagcacuuuggg

SEQ ID NO: 1104156 - RNA, 19 nt, Human
cuacaaacaggcagggcgc

SEQ ID NO: 1104157 - RNA, 18 nt, Human
cucaaaaaaaaaaaaaaa

SEQ ID NO: 1104158 - RNA, 23 nt, Human
cucaaaaaaaaaaaaaaaaagaa

SEQ ID NO: 1104159 - RNA, 22 nt, Human
cucacgccuguaaucccagcac

SEQ ID NO: 1104160 - RNA, 24 nt, Human
cucacgccuguaaucccagcacuu

SEQ ID NO: 1104161 - RNA, 19 nt, Human
cuccgucucaaaaaaaaaa

SEQ ID NO: 1104162 - RNA, 23 nt, Human
cuggccaacauggugaaacccca

SEQ ID NO: 1104163 - RNA, 21 nt, Human
cuguaaucccagcuacucggg

SEQ ID NO: 1104164 - RNA, 23 nt, Human
gagaauugcuugaacucgggagg

SEQ ID NO: 1104165 - RNA, 22 nt, Human
gagcuugcagugagccaagauc

SEQ ID NO: 1104166 - RNA, 23 nt, Human
gaggugagugcaucacgagguca

SEQ ID NO: 1104167 - RNA, 19 nt, Human
gcaaaagagagcagcugga

SEQ ID NO: 1104168 - RNA, 24 nt, Human
gccaacauggugaaaccccaucuc

SEQ ID NO: 1104169 - RNA, 20 nt, Human
gccaagaucacgccacugca

SEQ ID NO: 1104170 - RNA, 22 nt, Human
gccacugcacuccagccugggc

SEQ ID NO: 1104171 - RNA, 24 nt, Human
gccacugcacuccagccugggcaa

SEQ ID NO: 1104172 - RNA, 23 nt, Human
gccuggccaacauggugaaaccc

SEQ ID NO: 1104173 - RNA, 20 nt, Human
gcgcaguggcucacgccugu

SEQ ID NO: 1104174 - RNA, 20 nt, Human
ggagcuugcagugagccaag

SEQ ID NO: 1104175 - RNA, 24 nt, Human
ggagcuugcagugagccaagauca

SEQ ID NO: 1104176 - RNA, 19 nt, Human
ggcaccuguaaucccagcu

SEQ ID NO: 1104177 - RNA, 18 nt, Human
ggcagggcgcaguggcuc

SEQ ID NO: 1104178 - RNA, 23 nt, Human
ggcgcaguggcucacgccuguaa

SEQ ID NO: 1104179 - RNA, 18 nt, Human
gggcgcaguggcucacgc

SEQ ID NO: 1104180 - RNA, 24 nt, Human
gguggcaggcaccuguaaucccag

SEQ ID NO: 1104181 - RNA, 23 nt, Human
ggugugguggcaggcaccuguaa

SEQ ID NO: 1104182 - RNA, 21 nt, Human
gugacauuuaccugaacagag

SEQ ID NO: 1104183 - RNA, 22 nt, Human
uaaaaauacaaaacguuagcug

SEQ ID NO: 1104184 - RNA, 20 nt, Human
uaacucugcaaucuuuucag

SEQ ID NO: 1104185 - RNA, 18 nt, Human
uaacugggugcacuggag

SEQ ID NO: 1104186 - RNA, 23 nt, Human
uacaaacaggcagggcgcagugg

SEQ ID NO: 1104187 - RNA, 24 nt, Human
uaccugaacagagaggagaauggc

SEQ ID NO: 1104188 - RNA, 19 nt, Human
uacuacaaacaggcagggc

SEQ ID NO: 1104189 - RNA, 21 nt, Human
uauggagcaaaagagagcagc

SEQ ID NO: 1104190 - RNA, 23 nt, Human
ucaaaaaaaaaaaaaaaaagaau

SEQ ID NO: 1104191 - RNA, 22 nt, Human
ucacgaggucagaaguuugaga

SEQ ID NO: 1104192 - RNA, 24 nt, Human
ucacgaggucagaaguuugagauc

SEQ ID NO: 1104193 - RNA, 23 nt, Human
ucacgccacugcacuccagccug

SEQ ID NO: 1104194 - RNA, 23 nt, Human
ucacuguagcuggcaaaggucug

SEQ ID NO: 1104195 - RNA, 23 nt, Human
uccgucucaaaaaaaaaaaaaaa

SEQ ID NO: 1104196 - RNA, 23 nt, Human
ucgggaggcugaggcaggagaau

SEQ ID NO: 1104197 - RNA, 20 nt, Human
ucucuacuaaaaauacaaaa

SEQ ID NO: 1104198 - RNA, 24 nt, Human
ucugacaccgacaccagaacagac

SEQ ID NO: 1104199 - RNA, 19 nt, Human
ucugcaaucuuuucagcca

SEQ ID NO: 1104200 - RNA, 23 nt, Human
ucugcaaucuuuucagccacucu

SEQ ID NO: 1104201 - RNA, 19 nt, Human
ugaaaccccaucucuacua

SEQ ID NO: 1104202 - RNA, 20 nt, Human
ugacaccgacaccagaacag

SEQ ID NO: 1104203 - RNA, 20 nt, Human
ugaccucugacaccgacacc

SEQ ID NO: 1104204 - RNA, 24 nt, Human
ugagaucugccuggccaacauggu

SEQ ID NO: 1104205 - RNA, 23 nt, Human
ugaggcaggagaauugcuugaac

SEQ ID NO: 1104206 - RNA, 25 nt, Human
ugaggcaggagaauugcuugaacuc

SEQ ID NO: 1104207 - RNA, 22 nt, Human
ugagugcaucacgaggucagaa

SEQ ID NO: 1104208 - RNA, 20 nt, Human
ugcaaaucccaucacuguag

SEQ ID NO: 1104209 - RNA, 22 nt, Human
ugcaucacgaggucagaaguuu

SEQ ID NO: 1104210 - RNA, 23 nt, Human
ugccuaaaaauuacuacaaacag

SEQ ID NO: 1104211 - RNA, 21 nt, Human
uggagcaaaagagagcagcug

SEQ ID NO: 1104212 - RNA, 22 nt, Human
uggcaggcaccuguaaucccag

SEQ ID NO: 1104213 - RNA, 24 nt, Human
uggccaacauggugaaaccccauc

SEQ ID NO: 1104214 - RNA, 22 nt, Human
uggcucacgccuguaaucccag

SEQ ID NO: 1104215 - RNA, 24 nt, Human
uggcucacgccuguaaucccagca

SEQ ID NO: 1104216 - RNA, 19 nt, Human
ugggaggccgaggugagug

SEQ ID NO: 1104217 - RNA, 24 nt, Human
ugggaggccgaggugagugcauca

SEQ ID NO: 1104218 - RNA, 24 nt, Human
ugguggcaggcaccuguaauccca

SEQ ID NO: 1104219 - RNA, 19 nt, Human
ugugguggcaggcaccugu

SEQ ID NO: 1104220 - RNA, 18 nt, Human
uuagcugggugugguggc

SEQ ID NO: 1104221 - RNA, 24 nt, Human
uuagcugggugugguggcaggcac

SEQ ID NO: 1104222 - RNA, 20 nt, Human
uugcagugagccaagaucac

SEQ ID NO: 1104223 - RNA, 18 nt, Human
uugcuugaacucgggagg

SEQ ID NO: 1104224 - RNA, 23 nt, Human
uugcuugaacucgggaggcggag

SEQ ID NO: 1104225 - RNA, 19 nt, Human
uugggaggccgaggugagu

SEQ ID NO: 1104226 - RNA, 22 nt, Human
aaaaagacgaacacaacggaga

SEQ ID NO: 1104227 - RNA, 21 nt, Human
aaaagacgaacacaacggaga

SEQ ID NO: 1104228 - RNA, 24 nt, Human
aaaugacugcaguccacaacuugg

SEQ ID NO: 1104229 - RNA, 20 nt, Human
acaacggagaaauccagcac

SEQ ID NO: 1104230 - RNA, 20 nt, Human
acaugaacuuucucacaucc

SEQ ID NO: 1104231 - RNA, 18 nt, Human
acauucaaugccuuugcu

SEQ ID NO: 1104232 - RNA, 20 nt, Human
acugcaguccacaacuuguc

SEQ ID NO: 1104233 - RNA, 18 nt, Human
agaaggcuggacugugag

SEQ ID NO: 1104234 - RNA, 18 nt, Human
agacgaacacaacggaga

SEQ ID NO: 1104235 - RNA, 18 nt, Human
agcucagugcucaugugc

SEQ ID NO: 1104236 - RNA, 23 nt, Human
aggaggccuguucgcgacaugag

SEQ ID NO: 1104237 - RNA, 24 nt, Human
auggcacuggaaaaagacgaacac

SEQ ID NO: 1104238 - RNA, 22 nt, Human
caaauaaaugacugcaguccac

SEQ ID NO: 1104239 - RNA, 19 nt, Human
caaccucugauaaccagug

SEQ ID NO: 1104240 - RNA, 18 nt, Human
cacuugacuucugcucuu

SEQ ID NO: 1104241 - RNA, 24 nt, Human
ccucugauaaccagugucuuugag

SEQ ID NO: 1104242 - RNA, 24 nt, Human
cgccuccgacucaauagucagcuc

SEQ ID NO: 1104243 - RNA, 22 nt, Human
cucuuucuauuguuuuucaaaa

SEQ ID NO: 1104244 - RNA, 18 nt, Human
cugcucacucccaaagcc

SEQ ID NO: 1104245 - RNA, 23 nt, Human
cuuggcacagcucccuugcacau

SEQ ID NO: 1104246 - RNA, 24 nt, Human
cuuggcacagcucccuugcacaug

SEQ ID NO: 1104247 - RNA, 24 nt, Human
cuuguccuccugugccgauuuggu

SEQ ID NO: 1104248 - RNA, 21 nt, Human
gaaaauagcuguucagugaac

SEQ ID NO: 1104249 - RNA, 23 nt, Human
gaacuucuuucaugagcucacuu

SEQ ID NO: 1104250 - RNA, 22 nt, Human
gacagucacagauauugcgaag

SEQ ID NO: 1104251 - RNA, 19 nt, Human
gcuucaucaggaggccugu

SEQ ID NO: 1104252 - RNA, 20 nt, Human
ggaacuucuuucaugagcuc

SEQ ID NO: 1104253 - RNA, 18 nt, Human
uacacugauuguaacuga

SEQ ID NO: 1104254 - RNA, 22 nt, Human
uacuacugucuucuaacugucc

SEQ ID NO: 1104255 - RNA, 20 nt, Human
uacucaggagccuaucucca

SEQ ID NO: 1104256 - RNA, 21 nt, Human
uagaaggcuggacugugaggg

SEQ ID NO: 1104257 - RNA, 23 nt, Human
ucaggagccuaucuccaucuugu

SEQ ID NO: 1104258 - RNA, 21 nt, Human
uccugcugcucgcugagaagc

SEQ ID NO: 1104259 - RNA, 20 nt, Human
ucuuauagucauauccugga

SEQ ID NO: 1104260 - RNA, 22 nt, Human
ucuuauagucauauccuggaac

SEQ ID NO: 1104261 - RNA, 23 nt, Human
ucuuauagucauauccuggaacu

SEQ ID NO: 1104262 - RNA, 22 nt, Human
ucuuucuguucauucuguucca

SEQ ID NO: 1104263 - RNA, 25 nt, Human
ugccuuugcuuccugcugcucgcug

SEQ ID NO: 1104264 - RNA, 22 nt, Human
ugcucacucccaaagccugaca

SEQ ID NO: 1104265 - RNA, 21 nt, Human
uggaaaaagacgaacacaacg

SEQ ID NO: 1104266 - RNA, 23 nt, Human
uguugguccguaucccauucuac

SEQ ID NO: 1104267 - RNA, 21 nt, Human
uuauggaucuucuugugauuc

SEQ ID NO: 1104268 - RNA, 21 nt, Human
uugcauaaauccaaccucuga

SEQ ID NO: 1104269 - RNA, 18 nt, Human
cuuccugcugcgcugaac

SEQ ID NO: 1104270 - RNA, 20 nt, Human
gggggaaccuccucugccag

SEQ ID NO: 1104271 - RNA, 18 nt, Human
uaauuucugugcauuccc

SEQ ID NO: 1104272 - RNA, 22 nt, Human
uccugcugcgcugaaccccugc

SEQ ID NO: 1104273 - RNA, 21 nt, Human
ugcgcugaaccccugcccuuu

SEQ ID NO: 1104274 - RNA, 19 nt, Human
ugcugcgcugaaccccugc

SEQ ID NO: 1104275 - RNA, 19 nt, Human
ugggggaaccuccucugcc

SEQ ID NO: 1104276 - RNA, 22 nt, Human
ugugauuuuucaccaauuuggg

SEQ ID NO: 1104277 - RNA, 21 nt, Human
aaucuugcucuugccgcucug

SEQ ID NO: 1104278 - RNA, 22 nt, Human
accccggagggcacugcccagg

SEQ ID NO: 1104279 - RNA, 19 nt, Human
agacagccggcaggaggug

SEQ ID NO: 1104280 - RNA, 24 nt, Human
agccaaagcaguagcagcuggaau

SEQ ID NO: 1104281 - RNA, 19 nt, Human
aggccaccagcagauccca

SEQ ID NO: 1104282 - RNA, 19 nt, Human
caaagcaguagcagcugga

SEQ ID NO: 1104283 - RNA, 21 nt, Human
cacccaggccgccagacagcc

SEQ ID NO: 1104284 - RNA, 23 nt, Human
cagcagcccaucaacgcccccaa

SEQ ID NO: 1104285 - RNA, 23 nt, Human
caggcacacaggagaagggcugg

SEQ ID NO: 1104286 - RNA, 24 nt, Human
cauagccaccgccagagccaaagc

SEQ ID NO: 1104287 - RNA, 24 nt, Human
ccacacugccgaucagccccugga

SEQ ID NO: 1104288 - RNA, 24 nt, Human
ccagagccaaagcaguagcagcug

SEQ ID NO: 1104289 - RNA, 22 nt, Human
ccagcagcccaucaacgccccc

SEQ ID NO: 1104290 - RNA, 23 nt, Human
cccaaagcugcugccauagccac

SEQ ID NO: 1104291 - RNA, 22 nt, Human
cccaggccaccagcagauccca

SEQ ID NO: 1104292 - RNA, 23 nt, Human
ccccaaagcugcugccauagccu

SEQ ID NO: 1104293 - RNA, 24 nt, Human
ccccuggaucugggacagcugcau

SEQ ID NO: 1104294 - RNA, 19 nt, Human
ccgccagagccaaagcagu

SEQ ID NO: 1104295 - RNA, 25 nt, Human
ccgccagguugcccuccagggaugc

SEQ ID NO: 1104296 - RNA, 23 nt, Human
ccggcaggaggugcgggaugagc

SEQ ID NO: 1104297 - RNA, 20 nt, Human
ccugcauggugcgccagagc

SEQ ID NO: 1104298 - RNA, 21 nt, Human
cgccagagccaaagcaguagc

SEQ ID NO: 1104299 - RNA, 23 nt, Human
cgcccccaaagcugcugccauag

SEQ ID NO: 1104300 - RNA, 19 nt, Human
cggcacccaggccgccaga

SEQ ID NO: 1104301 - RNA, 19 nt, Human
cgggaugagccacucccag

SEQ ID NO: 1104302 - RNA, 21 nt, Human
cugguggauggugguggucau

SEQ ID NO: 1104303 - RNA, 19 nt, Human
gaugagccacucccaggcc

SEQ ID NO: 1104304 - RNA, 20 nt, Human
gccaccgccagagccaaagc

SEQ ID NO: 1104305 - RNA, 19 nt, Human
gccggcaggaggugcggga

SEQ ID NO: 1104306 - RNA, 19 nt, Human
gcugagcugggacugcagc

SEQ ID NO: 1104307 - RNA, 23 nt, Human
gcuggaggaggugaacuggugga

SEQ ID NO: 1104308 - RNA, 23 nt, Human
ggagcuggaggaggugaacugga

SEQ ID NO: 1104309 - RNA, 19 nt, Human
gggaugcuuucaugcugag

SEQ ID NO: 1104310 - RNA, 24 nt, Human
guggcggcggcaggaggcaggcac

SEQ ID NO: 1104311 - RNA, 21 nt, Human
guggucaugguggcggcggca

SEQ ID NO: 1104312 - RNA, 20 nt, Human
ucagccccuggaucugggac

SEQ ID NO: 1104313 - RNA, 22 nt, Human
uccagggaugcuuucaugcuga

SEQ ID NO: 1104314 - RNA, 21 nt, Human
ugcaguagcggcucucugucu

SEQ ID NO: 1104315 - RNA, 24 nt, Human
uggaauagcugcuaccccggaggg

SEQ ID NO: 1104316 - RNA, 18 nt, Human
uggauggugguggucaug

SEQ ID NO: 1104317 - RNA, 20 nt, Human
ugggacagcugcaugcagua

SEQ ID NO: 1104318 - RNA, 25 nt, Human
ugggccagcugcuccuccacacugc

SEQ ID NO: 1104319 - RNA, 19 nt, Human
uggucaugguggcggcggc

SEQ ID NO: 1104320 - RNA, 22 nt, Human
uggugguggucaugguggcggc

SEQ ID NO: 1104321 - RNA, 20 nt, Human
uuccucugucuugcugaaga

SEQ ID NO: 1104322 - RNA, 18 nt, Human
uugauggagcuggaggag

SEQ ID NO: 1104323 - RNA, 23 nt, Human
uuggcauccuugcgguucuucuc

SEQ ID NO: 1104324 - RNA, 19 nt, Human
aauuucuuccuuguuucuc

SEQ ID NO: 1104325 - RNA, 20 nt, Human
cagggccuucugcaaggcuu

SEQ ID NO: 1104326 - RNA, 23 nt, Human
ccugaccaggugucuuucucacc

SEQ ID NO: 1104327 - RNA, 22 nt, Human
ccuuuagucugacaccauaggc

SEQ ID NO: 1104328 - RNA, 19 nt, Human
gauuggcuuauacagagag

SEQ ID NO: 1104329 - RNA, 18 nt, Human
gccuuuagucugacacca

SEQ ID NO: 1104330 - RNA, 19 nt, Human
uccaaaugcuuuuucuugg

SEQ ID NO: 1104331 - RNA, 22 nt, Human
uccaaaugcuuuuucuuggcac

SEQ ID NO: 1104332 - RNA, 20 nt, Human
uccaagucuucaaagucacc

SEQ ID NO: 1104333 - RNA, 19 nt, Human
ucgcaugaagacaauaucg

SEQ ID NO: 1104334 - RNA, 22 nt, Human
ucucacccacugguuucaacaa

SEQ ID NO: 1104335 - RNA, 22 nt, Human
ucugaguaucggggcccgauuu

SEQ ID NO: 1104336 - RNA, 18 nt, Human
ugaauuaaaauguuucuu

SEQ ID NO: 1104337 - RNA, 21 nt, Human
uuccaagucuucaaagucacc

SEQ ID NO: 1104338 - RNA, 23 nt, Human
aaaaaccaaagugggcuggcuug

SEQ ID NO: 1104339 - RNA, 20 nt, Human
aaagaggcucgggcagcuuu

SEQ ID NO: 1104340 - RNA, 22 nt, Human
aagugggcuggcuuguacaggg

SEQ ID NO: 1104341 - RNA, 23 nt, Human
aauugccauucccucaauucucu

SEQ ID NO: 1104342 - RNA, 23 nt, Human
acaccacugcauuguugccaggc

SEQ ID NO: 1104343 - RNA, 26 nt, Human
accccaaaugcccuugggacagccuu

SEQ ID NO: 1104344 - RNA, 25 nt, Human
agcacugucaucuuugcucccugcg

SEQ ID NO: 1104345 - RNA, 22 nt, Human
agccuuugggggaggaaucagc

SEQ ID NO: 1104346 - RNA, 24 nt, Human
aggaaucagcuuugggcccagagc

SEQ ID NO: 1104347 - RNA, 24 nt, Human
aggcacucgguaaaagccugugga

SEQ ID NO: 1104348 - RNA, 20 nt, Human
aggcaugugggucaccaugu

SEQ ID NO: 1104349 - RNA, 21 nt, Human
aggcaugugggucaccauguc

SEQ ID NO: 1104350 - RNA, 18 nt, Human
aggggcucucucucuccc

SEQ ID NO: 1104351 - RNA, 22 nt, Human
auucccauuuuauagaugagga

SEQ ID NO: 1104352 - RNA, 28 nt, Human
caccccacagauuuacugauauucccaa

SEQ ID NO: 1104353 - RNA, 22 nt, Human
cagaacucaaacccaggacugu

SEQ ID NO: 1104354 - RNA, 24 nt, Human
cagaacucaaacccaggacugucu

SEQ ID NO: 1104355 - RNA, 20 nt, Human
cagcguccucauccacuccc

SEQ ID NO: 1104356 - RNA, 21 nt, Human
caggagguacucaauguuggg

SEQ ID NO: 1104357 - RNA, 21 nt, Human
caucuuguuuuucucagagug

SEQ ID NO: 1104358 - RNA, 18 nt, Human
cauuguugccaggcacuc

SEQ ID NO: 1104359 - RNA, 19 nt, Human
ccagggccagguuccgggg

SEQ ID NO: 1104360 - RNA, 22 nt, Human
cccaaaugcccuugggacagcc

SEQ ID NO: 1104361 - RNA, 22 nt, Human
ccccaaaugcccuugggacagc

SEQ ID NO: 1104362 - RNA, 18 nt, Human
ccccaggccgcgagagcc

SEQ ID NO: 1104363 - RNA, 18 nt, Human
ccccaggggguuuugggg

SEQ ID NO: 1104364 - RNA, 19 nt, Human
ccccaggggguuuuggggg

SEQ ID NO: 1104365 - RNA, 18 nt, Human
ccccccaggccgcgagag

SEQ ID NO: 1104366 - RNA, 19 nt, Human
ccccgggucaccagggggc

SEQ ID NO: 1104367 - RNA, 20 nt, Human
cccggaucagcuuccgcagc

SEQ ID NO: 1104368 - RNA, 25 nt, Human
ccuccuagccacauaacucccaggc

SEQ ID NO: 1104369 - RNA, 22 nt, Human
ccugaccccaaaugcccuuggg

SEQ ID NO: 1104370 - RNA, 21 nt, Human
cuauggcucacuuugcgauaa

SEQ ID NO: 1104371 - RNA, 23 nt, Human
cucagacuugaggccccccaggc

SEQ ID NO: 1104372 - RNA, 23 nt, Human
cucccugcgggcagguccugagu

SEQ ID NO: 1104373 - RNA, 20 nt, Human
cucugcuugaggaacucaga

SEQ ID NO: 1104374 - RNA, 22 nt, Human
cugcagcacugucaucuuugcu

SEQ ID NO: 1104375 - RNA, 24 nt, Human
cugcagcacugucaucuuugcucc

SEQ ID NO: 1104376 - RNA, 18 nt, Human
cuggcaguccuccagccu

SEQ ID NO: 1104377 - RNA, 24 nt, Human
gaacucagacuugaggccccccag

SEQ ID NO: 1104378 - RNA, 23 nt, Human
gaagaaccagucugacugcugga

SEQ ID NO: 1104379 - RNA, 20 nt, Human
gaccugguucuccguggcug

SEQ ID NO: 1104380 - RNA, 22 nt, Human
gagccagaacucaaacccagga

SEQ ID NO: 1104381 - RNA, 22 nt, Human
gccuccuagccacauaacuccc

SEQ ID NO: 1104382 - RNA, 21 nt, Human
gcuggcaguccuccagccuga

SEQ ID NO: 1104383 - RNA, 18 nt, Human
gggcagguccugaguccu

SEQ ID NO: 1104384 - RNA, 19 nt, Human
ggggaggaaucagcuuugg

SEQ ID NO: 1104385 - RNA, 24 nt, Human
ggucaggcaugugggucaccaugu

SEQ ID NO: 1104386 - RNA, 24 nt, Human
guaaaagccuguggacuccagccc

SEQ ID NO: 1104387 - RNA, 20 nt, Human
gucagugcuggggcuggugg

SEQ ID NO: 1104388 - RNA, 24 nt, Human
gugggcuggcuuguacagggauca

SEQ ID NO: 1104389 - RNA, 20 nt, Human
uaacucccaggccagguccu

SEQ ID NO: 1104390 - RNA, 21 nt, Human
uaaguaacuugcccaauaucc

SEQ ID NO: 1104391 - RNA, 18 nt, Human
uacagcagaugccucacc

SEQ ID NO: 1104392 - RNA, 22 nt, Human
uaucccaaacuacuaaauggug

SEQ ID NO: 1104393 - RNA, 19 nt, Human
ucaccaguguccgcccaaa

SEQ ID NO: 1104394 - RNA, 24 nt, Human
ucacugaagaaccagucugacugc

SEQ ID NO: 1104395 - RNA, 21 nt, Human
uccaucuuguuuuucucagag

SEQ ID NO: 1104396 - RNA, 25 nt, Human
ucccaaacuacuaaaugguggagcc

SEQ ID NO: 1104397 - RNA, 18 nt, Human
ucccaggccagguccuuc

SEQ ID NO: 1104398 - RNA, 24 nt, Human
ucccagggaccaucaacuuucccc

SEQ ID NO: 1104399 - RNA, 18 nt, Human
uccgcagcguccucaucc

SEQ ID NO: 1104400 - RNA, 24 nt, Human
uccucaccaguguccgcccaaaga

SEQ ID NO: 1104401 - RNA, 24 nt, Human
uccugaggccacgugccgcacucu

SEQ ID NO: 1104402 - RNA, 19 nt, Human
uccuucugcuugcuuuagg

SEQ ID NO: 1104403 - RNA, 21 nt, Human
ucuccacgaucuuguagaggu

SEQ ID NO: 1104404 - RNA, 21 nt, Human
ucucccuuguccucuucguca

SEQ ID NO: 1104405 - RNA, 19 nt, Human
ucucucucccuuguccucu

SEQ ID NO: 1104406 - RNA, 24 nt, Human
ucuuguagaggucaggcauguggg

SEQ ID NO: 1104407 - RNA, 20 nt, Human
ucuuuauuuccuucugcuuc

SEQ ID NO: 1104408 - RNA, 24 nt, Human
ugaaaagaggcucgggcagcuuuu

SEQ ID NO: 1104409 - RNA, 18 nt, Human
ugacugaacuacaggugg

SEQ ID NO: 1104410 - RNA, 20 nt, Human
ugacuucccucccagggacc

SEQ ID NO: 1104411 - RNA, 21 nt, Human
ugaguccugaggccacgugcc

SEQ ID NO: 1104412 - RNA, 23 nt, Human
ugccaggcacucgguaaaagccu

SEQ ID NO: 1104413 - RNA, 22 nt, Human
ugccccaggggguuuugggggc

SEQ ID NO: 1104414 - RNA, 21 nt, Human
ugcccuugggacagccuucuu

SEQ ID NO: 1104415 - RNA, 18 nt, Human
ugccugaggcuccuugcu

SEQ ID NO: 1104416 - RNA, 21 nt, Human
ugcgggcagguccugaguccu

SEQ ID NO: 1104417 - RNA, 21 nt, Human
ugcuuggcuuggaggucagug

SEQ ID NO: 1104418 - RNA, 18 nt, Human
uggcucacuuugcgauaa

SEQ ID NO: 1104419 - RNA, 22 nt, Human
ugguugaugucaccaggcccac

SEQ ID NO: 1104420 - RNA, 20 nt, Human
uguccgcccaaagaccaggg

SEQ ID NO: 1104421 - RNA, 25 nt, Human
uugcucccugcgggcagguccugag

SEQ ID NO: 1104422 - RNA, 21 nt, Human
aaaaaaaaaacacuuugauaa

SEQ ID NO: 1104423 - RNA, 20 nt, Human
aaaaacaucacaaaaccaaa

SEQ ID NO: 1104424 - RNA, 23 nt, Human
aaaaauaaaugggaagacuucac

SEQ ID NO: 1104425 - RNA, 22 nt, Human
aaaacaucacaaaaccaaaccc

SEQ ID NO: 1104426 - RNA, 24 nt, Human
aaaauagacugauaacuaugcaga

SEQ ID NO: 1104427 - RNA, 18 nt, Human
aaacaucacaaaaccaaa

SEQ ID NO: 1104428 - RNA, 24 nt, Human
aacaaguauacaaucaauacccau

SEQ ID NO: 1104429 - RNA, 20 nt, Human
aacaucacaaaaccaaaccc

SEQ ID NO: 1104430 - RNA, 19 nt, Human
aaccuggagguuugcccug

SEQ ID NO: 1104431 - RNA, 21 nt, Human
aacucuuguacucucuccuuu

SEQ ID NO: 1104432 - RNA, 22 nt, Human
aagaagaaugauacauaaaaaa

SEQ ID NO: 1104433 - RNA, 19 nt, Human
aaucuuccacgaaagagac

SEQ ID NO: 1104434 - RNA, 21 nt, Human
acagagaaaaucacaccugga

SEQ ID NO: 1104435 - RNA, 26 nt, Human
acagagaaaaucacaccuggaauauc

SEQ ID NO: 1104436 - RNA, 24 nt, Human
accauguuggacaggcuggucucg

SEQ ID NO: 1104437 - RNA, 18 nt, Human
acgggguuucaccauguu

SEQ ID NO: 1104438 - RNA, 23 nt, Human
acgggguuucaccauguuggaca

SEQ ID NO: 1104439 - RNA, 24 nt, Human
acgggguuucaccauguuggacag

SEQ ID NO: 1104440 - RNA, 26 nt, Human
acucccauuucaaaaauaaaugggaa

SEQ ID NO: 1104441 - RNA, 21 nt, Human
acucucuccuuuucccuccac

SEQ ID NO: 1104442 - RNA, 25 nt, Human
acucugucacccgggcuggagcgca

SEQ ID NO: 1104443 - RNA, 21 nt, Human
agaggaagaggggcaucuagc

SEQ ID NO: 1104444 - RNA, 22 nt, Human
agauuacaggcauaagccacag

SEQ ID NO: 1104445 - RNA, 23 nt, Human
agauuacaggcauaagccacagc

SEQ ID NO: 1104446 - RNA, 24 nt, Human
agcgauucuccugccucagccucc

SEQ ID NO: 1104447 - RNA, 25 nt, Human
aggaaaaaaaaaaaaacacuuugau

SEQ ID NO: 1104448 - RNA, 21 nt, Human
aggaagaggggcaucuagcuc

SEQ ID NO: 1104449 - RNA, 24 nt, Human
agggaaaaacaucacaaaaccaaa

SEQ ID NO: 1104450 - RNA, 24 nt, Human
aggugauccgcccgccucggccuc

SEQ ID NO: 1104451 - RNA, 24 nt, Human
aguauccuugccacugccaguuaa

SEQ ID NO: 1104452 - RNA, 22 nt, Human
aucagccccagugaaaagcugg

SEQ ID NO: 1104453 - RNA, 23 nt, Human
auccccaugacagagaaaaucac

SEQ ID NO: 1104454 - RNA, 21 nt, Human
augaggccaagacaacaagua

SEQ ID NO: 1104455 - RNA, 24 nt, Human
auuuuuguguuuuuaguggagacg

SEQ ID NO: 1104456 - RNA, 21 nt, Human
caaaauagacugauaacuaug

SEQ ID NO: 1104457 - RNA, 24 nt, Human
caaauugcugagauuacaggcaua

SEQ ID NO: 1104458 - RNA, 22 nt, Human
caacauacaaaauagacugaua

SEQ ID NO: 1104459 - RNA, 25 nt, Human
caacaugcucuaaaaaaaacucauc

SEQ ID NO: 1104460 - RNA, 23 nt, Human
caaccuccaccuccuggauucaa

SEQ ID NO: 1104461 - RNA, 20 nt, Human
caagcgauucuccugccuca

SEQ ID NO: 1104462 - RNA, 22 nt, Human
caagcgauucuccugccucagc

SEQ ID NO: 1104463 - RNA, 21 nt, Human
caaucaauacccaugugacac

SEQ ID NO: 1104464 - RNA, 18 nt, Human
cacaaaaccaaacccaua

SEQ ID NO: 1104465 - RNA, 26 nt, Human
cacaccuggaauaucaaagugcuuug

SEQ ID NO: 1104466 - RNA, 19 nt, Human
cacagcuuccugaugcuua

SEQ ID NO: 1104467 - RNA, 24 nt, Human
caccauguuggacaggcuggucuc

SEQ ID NO: 1104468 - RNA, 26 nt, Human
caccccaacccugaguugccggcgcc

SEQ ID NO: 1104469 - RNA, 21 nt, Human
caccccaacccugaguugcuc

SEQ ID NO: 1104470 - RNA, 20 nt, Human
caccuggaauaucaaagugc

SEQ ID NO: 1104471 - RNA, 24 nt, Human
cacucugucacccgggcuggagcg

SEQ ID NO: 1104472 - RNA, 21 nt, Human
cacugcaaccuccaccuccug

SEQ ID NO: 1104473 - RNA, 19 nt, Human
cacugccaguuaacagggc

SEQ ID NO: 1104474 - RNA, 18 nt, Human
cagcagccucacauccau

SEQ ID NO: 1104475 - RNA, 25 nt, Human
caggaugcuagggauacuucuggga

SEQ ID NO: 1104476 - RNA, 20 nt, Human
cagggcaguaagaaacaacu

SEQ ID NO: 1104477 - RNA, 25 nt, Human
caguagcugggacuacaggcacaug

SEQ ID NO: 1104478 - RNA, 19 nt, Human
caguggagcaaauccccau

SEQ ID NO: 1104479 - RNA, 24 nt, Human
caugccaccacgcccagauaauuu

SEQ ID NO: 1104480 - RNA, 23 nt, Human
ccaaauugcugagauuacaggca

SEQ ID NO: 1104481 - RNA, 24 nt, Human
ccaaauugcugagauuacaggcau

SEQ ID NO: 1104482 - RNA, 22 nt, Human
ccacaagcagauaaaaagagca

SEQ ID NO: 1104483 - RNA, 24 nt, Human
ccaccuccuggauucaagcgauuc

SEQ ID NO: 1104484 - RNA, 22 nt, Human
ccacuagcaugcccucucucag

SEQ ID NO: 1104485 - RNA, 24 nt, Human
ccagcccaccuuaaaccuaaauua

SEQ ID NO: 1104486 - RNA, 20 nt, Human
ccaugacagagaaaaucaca

SEQ ID NO: 1104487 - RNA, 19 nt, Human
cccacaagcagauaaaaag

SEQ ID NO: 1104488 - RNA, 23 nt, Human
cccaccuuaaaccuaaauuagaa

SEQ ID NO: 1104489 - RNA, 23 nt, Human
cccaguagcugggacuacaggca

SEQ ID NO: 1104490 - RNA, 24 nt, Human
ccuccuggauucaagcgauucucc

SEQ ID NO: 1104491 - RNA, 23 nt, Human
ccuggauucaagcgauucuccug

SEQ ID NO: 1104492 - RNA, 19 nt, Human
ccuuaaaccuaaauuagaa

SEQ ID NO: 1104493 - RNA, 21 nt, Human
cgaaagagacgacauucccac

SEQ ID NO: 1104494 - RNA, 24 nt, Human
cgccucggccucccaaauugcuga

SEQ ID NO: 1104495 - RNA, 24 nt, Human
cgggguuucaccauguuggacagg

SEQ ID NO: 1104496 - RNA, 24 nt, Human
cucacugcaaccuccaccuccugg

SEQ ID NO: 1104497 - RNA, 27 nt, Human
cucacugcaaccuccaccuccuggauu

SEQ ID NO: 1104498 - RNA, 24 nt, Human
cucagccuccccaguagcugggac

SEQ ID NO: 1104499 - RNA, 21 nt, Human
cucccaaauugcugagauuac

SEQ ID NO: 1104500 - RNA, 21 nt, Human
cugaccucaggugauccgccc

SEQ ID NO: 1104501 - RNA, 18 nt, Human
cugcaaccuccaccuccu

SEQ ID NO: 1104502 - RNA, 23 nt, Human
cugcaaccuccaccuccuggauu

SEQ ID NO: 1104503 - RNA, 23 nt, Human
cugccucagccuccccaguagcu

SEQ ID NO: 1104504 - RNA, 18 nt, Human
cuguggggggacaaggga

SEQ ID NO: 1104505 - RNA, 26 nt, Human
cuucugaccucaggugauccgcccgc

SEQ ID NO: 1104506 - RNA, 23 nt, Human
cuuguagccagcccaccuuaaac

SEQ ID NO: 1104507 - RNA, 23 nt, Human
gaaagagacgacauucccacaag

SEQ ID NO: 1104508 - RNA, 22 nt, Human
gaagggcuuuuaacacagcuuc

SEQ ID NO: 1104509 - RNA, 24 nt, Human
gaccucaggugauccgcccgccuc

SEQ ID NO: 1104510 - RNA, 20 nt, Human
gagacgggguuucaccaugu

SEQ ID NO: 1104511 - RNA, 18 nt, Human
gauuacaggcauaagcca

SEQ ID NO: 1104512 - RNA, 22 nt, Human
gcaaccuccaccuccuggauuc

SEQ ID NO: 1104513 - RNA, 24 nt, Human
gcgauucuccugccucagccuccc

SEQ ID NO: 1104514 - RNA, 24 nt, Human
gcuggagcgcaguggcgccaucuc

SEQ ID NO: 1104515 - RNA, 21 nt, Human
ggaauaugagggggcaguggg

SEQ ID NO: 1104516 - RNA, 20 nt, Human
ggaguuucacucugucaccc

SEQ ID NO: 1104517 - RNA, 24 nt, Human
ggcuggucucgaacuucugaccuc

SEQ ID NO: 1104518 - RNA, 23 nt, Human
gggaagccauggggugagggagu

SEQ ID NO: 1104519 - RNA, 23 nt, Human
gggaauaugagggggcagugggc

SEQ ID NO: 1104520 - RNA, 19 nt, Human
gggcaaugucucuuccuuc

SEQ ID NO: 1104521 - RNA, 21 nt, Human
gggcaaugucucuuccuucug

SEQ ID NO: 1104522 - RNA, 18 nt, Human
gggguuucaccauguugg

SEQ ID NO: 1104523 - RNA, 19 nt, Human
ggucucgaacuucugaccu

SEQ ID NO: 1104524 - RNA, 19 nt, Human
guaaaggaggaaaaaaaaa

SEQ ID NO: 1104525 - RNA, 22 nt, Human
guagacagcagccucacaucca

SEQ ID NO: 1104526 - RNA, 18 nt, Human
guagcugggacuacaggc

SEQ ID NO: 1104527 - RNA, 25 nt, Human
gucugaguaaaggaggaaaaaaaaa

SEQ ID NO: 1104528 - RNA, 24 nt, Human
gugauccgcccgccucggccuccc

SEQ ID NO: 1104529 - RNA, 23 nt, Human
guggagacgggguuucaccaugu

SEQ ID NO: 1104530 - RNA, 19 nt, Human
guuugcuucaggaugcuag

SEQ ID NO: 1104531 - RNA, 23 nt, Human
uaaaaaaaacucaucugacuaga

SEQ ID NO: 1104532 - RNA, 19 nt, Human
uaacacagcuuccugaugc

SEQ ID NO: 1104533 - RNA, 24 nt, Human
uaauuuuuguguuuuuaguggaga

SEQ ID NO: 1104534 - RNA, 24 nt, Human
uacaggcacaugccaccacgccca

SEQ ID NO: 1104535 - RNA, 18 nt, Human
uagcccuagguucucacu

SEQ ID NO: 1104536 - RNA, 24 nt, Human
uaguggagacgggguuucaccaug

SEQ ID NO: 1104537 - RNA, 19 nt, Human
ucaagcgauucuccugccu

SEQ ID NO: 1104538 - RNA, 19 nt, Human
ucaauacccaugugacaca

SEQ ID NO: 1104539 - RNA, 22 nt, Human
ucacucugucacccgggcugga

SEQ ID NO: 1104540 - RNA, 23 nt, Human
ucacucugucacccgggcuggag

SEQ ID NO: 1104541 - RNA, 19 nt, Human
ucacugcaaccuccaccuc

SEQ ID NO: 1104542 - RNA, 23 nt, Human
ucacugcaaccuccaccuccugg

SEQ ID NO: 1104543 - RNA, 24 nt, Human
ucacugcaaccuccaccuccugga

SEQ ID NO: 1104544 - RNA, 27 nt, Human
ucacugcaaccuccaccuccuggauuc

SEQ ID NO: 1104545 - RNA, 19 nt, Human
ucagccccagugaaaagcu

SEQ ID NO: 1104546 - RNA, 20 nt, Human
ucagccuccccaguagcugg

SEQ ID NO: 1104547 - RNA, 24 nt, Human
ucccaaauugcugagauuacaggc

SEQ ID NO: 1104548 - RNA, 23 nt, Human
ucccacaagcagauaaaaagagc

SEQ ID NO: 1104549 - RNA, 22 nt, Human
uccccaguagcugggacuacag

SEQ ID NO: 1104550 - RNA, 24 nt, Human
uccccaguagcugggacuacaggc

SEQ ID NO: 1104551 - RNA, 21 nt, Human
uccuggauucaagcgauucuc

SEQ ID NO: 1104552 - RNA, 24 nt, Human
uccuggauucaagcgauucuccug

SEQ ID NO: 1104553 - RNA, 18 nt, Human
ucucacucuguuggccua

SEQ ID NO: 1104554 - RNA, 27 nt, Human
ucucacucuguuggccuacgcugugaa

SEQ ID NO: 1104555 - RNA, 25 nt, Human
ucuccugccucagccuccccaguag

SEQ ID NO: 1104556 - RNA, 19 nt, Human
ucucgaacuucugaccuca

SEQ ID NO: 1104557 - RNA, 18 nt, Human
ucugucacccgggcugga

SEQ ID NO: 1104558 - RNA, 21 nt, Human
ugaccagagaagaggaagagg

SEQ ID NO: 1104559 - RNA, 18 nt, Human
ugaccucaggugauccgc

SEQ ID NO: 1104560 - RNA, 20 nt, Human
ugaccucaggugauccgccc

SEQ ID NO: 1104561 - RNA, 24 nt, Human
ugaccucaggugauccgcccgccu

SEQ ID NO: 1104562 - RNA, 20 nt, Human
ugagaccacccaaucuucca

SEQ ID NO: 1104563 - RNA, 23 nt, Human
ugagaccacccaaucuuccacga

SEQ ID NO: 1104564 - RNA, 21 nt, Human
ugagauuacaggcauaagcca

SEQ ID NO: 1104565 - RNA, 22 nt, Human
ugagauuacaggcauaagccac

SEQ ID NO: 1104566 - RNA, 23 nt, Human
ugagauuacaggcauaagccaca

SEQ ID NO: 1104567 - RNA, 26 nt, Human
ugagauuacaggcauaagccacagcg

SEQ ID NO: 1104568 - RNA, 27 nt, Human
ugagauuacaggcauaagccacagcgc

SEQ ID NO: 1104569 - RNA, 21 nt, Human
ugaguugcucuuuagcaaguc

SEQ ID NO: 1104570 - RNA, 21 nt, Human
ugcagaucacauucccaucuu

SEQ ID NO: 1104571 - RNA, 19 nt, Human
ugcccuggaacucugaugc

SEQ ID NO: 1104572 - RNA, 21 nt, Human
ugccucagccuccccaguagc

SEQ ID NO: 1104573 - RNA, 24 nt, Human
ugccucagccuccccaguagcugg

SEQ ID NO: 1104574 - RNA, 25 nt, Human
ugcugagauuacaggcauaagccac

SEQ ID NO: 1104575 - RNA, 20 nt, Human
uggaauaucaaagugcuuug

SEQ ID NO: 1104576 - RNA, 24 nt, Human
uggacaggcuggucucgaacuucu

SEQ ID NO: 1104577 - RNA, 24 nt, Human
uggauucaagcgauucuccugccu

SEQ ID NO: 1104578 - RNA, 21 nt, Human
uggccgaugacgaguauccuu

SEQ ID NO: 1104579 - RNA, 21 nt, Human
ugggacuacaggcacaugcca

SEQ ID NO: 1104580 - RNA, 22 nt, Human
ugggacuacaggcacaugccac

SEQ ID NO: 1104581 - RNA, 24 nt, Human
ugggacuacaggcacaugccacca

SEQ ID NO: 1104582 - RNA, 20 nt, Human
ugugacacaguccaagugcu

SEQ ID NO: 1104583 - RNA, 21 nt, Human
uguguuuuuaguggagacggg

SEQ ID NO: 1104584 - RNA, 24 nt, Human
uguuuguuuucugagauggaguuu

SEQ ID NO: 1104585 - RNA, 21 nt, Human
uuaaaccuaaauuagaagcuu

SEQ ID NO: 1104586 - RNA, 18 nt, Human
uuaguggagacgggguuu

SEQ ID NO: 1104587 - RNA, 22 nt, Human
uuaguggagacgggguuucacc

SEQ ID NO: 1104588 - RNA, 24 nt, Human
uuaguggagacgggguuucaccau

SEQ ID NO: 1104589 - RNA, 21 nt, Human
uucaagcgauucuccugccuc

SEQ ID NO: 1104590 - RNA, 23 nt, Human
uucaagcgauucuccugccucag

SEQ ID NO: 1104591 - RNA, 24 nt, Human
uucaagcgauucuccugccucagc

SEQ ID NO: 1104592 - RNA, 25 nt, Human
uugauggugguuguaguuuuguuuc

SEQ ID NO: 1104593 - RNA, 18 nt, Human
uugcuucaggaugcuagg

SEQ ID NO: 1104594 - RNA, 22 nt, Human
uuucaaguugggaagccauggg

SEQ ID NO: 1104595 - RNA, 21 nt, Human
uuucaccauguuggacaggcu

SEQ ID NO: 1104596 - RNA, 24 nt, Human
uuucacucugucacccgggcugga

SEQ ID NO: 1104597 - RNA, 19 nt, Human
uuucucaccucucccugga

SEQ ID NO: 1104598 - RNA, 19 nt, Human
uuugcccugcuucccagac

SEQ ID NO: 1104599 - RNA, 24 nt, Human
uuuuuaguggagacgggguuucac

SEQ ID NO: 1104600 - RNA, 20 nt, Human
uuuuuguguuuuuaguggag

SEQ ID NO: 1104601 - RNA, 18 nt, Human
cccagaaagaaaguaaca

SEQ ID NO: 1104602 - RNA, 18 nt, Human
ggacagauacauaaugcc

SEQ ID NO: 1104603 - RNA, 19 nt, Human
ggacagauacauaaugccu

SEQ ID NO: 1104604 - RNA, 20 nt, Human
ugcccagaaagaaaguaaca

SEQ ID NO: 1104605 - RNA, 21 nt, Human
ugcccagaaagaaaguaacag

SEQ ID NO: 1104606 - RNA, 20 nt, Human
uggacagauacauaaugccu

SEQ ID NO: 1104607 - RNA, 22 nt, Human
agcagcgaguaauuucagggca

SEQ ID NO: 1104608 - RNA, 18 nt, Human
augaaucuuguguucacc

SEQ ID NO: 1104609 - RNA, 24 nt, Human
auggugaugaaaauaaaaugaauc

SEQ ID NO: 1104610 - RNA, 19 nt, Human
caacaacaggauacguccc

SEQ ID NO: 1104611 - RNA, 22 nt, Human
ccucaccccguuuaguuccgga

SEQ ID NO: 1104612 - RNA, 24 nt, Human
cguuagagauaaccgaaugugacc

SEQ ID NO: 1104613 - RNA, 22 nt, Human
gaguaauuucagggcaagccca

SEQ ID NO: 1104614 - RNA, 25 nt, Human
uaaaaaccugaugaaaagugguuaa

SEQ ID NO: 1104615 - RNA, 20 nt, Human
uaauggguguuagcuccauc

SEQ ID NO: 1104616 - RNA, 23 nt, Human
ugacccagagaacucaacaacag

SEQ ID NO: 1104617 - RNA, 18 nt, Human
uuaguuccggaggcggcg

SEQ ID NO: 1104618 - RNA, 21 nt, Human
uuguguucaccguuguauucc

SEQ ID NO: 1104619 - RNA, 24 nt, Human
acugcaccagugaauccugagcag

SEQ ID NO: 1104620 - RNA, 20 nt, Human
aguucaguagguggaccugu

SEQ ID NO: 1104621 - RNA, 27 nt, Human
ccugagcagguucuagucgaccucggu

SEQ ID NO: 1104622 - RNA, 23 nt, Human
cucuggugcaguuaaagccuuau

SEQ ID NO: 1104623 - RNA, 23 nt, Human
uccgcagguacagagcucacaua

SEQ ID NO: 1104624 - RNA, 19 nt, Human
uuggguguaacuuucagac

SEQ ID NO: 1104625 - RNA, 26 nt, Human
uuuguacauaaauaguuguuuacaug

SEQ ID NO: 1104626 - RNA, 19 nt, Human
aaacaagccuaaguugaau

SEQ ID NO: 1104627 - RNA, 22 nt, Human
aaacacgcaugaaugauaccau

SEQ ID NO: 1104628 - RNA, 18 nt, Human
aaauaugaaggcuaaacc

SEQ ID NO: 1104629 - RNA, 18 nt, Human
aaaugcuagaaguuauau

SEQ ID NO: 1104630 - RNA, 19 nt, Human
aacaacagccacugacuug

SEQ ID NO: 1104631 - RNA, 18 nt, Human
aacacgguaaacagcauu

SEQ ID NO: 1104632 - RNA, 19 nt, Human
aacugaauauuccuaaccu

SEQ ID NO: 1104633 - RNA, 20 nt, Human
aagcagucgggggaggucaa

SEQ ID NO: 1104634 - RNA, 22 nt, Human
aagcuggacuuucaacaacaac

SEQ ID NO: 1104635 - RNA, 21 nt, Human
aaguuuauuuagaaaguucug

SEQ ID NO: 1104636 - RNA, 22 nt, Human
aauauaccucaaaaaagcugga

SEQ ID NO: 1104637 - RNA, 19 nt, Human
accauggcaugaaaaugcu

SEQ ID NO: 1104638 - RNA, 18 nt, Human
agaaaaucaaauacauca

SEQ ID NO: 1104639 - RNA, 22 nt, Human
agaaacacagaaaucuaaaagc

SEQ ID NO: 1104640 - RNA, 21 nt, Human
agaacaacagccacugacuug

SEQ ID NO: 1104641 - RNA, 21 nt, Human
agaauaauuuaaagccugaaa

SEQ ID NO: 1104642 - RNA, 21 nt, Human
agauagaacuucuaacagccc

SEQ ID NO: 1104643 - RNA, 19 nt, Human
agauaucacagucuuaaaa

SEQ ID NO: 1104644 - RNA, 21 nt, Human
agcaagacagaacaacagcca

SEQ ID NO: 1104645 - RNA, 19 nt, Human
agcuggacuuucaacaaca

SEQ ID NO: 1104646 - RNA, 21 nt, Human
agcuugccuuuugcucuccca

SEQ ID NO: 1104647 - RNA, 25 nt, Human
aggaaaaguagaaaagcugucagac

SEQ ID NO: 1104648 - RNA, 20 nt, Human
caagacagaacaacagccac

SEQ ID NO: 1104649 - RNA, 22 nt, Human
cacaaagcuacuucguggacac

SEQ ID NO: 1104650 - RNA, 19 nt, Human
caccauaaaguuaggcaac

SEQ ID NO: 1104651 - RNA, 24 nt, Human
cacgaacaugcacgauaccauggu

SEQ ID NO: 1104652 - RNA, 22 nt, Human
cacugcuauauguaaggcggac

SEQ ID NO: 1104653 - RNA, 20 nt, Human
cagcaagacagaacaacagc

SEQ ID NO: 1104654 - RNA, 21 nt, Human
cagccuuggacuucuguuucu

SEQ ID NO: 1104655 - RNA, 24 nt, Human
caggaagaacauuaccuucagaaa

SEQ ID NO: 1104656 - RNA, 18 nt, Human
caguacugcaaaccagcc

SEQ ID NO: 1104657 - RNA, 22 nt, Human
ccaaaacacgguaaacagcauu

SEQ ID NO: 1104658 - RNA, 20 nt, Human
ccuucuauaaaccuacagaa

SEQ ID NO: 1104659 - RNA, 21 nt, Human
ccuuuugcucucccauaccac

SEQ ID NO: 1104660 - RNA, 23 nt, Human
cggugccgggcuacguaugugua

SEQ ID NO: 1104661 - RNA, 20 nt, Human
cguuacguuugaccaaaaca

SEQ ID NO: 1104662 - RNA, 19 nt, Human
cugcgaucacaaagcuacu

SEQ ID NO: 1104663 - RNA, 19 nt, Human
cuggagucaaauguuuugg

SEQ ID NO: 1104664 - RNA, 24 nt, Human
cuuaaaguucuacugaaugucaaa

SEQ ID NO: 1104665 - RNA, 20 nt, Human
cuugaaaacaggaagaacau

SEQ ID NO: 1104666 - RNA, 21 nt, Human
cuuuuuggcaagaagcacuag

SEQ ID NO: 1104667 - RNA, 19 nt, Human
gaaaaguagaaaagcuguc

SEQ ID NO: 1104668 - RNA, 21 nt, Human
gaaaaugcuagaaguuauaug

SEQ ID NO: 1104669 - RNA, 21 nt, Human
gaaacacagaaaucuaaaagc

SEQ ID NO: 1104670 - RNA, 20 nt, Human
gaaacuuggugauuucugcu

SEQ ID NO: 1104671 - RNA, 24 nt, Human
gaacuauucaaacacgcaugaaug

SEQ ID NO: 1104672 - RNA, 18 nt, Human
gaacugaauauuccuaac

SEQ ID NO: 1104673 - RNA, 22 nt, Human
gaacugaauauuccuaaccuca

SEQ ID NO: 1104674 - RNA, 22 nt, Human
gaguacacagucagcuauacag

SEQ ID NO: 1104675 - RNA, 18 nt, Human
gaguucacuaugaaugua

SEQ ID NO: 1104676 - RNA, 24 nt, Human
ggacuugaauagaagccauggugg

SEQ ID NO: 1104677 - RNA, 20 nt, Human
gggaagaaaacugcaaaugc

SEQ ID NO: 1104678 - RNA, 18 nt, Human
gguaaacagcauuagcuu

SEQ ID NO: 1104679 - RNA, 23 nt, Human
guaucagacagcaagacagaaca

SEQ ID NO: 1104680 - RNA, 20 nt, Human
gugaacucuucaucagcauc

SEQ ID NO: 1104681 - RNA, 25 nt, Human
guucacuaaauuucaucucucucuu

SEQ ID NO: 1104682 - RNA, 26 nt, Human
uaaaagcaaaacagcuguuguguaua

SEQ ID NO: 1104683 - RNA, 24 nt, Human
uaaaccuucuauaaaccuacagaa

SEQ ID NO: 1104684 - RNA, 22 nt, Human
uaacuggacuugaauagaagcc

SEQ ID NO: 1104685 - RNA, 19 nt, Human
uaacuugagcccucacugg

SEQ ID NO: 1104686 - RNA, 19 nt, Human
uacaaguauuuaaggacac

SEQ ID NO: 1104687 - RNA, 20 nt, Human
uaccauggcaugaaaaugcu

SEQ ID NO: 1104688 - RNA, 24 nt, Human
uaccauggcaugaaaaugcuagaa

SEQ ID NO: 1104689 - RNA, 23 nt, Human
uacugugcacauauuccgauauu

SEQ ID NO: 1104690 - RNA, 24 nt, Human
uauauggauacaaugauaguggaa

SEQ ID NO: 1104691 - RNA, 20 nt, Human
uaucagacagcaagacagaa

SEQ ID NO: 1104692 - RNA, 21 nt, Human
uaugagcaccuuuucaauucu

SEQ ID NO: 1104693 - RNA, 22 nt, Human
uauguaaggcggacagaagaua

SEQ ID NO: 1104694 - RNA, 21 nt, Human
ucaaaaaagcuggacuuucaa

SEQ ID NO: 1104695 - RNA, 19 nt, Human
ucagacagcaagacagaac

SEQ ID NO: 1104696 - RNA, 19 nt, Human
ucaugauacagguguaaga

SEQ ID NO: 1104697 - RNA, 21 nt, Human
ucccauaccaccugugaacuc

SEQ ID NO: 1104698 - RNA, 20 nt, Human
ucgccagccuuggacuucug

SEQ ID NO: 1104699 - RNA, 20 nt, Human
ucuauaaaccuacagaaugc

SEQ ID NO: 1104700 - RNA, 26 nt, Human
ugaaaagccccacucucguaucagac

SEQ ID NO: 1104701 - RNA, 20 nt, Human
ugaacucuucaucagcauca

SEQ ID NO: 1104702 - RNA, 21 nt, Human
ugaccaaaacacgguaaacag

SEQ ID NO: 1104703 - RNA, 24 nt, Human
ugagaaaagucagguaugucaaga

SEQ ID NO: 1104704 - RNA, 20 nt, Human
ugauacagguguaagacucc

SEQ ID NO: 1104705 - RNA, 20 nt, Human
ugauaccaugauaccacgaa

SEQ ID NO: 1104706 - RNA, 19 nt, Human
ugccuagucugaggucagc

SEQ ID NO: 1104707 - RNA, 26 nt, Human
ugccuuuugcucucccauaccaccug

SEQ ID NO: 1104708 - RNA, 18 nt, Human
uggacuuucaacaacaac

SEQ ID NO: 1104709 - RNA, 20 nt, Human
uggagucaaauguuuuggcc

SEQ ID NO: 1104710 - RNA, 19 nt, Human
ugggugauccauaacgacc

SEQ ID NO: 1104711 - RNA, 23 nt, Human
uguauacaagcaauuaaaauaug

SEQ ID NO: 1104712 - RNA, 24 nt, Human
uuacaaaauaggaggucaccauaa

SEQ ID NO: 1104713 - RNA, 20 nt, Human
uuagaaaguucuguuaccaa

SEQ ID NO: 1104714 - RNA, 23 nt, Human
uuagcuugccuuuugcucuccca

SEQ ID NO: 1104715 - RNA, 20 nt, Human
uuaguucacugaaaagcccc

SEQ ID NO: 1104716 - RNA, 22 nt, Human
uucauugccucaaaauauaguc

SEQ ID NO: 1104717 - RNA, 19 nt, Human
uugcaucacggugccgggc

SEQ ID NO: 1104718 - RNA, 24 nt, Human
uuuaaggacaccuuugauacuugg

SEQ ID NO: 1104719 - RNA, 25 nt, Human
uuuuuaguugcugcuauggccagaa

SEQ ID NO: 1104720 - RNA, 21 nt, Human
agaccgcggggcagaugggac

SEQ ID NO: 1104721 - RNA, 21 nt, Human
aggcaggcacacaggagaagg

SEQ ID NO: 1104722 - RNA, 23 nt, Human
agggggcugaggguggagaggcc

SEQ ID NO: 1104723 - RNA, 21 nt, Human
cagaugggaccgcugccuccc

SEQ ID NO: 1104724 - RNA, 23 nt, Human
caggcacacaggagaagggcugg

SEQ ID NO: 1104725 - RNA, 23 nt, Human
ccgcugccucccugccuccuggg

SEQ ID NO: 1104726 - RNA, 18 nt, Human
gaagcauggggaagggac

SEQ ID NO: 1104727 - RNA, 21 nt, Human
gaagcauggggaagggacuga

SEQ ID NO: 1104728 - RNA, 19 nt, Human
gaccgcugccucccugccu

SEQ ID NO: 1104729 - RNA, 18 nt, Human
gcagaugggaccgcugcc

SEQ ID NO: 1104730 - RNA, 24 nt, Human
guggcggcggcaggaggcaggcac

SEQ ID NO: 1104731 - RNA, 21 nt, Human
ugaagcagggggcugagggug

SEQ ID NO: 1104732 - RNA, 23 nt, Human
aaacauggcguucccauaccccc

SEQ ID NO: 1104733 - RNA, 18 nt, Human
aagccaaccccaagacua

SEQ ID NO: 1104734 - RNA, 19 nt, Human
aagccagacugcccaggcu

SEQ ID NO: 1104735 - RNA, 22 nt, Human
aagcuccaggcuugggccucac

SEQ ID NO: 1104736 - RNA, 24 nt, Human
aaggcccagcugacacccuccaca

SEQ ID NO: 1104737 - RNA, 22 nt, Human
aaggggcagcagcagagcuggg

SEQ ID NO: 1104738 - RNA, 20 nt, Human
aaguggcagcuugcggugcc

SEQ ID NO: 1104739 - RNA, 20 nt, Human
aaguugcccacaugcccgcc

SEQ ID NO: 1104740 - RNA, 21 nt, Human
acaaaaccccaggacccuggc

SEQ ID NO: 1104741 - RNA, 18 nt, Human
acagguaggggcucuggg

SEQ ID NO: 1104742 - RNA, 21 nt, Human
acauggcguucccauaccccc

SEQ ID NO: 1104743 - RNA, 19 nt, Human
acccucaucccagccccau

SEQ ID NO: 1104744 - RNA, 20 nt, Human
acuuggguugggggcccuuc

SEQ ID NO: 1104745 - RNA, 19 nt, Human
agacccucuccuucccacu

SEQ ID NO: 1104746 - RNA, 20 nt, Human
agaccuguuuuguccccaag

SEQ ID NO: 1104747 - RNA, 22 nt, Human
agcccaccgugucccagaccaa

SEQ ID NO: 1104748 - RNA, 22 nt, Human
aggagaccuuagccuagagucc

SEQ ID NO: 1104749 - RNA, 21 nt, Human
aggcaggcucugcccaggggg

SEQ ID NO: 1104750 - RNA, 19 nt, Human
aggcagggccucuguggcu

SEQ ID NO: 1104751 - RNA, 20 nt, Human
aggcagggccucuguggcuu

SEQ ID NO: 1104752 - RNA, 18 nt, Human
aggcaggggucugcaccc

SEQ ID NO: 1104753 - RNA, 21 nt, Human
aggcagugagggcucagguga

SEQ ID NO: 1104754 - RNA, 18 nt, Human
agggguguccuaaagugc

SEQ ID NO: 1104755 - RNA, 22 nt, Human
agguacauaggagccaaagaca

SEQ ID NO: 1104756 - RNA, 22 nt, Human
agucaggugggcacaggucaga

SEQ ID NO: 1104757 - RNA, 24 nt, Human
auauucaucuaucugucccacacg

SEQ ID NO: 1104758 - RNA, 18 nt, Human
auggcguucccauacccc

SEQ ID NO: 1104759 - RNA, 21 nt, Human
caaaggcccagcugacacccu

SEQ ID NO: 1104760 - RNA, 19 nt, Human
caagccaaccccaagacua

SEQ ID NO: 1104761 - RNA, 20 nt, Human
caagccaaccccaagacuac

SEQ ID NO: 1104762 - RNA, 27 nt, Human
caaggugggcagcaucccaggaggccc

SEQ ID NO: 1104763 - RNA, 20 nt, Human
cacccugucagccaccuugu

SEQ ID NO: 1104764 - RNA, 24 nt, Human
caccucacucccucagcucuugcc

SEQ ID NO: 1104765 - RNA, 23 nt, Human
caccuggguaagcuccaggcuug

SEQ ID NO: 1104766 - RNA, 23 nt, Human
cacuggccacccucgcaucccag

SEQ ID NO: 1104767 - RNA, 23 nt, Human
cacuuccacuuuacagguagggg

SEQ ID NO: 1104768 - RNA, 18 nt, Human
cacuuuguucaucuguga

SEQ ID NO: 1104769 - RNA, 19 nt, Human
cagcacaaaaccccaggac

SEQ ID NO: 1104770 - RNA, 22 nt, Human
cagcacaaaaccccaggacccu

SEQ ID NO: 1104771 - RNA, 18 nt, Human
cagcagagcuggggccuc

SEQ ID NO: 1104772 - RNA, 23 nt, Human
cagcagaguugcauucaucuccc

SEQ ID NO: 1104773 - RNA, 22 nt, Human
cagcagcagagcuggggccucg

SEQ ID NO: 1104774 - RNA, 23 nt, Human
cagccacugggccacaaguuccu

SEQ ID NO: 1104775 - RNA, 21 nt, Human
cagcccccugcacugagggag

SEQ ID NO: 1104776 - RNA, 22 nt, Human
cagccuguuucaccucauccug

SEQ ID NO: 1104777 - RNA, 19 nt, Human
cagcucaccugaccuccag

SEQ ID NO: 1104778 - RNA, 23 nt, Human
cagcugcaccaagccaaccccaa

SEQ ID NO: 1104779 - RNA, 18 nt, Human
cagggcaggcacugcggc

SEQ ID NO: 1104780 - RNA, 26 nt, Human
cagggccucuguggcuuaccucggcc

SEQ ID NO: 1104781 - RNA, 23 nt, Human
caggggugauaagggaaggggca

SEQ ID NO: 1104782 - RNA, 20 nt, Human
caggguuccucacccaggca

SEQ ID NO: 1104783 - RNA, 21 nt, Human
cagguacauaggagccaaaga

SEQ ID NO: 1104784 - RNA, 20 nt, Human
caguaggcagacgaagagug

SEQ ID NO: 1104785 - RNA, 22 nt, Human
cagugguugagacuguggacac

SEQ ID NO: 1104786 - RNA, 26 nt, Human
caucucgccagaccuggguccgagca

SEQ ID NO: 1104787 - RNA, 22 nt, Human
ccaagacuacuugucuccaccc

SEQ ID NO: 1104788 - RNA, 21 nt, Human
ccaagcccaccgugucccaga

SEQ ID NO: 1104789 - RNA, 25 nt, Human
ccagaccaaacauggcguucccaua

SEQ ID NO: 1104790 - RNA, 24 nt, Human
ccagaggcuggggguccucaggca

SEQ ID NO: 1104791 - RNA, 24 nt, Human
ccaggaaggggucccucaagucuc

SEQ ID NO: 1104792 - RNA, 24 nt, Human
ccaucacagcaugcucccagcugu

SEQ ID NO: 1104793 - RNA, 18 nt, Human
cccaccgugucccagacc

SEQ ID NO: 1104794 - RNA, 21 nt, Human
cccaccgugucccagaccaaa

SEQ ID NO: 1104795 - RNA, 21 nt, Human
cccaggcuuaacuccaccuuc

SEQ ID NO: 1104796 - RNA, 22 nt, Human
cccauacccccggccucaccuc

SEQ ID NO: 1104797 - RNA, 22 nt, Human
ccccaaaggucucugacccucc

SEQ ID NO: 1104798 - RNA, 19 nt, Human
ccccaagacuacuugucuc

SEQ ID NO: 1104799 - RNA, 21 nt, Human
ccccaagacuacuugucucca

SEQ ID NO: 1104800 - RNA, 19 nt, Human
ccccaggacccuggcucug

SEQ ID NO: 1104801 - RNA, 22 nt, Human
cccccggccucaccucagagac

SEQ ID NO: 1104802 - RNA, 21 nt, Human
ccccgcaccccccagcugcac

SEQ ID NO: 1104803 - RNA, 22 nt, Human
ccccgcaccccccagcugcacc

SEQ ID NO: 1104804 - RNA, 24 nt, Human
ccccgcaccccccagcugcaccaa

SEQ ID NO: 1104805 - RNA, 21 nt, Human
ccccgcaccuggguaagcucc

SEQ ID NO: 1104806 - RNA, 26 nt, Human
ccccggccucaccucagagacacucc

SEQ ID NO: 1104807 - RNA, 20 nt, Human
ccccucuccauucuuuucca

SEQ ID NO: 1104808 - RNA, 21 nt, Human
ccccugcacugagggagcaag

SEQ ID NO: 1104809 - RNA, 22 nt, Human
cccgccagccagggccuaaagc

SEQ ID NO: 1104810 - RNA, 22 nt, Human
cccuccggaggggccuggcugc

SEQ ID NO: 1104811 - RNA, 18 nt, Human
cccucuccauucuuuucc

SEQ ID NO: 1104812 - RNA, 18 nt, Human
cccucuccuucccacucu

SEQ ID NO: 1104813 - RNA, 19 nt, Human
cccucuccuucccacucug

SEQ ID NO: 1104814 - RNA, 21 nt, Human
cccuugugaccaucugggcug

SEQ ID NO: 1104815 - RNA, 22 nt, Human
ccgcaccccccagcugcaccaa

SEQ ID NO: 1104816 - RNA, 21 nt, Human
ccuaaagugccucccccugua

SEQ ID NO: 1104817 - RNA, 19 nt, Human
ccuaagggguguccuaaag

SEQ ID NO: 1104818 - RNA, 21 nt, Human
ccugcccagcacaaaacccca

SEQ ID NO: 1104819 - RNA, 21 nt, Human
ccugggccccaaggcagaccc

SEQ ID NO: 1104820 - RNA, 24 nt, Human
ccugggccccaaggcagacccagg

SEQ ID NO: 1104821 - RNA, 22 nt, Human
cgagcagccuuuuugacucucc

SEQ ID NO: 1104822 - RNA, 22 nt, Human
cucccucagcucuugccagcuu

SEQ ID NO: 1104823 - RNA, 18 nt, Human
cucuccuagacagcucac

SEQ ID NO: 1104824 - RNA, 23 nt, Human
cucugcacgccuggggcagggac

SEQ ID NO: 1104825 - RNA, 21 nt, Human
cucugcccaggggguuggugu

SEQ ID NO: 1104826 - RNA, 24 nt, Human
cugaaauaaaggauugaaaacggu

SEQ ID NO: 1104827 - RNA, 23 nt, Human
cugcaucugugccucccagcccc

SEQ ID NO: 1104828 - RNA, 24 nt, Human
cugcaucugugccucccagccccc

SEQ ID NO: 1104829 - RNA, 22 nt, Human
cugggccccaaggcagacccag

SEQ ID NO: 1104830 - RNA, 24 nt, Human
cuggggcagggacuuuugaguuua

SEQ ID NO: 1104831 - RNA, 25 nt, Human
cuguagccaucccaagcccaccgug

SEQ ID NO: 1104832 - RNA, 22 nt, Human
cuguauucccccucccagggca

SEQ ID NO: 1104833 - RNA, 23 nt, Human
cuuaccucggccccucuccugac

SEQ ID NO: 1104834 - RNA, 18 nt, Human
cuucaguaggcagacgaa

SEQ ID NO: 1104835 - RNA, 24 nt, Human
gaaaacgguuccuguucagacuga

SEQ ID NO: 1104836 - RNA, 24 nt, Human
gagaacacuuuguaaacuugcuga

SEQ ID NO: 1104837 - RNA, 18 nt, Human
gagacccucuccuuccca

SEQ ID NO: 1104838 - RNA, 21 nt, Human
gagaggcuccagccacugggc

SEQ ID NO: 1104839 - RNA, 19 nt, Human
gagcaagggauccugcagc

SEQ ID NO: 1104840 - RNA, 18 nt, Human
gagcaggccacagaacgc

SEQ ID NO: 1104841 - RNA, 19 nt, Human
gaggcuggggguccucagg

SEQ ID NO: 1104842 - RNA, 20 nt, Human
gaguucacagggugucaggg

SEQ ID NO: 1104843 - RNA, 24 nt, Human
gauccugcagcugcguaugcccag

SEQ ID NO: 1104844 - RNA, 21 nt, Human
gcaccccccagcugcaccaag

SEQ ID NO: 1104845 - RNA, 20 nt, Human
gcagccugggccccaaggca

SEQ ID NO: 1104846 - RNA, 21 nt, Human
gcccacaugcccgccagccag

SEQ ID NO: 1104847 - RNA, 22 nt, Human
gcccaccgugucccagaccaaa

SEQ ID NO: 1104848 - RNA, 23 nt, Human
gccccuaacucaucuugaggccc

SEQ ID NO: 1104849 - RNA, 20 nt, Human
gcccuaagugaggguuucug

SEQ ID NO: 1104850 - RNA, 21 nt, Human
gcuccagccacugggccacaa

SEQ ID NO: 1104851 - RNA, 18 nt, Human
gcuguacaccaucacagc

SEQ ID NO: 1104852 - RNA, 18 nt, Human
gcuuguuccugggcuaga

SEQ ID NO: 1104853 - RNA, 20 nt, Human
ggaaggggcagcagcagagc

SEQ ID NO: 1104854 - RNA, 18 nt, Human
ggcagcagcagagcuggg

SEQ ID NO: 1104855 - RNA, 22 nt, Human
ggcagcuugcggugccuuuagg

SEQ ID NO: 1104856 - RNA, 22 nt, Human
ggccaugaggcccuaagugagg

SEQ ID NO: 1104857 - RNA, 20 nt, Human
ggccucuguggcuuaccucg

SEQ ID NO: 1104858 - RNA, 20 nt, Human
ggccugggggucggagaggg

SEQ ID NO: 1104859 - RNA, 22 nt, Human
ggccuguuugggucccuggagg

SEQ ID NO: 1104860 - RNA, 19 nt, Human
gggcagcagcagagcuggg

SEQ ID NO: 1104861 - RNA, 21 nt, Human
gggcagcagcagagcuggggc

SEQ ID NO: 1104862 - RNA, 22 nt, Human
gggcagcagcagagcuggggcc

SEQ ID NO: 1104863 - RNA, 24 nt, Human
gggcucaggugagaggcuccagcc

SEQ ID NO: 1104864 - RNA, 20 nt, Human
gggcuuguuccugggcuaga

SEQ ID NO: 1104865 - RNA, 21 nt, Human
gggggugucaggcccagacug

SEQ ID NO: 1104866 - RNA, 20 nt, Human
ggucugcacccucacucagg

SEQ ID NO: 1104867 - RNA, 22 nt, Human
gugcagccugggccccaaggca

SEQ ID NO: 1104868 - RNA, 23 nt, Human
gugcagccugggccccaaggcag

SEQ ID NO: 1104869 - RNA, 23 nt, Human
guggcuuaccucggccccucucc

SEQ ID NO: 1104870 - RNA, 22 nt, Human
gugucauuguccccucuccauu

SEQ ID NO: 1104871 - RNA, 22 nt, Human
gugugcgcguggaucagggcag

SEQ ID NO: 1104872 - RNA, 19 nt, Human
guguuggggcaaaggggcu

SEQ ID NO: 1104873 - RNA, 19 nt, Human
uaagggaaggggcagcagc

SEQ ID NO: 1104874 - RNA, 21 nt, Human
uaaguccccaguucuccuggc

SEQ ID NO: 1104875 - RNA, 24 nt, Human
uaaguccccaguucuccuggcucu

SEQ ID NO: 1104876 - RNA, 21 nt, Human
uaccaagacaggcagggccuc

SEQ ID NO: 1104877 - RNA, 22 nt, Human
uaccccaggaaggggucccuca

SEQ ID NO: 1104878 - RNA, 23 nt, Human
uaguggcuucaaaggcccagcug

SEQ ID NO: 1104879 - RNA, 21 nt, Human
uaucugucccacacgugugcg

SEQ ID NO: 1104880 - RNA, 23 nt, Human
ucacagcaugcucccagcugugu

SEQ ID NO: 1104881 - RNA, 22 nt, Human
ucacuggccacccucgcauccc

SEQ ID NO: 1104882 - RNA, 19 nt, Human
ucaggaugguugcgcaguc

SEQ ID NO: 1104883 - RNA, 19 nt, Human
ucagggcaggcacugcggc

SEQ ID NO: 1104884 - RNA, 19 nt, Human
uccacauggcagcccgagc

SEQ ID NO: 1104885 - RNA, 21 nt, Human
uccacccucaucccagcccca

SEQ ID NO: 1104886 - RNA, 25 nt, Human
ucccaagcccaccgugucccagacc

SEQ ID NO: 1104887 - RNA, 23 nt, Human
ucccacucugucccucuccuaga

SEQ ID NO: 1104888 - RNA, 22 nt, Human
ucccauaagacugagcccucuc

SEQ ID NO: 1104889 - RNA, 23 nt, Human
ucccauacccccggccucaccuc

SEQ ID NO: 1104890 - RNA, 22 nt, Human
uccccgcaccccccagcugcac

SEQ ID NO: 1104891 - RNA, 23 nt, Human
uccccucuccauucuuuuccaca

SEQ ID NO: 1104892 - RNA, 18 nt, Human
ucccucagcucuugccag

SEQ ID NO: 1104893 - RNA, 20 nt, Human
ucccucagcucuugccagcu

SEQ ID NO: 1104894 - RNA, 22 nt, Human
ucccucagcucuugccagcuuc

SEQ ID NO: 1104895 - RNA, 23 nt, Human
ucccucagcucuugccagcuucu

SEQ ID NO: 1104896 - RNA, 24 nt, Human
ucccugaugaucacaggcaggggu

SEQ ID NO: 1104897 - RNA, 21 nt, Human
uccggaggggccuggcugcca

SEQ ID NO: 1104898 - RNA, 20 nt, Human
uccucaggcagugagggcuc

SEQ ID NO: 1104899 - RNA, 20 nt, Human
uccugcagcugcguaugccc

SEQ ID NO: 1104900 - RNA, 22 nt, Human
uccugggccagccagaggaccc

SEQ ID NO: 1104901 - RNA, 19 nt, Human
uccuucccacucugucccu

SEQ ID NO: 1104902 - RNA, 18 nt, Human
uccuuggggucugucacu

SEQ ID NO: 1104903 - RNA, 21 nt, Human
uccuuggggucugucacuggc

SEQ ID NO: 1104904 - RNA, 20 nt, Human
uccuuuggcaagaaagccga

SEQ ID NO: 1104905 - RNA, 21 nt, Human
ucuacauuugcuugugagaga

SEQ ID NO: 1104906 - RNA, 19 nt, Human
ucuccacccucaucccagc

SEQ ID NO: 1104907 - RNA, 21 nt, Human
ucuccacccucaucccagccc

SEQ ID NO: 1104908 - RNA, 18 nt, Human
ucucccagcuggcauccc

SEQ ID NO: 1104909 - RNA, 24 nt, Human
ucuccuagacagcucaccugaccu

SEQ ID NO: 1104910 - RNA, 21 nt, Human
ucuccuggcucuccuuucuga

SEQ ID NO: 1104911 - RNA, 22 nt, Human
ucucugacacuuggguuggggg

SEQ ID NO: 1104912 - RNA, 21 nt, Human
ucuguauuuucuaagucccca

SEQ ID NO: 1104913 - RNA, 27 nt, Human
ucugucccucuccuagacagcucaccu

SEQ ID NO: 1104914 - RNA, 22 nt, Human
ucuugccagcuucucugacacu

SEQ ID NO: 1104915 - RNA, 23 nt, Human
ugaaaacgguuccuguucagacu

SEQ ID NO: 1104916 - RNA, 23 nt, Human
ugacacccuccacagccuaaggg

SEQ ID NO: 1104917 - RNA, 21 nt, Human
ugacccucccauccccgcacc

SEQ ID NO: 1104918 - RNA, 19 nt, Human
ugaccuccagcuuccaucu

SEQ ID NO: 1104919 - RNA, 20 nt, Human
ugaccuccagcuuccaucuc

SEQ ID NO: 1104920 - RNA, 18 nt, Human
ugagaacaagguggcggg

SEQ ID NO: 1104921 - RNA, 19 nt, Human
ugagaacaagguggcgggu

SEQ ID NO: 1104922 - RNA, 22 nt, Human
ugagcccucucauggggguuuu

SEQ ID NO: 1104923 - RNA, 24 nt, Human
ugaggccagaggcuggggguccuc

SEQ ID NO: 1104924 - RNA, 18 nt, Human
ugaggcggcaugcaggcg

SEQ ID NO: 1104925 - RNA, 20 nt, Human
ugaguucacagggugucagg

SEQ ID NO: 1104926 - RNA, 24 nt, Human
ugccucccccuguauucccccucc

SEQ ID NO: 1104927 - RNA, 20 nt, Human
ugccuggcugguggccauuc

SEQ ID NO: 1104928 - RNA, 20 nt, Human
ugcugaacaguagccagguu

SEQ ID NO: 1104929 - RNA, 22 nt, Human
ugcugagccugcaucugugccu

SEQ ID NO: 1104930 - RNA, 26 nt, Human
uggaggcauuucccauaagacugagc

SEQ ID NO: 1104931 - RNA, 22 nt, Human
uggaucagggcaggcacugcgg

SEQ ID NO: 1104932 - RNA, 20 nt, Human
uggcaaagggugggaaauga

SEQ ID NO: 1104933 - RNA, 23 nt, Human
uggcaagaaagccgagucgagac

SEQ ID NO: 1104934 - RNA, 21 nt, Human
ugggccccaaggcagacccag

SEQ ID NO: 1104935 - RNA, 22 nt, Human
ugggccccaaggcagacccagg

SEQ ID NO: 1104936 - RNA, 18 nt, Human
ugggcuggcagggaggcu

SEQ ID NO: 1104937 - RNA, 24 nt, Human
ugggggcccuuccaggaggaaacc

SEQ ID NO: 1104938 - RNA, 19 nt, Human
ugggugccccacacagggc

SEQ ID NO: 1104939 - RNA, 22 nt, Human
ugggugccccacacagggcucu

SEQ ID NO: 1104940 - RNA, 21 nt, Human
uguaaacuugcugaacaguag

SEQ ID NO: 1104941 - RNA, 18 nt, Human
ugucccagaccaaacaug

SEQ ID NO: 1104942 - RNA, 21 nt, Human
uguccccaaggcuggcuggca

SEQ ID NO: 1104943 - RNA, 22 nt, Human
uguccccucuccauucuuuucc

SEQ ID NO: 1104944 - RNA, 19 nt, Human
uguguuggggcaaaggggc

SEQ ID NO: 1104945 - RNA, 21 nt, Human
uguuccugggcuagaucugug

SEQ ID NO: 1104946 - RNA, 24 nt, Human
uuagccuagaguccuuggggucug

SEQ ID NO: 1104947 - RNA, 25 nt, Human
uuggaggcauuucccauaagacuga

SEQ ID NO: 1104948 - RNA, 22 nt, Human
uuucuggaucuguggucaggau

SEQ ID NO: 1104949 - RNA, 18 nt, Human
uuuguaaacuugcugaac

SEQ ID NO: 1104950 - RNA, 21 nt, Human
uuuguaaacuugcugaacagu

SEQ ID NO: 1104951 - RNA, 24 nt, Human
uuuguaaacuugcugaacaguagc

SEQ ID NO: 1104952 - RNA, 21 nt, Human
aaaaagacuggcucggagggu

SEQ ID NO: 1104953 - RNA, 24 nt, Human
aaaaagacuggcucggaggguccu

SEQ ID NO: 1104954 - RNA, 23 nt, Human
aagaagaaaguagaaauacauga

SEQ ID NO: 1104955 - RNA, 19 nt, Human
acggagucucgcugauggc

SEQ ID NO: 1104956 - RNA, 19 nt, Human
agaaaaagacuggcucgga

SEQ ID NO: 1104957 - RNA, 27 nt, Human
agaaaaagacuggcucggaggguccua

SEQ ID NO: 1104958 - RNA, 22 nt, Human
cagaaaaagacuggcucggagg

SEQ ID NO: 1104959 - RNA, 22 nt, Human
ccaccagcaucucuguggccac

SEQ ID NO: 1104960 - RNA, 18 nt, Human
cuacgcccacggagucuc

SEQ ID NO: 1104961 - RNA, 21 nt, Human
gauggcuagcacagcagucug

SEQ ID NO: 1104962 - RNA, 19 nt, Human
uccagaaaaagacuggcuc

SEQ ID NO: 1104963 - RNA, 24 nt, Human
uccagaaaaagacuggcucggagg

SEQ ID NO: 1104964 - RNA, 22 nt, Human
uccauauucugucuuccagaca

SEQ ID NO: 1104965 - RNA, 27 nt, Human
ucucuguggccacaaacuugauugcuc

SEQ ID NO: 1104966 - RNA, 18 nt, Human
uugauugcucuuccucca

SEQ ID NO: 1104967 - RNA, 23 nt, Human
aaaaaaaaaagaaaagaaaagaa

SEQ ID NO: 1104968 - RNA, 25 nt, Human
aaaaaaagaaaagaaaagaaaagaa

SEQ ID NO: 1104969 - RNA, 18 nt, Human
aaaaaagcccgccucgag

SEQ ID NO: 1104970 - RNA, 23 nt, Human
aaaaagcccgccucgaguagggc

SEQ ID NO: 1104971 - RNA, 21 nt, Human
aaacaggaacagggacccuac

SEQ ID NO: 1104972 - RNA, 21 nt, Human
aaacaggaacagggacccuac

SEQ ID NO: 1104973 - RNA, 23 nt, Human
aaacaggaacagggacccuacaa

SEQ ID NO: 1104974 - RNA, 23 nt, Human
aaaccaaacaaacagcagucagg

SEQ ID NO: 1104975 - RNA, 24 nt, Human
aaaccaaacaaacagcagucagga

SEQ ID NO: 1104976 - RNA, 18 nt, Human
aaaguaaacaggggaguc

SEQ ID NO: 1104977 - RNA, 20 nt, Human
aacauggagaagccccgucu

SEQ ID NO: 1104978 - RNA, 21 nt, Human
aacauggagaagccccgucuc

SEQ ID NO: 1104979 - RNA, 23 nt, Human
aaccaaacaaacagcagucagga

SEQ ID NO: 1104980 - RNA, 20 nt, Human
aagcccgccuuggccuggcg

SEQ ID NO: 1104981 - RNA, 18 nt, Human
aagccuccggaaugaacu

SEQ ID NO: 1104982 - RNA, 20 nt, Human
aaguacccauggcaaaccaa

SEQ ID NO: 1104983 - RNA, 24 nt, Human
aaucgcuugaacccgggaggcaga

SEQ ID NO: 1104984 - RNA, 19 nt, Human
acaagagugaaacuccauc

SEQ ID NO: 1104985 - RNA, 20 nt, Human
acaagagugaaacuccaucu

SEQ ID NO: 1104986 - RNA, 21 nt, Human
acaagagugaaacuccaucuc

SEQ ID NO: 1104987 - RNA, 24 nt, Human
acagcgaaagcacacagcagacgc

SEQ ID NO: 1104988 - RNA, 23 nt, Human
accccacgggccacagcuggagg

SEQ ID NO: 1104989 - RNA, 23 nt, Human
acccgggaggcuacccuggaagc

SEQ ID NO: 1104990 - RNA, 21 nt, Human
acugcuccauuucaauccuca

SEQ ID NO: 1104991 - RNA, 23 nt, Human
agaaaaaaaaagcccgccucgag

SEQ ID NO: 1104992 - RNA, 19 nt, Human
agaaaagaaaagaaaagaa

SEQ ID NO: 1104993 - RNA, 22 nt, Human
agaaucgcuugaacccgggagg

SEQ ID NO: 1104994 - RNA, 24 nt, Human
agacgccggggccagcauggaacu

SEQ ID NO: 1104995 - RNA, 24 nt, Human
agacguugcagugagcugagauug

SEQ ID NO: 1104996 - RNA, 27 nt, Human
agccuggguuuugcugucuaccuuggu

SEQ ID NO: 1104997 - RNA, 19 nt, Human
agccuuuggcuccauggca

SEQ ID NO: 1104998 - RNA, 20 nt, Human
aggagcuggaaggcugaccc

SEQ ID NO: 1104999 - RNA, 22 nt, Human
aggaggcccagccuucaccugc

SEQ ID NO: 1105000 - RNA, 20 nt, Human
aggcagacguugcagugagc

SEQ ID NO: 1105001 - RNA, 24 nt, Human
aggcagacguugcagugagcugag

SEQ ID NO: 1105002 - RNA, 24 nt, Human
aggcaggagaaucgcuugaacccg

SEQ ID NO: 1105003 - RNA, 18 nt, Human
aggcagguggaucacuug

SEQ ID NO: 1105004 - RNA, 26 nt, Human
aggcagguggaucacuugaggucagg

SEQ ID NO: 1105005 - RNA, 23 nt, Human
aggcccagccuucaccugcugcu

SEQ ID NO: 1105006 - RNA, 20 nt, Human
aggccgaggcaggagaaucg

SEQ ID NO: 1105007 - RNA, 24 nt, Human
aggccgaggcaggagaaucgcuug

SEQ ID NO: 1105008 - RNA, 21 nt, Human
aggccgaggcagguggaucac

SEQ ID NO: 1105009 - RNA, 22 nt, Human
agguggaucacuugaggucagg

SEQ ID NO: 1105010 - RNA, 22 nt, Human
agucucagcaauaccggcuuuc

SEQ ID NO: 1105011 - RNA, 24 nt, Human
aguggcacaugccuguaaucccag

SEQ ID NO: 1105012 - RNA, 23 nt, Human
aguggcucaugccuguaauccca

SEQ ID NO: 1105013 - RNA, 24 nt, Human
aguggcucaugccuguaaucccag

SEQ ID NO: 1105014 - RNA, 20 nt, Human
auugcaccauugcacuccag

SEQ ID NO: 1105015 - RNA, 19 nt, Human
caaaccaaacaaacagcag

SEQ ID NO: 1105016 - RNA, 24 nt, Human
caacauggagaagccccgucucua

SEQ ID NO: 1105017 - RNA, 20 nt, Human
caaggccauccaaaacaugg

SEQ ID NO: 1105018 - RNA, 22 nt, Human
caauccucagcguaucaagaca

SEQ ID NO: 1105019 - RNA, 23 nt, Human
cacaaacagcuacagucgcagcc

SEQ ID NO: 1105020 - RNA, 24 nt, Human
caccauugcacuccagcgugggca

SEQ ID NO: 1105021 - RNA, 24 nt, Human
cacuccagcgugggcaacaagagu

SEQ ID NO: 1105022 - RNA, 24 nt, Human
cacugcuccauuucaauccucagc

SEQ ID NO: 1105023 - RNA, 20 nt, Human
cagcaauaccggcuuucagc

SEQ ID NO: 1105024 - RNA, 21 nt, Human
cagcagucaggaacuggguaa

SEQ ID NO: 1105025 - RNA, 24 nt, Human
cagcauuucgggaggccgaggcag

SEQ ID NO: 1105026 - RNA, 25 nt, Human
cagcauuucgggaggccgaggcagg

SEQ ID NO: 1105027 - RNA, 24 nt, Human
cagccugaccaacauggagaagcc

SEQ ID NO: 1105028 - RNA, 19 nt, Human
cagcgcccugugaggugcc

SEQ ID NO: 1105029 - RNA, 24 nt, Human
cagcuaaucaggaggccgaggcag

SEQ ID NO: 1105030 - RNA, 24 nt, Human
caggaggcccagccuucaccugcc

SEQ ID NO: 1105031 - RNA, 23 nt, Human
caggcaaaaaucgugagauuaga

SEQ ID NO: 1105032 - RNA, 21 nt, Human
cagggcaucugcgucuggucc

SEQ ID NO: 1105033 - RNA, 20 nt, Human
cauggcaaaccaaacaaaca

SEQ ID NO: 1105034 - RNA, 18 nt, Human
cauugcacuccagcgugg

SEQ ID NO: 1105035 - RNA, 19 nt, Human
cauugcacuccagcguggg

SEQ ID NO: 1105036 - RNA, 21 nt, Human
cauugcacuccagcgugggca

SEQ ID NO: 1105037 - RNA, 24 nt, Human
cauugcacuccagcgugggcaaca

SEQ ID NO: 1105038 - RNA, 23 nt, Human
ccacacugugacuggugcaggca

SEQ ID NO: 1105039 - RNA, 20 nt, Human
ccagaaguacccauggcaaa

SEQ ID NO: 1105040 - RNA, 23 nt, Human
ccauccaaaacauggcaaagcua

SEQ ID NO: 1105041 - RNA, 21 nt, Human
ccauggcaaaccaaacaaaca

SEQ ID NO: 1105042 - RNA, 20 nt, Human
ccauugcacuccagcguggg

SEQ ID NO: 1105043 - RNA, 21 nt, Human
ccauugcacuccagcgugggc

SEQ ID NO: 1105044 - RNA, 24 nt, Human
ccauugcacuccagcgugggcaac

SEQ ID NO: 1105045 - RNA, 25 nt, Human
ccauugcacuccagcgugggcaaca

SEQ ID NO: 1105046 - RNA, 23 nt, Human
cccauggcaaaccaaacaaacag

SEQ ID NO: 1105047 - RNA, 23 nt, Human
ccccgucucuacuaaaaauacaa

SEQ ID NO: 1105048 - RNA, 20 nt, Human
cccgccccaguuugaccucu

SEQ ID NO: 1105049 - RNA, 18 nt, Human
ccuacaacuggcaugagg

SEQ ID NO: 1105050 - RNA, 24 nt, Human
ccucaguccuaccacacugacucc

SEQ ID NO: 1105051 - RNA, 18 nt, Human
ccuccggaaugaacuucc

SEQ ID NO: 1105052 - RNA, 19 nt, Human
ccucugcaguacauaaggg

SEQ ID NO: 1105053 - RNA, 23 nt, Human
ccugaccaacauggagaagcccc

SEQ ID NO: 1105054 - RNA, 24 nt, Human
ccugaccaacauggagaagccccg

SEQ ID NO: 1105055 - RNA, 23 nt, Human
ccuggaagccuccggaaugaacu

SEQ ID NO: 1105056 - RNA, 20 nt, Human
ccuguaaucccagcauuucg

SEQ ID NO: 1105057 - RNA, 20 nt, Human
ccuguaaucccagcauuucg

SEQ ID NO: 1105058 - RNA, 21 nt, Human
ccuguaaucccagcuaaucag

SEQ ID NO: 1105059 - RNA, 24 nt, Human
cgaggcaggagaaucgcuugaacc

SEQ ID NO: 1105060 - RNA, 24 nt, Human
cgaggcagguggaucacuugaggu

SEQ ID NO: 1105061 - RNA, 26 nt, Human
cgaggcagguggaucacuugagguca

SEQ ID NO: 1105062 - RNA, 25 nt, Human
cgcccugcagcaggaggcugggacu

SEQ ID NO: 1105063 - RNA, 24 nt, Human
cgggaggcagacguugcagugagc

SEQ ID NO: 1105064 - RNA, 18 nt, Human
cgugcuuguagacacaca

SEQ ID NO: 1105065 - RNA, 25 nt, Human
cucaguccuaccacacugacuccca

SEQ ID NO: 1105066 - RNA, 23 nt, Human
cucaugccuguaaucccagcauu

SEQ ID NO: 1105067 - RNA, 24 nt, Human
cucaugccuguaaucccagcauuu

SEQ ID NO: 1105068 - RNA, 19 nt, Human
cuccaucucaaaaaaaaaa

SEQ ID NO: 1105069 - RNA, 18 nt, Human
cucuacugacggcagagc

SEQ ID NO: 1105070 - RNA, 19 nt, Human
cugaaggucucuccagccg

SEQ ID NO: 1105071 - RNA, 18 nt, Human
cugacccuggagucucag

SEQ ID NO: 1105072 - RNA, 21 nt, Human
cugcauccgucccucaggcac

SEQ ID NO: 1105073 - RNA, 18 nt, Human
cuggagguuugccagccg

SEQ ID NO: 1105074 - RNA, 23 nt, Human
cuggguaaagguuggcugcagca

SEQ ID NO: 1105075 - RNA, 18 nt, Human
cuuggccuggcgcagugg

SEQ ID NO: 1105076 - RNA, 19 nt, Human
cuuucagaaugcuggccua

SEQ ID NO: 1105077 - RNA, 18 nt, Human
cuuucagcaggaggccca

SEQ ID NO: 1105078 - RNA, 20 nt, Human
gaaagcacacagcagacgcc

SEQ ID NO: 1105079 - RNA, 23 nt, Human
gaacuggguaaagguuggcugca

SEQ ID NO: 1105080 - RNA, 21 nt, Human
gagaagccccgucucuacuaa

SEQ ID NO: 1105081 - RNA, 23 nt, Human
gagauuagaccacaaucuguugu

SEQ ID NO: 1105082 - RNA, 21 nt, Human
gagcaaaccccacgggccaca

SEQ ID NO: 1105083 - RNA, 19 nt, Human
gaggaggagcuggaaggcu

SEQ ID NO: 1105084 - RNA, 23 nt, Human
gaggcagguggaucacuugaggu

SEQ ID NO: 1105085 - RNA, 22 nt, Human
gaucacuugaggucaggaguuc

SEQ ID NO: 1105086 - RNA, 24 nt, Human
gaucacuugaggucaggaguucca

SEQ ID NO: 1105087 - RNA, 25 nt, Human
gaucacuugaggucaggaguuccag

SEQ ID NO: 1105088 - RNA, 20 nt, Human
gcaaaccaaacaaacagcag

SEQ ID NO: 1105089 - RNA, 20 nt, Human
gccagggcaucugcgucugg

SEQ ID NO: 1105090 - RNA, 26 nt, Human
gcccaggccaccauggagcaaacccc

SEQ ID NO: 1105091 - RNA, 20 nt, Human
gccggguaguggcacaugcc

SEQ ID NO: 1105092 - RNA, 20 nt, Human
gccuacugaaggucucucca

SEQ ID NO: 1105093 - RNA, 19 nt, Human
gccuggcgcaguggcucau

SEQ ID NO: 1105094 - RNA, 20 nt, Human
gcuccauuucaauccucagc

SEQ ID NO: 1105095 - RNA, 18 nt, Human
gcuucacaucacccugga

SEQ ID NO: 1105096 - RNA, 20 nt, Human
ggagcuggaaggcugacccu

SEQ ID NO: 1105097 - RNA, 22 nt, Human
ggaucacuugaggucaggaguu

SEQ ID NO: 1105098 - RNA, 19 nt, Human
ggcagagcgcccugcagca

SEQ ID NO: 1105099 - RNA, 27 nt, Human
ggccgaggcaggagaaucgcuugaacc

SEQ ID NO: 1105100 - RNA, 23 nt, Human
ggcgcaguggcucaugccuguaa

SEQ ID NO: 1105101 - RNA, 23 nt, Human
gggaggccgaggcagguggauca

SEQ ID NO: 1105102 - RNA, 22 nt, Human
gggcuccacucuuuccaggccc

SEQ ID NO: 1105103 - RNA, 25 nt, Human
ggggaccgcggggacagaggaggau

SEQ ID NO: 1105104 - RNA, 22 nt, Human
ggguaguggcacaugccuguaa

SEQ ID NO: 1105105 - RNA, 22 nt, Human
gucucauuuaaauauccucuca

SEQ ID NO: 1105106 - RNA, 21 nt, Human
guggaucacuugaggucagga

SEQ ID NO: 1105107 - RNA, 19 nt, Human
guugcagugagcugagauu

SEQ ID NO: 1105108 - RNA, 19 nt, Human
uaaaaauacaaaauuggcc

SEQ ID NO: 1105109 - RNA, 24 nt, Human
uaaauauccucucaucuggcaguc

SEQ ID NO: 1105110 - RNA, 19 nt, Human
uaaucccagcuaaucagga

SEQ ID NO: 1105111 - RNA, 18 nt, Human
uacauaagggucuguggg

SEQ ID NO: 1105112 - RNA, 21 nt, Human
uaccacacugacucccacaua

SEQ ID NO: 1105113 - RNA, 19 nt, Human
uaccggcuuucagcaggag

SEQ ID NO: 1105114 - RNA, 24 nt, Human
uaguggcacaugccuguaauccca

SEQ ID NO: 1105115 - RNA, 23 nt, Human
uauacacacagcgaaagcacaca

SEQ ID NO: 1105116 - RNA, 25 nt, Human
uauacacacagcgaaagcacacagc

SEQ ID NO: 1105117 - RNA, 23 nt, Human
uauguauacacuuaggaaauccc

SEQ ID NO: 1105118 - RNA, 19 nt, Human
ucaaaguaaacaggggagu

SEQ ID NO: 1105119 - RNA, 19 nt, Human
ucaagacauuguguacaga

SEQ ID NO: 1105120 - RNA, 20 nt, Human
ucaggaacuggguaaagguu

SEQ ID NO: 1105121 - RNA, 21 nt, Human
ucaucuggcagucacugaaga

SEQ ID NO: 1105122 - RNA, 19 nt, Human
ucauggcugguacagccug

SEQ ID NO: 1105123 - RNA, 23 nt, Human
uccaacagacacaaauaaagccc

SEQ ID NO: 1105124 - RNA, 18 nt, Human
uccaucucaaaaaaaaaa

SEQ ID NO: 1105125 - RNA, 23 nt, Human
uccaucucaaaaaaaaaagaaaa

SEQ ID NO: 1105126 - RNA, 23 nt, Human
ucccucaggcacgcccucagucc

SEQ ID NO: 1105127 - RNA, 26 nt, Human
ucccucaggcacgcccucaguccuac

SEQ ID NO: 1105128 - RNA, 30 nt, Human
ucccuuccuuggccaaacaggaacagggac

SEQ ID NO: 1105129 - RNA, 18 nt, Human
ucgcuugaacccgggagg

SEQ ID NO: 1105130 - RNA, 20 nt, Human
ucucuacuaaaaauacaaaa

SEQ ID NO: 1105131 - RNA, 26 nt, Human
ucucucucaggcaaaaaucgugagau

SEQ ID NO: 1105132 - RNA, 19 nt, Human
ucucucugccccugcaucc

SEQ ID NO: 1105133 - RNA, 23 nt, Human
ugacagucaucuuugcaaucccg

SEQ ID NO: 1105134 - RNA, 22 nt, Human
ugacgcgugugagaaacccgcc

SEQ ID NO: 1105135 - RNA, 22 nt, Human
ugagauuagaccacaaucuguu

SEQ ID NO: 1105136 - RNA, 23 nt, Human
ugagauuagaccacaaucuguug

SEQ ID NO: 1105137 - RNA, 24 nt, Human
ugagauugcaccauugcacuccag

SEQ ID NO: 1105138 - RNA, 22 nt, Human
ugaggagaguugcacgggccag

SEQ ID NO: 1105139 - RNA, 26 nt, Human
ugaggagaguugcacgggggacgucc

SEQ ID NO: 1105140 - RNA, 23 nt, Human
ugaggcaggaucacugcuccauu

SEQ ID NO: 1105141 - RNA, 25 nt, Human
ugcacuccagcgugggcaacaagag

SEQ ID NO: 1105142 - RNA, 21 nt, Human
ugcagcaggaggcugggacag

SEQ ID NO: 1105143 - RNA, 21 nt, Human
ugcaggcauuacaagaaagug

SEQ ID NO: 1105144 - RNA, 22 nt, Human
ugccagccggcaacuuggggcu

SEQ ID NO: 1105145 - RNA, 24 nt, Human
ugccaggagguccccagaaguacc

SEQ ID NO: 1105146 - RNA, 24 nt, Human
ugccuguaaucccagcauuucggg

SEQ ID NO: 1105147 - RNA, 24 nt, Human
ugccuguaaucccagcuaaucagg

SEQ ID NO: 1105148 - RNA, 23 nt, Human
ugcugcucucucugccccugcau

SEQ ID NO: 1105149 - RNA, 20 nt, Human
ugcuuguagacacacacccc

SEQ ID NO: 1105150 - RNA, 24 nt, Human
uggaucacuugaggucaggaguuc

SEQ ID NO: 1105151 - RNA, 27 nt, Human
uggaucacuugaggucaggaguuccag

SEQ ID NO: 1105152 - RNA, 19 nt, Human
uggcaaaccaaacaaacag

SEQ ID NO: 1105153 - RNA, 24 nt, Human
uggcaaaccaaacaaacagcaguc

SEQ ID NO: 1105154 - RNA, 21 nt, Human
uggcacaugccuguaauccca

SEQ ID NO: 1105155 - RNA, 22 nt, Human
uggcacaugccuguaaucccag

SEQ ID NO: 1105156 - RNA, 21 nt, Human
uggcccaggccaccauggagc

SEQ ID NO: 1105157 - RNA, 24 nt, Human
uggcccaggccaccauggagcaag

SEQ ID NO: 1105158 - RNA, 22 nt, Human
uggccggguaguggcacaugcc

SEQ ID NO: 1105159 - RNA, 24 nt, Human
uggccuggcgcaguggcucaugcc

SEQ ID NO: 1105160 - RNA, 18 nt, Human
uggcgcaguggcucaugc

SEQ ID NO: 1105161 - RNA, 24 nt, Human
uggcucaugccuguaaucccagca

SEQ ID NO: 1105162 - RNA, 19 nt, Human
uggcugcagcacaaacagc

SEQ ID NO: 1105163 - RNA, 24 nt, Human
uggcuggcuucacaucacccugga

SEQ ID NO: 1105164 - RNA, 22 nt, Human
uggguaaagguuggcugcagca

SEQ ID NO: 1105165 - RNA, 23 nt, Human
uguauacacacagcgaaagcaca

SEQ ID NO: 1105166 - RNA, 25 nt, Human
uguauacacacagcgaaagcacaca

SEQ ID NO: 1105167 - RNA, 20 nt, Human
ugucccugugaaagcaggau

SEQ ID NO: 1105168 - RNA, 22 nt, Human
ugugaaagcaggauccaggcug

SEQ ID NO: 1105169 - RNA, 19 nt, Human
uugcagugagcugagauug

SEQ ID NO: 1105170 - RNA, 20 nt, Human
uugcagugagcugagauugc

SEQ ID NO: 1105171 - RNA, 22 nt, Human
uugcagugagcugagauugcac

SEQ ID NO: 1105172 - RNA, 24 nt, Human
aagcccuuauguaacagaaggggu

SEQ ID NO: 1105173 - RNA, 24 nt, Human
aagcggggaccggacgaggcccua

SEQ ID NO: 1105174 - RNA, 24 nt, Human
aagcucucaggcaugcacagccac

SEQ ID NO: 1105175 - RNA, 22 nt, Human
aaugugcuggucgccuccaacu

SEQ ID NO: 1105176 - RNA, 19 nt, Human
accaagaucccauuuccug

SEQ ID NO: 1105177 - RNA, 21 nt, Human
accaagccuguggaggaugcc

SEQ ID NO: 1105178 - RNA, 22 nt, Human
acuucaauuuccccucuuguua

SEQ ID NO: 1105179 - RNA, 26 nt, Human
agaaaauauuucuuagaaaaucuuua

SEQ ID NO: 1105180 - RNA, 24 nt, Human
agaaauaauagagaaccaggacca

SEQ ID NO: 1105181 - RNA, 26 nt, Human
agaaccaggaccaacaugagguguuu

SEQ ID NO: 1105182 - RNA, 21 nt, Human
agaagggguuauuuguaagaa

SEQ ID NO: 1105183 - RNA, 22 nt, Human
agacagaaaguagauuaauggg

SEQ ID NO: 1105184 - RNA, 21 nt, Human
agacgacugggcaccccaggc

SEQ ID NO: 1105185 - RNA, 19 nt, Human
agagacagaaaguagauua

SEQ ID NO: 1105186 - RNA, 23 nt, Human
agagaggccgggugcuggccagg

SEQ ID NO: 1105187 - RNA, 22 nt, Human
agcacaggagcagccacaguga

SEQ ID NO: 1105188 - RNA, 25 nt, Human
agcugcuuugcccgugagcagguga

SEQ ID NO: 1105189 - RNA, 20 nt, Human
aggaaggcauugggagaaac

SEQ ID NO: 1105190 - RNA, 25 nt, Human
aggaaggcauugggagaaacggacu

SEQ ID NO: 1105191 - RNA, 21 nt, Human
aggaguucugagacuagucag

SEQ ID NO: 1105192 - RNA, 23 nt, Human
aggcaagugcacagauuggaccu

SEQ ID NO: 1105193 - RNA, 24 nt, Human
aggcaagugcacagauuggaccug

SEQ ID NO: 1105194 - RNA, 21 nt, Human
aggcgucuggccaggcuggua

SEQ ID NO: 1105195 - RNA, 20 nt, Human
agggaggugugggcagaggg

SEQ ID NO: 1105196 - RNA, 23 nt, Human
aggggaccauggcggcucacagc

SEQ ID NO: 1105197 - RNA, 20 nt, Human
agguagugcgcccagggcag

SEQ ID NO: 1105198 - RNA, 20 nt, Human
aucugucuggugcuucccuu

SEQ ID NO: 1105199 - RNA, 19 nt, Human
aucuugagcuguucugugc

SEQ ID NO: 1105200 - RNA, 22 nt, Human
caaaaugcacagggaacgagcg

SEQ ID NO: 1105201 - RNA, 24 nt, Human
caaaaugcacagggaacgagcgug

SEQ ID NO: 1105202 - RNA, 23 nt, Human
caagccuguggaggaugccacaa

SEQ ID NO: 1105203 - RNA, 22 nt, Human
cacagauuggaccuggcuacac

SEQ ID NO: 1105204 - RNA, 20 nt, Human
cacaucuguggaaauaaaau

SEQ ID NO: 1105205 - RNA, 23 nt, Human
caccauaggguucccuuuucccc

SEQ ID NO: 1105206 - RNA, 26 nt, Human
caccaugaagacgacugggcacccca

SEQ ID NO: 1105207 - RNA, 18 nt, Human
cacccuuggauaagcggg

SEQ ID NO: 1105208 - RNA, 19 nt, Human
cagagugcaguuggacagg

SEQ ID NO: 1105209 - RNA, 21 nt, Human
caggagcagccacagugaccc

SEQ ID NO: 1105210 - RNA, 19 nt, Human
caggcuccauccgagagaa

SEQ ID NO: 1105211 - RNA, 22 nt, Human
cagugcacacagguccuggggc

SEQ ID NO: 1105212 - RNA, 22 nt, Human
caugcuguagaccaagccugug

SEQ ID NO: 1105213 - RNA, 19 nt, Human
caugcuguuuaauuauggg

SEQ ID NO: 1105214 - RNA, 21 nt, Human
cauggcguuuggccugggcaa

SEQ ID NO: 1105215 - RNA, 23 nt, Human
ccacaaggagacaggucuugggg

SEQ ID NO: 1105216 - RNA, 18 nt, Human
ccacccagagugacuucc

SEQ ID NO: 1105217 - RNA, 19 nt, Human
ccagaggcaagugcacaga

SEQ ID NO: 1105218 - RNA, 19 nt, Human
ccagggcaggaaaauccac

SEQ ID NO: 1105219 - RNA, 23 nt, Human
ccaggggaccauggcggcucaca

SEQ ID NO: 1105220 - RNA, 24 nt, Human
ccccacccagagugacuucccaaa

SEQ ID NO: 1105221 - RNA, 21 nt, Human
ccccgcugcccgugggcggca

SEQ ID NO: 1105222 - RNA, 22 nt, Human
ccccuaaacuggagcucagccu

SEQ ID NO: 1105223 - RNA, 20 nt, Human
cccgugggcggcagcuucua

SEQ ID NO: 1105224 - RNA, 24 nt, Human
cccgugggcggcagcuucuagucc

SEQ ID NO: 1105225 - RNA, 18 nt, Human
cccuccuuccuuccuucc

SEQ ID NO: 1105226 - RNA, 19 nt, Human
cccuccuuccuuccuuccu

SEQ ID NO: 1105227 - RNA, 20 nt, Human
cccuccuuccuuccuuccuc

SEQ ID NO: 1105228 - RNA, 22 nt, Human
cccucuccauggugaccuaaaa

SEQ ID NO: 1105229 - RNA, 24 nt, Human
ccucggagggcucauggcuuugcc

SEQ ID NO: 1105230 - RNA, 18 nt, Human
ccugaggaugcaugcugu

SEQ ID NO: 1105231 - RNA, 21 nt, Human
ccuggcuacacuugaguccac

SEQ ID NO: 1105232 - RNA, 23 nt, Human
ccuguggaggaugccacaaggag

SEQ ID NO: 1105233 - RNA, 20 nt, Human
ccuguugcugcgcugcugug

SEQ ID NO: 1105234 - RNA, 24 nt, Human
ccuuccggcuucuucccuccuucc

SEQ ID NO: 1105235 - RNA, 18 nt, Human
ccuuccuguuucucuccc

SEQ ID NO: 1105236 - RNA, 23 nt, Human
ccuugccugcagccuuccccagc

SEQ ID NO: 1105237 - RNA, 23 nt, Human
cgacgagggacgccacaggagga

SEQ ID NO: 1105238 - RNA, 25 nt, Human
cgccagagagucaggauaguuuuaa

SEQ ID NO: 1105239 - RNA, 19 nt, Human
cuaaagcuacugaguugua

SEQ ID NO: 1105240 - RNA, 21 nt, Human
cucaggcccuggccucuggcc

SEQ ID NO: 1105241 - RNA, 18 nt, Human
cucgcagccacucaucuc

SEQ ID NO: 1105242 - RNA, 21 nt, Human
cugggucagggccaggaauag

SEQ ID NO: 1105243 - RNA, 25 nt, Human
cuguggcgcccccugcuggcugccc

SEQ ID NO: 1105244 - RNA, 23 nt, Human
cuguucugugcuggggaucgugg

SEQ ID NO: 1105245 - RNA, 21 nt, Human
cuucagcaguucccacccuuc

SEQ ID NO: 1105246 - RNA, 23 nt, Human
cuuggagggagggcagugggcac

SEQ ID NO: 1105247 - RNA, 21 nt, Human
cuuugcccagauuucuucccc

SEQ ID NO: 1105248 - RNA, 18 nt, Human
gaccauggcggcucacag

SEQ ID NO: 1105249 - RNA, 24 nt, Human
gacgugguguguccugaugccguc

SEQ ID NO: 1105250 - RNA, 20 nt, Human
gaugccggcaaccgggugcc

SEQ ID NO: 1105251 - RNA, 20 nt, Human
gccacagugacccgcaaggu

SEQ ID NO: 1105252 - RNA, 20 nt, Human
gcgcccccugcuggcugccc

SEQ ID NO: 1105253 - RNA, 20 nt, Human
gcgcugugucuguugcucag

SEQ ID NO: 1105254 - RNA, 18 nt, Human
gcgucuggccaggcuggu

SEQ ID NO: 1105255 - RNA, 19 nt, Human
gcucugaauccccucucca

SEQ ID NO: 1105256 - RNA, 22 nt, Human
ggacucggaacgaugcaaggca

SEQ ID NO: 1105257 - RNA, 23 nt, Human
ggacucggaacgaugcaaggcag

SEQ ID NO: 1105258 - RNA, 18 nt, Human
ggacuuggagggagggca

SEQ ID NO: 1105259 - RNA, 24 nt, Human
ggacuuggagggagggcagugggc

SEQ ID NO: 1105260 - RNA, 26 nt, Human
ggagacgugcucucccuuccggcuuc

SEQ ID NO: 1105261 - RNA, 21 nt, Human
ggaggacuuggagggagggca

SEQ ID NO: 1105262 - RNA, 21 nt, Human
ggaggacuuggagggagggca

SEQ ID NO: 1105263 - RNA, 22 nt, Human
ggaggacuuggagggagggcag

SEQ ID NO: 1105264 - RNA, 26 nt, Human
ggaggacuuggagggagggcaguggg

SEQ ID NO: 1105265 - RNA, 21 nt, Human
ggaggugugggcagagggcgu

SEQ ID NO: 1105266 - RNA, 22 nt, Human
ggcaagugcacagauuggaccu

SEQ ID NO: 1105267 - RNA, 24 nt, Human
ggccauggcguuuggccugggcaa

SEQ ID NO: 1105268 - RNA, 21 nt, Human
gggaccauggcggcucacagc

SEQ ID NO: 1105269 - RNA, 24 nt, Human
gggcaggcaccaucaccuacuuca

SEQ ID NO: 1105270 - RNA, 19 nt, Human
gggcagugggcacgguaga

SEQ ID NO: 1105271 - RNA, 21 nt, Human
gggcugaggagaggaaggcau

SEQ ID NO: 1105272 - RNA, 19 nt, Human
ggggagggauggggccugg

SEQ ID NO: 1105273 - RNA, 22 nt, Human
gguguggggcugaggagaggaa

SEQ ID NO: 1105274 - RNA, 18 nt, Human
gugggccggugaugccgg

SEQ ID NO: 1105275 - RNA, 22 nt, Human
uaagccuggaagaauccccuga

SEQ ID NO: 1105276 - RNA, 18 nt, Human
uaauagaagagugaguua

SEQ ID NO: 1105277 - RNA, 23 nt, Human
uaccuccaccccggugcaagcuc

SEQ ID NO: 1105278 - RNA, 23 nt, Human
uagaaaaucuuuaguuugaaaac

SEQ ID NO: 1105279 - RNA, 21 nt, Human
uagacggugaucuugagcugu

SEQ ID NO: 1105280 - RNA, 22 nt, Human
uagggaggugugggcagagggc

SEQ ID NO: 1105281 - RNA, 21 nt, Human
ucaucagaaugugcuggucgc

SEQ ID NO: 1105282 - RNA, 18 nt, Human
uccacagagacagaaagu

SEQ ID NO: 1105283 - RNA, 19 nt, Human
uccacagagacagaaagua

SEQ ID NO: 1105284 - RNA, 23 nt, Human
uccacagagacagaaaguagauu

SEQ ID NO: 1105285 - RNA, 18 nt, Human
uccacugaguccagaaac

SEQ ID NO: 1105286 - RNA, 27 nt, Human
uccacugaguccagaaacagcggaccg

SEQ ID NO: 1105287 - RNA, 24 nt, Human
uccagggcaggaaaauccacagag

SEQ ID NO: 1105288 - RNA, 19 nt, Human
ucccaaaaggcagcacuac

SEQ ID NO: 1105289 - RNA, 25 nt, Human
ucccuuguugagcgcucgcaggaau

SEQ ID NO: 1105290 - RNA, 24 nt, Human
uccggcuucuucccuccuuccuuc

SEQ ID NO: 1105291 - RNA, 18 nt, Human
uccugaggcgaccccagc

SEQ ID NO: 1105292 - RNA, 22 nt, Human
ucguugguugaggcugccccuc

SEQ ID NO: 1105293 - RNA, 20 nt, Human
ucuccaaaugcccaugaguu

SEQ ID NO: 1105294 - RNA, 23 nt, Human
ucuggaaaagauaaaacugccaa

SEQ ID NO: 1105295 - RNA, 22 nt, Human
ucuggugcuucccuuguugagc

SEQ ID NO: 1105296 - RNA, 19 nt, Human
ucuguuccggagacuuccc

SEQ ID NO: 1105297 - RNA, 22 nt, Human
ugaaaucaaguguggcggaugc

SEQ ID NO: 1105298 - RNA, 20 nt, Human
ugaccggagcgugaaggcga

SEQ ID NO: 1105299 - RNA, 21 nt, Human
ugacucgcagccacucaucuc

SEQ ID NO: 1105300 - RNA, 20 nt, Human
ugaggagaggaaggcauugg

SEQ ID NO: 1105301 - RNA, 19 nt, Human
ugaggugcagagaggccgg

SEQ ID NO: 1105302 - RNA, 21 nt, Human
ugccuguugcugcgcugcugu

SEQ ID NO: 1105303 - RNA, 18 nt, Human
ugcuggggaucguggcca

SEQ ID NO: 1105304 - RNA, 24 nt, Human
ugcuguagaccaagccuguggagg

SEQ ID NO: 1105305 - RNA, 18 nt, Human
ugcuguggcgcccccugc

SEQ ID NO: 1105306 - RNA, 21 nt, Human
uggaaaccuuuggaagaggca

SEQ ID NO: 1105307 - RNA, 20 nt, Human
uggaagaggcaccuucagca

SEQ ID NO: 1105308 - RNA, 18 nt, Human
uggcacacgcccugcagg

SEQ ID NO: 1105309 - RNA, 20 nt, Human
uggcagauggggguagacgg

SEQ ID NO: 1105310 - RNA, 22 nt, Human
uggcauguguuuugacccagug

SEQ ID NO: 1105311 - RNA, 27 nt, Human
uggccaggcugguagggaggugugggc

SEQ ID NO: 1105312 - RNA, 19 nt, Human
uggccucuggcacacgccc

SEQ ID NO: 1105313 - RNA, 20 nt, Human
uggccucuggcacacgcccu

SEQ ID NO: 1105314 - RNA, 23 nt, Human
ugggcaauucaccaggggaccau

SEQ ID NO: 1105315 - RNA, 24 nt, Human
ugucuguugcucaggcccuggccu

SEQ ID NO: 1105316 - RNA, 21 nt, Human
uguucugugcuggggaucgug

SEQ ID NO: 1105317 - RNA, 18 nt, Human
uucagggauuuuuuuaau

SEQ ID NO: 1105318 - RNA, 27 nt, Human
uuccagaaaacacuucuuuccuggugg

SEQ ID NO: 1105319 - RNA, 24 nt, Human
uuccuguuucucucccuuccccag

SEQ ID NO: 1105320 - RNA, 23 nt, Human
uucuguuccggagacuucccagg

SEQ ID NO: 1105321 - RNA, 22 nt, Human
uugcugcgcugcuguggcgccc

SEQ ID NO: 1105322 - RNA, 22 nt, Human
uuguacacuuuaaaaugguuaa

SEQ ID NO: 1105323 - RNA, 25 nt, Human
uuugacccagugguguaguucuucc

SEQ ID NO: 1105324 - RNA, 18 nt, Human
aaaaaaaggcugggccca

SEQ ID NO: 1105325 - RNA, 19 nt, Human
aaaaaaaggcugggcccac

SEQ ID NO: 1105326 - RNA, 25 nt, Human
aaacaagaugaagauacaaaaaugg

SEQ ID NO: 1105327 - RNA, 24 nt, Human
aaacacuggaagcacgagauagcc

SEQ ID NO: 1105328 - RNA, 23 nt, Human
aagaaaaggugaaaaagagggac

SEQ ID NO: 1105329 - RNA, 18 nt, Human
aagaagcuaacugauagu

SEQ ID NO: 1105330 - RNA, 21 nt, Human
aagugcugcagccucuaagcc

SEQ ID NO: 1105331 - RNA, 18 nt, Human
acacacccacucccccuc

SEQ ID NO: 1105332 - RNA, 23 nt, Human
acacccacucccccucaccccca

SEQ ID NO: 1105333 - RNA, 19 nt, Human
accacaguacguuucagca

SEQ ID NO: 1105334 - RNA, 20 nt, Human
acccacucccccucaccccc

SEQ ID NO: 1105335 - RNA, 18 nt, Human
acccagauaacugaaaaa

SEQ ID NO: 1105336 - RNA, 23 nt, Human
agauagccgacguggaccaggac

SEQ ID NO: 1105337 - RNA, 25 nt, Human
aggaaguaauucagcacagcagaac

SEQ ID NO: 1105338 - RNA, 22 nt, Human
agggcggauguccaaagaugcu

SEQ ID NO: 1105339 - RNA, 24 nt, Human
aggucuggcuggcgagcagcagaa

SEQ ID NO: 1105340 - RNA, 22 nt, Human
agugcaaucuucaguuaugccu

SEQ ID NO: 1105341 - RNA, 21 nt, Human
augcacacgauacaaaaaaaa

SEQ ID NO: 1105342 - RNA, 20 nt, Human
caacagaacaaaagcagcgu

SEQ ID NO: 1105343 - RNA, 21 nt, Human
caagaaaaggugaaaaagaua

SEQ ID NO: 1105344 - RNA, 25 nt, Human
caagaaaaggugaaaaagauacaca

SEQ ID NO: 1105345 - RNA, 23 nt, Human
cacacaaaggcgcgcgcagccaa

SEQ ID NO: 1105346 - RNA, 21 nt, Human
cacacccguuuuaagaggaaa

SEQ ID NO: 1105347 - RNA, 23 nt, Human
cacacgauacaaaaaaaaaggcc

SEQ ID NO: 1105348 - RNA, 25 nt, Human
cacacgauacaaaaaaaaaggcugg

SEQ ID NO: 1105349 - RNA, 21 nt, Human
cacaguacguuucagcagggu

SEQ ID NO: 1105350 - RNA, 20 nt, Human
cagaagggagccggcuguua

SEQ ID NO: 1105351 - RNA, 24 nt, Human
cagcacagcagaacacgcuacccc

SEQ ID NO: 1105352 - RNA, 20 nt, Human
cagcagaacacgcuaccccu

SEQ ID NO: 1105353 - RNA, 20 nt, Human
cagcagaagggagccggcug

SEQ ID NO: 1105354 - RNA, 24 nt, Human
cauuucaaggagaucgcauccagc

SEQ ID NO: 1105355 - RNA, 21 nt, Human
ccaaggcaaaaggaauccacu

SEQ ID NO: 1105356 - RNA, 23 nt, Human
cccauggcuaggcuggccugaga

SEQ ID NO: 1105357 - RNA, 20 nt, Human
ccccccucuuucuuccucac

SEQ ID NO: 1105358 - RNA, 27 nt, Human
ccccccucuuucuuccucacacaccca

SEQ ID NO: 1105359 - RNA, 22 nt, Human
cccccucuuucuuccucacaca

SEQ ID NO: 1105360 - RNA, 19 nt, Human
ccuacauccuacacuacua

SEQ ID NO: 1105361 - RNA, 19 nt, Human
ccucacacacccacucccc

SEQ ID NO: 1105362 - RNA, 23 nt, Human
ccucacacacccacucccccuca

SEQ ID NO: 1105363 - RNA, 21 nt, Human
ccucgcgcggcggcggcggcg

SEQ ID NO: 1105364 - RNA, 21 nt, Human
cgccacacaaaggcgcgcgca

SEQ ID NO: 1105365 - RNA, 21 nt, Human
cgcggcggcggcggcggcggu

SEQ ID NO: 1105366 - RNA, 24 nt, Human
cggaagggcaacagaacaaaagca

SEQ ID NO: 1105367 - RNA, 25 nt, Human
cgucaugcacacgauacaaaaaaaa

SEQ ID NO: 1105368 - RNA, 26 nt, Human
cucacacacccacucccccucacccc

SEQ ID NO: 1105369 - RNA, 28 nt, Human
cucacacacccacucccccucaccccca

SEQ ID NO: 1105370 - RNA, 19 nt, Human
cucuuucuuuucagauugc

SEQ ID NO: 1105371 - RNA, 26 nt, Human
cuuuucuuuucuuuuuucucuuucuu

SEQ ID NO: 1105372 - RNA, 20 nt, Human
gagcagcagaagggagccgg

SEQ ID NO: 1105373 - RNA, 19 nt, Human
gagcggagcgcagcgcggc

SEQ ID NO: 1105374 - RNA, 22 nt, Human
gcaaugccuuccucagauggag

SEQ ID NO: 1105375 - RNA, 22 nt, Human
gcacagcagaacacgcuacccc

SEQ ID NO: 1105376 - RNA, 24 nt, Human
gccauggcucccacuuaagccagg

SEQ ID NO: 1105377 - RNA, 19 nt, Human
gcggcggcggcggcggcgg

SEQ ID NO: 1105378 - RNA, 24 nt, Human
gcggcggcggcggcggcgguggcg

SEQ ID NO: 1105379 - RNA, 20 nt, Human
gcggcggcggcggcgguggc

SEQ ID NO: 1105380 - RNA, 21 nt, Human
gcggcggcgguggcggggagg

SEQ ID NO: 1105381 - RNA, 20 nt, Human
ggagcgcagcgcggcgcggc

SEQ ID NO: 1105382 - RNA, 20 nt, Human
ggcaaacucucuaauaguuu

SEQ ID NO: 1105383 - RNA, 19 nt, Human
ggcggcggcggcggcggug

SEQ ID NO: 1105384 - RNA, 20 nt, Human
ggcggcggcggcggcggugg

SEQ ID NO: 1105385 - RNA, 23 nt, Human
ggcggcggcggcggcgguggcgg

SEQ ID NO: 1105386 - RNA, 20 nt, Human
ggcuacacgaccacaguacg

SEQ ID NO: 1105387 - RNA, 23 nt, Human
gggccagggcggauguccaaaga

SEQ ID NO: 1105388 - RNA, 20 nt, Human
ggguggcauuucaaggagaa

SEQ ID NO: 1105389 - RNA, 19 nt, Human
gugaaaaagauacacaacc

SEQ ID NO: 1105390 - RNA, 19 nt, Human
uaagacgcuauggccaugg

SEQ ID NO: 1105391 - RNA, 22 nt, Human
uaagaggaaaugccaaguaaua

SEQ ID NO: 1105392 - RNA, 21 nt, Human
uaauacauauguuuaacauuu

SEQ ID NO: 1105393 - RNA, 23 nt, Human
uacaaaaaaaaaggcugggccca

SEQ ID NO: 1105394 - RNA, 19 nt, Human
uacaagaagauugugguuu

SEQ ID NO: 1105395 - RNA, 23 nt, Human
uagcaaugccuuccucagaugga

SEQ ID NO: 1105396 - RNA, 21 nt, Human
ucacaauacagcuaaaugcgg

SEQ ID NO: 1105397 - RNA, 25 nt, Human
ucacacacccacucccccucacccc

SEQ ID NO: 1105398 - RNA, 20 nt, Human
ucccacuuaagccagggacc

SEQ ID NO: 1105399 - RNA, 24 nt, Human
ucgcgcggcggcggcggcggcuuu

SEQ ID NO: 1105400 - RNA, 20 nt, Human
ucugcgaaauuuuacccaca

SEQ ID NO: 1105401 - RNA, 25 nt, Human
ucuucaguuaugccugggugcugcc

SEQ ID NO: 1105402 - RNA, 18 nt, Human
ugagauaggggauacugc

SEQ ID NO: 1105403 - RNA, 23 nt, Human
ugcagccucuaagccaaggcaaa

SEQ ID NO: 1105404 - RNA, 19 nt, Human
ugccaaguaauaagagaua

SEQ ID NO: 1105405 - RNA, 18 nt, Human
ugcggaggcagaaggguc

SEQ ID NO: 1105406 - RNA, 18 nt, Human
uggaagcacgagauagcc

SEQ ID NO: 1105407 - RNA, 18 nt, Human
ugggauucuuuuuucuuu

SEQ ID NO: 1105408 - RNA, 18 nt, Human
uguuuuguuucaguuuuc

SEQ ID NO: 1105409 - RNA, 19 nt, Human
uuaaauagcaaugccuucc

SEQ ID NO: 1105410 - RNA, 21 nt, Human
uuaaauagcaaugccuuccuc

SEQ ID NO: 1105411 - RNA, 24 nt, Human
uugcugggauucuuuuuucuuuuc

SEQ ID NO: 1105412 - RNA, 22 nt, Human
uuuaacauuuuuugccuccaac

SEQ ID NO: 1105413 - RNA, 20 nt, Human
uuucgcacagagccaaacac

SEQ ID NO: 1105414 - RNA, 22 nt, Human
uuucuuuucagauugccaaaug

SEQ ID NO: 1105415 - RNA, 23 nt, Human
aaaagaccagagaggccaaccuu

SEQ ID NO: 1105416 - RNA, 19 nt, Human
aaacaaaaaagaccagaga

SEQ ID NO: 1105417 - RNA, 19 nt, Human
aaacaaacaaaaaagacca

SEQ ID NO: 1105418 - RNA, 18 nt, Human
aaagaccagagaggccaa

SEQ ID NO: 1105419 - RNA, 23 nt, Human
aaagggaagcugcaggccaccaa

SEQ ID NO: 1105420 - RNA, 20 nt, Human
aacauggcagaaggcuuccu

SEQ ID NO: 1105421 - RNA, 21 nt, Human
aagcacugcucugcuuccucc

SEQ ID NO: 1105422 - RNA, 20 nt, Human
aagcuagccacagugagggc

SEQ ID NO: 1105423 - RNA, 24 nt, Human
aagcugaggugggaggaucacuug

SEQ ID NO: 1105424 - RNA, 18 nt, Human
acaaccagcucccacgua

SEQ ID NO: 1105425 - RNA, 23 nt, Human
acagagggagacucugucucaaa

SEQ ID NO: 1105426 - RNA, 24 nt, Human
accaagacccugccaggucccuaa

SEQ ID NO: 1105427 - RNA, 20 nt, Human
accacaaacucccggagggc

SEQ ID NO: 1105428 - RNA, 18 nt, Human
accacccucuagccuggg

SEQ ID NO: 1105429 - RNA, 18 nt, Human
accacccucuagccuggg

SEQ ID NO: 1105430 - RNA, 24 nt, Human
accacccucuagccugggugacag

SEQ ID NO: 1105431 - RNA, 23 nt, Human
acccaggugucgaggcugcagug

SEQ ID NO: 1105432 - RNA, 25 nt, Human
acuagcuccccggcaccuggcacca

SEQ ID NO: 1105433 - RNA, 22 nt, Human
acucugucucaaacaaacaaac

SEQ ID NO: 1105434 - RNA, 20 nt, Human
agaaucacuacucaaggaca

SEQ ID NO: 1105435 - RNA, 22 nt, Human
agauagaaauugagggccguuc

SEQ ID NO: 1105436 - RNA, 20 nt, Human
agccacaggcaccuggcucc

SEQ ID NO: 1105437 - RNA, 18 nt, Human
agccauauuuauaucacc

SEQ ID NO: 1105438 - RNA, 24 nt, Human
agccugggugacagagggagacuc

SEQ ID NO: 1105439 - RNA, 20 nt, Human
agggaaguggcgggggauug

SEQ ID NO: 1105440 - RNA, 18 nt, Human
aggugggaggaucacuug

SEQ ID NO: 1105441 - RNA, 23 nt, Human
aggugggaggaucacuugaaccc

SEQ ID NO: 1105442 - RNA, 23 nt, Human
aggugucgaggcugcagugagcc

SEQ ID NO: 1105443 - RNA, 18 nt, Human
agucugcacugcauggug

SEQ ID NO: 1105444 - RNA, 24 nt, Human
aucaccacccucuagccuggguga

SEQ ID NO: 1105445 - RNA, 20 nt, Human
auggcacgugccuguggucc

SEQ ID NO: 1105446 - RNA, 23 nt, Human
augguggcguggugacagggcug

SEQ ID NO: 1105447 - RNA, 21 nt, Human
caaaaaagaccagagaggcca

SEQ ID NO: 1105448 - RNA, 22 nt, Human
caaaaaagaccagagaggccaa

SEQ ID NO: 1105449 - RNA, 18 nt, Human
caaacaaacaaaaaagac

SEQ ID NO: 1105450 - RNA, 26 nt, Human
caaacaaacaaacaaaaaagaccaga

SEQ ID NO: 1105451 - RNA, 23 nt, Human
cacaacaugagcacucaauaaau

SEQ ID NO: 1105452 - RNA, 21 nt, Human
cacaccagaccacaaacuccc

SEQ ID NO: 1105453 - RNA, 20 nt, Human
caccacccucuagccugggu

SEQ ID NO: 1105454 - RNA, 23 nt, Human
caccacccucuagccugggugac

SEQ ID NO: 1105455 - RNA, 25 nt, Human
caccagcugccccauaaagugaucu

SEQ ID NO: 1105456 - RNA, 19 nt, Human
caccaugccuggcacaaca

SEQ ID NO: 1105457 - RNA, 19 nt, Human
cagaaagggaagcugcagg

SEQ ID NO: 1105458 - RNA, 20 nt, Human
caggccaccaagacccugcc

SEQ ID NO: 1105459 - RNA, 22 nt, Human
cagggggcaccagcugccccau

SEQ ID NO: 1105460 - RNA, 19 nt, Human
ccagcacucuacucugccu

SEQ ID NO: 1105461 - RNA, 19 nt, Human
cccagauaacugucccuga

SEQ ID NO: 1105462 - RNA, 23 nt, Human
ccccagggggcaccagcugcccc

SEQ ID NO: 1105463 - RNA, 22 nt, Human
ccccauaaagugaucuugagca

SEQ ID NO: 1105464 - RNA, 24 nt, Human
ccccggcaccuggcaccaugccug

SEQ ID NO: 1105465 - RNA, 20 nt, Human
ccccuccuccaccucuccca

SEQ ID NO: 1105466 - RNA, 18 nt, Human
cccuccuccaccucuccc

SEQ ID NO: 1105467 - RNA, 23 nt, Human
ccugccaggucccuaaauuguau

SEQ ID NO: 1105468 - RNA, 23 nt, Human
ccuggcuccagggcaaaagguuc

SEQ ID NO: 1105469 - RNA, 22 nt, Human
ccugggugacagagggagacuc

SEQ ID NO: 1105470 - RNA, 24 nt, Human
cucaaacaaacaaacaaaaaagac

SEQ ID NO: 1105471 - RNA, 19 nt, Human
cucccaugcugacuccagc

SEQ ID NO: 1105472 - RNA, 23 nt, Human
cugagucauuuacuuguuuuugc

SEQ ID NO: 1105473 - RNA, 23 nt, Human
cugucucaaacaaacaaacaaaa

SEQ ID NO: 1105474 - RNA, 21 nt, Human
cuuugugcuuggcuaagcacu

SEQ ID NO: 1105475 - RNA, 22 nt, Human
gaagccacucccaggcacagcc

SEQ ID NO: 1105476 - RNA, 23 nt, Human
gaaggcuuccagagucaacacca

SEQ ID NO: 1105477 - RNA, 24 nt, Human
gacagagggagacucugucucaaa

SEQ ID NO: 1105478 - RNA, 20 nt, Human
gagugugggagccccagggg

SEQ ID NO: 1105479 - RNA, 23 nt, Human
gaucacuugaacccaggugucga

SEQ ID NO: 1105480 - RNA, 22 nt, Human
gcacagccacaggcaccuggcu

SEQ ID NO: 1105481 - RNA, 22 nt, Human
gcagagugugggagccccaggg

SEQ ID NO: 1105482 - RNA, 20 nt, Human
gccaccaagacccugccagg

SEQ ID NO: 1105483 - RNA, 19 nt, Human
gccccagggggcaccagcu

SEQ ID NO: 1105484 - RNA, 25 nt, Human
gccugggcugaagccacucccaggc

SEQ ID NO: 1105485 - RNA, 26 nt, Human
gcuuauugagauacaguguugucguc

SEQ ID NO: 1105486 - RNA, 25 nt, Human
ggaggaacauggcagaaggcuucca

SEQ ID NO: 1105487 - RNA, 21 nt, Human
ggcgggggauugguuccaaac

SEQ ID NO: 1105488 - RNA, 27 nt, Human
gggaaguggcgggggauugguuccaaa

SEQ ID NO: 1105489 - RNA, 23 nt, Human
ggguuuagcacaaaggaagacau

SEQ ID NO: 1105490 - RNA, 21 nt, Human
ggugacagggcuguggaggaa

SEQ ID NO: 1105491 - RNA, 24 nt, Human
gugcagagugugggagccccaggg

SEQ ID NO: 1105492 - RNA, 22 nt, Human
uaagcacugcucugcuuccucc

SEQ ID NO: 1105493 - RNA, 22 nt, Human
uagccacagugagggccagacg

SEQ ID NO: 1105494 - RNA, 21 nt, Human
uagccugggugacagagggag

SEQ ID NO: 1105495 - RNA, 19 nt, Human
uagugggcagagcugccgc

SEQ ID NO: 1105496 - RNA, 21 nt, Human
uaucugagaaguaucugcugc

SEQ ID NO: 1105497 - RNA, 22 nt, Human
uaucugagaaguaucugcugcu

SEQ ID NO: 1105498 - RNA, 22 nt, Human
ucaaggacagccacacacaagc

SEQ ID NO: 1105499 - RNA, 24 nt, Human
ucaccacccucuagccugggugac

SEQ ID NO: 1105500 - RNA, 22 nt, Human
ucagaaucacuacucaaggaca

SEQ ID NO: 1105501 - RNA, 25 nt, Human
ucccugcucucagcaaagucaaggg

SEQ ID NO: 1105502 - RNA, 20 nt, Human
ucuagccugggugacagagg

SEQ ID NO: 1105503 - RNA, 20 nt, Human
ucugcuuccucccugcucuc

SEQ ID NO: 1105504 - RNA, 21 nt, Human
ucuguccuggcuuuacuuggg

SEQ ID NO: 1105505 - RNA, 18 nt, Human
ugaagaagaguuauggcu

SEQ ID NO: 1105506 - RNA, 23 nt, Human
ugacagauacaaaguacccugau

SEQ ID NO: 1105507 - RNA, 24 nt, Human
ugagggccagacgucccacuggag

SEQ ID NO: 1105508 - RNA, 18 nt, Human
ugaggugggaggaucacu

SEQ ID NO: 1105509 - RNA, 19 nt, Human
ugaggugggaggaucacuu

SEQ ID NO: 1105510 - RNA, 20 nt, Human
ugaggugggaggaucacuug

SEQ ID NO: 1105511 - RNA, 18 nt, Human
ugauaguguucagcacaa

SEQ ID NO: 1105512 - RNA, 23 nt, Human
ugcaugguggcguggugacaggg

SEQ ID NO: 1105513 - RNA, 22 nt, Human
ugccucugaccuugagccaccu

SEQ ID NO: 1105514 - RNA, 24 nt, Human
ugccugugguccuagcuacuuggg

SEQ ID NO: 1105515 - RNA, 23 nt, Human
ugcucugcuuccucccugcucuc

SEQ ID NO: 1105516 - RNA, 24 nt, Human
ugcucugcuuccucccugcucuca

SEQ ID NO: 1105517 - RNA, 18 nt, Human
uggcacaacaugagcacu

SEQ ID NO: 1105518 - RNA, 24 nt, Human
uggcacgugccugugguccuagcu

SEQ ID NO: 1105519 - RNA, 22 nt, Human
uggcagaaggcuuccagaguca

SEQ ID NO: 1105520 - RNA, 21 nt, Human
uggcaggagcugccacuuggg

SEQ ID NO: 1105521 - RNA, 20 nt, Human
uggcguggugacagggcugu

SEQ ID NO: 1105522 - RNA, 19 nt, Human
ugggaagcugaggugggag

SEQ ID NO: 1105523 - RNA, 24 nt, Human
ugggaagcugaggugggaggauca

SEQ ID NO: 1105524 - RNA, 24 nt, Human
ugggaggaucacuugaacccaggu

SEQ ID NO: 1105525 - RNA, 24 nt, Human
ugggcugaagccacucccaggcac

SEQ ID NO: 1105526 - RNA, 21 nt, Human
uggggagggaaguggcggggg

SEQ ID NO: 1105527 - RNA, 18 nt, Human
ugggugacagagggagac

SEQ ID NO: 1105528 - RNA, 20 nt, Human
uguaugugcagaguguggga

SEQ ID NO: 1105529 - RNA, 18 nt, Human
uguuuuugcugccuuuca

SEQ ID NO: 1105530 - RNA, 23 nt, Human
uuaacgucuguauacacacacac

SEQ ID NO: 1105531 - RNA, 24 nt, Human
uucaaacacagugacagauacaaa

SEQ ID NO: 1105532 - RNA, 25 nt, Human
uugggaagcugaggugggaggauca

SEQ ID NO: 1105533 - RNA, 21 nt, Human
uuguaugugcagaguguggga

SEQ ID NO: 1105534 - RNA, 23 nt, Human
uuuuaagaaaauacauagacaaa

SEQ ID NO: 1105535 - RNA, 24 nt, Human
aagaaaauuuguauuauuuuaauu

SEQ ID NO: 1105536 - RNA, 18 nt, Human
uguacagaaaacucaaca

SEQ ID NO: 1105537 - RNA, 24 nt, Human
aaaaaaaaaaaaaagggcgcagaa

SEQ ID NO: 1105538 - RNA, 25 nt, Human
aaaaaaaaaaaaaagggcgcagaaa

SEQ ID NO: 1105539 - RNA, 19 nt, Human
aaagcacuuucuuugaaac

SEQ ID NO: 1105540 - RNA, 22 nt, Human
aacaguacaaauacaacaaagu

SEQ ID NO: 1105541 - RNA, 19 nt, Human
aacuuaugcugcuuuccuc

SEQ ID NO: 1105542 - RNA, 18 nt, Human
aagcaggggaaggagggg

SEQ ID NO: 1105543 - RNA, 23 nt, Human
acaccacggaggaacugggaaac

SEQ ID NO: 1105544 - RNA, 23 nt, Human
accaaaaaaaaaaaauuguacaa

SEQ ID NO: 1105545 - RNA, 18 nt, Human
accccaacacaaccuggc

SEQ ID NO: 1105546 - RNA, 19 nt, Human
accuggaugauagaaucca

SEQ ID NO: 1105547 - RNA, 23 nt, Human
acuacaccacaauaaccauguag

SEQ ID NO: 1105548 - RNA, 21 nt, Human
acugaagacgacaggaauuuu

SEQ ID NO: 1105549 - RNA, 19 nt, Human
acugagugcaaagguucug

SEQ ID NO: 1105550 - RNA, 21 nt, Human
agaaaacuaagaaccuacuca

SEQ ID NO: 1105551 - RNA, 19 nt, Human
agacacauguagaaaucag

SEQ ID NO: 1105552 - RNA, 20 nt, Human
agacuggaguuucuuccgac

SEQ ID NO: 1105553 - RNA, 21 nt, Human
agaguuccuguucuaggacuc

SEQ ID NO: 1105554 - RNA, 23 nt, Human
agaguuccuguucuaggacucuu

SEQ ID NO: 1105555 - RNA, 27 nt, Human
agauguaaacauucagaauacugaccc

SEQ ID NO: 1105556 - RNA, 19 nt, Human
auaaagcaccauauguacc

SEQ ID NO: 1105557 - RNA, 23 nt, Human
aucucaucagccucaauuguacc

SEQ ID NO: 1105558 - RNA, 18 nt, Human
auucagaauacugaccaa

SEQ ID NO: 1105559 - RNA, 27 nt, Human
caaagacaccacugauaaggaugccac

SEQ ID NO: 1105560 - RNA, 24 nt, Human
caauaaccauguaguaaauaauau

SEQ ID NO: 1105561 - RNA, 21 nt, Human
cacacuacaccacaauaacca

SEQ ID NO: 1105562 - RNA, 19 nt, Human
caccacaauaaccauguag

SEQ ID NO: 1105563 - RNA, 20 nt, Human
caccauauguaccagcuugu

SEQ ID NO: 1105564 - RNA, 18 nt, Human
caccucaggcauaugcau

SEQ ID NO: 1105565 - RNA, 27 nt, Human
cagacacauguagaaaucagaaaacua

SEQ ID NO: 1105566 - RNA, 27 nt, Human
cagcaguacaagaaaauuauggcaacc

SEQ ID NO: 1105567 - RNA, 24 nt, Human
caguaaucaggauaaugcacaugc

SEQ ID NO: 1105568 - RNA, 20 nt, Human
cauaucuuauaggaggagga

SEQ ID NO: 1105569 - RNA, 21 nt, Human
cauaucuuauaggaggaggaa

SEQ ID NO: 1105570 - RNA, 27 nt, Human
caucccagaaacacauaccaucccaaa

SEQ ID NO: 1105571 - RNA, 29 nt, Human
ccaaaaaaaaaaaauuguacaaacgaacu

SEQ ID NO: 1105572 - RNA, 23 nt, Human
ccagaaacacauaccaucccaaa

SEQ ID NO: 1105573 - RNA, 20 nt, Human
ccgcugugcugggccucacc

SEQ ID NO: 1105574 - RNA, 25 nt, Human
cuaacauuugcacacuacaccacaa

SEQ ID NO: 1105575 - RNA, 26 nt, Human
cuauaaaauaucugacccacauuuua

SEQ ID NO: 1105576 - RNA, 21 nt, Human
cucugcaugcucaggggguca

SEQ ID NO: 1105577 - RNA, 18 nt, Human
cucuucuuccuuucccuu

SEQ ID NO: 1105578 - RNA, 20 nt, Human
cugguauagcagugaaugaa

SEQ ID NO: 1105579 - RNA, 20 nt, Human
gaauuuggaaggaguuggca

SEQ ID NO: 1105580 - RNA, 21 nt, Human
gacucugggcucugcaugcuc

SEQ ID NO: 1105581 - RNA, 20 nt, Human
gaucuucgaaaucaggauga

SEQ ID NO: 1105582 - RNA, 18 nt, Human
ggaaggaggggaauacag

SEQ ID NO: 1105583 - RNA, 23 nt, Human
ggcuucagcuucuaaaaccuggg

SEQ ID NO: 1105584 - RNA, 24 nt, Human
gggccuucgcccccaaucuguguu

SEQ ID NO: 1105585 - RNA, 20 nt, Human
guucagggccuucgccccca

SEQ ID NO: 1105586 - RNA, 18 nt, Human
uaccucacauacugagug

SEQ ID NO: 1105587 - RNA, 23 nt, Human
uagcagugaaugaauuuggaagg

SEQ ID NO: 1105588 - RNA, 23 nt, Human
uauacaccucaggcauaugcaua

SEQ ID NO: 1105589 - RNA, 25 nt, Human
uauagcaaccaggcucaaccucaua

SEQ ID NO: 1105590 - RNA, 24 nt, Human
uauguaccagcuuguuuuugugua

SEQ ID NO: 1105591 - RNA, 22 nt, Human
uaugugaaaaaucaaaacauac

SEQ ID NO: 1105592 - RNA, 19 nt, Human
ucacauuuugcuguuacac

SEQ ID NO: 1105593 - RNA, 24 nt, Human
ucagaaaacuaagaaccuacucag

SEQ ID NO: 1105594 - RNA, 19 nt, Human
ucagccucaauuguaccuc

SEQ ID NO: 1105595 - RNA, 23 nt, Human
ucagggccuucgcccccaaucug

SEQ ID NO: 1105596 - RNA, 24 nt, Human
ugagaacacuaggaauuugaacug

SEQ ID NO: 1105597 - RNA, 21 nt, Human
ugauauaaaaugucuauguag

SEQ ID NO: 1105598 - RNA, 23 nt, Human
ugaugugaugguuuucaauuugc

SEQ ID NO: 1105599 - RNA, 19 nt, Human
uggaguuucuuccgacacc

SEQ ID NO: 1105600 - RNA, 24 nt, Human
uggauuuuguguguauauauauau

SEQ ID NO: 1105601 - RNA, 24 nt, Human
uggcaaccaaguaaagcacuuucu

SEQ ID NO: 1105602 - RNA, 24 nt, Human
uggcaggcagugaagagaaaacua

SEQ ID NO: 1105603 - RNA, 19 nt, Human
ugguauagcagugaaugaa

SEQ ID NO: 1105604 - RNA, 18 nt, Human
uguaccagcuuguuuuug

SEQ ID NO: 1105605 - RNA, 23 nt, Human
uguagacaguaucugacacuggu

SEQ ID NO: 1105606 - RNA, 21 nt, Human
uuaaauggcuaaugucaaaca

SEQ ID NO: 1105607 - RNA, 22 nt, Human
uuaaauggcuaaugucaaacag

SEQ ID NO: 1105608 - RNA, 23 nt, Human
uucacauuuugcuguuacacugu

SEQ ID NO: 1105609 - RNA, 23 nt, Human
uuguguguauauauauauuaaau

SEQ ID NO: 1105610 - RNA, 23 nt, Human
uuugcacauagcagacacaugua

SEQ ID NO: 1105611 - RNA, 20 nt, Human
auucagauccugaaggcgaa

SEQ ID NO: 1105612 - RNA, 22 nt, Human
acccuugagaccaucagaugca

SEQ ID NO: 1105613 - RNA, 21 nt, Human
caaaucagcaagacucacuuc

SEQ ID NO: 1105614 - RNA, 21 nt, Human
caccauggugcuggucagaga

SEQ ID NO: 1105615 - RNA, 21 nt, Human
cacuauuugaagucugaacuu

SEQ ID NO: 1105616 - RNA, 22 nt, Human
cagcaagacucacuucaaacac

SEQ ID NO: 1105617 - RNA, 20 nt, Human
cuggugaugagcgucuuucc

SEQ ID NO: 1105618 - RNA, 18 nt, Human
gccauggaaguuaggcag

SEQ ID NO: 1105619 - RNA, 20 nt, Human
gccauggaaguuaggcaguu

SEQ ID NO: 1105620 - RNA, 21 nt, Human
ggucagagagccaaaagggca

SEQ ID NO: 1105621 - RNA, 19 nt, Human
uagaaaauggaucaaccac

SEQ ID NO: 1105622 - RNA, 24 nt, Human
uagaaaauggaucaaccacuuucu

SEQ ID NO: 1105623 - RNA, 22 nt, Human
ucccuggguccuggugaugagc

SEQ ID NO: 1105624 - RNA, 22 nt, Human
ucuucuuggcucccuuuuugcc

SEQ ID NO: 1105625 - RNA, 19 nt, Human
ugaauuuucuaaacgcaac

SEQ ID NO: 1105626 - RNA, 23 nt, Human
uucguaaggugcuuguucuugcc

SEQ ID NO: 1105627 - RNA, 24 nt, Human
uucuucuuggcucccuuuuugccg

SEQ ID NO: 1105628 - RNA, 19 nt, Human
uuugguucccuggguccug

SEQ ID NO: 1105629 - RNA, 25 nt, Human
aaaaacaaaaacaaaaguacuggag

SEQ ID NO: 1105630 - RNA, 23 nt, Human
aaaacaaaaacaaaaguacugga

SEQ ID NO: 1105631 - RNA, 22 nt, Human
aaacaaaaguacuggagguuuc

SEQ ID NO: 1105632 - RNA, 20 nt, Human
acuuugucuucccuuuccau

SEQ ID NO: 1105633 - RNA, 19 nt, Human
agcagaauuguccauugug

SEQ ID NO: 1105634 - RNA, 18 nt, Human
agcccgagaauguggagu

SEQ ID NO: 1105635 - RNA, 24 nt, Human
aggaaacaccaagaagcccgagaa

SEQ ID NO: 1105636 - RNA, 22 nt, Human
aguacuggagguuucaaaggaa

SEQ ID NO: 1105637 - RNA, 21 nt, Human
caaaaacaaaaguacuggagg

SEQ ID NO: 1105638 - RNA, 22 nt, Human
caaaggccgagaucacugggua

SEQ ID NO: 1105639 - RNA, 23 nt, Human
cacuuugucuucccuuuccauga

SEQ ID NO: 1105640 - RNA, 20 nt, Human
ccccaugagguugccucucu

SEQ ID NO: 1105641 - RNA, 20 nt, Human
ccugcaaaggccgagaucac

SEQ ID NO: 1105642 - RNA, 22 nt, Human
cugcaaaggccgagaucacugg

SEQ ID NO: 1105643 - RNA, 26 nt, Human
cuuuacaaucacagguacaaauugcu

SEQ ID NO: 1105644 - RNA, 22 nt, Human
ggaguccuggguccaguuugcc

SEQ ID NO: 1105645 - RNA, 21 nt, Human
uacaaucacagguacaaauug

SEQ ID NO: 1105646 - RNA, 20 nt, Human
uauagaggaaacaccaagaa

SEQ ID NO: 1105647 - RNA, 23 nt, Human
uccaaaaaacaaaaacaaaagua

SEQ ID NO: 1105648 - RNA, 24 nt, Human
uccaaaaaacaaaaacaaaaguac

SEQ ID NO: 1105649 - RNA, 18 nt, Human
uccuggguccaguuugcc

SEQ ID NO: 1105650 - RNA, 19 nt, Human
uccuggucuccugcaaagg

SEQ ID NO: 1105651 - RNA, 21 nt, Human
ucucuggugacauccuggucu

SEQ ID NO: 1105652 - RNA, 19 nt, Human
ugaccuggaugguuugucu

SEQ ID NO: 1105653 - RNA, 22 nt, Human
ugaccuggaugguuugucuguu

SEQ ID NO: 1105654 - RNA, 19 nt, Human
ugcacuuugucuucccuuu

SEQ ID NO: 1105655 - RNA, 19 nt, Human
ugcucaaaucgauaauuuc

SEQ ID NO: 1105656 - RNA, 22 nt, Human
uuccaaaaaacaaaaacaaaag

SEQ ID NO: 1105657 - RNA, 23 nt, Human
uuccaaaaaacaaaaacaaaagu

SEQ ID NO: 1105658 - RNA, 19 nt, Human
uucucuggugacauccugg

SEQ ID NO: 1105659 - RNA, 19 nt, Human
uuugccauucccccaccau

SEQ ID NO: 1105660 - RNA, 21 nt, Human
aucccugucccucccaacccc

SEQ ID NO: 1105661 - RNA, 20 nt, Human
auuuaucccugucccuccca

SEQ ID NO: 1105662 - RNA, 21 nt, Human
ccacugugaccucauuggagu

SEQ ID NO: 1105663 - RNA, 19 nt, Human
cccucccaacccccaggcu

SEQ ID NO: 1105664 - RNA, 20 nt, Human
ccucagagcuccagccacug

SEQ ID NO: 1105665 - RNA, 19 nt, Human
ccuccuggcucagggagcc

SEQ ID NO: 1105666 - RNA, 24 nt, Human
ccuccuggcucagggagccugggc

SEQ ID NO: 1105667 - RNA, 21 nt, Human
cugucccucccaacccccagg

SEQ ID NO: 1105668 - RNA, 22 nt, Human
gaccucauuggaguuggggugg

SEQ ID NO: 1105669 - RNA, 18 nt, Human
gccugggccccucagagc

SEQ ID NO: 1105670 - RNA, 20 nt, Human
gccugggccccucagagcuc

SEQ ID NO: 1105671 - RNA, 23 nt, Human
gggagccugggccccucagagcu

SEQ ID NO: 1105672 - RNA, 18 nt, Human
ucagagcuccagccacug

SEQ ID NO: 1105673 - RNA, 21 nt, Human
ucccaacccccaggcucccaa

SEQ ID NO: 1105674 - RNA, 24 nt, Human
ucccaacccccaggcucccaaguu

SEQ ID NO: 1105675 - RNA, 22 nt, Human
ucccucccaacccccaggcucc

SEQ ID NO: 1105676 - RNA, 18 nt, Human
ugaccucauuggaguugg

SEQ ID NO: 1105677 - RNA, 27 nt, Human
ugccuuuauuuaucccugucccuccca

SEQ ID NO: 1105678 - RNA, 20 nt, Human
ugggccccucagagcuccag

SEQ ID NO: 1105679 - RNA, 19 nt, Human
uuaucccugucccucccaa

SEQ ID NO: 1105680 - RNA, 19 nt, Human
uucccuggaacuauccuga

SEQ ID NO: 1105681 - RNA, 19 nt, Human
aucagcuuaguucaucccu

SEQ ID NO: 1105682 - RNA, 22 nt, Human
cacagcacuugccaucuucuac

SEQ ID NO: 1105683 - RNA, 23 nt, Human
cagaaaucuuuucuuugaagucc

SEQ ID NO: 1105684 - RNA, 18 nt, Human
cccugaacccucaauacc

SEQ ID NO: 1105685 - RNA, 20 nt, Human
cucaauaccuaauauagggc

SEQ ID NO: 1105686 - RNA, 24 nt, Human
uacagccuagagagcaggaaccag

SEQ ID NO: 1105687 - RNA, 18 nt, Human
ucaauaccuaauauaggg

SEQ ID NO: 1105688 - RNA, 23 nt, Human
ucuacagccuagagagcaggaac

SEQ ID NO: 1105689 - RNA, 18 nt, Human
uuaguucaucccugaacc

SEQ ID NO: 1105690 - RNA, 18 nt, Human
uuuuuagaacuuacuaga

SEQ ID NO: 1105691 - RNA, 18 nt, Human
aacagcauggggugcaaa

SEQ ID NO: 1105692 - RNA, 21 nt, Human
aacccuuuguuggaaugcuuu

SEQ ID NO: 1105693 - RNA, 22 nt, Human
aacccuuuguuggaaugcuuuc

SEQ ID NO: 1105694 - RNA, 24 nt, Human
aucuucugccacugccauagcuac

SEQ ID NO: 1105695 - RNA, 28 nt, Human
caacagcauggggugcaaaaaaaaaaaa

SEQ ID NO: 1105696 - RNA, 21 nt, Human
cagggugaagagagacuuuaa

SEQ ID NO: 1105697 - RNA, 24 nt, Human
ccggucacuucucuggcucuccuc

SEQ ID NO: 1105698 - RNA, 20 nt, Human
ccugcuaagcuuuguuuccu

SEQ ID NO: 1105699 - RNA, 21 nt, Human
cggcguccaagggcagaaagg

SEQ ID NO: 1105700 - RNA, 18 nt, Human
cugcuaagcuuuguuucc

SEQ ID NO: 1105701 - RNA, 21 nt, Human
cuuuccacagaacagaaacua

SEQ ID NO: 1105702 - RNA, 20 nt, Human
gaagagagacuuuaacgaug

SEQ ID NO: 1105703 - RNA, 18 nt, Human
gccggucacuucucuggc

SEQ ID NO: 1105704 - RNA, 30 nt, Human
guuguauccuguagcuugccggucacuucc

SEQ ID NO: 1105705 - RNA, 18 nt, Human
uacugcugcugcuggaac

SEQ ID NO: 1105706 - RNA, 18 nt, Human
ucccuucauggguccaca

SEQ ID NO: 1105707 - RNA, 20 nt, Human
ucucuggcucuccucuccug

SEQ ID NO: 1105708 - RNA, 21 nt, Human
ucugccacugccauagcuacu

SEQ ID NO: 1105709 - RNA, 25 nt, Human
ugcaaaguauuggccuccaccgcca

SEQ ID NO: 1105710 - RNA, 20 nt, Human
uggggugcaaaaaaaaaaaa

SEQ ID NO: 1105711 - RNA, 22 nt, Human
uucaaaauuuccucccuucaug

SEQ ID NO: 1105712 - RNA, 25 nt, Human
uucaaaauuuccucccuucaugggu

SEQ ID NO: 1105713 - RNA, 25 nt, Human
uucaaaauuuccucccuucaugggu

SEQ ID NO: 1105714 - RNA, 19 nt, Human
aagagagacuuuaacgaug

SEQ ID NO: 1105715 - RNA, 24 nt, Human
aucuucugccacugccacagcuac
